United States Patent 11,640,849 (METHODS FOR HISTOLOGICAL DIAGNOSIS AND TREATMENT OF DISEASES) - sequence listing, part 19

SEQ ID NO: 736418 - protein, 24 aa, Mycobacterium
TDEISTAVASLFADHAQDYRTISL

SEQ ID NO: 736419 - protein, 25 aa, Mycobacterium
TDEISTAVASLFSGHGQAYQRLANQ

SEQ ID NO: 736420 - protein, 22 aa, Mycobacterium
TDEKAFRRLRGDDVGVKVGPGE

SEQ ID NO: 736421 - protein, 25 aa, Mycobacterium
TDEKGRRFLVQTAKIAYVEIGAADV

SEQ ID NO: 736422 - protein, 24 aa, Mycobacterium
TDEKRAEGFAGWKKAVQRTLDGVD

SEQ ID NO: 736423 - protein, 25 aa, Mycobacterium
TDELCRLDAGLVLTSIGYRGKPIRD

SEQ ID NO: 736424 - protein, 19 aa, Mycobacterium
TDELPLLQARTVRVAGHLL

SEQ ID NO: 736425 - protein, 25 aa, Mycobacterium
TDELSAALRRRIMVIDGAMGTAIQR

SEQ ID NO: 736426 - protein, 26 aa, Mycobacterium
TDELWDLLPGYLIFRSIIPGRPPTRR

SEQ ID NO: 736427 - protein, 22 aa, Mycobacterium
TDENRFTLPFIDEVNARIDEIV

SEQ ID NO: 736428 - protein, 18 aa, Mycobacterium
TDEPGLWLAHDRLGSETE

SEQ ID NO: 736429 - protein, 25 aa, Mycobacterium
TDEPGRLAGVIAFGDRVLRQYLLAD

SEQ ID NO: 736430 - protein, 29 aa, Mycobacterium
TDEPRPGFWQNLVELGWLGLHVDEEYGGS

SEQ ID NO: 736431 - protein, 24 aa, Mycobacterium
TDEQARFAMRMIRRPVHDPARYDR

SEQ ID NO: 736432 - protein, 22 aa, Mycobacterium
TDEQKARWLGPIASGDVVASFA

SEQ ID NO: 736433 - protein, 24 aa, Mycobacterium
TDERGRRFLVHTSKIAYVEIGPAD

SEQ ID NO: 736434 - protein, 22 aa, Mycobacterium
TDERLDQVRSWLADSPGTGVLI

SEQ ID NO: 736435 - protein, 25 aa, Mycobacterium
TDETLELLPLIPLVPKRALQGLGGL

SEQ ID NO: 736436 - protein, 30 aa, Mycobacterium
TDETRWALDLLRRRFAKVIWVPGNHELWTT

SEQ ID NO: 736437 - protein, 24 aa, Mycobacterium
TDEVSAGIAALFEAHGNAYQTLGA

SEQ ID NO: 736438 - protein, 22 aa, Mycobacterium
TDEVVDVVLLWWRDGDGDLVDT

SEQ ID NO: 736439 - protein, 22 aa, Mycobacterium
TDEVVDVVLLWWRDSDGDLVDT

SEQ ID NO: 736440 - protein, 19 aa, Mycobacterium
TDEVVLPFFWQGVSLHAAG

SEQ ID NO: 736441 - protein, 20 aa, Mycobacterium
TDFADDRWMLAIGADGYARA

SEQ ID NO: 736442 - protein, 22 aa, Mycobacterium
TDFAELRPRVVYDRDEGTLTGR

SEQ ID NO: 736443 - protein, 22 aa, Mycobacterium
TDFAHPRFRSVHDATPEFAWGL

SEQ ID NO: 736444 - protein, 35 aa, Mycobacterium
TDFAIGDVVGVAWHIACGTCAQCRINHPARCLRYG

SEQ ID NO: 736445 - protein, 19 aa, Mycobacterium
TDFAPRLLVTHPAEVKIAH

SEQ ID NO: 736446 - protein, 17 aa, Mycobacterium
TDFGWFPDVRAVRLDAG

SEQ ID NO: 736447 - protein, 18 aa, Mycobacterium
TDFLFNLETITGYNNLDE

SEQ ID NO: 736448 - protein, 18 aa, Mycobacterium
TDFLSPRSVRFAATEIDA

SEQ ID NO: 736449 - protein, 24 aa, Mycobacterium
TDFPAETLAALVERGHRIAYDGQG

SEQ ID NO: 736450 - protein, 26 aa, Mycobacterium
TDFPINLTAARLMWWTSPADHSKATR

SEQ ID NO: 736451 - protein, 26 aa, Mycobacterium
TDFRSWARVDLDLEPGRTVFVGPNGF

SEQ ID NO: 736452 - protein, 25 aa, Mycobacterium
TDFRSWSRVELELSPGRTVFVGPNG

SEQ ID NO: 736453 - protein, 17 aa, Mycobacterium
TDFSNFLRKAHALVVAA

SEQ ID NO: 736454 - protein, 22 aa, Mycobacterium
TDFSRPLARVSFDGAPAEALPV

SEQ ID NO: 736455 - protein, 20 aa, Mycobacterium
TDFYLPCLGAASAYDRAVGF

SEQ ID NO: 736456 - protein, 31 aa, Mycobacterium
TDGAFTLNGTRVWCAGAGFCTHALVTARLED

SEQ ID NO: 736457 - protein, 20 aa, Mycobacterium
TDGAGGFRLRGRGWETDGGD

SEQ ID NO: 736458 - protein, 19 aa, Mycobacterium
TDGALYLRMDEFPARLVIV

SEQ ID NO: 736459 - protein, 17 aa, Mycobacterium
TDGCGRDAYALLSRTFL

SEQ ID NO: 736460 - protein, 19 aa, Mycobacterium
TDGCMKLHRAGKVTNTGKG

SEQ ID NO: 736461 - protein, 18 aa, Mycobacterium
TDGDGRWDVRLADADGDG

SEQ ID NO: 736462 - protein, 22 aa, Mycobacterium
TDGDRLRISWHGQTVVDVPPRT

SEQ ID NO: 736463 - protein, 22 aa, Mycobacterium
TDGDRLRITWHGETVVDVPPRT

SEQ ID NO: 736464 - protein, 21 aa, Mycobacterium
TDGDRLRITWHGQTVVDVPPR

SEQ ID NO: 736465 - protein, 24 aa, Mycobacterium
TDGDRLRITWRGETVVDVPPRTVA

SEQ ID NO: 736466 - protein, 28 aa, Mycobacterium
TDGDWPSFPLPLGDTWSSTRGDLLTVEL

SEQ ID NO: 736467 - protein, 22 aa, Mycobacterium
TDGEFSLRARLNVTIPGVDQAT

SEQ ID NO: 736468 - protein, 23 aa, Mycobacterium
TDGEVRQQFSLLFATTVLGGTLA

SEQ ID NO: 736469 - protein, 27 aa, Mycobacterium
TDGFPNCSGRIPFETALLPEVLAENGY

SEQ ID NO: 736470 - protein, 20 aa, Mycobacterium
TDGFRILIRDSPAAITSGTY

SEQ ID NO: 736471 - protein, 20 aa, Mycobacterium
TDGFRILIRDSPPGVSSGTY

SEQ ID NO: 736472 - protein, 25 aa, Mycobacterium
TDGGKAAGSLMSWTHDSAHVGPGVS

SEQ ID NO: 736473 - protein, 17 aa, Mycobacterium
TDGLQIVGRFLALLELF

SEQ ID NO: 736474 - protein, 24 aa, Mycobacterium
TDGLTVWVYRGADWLVPDPHGPHV

SEQ ID NO: 736475 - protein, 18 aa, Mycobacterium
TDGMFLGYYKRPEVTAGV

SEQ ID NO: 736476 - protein, 26 aa, Mycobacterium
TDGNPRPGVEIRLGPDGEIFSRGPDL

SEQ ID NO: 736477 - protein, 21 aa, Mycobacterium
TDGPSALGYLGARTERMLLGS

SEQ ID NO: 736478 - protein, 22 aa, Mycobacterium
TDGPWLGGAALSMAGAATPQIA

SEQ ID NO: 736479 - protein, 17 aa, Mycobacterium
TDGQRIAAASAFGIAGT

SEQ ID NO: 736480 - protein, 24 aa, Mycobacterium
TDGQWDPGKDFAMVTARETAPTQK

SEQ ID NO: 736481 - protein, 21 aa, Mycobacterium
TDGRFTLSFFDGGHFYINEHT

SEQ ID NO: 736482 - protein, 24 aa, Mycobacterium
TDGRIGAKLLRFPAALITTTGRKS

SEQ ID NO: 736483 - protein, 21 aa, Mycobacterium
TDGRLGWNIVTSFNANVYRSF

SEQ ID NO: 736484 - protein, 23 aa, Mycobacterium
TDGRLIIAFGAGYVEAEFDAAGI

SEQ ID NO: 736485 - protein, 23 aa, Mycobacterium
TDGRLVTCIDIAPYTSGDAALSL

SEQ ID NO: 736486 - protein, 23 aa, Mycobacterium
TDGRPPVIQMWARPRGVAPDPLF

SEQ ID NO: 736487 - protein, 17 aa, Mycobacterium
TDGRRWVYLDIGRYGGL

SEQ ID NO: 736488 - protein, 17 aa, Mycobacterium
TDGRTAATFALACAQAG

SEQ ID NO: 736489 - protein, 26 aa, Mycobacterium
TDGRVITGLVLKWLAPGSDSDSSSRY

SEQ ID NO: 736490 - protein, 26 aa, Mycobacterium
TDGRWPRYRTAALDRTPVRSIMSFRL

SEQ ID NO: 736491 - protein, 24 aa, Mycobacterium
TDGSRPVMLWAYDPEAFNGWGKAA

SEQ ID NO: 736492 - protein, 19 aa, Mycobacterium
TDGSVRWDAKVGQGRVYYA

SEQ ID NO: 736493 - protein, 21 aa, Mycobacterium
TDGSYWWSREMTPKMASANSP

SEQ ID NO: 736494 - protein, 24 aa, Mycobacterium
TDGVELRLRIGLNSGEVITGGIGP

SEQ ID NO: 736495 - protein, 28 aa, Mycobacterium
TDGVPRWRKGSGLGWLTAEYAMLPSATH

SEQ ID NO: 736496 - protein, 17 aa, Mycobacterium
TDGVVWTRFGVTQQPAW

SEQ ID NO: 736497 - protein, 25 aa, Mycobacterium
TDHCLRSRHCVNVVVAGKQPALTYL

SEQ ID NO: 736498 - protein, 23 aa, Mycobacterium
TDHGWRHIIRVASFGLINPRPSA

SEQ ID NO: 736499 - protein, 20 aa, Mycobacterium
TDHLPLRRTLGWQGVDAVDA

SEQ ID NO: 736500 - protein, 19 aa, Mycobacterium
TDHLSALGIPTWYARFAAQ

SEQ ID NO: 736501 - protein, 22 aa, Mycobacterium
TDHLVCPLSAPAGAGKTTSMRA

SEQ ID NO: 736502 - protein, 17 aa, Mycobacterium
TDHNGWRITCFATNTRG

SEQ ID NO: 736503 - protein, 20 aa, Mycobacterium
TDHPDRFRAMIVESSNPAHS

SEQ ID NO: 736504 - protein, 23 aa, Mycobacterium
TDHPGVTVLDDWDGMGQRATGTG

SEQ ID NO: 736505 - protein, 25 aa, Mycobacterium
TDHRAVILRAYYRGSSVADISAELG

SEQ ID NO: 736506 - protein, 18 aa, Mycobacterium
TDHRLRLEHAPMLRPDQL

SEQ ID NO: 736507 - protein, 20 aa, Mycobacterium
TDHRPLVAVVLNYVDDTLHH

SEQ ID NO: 736508 - protein, 19 aa, Mycobacterium
TDHSPRLKIANGLSPDRLR

SEQ ID NO: 736509 - protein, 24 aa, Mycobacterium
TDHSPRLRIANGLSPERLREQLDV

SEQ ID NO: 736510 - protein, 24 aa, Mycobacterium
TDHSPRLTIANGLSAERLRRQLDV

SEQ ID NO: 736511 - protein, 21 aa, Mycobacterium
TDHWCAVATNVLGGCRGTTGP

SEQ ID NO: 736512 - protein, 26 aa, Mycobacterium
TDIAEPIAVVGVGCRFPGNVTGPESF

SEQ ID NO: 736513 - protein, 20 aa, Mycobacterium
TDIAGAPAFLGADLFEDDHT

SEQ ID NO: 736514 - protein, 18 aa, Mycobacterium
TDIALGMFNSPSSGYVLT

SEQ ID NO: 736515 - protein, 23 aa, Mycobacterium
TDIDAVLEFRVSEGVLLERLKGR

SEQ ID NO: 736516 - protein, 17 aa, Mycobacterium
TDIDAVLEFRVSQDELL

SEQ ID NO: 736517 - protein, 17 aa, Mycobacterium
TDIGAWVSHPGGPKIID

SEQ ID NO: 736518 - protein, 24 aa, Mycobacterium
TDIGNMWLALRFDGPLQTPALIAA

SEQ ID NO: 736519 - protein, 21 aa, Mycobacterium
TDIKGARVLALLGDSVTTDHI

SEQ ID NO: 736520 - protein, 23 aa, Mycobacterium
TDIKPADLYALLRQAGQNHGPAF

SEQ ID NO: 736521 - protein, 23 aa, Mycobacterium
TDILLRTGAPLLIASGKFLGADK

SEQ ID NO: 736522 - protein, 22 aa, Mycobacterium
TDIPLRAWLFRVADDEHVLVAV

SEQ ID NO: 736523 - protein, 21 aa, Mycobacterium
TDIPMDCHLMIENPERWAPPY

SEQ ID NO: 736524 - protein, 24 aa, Mycobacterium
TDIPRAVAEYGQLVSVLPLRRMLP

SEQ ID NO: 736525 - protein, 26 aa, Mycobacterium
TDIPTPLEWACFTFGVIQSEDHFTFF

SEQ ID NO: 736526 - protein, 23 aa, Mycobacterium
TDIPVTVKFRIGIDDAHHTHLDA

SEQ ID NO: 736527 - protein, 22 aa, Mycobacterium
TDIPVTVKFRIGIDDEHHTHLD

SEQ ID NO: 736528 - protein, 23 aa, Mycobacterium
TDIPVTVKFRIGIDDEHHTHLDA

SEQ ID NO: 736529 - protein, 21 aa, Mycobacterium
TDIQQRLVLQAGYHALEDAGI

SEQ ID NO: 736530 - protein, 19 aa, Mycobacterium
TDIWDKGKAAVIWSETTVT

SEQ ID NO: 736531 - protein, 29 aa, Mycobacterium
TDKGCERIIRFAFDLARTRRVKKVSSVTK

SEQ ID NO: 736532 - protein, 25 aa, Mycobacterium
TDKGPSLQASWTWAPSVFDEDKAAR

SEQ ID NO: 736533 - protein, 22 aa, Mycobacterium
TDKGRALAIAVMRKHRLAERLL

SEQ ID NO: 736534 - protein, 23 aa, Mycobacterium
TDKGRALAIAVMRKHRLAERLLV

SEQ ID NO: 736535 - protein, 27 aa, Mycobacterium
TDKLEIYPNLWAGVGLVRGGAGTALVG

SEQ ID NO: 736536 - protein, 24 aa, Mycobacterium
TDKLPRISSGGVHRRREIGQVGKT

SEQ ID NO: 736537 - protein, 17 aa, Mycobacterium
TDKMAADMAYDFRDVGI

SEQ ID NO: 736538 - protein, 28 aa, Mycobacterium
TDKMWKTSECWRQWINVGDFPDHPWRAY

SEQ ID NO: 736539 - protein, 24 aa, Mycobacterium
TDKPFGVNIAQAFVRDPSIAQFVV

SEQ ID NO: 736540 - protein, 28 aa, Mycobacterium
TDLAAFVARIRPAFLLLQTAFCVGITRA

SEQ ID NO: 736541 - protein, 28 aa, Mycobacterium
TDLAHGWIPAGINLPAGVRLLEPEQRTG

SEQ ID NO: 736542 - protein, 28 aa, Mycobacterium
TDLAHGWIPSGISLPAGVRLLEPGRRGG

SEQ ID NO: 736543 - protein, 21 aa, Mycobacterium
TDLAISCAMWVGMGRMLRTLD

SEQ ID NO: 736544 - protein, 17 aa, Mycobacterium
TDLARIGTTITSANTAA

SEQ ID NO: 736545 - protein, 18 aa, Mycobacterium
TDLATVFHAADLVAVPSY

SEQ ID NO: 736546 - protein, 17 aa, Mycobacterium
TDLCPLCPSTPERPTEI

SEQ ID NO: 736547 - protein, 22 aa, Mycobacterium
TDLDAATAYCRIVVGALAAVAT

SEQ ID NO: 736548 - protein, 25 aa, Mycobacterium
TDLDDEIFCVAALFHDSGTADEYNG

SEQ ID NO: 736549 - protein, 25 aa, Mycobacterium
TDLEAWPRWGLTVAKAEMDGSAFEL

SEQ ID NO: 736550 - protein, 18 aa, Mycobacterium
TDLEFNLFFLLLINAGGD

SEQ ID NO: 736551 - protein, 18 aa, Mycobacterium
TDLELAFFLQLQGGEITA

SEQ ID NO: 736552 - protein, 24 aa, Mycobacterium
TDLELLRDKGFRLLAMTPDPSAAT

SEQ ID NO: 736553 - protein, 24 aa, Mycobacterium
TDLEQRVADFLGFSTVLTSVGQVY

SEQ ID NO: 736554 - protein, 20 aa, Mycobacterium
TDLFCTPDRCPTIVGNTLVF

SEQ ID NO: 736555 - protein, 17 aa, Mycobacterium
TDLFLRRDGDPADRFER

SEQ ID NO: 736556 - protein, 18 aa, Mycobacterium
TDLGIMWDGGEWNGQRFV

SEQ ID NO: 736557 - protein, 21 aa, Mycobacterium
TDLGPLISYAHRDKVAGMVAR

SEQ ID NO: 736558 - protein, 20 aa, Mycobacterium
TDLGRRAVSVGTDITDEAQV

SEQ ID NO: 736559 - protein, 24 aa, Mycobacterium
TDLHRARLALCQATRQVIANGLAI

SEQ ID NO: 736560 - protein, 18 aa, Mycobacterium
TDLIETWISYKRENEIMP

SEQ ID NO: 736561 - protein, 25 aa, Mycobacterium
TDLIRPRPPVSVALTDAQGLVLAED

SEQ ID NO: 736562 - protein, 19 aa, Mycobacterium
TDLKFRVVREDFADAVAWV

SEQ ID NO: 736563 - protein, 35 aa, Mycobacterium; identical to SEQ ID NO: 85040

SEQ ID NO: 736564 - protein, 18 aa, Mycobacterium
TDLLDGWVAYFAEHPRER

SEQ ID NO: 736565 - protein, 18 aa, Mycobacterium
TDLLGPYYEEWCGAVQKK

SEQ ID NO: 736566 - protein, 20 aa, Mycobacterium
TDLLLGLGMDEGFRFFSDHV

SEQ ID NO: 736567 - protein, 17 aa, Mycobacterium
TDLLLRRSVELAKAARD

SEQ ID NO: 736568 - protein, 35 aa, Mycobacterium
TDLLNEAWWFPAIQWPDGRMQFMLNERMMPAQFIV

SEQ ID NO: 736569 - protein, 24 aa, Mycobacterium
TDLLRPIIDLVAARAPRGYDQGNH

SEQ ID NO: 736570 - protein, 17 aa, Mycobacterium
TDLLRWTDAHFGGVNGP

SEQ ID NO: 736571 - protein, 17 aa, Mycobacterium
TDLLYKLLRSDWLEPRW

SEQ ID NO: 736572 - protein, 30 aa, Mycobacterium
TDLLYKLLRSEWLEPRWMIGIDPESEGLAR

SEQ ID NO: 736573 - protein, 17 aa, Mycobacterium
TDLMAINFIGHRHLIDR

SEQ ID NO: 736574 - protein, 23 aa, Mycobacterium
TDLPEDRWTEFLDEPRIAERVKK

SEQ ID NO: 736575 - protein, 31 aa, Mycobacterium
TDLPGELMTALSQGLAQFGINLPPLPTGLLT

SEQ ID NO: 736576 - protein, 19 aa, Mycobacterium
TDLPIGYHRVYLRSHDYET

SEQ ID NO: 736577 - protein, 24 aa, Mycobacterium
TDLPPRARDVAMVFQNYALYPNMT

SEQ ID NO: 736578 - protein, 24 aa, Mycobacterium
TDLPRRAEILAGREIAAPGTDGSQ

SEQ ID NO: 736579 - protein, 21 aa, Mycobacterium
TDLRARLDAALAKPAAQQPSW

SEQ ID NO: 736580 - protein, 18 aa, Mycobacterium
TDLRAWLTTVVSRLGLDK

SEQ ID NO: 736581 - protein, 20 aa, Mycobacterium
TDLRCAQVVPGLLDGLDQPE

SEQ ID NO: 736582 - protein, 23 aa, Mycobacterium
TDLRGLASLGLDGVRLDSPNRAS

SEQ ID NO: 736583 - protein, 17 aa, Mycobacterium
TDLRVLSLLADEIGVDL

SEQ ID NO: 736584 - protein, 30 aa, Mycobacterium
TDLSIPTRMGQWWYYARSFEGKQYGVHCRC

SEQ ID NO: 736585 - protein, 19 aa, Mycobacterium
TDLSMRFDPIYGQITKRWL

SEQ ID NO: 736586 - protein, 24 aa, Mycobacterium
TDLTARIGAPLVVRGIGVRDVSRD

SEQ ID NO: 736587 - protein, 24 aa, Mycobacterium
TDLTFAGGWKEYRSVGYSGSTDDL

SEQ ID NO: 736588 - protein, 19 aa, Mycobacterium
TDLTFKSQVPIPAVLGHEG

SEQ ID NO: 736589 - protein, 26 aa, Mycobacterium
TDLTGRRALLTGGRAKIGMYIALRLL

SEQ ID NO: 736590 - protein, 25 aa, Mycobacterium
TDLVLRLLYRHGLLRDDPEQDPMLA

SEQ ID NO: 736591 - protein, 28 aa, Mycobacterium
TDMAKRAGLPWDCVLSAEIFGHYKPDRE

SEQ ID NO: 736592 - protein, 23 aa, Mycobacterium
TDMANRLKALRERLFGRSAPGAP

SEQ ID NO: 736593 - protein, 24 aa, Mycobacterium
TDMFPTLLRWVGCDIPDDRIIDGI

SEQ ID NO: 736594 - protein, 17 aa, Mycobacterium
TDMPAGVVLVVVHSGGG

SEQ ID NO: 736595 - protein, 31 aa, Mycobacterium
TDMPGVTPAMWSWWFGWHGCDTRRYKLWHPR

SEQ ID NO: 736596 - protein, 31 aa, Mycobacterium
TDMPGVTPAMWVWWFGWHGCDTRRYKLWHPR

SEQ ID NO: 736597 - protein, 17 aa, Mycobacterium
TDMPRGGHFAAFEEPEL

SEQ ID NO: 736598 - protein, 20 aa, Mycobacterium
TDMRDLAPAVARLRHLLDLD

SEQ ID NO: 736599 - protein, 18 aa, Mycobacterium
TDMTAGLDVFKIAPEYAA

SEQ ID NO: 736600 - protein, 19 aa, Mycobacterium
TDNGYKVFVDGGMQITSPT

SEQ ID NO: 736601 - protein, 25 aa, Mycobacterium
TDNLMRFPGKFSEHLLAEHLQKVSL

SEQ ID NO: 736602 - protein, 19 aa, Mycobacterium
TDNLRLVGLHSHIGSQIFD

SEQ ID NO: 736603 - protein, 18 aa, Mycobacterium
TDNPSLKATDTFIIKVAC

SEQ ID NO: 736604 - protein, 22 aa, Mycobacterium
TDNTKLEWARAFGATHTVNARE

SEQ ID NO: 736605 - protein, 25 aa, Mycobacterium
TDPAARPRHKGISIVLVQPGPGLTV

SEQ ID NO: 736606 - protein, 23 aa, Mycobacterium
TDPAGAVARINRIICTRVENRPA

SEQ ID NO: 736607 - protein, 28 aa, Mycobacterium
TDPAGLKGLHDFFKPVLRNLGASARVVV

SEQ ID NO: 736608 - protein, 18 aa, Mycobacterium
TDPAGLKSLHEFFTPLLR

SEQ ID NO: 736609 - protein, 18 aa, Mycobacterium
TDPAMALDESHMHRLETV

SEQ ID NO: 736610 - protein, 19 aa, Mycobacterium
TDPAPLVLWVHGGPLGSWN

SEQ ID NO: 736611 - protein, 23 aa, Mycobacterium
TDPARDWISLRSAMAVASASRQV

SEQ ID NO: 736612 - protein, 22 aa, Mycobacterium
TDPAVAGSWFWVDDQNAHWRPE

SEQ ID NO: 736613 - protein, 19 aa, Mycobacterium
TDPCHKCGGDGRVRARREI

SEQ ID NO: 736614 - protein, 21 aa, Mycobacterium
TDPDFTPGRHGFVGLIDALSG

SEQ ID NO: 736615 - protein, 33 aa, Mycobacterium
TDPDISASLGIQWYRVTFDAEYLTPFEAGVGTL

SEQ ID NO: 736616 - protein, 25 aa, Mycobacterium
TDPDRLRVLLRDVFVAAGGTHDNWD

SEQ ID NO: 736617 - protein, 17 aa, Mycobacterium
TDPEFGLAFDLLSSEQE

SEQ ID NO: 736618 - protein, 22 aa, Mycobacterium
TDPEIVAAVLPKPLEPADEPLV

SEQ ID NO: 736619 - protein, 23 aa, Mycobacterium
TDPEMLSEWFARPHLVETWEQPW

SEQ ID NO: 736620 - protein, 25 aa, Mycobacterium
TDPERVRPCFRLLRSLRDQARDLDL

SEQ ID NO: 736621 - protein, 24 aa, Mycobacterium
TDPFGGVLRDGRIYGRGTSDMKGG

SEQ ID NO: 736622 - protein, 21 aa, Mycobacterium
TDPGLLLALARFGHLPCVVLG

SEQ ID NO: 736623 - protein, 21 aa, Mycobacterium
TDPGLVRWTSLYDMRFVEGPM

SEQ ID NO: 736624 - protein, 21 aa, Mycobacterium
TDPGTICGPVISARQRDRIQG

SEQ ID NO: 736625 - protein, 22 aa, Mycobacterium
TDPGTICGPVISARQRDRIQGY

SEQ ID NO: 736626 - protein, 18 aa, Mycobacterium
TDPGWRLVAKELIMALLA

SEQ ID NO: 736627 - protein, 23 aa, Mycobacterium
TDPLCYVDPYLPIDSFRHRDEAR

SEQ ID NO: 736628 - protein, 23 aa, Mycobacterium
TDPLCYVDPYLPIDSFRRRDEAR

SEQ ID NO: 736629 - protein, 23 aa, Mycobacterium
TDPLCYVDPYLPIESFKRRDEAR

SEQ ID NO: 736630 - protein, 18 aa, Mycobacterium
TDPLPVVLFFHGGGFVMG

SEQ ID NO: 736631 - protein, 17 aa, Mycobacterium
TDPPRLAAMTAAAAQVG

SEQ ID NO: 736632 - protein, 19 aa, Mycobacterium
TDPQLAGGMMFGVMDHVGR

SEQ ID NO: 736633 - protein, 21 aa, Mycobacterium
TDPRAGNAIVGYLNLSPARDA

SEQ ID NO: 736634 - protein, 20 aa, Mycobacterium
TDPRGAVSVTARDVGRWRFV

SEQ ID NO: 736635 - protein, 20 aa, Mycobacterium
TDPRGLLLVADTRGDGLLVY

SEQ ID NO: 736636 - protein, 17 aa, Mycobacterium
TDPRGVVVLAHGYAEHA

SEQ ID NO: 736637 - protein, 21 aa, Mycobacterium
TDPRIKAVGFTGSRAGGMALV

SEQ ID NO: 736638 - protein, 23 aa, Mycobacterium
TDPRMPIELPSAGSEFVPQPDPA

SEQ ID NO: 736639 - protein, 18 aa, Mycobacterium
TDPRRVWRNGIKAFFTAF

SEQ ID NO: 736640 - protein, 22 aa, Mycobacterium
TDPRVRISVYLAAIGSAMNRCS

SEQ ID NO: 736641 - protein, 17 aa, Mycobacterium
TDPSGGVLAAFDGFTVQ

SEQ ID NO: 736642 - protein, 24 aa, Mycobacterium
TDPSPADFDAFLTLLENRGVDVLI

SEQ ID NO: 736643 - protein, 23 aa, Mycobacterium
TDPSRRALATALTHFAREIDAYT

SEQ ID NO: 736644 - protein, 21 aa, Mycobacterium
TDPSWDIKGCYITQIKGDPNI

SEQ ID NO: 736645 - protein, 19 aa, Mycobacterium
TDPSWNIKGCYITQIKGDP

SEQ ID NO: 736646 - protein, 20 aa, Mycobacterium
TDPSWNIKGCYITQIKGDPC

SEQ ID NO: 736647 - protein, 18 aa, Mycobacterium
TDPSYARPLTIEDVPAER

SEQ ID NO: 736648 - protein, 23 aa, Mycobacterium
TDPTLAGQAGGQGGTGETGGAAG

SEQ ID NO: 736649 - protein, 30 aa, Mycobacterium
TDPVLAEWFLRRFSLLDSLYMIPPPRIVGR

SEQ ID NO: 736650 - protein, 24 aa, Mycobacterium
TDPVMLDMLRWHGAEEVEHKAVAF

SEQ ID NO: 736651 - protein, 21 aa, Mycobacterium
TDPVVDCPGAGAALAAVAGRT

SEQ ID NO: 736652 - protein, 18 aa, Mycobacterium
TDQARLRGVAAVFEAAQL

SEQ ID NO: 736653 - protein, 23 aa, Mycobacterium
TDQGEAWWGPYLHKDAGPSWSFL

SEQ ID NO: 736654 - protein, 23 aa, Mycobacterium
TDQGRRPAIVVPLRSATNNLGVI

SEQ ID NO: 736655 - protein, 26 aa, Mycobacterium
TDQLRRVAHEVGFFYLVGHGVPQDLV

SEQ ID NO: 736656 - protein, 25 aa, Mycobacterium
TDQPLDWFCSFSSAAAMLGSPGQGA

SEQ ID NO: 736657 - protein, 28 aa, Mycobacterium
TDQPLDWFCSFSSAAAMLGSPGQGAYAA

SEQ ID NO: 736658 - protein, 21 aa, Mycobacterium
TDQPVEFWSTAAIRAALEGGD

SEQ ID NO: 736659 - protein, 22 aa, Mycobacterium
TDQRFLLGANMAIRTSAWQAVR

SEQ ID NO: 736660 - protein, 27 aa, Mycobacterium
TDQRPDWTAAAIERWYADTAEKQPLPR

SEQ ID NO: 736661 - protein, 17 aa, Mycobacterium
TDQTGVTPMRWIIDQRV

SEQ ID NO: 736662 - protein, 23 aa, Mycobacterium
TDQWRVLRIQSEFVEGFDALAQT

SEQ ID NO: 736663 - protein, 17 aa, Mycobacterium
TDRALAILTARHLDCWV

SEQ ID NO: 736664 - protein, 17 aa, Mycobacterium
TDRALAILTARHLNCWT

SEQ ID NO: 736665 - protein, 23 aa, Mycobacterium
TDRARRRGFRMGRQGADLMTAGA

SEQ ID NO: 736666 - protein, 23 aa, Mycobacterium
TDRARRSVVGAAGFALADGTPIT

SEQ ID NO: 736667 - protein, 23 aa, Mycobacterium
TDRDLAASFVRRAEAAGYKAIVV

SEQ ID NO: 736668 - protein, 32 aa, Mycobacterium
TDRDLALACVRAWNDWHFDVWAGSYPDRIIGC

SEQ ID NO: 736669 - protein, 32 aa, Mycobacterium
TDRDLALASVRAWNDWHLEVWAGSYPERIIPC

SEQ ID NO: 736670 - protein, 24 aa, Mycobacterium
TDRECLRYRLDVIAASALDVVQSA

SEQ ID NO: 736671 - protein, 20 aa, Mycobacterium
TDREIEVLRLLAAGLSNRAI

SEQ ID NO: 736672 - protein, 23 aa, Mycobacterium
TDRELAASLVRRAEAAGFKGIVV

SEQ ID NO: 736673 - protein, 25 aa, Mycobacterium
TDREPWLRRIAEWICEHGRAGTGGV

SEQ ID NO: 736674 - protein, 19 aa, Mycobacterium
TDRFAGLPLTEHVIRTTWP

SEQ ID NO: 736675 - protein, 25 aa, Mycobacterium
TDRFNELVLRAGLTAGQITILRGYA

SEQ ID NO: 736676 - protein, 18 aa, Mycobacterium
TDRGNCFIFGDGAGAVVV

SEQ ID NO: 736677 - protein, 17 aa, Mycobacterium
TDRGWDVEGLFDPDPDA

SEQ ID NO: 736678 - protein, 25 aa, Mycobacterium
TDRGWPIRDLLTGSCREGFKRIHNC

SEQ ID NO: 736679 - protein, 21 aa, Mycobacterium
TDRIDYDLVWAAKRSALELLW

SEQ ID NO: 736680 - protein, 22 aa, Mycobacterium
TDRIPFGVAEMKTAWVTDDPDE

SEQ ID NO: 736681 - protein, 24 aa, Mycobacterium
TDRLAAAPRVCFETAGDLGPGWSA

SEQ ID NO: 736682 - protein, 24 aa, Mycobacterium
TDRLARLGARAVLTGPCEHALGTH

SEQ ID NO: 736683 - protein, 25 aa, Mycobacterium
TDRLDAKPALLRRAIAFIEGNADSD

SEQ ID NO: 736684 - protein, 22 aa, Mycobacterium
TDRLEVATALLAEHETALGELL

SEQ ID NO: 736685 - protein, 24 aa, Mycobacterium
TDRLKDVVKSGGEWISSIDMENAI

SEQ ID NO: 736686 - protein, 24 aa, Mycobacterium
TDRMRPLRIEDHVVQQVWMPYHWG

SEQ ID NO: 736687 - protein, 21 aa, Mycobacterium
TDRPIKVPIMLKRVDREVFTR

SEQ ID NO: 736688 - protein, 23 aa, Mycobacterium
TDRPVYICGPGAFMESAKEALET

SEQ ID NO: 736689 - protein, 26 aa, Mycobacterium
TDRQWRGIGMIPRSGWTLSPQYAEFD

SEQ ID NO: 736690 - protein, 31 aa, Mycobacterium
TDRRAVAVDLRFDWPAALTEAGFDPAEPTAW

SEQ ID NO: 736691 - protein, 21 aa, Mycobacterium
TDRRRGVVVNPVLETSQIPET

SEQ ID NO: 736692 - protein, 24 aa, Mycobacterium
TDRVKDVIKSGGEWISSVDLENAL

SEQ ID NO: 736693 - protein, 18 aa, Mycobacterium
TDRWCAVATNVLGGCRGS

SEQ ID NO: 736694 - protein, 21 aa, Mycobacterium
TDRWCAVATNVLGGCRGSTGP

SEQ ID NO: 736695 - protein, 25 aa, Mycobacterium
TDRYFEAIPGVWARRSSEVAQTVVI

SEQ ID NO: 736696 - protein, 23 aa, Mycobacterium
TDSAAGWERRLRPLGVPAAAVRT

SEQ ID NO: 736697 - protein, 25 aa, Mycobacterium
TDSAELFCPPGIRCEKAAFESHVAY

SEQ ID NO: 736698 - protein, 21 aa, Mycobacterium
TDSATLAGLFARPPIGTPATS

SEQ ID NO: 736699 - protein, 19 aa, Mycobacterium
TDSAVRRYVTDAGPLLARL

SEQ ID NO: 736700 - protein, 19 aa, Mycobacterium
TDSAVRRYVTDAGPLLSRL

SEQ ID NO: 736701 - protein, 19 aa, Mycobacterium
TDSAVRRYVTDAGPLLTRL

SEQ ID NO: 736702 - protein, 17 aa, Mycobacterium
TDSCLQPDLDQFISAAL

SEQ ID NO: 736703 - protein, 23 aa, Mycobacterium
TDSEAKAIIAWHEFAPAAQAGAD

SEQ ID NO: 736704 - protein, 26 aa, Mycobacterium
TDSEAMEAFGLLCRMEGIIPAIESAH

SEQ ID NO: 736705 - protein, 24 aa, Mycobacterium
TDSEAMEAFGLLCRTEGIIPAIES

SEQ ID NO: 736706 - protein, 17 aa, Mycobacterium
TDSELFGRYWPANIHMI

SEQ ID NO: 736707 - protein, 18 aa, Mycobacterium
TDSGFTAFCGHRFDVRQA

SEQ ID NO: 736708 - protein, 17 aa, Mycobacterium
TDSGVALSSRITHGIGE

SEQ ID NO: 736709 - protein, 17 aa, Mycobacterium
TDSGVAVFLVAAADAGV

SEQ ID NO: 736710 - protein, 30 aa, Mycobacterium
TDSGYPRVIKRWRRGTPLSEARTVFEGART

SEQ ID NO: 736711 - protein, 39 aa, Mycobacterium
TDSHCYGIAWRLAVLGLRRGEILALRWDAVDFDAGTLAI

SEQ ID NO: 736712 - protein, 18 aa, Mycobacterium
TDSHFAVSLPVRRDADGC

SEQ ID NO: 736713 - protein, 17 aa, Mycobacterium
TDSIRWDDLGGEHDYEP

SEQ ID NO: 736714 - protein, 26 aa, Mycobacterium
TDSLVAWLPEDRILFTGNLFGPLFGH

SEQ ID NO: 736715 - protein, 32 aa, Mycobacterium
TDSLVVWLPAERICLCGNVFGPLFGHIPNLVT

SEQ ID NO: 736716 - protein, 33 aa, Mycobacterium
TDSLVVWLPDERICLCGNTFGPLFGHIPNLVTM

SEQ ID NO: 736717 - protein, 33 aa, Mycobacterium
TDSLVVWLPDERICLCGNTFGPVFGHVPNLVTI

SEQ ID NO: 736718 - protein, 19 aa, Mycobacterium
TDSMFPPKAFHALVELIEE

SEQ ID NO: 736719 - protein, 21 aa, Mycobacterium
TDSPFPGLTTHAYLWTPANIL

SEQ ID NO: 736720 - protein, 22 aa, Mycobacterium
TDSPGGHWRRIDVVEETGSTNA

SEQ ID NO: 736721 - protein, 20 aa, Mycobacterium
TDSVLRRDRDGQWWYESLSG

SEQ ID NO: 736722 - protein, 29 aa, Mycobacterium
TDSYGGGQLLDWLSRCIFPAEVKLADPAY

SEQ ID NO: 736723 - protein, 25 aa, Mycobacterium
TDTAEDWAVISARLARIPERVENYA

SEQ ID NO: 736724 - protein, 17 aa, Mycobacterium
TDTALPRLVKALQDAGV

SEQ ID NO: 736725 - protein, 24 aa, Mycobacterium
TDTATLLAVRRGRYQVASQGLQGA

SEQ ID NO: 736726 - protein, 21 aa, Mycobacterium
TDTFDLPPRYQHAVQDTAGSV

SEQ ID NO: 736727 - protein, 20 aa, Mycobacterium
TDTGAPLWTFPRAAWDRELL

SEQ ID NO: 736728 - protein, 25 aa, Mycobacterium
TDTGNAKRGFLCQYHLWSYDLEGTL

SEQ ID NO: 736729 - protein, 27 aa, Mycobacterium
TDTGSFRWASARAHRLAARLVEAGVDN

SEQ ID NO: 736730 - protein, 27 aa, Mycobacterium
TDTGSFRWASARALRLAARLVDAGVDN

SEQ ID NO: 736731 - protein, 27 aa, Mycobacterium
TDTGSFRWASARALRLAARLVDTGVDN

SEQ ID NO: 736732 - protein, 33 aa, Mycobacterium
TDTGSFRWASARGYRLAARLVEIGVDNAAVSRT

SEQ ID NO: 736733 - protein, 28 aa, Mycobacterium
TDTGSFRWASPRGLRLAARLVDIGVDNA

SEQ ID NO: 736734 - protein, 27 aa, Mycobacterium
TDTGSFRWATARAHRLAARLVELGVDN

SEQ ID NO: 736735 - protein, 23 aa, Mycobacterium
TDTGWVWKFDPAIFSGSLQGQTP

SEQ ID NO: 736736 - protein, 17 aa, Mycobacterium
TDTIPYQPVGTLWEATA

SEQ ID NO: 736737 - protein, 20 aa, Mycobacterium
TDTKIAWKGDEAVELTSSTE

SEQ ID NO: 736738 - protein, 20 aa, Mycobacterium
TDTKIAWKGEEAVELTSSTE

SEQ ID NO: 736739 - protein, 17 aa, Mycobacterium
TDTRIATAVGRAVATRM

SEQ ID NO: 736740 - protein, 20 aa, Mycobacterium
TDTTIAWKGDEAIELVSSTE

SEQ ID NO: 736741 - protein, 25 aa, Mycobacterium
TDTVAPHQSCLWGFGRAASLELPHV

SEQ ID NO: 736742 - protein, 23 aa, Mycobacterium
TDTWCAISTNVLGGCRGSIGPSS

SEQ ID NO: 736743 - protein, 20 aa, Mycobacterium
TDTWVLWNLTGGHRGGVHVT

SEQ ID NO: 736744 - protein, 24 aa, Mycobacterium
TDVAEWLVRQGVPFRSAHEAAGAA

SEQ ID NO: 736745 - protein, 26 aa, Mycobacterium
TDVAEWLVRRGVPFRVAHEAAGAAVR

SEQ ID NO: 736746 - protein, 24 aa, Mycobacterium
TDVAGPAGRVWVRITGHGTDGARA

SEQ ID NO: 736747 - protein, 29 aa, Mycobacterium
TDVCVRPQPLGAFGLPLGYLLVPAGSDTD

SEQ ID NO: 736748 - protein, 18 aa, Mycobacterium
TDVELRIRCLDQLHRVLV

SEQ ID NO: 736749 - protein, 18 aa, Mycobacterium
TDVFPDWATRHEVPALAA

SEQ ID NO: 736750 - protein, 18 aa, Mycobacterium
TDVFWCTADIGWVTGHTY

SEQ ID NO: 736751 - protein, 23 aa, Mycobacterium
TDVFWCTADIGWVTGHTYGVYGP

SEQ ID NO: 736752 - protein, 25 aa, Mycobacterium
TDVGFRMPSVWLADGHRKVAPVYLY

SEQ ID NO: 736753 - protein, 19 aa, Mycobacterium
TDVGTSWALLPQIYTNNRP

SEQ ID NO: 736754 - protein, 19 aa, Mycobacterium
TDVLADFRGNAVIDGVSRL

SEQ ID NO: 736755 - protein, 20 aa, Mycobacterium
TDVLAGFVLARASAGLVDST

SEQ ID NO: 736756 - protein, 20 aa, Mycobacterium
TDVLLPRRGTLIAWTTQGFP

SEQ ID NO: 736757 - protein, 27 aa, Mycobacterium
TDVLTRLRGMFAFALWDTVTRELFCAR

SEQ ID NO: 736758 - protein, 22 aa, Mycobacterium
TDVPFRNVAIVAHVDHGKTTLV

SEQ ID NO: 736759 - protein, 17 aa, Mycobacterium
TDVPILKLVAAQGAGLD

SEQ ID NO: 736760 - protein, 17 aa, Mycobacterium
TDVPLGIIPAGTGNDHA

SEQ ID NO: 736761 - protein, 17 aa, Mycobacterium
TDVPLQFELVDLTTGTS

SEQ ID NO: 736762 - protein, 22 aa, Mycobacterium
TDVPPYRHVLDAERELKAALQS

SEQ ID NO: 736763 - protein, 20 aa, Mycobacterium
TDVRGGLLFVWHDHEGNPPD

SEQ ID NO: 736764 - protein, 21 aa, Mycobacterium
TDVRGGLLFVWHDHENNPPDP

SEQ ID NO: 736765 - protein, 20 aa, Mycobacterium
TDVRGGLLFVWHDHEQNPPD

SEQ ID NO: 736766 - protein, 26 aa, Mycobacterium
TDVTFASLMPYRFDGGLWWLRARLTT

SEQ ID NO: 736767 - protein, 29 aa, Mycobacterium
TDVVALLRFCLEHGYQLRVIEQMPLDAGH

SEQ ID NO: 736768 - protein, 18 aa, Mycobacterium
TDVVAWAPVVRGGWQTES

SEQ ID NO: 736769 - protein, 17 aa, Mycobacterium
TDVVLRVPIGRRVRVSQ

SEQ ID NO: 736770 - protein, 20 aa, Mycobacterium
TDWDKAAALLHSLVTTQSLA

SEQ ID NO: 736771 - protein, 19 aa, Mycobacterium
TDWMFGIEHVRFVNDVPRG

SEQ ID NO: 736772 - protein, 18 aa, Mycobacterium
TDWRGDPPNDDWSLPPIR

SEQ ID NO: 736773 - protein, 17 aa, Mycobacterium
TDYAKPFSLLVIADLLG

SEQ ID NO: 736774 - protein, 19 aa, Mycobacterium
TDYALFWSLSFAVTADTWR

SEQ ID NO: 736775 - protein, 17 aa, Mycobacterium
TDYCANLSGGQRTRVSL

SEQ ID NO: 736776 - protein, 19 aa, Mycobacterium
TDYCRRTDFELIGRGGVSL

SEQ ID NO: 736777 - protein, 18 aa, Mycobacterium
TDYFSETSFRVFQAPYVG

SEQ ID NO: 736778 - protein, 23 aa, Mycobacterium
TDYLDVYWLHNWDRNTPIEETMR

SEQ ID NO: 736779 - protein, 25 aa, Mycobacterium
TDYPACSARPLAAFVQSCNDLLAGP

SEQ ID NO: 736780 - protein, 20 aa, Mycobacterium
TDYRAILEFFFQIHDPTTKD

SEQ ID NO: 736781 - protein, 21 aa, Mycobacterium
TDYRALLEFFFQIHDPTTKDR

SEQ ID NO: 736782 - protein, 21 aa, Mycobacterium
TDYRALLEFFFQIHDPTTKNR

SEQ ID NO: 736783 - protein, 22 aa, Mycobacterium
TDYRALLEFFFQIHDPTTKNRQ

SEQ ID NO: 736784 - protein, 25 aa, Mycobacterium
TDYVLKAAYWKSARDGLDGRTIDLA

SEQ ID NO: 736785 - protein, 23 aa, Mycobacterium
TDYVRNGYRFQILEIHRNGSIKA

SEQ ID NO: 736786 - protein, 25 aa, Mycobacterium
TEAAELHEIYKLGVVPIPTNKPMIR

SEQ ID NO: 736787 - protein, 25 aa, Mycobacterium
TEAAELHEIYKLGVVPIPTNKPMVR

SEQ ID NO: 736788 - protein, 25 aa, Mycobacterium
TEAAELHEIYKLGVVPIPTNRPMIR

SEQ ID NO: 736789 - protein, 28 aa, Mycobacterium
TEAAHGRRLLRIAASSAFAEHAAPGLIE

SEQ ID NO: 736790 - protein, 24 aa, Mycobacterium
TEAAHGRRLLRIAASSTFAEHAAP

SEQ ID NO: 736791 - protein, 24 aa, Mycobacterium
TEAAHGRRLLRIAASTTFAEHAAP

SEQ ID NO: 736792 - protein, 25 aa, Mycobacterium
TEAAPPARAPMWWRPDGRVPDDPVL

SEQ ID NO: 736793 - protein, 25 aa, Mycobacterium
TEAARASGIPVFYALHRRYRPGDYE

SEQ ID NO: 736794 - protein, 18 aa, Mycobacterium
TEAARFDAAPSYRTFHQL

SEQ ID NO: 736795 - protein, 24 aa, Mycobacterium
TEAARNPSRFMAMEGAFIDEHPDR

SEQ ID NO: 736796 - protein, 24 aa, Mycobacterium
TEACGDCPRVVLGSPLAGESLDEV

SEQ ID NO: 736797 - protein, 22 aa, Mycobacterium
TEACGISRAGFYTYFKDKREIF

SEQ ID NO: 736798 - protein, 18 aa, Mycobacterium
TEADILHRGPGAFHAALN

SEQ ID NO: 736799 - protein, 23 aa, Mycobacterium
TEAELDQLIGFFVNILVLRNDLT

SEQ ID NO: 736800 - protein, 28 aa, Mycobacterium
TEAELRSGATVYRYHRDDCLPGGEGGFH

SEQ ID NO: 736801 - protein, 21 aa, Mycobacterium
TEAFFSLVSGAGWSVQHGRVA

SEQ ID NO: 736802 - protein, 24 aa, Mycobacterium
TEAFFSLVSGAGWSVQHGRVARRE

SEQ ID NO: 736803 - protein, 24 aa, Mycobacterium
TEAFGAEVDRPWAVAELLLHQLMP

SEQ ID NO: 736804 - protein, 18 aa, Mycobacterium
TEAFGRFAAHHAPVSETR

SEQ ID NO: 736805 - protein, 26 aa, Mycobacterium
TEAFKPKNVRRLEGWIRGHAHDLVSE

SEQ ID NO: 736806 - protein, 30 aa, Mycobacterium
TEAFLLKRLEALGGKVIRPATVTSVTQHGT

SEQ ID NO: 736807 - protein, 17 aa, Mycobacterium
TEAFPLTVKGVADDGVP

SEQ ID NO: 736808 - protein, 17 aa, Mycobacterium
TEAGADGFLAWRAARCV

SEQ ID NO: 736809 - protein, 24 aa, Mycobacterium
TEAGEGRPARTPRRGGGRGQQRPT

SEQ ID NO: 736810 - protein, 22 aa, Mycobacterium
TEAGGLPGTGGVPAEDDELAGG

SEQ ID NO: 736811 - protein, 20 aa, Mycobacterium
TEAGIPVIVVPGVTSAIAVP

SEQ ID NO: 736812 - protein, 24 aa, Mycobacterium
TEAGLPPGRAWLLVEMGGADRASA

SEQ ID NO: 736813 - protein, 24 aa, Mycobacterium
TEAGPQLQATWTWAPSALDEEQIQ

SEQ ID NO: 736814 - protein, 25 aa, Mycobacterium
TEAGRAARIAKFWAAEAGARVAATA

SEQ ID NO: 736815 - protein, 29 aa, Mycobacterium
TEAGREIRDGFVVGAGYRELMTVDYSQIE

SEQ ID NO: 736816 - protein, 26 aa, Mycobacterium
TEAGRRAALEMVRRHRLLETFLVNEL

SEQ ID NO: 736817 - protein, 25 aa, Mycobacterium
TEAGRRIRDAFVVGDGYGELMTADY

SEQ ID NO: 736818 - protein, 25 aa, Mycobacterium
TEAGRRIRDAFVVGEGYAELMTADY

SEQ ID NO: 736819 - protein, 23 aa, Mycobacterium
TEAHRRRRVAVALATAPNTALAL

SEQ ID NO: 736820 - protein, 20 aa, Mycobacterium
TEAIKRVALVADRGAQIRME

SEQ ID NO: 736821 - protein, 20 aa, Mycobacterium
TEAIKRVALVADRGAQVRME

SEQ ID NO: 736822 - protein, 20 aa, Mycobacterium
TEAINLVAYVLGDKRFERAV

SEQ ID NO: 736823 - protein, 23 aa, Mycobacterium
TEAISGMNAVAGWPSAPRPVSAR

SEQ ID NO: 736824 - protein, 21 aa, Mycobacterium
TEAITTHGGWVIKNVGDEVMF

SEQ ID NO: 736825 - protein, 20 aa, Mycobacterium
TEAIWEMPPFTGWYQGGPSI

SEQ ID NO: 736826 - protein, 22 aa, Mycobacterium
TEAKTLVAICAIDNLTKGTGGA

SEQ ID NO: 736827 - protein, 21 aa, Mycobacterium
TEALAWYDHWLKGRDTGITDG

SEQ ID NO: 736828 - protein, 23 aa, Mycobacterium
TEALEHFVDLVARVEAAAAKASC

SEQ ID NO: 736829 - protein, 26 aa, Mycobacterium
TEALERARRALAEFQVEGLATVIPFH

SEQ ID NO: 736830 - protein, 25 aa, Mycobacterium
TEALIGAMLYRIFNRAKTVDETIKV

SEQ ID NO: 736831 - protein, 18 aa, Mycobacterium
TEALIPRMPAGSAVASVA

SEQ ID NO: 736832 - protein, 19 aa, Mycobacterium
TEALLTLAAVQKLGDAYDT

SEQ ID NO: 736833 - protein, 18 aa, Mycobacterium
TEALPVFRQRWLLCEQPT

SEQ ID NO: 736834 - protein, 20 aa, Mycobacterium
TEALRAGGFRHHTKVDIKWV

SEQ ID NO: 736835 - protein, 25 aa, Mycobacterium
TEALRCLKRRLARVVFHHLHTDHLN

SEQ ID NO: 736836 - protein, 20 aa, Mycobacterium
TEALSGLGLLANPVSAVATI

SEQ ID NO: 736837 - protein, 21 aa, Mycobacterium
TEALTNWYVRRSRARFWEEDP

SEQ ID NO: 736838 - protein, 22 aa, Mycobacterium
TEALTNWYVRRSRLRFWEEDGD

SEQ ID NO: 736839 - protein, 25 aa, Mycobacterium
TEALTNWYVRRSRSRFWAEDVDAID

SEQ ID NO: 736840 - protein, 22 aa, Mycobacterium
TEALTNWYVRRSRSRFWDEDAD

SEQ ID NO: 736841 - protein, 29 aa, Mycobacterium
TEAPAEMHFYFPKFRALCMAENATHNLHN

SEQ ID NO: 736842 - protein, 30 aa, Mycobacterium
TEAPAEMHFYFPKFRALCMAENATHNLHNL

SEQ ID NO: 736843 - protein, 31 aa, Mycobacterium
TEAPAEMHFYFPRFCALCMAENATHNLHNLL

SEQ ID NO: 736844 - protein, 24 aa, Mycobacterium
TEAPARLLFERSLGMLDTTVGNVL

SEQ ID NO: 736845 - protein, 21 aa, Mycobacterium
TEAPRRLMFERAVGSIDATVG

SEQ ID NO: 736846 - protein, 21 aa, Mycobacterium
TEAQADWARRVLAAAQAERGV

SEQ ID NO: 736847 - protein, 23 aa, Mycobacterium
TEARKRGATAFAVTEEANNRFFE

SEQ ID NO: 736848 - protein, 21 aa, Mycobacterium
TEARLTPLAMEMLREIDEETV

SEQ ID NO: 736849 - protein, 21 aa, Mycobacterium
TEARRMAPMVVEYVEEEPTPR

SEQ ID NO: 736850 - protein, 21 aa, Mycobacterium
TEARRMAPMVVEYVEETGPRT

SEQ ID NO: 736851 - protein, 29 aa, Mycobacterium
TEARRPIEWRTRTPLELIVHVRGEDRFDM

SEQ ID NO: 736852 - protein, 23 aa, Mycobacterium
TEARSWLYPSRHLVTTLGDEGSR

SEQ ID NO: 736853 - protein, 26 aa, Mycobacterium
TEASQFYLHFCVHRLAIDSGELSSLV

SEQ ID NO: 736854 - protein, 23 aa, Mycobacterium
TEATFCFPEVSIGVPTIVGAIRL

SEQ ID NO: 736855 - protein, 22 aa, Mycobacterium
TEATFCYPEVAIGVPTIVGAIR

SEQ ID NO: 736856 - protein, 19 aa, Mycobacterium
TEATVPWLVSARSRAALAG

SEQ ID NO: 736857 - protein, 23 aa, Mycobacterium
TEAVAAFARLWVAEEHWAAADKV

SEQ ID NO: 736858 - protein, 23 aa, Mycobacterium
TEAVAAFARLWVSDEHWAAADKV

SEQ ID NO: 736859 - protein, 17 aa, Mycobacterium
TEAVALLRRKRALQPPS

SEQ ID NO: 736860 - protein, 23 aa, Mycobacterium
TEAYKHLKAVGAFGAGVKLLPKA

SEQ ID NO: 736861 - protein, 23 aa, Mycobacterium
TEAYKHLKPIGAYGAGVDLLRTA

SEQ ID NO: 736862 - protein, 20 aa, Mycobacterium
TEAYLRHGVEKGYLRADLDT

SEQ ID NO: 736863 - protein, 24 aa, Mycobacterium
TECADRFDVVQAFTDEALTTCGKC

SEQ ID NO: 736864 - protein, 22 aa, Mycobacterium
TECARCAAPGPHRAFHVAAGGS

SEQ ID NO: 736865 - protein, 25 aa, Mycobacterium
TECDNRFDAVQAFSDDALTTCPKCS

SEQ ID NO: 736866 - protein, 18 aa, Mycobacterium
TECGALLMHRTRSSALMM

SEQ ID NO: 736867 - protein, 22 aa, Mycobacterium
TECRLRPLTLVEVDFTLAVLAG

SEQ ID NO: 736868 - protein, 31 aa, Mycobacterium
TECRRLRPDFATGLAPLRWGTGFMLGSNRFG

SEQ ID NO: 736869 - protein, 24 aa, Mycobacterium
TECSNKFDVVQAFTDDSLTECPQC

SEQ ID NO: 736870 - protein, 21 aa, Mycobacterium
TECSNRFDVVQSFTDDSLTTC

SEQ ID NO: 736871 - protein, 22 aa, Mycobacterium
TEDARVGKSLVVQLKYGPSRER

SEQ ID NO: 736872 - protein, 31 aa, Mycobacterium
TEDENWVWAGAAVLRPDFQRALVSLSRGGSD

SEQ ID NO: 736873 - protein, 18 aa, Mycobacterium
TEDFPIPRRMIHTTCDAE

SEQ ID NO: 736874 - protein, 21 aa, Mycobacterium
TEDIELSKKVARMSESQLASE

SEQ ID NO: 736875 - protein, 42 aa, Mycobacterium
TEDIGPRSIASFVIPRQSVTVIGIDLLYLGPITIPQINITGP

SEQ ID NO: 736876 - protein, 18 aa, Mycobacterium
TEDIGYRAALTSLARGRV

SEQ ID NO: 736877 - protein, 26 aa, Mycobacterium
TEDILPKEVLEKLTPEYVAPVVAYLC

SEQ ID NO: 736878 - protein, 20 aa, Mycobacterium
TEDLIETWISYKRENEIMPI

SEQ ID NO: 736879 - protein, 23 aa, Mycobacterium
TEDNRSSAFLGFTNQYAAANYIY

SEQ ID NO: 736880 - protein, 24 aa, Mycobacterium
TEDPALVGMPKWYAENGQYLTTQF

SEQ ID NO: 736881 - protein, 25 aa, Mycobacterium
TEDPALVGMPRWYAENGQYLTTKFF

SEQ ID NO: 736882 - protein, 25 aa, Mycobacterium
TEDPALVGMPRWYAENGQYLTTQFF

SEQ ID NO: 736883 - protein, 23 aa, Mycobacterium
TEDPGLVGMPSWYAENGQYLTTQ

SEQ ID NO: 736884 - protein, 19 aa, Mycobacterium
TEDPHLWARTLFDELEELG

SEQ ID NO: 736885 - protein, 19 aa, Mycobacterium
TEDPHLWARTLFDELEGLG

SEQ ID NO: 736886 - protein, 25 aa, Mycobacterium
TEDQARGTVRFSLGPGVSPADVDTV

SEQ ID NO: 736887 - protein, 26 aa, Mycobacterium
TEDQEVWRYFASVAFPSEPLVRNVLA

SEQ ID NO: 736888 - protein, 25 aa, Mycobacterium
TEDQHLRAAKVLSLAQDTADRLTSS

SEQ ID NO: 736889 - protein, 29 aa, Mycobacterium
TEDQPAWSYAGLALRWSERYYAAERELAL

SEQ ID NO: 736890 - protein, 24 aa, Mycobacterium
TEDQRLRFLPPIVRNEEKWCQLFS

SEQ ID NO: 736891 - protein, 22 aa, Mycobacterium
TEDQWWERSPIFSGLNTNKRGI

SEQ ID NO: 736892 - protein, 26 aa, Mycobacterium
TEDVMLRLRLRRGLALDDLAADERAR

SEQ ID NO: 736893 - protein, 21 aa, Mycobacterium
TEEAMRLVIARELAKSHHERS

SEQ ID NO: 736894 - protein, 18 aa, Mycobacterium
TEECADNASVFIVGGGKV

SEQ ID NO: 736895 - protein, 18 aa, Mycobacterium
TEECADNGSVFIVGGGKV

SEQ ID NO: 736896 - protein, 17 aa, Mycobacterium
TEECRKLGLAFAADPSQ

SEQ ID NO: 736897 - protein, 19 aa, Mycobacterium
TEEELRVLLTPMAASGNEP

SEQ ID NO: 736898 - protein, 25 aa, Mycobacterium
TEEGPRLHANWTWAPSALDREQVTR

SEQ ID NO: 736899 - protein, 22 aa, Mycobacterium
TEEILLELDVDWDDIAKAKELG

SEQ ID NO: 736900 - protein, 18 aa, Mycobacterium
TEEITDWQLAANAEHSST

SEQ ID NO: 736901 - protein, 18 aa, Mycobacterium
TEEITDWQLAANAEHTST

SEQ ID NO: 736902 - protein, 18 aa, Mycobacterium
TEEITDWQLASNAEHSST

SEQ ID NO: 736903 - protein, 18 aa, Mycobacterium
TEELARGWMSLAGAMGGH

SEQ ID NO: 736904 - protein, 28 aa, Mycobacterium
TEELPVRLAWSLSTARPVYIGEDAPALL

SEQ ID NO: 736905 - protein, 18 aa, Mycobacterium
TEELTAWAGRIHADVGDS

SEQ ID NO: 736906 - protein, 17 aa, Mycobacterium
TEELVAFAERVGADGDS

SEQ ID NO: 736907 - protein, 28 aa, Mycobacterium
TEEMPIKVPWSLPAARPAHTGDPAEVLL

SEQ ID NO: 736908 - protein, 28 aa, Mycobacterium
TEEMPVKVPWSLPSARPAYDGEDAPVLL

SEQ ID NO: 736909 - protein, 24 aa, Mycobacterium
TEEQKAKFLPAILKGTVDFAIGYS

SEQ ID NO: 736910 - protein, 28 aa, Mycobacterium
TEEQKHRWAVPVLRGEKTASLGMSEPSA

SEQ ID NO: 736911 - protein, 27 aa, Mycobacterium
TEEQKKWAVLAAERGWGSTMVLTEPDA

SEQ ID NO: 736912 - protein, 28 aa, Mycobacterium
TEEQKKWAVLAAERGWGSTMVLTEPDAG

SEQ ID NO: 736913 - protein, 27 aa, Mycobacterium
TEEQKQRWAVPILRADKTASLGMSEPG

SEQ ID NO: 736914 - protein, 18 aa, Mycobacterium
TEESRFMSMCEARQLPAV

SEQ ID NO: 736915 - protein, 18 aa, Mycobacterium
TEEVHVAKVPDHTPGEHP

SEQ ID NO: 736916 - protein, 23 aa, Mycobacterium
TEEVLMEAGLDWDTIATYKETGA

SEQ ID NO: 736917 - protein, 20 aa, Mycobacterium
TEFAAGVIDYPAHPKVVDVM

SEQ ID NO: 736918 - protein, 24 aa, Mycobacterium
TEFAANAAEGWAMASASVRDLFAE

SEQ ID NO: 736919 - protein, 24 aa, Mycobacterium
TEFAANAAEGWAMATASVRDLFAE

SEQ ID NO: 736920 - protein, 25 aa, Mycobacterium
TEFACGHCGWRYGLDGSLIAAPDAD

SEQ ID NO: 736921 - protein, 24 aa, Mycobacterium
TEFAELRPRLVYDRDTGTLTARPG

SEQ ID NO: 736922 - protein, 23 aa, Mycobacterium
TEFAELRPRLVYDRGTGTLTARP

SEQ ID NO: 736923 - protein, 17 aa, Mycobacterium
TEFARRGAAVVLADVDQ

SEQ ID NO: 736924 - protein, 25 aa, Mycobacterium
TEFARTGFTGGLNWYRNFDRNWALT

SEQ ID NO: 736925 - protein, 24 aa, Mycobacterium
TEFASNAAEGWAMATASVRDLFAE

SEQ ID NO: 736926 - protein, 21 aa, Mycobacterium
TEFCRERLAAFEIPATFELAS

SEQ ID NO: 736927 - protein, 25 aa, Mycobacterium
TEFDISQALRAHGWQVPAYTMPEGA

SEQ ID NO: 736928 - protein, 17 aa, Mycobacterium
TEFGAAIAAAADFRRPN

SEQ ID NO: 736929 - protein, 17 aa, Mycobacterium
TEFKTGPKVIGVANITD

SEQ ID NO: 736930 - protein, 23 aa, Mycobacterium
TEFLREMIEQLGLTNVSVVRGRA

SEQ ID NO: 736931 - protein, 27 aa, Mycobacterium
TEFMPVVWAMFEWGRKHLDDTSLRLTH

SEQ ID NO: 736932 - protein, 22 aa, Mycobacterium
TEFSGGAAWVFEDRKSLPLTVV

SEQ ID NO: 736933 - protein, 18 aa, Mycobacterium
TEFVAWINGHPDFADLPV

SEQ ID NO: 736934 - protein, 19 aa, Mycobacterium
TEGALYLRMDDFPARLVIV

SEQ ID NO: 736935 - protein, 26 aa, Mycobacterium
TEGAPGVGVAPGWFSTSGNQIVDSAG

SEQ ID NO: 736936 - protein, 24 aa, Mycobacterium
TEGARIPVTVKFRVGIDDEHHTHL

SEQ ID NO: 736937 - protein, 24 aa, Mycobacterium
TEGDNVFVALSWSKHPAPQTYEEA

SEQ ID NO: 736938 - protein, 24 aa, Mycobacterium
TEGDNVFVALSWSKHPVPQTYAEA

SEQ ID NO: 736939 - protein, 21 aa, Mycobacterium
TEGDRLRITWHGETVVDVPPR

SEQ ID NO: 736940 - protein, 21 aa, Mycobacterium
TEGFRPATLHQAYLALQAWGL

SEQ ID NO: 736941 - protein, 30 aa, Mycobacterium; identical to SEQ ID NO: 105047

SEQ ID NO: 736942 - protein, 22 aa, Mycobacterium
TEGGTRLRWRQGVTKPMRLNLA

SEQ ID NO: 736943 - protein, 22 aa, Mycobacterium
TEGILRARNVVVAGGLQPLLPP

SEQ ID NO: 736944 - protein, 25 aa, Mycobacterium
TEGILRYSRDLAFGAASAYAEAAET

SEQ ID NO: 736945 - protein, 20 aa, Mycobacterium
TEGKAVLEFAVIQTDKGEAV

SEQ ID NO: 736946 - protein, 24 aa, Mycobacterium
TEGKEVAGRLAARLGSGLLTDVVE

SEQ ID NO: 736947 - protein, 21 aa, Mycobacterium
TEGLETFAYERDRLAVLAPSR

SEQ ID NO: 736948 - protein, 25 aa, Mycobacterium
TEGLRKNALFPFVDFIRALSEEQVF

SEQ ID NO: 736949 - protein, 17 aa, Mycobacterium
TEGLWRITVFAEEADAA

SEQ ID NO: 736950 - protein, 18 aa, Mycobacterium
TEGLYRFDGQPAYSLGQG

SEQ ID NO: 736951 - protein, 28 aa, Mycobacterium
TEGPGIVGLLAMRIAHELGIVDSVSRSR

SEQ ID NO: 736952 - protein, 17 aa, Mycobacterium
TEGQGFIQLMTQLPQER

SEQ ID NO: 736953 - protein, 22 aa, Mycobacterium
TEGRLRRLDCSQMTDGGAGLVL

SEQ ID NO: 736954 - protein, 20 aa, Mycobacterium
TEGRSGADLAHICNTATQFA

SEQ ID NO: 736955 - protein, 23 aa, Mycobacterium
TEGSGFDWTGWVTAVGTTPAAVA

SEQ ID NO: 736956 - protein, 18 aa, Mycobacterium
TEGVLKLQIPVAEKAKPR

SEQ ID NO: 736957 - protein, 28 aa, Mycobacterium
TEGVPRWRKGSGLGWLTAEYAMLPASTH

SEQ ID NO: 736958 - protein, 28 aa, Mycobacterium
TEGVPRWRKGSGVGWLTAEYAMLPSATH

SEQ ID NO: 736959 - protein, 30 aa, Mycobacterium
TEGVSMDWPKAFAGLGARPVELPTYGFARQ

SEQ ID NO: 736960 - protein, 26 aa, Mycobacterium
TEGVVPACESYDCVTIFAPSLTTANA

SEQ ID NO: 736961 - protein, 23 aa, Mycobacterium
TEGVYNCRACGAELFRSTEKFES

SEQ ID NO: 736962 - protein, 23 aa, Mycobacterium
TEGVYQCRACGAELFRSSEKFES

SEQ ID NO: 736963 - protein, 23 aa, Mycobacterium
TEGYDLGTILLKGIDSGAITRAD

SEQ ID NO: 736964 - protein, 26 aa, Mycobacterium
TEHAEFIRWRVEQLVATDALIGQQLQ

SEQ ID NO: 736965 - protein, 25 aa, Mycobacterium
TEHARAVLGEAVFLAPEHKVVLNTD

SEQ ID NO: 736966 - protein, 17 aa, Mycobacterium
TEHCRKEAGLVRIGEQA

SEQ ID NO: 736967 - protein, 19 aa, Mycobacterium
TEHCRKELGLVEGRNQLEQ

SEQ ID NO: 736968 - protein, 24 aa, Mycobacterium
TEHGADFTWAWAIDGTGPIRNATP

SEQ ID NO: 736969 - protein, 17 aa, Mycobacterium
TEHGLAGARLNRIAINA

SEQ ID NO: 736970 - protein, 17 aa, Mycobacterium
TEHGRPIARLVPITDDP

SEQ ID NO: 736971 - protein, 23 aa, Mycobacterium
TEHGWQWEAFPLALEVSLHETWD

SEQ ID NO: 736972 - protein, 23 aa, Mycobacterium
TEHHPERYFEMFIAEQQLVASSV

SEQ ID NO: 736973 - protein, 17 aa, Mycobacterium
TEHHYGVFHGREAVREW

SEQ ID NO: 736974 - protein, 24 aa, Mycobacterium
TEHLPDIRVPTVFTHGTSDPFGTP

SEQ ID NO: 736975 - protein, 20 aa, Mycobacterium
TEHLPDITVPTVFTHGTSDP

SEQ ID NO: 736976 - protein, 21 aa, Mycobacterium
TEHLPSITVPTVFTHGSSDPF

SEQ ID NO: 736977 - protein, 23 aa, Mycobacterium
TEHLVDAAHYWSRTADLWEDVFL

SEQ ID NO: 736978 - protein, 24 aa, Mycobacterium
TEHPEMARFLITMTEPAVHRAAAD

SEQ ID NO: 736979 - protein, 21 aa, Mycobacterium
TEHPGGYGWEYVEKGPEVWRI

SEQ ID NO: 736980 - protein, 20 aa, Mycobacterium
TEHRGQVAAMILEPVMMNAG

SEQ ID NO: 736981 - protein, 23 aa, Mycobacterium
TEHRVFLNLLRKRFETDKDKWTK

SEQ ID NO: 736982 - protein, 19 aa, Mycobacterium
TEHRVPIDVLRGALADAKS

SEQ ID NO: 736983 - protein, 19 aa, Mycobacterium
TEHVGPFVIDPSVINPQSP

SEQ ID NO: 736984 - protein, 27 aa, Mycobacterium
TEIAQTVARWLVLYLRRPGGQTQFAAP

SEQ ID NO: 736985 - protein, 21 aa, Mycobacterium
TEIAYILVLETTFPNGFVATV

SEQ ID NO: 736986 - protein, 23 aa, Mycobacterium
TEIAYILVLHTRFPNGFTATVRG

SEQ ID NO: 736987 - protein, 25 aa, Mycobacterium
TEIDNWRWAGVPIFLRAGKALPERV

SEQ ID NO: 736988 - protein, 26 aa, Mycobacterium
TEIDNWRWAGVPVFLRAGKALPERVT

SEQ ID NO: 736989 - protein, 17 aa, Mycobacterium
TEIDTVLGLTVGADDYI

SEQ ID NO: 736990 - protein, 24 aa, Mycobacterium
TEIDVPGVLSVRVVPGTPAAETQA

SEQ ID NO: 736991 - protein, 24 aa, Mycobacterium
TEIDVPVLWVFTARTGAGGQAVQE

SEQ ID NO: 736992 - protein, 20 aa, Mycobacterium
TEIEGAWKPDQYSNQMGPES

SEQ ID NO: 736993 - protein, 18 aa, Mycobacterium
TEIFPGGRLPSIDMVAER

SEQ ID NO: 736994 - protein, 17 aa, Mycobacterium
TEIGFSHIVFKPGTVEQ

SEQ ID NO: 736995 - protein, 22 aa, Mycobacterium
TEIKRCNRCGYLHECNTPTNVE

SEQ ID NO: 736996 - protein, 30 aa, Mycobacterium
TEILAYAAEVWRLVSPIAQRLGFAIDELAD

SEQ ID NO: 736997 - protein, 26 aa, Mycobacterium
TEILPRLATYPRIRIWIAGCATGEEA

SEQ ID NO: 736998 - protein, 19 aa, Mycobacterium
TEILRLQRKLGVTTVYVTH

SEQ ID NO: 736999 - protein, 19 aa, Mycobacterium
TEILRRRIEQIDRDRGHQP

SEQ ID NO: 737000 - protein, 22 aa, Mycobacterium
TEIMTKLWVDRPYKVSSVDLGA

SEQ ID NO: 737001 - protein, 21 aa, Mycobacterium
TEIQFCPIIAISAPSFEELED

SEQ ID NO: 737002 - protein, 17 aa, Mycobacterium
TEIQIEQLLAEQGDGGA

SEQ ID NO: 737003 - protein, 18 aa, Mycobacterium
TEIRRVVQVLSRRTKNNP

SEQ ID NO: 737004 - protein, 20 aa, Mycobacterium
TEIRTFSGLIERFGTGKGCD

SEQ ID NO: 737005 - protein, 17 aa, Mycobacterium
TEIRWDPSDSRWVIATN

SEQ ID NO: 737006 - protein, 22 aa, Mycobacterium
TEISNLLLMRGMIGKPGAGLCP

SEQ ID NO: 737007 - protein, 29 aa, Mycobacterium
TEIVLAPFKIPAIPLDFPALSGTVGPIQM

SEQ ID NO: 737008 - protein, 24 aa, Mycobacterium
TEIVLMELGMDWDRIAELKDSGAI

SEQ ID NO: 737009 - protein, 22 aa, Mycobacterium
TEIWDKGKAAVIVSETTVTDPS

SEQ ID NO: 737010 - protein, 23 aa, Mycobacterium
TEIWDKGKAAVIWSETEVKDPDG

SEQ ID NO: 737011 - protein, 17 aa, Mycobacterium
TEIWECLNTTYNALAER

SEQ ID NO: 737012 - protein, 20 aa, Mycobacterium
TEIWEIVRRIIPQALADADV

SEQ ID NO: 737013 - protein, 17 aa, Mycobacterium
TEIWTDRVRVLAADSGR

SEQ ID NO: 737014 - protein, 23 aa, Mycobacterium
TEKDFRAPFAPKGRFEGLMIEHL

SEQ ID NO: 737015 - protein, 27 aa, Mycobacterium
TEKGFIFKCEACLAVVKLGLEAIIVKA

SEQ ID NO: 737016 - protein, 25 aa, Mycobacterium
TEKGRLKVGPDLQVPGFDGVFAGGD

SEQ ID NO: 737017 - protein, 18 aa, Mycobacterium
TEKLPVLPVLEGLFVGNA

SEQ ID NO: 737018 - protein, 25 aa, Mycobacterium
TEKLVKRMSEFTLGKGLDPSSTLGP

SEQ ID NO: 737019 - protein, 21 aa, Mycobacterium
TEKNFKWIAKSADGWITTPRD

SEQ ID NO: 737020 - protein, 19 aa, Mycobacterium
TEKPARFGVPLPARPAPLH

SEQ ID NO: 737021 - protein, 21 aa, Mycobacterium
TEKRWDTARVAKLSEILGFYG

SEQ ID NO: 737022 - protein, 24 aa, Mycobacterium
TEKVRIPLLPGRRSLNLSNAAAIA

SEQ ID NO: 737023 - protein, 27 aa, Mycobacterium
TELAAARPGVHWIREFLPTPKLREVLS

SEQ ID NO: 737024 - protein, 26 aa, Mycobacterium
TELAARLSGYARYRKILAGANLSARD

SEQ ID NO: 737025 - protein, 19 aa, Mycobacterium
TELAGALKVLARRMTNPRR

SEQ ID NO: 737026 - protein, 25 aa, Mycobacterium
TELAGRLAAAAALCLPGQPESSSST

SEQ ID NO: 737027 - protein, 20 aa, Mycobacterium
TELAMFFLTGLFALLATGTH

SEQ ID NO: 737028 - protein, 19 aa, Mycobacterium
TELAPGIFAPDPRQYLQPQ

SEQ ID NO: 737029 - protein, 19 aa, Mycobacterium
TELDGGVLVNWDVREGVFA

SEQ ID NO: 737030 - protein, 20 aa, Mycobacterium
TELDVRIGLHNIPVDRRPLW

SEQ ID NO: 737031 - protein, 32 aa, Mycobacterium; identical to SEQ ID NO: 85075

SEQ ID NO: 737032 - protein, 17 aa, Mycobacterium
TELEFTEGVGFDKGYLS

SEQ ID NO: 737033 - protein, 17 aa, Mycobacterium
TELEPDFDRAFKELAKQ

SEQ ID NO: 737034 - protein, 19 aa, Mycobacterium
TELFGNFAAMIDGILGTGH

SEQ ID NO: 737035 - protein, 21 aa, Mycobacterium
TELFRRQGIEVPPPQNDDPLG

SEQ ID NO: 737036 - protein, 28 aa, Mycobacterium
TELGFPPRIWDMLLERFGREVDRRLRDG

SEQ ID NO: 737037 - protein, 21 aa, Mycobacterium
TELGRLIGRIRVDTGPRGVGK

SEQ ID NO: 737038 - protein, 27 aa, Mycobacterium
TELGTRWFADHARWVQDPAGLHPFTTG

SEQ ID NO: 737039 - protein, 18 aa, Mycobacterium
TELITGLDLVRAQLLVAM

SEQ ID NO: 737040 - protein, 19 aa, Mycobacterium
TELIWAEFWVDFPELKFSL

SEQ ID NO: 737041 - protein, 24 aa, Mycobacterium
TELKADGSTACGCWIYSGVYADEV

SEQ ID NO: 737042 - protein, 20 aa, Mycobacterium
TELKLSVALHDPVPADAVRL

SEQ ID NO: 737043 - protein, 17 aa, Mycobacterium
TELLAVFDAYRTPLGRL

SEQ ID NO: 737044 - protein, 23 aa, Mycobacterium
TELLDCDAVVYATGYRPLDVRAF

SEQ ID NO: 737045 - protein, 36 aa, Mycobacterium
TELLDEAWWFPAICWPDGRLQFMLNERMMPAQFIVN

SEQ ID NO: 737046 - protein, 37 aa, Mycobacterium
TELLDEAWWFPAICWPDGRLQFMLNERMMPSQFVVNG

SEQ ID NO: 737047 - protein, 35 aa, Mycobacterium
TELLDEAWWFPAIQWPDGRMQFMLNERMMPAQFIV

SEQ ID NO: 737048 - protein, 21 aa, Mycobacterium
TELLDRLGAHLTRHIGPGVEY

SEQ ID NO: 737049 - protein, 21 aa, Mycobacterium
TELLELTALAKVFGYPTTAEA

SEQ ID NO: 737050 - protein, 25 aa, Mycobacterium
TELLEYHWGPDWMVWDAEKTAQQRG

SEQ ID NO: 737051 - protein, 25 aa, Mycobacterium
TELLEYHWGPDWMVWDAQRTVQQHG

SEQ ID NO: 737052 - protein, 17 aa, Mycobacterium
TELLIEMGLETAQNRVH

SEQ ID NO: 737053 - protein, 19 aa, Mycobacterium
TELLLSMTDEVGRLVLADN

SEQ ID NO: 737054 - protein, 21 aa, Mycobacterium
TELLPFGRPQLTGGPLRSAAK

SEQ ID NO: 737055 - protein, 20 aa, Mycobacterium
TELLVTLRAYLECRQERSAT

SEQ ID NO: 737056 - protein, 20 aa, Mycobacterium
TELPCFDAPALPGSLTEITA

SEQ ID NO: 737057 - protein, 17 aa, Mycobacterium
TELPDVALLDYRMPGMD

SEQ ID NO: 737058 - protein, 19 aa, Mycobacterium
TELPITPFVLTLRLLTVAL

SEQ ID NO: 737059 - protein, 17 aa, Mycobacterium
TELPKSWDPAAAEGAIY

SEQ ID NO: 737060 - protein, 25 aa, Mycobacterium
TELPRTETFKVLKRQLSAEGIDCTD

SEQ ID NO: 737061 - protein, 21 aa, Mycobacterium
TELQARLSIPSSNLLAHHLGV

SEQ ID NO: 737062 - protein, 17 aa, Mycobacterium
TELQRAKRGHTLYVLDE

SEQ ID NO: 737063 - protein, 21 aa, Mycobacterium
TELRALPLVDFGIGVAAGAVF

SEQ ID NO: 737064 - protein, 28 aa, Mycobacterium
TELREFAARFIAHSPFFCMATVGADGLL

SEQ ID NO: 737065 - protein, 25 aa, Mycobacterium
TELREIRSAGAVFGLLDVDDEFFVI

SEQ ID NO: 737066 - protein, 26 aa, Mycobacterium
TELRELRSAGAVFGLLDVDDEFFVIV

SEQ ID NO: 737067 - protein, 20 aa, Mycobacterium
TELRLLSFLVEQRGRIVSAG

SEQ ID NO: 737068 - protein, 18 aa, Mycobacterium
TELRLPLTEDDDAVPEEL

SEQ ID NO: 737069 - protein, 24 aa, Mycobacterium
TELRVRCVRQLRDAMREHIEELRA

SEQ ID NO: 737070 - protein, 19 aa, Mycobacterium
TELSPWWLRSQCPCRNCRT

SEQ ID NO: 737071 - protein, 17 aa, Mycobacterium
TELTAGLDLVELQIAVA

SEQ ID NO: 737072 - protein, 25 aa, Mycobacterium
TELTERPSLFPAWDSLSDSQKKLYA

SEQ ID NO: 737073 - protein, 21 aa, Mycobacterium
TELTLPGRSLLFVRNVGHLMT

SEQ ID NO: 737074 - protein, 21 aa, Mycobacterium
TELTPALGIGAFADKTLVHEG

SEQ ID NO: 737075 - protein, 21 aa, Mycobacterium
TELTPALGIGAFIEKTLVHAG

SEQ ID NO: 737076 - protein, 19 aa, Mycobacterium
TELVAPVVGLLAHESCPVN

SEQ ID NO: 737077 - protein, 18 aa, Mycobacterium
TELVAWINGHPDFADLPV

SEQ ID NO: 737078 - protein, 17 aa, Mycobacterium
TELVAWINGHPDFTDLP

SEQ ID NO: 737079 - protein, 18 aa, Mycobacterium
TELVGAVLDCARGRDVVA

SEQ ID NO: 737080 - protein, 24 aa, Mycobacterium
TELVLMELGMDWDRIEQLKDSGAI

SEQ ID NO: 737081 - protein, 18 aa, Mycobacterium
TELVLSCDLVVAGRSAKF

SEQ ID NO: 737082 - protein, 19 aa, Mycobacterium
TELVNRAAVVVQRYGGTVD

SEQ ID NO: 737083 - protein, 21 aa, Mycobacterium
TELWAEAGKLGFIGVNLPEEY

SEQ ID NO: 737084 - protein, 19 aa, Mycobacterium
TELWSEAGKLGFIGVNLPE

SEQ ID NO: 737085 - protein, 21 aa, Mycobacterium
TELWYGDRVAVLGGNGTGKSH

SEQ ID NO: 737086 - protein, 22 aa, Mycobacterium
TEMARRFRVGGRLFTFGNGGSC

SEQ ID NO: 737087 - protein, 19 aa, Mycobacterium
TEMATAYAAGREQFGRPIG

SEQ ID NO: 737088 - protein, 22 aa, Mycobacterium
TEMERLFAGAGFEVVVHRPVAR

SEQ ID NO: 737089 - protein, 23 aa, Mycobacterium
TEMHSRSGLIDEVRASAVDLATA

SEQ ID NO: 737090 - protein, 24 aa, Mycobacterium
TEMHSRSGLIDEVRASTVDLATAE

SEQ ID NO: 737091 - protein, 19 aa, Mycobacterium
TEMIRRIASHPDLELAGLH

SEQ ID NO: 737092 - protein, 24 aa, Mycobacterium
TEMISRLPFPLNRTTSVEACGAAF

SEQ ID NO: 737093 - protein, 18 aa, Mycobacterium
TEMKRISVALGVNLDARD

SEQ ID NO: 737094 - protein, 17 aa, Mycobacterium
TEMPARIADDFLAGLHK

SEQ ID NO: 737095 - protein, 18 aa, Mycobacterium
TEMPARIADDFLASLHKT

SEQ ID NO: 737096 - protein, 22 aa, Mycobacterium
TEMPNFNWPTAVISGGRDLITP

SEQ ID NO: 737097 - protein, 21 aa, Mycobacterium
TEMRSALSIATLLIGSSVRAV

SEQ ID NO: 737098 - protein, 17 aa, Mycobacterium
TEMVTGIDLVQWQILVA

SEQ ID NO: 737099 - protein, 25 aa, Mycobacterium
TENLGAKVVTDWVARFSAIGRRAVS

SEQ ID NO: 737100 - protein, 20 aa, Mycobacterium
TENLRSYWTRSLPATIVSRA

SEQ ID NO: 737101 - protein, 26 aa, Mycobacterium
TENRARPAPLAVEWGGQAFLDDATRC

SEQ ID NO: 737102 - protein, 26 aa, Mycobacterium
TENTRALDLLTRWGDALAAPPVQPLD

SEQ ID NO: 737103 - protein, 24 aa, Mycobacterium
TENVKRIGPAWVFQAGASGHMAGA

SEQ ID NO: 737104 - protein, 25 aa, Mycobacterium
TENWLRACLVSCWLASDESARSLLS

SEQ ID NO: 737105 - protein, 26 aa, Mycobacterium
TENYEFPAAPWGIKWDAIAPLLRRWH

SEQ ID NO: 737106 - protein, 18 aa, Mycobacterium
TENYMRWISDADHSAPRP

SEQ ID NO: 737107 - protein, 17 aa, Mycobacterium
TENYPGDRPAAVVHGDY

SEQ ID NO: 737108 - protein, 23 aa, Mycobacterium
TENYRTLVIFDEIHHGGDAKSWG

SEQ ID NO: 737109 - protein, 18 aa, Mycobacterium
TEPAAGRPAALEVTTIAE

SEQ ID NO: 737110 - protein, 18 aa, Mycobacterium
TEPAEFGRKVEVLNRHCD

SEQ ID NO: 737111 - protein, 19 aa, Mycobacterium
TEPAEFSWTASDVQLYHLA

SEQ ID NO: 737112 - protein, 31 aa, Mycobacterium
TEPAHSLALQRLRLDPVLDLQMRLGEGSGAL

SEQ ID NO: 737113 - protein, 29 aa, Mycobacterium
TEPALDWLEPFLPWDGMEMAPLPAALERL

SEQ ID NO: 737114 - protein, 18 aa, Mycobacterium
TEPALRTSYLMVHDEMER

SEQ ID NO: 737115 - protein, 21 aa, Mycobacterium
TEPCTLRAPMFSALHTLGNQY

SEQ ID NO: 737116 - protein, 19 aa, Mycobacterium
TEPDFFWSPVNSLEDVVAD

SEQ ID NO: 737117 - protein, 20 aa, Mycobacterium
TEPDGGVHVGIYLTTAACPK

SEQ ID NO: 737118 - protein, 23 aa, Mycobacterium
TEPDPSYHGVVFAELGPPAYALK

SEQ ID NO: 737119 - protein, 24 aa, Mycobacterium
TEPEAFKWIQRAAMDRRTTMKRVA

SEQ ID NO: 737120 - protein, 30 aa, Mycobacterium
TEPELPKLLKRLVIMGGSFDYPGNTTPVAE

SEQ ID NO: 737121 - protein, 22 aa, Mycobacterium
TEPELRELAARAAAELDGASAT

SEQ ID NO: 737122 - protein, 28 aa, Mycobacterium
TEPERILFRRLAAFAGDFDLDAAQAVGA

SEQ ID NO: 737123 - protein, 22 aa, Mycobacterium
TEPERILFRRLGVFMGGFDLDA

SEQ ID NO: 737124 - protein, 31 aa, Mycobacterium
TEPGELSVHFPFPIKDLVAIDDALKFGSRAS

SEQ ID NO: 737125 - protein, 25 aa, Mycobacterium
TEPGILRTPWYTVISGTGDTPVGTS

SEQ ID NO: 737126 - protein, 21 aa, Mycobacterium
TEPHWNVKGCYITKIQGDPCV

SEQ ID NO: 737127 - protein, 23 aa, Mycobacterium
TEPIAVVGIGCRLPGGVENADGF

SEQ ID NO: 737128 - protein, 25 aa, Mycobacterium
TEPIPDDWTALPFGVPLPNNACRVV

SEQ ID NO: 737129 - protein, 21 aa, Mycobacterium
TEPLARLWHASTLLREHRGDG

SEQ ID NO: 737130 - protein, 20 aa, Mycobacterium
TEPLLRLNVEARTDEDVAAV

SEQ ID NO: 737131 - protein, 20 aa, Mycobacterium
TEPLLRLNVEARTTEDVDAV

SEQ ID NO: 737132 - protein, 17 aa, Mycobacterium
TEPLLRLNVEARTTEEV

SEQ ID NO: 737133 - protein, 17 aa, Mycobacterium
TEPLLRLNVEGRTAEDV

SEQ ID NO: 737134 - protein, 35 aa, Mycobacterium
TEPRARELYADWPVIAADAVAGFRMNHGIAPHDPR

SEQ ID NO: 737135 - protein, 30 aa, Mycobacterium
TEPRITPFVLTMRLMLIALRHNEILNSTWA

SEQ ID NO: 737136 - protein, 21 aa, Mycobacterium
TEPVAIVGMGCRFPGGVDSAD

SEQ ID NO: 737137 - protein, 31 aa, Mycobacterium
TEPVASHLVSRCGLVDRTPHAFAEAAEQGQD

SEQ ID NO: 737138 - protein, 34 aa, Mycobacterium
TEPVASYGGLSWWGNFGEFGFLTKLRSEQLRDLG

SEQ ID NO: 737139 - protein, 25 aa, Mycobacterium
TEPVAVVGIGCRFPGGVDSAEKLWE

SEQ ID NO: 737140 - protein, 17 aa, Mycobacterium
TEPVLFGPTVNPWGSDV

SEQ ID NO: 737141 - protein, 20 aa, Mycobacterium
TEPWRGEPLLEYLRKMVFWS

SEQ ID NO: 737142 - protein, 22 aa, Mycobacterium
TEPWWCRTLVLAAARTARRHGV

SEQ ID NO: 737143 - protein, 26 aa, Mycobacterium
TEPWYVVTFGGGATPTPTSLGAAAVD

SEQ ID NO: 737144 - protein, 23 aa, Mycobacterium
TEQGIGFIPWFPLAAGPLAAPDG

SEQ ID NO: 737145 - protein, 26 aa, Mycobacterium
TEQIYRGSQIVPWVNAVIPISKILPN

SEQ ID NO: 737146 - protein, 23 aa, Mycobacterium
TEQLAQEAWRHFQAIEAHGGFVA

SEQ ID NO: 737147 - protein, 27 aa, Mycobacterium
TEQMAAMLLDLCDVEHKVAAAREPVLA

SEQ ID NO: 737148 - protein, 25 aa, Mycobacterium
TEQMMDQLMNWRYTFGGVVRIGGVA

SEQ ID NO: 737149 - protein, 21 aa, Mycobacterium
TEQRKTLVIFDEIHHGGDAKT

SEQ ID NO: 737150 - protein, 18 aa, Mycobacterium
TEQRLGVRLPESLVALLR

SEQ ID NO: 737151 - protein, 17 aa, Mycobacterium
TEQRQRWFPGLAAGTLL

SEQ ID NO: 737152 - protein, 21 aa, Mycobacterium
TEQRTAPSITLNFMPMSHANG

SEQ ID NO: 737153 - protein, 19 aa, Mycobacterium
TEQYISVGVGRDYSDVSPL

SEQ ID NO: 737154 - protein, 19 aa, Mycobacterium
TEQYPPVVMSMLLTQSARS

SEQ ID NO: 737155 - protein, 24 aa, Mycobacterium
TERAEGAGRHRGQVDGAPEDGESL

SEQ ID NO: 737156 - protein, 25 aa, Mycobacterium
TERAELVRWLFEQGITAEEIRATNP

SEQ ID NO: 737157 - protein, 25 aa, Mycobacterium
TERAPRPGHRRIVFKFMTSPVEIRG

SEQ ID NO: 737158 - protein, 22 aa, Mycobacterium
TERAREALVLKHIGGYSYDEIA

SEQ ID NO: 737159 - protein, 18 aa, Mycobacterium
TERCLRWPQAAAVCDDVL

SEQ ID NO: 737160 - protein, 17 aa, Mycobacterium
TEREMAETFAVSRSTLR

SEQ ID NO: 737161 - protein, 17 aa, Mycobacterium
TERFDAVIVPGVTSVSA

SEQ ID NO: 737162 - protein, 24 aa, Mycobacterium
TERGLRVDVAWSLHRSVAGMNLDN

SEQ ID NO: 737163 - protein, 17 aa, Mycobacterium
TERGRRLVAEIAPDHFG

SEQ ID NO: 737164 - protein, 21 aa, Mycobacterium
TERHIRLIFQRAREKASDGTP

SEQ ID NO: 737165 - protein, 20 aa, Mycobacterium
TERHIRLIFQRAREKASEGT

SEQ ID NO: 737166 - protein, 18 aa, Mycobacterium
TERHRWGLAAKGVAAKGG

SEQ ID NO: 737167 - protein, 20 aa, Mycobacterium
TERILYYTGINYKIGEVHDG

SEQ ID NO: 737168 - protein, 20 aa, Mycobacterium
TERILYYTGISYKIGEVHDG

SEQ ID NO: 737169 - protein, 18 aa, Mycobacterium
TERIRIVTAIVNIWSAPA

SEQ ID NO: 737170 - protein, 23 aa, Mycobacterium
TERLKELAVRFAKPVLPGQDITT

SEQ ID NO: 737171 - protein, 26 aa, Mycobacterium
TERLLRERLVQLRPGDPILGEEGGGP

SEQ ID NO: 737172 - protein, 20 aa, Mycobacterium
TERLPLIVAPRWLRTCVQPI

SEQ ID NO: 737173 - protein, 19 aa, Mycobacterium
TERLWPTLLEPLRSREQAR

SEQ ID NO: 737174 - protein, 19 aa, Mycobacterium
TERLWPTLLEPLRTRDQAR

SEQ ID NO: 737175 - protein, 22 aa, Mycobacterium
TERLWPTLMEPLRTRQQARRHV

SEQ ID NO: 737176 - protein, 22 aa, Mycobacterium
TERPAAYALRWSDHCPVTVHYA

SEQ ID NO: 737177 - protein, 27 aa, Mycobacterium
TERPAPRPAPQFEVMYRLDGCEPAAAD

SEQ ID NO: 737178 - protein, 27 aa, Mycobacterium
TERPNWREARWVSVVINYRAERWSDVV

SEQ ID NO: 737179 - protein, 23 aa, Mycobacterium
TERQSPQLLNCFLQLTGYVVELT

SEQ ID NO: 737180 - protein, 25 aa, Mycobacterium
TERRFRAWIRWNAAIMVHRAQRPGV

SEQ ID NO: 737181 - protein, 22 aa, Mycobacterium
TERRRGVVVNPVLETSEVPETM

SEQ ID NO: 737182 - protein, 22 aa, Mycobacterium
TERRSHSGLDRLKRAIRRRWLQ

SEQ ID NO: 737183 - protein, 24 aa, Mycobacterium
TERRVRRGRIQFVRQEPLFTSSVK

SEQ ID NO: 737184 - protein, 25 aa, Mycobacterium
TERSKLYWDFWEQFRSRVVSEYPGW

SEQ ID NO: 737185 - protein, 24 aa, Mycobacterium
TERSRAVYLRGWEEFDEPVDRIVS

SEQ ID NO: 737186 - protein, 23 aa, Mycobacterium
TERSRRILLRGWEQFDEPVDRII

SEQ ID NO: 737187 - protein, 25 aa, Mycobacterium
TERTDRRPLPIVSYQCAIDAVAGRC

SEQ ID NO: 737188 - protein, 23 aa, Mycobacterium
TERVEGRSGVWVPADDLRPARKI

SEQ ID NO: 737189 - protein, 21 aa, Mycobacterium
TERVVPFGAFGHLVSIAEIGK

SEQ ID NO: 737190 - protein, 17 aa, Mycobacterium
TESAAMRPGGWLRTGDL

SEQ ID NO: 737191 - protein, 18 aa, Mycobacterium
TESALQFVGAATFEALSG

SEQ ID NO: 737192 - protein, 24 aa, Mycobacterium
TESALRFIGAATFEALSGQPVHTG

SEQ ID NO: 737193 - protein, 23 aa, Mycobacterium
TESALRFVGAATFEALSGQPVRT

SEQ ID NO: 737194 - protein, 37 aa, Mycobacterium
TESAMRVCGGAAFSKHLPIERAFRDARAGAVMAPTAD

SEQ ID NO: 737195 - protein, 23 aa, Mycobacterium
TESDLRAACDWITDGSWHSQTLS

SEQ ID NO: 737196 - protein, 26 aa, Mycobacterium
TESEQRLWCRLSVLAANFELPAARDI

SEQ ID NO: 737197 - protein, 18 aa, Mycobacterium
TESESFRRYWPADLHMIG

SEQ ID NO: 737198 - protein, 17 aa, Mycobacterium
TESFRMLSDPTRIKVLW

SEQ ID NO: 737199 - protein, 26 aa, Mycobacterium
TESFRYIDCRCCGGMLKPDIVYFGES

SEQ ID NO: 737200 - protein, 17 aa, Mycobacterium
TESIACIIELVEKMLAS

SEQ ID NO: 737201 - protein, 38 aa, Mycobacterium
TESISDLRAIPWVLAWSQSRVMLPGWYGTGSAFEQWIA

SEQ ID NO: 737202 - protein, 17 aa, Mycobacterium
TESLAVKKFDLMMDINV

SEQ ID NO: 737203 - protein, 21 aa, Mycobacterium
TESLPLIASSIMSKKLAEGAR

SEQ ID NO: 737204 - protein, 20 aa, Mycobacterium
TESLPLIASSVMSKKIAEGT

SEQ ID NO: 737205 - protein, 18 aa, Mycobacterium
TESMWAYTHLPRNVADDS

SEQ ID NO: 737206 - protein, 19 aa, Mycobacterium
TESPWPVVEAIAPERDPGT

SEQ ID NO: 737207 - protein, 20 aa, Mycobacterium
TESRFQRHYGVAVDLRSRPW

SEQ ID NO: 737208 - protein, 20 aa, Mycobacterium
TESRVRLIGFFNPLDGKFHW

SEQ ID NO: 737209 - protein, 17 aa, Mycobacterium
TESVHWVTAAGIRPGVD

SEQ ID NO: 737210 - protein, 20 aa, Mycobacterium
TESWTKMSILNTARSGKFSS

SEQ ID NO: 737211 - protein, 19 aa, Mycobacterium
TETDWPAIGLIAATGFGVW

SEQ ID NO: 737212 - protein, 20 aa, Mycobacterium
TETFAAITLEVDTRRWAGVP

SEQ ID NO: 737213 - protein, 17 aa, Mycobacterium
TETKARVLRPYAEKLIT

SEQ ID NO: 737214 - protein, 20 aa, Mycobacterium
TETLAVEWAPKVRVNSVVVG

SEQ ID NO: 737215 - protein, 21 aa, Mycobacterium
TETLMRLLIETAWDKANQNLQ

SEQ ID NO: 737216 - protein, 23 aa, Mycobacterium
TETLTWWQIYRRAKIVAEELRGY

SEQ ID NO: 737217 - protein, 17 aa, Mycobacterium
TETMPWPDTDHLRTAAV

SEQ ID NO: 737218 - protein, 24 aa, Mycobacterium
TETPERFGPALAMLDGGWSVGEAG

SEQ ID NO: 737219 - protein, 23 aa, Mycobacterium
TETPMAPPMPNFGGGPLPGLGTM

SEQ ID NO: 737220 - protein, 23 aa, Mycobacterium
TETPRLVGLYKQGLLKIDEMITS

SEQ ID NO: 737221 - protein, 21 aa, Mycobacterium
TETRGDWALRGIATGVVGVAH

SEQ ID NO: 737222 - protein, 25 aa, Mycobacterium
TETRSARMDLVFSLAERWTEDGRPA

SEQ ID NO: 737223 - protein, 22 aa, Mycobacterium
TETSLEWGRRAAQRAENRMLID

SEQ ID NO: 737224 - protein, 26 aa, Mycobacterium
TETSPLCVVGRPLPKHDALDPADRRS

SEQ ID NO: 737225 - protein, 24 aa, Mycobacterium
TETYRTAFQRCVQAATAAGASIDT

SEQ ID NO: 737226 - protein, 23 aa, Mycobacterium
TEVAARPRSVVVLAPGAIPKTPS

SEQ ID NO: 737227 - protein, 22 aa, Mycobacterium
TEVAEFSRSLKLMAKELDVPVV

SEQ ID NO: 737228 - protein, 23 aa, Mycobacterium
TEVAEVYLPLARLIHLQVAARQR

SEQ ID NO: 737229 - protein, 20 aa, Mycobacterium
TEVAGALGLGAPQLDGIQSW

SEQ ID NO: 737230 - protein, 19 aa, Mycobacterium
TEVANASPLQSLEQQLLAA

SEQ ID NO: 737231 - protein, 26 aa, Mycobacterium
TEVDAAEGWVLPGLIDTHVHFYDVAA

SEQ ID NO: 737232 - protein, 25 aa, Mycobacterium
TEVDAVVGIYGRYDWEDRSTPERDR

SEQ ID NO: 737233 - protein, 24 aa, Mycobacterium
TEVDNLRAAFTWCRENSDLEAGLR

SEQ ID NO: 737234 - protein, 17 aa, Mycobacterium
TEVFRPLVDNLRHDDPF

SEQ ID NO: 737235 - protein, 27 aa, Mycobacterium
TEVGRRAALAMVRRHRLLETFLVNELG

SEQ ID NO: 737236 - protein, 20 aa, Mycobacterium
TEVGSRAWAAMYLGTPTTPE

SEQ ID NO: 737237 - protein, 18 aa, Mycobacterium
TEVIPRMLAERGPADPIR

SEQ ID NO: 737238 - protein, 20 aa, Mycobacterium
TEVIVAPAYAPAALDQLTKK

SEQ ID NO: 737239 - protein, 20 aa, Mycobacterium
TEVIVAPAYAPGALDVLARK

SEQ ID NO: 737240 - protein, 18 aa, Mycobacterium
TEVLDGLHHWWMVQDPAR

SEQ ID NO: 737241 - protein, 19 aa, Mycobacterium
TEVLERWAKELFDSDGAQR

SEQ ID NO: 737242 - protein, 25 aa, Mycobacterium
TEVLGFRPRGAFRIPAPPEFGPMRV

SEQ ID NO: 737243 - protein, 28 aa, Mycobacterium
TEVLGFRSRGAFRVPLPAEFGPIRVRFL

SEQ ID NO: 737244 - protein, 17 aa, Mycobacterium
TEVLIKAYHRWGDDFVS

SEQ ID NO: 737245 - protein, 17 aa, Mycobacterium
TEVLLKAYHRWGDAFVG

SEQ ID NO: 737246 - protein, 18 aa, Mycobacterium
TEVLPQFQGRGLATILVA

SEQ ID NO: 737247 - protein, 17 aa, Mycobacterium
TEVLSWFAVDADAPEEF

SEQ ID NO: 737248 - protein, 19 aa, Mycobacterium
TEVLSWFAVDSDAPADFKA

SEQ ID NO: 737249 - protein, 19 aa, Mycobacterium
TEVLYKLWEGSWEDDAVGA

SEQ ID NO: 737250 - protein, 22 aa, Mycobacterium
TEVMSRLAPLGPVYQAGTLSGN

SEQ ID NO: 737251 - protein, 18 aa, Mycobacterium
TEVPGIGAATARAVLDAL

SEQ ID NO: 737252 - protein, 18 aa, Mycobacterium
TEVPRPGPSELLVAVRAC

SEQ ID NO: 737253 - protein, 24 aa, Mycobacterium
TEVPRTADFLTEMIDAHGAHNVSV

SEQ ID NO: 737254 - protein, 22 aa, Mycobacterium
TEVPRYAGIATFARLPQRFEVL

SEQ ID NO: 737255 - protein, 20 aa, Mycobacterium
TEVRARDLALGKFIDAKTLS

SEQ ID NO: 737256 - protein, 17 aa, Mycobacterium
TEVRATLEAARTVVDQN

SEQ ID NO: 737257 - protein, 22 aa, Mycobacterium
TEVRGGIFPIVMDAAFGSLDLN

SEQ ID NO: 737258 - protein, 25 aa, Mycobacterium
TEVRRFARERSRWIFSNPDMIHLSL

SEQ ID NO: 737259 - protein, 28 aa, Mycobacterium
TEVRWWGVRPLWFALWSGVFERFPGLRW

SEQ ID NO: 737260 - protein, 28 aa, Mycobacterium
TEVRWWGVRPLWFALWSGVFERFPRLRW

SEQ ID NO: 737261 - protein, 17 aa, Mycobacterium
TEVSCKFRPDGVSAELD

SEQ ID NO: 737262 - protein, 17 aa, Mycobacterium
TEVTDAFGKPVWINSQG

SEQ ID NO: 737263 - protein, 25 aa, Mycobacterium
TEVTLRFADGEVVTMHVISIVEETP

SEQ ID NO: 737264 - protein, 19 aa, Mycobacterium
TEVTLRFDDGEVVTMHVIA

SEQ ID NO: 737265 - protein, 26 aa, Mycobacterium
TEVTLRFPDGEVVTMHVISIIEESPE

SEQ ID NO: 737266 - protein, 17 aa, Mycobacterium
TEVTRAAAAPVIAVLSS

SEQ ID NO: 737267 - protein, 17 aa, Mycobacterium
TEVTSRHGIPVVEDGCQ

SEQ ID NO: 737268 - protein, 26 aa, Mycobacterium
TEVYLCGPPPMVDAALMFLDANCVPK

SEQ ID NO: 737269 - protein, 17 aa, Mycobacterium
TEWAATLQPGWQRRRIT

SEQ ID NO: 737270 - protein, 23 aa, Mycobacterium
TEWATAPAKLAFGPQTVRLDGYR

SEQ ID NO: 737271 - protein, 21 aa, Mycobacterium
TEWGACYRIMLGHLDAAKFDA

SEQ ID NO: 737272 - protein, 17 aa, Mycobacterium
TEWIPPPHLDRGQPRTN

SEQ ID NO: 737273 - protein, 31 aa, Mycobacterium
TEWPEFRKLEWSRLAAGVTRRTVVDSRNLLD

SEQ ID NO: 737274 - protein, 17 aa, Mycobacterium
TEWPPAAQLHMAVDDDG

SEQ ID NO: 737275 - protein, 21 aa, Mycobacterium
TEYARRRWGGLLAPPALLMGW

SEQ ID NO: 737276 - protein, 20 aa, Mycobacterium
TEYEMRARIARAIGIPERDL

SEQ ID NO: 737277 - protein, 22 aa, Mycobacterium
TEYFADTPFRVFQAPYVGAVVM

SEQ ID NO: 737278 - protein, 17 aa, Mycobacterium
TEYFKDTTFRVFQAPYV

SEQ ID NO: 737279 - protein, 19 aa, Mycobacterium
TEYGDSLFRLKDRRDNDMM

SEQ ID NO: 737280 - protein, 26 aa, Mycobacterium
TEYGHKYGGTSFELFAKISEKNHAHS

SEQ ID NO: 737281 - protein, 21 aa, Mycobacterium
TEYGSALDAAMQWQSDGAEWI

SEQ ID NO: 737282 - protein, 21 aa, Mycobacterium
TEYGVAPLLNLSRFGRIAPVS

SEQ ID NO: 737283 - protein, 18 aa, Mycobacterium
TEYLPSVRSASVGLWIGV

SEQ ID NO: 737284 - protein, 18 aa, Mycobacterium
TEYLPSVRSASVGVWVGV

SEQ ID NO: 737285 - protein, 20 aa, Mycobacterium
TEYNVRFTAVVPVPNDGVGA

SEQ ID NO: 737286 - protein, 26 aa, Mycobacterium
TEYPARRLGAAAADWLGDEQETIYGC

SEQ ID NO: 737287 - protein, 24 aa, Mycobacterium
TEYWKEIGGTVMLPGTNRAADRFV

SEQ ID NO: 737288 - protein, 28 aa, Mycobacterium
TFAADWSFGFDVGMTFLEIHGPVPRLRQ

SEQ ID NO: 737289 - protein, 18 aa, Mycobacterium
TFAAITLEVDTRRWAGVP

SEQ ID NO: 737290 - protein, 18 aa, Mycobacterium
TFAAITLEVNSRRWAGVP

SEQ ID NO: 737291 - protein, 18 aa, Mycobacterium
TFAARALFFDKFFADAIA

SEQ ID NO: 737292 - protein, 19 aa, Mycobacterium
TFAAVAADWLASRRDLKPR

SEQ ID NO: 737293 - protein, 21 aa, Mycobacterium
TFADELGRYGIRANAVAPGNV

SEQ ID NO: 737294 - protein, 22 aa, Mycobacterium
TFADLQIHPAVLKAVADVGYES

SEQ ID NO: 737295 - protein, 22 aa, Mycobacterium
TFADLQIHPSVLRAVADVGYES

SEQ ID NO: 737296 - protein, 23 aa, Mycobacterium
TFADMARAVLVHQSRELEVIDDP

SEQ ID NO: 737297 - protein, 17 aa, Mycobacterium
TFADVPAGWRVVFGEAS

SEQ ID NO: 737298 - protein, 19 aa, Mycobacterium
TFAEWDFEANTTYPLLLHE

SEQ ID NO: 737299 - protein, 18 aa, Mycobacterium
TFAFAPDVSLAFYRALED

SEQ ID NO: 737300 - protein, 24 aa, Mycobacterium
TFAFGSPDLYAWLDGNADVAFLPV

SEQ ID NO: 737301 - protein, 17 aa, Mycobacterium
TFAFPELTGTFNWAIDW

SEQ ID NO: 737302 - protein, 20 aa, Mycobacterium
TFAGISARYTPDFDAFHSEA

SEQ ID NO: 737303 - protein, 20 aa, Mycobacterium
TFAGLPAYKQGLGRKVRFMA

SEQ ID NO: 737304 - protein, 18 aa, Mycobacterium
TFAGRGAAEFSRRRTTRA

SEQ ID NO: 737305 - protein, 25 aa, Mycobacterium
TFALPRKDFQDWAGKRTRFRMEDFY

SEQ ID NO: 737306 - protein, 24 aa, Mycobacterium
TFAMGSSELYAWLDGNTDVAFLPV

SEQ ID NO: 737307 - protein, 18 aa, Mycobacterium
TFAPILYVLTYDRLGDAI

SEQ ID NO: 737308 - protein, 25 aa, Mycobacterium
TFAQLRAAEGLSWHQPLSTLFDVEE

SEQ ID NO: 737309 - protein, 20 aa, Mycobacterium
TFARTLAAQSERIFPTVAFV

SEQ ID NO: 737310 - protein, 26 aa, Mycobacterium
TFASLPYRIMHEFQIPLYDQMRERDK

SEQ ID NO: 737311 - protein, 19 aa, Mycobacterium
TFATFGITTHGVWTDRDAN

SEQ ID NO: 737312 - protein, 18 aa, Mycobacterium
TFAVSLLALHQGLIRQRR

SEQ ID NO: 737313 - protein, 26 aa, Mycobacterium
TFCVAIDHLHCDAMFVGVAFAEIHLM

SEQ ID NO: 737314 - protein, 26 aa, Mycobacterium
TFCVAIDHLHCDAMFVGVVFAEIHLM

SEQ ID NO: 737315 - protein, 26 aa, Mycobacterium
TFDARKAVVFDDRWASAREDLVKLWL

SEQ ID NO: 737316 - protein, 26 aa, Mycobacterium
TFDAVCCFGALYLMPEPFRIAREMVR

SEQ ID NO: 737317 - protein, 24 aa, Mycobacterium
TFDDARAVPRIKYLSDGLGDVIGI

SEQ ID NO: 737318 - protein, 21 aa, Mycobacterium
TFDDARLYGERNWGAGFPERW

SEQ ID NO: 737319 - protein, 23 aa, Mycobacterium
TFDEAEAFFLARLDEWDNTAVDD

SEQ ID NO: 737320 - protein, 24 aa, Mycobacterium
TFDEICLRRYPGIGRVDHVHHAGN

SEQ ID NO: 737321 - protein, 18 aa, Mycobacterium
TFDLQWRLSGTPEVAPPL

SEQ ID NO: 737322 - protein, 17 aa, Mycobacterium
TFDLVIVDEAHRSIYGV

SEQ ID NO: 737323 - protein, 22 aa, Mycobacterium
TFDNLLGLPFSAPVPPTTPLDT

SEQ ID NO: 737324 - protein, 22 aa, Mycobacterium
TFDRILALLAERGYVEDSAELG

SEQ ID NO: 737325 - protein, 18 aa, Mycobacterium
TFDRLDIDGSCSTNDTVL

SEQ ID NO: 737326 - protein, 18 aa, Mycobacterium
TFDRPALGPSAFQTIIDM

SEQ ID NO: 737327 - protein, 22 aa, Mycobacterium
TFDYPSRIIAGLLGLPEEDYPQ

SEQ ID NO: 737328 - protein, 19 aa, Mycobacterium
TFEAARGVIVWDHGTYANM

SEQ ID NO: 737329 - protein, 20 aa, Mycobacterium
TFEAAWAAMIHPVAVGQNRS

SEQ ID NO: 737330 - protein, 17 aa, Mycobacterium
TFEEMLEMAACGAKVLM

SEQ ID NO: 737331 - protein, 18 aa, Mycobacterium
TFEFAMARLQTVAIDDGP

SEQ ID NO: 737332 - protein, 22 aa, Mycobacterium
TFEFPTRVIATLLGLPADDLPM

SEQ ID NO: 737333 - protein, 19 aa, Mycobacterium
TFEGPSFHSAAWDHSVDVT

SEQ ID NO: 737334 - protein, 17 aa, Mycobacterium
TFEMEWPKGSGRMREFP

SEQ ID NO: 737335 - protein, 24 aa, Mycobacterium
TFERLYRAAPLMRFGGGTNEVLRD

SEQ ID NO: 737336 - protein, 19 aa, Mycobacterium
TFESFVIGASNRFSHAAAV

SEQ ID NO: 737337 - protein, 21 aa, Mycobacterium
TFETACTWAGFDTLHAAVTDA

SEQ ID NO: 737338 - protein, 20 aa, Mycobacterium
TFETACTWDGFDALHAAVTD

SEQ ID NO: 737339 - protein, 18 aa, Mycobacterium
TFETEFFTAHGFTEIEGT

SEQ ID NO: 737340 - protein, 22 aa, Mycobacterium
TFEVVARPGAWEEYFKYGNPDG

SEQ ID NO: 737341 - protein, 18 aa, Mycobacterium
TFEWDPASTYVRKAPYFD

SEQ ID NO: 737342 - protein, 18 aa, Mycobacterium
TFGAPKLHDLYLATCGLR

SEQ ID NO: 737343 - protein, 18 aa, Mycobacterium
TFGDVWALLVDGEFGHGL

SEQ ID NO: 737344 - protein, 22 aa, Mycobacterium
TFGEGRNAVAIYAPNGTMKTSL

SEQ ID NO: 737345 - protein, 21 aa, Mycobacterium
TFGGFKPVHAFGDCGRLELVD

SEQ ID NO: 737346 - protein, 27 aa, Mycobacterium
TFGGGRRALRFGWSKINLHQRGAEFEP

SEQ ID NO: 737347 - protein, 19 aa, Mycobacterium
TFGGIEMIQQATVLLSSTN

SEQ ID NO: 737348 - protein, 18 aa, Mycobacterium
TFGGIEMLQQATVSLSSM

SEQ ID NO: 737349 - protein, 23 aa, Mycobacterium
TFGGKGRAAIAIGNPDKSRNTAV

SEQ ID NO: 737350 - protein, 21 aa, Mycobacterium
TFGGLKPVHALGECGRVRLID

SEQ ID NO: 737351 - protein, 26 aa, Mycobacterium
TFGHSLGAMVSFEFARLAEAQGIQVR

SEQ ID NO: 737352 - protein, 26 aa, Mycobacterium
TFGHSMGALVAFEFVRLAEANGIDVR

SEQ ID NO: 737353 - protein, 23 aa, Mycobacterium
TFGLDQVRYFLLREVPFGQDGSY

SEQ ID NO: 737354 - protein, 18 aa, Mycobacterium
TFGLKAGLVTSFLRGATM

SEQ ID NO: 737355 - protein, 29 aa, Mycobacterium
TFGLKASGWRQLILEARARVVALADALPV

SEQ ID NO: 737356 - protein, 20 aa, Mycobacterium
TFGMDSWFPSLKIYNRNGQL

SEQ ID NO: 737357 - protein, 24 aa, Mycobacterium
TFGNVIRLLPPLVIGDDLLDEGIT

SEQ ID NO: 737358 - protein, 25 aa, Mycobacterium
TFGPAARTALTFGMQKINLRPIAAT

SEQ ID NO: 737359 - protein, 28 aa, Mycobacterium
TFGPQSLRPRLIWFAYRRLKEGRPIVTH

SEQ ID NO: 737360 - protein, 23 aa, Mycobacterium
TFGPTGRVALRFGQQKPNLRPVG

SEQ ID NO: 737361 - protein, 25 aa, Mycobacterium
TFGRKIIDHQGLGFLLADMAAAVVS

SEQ ID NO: 737362 - protein, 30 aa, Mycobacterium
TFGSRAGLVGRAWLRAGHRFLGAQGELIDA

SEQ ID NO: 737363 - protein, 19 aa, Mycobacterium
TFGVIQRADHFTVYISVDH

SEQ ID NO: 737364 - protein, 24 aa, Mycobacterium
TFGVKVAGWLTGVVDAFEGLSALA

SEQ ID NO: 737365 - protein, 31 aa, Mycobacterium
TFHEGRLFIGECREGGRLLEFDLAGGPPRVL

SEQ ID NO: 737366 - protein, 20 aa, Mycobacterium
TFHEQFVQTLATASRAYASA

SEQ ID NO: 737367 - protein, 29 aa, Mycobacterium
TFHEQLVRSLAAGGFSYATAEAANASPLE

SEQ ID NO: 737368 - protein, 17 aa, Mycobacterium
TFHEWVQRYFHAERLFD

SEQ ID NO: 737369 - protein, 18 aa, Mycobacterium
TFHQLRRLVVALAATPDA

SEQ ID NO: 737370 - protein, 26 aa, Mycobacterium
TFHRVDGAWCFDSRTMFVDQVGDVSH

SEQ ID NO: 737371 - protein, 26 aa, Mycobacterium
TFHTQFVRALNLSGGAYAAADAANAS

SEQ ID NO: 737372 - protein, 21 aa, Mycobacterium
TFHYPGGLVDFVKHINRTKSP

SEQ ID NO: 737373 - protein, 19 aa, Mycobacterium
TFIALKVGIDNWRWAGVPI

SEQ ID NO: 737374 - protein, 18 aa, Mycobacterium
TFIARAGQALSIRETDGI

SEQ ID NO: 737375 - protein, 21 aa, Mycobacterium
TFIELTLAPLVPRSVYVNADE

SEQ ID NO: 737376 - protein, 19 aa, Mycobacterium
TFIKQFRDSYGITLEAIGR

SEQ ID NO: 737377 - protein, 24 aa, Mycobacterium
TFISVFGYQAQWAMFAANNIGISD

SEQ ID NO: 737378 - protein, 20 aa, Mycobacterium
TFKETARILAGFADERPEAV

SEQ ID NO: 737379 - protein, 27 aa, Mycobacterium
TFKRLERTRISGVLINLQPDRSSAKAR

SEQ ID NO: 737380 - protein, 18 aa, Mycobacterium
TFLAGWVNDIFAGRIDPS

SEQ ID NO: 737381 - protein, 20 aa, Mycobacterium
TFLAPDCIYLDMPVGPAAAA

SEQ ID NO: 737382 - protein, 21 aa, Mycobacterium
TFLDREGWDSLTINALATQLG

SEQ ID NO: 737383 - protein, 31 aa, Mycobacterium
TFLEALASAWSWKLPAAVKHWGAQPSGEDTD

SEQ ID NO: 737384 - protein, 29 aa, Mycobacterium
TFLGARPAGWWIRRRLHEVAVHRVDAAIA

SEQ ID NO: 737385 - protein, 18 aa, Mycobacterium
TFLHRAFDQLLFDVGLHQ

SEQ ID NO: 737386 - protein, 17 aa, Mycobacterium
TFLLGVRGAEYGDLEVY

SEQ ID NO: 737387 - protein, 24 aa, Mycobacterium
TFLPGQRVPAWAAKQMGPHCFAKD

SEQ ID NO: 737388 - protein, 30 aa, Mycobacterium
TFLPSCGRCSYCARGMGNLCELGAALMMGP

SEQ ID NO: 737389 - protein, 24 aa, Mycobacterium
TFLQAVLIMHDFRVEIGMPGAAGL

SEQ ID NO: 737390 - protein, 18 aa, Mycobacterium
TFLRAGHEMINFLIRKGV

SEQ ID NO: 737391 - protein, 24 aa, Mycobacterium
TFLRAIGALPRFAGRSNARTWLFS

SEQ ID NO: 737392 - protein, 17 aa, Mycobacterium
TFLRALEQGKLLGARSG

SEQ ID NO: 737393 - protein, 24 aa, Mycobacterium
TFLRRWPDPQAWAGEPLEARLTVS

SEQ ID NO: 737394 - protein, 24 aa, Mycobacterium
TFLVDCGRGVLQRAAAVGVGANQI

SEQ ID NO: 737395 - protein, 23 aa, Mycobacterium
TFLVDCGRGVLQRLAAAGSSASQ

SEQ ID NO: 737396 - protein, 24 aa, Mycobacterium
TFLVEGRVALIAPAGWPTQRVIGG

SEQ ID NO: 737397 - protein, 18 aa, Mycobacterium
TFLVGGWHDAFQRGAPLN

SEQ ID NO: 737398 - protein, 27 aa, Mycobacterium
TFMDSHPFVWLPILSRVLGTAELVPHA

SEQ ID NO: 737399 - protein, 24 aa, Mycobacterium
TFMQREFPMAVHLLEGHMVGGVRQ

SEQ ID NO: 737400 - protein, 21 aa, Mycobacterium
TFMSIFAVMIQNHFFQNVDIG

SEQ ID NO: 737401 - protein, 29 aa, Mycobacterium
TFNCVSWLEALGFCGFGEAQGWLDGGRRI

SEQ ID NO: 737402 - protein, 22 aa, Mycobacterium
TFNISRLAAFHMAESAPEDDER

SEQ ID NO: 737403 - protein, 27 aa, Mycobacterium
TFNLAYRPPLYRVRTHDGLALCGMMNA

SEQ ID NO: 737404 - protein, 18 aa, Mycobacterium
TFNLCVSNVPGPQEVLYL

SEQ ID NO: 737405 - protein, 27 aa, Mycobacterium
TFNRAAGRVKLSWFLLHAARYLPPQLF

SEQ ID NO: 737406 - protein, 17 aa, Mycobacterium
TFNVARELGQHASPGDR

SEQ ID NO: 737407 - protein, 21 aa, Mycobacterium
TFPARLARGRGIPPLDRLQYL

SEQ ID NO: 737408 - protein, 24 aa, Mycobacterium
TFPDRLDVWPAYALKITPKPHLQA

SEQ ID NO: 737409 - protein, 19 aa, Mycobacterium
TFPEFPLPLGNPAEATNST

SEQ ID NO: 737410 - protein, 18 aa, Mycobacterium
TFPGCQGPYLVDVGFGGM

SEQ ID NO: 737411 - protein, 24 aa, Mycobacterium
TFPLDEVRSAYELLERQHTRGKIV

SEQ ID NO: 737412 - protein, 17 aa, Mycobacterium
TFQCAYHGWVYKSDGSF

SEQ ID NO: 737413 - protein, 19 aa, Mycobacterium
TFQNIRLFGEMTALENVAV

SEQ ID NO: 737414 - protein, 20 aa, Mycobacterium
TFQRFAENLVFDRAPRLARH

SEQ ID NO: 737415 - protein, 23 aa, Mycobacterium
TFQRLWYQVGTNIGHYHSYPRLV

SEQ ID NO: 737416 - protein, 23 aa, Mycobacterium
TFRDDAWRFATFLAAQPAFTRPV

SEQ ID NO: 737417 - protein, 19 aa, Mycobacterium
TFRDGWLHTGDMAREDEDG

SEQ ID NO: 737418 - protein, 20 aa, Mycobacterium
TFREALRLGHNYIGTEHMLL

SEQ ID NO: 737419 - protein, 24 aa, Mycobacterium
TFRELRQSCLRESAMMLLITRSMS

SEQ ID NO: 737420 - protein, 25 aa, Mycobacterium
TFRFNEVIHYWALDDDWDCFENHYP

SEQ ID NO: 737421 - protein, 25 aa, Mycobacterium
TFRFNEVIHYWALDGGWDCFAEHYP

SEQ ID NO: 737422 - protein, 25 aa, Mycobacterium
TFRFNEVIHYWALEGDWACFENHYP

SEQ ID NO: 737423 - protein, 30 aa, Mycobacterium
TFRFWFIGERWEWSDEVARMHGYEPGSVEP

SEQ ID NO: 737424 - protein, 24 aa, Mycobacterium
TFRGCEGDALLMLLDANGIECSTG

SEQ ID NO: 737425 - protein, 25 aa, Mycobacterium
TFRGCEGDALLMLLDANGIECSTGS

SEQ ID NO: 737426 - protein, 22 aa, Mycobacterium
TFRGDLLAVLRAWAQLFTGDTG

SEQ ID NO: 737427 - protein, 22 aa, Mycobacterium
TFRGLRGSFDLILNTVSANLNL

SEQ ID NO: 737428 - protein, 19 aa, Mycobacterium
TFRGRFRDVADLAFQPKPV

SEQ ID NO: 737429 - protein, 24 aa, Mycobacterium
TFRIGRLGVPVIAEFTSPEPRTLV

SEQ ID NO: 737430 - protein, 26 aa, Mycobacterium
TFRKFKEWLADSAIGTFFSQTLPGFL

SEQ ID NO: 737431 - protein, 20 aa, Mycobacterium
TFRKHRERLAAVAIVASKPA

SEQ ID NO: 737432 - protein, 21 aa, Mycobacterium
TFRLIDKVFTGWNVEYTPVAL

SEQ ID NO: 737433 - protein, 20 aa, Mycobacterium
TFRLIDKVFTQWGVRYTPVA

SEQ ID NO: 737434 - protein, 21 aa, Mycobacterium
TFRLPPYGRYTLRTYFRPDVT

SEQ ID NO: 737435 - protein, 22 aa, Mycobacterium
TFRRRCCRAPDPAALRTQGVRP

SEQ ID NO: 737436 - protein, 24 aa, Mycobacterium
TFRVDGWGDPVATWRHNVAAKLEA

SEQ ID NO: 737437 - protein, 25 aa, Mycobacterium
TFRVDGWSDPIATWRHHVIAKLDAG

SEQ ID NO: 737438 - protein, 25 aa, Mycobacterium
TFRYNEVIHYWALDGGWECFANHYP

SEQ ID NO: 737439 - protein, 28 aa, Mycobacterium
TFSEAFDADFFAAWGKLAAVRTPTIAAV

SEQ ID NO: 737440 - protein, 31 aa, Mycobacterium
TFSEAVERIRCAAGAFAGLGIDKGDRVAIWA

SEQ ID NO: 737441 - protein, 23 aa, Mycobacterium
TFSEAYKVAALDVMNKIRALNQF

SEQ ID NO: 737442 - protein, 23 aa, Mycobacterium
TFSEAYKVAALDVMNKLRALSRF

SEQ ID NO: 737443 - protein, 24 aa, Mycobacterium
TFSFIDIPAAPGFGNTTATPSSGF

SEQ ID NO: 737444 - protein, 28 aa, Mycobacterium
TFSKAYGLAGLRIGYGFCAPQLARQLWT

SEQ ID NO: 737445 - protein, 17 aa, Mycobacterium
TFSPAPPREAMGEWAST

SEQ ID NO: 737446 - protein, 23 aa, Mycobacterium
TFSRDLVDYWLFVIDVAGGDDIP

SEQ ID NO: 737447 - protein, 22 aa, Mycobacterium
TFSRIPVMASFAPYELHFDNVR

SEQ ID NO: 737448 - protein, 17 aa, Mycobacterium
TFSSTYIRSCVDAGDVV

SEQ ID NO: 737449 - protein, 27 aa, Mycobacterium
TFTEYRPDGTWIDRGGAWIGPGQDRIY

SEQ ID NO: 737450 - protein, 20 aa, Mycobacterium
TFTGGHDWLAANGISVTVLD

SEQ ID NO: 737451 - protein, 19 aa, Mycobacterium
TFTGGHEWLAQHGVTVTVV

SEQ ID NO: 737452 - protein, 24 aa, Mycobacterium
TFTPAECRLPSMFEPSAPVDASKL

SEQ ID NO: 737453 - protein, 22 aa, Mycobacterium
TFTPKHMGVMFGAPGGDYCHGL

SEQ ID NO: 737454 - protein, 23 aa, Mycobacterium
TFTPRHMGVMFGAPGGDYCHGLL

SEQ ID NO: 737455 - protein, 24 aa, Mycobacterium
TFTPRMREVIILRVAHLQDSPYEL

SEQ ID NO: 737456 - protein, 18 aa, Mycobacterium
TFTTLVIRQAGGFGGVPG

SEQ ID NO: 737457 - protein, 23 aa, Mycobacterium
TFTVPADTSVTVYGEHGSPITQS

SEQ ID NO: 737458 - protein, 23 aa, Mycobacterium
TFVAEPRVRFHIGSFSEEVARMG

SEQ ID NO: 737459 - protein, 19 aa, Mycobacterium
TFVDLCVSFTCTGGAVDEK

SEQ ID NO: 737460 - protein, 18 aa, Mycobacterium
TFVEEALRMDAPVKSQFR

SEQ ID NO: 737461 - protein, 18 aa, Mycobacterium
TFVGLALSVCAQAPLEPV

SEQ ID NO: 737462 - protein, 20 aa, Mycobacterium
TFVISWEFDLANGRWTHSGA

SEQ ID NO: 737463 - protein, 25 aa, Mycobacterium
TFVLATGRPPRWIQPVVDGLGLAPM

SEQ ID NO: 737464 - protein, 19 aa, Mycobacterium
TFVNLIWRNLASIPGALRW

SEQ ID NO: 737465 - protein, 19 aa, Mycobacterium
TFVPMGWPDAKVAVVIDDD

SEQ ID NO: 737466 - protein, 24 aa, Mycobacterium
TFVTMKLPSSMVFDGKDGSKDRTD

SEQ ID NO: 737467 - protein, 20 aa, Mycobacterium
TFYASIAHLCVDPMIVGVLF

SEQ ID NO: 737468 - protein, 20 aa, Mycobacterium
TFYWAHATFFMLVIKVAEYF

SEQ ID NO: 737469 - protein, 19 aa, Mycobacterium
TFYWAHATFFMLVVKVAEY

SEQ ID NO: 737470 - protein, 25 aa, Mycobacterium
TGAAARMGHRLTIVMDAWTISVDGP

SEQ ID NO: 737471 - protein, 25 aa, Mycobacterium
TGAAGAMANCNWIDDDCATRGGTGG

SEQ ID NO: 737472 - protein, 25 aa, Mycobacterium
TGAAGAPGGWLLGDGGAGGSGAPGK

SEQ ID NO: 737473 - protein, 24 aa, Mycobacterium
TGAAGGDGGWLFGDGGSGGAGGAG

SEQ ID NO: 737474 - protein, 25 aa, Mycobacterium
TGAALLPVHCWFDGDGWGFEVFPPL

SEQ ID NO: 737475 - protein, 24 aa, Mycobacterium
TGAARPAQIAAFAVAMTMKVPTAE

SEQ ID NO: 737476 - protein, 37 aa, Mycobacterium
TGADALASILSWHRWEELFELARFVGVSRPGYDLRHD

SEQ ID NO: 737477 - protein, 23 aa, Mycobacterium
TGADARGPALLMIDRRPDVWHVR

SEQ ID NO: 737478 - protein, 25 aa, Mycobacterium
TGADELRARLRLAVGRRRGTADGIL

SEQ ID NO: 737479 - protein, 19 aa, Mycobacterium
TGADFTSKEDFAFDLSARN

SEQ ID NO: 737480 - protein, 24 aa, Mycobacterium
TGADGGAAGWLIGNGGAGGSGTPG

SEQ ID NO: 737481 - protein, 24 aa, Mycobacterium
TGADGGAGGLLWGNGGNGGSGAAG

SEQ ID NO: 737482 - protein, 19 aa, Mycobacterium
TGADIAAAVGFLCSEEARY

SEQ ID NO: 737483 - protein, 20 aa, Mycobacterium
TGAEFARRRGLEMSALTERF

SEQ ID NO: 737484 - protein, 26 aa, Mycobacterium
TGAEGIAGIHLEGPWLSPQYAGAHDP

SEQ ID NO: 737485 - protein, 19 aa, Mycobacterium
TGAFDRLVALVRSTAGDER

SEQ ID NO: 737486 - protein, 20 aa, Mycobacterium
TGAGELDLVLAILRARQLFG

SEQ ID NO: 737487 - protein, 24 aa, Mycobacterium
TGAGGGLGRSYAHFLAGNGALVVV

SEQ ID NO: 737488 - protein, 22 aa, Mycobacterium
TGAGGMSGLLLGLDGYNAPTST

SEQ ID NO: 737489 - protein, 24 aa, Mycobacterium
TGAGGYFCAGMDLKAATKRPPGES

SEQ ID NO: 737490 - protein, 24 aa, Mycobacterium
TGAGGYFCAGMDLKAATQKPPGES

SEQ ID NO: 737491 - protein, 20 aa, Mycobacterium
TGAGLPLPHLLVAATAATVT

SEQ ID NO: 737492 - protein, 18 aa, Mycobacterium
TGAGLVRAMSLPGAGGTA

SEQ ID NO: 737493 - protein, 18 aa, Mycobacterium
TGAICRPGAGPMSLTGQP

SEQ ID NO: 737494 - protein, 21 aa, Mycobacterium
TGAISAGVMKRCAQVMYRFAS

SEQ ID NO: 737495 - protein, 25 aa, Mycobacterium
TGAIVKRPRIIIDEFGNESIGVRSV

SEQ ID NO: 737496 - protein, 25 aa, Mycobacterium
TGAIVKRPRVIVDEFGNESIGVRSV

SEQ ID NO: 737497 - protein, 24 aa, Mycobacterium
TGAIVKRPRVIVDEYGNESIGVRS

SEQ ID NO: 737498 - protein, 23 aa, Mycobacterium
TGAIVKRPRVIVDSFGNESIGVR

SEQ ID NO: 737499 - protein, 23 aa, Mycobacterium
TGAIVKRPRVVVDDTGNESIGVR

SEQ ID NO: 737500 - protein, 25 aa, Mycobacterium
TGALFQFLAPQGMRSLGTALLTALQ

SEQ ID NO: 737501 - protein, 19 aa, Mycobacterium
TGALFSRRVTSMARELDQL

SEQ ID NO: 737502 - protein, 19 aa, Mycobacterium
TGALGRLVARQLIAAGHTV

SEQ ID NO: 737503 - protein, 18 aa, Mycobacterium
TGALKAWFDVHTESVLFV

SEQ ID NO: 737504 - protein, 18 aa, Mycobacterium
TGALKVAMDVSDRESVQS

SEQ ID NO: 737505 - protein, 18 aa, Mycobacterium
TGALPDRYARGWHCLGPV

SEQ ID NO: 737506 - protein, 26 aa, Mycobacterium
TGALPDRYARGWHCLGPVKNFSDGKP

SEQ ID NO: 737507 - protein, 25 aa, Mycobacterium
TGALRAAGLPEEWSPDSESSREVVR

SEQ ID NO: 737508 - protein, 24 aa, Mycobacterium
TGAMKFADFDGAWKYFYHDCDEET

SEQ ID NO: 737509 - protein, 32 aa, Mycobacterium
TGAMYRIVTLWVLRAGVDLTDPAAIAAATDQV

SEQ ID NO: 737510 - protein, 25 aa, Mycobacterium
TGANGGAAGWLLGDGGAGGSGGLEQ

SEQ ID NO: 737511 - protein, 23 aa, Mycobacterium
TGAPGGDGGILFGSGGAGGSGAG

SEQ ID NO: 737512 - protein, 24 aa, Mycobacterium
TGAPGGPGGYLFGNGGAGGSGAPG

SEQ ID NO: 737513 - protein, 24 aa, Mycobacterium
TGAPGRAWLFFGARNRALDFLYAD

SEQ ID NO: 737514 - protein, 33 aa, Mycobacterium
TGAPLFPAHCWFDGDGWGCAVYEPIDTSSSDVS

SEQ ID NO: 737515 - protein, 19 aa, Mycobacterium
TGAPLPFGADTVVPVESTD

SEQ ID NO: 737516 - protein, 21 aa, Mycobacterium
TGAPPRPAIKTYLAAYRGQEQ

SEQ ID NO: 737517 - protein, 20 aa, Mycobacterium
TGAPTRFRSGWINGVVALPA

SEQ ID NO: 737518 - protein, 25 aa, Mycobacterium
TGAQLPLTMGHEFSGTITAVGDGVT

SEQ ID NO: 737519 - protein, 17 aa, Mycobacterium
TGARCLLAAGAGCVAVT

SEQ ID NO: 737520 - protein, 27 aa, Mycobacterium
TGARFAFVCAVDMPLLSASLIDDLIGL

SEQ ID NO: 737521 - protein, 24 aa, Mycobacterium
TGARLNKLLAPFGVRRTVQAGRGY

SEQ ID NO: 737522 - protein, 31 aa, Mycobacterium
TGARLSPTFGARGWAPQGYYFTDPDGNVIEA

SEQ ID NO: 737523 - protein, 20 aa, Mycobacterium
TGARPRRWVRQTNFDNDEAV

SEQ ID NO: 737524 - protein, 27 aa, Mycobacterium
TGARQGEIIGMEWDRCDLEKGLFDFSW

SEQ ID NO: 737525 - protein, 22 aa, Mycobacterium
TGARRLCEWAGCAFLGEHQMSN

SEQ ID NO: 737526 - protein, 23 aa, Mycobacterium
TGARSISALVAWKTGASERNAKA

SEQ ID NO: 737527 - protein, 24 aa, Mycobacterium
TGARSVAALLAWKLGSSSTNAHTF

SEQ ID NO: 737528 - protein, 18 aa, Mycobacterium
TGARSVAALVAWKLGCSP

SEQ ID NO: 737529 - protein, 18 aa, Mycobacterium
TGASCPPGVVGELVNVAG

SEQ ID NO: 737530 - protein, 26 aa, Mycobacterium
TGASPRFLLDFSRRFPDATLVRLERD

SEQ ID NO: 737531 - protein, 26 aa, Mycobacterium
TGASPRFLLDFSRRFPDATVVRLERD

SEQ ID NO: 737532 - protein, 26 aa, Mycobacterium
TGASPRFLLDFSRRYPDATVVRLERD

SEQ ID NO: 737533 - protein, 26 aa, Mycobacterium
TGASPRFLLEFSRSFPDATVVRLERD

SEQ ID NO: 737534 - protein, 26 aa, Mycobacterium
TGASPRYLLDFSRRFPEVTLVRLERD

SEQ ID NO: 737535 - protein, 24 aa, Mycobacterium
TGASVRLHPRFDVDRMLYHIGNDR

SEQ ID NO: 737536 - protein, 28 aa, Mycobacterium
TGATDPVPECLATRATVAAEAAALTRAA

SEQ ID NO: 737537 - protein, 18 aa, Mycobacterium
TGATFVFVEQWADADALK

SEQ ID NO: 737538 - protein, 21 aa, Mycobacterium
TGATIARVRIDSADTASPAST

SEQ ID NO: 737539 - protein, 18 aa, Mycobacterium
TGATLDWSAVFDHTPAQR

SEQ ID NO: 737540 - protein, 26 aa, Mycobacterium
TGATPRYLLDFSRRFPDAAVVRLERD

SEQ ID NO: 737541 - protein, 19 aa, Mycobacterium
TGAVADGWQERLFALFWPI

SEQ ID NO: 737542 - protein, 35 aa, Mycobacterium
TGAVEGWMPFGRVFETLAWGRRHVVMGANQVDRFG

SEQ ID NO: 737543 - protein, 36 aa, Mycobacterium
TGAVEGWMPFGRVFETLAWGRRHVVMGANQVDRYGN

SEQ ID NO: 737544 - protein, 24 aa, Mycobacterium
TGAVFPLLGGVIDFADYPRMLLAE

SEQ ID NO: 737545 - protein, 25 aa, Mycobacterium
TGAVLSRYVDAIVWRTFAQERLTAM

SEQ ID NO: 737546 - protein, 32 aa, Mycobacterium
TGAWASVVPHTWLRAVPQLGAARAVRLIEPET

SEQ ID NO: 737547 - protein, 18 aa, Mycobacterium
TGAWIRLHRRFDIDAMLR

SEQ ID NO: 737548 - protein, 18 aa, Mycobacterium
TGAYAAAMTLSFLTRRHR

SEQ ID NO: 737549 - protein, 20 aa, Mycobacterium
TGCADAFRAGYIDVNQFTLA

SEQ ID NO: 737550 - protein, 22 aa, Mycobacterium
TGCAGEGIFARLIPVDYASHSS

SEQ ID NO: 737551 - protein, 18 aa, Mycobacterium
TGCAKAFRDGYIDINQFT

SEQ ID NO: 737552 - protein, 20 aa, Mycobacterium
TGCANAFRVGYIDVNQFTLA

SEQ ID NO: 737553 - protein, 20 aa, Mycobacterium
TGCANGFRVGYIDVNQFTLA

SEQ ID NO: 737554 - protein, 21 aa, Mycobacterium
TGCGKRKLAAVWLSTDGNTSL

SEQ ID NO: 737555 - protein, 18 aa, Mycobacterium
TGCGSAKRFTCPYHAWTY

SEQ ID NO: 737556 - protein, 27 aa, Mycobacterium
TGCKPEAGLKVARRFAHLTYRGEIELD

SEQ ID NO: 737557 - protein, 18 aa, Mycobacterium
TGCRQFCTPLGSGVHHHH

SEQ ID NO: 737558 - protein, 17 aa, Mycobacterium
TGCSSKSAFRQWRRRGR

SEQ ID NO: 737559 - protein, 19 aa, Mycobacterium
TGCTRSELIAMLRMLDATG

SEQ ID NO: 737560 - protein, 23 aa, Mycobacterium
TGDAELLMLGWGSSYGPIGEACR

SEQ ID NO: 737561 - protein, 27 aa, Mycobacterium
TGDDRVASLFLWHFVEEVEHRSSALTI

SEQ ID NO: 737562 - protein, 26 aa, Mycobacterium
TGDDWVATGFPVEFLSLGTGGVGVPV

SEQ ID NO: 737563 - protein, 28 aa, Mycobacterium
TGDEGFRVGGWFGRIGTRDHEDWAAVGL

SEQ ID NO: 737564 - protein, 17 aa, Mycobacterium
TGDELRWNVPTLYGHVI

SEQ ID NO: 737565 - protein, 23 aa, Mycobacterium
TGDFPARIVAVGTDRPCPALDIA

SEQ ID NO: 737566 - protein, 21 aa, Mycobacterium
TGDGDWSLWVPEVGAVDARAC

SEQ ID NO: 737567 - protein, 17 aa, Mycobacterium
TGDGIMAVFGAPAALED

SEQ ID NO: 737568 - protein, 22 aa, Mycobacterium
TGDGMGIVFRRGLPLEDMEFHQ

SEQ ID NO: 737569 - protein, 20 aa, Mycobacterium
TGDGQFGIGGFNSGTGNIGL

SEQ ID NO: 737570 - protein, 30 aa, Mycobacterium
TGDGRSGRGRPCRGRRGPTGRGRRRDAGRR

SEQ ID NO: 737571 - protein, 21 aa, Mycobacterium
TGDGYIVNGAWQWSSGSEHAT

SEQ ID NO: 737572 - protein, 25 aa, Mycobacterium
TGDHAPLWLVEGVADYNGRRGSGTP

SEQ ID NO: 737573 - protein, 20 aa, Mycobacterium
TGDHRLRIIHELSSQSPVPA

SEQ ID NO: 737574 - protein, 25 aa, Mycobacterium
TGDILAMEALVRWQHPTRGLLSPES

SEQ ID NO: 737575 - protein, 18 aa, Mycobacterium
TGDLAAYLSVAWELSPQS

SEQ ID NO: 737576 - protein, 22 aa, Mycobacterium
TGDLDALMAMLAPDVVWTADSD

SEQ ID NO: 737577 - protein, 24 aa, Mycobacterium
TGDLELIPKLILPVNDIFITIIMG

SEQ ID NO: 737578 - protein, 20 aa, Mycobacterium
TGDLPALRRVLVINGSGPKA

SEQ ID NO: 737579 - protein, 25 aa, Mycobacterium
TGDLRVGDRVVIPFQISCGSCYMCG

SEQ ID NO: 737580 - protein, 17 aa, Mycobacterium
TGDLVCWGPDGQLQYVG

SEQ ID NO: 737581 - protein, 18 aa, Mycobacterium
TGDLVRWRADGQLDYLGR

SEQ ID NO: 737582 - protein, 17 aa, Mycobacterium
TGDLVSWGADGQLRHLG

SEQ ID NO: 737583 - protein, 23 aa, Mycobacterium
TGDMPIRLPCIGGHEGAGVVKAV

SEQ ID NO: 737584 - protein, 20 aa, Mycobacterium
TGDMPYRWSDTYGARFGLLR

SEQ ID NO: 737585 - protein, 28 aa, Mycobacterium
TGDNGLIPLRWALACLLADIGSTAHTLE

SEQ ID NO: 737586 - protein, 29 aa, Mycobacterium
TGDPICSGGTRWASHLGYVPTLTNQAARF

SEQ ID NO: 737587 - protein, 24 aa, Mycobacterium
TGDPVRILSPRTAQPGGLSTWLDP

SEQ ID NO: 737588 - protein, 18 aa, Mycobacterium
TGDRERTDVLALLLAARY

SEQ ID NO: 737589 - protein, 20 aa, Mycobacterium
TGDSRWLLYMQDTGGDEYFH

SEQ ID NO: 737590 - protein, 18 aa, Mycobacterium
TGDTSGYGRLVREIVLPG

SEQ ID NO: 737591 - protein, 18 aa, Mycobacterium
TGDVGLIIAVKRLGAAKT

SEQ ID NO: 737592 - protein, 25 aa, Mycobacterium
TGDVGWVDAGGWLRITDRLKEMIKV

SEQ ID NO: 737593 - protein, 21 aa, Mycobacterium
TGDVMLRYNFPGAGLSDDALR

SEQ ID NO: 737594 - protein, 19 aa, Mycobacterium
TGECAPVLHGHVADLFVVP

SEQ ID NO: 737595 - protein, 23 aa, Mycobacterium
TGEEFPVEPGVSLLEALERRGFD

SEQ ID NO: 737596 - protein, 26 aa, Mycobacterium
TGEGHHGVTMVTGWDEAVSVLNDAET

SEQ ID NO: 737597 - protein, 21 aa, Mycobacterium
TGEGYRCAGDIGYLDEDGYLY

SEQ ID NO: 737598 - protein, 22 aa, Mycobacterium
TGEIFIALAGRVARAVIAETPG

SEQ ID NO: 737599 - protein, 31 aa, Mycobacterium
TGEKFGTTGYCMGGRASLIVATRVPDRVAAA

SEQ ID NO: 737600 - protein, 21 aa, Mycobacterium
TGEKTEMYWAIRSYEIAVEEG

SEQ ID NO: 737601 - protein, 18 aa, Mycobacterium
TGELHAMMLDMRRTFDEM

SEQ ID NO: 737602 - protein, 19 aa, Mycobacterium
TGELHAMMLDMRRTFDEMV

SEQ ID NO: 737603 - protein, 28 aa, Mycobacterium
TGELPSWQWEGLIDKPTRLVAIASASST

SEQ ID NO: 737604 - protein, 30 aa, Mycobacterium
TGELVGLTGYCMGGRISLRVAATHASRVGA

SEQ ID NO: 737605 - protein, 22 aa, Mycobacterium
TGEMLVALAGRVATAVVAESPG

SEQ ID NO: 737606 - protein, 24 aa, Mycobacterium
TGENPRDVLVVFFPLAFTGVCEGE

SEQ ID NO: 737607 - protein, 22 aa, Mycobacterium
TGEPARLLSQFIHGIKTLPVAW

SEQ ID NO: 737608 - protein, 20 aa, Mycobacterium
TGEPCPPGRVGELVNPTGPG

SEQ ID NO: 737609 - protein, 22 aa, Mycobacterium
TGEPHWAPWYAGRPILVTANDY

SEQ ID NO: 737610 - protein, 19 aa, Mycobacterium
TGEPRRWANDPGDNSVVHF

SEQ ID NO: 737611 - protein, 22 aa, Mycobacterium
TGEPRVSPLYFHRDGDRVIVAA

SEQ ID NO: 737612 - protein, 17 aa, Mycobacterium
TGEPVLFIAGRGGAGRT

SEQ ID NO: 737613 - protein, 26 aa, Mycobacterium
TGEQLPAPGYVVWRAAANHFRLRRID

SEQ ID NO: 737614 - protein, 27 aa, Mycobacterium
TGEQMKMFLTRLGFGSKMVVTGDITQV

SEQ ID NO: 737615 - protein, 21 aa, Mycobacterium
TGERALLLGDFVRGFVGLDSY

SEQ ID NO: 737616 - protein, 24 aa, Mycobacterium
TGERGAWLWMRVGSDVLVDNAFRL

SEQ ID NO: 737617 - protein, 17 aa, Mycobacterium
TGERIRVSAWLPDDPYP

SEQ ID NO: 737618 - protein, 24 aa, Mycobacterium
TGERMRHGMYWSGDLAYRDADGWI

SEQ ID NO: 737619 - protein, 23 aa, Mycobacterium
TGERTLLAGSFVRNFVGLDSHES

SEQ ID NO: 737620 - protein, 20 aa, Mycobacterium
TGESRLLFRPLPQLDPSQLA

SEQ ID NO: 737621 - protein, 25 aa, Mycobacterium
TGESRSVLSGGYWADMAVTAERGLL

SEQ ID NO: 737622 - protein, 23 aa, Mycobacterium
TGEVAGAIALVVPAARWPLAPDA

SEQ ID NO: 737623 - protein, 19 aa, Mycobacterium
TGEVLGWEVLREICDADAM

SEQ ID NO: 737624 - protein, 22 aa, Mycobacterium
TGEVTPEFVGKVVNSADSAEYW

SEQ ID NO: 737625 - protein, 23 aa, Mycobacterium
TGEWDSWIRFFSRGVEASAIDTA

SEQ ID NO: 737626 - protein, 22 aa, Mycobacterium
TGEYLVAIAGRIGRAALVESPG

SEQ ID NO: 737627 - protein, 28 aa, Mycobacterium
TGFAGVSREHWLRCLEINLMGAYNVLDA

SEQ ID NO: 737628 - protein, 19 aa, Mycobacterium
TGFDFPFAAMGSVHVENHI

SEQ ID NO: 737629 - protein, 18 aa, Mycobacterium
TGFEDGLFAAWRNDPSFI

SEQ ID NO: 737630 - protein, 18 aa, Mycobacterium
TGFEDGLFAGWRTDPSFI

SEQ ID NO: 737631 - protein, 23 aa, Mycobacterium
TGFERFLPLLFAYDLPPIAEEMR

SEQ ID NO: 737632 - protein, 20 aa, Mycobacterium
TGFGEIFFDDVFVPDNDVIG

SEQ ID NO: 737633 - protein, 20 aa, Mycobacterium
TGFGEIFLDDVFVPDDDVIG

SEQ ID NO: 737634 - protein, 21 aa, Mycobacterium
TGFGEIFLDDVFVPDEDVIGT

SEQ ID NO: 737635 - protein, 20 aa, Mycobacterium
TGFGEIFLDDVFVPDQDVIG

SEQ ID NO: 737636 - protein, 17 aa, Mycobacterium
TGFIGRRIVTRILETQP

SEQ ID NO: 737637 - protein, 23 aa, Mycobacterium
TGFKGPWLALLLLSRGHQVSGLA

SEQ ID NO: 737638 - protein, 19 aa, Mycobacterium
TGFLGRYLALQWLEQMELV

SEQ ID NO: 737639 - protein, 24 aa, Mycobacterium
TGFLVAGLNRYRVLDDAYRGFVAL

SEQ ID NO: 737640 - protein, 24 aa, Mycobacterium
TGFMPARLDGILGDLYHDLVLEDG

SEQ ID NO: 737641 - protein, 17 aa, Mycobacterium
TGFPNFYCMFGPGTNAV

SEQ ID NO: 737642 - protein, 22 aa, Mycobacterium
TGFPQHRRAYAWWHDTVNSQER

SEQ ID NO: 737643 - protein, 21 aa, Mycobacterium
TGFPVTVRGLSRFTDPASSRA

SEQ ID NO: 737644 - protein, 38 aa, Mycobacterium
TGFVGATSRPSALTLDDVVKFLLPRGATKKAAKGAATT

SEQ ID NO: 737645 - protein, 20 aa, Mycobacterium
TGGAARLFGSGGSGGTGGVG

SEQ ID NO: 737646 - protein, 35 aa, Mycobacterium
TGGAGAPGIDGAALGEGGTNGYIGGNGGNGGAGGA

SEQ ID NO: 737647 - protein, 20 aa, Mycobacterium
TGGAGARLAGGAGGTGGAGG

SEQ ID NO: 737648 - protein, 24 aa, Mycobacterium
TGGAGGAARWFGDGGTGGTGSQAG

SEQ ID NO: 737649 - protein, 26 aa, Mycobacterium
TGGAGGAGGWLFGPGGVGGAGGSSSS

SEQ ID NO: 737650 - protein, 24 aa, Mycobacterium
TGGAGGAGWDATAAGVLAATGGDG

SEQ ID NO: 737651 - protein, 24 aa, Mycobacterium
TGGAGGHGGLWGNGGDGGTGGQGA

SEQ ID NO: 737652 - protein, 26 aa, Mycobacterium
TGGAGGRGGLLWGNAGISGPGLDGRT

SEQ ID NO: 737653 - protein, 19 aa, Mycobacterium
TGGAGGWAAAGATGGIGGQ

SEQ ID NO: 737654 - protein, 18 aa, Mycobacterium
TGGAGGWGGTDEITGGTG

SEQ ID NO: 737655 - protein, 20 aa, Mycobacterium
TGGAGGWLSGTGGAGGSGGP

SEQ ID NO: 737656 - protein, 27 aa, Mycobacterium
TGGAMLPVLIFAAARAGVAFTPINYRL

SEQ ID NO: 737657 - protein, 25 aa, Mycobacterium
TGGAPGDFLSAGGHFQAPGHAAEPA

SEQ ID NO: 737658 - protein, 23 aa, Mycobacterium
TGGAPGNFLSAGGHYQAPGHTGK

SEQ ID NO: 737659 - protein, 19 aa, Mycobacterium
TGGARLTFRATVQVRVPII

SEQ ID NO: 737660 - protein, 21 aa, Mycobacterium
TGGAVPAIIAEYLGLPQLTHV

SEQ ID NO: 737661 - protein, 22 aa, Mycobacterium
TGGCSVILDGTWRDEEETGRAR

SEQ ID NO: 737662 - protein, 24 aa, Mycobacterium
TGGDGGRGGLLIGSGGNGGTGGTG

SEQ ID NO: 737663 - protein, 23 aa, Mycobacterium
TGGDLKTTFCLLGGDGRAHLSSH

SEQ ID NO: 737664 - protein, 17 aa, Mycobacterium
TGGDLVIVTAKADQLRQ

SEQ ID NO: 737665 - protein, 25 aa, Mycobacterium
TGGDRRLSNGFLWESAYSELLFLDE

SEQ ID NO: 737666 - protein, 24 aa, Mycobacterium
TGGDTGLDGLLGVPGSNGQTGEIV

SEQ ID NO: 737667 - protein, 23 aa, Mycobacterium
TGGEGGAGIGGKDGGTGGTGGTG

SEQ ID NO: 737668 - protein, 19 aa, Mycobacterium
TGGEGGRGGIGGAGDGSSG

SEQ ID NO: 737669 - protein, 19 aa, Mycobacterium
TGGEIIDLLARMRGGIDQD

SEQ ID NO: 737670 - protein, 23 aa, Mycobacterium
TGGEIRRLTILFADLVDATILST

SEQ ID NO: 737671 - protein, 22 aa, Mycobacterium
TGGEPRLPFADAAFDLVTSRHP

SEQ ID NO: 737672 - protein, 23 aa, Mycobacterium
TGGERRPVAFIAMTDPEKSPESS

SEQ ID NO: 737673 - protein, 24 aa, Mycobacterium
TGGETIDLLARMRGGIDKRRRAEL

SEQ ID NO: 737674 - protein, 24 aa, Mycobacterium
TGGETIDLLARMRGGIDRTRRAEL

SEQ ID NO: 737675 - protein, 20 aa, Mycobacterium
TGGETIDLLARMRGGVDEKL

SEQ ID NO: 737676 - protein, 17 aa, Mycobacterium
TGGFAEWIDRGRPAPPH

SEQ ID NO: 737677 - protein, 23 aa, Mycobacterium
TGGFTEFVPLPFVHQSAPLYLAG

SEQ ID NO: 737678 - protein, 20 aa, Mycobacterium
TGGGAPMMLPPGSMGPPAGP

SEQ ID NO: 737679 - protein, 18 aa, Mycobacterium
TGGGSEKALAAALPMVTW

SEQ ID NO: 737680 - protein, 28 aa, Mycobacterium
TGGHGGDSGFGWSGQVGSAGSGPNGVIG

SEQ ID NO: 737681 - protein, 25 aa, Mycobacterium
TGGHGGGGGNAFLRANGAGSSASGI

SEQ ID NO: 737682 - protein, 17 aa, Mycobacterium
TGGHGGLLIGNGGAGGI

SEQ ID NO: 737683 - protein, 17 aa, Mycobacterium
TGGIALAGINGGNPGSG

SEQ ID NO: 737684 - protein, 18 aa, Mycobacterium
TGGIGFGCAAKLAEMGMA

SEQ ID NO: 737685 - protein, 17 aa, Mycobacterium
TGGIGFGCATRLAEMGM

SEQ ID NO: 737686 - protein, 18 aa, Mycobacterium
TGGKRPEDGGSFYPPTVL

SEQ ID NO: 737687 - protein, 18 aa, Mycobacterium
TGGLFFSPTMDFLDDPPA

SEQ ID NO: 737688 - protein, 23 aa, Mycobacterium
TGGLGGLGLFLAERMAAAGCGRI

SEQ ID NO: 737689 - protein, 25 aa, Mycobacterium
TGGLGGLGLFLARKLAAAGVGRIIL

SEQ ID NO: 737690 - protein, 25 aa, Mycobacterium
TGGLGGLGLVVAKWLVDRGAGRVVL

SEQ ID NO: 737691 - protein, 26 aa, Mycobacterium
TGGLGGLGLVVARWLVDSGAGRVVLN

SEQ ID NO: 737692 - protein, 17 aa, Mycobacterium
TGGLLLVTHDRWFLDEV

SEQ ID NO: 737693 - protein, 19 aa, Mycobacterium
TGGMFVGLLAGEPVTGGAF

SEQ ID NO: 737694 - protein, 26 aa, Mycobacterium
TGGMFYGSGGVGGWGGNGGLDGGVGG

SEQ ID NO: 737695 - protein, 24 aa, Mycobacterium
TGGNGGAGGLIFGGGGAGGVGGLG

SEQ ID NO: 737696 - protein, 27 aa, Mycobacterium
TGGNGGRAALLIGFGGNGGNGGVGTAT

SEQ ID NO: 737697 - protein, 25 aa, Mycobacterium
TGGPGGYGDTGFGTAGYAGGTGGTG

SEQ ID NO: 737698 - protein, 25 aa, Mycobacterium
TGGPNIDAGGVLGAPGNSGAGGAGG

SEQ ID NO: 737699 - protein, 26 aa, Mycobacterium
TGGPRLKTLMSRTAGLSLHYVGGVPT

SEQ ID NO: 737700 - protein, 31 aa, Mycobacterium
TGGPRLKTLMSRTAGLSLHYVGRVPTHDATT

SEQ ID NO: 737701 - protein, 17 aa, Mycobacterium
TGGPRWSTSYDQSASDV

SEQ ID NO: 737702 - protein, 23 aa, Mycobacterium
TGGQGATSLFEASSGGTGGAGGA

SEQ ID NO: 737703 - protein, 24 aa, Mycobacterium
TGGQRIDLFGARVEQLPLIWKRLI

SEQ ID NO: 737704 - protein, 23 aa, Mycobacterium
TGGQRIDMFGARVDQLPEIWRRL

SEQ ID NO: 737705 - protein, 23 aa, Mycobacterium
TGGQRIDMFGARVEQLPEIWRRL

SEQ ID NO: 737706 - protein, 23 aa, Mycobacterium
TGGQSLEMVPGWSEIVKVVEKLD

SEQ ID NO: 737707 - protein, 18 aa, Mycobacterium
TGGRGGNAGLLFSSAGAG

SEQ ID NO: 737708 - protein, 21 aa, Mycobacterium
TGGRIPREYIPSVDAGAQDAM

SEQ ID NO: 737709 - protein, 22 aa, Mycobacterium
TGGRIPWDIGGPQPAVQQLVAY

SEQ ID NO: 737710 - protein, 28 aa, Mycobacterium
TGGRLPITYSRKVFIPVTHLCRDTCHYC

SEQ ID NO: 737711 - protein, 26 aa, Mycobacterium
TGGRPRRLPVPGPRPELVHYLRTLDD

SEQ ID NO: 737712 - protein, 17 aa, Mycobacterium
TGGRRLHEHWGDDPCAY

SEQ ID NO: 737713 - protein, 22 aa, Mycobacterium
TGGRRRGFVVVRWLDNPQAPTV

SEQ ID NO: 737714 - protein, 19 aa, Mycobacterium
TGGRVGWNVVTGYLPAAAR

SEQ ID NO: 737715 - protein, 20 aa, Mycobacterium
TGGRVPREYIPSVDAGAQDA

SEQ ID NO: 737716 - protein, 25 aa, Mycobacterium
TGGSGGHSGLLIGDGGSGGSGGNGG

SEQ ID NO: 737717 - protein, 18 aa, Mycobacterium
TGGSNVRPLLAGPDRAEK

SEQ ID NO: 737718 - protein, 24 aa, Mycobacterium
TGGTAHLGPLAIHGQSGDPGQSGP

SEQ ID NO: 737719 - protein, 22 aa, Mycobacterium
TGGTGGLLWGNGGIGGQGGTAM

SEQ ID NO: 737720 - protein, 25 aa, Mycobacterium
TGGTGQGGISFLAPGGQTGGDGSTG

SEQ ID NO: 737721 - protein, 21 aa, Mycobacterium
TGGTPALAHRLVPTAATPTLT

SEQ ID NO: 737722 - protein, 23 aa, Mycobacterium
TGGTSFARWSAMLEEYAQRPEVV

SEQ ID NO: 737723 - protein, 20 aa, Mycobacterium
TGGTSGFLLGLDGFNASGST

SEQ ID NO: 737724 - protein, 24 aa, Mycobacterium
TGGVARRGLPMITDSFQYPIEGFT

SEQ ID NO: 737725 - protein, 25 aa, Mycobacterium
TGGVGGSGGMLFGNGGAGGNGGTAM

SEQ ID NO: 737726 - protein, 21 aa, Mycobacterium
TGGVVKPILWGPGKAAAVQRF

SEQ ID NO: 737727 - protein, 22 aa, Mycobacterium
TGGYPPREIQGFYTRDQLELLI

SEQ ID NO: 737728 - protein, 24 aa, Mycobacterium
TGHEIARWTAAMIASGERLDFSDL

SEQ ID NO: 737729 - protein, 21 aa, Mycobacterium
TGHGFLDWPPGARERTAARLS

SEQ ID NO: 737730 - protein, 23 aa, Mycobacterium
TGHGRCYTLAPGVFDADEVGHSI

SEQ ID NO: 737731 - protein, 24 aa, Mycobacterium
TGHGRIAICGARATRSFPNRRRAA

SEQ ID NO: 737732 - protein, 18 aa, Mycobacterium
TGHLIHALFCDPHLEELS

SEQ ID NO: 737733 - protein, 17 aa, Mycobacterium
TGHLRLRADDGTDRAWT

SEQ ID NO: 737734 - protein, 18 aa, Mycobacterium
TGHMLSQAILRSARRHEA

SEQ ID NO: 737735 - protein, 25 aa, Mycobacterium
TGHRALDITGRWQAMVRAMRNNGRP

SEQ ID NO: 737736 - protein, 19 aa, Mycobacterium
TGHTAEYFTRMLAGLGDAL

SEQ ID NO: 737737 - protein, 20 aa, Mycobacterium
TGHTAEYFTRMMAGLGDELG

SEQ ID NO: 737738 - protein, 20 aa, Mycobacterium
TGHTAEYFTRMMAGLGDEMG

SEQ ID NO: 737739 - protein, 19 aa, Mycobacterium
TGHWLRPGDHLVLTIDGIG

SEQ ID NO: 737740 - protein, 24 aa, Mycobacterium
TGHWLRPGDTLTLILDDIGRIEHT

SEQ ID NO: 737741 - protein, 30 aa, Mycobacterium
TGIALAMVCAARGYRCVLTMPDTMSTERRM

SEQ ID NO: 737742 - protein, 25 aa, Mycobacterium
TGIARRSGDTGAMQMHWRSAMDVLA

SEQ ID NO: 737743 - protein, 25 aa, Mycobacterium
TGIAVLRWFDEPVISKETLVDELVV

SEQ ID NO: 737744 - protein, 31 aa, Mycobacterium
TGIDPAAVSPWWMQRRLLLSGIRAISPAVDV

SEQ ID NO: 737745 - protein, 25 aa, Mycobacterium
TGIDPGAVSPWWLQRRLLMCGMRVT

SEQ ID NO: 737746 - protein, 17 aa, Mycobacterium
TGIDVSWNDDRDLWWHD

SEQ ID NO: 737747 - protein, 35 aa, Mycobacterium
TGIEFPGVRLSERFLLADIHLDWAVDRAGTTGWIH

SEQ ID NO: 737748 - protein, 21 aa, Mycobacterium
TGIEIAEQFELPPALQAAWHT

SEQ ID NO: 737749 - protein, 21 aa, Mycobacterium
TGIEIAESFAMPPALENAWHA

SEQ ID NO: 737750 - protein, 19 aa, Mycobacterium
TGIELDPTWMFDVQVKRIH

SEQ ID NO: 737751 - protein, 17 aa, Mycobacterium
TGIGLSVARLVTAAGGD

SEQ ID NO: 737752 - protein, 17 aa, Mycobacterium
TGIGRRDFLRAVAAVSA

SEQ ID NO: 737753 - protein, 28 aa, Mycobacterium
TGIGSCRDSAWLLVSILRQFGLAARFVS

SEQ ID NO: 737754 - protein, 27 aa, Mycobacterium
TGIGSCRDSAWLLVSILRQLGLAARFV

SEQ ID NO: 737755 - protein, 18 aa, Mycobacterium
TGIGSFWLGHGSGESAAN

SEQ ID NO: 737756 - protein, 17 aa, Mycobacterium
TGIGSWPGTAARPAAEV

SEQ ID NO: 737757 - protein, 19 aa, Mycobacterium
TGIIPRVRFRFKDFQIVED

SEQ ID NO: 737758 - protein, 18 aa, Mycobacterium
TGILDGWLIHEGDHADID

SEQ ID NO: 737759 - protein, 17 aa, Mycobacterium
TGILVNAIIGQKRVGDY

SEQ ID NO: 737760 - protein, 23 aa, Mycobacterium
TGIPADLLTDWARRSRRSPGGGA

SEQ ID NO: 737761 - protein, 17 aa, Mycobacterium
TGIPAFKAPFEPLTPGG

SEQ ID NO: 737762 - protein, 18 aa, Mycobacterium
TGIPAFKAPFEPLVPGGF

SEQ ID NO: 737763 - protein, 17 aa, Mycobacterium
TGIPIPGPGFINLANEL

SEQ ID NO: 737764 - protein, 17 aa, Mycobacterium
TGIPREGGHIGRVTEAW

SEQ ID NO: 737765 - protein, 20 aa, Mycobacterium
TGIPVCLWFFAMDKKAGCQG

SEQ ID NO: 737766 - protein, 23 aa, Mycobacterium
TGIPVTVKFRIGIDDAHHTHLDA

SEQ ID NO: 737767 - protein, 18 aa, Mycobacterium
TGIQAAGSVDAFFDRRLD

SEQ ID NO: 737768 - protein, 26 aa, Mycobacterium
TGIRKLAWPKLKAHYGDRLEQMYAEL

SEQ ID NO: 737769 - protein, 21 aa, Mycobacterium
TGIRKLAWPKLKQHYGERLEQ

SEQ ID NO: 737770 - protein, 18 aa, Mycobacterium
TGIRLRDKHLLSADFFEV

SEQ ID NO: 737771 - protein, 17 aa, Mycobacterium
TGISKASGIAIVAKQAG

SEQ ID NO: 737772 - protein, 17 aa, Mycobacterium
TGITYSWETVRRLVQMR

SEQ ID NO: 737773 - protein, 26 aa, Mycobacterium
TGIVSRGGAVIADWCLLHNAESFLYA

SEQ ID NO: 737774 - protein, 29 aa, Mycobacterium
TGIVSRGGSIMAAWCLAHHRESFLYTHFD

SEQ ID NO: 737775 - protein, 29 aa, Mycobacterium
TGIVSRGGSIMAAWCLAHHRESFLYTHFE

SEQ ID NO: 737776 - protein, 27 aa, Mycobacterium
TGIVSRGGSIMAAWMLAHHTESFLYTH

SEQ ID NO: 737777 - protein, 18 aa, Mycobacterium
TGIYGGVNPCQWAASDGV

SEQ ID NO: 737778 - protein, 25 aa, Mycobacterium
TGIYGHSRACAWAVRDGVIGSSTTP

SEQ ID NO: 737779 - protein, 24 aa, Mycobacterium
TGKAEKCTLCYPRIEVGMPTVCSE

SEQ ID NO: 737780 - protein, 24 aa, Mycobacterium
TGKAEKCTMCYPRIEVGLPTVCSE

SEQ ID NO: 737781 - protein, 26 aa, Mycobacterium
TGKAELWPDLNLGLPFTYHQGYQSSP

SEQ ID NO: 737782 - protein, 27 aa, Mycobacterium
TGKDGLKRWNQIGTIVGKSWDSVIDAI

SEQ ID NO: 737783 - protein, 17 aa, Mycobacterium
TGKEAFVARARELAAKY

SEQ ID NO: 737784 - protein, 25 aa, Mycobacterium
TGKFEWLDDNVVQWVPDRFWPAHST

SEQ ID NO: 737785 - protein, 26 aa, Mycobacterium
TGKFEWLDNKVVQWVPDRYWPAHSTI

SEQ ID NO: 737786 - protein, 25 aa, Mycobacterium
TGKFEWLDNNVVQWVPSHYWPAHST

SEQ ID NO: 737787 - protein, 24 aa, Mycobacterium
TGKIRPSMLEFMDSVAINAVEDKL

SEQ ID NO: 737788 - protein, 25 aa, Mycobacterium
TGKLAELGELRWREGAAVTVVLAAE

SEQ ID NO: 737789 - protein, 24 aa, Mycobacterium
TGKLHPLHILQFLSNTDKHQLLNI

SEQ ID NO: 737790 - protein, 20 aa, Mycobacterium
TGKPHGWIHNELRRICGGPP

SEQ ID NO: 737791 - protein, 21 aa, Mycobacterium
TGKPPFLLDSHRPRVSLADFR

SEQ ID NO: 737792 - protein, 23 aa, Mycobacterium
TGKPVRLASEFDVPGSIDNVEFF

SEQ ID NO: 737793 - protein, 18 aa, Mycobacterium
TGKRLGATINDMVLAMSA

SEQ ID NO: 737794 - protein, 23 aa, Mycobacterium
TGKRLPVPLYPGFDTLGTLEYIT

SEQ ID NO: 737795 - protein, 25 aa, Mycobacterium
TGKTPAQVVLRWHIQRGDIVFPKSV

SEQ ID NO: 737796 - protein, 25 aa, Mycobacterium
TGLAAELRSAAAAFLAVTSGLTGNS

SEQ ID NO: 737797 - protein, 18 aa, Mycobacterium
TGLAAQWVSAGARIVGGC

SEQ ID NO: 737798 - protein, 17 aa, Mycobacterium
TGLAAVWLALRGLEVVG

SEQ ID NO: 737799 - protein, 31 aa, Mycobacterium
TGLAELWGTDVLYCPYCHGWEVRDQPIGVLA

SEQ ID NO: 737800 - protein, 17 aa, Mycobacterium
TGLAHAIHVPSTVFHAS

SEQ ID NO: 737801 - protein, 19 aa, Mycobacterium
TGLAIARRFAHLTYRGEVD

SEQ ID NO: 737802 - protein, 17 aa, Mycobacterium
TGLAIRVDQRLRETHLG

SEQ ID NO: 737803 - protein, 25 aa, Mycobacterium
TGLAKHLAVEWADRGIRVNAVAPGT

SEQ ID NO: 737804 - protein, 19 aa, Mycobacterium
TGLAQCSELTWQLRGTADK

SEQ ID NO: 737805 - protein, 19 aa, Mycobacterium
TGLARLALQTGVPVIPVAM

SEQ ID NO: 737806 - protein, 17 aa, Mycobacterium
TGLCVVPVMFDRIMELP

SEQ ID NO: 737807 - protein, 18 aa, Mycobacterium
TGLDAIDGHTLFPAVQLN

SEQ ID NO: 737808 - protein, 24 aa, Mycobacterium
TGLDEALRSWLAFGQEKVGEVVAL

SEQ ID NO: 737809 - protein, 21 aa, Mycobacterium
TGLDFPFAAMGSVHIENHITQ

SEQ ID NO: 737810 - protein, 20 aa, Mycobacterium
TGLDGLRNALWNIVDLKKQA

SEQ ID NO: 737811 - protein, 26 aa, Mycobacterium
TGLDLVRLQLLVAMGRPLPAEVSKPR

SEQ ID NO: 737812 - protein, 17 aa, Mycobacterium
TGLDRLGVEPTLEEAKE

SEQ ID NO: 737813 - protein, 22 aa, Mycobacterium
TGLDTWAAMGFGYAEVGTVTAH

SEQ ID NO: 737814 - protein, 23 aa, Mycobacterium
TGLEAHPAVLLFSHRSYIDGAVV

SEQ ID NO: 737815 - protein, 23 aa, Mycobacterium
TGLEFMACCAFAVLADEAKRCKE

SEQ ID NO: 737816 - protein, 23 aa, Mycobacterium
TGLEFMGCCAFAVLADEAKRCQK

SEQ ID NO: 737817 - protein, 17 aa, Mycobacterium
TGLELLYRMADFCRPDW

SEQ ID NO: 737818 - protein, 17 aa, Mycobacterium
TGLESTMRFILSAKSAY

SEQ ID NO: 737819 - protein, 21 aa, Mycobacterium
TGLESTMRFILSAKSAYVDGQ

SEQ ID NO: 737820 - protein, 17 aa, Mycobacterium
TGLGGVRVIGKVLDRAG

SEQ ID NO: 737821 - protein, 19 aa, Mycobacterium
TGLGMLTAFEEMFWGDAGI

SEQ ID NO: 737822 - protein, 24 aa, Mycobacterium
TGLGREPGETLILLGDTRDEFDGS

SEQ ID NO: 737823 - protein, 18 aa, Mycobacterium
TGLHLQFGRHAGTEVVVS

SEQ ID NO: 737824 - protein, 24 aa, Mycobacterium
TGLIDYRLAIRYSDDESAFVHTVA

SEQ ID NO: 737825 - protein, 25 aa, Mycobacterium
TGLITRWLAEPGVRIVSSTDGYAEA

SEQ ID NO: 737826 - protein, 22 aa, Mycobacterium
TGLKPAWAAEAFPDPAEDVRQS

SEQ ID NO: 737827 - protein, 17 aa, Mycobacterium
TGLLAALETGRCRVAGY

SEQ ID NO: 737828 - protein, 18 aa, Mycobacterium
TGLLDEWTPVIAGAELPE

SEQ ID NO: 737829 - protein, 25 aa, Mycobacterium
TGLLDGRRATTHWAAADLFRANFPA

SEQ ID NO: 737830 - protein, 20 aa, Mycobacterium
TGLLDLLDRLGITPLPNTAG

SEQ ID NO: 737831 - protein, 17 aa, Mycobacterium
TGLLLWTSPAKRRYVRI

SEQ ID NO: 737832 - protein, 24 aa, Mycobacterium
TGLLTLPHPEQWGGGGQPYEVYLQ

SEQ ID NO: 737833 - protein, 17 aa, Mycobacterium
TGLLWDAALKRIRRAKR

SEQ ID NO: 737834 - protein, 18 aa, Mycobacterium
TGLNKLRADFDVDSSGAF

SEQ ID NO: 737835 - protein, 25 aa, Mycobacterium
TGLNPERRTLFLLRNTPWPRGAKTA

SEQ ID NO: 737836 - protein, 17 aa, Mycobacterium
TGLPAFKAPFEPLTPGG

SEQ ID NO: 737837 - protein, 28 aa, Mycobacterium
TGLPAKGSRFIVCSQIQVVYPGVNLTTP

SEQ ID NO: 737838 - protein, 25 aa, Mycobacterium
TGLPEYRNGGLFLDTGVLRLRDDNL

SEQ ID NO: 737839 - protein, 28 aa, Mycobacterium
TGLPFSRIRILLRLSRGSMTVKEVAHAV

SEQ ID NO: 737840 - protein, 17 aa, Mycobacterium
TGLPGVLSRRIDPRNCT

SEQ ID NO: 737841 - protein, 17 aa, Mycobacterium
TGLPGVLSRRIDPRNGT

SEQ ID NO: 737842 - protein, 17 aa, Mycobacterium
TGLPMGITPRELDALTL

SEQ ID NO: 737843 - protein, 18 aa, Mycobacterium
TGLPRSATPVTHRRQPPG

SEQ ID NO: 737844 - protein, 23 aa, Mycobacterium
TGLPRTGTTVLHRLLTADPAHQG

SEQ ID NO: 737845 - protein, 17 aa, Mycobacterium
TGLPTVFVYDGHPGGAG

SEQ ID NO: 737846 - protein, 24 aa, Mycobacterium
TGLPVFCIDYRLAPKHRFPTAADD

SEQ ID NO: 737847 - protein, 18 aa, Mycobacterium
TGLPVFCVNYRLAPRYRF

SEQ ID NO: 737848 - protein, 19 aa, Mycobacterium
TGLPVPTIHRLIRTLLNNG

SEQ ID NO: 737849 - protein, 18 aa, Mycobacterium
TGLPWPDVDSAGTVSLLS

SEQ ID NO: 737850 - protein, 19 aa, Mycobacterium
TGLPWRGPAADAMVASVLP

SEQ ID NO: 737851 - protein, 25 aa, Mycobacterium
TGLPYPLMHPWWPLKGSDAEANRRV

SEQ ID NO: 737852 - protein, 17 aa, Mycobacterium
TGLRCALDDRVLTVLFD

SEQ ID NO: 737853 - protein, 19 aa, Mycobacterium
TGLRCEGCVETITNALSAL

SEQ ID NO: 737854 - protein, 17 aa, Mycobacterium
TGLRGSGIIEELTGKIE

SEQ ID NO: 737855 - protein, 26 aa, Mycobacterium
TGLRLANPPLLVPVLRAGLGMVDEAH

SEQ ID NO: 737856 - protein, 22 aa, Mycobacterium
TGLRPADVATIFARNKGVRNVR

SEQ ID NO: 737857 - protein, 25 aa, Mycobacterium
TGLRRSELLALRWTDFDETKQTIAA

SEQ ID NO: 737858 - protein, 30 aa, Mycobacterium
TGLRRSELLGLRWVDFDEKASMLAITGKVI

SEQ ID NO: 737859 - protein, 18 aa, Mycobacterium
TGLTELWKTIEHHRRVLT

SEQ ID NO: 737860 - protein, 24 aa, Mycobacterium
TGLTRGGVCSTFLADRAVAAPVFL

SEQ ID NO: 737861 - protein, 19 aa, Mycobacterium
TGLVARLTAFISVAVRANS

SEQ ID NO: 737862 - protein, 17 aa, Mycobacterium
TGLVCALLLTTRGAALT

SEQ ID NO: 737863 - protein, 20 aa, Mycobacterium
TGLVCALLLTTRGAALTLDQ

SEQ ID NO: 737864 - protein, 25 aa, Mycobacterium
TGLVGLKSKYGLDIAPANFVAISDG

SEQ ID NO: 737865 - protein, 19 aa, Mycobacterium
TGLVLDPYFSAPKMAWIRA

SEQ ID NO: 737866 - protein, 25 aa, Mycobacterium
TGLVQWLCAPTTYLDGDRPVDHLLT

SEQ ID NO: 737867 - protein, 24 aa, Mycobacterium
TGLVSPAVAFLVHESCPVSGANLE

SEQ ID NO: 737868 - protein, 17 aa, Mycobacterium
TGLVSRTGFSPLVHFQD

SEQ ID NO: 737869 - protein, 25 aa, Mycobacterium
TGLYGYRIPLVYLVQSTSAGVEVSL

SEQ ID NO: 737870 - protein, 18 aa, Mycobacterium
TGLYPPGSTFKMVTAGAA

SEQ ID NO: 737871 - protein, 23 aa, Mycobacterium
TGMAGGARGFGRPHVMPGGQEAP

SEQ ID NO: 737872 - protein, 19 aa, Mycobacterium
TGMAGGWLARHVVDHYGVR

SEQ ID NO: 737873 - protein, 19 aa, Mycobacterium
TGMELRAAIDAGDVVVTDK

SEQ ID NO: 737874 - protein, 19 aa, Mycobacterium
TGMPSPLFLERKGYNSAVL

SEQ ID NO: 737875 - protein, 24 aa, Mycobacterium
TGMTAYDWLTWRVTKGAEDAQRRH

SEQ ID NO: 737876 - protein, 20 aa, Mycobacterium
TGMTCGHCELSVREEVSGVA

SEQ ID NO: 737877 - protein, 22 aa, Mycobacterium
TGMVWPLSVKGILVTEGVRGDG

SEQ ID NO: 737878 - protein, 21 aa, Mycobacterium
TGMYELEFPGPQLSTPDGRGP

SEQ ID NO: 737879 - protein, 26 aa, Mycobacterium
TGNAAFRKALRELTLVLVYEATRAAP

SEQ ID NO: 737880 - protein, 17 aa, Mycobacterium
TGNAAQCAMVFQEDALL

SEQ ID NO: 737881 - protein, 28 aa, Mycobacterium
TGNARFARNQFWPALKNMSMYSLRVSES

SEQ ID NO: 737882 - protein, 18 aa, Mycobacterium
TGNIFLITGIGYYPNLGV

SEQ ID NO: 737883 - protein, 24 aa, Mycobacterium
TGNLDRPGGAMFPMSPTAPAPRGH

SEQ ID NO: 737884 - protein, 28 aa, Mycobacterium
TGNLGLDFCEYLAHRGARRITLVSRSGE

SEQ ID NO: 737885 - protein, 29 aa, Mycobacterium
TGNLGLEFCDHFAHRGARRITLVSRSGES

SEQ ID NO: 737886 - protein, 19 aa, Mycobacterium
TGNNFKINAKFVFVGAGGG

SEQ ID NO: 737887 - protein, 20 aa, Mycobacterium
TGNNKFGFGGLNSGSGNIGF

SEQ ID NO: 737888 - protein, 26 aa, Mycobacterium
TGNPLPLLGIPVRLAQGGTTLYQAIS

SEQ ID NO: 737889 - protein, 24 aa, Mycobacterium
TGNWASIVPHTWLWTTPTGGEIRP

SEQ ID NO: 737890 - protein, 25 aa, Mycobacterium
TGNYPFSIGPIYIWNDPSPIGTTVF

SEQ ID NO: 737891 - protein, 23 aa, Mycobacterium
TGPAEHVLLLVAHHIAWDDGSWR

SEQ ID NO: 737892 - protein, 23 aa, Mycobacterium
TGPCGRLGLPASGYLYGTYENPT

SEQ ID NO: 737893 - protein, 22 aa, Mycobacterium
TGPDLRNVCGWTLDRPPHHLET

SEQ ID NO: 737894 - protein, 24 aa, Mycobacterium
TGPDMLSRAAALNWDTNAPATVIV

SEQ ID NO: 737895 - protein, 19 aa, Mycobacterium
TGPDRFDCSGLVQWSYAQA

SEQ ID NO: 737896 - protein, 25 aa, Mycobacterium
TGPELLSRAAALNWDTTEPATVVVG

SEQ ID NO: 737897 - protein, 23 aa, Mycobacterium
TGPEPPRGVFEVGYEIGCGIDQS

SEQ ID NO: 737898 - protein, 18 aa, Mycobacterium
TGPFAVVEDLGRPGLAHL

SEQ ID NO: 737899 - protein, 24 aa, Mycobacterium
TGPFFLMDIDSFWTPVGGSIPEYN

SEQ ID NO: 737900 - protein, 20 aa, Mycobacterium
TGPFIDWLEITGALASETAN

SEQ ID NO: 737901 - protein, 18 aa, Mycobacterium
TGPGVCFFDRSPVCTHAL

SEQ ID NO: 737902 - protein, 21 aa, Mycobacterium
TGPGVRRLHIAVCTQSIIREA

SEQ ID NO: 737903 - protein, 23 aa, Mycobacterium
TGPIKETFIAAAVTQINGLNAAL

SEQ ID NO: 737904 - protein, 17 aa, Mycobacterium
TGPKLAELISVMRDEAS

SEQ ID NO: 737905 - protein, 20 aa, Mycobacterium
TGPLARYALNSSLLTPIAAQ

SEQ ID NO: 737906 - protein, 17 aa, Mycobacterium
TGPLAVVEDLGRAGLAH

SEQ ID NO: 737907 - protein, 17 aa, Mycobacterium
TGPLLQANWTWARSALD

SEQ ID NO: 737908 - protein, 20 aa, Mycobacterium
TGPLRPGAAAGIAEKITAEG

SEQ ID NO: 737909 - protein, 19 aa, Mycobacterium
TGPLSGVRVVDLTAMVMGP

SEQ ID NO: 737910 - protein, 17 aa, Mycobacterium
TGPLVWAALAGVPGVLA

SEQ ID NO: 737911 - protein, 24 aa, Mycobacterium
TGPMPLLPNGRWLYEHGDPRRLAQ

SEQ ID NO: 737912 - protein, 28 aa, Mycobacterium
TGPNAIRECLAWADGWLPGDAALRDVER

SEQ ID NO: 737913 - protein, 31 aa, Mycobacterium
TGPRPFLRLEGSAVFRWAAFEMGKVGQQAMD

SEQ ID NO: 737914 - protein, 31 aa, Mycobacterium
TGPRPFLRLEGSAVFRWAAFEMGKVGRQAMD

SEQ ID NO: 737915 - protein, 25 aa, Mycobacterium
TGPRPPGRLRPHRPERLGLLTRAWA

SEQ ID NO: 737916 - protein, 19 aa, Mycobacterium
TGPRSCIGRQFALHEAVLL

SEQ ID NO: 737917 - protein, 25 aa, Mycobacterium
TGPSFAVPSARGFERGLMSMMTGRR

SEQ ID NO: 737918 - protein, 36 aa, Mycobacterium
TGPVEGWMPFGRVFETLAWGRRHVVMGANQVDRYGN

SEQ ID NO: 737919 - protein, 20 aa, Mycobacterium
TGPYAGRAASEFTLQAWAGS

SEQ ID NO: 737920 - protein, 23 aa, Mycobacterium
TGPYAHGWATWFAPDGPPRTGRF

SEQ ID NO: 737921 - protein, 18 aa, Mycobacterium
TGPYFHGVSRPWQLEEEA

SEQ ID NO: 737922 - protein, 18 aa, Mycobacterium
TGPYRLTVGLRRALKAST

SEQ ID NO: 737923 - protein, 22 aa, Mycobacterium
TGQAICAFVILKASAHGGPENM

SEQ ID NO: 737924 - protein, 21 aa, Mycobacterium
TGQAICAFVILKSSAHGGEEN

SEQ ID NO: 737925 - protein, 23 aa, Mycobacterium
TGQAIVAFVILKASHTVEGDELV

SEQ ID NO: 737926 - protein, 25 aa, Mycobacterium
TGQAKAAFVAVEFDEYGAGYGPRVH

SEQ ID NO: 737927 - protein, 23 aa, Mycobacterium
TGQAMARLGFRMITLAAESQALR

SEQ ID NO: 737928 - protein, 18 aa, Mycobacterium
TGQGGWPMTCFLTPDGRP

SEQ ID NO: 737929 - protein, 24 aa, Mycobacterium
TGQIADGWLGTSFVPEGAAGAYFA

SEQ ID NO: 737930 - protein, 19 aa, Mycobacterium
TGQLLKFALYRTADDEFHL

SEQ ID NO: 737931 - protein, 25 aa, Mycobacterium
TGQLPVGGCSLHLAPVAFAGGRRVV

SEQ ID NO: 737932 - protein, 18 aa, Mycobacterium
TGQMGGRTRLEVVDPRAA

SEQ ID NO: 737933 - protein, 26 aa, Mycobacterium
TGQNGGDGGLLWGNGGNGGTGAAGQA

SEQ ID NO: 737934 - protein, 24 aa, Mycobacterium
TGQPAAVVPWDLDADGMPMSVQLV

SEQ ID NO: 737935 - protein, 24 aa, Mycobacterium
TGQPLDWFCLFSSGAALMGSPGQG

SEQ ID NO: 737936 - protein, 25 aa, Mycobacterium
TGQPRVSPLYFLRDGDRVIVAASKG

SEQ ID NO: 737937 - protein, 26 aa, Mycobacterium
TGQQLWRYKHAVPFDVSLCCGNVNRG

SEQ ID NO: 737938 - protein, 18 aa, Mycobacterium
TGQQRWAVRWKPALNAFA

SEQ ID NO: 737939 - protein, 22 aa, Mycobacterium
TGQRIPTRLVGVLQLTNVELQP

SEQ ID NO: 737940 - protein, 18 aa, Mycobacterium
TGQRRMWFLQAMDAGDPT

SEQ ID NO: 737941 - protein, 30 aa, Mycobacterium
TGQTAAGVALEWLRYRAGLASTPLIPVIGP

SEQ ID NO: 737942 - protein, 25 aa, Mycobacterium
TGQTCLAGSRLLVDRSVADALVEKI

SEQ ID NO: 737943 - protein, 26 aa, Mycobacterium
TGQTGQAGGLLWGNGGAGGSGAPGQS

SEQ ID NO: 737944 - protein, 21 aa, Mycobacterium
TGQTRGGAQIEMLQPTNRAGR

SEQ ID NO: 737945 - protein, 18 aa, Mycobacterium
TGQYRARGAVNPDVQPRP

SEQ ID NO: 737946 - protein, 19 aa, Mycobacterium
TGQYRARGAVNPDVQPRPT

SEQ ID NO: 737947 - protein, 25 aa, Mycobacterium
TGQYTACLDLAWAKDSCISLGQPVA

SEQ ID NO: 737948 - protein, 23 aa, Mycobacterium
TGRAARNWASFDAMVRTLTTLRE

SEQ ID NO: 737949 - protein, 17 aa, Mycobacterium
TGRACSVLAELRAGSAD

SEQ ID NO: 737950 - protein, 18 aa, Mycobacterium
TGRADWARVTGLDADGTP

SEQ ID NO: 737951 - protein, 19 aa, Mycobacterium
TGRAGCRDSGGGAFGGDGT

SEQ ID NO: 737952 - protein, 19 aa, Mycobacterium
TGRAGKAAADMGFRMITLA

SEQ ID NO: 737953 - protein, 21 aa, Mycobacterium
TGRARLSHISTYHGRLAADII

SEQ ID NO: 737954 - protein, 24 aa, Mycobacterium
TGRDIHLTREWILRNSPVPVGTVP

SEQ ID NO: 737955 - protein, 25 aa, Mycobacterium
TGRECPAGTVGEIWVHGDNVAGGYW

SEQ ID NO: 737956 - protein, 23 aa, Mycobacterium
TGRELGGAQVLRSLPRTVPEQSP

SEQ ID NO: 737957 - protein, 21 aa, Mycobacterium
TGRENLLMFGRLQGLKKKVAK

SEQ ID NO: 737958 - protein, 24 aa, Mycobacterium
TGRFADDGPRRFIETARVFAEFTL

SEQ ID NO: 737959 - protein, 17 aa, Mycobacterium
TGRFLREHVPGVQIVAA

SEQ ID NO: 737960 - protein, 20 aa, Mycobacterium
TGRHPLKFTAYDGSIAGNED

SEQ ID NO: 737961 - protein, 24 aa, Mycobacterium
TGRIADGWLGTSFVPEGAGDAYFT

SEQ ID NO: 737962 - protein, 18 aa, Mycobacterium
TGRKATRDCMPWTDGWLP

SEQ ID NO: 737963 - protein, 28 aa, Mycobacterium
TGRKPARIPVWFMRQAGRSLPEYRALRA

SEQ ID NO: 737964 - protein, 24 aa, Mycobacterium
TGRLLELLPQFRFDNDACELLARF

SEQ ID NO: 737965 - protein, 20 aa, Mycobacterium
TGRMGSTAARIFMASPATVA

SEQ ID NO: 737966 - protein, 19 aa, Mycobacterium
TGRNPLHFEDQAAFAIGLR

SEQ ID NO: 737967 - protein, 22 aa, Mycobacterium
TGRPCYEIVDPQPLTLLPEPDP

SEQ ID NO: 737968 - protein, 19 aa, Mycobacterium
TGRPEWTGVSGAKMLSHVR

SEQ ID NO: 737969 - protein, 24 aa, Mycobacterium
TGRPGLDIPEGWDAIPGARGCTTE

SEQ ID NO: 737970 - protein, 24 aa, Mycobacterium
TGRPGVHGFRLLPPRTLRHQMGLV

SEQ ID NO: 737971 - protein, 21 aa, Mycobacterium
TGRPKGVLWRQGDMYVASMVG

SEQ ID NO: 737972 - protein, 25 aa, Mycobacterium
TGRPKIVKFAGCYHGHADALLADAG

SEQ ID NO: 737973 - protein, 19 aa, Mycobacterium
TGRPPRAIPDPVPLTSHGP

SEQ ID NO: 737974 - protein, 20 aa, Mycobacterium
TGRPPRAIPEPQPRTSHGPA

SEQ ID NO: 737975 - protein, 21 aa, Mycobacterium
TGRPPRAIPEPQPRTSHGPAK

SEQ ID NO: 737976 - protein, 21 aa, Mycobacterium
TGRPRALLTRNVLDSVACAVG

SEQ ID NO: 737977 - protein, 26 aa, Mycobacterium
TGRPSLPADLIGSVLVLKELYDLSDP

SEQ ID NO: 737978 - protein, 23 aa, Mycobacterium
TGRPVKLHLRRADQFSSVGYQPW

SEQ ID NO: 737979 - protein, 26 aa, Mycobacterium
TGRPVQRETLLPGALLVRVASSHLRV

SEQ ID NO: 737980 - protein, 26 aa, Mycobacterium
TGRQNVEWFARLYGVPRAERSDRVDQ

SEQ ID NO: 737981 - protein, 25 aa, Mycobacterium
TGRQRFPGWPFRISPGPAHQHRAAA

SEQ ID NO: 737982 - protein, 22 aa, Mycobacterium
TGRRFEALSALSAGVKDVRAVI

SEQ ID NO: 737983 - protein, 17 aa, Mycobacterium
TGRRFRDLDGIAALELI

SEQ ID NO: 737984 - protein, 20 aa, Mycobacterium
TGRRGKYLWLTLEGSSGAQA

SEQ ID NO: 737985 - protein, 26 aa, Mycobacterium
TGRRRRCGWFDAVIARYATRVNGITD

SEQ ID NO: 737986 - protein, 25 aa, Mycobacterium
TGRRRRCGWFDAVVARYATRVNGIT

SEQ ID NO: 737987 - protein, 23 aa, Mycobacterium
TGRRYLDCLAAYSAVNFGHRNPE

SEQ ID NO: 737988 - protein, 21 aa, Mycobacterium
TGRRYLDMFTFVASSALGMNH

SEQ ID NO: 737989 - protein, 21 aa, Mycobacterium
TGRSVPLATLLGGVTATELIE

SEQ ID NO: 737990 - protein, 23 aa, Mycobacterium
TGRTSVRLLTRFETITYRQLGDR

SEQ ID NO: 737991 - protein, 24 aa, Mycobacterium
TGRTVVLRLRFADFSRATRSHTMP

SEQ ID NO: 737992 - protein, 23 aa, Mycobacterium
TGRTVVLRLRFDDFGRATRSHTM

SEQ ID NO: 737993 - protein, 23 aa, Mycobacterium
TGRTVVLRLRFDDFGRATRSRTL

SEQ ID NO: 737994 - protein, 24 aa, Mycobacterium
TGRVEGRSGVWIPAGSGRPERKIA

SEQ ID NO: 737995 - protein, 32 aa, Mycobacterium
TGRVKRPQMGIASWIIPSIVAFGTDEQKQRFL

SEQ ID NO: 737996 - protein, 32 aa, Mycobacterium
TGRVKRPQVGIAAWILPSIVAFGTEEQKQRFL

SEQ ID NO: 737997 - protein, 18 aa, Mycobacterium
TGRVSALIDGAARMVTYS

SEQ ID NO: 737998 - protein, 22 aa, Mycobacterium
TGRVYRGALDFRVDRTEVSDQE

SEQ ID NO: 737999 - protein, 20 aa, Mycobacterium
TGRWTFLIVDGAAFMMQAME

SEQ ID NO: 738000 - protein, 22 aa, Mycobacterium
TGRYLGCVHLQRLLREAPAELV

SEQ ID NO: 738001 - protein, 21 aa, Mycobacterium
TGRYLGCVHLQRLLREPPSEI

SEQ ID NO: 738002 - protein, 26 aa, Mycobacterium
TGRYLGCVHLQRLLREPPYAMVGGIL

SEQ ID NO: 738003 - protein, 21 aa, Mycobacterium
TGSAFWLRTAATLDFDPLTAV

SEQ ID NO: 738004 - protein, 22 aa, Mycobacterium
TGSCKSCPSSAVTLELAVQDAI

SEQ ID NO: 738005 - protein, 23 aa, Mycobacterium
TGSEAFLRYWPADLHMIGKDIIR

SEQ ID NO: 738006 - protein, 18 aa, Mycobacterium
TGSETSWAYVITDTSDMD

SEQ ID NO: 738007 - protein, 18 aa, Mycobacterium
TGSFAVNDFLGWSYLVSR

SEQ ID NO: 738008 - protein, 18 aa, Mycobacterium
TGSFKARGAYNRIANLSA

SEQ ID NO: 738009 - protein, 18 aa, Mycobacterium
TGSFLFQYAKTWRTLAKL

SEQ ID NO: 738010 - protein, 30 aa, Mycobacterium
TGSGALAIALADRWPAARILGVDDSGAALE

SEQ ID NO: 738011 - protein, 18 aa, Mycobacterium
TGSGALAVALARHRPAAR

SEQ ID NO: 738012 - protein, 29 aa, Mycobacterium
TGSGGTVDLAFPGTAGHGGDGGAGGGGGA

SEQ ID NO: 738013 - protein, 24 aa, Mycobacterium
TGSGISFSGSTTLTAGSGNGGNGG

SEQ ID NO: 738014 - protein, 19 aa, Mycobacterium
TGSGPWPGVVIIHDAIGYG

SEQ ID NO: 738015 - protein, 19 aa, Mycobacterium
TGSHPLLGIGVTDPTNGTR

SEQ ID NO: 738016 - protein, 22 aa, Mycobacterium
TGSIKDRPALRMIEQAEQDGLL

SEQ ID NO: 738017 - protein, 22 aa, Mycobacterium
TGSIKDRPALRMIEQAERDGLL

SEQ ID NO: 738018 - protein, 19 aa, Mycobacterium
TGSIWCFATAETRQWWGGM

SEQ ID NO: 738019 - protein, 26 aa, Mycobacterium
TGSLGHERVMLWLGYANLLGELTIDF

SEQ ID NO: 738020 - protein, 35 aa, Mycobacterium
TGSMAAAWTRKGLRVNCIACGAVRTPGLEADAQRQ

SEQ ID NO: 738021 - protein, 24 aa, Mycobacterium
TGSMAAAWTRKGVRVNCIACGAVR

SEQ ID NO: 738022 - protein, 18 aa, Mycobacterium
TGSMRVSADLALWRARSR

SEQ ID NO: 738023 - protein, 24 aa, Mycobacterium
TGSMVAGALELRRLGLVRQPWLVV

SEQ ID NO: 738024 - protein, 25 aa, Mycobacterium
TGSPKWTGTRVDLVFASNSQLRALA

SEQ ID NO: 738025 - protein, 18 aa, Mycobacterium
TGSPLSVKGFRWIGEHVG

SEQ ID NO: 738026 - protein, 24 aa, Mycobacterium
TGSPYGHGWVTWFPPEGPPRTERF

SEQ ID NO: 738027 - protein, 24 aa, Mycobacterium
TGSRGRGDIAGFFLGSTSHALIHK

SEQ ID NO: 738028 - protein, 17 aa, Mycobacterium
TGSRMIAFDVLGSGVGE

SEQ ID NO: 738029 - protein, 26 aa, Mycobacterium
TGSRVSFEVTFDFGIPSLAGVLEPIA

SEQ ID NO: 738030 - protein, 27 aa, Mycobacterium
TGSSKWALKIAREWSGERVQWGKPLAE

SEQ ID NO: 738031 - protein, 18 aa, Mycobacterium
TGSTRAGIEVARNAAPTV

SEQ ID NO: 738032 - protein, 29 aa, Mycobacterium
TGSVARPPQWWRLHELFDAADPVKPYVVT

SEQ ID NO: 738033 - protein, 27 aa, Mycobacterium
TGSVLELRPDYGVGIVTGLVRVEGAAY

SEQ ID NO: 738034 - protein, 19 aa, Mycobacterium
TGSVLIAVRGFRFGTGSSD

SEQ ID NO: 738035 - protein, 33 aa, Mycobacterium
TGSVRWVSPEFLRFGYRTSVLKHSSQWVVLEVE

SEQ ID NO: 738036 - protein, 18 aa, Mycobacterium
TGTACAHLLLWRADAPWE

SEQ ID NO: 738037 - protein, 31 aa, Mycobacterium
TGTARVKRGMAEMLKGGVIMDVVTPEQAKIA

SEQ ID NO: 738038 - protein, 27 aa, Mycobacterium
TGTATGVPWARACAAALLAVTTPAGLR

SEQ ID NO: 738039 - protein, 17 aa, Mycobacterium
TGTDDWLGEWTFAFPQG

SEQ ID NO: 738040 - protein, 24 aa, Mycobacterium
TGTECLRYRLEVVATSAIDVVHAA

SEQ ID NO: 738041 - protein, 18 aa, Mycobacterium
TGTEIFGGVAGALAQGFR

SEQ ID NO: 738042 - protein, 25 aa, Mycobacterium
TGTELLRPGWLEIASDRVVAVGAGA

SEQ ID NO: 738043 - protein, 24 aa, Mycobacterium
TGTFLCIRAALPDMVKAQWGRIVT

SEQ ID NO: 738044 - protein, 19 aa, Mycobacterium
TGTFNVLQCVWVYNREVDI

SEQ ID NO: 738045 - protein, 18 aa, Mycobacterium
TGTGIAHCPTSNGRLGAG

SEQ ID NO: 738046 - protein, 25 aa, Mycobacterium
TGTGLRCPWSSCFPSAPRSATGSGA

SEQ ID NO: 738047 - protein, 26 aa, Mycobacterium
TGTGLRCPWSSCLPLPSPAVRIRIRG

SEQ ID NO: 738048 - protein, 25 aa, Mycobacterium
TGTGQRLHTTWTWAPSALDEEQIQR

SEQ ID NO: 738049 - protein, 20 aa, Mycobacterium
TGTHRYRFTLYQLPDDYQLP

SEQ ID NO: 738050 - protein, 18 aa, Mycobacterium
TGTHVALRKYEHGLDALL

SEQ ID NO: 738051 - protein, 19 aa, Mycobacterium
TGTNMLFTMRAAWAQADSD

SEQ ID NO: 738052 - protein, 19 aa, Mycobacterium
TGTNMLFTMRSAWAHADAQ

SEQ ID NO: 738053 - protein, 26 aa, Mycobacterium
TGTPCGAGAFTGRFLRSGDTVEVAIE

SEQ ID NO: 738054 - protein, 24 aa, Mycobacterium
TGTPGDWWTVFALVPDALKHSVQG

SEQ ID NO: 738055 - protein, 17 aa, Mycobacterium
TGTPILFASTGEKLEDF

SEQ ID NO: 738056 - protein, 28 aa, Mycobacterium
TGTQVRVAAFGPRAANVVGLTDQTDLFF

SEQ ID NO: 738057 - protein, 23 aa, Mycobacterium
TGTRAHSARSWLGDNAVHKLGDV

SEQ ID NO: 738058 - protein, 21 aa, Mycobacterium
TGTRLDADRAYTLGLTPLPPV

SEQ ID NO: 738059 - protein, 18 aa, Mycobacterium
TGTSEHGFEFLVSKGRAL

SEQ ID NO: 738060 - protein, 25 aa, Mycobacterium
TGTSFARWSSLLAEYAQTAEVMAQA

SEQ ID NO: 738061 - protein, 17 aa, Mycobacterium
TGTSGYQAHDWLREHAH

SEQ ID NO: 738062 - protein, 19 aa, Mycobacterium
TGTTIRFWADPDIFETTEY

SEQ ID NO: 738063 - protein, 19 aa, Mycobacterium
TGTTIRFWADPEIFETTNY

SEQ ID NO: 738064 - protein, 20 aa, Mycobacterium
TGTTIRFWADPEIFETTQYD

SEQ ID NO: 738065 - protein, 18 aa, Mycobacterium
TGTTPELLAGLTDPEHRE

SEQ ID NO: 738066 - protein, 26 aa, Mycobacterium
TGTVVYRFTWHLPKNRTWTYDGQLKM

SEQ ID NO: 738067 - protein, 20 aa, Mycobacterium
TGTYAINWYAFDPCCPFGGY

SEQ ID NO: 738068 - protein, 26 aa, Mycobacterium
TGVAANWRAGGGWTDGRQRLGTSPEK

SEQ ID NO: 738069 - protein, 25 aa, Mycobacterium
TGVAPRIPAIPGIAHAKVLTYTEAI

SEQ ID NO: 738070 - protein, 18 aa, Mycobacterium
TGVARLTVDIARAGLAAL

SEQ ID NO: 738071 - protein, 19 aa, Mycobacterium
TGVDFWHPVMPGVLRCANG

SEQ ID NO: 738072 - protein, 23 aa, Mycobacterium
TGVDLDPSWMFDIQVKRIHEYKR

SEQ ID NO: 738073 - protein, 17 aa, Mycobacterium
TGVDPRGPVSVQPNSLV

SEQ ID NO: 738074 - protein, 28 aa, Mycobacterium
TGVELRNRLRAVTGLALSRTIIFDYPTP

SEQ ID NO: 738075 - protein, 24 aa, Mycobacterium
TGVFAGTMTSCYGVGIDNVTSAVS

SEQ ID NO: 738076 - protein, 17 aa, Mycobacterium
TGVFPMPLAYVEYDPDT

SEQ ID NO: 738077 - protein, 27 aa, Mycobacterium
TGVGAALRKGAPVIVVGHVYTSEYEDR

SEQ ID NO: 738078 - protein, 21 aa, Mycobacterium
TGVGFGPPVAIPSWGVLRRPD

SEQ ID NO: 738079 - protein, 20 aa, Mycobacterium
TGVGGAVVFRAGQFRDGYGR

SEQ ID NO: 738080 - protein, 26 aa, Mycobacterium
TGVIGGLCDSLARTVDRFANRVDHAQ

SEQ ID NO: 738081 - protein, 17 aa, Mycobacterium
TGVKSGFSFLQIPIGPS

SEQ ID NO: 738082 - protein, 18 aa, Mycobacterium
TGVKTLTEDASWAQGLTI

SEQ ID NO: 738083 - protein, 27 aa, Mycobacterium
TGVLDLLKRLDIVPLPNTAGCRGAAEA

SEQ ID NO: 738084 - protein, 20 aa, Mycobacterium
TGVMWKRFSETGAIKAKSVI

SEQ ID NO: 738085 - protein, 23 aa, Mycobacterium
TGVPFCGFSSELLTGALQGSSGP

SEQ ID NO: 738086 - protein, 17 aa, Mycobacterium
TGVPIDYFAEVNLAGFY

SEQ ID NO: 738087 - protein, 24 aa, Mycobacterium
TGVPTGMVPPSFGPLLGEQRSDLI

SEQ ID NO: 738088 - protein, 20 aa, Mycobacterium
TGVQRFGLRPVTGIDPAAVS

SEQ ID NO: 738089 - protein, 20 aa, Mycobacterium
TGVQRFGLRPVTGIDPKAVS

SEQ ID NO: 738090 - protein, 22 aa, Mycobacterium
TGVQRVFFGWAQVWRTKSREAE

SEQ ID NO: 738091 - protein, 24 aa, Mycobacterium
TGVRFPVWDGRCGFGVEEFSRRHG

SEQ ID NO: 738092 - protein, 17 aa, Mycobacterium
TGVRMIIGGTIVERREF

SEQ ID NO: 738093 - protein, 20 aa, Mycobacterium
TGVRRFALRPVTGIDPAAVS

SEQ ID NO: 738094 - protein, 21 aa, Mycobacterium
TGVRRFALRPVTGIDPGAVSP

SEQ ID NO: 738095 - protein, 17 aa, Mycobacterium
TGVRVFFPDPWPKARHH

SEQ ID NO: 738096 - protein, 21 aa, Mycobacterium
TGVTILNNWIRQGVVERGLVV

SEQ ID NO: 738097 - protein, 17 aa, Mycobacterium
TGVVCYITTSGYLRGPG

SEQ ID NO: 738098 - protein, 22 aa, Mycobacterium
TGVVDLSGWPPGMRLIVRRERP

SEQ ID NO: 738099 - protein, 17 aa, Mycobacterium
TGVVKVMARQTDEDGNV

SEQ ID NO: 738100 - protein, 24 aa, Mycobacterium
TGVVPRIPAIPGIDHPRVLTYAEA

SEQ ID NO: 738101 - protein, 26 aa, Mycobacterium
TGVWDVRASFLPAIYFEGVGMAGGIA

SEQ ID NO: 738102 - protein, 18 aa, Mycobacterium
TGWADRRGKRRWTADTAP

SEQ ID NO: 738103 - protein, 18 aa, Mycobacterium
TGWALIYIAMCLRTNSSR

SEQ ID NO: 738104 - protein, 18 aa, Mycobacterium
TGWGWLPLATGVAVVDTV

SEQ ID NO: 738105 - protein, 21 aa, Mycobacterium
TGWHKGRAVEWILDRIDGDEL

SEQ ID NO: 738106 - protein, 18 aa, Mycobacterium
TGWHNARVIGYGPIELDP

SEQ ID NO: 738107 - protein, 18 aa, Mycobacterium
TGWHTHEGLIYGIVKTGV

SEQ ID NO: 738108 - protein, 27 aa, Mycobacterium
TGWHYHDCVFQWLFITKGWLELQFENG

SEQ ID NO: 738109 - protein, 31 aa, Mycobacterium
TGWRLHGHPQWWIDIAAEWGRRDYWQQWRDV

SEQ ID NO: 738110 - protein, 18 aa, Mycobacterium
TGYCGLPDGAGYTSSLVR

SEQ ID NO: 738111 - protein, 17 aa, Mycobacterium
TGYFCEVHHVVPYAQSP

SEQ ID NO: 738112 - protein, 20 aa, Mycobacterium
TGYLPFGQQAIYISNSPSGV

SEQ ID NO: 738113 - protein, 21 aa, Mycobacterium
TGYPPVYARDSLPVIDSYPDG

SEQ ID NO: 738114 - protein, 27 aa, Mycobacterium
TGYRLANPPLLVPVLRAGLGMVDQAHA

SEQ ID NO: 738115 - protein, 17 aa, Mycobacterium
TGYSWGPLAWMLLAQAL

SEQ ID NO: 738116 - protein, 24 aa, Mycobacterium
TGYTCPSCNGTLMSVGDNAYRCQV

SEQ ID NO: 738117 - protein, 25 aa, Mycobacterium
TGYTFACDYWDVVPDVFLLGKALGG

SEQ ID NO: 738118 - protein, 17 aa, Mycobacterium
TGYWRLYFQWASFEILP

SEQ ID NO: 738119 - protein, 18 aa, Mycobacterium
TGYWWPKHAGRYAALASP

SEQ ID NO: 738120 - protein, 18 aa, Mycobacterium
THAALPGMIERGAGAVMN

SEQ ID NO: 738121 - protein, 19 aa, Mycobacterium
THAALPGMVERGAGAVMNI

SEQ ID NO: 738122 - protein, 17 aa, Mycobacterium
THADPGFSDPIDSFETL

SEQ ID NO: 738123 - protein, 23 aa, Mycobacterium
THADRLSALMITYPSTHGVYEHD

SEQ ID NO: 738124 - protein, 18 aa, Mycobacterium
THADVCAALGLTDDGGPG

SEQ ID NO: 738125 - protein, 17 aa, Mycobacterium
THAFHYLTIFGDDGRPL

SEQ ID NO: 738126 - protein, 25 aa, Mycobacterium
THAGICNRLLWQADVLGFGAGDVAL

SEQ ID NO: 738127 - protein, 23 aa, Mycobacterium
THAGIRNRLLWMQAAYQLTPADR

SEQ ID NO: 738128 - protein, 18 aa, Mycobacterium
THAHARLIAKLSYTNLGF

SEQ ID NO: 738129 - protein, 19 aa, Mycobacterium
THAHARLVAKMSYTNIGFA

SEQ ID NO: 738130 - protein, 18 aa, Mycobacterium
THAHGMEGVNFYTRGKAI

SEQ ID NO: 738131 - protein, 23 aa, Mycobacterium
THAPGALPVLFGHIGEGNLHLNV

SEQ ID NO: 738132 - protein, 23 aa, Mycobacterium
THAQEANWMFALVRTTRGAKKQQ

SEQ ID NO: 738133 - protein, 23 aa, Mycobacterium
THAQEANWMFALVRTTRTDKKQR

SEQ ID NO: 738134 - protein, 22 aa, Mycobacterium
THAREANWMFALVRTTKGPKKQ

SEQ ID NO: 738135 - protein, 26 aa, Mycobacterium
THASLAVAIRHWRDALGLTAADRMQV

SEQ ID NO: 738136 - protein, 21 aa, Mycobacterium
THASPWLTRHVEEPDWHLHMA

SEQ ID NO: 738137 - protein, 21 aa, Mycobacterium
THATELLAVFDIYRTTFGALL

SEQ ID NO: 738138 - protein, 22 aa, Mycobacterium
THAYACGPIPMLHTYQELAAQA

SEQ ID NO: 738139 - protein, 20 aa, Mycobacterium
THCAKRLRAIIDEHGPDAVA

SEQ ID NO: 738140 - protein, 24 aa, Mycobacterium
THCFAGKDRTGFVVATVLEAIGID

SEQ ID NO: 738141 - protein, 23 aa, Mycobacterium
THCGAQGGDVCVAGRVRRHRVAV

SEQ ID NO: 738142 - protein, 17 aa, Mycobacterium
THDACRELGLTAWQDPH

SEQ ID NO: 738143 - protein, 25 aa, Mycobacterium
THDDWRWVIDIDLWGSIHAVEAFLP

SEQ ID NO: 738144 - protein, 25 aa, Mycobacterium
THDDWRWVIDIDLWGSIHTVEAFLP

SEQ ID NO: 738145 - protein, 26 aa, Mycobacterium
THDDWRWVVDIDLWGNIHAVEAFLPR

SEQ ID NO: 738146 - protein, 22 aa, Mycobacterium
THDRWLRYGRIAQRAEPDLKSG

SEQ ID NO: 738147 - protein, 17 aa, Mycobacterium
THDVFRKGSGPGVVLIP

SEQ ID NO: 738148 - protein, 23 aa, Mycobacterium
THEARTGVDVVRLVAGDPLTVDA

SEQ ID NO: 738149 - protein, 24 aa, Mycobacterium
THEATRVLGGFLRDVIARNKDRFR

SEQ ID NO: 738150 - protein, 24 aa, Mycobacterium
THEELRAAFTECVDGALQAPGSAV

SEQ ID NO: 738151 - protein, 20 aa, Mycobacterium
THEKVALPGLMLAERFGLGP

SEQ ID NO: 738152 - protein, 29 aa, Mycobacterium
THEQLLFCCAFLYVCSGYYRYDEGFSPRF

SEQ ID NO: 738153 - protein, 26 aa, Mycobacterium
THEVSWPRKAKLLDVLLNKGLDAPFS

SEQ ID NO: 738154 - protein, 24 aa, Mycobacterium
THEVWKAGEPVALSPTEFTLLRYF

SEQ ID NO: 738155 - protein, 17 aa, Mycobacterium
THFCLGAALARMEMRVI

SEQ ID NO: 738156 - protein, 18 aa, Mycobacterium
THFDWALAPYDIKASKAH

SEQ ID NO: 738157 - protein, 17 aa, Mycobacterium
THFDWALAPYDVTASRA

SEQ ID NO: 738158 - protein, 19 aa, Mycobacterium
THFFDEYFLAAAAAGIRQV

SEQ ID NO: 738159 - protein, 17 aa, Mycobacterium
THFGRLVRRWHWTAETD

SEQ ID NO: 738160 - protein, 24 aa, Mycobacterium
THFMPTDTFACFMPVTAAQIGDDS

SEQ ID NO: 738161 - protein, 25 aa, Mycobacterium
THFNLSVGVGDAFLRAVERGGAHRL

SEQ ID NO: 738162 - protein, 18 aa, Mycobacterium
THFRFVRDHHKHVKKVAV

SEQ ID NO: 738163 - protein, 19 aa, Mycobacterium
THFRRPEIDAETLREICEF

SEQ ID NO: 738164 - protein, 21 aa, Mycobacterium
THFRVPGIHLCEPSPQRTPVL

SEQ ID NO: 738165 - protein, 18 aa, Mycobacterium
THFSRKQLVLALAPGEDR

SEQ ID NO: 738166 - protein, 23 aa, Mycobacterium
THGAGIGPIPAVTAVAASGLGQP

SEQ ID NO: 738167 - protein, 25 aa, Mycobacterium
THGARAGAVIALLLPRSDHAILAIL

SEQ ID NO: 738168 - protein, 29 aa, Mycobacterium
THGASSEAARAWWGNFLVRKANENGVELD

SEQ ID NO: 738169 - protein, 17 aa, Mycobacterium
THGDCLFTLVWHVSEGH

SEQ ID NO: 738170 - protein, 25 aa, Mycobacterium
THGDEVLAILGGLRVPSIVIVHDVS

SEQ ID NO: 738171 - protein, 17 aa, Mycobacterium
THGEMYWQNRHYNLDVY

SEQ ID NO: 738172 - protein, 18 aa, Mycobacterium
THGLRAAGRYLAIKVTIP

SEQ ID NO: 738173 - protein, 19 aa, Mycobacterium
THGNPVLPLVCDVTDEEAV

SEQ ID NO: 738174 - protein, 21 aa, Mycobacterium
THGPISWGTAAAVEAVQHARR

SEQ ID NO: 738175 - protein, 19 aa, Mycobacterium
THGPLRFGVDVVDDDALAR

SEQ ID NO: 738176 - protein, 19 aa, Mycobacterium
THGPMECHELMALDFKSHI

SEQ ID NO: 738177 - protein, 19 aa, Mycobacterium
THGPMECHELMALNFASHL

SEQ ID NO: 738178 - protein, 21 aa, Mycobacterium
THGPRGLGYARLPEPTTTLTD

SEQ ID NO: 738179 - protein, 22 aa, Mycobacterium
THGRYAPFRWTFGARVGEQMIQ

SEQ ID NO: 738180 - protein, 20 aa, Mycobacterium
THGSPFRRAFEEGLLQETNM

SEQ ID NO: 738181 - protein, 25 aa, Mycobacterium
THGSTLRFAPPLVITADEIDWAVAR

SEQ ID NO: 738182 - protein, 25 aa, Mycobacterium
THGSTLRFAPPLVITAQEIDWAVRQ

SEQ ID NO: 738183 - protein, 25 aa, Mycobacterium
THGSTLRFAPPLVVTSEEIDWAVDR

SEQ ID NO: 738184 - protein, 22 aa, Mycobacterium
THGVEPWAYMIVGGVQLATHSW

SEQ ID NO: 738185 - protein, 24 aa, Mycobacterium
THHHMVFVIPPLVFPLRRSLEAGI

SEQ ID NO: 738186 - protein, 18 aa, Mycobacterium
THHIACLTCGRPIACLHD

SEQ ID NO: 738187 - protein, 19 aa, Mycobacterium
THHIQRLMILGSHALQRGY

SEQ ID NO: 738188 - protein, 19 aa, Mycobacterium
THHLTGFGLAQAGKIAAVR

SEQ ID NO: 738189 - protein, 24 aa, Mycobacterium
THHPGRFLLGVGVGHPEHTQEYVK

SEQ ID NO: 738190 - protein, 28 aa, Mycobacterium
THHTPELLAELGFEYVLDWTNDDQPYPL

SEQ ID NO: 738191 - protein, 29 aa, Mycobacterium
THHTPELLAELGFQYVLDWTNDDQPYPLS

SEQ ID NO: 738192 - protein, 20 aa, Mycobacterium
THIPCWLITDHRSFNRYVVG

SEQ ID NO: 738193 - protein, 17 aa, Mycobacterium
THIPLFKILGFGGPGDA

SEQ ID NO: 738194 - protein, 19 aa, Mycobacterium
THKAYRDARGYVVSVKAET

SEQ ID NO: 738195 - protein, 31 aa, Mycobacterium
THKIWSIESGFTFPVLSDFWPHGKVARDYGV

SEQ ID NO: 738196 - protein, 20 aa, Mycobacterium
THKQLALYLFDAYSQAIAPG

SEQ ID NO: 738197 - protein, 17 aa, Mycobacterium
THKRYRADHLIEAYEAK

SEQ ID NO: 738198 - protein, 19 aa, Mycobacterium
THKRYRADHLIEAYEAKHG

SEQ ID NO: 738199 - protein, 24 aa, Mycobacterium
THKSLRGPRGGMVLATEEYAPAVD

SEQ ID NO: 738200 - protein, 18 aa, Mycobacterium
THLDAPYHFASTMNMASV

SEQ ID NO: 738201 - protein, 20 aa, Mycobacterium
THLEAALALDVRVLVLGGGE

SEQ ID NO: 738202 - protein, 17 aa, Mycobacterium
THLEIAMRSRFGLRECV

SEQ ID NO: 738203 - protein, 28 aa, Mycobacterium
THLFPSRKGTWCALTLSRPDDVAAVPAL

SEQ ID NO: 738204 - protein, 17 aa, Mycobacterium
THLGRGLGRVATDAVLR

SEQ ID NO: 738205 - protein, 31 aa, Mycobacterium
THLGWCAHSGWQIAGSPDWAANLPEALRSAE

SEQ ID NO: 738206 - protein, 18 aa, Mycobacterium
THLIPRNSIGWIEAEGDY

SEQ ID NO: 738207 - protein, 25 aa, Mycobacterium
THLLPWEIPALPPAPTVIPIPFPVP

SEQ ID NO: 738208 - protein, 33 aa, Mycobacterium
THLLRYPLPSRWCSEVDVALYLKDETTHITGSL

SEQ ID NO: 738209 - protein, 21 aa, Mycobacterium
THLPEGSAFEQVRVQHEAVSD

SEQ ID NO: 738210 - protein, 21 aa, Mycobacterium
THLPNLRVEAGQGLVVDFVKS

SEQ ID NO: 738211 - protein, 21 aa, Mycobacterium
THLPNLRVEAGQGLVVDFVRS

SEQ ID NO: 738212 - protein, 19 aa, Mycobacterium
THLPNLRVESGQGLIVDFV

SEQ ID NO: 738213 - protein, 18 aa, Mycobacterium
THLQRLVPQHVMRRMFYT

SEQ ID NO: 738214 - protein, 21 aa, Mycobacterium
THLRKIISRAFTPRAVERLRD

SEQ ID NO: 738215 - protein, 24 aa, Mycobacterium
THLSFVPGWNRRQLRRLVHDLRGF

SEQ ID NO: 738216 - protein, 25 aa, Mycobacterium
THLSFVPGWNRWQLRRLAHDVRGFP

SEQ ID NO: 738217 - protein, 24 aa, Mycobacterium
THLSFVPGWNRYQLHHLMRDVRGL

SEQ ID NO: 738218 - protein, 18 aa, Mycobacterium
THLSRLVPQHLMRRLFFT

SEQ ID NO: 738219 - protein, 24 aa, Mycobacterium
THLTRLRLITSMLDRGYTIAHVRE

SEQ ID NO: 738220 - protein, 22 aa, Mycobacterium
THMADWICFMLSDSADFLCGSV

SEQ ID NO: 738221 - protein, 20 aa, Mycobacterium
THMNSCLTLAVQCSGRDVTT

SEQ ID NO: 738222 - protein, 18 aa, Mycobacterium
THNGCPQDIEWVIADGAV

SEQ ID NO: 738223 - protein, 26 aa, Mycobacterium
THNGRPAFWVAHSFGGVALARAAAET

SEQ ID NO: 738224 - protein, 23 aa, Mycobacterium
THPDEVRRHMGLTGQVATVDELL

SEQ ID NO: 738225 - protein, 23 aa, Mycobacterium
THPDGRSAFALWFTGGIFVDQDG

SEQ ID NO: 738226 - protein, 23 aa, Mycobacterium
THPDGRSAFALWFTGGIFVNQDG

SEQ ID NO: 738227 - protein, 24 aa, Mycobacterium
THPDGTSAFALWFTGGIFVDDHGR

SEQ ID NO: 738228 - protein, 23 aa, Mycobacterium
THPFRWIAAAVRSLIPAGEPVGV

SEQ ID NO: 738229 - protein, 22 aa, Mycobacterium
THPFSVLRAAALTQWVDTGGYG

SEQ ID NO: 738230 - protein, 22 aa, Mycobacterium
THPHLRKPRVLTIDRIPDSAGE

SEQ ID NO: 738231 - protein, 22 aa, Mycobacterium
THPLGVAAFGREATRRGVPPVV

SEQ ID NO: 738232 - protein, 19 aa, Mycobacterium
THPLKSWGFSYRVYCLAKA

SEQ ID NO: 738233 - protein, 22 aa, Mycobacterium
THPLRPDIPIMLGAEGPKNVAL

SEQ ID NO: 738234 - protein, 17 aa, Mycobacterium
THPVHGPISLGIAAIET

SEQ ID NO: 738235 - protein, 17 aa, Mycobacterium
THPVHGPVSLGLAAIET

SEQ ID NO: 738236 - protein, 26 aa, Mycobacterium
THQIPRAGNMFSVFFGGDPVTDFASA

SEQ ID NO: 738237 - protein, 18 aa, Mycobacterium
THQLPGLDFVQGDAENLP

SEQ ID NO: 738238 - protein, 17 aa, Mycobacterium
THQRLGGPGAWLLAVPP

SEQ ID NO: 738239 - protein, 19 aa, Mycobacterium
THRAEFCIDKLYSPDSARG

SEQ ID NO: 738240 - protein, 17 aa, Mycobacterium
THRARAVILAMGAAARY

SEQ ID NO: 738241 - protein, 19 aa, Mycobacterium
THRDALTGLFTLWFSEHTA

SEQ ID NO: 738242 - protein, 20 aa, Mycobacterium
THRECPADVVGEIWVHGDNV

SEQ ID NO: 738243 - protein, 19 aa, Mycobacterium
THREHIFDGIESCVDALNG

SEQ ID NO: 738244 - protein, 19 aa, Mycobacterium
THRELPKRRPVPLRLKDWH

SEQ ID NO: 738245 - protein, 19 aa, Mycobacterium
THRELPKRRPVPLRLRDWR

SEQ ID NO: 738246 - protein, 17 aa, Mycobacterium
THRGRRSARPSGDDREL

SEQ ID NO: 738247 - protein, 19 aa, Mycobacterium
THRGYRYEFLDGEPEFGAP

SEQ ID NO: 738248 - protein, 26 aa, Mycobacterium
THRKGLAAFRRAGGRIVESVSPATDL

SEQ ID NO: 738249 - protein, 17 aa, Mycobacterium
THRLIQTGVTWKDLGLV

SEQ ID NO: 738250 - protein, 17 aa, Mycobacterium
THRLLQTGVTWKDLGLI

SEQ ID NO: 738251 - protein, 23 aa, Mycobacterium
THRLPEPFLVLATDNPIEYEGTY

SEQ ID NO: 738252 - protein, 17 aa, Mycobacterium
THRPDWPQSTAVGKTAV

SEQ ID NO: 738253 - protein, 28 aa, Mycobacterium
THRPPACRFWNLVVWNQFMAVPGVEDAR

SEQ ID NO: 738254 - protein, 25 aa, Mycobacterium
THRPPACRFWNMVVWNQFMATYGAS

SEQ ID NO: 738255 - protein, 27 aa, Mycobacterium
THRPPPCRFWNLVVWNQFMATFGASEG

SEQ ID NO: 738256 - protein, 26 aa, Mycobacterium
THRPPSCRFWNLVVWNQFMATCGAAD

SEQ ID NO: 738257 - protein, 19 aa, Mycobacterium
THRPRPGLTDADRNCISNI

SEQ ID NO: 738258 - protein, 26 aa, Mycobacterium
THSFTQRFAVHVTRIPLVIVLFKDIE

SEQ ID NO: 738259 - protein, 20 aa, Mycobacterium
THSLELNLLFGEVAAQLAAA

SEQ ID NO: 738260 - protein, 23 aa, Mycobacterium
THSRFNAALEELRAQIAPLQQVW

SEQ ID NO: 738261 - protein, 17 aa, Mycobacterium
THSSFMLQWGVAVQEMP

SEQ ID NO: 738262 - protein, 24 aa, Mycobacterium
THSSWAFAQLGAFLSYKAARAGVP

SEQ ID NO: 738263 - protein, 17 aa, Mycobacterium
THSSWVLLAGPYAYKLK

SEQ ID NO: 738264 - protein, 19 aa, Mycobacterium
THSTAGWGVGDDVDHAEFG

SEQ ID NO: 738265 - protein, 24 aa, Mycobacterium
THSVRYGRSRLVLPVGPAELSADG

SEQ ID NO: 738266 - protein, 22 aa, Mycobacterium
THTATLRLGHNYIGTEHILLGI

SEQ ID NO: 738267 - protein, 24 aa, Mycobacterium
THTCVTCSDEGRLAEVILPPAGAG

SEQ ID NO: 738268 - protein, 36 aa, Mycobacterium
THTDGSSVLLHFHGHSSLGASGWDAAPAGYTRQASS

SEQ ID NO: 738269 - protein, 18 aa, Mycobacterium
THTEFRKLVSRGFTPRQV

SEQ ID NO: 738270 - protein, 22 aa, Mycobacterium
THTKGRMLAWASFYDEDGHPIA

SEQ ID NO: 738271 - protein, 18 aa, Mycobacterium
THTMVPFFYGYIGYAALA

SEQ ID NO: 738272 - protein, 17 aa, Mycobacterium
THTRLGTGVVRITLPAK

SEQ ID NO: 738273 - protein, 26 aa, Mycobacterium
THTTFPYVLCDATFCKVHIGAHEVSQ

SEQ ID NO: 738274 - protein, 22 aa, Mycobacterium
THTVCMDIDWVVGGCMNVDPEN

SEQ ID NO: 738275 - protein, 17 aa, Mycobacterium
THVRATGGVHILVHVAG

SEQ ID NO: 738276 - protein, 21 aa, Mycobacterium
THVRECLKRGEVVELAHLRAD

SEQ ID NO: 738277 - protein, 17 aa, Mycobacterium
THVRLRGKEQAHFLSPM

SEQ ID NO: 738278 - protein, 17 aa, Mycobacterium
THVRLRGREQAHFLSPI

SEQ ID NO: 738279 - protein, 24 aa, Mycobacterium
THVTRLRLITSMLDRGYNLAHVDE

SEQ ID NO: 738280 - protein, 24 aa, Mycobacterium
THVVRRYGVEFEHPGPRLRDYVLA

SEQ ID NO: 738281 - protein, 20 aa, Mycobacterium
THVYTKLGFNSRVQLAQQAA

SEQ ID NO: 738282 - protein, 17 aa, Mycobacterium
THWGVFSAEIVDGDIAA

SEQ ID NO: 738283 - protein, 17 aa, Mycobacterium
THWKLNPVFDECGFDYY

SEQ ID NO: 738284 - protein, 18 aa, Mycobacterium
THWWAHRALWHLIFSGAL

SEQ ID NO: 738285 - protein, 17 aa, Mycobacterium
THYCLGSALARLEGRIA

SEQ ID NO: 738286 - protein, 25 aa, Mycobacterium
THYHKIHLYDAFGFTESRTVAPGFT

SEQ ID NO: 738287 - protein, 27 aa, Mycobacterium
THYRPIAWDDAYRLIADELNALDSPDE

SEQ ID NO: 738288 - protein, 22 aa, Mycobacterium
TIAAAVSEWFTVDWHREIVDKW

SEQ ID NO: 738289 - protein, 27 aa, Mycobacterium
TIAAGPSMVRWARANGWSARPEAGARE

SEQ ID NO: 738290 - protein, 22 aa, Mycobacterium
TIAAPVEMVFDWLADPHALTAA

SEQ ID NO: 738291 - protein, 19 aa, Mycobacterium
TIAAVGSVEECRRALPGAE

SEQ ID NO: 738292 - protein, 27 aa, Mycobacterium
TIACFPVKIHAASAGWTRAVAMIDDTN

SEQ ID NO: 738293 - protein, 23 aa, Mycobacterium
TIACPDCGPRLSWNGDEHDDPIG

SEQ ID NO: 738294 - protein, 25 aa, Mycobacterium
TIADFVRCAWLAREAGYDGVEIMGS

SEQ ID NO: 738295 - protein, 25 aa, Mycobacterium
TIAEAAQAFSTWRDTPAPVRGALVS

SEQ ID NO: 738296 - protein, 18 aa, Mycobacterium
TIAGELYVAPSTVKTHVQ

SEQ ID NO: 738297 - protein, 19 aa, Mycobacterium
TIAGLRAFVAIAEKRQFSG

SEQ ID NO: 738298 - protein, 19 aa, Mycobacterium
TIAGLRAFVAVAEKHQFSG

SEQ ID NO: 738299 - protein, 20 aa, Mycobacterium
TIAHSGRPGFKRASRVAPLI

SEQ ID NO: 738300 - protein, 24 aa, Mycobacterium
TIAKFLDKRGPGIQQMAVRVSDLD

SEQ ID NO: 738301 - protein, 22 aa, Mycobacterium
TIAKFRAARNLWARVAEVVGDP

SEQ ID NO: 738302 - protein, 25 aa, Mycobacterium
TIAKLGPDVTGWAEGDRVVVAAGRP

SEQ ID NO: 738303 - protein, 19 aa, Mycobacterium
TIAKWDGDRLTLWDKVQHI

SEQ ID NO: 738304 - protein, 23 aa, Mycobacterium
TIALGLRLNWVRPETRRTLEVGS

SEQ ID NO: 738305 - protein, 23 aa, Mycobacterium
TIAMTRWQATVNWVADEPSAAEL

SEQ ID NO: 738306 - protein, 26 aa, Mycobacterium
TIAQCRLAFDMMCERALSRESHGKVI

SEQ ID NO: 738307 - protein, 20 aa, Mycobacterium
TIARALRWQFDGVDRVGPDL

SEQ ID NO: 738308 - protein, 19 aa, Mycobacterium
TIASFGWTRDDVRRYLWLN

SEQ ID NO: 738309 - protein, 18 aa, Mycobacterium
TIASTFLGLVPFPATPAL

SEQ ID NO: 738310 - protein, 18 aa, Mycobacterium
TIAYRLLATLSQFRYVAK

SEQ ID NO: 738311 - protein, 18 aa, Mycobacterium
TICTTWDVTDFRGEPVTV

SEQ ID NO: 738312 - protein, 24 aa, Mycobacterium
TIDAAGLLRIWKSLIVLYPDGTPR

SEQ ID NO: 738313 - protein, 19 aa, Mycobacterium
TIDATGWSPARLEGAIRDA

SEQ ID NO: 738314 - protein, 24 aa, Mycobacterium
TIDCTGRVLLPGFVDLHTHLREPG

SEQ ID NO: 738315 - protein, 23 aa, Mycobacterium
TIDEGAVCTAMLDLYQNEGIIAE

SEQ ID NO: 738316 - protein, 30 aa, Mycobacterium
TIDEMPLDWFLRPAVKLDFRHLDDGYVATA

SEQ ID NO: 738317 - protein, 17 aa, Mycobacterium
TIDGDRVGAGWVAGGSD

SEQ ID NO: 738318 - protein, 17 aa, Mycobacterium
TIDIPRRTIGLDVADDE

SEQ ID NO: 738319 - protein, 19 aa, Mycobacterium
TIDKVHWFYSLSPEDRRTY

SEQ ID NO: 738320 - protein, 25 aa, Mycobacterium
TIDLDGWRIGLGICRDTGVPEHVRG

SEQ ID NO: 738321 - protein, 25 aa, Mycobacterium
TIDLFPGALLWLPRRSRRQFTAGAE

SEQ ID NO: 738322 - protein, 26 aa, Mycobacterium
TIDLGSGCLMPGFVEAHGHPLMEAIV

SEQ ID NO: 738323 - protein, 22 aa, Mycobacterium
TIDPEAFVGWKQRNSKPADASV

SEQ ID NO: 738324 - protein, 24 aa, Mycobacterium
TIDQCTGCGGVFLDRGELEQLSEA

SEQ ID NO: 738325 - protein, 19 aa, Mycobacterium
TIDRPQSWWQGVRLRAESD

SEQ ID NO: 738326 - protein, 23 aa, Mycobacterium
TIDTDWYLAWLAREAKNAGVCVD

SEQ ID NO: 738327 - protein, 24 aa, Mycobacterium
TIDTDWYLAWLARQAEAAGITVVR

SEQ ID NO: 738328 - protein, 24 aa, Mycobacterium
TIDYKTYDAQGWIITATTDGTRFQ

SEQ ID NO: 738329 - protein, 22 aa, Mycobacterium
TIDYRDAWRLQRELADTRVAGG

SEQ ID NO: 738330 - protein, 24 aa, Mycobacterium
TIECLRSILGGARVDYHGRHVASH

SEQ ID NO: 738331 - protein, 23 aa, Mycobacterium
TIEDLGYGSVWVGGVFTADLAYV

SEQ ID NO: 738332 - protein, 23 aa, Mycobacterium
TIEEGLNWLAEIHRACGAILSDR

SEQ ID NO: 738333 - protein, 25 aa, Mycobacterium
TIEEKRITATFLVPSMLYALMDHPD

SEQ ID NO: 738334 - protein, 19 aa, Mycobacterium
TIEELRRVNAPTLVIAGND

SEQ ID NO: 738335 - protein, 19 aa, Mycobacterium
TIEIRVCDGISNLRELGAL

SEQ ID NO: 738336 - protein, 20 aa, Mycobacterium
TIELRICDGVSNLRELGALV

SEQ ID NO: 738337 - protein, 20 aa, Mycobacterium
TIEPGERVLLLGASGSGKST

SEQ ID NO: 738338 - protein, 18 aa, Mycobacterium
TIERCLRSILDQDAEYEL

SEQ ID NO: 738339 - protein, 26 aa, Mycobacterium
TIERLAGWLIRVVTEFADNVDQTLRD

SEQ ID NO: 738340 - protein, 19 aa, Mycobacterium
TIEVRVCDGVSNLRELGAL

SEQ ID NO: 738341 - protein, 20 aa, Mycobacterium
TIFAFGCYVGEVLVRNAGYE

SEQ ID NO: 738342 - protein, 17 aa, Mycobacterium
TIFPRHISVPTIPALAR

SEQ ID NO: 738343 - protein, 24 aa, Mycobacterium
TIFRLGSDPGLARFIDQVARRVEG

SEQ ID NO: 738344 - protein, 25 aa, Mycobacterium
TIFRLGSDPGLARFIDQVARRVEGR

SEQ ID NO: 738345 - protein, 25 aa, Mycobacterium
TIFRLGSDRGLARFIDQVARRVEGR

SEQ ID NO: 738346 - protein, 27 aa, Mycobacterium
TIFTRSRPNPSWPVARVEYSHADSEDS

SEQ ID NO: 738347 - protein, 25 aa, Mycobacterium
TIGAGSFPWVLAITCPYRDAAERNA

SEQ ID NO: 738348 - protein, 25 aa, Mycobacterium
TIGAGSFPWVLAITSPYTDAAHRQA

SEQ ID NO: 738349 - protein, 18 aa, Mycobacterium
TIGALGFLLERGCHHLQA

SEQ ID NO: 738350 - protein, 17 aa, Mycobacterium
TIGAWLWSGRRAVIAGV

SEQ ID NO: 738351 - protein, 18 aa, Mycobacterium
TIGDAVMFVCPDPVPLLD

SEQ ID NO: 738352 - protein, 17 aa, Mycobacterium
TIGDAWAADVVVKVAPP

SEQ ID NO: 738353 - protein, 18 aa, Mycobacterium
TIGDAWAADVVVKVAPPT

SEQ ID NO: 738354 - protein, 18 aa, Mycobacterium
TIGDGWSGPGARAALSTM

SEQ ID NO: 738355 - protein, 19 aa, Mycobacterium
TIGEGGRVIGLASIAGIAG

SEQ ID NO: 738356 - protein, 25 aa, Mycobacterium
TIGGIKFKIRFLRVNQRHHSVAIAA

SEQ ID NO: 738357 - protein, 24 aa, Mycobacterium
TIGKLSVPPTWAGASPVATPTSTS

SEQ ID NO: 738358 - protein, 24 aa, Mycobacterium
TIGPKLHGGVMLALLAGAARESLT

SEQ ID NO: 738359 - protein, 26 aa, Mycobacterium
TIGPPRWDTLIVGLDWETEKLDDRIA

SEQ ID NO: 738360 - protein, 23 aa, Mycobacterium
TIGQCAAGHPFGCFDTEDPHPFV

SEQ ID NO: 738361 - protein, 26 aa, Mycobacterium
TIGRKRAKEMWYLNGKFTAAKAEAMG

SEQ ID NO: 738362 - protein, 17 aa, Mycobacterium
TIGRLTALRAEYGRAEQ

SEQ ID NO: 738363 - protein, 22 aa, Mycobacterium
TIGRPALTSIRVRAEGFEAIED

SEQ ID NO: 738364 - protein, 24 aa, Mycobacterium
TIGTRVSAIFVRLGQPRASMPERI

SEQ ID NO: 738365 - protein, 23 aa, Mycobacterium
TIGWLTWHIVYWWSGALASLSGD

SEQ ID NO: 738366 - protein, 30 aa, Mycobacterium
TIGYDLPLPLPRISYADAMRRFGSDKPDLR

SEQ ID NO: 738367 - protein, 20 aa, Mycobacterium
TIHKLAFPDRFLRATSDDAP

SEQ ID NO: 738368 - protein, 23 aa, Mycobacterium
TIHPDGFLTYRVVGSQQHAFRPP

SEQ ID NO: 738369 - protein, 22 aa, Mycobacterium
TIHPEGFLTYRVVGESDHGYRP

SEQ ID NO: 738370 - protein, 17 aa, Mycobacterium
TIHRLIRTLLNNGYVRQ

SEQ ID NO: 738371 - protein, 18 aa, Mycobacterium
TIHRVWRSKLPETLERGA

SEQ ID NO: 738372 - protein, 22 aa, Mycobacterium
TIIDMWLPLSWSLNMVNRSMGH

SEQ ID NO: 738373 - protein, 30 aa, Mycobacterium
TIIDVPWDGVWWWSRPDGSLQLVPFSRAEQ

SEQ ID NO: 738374 - protein, 22 aa, Mycobacterium
TIIEMWLPLAWSLNMVNRSMGH

SEQ ID NO: 738375 - protein, 23 aa, Mycobacterium
TIIEVIGELGLDYQIAHNRGALM

SEQ ID NO: 738376 - protein, 17 aa, Mycobacterium
TIISANLDSCFVVTAAA

SEQ ID NO: 738377 - protein, 20 aa, Mycobacterium
TIKAGIAYIRERVMPALEIA

SEQ ID NO: 738378 - protein, 24 aa, Mycobacterium
TIKAVLPGMRARRRGAIVNISSIG

SEQ ID NO: 738379 - protein, 25 aa, Mycobacterium
TIKDWKGKLKFLAKKIPFAGTLAEI

SEQ ID NO: 738380 - protein, 18 aa, Mycobacterium
TIKSVKFVLTRPCVLFSK

SEQ ID NO: 738381 - protein, 31 aa, Mycobacterium
TIKTLPENVKFFFTGIPWKTYPQTLKAFVAL

SEQ ID NO: 738382 - protein, 25 aa, Mycobacterium
TIKWDMDEMFGGRFCSHNSGNSCTP

SEQ ID NO: 738383 - protein, 20 aa, Mycobacterium
TILARGRTPLTIDEGIALVV

SEQ ID NO: 738384 - protein, 18 aa, Mycobacterium
TILARLALQAGMPDGVLN

SEQ ID NO: 738385 - protein, 24 aa, Mycobacterium
TILDAACGPGLYAEELAKRGASLI

SEQ ID NO: 738386 - protein, 23 aa, Mycobacterium
TILEEARIPFLREPFGETITTIG

SEQ ID NO: 738387 - protein, 19 aa, Mycobacterium
TILHYIILSYEVDKVLARR

SEQ ID NO: 738388 - protein, 18 aa, Mycobacterium
TILKANWQRAAKVLGSSR

SEQ ID NO: 738389 - protein, 23 aa, Mycobacterium
TILPVHECWDLMKSVTLGRLVTS

SEQ ID NO: 738390 - protein, 25 aa, Mycobacterium
TILPVSECWELLKSVTLGRLVTSVD

SEQ ID NO: 738391 - protein, 20 aa, Mycobacterium
TILRELPAVRGVVHAAGVEA

SEQ ID NO: 738392 - protein, 26 aa, Mycobacterium
TILREPRGDGGFGYDPVFLPAGSERS

SEQ ID NO: 738393 - protein, 19 aa, Mycobacterium
TILSSRWQDLHTVLAAPMQ

SEQ ID NO: 738394 - protein, 22 aa, Mycobacterium
TILTLGAPFALTAVQSAKNAGS

SEQ ID NO: 738395 - protein, 26 aa, Mycobacterium
TILVLWAVDGCDAMLLRATTALPGAR

SEQ ID NO: 738396 - protein, 25 aa, Mycobacterium
TIMEARHLILIAMGRSKAEAVHHLV

SEQ ID NO: 738397 - protein, 18 aa, Mycobacterium
TIMIARSVAKFASPEIRD

SEQ ID NO: 738398 - protein, 27 aa, Mycobacterium
TINGYRGCSHACRYCFARPTHEYLDFD

SEQ ID NO: 738399 - protein, 17 aa, Mycobacterium
TINLCILSPTGYIRDTF

SEQ ID NO: 738400 - protein, 22 aa, Mycobacterium
TINLRFLSLRDHLEVITDARAF

SEQ ID NO: 738401 - protein, 22 aa, Mycobacterium
TINRPEAFNALDGEVIGALAAE

SEQ ID NO: 738402 - protein, 17 aa, Mycobacterium
TIPAGFSRIDAFRDGVA

SEQ ID NO: 738403 - protein, 18 aa, Mycobacterium
TIPAGKPVFLINGAANRD

SEQ ID NO: 738404 - protein, 23 aa, Mycobacterium
TIPDPFGGPGRVPTMLVTDISLR

SEQ ID NO: 738405 - protein, 25 aa, Mycobacterium
TIPEIPINLPLSVPLHIPVEGRTTE

SEQ ID NO: 738406 - protein, 18 aa, Mycobacterium
TIPGFRRNAVTIATGGVY

SEQ ID NO: 738407 - protein, 17 aa, Mycobacterium
TIPGRRAAWLVIDVRDV

SEQ ID NO: 738408 - protein, 23 aa, Mycobacterium
TIPGVLKNAIDWLSRPYGDSALK

SEQ ID NO: 738409 - protein, 24 aa, Mycobacterium
TIPLIDIPAGPGFGNSSTSPSSGF

SEQ ID NO: 738410 - protein, 18 aa, Mycobacterium
TIPPFVIDTPMLREQQAA

SEQ ID NO: 738411 - protein, 22 aa, Mycobacterium
TIPSFLRYGAYPQIVVVREQSP

SEQ ID NO: 738412 - protein, 18 aa, Mycobacterium
TIQQMLYGLLIRRRNVFF

SEQ ID NO: 738413 - protein, 26 aa, Mycobacterium
TIQRAHECLRLLGVATEVLRGRQRTY

SEQ ID NO: 738414 - protein, 18 aa, Mycobacterium
TIRARKLLIASGLVDHLP

SEQ ID NO: 738415 - protein, 20 aa, Mycobacterium
TIRARMFAPHMGIREDEATG

SEQ ID NO: 738416 - protein, 19 aa, Mycobacterium
TIRDGRILKIEASVDPSAA

SEQ ID NO: 738417 - protein, 17 aa, Mycobacterium
TIRGDLGLETQFNLVHG

SEQ ID NO: 738418 - protein, 17 aa, Mycobacterium
TIRGRSLLVDHVLTELG

SEQ ID NO: 738419 - protein, 26 aa, Mycobacterium
TIRLRLELLATEWALPRLDAETTVAL

SEQ ID NO: 738420 - protein, 17 aa, Mycobacterium
TIRPYRPSLSHPVPPAA

SEQ ID NO: 738421 - protein, 17 aa, Mycobacterium
TIRPYRPSLSQAVPPAA

SEQ ID NO: 738422 - protein, 18 aa, Mycobacterium
TIRQAWQDGMEPFLGIAV

SEQ ID NO: 738423 - protein, 23 aa, Mycobacterium
TIRQRLGGIEGRRIVIVGDILHS

SEQ ID NO: 738424 - protein, 23 aa, Mycobacterium
TIRQRLGGIEGRRVVIVGDILHS

SEQ ID NO: 738425 - protein, 24 aa, Mycobacterium
TIRQRLGGIEGRRVVIVGDILHSR

SEQ ID NO: 738426 - protein, 24 aa, Mycobacterium
TIRQRLGGIEGRRVVIVGDVLHSR

SEQ ID NO: 738427 - protein, 24 aa, Mycobacterium
TIRQRLGSLEGRRVVIVGDILHSR

SEQ ID NO: 738428 - protein, 19 aa, Mycobacterium
TIRQVDPVRQWKLSPTDLA

SEQ ID NO: 738429 - protein, 23 aa, Mycobacterium
TIRRDLKVLAGRRLLKRVHGGAV

SEQ ID NO: 738430 - protein, 30 aa, Mycobacterium
TIRRYAHLWADPRMVICVFHNNDLAHVTWE

SEQ ID NO: 738431 - protein, 28 aa, Mycobacterium
TIRTGRANPGMFSRIVIDYYGAATPITQ

SEQ ID NO: 738432 - protein, 27 aa, Mycobacterium
TIRTGRANPGMFSRIVIDYYGATTPIT

SEQ ID NO: 738433 - protein, 24 aa, Mycobacterium
TIRVCGADVPFGPDLLFGASDLPG

SEQ ID NO: 738434 - protein, 18 aa, Mycobacterium
TIRVSAVVLRDDRGAVLT

SEQ ID NO: 738435 - protein, 22 aa, Mycobacterium
TIRWSWAPGDVAIWDNRATQHR

SEQ ID NO: 738436 - protein, 20 aa, Mycobacterium
TIRYELIGSMPAGVSGKDVF

SEQ ID NO: 738437 - protein, 25 aa, Mycobacterium
TISARAEWAPEFAIHDLDSPDALAA

SEQ ID NO: 738438 - protein, 19 aa, Mycobacterium
TISARFCLMATGPLSAALT

SEQ ID NO: 738439 - protein, 18 aa, Mycobacterium
TISAWLAGDVRLEPGELV

SEQ ID NO: 738440 - protein, 17 aa, Mycobacterium
TISELLHQATLAYERGD

SEQ ID NO: 738441 - protein, 28 aa, Mycobacterium
TISMYPRMWAAGGIDYPTLLAAMVDTAI

SEQ ID NO: 738442 - protein, 21 aa, Mycobacterium
TISMYPRMWDATGVDYPTLLD

SEQ ID NO: 738443 - protein, 23 aa, Mycobacterium
TISRRVREALAMADSDPIHPGQL

SEQ ID NO: 738444 - protein, 19 aa, Mycobacterium
TISVPTLYALGALGSLRAR

SEQ ID NO: 738445 - protein, 18 aa, Mycobacterium
TITFAGFLKAYVETVDEL

SEQ ID NO: 738446 - protein, 24 aa, Mycobacterium
TITGFRIKIDSCVGQSFIRSYATM

SEQ ID NO: 738447 - protein, 23 aa, Mycobacterium
TITGIGAGGIWAADNRTFYYTTV

SEQ ID NO: 738448 - protein, 23 aa, Mycobacterium
TITIPQFRTLVILSNRGPINLAT

SEQ ID NO: 738449 - protein, 17 aa, Mycobacterium
TITNLQSLGATWAANPA

SEQ ID NO: 738450 - protein, 26 aa, Mycobacterium
TITPRFLLHLLSWVPVEAGIYRVNRV

SEQ ID NO: 738451 - protein, 25 aa, Mycobacterium
TITWTLPDVRAWWEMTWKGRPDPDV

SEQ ID NO: 738452 - protein, 24 aa, Mycobacterium
TIVALKYPGGVLIAGDRRSTQGNM

SEQ ID NO: 738453 - protein, 18 aa, Mycobacterium
TIVASAGSYVWDGGGRRL

SEQ ID NO: 738454 - protein, 25 aa, Mycobacterium
TIVAVGVAWHAGVGMYPWIPANMGN

SEQ ID NO: 738455 - protein, 19 aa, Mycobacterium
TIVCGDRGLAVQVKARTEA

SEQ ID NO: 738456 - protein, 28 aa, Mycobacterium
TIVINAEFEAPIQRIWQIYADPRQLEKV

SEQ ID NO: 738457 - protein, 17 aa, Mycobacterium
TIVLVHGAFEDGSVWNG

SEQ ID NO: 738458 - protein, 24 aa, Mycobacterium
TIVRDLRAEFGWLGVALQAYLRRT

SEQ ID NO: 738459 - protein, 17 aa, Mycobacterium
TIVRHAPGLKVVVIGGG

SEQ ID NO: 738460 - protein, 18 aa, Mycobacterium
TIVVDRGRYLGRKGHGVF

SEQ ID NO: 738461 - protein, 24 aa, Mycobacterium
TIVVSRAGAAPALALFDDDELGEA

SEQ ID NO: 738462 - protein, 18 aa, Mycobacterium
TIVWDYPTIRAMAAHLMS

SEQ ID NO: 738463 - protein, 20 aa, Mycobacterium
TIWGFPKIMADFNVREGKKF

SEQ ID NO: 738464 - protein, 20 aa, Mycobacterium
TIWGFPKIMADFNVREGPKF

SEQ ID NO: 738465 - protein, 26 aa, Mycobacterium
TIWVLRGHAFLGYWRTDSALSTVSTT

SEQ ID NO: 738466 - protein, 17 aa, Mycobacterium
TIYRFHEALSLYGPALK

SEQ ID NO: 738467 - protein, 21 aa, Mycobacterium
TIYRFYEMLQVYGTTLKALIH

SEQ ID NO: 738468 - protein, 24 aa, Mycobacterium
TKADLRQTYPFGMFAVPQSQISRV

SEQ ID NO: 738469 - protein, 21 aa, Mycobacterium
TKADPLLVLRDLLGHSTVLTT

SEQ ID NO: 738470 - protein, 26 aa, Mycobacterium
TKAEQWSGFGDFGFSATVSSVSKPRS

SEQ ID NO: 738471 - protein, 29 aa, Mycobacterium
TKAFKDAEAHFAEALGLTKPDPKSAALEK

SEQ ID NO: 738472 - protein, 19 aa, Mycobacterium
TKAFLPYLIASGDGHVINV

SEQ ID NO: 738473 - protein, 25 aa, Mycobacterium
TKAGIDRKALRVILGNPLIAITMLR

SEQ ID NO: 738474 - protein, 17 aa, Mycobacterium
TKAGIPRQLSWDCPQGP

SEQ ID NO: 738475 - protein, 21 aa, Mycobacterium
TKAGLPVDQFIATVQRFNGFA

SEQ ID NO: 738476 - protein, 18 aa, Mycobacterium
TKAGYAFERVPKAEVEDL

SEQ ID NO: 738477 - protein, 29 aa, Mycobacterium
TKAKEQPLWRVLVALSIRHVGPTAARALA

SEQ ID NO: 738478 - protein, 23 aa, Mycobacterium
TKALRTGFVAAFSVPANQLPDEV

SEQ ID NO: 738479 - protein, 19 aa, Mycobacterium
TKALVRFSDEFGIQVANTF

SEQ ID NO: 738480 - protein, 20 aa, Mycobacterium
TKARVLRPYAEKLITHAKKG

SEQ ID NO: 738481 - protein, 25 aa, Mycobacterium
TKASRPRFQRLWGTPYNFQKVTCTW

SEQ ID NO: 738482 - protein, 27 aa, Mycobacterium
TKAVDIALEWLTRGDLNIAQGWMNRAR

SEQ ID NO: 738483 - protein, 18 aa, Mycobacterium
TKAVLRARRLIYLEDQYL

SEQ ID NO: 738484 - protein, 21 aa, Mycobacterium
TKAYLARLVTRQALNTLRAQS

SEQ ID NO: 738485 - protein, 20 aa, Mycobacterium
TKCELVHAALVFALPPVPEL

SEQ ID NO: 738486 - protein, 18 aa, Mycobacterium
TKCELVHAALVHTLPPLP

SEQ ID NO: 738487 - protein, 17 aa, Mycobacterium
TKCLCRIHHLVKTFWAG

SEQ ID NO: 738488 - protein, 25 aa, Mycobacterium
TKCQLPVTLPQLLGLVQAAQQQGTA

SEQ ID NO: 738489 - protein, 26 aa, Mycobacterium
TKDCIQILGGIGFTWEHDAHLYLRRA

SEQ ID NO: 738490 - protein, 23 aa, Mycobacterium
TKDEIIRMVDLMITRVGNQLKAK

SEQ ID NO: 738491 - protein, 25 aa, Mycobacterium
TKDGDWKIVTGLEINDFSRARIDKS

SEQ ID NO: 738492 - protein, 24 aa, Mycobacterium
TKDGDWTIVSGLEIDEFSRGRIDK

SEQ ID NO: 738493 - protein, 24 aa, Mycobacterium
TKDGRPKPVPVWAALDGDHGDRLL

SEQ ID NO: 738494 - protein, 19 aa, Mycobacterium
TKDHIEAIANWDPEAEPSV

SEQ ID NO: 738495 - protein, 19 aa, Mycobacterium
TKDHIEAIANWDPKAEPSI

SEQ ID NO: 738496 - protein, 19 aa, Mycobacterium
TKDHIEAIANWDPNAEPSI

SEQ ID NO: 738497 - protein, 19 aa, Mycobacterium
TKDHIEAIANWDPQAEPSI

SEQ ID NO: 738498 - protein, 20 aa, Mycobacterium
TKDLIIRGGHNIDPATTEDA

SEQ ID NO: 738499 - protein, 22 aa, Mycobacterium
TKDLPAATGDDIVWADAVIFGS

SEQ ID NO: 738500 - protein, 22 aa, Mycobacterium
TKDLPAATGEDIVWADAVIFGS

SEQ ID NO: 738501 - protein, 23 aa, Mycobacterium
TKDLPAATGEDIVWADAVVFGSP

SEQ ID NO: 738502 - protein, 23 aa, Mycobacterium
TKDLPVATGDDIVWADAVIFGSP

SEQ ID NO: 738503 - protein, 23 aa, Mycobacterium
TKDVHIGPSDHVGWLDDRKWAYV

SEQ ID NO: 738504 - protein, 18 aa, Mycobacterium
TKEACDFRDNLHDLNDAG

SEQ ID NO: 738505 - protein, 21 aa, Mycobacterium
TKEELLRVFAPYANKDTENGI

SEQ ID NO: 738506 - protein, 29 aa, Mycobacterium
TKEERAVVEFARYRCFLLGLPEELLPSEP

SEQ ID NO: 738507 - protein, 18 aa, Mycobacterium
TKELGLAAFVAFSSMAGI

SEQ ID NO: 738508 - protein, 25 aa, Mycobacterium
TKERGWRVIPAVSMTLALAARYASR

SEQ ID NO: 738509 - protein, 18 aa, Mycobacterium
TKETIAYCRIGERSSHTW

SEQ ID NO: 738510 - protein, 18 aa, Mycobacterium
TKETLGWIALNQRANAAL

SEQ ID NO: 738511 - protein, 18 aa, Mycobacterium
TKETLGWIALNQRANAEL

SEQ ID NO: 738512 - protein, 17 aa, Mycobacterium
TKFADEWLPCAAGTDGA

SEQ ID NO: 738513 - protein, 21 aa, Mycobacterium
TKFDLSLDPLVPLPGFVIKRA

SEQ ID NO: 738514 - protein, 19 aa, Mycobacterium
TKFDNPWLFDVGRHPNPHV

SEQ ID NO: 738515 - protein, 25 aa, Mycobacterium
TKFGMAVEMCLRVLRGGVEGNRLAC

SEQ ID NO: 738516 - protein, 24 aa, Mycobacterium
TKGDLYTLWAPRWRDAGDEWEAFL

SEQ ID NO: 738517 - protein, 24 aa, Mycobacterium
TKGGDAYGSIWLNAGVGSVVRLKG

SEQ ID NO: 738518 - protein, 18 aa, Mycobacterium
TKGGTIWITGLSASGKST

SEQ ID NO: 738519 - protein, 17 aa, Mycobacterium
TKGLSLFFVPKFHFDHE

SEQ ID NO: 738520 - protein, 17 aa, Mycobacterium
TKGLSLFFVPKFIPNFE

SEQ ID NO: 738521 - protein, 17 aa, Mycobacterium
TKGLSLFYVPKFLFDPE

SEQ ID NO: 738522 - protein, 17 aa, Mycobacterium
TKGMLMLVYGVDEMAAF

SEQ ID NO: 738523 - protein, 23 aa, Mycobacterium
TKGPAVVEFNCRFGDPETQAVLA

SEQ ID NO: 738524 - protein, 23 aa, Mycobacterium
TKGRPAIKSFLVPREHPGVTIER

SEQ ID NO: 738525 - protein, 18 aa, Mycobacterium
TKGRVAVNIVTTGTPAAA

SEQ ID NO: 738526 - protein, 20 aa, Mycobacterium
TKGSFYWHFRDMAAYRAALV

SEQ ID NO: 738527 - protein, 20 aa, Mycobacterium
TKGSSLQVFVLRPCIVAGPE

SEQ ID NO: 738528 - protein, 25 aa, Mycobacterium
TKHLLRKGFEFKELEAAGLSREGKR

SEQ ID NO: 738529 - protein, 24 aa, Mycobacterium
TKHLLRKGFEFKELEAAGLSREGR

SEQ ID NO: 738530 - protein, 24 aa, Mycobacterium
TKHLMRKGFEFKELEAAGLSREGR

SEQ ID NO: 738531 - protein, 17 aa, Mycobacterium
TKHLVRKGFEFKELEAA

SEQ ID NO: 738532 - protein, 23 aa, Mycobacterium
TKHLVRKGFEFKELEAAGLSRQG

SEQ ID NO: 738533 - protein, 21 aa, Mycobacterium
TKHPAELLVLGPYFEAHTYVI

SEQ ID NO: 738534 - protein, 24 aa, Mycobacterium
TKHSLNYWYRMFAPAFDTSLGLEF

SEQ ID NO: 738535 - protein, 22 aa, Mycobacterium
TKIECSCAGLTPGQAYTTAQLV

SEQ ID NO: 738536 - protein, 17 aa, Mycobacterium
TKIEPSLTRISALMDLL

SEQ ID NO: 738537 - protein, 22 aa, Mycobacterium
TKIVEILNAFTLTRPAMTLGEI

SEQ ID NO: 738538 - protein, 25 aa, Mycobacterium
TKKSEVSTVWTWPDKPGVAGCAAMD

SEQ ID NO: 738539 - protein, 24 aa, Mycobacterium
TKKVADVMLRYNFPAAGLTDDALR

SEQ ID NO: 738540 - protein, 27 aa, Mycobacterium
TKLALSRAALELALDRGDLAAVTVDDI

SEQ ID NO: 738541 - protein, 23 aa, Mycobacterium
TKLDPAMCDAWLARLLAGDQTMD

SEQ ID NO: 738542 - protein, 17 aa, Mycobacterium
TKLDRWRRDVTFNTDGA

SEQ ID NO: 738543 - protein, 21 aa, Mycobacterium
TKLFAARGYHGTRMDDVADAV

SEQ ID NO: 738544 - protein, 21 aa, Mycobacterium
TKLGDPYVWGATGPRQYDCSG

SEQ ID NO: 738545 - protein, 29 aa, Mycobacterium
TKLGFPVPIRHWFVDGLLHDWAREMLSTT

SEQ ID NO: 738546 - protein, 29 aa, Mycobacterium
TKLGFSHFLRWERFAVVTDIEWIKQTVKF

SEQ ID NO: 738547 - protein, 18 aa, Mycobacterium
TKLGLKADLLAADDFDDP

SEQ ID NO: 738548 - protein, 21 aa, Mycobacterium
TKLGPSLWHKDFHDAVIVECP

SEQ ID NO: 738549 - protein, 20 aa, Mycobacterium
TKLGVAYAGQADWLIVTADG

SEQ ID NO: 738550 - protein, 17 aa, Mycobacterium
TKLKLAEHMVEGAAIMA

SEQ ID NO: 738551 - protein, 18 aa, Mycobacterium
TKLLKGQHGFLDRLMADP

SEQ ID NO: 738552 - protein, 23 aa, Mycobacterium
TKLLRVRLGEPFMARQGSMVAYQ

SEQ ID NO: 738553 - protein, 21 aa, Mycobacterium
TKLNRSHFVPGRKALILPTLG

SEQ ID NO: 738554 - protein, 18 aa, Mycobacterium
TKLPDEVRIVAAANPPDR

SEQ ID NO: 738555 - protein, 20 aa, Mycobacterium
TKLPGLGGWRRPQEELDESS

SEQ ID NO: 738556 - protein, 22 aa, Mycobacterium
TKLPGLGSWRRPQAELDESSRA

SEQ ID NO: 738557 - protein, 25 aa, Mycobacterium
TKLSIPDLIRLASQALHYLAVYDEH

SEQ ID NO: 738558 - protein, 24 aa, Mycobacterium
TKLSIPDLIRLATQAHHYLAVYDE

SEQ ID NO: 738559 - protein, 19 aa, Mycobacterium
TKLYAARSLLLSAAEKFDA

SEQ ID NO: 738560 - protein, 17 aa, Mycobacterium
TKMGGLMAERVTDLRDI

SEQ ID NO: 738561 - protein, 22 aa, Mycobacterium
TKMGLFPFRRNLSFYGVDLGML

SEQ ID NO: 738562 - protein, 25 aa, Mycobacterium
TKMWMARLYPTYECNTCLVSNGLST

SEQ ID NO: 738563 - protein, 17 aa, Mycobacterium
TKNARAFLGTLTDRKKV

SEQ ID NO: 738564 - protein, 25 aa, Mycobacterium
TKNLIPISVFLRRNPNLMAIQSAIG

SEQ ID NO: 738565 - protein, 26 aa, Mycobacterium
TKNPSRVLGLHFFNPVPVLPLVEVIN

SEQ ID NO: 738566 - protein, 17 aa, Mycobacterium
TKPEDWDAAVATAVSEF

SEQ ID NO: 738567 - protein, 17 aa, Mycobacterium
TKPGVIIVNAARGGLID

SEQ ID NO: 738568 - protein, 19 aa, Mycobacterium
TKPLAEWSEAFAAEPDFFW

SEQ ID NO: 738569 - protein, 22 aa, Mycobacterium
TKPMPSMPVGFWNDRDGSRYRC

SEQ ID NO: 738570 - protein, 22 aa, Mycobacterium
TKPPRWPTFGITVIPKLAEGIE

SEQ ID NO: 738571 - protein, 20 aa, Mycobacterium
TKPQAVPMKVLFDPKIAAKA

SEQ ID NO: 738572 - protein, 17 aa, Mycobacterium
TKPQDWDAAVATALGEF

SEQ ID NO: 738573 - protein, 21 aa, Mycobacterium
TKPSHSFSVLQAMLMIASAGK

SEQ ID NO: 738574 - protein, 17 aa, Mycobacterium
TKPTAWLAEGLLMYLPA

SEQ ID NO: 738575 - protein, 27 aa, Mycobacterium
TKPVAPPSWPRFRTGIAGAQSAGAARE

SEQ ID NO: 738576 - protein, 17 aa, Mycobacterium
TKQAFWVALRTRATRHA

SEQ ID NO: 738577 - protein, 36 aa, Mycobacterium
TKQALTEAVLWPLQHPDTFQRLGVDPPRGVLLYGPP

SEQ ID NO: 738578 - protein, 17 aa, Mycobacterium
TKQELTVFLAVVAGAGV

SEQ ID NO: 738579 - protein, 19 aa, Mycobacterium
TKQHRLWGRYFVAPNGVAD

SEQ ID NO: 738580 - protein, 17 aa, Mycobacterium
TKRARELVVGASLDEGV

SEQ ID NO: 738581 - protein, 26 aa, Mycobacterium
TKRCAEAAVAAAARQGIAPSGAVAAV

SEQ ID NO: 738582 - protein, 20 aa, Mycobacterium
TKRDLAFRFGATHFVTSMEE

SEQ ID NO: 738583 - protein, 22 aa, Mycobacterium
TKRFSSCISVTGPFPGFPVALD

SEQ ID NO: 738584 - protein, 26 aa, Mycobacterium
TKRGERHLAAFVAYAAHAQEHALYAA

SEQ ID NO: 738585 - protein, 25 aa, Mycobacterium
TKRHWPLSRGFERFYGFLGGETDQW

SEQ ID NO: 738586 - protein, 25 aa, Mycobacterium
TKRHWPLSRGFERFYGFMGGETDQW

SEQ ID NO: 738587 - protein, 21 aa, Mycobacterium
TKRIAPIVVLTAFSQRDLVER

SEQ ID NO: 738588 - protein, 20 aa, Mycobacterium
TKRKMLRNLIEVIQAGIDAG

SEQ ID NO: 738589 - protein, 21 aa, Mycobacterium
TKRLRAVDFTLGYEVRSIGAA

SEQ ID NO: 738590 - protein, 21 aa, Mycobacterium
TKRLRAVDFTLGYEVRSVNAD

SEQ ID NO: 738591 - protein, 21 aa, Mycobacterium
TKRLRAVDFTLGYEVRSVSAD

SEQ ID NO: 738592 - protein, 23 aa, Mycobacterium
TKRRVTPEFFARHSVAELQNKPE

SEQ ID NO: 738593 - protein, 24 aa, Mycobacterium
TKRVEGRSGVWLAAGGGKPERKIA

SEQ ID NO: 738594 - protein, 18 aa, Mycobacterium
TKRWAEISDMSHAKLGTN

SEQ ID NO: 738595 - protein, 20 aa, Mycobacterium
TKRWRNLRKITVAQVHGTVL

SEQ ID NO: 738596 - protein, 23 aa, Mycobacterium
TKSAAIATELQSFVTAISTDITT

SEQ ID NO: 738597 - protein, 22 aa, Mycobacterium
TKSAKPGWHGIDVGSPFEHAKS

SEQ ID NO: 738598 - protein, 17 aa, Mycobacterium
TKSARAFLGTLTERKQV

SEQ ID NO: 738599 - protein, 25 aa, Mycobacterium
TKSEGLRIVPTCWMVAEYIDKHPEY

SEQ ID NO: 738600 - protein, 23 aa, Mycobacterium
TKSLEFADMLKLGRTQLQDAVPM

SEQ ID NO: 738601 - protein, 19 aa, Mycobacterium
TKTAMGWSLPVESIGPALE

SEQ ID NO: 738602 - protein, 20 aa, Mycobacterium
TKTDGGWLLNGQKIWSSRAV

SEQ ID NO: 738603 - protein, 19 aa, Mycobacterium
TKTGMGWSLPVESIGPALQ

SEQ ID NO: 738604 - protein, 25 aa, Mycobacterium
TKTHALELLVIVSFVRGLSVRDVEA

SEQ ID NO: 738605 - protein, 23 aa, Mycobacterium
TKTHGKNQFWAHGTLEAARATAA

SEQ ID NO: 738606 - protein, 22 aa, Mycobacterium
TKTPPEHLIDWQGRQWTPESTE

SEQ ID NO: 738607 - protein, 23 aa, Mycobacterium
TKTPVEFDRVLGMLDRLSLSLKG

SEQ ID NO: 738608 - protein, 17 aa, Mycobacterium
TKTSMGWSLPAEKIGPA

SEQ ID NO: 738609 - protein, 19 aa, Mycobacterium
TKTVMGRSILLTRAADGAV

SEQ ID NO: 738610 - protein, 19 aa, Mycobacterium
TKTWEKFEVPDEGIGCGFT

SEQ ID NO: 738611 - protein, 18 aa, Mycobacterium
TKVAGELAVHGVLPSAQV

SEQ ID NO: 738612 - protein, 20 aa, Mycobacterium
TKVAPAYRSSVSVSLSASSA

SEQ ID NO: 738613 - protein, 18 aa, Mycobacterium
TKVCWDRDPDAALKTAHR

SEQ ID NO: 738614 - protein, 23 aa, Mycobacterium
TKVFLDLRVKVAKNWQRDPKQLG

SEQ ID NO: 738615 - protein, 17 aa, Mycobacterium
TKVGASLGVRFTPTLAF

SEQ ID NO: 738616 - protein, 20 aa, Mycobacterium
TKVHHCMADGIAVTHILTGL

SEQ ID NO: 738617 - protein, 22 aa, Mycobacterium
TKVKPGDHVVCSYIPNCGTCRY

SEQ ID NO: 738618 - protein, 25 aa, Mycobacterium
TKVLHLRGAFHGRSGYTLSLTNTKP

SEQ ID NO: 738619 - protein, 20 aa, Mycobacterium
TKVLRIRRYSVITAACALLV

SEQ ID NO: 738620 - protein, 20 aa, Mycobacterium
TKWRYSAFHRSALLERMHAA

SEQ ID NO: 738621 - protein, 27 aa, Mycobacterium
TKYPAALSITGGLSWSKVAAGDAALGA

SEQ ID NO: 738622 - protein, 25 aa, Mycobacterium
TKYPVALTIDGLDWASVVGGDDALG

SEQ ID NO: 738623 - protein, 24 aa, Mycobacterium
TKYPWFRGAGRRKFGFYDEDRGPA

SEQ ID NO: 738624 - protein, 24 aa, Mycobacterium
TLAAHLKLPIDVIATVPIAENMPS

SEQ ID NO: 738625 - protein, 25 aa, Mycobacterium
TLAALIARHRVDLIAIGNGTASRET

SEQ ID NO: 738626 - protein, 18 aa, Mycobacterium
TLAALLIGRKPRLPAKTV

SEQ ID NO: 738627 - protein, 18 aa, Mycobacterium
TLAALPMGIPANFAAPAA

SEQ ID NO: 738628 - protein, 18 aa, Mycobacterium
TLADLALKALTDWRYIDS

SEQ ID NO: 738629 - protein, 20 aa, Mycobacterium
TLADLCFTAGTARSHLEHRA

SEQ ID NO: 738630 - protein, 17 aa, Mycobacterium
TLADLGWTGMTSTVLAT

SEQ ID NO: 738631 - protein, 26 aa, Mycobacterium
TLADLSLPVLRSWLGAQARQGAARST

SEQ ID NO: 738632 - protein, 25 aa, Mycobacterium
TLADQWPGVQLCATVSFEPIDTGTR

SEQ ID NO: 738633 - protein, 27 aa, Mycobacterium
TLAELGVTWRSPREAIIATFAPRGGGE

SEQ ID NO: 738634 - protein, 23 aa, Mycobacterium
TLAELPGRFLFSLDDGRGDMAAM

SEQ ID NO: 738635 - protein, 17 aa, Mycobacterium
TLAELVTHAEIARDERK

SEQ ID NO: 738636 - protein, 17 aa, Mycobacterium
TLAENRSRFVIEPLEPG

SEQ ID NO: 738637 - protein, 24 aa, Mycobacterium
TLAERERVFSFARDEENMWLVTDH

SEQ ID NO: 738638 - protein, 24 aa, Mycobacterium
TLAERKRLAALAFQHTAEYDIAVA

SEQ ID NO: 738639 - protein, 18 aa, Mycobacterium
TLAEWDFSANTVYPLLMN

SEQ ID NO: 738640 - protein, 26 aa, Mycobacterium
TLAFLKEGHMVYAFPGAIDTNLVPPQ

SEQ ID NO: 738641 - protein, 27 aa, Mycobacterium
TLAGAFLRAGLVDRILAYLAPMLLGGN

SEQ ID NO: 738642 - protein, 23 aa, Mycobacterium
TLAGELIGSLAITEPGGGSDVGH

SEQ ID NO: 738643 - protein, 24 aa, Mycobacterium
TLAGIACPILLMAGDRDELTRQQQ

SEQ ID NO: 738644 - protein, 21 aa, Mycobacterium
TLAGLKPAFYHESYAARFPQI

SEQ ID NO: 738645 - protein, 20 aa, Mycobacterium
TLAGLRFAREHRMAAPAAGS

SEQ ID NO: 738646 - protein, 17 aa, Mycobacterium
TLAHRALGIHRQIGQLL

SEQ ID NO: 738647 - protein, 23 aa, Mycobacterium
TLAKGFGCTGGFAVFPNAEAQRK

SEQ ID NO: 738648 - protein, 20 aa, Mycobacterium
TLALAREMCDVAGLDGVDPA

SEQ ID NO: 738649 - protein, 20 aa, Mycobacterium
TLALLSNRPILVVGDLEQVR

SEQ ID NO: 738650 - protein, 29 aa, Mycobacterium
TLAMGHAMVRAGLALGLKGSGDWRPDVVH

SEQ ID NO: 738651 - protein, 26 aa, Mycobacterium
TLAMPAMAPMAACYITLGTAGMAGVV

SEQ ID NO: 738652 - protein, 24 aa, Mycobacterium
TLAPALRLGWLVAPRRRHPDLVAA

SEQ ID NO: 738653 - protein, 25 aa, Mycobacterium
TLAPHLVKPLPFLFPLTKRGWERPY

SEQ ID NO: 738654 - protein, 25 aa, Mycobacterium
TLAPHLVKPLPFLFPLTNRVWERPY

SEQ ID NO: 738655 - protein, 28 aa, Mycobacterium
TLAPHLVKPLPFLFPLTNRWWERPYVAA

SEQ ID NO: 738656 - protein, 30 aa, Mycobacterium
TLAPHLVKPLPFLFPLTSRWWERPYVAAGI

SEQ ID NO: 738657 - protein, 20 aa, Mycobacterium
TLAQELPKRIDFACYSAIYY

SEQ ID NO: 738658 - protein, 20 aa, Mycobacterium
TLAQHRWHEISAIAGQCAPA

SEQ ID NO: 738659 - protein, 21 aa, Mycobacterium
TLAQLRARLQLLSVGELEELL

SEQ ID NO: 738660 - protein, 24 aa, Mycobacterium
TLARALRLLSEFRFERSDPARFYG

SEQ ID NO: 738661 - protein, 17 aa, Mycobacterium
TLARLRADSGIEFLDPL

SEQ ID NO: 738662 - protein, 19 aa, Mycobacterium
TLARMVVDINVPRAGVVRL

SEQ ID NO: 738663 - protein, 18 aa, Mycobacterium
TLARRGVAAIFFVVGENV

SEQ ID NO: 738664 - protein, 25 aa, Mycobacterium
TLARRIVRRGGTMLGDVVGLGKTLT

SEQ ID NO: 738665 - protein, 17 aa, Mycobacterium
TLARRLPGLKLAVPPEE

SEQ ID NO: 738666 - protein, 18 aa, Mycobacterium
TLARRTVVAGSQCGELLA

SEQ ID NO: 738667 - protein, 19 aa, Mycobacterium
TLARSVRLLSEFRYEQTDP

SEQ ID NO: 738668 - protein, 18 aa, Mycobacterium
TLARVALTGSWLDRDATA

SEQ ID NO: 738669 - protein, 18 aa, Mycobacterium
TLASLKWVLANRAYTPWY

SEQ ID NO: 738670 - protein, 23 aa, Mycobacterium
TLASQAAHIVMRFQQNLAELVIK

SEQ ID NO: 738671 - protein, 19 aa, Mycobacterium
TLASQAAHLVMLFQQNLAE

SEQ ID NO: 738672 - protein, 20 aa, Mycobacterium
TLASRLATNIAEFSGVQVAH

SEQ ID NO: 738673 - protein, 18 aa, Mycobacterium
TLATLRRELARAGLVLTT

SEQ ID NO: 738674 - protein, 18 aa, Mycobacterium
TLAVAHGYIPPNLHFSRW

SEQ ID NO: 738675 - protein, 22 aa, Mycobacterium
TLAVLVHGAWHSSLHWAAAQRG

SEQ ID NO: 738676 - protein, 24 aa, Mycobacterium
TLAYEKRVLKLLQWGEPERPWRLK

SEQ ID NO: 738677 - protein, 26 aa, Mycobacterium
TLCAGALRRWLADRGELPEQPLVAAI

SEQ ID NO: 738678 - protein, 28 aa, Mycobacterium
TLCSPKVSAILLRRLSTLAAQREPAPTE

SEQ ID NO: 738679 - protein, 21 aa, Mycobacterium
TLCSTWDLTDWQGQPMRIGFV

SEQ ID NO: 738680 - protein, 27 aa, Mycobacterium
TLDAELRAECGMSLLTLDTLVQLSRAP

SEQ ID NO: 738681 - protein, 19 aa, Mycobacterium
TLDAGLYAGITARKPSGDV

SEQ ID NO: 738682 - protein, 28 aa, Mycobacterium
TLDALISLVLDWKRPVKVFIETKHPVRY

SEQ ID NO: 738683 - protein, 23 aa, Mycobacterium
TLDALVSLVLDWHRPVKLFIETK

SEQ ID NO: 738684 - protein, 24 aa, Mycobacterium
TLDALVSLVLDWRRPVKLFIETKH

SEQ ID NO: 738685 - protein, 18 aa, Mycobacterium
TLDDAWPGDVIGLANAQA

SEQ ID NO: 738686 - protein, 25 aa, Mycobacterium
TLDDLVSLVMDWNRPVKMFIETKHP

SEQ ID NO: 738687 - protein, 23 aa, Mycobacterium
TLDEILIALARRGAPNFAAEARL

SEQ ID NO: 738688 - protein, 17 aa, Mycobacterium
TLDELGRQLEIQPQDPV

SEQ ID NO: 738689 - protein, 27 aa, Mycobacterium
TLDELVRMALDWNRPVKLFIETKHPVR

SEQ ID NO: 738690 - protein, 17 aa, Mycobacterium
TLDEVKFSYELGACTKD

SEQ ID NO: 738691 - protein, 18 aa, Mycobacterium
TLDEVKFSYELGACTKDV

SEQ ID NO: 738692 - protein, 24 aa, Mycobacterium
TLDHSLPYIFAVALQDGSWHHERS

SEQ ID NO: 738693 - protein, 26 aa, Mycobacterium
TLDICRAHLGLAFRMHVTAATMHGVT

SEQ ID NO: 738694 - protein, 25 aa, Mycobacterium
TLDIFSIRIPKPWFVLMPTPIWDQL

SEQ ID NO: 738695 - protein, 24 aa, Mycobacterium
TLDIGFMESVIWVFKQLWDKGLAY

SEQ ID NO: 738696 - protein, 24 aa, Mycobacterium
TLDIPGARWKPAFTPGRPDDFVAL

SEQ ID NO: 738697 - protein, 33 aa, Mycobacterium
TLDIYRIGQYIAWRLWINIAFDLTSDPQELREL

SEQ ID NO: 738698 - protein, 23 aa, Mycobacterium
TLDKLEAIPGFSAELTKTQIRQQ

SEQ ID NO: 738699 - protein, 24 aa, Mycobacterium
TLDKVDTRISVVGLNNTITYKDGE

SEQ ID NO: 738700 - protein, 26 aa, Mycobacterium
TLDMRRLLDRASRWLISYRPQPLAVG

SEQ ID NO: 738701 - protein, 25 aa, Mycobacterium
TLDNRLSGGLYRWQSRYLRAEDQAA

SEQ ID NO: 738702 - protein, 18 aa, Mycobacterium
TLDPCDGTGPALPADAAD

SEQ ID NO: 738703 - protein, 32 aa, Mycobacterium
TLDPPALVLDANFGLPLSILFGVAGAPVAGLD

SEQ ID NO: 738704 - protein, 26 aa, Mycobacterium
TLDPVRLRLGIGYVIQHAGLMPHLRV

SEQ ID NO: 738705 - protein, 24 aa, Mycobacterium
TLDRLSCGRLVLGVGIGSLREEFD

SEQ ID NO: 738706 - protein, 17 aa, Mycobacterium
TLDSLRLEPRPSVCAAS

SEQ ID NO: 738707 - protein, 18 aa, Mycobacterium
TLDVAFTIVVRPGHDGPV

SEQ ID NO: 738708 - protein, 25 aa, Mycobacterium
TLDVPGTWPSPAFTPARPDEFTALL

SEQ ID NO: 738709 - protein, 23 aa, Mycobacterium
TLDWSFSHGRDWGSPAIPEKMDL

SEQ ID NO: 738710 - protein, 26 aa, Mycobacterium
TLEAAGYKPGLIVLSAADWEAVELLN

SEQ ID NO: 738711 - protein, 22 aa, Mycobacterium
TLEAGMIPKIEACLRAVDGGVP

SEQ ID NO: 738712 - protein, 19 aa, Mycobacterium
TLEALGLRIDLGPDDVARC

SEQ ID NO: 738713 - protein, 18 aa, Mycobacterium
TLEARLATRVGLRPDVKR

SEQ ID NO: 738714 - protein, 18 aa, Mycobacterium
TLEARLATRVGLRQDVKR

SEQ ID NO: 738715 - protein, 20 aa, Mycobacterium
TLEARWWRRDVGGVMVRFVV

SEQ ID NO: 738716 - protein, 24 aa, Mycobacterium
TLEDLKGDLAHRYKWTPSGGSSVD

SEQ ID NO: 738717 - protein, 26 aa, Mycobacterium
TLEELVSLVLDWNRPVKLFIETKHPV

SEQ ID NO: 738718 - protein, 23 aa, Mycobacterium
TLEERKARLGAAGELRFGSDQQE

SEQ ID NO: 738719 - protein, 23 aa, Mycobacterium
TLEESIKALAIILSKRLPPADLT

SEQ ID NO: 738720 - protein, 18 aa, Mycobacterium
TLEGFDCGKESLNTWLIA

SEQ ID NO: 738721 - protein, 20 aa, Mycobacterium
TLEGIGWPVVEVTLPALDRM

SEQ ID NO: 738722 - protein, 18 aa, Mycobacterium
TLEGRLVRYSVFPNLGNE

SEQ ID NO: 738723 - protein, 25 aa, Mycobacterium
TLEGRWWRRDVGGVMVRFVVCRKGE

SEQ ID NO: 738724 - protein, 19 aa, Mycobacterium
TLEIVRAGLGVSILPSAGL

SEQ ID NO: 738725 - protein, 18 aa, Mycobacterium
TLELGGKSPNIFFADVAD

SEQ ID NO: 738726 - protein, 17 aa, Mycobacterium
TLELGGKSPNIFFNNVL

SEQ ID NO: 738727 - protein, 18 aa, Mycobacterium
TLELGGKSPNIFFSDVMG

SEQ ID NO: 738728 - protein, 18 aa, Mycobacterium
TLELGGKSPNIFMPDVMA

SEQ ID NO: 738729 - protein, 25 aa, Mycobacterium
TLELIMTGPLAWLAGRTAGSRVRSY

SEQ ID NO: 738730 - protein, 18 aa, Mycobacterium
TLELKVNYVRTVPVDGER

SEQ ID NO: 738731 - protein, 17 aa, Mycobacterium
TLELLPRFETLTYRDLG

SEQ ID NO: 738732 - protein, 18 aa, Mycobacterium
TLELRRRLWSLGLGVAES

SEQ ID NO: 738733 - protein, 21 aa, Mycobacterium
TLELRTSWRNPPEVLHLANAA

SEQ ID NO: 738734 - protein, 19 aa, Mycobacterium
TLELRVCDSCPSVDTIVLV

SEQ ID NO: 738735 - protein, 26 aa, Mycobacterium
TLENWKRLVDPVAEQISGMWAANLPE

SEQ ID NO: 738736 - protein, 18 aa, Mycobacterium
TLEPDWRATITTIAAETT

SEQ ID NO: 738737 - protein, 18 aa, Mycobacterium
TLEPKWFERTTTAYTISK

SEQ ID NO: 738738 - protein, 17 aa, Mycobacterium
TLEQWAELAAAALEDAG

SEQ ID NO: 738739 - protein, 19 aa, Mycobacterium
TLERLGWIVIRVVAGDRPA

SEQ ID NO: 738740 - protein, 22 aa, Mycobacterium
TLERPEILVDFEVGESVTVMDG

SEQ ID NO: 738741 - protein, 18 aa, Mycobacterium
TLESASLMAAVANATEAD

SEQ ID NO: 738742 - protein, 25 aa, Mycobacterium
TLESRGYCFQVEMTWRSLNAGFAVV

SEQ ID NO: 738743 - protein, 18 aa, Mycobacterium
TLETIAELAIEYAQTREQ

SEQ ID NO: 738744 - protein, 17 aa, Mycobacterium
TLEVAVRLLNAIERSRY

SEQ ID NO: 738745 - protein, 18 aa, Mycobacterium
TLEVHRAALLVHDMQHYF

SEQ ID NO: 738746 - protein, 28 aa, Mycobacterium
TLEVVRRARFSSAFTFQYSIRPGTPAAK

SEQ ID NO: 738747 - protein, 26 aa, Mycobacterium
TLEYGEVIIATGLVPRRIPTFPDLAG

SEQ ID NO: 738748 - protein, 27 aa, Mycobacterium
TLFDALLPRYVATRVYAALLEAAASES

SEQ ID NO: 738749 - protein, 17 aa, Mycobacterium
TLFDEWFPANKLVRLGL

SEQ ID NO: 738750 - protein, 22 aa, Mycobacterium
TLFERFPRLSLAGEPEYLNGMG

SEQ ID NO: 738751 - protein, 20 aa, Mycobacterium
TLFGAYCAGMAINTAGTAGA

SEQ ID NO: 738752 - protein, 18 aa, Mycobacterium
TLFGRDSLLTAWMSLPLD

SEQ ID NO: 738753 - protein, 27 aa, Mycobacterium
TLFIQPRFPGYLSNALHTPEQFWPTTP

SEQ ID NO: 738754 - protein, 32 aa, Mycobacterium
TLFQWLTEMYPVWGRLDAELEFAAASAGLAGL

SEQ ID NO: 738755 - protein, 19 aa, Mycobacterium
TLFSLRVALMSAQEETEPG

SEQ ID NO: 738756 - protein, 18 aa, Mycobacterium
TLFSYGFDDDAAVAAYRA

SEQ ID NO: 738757 - protein, 23 aa, Mycobacterium
TLFYCVANMPSAVPKTSTVALTN

SEQ ID NO: 738758 - protein, 18 aa, Mycobacterium
TLGAAPWLGAEAIDRMAR

SEQ ID NO: 738759 - protein, 21 aa, Mycobacterium
TLGAGLDWKTSLQELTASRSL

SEQ ID NO: 738760 - protein, 29 aa, Mycobacterium
TLGCWKIGAVPIPMHWDLPEWERDRVRAV

SEQ ID NO: 738761 - protein, 23 aa, Mycobacterium
TLGEAYQLLWAFRATSKNTQDRI

SEQ ID NO: 738762 - protein, 18 aa, Mycobacterium
TLGERLILSSGFVAVTVV

SEQ ID NO: 738763 - protein, 31 aa, Mycobacterium
TLGEVRRAWPRAQIVFVRPRFLDDPTDDLGM

SEQ ID NO: 738764 - protein, 25 aa, Mycobacterium
TLGEVSSAFAVQWRALALVATTADL

SEQ ID NO: 738765 - protein, 19 aa, Mycobacterium
TLGGPRGGIILSNDAAIAK

SEQ ID NO: 738766 - protein, 24 aa, Mycobacterium
TLGGPRLKDVAGLSLTKLFVGSEG

SEQ ID NO: 738767 - protein, 27 aa, Mycobacterium
TLGHRKGFLQFRWQRVSREMTAADGPT

SEQ ID NO: 738768 - protein, 21 aa, Mycobacterium
TLGIPEVRFTAALTSGGGGSA

SEQ ID NO: 738769 - protein, 17 aa, Mycobacterium
TLGKLSVPQSWAATNPA

SEQ ID NO: 738770 - protein, 20 aa, Mycobacterium
TLGKPPCDWDDPAAREALVD

SEQ ID NO: 738771 - protein, 28 aa, Mycobacterium
TLGKRAALIARVFARMGFGPELQPATGS

SEQ ID NO: 738772 - protein, 25 aa, Mycobacterium
TLGLPWRTYLLHARMLRAMAPLAAP

SEQ ID NO: 738773 - protein, 26 aa, Mycobacterium
TLGNLRARFNIALGIEASGFSGFSGN

SEQ ID NO: 738774 - protein, 26 aa, Mycobacterium
TLGNLRARFNIALGIGSSGFSSDRVC

SEQ ID NO: 738775 - protein, 20 aa, Mycobacterium
TLGPKGRNVVLEKKWGAPTI

SEQ ID NO: 738776 - protein, 18 aa, Mycobacterium
TLGPYTFGFAYQQSPGFF

SEQ ID NO: 738777 - protein, 25 aa, Mycobacterium
TLGQAMARLAEWQADLLTREVGGRL

SEQ ID NO: 738778 - protein, 22 aa, Mycobacterium
TLGQYADWIFCLVRTDPNAPKK

SEQ ID NO: 738779 - protein, 24 aa, Mycobacterium
TLGRCAPGMPVLGISAGLHAVVAL

SEQ ID NO: 738780 - protein, 18 aa, Mycobacterium
TLGRPAFDGASAGRRHVA

SEQ ID NO: 738781 - protein, 27 aa, Mycobacterium
TLGRSHCLRIIMGRKVVELRASLDWDK

SEQ ID NO: 738782 - protein, 17 aa, Mycobacterium
TLGSLASQIIKSDLQVH

SEQ ID NO: 738783 - protein, 17 aa, Mycobacterium
TLGSVATLVAERIRVSE

SEQ ID NO: 738784 - protein, 27 aa, Mycobacterium
TLGSYRWLRPHGRRTAQEIAVEFSSAL

SEQ ID NO: 738785 - protein, 25 aa, Mycobacterium
TLGSYRWLRPHGRRTAREIAAEFST

SEQ ID NO: 738786 - protein, 24 aa, Mycobacterium
TLGSYRWLRPSGRRTAKEIAAEFS

SEQ ID NO: 738787 - protein, 25 aa, Mycobacterium
TLGTNWRSDAALVDRLQVVLRGAQL

SEQ ID NO: 738788 - protein, 19 aa, Mycobacterium
TLGVITRVRLRVHRAPAAV

SEQ ID NO: 738789 - protein, 18 aa, Mycobacterium
TLGVVVGDMFFVDPRPLE

SEQ ID NO: 738790 - protein, 26 aa, Mycobacterium
TLHAARLNPEVPWEAMRFAVTTRPTF

SEQ ID NO: 738791 - protein, 18 aa, Mycobacterium
TLHGFDEFFGILYHLNAG

SEQ ID NO: 738792 - protein, 17 aa, Mycobacterium
TLHGGICATLLDSVLGC

SEQ ID NO: 738793 - protein, 19 aa, Mycobacterium
TLHGLRLVFERNREAQRGR

SEQ ID NO: 738794 - protein, 19 aa, Mycobacterium
TLHHAGWYAPIPAPGRANV

SEQ ID NO: 738795 - protein, 17 aa, Mycobacterium
TLHKFRCPQSFDETKFY

SEQ ID NO: 738796 - protein, 21 aa, Mycobacterium
TLHKPQLAFVPSHEFVETNIS

SEQ ID NO: 738797 - protein, 23 aa, Mycobacterium
TLHPGRVCGLVGMNGSGKSTLFK

SEQ ID NO: 738798 - protein, 25 aa, Mycobacterium
TLHSVKVIPSRGAWLEFDVDKRDTV

SEQ ID NO: 738799 - protein, 28 aa, Mycobacterium
TLIALSIFGSLAWKSGEAAAEGVAGAAG

SEQ ID NO: 738800 - protein, 27 aa, Mycobacterium
TLIAMPALRLDAAFAHLNLGDCRGNAA

SEQ ID NO: 738801 - protein, 27 aa, Mycobacterium
TLIAMPALRLDAAFVHLNLGDCRGNAA

SEQ ID NO: 738802 - protein, 27 aa, Mycobacterium
TLIAMPALRLDAAFVHLNLGDSRGNAA

SEQ ID NO: 738803 - protein, 20 aa, Mycobacterium
TLIARLGAAAVRSTLPELVA

SEQ ID NO: 738804 - protein, 22 aa, Mycobacterium
TLIAWEAWRFRRGDGAAISRRQ

SEQ ID NO: 738805 - protein, 23 aa, Mycobacterium
TLIDLWLPLSWALNQVNRSMGKE

SEQ ID NO: 738806 - protein, 25 aa, Mycobacterium
TLIFGRSAGVLARLLLPSPDLLDVQ

SEQ ID NO: 738807 - protein, 18 aa, Mycobacterium
TLIFLPLAHVLARGIAMA

SEQ ID NO: 738808 - protein, 17 aa, Mycobacterium
TLIKRAASEAGIDGLDE

SEQ ID NO: 738809 - protein, 20 aa, Mycobacterium
TLILHRGRSRYVPVEHGRYL

SEQ ID NO: 738810 - protein, 31 aa, Mycobacterium
TLINLWASWCAPCREEIPVLDAYAGQPGAVR

SEQ ID NO: 738811 - protein, 19 aa, Mycobacterium
TLINPVREIQCDAGETRKT

SEQ ID NO: 738812 - protein, 24 aa, Mycobacterium
TLIPRARAKISIRIAPGGDAAAHL

SEQ ID NO: 738813 - protein, 24 aa, Mycobacterium
TLIPRARAKISLRVAPGGDAVAHL

SEQ ID NO: 738814 - protein, 24 aa, Mycobacterium
TLIPRARAKISMRVAPGGDARAHL

SEQ ID NO: 738815 - protein, 17 aa, Mycobacterium
TLIPRFSPEKALQIIER

SEQ ID NO: 738816 - protein, 25 aa, Mycobacterium
TLIREKWLTANGVIGFFPANAVGDD

SEQ ID NO: 738817 - protein, 19 aa, Mycobacterium
TLIRREYMTAIGPVDLLCR

SEQ ID NO: 738818 - protein, 25 aa, Mycobacterium
TLIWPPRSPSGFSLIVDGQARAGAT

SEQ ID NO: 738819 - protein, 25 aa, Mycobacterium
TLKALCRGCPRRWLCANEALHTPGI

SEQ ID NO: 738820 - protein, 18 aa, Mycobacterium
TLKEFMSDLVWIENVGAR

SEQ ID NO: 738821 - protein, 19 aa, Mycobacterium
TLKELCADLAMARQSVAKH

SEQ ID NO: 738822 - protein, 31 aa, Mycobacterium
TLKKRFAEKFWLPDRGYYALALDGDKRPVDS

SEQ ID NO: 738823 - protein, 21 aa, Mycobacterium
TLKTGALAYTGAEAANASPLQ

SEQ ID NO: 738824 - protein, 23 aa, Mycobacterium
TLKYKAKPGRSFEQLRSELLRLM

SEQ ID NO: 738825 - protein, 17 aa, Mycobacterium
TLLAHAGVERWIVDTGF

SEQ ID NO: 738826 - protein, 17 aa, Mycobacterium
TLLALGLDTIDDAVVAA

SEQ ID NO: 738827 - protein, 17 aa, Mycobacterium
TLLALGRRDEALRWFLR

SEQ ID NO: 738828 - protein, 26 aa, Mycobacterium
TLLARELPVYVISLGRAFRTDEIDAT

SEQ ID NO: 738829 - protein, 26 aa, Mycobacterium
TLLDIGCGWGSTIQRAVEKYDVNVIG

SEQ ID NO: 738830 - protein, 26 aa, Mycobacterium
TLLDIGCGWGTTIVRALERYDVNVVG

SEQ ID NO: 738831 - protein, 28 aa, Mycobacterium
TLLDTHPFAWLPMLSRVLATARLLPDAL

SEQ ID NO: 738832 - protein, 26 aa, Mycobacterium
TLLDVGCGWGATARRAIEKYDVNVIG

SEQ ID NO: 738833 - protein, 21 aa, Mycobacterium
TLLDYFPEDFLMVIDESHVTV

SEQ ID NO: 738834 - protein, 24 aa, Mycobacterium
TLLEYPVLMWHWARVADPAVPWDR

SEQ ID NO: 738835 - protein, 25 aa, Mycobacterium
TLLGARPRAGFAIAGVVPGRQLSLA

SEQ ID NO: 738836 - protein, 20 aa, Mycobacterium
TLLGRPLIGDGVHGSAPGQA

SEQ ID NO: 738837 - protein, 17 aa, Mycobacterium
TLLHLKVMPPGFVGASL

SEQ ID NO: 738838 - protein, 22 aa, Mycobacterium
TLLKLLHPVMPFVTETLWKTLT

SEQ ID NO: 738839 - protein, 19 aa, Mycobacterium
TLLKSIFRLVEPMSGEISL

SEQ ID NO: 738840 - protein, 20 aa, Mycobacterium
TLLLGRPCPEDAGIKAYSMA

SEQ ID NO: 738841 - protein, 19 aa, Mycobacterium
TLLMLLFEWGVGTQHLELG

SEQ ID NO: 738842 - protein, 19 aa, Mycobacterium
TLLPGMLTSPAWELGVVRI

SEQ ID NO: 738843 - protein, 26 aa, Mycobacterium
TLLPIADEGLRRWGVDAEVRDRFLGV

SEQ ID NO: 738844 - protein, 20 aa, Mycobacterium
TLLPREYFERVFALQREVFP

SEQ ID NO: 738845 - protein, 17 aa, Mycobacterium
TLLQDWSQFAAPAVFGA

SEQ ID NO: 738846 - protein, 17 aa, Mycobacterium
TLLQDWSQFAAPAVFGT

SEQ ID NO: 738847 - protein, 17 aa, Mycobacterium
TLLQDWSQFAAPAVFGV

SEQ ID NO: 738848 - protein, 17 aa, Mycobacterium
TLLQDWTQFAAPAVFGT

SEQ ID NO: 738849 - protein, 25 aa, Mycobacterium
TLLRAWKSYHRFEGKSSLRTWLHRI

SEQ ID NO: 738850 - protein, 24 aa, Mycobacterium
TLLRECSEFLAPYVSAARLTGEVR

SEQ ID NO: 738851 - protein, 21 aa, Mycobacterium
TLLRGKHKPTFAPNVDGGDFV

SEQ ID NO: 738852 - protein, 18 aa, Mycobacterium
TLLRICAGLDALTSGTLT

SEQ ID NO: 738853 - protein, 23 aa, Mycobacterium
TLLRNVVLKGRHSGSSFVAAETS

SEQ ID NO: 738854 - protein, 21 aa, Mycobacterium
TLLRRDLPLLAEVSGQVPVSV

SEQ ID NO: 738855 - protein, 30 aa, Mycobacterium
TLLRRIGLAAAKYWVCKRATPHAAEAMECF

SEQ ID NO: 738856 - protein, 25 aa, Mycobacterium
TLLRVSHAFHSPAMDPILAEFEAIA

SEQ ID NO: 738857 - protein, 24 aa, Mycobacterium
TLLTLHPRFGRWLQLGGHCEDTDP

SEQ ID NO: 738858 - protein, 17 aa, Mycobacterium
TLLWPPPEPGGYSLIVD

SEQ ID NO: 738859 - protein, 18 aa, Mycobacterium
TLLYKKSNVMFGIDLAKR

SEQ ID NO: 738860 - protein, 24 aa, Mycobacterium
TLLYKKSSVLFGIDLAKRDIARGH

SEQ ID NO: 738861 - protein, 24 aa, Mycobacterium
TLLYPLFNLWGPAYHDKYSNVTIT

SEQ ID NO: 738862 - protein, 19 aa, Mycobacterium
TLMDRDWKHGVKSAVDIAL

SEQ ID NO: 738863 - protein, 28 aa, Mycobacterium
TLMDTHPFAWLPMLSRVLGSAELVADAV

SEQ ID NO: 738864 - protein, 24 aa, Mycobacterium
TLMDTHPFTWLPLLSRVLGSAELL

SEQ ID NO: 738865 - protein, 18 aa, Mycobacterium
TLMEPGRTIGAFVDGQLV

SEQ ID NO: 738866 - protein, 27 aa, Mycobacterium
TLMGHARLTVEFTWYGPDGDSITSVAA

SEQ ID NO: 738867 - protein, 24 aa, Mycobacterium
TLMIEAVAPYLAWMRAAAAQAEQA

SEQ ID NO: 738868 - protein, 26 aa, Mycobacterium
TLMLLRGMGIPAHYVSGYLHPKRDAV

SEQ ID NO: 738869 - protein, 21 aa, Mycobacterium
TLMRCALLACELAEDGAARRQ

SEQ ID NO: 738870 - protein, 31 aa, Mycobacterium
TLMRKVHDGLARFAGSGIRKIWVYRALDDGN

SEQ ID NO: 738871 - protein, 19 aa, Mycobacterium
TLMSAYGWLTPVSEIQAFS

SEQ ID NO: 738872 - protein, 27 aa, Mycobacterium
TLNADGWNRYGWPEAAGGLGGNEIHRA

SEQ ID NO: 738873 - protein, 19 aa, Mycobacterium
TLNCEEPVWAQGRVELNYQ

SEQ ID NO: 738874 - protein, 19 aa, Mycobacterium
TLNDAIVRWHRARGCDIPD

SEQ ID NO: 738875 - protein, 23 aa, Mycobacterium
TLNDCPLRWLAERHGGTNPRDLR

SEQ ID NO: 738876 - protein, 22 aa, Mycobacterium
TLNDFLGWSAMVARQEEPGVVR

SEQ ID NO: 738877 - protein, 34 aa, Mycobacterium
TLNEEYPRLFVYRGPRRKGVRYFGPYSHAWAIRE

SEQ ID NO: 738878 - protein, 24 aa, Mycobacterium
TLNFAVGPFASMLDRARDVIGAAL

SEQ ID NO: 738879 - protein, 25 aa, Mycobacterium
TLNLKEWKAEWGVADPQEARGALTT

SEQ ID NO: 738880 - protein, 20 aa, Mycobacterium
TLNLNFFVHDPFTLEPYSRD

SEQ ID NO: 738881 - protein, 22 aa, Mycobacterium
TLNLTNLPGYRVGGTIHIIVNN

SEQ ID NO: 738882 - protein, 19 aa, Mycobacterium
TLNLVGGLRRSMAKAGYCD

SEQ ID NO: 738883 - protein, 20 aa, Mycobacterium
TLNLVGGLRRSMAKAGYCDL

SEQ ID NO: 738884 - protein, 20 aa, Mycobacterium
TLNLVGGLRRSMAKSGYCDL

SEQ ID NO: 738885 - protein, 25 aa, Mycobacterium
TLNPKSVVVPGHLIDIVVVQEDQWQ

SEQ ID NO: 738886 - protein, 18 aa, Mycobacterium
TLNSAFPRVFNKPHCDLV

SEQ ID NO: 738887 - protein, 19 aa, Mycobacterium
TLNSMKALWARPKDEVSAD

SEQ ID NO: 738888 - protein, 21 aa, Mycobacterium
TLNSMKALWARPKDEVSDEEY

SEQ ID NO: 738889 - protein, 21 aa, Mycobacterium
TLNSMKALWARPKDEVSEEEY

SEQ ID NO: 738890 - protein, 22 aa, Mycobacterium
TLNSMKALWARPKEEVSAEEYQ

SEQ ID NO: 738891 - protein, 24 aa, Mycobacterium
TLNTRPRKTLGWRTPAEAFNEHLH

SEQ ID NO: 738892 - protein, 25 aa, Mycobacterium
TLNYGTLYHALGWTITPTSEGTTFT

SEQ ID NO: 738893 - protein, 24 aa, Mycobacterium
TLPAGKLRDALGIREVGYTTGESA

SEQ ID NO: 738894 - protein, 23 aa, Mycobacterium
TLPALELATALNLMNERTLSASF

SEQ ID NO: 738895 - protein, 21 aa, Mycobacterium
TLPALRRIYVIDGSVPALDEL

SEQ ID NO: 738896 - protein, 25 aa, Mycobacterium
TLPDAGARFRSLQIITEDHYVPRVI

SEQ ID NO: 738897 - protein, 26 aa, Mycobacterium
TLPDLLRFTGPFNFSGSPTITLPGGF

SEQ ID NO: 738898 - protein, 19 aa, Mycobacterium
TLPEFPWDTLADVTALARS

SEQ ID NO: 738899 - protein, 21 aa, Mycobacterium
TLPELREIYFTRGVLERAALA

SEQ ID NO: 738900 - protein, 25 aa, Mycobacterium
TLPEPLRADARLVFTAHSIPLRAAS

SEQ ID NO: 738901 - protein, 22 aa, Mycobacterium
TLPERLRRCLVSDPRFDELLAQ

SEQ ID NO: 738902 - protein, 23 aa, Mycobacterium
TLPEVLWLAQRVRETWDDVQIAL

SEQ ID NO: 738903 - protein, 18 aa, Mycobacterium
TLPGASWQRCRTHYATNL

SEQ ID NO: 738904 - protein, 18 aa, Mycobacterium
TLPGFTFPECGLVHIDCD

SEQ ID NO: 738905 - protein, 18 aa, Mycobacterium
TLPGGAIVRHAAVTRIGV

SEQ ID NO: 738906 - protein, 17 aa, Mycobacterium
TLPGLAMQHVRTRFREM

SEQ ID NO: 738907 - protein, 21 aa, Mycobacterium
TLPGPHRVASLLKRWNAGTHH

SEQ ID NO: 738908 - protein, 25 aa, Mycobacterium
TLPKTVDVMLRYNFPGAGLTDNALR

SEQ ID NO: 738909 - protein, 19 aa, Mycobacterium
TLPLEAWPSALRASPKEVA

SEQ ID NO: 738910 - protein, 24 aa, Mycobacterium
TLPLLKDLRRAIGESVLNLPHDTW

SEQ ID NO: 738911 - protein, 18 aa, Mycobacterium
TLPLLRPQQVIMLGRPTL

SEQ ID NO: 738912 - protein, 19 aa, Mycobacterium
TLPLRPFKTMAVNVDGDLP

SEQ ID NO: 738913 - protein, 19 aa, Mycobacterium
TLPLRPFKTMAVNVDGELP

SEQ ID NO: 738914 - protein, 19 aa, Mycobacterium
TLPLRPFKTMAVNVDGKLP

SEQ ID NO: 738915 - protein, 20 aa, Mycobacterium
TLPLRVGQTLVPWPEDGRRA

SEQ ID NO: 738916 - protein, 19 aa, Mycobacterium
TLPLTGVGCVDRIVTELAV

SEQ ID NO: 738917 - protein, 28 aa, Mycobacterium
TLPLVARYAQHWNFPDGTPTEFARKREI

SEQ ID NO: 738918 - protein, 17 aa, Mycobacterium
TLPPAPRIPSLVQGLVF

SEQ ID NO: 738919 - protein, 26 aa, Mycobacterium
TLPPHPAHFLWLNWGPIPPRQDMAYS

SEQ ID NO: 738920 - protein, 26 aa, Mycobacterium
TLPPHPSHFLWLNWGPSPARQDMAYS

SEQ ID NO: 738921 - protein, 23 aa, Mycobacterium
TLPQRPAATLAYAGKMTELTGTT

SEQ ID NO: 738922 - protein, 23 aa, Mycobacterium
TLPRELFVKFSRDFDDPARDLGR

SEQ ID NO: 738923 - protein, 27 aa, Mycobacterium
TLPRLKPRIFYDLVVEVALIRPGPIQG

SEQ ID NO: 738924 - protein, 20 aa, Mycobacterium
TLPSMTRSWLMTRKEPYGAV

SEQ ID NO: 738925 - protein, 21 aa, Mycobacterium
TLPSVIERRGYVLIVSSLAAY

SEQ ID NO: 738926 - protein, 17 aa, Mycobacterium
TLPTIDCFAQLLRPGLC

SEQ ID NO: 738927 - protein, 17 aa, Mycobacterium
TLPTLWNAEDRYRVSYL

SEQ ID NO: 738928 - protein, 20 aa, Mycobacterium
TLPVDGRWVIVVTGGAGAIS

SEQ ID NO: 738929 - protein, 23 aa, Mycobacterium
TLPWRTVEENVAFAMEMIGVEKA

SEQ ID NO: 738930 - protein, 25 aa, Mycobacterium
TLQAQAIALSQAWGTANGTPVTVSY

SEQ ID NO: 738931 - protein, 24 aa, Mycobacterium
TLQELEKAAGVAITAGGTKLSIPD

SEQ ID NO: 738932 - protein, 24 aa, Mycobacterium
TLQEWVRHTGARVVVIFEGRDGAG

SEQ ID NO: 738933 - protein, 19 aa, Mycobacterium
TLQFKDLRTGERYPDEIAG

SEQ ID NO: 738934 - protein, 27 aa, Mycobacterium
TLQMLTDCPLRWLLERHGGDDGRDVRS

SEQ ID NO: 738935 - protein, 24 aa, Mycobacterium
TLQPIRPLRCGPAASSTGREMNSP

SEQ ID NO: 738936 - protein, 26 aa, Mycobacterium
TLQVIFAYPGVHAIWGHRISHWLWNR

SEQ ID NO: 738937 - protein, 18 aa, Mycobacterium
TLRAELRALAPTGDRRMS

SEQ ID NO: 738938 - protein, 21 aa, Mycobacterium
TLRALARWRKHTVIRKPTVGG

SEQ ID NO: 738939 - protein, 18 aa, Mycobacterium
TLRCFLRHHGSRLKVAEE

SEQ ID NO: 738940 - protein, 29 aa, Mycobacterium
TLRCYLDDEPIFLGRNGRISVFPSERALA

SEQ ID NO: 738941 - protein, 26 aa, Mycobacterium
TLRDAHPRWGPTRIVYELQRDGVPVV

SEQ ID NO: 738942 - protein, 26 aa, Mycobacterium
TLRDAHPRWGPTRIVYELQRDVVPVV

SEQ ID NO: 738943 - protein, 24 aa, Mycobacterium
TLRDIRRRVGLVFQDPDDQLFMPT

SEQ ID NO: 738944 - protein, 24 aa, Mycobacterium
TLRDLKARIAALEASRTSYEEIVD

SEQ ID NO: 738945 - protein, 17 aa, Mycobacterium
TLRDVLGGAAWDVESLE

SEQ ID NO: 738946 - protein, 17 aa, Mycobacterium
TLRDVLGGAGWEIAALD

SEQ ID NO: 738947 - protein, 19 aa, Mycobacterium
TLREGIDSTVAWYRANAGA

SEQ ID NO: 738948 - protein, 21 aa, Mycobacterium
TLRELGGGDPLVFSVRTFSKI

SEQ ID NO: 738949 - protein, 21 aa, Mycobacterium
TLRELPLRKSPSISEVVDGAR

SEQ ID NO: 738950 - protein, 17 aa, Mycobacterium
TLREPAFAALEKLEVDY

SEQ ID NO: 738951 - protein, 27 aa, Mycobacterium
TLREYLGPMTWYWDLMFDRTPGGMTVL

SEQ ID NO: 738952 - protein, 27 aa, Mycobacterium
TLRGALVRDPHAWSGYLTEAIDTFADR

SEQ ID NO: 738953 - protein, 27 aa, Mycobacterium
TLRGALVRDPHGWAGYLTEAIDTFVDR

SEQ ID NO: 738954 - protein, 19 aa, Mycobacterium
TLRGCGAPVLTLRTDRDWL

SEQ ID NO: 738955 - protein, 17 aa, Mycobacterium
TLRGFGFEHPMGDRWRG

SEQ ID NO: 738956 - protein, 19 aa, Mycobacterium
TLRGLKAIANYTCPPDVTL

SEQ ID NO: 738957 - protein, 17 aa, Mycobacterium
TLRGMIIDRDEAWRAHA

SEQ ID NO: 738958 - protein, 18 aa, Mycobacterium
TLRHVPLTLVHMVNQAVP

SEQ ID NO: 738959 - protein, 20 aa, Mycobacterium
TLRIRPVIFSSGRVLKESVE

SEQ ID NO: 738960 - protein, 24 aa, Mycobacterium
TLRISSQLLANWLRHDVITEDEVV

SEQ ID NO: 738961 - protein, 24 aa, Mycobacterium
TLRISSQLLANWLRHGVITEEDVR

SEQ ID NO: 738962 - protein, 25 aa, Mycobacterium
TLRISSQLLANWLRHGVITEEDVRA

SEQ ID NO: 738963 - protein, 24 aa, Mycobacterium
TLRISSQLLANWLRHGVITSEDAR

SEQ ID NO: 738964 - protein, 20 aa, Mycobacterium
TLRKRIETVQSLLACDLDIA

SEQ ID NO: 738965 - protein, 24 aa, Mycobacterium
TLRLLRPLFAAGVGGRLGSGKQWL

SEQ ID NO: 738966 - protein, 21 aa, Mycobacterium
TLRNFKWPLVEVLKTGARTGG

SEQ ID NO: 738967 - protein, 30 aa, Mycobacterium
TLRQAVGICTDWLHRHGFSLPVASAATEGA

SEQ ID NO: 738968 - protein, 26 aa, Mycobacterium
TLRRLLGRLGYRAHGWGLGRNIGPTP

SEQ ID NO: 738969 - protein, 24 aa, Mycobacterium
TLRRRIVTVPARLARPQRRPVLHL

SEQ ID NO: 738970 - protein, 18 aa, Mycobacterium
TLRRRLRASQTFEPAGLA

SEQ ID NO: 738971 - protein, 21 aa, Mycobacterium
TLRSLPGVGEWTAAETMQRVF

SEQ ID NO: 738972 - protein, 21 aa, Mycobacterium
TLRTARSFLFVPGNRPERFSK

SEQ ID NO: 738973 - protein, 21 aa, Mycobacterium
TLRTEMGYPLHGHELSLDISP

SEQ ID NO: 738974 - protein, 25 aa, Mycobacterium
TLRTTLPGHPLLVAVAENPDITRAL

SEQ ID NO: 738975 - protein, 20 aa, Mycobacterium
TLRYDPPVHMVARVADGEMA

SEQ ID NO: 738976 - protein, 27 aa, Mycobacterium
TLRYITRLLLRLGCREDAAVLYWAFVN

SEQ ID NO: 738977 - protein, 18 aa, Mycobacterium
TLSAAAVIGLRFGPDMLA

SEQ ID NO: 738978 - protein, 24 aa, Mycobacterium
TLSAARALGRYGVRANAIAPRART

SEQ ID NO: 738979 - protein, 21 aa, Mycobacterium
TLSAVVHGWVLARANRDRALE

SEQ ID NO: 738980 - protein, 25 aa, Mycobacterium
TLSAWCKSAGVPIRHRRGVVVAEPV

SEQ ID NO: 738981 - protein, 25 aa, Mycobacterium
TLSDEFDFRYLVGVLSVLADKDANG

SEQ ID NO: 738982 - protein, 17 aa, Mycobacterium
TLSDMGWQRALPVLRSV

SEQ ID NO: 738983 - protein, 26 aa, Mycobacterium
TLSESGYDWLPRFVALLQGKLSTNLA

SEQ ID NO: 738984 - protein, 19 aa, Mycobacterium
TLSGALLIGGERINAASGG

SEQ ID NO: 738985 - protein, 18 aa, Mycobacterium
TLSGKKCEVPVKKILAGA

SEQ ID NO: 738986 - protein, 28 aa, Mycobacterium
TLSGTCRLPVTLPQIFGLMQAAQQGPAQ

SEQ ID NO: 738987 - protein, 17 aa, Mycobacterium
TLSGVSLFVDWLLENKA

SEQ ID NO: 738988 - protein, 25 aa, Mycobacterium
TLSIKRPNWITAFDRGGVWVETERS

SEQ ID NO: 738989 - protein, 23 aa, Mycobacterium
TLSMLPRLAGPTVSVRWDAPQTG

SEQ ID NO: 738990 - protein, 17 aa, Mycobacterium
TLSPLGFVAEGRSLIGS

SEQ ID NO: 738991 - protein, 34 aa, Mycobacterium
TLSPPVLLGREWLKPTAYMMAKFGMTLCALGIAE

SEQ ID NO: 738992 - protein, 19 aa, Mycobacterium
TLSPWASLNLGAAMFELTQ

SEQ ID NO: 738993 - protein, 20 aa, Mycobacterium
TLSRAWRPGVPIEVTHEIHT

SEQ ID NO: 738994 - protein, 19 aa, Mycobacterium
TLSSGWINDIWAGADPLNP

SEQ ID NO: 738995 - protein, 19 aa, Mycobacterium
TLSSGWINDIWAGASPTSP

SEQ ID NO: 738996 - protein, 18 aa, Mycobacterium
TLSSRLDPAIVLGEMSFV

SEQ ID NO: 738997 - protein, 25 aa, Mycobacterium
TLSTLRDIYCATLGYPVDATNLQRV

SEQ ID NO: 738998 - protein, 20 aa, Mycobacterium
TLSTLTWRIATNVTKLPGLG

SEQ ID NO: 738999 - protein, 39 aa, Mycobacterium
TLTAARALGRYGVCANAICPRARTAMTADVFGDAPEVEA

SEQ ID NO: 739000 - protein, 18 aa, Mycobacterium
TLTAASWLADENVPVVGV

SEQ ID NO: 739001 - protein, 18 aa, Mycobacterium
TLTAEHPLSEAFDIAESI

SEQ ID NO: 739002 - protein, 20 aa, Mycobacterium
TLTAIPTVRKSLMEQTSRAV

SEQ ID NO: 739003 - protein, 23 aa, Mycobacterium
TLTALGVSHVFGIPGQNALGLFD

SEQ ID NO: 739004 - protein, 27 aa, Mycobacterium
TLTALYPGRFVLGLGVSHGPLVERGMG

SEQ ID NO: 739005 - protein, 25 aa, Mycobacterium
TLTAVCEFLRFCARTGVIEQAVADR

SEQ ID NO: 739006 - protein, 17 aa, Mycobacterium
TLTDPWQPAVLALVAAT

SEQ ID NO: 739007 - protein, 23 aa, Mycobacterium
TLTDRKQLLVVIGRDDETAAKSV

SEQ ID NO: 739008 - protein, 18 aa, Mycobacterium
TLTEFKLLSFLVQHAGRP

SEQ ID NO: 739009 - protein, 23 aa, Mycobacterium
TLTERRIAVVGANGSGKSTLARL

SEQ ID NO: 739010 - protein, 24 aa, Mycobacterium
TLTFADVGAIGWLVDGAAICNQVP

SEQ ID NO: 739011 - protein, 17 aa, Mycobacterium
TLTGFKWLARADADRPG

SEQ ID NO: 739012 - protein, 18 aa, Mycobacterium
TLTGFKWLARADAERPGT

SEQ ID NO: 739013 - protein, 18 aa, Mycobacterium
TLTGFKWLARADAEVPGG

SEQ ID NO: 739014 - protein, 26 aa, Mycobacterium
TLTGGVPGIRVGNVLSPDDGEMALAG

SEQ ID NO: 739015 - protein, 25 aa, Mycobacterium
TLTGKQLCCGLTWISTGQLDTARRT

SEQ ID NO: 739016 - protein, 19 aa, Mycobacterium
TLTGVRPLINVTYPPPTVQ

SEQ ID NO: 739017 - protein, 24 aa, Mycobacterium
TLTLGDGRVVIWGTTDRTDEKAEK

SEQ ID NO: 739018 - protein, 22 aa, Mycobacterium
TLTLRYRRPTALGRPLRAQAHV

SEQ ID NO: 739019 - protein, 19 aa, Mycobacterium
TLTLWSARAVQSFELDAFN

SEQ ID NO: 739020 - protein, 18 aa, Mycobacterium
TLTLWTAGDQPFWGAQLK

SEQ ID NO: 739021 - protein, 17 aa, Mycobacterium
TLTPAIVDQMWASGLMS

SEQ ID NO: 739022 - protein, 17 aa, Mycobacterium
TLTPMAIQIIEQLSSLE

SEQ ID NO: 739023 - protein, 20 aa, Mycobacterium
TLTQCRIGLTGVNSVFAPDV

SEQ ID NO: 739024 - protein, 17 aa, Mycobacterium
TLTQEWTGPTSMSMAAA

SEQ ID NO: 739025 - protein, 25 aa, Mycobacterium
TLTRFPRLRIASVENGSSWIFPLFR

SEQ ID NO: 739026 - protein, 19 aa, Mycobacterium
TLTRLRNARSWENGVGDQT

SEQ ID NO: 739027 - protein, 18 aa, Mycobacterium
TLTRPVVLRIAEMSGGNP

SEQ ID NO: 739028 - protein, 22 aa, Mycobacterium
TLTSRFPIVLWLSPTDLFLMYN

SEQ ID NO: 739029 - protein, 25 aa, Mycobacterium
TLTTHVWTAPPLRRGSPIHSHAFGA

SEQ ID NO: 739030 - protein, 19 aa, Mycobacterium
TLTTRWAATTAFATGPQPS

SEQ ID NO: 739031 - protein, 36 aa, Mycobacterium
TLTTVAFERLGRAWPALGWAAVQAHTAIDVLAGDDR

SEQ ID NO: 739032 - protein, 17 aa, Mycobacterium
TLTVPFVVPLVGVVPQT

SEQ ID NO: 739033 - protein, 24 aa, Mycobacterium
TLTVSRLLAPILAPVMYRAAIAAR

SEQ ID NO: 739034 - protein, 26 aa, Mycobacterium
TLVCGGRLGPSLSNRGRRSVARQLGK

SEQ ID NO: 739035 - protein, 18 aa, Mycobacterium
TLVDLGWTELAASDCRDD

SEQ ID NO: 739036 - protein, 20 aa, Mycobacterium
TLVDLTARFLPGMVERRHGV

SEQ ID NO: 739037 - protein, 18 aa, Mycobacterium
TLVEALLHTGFDTAEVTA

SEQ ID NO: 739038 - protein, 17 aa, Mycobacterium
TLVERFTVIAPDMIGMG

SEQ ID NO: 739039 - protein, 22 aa, Mycobacterium
TLVGCGPALYGVEVVIVDPDTR

SEQ ID NO: 739040 - protein, 17 aa, Mycobacterium
TLVGEAADHQWARDARV

SEQ ID NO: 739041 - protein, 19 aa, Mycobacterium
TLVGHKWFTSAPMCDVFLV

SEQ ID NO: 739042 - protein, 18 aa, Mycobacterium
TLVGKLSIPPSWATATPS

SEQ ID NO: 739043 - protein, 17 aa, Mycobacterium
TLVGLGYVRQLPNRRYA

SEQ ID NO: 739044 - protein, 17 aa, Mycobacterium
TLVGPLIHTRAYRDMVG

SEQ ID NO: 739045 - protein, 17 aa, Mycobacterium
TLVIKPGWGFSFDYQPG

SEQ ID NO: 739046 - protein, 20 aa, Mycobacterium
TLVIPIGICDSAIGVATVPL

SEQ ID NO: 739047 - protein, 27 aa, Mycobacterium
TLVLHDWGGALGFDWANRHRDRVAGIV

SEQ ID NO: 739048 - protein, 23 aa, Mycobacterium
TLVNCVGIFDFYRGIGDIDPPDL

SEQ ID NO: 739049 - protein, 24 aa, Mycobacterium
TLVNCVGIFDFYRGVGDIDAGDLA

SEQ ID NO: 739050 - protein, 29 aa, Mycobacterium
TLVPDALVGLCWPAVFSAIGSAVTDDGFP

SEQ ID NO: 739051 - protein, 17 aa, Mycobacterium
TLVPREFVPQHVRVQAA

SEQ ID NO: 739052 - protein, 18 aa, Mycobacterium
TLVPRLTRTSVLIGKSTV

SEQ ID NO: 739053 - protein, 19 aa, Mycobacterium
TLVRAVCGDRRLVTLDGPE

SEQ ID NO: 739054 - protein, 24 aa, Mycobacterium
TLVRELTMVAPLVLSHDVPVQVQV

SEQ ID NO: 739055 - protein, 31 aa, Mycobacterium
TLVRHPRLAKGFLRFNFHLLYGSSLPARLRE

SEQ ID NO: 739056 - protein, 17 aa, Mycobacterium
TLVRRLEDEVARAVAAA

SEQ ID NO: 739057 - protein, 18 aa, Mycobacterium
TLVRRRHGRRLALLATDE

SEQ ID NO: 739058 - protein, 17 aa, Mycobacterium
TLVRVTLHEGRKHIVRR

SEQ ID NO: 739059 - protein, 18 aa, Mycobacterium
TLVRYCVGDLGHPLLWCT

SEQ ID NO: 739060 - protein, 19 aa, Mycobacterium
TLVRYCVGELGHPMLWCTS

SEQ ID NO: 739061 - protein, 18 aa, Mycobacterium
TLVSKGFTPRRIRELEPR

SEQ ID NO: 739062 - protein, 25 aa, Mycobacterium
TLVSLGAQVRWASCNIFSTQDHAAA

SEQ ID NO: 739063 - protein, 18 aa, Mycobacterium
TLVSWLPFYHDMGLVLGV

SEQ ID NO: 739064 - protein, 17 aa, Mycobacterium
TLVTVSWSLQRVRHGEQ

SEQ ID NO: 739065 - protein, 24 aa, Mycobacterium
TLVYCCGPEGLLSAVEQFCQSWPK

SEQ ID NO: 739066 - protein, 42 aa, Mycobacterium
TLWAEAVPGRVWRRGAGAVKAWSEAMVAAWIGGIDDELGETR

SEQ ID NO: 739067 - protein, 17 aa, Mycobacterium
TLWAHRVNVESGEFVEG

SEQ ID NO: 739068 - protein, 23 aa, Mycobacterium
TLWGPARLMRTAPISREMILNYV

SEQ ID NO: 739069 - protein, 26 aa, Mycobacterium
TLWRAAAKSRRWLVAAHIPPEDNRPI

SEQ ID NO: 739070 - protein, 25 aa, Mycobacterium
TLWRAAGRSRRWLVAPHVPPEEDRP

SEQ ID NO: 739071 - protein, 18 aa, Mycobacterium
TLWSHAWLARTQFSLGEW

SEQ ID NO: 739072 - protein, 19 aa, Mycobacterium
TLWSIPIVFDMSADDIAEL

SEQ ID NO: 739073 - protein, 18 aa, Mycobacterium
TLYALGALGSLRARLTGK

SEQ ID NO: 739074 - protein, 25 aa, Mycobacterium
TLYASRTQLPITMWQQHFADATTGI

SEQ ID NO: 739075 - protein, 20 aa, Mycobacterium
TLYDAGFSAVSWPKEYGGRD

SEQ ID NO: 739076 - protein, 20 aa, Mycobacterium
TLYGFGLENQNAWIGHNGNI

SEQ ID NO: 739077 - protein, 28 aa, Mycobacterium
TLYPSLSSDQAWAMLGVTPMIGVNDDTS

SEQ ID NO: 739078 - protein, 25 aa, Mycobacterium
TLYPSLTSEQAWSMLGVTPLIGIND

SEQ ID NO: 739079 - protein, 17 aa, Mycobacterium
TLYRHFATKTDLVLAVL

SEQ ID NO: 739080 - protein, 41 aa, Mycobacterium
TLYRPHRLAVCLDLDWRPAWRVAAIPSYKAHRVVTDDPLAG

SEQ ID NO: 739081 - protein, 25 aa, Mycobacterium
TLYRSVRGLWHFGLQPDEVAGFVDE

SEQ ID NO: 739082 - protein, 17 aa, Mycobacterium
TLYRYFPSKVHLLVSAL

SEQ ID NO: 739083 - protein, 28 aa, Mycobacterium
TLYVARWLHPGQRAFQIATQYALLTQAE

SEQ ID NO: 739084 - protein, 19 aa, Mycobacterium
TMAALRFAIQGGPGLVTVV

SEQ ID NO: 739085 - protein, 27 aa, Mycobacterium
TMADPGSVSYLFSRKGVVTLDKDGLTE

SEQ ID NO: 739086 - protein, 24 aa, Mycobacterium
TMADPRWLDPTIEPNGRRPRWSYL

SEQ ID NO: 739087 - protein, 24 aa, Mycobacterium
TMAEQRRRCPADDIVTRLVEADLD

SEQ ID NO: 739088 - protein, 23 aa, Mycobacterium
TMAERRAALRLSREQSSLALDVK

SEQ ID NO: 739089 - protein, 22 aa, Mycobacterium
TMALAVVCRGLFHTDLGGSAVS

SEQ ID NO: 739090 - protein, 20 aa, Mycobacterium
TMAMLRGWTPLIALQVEYSL

SEQ ID NO: 739091 - protein, 24 aa, Mycobacterium
TMARDLGSLGIRALAIAPSLFATG

SEQ ID NO: 739092 - protein, 17 aa, Mycobacterium
TMARIRDEFGWLDSCFA

SEQ ID NO: 739093 - protein, 17 aa, Mycobacterium
TMDAWTLVHSWYRRFEG

SEQ ID NO: 739094 - protein, 24 aa, Mycobacterium
TMDGSECVPVLLTALGEITGTDTG

SEQ ID NO: 739095 - protein, 18 aa, Mycobacterium
TMDLVVLDDALKYGSRAA

SEQ ID NO: 739096 - protein, 20 aa, Mycobacterium
TMDTEWPLTLVDLAHIASDR

SEQ ID NO: 739097 - protein, 19 aa, Mycobacterium
TMDTWVASGRCDAMQDFAG

SEQ ID NO: 739098 - protein, 25 aa, Mycobacterium
TMDVLAAAVAMGWTPFYPQFNRSSL

SEQ ID NO: 739099 - protein, 26 aa, Mycobacterium
TMDVRLVPLARAWTRGAVKTVPPEWL

SEQ ID NO: 739100 - protein, 23 aa, Mycobacterium
TMEAEARLSLAERLAGWEERYPD

SEQ ID NO: 739101 - protein, 19 aa, Mycobacterium
TMEALTRLLADRTGGPRLD

SEQ ID NO: 739102 - protein, 21 aa, Mycobacterium
TMEFFEEVLPLVARSEEQLTA

SEQ ID NO: 739103 - protein, 25 aa, Mycobacterium
TMFFPANFPLPAKIVYQVLEPIDIA

SEQ ID NO: 739104 - protein, 24 aa, Mycobacterium
TMFIPAFLRYDLREVNGEWRIGRL

SEQ ID NO: 739105 - protein, 22 aa, Mycobacterium
TMGCAVPYALGAKFAHPDRPVI

SEQ ID NO: 739106 - protein, 22 aa, Mycobacterium
TMGDFMAATAYEVLRRQLDIFT

SEQ ID NO: 739107 - protein, 17 aa, Mycobacterium
TMGLRYATVTGVARDDL

SEQ ID NO: 739108 - protein, 31 aa, Mycobacterium
TMGLWRYRAGTIGPWNLREWVRLMRAGVYPY

SEQ ID NO: 739109 - protein, 19 aa, Mycobacterium
TMGMGAAIVDHVRDAVTGR

SEQ ID NO: 739110 - protein, 21 aa, Mycobacterium
TMGQPYPVAMAKLGQAIAAEQ

SEQ ID NO: 739111 - protein, 25 aa, Mycobacterium
TMGRLPGRAFLGYCTAKGALAHYTR

SEQ ID NO: 739112 - protein, 23 aa, Mycobacterium
TMHCLAEALGMTVAGSAPVRANS

SEQ ID NO: 739113 - protein, 25 aa, Mycobacterium
TMIEPWLLMNWHRTMDWLLLAPTLS

SEQ ID NO: 739114 - protein, 25 aa, Mycobacterium
TMIEPWLLMNWHRTMDWLLLAPTLT

SEQ ID NO: 739115 - protein, 23 aa, Mycobacterium
TMIKQLLGGLAMRRPSNWLLAAR

SEQ ID NO: 739116 - protein, 24 aa, Mycobacterium
TMKERSTAEWLALLRQLEIPAAPL

SEQ ID NO: 739117 - protein, 24 aa, Mycobacterium
TMKHLRAGYWRQVRAQLAVTPVML

SEQ ID NO: 739118 - protein, 23 aa, Mycobacterium
TMKHLRAGYWRQVRTQLLVTPAM

SEQ ID NO: 739119 - protein, 18 aa, Mycobacterium
TMLAQRYANTPTVIGADL

SEQ ID NO: 739120 - protein, 24 aa, Mycobacterium
TMLARIAAIPGIRQRDLSSIVFIL

SEQ ID NO: 739121 - protein, 23 aa, Mycobacterium
TMLARIAARPDVRRRDLSSIVFI

SEQ ID NO: 739122 - protein, 21 aa, Mycobacterium
TMLGVALSAYEHWLGDESVSL

SEQ ID NO: 739123 - protein, 21 aa, Mycobacterium
TMLGVALSAYEHWLSDESVSL

SEQ ID NO: 739124 - protein, 17 aa, Mycobacterium
TMLNLLCHLSGVATATA

SEQ ID NO: 739125 - protein, 17 aa, Mycobacterium
TMLRAHLGHPLPELVAE

SEQ ID NO: 739126 - protein, 22 aa, Mycobacterium
TMLSERSGLLVPLTNSVAAQLE

SEQ ID NO: 739127 - protein, 21 aa, Mycobacterium
TMLSFAEMLGRLAVHDPETYT

SEQ ID NO: 739128 - protein, 17 aa, Mycobacterium
TMLSWSALCGIVEVNGS

SEQ ID NO: 739129 - protein, 25 aa, Mycobacterium
TMMHLGPFRPAWGFGGYRTPVPGLY

SEQ ID NO: 739130 - protein, 25 aa, Mycobacterium
TMNERRWRTGLSLAEGAPVEDIHLG

SEQ ID NO: 739131 - protein, 26 aa, Mycobacterium
TMNFPSFPGFAARLFATDDEEFSLAL

SEQ ID NO: 739132 - protein, 21 aa, Mycobacterium
TMNLSRRWANDGIRVNAIAPG

SEQ ID NO: 739133 - protein, 18 aa, Mycobacterium
TMPARAAAITAPLLVVHG

SEQ ID NO: 739134 - protein, 24 aa, Mycobacterium
TMPKFPLPLGDLSVPCTGDLMTVQ

SEQ ID NO: 739135 - protein, 23 aa, Mycobacterium
TMPLAEIHKAFQLMIDGGLTGKL

SEQ ID NO: 739136 - protein, 21 aa, Mycobacterium
TMPMMPGMDGMPGHSGMPSAS

SEQ ID NO: 739137 - protein, 18 aa, Mycobacterium
TMPNYTLLPPDDMNIVGT

SEQ ID NO: 739138 - protein, 26 aa, Mycobacterium
TMQEGQRLWLSWAMANRDPRLFDQPD

SEQ ID NO: 739139 - protein, 17 aa, Mycobacterium
TMQLTHPAFMVLDSASG

SEQ ID NO: 739140 - protein, 17 aa, Mycobacterium
TMRAGMFHLRDRRPDVY

SEQ ID NO: 739141 - protein, 22 aa, Mycobacterium
TMRALTARSWRAGLRQRAAVRA

SEQ ID NO: 739142 - protein, 18 aa, Mycobacterium
TMREVCVLLADNGSTDGT

SEQ ID NO: 739143 - protein, 18 aa, Mycobacterium
TMRGVCARTSLNDRYFYE

SEQ ID NO: 739144 - protein, 18 aa, Mycobacterium
TMRHLPGAAVIAKVADRA

SEQ ID NO: 739145 - protein, 20 aa, Mycobacterium
TMRIPAYLRYALQDTETDTE

SEQ ID NO: 739146 - protein, 22 aa, Mycobacterium
TMRLLGVTCLEELSPRHVTQLR

SEQ ID NO: 739147 - protein, 25 aa, Mycobacterium
TMRRVAADWPPARVSAVTGIEEERI

SEQ ID NO: 739148 - protein, 17 aa, Mycobacterium
TMRRVAADWPPKRVGAV

SEQ ID NO: 739149 - protein, 22 aa, Mycobacterium
TMRWDRLVLTPGSVTRLFDVPG

SEQ ID NO: 739150 - protein, 18 aa, Mycobacterium
TMSAFPMCERCAAEYHDP

SEQ ID NO: 739151 - protein, 17 aa, Mycobacterium
TMSAIRLARGFTGRAKI

SEQ ID NO: 739152 - protein, 19 aa, Mycobacterium
TMSAIRLARGFTGRPKIVK

SEQ ID NO: 739153 - protein, 17 aa, Mycobacterium
TMSAVRLARGFTGRSKI

SEQ ID NO: 739154 - protein, 22 aa, Mycobacterium
TMSDIRFARFIGQEIFPGGQLP

SEQ ID NO: 739155 - protein, 29 aa, Mycobacterium
TMSFYRPTQPGSYPIVLATYEIVCSKYPD

SEQ ID NO: 739156 - protein, 26 aa, Mycobacterium
TMSKAFAFAGGRLGYLVAAPAVIDAM

SEQ ID NO: 739157 - protein, 27 aa, Mycobacterium
TMSLEMLRLVEAFGYGWSDLERFTINA

SEQ ID NO: 739158 - protein, 18 aa, Mycobacterium
TMSLTCVFDHRIADGAQA

SEQ ID NO: 739159 - protein, 36 aa, Mycobacterium
TMSPAERWQLLATAWLDLPGRPALIGSRGPDAKPYS

SEQ ID NO: 739160 - protein, 17 aa, Mycobacterium
TMSRLCWGAEALLRRWS

SEQ ID NO: 739161 - protein, 25 aa, Mycobacterium
TMSTWKRLCDPVAEQISTVWAQALP

SEQ ID NO: 739162 - protein, 19 aa, Mycobacterium
TMTGFGGWNSGSGNIGLFN

SEQ ID NO: 739163 - protein, 19 aa, Mycobacterium
TMTGLPFSALCAYDTHQLA

SEQ ID NO: 739164 - protein, 27 aa, Mycobacterium
TMTKSLRAGKVFLDWSQNNAAKTTIAP

SEQ ID NO: 739165 - protein, 27 aa, Mycobacterium
TMTKSLRAGKVFLDWSQNSGSKTTIAP

SEQ ID NO: 739166 - protein, 17 aa, Mycobacterium
TMTKYILIPTHDLPLLN

SEQ ID NO: 739167 - protein, 26 aa, Mycobacterium
TMTVARLGVRPVRCVLIDCAEAGVAA

SEQ ID NO: 739168 - protein, 21 aa, Mycobacterium
TMVADPWGRILVADTRGGQLL

SEQ ID NO: 739169 - protein, 17 aa, Mycobacterium
TMVAFAMGDREPVDVTV

SEQ ID NO: 739170 - protein, 25 aa, Mycobacterium
TMVDLLSTVLIRWERDDEVRAVVVS

SEQ ID NO: 739171 - protein, 23 aa, Mycobacterium
TMVERLLGFGLAKGHGAADWSKR

SEQ ID NO: 739172 - protein, 21 aa, Mycobacterium
TMVLPELRALANQVGVKGTSG

SEQ ID NO: 739173 - protein, 24 aa, Mycobacterium
TMVLPELRALANRAGVKGTSGMRK

SEQ ID NO: 739174 - protein, 24 aa, Mycobacterium
TMVLPELRALASQVGVKGTSGMRK

SEQ ID NO: 739175 - protein, 26 aa, Mycobacterium
TMVPARLRPIGMVFQHYALFPNMTVA

SEQ ID NO: 739176 - protein, 24 aa, Mycobacterium
TMVRRLPPDAMWQVIAIGRANLEL

SEQ ID NO: 739177 - protein, 19 aa, Mycobacterium
TMVVTGLHLLGGARADANR

SEQ ID NO: 739178 - protein, 20 aa, Mycobacterium
TMVVTGLHLLGGARADATKV

SEQ ID NO: 739179 - protein, 25 aa, Mycobacterium
TMVYLCGPAGRYVTGVALPVDAGQT

SEQ ID NO: 739180 - protein, 21 aa, Mycobacterium
TMWACKSAPLSAGSEGHGVPI

SEQ ID NO: 739181 - protein, 24 aa, Mycobacterium
TMWERRLGVPVIRATYDIHAAGAS

SEQ ID NO: 739182 - protein, 17 aa, Mycobacterium
TMYAGWRTVIAEYVADR

SEQ ID NO: 739183 - protein, 24 aa, Mycobacterium
TMYIPAFLRYDLREANGEWLIGEL

SEQ ID NO: 739184 - protein, 17 aa, Mycobacterium
TMYVIAFCMGPLGSDDP

SEQ ID NO: 739185 - protein, 17 aa, Mycobacterium
TNAAAFAMLRGELDLAR

SEQ ID NO: 739186 - protein, 31 aa, Mycobacterium
TNAGGCDRTKCVWAQVCPMTQQLNGLDKAPG

SEQ ID NO: 739187 - protein, 26 aa, Mycobacterium
TNAGQPIFWVVRALELLEDFEQFGYY

SEQ ID NO: 739188 - protein, 25 aa, Mycobacterium
TNAGRFSIAVGDMATGIIVGLEPDG

SEQ ID NO: 739189 - protein, 18 aa, Mycobacterium
TNAGRSALILTFDHTVGD

SEQ ID NO: 739190 - protein, 24 aa, Mycobacterium
TNAGSLWWRTVQAVAAEYPEVEVA

SEQ ID NO: 739191 - protein, 17 aa, Mycobacterium
TNAKLVAEFGIDTDNMF

SEQ ID NO: 739192 - protein, 24 aa, Mycobacterium
TNALCAAAVALECGADVDQVAAAL

SEQ ID NO: 739193 - protein, 23 aa, Mycobacterium
TNALCAGAVALQCGATVEQVATA

SEQ ID NO: 739194 - protein, 19 aa, Mycobacterium
TNAPMCSDIGIAFGQVAET

SEQ ID NO: 739195 - protein, 17 aa, Mycobacterium
TNARIAVNLGAPLLLTV

SEQ ID NO: 739196 - protein, 25 aa, Mycobacterium
TNARIAVNLGAPVLLTIKGFDRTPD

SEQ ID NO: 739197 - protein, 17 aa, Mycobacterium
TNARVGSLSTMVLPELR

SEQ ID NO: 739198 - protein, 21 aa, Mycobacterium
TNATCGACFGYHMGLVGPGEV

SEQ ID NO: 739199 - protein, 19 aa, Mycobacterium
TNAWVPFVVASSILVRDGG

SEQ ID NO: 739200 - protein, 19 aa, Mycobacterium
TNAWVPFVVASTIVVRDGG

SEQ ID NO: 739201 - protein, 17 aa, Mycobacterium
TNCGPRYTVITDLPYDR

SEQ ID NO: 739202 - protein, 24 aa, Mycobacterium
TNDARFLLYPAMKKLTLDIASMVF

SEQ ID NO: 739203 - protein, 18 aa, Mycobacterium
TNDKKLFWIENSTRRWDG

SEQ ID NO: 739204 - protein, 24 aa, Mycobacterium
TNDNRFLFYPAIKELTLDVASVVF

SEQ ID NO: 739205 - protein, 22 aa, Mycobacterium
TNDVRINLQLQLAAQWHTVDVL

SEQ ID NO: 739206 - protein, 23 aa, Mycobacterium
TNDWKLEQAKLFGATHTVNPNTT

SEQ ID NO: 739207 - protein, 18 aa, Mycobacterium
TNDYEWDLLLSKTGWSEA

SEQ ID NO: 739208 - protein, 18 aa, Mycobacterium
TNDYEWDLLLSKTGWTEA

SEQ ID NO: 739209 - protein, 17 aa, Mycobacterium
TNDYEWELLLNKTGWSE

SEQ ID NO: 739210 - protein, 22 aa, Mycobacterium
TNEGLRSRFTRSIDFPSYTAPE

SEQ ID NO: 739211 - protein, 22 aa, Mycobacterium
TNEGLRSRFTRSIDFPSYTSHE

SEQ ID NO: 739212 - protein, 23 aa, Mycobacterium
TNEGLRSRFTRSIEFPSYTSHEL

SEQ ID NO: 739213 - protein, 23 aa, Mycobacterium
TNEGLRSRFTRSINFPSYAPSEL

SEQ ID NO: 739214 - protein, 18 aa, Mycobacterium
TNELRSVQYFNRSPRAFA

SEQ ID NO: 739215 - protein, 25 aa, Mycobacterium
TNFARSAITWNVLDDLGIGGITDLW

SEQ ID NO: 739216 - protein, 23 aa, Mycobacterium
TNFRDVMITLGMFTHEALLGGEG

SEQ ID NO: 739217 - protein, 22 aa, Mycobacterium
TNFRLRMSDLLGEVAEALDARF

SEQ ID NO: 739218 - protein, 29 aa, Mycobacterium
TNGAPLGYPSIYDGWHYGTGSPGTNLPIQ

SEQ ID NO: 739219 - protein, 28 aa, Mycobacterium
TNGFAYRFALPRAIAFAMRGVADESTLI

SEQ ID NO: 739220 - protein, 17 aa, Mycobacterium
TNGFRPATFAAIVDGIV

SEQ ID NO: 739221 - protein, 25 aa, Mycobacterium
TNGGFQLSGHWKIVTGIRSATWIVV

SEQ ID NO: 739222 - protein, 19 aa, Mycobacterium
TNGLASLPLPAPGLGSGGY

SEQ ID NO: 739223 - protein, 18 aa, Mycobacterium
TNGLPYPASALMGNAFMR

SEQ ID NO: 739224 - protein, 26 aa, Mycobacterium
TNGPGTDRCGPWIIERAIRDVRGGIE

SEQ ID NO: 739225 - protein, 17 aa, Mycobacterium
TNGRPQLSLVPERIDSF

SEQ ID NO: 739226 - protein, 24 aa, Mycobacterium
TNGRTAKFVKRFGAVGDELRRAAT

SEQ ID NO: 739227 - protein, 27 aa, Mycobacterium
TNGTFTSGFGYRWGALHGGIDIANSIG

SEQ ID NO: 739228 - protein, 19 aa, Mycobacterium
TNGTGFGIGGTGGDGGDSF

SEQ ID NO: 739229 - protein, 25 aa, Mycobacterium
TNGVGGEFRGGVGQGARGSAGVITA

SEQ ID NO: 739230 - protein, 18 aa, Mycobacterium
TNHLGHFALTGLLFDNIL

SEQ ID NO: 739231 - protein, 17 aa, Mycobacterium
TNHLGHFALTGLLLDHL

SEQ ID NO: 739232 - protein, 18 aa, Mycobacterium
TNHLGHFALTGLLLDHLL

SEQ ID NO: 739233 - protein, 17 aa, Mycobacterium
TNHLGHFALTGLLLDRL

SEQ ID NO: 739234 - protein, 17 aa, Mycobacterium
TNHLGHFALTGLLLENL

SEQ ID NO: 739235 - protein, 18 aa, Mycobacterium
TNHLKGVVMFDGVANNAT

SEQ ID NO: 739236 - protein, 18 aa, Mycobacterium
TNHLKRLGLPDEMVGTAL

SEQ ID NO: 739237 - protein, 23 aa, Mycobacterium
TNHPAGVDPLVFARRRLTRAGVS

SEQ ID NO: 739238 - protein, 19 aa, Mycobacterium
TNHPVAMDPLVFARRQLIA

SEQ ID NO: 739239 - protein, 32 aa, Mycobacterium
TNIEFIVAQLLRLGKLGSFDFNSRFYADDDLI

SEQ ID NO: 739240 - protein, 26 aa, Mycobacterium
TNILAKLGLRDRLALTRYAIRAGLIE

SEQ ID NO: 739241 - protein, 18 aa, Mycobacterium
TNIMKLPMLSDWRRPQAE

SEQ ID NO: 739242 - protein, 19 aa, Mycobacterium
TNLAGWLYRIMRNTHLSAY

SEQ ID NO: 739243 - protein, 21 aa, Mycobacterium
TNLCGAFRLISEMAATGLGGS

SEQ ID NO: 739244 - protein, 30 aa, Mycobacterium
TNLDASAFLGRLALIRIYKGRIKKGQQVAW

SEQ ID NO: 739245 - protein, 28 aa, Mycobacterium
TNLDASAFLGRLALIRIYNGRIRKGQQV

SEQ ID NO: 739246 - protein, 28 aa, Mycobacterium
TNLDASAFLGRLALVRIYNGKLKKGQQV

SEQ ID NO: 739247 - protein, 28 aa, Mycobacterium
TNLDASAFLGRLALVRIYNGKLRKGQQV

SEQ ID NO: 739248 - protein, 24 aa, Mycobacterium
TNLDKLKSLMAVARKDVVLSAGWD

SEQ ID NO: 739249 - protein, 19 aa, Mycobacterium
TNLEHWTTLIPRGATLVSL

SEQ ID NO: 739250 - protein, 20 aa, Mycobacterium
TNLFGLNAPAIMAAEGQYEQ

SEQ ID NO: 739251 - protein, 17 aa, Mycobacterium
TNLGLAIDLQGKDGKRA

SEQ ID NO: 739252 - protein, 25 aa, Mycobacterium
TNLNPVWKVGFQVAEALRANTSDRH

SEQ ID NO: 739253 - protein, 22 aa, Mycobacterium
TNLPATPIHVVFRSDESGTTDN

SEQ ID NO: 739254 - protein, 18 aa, Mycobacterium
TNLPRFSTDFALSDGAPA

SEQ ID NO: 739255 - protein, 19 aa, Mycobacterium
TNLRAPWTAIGMLQQGRRW

SEQ ID NO: 739256 - protein, 33 aa, Mycobacterium
TNLRARPQLAVTFRNGWLWATVEGRAELVGPDD

SEQ ID NO: 739257 - protein, 24 aa, Mycobacterium
TNLRDPWTAIGMLQQGRRWIEKAL

SEQ ID NO: 739258 - protein, 20 aa, Mycobacterium
TNLRRLIGLFEMLRDRSQLI

SEQ ID NO: 739259 - protein, 21 aa, Mycobacterium
TNLRYPHNMGIFTARYGASRR

SEQ ID NO: 739260 - protein, 18 aa, Mycobacterium
TNLVRWNLKPETVVSDIF

SEQ ID NO: 739261 - protein, 20 aa, Mycobacterium
TNLWGAFGLLAEMVADGRSG

SEQ ID NO: 739262 - protein, 20 aa, Mycobacterium
TNLWGAFGLLAEMVAEGRGG

SEQ ID NO: 739263 - protein, 20 aa, Mycobacterium
TNLWGAFGLLAEMVSDGRSG

SEQ ID NO: 739264 - protein, 19 aa, Mycobacterium
TNMIGRLMALKSLAEIIPE

SEQ ID NO: 739265 - protein, 19 aa, Mycobacterium
TNMQAWLFRIMRNTWISNF

SEQ ID NO: 739266 - protein, 17 aa, Mycobacterium
TNPAVVISRHLTTPPPA

SEQ ID NO: 739267 - protein, 22 aa, Mycobacterium
TNPELRLLGALPTLYDSRTTHT

SEQ ID NO: 739268 - protein, 21 aa, Mycobacterium
TNPHLRHSWWTGDADQARALG

SEQ ID NO: 739269 - protein, 17 aa, Mycobacterium
TNPKCSSVSVPLLDVPL

SEQ ID NO: 739270 - protein, 23 aa, Mycobacterium
TNPLPRRVVENLYRQAPMYLTKP

SEQ ID NO: 739271 - protein, 25 aa, Mycobacterium
TNPNPLFVDHAWHGVSGVLADFDMA

SEQ ID NO: 739272 - protein, 32 aa, Mycobacterium
TNPPVEGAFYWLSNREVRWRPAEYWEPGTKVE

SEQ ID NO: 739273 - protein, 17 aa, Mycobacterium
TNPRHVVAFTDGEVRQQ

SEQ ID NO: 739274 - protein, 27 aa, Mycobacterium
TNPRITALLCTADILALSAMDYLRAHG

SEQ ID NO: 739275 - protein, 17 aa, Mycobacterium
TNPSPYMYLLHVPNDAG

SEQ ID NO: 739276 - protein, 27 aa, Mycobacterium
TNPVLAEWFLRRISLLDSLYTVPSAPI

SEQ ID NO: 739277 - protein, 29 aa, Mycobacterium
TNPVYFALLARRRMDLFGATVEDFAQVKV

SEQ ID NO: 739278 - protein, 27 aa, Mycobacterium
TNPVYFALLARRRMDLYGATLEDFAQV

SEQ ID NO: 739279 - protein, 18 aa, Mycobacterium
TNPWSAAYRQERLEPSER

SEQ ID NO: 739280 - protein, 25 aa, Mycobacterium
TNQHGALCCPVELTLQVPEDPHHGD

SEQ ID NO: 739281 - protein, 27 aa, Mycobacterium
TNQLMKLTEVWQGAGSLAASGEATTMI

SEQ ID NO: 739282 - protein, 23 aa, Mycobacterium
TNRCLDALLTLLAGRPTGDRVPL

SEQ ID NO: 739283 - protein, 20 aa, Mycobacterium
TNRFSFDWWHSLKQLGATHC

SEQ ID NO: 739284 - protein, 24 aa, Mycobacterium
TNRGWLPHRLPRPARARCDDPQLL

SEQ ID NO: 739285 - protein, 20 aa, Mycobacterium
TNRLPAYRNIAAPVLVIGFA

SEQ ID NO: 739286 - protein, 18 aa, Mycobacterium
TNRPEFHLCDTAVLHCGA

SEQ ID NO: 739287 - protein, 31 aa, Mycobacterium
TNRPELIDPALLRPGRMERLVFVEPPDAQAR

SEQ ID NO: 739288 - protein, 18 aa, Mycobacterium
TNSLLWRDVVTAVAATGR

SEQ ID NO: 739289 - protein, 18 aa, Mycobacterium
TNSTLVWQALSAAHTTGF

SEQ ID NO: 739290 - protein, 17 aa, Mycobacterium
TNTASLVCERFSAQLAA

SEQ ID NO: 739291 - protein, 17 aa, Mycobacterium
TNTCELGQWGFTSGPGF

SEQ ID NO: 739292 - protein, 24 aa, Mycobacterium
TNTGTRGLPGVAPQPSTGAAGTPG

SEQ ID NO: 739293 - protein, 33 aa, Mycobacterium
TNTILKAAGFRWFRTLGVWGIAGSRDRQPNRYK

SEQ ID NO: 739294 - protein, 18 aa, Mycobacterium
TNTLCAIMGGDAIFEELK

SEQ ID NO: 739295 - protein, 18 aa, Mycobacterium
TNTLCAVMGGDAIFDALK

SEQ ID NO: 739296 - protein, 21 aa, Mycobacterium
TNTPRNFARRGIRTHVLASSA

SEQ ID NO: 739297 - protein, 26 aa, Mycobacterium
TNTPRNFARRGIRVQVVPASISPDEL

SEQ ID NO: 739298 - protein, 23 aa, Mycobacterium
TNTPRNFARRGVRSHVLPSSTSF

SEQ ID NO: 739299 - protein, 23 aa, Mycobacterium
TNTPRNFARRGVRSHVLPSSVTF

SEQ ID NO: 739300 - protein, 25 aa, Mycobacterium
TNTPRNFARRGVRTHVLPASATFDQ

SEQ ID NO: 739301 - protein, 18 aa, Mycobacterium
TNTVLAFFVEQMSTEQSA

SEQ ID NO: 739302 - protein, 28 aa, Mycobacterium
TNVAFRLSGIAGRAGRAPVMVTDVVHDA

SEQ ID NO: 739303 - protein, 25 aa, Mycobacterium
TNVARFEGYRGFLFGSLNPDVLPLT

SEQ ID NO: 739304 - protein, 20 aa, Mycobacterium
TNVCGPTAWDGYAAAAVCAA

SEQ ID NO: 739305 - protein, 26 aa, Mycobacterium
TNVEDFKFFWVTGLTADGKIVVANNY

SEQ ID NO: 739306 - protein, 25 aa, Mycobacterium
TNVEREGWHALLTMRLDGNVKLPAN

SEQ ID NO: 739307 - protein, 17 aa, Mycobacterium
TNVGAWLDLLVARLQAL

SEQ ID NO: 739308 - protein, 27 aa, Mycobacterium
TNVLTFAGRLWSRIVAEVGRDYPDVEV

SEQ ID NO: 739309 - protein, 31 aa, Mycobacterium
TNVLTFAGSLWWRTVQEIAKKYPDVEVAYQH

SEQ ID NO: 739310 - protein, 25 aa, Mycobacterium
TNVMPQWAGSSWYELRYADPDNAEA

SEQ ID NO: 739311 - protein, 25 aa, Mycobacterium
TNVMPQWAGSSWYELRYTDPHNPDE

SEQ ID NO: 739312 - protein, 26 aa, Mycobacterium
TNVMPQWAGSSWYELRYTDPYNSEAL

SEQ ID NO: 739313 - protein, 25 aa, Mycobacterium
TNVSHEFRTPLTLLLGPLDDALAEA

SEQ ID NO: 739314 - protein, 25 aa, Mycobacterium
TNVSHEFRTPLTLLLGPLDDARSDA

SEQ ID NO: 739315 - protein, 25 aa, Mycobacterium
TNVSHEFRTPLTLLLGPVEDALADA

SEQ ID NO: 739316 - protein, 30 aa, Mycobacterium
TNVSQWISGEFSKLVQFILNLVNAPSELLF

SEQ ID NO: 739317 - protein, 25 aa, Mycobacterium
TNVTKLPGLGGWRRPQAELDESSRA

SEQ ID NO: 739318 - protein, 28 aa, Mycobacterium
TNVYVLDEWLEPVAIGVIGDVYYAGGAV

SEQ ID NO: 739319 - protein, 24 aa, Mycobacterium
TNWLTAGALLWLPRRSRPQLTAGG

SEQ ID NO: 739320 - protein, 17 aa, Mycobacterium
TNYFLFYGAGRNPFKLV

SEQ ID NO: 739321 - protein, 23 aa, Mycobacterium
TNYRLTLRNGVLVYRKVAADEES

SEQ ID NO: 739322 - protein, 18 aa, Mycobacterium
TPAAAPWMKVSEAVDYLR

SEQ ID NO: 739323 - protein, 20 aa, Mycobacterium
TPAAEGCHLWHERHAVEATI

SEQ ID NO: 739324 - protein, 20 aa, Mycobacterium
TPAAFSYAFGRAFNIAPSSV

SEQ ID NO: 739325 - protein, 28 aa, Mycobacterium
TPAAHEFYIRDVLLDWGRDDPNHLEVQR

SEQ ID NO: 739326 - protein, 19 aa, Mycobacterium
TPAALLRCLVEGADEVHVD

SEQ ID NO: 739327 - protein, 18 aa, Mycobacterium
TPADFPDESAWSFPLSGA

SEQ ID NO: 739328 - protein, 20 aa, Mycobacterium
TPADLMRWVHPSLVANTQGT

SEQ ID NO: 739329 - protein, 22 aa, Mycobacterium
TPADLTALVADWLGTGHWIPDA

SEQ ID NO: 739330 - protein, 22 aa, Mycobacterium
TPADLTALVADWLGTGHWIPNA

SEQ ID NO: 739331 - protein, 24 aa, Mycobacterium
TPADRRPHCAWTVIIDESHPEAQS

SEQ ID NO: 739332 - protein, 26 aa, Mycobacterium
TPAEAKRALTRFIEHRLPHFGRYEDA

SEQ ID NO: 739333 - protein, 21 aa, Mycobacterium
TPAEFMTTGWFVGHIPFTVAV

SEQ ID NO: 739334 - protein, 25 aa, Mycobacterium
TPAEGIGLFRTELCFLNRDTEPTVA

SEQ ID NO: 739335 - protein, 24 aa, Mycobacterium
TPAEGVGLFRTELCFLNTDSEPTV

SEQ ID NO: 739336 - protein, 22 aa, Mycobacterium
TPAEIQKLWSINVDGVLWGIQA

SEQ ID NO: 739337 - protein, 23 aa, Mycobacterium
TPAELRAAYRAALADSAGDGVVA

SEQ ID NO: 739338 - protein, 21 aa, Mycobacterium
TPAELWRQAGLVHPLGEHFNP

SEQ ID NO: 739339 - protein, 22 aa, Mycobacterium
TPAESYWITGIKTMTEDASWAE

SEQ ID NO: 739340 - protein, 17 aa, Mycobacterium
TPAEVLELAVALRRENP

SEQ ID NO: 739341 - protein, 17 aa, Mycobacterium
TPAEYAAVCSCTHTPVA

SEQ ID NO: 739342 - protein, 18 aa, Mycobacterium
TPAFEWYYQSGLSVIMPV

SEQ ID NO: 739343 - protein, 25 aa, Mycobacterium
TPAFREPGPRLALLDEQGIDKSMMY

SEQ ID NO: 739344 - protein, 27 aa, Mycobacterium
TPAGCRRLKPALATYARFVRLNYLNPL

SEQ ID NO: 739345 - protein, 18 aa, Mycobacterium
TPAGIGFCAAQLGLTEAE

SEQ ID NO: 739346 - protein, 24 aa, Mycobacterium
TPAGKRGTESWVPVNKVHPSGGDG

SEQ ID NO: 739347 - protein, 20 aa, Mycobacterium
TPAGKVLGFTAVRCRVTLAG

SEQ ID NO: 739348 - protein, 30 aa, Mycobacterium
TPAGLLYLIGPMAWTLGYPIVPMLTPGSLD

SEQ ID NO: 739349 - protein, 18 aa, Mycobacterium
TPAGMRWTGPPPGGGLAD

SEQ ID NO: 739350 - protein, 17 aa, Mycobacterium
TPAGRVCVENVISGQRR

SEQ ID NO: 739351 - protein, 24 aa, Mycobacterium
TPAGWSHFDTDRWELFHIEADRSQ

SEQ ID NO: 739352 - protein, 24 aa, Mycobacterium
TPAHAHCDLFCGVYDPAQAKIEAM

SEQ ID NO: 739353 - protein, 25 aa, Mycobacterium
TPAHEPRPAFERTIPAGHSAAEISW

SEQ ID NO: 739354 - protein, 23 aa, Mycobacterium
TPAHYYRALALAVRDRMQQRWIA

SEQ ID NO: 739355 - protein, 22 aa, Mycobacterium
TPAIPFAKLMGRTHVGHMNNLL

SEQ ID NO: 739356 - protein, 18 aa, Mycobacterium
TPAKAPRKAAGKRSKTIE

SEQ ID NO: 739357 - protein, 19 aa, Mycobacterium
TPALIPFSGPARKVLELTF

SEQ ID NO: 739358 - protein, 18 aa, Mycobacterium
TPALLWIHGGGYVLGKAA

SEQ ID NO: 739359 - protein, 18 aa, Mycobacterium
TPALPKLSTAIVDDDPNE

SEQ ID NO: 739360 - protein, 17 aa, Mycobacterium
TPALWKALTDAGVFGLA

SEQ ID NO: 739361 - protein, 24 aa, Mycobacterium
TPAMARAGLNFDVPGLSVSEPADV

SEQ ID NO: 739362 - protein, 25 aa, Mycobacterium
TPAMRYQPVNAWGIPTGRVEQRPAA

SEQ ID NO: 739363 - protein, 24 aa, Mycobacterium
TPANLRFYAGEALRSTGTTYPAPG

SEQ ID NO: 739364 - protein, 17 aa, Mycobacterium
TPAPGRIALYSTVHGVT

SEQ ID NO: 739365 - protein, 20 aa, Mycobacterium
TPAPIGRTWMSEMRQGWPHR

SEQ ID NO: 739366 - protein, 21 aa, Mycobacterium
TPAPLLRWGVAQFDPTLRSPV

SEQ ID NO: 739367 - protein, 22 aa, Mycobacterium
TPAPRAPVGWIEQLRTGESPGE

SEQ ID NO: 739368 - protein, 22 aa, Mycobacterium
TPAPRPVVIHVVADRASAAGTS

SEQ ID NO: 739369 - protein, 20 aa, Mycobacterium
TPAQLADLVQQWHAAGASGL

SEQ ID NO: 739370 - protein, 30 aa, Mycobacterium
TPAQMGAVWRGKWHGGLSFTGKCVAPIAIP

SEQ ID NO: 739371 - protein, 25 aa, Mycobacterium
TPAQRPAVHALYGFARRADDVLDSF

SEQ ID NO: 739372 - protein, 17 aa, Mycobacterium
TPAREFALSRFDLAAGE

SEQ ID NO: 739373 - protein, 18 aa, Mycobacterium
TPARHFSGRLFSRDTTLW

SEQ ID NO: 739374 - protein, 20 aa, Mycobacterium
TPARLVQLIDPFSVGFNLAK

SEQ ID NO: 739375 - protein, 21 aa, Mycobacterium
TPARMFGLYGRKGVIAPGADA

SEQ ID NO: 739376 - protein, 17 aa, Mycobacterium
TPARMFGLYPRKGVISP

SEQ ID NO: 739377 - protein, 24 aa, Mycobacterium
TPARPAVMPMDAWREEGQFIVEFD

SEQ ID NO: 739378 - protein, 17 aa, Mycobacterium
TPARRSGYLKVRDRTSY

SEQ ID NO: 739379 - protein, 22 aa, Mycobacterium
TPARVARAWREMLWGYHEVPED

SEQ ID NO: 739380 - protein, 24 aa, Mycobacterium
TPARVARAWREMLWGYNEVPEDHL

SEQ ID NO: 739381 - protein, 24 aa, Mycobacterium
TPARVKSNFELFDFELDDSDMDAI

SEQ ID NO: 739382 - protein, 19 aa, Mycobacterium
TPASGTWAATILARQIWAA

SEQ ID NO: 739383 - protein, 20 aa, Mycobacterium
TPASILHLFSLIGDLLPPGV

SEQ ID NO: 739384 - protein, 19 aa, Mycobacterium
TPASILVLMELIADLLPSG

SEQ ID NO: 739385 - protein, 28 aa, Mycobacterium
TPASLRPRREFSAMSFAAVNTVFRDSRA

SEQ ID NO: 739386 - protein, 23 aa, Mycobacterium
TPASLRTDLAIARDQIKTLRAER

SEQ ID NO: 739387 - protein, 24 aa, Mycobacterium
TPASVMRLRGITFHNLVGVDVDIP

SEQ ID NO: 739388 - protein, 19 aa, Mycobacterium
TPATREWWGGMWADRIVGS

SEQ ID NO: 739389 - protein, 18 aa, Mycobacterium
TPATVWELASQVPPQADM

SEQ ID NO: 739390 - protein, 26 aa, Mycobacterium
TPAVQRWLINHPRFILHFTPTSSSWL

SEQ ID NO: 739391 - protein, 19 aa, Mycobacterium
TPAVQRWLTNHPRFVLHFT

SEQ ID NO: 739392 - protein, 17 aa, Mycobacterium
TPAYFAVKAHEVVIQAA

SEQ ID NO: 739393 - protein, 30 aa, Mycobacterium
TPAYSGVLGRLWLARGGTYVLANIRGGGEY

SEQ ID NO: 739394 - protein, 21 aa, Mycobacterium
TPCEFSRDLFRGDRTRLAVTA

SEQ ID NO: 739395 - protein, 25 aa, Mycobacterium
TPCGTCESCQALAPSAPGSIDVVEL

SEQ ID NO: 739396 - protein, 25 aa, Mycobacterium
TPCVIKAADGRVVWDNDAYSFLDGP

SEQ ID NO: 739397 - protein, 23 aa, Mycobacterium
TPDACPSWLRPLVDHVDDVPDAA

SEQ ID NO: 739398 - protein, 24 aa, Mycobacterium
TPDAGLPLYAGWRTMALADDAAAR

SEQ ID NO: 739399 - protein, 30 aa, Mycobacterium
TPDAQRAAAFYGHVLGWVFDPETQRVTNTG

SEQ ID NO: 739400 - protein, 23 aa, Mycobacterium
TPDARVSTPLFWDELAGCKPEEF

SEQ ID NO: 739401 - protein, 18 aa, Mycobacterium
TPDELRAALTEAIGSGAP

SEQ ID NO: 739402 - protein, 17 aa, Mycobacterium
TPDELRTAAALIGGTTA

SEQ ID NO: 739403 - protein, 22 aa, Mycobacterium
TPDEMYKYLVAVAKDPDHAKIR

SEQ ID NO: 739404 - protein, 24 aa, Mycobacterium
TPDGRTAATATFDFTGNYVTVTVK

SEQ ID NO: 739405 - protein, 24 aa, Mycobacterium
TPDGSCPVSLFVPDTCEPVPGVVM

SEQ ID NO: 739406 - protein, 24 aa, Mycobacterium
TPDMRLDMPLVDFFSRGGALKSSW

SEQ ID NO: 739407 - protein, 23 aa, Mycobacterium
TPDPSYHGVVFADLGAPAYALKA

SEQ ID NO: 739408 - protein, 17 aa, Mycobacterium
TPDRFLVGLAVLSLMAA

SEQ ID NO: 739409 - protein, 17 aa, Mycobacterium
TPDRIRFASSLPALLAG

SEQ ID NO: 739410 - protein, 19 aa, Mycobacterium
TPDRLAGYAKDMAHMFVKS

SEQ ID NO: 739411 - protein, 26 aa, Mycobacterium
TPDRLLRCIEAVLACREALAINVKPK

SEQ ID NO: 739412 - protein, 23 aa, Mycobacterium
TPDRMDAVLRAKVDGAWNLHVLT

SEQ ID NO: 739413 - protein, 29 aa, Mycobacterium
TPDRVDAVLRAKVDGAWHLHELTRHLDLS

SEQ ID NO: 739414 - protein, 24 aa, Mycobacterium
TPDRVDAVLRAKVDGAWNLHEATR

SEQ ID NO: 739415 - protein, 21 aa, Mycobacterium
TPDSFWLPIFTHVRGLGEKDL

SEQ ID NO: 739416 - protein, 17 aa, Mycobacterium
TPDTFVFDGERRLVYRG

SEQ ID NO: 739417 - protein, 20 aa, Mycobacterium
TPDTLEWGCFTYGIVQHADY

SEQ ID NO: 739418 - protein, 22 aa, Mycobacterium
TPDVRNGIDFKIADLSLADFGR

SEQ ID NO: 739419 - protein, 22 aa, Mycobacterium
TPDVRNGIDFKVADLSLADYGR

SEQ ID NO: 739420 - protein, 17 aa, Mycobacterium
TPEAIAVTFDGRAMTYR

SEQ ID NO: 739421 - protein, 22 aa, Mycobacterium
TPEALRPADVVWPDDIPEGKLD

SEQ ID NO: 739422 - protein, 18 aa, Mycobacterium
TPEALRVLVSIQDEVAEQ

SEQ ID NO: 739423 - protein, 21 aa, Mycobacterium
TPEANSIAWLLWHSARCQDMQ

SEQ ID NO: 739424 - protein, 21 aa, Mycobacterium
TPEANSIAWLLWHSARVQDVQ

SEQ ID NO: 739425 - protein, 22 aa, Mycobacterium
TPEARAALWRTLFGLDSMERVS

SEQ ID NO: 739426 - protein, 24 aa, Mycobacterium
TPEARARYFQAWTATQAEFVDDPA

SEQ ID NO: 739427 - protein, 23 aa, Mycobacterium
TPEARELVRLAADVADKVLDPIV

SEQ ID NO: 739428 - protein, 23 aa, Mycobacterium
TPEARLSLISAIREAGLRCHVMV

SEQ ID NO: 739429 - protein, 18 aa, Mycobacterium
TPEAVKLFDQAGVTFAPG

SEQ ID NO: 739430 - protein, 24 aa, Mycobacterium
TPEEAWKLLSENSEAVLVDCRTDA

SEQ ID NO: 739431 - protein, 18 aa, Mycobacterium
TPEEIKALVAQSQKRSAV

SEQ ID NO: 739432 - protein, 35 aa, Mycobacterium
TPEEPKGVPVFAWKGESLEEYWWCAEQMLTWPDSD

SEQ ID NO: 739433 - protein, 43 aa, Mycobacterium
TPEEPKGVPVFAWKGETLEEYWWAAEQMLTWPDEPANMILDDG

SEQ ID NO: 739434 - protein, 42 aa, Mycobacterium
TPEEPKGVPVFAWKGETLEEYWWAAEQMLTWPDPDKPANMIL

SEQ ID NO: 739435 - protein, 41 aa, Mycobacterium
TPEEPKGVPVYAWKGETLEEYWWAAEQVLTWPDEPANMILD

SEQ ID NO: 739436 - protein, 22 aa, Mycobacterium
TPEERTELLLSMTDEVGELVLA

SEQ ID NO: 739437 - protein, 19 aa, Mycobacterium
TPEGARLSTSHAFLHPILG

SEQ ID NO: 739438 - protein, 24 aa, Mycobacterium
TPEGSGPWPGVVLFPDAGGLRPTM

SEQ ID NO: 739439 - protein, 22 aa, Mycobacterium
TPEGWRISSRIARPIFTPEVWP

SEQ ID NO: 739440 - protein, 21 aa, Mycobacterium
TPEKQFTLFFDDVRVPAANLI

SEQ ID NO: 739441 - protein, 22 aa, Mycobacterium
TPEKQFTLFFDDVRVPAANLIG

SEQ ID NO: 739442 - protein, 19 aa, Mycobacterium
TPELMLEYLRLEVGDAVKP

SEQ ID NO: 739443 - protein, 24 aa, Mycobacterium
TPELMPLPIALAHRLSRKLTEVRK

SEQ ID NO: 739444 - protein, 26 aa, Mycobacterium
TPELMPLPIALAHRLSRRLTEVRKDG

SEQ ID NO: 739445 - protein, 26 aa, Mycobacterium
TPELMPLPIALAHRLSRRLTEVRKNG

SEQ ID NO: 739446 - protein, 27 aa, Mycobacterium
TPELMPLPIALAHRLSRRLTEVRKNGV

SEQ ID NO: 739447 - protein, 24 aa, Mycobacterium
TPELPPPLAEPLLDLRIDAETAAS

SEQ ID NO: 739448 - protein, 18 aa, Mycobacterium
TPELRAMAEAHLTGSGET

SEQ ID NO: 739449 - protein, 24 aa, Mycobacterium
TPELYRLATMGEWRSGSDVDLALD

SEQ ID NO: 739450 - protein, 24 aa, Mycobacterium
TPEPGFRIVWGISRNTRRWWSLEA

SEQ ID NO: 739451 - protein, 26 aa, Mycobacterium
TPEPGHICPISMTYAVVPALRFNPEL

SEQ ID NO: 739452 - protein, 25 aa, Mycobacterium
TPEPGHVCPISMTYAVVPALRHNPE

SEQ ID NO: 739453 - protein, 21 aa, Mycobacterium
TPEPPWQDWLRLSRGDYGYEI

SEQ ID NO: 739454 - protein, 24 aa, Mycobacterium
TPEQFWPITGTLTFGQSVAQGVTL

SEQ ID NO: 739455 - protein, 18 aa, Mycobacterium
TPERKRYVLGSMGPGTKL

SEQ ID NO: 739456 - protein, 21 aa, Mycobacterium
TPERLHIWGGEGRRKGVSVAG

SEQ ID NO: 739457 - protein, 22 aa, Mycobacterium
TPERPCPLLSYQCAIDAVSSRC

SEQ ID NO: 739458 - protein, 21 aa, Mycobacterium
TPERRAGGAIRAELDALEGAA

SEQ ID NO: 739459 - protein, 23 aa, Mycobacterium
TPERTAFDIGRRGAVRSAVVRLD

SEQ ID NO: 739460 - protein, 28 aa, Mycobacterium
TPERVDAVLRAKVDAAWNLHELTRDLDL

SEQ ID NO: 739461 - protein, 26 aa, Mycobacterium
TPESWRLAPVRPRAVTTVNLLPIESQ

SEQ ID NO: 739462 - protein, 20 aa, Mycobacterium
TPETLGWGCFTYGVVQGADH

SEQ ID NO: 739463 - protein, 17 aa, Mycobacterium
TPEVFARFRRAVTDTGL

SEQ ID NO: 739464 - protein, 19 aa, Mycobacterium
TPEVGRFDDFFALGGDSIL

SEQ ID NO: 739465 - protein, 23 aa, Mycobacterium
TPEVPYYSATLFDPREEPYCDGS

SEQ ID NO: 739466 - protein, 21 aa, Mycobacterium
TPEVPYYSATLFDPREQPVCD

SEQ ID NO: 739467 - protein, 22 aa, Mycobacterium
TPEWARTAIELAQKVADGFAQD

SEQ ID NO: 739468 - protein, 19 aa, Mycobacterium
TPEWARTAIELARTAAEAF

SEQ ID NO: 739469 - protein, 25 aa, Mycobacterium
TPFAEELVMWWNFVGRNHDEIVSYR

SEQ ID NO: 739470 - protein, 30 aa, Mycobacterium
TPFALSAWTIRLLSRFPQRAVVALATNVPG

SEQ ID NO: 739471 - protein, 18 aa, Mycobacterium
TPFDREGRPEKAFLAVRT

SEQ ID NO: 739472 - protein, 20 aa, Mycobacterium
TPFEGYPRVRGETWTGDPGP

SEQ ID NO: 739473 - protein, 19 aa, Mycobacterium
TPFGFRRIFCVASKPDGAR

SEQ ID NO: 739474 - protein, 24 aa, Mycobacterium
TPFGTLPIVFSLGGLNAGSTGFGF

SEQ ID NO: 739475 - protein, 17 aa, Mycobacterium
TPFGVLTSIWAAVNSRV

SEQ ID NO: 739476 - protein, 21 aa, Mycobacterium
TPFHRMLAGLSGRSVSSAVAG

SEQ ID NO: 739477 - protein, 18 aa, Mycobacterium
TPFLPTWAVEPEDIADAV

SEQ ID NO: 739478 - protein, 24 aa, Mycobacterium
TPFLRKWREVGWRSPAKSGAESAH

SEQ ID NO: 739479 - protein, 17 aa, Mycobacterium
TPFNHPMLILARSLSAA

SEQ ID NO: 739480 - protein, 19 aa, Mycobacterium
TPFPGVRTSFELLKGRPGK

SEQ ID NO: 739481 - protein, 29 aa, Mycobacterium
TPFPKACPAPGVMQGCLESTSGLIMGPDS

SEQ ID NO: 739482 - protein, 24 aa, Mycobacterium
TPFPRRRCLPAGPARWPAASATAA

SEQ ID NO: 739483 - protein, 32 aa, Mycobacterium
TPFPTTARLTGRWMRGRIPVVSDFTRGIPFVH

SEQ ID NO: 739484 - protein, 22 aa, Mycobacterium
TPFRRDRRWGGDNTDAYYFMCP

SEQ ID NO: 739485 - protein, 23 aa, Mycobacterium
TPFRRDRRWGGDNTDAYYFVCPV

SEQ ID NO: 739486 - protein, 22 aa, Mycobacterium
TPFRRDRRWGGDNTDAYYHICP

SEQ ID NO: 739487 - protein, 22 aa, Mycobacterium
TPFRRDRRWGGDNTDAYYLMCP

SEQ ID NO: 739488 - protein, 19 aa, Mycobacterium
TPFVGGVAIGLRPGLINTV

SEQ ID NO: 739489 - protein, 20 aa, Mycobacterium
TPFVPGHEGAGVVERVGAGV

SEQ ID NO: 739490 - protein, 20 aa, Mycobacterium
TPFWRANGFSGQALSDNGPV

SEQ ID NO: 739491 - protein, 20 aa, Mycobacterium
TPGADRLRDFLGPDAAALID

SEQ ID NO: 739492 - protein, 24 aa, Mycobacterium
TPGANGGNGGWLIGSGGDGAAGGV

SEQ ID NO: 739493 - protein, 21 aa, Mycobacterium
TPGCFADVCDLLASGKNVVAT

SEQ ID NO: 739494 - protein, 17 aa, Mycobacterium
TPGCTKEACDFRDNLHD

SEQ ID NO: 739495 - protein, 21 aa, Mycobacterium
TPGCTKEACHFRDLAAEFTAV

SEQ ID NO: 739496 - protein, 17 aa, Mycobacterium
TPGCTKEACHFRDLAQE

SEQ ID NO: 739497 - protein, 24 aa, Mycobacterium
TPGCVIGGTAWDFANANRIPPGSL

SEQ ID NO: 739498 - protein, 18 aa, Mycobacterium
TPGDLLFHLRAESMDVCF

SEQ ID NO: 739499 - protein, 27 aa, Mycobacterium
TPGELLGCVSGALGLRKFFEDAGHELV

SEQ ID NO: 739500 - protein, 25 aa, Mycobacterium
TPGELLGCVSGELGLRRYLEAHGHE

SEQ ID NO: 739501 - protein, 17 aa, Mycobacterium
TPGERLLGLDLANGGHL

SEQ ID NO: 739502 - protein, 30 aa, Mycobacterium
TPGEVIELGDWVRPVLLDGLAVLLLEPPRG

SEQ ID NO: 739503 - protein, 17 aa, Mycobacterium
TPGGAWIATRYDDCYEI

SEQ ID NO: 739504 - protein, 21 aa, Mycobacterium
TPGGCGFQFDPPRYLRPGDVI

SEQ ID NO: 739505 - protein, 17 aa, Mycobacterium
TPGGWLLTAARNRARDR

SEQ ID NO: 739506 - protein, 21 aa, Mycobacterium
TPGHPEFRHTKGVEITTGPLG

SEQ ID NO: 739507 - protein, 23 aa, Mycobacterium
TPGHPEFRHTPGVEITTGPLGQG

SEQ ID NO: 739508 - protein, 19 aa, Mycobacterium
TPGHPEFRHTRGVEITTGP

SEQ ID NO: 739509 - protein, 17 aa, Mycobacterium
TPGHSGGHCSFLVAGHV

SEQ ID NO: 739510 - protein, 23 aa, Mycobacterium
TPGHTKGSVVFRVEQGPDQVAFT

SEQ ID NO: 739511 - protein, 30 aa, Mycobacterium
TPGKCNQLFCPVCALAALVEGEHHPLLATI

SEQ ID NO: 739512 - protein, 21 aa, Mycobacterium
TPGKPALLRPALDDDSHPTGP

SEQ ID NO: 739513 - protein, 20 aa, Mycobacterium
TPGLDLRAGIVRQLKGLGVA

SEQ ID NO: 739514 - protein, 22 aa, Mycobacterium
TPGLPPWPGMDGFTGQLLHAAD

SEQ ID NO: 739515 - protein, 18 aa, Mycobacterium
TPGLSFGAPERKMGWHAQ

SEQ ID NO: 739516 - protein, 18 aa, Mycobacterium
TPGNKAWHSPRCRSTADG

SEQ ID NO: 739517 - protein, 22 aa, Mycobacterium
TPGPRADFLAALSAQMRPGDSL

SEQ ID NO: 739518 - protein, 25 aa, Mycobacterium
TPGPRAEFLAGLAAVMRPGDSLLLG

SEQ ID NO: 739519 - protein, 19 aa, Mycobacterium
TPGQPRLVAYYTTTIGGGG

SEQ ID NO: 739520 - protein, 18 aa, Mycobacterium
TPGQRLLVFLPLAHVLAR

SEQ ID NO: 739521 - protein, 20 aa, Mycobacterium
TPGRLRTALDEGQVVLVAGF

SEQ ID NO: 739522 - protein, 18 aa, Mycobacterium
TPGRPCQPTTAAVGGAHT

SEQ ID NO: 739523 - protein, 17 aa, Mycobacterium
TPGSIALALDGAATGGV

SEQ ID NO: 739524 - protein, 26 aa, Mycobacterium
TPGSLDFNGVVFNQDFTHAMDTMYSA

SEQ ID NO: 739525 - protein, 17 aa, Mycobacterium
TPGSVALALAGADGADG

SEQ ID NO: 739526 - protein, 17 aa, Mycobacterium
TPGSVALALDGPATGGV

SEQ ID NO: 739527 - protein, 18 aa, Mycobacterium
TPGSVALALGGPATDDRV

SEQ ID NO: 739528 - protein, 18 aa, Mycobacterium
TPGSVSFDGLKVGDEIPV

SEQ ID NO: 739529 - protein, 19 aa, Mycobacterium
TPGSWRREPIAGIPASTNT

SEQ ID NO: 739530 - protein, 21 aa, Mycobacterium
TPGTGRRARALLRELAAAGLG

SEQ ID NO: 739531 - protein, 26 aa, Mycobacterium
TPGTPWGPPWSTMWLHVTGTVPPSWR

SEQ ID NO: 739532 - protein, 25 aa, Mycobacterium
TPGVPGMPAPGVYGHSFGSGPRYGF

SEQ ID NO: 739533 - protein, 18 aa, Mycobacterium
TPGYCYQDSLGPGPDNLA

SEQ ID NO: 739534 - protein, 19 aa, Mycobacterium
TPHAGEFARLAGGPPGPDR

SEQ ID NO: 739535 - protein, 19 aa, Mycobacterium
TPHAGEFARLAGSSPGAER

SEQ ID NO: 739536 - protein, 20 aa, Mycobacterium
TPHALMRLEIESVVVADSTG

SEQ ID NO: 739537 - protein, 25 aa, Mycobacterium
TPHCAAVGRISYLLGLRGPAVAVDT

SEQ ID NO: 739538 - protein, 17 aa, Mycobacterium
TPHCPTCGERIARQTPQ

SEQ ID NO: 739539 - protein, 17 aa, Mycobacterium
TPHCPVCGERIAKQTPQ

SEQ ID NO: 739540 - protein, 20 aa, Mycobacterium
TPHFDGYPAVLVNLAEISVR

SEQ ID NO: 739541 - protein, 19 aa, Mycobacterium
TPHFDGYPAVLVVLSEIEA

SEQ ID NO: 739542 - protein, 26 aa, Mycobacterium
TPHFDGYPVVLVRLGAISVRGLEELI

SEQ ID NO: 739543 - protein, 17 aa, Mycobacterium
TPHPTVWMGGDADAVLR

SEQ ID NO: 739544 - protein, 19 aa, Mycobacterium
TPHTPRLTPTQVLTPPAAP

SEQ ID NO: 739545 - protein, 27 aa, Mycobacterium
TPHVWALGDVAAWAGADGRPNRVEHWS

SEQ ID NO: 739546 - protein, 23 aa, Mycobacterium
TPIDTVLTARGWLREAEGRKAFV

SEQ ID NO: 739547 - protein, 25 aa, Mycobacterium
TPIDVEVPFDMMLAGRIVRGRIDAI

SEQ ID NO: 739548 - protein, 18 aa, Mycobacterium
TPIESYPPISRGVSKIVG

SEQ ID NO: 739549 - protein, 17 aa, Mycobacterium
TPIEYERSFTKYTLTAV

SEQ ID NO: 739550 - protein, 17 aa, Mycobacterium
TPIGAGCRVCERDNCPQ

SEQ ID NO: 739551 - protein, 21 aa, Mycobacterium
TPIGTLAVLYAFTELRGGLTG

SEQ ID NO: 739552 - protein, 20 aa, Mycobacterium
TPIKMLLRLALDVGSEVLYR

SEQ ID NO: 739553 - protein, 20 aa, Mycobacterium
TPILSELRRPLAALAAGLLP

SEQ ID NO: 739554 - protein, 25 aa, Mycobacterium
TPIMPPKMLHMILPRADYQIVEDSW

SEQ ID NO: 739555 - protein, 22 aa, Mycobacterium
TPIPGDLCWFSFDSDDLGNPAY

SEQ ID NO: 739556 - protein, 17 aa, Mycobacterium
TPIPRLPQYLAESRGLG

SEQ ID NO: 739557 - protein, 18 aa, Mycobacterium
TPIPRTVALTVYGDLETA

SEQ ID NO: 739558 - protein, 18 aa, Mycobacterium
TPIPRTVALTVYGDLETS

SEQ ID NO: 739559 - protein, 28 aa, Mycobacterium
TPITDGRWSCVRWGTLTPPFYPEAEATP

SEQ ID NO: 739560 - protein, 18 aa, Mycobacterium
TPIWGGWITGPTVLGPDE

SEQ ID NO: 739561 - protein, 23 aa, Mycobacterium
TPKAKALLAKRGFDPVLGARPLR

SEQ ID NO: 739562 - protein, 23 aa, Mycobacterium
TPKATPRPTLWPDPAHPPDYGND

SEQ ID NO: 739563 - protein, 22 aa, Mycobacterium
TPKGALVHRLIRAGGALFTAHT

SEQ ID NO: 739564 - protein, 23 aa, Mycobacterium
TPKGALVHRMIRTGRSLFTAHTN

SEQ ID NO: 739565 - protein, 22 aa, Mycobacterium
TPKGAPRKLALTLAPVGGMFSH

SEQ ID NO: 739566 - protein, 24 aa, Mycobacterium
TPKHCQRLLFSATLDAGVDVLVKR

SEQ ID NO: 739567 - protein, 22 aa, Mycobacterium
TPKIRTGYNLPISHVGGPRAER

SEQ ID NO: 739568 - protein, 22 aa, Mycobacterium
TPKIRTGYNLPISHVRGPATEM

SEQ ID NO: 739569 - protein, 21 aa, Mycobacterium
TPKLRARELLTGWERNRRGIY

SEQ ID NO: 739570 - protein, 21 aa, Mycobacterium
TPKLRARQLISQWEQRRRGIY

SEQ ID NO: 739571 - protein, 19 aa, Mycobacterium
TPKPLKGMPPFSGPQGPFA

SEQ ID NO: 739572 - protein, 23 aa, Mycobacterium
TPKRFPSYYLQQGSFGLTQSQNE

SEQ ID NO: 739573 - protein, 17 aa, Mycobacterium
TPKRPKPASSHDAGPAA

SEQ ID NO: 739574 - protein, 23 aa, Mycobacterium
TPKTVGRWSGMRALATAETFPAD

SEQ ID NO: 739575 - protein, 19 aa, Mycobacterium
TPLAAVCSGLKSAAAAFTS

SEQ ID NO: 739576 - protein, 24 aa, Mycobacterium
TPLAERARKIWAALRQASNVELGG

SEQ ID NO: 739577 - protein, 26 aa, Mycobacterium
TPLARLYSWHRAMRIFDGPDEVHLRS

SEQ ID NO: 739578 - protein, 27 aa, Mycobacterium
TPLARLYSWHRAMRIFDGPDEVHMRSI

SEQ ID NO: 739579 - protein, 25 aa, Mycobacterium
TPLARVFWPRTRIVVSQDTVQLWGA

SEQ ID NO: 739580 - protein, 22 aa, Mycobacterium
TPLDAARIAAVYSEYESLKVRD

SEQ ID NO: 739581 - protein, 27 aa, Mycobacterium
TPLDPWTWTALQRCISHRDTVGSNNSH

SEQ ID NO: 739582 - protein, 26 aa, Mycobacterium
TPLDRSRPLWEFHFAEGLAGGRFALV

SEQ ID NO: 739583 - protein, 26 aa, Mycobacterium
TPLDRTRPLWEFHFAEGLADGRFALI

SEQ ID NO: 739584 - protein, 27 aa, Mycobacterium
TPLDRTRPLWEFHFAEGMADNRFALIG

SEQ ID NO: 739585 - protein, 18 aa, Mycobacterium
TPLFEFAIRSALAEMDLD

SEQ ID NO: 739586 - protein, 18 aa, Mycobacterium
TPLFEFAIRSALAETDLN

SEQ ID NO: 739587 - protein, 18 aa, Mycobacterium
TPLFEFAIRTALAEMDLD

SEQ ID NO: 739588 - protein, 18 aa, Mycobacterium
TPLFEFAIRTALAESDLE

SEQ ID NO: 739589 - protein, 20 aa, Mycobacterium
TPLFEFVIRSALAEHDLDSA

SEQ ID NO: 739590 - protein, 27 aa, Mycobacterium
TPLFVMLLAECWRWGADEGAVRALLPA

SEQ ID NO: 739591 - protein, 24 aa, Mycobacterium
TPLGAREFQNFLLAKQREIATIVA

SEQ ID NO: 739592 - protein, 20 aa, Mycobacterium
TPLGLAERLEKAGVPIVGTK

SEQ ID NO: 739593 - protein, 17 aa, Mycobacterium
TPLGLHRVSGLAMDAVS

SEQ ID NO: 739594 - protein, 25 aa, Mycobacterium
TPLGSKMSRVFLRGALGARLLSEAA

SEQ ID NO: 739595 - protein, 19 aa, Mycobacterium
TPLHPRTRLVTARHAALYR

SEQ ID NO: 739596 - protein, 26 aa, Mycobacterium
TPLIKRWFRAEVRGLESFPPTGGVLL

SEQ ID NO: 739597 - protein, 17 aa, Mycobacterium
TPLKYRLAYTADLEATF

SEQ ID NO: 739598 - protein, 19 aa, Mycobacterium
TPLKYRLAYTADLEATFTP

SEQ ID NO: 739599 - protein, 18 aa, Mycobacterium
TPLLAGLLDKPTVAMGPA

SEQ ID NO: 739600 - protein, 29 aa, Mycobacterium
TPLMPPQMLHMILPRKDYEIVDDSWDVVG

SEQ ID NO: 739601 - protein, 23 aa, Mycobacterium
TPLPARLILRLLNFDESRFMDWV

SEQ ID NO: 739602 - protein, 24 aa, Mycobacterium
TPLPELRAANGLAPAAVDDDGPSV

SEQ ID NO: 739603 - protein, 27 aa, Mycobacterium
TPLPGPRSGALAERRRAAVSAGVGSTA

SEQ ID NO: 739604 - protein, 17 aa, Mycobacterium
TPLPLSFAQSRLWFIYK

SEQ ID NO: 739605 - protein, 17 aa, Mycobacterium
TPLPMLMPDGANQTAEG

SEQ ID NO: 739606 - protein, 18 aa, Mycobacterium
TPLPPGVVGSGIGASAGA

SEQ ID NO: 739607 - protein, 18 aa, Mycobacterium
TPLPRSALAAAVDVLDAA

SEQ ID NO: 739608 - protein, 18 aa, Mycobacterium
TPLPVLVAALGPVMLQIA

SEQ ID NO: 739609 - protein, 17 aa, Mycobacterium
TPLPYPAPENVAYIIYT

SEQ ID NO: 739610 - protein, 25 aa, Mycobacterium
TPLQPVDSTIVFRVLPHTPPVTQHI

SEQ ID NO: 739611 - protein, 20 aa, Mycobacterium
TPLQWPCPPDGASNRSPIRY

SEQ ID NO: 739612 - protein, 17 aa, Mycobacterium
TPLRGNELWQIALLELW

SEQ ID NO: 739613 - protein, 19 aa, Mycobacterium
TPLRPWRSALAAALAAACG

SEQ ID NO: 739614 - protein, 17 aa, Mycobacterium
TPLSMLALLGILREAGV

SEQ ID NO: 739615 - protein, 24 aa, Mycobacterium
TPLTAVACQALLERACADVGAPPA

SEQ ID NO: 739616 - protein, 25 aa, Mycobacterium
TPLTDLITWTGVWSGINGMPHGQFR

SEQ ID NO: 739617 - protein, 20 aa, Mycobacterium
TPLTNWQLQFDLPTNESVTN

SEQ ID NO: 739618 - protein, 25 aa, Mycobacterium
TPLTWPVGIAGDFKGVLDRRGGQFI

SEQ ID NO: 739619 - protein, 25 aa, Mycobacterium
TPLVDARAALAIAQRQRQTLGDIEQ

SEQ ID NO: 739620 - protein, 21 aa, Mycobacterium
TPLVECGRVPAMVTLTYPGEW

SEQ ID NO: 739621 - protein, 23 aa, Mycobacterium
TPLYGGDVSQLWEFVPIAEADRP

SEQ ID NO: 739622 - protein, 31 aa, Mycobacterium
TPLYNASALWGRGLIGTTIFLVDYLINFFQY

SEQ ID NO: 739623 - protein, 24 aa, Mycobacterium
TPMDIPYPVLWRNLTEAVAGILSA

SEQ ID NO: 739624 - protein, 24 aa, Mycobacterium
TPMEIPYPVLWRNLTQVVASILEA

SEQ ID NO: 739625 - protein, 18 aa, Mycobacterium
TPMEKMAALKPAFKEDGV

SEQ ID NO: 739626 - protein, 22 aa, Mycobacterium
TPMGRPILCTEYMARPRGSTVQ

SEQ ID NO: 739627 - protein, 18 aa, Mycobacterium
TPMGSSLANGGRPYPKAF

SEQ ID NO: 739628 - protein, 18 aa, Mycobacterium
TPMGSSLANGGRPYSQTF

SEQ ID NO: 739629 - protein, 19 aa, Mycobacterium
TPMLRKAEQRGFLGDTEQQ

SEQ ID NO: 739630 - protein, 22 aa, Mycobacterium
TPMPAYRFPGLVPGDRWCVTAL

SEQ ID NO: 739631 - protein, 30 aa, Mycobacterium
TPMPFAGPLFRFALFRTRADQFHLFACCHH

SEQ ID NO: 739632 - protein, 28 aa, Mycobacterium
TPNACPYLPSINPGVNFFLGQPTVTVLS

SEQ ID NO: 739633 - protein, 19 aa, Mycobacterium
TPNAPTWPGRDVRGQIVEL

SEQ ID NO: 739634 - protein, 23 aa, Mycobacterium
TPNELLKPLPLVPYTPKWLARKM

SEQ ID NO: 739635 - protein, 17 aa, Mycobacterium
TPNEPPTGWALATPQQP

SEQ ID NO: 739636 - protein, 33 aa, Mycobacterium
TPNEVGGLFGLFRMGLPTNFGLSGYSGGLTYLY

SEQ ID NO: 739637 - protein, 28 aa, Mycobacterium
TPNGGIFTRFPGFHIPVLDLTFTPDTPP

SEQ ID NO: 739638 - protein, 18 aa, Mycobacterium
TPNIPVPYVYPVDLRYLL

SEQ ID NO: 739639 - protein, 23 aa, Mycobacterium
TPNPAWLTRCAEINRHANDAVRG

SEQ ID NO: 739640 - protein, 33 aa, Mycobacterium
TPNPCIRCNQRIKFSALYAKALALGFDVVVTGH

SEQ ID NO: 739641 - protein, 25 aa, Mycobacterium
TPNPKWLRRCADLNRHALAAVREQL

SEQ ID NO: 739642 - protein, 18 aa, Mycobacterium
TPNVCPALHMPLQSGSDP

SEQ ID NO: 739643 - protein, 18 aa, Mycobacterium
TPNVCPALHMPLQSGSDR

SEQ ID NO: 739644 - protein, 29 aa, Mycobacterium
TPPALIKAILKAPVDLLWNGGIGTYIKAE

SEQ ID NO: 739645 - protein, 29 aa, Mycobacterium
TPPAVARFLARWVCEAGPRILEPSCGDGR

SEQ ID NO: 739646 - protein, 19 aa, Mycobacterium
TPPCVNALLEAKVATVVYA

SEQ ID NO: 739647 - protein, 25 aa, Mycobacterium
TPPDADGWCSLSLHAGGTVEELRRA

SEQ ID NO: 739648 - protein, 23 aa, Mycobacterium
TPPDLKESFSLGADDATGDPEVD

SEQ ID NO: 739649 - protein, 22 aa, Mycobacterium
TPPDLKESFSLGAETATGDAEV

SEQ ID NO: 739650 - protein, 25 aa, Mycobacterium
TPPDPQWPGGAAIAVQFVLNYEEGA

SEQ ID NO: 739651 - protein, 20 aa, Mycobacterium
TPPEGSTWPSANPLVNLAVG

SEQ ID NO: 739652 - protein, 19 aa, Mycobacterium
TPPELSIRFLQRISAPTEL

SEQ ID NO: 739653 - protein, 17 aa, Mycobacterium
TPPFRRMAKPVLAAING

SEQ ID NO: 739654 - protein, 19 aa, Mycobacterium
TPPGLRSQQLIDMLNSNWP

SEQ ID NO: 739655 - protein, 26 aa, Mycobacterium
TPPGPDGWCSLSLHAGGTIGELRRAG

SEQ ID NO: 739656 - protein, 17 aa, Mycobacterium
TPPGSALYYGYDIIADL

SEQ ID NO: 739657 - protein, 24 aa, Mycobacterium
TPPGWRTDFLTQMGLTVLQVPALI

SEQ ID NO: 739658 - protein, 18 aa, Mycobacterium
TPPHPEWIVSESTPTPMW

SEQ ID NO: 739659 - protein, 18 aa, Mycobacterium
TPPKARNPLAAGMPAGFP

SEQ ID NO: 739660 - protein, 17 aa, Mycobacterium
TPPKVKSPFGMPGMPGM

SEQ ID NO: 739661 - protein, 19 aa, Mycobacterium
TPPMLGVFRPKRWPMKTTP

SEQ ID NO: 739662 - protein, 25 aa, Mycobacterium
TPPMPYAGGGWVVWERRDSTDSADS

SEQ ID NO: 739663 - protein, 18 aa, Mycobacterium
TPPPLSIRFADRISAPTR

SEQ ID NO: 739664 - protein, 18 aa, Mycobacterium
TPPPPRPAGTAPVIDQGV

SEQ ID NO: 739665 - protein, 18 aa, Mycobacterium
TPPPVLHQWQDLAEQVRE

SEQ ID NO: 739666 - protein, 25 aa, Mycobacterium
TPPQRWLDTVAETWTTPKADLGRRL

SEQ ID NO: 739667 - protein, 22 aa, Mycobacterium
TPPRFADRFEHVYGRHDGFRRN

SEQ ID NO: 739668 - protein, 17 aa, Mycobacterium
TPPRISFSTPYNLACDF

SEQ ID NO: 739669 - protein, 18 aa, Mycobacterium
TPPRLAVIAMGKCGAREL

SEQ ID NO: 739670 - protein, 18 aa, Mycobacterium
TPPRWRRIADGLMHTKTR

SEQ ID NO: 739671 - protein, 23 aa, Mycobacterium
TPPSHLFPAEFAERAKTLGEQAG

SEQ ID NO: 739672 - protein, 26 aa, Mycobacterium
TPPSHLFPAEFAKRAKALATAEGIEV

SEQ ID NO: 739673 - protein, 25 aa, Mycobacterium
TPPSHLFPAEFAKRARSLGESVGLE

SEQ ID NO: 739674 - protein, 25 aa, Mycobacterium
TPPYFGGADWLWKPISSNPALAANS

SEQ ID NO: 739675 - protein, 18 aa, Mycobacterium
TPQAVTFRPDLRVPLITI

SEQ ID NO: 739676 - protein, 18 aa, Mycobacterium
TPQEIFLTLKVAASEFAY

SEQ ID NO: 739677 - protein, 19 aa, Mycobacterium
TPQEIRAAIHLVTDKEPNP

SEQ ID NO: 739678 - protein, 26 aa, Mycobacterium
TPQEISARVLMKLKRDAESYLGEDIT

SEQ ID NO: 739679 - protein, 23 aa, Mycobacterium
TPQFEVADPIPLGTLPAPNPGDV

SEQ ID NO: 739680 - protein, 18 aa, Mycobacterium
TPQGFAGDLLRRAYQHAD

SEQ ID NO: 739681 - protein, 17 aa, Mycobacterium
TPQGRPVLVQAGSSEQG

SEQ ID NO: 739682 - protein, 25 aa, Mycobacterium
TPQNFWPVYGSMSFDESTVAGLAAL

SEQ ID NO: 739683 - protein, 17 aa, Mycobacterium
TPQNSPVGFTFNEQLGT

SEQ ID NO: 739684 - protein, 21 aa, Mycobacterium
TPQRPRLVVHRSARHIHVQLV

SEQ ID NO: 739685 - protein, 24 aa, Mycobacterium
TPQSRIPTLLWAREIPVEGEPADV

SEQ ID NO: 739686 - protein, 26 aa, Mycobacterium
TPQSRLAERTGWSVARVRRRLAALEA

SEQ ID NO: 739687 - protein, 17 aa, Mycobacterium
TPQVDWSAGTVRLLTET

SEQ ID NO: 739688 - protein, 24 aa, Mycobacterium
TPRAIRRLCAIAAFDDIDELEESV

SEQ ID NO: 739689 - protein, 22 aa, Mycobacterium
TPRAVKTFFRRVPLAQRLLQEG

SEQ ID NO: 739690 - protein, 23 aa, Mycobacterium
TPRDVCYLSMPLFHSNAVLAGWS

SEQ ID NO: 739691 - protein, 17 aa, Mycobacterium
TPREVDELLAYLRPRAV

SEQ ID NO: 739692 - protein, 17 aa, Mycobacterium
TPRGAVFATEIAAADGT

SEQ ID NO: 739693 - protein, 18 aa, Mycobacterium
TPRGAVFATEIAAARGTV

SEQ ID NO: 739694 - protein, 24 aa, Mycobacterium
TPRGRVRCAARISGIRDGVLFVPF

SEQ ID NO: 739695 - protein, 21 aa, Mycobacterium
TPRIDHDLVWAAKRGALELLW

SEQ ID NO: 739696 - protein, 20 aa, Mycobacterium
TPRILRLGPVSAERIAEVLG

SEQ ID NO: 739697 - protein, 19 aa, Mycobacterium
TPRILRPGPVSAERIAEVL

SEQ ID NO: 739698 - protein, 23 aa, Mycobacterium
TPRLLCASCALTAERPNDADAVG

SEQ ID NO: 739699 - protein, 21 aa, Mycobacterium
TPRLREFALREGLADAQQRIA

SEQ ID NO: 739700 - protein, 18 aa, Mycobacterium
TPRPELPGFGAPWGEPTT

SEQ ID NO: 739701 - protein, 19 aa, Mycobacterium
TPRPERFDWSAAEEQVADI

SEQ ID NO: 739702 - protein, 20 aa, Mycobacterium
TPRPRLPGVGTPWGTGSTIE

SEQ ID NO: 739703 - protein, 25 aa, Mycobacterium
TPRPRVAPTKAWRKMFGENFFYILY

SEQ ID NO: 739704 - protein, 18 aa, Mycobacterium
TPRPSWRATATALIDAIV

SEQ ID NO: 739705 - protein, 21 aa, Mycobacterium
TPRQFRWVWRLLFPGYPRPSG

SEQ ID NO: 739706 - protein, 20 aa, Mycobacterium
TPRQLWAFYRAIRAFAKSRP

SEQ ID NO: 739707 - protein, 26 aa, Mycobacterium
TPRQRLAIEFAERFAIDHASLDDAFF

SEQ ID NO: 739708 - protein, 22 aa, Mycobacterium
TPRQSLREFLGPMVTGLDDYPF

SEQ ID NO: 739709 - protein, 20 aa, Mycobacterium
TPRRALDDVVQWSRQTDRPL

SEQ ID NO: 739710 - protein, 17 aa, Mycobacterium
TPRSARPRRYLMTAPQF

SEQ ID NO: 739711 - protein, 23 aa, Mycobacterium
TPRSGVVVIRLNRPERLNAINDA

SEQ ID NO: 739712 - protein, 24 aa, Mycobacterium
TPRSPKWVERFGNTRYPRRLHPSA

SEQ ID NO: 739713 - protein, 20 aa, Mycobacterium
TPRSVAFNVQGFRVAVNPET

SEQ ID NO: 739714 - protein, 20 aa, Mycobacterium
TPRSVSFNVHAFRVAVNTDT

SEQ ID NO: 739715 - protein, 25 aa, Mycobacterium
TPRTEFRLPVLHATDYPRLPVMGSE

SEQ ID NO: 739716 - protein, 27 aa, Mycobacterium
TPRVREIFAEAGIRIPTQDDWRRLKES

SEQ ID NO: 739717 - protein, 19 aa, Mycobacterium
TPRWGRWRDAVGVGEHEAD

SEQ ID NO: 739718 - protein, 28 aa, Mycobacterium
TPRYAVGCKRPGFHNGYLATFNRDNVRL

SEQ ID NO: 739719 - protein, 26 aa, Mycobacterium
TPRYAVGCKRPGFHNSYLSTFNRDNV

SEQ ID NO: 739720 - protein, 24 aa, Mycobacterium
TPRYRRIGHRFGMIAHEQGICGCH

SEQ ID NO: 739721 - protein, 25 aa, Mycobacterium
TPSESRLAAEIIERVPPVERVRLVN

SEQ ID NO: 739722 - protein, 19 aa, Mycobacterium
TPSGYRLDGVKSLVPAAAD

SEQ ID NO: 739723 - protein, 18 aa, Mycobacterium
TPSGYRLDGVKSLVPAAT

SEQ ID NO: 739724 - protein, 24 aa, Mycobacterium
TPSGYRLSGVKSLVPAAADAELFI

SEQ ID NO: 739725 - protein, 21 aa, Mycobacterium
TPSKGAWQFIAPTFARYHQPG

SEQ ID NO: 739726 - protein, 25 aa, Mycobacterium
TPSKPLRRSWLDELLARRPTLVVID

SEQ ID NO: 739727 - protein, 19 aa, Mycobacterium
TPSLLAMVPGLPPLPNFSF

SEQ ID NO: 739728 - protein, 23 aa, Mycobacterium
TPSLWPKLAAVLVAETPVRGAMG

SEQ ID NO: 739729 - protein, 25 aa, Mycobacterium
TPSLWVPDLFMLRQIHRTPRLSVNS

SEQ ID NO: 739730 - protein, 24 aa, Mycobacterium
TPSPLEWDCFRFSIIQRADHFTFC

SEQ ID NO: 739731 - protein, 22 aa, Mycobacterium
TPSPMSGMGIAQPPTMMTAGAA

SEQ ID NO: 739732 - protein, 18 aa, Mycobacterium
TPSPRSDAVLVFSSGTTG

SEQ ID NO: 739733 - protein, 24 aa, Mycobacterium
TPSQEFYDLIVIGGGPAGLAAAVY

SEQ ID NO: 739734 - protein, 26 aa, Mycobacterium
TPSQLALAWLLKRSPAMLPIPGTSSV

SEQ ID NO: 739735 - protein, 24 aa, Mycobacterium
TPSRAELLAALSIAIDLGLGQPAE

SEQ ID NO: 739736 - protein, 24 aa, Mycobacterium
TPSRREFQRTPGLNGPAVSRAWNH

SEQ ID NO: 739737 - protein, 24 aa, Mycobacterium
TPSRREFQRTPGLNGQAVSRAWAH

SEQ ID NO: 739738 - protein, 25 aa, Mycobacterium
TPSSAAQVLAGWQTWLAAADRDTWG

SEQ ID NO: 739739 - protein, 22 aa, Mycobacterium
TPSSLPISFALLNNSMNPMRPR

SEQ ID NO: 739740 - protein, 17 aa, Mycobacterium
TPSSWGAGVREFANAAA

SEQ ID NO: 739741 - protein, 18 aa, Mycobacterium
TPSVPGHELSGVVVELGY

SEQ ID NO: 739742 - protein, 17 aa, Mycobacterium
TPSYMLTLLDAMDRVGI

SEQ ID NO: 739743 - protein, 18 aa, Mycobacterium
TPTAFHIWRAFARYSPVL

SEQ ID NO: 739744 - protein, 18 aa, Mycobacterium
TPTEWSMLAVLVRNRGKL

SEQ ID NO: 739745 - protein, 27 aa, Mycobacterium
TPTGEVWPGRAYPLGATYDGMGTNFAI

SEQ ID NO: 739746 - protein, 31 aa, Mycobacterium
TPTGLLLARRGREIIDRMAAVEAELRELSDE

SEQ ID NO: 739747 - protein, 20 aa, Mycobacterium
TPTGPWLRTGDLGFVSGGEL

SEQ ID NO: 739748 - protein, 17 aa, Mycobacterium
TPTHQRGAVLLAAAQIV

SEQ ID NO: 739749 - protein, 20 aa, Mycobacterium
TPTHVAAAFDVSRQTFRSER

SEQ ID NO: 739750 - protein, 19 aa, Mycobacterium
TPTIPGLNLAPIFENDITY

SEQ ID NO: 739751 - protein, 19 aa, Mycobacterium
TPTIQRIRLGADHDGRITA

SEQ ID NO: 739752 - protein, 25 aa, Mycobacterium
TPTLERIAGAGLRYNQFHTTALCSP

SEQ ID NO: 739753 - protein, 26 aa, Mycobacterium
TPTLEVWPGRAYPLGATYDGAGTNFA

SEQ ID NO: 739754 - protein, 18 aa, Mycobacterium
TPTLLAMTAAGLDYVSGG

SEQ ID NO: 739755 - protein, 22 aa, Mycobacterium
TPTLLFPFAAPKVVGDLSEAGS

SEQ ID NO: 739756 - protein, 23 aa, Mycobacterium
TPTLRELGEFAVIDRLVQGRNQP

SEQ ID NO: 739757 - protein, 25 aa, Mycobacterium
TPTLRYCTIHGYRRAYRIAGSGPAI

SEQ ID NO: 739758 - protein, 26 aa, Mycobacterium
TPTPCGVCDSCVALAPNGPGNVDVVE

SEQ ID NO: 739759 - protein, 17 aa, Mycobacterium
TPTPGFGRVSRVRLQVS

SEQ ID NO: 739760 - protein, 25 aa, Mycobacterium
TPTPVPRPAMPIPTVPMRVPETPAL

SEQ ID NO: 739761 - protein, 24 aa, Mycobacterium
TPTQAIFGRPLIGDGANGTATSPN

SEQ ID NO: 739762 - protein, 24 aa, Mycobacterium
TPTRIVTCAGVGASGLLLEQSPAE

SEQ ID NO: 739763 - protein, 17 aa, Mycobacterium
TPTRTAVDIAQAMDAVG

SEQ ID NO: 739764 - protein, 23 aa, Mycobacterium
TPTRTQVPVTITFGADGVATQTI

SEQ ID NO: 739765 - protein, 23 aa, Mycobacterium
TPTRWADMLDELTAFIAEHGHAR

SEQ ID NO: 739766 - protein, 22 aa, Mycobacterium
TPTTAFRLGEKVDDPLSMYLFD

SEQ ID NO: 739767 - protein, 18 aa, Mycobacterium
TPTTMPWGNRALLFRDPD

SEQ ID NO: 739768 - protein, 25 aa, Mycobacterium
TPTVALPLFAGWRTMPLAGDAPARA

SEQ ID NO: 739769 - protein, 28 aa, Mycobacterium
TPTYKRGFGFHPMCAFVDHGPGGTGEPL

SEQ ID NO: 739770 - protein, 23 aa, Mycobacterium
TPTYLRYAIYPNIVVIRQDNGSG

SEQ ID NO: 739771 - protein, 18 aa, Mycobacterium
TPVAARFGGGGHRLAAGY

SEQ ID NO: 739772 - protein, 19 aa, Mycobacterium
TPVADWLGEHGWRASATTS

SEQ ID NO: 739773 - protein, 17 aa, Mycobacterium
TPVAISLFRDPQYVVAI

SEQ ID NO: 739774 - protein, 31 aa, Mycobacterium
TPVDAKVGWKGFHAIERDLWQGGTITAGTKA

SEQ ID NO: 739775 - protein, 17 aa, Mycobacterium
TPVDGWAAGETRPGFDQ

SEQ ID NO: 739776 - protein, 17 aa, Mycobacterium
TPVEAIGVDLVYGADTG

SEQ ID NO: 739777 - protein, 26 aa, Mycobacterium
TPVGDRLRIAGMMEFRAVDAPLDPRR

SEQ ID NO: 739778 - protein, 19 aa, Mycobacterium
TPVGPWITTRDEFGGSGQI

SEQ ID NO: 739779 - protein, 22 aa, Mycobacterium
TPVHGIMGFRLLVGPHKIGALN

SEQ ID NO: 739780 - protein, 21 aa, Mycobacterium
TPVKALVCGGIGTGKTSLLIA

SEQ ID NO: 739781 - protein, 17 aa, Mycobacterium
TPVLAIAGAEDWVTPPE

SEQ ID NO: 739782 - protein, 18 aa, Mycobacterium
TPVLDWITGTALTQVRSR

SEQ ID NO: 739783 - protein, 17 aa, Mycobacterium
TPVLPWVDVASGSLGQG

SEQ ID NO: 739784 - protein, 25 aa, Mycobacterium
TPVPEYRFPGLLPGDRWCVTALNWL

SEQ ID NO: 739785 - protein, 25 aa, Mycobacterium
TPVPEYRFPGLLPGDRWCVTAMNWL

SEQ ID NO: 739786 - protein, 24 aa, Mycobacterium
TPVPEYRFPGLLPGDRWCVVAVNW

SEQ ID NO: 739787 - protein, 26 aa, Mycobacterium
TPVPKREWKEVVLLAGGRSDVAVVCL

SEQ ID NO: 739788 - protein, 28 aa, Mycobacterium
TPVPNKNIRLVIEWLDRYAEALPLTVIG

SEQ ID NO: 739789 - protein, 17 aa, Mycobacterium
TPVPPGRTRDIQVVLQG

SEQ ID NO: 739790 - protein, 17 aa, Mycobacterium
TPVPPSGQWDRSSPAPA

SEQ ID NO: 739791 - protein, 31 aa, Mycobacterium
TPVRGAMGFRLLVDKRKGAALNLFSDTPNVF

SEQ ID NO: 739792 - protein, 31 aa, Mycobacterium
TPVRGAMGFRLLVDKRKGAALNLFSETPNSF

SEQ ID NO: 739793 - protein, 29 aa, Mycobacterium
TPVSGAPVWFVPEAFEFVLRAANDPEHPY

SEQ ID NO: 739794 - protein, 24 aa, Mycobacterium
TPVTPRPVPPVTPGKPVTPIPPVT

SEQ ID NO: 739795 - protein, 26 aa, Mycobacterium
TPVTTPPTTMAPVTTTVAPTTVPPTT

SEQ ID NO: 739796 - protein, 24 aa, Mycobacterium
TPVVWRGPMLHRALQQFLADVYWG

SEQ ID NO: 739797 - protein, 25 aa, Mycobacterium
TPVVWRGPMLHRALQQFLADVYWGD

SEQ ID NO: 739798 - protein, 21 aa, Mycobacterium
TPWDRTWTIAALRGVRARRRG

SEQ ID NO: 739799 - protein, 18 aa, Mycobacterium
TPWGEFFNPEMAPLPAHV

SEQ ID NO: 739800 - protein, 24 aa, Mycobacterium
TPWGRGRPGWHLECSAMARTYLGA

SEQ ID NO: 739801 - protein, 25 aa, Mycobacterium
TPWGRGRPGWHLECSAMARTYLGAQ

SEQ ID NO: 739802 - protein, 24 aa, Mycobacterium
TPWGRGRPGWHLECSAMARTYLGP

SEQ ID NO: 739803 - protein, 24 aa, Mycobacterium
TPWGRGRPGWHLECSAMARTYLGS

SEQ ID NO: 739804 - protein, 18 aa, Mycobacterium
TPWMKWLLRAGPADYALA

SEQ ID NO: 739805 - protein, 17 aa, Mycobacterium
TPWNFPAAMATRKIAPA

SEQ ID NO: 739806 - protein, 25 aa, Mycobacterium
TPWNFPMTIASWGFAPALAAGNAVL

SEQ ID NO: 739807 - protein, 17 aa, Mycobacterium
TPWNGATILSWRAALSP

SEQ ID NO: 739808 - protein, 28 aa, Mycobacterium
TPWPRFAEAAVKLGVRSMLSFQLFTFGE

SEQ ID NO: 739809 - protein, 18 aa, Mycobacterium
TPWRARQAGALLAADVNG

SEQ ID NO: 739810 - protein, 19 aa, Mycobacterium
TPYAAPRTRQHIFLASANR

SEQ ID NO: 739811 - protein, 26 aa, Mycobacterium
TPYAVVTVCRRLWRGNLEAVRELADK

SEQ ID NO: 739812 - protein, 31 aa, Mycobacterium
TPYCALACAELLYRAGLPRALYAVVPGPGSV

SEQ ID NO: 739813 - protein, 19 aa, Mycobacterium
TPYEIRLQLVTDTISAHSK

SEQ ID NO: 739814 - protein, 21 aa, Mycobacterium
TPYELMKLRLLNASHQALCYF

SEQ ID NO: 739815 - protein, 26 aa, Mycobacterium
TPYPPARLEKLWLPGVDRLLDCVERA

SEQ ID NO: 739816 - protein, 17 aa, Mycobacterium
TPYQLKPHRSAVRPGFD

SEQ ID NO: 739817 - protein, 29 aa, Mycobacterium
TPYQYRITPRYEIPCTVTGTVTVGETVHP

SEQ ID NO: 739818 - protein, 24 aa, Mycobacterium
TPYREMMGPFVSVYARCYLGLAAK

SEQ ID NO: 739819 - protein, 17 aa, Mycobacterium
TPYRTLLALLLKYMSSA

SEQ ID NO: 739820 - protein, 25 aa, Mycobacterium
TPYSCTAGFCGTCETKVLAGEVDHR

SEQ ID NO: 739821 - protein, 19 aa, Mycobacterium
TPYVTPLVRKLAEENNIDL

SEQ ID NO: 739822 - protein, 18 aa, Mycobacterium
TQAAALCPDGVGLLAGAT

SEQ ID NO: 739823 - protein, 18 aa, Mycobacterium
TQAAGWKHLDLGWVDVTV

SEQ ID NO: 739824 - protein, 25 aa, Mycobacterium
TQACGDCPRVILGSPLAGESLDEVL

SEQ ID NO: 739825 - protein, 24 aa, Mycobacterium
TQAFPHVYCELDFTNPLELTVATI

SEQ ID NO: 739826 - protein, 20 aa, Mycobacterium
TQAHFERLCGLVGREDLIND

SEQ ID NO: 739827 - protein, 20 aa, Mycobacterium
TQAIFGRPLIGDGAAGTATD

SEQ ID NO: 739828 - protein, 25 aa, Mycobacterium
TQAILGRPLIGNGSNGTYPGQDGRD

SEQ ID NO: 739829 - protein, 17 aa, Mycobacterium
TQAKLLQAARCPTQARD

SEQ ID NO: 739830 - protein, 25 aa, Mycobacterium
TQALERLETLLALIEGWVQTVVTDA

SEQ ID NO: 739831 - protein, 25 aa, Mycobacterium
TQALERLETLLALIEGWVQVVVAAA

SEQ ID NO: 739832 - protein, 25 aa, Mycobacterium
TQALERLETLLALIEGWVQVVVTAA

SEQ ID NO: 739833 - protein, 22 aa, Mycobacterium
TQALFGRPLIGNGANGTATSPN

SEQ ID NO: 739834 - protein, 20 aa, Mycobacterium
TQALKFPLTHMPTGPGEVWT

SEQ ID NO: 739835 - protein, 24 aa, Mycobacterium
TQALLGRPLIGNGANAAPGSGANG

SEQ ID NO: 739836 - protein, 18 aa, Mycobacterium
TQALREGRLSVDQVGVIA

SEQ ID NO: 739837 - protein, 20 aa, Mycobacterium
TQALRGWQRKALVKYLTTKP

SEQ ID NO: 739838 - protein, 17 aa, Mycobacterium
TQAPPAMRLCHHLHGGM

SEQ ID NO: 739839 - protein, 24 aa, Mycobacterium
TQAPSAEEIVAWCRERLAHFKCPR

SEQ ID NO: 739840 - protein, 18 aa, Mycobacterium
TQASSGWYHDPRTGEYRL

SEQ ID NO: 739841 - protein, 23 aa, Mycobacterium
TQAWKRERLAATGIDIPATATLV

SEQ ID NO: 739842 - protein, 17 aa, Mycobacterium
TQAYLDMVFTYSNHLTL

SEQ ID NO: 739843 - protein, 34 aa, Mycobacterium
TQCHSSAFDFSVWEIFGAVLRGRRLLVVPESVAS

SEQ ID NO: 739844 - protein, 23 aa, Mycobacterium
TQCQQVLAGIGFTAEHPFHRFLA

SEQ ID NO: 739845 - protein, 19 aa, Mycobacterium
TQCRPELIERTFLACEGAP

SEQ ID NO: 739846 - protein, 20 aa, Mycobacterium
TQCRPELIERTFLACEGASK

SEQ ID NO: 739847 - protein, 20 aa, Mycobacterium
TQCRPELIERTFLACQGAPR

SEQ ID NO: 739848 - protein, 36 aa, Mycobacterium
TQDAFTISKIRIKVVLHQWPGINITVYDGDIGPWTI

SEQ ID NO: 739849 - protein, 19 aa, Mycobacterium
TQDARWFLLCGMDGVTVTT

SEQ ID NO: 739850 - protein, 26 aa, Mycobacterium
TQDILPPEVFEKLTPEYVAPVVAYLM

SEQ ID NO: 739851 - protein, 19 aa, Mycobacterium
TQDKAHWFFSLSPADRRDY

SEQ ID NO: 739852 - protein, 19 aa, Mycobacterium
TQDKVHWFFSLSPADRRDY

SEQ ID NO: 739853 - protein, 18 aa, Mycobacterium
TQDLDLSAFVLFSSAAGV

SEQ ID NO: 739854 - protein, 19 aa, Mycobacterium
TQDRMVFVEVMLERMDIPP

SEQ ID NO: 739855 - protein, 24 aa, Mycobacterium
TQDSGRVIGQWTVFPRVSAVHLYR

SEQ ID NO: 739856 - protein, 25 aa, Mycobacterium
TQDYEMMRIPTILARAQVAEAEADY

SEQ ID NO: 739857 - protein, 19 aa, Mycobacterium
TQEAFKRKWAPHVIEPEYL

SEQ ID NO: 739858 - protein, 23 aa, Mycobacterium
TQEKLYPGAIAFRDKVLAQDPAA

SEQ ID NO: 739859 - protein, 24 aa, Mycobacterium
TQEKSWKVKRIRNTPRVSLATCTM

SEQ ID NO: 739860 - protein, 24 aa, Mycobacterium
TQEVIPFADLNRPFGVAVDADGAV

SEQ ID NO: 739861 - protein, 20 aa, Mycobacterium
TQFAGCLDINASEKAARFIR

SEQ ID NO: 739862 - protein, 20 aa, Mycobacterium
TQFAGCLDINASEKAARFVR

SEQ ID NO: 739863 - protein, 22 aa, Mycobacterium
TQFDVLACRAVRGELRTPDITA

SEQ ID NO: 739864 - protein, 17 aa, Mycobacterium
TQFEVADVLPLTPLQQG

SEQ ID NO: 739865 - protein, 27 aa, Mycobacterium
TQFKEGDRLWLSWAMANRDPAVFPDPN

SEQ ID NO: 739866 - protein, 19 aa, Mycobacterium
TQFLHCNDVVPTIYQVVGI

SEQ ID NO: 739867 - protein, 17 aa, Mycobacterium
TQFPFLAPEDWNLPTGR

SEQ ID NO: 739868 - protein, 21 aa, Mycobacterium
TQGIMDWHFDFLKYPELAGKW

SEQ ID NO: 739869 - protein, 29 aa, Mycobacterium
TQGKVIPDLIAWWCARDGVRPDKSRNHKG

SEQ ID NO: 739870 - protein, 18 aa, Mycobacterium
TQGLLALVGVTHDDDHMK

SEQ ID NO: 739871 - protein, 24 aa, Mycobacterium
TQGLPRPPSVPVFDGDRITLQSVR

SEQ ID NO: 739872 - protein, 17 aa, Mycobacterium
TQHCPPWTLDSSATTTT

SEQ ID NO: 739873 - protein, 19 aa, Mycobacterium
TQHFARSLARRGVTRPISA

SEQ ID NO: 739874 - protein, 23 aa, Mycobacterium
TQHPRFATVTARDKAQAVAGLSA

SEQ ID NO: 739875 - protein, 23 aa, Mycobacterium
TQHPRIRADMAFHETPNGGAVWS

SEQ ID NO: 739876 - protein, 20 aa, Mycobacterium
TQHWRVASRLGVPGDDLLGV

SEQ ID NO: 739877 - protein, 18 aa, Mycobacterium
TQIATSFLERVVADERLR

SEQ ID NO: 739878 - protein, 23 aa, Mycobacterium
TQIFKAHIQVGAYDPNDPLLDEV

SEQ ID NO: 739879 - protein, 24 aa, Mycobacterium
TQIKGAAPDSVFYSGYYSEAAPFV

SEQ ID NO: 739880 - protein, 19 aa, Mycobacterium
TQIKIAIEKIFDVKVDSVN

SEQ ID NO: 739881 - protein, 19 aa, Mycobacterium
TQIKIAIEKIFKVKVDSVN

SEQ ID NO: 739882 - protein, 19 aa, Mycobacterium
TQIKIAIEKIFSVKVASVN

SEQ ID NO: 739883 - protein, 19 aa, Mycobacterium
TQIKIAIEQIFSVKVSSVN

SEQ ID NO: 739884 - protein, 22 aa, Mycobacterium
TQILLDRGRTVIAMDLRNDNTV

SEQ ID NO: 739885 - protein, 25 aa, Mycobacterium
TQIMRYRGYRSLTWALNGLLPGAEA

SEQ ID NO: 739886 - protein, 18 aa, Mycobacterium
TQIRLHHALRLLAEDRPV

SEQ ID NO: 739887 - protein, 22 aa, Mycobacterium
TQKEFLLRQQLAAIRKELGEGD

SEQ ID NO: 739888 - protein, 22 aa, Mycobacterium
TQKEFLLRQQLAAIRKELGEGE

SEQ ID NO: 739889 - protein, 22 aa, Mycobacterium
TQKEFLLRQQLAAIRKELGELG

SEQ ID NO: 739890 - protein, 22 aa, Mycobacterium
TQKKLAAAIDVWVHRYDPDAVR

SEQ ID NO: 739891 - protein, 32 aa, Mycobacterium
TQKVSALRSAHPVFRRRRFFNGRPVRRPGEPR

SEQ ID NO: 739892 - protein, 19 aa, Mycobacterium
TQLADLVLRGVLAGPRPAT

SEQ ID NO: 739893 - protein, 21 aa, Mycobacterium
TQLAGLPFSGPVGGVRVALID

SEQ ID NO: 739894 - protein, 21 aa, Mycobacterium
TQLAGLPFSGPVGGVRVALIE

SEQ ID NO: 739895 - protein, 18 aa, Mycobacterium
TQLARAGIERIHVVNRSL

SEQ ID NO: 739896 - protein, 18 aa, Mycobacterium
TQLATRCRRLFPDVYTER

SEQ ID NO: 739897 - protein, 23 aa, Mycobacterium
TQLEIPVRAAVAAAEHARSAGAV

SEQ ID NO: 739898 - protein, 33 aa, Mycobacterium; identical to SEQ ID NO: 85253

SEQ ID NO: 739899 - protein, 21 aa, Mycobacterium
TQLEVILPYFLHYADTEQRQR

SEQ ID NO: 739900 - protein, 22 aa, Mycobacterium
TQLEVILPYFLHYANAEQRERW

SEQ ID NO: 739901 - protein, 24 aa, Mycobacterium
TQLFDGDVLFLEWAADSAASRVDD

SEQ ID NO: 739902 - protein, 18 aa, Mycobacterium
TQLFLARGNWLARKLGLT

SEQ ID NO: 739903 - protein, 28 aa, Mycobacterium
TQLFRSTGIPVCLWFFAKDKKARSGQVL

SEQ ID NO: 739904 - protein, 37 aa, Mycobacterium
TQLGDLHWFYVYSGVMWACVFMRTGARRVHFGEVEKP

SEQ ID NO: 739905 - protein, 19 aa, Mycobacterium
TQLGPVISERARQRILNYV

SEQ ID NO: 739906 - protein, 20 aa, Mycobacterium
TQLIGNWRWSDAVFERSDID

SEQ ID NO: 739907 - protein, 25 aa, Mycobacterium
TQLKTSFKAGALIGRGSGEALQVSF

SEQ ID NO: 739908 - protein, 25 aa, Mycobacterium
TQLKTSFKAGALIGRGSGEAVQVSF

SEQ ID NO: 739909 - protein, 22 aa, Mycobacterium
TQLLPDPLDTVFLVNSGSEAGD

SEQ ID NO: 739910 - protein, 18 aa, Mycobacterium
TQLPQERLIVAVGAVAAM

SEQ ID NO: 739911 - protein, 26 aa, Mycobacterium
TQLRFPKRQGMRIDFILGSPAFAQRV

SEQ ID NO: 739912 - protein, 21 aa, Mycobacterium
TQLRIAHEMLDAMGMEAFAER

SEQ ID NO: 739913 - protein, 17 aa, Mycobacterium
TQLRMIQSQVLAKIAAA

SEQ ID NO: 739914 - protein, 22 aa, Mycobacterium
TQLRQGEKMILLFESANFDEKV

SEQ ID NO: 739915 - protein, 32 aa, Mycobacterium
TQLRTMGRLLGWRLGLDGVDPKGTVQLESAGS

SEQ ID NO: 739916 - protein, 17 aa, Mycobacterium
TQLSMSVGIGVGEVPPD

SEQ ID NO: 739917 - protein, 20 aa, Mycobacterium
TQLVSEEWMGPASAQMAEAA

SEQ ID NO: 739918 - protein, 25 aa, Mycobacterium
TQLWQLAFRLVCDFDGDLDTEKTPG

SEQ ID NO: 739919 - protein, 22 aa, Mycobacterium
TQMAAAVVKTKMAVNAAAQEVQ

SEQ ID NO: 739920 - protein, 25 aa, Mycobacterium
TQMANAAKPYLVWMRASAAQAEQAA

SEQ ID NO: 739921 - protein, 19 aa, Mycobacterium
TQMHWLWDRAHTRGLDLDH

SEQ ID NO: 739922 - protein, 17 aa, Mycobacterium
TQMLCIFIGGTETVPKI

SEQ ID NO: 739923 - protein, 19 aa, Mycobacterium
TQNFGWKDSVIPLEFNSGD

SEQ ID NO: 739924 - protein, 25 aa, Mycobacterium
TQNGLPFLARFAFGRRVAVLVHHCH

SEQ ID NO: 739925 - protein, 19 aa, Mycobacterium
TQNGLPFLSRLVHGRRAVV

SEQ ID NO: 739926 - protein, 19 aa, Mycobacterium
TQNGLPLGVQFVGKLGADG

SEQ ID NO: 739927 - protein, 18 aa, Mycobacterium
TQNIGNWALVISGPLFTA

SEQ ID NO: 739928 - protein, 18 aa, Mycobacterium
TQPAAAVCPIVEHTTAGR

SEQ ID NO: 739929 - protein, 18 aa, Mycobacterium
TQPAALYVWVMLLTVRGI

SEQ ID NO: 739930 - protein, 26 aa, Mycobacterium
TQPALAWRSEFGSVHYWDELLTTAAL

SEQ ID NO: 739931 - protein, 23 aa, Mycobacterium
TQPDPRFATLLQEQFGGANGELK

SEQ ID NO: 739932 - protein, 30 aa, Mycobacterium
TQPDQRWNAVWSFHVQPHWEDRVRLLTRAR

SEQ ID NO: 739933 - protein, 17 aa, Mycobacterium
TQPELVEHVISGIVRHA

SEQ ID NO: 739934 - protein, 19 aa, Mycobacterium
TQPTMGFARGKRWLTDPEQ

SEQ ID NO: 739935 - protein, 19 aa, Mycobacterium
TQPWHRWESLDALGNYLRS

SEQ ID NO: 739936 - protein, 19 aa, Mycobacterium
TQPWLTDPDRLRVLLRDVF

SEQ ID NO: 739937 - protein, 22 aa, Mycobacterium
TQPWSPRFLRVYGTAEVVAGDQ

SEQ ID NO: 739938 - protein, 22 aa, Mycobacterium
TQQDVWRFVAYLSDAGSADDLT

SEQ ID NO: 739939 - protein, 23 aa, Mycobacterium
TQQGVGFIPWFPLASGPLAAPDG

SEQ ID NO: 739940 - protein, 23 aa, Mycobacterium
TQQSVAPTALWLRGNEPDCWQRT

SEQ ID NO: 739941 - protein, 17 aa, Mycobacterium
TQQSVAPTTVWLREHEP

SEQ ID NO: 739942 - protein, 18 aa, Mycobacterium
TQRADLGLVLSAGEAGAA

SEQ ID NO: 739943 - protein, 17 aa, Mycobacterium
TQRARPLIESMIAAHRI

SEQ ID NO: 739944 - protein, 18 aa, Mycobacterium
TQRFGLGRDDVCYVSMPL

SEQ ID NO: 739945 - protein, 18 aa, Mycobacterium
TQRGDILWCQLFSEPGAG

SEQ ID NO: 739946 - protein, 17 aa, Mycobacterium
TQRHGFRLVDLYTAPSM

SEQ ID NO: 739947 - protein, 17 aa, Mycobacterium
TQRIVRFTALTGTDALV

SEQ ID NO: 739948 - protein, 19 aa, Mycobacterium
TQRLHPRGAVVVVTGGEPR

SEQ ID NO: 739949 - protein, 24 aa, Mycobacterium
TQRLLSICCCVACRDTWRARGLDP

SEQ ID NO: 739950 - protein, 18 aa, Mycobacterium
TQRLPRVLGEKVAAHLML

SEQ ID NO: 739951 - protein, 18 aa, Mycobacterium
TQRMLWDRVNDALTPGNV

SEQ ID NO: 739952 - protein, 20 aa, Mycobacterium
TQRNAAAVARICERLDGLPL

SEQ ID NO: 739953 - protein, 23 aa, Mycobacterium
TQRPELLPLLAQTYQAAAAMLVK

SEQ ID NO: 739954 - protein, 21 aa, Mycobacterium
TQRPRYCALVNYTDYDGTGEA

SEQ ID NO: 739955 - protein, 26 aa, Mycobacterium
TQRRIECARKVWAAGVQASRLGKMIA

SEQ ID NO: 739956 - protein, 18 aa, Mycobacterium
TQRRLHLHSEAGRRYERS

SEQ ID NO: 739957 - protein, 22 aa, Mycobacterium
TQRRRPIVAYAISKLANILFTK

SEQ ID NO: 739958 - protein, 28 aa, Mycobacterium
TQRVKANLFYRGLAFHRFPVIGDTLTTR

SEQ ID NO: 739959 - protein, 27 aa, Mycobacterium
TQRVKANLFYRGLTFHRFPVIGDSLST

SEQ ID NO: 739960 - protein, 27 aa, Mycobacterium
TQRVKANLFYRGLTFHRYPLIGDTIYT

SEQ ID NO: 739961 - protein, 27 aa, Mycobacterium
TQRVKANLFYRGLTFHRYPVLGDTIYT

SEQ ID NO: 739962 - protein, 27 aa, Mycobacterium
TQRVKANLFYRGLVFHRFPVIGDSLYT

SEQ ID NO: 739963 - protein, 26 aa, Mycobacterium
TQSGFTFPVLSDFWPHGAVSQAYGVF

SEQ ID NO: 739964 - protein, 33 aa, Mycobacterium
TQSGTQWDALCHFFWRGKMYNGHRVADAGTGGS

SEQ ID NO: 739965 - protein, 28 aa, Mycobacterium
TQSLLGWNLSVANLRFQNGYVLIDVTGA

SEQ ID NO: 739966 - protein, 24 aa, Mycobacterium
TQSRREFQRTPGLNGPAVSRAWGH

SEQ ID NO: 739967 - protein, 19 aa, Mycobacterium
TQSTHWWPTAAVRMHSGQM

SEQ ID NO: 739968 - protein, 23 aa, Mycobacterium
TQSWPAVLTWRAHDEPRMESVRV

SEQ ID NO: 739969 - protein, 24 aa, Mycobacterium
TQTGRHPLAWGMRVLDVVGPTAVA

SEQ ID NO: 739970 - protein, 30 aa, Mycobacterium
TQTLAVEWGPKVRVNACVVGMVETEQSELF

SEQ ID NO: 739971 - protein, 20 aa, Mycobacterium
TQTLFGRDLIGNGTDGAAGT

SEQ ID NO: 739972 - protein, 25 aa, Mycobacterium
TQTLPLRPFRTMAINIDGSLPTGVT

SEQ ID NO: 739973 - protein, 24 aa, Mycobacterium
TQVADFFDRLGLSMVEESEDGCRR

SEQ ID NO: 739974 - protein, 18 aa, Mycobacterium
TQVESMILPPIAHEVKVI

SEQ ID NO: 739975 - protein, 34 aa, Mycobacterium
TQVGSPYVWGGAAPGGFDCSGLVMWAFQQAGISL

SEQ ID NO: 739976 - protein, 19 aa, Mycobacterium
TQVIEIFRSLSQVLDKVAS

SEQ ID NO: 739977 - protein, 17 aa, Mycobacterium
TQVLERLADTYPGREKE

SEQ ID NO: 739978 - protein, 24 aa, Mycobacterium
TQVLGFKSRGAFRVPTPPEYGPVR

SEQ ID NO: 739979 - protein, 17 aa, Mycobacterium
TQVPFAVGADAFLVPAE

SEQ ID NO: 739980 - protein, 17 aa, Mycobacterium
TQVPLLLDEYTRNPSTG

SEQ ID NO: 739981 - protein, 24 aa, Mycobacterium
TQVPRLENYRGMIFGCLDEKAEPL

SEQ ID NO: 739982 - protein, 17 aa, Mycobacterium
TQVSALIHGLHPVNPER

SEQ ID NO: 739983 - protein, 19 aa, Mycobacterium
TQVTLWARRPELAERINAT

SEQ ID NO: 739984 - protein, 26 aa, Mycobacterium
TQVVRLRDLLKFDFYFADSAAFHQNV

SEQ ID NO: 739985 - protein, 25 aa, Mycobacterium
TQVYRVGTASVRFLMSVGDLLIGWL

SEQ ID NO: 739986 - protein, 21 aa, Mycobacterium
TQWEESLEVAIRCMVEEPFSG

SEQ ID NO: 739987 - protein, 22 aa, Mycobacterium
TQYGATMLAGLVREAADVYERR

SEQ ID NO: 739988 - protein, 24 aa, Mycobacterium
TQYGRKGVRCNAVAPGAVMTPALA

SEQ ID NO: 739989 - protein, 18 aa, Mycobacterium
TQYPRFHTLMAEMSGEVF

SEQ ID NO: 739990 - protein, 22 aa, Mycobacterium
TQYYKVGVAWLTYLDGGQKHFR

SEQ ID NO: 739991 - protein, 27 aa, Mycobacterium
TRAADHSKLWIGIGVGLALFGKPAAAR

SEQ ID NO: 739992 - protein, 28 aa, Mycobacterium
TRAAGGVYEDRCGPVLADWLTDRGITTP

SEQ ID NO: 739993 - protein, 33 aa, Mycobacterium
TRAALLDRFGMFGIRISIAVLRAGVSDSVALAD

SEQ ID NO: 739994 - protein, 26 aa, Mycobacterium
TRAALLHRFGMFGIRISVAVMRVGVT

SEQ ID NO: 739995 - protein, 19 aa, Mycobacterium
TRAALPGMVERGAGAVLNI

SEQ ID NO: 739996 - protein, 18 aa, Mycobacterium
TRACRDLLQRNGFEVLTH

SEQ ID NO: 739997 - protein, 42 aa, Mycobacterium
TRAEAAYPLGRGFRPKVWPPVRRIDGAYGDRNLVCSCPPIEA

SEQ ID NO: 739998 - protein, 19 aa, Mycobacterium
TRAEALLHRRLTDYGTGPD

SEQ ID NO: 739999 - protein, 23 aa, Mycobacterium
TRAELRIAIVTWIERTYHRRRRQ

SEQ ID NO: 740000 - protein, 25 aa, Mycobacterium
TRAESQWFAAAGFNLVNMTGYPEAI

SEQ ID NO: 740001 - protein, 20 aa, Mycobacterium
TRAGGHLLLGQRAQQPQQVG

SEQ ID NO: 740002 - protein, 17 aa, Mycobacterium
TRAGIDLDDVFEVLETE

SEQ ID NO: 740003 - protein, 21 aa, Mycobacterium
TRAGIKIGAGRLFAELERRGW

SEQ ID NO: 740004 - protein, 19 aa, Mycobacterium
TRAGITAGFHVIGDAAVTQ

SEQ ID NO: 740005 - protein, 18 aa, Mycobacterium
TRAGLALLQACGTNVLVL

SEQ ID NO: 740006 - protein, 29 aa, Mycobacterium
TRAGLKDPRRPSGSFIFAGPSGVGKTELS

SEQ ID NO: 740007 - protein, 19 aa, Mycobacterium
TRAGLWVHCETVAPTTGSP

SEQ ID NO: 740008 - protein, 20 aa, Mycobacterium
TRAGRFGLDQAYSLDELAER

SEQ ID NO: 740009 - protein, 17 aa, Mycobacterium
TRAGRGWIAATTSTERD

SEQ ID NO: 740010 - protein, 18 aa, Mycobacterium
TRAGRQLWVYGRAGQPCR

SEQ ID NO: 740011 - protein, 18 aa, Mycobacterium
TRAGRRLWVYGRAGEPCR

SEQ ID NO: 740012 - protein, 26 aa, Mycobacterium
TRAGVLRFVVLDGLAKPGRLEGPDPS

SEQ ID NO: 740013 - protein, 26 aa, Mycobacterium
TRAGVLRFVVLDGLAKPGRMVGPDPG

SEQ ID NO: 740014 - protein, 26 aa, Mycobacterium
TRAGVLRFVVLDGLGRPGRLVGPDPG

SEQ ID NO: 740015 - protein, 25 aa, Mycobacterium
TRAHAAWLWSRRRGVVGGHSASALL

SEQ ID NO: 740016 - protein, 29 aa, Mycobacterium
TRAHWLASRCGAVTPALRCAADPLPLTPR

SEQ ID NO: 740017 - protein, 20 aa, Mycobacterium
TRAIAAWLWSGRSATAVGLS

SEQ ID NO: 740018 - protein, 19 aa, Mycobacterium
TRAIDSFDITPGYRNFVRA

SEQ ID NO: 740019 - protein, 43 aa, Mycobacterium
TRAITLWYTHYYRMGRMIELIQCWKAEPPRLAEIAYCGIRAGF

SEQ ID NO: 740020 - protein, 24 aa, Mycobacterium
TRAKAAYFMVGFSGPIPDDNWPQA

SEQ ID NO: 740021 - protein, 21 aa, Mycobacterium
TRAKTAFAEREGVNLTFLPFI

SEQ ID NO: 740022 - protein, 23 aa, Mycobacterium
TRALAASVGISWTSELLTVTGVD

SEQ ID NO: 740023 - protein, 23 aa, Mycobacterium
TRALATAVGISWTSELLTVTGVD

SEQ ID NO: 740024 - protein, 25 aa, Mycobacterium
TRALEPLEVTSLWIAGETPETYPSG

SEQ ID NO: 740025 - protein, 18 aa, Mycobacterium
TRALPPIRKLGGGLVEIP

SEQ ID NO: 740026 - protein, 24 aa, Mycobacterium
TRAPGCPFAPPPKVLELNAGKQLS

SEQ ID NO: 740027 - protein, 17 aa, Mycobacterium
TRAPRFGAYIASKAALD

SEQ ID NO: 740028 - protein, 19 aa, Mycobacterium
TRAQAVLAHAELVFTDPDV

SEQ ID NO: 740029 - protein, 26 aa, Mycobacterium
TRAQLLERFGMFGIRISIAGLAAGIA

SEQ ID NO: 740030 - protein, 20 aa, Mycobacterium
TRARAPVPLNVIGLNNIAPA

SEQ ID NO: 740031 - protein, 28 aa, Mycobacterium
TRARAVVARARHKGCTLLVTDGDWEGAS

SEQ ID NO: 740032 - protein, 28 aa, Mycobacterium
TRARAVVARARHRGCTLLVTDGDWEGAP

SEQ ID NO: 740033 - protein, 20 aa, Mycobacterium
TRARDRWEALVALAELVDDE

SEQ ID NO: 740034 - protein, 18 aa, Mycobacterium
TRARERWEALSALAELVD

SEQ ID NO: 740035 - protein, 19 aa, Mycobacterium
TRARERWEALSALAQLVDD

SEQ ID NO: 740036 - protein, 19 aa, Mycobacterium
TRARERWEALVALAELVEE

SEQ ID NO: 740037 - protein, 18 aa, Mycobacterium
TRARFWPTAMTTLSTHDT

SEQ ID NO: 740038 - protein, 17 aa, Mycobacterium
TRARFYIFVNQIANFVP

SEQ ID NO: 740039 - protein, 20 aa, Mycobacterium
TRARGYRVVGRVAALNSLLV

SEQ ID NO: 740040 - protein, 20 aa, Mycobacterium
TRARKVLVATEVGMLHQLRR

SEQ ID NO: 740041 - protein, 23 aa, Mycobacterium
TRARRDGKDWILDGTKMWITNGN

SEQ ID NO: 740042 - protein, 22 aa, Mycobacterium
TRARRLGLRPVAIAFHVGSQQL

SEQ ID NO: 740043 - protein, 17 aa, Mycobacterium
TRARRNAPLLAVHTGPG

SEQ ID NO: 740044 - protein, 21 aa, Mycobacterium
TRARRNLPVLAIHTGDGKGKS

SEQ ID NO: 740045 - protein, 25 aa, Mycobacterium
TRARVLGRLRAHLCSDGRAVIGFGA

SEQ ID NO: 740046 - protein, 20 aa, Mycobacterium
TRASAGVYEDRCGPIIAEWL

SEQ ID NO: 740047 - protein, 26 aa, Mycobacterium
TRASINRFATWWVVLERHGEMVRLYP

SEQ ID NO: 740048 - protein, 19 aa, Mycobacterium
TRASKRFPLDDFRFDRLPE

SEQ ID NO: 740049 - protein, 21 aa, Mycobacterium
TRASWKLGQAIAGNGTHSPDV

SEQ ID NO: 740050 - protein, 23 aa, Mycobacterium
TRATRSGDDWILTGTKMWITNGS

SEQ ID NO: 740051 - protein, 20 aa, Mycobacterium
TRATVALAAMGLRPLIERVP

SEQ ID NO: 740052 - protein, 19 aa, Mycobacterium
TRATVLFEPAMRRMLDDGY

SEQ ID NO: 740053 - protein, 17 aa, Mycobacterium
TRAVAAWLWSRRTATLA

SEQ ID NO: 740054 - protein, 19 aa, Mycobacterium
TRAVGAYSLDDGLRVVAVN

SEQ ID NO: 740055 - protein, 18 aa, Mycobacterium
TRAVYRKMAKRGGGAIVN

SEQ ID NO: 740056 - protein, 17 aa, Mycobacterium
TRAWLRDPAPLFRTNVE

SEQ ID NO: 740057 - protein, 17 aa, Mycobacterium
TRAWLRDPSPLFRTNVE

SEQ ID NO: 740058 - protein, 19 aa, Mycobacterium
TRAYADWSAEVNARYHGQL

SEQ ID NO: 740059 - protein, 20 aa, Mycobacterium
TRAYDLVRKLDWPAGYDARA

SEQ ID NO: 740060 - protein, 25 aa, Mycobacterium
TRAYRLDWPAGTVVFEVDQPQVIEF

SEQ ID NO: 740061 - protein, 18 aa, Mycobacterium
TRAYRVGPGLDLLAFSVL

SEQ ID NO: 740062 - protein, 19 aa, Mycobacterium
TRCAESLPAGHVVDTLAGV

SEQ ID NO: 740063 - protein, 18 aa, Mycobacterium
TRCAHFSALVGLPVVPMI

SEQ ID NO: 740064 - protein, 20 aa, Mycobacterium
TRCRHCTGPLSLQERGGPGA

SEQ ID NO: 740065 - protein, 17 aa, Mycobacterium
TRCSAIEAVEFGVRINA

SEQ ID NO: 740066 - protein, 22 aa, Mycobacterium
TRCWKQIIHFTPKFTAPEPESV

SEQ ID NO: 740067 - protein, 19 aa, Mycobacterium
TRDAELRARDFVALVISGL

SEQ ID NO: 740068 - protein, 23 aa, Mycobacterium
TRDAVGASDAFFPFPDGLQTLID

SEQ ID NO: 740069 - protein, 25 aa, Mycobacterium
TRDAYLPGLWFKTGDRADVDENGWL

SEQ ID NO: 740070 - protein, 18 aa, Mycobacterium
TRDDRYLCINPFFHNFGY

SEQ ID NO: 740071 - protein, 24 aa, Mycobacterium
TRDEIIRMVDLMIGRVANQLKSKD

SEQ ID NO: 740072 - protein, 21 aa, Mycobacterium
TRDEIRAALDQGDWNSDSPSR

SEQ ID NO: 740073 - protein, 20 aa, Mycobacterium
TRDEIVDWLGPTIQRYLGLP

SEQ ID NO: 740074 - protein, 27 aa, Mycobacterium
TRDEPGNLWFEWSRSLDDPAVYVLVEG

SEQ ID NO: 740075 - protein, 20 aa, Mycobacterium
TRDETIAAIAARAADLDVPG

SEQ ID NO: 740076 - protein, 23 aa, Mycobacterium
TRDEVRAALAVGDWTSASDSKLL

SEQ ID NO: 740077 - protein, 22 aa, Mycobacterium
TRDEVRAALDAGDWTTTSSESK

SEQ ID NO: 740078 - protein, 18 aa, Mycobacterium
TRDGCIRQAVLGVVESFL

SEQ ID NO: 740079 - protein, 26 aa, Mycobacterium
TRDGDSWRLNGFKWFASNCAGQAFVV

SEQ ID NO: 740080 - protein, 22 aa, Mycobacterium
TRDGRLPFVFEASGVETHFTNG

SEQ ID NO: 740081 - protein, 24 aa, Mycobacterium
TRDILDREILGIAEAIRASGLSAG

SEQ ID NO: 740082 - protein, 23 aa, Mycobacterium
TRDILDREILGIAEAVRASGLSA

SEQ ID NO: 740083 - protein, 17 aa, Mycobacterium
TRDILLIVDDVQMGCGR

SEQ ID NO: 740084 - protein, 24 aa, Mycobacterium
TRDLGCDYAICYFPEAAYDRSGIE

SEQ ID NO: 740085 - protein, 20 aa, Mycobacterium
TRDLKPLDLVAGQLASLIDA

SEQ ID NO: 740086 - protein, 20 aa, Mycobacterium
TRDPMVVAWPARIRPDGQVR

SEQ ID NO: 740087 - protein, 24 aa, Mycobacterium
TRDQRWKRFNIFNLVYNTLLALLF

SEQ ID NO: 740088 - protein, 24 aa, Mycobacterium
TRDQRWKRFNLLNLVYNTMLMLLF

SEQ ID NO: 740089 - protein, 22 aa, Mycobacterium
TRDRFVEVVAWAAQVAASLGKI

SEQ ID NO: 740090 - protein, 17 aa, Mycobacterium
TRDRKGYHVEYGYSCMG

SEQ ID NO: 740091 - protein, 22 aa, Mycobacterium
TRDRLGFSVLHVVKDNPTSLIA

SEQ ID NO: 740092 - protein, 18 aa, Mycobacterium
TRDSRLRASAARLATAGA

SEQ ID NO: 740093 - protein, 23 aa, Mycobacterium
TRDSSFWIGPRVAITSLALPARH

SEQ ID NO: 740094 - protein, 22 aa, Mycobacterium
TRDSSIWIGPRVVIPSLALRAR

SEQ ID NO: 740095 - protein, 25 aa, Mycobacterium
TRDVLIRIGDEFAIQVRALTELAET

SEQ ID NO: 740096 - protein, 20 aa, Mycobacterium
TREAKRICQGCEVKDECLEY

SEQ ID NO: 740097 - protein, 23 aa, Mycobacterium
TREAKRICQGCEVRDACLEYALA

SEQ ID NO: 740098 - protein, 17 aa, Mycobacterium
TREAVTIDEEWFASRAG

SEQ ID NO: 740099 - protein, 23 aa, Mycobacterium
TREFFWRGEHALASSGIDLPPEF

SEQ ID NO: 740100 - protein, 17 aa, Mycobacterium
TREFLQVVRRLWTEENV

SEQ ID NO: 740101 - protein, 21 aa, Mycobacterium
TREIADVVGPLAQRIAADDRP

SEQ ID NO: 740102 - protein, 23 aa, Mycobacterium
TREIAVAPVRFIKTIGDEVMLVS

SEQ ID NO: 740103 - protein, 23 aa, Mycobacterium
TREILDREILGIAEAIRASGLSA

SEQ ID NO: 740104 - protein, 21 aa, Mycobacterium
TREIMSYGSGYGGNALLGKKC

SEQ ID NO: 740105 - protein, 20 aa, Mycobacterium
TREIPILIGGGGERKTLRLV

SEQ ID NO: 740106 - protein, 19 aa, Mycobacterium
TREIPRNGIRIVTDGAVLI

SEQ ID NO: 740107 - protein, 22 aa, Mycobacterium
TREIYRNPWLTIREDEIRRPDG

SEQ ID NO: 740108 - protein, 26 aa, Mycobacterium
TREKLFPLICRYALAYHVVFIPSVEV

SEQ ID NO: 740109 - protein, 19 aa, Mycobacterium
TREKLRLIVERGLIGESTL

SEQ ID NO: 740110 - protein, 19 aa, Mycobacterium
TREKLRLIVERGLIGGSTL

SEQ ID NO: 740111 - protein, 21 aa, Mycobacterium
TRELAGQAWGHFQEIEAKGGF

SEQ ID NO: 740112 - protein, 28 aa, Mycobacterium
TRELALQVAEAFGRYGAHMPKLNVLPIY

SEQ ID NO: 740113 - protein, 25 aa, Mycobacterium
TRELALQVAEAFGRYGAQLRVNVLP

SEQ ID NO: 740114 - protein, 24 aa, Mycobacterium
TRELALQVAEAFGRYGSHLPQVNV

SEQ ID NO: 740115 - protein, 28 aa, Mycobacterium
TRELALQVAEAFSRYGAHLPKINVLPIY

SEQ ID NO: 740116 - protein, 25 aa, Mycobacterium
TRELALQVAEAFSRYGAHLPKVNVL

SEQ ID NO: 740117 - protein, 31 aa, Mycobacterium
TRELALQVAEAFSRYGAYLPKLNVLPIYGGS

SEQ ID NO: 740118 - protein, 27 aa, Mycobacterium
TRELEWPAMRISHCRPPGSDRDVVLMH

SEQ ID NO: 740119 - protein, 21 aa, Mycobacterium
TRELEWPGMHISYCSPPGSQR

SEQ ID NO: 740120 - protein, 18 aa, Mycobacterium
TRELGWKPAPTADAIARA

SEQ ID NO: 740121 - protein, 18 aa, Mycobacterium
TRELPKSIIIAGAGAIGM

SEQ ID NO: 740122 - protein, 21 aa, Mycobacterium
TRELVWPAMRISHCRPPGSDR

SEQ ID NO: 740123 - protein, 27 aa, Mycobacterium
TRELVWPAMRISHCRPPGSDRDVVLMH

SEQ ID NO: 740124 - protein, 27 aa, Mycobacterium
TRELVWPSMRISHCRPPGADRDIVLMH

SEQ ID NO: 740125 - protein, 27 aa, Mycobacterium
TRELVWPSMRISYCRPPGSDRDVVLMH

SEQ ID NO: 740126 - protein, 26 aa, Mycobacterium
TRENQLWLDLYVSTSLEFNNTKFYDP

SEQ ID NO: 740127 - protein, 20 aa, Mycobacterium
TREPVLVVGEITDWEGHSDE

SEQ ID NO: 740128 - protein, 24 aa, Mycobacterium
TREQRLDLLQAILAEYQKRAGDLA

SEQ ID NO: 740129 - protein, 23 aa, Mycobacterium
TREQRLDLLQSILAEYQKRADDL

SEQ ID NO: 740130 - protein, 18 aa, Mycobacterium
TREREFTSALTLDSPGVQ

SEQ ID NO: 740131 - protein, 19 aa, Mycobacterium
TRERLAIAIAQSNTCSYCL

SEQ ID NO: 740132 - protein, 21 aa, Mycobacterium
TRETLGFSVLHVVRDNPTSII

SEQ ID NO: 740133 - protein, 24 aa, Mycobacterium
TRETLRLLIDLARTANLEQRRDQM

SEQ ID NO: 740134 - protein, 29 aa, Mycobacterium
TREVLGAGIPLFGICFGNQILGRALGRST

SEQ ID NO: 740135 - protein, 18 aa, Mycobacterium
TREYMWVDVVTWNDDEIT

SEQ ID NO: 740136 - protein, 22 aa, Mycobacterium
TRFAFAGVGVLLPRSSGDQYDV

SEQ ID NO: 740137 - protein, 17 aa, Mycobacterium
TRFALDHHINLRPAKLY

SEQ ID NO: 740138 - protein, 28 aa, Mycobacterium
TRFANPEPKGCVFEYVYLARPDSTLVGR

SEQ ID NO: 740139 - protein, 17 aa, Mycobacterium
TRFARGWHCLGLADSFR

SEQ ID NO: 740140 - protein, 19 aa, Mycobacterium
TRFATLVLASVVRRDGFVR

SEQ ID NO: 740141 - protein, 18 aa, Mycobacterium
TRFDDFVRRVGITKAATS

SEQ ID NO: 740142 - protein, 20 aa, Mycobacterium
TRFDEFAERIGVSAPAVSRA

SEQ ID NO: 740143 - protein, 17 aa, Mycobacterium
TRFFDAFFEDAARAGIR

SEQ ID NO: 740144 - protein, 18 aa, Mycobacterium
TRFFDDFFLNAARDGIRQ

SEQ ID NO: 740145 - protein, 17 aa, Mycobacterium
TRFFDSFFQAATQAGIR

SEQ ID NO: 740146 - protein, 19 aa, Mycobacterium
TRFFRHSRLAYGALSKAGL

SEQ ID NO: 740147 - protein, 19 aa, Mycobacterium
TRFGSPAGQLRTFLDSLGG

SEQ ID NO: 740148 - protein, 22 aa, Mycobacterium
TRFGVTQQPAWAFVSANGDVDV

SEQ ID NO: 740149 - protein, 24 aa, Mycobacterium
TRFIDVLRADIDFRQSPNDMLRNT

SEQ ID NO: 740150 - protein, 24 aa, Mycobacterium
TRFNKPGTIPLQFQTEVRDGCPSD

SEQ ID NO: 740151 - protein, 18 aa, Mycobacterium
TRFQQRVLAAMAHATQLD

SEQ ID NO: 740152 - protein, 29 aa, Mycobacterium
TRFRRMLSKPFTFKRVEALRPAVQKITDD

SEQ ID NO: 740153 - protein, 30 aa, Mycobacterium; identical to SEQ ID NO: 85269

SEQ ID NO: 740154 - protein, 30 aa, Mycobacterium
TRFRRMLSKPFTFKRVEALRPTIQQITDEH

SEQ ID NO: 740155 - protein, 30 aa, Mycobacterium
TRFRRMLSKPFTFKRVEGLRPTIQQITDDH

SEQ ID NO: 740156 - protein, 31 aa, Mycobacterium
TRFRRMLSKPFTFRRVEALRPVIQEVTDECI

SEQ ID NO: 740157 - protein, 31 aa, Mycobacterium
TRFRRMLSKPFTFRRVEGLRPAIQKITDECI

SEQ ID NO: 740158 - protein, 30 aa, Mycobacterium
TRFRRMLSKPFTFRRVEGLRPTIQQITDDH

SEQ ID NO: 740159 - protein, 17 aa, Mycobacterium
TRFRSEAAYARHAGLAP

SEQ ID NO: 740160 - protein, 18 aa, Mycobacterium
TRFRSHPDLDVLSHGLTL

SEQ ID NO: 740161 - protein, 19 aa, Mycobacterium
TRFSEPMDVGRNLQISQKD

SEQ ID NO: 740162 - protein, 17 aa, Mycobacterium
TRFTASMPVHNLVVSNV

SEQ ID NO: 740163 - protein, 27 aa, Mycobacterium
TRFVACPFGAPGARMYRTGDLVRWGAD

SEQ ID NO: 740164 - protein, 19 aa, Mycobacterium
TRFVEAMAHALGRNLITVA

SEQ ID NO: 740165 - protein, 19 aa, Mycobacterium
TRFVEAMAHDLGRPLITVA

SEQ ID NO: 740166 - protein, 21 aa, Mycobacterium
TRFWACPEALVSPRAHQRAVE

SEQ ID NO: 740167 - protein, 18 aa, Mycobacterium
TRGAIAAVAVDIRPGSQT

SEQ ID NO: 740168 - protein, 18 aa, Mycobacterium
TRGAIAAVAVDVRPDSLT

SEQ ID NO: 740169 - protein, 20 aa, Mycobacterium
TRGAIDFNRPGIPIVASLPS

SEQ ID NO: 740170 - protein, 20 aa, Mycobacterium
TRGAIDFNRPGIPVVASLPS

SEQ ID NO: 740171 - protein, 24 aa, Mycobacterium
TRGALQYRVLRAFNLAGPDAQRTP

SEQ ID NO: 740172 - protein, 19 aa, Mycobacterium
TRGALRVAELVQRSLIPDS

SEQ ID NO: 740173 - protein, 25 aa, Mycobacterium
TRGAPLCAFRETSRILAGLPDQRPD

SEQ ID NO: 740174 - protein, 17 aa, Mycobacterium
TRGCGARGQAVWTPVAK

SEQ ID NO: 740175 - protein, 19 aa, Mycobacterium
TRGDTEWKPPPHLERGQPR

SEQ ID NO: 740176 - protein, 19 aa, Mycobacterium
TRGETEWKPPPHLERGQPP

SEQ ID NO: 740177 - protein, 22 aa, Mycobacterium
TRGEWYLRQMLGAANFKAGPLL

SEQ ID NO: 740178 - protein, 17 aa, Mycobacterium
TRGFPLGPGYLLDGRPV

SEQ ID NO: 740179 - protein, 20 aa, Mycobacterium
TRGGQLLVYGVDPLILRQAY

SEQ ID NO: 740180 - protein, 18 aa, Mycobacterium
TRGGWYVRQLLGAANIDG

SEQ ID NO: 740181 - protein, 28 aa, Mycobacterium
TRGLEVVEFACGIPHLLKGGFTENASTK

SEQ ID NO: 740182 - protein, 20 aa, Mycobacterium
TRGLFRRVILHSAPLGLAYQ

SEQ ID NO: 740183 - protein, 18 aa, Mycobacterium
TRGLGRRSSDNDDKTPDK

SEQ ID NO: 740184 - protein, 18 aa, Mycobacterium
TRGLGVLIDAVFNHLGPS

SEQ ID NO: 740185 - protein, 18 aa, Mycobacterium
TRGMMCRKVIVTVGHVEG

SEQ ID NO: 740186 - protein, 21 aa, Mycobacterium
TRGPRIADLVGEAARRSPDAP

SEQ ID NO: 740187 - protein, 21 aa, Mycobacterium
TRGRDDWAVHVALWQRRANGR

SEQ ID NO: 740188 - protein, 21 aa, Mycobacterium
TRGRDDWAVHVALWQRTTNGR

SEQ ID NO: 740189 - protein, 18 aa, Mycobacterium
TRGRELLAQVGLADKADA

SEQ ID NO: 740190 - protein, 31 aa, Mycobacterium
TRGRGAEGLVLPVAGGFACFAEPGSPMNKVV

SEQ ID NO: 740191 - protein, 17 aa, Mycobacterium
TRGRISYLDGYTGLLTG

SEQ ID NO: 740192 - protein, 24 aa, Mycobacterium
TRGRLGLLELRGFEMPPHLRMAMV

SEQ ID NO: 740193 - protein, 20 aa, Mycobacterium
TRGSFYWHFTDMKAYRAALV

SEQ ID NO: 740194 - protein, 22 aa, Mycobacterium
TRGSMKAGVFSGAALADPAELV

SEQ ID NO: 740195 - protein, 18 aa, Mycobacterium
TRGSRKVRYRGVAKNDHW

SEQ ID NO: 740196 - protein, 18 aa, Mycobacterium
TRGSTALRGIAGAARDAS

SEQ ID NO: 740197 - protein, 18 aa, Mycobacterium
TRGSVVFRVSSDKDDKDY

SEQ ID NO: 740198 - protein, 18 aa, Mycobacterium
TRGSVVFRVTGDKDLVFT

SEQ ID NO: 740199 - protein, 25 aa, Mycobacterium
TRGVLQYRVLRAFKKAGLNSQRARG

SEQ ID NO: 740200 - protein, 17 aa, Mycobacterium
TRGWLRDPAPLFRTNVE

SEQ ID NO: 740201 - protein, 22 aa, Mycobacterium
TRHALAAVAAWLARPDTAETVL

SEQ ID NO: 740202 - protein, 25 aa, Mycobacterium
TRHARRARLRLAAHHPWTHLLTDTL

SEQ ID NO: 740203 - protein, 25 aa, Mycobacterium
TRHDFAEPWSYVDFTITFEGDENQT

SEQ ID NO: 740204 - protein, 30 aa, Mycobacterium
TRHEARWHPQRHLLTRALGIGPHIGPDVFG

SEQ ID NO: 740205 - protein, 26 aa, Mycobacterium
TRHGDSWLLNGFKWFASNCAGEAFVV

SEQ ID NO: 740206 - protein, 22 aa, Mycobacterium
TRHLKPVIRRGLSGLITDTQKH

SEQ ID NO: 740207 - protein, 19 aa, Mycobacterium
TRHLSDFGFATVDRNPSPQ

SEQ ID NO: 740208 - protein, 23 aa, Mycobacterium
TRHLSVAYWKGGDSGFEERLFQP

SEQ ID NO: 740209 - protein, 19 aa, Mycobacterium
TRHNLGFMVADLLAAKDGA

SEQ ID NO: 740210 - protein, 20 aa, Mycobacterium
TRHNVGFMVADLLAARMGSK

SEQ ID NO: 740211 - protein, 24 aa, Mycobacterium
TRHPNLRAAFWDRGLPKPVQIVPT

SEQ ID NO: 740212 - protein, 28 aa, Mycobacterium
TRHPYASALVFWFGWPASEVPGMYLSVS

SEQ ID NO: 740213 - protein, 20 aa, Mycobacterium
TRHRHGTAFTDDFTGLAAGY

SEQ ID NO: 740214 - protein, 19 aa, Mycobacterium
TRHTIAWDLPVGAPAGVTP

SEQ ID NO: 740215 - protein, 23 aa, Mycobacterium
TRHWPQGRLSKAYAAYSTPFWRA

SEQ ID NO: 740216 - protein, 17 aa, Mycobacterium
TRIAADIERPVSFTLLQ

SEQ ID NO: 740217 - protein, 24 aa, Mycobacterium
TRIAGDQCDAWTGLAAAGDQSIGV

SEQ ID NO: 740218 - protein, 22 aa, Mycobacterium
TRIAVCQPGLFNAEVKKAAAEH

SEQ ID NO: 740219 - protein, 18 aa, Mycobacterium
TRIDARAAAPLAAVSVPG

SEQ ID NO: 740220 - protein, 30 aa, Mycobacterium
TRIDSLAPFRWRLAPVPLNLDHPYWFDDPV

SEQ ID NO: 740221 - protein, 27 aa, Mycobacterium
TRIEFWAFDLLFLDGRSLLRARYRDRR

SEQ ID NO: 740222 - protein, 17 aa, Mycobacterium
TRIEIAKRLDLIDPNAW

SEQ ID NO: 740223 - protein, 19 aa, Mycobacterium
TRIFPGVQQPLAIAIFTRT

SEQ ID NO: 740224 - protein, 19 aa, Mycobacterium
TRIFQEFAGVGVPMTHFGV

SEQ ID NO: 740225 - protein, 23 aa, Mycobacterium
TRIGERRVLVLVGRVHAYEGHDL

SEQ ID NO: 740226 - protein, 22 aa, Mycobacterium
TRIGLGVPYTWARMRMMRYGNR

SEQ ID NO: 740227 - protein, 19 aa, Mycobacterium
TRIGTAVEELVRWATPVMT

SEQ ID NO: 740228 - protein, 21 aa, Mycobacterium
TRIGVLPTFRRQGIATELMSH

SEQ ID NO: 740229 - protein, 17 aa, Mycobacterium
TRIIPVCRTVGTDRVVD

SEQ ID NO: 740230 - protein, 19 aa, Mycobacterium
TRIKNLFTFQPRDLCAKGP

SEQ ID NO: 740231 - protein, 28 aa, Mycobacterium
TRINDRCEVEWIPPPGLDTGQARVNTYH

SEQ ID NO: 740232 - protein, 17 aa, Mycobacterium
TRIPLHGRIEVDEPYVL

SEQ ID NO: 740233 - protein, 26 aa, Mycobacterium
TRIREICAALDMPRSSAHALLRTLVA

SEQ ID NO: 740234 - protein, 24 aa, Mycobacterium
TRIRPGLDVRPAFLELAEPAFIDV

SEQ ID NO: 740235 - protein, 19 aa, Mycobacterium
TRISELTMMVRALRRADGP

SEQ ID NO: 740236 - protein, 17 aa, Mycobacterium
TRISGLPVTHRVRTAFD

SEQ ID NO: 740237 - protein, 20 aa, Mycobacterium
TRISTRIAVMRDRHNVALAE

SEQ ID NO: 740238 - protein, 30 aa, Mycobacterium
TRITERIRISAPRLLAGVTVRGAVKAHAEM

SEQ ID NO: 740239 - protein, 24 aa, Mycobacterium
TRITLPEVDAFVWHAYLPTIEPGQ

SEQ ID NO: 740240 - protein, 26 aa, Mycobacterium
TRITLPEVDGFVWHGFIPNIEPGQRY

SEQ ID NO: 740241 - protein, 27 aa, Mycobacterium
TRIVALRAKAKAGFAEREGVNLTYLPF

SEQ ID NO: 740242 - protein, 17 aa, Mycobacterium
TRIWHAVCWGIIIPAGW

SEQ ID NO: 740243 - protein, 18 aa, Mycobacterium
TRIYSCAYFEPPELTLEE

SEQ ID NO: 740244 - protein, 17 aa, Mycobacterium
TRKAFLIDDNWAHDFGI

SEQ ID NO: 740245 - protein, 21 aa, Mycobacterium
TRKGLDGDTRFAVVADGPATS

SEQ ID NO: 740246 - protein, 31 aa, Mycobacterium
TRKLARNTFYGMARWQARLEQKQGFLGRIVD

SEQ ID NO: 740247 - protein, 24 aa, Mycobacterium
TRKLDTEFFAPVLLGVPYEVSAEL

SEQ ID NO: 740248 - protein, 18 aa, Mycobacterium
TRKLRDWLINRAIECSVP

SEQ ID NO: 740249 - protein, 23 aa, Mycobacterium
TRKPESLRRFGWFDDVTPATLDA

SEQ ID NO: 740250 - protein, 20 aa, Mycobacterium
TRKRRLGVLGYDDLLTRLAD

SEQ ID NO: 740251 - protein, 17 aa, Mycobacterium
TRKRRSDGITEWIPPPH

SEQ ID NO: 740252 - protein, 19 aa, Mycobacterium
TRKSPSFIEFEFPERPQLG

SEQ ID NO: 740253 - protein, 17 aa, Mycobacterium
TRKSRRLGVDLVGGDQS

SEQ ID NO: 740254 - protein, 17 aa, Mycobacterium
TRKSRRLGVDLVGGSSA

SEQ ID NO: 740255 - protein, 24 aa, Mycobacterium
TRKTFAEGYWRWITLLEDGFHRMR

SEQ ID NO: 740256 - protein, 22 aa, Mycobacterium
TRKWAEQSLHRFRELADDPTSG

SEQ ID NO: 740257 - protein, 20 aa, Mycobacterium
TRLAALVDRLISSGVHAIAP

SEQ ID NO: 740258 - protein, 23 aa, Mycobacterium
TRLADEGFLALAFDPRTVGESGG

SEQ ID NO: 740259 - protein, 22 aa, Mycobacterium
TRLAEGLTQAAALMESHEADSQ

SEQ ID NO: 740260 - protein, 19 aa, Mycobacterium
TRLAERARHEPRRGQPGPL

SEQ ID NO: 740261 - protein, 33 aa, Mycobacterium
TRLAHDVAPDWPIGIGDLSYRVVITGDPDLDCT

SEQ ID NO: 740262 - protein, 22 aa, Mycobacterium
TRLAHIYFELSAHLGVDGLLYA

SEQ ID NO: 740263 - protein, 19 aa, Mycobacterium
TRLAHRGSPVACGTAAMDS

SEQ ID NO: 740264 - protein, 18 aa, Mycobacterium
TRLAHVMKGYRADSYSQI

SEQ ID NO: 740265 - protein, 17 aa, Mycobacterium
TRLAPNFERSIIRHTTF

SEQ ID NO: 740266 - protein, 17 aa, Mycobacterium
TRLAPVLSATNRESVVL

SEQ ID NO: 740267 - protein, 18 aa, Mycobacterium
TRLARVAIDLMGGVPSEG

SEQ ID NO: 740268 - protein, 23 aa, Mycobacterium
TRLASELEILLALGAAHGADALV

SEQ ID NO: 740269 - protein, 22 aa, Mycobacterium
TRLCSACFDGDYPIELPGETAL

SEQ ID NO: 740270 - protein, 24 aa, Mycobacterium
TRLDFARAAALIAHHIRQDVAGVT

SEQ ID NO: 740271 - protein, 18 aa, Mycobacterium
TRLDTRRIILTGQVTEQC

SEQ ID NO: 740272 - protein, 27 aa, Mycobacterium
TRLEIGRRLARECPVDADLVIGVPESG

SEQ ID NO: 740273 - protein, 19 aa, Mycobacterium
TRLELRRMAYVQRMALHVG

SEQ ID NO: 740274 - protein, 17 aa, Mycobacterium
TRLERGAGVPAIERLAY

SEQ ID NO: 740275 - protein, 18 aa, Mycobacterium
TRLERGAGVPAVERLAYF

SEQ ID NO: 740276 - protein, 18 aa, Mycobacterium
TRLERGAGVPSVERLGYF

SEQ ID NO: 740277 - protein, 25 aa, Mycobacterium
TRLERRIGERLPWLSIRDSGVNLRT

SEQ ID NO: 740278 - protein, 21 aa, Mycobacterium
TRLEVTIKRDGHEWFQYYDRA

SEQ ID NO: 740279 - protein, 24 aa, Mycobacterium
TRLEYLQRLGVDGIWINPVTVSPM

SEQ ID NO: 740280 - protein, 20 aa, Mycobacterium
TRLFAAPGWNVSPGTVTALP

SEQ ID NO: 740281 - protein, 22 aa, Mycobacterium
TRLFDVPGLATCARGLKTTAEA

SEQ ID NO: 740282 - protein, 25 aa, Mycobacterium
TRLFLGAEIRQIWARTHQTIVFVTH

SEQ ID NO: 740283 - protein, 26 aa, Mycobacterium
TRLFQFMPRRLLLPLLKSQHPGLKRD

SEQ ID NO: 740284 - protein, 22 aa, Mycobacterium
TRLGAELTVPILAGGEVAADVL

SEQ ID NO: 740285 - protein, 17 aa, Mycobacterium
TRLGEVVWLEPFPDSLM

SEQ ID NO: 740286 - protein, 20 aa, Mycobacterium
TRLGLWPSDIDVLSKLVRYH

SEQ ID NO: 740287 - protein, 19 aa, Mycobacterium
TRLGSWFSSPDRFWHREIF

SEQ ID NO: 740288 - protein, 17 aa, Mycobacterium
TRLGTGVVRITLPAKLI

SEQ ID NO: 740289 - protein, 25 aa, Mycobacterium
TRLKDFRFIPCLSQQAPDPVPNGRS

SEQ ID NO: 740290 - protein, 22 aa, Mycobacterium
TRLKGRECFGGLDLGATSDLTA

SEQ ID NO: 740291 - protein, 21 aa, Mycobacterium
TRLKMYRLLHELWARRHMAVL

SEQ ID NO: 740292 - protein, 19 aa, Mycobacterium
TRLKPEILAVTLAGRELGP

SEQ ID NO: 740293 - protein, 19 aa, Mycobacterium
TRLKPEILAVTLSAGDFGA

SEQ ID NO: 740294 - protein, 18 aa, Mycobacterium
TRLKPEILAVTLSAGDRG

SEQ ID NO: 740295 - protein, 17 aa, Mycobacterium
TRLKPEILAVTMTAGTF

SEQ ID NO: 740296 - protein, 34 aa, Mycobacterium
TRLKTIDSELGWSRDVWKQLAEVGVLGLGFDEDA

SEQ ID NO: 740297 - protein, 27 aa, Mycobacterium
TRLLGPAYRLFYERPVHLVRGRGSHMF

SEQ ID NO: 740298 - protein, 26 aa, Mycobacterium
TRLLIIDDLHFLRGRRERMTDLSNQF

SEQ ID NO: 740299 - protein, 20 aa, Mycobacterium
TRLLNMVPYFQANPGISAAE

SEQ ID NO: 740300 - protein, 24 aa, Mycobacterium
TRLLPNLVTVLGWESCDHTGPVHE

SEQ ID NO: 740301 - protein, 19 aa, Mycobacterium
TRLLPYRPITITATDGQPV

SEQ ID NO: 740302 - protein, 18 aa, Mycobacterium
TRLLTGRGTFVDDIVRPG

SEQ ID NO: 740303 - protein, 25 aa, Mycobacterium
TRLMKFYQCIQNVVIPTQPGAGGEG

SEQ ID NO: 740304 - protein, 21 aa, Mycobacterium
TRLMPGASVIIVLTRWHTDDL

SEQ ID NO: 740305 - protein, 20 aa, Mycobacterium
TRLPAGAVVYTYREPAEEIS

SEQ ID NO: 740306 - protein, 25 aa, Mycobacterium
TRLPDLKFFVCGGASVSPSLIRCAT

SEQ ID NO: 740307 - protein, 24 aa, Mycobacterium
TRLPDLKVFICGGASVSPSLIRRA

SEQ ID NO: 740308 - protein, 17 aa, Mycobacterium
TRLPFGRHLPFGLTVTM

SEQ ID NO: 740309 - protein, 17 aa, Mycobacterium
TRLPGFLMDAPVILRGV

SEQ ID NO: 740310 - protein, 17 aa, Mycobacterium
TRLPWFGPPMSAVSSLT

SEQ ID NO: 740311 - protein, 19 aa, Mycobacterium
TRLQERWQQIEAKAAEVKQ

SEQ ID NO: 740312 - protein, 18 aa, Mycobacterium
TRLQPGRMFLVDTTQGRI

SEQ ID NO: 740313 - protein, 17 aa, Mycobacterium
TRLRAHADLDRLAESVV

SEQ ID NO: 740314 - protein, 25 aa, Mycobacterium
TRLRDRILLRFGLHQALRLGKPLQF

SEQ ID NO: 740315 - protein, 23 aa, Mycobacterium
TRLRELLDRYPLRGIKGPMGTGQ

SEQ ID NO: 740316 - protein, 17 aa, Mycobacterium
TRLRFFINVNHSVSDLV

SEQ ID NO: 740317 - protein, 20 aa, Mycobacterium
TRLRGLMSRVFTPRRMAALE

SEQ ID NO: 740318 - protein, 19 aa, Mycobacterium
TRLRGVMSRVFTPRRMAEL

SEQ ID NO: 740319 - protein, 20 aa, Mycobacterium
TRLRKIISRGFTPRAIGRLE

SEQ ID NO: 740320 - protein, 27 aa, Mycobacterium
TRLRWAQRRVELPAGRYETIMPPSAVA

SEQ ID NO: 740321 - protein, 20 aa, Mycobacterium
TRLSAFKVPHRLAVVERLPR

SEQ ID NO: 740322 - protein, 25 aa, Mycobacterium
TRLSRLTPRKGCWICRENPVMKIDV

SEQ ID NO: 740323 - protein, 18 aa, Mycobacterium
TRLTCGYSAAPDSAEVVR

SEQ ID NO: 740324 - protein, 24 aa, Mycobacterium
TRLTPMRFTWCRDYADYHPEEPGG

SEQ ID NO: 740325 - protein, 22 aa, Mycobacterium
TRLVGLTGIPFTDVFNACATAA

SEQ ID NO: 740326 - protein, 20 aa, Mycobacterium
TRLVPERGYHLELITPVPLP

SEQ ID NO: 740327 - protein, 22 aa, Mycobacterium
TRLVSICTGAFVLAAAGLLDGR

SEQ ID NO: 740328 - protein, 21 aa, Mycobacterium
TRLWEHWGKPEIHWYQGGHTG

SEQ ID NO: 740329 - protein, 22 aa, Mycobacterium
TRLWEHWGKPEIVWYPGGHTGF

SEQ ID NO: 740330 - protein, 18 aa, Mycobacterium
TRLYGQGPNAEWVYGQVQ

SEQ ID NO: 740331 - protein, 23 aa, Mycobacterium
TRMARLAVHPDAYIRPSPTSGTL

SEQ ID NO: 740332 - protein, 20 aa, Mycobacterium
TRMGMLGEFGLTWPWESLHL

SEQ ID NO: 740333 - protein, 23 aa, Mycobacterium
TRMGRLSVHPDAYIRPSPTSGTL

SEQ ID NO: 740334 - protein, 18 aa, Mycobacterium
TRMIEPTPILGRLPGLYP

SEQ ID NO: 740335 - protein, 18 aa, Mycobacterium
TRMKLARNMLTFVSYAAA

SEQ ID NO: 740336 - protein, 20 aa, Mycobacterium
TRMPLCTHIGSSSVSPTTSP

SEQ ID NO: 740337 - protein, 21 aa, Mycobacterium
TRMPWPGVADQIFAVLNHFEG

SEQ ID NO: 740338 - protein, 17 aa, Mycobacterium
TRMRVPRSLMASIGDDE

SEQ ID NO: 740339 - protein, 17 aa, Mycobacterium
TRMRVPRSLMASIGNEA

SEQ ID NO: 740340 - protein, 18 aa, Mycobacterium
TRMRWKNNFRNGATAEIY

SEQ ID NO: 740341 - protein, 18 aa, Mycobacterium
TRMRWRDEVDWIAPDRRT

SEQ ID NO: 740342 - protein, 17 aa, Mycobacterium
TRMTLDVLVRIGDEVAE

SEQ ID NO: 740343 - protein, 23 aa, Mycobacterium
TRMYRTGDLVLWGDDGQLQYLGR

SEQ ID NO: 740344 - protein, 17 aa, Mycobacterium
TRMYRTGDLVSWGADGQ

SEQ ID NO: 740345 - protein, 18 aa, Mycobacterium
TRMYRTGDLVWWDPDGQL

SEQ ID NO: 740346 - protein, 18 aa, Mycobacterium
TRNAAAYWRSKAKAGDGT

SEQ ID NO: 740347 - protein, 20 aa, Mycobacterium
TRNAATYWRGASKAAGAPTY

SEQ ID NO: 740348 - protein, 24 aa, Mycobacterium
TRNARFCYTRVTACGHDAEADIDV

SEQ ID NO: 740349 - protein, 24 aa, Mycobacterium
TRNDLPAILTFGGGAHYCLGANLA

SEQ ID NO: 740350 - protein, 19 aa, Mycobacterium
TRNGIPVFLSEDAKEGPRA

SEQ ID NO: 740351 - protein, 26 aa, Mycobacterium
TRNGMAVSWPRGITCAGEQRSQFHHV

SEQ ID NO: 740352 - protein, 17 aa, Mycobacterium
TRNGPQVFFDWMNHGKL

SEQ ID NO: 740353 - protein, 18 aa, Mycobacterium
TRNGRQLWVYGRAGEPCR

SEQ ID NO: 740354 - protein, 19 aa, Mycobacterium
TRNGWWLVARTKIIDDAIA

SEQ ID NO: 740355 - protein, 24 aa, Mycobacterium
TRNLAVKWAPMGIRVNAVAPGTID

SEQ ID NO: 740356 - protein, 25 aa, Mycobacterium
TRNMARLGSFFSDRWMESLRAAEGA

SEQ ID NO: 740357 - protein, 20 aa, Mycobacterium
TRNPMIVSWPARITDRGGLR

SEQ ID NO: 740358 - protein, 18 aa, Mycobacterium
TRNPWSLDRIPGGSSGGT

SEQ ID NO: 740359 - protein, 22 aa, Mycobacterium
TRNQLSFLFGGVIYDLGGTLLG

SEQ ID NO: 740360 - protein, 23 aa, Mycobacterium
TRNVRYCLSRIVKADSFGVEADL

SEQ ID NO: 740361 - protein, 18 aa, Mycobacterium
TRNWALDQPARWALLYGS

SEQ ID NO: 740362 - protein, 24 aa, Mycobacterium
TRNYREAYGLFAVNGILFNHESPR

SEQ ID NO: 740363 - protein, 24 aa, Mycobacterium
TRNYREAYGMFTVNGILFNHESPR

SEQ ID NO: 740364 - protein, 20 aa, Mycobacterium
TRPDRLPVWIYQFKISPHRT

SEQ ID NO: 740365 - protein, 17 aa, Mycobacterium
TRPEARVTIPARATLLL

SEQ ID NO: 740366 - protein, 29 aa, Mycobacterium
TRPEDWPVMPVDIVSFWLKPYGFFDRNPA

SEQ ID NO: 740367 - protein, 25 aa, Mycobacterium
TRPEGLRRWMAITARIEPYDAGVYR

SEQ ID NO: 740368 - protein, 17 aa, Mycobacterium
TRPELLGLYPLSLSTRT

SEQ ID NO: 740369 - protein, 20 aa, Mycobacterium
TRPEPALLLLADLRRVHRIA

SEQ ID NO: 740370 - protein, 22 aa, Mycobacterium
TRPEPPLPPGPPRRRAQPPTAP

SEQ ID NO: 740371 - protein, 17 aa, Mycobacterium
TRPETWAAGPTGLEGAD

SEQ ID NO: 740372 - protein, 20 aa, Mycobacterium
TRPFGPICTYVRATGEIHLN

SEQ ID NO: 740373 - protein, 20 aa, Mycobacterium
TRPGATLLISCFSDANPPNE

SEQ ID NO: 740374 - protein, 23 aa, Mycobacterium
TRPGQDVWVYGRAGLPCRRCGTP

SEQ ID NO: 740375 - protein, 21 aa, Mycobacterium
TRPGQYEAPLGITLRELLAYA

SEQ ID NO: 740376 - protein, 25 aa, Mycobacterium
TRPGTVVEFGMSFGISAIHLAAAVR

SEQ ID NO: 740377 - protein, 20 aa, Mycobacterium
TRPHPLFVAFVGAALDYQSG

SEQ ID NO: 740378 - protein, 23 aa, Mycobacterium
TRPHPLFVAFVGAALEYKAGERL

SEQ ID NO: 740379 - protein, 19 aa, Mycobacterium
TRPHPLFVAFVGAAVEYNN

SEQ ID NO: 740380 - protein, 19 aa, Mycobacterium
TRPIISMNGAHHFNEVILD

SEQ ID NO: 740381 - protein, 18 aa, Mycobacterium
TRPLPALRRKADLVFTRR

SEQ ID NO: 740382 - protein, 21 aa, Mycobacterium
TRPLWEVYVIDGLQDGRWALL

SEQ ID NO: 740383 - protein, 32 aa, Mycobacterium
TRPNGLRLRQIRVPLGVVGMVYEGRPNVTVDA

SEQ ID NO: 740384 - protein, 21 aa, Mycobacterium
TRPNVPIVLVCASRAGRDAVT

SEQ ID NO: 740385 - protein, 20 aa, Mycobacterium
TRPPVLGRRGEVVTFTVSAP

SEQ ID NO: 740386 - protein, 21 aa, Mycobacterium
TRPQVMDVYFLAGGDDFILHV

SEQ ID NO: 740387 - protein, 20 aa, Mycobacterium
TRPREYARVLSPLHRLIRDI

SEQ ID NO: 740388 - protein, 21 aa, Mycobacterium
TRPRRDLFGDYGLEFPDDDEA

SEQ ID NO: 740389 - protein, 20 aa, Mycobacterium
TRPSALVAIAALSRLGAIVV

SEQ ID NO: 740390 - protein, 20 aa, Mycobacterium
TRPSLDRWTINLATGAVTTE

SEQ ID NO: 740391 - protein, 18 aa, Mycobacterium
TRPSPTRVVSSPRVLADL

SEQ ID NO: 740392 - protein, 20 aa, Mycobacterium
TRPSTPLAQREEMRRRVARL

SEQ ID NO: 740393 - protein, 21 aa, Mycobacterium
TRPTIPVLAGVLLTGTDEGLT

SEQ ID NO: 740394 - protein, 34 aa, Mycobacterium
TRPTLRGRPVLVGGLGGRGVVAGASYEARRYGAR

SEQ ID NO: 740395 - protein, 21 aa, Mycobacterium
TRPTSIGGLGFSMKWNMGWMH

SEQ ID NO: 740396 - protein, 19 aa, Mycobacterium
TRPVPLWQHVMVGRRLFDL

SEQ ID NO: 740397 - protein, 28 aa, Mycobacterium
TRPVTVAVLLRLTERFDLSPHYFSPDSD

SEQ ID NO: 740398 - protein, 20 aa, Mycobacterium
TRPYAYLGITVPKFPNLFII

SEQ ID NO: 740399 - protein, 17 aa, Mycobacterium
TRQAVLAVADWLRDESW

SEQ ID NO: 740400 - protein, 21 aa, Mycobacterium
TRQDIDDIFWLQATIARELAA

SEQ ID NO: 740401 - protein, 21 aa, Mycobacterium
TRQDIDDIFWLQATIARELAV

SEQ ID NO: 740402 - protein, 18 aa, Mycobacterium
TRQDSWRAIEIIANTHNR

SEQ ID NO: 740403 - protein, 18 aa, Mycobacterium
TRQEIKQALLALQRAAER

SEQ ID NO: 740404 - protein, 22 aa, Mycobacterium
TRQFRFGLQLLVDGLAAHGGGS

SEQ ID NO: 740405 - protein, 25 aa, Mycobacterium
TRQLIRLALAIGQFMTGGGRLGNVV

SEQ ID NO: 740406 - protein, 19 aa, Mycobacterium
TRQMLGLAAAEVYNFDLGA

SEQ ID NO: 740407 - protein, 26 aa, Mycobacterium
TRQPYVVSFQLNWDRAFGPGAAGWVI

SEQ ID NO: 740408 - protein, 19 aa, Mycobacterium
TRQRFDWKPTGPSLLDDLE

SEQ ID NO: 740409 - protein, 21 aa, Mycobacterium
TRQRFIAIELDFPPPDAETEI

SEQ ID NO: 740410 - protein, 21 aa, Mycobacterium
TRQRLVDWLKSMVYDQGLVTE

SEQ ID NO: 740411 - protein, 23 aa, Mycobacterium
TRQSRKGLISSWKAFAPAHAGKV

SEQ ID NO: 740412 - protein, 24 aa, Mycobacterium
TRQSRKGLISSWKAYAPAHAGKVA

SEQ ID NO: 740413 - protein, 18 aa, Mycobacterium
TRQWAVAHPSRWALLYGS

SEQ ID NO: 740414 - protein, 18 aa, Mycobacterium
TRRAHVVWPDGLPDVVTY

SEQ ID NO: 740415 - protein, 18 aa, Mycobacterium
TRRAIIAAALKLLQDRSF

SEQ ID NO: 740416 - protein, 22 aa, Mycobacterium
TRRAIIAAALKLVHDRSFSALS

SEQ ID NO: 740417 - protein, 25 aa, Mycobacterium
TRRAVWKPEEIRTFLTSIRDDRFAA

SEQ ID NO: 740418 - protein, 22 aa, Mycobacterium
TRRCLKRYVCRSVFRHLQAATT

SEQ ID NO: 740419 - protein, 19 aa, Mycobacterium
TRRCRRWPQASAMCDDVLR

SEQ ID NO: 740420 - protein, 22 aa, Mycobacterium
TRRELPESPYLAAAAGRKPHRV

SEQ ID NO: 740421 - protein, 20 aa, Mycobacterium
TRREVPFVLVNRSVADYPAA

SEQ ID NO: 740422 - protein, 19 aa, Mycobacterium
TRRGNWWYYARTFEGKQYG

SEQ ID NO: 740423 - protein, 19 aa, Mycobacterium
TRRGNWWYYARTFEGRQYG

SEQ ID NO: 740424 - protein, 19 aa, Mycobacterium
TRRGREIAVLIPVEEYRRI

SEQ ID NO: 740425 - protein, 26 aa, Mycobacterium
TRRGRSGGSFVRRPAGPPVEKLTARL

SEQ ID NO: 740426 - protein, 19 aa, Mycobacterium
TRRGSFLTQEFRRFDADFF

SEQ ID NO: 740427 - protein, 20 aa, Mycobacterium
TRRHGIGTAIAFGAIQSPSS

SEQ ID NO: 740428 - protein, 22 aa, Mycobacterium
TRRIPAAEFFTGLWETALASDE

SEQ ID NO: 740429 - protein, 18 aa, Mycobacterium
TRRIPKWQFLGNELLPGL

SEQ ID NO: 740430 - protein, 20 aa, Mycobacterium
TRRIRAMRWGLVPNWATARQ

SEQ ID NO: 740431 - protein, 18 aa, Mycobacterium
TRRLAELLARTDPRPAVL

SEQ ID NO: 740432 - protein, 18 aa, Mycobacterium
TRRLHAPRLLRLIDPIIR

SEQ ID NO: 740433 - protein, 20 aa, Mycobacterium
TRRLKSDRFYTVDFTPQVYT

SEQ ID NO: 740434 - protein, 21 aa, Mycobacterium
TRRLLIVSSRLTWDGRGLAGR

SEQ ID NO: 740435 - protein, 17 aa, Mycobacterium
TRRMFRDGAGEYEINGA

SEQ ID NO: 740436 - protein, 24 aa, Mycobacterium
TRRMHLLAQFLFRGDRIHLPVGAL

SEQ ID NO: 740437 - protein, 19 aa, Mycobacterium
TRRMVRAVCNGHVDVLGHC

SEQ ID NO: 740438 - protein, 25 aa, Mycobacterium
TRRNFLYPRWSDFFDGIDPRRIAEL

SEQ ID NO: 740439 - protein, 18 aa, Mycobacterium
TRRNLEWVGPHVDLSAVD

SEQ ID NO: 740440 - protein, 20 aa, Mycobacterium
TRRPEHYRRVSARRRAENFT

SEQ ID NO: 740441 - protein, 25 aa, Mycobacterium
TRRPGELRIGYSWSSAINPHPDREA

SEQ ID NO: 740442 - protein, 19 aa, Mycobacterium
TRRPGQIALDIPVDLPRTG

SEQ ID NO: 740443 - protein, 17 aa, Mycobacterium
TRRPGQVALDIPVDLPR

SEQ ID NO: 740444 - protein, 29 aa, Mycobacterium
TRRPQLEFSPAWIDRLVVATGRKFNGRRI

SEQ ID NO: 740445 - protein, 17 aa, Mycobacterium
TRRPREFPIAGHGLTVA

SEQ ID NO: 740446 - protein, 26 aa, Mycobacterium
TRRRHRWPFVIGRVFADPQDPGLGTL

SEQ ID NO: 740447 - protein, 25 aa, Mycobacterium
TRRRILEAAAHVFADFGYAAGTTNR

SEQ ID NO: 740448 - protein, 17 aa, Mycobacterium
TRRRKRWTVPRLYRALR

SEQ ID NO: 740449 - protein, 17 aa, Mycobacterium
TRRSGLPVSTRVRTAFD

SEQ ID NO: 740450 - protein, 28 aa, Mycobacterium
TRRSSARPSSGWVATRWFTRSSTSWRPR

SEQ ID NO: 740451 - protein, 27 aa, Mycobacterium
TRRVRLMRWGLVPPWVKAGEDGGPDTK

SEQ ID NO: 740452 - protein, 27 aa, Mycobacterium
TRRVRMMRWGFVPSWAKPGPQGAPEGK

SEQ ID NO: 740453 - protein, 22 aa, Mycobacterium
TRRWCRPDGCAKALPAAISAAS

SEQ ID NO: 740454 - protein, 20 aa, Mycobacterium
TRSAIDFNRPGIPVVASLPS

SEQ ID NO: 740455 - protein, 19 aa, Mycobacterium
TRSAPWVMAPMIATPDEAK

SEQ ID NO: 740456 - protein, 21 aa, Mycobacterium
TRSASLFARGFLLTKRDIDWF

SEQ ID NO: 740457 - protein, 17 aa, Mycobacterium
TRSASPLIQDPFAQLLV

SEQ ID NO: 740458 - protein, 23 aa, Mycobacterium
TRSDPLLPLARLRANGELVEMRS

SEQ ID NO: 740459 - protein, 22 aa, Mycobacterium
TRSDVPPDLAFGGTTYRYLATK

SEQ ID NO: 740460 - protein, 18 aa, Mycobacterium
TRSFIKRTAKTELVTLPD

SEQ ID NO: 740461 - protein, 18 aa, Mycobacterium
TRSFPNRRRAASEVPVEL

SEQ ID NO: 740462 - protein, 26 aa, Mycobacterium
TRSGACTAPPAATRCTLRGTDVELNG

SEQ ID NO: 740463 - protein, 26 aa, Mycobacterium
TRSGILRFVVLDGLAKPGRLEGPDPS

SEQ ID NO: 740464 - protein, 26 aa, Mycobacterium
TRSGKILRKTMRGIAAGRDEPVPSTI

SEQ ID NO: 740465 - protein, 25 aa, Mycobacterium
TRSGKILRKTMRGIADGKDEPVPST

SEQ ID NO: 740466 - protein, 17 aa, Mycobacterium
TRSGNPLPRTGGTVADL

SEQ ID NO: 740467 - protein, 20 aa, Mycobacterium
TRSGSALPRGADIAADITTA

SEQ ID NO: 740468 - protein, 23 aa, Mycobacterium
TRSICPVCKVVIDAQVNVRGGKV

SEQ ID NO: 740469 - protein, 18 aa, Mycobacterium
TRSKAGWLAGTAALAYAK

SEQ ID NO: 740470 - protein, 20 aa, Mycobacterium
TRSKVGMVFQQFNLFPHMTA

SEQ ID NO: 740471 - protein, 17 aa, Mycobacterium
TRSLALETGRYGITANN

SEQ ID NO: 740472 - protein, 22 aa, Mycobacterium
TRSLGSAGLRFDRQCQNAAAVA

SEQ ID NO: 740473 - protein, 17 aa, Mycobacterium
TRSLLLYRYRRLPEARR

SEQ ID NO: 740474 - protein, 22 aa, Mycobacterium
TRSLMAYLFEVDYLDHFVFVLT

SEQ ID NO: 740475 - protein, 26 aa, Mycobacterium
TRSLPLPAWVADAMWSRASLCGSPGR

SEQ ID NO: 740476 - protein, 18 aa, Mycobacterium
TRSNEILEATGIDKNLRT

SEQ ID NO: 740477 - protein, 20 aa, Mycobacterium
TRSPIALSVTLEAVRRAAEL

SEQ ID NO: 740478 - protein, 26 aa, Mycobacterium
TRSPLRKPKFPAALAPESPLPDLKPR

SEQ ID NO: 740479 - protein, 19 aa, Mycobacterium
TRSQEILEATGISRDQRTK

SEQ ID NO: 740480 - protein, 24 aa, Mycobacterium
TRSQLTCSFLFLCSGYYNYEQGYS

SEQ ID NO: 740481 - protein, 25 aa, Mycobacterium
TRSQRAIHFQEWWVRYRAQVPTHSF

SEQ ID NO: 740482 - protein, 20 aa, Mycobacterium
TRSRIAAGTLRGPRFLATGC

SEQ ID NO: 740483 - protein, 17 aa, Mycobacterium
TRSRILRSQLEHVSVKP

SEQ ID NO: 740484 - protein, 23 aa, Mycobacterium
TRSRSAAFFAEILGMISVIEHTR

SEQ ID NO: 740485 - protein, 22 aa, Mycobacterium
TRSRVGLPRRAHVLAKAADAGT

SEQ ID NO: 740486 - protein, 21 aa, Mycobacterium
TRSRVKALLAQHHYVARRTEL

SEQ ID NO: 740487 - protein, 20 aa, Mycobacterium
TRSRVLAAFNDRSGLQQPGI

SEQ ID NO: 740488 - protein, 19 aa, Mycobacterium
TRSSEIIELIRATGADIVV

SEQ ID NO: 740489 - protein, 23 aa, Mycobacterium
TRSSETLDAWTLHVYVRYEVAIA

SEQ ID NO: 740490 - protein, 17 aa, Mycobacterium
TRSTLALSSQARKYGLG

SEQ ID NO: 740491 - protein, 17 aa, Mycobacterium
TRSVLGIALSAAHSNVV

SEQ ID NO: 740492 - protein, 22 aa, Mycobacterium
TRSVVPVRVFWVPGGLPTRSKV

SEQ ID NO: 740493 - protein, 17 aa, Mycobacterium
TRSWKRSPGGLVTALEP

SEQ ID NO: 740494 - protein, 25 aa, Mycobacterium
TRSYGGGMLICPHADHTDGLLDITM

SEQ ID NO: 740495 - protein, 21 aa, Mycobacterium
TRSYGGGMLMCPNADRTDGLL

SEQ ID NO: 740496 - protein, 21 aa, Mycobacterium
TRTAALDVIVRWAEHLPQPGI

SEQ ID NO: 740497 - protein, 21 aa, Mycobacterium
TRTAFFDEFFLGAADAGVRQV

SEQ ID NO: 740498 - protein, 22 aa, Mycobacterium
TRTAFFDEFFLGAADSGVRQVV

SEQ ID NO: 740499 - protein, 18 aa, Mycobacterium
TRTAGLLRFTKILDDSVD

SEQ ID NO: 740500 - protein, 18 aa, Mycobacterium
TRTALRFVTDQSREDQPP

SEQ ID NO: 740501 - protein, 22 aa, Mycobacterium
TRTALRRWLSGAKVEQGRVMEV

SEQ ID NO: 740502 - protein, 18 aa, Mycobacterium
TRTARLLRHTGIVDDMVD

SEQ ID NO: 740503 - protein, 26 aa, Mycobacterium
TRTARTDLLFSLAERWTGDGRSAGIG

SEQ ID NO: 740504 - protein, 23 aa, Mycobacterium
TRTAVCQPGLFNAEVKKAAAEHG

SEQ ID NO: 740505 - protein, 24 aa, Mycobacterium
TRTDLPPILTFGGGAHYCLGANLA

SEQ ID NO: 740506 - protein, 24 aa, Mycobacterium
TRTDTSSYCPFKGEASYYSVTSSA

SEQ ID NO: 740507 - protein, 20 aa, Mycobacterium
TRTEICFIGAGAHHRQAVHR

SEQ ID NO: 740508 - protein, 20 aa, Mycobacterium
TRTGDIWLFRGQSGPDRAIQ

SEQ ID NO: 740509 - protein, 21 aa, Mycobacterium
TRTGDLWLFRGGSGPDRAIQT

SEQ ID NO: 740510 - protein, 20 aa, Mycobacterium
TRTGDLWLFRGRSRPDRAIQ

SEQ ID NO: 740511 - protein, 21 aa, Mycobacterium
TRTGFEDGLFAAWRNDPSFVL

SEQ ID NO: 740512 - protein, 20 aa, Mycobacterium
TRTGSWATLTSRTTASPVTN

SEQ ID NO: 740513 - protein, 18 aa, Mycobacterium
TRTGVVIVAAKSGGRKIF

SEQ ID NO: 740514 - protein, 18 aa, Mycobacterium
TRTGYGRRKNTKRAIVTL

SEQ ID NO: 740515 - protein, 24 aa, Mycobacterium
TRTHARLAGAMAHIRDPQGFAQLR

SEQ ID NO: 740516 - protein, 17 aa, Mycobacterium
TRTIEWPTPSGPKTYPL

SEQ ID NO: 740517 - protein, 17 aa, Mycobacterium
TRTKFWAEGALRTAPWS

SEQ ID NO: 740518 - protein, 20 aa, Mycobacterium
TRTLAEWSERFATLAGPWAP

SEQ ID NO: 740519 - protein, 25 aa, Mycobacterium
TRTLAEWSERFVTLAGPWAPVQDTL

SEQ ID NO: 740520 - protein, 20 aa, Mycobacterium
TRTLDEWAAIFATEPDFFWS

SEQ ID NO: 740521 - protein, 21 aa, Mycobacterium
TRTLGSLALMGVRVEELLVNQ

SEQ ID NO: 740522 - protein, 27 aa, Mycobacterium
TRTLKDWADRGIRVIGLDAGGDTVVDD

SEQ ID NO: 740523 - protein, 26 aa, Mycobacterium
TRTLKDWADRGLRVIGLDAAGETAVD

SEQ ID NO: 740524 - protein, 23 aa, Mycobacterium
TRTPEQVAAAWLALGPAIVVVTF

SEQ ID NO: 740525 - protein, 18 aa, Mycobacterium
TRTPLLLDEYSRNPATGS

SEQ ID NO: 740526 - protein, 20 aa, Mycobacterium
TRTRFGLCFRDLALRTMNFA

SEQ ID NO: 740527 - protein, 19 aa, Mycobacterium
TRTRLLLFDAGFPRPTTQI

SEQ ID NO: 740528 - protein, 26 aa, Mycobacterium
TRTRLMKRLSGQGAMALLELDAQATE

SEQ ID NO: 740529 - protein, 18 aa, Mycobacterium
TRTRLMREACGYDSNSRA

SEQ ID NO: 740530 - protein, 24 aa, Mycobacterium
TRTRVVGIGEGFLTEPWWCRTLVL

SEQ ID NO: 740531 - protein, 18 aa, Mycobacterium
TRTSEFLTHPAFSDYRTE

SEQ ID NO: 740532 - protein, 17 aa, Mycobacterium
TRTTCATTPAGATLGAR

SEQ ID NO: 740533 - protein, 23 aa, Mycobacterium
TRTVEPWGVVTEKGRWYLVGHDR

SEQ ID NO: 740534 - protein, 19 aa, Mycobacterium
TRTVHRVAARLGLTEHHRT

SEQ ID NO: 740535 - protein, 22 aa, Mycobacterium
TRTYSCAYFRRGEMTLQEAQLA

SEQ ID NO: 740536 - protein, 25 aa, Mycobacterium
TRVADEFPDGVWLFELAAVSDPAAV

SEQ ID NO: 740537 - protein, 17 aa, Mycobacterium
TRVAERHGLPAPSITVG

SEQ ID NO: 740538 - protein, 18 aa, Mycobacterium
TRVAKWIDRLGQVWVEGQ

SEQ ID NO: 740539 - protein, 19 aa, Mycobacterium
TRVAPRFRQVVSPTVPPLP

SEQ ID NO: 740540 - protein, 17 aa, Mycobacterium
TRVAVVAGRAGFVAAAD

SEQ ID NO: 740541 - protein, 17 aa, Mycobacterium
TRVDGGREPVWHIAPEH

SEQ ID NO: 740542 - protein, 24 aa, Mycobacterium
TRVEGGWRINGHKIWTSSAHTADF

SEQ ID NO: 740543 - protein, 18 aa, Mycobacterium
TRVGEKLTSLPLTLYSDP

SEQ ID NO: 740544 - protein, 25 aa, Mycobacterium
TRVGELLPALAGTCLQAATCMYSNT

SEQ ID NO: 740545 - protein, 18 aa, Mycobacterium
TRVGERLTDLPLTLFSDP

SEQ ID NO: 740546 - protein, 18 aa, Mycobacterium
TRVGERLTELPLTLFSDP

SEQ ID NO: 740547 - protein, 20 aa, Mycobacterium
TRVGRIAWTLFRHPVKSREF

SEQ ID NO: 740548 - protein, 25 aa, Mycobacterium
TRVHSLQLHYARTLETWAAALEANR

SEQ ID NO: 740549 - protein, 20 aa, Mycobacterium
TRVIPCLDVDDGRVVKGVNF

SEQ ID NO: 740550 - protein, 20 aa, Mycobacterium
TRVIPCLDVDNGRVVKGVNF

SEQ ID NO: 740551 - protein, 20 aa, Mycobacterium
TRVLGDWLVGTGVASATYPG

SEQ ID NO: 740552 - protein, 28 aa, Mycobacterium
TRVLPWCTRGSVKFLWSEQRGAFQRVYQ

SEQ ID NO: 740553 - protein, 19 aa, Mycobacterium
TRVLRGWSSLPVALGPARS

SEQ ID NO: 740554 - protein, 19 aa, Mycobacterium
TRVLRGWSTLPIALGKARA

SEQ ID NO: 740555 - protein, 20 aa, Mycobacterium
TRVLRLGGRLVLVDHIESSR

SEQ ID NO: 740556 - protein, 17 aa, Mycobacterium
TRVMIRYRLAEGSIPPL

SEQ ID NO: 740557 - protein, 26 aa, Mycobacterium
TRVPDRVAAALSFHGGRIAVEDDPDS

SEQ ID NO: 740558 - protein, 23 aa, Mycobacterium
TRVPGIGKRGAERMVLELRDKIG

SEQ ID NO: 740559 - protein, 24 aa, Mycobacterium
TRVPGIGKRGAERMVLELRDKVGA

SEQ ID NO: 740560 - protein, 23 aa, Mycobacterium
TRVPGIGKRGAERMVVELRDKVG

SEQ ID NO: 740561 - protein, 17 aa, Mycobacterium
TRVPRGWSMAQAAGVPV

SEQ ID NO: 740562 - protein, 19 aa, Mycobacterium
TRVRDALAAVGARIALGVP

SEQ ID NO: 740563 - protein, 21 aa, Mycobacterium
TRVRFRHPLVRSAVYISANPL

SEQ ID NO: 740564 - protein, 25 aa, Mycobacterium
TRVRFWRLHFAAMRAVVDRARDRGE

SEQ ID NO: 740565 - protein, 18 aa, Mycobacterium
TRVRIWDGSTPWLITGYE

SEQ ID NO: 740566 - protein, 19 aa, Mycobacterium
TRVRKLRLAHVTVQQNVKT

SEQ ID NO: 740567 - protein, 32 aa, Mycobacterium
TRVRLELMVDLKAPLPGFLVKKGAKGLMDTAT

SEQ ID NO: 740568 - protein, 24 aa, Mycobacterium
TRVRRLEARGVLAGYAARVNPESV

SEQ ID NO: 740569 - protein, 25 aa, Mycobacterium
TRVRTRLIELFELFDPADPEVIAGR

SEQ ID NO: 740570 - protein, 25 aa, Mycobacterium
TRVRTRLIELFELFDPADPEVVAGR

SEQ ID NO: 740571 - protein, 25 aa, Mycobacterium
TRVSLACALVCRPDLLVLDEPTVGL

SEQ ID NO: 740572 - protein, 19 aa, Mycobacterium
TRVTPFVGHFQIRNRGTLG

SEQ ID NO: 740573 - protein, 30 aa, Mycobacterium
TRVVFPYFFCCHTCRNCLAGRRNACVNLKM

SEQ ID NO: 740574 - protein, 28 aa, Mycobacterium
TRVVGLNCGTPCPAFAGGSTVTAVATGG

SEQ ID NO: 740575 - protein, 25 aa, Mycobacterium
TRVWGMRIATVILFTELVIQTTRSL

SEQ ID NO: 740576 - protein, 18 aa, Mycobacterium
TRVWPLLERNKSALADIG

SEQ ID NO: 740577 - protein, 20 aa, Mycobacterium
TRVYCCGPAPMLDAVQSLAA

SEQ ID NO: 740578 - protein, 21 aa, Mycobacterium
TRWAATLAPYGLRWYEEPGDP

SEQ ID NO: 740579 - protein, 20 aa, Mycobacterium
TRWGDIRDRVFGRIDPIAAA

SEQ ID NO: 740580 - protein, 25 aa, Mycobacterium
TRWHPVNRLPPMAFDHAPMVDHART

SEQ ID NO: 740581 - protein, 19 aa, Mycobacterium
TRWRADPDAALAAEVNGAL

SEQ ID NO: 740582 - protein, 19 aa, Mycobacterium
TRWTAAMVNSGERFDFTDL

SEQ ID NO: 740583 - protein, 20 aa, Mycobacterium
TRWTIEPGGAIPMHRHEHDY

SEQ ID NO: 740584 - protein, 18 aa, Mycobacterium
TRWVRQANIRWGLDQEHR

SEQ ID NO: 740585 - protein, 24 aa, Mycobacterium
TRYADPRPAGPLDITIARNGESIA

SEQ ID NO: 740586 - protein, 23 aa, Mycobacterium
TRYAPEGVRSFGPLRASLGHDTV

SEQ ID NO: 740587 - protein, 18 aa, Mycobacterium
TRYAPRIAGRPAASIEQH

SEQ ID NO: 740588 - protein, 19 aa, Mycobacterium
TRYAVRLSAPAIVSAAEGA

SEQ ID NO: 740589 - protein, 17 aa, Mycobacterium
TRYAYKMLSGAPTRNHV

SEQ ID NO: 740590 - protein, 26 aa, Mycobacterium
TRYDIEIFPTAALIAAGHRLRLTITT

SEQ ID NO: 740591 - protein, 23 aa, Mycobacterium
TRYDIPTGPGVRLDSGVEAGSVI

SEQ ID NO: 740592 - protein, 21 aa, Mycobacterium
TRYFDTFFREAAEADVRQAVI

SEQ ID NO: 740593 - protein, 23 aa, Mycobacterium
TRYGDSPAMRRIVIDADRILSDV

SEQ ID NO: 740594 - protein, 21 aa, Mycobacterium
TRYILCLEPACSMTHDEIIRQ

SEQ ID NO: 740595 - protein, 25 aa, Mycobacterium
TRYLRAVPLPGMGVVHDMALTRRYA

SEQ ID NO: 740596 - protein, 22 aa, Mycobacterium
TRYPGMCHGFLMRSDATARGRL

SEQ ID NO: 740597 - protein, 18 aa, Mycobacterium
TRYRIVVNVWEMNGQGGL

SEQ ID NO: 740598 - protein, 17 aa, Mycobacterium
TRYWYYALQTCRLNEHR

SEQ ID NO: 740599 - protein, 24 aa, Mycobacterium
TSAAARQCVRPDLGAVAPGKRADL

SEQ ID NO: 740600 - protein, 19 aa, Mycobacterium
TSAALRLGICGHLGAQRIL

SEQ ID NO: 740601 - protein, 22 aa, Mycobacterium
TSAARRGVRIGAQVSYRDLAGF

SEQ ID NO: 740602 - protein, 22 aa, Mycobacterium
TSAATTCFWKDNQINIIDTPGH

SEQ ID NO: 740603 - protein, 22 aa, Mycobacterium
TSAAVTCFWNGNQINIIDTPGH

SEQ ID NO: 740604 - protein, 24 aa, Mycobacterium
TSACPPYHLAVVIGGTSAEFALKT

SEQ ID NO: 740605 - protein, 19 aa, Mycobacterium
TSADHCWFAVWAGRGELHQ

SEQ ID NO: 740606 - protein, 20 aa, Mycobacterium
TSADIMARVVGFHLNRGVLA

SEQ ID NO: 740607 - protein, 25 aa, Mycobacterium
TSAEFRKLLTEWKAAGRAARDVDDA

SEQ ID NO: 740608 - protein, 23 aa, Mycobacterium
TSAEFRKLLTEWKAAGRASKDVD

SEQ ID NO: 740609 - protein, 24 aa, Mycobacterium
TSAEFRKLLTEWKAAGRATREVDD

SEQ ID NO: 740610 - protein, 25 aa, Mycobacterium
TSAFTASPFRWLSWLSESRATITAA

SEQ ID NO: 740611 - protein, 26 aa, Mycobacterium
TSAGALRGAGWTVPAPQAAPGTVIPG

SEQ ID NO: 740612 - protein, 19 aa, Mycobacterium
TSAGAWPAAPGDPLLASVR

SEQ ID NO: 740613 - protein, 20 aa, Mycobacterium
TSAGAYEFDLFYLTTQPPSM

SEQ ID NO: 740614 - protein, 20 aa, Mycobacterium
TSAGMVWRAAAAVELGVCEA

SEQ ID NO: 740615 - protein, 22 aa, Mycobacterium
TSAHGIKAPALDVLTLTVVEIE

SEQ ID NO: 740616 - protein, 18 aa, Mycobacterium
TSAIRPGTLVAHTSGANG

SEQ ID NO: 740617 - protein, 17 aa, Mycobacterium
TSALCLAEAGWPVRVWT

SEQ ID NO: 740618 - protein, 24 aa, Mycobacterium
TSALFEVLSRYGVTLLNVEQVVIR

SEQ ID NO: 740619 - protein, 24 aa, Mycobacterium
TSALPALEVELVWHRERESPGLLR

SEQ ID NO: 740620 - protein, 21 aa, Mycobacterium
TSALRHARLVRSRRDGKAVIH

SEQ ID NO: 740621 - protein, 18 aa, Mycobacterium
TSALRLRSRDGVRAAVDA

SEQ ID NO: 740622 - protein, 17 aa, Mycobacterium
TSALTIERVLRRHPDVV

SEQ ID NO: 740623 - protein, 17 aa, Mycobacterium
TSALTIERVLRRHPEVI

SEQ ID NO: 740624 - protein, 20 aa, Mycobacterium
TSALTRSVGITWTSELLTVT

SEQ ID NO: 740625 - protein, 22 aa, Mycobacterium
TSALVLPGGFPEEFVTELSANE

SEQ ID NO: 740626 - protein, 20 aa, Mycobacterium
TSANPTWLLKLKAPRGPQGD

SEQ ID NO: 740627 - protein, 19 aa, Mycobacterium
TSANWEWFDPVYSHRILWP

SEQ ID NO: 740628 - protein, 19 aa, Mycobacterium
TSAPALCRGGGALASTAHD

SEQ ID NO: 740629 - protein, 24 aa, Mycobacterium
TSAPSVIVAKTWTLSGLDHILPDE

SEQ ID NO: 740630 - protein, 24 aa, Mycobacterium
TSARLHAVAMEWRRERETAERERQ

SEQ ID NO: 740631 - protein, 22 aa, Mycobacterium
TSARLKCPFTSLALAPEAASSY

SEQ ID NO: 740632 - protein, 33 aa, Mycobacterium
TSARPAVMPMDAWREGDKFVVEFDLPGIDADSL

SEQ ID NO: 740633 - protein, 26 aa, Mycobacterium
TSARRLAERTALPVGRGRFIDENYRA

SEQ ID NO: 740634 - protein, 17 aa, Mycobacterium
TSARRVGDEFIVNGQKL

SEQ ID NO: 740635 - protein, 24 aa, Mycobacterium
TSATIAAIIAIRASTGGRRALGAF

SEQ ID NO: 740636 - protein, 18 aa, Mycobacterium
TSATLAFDATGGGTLAGQ

SEQ ID NO: 740637 - protein, 33 aa, Mycobacterium
TSATSGDVTAHWGRGTLVGSLSVPPSWATATPA

SEQ ID NO: 740638 - protein, 18 aa, Mycobacterium
TSAVAGYFIDRYVFPDGE

SEQ ID NO: 740639 - protein, 25 aa, Mycobacterium
TSAVLGFAVDGGWWVLGVHTPAAAE

SEQ ID NO: 740640 - protein, 25 aa, Mycobacterium
TSAVSGRVAYAFGFEGPAVTVDTAC

SEQ ID NO: 740641 - protein, 24 aa, Mycobacterium
TSCARGHCFFLVYRGGDYLFADVV

SEQ ID NO: 740642 - protein, 27 aa, Mycobacterium
TSCDAFEHFPPPILKPVILAAKSKATF

SEQ ID NO: 740643 - protein, 27 aa, Mycobacterium
TSCDAFEHFPPPILKPVILAAKSKKMF

SEQ ID NO: 740644 - protein, 27 aa, Mycobacterium
TSCDAFEHFPPPILKPVILAAKSKTTF

SEQ ID NO: 740645 - protein, 17 aa, Mycobacterium
TSCYLGIQILAGTGLTP

SEQ ID NO: 740646 - protein, 24 aa, Mycobacterium
TSDAAEIGSALAAANAAAAARTAG

SEQ ID NO: 740647 - protein, 21 aa, Mycobacterium
TSDADAFVRWVTQRGSWEALG

SEQ ID NO: 740648 - protein, 27 aa, Mycobacterium
TSDDFPVLWPVGTRWADNDMFGHLNNA

SEQ ID NO: 740649 - protein, 17 aa, Mycobacterium
TSDELRKAAEGYLEAAT

SEQ ID NO: 740650 - protein, 27 aa, Mycobacterium
TSDFPQFPLNFLADLNAIMSTGQHDLY

SEQ ID NO: 740651 - protein, 26 aa, Mycobacterium
TSDGFPADMPFLIWGYGATAAGSPGI

SEQ ID NO: 740652 - protein, 25 aa, Mycobacterium
TSDHRPEVLLSFGFVPKLESKIGLI

SEQ ID NO: 740653 - protein, 34 aa, Mycobacterium
TSDIKNLVPMFGVFKPTLVISVPRVFEKVYNTAE

SEQ ID NO: 740654 - protein, 24 aa, Mycobacterium
TSDIRLRGLISLLRDDPRIRRFAE

SEQ ID NO: 740655 - protein, 28 aa, Mycobacterium
TSDLGFRMPSIWFADGHRAVAPVYLYRF

SEQ ID NO: 740656 - protein, 25 aa, Mycobacterium
TSDQPRPLVPAMFSGVLSRLRRTHT

SEQ ID NO: 740657 - protein, 17 aa, Mycobacterium
TSDVLTHAWDLAAATGQ

SEQ ID NO: 740658 - protein, 23 aa, Mycobacterium
TSEKHFRRARGRKIELTLADGSR

SEQ ID NO: 740659 - protein, 22 aa, Mycobacterium
TSEKHFRRARGRKVDVVLSDGS

SEQ ID NO: 740660 - protein, 23 aa, Mycobacterium
TSEKHFRRARGRKVELTLADGSQ

SEQ ID NO: 740661 - protein, 20 aa, Mycobacterium
TSELAGAAWQGPASAAMAAA

SEQ ID NO: 740662 - protein, 23 aa, Mycobacterium
TSELIPLCHQIPLTGIEVDFAID

SEQ ID NO: 740663 - protein, 29 aa, Mycobacterium
TSELPVGDYWFWNLRNIVRFDKAIAAAVQ

SEQ ID NO: 740664 - protein, 23 aa, Mycobacterium
TSELRTALLRWFSISAADWDAWV

SEQ ID NO: 740665 - protein, 21 aa, Mycobacterium
TSESELIAFARERLAAYKCPK

SEQ ID NO: 740666 - protein, 29 aa, Mycobacterium
TSESLEDWKCWARWRLIRARAPWLTSDLV

SEQ ID NO: 740667 - protein, 25 aa, Mycobacterium
TSETAGAAFARWAAFRDAMPLVPSM

SEQ ID NO: 740668 - protein, 21 aa, Mycobacterium
TSETAVALLGRHGRDIPADLP

SEQ ID NO: 740669 - protein, 25 aa, Mycobacterium
TSFAQRSRFAEAFGSMGQGRPDTGK

SEQ ID NO: 740670 - protein, 18 aa, Mycobacterium
TSFDAVGTVGGWQVKETS

SEQ ID NO: 740671 - protein, 29 aa, Mycobacterium
TSFDPHRRKDHPTMPKPTRIARTDNTADD

SEQ ID NO: 740672 - protein, 25 aa, Mycobacterium
TSFELRAQLQIPRGGAQGVVICIGG

SEQ ID NO: 740673 - protein, 24 aa, Mycobacterium
TSFGRLDALINCAGIAEPPGSSIL

SEQ ID NO: 740674 - protein, 24 aa, Mycobacterium
TSFGTRIELGLALMAELTPEQRCA

SEQ ID NO: 740675 - protein, 22 aa, Mycobacterium
TSFKAKPGQRIRIRIINVASDT

SEQ ID NO: 740676 - protein, 18 aa, Mycobacterium
TSFYDWYADLPVASPQVF

SEQ ID NO: 740677 - protein, 25 aa, Mycobacterium
TSFYLKLYPRPAVCGTSVYVYPFDV

SEQ ID NO: 740678 - protein, 22 aa, Mycobacterium
TSFYYRTRTALLHGVADQLVRY

SEQ ID NO: 740679 - protein, 22 aa, Mycobacterium
TSGAEFADYIWLAARTDPTVKK

SEQ ID NO: 740680 - protein, 26 aa, Mycobacterium
TSGAHQARWALLVARSNPDVAKHRGL

SEQ ID NO: 740681 - protein, 23 aa, Mycobacterium
TSGAHYWGRFGAAGLLLRAPQPD

SEQ ID NO: 740682 - protein, 25 aa, Mycobacterium
TSGAPALVLVHGFPTSSIDYFGLAG

SEQ ID NO: 740683 - protein, 19 aa, Mycobacterium
TSGARGFHVYARIAPRWPF

SEQ ID NO: 740684 - protein, 23 aa, Mycobacterium
TSGASDPRCKILIVMGRTNPDAA

SEQ ID NO: 740685 - protein, 18 aa, Mycobacterium
TSGAWLQVRLPEAPPPLE

SEQ ID NO: 740686 - protein, 29 aa, Mycobacterium
TSGDFPVLWPVLTRWADNDMFGHLNNAVY

SEQ ID NO: 740687 - protein, 23 aa, Mycobacterium
TSGDPPRPAWPRLRSPLGQAQLL

SEQ ID NO: 740688 - protein, 31 aa, Mycobacterium
TSGDPPRPAWPRLRSPRCLTSGDPPRPAWPR

SEQ ID NO: 740689 - protein, 23 aa, Mycobacterium
TSGECGRCLKPITGEVSIDLTEL

SEQ ID NO: 740690 - protein, 25 aa, Mycobacterium
TSGEGPCLAAAWEHHIMQITDLSAE

SEQ ID NO: 740691 - protein, 25 aa, Mycobacterium
TSGELCARGPYTIRGYFAAPERNAE

SEQ ID NO: 740692 - protein, 25 aa, Mycobacterium
TSGEQRASNFLLWQAAYAEYVFQDK

SEQ ID NO: 740693 - protein, 27 aa, Mycobacterium
TSGEQRLSGFLLWQSAYSEMWFTEAHW

SEQ ID NO: 740694 - protein, 24 aa, Mycobacterium
TSGFMNVATTFGFTSGINNVGDYQ

SEQ ID NO: 740695 - protein, 17 aa, Mycobacterium
TSGGGWQSVHMTINRVE

SEQ ID NO: 740696 - protein, 17 aa, Mycobacterium
TSGGPVYKDGQRISPKS

SEQ ID NO: 740697 - protein, 30 aa, Mycobacterium
TSGGRGIHVFLRIATDWDFIEVRRAGIALA

SEQ ID NO: 740698 - protein, 30 aa, Mycobacterium
TSGGRGIHVYLRIAARWDFIEVRRAGIALA

SEQ ID NO: 740699 - protein, 17 aa, Mycobacterium
TSGGVWGLDRGYCLMVG

SEQ ID NO: 740700 - protein, 19 aa, Mycobacterium
TSGGVWGLERGYCLMIGGD

SEQ ID NO: 740701 - protein, 19 aa, Mycobacterium
TSGGVWGRERGYCLMIGGD

SEQ ID NO: 740702 - protein, 20 aa, Mycobacterium
TSGGVWGRERGYCLMVGGDD

SEQ ID NO: 740703 - protein, 25 aa, Mycobacterium
TSGHIYRQGAGFTMETQHYPDSPNH

SEQ ID NO: 740704 - protein, 17 aa, Mycobacterium
TSGIARINVDIVAFFVA

SEQ ID NO: 740705 - protein, 20 aa, Mycobacterium
TSGIASRRRASIRIGSEPVR

SEQ ID NO: 740706 - protein, 18 aa, Mycobacterium
TSGIGLATARLFAAEGAK

SEQ ID NO: 740707 - protein, 27 aa, Mycobacterium
TSGISRRGLLELAWPALPPDTFSTAAV

SEQ ID NO: 740708 - protein, 18 aa, Mycobacterium
TSGITAFYVNIWKLDGVS

SEQ ID NO: 740709 - protein, 22 aa, Mycobacterium
TSGKLARRACRQEYLDNKLGVR

SEQ ID NO: 740710 - protein, 26 aa, Mycobacterium
TSGKLARSACRAEYLAGKYDPVAKTA

SEQ ID NO: 740711 - protein, 23 aa, Mycobacterium
TSGPRFSSGIGPLMAGVYSAPFP

SEQ ID NO: 740712 - protein, 25 aa, Mycobacterium
TSGQLRLFAGVLREGSWNQARIDPA

SEQ ID NO: 740713 - protein, 29 aa, Mycobacterium
TSGRIERFLQLWAEGSMTIAMPSTPANYF

SEQ ID NO: 740714 - protein, 27 aa, Mycobacterium
TSGRIERFLQLWAEGSMTIAVPSTPSN

SEQ ID NO: 740715 - protein, 18 aa, Mycobacterium
TSGRLPVGPTLYLHTNGP

SEQ ID NO: 740716 - protein, 18 aa, Mycobacterium
TSGRRQVVLTSDRGRSWV

SEQ ID NO: 740717 - protein, 26 aa, Mycobacterium
TSGRVKRPQLGIANWVVPSIVAFGTE

SEQ ID NO: 740718 - protein, 17 aa, Mycobacterium
TSGSARPAAGCPAALGG

SEQ ID NO: 740719 - protein, 25 aa, Mycobacterium
TSGTPLSWDCFTFGVIQRADHFTVY

SEQ ID NO: 740720 - protein, 24 aa, Mycobacterium
TSGVDRFVIVSAFGVGDSLAKASF

SEQ ID NO: 740721 - protein, 18 aa, Mycobacterium
TSGVLWGALLTALGARLG

SEQ ID NO: 740722 - protein, 22 aa, Mycobacterium
TSGYDRPIFLGVGMQDRDVPPN

SEQ ID NO: 740723 - protein, 27 aa, Mycobacterium
TSGYLCVPLDGSICDRLGLLPMFAVNQ

SEQ ID NO: 740724 - protein, 19 aa, Mycobacterium
TSHAPRSSIRPRLVLDPYG

SEQ ID NO: 740725 - protein, 22 aa, Mycobacterium
TSHGIAVWDVLRSCRRVGSLDS

SEQ ID NO: 740726 - protein, 29 aa, Mycobacterium
TSHKEVLLHLAAEGWQRWSNTVCGELSQP

SEQ ID NO: 740727 - protein, 30 aa, Mycobacterium
TSHKEVLLHLAAEGWVRWSKTVCESLSEPG

SEQ ID NO: 740728 - protein, 29 aa, Mycobacterium
TSHKEVLLRLSAEGWVRWSNTVSDKLAEP

SEQ ID NO: 740729 - protein, 24 aa, Mycobacterium
TSHVPDWFSRVGPDTLIVVDEAGK

SEQ ID NO: 740730 - protein, 22 aa, Mycobacterium
TSIACAAAIHLAGSGKRVLLVS

SEQ ID NO: 740731 - protein, 37 aa, Mycobacterium
TSIADLRAIPWVLAWSQSRVMLPGWYGTGSAFENWIG

SEQ ID NO: 740732 - protein, 21 aa, Mycobacterium
TSIAGRKGFLRGQLMRDQDNG

SEQ ID NO: 740733 - protein, 17 aa, Mycobacterium
TSIASRFTSPVFPGETL

SEQ ID NO: 740734 - protein, 18 aa, Mycobacterium
TSIASRGADTAVTAVAPA

SEQ ID NO: 740735 - protein, 28 aa, Mycobacterium
TSIEDWKAAISVNLWGVIYGCETFVPRL

SEQ ID NO: 740736 - protein, 25 aa, Mycobacterium
TSIHPPRFLVGLSRKNHTFRVAAEA

SEQ ID NO: 740737 - protein, 23 aa, Mycobacterium
TSIKDRWLLRNRPHLVLDGLRLA

SEQ ID NO: 740738 - protein, 22 aa, Mycobacterium
TSILQRRVVFRADKAAIKKIAT

SEQ ID NO: 740739 - protein, 22 aa, Mycobacterium
TSILSRGVCGVAGRTLVVNLPG

SEQ ID NO: 740740 - protein, 20 aa, Mycobacterium
TSILSRGVCGVSGRTLIVNL

SEQ ID NO: 740741 - protein, 19 aa, Mycobacterium
TSIPEMFAAQVARAPQAAA

SEQ ID NO: 740742 - protein, 18 aa, Mycobacterium
TSIRRAGADIVLSYWAAE

SEQ ID NO: 740743 - protein, 17 aa, Mycobacterium
TSIRRAGADIVLTYWAA

SEQ ID NO: 740744 - protein, 20 aa, Mycobacterium
TSISEPWRNPLLPADSYIEF

SEQ ID NO: 740745 - protein, 24 aa, Mycobacterium
TSITWCRRRTIQVGRIAARVPQEW

SEQ ID NO: 740746 - protein, 27 aa, Mycobacterium
TSIYNWELFFHAPFLIACKLTANQRFD

SEQ ID NO: 740747 - protein, 18 aa, Mycobacterium
TSKAFARYLADYIQEQGW

SEQ ID NO: 740748 - protein, 27 aa, Mycobacterium
TSKAHLARWGVCLARTDPDAPKHKGIT

SEQ ID NO: 740749 - protein, 21 aa, Mycobacterium
TSKAVSKCEGRLVPAPRDPEE

SEQ ID NO: 740750 - protein, 19 aa, Mycobacterium
TSKGREALVAMRAQRQGVL

SEQ ID NO: 740751 - protein, 19 aa, Mycobacterium
TSKIFAGRLMIEYHSHGPA

SEQ ID NO: 740752 - protein, 23 aa, Mycobacterium
TSKLRFNFFVLKLPIRPPALVAK

SEQ ID NO: 740753 - protein, 22 aa, Mycobacterium
TSKRYMHHYNFPPYSTGETGRV

SEQ ID NO: 740754 - protein, 20 aa, Mycobacterium
TSLAFARQGARVVVADINHD

SEQ ID NO: 740755 - protein, 26 aa, Mycobacterium
TSLAHRARWGLLLARTNPDVPKHKGL

SEQ ID NO: 740756 - protein, 18 aa, Mycobacterium
TSLAHWLTEYGYRAVVVE

SEQ ID NO: 740757 - protein, 26 aa, Mycobacterium
TSLAKRTQVLFAFRELLNARKEEVAA

SEQ ID NO: 740758 - protein, 23 aa, Mycobacterium
TSLDPHGPVAFWGYSQGGGATAS

SEQ ID NO: 740759 - protein, 23 aa, Mycobacterium
TSLGESVARALDRKFVRVALGGV

SEQ ID NO: 740760 - protein, 30 aa, Mycobacterium; identical to SEQ ID NO: 92062

SEQ ID NO: 740761 - protein, 24 aa, Mycobacterium
TSLGVPIDLGGAWIHGPEGNPLTD

SEQ ID NO: 740762 - protein, 20 aa, Mycobacterium
TSLIAQWRFTTTDADWDDIY

SEQ ID NO: 740763 - protein, 17 aa, Mycobacterium
TSLKFRVARDDFADSVA

SEQ ID NO: 740764 - protein, 17 aa, Mycobacterium
TSLKQATLLKHSSRIRL

SEQ ID NO: 740765 - protein, 20 aa, Mycobacterium
TSLLSDWPRRSAQFTKIMPR

SEQ ID NO: 740766 - protein, 20 aa, Mycobacterium
TSLLSRRSVYCIDLLGEPGM

SEQ ID NO: 740767 - protein, 19 aa, Mycobacterium
TSLMRRVRHRMDQAGHDTF

SEQ ID NO: 740768 - protein, 19 aa, Mycobacterium
TSLMRRVRHRMDQAGYSTF

SEQ ID NO: 740769 - protein, 22 aa, Mycobacterium
TSLPAMSIPVGFTDSGLPVGLE

SEQ ID NO: 740770 - protein, 25 aa, Mycobacterium
TSLPGRHAPGWSRRLLPPVMGTMLE

SEQ ID NO: 740771 - protein, 18 aa, Mycobacterium
TSLPHAVQAAQHFARVAY

SEQ ID NO: 740772 - protein, 18 aa, Mycobacterium
TSLPLSASVPGFDIAIQV

SEQ ID NO: 740773 - protein, 22 aa, Mycobacterium
TSLPVPCRRPTYYVVSPMISRS

SEQ ID NO: 740774 - protein, 24 aa, Mycobacterium
TSLQLTADMGRNFLTKLGILSPAT

SEQ ID NO: 740775 - protein, 17 aa, Mycobacterium
TSLRALATMARRRHTAR

SEQ ID NO: 740776 - protein, 24 aa, Mycobacterium
TSLRESRRLVREWLTTWSQAKLIP

SEQ ID NO: 740777 - protein, 22 aa, Mycobacterium
TSLRLIPNIVVLPYRNPFVVAK

SEQ ID NO: 740778 - protein, 17 aa, Mycobacterium
TSLRRLIVHRSIADDVV

SEQ ID NO: 740779 - protein, 30 aa, Mycobacterium
TSLRRYRMWCRLLRAGALLATGHDLTTAAV

SEQ ID NO: 740780 - protein, 19 aa, Mycobacterium
TSLRTGIFGAEPWTEQMRS

SEQ ID NO: 740781 - protein, 25 aa, Mycobacterium
TSLVEIPIQWALDDWEQYCFLPDIS

SEQ ID NO: 740782 - protein, 17 aa, Mycobacterium
TSLVRRAEACGFKAIAV

SEQ ID NO: 740783 - protein, 18 aa, Mycobacterium
TSLVTGWASIHGYPVGIL

SEQ ID NO: 740784 - protein, 21 aa, Mycobacterium
TSLYVYARETVGYALVIDGRV

SEQ ID NO: 740785 - protein, 24 aa, Mycobacterium
TSMASAAAHHVAWLSATAAHAELT

SEQ ID NO: 740786 - protein, 17 aa, Mycobacterium
TSMATLVALVYVDVNHF

SEQ ID NO: 740787 - protein, 25 aa, Mycobacterium
TSMCFPLPKFSDIRYNYALAGGATM

SEQ ID NO: 740788 - protein, 22 aa, Mycobacterium
TSMHMVPSLLGLILSLPGVTQW

SEQ ID NO: 740789 - protein, 25 aa, Mycobacterium
TSMIAAVTPYVSWLTTIAGQAEETA

SEQ ID NO: 740790 - protein, 26 aa, Mycobacterium
TSMSMAAAAAPYVVWLRATAELCEQS

SEQ ID NO: 740791 - protein, 20 aa, Mycobacterium
TSMVVFRGGNYEKFVNMARL

SEQ ID NO: 740792 - protein, 18 aa, Mycobacterium
TSNCGTCVVDVDGVPVKS

SEQ ID NO: 740793 - protein, 24 aa, Mycobacterium
TSNGPAVVEFNCRFGDPETQAVLA

SEQ ID NO: 740794 - protein, 17 aa, Mycobacterium
TSNGQLVIREVYADWSA

SEQ ID NO: 740795 - protein, 24 aa, Mycobacterium
TSNGRLGAGIARVRELLAAGVPVG

SEQ ID NO: 740796 - protein, 24 aa, Mycobacterium
TSNPFREAVQWRIPVDELTVPDLA

SEQ ID NO: 740797 - protein, 27 aa, Mycobacterium
TSNRGRTSFDLIPAMSLTCAVSSVKPV

SEQ ID NO: 740798 - protein, 30 aa, Mycobacterium
TSPAPRPAPDRMPARPMPDRMPTHSTPAEP

SEQ ID NO: 740799 - protein, 19 aa, Mycobacterium
TSPARAAYVAGAWGAVASL

SEQ ID NO: 740800 - protein, 25 aa, Mycobacterium
TSPARAAYVAGDWGAIASLSPELFL

SEQ ID NO: 740801 - protein, 24 aa, Mycobacterium
TSPDFPFALITGRTVYHFHTRTKT

SEQ ID NO: 740802 - protein, 22 aa, Mycobacterium
TSPDRRLAVVFGAGGERDPGKR

SEQ ID NO: 740803 - protein, 17 aa, Mycobacterium
TSPEERAILLTRIADLI

SEQ ID NO: 740804 - protein, 17 aa, Mycobacterium
TSPELATLMAHVKLALK

SEQ ID NO: 740805 - protein, 17 aa, Mycobacterium
TSPELATLMAHVKLGLK

SEQ ID NO: 740806 - protein, 23 aa, Mycobacterium
TSPELHARLALEATEQGVPMNQW

SEQ ID NO: 740807 - protein, 19 aa, Mycobacterium
TSPELKAWAESLLQMHLMD

SEQ ID NO: 740808 - protein, 17 aa, Mycobacterium
TSPGGGVTIVIPGHENV

SEQ ID NO: 740809 - protein, 30 aa, Mycobacterium
TSPLLRRPDLLVSLLTYWQHHPALSYLFSG

SEQ ID NO: 740810 - protein, 18 aa, Mycobacterium
TSPNRRGRPPAHGAAATR

SEQ ID NO: 740811 - protein, 20 aa, Mycobacterium
TSPPEDIQWTLGRTDHPNAD

SEQ ID NO: 740812 - protein, 17 aa, Mycobacterium
TSPRAVLFVTPSPKLAR

SEQ ID NO: 740813 - protein, 21 aa, Mycobacterium
TSPRGKRQFRRAILDIGTGQV

SEQ ID NO: 740814 - protein, 17 aa, Mycobacterium
TSPRGKRQFRRAVLDRD

SEQ ID NO: 740815 - protein, 21 aa, Mycobacterium
TSPRGKRQFRRGVFDPVTDTV

SEQ ID NO: 740816 - protein, 30 aa, Mycobacterium
TSPTVLKRDFGMAWGVGGWLLTTFLQSAGA

SEQ ID NO: 740817 - protein, 17 aa, Mycobacterium
TSPVAFLQRPARWIHAM

SEQ ID NO: 740818 - protein, 18 aa, Mycobacterium
TSPVCPVQAFRVGANVYA

SEQ ID NO: 740819 - protein, 19 aa, Mycobacterium
TSPVGTFGRTVMKDTEIAG

SEQ ID NO: 740820 - protein, 25 aa, Mycobacterium
TSPWPEDYELLGVPFAKRGKRMDEC

SEQ ID NO: 740821 - protein, 26 aa, Mycobacterium
TSPWPEDYELLGVPFAKRGKRMDECI

SEQ ID NO: 740822 - protein, 33 aa, Mycobacterium
TSPWYERAKALAPKGAGAVLAFELDGGVEAATT

SEQ ID NO: 740823 - protein, 20 aa, Mycobacterium
TSQAPPAMRLCHHLHGGMGM

SEQ ID NO: 740824 - protein, 28 aa, Mycobacterium
TSQAPPVMQTCHHLHGGMGMDITYPMHR

SEQ ID NO: 740825 - protein, 18 aa, Mycobacterium
TSQRARLAAEFEDALRPH

SEQ ID NO: 740826 - protein, 17 aa, Mycobacterium
TSQWRWDTLAARLAELL

SEQ ID NO: 740827 - protein, 34 aa, Mycobacterium
TSRAAAKLGEGWQPDIWRGFAEELGILGATLPEE

SEQ ID NO: 740828 - protein, 20 aa, Mycobacterium
TSRALLWRAATALDNDHPDR

SEQ ID NO: 740829 - protein, 17 aa, Mycobacterium
TSRARGVGIPFQGTPGP

SEQ ID NO: 740830 - protein, 18 aa, Mycobacterium
TSRAVPELVVERGGTPLR

SEQ ID NO: 740831 - protein, 25 aa, Mycobacterium
TSRESMCRVLHEFEKRGLIQVHGTS

SEQ ID NO: 740832 - protein, 24 aa, Mycobacterium
TSRGPAVVEFNCRFGDPETQAVLA

SEQ ID NO: 740833 - protein, 23 aa, Mycobacterium
TSRIRLAPLVLSMTFRHPAVLAN

SEQ ID NO: 740834 - protein, 24 aa, Mycobacterium
TSRKDWDWLVSINVMGVVHGCEAF

SEQ ID NO: 740835 - protein, 19 aa, Mycobacterium
TSRLRLTARASLSADEQEL

SEQ ID NO: 740836 - protein, 20 aa, Mycobacterium
TSRLRSIAHIGVRTRDFAFA

SEQ ID NO: 740837 - protein, 25 aa, Mycobacterium
TSRPDLPGLVRAAAIQRPLPDELPA

SEQ ID NO: 740838 - protein, 24 aa, Mycobacterium
TSRPLRIVGLDEFIDLYPTVAEAL

SEQ ID NO: 740839 - protein, 21 aa, Mycobacterium
TSRPRLMAWAPDGALLVSVPS

SEQ ID NO: 740840 - protein, 28 aa, Mycobacterium
TSRVAICVDADGAYQYRGVRVRDGARLI

SEQ ID NO: 740841 - protein, 24 aa, Mycobacterium
TSSAQLGGWLTEWGAQAPPVATLP

SEQ ID NO: 740842 - protein, 20 aa, Mycobacterium
TSSARTAFDIGRRSPTNRGV

SEQ ID NO: 740843 - protein, 24 aa, Mycobacterium
TSSGRGLWELAWPPLSSAGAPGAA

SEQ ID NO: 740844 - protein, 25 aa, Mycobacterium
TSSHGYGAHGYRCYRLVATSDTTPV

SEQ ID NO: 740845 - protein, 38 aa, Mycobacterium
TSSISDLRAIPWVLAWSQSRVMLPGWYGTGTAFEQWIA

SEQ ID NO: 740846 - protein, 19 aa, Mycobacterium
TSSKIMCWVALDRGSKLAD

SEQ ID NO: 740847 - protein, 19 aa, Mycobacterium
TSSKIMCWVALDRGSKLAE

SEQ ID NO: 740848 - protein, 19 aa, Mycobacterium
TSSKIMCWVAMDRGAKLAE

SEQ ID NO: 740849 - protein, 21 aa, Mycobacterium
TSSKNQSRWQFGVLGPPGAAD

SEQ ID NO: 740850 - protein, 21 aa, Mycobacterium
TSSKNQSRWQFGVLGPPGALE

SEQ ID NO: 740851 - protein, 17 aa, Mycobacterium
TSSLPRAFDQPRAEAAV

SEQ ID NO: 740852 - protein, 23 aa, Mycobacterium
TSSPARPSVLVLSARTQEALEDS

SEQ ID NO: 740853 - protein, 26 aa, Mycobacterium
TSSPLRPWPGFVPMLYERYSQPFFDG

SEQ ID NO: 740854 - protein, 17 aa, Mycobacterium
TSSRYLGTALHFNAVAP

SEQ ID NO: 740855 - protein, 19 aa, Mycobacterium
TSSVLVRFLGLWDATAIPG

SEQ ID NO: 740856 - protein, 17 aa, Mycobacterium
TSSYCNYKGAATYWSAV

SEQ ID NO: 740857 - protein, 18 aa, Mycobacterium
TSSYCNYKGFATYWSLVS

SEQ ID NO: 740858 - protein, 24 aa, Mycobacterium
TSTARLWLDDEVLCTGEVNTLASR

SEQ ID NO: 740859 - protein, 24 aa, Mycobacterium
TSTDTSSYCPFKGDASYYSVTTST

SEQ ID NO: 740860 - protein, 18 aa, Mycobacterium
TSTEAWLMAGGPHHTVLT

SEQ ID NO: 740861 - protein, 18 aa, Mycobacterium
TSTELWPVGLEDLEVSDL

SEQ ID NO: 740862 - protein, 18 aa, Mycobacterium
TSTFRATRAALRYFREAG

SEQ ID NO: 740863 - protein, 24 aa, Mycobacterium
TSTGELPFVPGIDAVVRDAEGTLY

SEQ ID NO: 740864 - protein, 31 aa, Mycobacterium
TSTLCFPAALARSIPWGAAFDQPHDEPSWLI

SEQ ID NO: 740865 - protein, 20 aa, Mycobacterium
TSTLRLASLLGASRTIAVVS

SEQ ID NO: 740866 - protein, 25 aa, Mycobacterium
TSTLRLGTAVALPLEHELFTFAKQV

SEQ ID NO: 740867 - protein, 23 aa, Mycobacterium
TSTPFMGGLGIVFERYEPDDVTI

SEQ ID NO: 740868 - protein, 31 aa, Mycobacterium
TSTSGTSSRCWIRCAPASSPGARWCGSPTAS

SEQ ID NO: 740869 - protein, 23 aa, Mycobacterium
TSTSVLARILAAGAARAAGTTSP

SEQ ID NO: 740870 - protein, 24 aa, Mycobacterium
TSTTETFAAITLEVDSRRWAGVPF

SEQ ID NO: 740871 - protein, 20 aa, Mycobacterium
TSTTETFAAITLEVNSRRWA

SEQ ID NO: 740872 - protein, 26 aa, Mycobacterium
TSVAQFADWGACLARTDPSAPKHNGI

SEQ ID NO: 740873 - protein, 19 aa, Mycobacterium
TSVDRERFASAFDELATRA

SEQ ID NO: 740874 - protein, 20 aa, Mycobacterium
TSVFRADFLNELDAPAAAGT

SEQ ID NO: 740875 - protein, 20 aa, Mycobacterium
TSVFRADFLNELDAPAQAGT

SEQ ID NO: 740876 - protein, 22 aa, Mycobacterium
TSVLPYGFPYLAWVLGRLLRKL

SEQ ID NO: 740877 - protein, 23 aa, Mycobacterium
TSVLSRGVCGVAGQTLIVNLPGS

SEQ ID NO: 740878 - protein, 17 aa, Mycobacterium
TSVMLRGIASFGPTQVI

SEQ ID NO: 740879 - protein, 17 aa, Mycobacterium
TSVMPTHVMAVLFCDPE

SEQ ID NO: 740880 - protein, 21 aa, Mycobacterium
TSVMTDLRFSIARNDHNPMEM

SEQ ID NO: 740881 - protein, 19 aa, Mycobacterium
TSVPMLREFLVSNLVLVLS

SEQ ID NO: 740882 - protein, 24 aa, Mycobacterium
TSVRHPLRWHHLALVMWYPDQGSE

SEQ ID NO: 740883 - protein, 18 aa, Mycobacterium
TSVTKWYGRNRVLDDVSL

SEQ ID NO: 740884 - protein, 17 aa, Mycobacterium
TSVVCFWLKQNSHDRGV

SEQ ID NO: 740885 - protein, 22 aa, Mycobacterium
TSVVINPFFDWGYDRAPVTPYN

SEQ ID NO: 740886 - protein, 25 aa, Mycobacterium
TSVVSGRVAYAFGLQGPAVTVDTAC

SEQ ID NO: 740887 - protein, 23 aa, Mycobacterium
TSVYACGPAPMLTAVRDALVGRD

SEQ ID NO: 740888 - protein, 26 aa, Mycobacterium
TSWDLRKFLWAPKLGCYGIQRIHPLR

SEQ ID NO: 740889 - protein, 19 aa, Mycobacterium
TSWDLRKFLWAPRLGCYGI

SEQ ID NO: 740890 - protein, 25 aa, Mycobacterium
TSWDREIKRPWFLLNNLDNTEALAK

SEQ ID NO: 740891 - protein, 17 aa, Mycobacterium
TSWPPHCRAGTPGADFH

SEQ ID NO: 740892 - protein, 26 aa, Mycobacterium
TSWQLRKFLWAPKLGCYGIQRIHLLR

SEQ ID NO: 740893 - protein, 20 aa, Mycobacterium
TSYADVRTPFGLFPDVSPGT

SEQ ID NO: 740894 - protein, 24 aa, Mycobacterium
TSYKAAVFESEFGDGSKLGLQIDY

SEQ ID NO: 740895 - protein, 18 aa, Mycobacterium
TSYLLPKIVGAGVARELM

SEQ ID NO: 740896 - protein, 19 aa, Mycobacterium
TSYLLPKIVGAGVARELML

SEQ ID NO: 740897 - protein, 22 aa, Mycobacterium
TSYLTELRWWTSPFEANADHVP

SEQ ID NO: 740898 - protein, 18 aa, Mycobacterium
TSYQAGVFEAEFGDGSKL

SEQ ID NO: 740899 - protein, 18 aa, Mycobacterium
TSYRAEVFEAEFGDGSKL

SEQ ID NO: 740900 - protein, 23 aa, Mycobacterium
TSYRRWCELMWQRAAAPEAQAQR

SEQ ID NO: 740901 - protein, 23 aa, Mycobacterium
TSYSDVADWCLLLARTDKDVPRH

SEQ ID NO: 740902 - protein, 23 aa, Mycobacterium
TSYSDVADWCLLLARTDREAHRH

SEQ ID NO: 740903 - protein, 24 aa, Mycobacterium
TSYSDVADWCLVLARTDKDVPKHK

SEQ ID NO: 740904 - protein, 22 aa, Mycobacterium
TSYSDVAEWCLLLARTEPGASR

SEQ ID NO: 740905 - protein, 22 aa, Mycobacterium
TSYVPRLVHRDTLPSGKPLHLR

SEQ ID NO: 740906 - protein, 25 aa, Mycobacterium
TSYYYRTRTALLRGVGKRVAEIDVA

SEQ ID NO: 740907 - protein, 18 aa, Mycobacterium
TTAAHCKTVLVGDAHQLA

SEQ ID NO: 740908 - protein, 19 aa, Mycobacterium
TTAAIRFEVRGMKDGNVAV

SEQ ID NO: 740909 - protein, 25 aa, Mycobacterium
TTAANRLLGAIAWLAEQKPGIYDGL

SEQ ID NO: 740910 - protein, 26 aa, Mycobacterium
TTAARYVWELPYYPTYYVPITDVRRE

SEQ ID NO: 740911 - protein, 27 aa, Mycobacterium
TTAARYVWEVPYYPQYYIPLADVRAEF

SEQ ID NO: 740912 - protein, 27 aa, Mycobacterium
TTAARYVWEVPYYPQYYIPLADVRTEF

SEQ ID NO: 740913 - protein, 18 aa, Mycobacterium
TTACAYDHLIPGRGVGVL

SEQ ID NO: 740914 - protein, 19 aa, Mycobacterium
TTACSSGRCVATATDGPTP

SEQ ID NO: 740915 - protein, 24 aa, Mycobacterium
TTADEIVRWATPVTSFQRTALQDY

SEQ ID NO: 740916 - protein, 25 aa, Mycobacterium
TTADLFIRYLRPIRQGAARAVPRML

SEQ ID NO: 740917 - protein, 26 aa, Mycobacterium
TTADLFIRYLRPIRQGSALAVPRVLR

SEQ ID NO: 740918 - protein, 24 aa, Mycobacterium
TTADRGRAGLSIYAATKAAVRSLA

SEQ ID NO: 740919 - protein, 21 aa, Mycobacterium
TTAEGFSWTPVHTMAGPDTSA

SEQ ID NO: 740920 - protein, 21 aa, Mycobacterium
TTAEGFSWTPVHTMSGVDTSA

SEQ ID NO: 740921 - protein, 21 aa, Mycobacterium
TTAEGFSWTPVHTVSGVDTSA

SEQ ID NO: 740922 - protein, 17 aa, Mycobacterium
TTAEIFDRKGFIGTSAQ

SEQ ID NO: 740923 - protein, 17 aa, Mycobacterium
TTAELRSRFDGHDLAVI

SEQ ID NO: 740924 - protein, 24 aa, Mycobacterium
TTAEQRAGWDLSPLQVIVSAAEPV

SEQ ID NO: 740925 - protein, 25 aa, Mycobacterium
TTAESGWTFGFVDLAGFTALTDAHG

SEQ ID NO: 740926 - protein, 17 aa, Mycobacterium
TTAFPGSFVPRTASERG

SEQ ID NO: 740927 - protein, 23 aa, Mycobacterium
TTAGLPYEDCVGVSYQQVHEDPD

SEQ ID NO: 740928 - protein, 17 aa, Mycobacterium
TTAGLSMRHALRPRPWT

SEQ ID NO: 740929 - protein, 26 aa, Mycobacterium
TTAGQRWSWKGLRAGETRVEIETLWT

SEQ ID NO: 740930 - protein, 22 aa, Mycobacterium
TTALCSPSRSCILNGRNHHSNH

SEQ ID NO: 740931 - protein, 19 aa, Mycobacterium
TTALTHSWVATSDEDAGVL

SEQ ID NO: 740932 - protein, 18 aa, Mycobacterium
TTAMAALAHAWRSSGGHV

SEQ ID NO: 740933 - protein, 23 aa, Mycobacterium
TTAMAALSHAWRSSGATIVGLAP

SEQ ID NO: 740934 - protein, 23 aa, Mycobacterium
TTANAMSWFWYLMALHPDARDRM

SEQ ID NO: 740935 - protein, 17 aa, Mycobacterium
TTAPDWTAIEIARTLRP

SEQ ID NO: 740936 - protein, 19 aa, Mycobacterium
TTAQQWRTVIDVNLIGTWN

SEQ ID NO: 740937 - protein, 17 aa, Mycobacterium
TTARGQYGPGWQGSQQV

SEQ ID NO: 740938 - protein, 23 aa, Mycobacterium
TTARKSGSGWVISGSKYYISAVD

SEQ ID NO: 740939 - protein, 17 aa, Mycobacterium
TTARMALALTEPDEGTV

SEQ ID NO: 740940 - protein, 27 aa, Mycobacterium
TTAVVVCPIGFVADHIEVVWDLDHELA

SEQ ID NO: 740941 - protein, 22 aa, Mycobacterium
TTAWIAEGLFGYLPPEAQDRLL

SEQ ID NO: 740942 - protein, 23 aa, Mycobacterium
TTCAYCGVGCSFKAELRGDELVR

SEQ ID NO: 740943 - protein, 32 aa, Mycobacterium
TTCSEMAFDPGFRPLVEGLRSQLTVRLRTYEI

SEQ ID NO: 740944 - protein, 21 aa, Mycobacterium
TTDAEGGPALTEFAGRACYQS

SEQ ID NO: 740945 - protein, 35 aa, Mycobacterium
TTDAGSVANWWARHLRLRPGMAASLAGNLATMGPG

SEQ ID NO: 740946 - protein, 18 aa, Mycobacterium
TTDAVWRGLADLGTTGLL

SEQ ID NO: 740947 - protein, 24 aa, Mycobacterium
TTDEPFAALAFKIATHPFFGKLTY

SEQ ID NO: 740948 - protein, 22 aa, Mycobacterium
TTDFPDTTWRAAAEAGTGSSPV

SEQ ID NO: 740949 - protein, 34 aa, Mycobacterium
TTDGHLKALDWARRRFGSDLVWGIEDCRSVTSRL

SEQ ID NO: 740950 - protein, 30 aa, Mycobacterium
TTDGHLKALGWARREFGGDLIWGVEDCRNL

SEQ ID NO: 740951 - protein, 22 aa, Mycobacterium
TTDLRIGASLVHLGHATRLWSP

SEQ ID NO: 740952 - protein, 21 aa, Mycobacterium
TTDPLVICDLGMPRDVDPAVA

SEQ ID NO: 740953 - protein, 23 aa, Mycobacterium
TTDQAWCLADVLGAGSYPWVLAI

SEQ ID NO: 740954 - protein, 19 aa, Mycobacterium
TTDSSIWFHHEVRAGEWNL

SEQ ID NO: 740955 - protein, 26 aa, Mycobacterium
TTDVDRRLSLLIGWTGDHLAETEVND

SEQ ID NO: 740956 - protein, 24 aa, Mycobacterium
TTDYRRLDIAGARTVHGAGREFLD

SEQ ID NO: 740957 - protein, 26 aa, Mycobacterium
TTEELRFGYRTSVLKHSDAVIVLEVE

SEQ ID NO: 740958 - protein, 32 aa, Mycobacterium
TTEEPRIATGPTVLTIRARPPGTTITEQQPTV

SEQ ID NO: 740959 - protein, 23 aa, Mycobacterium
TTEEVLSALGVVVNKGNVGALEE

SEQ ID NO: 740960 - protein, 18 aa, Mycobacterium
TTEFKLNLLQPVSSGVCV

SEQ ID NO: 740961 - protein, 18 aa, Mycobacterium
TTEFRLSDLFSAAGLPDL

SEQ ID NO: 740962 - protein, 26 aa, Mycobacterium
TTEHRPEILLSFGFVPKMEAKVGLIN

SEQ ID NO: 740963 - protein, 17 aa, Mycobacterium
TTEIALNYPEAWGDEDR

SEQ ID NO: 740964 - protein, 22 aa, Mycobacterium
TTEKHFRRARGRKAELSLADGS

SEQ ID NO: 740965 - protein, 25 aa, Mycobacterium
TTELPDGEMAWWLLEDSARSTRLAL

SEQ ID NO: 740966 - protein, 17 aa, Mycobacterium
TTEPLGYDKQYTINADA

SEQ ID NO: 740967 - protein, 25 aa, Mycobacterium
TTEPYLDDGALRWRDGVHASLDTDV

SEQ ID NO: 740968 - protein, 19 aa, Mycobacterium
TTESGWSAGDAELFRDATW

SEQ ID NO: 740969 - protein, 26 aa, Mycobacterium
TTETEYAEMWARDTAAMFGYAGSTAS

SEQ ID NO: 740970 - protein, 21 aa, Mycobacterium
TTEVMLAGAIVRAVEGDTLLL

SEQ ID NO: 740971 - protein, 25 aa, Mycobacterium
TTEVRMIRWLSARGLIVGTVASATL

SEQ ID NO: 740972 - protein, 17 aa, Mycobacterium
TTEYPKPWSVETVQAAD

SEQ ID NO: 740973 - protein, 17 aa, Mycobacterium
TTFALRVAAELLSQRAV

SEQ ID NO: 740974 - protein, 17 aa, Mycobacterium
TTFARALAVAYRDHNEQ

SEQ ID NO: 740975 - protein, 25 aa, Mycobacterium
TTFDPARPAVWLAEGLLQYLDETAV

SEQ ID NO: 740976 - protein, 18 aa, Mycobacterium
TTFEVDLMGTVGMVDAAM

SEQ ID NO: 740977 - protein, 18 aa, Mycobacterium
TTFGHPFLVMPYCGLGCI

SEQ ID NO: 740978 - protein, 29 aa, Mycobacterium
TTFLREHLAGFKVPRTMVFDHLPKTSTGK

SEQ ID NO: 740979 - protein, 24 aa, Mycobacterium
TTFQRPRVVVFAGDHGVAAAGVSA

SEQ ID NO: 740980 - protein, 23 aa, Mycobacterium
TTFTKRGKLGIRWYSSKQGHGEP

SEQ ID NO: 740981 - protein, 23 aa, Mycobacterium
TTFTKRGKLGIRWYSSKQGHGQP

SEQ ID NO: 740982 - protein, 23 aa, Mycobacterium
TTFTKRGKLGIRWYTSKQGHGEP

SEQ ID NO: 740983 - protein, 21 aa, Mycobacterium
TTFVCPSVYEPLGIVNLEAMA

SEQ ID NO: 740984 - protein, 18 aa, Mycobacterium
TTFWAGAYLTCYLGAFGA

SEQ ID NO: 740985 - protein, 23 aa, Mycobacterium
TTFWWAHATFQVMVEQTIDRYSR

SEQ ID NO: 740986 - protein, 23 aa, Mycobacterium
TTGATGPLAWLANLGTAYQTFWT

SEQ ID NO: 740987 - protein, 20 aa, Mycobacterium
TTGDGRWDVVLTDGDGDGIA

SEQ ID NO: 740988 - protein, 17 aa, Mycobacterium
TTGEAFDDYVRGRGLTP

SEQ ID NO: 740989 - protein, 19 aa, Mycobacterium
TTGERISRIALRYLGVHSS

SEQ ID NO: 740990 - protein, 17 aa, Mycobacterium
TTGFIPREVSFEGPKAP

SEQ ID NO: 740991 - protein, 18 aa, Mycobacterium
TTGGRIDRGLLFDASAAS

SEQ ID NO: 740992 - protein, 21 aa, Mycobacterium
TTGGYAGPGFAVSARCGTGAG

SEQ ID NO: 740993 - protein, 23 aa, Mycobacterium
TTGIPLDLQVTILGADTNEIGVD

SEQ ID NO: 740994 - protein, 24 aa, Mycobacterium
TTGIYCRPSCPAITPKRQNVSFHP

SEQ ID NO: 740995 - protein, 28 aa, Mycobacterium
TTGKAFSAPPAWRVIKLAFGQPGPNASA

SEQ ID NO: 740996 - protein, 18 aa, Mycobacterium
TTGLFRDTCMAVADQYPD

SEQ ID NO: 740997 - protein, 18 aa, Mycobacterium
TTGLLMVAPYVARSMPQL

SEQ ID NO: 740998 - protein, 18 aa, Mycobacterium
TTGMLLGAVPAAFHAGVQ

SEQ ID NO: 740999 - protein, 17 aa, Mycobacterium
TTGMWSTPWTWKSAGTY

SEQ ID NO: 741000 - protein, 23 aa, Mycobacterium
TTGNLKPAASWLVEVNGDPGKGW

SEQ ID NO: 741001 - protein, 26 aa, Mycobacterium
TTGNPGRSGWTGGAVSAVTAVTAGDG

SEQ ID NO: 741002 - protein, 26 aa, Mycobacterium
TTGNPGRSGWTGGAVSTVTAVTAGDG

SEQ ID NO: 741003 - protein, 27 aa, Mycobacterium
TTGRARRCGWFDAVIARYATRVNGITD

SEQ ID NO: 741004 - protein, 23 aa, Mycobacterium
TTGRAVGVLADLQGPKIRLGRFA

SEQ ID NO: 741005 - protein, 24 aa, Mycobacterium
TTGRGRHLYFAWDHTAQRIGNVPK

SEQ ID NO: 741006 - protein, 18 aa, Mycobacterium
TTGRPAIVLPAFLSRGYH

SEQ ID NO: 741007 - protein, 21 aa, Mycobacterium
TTGSGLVRLQCYEGVDEARAL

SEQ ID NO: 741008 - protein, 20 aa, Mycobacterium
TTGSVWVLGAQMGRTDLSVL

SEQ ID NO: 741009 - protein, 18 aa, Mycobacterium
TTGTGVCAMCYGRSMATG

SEQ ID NO: 741010 - protein, 17 aa, Mycobacterium
TTGTGVCATCYGRSMAT

SEQ ID NO: 741011 - protein, 25 aa, Mycobacterium
TTGVPRAPVGMFAPHSPAGPLAAPT

SEQ ID NO: 741012 - protein, 25 aa, Mycobacterium
TTGVPVDWPAVFAGSGGRRVDLPTY

SEQ ID NO: 741013 - protein, 25 aa, Mycobacterium
TTGWTSLANVTGWAAISLPLGVSGD

SEQ ID NO: 741014 - protein, 20 aa, Mycobacterium
TTHEGVDWLLARSEKPDLVF

SEQ ID NO: 741015 - protein, 25 aa, Mycobacterium
TTHELWPGKAYPLGATYDGSGTNFA

SEQ ID NO: 741016 - protein, 25 aa, Mycobacterium
TTHGARAGAVVALLLPRSDHAILAI

SEQ ID NO: 741017 - protein, 21 aa, Mycobacterium
TTHGPRGMMFAPDLVGTTDEL

SEQ ID NO: 741018 - protein, 17 aa, Mycobacterium
TTHGPRNAFPLTVPGYG

SEQ ID NO: 741019 - protein, 23 aa, Mycobacterium
TTHLPNLRVESGQGLVVDFVKSR

SEQ ID NO: 741020 - protein, 23 aa, Mycobacterium
TTHPAGSVLVEFGETRVMCTASV

SEQ ID NO: 741021 - protein, 19 aa, Mycobacterium
TTHRAMWALGDYAVLADEV

SEQ ID NO: 741022 - protein, 23 aa, Mycobacterium
TTHRYRREYGLRVTSGRKVVELR

SEQ ID NO: 741023 - protein, 30 aa, Mycobacterium
TTHWPKELACIGSIRFARRSSNFEEAVRFY

SEQ ID NO: 741024 - protein, 18 aa, Mycobacterium
TTICPGFISTNIVDTTRF

SEQ ID NO: 741025 - protein, 20 aa, Mycobacterium
TTIGEFAFPAGPGYLNSSAT

SEQ ID NO: 741026 - protein, 19 aa, Mycobacterium
TTIMTPVFEVHRGPTGELQ

SEQ ID NO: 741027 - protein, 23 aa, Mycobacterium
TTIQCFCAYGYEKSSMKLISTKA

SEQ ID NO: 741028 - protein, 19 aa, Mycobacterium
TTIRNLVHGIGFQRDVLGA

SEQ ID NO: 741029 - protein, 17 aa, Mycobacterium
TTIRRLVKFLVDGKPTA

SEQ ID NO: 741030 - protein, 19 aa, Mycobacterium
TTISHLLCGFDLLEPLRAR

SEQ ID NO: 741031 - protein, 31 aa, Mycobacterium
TTITSGSVCARRCTVGGVGAIAAVAAEAATA

SEQ ID NO: 741032 - protein, 24 aa, Mycobacterium
TTIVALKFPGGVVMAGDRRATQGH

SEQ ID NO: 741033 - protein, 18 aa, Mycobacterium
TTIVNWRVIGDELVHVLA

SEQ ID NO: 741034 - protein, 20 aa, Mycobacterium
TTKAVGWTPADWVDNSLQTW

SEQ ID NO: 741035 - protein, 19 aa, Mycobacterium
TTKDGNWSIVKGLEIDEFS

SEQ ID NO: 741036 - protein, 23 aa, Mycobacterium
TTKDGNWSIVQGLEIDEFSQGRI

SEQ ID NO: 741037 - protein, 22 aa, Mycobacterium
TTKGEAECAHWVAQQLEEVGYE

SEQ ID NO: 741038 - protein, 18 aa, Mycobacterium
TTKGPKKQLGITFILIDF

SEQ ID NO: 741039 - protein, 26 aa, Mycobacterium
TTKIQLPTFIPRIVFGAYPGLPGGEN

SEQ ID NO: 741040 - protein, 22 aa, Mycobacterium
TTKRYMHHYNFPPFSTGETGRV

SEQ ID NO: 741041 - protein, 19 aa, Mycobacterium
TTKVQSWDIFRCVRQVLDV

SEQ ID NO: 741042 - protein, 19 aa, Mycobacterium
TTLAAKYGDSPAMRRVTND

SEQ ID NO: 741043 - protein, 18 aa, Mycobacterium
TTLAEFAIPGGPGYLNTS

SEQ ID NO: 741044 - protein, 25 aa, Mycobacterium
TTLAPCWYCSGLVRQFNIGSLLVGE

SEQ ID NO: 741045 - protein, 26 aa, Mycobacterium
TTLARPDRRLAVVFGAGGERDPGKRA

SEQ ID NO: 741046 - protein, 22 aa, Mycobacterium
TTLAVLMLLPLSAFEAMTPLPG

SEQ ID NO: 741047 - protein, 18 aa, Mycobacterium
TTLAVLRRLAPRARITVG

SEQ ID NO: 741048 - protein, 24 aa, Mycobacterium
TTLCGLPAVRGHYMAPLLGTSSPR

SEQ ID NO: 741049 - protein, 25 aa, Mycobacterium
TTLDRARFDLGWNRLGMIGPTVTAA

SEQ ID NO: 741050 - protein, 26 aa, Mycobacterium
TTLDVAFSIVVKRGCRAADVRTLAAF

SEQ ID NO: 741051 - protein, 19 aa, Mycobacterium
TTLDVAFSIVVRPGVGAAD

SEQ ID NO: 741052 - protein, 22 aa, Mycobacterium
TTLELAAAMADYIDNLYNVDRH

SEQ ID NO: 741053 - protein, 23 aa, Mycobacterium
TTLEVVRIAALLSQPVMPGTMAT

SEQ ID NO: 741054 - protein, 20 aa, Mycobacterium
TTLHEILELVAPQSGSIEVL

SEQ ID NO: 741055 - protein, 26 aa, Mycobacterium
TTLIDLNVRWRKGQTLEPDWKIEQDG

SEQ ID NO: 741056 - protein, 18 aa, Mycobacterium
TTLLDLRNARMLRAAFAT

SEQ ID NO: 741057 - protein, 23 aa, Mycobacterium
TTLNEPWCSAFLGYAAGAHAPGR

SEQ ID NO: 741058 - protein, 17 aa, Mycobacterium
TTLPALLRLLGVQNASA

SEQ ID NO: 741059 - protein, 24 aa, Mycobacterium
TTLPEGLHWDRILFCAKEATYKAW

SEQ ID NO: 741060 - protein, 19 aa, Mycobacterium
TTLPGGFAIAARKTYGRDS

SEQ ID NO: 741061 - protein, 18 aa, Mycobacterium
TTLPRDCLLVFGQEGPGI

SEQ ID NO: 741062 - protein, 24 aa, Mycobacterium
TTLPRPYDGPFRIWHGSATSTFAV

SEQ ID NO: 741063 - protein, 26 aa, Mycobacterium
TTLRAHGGLDRWKKLTSISAHRSFGG

SEQ ID NO: 741064 - protein, 22 aa, Mycobacterium
TTLRLIPNIVVLPYRNPFVVAK

SEQ ID NO: 741065 - protein, 23 aa, Mycobacterium
TTLRLLDDLGLWPRFADISHSRL

SEQ ID NO: 741066 - protein, 17 aa, Mycobacterium
TTLRLLPHFETISYGEL

SEQ ID NO: 741067 - protein, 17 aa, Mycobacterium
TTLRLLRDGAPVPGRVI

SEQ ID NO: 741068 - protein, 20 aa, Mycobacterium
TTLRLPGLILTAPGEPQSLT

SEQ ID NO: 741069 - protein, 17 aa, Mycobacterium
TTLRLVPNIVVLPYRNP

SEQ ID NO: 741070 - protein, 18 aa, Mycobacterium
TTLRRLIVHRSIADGLVE

SEQ ID NO: 741071 - protein, 18 aa, Mycobacterium
TTLRWRDIAVGDEVTPLE

SEQ ID NO: 741072 - protein, 25 aa, Mycobacterium
TTLSPCWYCSGLVRQFNIGALVIGE

SEQ ID NO: 741073 - protein, 25 aa, Mycobacterium
TTLSPCWYCSGLVRQFNIGALVVGE

SEQ ID NO: 741074 - protein, 25 aa, Mycobacterium
TTLSPCWYCSGLVRQFNIGTVVIGE

SEQ ID NO: 741075 - protein, 20 aa, Mycobacterium
TTLWECPERGDSRVFDVDDM

SEQ ID NO: 741076 - protein, 22 aa, Mycobacterium
TTLYPRDRLDAAPATFASAPLD

SEQ ID NO: 741077 - protein, 19 aa, Mycobacterium
TTMAARTRFFDTFVQDAIW

SEQ ID NO: 741078 - protein, 22 aa, Mycobacterium
TTMAGFPMCTECAREYRDPDDR

SEQ ID NO: 741079 - protein, 17 aa, Mycobacterium
TTMCVYEAVAGTALASV

SEQ ID NO: 741080 - protein, 18 aa, Mycobacterium
TTMGAALRQRCLIHRARN

SEQ ID NO: 741081 - protein, 25 aa, Mycobacterium
TTMGRAGLIAPMRPDRYLKIAAAMR

SEQ ID NO: 741082 - protein, 27 aa, Mycobacterium
TTMKCAAHSAAIRRCYDDCRSGPGRRA

SEQ ID NO: 741083 - protein, 18 aa, Mycobacterium
TTMLSHCDDTVCERFTDI

SEQ ID NO: 741084 - protein, 25 aa, Mycobacterium
TTMNCLPITPGWNYMVRLYRAQRRF

SEQ ID NO: 741085 - protein, 28 aa, Mycobacterium
TTMPENLSAAGISWKLYRNKTLGPVLNQ

SEQ ID NO: 741086 - protein, 17 aa, Mycobacterium
TTMPRGGHFAAFEQPDL

SEQ ID NO: 741087 - protein, 23 aa, Mycobacterium
TTMPRGGHFAAFEQPELFVGDVR

SEQ ID NO: 741088 - protein, 18 aa, Mycobacterium
TTMPRGGHFAAFEQPSSF

SEQ ID NO: 741089 - protein, 18 aa, Mycobacterium
TTMPWGNRALVFRDPDGN

SEQ ID NO: 741090 - protein, 17 aa, Mycobacterium
TTMQWFRDWFAGKTPTI

SEQ ID NO: 741091 - protein, 17 aa, Mycobacterium
TTMRLLDELGLWERFAE

SEQ ID NO: 741092 - protein, 24 aa, Mycobacterium
TTMRRMMAGMARIDGATMIAPGPA

SEQ ID NO: 741093 - protein, 17 aa, Mycobacterium
TTMRWIPNPVADLMFPE

SEQ ID NO: 741094 - protein, 18 aa, Mycobacterium
TTNACALALLLGGAAANR

SEQ ID NO: 741095 - protein, 23 aa, Mycobacterium
TTNHVWAVLGWYGVLKAGLVPVA

SEQ ID NO: 741096 - protein, 23 aa, Mycobacterium
TTNLPGPLWQASAMGKAATTTAV

SEQ ID NO: 741097 - protein, 24 aa, Mycobacterium
TTNPGHLNSFGFGNSGSGNLGIGN

SEQ ID NO: 741098 - protein, 23 aa, Mycobacterium
TTNVEFLRFLLADPDVAAGDLDT

SEQ ID NO: 741099 - protein, 21 aa, Mycobacterium
TTNWDKLFIGGQWVEPSSSEI

SEQ ID NO: 741100 - protein, 24 aa, Mycobacterium
TTPAEMREAIGWALAEADEGRCAV

SEQ ID NO: 741101 - protein, 21 aa, Mycobacterium
TTPAPLVVPDFYATVRTNPIN

SEQ ID NO: 741102 - protein, 24 aa, Mycobacterium
TTPARLLVEEWVRLSQRSLTPPRV

SEQ ID NO: 741103 - protein, 19 aa, Mycobacterium
TTPASKYGIEWYGSAEDIC

SEQ ID NO: 741104 - protein, 19 aa, Mycobacterium
TTPDAPWGLYRTEGDDHWV

SEQ ID NO: 741105 - protein, 20 aa, Mycobacterium
TTPDPSYHGVVFAELGAPAY

SEQ ID NO: 741106 - protein, 31 aa, Mycobacterium
TTPDSPLGWLWQILFGTTFPTSISALLTDLQ

SEQ ID NO: 741107 - protein, 22 aa, Mycobacterium
TTPEHRWAWQTRSWSHGQREPA

SEQ ID NO: 741108 - protein, 25 aa, Mycobacterium
TTPEQWRLVVDVNLIGAWNTCAAAL

SEQ ID NO: 741109 - protein, 20 aa, Mycobacterium
TTPEYSWKGVTDSYRYGATV

SEQ ID NO: 741110 - protein, 30 aa, Mycobacterium
TTPGGNGGDGGWLFGSGGNGAAGAAGQAGG

SEQ ID NO: 741111 - protein, 22 aa, Mycobacterium
TTPGRRGAAPGPNLPRAPRAYA

SEQ ID NO: 741112 - protein, 22 aa, Mycobacterium
TTPHFDGHLSVLVRASRLAEIS

SEQ ID NO: 741113 - protein, 25 aa, Mycobacterium
TTPHYKDLRSFYAYDKDKAGKLLDE

SEQ ID NO: 741114 - protein, 24 aa, Mycobacterium
TTPKGAKRRIVFRFRTSPIEIRGD

SEQ ID NO: 741115 - protein, 24 aa, Mycobacterium
TTPKWVHNRIQPIAVRDVLHYLAA

SEQ ID NO: 741116 - protein, 18 aa, Mycobacterium
TTPLLEWIAAQISALRGD

SEQ ID NO: 741117 - protein, 25 aa, Mycobacterium
TTPLTFRAVPLLKDMTRNAGWGRST

SEQ ID NO: 741118 - protein, 23 aa, Mycobacterium
TTPPWKASCPCCNATSSTANAGP

SEQ ID NO: 741119 - protein, 37 aa, Mycobacterium
TTPRRRADVGAWADERARLPIDPEWGPGWHLGVVGLD

SEQ ID NO: 741120 - protein, 26 aa, Mycobacterium
TTPSFITNWNEFWSVVTGVYSPQSWT

SEQ ID NO: 741121 - protein, 19 aa, Mycobacterium
TTPSQRQKALLDFADEVER

SEQ ID NO: 741122 - protein, 24 aa, Mycobacterium
TTPTELRSALTAALASNGPTVIDC

SEQ ID NO: 741123 - protein, 18 aa, Mycobacterium
TTPWRDLFSPAVALADNG

SEQ ID NO: 741124 - protein, 19 aa, Mycobacterium
TTPYREGYGGYGHGAYGGY

SEQ ID NO: 741125 - protein, 20 aa, Mycobacterium
TTQAAERWKAHKLDLTPVLH

SEQ ID NO: 741126 - protein, 26 aa, Mycobacterium
TTQARYVWEVPYYPAYYVPLADVRAE

SEQ ID NO: 741127 - protein, 23 aa, Mycobacterium
TTQDYPPILAMTSLNDTRVYYVE

SEQ ID NO: 741128 - protein, 19 aa, Mycobacterium
TTQGLRYATNVRRILYLAS

SEQ ID NO: 741129 - protein, 24 aa, Mycobacterium
TTQLAPVIDRWGAPIVVDTAGALD

SEQ ID NO: 741130 - protein, 17 aa, Mycobacterium
TTQLLLRGMELMGEGEI

SEQ ID NO: 741131 - protein, 20 aa, Mycobacterium
TTQPPARRVRAMLEALLDTV

SEQ ID NO: 741132 - protein, 22 aa, Mycobacterium
TTQRLAGLPGLVADYDPEHGVA

SEQ ID NO: 741133 - protein, 30 aa, Mycobacterium
TTRAGGAIFRFGLPPFKWWQGLQGRKLLEE

SEQ ID NO: 741134 - protein, 18 aa, Mycobacterium
TTRAIPLLDVSGRPSEAE

SEQ ID NO: 741135 - protein, 19 aa, Mycobacterium
TTRAVGWSPTDWVDNTLDV

SEQ ID NO: 741136 - protein, 25 aa, Mycobacterium
TTRAVKVDGGWRITGQKIWTTGAQF

SEQ ID NO: 741137 - protein, 17 aa, Mycobacterium
TTRAVLAAGGDEISAAV

SEQ ID NO: 741138 - protein, 17 aa, Mycobacterium
TTRDEWRIFDAAFDDGV

SEQ ID NO: 741139 - protein, 31 aa, Mycobacterium
TTRDFLGGGLNWPLDLTVGADGAVYVADGTY

SEQ ID NO: 741140 - protein, 25 aa, Mycobacterium
TTRDGWRLQIRLDHEQVNPVPNLAG

SEQ ID NO: 741141 - protein, 25 aa, Mycobacterium
TTREERLELLGAIMAEYQNRAADLA

SEQ ID NO: 741142 - protein, 19 aa, Mycobacterium
TTREWDAAVLDLTIQAQPL

SEQ ID NO: 741143 - protein, 27 aa, Mycobacterium
TTRFVACPFGAPGSRMYRTGDLVQWGE

SEQ ID NO: 741144 - protein, 19 aa, Mycobacterium
TTRGMAVAACRDAIADAGL

SEQ ID NO: 741145 - protein, 17 aa, Mycobacterium
TTRILAWTDSDTDALTV

SEQ ID NO: 741146 - protein, 34 aa, Mycobacterium
TTRKVWREPVGVVGAIVPWNFPFEVTINKLGQAL

SEQ ID NO: 741147 - protein, 17 aa, Mycobacterium
TTRLAEALKSLGTDCIT

SEQ ID NO: 741148 - protein, 17 aa, Mycobacterium
TTRRCGYDIPLDIIWHG

SEQ ID NO: 741149 - protein, 17 aa, Mycobacterium
TTRRGAGLLADIRRSDC

SEQ ID NO: 741150 - protein, 22 aa, Mycobacterium
TTRRLPFGVAVLGGPTTVVDIG

SEQ ID NO: 741151 - protein, 22 aa, Mycobacterium
TTRRPALAGVRADYDKVVRQRT

SEQ ID NO: 741152 - protein, 23 aa, Mycobacterium
TTRRRGVVINPVLETSEVPETMP

SEQ ID NO: 741153 - protein, 17 aa, Mycobacterium
TTRTSWTALQSEAEETL

SEQ ID NO: 741154 - protein, 25 aa, Mycobacterium
TTRVFDVALGYPWPAHFPERVLRNA

SEQ ID NO: 741155 - protein, 26 aa, Mycobacterium
TTSCLTCADLHRRDRDAAWPAISAQL

SEQ ID NO: 741156 - protein, 25 aa, Mycobacterium
TTSDFPTDRGWDLAELFDPDPDTPG

SEQ ID NO: 741157 - protein, 18 aa, Mycobacterium
TTSDWFDRTTLFASGLVS

SEQ ID NO: 741158 - protein, 17 aa, Mycobacterium
TTSFYFRTRSALLRAVA

SEQ ID NO: 741159 - protein, 24 aa, Mycobacterium
TTSGRPIADFELRIGESGEVLLRG

SEQ ID NO: 741160 - protein, 38 aa, Mycobacterium
TTSISDLRAIPWVLAWSQSRVMLPGWYGTGTAFEDYVG

SEQ ID NO: 741161 - protein, 23 aa, Mycobacterium
TTSLRLIPNIVVLPYRNPFVVAK

SEQ ID NO: 741162 - protein, 18 aa, Mycobacterium
TTSMNIWANLGLARQMNS

SEQ ID NO: 741163 - protein, 23 aa, Mycobacterium
TTSMPRSGIRITVDDVEVSETET

SEQ ID NO: 741164 - protein, 20 aa, Mycobacterium
TTSRAGRRIAPLRKLPPARP

SEQ ID NO: 741165 - protein, 26 aa, Mycobacterium
TTSVAWRLRGQTSYCIDGQVYTAASA

SEQ ID NO: 741166 - protein, 26 aa, Mycobacterium
TTSWCGYCLRLKTALKAEGIAYDEID

SEQ ID NO: 741167 - protein, 31 aa, Mycobacterium
TTSWCGYCVRLKKVLKNEGITFAEVNIEEDP

SEQ ID NO: 741168 - protein, 27 aa, Mycobacterium
TTTAGHTAGWGGNGGYGGQGGGGAAGP

SEQ ID NO: 741169 - protein, 18 aa, Mycobacterium
TTTATRTADGWSVNGQKT

SEQ ID NO: 741170 - protein, 28 aa, Mycobacterium
TTTDLTAASLLKSMPAAVNAPAQALFGR

SEQ ID NO: 741171 - protein, 24 aa, Mycobacterium
TTTDPIALNFVWDQLYHYEVGPRT

SEQ ID NO: 741172 - protein, 22 aa, Mycobacterium
TTTDWLESRHCFSFGDHYDPDN

SEQ ID NO: 741173 - protein, 24 aa, Mycobacterium
TTTLRLATAVALPLEHELFTLAKQ

SEQ ID NO: 741174 - protein, 18 aa, Mycobacterium
TTTPKVEGSWFWVDGQNA

SEQ ID NO: 741175 - protein, 19 aa, Mycobacterium
TTTPWLPGQVHVFIHGEAQ

SEQ ID NO: 741176 - protein, 26 aa, Mycobacterium
TTTPWLTSRHSFSFGDHYDPDNTHYG

SEQ ID NO: 741177 - protein, 25 aa, Mycobacterium
TTTPWLTSRHSFSFGDHYDPENTHH

SEQ ID NO: 741178 - protein, 20 aa, Mycobacterium
TTTRLIGWAGKTLADYPDQR

SEQ ID NO: 741179 - protein, 20 aa, Mycobacterium
TTTRLIGWAGKTLADYPEQR

SEQ ID NO: 741180 - protein, 23 aa, Mycobacterium
TTTRLLGRLAPRRQPPKTVPPLR

SEQ ID NO: 741181 - protein, 26 aa, Mycobacterium
TTTSWLTSRHSFSFGDHYDPDNTHHG

SEQ ID NO: 741182 - protein, 26 aa, Mycobacterium
TTTTLRAGAVLGVIMLGLTGCGGQRG

SEQ ID NO: 741183 - protein, 19 aa, Mycobacterium
TTTVARLLAAFAEQAELAG

SEQ ID NO: 741184 - protein, 18 aa, Mycobacterium
TTTVARLLALLADQASSA

SEQ ID NO: 741185 - protein, 19 aa, Mycobacterium
TTTVARLLALLAEQAALAG

SEQ ID NO: 741186 - protein, 18 aa, Mycobacterium
TTTYCPYKGEANYYSLEF

SEQ ID NO: 741187 - protein, 26 aa, Mycobacterium
TTVADPLDVRVCTGGKPLPGMEARIV

SEQ ID NO: 741188 - protein, 25 aa, Mycobacterium
TTVARFESYRGFLFGSLNPDVLPLT

SEQ ID NO: 741189 - protein, 22 aa, Mycobacterium
TTVCKRGRRISVVDVELNQGAR

SEQ ID NO: 741190 - protein, 24 aa, Mycobacterium
TTVFGGNCGFTLAPAAADQHDYLT

SEQ ID NO: 741191 - protein, 25 aa, Mycobacterium
TTVGHRQAIRWARSQFGVELVWAIE

SEQ ID NO: 741192 - protein, 26 aa, Mycobacterium
TTVGPYLRYGLPLVAACAAAGTDYAD

SEQ ID NO: 741193 - protein, 17 aa, Mycobacterium
TTVGWKGLINDPAMDGS

SEQ ID NO: 741194 - protein, 17 aa, Mycobacterium
TTVITLSDWIAYRLCGE

SEQ ID NO: 741195 - protein, 24 aa, Mycobacterium
TTVKAGLGLLGFPVGDPRPPLLPL

SEQ ID NO: 741196 - protein, 17 aa, Mycobacterium
TTVKVRSVLTCTTGTGV

SEQ ID NO: 741197 - protein, 19 aa, Mycobacterium
TTVLDGLGHWWMVEDPQRG

SEQ ID NO: 741198 - protein, 18 aa, Mycobacterium
TTVLRLLRTLADERFTFR

SEQ ID NO: 741199 - protein, 19 aa, Mycobacterium
TTVLWRKLVLNALAGLMAL

SEQ ID NO: 741200 - protein, 18 aa, Mycobacterium
TTVNLKAAIKAASDRVVF

SEQ ID NO: 741201 - protein, 19 aa, Mycobacterium
TTVNLLFEPIMPMKPIVLP

SEQ ID NO: 741202 - protein, 17 aa, Mycobacterium
TTVPAAFAHHLPSGYSD

SEQ ID NO: 741203 - protein, 17 aa, Mycobacterium
TTVPKVWFHDLIRPEGR

SEQ ID NO: 741204 - protein, 17 aa, Mycobacterium
TTVRSAAVIDGRNCLDA

SEQ ID NO: 741205 - protein, 39 aa, Mycobacterium
TTVSVEFTSYVPPAITGTFGLPVALTLDAAGSAVTTANA

SEQ ID NO: 741206 - protein, 18 aa, Mycobacterium
TTVWAEFLLGHSPRELDC

SEQ ID NO: 741207 - protein, 17 aa, Mycobacterium
TTVWKIGPALVAGNSVV

SEQ ID NO: 741208 - protein, 23 aa, Mycobacterium
TTWEYDWPVARWRNHLRAQVDGA

SEQ ID NO: 741209 - protein, 18 aa, Mycobacterium
TTWFATVVASGFDSLVND

SEQ ID NO: 741210 - protein, 23 aa, Mycobacterium
TTWFPNDIGRFGRPEEVAAAVAF

SEQ ID NO: 741211 - protein, 28 aa, Mycobacterium
TTWPKLVARPRLGLSLLAEDHEDAARLL

SEQ ID NO: 741212 - protein, 26 aa, Mycobacterium
TTWPNLRGAPRLGISVLGESHDEAAR

SEQ ID NO: 741213 - protein, 17 aa, Mycobacterium
TTWQTKTGWLTVRDALV

SEQ ID NO: 741214 - protein, 18 aa, Mycobacterium
TTWRDGAFRWYKPEDTVA

SEQ ID NO: 741215 - protein, 20 aa, Mycobacterium
TTWRRLGLTVPLVVDPVAAS

SEQ ID NO: 741216 - protein, 42 aa, Mycobacterium
TTYDPIILDFLWENTYHYDIGPRIFGPYEIPIVNFSGTGFGN

SEQ ID NO: 741217 - protein, 25 aa, Mycobacterium
TTYLRRRPAPGWMRVMASSTVIGDS

SEQ ID NO: 741218 - protein, 23 aa, Mycobacterium
TTYLSELRWWTSPFTTDPSHAPE

SEQ ID NO: 741219 - protein, 23 aa, Mycobacterium
TTYMSELRWWTSPFSSNADHAPE

SEQ ID NO: 741220 - protein, 25 aa, Mycobacterium
TVAAARWPAVRFAVRNTAVQGPSAV

SEQ ID NO: 741221 - protein, 19 aa, Mycobacterium
TVAAAVFTRPEIAAVGVPQ

SEQ ID NO: 741222 - protein, 24 aa, Mycobacterium
TVAAELPPLAGIVHAAGEIGTTPL

SEQ ID NO: 741223 - protein, 18 aa, Mycobacterium
TVAALGCSVLMEIGPQPI

SEQ ID NO: 741224 - protein, 23 aa, Mycobacterium
TVAAQLAPWQGVLQTLQGNASSS

SEQ ID NO: 741225 - protein, 25 aa, Mycobacterium
TVAASELRPAALASPLSSLDSAMVA

SEQ ID NO: 741226 - protein, 18 aa, Mycobacterium
TVAAVRFLIEGLVDGRPA

SEQ ID NO: 741227 - protein, 31 aa, Mycobacterium
TVAAWPRLVRRLPVLGPWVRNLLDADAREKA

SEQ ID NO: 741228 - protein, 17 aa, Mycobacterium
TVACGFSGHGFKFVPVV

SEQ ID NO: 741229 - protein, 20 aa, Mycobacterium
TVADAFRFVGSRLQPAVTRV

SEQ ID NO: 741230 - protein, 22 aa, Mycobacterium
TVADARAAIGFYVDALGARVLG

SEQ ID NO: 741231 - protein, 18 aa, Mycobacterium
TVADGDYDLGRFVTEKNA

SEQ ID NO: 741232 - protein, 22 aa, Mycobacterium
TVADLVALRFGPQVVARLVDPL

SEQ ID NO: 741233 - protein, 18 aa, Mycobacterium
TVADMMIYMAWSMSGRGA

SEQ ID NO: 741234 - protein, 22 aa, Mycobacterium
TVADMRGVLALFEGVATGAADG

SEQ ID NO: 741235 - protein, 23 aa, Mycobacterium
TVADSFHLPIVFLADNPGMLPGS

SEQ ID NO: 741236 - protein, 20 aa, Mycobacterium
TVADVLRLNCTIDDIERPAR

SEQ ID NO: 741237 - protein, 17 aa, Mycobacterium
TVADVRFVPAGAIPRTT

SEQ ID NO: 741238 - protein, 20 aa, Mycobacterium
TVADYGRFVRAWLNDGELDG

SEQ ID NO: 741239 - protein, 18 aa, Mycobacterium
TVAEARPRGRTVWFTGLS

SEQ ID NO: 741240 - protein, 18 aa, Mycobacterium
TVAELGALAGRVTRALAE

SEQ ID NO: 741241 - protein, 17 aa, Mycobacterium
TVAELKPGSPDGIVDLL

SEQ ID NO: 741242 - protein, 27 aa, Mycobacterium
TVAELRTRLRGILARELGMPEDAVDVE

SEQ ID NO: 741243 - protein, 24 aa, Mycobacterium
TVAEPGALIGFLGPRVYQLLYGEP

SEQ ID NO: 741244 - protein, 26 aa, Mycobacterium
TVAEPGWTMYMISHFHYDPVWWNTQA

SEQ ID NO: 741245 - protein, 23 aa, Mycobacterium
TVAGFPLDFFVDGVARTSPARAA

SEQ ID NO: 741246 - protein, 18 aa, Mycobacterium
TVAGGWALVRALREDGRT

SEQ ID NO: 741247 - protein, 22 aa, Mycobacterium
TVAGHIAILFGLTGPTSVYSPF

SEQ ID NO: 741248 - protein, 30 aa, Mycobacterium
TVAGIHLEGPWLSRARCGAHDPARMRDPDP

SEQ ID NO: 741249 - protein, 20 aa, Mycobacterium
TVAGKARYLSSVCTGSLILA

SEQ ID NO: 741250 - protein, 18 aa, Mycobacterium
TVAGMAAVGQRIARAARE

SEQ ID NO: 741251 - protein, 23 aa, Mycobacterium
TVAGRNAERLDWLRTVGADDAIM

SEQ ID NO: 741252 - protein, 18 aa, Mycobacterium
TVAGVKLAVLAAQTGAVP

SEQ ID NO: 741253 - protein, 17 aa, Mycobacterium
TVAHGGSIMFVGTKKQA

SEQ ID NO: 741254 - protein, 26 aa, Mycobacterium
TVAIDLRDDWPTALRGSGFDADSPTA

SEQ ID NO: 741255 - protein, 18 aa, Mycobacterium
TVAIPHGWGHNGSGGWRI

SEQ ID NO: 741256 - protein, 19 aa, Mycobacterium
TVAIPSLFGKPGKAVSIGY

SEQ ID NO: 741257 - protein, 29 aa, Mycobacterium
TVAKAELEWSLTRSVLWEAAAMPHHVEGK

SEQ ID NO: 741258 - protein, 19 aa, Mycobacterium
TVAKRGAAIIDARGASSAA

SEQ ID NO: 741259 - protein, 19 aa, Mycobacterium
TVAKRGAAVIDARGASSAA

SEQ ID NO: 741260 - protein, 18 aa, Mycobacterium
TVALPLDCTYDFEVTAAK

SEQ ID NO: 741261 - protein, 24 aa, Mycobacterium
TVALSRLPVDDWVGIQADSHHAAD

SEQ ID NO: 741262 - protein, 29 aa, Mycobacterium
TVANLPANIGLAVADAVNFPAELQGYLGK

SEQ ID NO: 741263 - protein, 17 aa, Mycobacterium
TVANPDAIVGMLGLSGI

SEQ ID NO: 741264 - protein, 21 aa, Mycobacterium
TVAPDLDKWVVYVPRENAQAV

SEQ ID NO: 741265 - protein, 23 aa, Mycobacterium
TVAPEQSALWGFGRAAALELPQV

SEQ ID NO: 741266 - protein, 21 aa, Mycobacterium
TVAPFVVLGCHGDEGRILLPE

SEQ ID NO: 741267 - protein, 18 aa, Mycobacterium
TVAPGREPVVISVDTESG

SEQ ID NO: 741268 - protein, 19 aa, Mycobacterium
TVAPLCDAMARLGGVTLSK

SEQ ID NO: 741269 - protein, 22 aa, Mycobacterium
TVAQRRLPLLIASGADVHVISR

SEQ ID NO: 741270 - protein, 23 aa, Mycobacterium
TVAQRRLPLLVSNGADVHVVTKA

SEQ ID NO: 741271 - protein, 23 aa, Mycobacterium
TVARASALFLRRGEHPDGAVWSA

SEQ ID NO: 741272 - protein, 22 aa, Mycobacterium
TVARAYPRRKLHVVCDNYHTHK

SEQ ID NO: 741273 - protein, 23 aa, Mycobacterium
TVARQRIAVIRAIRNALERRGFL

SEQ ID NO: 741274 - protein, 18 aa, Mycobacterium
TVARRGTAIIEARGASSA

SEQ ID NO: 741275 - protein, 17 aa, Mycobacterium
TVARRIRSGMVAVNGGF

SEQ ID NO: 741276 - protein, 18 aa, Mycobacterium
TVARRLQSGSVWINQGSR

SEQ ID NO: 741277 - protein, 17 aa, Mycobacterium
TVARTAFDLGRRIPGDE

SEQ ID NO: 741278 - protein, 19 aa, Mycobacterium
TVASATFTRPEIAAVGIPQ

SEQ ID NO: 741279 - protein, 19 aa, Mycobacterium
TVASAWRFGPGEVLWTAMP

SEQ ID NO: 741280 - protein, 18 aa, Mycobacterium
TVASRLGLPRGALRVIAL

SEQ ID NO: 741281 - protein, 25 aa, Mycobacterium
TVASSRWPAVRFAIRNTIVQGPNAV

SEQ ID NO: 741282 - protein, 25 aa, Mycobacterium
TVATGRWPGVRFAVRNTAVQGPNAV

SEQ ID NO: 741283 - protein, 20 aa, Mycobacterium
TVAVIPRFQELLAEYQSPDG

SEQ ID NO: 741284 - protein, 23 aa, Mycobacterium
TVAVLLRITEVFGVDATFFASQD

SEQ ID NO: 741285 - protein, 17 aa, Mycobacterium
TVAVLQFEIRGMVKGNP

SEQ ID NO: 741286 - protein, 22 aa, Mycobacterium
TVAVPARFSGVRVYGDVTEGVT

SEQ ID NO: 741287 - protein, 18 aa, Mycobacterium
TVAWALATVHHWPDVDAG

SEQ ID NO: 741288 - protein, 17 aa, Mycobacterium
TVCADLWDTPASRHEAA

SEQ ID NO: 741289 - protein, 17 aa, Mycobacterium
TVCAPRSGLLGRPGPHR

SEQ ID NO: 741290 - protein, 17 aa, Mycobacterium
TVCDARPVFATRARFPT

SEQ ID NO: 741291 - protein, 17 aa, Mycobacterium
TVCDARPVFATTARFPT

SEQ ID NO: 741292 - protein, 18 aa, Mycobacterium
TVCDGLWDTPASRHEAAC

SEQ ID NO: 741293 - protein, 19 aa, Mycobacterium
TVCGHPSSTITYTLQNRPV

SEQ ID NO: 741294 - protein, 24 aa, Mycobacterium
TVCILDRPRHAQLIEDVRATGARI

SEQ ID NO: 741295 - protein, 25 aa, Mycobacterium
TVCILDRPRHAQLIEDVRATGARIR

SEQ ID NO: 741296 - protein, 24 aa, Mycobacterium
TVCILDRPRHAQLIHDVRATGARI

SEQ ID NO: 741297 - protein, 25 aa, Mycobacterium
TVCILDRPRHAQLIHDVRATGARIR

SEQ ID NO: 741298 - protein, 26 aa, Mycobacterium
TVCPGPVRTARLVKQFAANARDWNCT

SEQ ID NO: 741299 - protein, 17 aa, Mycobacterium
TVCQRSGLAQRYFYESF

SEQ ID NO: 741300 - protein, 17 aa, Mycobacterium
TVCRATQWLDLRFVSGP

SEQ ID NO: 741301 - protein, 30 aa, Mycobacterium
TVCYDIRFPELYTELARRGASLIAVCASWG

SEQ ID NO: 741302 - protein, 23 aa, Mycobacterium
TVDAAGLLKIWEALIIVYPNGTP

SEQ ID NO: 741303 - protein, 24 aa, Mycobacterium
TVDADRPFLEYGLDSLGMLEMRTH

SEQ ID NO: 741304 - protein, 27 aa, Mycobacterium
TVDAPLVWRKRLLRKAIDFGGPLRYTP

SEQ ID NO: 741305 - protein, 31 aa, Mycobacterium
TVDAVTFDLRWKAACGLPITAAAFHSTTLTY

SEQ ID NO: 741306 - protein, 30 aa, Mycobacterium
TVDAVTFDLRWKAACGLPVTAGAFHSTTLT

SEQ ID NO: 741307 - protein, 24 aa, Mycobacterium
TVDAWRAAGEDVVFLDSRTPAEYR

SEQ ID NO: 741308 - protein, 33 aa, Mycobacterium
TVDCGLAGTVLRFLPPVAALRHAPTVFDGDEQA

SEQ ID NO: 741309 - protein, 31 aa, Mycobacterium
TVDCGLAGTVLRFVPPVAALSRSSVTFDGDE

SEQ ID NO: 741310 - protein, 20 aa, Mycobacterium
TVDCLVKYGYAGTTTTRVAQ

SEQ ID NO: 741311 - protein, 25 aa, Mycobacterium
TVDDAWPAVLTWRAHDEPRMESVRV

SEQ ID NO: 741312 - protein, 26 aa, Mycobacterium
TVDDAWRPDTVWRHRLGAGLPGERVY

SEQ ID NO: 741313 - protein, 25 aa, Mycobacterium
TVDDAWRPDTVWRHRLGSGQPAQRV

SEQ ID NO: 741314 - protein, 27 aa, Mycobacterium
TVDDAWRPDTVWRYRLGPGAVSEQVYH

SEQ ID NO: 741315 - protein, 24 aa, Mycobacterium
TVDDRGRIGLPRIGIEAVAANWDN

SEQ ID NO: 741316 - protein, 18 aa, Mycobacterium
TVDEISPLIAEWDYGAYE

SEQ ID NO: 741317 - protein, 19 aa, Mycobacterium
TVDEWFPANMLVALERHIA

SEQ ID NO: 741318 - protein, 18 aa, Mycobacterium
TVDGEVRAAALLRTLSLG

SEQ ID NO: 741319 - protein, 29 aa, Mycobacterium
TVDGLRRDYRWAEAERHLWIADVRGTWHI

SEQ ID NO: 741320 - protein, 29 aa, Mycobacterium
TVDGVDALHRWLVAWADIYDAHAAVFAEF

SEQ ID NO: 741321 - protein, 24 aa, Mycobacterium
TVDLLDRELLGISEALRSSGLSAG

SEQ ID NO: 741322 - protein, 25 aa, Mycobacterium
TVDLSWTDIPIADSFKVQQSPTGAG

SEQ ID NO: 741323 - protein, 24 aa, Mycobacterium
TVDNPQCLGAWAAAQGAVYTNTGA

SEQ ID NO: 741324 - protein, 26 aa, Mycobacterium
TVDPVKLRLGIGYVIQNAGLMPHQRV

SEQ ID NO: 741325 - protein, 30 aa, Mycobacterium
TVDRAAFRWWLVLATLRWGVICRYQAERHL

SEQ ID NO: 741326 - protein, 24 aa, Mycobacterium
TVDRAVKLAEEFERAAPSSWAALR

SEQ ID NO: 741327 - protein, 17 aa, Mycobacterium
TVDRCARRQFFARERSR

SEQ ID NO: 741328 - protein, 24 aa, Mycobacterium
TVDRLGYALIRLSGQITGPAELPP

SEQ ID NO: 741329 - protein, 25 aa, Mycobacterium
TVDSGEPWLSLDFHTPAREQFVEDL

SEQ ID NO: 741330 - protein, 17 aa, Mycobacterium
TVDWHRAIVDKWRAAGV

SEQ ID NO: 741331 - protein, 25 aa, Mycobacterium
TVEDRARNGLSIVIAPEGTRLDTTE

SEQ ID NO: 741332 - protein, 17 aa, Mycobacterium
TVEFPRAACTAVTGPNG

SEQ ID NO: 741333 - protein, 24 aa, Mycobacterium
TVEGFTRDGVHRWRSIPYARPPVG

SEQ ID NO: 741334 - protein, 24 aa, Mycobacterium
TVEGRPTIKTTLSFEPPPDFVAET

SEQ ID NO: 741335 - protein, 17 aa, Mycobacterium
TVEHTIEILKGLRDRYE

SEQ ID NO: 741336 - protein, 22 aa, Mycobacterium
TVEHYRMLAGRGVPTGLTIGPW

SEQ ID NO: 741337 - protein, 20 aa, Mycobacterium
TVEIVKWAKGQGISITAEVT

SEQ ID NO: 741338 - protein, 31 aa, Mycobacterium
TVELAKSGAWCVAADFSVGMLAAGASRQVPK

SEQ ID NO: 741339 - protein, 31 aa, Mycobacterium
TVELAKSGAWCVAADFSVGMLAAGGARKVPK

SEQ ID NO: 741340 - protein, 25 aa, Mycobacterium
TVELAKSGAWCVAADFSVGMLAAGH

SEQ ID NO: 741341 - protein, 18 aa, Mycobacterium
TVELKKSGAWCVAADFSV

SEQ ID NO: 741342 - protein, 23 aa, Mycobacterium
TVELKTNFLGAAREGKLTAVAVP

SEQ ID NO: 741343 - protein, 32 aa, Mycobacterium
TVEPGDFVILNWRAVCGQCRACKRGRPHYCFD

SEQ ID NO: 741344 - protein, 31 aa, Mycobacterium
TVEPGDFVILNWRAVCGVCRACKRGRPQYCF

SEQ ID NO: 741345 - protein, 34 aa, Mycobacterium
TVERGNPDYGLRLSWDFLARSTAGLWEWAECLGD

SEQ ID NO: 741346 - protein, 22 aa, Mycobacterium
TVERIERVGGWLSCTANEEGGG

SEQ ID NO: 741347 - protein, 25 aa, Mycobacterium
TVESFGFKYGLPMDADMVVDVRFLP

SEQ ID NO: 741348 - protein, 17 aa, Mycobacterium
TVESLRVTMPINIRTAA

SEQ ID NO: 741349 - protein, 22 aa, Mycobacterium
TVESRPAGPVQRDRYATLVMDF

SEQ ID NO: 741350 - protein, 22 aa, Mycobacterium
TVETCPHYLTLLAEEIPNGATA

SEQ ID NO: 741351 - protein, 17 aa, Mycobacterium
TVEVMAHWLGRGADGWR

SEQ ID NO: 741352 - protein, 19 aa, Mycobacterium
TVEVPLLWRKRLLRKAIDF

SEQ ID NO: 741353 - protein, 27 aa, Mycobacterium
TVEVPRRTVCCGLTWISTGQLTTAKRV

SEQ ID NO: 741354 - protein, 18 aa, Mycobacterium
TVEVTFGGFAARVRGSDV

SEQ ID NO: 741355 - protein, 23 aa, Mycobacterium
TVEVTFGGFAARVSGGDVDIAVT

SEQ ID NO: 741356 - protein, 18 aa, Mycobacterium
TVEVTFGGFSARVRGGDV

SEQ ID NO: 741357 - protein, 31 aa, Mycobacterium
TVEWLRRQPWFTGRFATIGVSYLGFTQWALL

SEQ ID NO: 741358 - protein, 17 aa, Mycobacterium
TVEYLVDAVFNYPTFSE

SEQ ID NO: 741359 - protein, 24 aa, Mycobacterium
TVFATHIALGWSMMRRNDQFRSAL

SEQ ID NO: 741360 - protein, 17 aa, Mycobacterium
TVFCERYLPTGHHIEVQ

SEQ ID NO: 741361 - protein, 19 aa, Mycobacterium
TVFCERYLPTGHHVEVQVL

SEQ ID NO: 741362 - protein, 24 aa, Mycobacterium
TVFDGGWILPGLVDAHCHVGLGDH

SEQ ID NO: 741363 - protein, 23 aa, Mycobacterium
TVFDGGWILPGLVDAHCHVGLGH

SEQ ID NO: 741364 - protein, 25 aa, Mycobacterium
TVFDIMLLAHGWALKHWHFGPLYTR

SEQ ID NO: 741365 - protein, 26 aa, Mycobacterium
TVFDRLRFEINLGFQPFNFELAMAAH

SEQ ID NO: 741366 - protein, 17 aa, Mycobacterium
TVFEELFWGDAGIALSI

SEQ ID NO: 741367 - protein, 23 aa, Mycobacterium
TVFEHLGRLLIIDCGVMFPTHDE

SEQ ID NO: 741368 - protein, 22 aa, Mycobacterium
TVFFPANMPLPAKIIYQVLEPI

SEQ ID NO: 741369 - protein, 20 aa, Mycobacterium
TVFGALRLIQGFTPALEESK

SEQ ID NO: 741370 - protein, 19 aa, Mycobacterium
TVFIPEEDAFAFSVVGDIG

SEQ ID NO: 741371 - protein, 17 aa, Mycobacterium
TVFKLELACADALSRAM

SEQ ID NO: 741372 - protein, 22 aa, Mycobacterium
TVFPDGRIRSIALSPGVVRMSE

SEQ ID NO: 741373 - protein, 17 aa, Mycobacterium
TVFPGPDAIVVTAAEQQ

SEQ ID NO: 741374 - protein, 20 aa, Mycobacterium
TVFRAPCVFFIQNNQWAISV

SEQ ID NO: 741375 - protein, 20 aa, Mycobacterium
TVFRSELTEWMYADDGKGRA

SEQ ID NO: 741376 - protein, 24 aa, Mycobacterium
TVFTLSGGHLFSLYDGCRDEGVRL

SEQ ID NO: 741377 - protein, 23 aa, Mycobacterium
TVFYCVANMPGAVPRTSTFALTN

SEQ ID NO: 741378 - protein, 21 aa, Mycobacterium
TVGACGICGTDAHFVNGGFPG

SEQ ID NO: 741379 - protein, 19 aa, Mycobacterium
TVGAIKAIFAAWEGQRRLD

SEQ ID NO: 741380 - protein, 20 aa, Mycobacterium
TVGARLLVLRRLAYPDDARL

SEQ ID NO: 741381 - protein, 18 aa, Mycobacterium
TVGCSWCVDFGSMLQRLD

SEQ ID NO: 741382 - protein, 18 aa, Mycobacterium
TVGDAWSADVVVKVAPPT

SEQ ID NO: 741383 - protein, 23 aa, Mycobacterium
TVGDEVRVPDALIQPIAAADLAA

SEQ ID NO: 741384 - protein, 25 aa, Mycobacterium
TVGDIRGAVMLGVYYNEYQSASAGN

SEQ ID NO: 741385 - protein, 24 aa, Mycobacterium
TVGDPKLDLGWMVQSWPEDTENPA

SEQ ID NO: 741386 - protein, 24 aa, Mycobacterium
TVGDRITTPMLRDGGVLRPASWSE

SEQ ID NO: 741387 - protein, 22 aa, Mycobacterium
TVGDRLLADMLRGMTPADAQQA

SEQ ID NO: 741388 - protein, 17 aa, Mycobacterium
TVGECSRCLTPVDGRVQ

SEQ ID NO: 741389 - protein, 17 aa, Mycobacterium
TVGECSRCLTPVTGSVQ

SEQ ID NO: 741390 - protein, 25 aa, Mycobacterium
TVGEYGVTVGFELTRVQSLRLHYAR

SEQ ID NO: 741391 - protein, 25 aa, Mycobacterium
TVGFMRRDYANFGFEHADVIVAVGY

SEQ ID NO: 741392 - protein, 26 aa, Mycobacterium
TVGGFDLPALQTRSITVGGIDAGGFR

SEQ ID NO: 741393 - protein, 17 aa, Mycobacterium
TVGHCFFDTAIGSCAIA

SEQ ID NO: 741394 - protein, 23 aa, Mycobacterium
TVGIDLRDDWPKVLRDSGFDVTA

SEQ ID NO: 741395 - protein, 23 aa, Mycobacterium
TVGIPMRCVLTLTAMGFLPQPTA

SEQ ID NO: 741396 - protein, 21 aa, Mycobacterium
TVGKVRRVRLLPGDPPATRQA

SEQ ID NO: 741397 - protein, 22 aa, Mycobacterium
TVGLDPVLRVDLWQQFAELARA

SEQ ID NO: 741398 - protein, 29 aa, Mycobacterium
TVGLMLTNRPEFHIADMATLLAGATPFSL

SEQ ID NO: 741399 - protein, 24 aa, Mycobacterium
TVGLRSSYIASWYAAPLLAAQDRA

SEQ ID NO: 741400 - protein, 22 aa, Mycobacterium
TVGMLFSPGYPGFLRGVIAGGA

SEQ ID NO: 741401 - protein, 18 aa, Mycobacterium
TVGNGGTVALHWPPSLHQ

SEQ ID NO: 741402 - protein, 27 aa, Mycobacterium
TVGNPPGPCRAVGATDLTFAGGWKEYR

SEQ ID NO: 741403 - protein, 18 aa, Mycobacterium
TVGQKVQGLLGWQEYAVL

SEQ ID NO: 741404 - protein, 17 aa, Mycobacterium
TVGRIFVSNAIPFDGYT

SEQ ID NO: 741405 - protein, 25 aa, Mycobacterium
TVGRPVAGCPVRILNKSDRPVGPRV

SEQ ID NO: 741406 - protein, 24 aa, Mycobacterium
TVGSAGRPRYDFQPGEPEGYRGRE

SEQ ID NO: 741407 - protein, 19 aa, Mycobacterium
TVGSFAALHPVVLTASGQT

SEQ ID NO: 741408 - protein, 18 aa, Mycobacterium
TVGYKRAIWWAQYGAARL

SEQ ID NO: 741409 - protein, 18 aa, Mycobacterium
TVGYWRLYFQWASFEILP

SEQ ID NO: 741410 - protein, 22 aa, Mycobacterium
TVHGESSYFVWLNRGKESLTVD

SEQ ID NO: 741411 - protein, 23 aa, Mycobacterium
TVHGGTLICRWHGLALDGHSREF

SEQ ID NO: 741412 - protein, 18 aa, Mycobacterium
TVHLPQRVPMGFHGNWAP

SEQ ID NO: 741413 - protein, 17 aa, Mycobacterium
TVHPVVASSLYFMRTLG

SEQ ID NO: 741414 - protein, 20 aa, Mycobacterium
TVHQLRWPRDRNLVDTMLAA

SEQ ID NO: 741415 - protein, 20 aa, Mycobacterium
TVHSPFRFDGLAVRNKRFPD

SEQ ID NO: 741416 - protein, 18 aa, Mycobacterium
TVIACERVGVATGWAPGI

SEQ ID NO: 741417 - protein, 25 aa, Mycobacterium
TVIDPRLLTTMPEWLNAATGLDALT

SEQ ID NO: 741418 - protein, 20 aa, Mycobacterium
TVIDVLRGKLEFETGEEGRE

SEQ ID NO: 741419 - protein, 17 aa, Mycobacterium
TVIDVNLIGTWNTCRAA

SEQ ID NO: 741420 - protein, 17 aa, Mycobacterium
TVIGCSRSPLDGLPGIE

SEQ ID NO: 741421 - protein, 27 aa, Mycobacterium
TVIGCSRSRLDTIPGVEPDWAVRASQK

SEQ ID NO: 741422 - protein, 18 aa, Mycobacterium
TVIHEIAHHFGIDDARLD

SEQ ID NO: 741423 - protein, 17 aa, Mycobacterium
TVIHEIAHHFGIDDERL

SEQ ID NO: 741424 - protein, 19 aa, Mycobacterium
TVIKADWRTGASDAMTQKV

SEQ ID NO: 741425 - protein, 24 aa, Mycobacterium
TVILPRLVGQVLRGATPGPVSLSA

SEQ ID NO: 741426 - protein, 22 aa, Mycobacterium
TVILRACAVLDLADALDQELAR

SEQ ID NO: 741427 - protein, 25 aa, Mycobacterium
TVINRHVFESLAFNARIALHVRTLY

SEQ ID NO: 741428 - protein, 22 aa, Mycobacterium
TVIPDPCHQCMGDGRVRARREI

SEQ ID NO: 741429 - protein, 17 aa, Mycobacterium
TVIPGMPGMGAAARNSA

SEQ ID NO: 741430 - protein, 17 aa, Mycobacterium
TVIPIPFPVPAGITKGR

SEQ ID NO: 741431 - protein, 20 aa, Mycobacterium
TVIRDEWLPAMQDAVAAVTA

SEQ ID NO: 741432 - protein, 27 aa, Mycobacterium
TVISSGLMNTGFLPFWNQPVYIDYSPA

SEQ ID NO: 741433 - protein, 27 aa, Mycobacterium
TVISTPRWTELRARIRDYLGTKIEFRL

SEQ ID NO: 741434 - protein, 25 aa, Mycobacterium
TVISVLSLLCFVPGALRDLTMPAGM

SEQ ID NO: 741435 - protein, 35 aa, Mycobacterium
TVITGLPGVLSRRIDPRAGTVMVWGAVNAGQAANA

SEQ ID NO: 741436 - protein, 19 aa, Mycobacterium
TVIWVPGWMVSNVDTIDEP

SEQ ID NO: 741437 - protein, 19 aa, Mycobacterium
TVKDILGRFGHVDYLVNNA

SEQ ID NO: 741438 - protein, 25 aa, Mycobacterium
TVKHAMAALVDRVCEVVGREPALLA

SEQ ID NO: 741439 - protein, 24 aa, Mycobacterium
TVKHAMAAMIDRVCEVVGEGPAAV

SEQ ID NO: 741440 - protein, 17 aa, Mycobacterium
TVKHVWDVVRRVLKYAV

SEQ ID NO: 741441 - protein, 17 aa, Mycobacterium
TVKLGPEYGDWANNAHS

SEQ ID NO: 741442 - protein, 17 aa, Mycobacterium
TVKLLFRDAHALGDRFE

SEQ ID NO: 741443 - protein, 27 aa, Mycobacterium
TVKPRSCAALPRILRDNGYVTGAFGKW

SEQ ID NO: 741444 - protein, 17 aa, Mycobacterium
TVKRGDVLGHEFMGEVV

SEQ ID NO: 741445 - protein, 18 aa, Mycobacterium
TVKRVIRHDAGWISNPLP

SEQ ID NO: 741446 - protein, 30 aa, Mycobacterium
TVKSEEFVTLWADHRVKRCEADTYDLRHPI

SEQ ID NO: 741447 - protein, 23 aa, Mycobacterium
TVKSRLHYAVRALKLSLQEMGVT

SEQ ID NO: 741448 - protein, 26 aa, Mycobacterium
TVKTFKRAGGQIWLMPHNPAFDPIPG

SEQ ID NO: 741449 - protein, 21 aa, Mycobacterium
TVKTFKRAGGQVWLMPHNPSF

SEQ ID NO: 741450 - protein, 26 aa, Mycobacterium
TVKTSWQGAGGIGGFFEKTFAPLGLR

SEQ ID NO: 741451 - protein, 23 aa, Mycobacterium
TVKYRVGRAVARRGRAIGSDRLD

SEQ ID NO: 741452 - protein, 24 aa, Mycobacterium
TVLAAKADSAWHLHQLTANTELAA

SEQ ID NO: 741453 - protein, 20 aa, Mycobacterium
TVLAAPGFEADDIIATLATQ

SEQ ID NO: 741454 - protein, 23 aa, Mycobacterium
TVLAAQGSYVWDGDGTRLLDFSS

SEQ ID NO: 741455 - protein, 17 aa, Mycobacterium
TVLCGELSLMAAQTNPG

SEQ ID NO: 741456 - protein, 18 aa, Mycobacterium
TVLCRDRQEVAGLYALPV

SEQ ID NO: 741457 - protein, 23 aa, Mycobacterium
TVLDEPWCRSLATHLGHFDTDAV

SEQ ID NO: 741458 - protein, 28 aa, Mycobacterium
TVLDFLAPHLDWLDVRFCGEEDDETFYR

SEQ ID NO: 741459 - protein, 26 aa, Mycobacterium
TVLDIARGAPWPAKYPGRSLGHPFLE

SEQ ID NO: 741460 - protein, 17 aa, Mycobacterium
TVLDKPGSVVLWTNCHH

SEQ ID NO: 741461 - protein, 18 aa, Mycobacterium
TVLDRLGLAGANIEIRST

SEQ ID NO: 741462 - protein, 22 aa, Mycobacterium
TVLGALRLRWLGTELNATPIDA

SEQ ID NO: 741463 - protein, 24 aa, Mycobacterium
TVLGTGRAPMHWDTGSFGTQTDSE

SEQ ID NO: 741464 - protein, 18 aa, Mycobacterium
TVLLHRLGVPYAAIMTPV

SEQ ID NO: 741465 - protein, 21 aa, Mycobacterium
TVLLNHQFHRAINVAADSPKL

SEQ ID NO: 741466 - protein, 20 aa, Mycobacterium
TVLLPRFVAQLLRGEEPDRL

SEQ ID NO: 741467 - protein, 22 aa, Mycobacterium
TVLLRHCPSLAPALDGVTNPFA

SEQ ID NO: 741468 - protein, 34 aa, Mycobacterium
TVLLSGANGWLGRFLTLQWLERLAPVGGTLITIV

SEQ ID NO: 741469 - protein, 17 aa, Mycobacterium
TVLMSSLSWFLVLEQAV

SEQ ID NO: 741470 - protein, 19 aa, Mycobacterium
TVLMTGFGFGPPVVTPTWG

SEQ ID NO: 741471 - protein, 26 aa, Mycobacterium
TVLPFSWQGVCLHAAGASRVRVRLAP

SEQ ID NO: 741472 - protein, 20 aa, Mycobacterium
TVLPFTGLNTPLAVAVDSAG

SEQ ID NO: 741473 - protein, 20 aa, Mycobacterium
TVLPPALSIRNGRRSVVITG

SEQ ID NO: 741474 - protein, 17 aa, Mycobacterium
TVLPPKEQRNFGELLDA

SEQ ID NO: 741475 - protein, 19 aa, Mycobacterium
TVLQPGVIVNLPLGNMVLS

SEQ ID NO: 741476 - protein, 22 aa, Mycobacterium
TVLQRKELLGGKGANQAVGLAQ

SEQ ID NO: 741477 - protein, 25 aa, Mycobacterium
TVLRISPGLIRRYAVVGGDHNPIHT

SEQ ID NO: 741478 - protein, 24 aa, Mycobacterium
TVLRMLLDRTEWFEAADVGPWLPS

SEQ ID NO: 741479 - protein, 40 aa, Mycobacterium
TVLRPAAARLRRRLRIAHAWSFAFDAAWQPLVALLDGHTV

SEQ ID NO: 741480 - protein, 24 aa, Mycobacterium
TVLTAKADTAWHLHQLTTDADLDA

SEQ ID NO: 741481 - protein, 18 aa, Mycobacterium
TVLTGLFAVWDDLDALLA

SEQ ID NO: 741482 - protein, 18 aa, Mycobacterium
TVLVRPAPVPGFKGSRSF

SEQ ID NO: 741483 - protein, 37 aa, Mycobacterium
TVLVRPAPVPGYRGSRSFGLEEFDPFWQACVRAEIPV

SEQ ID NO: 741484 - protein, 37 aa, Mycobacterium
TVLVRPAPVPGYRGSRSLGLPEFDPFWDACVQAGIPV

SEQ ID NO: 741485 - protein, 20 aa, Mycobacterium
TVLWGGYTWQYWRATRSVKT

SEQ ID NO: 741486 - protein, 19 aa, Mycobacterium
TVLYGTGYIRKGIPGPRWI

SEQ ID NO: 741487 - protein, 25 aa, Mycobacterium
TVLYGTGYIRKGIPGPRWMPKPIWN

SEQ ID NO: 741488 - protein, 23 aa, Mycobacterium
TVLYKKSQVLFGLDLAKRDIAKG

SEQ ID NO: 741489 - protein, 24 aa, Mycobacterium
TVLYKKSSVLFGLDLAKRDIAKAH

SEQ ID NO: 741490 - protein, 24 aa, Mycobacterium
TVMAAAWCGVPAPPELRGVTVSMA

SEQ ID NO: 741491 - protein, 26 aa, Mycobacterium
TVMDGRAGTDFSRRLLTLIRRIEQLP

SEQ ID NO: 741492 - protein, 19 aa, Mycobacterium
TVMKAIWESLLLRGKDAEQ

SEQ ID NO: 741493 - protein, 23 aa, Mycobacterium
TVMPGEFVCLMGPSGSGKSTLLN

SEQ ID NO: 741494 - protein, 32 aa, Mycobacterium
TVMSPAAFIRRPLRWLREMAVKGEDRGGSFSA

SEQ ID NO: 741495 - protein, 38 aa, Mycobacterium
TVNDAFKPLSRFFDRVWRPEQLPAALLGAMRVLTDPVE

SEQ ID NO: 741496 - protein, 25 aa, Mycobacterium
TVNLTDMHIGWVFTRTERNNAHTHI

SEQ ID NO: 741497 - protein, 22 aa, Mycobacterium
TVNMVTAWRVLRAADPRIRPHR

SEQ ID NO: 741498 - protein, 17 aa, Mycobacterium
TVNRLHVLLTHLMPAGA

SEQ ID NO: 741499 - protein, 25 aa, Mycobacterium
TVNVSFHEPAAWDGWLLYSHESTQV

SEQ ID NO: 741500 - protein, 23 aa, Mycobacterium
TVPAGSAILMLFGAANRDPRRYH

SEQ ID NO: 741501 - protein, 18 aa, Mycobacterium
TVPDAVGFGKRWVTECLR

SEQ ID NO: 741502 - protein, 24 aa, Mycobacterium
TVPDNMGMLFRKHLVMFGPREVLL

SEQ ID NO: 741503 - protein, 25 aa, Mycobacterium
TVPDNMGMLFRKHLVMFGPREVLLT

SEQ ID NO: 741504 - protein, 18 aa, Mycobacterium
TVPDNMGMLFRKQLVMFG

SEQ ID NO: 741505 - protein, 18 aa, Mycobacterium
TVPDNMGMLFRRKLVMFG

SEQ ID NO: 741506 - protein, 24 aa, Mycobacterium
TVPEGHMGLGLGIHGEPGVSEEKM

SEQ ID NO: 741507 - protein, 25 aa, Mycobacterium
TVPGLRSGGSIASYVGSLVLTNERV

SEQ ID NO: 741508 - protein, 26 aa, Mycobacterium
TVPGWPNAYMLIGPWAYSPGSYLVLL

SEQ ID NO: 741509 - protein, 18 aa, Mycobacterium
TVPLEVVNVTEPVVNVNV

SEQ ID NO: 741510 - protein, 25 aa, Mycobacterium
TVPLPFAGGSWVIWSRGDQAGSVLD

SEQ ID NO: 741511 - protein, 24 aa, Mycobacterium
TVPLPFAGGSWVLWERTERATSMV

SEQ ID NO: 741512 - protein, 18 aa, Mycobacterium
TVPLPRDHWQQVIDPQTM

SEQ ID NO: 741513 - protein, 22 aa, Mycobacterium
TVPLRPDLGFATSLDHSIWFHR

SEQ ID NO: 741514 - protein, 18 aa, Mycobacterium
TVPMPGYDVQILRADGSV

SEQ ID NO: 741515 - protein, 17 aa, Mycobacterium
TVPMPGYEVHILDEHGH

SEQ ID NO: 741516 - protein, 22 aa, Mycobacterium
TVPMRLSGWPGRFHTEPAPLLG

SEQ ID NO: 741517 - protein, 24 aa, Mycobacterium
TVPPGKLGWGWAKFAFNGWKALSW

SEQ ID NO: 741518 - protein, 22 aa, Mycobacterium
TVPPGSLGFRYGDEGVGRWNLD

SEQ ID NO: 741519 - protein, 27 aa, Mycobacterium
TVPPPRIAANRSRLMSLVAANILGQNS

SEQ ID NO: 741520 - protein, 18 aa, Mycobacterium
TVPREFLDDGDAGELEAT

SEQ ID NO: 741521 - protein, 29 aa, Mycobacterium
TVPRGLRLPARLVLSALIGRVRIPDPVAA

SEQ ID NO: 741522 - protein, 28 aa, Mycobacterium
TVPRLAFPTATGRAVFFARPHLVPDEMP

SEQ ID NO: 741523 - protein, 17 aa, Mycobacterium
TVPSAPELLRLGSKPAS

SEQ ID NO: 741524 - protein, 22 aa, Mycobacterium
TVPSRARIGLDMIAIEAGAPLE

SEQ ID NO: 741525 - protein, 24 aa, Mycobacterium
TVPVHRRRVGLMPQEGALFPHLSV

SEQ ID NO: 741526 - protein, 25 aa, Mycobacterium
TVPYRANMWALRALGARRVFAPCAV

SEQ ID NO: 741527 - protein, 24 aa, Mycobacterium
TVPYRANMWALRKLGVRRIFGPCA

SEQ ID NO: 741528 - protein, 25 aa, Mycobacterium
TVQAMKLPGLESWRRPQEELDENSR

SEQ ID NO: 741529 - protein, 18 aa, Mycobacterium
TVQFPWAARSRLPVYGAG

SEQ ID NO: 741530 - protein, 17 aa, Mycobacterium
TVQGGRVTAEFIGVDVT

SEQ ID NO: 741531 - protein, 25 aa, Mycobacterium
TVQGLAFSVARRWVVKQAARRYGDV

SEQ ID NO: 741532 - protein, 20 aa, Mycobacterium
TVQGSGWAALGWDTLGNKLL

SEQ ID NO: 741533 - protein, 23 aa, Mycobacterium
TVQGSGWAALGWDTLGNKLLIFQ

SEQ ID NO: 741534 - protein, 18 aa, Mycobacterium
TVQNVRFVREPDVELPLD

SEQ ID NO: 741535 - protein, 24 aa, Mycobacterium
TVQQRAAAVLAFYRYHAHAHNLDV

SEQ ID NO: 741536 - protein, 19 aa, Mycobacterium
TVQSMFIGPVFGPLLKLLG

SEQ ID NO: 741537 - protein, 24 aa, Mycobacterium
TVQTSRFHAEFVRALAAAGAAYAA

SEQ ID NO: 741538 - protein, 20 aa, Mycobacterium
TVQYRWRVGGDPECCPSGMG

SEQ ID NO: 741539 - protein, 24 aa, Mycobacterium
TVRAICAQSGLAARYFYESFTDKD

SEQ ID NO: 741540 - protein, 24 aa, Mycobacterium
TVREFLYRTLNAFGTRFVGSAEQV

SEQ ID NO: 741541 - protein, 26 aa, Mycobacterium
TVREFLYRTVNGWGAAVVGTPERIAD

SEQ ID NO: 741542 - protein, 22 aa, Mycobacterium
TVREICKTAGLNTRYFYECFDG

SEQ ID NO: 741543 - protein, 17 aa, Mycobacterium
TVRERIVALKLMSQTLS

SEQ ID NO: 741544 - protein, 24 aa, Mycobacterium
TVRFALGTQTGWAVPLGAFSRAVS

SEQ ID NO: 741545 - protein, 17 aa, Mycobacterium
TVRFYRELVGLPLFETF

SEQ ID NO: 741546 - protein, 19 aa, Mycobacterium
TVRGFPAFVDAGGAVDLRV

SEQ ID NO: 741547 - protein, 19 aa, Mycobacterium
TVRGFPAFVDTGGAVDLRV

SEQ ID NO: 741548 - protein, 22 aa, Mycobacterium
TVRGICRQAGLSARYFYESFPD

SEQ ID NO: 741549 - protein, 17 aa, Mycobacterium
TVRGRAAVMRALSALRL

SEQ ID NO: 741550 - protein, 23 aa, Mycobacterium
TVRGVCRRAGLAARYFYESFTDK

SEQ ID NO: 741551 - protein, 18 aa, Mycobacterium
TVRHCARIALGELGLPPV

SEQ ID NO: 741552 - protein, 18 aa, Mycobacterium
TVRHCARVALGDLGVPPV

SEQ ID NO: 741553 - protein, 19 aa, Mycobacterium
TVRKGEFVALLGRSGTGKT

SEQ ID NO: 741554 - protein, 17 aa, Mycobacterium
TVRLGLAPPAALTGEWF

SEQ ID NO: 741555 - protein, 22 aa, Mycobacterium
TVRNWPWRRLALSKTANTYSRL

SEQ ID NO: 741556 - protein, 20 aa, Mycobacterium
TVRPEWLVRAVRAYVRDDRT

SEQ ID NO: 741557 - protein, 20 aa, Mycobacterium
TVRPSFAFYNTFDEIDVFID

SEQ ID NO: 741558 - protein, 20 aa, Mycobacterium
TVRPSFAFYNTFDEVDVFIS

SEQ ID NO: 741559 - protein, 22 aa, Mycobacterium
TVRRPAVAAVRADYDKVLRQRT

SEQ ID NO: 741560 - protein, 21 aa, Mycobacterium
TVRRRGVVVNPVLETSEVPET

SEQ ID NO: 741561 - protein, 17 aa, Mycobacterium
TVRRRLRVTLAGDGEVH

SEQ ID NO: 741562 - protein, 17 aa, Mycobacterium
TVRRWLRRLPAAHLERI

SEQ ID NO: 741563 - protein, 21 aa, Mycobacterium
TVRSPIRLMRKVWEPLIRYWG

SEQ ID NO: 741564 - protein, 20 aa, Mycobacterium
TVRTRFFDDFFRAATAAGAR

SEQ ID NO: 741565 - protein, 24 aa, Mycobacterium
TVRTRLIELFDLFDPADPAVIAGR

SEQ ID NO: 741566 - protein, 21 aa, Mycobacterium
TVRVGHGPFGVAVDSETHTAY

SEQ ID NO: 741567 - protein, 24 aa, Mycobacterium
TVRWSWKPGDLAIWDNRATQHYAV

SEQ ID NO: 741568 - protein, 18 aa, Mycobacterium
TVRYDWTPHTGIIIGRLD

SEQ ID NO: 741569 - protein, 19 aa, Mycobacterium
TVSDCFSRIEASPVPWVAV

SEQ ID NO: 741570 - protein, 23 aa, Mycobacterium
TVSDFPADRGWDVEGLYDPDPDA

SEQ ID NO: 741571 - protein, 24 aa, Mycobacterium
TVSDFPLDRGWDVEGLYDPDPDAK

SEQ ID NO: 741572 - protein, 17 aa, Mycobacterium
TVSELRYPTGEFTDAIE

SEQ ID NO: 741573 - protein, 23 aa, Mycobacterium
TVSESRATWTINHVRAEAQRELR

SEQ ID NO: 741574 - protein, 25 aa, Mycobacterium
TVSGRGAEIRPCIACLQSCAGGLNT

SEQ ID NO: 741575 - protein, 22 aa, Mycobacterium
TVSICRLEPELSALRILHNAGR

SEQ ID NO: 741576 - protein, 17 aa, Mycobacterium
TVSLMMANRVEFYPLEV

SEQ ID NO: 741577 - protein, 20 aa, Mycobacterium
TVSLRLPVRTPFAYQGVFGH

SEQ ID NO: 741578 - protein, 17 aa, Mycobacterium
TVSPLGFVAEGRSLIGS

SEQ ID NO: 741579 - protein, 28 aa, Mycobacterium
TVSRCEQMTPELREMWNVLGTGDDISQQ

SEQ ID NO: 741580 - protein, 25 aa, Mycobacterium
TVSRPRWAATADWLGAPYVPAPADE

SEQ ID NO: 741581 - protein, 18 aa, Mycobacterium
TVSRSLIAPILRAASFSD

SEQ ID NO: 741582 - protein, 22 aa, Mycobacterium
TVSSALVSRGYTKGDVRDPLSG

SEQ ID NO: 741583 - protein, 23 aa, Mycobacterium
TVSSIFLMCLADRVLAYGDCAIV

SEQ ID NO: 741584 - protein, 27 aa, Mycobacterium
TVSSIFLMCLPDRVLAYGDCAIVPNPT

SEQ ID NO: 741585 - protein, 20 aa, Mycobacterium
TVSVVACLPAAWEAIENRAT

SEQ ID NO: 741586 - protein, 24 aa, Mycobacterium
TVSWPRSAKLLDVLLAAGLDAPFS

SEQ ID NO: 741587 - protein, 26 aa, Mycobacterium
TVSYEAGDALGVWPRNAHQLVDEWLG

SEQ ID NO: 741588 - protein, 25 aa, Mycobacterium
TVTAFAWALVLGRLTDRTDVVFGTI

SEQ ID NO: 741589 - protein, 23 aa, Mycobacterium
TVTAWCARIDVLATDMRVEQRSL

SEQ ID NO: 741590 - protein, 24 aa, Mycobacterium
TVTAWCARVNVLATDMRVEQRSLE

SEQ ID NO: 741591 - protein, 20 aa, Mycobacterium
TVTAYARPQSNHAFGAEPGV

SEQ ID NO: 741592 - protein, 23 aa, Mycobacterium
TVTDARAAIDWYVDVLGASVVGA

SEQ ID NO: 741593 - protein, 19 aa, Mycobacterium
TVTDIKWWFGNTLGSARQA

SEQ ID NO: 741594 - protein, 27 aa, Mycobacterium
TVTDVKWWFGHTLTWARHALRDIGAVE

SEQ ID NO: 741595 - protein, 32 aa, Mycobacterium
TVTEARMAIAMARAGGMGVLHRNLSVEDQAGQ

SEQ ID NO: 741596 - protein, 32 aa, Mycobacterium
TVTESRMAIAMARAGGMGVLHRNLPVAEQASQ

SEQ ID NO: 741597 - protein, 22 aa, Mycobacterium
TVTEVRCGIGYLHTGIEKNLEY

SEQ ID NO: 741598 - protein, 25 aa, Mycobacterium
TVTFSDRYEPAWVYRGNDAAAVRDG

SEQ ID NO: 741599 - protein, 19 aa, Mycobacterium
TVTGGLTFAGGPWSNYVMH

SEQ ID NO: 741600 - protein, 19 aa, Mycobacterium
TVTHAQLWDRAVRLVSAMA

SEQ ID NO: 741601 - protein, 20 aa, Mycobacterium
TVTIPGVRVNNFVAFIPNNI

SEQ ID NO: 741602 - protein, 17 aa, Mycobacterium
TVTKAFIREASATGVDI

SEQ ID NO: 741603 - protein, 20 aa, Mycobacterium
TVTLRPGATVAELVDDLAAR

SEQ ID NO: 741604 - protein, 18 aa, Mycobacterium
TVTLRRGQILLFYTDGLI

SEQ ID NO: 741605 - protein, 28 aa, Mycobacterium
TVTPEREGRAAFLPPYLISGQGLAVDTT

SEQ ID NO: 741606 - protein, 24 aa, Mycobacterium
TVTPRVDLTLVFYDCEEIESSANG

SEQ ID NO: 741607 - protein, 24 aa, Mycobacterium
TVTRARRAYLPAVFSTGGDTDNGI

SEQ ID NO: 741608 - protein, 22 aa, Mycobacterium
TVTRCRHCTGPLALPDRDSAAA

SEQ ID NO: 741609 - protein, 23 aa, Mycobacterium
TVTRLTAPVIRGLGIGIVPAATR

SEQ ID NO: 741610 - protein, 20 aa, Mycobacterium
TVTTCLDGRVHDVALSHSAA

SEQ ID NO: 741611 - protein, 26 aa, Mycobacterium
TVTVKLRAAGIPILGKTNMDEFAMGS

SEQ ID NO: 741612 - protein, 21 aa, Mycobacterium
TVTWADLRYRVAALAGSLSRR

SEQ ID NO: 741613 - protein, 28 aa, Mycobacterium
TVTWSLPDPQAWWQMTWRGRPDPTLGEW

SEQ ID NO: 741614 - protein, 26 aa, Mycobacterium
TVTYEAGDALGVWPRNSDQLVDEWLS

SEQ ID NO: 741615 - protein, 27 aa, Mycobacterium
TVVAADWPRLAAAYHTRAQLHILDDLL

SEQ ID NO: 741616 - protein, 25 aa, Mycobacterium
TVVARASALFLRRGDHPDGQVWSFP

SEQ ID NO: 741617 - protein, 17 aa, Mycobacterium
TVVASGFDSLVNDRANR

SEQ ID NO: 741618 - protein, 24 aa, Mycobacterium
TVVASRLALPHMIAEGGGSIINTV

SEQ ID NO: 741619 - protein, 19 aa, Mycobacterium
TVVATCYLLGVSTRRMDKL

SEQ ID NO: 741620 - protein, 24 aa, Mycobacterium
TVVCVSRLVPRKGQDMLIKALPSI

SEQ ID NO: 741621 - protein, 23 aa, Mycobacterium
TVVDALGAWGVRWIGDLGEQDLD

SEQ ID NO: 741622 - protein, 17 aa, Mycobacterium
TVVDCAFYHTFSTEPQL

SEQ ID NO: 741623 - protein, 18 aa, Mycobacterium
TVVDRVRPGMPLHDEEVF

SEQ ID NO: 741624 - protein, 19 aa, Mycobacterium
TVVELGVWVAGPATAAILA

SEQ ID NO: 741625 - protein, 25 aa, Mycobacterium
TVVFPDAPVKIFLTASAETRARRRN

SEQ ID NO: 741626 - protein, 18 aa, Mycobacterium
TVVGLALSVCSRAPLEPV

SEQ ID NO: 741627 - protein, 27 aa, Mycobacterium
TVVGLQARFAPAIRRMRELVDAGYVGK

SEQ ID NO: 741628 - protein, 24 aa, Mycobacterium
TVVGLRAFVAIARKRHFGSAAGEL

SEQ ID NO: 741629 - protein, 24 aa, Mycobacterium
TVVHFRVSDLIPVYRAQRAELQRL

SEQ ID NO: 741630 - protein, 17 aa, Mycobacterium
TVVIVVFDGMKLLDVAG

SEQ ID NO: 741631 - protein, 18 aa, Mycobacterium
TVVLGVWQPGAPGAGLVG

SEQ ID NO: 741632 - protein, 18 aa, Mycobacterium
TVVLKPAFQTPWHATLLA

SEQ ID NO: 741633 - protein, 25 aa, Mycobacterium
TVVLKPAQLTPWSGSEYGRIVAEET

SEQ ID NO: 741634 - protein, 25 aa, Mycobacterium
TVVLKPAQLTPWSGTEYGRIVAEET

SEQ ID NO: 741635 - protein, 25 aa, Mycobacterium
TVVNKLSVPPSWAGSTPVVGSSAAP

SEQ ID NO: 741636 - protein, 24 aa, Mycobacterium
TVVPEQSCLWGFGRAAALELPHIW

SEQ ID NO: 741637 - protein, 38 aa, Mycobacterium
TVVPIGAPVPGAGVFVLDGWLRPVPPGTVGELYVAGTG

SEQ ID NO: 741638 - protein, 38 aa, Mycobacterium
TVVPIGAPVPGAGVFVLDRWLRPVPPGTVGELYVAGTG

SEQ ID NO: 741639 - protein, 20 aa, Mycobacterium
TVVPKSDWDTVVSVGATVEV

SEQ ID NO: 741640 - protein, 18 aa, Mycobacterium
TVVPLLPAQDFKRVGDND

SEQ ID NO: 741641 - protein, 18 aa, Mycobacterium
TVVPLLPAQDHKRVGDGD

SEQ ID NO: 741642 - protein, 18 aa, Mycobacterium
TVVPRLALIDLPAGVRTV

SEQ ID NO: 741643 - protein, 24 aa, Mycobacterium
TVVQRLVALLGHRCKGADGQSTDS

SEQ ID NO: 741644 - protein, 25 aa, Mycobacterium
TVVRYRISDLIPVYRSQRAVLQRLL

SEQ ID NO: 741645 - protein, 19 aa, Mycobacterium
TVVSRLRAQGAIVLGMTNV

SEQ ID NO: 741646 - protein, 18 aa, Mycobacterium
TVVSWLPFFHDMGLMFGI

SEQ ID NO: 741647 - protein, 27 aa, Mycobacterium
TVVVVAPMFHAWGFSQLIFAASMACTV

SEQ ID NO: 741648 - protein, 18 aa, Mycobacterium
TVVWALATVHHWQDVVRA

SEQ ID NO: 741649 - protein, 18 aa, Mycobacterium
TVVWKPSPTQTFAAYLTM

SEQ ID NO: 741650 - protein, 18 aa, Mycobacterium
TVVWKPSVTQAFAAHFTL

SEQ ID NO: 741651 - protein, 19 aa, Mycobacterium
TVVWLPHFISAERRNDLGR

SEQ ID NO: 741652 - protein, 18 aa, Mycobacterium
TVYACGPAPMLTMLRTAL

SEQ ID NO: 741653 - protein, 26 aa, Mycobacterium
TVYERLWRPTSFYLASGITARAEQRR

SEQ ID NO: 741654 - protein, 20 aa, Mycobacterium
TVYFALAVRGRLQRGETVLV

SEQ ID NO: 741655 - protein, 19 aa, Mycobacterium
TVYFPSLSGRTFVYKGMLT

SEQ ID NO: 741656 - protein, 23 aa, Mycobacterium
TVYLRGGCIYGSLTGELLEQRDV

SEQ ID NO: 741657 - protein, 18 aa, Mycobacterium
TVYPGLSQRVHDMFSERG

SEQ ID NO: 741658 - protein, 23 aa, Mycobacterium
TVYPLEDHIAWVLQDKFDDPIAH

SEQ ID NO: 741659 - protein, 17 aa, Mycobacterium
TVYPRNAVAGLAMPGFA

SEQ ID NO: 741660 - protein, 23 aa, Mycobacterium
TVYTLSDLGWRRVLPVLQSLAWF

SEQ ID NO: 741661 - protein, 20 aa, Mycobacterium
TVYYCVVDARAWLRDATPLW

SEQ ID NO: 741662 - protein, 22 aa, Mycobacterium
TWAAKRARAGKTFFGGTLALVL

SEQ ID NO: 741663 - protein, 18 aa, Mycobacterium
TWAAPQWLELGRELAGSD

SEQ ID NO: 741664 - protein, 19 aa, Mycobacterium
TWAAPQWLQLGRELAGSDS

SEQ ID NO: 741665 - protein, 26 aa, Mycobacterium
TWAATILARQIWAATISVPRTSVNST

SEQ ID NO: 741666 - protein, 22 aa, Mycobacterium
TWANPWPMYRALRDHDPVHHVV

SEQ ID NO: 741667 - protein, 25 aa, Mycobacterium
TWAQEIYADLGLRFEGERAEKISEA

SEQ ID NO: 741668 - protein, 20 aa, Mycobacterium
TWAQYLRWVADRAGLEVVGG

SEQ ID NO: 741669 - protein, 24 aa, Mycobacterium
TWARQIRATVRFADELDALLAAPD

SEQ ID NO: 741670 - protein, 19 aa, Mycobacterium
TWASLRWFERRVVDAATGP

SEQ ID NO: 741671 - protein, 20 aa, Mycobacterium
TWCALDEYLGLPTHHPQSYR

SEQ ID NO: 741672 - protein, 18 aa, Mycobacterium
TWCGVLVACGPRDAARTR

SEQ ID NO: 741673 - protein, 24 aa, Mycobacterium
TWDAAREVYCFPDAEPPSATSMHT

SEQ ID NO: 741674 - protein, 23 aa, Mycobacterium
TWDGPDQRPEWFYIVRFNLSQLW

SEQ ID NO: 741675 - protein, 18 aa, Mycobacterium
TWDRFRETVNMTAGELEK

SEQ ID NO: 741676 - protein, 21 aa, Mycobacterium
TWDRRPAWFRKLAGRATGVPD

SEQ ID NO: 741677 - protein, 19 aa, Mycobacterium
TWDRRPRWFRKIAGMATGV

SEQ ID NO: 741678 - protein, 18 aa, Mycobacterium
TWDTYALSRFDDIWNVLE

SEQ ID NO: 741679 - protein, 26 aa, Mycobacterium
TWEALQIPVGVAFFFTNSAIGRTVAF

SEQ ID NO: 741680 - protein, 19 aa, Mycobacterium
TWEELVRLLAEIADEGTAV

SEQ ID NO: 741681 - protein, 20 aa, Mycobacterium
TWEHQAHLYFKRATTDAALL

SEQ ID NO: 741682 - protein, 25 aa, Mycobacterium
TWELRARFAAGLSAMYAGEVPAYST

SEQ ID NO: 741683 - protein, 21 aa, Mycobacterium
TWFKHAVFYEVLVRAFYDGTA

SEQ ID NO: 741684 - protein, 21 aa, Mycobacterium
TWFKHAVFYEVLVRAFYDSSA

SEQ ID NO: 741685 - protein, 17 aa, Mycobacterium
TWFRGELDITRDRLEDF

SEQ ID NO: 741686 - protein, 20 aa, Mycobacterium
TWFWPGHSIETFPTQAKMCV

SEQ ID NO: 741687 - protein, 20 aa, Mycobacterium
TWGASTLIPFFGGLTSIPVS

SEQ ID NO: 741688 - protein, 19 aa, Mycobacterium
TWGASTLIPFFGGLTSVPV

SEQ ID NO: 741689 - protein, 22 aa, Mycobacterium
TWGNFRTFFRFVPDESGKFRQL

SEQ ID NO: 741690 - protein, 21 aa, Mycobacterium
TWGTMCPKVIVTVGHCEGSEV

SEQ ID NO: 741691 - protein, 25 aa, Mycobacterium
TWGTMGIGMGYAIAAAVETGRPVVA

SEQ ID NO: 741692 - protein, 19 aa, Mycobacterium
TWGVMGIGLGYSIAAAVET

SEQ ID NO: 741693 - protein, 25 aa, Mycobacterium
TWGVMGIGMGYSIAAAVETGRPVVA

SEQ ID NO: 741694 - protein, 21 aa, Mycobacterium
TWGVMWGAEDLFGFLGGTNNR

SEQ ID NO: 741695 - protein, 21 aa, Mycobacterium
TWHRRLKRIITQGILGCLEDS

SEQ ID NO: 741696 - protein, 20 aa, Mycobacterium
TWHYGCEPLTPLATHVAKYF

SEQ ID NO: 741697 - protein, 17 aa, Mycobacterium
TWIASRVDLSFASDPVL

SEQ ID NO: 741698 - protein, 19 aa, Mycobacterium
TWIEIRFTLTDVVRSGGAP

SEQ ID NO: 741699 - protein, 18 aa, Mycobacterium
TWKGRPDPTLGPWWDSVG

SEQ ID NO: 741700 - protein, 21 aa, Mycobacterium
TWKMDIHPWWVAFTQGAGVTT

SEQ ID NO: 741701 - protein, 26 aa, Mycobacterium
TWLAEHLKQRWARNTGGLLLVTHDRW

SEQ ID NO: 741702 - protein, 25 aa, Mycobacterium
TWLPKPARPVPPWPTVQREACAAIT

SEQ ID NO: 741703 - protein, 19 aa, Mycobacterium
TWLPLLRSGPDGQAESLID

SEQ ID NO: 741704 - protein, 21 aa, Mycobacterium
TWLPMPDEWAALTVERQLADP

SEQ ID NO: 741705 - protein, 20 aa, Mycobacterium
TWLPMPKEWAALTVDKQSAD

SEQ ID NO: 741706 - protein, 17 aa, Mycobacterium
TWLPMPPEWAALTVEKQ

SEQ ID NO: 741707 - protein, 30 aa, Mycobacterium
TWLRTELRRAPRLGFEIDIDDAKISLPQIH

SEQ ID NO: 741708 - protein, 30 aa, Mycobacterium
TWLRTELRRAPRLGFEIDIDDAKLSLRQIH

SEQ ID NO: 741709 - protein, 23 aa, Mycobacterium
TWNDEFVLRLSFTNWATSDDDVD

SEQ ID NO: 741710 - protein, 23 aa, Mycobacterium
TWNGTRLAAAIMRENKRGAIVNM

SEQ ID NO: 741711 - protein, 21 aa, Mycobacterium
TWNQYRIATSVYFVNLSATRP

SEQ ID NO: 741712 - protein, 24 aa, Mycobacterium
TWNTLYRKWLSVLGPAPAPPRPRY

SEQ ID NO: 741713 - protein, 18 aa, Mycobacterium
TWPAEGLTYPKALADDLK

SEQ ID NO: 741714 - protein, 25 aa, Mycobacterium
TWPAHVRPGVVGTHFESEWALVSVL

SEQ ID NO: 741715 - protein, 18 aa, Mycobacterium
TWPTVSQWVQWREGEAAK

SEQ ID NO: 741716 - protein, 23 aa, Mycobacterium
TWQDRWAREGTFNVPNPVGSLAA

SEQ ID NO: 741717 - protein, 25 aa, Mycobacterium
TWQLRARFAAGLSARYAAEVPAYTT

SEQ ID NO: 741718 - protein, 22 aa, Mycobacterium
TWRDTESWTRKSILNSAHSGKF

SEQ ID NO: 741719 - protein, 20 aa, Mycobacterium
TWRIKPRDWLHHKGVSPAAQ

SEQ ID NO: 741720 - protein, 21 aa, Mycobacterium
TWRINTYPGLACDVKSHLYSY

SEQ ID NO: 741721 - protein, 23 aa, Mycobacterium
TWRNEIDSSIGLQVVGVRTTAAA

SEQ ID NO: 741722 - protein, 23 aa, Mycobacterium
TWRNEVDAGVGMELARVRTAAAA

SEQ ID NO: 741723 - protein, 24 aa, Mycobacterium
TWRSATCRVLAAATGSRTANAGPV

SEQ ID NO: 741724 - protein, 24 aa, Mycobacterium
TWRSATCRVLVAAKGSRSANAGPV

SEQ ID NO: 741725 - protein, 23 aa, Mycobacterium
TWRTLRAAVPAMIEAGNGGSIIV

SEQ ID NO: 741726 - protein, 20 aa, Mycobacterium
TWRWATAISTAWHRLRTAFP

SEQ ID NO: 741727 - protein, 28 aa, Mycobacterium
TWRYDSFRKGDGFEGLWDDVESITMPTT

SEQ ID NO: 741728 - protein, 24 aa, Mycobacterium
TWRYLLVPCAIEFWDEDGGAASGE

SEQ ID NO: 741729 - protein, 20 aa, Mycobacterium
TWSAELLDRGIRVNAISPGA

SEQ ID NO: 741730 - protein, 18 aa, Mycobacterium
TWSCSQAGVVVARQSGKG

SEQ ID NO: 741731 - protein, 17 aa, Mycobacterium
TWSEFDCGATILAEQLA

SEQ ID NO: 741732 - protein, 22 aa, Mycobacterium
TWSNPWPMYRALRDHDPVHHVV

SEQ ID NO: 741733 - protein, 22 aa, Mycobacterium
TWSPRHRQVMDLLARHQRAGAI

SEQ ID NO: 741734 - protein, 22 aa, Mycobacterium
TWSSGILDRPLVRYTVSTDEGG

SEQ ID NO: 741735 - protein, 22 aa, Mycobacterium
TWSTSLKSLWVGEGEAVGDVVV

SEQ ID NO: 741736 - protein, 37 aa, Mycobacterium
TWTASGGSITARWAVLYELGGNVLCYVLLDNTPADVT

SEQ ID NO: 741737 - protein, 19 aa, Mycobacterium
TWTGAGGVKGFFEKTFAPL

SEQ ID NO: 741738 - protein, 25 aa, Mycobacterium
TWTGCGGDYEWTRAKAAYFMVGFSG

SEQ ID NO: 741739 - protein, 23 aa, Mycobacterium
TWTIRFFMPAKWTLDALPVPNDN

SEQ ID NO: 741740 - protein, 30 aa, Mycobacterium
TWTLLKWLDEPCPFYDWRVNEPDKPRVHPD

SEQ ID NO: 741741 - protein, 21 aa, Mycobacterium
TWTPTGFPVEFLSLGTSGVGV

SEQ ID NO: 741742 - protein, 21 aa, Mycobacterium
TWTSRFFRDQRLLSIGGGADE

SEQ ID NO: 741743 - protein, 24 aa, Mycobacterium
TWVERPHYLPLFVAPQPIPEAIDE

SEQ ID NO: 741744 - protein, 17 aa, Mycobacterium
TWVIRFFMPAKWTLDTL

SEQ ID NO: 741745 - protein, 26 aa, Mycobacterium
TWVLQRPCPECGFDPSSVHHTEVAGR

SEQ ID NO: 741746 - protein, 24 aa, Mycobacterium
TWVRWWVMQHAYRFIQEFEASVEK

SEQ ID NO: 741747 - protein, 28 aa, Mycobacterium
TWWPRLSSTVTGCWLVTVGGEQAIADDG

SEQ ID NO: 741748 - protein, 28 aa, Mycobacterium
TWYTVLACFKLGIVIEGTLARACAGKAE

SEQ ID NO: 741749 - protein, 21 aa, Mycobacterium
TWYWNRYPGARVDIPSVDYMY

SEQ ID NO: 741750 - protein, 17 aa, Mycobacterium
TYAALGITEQGFNSGDA

SEQ ID NO: 741751 - protein, 23 aa, Mycobacterium
TYAARIVPWLSVARVARASTDDL

SEQ ID NO: 741752 - protein, 17 aa, Mycobacterium
TYADAMRRFGSDKPDMR

SEQ ID NO: 741753 - protein, 17 aa, Mycobacterium
TYAEGWLNDGRWDRMGR

SEQ ID NO: 741754 - protein, 26 aa, Mycobacterium
TYAELLAAIRFVAPYSGYPAAADALA

SEQ ID NO: 741755 - protein, 19 aa, Mycobacterium
TYAEWDFEKNTTYPLLLHE

SEQ ID NO: 741756 - protein, 24 aa, Mycobacterium
TYAFDRRRFWLSGEGAAADATGLG

SEQ ID NO: 741757 - protein, 19 aa, Mycobacterium
TYAFDRRRFWLSRDDAPAD

SEQ ID NO: 741758 - protein, 23 aa, Mycobacterium
TYAFERRRFWLSGDAVAADAAGL

SEQ ID NO: 741759 - protein, 20 aa, Mycobacterium
TYAFLPVVRTFASAAGIDVK

SEQ ID NO: 741760 - protein, 23 aa, Mycobacterium
TYAFQRRRFWLSGDGVAADATDL

SEQ ID NO: 741761 - protein, 19 aa, Mycobacterium
TYAGLDFLTDLRVVPAELG

SEQ ID NO: 741762 - protein, 25 aa, Mycobacterium
TYAGVPCWSGGGAYWAHVTVAAAYD

SEQ ID NO: 741763 - protein, 20 aa, Mycobacterium
TYAGVPVRVCRTGYTGEHGY

SEQ ID NO: 741764 - protein, 22 aa, Mycobacterium
TYAGYCSDFGRTWVVGEQPTPR

SEQ ID NO: 741765 - protein, 20 aa, Mycobacterium
TYAKRVEAFGARAISVDGHR

SEQ ID NO: 741766 - protein, 25 aa, Mycobacterium
TYAKTRHNLGFMVADVLAGRIGSAF

SEQ ID NO: 741767 - protein, 22 aa, Mycobacterium
TYALFPFMSVWDNVAFGLRYQK

SEQ ID NO: 741768 - protein, 18 aa, Mycobacterium
TYALLRLEIESIVVADST

SEQ ID NO: 741769 - protein, 18 aa, Mycobacterium
TYALTVPFLQRFFALAKS

SEQ ID NO: 741770 - protein, 18 aa, Mycobacterium
TYAQVWSRVQAVAAALRH

SEQ ID NO: 741771 - protein, 26 aa, Mycobacterium
TYARISGRFHAGWPVGRVDTGLASLV

SEQ ID NO: 741772 - protein, 33 aa, Mycobacterium
TYASAEATGAAPLQPVLDLINGPTQALLGRPLI

SEQ ID NO: 741773 - protein, 27 aa, Mycobacterium
TYASLCAAVGVPVREVAKFMGHATTTT

SEQ ID NO: 741774 - protein, 28 aa, Mycobacterium
TYASVDFGRPFGFLAVHRPSRLAVVAGW

SEQ ID NO: 741775 - protein, 27 aa, Mycobacterium
TYATAWTCLFRSLELEPGQLLLIRGAT

SEQ ID NO: 741776 - protein, 21 aa, Mycobacterium
TYATCPACQGARYSDETLEVR

SEQ ID NO: 741777 - protein, 25 aa, Mycobacterium
TYATMLANLAMSWRGPSATKMTAAA

SEQ ID NO: 741778 - protein, 24 aa, Mycobacterium
TYAVPRLLTRNGLTLQDFDYYEIH

SEQ ID NO: 741779 - protein, 23 aa, Mycobacterium
TYCSTRNAQYCLARVTSSRPGEC

SEQ ID NO: 741780 - protein, 20 aa, Mycobacterium
TYDDFKPMFNKAVKQFDPDS

SEQ ID NO: 741781 - protein, 20 aa, Mycobacterium
TYDDFKPMFNKAVKQIDPDS

SEQ ID NO: 741782 - protein, 19 aa, Mycobacterium
TYDGFPIRPLYTSRDDVGE

SEQ ID NO: 741783 - protein, 20 aa, Mycobacterium
TYDLLKRRGTQFVVVSAAEP

SEQ ID NO: 741784 - protein, 25 aa, Mycobacterium
TYDLRLAGPGNKYSWTINEKTYNPA

SEQ ID NO: 741785 - protein, 20 aa, Mycobacterium
TYDLWFTEWAPRSNTKGLGE

SEQ ID NO: 741786 - protein, 18 aa, Mycobacterium
TYDRLGLVSPRRTSGGGR

SEQ ID NO: 741787 - protein, 21 aa, Mycobacterium
TYDRSQIGIGIAHFGVGGFHR

SEQ ID NO: 741788 - protein, 20 aa, Mycobacterium
TYDSVRRWPRRGLRSRLTID

SEQ ID NO: 741789 - protein, 29 aa, Mycobacterium
TYEHPYPHCWRCRNPLIYRAVSSWFVAVT

SEQ ID NO: 741790 - protein, 30 aa, Mycobacterium
TYEHPYPHCWRCRNPLIYRAVSSWFVAVTA

SEQ ID NO: 741791 - protein, 18 aa, Mycobacterium
TYELLKRRGTQFVVVSAA

SEQ ID NO: 741792 - protein, 21 aa, Mycobacterium
TYERIPVHVFPEFEQLVVDRT

SEQ ID NO: 741793 - protein, 17 aa, Mycobacterium
TYESPILDRFRRVSSGR

SEQ ID NO: 741794 - protein, 17 aa, Mycobacterium
TYFFSDPAARDFVAGVA

SEQ ID NO: 741795 - protein, 24 aa, Mycobacterium
TYFKLEPGMEGFGVITRVGSQVTE

SEQ ID NO: 741796 - protein, 23 aa, Mycobacterium
TYFLCADPRPLGYDDSTAFCAEL

SEQ ID NO: 741797 - protein, 26 aa, Mycobacterium
TYFQAYAAACGLYFAEKALEEIRAGR

SEQ ID NO: 741798 - protein, 19 aa, Mycobacterium
TYFRSEVHGLDSFPPGGAL

SEQ ID NO: 741799 - protein, 18 aa, Mycobacterium
TYGEYAGEMTLSYDPPRK

SEQ ID NO: 741800 - protein, 18 aa, Mycobacterium
TYGFPIDLTLEMAAEAGL

SEQ ID NO: 741801 - protein, 25 aa, Mycobacterium
TYGHFGQAGGFIWADPDRDLALVAL

SEQ ID NO: 741802 - protein, 27 aa, Mycobacterium
TYGHFGQAGGFIWADPEADLALVVLTD

SEQ ID NO: 741803 - protein, 25 aa, Mycobacterium
TYGHFGQAGTFIWVDPAVDLGLVVL

SEQ ID NO: 741804 - protein, 19 aa, Mycobacterium
TYGIYKLDFDIEGAALYNV

SEQ ID NO: 741805 - protein, 18 aa, Mycobacterium
TYGLIVYQEQIMFIAQKV

SEQ ID NO: 741806 - protein, 18 aa, Mycobacterium
TYGLIVYQEQIMRIAQKV

SEQ ID NO: 741807 - protein, 18 aa, Mycobacterium
TYGMPRLAVYSSTKHAVK

SEQ ID NO: 741808 - protein, 26 aa, Mycobacterium
TYGNVLRFLPPLSMPDHLLDEGLDIL

SEQ ID NO: 741809 - protein, 25 aa, Mycobacterium
TYGPAFRGLQAMWQRGEEIFAEVSL

SEQ ID NO: 741810 - protein, 18 aa, Mycobacterium
TYGPVAVNVWQPEWDELP

SEQ ID NO: 741811 - protein, 24 aa, Mycobacterium
TYGRFMRIRVFDCWMHEQDIRVAL

SEQ ID NO: 741812 - protein, 18 aa, Mycobacterium
TYGRPGLVVSPQYDSLLA

SEQ ID NO: 741813 - protein, 24 aa, Mycobacterium
TYGSLEIFTGLDLAIDRGSRVVVL

SEQ ID NO: 741814 - protein, 19 aa, Mycobacterium
TYHAFAGSLLRDHGLLLPI

SEQ ID NO: 741815 - protein, 27 aa, Mycobacterium
TYHAFAGTLLREFGLMLPVEPDTRLLG

SEQ ID NO: 741816 - protein, 24 aa, Mycobacterium
TYHDVLRLPVDIVVTEKFAADSPP

SEQ ID NO: 741817 - protein, 24 aa, Mycobacterium
TYHDVLRLPVDVVVTEKFAADSPP

SEQ ID NO: 741818 - protein, 17 aa, Mycobacterium
TYHPTCHSLRMLRVGDR

SEQ ID NO: 741819 - protein, 18 aa, Mycobacterium
TYHTFSYSPLRDDFGHVV

SEQ ID NO: 741820 - protein, 24 aa, Mycobacterium
TYIEGYRLLKDWLDARPAEVGLTE

SEQ ID NO: 741821 - protein, 23 aa, Mycobacterium
TYILPALGALFGFGDGPFPLNLI

SEQ ID NO: 741822 - protein, 17 aa, Mycobacterium
TYIPALKDHSIDLVPEY

SEQ ID NO: 741823 - protein, 18 aa, Mycobacterium
TYIRSCVDAGDMVAATEA

SEQ ID NO: 741824 - protein, 18 aa, Mycobacterium
TYIRSCVDAGDVVAATEA

SEQ ID NO: 741825 - protein, 22 aa, Mycobacterium
TYISPSGRLTVEEFAGGVGGGG

SEQ ID NO: 741826 - protein, 25 aa, Mycobacterium
TYKMVFGHRGINIPVIDHATGRVAV

SEQ ID NO: 741827 - protein, 23 aa, Mycobacterium
TYKMVFGHRGINIPVMDHTTGRV

SEQ ID NO: 741828 - protein, 24 aa, Mycobacterium
TYKTGRGSIRMRGVVEIEEDARGR

SEQ ID NO: 741829 - protein, 18 aa, Mycobacterium
TYLAAARFGRFEHDFDPA

SEQ ID NO: 741830 - protein, 19 aa, Mycobacterium
TYLAECLLLGTGTPTTDRH

SEQ ID NO: 741831 - protein, 17 aa, Mycobacterium
TYLAFDLIHRLWLDLGH

SEQ ID NO: 741832 - protein, 19 aa, Mycobacterium
TYLAGFFEMRPLPYAEAGF

SEQ ID NO: 741833 - protein, 20 aa, Mycobacterium
TYLAWLDCRGLGLEEEAAAG

SEQ ID NO: 741834 - protein, 34 aa, Mycobacterium
TYLDTESWRGQPLKDFLTKMVFWSKVEVAAADLK

SEQ ID NO: 741835 - protein, 25 aa, Mycobacterium
TYLLSRAPGALGLHAALTGAPFSGA

SEQ ID NO: 741836 - protein, 19 aa, Mycobacterium
TYLLSRAPGQLGLHAALTG

SEQ ID NO: 741837 - protein, 21 aa, Mycobacterium
TYLPCWGTPLQRVAGDDEDAV

SEQ ID NO: 741838 - protein, 19 aa, Mycobacterium
TYLRAHAPVSWVEAEGYKP

SEQ ID NO: 741839 - protein, 19 aa, Mycobacterium
TYLRGWRGYQAFEERAALK

SEQ ID NO: 741840 - protein, 23 aa, Mycobacterium
TYLTFDLVHRLWLDAGHTVQYVQ

SEQ ID NO: 741841 - protein, 22 aa, Mycobacterium
TYLYRDGSDFVFMDSQDYEQHP

SEQ ID NO: 741842 - protein, 17 aa, Mycobacterium
TYNAAGWTINATADGTR

SEQ ID NO: 741843 - protein, 23 aa, Mycobacterium
TYNHYPIGWAMAFNTPYKLYKRY

SEQ ID NO: 741844 - protein, 19 aa, Mycobacterium
TYPAAAAKFGRDAPVPAEQ

SEQ ID NO: 741845 - protein, 25 aa, Mycobacterium
TYPASEIPAAFAFEHYVHIRYDLLQ

SEQ ID NO: 741846 - protein, 25 aa, Mycobacterium
TYPLHLRLCEDCLLLQIPALITPED

SEQ ID NO: 741847 - protein, 18 aa, Mycobacterium
TYPQTLKAFVALRRYMNL

SEQ ID NO: 741848 - protein, 20 aa, Mycobacterium
TYPSLAKRRAVLNTHIKLAE

SEQ ID NO: 741849 - protein, 24 aa, Mycobacterium
TYPSSVVGPAWFTAPGVTERGWGP

SEQ ID NO: 741850 - protein, 21 aa, Mycobacterium
TYPTLCRLFDDLGVATQESDM

SEQ ID NO: 741851 - protein, 23 aa, Mycobacterium
TYQKIGMDYGFFVDRANELHADK

SEQ ID NO: 741852 - protein, 28 aa, Mycobacterium
TYQTLGIAAARFHDEFVGNLRAAATSYA

SEQ ID NO: 741853 - protein, 24 aa, Mycobacterium
TYRANPNIDFIVCFFHHCAYSTTL

SEQ ID NO: 741854 - protein, 19 aa, Mycobacterium
TYRAVLALLLLTGSMGRNG

SEQ ID NO: 741855 - protein, 18 aa, Mycobacterium
TYRCPGCDHEIRPNTAHL

SEQ ID NO: 741856 - protein, 18 aa, Mycobacterium
TYRCPGCDHEIRSGSAHL

SEQ ID NO: 741857 - protein, 17 aa, Mycobacterium
TYRCPGCDHEIRSGTAH

SEQ ID NO: 741858 - protein, 19 aa, Mycobacterium
TYRELRAGHDVWWTVLLDG

SEQ ID NO: 741859 - protein, 25 aa, Mycobacterium
TYREVRPGHEVRWTVLLDGPVRISV

SEQ ID NO: 741860 - protein, 18 aa, Mycobacterium
TYRITPLALWNARAAGHD

SEQ ID NO: 741861 - protein, 17 aa, Mycobacterium
TYRMWGSRDLDINDVRD

SEQ ID NO: 741862 - protein, 25 aa, Mycobacterium
TYRPLVAPLRAAGIPKPHRRNSWYF

SEQ ID NO: 741863 - protein, 26 aa, Mycobacterium
TYRRLAAHFFLTFPALDDVRFTHRWA

SEQ ID NO: 741864 - protein, 17 aa, Mycobacterium
TYRTAYHALRSVAQVSQ

SEQ ID NO: 741865 - protein, 25 aa, Mycobacterium
TYRVVPLDVGLPWFMRGPGAVTGAF

SEQ ID NO: 741866 - protein, 23 aa, Mycobacterium
TYSFARQRFWLGEGAGRKADSSD

SEQ ID NO: 741867 - protein, 23 aa, Mycobacterium
TYSLDEVTAFLVVAATLLDLKAA

SEQ ID NO: 741868 - protein, 17 aa, Mycobacterium
TYSRLILGVGVYDITGG

SEQ ID NO: 741869 - protein, 23 aa, Mycobacterium
TYSRTGGFLANIAEFDAEFFGIS

SEQ ID NO: 741870 - protein, 22 aa, Mycobacterium
TYSSRAARRLAVPMPAETAARI

SEQ ID NO: 741871 - protein, 25 aa, Mycobacterium
TYSYWFEPNPGWSRLFAPGAEVKAY

SEQ ID NO: 741872 - protein, 28 aa, Mycobacterium
TYTAGTPVLAVFELRLTGSARTTGAAGT

SEQ ID NO: 741873 - protein, 18 aa, Mycobacterium
TYTFKIKQGVKFHDGTPL

SEQ ID NO: 741874 - protein, 21 aa, Mycobacterium
TYTKLALCTGARARRLPTPGV

SEQ ID NO: 741875 - protein, 18 aa, Mycobacterium
TYTLADLASAWRNNLDAT

SEQ ID NO: 741876 - protein, 25 aa, Mycobacterium
TYTLGRWSTGVAWSTIKVPLAIAAL

SEQ ID NO: 741877 - protein, 22 aa, Mycobacterium
TYTRKTKFGFRMLDSKQGHGEP

SEQ ID NO: 741878 - protein, 17 aa, Mycobacterium
TYTRYGGFLDHIDEFDP

SEQ ID NO: 741879 - protein, 18 aa, Mycobacterium
TYTVAAFVQANFGARAEL

SEQ ID NO: 741880 - protein, 24 aa, Mycobacterium
TYVDVLRLPVDIVVADKFAADATL

SEQ ID NO: 741881 - protein, 28 aa, Mycobacterium
TYVFDFGRREVRNFLVANALFWLEEFHI

SEQ ID NO: 741882 - protein, 20 aa, Mycobacterium
TYVGALPGRIVRAIGEAGTM

SEQ ID NO: 741883 - protein, 17 aa, Mycobacterium
TYVKQAVVLFPYLEKAG

SEQ ID NO: 741884 - protein, 27 aa, Mycobacterium
TYVPDFRVLRKLLAVPLYLDAPSTTGV

SEQ ID NO: 741885 - protein, 24 aa, Mycobacterium
TYVPEVFRAAGLRVVGPQLMALEI

SEQ ID NO: 741886 - protein, 17 aa, Mycobacterium
TYVRACQQLGYHHPDLT

SEQ ID NO: 741887 - protein, 25 aa, Mycobacterium
TYVVRRGRCEGPRIAGDILPGGGDW

SEQ ID NO: 741888 - protein, 28 aa, Mycobacterium
TYWLGRDRFVLSCGHSSLTLYIQLYLGG

SEQ ID NO: 741889 - protein, 19 aa, Mycobacterium
TYYPGETMPNYTLLPPDDM

SEQ ID NO: 741890 - protein, 18 aa, Mycobacterium
VAAAAAWNGIAVELSTAA

SEQ ID NO: 741891 - protein, 17 aa, Mycobacterium
VAAAAFEAAFAMTVPPP

SEQ ID NO: 741892 - protein, 17 aa, Mycobacterium
VAAAAKVNTLLDIAQAN

SEQ ID NO: 741893 - protein, 18 aa, Mycobacterium
VAAAALWSADGVYDVEGL

SEQ ID NO: 741894 - protein, 19 aa, Mycobacterium
VAAAAPWLRDGDVVVVTSK

SEQ ID NO: 741895 - protein, 20 aa, Mycobacterium
VAAAARRRPSGLVVDLTSVD

SEQ ID NO: 741896 - protein, 19 aa, Mycobacterium
VAAACRGSLALRRKFSASN

SEQ ID NO: 741897 - protein, 19 aa, Mycobacterium
VAAACRRAGAQFSLVLTKT

SEQ ID NO: 741898 - protein, 18 aa, Mycobacterium
VAAACSGAPMHRRDALWA

SEQ ID NO: 741899 - protein, 26 aa, Mycobacterium
VAAAEEHARLGLWAGDRPAPPQTEEH

SEQ ID NO: 741900 - protein, 22 aa, Mycobacterium
VAAAEHPHLWGGVLDVADGPLP

SEQ ID NO: 741901 - protein, 25 aa, Mycobacterium
VAAAERAFESWGRSTPSFRQQALLK

SEQ ID NO: 741902 - protein, 20 aa, Mycobacterium
VAAAERRLLLDSVRHPRHAP

SEQ ID NO: 741903 - protein, 28 aa, Mycobacterium
VAAAESWGPLFYEARRAAVAAVNDRETA

SEQ ID NO: 741904 - protein, 18 aa, Mycobacterium
VAAAFEAILGRLPSDIRA

SEQ ID NO: 741905 - protein, 18 aa, Mycobacterium
VAAAIGMTGARYGAIGVW

SEQ ID NO: 741906 - protein, 20 aa, Mycobacterium
VAAAISMPLAHSVELNAGTM

SEQ ID NO: 741907 - protein, 17 aa, Mycobacterium
VAAAIVVRAHCPTPTLD

SEQ ID NO: 741908 - protein, 24 aa, Mycobacterium
VAAAKRFPDKSVRSVQAVFARAVL

SEQ ID NO: 741909 - protein, 28 aa, Mycobacterium
VAAAKWWRKPLVRRWYGFAEMQKDVARK

SEQ ID NO: 741910 - protein, 17 aa, Mycobacterium
VAAALALQGLRTLVIDL

SEQ ID NO: 741911 - protein, 18 aa, Mycobacterium
VAAALAWVRALGKADVVA

SEQ ID NO: 741912 - protein, 19 aa, Mycobacterium
VAAALEFARTSNLAVAIRG

SEQ ID NO: 741913 - protein, 18 aa, Mycobacterium
VAAALGISRGRASGRLHY

SEQ ID NO: 741914 - protein, 22 aa, Mycobacterium
VAAALPDYMTPAGYVVLDEIPI

SEQ ID NO: 741915 - protein, 17 aa, Mycobacterium
VAAALRAPLDVFLVRKL

SEQ ID NO: 741916 - protein, 20 aa, Mycobacterium
VAAALRIPAEVIGTGNHTVG

SEQ ID NO: 741917 - protein, 19 aa, Mycobacterium
VAAAPEFRDAIRGPLDTDR

SEQ ID NO: 741918 - protein, 18 aa, Mycobacterium
VAAARAAYIAGFAASSNL

SEQ ID NO: 741919 - protein, 24 aa, Mycobacterium
VAAARAGADLVLPVQEIGRVLADI

SEQ ID NO: 741920 - protein, 23 aa, Mycobacterium
VAAARAGARVQFVGAVGDDPAAE

SEQ ID NO: 741921 - protein, 22 aa, Mycobacterium
VAAARAGARVQFVGTIGDDPAA

SEQ ID NO: 741922 - protein, 18 aa, Mycobacterium
VAAARFRRPGAGPGSEPE

SEQ ID NO: 741923 - protein, 21 aa, Mycobacterium
VAAARLGNRSALISGVGDDPF

SEQ ID NO: 741924 - protein, 23 aa, Mycobacterium
VAAARRLFIDAGYDATPMSRLAK

SEQ ID NO: 741925 - protein, 24 aa, Mycobacterium
VAAARSGERTVWFVIDPTRPQCSV

SEQ ID NO: 741926 - protein, 18 aa, Mycobacterium
VAAARSSLLADIAKVAEA

SEQ ID NO: 741927 - protein, 17 aa, Mycobacterium
VAAARYWQQQSLEDNCG

SEQ ID NO: 741928 - protein, 18 aa, Mycobacterium
VAAATAYEAAFMATVPPA

SEQ ID NO: 741929 - protein, 18 aa, Mycobacterium
VAAATGLPVRLGGDGLCM

SEQ ID NO: 741930 - protein, 19 aa, Mycobacterium
VAAAVELMHNFSLVHDDVM

SEQ ID NO: 741931 - protein, 20 aa, Mycobacterium
VAAAVELMHNFSLVHDDVMD

SEQ ID NO: 741932 - protein, 17 aa, Mycobacterium
VAAAVGEGSMAVMFVHR

SEQ ID NO: 741933 - protein, 17 aa, Mycobacterium
VAAAVGEGSMAVMLVHR

SEQ ID NO: 741934 - protein, 20 aa, Mycobacterium
VAAAWTLHARLVRRHLERGI

SEQ ID NO: 741935 - protein, 19 aa, Mycobacterium
VAACALESMDVEKWFDVVR

SEQ ID NO: 741936 - protein, 17 aa, Mycobacterium
VAACATVAVSVEEGVDK

SEQ ID NO: 741937 - protein, 20 aa, Mycobacterium
VAACDAIIPSLVERDPEWAG

SEQ ID NO: 741938 - protein, 27 aa, Mycobacterium
VAACFHCPSCIEQLRAADDVLLVAGLR

SEQ ID NO: 741939 - protein, 20 aa, Mycobacterium
VAACRRRYGSVFTLRVAGMG

SEQ ID NO: 741940 - protein, 24 aa, Mycobacterium
VAACTRRRLPLLIAPPNVLFATVS

SEQ ID NO: 741941 - protein, 17 aa, Mycobacterium
VAACVAAEPVIEYSMTG

SEQ ID NO: 741942 - protein, 19 aa, Mycobacterium
VAADFGDRAVLGVADPHPR

SEQ ID NO: 741943 - protein, 23 aa, Mycobacterium
VAADGRPLVAPVWFVVDDGHLVF

SEQ ID NO: 741944 - protein, 24 aa, Mycobacterium
VAADGRPLVTPVWFVVDEGQLAFN

SEQ ID NO: 741945 - protein, 17 aa, Mycobacterium
VAADGSARFVRYHMIPA

SEQ ID NO: 741946 - protein, 17 aa, Mycobacterium
VAADIDALVGLDTDRIL

SEQ ID NO: 741947 - protein, 21 aa, Mycobacterium
VAADIVPLIQTWLPALTSSMS

SEQ ID NO: 741948 - protein, 20 aa, Mycobacterium
VAADLGFTIGMADVVAIRGE

SEQ ID NO: 741949 - protein, 22 aa, Mycobacterium
VAADLKAAGALDESGNADPMIR

SEQ ID NO: 741950 - protein, 24 aa, Mycobacterium
VAADLPVPHGFVVMRSAYLDSVRM

SEQ ID NO: 741951 - protein, 19 aa, Mycobacterium
VAADLQIMKRGAALLELGK

SEQ ID NO: 741952 - protein, 22 aa, Mycobacterium
VAADMEEFFAAVTLRPDAVPEF

SEQ ID NO: 741953 - protein, 31 aa, Mycobacterium
VAADRPAVVPLSFAQNRLWFLDQLQGPSPVY

SEQ ID NO: 741954 - protein, 19 aa, Mycobacterium
VAADTLFTAALARTELIRA

SEQ ID NO: 741955 - protein, 22 aa, Mycobacterium
VAADVHGIGALLANGNAAAAAT

SEQ ID NO: 741956 - protein, 24 aa, Mycobacterium
VAAEAPRQFSWSILNRSGELQESV

SEQ ID NO: 741957 - protein, 20 aa, Mycobacterium
VAAEATRVGMPYVNQRWLGG

SEQ ID NO: 741958 - protein, 21 aa, Mycobacterium
VAAEATRVGMPYVNQRWLGGM

SEQ ID NO: 741959 - protein, 27 aa, Mycobacterium
VAAEFAHVFSAFGVRVTLVIRGGCMLR

SEQ ID NO: 741960 - protein, 17 aa, Mycobacterium
VAAEFAHVFSALGSRVT

SEQ ID NO: 741961 - protein, 21 aa, Mycobacterium
VAAEGRPTLGFQRVPDPTPGK

SEQ ID NO: 741962 - protein, 17 aa, Mycobacterium
VAAELALPHRRRRDPFD

SEQ ID NO: 741963 - protein, 17 aa, Mycobacterium
VAAELDGAVAADCVVLG

SEQ ID NO: 741964 - protein, 19 aa, Mycobacterium
VAAELDRRGVLRRVGGAPY

SEQ ID NO: 741965 - protein, 17 aa, Mycobacterium
VAAELIFDQGLGDMFVV

SEQ ID NO: 741966 - protein, 25 aa, Mycobacterium
VAAELPMQMICILLGVPESERHWLF

SEQ ID NO: 741967 - protein, 17 aa, Mycobacterium
VAAEPGLKDRLLSDADL

SEQ ID NO: 741968 - protein, 24 aa, Mycobacterium
VAAEVARLALFLTTSAARHITGQT

SEQ ID NO: 741969 - protein, 31 aa, Mycobacterium
VAAFLERRTPRWSASVAQEWEPVPHVDREGS

SEQ ID NO: 741970 - protein, 25 aa, Mycobacterium
VAAFPPRELAVAWCEADHNRLEALM

SEQ ID NO: 741971 - protein, 26 aa, Mycobacterium
VAAFPQWRGTTLLERSEMIRSFAQRL

SEQ ID NO: 741972 - protein, 26 aa, Mycobacterium
VAAFPRYHPRWAWWVTSVPLLREFAV

SEQ ID NO: 741973 - protein, 20 aa, Mycobacterium
VAAFRAIDCQGLARVDFFLA

SEQ ID NO: 741974 - protein, 18 aa, Mycobacterium
VAAFSAFFHQGQICLNAR

SEQ ID NO: 741975 - protein, 18 aa, Mycobacterium
VAAGAPGWDVSPEELEQA

SEQ ID NO: 741976 - protein, 24 aa, Mycobacterium
VAAGASWGNAGWIAPALTLPLQPS

SEQ ID NO: 741977 - protein, 29 aa, Mycobacterium
VAAGCLPRLEHACGLGTGSLFVDDVAEPR

SEQ ID NO: 741978 - protein, 19 aa, Mycobacterium
VAAGGLWESQAAPPLACLL

SEQ ID NO: 741979 - protein, 23 aa, Mycobacterium
VAAGIDAGMVWVNDHHRLEPSLP

SEQ ID NO: 741980 - protein, 19 aa, Mycobacterium
VAAGLARTGHQVFVNTFGV

SEQ ID NO: 741981 - protein, 20 aa, Mycobacterium
VAAGLGLGGCEAYPGVFAPF

SEQ ID NO: 741982 - protein, 23 aa, Mycobacterium
VAAGRPAPYMIYRAMEHSGVQDI

SEQ ID NO: 741983 - protein, 18 aa, Mycobacterium
VAAGRRGPQALSLKLIDP

SEQ ID NO: 741984 - protein, 22 aa, Mycobacterium
VAAGSWSRHRIEAIQRAADVTA

SEQ ID NO: 741985 - protein, 19 aa, Mycobacterium
VAAGVFVYQVHACRGFPGD

SEQ ID NO: 741986 - protein, 27 aa, Mycobacterium
VAAHAPEALPVLFGHIGEGNLHLNVLR

SEQ ID NO: 741987 - protein, 21 aa, Mycobacterium
VAAHAPYLAWLTRASADSAAA

SEQ ID NO: 741988 - protein, 24 aa, Mycobacterium
VAAHHPRLLVANAVHETMLQRASR

SEQ ID NO: 741989 - protein, 18 aa, Mycobacterium
VAAHLGIDREEVVQATIA

SEQ ID NO: 741990 - protein, 26 aa, Mycobacterium
VAAHVPEAIPLLFGHIGEGNLHLNVL

SEQ ID NO: 741991 - protein, 23 aa, Mycobacterium
VAAIDRACEWGRDSVEQAIPVTT

SEQ ID NO: 741992 - protein, 25 aa, Mycobacterium
VAAIGNWRLFSALLRSLHVPLEDGL

SEQ ID NO: 741993 - protein, 21 aa, Mycobacterium
VAAIRLPGSHFRSDIGQAAAE

SEQ ID NO: 741994 - protein, 30 aa, Mycobacterium
VAAITVAITHGWSLAKSVRYGIAAGTAMLM

SEQ ID NO: 741995 - protein, 24 aa, Mycobacterium
VAAITVGLARGWPLVKSVRLGIAA

SEQ ID NO: 741996 - protein, 25 aa, Mycobacterium
VAAIVPWNMPQFLIATKLVPALLAG

SEQ ID NO: 741997 - protein, 26 aa, Mycobacterium
VAAIVPWNMPQFLIVTKLVPALLAGC

SEQ ID NO: 741998 - protein, 24 aa, Mycobacterium
VAAKLPVPPGFVLLRDCYRDSMRA

SEQ ID NO: 741999 - protein, 24 aa, Mycobacterium
VAALAHACGDQGDIVTILAFTGLR

SEQ ID NO: 742000 - protein, 25 aa, Mycobacterium
VAALAHACGDQGDIVTILAFTGLRW

SEQ ID NO: 742001 - protein, 21 aa, Mycobacterium
VAALCDRRRGLGADGILRVTT

SEQ ID NO: 742002 - protein, 21 aa, Mycobacterium
VAALCESGAAGLCFGTGDAHD

SEQ ID NO: 742003 - protein, 17 aa, Mycobacterium
VAALCGAGGQGDALVLR

SEQ ID NO: 742004 - protein, 18 aa, Mycobacterium
VAALCGSPKQARKHADAG

SEQ ID NO: 742005 - protein, 18 aa, Mycobacterium
VAALCGSPSQARKHADAG

SEQ ID NO: 742006 - protein, 17 aa, Mycobacterium
VAALCGSPSQARKHANA

SEQ ID NO: 742007 - protein, 18 aa, Mycobacterium
VAALCGSPSQARKHVDAG

SEQ ID NO: 742008 - protein, 21 aa, Mycobacterium
VAALKAGRLVVMPTDTVYGVA

SEQ ID NO: 742009 - protein, 18 aa, Mycobacterium
VAALLCRIMLQGLATRPP

SEQ ID NO: 742010 - protein, 23 aa, Mycobacterium
VAALPDLPAIDAIAHRLNAVSVG

SEQ ID NO: 742011 - protein, 20 aa, Mycobacterium
VAALQEWVRRTGLGSVVSDV

SEQ ID NO: 742012 - protein, 25 aa, Mycobacterium
VAALQRSDLLIALGTRFDDRVTGKL

SEQ ID NO: 742013 - protein, 26 aa, Mycobacterium
VAALQRSDLLIALGTRFDDRVTGKLE

SEQ ID NO: 742014 - protein, 23 aa, Mycobacterium
VAALRARCPGLPVGVTTGAWALA

SEQ ID NO: 742015 - protein, 26 aa, Mycobacterium
VAALRKRLSTALVITEWCQLPSGTTR

SEQ ID NO: 742016 - protein, 22 aa, Mycobacterium
VAALRNDWLGARDFAVKAITES

SEQ ID NO: 742017 - protein, 21 aa, Mycobacterium
VAALRRFWMFHGMLSEGFQWT

SEQ ID NO: 742018 - protein, 26 aa, Mycobacterium
VAALRVAVCRLVARHPALRTGLRAAL

SEQ ID NO: 742019 - protein, 20 aa, Mycobacterium
VAAMQGRIAMYHALGEGVAP

SEQ ID NO: 742020 - protein, 24 aa, Mycobacterium
VAAMVAVARSCCGHAVDPVVRNAH

SEQ ID NO: 742021 - protein, 19 aa, Mycobacterium
VAAMYADLFDEWKLPVPAL

SEQ ID NO: 742022 - protein, 26 aa, Mycobacterium
VAANAEAYCAGWYRTGDIGWLDGEGW

SEQ ID NO: 742023 - protein, 25 aa, Mycobacterium
VAANEMRARFLFHCREFEVIEESRS

SEQ ID NO: 742024 - protein, 25 aa, Mycobacterium
VAANRAQLVSLVRSNLLGLNAPAIA

SEQ ID NO: 742025 - protein, 26 aa, Mycobacterium
VAANRARLAILVATNFFGQNTPAIAA

SEQ ID NO: 742026 - protein, 24 aa, Mycobacterium
VAANRARLAMLLATNFFGVNYPAI

SEQ ID NO: 742027 - protein, 27 aa, Mycobacterium
VAANRNAFVKLVLSNVFGQNAPLIAAA

SEQ ID NO: 742028 - protein, 18 aa, Mycobacterium
VAANWKLIVENFMECYHC

SEQ ID NO: 742029 - protein, 23 aa, Mycobacterium
VAAPARAGFRAALAAKLGTAAER

SEQ ID NO: 742030 - protein, 22 aa, Mycobacterium
VAAPARQGFRTALGNRLGVPAD

SEQ ID NO: 742031 - protein, 25 aa, Mycobacterium
VAAPAYNTGSAWGYTPKGATGVPTR

SEQ ID NO: 742032 - protein, 18 aa, Mycobacterium
VAAPFRFASRPTAADDSA

SEQ ID NO: 742033 - protein, 24 aa, Mycobacterium
VAAPLADTGACWVVQHGKAPTPMR

SEQ ID NO: 742034 - protein, 21 aa, Mycobacterium
VAAPRRPIIRPIPVDESGFTI

SEQ ID NO: 742035 - protein, 18 aa, Mycobacterium
VAAPRRVDAADREGAAVI

SEQ ID NO: 742036 - protein, 18 aa, Mycobacterium
VAAQFWALIHGFVMLELA

SEQ ID NO: 742037 - protein, 17 aa, Mycobacterium
VAAQLGTAFLLAEEAGS

SEQ ID NO: 742038 - protein, 19 aa, Mycobacterium
VAAQLRLQANLIHLKTDTF

SEQ ID NO: 742039 - protein, 24 aa, Mycobacterium
VAAQRLSADFPLRPAASASHPGQP

SEQ ID NO: 742040 - protein, 26 aa, Mycobacterium
VAAQSGRFAFQWTEFPWGCEHYEWTG

SEQ ID NO: 742041 - protein, 20 aa, Mycobacterium
VAAQSWALERINAVKAAAGV

SEQ ID NO: 742042 - protein, 26 aa, Mycobacterium
VAAQSWPLERLRRIKAVTGATINDIV

SEQ ID NO: 742043 - protein, 21 aa, Mycobacterium
VAAQSWSLDRIKAVKNAADVT

SEQ ID NO: 742044 - protein, 25 aa, Mycobacterium
VAAQSWSLDRIKAVKSAAGVTVNDV

SEQ ID NO: 742045 - protein, 17 aa, Mycobacterium
VAARAPGGPAIRVEPEA

SEQ ID NO: 742046 - protein, 19 aa, Mycobacterium
VAARARLTADFDWATVADE

SEQ ID NO: 742047 - protein, 21 aa, Mycobacterium
VAARDKDAWLAVFADDAIVED

SEQ ID NO: 742048 - protein, 24 aa, Mycobacterium
VAARDLSPLGIRVVTIAPGTINTP

SEQ ID NO: 742049 - protein, 22 aa, Mycobacterium
VAARELELFLDLVGYLSTTSAS

SEQ ID NO: 742050 - protein, 20 aa, Mycobacterium
VAARGAAFGGFIGAGQTCIA

SEQ ID NO: 742051 - protein, 24 aa, Mycobacterium
VAARGADAALEYGASFDGVRPDRV

SEQ ID NO: 742052 - protein, 19 aa, Mycobacterium
VAARGARLTIADPVGATSS

SEQ ID NO: 742053 - protein, 19 aa, Mycobacterium
VAARGGLTGAAYTWGEESE

SEQ ID NO: 742054 - protein, 25 aa, Mycobacterium
VAARIARLLPALALARIDGRSPVDY

SEQ ID NO: 742055 - protein, 20 aa, Mycobacterium
VAARIGIKVLGYRPGRSARK

SEQ ID NO: 742056 - protein, 17 aa, Mycobacterium
VAARILAEFSDCLTEEQ

SEQ ID NO: 742057 - protein, 17 aa, Mycobacterium
VAARLAGSGRKVLVLEA

SEQ ID NO: 742058 - protein, 17 aa, Mycobacterium
VAARLRPTTALIVDHGL

SEQ ID NO: 742059 - protein, 23 aa, Mycobacterium
VAARMWRDAFDYVTTSFASADTA

SEQ ID NO: 742060 - protein, 17 aa, Mycobacterium
VAARPKMAVTIKADGRA

SEQ ID NO: 742061 - protein, 17 aa, Mycobacterium
VAARPPASLVLFSPLID

SEQ ID NO: 742062 - protein, 23 aa, Mycobacterium
VAARRIADRWVRQGTGAGRSLGF

SEQ ID NO: 742063 - protein, 17 aa, Mycobacterium
VAARRIGYMKGLNSGQV

SEQ ID NO: 742064 - protein, 17 aa, Mycobacterium
VAARTNIALGMFNSPSS

SEQ ID NO: 742065 - protein, 19 aa, Mycobacterium
VAARVPRLLFLGSSCIYPK

SEQ ID NO: 742066 - protein, 25 aa, Mycobacterium
VAARVRNAGAIFLGPWSPVSLGDYC

SEQ ID NO: 742067 - protein, 27 aa, Mycobacterium
VAASCAVPGAWPPVTIAGRRYMDGGVA

SEQ ID NO: 742068 - protein, 26 aa, Mycobacterium
VAASGRWVPDFLSLPIAVENSMKDQT

SEQ ID NO: 742069 - protein, 29 aa, Mycobacterium
VAASPRWADPVNRLGCLRGISALTGLALS

SEQ ID NO: 742070 - protein, 17 aa, Mycobacterium
VAASSIGFIAPIPDATN

SEQ ID NO: 742071 - protein, 17 aa, Mycobacterium
VAATADYLIARQSLEDL

SEQ ID NO: 742072 - protein, 24 aa, Mycobacterium
VAATEFWKTITLCAKHAPVDVLSI

SEQ ID NO: 742073 - protein, 24 aa, Mycobacterium
VAATLRRDMWAGLAAAGLDSIPVN

SEQ ID NO: 742074 - protein, 18 aa, Mycobacterium
VAATPALLPAVRPDVDTY

SEQ ID NO: 742075 - protein, 22 aa, Mycobacterium
VAATRGGWRAGGVRDGQAGILA

SEQ ID NO: 742076 - protein, 23 aa, Mycobacterium
VAATWGLAAAMTRGDVTVTGVDP

SEQ ID NO: 742077 - protein, 25 aa, Mycobacterium
VAAVAAVLGMRCHLVQERWVDWDDP

SEQ ID NO: 742078 - protein, 17 aa, Mycobacterium
VAAVAAWARAAEDEIAR

SEQ ID NO: 742079 - protein, 18 aa, Mycobacterium
VAAVAQVNALLDIAQANL

SEQ ID NO: 742080 - protein, 23 aa, Mycobacterium
VAAVARCGHRLEHLEMVTDDQAA

SEQ ID NO: 742081 - protein, 20 aa, Mycobacterium
VAAVARLDLGSVLIPMPDAG

SEQ ID NO: 742082 - protein, 25 aa, Mycobacterium
VAAVARLRPDVVFIVSPNNPTGQSV

SEQ ID NO: 742083 - protein, 19 aa, Mycobacterium
VAAVARRAGMRVERRDDHL

SEQ ID NO: 742084 - protein, 20 aa, Mycobacterium
VAAVARRGGVPLVIDKKPPA

SEQ ID NO: 742085 - protein, 22 aa, Mycobacterium
VAAVDCRGGAPGTRETDLLDPV

SEQ ID NO: 742086 - protein, 26 aa, Mycobacterium
VAAVFAEGLIAYRLVHLICTRTMLVK

SEQ ID NO: 742087 - protein, 27 aa, Mycobacterium
VAAVFLPNCSAFAVVLHGILRAGGTAS

SEQ ID NO: 742088 - protein, 17 aa, Mycobacterium
VAAVGHWVHVYVDRHTR

SEQ ID NO: 742089 - protein, 18 aa, Mycobacterium
VAAVGPLVEALAEHAARL

SEQ ID NO: 742090 - protein, 20 aa, Mycobacterium
VAAVLPDRFTAGLLAAMLER

SEQ ID NO: 742091 - protein, 20 aa, Mycobacterium
VAAVLRFAATEVVPRLAGTE

SEQ ID NO: 742092 - protein, 25 aa, Mycobacterium
VAAVNGFCVGGGIGLVGNSDVIVAS

SEQ ID NO: 742093 - protein, 18 aa, Mycobacterium
VAAVPLMLEHSGGGNIIN

SEQ ID NO: 742094 - protein, 18 aa, Mycobacterium
VAAVPLMLEHSGGGSIIN

SEQ ID NO: 742095 - protein, 25 aa, Mycobacterium
VAAVPNIRFLPALSKVLFRKDFPQE

SEQ ID NO: 742096 - protein, 20 aa, Mycobacterium
VAAVSGRLPVVVGVSDVTTA

SEQ ID NO: 742097 - protein, 29 aa, Mycobacterium
VAAVVDLCSRFLPAMVERGRGAVLNVASV

SEQ ID NO: 742098 - protein, 19 aa, Mycobacterium
VAAWQGEASEMWAMEQQKL

SEQ ID NO: 742099 - protein, 18 aa, Mycobacterium
VAAWRLLLAEGIEGRCRI

SEQ ID NO: 742100 - protein, 25 aa, Mycobacterium
VAAWRLLLAEGIEGRCRIIGPIDDY

SEQ ID NO: 742101 - protein, 31 aa, Mycobacterium
VAAYARQAAFDWHEFVAFRGRELASGAQLVV

SEQ ID NO: 742102 - protein, 21 aa, Mycobacterium
VAAYGARFAGVAFPGETLKVG

SEQ ID NO: 742103 - protein, 21 aa, Mycobacterium
VAAYLGGPWRALRVAGVIPAP

SEQ ID NO: 742104 - protein, 17 aa, Mycobacterium
VAAYLKPAAKLALPTAP

SEQ ID NO: 742105 - protein, 17 aa, Mycobacterium
VAAYLPYRSKPRSPEGL

SEQ ID NO: 742106 - protein, 18 aa, Mycobacterium
VAAYRLSAQALRDALALP

SEQ ID NO: 742107 - protein, 17 aa, Mycobacterium
VACAAALATLDVIDEEG

SEQ ID NO: 742108 - protein, 18 aa, Mycobacterium
VACAEPIAQELLKHISND

SEQ ID NO: 742109 - protein, 18 aa, Mycobacterium
VACAGFGMGGPFIDAEPR

SEQ ID NO: 742110 - protein, 17 aa, Mycobacterium
VACALAHGFTVPDAVAF

SEQ ID NO: 742111 - protein, 22 aa, Mycobacterium
VACARAGAVTVAINDRFRIDEL

SEQ ID NO: 742112 - protein, 17 aa, Mycobacterium
VACDGRWSIARQAAGLK

SEQ ID NO: 742113 - protein, 18 aa, Mycobacterium
VACEGLYHFAWDEFCDWY

SEQ ID NO: 742114 - protein, 18 aa, Mycobacterium
VACGMSYPDTRIDDAVGV

SEQ ID NO: 742115 - protein, 19 aa, Mycobacterium
VACGRAVSRAGDWFGSPVN

SEQ ID NO: 742116 - protein, 39 aa, Mycobacterium
VACGYARRSGLTASRFVACPFGAPGSRMYRTGDLVRWGA

SEQ ID NO: 742117 - protein, 36 aa, Mycobacterium
VACLLAESFNSLFLRNCINYGLPILAVPGISSAVTE

SEQ ID NO: 742118 - protein, 19 aa, Mycobacterium
VACRFPGAANPGEFWELVS

SEQ ID NO: 742119 - protein, 19 aa, Mycobacterium
VACRPWLIAEIEAVQPEVI

SEQ ID NO: 742120 - protein, 19 aa, Mycobacterium
VACRSDLGGSLVLSEFTGA

SEQ ID NO: 742121 - protein, 19 aa, Mycobacterium
VACRVRPGGRFVTLTTNPG

SEQ ID NO: 742122 - protein, 18 aa, Mycobacterium
VACSGFRAPSLRDAGPKA

SEQ ID NO: 742123 - protein, 18 aa, Mycobacterium
VACTGAYHHSMASNYNMV

SEQ ID NO: 742124 - protein, 18 aa, Mycobacterium
VACTGAYHHSMASSYNLV

SEQ ID NO: 742125 - protein, 22 aa, Mycobacterium
VADAALAVWLRMWNSDSRIARR

SEQ ID NO: 742126 - protein, 23 aa, Mycobacterium
VADADTGANMLFTMRAALAEADA

SEQ ID NO: 742127 - protein, 18 aa, Mycobacterium
VADADTGTNMLFTMRAAW

SEQ ID NO: 742128 - protein, 18 aa, Mycobacterium
VADADTGTNMLFTMRSAW

SEQ ID NO: 742129 - protein, 22 aa, Mycobacterium
VADAGLVFQGWFQKTPYYPHDF

SEQ ID NO: 742130 - protein, 19 aa, Mycobacterium
VADAGWKYLSTGAYGGSLA

SEQ ID NO: 742131 - protein, 19 aa, Mycobacterium
VADAISLGGLRPVIVGGPA

SEQ ID NO: 742132 - protein, 17 aa, Mycobacterium
VADALDLGDEPAYDTII

SEQ ID NO: 742133 - protein, 21 aa, Mycobacterium
VADALIDICVREFGRIDILIN

SEQ ID NO: 742134 - protein, 21 aa, Mycobacterium
VADALRGALISPVITAHPTET

SEQ ID NO: 742135 - protein, 18 aa, Mycobacterium
VADAPWTPAQFAAGPTAT

SEQ ID NO: 742136 - protein, 18 aa, Mycobacterium
VADARRVGFGIGAEIEAG

SEQ ID NO: 742137 - protein, 17 aa, Mycobacterium
VADASLVSAGRTKALGR

SEQ ID NO: 742138 - protein, 19 aa, Mycobacterium
VADATKLDGFDGHFDTVVD

SEQ ID NO: 742139 - protein, 19 aa, Mycobacterium
VADAVAWLASDQSRLVTAT

SEQ ID NO: 742140 - protein, 17 aa, Mycobacterium
VADAVGLVIPDSAGGFD

SEQ ID NO: 742141 - protein, 19 aa, Mycobacterium
VADAYRFLPTLGEVDLFLF

SEQ ID NO: 742142 - protein, 17 aa, Mycobacterium
VADCEEALFASPVAVHQ

SEQ ID NO: 742143 - protein, 25 aa, Mycobacterium
VADCGLPRAEVVGVPVREAITSLDR

SEQ ID NO: 742144 - protein, 23 aa, Mycobacterium
VADDGLCFGRLDAITGERSYVGR

SEQ ID NO: 742145 - protein, 22 aa, Mycobacterium
VADDRPAPGLGRGESHDTPKTA

SEQ ID NO: 742146 - protein, 22 aa, Mycobacterium
VADEDFHGPGWLDSAPPDSESE

SEQ ID NO: 742147 - protein, 18 aa, Mycobacterium
VADERIETVLPFSWQGVS

SEQ ID NO: 742148 - protein, 23 aa, Mycobacterium
VADEYDRRYGLDDAHLRAIAQLN

SEQ ID NO: 742149 - protein, 17 aa, Mycobacterium
VADFLMMGLAYHRFALA

SEQ ID NO: 742150 - protein, 17 aa, Mycobacterium
VADFLPRVWAGCDALGL

SEQ ID NO: 742151 - protein, 26 aa, Mycobacterium
VADFRPGPRCRLGVLVDHLVPGSKEA

SEQ ID NO: 742152 - protein, 22 aa, Mycobacterium
VADGAQVARFICELRGLIEAPE

SEQ ID NO: 742153 - protein, 19 aa, Mycobacterium
VADGLLVMPFGSRRFLTEV

SEQ ID NO: 742154 - protein, 24 aa, Mycobacterium
VADGLRPPPPVRYRLADGAAALDA

SEQ ID NO: 742155 - protein, 20 aa, Mycobacterium
VADGRITNFYAMRNPEKLTG

SEQ ID NO: 742156 - protein, 19 aa, Mycobacterium
VADHCYELGMPAGMVELAD

SEQ ID NO: 742157 - protein, 25 aa, Mycobacterium
VADHRGASVSVDWPAEVQQRVREAA

SEQ ID NO: 742158 - protein, 24 aa, Mycobacterium
VADHRGASVTVDWPARLQQRVRRV

SEQ ID NO: 742159 - protein, 24 aa, Mycobacterium
VADHRGATLAVEWPAELQDGVREL

SEQ ID NO: 742160 - protein, 19 aa, Mycobacterium
VADHRGATVSVQWPAELQQ

SEQ ID NO: 742161 - protein, 24 aa, Mycobacterium
VADIAAEFGTPVFVIDEADFRSRC

SEQ ID NO: 742162 - protein, 29 aa, Mycobacterium
VADIARKWGFWRLGPFTTVYRETYGQVPD

SEQ ID NO: 742163 - protein, 17 aa, Mycobacterium
VADIARRAGVAKGTVFR

SEQ ID NO: 742164 - protein, 19 aa, Mycobacterium
VADICRELGVKLILDTSGG

SEQ ID NO: 742165 - protein, 18 aa, Mycobacterium
VADIFFLVCDGLKGLPQS

SEQ ID NO: 742166 - protein, 20 aa, Mycobacterium
VADIFTRMILSVVATGCAPK

SEQ ID NO: 742167 - protein, 23 aa, Mycobacterium
VADILLRVAVGIIMFPTDRLDTS

SEQ ID NO: 742168 - protein, 18 aa, Mycobacterium
VADIPKDRWDADKYYDPD

SEQ ID NO: 742169 - protein, 17 aa, Mycobacterium
VADIRRLSELDALREAA

SEQ ID NO: 742170 - protein, 25 aa, Mycobacterium
VADKLDLRPGITFDTRVVSATLDEK

SEQ ID NO: 742171 - protein, 17 aa, Mycobacterium
VADLAGWDAGRLDHAIW

SEQ ID NO: 742172 - protein, 24 aa, Mycobacterium
VADLGEYFLGLGYVAAAQAALAGG

SEQ ID NO: 742173 - protein, 23 aa, Mycobacterium
VADLGFPLSVHFEATYGVNTAAF

SEQ ID NO: 742174 - protein, 24 aa, Mycobacterium
VADLGRLTLYLSTRDCYATNSTFI

SEQ ID NO: 742175 - protein, 18 aa, Mycobacterium
VADLIAQAGGDPWAVNRS

SEQ ID NO: 742176 - protein, 18 aa, Mycobacterium
VADLISRHRVTVLHMVPS

SEQ ID NO: 742177 - protein, 25 aa, Mycobacterium
VADLLPRPLLDVMFAGGREAGVPPT

SEQ ID NO: 742178 - protein, 25 aa, Mycobacterium
VADLPSRRFVSMIAVGRDADPAIAD

SEQ ID NO: 742179 - protein, 25 aa, Mycobacterium
VADLQRPQGILVRDGVLYVVDAGAK

SEQ ID NO: 742180 - protein, 24 aa, Mycobacterium
VADLQRPQGIMVRDEVLYIVDAGA

SEQ ID NO: 742181 - protein, 20 aa, Mycobacterium
VADLRMLFIVSGKLKEGRRW

SEQ ID NO: 742182 - protein, 22 aa, Mycobacterium
VADLRTARELERHGPGRVPTEV

SEQ ID NO: 742183 - protein, 22 aa, Mycobacterium
VADLVERIECARKPETDVWAGY

SEQ ID NO: 742184 - protein, 25 aa, Mycobacterium
VADMLPRPLLDVLFATDRETADLLQ

SEQ ID NO: 742185 - protein, 27 aa, Mycobacterium
VADMSWKDFDWLIGINIGGVVNGTKAF

SEQ ID NO: 742186 - protein, 25 aa, Mycobacterium
VADMTYLQWLQRYVELAIGDGDSTA

SEQ ID NO: 742187 - protein, 28 aa, Mycobacterium
VADMTYLQWLQRYVELTIGDGNSTADTA

SEQ ID NO: 742188 - protein, 17 aa, Mycobacterium
VADPALVPLYFIAKEAR

SEQ ID NO: 742189 - protein, 24 aa, Mycobacterium
VADPEGMWGLGVLRVADRAEALAI

SEQ ID NO: 742190 - protein, 22 aa, Mycobacterium
VADPFGHQWSMGRPVREVGYDE

SEQ ID NO: 742191 - protein, 18 aa, Mycobacterium
VADPLPPHRYRLVNQGAG

SEQ ID NO: 742192 - protein, 18 aa, Mycobacterium
VADPLYRCARSESADAYS

SEQ ID NO: 742193 - protein, 25 aa, Mycobacterium
VADPNRPTGSFLFLGPTGVGKTELA

SEQ ID NO: 742194 - protein, 17 aa, Mycobacterium
VADPPPYRRNPLLRGPR

SEQ ID NO: 742195 - protein, 21 aa, Mycobacterium
VADPRLSRLLLQQGAAVDAEM

SEQ ID NO: 742196 - protein, 26 aa, Mycobacterium
VADPTLAPGRIRVMLGTGYSAPSDVL

SEQ ID NO: 742197 - protein, 23 aa, Mycobacterium
VADQRGSSVVVDWPAELQQQVRR

SEQ ID NO: 742198 - protein, 17 aa, Mycobacterium
VADRASWRRWWPDLRLQ

SEQ ID NO: 742199 - protein, 23 aa, Mycobacterium
VADRAVVVATRLDSRALGTDSTA

SEQ ID NO: 742200 - protein, 21 aa, Mycobacterium
VADRFLLLPMPEWSVNPIDPI

SEQ ID NO: 742201 - protein, 22 aa, Mycobacterium
VADRFLRRWMRASGQFEYHPTW

SEQ ID NO: 742202 - protein, 23 aa, Mycobacterium
VADRICALYLGRVAADVPAADVT

SEQ ID NO: 742203 - protein, 23 aa, Mycobacterium
VADRLAVRRCWVGAELAMFSGDG

SEQ ID NO: 742204 - protein, 19 aa, Mycobacterium
VADRLRGDELVKALMHSDL

SEQ ID NO: 742205 - protein, 17 aa, Mycobacterium
VADRLRRDDLIKALMHS

SEQ ID NO: 742206 - protein, 23 aa, Mycobacterium
VADRRYPAILAMTSLNDTRVYFV

SEQ ID NO: 742207 - protein, 17 aa, Mycobacterium
VADRSSWSRWWPDLRLE

SEQ ID NO: 742208 - protein, 18 aa, Mycobacterium
VADRWRIGRVFLAGDAAH

SEQ ID NO: 742209 - protein, 24 aa, Mycobacterium
VADSEWAGVLAWAVGQALAANLDE

SEQ ID NO: 742210 - protein, 21 aa, Mycobacterium
VADSFHLPIVFLADNPGMLPG

SEQ ID NO: 742211 - protein, 20 aa, Mycobacterium
VADSLGGPTAFVPVDTGHHA

SEQ ID NO: 742212 - protein, 22 aa, Mycobacterium
VADSTALRPGRLFRSSELSRLD

SEQ ID NO: 742213 - protein, 24 aa, Mycobacterium
VADTALRVLAPMGLVFDENSPWLD

SEQ ID NO: 742214 - protein, 17 aa, Mycobacterium
VADTALWVTVELTKNAA

SEQ ID NO: 742215 - protein, 23 aa, Mycobacterium
VADTRGGQLLVYGVDPLILRQAY

SEQ ID NO: 742216 - protein, 18 aa, Mycobacterium
VADTYFALMDRLGTDGLL

SEQ ID NO: 742217 - protein, 24 aa, Mycobacterium
VADVALRVLAPLGLIFDEDSAWLS

SEQ ID NO: 742218 - protein, 18 aa, Mycobacterium
VADVALYLLDDVLGLNAQ

SEQ ID NO: 742219 - protein, 22 aa, Mycobacterium
VADVGGAFARLVRGEGARQVVI

SEQ ID NO: 742220 - protein, 18 aa, Mycobacterium
VADVGYWAETLRPLPEPP

SEQ ID NO: 742221 - protein, 26 aa, Mycobacterium
VADVLRAWAAWCVDLPETINTSIAIQ

SEQ ID NO: 742222 - protein, 18 aa, Mycobacterium
VADVLVVGGQKWLRAGWG

SEQ ID NO: 742223 - protein, 18 aa, Mycobacterium
VADVRVCGAIGVIDMEHP

SEQ ID NO: 742224 - protein, 18 aa, Mycobacterium
VADVVAWLAGDGSGTLTG

SEQ ID NO: 742225 - protein, 18 aa, Mycobacterium
VADVVAWLAGDGSGTVTG

SEQ ID NO: 742226 - protein, 24 aa, Mycobacterium
VADYFYRVASWYIAGGFTDEHGQW

SEQ ID NO: 742227 - protein, 24 aa, Mycobacterium
VADYPARIVAVGVDRDCRATEIAA

SEQ ID NO: 742228 - protein, 26 aa, Mycobacterium
VADYRGARVAVEWPPELQQRVSEVAG

SEQ ID NO: 742229 - protein, 26 aa, Mycobacterium
VAEAAWERQGWRVLPDDPSGPLTLTK

SEQ ID NO: 742230 - protein, 22 aa, Mycobacterium
VAEAFGAEWLVIRALSDLAGED

SEQ ID NO: 742231 - protein, 19 aa, Mycobacterium
VAEAFPATPVPGVAAADVN

SEQ ID NO: 742232 - protein, 21 aa, Mycobacterium
VAEAGAFCVVMEMVPADLATQ

SEQ ID NO: 742233 - protein, 17 aa, Mycobacterium
VAEAGVRTLWLGQMYHY

SEQ ID NO: 742234 - protein, 17 aa, Mycobacterium
VAEAIAYILEILPALSY

SEQ ID NO: 742235 - protein, 32 aa, Mycobacterium
VAEALGEHVFDFFLRNKRAEWARYRSNVTPFE

SEQ ID NO: 742236 - protein, 25 aa, Mycobacterium
VAEALGEHVFDFFLRNKRREWENYR

SEQ ID NO: 742237 - protein, 27 aa, Mycobacterium
VAEAMAAGALRRFGADTAVAITGIAGP

SEQ ID NO: 742238 - protein, 23 aa, Mycobacterium
VAEARSGVDVVRLVAGDPLSIDS

SEQ ID NO: 742239 - protein, 17 aa, Mycobacterium
VAEASGLDLVPDPGGAA

SEQ ID NO: 742240 - protein, 27 aa, Mycobacterium
VAEASRLRSRFGFLAIHGGGLEEMTDV

SEQ ID NO: 742241 - protein, 30 aa, Mycobacterium
VAEATSLVNLCTWPAGTRLVLRKERPHPGA

SEQ ID NO: 742242 - protein, 23 aa, Mycobacterium
VAEAVLAVGGIRVGTEEPKYTHR

SEQ ID NO: 742243 - protein, 18 aa, Mycobacterium
VAEAVLFLAGDAASYVTG

SEQ ID NO: 742244 - protein, 24 aa, Mycobacterium
VAECGRAGVGKLVALSAINADDDL

SEQ ID NO: 742245 - protein, 25 aa, Mycobacterium
VAECKATGLLPFANFNRIHAVPPCS

SEQ ID NO: 742246 - protein, 28 aa, Mycobacterium
VAEDGARIPVSVVHRSGIEFPAPALVYG

SEQ ID NO: 742247 - protein, 27 aa, Mycobacterium
VAEDGARVPISIVHRAGVQFPAPAMLY

SEQ ID NO: 742248 - protein, 17 aa, Mycobacterium
VAEEALKLTAADAALVA

SEQ ID NO: 742249 - protein, 17 aa, Mycobacterium
VAEEALKLTSADAALVA

SEQ ID NO: 742250 - protein, 17 aa, Mycobacterium
VAEEARRGDGWIKLVGD

SEQ ID NO: 742251 - protein, 19 aa, Mycobacterium
VAEEFASWLADFLPRDYYQ

SEQ ID NO: 742252 - protein, 26 aa, Mycobacterium
VAEELGQPLPLFIKWDDAEYGLRANE

SEQ ID NO: 742253 - protein, 18 aa, Mycobacterium
VAEELPLLGSCTVQAAGH

SEQ ID NO: 742254 - protein, 23 aa, Mycobacterium
VAEELRRLGGVAVVLATAGNSAA

SEQ ID NO: 742255 - protein, 20 aa, Mycobacterium
VAEFAFGCGDKISLAAVGQK

SEQ ID NO: 742256 - protein, 22 aa, Mycobacterium
VAEFCRELADTAAIAVTPRTDT

SEQ ID NO: 742257 - protein, 17 aa, Mycobacterium
VAEFGEAGARVVSVLDY

SEQ ID NO: 742258 - protein, 18 aa, Mycobacterium
VAEFGRLDVIVANAGITV

SEQ ID NO: 742259 - protein, 19 aa, Mycobacterium
VAEFGRLDVLANIAGFHKM

SEQ ID NO: 742260 - protein, 18 aa, Mycobacterium
VAEFIIAFRHERPEDFGL

SEQ ID NO: 742261 - protein, 18 aa, Mycobacterium
VAEFLVRRDLAAIARVMA

SEQ ID NO: 742262 - protein, 23 aa, Mycobacterium
VAEFNGHVIVGVFNVDRAAAVAS

SEQ ID NO: 742263 - protein, 21 aa, Mycobacterium
VAEFPPERVADICGVDPDDVR

SEQ ID NO: 742264 - protein, 17 aa, Mycobacterium
VAEFSCPEARTIVMRIV

SEQ ID NO: 742265 - protein, 19 aa, Mycobacterium
VAEFVCGRDVLFNRRIAEG

SEQ ID NO: 742266 - protein, 17 aa, Mycobacterium
VAEGGAPAVIARHPAPE

SEQ ID NO: 742267 - protein, 21 aa, Mycobacterium
VAEGLDFPNGMAITPDGETLI

SEQ ID NO: 742268 - protein, 29 aa, Mycobacterium
VAEGLEAAKPFIAALCDAQAALAGAAGKE

SEQ ID NO: 742269 - protein, 19 aa, Mycobacterium
VAEGSGLPQEVVYLYNGPG

SEQ ID NO: 742270 - protein, 22 aa, Mycobacterium
VAEGTVTRWLKKVGDSVQVDEA

SEQ ID NO: 742271 - protein, 17 aa, Mycobacterium
VAEGVLVRSVRDCARFF

SEQ ID NO: 742272 - protein, 18 aa, Mycobacterium
VAEGWQPAWDYQREQTPE

SEQ ID NO: 742273 - protein, 18 aa, Mycobacterium
VAEGYILTCQGVPDTDSI

SEQ ID NO: 742274 - protein, 18 aa, Mycobacterium
VAEGYILTCQGVPDTESV

SEQ ID NO: 742275 - protein, 18 aa, Mycobacterium
VAEHRWLKDRSWSRPTWS

SEQ ID NO: 742276 - protein, 24 aa, Mycobacterium
VAEICAALDGLAARGGVDVPVHVD

SEQ ID NO: 742277 - protein, 21 aa, Mycobacterium
VAEIGCGGFGVVYRCAQPLLD

SEQ ID NO: 742278 - protein, 18 aa, Mycobacterium
VAEIRRTGVAFDRDQHTP

SEQ ID NO: 742279 - protein, 27 aa, Mycobacterium
VAEISARLDLPLGVARVLVGDLVLSGY

SEQ ID NO: 742280 - protein, 19 aa, Mycobacterium
VAELAAVAAEFGVPMHSDA

SEQ ID NO: 742281 - protein, 17 aa, Mycobacterium
VAELAGLLGAASPTAQR

SEQ ID NO: 742282 - protein, 21 aa, Mycobacterium
VAELALRIADRAILVGEEPEV

SEQ ID NO: 742283 - protein, 20 aa, Mycobacterium
VAELARLDLGSVLIPMPEAG

SEQ ID NO: 742284 - protein, 19 aa, Mycobacterium
VAELARMLAGLGESDSGRA

SEQ ID NO: 742285 - protein, 18 aa, Mycobacterium
VAELARRSGVRVVSDEIH

SEQ ID NO: 742286 - protein, 18 aa, Mycobacterium
VAELAVPVVQSMAQTTTR

SEQ ID NO: 742287 - protein, 19 aa, Mycobacterium
VAELCDRVVLVVAGQAVPI

SEQ ID NO: 742288 - protein, 22 aa, Mycobacterium
VAELGFPLSIHLEATYGVSAPA

SEQ ID NO: 742289 - protein, 23 aa, Mycobacterium
VAELGLPVVVRPSFTMGGLGSGM

SEQ ID NO: 742290 - protein, 24 aa, Mycobacterium
VAELGLPVVVRPSFTMGGLGSGMA

SEQ ID NO: 742291 - protein, 19 aa, Mycobacterium
VAELGRLDIILANAGIGNG

SEQ ID NO: 742292 - protein, 23 aa, Mycobacterium
VAELKAAGSGVDFVDHCAKELPI

SEQ ID NO: 742293 - protein, 19 aa, Mycobacterium
VAELKKFRDARDIADGEII

SEQ ID NO: 742294 - protein, 21 aa, Mycobacterium
VAELKRPVAGMRVGVLCEGFG

SEQ ID NO: 742295 - protein, 20 aa, Mycobacterium
VAELLAWAGVHSDYTSLSED

SEQ ID NO: 742296 - protein, 20 aa, Mycobacterium
VAELPLCVTVTLVDGLVLAR

SEQ ID NO: 742297 - protein, 21 aa, Mycobacterium
VAELQRPVLLFSAGKDSIVLL

SEQ ID NO: 742298 - protein, 18 aa, Mycobacterium
VAELRERLAHAALGGNEQ

SEQ ID NO: 742299 - protein, 23 aa, Mycobacterium
VAELRVRIYRGCEVTDITQDDNG

SEQ ID NO: 742300 - protein, 17 aa, Mycobacterium
VAELTWRQLGVRLRAVG

SEQ ID NO: 742301 - protein, 31 aa, Mycobacterium
VAELVERLAIRGSRLATVLSRCSYLCDGVAV

SEQ ID NO: 742302 - protein, 19 aa, Mycobacterium
VAELVGLPTRLHIGGHTSD

SEQ ID NO: 742303 - protein, 34 aa, Mycobacterium
VAELYDGFTFNCLSWLEALGFCGIGESKDFLDGG

SEQ ID NO: 742304 - protein, 34 aa, Mycobacterium
VAELYDGFTFNCLSWLEGLGFCGIGEAKDFLDGG

SEQ ID NO: 742305 - protein, 17 aa, Mycobacterium
VAEMPGLRVRFIDLDPR

SEQ ID NO: 742306 - protein, 24 aa, Mycobacterium
VAEMRARHAAVRFGDRSQATRVDE

SEQ ID NO: 742307 - protein, 18 aa, Mycobacterium
VAEMSYAQWLNRYVELSI

SEQ ID NO: 742308 - protein, 21 aa, Mycobacterium
VAEMTRLVLSHPITWYCSPPA

SEQ ID NO: 742309 - protein, 28 aa, Mycobacterium
VAEMTYLQWLRRYVELAIGDGNSTADTK

SEQ ID NO: 742310 - protein, 28 aa, Mycobacterium
VAEMTYLQWLRRYVELTIGEGNSTADTA

SEQ ID NO: 742311 - protein, 27 aa, Mycobacterium
VAENIANCWQLAAVMKQRVGRLPEEKT

SEQ ID NO: 742312 - protein, 23 aa, Mycobacterium
VAENLLRLFGMPADEAHRLCLRP

SEQ ID NO: 742313 - protein, 23 aa, Mycobacterium
VAEPGALIGFLGPRVYELLYDEP

SEQ ID NO: 742314 - protein, 29 aa, Mycobacterium
VAEPGDAELPSWIGGTWNRSAVLRYGENP

SEQ ID NO: 742315 - protein, 24 aa, Mycobacterium
VAEPGMVLTVRFDDAGDTETFLLG

SEQ ID NO: 742316 - protein, 23 aa, Mycobacterium
VAEPGMVLTVRWDGSDDTETFLL

SEQ ID NO: 742317 - protein, 22 aa, Mycobacterium
VAEPGWTMYMVSHFHYDPVWWN

SEQ ID NO: 742318 - protein, 19 aa, Mycobacterium
VAEPIEWHTLRLLADQSAV

SEQ ID NO: 742319 - protein, 19 aa, Mycobacterium
VAEPLWIPTPVDPRLRRAC

SEQ ID NO: 742320 - protein, 25 aa, Mycobacterium
VAEPPCAELAALVQRVGPVEAAERI

SEQ ID NO: 742321 - protein, 26 aa, Mycobacterium
VAEPPCAELAALVRRVGPLEAADRVR

SEQ ID NO: 742322 - protein, 22 aa, Mycobacterium
VAEPRAGYGAAVHAGVMAATTP

SEQ ID NO: 742323 - protein, 22 aa, Mycobacterium
VAEPSGAVSLAGYRKAALPDGS

SEQ ID NO: 742324 - protein, 21 aa, Mycobacterium
VAEQCRRLDVLGIDHEIVPGV

SEQ ID NO: 742325 - protein, 24 aa, Mycobacterium
VAEQPRLRWRLIDVGPDTELSQLI

SEQ ID NO: 742326 - protein, 22 aa, Mycobacterium
VAEQVAALAHELFNMAREGNAS

SEQ ID NO: 742327 - protein, 17 aa, Mycobacterium
VAERAAIMERFRDLVAK

SEQ ID NO: 742328 - protein, 20 aa, Mycobacterium
VAERALRIAAEYTTGREQFG

SEQ ID NO: 742329 - protein, 27 aa, Mycobacterium
VAERAYCVPKAVLLTAACRAAGIPARL

SEQ ID NO: 742330 - protein, 17 aa, Mycobacterium
VAERGWFALATVAGVRY

SEQ ID NO: 742331 - protein, 22 aa, Mycobacterium
VAERLLARNGWRNTSLAQIARE

SEQ ID NO: 742332 - protein, 22 aa, Mycobacterium
VAERLTKNLGHFSIKNTQTRGA

SEQ ID NO: 742333 - protein, 24 aa, Mycobacterium
VAERSLRGANLWNEVKDRLDKPGG

SEQ ID NO: 742334 - protein, 27 aa, Mycobacterium
VAERSRLNPAAGVMLRAVWAEPTGRLA

SEQ ID NO: 742335 - protein, 24 aa, Mycobacterium
VAERTGRRAIPVVADTGDDESVKA

SEQ ID NO: 742336 - protein, 26 aa, Mycobacterium
VAESGRLLAWRLNRVVDAASQLRDEL

SEQ ID NO: 742337 - protein, 25 aa, Mycobacterium
VAESKRFCWNCGKPVGRSTPDGRAL

SEQ ID NO: 742338 - protein, 25 aa, Mycobacterium
VAESKRFCWNCGRPVGRSTKDGRAL

SEQ ID NO: 742339 - protein, 23 aa, Mycobacterium
VAESLGLSALLGRKPKDLSGGQQ

SEQ ID NO: 742340 - protein, 24 aa, Mycobacterium
VAEVASCLPWYPGQATVEAASMSA

SEQ ID NO: 742341 - protein, 19 aa, Mycobacterium
VAEVERAWAALGLTVAGVD

SEQ ID NO: 742342 - protein, 22 aa, Mycobacterium
VAEVHIRLAASLVQVNTDVLDV

SEQ ID NO: 742343 - protein, 18 aa, Mycobacterium
VAEVPITFTERAIGESKM

SEQ ID NO: 742344 - protein, 23 aa, Mycobacterium
VAEVRGRVAPVFDLGVGMDPEIS

SEQ ID NO: 742345 - protein, 23 aa, Mycobacterium
VAEYLFRCERLGFGNASLQTSTL

SEQ ID NO: 742346 - protein, 20 aa, Mycobacterium
VAFADPYCPTLRAAATGLPG

SEQ ID NO: 742347 - protein, 18 aa, Mycobacterium
VAFADSWKQTLRASDYAA

SEQ ID NO: 742348 - protein, 19 aa, Mycobacterium
VAFAKEYGVPVAIKAAFGG

SEQ ID NO: 742349 - protein, 24 aa, Mycobacterium
VAFANWKALGARFIALRPATQLHW

SEQ ID NO: 742350 - protein, 19 aa, Mycobacterium
VAFAQEYGLPIAIKAAFGG

SEQ ID NO: 742351 - protein, 18 aa, Mycobacterium
VAFCMGKASSFVALSRAA

SEQ ID NO: 742352 - protein, 17 aa, Mycobacterium
VAFDVYRLVGGTERTRV

SEQ ID NO: 742353 - protein, 18 aa, Mycobacterium
VAFFERLDFCPSCKTSYE

SEQ ID NO: 742354 - protein, 18 aa, Mycobacterium
VAFGERKPTVAWAETYPG

SEQ ID NO: 742355 - protein, 20 aa, Mycobacterium
VAFGGAKLGRNGQDVDVSKS

SEQ ID NO: 742356 - protein, 17 aa, Mycobacterium
VAFGRAHNRLHFPRAMF

SEQ ID NO: 742357 - protein, 18 aa, Mycobacterium
VAFGRYPTFEGYQQQLGG

SEQ ID NO: 742358 - protein, 28 aa, Mycobacterium
VAFHWWLVLATLRWGVICRFQAERHLSG

SEQ ID NO: 742359 - protein, 17 aa, Mycobacterium
VAFIPNFNVQNAQVIYP

SEQ ID NO: 742360 - protein, 17 aa, Mycobacterium
VAFIPNFNVQSGQMIYP

SEQ ID NO: 742361 - protein, 22 aa, Mycobacterium
VAFKITRLTGRTKLVAAQGAFH

SEQ ID NO: 742362 - protein, 36 aa, Mycobacterium
VAFKLADMKARIDAARLLVWRAGWMARNNHNFDSAE

SEQ ID NO: 742363 - protein, 36 aa, Mycobacterium
VAFKLADMKARIDAARLLVYRAGWMARNGKAFESAE

SEQ ID NO: 742364 - protein, 24 aa, Mycobacterium
VAFLEAGAGWVPFFIDRLHEHYEK

SEQ ID NO: 742365 - protein, 27 aa, Mycobacterium
VAFLSKVHPCVDWVIVGGCIAGATVEV

SEQ ID NO: 742366 - protein, 19 aa, Mycobacterium
VAFPCIPNGGDVFGCQPRT

SEQ ID NO: 742367 - protein, 22 aa, Mycobacterium
VAFPGIFGALAARLPVQDLLGF

SEQ ID NO: 742368 - protein, 20 aa, Mycobacterium
VAFPGVFGVVADRLPLQDLL

SEQ ID NO: 742369 - protein, 18 aa, Mycobacterium
VAFPRINDAIAYCDRYPL

SEQ ID NO: 742370 - protein, 28 aa, Mycobacterium
VAFQEPRLFPWRSVRDNVLYGLTRTKLS

SEQ ID NO: 742371 - protein, 17 aa, Mycobacterium
VAFQLATAATWPDPWPM

SEQ ID NO: 742372 - protein, 25 aa, Mycobacterium
VAFRRGWECQDILVAVTRWTVRLEE

SEQ ID NO: 742373 - protein, 44 aa, Mycobacterium
VAFTAAKPSLAWAETYPGTLSYYLASAFGEVWMQPAGSVGLIGF

SEQ ID NO: 742374 - protein, 44 aa, Mycobacterium
VAFTAKKPSLAWAETYPGTLSYYLASAFGEVWMQPSGTLGLVGF

SEQ ID NO: 742375 - protein, 19 aa, Mycobacterium
VAFVLHDVFAVPFEEIAGL

SEQ ID NO: 742376 - protein, 25 aa, Mycobacterium
VAFVQRPARWIRLLATNRGVFTAAP

SEQ ID NO: 742377 - protein, 20 aa, Mycobacterium
VAGAAEFAFSVADLDGATRL

SEQ ID NO: 742378 - protein, 19 aa, Mycobacterium
VAGAAWYAVVVRKVTDLDA

SEQ ID NO: 742379 - protein, 24 aa, Mycobacterium
VAGADMAAALGMLEARHIVGDQQL

SEQ ID NO: 742380 - protein, 26 aa, Mycobacterium
VAGAFTLDGLGGWFIDRIEGDPSNVI

SEQ ID NO: 742381 - protein, 25 aa, Mycobacterium
VAGAGGRGGLIGAAGGTGSIGAGGA

SEQ ID NO: 742382 - protein, 17 aa, Mycobacterium
VAGAGTGVWETVLDSEF

SEQ ID NO: 742383 - protein, 32 aa, Mycobacterium
VAGAGVACGYWGRSGLTASRFVACPFGDAQAP

SEQ ID NO: 742384 - protein, 21 aa, Mycobacterium
VAGALRPGDQLVLGASNPVRD

SEQ ID NO: 742385 - protein, 18 aa, Mycobacterium
VAGAPALVTVNGRPVPQW

SEQ ID NO: 742386 - protein, 23 aa, Mycobacterium
VAGAPTMFCCYAVDDLDAARRAI

SEQ ID NO: 742387 - protein, 19 aa, Mycobacterium
VAGAVAFLVSDAASWITGE

SEQ ID NO: 742388 - protein, 17 aa, Mycobacterium
VAGAVFVAVLGRMSEPT

SEQ ID NO: 742389 - protein, 26 aa, Mycobacterium
VAGAVSEWLARPGARLEAVRNTVADV

SEQ ID NO: 742390 - protein, 23 aa, Mycobacterium
VAGAVWRPRFVEPVVKTRKWAEQ

SEQ ID NO: 742391 - protein, 25 aa, Mycobacterium
VAGAWTFGSSTAWNPLPRGWYPGPQ

SEQ ID NO: 742392 - protein, 17 aa, Mycobacterium
VAGCAAMDGTVLVNLIN

SEQ ID NO: 742393 - protein, 24 aa, Mycobacterium
VAGCGACAGCATRDPAMCVSGPQI

SEQ ID NO: 742394 - protein, 25 aa, Mycobacterium
VAGCGACAGCATRDPVMCHSGFQIF

SEQ ID NO: 742395 - protein, 21 aa, Mycobacterium
VAGDESCARALSTARLLVSGS

SEQ ID NO: 742396 - protein, 27 aa, Mycobacterium
VAGDFPSRWVYRTSPDFYEVKNFLVTQ

SEQ ID NO: 742397 - protein, 23 aa, Mycobacterium
VAGDGRAAIGFGAGRDYDFDVFL

SEQ ID NO: 742398 - protein, 23 aa, Mycobacterium
VAGEESYVLLVRVVSARALEDLL

SEQ ID NO: 742399 - protein, 20 aa, Mycobacterium
VAGEFYLNAINVMRGAEAIS

SEQ ID NO: 742400 - protein, 24 aa, Mycobacterium
VAGEGRPHLRLENRVLPAGPTVLD

SEQ ID NO: 742401 - protein, 30 aa, Mycobacterium
VAGELGIDEWRAEVLPEDKLQAVRQLQDEG

SEQ ID NO: 742402 - protein, 18 aa, Mycobacterium
VAGELGLPAPEGTDKLGA

SEQ ID NO: 742403 - protein, 17 aa, Mycobacterium
VAGEPITTWAPRSTGAI

SEQ ID NO: 742404 - protein, 31 aa, Mycobacterium
VAGERPAVIPLSFAQNRLWFIQQLQGPSPVY

SEQ ID NO: 742405 - protein, 31 aa, Mycobacterium
VAGERPAVVPLSFAQQRLWFIDQLQGPSAVY

SEQ ID NO: 742406 - protein, 17 aa, Mycobacterium
VAGFDRLEITTCLRRGE

SEQ ID NO: 742407 - protein, 21 aa, Mycobacterium
VAGFGELQTGYDVTKFYKDQS

SEQ ID NO: 742408 - protein, 19 aa, Mycobacterium
VAGGARIALSRGLDPDRFV

SEQ ID NO: 742409 - protein, 24 aa, Mycobacterium
VAGGARLDGAVIFDGVKIGAGAVI

SEQ ID NO: 742410 - protein, 25 aa, Mycobacterium
VAGGDGRPGGILMGKGGDGAPGGPG

SEQ ID NO: 742411 - protein, 17 aa, Mycobacterium
VAGGEPLLGTWQSVVLI

SEQ ID NO: 742412 - protein, 19 aa, Mycobacterium
VAGGFAHRTLFDGVDLTVA

SEQ ID NO: 742413 - protein, 25 aa, Mycobacterium
VAGGFTLDGLGGWFVDRIDGDPSNV

SEQ ID NO: 742414 - protein, 18 aa, Mycobacterium
VAGGGLWVSRGIYRLPGR

SEQ ID NO: 742415 - protein, 24 aa, Mycobacterium
VAGGIRPGLLSDFTALPPEINSGR

SEQ ID NO: 742416 - protein, 22 aa, Mycobacterium
VAGGLPLAVGIALADAMLQQKR

SEQ ID NO: 742417 - protein, 18 aa, Mycobacterium
VAGGLPTTVKAGLELLGF

SEQ ID NO: 742418 - protein, 19 aa, Mycobacterium
VAGGLPTTVKAGLELQGRP

SEQ ID NO: 742419 - protein, 31 aa, Mycobacterium
VAGHLRAAIMSGTLRPGTFIRLDETAAELGV

SEQ ID NO: 742420 - protein, 23 aa, Mycobacterium
VAGHRAAMWGATWQTPALVAEYG

SEQ ID NO: 742421 - protein, 24 aa, Mycobacterium
VAGHSMGGITIAAWSERYRHKVPR

SEQ ID NO: 742422 - protein, 29 aa, Mycobacterium
VAGHWLLARLGKRVLRPGGVELTRTLLAR

SEQ ID NO: 742423 - protein, 35 aa, Mycobacterium
VAGIGRKLIEVPVGFKWFVDGLIEGGIGFGGEESA

SEQ ID NO: 742424 - protein, 31 aa, Mycobacterium
VAGIGRKLVEVPVGFKWFVDGLIGGTIGFGG

SEQ ID NO: 742425 - protein, 24 aa, Mycobacterium
VAGIPFPPAFTLEGLQAAAAATRR

SEQ ID NO: 742426 - protein, 24 aa, Mycobacterium
VAGKGGGFAGPRYGFKPTVMPKQV

SEQ ID NO: 742427 - protein, 21 aa, Mycobacterium
VAGKPGRALIEDALARGSFAR

SEQ ID NO: 742428 - protein, 21 aa, Mycobacterium
VAGKTVWGVGIAPSITTASLR

SEQ ID NO: 742429 - protein, 22 aa, Mycobacterium
VAGLAVRPGYVLSDGFRVPGLP

SEQ ID NO: 742430 - protein, 25 aa, Mycobacterium
VAGLGKRYLIVLPFLTPAIASLWVG

SEQ ID NO: 742431 - protein, 26 aa, Mycobacterium
VAGLGQRLPIVETRFGTFETASRVAA

SEQ ID NO: 742432 - protein, 31 aa, Mycobacterium
VAGLGRRLVEVPVGFKWFVDGLINGTIGFGG

SEQ ID NO: 742433 - protein, 28 aa, Mycobacterium
VAGLHAAAGCWRGLAAALGGAEQGLNVP

SEQ ID NO: 742434 - protein, 31 aa, Mycobacterium
VAGLIASPMRWKGPSGHSCWFANAPDVGATR

SEQ ID NO: 742435 - protein, 18 aa, Mycobacterium
VAGLKRRDETGLSVRSAD

SEQ ID NO: 742436 - protein, 19 aa, Mycobacterium
VAGLLRYRHVPGAVELAER

SEQ ID NO: 742437 - protein, 23 aa, Mycobacterium
VAGLPGVFVIDMDRILREPTAKT

SEQ ID NO: 742438 - protein, 17 aa, Mycobacterium
VAGLRLGTVSVPLQTGA

SEQ ID NO: 742439 - protein, 23 aa, Mycobacterium
VAGLRLRLPIIGTTLGTYDAASA

SEQ ID NO: 742440 - protein, 24 aa, Mycobacterium
VAGLRRCRAQHRVHTPKPVWNPDL

SEQ ID NO: 742441 - protein, 23 aa, Mycobacterium
VAGLRRRVMVVLPFLTPTIASWW

SEQ ID NO: 742442 - protein, 19 aa, Mycobacterium
VAGLRVAYSPNLGYVHNDP

SEQ ID NO: 742443 - protein, 24 aa, Mycobacterium
VAGLRVRESFDLFEDLLGGVVVES

SEQ ID NO: 742444 - protein, 18 aa, Mycobacterium
VAGLRWLQEQGYTSDQIV

SEQ ID NO: 742445 - protein, 18 aa, Mycobacterium
VAGLRYAKANGHRVSIVS

SEQ ID NO: 742446 - protein, 24 aa, Mycobacterium
VAGLSELLPWVDLWHGEPDALYGG

SEQ ID NO: 742447 - protein, 24 aa, Mycobacterium
VAGLSSPRIVGWIMRTDSADLPWH

SEQ ID NO: 742448 - protein, 25 aa, Mycobacterium
VAGLSVRPGYVLSDGFRVPGLAVPS

SEQ ID NO: 742449 - protein, 18 aa, Mycobacterium
VAGLTWLPFMDQRYTAVS

SEQ ID NO: 742450 - protein, 18 aa, Mycobacterium
VAGMFTEMPLAEALARWA

SEQ ID NO: 742451 - protein, 25 aa, Mycobacterium
VAGMLADAAARCVIIDAETREILPS

SEQ ID NO: 742452 - protein, 21 aa, Mycobacterium
VAGMRCGHCESAIRSEVAQIP

SEQ ID NO: 742453 - protein, 25 aa, Mycobacterium
VAGNELPLVAGMAFSVEPGIYFPGR

SEQ ID NO: 742454 - protein, 25 aa, Mycobacterium
VAGNGGKGGDGYTPTTPGADGGNGG

SEQ ID NO: 742455 - protein, 19 aa, Mycobacterium
VAGPAWRDFGSVLVASDAE

SEQ ID NO: 742456 - protein, 25 aa, Mycobacterium
VAGPAYNTGSAWGYTPKGATGVPTR

SEQ ID NO: 742457 - protein, 18 aa, Mycobacterium
VAGPRLGKDVQVAIKAVK

SEQ ID NO: 742458 - protein, 32 aa, Mycobacterium
VAGPRPAVVPLSFAQSRLWFLDQLQGPSPVYN

SEQ ID NO: 742459 - protein, 32 aa, Mycobacterium
VAGPRPPRVPLSFAQSRLWFLEQLQGPSAVYN

SEQ ID NO: 742460 - protein, 19 aa, Mycobacterium
VAGPSRWVATDHYLDLVVR

SEQ ID NO: 742461 - protein, 18 aa, Mycobacterium
VAGPVPLWTWSLLHRRDD

SEQ ID NO: 742462 - protein, 22 aa, Mycobacterium
VAGPWRLDALPLVISASDWDHL

SEQ ID NO: 742463 - protein, 24 aa, Mycobacterium
VAGQRFIVDITMWIDLVDAARSDD

SEQ ID NO: 742464 - protein, 27 aa, Mycobacterium
VAGRAARMGHRLTIAMTRWQATVNWVA

SEQ ID NO: 742465 - protein, 23 aa, Mycobacterium
VAGRAGLFLGRPVMARMFQKFLH

SEQ ID NO: 742466 - protein, 20 aa, Mycobacterium
VAGRCADLAALLRVMEQTGG

SEQ ID NO: 742467 - protein, 25 aa, Mycobacterium
VAGRGEAFLPIASRCRAQRKTTDGM

SEQ ID NO: 742468 - protein, 18 aa, Mycobacterium
VAGRGVATGYARRSGLTA

SEQ ID NO: 742469 - protein, 18 aa, Mycobacterium
VAGRLSGVGADWAYASGW

SEQ ID NO: 742470 - protein, 17 aa, Mycobacterium
VAGRPLRDVLGAYLDTL

SEQ ID NO: 742471 - protein, 24 aa, Mycobacterium
VAGRRMAETVARRGGITVLPQDLP

SEQ ID NO: 742472 - protein, 18 aa, Mycobacterium
VAGRRMAETVARRGGIVI

SEQ ID NO: 742473 - protein, 24 aa, Mycobacterium
VAGRRMAETVARRGGIVVLPQDLP

SEQ ID NO: 742474 - protein, 20 aa, Mycobacterium
VAGRRMAETVARRGGLVVLP

SEQ ID NO: 742475 - protein, 25 aa, Mycobacterium
VAGRSHAWIQAWTGAWWNYDPTHDT

SEQ ID NO: 742476 - protein, 25 aa, Mycobacterium
VAGRSHAWIQAWTGGWWHYDPTNDT

SEQ ID NO: 742477 - protein, 23 aa, Mycobacterium
VAGSRKFLIWAVHDAVERGELTA

SEQ ID NO: 742478 - protein, 24 aa, Mycobacterium
VAGSSRLGWRLEVNDGGQWAFFDD

SEQ ID NO: 742479 - protein, 22 aa, Mycobacterium
VAGTRYGFGFFVMDTGELAGTC

SEQ ID NO: 742480 - protein, 24 aa, Mycobacterium
VAGTVRFDWDVLRWFEEDEQIHGH

SEQ ID NO: 742481 - protein, 17 aa, Mycobacterium
VAGVALFPGAGFAELAV

SEQ ID NO: 742482 - protein, 30 aa, Mycobacterium
VAGVAVGLARRWPLGRAVRFGIAAASAKLQ

SEQ ID NO: 742483 - protein, 18 aa, Mycobacterium
VAGVERFDIIKDFGAIMP

SEQ ID NO: 742484 - protein, 23 aa, Mycobacterium
VAGVLGLLWSAPRRFDAAELDTF

SEQ ID NO: 742485 - protein, 27 aa, Mycobacterium
VAGVPAARFYIDYSDFSVWILDVERVR

SEQ ID NO: 742486 - protein, 18 aa, Mycobacterium
VAGVPGKVRRQLGEDELA

SEQ ID NO: 742487 - protein, 25 aa, Mycobacterium
VAGVQLELPSRVRGISPRSPLPGAD

SEQ ID NO: 742488 - protein, 17 aa, Mycobacterium
VAGVRGREDAFYDFATK

SEQ ID NO: 742489 - protein, 18 aa, Mycobacterium
VAGVRGREDGFYDFATKY

SEQ ID NO: 742490 - protein, 18 aa, Mycobacterium
VAGVRGREDGFYDFETKY

SEQ ID NO: 742491 - protein, 18 aa, Mycobacterium
VAGVVGFLVSDAAASVVG

SEQ ID NO: 742492 - protein, 23 aa, Mycobacterium
VAGWEAHSGMLNRPSGAWRTILD

SEQ ID NO: 742493 - protein, 18 aa, Mycobacterium
VAGWGNKRVEAEAKRIAA

SEQ ID NO: 742494 - protein, 17 aa, Mycobacterium
VAGWIDLALGRPLVDPQ

SEQ ID NO: 742495 - protein, 23 aa, Mycobacterium
VAGWLAGTGLHAWVVQRELADPI

SEQ ID NO: 742496 - protein, 23 aa, Mycobacterium
VAGWMWRPLIEQMGSGYRFLVPD

SEQ ID NO: 742497 - protein, 18 aa, Mycobacterium
VAGYWIDRIDEMLSACLR

SEQ ID NO: 742498 - protein, 18 aa, Mycobacterium
VAHAAAPLPGPRSEARNR

SEQ ID NO: 742499 - protein, 26 aa, Mycobacterium
VAHAPTLMTAMSWLALGRDLEGLPEP

SEQ ID NO: 742500 - protein, 25 aa, Mycobacterium
VAHDFGGPWALAWAAEHLGAVASIT

SEQ ID NO: 742501 - protein, 23 aa, Mycobacterium
VAHDWGGPVAFIMMLRHPEKVTG

SEQ ID NO: 742502 - protein, 25 aa, Mycobacterium
VAHELGRALAPVPFVSSTVLATGLL

SEQ ID NO: 742503 - protein, 19 aa, Mycobacterium
VAHEPRIALVSTMTGQLAA

SEQ ID NO: 742504 - protein, 26 aa, Mycobacterium
VAHGFVAGMAVDWRGAIGTANLVELP

SEQ ID NO: 742505 - protein, 28 aa, Mycobacterium
VAHHIGRAGNMFSVFFGTEPVRDFQSAK

SEQ ID NO: 742506 - protein, 25 aa, Mycobacterium
VAHIFAQAGLRVWDVEELPTHGGSL

SEQ ID NO: 742507 - protein, 17 aa, Mycobacterium
VAHLCVIHGVHVGQEAL

SEQ ID NO: 742508 - protein, 25 aa, Mycobacterium
VAHLSEGVPRYWFKDNDTLEQFIAD

SEQ ID NO: 742509 - protein, 20 aa, Mycobacterium
VAHPAVALAQFFDVPLVSTI

SEQ ID NO: 742510 - protein, 17 aa, Mycobacterium
VAHPDHYRVMFGAELSK

SEQ ID NO: 742511 - protein, 19 aa, Mycobacterium
VAHPIPRKITFTGSIAGGK

SEQ ID NO: 742512 - protein, 18 aa, Mycobacterium
VAHPLRGRTGRVIGVLIL

SEQ ID NO: 742513 - protein, 27 aa, Mycobacterium
VAHPRNLPPLPGRCGPASRLHRRQTHG

SEQ ID NO: 742514 - protein, 21 aa, Mycobacterium
VAHPRSWKLLRGKIALPSRDR

SEQ ID NO: 742515 - protein, 20 aa, Mycobacterium
VAHPTIRWVGSANELNAGYA

SEQ ID NO: 742516 - protein, 26 aa, Mycobacterium
VAHRISLRPEMWVRRITGAHVVDELL

SEQ ID NO: 742517 - protein, 26 aa, Mycobacterium
VAHRRGEFRPRPSFLSPGKKILHDDR

SEQ ID NO: 742518 - protein, 18 aa, Mycobacterium
VAHSIRFGVLSRFTAFVA

SEQ ID NO: 742519 - protein, 40 aa, Mycobacterium
VAHSPWLDITWRDRFEQMLKRAEARLHPKDFGPVETLFAD

SEQ ID NO: 742520 - protein, 25 aa, Mycobacterium
VAHSVCPFCAVGCAQKVYVKDGKVV

SEQ ID NO: 742521 - protein, 17 aa, Mycobacterium
VAHSVRTSARYGVDAHI

SEQ ID NO: 742522 - protein, 17 aa, Mycobacterium
VAHVPMDGFHLADAQLR

SEQ ID NO: 742523 - protein, 27 aa, Mycobacterium
VAHYGDGWCPFPAPARLARTAGTAAID

SEQ ID NO: 742524 - protein, 18 aa, Mycobacterium
VAHYWRTRYDWRKFEARL

SEQ ID NO: 742525 - protein, 17 aa, Mycobacterium
VAIAAGIGRPARQRTTT

SEQ ID NO: 742526 - protein, 25 aa, Mycobacterium
VAIACALGGPGRRTLFLLSSTDAYP

SEQ ID NO: 742527 - protein, 26 aa, Mycobacterium
VAIAEALRLDAPVMHMARTVVTGHEK

SEQ ID NO: 742528 - protein, 20 aa, Mycobacterium
VAIAEAVSMLGVPLDAITVL

SEQ ID NO: 742529 - protein, 20 aa, Mycobacterium
VAIAGIDWGVLRTPLPSTAK

SEQ ID NO: 742530 - protein, 24 aa, Mycobacterium
VAIARAAGIILTWNDIADLSAVVP

SEQ ID NO: 742531 - protein, 31 aa, Mycobacterium
VAICGDGSFNFGVPTAALWSAHRHDAPFVTV

SEQ ID NO: 742532 - protein, 24 aa, Mycobacterium
VAIDAGEKVGMVFGELVHGEVDVR

SEQ ID NO: 742533 - protein, 28 aa, Mycobacterium
VAIDATMGLPLALGVEALGGPVDAIDAF

SEQ ID NO: 742534 - protein, 20 aa, Mycobacterium
VAIDLLLKREAELAGTTEAE

SEQ ID NO: 742535 - protein, 26 aa, Mycobacterium
VAIDLREDWPAALQAAGFDPEQPTVW

SEQ ID NO: 742536 - protein, 26 aa, Mycobacterium
VAIDLREDWPAALRAAGFDPTKPTAW

SEQ ID NO: 742537 - protein, 28 aa, Mycobacterium
VAIDLREDWPAALRAAGFDPTRPTAWLA

SEQ ID NO: 742538 - protein, 26 aa, Mycobacterium
VAIDLREDWPAALRAAGFDSAQPTAW

SEQ ID NO: 742539 - protein, 31 aa, Mycobacterium
VAIDLRRDWPAALCATGFDTTVPTAWLAEGL

SEQ ID NO: 742540 - protein, 23 aa, Mycobacterium
VAIDSGEAWVVLRADQLEIEPVK

SEQ ID NO: 742541 - protein, 22 aa, Mycobacterium
VAIDSGEEWVVLDADQLEIEPV

SEQ ID NO: 742542 - protein, 24 aa, Mycobacterium
VAIDSGEEWVVLRAEQLEIEPVRS

SEQ ID NO: 742543 - protein, 25 aa, Mycobacterium
VAIEAGVAQSWYKLVGDTGEIISIE

SEQ ID NO: 742544 - protein, 24 aa, Mycobacterium
VAIEARPAFAVPFKAFAPVLKAAF

SEQ ID NO: 742545 - protein, 18 aa, Mycobacterium
VAIEDVRHILPFVLVNRL

SEQ ID NO: 742546 - protein, 23 aa, Mycobacterium
VAIEGDSAFGFSAMELETICRYR

SEQ ID NO: 742547 - protein, 23 aa, Mycobacterium
VAIEGDSAFGFSGMELEAICRYN

SEQ ID NO: 742548 - protein, 23 aa, Mycobacterium
VAIEGDSAFGFSGMEVETICRYQ

SEQ ID NO: 742549 - protein, 19 aa, Mycobacterium
VAIELLRAVGPMAVSSANV

SEQ ID NO: 742550 - protein, 32 aa, Mycobacterium
VAIERPAVIPLSFAQSRLWFLDQLQGPSAVYN

SEQ ID NO: 742551 - protein, 22 aa, Mycobacterium
VAIESGEEWVLIDAAQLEIEPV

SEQ ID NO: 742552 - protein, 27 aa, Mycobacterium
VAIFRARPSPFYVMDEVEAALDDVNLQ

SEQ ID NO: 742553 - protein, 18 aa, Mycobacterium
VAIGELFVLRCRESGERA

SEQ ID NO: 742554 - protein, 30 aa, Mycobacterium
VAIGMTIPYAALEIMKLRLTPSAYQQAAGL

SEQ ID NO: 742555 - protein, 18 aa, Mycobacterium
VAIGRDFDSLGALRKGAS

SEQ ID NO: 742556 - protein, 19 aa, Mycobacterium
VAIGYTFITREYWGGTVNA

SEQ ID NO: 742557 - protein, 17 aa, Mycobacterium
VAILSATRYEWVILDYA

SEQ ID NO: 742558 - protein, 18 aa, Mycobacterium
VAILSATRYEWVILDYAI

SEQ ID NO: 742559 - protein, 18 aa, Mycobacterium
VAIPADLSQSGERERLFA

SEQ ID NO: 742560 - protein, 19 aa, Mycobacterium
VAIPEAFKKSVKAITEAGW

SEQ ID NO: 742561 - protein, 19 aa, Mycobacterium
VAIPHGMVGLVHPRSGLAA

SEQ ID NO: 742562 - protein, 18 aa, Mycobacterium
VAIPSLFGAPGKAVSAGY

SEQ ID NO: 742563 - protein, 26 aa, Mycobacterium
VAIPSPLEWGCFTFGVIQNDDHFSFF

SEQ ID NO: 742564 - protein, 19 aa, Mycobacterium
VAIRAELRRAAYRLFIEHG

SEQ ID NO: 742565 - protein, 18 aa, Mycobacterium
VAIRALVPRRGVNEIMDE

SEQ ID NO: 742566 - protein, 21 aa, Mycobacterium
VAIRRHGRFLSMDEIAAEIGV

SEQ ID NO: 742567 - protein, 25 aa, Mycobacterium
VAIRRLERDLGIVIVQRGHRFEGFT

SEQ ID NO: 742568 - protein, 19 aa, Mycobacterium
VAIVAKFRFAQRAGESRAY

SEQ ID NO: 742569 - protein, 18 aa, Mycobacterium
VAIVEFVVSPVFGSPPES

SEQ ID NO: 742570 - protein, 23 aa, Mycobacterium
VAIWHRCAGEVLTFSFDGGETTE

SEQ ID NO: 742571 - protein, 20 aa, Mycobacterium
VAKFAFGCGDKISLEAVGQR

SEQ ID NO: 742572 - protein, 30 aa, Mycobacterium
VAKFKWPERLEIRAELPLTNIHKVNKAILR

SEQ ID NO: 742573 - protein, 17 aa, Mycobacterium
VAKGSNLEFALGYSHPV

SEQ ID NO: 742574 - protein, 23 aa, Mycobacterium
VAKHYGVSVAICPPRRGNRKAWW

SEQ ID NO: 742575 - protein, 20 aa, Mycobacterium
VAKLKELIADSGLTVSQLVS

SEQ ID NO: 742576 - protein, 19 aa, Mycobacterium
VAKLPGVRIIVAGGPSGSG

SEQ ID NO: 742577 - protein, 19 aa, Mycobacterium
VAKLPTQLIDPSWNPLVSD

SEQ ID NO: 742578 - protein, 17 aa, Mycobacterium
VAKLRAAGITVAAKTLK

SEQ ID NO: 742579 - protein, 20 aa, Mycobacterium
VAKLREAGILFAVTSGRPPR

SEQ ID NO: 742580 - protein, 22 aa, Mycobacterium
VAKNRVVIIPGLQYKALTTGGR

SEQ ID NO: 742581 - protein, 22 aa, Mycobacterium
VAKPSTGMLFFLASSRILNWGK

SEQ ID NO: 742582 - protein, 17 aa, Mycobacterium
VAKRESLGFRAALRDLI

SEQ ID NO: 742583 - protein, 18 aa, Mycobacterium
VAKRFGVYERVRFNTNVE

SEQ ID NO: 742584 - protein, 24 aa, Mycobacterium
VAKRFPARATACWSGNVACAPSPL

SEQ ID NO: 742585 - protein, 17 aa, Mycobacterium
VAKRGAAIIDARGASSA

SEQ ID NO: 742586 - protein, 17 aa, Mycobacterium
VAKRGAAVIEARGASSA

SEQ ID NO: 742587 - protein, 19 aa, Mycobacterium
VAKRLDLIDPDAWAFTWVV

SEQ ID NO: 742588 - protein, 17 aa, Mycobacterium
VAKSAGLVPTAFYRHFE

SEQ ID NO: 742589 - protein, 20 aa, Mycobacterium
VAKVLGSPVLAVFPAGGSHG

SEQ ID NO: 742590 - protein, 26 aa, Mycobacterium
VAKVRSCSVSDITVCILDRPRHGELI

SEQ ID NO: 742591 - protein, 22 aa, Mycobacterium
VALAEAQRSAGWYISALEQDLE

SEQ ID NO: 742592 - protein, 18 aa, Mycobacterium
VALAEARQPAFQQYAQQV

SEQ ID NO: 742593 - protein, 24 aa, Mycobacterium
VALAEELVALLAVDAKARVFFCNS

SEQ ID NO: 742594 - protein, 18 aa, Mycobacterium
VALAEGKNALARALLSTG

SEQ ID NO: 742595 - protein, 20 aa, Mycobacterium
VALAELFKRIRGYDVDESAS

SEQ ID NO: 742596 - protein, 21 aa, Mycobacterium
VALAELFKRIRGYEVDEDNAV

SEQ ID NO: 742597 - protein, 17 aa, Mycobacterium
VALAGGVQLMLSPFTSI

SEQ ID NO: 742598 - protein, 18 aa, Mycobacterium
VALAHEYPAARIVAIDVS

SEQ ID NO: 742599 - protein, 19 aa, Mycobacterium
VALALGSGGARGYAHIGVI

SEQ ID NO: 742600 - protein, 18 aa, Mycobacterium
VALANAPLRMVSERGINA

SEQ ID NO: 742601 - protein, 24 aa, Mycobacterium
VALARRIGADLVVIGPEVPLVLGV

SEQ ID NO: 742602 - protein, 24 aa, Mycobacterium
VALASSTRYEWVLVDFAVMCAGAA

SEQ ID NO: 742603 - protein, 19 aa, Mycobacterium
VALATRLAQRMGRLSPADG

SEQ ID NO: 742604 - protein, 21 aa, Mycobacterium
VALAYSGGVLFVAENPSRSLQ

SEQ ID NO: 742605 - protein, 17 aa, Mycobacterium
VALCAAGDSVIERLVEL

SEQ ID NO: 742606 - protein, 19 aa, Mycobacterium
VALCAEYDALPGLGHACGH

SEQ ID NO: 742607 - protein, 17 aa, Mycobacterium
VALCGEVFPVTKSPKPG

SEQ ID NO: 742608 - protein, 18 aa, Mycobacterium
VALCRRIDERDLPAAYER

SEQ ID NO: 742609 - protein, 18 aa, Mycobacterium
VALCRRIDERELPDAYER

SEQ ID NO: 742610 - protein, 18 aa, Mycobacterium
VALCRTVAEYGGYFCPHH

SEQ ID NO: 742611 - protein, 17 aa, Mycobacterium
VALDFPELVIVCGHVGY

SEQ ID NO: 742612 - protein, 17 aa, Mycobacterium
VALDFPVSRRVHPDSRT

SEQ ID NO: 742613 - protein, 17 aa, Mycobacterium
VALDFPVSRRVTPESKT

SEQ ID NO: 742614 - protein, 18 aa, Mycobacterium
VALDIPVDLPRTGIDPDD

SEQ ID NO: 742615 - protein, 25 aa, Mycobacterium
VALDMFAQSFLKRVGCRPYEQVMLF

SEQ ID NO: 742616 - protein, 24 aa, Mycobacterium
VALDRLGFDEAWFGEHHSGGYELI

SEQ ID NO: 742617 - protein, 25 aa, Mycobacterium
VALDRLGFDEAWFGEHHSGGYELIA

SEQ ID NO: 742618 - protein, 25 aa, Mycobacterium
VALDRLGYHEAWFGEHHSGGYELIS

SEQ ID NO: 742619 - protein, 20 aa, Mycobacterium
VALEAALRCSPGHRMAGMLD

SEQ ID NO: 742620 - protein, 18 aa, Mycobacterium
VALEAIVRAAGVTRGALY

SEQ ID NO: 742621 - protein, 17 aa, Mycobacterium
VALEALGFPGERNDVAA

SEQ ID NO: 742622 - protein, 20 aa, Mycobacterium
VALEAVRRAAGLATLEDVLR

SEQ ID NO: 742623 - protein, 24 aa, Mycobacterium
VALEEFHALAGFRPVARTVELMRT

SEQ ID NO: 742624 - protein, 27 aa, Mycobacterium
VALEEVLKRWPDWEVDYANAQRAHTAS

SEQ ID NO: 742625 - protein, 19 aa, Mycobacterium
VALEVMRYACGDRAEEVLL

SEQ ID NO: 742626 - protein, 19 aa, Mycobacterium
VALGENYWAAPGLVTSLRK

SEQ ID NO: 742627 - protein, 18 aa, Mycobacterium
VALGEWFFAFPMGSHTDE

SEQ ID NO: 742628 - protein, 24 aa, Mycobacterium
VALGGCLTAGIASIAQQRNIQLHS

SEQ ID NO: 742629 - protein, 21 aa, Mycobacterium
VALGLRPPPPQRYPLSEAQAA

SEQ ID NO: 742630 - protein, 25 aa, Mycobacterium
VALGRSCNGRREWIGADGSTFGQWE

SEQ ID NO: 742631 - protein, 18 aa, Mycobacterium
VALGVPFDLASDVASCLY

SEQ ID NO: 742632 - protein, 19 aa, Mycobacterium
VALGYDFLPGTTVNRYCSS

SEQ ID NO: 742633 - protein, 21 aa, Mycobacterium
VALHADFPPERITLHGNNKSV

SEQ ID NO: 742634 - protein, 21 aa, Mycobacterium
VALHANFPPERITFHGNNKSV

SEQ ID NO: 742635 - protein, 23 aa, Mycobacterium
VALHANFPPERITLHGNNKSVAE

SEQ ID NO: 742636 - protein, 18 aa, Mycobacterium
VALHCGAKALVKRITGGA

SEQ ID NO: 742637 - protein, 20 aa, Mycobacterium
VALHHKDGWTVGAMGKGAGM

SEQ ID NO: 742638 - protein, 23 aa, Mycobacterium
VALHKLPVTMVLDRAGITGSDGA

SEQ ID NO: 742639 - protein, 22 aa, Mycobacterium
VALHKLPVTMVLDRAGVTGSDG

SEQ ID NO: 742640 - protein, 22 aa, Mycobacterium
VALHKLPVTMVLDRSGITGPDG

SEQ ID NO: 742641 - protein, 18 aa, Mycobacterium
VALIDGTWVAFPTVEQLE

SEQ ID NO: 742642 - protein, 20 aa, Mycobacterium
VALIDVREPVEWDIVHIDGA

SEQ ID NO: 742643 - protein, 24 aa, Mycobacterium
VALILQRLLRLCERYGSHPTVVFA

SEQ ID NO: 742644 - protein, 19 aa, Mycobacterium
VALIYAWWSSADAVHYLHQ

SEQ ID NO: 742645 - protein, 32 aa, Mycobacterium
VALKDWRLKTAKEMKVPAFVVFTDNTLIAIAE

SEQ ID NO: 742646 - protein, 24 aa, Mycobacterium
VALKERGFRLLALTPKGDARALPE

SEQ ID NO: 742647 - protein, 30 aa, Mycobacterium
VALKKELRLKPGDWYVIHSYAGYENKVKAN

SEQ ID NO: 742648 - protein, 17 aa, Mycobacterium
VALKVARALDVDVGRLF

SEQ ID NO: 742649 - protein, 19 aa, Mycobacterium
VALLAQLPGGLPVSGIDVA

SEQ ID NO: 742650 - protein, 19 aa, Mycobacterium
VALLCPGPVRTEFLKNAGM

SEQ ID NO: 742651 - protein, 19 aa, Mycobacterium
VALLCPGPVRTEFVKSAGM

SEQ ID NO: 742652 - protein, 17 aa, Mycobacterium
VALLIPRSAGAVAAMLA

SEQ ID NO: 742653 - protein, 30 aa, Mycobacterium
VALLRAVKVPARLVAVYAPGCDPMDFHAVA

SEQ ID NO: 742654 - protein, 27 aa, Mycobacterium
VALLRAVNVPARLVSVYAPGCQPMDFH

SEQ ID NO: 742655 - protein, 26 aa, Mycobacterium
VALLRAVSVPARLVSVYAPGVNPMDF

SEQ ID NO: 742656 - protein, 18 aa, Mycobacterium
VALLRKGQTVRLNEALTV

SEQ ID NO: 742657 - protein, 17 aa, Mycobacterium
VALLRRATVTLAPTGYS

SEQ ID NO: 742658 - protein, 25 aa, Mycobacterium
VALLRRPAGLDERTWLHRWHLDHTR

SEQ ID NO: 742659 - protein, 17 aa, Mycobacterium
VALLRSGENWMGDEFAA

SEQ ID NO: 742660 - protein, 17 aa, Mycobacterium
VALLRSREVMPSRLRLL

SEQ ID NO: 742661 - protein, 24 aa, Mycobacterium
VALLSRGKLAYGVLDDENQPPGSR

SEQ ID NO: 742662 - protein, 24 aa, Mycobacterium
VALLSRGKLLYGVVDDENQPPGSR

SEQ ID NO: 742663 - protein, 24 aa, Mycobacterium
VALLSRGKLLYGVVDNEDQPPGSR

SEQ ID NO: 742664 - protein, 19 aa, Mycobacterium
VALMFQEPALFPWLTSAAN

SEQ ID NO: 742665 - protein, 17 aa, Mycobacterium
VALMGIGGVEYHGHTWE

SEQ ID NO: 742666 - protein, 28 aa, Mycobacterium
VALMKPGRGPHRYVCGGVLVSFNEWIDI

SEQ ID NO: 742667 - protein, 26 aa, Mycobacterium
VALNFRRPAGGLSWGQVVAGEDALGA

SEQ ID NO: 742668 - protein, 20 aa, Mycobacterium
VALNLEYYGQMWPRNAAAGA

SEQ ID NO: 742669 - protein, 25 aa, Mycobacterium
VALNRNAFVRMVLTNWFGQNCLAIA

SEQ ID NO: 742670 - protein, 17 aa, Mycobacterium
VALPDGWLDDADDCRVP

SEQ ID NO: 742671 - protein, 17 aa, Mycobacterium
VALPPTVPHAFPVTPTA

SEQ ID NO: 742672 - protein, 20 aa, Mycobacterium
VALPSLRAAHAVHGPVALVH

SEQ ID NO: 742673 - protein, 20 aa, Mycobacterium
VALQDRFFRALPEMAVRWQA

SEQ ID NO: 742674 - protein, 17 aa, Mycobacterium
VALQIAALKARYLSRED

SEQ ID NO: 742675 - protein, 17 aa, Mycobacterium
VALRAATVSICRLEPEL

SEQ ID NO: 742676 - protein, 19 aa, Mycobacterium
VALRDGLQIEAPIPLSAKL

SEQ ID NO: 742677 - protein, 17 aa, Mycobacterium
VALRDGLQIEKPVPLSA

SEQ ID NO: 742678 - protein, 17 aa, Mycobacterium
VALRDGRDGHIFGRRTL

SEQ ID NO: 742679 - protein, 22 aa, Mycobacterium
VALRDGVLYAKRIVESDASVAD

SEQ ID NO: 742680 - protein, 20 aa, Mycobacterium
VALRDRLPLVAAQFAEGAVS

SEQ ID NO: 742681 - protein, 19 aa, Mycobacterium
VALRKARGFGRPVIVHVVT

SEQ ID NO: 742682 - protein, 17 aa, Mycobacterium
VALRLKALADPVRVKIM

SEQ ID NO: 742683 - protein, 21 aa, Mycobacterium
VALRLPRIGYVGAMGSRQTHD

SEQ ID NO: 742684 - protein, 20 aa, Mycobacterium
VALRLRGRVDTGAFGAALAD

SEQ ID NO: 742685 - protein, 37 aa, Mycobacterium
VALRQGRASWYRNRWVRSLPVCAALGEPAPNRLDPRA

SEQ ID NO: 742686 - protein, 20 aa, Mycobacterium
VALRRAGLQLPDIDLIELNE

SEQ ID NO: 742687 - protein, 33 aa, Mycobacterium
VALRRELSALVARSPFGQGAAWPVVQTVQRDGI

SEQ ID NO: 742688 - protein, 18 aa, Mycobacterium
VALRRLLYCGEWIHSHVL

SEQ ID NO: 742689 - protein, 18 aa, Mycobacterium
VALRSGGVVIVFPGGDYD

SEQ ID NO: 742690 - protein, 24 aa, Mycobacterium
VALSEIPDPVFSAGMVGHGAAVDP

SEQ ID NO: 742691 - protein, 17 aa, Mycobacterium
VALSGGYNREDACAKLA

SEQ ID NO: 742692 - protein, 18 aa, Mycobacterium
VALSLPLGAGRLTREWLP

SEQ ID NO: 742693 - protein, 19 aa, Mycobacterium
VALSLPLGAGRLTREWLPD

SEQ ID NO: 742694 - protein, 18 aa, Mycobacterium
VALSLVYEGGRLTRASTR

SEQ ID NO: 742695 - protein, 26 aa, Mycobacterium
VALSRLPRDEWIGVQADSHWTSDGIA

SEQ ID NO: 742696 - protein, 19 aa, Mycobacterium
VALTCRALFDAGHDSGLTG

SEQ ID NO: 742697 - protein, 21 aa, Mycobacterium
VALTELFKRIRGYEVDEANAV

SEQ ID NO: 742698 - protein, 20 aa, Mycobacterium
VALTELFKRIRGYQVDEGNA

SEQ ID NO: 742699 - protein, 17 aa, Mycobacterium
VALTELFTRISGYEIDE

SEQ ID NO: 742700 - protein, 21 aa, Mycobacterium
VALTGRPLIGNGADGAAGTGE

SEQ ID NO: 742701 - protein, 17 aa, Mycobacterium
VALTLCRANEQARQLTV

SEQ ID NO: 742702 - protein, 33 aa, Mycobacterium
VALTLPHGMKIRLSFLSGFVLDGLPGWRDTMHL

SEQ ID NO: 742703 - protein, 17 aa, Mycobacterium
VALTPARLLLIVITDSG

SEQ ID NO: 742704 - protein, 18 aa, Mycobacterium
VALTPARLLLVVITDTGR

SEQ ID NO: 742705 - protein, 23 aa, Mycobacterium
VALTPRPAPKVATAHLHEQTVSV

SEQ ID NO: 742706 - protein, 25 aa, Mycobacterium
VALTPRPVPTVAIGHLHEQTVSVPE

SEQ ID NO: 742707 - protein, 17 aa, Mycobacterium
VALTRAMVDHCRDAGRA

SEQ ID NO: 742708 - protein, 27 aa, Mycobacterium
VALTSRFPIVLWLDPTELFLMYNDAYA

SEQ ID NO: 742709 - protein, 24 aa, Mycobacterium
VALTSRFPIVLWVGRDLFLIYNDA

SEQ ID NO: 742710 - protein, 29 aa, Mycobacterium
VALVCYSHGLASYLERITATWNRRHRPAY

SEQ ID NO: 742711 - protein, 20 aa, Mycobacterium
VALVGRSMVRNMGIARELGF

SEQ ID NO: 742712 - protein, 18 aa, Mycobacterium
VALVPKSTALVVWQPRRP

SEQ ID NO: 742713 - protein, 17 aa, Mycobacterium
VALVSPQPIFLALREVR

SEQ ID NO: 742714 - protein, 23 aa, Mycobacterium
VALYRRIGYKLGSWHDVTHFQLF

SEQ ID NO: 742715 - protein, 23 aa, Mycobacterium
VAMAAAAAQYVAWMSETSAQAKT

SEQ ID NO: 742716 - protein, 24 aa, Mycobacterium
VAMADAVAPYVVWMRATAAQAEHT

SEQ ID NO: 742717 - protein, 17 aa, Mycobacterium
VAMCAKLFATVGRQFSD

SEQ ID NO: 742718 - protein, 29 aa, Mycobacterium
VAMCGHCQLGPLLLCRDGPVVGYDVAGPL

SEQ ID NO: 742719 - protein, 18 aa, Mycobacterium
VAMEAEVSMLLQRRCVWM

SEQ ID NO: 742720 - protein, 17 aa, Mycobacterium
VAMFPAVEPDDVSALTQ

SEQ ID NO: 742721 - protein, 21 aa, Mycobacterium
VAMGAAGAWTGSVWLTTEEAE

SEQ ID NO: 742722 - protein, 22 aa, Mycobacterium
VAMGLNVLRVMTGRPVDRVFVR

SEQ ID NO: 742723 - protein, 18 aa, Mycobacterium
VAMIAAHYQIDFSEHYLA

SEQ ID NO: 742724 - protein, 19 aa, Mycobacterium
VAMLLERTPLIPIAVLAII

SEQ ID NO: 742725 - protein, 18 aa, Mycobacterium
VAMLMRFQHATARIAASA

SEQ ID NO: 742726 - protein, 32 aa, Mycobacterium
VAMLQLLRHWGIRPDFVLGHSVGEIAAAYAAQ

SEQ ID NO: 742727 - protein, 18 aa, Mycobacterium
VAMLRAGATRLGLSGTRS

SEQ ID NO: 742728 - protein, 24 aa, Mycobacterium
VAMMDRLRTAGPWESQQTHDSLRR

SEQ ID NO: 742729 - protein, 22 aa, Mycobacterium
VAMPAETPLIVAARSAGKPVIT

SEQ ID NO: 742730 - protein, 19 aa, Mycobacterium
VAMRPSRREPFTGARLVQA

SEQ ID NO: 742731 - protein, 30 aa, Mycobacterium
VAMTGWQRLHFRFGIPAPLLEPLAVERLYL

SEQ ID NO: 742732 - protein, 17 aa, Mycobacterium
VAMVDVAGWLRGSTVLE

SEQ ID NO: 742733 - protein, 17 aa, Mycobacterium
VAMVHPLAVAANRNAFV

SEQ ID NO: 742734 - protein, 27 aa, Mycobacterium
VAMVLRRLLRLCARYAPAGDVSGPTVV

SEQ ID NO: 742735 - protein, 26 aa, Mycobacterium
VAMVLRRLLRLCARYSAEPGCGPTVI

SEQ ID NO: 742736 - protein, 26 aa, Mycobacterium
VAMVLRRLLRLCARYSAHPTVIFASA

SEQ ID NO: 742737 - protein, 25 aa, Mycobacterium
VAMVLRRLLRLCARYSSAPTVIFAS

SEQ ID NO: 742738 - protein, 18 aa, Mycobacterium
VAMVLRRLLRLCERYSAN

SEQ ID NO: 742739 - protein, 20 aa, Mycobacterium
VAMVLSHRSGVIGPNARMSW

SEQ ID NO: 742740 - protein, 19 aa, Mycobacterium
VAMVLSHRSGVIGPNKRLS

SEQ ID NO: 742741 - protein, 18 aa, Mycobacterium
VAMVTGKAWFSVRKEQKK

SEQ ID NO: 742742 - protein, 18 aa, Mycobacterium
VAMVTGKAWFSVRKEQKS

SEQ ID NO: 742743 - protein, 31 aa, Mycobacterium
VANAAPWLIGDNGFGHWWLGDRVGGTSKYLM

SEQ ID NO: 742744 - protein, 24 aa, Mycobacterium
VANADMIAALGMLDARHIAGDARL

SEQ ID NO: 742745 - protein, 18 aa, Mycobacterium
VANAGTRLSGFFFRGTGP

SEQ ID NO: 742746 - protein, 17 aa, Mycobacterium
VANALFWLEEFHIDGLR

SEQ ID NO: 742747 - protein, 18 aa, Mycobacterium
VANALYWLQEFHVDGLRV

SEQ ID NO: 742748 - protein, 18 aa, Mycobacterium
VANALYWLQEYHIDGLRV

SEQ ID NO: 742749 - protein, 18 aa, Mycobacterium
VANARLAYAAYEEIFLGG

SEQ ID NO: 742750 - protein, 18 aa, Mycobacterium
VANARLAYQAYEKVFGSD

SEQ ID NO: 742751 - protein, 48 aa, Mycobacterium
VANATFDFANGFATLTLETVPNPILTPGFHGLHIHSVGKCEANSVAPT

SEQ ID NO: 742752 - protein, 22 aa, Mycobacterium
VANAVARYCVVPPWREGGQAQF

SEQ ID NO: 742753 - protein, 24 aa, Mycobacterium
VANERRIAEETARAEGKPEQALTK

SEQ ID NO: 742754 - protein, 24 aa, Mycobacterium
VANERRIAEETARNEGKPEQALPK

SEQ ID NO: 742755 - protein, 18 aa, Mycobacterium
VANEVAWEQSVFGTDSAL

SEQ ID NO: 742756 - protein, 17 aa, Mycobacterium
VANFLVLRTRRDGSRNG

SEQ ID NO: 742757 - protein, 28 aa, Mycobacterium
VANGLRNVWAYAVIVCGHFADGAEKFTP

SEQ ID NO: 742758 - protein, 22 aa, Mycobacterium
VANISQPWAVTVTRTQRDKPLI

SEQ ID NO: 742759 - protein, 34 aa, Mycobacterium
VANLPIALWPGMKIGQLCILRLTSPAEHPYGSSG

SEQ ID NO: 742760 - protein, 33 aa, Mycobacterium
VANLPITLWPGMKIGQLCILKLTSPSEHPYGSS

SEQ ID NO: 742761 - protein, 34 aa, Mycobacterium
VANLPITLWPGMKIGQLCILRLTSPAEHPYGSSQ

SEQ ID NO: 742762 - protein, 34 aa, Mycobacterium
VANLPITLWPGMKIGQLCILRLTSPAEHPYGSSR

SEQ ID NO: 742763 - protein, 34 aa, Mycobacterium
VANLPITLWPGMKIGQLCLLRLTSPAEHPYGSAG

SEQ ID NO: 742764 - protein, 33 aa, Mycobacterium
VANLPITLWPGMKIGQLCLLRLTSPAENPYGSA

SEQ ID NO: 742765 - protein, 34 aa, Mycobacterium
VANLPITLWPGMKIGQLCLLRLTSPAQHPYGSSQ

SEQ ID NO: 742766 - protein, 23 aa, Mycobacterium
VANLRANPVFELRDGEDVQTVRA

SEQ ID NO: 742767 - protein, 20 aa, Mycobacterium
VANRLCAQILLLAAEDADKD

SEQ ID NO: 742768 - protein, 20 aa, Mycobacterium
VANRLCAQILLLAAEDASKD

SEQ ID NO: 742769 - protein, 20 aa, Mycobacterium
VANTDFLDPLGLRLVAHPSG

SEQ ID NO: 742770 - protein, 20 aa, Mycobacterium
VANTGSTNWGMVNSGSVNTG

SEQ ID NO: 742771 - protein, 18 aa, Mycobacterium
VANTRLAEELALTTDLEQ

SEQ ID NO: 742772 - protein, 17 aa, Mycobacterium
VANVIAFLASDAAAAIH

SEQ ID NO: 742773 - protein, 22 aa, Mycobacterium
VAPAAYPVAWPAVGVASSVTAP

SEQ ID NO: 742774 - protein, 20 aa, Mycobacterium
VAPACFFPAGDRALLARFAD

SEQ ID NO: 742775 - protein, 19 aa, Mycobacterium
VAPAWEYAMSGSRVSNTRI

SEQ ID NO: 742776 - protein, 18 aa, Mycobacterium
VAPDALFALMCGDLSAPV

SEQ ID NO: 742777 - protein, 26 aa, Mycobacterium
VAPDPRLDLVRAFSRYFNVDPSYFTV

SEQ ID NO: 742778 - protein, 26 aa, Mycobacterium
VAPDWPTGIGDLSYRVMISGDPDIDC

SEQ ID NO: 742779 - protein, 22 aa, Mycobacterium
VAPEAIAAAILDLTGDIRQVPS

SEQ ID NO: 742780 - protein, 18 aa, Mycobacterium
VAPEAIAALWTDNLLDRI

SEQ ID NO: 742781 - protein, 31 aa, Mycobacterium
VAPEHSASWVLPLLWRRWSPGYRADEDLRHV

SEQ ID NO: 742782 - protein, 23 aa, Mycobacterium
VAPELRQARDLRYTLLDDVPVAT

SEQ ID NO: 742783 - protein, 23 aa, Mycobacterium
VAPELTGKWLGAFFMGPVNTRIV

SEQ ID NO: 742784 - protein, 18 aa, Mycobacterium
VAPERIDTIISFQKAGEV

SEQ ID NO: 742785 - protein, 22 aa, Mycobacterium
VAPERINTIIAFQKAGEVGAKT

SEQ ID NO: 742786 - protein, 24 aa, Mycobacterium
VAPFLPPPFRDLAESVLGAADASG

SEQ ID NO: 742787 - protein, 23 aa, Mycobacterium
VAPGDVWLQAIVVRRQLESADVA

SEQ ID NO: 742788 - protein, 23 aa, Mycobacterium
VAPGIMIKPEMRQYLLDPQDDKQ

SEQ ID NO: 742789 - protein, 17 aa, Mycobacterium
VAPGRMNRPNWAAHLFA

SEQ ID NO: 742790 - protein, 18 aa, Mycobacterium
VAPGWTIDQVIALMDFRP

SEQ ID NO: 742791 - protein, 18 aa, Mycobacterium
VAPGYIWGDTLQGYFEHQ

SEQ ID NO: 742792 - protein, 17 aa, Mycobacterium
VAPHVPFGGIGYSGIGR

SEQ ID NO: 742793 - protein, 32 aa, Mycobacterium
VAPIGAPSFKESLRWGTEVYHSLKSVLKKQGL

SEQ ID NO: 742794 - protein, 24 aa, Mycobacterium
VAPILCAGVTVYKGLKVTDTRPGQ

SEQ ID NO: 742795 - protein, 18 aa, Mycobacterium
VAPKGMRASRRYRVPPMP

SEQ ID NO: 742796 - protein, 17 aa, Mycobacterium
VAPKLSRRILHQLYLGY

SEQ ID NO: 742797 - protein, 17 aa, Mycobacterium
VAPLCNAMSRLGGVTMS

SEQ ID NO: 742798 - protein, 18 aa, Mycobacterium
VAPLGGISAMLAIADQID

SEQ ID NO: 742799 - protein, 17 aa, Mycobacterium
VAPLHGWGPDPYLTPGL

SEQ ID NO: 742800 - protein, 19 aa, Mycobacterium
VAPNFGFELAMRKTTAEQR

SEQ ID NO: 742801 - protein, 19 aa, Mycobacterium
VAPNLWTGVGLVRGGAGTA

SEQ ID NO: 742802 - protein, 20 aa, Mycobacterium
VAPPDFRYTSATIIDEETGT

SEQ ID NO: 742803 - protein, 24 aa, Mycobacterium
VAPPGVPVPLLIGGNGTRVLQLAG

SEQ ID NO: 742804 - protein, 23 aa, Mycobacterium
VAPPHKRVALVFSAYPTKHARIG

SEQ ID NO: 742805 - protein, 18 aa, Mycobacterium
VAPPPGGVGYGMFYTNSF

SEQ ID NO: 742806 - protein, 23 aa, Mycobacterium
VAPPRRFGALSVDVAAREVGIDD

SEQ ID NO: 742807 - protein, 28 aa, Mycobacterium
VAPQAIWPRVRRALAAVGLALPLMHDTG

SEQ ID NO: 742808 - protein, 23 aa, Mycobacterium
VAPRAPWSKIVRAGDVLTIVDLH

SEQ ID NO: 742809 - protein, 20 aa, Mycobacterium
VAPRGSWAILGRALDLDPAT

SEQ ID NO: 742810 - protein, 26 aa, Mycobacterium
VAPRLDYADVVALFAVHLGGTAAERE

SEQ ID NO: 742811 - protein, 24 aa, Mycobacterium
VAPRMLGQGTALWRLLRGDDARAL

SEQ ID NO: 742812 - protein, 19 aa, Mycobacterium
VAPRPYRDYIGWLASRDPE

SEQ ID NO: 742813 - protein, 20 aa, Mycobacterium
VAPRRKPLNTLNAWIATGAD

SEQ ID NO: 742814 - protein, 18 aa, Mycobacterium
VAPRRSGPVVWVKDASRS

SEQ ID NO: 742815 - protein, 25 aa, Mycobacterium
VAPRSRWLYRVFPYDEATLLLTHGG

SEQ ID NO: 742816 - protein, 17 aa, Mycobacterium
VAPRTAFDSFKEAHQAA

SEQ ID NO: 742817 - protein, 17 aa, Mycobacterium
VAPSITEKVPLLGADGY

SEQ ID NO: 742818 - protein, 22 aa, Mycobacterium
VAPSRTAAWCAISAARMAPAYA

SEQ ID NO: 742819 - protein, 27 aa, Mycobacterium
VAPTKIRGVLMGGYFAGLLNRGVLGTT

SEQ ID NO: 742820 - protein, 23 aa, Mycobacterium
VAPTLRGEIEWCQLFSEPGAGSD

SEQ ID NO: 742821 - protein, 25 aa, Mycobacterium
VAPTSRRAAVLAGLRAAHPYEEPAF

SEQ ID NO: 742822 - protein, 29 aa, Mycobacterium
VAPVGDARPDWQLICAVAEHLGFGEHFRY

SEQ ID NO: 742823 - protein, 20 aa, Mycobacterium
VAPVLRLRALVRDSVGLGST

SEQ ID NO: 742824 - protein, 18 aa, Mycobacterium
VAPWMFGAAGREHMKKYG

SEQ ID NO: 742825 - protein, 27 aa, Mycobacterium
VAPWNYPMMMAVWKFAPALAAGCTVVL

SEQ ID NO: 742826 - protein, 18 aa, Mycobacterium
VAPYMGWMSITGVQAEQT

SEQ ID NO: 742827 - protein, 25 aa, Mycobacterium
VAPYPELIDLLVLDAIANPHDPWDL

SEQ ID NO: 742828 - protein, 18 aa, Mycobacterium
VAQACAFINYAMGRYGVA

SEQ ID NO: 742829 - protein, 18 aa, Mycobacterium
VAQACAFINYAQGRYGVA

SEQ ID NO: 742830 - protein, 23 aa, Mycobacterium
VAQACAFINYARGHYGVAADASN

SEQ ID NO: 742831 - protein, 24 aa, Mycobacterium
VAQAQGLRYIGFRHESDAGHAAAA

SEQ ID NO: 742832 - protein, 22 aa, Mycobacterium
VAQASGIRYIGFRQETSAGNAA

SEQ ID NO: 742833 - protein, 17 aa, Mycobacterium
VAQAWATMTDRLAPGGL

SEQ ID NO: 742834 - protein, 17 aa, Mycobacterium
VAQAWHWVDAERAIPEV

SEQ ID NO: 742835 - protein, 18 aa, Mycobacterium
VAQDESWQSAWRAAADVA

SEQ ID NO: 742836 - protein, 25 aa, Mycobacterium
VAQEPRGAGGFGYDPVFIADGANRT

SEQ ID NO: 742837 - protein, 25 aa, Mycobacterium
VAQGHRGEIAFVHYARTPAEACYRD

SEQ ID NO: 742838 - protein, 18 aa, Mycobacterium
VAQGVGMYAALKRAADTT

SEQ ID NO: 742839 - protein, 17 aa, Mycobacterium
VAQGWFLQQGYLMRPII

SEQ ID NO: 742840 - protein, 17 aa, Mycobacterium
VAQHMSPPLPLVGSGEP

SEQ ID NO: 742841 - protein, 19 aa, Mycobacterium
VAQIARWAGCIGNRSTIVP

SEQ ID NO: 742842 - protein, 19 aa, Mycobacterium
VAQILRFAATEVVPRLNGT

SEQ ID NO: 742843 - protein, 18 aa, Mycobacterium
VAQINWLFDLILHAEDIA

SEQ ID NO: 742844 - protein, 24 aa, Mycobacterium
VAQLPPWLGSTFRRSAVLRYGENP

SEQ ID NO: 742845 - protein, 17 aa, Mycobacterium
VAQLRFLTPDVALIHAN

SEQ ID NO: 742846 - protein, 24 aa, Mycobacterium
VAQLRSGMTIGIAGWGSRRKPMAF

SEQ ID NO: 742847 - protein, 24 aa, Mycobacterium
VAQLRSGMTIGIGGWGSRRKPMAF

SEQ ID NO: 742848 - protein, 26 aa, Mycobacterium
VAQMGKDGWLTLNWPKEYGGQDRSPM

SEQ ID NO: 742849 - protein, 26 aa, Mycobacterium
VAQMGKDGWLTLSWPEEFGGQARPPM

SEQ ID NO: 742850 - protein, 27 aa, Mycobacterium
VAQMGKDGWLTLSWPKEFGGQARPPMD

SEQ ID NO: 742851 - protein, 25 aa, Mycobacterium
VAQNVARWLVLYLRRPGGQTQFAAP

SEQ ID NO: 742852 - protein, 23 aa, Mycobacterium
VAQRAAKCGHRLDVPMVSAPTGK

SEQ ID NO: 742853 - protein, 25 aa, Mycobacterium
VAQRFNARFPDTFVVPDVLIPKATA

SEQ ID NO: 742854 - protein, 21 aa, Mycobacterium
VAQRLAAHFGDITVETSDLTW

SEQ ID NO: 742855 - protein, 18 aa, Mycobacterium
VAQRLAKDGFTLVLGYHP

SEQ ID NO: 742856 - protein, 17 aa, Mycobacterium
VAQRLKAPLDVCLVRKL

SEQ ID NO: 742857 - protein, 22 aa, Mycobacterium
VAQRLLSRNGWRNTTLAQIAGE

SEQ ID NO: 742858 - protein, 17 aa, Mycobacterium
VAQRSAILMPLRAHDHV

SEQ ID NO: 742859 - protein, 17 aa, Mycobacterium
VAQRVPYLQVWNLTGQP

SEQ ID NO: 742860 - protein, 23 aa, Mycobacterium
VAQRVPYQQVWNLTGQPAAVVPW

SEQ ID NO: 742861 - protein, 26 aa, Mycobacterium
VAQTVARWLVLHLRRPGGQTQFAAPV

SEQ ID NO: 742862 - protein, 25 aa, Mycobacterium
VAQTVARWLVLYLRRPGGQTQFAAP

SEQ ID NO: 742863 - protein, 26 aa, Mycobacterium
VAQVPRIRWPAAAFPVRAVRAGVAHR

SEQ ID NO: 742864 - protein, 25 aa, Mycobacterium
VAQWREFAERAPLYTAREKAKELGA

SEQ ID NO: 742865 - protein, 25 aa, Mycobacterium
VAQYRLARRFPRSMRKALIAWAKHQ

SEQ ID NO: 742866 - protein, 17 aa, Mycobacterium
VAQYWPEFGANGKAEIT

SEQ ID NO: 742867 - protein, 23 aa, Mycobacterium
VARAAGLPPLVGVLPRAAAAPLL

SEQ ID NO: 742868 - protein, 23 aa, Mycobacterium
VARAAGVRVVHCLVQRRPDGLGS

SEQ ID NO: 742869 - protein, 22 aa, Mycobacterium
VARAKFAFRCAPISGVLAVSTA

SEQ ID NO: 742870 - protein, 18 aa, Mycobacterium
VARALDVDVGRLFSDESA

SEQ ID NO: 742871 - protein, 23 aa, Mycobacterium
VARAPRPEIGWCEVASDRPDLVP

SEQ ID NO: 742872 - protein, 19 aa, Mycobacterium
VARARAALHPLPITPELRG

SEQ ID NO: 742873 - protein, 19 aa, Mycobacterium
VARASGWRMLTLDTSTLQH

SEQ ID NO: 742874 - protein, 17 aa, Mycobacterium
VARAYFVPLADLLVTPR

SEQ ID NO: 742875 - protein, 19 aa, Mycobacterium
VARAYLDARVQTIYGGTTE

SEQ ID NO: 742876 - protein, 19 aa, Mycobacterium
VARAYLDSRVQTIYGGTTE

SEQ ID NO: 742877 - protein, 21 aa, Mycobacterium
VARAYMDSRIQTIYGGTTEIM

SEQ ID NO: 742878 - protein, 27 aa, Mycobacterium
VARCVAEVGIGFAFAPQFHPSYRHAGA

SEQ ID NO: 742879 - protein, 18 aa, Mycobacterium
VAREEVFGPVLVVMTYDT

SEQ ID NO: 742880 - protein, 24 aa, Mycobacterium
VAREGRLRSAIAGLPADAFDFVFI

SEQ ID NO: 742881 - protein, 17 aa, Mycobacterium
VARELSNWGRWGDADEL

SEQ ID NO: 742882 - protein, 19 aa, Mycobacterium
VARENRLRTALADLDDLDF

SEQ ID NO: 742883 - protein, 17 aa, Mycobacterium
VAREVLEDYGLTPWPKT

SEQ ID NO: 742884 - protein, 19 aa, Mycobacterium
VARFSAIGRRAVSEGDLTP

SEQ ID NO: 742885 - protein, 24 aa, Mycobacterium
VARFSSNYAPLFGRLLTPLVNGIR

SEQ ID NO: 742886 - protein, 23 aa, Mycobacterium
VARGEADRALLICGTGLGVAIAA

SEQ ID NO: 742887 - protein, 21 aa, Mycobacterium
VARGGSLIGDIVDYKLHHGGP

SEQ ID NO: 742888 - protein, 25 aa, Mycobacterium
VARHGDGWCPFAAPPGLAQTAGTAA

SEQ ID NO: 742889 - protein, 30 aa, Mycobacterium
VARHGVNRCRPRPEHQVVVFGAGPIGLGAT

SEQ ID NO: 742890 - protein, 17 aa, Mycobacterium
VARHVRLLIDRSGLAQQ

SEQ ID NO: 742891 - protein, 27 aa, Mycobacterium
VARIAERVPQEWLLPYVHQRYDDPVLS

SEQ ID NO: 742892 - protein, 19 aa, Mycobacterium
VARIDGCGRVRIVDRKKDL

SEQ ID NO: 742893 - protein, 20 aa, Mycobacterium
VARIIPAPVRDWLYDKVAGI

SEQ ID NO: 742894 - protein, 29 aa, Mycobacterium
VARIKFPTPAACGRIPLVAKGLSKNYGSL

SEQ ID NO: 742895 - protein, 18 aa, Mycobacterium
VARIKFPTPAACGRTPLV

SEQ ID NO: 742896 - protein, 27 aa, Mycobacterium
VARIKFPTPAACGRVPLVAKGLTKNYG

SEQ ID NO: 742897 - protein, 19 aa, Mycobacterium
VARIKFPTPAPCGKTPLIA

SEQ ID NO: 742898 - protein, 26 aa, Mycobacterium
VARISRVFPSTVFLTIMGMPVEDLEK

SEQ ID NO: 742899 - protein, 19 aa, Mycobacterium
VARLARAFLPKLTDEQLLA

SEQ ID NO: 742900 - protein, 18 aa, Mycobacterium
VARLARFPGPNGLTQEIY

SEQ ID NO: 742901 - protein, 23 aa, Mycobacterium
VARLCSQERIWSIFAKKRGLNRR

SEQ ID NO: 742902 - protein, 22 aa, Mycobacterium
VARLKSSVAMAIRRQERGLAVA

SEQ ID NO: 742903 - protein, 23 aa, Mycobacterium
VARLKSSVAMALRRQDRGLAVGH

SEQ ID NO: 742904 - protein, 21 aa, Mycobacterium
VARLKSSVAMELVRKQRGLAV

SEQ ID NO: 742905 - protein, 19 aa, Mycobacterium
VARLLTFLPGGAMSQSGYL

SEQ ID NO: 742906 - protein, 27 aa, Mycobacterium
VARLPRIPFPFPLYLREPRKVVVVHEE

SEQ ID NO: 742907 - protein, 19 aa, Mycobacterium
VARLQRWRTATALPTGPDA

SEQ ID NO: 742908 - protein, 33 aa, Mycobacterium
VARLRADRALIAFPEIRGISYFTRVVEELDSAG

SEQ ID NO: 742909 - protein, 26 aa, Mycobacterium
VARLRARLEAALTLPNRTEGVVMTGT

SEQ ID NO: 742910 - protein, 17 aa, Mycobacterium
VARLRDCVRRLDPDVLS

SEQ ID NO: 742911 - protein, 17 aa, Mycobacterium
VARLRKTFATGRTRSVE

SEQ ID NO: 742912 - protein, 19 aa, Mycobacterium
VARLRLELSTSLRGAVLAS

SEQ ID NO: 742913 - protein, 25 aa, Mycobacterium
VARLRRGQTLIGFLAPRNADNSIGA

SEQ ID NO: 742914 - protein, 25 aa, Mycobacterium
VARLRRRIAGVMGYSNDSAVDTAKP

SEQ ID NO: 742915 - protein, 17 aa, Mycobacterium
VARLRRVVAAMAEEPGR

SEQ ID NO: 742916 - protein, 29 aa, Mycobacterium
VARLRSDRALIAFPEIRNLGYFTLVVQEL

SEQ ID NO: 742917 - protein, 25 aa, Mycobacterium
VARMAPRLVGAVLIGRDRAAVAEAL

SEQ ID NO: 742918 - protein, 25 aa, Mycobacterium
VARMAPRLVGAVLIGRDRQEVAEAL

SEQ ID NO: 742919 - protein, 21 aa, Mycobacterium
VARMASRLVGAVLIGQDRAEV

SEQ ID NO: 742920 - protein, 25 aa, Mycobacterium
VARMGGWRLAPPLLVDQLAGLKPPA

SEQ ID NO: 742921 - protein, 17 aa, Mycobacterium
VARPDLLALGALLHDIG

SEQ ID NO: 742922 - protein, 18 aa, Mycobacterium
VARPRKAFSDMLVSVTGA

SEQ ID NO: 742923 - protein, 23 aa, Mycobacterium
VARPSHVLIEMGIDPEVARGSLR

SEQ ID NO: 742924 - protein, 22 aa, Mycobacterium
VARQEPRLNWAVGQRADGLTVL

SEQ ID NO: 742925 - protein, 20 aa, Mycobacterium
VARQRIAVIRAVRNALERRG

SEQ ID NO: 742926 - protein, 21 aa, Mycobacterium
VARQRIAVVRAIRNALERRGF

SEQ ID NO: 742927 - protein, 19 aa, Mycobacterium
VARRAAGLKAREFPVKFDV

SEQ ID NO: 742928 - protein, 21 aa, Mycobacterium
VARRARVSLATIYKRYPTRDE

SEQ ID NO: 742929 - protein, 26 aa, Mycobacterium
VARRAVDVLRRLYGRVGDRLVLISVG

SEQ ID NO: 742930 - protein, 26 aa, Mycobacterium
VARRCGPAPPGLRRPRRLCRSKPMKT

SEQ ID NO: 742931 - protein, 23 aa, Mycobacterium
VARRFGCSESDLRRVLFEETGGM

SEQ ID NO: 742932 - protein, 21 aa, Mycobacterium
VARRLAGLFASYARQRPALLA

SEQ ID NO: 742933 - protein, 21 aa, Mycobacterium
VARRLAGLFASYARQRPQLLI

SEQ ID NO: 742934 - protein, 22 aa, Mycobacterium
VARRLAGLFASYARQRPRLLAD

SEQ ID NO: 742935 - protein, 22 aa, Mycobacterium
VARRLAGLFASYARQRPRVLSD

SEQ ID NO: 742936 - protein, 22 aa, Mycobacterium
VARRLEKPCYALAHGLLASLPS

SEQ ID NO: 742937 - protein, 17 aa, Mycobacterium
VARRLPVPVLTTLHTPP

SEQ ID NO: 742938 - protein, 17 aa, Mycobacterium
VARRLRAGFIGVNGGAP

SEQ ID NO: 742939 - protein, 17 aa, Mycobacterium
VARRRIGYGQVDPEVSR

SEQ ID NO: 742940 - protein, 17 aa, Mycobacterium
VARRSVDGATIIKASVG

SEQ ID NO: 742941 - protein, 17 aa, Mycobacterium
VARRYVSVLQRVWTAER

SEQ ID NO: 742942 - protein, 22 aa, Mycobacterium
VARSHPMTVDWISYAQSLTAKP

SEQ ID NO: 742943 - protein, 18 aa, Mycobacterium
VARSLPYRPYHSHDELQP

SEQ ID NO: 742944 - protein, 17 aa, Mycobacterium
VARSVRSLVDIDVTDER

SEQ ID NO: 742945 - protein, 24 aa, Mycobacterium
VARTAMAHAAWRGEVTVDEEDIRV

SEQ ID NO: 742946 - protein, 20 aa, Mycobacterium
VARTRLAALAGQGVAAVGSA

SEQ ID NO: 742947 - protein, 22 aa, Mycobacterium
VARVGLQPLVFGLWRMISEYNA

SEQ ID NO: 742948 - protein, 21 aa, Mycobacterium
VARVGLVNAVIRFDVTAGSDF

SEQ ID NO: 742949 - protein, 20 aa, Mycobacterium
VARVLRFAATEVVPRLAGSS

SEQ ID NO: 742950 - protein, 27 aa, Mycobacterium
VARYLLPKLRAVNFVIQDILGKGVAYQ

SEQ ID NO: 742951 - protein, 17 aa, Mycobacterium
VARYPGAQWSVRGRDAQ

SEQ ID NO: 742952 - protein, 32 aa, Mycobacterium
VARYYEAYGSFEWGMFKAHAFVTREALSDTLS

SEQ ID NO: 742953 - protein, 26 aa, Mycobacterium
VASAIGGLATEVFEIGDIARRAARAG

SEQ ID NO: 742954 - protein, 20 aa, Mycobacterium
VASALAQDVGMRMITRFDVD

SEQ ID NO: 742955 - protein, 31 aa, Mycobacterium
VASALLRASGGWPWLAPGNDPGELLTLLSRA

SEQ ID NO: 742956 - protein, 21 aa, Mycobacterium
VASAVRASMAIPFIYPPVTLT

SEQ ID NO: 742957 - protein, 18 aa, Mycobacterium
VASCPNSKIVLGGYSQGS

SEQ ID NO: 742958 - protein, 22 aa, Mycobacterium
VASDQCDAWTGLAAAGDQSIGV

SEQ ID NO: 742959 - protein, 17 aa, Mycobacterium
VASEAGVTLGLVQHHFK

SEQ ID NO: 742960 - protein, 23 aa, Mycobacterium
VASEEFYLFVSIHHVVVDGFGYA

SEQ ID NO: 742961 - protein, 17 aa, Mycobacterium
VASEIFGSMTGMRYGFA

SEQ ID NO: 742962 - protein, 29 aa, Mycobacterium
VASERAWFAESFVQLGLIPGDGGTWFLQR

SEQ ID NO: 742963 - protein, 19 aa, Mycobacterium
VASERRIAEETAKAEGKPE

SEQ ID NO: 742964 - protein, 23 aa, Mycobacterium
VASERRIAEETAKEEGKPEQALP

SEQ ID NO: 742965 - protein, 20 aa, Mycobacterium
VASGFGRKAQWFRNIEANPR

SEQ ID NO: 742966 - protein, 24 aa, Mycobacterium
VASGRIAYALGLHGPALTFDTACS

SEQ ID NO: 742967 - protein, 28 aa, Mycobacterium
VASGSRFLVFMQRYTPAVLFISTADQGA

SEQ ID NO: 742968 - protein, 17 aa, Mycobacterium
VASGWRADTFVAGTPEP

SEQ ID NO: 742969 - protein, 17 aa, Mycobacterium
VASHMRTTMVLDALEMA

SEQ ID NO: 742970 - protein, 24 aa, Mycobacterium
VASIARKLGALTIGVVTRPFSFEG

SEQ ID NO: 742971 - protein, 22 aa, Mycobacterium
VASICARRGPTLQWVRSEETAK

SEQ ID NO: 742972 - protein, 22 aa, Mycobacterium
VASICARRGPTLQWVRSEETAS

SEQ ID NO: 742973 - protein, 18 aa, Mycobacterium
VASINWGAVPPGIFDAAE

SEQ ID NO: 742974 - protein, 19 aa, Mycobacterium
VASINWGGVPPAIFDAAED

SEQ ID NO: 742975 - protein, 28 aa, Mycobacterium
VASIPIKRLRQAGVLDLLLALAQETEVN

SEQ ID NO: 742976 - protein, 24 aa, Mycobacterium
VASKIMPVAPFPAVVRQRARASAR

SEQ ID NO: 742977 - protein, 28 aa, Mycobacterium
VASKLRRMEFAIAVAKTLANQTAEAVQR

SEQ ID NO: 742978 - protein, 33 aa, Mycobacterium
VASLAPLRFGELCLEAGLPPGLVNVLPAGPEGG

SEQ ID NO: 742979 - protein, 23 aa, Mycobacterium
VASLEMQHLLTLPAGQRPTADQL

SEQ ID NO: 742980 - protein, 23 aa, Mycobacterium
VASLESWIYITCHYKAVRPRPRR

SEQ ID NO: 742981 - protein, 26 aa, Mycobacterium
VASLISAGRAWARFEHGQVVFKAEVG

SEQ ID NO: 742982 - protein, 24 aa, Mycobacterium
VASLLDWPMARWIEFFDANHAAQH

SEQ ID NO: 742983 - protein, 19 aa, Mycobacterium
VASLLKRWNAGTHHYRVER

SEQ ID NO: 742984 - protein, 19 aa, Mycobacterium
VASLRLALADIDAQVAKFE

SEQ ID NO: 742985 - protein, 18 aa, Mycobacterium
VASLSWSLDHVGPLSRNV

SEQ ID NO: 742986 - protein, 20 aa, Mycobacterium
VASPGFRGAPGYEGYLNDRV

SEQ ID NO: 742987 - protein, 18 aa, Mycobacterium
VASPRTFGGFEVAPGAVG

SEQ ID NO: 742988 - protein, 19 aa, Mycobacterium
VASRAGAPLGHDYAVISLS

SEQ ID NO: 742989 - protein, 18 aa, Mycobacterium
VASRAGQLQSIFDDTSNR

SEQ ID NO: 742990 - protein, 17 aa, Mycobacterium
VASRCDAFAVGDVVTTL

SEQ ID NO: 742991 - protein, 27 aa, Mycobacterium
VASRDPFVFVFRCCESCDLAARELERT

SEQ ID NO: 742992 - protein, 23 aa, Mycobacterium
VASRIRSAGAIFVGPWAPVSLGD

SEQ ID NO: 742993 - protein, 17 aa, Mycobacterium
VASRLLAVVGAFDERHR

SEQ ID NO: 742994 - protein, 23 aa, Mycobacterium
VASRRSLLPAGITGVSGRFHGGD

SEQ ID NO: 742995 - protein, 18 aa, Mycobacterium
VASSGRIAATVKPDVVLM

SEQ ID NO: 742996 - protein, 17 aa, Mycobacterium
VASSLYFMRTLGDGMGG

SEQ ID NO: 742997 - protein, 21 aa, Mycobacterium
VASSRGWSAAPVRHGVSVVRS

SEQ ID NO: 742998 - protein, 21 aa, Mycobacterium
VASTCRQLGISIQPARVRVAY

SEQ ID NO: 742999 - protein, 17 aa, Mycobacterium
VASTGKADAAERLKTLG

SEQ ID NO: 743000 - protein, 20 aa, Mycobacterium
VASTLPNRLFNLLVTNVPGP

SEQ ID NO: 743001 - protein, 24 aa, Mycobacterium
VASVELKGKFPLTMTASPDGRLGY

SEQ ID NO: 743002 - protein, 24 aa, Mycobacterium
VASVHGWAAGGGLSLVLLADIAIG

SEQ ID NO: 743003 - protein, 31 aa, Mycobacterium
VASVLLRSSGGWPWLAPGDDPGALLTLLQRA

SEQ ID NO: 743004 - protein, 24 aa, Mycobacterium
VASVLRAKVDAAWNLHELTRDLDV

SEQ ID NO: 743005 - protein, 22 aa, Mycobacterium
VASVSAFVWRANVLGEESAVVG

SEQ ID NO: 743006 - protein, 20 aa, Mycobacterium
VASWAACFWVLADHEDPGYA

SEQ ID NO: 743007 - protein, 19 aa, Mycobacterium
VASYREWDYAWIPNGEPGT

SEQ ID NO: 743008 - protein, 25 aa, Mycobacterium
VATACQPGRPVASITAAAPGATDET

SEQ ID NO: 743009 - protein, 24 aa, Mycobacterium
VATAECDPIRDWGERYAARLRDAG

SEQ ID NO: 743010 - protein, 17 aa, Mycobacterium
VATAIAWSKALDTGGAG

SEQ ID NO: 743011 - protein, 26 aa, Mycobacterium
VATALRWTLKGVKSRVAAAVGGAPTM

SEQ ID NO: 743012 - protein, 19 aa, Mycobacterium
VATAPAWQTFFNTFASTMA

SEQ ID NO: 743013 - protein, 21 aa, Mycobacterium
VATASIFHWWTYADMARDTGA

SEQ ID NO: 743014 - protein, 26 aa, Mycobacterium
VATAWDIAARLGLRDRRLYAAANACV

SEQ ID NO: 743015 - protein, 18 aa, Mycobacterium
VATCGALMAAGRFSEVSR

SEQ ID NO: 743016 - protein, 19 aa, Mycobacterium
VATCGLMAVGHRVVHGGKD

SEQ ID NO: 743017 - protein, 23 aa, Mycobacterium
VATDHCPFCMVGQKELGIGNFSK

SEQ ID NO: 743018 - protein, 25 aa, Mycobacterium
VATDLRQDWPTALNAAGFEPNRASA

SEQ ID NO: 743019 - protein, 19 aa, Mycobacterium
VATEAGIDRPTVVRVLGAI

SEQ ID NO: 743020 - protein, 19 aa, Mycobacterium
VATEQGLEFFEVFCDTPLD

SEQ ID NO: 743021 - protein, 20 aa, Mycobacterium
VATEVPWASHADRIVVIRQS

SEQ ID NO: 743022 - protein, 26 aa, Mycobacterium
VATEWDRWPSSLAWSADASALIVTAD

SEQ ID NO: 743023 - protein, 19 aa, Mycobacterium
VATFMPKPFADRTGSGLHF

SEQ ID NO: 743024 - protein, 17 aa, Mycobacterium
VATFVVFLASDESRYST

SEQ ID NO: 743025 - protein, 19 aa, Mycobacterium
VATGKFFARNVLPRLSAQR

SEQ ID NO: 743026 - protein, 19 aa, Mycobacterium
VATGLGVPDAVKFGADGHL

SEQ ID NO: 743027 - protein, 25 aa, Mycobacterium
VATGLWRKFLFDRKRKSAGLPPHPS

SEQ ID NO: 743028 - protein, 22 aa, Mycobacterium
VATGRCPVLAPAGLLEHAVAEN

SEQ ID NO: 743029 - protein, 23 aa, Mycobacterium
VATGVWTRPFLSAHGIDMPIRVV

SEQ ID NO: 743030 - protein, 18 aa, Mycobacterium
VATGYRTDMTAVRTATYA

SEQ ID NO: 743031 - protein, 24 aa, Mycobacterium
VATIRIDQTFVRFFVTSTADAIHH

SEQ ID NO: 743032 - protein, 21 aa, Mycobacterium
VATIVPKPWLPGSLTQPDYEQ

SEQ ID NO: 743033 - protein, 25 aa, Mycobacterium
VATKATRVADGWVVSGQKVWTSDAV

SEQ ID NO: 743034 - protein, 23 aa, Mycobacterium
VATKLFAARGYHGTRMDDVADVI

SEQ ID NO: 743035 - protein, 19 aa, Mycobacterium
VATLGGFKAVHFKSVAKQA

SEQ ID NO: 743036 - protein, 24 aa, Mycobacterium
VATNEIRALMALPPGQQPDPSRLA

SEQ ID NO: 743037 - protein, 24 aa, Mycobacterium
VATNQTGTWLGMRAVIPHMVSQHG

SEQ ID NO: 743038 - protein, 23 aa, Mycobacterium
VATNVAAFRWGRVAIADPAHFHD

SEQ ID NO: 743039 - protein, 24 aa, Mycobacterium
VATPDGRHVWEFVPRGKTDLAALV

SEQ ID NO: 743040 - protein, 17 aa, Mycobacterium
VATPDIRAVAAALSAAG

SEQ ID NO: 743041 - protein, 20 aa, Mycobacterium
VATPHVRLLQGLAGQAEQAA

SEQ ID NO: 743042 - protein, 18 aa, Mycobacterium
VATQANWWQGKSLAQGRN

SEQ ID NO: 743043 - protein, 17 aa, Mycobacterium
VATRAAFGQVLNDVAPK

SEQ ID NO: 743044 - protein, 17 aa, Mycobacterium
VATRAEWDRALLEEDPD

SEQ ID NO: 743045 - protein, 26 aa, Mycobacterium
VATRAYPLLKRGIRINAICPGPTDTP

SEQ ID NO: 743046 - protein, 18 aa, Mycobacterium
VATRFLEVIGVDRADMSA

SEQ ID NO: 743047 - protein, 17 aa, Mycobacterium
VATRLSGLEPLNITDDS

SEQ ID NO: 743048 - protein, 17 aa, Mycobacterium
VATSFYGQLSCSVFNAA

SEQ ID NO: 743049 - protein, 24 aa, Mycobacterium
VATSRWWKEEREGVFVDFNQNAKD

SEQ ID NO: 743050 - protein, 26 aa, Mycobacterium
VATTCGRPFADFELRIDASDSGAAGE

SEQ ID NO: 743051 - protein, 26 aa, Mycobacterium
VATTCGRPFADFELRIDSGESGESGE

SEQ ID NO: 743052 - protein, 26 aa, Mycobacterium
VATTCGRPFADFELRIGPDTGEVLLR

SEQ ID NO: 743053 - protein, 25 aa, Mycobacterium
VATTCGRPFAGFELRIDAETGSETG

SEQ ID NO: 743054 - protein, 25 aa, Mycobacterium
VATTCGRPIADFELRLDDSGEVLLR

SEQ ID NO: 743055 - protein, 24 aa, Mycobacterium
VATTCGRPMLGYELRIDGAEKPGD

SEQ ID NO: 743056 - protein, 18 aa, Mycobacterium
VATTMALVRTFKELLRDK

SEQ ID NO: 743057 - protein, 22 aa, Mycobacterium
VATTRWPAVQFAIRNTPVQGPH

SEQ ID NO: 743058 - protein, 23 aa, Mycobacterium
VATVCADAGFLPRIRQEVSETST

SEQ ID NO: 743059 - protein, 20 aa, Mycobacterium
VATVIGCGEPQLVVRDGIAH

SEQ ID NO: 743060 - protein, 25 aa, Mycobacterium
VATVKRFTERFARYNLSSTAVRPSY

SEQ ID NO: 743061 - protein, 25 aa, Mycobacterium
VATVYERLWRPAAFYVASGVTTGAE

SEQ ID NO: 743062 - protein, 18 aa, Mycobacterium
VATYRAAAAAGRVTAVAT

SEQ ID NO: 743063 - protein, 29 aa, Mycobacterium
VAVAAFGRRVGRCGVGVFVAVGHHRQDRA

SEQ ID NO: 743064 - protein, 18 aa, Mycobacterium
VAVAAGWPSDDGGEFLDN

SEQ ID NO: 743065 - protein, 18 aa, Mycobacterium
VAVAAGWPTDEGGEFLDN

SEQ ID NO: 743066 - protein, 19 aa, Mycobacterium
VAVAARLAERAVAYRDLVM

SEQ ID NO: 743067 - protein, 26 aa, Mycobacterium
VAVACGIAGLAAWLPLTRHADVSRGE

SEQ ID NO: 743068 - protein, 24 aa, Mycobacterium
VAVADWIAMFSMWPVKSTPGTRCQ

SEQ ID NO: 743069 - protein, 17 aa, Mycobacterium
VAVAFPRSPFVTAAAAW

SEQ ID NO: 743070 - protein, 17 aa, Mycobacterium
VAVAFPRSPFVTAASAW

SEQ ID NO: 743071 - protein, 17 aa, Mycobacterium
VAVAFPRSPFVTAATAW

SEQ ID NO: 743072 - protein, 17 aa, Mycobacterium
VAVAGLVALPWSQDGRS

SEQ ID NO: 743073 - protein, 24 aa, Mycobacterium
VAVAHRLAGEWAFRRARREPPLAV

SEQ ID NO: 743074 - protein, 19 aa, Mycobacterium
VAVAIPFGMVGLVHPRSGL

SEQ ID NO: 743075 - protein, 18 aa, Mycobacterium
VAVAIWVDGQEFVKGYGV

SEQ ID NO: 743076 - protein, 19 aa, Mycobacterium
VAVAKRFPDKSVRSAHAVF

SEQ ID NO: 743077 - protein, 17 aa, Mycobacterium
VAVALGFADIAIGTDTA

SEQ ID NO: 743078 - protein, 18 aa, Mycobacterium
VAVANSFAEFVPGHTHLQ

SEQ ID NO: 743079 - protein, 20 aa, Mycobacterium
VAVAQGCDFMVVCGDVFESN

SEQ ID NO: 743080 - protein, 25 aa, Mycobacterium
VAVARLRLLCREFGITEIGAVSAST

SEQ ID NO: 743081 - protein, 23 aa, Mycobacterium
VAVARPLLPAAIESAAAVVDWLQ

SEQ ID NO: 743082 - protein, 17 aa, Mycobacterium
VAVAVCRQPVVAVGDVR

SEQ ID NO: 743083 - protein, 28 aa, Mycobacterium
VAVCDLLHRHGFVGAQAYLGVDGTVAGR

SEQ ID NO: 743084 - protein, 19 aa, Mycobacterium
VAVCIGWGGLRIADVEKRL

SEQ ID NO: 743085 - protein, 17 aa, Mycobacterium
VAVDFARAMLRKFDVDW

SEQ ID NO: 743086 - protein, 24 aa, Mycobacterium
VAVDLRDDWPAALKEAGFDAGRPT

SEQ ID NO: 743087 - protein, 26 aa, Mycobacterium
VAVDLRDDWPAALRAAGFDAATPTAW

SEQ ID NO: 743088 - protein, 23 aa, Mycobacterium
VAVDLRDDWPAALRAKGFDPTRP

SEQ ID NO: 743089 - protein, 24 aa, Mycobacterium
VAVDLRDDWPAALRDAGFDPAEPT

SEQ ID NO: 743090 - protein, 28 aa, Mycobacterium
VAVDLREDWPAALLRAGFDRDRPTAWLA

SEQ ID NO: 743091 - protein, 25 aa, Mycobacterium
VAVDLRHGWPKALSDTGFDRSRTTA

SEQ ID NO: 743092 - protein, 23 aa, Mycobacterium
VAVDLRQDWPKALTDAGFDAGSP

SEQ ID NO: 743093 - protein, 19 aa, Mycobacterium
VAVDLTLARGFRRNVVEHL

SEQ ID NO: 743094 - protein, 26 aa, Mycobacterium
VAVDMLEMLPTPWGLVRSGVAPDHPK

SEQ ID NO: 743095 - protein, 19 aa, Mycobacterium
VAVEAAVAQSWYKLVGDTG

SEQ ID NO: 743096 - protein, 23 aa, Mycobacterium
VAVEAGIAQCWHKLVGDTGKIVS

SEQ ID NO: 743097 - protein, 18 aa, Mycobacterium
VAVECPAGAMLVFDSTLW

SEQ ID NO: 743098 - protein, 17 aa, Mycobacterium
VAVERAILLAAFAGVAA

SEQ ID NO: 743099 - protein, 17 aa, Mycobacterium
VAVFRSDMILAHSDFAG

SEQ ID NO: 743100 - protein, 20 aa, Mycobacterium
VAVGDLHITMPISLRTKDDG

SEQ ID NO: 743101 - protein, 20 aa, Mycobacterium
VAVGDLHLTMPISLRTNTDD

SEQ ID NO: 743102 - protein, 17 aa, Mycobacterium
VAVGFTFDPHTHIARVI

SEQ ID NO: 743103 - protein, 18 aa, Mycobacterium
VAVGFTFDPRTHIARVIT

SEQ ID NO: 743104 - protein, 19 aa, Mycobacterium
VAVGPRPDKALHITALVER

SEQ ID NO: 743105 - protein, 19 aa, Mycobacterium
VAVGQAWNPLSVRGLRQLG

SEQ ID NO: 743106 - protein, 17 aa, Mycobacterium
VAVGRSGNSLGVELQAA

SEQ ID NO: 743107 - protein, 18 aa, Mycobacterium
VAVHAAAPCPVEVKQSMI

SEQ ID NO: 743108 - protein, 19 aa, Mycobacterium
VAVICKILGVPIEDEPKFH

SEQ ID NO: 743109 - protein, 25 aa, Mycobacterium
VAVIVALGGFAWRAALELIADRPKP

SEQ ID NO: 743110 - protein, 19 aa, Mycobacterium
VAVKDIYDVAGYRTGNGSL

SEQ ID NO: 743111 - protein, 20 aa, Mycobacterium
VAVKMALQFWRSGGHRAKSR

SEQ ID NO: 743112 - protein, 18 aa, Mycobacterium
VAVLALAALIHRHRTGAG

SEQ ID NO: 743113 - protein, 17 aa, Mycobacterium
VAVLAPRSPSDCFETAL

SEQ ID NO: 743114 - protein, 18 aa, Mycobacterium
VAVLKILALQFIMSDPRH

SEQ ID NO: 743115 - protein, 18 aa, Mycobacterium
VAVLKMLALQFIMSDHQH

SEQ ID NO: 743116 - protein, 18 aa, Mycobacterium
VAVLKMLALQFIMSDPKH

SEQ ID NO: 743117 - protein, 23 aa, Mycobacterium
VAVLLRITEVFGVDATFFSPQDD

SEQ ID NO: 743118 - protein, 22 aa, Mycobacterium
VAVLLRITEVFGVDATFFSSQD

SEQ ID NO: 743119 - protein, 19 aa, Mycobacterium
VAVLRAMRALDIVGADVVE

SEQ ID NO: 743120 - protein, 19 aa, Mycobacterium
VAVLRAMRGLNIVGADIVE

SEQ ID NO: 743121 - protein, 17 aa, Mycobacterium
VAVLRKVTAAPFGNVRV

SEQ ID NO: 743122 - protein, 39 aa, Mycobacterium
VAVLRVAEPLAAYKSQLQRCASFTFSGPDQIQSTVTASE

SEQ ID NO: 743123 - protein, 17 aa, Mycobacterium
VAVLTARHRIVAALGRR

SEQ ID NO: 743124 - protein, 17 aa, Mycobacterium
VAVLVALGRQLAAVPYL

SEQ ID NO: 743125 - protein, 20 aa, Mycobacterium
VAVLVSVELCSLTHKHTPSM

SEQ ID NO: 743126 - protein, 18 aa, Mycobacterium
VAVMWGMGFYAGYVGRSE

SEQ ID NO: 743127 - protein, 17 aa, Mycobacterium
VAVNCTEPGGLCFCASM

SEQ ID NO: 743128 - protein, 21 aa, Mycobacterium
VAVNFPLYVILSLLGLPESDF

SEQ ID NO: 743129 - protein, 18 aa, Mycobacterium
VAVNPLFLVLSGGGPDVK

SEQ ID NO: 743130 - protein, 19 aa, Mycobacterium
VAVNVEWGLDEILLPSTGP

SEQ ID NO: 743131 - protein, 19 aa, Mycobacterium
VAVPAERLYRLPVQVDPLA

SEQ ID NO: 743132 - protein, 18 aa, Mycobacterium
VAVPGCYPTAALLALSPA

SEQ ID NO: 743133 - protein, 17 aa, Mycobacterium
VAVPSIIDSGGVMGTIP

SEQ ID NO: 743134 - protein, 17 aa, Mycobacterium
VAVPTLILHRDNPDFSP

SEQ ID NO: 743135 - protein, 21 aa, Mycobacterium
VAVQLGYDFLPGTTVNRYCSS

SEQ ID NO: 743136 - protein, 19 aa, Mycobacterium
VAVRAAERLIPASLELGGK

SEQ ID NO: 743137 - protein, 25 aa, Mycobacterium
VAVRCELWGGCAWINLDDDAPALRD

SEQ ID NO: 743138 - protein, 22 aa, Mycobacterium
VAVRGFPNYFFITGPDAAAQGR

SEQ ID NO: 743139 - protein, 21 aa, Mycobacterium
VAVRGFPNYFFITGPDPDAQA

SEQ ID NO: 743140 - protein, 25 aa, Mycobacterium
VAVRGLRLGTGVSELGNRDRVLGER

SEQ ID NO: 743141 - protein, 29 aa, Mycobacterium
VAVRIWRPRWAAWGLHVVRSGGLIRDGIP

SEQ ID NO: 743142 - protein, 39 aa, Mycobacterium
VAVRLPAHWQTAGVLLGIWWAGAELVFGDASTDVAFCTL

SEQ ID NO: 743143 - protein, 17 aa, Mycobacterium
VAVRLRATRTIRRPPRC

SEQ ID NO: 743144 - protein, 26 aa, Mycobacterium
VAVRPEPFGALLYHFGTRKLSFLKNR

SEQ ID NO: 743145 - protein, 18 aa, Mycobacterium
VAVRPEWPELVQAMKEIL

SEQ ID NO: 743146 - protein, 32 aa, Mycobacterium
VAVRPQRRLGRRSNVYTTEWDHVQGLTPAGLA

SEQ ID NO: 743147 - protein, 18 aa, Mycobacterium
VAVRPTGPLVLWASQTGN

SEQ ID NO: 743148 - protein, 20 aa, Mycobacterium
VAVRTDGRWLLASSQNTTHR

SEQ ID NO: 743149 - protein, 17 aa, Mycobacterium
VAVRWTLKRVAARVHSR

SEQ ID NO: 743150 - protein, 19 aa, Mycobacterium
VAVSASFLWAPDPGPVQLV

SEQ ID NO: 743151 - protein, 18 aa, Mycobacterium
VAVSCRFPGAPDPEAFWD

SEQ ID NO: 743152 - protein, 17 aa, Mycobacterium
VAVSCRFPGAPDPESFW

SEQ ID NO: 743153 - protein, 18 aa, Mycobacterium
VAVSCRFPGAPNPEAFWD

SEQ ID NO: 743154 - protein, 17 aa, Mycobacterium
VAVSGLVALPWSQDGRS

SEQ ID NO: 743155 - protein, 17 aa, Mycobacterium
VAVSMGQLNEPWPDVRD

SEQ ID NO: 743156 - protein, 23 aa, Mycobacterium
VAVSRGCRVRLHPSRRADAQDLF

SEQ ID NO: 743157 - protein, 18 aa, Mycobacterium
VAVSRWTVALAEAGWGDT

SEQ ID NO: 743158 - protein, 18 aa, Mycobacterium
VAVSSVYAHRARTGRVAY

SEQ ID NO: 743159 - protein, 17 aa, Mycobacterium
VAVSWLPPHHDMGLISM

SEQ ID NO: 743160 - protein, 29 aa, Mycobacterium
VAVTDSQIWLSGGGRTWSVQKVREEPVRP

SEQ ID NO: 743161 - protein, 17 aa, Mycobacterium
VAVTRWTVRLTETGWGN

SEQ ID NO: 743162 - protein, 18 aa, Mycobacterium
VAVTWDDLVELLGGELRR

SEQ ID NO: 743163 - protein, 20 aa, Mycobacterium
VAVVARLAERAALYRDVVMA

SEQ ID NO: 743164 - protein, 18 aa, Mycobacterium
VAVVARLAERAVAYRDLV

SEQ ID NO: 743165 - protein, 19 aa, Mycobacterium
VAVVARLAERAVVYRDLVM

SEQ ID NO: 743166 - protein, 17 aa, Mycobacterium
VAVVCKSLFGKAHTVMA

SEQ ID NO: 743167 - protein, 17 aa, Mycobacterium
VAVVPKSTALVVWQPRR

SEQ ID NO: 743168 - protein, 19 aa, Mycobacterium
VAVWQLLMERHFPHTGWLR

SEQ ID NO: 743169 - protein, 17 aa, Mycobacterium
VAVYFDFDNIVISRYDQ

SEQ ID NO: 743170 - protein, 17 aa, Mycobacterium
VAVYFDFDNIVISRYEQ

SEQ ID NO: 743171 - protein, 25 aa, Mycobacterium
VAVYLCGPPPMVEAVRTHLTNSGVT

SEQ ID NO: 743172 - protein, 23 aa, Mycobacterium
VAVYRASAAFLREFAQTLQDELG

SEQ ID NO: 743173 - protein, 17 aa, Mycobacterium
VAWASAYRRGSYGETSL

SEQ ID NO: 743174 - protein, 19 aa, Mycobacterium
VAWGKRADGAVARVGGWGY

SEQ ID NO: 743175 - protein, 34 aa, Mycobacterium
VAWGSARPDQVWAVLSGVVAWAAAKGTRDAWNTA

SEQ ID NO: 743176 - protein, 25 aa, Mycobacterium
VAWHRARGSGMPDLNELVRRGITDA

SEQ ID NO: 743177 - protein, 26 aa, Mycobacterium
VAWLANRLAPHGVWLERGEVILSGSF

SEQ ID NO: 743178 - protein, 24 aa, Mycobacterium
VAWLARKVASFGVRLRAGDVVLPG

SEQ ID NO: 743179 - protein, 23 aa, Mycobacterium
VAWNENYGGFWFLSSYDAVSRTA

SEQ ID NO: 743180 - protein, 19 aa, Mycobacterium
VAWPAATGHRRFGTWHYWW

SEQ ID NO: 743181 - protein, 19 aa, Mycobacterium
VAWPPARKYTLFGTWHYWW

SEQ ID NO: 743182 - protein, 21 aa, Mycobacterium
VAWSRVRYRNYAFIRVDVRPG

SEQ ID NO: 743183 - protein, 19 aa, Mycobacterium
VAYALAGTMDFDFDQQPLG

SEQ ID NO: 743184 - protein, 19 aa, Mycobacterium
VAYALAGTMDFDFENQPLG

SEQ ID NO: 743185 - protein, 24 aa, Mycobacterium
VAYALAGTMDFDFESQKLGTDKDG

SEQ ID NO: 743186 - protein, 17 aa, Mycobacterium
VAYALGLQGPAITIDTA

SEQ ID NO: 743187 - protein, 23 aa, Mycobacterium
VAYELDCLIFATGFEVGTDYCHR

SEQ ID NO: 743188 - protein, 21 aa, Mycobacterium
VAYEVQCRFSAQVPVMARGLN

SEQ ID NO: 743189 - protein, 18 aa, Mycobacterium
VAYGYPGAPGQWWQQQVI

SEQ ID NO: 743190 - protein, 18 aa, Mycobacterium
VAYGYPGAPGQWWQQQVV

SEQ ID NO: 743191 - protein, 24 aa, Mycobacterium
VAYILGHSGARGFIVEAGLAATAE

SEQ ID NO: 743192 - protein, 22 aa, Mycobacterium
VAYRLGRSAARMEAALSAPSIF

SEQ ID NO: 743193 - protein, 19 aa, Mycobacterium
VAYTLAALVGQLAHRRLST

SEQ ID NO: 743194 - protein, 17 aa, Mycobacterium
VCADLGLEAGRVDGRSG

SEQ ID NO: 743195 - protein, 19 aa, Mycobacterium
VCADLRSGSGRALVLRGEP

SEQ ID NO: 743196 - protein, 24 aa, Mycobacterium
VCAELLARLAPPAGYRDDVVVLAL

SEQ ID NO: 743197 - protein, 23 aa, Mycobacterium
VCAELLHRMCPAEGYRDDVVVLA

SEQ ID NO: 743198 - protein, 21 aa, Mycobacterium
VCALMAGGGYAERVNVAATQV

SEQ ID NO: 743199 - protein, 21 aa, Mycobacterium
VCANAGIAAMAFRELTIEEDL

SEQ ID NO: 743200 - protein, 21 aa, Mycobacterium
VCANAGIAPVAFRELSIEEEL

SEQ ID NO: 743201 - protein, 21 aa, Mycobacterium
VCANAGIFPSGRLEDLTPDDI

SEQ ID NO: 743202 - protein, 17 aa, Mycobacterium
VCANCNGAGVVSRNQGA

SEQ ID NO: 743203 - protein, 21 aa, Mycobacterium
VCAPGSRLLVDYIDAGVATAT

SEQ ID NO: 743204 - protein, 19 aa, Mycobacterium
VCASDRWAYVPALEQVAAW

SEQ ID NO: 743205 - protein, 20 aa, Mycobacterium
VCAVDMPYLSAELIDTLVDP

SEQ ID NO: 743206 - protein, 20 aa, Mycobacterium
VCAVSGLPWIDHLVGDPQNY

SEQ ID NO: 743207 - protein, 20 aa, Mycobacterium
VCAVSGLPWIERLIGDPQNY

SEQ ID NO: 743208 - protein, 21 aa, Mycobacterium
VCAYCGVGCGIVLQTTTDPQT

SEQ ID NO: 743209 - protein, 19 aa, Mycobacterium
VCDAGWKYLSTGAYAGSLD

SEQ ID NO: 743210 - protein, 25 aa, Mycobacterium
VCDLADRPAFRVAMVRTAENRHRLV

SEQ ID NO: 743211 - protein, 23 aa, Mycobacterium
VCDLVATLLRQGRSVVDLLDELA

SEQ ID NO: 743212 - protein, 20 aa, Mycobacterium
VCDPKGSSFAVHNQYQEFGL

SEQ ID NO: 743213 - protein, 25 aa, Mycobacterium
VCDRLSRMREAFIARRERFKKDLAC

SEQ ID NO: 743214 - protein, 17 aa, Mycobacterium
VCDVNFMGFFPGLNDVV

SEQ ID NO: 743215 - protein, 41 aa, Mycobacterium
VCEHFGRPAIDMLTWQMALCRPLWRCYGKILECDLRAPQDW

SEQ ID NO: 743216 - protein, 24 aa, Mycobacterium
VCEHIARATPWWEPGTAQGYHMAT

SEQ ID NO: 743217 - protein, 17 aa, Mycobacterium
VCELTWQLKGQATGRQV

SEQ ID NO: 743218 - protein, 19 aa, Mycobacterium
VCEPFLVRAGMLARTPRGR

SEQ ID NO: 743219 - protein, 17 aa, Mycobacterium
VCERGECDFVRDIAAPL

SEQ ID NO: 743220 - protein, 18 aa, Mycobacterium
VCEVPGWGHQLDRQRVLS

SEQ ID NO: 743221 - protein, 17 aa, Mycobacterium
VCGAGMVRVPARTVEVI

SEQ ID NO: 743222 - protein, 17 aa, Mycobacterium
VCGAIEIGIKWLSLYAF

SEQ ID NO: 743223 - protein, 22 aa, Mycobacterium
VCGALRRYHEAHGLPISTLPMA

SEQ ID NO: 743224 - protein, 18 aa, Mycobacterium
VCGDEVTLRVTLSNDGAT

SEQ ID NO: 743225 - protein, 25 aa, Mycobacterium
VCGDISVPVTFPLGRFGWAPTVQLT

SEQ ID NO: 743226 - protein, 23 aa, Mycobacterium
VCGDLDPRLAVIAMGKCGARELN

SEQ ID NO: 743227 - protein, 19 aa, Mycobacterium
VCGDRRLVTLDGPEVGALA

SEQ ID NO: 743228 - protein, 23 aa, Mycobacterium
VCGDRTPPRLAVIAMGKCGAREL

SEQ ID NO: 743229 - protein, 26 aa, Mycobacterium
VCGGADLAAMAGFCAQAAVRRTPVLL

SEQ ID NO: 743230 - protein, 20 aa, Mycobacterium
VCGGGHGFLSKALLAGVPTV

SEQ ID NO: 743231 - protein, 28 aa, Mycobacterium
VCGHKKSFVCGFHGWTYDQDGNCIHIPE

SEQ ID NO: 743232 - protein, 18 aa, Mycobacterium
VCGIYCATANPVEVIVAV

SEQ ID NO: 743233 - protein, 19 aa, Mycobacterium
VCGLSEPFQDVRTGPERFR

SEQ ID NO: 743234 - protein, 17 aa, Mycobacterium
VCGRAGAVTDRHLRDGV

SEQ ID NO: 743235 - protein, 17 aa, Mycobacterium
VCGRAKELITIAGRNIF

SEQ ID NO: 743236 - protein, 24 aa, Mycobacterium
VCGRVKELITIAGRNIFPTEVERV

SEQ ID NO: 743237 - protein, 18 aa, Mycobacterium
VCGSCNGSGVINRNQGAF

SEQ ID NO: 743238 - protein, 20 aa, Mycobacterium
VCGSLRDGDQLVLGASNPVR

SEQ ID NO: 743239 - protein, 20 aa, Mycobacterium
VCGTAVWFLNFSTWTGHHGI

SEQ ID NO: 743240 - protein, 18 aa, Mycobacterium
VCGTLRLVAEDAEVDGYV

SEQ ID NO: 743241 - protein, 20 aa, Mycobacterium
VCGTPRIVVADVEFAGYLFP

SEQ ID NO: 743242 - protein, 17 aa, Mycobacterium
VCGTSVYVYPFDVADEV

SEQ ID NO: 743243 - protein, 22 aa, Mycobacterium
VCGVDPSWSVAFGVRAGGAATE

SEQ ID NO: 743244 - protein, 25 aa, Mycobacterium
VCGVPAETFLQVARAWAENSGRERT

SEQ ID NO: 743245 - protein, 17 aa, Mycobacterium
VCHARKPACGVCLIAKD

SEQ ID NO: 743246 - protein, 19 aa, Mycobacterium
VCHCGGLIRPDIVWFGEPL

SEQ ID NO: 743247 - protein, 18 aa, Mycobacterium
VCHCGGLIRPDIVWFGEQ

SEQ ID NO: 743248 - protein, 24 aa, Mycobacterium
VCHSMGGLVARWYISCEGGAELTR

SEQ ID NO: 743249 - protein, 25 aa, Mycobacterium
VCIGLDLSGPMLRRAVRDNSAERVD

SEQ ID NO: 743250 - protein, 18 aa, Mycobacterium
VCIIPGPAAVAGITRLDE

SEQ ID NO: 743251 - protein, 18 aa, Mycobacterium
VCIIPGPAAVAGITRMDE

SEQ ID NO: 743252 - protein, 24 aa, Mycobacterium
VCILDRPRHAKLIADVRAAGARIR

SEQ ID NO: 743253 - protein, 22 aa, Mycobacterium
VCILDRPRHAKLMEEVRSAGAR

SEQ ID NO: 743254 - protein, 20 aa, Mycobacterium
VCILDRPRHGELIQNVRETG

SEQ ID NO: 743255 - protein, 17 aa, Mycobacterium
VCIQNAYNLLNRTGADV

SEQ ID NO: 743256 - protein, 18 aa, Mycobacterium
VCIQRRQGFEQALTSLVP

SEQ ID NO: 743257 - protein, 18 aa, Mycobacterium
VCKNVLRAQELIADDFGP

SEQ ID NO: 743258 - protein, 21 aa, Mycobacterium
VCKTHCGIPSFASSASLGIAA

SEQ ID NO: 743259 - protein, 26 aa, Mycobacterium
VCMGAGYCYRSYPQLFAAAADGTSLA

SEQ ID NO: 743260 - protein, 21 aa, Mycobacterium
VCMRMTLSGFYSHPWAWNEIG

SEQ ID NO: 743261 - protein, 19 aa, Mycobacterium
VCNGETLKSLSARQRRRAV

SEQ ID NO: 743262 - protein, 19 aa, Mycobacterium
VCNTCPVRAQCLNHAIEHD

SEQ ID NO: 743263 - protein, 17 aa, Mycobacterium
VCPALHMPLQSGSDPVL

SEQ ID NO: 743264 - protein, 19 aa, Mycobacterium
VCPDCGNKGQWTEPRDFNM

SEQ ID NO: 743265 - protein, 27 aa, Mycobacterium
VCPGNIPIQSPGPWRRSGAGQPAGTLV

SEQ ID NO: 743266 - protein, 19 aa, Mycobacterium
VCPHCRRSAEATVEYNYDN

SEQ ID NO: 743267 - protein, 26 aa, Mycobacterium
VCPICRKEQLTIVSWVFGEHLGAISG

SEQ ID NO: 743268 - protein, 18 aa, Mycobacterium
VCPLPLRETKRIVMGHGG

SEQ ID NO: 743269 - protein, 20 aa, Mycobacterium
VCPLRLRDSEGWPLYPIRPG

SEQ ID NO: 743270 - protein, 18 aa, Mycobacterium
VCPNCNGAGVVNRNQGAF

SEQ ID NO: 743271 - protein, 18 aa, Mycobacterium
VCPTCNGAGVINRNQGAF

SEQ ID NO: 743272 - protein, 24 aa, Mycobacterium
VCPVPPPRELDMLLTAGERISNAL

SEQ ID NO: 743273 - protein, 23 aa, Mycobacterium
VCQATLFRWKRQALIDAGVIEGT

SEQ ID NO: 743274 - protein, 22 aa, Mycobacterium
VCQAVGAAAWGLRLAVGATASG

SEQ ID NO: 743275 - protein, 23 aa, Mycobacterium
VCQDFAHLSLIMLRGMGIPARYV

SEQ ID NO: 743276 - protein, 19 aa, Mycobacterium
VCQQLSWGAPPSQLEGLAL

SEQ ID NO: 743277 - protein, 25 aa, Mycobacterium
VCQREFDDGAYIRPILDDMHMHRLE

SEQ ID NO: 743278 - protein, 18 aa, Mycobacterium
VCQRRWGPKQVIDLRPDY

SEQ ID NO: 743279 - protein, 20 aa, Mycobacterium
VCRAVSRLSYDGRLLSYETV

SEQ ID NO: 743280 - protein, 17 aa, Mycobacterium
VCRLAYELAPHIRVNGV

SEQ ID NO: 743281 - protein, 23 aa, Mycobacterium
VCRNRLRIACNLGAESVQVPVTG

SEQ ID NO: 743282 - protein, 17 aa, Mycobacterium
VCRSCGVIADIDCAVGA

SEQ ID NO: 743283 - protein, 17 aa, Mycobacterium
VCRSCGVIADIDCAVGD

SEQ ID NO: 743284 - protein, 17 aa, Mycobacterium
VCRSEAMALPGTQDLVD

SEQ ID NO: 743285 - protein, 19 aa, Mycobacterium
VCRTDLHILEGQWAEKSQV

SEQ ID NO: 743286 - protein, 25 aa, Mycobacterium
VCRTVRLVPLRGRREVHGLTLDPPG

SEQ ID NO: 743287 - protein, 18 aa, Mycobacterium
VCRVARDAGADFVKTSTG

SEQ ID NO: 743288 - protein, 17 aa, Mycobacterium
VCSCKLPCPCSFAQAPT

SEQ ID NO: 743289 - protein, 19 aa, Mycobacterium
VCSEPAPTFEQWLGSPLVN

SEQ ID NO: 743290 - protein, 20 aa, Mycobacterium
VCSIRVWAYQIADLATDYRV

SEQ ID NO: 743291 - protein, 34 aa, Mycobacterium
VCSRESIVPYALRGLLFCAACGRRMQGAARVGKQ

SEQ ID NO: 743292 - protein, 17 aa, Mycobacterium
VCTARAPRCGVCPLTHC

SEQ ID NO: 743293 - protein, 18 aa, Mycobacterium
VCTCRRSKTYPLCDTSHR

SEQ ID NO: 743294 - protein, 25 aa, Mycobacterium
VCTGAPVWHPLSGKLLAVVTVSTML

SEQ ID NO: 743295 - protein, 25 aa, Mycobacterium
VCTLCSCYPRPILGNSPEWYRTPNY

SEQ ID NO: 743296 - protein, 17 aa, Mycobacterium
VCTRAAGVVDGREAIIV

SEQ ID NO: 743297 - protein, 17 aa, Mycobacterium
VCTSEFITFASMQQQFA

SEQ ID NO: 743298 - protein, 21 aa, Mycobacterium
VCTSTIWARRVLAGGPFPDVD

SEQ ID NO: 743299 - protein, 19 aa, Mycobacterium
VCTVSIWMGILLTEKLRAA

SEQ ID NO: 743300 - protein, 17 aa, Mycobacterium
VCVDLGVVAAFDQDLDR

SEQ ID NO: 743301 - protein, 26 aa, Mycobacterium
VCVERGKRTLVEFGGYLGSNFLDDRA

SEQ ID NO: 743302 - protein, 17 aa, Mycobacterium
VCVGYTVDGKRVDEMPM

SEQ ID NO: 743303 - protein, 18 aa, Mycobacterium
VCVPDCEAAVAFYRDVLG

SEQ ID NO: 743304 - protein, 21 aa, Mycobacterium
VCVSHQLPVWTLRLHLTGRRL

SEQ ID NO: 743305 - protein, 21 aa, Mycobacterium
VCVSHQLPVWTLRLHVTGRRL

SEQ ID NO: 743306 - protein, 26 aa, Mycobacterium
VCVSKDLPFAFARFCGAEGIENVTTA

SEQ ID NO: 743307 - protein, 17 aa, Mycobacterium
VCVSSHFVPGQHAGMPC

SEQ ID NO: 743308 - protein, 17 aa, Mycobacterium
VCVSSKDDLMWLVCQRR

SEQ ID NO: 743309 - protein, 21 aa, Mycobacterium
VCVTCSDEGRPGEAVTASADG

SEQ ID NO: 743310 - protein, 20 aa, Mycobacterium
VCVTHMRRSVGIRDRGGDVI

SEQ ID NO: 743311 - protein, 20 aa, Mycobacterium
VCVVRAVIPPGVTVPLHSHD

SEQ ID NO: 743312 - protein, 17 aa, Mycobacterium
VCWAAAPDRDWDGSRIC

SEQ ID NO: 743313 - protein, 20 aa, Mycobacterium
VCWPSRIPREGGIRSQFTHC

SEQ ID NO: 743314 - protein, 22 aa, Mycobacterium
VCWYAPELRAVFSGDTLFQGGP

SEQ ID NO: 743315 - protein, 18 aa, Mycobacterium
VCYKLWEASWEPGAVVRD

SEQ ID NO: 743316 - protein, 21 aa, Mycobacterium
VCYRHPHRYLTIIGDHDTGTV

SEQ ID NO: 743317 - protein, 17 aa, Mycobacterium
VDAAACERLGLVNRVAA

SEQ ID NO: 743318 - protein, 29 aa, Mycobacterium
VDAAAPGARLAWRDDARWAPHGGESRVDV

SEQ ID NO: 743319 - protein, 17 aa, Mycobacterium
VDAAGWRAIDAAEIARG

SEQ ID NO: 743320 - protein, 19 aa, Mycobacterium
VDAAHLLGDRIAWLHEIDE

SEQ ID NO: 743321 - protein, 21 aa, Mycobacterium
VDAAIAFYSQLFGWRIDFLDG

SEQ ID NO: 743322 - protein, 18 aa, Mycobacterium
VDAAIAIHDERFVNPSAY

SEQ ID NO: 743323 - protein, 19 aa, Mycobacterium
VDAAIARAYARFQDYRRNT

SEQ ID NO: 743324 - protein, 17 aa, Mycobacterium
VDAALAIALDPDADRCA

SEQ ID NO: 743325 - protein, 22 aa, Mycobacterium
VDAALRAGRRIVLAGPIVDDHF

SEQ ID NO: 743326 - protein, 22 aa, Mycobacterium
VDAARVRLRLGAAAVAAGIAGA

SEQ ID NO: 743327 - protein, 18 aa, Mycobacterium
VDAAVFFDRFIARVGTFA

SEQ ID NO: 743328 - protein, 22 aa, Mycobacterium
VDACAGGCLIFSAQHRQLLRGI

SEQ ID NO: 743329 - protein, 17 aa, Mycobacterium
VDACHAKGLGVLIDAVF

SEQ ID NO: 743330 - protein, 18 aa, Mycobacterium
VDADAFWAGVDKVVTDLA

SEQ ID NO: 743331 - protein, 27 aa, Mycobacterium
VDADEALRMGLVWRVCDPEDLLPEARR

SEQ ID NO: 743332 - protein, 28 aa, Mycobacterium
VDADEALRMGLVWRVCQPDELLPQARHH

SEQ ID NO: 743333 - protein, 24 aa, Mycobacterium
VDADLAADILRWGPQSAKKTEAAI

SEQ ID NO: 743334 - protein, 25 aa, Mycobacterium
VDADLAADILRWGPQSAKKTEAAID

SEQ ID NO: 743335 - protein, 24 aa, Mycobacterium
VDADLAWQPELWRALVAAVAAEPP

SEQ ID NO: 743336 - protein, 19 aa, Mycobacterium
VDADLTGLGPFLLQVGSQE

SEQ ID NO: 743337 - protein, 24 aa, Mycobacterium
VDADMSGLFAAEWSALQAVVQKPI

SEQ ID NO: 743338 - protein, 21 aa, Mycobacterium
VDADRGAGVTQEFRPCQPEGD

SEQ ID NO: 743339 - protein, 18 aa, Mycobacterium
VDADRPFVEYGLDSLGML

SEQ ID NO: 743340 - protein, 17 aa, Mycobacterium
VDAEAGLLLRYDDGRTA

SEQ ID NO: 743341 - protein, 23 aa, Mycobacterium
VDAEFRVGTMGLGWDAEANSVVV

SEQ ID NO: 743342 - protein, 23 aa, Mycobacterium
VDAEFRVGTMGLGWDSEAQTVVV

SEQ ID NO: 743343 - protein, 24 aa, Mycobacterium
VDAEFRVGTMGLGWDSEAQTVVVE

SEQ ID NO: 743344 - protein, 21 aa, Mycobacterium
VDAELAAAVPAHVARAVDRLD

SEQ ID NO: 743345 - protein, 27 aa, Mycobacterium
VDAELLRPPINVMRLCLHPRGLAQRLL

SEQ ID NO: 743346 - protein, 17 aa, Mycobacterium
VDAELMSALPNLGAVVN

SEQ ID NO: 743347 - protein, 24 aa, Mycobacterium
VDAERRALAALGWDDRHGDRHTAM

SEQ ID NO: 743348 - protein, 32 aa, Mycobacterium
VDAESASQAMVWKRPRWSARLQRDPVADLLTE

SEQ ID NO: 743349 - protein, 25 aa, Mycobacterium
VDAEVAYQIAMRFCERELDLPPKKA

SEQ ID NO: 743350 - protein, 20 aa, Mycobacterium
VDAFFDRRLDLIQRIENMGK

SEQ ID NO: 743351 - protein, 19 aa, Mycobacterium
VDAFFSAAFFLLGVYGVLT

SEQ ID NO: 743352 - protein, 26 aa, Mycobacterium
VDAFKADVIDLIRTSQDWWPADYGNY

SEQ ID NO: 743353 - protein, 17 aa, Mycobacterium
VDAFWSQVMRLRDLLKF

SEQ ID NO: 743354 - protein, 18 aa, Mycobacterium
VDAGCPIRRIPDYDEWLS

SEQ ID NO: 743355 - protein, 26 aa, Mycobacterium
VDAGGWDVRFPFLMDLATYCAVLLHS

SEQ ID NO: 743356 - protein, 17 aa, Mycobacterium
VDAGLARLLGLSRTAAA

SEQ ID NO: 743357 - protein, 23 aa, Mycobacterium
VDAGLPLAVFPAGTFNHFAKDIG

SEQ ID NO: 743358 - protein, 28 aa, Mycobacterium
VDAGLPLTLWLARFLKFIQTEIFPGGHP

SEQ ID NO: 743359 - protein, 23 aa, Mycobacterium
VDAGRVMAALGFEDREVLREGIA

SEQ ID NO: 743360 - protein, 24 aa, Mycobacterium
VDAGRWKPVMADLVPHVSDMVCSG

SEQ ID NO: 743361 - protein, 24 aa, Mycobacterium
VDAGWLGRRVFAMPMTGGGYAEYV

SEQ ID NO: 743362 - protein, 26 aa, Mycobacterium
VDAHAPGARLAWREDATWAPHGGESR

SEQ ID NO: 743363 - protein, 17 aa, Mycobacterium
VDAHMKVIMTGGVVRSK

SEQ ID NO: 743364 - protein, 20 aa, Mycobacterium
VDAHQAIPVIRAFTHFALLA

SEQ ID NO: 743365 - protein, 19 aa, Mycobacterium
VDAIADSFAPYSFTDFHLT

SEQ ID NO: 743366 - protein, 18 aa, Mycobacterium
VDAIPALIAPVASIESVL

SEQ ID NO: 743367 - protein, 23 aa, Mycobacterium
VDAIPVPGAIPMPAVAGAPGAPM

SEQ ID NO: 743368 - protein, 19 aa, Mycobacterium
VDAIREWLRREDTCLLLAP

SEQ ID NO: 743369 - protein, 18 aa, Mycobacterium
VDAIVKWIADRENATPTA

SEQ ID NO: 743370 - protein, 20 aa, Mycobacterium
VDAKAAKWCAAFFGSTAAGW

SEQ ID NO: 743371 - protein, 19 aa, Mycobacterium
VDAKGRFDASVPDYAGQHV

SEQ ID NO: 743372 - protein, 18 aa, Mycobacterium
VDAKGRFDASVPDYQGQR

SEQ ID NO: 743373 - protein, 18 aa, Mycobacterium
VDAKGRFDATVADYQGQH

SEQ ID NO: 743374 - protein, 26 aa, Mycobacterium
VDAKGRLRIAAAVGINGDVGAKAQAL

SEQ ID NO: 743375 - protein, 18 aa, Mycobacterium
VDAKLWVDMAHFAGLVAA

SEQ ID NO: 743376 - protein, 23 aa, Mycobacterium
VDALAALLVSRPTQFDVIVAENM

SEQ ID NO: 743377 - protein, 20 aa, Mycobacterium
VDALAARLAAIVEQAEGATQ

SEQ ID NO: 743378 - protein, 20 aa, Mycobacterium
VDALATWLAVKSVVGEDGAF

SEQ ID NO: 743379 - protein, 19 aa, Mycobacterium
VDALATWVALKAVVGQDGA

SEQ ID NO: 743380 - protein, 18 aa, Mycobacterium
VDALATWVALKTVVGEDG

SEQ ID NO: 743381 - protein, 26 aa, Mycobacterium
VDALCARFRISGLPVVDDDGALVGII

SEQ ID NO: 743382 - protein, 26 aa, Mycobacterium
VDALCARFRISGLPVVDESGALVGII

SEQ ID NO: 743383 - protein, 17 aa, Mycobacterium
VDALDRFGGDHDGLKAA

SEQ ID NO: 743384 - protein, 17 aa, Mycobacterium
VDALILLLNGYVGYATG

SEQ ID NO: 743385 - protein, 22 aa, Mycobacterium
VDALRARGYRVGVLDMAGRADA

SEQ ID NO: 743386 - protein, 18 aa, Mycobacterium
VDALRQCVPLVSRIRDYA

SEQ ID NO: 743387 - protein, 26 aa, Mycobacterium
VDAMCARFRISGLPVVDDKGSLVGII

SEQ ID NO: 743388 - protein, 26 aa, Mycobacterium
VDAMCARFRISGLPVVDDTGELVGII

SEQ ID NO: 743389 - protein, 19 aa, Mycobacterium
VDAMCPLGPILGGAGLNIT

SEQ ID NO: 743390 - protein, 18 aa, Mycobacterium
VDAMNAFGIDRRREPMLV

SEQ ID NO: 743391 - protein, 17 aa, Mycobacterium
VDANVWRHLAPKGWFYN

SEQ ID NO: 743392 - protein, 18 aa, Mycobacterium
VDAPAPTDAASWVSADQQ

SEQ ID NO: 743393 - protein, 17 aa, Mycobacterium
VDAPARVAERRRRLLEA

SEQ ID NO: 743394 - protein, 18 aa, Mycobacterium
VDAPEPLSEYVLGLARHI

SEQ ID NO: 743395 - protein, 21 aa, Mycobacterium
VDAPGGRRFSILPLSARTPAA

SEQ ID NO: 743396 - protein, 18 aa, Mycobacterium
VDAPLLLNLVIGGLTPDQ

SEQ ID NO: 743397 - protein, 19 aa, Mycobacterium
VDAPLPVWANRRLLLATAD

SEQ ID NO: 743398 - protein, 23 aa, Mycobacterium
VDAPPAKVWRVLHPPAPPDAPRP

SEQ ID NO: 743399 - protein, 23 aa, Mycobacterium
VDAPTCPVALAFPEGPQSELLEE

SEQ ID NO: 743400 - protein, 23 aa, Mycobacterium
VDAQALAPTGAWVRYDGEGRPPV

SEQ ID NO: 743401 - protein, 26 aa, Mycobacterium
VDAQRALELPVRMGLATGEAEPHDAD

SEQ ID NO: 743402 - protein, 26 aa, Mycobacterium
VDAQSRFGWHRGMLIPGARMQVSFLK

SEQ ID NO: 743403 - protein, 21 aa, Mycobacterium
VDARAAGIMITDRVRPRRLGH

SEQ ID NO: 743404 - protein, 20 aa, Mycobacterium
VDARAWLRDATPLWRTNVDG

SEQ ID NO: 743405 - protein, 23 aa, Mycobacterium
VDAREAWLRNGPRAAALPPSGTG

SEQ ID NO: 743406 - protein, 17 aa, Mycobacterium
VDARKYLPAAWADVSLA

SEQ ID NO: 743407 - protein, 19 aa, Mycobacterium
VDARLAACVYTREHGEDDP

SEQ ID NO: 743408 - protein, 17 aa, Mycobacterium
VDARLSRYSYLVSLLPR

SEQ ID NO: 743409 - protein, 24 aa, Mycobacterium
VDARLTVSNLKHWLTSNISEPGHR

SEQ ID NO: 743410 - protein, 18 aa, Mycobacterium
VDARMRRLIADDGIETVW

SEQ ID NO: 743411 - protein, 22 aa, Mycobacterium
VDARPVSAFGCDGVLISTPTGS

SEQ ID NO: 743412 - protein, 17 aa, Mycobacterium
VDARRLGAPLAQELSAY

SEQ ID NO: 743413 - protein, 21 aa, Mycobacterium
VDARTIVTLSGFAPPTLHAMG

SEQ ID NO: 743414 - protein, 18 aa, Mycobacterium
VDARVHLSAALTAFDRAG

SEQ ID NO: 743415 - protein, 19 aa, Mycobacterium
VDASGLWPGKVVTEVSPAP

SEQ ID NO: 743416 - protein, 19 aa, Mycobacterium
VDASGLWPGKVVTEVTPAS

SEQ ID NO: 743417 - protein, 23 aa, Mycobacterium
VDASLRLLVRGGRFLEMGKTDIR

SEQ ID NO: 743418 - protein, 22 aa, Mycobacterium
VDASTSGAVFRSGRPMITETLR

SEQ ID NO: 743419 - protein, 24 aa, Mycobacterium
VDATDPRAALWVRDDTHAAGLSVD

SEQ ID NO: 743420 - protein, 18 aa, Mycobacterium
VDATHAWASVWTPQNIWL

SEQ ID NO: 743421 - protein, 19 aa, Mycobacterium
VDATHAWASVWTPQNLWLG

SEQ ID NO: 743422 - protein, 25 aa, Mycobacterium
VDATWASSISGYWRRGRTEETFREW

SEQ ID NO: 743423 - protein, 26 aa, Mycobacterium
VDAVARQEPGLSWAAGLRDDGRTTLL

SEQ ID NO: 743424 - protein, 29 aa, Mycobacterium
VDAVARQESRLSWAAGLRDDGSTTLLVTD

SEQ ID NO: 743425 - protein, 24 aa, Mycobacterium
VDAVLRVGEKFVIVDYKTNWLGTG

SEQ ID NO: 743426 - protein, 19 aa, Mycobacterium
VDAVLRVGSRYVVVDYKTN

SEQ ID NO: 743427 - protein, 18 aa, Mycobacterium
VDAVPGQRDHSWGVRDWW

SEQ ID NO: 743428 - protein, 20 aa, Mycobacterium
VDAVRPEGATDWIAPDVDPD

SEQ ID NO: 743429 - protein, 20 aa, Mycobacterium
VDAVRVVNLLSWRYRDPGLL

SEQ ID NO: 743430 - protein, 23 aa, Mycobacterium
VDAVVGIYGRYDWEDKSTVERVR

SEQ ID NO: 743431 - protein, 23 aa, Mycobacterium
VDAVVGIYGRYDWEDRSTVERER

SEQ ID NO: 743432 - protein, 17 aa, Mycobacterium
VDAVVPLPGFVLKRAVK

SEQ ID NO: 743433 - protein, 19 aa, Mycobacterium
VDAYLHAGGQWEWDNAAPA

SEQ ID NO: 743434 - protein, 19 aa, Mycobacterium
VDAYLHAGGQWEWDSAAPA

SEQ ID NO: 743435 - protein, 17 aa, Mycobacterium
VDAYLRLGALVTPAQFG

SEQ ID NO: 743436 - protein, 19 aa, Mycobacterium
VDAYPRLWDKAAALLQSLA

SEQ ID NO: 743437 - protein, 19 aa, Mycobacterium
VDAYRAAFVPSVYLPQPYV

SEQ ID NO: 743438 - protein, 20 aa, Mycobacterium
VDAYRPLALEMAAQLGRVDV

SEQ ID NO: 743439 - protein, 25 aa, Mycobacterium
VDCAREVADIIAPVLGWTAEDIGRE

SEQ ID NO: 743440 - protein, 19 aa, Mycobacterium
VDCPEEYVGAVTQLMAARK

SEQ ID NO: 743441 - protein, 17 aa, Mycobacterium
VDCPGYMVGPAAEAEAL

SEQ ID NO: 743442 - protein, 18 aa, Mycobacterium
VDCPHFEYALAAYYLILP

SEQ ID NO: 743443 - protein, 21 aa, Mycobacterium
VDCPVRRQCLAAALERAEPWG

SEQ ID NO: 743444 - protein, 20 aa, Mycobacterium
VDCTALLRLRDRIRSAETEL

SEQ ID NO: 743445 - protein, 17 aa, Mycobacterium
VDCVVLAFGEKRGLVQH

SEQ ID NO: 743446 - protein, 18 aa, Mycobacterium
VDCWYSRIFSYARELKYF

SEQ ID NO: 743447 - protein, 18 aa, Mycobacterium
VDDAHGFGALGATGSGAG

SEQ ID NO: 743448 - protein, 18 aa, Mycobacterium
VDDARLVVAVARTAAQHG

SEQ ID NO: 743449 - protein, 26 aa, Mycobacterium
VDDATMARCFALWAGLIGAVSLEVFG

SEQ ID NO: 743450 - protein, 18 aa, Mycobacterium
VDDCYDAYVWLRRAGYEP

SEQ ID NO: 743451 - protein, 23 aa, Mycobacterium
VDDEPRWSAAESKPKPVDQGLPL

SEQ ID NO: 743452 - protein, 18 aa, Mycobacterium
VDDGWVLTCQAVPTSPTV

SEQ ID NO: 743453 - protein, 18 aa, Mycobacterium
VDDLLRGRRPKSFRPDDF

SEQ ID NO: 743454 - protein, 20 aa, Mycobacterium
VDDLLSVSDLEGWGQVCDSG

SEQ ID NO: 743455 - protein, 19 aa, Mycobacterium
VDDLPPMMFIKGHANSHGF

SEQ ID NO: 743456 - protein, 17 aa, Mycobacterium
VDDPAFVLHGNHPVRLF

SEQ ID NO: 743457 - protein, 19 aa, Mycobacterium
VDDPLAFERLVALRLIRID

SEQ ID NO: 743458 - protein, 19 aa, Mycobacterium
VDDPLLMRRALEYASGLGV

SEQ ID NO: 743459 - protein, 18 aa, Mycobacterium
VDDPRWLLYVQDSGGDEN

SEQ ID NO: 743460 - protein, 22 aa, Mycobacterium
VDDPYFDIGHHLHRVAVPAPGA

SEQ ID NO: 743461 - protein, 25 aa, Mycobacterium
VDDRARRLAAFLIGRGLVPGDRVMV

SEQ ID NO: 743462 - protein, 20 aa, Mycobacterium
VDDRGHFSLGERLLGFGNAT

SEQ ID NO: 743463 - protein, 23 aa, Mycobacterium
VDDRIIWGNGIFNMKGAFVCYAA

SEQ ID NO: 743464 - protein, 17 aa, Mycobacterium
VDDRVVLRFAQLSVAAG

SEQ ID NO: 743465 - protein, 17 aa, Mycobacterium
VDDVIWGCVSQVGDQSS

SEQ ID NO: 743466 - protein, 29 aa, Mycobacterium
VDDVPRGISFLLNRNRLNVAISRAQYAAV

SEQ ID NO: 743467 - protein, 17 aa, Mycobacterium
VDDVVRSGARFEVVSEY

SEQ ID NO: 743468 - protein, 17 aa, Mycobacterium
VDEAARFAGTGRMRPTM

SEQ ID NO: 743469 - protein, 18 aa, Mycobacterium
VDEAELALRVVIGQQVSI

SEQ ID NO: 743470 - protein, 22 aa, Mycobacterium
VDEAHCISVWGHDFRPEFRQVP

SEQ ID NO: 743471 - protein, 18 aa, Mycobacterium
VDEAMAGHATRVDVTLLA

SEQ ID NO: 743472 - protein, 27 aa, Mycobacterium
VDECMQLSGGIGFTWEYPLHYELRRVF

SEQ ID NO: 743473 - protein, 22 aa, Mycobacterium
VDECWYCGPCAARCPTGAVTVN

SEQ ID NO: 743474 - protein, 30 aa, Mycobacterium
VDEDATMGVFCRRWGVPLIDGGTVRLPRLI

SEQ ID NO: 743475 - protein, 27 aa, Mycobacterium
VDEDLATSAHFVWPRETLRLGEKYPLK

SEQ ID NO: 743476 - protein, 26 aa, Mycobacterium
VDEEWPRDRLEIYIKEKPRGPGYVCD

SEQ ID NO: 743477 - protein, 24 aa, Mycobacterium
VDEFLRLTSPVQMLGRTVTRDVTL

SEQ ID NO: 743478 - protein, 17 aa, Mycobacterium
VDEFLRTRAPVLERRVA

SEQ ID NO: 743479 - protein, 24 aa, Mycobacterium
VDEGSVLVPFSWQGVSLHAGGASA

SEQ ID NO: 743480 - protein, 17 aa, Mycobacterium
VDEGVEAYGRLDVIVAN

SEQ ID NO: 743481 - protein, 20 aa, Mycobacterium
VDEGYVLLCRSHAFSDCTIE

SEQ ID NO: 743482 - protein, 18 aa, Mycobacterium
VDEHARVLILGSFPSAQS

SEQ ID NO: 743483 - protein, 18 aa, Mycobacterium
VDEIAPERFGEYVRPMLT

SEQ ID NO: 743484 - protein, 22 aa, Mycobacterium
VDEIRKAVRYQIKHGAELIKVC

SEQ ID NO: 743485 - protein, 20 aa, Mycobacterium
VDELEYWGLRAMPVPVDDEG

SEQ ID NO: 743486 - protein, 20 aa, Mycobacterium
VDELLGPDVTREWIKDFSSY

SEQ ID NO: 743487 - protein, 25 aa, Mycobacterium
VDELLRAGVLVDLYPLVRKSIRVGT

SEQ ID NO: 743488 - protein, 20 aa, Mycobacterium
VDELLRRGAAKVYATARAPR

SEQ ID NO: 743489 - protein, 18 aa, Mycobacterium
VDELLYWIADDLARTTAW

SEQ ID NO: 743490 - protein, 18 aa, Mycobacterium
VDELRWLPVKDAIKTVSY

SEQ ID NO: 743491 - protein, 17 aa, Mycobacterium
VDEPICMIVPQRRAELE

SEQ ID NO: 743492 - protein, 18 aa, Mycobacterium
VDEPICMIVPQRRAELEE

SEQ ID NO: 743493 - protein, 25 aa, Mycobacterium
VDERARAGLFLAMQYPVEVPGVSVS

SEQ ID NO: 743494 - protein, 23 aa, Mycobacterium
VDERHVVASLGFDTIDSGDDVRA

SEQ ID NO: 743495 - protein, 26 aa, Mycobacterium
VDERRLGWDEAWEITVATFGYTNHTL

SEQ ID NO: 743496 - protein, 18 aa, Mycobacterium
VDESLCFAGANLIPLRGG

SEQ ID NO: 743497 - protein, 22 aa, Mycobacterium
VDESRALYEWNHAKQILRIQAG

SEQ ID NO: 743498 - protein, 19 aa, Mycobacterium
VDESREFTAQLAAGEHAGQ

SEQ ID NO: 743499 - protein, 32 aa, Mycobacterium
VDESRLTFLAVRRWFGWSAGRIINLDIGGGSL

SEQ ID NO: 743500 - protein, 17 aa, Mycobacterium
VDESRVFTAKLAAGEHA

SEQ ID NO: 743501 - protein, 21 aa, Mycobacterium
VDESVKYAKERQAFGAAIGTY

SEQ ID NO: 743502 - protein, 19 aa, Mycobacterium
VDETRHWVVVDLINPLLTQ

SEQ ID NO: 743503 - protein, 25 aa, Mycobacterium
VDETTWKKAGFDAAVTAFSTGSTFV

SEQ ID NO: 743504 - protein, 19 aa, Mycobacterium
VDFDFRLDGKVALVTGAAS

SEQ ID NO: 743505 - protein, 20 aa, Mycobacterium
VDFDPIYSWPKPVQQPYPPL

SEQ ID NO: 743506 - protein, 24 aa, Mycobacterium
VDFDRIKVSLPFHADHIVTAQQWR

SEQ ID NO: 743507 - protein, 18 aa, Mycobacterium
VDFFTRWVTGDLVVADVD

SEQ ID NO: 743508 - protein, 25 aa, Mycobacterium
VDFGAILGGWCGDAARSFVVGTPRP

SEQ ID NO: 743509 - protein, 24 aa, Mycobacterium
VDFGELLWSFAPPARPRPADMSQV

SEQ ID NO: 743510 - protein, 19 aa, Mycobacterium
VDFGGIRKNVCLQYLPDAQ

SEQ ID NO: 743511 - protein, 17 aa, Mycobacterium
VDFIPALDVIGRTRAAQ

SEQ ID NO: 743512 - protein, 18 aa, Mycobacterium
VDFIPNYDGRVMEPTVLP

SEQ ID NO: 743513 - protein, 19 aa, Mycobacterium
VDFKIARYVISARIKALQG

SEQ ID NO: 743514 - protein, 17 aa, Mycobacterium
VDFPLHPGFAASWQGLR

SEQ ID NO: 743515 - protein, 19 aa, Mycobacterium
VDFRPAEPATVFAYPHDDH

SEQ ID NO: 743516 - protein, 20 aa, Mycobacterium
VDFRQEFKKDVVIDMLCYRK

SEQ ID NO: 743517 - protein, 17 aa, Mycobacterium
VDFSGAVVRTIPATVNL

SEQ ID NO: 743518 - protein, 34 aa, Mycobacterium
VDFTLRADQTLPWHPGRCAAVLIGDVVVGHAGQL

SEQ ID NO: 743519 - protein, 17 aa, Mycobacterium
VDFVKSRGLTAIVKGLR

SEQ ID NO: 743520 - protein, 22 aa, Mycobacterium
VDFVRKEFRALRVKVDEDTVTA

SEQ ID NO: 743521 - protein, 28 aa, Mycobacterium
VDFWASWCGPCKAFAPTFAASAEKHPDV

SEQ ID NO: 743522 - protein, 28 aa, Mycobacterium
VDFWASWCGPCKAFAPTFAASSEKHPDI

SEQ ID NO: 743523 - protein, 27 aa, Mycobacterium
VDFWATWCGPCKMVAPVLEEIASEKAG

SEQ ID NO: 743524 - protein, 27 aa, Mycobacterium
VDFWATWCGPCKMVAPVLEEIATERAD

SEQ ID NO: 743525 - protein, 18 aa, Mycobacterium
VDFYDKFGYDRPVYTLSH

SEQ ID NO: 743526 - protein, 26 aa, Mycobacterium
VDGACPDCARGAFHAERPYEAEAVRH

SEQ ID NO: 743527 - protein, 23 aa, Mycobacterium
VDGARFDGWLSRWQALGPDAELM

SEQ ID NO: 743528 - protein, 18 aa, Mycobacterium
VDGARKVFKLVDALEDSD

SEQ ID NO: 743529 - protein, 18 aa, Mycobacterium
VDGARKVFKLVDALEESD

SEQ ID NO: 743530 - protein, 20 aa, Mycobacterium
VDGARVAYKVVNRADNPEPG

SEQ ID NO: 743531 - protein, 24 aa, Mycobacterium
VDGARWLSLEGKASVNRDIDAVRD

SEQ ID NO: 743532 - protein, 18 aa, Mycobacterium
VDGARWLSLEGKSTVSSD

SEQ ID NO: 743533 - protein, 22 aa, Mycobacterium
VDGARWLSLEGNALVNNDLDAV

SEQ ID NO: 743534 - protein, 20 aa, Mycobacterium
VDGARWLSLEGSSKVNSDAD

SEQ ID NO: 743535 - protein, 33 aa, Mycobacterium
VDGAVDFLLLDGWKDLYLPVIELLEPRLSMGAL

SEQ ID NO: 743536 - protein, 21 aa, Mycobacterium
VDGDAGWPLYLARYADVLSGG

SEQ ID NO: 743537 - protein, 20 aa, Mycobacterium
VDGDAQWAAEVRRLARLRGA

SEQ ID NO: 743538 - protein, 21 aa, Mycobacterium
VDGEAGWPLYLDRYAALLPAG

SEQ ID NO: 743539 - protein, 22 aa, Mycobacterium
VDGEPVLDLWAGVAQKGEEWTR

SEQ ID NO: 743540 - protein, 18 aa, Mycobacterium
VDGESKFQVHSRPYGERG

SEQ ID NO: 743541 - protein, 17 aa, Mycobacterium
VDGFAGRIHAAYFDEVI

SEQ ID NO: 743542 - protein, 22 aa, Mycobacterium
VDGFMRRAPLLLAVGGEPFEYR

SEQ ID NO: 743543 - protein, 18 aa, Mycobacterium
VDGFPNLFVVTGPGSPSV

SEQ ID NO: 743544 - protein, 23 aa, Mycobacterium
VDGFRLATIPALEELDGFCSASL

SEQ ID NO: 743545 - protein, 22 aa, Mycobacterium
VDGFSSVLFVSRIAVIYSALAS

SEQ ID NO: 743546 - protein, 18 aa, Mycobacterium
VDGGGLAPIAFSITIGTL

SEQ ID NO: 743547 - protein, 20 aa, Mycobacterium
VDGGRWEIYVGGAAGAHIRK

SEQ ID NO: 743548 - protein, 19 aa, Mycobacterium
VDGGWKINGQKVWTSGAHY

SEQ ID NO: 743549 - protein, 25 aa, Mycobacterium
VDGGWSVTGAKVWTSGAHRADAFIC

SEQ ID NO: 743550 - protein, 24 aa, Mycobacterium
VDGGYQLSGSWSFGSGTGHSQYIA

SEQ ID NO: 743551 - protein, 17 aa, Mycobacterium
VDGHGGLTVRRKAGRLA

SEQ ID NO: 743552 - protein, 23 aa, Mycobacterium
VDGHGRLTGLITVKDFVKTEQHP

SEQ ID NO: 743553 - protein, 18 aa, Mycobacterium
VDGIPVAFLDLGWAEDMV

SEQ ID NO: 743554 - protein, 22 aa, Mycobacterium
VDGKFRPADVVIYGTGFRATDF

SEQ ID NO: 743555 - protein, 18 aa, Mycobacterium
VDGKPVVDTGFWSFPRSC

SEQ ID NO: 743556 - protein, 20 aa, Mycobacterium
VDGKTKFILVRTGEERQGVV

SEQ ID NO: 743557 - protein, 22 aa, Mycobacterium
VDGLLREIRLVRALSGTDVPHA

SEQ ID NO: 743558 - protein, 17 aa, Mycobacterium
VDGLPVFGAFWDRDAEL

SEQ ID NO: 743559 - protein, 28 aa, Mycobacterium
VDGLSRFADLCVTAFAGFAVVKPQVAFF

SEQ ID NO: 743560 - protein, 17 aa, Mycobacterium
VDGMATVKVSGTIDGAV

SEQ ID NO: 743561 - protein, 18 aa, Mycobacterium
VDGMRADLVLARTATAHA

SEQ ID NO: 743562 - protein, 18 aa, Mycobacterium
VDGMRADLVVARAAIAHA

SEQ ID NO: 743563 - protein, 17 aa, Mycobacterium
VDGMRADLVVARTAAAH

SEQ ID NO: 743564 - protein, 18 aa, Mycobacterium
VDGMRADLVVARTAAAHA

SEQ ID NO: 743565 - protein, 21 aa, Mycobacterium
VDGNDVLACYAVMAEAATRAR

SEQ ID NO: 743566 - protein, 21 aa, Mycobacterium
VDGNDVLACYAVMSEAAERAR

SEQ ID NO: 743567 - protein, 25 aa, Mycobacterium
VDGPAFRAAVTVTFGGYKPVHALGD

SEQ ID NO: 743568 - protein, 26 aa, Mycobacterium
VDGPDLPPLWEVFGARLRTDDRWVLP

SEQ ID NO: 743569 - protein, 18 aa, Mycobacterium
VDGPLRFELIDTATGTSK

SEQ ID NO: 743570 - protein, 19 aa, Mycobacterium
VDGPTFLGGAGRWRDSGMA

SEQ ID NO: 743571 - protein, 19 aa, Mycobacterium
VDGPWRLGLSSAGTFENLQ

SEQ ID NO: 743572 - protein, 20 aa, Mycobacterium
VDGPYYFFGVLARLAVLPSL

SEQ ID NO: 743573 - protein, 20 aa, Mycobacterium
VDGQAAIVIEHITRLRPDLR

SEQ ID NO: 743574 - protein, 21 aa, Mycobacterium
VDGQLAATVARWPALTPARLA

SEQ ID NO: 743575 - protein, 17 aa, Mycobacterium
VDGQRIGAVSAFGISGT

SEQ ID NO: 743576 - protein, 22 aa, Mycobacterium
VDGRAGEFIATLGTGIGFLAKG

SEQ ID NO: 743577 - protein, 17 aa, Mycobacterium
VDGRAPFVLFRMPGAEI

SEQ ID NO: 743578 - protein, 26 aa, Mycobacterium
VDGRDVCYGLTYADVRAVHQNGTVAD

SEQ ID NO: 743579 - protein, 17 aa, Mycobacterium
VDGRGRITVDSNFQTKV

SEQ ID NO: 743580 - protein, 17 aa, Mycobacterium
VDGRLCRPGWLETAGGR

SEQ ID NO: 743581 - protein, 17 aa, Mycobacterium
VDGRLRRAAQWGATPVG

SEQ ID NO: 743582 - protein, 21 aa, Mycobacterium
VDGRPAIVVEHITRLRGDLRP

SEQ ID NO: 743583 - protein, 25 aa, Mycobacterium
VDGRPRPLPGAALLVSEDGTRTEVR

SEQ ID NO: 743584 - protein, 24 aa, Mycobacterium
VDGRPRRAGVSSFGISGTNAHVIL

SEQ ID NO: 743585 - protein, 21 aa, Mycobacterium
VDGRPVSAFGCDGVLVSTPTG

SEQ ID NO: 743586 - protein, 17 aa, Mycobacterium
VDGRPVSSFGCDGVLVS

SEQ ID NO: 743587 - protein, 25 aa, Mycobacterium
VDGRRAAGVEIIYRGQLHTISAAAE

SEQ ID NO: 743588 - protein, 23 aa, Mycobacterium
VDGRRINSCLALAVMHDGAQITT

SEQ ID NO: 743589 - protein, 17 aa, Mycobacterium
VDGRRVTSCLTFAVAAD

SEQ ID NO: 743590 - protein, 25 aa, Mycobacterium
VDGRSHAWIQAWTGGWWSYDPTLET

SEQ ID NO: 743591 - protein, 20 aa, Mycobacterium
VDGSGCLLTPGLVNTHHHLY

SEQ ID NO: 743592 - protein, 25 aa, Mycobacterium
VDGSLPMDVFNRWVSPARLVVTQMK

SEQ ID NO: 743593 - protein, 22 aa, Mycobacterium
VDGTLKVYGVDGLRIADGSIMP

SEQ ID NO: 743594 - protein, 17 aa, Mycobacterium
VDGTSWITGADQPGRHV

SEQ ID NO: 743595 - protein, 18 aa, Mycobacterium
VDGVARVETHLEWQMTPH

SEQ ID NO: 743596 - protein, 28 aa, Mycobacterium
VDGVGLLRAEFMLTEALAGRHPRDLITK

SEQ ID NO: 743597 - protein, 31 aa, Mycobacterium
VDGVLALPGARRLLGALPHSHWAAVTSGPRS

SEQ ID NO: 743598 - protein, 24 aa, Mycobacterium
VDGVPRIETHLEWQMTPHTDPHWD

SEQ ID NO: 743599 - protein, 24 aa, Mycobacterium
VDGVPRYAPYVIADKVSGLYIVIA

SEQ ID NO: 743600 - protein, 18 aa, Mycobacterium
VDGVPWDRMAVIVRSVPR

SEQ ID NO: 743601 - protein, 20 aa, Mycobacterium
VDGWMSATWFQGPAAEFIEQ

SEQ ID NO: 743602 - protein, 25 aa, Mycobacterium
VDGWNVTWQKWSLRVGFNAREGLTL

SEQ ID NO: 743603 - protein, 25 aa, Mycobacterium
VDGWPNQQFALLFVDWLRANPGARA

SEQ ID NO: 743604 - protein, 25 aa, Mycobacterium
VDGWPNQQFALLFVDWLRANSGVRA

SEQ ID NO: 743605 - protein, 25 aa, Mycobacterium
VDGWPNQQFALLFVDWLTDNPAVRT

SEQ ID NO: 743606 - protein, 17 aa, Mycobacterium
VDGWSLAVFFTELLAVY

SEQ ID NO: 743607 - protein, 24 aa, Mycobacterium
VDGYQRYGVDFANPDFVAYAHSYG

SEQ ID NO: 743608 - protein, 23 aa, Mycobacterium
VDGYRVLVDPVWSERCSPSRTVG

SEQ ID NO: 743609 - protein, 23 aa, Mycobacterium
VDHAEVKIGMPVRATYIDFPAGE

SEQ ID NO: 743610 - protein, 17 aa, Mycobacterium
VDHAQSYVRACHALGYQ

SEQ ID NO: 743611 - protein, 24 aa, Mycobacterium
VDHDLRPGGRVTYFMTGPDGEKYA

SEQ ID NO: 743612 - protein, 25 aa, Mycobacterium
VDHDLRPGGRVTYFMTGPEGDKHAG

SEQ ID NO: 743613 - protein, 17 aa, Mycobacterium
VDHEWHHGWLLRSGRGA

SEQ ID NO: 743614 - protein, 17 aa, Mycobacterium
VDHGAWITKAGIDRKAL

SEQ ID NO: 743615 - protein, 18 aa, Mycobacterium
VDHHVHGCWLGRHDRAQF

SEQ ID NO: 743616 - protein, 19 aa, Mycobacterium
VDHLERMLSLDNAFSSDEL

SEQ ID NO: 743617 - protein, 17 aa, Mycobacterium
VDHNDGWLLSSDGSESA

SEQ ID NO: 743618 - protein, 17 aa, Mycobacterium
VDHPGACALARGQPALG

SEQ ID NO: 743619 - protein, 18 aa, Mycobacterium
VDHPPYRPFWAITKHADI

SEQ ID NO: 743620 - protein, 23 aa, Mycobacterium
VDHPRLGWQRAPVGPVLADALGL

SEQ ID NO: 743621 - protein, 24 aa, Mycobacterium
VDHPRLGWRQAPVGPVLGDALGLP

SEQ ID NO: 743622 - protein, 23 aa, Mycobacterium
VDHPRLGWTEAPVGRVFADTLGL

SEQ ID NO: 743623 - protein, 26 aa, Mycobacterium
VDHTGRYRGRACALVRPGTGDQVAAV

SEQ ID NO: 743624 - protein, 17 aa, Mycobacterium
VDHVVGMAFHRVKATAP

SEQ ID NO: 743625 - protein, 24 aa, Mycobacterium
VDHYAEIGLLGFALITDALGGVDV

SEQ ID NO: 743626 - protein, 24 aa, Mycobacterium
VDHYAEIGLLGFALITDALGGVNV

SEQ ID NO: 743627 - protein, 17 aa, Mycobacterium
VDHYFDWDRCAIVSDVP

SEQ ID NO: 743628 - protein, 30 aa, Mycobacterium
VDIALRAGEELPWHPGRCAEIVVDGQIVGH

SEQ ID NO: 743629 - protein, 18 aa, Mycobacterium
VDICAQIPSVEYPMATTE

SEQ ID NO: 743630 - protein, 26 aa, Mycobacterium
VDIDGCVYREGLSAVRIDGGIAGNVI

SEQ ID NO: 743631 - protein, 17 aa, Mycobacterium
VDIDVVWAESMAKAEQE

SEQ ID NO: 743632 - protein, 19 aa, Mycobacterium
VDIERFDMDPSRPILHGLL

SEQ ID NO: 743633 - protein, 19 aa, Mycobacterium
VDIEYKFGFQGNPWGELEG

SEQ ID NO: 743634 - protein, 31 aa, Mycobacterium
VDIGDRGRLALRRVAVRSGVPDYGYAFEPVR

SEQ ID NO: 743635 - protein, 19 aa, Mycobacterium
VDIGRGRNGVLYAGEVNWD

SEQ ID NO: 743636 - protein, 20 aa, Mycobacterium
VDIGRTFPVVAERASRPGLQ

SEQ ID NO: 743637 - protein, 24 aa, Mycobacterium
VDIKRDGYEWSQFYDRAQPGTLKQ

SEQ ID NO: 743638 - protein, 17 aa, Mycobacterium
VDIKYKLYDTVKFSSAD

SEQ ID NO: 743639 - protein, 18 aa, Mycobacterium
VDILAALAETASPAGILI

SEQ ID NO: 743640 - protein, 24 aa, Mycobacterium
VDILEMLPTPWGLVRSGVAPDHPK

SEQ ID NO: 743641 - protein, 17 aa, Mycobacterium
VDILRSRERGVPRYNEF

SEQ ID NO: 743642 - protein, 19 aa, Mycobacterium
VDIPATRRAYILASSQNPR

SEQ ID NO: 743643 - protein, 17 aa, Mycobacterium
VDIPESDYASLRTLADV

SEQ ID NO: 743644 - protein, 26 aa, Mycobacterium
VDIPGALDFRARVAGWAGEAVAPQLF

SEQ ID NO: 743645 - protein, 18 aa, Mycobacterium
VDIPRLAQEQGVGVKVDQ

SEQ ID NO: 743646 - protein, 23 aa, Mycobacterium
VDIPRQRIGLTLRLNDDPQQGKR

SEQ ID NO: 743647 - protein, 30 aa, Mycobacterium
VDIPSFIYSFSFAQTGKWSRLFAPGEELQQ

SEQ ID NO: 743648 - protein, 23 aa, Mycobacterium
VDIQMPIAVDPEWDRPGRAVTNR

SEQ ID NO: 743649 - protein, 24 aa, Mycobacterium
VDIRFPPNVFPIDVQRDFTSRVTE

SEQ ID NO: 743650 - protein, 18 aa, Mycobacterium
VDIRIPFNAGMAALIQSK

SEQ ID NO: 743651 - protein, 20 aa, Mycobacterium
VDIRMPPTFTDEGLGAAHAI

SEQ ID NO: 743652 - protein, 21 aa, Mycobacterium
VDIRPKLTLPDPGSLTISVDP

SEQ ID NO: 743653 - protein, 20 aa, Mycobacterium
VDISNAVLFLASDESRYITG

SEQ ID NO: 743654 - protein, 17 aa, Mycobacterium
VDITDLLAQLAIPIPTV

SEQ ID NO: 743655 - protein, 18 aa, Mycobacterium
VDITRFWYEQGSLDNERQ

SEQ ID NO: 743656 - protein, 18 aa, Mycobacterium
VDITRYLFGEEIASVQII

SEQ ID NO: 743657 - protein, 25 aa, Mycobacterium
VDIVPHLNLADGREVIVNRDDNEWE

SEQ ID NO: 743658 - protein, 18 aa, Mycobacterium
VDIVVRGICALRPGVPGY

SEQ ID NO: 743659 - protein, 18 aa, Mycobacterium
VDIYAHLTGGGPSGQAGA

SEQ ID NO: 743660 - protein, 22 aa, Mycobacterium
VDKALDAALCVFWRKGYEGASY

SEQ ID NO: 743661 - protein, 24 aa, Mycobacterium
VDKARELADEFGIDTEKVGNFSDA

SEQ ID NO: 743662 - protein, 19 aa, Mycobacterium
VDKGARWDPAELGPVVADL

SEQ ID NO: 743663 - protein, 23 aa, Mycobacterium
VDKGRWTFGYLMSRATTIGAGTA

SEQ ID NO: 743664 - protein, 27 aa, Mycobacterium
VDKLKDAGFHWATRSGVTVSMADVLVP

SEQ ID NO: 743665 - protein, 17 aa, Mycobacterium
VDKLRFDPAAFGFARAR

SEQ ID NO: 743666 - protein, 18 aa, Mycobacterium
VDKLVRWGYSATQVVEGL

SEQ ID NO: 743667 - protein, 17 aa, Mycobacterium
VDKLWLDRWAAIDRAGG

SEQ ID NO: 743668 - protein, 18 aa, Mycobacterium
VDKMAADMAVDFKDTGIT

SEQ ID NO: 743669 - protein, 24 aa, Mycobacterium
VDKPASALLFFLASSRILNRRKGV

SEQ ID NO: 743670 - protein, 28 aa, Mycobacterium
VDKPKLVFFFDEAHLLFADASKAFLEQV

SEQ ID NO: 743671 - protein, 28 aa, Mycobacterium
VDKPKLVFIFDEAHLLFADASKAFLEQV

SEQ ID NO: 743672 - protein, 21 aa, Mycobacterium
VDKRGRFVFGSMDTLEESRSG

SEQ ID NO: 743673 - protein, 22 aa, Mycobacterium
VDKYCRVRGIDGLFVIDGSILP

SEQ ID NO: 743674 - protein, 18 aa, Mycobacterium
VDLAEYWGVETLDPGYPI

SEQ ID NO: 743675 - protein, 18 aa, Mycobacterium
VDLAFSVASVRGDPSKSV

SEQ ID NO: 743676 - protein, 19 aa, Mycobacterium
VDLALAWRDGVDNPVVDAV

SEQ ID NO: 743677 - protein, 18 aa, Mycobacterium
VDLALERFGSVDILINNA

SEQ ID NO: 743678 - protein, 25 aa, Mycobacterium
VDLALGWAHRLVGLQGGRKVLDRPA

SEQ ID NO: 743679 - protein, 18 aa, Mycobacterium
VDLAMPMIGLLKRKAERR

SEQ ID NO: 743680 - protein, 17 aa, Mycobacterium
VDLAVQRWGHIDFLINN

SEQ ID NO: 743681 - protein, 17 aa, Mycobacterium
VDLCTGTGALALALAQH

SEQ ID NO: 743682 - protein, 23 aa, Mycobacterium
VDLDIPLRLVYVIDADNEDAVDP

SEQ ID NO: 743683 - protein, 17 aa, Mycobacterium
VDLDMWEKVIFNLLSNA

SEQ ID NO: 743684 - protein, 17 aa, Mycobacterium
VDLDPMPGVSWGRIIEV

SEQ ID NO: 743685 - protein, 24 aa, Mycobacterium
VDLDPMPGVSWRRIVDVALVAREV

SEQ ID NO: 743686 - protein, 17 aa, Mycobacterium
VDLDVLAPAFGHIDVHT

SEQ ID NO: 743687 - protein, 18 aa, Mycobacterium
VDLEGAFVAPAFVDAHVH

SEQ ID NO: 743688 - protein, 29 aa, Mycobacterium
VDLEGLRRFSRHLGRGWLGRRIERSPLPF

SEQ ID NO: 743689 - protein, 24 aa, Mycobacterium
VDLETWRAALGDLRRREKAATREL

SEQ ID NO: 743690 - protein, 19 aa, Mycobacterium
VDLFPCGKPQPGYLPVLRA

SEQ ID NO: 743691 - protein, 23 aa, Mycobacterium
VDLGFPLSIHFEATYGLSAPAFE

SEQ ID NO: 743692 - protein, 24 aa, Mycobacterium
VDLGGRGRSVLKPDVDLARTVGSF

SEQ ID NO: 743693 - protein, 19 aa, Mycobacterium
VDLGGSWLLPKTVGLQQAK

SEQ ID NO: 743694 - protein, 24 aa, Mycobacterium
VDLGSQRRALLFLRADRLQYFVSC

SEQ ID NO: 743695 - protein, 24 aa, Mycobacterium
VDLGSQRRALLFLRVDRLQFFVSC

SEQ ID NO: 743696 - protein, 25 aa, Mycobacterium
VDLGSQRRALLFLRVDRLQFFVSCL

SEQ ID NO: 743697 - protein, 17 aa, Mycobacterium
VDLISAVDIRYASADAK

SEQ ID NO: 743698 - protein, 17 aa, Mycobacterium
VDLISAVDIRYASSDAK

SEQ ID NO: 743699 - protein, 17 aa, Mycobacterium
VDLKAALAMHLGSDVAP

SEQ ID NO: 743700 - protein, 21 aa, Mycobacterium
VDLKDPEWLEVVLRLLDEADV

SEQ ID NO: 743701 - protein, 24 aa, Mycobacterium
VDLLCAFVKWQGLRLLEDQLRELR

SEQ ID NO: 743702 - protein, 18 aa, Mycobacterium
VDLLEEFARSGRCVPGVS

SEQ ID NO: 743703 - protein, 23 aa, Mycobacterium
VDLLESRLAAWADDLDTAAGRMV

SEQ ID NO: 743704 - protein, 25 aa, Mycobacterium
VDLLGAFRRGGSWRRIGLMDCGERW

SEQ ID NO: 743705 - protein, 17 aa, Mycobacterium
VDLLGVRRDWRGRKLAQ

SEQ ID NO: 743706 - protein, 21 aa, Mycobacterium
VDLLMPVPGFLIKRGSKSLMD

SEQ ID NO: 743707 - protein, 25 aa, Mycobacterium
VDLLPAGQVPPGFLPILQAYDYAGD

SEQ ID NO: 743708 - protein, 17 aa, Mycobacterium
VDLLPGLLSQALEELLE

SEQ ID NO: 743709 - protein, 23 aa, Mycobacterium
VDLLPTLLSLLGIDIPADVEGLS

SEQ ID NO: 743710 - protein, 26 aa, Mycobacterium
VDLLRFCLEHGYQLRVIEQMPLDAGH

SEQ ID NO: 743711 - protein, 24 aa, Mycobacterium
VDLLTRWRPALAVAQNAKVVVVGS

SEQ ID NO: 743712 - protein, 19 aa, Mycobacterium
VDLLTSIALPPPEILAPPT

SEQ ID NO: 743713 - protein, 21 aa, Mycobacterium
VDLLVPLPGFVVRRGAKGVMD

SEQ ID NO: 743714 - protein, 18 aa, Mycobacterium
VDLNTWTLLKWLDEPCPF

SEQ ID NO: 743715 - protein, 18 aa, Mycobacterium
VDLPFPRSRGDDGFDDLR

SEQ ID NO: 743716 - protein, 17 aa, Mycobacterium
VDLPFPRSRGDDGFDEL

SEQ ID NO: 743717 - protein, 23 aa, Mycobacterium
VDLPGEPPRLFVVTRNAQTVVDG

SEQ ID NO: 743718 - protein, 29 aa, Mycobacterium
VDLPLICAGGICDARSAAAAVVLGAEGIQ

SEQ ID NO: 743719 - protein, 17 aa, Mycobacterium
VDLPRGLREQAATMSWD

SEQ ID NO: 743720 - protein, 23 aa, Mycobacterium
VDLPRSVPMGFRTIWINRNSQTL

SEQ ID NO: 743721 - protein, 20 aa, Mycobacterium
VDLPSAIPMLVFSGIMNSGQ

SEQ ID NO: 743722 - protein, 21 aa, Mycobacterium
VDLPSAIPMLVFSGIMNTGQA

SEQ ID NO: 743723 - protein, 17 aa, Mycobacterium
VDLPVLALIAGSSVMLD

SEQ ID NO: 743724 - protein, 17 aa, Mycobacterium
VDLQRFVVESGADIGLA

SEQ ID NO: 743725 - protein, 21 aa, Mycobacterium
VDLRADWPTAVRAAGLDSAAP

SEQ ID NO: 743726 - protein, 22 aa, Mycobacterium
VDLREDWPAALQASGFDPSKPT

SEQ ID NO: 743727 - protein, 17 aa, Mycobacterium
VDLREVIDTSGAYIPGH

SEQ ID NO: 743728 - protein, 23 aa, Mycobacterium
VDLRGTGGLDIRPIVSMNGDHHF

SEQ ID NO: 743729 - protein, 18 aa, Mycobacterium
VDLRNDWPTALQENGFDA

SEQ ID NO: 743730 - protein, 23 aa, Mycobacterium
VDLRSDWPKALADAGFDKSRPTA

SEQ ID NO: 743731 - protein, 23 aa, Mycobacterium
VDLRSGAYAALGRIPGAVRVQVL

SEQ ID NO: 743732 - protein, 21 aa, Mycobacterium
VDLRTLVPLDVETVVESVRRT

SEQ ID NO: 743733 - protein, 18 aa, Mycobacterium
VDLSPAGNRFRGHTMVGC

SEQ ID NO: 743734 - protein, 22 aa, Mycobacterium
VDLSQWSGIILGGGPYNVSDDA

SEQ ID NO: 743735 - protein, 25 aa, Mycobacterium
VDLSRLAEDIIIWSSTEFGYVTLHD

SEQ ID NO: 743736 - protein, 25 aa, Mycobacterium
VDLSRLAEDIILWSSTEFGYVTLHD

SEQ ID NO: 743737 - protein, 25 aa, Mycobacterium
VDLSRLAEDVILWSSTEFGYVTLHD

SEQ ID NO: 743738 - protein, 25 aa, Mycobacterium
VDLSRLAEDVILWSTTEFGYVELHD

SEQ ID NO: 743739 - protein, 20 aa, Mycobacterium
VDLSRTVGWFTAKYPVALNV

SEQ ID NO: 743740 - protein, 19 aa, Mycobacterium
VDLSRTVGWFTAKYPVALR

SEQ ID NO: 743741 - protein, 19 aa, Mycobacterium
VDLSRTVGWFTTKYPAALS

SEQ ID NO: 743742 - protein, 20 aa, Mycobacterium
VDLSRTVGWFTTKYPVALAV

SEQ ID NO: 743743 - protein, 20 aa, Mycobacterium
VDLSRTVGWFTTKYPVALTI

SEQ ID NO: 743744 - protein, 20 aa, Mycobacterium
VDLTKAMAYKGMMLSGLPNM

SEQ ID NO: 743745 - protein, 18 aa, Mycobacterium
VDLTLDRFGSVDILVNNA

SEQ ID NO: 743746 - protein, 17 aa, Mycobacterium
VDLVALFELHARAIYDM

SEQ ID NO: 743747 - protein, 19 aa, Mycobacterium
VDLVRPCGHVANIGVHGAP

SEQ ID NO: 743748 - protein, 17 aa, Mycobacterium
VDLYLIHWPAPAVGKYV

SEQ ID NO: 743749 - protein, 18 aa, Mycobacterium
VDMAHFFYVHGAVPTYFK

SEQ ID NO: 743750 - protein, 29 aa, Mycobacterium
VDMASPMAGLPMGAKFGTLVHAVLETADP

SEQ ID NO: 743751 - protein, 17 aa, Mycobacterium
VDMAWDPITRIVGSLGI

SEQ ID NO: 743752 - protein, 23 aa, Mycobacterium
VDMDTGLLIGERVKLLTPQPATP

SEQ ID NO: 743753 - protein, 27 aa, Mycobacterium
VDMFSRMAAGDIKACWIMCTNPVATVA

SEQ ID NO: 743754 - protein, 25 aa, Mycobacterium
VDMGAWPVPNLLALAQQRGISLLTL

SEQ ID NO: 743755 - protein, 29 aa, Mycobacterium
VDMKDMIGMMIVVARHFRRAGIVPPRDLV

SEQ ID NO: 743756 - protein, 19 aa, Mycobacterium
VDMPIAYDLSALRAEHPHR

SEQ ID NO: 743757 - protein, 26 aa, Mycobacterium
VDMPSLPWPAADDWLAAVRASPLAGE

SEQ ID NO: 743758 - protein, 18 aa, Mycobacterium
VDMRPRNVVVLGPGTIPK

SEQ ID NO: 743759 - protein, 24 aa, Mycobacterium
VDMSRRYAADFGFTSYDPAWIDTL

SEQ ID NO: 743760 - protein, 33 aa, Mycobacterium
VDMTKIVALRARAKAAFAEREGVNLTFLPFFAR

SEQ ID NO: 743761 - protein, 28 aa, Mycobacterium
VDMTKIVALRARAKAEFAEREGVNLTFL

SEQ ID NO: 743762 - protein, 33 aa, Mycobacterium
VDMTRIVALRARAKGSFAEREGVNLTFLPFIAR

SEQ ID NO: 743763 - protein, 33 aa, Mycobacterium
VDMTRIVGLRARAKSAFAEREGVNLTFLPFIAR

SEQ ID NO: 743764 - protein, 20 aa, Mycobacterium
VDMWSMLVIARDLLSMLADA

SEQ ID NO: 743765 - protein, 25 aa, Mycobacterium
VDNALKLLLLLGERPEIRLSEATRY

SEQ ID NO: 743766 - protein, 25 aa, Mycobacterium
VDNALKLLLLLGERPQIRLSEATRY

SEQ ID NO: 743767 - protein, 23 aa, Mycobacterium
VDNALRLILLLGDRSEIRLTDAS

SEQ ID NO: 743768 - protein, 24 aa, Mycobacterium
VDNALRLLLLLGERSEIRLTDASE

SEQ ID NO: 743769 - protein, 19 aa, Mycobacterium
VDNAWFWRDGDLLRCGLMD

SEQ ID NO: 743770 - protein, 17 aa, Mycobacterium
VDNDPDIRCAILTGAGG

SEQ ID NO: 743771 - protein, 17 aa, Mycobacterium
VDNIDFFAGAARHLEGK

SEQ ID NO: 743772 - protein, 24 aa, Mycobacterium
VDNIGRLPMAWVDPAAADTRAIVG

SEQ ID NO: 743773 - protein, 17 aa, Mycobacterium
VDNLATFRLIENGVETH

SEQ ID NO: 743774 - protein, 25 aa, Mycobacterium
VDNLGRPSSFIWYGPRWAQAATAPS

SEQ ID NO: 743775 - protein, 22 aa, Mycobacterium
VDNMLHDMSWFKQDSTAMAKAN

SEQ ID NO: 743776 - protein, 19 aa, Mycobacterium
VDNPHAWIRKPVTAGEIWQ

SEQ ID NO: 743777 - protein, 19 aa, Mycobacterium
VDNPHAWIRTPMTAEQICR

SEQ ID NO: 743778 - protein, 24 aa, Mycobacterium
VDNQYHAGWAWAGSTPYKGMKLMA

SEQ ID NO: 743779 - protein, 25 aa, Mycobacterium
VDNRIYRGSGLTGYRPGEKSSFREH

SEQ ID NO: 743780 - protein, 17 aa, Mycobacterium
VDNRLTLLDALREKLGA

SEQ ID NO: 743781 - protein, 27 aa, Mycobacterium
VDPAARIRIPLATLNRHGLIAGATGTG

SEQ ID NO: 743782 - protein, 23 aa, Mycobacterium
VDPACGTGGFLLVAHEHAVQGAE

SEQ ID NO: 743783 - protein, 24 aa, Mycobacterium
VDPAEYRAAGLWRSAETISGLAEE

SEQ ID NO: 743784 - protein, 27 aa, Mycobacterium
VDPAHPAARIGFMLADAAPVAALTTAD

SEQ ID NO: 743785 - protein, 19 aa, Mycobacterium
VDPAHPFPYISGLSLNLAI

SEQ ID NO: 743786 - protein, 22 aa, Mycobacterium
VDPALLRPGRLERLVFVEPPDA

SEQ ID NO: 743787 - protein, 17 aa, Mycobacterium
VDPARGGAVASLVQDGR

SEQ ID NO: 743788 - protein, 19 aa, Mycobacterium
VDPAVRWNPTLPAFIDAIR

SEQ ID NO: 743789 - protein, 17 aa, Mycobacterium
VDPDGADAWALQDVLAL

SEQ ID NO: 743790 - protein, 21 aa, Mycobacterium
VDPDIAGLLGQELGRQRDMLE

SEQ ID NO: 743791 - protein, 19 aa, Mycobacterium
VDPDPAFARRLRSRLEAAA

SEQ ID NO: 743792 - protein, 26 aa, Mycobacterium
VDPEAYLRAAIAWHFGQDTGSPFWLR

SEQ ID NO: 743793 - protein, 26 aa, Mycobacterium
VDPEEWRAELPLIEEWLEFVGEKLPT

SEQ ID NO: 743794 - protein, 22 aa, Mycobacterium
VDPEGLVAMYDGSFWVSDEYGP

SEQ ID NO: 743795 - protein, 25 aa, Mycobacterium
VDPEHRELLDGLDLNGIQILDVTGG

SEQ ID NO: 743796 - protein, 21 aa, Mycobacterium
VDPELGALVHTELQRHGVEVL

SEQ ID NO: 743797 - protein, 23 aa, Mycobacterium
VDPELGLAIAFNGCIYNYKELRS

SEQ ID NO: 743798 - protein, 25 aa, Mycobacterium
VDPELRRPITELGMVKSVEVAPDGA

SEQ ID NO: 743799 - protein, 17 aa, Mycobacterium
VDPEWDRPGRAVTNRHG

SEQ ID NO: 743800 - protein, 17 aa, Mycobacterium
VDPGALARFVAAVPPHI

SEQ ID NO: 743801 - protein, 23 aa, Mycobacterium
VDPGEALFEFLRSMMDWGGTDQG

SEQ ID NO: 743802 - protein, 19 aa, Mycobacterium
VDPGFSMDSAWRGVLPPEK

SEQ ID NO: 743803 - protein, 19 aa, Mycobacterium
VDPGHWWDALQRTITAVGG

SEQ ID NO: 743804 - protein, 17 aa, Mycobacterium
VDPGRLGTSVGFLSFDE

SEQ ID NO: 743805 - protein, 22 aa, Mycobacterium
VDPGTRFYVRPAECVATVTVSV

SEQ ID NO: 743806 - protein, 18 aa, Mycobacterium
VDPIRVLLIGGHSYLEAW

SEQ ID NO: 743807 - protein, 24 aa, Mycobacterium
VDPKAVPSKLAWETGQAMADSLLD

SEQ ID NO: 743808 - protein, 25 aa, Mycobacterium
VDPKAVPSRLAWEAGAALADSLLTR

SEQ ID NO: 743809 - protein, 26 aa, Mycobacterium
VDPKAVPSRLAWEAGVALADSLLARY

SEQ ID NO: 743810 - protein, 26 aa, Mycobacterium
VDPKAVPSRLAWEAGVALADSLLDRY

SEQ ID NO: 743811 - protein, 26 aa, Mycobacterium
VDPKAVPSRLAWEAGVALADSLLTRY

SEQ ID NO: 743812 - protein, 30 aa, Mycobacterium
VDPKAVPSRLAWETGVAMADSLLARYREDY

SEQ ID NO: 743813 - protein, 29 aa, Mycobacterium
VDPKAVPSRLAWETGVAMADSLLDRYRAD

SEQ ID NO: 743814 - protein, 25 aa, Mycobacterium
VDPLLPEVAWSWLVDAINSRTADVT

SEQ ID NO: 743815 - protein, 25 aa, Mycobacterium
VDPLLPEVAWSWLVDALDARANQVT

SEQ ID NO: 743816 - protein, 25 aa, Mycobacterium
VDPLLPEVAWSWLVDALEQRAEHVT

SEQ ID NO: 743817 - protein, 25 aa, Mycobacterium
VDPLLPEVAWSWLVDALESRMEQVT

SEQ ID NO: 743818 - protein, 26 aa, Mycobacterium
VDPLLPEVAWSWLVEALESRMEHVVA

SEQ ID NO: 743819 - protein, 31 aa, Mycobacterium
VDPMIREWLTVLLRRDLGLLVTITVPGREAT

SEQ ID NO: 743820 - protein, 22 aa, Mycobacterium
VDPMIREWLTVLLRRDLGLVVM

SEQ ID NO: 743821 - protein, 18 aa, Mycobacterium
VDPMPCNETHTLLRELPS

SEQ ID NO: 743822 - protein, 18 aa, Mycobacterium
VDPPRCLVDLEIQVTNQH

SEQ ID NO: 743823 - protein, 22 aa, Mycobacterium
VDPRFHGDLSLHFKADIPEDVL

SEQ ID NO: 743824 - protein, 23 aa, Mycobacterium
VDPRGIEAWKRRVDVEDILVAED

SEQ ID NO: 743825 - protein, 17 aa, Mycobacterium
VDPRGPVSVQPNSLVTW

SEQ ID NO: 743826 - protein, 17 aa, Mycobacterium
VDPRIAISQAREAKSRE

SEQ ID NO: 743827 - protein, 25 aa, Mycobacterium
VDPRIEAIAGKDWRARNALEVLTSS

SEQ ID NO: 743828 - protein, 25 aa, Mycobacterium
VDPRLRRACALIADNLREPLTLQQI

SEQ ID NO: 743829 - protein, 22 aa, Mycobacterium
VDPRRFVEALGRSVLARGATMH

SEQ ID NO: 743830 - protein, 23 aa, Mycobacterium
VDPRRPAALPAERAAQLPVLVVG

SEQ ID NO: 743831 - protein, 17 aa, Mycobacterium
VDPRRPPALPAESAADL

SEQ ID NO: 743832 - protein, 17 aa, Mycobacterium
VDPRVVDGTSWITGADE

SEQ ID NO: 743833 - protein, 17 aa, Mycobacterium
VDPRVVDGTSWITGADQ

SEQ ID NO: 743834 - protein, 17 aa, Mycobacterium
VDPRVVHGSSWITGADA

SEQ ID NO: 743835 - protein, 35 aa, Mycobacterium
VDPSRLACGDLAMFKDHYVPVLSSVKAFVNGQVVP

SEQ ID NO: 743836 - protein, 34 aa, Mycobacterium
VDPSWEWNPALLALRGELERVFLAGVRRDVGPIA

SEQ ID NO: 743837 - protein, 17 aa, Mycobacterium
VDPSWTYGAATPVDAVA

SEQ ID NO: 743838 - protein, 19 aa, Mycobacterium
VDPTESWVEYALRAPVMLV

SEQ ID NO: 743839 - protein, 23 aa, Mycobacterium
VDPTWSDRCYFFAASPDGTMLLA

SEQ ID NO: 743840 - protein, 25 aa, Mycobacterium
VDPVLKIPRLQDAYFKRFPDYPKGI

SEQ ID NO: 743841 - protein, 26 aa, Mycobacterium
VDPVLKIPRLRDAYLKRFPDYSKGIT

SEQ ID NO: 743842 - protein, 20 aa, Mycobacterium
VDPYLPPGVKPRWRDYLDSA

SEQ ID NO: 743843 - protein, 17 aa, Mycobacterium
VDQAFKYIRPVRSGDTL

SEQ ID NO: 743844 - protein, 23 aa, Mycobacterium
VDQAKRIADELIQNGVASHASLG

SEQ ID NO: 743845 - protein, 18 aa, Mycobacterium
VDQARTWVGVAGTMTTLA

SEQ ID NO: 743846 - protein, 22 aa, Mycobacterium
VDQGKCLIRVTPKQWGPVATGG

SEQ ID NO: 743847 - protein, 17 aa, Mycobacterium
VDQGWKVATTSLVEERS

SEQ ID NO: 743848 - protein, 18 aa, Mycobacterium
VDQIRFFAGAARVLEGRS

SEQ ID NO: 743849 - protein, 18 aa, Mycobacterium
VDQLAAVNLRVFDDPDGR

SEQ ID NO: 743850 - protein, 22 aa, Mycobacterium
VDQLWGACYHRLLVPDQPLTAG

SEQ ID NO: 743851 - protein, 23 aa, Mycobacterium
VDQPRFLEPYLWALDSLHRRGAR

SEQ ID NO: 743852 - protein, 24 aa, Mycobacterium
VDQPVEFWPTAAIRSALQSGDIAT

SEQ ID NO: 743853 - protein, 18 aa, Mycobacterium
VDQRAAVVAVDMQGYSVA

SEQ ID NO: 743854 - protein, 24 aa, Mycobacterium
VDQRTFGGWMLADLVTVDGSDVPA

SEQ ID NO: 743855 - protein, 19 aa, Mycobacterium
VDQSLRFVRPIKAGDELYC

SEQ ID NO: 743856 - protein, 23 aa, Mycobacterium
VDQVLKFAKPIVAGDKLYCDVYV

SEQ ID NO: 743857 - protein, 18 aa, Mycobacterium
VDQVLKFFAPLVAGDKLY

SEQ ID NO: 743858 - protein, 19 aa, Mycobacterium
VDQVLKFNAPIVAGDKLYC

SEQ ID NO: 743859 - protein, 23 aa, Mycobacterium
VDQVLKFSKPIVAGDILHCDVHV

SEQ ID NO: 743860 - protein, 17 aa, Mycobacterium
VDRAAAAARAFRQLDQQ

SEQ ID NO: 743861 - protein, 17 aa, Mycobacterium
VDRALCDIAAEFGNLDP

SEQ ID NO: 743862 - protein, 21 aa, Mycobacterium
VDRCLQFFGGYGYMMEYPIAR

SEQ ID NO: 743863 - protein, 23 aa, Mycobacterium
VDRDEVLLDIGYKTEGVIPAREL

SEQ ID NO: 743864 - protein, 23 aa, Mycobacterium
VDRDEVLLDIGYKTEGVIPSREL

SEQ ID NO: 743865 - protein, 24 aa, Mycobacterium
VDREVPADVLAGIGRDVNALTLEV

SEQ ID NO: 743866 - protein, 20 aa, Mycobacterium
VDRFERLGARALVKQQEHYV

SEQ ID NO: 743867 - protein, 26 aa, Mycobacterium
VDRFFGDIWWRREFYEARNANGASAA

SEQ ID NO: 743868 - protein, 27 aa, Mycobacterium
VDRFGFPWERLQEINPRLIYASIKGFG

SEQ ID NO: 743869 - protein, 21 aa, Mycobacterium
VDRFVELGARGHLDDAEGPAI

SEQ ID NO: 743870 - protein, 19 aa, Mycobacterium
VDRGELRTTLTTAIDGFTA

SEQ ID NO: 743871 - protein, 23 aa, Mycobacterium
VDRGGGLPAALVLAEAVSWQGRG

SEQ ID NO: 743872 - protein, 17 aa, Mycobacterium
VDRGILPGMQELVRRIG

SEQ ID NO: 743873 - protein, 27 aa, Mycobacterium
VDRGKLLPRDRVDALLDPGSPFLELSP

SEQ ID NO: 743874 - protein, 23 aa, Mycobacterium
VDRIKDLIKSGGEWISSVELENA

SEQ ID NO: 743875 - protein, 22 aa, Mycobacterium
VDRIVSIEAFEHFGHENYDDFF

SEQ ID NO: 743876 - protein, 22 aa, Mycobacterium
VDRIVSIGAFEHFGFNKYEDYF

SEQ ID NO: 743877 - protein, 26 aa, Mycobacterium
VDRKIWSGAGTFLFTRTTVGEIGILP

SEQ ID NO: 743878 - protein, 26 aa, Mycobacterium
VDRKIWSGEATFLFTRTTVGEIGILP

SEQ ID NO: 743879 - protein, 25 aa, Mycobacterium
VDRKIWSGKATFLFTRTTVGEIGIL

SEQ ID NO: 743880 - protein, 17 aa, Mycobacterium
VDRLDRMLTALVRDRDT

SEQ ID NO: 743881 - protein, 22 aa, Mycobacterium
VDRLESYDIFALLHGGGPSGQA

SEQ ID NO: 743882 - protein, 19 aa, Mycobacterium
VDRLISLGARHVDIGQGEQ

SEQ ID NO: 743883 - protein, 24 aa, Mycobacterium
VDRLKPRGRRIVGLTCPGDRRDED

SEQ ID NO: 743884 - protein, 27 aa, Mycobacterium
VDRLKTWWRPGLLCIGDAAHAMSPAGG

SEQ ID NO: 743885 - protein, 23 aa, Mycobacterium
VDRLRQWGIHRIFGYPGDGILSM

SEQ ID NO: 743886 - protein, 22 aa, Mycobacterium
VDRLRYDILFEAAREIIGDDRN

SEQ ID NO: 743887 - protein, 19 aa, Mycobacterium
VDRLSCIRYGSARYSVPMR

SEQ ID NO: 743888 - protein, 19 aa, Mycobacterium
VDRLSCVRYASARYSVPTR

SEQ ID NO: 743889 - protein, 19 aa, Mycobacterium
VDRLSCVRYGSARYSVPTR

SEQ ID NO: 743890 - protein, 25 aa, Mycobacterium
VDRPIEWSKVHLFWGDERYVPEDDD

SEQ ID NO: 743891 - protein, 27 aa, Mycobacterium
VDRRARWGDPVADGFARISLGIEDTDD

SEQ ID NO: 743892 - protein, 27 aa, Mycobacterium
VDRRARWGDPVPEGFVRISAGIEDTDD

SEQ ID NO: 743893 - protein, 27 aa, Mycobacterium
VDRRARWGDSVAAGFARMSMGIEDTDD

SEQ ID NO: 743894 - protein, 29 aa, Mycobacterium
VDRRIGWDKLPAWLGISVLVGIRDALREH

SEQ ID NO: 743895 - protein, 17 aa, Mycobacterium
VDRRLLIDGRLVTTDTR

SEQ ID NO: 743896 - protein, 24 aa, Mycobacterium
VDRRPDLPSGKGLVIAEGVLVVQR

SEQ ID NO: 743897 - protein, 24 aa, Mycobacterium
VDRRPDLPTGKALVIAEGVLVVQR

SEQ ID NO: 743898 - protein, 27 aa, Mycobacterium
VDRRPSWRDARWLAVVINYRAQRWSDV

SEQ ID NO: 743899 - protein, 19 aa, Mycobacterium
VDRRQGWPALNLFYNTAFD

SEQ ID NO: 743900 - protein, 28 aa, Mycobacterium
VDRRRAGLAVGMSEWFAPAPERSPAEST

SEQ ID NO: 743901 - protein, 21 aa, Mycobacterium
VDRRRLWGRGLSAIDAHLLGS

SEQ ID NO: 743902 - protein, 23 aa, Mycobacterium
VDRSRAIAMLIGPLVLGRLSTLP

SEQ ID NO: 743903 - protein, 17 aa, Mycobacterium
VDRSRLAGLQATTLHRL

SEQ ID NO: 743904 - protein, 23 aa, Mycobacterium
VDRTHVECAWAFPREAAERPGFD

SEQ ID NO: 743905 - protein, 24 aa, Mycobacterium
VDRTLRVAWSLADLAGRAAPGLDE

SEQ ID NO: 743906 - protein, 25 aa, Mycobacterium
VDRTLRVAWSLADLAGRVSPSLEDV

SEQ ID NO: 743907 - protein, 18 aa, Mycobacterium
VDRVAPALLRDWIQKYGP

SEQ ID NO: 743908 - protein, 20 aa, Mycobacterium
VDRVKDMIVTGGFNVFPREV

SEQ ID NO: 743909 - protein, 23 aa, Mycobacterium
VDRVKDMIVTGGFNVFPREVEDV

SEQ ID NO: 743910 - protein, 23 aa, Mycobacterium
VDRVKPFRPFQVNEQLLGLADSE

SEQ ID NO: 743911 - protein, 25 aa, Mycobacterium
VDRVPPEQLLKCIEAVLECREALAV

SEQ ID NO: 743912 - protein, 17 aa, Mycobacterium
VDRVVPLLQARGAFRTE

SEQ ID NO: 743913 - protein, 23 aa, Mycobacterium
VDRVVRIAEHLRRDDIVMSVIFN

SEQ ID NO: 743914 - protein, 17 aa, Mycobacterium
VDRYPLRCRPIRDLLVD

SEQ ID NO: 743915 - protein, 24 aa, Mycobacterium
VDRYRVFLELGPHPVLLGNIRESF

SEQ ID NO: 743916 - protein, 18 aa, Mycobacterium
VDSACGHDGFLIEIEAVG

SEQ ID NO: 743917 - protein, 18 aa, Mycobacterium
VDSAHWFVEHEIAALATD

SEQ ID NO: 743918 - protein, 17 aa, Mycobacterium
VDSALSWRDDLDGEAPR

SEQ ID NO: 743919 - protein, 25 aa, Mycobacterium
VDSCGQCSSCLAGLEQYCKPGATFT

SEQ ID NO: 743920 - protein, 22 aa, Mycobacterium
VDSELKFLGALRNAGVQHLALR

SEQ ID NO: 743921 - protein, 25 aa, Mycobacterium
VDSFFLPLVCPRRVTFLAKSEYFTE

SEQ ID NO: 743922 - protein, 26 aa, Mycobacterium
VDSFWRDLVAFTWNIKTVEGHEGIAD

SEQ ID NO: 743923 - protein, 25 aa, Mycobacterium
VDSFWRDLVSFTWNIKTVEGRDQIA

SEQ ID NO: 743924 - protein, 25 aa, Mycobacterium
VDSGAKELVCFDLGSGDRHTIASDL

SEQ ID NO: 743925 - protein, 18 aa, Mycobacterium
VDSGEEWELCELAALYTR

SEQ ID NO: 743926 - protein, 21 aa, Mycobacterium
VDSLCGHDGFLVESDAVGELI

SEQ ID NO: 743927 - protein, 18 aa, Mycobacterium
VDSLLDFSRIEAGRANAK

SEQ ID NO: 743928 - protein, 20 aa, Mycobacterium
VDSLLGRKVDGMIVAPAAGS

SEQ ID NO: 743929 - protein, 21 aa, Mycobacterium
VDSLRIFPATHYVAGPERMAA

SEQ ID NO: 743930 - protein, 22 aa, Mycobacterium
VDSMICGLISGPWLGASATAMA

SEQ ID NO: 743931 - protein, 24 aa, Mycobacterium
VDSPRLPAAAALLALHDLGLGNQI

SEQ ID NO: 743932 - protein, 25 aa, Mycobacterium
VDSPRLRLALGPGVMLPPTLIQVGG

SEQ ID NO: 743933 - protein, 22 aa, Mycobacterium
VDSPSKAAGYWGLPDKSRDTFG

SEQ ID NO: 743934 - protein, 21 aa, Mycobacterium
VDSPSKAAGYWGSPDESRATF

SEQ ID NO: 743935 - protein, 17 aa, Mycobacterium
VDSPWVWVLDPVDGTFN

SEQ ID NO: 743936 - protein, 18 aa, Mycobacterium
VDSPWVWVLDPVDGTFNY

SEQ ID NO: 743937 - protein, 21 aa, Mycobacterium
VDSRIRAGAELLKVERNDKGG

SEQ ID NO: 743938 - protein, 17 aa, Mycobacterium
VDSRISPPSHWGIADTR

SEQ ID NO: 743939 - protein, 23 aa, Mycobacterium
VDSRRLGCEVARAHLHVVRRDDN

SEQ ID NO: 743940 - protein, 17 aa, Mycobacterium
VDTAERFMYDVAERGEL

SEQ ID NO: 743941 - protein, 20 aa, Mycobacterium
VDTAQAWDLLPRVYAENRPS

SEQ ID NO: 743942 - protein, 18 aa, Mycobacterium
VDTAREMLVEVSRLAEGP

SEQ ID NO: 743943 - protein, 20 aa, Mycobacterium
VDTAVLCDLCHGKGTHGDST

SEQ ID NO: 743944 - protein, 24 aa, Mycobacterium
VDTCRRLLDEYADVIHLPVDIVVA

SEQ ID NO: 743945 - protein, 25 aa, Mycobacterium
VDTDLRWRIVTALATAGVIDSDGPE

SEQ ID NO: 743946 - protein, 25 aa, Mycobacterium
VDTEGKPSLGWRGRRAARKVSETVA

SEQ ID NO: 743947 - protein, 23 aa, Mycobacterium
VDTEIPSPVAGTLLSITAEEDDT

SEQ ID NO: 743948 - protein, 22 aa, Mycobacterium
VDTEIPSPVAGTLLSITANEDD

SEQ ID NO: 743949 - protein, 25 aa, Mycobacterium
VDTEIPSPVAGVLLSISANEDDTVA

SEQ ID NO: 743950 - protein, 25 aa, Mycobacterium
VDTEIPSPVAGVLLSITAEEDDVVQ

SEQ ID NO: 743951 - protein, 24 aa, Mycobacterium
VDTEIPSPVAGVLVSITADEDDVV

SEQ ID NO: 743952 - protein, 24 aa, Mycobacterium
VDTEIPSPVAGVLVSITAEEDATV

SEQ ID NO: 743953 - protein, 17 aa, Mycobacterium
VDTFVFADGMIRAQTVR

SEQ ID NO: 743954 - protein, 17 aa, Mycobacterium
VDTGAFISGNYSNGFLW

SEQ ID NO: 743955 - protein, 17 aa, Mycobacterium
VDTGAFISGSYSNGLFW

SEQ ID NO: 743956 - protein, 18 aa, Mycobacterium
VDTGAFISGSYSNGLFWQ

SEQ ID NO: 743957 - protein, 21 aa, Mycobacterium
VDTGGRWLLKLHGSVTESHKM

SEQ ID NO: 743958 - protein, 17 aa, Mycobacterium
VDTGIFISGNYSNGILA

SEQ ID NO: 743959 - protein, 24 aa, Mycobacterium
VDTHFARLVHRWRWTADKDPVKIE

SEQ ID NO: 743960 - protein, 23 aa, Mycobacterium
VDTHFARLVHRWRWTTDKDPVKI

SEQ ID NO: 743961 - protein, 20 aa, Mycobacterium
VDTHFGRLVRRWRWTAEEDP

SEQ ID NO: 743962 - protein, 19 aa, Mycobacterium
VDTHFGRLVRRWRWTDHED

SEQ ID NO: 743963 - protein, 23 aa, Mycobacterium
VDTKRYLSAFGRDVDIHEFELEY

SEQ ID NO: 743964 - protein, 19 aa, Mycobacterium
VDTLAKAGAIFVDETDEVP

SEQ ID NO: 743965 - protein, 20 aa, Mycobacterium
VDTLAKAGAIFVEQTDEVPE

SEQ ID NO: 743966 - protein, 18 aa, Mycobacterium
VDTLLTLPGIGAYTARAV

SEQ ID NO: 743967 - protein, 25 aa, Mycobacterium
VDTLREFLRRFDFLVTPVTTAQAFG

SEQ ID NO: 743968 - protein, 21 aa, Mycobacterium
VDTLVAVACRELLLTDDVRVR

SEQ ID NO: 743969 - protein, 19 aa, Mycobacterium
VDTNFSVSIVDDGTTDDTS

SEQ ID NO: 743970 - protein, 18 aa, Mycobacterium
VDTRGWTPMILLDRTEPA

SEQ ID NO: 743971 - protein, 17 aa, Mycobacterium
VDTRLKPNVEGWFESAT

SEQ ID NO: 743972 - protein, 18 aa, Mycobacterium
VDTRRLMVSIGMALGTTE

SEQ ID NO: 743973 - protein, 23 aa, Mycobacterium
VDTRRPPRLFGLIKQSGGHAARD

SEQ ID NO: 743974 - protein, 25 aa, Mycobacterium
VDTSFSMVMENRWLPMKQTALALNH

SEQ ID NO: 743975 - protein, 25 aa, Mycobacterium
VDTSRLAEDIILWSSTEFGYVRLHD

SEQ ID NO: 743976 - protein, 17 aa, Mycobacterium
VDTSVLWSALRQPEVST

SEQ ID NO: 743977 - protein, 25 aa, Mycobacterium
VDTTPRIAQMFGIQAVPTVVALAGG

SEQ ID NO: 743978 - protein, 22 aa, Mycobacterium
VDTVEAFLVFGSLRRTAAELHL

SEQ ID NO: 743979 - protein, 19 aa, Mycobacterium
VDTVIEAHGKYVIPGGIDA

SEQ ID NO: 743980 - protein, 21 aa, Mycobacterium
VDTWGRLDAVILNAGQWAGGR

SEQ ID NO: 743981 - protein, 24 aa, Mycobacterium
VDTYGRPGLVPSPLYDSLLAKVIT

SEQ ID NO: 743982 - protein, 25 aa, Mycobacterium
VDVAEHLRLGAALFESLAVDRDIEF

SEQ ID NO: 743983 - protein, 20 aa, Mycobacterium
VDVAGWLRGSTVLEFGSPHG

SEQ ID NO: 743984 - protein, 26 aa, Mycobacterium
VDVANHFYCYSFEPNNDWTHFFAEQG

SEQ ID NO: 743985 - protein, 28 aa, Mycobacterium
VDVANHFYCYSFEPNNDWTHFFAEQHEL

SEQ ID NO: 743986 - protein, 24 aa, Mycobacterium
VDVAPRVAQIFGVQAVPTVVALAA

SEQ ID NO: 743987 - protein, 17 aa, Mycobacterium
VDVARLVATGARIANII

SEQ ID NO: 743988 - protein, 24 aa, Mycobacterium
VDVAYSLGFCKPVPHFAFGSSDRA

SEQ ID NO: 743989 - protein, 24 aa, Mycobacterium
VDVAYSLGFCKPVPHFTFGSSDVR

SEQ ID NO: 743990 - protein, 17 aa, Mycobacterium
VDVCAAANEALRLGDLE

SEQ ID NO: 743991 - protein, 21 aa, Mycobacterium
VDVDALQEWKIGQRLLDDMQR

SEQ ID NO: 743992 - protein, 18 aa, Mycobacterium
VDVDTAFRHTLPMPLPTL

SEQ ID NO: 743993 - protein, 22 aa, Mycobacterium
VDVEGARKVFKLVDALEDSDDV

SEQ ID NO: 743994 - protein, 19 aa, Mycobacterium
VDVEIAWNPEFLREGFAVH

SEQ ID NO: 743995 - protein, 23 aa, Mycobacterium
VDVFRRPEELAGIAQEAIDIGAR

SEQ ID NO: 743996 - protein, 28 aa, Mycobacterium
VDVGGFAYAGGWLRPGALTPPRFADRFE

SEQ ID NO: 743997 - protein, 21 aa, Mycobacterium
VDVHRAIPVIRAFTHFALLAN

SEQ ID NO: 743998 - protein, 18 aa, Mycobacterium
VDVIGNGSGMAWVEGSVV

SEQ ID NO: 743999 - protein, 28 aa, Mycobacterium
VDVIQVRRLGAAMSFVIASSEMMAAAAT

SEQ ID NO: 744000 - protein, 17 aa, Mycobacterium
VDVIVCHKFLDPRLDRP

SEQ ID NO: 744001 - protein, 24 aa, Mycobacterium
VDVKRRMMEWFGPIIHEYYGGTEG

SEQ ID NO: 744002 - protein, 17 aa, Mycobacterium
VDVKSGFLDSGKPFERA

SEQ ID NO: 744003 - protein, 24 aa, Mycobacterium
VDVLACGICGSDLHCAAHGPEFNS

SEQ ID NO: 744004 - protein, 20 aa, Mycobacterium
VDVLAKYVERLLPAPRTANA

SEQ ID NO: 744005 - protein, 17 aa, Mycobacterium
VDVLELVLGVTRTPAME

SEQ ID NO: 744006 - protein, 18 aa, Mycobacterium
VDVLELVLGVTRTPAMER

SEQ ID NO: 744007 - protein, 20 aa, Mycobacterium
VDVLLARPGYQHVVITGRDA

SEQ ID NO: 744008 - protein, 17 aa, Mycobacterium
VDVLVQWALASRAEARE

SEQ ID NO: 744009 - protein, 21 aa, Mycobacterium
VDVMALHAWSDVAITELPESD

SEQ ID NO: 744010 - protein, 21 aa, Mycobacterium
VDVPAKLAARVRVLSTGHGRK

SEQ ID NO: 744011 - protein, 17 aa, Mycobacterium
VDVPEAGVVIWGKGFDV

SEQ ID NO: 744012 - protein, 19 aa, Mycobacterium
VDVPFELDFPSTYRVARRH

SEQ ID NO: 744013 - protein, 23 aa, Mycobacterium
VDVPKLGSFEVMNRTIDIAQAAL

SEQ ID NO: 744014 - protein, 24 aa, Mycobacterium
VDVPMRCVFALTAMGFIPASPAED

SEQ ID NO: 744015 - protein, 24 aa, Mycobacterium
VDVPPYRPFWAITRYADIMAIERA

SEQ ID NO: 744016 - protein, 17 aa, Mycobacterium
VDVPRLVSFHNLVDEPA

SEQ ID NO: 744017 - protein, 32 aa, Mycobacterium
VDVPVDLHRCWPRSLCLAGFDPAAPTAWLVEG

SEQ ID NO: 744018 - protein, 20 aa, Mycobacterium
VDVRCGVGVTEVRGTQNVET

SEQ ID NO: 744019 - protein, 26 aa, Mycobacterium
VDVRWQIIDAQGWSSRRLAAALEQQA

SEQ ID NO: 744020 - protein, 17 aa, Mycobacterium
VDVSEWPGIDWPATQSM

SEQ ID NO: 744021 - protein, 17 aa, Mycobacterium
VDVSIRSRAEWARRYQE

SEQ ID NO: 744022 - protein, 22 aa, Mycobacterium
VDVSRLPALLAANPDAALYADA

SEQ ID NO: 744023 - protein, 18 aa, Mycobacterium
VDVTRFLFDEEIASVHIL

SEQ ID NO: 744024 - protein, 33 aa, Mycobacterium
VDVTVASAYKWLLAPRGTAWMSLSDSVAERMTP

SEQ ID NO: 744025 - protein, 17 aa, Mycobacterium
VDVVERIAALTQRLGVT

SEQ ID NO: 744026 - protein, 24 aa, Mycobacterium
VDVVPRVAQIFGVQAVPTVVALAA

SEQ ID NO: 744027 - protein, 21 aa, Mycobacterium
VDVVRCWHRDDGFGRGAGELR

SEQ ID NO: 744028 - protein, 17 aa, Mycobacterium
VDVYRGVNTLVIQYRNQ

SEQ ID NO: 744029 - protein, 19 aa, Mycobacterium
VDVYSCFPSAVQVAAAELG

SEQ ID NO: 744030 - protein, 20 aa, Mycobacterium
VDWAAVFAAHRPRRVDLPTY

SEQ ID NO: 744031 - protein, 17 aa, Mycobacterium
VDWDWCTAGHPLADLAW

SEQ ID NO: 744032 - protein, 17 aa, Mycobacterium
VDWHRAIVDKWREAGVR

SEQ ID NO: 744033 - protein, 26 aa, Mycobacterium
VDWLEPRPGAALGLGAREWPVNHYEL

SEQ ID NO: 744034 - protein, 26 aa, Mycobacterium
VDWLVGAGYTHCFFVAGGNIMHLLNS

SEQ ID NO: 744035 - protein, 24 aa, Mycobacterium
VDWSGIPYLRFLASNVGRGQPLAH

SEQ ID NO: 744036 - protein, 25 aa, Mycobacterium
VDWSGLPYLRFLAANVGRGQPLVHR

SEQ ID NO: 744037 - protein, 22 aa, Mycobacterium
VDWSGLPYLRFLMANTGRGQPV

SEQ ID NO: 744038 - protein, 19 aa, Mycobacterium
VDWVPLAVPVRLRREHPRG

SEQ ID NO: 744039 - protein, 17 aa, Mycobacterium
VDWWLTFSSAAALLGTP

SEQ ID NO: 744040 - protein, 26 aa, Mycobacterium
VDWYDWLIERVRLWPDVKRRNDQLDL

SEQ ID NO: 744041 - protein, 21 aa, Mycobacterium
VDYFCVGPCWPTPTKPGRAAP

SEQ ID NO: 744042 - protein, 23 aa, Mycobacterium
VDYLEIWDAAKWQQYLEEHEENF

SEQ ID NO: 744043 - protein, 20 aa, Mycobacterium
VDYLEIWDAQAWHDYQQLHE

SEQ ID NO: 744044 - protein, 20 aa, Mycobacterium
VDYLEIWDAQAWHEYQQLHE

SEQ ID NO: 744045 - protein, 20 aa, Mycobacterium
VDYLEIWDAQAWQEYQQAHE

SEQ ID NO: 744046 - protein, 19 aa, Mycobacterium
VDYLGGPWKLFGVARIIPA

SEQ ID NO: 744047 - protein, 17 aa, Mycobacterium
VDYLMRLQMIYTAIEDA

SEQ ID NO: 744048 - protein, 21 aa, Mycobacterium
VDYPRSLGMATGFTDRRTTNR

SEQ ID NO: 744049 - protein, 17 aa, Mycobacterium
VDYQHSYSGVRMVDVEP

SEQ ID NO: 744050 - protein, 18 aa, Mycobacterium
VDYQRLNKMPPLESGGLH

SEQ ID NO: 744051 - protein, 17 aa, Mycobacterium
VDYRLAPEFPYPAPVED

SEQ ID NO: 744052 - protein, 17 aa, Mycobacterium
VDYRLAPEWPPPAQFDD

SEQ ID NO: 744053 - protein, 23 aa, Mycobacterium
VDYSEAGLYLWVTRGESCHDSVA

SEQ ID NO: 744054 - protein, 18 aa, Mycobacterium
VDYTGAGTVEFIVSADRP

SEQ ID NO: 744055 - protein, 18 aa, Mycobacterium
VDYVDHFVWVMTDGADGP

SEQ ID NO: 744056 - protein, 18 aa, Mycobacterium
VDYVDHFVWVVTDGVAGP

SEQ ID NO: 744057 - protein, 17 aa, Mycobacterium
VDYWRQHLKTMKGQWAP

SEQ ID NO: 744058 - protein, 17 aa, Mycobacterium
VDYWSIIRAELPAVRGL

SEQ ID NO: 744059 - protein, 26 aa, Mycobacterium
VDYYKWTQWIFLQIYNAWFDRDQNKA

SEQ ID NO: 744060 - protein, 18 aa, Mycobacterium
VEAAAKVNALLDIAQANL

SEQ ID NO: 744061 - protein, 22 aa, Mycobacterium
VEAAAWQVPKFYWTVTSDSALR

SEQ ID NO: 744062 - protein, 24 aa, Mycobacterium
VEAADAFEAVRIIARASAVDVMLR

SEQ ID NO: 744063 - protein, 24 aa, Mycobacterium
VEAADAFEAVRIIARASGIDVTLR

SEQ ID NO: 744064 - protein, 29 aa, Mycobacterium
VEAAGGASQVHWAAGMVVTSGRRQVVLTS

SEQ ID NO: 744065 - protein, 17 aa, Mycobacterium
VEAAGILASGIAELTGH

SEQ ID NO: 744066 - protein, 19 aa, Mycobacterium
VEAAINGFENWASHYVSPI

SEQ ID NO: 744067 - protein, 21 aa, Mycobacterium
VEAAIRLAQDVGIPDNFSQVR

SEQ ID NO: 744068 - protein, 25 aa, Mycobacterium
VEAAKGVAMPLRLTSPAPCTNCHGS

SEQ ID NO: 744069 - protein, 21 aa, Mycobacterium
VEAALALAERITCNAPLSVQA

SEQ ID NO: 744070 - protein, 21 aa, Mycobacterium
VEAALELKNQILVKIYNRKAL

SEQ ID NO: 744071 - protein, 23 aa, Mycobacterium
VEAALNRFGGLDILVNNAGILNI

SEQ ID NO: 744072 - protein, 22 aa, Mycobacterium
VEAALRTALRRELSPRHVPDRF

SEQ ID NO: 744073 - protein, 23 aa, Mycobacterium
VEAARFPSPILLITGDTPAEATH

SEQ ID NO: 744074 - protein, 21 aa, Mycobacterium
VEAATGRPLIGNGTPGAAGSG

SEQ ID NO: 744075 - protein, 26 aa, Mycobacterium
VEADLRSDIWIKLMGNVAFNPLSALT

SEQ ID NO: 744076 - protein, 17 aa, Mycobacterium
VEADRAFHAITLQESGN

SEQ ID NO: 744077 - protein, 19 aa, Mycobacterium
VEAECWATPLVDLVVGEQM

SEQ ID NO: 744078 - protein, 18 aa, Mycobacterium
VEAERIGFRRVFISERWD

SEQ ID NO: 744079 - protein, 26 aa, Mycobacterium
VEAEYRRLAGLGVRFTQEPVEMGPVT

SEQ ID NO: 744080 - protein, 30 aa, Mycobacterium
VEAFAGRAGKKRWAEIEKIIAKGWDKVIEA

SEQ ID NO: 744081 - protein, 23 aa, Mycobacterium
VEAFDWNCSRSIIPRYDQQYLSE

SEQ ID NO: 744082 - protein, 24 aa, Mycobacterium
VEAFNALKKLAMVTSRVLAKTKVD

SEQ ID NO: 744083 - protein, 20 aa, Mycobacterium
VEAGDIWRMCVVKDAPIRDW

SEQ ID NO: 744084 - protein, 17 aa, Mycobacterium
VEAGGLFGSILSGHEDD

SEQ ID NO: 744085 - protein, 22 aa, Mycobacterium
VEAGMRARWLIRGQNADTGPAE

SEQ ID NO: 744086 - protein, 26 aa, Mycobacterium
VEAHLISPWGTWEWLGPAVRAAVLPA

SEQ ID NO: 744087 - protein, 21 aa, Mycobacterium
VEAIAGITLLRLLTRGADLDD

SEQ ID NO: 744088 - protein, 20 aa, Mycobacterium
VEAILRAFGDESYWNARITE

SEQ ID NO: 744089 - protein, 21 aa, Mycobacterium
VEAIPRISRAQVMDALSSQAN

SEQ ID NO: 744090 - protein, 24 aa, Mycobacterium
VEAKHIVAAYAFELGKVETPEIRS

SEQ ID NO: 744091 - protein, 19 aa, Mycobacterium
VEAKLKWPNDVLVDTGKLA

SEQ ID NO: 744092 - protein, 24 aa, Mycobacterium
VEAKRAITELGMCGVVINGHTQGT

SEQ ID NO: 744093 - protein, 24 aa, Mycobacterium
VEALAAAGYEVFAVNPLAVARYRD

SEQ ID NO: 744094 - protein, 18 aa, Mycobacterium
VEALCRAIENAGGRPLPV

SEQ ID NO: 744095 - protein, 18 aa, Mycobacterium
VEALKGGAARDVELLALA

SEQ ID NO: 744096 - protein, 23 aa, Mycobacterium
VEALKPTDICRAAVRRSGADVTL

SEQ ID NO: 744097 - protein, 24 aa, Mycobacterium
VEALLKGLYLYRPAPEKRAKSAQI

SEQ ID NO: 744098 - protein, 20 aa, Mycobacterium
VEALMAMLAPDATWLADSGG

SEQ ID NO: 744099 - protein, 22 aa, Mycobacterium
VEALPGLNGRVVFGSFLPSPTI

SEQ ID NO: 744100 - protein, 23 aa, Mycobacterium
VEALRAGELVGVYPEATISRSFE

SEQ ID NO: 744101 - protein, 17 aa, Mycobacterium
VEALRIKGAKDVGKRAE

SEQ ID NO: 744102 - protein, 18 aa, Mycobacterium
VEALTEFGMRGIDLTRIE

SEQ ID NO: 744103 - protein, 20 aa, Mycobacterium
VEALVGLGFAVKQAEEATDK

SEQ ID NO: 744104 - protein, 17 aa, Mycobacterium
VEALVRVVRDFRPHVIT

SEQ ID NO: 744105 - protein, 21 aa, Mycobacterium
VEALWRRWNEPGAQRRSQLLF

SEQ ID NO: 744106 - protein, 17 aa, Mycobacterium
VEAMALYRHVHSRGDLL

SEQ ID NO: 744107 - protein, 19 aa, Mycobacterium
VEAMTGITLALREYRDGDL

SEQ ID NO: 744108 - protein, 17 aa, Mycobacterium
VEAPDRYLQPSVGTKLR

SEQ ID NO: 744109 - protein, 19 aa, Mycobacterium
VEAPVLDADLLRRAKYSGL

SEQ ID NO: 744110 - protein, 18 aa, Mycobacterium
VEAPWLKRLQALGEDVSL

SEQ ID NO: 744111 - protein, 25 aa, Mycobacterium
VEARAGRLDLMFNNAGIVFGGETEL

SEQ ID NO: 744112 - protein, 20 aa, Mycobacterium
VEARLDLTGRPRFVTARKKG

SEQ ID NO: 744113 - protein, 17 aa, Mycobacterium
VEARPVGMFKMVDDGGG

SEQ ID NO: 744114 - protein, 18 aa, Mycobacterium
VEARRFWRDEYLMNAQIS

SEQ ID NO: 744115 - protein, 26 aa, Mycobacterium
VEARSRLNLADGLLVSAVWASATSQL

SEQ ID NO: 744116 - protein, 32 aa, Mycobacterium
VEASAALIWRRPRWAKRLQPGPVADLLAESHA

SEQ ID NO: 744117 - protein, 29 aa, Mycobacterium
VEASHCYPHFRRFLAEVVRVLRPGGYFAY

SEQ ID NO: 744118 - protein, 24 aa, Mycobacterium
VEASHCYPRFPVFLEEVKRVLRPG

SEQ ID NO: 744119 - protein, 24 aa, Mycobacterium
VEASKLYLTQMVKHHEGAITMAQN

SEQ ID NO: 744120 - protein, 20 aa, Mycobacterium
VEASLRFAVDNCAELDADAH

SEQ ID NO: 744121 - protein, 17 aa, Mycobacterium
VEATLPAIVSVTEKINE

SEQ ID NO: 744122 - protein, 19 aa, Mycobacterium
VEATLRWAGNSMTTNGVSV

SEQ ID NO: 744123 - protein, 32 aa, Mycobacterium
VEATPAQVALAWLRYRADAFGVASVPIPGTRR

SEQ ID NO: 744124 - protein, 20 aa, Mycobacterium
VEAVCNLRRMARIEEQDRDS

SEQ ID NO: 744125 - protein, 19 aa, Mycobacterium
VEAVRPYWEAGFTDVALVQ

SEQ ID NO: 744126 - protein, 18 aa, Mycobacterium
VEAWLGLTAKGGTCVLTA

SEQ ID NO: 744127 - protein, 20 aa, Mycobacterium
VEAYAIQQVNLFRRLRDGRR

SEQ ID NO: 744128 - protein, 21 aa, Mycobacterium
VEAYRGLAMELIEQLGSVDVL

SEQ ID NO: 744129 - protein, 26 aa, Mycobacterium
VECGVWRGGASILMRAVLAANGDEKR

SEQ ID NO: 744130 - protein, 26 aa, Mycobacterium
VECGVWRGGASILMRAVLAAYGDEKR

SEQ ID NO: 744131 - protein, 26 aa, Mycobacterium
VECGVWRGGASILMRAVLAAYGDTTR

SEQ ID NO: 744132 - protein, 26 aa, Mycobacterium
VECGVWRGGASILMRAVLAVYGDKKR

SEQ ID NO: 744133 - protein, 26 aa, Mycobacterium
VECGVWRGGASILMRAVLSAYGDEKR

SEQ ID NO: 744134 - protein, 18 aa, Mycobacterium
VECQARLVGAYAAGKYRL

SEQ ID NO: 744135 - protein, 21 aa, Mycobacterium
VECRAGDGLAAVLAELDDADT

SEQ ID NO: 744136 - protein, 21 aa, Mycobacterium
VECRSEATDLVAVLAELDHAD

SEQ ID NO: 744137 - protein, 23 aa, Mycobacterium
VECTEFFKDTTFRVFQAPYVGSV

SEQ ID NO: 744138 - protein, 19 aa, Mycobacterium
VEDALDILRWAPQAASEPV

SEQ ID NO: 744139 - protein, 25 aa, Mycobacterium
VEDALKSGRLKAVVATSSLELGIDM

SEQ ID NO: 744140 - protein, 17 aa, Mycobacterium
VEDARALAAYLAAKAAG

SEQ ID NO: 744141 - protein, 24 aa, Mycobacterium
VEDCRHLSARLERDLLGAGQQVVR

SEQ ID NO: 744142 - protein, 17 aa, Mycobacterium
VEDCRNLSQRLERDLLN

SEQ ID NO: 744143 - protein, 23 aa, Mycobacterium
VEDCTGCNLCVEACPAVVPGTPV

SEQ ID NO: 744144 - protein, 17 aa, Mycobacterium
VEDFFRPPVRAAAKISP

SEQ ID NO: 744145 - protein, 18 aa, Mycobacterium
VEDFFWYAAQGGYGIQMA

SEQ ID NO: 744146 - protein, 24 aa, Mycobacterium
VEDGPRLALRLQPGEIVVFQNRRT

SEQ ID NO: 744147 - protein, 24 aa, Mycobacterium
VEDGRLSRWTRFSAQAVTTMDPTR

SEQ ID NO: 744148 - protein, 24 aa, Mycobacterium
VEDGRWTVQLQWRTGRSDNKAHFR

SEQ ID NO: 744149 - protein, 19 aa, Mycobacterium
VEDHFDRQIAWLRQMADLC

SEQ ID NO: 744150 - protein, 17 aa, Mycobacterium
VEDKLRTVLWGWAGKPI

SEQ ID NO: 744151 - protein, 18 aa, Mycobacterium
VEDLANYVWYVLDGAGGS

SEQ ID NO: 744152 - protein, 22 aa, Mycobacterium
VEDLKAWLTTVVSRLALDKLRS

SEQ ID NO: 744153 - protein, 25 aa, Mycobacterium
VEDLRAAGALTMLPVALVTFAGVCV

SEQ ID NO: 744154 - protein, 23 aa, Mycobacterium
VEDPARLRDALVSARREAGSSFG

SEQ ID NO: 744155 - protein, 18 aa, Mycobacterium
VEDPGALVMSWFFEAAAG

SEQ ID NO: 744156 - protein, 20 aa, Mycobacterium
VEDPTLDLAHHIRRAALPHP

SEQ ID NO: 744157 - protein, 34 aa, Mycobacterium
VEDREGWHGKAFPPEMARRALAELGEVEGLTVAG

SEQ ID NO: 744158 - protein, 24 aa, Mycobacterium
VEDRLRLLSATLHDFLAGIPADIS

SEQ ID NO: 744159 - protein, 21 aa, Mycobacterium
VEDRTRYAVLETMRAYGRDRL

SEQ ID NO: 744160 - protein, 25 aa, Mycobacterium
VEDSPFEFRACDIRDDDAVKALVDG

SEQ ID NO: 744161 - protein, 17 aa, Mycobacterium
VEDVFPLPRELVGEGSL

SEQ ID NO: 744162 - protein, 17 aa, Mycobacterium
VEDVFPLPRELVGEGTL

SEQ ID NO: 744163 - protein, 18 aa, Mycobacterium
VEDVFPLPRELVGEGTLF

SEQ ID NO: 744164 - protein, 18 aa, Mycobacterium
VEDVKGKAKEAVGAVTGQ

SEQ ID NO: 744165 - protein, 17 aa, Mycobacterium
VEDVMRFEQEFLDHVRG

SEQ ID NO: 744166 - protein, 29 aa, Mycobacterium
VEDYFKLGYRGARFAFGYGACPDLEDRAK

SEQ ID NO: 744167 - protein, 23 aa, Mycobacterium
VEDYGRMGLDRSAQALLLVQSDA

SEQ ID NO: 744168 - protein, 23 aa, Mycobacterium
VEEAKKYPGTQWRYEYSPESYTG

SEQ ID NO: 744169 - protein, 24 aa, Mycobacterium
VEEALRMMINMAYQDVDPLTLQRQ

SEQ ID NO: 744170 - protein, 19 aa, Mycobacterium
VEEARPLLRQFPVLVPTGV

SEQ ID NO: 744171 - protein, 17 aa, Mycobacterium
VEECPVDCIYEGGRALY

SEQ ID NO: 744172 - protein, 17 aa, Mycobacterium
VEEEGRPSLQYIDQSGR

SEQ ID NO: 744173 - protein, 17 aa, Mycobacterium
VEEELRITVKRDPGGLV

SEQ ID NO: 744174 - protein, 19 aa, Mycobacterium
VEEGYILTCQGVPDTDSIT

SEQ ID NO: 744175 - protein, 19 aa, Mycobacterium
VEEHARFGGVVPEIASRAH

SEQ ID NO: 744176 - protein, 18 aa, Mycobacterium
VEEHFRLIADHHVAKQSS

SEQ ID NO: 744177 - protein, 24 aa, Mycobacterium
VEEHGRHALAHVVDVRDGEALSAA

SEQ ID NO: 744178 - protein, 29 aa, Mycobacterium
VEEHGRRCVWAFADVRDAAALTEAIDTGV

SEQ ID NO: 744179 - protein, 23 aa, Mycobacterium
VEEICAPYNKWSVRTVGDLELLG

SEQ ID NO: 744180 - protein, 24 aa, Mycobacterium
VEEKCQHCGEVAATAPRTLTVPEF

SEQ ID NO: 744181 - protein, 21 aa, Mycobacterium
VEELARKGLSILIAPEGTRLD

SEQ ID NO: 744182 - protein, 17 aa, Mycobacterium
VEELCLAGVPFGLRPEA

SEQ ID NO: 744183 - protein, 20 aa, Mycobacterium
VEELGGLAAVLGEATGAERA

SEQ ID NO: 744184 - protein, 20 aa, Mycobacterium
VEELGIDVFLVMPFTSDFMK

SEQ ID NO: 744185 - protein, 24 aa, Mycobacterium
VEELGRSGAALGESGIGYAAGDAV

SEQ ID NO: 744186 - protein, 23 aa, Mycobacterium
VEELKAPLLAAVGAADLALATVN

SEQ ID NO: 744187 - protein, 27 aa, Mycobacterium
VEELLRWATPVMHFRRTVTRDVVIRGQ

SEQ ID NO: 744188 - protein, 18 aa, Mycobacterium
VEELRTVLETSGFPAVVR

SEQ ID NO: 744189 - protein, 19 aa, Mycobacterium
VEELVPLIRRIWNLHEGPV

SEQ ID NO: 744190 - protein, 22 aa, Mycobacterium
VEELVRWATPVMTFRRTAAADF

SEQ ID NO: 744191 - protein, 25 aa, Mycobacterium
VEEMGIDVFLVMPFTSDFMKLTPER

SEQ ID NO: 744192 - protein, 27 aa, Mycobacterium
VEEMIRWSTPVKEFMRTAAEDTEVRGV

SEQ ID NO: 744193 - protein, 23 aa, Mycobacterium
VEEMLRFTSPVTHMARRATEDVE

SEQ ID NO: 744194 - protein, 18 aa, Mycobacterium
VEEMLRWTSPVKNMCRML

SEQ ID NO: 744195 - protein, 23 aa, Mycobacterium
VEEMLRWTSPVTVFSRTATRDTD

SEQ ID NO: 744196 - protein, 23 aa, Mycobacterium
VEEMLRWTSPVVHMARTATTDVE

SEQ ID NO: 744197 - protein, 17 aa, Mycobacterium
VEEMVRWTSPSPSKRRT

SEQ ID NO: 744198 - protein, 19 aa, Mycobacterium
VEENFRLLDRAARERIAAW

SEQ ID NO: 744199 - protein, 22 aa, Mycobacterium
VEEPARLREALVSARREAASAF

SEQ ID NO: 744200 - protein, 18 aa, Mycobacterium
VEEPEAFLHPAAQERLRE

SEQ ID NO: 744201 - protein, 21 aa, Mycobacterium
VEEPWRAQRVLDHATTLAQIC

SEQ ID NO: 744202 - protein, 17 aa, Mycobacterium
VEERRKTVTLARQGEEM

SEQ ID NO: 744203 - protein, 19 aa, Mycobacterium
VEERSCWHIWISPAQRRAI

SEQ ID NO: 744204 - protein, 22 aa, Mycobacterium
VEESRALLARLRDWATQPRYVY

SEQ ID NO: 744205 - protein, 24 aa, Mycobacterium
VEEVLRIGVKIAAALESAHRVGVV

SEQ ID NO: 744206 - protein, 25 aa, Mycobacterium
VEEVLRLEGLEIIPSVLPTAPAGRG

SEQ ID NO: 744207 - protein, 24 aa, Mycobacterium
VEEVLRWGSPLLHMRRTATQDVTV

SEQ ID NO: 744208 - protein, 31 aa, Mycobacterium
VEEVVQRLTASFAHARSRLDEQWSQGQDAST

SEQ ID NO: 744209 - protein, 17 aa, Mycobacterium
VEFAFFVILLAVAGNET

SEQ ID NO: 744210 - protein, 20 aa, Mycobacterium
VEFDPRLLAADYVHMILEAY

SEQ ID NO: 744211 - protein, 27 aa, Mycobacterium
VEFDSRAVGPGGLFLALPGARADGHDY

SEQ ID NO: 744212 - protein, 19 aa, Mycobacterium
VEFDTEIFDAASIEALVDR

SEQ ID NO: 744213 - protein, 17 aa, Mycobacterium
VEFFTRWVSGDLVAADV

SEQ ID NO: 744214 - protein, 17 aa, Mycobacterium
VEFGFAAHRGMTVLPLA

SEQ ID NO: 744215 - protein, 18 aa, Mycobacterium
VEFIAAAISTLGTQITDS

SEQ ID NO: 744216 - protein, 18 aa, Mycobacterium
VEFIAAAISTLGTQVLDN

SEQ ID NO: 744217 - protein, 25 aa, Mycobacterium
VEFIAEAIATLGARDGKGFQTYHVM

SEQ ID NO: 744218 - protein, 19 aa, Mycobacterium
VEFIAEAISTLGAQSQDGF

SEQ ID NO: 744219 - protein, 25 aa, Mycobacterium
VEFIAEAVATLGARRHDGFQVHHVA

SEQ ID NO: 744220 - protein, 22 aa, Mycobacterium
VEFKQKSAHLFGATHGAGSISE

SEQ ID NO: 744221 - protein, 17 aa, Mycobacterium
VEFLEVLLGCAKIGAIT

SEQ ID NO: 744222 - protein, 18 aa, Mycobacterium
VEFLLRMIQSMVIAPPDP

SEQ ID NO: 744223 - protein, 18 aa, Mycobacterium
VEFLPALRSAAPDVIHPV

SEQ ID NO: 744224 - protein, 28 aa, Mycobacterium
VEFPEIARTLALSGVDLFVVSSANMFPY

SEQ ID NO: 744225 - protein, 18 aa, Mycobacterium
VEFSAARPGMLGLQTALS

SEQ ID NO: 744226 - protein, 20 aa, Mycobacterium
VEFTCSLPVVAAGERIASRS

SEQ ID NO: 744227 - protein, 34 aa, Mycobacterium
VEFTFRAAQELPWHPGRCAAILIGDTVVGHAGEL

SEQ ID NO: 744228 - protein, 32 aa, Mycobacterium
VEFTTAAKIAVTWRLPVVFVVENIRGGPDARR

SEQ ID NO: 744229 - protein, 21 aa, Mycobacterium
VEFVHGPGCPVCVTPLEVIDR

SEQ ID NO: 744230 - protein, 26 aa, Mycobacterium
VEFYGNRGWLAWPRGFFGDPPPLPDV

SEQ ID NO: 744231 - protein, 18 aa, Mycobacterium
VEGAEIATGIYLLSAADR

SEQ ID NO: 744232 - protein, 18 aa, Mycobacterium
VEGAKGKAKEVFGAVTGR

SEQ ID NO: 744233 - protein, 17 aa, Mycobacterium
VEGCDFAPSFSIWTTIE

SEQ ID NO: 744234 - protein, 19 aa, Mycobacterium
VEGDIPWTNPDCGRAGTVH

SEQ ID NO: 744235 - protein, 27 aa, Mycobacterium
VEGDLCLPLPKFSDIRYNYSLAGGATM

SEQ ID NO: 744236 - protein, 22 aa, Mycobacterium
VEGDLISRCEIFDAADLDAALA

SEQ ID NO: 744237 - protein, 18 aa, Mycobacterium
VEGDRVDRCELFDEADLD

SEQ ID NO: 744238 - protein, 18 aa, Mycobacterium
VEGEGALHVTLRDGAVVG

SEQ ID NO: 744239 - protein, 17 aa, Mycobacterium
VEGELRYLFDNSDMVAL

SEQ ID NO: 744240 - protein, 24 aa, Mycobacterium
VEGESFLNLAHRWYGDEALAVVIA

SEQ ID NO: 744241 - protein, 23 aa, Mycobacterium
VEGFSRDGVTRWRSIPYAEPPVG

SEQ ID NO: 744242 - protein, 23 aa, Mycobacterium
VEGFTRDGVHRWRSIPYARAPIG

SEQ ID NO: 744243 - protein, 18 aa, Mycobacterium
VEGFVREECEPIDLIVKE

SEQ ID NO: 744244 - protein, 24 aa, Mycobacterium
VEGGWSLSGTKVWTSGAHLAHAFI

SEQ ID NO: 744245 - protein, 18 aa, Mycobacterium
VEGILDCAELLVVALGDD

SEQ ID NO: 744246 - protein, 19 aa, Mycobacterium
VEGILECAELLVVALCDDR

SEQ ID NO: 744247 - protein, 19 aa, Mycobacterium
VEGILECAELLVVALCDNR

SEQ ID NO: 744248 - protein, 18 aa, Mycobacterium
VEGILECAELMVVALRDG

SEQ ID NO: 744249 - protein, 17 aa, Mycobacterium
VEGLATVIPFHRAVTAD

SEQ ID NO: 744250 - protein, 17 aa, Mycobacterium
VEGLLMYLTGDAQNLLF

SEQ ID NO: 744251 - protein, 24 aa, Mycobacterium
VEGLPPNRVTLIWNAATDNPVRDE

SEQ ID NO: 744252 - protein, 24 aa, Mycobacterium
VEGLPRGGLLAVVADHGMIALDDN

SEQ ID NO: 744253 - protein, 24 aa, Mycobacterium
VEGMLALTGYFAWHKICVDRGILP

SEQ ID NO: 744254 - protein, 36 aa, Mycobacterium
VEGMLALTGYYAWHKICVERGILPGMQRLVRHISDD

SEQ ID NO: 744255 - protein, 26 aa, Mycobacterium
VEGMLALTGYYAWHRICVDRGILPGM

SEQ ID NO: 744256 - protein, 18 aa, Mycobacterium
VEGNPSMSLELYLEPSKE

SEQ ID NO: 744257 - protein, 22 aa, Mycobacterium
VEGNWVAGWVDFAGPTVDVGSL

SEQ ID NO: 744258 - protein, 22 aa, Mycobacterium
VEGPSKVGIVFGELVDGEVNVR

SEQ ID NO: 744259 - protein, 31 aa, Mycobacterium
VEGQFPPGVVIPLHPGARVFILTEQDAIDFA

SEQ ID NO: 744260 - protein, 26 aa, Mycobacterium
VEGQPGRFLLVTNFEYATPQFMFPGY

SEQ ID NO: 744261 - protein, 27 aa, Mycobacterium
VEGQTFAPECWLTWSGVAAAGSTFRLQ

SEQ ID NO: 744262 - protein, 17 aa, Mycobacterium
VEGRGQEALSLLGQAVT

SEQ ID NO: 744263 - protein, 27 aa, Mycobacterium
VEGRLFQIRHCMNLAGQVRQLPPFAPP

SEQ ID NO: 744264 - protein, 21 aa, Mycobacterium
VEGRPAGTMRVRWFAEFAKFE

SEQ ID NO: 744265 - protein, 21 aa, Mycobacterium
VEGRTRVSLALPGDLVPGDPR

SEQ ID NO: 744266 - protein, 22 aa, Mycobacterium
VEGSELGWRMEVEADGEWRFFD

SEQ ID NO: 744267 - protein, 34 aa, Mycobacterium
VEGSGFAIAQARLGPGRIHHCMRAIGAAERALTL

SEQ ID NO: 744268 - protein, 17 aa, Mycobacterium
VEGSGGYGIVFGPDASD

SEQ ID NO: 744269 - protein, 17 aa, Mycobacterium
VEGSGGYGIVFGPEASD

SEQ ID NO: 744270 - protein, 17 aa, Mycobacterium
VEGSGGYGIVFGPEASE

SEQ ID NO: 744271 - protein, 18 aa, Mycobacterium
VEGSWFWVDGQNAHWRPE

SEQ ID NO: 744272 - protein, 22 aa, Mycobacterium
VEGTRLAAVPPRTGSLRDDLLR

SEQ ID NO: 744273 - protein, 18 aa, Mycobacterium
VEGVKGKAKEVGGAVLGR

SEQ ID NO: 744274 - protein, 18 aa, Mycobacterium
VEGVKGKVKEVGGAALGR

SEQ ID NO: 744275 - protein, 33 aa, Mycobacterium
VEGVKMAINYGFNKARFITPVAVGAKIRASARV

SEQ ID NO: 744276 - protein, 19 aa, Mycobacterium
VEGVWQLRGEMTLSPQLTT

SEQ ID NO: 744277 - protein, 17 aa, Mycobacterium
VEGWPAWTKSMREIERL

SEQ ID NO: 744278 - protein, 28 aa, Mycobacterium
VEHAFSWILPLMWRMDAIYDARKSWVDI

SEQ ID NO: 744279 - protein, 29 aa, Mycobacterium
VEHAFTWILPLMWRMDAIYAARKSRVDIK

SEQ ID NO: 744280 - protein, 29 aa, Mycobacterium
VEHAFTWILPLMWRMDAIYERRKSWLNIK

SEQ ID NO: 744281 - protein, 24 aa, Mycobacterium
VEHARTRLVAKLSYTNIGFALAPK

SEQ ID NO: 744282 - protein, 25 aa, Mycobacterium
VEHDWAPKVYGAWNLHQAVQSGGPA

SEQ ID NO: 744283 - protein, 22 aa, Mycobacterium
VEHETFFPLLPIVVPDTSDGDL

SEQ ID NO: 744284 - protein, 25 aa, Mycobacterium
VEHFDWLEDLGFQFERSYFPGKAVI

SEQ ID NO: 744285 - protein, 20 aa, Mycobacterium
VEHFGRLDIVLANAGIAPLA

SEQ ID NO: 744286 - protein, 18 aa, Mycobacterium
VEHFILEDYWGRWLGRWT

SEQ ID NO: 744287 - protein, 17 aa, Mycobacterium
VEHFILEEQWGRFLGRW

SEQ ID NO: 744288 - protein, 20 aa, Mycobacterium
VEHFNWLEDLGFQFERSYFP

SEQ ID NO: 744289 - protein, 20 aa, Mycobacterium
VEHFNWLEDLGFQFERSYYP

SEQ ID NO: 744290 - protein, 17 aa, Mycobacterium
VEHGHIFLAQPPLYKLK

SEQ ID NO: 744291 - protein, 17 aa, Mycobacterium
VEHGPLPPQGRSFVGGG

SEQ ID NO: 744292 - protein, 23 aa, Mycobacterium
VEHHAVLDAVEWLVAHEGAEVTW

SEQ ID NO: 744293 - protein, 25 aa, Mycobacterium
VEHIDALGFDEAWIGEHHSAGSEII

SEQ ID NO: 744294 - protein, 25 aa, Mycobacterium
VEHLDALGFDEAWIGEHHSAGSEII

SEQ ID NO: 744295 - protein, 24 aa, Mycobacterium
VEHRRADILAVQWHPEDRHATADS

SEQ ID NO: 744296 - protein, 17 aa, Mycobacterium
VEHVGSALPEFALAMRD

SEQ ID NO: 744297 - protein, 18 aa, Mycobacterium
VEHVGSALPEFALTMRDQ

SEQ ID NO: 744298 - protein, 17 aa, Mycobacterium
VEHYLRTPFVLTKASVP

SEQ ID NO: 744299 - protein, 17 aa, Mycobacterium
VEHYLRTPFVLTQAAVP

SEQ ID NO: 744300 - protein, 24 aa, Mycobacterium
VEHYYAPAAHSWRKTIGVADDGTE

SEQ ID NO: 744301 - protein, 18 aa, Mycobacterium
VEIAEMFQMPPALDRAWH

SEQ ID NO: 744302 - protein, 18 aa, Mycobacterium
VEIAEMFQMPPALEQAWH

SEQ ID NO: 744303 - protein, 19 aa, Mycobacterium
VEIAEMFQMPPALERAWHT

SEQ ID NO: 744304 - protein, 28 aa, Mycobacterium
VEIAEMFRMPPALERAWHTHGYYGSVSH

SEQ ID NO: 744305 - protein, 19 aa, Mycobacterium
VEIAHRYGARVLIDGAQSV

SEQ ID NO: 744306 - protein, 18 aa, Mycobacterium
VEIAIAFEELLARVTNFR

SEQ ID NO: 744307 - protein, 17 aa, Mycobacterium
VEIARRLLAAVGDDGLV

SEQ ID NO: 744308 - protein, 24 aa, Mycobacterium
VEICRKVWRRERLRHDGKHYQIPL

SEQ ID NO: 744309 - protein, 19 aa, Mycobacterium
VEIDELWRGGPYAYQTVAM

SEQ ID NO: 744310 - protein, 17 aa, Mycobacterium
VEIDGRRGTPASCTTPV

SEQ ID NO: 744311 - protein, 25 aa, Mycobacterium
VEIDQCTGCNGLFLDRGELEALSQA

SEQ ID NO: 744312 - protein, 23 aa, Mycobacterium
VEIEGSPSMRCEFEMAEDHDHDL

SEQ ID NO: 744313 - protein, 19 aa, Mycobacterium
VEIFMPPKPRTVAVESPLA

SEQ ID NO: 744314 - protein, 17 aa, Mycobacterium
VEIHAANGYLLDQFLTT

SEQ ID NO: 744315 - protein, 17 aa, Mycobacterium
VEIHGANGYLLDAFLKD

SEQ ID NO: 744316 - protein, 25 aa, Mycobacterium
VEIHSLPLYHCAQLDNFLATDVYLG

SEQ ID NO: 744317 - protein, 25 aa, Mycobacterium
VEIHSLPLYHCAQLDNFLVTDVYLG

SEQ ID NO: 744318 - protein, 23 aa, Mycobacterium
VEIKKQMMDWWGPIIDEYYASSE

SEQ ID NO: 744319 - protein, 28 aa, Mycobacterium
VEIKTPCPRIDLIAAFADATRRVYLTAT

SEQ ID NO: 744320 - protein, 17 aa, Mycobacterium
VEILATGEVLGWEVLRE

SEQ ID NO: 744321 - protein, 24 aa, Mycobacterium
VEILGKGYLGLVFNGFDYTNVPVV

SEQ ID NO: 744322 - protein, 20 aa, Mycobacterium
VEILKWAKSQGISITAEVTP

SEQ ID NO: 744323 - protein, 25 aa, Mycobacterium
VEILPTPFLPAGVFDLWGLPADDPR

SEQ ID NO: 744324 - protein, 18 aa, Mycobacterium
VEILRDGFEWQQVYTRSE

SEQ ID NO: 744325 - protein, 18 aa, Mycobacterium
VEILTRMYGLARPIAVEA

SEQ ID NO: 744326 - protein, 21 aa, Mycobacterium
VEIMTALYFEELREGDRVSVK

SEQ ID NO: 744327 - protein, 18 aa, Mycobacterium
VEINEAFAAVALASTKEL

SEQ ID NO: 744328 - protein, 19 aa, Mycobacterium
VEINEAFAAVALASTRELG

SEQ ID NO: 744329 - protein, 23 aa, Mycobacterium
VEINEAFAPVVLAWIKDLKADPE

SEQ ID NO: 744330 - protein, 22 aa, Mycobacterium
VEINEAFAPVVLAWLKEIKADP

SEQ ID NO: 744331 - protein, 22 aa, Mycobacterium
VEINEAFAPVVLAWLKEVKADP

SEQ ID NO: 744332 - protein, 23 aa, Mycobacterium
VEINEAFAPVVMAWLKEIKADPE

SEQ ID NO: 744333 - protein, 21 aa, Mycobacterium
VEINEAFAPVVQAWLKETKAD

SEQ ID NO: 744334 - protein, 20 aa, Mycobacterium
VEINEAFSAVALASTRELGL

SEQ ID NO: 744335 - protein, 22 aa, Mycobacterium
VEIPDALRHIWVARGGDREPST

SEQ ID NO: 744336 - protein, 19 aa, Mycobacterium
VEIPFKLHHPMWREHCDVD

SEQ ID NO: 744337 - protein, 23 aa, Mycobacterium
VEIPTMLQWRAEDVDRLPIAEAI

SEQ ID NO: 744338 - protein, 26 aa, Mycobacterium
VEIRRLAIACLRELVTVAPAVFSDFV

SEQ ID NO: 744339 - protein, 25 aa, Mycobacterium
VEIRRLAIACLRQLADLAPSIFGDF

SEQ ID NO: 744340 - protein, 23 aa, Mycobacterium
VEIRRLAIECLRQLADSAPAVFA

SEQ ID NO: 744341 - protein, 23 aa, Mycobacterium
VEIRRLAIECLRQLAEAAPAVFA

SEQ ID NO: 744342 - protein, 30 aa, Mycobacterium
VEIRRLAIECLRQLAGAAPAVFADFEISAL

SEQ ID NO: 744343 - protein, 28 aa, Mycobacterium
VEIRRLAIECLRQLVAVAPAVFADFEVT

SEQ ID NO: 744344 - protein, 28 aa, Mycobacterium
VEIRRLAIECLRRLVAVAPQVFSDFEIT

SEQ ID NO: 744345 - protein, 23 aa, Mycobacterium
VEIRWGHGLADMAPRPDGVTLNV

SEQ ID NO: 744346 - protein, 22 aa, Mycobacterium
VEIRYRPLEVVVSPGTADDPDD

SEQ ID NO: 744347 - protein, 17 aa, Mycobacterium
VEIYEAVLATRDRDTDP

SEQ ID NO: 744348 - protein, 24 aa, Mycobacterium
VEIYRPRLAGPVPQAEEVVATAVR

SEQ ID NO: 744349 - protein, 23 aa, Mycobacterium
VEKARDLWHGRIRPFAHNLAAGE

SEQ ID NO: 744350 - protein, 24 aa, Mycobacterium
VEKAWDYAMAGSRVTNNRVIVEGF

SEQ ID NO: 744351 - protein, 21 aa, Mycobacterium
VEKFWAWADCDGHPENVFTRD

SEQ ID NO: 744352 - protein, 27 aa, Mycobacterium
VEKILGRPALPFGHWVAEHRDVFTNEN

SEQ ID NO: 744353 - protein, 24 aa, Mycobacterium
VEKLAKLKPVFGVKAGDATMTAGN

SEQ ID NO: 744354 - protein, 24 aa, Mycobacterium
VEKLASLRPVFGVKAGDATMTAGN

SEQ ID NO: 744355 - protein, 24 aa, Mycobacterium
VEKLATLKPVFNRDGTVTAGNASP

SEQ ID NO: 744356 - protein, 34 aa, Mycobacterium
VEKLDYLVDLGIDFVELLPVNSFAGTRGWGYDGV

SEQ ID NO: 744357 - protein, 17 aa, Mycobacterium
VEKLGPMARMLKAVLHD

SEQ ID NO: 744358 - protein, 21 aa, Mycobacterium
VEKRLAGAGLDVFADEPHVPE

SEQ ID NO: 744359 - protein, 25 aa, Mycobacterium
VEKRWPRYRRYALEQTPIRSILSYE

SEQ ID NO: 744360 - protein, 24 aa, Mycobacterium
VEKRWQLPPGSIRAEFGTGTVDMF

SEQ ID NO: 744361 - protein, 22 aa, Mycobacterium
VEKTATVIQRWVQEYLEATNRL

SEQ ID NO: 744362 - protein, 23 aa, Mycobacterium
VEKWCGEAIGLIGTVKEAIIGTV

SEQ ID NO: 744363 - protein, 27 aa, Mycobacterium
VELAARWLRPGGVFAVEHDDTTAARTV

SEQ ID NO: 744364 - protein, 17 aa, Mycobacterium
VELAASLGMVAAVPETP

SEQ ID NO: 744365 - protein, 20 aa, Mycobacterium
VELAELRDGALLTEVIASTL

SEQ ID NO: 744366 - protein, 18 aa, Mycobacterium
VELARFTADLPFALDDFQ

SEQ ID NO: 744367 - protein, 20 aa, Mycobacterium
VELARGLARRGFPLMLVARR

SEQ ID NO: 744368 - protein, 24 aa, Mycobacterium
VELARSGVIHALWAADNAGPDERH

SEQ ID NO: 744369 - protein, 24 aa, Mycobacterium
VELARSGVIHALWASDAHPGADGQ

SEQ ID NO: 744370 - protein, 30 aa, Mycobacterium
VELASSGAWCVAADFSVGMLAAGASRRVPK

SEQ ID NO: 744371 - protein, 21 aa, Mycobacterium
VELCAGSAALAIALAQHEPTA

SEQ ID NO: 744372 - protein, 17 aa, Mycobacterium
VELDQRFGIADRIEKRH

SEQ ID NO: 744373 - protein, 20 aa, Mycobacterium
VELDRRLRDSGVRAFAVHPG

SEQ ID NO: 744374 - protein, 19 aa, Mycobacterium
VELDVSAGFDITELPRAVD

SEQ ID NO: 744375 - protein, 17 aa, Mycobacterium
VELDVSAGFDVAQLPGA

SEQ ID NO: 744376 - protein, 17 aa, Mycobacterium
VELEEGVRMLGELRNVD

SEQ ID NO: 744377 - protein, 21 aa, Mycobacterium
VELEGSGLFARMLQHETGHLD

SEQ ID NO: 744378 - protein, 25 aa, Mycobacterium
VELELGWGRLIFGQTFADPEKLAEA

SEQ ID NO: 744379 - protein, 17 aa, Mycobacterium
VELFDDLVRLFPPLFPM

SEQ ID NO: 744380 - protein, 24 aa, Mycobacterium
VELFTAEAIWEMPPYAGWYRGAAD

SEQ ID NO: 744381 - protein, 24 aa, Mycobacterium
VELFTAEAIWEMPPYAGWYRGARD

SEQ ID NO: 744382 - protein, 25 aa, Mycobacterium
VELFTAEAIWEMPPYVGWYRGAQDI

SEQ ID NO: 744383 - protein, 18 aa, Mycobacterium
VELGFDFLPGTTVNRYCS

SEQ ID NO: 744384 - protein, 21 aa, Mycobacterium
VELGFDYPDYLLAVVDHTGAD

SEQ ID NO: 744385 - protein, 27 aa, Mycobacterium
VELGHRRICGVFGPATLDTMVRRRHGF

SEQ ID NO: 744386 - protein, 20 aa, Mycobacterium
VELGLTPIVRYVAGAVTGAD

SEQ ID NO: 744387 - protein, 19 aa, Mycobacterium
VELGLTPLVRYLAGAVTGA

SEQ ID NO: 744388 - protein, 18 aa, Mycobacterium
VELGQLFRLPIAALGNGA

SEQ ID NO: 744389 - protein, 18 aa, Mycobacterium
VELGQLFRLPIAALGNGS

SEQ ID NO: 744390 - protein, 23 aa, Mycobacterium
VELGWLREVLKDWARSTRPYVQG

SEQ ID NO: 744391 - protein, 29 aa, Mycobacterium
VELHFGHLYLPSSFLSPLINRRKDDYGGS

SEQ ID NO: 744392 - protein, 17 aa, Mycobacterium
VELHRRIAYVPGDVMLW

SEQ ID NO: 744393 - protein, 17 aa, Mycobacterium
VELKIVRHNMPFGEVGK

SEQ ID NO: 744394 - protein, 23 aa, Mycobacterium
VELKKWLIGYVVANIDCSPDEID

SEQ ID NO: 744395 - protein, 18 aa, Mycobacterium
VELLADVVNKVWFLDAVR

SEQ ID NO: 744396 - protein, 25 aa, Mycobacterium
VELLADVVNRVWFLDAVRGEADVYN

SEQ ID NO: 744397 - protein, 24 aa, Mycobacterium
VELLADVVNRVWFLDAVRGEVDVY

SEQ ID NO: 744398 - protein, 19 aa, Mycobacterium
VELLAQRAAELGIPIRYET

SEQ ID NO: 744399 - protein, 19 aa, Mycobacterium
VELLCTLPVDMAADRISTR

SEQ ID NO: 744400 - protein, 19 aa, Mycobacterium
VELLDGFTPEMVVSAQGDD

SEQ ID NO: 744401 - protein, 18 aa, Mycobacterium
VELLEASQSFLAMDPPRH

SEQ ID NO: 744402 - protein, 26 aa, Mycobacterium
VELLFREDFNAYGIEVVQGLLDAGCA

SEQ ID NO: 744403 - protein, 23 aa, Mycobacterium
VELLKWAKAQGISITAEVTPHHL

SEQ ID NO: 744404 - protein, 20 aa, Mycobacterium
VELLPELDVFCLIRAQSEEQ

SEQ ID NO: 744405 - protein, 17 aa, Mycobacterium
VELLRALAVSDLDPYIE

SEQ ID NO: 744406 - protein, 21 aa, Mycobacterium
VELLREAWLTATRARNALVLV

SEQ ID NO: 744407 - protein, 23 aa, Mycobacterium
VELLREVVDFELPAPTADGDNTF

SEQ ID NO: 744408 - protein, 21 aa, Mycobacterium
VELLRQAWLTATRARNALVLV

SEQ ID NO: 744409 - protein, 18 aa, Mycobacterium
VELLRSRIFFDWFDAAGV

SEQ ID NO: 744410 - protein, 18 aa, Mycobacterium
VELLWKVIEQHPGTEITV

SEQ ID NO: 744411 - protein, 25 aa, Mycobacterium
VELNEAGAPSAVWVVTPNGRFTIAA

SEQ ID NO: 744412 - protein, 25 aa, Mycobacterium
VELNVRWRKGQTLEPDWQIDQDGWV

SEQ ID NO: 744413 - protein, 17 aa, Mycobacterium
VELPHKVYMASADHAIP

SEQ ID NO: 744414 - protein, 18 aa, Mycobacterium
VELPIRFLSVIAFPDSQV

SEQ ID NO: 744415 - protein, 17 aa, Mycobacterium
VELPSLVADAARGAARL

SEQ ID NO: 744416 - protein, 21 aa, Mycobacterium
VELQLWVAACLYKGGVDIYRT

SEQ ID NO: 744417 - protein, 25 aa, Mycobacterium
VELQRRGCVVSRLILLDAQPVMDGE

SEQ ID NO: 744418 - protein, 22 aa, Mycobacterium
VELRAIPGPRDDWFVDPEALVH

SEQ ID NO: 744419 - protein, 22 aa, Mycobacterium
VELRDHLEILIATSAARHRTTR

SEQ ID NO: 744420 - protein, 27 aa, Mycobacterium
VELREGQRLWLSWAMANRDPAVFTDPD

SEQ ID NO: 744421 - protein, 23 aa, Mycobacterium
VELRHLGGALAREATHRSAFCHR

SEQ ID NO: 744422 - protein, 19 aa, Mycobacterium
VELRLGSETVVLDFPKRIV

SEQ ID NO: 744423 - protein, 22 aa, Mycobacterium
VELRLHLAALLADRGRHAEALG

SEQ ID NO: 744424 - protein, 17 aa, Mycobacterium
VELRNLVTHDDCEALAA

SEQ ID NO: 744425 - protein, 19 aa, Mycobacterium
VELRNRLKTATGLTLSPTL

SEQ ID NO: 744426 - protein, 20 aa, Mycobacterium
VELRNRLKTATGLTLSPTLI

SEQ ID NO: 744427 - protein, 19 aa, Mycobacterium
VELRNRLKTVTGLGLSPTL

SEQ ID NO: 744428 - protein, 18 aa, Mycobacterium
VELRNRLTAATGLALSRT

SEQ ID NO: 744429 - protein, 18 aa, Mycobacterium
VELRNRLYGQFGGAFTIS

SEQ ID NO: 744430 - protein, 20 aa, Mycobacterium
VELRPRMATLNPCSMSFGAG

SEQ ID NO: 744431 - protein, 18 aa, Mycobacterium
VELRRALSEVARTPRLLV

SEQ ID NO: 744432 - protein, 17 aa, Mycobacterium
VELRRPGGPGVIQGRDI

SEQ ID NO: 744433 - protein, 18 aa, Mycobacterium
VELRRRIEQGVGKDIPVT

SEQ ID NO: 744434 - protein, 18 aa, Mycobacterium
VELRRRIEQGVGKEIPAT

SEQ ID NO: 744435 - protein, 19 aa, Mycobacterium
VELRRRIETGVGKEIPVTL

SEQ ID NO: 744436 - protein, 21 aa, Mycobacterium
VELRRRVEHAVGRELPATLAM

SEQ ID NO: 744437 - protein, 20 aa, Mycobacterium
VELRVPLRETFAGKAKGHGR

SEQ ID NO: 744438 - protein, 20 aa, Mycobacterium
VELRVPLRETFAGKATGHGR

SEQ ID NO: 744439 - protein, 17 aa, Mycobacterium
VELRVPVSETVTIPLTP

SEQ ID NO: 744440 - protein, 24 aa, Mycobacterium
VELSWEILDPVLEYWAQHGKPEPY

SEQ ID NO: 744441 - protein, 27 aa, Mycobacterium
VELSWRILDPALDFWASQGRPDTYESG

SEQ ID NO: 744442 - protein, 18 aa, Mycobacterium
VELTELWPTATGGPGRGA

SEQ ID NO: 744443 - protein, 29 aa, Mycobacterium
VELTLALLPALRRAHGQVVFINSGSGRNV

SEQ ID NO: 744444 - protein, 28 aa, Mycobacterium
VELTLALLPALRRARGQVIFINSGAGRN

SEQ ID NO: 744445 - protein, 22 aa, Mycobacterium
VELTVALAREMLAAAGIDGVDP

SEQ ID NO: 744446 - protein, 22 aa, Mycobacterium
VELVELLGPRYVLIIRAGAHRL

SEQ ID NO: 744447 - protein, 17 aa, Mycobacterium
VELVRRAGPAIGEIQVA

SEQ ID NO: 744448 - protein, 19 aa, Mycobacterium
VELVRRVRTELPFQTLMTG

SEQ ID NO: 744449 - protein, 20 aa, Mycobacterium
VELYISYLRKKIDNGRDPMI

SEQ ID NO: 744450 - protein, 17 aa, Mycobacterium
VELYNLVVWNERNIELA

SEQ ID NO: 744451 - protein, 20 aa, Mycobacterium
VEMAEQLFAIPQEGRTLGVD

SEQ ID NO: 744452 - protein, 37 aa, Mycobacterium
VEMAEVPIGGPLDWVPRRLALLAAFPRNRECTARLVA

SEQ ID NO: 744453 - protein, 31 aa, Mycobacterium
VEMAGALKNVFAIAVGMGYSLGIGENTRALV

SEQ ID NO: 744454 - protein, 27 aa, Mycobacterium
VEMAGALKNVFAISAGMGYSLGIGENT

SEQ ID NO: 744455 - protein, 23 aa, Mycobacterium
VEMALRHARGFGRPVIVHVVTRK

SEQ ID NO: 744456 - protein, 20 aa, Mycobacterium
VEMENGYLLLMRVGDGSNLA

SEQ ID NO: 744457 - protein, 25 aa, Mycobacterium
VEMERAGLEIPLLIGGATTSRAHTA

SEQ ID NO: 744458 - protein, 17 aa, Mycobacterium
VEMFNRLLHGVAPADIS

SEQ ID NO: 744459 - protein, 27 aa, Mycobacterium
VEMGLARLWQSWGIEPDVVLGHSVGQY

SEQ ID NO: 744460 - protein, 26 aa, Mycobacterium
VEMGLARLWQSWGIVPDVVLGHSVGQ

SEQ ID NO: 744461 - protein, 19 aa, Mycobacterium
VEMLMPCFAQLYEDLGITQ

SEQ ID NO: 744462 - protein, 17 aa, Mycobacterium
VEMLMPCFAQLYSDLGI

SEQ ID NO: 744463 - protein, 20 aa, Mycobacterium
VEMLMPCFHQLYDELGLQQS

SEQ ID NO: 744464 - protein, 24 aa, Mycobacterium
VEMLMPCFRELYSELGLEQTDIGF

SEQ ID NO: 744465 - protein, 23 aa, Mycobacterium
VEMMSRRAKSRFTQGSSLADKQL

SEQ ID NO: 744466 - protein, 18 aa, Mycobacterium
VEMPHYFSNWHVVDEEHG

SEQ ID NO: 744467 - protein, 20 aa, Mycobacterium
VEMQNGFLLLMRVGDGSHLA

SEQ ID NO: 744468 - protein, 22 aa, Mycobacterium
VEMSAHPALLFSLGQSAGDALT

SEQ ID NO: 744469 - protein, 19 aa, Mycobacterium
VENAESWLATEWGSALEGF

SEQ ID NO: 744470 - protein, 18 aa, Mycobacterium
VENERRIAEETAKAEGKP

SEQ ID NO: 744471 - protein, 20 aa, Mycobacterium
VENFFRFIAEDIRKYLAELG

SEQ ID NO: 744472 - protein, 25 aa, Mycobacterium
VENFRPGTLEKWNLGYDVLSERNPG

SEQ ID NO: 744473 - protein, 26 aa, Mycobacterium
VENFRPGTMEKLGLGYDDVRAIRPDV

SEQ ID NO: 744474 - protein, 18 aa, Mycobacterium
VENGKLWLLQTRSAERSA

SEQ ID NO: 744475 - protein, 17 aa, Mycobacterium
VENKLRTVLWGWAGKPV

SEQ ID NO: 744476 - protein, 20 aa, Mycobacterium
VENLKLLFRDTNATSEAVIN

SEQ ID NO: 744477 - protein, 25 aa, Mycobacterium
VENMPEIWKRLDAVGLQTTEACGDC

SEQ ID NO: 744478 - protein, 18 aa, Mycobacterium
VENPASLVEYVIMGQVLT

SEQ ID NO: 744479 - protein, 18 aa, Mycobacterium
VENTSLVRTAMGWLKERT

SEQ ID NO: 744480 - protein, 18 aa, Mycobacterium
VENVRWTDRSGFWLVART

SEQ ID NO: 744481 - protein, 21 aa, Mycobacterium
VEPAILRPSFRNWDHPIRRQI

SEQ ID NO: 744482 - protein, 21 aa, Mycobacterium
VEPAILRPSFRNWDHPYRRQI

SEQ ID NO: 744483 - protein, 18 aa, Mycobacterium
VEPARKAILRALEHGKSV

SEQ ID NO: 744484 - protein, 17 aa, Mycobacterium
VEPCAAAARELLRRGHE

SEQ ID NO: 744485 - protein, 17 aa, Mycobacterium
VEPCAAVGRELLRRGHD

SEQ ID NO: 744486 - protein, 23 aa, Mycobacterium
VEPDRIEVARAWHAELVDHQLAA

SEQ ID NO: 744487 - protein, 28 aa, Mycobacterium
VEPDRYRLVVARACPWANRAIIVRRLLG

SEQ ID NO: 744488 - protein, 24 aa, Mycobacterium
VEPDSSGGCTITWEAQYRSQLPGS

SEQ ID NO: 744489 - protein, 17 aa, Mycobacterium
VEPEGPPGLPRFTVVAF

SEQ ID NO: 744490 - protein, 23 aa, Mycobacterium
VEPEVDEGFQLAGQALEPGTVAA

SEQ ID NO: 744491 - protein, 20 aa, Mycobacterium
VEPEVSWSELAAVVYGLVLE

SEQ ID NO: 744492 - protein, 18 aa, Mycobacterium
VEPEWGRKVAGVRQAGDR

SEQ ID NO: 744493 - protein, 19 aa, Mycobacterium
VEPFALGGVEQVDRRQRAV

SEQ ID NO: 744494 - protein, 20 aa, Mycobacterium
VEPFAPLPEFWVSRARKKIL

SEQ ID NO: 744495 - protein, 19 aa, Mycobacterium
VEPFGCLRSVPPPDGVGAA

SEQ ID NO: 744496 - protein, 18 aa, Mycobacterium
VEPGEFIAVLGPNGSGKT

SEQ ID NO: 744497 - protein, 28 aa, Mycobacterium
VEPGRYRLIVARACPWANRAIIVRRLLG

SEQ ID NO: 744498 - protein, 27 aa, Mycobacterium
VEPGRYRLIVARACPWANRTIIVRRLL

SEQ ID NO: 744499 - protein, 26 aa, Mycobacterium
VEPIDVDYPYLWRNLTEVVGTVLEAL

SEQ ID NO: 744500 - protein, 20 aa, Mycobacterium
VEPIWLDWVSRWPTPSATAA

SEQ ID NO: 744501 - protein, 26 aa, Mycobacterium
VEPLPEGSGFEFLDKVVGGAVPRQFI

SEQ ID NO: 744502 - protein, 18 aa, Mycobacterium
VEPLRKWRLDVAPNGSGI

SEQ ID NO: 744503 - protein, 19 aa, Mycobacterium
VEPNLTYLVNLGYGDPNYG

SEQ ID NO: 744504 - protein, 24 aa, Mycobacterium
VEPNPGPVLANFGVDGLRFLTPVK

SEQ ID NO: 744505 - protein, 27 aa, Mycobacterium
VEPPQKWSASGKFGLVANEASEGESLD

SEQ ID NO: 744506 - protein, 19 aa, Mycobacterium
VEPPSGAFERSWSAPDAYL

SEQ ID NO: 744507 - protein, 34 aa, Mycobacterium
VEPRERPAVVPLSFAQSRLWFIDQLHGPSPVYNM

SEQ ID NO: 744508 - protein, 26 aa, Mycobacterium
VEPRHRRPTLSWPREIPIEGEPADVH

SEQ ID NO: 744509 - protein, 18 aa, Mycobacterium
VEPRKGDNAPMAVIELVR

SEQ ID NO: 744510 - protein, 20 aa, Mycobacterium
VEPRMLLVHFLRDQLGLTGT

SEQ ID NO: 744511 - protein, 24 aa, Mycobacterium
VEPRRLRPGFTAFGQTRWPLDRQA

SEQ ID NO: 744512 - protein, 26 aa, Mycobacterium
VEPSAPLPEFWIKRARKKILHAALEG

SEQ ID NO: 744513 - protein, 23 aa, Mycobacterium
VEPSAPLPEFWVNRARRKILHSA

SEQ ID NO: 744514 - protein, 27 aa, Mycobacterium
VEPSIQPKLTFSWRIMPQNLSDAGISW

SEQ ID NO: 744515 - protein, 23 aa, Mycobacterium
VEPSRKAILCALEHGKSVVTANK

SEQ ID NO: 744516 - protein, 26 aa, Mycobacterium
VEPVKVHAFLPAPADIYGFGRALPST

SEQ ID NO: 744517 - protein, 18 aa, Mycobacterium
VEPWGLYMARPTPGRAQF

SEQ ID NO: 744518 - protein, 28 aa, Mycobacterium
VEPWTMKPDVCWQLPIRRSQDWVERPDG

SEQ ID NO: 744519 - protein, 19 aa, Mycobacterium
VEQAAFWGLGRVIGHQELG

SEQ ID NO: 744520 - protein, 21 aa, Mycobacterium
VEQAASMSFRMRSICDRIAGF

SEQ ID NO: 744521 - protein, 19 aa, Mycobacterium
VEQFGRLDIVVANAGVLSW

SEQ ID NO: 744522 - protein, 17 aa, Mycobacterium
VEQFVLFSSISGVLGSR

SEQ ID NO: 744523 - protein, 26 aa, Mycobacterium
VEQIKRFRILPSLWEPGGDEITLTMK

SEQ ID NO: 744524 - protein, 25 aa, Mycobacterium
VEQIKRFRVLPTLWEPGGDEITLTM

SEQ ID NO: 744525 - protein, 25 aa, Mycobacterium
VEQIKRFVIVGTPWEPGGDELTPTM

SEQ ID NO: 744526 - protein, 23 aa, Mycobacterium
VEQKTRSLVMGRFGTPDEVATAV

SEQ ID NO: 744527 - protein, 17 aa, Mycobacterium
VEQLAAIYARHSDDMAD

SEQ ID NO: 744528 - protein, 22 aa, Mycobacterium
VEQLRICAEHGVNAVTLSEEML

SEQ ID NO: 744529 - protein, 26 aa, Mycobacterium
VEQMGADGWLALGWPKEFGGQDRSVM

SEQ ID NO: 744530 - protein, 23 aa, Mycobacterium
VEQPGRRGFRCLDDSVPSELDGA

SEQ ID NO: 744531 - protein, 17 aa, Mycobacterium
VEQRAAVVAVDMQGFSV

SEQ ID NO: 744532 - protein, 17 aa, Mycobacterium
VEQRAAVVAVDMQGYSI

SEQ ID NO: 744533 - protein, 18 aa, Mycobacterium
VEQTYLKQYCSLIHGQVV

SEQ ID NO: 744534 - protein, 17 aa, Mycobacterium
VEQVWLRDGWVDRFALD

SEQ ID NO: 744535 - protein, 19 aa, Mycobacterium
VEQVWLRDGWVDRFGLDLP

SEQ ID NO: 744536 - protein, 17 aa, Mycobacterium
VERADGPAAAMAGALGV

SEQ ID NO: 744537 - protein, 18 aa, Mycobacterium
VERALIAGHDFVLLGERG

SEQ ID NO: 744538 - protein, 17 aa, Mycobacterium
VERAVALAEPFSAAVEA

SEQ ID NO: 744539 - protein, 17 aa, Mycobacterium
VERCLPLADHIARRFDG

SEQ ID NO: 744540 - protein, 17 aa, Mycobacterium
VERDARSGQWFLGPEIY

SEQ ID NO: 744541 - protein, 24 aa, Mycobacterium
VERDLRAAVYGWLAFTFEMCRQRL

SEQ ID NO: 744542 - protein, 22 aa, Mycobacterium
VEREEPKRAGVLVVSSDRGLCG

SEQ ID NO: 744543 - protein, 23 aa, Mycobacterium
VEREFKGVFSSLFPGGEGRLVLT

SEQ ID NO: 744544 - protein, 22 aa, Mycobacterium
VEREFRVVFGSLFPGGEGRLRL

SEQ ID NO: 744545 - protein, 17 aa, Mycobacterium
VEREHKDFLTLSDVAAE

SEQ ID NO: 744546 - protein, 26 aa, Mycobacterium
VEREIWSGKATFVFTRTTSGEIGILP

SEQ ID NO: 744547 - protein, 25 aa, Mycobacterium
VERELWSGPATFVFTRTTAGEIGIL

SEQ ID NO: 744548 - protein, 23 aa, Mycobacterium
VEREVVRAMMLLRLSTLATGHTG

SEQ ID NO: 744549 - protein, 24 aa, Mycobacterium
VEREYRLGMRKRREQLIDGLRAVG

SEQ ID NO: 744550 - protein, 17 aa, Mycobacterium
VERFGDLVFDTVITRTV

SEQ ID NO: 744551 - protein, 17 aa, Mycobacterium
VERFPRRASYAYQLDAF

SEQ ID NO: 744552 - protein, 17 aa, Mycobacterium
VERGGGLPAALVLAEAV

SEQ ID NO: 744553 - protein, 21 aa, Mycobacterium
VERGLPTFCEKPIASTAAESA

SEQ ID NO: 744554 - protein, 28 aa, Mycobacterium
VERGMPISFTFARFIKFIVTEIFPGGRL

SEQ ID NO: 744555 - protein, 22 aa, Mycobacterium
VERIETRLAMSLPAAAETPDTA

SEQ ID NO: 744556 - protein, 20 aa, Mycobacterium
VERILAAAVRVMARVAPEPP

SEQ ID NO: 744557 - protein, 23 aa, Mycobacterium
VERIPVPPNWGGYLIAAEVVEFW

SEQ ID NO: 744558 - protein, 24 aa, Mycobacterium
VERKLIGGTCVNTGCIPTKTLVAS

SEQ ID NO: 744559 - protein, 19 aa, Mycobacterium
VERLLGMGLVKGHGAADWS

SEQ ID NO: 744560 - protein, 17 aa, Mycobacterium
VERLLVAGVVGFPSGKH

SEQ ID NO: 744561 - protein, 17 aa, Mycobacterium
VERLPIMGDGWKGVSGE

SEQ ID NO: 744562 - protein, 19 aa, Mycobacterium
VERLPRTGSYFTRELPSAG

SEQ ID NO: 744563 - protein, 22 aa, Mycobacterium
VERLRAGADVADFGCGSGHAIN

SEQ ID NO: 744564 - protein, 25 aa, Mycobacterium
VERLRARGATRLVIAPWFLAHGRIT

SEQ ID NO: 744565 - protein, 26 aa, Mycobacterium
VERLSRAELPAVPGRLQVRGDGSYVV

SEQ ID NO: 744566 - protein, 20 aa, Mycobacterium
VERLVCERARIDAEMKRLAA

SEQ ID NO: 744567 - protein, 25 aa, Mycobacterium
VERLWRELRVDRIWEGTSEIQRLVI

SEQ ID NO: 744568 - protein, 19 aa, Mycobacterium
VERMWPRVWQLACMVDHIA

SEQ ID NO: 744569 - protein, 22 aa, Mycobacterium
VERPDLRVILTGAGSSAFIGEI

SEQ ID NO: 744570 - protein, 22 aa, Mycobacterium
VERPECQDALIADTSAKLPRPT

SEQ ID NO: 744571 - protein, 22 aa, Mycobacterium
VERPEPKRAGVLIVSSDRGLCG

SEQ ID NO: 744572 - protein, 22 aa, Mycobacterium
VERPEPKRAGVLVVSSDRGLCG

SEQ ID NO: 744573 - protein, 23 aa, Mycobacterium
VERPEPKRAGVLVVTSDRGLCGA

SEQ ID NO: 744574 - protein, 24 aa, Mycobacterium
VERPGSRISLMAAEMLVDRPDGPR

SEQ ID NO: 744575 - protein, 18 aa, Mycobacterium
VERPIRFAVDDVEISETE

SEQ ID NO: 744576 - protein, 23 aa, Mycobacterium
VERPMPWPIYLPSVRVAATPHHG

SEQ ID NO: 744577 - protein, 23 aa, Mycobacterium
VERQGWHALLTLRLNGDVNLPAN

SEQ ID NO: 744578 - protein, 30 aa, Mycobacterium
VERQRLWARSGYLQPHWPAPYGRAADSVEQ

SEQ ID NO: 744579 - protein, 25 aa, Mycobacterium
VERRADGFFYIRGRSSEMIISGGVN

SEQ ID NO: 744580 - protein, 21 aa, Mycobacterium
VERRARWVVRVITSLLQFPGR

SEQ ID NO: 744581 - protein, 25 aa, Mycobacterium
VERRFRAWIRWNAAIMVHRAQRPGV

SEQ ID NO: 744582 - protein, 23 aa, Mycobacterium
VERRRELTGGKRSFILVPGIDVP

SEQ ID NO: 744583 - protein, 20 aa, Mycobacterium
VERRSVPLPLAQKIFDTEWV

SEQ ID NO: 744584 - protein, 21 aa, Mycobacterium
VERSGLFTGTRGRQLAGRCGV

SEQ ID NO: 744585 - protein, 24 aa, Mycobacterium
VERSGRLMPEIGPALAVRAEHVLK

SEQ ID NO: 744586 - protein, 20 aa, Mycobacterium
VERSWKVIARALLDGYDVGA

SEQ ID NO: 744587 - protein, 24 aa, Mycobacterium
VERTCGAGARGVRLDVTDADAPGR

SEQ ID NO: 744588 - protein, 18 aa, Mycobacterium
VERVALALLTYVEERTDG

SEQ ID NO: 744589 - protein, 17 aa, Mycobacterium
VERYMKLLAPDWALLAD

SEQ ID NO: 744590 - protein, 22 aa, Mycobacterium
VERYRAWTKRLGKQQPQRSGTE

SEQ ID NO: 744591 - protein, 18 aa, Mycobacterium
VESAIRIGLALNCEITPW

SEQ ID NO: 744592 - protein, 25 aa, Mycobacterium
VESARSVVYHGLWTAVHDVANLSVA

SEQ ID NO: 744593 - protein, 24 aa, Mycobacterium
VESAWKLAKQFFKLTGKPGKHKVI

SEQ ID NO: 744594 - protein, 23 aa, Mycobacterium
VESAWKLAKQYFKETGKPGKYKA

SEQ ID NO: 744595 - protein, 23 aa, Mycobacterium
VESDPRSAAVIARNADALGLAGA

SEQ ID NO: 744596 - protein, 21 aa, Mycobacterium
VESEGRKVLARQADVRDSAAL

SEQ ID NO: 744597 - protein, 23 aa, Mycobacterium
VESEGTPVGFLLMLPDVNEIAGR

SEQ ID NO: 744598 - protein, 22 aa, Mycobacterium
VESFGYKYGLPMDADTVMDVRF

SEQ ID NO: 744599 - protein, 23 aa, Mycobacterium
VESFRPGVMTDLDLGYDTLASAN

SEQ ID NO: 744600 - protein, 21 aa, Mycobacterium
VESFSDLKTTLRLALSSNTPP

SEQ ID NO: 744601 - protein, 26 aa, Mycobacterium
VESGARADRDFVLRFRLDQGRLSSSA

SEQ ID NO: 744602 - protein, 17 aa, Mycobacterium
VESGARAMGSLGSGLGT

SEQ ID NO: 744603 - protein, 23 aa, Mycobacterium
VESGELPWSIVALGLSSVAPQQP

SEQ ID NO: 744604 - protein, 18 aa, Mycobacterium
VESGRILGHEAVGTVTAI

SEQ ID NO: 744605 - protein, 26 aa, Mycobacterium
VESIGPALEDWAKWGQARHDYFLRAS

SEQ ID NO: 744606 - protein, 20 aa, Mycobacterium
VESIGPALQDWAKWGQARHN

SEQ ID NO: 744607 - protein, 21 aa, Mycobacterium
VESIPLIAGSIMGKKLAEGTA

SEQ ID NO: 744608 - protein, 27 aa, Mycobacterium
VESKLPVPIHVGGGYGGDSDWIHGMWK

SEQ ID NO: 744609 - protein, 23 aa, Mycobacterium
VESKYWGGVCLNVGCIPSKALLR

SEQ ID NO: 744610 - protein, 19 aa, Mycobacterium
VESLACAYAAVLAEAKRYE

SEQ ID NO: 744611 - protein, 17 aa, Mycobacterium
VESLPLFGADWTRTADL

SEQ ID NO: 744612 - protein, 20 aa, Mycobacterium
VESLPLIASSVMSKKLAEGA

SEQ ID NO: 744613 - protein, 20 aa, Mycobacterium
VESLPLIASSVMSKKLAEGT

SEQ ID NO: 744614 - protein, 32 aa, Mycobacterium
VESLRTEWWQSCLLPVNWKLATAAFMEGYHVP

SEQ ID NO: 744615 - protein, 18 aa, Mycobacterium
VESMPEHRFQVAVVTGGG

SEQ ID NO: 744616 - protein, 24 aa, Mycobacterium
VESPDGRYLYIAGYSGVVTVAPIT

SEQ ID NO: 744617 - protein, 25 aa, Mycobacterium
VESQSRLLAAYAVGRYALPPVDEME

SEQ ID NO: 744618 - protein, 22 aa, Mycobacterium
VESRRLRRGFTAFGQTPWRLDR

SEQ ID NO: 744619 - protein, 17 aa, Mycobacterium
VESRTITFLDIPAAPGF

SEQ ID NO: 744620 - protein, 25 aa, Mycobacterium
VESSHLYPRFDVFLTEVARVLRPGG

SEQ ID NO: 744621 - protein, 24 aa, Mycobacterium
VESSYRMEQGFTFELNLAGVADEH

SEQ ID NO: 744622 - protein, 26 aa, Mycobacterium
VESVDRWLRPHLPAWPPVTSNMTVVE

SEQ ID NO: 744623 - protein, 23 aa, Mycobacterium
VESVRPYWEAGFTDIALIQVGGD

SEQ ID NO: 744624 - protein, 18 aa, Mycobacterium
VESVRSWARQADIDDGYE

SEQ ID NO: 744625 - protein, 20 aa, Mycobacterium
VESYIYLPLLEELGYVPTEK

SEQ ID NO: 744626 - protein, 18 aa, Mycobacterium
VESYRISEDITRSLGELA

SEQ ID NO: 744627 - protein, 18 aa, Mycobacterium
VETADLDAAVPVPRDIPW

SEQ ID NO: 744628 - protein, 23 aa, Mycobacterium
VETAEGLGGLDIVVNNAGITRDR

SEQ ID NO: 744629 - protein, 26 aa, Mycobacterium
VETALYRLAQSWGFQPDFVMGCSAGE

SEQ ID NO: 744630 - protein, 19 aa, Mycobacterium
VETARKVFKLVDALEDSDD

SEQ ID NO: 744631 - protein, 18 aa, Mycobacterium
VETARLWMSLGHHDRHGV

SEQ ID NO: 744632 - protein, 18 aa, Mycobacterium
VETARMWLSLGHHDRHGN

SEQ ID NO: 744633 - protein, 19 aa, Mycobacterium
VETERRFYLANSVELIPRN

SEQ ID NO: 744634 - protein, 18 aa, Mycobacterium
VETERRFYLANSVEMIPR

SEQ ID NO: 744635 - protein, 19 aa, Mycobacterium
VETERRFYLANSVEMTPRN

SEQ ID NO: 744636 - protein, 19 aa, Mycobacterium
VETERRFYLANSVEMVPRN

SEQ ID NO: 744637 - protein, 19 aa, Mycobacterium
VETERRFYLANSVEVIPRN

SEQ ID NO: 744638 - protein, 26 aa, Mycobacterium
VETFIPRGIAGLFFFDGEQIEALADL

SEQ ID NO: 744639 - protein, 23 aa, Mycobacterium
VETICRYRLPVTVVILNNGGVYR

SEQ ID NO: 744640 - protein, 24 aa, Mycobacterium
VETIPRCRQVLRTHPLDLRPPEWV

SEQ ID NO: 744641 - protein, 21 aa, Mycobacterium
VETKLLAALHRFGIAAPASAD

SEQ ID NO: 744642 - protein, 22 aa, Mycobacterium
VETKLLALLHRFGIAAPASADR

SEQ ID NO: 744643 - protein, 27 aa, Mycobacterium
VETKLPIPKPMVKKLANQVLEHLAEGL

SEQ ID NO: 744644 - protein, 38 aa, Mycobacterium
VETKRALTEAVLWPLQHPDTFSRLGIDPPRGVLLYGPP

SEQ ID NO: 744645 - protein, 20 aa, Mycobacterium
VETLAKAGAIFVDETDEVPE

SEQ ID NO: 744646 - protein, 18 aa, Mycobacterium
VETLRMGVKLAGALEAAH

SEQ ID NO: 744647 - protein, 24 aa, Mycobacterium
VETLRRAGDRFGFAVESMSLLSEH

SEQ ID NO: 744648 - protein, 25 aa, Mycobacterium
VETLRRAGERFGFAVESMSLLSEHH

SEQ ID NO: 744649 - protein, 26 aa, Mycobacterium
VETLSAYGVRYLFGVPGAKIDSVFDA

SEQ ID NO: 744650 - protein, 22 aa, Mycobacterium
VETLTGFKWLARADEGLDATLV

SEQ ID NO: 744651 - protein, 21 aa, Mycobacterium
VETLTGFKWLARAGSPGTTLV

SEQ ID NO: 744652 - protein, 20 aa, Mycobacterium
VETLTGFKWLVRAADSDLVY

SEQ ID NO: 744653 - protein, 24 aa, Mycobacterium
VETNLRGTVALTRAALPHLQRGNS

SEQ ID NO: 744654 - protein, 18 aa, Mycobacterium
VETPPVGGDTIWVNMVEA

SEQ ID NO: 744655 - protein, 25 aa, Mycobacterium
VETQLRLGPWVLPKGHMIVGDVWAA

SEQ ID NO: 744656 - protein, 17 aa, Mycobacterium
VETRPGQGYPRTYQDQE

SEQ ID NO: 744657 - protein, 17 aa, Mycobacterium
VETSAKINALLDIAQAN

SEQ ID NO: 744658 - protein, 35 aa, Mycobacterium
VETSSGYVWSGAFSTEEFVFYQGLPRHAYVSGNDA

SEQ ID NO: 744659 - protein, 27 aa, Mycobacterium
VEVADRVAVLALRRARPLQRAAAEPLV

SEQ ID NO: 744660 - protein, 17 aa, Mycobacterium
VEVAETLSARFGESDLG

SEQ ID NO: 744661 - protein, 33 aa, Mycobacterium
VEVALYRLLESWGIRPDFVMGHSVGEISAAHVA

SEQ ID NO: 744662 - protein, 17 aa, Mycobacterium
VEVARRVIFQATGKLPE

SEQ ID NO: 744663 - protein, 18 aa, Mycobacterium
VEVARRVIFQATGRFPED

SEQ ID NO: 744664 - protein, 19 aa, Mycobacterium
VEVARRVIFQATGRFPEDE

SEQ ID NO: 744665 - protein, 18 aa, Mycobacterium
VEVARRVIFQATGRLPEE

SEQ ID NO: 744666 - protein, 17 aa, Mycobacterium
VEVAVALEALRWRGSDI

SEQ ID NO: 744667 - protein, 17 aa, Mycobacterium
VEVAVKMALQFWRSGGH

SEQ ID NO: 744668 - protein, 21 aa, Mycobacterium
VEVCRTCSWNHLVKSYVLGAA

SEQ ID NO: 744669 - protein, 22 aa, Mycobacterium
VEVCRTCSWNHLVKSYVLGAAR

SEQ ID NO: 744670 - protein, 23 aa, Mycobacterium
VEVCRTCSWNHLVKSYVLGAARP

SEQ ID NO: 744671 - protein, 22 aa, Mycobacterium
VEVCRTCSWNHLVKSYVLGAPR

SEQ ID NO: 744672 - protein, 23 aa, Mycobacterium
VEVCRTCSWNHLVKSYVLGAVPP

SEQ ID NO: 744673 - protein, 27 aa, Mycobacterium
VEVDPPWRFSFRWCYPEGHTANPENSL

SEQ ID NO: 744674 - protein, 25 aa, Mycobacterium
VEVEVSMMFKIGKYLYPDSLTVPDY

SEQ ID NO: 744675 - protein, 25 aa, Mycobacterium
VEVFRAAARRGLPVLLKGPTGCGKT

SEQ ID NO: 744676 - protein, 31 aa, Mycobacterium
VEVGEGRVGWRISIPAAMSYWSELARPVVLP

SEQ ID NO: 744677 - protein, 18 aa, Mycobacterium
VEVGFPLVEDVSMQVAQK

SEQ ID NO: 744678 - protein, 26 aa, Mycobacterium
VEVGGRPVLWHIMKVLGHHGISDFVV

SEQ ID NO: 744679 - protein, 19 aa, Mycobacterium
VEVGLKWPNDVLAGPPGSP

SEQ ID NO: 744680 - protein, 17 aa, Mycobacterium
VEVGRRVIFMVTGVLPS

SEQ ID NO: 744681 - protein, 22 aa, Mycobacterium
VEVHAKPALAVWSVGATIEVSE

SEQ ID NO: 744682 - protein, 24 aa, Mycobacterium
VEVIPDVLRHRLVLTYDALADEIS

SEQ ID NO: 744683 - protein, 25 aa, Mycobacterium
VEVIPDVLRHRLVLTYDALADEISA

SEQ ID NO: 744684 - protein, 20 aa, Mycobacterium
VEVIPETKLAFRVDTNNTIW

SEQ ID NO: 744685 - protein, 25 aa, Mycobacterium
VEVIVACSWDCPFDGPTAQKRVLDI

SEQ ID NO: 744686 - protein, 19 aa, Mycobacterium
VEVLHIFGPQGERMHVRAR

SEQ ID NO: 744687 - protein, 22 aa, Mycobacterium
VEVLNCLIPPYADDLSVTSAAL

SEQ ID NO: 744688 - protein, 26 aa, Mycobacterium
VEVLPDWVDLALLRKGQRALRRGGAD

SEQ ID NO: 744689 - protein, 25 aa, Mycobacterium
VEVLPVPGLPEFRPGDDLAAAIADA

SEQ ID NO: 744690 - protein, 18 aa, Mycobacterium
VEVMSRVPLGAARATGMP

SEQ ID NO: 744691 - protein, 19 aa, Mycobacterium
VEVMSRVPLGAARATGMPY

SEQ ID NO: 744692 - protein, 19 aa, Mycobacterium
VEVMSRVPLGSARASGMPY

SEQ ID NO: 744693 - protein, 19 aa, Mycobacterium
VEVMSRVPLGSARATGIPY

SEQ ID NO: 744694 - protein, 19 aa, Mycobacterium
VEVMSRVPLGSARATGMPY

SEQ ID NO: 744695 - protein, 19 aa, Mycobacterium
VEVMSRVPLGSARSTGMPY

SEQ ID NO: 744696 - protein, 23 aa, Mycobacterium
VEVNARPGVVLVIPGDSPHVLAV

SEQ ID NO: 744697 - protein, 24 aa, Mycobacterium
VEVPDYRPFWAITKHADIMDIERD

SEQ ID NO: 744698 - protein, 18 aa, Mycobacterium
VEVPFAELEPDFQRAYKE

SEQ ID NO: 744699 - protein, 17 aa, Mycobacterium
VEVPFEMPVGDTVVRGR

SEQ ID NO: 744700 - protein, 24 aa, Mycobacterium
VEVPGLLDLSSLWQIYSVDRPGLK

SEQ ID NO: 744701 - protein, 17 aa, Mycobacterium
VEVPGVLTARITQGATA

SEQ ID NO: 744702 - protein, 18 aa, Mycobacterium
VEVPIRFLSVIAFPDSQV

SEQ ID NO: 744703 - protein, 25 aa, Mycobacterium
VEVREVLPGIPLVASGGIRTGMDAA

SEQ ID NO: 744704 - protein, 20 aa, Mycobacterium
VEVRLSRYSYLVSLLPQRIV

SEQ ID NO: 744705 - protein, 21 aa, Mycobacterium
VEVRPIISMNGGHHFNEVILD

SEQ ID NO: 744706 - protein, 19 aa, Mycobacterium
VEVRTRRYGAYEVNTTCAP

SEQ ID NO: 744707 - protein, 24 aa, Mycobacterium
VEVSEFSRHLKLLAKEIEVPVVAI

SEQ ID NO: 744708 - protein, 21 aa, Mycobacterium
VEVSEYLGLRPTWVDATNVGG

SEQ ID NO: 744709 - protein, 18 aa, Mycobacterium
VEVVDRLSAQLAEATASI

SEQ ID NO: 744710 - protein, 20 aa, Mycobacterium
VEVVGAVLGRFAEAYYDLGT

SEQ ID NO: 744711 - protein, 18 aa, Mycobacterium
VEVVHRFGVTCTAGTPFH

SEQ ID NO: 744712 - protein, 19 aa, Mycobacterium
VEVVIRPALAATIPDMLDA

SEQ ID NO: 744713 - protein, 38 aa, Mycobacterium
VEVWPLVDCSREFGGKGSTSWLALLLEPADRAYVPGSP

SEQ ID NO: 744714 - protein, 17 aa, Mycobacterium
VEVYRKGLAQLLSAIDR

SEQ ID NO: 744715 - protein, 29 aa, Mycobacterium
VEWEHPLGHRWRWELAEVGPGATKVTETF

SEQ ID NO: 744716 - protein, 20 aa, Mycobacterium
VEWHLRKVFVKLGITSRRQL

SEQ ID NO: 744717 - protein, 25 aa, Mycobacterium
VEWLRRQPWFTGRFGTVGLSYLGFT

SEQ ID NO: 744718 - protein, 17 aa, Mycobacterium
VEWRRHIHRYPELGRQE

SEQ ID NO: 744719 - protein, 25 aa, Mycobacterium
VEWSDLRSAAALRWAISPWAQSQVP

SEQ ID NO: 744720 - protein, 26 aa, Mycobacterium
VEYAQLRAQWGWRLVAAASTLPTPAL

SEQ ID NO: 744721 - protein, 19 aa, Mycobacterium
VEYCRQRKAFGQPLTAKQH

SEQ ID NO: 744722 - protein, 22 aa, Mycobacterium
VEYDGAIAWLVGEEGRGVPTII

SEQ ID NO: 744723 - protein, 17 aa, Mycobacterium
VEYDPAYHELMRAAITH

SEQ ID NO: 744724 - protein, 24 aa, Mycobacterium
VEYEVDCVIFASGFEISTEIHRRY

SEQ ID NO: 744725 - protein, 23 aa, Mycobacterium
VEYGEMRLDLALRARVHALHHAL

SEQ ID NO: 744726 - protein, 24 aa, Mycobacterium
VEYGLLRPRQVLFTYLHLAASRAC

SEQ ID NO: 744727 - protein, 18 aa, Mycobacterium
VEYGRFAVAPQRMRRDVE

SEQ ID NO: 744728 - protein, 20 aa, Mycobacterium
VEYHPALGLADNIYRPTHLV

SEQ ID NO: 744729 - protein, 30 aa, Mycobacterium
VEYIGFDIPNEFVVGYGLDYAERYRDLPYI

SEQ ID NO: 744730 - protein, 21 aa, Mycobacterium
VEYPVSLLVLGGHRAVPALRV

SEQ ID NO: 744731 - protein, 21 aa, Mycobacterium
VEYRESLGFEVLPLTGGERPP

SEQ ID NO: 744732 - protein, 25 aa, Mycobacterium
VEYTRRGTWHLCLTVSDVERQTRSV

SEQ ID NO: 744733 - protein, 27 aa, Mycobacterium
VEYVDIRFCDLPGVVQHFSIPASAFDE

SEQ ID NO: 744734 - protein, 18 aa, Mycobacterium
VEYWLRAQRDPQLRDRLI

SEQ ID NO: 744735 - protein, 18 aa, Mycobacterium
VFAAAWGTTVGRLVFLAP

SEQ ID NO: 744736 - protein, 22 aa, Mycobacterium
VFAAVCGDWLGAQPGLPAIACG

SEQ ID NO: 744737 - protein, 17 aa, Mycobacterium
VFAAYELMQLVCPDMIE

SEQ ID NO: 744738 - protein, 41 aa, Mycobacterium
VFADCPVCGVASCGSCRQETGGLCLRCGSPGRAPEFDTEFA

SEQ ID NO: 744739 - protein, 18 aa, Mycobacterium
VFAEALWAELHDKGVDVV

SEQ ID NO: 744740 - protein, 19 aa, Mycobacterium
VFAELSIELFEPQWVAGLV

SEQ ID NO: 744741 - protein, 18 aa, Mycobacterium
VFAERLVAHYGARHLLLV

SEQ ID NO: 744742 - protein, 23 aa, Mycobacterium
VFAETCPQYLYLSLEEHLGAPGF

SEQ ID NO: 744743 - protein, 17 aa, Mycobacterium
VFAETTLDVAFSIVVKP

SEQ ID NO: 744744 - protein, 17 aa, Mycobacterium
VFAETTLDVAFSIVVKR

SEQ ID NO: 744745 - protein, 18 aa, Mycobacterium
VFAGASLLTRGGYDVTLV

SEQ ID NO: 744746 - protein, 17 aa, Mycobacterium
VFAGAYHGWGFHEDGAA

SEQ ID NO: 744747 - protein, 21 aa, Mycobacterium
VFAGSCLSEYGAIASTDLTQV

SEQ ID NO: 744748 - protein, 18 aa, Mycobacterium
VFAGVLAAGWPAGHEHAL

SEQ ID NO: 744749 - protein, 18 aa, Mycobacterium
VFAGVLAGSWPRDPGSPA

SEQ ID NO: 744750 - protein, 18 aa, Mycobacterium
VFAGVPAGWTVAFGGAGG

SEQ ID NO: 744751 - protein, 26 aa, Mycobacterium
VFALSGWDVCGMLTLPSSTIPELLRE

SEQ ID NO: 744752 - protein, 18 aa, Mycobacterium
VFAMFQWGKRHLPGGDRL

SEQ ID NO: 744753 - protein, 19 aa, Mycobacterium
VFAPLEMGAALQAVATILT

SEQ ID NO: 744754 - protein, 23 aa, Mycobacterium
VFAPNGFAFHFPGWSIQRVLQPW

SEQ ID NO: 744755 - protein, 26 aa, Mycobacterium
VFAPRPERMSARKFWMRYAAESAGAL

SEQ ID NO: 744756 - protein, 29 aa, Mycobacterium
VFAPRPERMSARRFWVRYAAEASGTLTLD

SEQ ID NO: 744757 - protein, 25 aa, Mycobacterium
VFAPRPGRMSARRFWVRYAAESAGW

SEQ ID NO: 744758 - protein, 21 aa, Mycobacterium
VFARLCKAMGRPELVTDERFA

SEQ ID NO: 744759 - protein, 19 aa, Mycobacterium
VFARRAARIGRPMKIPTPA

SEQ ID NO: 744760 - protein, 28 aa, Mycobacterium
VFASGAISYRLVKSVVKRTRLVVDPEVM

SEQ ID NO: 744761 - protein, 25 aa, Mycobacterium
VFASRLPDYFPRPLRERFTSEIRSH

SEQ ID NO: 744762 - protein, 25 aa, Mycobacterium
VFASRLPLYFPKPLRERFTGEIRTH

SEQ ID NO: 744763 - protein, 18 aa, Mycobacterium
VFASSLLLQRGVYVGPVT

SEQ ID NO: 744764 - protein, 21 aa, Mycobacterium
VFATRETPVWLGSVKSNIGHT

SEQ ID NO: 744765 - protein, 23 aa, Mycobacterium
VFAVNTRAPFFITQHGLSRLRDH

SEQ ID NO: 744766 - protein, 26 aa, Mycobacterium
VFAWHARPGAFARLSPPWQPMRLVTE

SEQ ID NO: 744767 - protein, 33 aa, Mycobacterium
VFAWKGETLEEYWWAAEQMLTWDGEPANMILDD

SEQ ID NO: 744768 - protein, 34 aa, Mycobacterium
VFAWKGETLEEYWWAAEQMLTWPNEPANMILDDG

SEQ ID NO: 744769 - protein, 18 aa, Mycobacterium
VFCDTPLEDCERRDPKGL

SEQ ID NO: 744770 - protein, 26 aa, Mycobacterium
VFCEAVDVVCGIGWDKIDPGNPAFRF

SEQ ID NO: 744771 - protein, 18 aa, Mycobacterium
VFCGHDFGAHLVWDMPAW

SEQ ID NO: 744772 - protein, 19 aa, Mycobacterium
VFCRAAGGEWAELVAGGVP

SEQ ID NO: 744773 - protein, 19 aa, Mycobacterium
VFCTARVYDGFGPEVRRKL

SEQ ID NO: 744774 - protein, 26 aa, Mycobacterium
VFCVNYRLAPRYRFPTAADDVRAGWD

SEQ ID NO: 744775 - protein, 32 aa, Mycobacterium
VFDAARGRALIRWDNFELIRLSTWSHGRVAVL

SEQ ID NO: 744776 - protein, 18 aa, Mycobacterium
VFDAPAIETLIERLRHVM

SEQ ID NO: 744777 - protein, 17 aa, Mycobacterium
VFDAVTISFGLRNVVDH

SEQ ID NO: 744778 - protein, 24 aa, Mycobacterium
VFDEHGFRVILDYGHNEAAVGAMV

SEQ ID NO: 744779 - protein, 19 aa, Mycobacterium
VFDELSLRGCAAALDGSDV

SEQ ID NO: 744780 - protein, 23 aa, Mycobacterium
VFDEPDLDAALARFDELHRQAPR

SEQ ID NO: 744781 - protein, 19 aa, Mycobacterium
VFDEQRPPFGLYQITVPAA

SEQ ID NO: 744782 - protein, 37 aa, Mycobacterium
VFDFGRPEVRNFLVANALYWLQEFHIDGLRVDAVASM

SEQ ID NO: 744783 - protein, 28 aa, Mycobacterium
VFDFGRPEVRNFLVANALYWLQEFHVDG

SEQ ID NO: 744784 - protein, 25 aa, Mycobacterium
VFDGRRVALMLAVHPLCPLSARQIR

SEQ ID NO: 744785 - protein, 24 aa, Mycobacterium
VFDIMLLAHGWALKHWHFGPTYTL

SEQ ID NO: 744786 - protein, 22 aa, Mycobacterium
VFDKGKALALYHSKRLAAPGQR

SEQ ID NO: 744787 - protein, 23 aa, Mycobacterium
VFDLLGERRFELALTHSPIGMAV

SEQ ID NO: 744788 - protein, 19 aa, Mycobacterium
VFDLLSPRDIRLFTHAYSE

SEQ ID NO: 744789 - protein, 19 aa, Mycobacterium
VFDREWPLRVADIDRTGRL

SEQ ID NO: 744790 - protein, 40 aa, Mycobacterium
VFDRFPTLRIVFVEHAFSWILPLMWRMDAIYEARKSWVDI

SEQ ID NO: 744791 - protein, 26 aa, Mycobacterium
VFDRLRSEINLGFQPFTLEHAIAAHR

SEQ ID NO: 744792 - protein, 23 aa, Mycobacterium
VFDRPIAEYVLGAVIAHAKDTRR

SEQ ID NO: 744793 - protein, 24 aa, Mycobacterium
VFDRRWGGLHAHIVLRVRYADDLC

SEQ ID NO: 744794 - protein, 25 aa, Mycobacterium
VFDRTYERWHFGDLDARMPGGESAQ

SEQ ID NO: 744795 - protein, 18 aa, Mycobacterium
VFDSIKLGKTVPTPPVLI

SEQ ID NO: 744796 - protein, 26 aa, Mycobacterium
VFDSRKAVVLDDRWASAREDLVKIWL

SEQ ID NO: 744797 - protein, 27 aa, Mycobacterium
VFDTARRKAPCVLFFDEVDALGHRRSA

SEQ ID NO: 744798 - protein, 36 aa, Mycobacterium
VFDTYAQEYQTFGAHMAAFHDQFVQTLKTGALAYTG

SEQ ID NO: 744799 - protein, 24 aa, Mycobacterium
VFDVRRLRYADGVPLSVDTAYFPA

SEQ ID NO: 744800 - protein, 19 aa, Mycobacterium
VFEALDELGAIVEEARGVP

SEQ ID NO: 744801 - protein, 23 aa, Mycobacterium
VFEALPGYAHRALITSHLQRATH

SEQ ID NO: 744802 - protein, 19 aa, Mycobacterium
VFEDARAAMVHPLAVAANR

SEQ ID NO: 744803 - protein, 25 aa, Mycobacterium
VFEEEWSHFAARDWDALADLVADDY

SEQ ID NO: 744804 - protein, 19 aa, Mycobacterium
VFEEFGIELGVSVDFSEGV

SEQ ID NO: 744805 - protein, 25 aa, Mycobacterium
VFEGLKAYRWADGSIVSFRPESNAA

SEQ ID NO: 744806 - protein, 18 aa, Mycobacterium
VFEGTSFGGALMTTTEVE

SEQ ID NO: 744807 - protein, 19 aa, Mycobacterium
VFEGTSFGGALMTTTEVEN

SEQ ID NO: 744808 - protein, 22 aa, Mycobacterium
VFEHLGRLLIIDCGVMFPTHDE

SEQ ID NO: 744809 - protein, 26 aa, Mycobacterium
VFEHLGRLLIVDCGVLFPGHDEPGVD

SEQ ID NO: 744810 - protein, 23 aa, Mycobacterium
VFEHLGRLLIVDCGVLFPTHDEP

SEQ ID NO: 744811 - protein, 20 aa, Mycobacterium
VFEHRAVLVGGDRGGFMAGL

SEQ ID NO: 744812 - protein, 22 aa, Mycobacterium
VFELDRPPVLDFKREVLSRHGA

SEQ ID NO: 744813 - protein, 31 aa, Mycobacterium
VFEPFFDCWAVRPGGGWGWAVEPPGVTVADV

SEQ ID NO: 744814 - protein, 17 aa, Mycobacterium
VFEPPRITPGGLSSQFS

SEQ ID NO: 744815 - protein, 19 aa, Mycobacterium
VFEPRAAQRPSWLDHIDDP

SEQ ID NO: 744816 - protein, 17 aa, Mycobacterium
VFEQEFTDVAGLMGPYL

SEQ ID NO: 744817 - protein, 30 aa, Mycobacterium
VFERFPRLRWGATECGAFWASDLLWLMDTR

SEQ ID NO: 744818 - protein, 19 aa, Mycobacterium
VFESVADLVAFVRTDNDND

SEQ ID NO: 744819 - protein, 26 aa, Mycobacterium
VFEVMVRPLIRLALGRRQSQRRIIQA

SEQ ID NO: 744820 - protein, 17 aa, Mycobacterium
VFFCCKAALRHMVPAQK

SEQ ID NO: 744821 - protein, 21 aa, Mycobacterium
VFGAHGRAYQALAAHVSAFHD

SEQ ID NO: 744822 - protein, 19 aa, Mycobacterium
VFGAVTGRDDMKREGQAQQ

SEQ ID NO: 744823 - protein, 23 aa, Mycobacterium
VFGCGAARAEVRLPVQASQGARR

SEQ ID NO: 744824 - protein, 24 aa, Mycobacterium
VFGEAVALFPSWETLPHERLSPGV

SEQ ID NO: 744825 - protein, 17 aa, Mycobacterium
VFGEPDLVCDFWTELGR

SEQ ID NO: 744826 - protein, 21 aa, Mycobacterium
VFGGARQGYYFARQPDSNYLR

SEQ ID NO: 744827 - protein, 17 aa, Mycobacterium
VFGGYGLSAQAVLTQAS

SEQ ID NO: 744828 - protein, 26 aa, Mycobacterium
VFGLAARKRIPVVLFAEGGGGRPGDT

SEQ ID NO: 744829 - protein, 18 aa, Mycobacterium
VFGMLRAGGSIVVVDEEH

SEQ ID NO: 744830 - protein, 17 aa, Mycobacterium
VFGNGDLNQVTWELRAM

SEQ ID NO: 744831 - protein, 24 aa, Mycobacterium
VFGPADFMASLGMRTLVVGEQPPG

SEQ ID NO: 744832 - protein, 26 aa, Mycobacterium
VFGPFSRRGMFRFGHSRRRESALRWL

SEQ ID NO: 744833 - protein, 25 aa, Mycobacterium
VFGPRVRWRAMLELLRDEGFGVQPP

SEQ ID NO: 744834 - protein, 18 aa, Mycobacterium
VFGPVLVLLPFDDDDEAV

SEQ ID NO: 744835 - protein, 18 aa, Mycobacterium
VFGPVLVVIAFDDDDDAV

SEQ ID NO: 744836 - protein, 19 aa, Mycobacterium
VFGQTRFSLHFRVSLLRDL

SEQ ID NO: 744837 - protein, 24 aa, Mycobacterium
VFGRLRPLLDTALDRAVVPGYTRI

SEQ ID NO: 744838 - protein, 18 aa, Mycobacterium
VFGRRNRYVSDWDDSGQA

SEQ ID NO: 744839 - protein, 25 aa, Mycobacterium
VFGRRVALIACEFDFLAGSIGVAAA

SEQ ID NO: 744840 - protein, 19 aa, Mycobacterium
VFGSPTWRTVTGGSVNYVR

SEQ ID NO: 744841 - protein, 17 aa, Mycobacterium
VFGSWCEEYRVVPEPEP

SEQ ID NO: 744842 - protein, 26 aa, Mycobacterium
VFGTGLPQWRDVSGADMLRHVHTLLV

SEQ ID NO: 744843 - protein, 19 aa, Mycobacterium
VFGTLPWHADLWLDSEDAL

SEQ ID NO: 744844 - protein, 24 aa, Mycobacterium
VFGVCFPGPLGLAAGFDKDGLGVL

SEQ ID NO: 744845 - protein, 24 aa, Mycobacterium
VFHCWAEGDFDAMLQRALPRTALI

SEQ ID NO: 744846 - protein, 19 aa, Mycobacterium
VFHGAQYMGRRFVSPYGHK

SEQ ID NO: 744847 - protein, 19 aa, Mycobacterium
VFHIMPFWYFNAISPAWGQ

SEQ ID NO: 744848 - protein, 20 aa, Mycobacterium
VFHREVKRMQGAITAVADCR

SEQ ID NO: 744849 - protein, 18 aa, Mycobacterium
VFHRRFLPNWQIREGKTA

SEQ ID NO: 744850 - protein, 19 aa, Mycobacterium
VFHTCRVVAPLMVQQRHGA

SEQ ID NO: 744851 - protein, 23 aa, Mycobacterium
VFHVGGNITGVWNDFQEFAEADQ

SEQ ID NO: 744852 - protein, 29 aa, Mycobacterium
VFHVVALPITVPVQFFLGSAEGVPTVIAA

SEQ ID NO: 744853 - protein, 25 aa, Mycobacterium
VFIGSGMPAGLWKRVTEVFEPAQVV

SEQ ID NO: 744854 - protein, 17 aa, Mycobacterium
VFIRAPWVERIGPDVEV

SEQ ID NO: 744855 - protein, 19 aa, Mycobacterium
VFIRARRGVVLAMGSFAYN

SEQ ID NO: 744856 - protein, 21 aa, Mycobacterium
VFIREPLRAAMGLTPARTRHE

SEQ ID NO: 744857 - protein, 18 aa, Mycobacterium
VFISWLVSAENSYITGQS

SEQ ID NO: 744858 - protein, 17 aa, Mycobacterium
VFITARLPAASPADPHC

SEQ ID NO: 744859 - protein, 19 aa, Mycobacterium
VFIVGHWRTGTTLLHELLI

SEQ ID NO: 744860 - protein, 18 aa, Mycobacterium
VFKFIADEKVEYVDVRFC

SEQ ID NO: 744861 - protein, 20 aa, Mycobacterium
VFKGDERWRGLPTPEGNTFA

SEQ ID NO: 744862 - protein, 24 aa, Mycobacterium
VFKQYRVGSIASYREMRDDPNNPA

SEQ ID NO: 744863 - protein, 17 aa, Mycobacterium
VFLCTREFGRGMVDRGW

SEQ ID NO: 744864 - protein, 27 aa, Mycobacterium
VFLDLGPIFAEWEADFGRTFVLSDDPH

SEQ ID NO: 744865 - protein, 18 aa, Mycobacterium
VFLEAFRNPELEQLGDAA

SEQ ID NO: 744866 - protein, 18 aa, Mycobacterium
VFLGRNGRISVFPSERTL

SEQ ID NO: 744867 - protein, 19 aa, Mycobacterium
VFLPCGGAIDFLAGATNRA

SEQ ID NO: 744868 - protein, 17 aa, Mycobacterium
VFLPPIGGQTIYIFGDP

SEQ ID NO: 744869 - protein, 18 aa, Mycobacterium
VFLQRGFHATTVAQIAAE

SEQ ID NO: 744870 - protein, 17 aa, Mycobacterium
VFLVMPFTSDFMKLTPE

SEQ ID NO: 744871 - protein, 17 aa, Mycobacterium
VFMDGWDPAQAVEVVHR

SEQ ID NO: 744872 - protein, 19 aa, Mycobacterium
VFMDLPIVFDLDIAMRGEG

SEQ ID NO: 744873 - protein, 26 aa, Mycobacterium
VFMPIARRQGIEFDLAFEAREIGATL

SEQ ID NO: 744874 - protein, 24 aa, Mycobacterium
VFMPIPVRIIAALLGLPESDVGEF

SEQ ID NO: 744875 - protein, 17 aa, Mycobacterium
VFNAKLLQRELGITTGN

SEQ ID NO: 744876 - protein, 20 aa, Mycobacterium
VFNDASGWYGKTHDAAKIKV

SEQ ID NO: 744877 - protein, 23 aa, Mycobacterium
VFNDPLVECLNCHKRHRQDHLQE

SEQ ID NO: 744878 - protein, 23 aa, Mycobacterium
VFNDPLVECLNCHKRHRQDHMQE

SEQ ID NO: 744879 - protein, 23 aa, Mycobacterium
VFNDPLVECLSCHKRHRQDHMQE

SEQ ID NO: 744880 - protein, 25 aa, Mycobacterium
VFNGACAMGADSFAAVNDVTGGAAA

SEQ ID NO: 744881 - protein, 18 aa, Mycobacterium
VFNPLSIYWCHDRDGRVR

SEQ ID NO: 744882 - protein, 29 aa, Mycobacterium
VFNPLTLYWCYDANGVLRCVVAEVQNTHG

SEQ ID NO: 744883 - protein, 27 aa, Mycobacterium
VFNRVVADLGATGWRLDDGELDLQVRG

SEQ ID NO: 744884 - protein, 25 aa, Mycobacterium
VFPARTCSMGVFKRHKQIDRPCLLG

SEQ ID NO: 744885 - protein, 18 aa, Mycobacterium
VFPDSIVVFTHRDPVPVA

SEQ ID NO: 744886 - protein, 24 aa, Mycobacterium
VFPEATMCRFGVPLAPIAEPLDGP

SEQ ID NO: 744887 - protein, 23 aa, Mycobacterium
VFPEATMCRFGVPLAPIAEPVDG

SEQ ID NO: 744888 - protein, 24 aa, Mycobacterium
VFPEATMCRFGVPLGPVAQPVNGR

SEQ ID NO: 744889 - protein, 18 aa, Mycobacterium
VFPEGFKGLGKPFKDRYK

SEQ ID NO: 744890 - protein, 31 aa, Mycobacterium
VFPEGYKGLGKCFRDRYKLRRFGRGGFVSAA

SEQ ID NO: 744891 - protein, 18 aa, Mycobacterium
VFPFLRDWFSARLDECPP

SEQ ID NO: 744892 - protein, 17 aa, Mycobacterium
VFPGAVLYQRIVSTASN

SEQ ID NO: 744893 - protein, 23 aa, Mycobacterium
VFPGETLTTLIWRTDPGKAVFRT

SEQ ID NO: 744894 - protein, 23 aa, Mycobacterium
VFPGETLTTLIWRTEPGKAVFRT

SEQ ID NO: 744895 - protein, 23 aa, Mycobacterium
VFPGETLTTLIWRTEPGKAVYRT

SEQ ID NO: 744896 - protein, 26 aa, Mycobacterium
VFPGETLTTLIWRTGEGKAVFRTEAS

SEQ ID NO: 744897 - protein, 19 aa, Mycobacterium
VFPNCGHWVMIEAKSAFER

SEQ ID NO: 744898 - protein, 21 aa, Mycobacterium
VFPRVSAVHLYRIPAEESAAD

SEQ ID NO: 744899 - protein, 25 aa, Mycobacterium
VFPTRPIVGLLGFLGLRSNLVPNHG

SEQ ID NO: 744900 - protein, 19 aa, Mycobacterium
VFPTYRLDHQFDVIRKVGE

SEQ ID NO: 744901 - protein, 21 aa, Mycobacterium
VFPTYRLDHQFEVIRKVGELT

SEQ ID NO: 744902 - protein, 19 aa, Mycobacterium
VFQQFATTVPTEFQSLVVH

SEQ ID NO: 744903 - protein, 23 aa, Mycobacterium
VFQQPRLFPWRTVGGNIDLALKY

SEQ ID NO: 744904 - protein, 23 aa, Mycobacterium
VFQQPRLFPWRTVGGNIELALKY

SEQ ID NO: 744905 - protein, 18 aa, Mycobacterium
VFQRALSWLTERMPGPPV

SEQ ID NO: 744906 - protein, 21 aa, Mycobacterium
VFQRTPGWVLPRVNFRHPAWA

SEQ ID NO: 744907 - protein, 37 aa, Mycobacterium
VFQRTPIWCFPKFDFPLPAALRWAMRIPGGKALQRLL

SEQ ID NO: 744908 - protein, 26 aa, Mycobacterium
VFQRTPIWCFPKFDVPLSRTARAMMR

SEQ ID NO: 744909 - protein, 24 aa, Mycobacterium
VFQRTPIWCFPKLDVALPAPARWA

SEQ ID NO: 744910 - protein, 24 aa, Mycobacterium
VFQRTPIWCFPKLDVPLPAPARWA

SEQ ID NO: 744911 - protein, 25 aa, Mycobacterium
VFQRTPIWCLPKFDFAVPRPLSALL

SEQ ID NO: 744912 - protein, 19 aa, Mycobacterium
VFQVVKAVILGVVAQGWFL

SEQ ID NO: 744913 - protein, 20 aa, Mycobacterium
VFQYRLGQLDVRLGSVRALA

SEQ ID NO: 744914 - protein, 19 aa, Mycobacterium
VFRAMPALDPDRCVRGQYR

SEQ ID NO: 744915 - protein, 25 aa, Mycobacterium
VFREPLPRIGLDSLPDQGAWLQPFR

SEQ ID NO: 744916 - protein, 26 aa, Mycobacterium
VFRHGLQLHGAMGFTWENDLQFALKR

SEQ ID NO: 744917 - protein, 17 aa, Mycobacterium
VFRHVIRPLLQHAETAA

SEQ ID NO: 744918 - protein, 26 aa, Mycobacterium
VFRNCYRPQWCRVIDYPFTAGADVTA

SEQ ID NO: 744919 - protein, 25 aa, Mycobacterium
VFRQRYWARNHVGWRHMDDTAPNAG

SEQ ID NO: 744920 - protein, 25 aa, Mycobacterium
VFRQRYWARNHVGWRHMDETQPNAG

SEQ ID NO: 744921 - protein, 19 aa, Mycobacterium
VFRRDGMLLAVDRHMRPRD

SEQ ID NO: 744922 - protein, 19 aa, Mycobacterium
VFRRDRTSPPLAFGYGTHH

SEQ ID NO: 744923 - protein, 20 aa, Mycobacterium
VFRRNIWVSPFWEGSVADVV

SEQ ID NO: 744924 - protein, 18 aa, Mycobacterium
VFRSELTEWMYADDEKGR

SEQ ID NO: 744925 - protein, 25 aa, Mycobacterium
VFRTRAFRDGDDWVITGRKYFSSNA

SEQ ID NO: 744926 - protein, 23 aa, Mycobacterium
VFRYEEGTAMAVMYPANAVAQKS

SEQ ID NO: 744927 - protein, 21 aa, Mycobacterium
VFSDVERWPEWTASVTSLAAV

SEQ ID NO: 744928 - protein, 23 aa, Mycobacterium
VFSEALAAPLYWIATNAGLDGAV

SEQ ID NO: 744929 - protein, 18 aa, Mycobacterium
VFSGCDFSGVNLAESQHR

SEQ ID NO: 744930 - protein, 18 aa, Mycobacterium
VFSGHKIYGPTGIGVLYG

SEQ ID NO: 744931 - protein, 20 aa, Mycobacterium
VFSHGVAVVARLAERAVAYR

SEQ ID NO: 744932 - protein, 18 aa, Mycobacterium
VFSHGVAVVARLAERAVV

SEQ ID NO: 744933 - protein, 24 aa, Mycobacterium
VFTAACARAAAAIDGERWDEALAE

SEQ ID NO: 744934 - protein, 18 aa, Mycobacterium
VFTAEAWGSDAYTPLAWW

SEQ ID NO: 744935 - protein, 22 aa, Mycobacterium
VFTARLGERILAYEGAKQQDKP

SEQ ID NO: 744936 - protein, 19 aa, Mycobacterium
VFTLPSYNLNLFLDGVIQA

SEQ ID NO: 744937 - protein, 19 aa, Mycobacterium
VFTLRRMLAVDGLVREFCC

SEQ ID NO: 744938 - protein, 24 aa, Mycobacterium
VFTPGLAGLVLGEFRRMSSAPAAD

SEQ ID NO: 744939 - protein, 18 aa, Mycobacterium
VFTPLRAIIGIFTNGGLL

SEQ ID NO: 744940 - protein, 24 aa, Mycobacterium
VFTQDCPRQALVLPLSENPAPGAL

SEQ ID NO: 744941 - protein, 24 aa, Mycobacterium
VFTRAQLLQEVWGYDFFGGTRTVD

SEQ ID NO: 744942 - protein, 18 aa, Mycobacterium
VFTRHDFAAPVSFVDFTI

SEQ ID NO: 744943 - protein, 18 aa, Mycobacterium
VFTRLCQAMGCPELATDD

SEQ ID NO: 744944 - protein, 21 aa, Mycobacterium
VFTVACPRFVDFVERGVTSGR

SEQ ID NO: 744945 - protein, 17 aa, Mycobacterium
VFTVDGFTIPASTVELD

SEQ ID NO: 744946 - protein, 20 aa, Mycobacterium
VFTVDYFWPVTYQFKSDGIG

SEQ ID NO: 744947 - protein, 21 aa, Mycobacterium
VFTVPRGRRGAVFDESLELLN

SEQ ID NO: 744948 - protein, 19 aa, Mycobacterium
VFVCPSVYEPLGIVNLEAM

SEQ ID NO: 744949 - protein, 17 aa, Mycobacterium
VFVDHGLLRAGERAQVE

SEQ ID NO: 744950 - protein, 17 aa, Mycobacterium
VFVDHGLLRAGERAQVQ

SEQ ID NO: 744951 - protein, 18 aa, Mycobacterium
VFVDHGLLRSGERAQVEH

SEQ ID NO: 744952 - protein, 31 aa, Mycobacterium
VFVEAPMALGWSRWRALDGGRSLGLIQDILE

SEQ ID NO: 744953 - protein, 17 aa, Mycobacterium
VFVGLELDADAYAGVPC

SEQ ID NO: 744954 - protein, 18 aa, Mycobacterium
VFVGRNGKDLGISFHNYL

SEQ ID NO: 744955 - protein, 20 aa, Mycobacterium
VFVGRNGKDLGISFHNYLYN

SEQ ID NO: 744956 - protein, 22 aa, Mycobacterium
VFVHLCSAAQWTAITGEVPPPT

SEQ ID NO: 744957 - protein, 17 aa, Mycobacterium
VFVLECAILADRVIVPT

SEQ ID NO: 744958 - protein, 18 aa, Mycobacterium
VFVLRPCIVAGPEAHALA

SEQ ID NO: 744959 - protein, 19 aa, Mycobacterium
VFVLRPCIVAGPHAYSLAE

SEQ ID NO: 744960 - protein, 18 aa, Mycobacterium
VFVLRPCVVAGPNATALA

SEQ ID NO: 744961 - protein, 17 aa, Mycobacterium
VFVPMFLGKEVADSLGG

SEQ ID NO: 744962 - protein, 20 aa, Mycobacterium
VFVPPKFAKDAIIEAIDAEI

SEQ ID NO: 744963 - protein, 19 aa, Mycobacterium
VFVRGRAGVDSGLLATVDT

SEQ ID NO: 744964 - protein, 37 aa, Mycobacterium
VFVSTARCPMTYVLVSPEIMASVAADVHGIGALLANG

SEQ ID NO: 744965 - protein, 17 aa, Mycobacterium
VFVVGVGMTKFEKPGRR

SEQ ID NO: 744966 - protein, 18 aa, Mycobacterium
VFWQLPPVQQLALSAFNI

SEQ ID NO: 744967 - protein, 24 aa, Mycobacterium
VFYLHSRLLERCAKLSDDLGGGSL

SEQ ID NO: 744968 - protein, 24 aa, Mycobacterium
VFYLHSRLLERCAKLSDELGGGSM

SEQ ID NO: 744969 - protein, 17 aa, Mycobacterium
VFYPVIPPGSWVATTEF

SEQ ID NO: 744970 - protein, 20 aa, Mycobacterium
VGAAAELIGEIGLGAVTLEA

SEQ ID NO: 744971 - protein, 17 aa, Mycobacterium
VGAAAVRGPAGYLADHV

SEQ ID NO: 744972 - protein, 25 aa, Mycobacterium
VGAACAAAPISEMAAGVPLAPPGPV

SEQ ID NO: 744973 - protein, 19 aa, Mycobacterium
VGAACTAALLGGGADPAVR

SEQ ID NO: 744974 - protein, 18 aa, Mycobacterium
VGAADAVTCYLDRTPPPP

SEQ ID NO: 744975 - protein, 18 aa, Mycobacterium
VGAAERGLHTAVSFAESR

SEQ ID NO: 744976 - protein, 18 aa, Mycobacterium
VGAAFANMEMDIVLRTVL

SEQ ID NO: 744977 - protein, 19 aa, Mycobacterium
VGAAGGWTRWSPVKFEVIS

SEQ ID NO: 744978 - protein, 18 aa, Mycobacterium
VGAAGNEKNFKWIARSAD

SEQ ID NO: 744979 - protein, 17 aa, Mycobacterium
VGAAGWCTAAPNLWPQP

SEQ ID NO: 744980 - protein, 17 aa, Mycobacterium
VGAAIADPSNWRRWWPD

SEQ ID NO: 744981 - protein, 17 aa, Mycobacterium
VGAALADLVDRGLKPPA

SEQ ID NO: 744982 - protein, 21 aa, Mycobacterium
VGAALRRIREKKTQTVADKIR

SEQ ID NO: 744983 - protein, 20 aa, Mycobacterium
VGAANLGGTVLAKFGEAVPV

SEQ ID NO: 744984 - protein, 26 aa, Mycobacterium
VGAAPRLRAAAAWFTLLKQERRRRRI

SEQ ID NO: 744985 - protein, 18 aa, Mycobacterium
VGACALCHAVTISRAGVS

SEQ ID NO: 744986 - protein, 23 aa, Mycobacterium
VGACLRCPLCTEQLHATDDLLLV

SEQ ID NO: 744987 - protein, 17 aa, Mycobacterium
VGADARGPALLIIDRQR

SEQ ID NO: 744988 - protein, 25 aa, Mycobacterium
VGADGPRGRAHRGQIDGAPEDGQSL

SEQ ID NO: 744989 - protein, 24 aa, Mycobacterium
VGADRGYRGLQFFHATGLPLHDIR

SEQ ID NO: 744990 - protein, 24 aa, Mycobacterium
VGADRGYRGLQFFHATGLPLHEIR

SEQ ID NO: 744991 - protein, 25 aa, Mycobacterium
VGADTLRKSVTFFLHASREAGIALS

SEQ ID NO: 744992 - protein, 19 aa, Mycobacterium
VGADVAWFSTCGSSLSVKA

SEQ ID NO: 744993 - protein, 17 aa, Mycobacterium
VGADVLGAVNAPTMAVL

SEQ ID NO: 744994 - protein, 19 aa, Mycobacterium
VGADWPIRYEDIRAHYERI

SEQ ID NO: 744995 - protein, 18 aa, Mycobacterium
VGADWPLRYEDIRPHYEQ

SEQ ID NO: 744996 - protein, 18 aa, Mycobacterium
VGAEAIVVSVDYRLAPEH

SEQ ID NO: 744997 - protein, 27 aa, Mycobacterium
VGAEALVRWRHPVWGLLLPDSFIGIAE

SEQ ID NO: 744998 - protein, 20 aa, Mycobacterium
VGAEFARLLAEAGVNLVLIA

SEQ ID NO: 744999 - protein, 37 aa, Mycobacterium
VGAEGIPNVEFRLRAGLIHDWFTFPFLPDAHEDRAGV

SEQ ID NO: 745000 - protein, 23 aa, Mycobacterium
VGAEGLKDVGIWGTVFEGEAHPL

SEQ ID NO: 745001 - protein, 26 aa, Mycobacterium
VGAEGWPVTVSYDFDAELPAADAVLM

SEQ ID NO: 745002 - protein, 20 aa, Mycobacterium
VGAEKLWMGETHAMPSTVSA

SEQ ID NO: 745003 - protein, 19 aa, Mycobacterium
VGAELEFDGVIARLVELAY

SEQ ID NO: 745004 - protein, 19 aa, Mycobacterium
VGAELRKRCVGPECDVLVE

SEQ ID NO: 745005 - protein, 26 aa, Mycobacterium
VGAERAVWIGHDWGAAVVWNAPLLHP

SEQ ID NO: 745006 - protein, 25 aa, Mycobacterium
VGAERAVWVGHDWGAVVVWNAPLLH

SEQ ID NO: 745007 - protein, 17 aa, Mycobacterium
VGAEVPLLGRIPLDPAL

SEQ ID NO: 745008 - protein, 18 aa, Mycobacterium
VGAEWLQRMGWTNDRAMA

SEQ ID NO: 745009 - protein, 21 aa, Mycobacterium
VGAFNDWPAAVKDIRNILAHQ

SEQ ID NO: 745010 - protein, 18 aa, Mycobacterium
VGAFNFAPALSIYASSKA

SEQ ID NO: 745011 - protein, 20 aa, Mycobacterium
VGAGGAGMRAAVEAGPRART

SEQ ID NO: 745012 - protein, 17 aa, Mycobacterium
VGAGIADRGWTLVSGGG

SEQ ID NO: 745013 - protein, 20 aa, Mycobacterium
VGAGLHWPHEVYPIFESAIA

SEQ ID NO: 745014 - protein, 26 aa, Mycobacterium
VGAGQAPTIIFGWGGGTLRSYVDAGQ

SEQ ID NO: 745015 - protein, 25 aa, Mycobacterium
VGAGSGSIAVEWCRSAAGCTAVAFE

SEQ ID NO: 745016 - protein, 20 aa, Mycobacterium
VGAGWCLTEPTGGSDLSGIR

SEQ ID NO: 745017 - protein, 21 aa, Mycobacterium
VGAGWPAGVDPLWTGGGATPA

SEQ ID NO: 745018 - protein, 19 aa, Mycobacterium
VGAHFCLGSALARLEGRVA

SEQ ID NO: 745019 - protein, 17 aa, Mycobacterium
VGAHGATGNVVANGGNG

SEQ ID NO: 745020 - protein, 18 aa, Mycobacterium
VGAHGGAFVTAPTSSRVS

SEQ ID NO: 745021 - protein, 21 aa, Mycobacterium
VGAHLATLGKRVLVIGSGGLS

SEQ ID NO: 745022 - protein, 23 aa, Mycobacterium
VGAHLKSRLLALSDKHPIIGTVH

SEQ ID NO: 745023 - protein, 25 aa, Mycobacterium
VGAHRFLQRVWRLVVDEQTGETRVL

SEQ ID NO: 745024 - protein, 25 aa, Mycobacterium
VGAHRFLQRVWRLVVDEQTGKTRVI

SEQ ID NO: 745025 - protein, 24 aa, Mycobacterium
VGAHRFLQRVWRLVVEEDTGETRV

SEQ ID NO: 745026 - protein, 24 aa, Mycobacterium
VGAHRFLQRVWRVVIDETSGNVRV

SEQ ID NO: 745027 - protein, 24 aa, Mycobacterium
VGAHRVCTVFDLMLAQYGVARPGL

SEQ ID NO: 745028 - protein, 17 aa, Mycobacterium
VGAIRLPQRVGWANAME

SEQ ID NO: 745029 - protein, 17 aa, Mycobacterium
VGAIVDFAGQRLKGLGE

SEQ ID NO: 745030 - protein, 20 aa, Mycobacterium
VGAIVEWVSAVMTLLPGDVI

SEQ ID NO: 745031 - protein, 19 aa, Mycobacterium
VGAKRARRVVDLGCGPGHL

SEQ ID NO: 745032 - protein, 18 aa, Mycobacterium
VGALAMAWTGPGADAAVN

SEQ ID NO: 745033 - protein, 18 aa, Mycobacterium
VGALDEWTLNAGTVTSWH

SEQ ID NO: 745034 - protein, 26 aa, Mycobacterium
VGALDFGTGEFRYCTAGHPPPLLVTS

SEQ ID NO: 745035 - protein, 25 aa, Mycobacterium
VGALFRRVADESGRLDLLVNNAAAI

SEQ ID NO: 745036 - protein, 26 aa, Mycobacterium
VGALGAVHLVGWSYGALIGLEAALGS

SEQ ID NO: 745037 - protein, 17 aa, Mycobacterium
VGALGLRPTLAALESGA

SEQ ID NO: 745038 - protein, 18 aa, Mycobacterium
VGALGRLGFEGISDVRQG

SEQ ID NO: 745039 - protein, 27 aa, Mycobacterium
VGALGRPAILIGHSMGALHSWCLAAAR

SEQ ID NO: 745040 - protein, 19 aa, Mycobacterium
VGALLCVLAKLTGAKAVVE

SEQ ID NO: 745041 - protein, 17 aa, Mycobacterium
VGALPFDTSRPVALTAP

SEQ ID NO: 745042 - protein, 23 aa, Mycobacterium
VGALRGGFEYARTGNPTRAALEA

SEQ ID NO: 745043 - protein, 24 aa, Mycobacterium
VGALRGGFEYARTGNPTRAALEAA

SEQ ID NO: 745044 - protein, 20 aa, Mycobacterium
VGALVWSPLGWGRLTGRIRR

SEQ ID NO: 745045 - protein, 23 aa, Mycobacterium
VGALWPMVVLRTVVLIVSDAQQA

SEQ ID NO: 745046 - protein, 24 aa, Mycobacterium
VGANTPVLVRMPFGGVLAQPQPIT

SEQ ID NO: 745047 - protein, 24 aa, Mycobacterium
VGAPGHTPGSIGLYLPAADAVLTG

SEQ ID NO: 745048 - protein, 17 aa, Mycobacterium
VGAPLARLEGRVALEEV

SEQ ID NO: 745049 - protein, 20 aa, Mycobacterium
VGAPRPERQVSFEPSVSSLY

SEQ ID NO: 745050 - protein, 19 aa, Mycobacterium
VGAPWAAAYHFVYTTQGAD

SEQ ID NO: 745051 - protein, 30 aa, Mycobacterium
VGAQAGRVGAPMPMGMPMGAAGAAAAGSSS

SEQ ID NO: 745052 - protein, 17 aa, Mycobacterium
VGAQGRWQGLHDLQQFI

SEQ ID NO: 745053 - protein, 25 aa, Mycobacterium
VGARAATVAHAWSALLRAALRTAAR

SEQ ID NO: 745054 - protein, 22 aa, Mycobacterium
VGARAGGTLVGYAGISRLGRTP

SEQ ID NO: 745055 - protein, 23 aa, Mycobacterium
VGARAQTALAWHVDELPAHPGRD

SEQ ID NO: 745056 - protein, 22 aa, Mycobacterium
VGARFVPSPAAAALEAQVYPSP

SEQ ID NO: 745057 - protein, 17 aa, Mycobacterium
VGARLAGAQVLRADSLT

SEQ ID NO: 745058 - protein, 19 aa, Mycobacterium
VGARLRLTRALPLRIGDIG

SEQ ID NO: 745059 - protein, 22 aa, Mycobacterium
VGARPRGPGMERSDLLEANGAI

SEQ ID NO: 745060 - protein, 25 aa, Mycobacterium
VGARQRCAATWGVSLTGVAGPEAHG

SEQ ID NO: 745061 - protein, 17 aa, Mycobacterium
VGARRPAGIAVDVTVSR

SEQ ID NO: 745062 - protein, 17 aa, Mycobacterium
VGARRTAEELGRAFPGT

SEQ ID NO: 745063 - protein, 23 aa, Mycobacterium
VGARRTAEELGRAFPGTPVITSG

SEQ ID NO: 745064 - protein, 17 aa, Mycobacterium
VGARRTAEELGRALPGV

SEQ ID NO: 745065 - protein, 18 aa, Mycobacterium
VGASFYPDDMAFATEHPV

SEQ ID NO: 745066 - protein, 19 aa, Mycobacterium
VGASGRMMAPIARNEAQTT

SEQ ID NO: 745067 - protein, 22 aa, Mycobacterium
VGASGRPGRLVDRHPTVSPERL

SEQ ID NO: 745068 - protein, 20 aa, Mycobacterium
VGASRKRFLGTLLAAADGTP

SEQ ID NO: 745069 - protein, 17 aa, Mycobacterium
VGASRKRFLGTLLAAPD

SEQ ID NO: 745070 - protein, 22 aa, Mycobacterium
VGATIAAAVVDWFSVDWHRAIV

SEQ ID NO: 745071 - protein, 22 aa, Mycobacterium
VGATSRLLARFPSIGGTDTCGR

SEQ ID NO: 745072 - protein, 20 aa, Mycobacterium
VGATTTFWFGLGRTLAVGRM

SEQ ID NO: 745073 - protein, 21 aa, Mycobacterium
VGAVALVAGWVARTSEPGTRV

SEQ ID NO: 745074 - protein, 20 aa, Mycobacterium
VGAVDCRGGAPGTRETDLLD

SEQ ID NO: 745075 - protein, 22 aa, Mycobacterium
VGAVDCRGGAPGTRETDLLDPA

SEQ ID NO: 745076 - protein, 22 aa, Mycobacterium
VGAVDCRGGAPGTRETDLLDPV

SEQ ID NO: 745077 - protein, 18 aa, Mycobacterium
VGAVGLVAGWAARTLPSD

SEQ ID NO: 745078 - protein, 19 aa, Mycobacterium
VGAVLCNLATHLDDPADRL

SEQ ID NO: 745079 - protein, 21 aa, Mycobacterium
VGAVLGMGVPVRLEVVDLGQH

SEQ ID NO: 745080 - protein, 17 aa, Mycobacterium
VGAVVDWLQRFIDELLV

SEQ ID NO: 745081 - protein, 26 aa, Mycobacterium
VGAWKNRPDTEFGYRAAELADDAPEW

SEQ ID NO: 745082 - protein, 17 aa, Mycobacterium
VGAYCWGFVAGKTQTYL

SEQ ID NO: 745083 - protein, 22 aa, Mycobacterium
VGAYTARAIACFGYGQRVPVVD

SEQ ID NO: 745084 - protein, 23 aa, Mycobacterium
VGCAEVIRQVWLLLDGECGPDTR

SEQ ID NO: 745085 - protein, 23 aa, Mycobacterium
VGCAEVIRQVWLLLDGECTPESR

SEQ ID NO: 745086 - protein, 17 aa, Mycobacterium
VGCAGRLVYSPAVRVTV

SEQ ID NO: 745087 - protein, 17 aa, Mycobacterium
VGCASSLAIMSAATTRW

SEQ ID NO: 745088 - protein, 20 aa, Mycobacterium
VGCDHFRTNIAFLPDLQAYL

SEQ ID NO: 745089 - protein, 24 aa, Mycobacterium
VGCGPELRCTAAWFEVLKLERRRL

SEQ ID NO: 745090 - protein, 22 aa, Mycobacterium
VGCGVATGFGAAVNRAQVGPGD

SEQ ID NO: 745091 - protein, 18 aa, Mycobacterium
VGCGVGGWVATWLDSGAD

SEQ ID NO: 745092 - protein, 22 aa, Mycobacterium
VGCGVPAGWGGPVYNNGIRPGD

SEQ ID NO: 745093 - protein, 20 aa, Mycobacterium
VGCKRPGFHNTYLATFNRDN

SEQ ID NO: 745094 - protein, 18 aa, Mycobacterium
VGCLCVNSAMAETVAADA

SEQ ID NO: 745095 - protein, 19 aa, Mycobacterium
VGCRDRLPHLQRLAVYTGD

SEQ ID NO: 745096 - protein, 21 aa, Mycobacterium
VGCRRSVPSLQRLLGHLETSL

SEQ ID NO: 745097 - protein, 17 aa, Mycobacterium
VGCSWCVDFGSMLMRLE

SEQ ID NO: 745098 - protein, 18 aa, Mycobacterium
VGCVDRIVTELAVIDVCD

SEQ ID NO: 745099 - protein, 19 aa, Mycobacterium
VGCVNRIVTELAVIDVCHD

SEQ ID NO: 745100 - protein, 18 aa, Mycobacterium
VGCYVGASYLGYGGDLAE

SEQ ID NO: 745101 - protein, 17 aa, Mycobacterium
VGDAAYLLTSWHPASRP

SEQ ID NO: 745102 - protein, 25 aa, Mycobacterium
VGDALTAAWAIRLAVAPGIDVRFGI

SEQ ID NO: 745103 - protein, 18 aa, Mycobacterium
VGDATAYCASKFGVVGFT

SEQ ID NO: 745104 - protein, 25 aa, Mycobacterium
VGDAVAFLPEHRVLFSGDLLTRGIV

SEQ ID NO: 745105 - protein, 18 aa, Mycobacterium
VGDAYQLAPVKARGGMFA

SEQ ID NO: 745106 - protein, 24 aa, Mycobacterium
VGDCARLTVVWIADWADDTVHLSA

SEQ ID NO: 745107 - protein, 17 aa, Mycobacterium
VGDCVGHGLAAATVMGQ

SEQ ID NO: 745108 - protein, 22 aa, Mycobacterium
VGDCVGHGLAAATVMGQVRSAC

SEQ ID NO: 745109 - protein, 19 aa, Mycobacterium
VGDDGRLGWTDGTGPPETN

SEQ ID NO: 745110 - protein, 24 aa, Mycobacterium
VGDDIRFGLGAIRNVGANVVSSLI

SEQ ID NO: 745111 - protein, 24 aa, Mycobacterium
VGDDIRFGLGAVRNVGANVVASLV

SEQ ID NO: 745112 - protein, 17 aa, Mycobacterium
VGDDVAHTELGHGWVQG

SEQ ID NO: 745113 - protein, 19 aa, Mycobacterium
VGDELAVTVANRLDSATSV

SEQ ID NO: 745114 - protein, 23 aa, Mycobacterium
VGDENLRLAWPFENAPVDLLAAA

SEQ ID NO: 745115 - protein, 21 aa, Mycobacterium
VGDFGFDACIDYKNDDLAAAL

SEQ ID NO: 745116 - protein, 17 aa, Mycobacterium
VGDGAQWLSWIGIDDLV

SEQ ID NO: 745117 - protein, 18 aa, Mycobacterium
VGDGCVMPGFVEAHGHPL

SEQ ID NO: 745118 - protein, 23 aa, Mycobacterium
VGDGGDGALHWLINEIERCETDP

SEQ ID NO: 745119 - protein, 21 aa, Mycobacterium
VGDGGDGALHWLINETERCIG

SEQ ID NO: 745120 - protein, 35 aa, Mycobacterium
VGDGMRWAMRHLPFYGRWYRFLVLWPGSDKGLDAA

SEQ ID NO: 745121 - protein, 31 aa, Mycobacterium
VGDGNTGIAARGHQAGNLGIVSTAIGFGNTD

SEQ ID NO: 745122 - protein, 17 aa, Mycobacterium
VGDGRWRIRGRTLRYQI

SEQ ID NO: 745123 - protein, 19 aa, Mycobacterium
VGDGVAFVVAETANQAATA

SEQ ID NO: 745124 - protein, 25 aa, Mycobacterium
VGDHNIVSVGFNWIMGEHVTPPKPL

SEQ ID NO: 745125 - protein, 24 aa, Mycobacterium
VGDIARSWLFERISMLPRSAAPFK

SEQ ID NO: 745126 - protein, 22 aa, Mycobacterium
VGDICGLPEPVGIVATDDVDAL

SEQ ID NO: 745127 - protein, 19 aa, Mycobacterium
VGDIFAWFTKNCVPKEVAI

SEQ ID NO: 745128 - protein, 17 aa, Mycobacterium
VGDIRYISEVGFGVPDV

SEQ ID NO: 745129 - protein, 17 aa, Mycobacterium
VGDIWLIPADRRYSALA

SEQ ID NO: 745130 - protein, 23 aa, Mycobacterium
VGDKLWAPTFVRDFPVETTPLTR

SEQ ID NO: 745131 - protein, 21 aa, Mycobacterium
VGDKLWFDSYLDSVIESHGTV

SEQ ID NO: 745132 - protein, 18 aa, Mycobacterium
VGDKWVINGAKTWSTSAF

SEQ ID NO: 745133 - protein, 18 aa, Mycobacterium
VGDLCAALLQIADGGVRG

SEQ ID NO: 745134 - protein, 26 aa, Mycobacterium
VGDLDRPKLVFVFDEAHLLFADASKA

SEQ ID NO: 745135 - protein, 24 aa, Mycobacterium
VGDLPAVIIGGGIVPAPLLAELIA

SEQ ID NO: 745136 - protein, 18 aa, Mycobacterium
VGDPEILTYFGTLIAEYQ

SEQ ID NO: 745137 - protein, 24 aa, Mycobacterium
VGDPGFSFPYAVGGGPRLGTGLAL

SEQ ID NO: 745138 - protein, 22 aa, Mycobacterium
VGDPGWFGPGSAVWHVHSHMPA

SEQ ID NO: 745139 - protein, 17 aa, Mycobacterium
VGDPIQSIYGWRGASAT

SEQ ID NO: 745140 - protein, 23 aa, Mycobacterium
VGDPIQSIYGWRGASATNLPRFA

SEQ ID NO: 745141 - protein, 23 aa, Mycobacterium
VGDPIQSIYGWRGASATNLPRFS

SEQ ID NO: 745142 - protein, 24 aa, Mycobacterium
VGDPIQSIYGWRGASATNLPRFTT

SEQ ID NO: 745143 - protein, 23 aa, Mycobacterium
VGDPKLDLAWMVQSWPTGADSGA

SEQ ID NO: 745144 - protein, 22 aa, Mycobacterium
VGDPLLDLAWCLLGYDGEEPRA

SEQ ID NO: 745145 - protein, 22 aa, Mycobacterium
VGDPLLDLAWCLLGYDGENPRE

SEQ ID NO: 745146 - protein, 21 aa, Mycobacterium
VGDPRLPQMPATPEQIDALAA

SEQ ID NO: 745147 - protein, 17 aa, Mycobacterium
VGDPVLHTATEPIPVGP

SEQ ID NO: 745148 - protein, 18 aa, Mycobacterium
VGDQGKRDVSHGCINLSP

SEQ ID NO: 745149 - protein, 18 aa, Mycobacterium
VGDQVLRAMLGTEGDAAA

SEQ ID NO: 745150 - protein, 20 aa, Mycobacterium
VGDRARALGITRAALFSDSA

SEQ ID NO: 745151 - protein, 17 aa, Mycobacterium
VGDRARLARIISETKTR

SEQ ID NO: 745152 - protein, 22 aa, Mycobacterium
VGDRFPVIPIPSWMDNPIDPIS

SEQ ID NO: 745153 - protein, 23 aa, Mycobacterium
VGDRILHDILRGMHPDAAANAEW

SEQ ID NO: 745154 - protein, 22 aa, Mycobacterium
VGDRKAGCLVGFTSQTSINPPR

SEQ ID NO: 745155 - protein, 17 aa, Mycobacterium
VGDRKTYLFAFLDDHSR

SEQ ID NO: 745156 - protein, 21 aa, Mycobacterium
VGDRLLRRVPRGCELTAAGQQ

SEQ ID NO: 745157 - protein, 25 aa, Mycobacterium
VGDRLRLALDAALCAAVIGAPAPLA

SEQ ID NO: 745158 - protein, 26 aa, Mycobacterium
VGDRLRLALDADLCGAVTGLPAPLAH

SEQ ID NO: 745159 - protein, 23 aa, Mycobacterium
VGDRSGVVKAWFDTHQESVLFLR

SEQ ID NO: 745160 - protein, 17 aa, Mycobacterium
VGDRVMVPFNIFCGSCY

SEQ ID NO: 745161 - protein, 18 aa, Mycobacterium
VGDRYLPYVHGIVDDPAM

SEQ ID NO: 745162 - protein, 27 aa, Mycobacterium
VGDSMVDAAICDGDWVVVRQQNVADNG

SEQ ID NO: 745163 - protein, 24 aa, Mycobacterium
VGDSSGPCLEGWTTLTALAQATSR

SEQ ID NO: 745164 - protein, 25 aa, Mycobacterium
VGDVLWGSWCGRTASTAYQDMVVLR

SEQ ID NO: 745165 - protein, 19 aa, Mycobacterium
VGDYGESVLARFANTALPH

SEQ ID NO: 745166 - protein, 20 aa, Mycobacterium
VGEAGWRASMAKAVCSEALR

SEQ ID NO: 745167 - protein, 22 aa, Mycobacterium
VGEARTLLELGERYPADAGVLA

SEQ ID NO: 745168 - protein, 18 aa, Mycobacterium
VGEAWKYLKELRLERGPL

SEQ ID NO: 745169 - protein, 25 aa, Mycobacterium
VGEAWRFLKELRLERGPLDTDEATA

SEQ ID NO: 745170 - protein, 25 aa, Mycobacterium
VGEAWRFLKELRLERGPLTAEEATA

SEQ ID NO: 745171 - protein, 25 aa, Mycobacterium
VGEAWRYLKELRLDRGPLSTEEATA

SEQ ID NO: 745172 - protein, 25 aa, Mycobacterium
VGEAWRYLKELRLERGPLTIEEAKA

SEQ ID NO: 745173 - protein, 28 aa, Mycobacterium
VGECIRRIGDCLGIYTAIRAGRMPEAAA

SEQ ID NO: 745174 - protein, 19 aa, Mycobacterium
VGEDGRFEILLGPRRPGEH

SEQ ID NO: 745175 - protein, 17 aa, Mycobacterium
VGEELPVHTARLSRGDL

SEQ ID NO: 745176 - protein, 25 aa, Mycobacterium
VGEELRIGELTVRAVGGKHAVIHPE

SEQ ID NO: 745177 - protein, 27 aa, Mycobacterium
VGEFHCAMPWIPLKYRGHFEGSTLITD

SEQ ID NO: 745178 - protein, 27 aa, Mycobacterium
VGEFKKGPFRIAMSVNIPIVPIVIRNA

SEQ ID NO: 745179 - protein, 23 aa, Mycobacterium
VGEGGRAAALWRIRADGAGLAAR

SEQ ID NO: 745180 - protein, 17 aa, Mycobacterium
VGEGLGITVDDVRDLEP

SEQ ID NO: 745181 - protein, 19 aa, Mycobacterium
VGEHGKYLLAATFGNVHGV

SEQ ID NO: 745182 - protein, 17 aa, Mycobacterium
VGEHLSCGPELIRARLT

SEQ ID NO: 745183 - protein, 17 aa, Mycobacterium
VGEIAAYAIAGVMAADD

SEQ ID NO: 745184 - protein, 17 aa, Mycobacterium
VGEIAAYAIAGVMAAND

SEQ ID NO: 745185 - protein, 23 aa, Mycobacterium
VGEIACRPRHPHVMSEGYVDHGM

SEQ ID NO: 745186 - protein, 31 aa, Mycobacterium
VGEICVSGPLLAGGYWKLPDATAETFKDGWL

SEQ ID NO: 745187 - protein, 25 aa, Mycobacterium
VGEICVSGPLLSGGYWNLPEATAET

SEQ ID NO: 745188 - protein, 24 aa, Mycobacterium
VGEICVSGPLLSGGYWNLPEETAK

SEQ ID NO: 745189 - protein, 22 aa, Mycobacterium
VGEIFIRVTLLTGNRPWVREPS

SEQ ID NO: 745190 - protein, 24 aa, Mycobacterium
VGEITCRPRYPHVMSEGYVSQEAP

SEQ ID NO: 745191 - protein, 18 aa, Mycobacterium
VGEITVSTVWPIAKKVVG

SEQ ID NO: 745192 - protein, 17 aa, Mycobacterium
VGELAGLAPNGVKATGT

SEQ ID NO: 745193 - protein, 17 aa, Mycobacterium
VGELCPAQIWQLRQSAA

SEQ ID NO: 745194 - protein, 18 aa, Mycobacterium
VGELGRLDVIVANAGICS

SEQ ID NO: 745195 - protein, 20 aa, Mycobacterium
VGELLAWAGVHPDYTSLAEA

SEQ ID NO: 745196 - protein, 17 aa, Mycobacterium
VGELPWAHVAAGGAALG

SEQ ID NO: 745197 - protein, 21 aa, Mycobacterium
VGELREVIVRVGALAAAENRI

SEQ ID NO: 745198 - protein, 18 aa, Mycobacterium
VGEMRLRALMAHGADTLA

SEQ ID NO: 745199 - protein, 22 aa, Mycobacterium
VGENAWAMPLPEELKDDLKSTV

SEQ ID NO: 745200 - protein, 18 aa, Mycobacterium
VGEPCVFAGQVRSVDGAP

SEQ ID NO: 745201 - protein, 22 aa, Mycobacterium
VGEPGLIVAVWDRRLHAGAQAA

SEQ ID NO: 745202 - protein, 26 aa, Mycobacterium
VGEPPIAFLTGWRLALAADLLRSSQA

SEQ ID NO: 745203 - protein, 20 aa, Mycobacterium
VGEPSWPDAITMVENANKNA

SEQ ID NO: 745204 - protein, 26 aa, Mycobacterium
VGEQIRIGIRMSYWAATARKDLDVLA

SEQ ID NO: 745205 - protein, 22 aa, Mycobacterium
VGEQLRQRFRVVLLDEYQDTGH

SEQ ID NO: 745206 - protein, 19 aa, Mycobacterium
VGERFCARNSGALAVVEGV

SEQ ID NO: 745207 - protein, 20 aa, Mycobacterium
VGERLPEYMVPAAVMVIDAL

SEQ ID NO: 745208 - protein, 17 aa, Mycobacterium
VGERPPLERLLNGPSDD

SEQ ID NO: 745209 - protein, 25 aa, Mycobacterium
VGERRFVLAEARLAAYARELGEEPE

SEQ ID NO: 745210 - protein, 22 aa, Mycobacterium
VGERWTLLIVRELASGPKRYTE

SEQ ID NO: 745211 - protein, 23 aa, Mycobacterium
VGETLRIANEFTEVVVQRVDTRN

SEQ ID NO: 745212 - protein, 20 aa, Mycobacterium
VGEVGLWKLGLSPAQMFEHG

SEQ ID NO: 745213 - protein, 17 aa, Mycobacterium
VGEVVDRFGGLSTLVNN

SEQ ID NO: 745214 - protein, 21 aa, Mycobacterium
VGEYPVYVSIDIDVLDPAFAP

SEQ ID NO: 745215 - protein, 21 aa, Mycobacterium
VGFACQSFAALSLEPPLVLFC

SEQ ID NO: 745216 - protein, 24 aa, Mycobacterium
VGFAGRAALGFGKRLTGKSRDEVQ

SEQ ID NO: 745217 - protein, 19 aa, Mycobacterium
VGFAGRAALGVGKRLAGKS

SEQ ID NO: 745218 - protein, 22 aa, Mycobacterium
VGFAHSYGATGHRLDDPARFRE

SEQ ID NO: 745219 - protein, 20 aa, Mycobacterium
VGFAPVRRGTEQWLIELMEG

SEQ ID NO: 745220 - protein, 19 aa, Mycobacterium
VGFDHPWALGDAGDARANS

SEQ ID NO: 745221 - protein, 23 aa, Mycobacterium
VGFDIPNDFVVGYGLDYDERYRD

SEQ ID NO: 745222 - protein, 24 aa, Mycobacterium
VGFDIPNDFVVGYGLDYDERYRDL

SEQ ID NO: 745223 - protein, 23 aa, Mycobacterium
VGFDISNDFVVGYGLDYDERYRD

SEQ ID NO: 745224 - protein, 17 aa, Mycobacterium
VGFEGSYGWGRDRVTTG

SEQ ID NO: 745225 - protein, 22 aa, Mycobacterium
VGFELIFKRQIIAHARDRDIAV

SEQ ID NO: 745226 - protein, 29 aa, Mycobacterium
VGFESWWRRAESVGFCAHPIQLAGTDEYG

SEQ ID NO: 745227 - protein, 23 aa, Mycobacterium
VGFFKLLQPEQWGGLQCDPTLFY

SEQ ID NO: 745228 - protein, 19 aa, Mycobacterium
VGFGCNLALAADFTVAADD

SEQ ID NO: 745229 - protein, 18 aa, Mycobacterium
VGFGDFPTAAALRPPITV

SEQ ID NO: 745230 - protein, 18 aa, Mycobacterium
VGFGYPWALGDAGDSLAN

SEQ ID NO: 745231 - protein, 23 aa, Mycobacterium
VGFIWEVLGRIGLGRKDALVSLG

SEQ ID NO: 745232 - protein, 24 aa, Mycobacterium
VGFLWEVFGRIGIDRKDAVVSLGG

SEQ ID NO: 745233 - protein, 23 aa, Mycobacterium
VGFLWEVLGRIGIGRKDALVSLG

SEQ ID NO: 745234 - protein, 19 aa, Mycobacterium
VGFMRRFDPEYAELKTLID

SEQ ID NO: 745235 - protein, 17 aa, Mycobacterium
VGFPYRSALVRRRNAEL

SEQ ID NO: 745236 - protein, 20 aa, Mycobacterium
VGFQDGWRGLLENRRIQLQN

SEQ ID NO: 745237 - protein, 20 aa, Mycobacterium
VGFQDGWRGLLENRRMQLRN

SEQ ID NO: 745238 - protein, 20 aa, Mycobacterium
VGFQDGWRGLLENRRVQLHN

SEQ ID NO: 745239 - protein, 24 aa, Mycobacterium
VGFSAPYPSWPILPSAFDDATQYT

SEQ ID NO: 745240 - protein, 17 aa, Mycobacterium
VGFSAWSLRSGDDATLR

SEQ ID NO: 745241 - protein, 17 aa, Mycobacterium
VGFSMALGEHLAYGPQA

SEQ ID NO: 745242 - protein, 24 aa, Mycobacterium
VGFTGSNLFGFGGLNSGTNNTGLF

SEQ ID NO: 745243 - protein, 20 aa, Mycobacterium
VGFVPPKFAKDAMIEAIDAE

SEQ ID NO: 745244 - protein, 20 aa, Mycobacterium
VGGACKNVIALSCGMAAGVG

SEQ ID NO: 745245 - protein, 26 aa, Mycobacterium
VGGAGGAGWDADAVGATGGNGGNSGS

SEQ ID NO: 745246 - protein, 26 aa, Mycobacterium
VGGAGGANNAWLGGAAGSGGTGGSGG

SEQ ID NO: 745247 - protein, 25 aa, Mycobacterium
VGGARGGWKPFLHHISKGTPRSRRV

SEQ ID NO: 745248 - protein, 24 aa, Mycobacterium
VGGARIALIDGTWVAFPTVEQLER

SEQ ID NO: 745249 - protein, 23 aa, Mycobacterium
VGGARRCAAQSWELDRVKSVKDA

SEQ ID NO: 745250 - protein, 24 aa, Mycobacterium
VGGECHYFGCNPSKTLIRPIEVFN

SEQ ID NO: 745251 - protein, 22 aa, Mycobacterium
VGGELKNTFCLTDGSRAYLSAH

SEQ ID NO: 745252 - protein, 17 aa, Mycobacterium
VGGELLVHCCASDPPWE

SEQ ID NO: 745253 - protein, 21 aa, Mycobacterium
VGGFGHLLVLGFDYRENPGPW

SEQ ID NO: 745254 - protein, 17 aa, Mycobacterium
VGGFPNFFMLYGPNTNQ

SEQ ID NO: 745255 - protein, 21 aa, Mycobacterium
VGGGIPWRKQDLFFNAPANGP

SEQ ID NO: 745256 - protein, 18 aa, Mycobacterium
VGGGLKMPGSGGLSGAGS

SEQ ID NO: 745257 - protein, 18 aa, Mycobacterium
VGGGSEFASGTAAENASE

SEQ ID NO: 745258 - protein, 17 aa, Mycobacterium
VGGGSEFASGTGAENAN

SEQ ID NO: 745259 - protein, 26 aa, Mycobacterium
VGGGTGMICHGFKGGIGTASRVTDTA

SEQ ID NO: 745260 - protein, 19 aa, Mycobacterium
VGGGTGWQIAAGGLVRFAA

SEQ ID NO: 745261 - protein, 17 aa, Mycobacterium
VGGGWRVAITTLASERI

SEQ ID NO: 745262 - protein, 20 aa, Mycobacterium
VGGKGGNGGLLMGTGGDGGS

SEQ ID NO: 745263 - protein, 24 aa, Mycobacterium
VGGKVVFRLGEFIEGYGHDLQTGR

SEQ ID NO: 745264 - protein, 26 aa, Mycobacterium
VGGLGFPLSIHFEAPYGLARPAFETF

SEQ ID NO: 745265 - protein, 27 aa, Mycobacterium
VGGLGHLGVQFARAMGFETIAINRGSG

SEQ ID NO: 745266 - protein, 35 aa, Mycobacterium
VGGLGLKKPANWLLAARCLRGLLTMSSQQPDPALT

SEQ ID NO: 745267 - protein, 20 aa, Mycobacterium
VGGLGPAISRLVRGSTALAS

SEQ ID NO: 745268 - protein, 21 aa, Mycobacterium
VGGLGVSVLRAVKSVLDPAGI

SEQ ID NO: 745269 - protein, 18 aa, Mycobacterium
VGGLLPRGELVVIGVTAD

SEQ ID NO: 745270 - protein, 18 aa, Mycobacterium
VGGLPGGISPVVVEVDAL

SEQ ID NO: 745271 - protein, 18 aa, Mycobacterium
VGGLRALLLQSLHPLAMA

SEQ ID NO: 745272 - protein, 23 aa, Mycobacterium
VGGLRGGFEYARTGNPTRSVLES

SEQ ID NO: 745273 - protein, 22 aa, Mycobacterium
VGGLRGGYEYARTGNPTRAALE

SEQ ID NO: 745274 - protein, 22 aa, Mycobacterium
VGGLRGGYEYARTGNPTRTALE

SEQ ID NO: 745275 - protein, 19 aa, Mycobacterium
VGGLRPDFAALQGQPRRRL

SEQ ID NO: 745276 - protein, 20 aa, Mycobacterium
VGGMAADLSAALGKAGGETA

SEQ ID NO: 745277 - protein, 25 aa, Mycobacterium
VGGMGGLGFVVARWLAEQGAGLIVL

SEQ ID NO: 745278 - protein, 25 aa, Mycobacterium
VGGMGGLGFVVARWLAEQGAGLVVL

SEQ ID NO: 745279 - protein, 32 aa, Mycobacterium
VGGMSSAGCWGSFITCDARLATTLPPGLTDRQ

SEQ ID NO: 745280 - protein, 22 aa, Mycobacterium
VGGMTPTGAWRSFVVVDANLAA

SEQ ID NO: 745281 - protein, 26 aa, Mycobacterium
VGGNCPLWVIHQAFARPGRFLTQVAQ

SEQ ID NO: 745282 - protein, 24 aa, Mycobacterium
VGGNCPLWVVHEAFSNPGQFVTQV

SEQ ID NO: 745283 - protein, 24 aa, Mycobacterium
VGGNCPLWVVHHAFARPGQFLTQV

SEQ ID NO: 745284 - protein, 25 aa, Mycobacterium
VGGNCPLWVVHHAFSRPGQFLTQVA

SEQ ID NO: 745285 - protein, 24 aa, Mycobacterium
VGGNCPLWVVHQAFAQPGQFVTQV

SEQ ID NO: 745286 - protein, 26 aa, Mycobacterium
VGGNGGNASAVFGFGGNGGASGTGGA

SEQ ID NO: 745287 - protein, 29 aa, Mycobacterium
VGGNGGNGGRLLGLGGAGGDAGNGGVGGT

SEQ ID NO: 745288 - protein, 32 aa, Mycobacterium
VGGNSAVVILWDWTGEGLDTFRGVPTEGKTLS

SEQ ID NO: 745289 - protein, 25 aa, Mycobacterium
VGGPADRAGLLAGDIIVMLDGTPLD

SEQ ID NO: 745290 - protein, 21 aa, Mycobacterium
VGGPDPVFGCLAGINGEPCRP

SEQ ID NO: 745291 - protein, 18 aa, Mycobacterium
VGGPFEGATLLLLHTTGA

SEQ ID NO: 745292 - protein, 18 aa, Mycobacterium
VGGPFENGTLLLLHTTGA

SEQ ID NO: 745293 - protein, 18 aa, Mycobacterium
VGGPFGRGSSRWDPLNGK

SEQ ID NO: 745294 - protein, 17 aa, Mycobacterium
VGGPGVLTNADFRTRIN

SEQ ID NO: 745295 - protein, 33 aa, Mycobacterium
VGGPKPAGVPFLWRWQDVHAKLLKSCDVMPESL

SEQ ID NO: 745296 - protein, 34 aa, Mycobacterium
VGGPKPAGVPFLWRWQDVHAKLLKSCDVMPESLT

SEQ ID NO: 745297 - protein, 27 aa, Mycobacterium
VGGPQSAWRPAGCSRPRPSGASTCGYR

SEQ ID NO: 745298 - protein, 27 aa, Mycobacterium
VGGQSTWRLGGAFNCGKAQPGQVAAVS

SEQ ID NO: 745299 - protein, 24 aa, Mycobacterium
VGGRAVRGFPGFIDAGGAVDLRVF

SEQ ID NO: 745300 - protein, 18 aa, Mycobacterium
VGGRLAAEGDDASAESSA

SEQ ID NO: 745301 - protein, 21 aa, Mycobacterium
VGGRRAILDWHHPELERLIEV

SEQ ID NO: 745302 - protein, 18 aa, Mycobacterium
VGGSAGSYGRLIVTPDME

SEQ ID NO: 745303 - protein, 25 aa, Mycobacterium
VGGSEVLDWLVTRNALARSAYQLGV

SEQ ID NO: 745304 - protein, 19 aa, Mycobacterium
VGGSFGLKMTGQVEEPLVC

SEQ ID NO: 745305 - protein, 20 aa, Mycobacterium
VGGSGGWLVGDGGTGGDGGQ

SEQ ID NO: 745306 - protein, 24 aa, Mycobacterium
VGGSIPFIAEFAAAFPEAKILVTG

SEQ ID NO: 745307 - protein, 17 aa, Mycobacterium
VGGSRIALSRGLQPNRF

SEQ ID NO: 745308 - protein, 20 aa, Mycobacterium
VGGTAWDFANATKFERECLD

SEQ ID NO: 745309 - protein, 17 aa, Mycobacterium
VGGTCVNSGCIPTKTLV

SEQ ID NO: 745310 - protein, 19 aa, Mycobacterium
VGGTETWQAPTTAFASAPF

SEQ ID NO: 745311 - protein, 26 aa, Mycobacterium
VGGTGGLISFLGGHGTGGAGGEGGSG

SEQ ID NO: 745312 - protein, 20 aa, Mycobacterium
VGGTVGRYSPFAVYLPGGDP

SEQ ID NO: 745313 - protein, 20 aa, Mycobacterium
VGGTVGRYSPYAVYLPGGDP

SEQ ID NO: 745314 - protein, 34 aa, Mycobacterium
VGGVFRILLCLAEARPFVLLPKFELHSWAEAVRE

SEQ ID NO: 745315 - protein, 19 aa, Mycobacterium
VGGVGWDPSGEWSEELLDH

SEQ ID NO: 745316 - protein, 17 aa, Mycobacterium
VGGVKVKLMAKVQPADE

SEQ ID NO: 745317 - protein, 26 aa, Mycobacterium
VGGVMVRFVVCRKGERHVIAVRDGDM

SEQ ID NO: 745318 - protein, 20 aa, Mycobacterium
VGGVPLFCVHPAGGVSWPYQ

SEQ ID NO: 745319 - protein, 23 aa, Mycobacterium
VGGVPTLLWKLIGEIRPGDHVVL

SEQ ID NO: 745320 - protein, 19 aa, Mycobacterium
VGGVTIEIAQPLGDARLPA

SEQ ID NO: 745321 - protein, 23 aa, Mycobacterium
VGGVVLAGFGFRTDRRAHDEVAG

SEQ ID NO: 745322 - protein, 23 aa, Mycobacterium
VGGWQCRPTDEFGYLACAAAVQE

SEQ ID NO: 745323 - protein, 27 aa, Mycobacterium
VGGWTAACDGGFIARDLGVPVVVLGPG

SEQ ID NO: 745324 - protein, 24 aa, Mycobacterium
VGGYRRIELRSGDIVFRQGEPASH

SEQ ID NO: 745325 - protein, 17 aa, Mycobacterium
VGHAARAALHLAEDHPL

SEQ ID NO: 745326 - protein, 18 aa, Mycobacterium
VGHAIGYLHHEACEQQGA

SEQ ID NO: 745327 - protein, 25 aa, Mycobacterium
VGHASRITAPKGWELVRHAGPLPTH

SEQ ID NO: 745328 - protein, 20 aa, Mycobacterium
VGHGTMRWITVGPPNQPGTS

SEQ ID NO: 745329 - protein, 17 aa, Mycobacterium
VGHHLPQVFGRLNAAGE

SEQ ID NO: 745330 - protein, 24 aa, Mycobacterium
VGHIPFTVAVASSFDETVRGAQAN

SEQ ID NO: 745331 - protein, 25 aa, Mycobacterium
VGHKGARLTTQISLAGRYLVYVPGA

SEQ ID NO: 745332 - protein, 23 aa, Mycobacterium
VGHPFIDIWEAVKPARLGMKAWP

SEQ ID NO: 745333 - protein, 25 aa, Mycobacterium
VGHPILYVAQAWDWIFPLGDNPDYE

SEQ ID NO: 745334 - protein, 23 aa, Mycobacterium
VGHPRLYARITLVVRDGRIEQVF

SEQ ID NO: 745335 - protein, 18 aa, Mycobacterium
VGHPRYGDDDGWEQKLEV

SEQ ID NO: 745336 - protein, 18 aa, Mycobacterium
VGHQCGGAPGAAREVCAQ

SEQ ID NO: 745337 - protein, 17 aa, Mycobacterium
VGHSLDPKADYGPLVTE

SEQ ID NO: 745338 - protein, 35 aa, Mycobacterium
VGHSLGGGVAMQFAYQFPQFVDRLILVGAGGVTKD

SEQ ID NO: 745339 - protein, 18 aa, Mycobacterium
VGHSSDWGIDPARIVLLG

SEQ ID NO: 745340 - protein, 17 aa, Mycobacterium
VGHSYIKAMMADTGAIF

SEQ ID NO: 745341 - protein, 22 aa, Mycobacterium
VGHVLRRGHSLVHCDVDVHTPD

SEQ ID NO: 745342 - protein, 27 aa, Mycobacterium
VGIAAWRLGAGRSRPGEAVQHGAGVRI

SEQ ID NO: 745343 - protein, 19 aa, Mycobacterium
VGIAGGREKCRAVVENFGF

SEQ ID NO: 745344 - protein, 18 aa, Mycobacterium
VGIAGIRSGGVAAVRLAT

SEQ ID NO: 745345 - protein, 17 aa, Mycobacterium
VGIALALIDTAAGIADG

SEQ ID NO: 745346 - protein, 17 aa, Mycobacterium
VGIALALIDTEYDIADG

SEQ ID NO: 745347 - protein, 17 aa, Mycobacterium
VGIALAVRKECLRRRGL

SEQ ID NO: 745348 - protein, 17 aa, Mycobacterium
VGIAPSITTASLRAVVS

SEQ ID NO: 745349 - protein, 18 aa, Mycobacterium
VGIAPSITTASLRAVVSA

SEQ ID NO: 745350 - protein, 20 aa, Mycobacterium
VGIDEARLGLILEVAAAAGL

SEQ ID NO: 745351 - protein, 28 aa, Mycobacterium
VGIDLRDDWPSALRAAGFDAARPTAWLA

SEQ ID NO: 745352 - protein, 33 aa, Mycobacterium
VGIDLRQDWLAALWRVGFDADQPTAWIAENLLV

SEQ ID NO: 745353 - protein, 26 aa, Mycobacterium
VGIDNWRWAGVPIYLRTGKRMAEGQR

SEQ ID NO: 745354 - protein, 19 aa, Mycobacterium
VGIELSALVARLDPHGRSD

SEQ ID NO: 745355 - protein, 18 aa, Mycobacterium
VGIGAVFTSWNSPRAKAY

SEQ ID NO: 745356 - protein, 17 aa, Mycobacterium
VGIGDIPPADVLTEAAA

SEQ ID NO: 745357 - protein, 18 aa, Mycobacterium
VGIGELKFFSKIHYGGGA

SEQ ID NO: 745358 - protein, 18 aa, Mycobacterium
VGIGRRRWSGAFKQSLRD

SEQ ID NO: 745359 - protein, 24 aa, Mycobacterium
VGIKGPRILLCTQGDVTLDGSGAG

SEQ ID NO: 745360 - protein, 17 aa, Mycobacterium
VGILADLQGPKIRLGRF

SEQ ID NO: 745361 - protein, 23 aa, Mycobacterium
VGILDALGIKWAVVVGDREGAEL

SEQ ID NO: 745362 - protein, 20 aa, Mycobacterium
VGILHGCLRHHTPYSEHKAW

SEQ ID NO: 745363 - protein, 18 aa, Mycobacterium
VGILPGGGMTARLPQLVG

SEQ ID NO: 745364 - protein, 18 aa, Mycobacterium
VGILPTPAVAYLTSAYDA

SEQ ID NO: 745365 - protein, 25 aa, Mycobacterium
VGIMKASAGFFPLDPGYPAARKQLM

SEQ ID NO: 745366 - protein, 19 aa, Mycobacterium
VGINFLPMRLTLDLAGSPA

SEQ ID NO: 745367 - protein, 27 aa, Mycobacterium
VGIPELRPRIAEHFSRRGLPTTEDQIM

SEQ ID NO: 745368 - protein, 24 aa, Mycobacterium
VGIPGHLRVTIGLAAENDAFLAAG

SEQ ID NO: 745369 - protein, 18 aa, Mycobacterium
VGIREFVDDGAIDPDHAS

SEQ ID NO: 745370 - protein, 25 aa, Mycobacterium
VGIRRGEGGLVFTSMSVVLDAEDSI

SEQ ID NO: 745371 - protein, 20 aa, Mycobacterium
VGITALCDWIDTNRPLLVIH

SEQ ID NO: 745372 - protein, 17 aa, Mycobacterium
VGITPEGSWVLTEGRPE

SEQ ID NO: 745373 - protein, 26 aa, Mycobacterium
VGITRARVHLALSWALARAPGGRQSR

SEQ ID NO: 745374 - protein, 22 aa, Mycobacterium
VGITRMRPGFIGQRDAAMGLRR

SEQ ID NO: 745375 - protein, 23 aa, Mycobacterium
VGITRMRPGFILQRDAALGLRRY

SEQ ID NO: 745376 - protein, 29 aa, Mycobacterium
VGIVNNGAFTPALYGFGGNGGNGVNGGTG

SEQ ID NO: 745377 - protein, 17 aa, Mycobacterium
VGIWRRAPLQALARLHM

SEQ ID NO: 745378 - protein, 18 aa, Mycobacterium
VGKALHLAPGTVRTYLQR

SEQ ID NO: 745379 - protein, 20 aa, Mycobacterium
VGKARAAGLLTVQAPESYGG

SEQ ID NO: 745380 - protein, 26 aa, Mycobacterium
VGKARRRVVTIFDMIHELFKPPMAKL

SEQ ID NO: 745381 - protein, 19 aa, Mycobacterium
VGKDFCAGSDWVATNSGGG

SEQ ID NO: 745382 - protein, 18 aa, Mycobacterium
VGKFPFETVRTMARIVSA

SEQ ID NO: 745383 - protein, 24 aa, Mycobacterium
VGKFTNLPALLALSSVYTDVVTRD

SEQ ID NO: 745384 - protein, 19 aa, Mycobacterium
VGKGEMRWITVGPPNQPDT

SEQ ID NO: 745385 - protein, 20 aa, Mycobacterium
VGKGKMRWVTVGPPHQPDTS

SEQ ID NO: 745386 - protein, 34 aa, Mycobacterium
VGKGTRVGILFPNCAQWLIAWLAAARIGALTVPL

SEQ ID NO: 745387 - protein, 18 aa, Mycobacterium
VGKGWPTVERRLDMLAEA

SEQ ID NO: 745388 - protein, 18 aa, Mycobacterium
VGKHFSVNVMLDRDTIRR

SEQ ID NO: 745389 - protein, 30 aa, Mycobacterium
VGKIRLPIGQGISGWVADHCEPVVISHDKE

SEQ ID NO: 745390 - protein, 26 aa, Mycobacterium
VGKIRLPLGQGISGWVASHRQPVVIR

SEQ ID NO: 745391 - protein, 24 aa, Mycobacterium
VGKLHVRGPMMFDGYLNRPDATAE

SEQ ID NO: 745392 - protein, 17 aa, Mycobacterium
VGKLIALTNPISGHGTA

SEQ ID NO: 745393 - protein, 26 aa, Mycobacterium
VGKLMAGALPDHWTAHTLRHRFATRA

SEQ ID NO: 745394 - protein, 25 aa, Mycobacterium
VGKLRSGQTLIGFLAPRNADNSIGA

SEQ ID NO: 745395 - protein, 21 aa, Mycobacterium
VGKPSAPYAQAVREWENLEQF

SEQ ID NO: 745396 - protein, 24 aa, Mycobacterium
VGKPVAGCPVRIFDKHDRPVGPRV

SEQ ID NO: 745397 - protein, 17 aa, Mycobacterium
VGKQFGFSSPTAESKGW

SEQ ID NO: 745398 - protein, 18 aa, Mycobacterium
VGKTRLALEVATRVADEF

SEQ ID NO: 745399 - protein, 23 aa, Mycobacterium
VGKTTTPEFAWKGVTDSRQRGIT

SEQ ID NO: 745400 - protein, 19 aa, Mycobacterium
VGKVRRVRLLPSDPPATPQ

SEQ ID NO: 745401 - protein, 22 aa, Mycobacterium
VGKYPLLAVRTMSRIICAVEEN

SEQ ID NO: 745402 - protein, 23 aa, Mycobacterium
VGLAAALRRLLAQRFQCESMGAA

SEQ ID NO: 745403 - protein, 22 aa, Mycobacterium
VGLAALMLSRFDIVLLDEPTND

SEQ ID NO: 745404 - protein, 26 aa, Mycobacterium
VGLAAQRFGEFNGFWRDDGFQAATGV

SEQ ID NO: 745405 - protein, 25 aa, Mycobacterium
VGLAAQRYGEFNGFWRDDGFQPATG

SEQ ID NO: 745406 - protein, 26 aa, Mycobacterium
VGLAAWRLGAGRSRPGARVQHGAGIR

SEQ ID NO: 745407 - protein, 26 aa, Mycobacterium
VGLAAWRLGAGRSRPGARVQHGAGVR

SEQ ID NO: 745408 - protein, 17 aa, Mycobacterium
VGLACDLIYAADTAFFL

SEQ ID NO: 745409 - protein, 24 aa, Mycobacterium
VGLADTLCGYGCLASLPEGASGFT

SEQ ID NO: 745410 - protein, 17 aa, Mycobacterium
VGLAESIRRAGGGKSGK

SEQ ID NO: 745411 - protein, 19 aa, Mycobacterium
VGLAESLALAGAVDDVIRT

SEQ ID NO: 745412 - protein, 22 aa, Mycobacterium
VGLAHAIQAGWVSRAEVIEAAI

SEQ ID NO: 745413 - protein, 27 aa, Mycobacterium
VGLAMARFTAAGIRKTWVFQAFDDEHE

SEQ ID NO: 745414 - protein, 20 aa, Mycobacterium
VGLARALFRSPELLLLDEPF

SEQ ID NO: 745415 - protein, 18 aa, Mycobacterium
VGLARARRMLLLGEKVAG

SEQ ID NO: 745416 - protein, 17 aa, Mycobacterium
VGLARARRMLLLGEKVS

SEQ ID NO: 745417 - protein, 21 aa, Mycobacterium
VGLAVVRWLVDHGAGRLVLNG

SEQ ID NO: 745418 - protein, 25 aa, Mycobacterium
VGLDCSGLTQWAYREAGLDIPRLAQ

SEQ ID NO: 745419 - protein, 25 aa, Mycobacterium
VGLDCSGLTQWAYREAGLNIPRLAQ

SEQ ID NO: 745420 - protein, 21 aa, Mycobacterium
VGLDPVLRADLWDQFAELARA

SEQ ID NO: 745421 - protein, 18 aa, Mycobacterium
VGLDSGKWTKEQMAQVAL

SEQ ID NO: 745422 - protein, 23 aa, Mycobacterium
VGLGAVLNFPSTVLTAPGTNGVT

SEQ ID NO: 745423 - protein, 19 aa, Mycobacterium
VGLGCNLALAADFTVATPE

SEQ ID NO: 745424 - protein, 20 aa, Mycobacterium
VGLGCSIALLSDFLVMGENS

SEQ ID NO: 745425 - protein, 23 aa, Mycobacterium
VGLGCSLAALSDVVYIAENAFFA

SEQ ID NO: 745426 - protein, 19 aa, Mycobacterium
VGLGFPLSIHFEATYGVSP

SEQ ID NO: 745427 - protein, 24 aa, Mycobacterium
VGLGGIGRVIARKLAALGVTVVGT

SEQ ID NO: 745428 - protein, 25 aa, Mycobacterium
VGLGLPQLLALNALGAPVNAGLAAG

SEQ ID NO: 745429 - protein, 20 aa, Mycobacterium
VGLGSVRFLMSVGDLIIGWL

SEQ ID NO: 745430 - protein, 20 aa, Mycobacterium
VGLGSVRFLMSVGDLVIAWL

SEQ ID NO: 745431 - protein, 20 aa, Mycobacterium
VGLGSVRFLMSVGDLVIGWL

SEQ ID NO: 745432 - protein, 27 aa, Mycobacterium
VGLGYVRRAGLTGSRFVACPFGAPGAR

SEQ ID NO: 745433 - protein, 25 aa, Mycobacterium
VGLHARPAAIIAEAVVNAGVPVSLS

SEQ ID NO: 745434 - protein, 23 aa, Mycobacterium
VGLHLRPGAIFDLTGTEASTWTG

SEQ ID NO: 745435 - protein, 17 aa, Mycobacterium
VGLHVRHYIPFASTFAA

SEQ ID NO: 745436 - protein, 20 aa, Mycobacterium
VGLIPSYRSSGVNGRSAVGG

SEQ ID NO: 745437 - protein, 22 aa, Mycobacterium
VGLIRTALFNWAYARHTGGDFV

SEQ ID NO: 745438 - protein, 25 aa, Mycobacterium
VGLLDEMKERWRADLLADGRDAESV

SEQ ID NO: 745439 - protein, 18 aa, Mycobacterium
VGLLICYDVEFPENVRAL

SEQ ID NO: 745440 - protein, 25 aa, Mycobacterium
VGLLRSCALAMLKRHPNLRARFLGR

SEQ ID NO: 745441 - protein, 26 aa, Mycobacterium
VGLMLRNRPEFHLADTAAMHLGAIPF

SEQ ID NO: 745442 - protein, 21 aa, Mycobacterium
VGLNFGGGWAQRRAIATENLA

SEQ ID NO: 745443 - protein, 23 aa, Mycobacterium
VGLNIPTGIPLRYDLDENLKPVT

SEQ ID NO: 745444 - protein, 17 aa, Mycobacterium
VGLPGPPRRILGPFAGV

SEQ ID NO: 745445 - protein, 24 aa, Mycobacterium
VGLPTGLLLRGRRPPDTATRSRLE

SEQ ID NO: 745446 - protein, 20 aa, Mycobacterium
VGLPTPRLVVEPGRAIAGPG

SEQ ID NO: 745447 - protein, 19 aa, Mycobacterium
VGLPVTFTLAVGNAGDPFF

SEQ ID NO: 745448 - protein, 20 aa, Mycobacterium
VGLQPARWGTGYILGTNRWG

SEQ ID NO: 745449 - protein, 24 aa, Mycobacterium
VGLQRAVADHHQLASNFASPFSPQ

SEQ ID NO: 745450 - protein, 18 aa, Mycobacterium
VGLRAGYQRSIVRAAAPG

SEQ ID NO: 745451 - protein, 25 aa, Mycobacterium
VGLRDALAALEWVRDNVAAFGGDPH

SEQ ID NO: 745452 - protein, 25 aa, Mycobacterium
VGLRDVLAALHWVRENIAAFGGDPA

SEQ ID NO: 745453 - protein, 25 aa, Mycobacterium
VGLRDVLAALSWVRDNIAAFGGDPR

SEQ ID NO: 745454 - protein, 23 aa, Mycobacterium
VGLRIVVELKRDAVAKVVLNNLY

SEQ ID NO: 745455 - protein, 17 aa, Mycobacterium
VGLRPGPQHAPTVDDVV

SEQ ID NO: 745456 - protein, 19 aa, Mycobacterium
VGLRPVRQFAEDPVAVVQG

SEQ ID NO: 745457 - protein, 22 aa, Mycobacterium
VGLRSSYVATVYAAPLMLPLGK

SEQ ID NO: 745458 - protein, 17 aa, Mycobacterium
VGLSTAVALPVEHDPIT

SEQ ID NO: 745459 - protein, 17 aa, Mycobacterium
VGLTGNNKFGFGGLNSG

SEQ ID NO: 745460 - protein, 31 aa, Mycobacterium
VGLTVCYDIRFPALYTELARRGAQLIAVCAS

SEQ ID NO: 745461 - protein, 23 aa, Mycobacterium
VGLVGPRARNMWVSTFHSTCVRI

SEQ ID NO: 745462 - protein, 19 aa, Mycobacterium
VGLVHPRSGLAARVGLSIV

SEQ ID NO: 745463 - protein, 19 aa, Mycobacterium
VGLVTCRFTHVYPDGPAPY

SEQ ID NO: 745464 - protein, 18 aa, Mycobacterium
VGLWLPAATMARLAADRA

SEQ ID NO: 745465 - protein, 17 aa, Mycobacterium
VGLWTFRVDGWGDPIHS

SEQ ID NO: 745466 - protein, 27 aa, Mycobacterium
VGLYCRNRIEIVIAMLGIIKAGAILIN

SEQ ID NO: 745467 - protein, 18 aa, Mycobacterium
VGLYGAGLERIMLLAQEG

SEQ ID NO: 745468 - protein, 23 aa, Mycobacterium
VGLYGAGLERIMRLLSQPGLDPD

SEQ ID NO: 745469 - protein, 24 aa, Mycobacterium
VGMAGRAALGFGKRLTGKSKDEVN

SEQ ID NO: 745470 - protein, 24 aa, Mycobacterium
VGMAGRAALGFGKRLTGKSKDEVT

SEQ ID NO: 745471 - protein, 17 aa, Mycobacterium
VGMAPWLGDRVQKLTSF

SEQ ID NO: 745472 - protein, 17 aa, Mycobacterium
VGMAYALARTSRLKVGT

SEQ ID NO: 745473 - protein, 17 aa, Mycobacterium
VGMFPGVVPTGWVPIGR

SEQ ID NO: 745474 - protein, 17 aa, Mycobacterium
VGMGYAIAAAVEGSGPV

SEQ ID NO: 745475 - protein, 23 aa, Mycobacterium
VGMMLRDRFVRMAVTDPGSPLHG

SEQ ID NO: 745476 - protein, 22 aa, Mycobacterium
VGMPVEIAPAIQAVWMRGASLT

SEQ ID NO: 745477 - protein, 28 aa, Mycobacterium
VGMPYVNQRWLGGMLTNFSTVHKRLQRL

SEQ ID NO: 745478 - protein, 21 aa, Mycobacterium
VGMQILFDSGIEFGVQTTGCG

SEQ ID NO: 745479 - protein, 18 aa, Mycobacterium
VGMRLVGMPLEYRSPDRQ

SEQ ID NO: 745480 - protein, 17 aa, Mycobacterium
VGMSGLLVKSTVVMKEN

SEQ ID NO: 745481 - protein, 19 aa, Mycobacterium
VGMSLPFAPLCQPDCPGLC

SEQ ID NO: 745482 - protein, 26 aa, Mycobacterium
VGMSPEEWRAFAGRASLYAARTKAKE

SEQ ID NO: 745483 - protein, 18 aa, Mycobacterium
VGMSQPWDFVLVRSPETL

SEQ ID NO: 745484 - protein, 23 aa, Mycobacterium
VGMSVDCARYWLDSDRPISKSDA

SEQ ID NO: 745485 - protein, 18 aa, Mycobacterium
VGMTGVLVRTGKFRQDTL

SEQ ID NO: 745486 - protein, 19 aa, Mycobacterium
VGMYPWLPANMGNWHTIGI

SEQ ID NO: 745487 - protein, 23 aa, Mycobacterium
VGNAGNITAYWKGYTEYHRDGLA

SEQ ID NO: 745488 - protein, 23 aa, Mycobacterium
VGNELRSGLPVAGIFATDLSAFD

SEQ ID NO: 745489 - protein, 17 aa, Mycobacterium
VGNFLAEITEWGWDDAP

SEQ ID NO: 745490 - protein, 18 aa, Mycobacterium
VGNFPGLWTEWNGKYRDT

SEQ ID NO: 745491 - protein, 35 aa, Mycobacterium
VGNGLRPAIWDEFIERFGISRVCEFYAASEGNTAF

SEQ ID NO: 745492 - protein, 36 aa, Mycobacterium
VGNGLRPELWGEFTARFGIKRVCEFYSASESNTAFV

SEQ ID NO: 745493 - protein, 17 aa, Mycobacterium
VGNGPSFRVENRIPGAD

SEQ ID NO: 745494 - protein, 20 aa, Mycobacterium
VGNIHPLWTYAHVPNGYTGD

SEQ ID NO: 745495 - protein, 23 aa, Mycobacterium
VGNLARIGSSIGVANAAAAAATT

SEQ ID NO: 745496 - protein, 19 aa, Mycobacterium
VGNLARIRSSIGVANAAAA

SEQ ID NO: 745497 - protein, 22 aa, Mycobacterium
VGNLVCPALFDLGETSKVVVIS

SEQ ID NO: 745498 - protein, 26 aa, Mycobacterium
VGNLVCPALFDLGEYQKVVVISVTEG

SEQ ID NO: 745499 - protein, 31 aa, Mycobacterium
VGNNFPVFFIQDGIKFPDFVHAVKPEPDNEI

SEQ ID NO: 745500 - protein, 32 aa, Mycobacterium; identical to SEQ ID NO: 105953

SEQ ID NO: 745501 - protein, 29 aa, Mycobacterium
VGNNFPVFFIQDGIKFPDLVHAVKPEPHN

SEQ ID NO: 745502 - protein, 26 aa, Mycobacterium
VGNNMPVFFIQDGIKFPDVVHAAKPH

SEQ ID NO: 745503 - protein, 17 aa, Mycobacterium
VGNPIRVSGYRPEYRPA

SEQ ID NO: 745504 - protein, 23 aa, Mycobacterium
VGNPPLIVTINFLGLRHLTEALI

SEQ ID NO: 745505 - protein, 17 aa, Mycobacterium
VGNRPGLVMRPLPESWA

SEQ ID NO: 745506 - protein, 21 aa, Mycobacterium
VGNTDGVPWDMRVAANRTNIA

SEQ ID NO: 745507 - protein, 22 aa, Mycobacterium
VGNTEWPKWETVMSPDPVDPAE

SEQ ID NO: 745508 - protein, 21 aa, Mycobacterium
VGPAGPSWRKGRYHVSGRGPR

SEQ ID NO: 745509 - protein, 18 aa, Mycobacterium
VGPAGRPDMNIVLTPPAA

SEQ ID NO: 745510 - protein, 23 aa, Mycobacterium
VGPALRTSLSWVADRASRPVNLP

SEQ ID NO: 745511 - protein, 19 aa, Mycobacterium
VGPAQQIGKVWAGNLDVND

SEQ ID NO: 745512 - protein, 18 aa, Mycobacterium
VGPARAYLESAVWRPNLA

SEQ ID NO: 745513 - protein, 25 aa, Mycobacterium
VGPATRASCDIDYLFAQVDVESMRV

SEQ ID NO: 745514 - protein, 18 aa, Mycobacterium
VGPDGFAYGVDMTDEMLA

SEQ ID NO: 745515 - protein, 20 aa, Mycobacterium
VGPDQAFELLQWRSQQTNTK

SEQ ID NO: 745516 - protein, 24 aa, Mycobacterium
VGPEAVVGLAIRRSIELVVGMYAV

SEQ ID NO: 745517 - protein, 19 aa, Mycobacterium
VGPEDRWRQIVGAQSDFAG

SEQ ID NO: 745518 - protein, 17 aa, Mycobacterium
VGPENPYGLSLRQRNTP

SEQ ID NO: 745519 - protein, 28 aa, Mycobacterium
VGPFKKGPFRLAMAAGIPIVPIVIRNAE

SEQ ID NO: 745520 - protein, 31 aa, Mycobacterium
VGPFVGHVELFWTVPEFKSFFDQLASFCRVA

SEQ ID NO: 745521 - protein, 21 aa, Mycobacterium
VGPGCADYAAANPSGPASVEG

SEQ ID NO: 745522 - protein, 31 aa, Mycobacterium
VGPGGCVAVMFPRCADAIVAMLAVLKTGAAY

SEQ ID NO: 745523 - protein, 25 aa, Mycobacterium
VGPGIYSWLPLGLRVLRKIENVVRS

SEQ ID NO: 745524 - protein, 21 aa, Mycobacterium
VGPGLIYRLEERFGVRSPEVA

SEQ ID NO: 745525 - protein, 22 aa, Mycobacterium
VGPGLYSWLPLGLKVLRKIEHI

SEQ ID NO: 745526 - protein, 24 aa, Mycobacterium
VGPGRIAGNVARDFPLTPRAELAA

SEQ ID NO: 745527 - protein, 17 aa, Mycobacterium
VGPIPLGHHLFGVRYAR

SEQ ID NO: 745528 - protein, 28 aa, Mycobacterium
VGPIRLSFLDIPAAPGFGNSTTNPSSGF

SEQ ID NO: 745529 - protein, 17 aa, Mycobacterium
VGPITALVNGAGVLRTG

SEQ ID NO: 745530 - protein, 17 aa, Mycobacterium
VGPKEAPELAANANPHG

SEQ ID NO: 745531 - protein, 19 aa, Mycobacterium
VGPKLEWVRRHEPEVFERA

SEQ ID NO: 745532 - protein, 17 aa, Mycobacterium
VGPLAGRSAVVVGAGSM

SEQ ID NO: 745533 - protein, 17 aa, Mycobacterium
VGPLLPKLENILVATGF

SEQ ID NO: 745534 - protein, 20 aa, Mycobacterium
VGPLMPSLVRKLADDYDARR

SEQ ID NO: 745535 - protein, 24 aa, Mycobacterium
VGPLPKVSPAVIGVWNEEHVEYQN

SEQ ID NO: 745536 - protein, 21 aa, Mycobacterium
VGPMARTVRDLALAYELLAGP

SEQ ID NO: 745537 - protein, 23 aa, Mycobacterium
VGPNPRAAYQVALPDTTFVEHIK

SEQ ID NO: 745538 - protein, 23 aa, Mycobacterium
VGPNPRAGYQVRLPDAPFTEHIK

SEQ ID NO: 745539 - protein, 23 aa, Mycobacterium
VGPPELYAWLHYDPIPDRDDLAK

SEQ ID NO: 745540 - protein, 22 aa, Mycobacterium
VGPPELYAWLHYDPIPTRDDLA

SEQ ID NO: 745541 - protein, 23 aa, Mycobacterium
VGPPELYAWLHYDPVPTRDDLAK

SEQ ID NO: 745542 - protein, 17 aa, Mycobacterium
VGPPPFTGYVDRLVDFM

SEQ ID NO: 745543 - protein, 22 aa, Mycobacterium
VGPQLPKFFGAVTDLIEQLIPL

SEQ ID NO: 745544 - protein, 26 aa, Mycobacterium
VGPQVARAALLFGMRFDADSAVRHGV

SEQ ID NO: 745545 - protein, 25 aa, Mycobacterium
VGPRFEQWGRLVVPYAPADATRAAT

SEQ ID NO: 745546 - protein, 23 aa, Mycobacterium
VGPRGFVKERLAAYAESGVTTLL

SEQ ID NO: 745547 - protein, 18 aa, Mycobacterium
VGPRLAMATLSVHDANGL

SEQ ID NO: 745548 - protein, 21 aa, Mycobacterium
VGPRTEEWGRLIIPHTPAAPA

SEQ ID NO: 745549 - protein, 18 aa, Mycobacterium
VGPTEMFGELSIFDPEPR

SEQ ID NO: 745550 - protein, 18 aa, Mycobacterium
VGPTGFAYGVDMTDEMLA

SEQ ID NO: 745551 - protein, 25 aa, Mycobacterium
VGPTIASAVSEWFTVDWHREIVEKW

SEQ ID NO: 745552 - protein, 24 aa, Mycobacterium
VGPVAATPIMRWLHSVDGPVEEFN

SEQ ID NO: 745553 - protein, 26 aa, Mycobacterium
VGPVAATPIMRWLRDVAGPVDQFNQA

SEQ ID NO: 745554 - protein, 17 aa, Mycobacterium
VGPWLPEPVRVAYDDSD

SEQ ID NO: 745555 - protein, 23 aa, Mycobacterium
VGPYPRPGGVDADLINAGKETVT

SEQ ID NO: 745556 - protein, 17 aa, Mycobacterium
VGPYTRYGLPLVAACAA

SEQ ID NO: 745557 - protein, 25 aa, Mycobacterium
VGQAAWRLGAGRSRPGERVQAGAGI

SEQ ID NO: 745558 - protein, 20 aa, Mycobacterium
VGQARRLRVAGAGLIQAWLA

SEQ ID NO: 745559 - protein, 19 aa, Mycobacterium
VGQDLGDLLGLGRQLGVAV

SEQ ID NO: 745560 - protein, 17 aa, Mycobacterium
VGQFDFRAPAVIVTSGG

SEQ ID NO: 745561 - protein, 30 aa, Mycobacterium
VGQIIPWNFPILMGAWKLAPALAAGNAVVL

SEQ ID NO: 745562 - protein, 32 aa, Mycobacterium
VGQIIPWNFPILMGAWKLAPALAAGNAVVLKP

SEQ ID NO: 745563 - protein, 29 aa, Mycobacterium
VGQIIPWNFPLLMAVWKLAPALAAGNCVV

SEQ ID NO: 745564 - protein, 24 aa, Mycobacterium
VGQKRFSLEGAEGVIPMMDAVIDQ

SEQ ID NO: 745565 - protein, 23 aa, Mycobacterium
VGQKRFSLEGAESIIPMMDAAID

SEQ ID NO: 745566 - protein, 17 aa, Mycobacterium
VGQKRFSLEGAESVIPM

SEQ ID NO: 745567 - protein, 23 aa, Mycobacterium
VGQKRFSLEGAETVIPMMDAVID

SEQ ID NO: 745568 - protein, 17 aa, Mycobacterium
VGQLACYEHFNALARYA

SEQ ID NO: 745569 - protein, 23 aa, Mycobacterium
VGQLGRRCLPMVVDVRDAAQVNT

SEQ ID NO: 745570 - protein, 25 aa, Mycobacterium
VGQLHPRLGQGRMRVVGAGRQGREH

SEQ ID NO: 745571 - protein, 17 aa, Mycobacterium
VGQLIAERAKAAGIDTV

SEQ ID NO: 745572 - protein, 17 aa, Mycobacterium
VGQLLSLVERRMLLPDA

SEQ ID NO: 745573 - protein, 18 aa, Mycobacterium
VGQLPGPCAVVYEAGPTG

SEQ ID NO: 745574 - protein, 23 aa, Mycobacterium
VGQLRGGFEYARTGNPTRAVLEA

SEQ ID NO: 745575 - protein, 28 aa, Mycobacterium
VGQPLDWFCSFSSAAAMLGSPGQGAYAA

SEQ ID NO: 745576 - protein, 19 aa, Mycobacterium
VGQRFPIDPPFGLVAMAWR

SEQ ID NO: 745577 - protein, 30 aa, Mycobacterium
VGQRFPIDPPFGLVAMAWRDDDVVHAWLHR

SEQ ID NO: 745578 - protein, 24 aa, Mycobacterium
VGQRGAPISRMWVRPFASDEADPA

SEQ ID NO: 745579 - protein, 20 aa, Mycobacterium
VGQRLVELVQLYVPADAKPK

SEQ ID NO: 745580 - protein, 17 aa, Mycobacterium
VGQRPAILMPLRAREEV

SEQ ID NO: 745581 - protein, 17 aa, Mycobacterium
VGQRRSLLPAGITAVSG

SEQ ID NO: 745582 - protein, 23 aa, Mycobacterium
VGQRRVYSNFGFGLLAHAIEDAA

SEQ ID NO: 745583 - protein, 19 aa, Mycobacterium
VGQSCPAYATSSGKVLLAG

SEQ ID NO: 745584 - protein, 18 aa, Mycobacterium
VGQTFDWAPAMTLSPGLA

SEQ ID NO: 745585 - protein, 18 aa, Mycobacterium
VGQVLRAGGRYVVTDFDG

SEQ ID NO: 745586 - protein, 19 aa, Mycobacterium
VGQVWRDTLNMDWEGEAIT

SEQ ID NO: 745587 - protein, 25 aa, Mycobacterium
VGRADLVLPMWQRLESAWGPARDVR

SEQ ID NO: 745588 - protein, 23 aa, Mycobacterium
VGRADLVLPMWQRLESTWGPARD

SEQ ID NO: 745589 - protein, 27 aa, Mycobacterium
VGRAELVLPMWERLQSLWGPARDVRAQ

SEQ ID NO: 745590 - protein, 30 aa, Mycobacterium
VGRAELVLPMWQRLEPVWGPARDVRAHQPL

SEQ ID NO: 745591 - protein, 22 aa, Mycobacterium
VGRAGAATPFWVHVTHGDPARL

SEQ ID NO: 745592 - protein, 20 aa, Mycobacterium
VGRAGWLPPDRARLIRGEAV

SEQ ID NO: 745593 - protein, 26 aa, Mycobacterium
VGRALRWRLTGLGLRVIAHDPYSDEA

SEQ ID NO: 745594 - protein, 23 aa, Mycobacterium
VGRAVDLVQLFPAAAYGKNGADI

SEQ ID NO: 745595 - protein, 22 aa, Mycobacterium
VGRAVDLVQLFPAASYGKNGAD

SEQ ID NO: 745596 - protein, 19 aa, Mycobacterium
VGRCRRIFATRKVGHAGTL

SEQ ID NO: 745597 - protein, 19 aa, Mycobacterium
VGRCRRIFGTRRVGHAGTL

SEQ ID NO: 745598 - protein, 24 aa, Mycobacterium
VGRDAAGNWGQWALLRAADSTVRN

SEQ ID NO: 745599 - protein, 17 aa, Mycobacterium
VGRDCVQAHLAALDLVY

SEQ ID NO: 745600 - protein, 28 aa, Mycobacterium
VGREIKKLPTLRGRTIVTMFYENSTRTR

SEQ ID NO: 745601 - protein, 29 aa, Mycobacterium
VGREIKKLPTLRGRTVITMFYENSTRTRV

SEQ ID NO: 745602 - protein, 20 aa, Mycobacterium
VGRELGRFGFEEYLQTKSLQ

SEQ ID NO: 745603 - protein, 19 aa, Mycobacterium
VGRELRNQFRVVLLDEYQD

SEQ ID NO: 745604 - protein, 24 aa, Mycobacterium
VGREMGVAGLEEFLERKTFAVPAV

SEQ ID NO: 745605 - protein, 24 aa, Mycobacterium
VGREMGVAGLEEFLERKTFAVPVG

SEQ ID NO: 745606 - protein, 24 aa, Mycobacterium
VGREMGVAGLEEFLERKTFAVPVM

SEQ ID NO: 745607 - protein, 30 aa, Mycobacterium
VGREVKKLPTLRGRTIITMFYENSTRTRVS

SEQ ID NO: 745608 - protein, 28 aa, Mycobacterium
VGREVKKLPTLRGRTVVTMFYENSTRTR

SEQ ID NO: 745609 - protein, 27 aa, Mycobacterium
VGRFALRGGRTMFLFIFRAEHDSVGVT

SEQ ID NO: 745610 - protein, 19 aa, Mycobacterium
VGRFIPVVSGHPSLWRMDA

SEQ ID NO: 745611 - protein, 34 aa, Mycobacterium
VGRFRFFLDGHRWEWSDAVARMHGYKPGQVQPTT

SEQ ID NO: 745612 - protein, 19 aa, Mycobacterium
VGRGEIFGFLGPSGAGKST

SEQ ID NO: 745613 - protein, 29 aa, Mycobacterium
VGRGQEVVEFACGIPHLLKGGFTENASTN

SEQ ID NO: 745614 - protein, 24 aa, Mycobacterium
VGRGRGGVEAALRSCPVPVVVGGI

SEQ ID NO: 745615 - protein, 23 aa, Mycobacterium
VGRGRLRIVCNLGAEAVRVPVAG

SEQ ID NO: 745616 - protein, 21 aa, Mycobacterium
VGRHRAELIARVADVAYVDDS

SEQ ID NO: 745617 - protein, 26 aa, Mycobacterium
VGRIAARVPQEWLLPYVHQRYDDVAL

SEQ ID NO: 745618 - protein, 23 aa, Mycobacterium
VGRIARVLGPRGLMPNPKTGTVT

SEQ ID NO: 745619 - protein, 24 aa, Mycobacterium
VGRIDMGWPEWKVGVQYDGIQHWT

SEQ ID NO: 745620 - protein, 25 aa, Mycobacterium
VGRIKDIVIRNGLKIPAAEVEEAVS

SEQ ID NO: 745621 - protein, 17 aa, Mycobacterium
VGRIRDVVISISIVRQQ

SEQ ID NO: 745622 - protein, 24 aa, Mycobacterium
VGRIVANRVQSMWVSTFHSSCVRI

SEQ ID NO: 745623 - protein, 24 aa, Mycobacterium
VGRKALNYFKFRNWDITESWTGFS

SEQ ID NO: 745624 - protein, 25 aa, Mycobacterium
VGRLEAGRCLLDLRTVAPEEDELLL

SEQ ID NO: 745625 - protein, 25 aa, Mycobacterium
VGRLEVRGPMMFDGYLNRPEATAAA

SEQ ID NO: 745626 - protein, 19 aa, Mycobacterium
VGRLFGWLGKVLADHPDAR

SEQ ID NO: 745627 - protein, 24 aa, Mycobacterium
VGRLNRAAPPLALRAVRTIGREGY

SEQ ID NO: 745628 - protein, 24 aa, Mycobacterium
VGRLRNRLLGLLSRAVLLRPAHRS

SEQ ID NO: 745629 - protein, 22 aa, Mycobacterium
VGRLWLTPRAQRIADESRAARR

SEQ ID NO: 745630 - protein, 19 aa, Mycobacterium
VGRMTVRAALARLVDLGLV

SEQ ID NO: 745631 - protein, 18 aa, Mycobacterium
VGRNGLALGDKWAPGPST

SEQ ID NO: 745632 - protein, 28 aa, Mycobacterium
VGRPAEGPPAWLRFFGCNPRHHSLAFLP

SEQ ID NO: 745633 - protein, 23 aa, Mycobacterium
VGRPDIMIVVGGVIPPGDFDELY

SEQ ID NO: 745634 - protein, 18 aa, Mycobacterium
VGRPDIVAVVEFSQLGVY

SEQ ID NO: 745635 - protein, 27 aa, Mycobacterium
VGRPIRRIPLSPAMFHAIGWVSDLLGN

SEQ ID NO: 745636 - protein, 23 aa, Mycobacterium
VGRPRLKTSLLSAADIKAIPPVI

SEQ ID NO: 745637 - protein, 19 aa, Mycobacterium
VGRRIALTGPQSFTNAELV

SEQ ID NO: 745638 - protein, 21 aa, Mycobacterium
VGRRLAEPGPYSMLEVLAPTM

SEQ ID NO: 745639 - protein, 23 aa, Mycobacterium
VGRRRWNRRGAMVTDRYQHLMHH

SEQ ID NO: 745640 - protein, 23 aa, Mycobacterium
VGRRRWNRRGAMVTDRYQRLCHH

SEQ ID NO: 745641 - protein, 24 aa, Mycobacterium
VGRYRKERNWSRERLAGQIHKSVS

SEQ ID NO: 745642 - protein, 24 aa, Mycobacterium
VGSACAHNPLPVVIPCHRVVRSDG

SEQ ID NO: 745643 - protein, 24 aa, Mycobacterium
VGSACSMAAGALAAVLGGTPAQVE

SEQ ID NO: 745644 - protein, 24 aa, Mycobacterium
VGSAGTWFPTPQFAQLGLGNLGSL

SEQ ID NO: 745645 - protein, 18 aa, Mycobacterium
VGSARAAARYGADTCARG

SEQ ID NO: 745646 - protein, 27 aa, Mycobacterium
VGSARLARVQYWPALKDLSMYSLRIKE

SEQ ID NO: 745647 - protein, 27 aa, Mycobacterium
VGSARTARLQYWPALKDLSMYSLRIRE

SEQ ID NO: 745648 - protein, 22 aa, Mycobacterium
VGSASTDPVSWIGESSGVPGEL

SEQ ID NO: 745649 - protein, 17 aa, Mycobacterium
VGSCGAAGAAEAAVAAG

SEQ ID NO: 745650 - protein, 20 aa, Mycobacterium
VGSEVPRDGLLRLLVDVQYT

SEQ ID NO: 745651 - protein, 17 aa, Mycobacterium
VGSGAWTAMHHAFTAPK

SEQ ID NO: 745652 - protein, 17 aa, Mycobacterium
VGSGAWTAVHHAFTSPK

SEQ ID NO: 745653 - protein, 18 aa, Mycobacterium
VGSGAWTAVHHAFTSPKP

SEQ ID NO: 745654 - protein, 18 aa, Mycobacterium
VGSGFAGFECARRLSKQL

SEQ ID NO: 745655 - protein, 23 aa, Mycobacterium
VGSGRAQLLSGLAGLAAGEPGAG

SEQ ID NO: 745656 - protein, 24 aa, Mycobacterium
VGSGRTELLAAIFGASTITGGTMS

SEQ ID NO: 745657 - protein, 32 aa, Mycobacterium
VGSGSGLRELKCGYHGWTWDLAGTLKRVPNRK

SEQ ID NO: 745658 - protein, 23 aa, Mycobacterium
VGSGWTAAMSLLGFERGAQATTG

SEQ ID NO: 745659 - protein, 18 aa, Mycobacterium
VGSHGRGGFPGMLLGSVS

SEQ ID NO: 745660 - protein, 26 aa, Mycobacterium
VGSHGRGGFTGMLLGSVSSRVAQSAT

SEQ ID NO: 745661 - protein, 29 aa, Mycobacterium
VGSHPSFRPTRVVSLAGPLDMVYAAEHGD

SEQ ID NO: 745662 - protein, 26 aa, Mycobacterium
VGSHSKRVFCEAVDIVSGIGYDKVDP

SEQ ID NO: 745663 - protein, 18 aa, Mycobacterium
VGSHVLVAVGRRPNTDDL

SEQ ID NO: 745664 - protein, 28 aa, Mycobacterium
VGSIPVKRLRQAGVLELLLALADESNGN

SEQ ID NO: 745665 - protein, 19 aa, Mycobacterium
VGSLARKPPEISWETAAVF

SEQ ID NO: 745666 - protein, 25 aa, Mycobacterium
VGSLARVSGRLSASATDVYPALREF

SEQ ID NO: 745667 - protein, 22 aa, Mycobacterium
VGSMLRPLLSGARTVFMDGWDP

SEQ ID NO: 745668 - protein, 21 aa, Mycobacterium
VGSNLKARRLVAGRGGGLLTL

SEQ ID NO: 745669 - protein, 26 aa, Mycobacterium
VGSNPIDILAWLLGYNGQASGGLGGI

SEQ ID NO: 745670 - protein, 23 aa, Mycobacterium
VGSPETRLGVSVAGGVGPINIPI

SEQ ID NO: 745671 - protein, 21 aa, Mycobacterium
VGSRFLDRLNTLPDTKPGVDY

SEQ ID NO: 745672 - protein, 24 aa, Mycobacterium
VGSRGRGGFARKVLGSTSMGLVHR

SEQ ID NO: 745673 - protein, 17 aa, Mycobacterium
VGSRPPLLKRIVLQTAA

SEQ ID NO: 745674 - protein, 18 aa, Mycobacterium
VGSRRPTISVAIYEKPLT

SEQ ID NO: 745675 - protein, 17 aa, Mycobacterium
VGSSLDIADLFYTGERN

SEQ ID NO: 745676 - protein, 24 aa, Mycobacterium
VGSSLRLPYFGSFPETNVRLYSVD

SEQ ID NO: 745677 - protein, 24 aa, Mycobacterium
VGSSPGFLSYPWGVIGDHTIEKVQ

SEQ ID NO: 745678 - protein, 22 aa, Mycobacterium
VGSSSDLRRIAALAASDDEAIG

SEQ ID NO: 745679 - protein, 18 aa, Mycobacterium
VGSSYVWGGAAPGGFDCS

SEQ ID NO: 745680 - protein, 22 aa, Mycobacterium
VGSVEECRRALPGAEVVDTGAT

SEQ ID NO: 745681 - protein, 21 aa, Mycobacterium
VGSWTGPSSIAMAAAVAPYLA

SEQ ID NO: 745682 - protein, 18 aa, Mycobacterium
VGSYLRYGAYPYAIAVRE

SEQ ID NO: 745683 - protein, 17 aa, Mycobacterium
VGSYLTKEIEVVGASVI

SEQ ID NO: 745684 - protein, 26 aa, Mycobacterium
VGTADHKASVLSFVLDGHDPVEVGKA

SEQ ID NO: 745685 - protein, 32 aa, Mycobacterium
VGTADSAPAGWGWIAPYIGMIWPTGNLSKLRT

SEQ ID NO: 745686 - protein, 23 aa, Mycobacterium
VGTAPGRWWALIRVACAGELLYS

SEQ ID NO: 745687 - protein, 24 aa, Mycobacterium
VGTARRIAALIGRPDVAVVSNPEF

SEQ ID NO: 745688 - protein, 20 aa, Mycobacterium
VGTAVRYTAKPGAFRRPNGQ

SEQ ID NO: 745689 - protein, 19 aa, Mycobacterium
VGTDFRLAKRQPLADVLHW

SEQ ID NO: 745690 - protein, 24 aa, Mycobacterium
VGTDIRFGLGAVRNVGANVVGSLI

SEQ ID NO: 745691 - protein, 23 aa, Mycobacterium
VGTDRWTDWHWYTTVVHTNCREI

SEQ ID NO: 745692 - protein, 27 aa, Mycobacterium
VGTELFSWPGVHYLSGFYGPLERALRD

SEQ ID NO: 745693 - protein, 27 aa, Mycobacterium
VGTGAGVSGLWLLSGMRDDGVLTTIDV

SEQ ID NO: 745694 - protein, 27 aa, Mycobacterium
VGTGAGVSGLWLLSGMSNDGVLTTIDI

SEQ ID NO: 745695 - protein, 18 aa, Mycobacterium
VGTGHSFTDCACTDGVMV

SEQ ID NO: 745696 - protein, 24 aa, Mycobacterium
VGTGMLRYVMRVPPLSSLGVDEVV

SEQ ID NO: 745697 - protein, 25 aa, Mycobacterium
VGTGRPKLAVIVSKFDALRALRDVE

SEQ ID NO: 745698 - protein, 25 aa, Mycobacterium
VGTGRWAAIVARTWFATAAPPAGTR

SEQ ID NO: 745699 - protein, 25 aa, Mycobacterium
VGTGTEVTWRWTVYPRNAVAGLAMP

SEQ ID NO: 745700 - protein, 17 aa, Mycobacterium
VGTHWWNPAPLIPLVEV

SEQ ID NO: 745701 - protein, 20 aa, Mycobacterium
VGTLRRWIREEQPGSGLRPE

SEQ ID NO: 745702 - protein, 19 aa, Mycobacterium
VGTLYRYFPAKTHLLVAAL

SEQ ID NO: 745703 - protein, 24 aa, Mycobacterium
VGTPADKVLEHWLASARRDDEARG

SEQ ID NO: 745704 - protein, 23 aa, Mycobacterium
VGTPDRRNLWLLAREPSIDPATQ

SEQ ID NO: 745705 - protein, 20 aa, Mycobacterium
VGTPEWSELIGRAGELTPHR

SEQ ID NO: 745706 - protein, 19 aa, Mycobacterium
VGTPQRRGFGIDVGGSGIK

SEQ ID NO: 745707 - protein, 21 aa, Mycobacterium
VGTPYRIGVRPTNLTMHETVF

SEQ ID NO: 745708 - protein, 25 aa, Mycobacterium
VGTRLGMCGVEYFGHPWEFGPRKAK

SEQ ID NO: 745709 - protein, 27 aa, Mycobacterium
VGTRLRRWNAPGGKPRRAGVSSYSMGG

SEQ ID NO: 745710 - protein, 26 aa, Mycobacterium
VGTRPFGPICEFVRATGEIHLNSTWD

SEQ ID NO: 745711 - protein, 23 aa, Mycobacterium
VGTSEVYRPLPIDDPTQRCPELS

SEQ ID NO: 745712 - protein, 18 aa, Mycobacterium
VGTSFLKVGEARRFGMGE

SEQ ID NO: 745713 - protein, 17 aa, Mycobacterium
VGTSRAMLSLARQHALD

SEQ ID NO: 745714 - protein, 17 aa, Mycobacterium
VGTTIGEPLQVHGLAKG

SEQ ID NO: 745715 - protein, 25 aa, Mycobacterium
VGTTMPVYAARAFGGIVEDVDGNRL

SEQ ID NO: 745716 - protein, 18 aa, Mycobacterium
VGTVAPRHDDTFVVFGYS

SEQ ID NO: 745717 - protein, 18 aa, Mycobacterium
VGTVCFSVALADGTFLTR

SEQ ID NO: 745718 - protein, 19 aa, Mycobacterium
VGTVSGLYVCEMVTARALV

SEQ ID NO: 745719 - protein, 17 aa, Mycobacterium
VGVAAPIILQFDASIDD

SEQ ID NO: 745720 - protein, 17 aa, Mycobacterium
VGVAGRVIFARNSGKLC

SEQ ID NO: 745721 - protein, 24 aa, Mycobacterium
VGVAKAAGVPTVLACTPPSGEHGA

SEQ ID NO: 745722 - protein, 17 aa, Mycobacterium
VGVARAAFEYARDYACE

SEQ ID NO: 745723 - protein, 19 aa, Mycobacterium
VGVCTNTLCAIMGGDAIFE

SEQ ID NO: 745724 - protein, 18 aa, Mycobacterium
VGVCTNTLCAVMGGDAIF

SEQ ID NO: 745725 - protein, 23 aa, Mycobacterium
VGVCTNTLCAVMGGDAIFETLKD

SEQ ID NO: 745726 - protein, 23 aa, Mycobacterium
VGVCTNTLCAVMGGDAILESLEQ

SEQ ID NO: 745727 - protein, 23 aa, Mycobacterium
VGVDARNIFRYGGGIHCITQHMP

SEQ ID NO: 745728 - protein, 19 aa, Mycobacterium
VGVDEAYRGFGLAASMLGW

SEQ ID NO: 745729 - protein, 25 aa, Mycobacterium
VGVDGWPVTVSNDFDAELPAADAVL

SEQ ID NO: 745730 - protein, 22 aa, Mycobacterium
VGVDIGCGMVAAKTRFTEADLA

SEQ ID NO: 745731 - protein, 20 aa, Mycobacterium
VGVDTSALWSALRQSDVGAR

SEQ ID NO: 745732 - protein, 29 aa, Mycobacterium
VGVEGRLGLRGAPVLIGRSAVACDYETAA

SEQ ID NO: 745733 - protein, 19 aa, Mycobacterium
VGVEKWRDGRFVGFEGSYG

SEQ ID NO: 745734 - protein, 19 aa, Mycobacterium
VGVELNPGGYIPVDRVSRT

SEQ ID NO: 745735 - protein, 24 aa, Mycobacterium
VGVENRLRVVAHVSTGLDHYLLSD

SEQ ID NO: 745736 - protein, 35 aa, Mycobacterium
VGVERIGLRYVLEIRVPAGVDGRIAWSNWIDEQLL

SEQ ID NO: 745737 - protein, 18 aa, Mycobacterium
VGVGDALRASGCQPDGGA

SEQ ID NO: 745738 - protein, 20 aa, Mycobacterium
VGVGDLHLTMPISLRTDDDG

SEQ ID NO: 745739 - protein, 17 aa, Mycobacterium
VGVGGLVLGGGFGQCTR

SEQ ID NO: 745740 - protein, 25 aa, Mycobacterium
VGVGISLRGGGLVAPAIHDVADKKL

SEQ ID NO: 745741 - protein, 23 aa, Mycobacterium
VGVGISLRGGGLVAPAIHDVPDK

SEQ ID NO: 745742 - protein, 24 aa, Mycobacterium
VGVGISLRGGGLVAPAIHDVPEKK

SEQ ID NO: 745743 - protein, 17 aa, Mycobacterium
VGVGRLVLDSSLGIAYL

SEQ ID NO: 745744 - protein, 18 aa, Mycobacterium
VGVGSRYTVHWKVGSVPI

SEQ ID NO: 745745 - protein, 19 aa, Mycobacterium
VGVGYAGQADWMIVTSDSA

SEQ ID NO: 745746 - protein, 38 aa, Mycobacterium
VGVGYVRRAGLTASRFVACPFGAPGTRMYRTGDLVSWG

SEQ ID NO: 745747 - protein, 19 aa, Mycobacterium
VGVHPDGADAWALQDVLAL

SEQ ID NO: 745748 - protein, 23 aa, Mycobacterium
VGVIPKLLIRRELSDADAANELI

SEQ ID NO: 745749 - protein, 18 aa, Mycobacterium
VGVLAMRNHSHFGGPPAD

SEQ ID NO: 745750 - protein, 17 aa, Mycobacterium
VGVLARLGGENFAWQVP

SEQ ID NO: 745751 - protein, 21 aa, Mycobacterium
VGVLCRDHRGLVITMAACGKL

SEQ ID NO: 745752 - protein, 24 aa, Mycobacterium
VGVLGFREHASWALTSDILEFVDL

SEQ ID NO: 745753 - protein, 20 aa, Mycobacterium
VGVLIAIRLSRHCDVVGISA

SEQ ID NO: 745754 - protein, 19 aa, Mycobacterium
VGVLPTPAVAYLTGAYGAA

SEQ ID NO: 745755 - protein, 19 aa, Mycobacterium
VGVLPTPAVAYLTSAYDAD

SEQ ID NO: 745756 - protein, 17 aa, Mycobacterium
VGVLRAVLFAPEDLALV

SEQ ID NO: 745757 - protein, 19 aa, Mycobacterium
VGVLYARRQLLSELPPFLT

SEQ ID NO: 745758 - protein, 32 aa, Mycobacterium
VGVLYGRRALLEAMPPFITGGSMIETVTMEVS

SEQ ID NO: 745759 - protein, 26 aa, Mycobacterium
VGVNPRELAGWLAAALTKADGIASAE

SEQ ID NO: 745760 - protein, 25 aa, Mycobacterium
VGVNPRELAGWLAAAVSQADGVASA

SEQ ID NO: 745761 - protein, 23 aa, Mycobacterium
VGVNPRELAGWLATALTAADGIA

SEQ ID NO: 745762 - protein, 23 aa, Mycobacterium
VGVPEDWLLAGHIVIGWPQGKHG

SEQ ID NO: 745763 - protein, 22 aa, Mycobacterium
VGVPGLRGSEDVLGILLSAIDS

SEQ ID NO: 745764 - protein, 20 aa, Mycobacterium
VGVPRLLGILDEFNVPGTFF

SEQ ID NO: 745765 - protein, 25 aa, Mycobacterium
VGVPWHLLEAVVMDLMRVWELCQVC

SEQ ID NO: 745766 - protein, 17 aa, Mycobacterium
VGVRAGHIVVCSGPDAW

SEQ ID NO: 745767 - protein, 25 aa, Mycobacterium
VGVRCTRLPVNRGFHSALVDPAVSS

SEQ ID NO: 745768 - protein, 24 aa, Mycobacterium
VGVRGKPAPALRPDGAIPELAGAI

SEQ ID NO: 745769 - protein, 23 aa, Mycobacterium
VGVRHPGRVAAMVLDSPVLSAHD

SEQ ID NO: 745770 - protein, 18 aa, Mycobacterium
VGVRRPGDQMLMYGSTMF

SEQ ID NO: 745771 - protein, 20 aa, Mycobacterium
VGVRWLREVAGAETVVLLGN

SEQ ID NO: 745772 - protein, 18 aa, Mycobacterium
VGVRWLREVQGIETVILL

SEQ ID NO: 745773 - protein, 25 aa, Mycobacterium
VGVSEALSGLAPWQEVLSGVSGRVA

SEQ ID NO: 745774 - protein, 24 aa, Mycobacterium
VGVSLALACDIVLASDQAFFLLAF

SEQ ID NO: 745775 - protein, 27 aa, Mycobacterium
VGVSPSLRFGLAFCEASGPRLVRRTGN

SEQ ID NO: 745776 - protein, 30 aa, Mycobacterium
VGVSRPTVIKWRDRFAAFGIEGLDDEPRSG

SEQ ID NO: 745777 - protein, 21 aa, Mycobacterium
VGVTFLTRWATGELSASDVDV

SEQ ID NO: 745778 - protein, 26 aa, Mycobacterium
VGVTRARVHLALSWALARTPGGRQGR

SEQ ID NO: 745779 - protein, 25 aa, Mycobacterium
VGVTRARVHLALTWALARSPGGRQG

SEQ ID NO: 745780 - protein, 17 aa, Mycobacterium
VGVTRVSTRAKLEDDAR

SEQ ID NO: 745781 - protein, 18 aa, Mycobacterium
VGVVAAIVPWNMPQFLIA

SEQ ID NO: 745782 - protein, 18 aa, Mycobacterium
VGVVAAIVPWNMPQFLIV

SEQ ID NO: 745783 - protein, 18 aa, Mycobacterium
VGVVESWVHLEVVKESYA

SEQ ID NO: 745784 - protein, 18 aa, Mycobacterium
VGVVHVCIDPKANSEEMP

SEQ ID NO: 745785 - protein, 19 aa, Mycobacterium
VGVVLVPVNFMLTAEEVAY

SEQ ID NO: 745786 - protein, 24 aa, Mycobacterium
VGVVPDYLGNVWFATGTGVVGVAK

SEQ ID NO: 745787 - protein, 29 aa, Mycobacterium
VGVVSAPALARRWWAAEGQGAFGSFNGTT

SEQ ID NO: 745788 - protein, 20 aa, Mycobacterium
VGVVSQRCEPIFVMAAPGQP

SEQ ID NO: 745789 - protein, 17 aa, Mycobacterium
VGVVSVIRLLQADGDAA

SEQ ID NO: 745790 - protein, 20 aa, Mycobacterium
VGVWRRAPLQAIARLHSLAA

SEQ ID NO: 745791 - protein, 22 aa, Mycobacterium
VGWASGFDGMMERVISNGDGLA

SEQ ID NO: 745792 - protein, 23 aa, Mycobacterium
VGWDPRKAVVVRPPAGLPGSVLA

SEQ ID NO: 745793 - protein, 17 aa, Mycobacterium
VGWFREEFEALGVPFER

SEQ ID NO: 745794 - protein, 20 aa, Mycobacterium
VGWFTAKYPVALNVGGLSWA

SEQ ID NO: 745795 - protein, 19 aa, Mycobacterium
VGWFTSKYPVALDFDRNTG

SEQ ID NO: 745796 - protein, 20 aa, Mycobacterium
VGWFTTKYPVALAVGELDWA

SEQ ID NO: 745797 - protein, 19 aa, Mycobacterium
VGWFTTKYPVALQVGGLSW

SEQ ID NO: 745798 - protein, 19 aa, Mycobacterium
VGWFTTKYPVALSVAEMPW

SEQ ID NO: 745799 - protein, 19 aa, Mycobacterium
VGWFTTKYPVALTVADVPW

SEQ ID NO: 745800 - protein, 25 aa, Mycobacterium
VGWGGPPIGALVFRDPALIDSFGSV

SEQ ID NO: 745801 - protein, 17 aa, Mycobacterium
VGYAMSGVRVLNRAAEP

SEQ ID NO: 745802 - protein, 17 aa, Mycobacterium
VGYARATIREIARTANV

SEQ ID NO: 745803 - protein, 17 aa, Mycobacterium
VGYARTPAWLLHPGDHV

SEQ ID NO: 745804 - protein, 18 aa, Mycobacterium
VGYAYAPFHCPDCAASYC

SEQ ID NO: 745805 - protein, 26 aa, Mycobacterium
VGYEALARWPAYDSLSPLDVFAHATA

SEQ ID NO: 745806 - protein, 29 aa, Mycobacterium
VGYELARDALREWLRRGGKPARLIDIASR

SEQ ID NO: 745807 - protein, 18 aa, Mycobacterium
VGYGGAPIAPSLVRAVKD

SEQ ID NO: 745808 - protein, 18 aa, Mycobacterium
VGYLDLTGCMALGITGPI

SEQ ID NO: 745809 - protein, 22 aa, Mycobacterium
VGYLDRPFEVMFTHPGDVQMAS

SEQ ID NO: 745810 - protein, 19 aa, Mycobacterium
VGYLKREFAALGVDHAERA

SEQ ID NO: 745811 - protein, 19 aa, Mycobacterium
VGYLLPHLVGSIFTLDPRC

SEQ ID NO: 745812 - protein, 21 aa, Mycobacterium
VGYPAKWRDYSTLVIDRDDLY

SEQ ID NO: 745813 - protein, 17 aa, Mycobacterium
VGYPREWRRRKPHSWLR

SEQ ID NO: 745814 - protein, 19 aa, Mycobacterium
VGYPREWRRRKPYSWLRQV

SEQ ID NO: 745815 - protein, 21 aa, Mycobacterium
VGYPREWRRRKPYSWLRQVLP

SEQ ID NO: 745816 - protein, 18 aa, Mycobacterium
VGYPREWRRRRPYRWLRQ

SEQ ID NO: 745817 - protein, 27 aa, Mycobacterium
VGYQYPHRCWTCMVPALIREDMIVEKV

SEQ ID NO: 745818 - protein, 24 aa, Mycobacterium
VGYRDLAGFGRRFIDVDPEDLVAE

SEQ ID NO: 745819 - protein, 24 aa, Mycobacterium
VGYRHRWARRTGLLAAGACAGFFR

SEQ ID NO: 745820 - protein, 23 aa, Mycobacterium
VGYRLDLATEIPIRAELLRVSPT

SEQ ID NO: 745821 - protein, 26 aa, Mycobacterium
VGYSYYGEVLLDWIVERLANQKGSDD

SEQ ID NO: 745822 - protein, 37 aa, Mycobacterium
VGYVHRSGLTGSRFVACPFGRPGVRMYRTGDLARYSE

SEQ ID NO: 745823 - protein, 25 aa, Mycobacterium
VGYWRRSALTASRFMACPFGAPGTR

SEQ ID NO: 745824 - protein, 18 aa, Mycobacterium
VHAALPRTSWGVRAAGDP

SEQ ID NO: 745825 - protein, 18 aa, Mycobacterium
VHACGECTARVALDAIER

SEQ ID NO: 745826 - protein, 27 aa, Mycobacterium
VHACQKTKHFVMDWCVGVFHTQSGVET

SEQ ID NO: 745827 - protein, 19 aa, Mycobacterium
VHADAGFEFIEVFCDTPID

SEQ ID NO: 745828 - protein, 20 aa, Mycobacterium
VHAEHGWQLQGPLRADRELR

SEQ ID NO: 745829 - protein, 19 aa, Mycobacterium
VHAELRVAVTLSGGDERRA

SEQ ID NO: 745830 - protein, 17 aa, Mycobacterium
VHAGRVGAQLGVVARTV

SEQ ID NO: 745831 - protein, 19 aa, Mycobacterium
VHAHPRWIAQAFTDALGAA

SEQ ID NO: 745832 - protein, 17 aa, Mycobacterium
VHAHRRLIKHGRGVRTV

SEQ ID NO: 745833 - protein, 26 aa, Mycobacterium
VHAIKEAGWWRLMLDEQIGGMAAPPP

SEQ ID NO: 745834 - protein, 25 aa, Mycobacterium
VHAKAEVLKLINWELASAASEDLSP

SEQ ID NO: 745835 - protein, 25 aa, Mycobacterium
VHAKAEVLKLINWELASTEAAPSPA

SEQ ID NO: 745836 - protein, 23 aa, Mycobacterium
VHAKVCVIDDVWASVGSDNFNRR

SEQ ID NO: 745837 - protein, 20 aa, Mycobacterium
VHALLCGPDMATVAVADIEV

SEQ ID NO: 745838 - protein, 24 aa, Mycobacterium
VHALLEIAARIGMPAVISSALDSA

SEQ ID NO: 745839 - protein, 25 aa, Mycobacterium
VHALPMVFDLMSGIYWRPGESGGLL

SEQ ID NO: 745840 - protein, 18 aa, Mycobacterium
VHALVRKLHPCWEREDPG

SEQ ID NO: 745841 - protein, 22 aa, Mycobacterium
VHAMNCIEWVDAFYGAFKARAV

SEQ ID NO: 745842 - protein, 17 aa, Mycobacterium
VHARAIIIGTGFSGLGM

SEQ ID NO: 745843 - protein, 19 aa, Mycobacterium
VHARLDMLLPLASLPTTAV

SEQ ID NO: 745844 - protein, 31 aa, Mycobacterium
VHARRVWDSRGRPTIEAELLLSDGSTGRAIA

SEQ ID NO: 745845 - protein, 23 aa, Mycobacterium
VHARSWAAPQWLQLGRELAGSDS

SEQ ID NO: 745846 - protein, 17 aa, Mycobacterium
VHASMDLYKWAYKLGPL

SEQ ID NO: 745847 - protein, 43 aa, Mycobacterium
VHASMSISLLRHGRLWGLIACHHYAGPHLPPFGNRAAAEFLGS

SEQ ID NO: 745848 - protein, 24 aa, Mycobacterium
VHAVKGAELMDKWVGSSEKAVREL

SEQ ID NO: 745849 - protein, 24 aa, Mycobacterium
VHAVKGAELMDKWVGSSEQAVRDL

SEQ ID NO: 745850 - protein, 24 aa, Mycobacterium
VHAYPRTGSVVVWYSPRRCDRDAV

SEQ ID NO: 745851 - protein, 22 aa, Mycobacterium
VHCDVWEGFIFVNFAKKPEQSL

SEQ ID NO: 745852 - protein, 21 aa, Mycobacterium
VHCDVWEGFIFVNFAKNPEQS

SEQ ID NO: 745853 - protein, 24 aa, Mycobacterium
VHCDVWNGFIFINFDAEPRQTLRE

SEQ ID NO: 745854 - protein, 21 aa, Mycobacterium
VHCGFGFGIVFVNPALDALGW

SEQ ID NO: 745855 - protein, 18 aa, Mycobacterium
VHCLEQFHRALLEHRDEL

SEQ ID NO: 745856 - protein, 21 aa, Mycobacterium
VHCQVWEGFIFVNFAQEPEQS

SEQ ID NO: 745857 - protein, 19 aa, Mycobacterium
VHDAVRWKPYSIGRRLLTG

SEQ ID NO: 745858 - protein, 23 aa, Mycobacterium
VHDELPHSLAVVIDDVSPRDGRD

SEQ ID NO: 745859 - protein, 23 aa, Mycobacterium
VHDELPHSLAVVIDEVSPREGRE

SEQ ID NO: 745860 - protein, 19 aa, Mycobacterium
VHDEVFFDRSLLAPLVAGN

SEQ ID NO: 745861 - protein, 23 aa, Mycobacterium
VHDGGDHFVVFGAVHSLSDVPKK

SEQ ID NO: 745862 - protein, 19 aa, Mycobacterium
VHDGGDHFVVFGAVHSLSE

SEQ ID NO: 745863 - protein, 23 aa, Mycobacterium
VHDGGDHFVVFGAVHSLSEVPKT

SEQ ID NO: 745864 - protein, 19 aa, Mycobacterium
VHDGGDHFVVFGAVNSLSE

SEQ ID NO: 745865 - protein, 23 aa, Mycobacterium
VHDGGDHFVVFGAVQSLSEAPKI

SEQ ID NO: 745866 - protein, 22 aa, Mycobacterium
VHDHCSAIHPMAVGSEFLTGLD

SEQ ID NO: 745867 - protein, 17 aa, Mycobacterium
VHDIAGWHVELYVDAAH

SEQ ID NO: 745868 - protein, 18 aa, Mycobacterium
VHDICSAVHPLALASPFF

SEQ ID NO: 745869 - protein, 19 aa, Mycobacterium
VHDIGIWTARTWDYLDPSV

SEQ ID NO: 745870 - protein, 24 aa, Mycobacterium
VHDKLYLPGLVKLRRLVDEGFFGR

SEQ ID NO: 745871 - protein, 24 aa, Mycobacterium
VHDSVLADICRRLFADDVRPSLDA

SEQ ID NO: 745872 - protein, 18 aa, Mycobacterium
VHEREMFETGILKATAGL

SEQ ID NO: 745873 - protein, 17 aa, Mycobacterium
VHEVARFFATGWPVNYW

SEQ ID NO: 745874 - protein, 24 aa, Mycobacterium
VHEVNRWCTLLEWGGIPCDADDVL

SEQ ID NO: 745875 - protein, 17 aa, Mycobacterium
VHFAIGYSEPEAGTDLA

SEQ ID NO: 745876 - protein, 17 aa, Mycobacterium
VHFCVGAALARLEAHIV

SEQ ID NO: 745877 - protein, 20 aa, Mycobacterium
VHFDNCRIPSSWRLQTDGFR

SEQ ID NO: 745878 - protein, 21 aa, Mycobacterium
VHFKKVMPRDYKRVLEAIAEA

SEQ ID NO: 745879 - protein, 22 aa, Mycobacterium
VHFKSVAYELLWFLRGDSNIGW

SEQ ID NO: 745880 - protein, 23 aa, Mycobacterium
VHFKSVVYELLWFLRGDSNVGWL

SEQ ID NO: 745881 - protein, 17 aa, Mycobacterium
VHFQWRAQHEDLKTLPF

SEQ ID NO: 745882 - protein, 24 aa, Mycobacterium
VHFRLPSPNGLHFHPPQSLWLDSD

SEQ ID NO: 745883 - protein, 18 aa, Mycobacterium
VHGCAARLLGAARHLDLE

SEQ ID NO: 745884 - protein, 18 aa, Mycobacterium
VHGEPGCELYSLHQTGAT

SEQ ID NO: 745885 - protein, 18 aa, Mycobacterium
VHGFPNCFIESIAQSGFT

SEQ ID NO: 745886 - protein, 21 aa, Mycobacterium
VHGFSTLWLNDALDAQVRALD

SEQ ID NO: 745887 - protein, 17 aa, Mycobacterium
VHGGVMLALCAKAARAA

SEQ ID NO: 745888 - protein, 27 aa, Mycobacterium
VHGIAVLSCREGLEFATSVASDAAPLH

SEQ ID NO: 745889 - protein, 23 aa, Mycobacterium
VHGLRPRQLHVFDDPKRDDRGWV

SEQ ID NO: 745890 - protein, 19 aa, Mycobacterium
VHGLWRGGIGTTWEARIKF

SEQ ID NO: 745891 - protein, 19 aa, Mycobacterium
VHGPLALAVGRRLRDRYGL

SEQ ID NO: 745892 - protein, 18 aa, Mycobacterium
VHGPRGWATCNYVLTSSM

SEQ ID NO: 745893 - protein, 19 aa, Mycobacterium
VHGRAPLPPGYAVGHEGVA

SEQ ID NO: 745894 - protein, 24 aa, Mycobacterium
VHGRGGQDLGEFWDRHRFQSYQGV

SEQ ID NO: 745895 - protein, 32 aa, Mycobacterium
VHGRLRILVRDLWKLVVSRIAELMAEPKDDAV

SEQ ID NO: 745896 - protein, 17 aa, Mycobacterium
VHGRTALILPSLGRTDR

SEQ ID NO: 745897 - protein, 17 aa, Mycobacterium
VHGTVWAVGERECSIQR

SEQ ID NO: 745898 - protein, 19 aa, Mycobacterium
VHGTWRMLRANAKLAAGTG

SEQ ID NO: 745899 - protein, 19 aa, Mycobacterium
VHGTWRMLRANAKLAASAG

SEQ ID NO: 745900 - protein, 19 aa, Mycobacterium
VHGTWRMLRANAKLAASTG

SEQ ID NO: 745901 - protein, 18 aa, Mycobacterium
VHGTWRMLRANSKLAART

SEQ ID NO: 745902 - protein, 21 aa, Mycobacterium
VHGVGLYLGVEMIRDPATLEP

SEQ ID NO: 745903 - protein, 24 aa, Mycobacterium
VHGVLIPGGFGIRGIEGKIAAISY

SEQ ID NO: 745904 - protein, 24 aa, Mycobacterium
VHGVLIPGGFGIRGIEGKIGAISY

SEQ ID NO: 745905 - protein, 24 aa, Mycobacterium
VHGVLIPGGFGIRGIEGKISAISY

SEQ ID NO: 745906 - protein, 20 aa, Mycobacterium
VHGYLDFARIVPAANEEFRL

SEQ ID NO: 745907 - protein, 25 aa, Mycobacterium
VHHPDRLGALVLTSCDAFEHFPPPI

SEQ ID NO: 745908 - protein, 19 aa, Mycobacterium
VHHRERLGALVLTSCDAFE

SEQ ID NO: 745909 - protein, 26 aa, Mycobacterium
VHHRERVGALVLTSCDAFENFPPPIL

SEQ ID NO: 745910 - protein, 29 aa, Mycobacterium
VHHYACDHFDVWPGHDWFDTAVTDQIAFL

SEQ ID NO: 745911 - protein, 27 aa, Mycobacterium
VHHYACDHFDVWPGNDWFDKTVTDQIA

SEQ ID NO: 745912 - protein, 32 aa, Mycobacterium
VHIGEVYEDLAWFCIRAWRFGATESHAAGGLG

SEQ ID NO: 745913 - protein, 17 aa, Mycobacterium
VHIGPSDHVAWLDDRKW

SEQ ID NO: 745914 - protein, 18 aa, Mycobacterium
VHINKRIDLGDGVLHRYD

SEQ ID NO: 745915 - protein, 17 aa, Mycobacterium
VHIPAGTVLMLCLGAAN

SEQ ID NO: 745916 - protein, 18 aa, Mycobacterium
VHIPVEVLARLGGDEFAW

SEQ ID NO: 745917 - protein, 26 aa, Mycobacterium
VHISSRLRPILNFRPKYDSWLTQAPW

SEQ ID NO: 745918 - protein, 17 aa, Mycobacterium
VHIYLQFDGLEEATHRQ

SEQ ID NO: 745919 - protein, 28 aa, Mycobacterium
VHKKGSALVPSWVAFAVIGLLEQHFSRL

SEQ ID NO: 745920 - protein, 23 aa, Mycobacterium
VHKPSAPIPLQFNDVAVTARRSR

SEQ ID NO: 745921 - protein, 23 aa, Mycobacterium
VHKPSAPIPLTFDDVAVVARRSR

SEQ ID NO: 745922 - protein, 26 aa, Mycobacterium
VHKRGSALVPSWTAFAVIGLLEQHFG

SEQ ID NO: 745923 - protein, 17 aa, Mycobacterium
VHLAALFKSANVQQVSY

SEQ ID NO: 745924 - protein, 19 aa, Mycobacterium
VHLACSLPVQANTATVDSG

SEQ ID NO: 745925 - protein, 23 aa, Mycobacterium
VHLARPTLRETLGRLAPGTPLRD

SEQ ID NO: 745926 - protein, 21 aa, Mycobacterium
VHLCLTIELWNQWKAAVDKAI

SEQ ID NO: 745927 - protein, 26 aa, Mycobacterium
VHLDLDPLLPFPGWHEHAPAVEEPVR

SEQ ID NO: 745928 - protein, 26 aa, Mycobacterium
VHLDLRFTDPFNWPKAFGGGGVFASV

SEQ ID NO: 745929 - protein, 17 aa, Mycobacterium
VHLGLTILAEAIAEAGA

SEQ ID NO: 745930 - protein, 23 aa, Mycobacterium
VHLGYKCSIRKPWWSTPSLWVPD

SEQ ID NO: 745931 - protein, 45 aa, Mycobacterium
VHLILTVLGCWKIGAVPVPMHWDLPEWERNRVLDVIDAAVVIDER

SEQ ID NO: 745932 - protein, 18 aa, Mycobacterium
VHLKGHFATMKHAAAYWR

SEQ ID NO: 745933 - protein, 26 aa, Mycobacterium
VHLLMARHMFTLWAPKRAGVTDGVTA

SEQ ID NO: 745934 - protein, 27 aa, Mycobacterium
VHLLPRTEWDRVIGINLTATFLVAKAA

SEQ ID NO: 745935 - protein, 20 aa, Mycobacterium
VHLMASCSGGIIAAMTAAHL

SEQ ID NO: 745936 - protein, 17 aa, Mycobacterium
VHLMPPLYHGRGSGAYR

SEQ ID NO: 745937 - protein, 25 aa, Mycobacterium
VHLPGAPSWELDPLVWQRTLDINLT

SEQ ID NO: 745938 - protein, 17 aa, Mycobacterium
VHLPQRVPMGFHGNWAP

SEQ ID NO: 745939 - protein, 17 aa, Mycobacterium
VHLPSWLVNAGPIYVMA

SEQ ID NO: 745940 - protein, 25 aa, Mycobacterium
VHLQPRPGEDVTILAGIIHIIIDRQ

SEQ ID NO: 745941 - protein, 19 aa, Mycobacterium
VHLRFATAHQCARATEALA

SEQ ID NO: 745942 - protein, 23 aa, Mycobacterium
VHLRGAFHVVRPAFPLMCAAHYG

SEQ ID NO: 745943 - protein, 18 aa, Mycobacterium
VHLRGFRIGTVPVTNAEW

SEQ ID NO: 745944 - protein, 26 aa, Mycobacterium
VHLRLPTAFCSPNFAYLMASDALDAL

SEQ ID NO: 745945 - protein, 17 aa, Mycobacterium
VHLRMQAMINYMACRTA

SEQ ID NO: 745946 - protein, 25 aa, Mycobacterium
VHLRPNHTFRLPGADVPIIMVGPGT

SEQ ID NO: 745947 - protein, 21 aa, Mycobacterium
VHNFWYRDAVWRRYDEMDGFP

SEQ ID NO: 745948 - protein, 29 aa, Mycobacterium
VHNGRITLWRDYFDFFDMLKATARGLAAL

SEQ ID NO: 745949 - protein, 23 aa, Mycobacterium
VHNLPMTRWTGLMVAAITLTTGG

SEQ ID NO: 745950 - protein, 25 aa, Mycobacterium
VHNTWRFGIDRILAGVAMSDDSNAW

SEQ ID NO: 745951 - protein, 25 aa, Mycobacterium
VHNTWRFGIDRVLAGVAMSDDSHAW

SEQ ID NO: 745952 - protein, 25 aa, Mycobacterium
VHNTWRFGIDRVLAGVAMSEASHAW

SEQ ID NO: 745953 - protein, 26 aa, Mycobacterium
VHPAKRGLVGHGFGASAAVFAAAGLA

SEQ ID NO: 745954 - protein, 27 aa, Mycobacterium
VHPDFSTRLLAFALLGLFTGHPYPRAC

SEQ ID NO: 745955 - protein, 25 aa, Mycobacterium
VHPECGCATSALYLAGEGAFPADRV

SEQ ID NO: 745956 - protein, 22 aa, Mycobacterium
VHPECGCATSALYLAGEGAFPE

SEQ ID NO: 745957 - protein, 24 aa, Mycobacterium
VHPECGCATSALYLAGEGAFPPDR

SEQ ID NO: 745958 - protein, 24 aa, Mycobacterium
VHPECGCATSALYLAGEGAFPQER

SEQ ID NO: 745959 - protein, 22 aa, Mycobacterium
VHPECGCATSALYLAGEGAVPD

SEQ ID NO: 745960 - protein, 19 aa, Mycobacterium
VHPEIEFFLLKNLPDDGTA

SEQ ID NO: 745961 - protein, 19 aa, Mycobacterium
VHPGAVVLHLGCGLDSRYF

SEQ ID NO: 745962 - protein, 19 aa, Mycobacterium
VHPHVAKLVGLFANMVALR

SEQ ID NO: 745963 - protein, 25 aa, Mycobacterium
VHPPFRWQRRYAEGFAEQVAALEDS

SEQ ID NO: 745964 - protein, 21 aa, Mycobacterium
VHPPFRWQRRYAEGFSDQVAE

SEQ ID NO: 745965 - protein, 23 aa, Mycobacterium
VHPPFRWQRRYAEGFSEQVAELE

SEQ ID NO: 745966 - protein, 25 aa, Mycobacterium
VHPPRPEELGSFARVKLAGFKIPQY

SEQ ID NO: 745967 - protein, 19 aa, Mycobacterium
VHPQALFARCLTALRERIG

SEQ ID NO: 745968 - protein, 24 aa, Mycobacterium
VHPQEWPDDLVIAGKRVALIGSGA

SEQ ID NO: 745969 - protein, 26 aa, Mycobacterium
VHPRPDFKNRILRAFNDGVRQRPQST

SEQ ID NO: 745970 - protein, 17 aa, Mycobacterium
VHPSTLYPGGVGTVATI

SEQ ID NO: 745971 - protein, 24 aa, Mycobacterium
VHPTSRFRDLICSRAVDIAIGPAG

SEQ ID NO: 745972 - protein, 25 aa, Mycobacterium
VHPVDLGAFAWRGLLDRVDVDPAAV

SEQ ID NO: 745973 - protein, 24 aa, Mycobacterium
VHPVDLGALGWRGLLDRVDVDPAA

SEQ ID NO: 745974 - protein, 25 aa, Mycobacterium
VHPVDLGALGWRGLLDRVDVDPAAV

SEQ ID NO: 745975 - protein, 23 aa, Mycobacterium
VHPVGACATAAVSVEEGVDKIKL

SEQ ID NO: 745976 - protein, 36 aa, Mycobacterium
VHPVWLRELAKRWCRWRMSCGVGLGQLRSDRLALVR

SEQ ID NO: 745977 - protein, 18 aa, Mycobacterium
VHPWQRPAGSYTLKPRYK

SEQ ID NO: 745978 - protein, 31 aa, Mycobacterium
VHQARINMMPGFTGGGFYWHSDFETWHAEDG

SEQ ID NO: 745979 - protein, 26 aa, Mycobacterium
VHQAYKCRVRKPWWRVPYLRPADLFL

SEQ ID NO: 745980 - protein, 22 aa, Mycobacterium
VHQIWMPYHWGSVGLVDGDVVN

SEQ ID NO: 745981 - protein, 17 aa, Mycobacterium
VHQIYDVVRWAAGPHPD

SEQ ID NO: 745982 - protein, 19 aa, Mycobacterium
VHQLEYERFGLPHPDWQVF

SEQ ID NO: 745983 - protein, 19 aa, Mycobacterium
VHQNWRLVAVLDMGWQKYQ

SEQ ID NO: 745984 - protein, 24 aa, Mycobacterium
VHQPGRPAVTGTLTLRYRRPTPLD

SEQ ID NO: 745985 - protein, 19 aa, Mycobacterium
VHQRKLLPLIARSYALAFA

SEQ ID NO: 745986 - protein, 20 aa, Mycobacterium
VHQRRLFPLIAKSYALQFAQ

SEQ ID NO: 745987 - protein, 25 aa, Mycobacterium
VHQWFGCIQVCLNGGLTVAQAEADL

SEQ ID NO: 745988 - protein, 21 aa, Mycobacterium
VHQYRHAFGRRLWELPAGLLD

SEQ ID NO: 745989 - protein, 18 aa, Mycobacterium
VHRAGSPLSYAFPVDEVG

SEQ ID NO: 745990 - protein, 25 aa, Mycobacterium
VHRARGLSWAAFRLLFVTWLAGPLE

SEQ ID NO: 745991 - protein, 27 aa, Mycobacterium
VHRAVLPDGRRVAVKIQYPGAAEAIRD

SEQ ID NO: 745992 - protein, 18 aa, Mycobacterium
VHRDGGVVPGLYAAGRTA

SEQ ID NO: 745993 - protein, 17 aa, Mycobacterium
VHREQRGKWAYYRLDAA

SEQ ID NO: 745994 - protein, 21 aa, Mycobacterium
VHRFTATDAFQLAGVGGNSAV

SEQ ID NO: 745995 - protein, 23 aa, Mycobacterium
VHRGQLAYERWLLDTKLAQRDPD

SEQ ID NO: 745996 - protein, 19 aa, Mycobacterium
VHRGVALTSFYQCGDLYRV

SEQ ID NO: 745997 - protein, 25 aa, Mycobacterium
VHRHLLRYMNWIPAEYVDAMAPTTG

SEQ ID NO: 745998 - protein, 25 aa, Mycobacterium
VHRHLLRYMNWIPSEFVDAMAPTTG

SEQ ID NO: 745999 - protein, 17 aa, Mycobacterium
VHRHLRRYMNWIPAEYV

SEQ ID NO: 746000 - protein, 18 aa, Mycobacterium
VHRHLRRYMNWIPAEYVD

SEQ ID NO: 746001 - protein, 17 aa, Mycobacterium
VHRIFDSRVRLMLTETD

SEQ ID NO: 746002 - protein, 21 aa, Mycobacterium
VHRLRALLVELERLYNHAADL

SEQ ID NO: 746003 - protein, 24 aa, Mycobacterium
VHRLRAVDELEALLAADVVPHATL

SEQ ID NO: 746004 - protein, 24 aa, Mycobacterium
VHRMPARLTRFVGRIAQMADVRSL

SEQ ID NO: 746005 - protein, 17 aa, Mycobacterium
VHRPRYDDWSLPKGKLD

SEQ ID NO: 746006 - protein, 19 aa, Mycobacterium
VHRRARAAELLRSVMTRHR

SEQ ID NO: 746007 - protein, 20 aa, Mycobacterium
VHRRAWKAMFDEYLSDIADG

SEQ ID NO: 746008 - protein, 19 aa, Mycobacterium
VHRRGALELVDEPQPGLRE

SEQ ID NO: 746009 - protein, 17 aa, Mycobacterium
VHRRGRKVVVLSKVGAT

SEQ ID NO: 746010 - protein, 17 aa, Mycobacterium
VHRRGRPLSYVFAPDDV

SEQ ID NO: 746011 - protein, 18 aa, Mycobacterium
VHRYFLAAKQSEFALGSA

SEQ ID NO: 746012 - protein, 19 aa, Mycobacterium
VHRYFLAAKRGEFASGSAT

SEQ ID NO: 746013 - protein, 18 aa, Mycobacterium
VHRYKWLQRRERADLFAI

SEQ ID NO: 746014 - protein, 23 aa, Mycobacterium
VHSCAPDLPWKVLQDSSFSAVSV

SEQ ID NO: 746015 - protein, 18 aa, Mycobacterium
VHSCPGGPLARVEGRVSI

SEQ ID NO: 746016 - protein, 19 aa, Mycobacterium
VHSEIARLTAAEMFTEEEI

SEQ ID NO: 746017 - protein, 19 aa, Mycobacterium
VHSGTLLLTEFFGTRTSAM

SEQ ID NO: 746018 - protein, 19 aa, Mycobacterium
VHSLLSWVAAALTKKPDFV

SEQ ID NO: 746019 - protein, 24 aa, Mycobacterium
VHSPARWAWDRTFRDHEMASRAGR

SEQ ID NO: 746020 - protein, 19 aa, Mycobacterium
VHTAASLLARHTGPVRVGY

SEQ ID NO: 746021 - protein, 18 aa, Mycobacterium
VHTAGGPAAAWVYIDHRV

SEQ ID NO: 746022 - protein, 18 aa, Mycobacterium
VHTARAALRPGVGPGGPV

SEQ ID NO: 746023 - protein, 18 aa, Mycobacterium
VHTARALLNFPISGMPIS

SEQ ID NO: 746024 - protein, 18 aa, Mycobacterium
VHTARWVTPTGAVHYSIA

SEQ ID NO: 746025 - protein, 17 aa, Mycobacterium
VHTCPGAPIARAEVRVS

SEQ ID NO: 746026 - protein, 21 aa, Mycobacterium
VHTEECRKLGLPFAADPSQQL

SEQ ID NO: 746027 - protein, 20 aa, Mycobacterium
VHTEECRKLGLSFAADPSQQ

SEQ ID NO: 746028 - protein, 17 aa, Mycobacterium
VHTEFRKLVSRGFTPRQ

SEQ ID NO: 746029 - protein, 18 aa, Mycobacterium
VHTGWWTRFLATRDGGEA

SEQ ID NO: 746030 - protein, 18 aa, Mycobacterium
VHTLCGPLSGIALNLLPP

SEQ ID NO: 746031 - protein, 18 aa, Mycobacterium
VHTLLDFHFHPHITAPSG

SEQ ID NO: 746032 - protein, 18 aa, Mycobacterium
VHTLLDFHFHPHVVAPSG

SEQ ID NO: 746033 - protein, 25 aa, Mycobacterium
VHTLRRAGERFGFAVEAMSLVSEHH

SEQ ID NO: 746034 - protein, 18 aa, Mycobacterium
VHTPTLLIVGGRDELVLE

SEQ ID NO: 746035 - protein, 20 aa, Mycobacterium
VHTRRGKPVIPAWEDVLLGV

SEQ ID NO: 746036 - protein, 25 aa, Mycobacterium
VHVAEVFPGAAGVAVRILRLLAAAE

SEQ ID NO: 746037 - protein, 24 aa, Mycobacterium
VHVARAVAHLVDLPLEVAVPSLTV

SEQ ID NO: 746038 - protein, 28 aa, Mycobacterium
VHVAVRPGQDWALLLAMVAVILGEGLEH

SEQ ID NO: 746039 - protein, 23 aa, Mycobacterium
VHVGCRRIDRPVAHHNILFGDAW

SEQ ID NO: 746040 - protein, 25 aa, Mycobacterium
VHVGLPMRCVFALTAMGFLPQSPDA

SEQ ID NO: 746041 - protein, 22 aa, Mycobacterium
VHVGQRVSVRFDNIDDVWFPLF

SEQ ID NO: 746042 - protein, 18 aa, Mycobacterium
VHVIGRFASTDALPAEFT

SEQ ID NO: 746043 - protein, 26 aa, Mycobacterium
VHVLAHDWGSVGIWEYLSRQGSAARM

SEQ ID NO: 746044 - protein, 21 aa, Mycobacterium
VHVLIVRPGFVIGHMTEGMEP

SEQ ID NO: 746045 - protein, 19 aa, Mycobacterium
VHVNPDIAPWISGSSSRVI

SEQ ID NO: 746046 - protein, 17 aa, Mycobacterium
VHVPFCATRCGYCDFNT

SEQ ID NO: 746047 - protein, 23 aa, Mycobacterium
VHVPQCPRRWRYLSPAIPADPDG

SEQ ID NO: 746048 - protein, 23 aa, Mycobacterium
VHVPQCPRRWRYLSPAIPADPGG

SEQ ID NO: 746049 - protein, 27 aa, Mycobacterium
VHVPRLVRREELPSGKPLEVRSDATYL

SEQ ID NO: 746050 - protein, 17 aa, Mycobacterium
VHVRGSVVLHRLYEKNR

SEQ ID NO: 746051 - protein, 31 aa, Mycobacterium
VHVRIASPPVKWPCFYGIDFATPAELIANAA

SEQ ID NO: 746052 - protein, 19 aa, Mycobacterium
VHVRPCEWLSSPMPEQDVP

SEQ ID NO: 746053 - protein, 20 aa, Mycobacterium
VHVRPCQWLDAPLTESRCPT

SEQ ID NO: 746054 - protein, 18 aa, Mycobacterium
VHVRRGQPRVGQRGANHP

SEQ ID NO: 746055 - protein, 18 aa, Mycobacterium
VHVRRLREKLGDDPEHGE

SEQ ID NO: 746056 - protein, 32 aa, Mycobacterium
VHVSSGMGGLQCRRHSGAVPPRPLPSHRSARR

SEQ ID NO: 746057 - protein, 24 aa, Mycobacterium
VHVTDVDAGRRWYATLFGRPEGNN

SEQ ID NO: 746058 - protein, 20 aa, Mycobacterium
VHVVGFRDGKSFYRNRFVQT

SEQ ID NO: 746059 - protein, 25 aa, Mycobacterium
VHWVAPADAVWACRTLAATHYASGG

SEQ ID NO: 746060 - protein, 24 aa, Mycobacterium
VHYAKAFGAKGIRIHSMDQFAEVF

SEQ ID NO: 746061 - protein, 18 aa, Mycobacterium
VHYCLGANLARLELRVLF

SEQ ID NO: 746062 - protein, 19 aa, Mycobacterium
VHYHCARPASGLIIPVLAA

SEQ ID NO: 746063 - protein, 22 aa, Mycobacterium
VHYNRIELVLPKGVAEFVDTCE

SEQ ID NO: 746064 - protein, 19 aa, Mycobacterium
VHYPFPTMDLVVLDDALKY

SEQ ID NO: 746065 - protein, 24 aa, Mycobacterium
VHYPGDVFAGFGIGAGLAVLGARV

SEQ ID NO: 746066 - protein, 24 aa, Mycobacterium
VHYPGDVLAGFGIGAGVAVLGGRL

SEQ ID NO: 746067 - protein, 19 aa, Mycobacterium
VHYRDGWEFVERSTQAYDI

SEQ ID NO: 746068 - protein, 18 aa, Mycobacterium
VHYRRFGVERSWRSLASL

SEQ ID NO: 746069 - protein, 26 aa, Mycobacterium
VHYVMECLQLMALRAASTIEVKQRAY

SEQ ID NO: 746070 - protein, 25 aa, Mycobacterium
VHYVMECLQLMALRKATTLEVTQRA

SEQ ID NO: 746071 - protein, 18 aa, Mycobacterium
VIAAAQWVRSELDYVPGT

SEQ ID NO: 746072 - protein, 18 aa, Mycobacterium
VIAAGLFMKQSRCAEVAY

SEQ ID NO: 746073 - protein, 21 aa, Mycobacterium
VIAANRAELLMLIATNVLGQN

SEQ ID NO: 746074 - protein, 17 aa, Mycobacterium
VIAANRALLATLIATNI

SEQ ID NO: 746075 - protein, 25 aa, Mycobacterium
VIAANRALLMGLVFTNIFGQNTPAI

SEQ ID NO: 746076 - protein, 25 aa, Mycobacterium
VIAANRAQLMMLIATNFFGQNLPAI

SEQ ID NO: 746077 - protein, 22 aa, Mycobacterium
VIAARTDFVLAFHAQPEMGGLR

SEQ ID NO: 746078 - protein, 18 aa, Mycobacterium
VIAASLYFMRTLGAGMGG

SEQ ID NO: 746079 - protein, 24 aa, Mycobacterium
VIAASRSGPGWALGTAALATAKSI

SEQ ID NO: 746080 - protein, 17 aa, Mycobacterium
VIAATLAEVQWAAAGYI

SEQ ID NO: 746081 - protein, 20 aa, Mycobacterium
VIAAVPCGECHECRKGWMAV

SEQ ID NO: 746082 - protein, 18 aa, Mycobacterium
VIACFRDGGGLSYAEYPR

SEQ ID NO: 746083 - protein, 24 aa, Mycobacterium
VIACGDCALNRGVFADAYGVVGAV

SEQ ID NO: 746084 - protein, 25 aa, Mycobacterium
VIADALKRAGLRPADVGYLEAHGTG

SEQ ID NO: 746085 - protein, 23 aa, Mycobacterium
VIADGPIPLARLIPAGVDIRGNS

SEQ ID NO: 746086 - protein, 18 aa, Mycobacterium
VIADGWTYSQWVVGNTRM

SEQ ID NO: 746087 - protein, 24 aa, Mycobacterium
VIADSRAGLVVALREVADGDAPYQ

SEQ ID NO: 746088 - protein, 19 aa, Mycobacterium
VIADWPQPSGIALDQVAAQ

SEQ ID NO: 746089 - protein, 17 aa, Mycobacterium
VIAEAGALKAVTVSTQM

SEQ ID NO: 746090 - protein, 24 aa, Mycobacterium
VIAEHASQIFAPRRSRRRRKATTR

SEQ ID NO: 746091 - protein, 22 aa, Mycobacterium
VIAEIHSLRLLNLRRATRAISG

SEQ ID NO: 746092 - protein, 19 aa, Mycobacterium
VIAESLPLTGLGKPDKKAV

SEQ ID NO: 746093 - protein, 21 aa, Mycobacterium
VIAGALGNWLMSRGVAVSPTA

SEQ ID NO: 746094 - protein, 24 aa, Mycobacterium
VIAGHSMGGIAISSWSERLPHRVA

SEQ ID NO: 746095 - protein, 23 aa, Mycobacterium
VIAGLAADNGWSGVIVNGAVRDA

SEQ ID NO: 746096 - protein, 30 aa, Mycobacterium
VIAGLNFPFFPRFCGQMFAHLGDRDLALKC

SEQ ID NO: 746097 - protein, 18 aa, Mycobacterium
VIAHAIPDLYERIAPRPT

SEQ ID NO: 746098 - protein, 24 aa, Mycobacterium
VIAHGMLTMGLGAGFVSSWSGDPG

SEQ ID NO: 746099 - protein, 24 aa, Mycobacterium
VIAIEGDSAFGFSGMEVETICRYR

SEQ ID NO: 746100 - protein, 17 aa, Mycobacterium
VIAIPLAVPQGGATNER

SEQ ID NO: 746101 - protein, 24 aa, Mycobacterium
VIAKLGPGVTGWSEGDRVIVAAGR

SEQ ID NO: 746102 - protein, 23 aa, Mycobacterium
VIAKRGHIPLGYYKDEKKTAETF

SEQ ID NO: 746103 - protein, 19 aa, Mycobacterium
VIALGESQSAMFLTTYINA

SEQ ID NO: 746104 - protein, 19 aa, Mycobacterium
VIALTPARLLMVVITDSGR

SEQ ID NO: 746105 - protein, 28 aa, Mycobacterium
VIAMLACARLGIMHSVVFAGFTAKALQA

SEQ ID NO: 746106 - protein, 28 aa, Mycobacterium
VIAMLACARLGIMHSVVFGGFTANALHA

SEQ ID NO: 746107 - protein, 27 aa, Mycobacterium
VIAMLACARLGIMHTVVFGGFTAHALR

SEQ ID NO: 746108 - protein, 17 aa, Mycobacterium
VIAPHWALLTALARHAS

SEQ ID NO: 746109 - protein, 19 aa, Mycobacterium
VIAPLGVAEHEWAGDARIR

SEQ ID NO: 746110 - protein, 17 aa, Mycobacterium
VIAPSCGFYSEQRPCHE

SEQ ID NO: 746111 - protein, 23 aa, Mycobacterium
VIAQLKFPGYFLVVHDITQFCRR

SEQ ID NO: 746112 - protein, 18 aa, Mycobacterium
VIAQLSFPGYFLVVHDIT

SEQ ID NO: 746113 - protein, 17 aa, Mycobacterium
VIARCRTSVELLAPHAC

SEQ ID NO: 746114 - protein, 17 aa, Mycobacterium
VIARCRTSVELLAPHAD

SEQ ID NO: 746115 - protein, 24 aa, Mycobacterium
VIARERPHRLVVCRDDDWRPQWRV

SEQ ID NO: 746116 - protein, 23 aa, Mycobacterium
VIASLEMQHFISLGPNAPDPSQI

SEQ ID NO: 746117 - protein, 20 aa, Mycobacterium
VIASRAKLQIGRSGRHIAQE

SEQ ID NO: 746118 - protein, 18 aa, Mycobacterium
VIASRSPIALSVTLEAVR

SEQ ID NO: 746119 - protein, 18 aa, Mycobacterium
VIATAFPHAVEVLGNGAG

SEQ ID NO: 746120 - protein, 24 aa, Mycobacterium
VIAVTRLDAGFGQHLAPLADFLVR

SEQ ID NO: 746121 - protein, 21 aa, Mycobacterium
VIAYALAGTMDFDFDEQPLGK

SEQ ID NO: 746122 - protein, 19 aa, Mycobacterium
VIAYGRCVHDALSAADTLG

SEQ ID NO: 746123 - protein, 26 aa, Mycobacterium
VICAEPRLAGLGGRFWFSVDDGRADV

SEQ ID NO: 746124 - protein, 27 aa, Mycobacterium
VICDKGFPAYFLIVADLINYAKSVGIR

SEQ ID NO: 746125 - protein, 27 aa, Mycobacterium
VICDKGFPSYFLIVADLINYARSVDIR

SEQ ID NO: 746126 - protein, 27 aa, Mycobacterium
VICDKGFPSYFLIVADLINYARSVGIR

SEQ ID NO: 746127 - protein, 29 aa, Mycobacterium
VICHAGGRSLRVANYLARNGYTPINVEGG

SEQ ID NO: 746128 - protein, 20 aa, Mycobacterium
VICRHCPVMQECAADALDNK

SEQ ID NO: 746129 - protein, 20 aa, Mycobacterium
VICRHCPVMQECGADALDNK

SEQ ID NO: 746130 - protein, 25 aa, Mycobacterium
VICSFPRQADSYVFDALYRAGKVDL

SEQ ID NO: 746131 - protein, 24 aa, Mycobacterium
VICSSSPAVASRCAYARAGVGVVA

SEQ ID NO: 746132 - protein, 33 aa, Mycobacterium
VICTLCSCFPWPVLGLPPYWYKDPVFRARAARE

SEQ ID NO: 746133 - protein, 17 aa, Mycobacterium
VIDAADGVRHWAVAARG

SEQ ID NO: 746134 - protein, 19 aa, Mycobacterium
VIDADFLTDMGFVVVAPHR

SEQ ID NO: 746135 - protein, 18 aa, Mycobacterium
VIDADGWFHTGDLGAIDD

SEQ ID NO: 746136 - protein, 18 aa, Mycobacterium
VIDAKRGKMFAKLIKNIE

SEQ ID NO: 746137 - protein, 18 aa, Mycobacterium
VIDALKIHPNINASYNEE

SEQ ID NO: 746138 - protein, 18 aa, Mycobacterium
VIDALKIHPNINASYNEQ

SEQ ID NO: 746139 - protein, 17 aa, Mycobacterium
VIDALKIHPNVNASYNE

SEQ ID NO: 746140 - protein, 25 aa, Mycobacterium
VIDARGQVLLPGFVDLHTHLREPGR

SEQ ID NO: 746141 - protein, 18 aa, Mycobacterium
VIDATTWTPGQLRDVVAT

SEQ ID NO: 746142 - protein, 24 aa, Mycobacterium
VIDAWRPGQRLDLYQEFRSAVRRS

SEQ ID NO: 746143 - protein, 19 aa, Mycobacterium
VIDDFWLLREYLPDAARIN

SEQ ID NO: 746144 - protein, 17 aa, Mycobacterium
VIDEARAWAVRRVESTL

SEQ ID NO: 746145 - protein, 22 aa, Mycobacterium
VIDELTRWGVERFSIEALSERH

SEQ ID NO: 746146 - protein, 22 aa, Mycobacterium
VIDEVRGAPGLVYAYTSDLDTA

SEQ ID NO: 746147 - protein, 23 aa, Mycobacterium
VIDFPVLKPTSVMFGGPDLDVLY

SEQ ID NO: 746148 - protein, 22 aa, Mycobacterium
VIDGCVQLHGGYGYMTEYRVAR

SEQ ID NO: 746149 - protein, 17 aa, Mycobacterium
VIDGDPGTELILRGSED

SEQ ID NO: 746150 - protein, 17 aa, Mycobacterium
VIDGRLLVADAWHHRIL

SEQ ID NO: 746151 - protein, 25 aa, Mycobacterium
VIDGSGADALWFLPLLGQDARDLIE

SEQ ID NO: 746152 - protein, 23 aa, Mycobacterium
VIDGSGADALWFVPLLAQDALDK

SEQ ID NO: 746153 - protein, 20 aa, Mycobacterium
VIDGWSLPILLREIFAIYFG

SEQ ID NO: 746154 - protein, 19 aa, Mycobacterium
VIDGYRLVYRADSMVNWCP

SEQ ID NO: 746155 - protein, 21 aa, Mycobacterium
VIDIGELRDGALLPGLAAGAL

SEQ ID NO: 746156 - protein, 24 aa, Mycobacterium
VIDIRQCRPNGGANIAALVSATAA

SEQ ID NO: 746157 - protein, 21 aa, Mycobacterium
VIDLIMPIGKGQRALIVSPPK

SEQ ID NO: 746158 - protein, 24 aa, Mycobacterium
VIDLKSDFLSGGAPFERAVSGDDI

SEQ ID NO: 746159 - protein, 19 aa, Mycobacterium
VIDLKSDFLSSGSPFERPV

SEQ ID NO: 746160 - protein, 25 aa, Mycobacterium
VIDLVPPVVIGWVMGVYTGLQLSRF

SEQ ID NO: 746161 - protein, 24 aa, Mycobacterium
VIDNIRYFAELCGVDGQAADEVID

SEQ ID NO: 746162 - protein, 25 aa, Mycobacterium
VIDPELRRPITELGMVKDITFDDAH

SEQ ID NO: 746163 - protein, 23 aa, Mycobacterium
VIDPGLGFAKTGHHNWALLRALP

SEQ ID NO: 746164 - protein, 18 aa, Mycobacterium
VIDPRLGPVEYRQATWRA

SEQ ID NO: 746165 - protein, 17 aa, Mycobacterium
VIDSAVSLGDWPIPLPR

SEQ ID NO: 746166 - protein, 20 aa, Mycobacterium
VIDSYRLVYRADSMVNWCPG

SEQ ID NO: 746167 - protein, 25 aa, Mycobacterium
VIDTPRCADPLLPLESSEIDAVRTI

SEQ ID NO: 746168 - protein, 25 aa, Mycobacterium
VIDVDFPFLGCCYGVGTVGTAVGAV

SEQ ID NO: 746169 - protein, 19 aa, Mycobacterium
VIDWARRTGGMIIEDDYDG

SEQ ID NO: 746170 - protein, 19 aa, Mycobacterium
VIDYEMAWELQRDIVEARV

SEQ ID NO: 746171 - protein, 20 aa, Mycobacterium
VIEAAEALMLAIVHNISDRV

SEQ ID NO: 746172 - protein, 23 aa, Mycobacterium
VIEAALPGLHDWVDEALAARGIV

SEQ ID NO: 746173 - protein, 19 aa, Mycobacterium
VIEAGGLYVLGTERHESRR

SEQ ID NO: 746174 - protein, 21 aa, Mycobacterium
VIEAISVAMFEYIDWMSQQVV

SEQ ID NO: 746175 - protein, 28 aa, Mycobacterium
VIEALELLYTGTMVWAGMGYDSYEQVVR

SEQ ID NO: 746176 - protein, 18 aa, Mycobacterium
VIEDLWPGQGPLVAMGQG

SEQ ID NO: 746177 - protein, 19 aa, Mycobacterium
VIEEGFPIAELREIVADMS

SEQ ID NO: 746178 - protein, 25 aa, Mycobacterium
VIEFKTARHLEDWGDFFTDQAPADY

SEQ ID NO: 746179 - protein, 22 aa, Mycobacterium
VIEFKTRVLASLGAQPATERRT

SEQ ID NO: 746180 - protein, 23 aa, Mycobacterium
VIEGDPRIGTLMFGNNPANSVIA

SEQ ID NO: 746181 - protein, 19 aa, Mycobacterium
VIEGEPHIHCDLRFGTEGT

SEQ ID NO: 746182 - protein, 23 aa, Mycobacterium
VIEGQAKVVSWYDNEWGYSNRLI

SEQ ID NO: 746183 - protein, 17 aa, Mycobacterium
VIEHLWDQAQFVAECAR

SEQ ID NO: 746184 - protein, 17 aa, Mycobacterium
VIEHLWDQAQFVSECFR

SEQ ID NO: 746185 - protein, 21 aa, Mycobacterium
VIEINEAFAAVALASARELGL

SEQ ID NO: 746186 - protein, 18 aa, Mycobacterium
VIEIPGLPPITIPLLAPP

SEQ ID NO: 746187 - protein, 20 aa, Mycobacterium
VIEIQRLRLADGSPISLELA

SEQ ID NO: 746188 - protein, 20 aa, Mycobacterium
VIEKMRVAGQIAARALVEAG

SEQ ID NO: 746189 - protein, 20 aa, Mycobacterium
VIEPDLSNSVPFLAAAVVSG

SEQ ID NO: 746190 - protein, 24 aa, Mycobacterium
VIEPGRLVYRGALGDTHRHTHAAV

SEQ ID NO: 746191 - protein, 24 aa, Mycobacterium
VIEPLEPGFGYTLGNSLRRTLLSS

SEQ ID NO: 746192 - protein, 17 aa, Mycobacterium
VIEQALRKAKARIAADP

SEQ ID NO: 746193 - protein, 21 aa, Mycobacterium
VIEQITYLLFIRRLDDLETLE

SEQ ID NO: 746194 - protein, 25 aa, Mycobacterium
VIEQMPLDAGHQWRRDAALSAEDVL

SEQ ID NO: 746195 - protein, 29 aa, Mycobacterium
VIEQMPLDAGHQWRRGAALSADDVLDTLR

SEQ ID NO: 746196 - protein, 25 aa, Mycobacterium
VIEQMPLDAGHQWRRNALLGSDDVL

SEQ ID NO: 746197 - protein, 17 aa, Mycobacterium
VIERALLRELDQPAPDA

SEQ ID NO: 746198 - protein, 17 aa, Mycobacterium
VIERLATGHGWRIGVVA

SEQ ID NO: 746199 - protein, 23 aa, Mycobacterium
VIESMASVSAHVWLGQNGGGTVV

SEQ ID NO: 746200 - protein, 19 aa, Mycobacterium
VIEVDGLRVGPMICFDVEF

SEQ ID NO: 746201 - protein, 29 aa, Mycobacterium
VIEVPDLDTALAWARRCPAAEWGSVEIRP

SEQ ID NO: 746202 - protein, 22 aa, Mycobacterium
VIEVRGTAHAAGPAGATDPAGA

SEQ ID NO: 746203 - protein, 21 aa, Mycobacterium
VIEVVNLFRAKVVDVSPESVT

SEQ ID NO: 746204 - protein, 32 aa, Mycobacterium
VIFDLPVGDWALRPTAEFGYRACEAAARGEAA

SEQ ID NO: 746205 - protein, 22 aa, Mycobacterium
VIGASNRFAHAAALAIAEAPAR

SEQ ID NO: 746206 - protein, 17 aa, Mycobacterium
VIGCGPIGLAVISMLKS

SEQ ID NO: 746207 - protein, 17 aa, Mycobacterium
VIGCGPVGIAVIAALKL

SEQ ID NO: 746208 - protein, 18 aa, Mycobacterium
VIGCLKARVVPVNVNHHY

SEQ ID NO: 746209 - protein, 27 aa, Mycobacterium
VIGDGGDGGVGGWGVLAAAGGKGGDAI

SEQ ID NO: 746210 - protein, 19 aa, Mycobacterium
VIGDLASVIGRFRRQLRRA

SEQ ID NO: 746211 - protein, 23 aa, Mycobacterium
VIGECWSGGFALAAAVDDSVLAP

SEQ ID NO: 746212 - protein, 25 aa, Mycobacterium
VIGEFPPDRGWDIERLFDPDPDALG

SEQ ID NO: 746213 - protein, 19 aa, Mycobacterium
VIGELPLTVNGKLDRRALP

SEQ ID NO: 746214 - protein, 25 aa, Mycobacterium
VIGFFPANAVGPGFEDIEVYTDDTR

SEQ ID NO: 746215 - protein, 24 aa, Mycobacterium
VIGGAKRGKAIIILNPADPPMIMR

SEQ ID NO: 746216 - protein, 20 aa, Mycobacterium
VIGGEQIYTLALPRAIRCEV

SEQ ID NO: 746217 - protein, 20 aa, Mycobacterium
VIGLGRYIPRIARIAEATEL

SEQ ID NO: 746218 - protein, 24 aa, Mycobacterium
VIGMDFRPGLPIRLMPRQQAQRSY

SEQ ID NO: 746219 - protein, 24 aa, Mycobacterium
VIGPELPLVLGVADAVRAAGIVCF

SEQ ID NO: 746220 - protein, 31 aa, Mycobacterium
VIGPQAATLVQIFVVALNFGITAAELARRPY

SEQ ID NO: 746221 - protein, 19 aa, Mycobacterium
VIGPWNFPLNLVVLPAVAA

SEQ ID NO: 746222 - protein, 20 aa, Mycobacterium
VIGPWNFPVNLVVLPASAAF

SEQ ID NO: 746223 - protein, 17 aa, Mycobacterium
VIGSALAAVLVRGPDGL

SEQ ID NO: 746224 - protein, 17 aa, Mycobacterium
VIGSCRDAIEWFGRANL

SEQ ID NO: 746225 - protein, 20 aa, Mycobacterium
VIGTELGWSREVWSQLADTG

SEQ ID NO: 746226 - protein, 20 aa, Mycobacterium
VIGVCAEYDALPGIGHACGH

SEQ ID NO: 746227 - protein, 21 aa, Mycobacterium
VIGVDCGRTLAHIADHITELP

SEQ ID NO: 746228 - protein, 25 aa, Mycobacterium
VIGVPLPGAVAWHGVPQWFARRKDR

SEQ ID NO: 746229 - protein, 19 aa, Mycobacterium
VIGYHALRVAVPREHLLAE

SEQ ID NO: 746230 - protein, 19 aa, Mycobacterium
VIHDSFRQLWFGWSDPARV

SEQ ID NO: 746231 - protein, 18 aa, Mycobacterium
VIHGIKAFVPILLERGEG

SEQ ID NO: 746232 - protein, 19 aa, Mycobacterium
VIHGRLYKLDPFRYELVDI

SEQ ID NO: 746233 - protein, 22 aa, Mycobacterium
VIHLCQPGRSFGATCVNEPGCL

SEQ ID NO: 746234 - protein, 24 aa, Mycobacterium
VIHVPEIPAHVDASAPINIPLTAN

SEQ ID NO: 746235 - protein, 17 aa, Mycobacterium
VIIAGYRADLDKFLDTN

SEQ ID NO: 746236 - protein, 20 aa, Mycobacterium
VIICAGGFIANTEWVQRFAP

SEQ ID NO: 746237 - protein, 18 aa, Mycobacterium
VIICGKPNFYTGRGTFSL

SEQ ID NO: 746238 - protein, 19 aa, Mycobacterium
VIIDDAWRGALPPGGEVRI

SEQ ID NO: 746239 - protein, 21 aa, Mycobacterium
VIIEAVTVYGARSVTLSGSSL

SEQ ID NO: 746240 - protein, 18 aa, Mycobacterium
VIILPWNIAHEVRTQLAD

SEQ ID NO: 746241 - protein, 25 aa, Mycobacterium
VIISDFLGPINWMRPLRAIGGRHEV

SEQ ID NO: 746242 - protein, 24 aa, Mycobacterium
VIKAEIPEVELVRYAIDLRSMSHG

SEQ ID NO: 746243 - protein, 25 aa, Mycobacterium
VIKDGRPVDFGSFLIPRTEYEINDV

SEQ ID NO: 746244 - protein, 25 aa, Mycobacterium
VIKDGRPVDFGSFLIPRTEYTIDDV

SEQ ID NO: 746245 - protein, 18 aa, Mycobacterium
VIKERRPSAQFVAVEPAA

SEQ ID NO: 746246 - protein, 17 aa, Mycobacterium
VIKEVPAGGMLVNHLAF

SEQ ID NO: 746247 - protein, 20 aa, Mycobacterium
VIKLLRPLRSATITINGATQ

SEQ ID NO: 746248 - protein, 23 aa, Mycobacterium
VIKQRRSLLPAGITSVTGRFHGG

SEQ ID NO: 746249 - protein, 17 aa, Mycobacterium
VIKRQLHKDALRNLHDA

SEQ ID NO: 746250 - protein, 18 aa, Mycobacterium
VILACGGHTRIWRHTSSR

SEQ ID NO: 746251 - protein, 19 aa, Mycobacterium
VILANRLSPALTFGGANLN

SEQ ID NO: 746252 - protein, 25 aa, Mycobacterium
VILARRGLREAAFSVGEFLALGYLP

SEQ ID NO: 746253 - protein, 19 aa, Mycobacterium
VILASRLAANIGEYSGIEV

SEQ ID NO: 746254 - protein, 22 aa, Mycobacterium
VILGALPLFHAFGQTAGLNAAV

SEQ ID NO: 746255 - protein, 17 aa, Mycobacterium
VILHLPEEVRLVSLSAT

SEQ ID NO: 746256 - protein, 21 aa, Mycobacterium
VILIHWDDFFRPLTKPLRALP

SEQ ID NO: 746257 - protein, 19 aa, Mycobacterium
VILLHGWPYDIHSYADVSA

SEQ ID NO: 746258 - protein, 20 aa, Mycobacterium
VILQCARALADYGVEPRHLR

SEQ ID NO: 746259 - protein, 19 aa, Mycobacterium
VILQCARALSDYGVEPRHL

SEQ ID NO: 746260 - protein, 19 aa, Mycobacterium
VILQCARALSEYGVEPRHL

SEQ ID NO: 746261 - protein, 25 aa, Mycobacterium
VILRARPGTRLIVAGVCMQPDTVHP

SEQ ID NO: 746262 - protein, 23 aa, Mycobacterium
VILRGGESIAALDLESHLQTHPA

SEQ ID NO: 746263 - protein, 17 aa, Mycobacterium
VILRPDHSLGMTRTEVL

SEQ ID NO: 746264 - protein, 18 aa, Mycobacterium
VILRRGAEWFRTMGTEKS

SEQ ID NO: 746265 - protein, 31 aa, Mycobacterium
VILSGARLDPSLARRFMDTFGDILYNAYGSS

SEQ ID NO: 746266 - protein, 27 aa, Mycobacterium
VILSRSLEVPFALDFPSTYRLARRHNT

SEQ ID NO: 746267 - protein, 18 aa, Mycobacterium
VIMLGEYPGRAMLTVERL

SEQ ID NO: 746268 - protein, 17 aa, Mycobacterium
VIMLHEVRDGLIRDANN

SEQ ID NO: 746269 - protein, 21 aa, Mycobacterium
VIMLPFVRRVAEADLVLETMA

SEQ ID NO: 746270 - protein, 21 aa, Mycobacterium
VIMLPFVRRVAEADLVLQTMA

SEQ ID NO: 746271 - protein, 21 aa, Mycobacterium
VINAFARWGRHLLANRDRKET

SEQ ID NO: 746272 - protein, 28 aa, Mycobacterium
VINAPFEAAIGRDLIGNGAPGVAGVNGG

SEQ ID NO: 746273 - protein, 25 aa, Mycobacterium
VINDARFLLYPAMKELTLNIASMVF

SEQ ID NO: 746274 - protein, 18 aa, Mycobacterium
VINFPVNGILVPPHDYTA

SEQ ID NO: 746275 - protein, 18 aa, Mycobacterium
VINGAALERIDEIADNAA

SEQ ID NO: 746276 - protein, 31 aa, Mycobacterium
VINRGRYAPRSGWRKAVHRSTGGRVNPGDSR

SEQ ID NO: 746277 - protein, 17 aa, Mycobacterium
VINRNQGAFGFSEPCAD

SEQ ID NO: 746278 - protein, 24 aa, Mycobacterium
VIPALAAGCAVVIKPAEITPLTTL

SEQ ID NO: 746279 - protein, 24 aa, Mycobacterium
VIPALAAGCSVVIKPAEITPLTTL

SEQ ID NO: 746280 - protein, 22 aa, Mycobacterium
VIPDVLRHRLVLTYDALADEIS

SEQ ID NO: 746281 - protein, 21 aa, Mycobacterium
VIPEIVKHPLFELVGVGVSNP

SEQ ID NO: 746282 - protein, 17 aa, Mycobacterium
VIPGHGVTAVFGPSGSG

SEQ ID NO: 746283 - protein, 18 aa, Mycobacterium
VIPGSGLAVERIGERAHD

SEQ ID NO: 746284 - protein, 18 aa, Mycobacterium
VIPHLCVDNAAAAIDFYV

SEQ ID NO: 746285 - protein, 20 aa, Mycobacterium
VIPILSPRLNRSVISALWWV

SEQ ID NO: 746286 - protein, 24 aa, Mycobacterium
VIPPERIHTLVFGFLRGVTAVAWA

SEQ ID NO: 746287 - protein, 28 aa, Mycobacterium
VIPRASFDEQWRLTARLLASVPAGEVKR

SEQ ID NO: 746288 - protein, 19 aa, Mycobacterium
VIPVSASVWREGHEAVAAT

SEQ ID NO: 746289 - protein, 18 aa, Mycobacterium
VIQFSDLLKAPVVARSGE

SEQ ID NO: 746290 - protein, 20 aa, Mycobacterium
VIQNHLLQLLAFTAMEEPIN

SEQ ID NO: 746291 - protein, 20 aa, Mycobacterium
VIQNHLLQLLALTALEEPVS

SEQ ID NO: 746292 - protein, 25 aa, Mycobacterium
VIQRELDRYLPFLATTKVLIAAVRA

SEQ ID NO: 746293 - protein, 25 aa, Mycobacterium
VIQVLPRLDGFGVVLGGGGLLEGDI

SEQ ID NO: 746294 - protein, 18 aa, Mycobacterium
VIRAKRVILAAGTLGSTY

SEQ ID NO: 746295 - protein, 23 aa, Mycobacterium
VIRALGLNAFHIFGNSWGGMLAQ

SEQ ID NO: 746296 - protein, 21 aa, Mycobacterium
VIRDPHCPPVEMNTTALVSTP

SEQ ID NO: 746297 - protein, 17 aa, Mycobacterium
VIREFVGLPSPTAGRAG

SEQ ID NO: 746298 - protein, 22 aa, Mycobacterium
VIRERYELVRTWMLAAETSAEL

SEQ ID NO: 746299 - protein, 17 aa, Mycobacterium
VIREVYGDWAAQRGTLA

SEQ ID NO: 746300 - protein, 25 aa, Mycobacterium
VIREYRPDAAPGILIPFFASHTQKV

SEQ ID NO: 746301 - protein, 19 aa, Mycobacterium
VIRGGRPVAGVAFNSIGRF

SEQ ID NO: 746302 - protein, 25 aa, Mycobacterium
VIRKAVKKLPGWVDVATREQFEVNL

SEQ ID NO: 746303 - protein, 18 aa, Mycobacterium
VIRKRYNLFANIRPARAL

SEQ ID NO: 746304 - protein, 19 aa, Mycobacterium
VIRLRFGLDDGQPRTLDQI

SEQ ID NO: 746305 - protein, 18 aa, Mycobacterium
VIRMARDVAPDWPTSESD

SEQ ID NO: 746306 - protein, 19 aa, Mycobacterium
VIRNGRWFDGTGAPSAIRN

SEQ ID NO: 746307 - protein, 23 aa, Mycobacterium
VIRRAMSQLGVPYSWGGGNANGP

SEQ ID NO: 746308 - protein, 18 aa, Mycobacterium
VIRRLFRQLPESVDLDTR

SEQ ID NO: 746309 - protein, 17 aa, Mycobacterium
VIRRMSRVLPLMRERLE

SEQ ID NO: 746310 - protein, 17 aa, Mycobacterium
VIRSCNKAAASLFTAGQ

SEQ ID NO: 746311 - protein, 24 aa, Mycobacterium
VIRSEFPDTGILVLSAHVEVEHAT

SEQ ID NO: 746312 - protein, 19 aa, Mycobacterium
VIRSHYPVLARALLSGASG

SEQ ID NO: 746313 - protein, 17 aa, Mycobacterium
VIRTRADELVLLLVVHH

SEQ ID NO: 746314 - protein, 21 aa, Mycobacterium
VIRTRGRLWLANRPDQVMWLE

SEQ ID NO: 746315 - protein, 21 aa, Mycobacterium
VIRWAGHAHHYLAIFDQARPL

SEQ ID NO: 746316 - protein, 19 aa, Mycobacterium
VIRYTELRPFVLHVNHTGA

SEQ ID NO: 746317 - protein, 18 aa, Mycobacterium
VISAAEWSRLERGIRQRV

SEQ ID NO: 746318 - protein, 18 aa, Mycobacterium
VISAAEWTRLERGIRQRV

SEQ ID NO: 746319 - protein, 26 aa, Mycobacterium
VISAFNFPVAVWSWNTAIALVCGDTV

SEQ ID NO: 746320 - protein, 19 aa, Mycobacterium
VISDGSFTPTPVGYGGNGG

SEQ ID NO: 746321 - protein, 17 aa, Mycobacterium
VISDIWLANLVAFSGHR

SEQ ID NO: 746322 - protein, 22 aa, Mycobacterium
VISECMHIFGGSGYLVDETPLG

SEQ ID NO: 746323 - protein, 24 aa, Mycobacterium
VISERGAHYWGRYGAAGLLLRAPQ

SEQ ID NO: 746324 - protein, 20 aa, Mycobacterium
VISGLQMLLHQAFTQVELFT

SEQ ID NO: 746325 - protein, 20 aa, Mycobacterium
VISGRISYLLGLAGPALTID

SEQ ID NO: 746326 - protein, 18 aa, Mycobacterium
VISGRVAYTLGLAGPALT

SEQ ID NO: 746327 - protein, 18 aa, Mycobacterium
VISGRVAYVLGLQGPAVS

SEQ ID NO: 746328 - protein, 20 aa, Mycobacterium
VISHCLTDAVGLCEAVADAA

SEQ ID NO: 746329 - protein, 23 aa, Mycobacterium
VISLCGGVLPAALAGANPANPRG

SEQ ID NO: 746330 - protein, 19 aa, Mycobacterium
VISPGVVRQGDYITVRDIP

SEQ ID NO: 746331 - protein, 17 aa, Mycobacterium
VISPYSRGGLLAHERFD

SEQ ID NO: 746332 - protein, 18 aa, Mycobacterium
VISRLHFALGAQGTLFLG

SEQ ID NO: 746333 - protein, 21 aa, Mycobacterium
VISRRYLHAAGEYKVVITDRA

SEQ ID NO: 746334 - protein, 17 aa, Mycobacterium
VISRRYLHATGEHKVVI

SEQ ID NO: 746335 - protein, 25 aa, Mycobacterium
VISSELPELLGLCDRIYTLSAGRLT

SEQ ID NO: 746336 - protein, 32 aa, Mycobacterium
VISTPSKCGMTWTQRLVSLLVFDGPELPGPLS

SEQ ID NO: 746337 - protein, 18 aa, Mycobacterium
VISWSRANLGVLVRDHYG

SEQ ID NO: 746338 - protein, 26 aa, Mycobacterium
VITAFNFPVAVWAWNAALALVCGDPV

SEQ ID NO: 746339 - protein, 25 aa, Mycobacterium
VITAFNFPVAVWAWNIAVALVCGDT

SEQ ID NO: 746340 - protein, 24 aa, Mycobacterium
VITAFNFPVAVWAWNTAVALVCGD

SEQ ID NO: 746341 - protein, 25 aa, Mycobacterium
VITAFNFPVAVWAWNTAVALVCGNT

SEQ ID NO: 746342 - protein, 26 aa, Mycobacterium
VITAFNFPVAVWSWNTAIALVCGDTV

SEQ ID NO: 746343 - protein, 26 aa, Mycobacterium
VITCNIGDMLMRWSDDLLPSNFHRVR

SEQ ID NO: 746344 - protein, 19 aa, Mycobacterium
VITDELWDGMQAMLADIRR

SEQ ID NO: 746345 - protein, 23 aa, Mycobacterium
VITDEVYEALVFDGHRHLTLASY

SEQ ID NO: 746346 - protein, 25 aa, Mycobacterium
VITEPMPSMPVFFWNDDDGSRYRAA

SEQ ID NO: 746347 - protein, 17 aa, Mycobacterium
VITFGGGVNEVMREMVS

SEQ ID NO: 746348 - protein, 19 aa, Mycobacterium
VITLLELGAQAARPVMFST

SEQ ID NO: 746349 - protein, 34 aa, Mycobacterium
VITPFNFPIAIPAWKIAPALVYGNTVVWKPASTV

SEQ ID NO: 746350 - protein, 17 aa, Mycobacterium
VITPGYDLRYLVGSRAQ

SEQ ID NO: 746351 - protein, 40 aa, Mycobacterium
VITQHRPGRLVVCLDLDWRPQFRVDLISSYKAHRVAETEP

SEQ ID NO: 746352 - protein, 42 aa, Mycobacterium
VITQHRPSRLAVCLDLDWRPQFRVDLIPSYKAHRVAEPEPAG

SEQ ID NO: 746353 - protein, 18 aa, Mycobacterium
VITRMAGVPEDFRQQVRH

SEQ ID NO: 746354 - protein, 17 aa, Mycobacterium
VIVAAGRPCMSCPNCLR

SEQ ID NO: 746355 - protein, 18 aa, Mycobacterium
VIVAEGTPCLGPVTHAGC

SEQ ID NO: 746356 - protein, 17 aa, Mycobacterium
VIVAPGYADGAVEVLSR

SEQ ID NO: 746357 - protein, 21 aa, Mycobacterium
VIVCAGGFIANSEWIKRYAPR

SEQ ID NO: 746358 - protein, 20 aa, Mycobacterium
VIVDLCTGSGALAVALARHR

SEQ ID NO: 746359 - protein, 17 aa, Mycobacterium
VIVESAALLGLADESTL

SEQ ID NO: 746360 - protein, 17 aa, Mycobacterium
VIVESAVLLDRAGEHLL

SEQ ID NO: 746361 - protein, 18 aa, Mycobacterium
VIVESAVLLSGTDESTLV

SEQ ID NO: 746362 - protein, 19 aa, Mycobacterium
VIVEYQLSYPGMRMVDVEP

SEQ ID NO: 746363 - protein, 18 aa, Mycobacterium
VIVGFRIPYITGQDTEPL

SEQ ID NO: 746364 - protein, 19 aa, Mycobacterium
VIVGFRIPYIVGPDTEPLD

SEQ ID NO: 746365 - protein, 18 aa, Mycobacterium
VIVGFRMPYIKGPDTEPL

SEQ ID NO: 746366 - protein, 26 aa, Mycobacterium
VIVGLQLALTRLWRVYGVEPDAVIGH

SEQ ID NO: 746367 - protein, 24 aa, Mycobacterium
VIVGPRIYPSGGFISQTGGHGDFR

SEQ ID NO: 746368 - protein, 19 aa, Mycobacterium
VIVGTLWTNTMFKPRNGLV

SEQ ID NO: 746369 - protein, 21 aa, Mycobacterium
VIVGVFAMRAHHHFGGPSADY

SEQ ID NO: 746370 - protein, 29 aa, Mycobacterium
VIVHPLITCGLCRACRSGDDVHCESNAFP

SEQ ID NO: 746371 - protein, 25 aa, Mycobacterium
VIVHRGVALTSHYQCGDLYRIDPCT

SEQ ID NO: 746372 - protein, 17 aa, Mycobacterium
VIVLLNLSRDQLDRVGE

SEQ ID NO: 746373 - protein, 18 aa, Mycobacterium
VIVLPTYTYGTWSEKVVA

SEQ ID NO: 746374 - protein, 17 aa, Mycobacterium
VIVNSGLVFEGPLHRKA

SEQ ID NO: 746375 - protein, 19 aa, Mycobacterium
VIVRQMLRRVTIIDSGATE

SEQ ID NO: 746376 - protein, 22 aa, Mycobacterium
VIVVGPGHKWAHRRKPVTLREL

SEQ ID NO: 746377 - protein, 18 aa, Mycobacterium
VIVVPGVTSAIAVPALAG

SEQ ID NO: 746378 - protein, 25 aa, Mycobacterium
VIYLQHGFGAIGWFYQPLAMQLAQQ

SEQ ID NO: 746379 - protein, 18 aa, Mycobacterium
VIYQYSFFRNPHWSRVFA

SEQ ID NO: 746380 - protein, 25 aa, Mycobacterium
VIYRDFRPVAVLDWEMATIGPREFD

SEQ ID NO: 746381 - protein, 18 aa, Mycobacterium
VIYTPGRHTFDRAGIGTR

SEQ ID NO: 746382 - protein, 19 aa, Mycobacterium
VIYWGQEALAFGMTKHPNA

SEQ ID NO: 746383 - protein, 17 aa, Mycobacterium
VKAAHAYPGELVGLATG

SEQ ID NO: 746384 - protein, 19 aa, Mycobacterium
VKAAIAWARANVDKFGGDR

SEQ ID NO: 746385 - protein, 21 aa, Mycobacterium
VKAALPVWKHQFFANGTDEWV

SEQ ID NO: 746386 - protein, 24 aa, Mycobacterium
VKAALRYADALIWTPAHLAADDAA

SEQ ID NO: 746387 - protein, 22 aa, Mycobacterium
VKAARPAVRIVAVQAAGAAAWP

SEQ ID NO: 746388 - protein, 17 aa, Mycobacterium
VKAAVTGSGRADKSQVT

SEQ ID NO: 746389 - protein, 25 aa, Mycobacterium
VKACGICGSDLHFAQHGEDLLASTA

SEQ ID NO: 746390 - protein, 21 aa, Mycobacterium
VKAEEFGAEVIRQFRQDIHIW

SEQ ID NO: 746391 - protein, 21 aa, Mycobacterium
VKAELVCKDFGALKVLKGITL

SEQ ID NO: 746392 - protein, 22 aa, Mycobacterium
VKAGGTCNRAAPSGATLAPSTR

SEQ ID NO: 746393 - protein, 20 aa, Mycobacterium
VKAHGIGGEIVVEIRTDDPD

SEQ ID NO: 746394 - protein, 22 aa, Mycobacterium
VKAHRGLTHFRRLRSPEPWIER

SEQ ID NO: 746395 - protein, 26 aa, Mycobacterium
VKAHSRTPFRQHVWDRLAEGIRFVQG

SEQ ID NO: 746396 - protein, 21 aa, Mycobacterium
VKAKDRGLWNLFLPAESGLTN

SEQ ID NO: 746397 - protein, 19 aa, Mycobacterium
VKAKKLAIVYLTYKLADGR

SEQ ID NO: 746398 - protein, 26 aa, Mycobacterium
VKALAERGIAEPFPIQAATLPDSLAG

SEQ ID NO: 746399 - protein, 17 aa, Mycobacterium
VKALAKFNVEPTRENLE

SEQ ID NO: 746400 - protein, 18 aa, Mycobacterium
VKALIAVDPVRARAVASI

SEQ ID NO: 746401 - protein, 20 aa, Mycobacterium
VKALKAAELQVMPGEFVCLM

SEQ ID NO: 746402 - protein, 19 aa, Mycobacterium
VKALLELDQSFARLRSEAA

SEQ ID NO: 746403 - protein, 18 aa, Mycobacterium
VKALRARQQRNFLTTLLL

SEQ ID NO: 746404 - protein, 25 aa, Mycobacterium
VKALYTPWAARAWARAGVDPRKLHN

SEQ ID NO: 746405 - protein, 25 aa, Mycobacterium
VKAMARPTLRHRIGLRPEAELEGAT

SEQ ID NO: 746406 - protein, 19 aa, Mycobacterium
VKAMMVFSGMSAAAGPASD

SEQ ID NO: 746407 - protein, 24 aa, Mycobacterium
VKANLFYRGLTFHRFPVIGDTVYT

SEQ ID NO: 746408 - protein, 20 aa, Mycobacterium
VKANVDIAGRTVIEKDANSS

SEQ ID NO: 746409 - protein, 18 aa, Mycobacterium
VKANWKLYMDAFQEFYHA

SEQ ID NO: 746410 - protein, 20 aa, Mycobacterium
VKAQIFLALLGKQYGVTPKG

SEQ ID NO: 746411 - protein, 24 aa, Mycobacterium
VKAQLARWLAPRGLVFNEDKTRIV

SEQ ID NO: 746412 - protein, 17 aa, Mycobacterium
VKAQLGFDVPVRAVFEA

SEQ ID NO: 746413 - protein, 23 aa, Mycobacterium
VKARHLRSGRIVTLPADYIAEHV

SEQ ID NO: 746414 - protein, 17 aa, Mycobacterium
VKARKWAAAELNPQLFA

SEQ ID NO: 746415 - protein, 26 aa, Mycobacterium
VKASAYRCGESWSTLVAHRPTGRRLL

SEQ ID NO: 746416 - protein, 17 aa, Mycobacterium
VKASMFFSPGGVTKFIE

SEQ ID NO: 746417 - protein, 20 aa, Mycobacterium
VKAVILGVVAQGWFLQQGYL

SEQ ID NO: 746418 - protein, 18 aa, Mycobacterium
VKCAPGIDFDEVRRLGFD

SEQ ID NO: 746419 - protein, 19 aa, Mycobacterium
VKCSERFAPQLDWILANLD

SEQ ID NO: 746420 - protein, 22 aa, Mycobacterium
VKDAAAYISGFFNTGSNLSGFF

SEQ ID NO: 746421 - protein, 18 aa, Mycobacterium
VKDAFGREGDQGVEFVKV

SEQ ID NO: 746422 - protein, 30 aa, Mycobacterium
VKDAMANPRFREHIPLMIGGSGEKKTIPLA

SEQ ID NO: 746423 - protein, 25 aa, Mycobacterium
VKDAMIDWWGPGLVEYYGATEQHGT

SEQ ID NO: 746424 - protein, 30 aa, Mycobacterium
VKDARFLDALFPVWRYHPFFTDSDEPVDAA

SEQ ID NO: 746425 - protein, 27 aa, Mycobacterium
VKDAVDVLWFFFGYTGFFTLLDDNGWS

SEQ ID NO: 746426 - protein, 17 aa, Mycobacterium
VKDGFVWGRGAVDMKDM

SEQ ID NO: 746427 - protein, 29 aa, Mycobacterium
VKDGYGRNFLLPRGLAIVASRGAQKQADE

SEQ ID NO: 746428 - protein, 29 aa, Mycobacterium
VKDGYGRNFLLPRGMAIVASRGAQKQADE

SEQ ID NO: 746429 - protein, 25 aa, Mycobacterium
VKDKPAWLDRAWQRIIEEVAAGRQA

SEQ ID NO: 746430 - protein, 24 aa, Mycobacterium
VKDKPAWLDRAWQRIVEEVAAGRQ

SEQ ID NO: 746431 - protein, 19 aa, Mycobacterium
VKDLLARAGREGAQVADTP

SEQ ID NO: 746432 - protein, 23 aa, Mycobacterium
VKDLRKVPADRIRDWWVAQFAQP

SEQ ID NO: 746433 - protein, 18 aa, Mycobacterium
VKDRACVDECPVDCIYEG

SEQ ID NO: 746434 - protein, 19 aa, Mycobacterium
VKDRLGLGAVLVRPDGVVA

SEQ ID NO: 746435 - protein, 25 aa, Mycobacterium
VKEAFSKWASLVIHAGAPGAGTRMK

SEQ ID NO: 746436 - protein, 25 aa, Mycobacterium
VKEAQRALDDWFKTTAPRDYNVNLD

SEQ ID NO: 746437 - protein, 20 aa, Mycobacterium
VKEAQSWLKKRVYQSYEDSP

SEQ ID NO: 746438 - protein, 25 aa, Mycobacterium
VKEAVLPFHRFRKADGAQIDSLLGP

SEQ ID NO: 746439 - protein, 26 aa, Mycobacterium
VKEAVLPFHRFRKADGSGVDSLLGPE

SEQ ID NO: 746440 - protein, 25 aa, Mycobacterium
VKEAVLPFHRFRRADGAAIDSLLGP

SEQ ID NO: 746441 - protein, 24 aa, Mycobacterium
VKEAVLPFHRFRRADGAQIDSLLG

SEQ ID NO: 746442 - protein, 25 aa, Mycobacterium
VKEAVLPFHRFRRIDGAAIDSLLGP

SEQ ID NO: 746443 - protein, 18 aa, Mycobacterium
VKEAWHAVAGRDVADTPR

SEQ ID NO: 746444 - protein, 22 aa, Mycobacterium
VKEDAAQGLATWMTTAPKSRRF

SEQ ID NO: 746445 - protein, 25 aa, Mycobacterium
VKEGGVGVHSIFGGAFTVDAQVTSE

SEQ ID NO: 746446 - protein, 18 aa, Mycobacterium
VKEIIAVSELTIWENGGF

SEQ ID NO: 746447 - protein, 21 aa, Mycobacterium
VKEILGFDPEKKFEVRDEVIA

SEQ ID NO: 746448 - protein, 25 aa, Mycobacterium
VKEKKGWSYEKWTKHVTEVLVSIEN

SEQ ID NO: 746449 - protein, 18 aa, Mycobacterium
VKEKNDWSYKQWAPEVTK

SEQ ID NO: 746450 - protein, 20 aa, Mycobacterium
VKENAGWRVSTSVDENHTHT

SEQ ID NO: 746451 - protein, 28 aa, Mycobacterium
VKEPIGVCGLITPWNWPINQIACKVFPA

SEQ ID NO: 746452 - protein, 29 aa, Mycobacterium
VKEPIGVCGLITPWNWPINQIACKVFPAL

SEQ ID NO: 746453 - protein, 18 aa, Mycobacterium
VKERNGWSYEKWAKQVTR

SEQ ID NO: 746454 - protein, 18 aa, Mycobacterium
VKESIPWRRGQRGGRPRI

SEQ ID NO: 746455 - protein, 17 aa, Mycobacterium
VKETFLISGQVFMQVSI

SEQ ID NO: 746456 - protein, 22 aa, Mycobacterium
VKETPWLPGQVQVFIHGEAQAV

SEQ ID NO: 746457 - protein, 22 aa, Mycobacterium
VKEVKAAMAALDIDPSFAERNV

SEQ ID NO: 746458 - protein, 24 aa, Mycobacterium
VKEVKAAMAALEIDPVFAERSVNE

SEQ ID NO: 746459 - protein, 28 aa, Mycobacterium
VKEYARKHPHSMAPWSPASRTHVATMRG

SEQ ID NO: 746460 - protein, 19 aa, Mycobacterium
VKEYARKHPHSMGEWSQAS

SEQ ID NO: 746461 - protein, 17 aa, Mycobacterium
VKFGRALANGDLLTPEM

SEQ ID NO: 746462 - protein, 33 aa, Mycobacterium
VKFKDAELLGMPWVVVVGRGWADGVVELRDRFG

SEQ ID NO: 746463 - protein, 19 aa, Mycobacterium
VKFLHDWAGPEAMIKKLSI

SEQ ID NO: 746464 - protein, 18 aa, Mycobacterium
VKFQIAYDPGHVWQSDDY

SEQ ID NO: 746465 - protein, 17 aa, Mycobacterium
VKFQPSGRCLSFAECDE

SEQ ID NO: 746466 - protein, 19 aa, Mycobacterium
VKFSAELGACTKDVDLGWY

SEQ ID NO: 746467 - protein, 18 aa, Mycobacterium
VKGAADFEKKAADLDDEQ

SEQ ID NO: 746468 - protein, 18 aa, Mycobacterium
VKGENRYFVVTQWESDEA

SEQ ID NO: 746469 - protein, 18 aa, Mycobacterium
VKGETRYFVVTQWESEEA

SEQ ID NO: 746470 - protein, 21 aa, Mycobacterium
VKGFFEKTFAPLGLKRIQGEV

SEQ ID NO: 746471 - protein, 24 aa, Mycobacterium
VKGGRRFSFTALVIVGDGNGMVGV

SEQ ID NO: 746472 - protein, 19 aa, Mycobacterium
VKGGWLYDAHNDAINLYDQ

SEQ ID NO: 746473 - protein, 17 aa, Mycobacterium
VKGHVFNALGHCLDKPG

SEQ ID NO: 746474 - protein, 25 aa, Mycobacterium
VKGKAKEVGGAVLGRDDLADEGRAQ

SEQ ID NO: 746475 - protein, 25 aa, Mycobacterium
VKGKVKEVGGAALGRDDLVEEGQAQ

SEQ ID NO: 746476 - protein, 18 aa, Mycobacterium
VKGLAGKGVLVTGAASGI

SEQ ID NO: 746477 - protein, 26 aa, Mycobacterium
VKGMLNRVRWTLVHYKPPQALTLNGD

SEQ ID NO: 746478 - protein, 22 aa, Mycobacterium
VKGPGLQVGGEWFATTLPASAR

SEQ ID NO: 746479 - protein, 24 aa, Mycobacterium
VKGPIAGTGAEMWVNVNPQAYRDL

SEQ ID NO: 746480 - protein, 19 aa, Mycobacterium
VKGPWPSDVYNAVNNLDPL

SEQ ID NO: 746481 - protein, 21 aa, Mycobacterium
VKGRSGVGILSRVPAASTRVA

SEQ ID NO: 746482 - protein, 20 aa, Mycobacterium
VKGYYCPTPPRLVWINGPTP

SEQ ID NO: 746483 - protein, 27 aa, Mycobacterium
VKHFFVCSTHDWILFFTTKGRVYRAKA

SEQ ID NO: 746484 - protein, 20 aa, Mycobacterium
VKHGVHCFVVPIRDEQGEDL

SEQ ID NO: 746485 - protein, 22 aa, Mycobacterium
VKHLAHSVVVMFAGSIVEQGNS

SEQ ID NO: 746486 - protein, 19 aa, Mycobacterium
VKHLAMRRTLWLVGVEDLP

SEQ ID NO: 746487 - protein, 17 aa, Mycobacterium
VKHPDLIELQRRAAALA

SEQ ID NO: 746488 - protein, 17 aa, Mycobacterium
VKHPNAYAELVAGATLP

SEQ ID NO: 746489 - protein, 35 aa, Mycobacterium
VKHPNAYAEMLARAALPVGGFELLDPDALHTEVVL

SEQ ID NO: 746490 - protein, 21 aa, Mycobacterium
VKHRCADMLVQVEGARSAQSH

SEQ ID NO: 746491 - protein, 29 aa, Mycobacterium
VKHVAKLSELLGFLWPGRYRTFSQADAGE

SEQ ID NO: 746492 - protein, 18 aa, Mycobacterium
VKIAFGLNQALFDELATM

SEQ ID NO: 746493 - protein, 17 aa, Mycobacterium
VKIAKNWQRDPKQLGKL

SEQ ID NO: 746494 - protein, 17 aa, Mycobacterium
VKIAKNWQRDPKQLGRL

SEQ ID NO: 746495 - protein, 33 aa, Mycobacterium
VKIAPGERAMFWPDCLENSFICVSWDEVGDLTL

SEQ ID NO: 746496 - protein, 18 aa, Mycobacterium
VKIDDWLPLTTAVLVGCG

SEQ ID NO: 746497 - protein, 18 aa, Mycobacterium
VKIERIATLLARSAAEDD

SEQ ID NO: 746498 - protein, 21 aa, Mycobacterium
VKIGEGICGQAHQQASTIRAV

SEQ ID NO: 746499 - protein, 20 aa, Mycobacterium
VKIKKGQRVVMMYRSANFDE

SEQ ID NO: 746500 - protein, 17 aa, Mycobacterium
VKIPAGWSDTAAATTSV

SEQ ID NO: 746501 - protein, 22 aa, Mycobacterium
VKIQGFSFWGGVGIKRKPRKAR

SEQ ID NO: 746502 - protein, 28 aa, Mycobacterium
VKIRPVPGQGVVRVSQWIEQRDVTSSPF

SEQ ID NO: 746503 - protein, 18 aa, Mycobacterium
VKIVATMCERGHADKMVL

SEQ ID NO: 746504 - protein, 17 aa, Mycobacterium
VKKALGVKGKKKADSKA

SEQ ID NO: 746505 - protein, 17 aa, Mycobacterium
VKKGERLLIRFDSANRD

SEQ ID NO: 746506 - protein, 17 aa, Mycobacterium
VKKKYGNKISWADLIIF

SEQ ID NO: 746507 - protein, 17 aa, Mycobacterium
VKKKYGNKLSWADLIVF

SEQ ID NO: 746508 - protein, 20 aa, Mycobacterium
VKKLGWPLTLNVVLHRQNID

SEQ ID NO: 746509 - protein, 22 aa, Mycobacterium
VKKLQLAPLAAMWEPVVDMGYG

SEQ ID NO: 746510 - protein, 20 aa, Mycobacterium
VKKPAALFLNYGYQGMASLI

SEQ ID NO: 746511 - protein, 18 aa, Mycobacterium
VKKVSYWSARAVGGEFVP

SEQ ID NO: 746512 - protein, 17 aa, Mycobacterium
VKLAATRGAEMAKACAV

SEQ ID NO: 746513 - protein, 18 aa, Mycobacterium
VKLAQRIGADLVVIGPEV

SEQ ID NO: 746514 - protein, 19 aa, Mycobacterium
VKLASGIFQLYTRTPTLLA

SEQ ID NO: 746515 - protein, 20 aa, Mycobacterium
VKLASMLPASAVELRQLAGV

SEQ ID NO: 746516 - protein, 17 aa, Mycobacterium
VKLASRLSQAFDRDVPP

SEQ ID NO: 746517 - protein, 19 aa, Mycobacterium
VKLAYPAWVPRPVTDDQFV

SEQ ID NO: 746518 - protein, 21 aa, Mycobacterium
VKLDRLDAEVPHLPRVDPGAR

SEQ ID NO: 746519 - protein, 17 aa, Mycobacterium
VKLEKGVELLIGLEAIS

SEQ ID NO: 746520 - protein, 21 aa, Mycobacterium
VKLESWFGYFVSRALPAVNRR

SEQ ID NO: 746521 - protein, 17 aa, Mycobacterium
VKLGLKEEMLETELTEQ

SEQ ID NO: 746522 - protein, 18 aa, Mycobacterium
VKLGQMCTAMSYRNPAYL

SEQ ID NO: 746523 - protein, 18 aa, Mycobacterium
VKLIPFALATRAIRAVTS

SEQ ID NO: 746524 - protein, 18 aa, Mycobacterium
VKLIQPVAMDEGLRFAIR

SEQ ID NO: 746525 - protein, 22 aa, Mycobacterium
VKLLIARPGFVVGRMTQGMDPA

SEQ ID NO: 746526 - protein, 17 aa, Mycobacterium
VKLLKRVRDAQRAGAPF

SEQ ID NO: 746527 - protein, 19 aa, Mycobacterium
VKLLRQAWLTATRARNALV

SEQ ID NO: 746528 - protein, 28 aa, Mycobacterium
VKLLRRMEGRLGFEVKVHRIAADGAAVL

SEQ ID NO: 746529 - protein, 19 aa, Mycobacterium
VKLMCALGGAAARHPAYAV

SEQ ID NO: 746530 - protein, 17 aa, Mycobacterium
VKLPHRVPSGFHGNWVP

SEQ ID NO: 746531 - protein, 18 aa, Mycobacterium
VKLRGGVLSVTIDRPESL

SEQ ID NO: 746532 - protein, 17 aa, Mycobacterium
VKLRLLAEQLIRDYNEL

SEQ ID NO: 746533 - protein, 23 aa, Mycobacterium
VKLTITDTGSWKAPQPASHHRRG

SEQ ID NO: 746534 - protein, 19 aa, Mycobacterium
VKLVARAGPRIRIAQVAPS

SEQ ID NO: 746535 - protein, 18 aa, Mycobacterium
VKMFCRKSTGVVIGGVVV

SEQ ID NO: 746536 - protein, 17 aa, Mycobacterium
VKMGVDFSRGEMWRPYT

SEQ ID NO: 746537 - protein, 21 aa, Mycobacterium
VKMKPRRDGWGRVSALAEALL

SEQ ID NO: 746538 - protein, 20 aa, Mycobacterium
VKMVRRWCRAAEAAGNLPDE

SEQ ID NO: 746539 - protein, 17 aa, Mycobacterium
VKNELQYLLADAGATAL

SEQ ID NO: 746540 - protein, 26 aa, Mycobacterium
VKNNVKRAWELMGMRVHLQVSHILTN

SEQ ID NO: 746541 - protein, 24 aa, Mycobacterium
VKPARGGSSIGVSRVTAWDELPAA

SEQ ID NO: 746542 - protein, 18 aa, Mycobacterium
VKPARGGSSIGVTRVSSW

SEQ ID NO: 746543 - protein, 20 aa, Mycobacterium
VKPDFSRTRLLSGATEPAKS

SEQ ID NO: 746544 - protein, 32 aa, Mycobacterium
VKPEEWRAELPLIEEWFEFVGEKLPTGLKDEF

SEQ ID NO: 746545 - protein, 22 aa, Mycobacterium
VKPERFYVEFNIREKLTGNFEQ

SEQ ID NO: 746546 - protein, 28 aa, Mycobacterium
VKPESLQPIGAFKMRGAFNAVGTVRGST

SEQ ID NO: 746547 - protein, 17 aa, Mycobacterium
VKPGELLCARVLPTGSI

SEQ ID NO: 746548 - protein, 17 aa, Mycobacterium
VKPGKGPAFVRTKLKNV

SEQ ID NO: 746549 - protein, 20 aa, Mycobacterium
VKPGSGVRGFIAKKGNIPVG

SEQ ID NO: 746550 - protein, 20 aa, Mycobacterium
VKPGSGVRGIIAKKGNIPVG

SEQ ID NO: 746551 - protein, 21 aa, Mycobacterium
VKPLSGAERKAILNFLEGGVD

SEQ ID NO: 746552 - protein, 23 aa, Mycobacterium
VKPRPYRDYIGWLAARDRSASEQ

SEQ ID NO: 746553 - protein, 26 aa, Mycobacterium
VKPRSCAALPRILRDNGYATGGFGKW

SEQ ID NO: 746554 - protein, 24 aa, Mycobacterium
VKPSPPFIPGHEGYGTVVAVGDGV

SEQ ID NO: 746555 - protein, 32 aa, Mycobacterium
VKPTSVPAFRPGAQFKAVISGAQKLPADGPAV

SEQ ID NO: 746556 - protein, 23 aa, Mycobacterium
VKPWTGVRLTLRYGPSAPQPHVA

SEQ ID NO: 746557 - protein, 17 aa, Mycobacterium
VKQACYGATGALQLALA

SEQ ID NO: 746558 - protein, 17 aa, Mycobacterium
VKQHARTSLMIHDTGAI

SEQ ID NO: 746559 - protein, 18 aa, Mycobacterium
VKQHARTSLMIHDVGAIV

SEQ ID NO: 746560 - protein, 18 aa, Mycobacterium
VKQHPDRLVAGWQVVALQ

SEQ ID NO: 746561 - protein, 17 aa, Mycobacterium
VKQRFGVTVNDVVVALC

SEQ ID NO: 746562 - protein, 17 aa, Mycobacterium
VKQRFVDLLPQLTILDA

SEQ ID NO: 746563 - protein, 23 aa, Mycobacterium
VKQRMAHEYVRRARERGFLPPTT

SEQ ID NO: 746564 - protein, 25 aa, Mycobacterium
VKQSMIDWWGPILYEYYSSTEGNGV

SEQ ID NO: 746565 - protein, 18 aa, Mycobacterium
VKQWFPNAVRNLDGVPTR

SEQ ID NO: 746566 - protein, 22 aa, Mycobacterium
VKRACNGCGQLVGDVTEQEINA

SEQ ID NO: 746567 - protein, 27 aa, Mycobacterium
VKRAHDQFRWFAGGWKVNADLPTPAGF

SEQ ID NO: 746568 - protein, 24 aa, Mycobacterium
VKRAHHTLRALVLLGAADLDLQDI

SEQ ID NO: 746569 - protein, 32 aa, Mycobacterium
VKRALGEIHAMWRINELLNWQVAAAGEDINMA

SEQ ID NO: 746570 - protein, 18 aa, Mycobacterium
VKRAMVKAANYVVVAADS

SEQ ID NO: 746571 - protein, 17 aa, Mycobacterium
VKRAMVSAANYVVVVAD

SEQ ID NO: 746572 - protein, 24 aa, Mycobacterium
VKRARIMLDADFSFISVRDDSEPE

SEQ ID NO: 746573 - protein, 19 aa, Mycobacterium
VKRAYEFGALATAAQLIGA

SEQ ID NO: 746574 - protein, 20 aa, Mycobacterium
VKRDPGGLVSNWINDTAAEG

SEQ ID NO: 746575 - protein, 22 aa, Mycobacterium
VKRDRLPALERLHGALLAGKPD

SEQ ID NO: 746576 - protein, 18 aa, Mycobacterium
VKRGLVAAGGGLLRLPKR

SEQ ID NO: 746577 - protein, 18 aa, Mycobacterium
VKRGLVAAGGGLLRLQKR

SEQ ID NO: 746578 - protein, 21 aa, Mycobacterium
VKRGPNAGSRFLLDQPTTSAG

SEQ ID NO: 746579 - protein, 17 aa, Mycobacterium
VKRGYRLAIDHPDESPW

SEQ ID NO: 746580 - protein, 17 aa, Mycobacterium
VKRGYRLALDTQDDTAC

SEQ ID NO: 746581 - protein, 22 aa, Mycobacterium
VKRHMLAAAGQRVFLVDSSKFG

SEQ ID NO: 746582 - protein, 22 aa, Mycobacterium
VKRIVGAKGKAALLRELSDAVP

SEQ ID NO: 746583 - protein, 21 aa, Mycobacterium
VKRLNKARLAEYVLATTGVDL

SEQ ID NO: 746584 - protein, 21 aa, Mycobacterium
VKRLRAVDFTLGYEVRSVSAE

SEQ ID NO: 746585 - protein, 19 aa, Mycobacterium
VKRLRQAGITTVATVTSYD

SEQ ID NO: 746586 - protein, 25 aa, Mycobacterium
VKRNFSFVYHREGLRSKPTEYTQYP

SEQ ID NO: 746587 - protein, 21 aa, Mycobacterium
VKRPLPLNMFAGIVGSAGTGK

SEQ ID NO: 746588 - protein, 22 aa, Mycobacterium
VKRPRPAWQAVQSFAHACVDPV

SEQ ID NO: 746589 - protein, 23 aa, Mycobacterium
VKRRGEAEVADFLATHRSEVSDG

SEQ ID NO: 746590 - protein, 19 aa, Mycobacterium
VKRRIMIGTYALSAGYYDA

SEQ ID NO: 746591 - protein, 19 aa, Mycobacterium
VKRRLKVIDDAAARFTAEV

SEQ ID NO: 746592 - protein, 27 aa, Mycobacterium
VKRRYRAAHNIGHFRFVECSRLVNGRP

SEQ ID NO: 746593 - protein, 34 aa, Mycobacterium
VKRSELPRHIAVLCDGNRRWARETGHDDVAYGYR

SEQ ID NO: 746594 - protein, 18 aa, Mycobacterium
VKRTNKARLSDYVRSCTG

SEQ ID NO: 746595 - protein, 17 aa, Mycobacterium
VKRVPLFGLGCVAGAAG

SEQ ID NO: 746596 - protein, 20 aa, Mycobacterium
VKRYPSPMMVTRGVAGETAP

SEQ ID NO: 746597 - protein, 19 aa, Mycobacterium
VKSADPIPARTIKSADPIP

SEQ ID NO: 746598 - protein, 22 aa, Mycobacterium
VKSAGRPTAPIRAALARDNVKR

SEQ ID NO: 746599 - protein, 19 aa, Mycobacterium
VKSAKWKVGEEAAFAALGD

SEQ ID NO: 746600 - protein, 19 aa, Mycobacterium
VKSAKWKVGEESALTELGR

SEQ ID NO: 746601 - protein, 20 aa, Mycobacterium
VKSAKWRVGEESVFGELAKL

SEQ ID NO: 746602 - protein, 21 aa, Mycobacterium
VKSALLGADSFEFGTTALMML

SEQ ID NO: 746603 - protein, 20 aa, Mycobacterium
VKSCVGTDWCRYGQQDSVQL

SEQ ID NO: 746604 - protein, 18 aa, Mycobacterium
VKSDLDFHAAIIGLLDSP

SEQ ID NO: 746605 - protein, 18 aa, Mycobacterium
VKSFYRRPLSVGDASGAA

SEQ ID NO: 746606 - protein, 18 aa, Mycobacterium
VKSGFGLEFAKTADVAVD

SEQ ID NO: 746607 - protein, 18 aa, Mycobacterium
VKSGFSFLQIPIGPSEFL

SEQ ID NO: 746608 - protein, 17 aa, Mycobacterium
VKSGWKVAEAFPADRVA

SEQ ID NO: 746609 - protein, 18 aa, Mycobacterium
VKSGWRPDDSVILAAAGT

SEQ ID NO: 746610 - protein, 20 aa, Mycobacterium
VKSLPGLLTILHDGGYHDTE

SEQ ID NO: 746611 - protein, 22 aa, Mycobacterium
VKSLRLLTPQQLHWCANPTMAH

SEQ ID NO: 746612 - protein, 24 aa, Mycobacterium
VKSMLGEAVATLFVDEHGADGDRR

SEQ ID NO: 746613 - protein, 21 aa, Mycobacterium
VKSPELGGAMAQFTNAVYTKS

SEQ ID NO: 746614 - protein, 21 aa, Mycobacterium
VKSRLHYAVRALRLTLQELGV

SEQ ID NO: 746615 - protein, 22 aa, Mycobacterium
VKSRLHYGVRALRLSLQEMGVT

SEQ ID NO: 746616 - protein, 22 aa, Mycobacterium
VKSSLRTAVRAFREATHAGDKE

SEQ ID NO: 746617 - protein, 19 aa, Mycobacterium
VKSTATAVFGIRREVWSDI

SEQ ID NO: 746618 - protein, 25 aa, Mycobacterium
VKSTPGTRCQLDIAPYTNRLPAYRS

SEQ ID NO: 746619 - protein, 18 aa, Mycobacterium
VKTANKWGIAVSKDRPDT

SEQ ID NO: 746620 - protein, 25 aa, Mycobacterium
VKTFKRARGQVWLMPHNPAYDPIPG

SEQ ID NO: 746621 - protein, 17 aa, Mycobacterium
VKTFKRTSGQVWLMPHN

SEQ ID NO: 746622 - protein, 25 aa, Mycobacterium
VKTFQDNCWVFRNTINDEYAGPRLQ

SEQ ID NO: 746623 - protein, 18 aa, Mycobacterium
VKTFWGWQEKQLPDGTLI

SEQ ID NO: 746624 - protein, 17 aa, Mycobacterium
VKTFWGWQEKQLPDGTV

SEQ ID NO: 746625 - protein, 20 aa, Mycobacterium
VKTNATAVFGLRRDTWSDTE

SEQ ID NO: 746626 - protein, 17 aa, Mycobacterium
VKTQPWLSDHVIYGTVV

SEQ ID NO: 746627 - protein, 19 aa, Mycobacterium
VKTQPWLSHHVIYGTVVVP

SEQ ID NO: 746628 - protein, 24 aa, Mycobacterium
VKTRAVIIGTGFSGLGMAIALQKQ

SEQ ID NO: 746629 - protein, 22 aa, Mycobacterium
VKTRDELSCLRRAARITEQAIV

SEQ ID NO: 746630 - protein, 19 aa, Mycobacterium
VKTRPVIRPIPVDESGFTV

SEQ ID NO: 746631 - protein, 23 aa, Mycobacterium
VKTVDQIACVRRACQITEEAVAE

SEQ ID NO: 746632 - protein, 19 aa, Mycobacterium
VKTYLDLPLFAGRPAPGLV

SEQ ID NO: 746633 - protein, 22 aa, Mycobacterium
VKTYRRLGFDIVNTDVAYAAVA

SEQ ID NO: 746634 - protein, 30 aa, Mycobacterium
VKVARFPKFDWPRIDAPYVRPGLDDDAMAA

SEQ ID NO: 746635 - protein, 29 aa, Mycobacterium
VKVEALWVGPVWRPATVIAQRGGPTARVR

SEQ ID NO: 746636 - protein, 21 aa, Mycobacterium
VKVGDLLPEKVIPLTRADLVN

SEQ ID NO: 746637 - protein, 30 aa, Mycobacterium
VKVGGARRCAAQSWSLERIRAVKQAAGVTV

SEQ ID NO: 746638 - protein, 18 aa, Mycobacterium
VKVHEASAGWTRAVAIID

SEQ ID NO: 746639 - protein, 18 aa, Mycobacterium
VKVIAAFVRDLPQDTPAD

SEQ ID NO: 746640 - protein, 26 aa, Mycobacterium
VKVICRRSRLCTRLAGSGAMASVELP

SEQ ID NO: 746641 - protein, 26 aa, Mycobacterium
VKVLACGICGSDLHFAAHGEEMLALT

SEQ ID NO: 746642 - protein, 17 aa, Mycobacterium
VKVLDRHGDPVVANALF

SEQ ID NO: 746643 - protein, 18 aa, Mycobacterium
VKVLNLRSTLLTIAGGDP

SEQ ID NO: 746644 - protein, 17 aa, Mycobacterium
VKVMDLAIKTGRPLIGI

SEQ ID NO: 746645 - protein, 19 aa, Mycobacterium
VKVPAGWSHTAAATASVVF

SEQ ID NO: 746646 - protein, 19 aa, Mycobacterium
VKVPAGWSHTAAATTSVVF

SEQ ID NO: 746647 - protein, 18 aa, Mycobacterium
VKVPLAIAALRSDPRHAA

SEQ ID NO: 746648 - protein, 21 aa, Mycobacterium
VKVRFHGRVRRCGMVSPTVFW

SEQ ID NO: 746649 - protein, 23 aa, Mycobacterium
VKVRGGEVLGEFATLVDPGRAIP

SEQ ID NO: 746650 - protein, 20 aa, Mycobacterium
VKVRNLGAYLARLDELGIAT

SEQ ID NO: 746651 - protein, 26 aa, Mycobacterium
VKVRPGMELACWDLLIYYLRDLAQSY

SEQ ID NO: 746652 - protein, 19 aa, Mycobacterium
VKVTDRIKAKISEAKEARQ

SEQ ID NO: 746653 - protein, 26 aa, Mycobacterium
VKVTRRLVGMLARRGYNQSMAYDVVS

SEQ ID NO: 746654 - protein, 17 aa, Mycobacterium
VKVVGFVASAPGFNGQP

SEQ ID NO: 746655 - protein, 18 aa, Mycobacterium
VKWKELRNGAYGQTLVTR

SEQ ID NO: 746656 - protein, 17 aa, Mycobacterium
VKWSDAVSDDFLKNQVR

SEQ ID NO: 746657 - protein, 24 aa, Mycobacterium
VKYPPLGSFRHGASVSQWYANPNA

SEQ ID NO: 746658 - protein, 19 aa, Mycobacterium
VLAAGARRATEVSAKTLQR

SEQ ID NO: 746659 - protein, 19 aa, Mycobacterium
VLAALGVGCCYHPDPGVAA

SEQ ID NO: 746660 - protein, 17 aa, Mycobacterium
VLAALIITPELQQDDAF

SEQ ID NO: 746661 - protein, 18 aa, Mycobacterium
VLAALNFAERSGVGQQVE

SEQ ID NO: 746662 - protein, 17 aa, Mycobacterium
VLAARPVGVPAIVVTPE

SEQ ID NO: 746663 - protein, 24 aa, Mycobacterium
VLAASSRRSAWWVGAVTLSVAKII

SEQ ID NO: 746664 - protein, 18 aa, Mycobacterium
VLAAVGIAPVTLDPQRIS

SEQ ID NO: 746665 - protein, 25 aa, Mycobacterium
VLAAYPGHIARMFGLVFGGEPADHL

SEQ ID NO: 746666 - protein, 22 aa, Mycobacterium
VLACARLGAIAVMVDDSLPAAT

SEQ ID NO: 746667 - protein, 19 aa, Mycobacterium
VLADFGALSSWVDKIDHSC

SEQ ID NO: 746668 - protein, 17 aa, Mycobacterium
VLADGHWGRALREYMRD

SEQ ID NO: 746669 - protein, 18 aa, Mycobacterium
VLADIPVERVREIDDVVR

SEQ ID NO: 746670 - protein, 17 aa, Mycobacterium
VLADLVNEFAAVRLSLD

SEQ ID NO: 746671 - protein, 27 aa, Mycobacterium
VLAEALRLARRRVIVAVPFEDEPQVCY

SEQ ID NO: 746672 - protein, 24 aa, Mycobacterium
VLAELPGRFLFGFDDGRGDISGLG

SEQ ID NO: 746673 - protein, 25 aa, Mycobacterium
VLAEPPVGCSYNFERVVEDRRDPKP

SEQ ID NO: 746674 - protein, 25 aa, Mycobacterium
VLAEQRFNLELSLCCTQAQTGRVEV

SEQ ID NO: 746675 - protein, 24 aa, Mycobacterium
VLAERIAALLLEINRRFGTPIPPE

SEQ ID NO: 746676 - protein, 25 aa, Mycobacterium
VLAERLCGWQERYPDVVTHKVVVSD

SEQ ID NO: 746677 - protein, 23 aa, Mycobacterium
VLAEVPLAAFLTEEIVPYDTDEV

SEQ ID NO: 746678 - protein, 17 aa, Mycobacterium
VLAEYPEALVFGEDVAR

SEQ ID NO: 746679 - protein, 34 aa, Mycobacterium
VLAEYSIDLFALLPLAELWVAATRIRQVDQLEYP

SEQ ID NO: 746680 - protein, 24 aa, Mycobacterium
VLAGFPGTVASFWQQAGRAGRRGQ

SEQ ID NO: 746681 - protein, 23 aa, Mycobacterium
VLAGGAAFGFDGRFARLLGADAW

SEQ ID NO: 746682 - protein, 20 aa, Mycobacterium
VLAGKCSEPPEIAYFDEQVK

SEQ ID NO: 746683 - protein, 20 aa, Mycobacterium
VLAGKGARVVIAVRDAGKGQ

SEQ ID NO: 746684 - protein, 18 aa, Mycobacterium
VLAGLAPAVPDRVGLCRR

SEQ ID NO: 746685 - protein, 19 aa, Mycobacterium
VLAGLCGAVDALSELDTSA

SEQ ID NO: 746686 - protein, 18 aa, Mycobacterium
VLAGPLVRSSYRAGKLYA

SEQ ID NO: 746687 - protein, 26 aa, Mycobacterium
VLAGQGPAAWPKCASAGGLPPVPVVL

SEQ ID NO: 746688 - protein, 23 aa, Mycobacterium
VLAGQRLCIYLDPSREWQPTLGV

SEQ ID NO: 746689 - protein, 26 aa, Mycobacterium
VLAGSARFTQRLTLGYRDAVAVADSP

SEQ ID NO: 746690 - protein, 27 aa, Mycobacterium
VLAGSRIPLCLDTGHLLIGGTDPLALT

SEQ ID NO: 746691 - protein, 25 aa, Mycobacterium
VLAGTRLAILMVRAAHLMIGAGLLP

SEQ ID NO: 746692 - protein, 24 aa, Mycobacterium
VLAHTVCLAGAFTAPDPISGRLVT

SEQ ID NO: 746693 - protein, 19 aa, Mycobacterium
VLAHWPEVIASPTPASAGR

SEQ ID NO: 746694 - protein, 26 aa, Mycobacterium
VLAIDAVKGFSAWYAGHVDLTDPPAT

SEQ ID NO: 746695 - protein, 29 aa, Mycobacterium
VLAINLVGTFDCIRLAATAMSRLDLTESG

SEQ ID NO: 746696 - protein, 24 aa, Mycobacterium
VLAISVNGPRAWDLDLAIDVTFLD

SEQ ID NO: 746697 - protein, 17 aa, Mycobacterium
VLAIWCMDWPAVAAAAA

SEQ ID NO: 746698 - protein, 20 aa, Mycobacterium
VLAKDCPSYGLGPTDPEVAA

SEQ ID NO: 746699 - protein, 18 aa, Mycobacterium
VLALKAGWNYGETTEAFG

SEQ ID NO: 746700 - protein, 19 aa, Mycobacterium
VLALPRGGIPVGREIATAL

SEQ ID NO: 746701 - protein, 18 aa, Mycobacterium
VLALSALEFDASVYDIFG

SEQ ID NO: 746702 - protein, 18 aa, Mycobacterium
VLALSGPERLSWLHTVSS

SEQ ID NO: 746703 - protein, 21 aa, Mycobacterium
VLALSRYPAERDKWWSNFDRL

SEQ ID NO: 746704 - protein, 22 aa, Mycobacterium
VLALTGRPLIGNGANGAPGTGA

SEQ ID NO: 746705 - protein, 18 aa, Mycobacterium
VLAMAARAHLRRKFLTAR

SEQ ID NO: 746706 - protein, 36 aa, Mycobacterium
VLANRWSLTRADGRWRISKRTVLPMDGSGPALDDVV

SEQ ID NO: 746707 - protein, 22 aa, Mycobacterium
VLANSLAPFSIRVNTVHPTAVR

SEQ ID NO: 746708 - protein, 18 aa, Mycobacterium
VLANWAWGQDHRDPVLGT

SEQ ID NO: 746709 - protein, 25 aa, Mycobacterium
VLAPAGRLALVWNRIEPTVPTQHDL

SEQ ID NO: 746710 - protein, 21 aa, Mycobacterium
VLAPGCDAVLVGEHQNKPDFP

SEQ ID NO: 746711 - protein, 20 aa, Mycobacterium
VLAPGFLYHYSLDATTAGAD

SEQ ID NO: 746712 - protein, 17 aa, Mycobacterium
VLAPLGLVFDENSPWLD

SEQ ID NO: 746713 - protein, 17 aa, Mycobacterium
VLAPLGLVFDENSPWLR

SEQ ID NO: 746714 - protein, 25 aa, Mycobacterium
VLAPSTIRSAGWFRSSTLYVPGSQN

SEQ ID NO: 746715 - protein, 30 aa, Mycobacterium
VLAQALLKAGLRLVAAGVNPIALGAGIGKA

SEQ ID NO: 746716 - protein, 22 aa, Mycobacterium
VLAQALVKTGLRLVAAGINPIA

SEQ ID NO: 746717 - protein, 22 aa, Mycobacterium
VLAQPCAQPADFADQVADIEAM

SEQ ID NO: 746718 - protein, 24 aa, Mycobacterium
VLAQRCVELLRPALTRHHADGSEA

SEQ ID NO: 746719 - protein, 19 aa, Mycobacterium
VLARARCVATVGRLSVPQS

SEQ ID NO: 746720 - protein, 17 aa, Mycobacterium
VLAREGADLLIAVDDGS

SEQ ID NO: 746721 - protein, 20 aa, Mycobacterium
VLARGTAWLDTGTFDSLLDA

SEQ ID NO: 746722 - protein, 23 aa, Mycobacterium
VLARLLPPGYRAMAMINGGPSLG

SEQ ID NO: 746723 - protein, 25 aa, Mycobacterium
VLARLYGWHRAMRIFDGPDEVHMRT

SEQ ID NO: 746724 - protein, 21 aa, Mycobacterium
VLARQGIRVVVLEAAGSKERQ

SEQ ID NO: 746725 - protein, 18 aa, Mycobacterium
VLARRRLIIYSWGANELD

SEQ ID NO: 746726 - protein, 24 aa, Mycobacterium
VLARSYGWHRAMRLFDGPDEVHMR

SEQ ID NO: 746727 - protein, 25 aa, Mycobacterium
VLARTWPAICDELLEHYAAAAGTTL

SEQ ID NO: 746728 - protein, 21 aa, Mycobacterium
VLARTWPVVCDELIGHYEAVL

SEQ ID NO: 746729 - protein, 25 aa, Mycobacterium
VLARVDAQLAATVARWPSMTRSRLA

SEQ ID NO: 746730 - protein, 17 aa, Mycobacterium
VLARYVPVLNDLRMRYL

SEQ ID NO: 746731 - protein, 30 aa, Mycobacterium
VLASRLGEMRRLRVSGPLKAMVEAEWVFDP

SEQ ID NO: 746732 - protein, 17 aa, Mycobacterium
VLASWLPQHHDMGLISA

SEQ ID NO: 746733 - protein, 28 aa, Mycobacterium
VLATVTAWCARLDVLATDMRVEQRSLED

SEQ ID NO: 746734 - protein, 20 aa, Mycobacterium
VLAVEGYEAAFAMTVPPPVV

SEQ ID NO: 746735 - protein, 28 aa, Mycobacterium
VLAVMPWNFPLWQAVRFAAPALMAGNVG

SEQ ID NO: 746736 - protein, 18 aa, Mycobacterium
VLAWLHPPGIDFGPALVA

SEQ ID NO: 746737 - protein, 26 aa, Mycobacterium
VLAWRARTLTGRRWFEEHGVSFARHY

SEQ ID NO: 746738 - protein, 25 aa, Mycobacterium
VLAYCGRISVGLGQQARRDLHARLS

SEQ ID NO: 746739 - protein, 24 aa, Mycobacterium
VLAYGRSGLNVWIPVPDETVAITR

SEQ ID NO: 746740 - protein, 20 aa, Mycobacterium
VLAYPRVVWVAGGLLKGASV

SEQ ID NO: 746741 - protein, 25 aa, Mycobacterium
VLCHISHVYPTGASLYFTVVAAQRG

SEQ ID NO: 746742 - protein, 18 aa, Mycobacterium
VLCLVAMEPPTHVNRESV

SEQ ID NO: 746743 - protein, 17 aa, Mycobacterium
VLCVCAAPEGIAALEKV

SEQ ID NO: 746744 - protein, 24 aa, Mycobacterium
VLCVRRLEHRMGIHRLIESWPTVV

SEQ ID NO: 746745 - protein, 24 aa, Mycobacterium
VLDADLLRRAKYSGLSDRQISALR

SEQ ID NO: 746746 - protein, 21 aa, Mycobacterium
VLDAIPVVVGLAVDEIGRPRP

SEQ ID NO: 746747 - protein, 21 aa, Mycobacterium
VLDALQELTRLAVHQKTGERS

SEQ ID NO: 746748 - protein, 25 aa, Mycobacterium
VLDAPAVVANGLFNGQSTFPLTIDA

SEQ ID NO: 746749 - protein, 25 aa, Mycobacterium
VLDAQRWAREQARGVVEQKSVRRGL

SEQ ID NO: 746750 - protein, 24 aa, Mycobacterium
VLDAWLRPVPPGVVGELYVAGSGV

SEQ ID NO: 746751 - protein, 19 aa, Mycobacterium
VLDAYGALLDRLTESIEDP

SEQ ID NO: 746752 - protein, 19 aa, Mycobacterium
VLDDGRLAGIVSIGDVVKT

SEQ ID NO: 746753 - protein, 17 aa, Mycobacterium
VLDDGWRMFDYLVDELN

SEQ ID NO: 746754 - protein, 26 aa, Mycobacterium
VLDDIRRYLSFFPSSAWSYPSSTPPG

SEQ ID NO: 746755 - protein, 24 aa, Mycobacterium
VLDDLLRFGGWHIVIQADKLGHHP

SEQ ID NO: 746756 - protein, 22 aa, Mycobacterium
VLDELRELAAVLGVARDAEVLG

SEQ ID NO: 746757 - protein, 25 aa, Mycobacterium
VLDELRELAGILGIARDAEVLAERY

SEQ ID NO: 746758 - protein, 23 aa, Mycobacterium
VLDELRELAGVLGVARDAEVLAE

SEQ ID NO: 746759 - protein, 20 aa, Mycobacterium
VLDFKREVLAGVGAEPRAER

SEQ ID NO: 746760 - protein, 25 aa, Mycobacterium
VLDFKTVGALSKWYLGDTNPATAGP

SEQ ID NO: 746761 - protein, 24 aa, Mycobacterium
VLDFLVSRVPKWIDHEIVVVPYAM

SEQ ID NO: 746762 - protein, 19 aa, Mycobacterium
VLDFPTGFHYDFRTPEYAQ

SEQ ID NO: 746763 - protein, 23 aa, Mycobacterium
VLDFYRCAMLPAGPDWRPDRPEA

SEQ ID NO: 746764 - protein, 18 aa, Mycobacterium
VLDGHGWFGTKDIAMLDE

SEQ ID NO: 746765 - protein, 18 aa, Mycobacterium
VLDGHKATTHWIYTDELR

SEQ ID NO: 746766 - protein, 23 aa, Mycobacterium
VLDGKRATSHWAALPVLKTLGAQ

SEQ ID NO: 746767 - protein, 21 aa, Mycobacterium
VLDGLPGIRAWQEDFYRDLHR

SEQ ID NO: 746768 - protein, 22 aa, Mycobacterium
VLDGLRLAALMVGAHRAVLYTS

SEQ ID NO: 746769 - protein, 19 aa, Mycobacterium
VLDGVRFIGINGGPQFPFT

SEQ ID NO: 746770 - protein, 23 aa, Mycobacterium
VLDGWLRPVPPGTVGELYVAGTG

SEQ ID NO: 746771 - protein, 25 aa, Mycobacterium
VLDGWLRPVPPGVVGELYVAGAGVG

SEQ ID NO: 746772 - protein, 22 aa, Mycobacterium
VLDGWSKPILLQEIFASYFGER

SEQ ID NO: 746773 - protein, 17 aa, Mycobacterium
VLDHLMPDGWRAEEPEA

SEQ ID NO: 746774 - protein, 24 aa, Mycobacterium
VLDIGCGFGDNAIYLAQHGHRVTA

SEQ ID NO: 746775 - protein, 26 aa, Mycobacterium
VLDIGCGWGACLDRAMRKFDVNVIGI

SEQ ID NO: 746776 - protein, 22 aa, Mycobacterium
VLDLDYRPMFWATPAAATEQVR

SEQ ID NO: 746777 - protein, 26 aa, Mycobacterium
VLDLGKIEATGFWPADMDETLTDYVR

SEQ ID NO: 746778 - protein, 20 aa, Mycobacterium
VLDLLTRLGITPLPNTAGCR

SEQ ID NO: 746779 - protein, 25 aa, Mycobacterium
VLDMSRRYGGDFGFTSYDPAWIDTL

SEQ ID NO: 746780 - protein, 24 aa, Mycobacterium
VLDPDQRYGAAIPMDSTRALMSEQ

SEQ ID NO: 746781 - protein, 17 aa, Mycobacterium
VLDQRPFEVQLMGAAAL

SEQ ID NO: 746782 - protein, 18 aa, Mycobacterium
VLDRACAYYGERTAILDA

SEQ ID NO: 746783 - protein, 18 aa, Mycobacterium
VLDRGREGVSIDVPENLD

SEQ ID NO: 746784 - protein, 19 aa, Mycobacterium
VLDRIGELVLKPVEGSGGY

SEQ ID NO: 746785 - protein, 24 aa, Mycobacterium
VLDRLCGSRDPVLAAVAAKGVKEL

SEQ ID NO: 746786 - protein, 19 aa, Mycobacterium
VLDRLKELVLKPVEGSGGY

SEQ ID NO: 746787 - protein, 23 aa, Mycobacterium
VLDRPLYRFPVFGFFALSIGAAA

SEQ ID NO: 746788 - protein, 18 aa, Mycobacterium
VLDRWLRPVPAGVVGELF

SEQ ID NO: 746789 - protein, 25 aa, Mycobacterium
VLDRWLRPVPPGVVGELYVAGAGVG

SEQ ID NO: 746790 - protein, 17 aa, Mycobacterium
VLDRYVPVLTDLRLRYL

SEQ ID NO: 746791 - protein, 17 aa, Mycobacterium
VLDRYVPVLTELRMRYL

SEQ ID NO: 746792 - protein, 27 aa, Mycobacterium
VLDSDGILNLRFIPGSMVVVGAGVIGI

SEQ ID NO: 746793 - protein, 21 aa, Mycobacterium
VLDSEADWLGDMSLVTMATGL

SEQ ID NO: 746794 - protein, 26 aa, Mycobacterium
VLDVARLLAMARMRGAHGVVGELGFF

SEQ ID NO: 746795 - protein, 26 aa, Mycobacterium
VLDVARLLSMARMRGAQGVVGELGFF

SEQ ID NO: 746796 - protein, 25 aa, Mycobacterium
VLDVDWRFASPVVDVLDCALVSAAW

SEQ ID NO: 746797 - protein, 26 aa, Mycobacterium
VLDVGCGWGGAVVRALEKYDVNVIGI

SEQ ID NO: 746798 - protein, 21 aa, Mycobacterium
VLDVGDGVPVWISGPQYETWK

SEQ ID NO: 746799 - protein, 21 aa, Mycobacterium
VLDVGTGVPVWISGPQFDTWK

SEQ ID NO: 746800 - protein, 21 aa, Mycobacterium
VLDVVTPLDWARQGMAAGTPF

SEQ ID NO: 746801 - protein, 26 aa, Mycobacterium
VLDWCTRERISVIPYGGGSSVVGGVE

SEQ ID NO: 746802 - protein, 19 aa, Mycobacterium
VLDWEAGQAGRKWLLEYGD

SEQ ID NO: 746803 - protein, 25 aa, Mycobacterium
VLDWNSQPPFDGWAAAIGAYDAAID

SEQ ID NO: 746804 - protein, 34 aa, Mycobacterium
VLDWSDAPFAKWFGDGKLNVAYNCVDRHVEAGHG

SEQ ID NO: 746805 - protein, 24 aa, Mycobacterium
VLDWSDAPFAKWFVGGKLNVAYNC

SEQ ID NO: 746806 - protein, 24 aa, Mycobacterium
VLDWSEAPFAKWFVGGTLNVAYNC

SEQ ID NO: 746807 - protein, 26 aa, Mycobacterium
VLDYEVPGLADAIRRSGLPKVPTSIL

SEQ ID NO: 746808 - protein, 23 aa, Mycobacterium
VLEAAWRAAMWAKAAGHGINDPD

SEQ ID NO: 746809 - protein, 22 aa, Mycobacterium
VLEAGRSLADWLDRRNDHRSGS

SEQ ID NO: 746810 - protein, 18 aa, Mycobacterium
VLEALRIDPPTSIGGVTQ

SEQ ID NO: 746811 - protein, 18 aa, Mycobacterium
VLEAMGIPHTEIDLILVN

SEQ ID NO: 746812 - protein, 18 aa, Mycobacterium
VLEAMGIPHTEVDLILVN

SEQ ID NO: 746813 - protein, 18 aa, Mycobacterium
VLEARSAIGGTWDLFRYP

SEQ ID NO: 746814 - protein, 24 aa, Mycobacterium
VLECLRLHPEDTIAAIKARAAELK

SEQ ID NO: 746815 - protein, 21 aa, Mycobacterium
VLEDANLVSIVWQGREKLHYL

SEQ ID NO: 746816 - protein, 18 aa, Mycobacterium
VLEDGRVFTGTPFGAEGE

SEQ ID NO: 746817 - protein, 17 aa, Mycobacterium
VLEDYFFRHLPAARAGE

SEQ ID NO: 746818 - protein, 18 aa, Mycobacterium
VLEECGRAIAPIPLLSSI

SEQ ID NO: 746819 - protein, 17 aa, Mycobacterium
VLEESRRPISEVTPPSR

SEQ ID NO: 746820 - protein, 25 aa, Mycobacterium
VLEHCRRQLADFKVPQYVTVVTEAL

SEQ ID NO: 746821 - protein, 24 aa, Mycobacterium
VLEHLRYDTALIFNGDVLSGLDLK

SEQ ID NO: 746822 - protein, 26 aa, Mycobacterium
VLEHTPLKMCWVPRYSDYYPEAPGGR

SEQ ID NO: 746823 - protein, 29 aa, Mycobacterium
VLEHVTRLRADLCPDWPQPAQPGGSYRIE

SEQ ID NO: 746824 - protein, 18 aa, Mycobacterium
VLEIPAGPGPVVVVAPST

SEQ ID NO: 746825 - protein, 22 aa, Mycobacterium
VLEKHARLTIAVNDIYLSTVGG

SEQ ID NO: 746826 - protein, 21 aa, Mycobacterium
VLELAWTTGLIRWEDAPHPGW

SEQ ID NO: 746827 - protein, 21 aa, Mycobacterium
VLELAWTTGLIRWEDDPQPGW

SEQ ID NO: 746828 - protein, 21 aa, Mycobacterium
VLELAWTTGLVKWEDDPQPGW

SEQ ID NO: 746829 - protein, 21 aa, Mycobacterium
VLELAWTTGLVKWENDPEAGW

SEQ ID NO: 746830 - protein, 18 aa, Mycobacterium
VLELPWVTGQVVHADGGL

SEQ ID NO: 746831 - protein, 26 aa, Mycobacterium
VLELRPAHHPSHPWGFVNSVISTEDL

SEQ ID NO: 746832 - protein, 25 aa, Mycobacterium
VLEMGYAVACGVQILTLEPVEDPNL

SEQ ID NO: 746833 - protein, 17 aa, Mycobacterium
VLEMTVRYAKLRVQFGR

SEQ ID NO: 746834 - protein, 17 aa, Mycobacterium
VLEMVGLSGKANRLPSE

SEQ ID NO: 746835 - protein, 18 aa, Mycobacterium
VLENPAWYTAYTPYQPEI

SEQ ID NO: 746836 - protein, 25 aa, Mycobacterium
VLENPTRWRLILTVPDSAPREYRAA

SEQ ID NO: 746837 - protein, 25 aa, Mycobacterium
VLEPCRAQCALAYAQYVERFGALNR

SEQ ID NO: 746838 - protein, 19 aa, Mycobacterium
VLEPDGIRSGTAVTTVGAV

SEQ ID NO: 746839 - protein, 22 aa, Mycobacterium
VLEPGCGAGTFIAHAPDEAVMV

SEQ ID NO: 746840 - protein, 18 aa, Mycobacterium
VLEPLGLTAQEPVGTRAR

SEQ ID NO: 746841 - protein, 24 aa, Mycobacterium
VLEPLRLHYLRWILFDVGSGLHFQ

SEQ ID NO: 746842 - protein, 23 aa, Mycobacterium
VLEPRLKSFVGALSRPAEALDDQ

SEQ ID NO: 746843 - protein, 28 aa, Mycobacterium
VLEPRLRVPDEFGLCRYLAAGLAALSTV

SEQ ID NO: 746844 - protein, 18 aa, Mycobacterium
VLEQELRGLSLLGVQTVL

SEQ ID NO: 746845 - protein, 17 aa, Mycobacterium
VLEQLAFDERRLRQALS

SEQ ID NO: 746846 - protein, 17 aa, Mycobacterium
VLEQLAFDERRLRQALT

SEQ ID NO: 746847 - protein, 27 aa, Mycobacterium
VLEQSRLLPAITFIFSRAGCDAAVKQC

SEQ ID NO: 746848 - protein, 24 aa, Mycobacterium
VLEQYRPGEIITEPAFTSTSTDHT

SEQ ID NO: 746849 - protein, 27 aa, Mycobacterium
VLERARPVLEPMAGKIIHCGAAGAGQA

SEQ ID NO: 746850 - protein, 37 aa, Mycobacterium
VLERGLLLRIRFELDHHINLRPGRLYPGVQSPLAGNP

SEQ ID NO: 746851 - protein, 23 aa, Mycobacterium
VLERGLRMTAEYARTREQFDRPI

SEQ ID NO: 746852 - protein, 25 aa, Mycobacterium
VLERLRPGDFYRPAHQSVYDAILDL

SEQ ID NO: 746853 - protein, 18 aa, Mycobacterium
VLERRVGAQAGRRSGHRA

SEQ ID NO: 746854 - protein, 19 aa, Mycobacterium
VLERTRWTVTYNINANHQY

SEQ ID NO: 746855 - protein, 17 aa, Mycobacterium
VLESIFAENDIRADINR

SEQ ID NO: 746856 - protein, 17 aa, Mycobacterium
VLETEYLKRPLIDGPAP

SEQ ID NO: 746857 - protein, 24 aa, Mycobacterium
VLETGGAVTMPWLDRVSAVLESWY

SEQ ID NO: 746858 - protein, 23 aa, Mycobacterium
VLETGNPVAMPWQDSVNAIVQAW

SEQ ID NO: 746859 - protein, 24 aa, Mycobacterium
VLETGNPVSMPWRDAVNAVVQAWY

SEQ ID NO: 746860 - protein, 25 aa, Mycobacterium
VLETGNPVTMPWRDSVRAIVQAWYP

SEQ ID NO: 746861 - protein, 25 aa, Mycobacterium
VLETRGRFGTFVARADPADAAMAAA

SEQ ID NO: 746862 - protein, 20 aa, Mycobacterium
VLEVARMVLFGQVGRELVNL

SEQ ID NO: 746863 - protein, 18 aa, Mycobacterium
VLEVCARRGVSPMPGGTD

SEQ ID NO: 746864 - protein, 22 aa, Mycobacterium
VLEVSGPCVMRGYWRNSELTAE

SEQ ID NO: 746865 - protein, 22 aa, Mycobacterium
VLEVTGRLAAPLLPLITEVIWR

SEQ ID NO: 746866 - protein, 19 aa, Mycobacterium
VLEYRKDLAVRLSELDLLL

SEQ ID NO: 746867 - protein, 17 aa, Mycobacterium
VLFCCENNLYAMGTALD

SEQ ID NO: 746868 - protein, 18 aa, Mycobacterium
VLFDPGTFAHGFEGITGL

SEQ ID NO: 746869 - protein, 25 aa, Mycobacterium
VLFHARAKLKRKGCDLLVVNAVGEG

SEQ ID NO: 746870 - protein, 18 aa, Mycobacterium
VLFHLGIVVADAAAWQIS

SEQ ID NO: 746871 - protein, 18 aa, Mycobacterium
VLFHMPRSATVRARTDAT

SEQ ID NO: 746872 - protein, 24 aa, Mycobacterium
VLFKGLEPKARFYFVHSYAAQRWE

SEQ ID NO: 746873 - protein, 18 aa, Mycobacterium
VLFKGMDAETRFYFVHSY

SEQ ID NO: 746874 - protein, 19 aa, Mycobacterium
VLFLHGWTQNREAWDDVAG

SEQ ID NO: 746875 - protein, 23 aa, Mycobacterium
VLFNDFLPAVARMRALDPVTSEL

SEQ ID NO: 746876 - protein, 23 aa, Mycobacterium
VLFPQISTIYGFRQDPLKWHPNG

SEQ ID NO: 746877 - protein, 19 aa, Mycobacterium
VLFRQLEYFVAVAQERHFA

SEQ ID NO: 746878 - protein, 21 aa, Mycobacterium
VLFRRLGVFVGGFDLQAAQAV

SEQ ID NO: 746879 - protein, 25 aa, Mycobacterium
VLFSRCCGMNATFIAHDRRPEVFRD

SEQ ID NO: 746880 - protein, 18 aa, Mycobacterium
VLFTAHWQQDGAAITRGM

SEQ ID NO: 746881 - protein, 20 aa, Mycobacterium
VLGALRLHWLGTELNGTPID

SEQ ID NO: 746882 - protein, 25 aa, Mycobacterium
VLGARLTVPLGMIILRKAYGLGAMA

SEQ ID NO: 746883 - protein, 20 aa, Mycobacterium
VLGASWLTAFAQRSPFAELF

SEQ ID NO: 746884 - protein, 17 aa, Mycobacterium
VLGCFAMTETGHGSDVQ

SEQ ID NO: 746885 - protein, 17 aa, Mycobacterium
VLGCFGMTETGHGSNVQ

SEQ ID NO: 746886 - protein, 23 aa, Mycobacterium
VLGCGPVGLAVICHLKTRGVRTI

SEQ ID NO: 746887 - protein, 24 aa, Mycobacterium
VLGCGRCEFCRAGDAQVCPNQEQP

SEQ ID NO: 746888 - protein, 18 aa, Mycobacterium
VLGDAVFYLMEPVEGFNA

SEQ ID NO: 746889 - protein, 22 aa, Mycobacterium
VLGDHRHHIGAGRGQPQTARVG

SEQ ID NO: 746890 - protein, 19 aa, Mycobacterium
VLGDPALPHLFFVDGGALA

SEQ ID NO: 746891 - protein, 23 aa, Mycobacterium
VLGDPALPHLFFVDGGALAVENA

SEQ ID NO: 746892 - protein, 24 aa, Mycobacterium
VLGDPRFGIPPGIHLAAHGITSGE

SEQ ID NO: 746893 - protein, 19 aa, Mycobacterium
VLGEAIVRLLRYGPRLDGP

SEQ ID NO: 746894 - protein, 18 aa, Mycobacterium
VLGEAVALLRDMLNPDEL

SEQ ID NO: 746895 - protein, 24 aa, Mycobacterium
VLGERIGGLVARLHRAEGVDVRLG

SEQ ID NO: 746896 - protein, 24 aa, Mycobacterium
VLGERWTLLILRELVGGARRYGDL

SEQ ID NO: 746897 - protein, 19 aa, Mycobacterium
VLGESVALLRDLLNPDELV

SEQ ID NO: 746898 - protein, 20 aa, Mycobacterium
VLGEVAAAVFGRPSEHLRVI

SEQ ID NO: 746899 - protein, 26 aa, Mycobacterium
VLGFDRVRLALPRDHRLAGKASVDIS

SEQ ID NO: 746900 - protein, 18 aa, Mycobacterium
VLGFMFLMVIAGNETTTK

SEQ ID NO: 746901 - protein, 18 aa, Mycobacterium
VLGGAGWEIAALDPVTVN

SEQ ID NO: 746902 - protein, 30 aa, Mycobacterium
VLGGGKRLRPAFAYWGWRAVATDEPDEQVL

SEQ ID NO: 746903 - protein, 17 aa, Mycobacterium
VLGGIGFTAEHPLHHHV

SEQ ID NO: 746904 - protein, 18 aa, Mycobacterium
VLGGLGVAIISTSSGLLT

SEQ ID NO: 746905 - protein, 17 aa, Mycobacterium
VLGGLGVAIISTSSGLR

SEQ ID NO: 746906 - protein, 17 aa, Mycobacterium
VLGGLYLGAHRVDGFAA

SEQ ID NO: 746907 - protein, 17 aa, Mycobacterium
VLGGRIAFRGQDLTTLR

SEQ ID NO: 746908 - protein, 26 aa, Mycobacterium
VLGKVDYRALKSLALELLGREKPEPD

SEQ ID NO: 746909 - protein, 28 aa, Mycobacterium
VLGLDHLRKVVGWARDRGVLVASDECYL

SEQ ID NO: 746910 - protein, 18 aa, Mycobacterium
VLGLLGLVDQVGAVGADH

SEQ ID NO: 746911 - protein, 25 aa, Mycobacterium
VLGLPRGGVPVAFEVAKALHAPLDV

SEQ ID NO: 746912 - protein, 25 aa, Mycobacterium
VLGLPRGGVPVAFEVARALHAPLDV

SEQ ID NO: 746913 - protein, 25 aa, Mycobacterium
VLGLPRGGVPVAFEVARALRAPLDV

SEQ ID NO: 746914 - protein, 22 aa, Mycobacterium
VLGLTGRPLIGNGANGAAGTGA

SEQ ID NO: 746915 - protein, 25 aa, Mycobacterium
VLGMPFYLMRAIDGWSPMDGGWPAP

SEQ ID NO: 746916 - protein, 24 aa, Mycobacterium
VLGMPFYVMEAIDGWSPMDGGWQP

SEQ ID NO: 746917 - protein, 21 aa, Mycobacterium
VLGMTRCRVPVVAAVNGPAVG

SEQ ID NO: 746918 - protein, 24 aa, Mycobacterium
VLGPEAFDAVPFLNLLKDYGSPWG

SEQ ID NO: 746919 - protein, 22 aa, Mycobacterium
VLGPEGALRCDARGRWDAQTAR

SEQ ID NO: 746920 - protein, 17 aa, Mycobacterium
VLGPLAMAGELGGDEHG

SEQ ID NO: 746921 - protein, 26 aa, Mycobacterium
VLGPRLRECAELLAAHTGRSATQILG

SEQ ID NO: 746922 - protein, 24 aa, Mycobacterium
VLGPSGKRPAAIAERVKKTWELGE

SEQ ID NO: 746923 - protein, 20 aa, Mycobacterium
VLGRDGIKLSDAWSDGPRAY

SEQ ID NO: 746924 - protein, 24 aa, Mycobacterium
VLGRLKRELGVTVLVVAHDLNPLL

SEQ ID NO: 746925 - protein, 23 aa, Mycobacterium
VLGRSAAGYELLRNGIDGFDELR

SEQ ID NO: 746926 - protein, 20 aa, Mycobacterium
VLGRTWPVICDELVGHYEAV

SEQ ID NO: 746927 - protein, 19 aa, Mycobacterium
VLGSYRWLNPSGRRSAQEI

SEQ ID NO: 746928 - protein, 19 aa, Mycobacterium
VLGTGFAVLCWNNNPRTLL

SEQ ID NO: 746929 - protein, 23 aa, Mycobacterium
VLGVCGGFQMLCSRIDDPVESRE

SEQ ID NO: 746930 - protein, 24 aa, Mycobacterium
VLGVCVGMQILFARGVEFGVETQG

SEQ ID NO: 746931 - protein, 22 aa, Mycobacterium
VLGVCVGMQIMFARGVEFGVET

SEQ ID NO: 746932 - protein, 32 aa, Mycobacterium
VLGVDHLRKVVGWARDRGVLVASDECYLGLGW

SEQ ID NO: 746933 - protein, 25 aa, Mycobacterium
VLGVFCRRWGVPLIDGGTVRLPRLI

SEQ ID NO: 746934 - protein, 25 aa, Mycobacterium
VLGVSRPVVREALKRLTAAGLVEVR

SEQ ID NO: 746935 - protein, 21 aa, Mycobacterium
VLGWLRHGYPHGIPTTDYFPL

SEQ ID NO: 746936 - protein, 19 aa, Mycobacterium
VLGWRAQHSQAHYAAAKAG

SEQ ID NO: 746937 - protein, 20 aa, Mycobacterium
VLGYRNWLGLNKGDLSEDVD

SEQ ID NO: 746938 - protein, 20 aa, Mycobacterium
VLGYRNWLGLNKGDLSEEVS

SEQ ID NO: 746939 - protein, 23 aa, Mycobacterium
VLHAAWAQLLAWLTGQHDVAFGT

SEQ ID NO: 746940 - protein, 17 aa, Mycobacterium
VLHARWGGELYWHQGSH

SEQ ID NO: 746941 - protein, 21 aa, Mycobacterium
VLHCVHRNAAVPPSFDSTMIV

SEQ ID NO: 746942 - protein, 18 aa, Mycobacterium
VLHEGPRSLGYGAGLAAR

SEQ ID NO: 746943 - protein, 18 aa, Mycobacterium
VLHHWPASAWRNWNHQFD

SEQ ID NO: 746944 - protein, 18 aa, Mycobacterium
VLHHWPASAWRNWNKDFD

SEQ ID NO: 746945 - protein, 26 aa, Mycobacterium
VLHLELGGNCPVIVLGDVDVEAVAHE

SEQ ID NO: 746946 - protein, 24 aa, Mycobacterium
VLHLLYSRFWHKVLYDLGHVSSRE

SEQ ID NO: 746947 - protein, 25 aa, Mycobacterium
VLHLLYSRFWHKVLYDLGYVSSREP

SEQ ID NO: 746948 - protein, 18 aa, Mycobacterium
VLHMPFKSELATMGQTVH

SEQ ID NO: 746949 - protein, 25 aa, Mycobacterium
VLHPLSAPMTLRWLTDRFAGRPLSE

SEQ ID NO: 746950 - protein, 20 aa, Mycobacterium
VLHPRVVKAIAVVSSPHPSA

SEQ ID NO: 746951 - protein, 18 aa, Mycobacterium
VLHPVGWPAADFQGPICG

SEQ ID NO: 746952 - protein, 18 aa, Mycobacterium
VLHRPKLGFPVPIRHWLR

SEQ ID NO: 746953 - protein, 36 aa, Mycobacterium
VLHRPKLGFPVPIRHWLRAGELLDWAYGLAASSQAG

SEQ ID NO: 746954 - protein, 36 aa, Mycobacterium
VLHRPKLGFPVPIRHWLRSGALLDWAHQTVSGSGAG

SEQ ID NO: 746955 - protein, 22 aa, Mycobacterium
VLHRRSGIATPRTWRFHLAATT

SEQ ID NO: 746956 - protein, 18 aa, Mycobacterium
VLIALVVAEHVHHDVAAA

SEQ ID NO: 746957 - protein, 19 aa, Mycobacterium
VLICATGFRLWDKGSVPPF

SEQ ID NO: 746958 - protein, 27 aa, Mycobacterium
VLICVGGSLPGWLAYRDALAGAGADFP

SEQ ID NO: 746959 - protein, 17 aa, Mycobacterium
VLIEAPEGITFAVETPT

SEQ ID NO: 746960 - protein, 19 aa, Mycobacterium
VLIEPGVRTGIPLLVDNPK

SEQ ID NO: 746961 - protein, 25 aa, Mycobacterium
VLIERAVRWAVAEFEPLRVGIFEVD

SEQ ID NO: 746962 - protein, 19 aa, Mycobacterium
VLIGGEGRLAEPLRAALAD

SEQ ID NO: 746963 - protein, 17 aa, Mycobacterium
VLIGGGPMPAGMAERAA

SEQ ID NO: 746964 - protein, 24 aa, Mycobacterium
VLIKAEAIGVNFIDTYFRSGLYPR

SEQ ID NO: 746965 - protein, 21 aa, Mycobacterium
VLIKAYHRWGDDFVSHLFGMF

SEQ ID NO: 746966 - protein, 28 aa, Mycobacterium
VLINRVLKGAWGFRGWVMSDWGATPSWE

SEQ ID NO: 746967 - protein, 23 aa, Mycobacterium
VLIPDQRAGCSLADSITPDELRA

SEQ ID NO: 746968 - protein, 17 aa, Mycobacterium
VLIPELPGIHPGVLGLG

SEQ ID NO: 746969 - protein, 20 aa, Mycobacterium
VLIQRGTLRVGDSVVAGDAY

SEQ ID NO: 746970 - protein, 24 aa, Mycobacterium
VLIRAGESMLSLGNQLDMLMGALG

SEQ ID NO: 746971 - protein, 17 aa, Mycobacterium
VLISGRLLNMISADEPD

SEQ ID NO: 746972 - protein, 18 aa, Mycobacterium
VLISPAWKRAEVDHALAL

SEQ ID NO: 746973 - protein, 25 aa, Mycobacterium
VLIVACLKLGPKDGRIPFVPMPHAA

SEQ ID NO: 746974 - protein, 38 aa, Mycobacterium
VLKAEPWRPDAVLTHARRLAGICGVPAPPESAVVSVVL

SEQ ID NO: 746975 - protein, 24 aa, Mycobacterium
VLKARPGEVVSEFPIDLGTTSTDI

SEQ ID NO: 746976 - protein, 19 aa, Mycobacterium
VLKLARQPYYRWLADPVTD

SEQ ID NO: 746977 - protein, 20 aa, Mycobacterium
VLKLSRQPYYRWLADPITEA

SEQ ID NO: 746978 - protein, 20 aa, Mycobacterium
VLKPHQWTPLDAFEIAKAAQ

SEQ ID NO: 746979 - protein, 20 aa, Mycobacterium
VLKRLGFKQPYIALMPQWDF

SEQ ID NO: 746980 - protein, 18 aa, Mycobacterium
VLKRLQPRLYSISSSPKE

SEQ ID NO: 746981 - protein, 20 aa, Mycobacterium
VLKSGAAYLPIDPALPESRI

SEQ ID NO: 746982 - protein, 19 aa, Mycobacterium
VLKSGAAYLPIDPALPTTR

SEQ ID NO: 746983 - protein, 21 aa, Mycobacterium
VLKSGAAYLPIDPGLPAERIG

SEQ ID NO: 746984 - protein, 17 aa, Mycobacterium
VLKSILDRTPWRAEQPV

SEQ ID NO: 746985 - protein, 25 aa, Mycobacterium
VLKTELRLRYGVGVYSESRSVSRSF

SEQ ID NO: 746986 - protein, 25 aa, Mycobacterium
VLLARAGFDPATLREAYELSSQYNL

SEQ ID NO: 746987 - protein, 28 aa, Mycobacterium
VLLARHGLLRGLRLLPVNGNGDDAVAEE

SEQ ID NO: 746988 - protein, 18 aa, Mycobacterium
VLLATLGARGMRRILTEG

SEQ ID NO: 746989 - protein, 25 aa, Mycobacterium
VLLDGWKELYLPVIRLLEPSLSAGA

SEQ ID NO: 746990 - protein, 25 aa, Mycobacterium
VLLDHIPEALPIVYTPTVGEACQRF

SEQ ID NO: 746991 - protein, 30 aa, Mycobacterium
VLLDKKWLKPTAYMMAKFGMTLCALGIAEE

SEQ ID NO: 746992 - protein, 25 aa, Mycobacterium
VLLDLCTGVAFPAFPALLAATERGA

SEQ ID NO: 746993 - protein, 26 aa, Mycobacterium
VLLDLRPAVVSFTFGLPSAEERRRLT

SEQ ID NO: 746994 - protein, 20 aa, Mycobacterium
VLLDQGALFLADRTVVGARQ

SEQ ID NO: 746995 - protein, 23 aa, Mycobacterium
VLLDRASGQWVRHPWQELHTRAE

SEQ ID NO: 746996 - protein, 29 aa, Mycobacterium
VLLDRERCILCARCTRFSEQIAGDPFIDM

SEQ ID NO: 746997 - protein, 29 aa, Mycobacterium
VLLDRERCILCARCTRFSNQIAGDPFIDM

SEQ ID NO: 746998 - protein, 29 aa, Mycobacterium
VLLDRERCVLCARCTRFSDQIAGDRFIDL

SEQ ID NO: 746999 - protein, 28 aa, Mycobacterium
VLLDRERCVLCARCTRFSQQVAGDPFIE

SEQ ID NO: 747000 - protein, 21 aa, Mycobacterium
VLLECTLAGLATCPVTHLTEI

SEQ ID NO: 747001 - protein, 22 aa, Mycobacterium
VLLECTLAGLATCPVTHLTEMD

SEQ ID NO: 747002 - protein, 21 aa, Mycobacterium
VLLECTMSGLATCPVTHVTEL

SEQ ID NO: 747003 - protein, 29 aa, Mycobacterium
VLLEHLGVPRWRLMGVFGDPDADAVSIAA

SEQ ID NO: 747004 - protein, 21 aa, Mycobacterium
VLLERCSVFAGGFDLQSACAV

SEQ ID NO: 747005 - protein, 23 aa, Mycobacterium
VLLERRLSDVAARAPVFPMAIRA

SEQ ID NO: 747006 - protein, 21 aa, Mycobacterium
VLLEVAWEALEHAGLPPDSLS

SEQ ID NO: 747007 - protein, 19 aa, Mycobacterium
VLLFKYIIKNTAWANGKTV

SEQ ID NO: 747008 - protein, 27 aa, Mycobacterium
VLLFKYIIKNTAWQAGKTVTFMPKPLF

SEQ ID NO: 747009 - protein, 25 aa, Mycobacterium
VLLFPFAAGVATWWRTAGPKVAGLS

SEQ ID NO: 747010 - protein, 26 aa, Mycobacterium
VLLFPFAAGVATWWRTVGPKVAKLPN

SEQ ID NO: 747011 - protein, 24 aa, Mycobacterium
VLLGASRKRFLGSLLAGPDGATRP

SEQ ID NO: 747012 - protein, 24 aa, Mycobacterium
VLLGECGLALAFDRDKLPNLHGVL

SEQ ID NO: 747013 - protein, 24 aa, Mycobacterium
VLLGECGLALAFDRDKLSDLHGVL

SEQ ID NO: 747014 - protein, 24 aa, Mycobacterium
VLLGECGLALAFDRDQLSGLHGVL

SEQ ID NO: 747015 - protein, 30 aa, Mycobacterium; identical to SEQ ID NO: 92361

SEQ ID NO: 747016 - protein, 19 aa, Mycobacterium
VLLGPSGTGKSVFLKSLIG

SEQ ID NO: 747017 - protein, 26 aa, Mycobacterium
VLLHGLPVRKLWGIGPVAEDRLHRIG

SEQ ID NO: 747018 - protein, 21 aa, Mycobacterium
VLLKAYHRWGDAFVGHLHGMF

SEQ ID NO: 747019 - protein, 17 aa, Mycobacterium
VLLKTLALEFIMSDHRH

SEQ ID NO: 747020 - protein, 25 aa, Mycobacterium
VLLLASRSKTAWLLGTACLSMAKIL

SEQ ID NO: 747021 - protein, 17 aa, Mycobacterium
VLLLCLTCLSGTAQRIQ

SEQ ID NO: 747022 - protein, 17 aa, Mycobacterium
VLLLCWRDTGHPQGGGS

SEQ ID NO: 747023 - protein, 19 aa, Mycobacterium
VLLLHGFPSSSFDFRSVIP

SEQ ID NO: 747024 - protein, 18 aa, Mycobacterium
VLLMAVERIELFVDALLK

SEQ ID NO: 747025 - protein, 18 aa, Mycobacterium
VLLMLGTDFPYRQFYPPK

SEQ ID NO: 747026 - protein, 17 aa, Mycobacterium
VLLNELRDLAGEPLAET

SEQ ID NO: 747027 - protein, 18 aa, Mycobacterium
VLLNINLEAVWRLGGCLQ

SEQ ID NO: 747028 - protein, 25 aa, Mycobacterium
VLLNSKTRRPSVCNAAETLLVDANI

SEQ ID NO: 747029 - protein, 19 aa, Mycobacterium
VLLPCGGAIDFLAGKTIRA

SEQ ID NO: 747030 - protein, 17 aa, Mycobacterium
VLLPGFVDLHTHLREPG

SEQ ID NO: 747031 - protein, 17 aa, Mycobacterium
VLLQPSAAFGRHGAGDL

SEQ ID NO: 747032 - protein, 22 aa, Mycobacterium
VLLQRAPVPFLHHSSWQVDDVD

SEQ ID NO: 747033 - protein, 18 aa, Mycobacterium
VLLRAGIERAQAFAAVSS

SEQ ID NO: 747034 - protein, 25 aa, Mycobacterium
VLLRARPGTRLVVAGVCMQPDTVHP

SEQ ID NO: 747035 - protein, 31 aa, Mycobacterium
VLLREAHDMFGLPVAVFRSSMVMADTSYAGQ

SEQ ID NO: 747036 - protein, 19 aa, Mycobacterium
VLLRNILENPAWYTAYTPY

SEQ ID NO: 747037 - protein, 20 aa, Mycobacterium
VLLRNVLENPAWYTAYTPYQ

SEQ ID NO: 747038 - protein, 20 aa, Mycobacterium
VLLRPAHRSAERMLRAMGLP

SEQ ID NO: 747039 - protein, 22 aa, Mycobacterium
VLLRPDGHIAWVGDEQGDLEGC

SEQ ID NO: 747040 - protein, 26 aa, Mycobacterium
VLLRRDVPELAAFIDWEMCTVGDPLL

SEQ ID NO: 747041 - protein, 23 aa, Mycobacterium
VLLRRKRHPLLAVARSRAHQLLR

SEQ ID NO: 747042 - protein, 18 aa, Mycobacterium
VLLRRQGVAIVDLMDPVF

SEQ ID NO: 747043 - protein, 22 aa, Mycobacterium
VLLRRRPTGLVRPGDTELVTTP

SEQ ID NO: 747044 - protein, 18 aa, Mycobacterium
VLLRSMGVPARYVSGYLH

SEQ ID NO: 747045 - protein, 18 aa, Mycobacterium
VLLRTCRHLKILATSREV

SEQ ID NO: 747046 - protein, 24 aa, Mycobacterium
VLLSDPWACSRFAEHEVVVPLVVI

SEQ ID NO: 747047 - protein, 23 aa, Mycobacterium
VLLSDPWACTRFAEHEVVVPLVV

SEQ ID NO: 747048 - protein, 18 aa, Mycobacterium
VLLSDPWATNRFAEHEVV

SEQ ID NO: 747049 - protein, 23 aa, Mycobacterium
VLLSLRPDLRMPIVETTTSLLRI

SEQ ID NO: 747050 - protein, 19 aa, Mycobacterium
VLLTHGFGATAGMWEPNVD

SEQ ID NO: 747051 - protein, 25 aa, Mycobacterium
VLLTLHPRLGRWVQLGGHCEDDHDI

SEQ ID NO: 747052 - protein, 26 aa, Mycobacterium
VLLVGARLNWLLGHGDSPQWAADARF

SEQ ID NO: 747053 - protein, 27 aa, Mycobacterium
VLLVGARLNWLLGHGEPPQFSRDVKFI

SEQ ID NO: 747054 - protein, 18 aa, Mycobacterium
VLLVGHGHFSRALMTRWI

SEQ ID NO: 747055 - protein, 26 aa, Mycobacterium
VLMDARATHPLLWKSGALHRSPDYAP

SEQ ID NO: 747056 - protein, 21 aa, Mycobacterium
VLMDRWDPVRAVALMNDERCT

SEQ ID NO: 747057 - protein, 20 aa, Mycobacterium
VLMGLKARRPVSAGHVFERI

SEQ ID NO: 747058 - protein, 19 aa, Mycobacterium
VLMPRFEPAEFLRLVTSHR

SEQ ID NO: 747059 - protein, 26 aa, Mycobacterium
VLMSGYLGSIGFGFPAAMGAWAAAPD

SEQ ID NO: 747060 - protein, 17 aa, Mycobacterium
VLMTGFGFTPPVVTPTW

SEQ ID NO: 747061 - protein, 19 aa, Mycobacterium
VLNAPWWNPALLARDIATT

SEQ ID NO: 747062 - protein, 24 aa, Mycobacterium
VLNARFALNAANARWGSLYDALYG

SEQ ID NO: 747063 - protein, 20 aa, Mycobacterium
VLNGTKCWITNGGKSSWYTV

SEQ ID NO: 747064 - protein, 23 aa, Mycobacterium
VLNHPGNGVAWLANRLAPHGVWL

SEQ ID NO: 747065 - protein, 17 aa, Mycobacterium
VLNIKWENLDAVLHKHV

SEQ ID NO: 747066 - protein, 27 aa, Mycobacterium
VLNKLRSKGIRRIVMLTGDHPDTAEVV

SEQ ID NO: 747067 - protein, 26 aa, Mycobacterium
VLNLMPRWYIGSVLRHVDFLTSDVPG

SEQ ID NO: 747068 - protein, 21 aa, Mycobacterium
VLNPLPVVRWNIDKRYLNDLA

SEQ ID NO: 747069 - protein, 17 aa, Mycobacterium
VLNPMAAIMQTRAGRGW

SEQ ID NO: 747070 - protein, 24 aa, Mycobacterium
VLNQQRPRIVTAMRKLGDFSDTAT

SEQ ID NO: 747071 - protein, 19 aa, Mycobacterium
VLNRAEFRVAILTGAGRGF

SEQ ID NO: 747072 - protein, 18 aa, Mycobacterium
VLNRLWRLVNDRLNYLTP

SEQ ID NO: 747073 - protein, 20 aa, Mycobacterium
VLNRSLPRAQRLAGKVRGAG

SEQ ID NO: 747074 - protein, 22 aa, Mycobacterium
VLNTGRLQHHWHTLTKTGRIKT

SEQ ID NO: 747075 - protein, 23 aa, Mycobacterium
VLPAEYRIALQISGHDFEREEPK

SEQ ID NO: 747076 - protein, 17 aa, Mycobacterium
VLPAIKDEHPGAADDLA

SEQ ID NO: 747077 - protein, 19 aa, Mycobacterium
VLPALAAGCTVVIKPSELT

SEQ ID NO: 747078 - protein, 21 aa, Mycobacterium
VLPAPRPIRTLLIAAGSGITP

SEQ ID NO: 747079 - protein, 19 aa, Mycobacterium
VLPASEWPWAPSDIDPLTF

SEQ ID NO: 747080 - protein, 25 aa, Mycobacterium
VLPASMGRPEFETPVGTYHVISKDR

SEQ ID NO: 747081 - protein, 21 aa, Mycobacterium
VLPDAELRRIATLCAAFDVDG

SEQ ID NO: 747082 - protein, 20 aa, Mycobacterium
VLPDPAPRSMLFVTAGSGIT

SEQ ID NO: 747083 - protein, 36 aa, Mycobacterium
VLPDPVGLLRCCGGADLAAMAGFCAQAAVRRTPLLL

SEQ ID NO: 747084 - protein, 18 aa, Mycobacterium
VLPEFAKDLKLNLGSITR

SEQ ID NO: 747085 - protein, 24 aa, Mycobacterium
VLPELKGKLDGYALRVPIPTGSAT

SEQ ID NO: 747086 - protein, 18 aa, Mycobacterium
VLPESAARVRANIDEMAV

SEQ ID NO: 747087 - protein, 20 aa, Mycobacterium
VLPETMAALGAQAVLANAYH

SEQ ID NO: 747088 - protein, 19 aa, Mycobacterium
VLPEVPLLVSPSVEELMKA

SEQ ID NO: 747089 - protein, 18 aa, Mycobacterium
VLPFDVAIPNGFPGTSAT

SEQ ID NO: 747090 - protein, 18 aa, Mycobacterium
VLPFKIDDHTAWRLLEGL

SEQ ID NO: 747091 - protein, 25 aa, Mycobacterium
VLPFNEVLDAAGFRCNFQESVGVSC

SEQ ID NO: 747092 - protein, 18 aa, Mycobacterium
VLPFRIDDHTAWRLLEGL

SEQ ID NO: 747093 - protein, 28 aa, Mycobacterium
VLPGCAPVRPAVRLWVDGVLAGRYSRTD

SEQ ID NO: 747094 - protein, 22 aa, Mycobacterium
VLPGGLNWPLDLAVGQDGQLYI

SEQ ID NO: 747095 - protein, 19 aa, Mycobacterium
VLPGPQLGFRVEYDTAAFD

SEQ ID NO: 747096 - protein, 22 aa, Mycobacterium
VLPGQGLPAGWTDFDRWLQTDS

SEQ ID NO: 747097 - protein, 17 aa, Mycobacterium
VLPGRPPLATLFLPHNR

SEQ ID NO: 747098 - protein, 19 aa, Mycobacterium
VLPGVGIYLDGGFGVGKTH

SEQ ID NO: 747099 - protein, 21 aa, Mycobacterium
VLPGVGLYLDGGFGVGKTHLL

SEQ ID NO: 747100 - protein, 20 aa, Mycobacterium
VLPHDDAYAWAQRSNVSVNT

SEQ ID NO: 747101 - protein, 23 aa, Mycobacterium
VLPHPRFTRHFTRHLPANAEVTH

SEQ ID NO: 747102 - protein, 23 aa, Mycobacterium
VLPKFDAGAVLAAIEEHQITATM

SEQ ID NO: 747103 - protein, 24 aa, Mycobacterium
VLPKLPSPGSQVWRSRRQIRRDLE

SEQ ID NO: 747104 - protein, 23 aa, Mycobacterium
VLPKPVAQMPVLLAGGGSLPDRS

SEQ ID NO: 747105 - protein, 18 aa, Mycobacterium
VLPLALSGMSRRIDSITL

SEQ ID NO: 747106 - protein, 17 aa, Mycobacterium
VLPLLFDSMFGMVIHAT

SEQ ID NO: 747107 - protein, 24 aa, Mycobacterium
VLPLPGHAVAAAFDGGTHQLAVLA

SEQ ID NO: 747108 - protein, 22 aa, Mycobacterium
VLPLSACGREFAESRLRYSRIC

SEQ ID NO: 747109 - protein, 20 aa, Mycobacterium
VLPMFFEFVGNSVLVAHNAG

SEQ ID NO: 747110 - protein, 22 aa, Mycobacterium
VLPNYSGGLGILAGDHLKSASD

SEQ ID NO: 747111 - protein, 18 aa, Mycobacterium
VLPPIDIVTEFGDHPDAS

SEQ ID NO: 747112 - protein, 25 aa, Mycobacterium
VLPPRSARLLICVDDGPGPDLPGAI

SEQ ID NO: 747113 - protein, 18 aa, Mycobacterium
VLPPWGIKIIRKAIHRSR

SEQ ID NO: 747114 - protein, 17 aa, Mycobacterium
VLPRRVAHQVVRVRNAM

SEQ ID NO: 747115 - protein, 21 aa, Mycobacterium
VLPSHYEPFGIVALEAAATGT

SEQ ID NO: 747116 - protein, 25 aa, Mycobacterium
VLPSKIRSVGEYAYLRQSVRTNNAA

SEQ ID NO: 747117 - protein, 26 aa, Mycobacterium
VLPTAGCARHSSGLSVQTFLRGIHVV

SEQ ID NO: 747118 - protein, 21 aa, Mycobacterium
VLPTLRLIKLTSVVENGVELD

SEQ ID NO: 747119 - protein, 24 aa, Mycobacterium
VLPTPGTSFGRWSRLLDQHARTAD

SEQ ID NO: 747120 - protein, 26 aa, Mycobacterium
VLPVIGSKELIAWLPTLLGLGPADVV

SEQ ID NO: 747121 - protein, 26 aa, Mycobacterium
VLPVIGSKELIAWLPTLLGLGPGDVI

SEQ ID NO: 747122 - protein, 26 aa, Mycobacterium
VLPVIGSKELIAWLPTLLGLGSADMI

SEQ ID NO: 747123 - protein, 27 aa, Mycobacterium
VLPVIGTKEFIAWLPTLLGLGSADAVV

SEQ ID NO: 747124 - protein, 26 aa, Mycobacterium
VLPVIGTKELIAWLPTLLGLGAADTV

SEQ ID NO: 747125 - protein, 26 aa, Mycobacterium
VLPVIPMPFGFGIWTSHTTPIYLGAS

SEQ ID NO: 747126 - protein, 26 aa, Mycobacterium
VLPVTECWDLLAGVTLGRLVTSVGGQ

SEQ ID NO: 747127 - protein, 18 aa, Mycobacterium
VLPWPDYYGSVPGARNDG

SEQ ID NO: 747128 - protein, 19 aa, Mycobacterium
VLPYSWQRVSLYAGGAERL

SEQ ID NO: 747129 - protein, 22 aa, Mycobacterium
VLQGAWAQVLMWLTGQPDVAFG

SEQ ID NO: 747130 - protein, 19 aa, Mycobacterium
VLQGLRLTGDLSRFRRRVY

SEQ ID NO: 747131 - protein, 17 aa, Mycobacterium
VLQLGIRSPVAVAQTAI

SEQ ID NO: 747132 - protein, 17 aa, Mycobacterium
VLQLLKITGDWQKFKGL

SEQ ID NO: 747133 - protein, 28 aa, Mycobacterium
VLQLLQWHCPPTLWHLKTPVHMFALDAL

SEQ ID NO: 747134 - protein, 19 aa, Mycobacterium
VLQNPYAFYAMLREQAPVW

SEQ ID NO: 747135 - protein, 18 aa, Mycobacterium
VLQPMLAAALHLVEVLGE

SEQ ID NO: 747136 - protein, 18 aa, Mycobacterium
VLQPRVPYRSDAMATTPP

SEQ ID NO: 747137 - protein, 23 aa, Mycobacterium
VLQQPGAVSPEFADQVDDILALI

SEQ ID NO: 747138 - protein, 24 aa, Mycobacterium
VLQRAWFDKWLKGIDNGIDRYGPV

SEQ ID NO: 747139 - protein, 18 aa, Mycobacterium
VLQRIPSIDVVFVGHRRG

SEQ ID NO: 747140 - protein, 22 aa, Mycobacterium
VLQRLGWHVIHVIKEDWPTEVV

SEQ ID NO: 747141 - protein, 24 aa, Mycobacterium
VLQVNFRGSTGFGKAFTKAAIGEF

SEQ ID NO: 747142 - protein, 21 aa, Mycobacterium
VLQVRDVPRPVPAPDEVLVQV

SEQ ID NO: 747143 - protein, 20 aa, Mycobacterium
VLQVREQLLILPIIGVLDSQ

SEQ ID NO: 747144 - protein, 18 aa, Mycobacterium
VLQVVWPVLTTLASRPVV

SEQ ID NO: 747145 - protein, 19 aa, Mycobacterium
VLRACGFDTPYPPARLEKV

SEQ ID NO: 747146 - protein, 18 aa, Mycobacterium
VLRADEWDSPLVPLLASE

SEQ ID NO: 747147 - protein, 21 aa, Mycobacterium
VLRADLLRPWANWITPEAERT

SEQ ID NO: 747148 - protein, 17 aa, Mycobacterium
VLRAEPWRPEAVLRHAR

SEQ ID NO: 747149 - protein, 18 aa, Mycobacterium
VLRAKRAAFDKLVYGKLR

SEQ ID NO: 747150 - protein, 19 aa, Mycobacterium
VLRAQGLAYVRFALQTPEL

SEQ ID NO: 747151 - protein, 19 aa, Mycobacterium
VLRAVKSVLDPAGILNPGK

SEQ ID NO: 747152 - protein, 25 aa, Mycobacterium
VLRCGEALSAFLLDATMTGLATCTV

SEQ ID NO: 747153 - protein, 26 aa, Mycobacterium
VLRDAHPRWGPTRIVYELVREGVVAV

SEQ ID NO: 747154 - protein, 24 aa, Mycobacterium
VLRDARFQIPPGINLLAQGVTSGP

SEQ ID NO: 747155 - protein, 23 aa, Mycobacterium
VLRDEVRGLGPLPATGRGLRAAA

SEQ ID NO: 747156 - protein, 21 aa, Mycobacterium
VLRDEVRGVGPLVAAGRGLRA

SEQ ID NO: 747157 - protein, 27 aa, Mycobacterium
VLRDLASRIFADFAYRSGSTTISTGVN

SEQ ID NO: 747158 - protein, 19 aa, Mycobacterium
VLRDRLPKVGALFLQGLLS

SEQ ID NO: 747159 - protein, 22 aa, Mycobacterium
VLRDRLTQLWLRSEAQRLTAER

SEQ ID NO: 747160 - protein, 24 aa, Mycobacterium
VLRDSESWVDYSYINHLVVNDGVI

SEQ ID NO: 747161 - protein, 19 aa, Mycobacterium
VLRDSRFVTAHGLGLGLQG

SEQ ID NO: 747162 - protein, 24 aa, Mycobacterium
VLRDTRFQIPPGLNLLVQGITSGP

SEQ ID NO: 747163 - protein, 17 aa, Mycobacterium
VLREARTAQGRTLREVS

SEQ ID NO: 747164 - protein, 28 aa, Mycobacterium
VLRECTARGIAFVPFFPLGAAFVQPNPV

SEQ ID NO: 747165 - protein, 19 aa, Mycobacterium
VLREGLACAVLRRSDHRET

SEQ ID NO: 747166 - protein, 25 aa, Mycobacterium
VLREHLAGLCERVDVLPGADGRAYL

SEQ ID NO: 747167 - protein, 20 aa, Mycobacterium
VLREKRAWAELAEVVPQLVT

SEQ ID NO: 747168 - protein, 17 aa, Mycobacterium
VLRELGELVEFYLEHLP

SEQ ID NO: 747169 - protein, 32 aa, Mycobacterium
VLRELPYDRALELGCGTGFFLLNLIQSGVARR

SEQ ID NO: 747170 - protein, 21 aa, Mycobacterium
VLREPLTWLELVDRYRITVTW

SEQ ID NO: 747171 - protein, 17 aa, Mycobacterium
VLREVLRRAELITTTAA

SEQ ID NO: 747172 - protein, 18 aa, Mycobacterium
VLREVPVAEYARRCGVDE

SEQ ID NO: 747173 - protein, 17 aa, Mycobacterium
VLRFIVDYQHSYSGVRM

SEQ ID NO: 747174 - protein, 18 aa, Mycobacterium
VLRHWGVQPDFVMGHSVG

SEQ ID NO: 747175 - protein, 24 aa, Mycobacterium
VLRKADGNGSVWLHDNLELGMSVE

SEQ ID NO: 747176 - protein, 17 aa, Mycobacterium
VLRKRFNGQPEFVENFF

SEQ ID NO: 747177 - protein, 22 aa, Mycobacterium
VLRLFGDLLYLDRYWLEEQQVC

SEQ ID NO: 747178 - protein, 24 aa, Mycobacterium
VLRLLREVNAEFGVTIVVITHEMD

SEQ ID NO: 747179 - protein, 26 aa, Mycobacterium
VLRLMMKYDPHFFAFLEIPEVLNVVD

SEQ ID NO: 747180 - protein, 24 aa, Mycobacterium
VLRLPGRGADEWVPVHVTVNRIEL

SEQ ID NO: 747181 - protein, 20 aa, Mycobacterium
VLRLPIPPRVALLACASGGD

SEQ ID NO: 747182 - protein, 23 aa, Mycobacterium
VLRLRPRPPALLEPYDLARQFAI

SEQ ID NO: 747183 - protein, 17 aa, Mycobacterium
VLRLRPVEVVSSAALQL

SEQ ID NO: 747184 - protein, 19 aa, Mycobacterium
VLRMARECHDDGVALAVFP

SEQ ID NO: 747185 - protein, 26 aa, Mycobacterium
VLRNLPGAQVRFVWHEAGPITADSGV

SEQ ID NO: 747186 - protein, 18 aa, Mycobacterium
VLRNRAYTPWYLVRYWRL

SEQ ID NO: 747187 - protein, 34 aa, Mycobacterium
VLRPEQFPPNMLVPDPKHPGVMRVGTLEELRQMK

SEQ ID NO: 747188 - protein, 20 aa, Mycobacterium
VLRPHGLTFSRYELLMLLSF

SEQ ID NO: 747189 - protein, 19 aa, Mycobacterium
VLRPLLLDYVLSMPRGAQV

SEQ ID NO: 747190 - protein, 21 aa, Mycobacterium
VLRPLTARHDVLWPMIADMPA

SEQ ID NO: 747191 - protein, 17 aa, Mycobacterium
VLRRARDGVSLNLDEAA

SEQ ID NO: 747192 - protein, 17 aa, Mycobacterium
VLRRARDGVTLNVDEAA

SEQ ID NO: 747193 - protein, 19 aa, Mycobacterium
VLRRASAYLSQANLPGKGS

SEQ ID NO: 747194 - protein, 17 aa, Mycobacterium
VLRRAVDHGVRFFDTAN

SEQ ID NO: 747195 - protein, 17 aa, Mycobacterium
VLRRAWADAETRAKVQR

SEQ ID NO: 747196 - protein, 18 aa, Mycobacterium
VLRREILDESALPDGDVE

SEQ ID NO: 747197 - protein, 21 aa, Mycobacterium
VLRRHPLVIAAGVYAVPDPRS

SEQ ID NO: 747198 - protein, 18 aa, Mycobacterium
VLRRLEGHFTLVFANADD

SEQ ID NO: 747199 - protein, 23 aa, Mycobacterium
VLRRPGGTVLVAFVVWQEDTDGD

SEQ ID NO: 747200 - protein, 31 aa, Mycobacterium
VLRRRGDGRWAWRWDPAFATSNFQFLQSDSD

SEQ ID NO: 747201 - protein, 24 aa, Mycobacterium
VLRRRLNPPSASWVYELTPWGAEL

SEQ ID NO: 747202 - protein, 17 aa, Mycobacterium
VLRRRWLNPEFYLFRHG

SEQ ID NO: 747203 - protein, 17 aa, Mycobacterium
VLRRTGVVTARKDGNTV

SEQ ID NO: 747204 - protein, 21 aa, Mycobacterium
VLRSGCGYLQPSMKQILEGRC

SEQ ID NO: 747205 - protein, 23 aa, Mycobacterium
VLRSLGSAGLRFERQCQNALALA

SEQ ID NO: 747206 - protein, 23 aa, Mycobacterium
VLRSLRFEQRWLVVDVATDSTID

SEQ ID NO: 747207 - protein, 20 aa, Mycobacterium
VLRTEIWPLLHDRSPITKSE

SEQ ID NO: 747208 - protein, 25 aa, Mycobacterium
VLRTGEETYRFVLTNHHIVLDGWSK

SEQ ID NO: 747209 - protein, 25 aa, Mycobacterium
VLRTPESWLLIDFEGEPGQPLDERR

SEQ ID NO: 747210 - protein, 25 aa, Mycobacterium
VLRTPESWLLIDFEGEPGQPLEDRR

SEQ ID NO: 747211 - protein, 25 aa, Mycobacterium
VLRTPESWLLIDFEGEPGQPVDERR

SEQ ID NO: 747212 - protein, 22 aa, Mycobacterium
VLRTRAAAVGIDIELVDIEKKL

SEQ ID NO: 747213 - protein, 19 aa, Mycobacterium
VLRVGRIGGQYAKPRSKPT

SEQ ID NO: 747214 - protein, 17 aa, Mycobacterium
VLRVGVAEFRRSLERVL

SEQ ID NO: 747215 - protein, 26 aa, Mycobacterium
VLRVRAISGGWLRLRASATKFALRDN

SEQ ID NO: 747216 - protein, 18 aa, Mycobacterium
VLRVRRPVLRRELERAER

SEQ ID NO: 747217 - protein, 22 aa, Mycobacterium
VLRVRVRNFPAFIVIDDKGNDF

SEQ ID NO: 747218 - protein, 17 aa, Mycobacterium
VLRVSWRALENSGINPD

SEQ ID NO: 747219 - protein, 26 aa, Mycobacterium
VLRVVRHWIDHGVKFFRVDNPHTKPP

SEQ ID NO: 747220 - protein, 19 aa, Mycobacterium
VLSAAALWDGCGAWSAPRR

SEQ ID NO: 747221 - protein, 26 aa, Mycobacterium
VLSALGPKLPELWGGSADLAGSNNTT

SEQ ID NO: 747222 - protein, 26 aa, Mycobacterium
VLSAQAAKFHSRFAQTLAAAAASYAG

SEQ ID NO: 747223 - protein, 23 aa, Mycobacterium
VLSARGGQWLVHLVRARCGVRAR

SEQ ID NO: 747224 - protein, 24 aa, Mycobacterium
VLSDGRIDAGFGLSWVRDEYDVSG

SEQ ID NO: 747225 - protein, 26 aa, Mycobacterium
VLSEGRLDLGVGVGWQREEYDAAGLS

SEQ ID NO: 747226 - protein, 18 aa, Mycobacterium
VLSERVFEPLGMTDTGFS

SEQ ID NO: 747227 - protein, 18 aa, Mycobacterium
VLSERYGYRFEYHDIPAF

SEQ ID NO: 747228 - protein, 39 aa, Mycobacterium
VLSFVAVCGQCRWCATGMEYICDVGAFTLTPGMPTDGTF

SEQ ID NO: 747229 - protein, 17 aa, Mycobacterium
VLSGKLRLILGEQDFTV

SEQ ID NO: 747230 - protein, 20 aa, Mycobacterium
VLSGPLVRSSYRAGRLYQQA

SEQ ID NO: 747231 - protein, 21 aa, Mycobacterium
VLSGRLRLILGDRDFTIKPGE

SEQ ID NO: 747232 - protein, 20 aa, Mycobacterium
VLSLCGGTLPAAMLGADANN

SEQ ID NO: 747233 - protein, 22 aa, Mycobacterium
VLSLGAPMDVLWFRMSRRPGDP

SEQ ID NO: 747234 - protein, 20 aa, Mycobacterium
VLSLGSGVRKVMAMDVNRAR

SEQ ID NO: 747235 - protein, 27 aa, Mycobacterium
VLSLMLRAPFRLTREVLPHLRPGSAII

SEQ ID NO: 747236 - protein, 23 aa, Mycobacterium
VLSLTGRPLIGNGANGAPGTGAN

SEQ ID NO: 747237 - protein, 19 aa, Mycobacterium
VLSLTRWAAEPDARDALGI

SEQ ID NO: 747238 - protein, 27 aa, Mycobacterium
VLSPHWPEYLGALGFPIHYRGNHLHLR

SEQ ID NO: 747239 - protein, 19 aa, Mycobacterium
VLSPRAAAQYNTRRADWHA

SEQ ID NO: 747240 - protein, 28 aa, Mycobacterium
VLSQRSKLLYDYFVELFAQVTNPPLDAI

SEQ ID NO: 747241 - protein, 17 aa, Mycobacterium
VLSRAIGALATVEGEQR

SEQ ID NO: 747242 - protein, 22 aa, Mycobacterium
VLSRAVGPIGLILDAVADLDPL

SEQ ID NO: 747243 - protein, 20 aa, Mycobacterium
VLSRGVCGVAGQSLIVNLPG

SEQ ID NO: 747244 - protein, 17 aa, Mycobacterium
VLSRHGATPRAVRREIA

SEQ ID NO: 747245 - protein, 22 aa, Mycobacterium
VLSRIMPPLARWVSAQMAKAAK

SEQ ID NO: 747246 - protein, 23 aa, Mycobacterium
VLSRLRSGILVVDEAFIEMSTKD

SEQ ID NO: 747247 - protein, 26 aa, Mycobacterium
VLSRPKWPDIPGVRDFAGVTLHTARW

SEQ ID NO: 747248 - protein, 18 aa, Mycobacterium
VLSRRPRMLYDYFQQLFA

SEQ ID NO: 747249 - protein, 24 aa, Mycobacterium
VLSRTRLLELVWGYDFDVETNVAD

SEQ ID NO: 747250 - protein, 18 aa, Mycobacterium
VLSSPGYREAAQRAAASI

SEQ ID NO: 747251 - protein, 25 aa, Mycobacterium
VLSSPRMLECFSLAGALAAATSAIG

SEQ ID NO: 747252 - protein, 28 aa, Mycobacterium
VLSSWVALRNRINFKPGSRVLILGATGS

SEQ ID NO: 747253 - protein, 20 aa, Mycobacterium
VLSTCPREAREPGGKTIRFA

SEQ ID NO: 747254 - protein, 23 aa, Mycobacterium
VLSVLRRLAPRARITARVGRVEQ

SEQ ID NO: 747255 - protein, 26 aa, Mycobacterium
VLSVPAPLPCTARGIVHLLRRYDVEI

SEQ ID NO: 747256 - protein, 21 aa, Mycobacterium
VLSYLGGLILAFANGSPEPLS

SEQ ID NO: 747257 - protein, 18 aa, Mycobacterium
VLTAAGAVQVKAPRVNDK

SEQ ID NO: 747258 - protein, 23 aa, Mycobacterium
VLTAAPVWAEPAARVETVVPVAQ

SEQ ID NO: 747259 - protein, 24 aa, Mycobacterium
VLTAAWLRALERFQARALAADGDT

SEQ ID NO: 747260 - protein, 23 aa, Mycobacterium
VLTACGIVAGYLYDAEAAAAYYA

SEQ ID NO: 747261 - protein, 23 aa, Mycobacterium
VLTADCVPVLLADARTGVIGAVH

SEQ ID NO: 747262 - protein, 20 aa, Mycobacterium
VLTADCVPVLMADARAGVTA

SEQ ID NO: 747263 - protein, 18 aa, Mycobacterium
VLTALDFVGHQRREFRFD

SEQ ID NO: 747264 - protein, 17 aa, Mycobacterium
VLTALLFTEQPTMTSSE

SEQ ID NO: 747265 - protein, 32 aa, Mycobacterium
VLTAMAAGVVRRWLRDRGELPNRPLVAACPIT

SEQ ID NO: 747266 - protein, 18 aa, Mycobacterium
VLTAMGLTERAARSTVRF

SEQ ID NO: 747267 - protein, 24 aa, Mycobacterium
VLTAQERLRFAAGNFYVNDKPTGA

SEQ ID NO: 747268 - protein, 17 aa, Mycobacterium
VLTCGMFGNVIRLLPPL

SEQ ID NO: 747269 - protein, 28 aa, Mycobacterium
VLTDCTRVAELRGLVAPADAVFLDAAIE

SEQ ID NO: 747270 - protein, 17 aa, Mycobacterium
VLTDLQWAIREGREGNL

SEQ ID NO: 747271 - protein, 26 aa, Mycobacterium
VLTDPNFRLPFGLTVTMDGRQGTGLV

SEQ ID NO: 747272 - protein, 25 aa, Mycobacterium
VLTDRWADHRVEPLFAAPFFAVVPY

SEQ ID NO: 747273 - protein, 17 aa, Mycobacterium
VLTEGWQAGGAGMEIPP

SEQ ID NO: 747274 - protein, 23 aa, Mycobacterium
VLTERFLRYYAGYVDKSHGASTP

SEQ ID NO: 747275 - protein, 27 aa, Mycobacterium
VLTERVRPGNTWAPFHWNDEHGENLTI

SEQ ID NO: 747276 - protein, 18 aa, Mycobacterium
VLTFMKHHVPISARFTAT

SEQ ID NO: 747277 - protein, 18 aa, Mycobacterium
VLTGEKLPAIFGSTPHPE

SEQ ID NO: 747278 - protein, 19 aa, Mycobacterium
VLTGLPAPAMHSIAVGLQD

SEQ ID NO: 747279 - protein, 26 aa, Mycobacterium
VLTGPRWRLGAHDLVVLWRRATGFGR

SEQ ID NO: 747280 - protein, 19 aa, Mycobacterium
VLTGPRWRLGGSDVAALWR

SEQ ID NO: 747281 - protein, 23 aa, Mycobacterium
VLTHEKLCPVLGMTTVADAPRGI

SEQ ID NO: 747282 - protein, 22 aa, Mycobacterium
VLTHLLGLPGVRNYDGSWTEWG

SEQ ID NO: 747283 - protein, 17 aa, Mycobacterium
VLTKAWSKFFPHVSQSA

SEQ ID NO: 747284 - protein, 23 aa, Mycobacterium
VLTKKPPRWIVVADLVETSRLFG

SEQ ID NO: 747285 - protein, 22 aa, Mycobacterium
VLTLRPRLTEVLGVDPLSDAGM

SEQ ID NO: 747286 - protein, 22 aa, Mycobacterium
VLTLTGRPLIGNGANGAAGTGA

SEQ ID NO: 747287 - protein, 24 aa, Mycobacterium
VLTPGDEFQPFWAHNRTEERQALQ

SEQ ID NO: 747288 - protein, 34 aa, Mycobacterium
VLTPLAVDPAHPFPFVSGLSLNLAITVKHPDDGG

SEQ ID NO: 747289 - protein, 35 aa, Mycobacterium
VLTPLAVDPAHPFPFVSGLSLNLAITVRHPDDGGQ

SEQ ID NO: 747290 - protein, 35 aa, Mycobacterium
VLTPLAVDPAHPFPFVSGLSLNLAVMVRQPEDGGQ

SEQ ID NO: 747291 - protein, 34 aa, Mycobacterium
VLTPLAVDPAHPFPFVSGLSLNLAVTVRQPDDGG

SEQ ID NO: 747292 - protein, 19 aa, Mycobacterium
VLTPLAVDPAHPFPYISGL

SEQ ID NO: 747293 - protein, 22 aa, Mycobacterium
VLTQRGSPIFAGRIPQTDAVSV

SEQ ID NO: 747294 - protein, 23 aa, Mycobacterium
VLTRDLPQWGMAPLAPGEKAPLI

SEQ ID NO: 747295 - protein, 18 aa, Mycobacterium
VLTREAGVPLLRQDGRGI

SEQ ID NO: 747296 - protein, 19 aa, Mycobacterium
VLTRLPLSGIRVLDLTTFW

SEQ ID NO: 747297 - protein, 25 aa, Mycobacterium
VLTRPDAASGRRGRPEPSPVAREAL

SEQ ID NO: 747298 - protein, 21 aa, Mycobacterium
VLTRPRLTGICGSDSKQILMD

SEQ ID NO: 747299 - protein, 24 aa, Mycobacterium
VLTRREFAGMISVAIESADGAANT

SEQ ID NO: 747300 - protein, 22 aa, Mycobacterium
VLTRVDGGVGFISLNRPKAINS

SEQ ID NO: 747301 - protein, 17 aa, Mycobacterium
VLTSARRSAEQGGDPRQ

SEQ ID NO: 747302 - protein, 22 aa, Mycobacterium
VLTSQVFPVWLLSRDPDAEVIV

SEQ ID NO: 747303 - protein, 23 aa, Mycobacterium
VLTSRPCPTCQGAGEVITDPCHK

SEQ ID NO: 747304 - protein, 20 aa, Mycobacterium
VLTSTHWPWIGDRTRHLDGP

SEQ ID NO: 747305 - protein, 20 aa, Mycobacterium
VLTTELPQTYALLGRTPRRA

SEQ ID NO: 747306 - protein, 19 aa, Mycobacterium
VLTTELPRTYELLGRTPRR

SEQ ID NO: 747307 - protein, 23 aa, Mycobacterium
VLVAALGRTITEWRGRRNQPTPP

SEQ ID NO: 747308 - protein, 17 aa, Mycobacterium
VLVAPDCYADSMSALEA

SEQ ID NO: 747309 - protein, 19 aa, Mycobacterium
VLVAQAWHWFDETRAVKEI

SEQ ID NO: 747310 - protein, 20 aa, Mycobacterium
VLVAQAWHWVDPERAIPEVA

SEQ ID NO: 747311 - protein, 20 aa, Mycobacterium
VLVCARGRLMQSCTPGAMMA

SEQ ID NO: 747312 - protein, 29 aa, Mycobacterium
VLVDFWASWCGPCRAFAPTFQASSEAHPD

SEQ ID NO: 747313 - protein, 29 aa, Mycobacterium
VLVDFWASWCGPCRQFGPTFQASSEKHPD

SEQ ID NO: 747314 - protein, 29 aa, Mycobacterium
VLVDFWASWCGPCRQFGPVFEASSEANPD

SEQ ID NO: 747315 - protein, 29 aa, Mycobacterium
VLVDFWASWCGPCRSFAPTFQASSEKHPD

SEQ ID NO: 747316 - protein, 22 aa, Mycobacterium
VLVDGALAWFLERGGRTLLTFT

SEQ ID NO: 747317 - protein, 22 aa, Mycobacterium
VLVDGHLAWFLERGGRSLLTFT

SEQ ID NO: 747318 - protein, 25 aa, Mycobacterium
VLVDLWRVVLKVPRIGVDDNFFDMG

SEQ ID NO: 747319 - protein, 22 aa, Mycobacterium
VLVECRGNVMVITINRPEARNA

SEQ ID NO: 747320 - protein, 18 aa, Mycobacterium
VLVEELWSRARAEHVQVA

SEQ ID NO: 747321 - protein, 17 aa, Mycobacterium
VLVEHGQGLTVSRDLPK

SEQ ID NO: 747322 - protein, 23 aa, Mycobacterium
VLVFAVGAFPPGIGPNAVTEDEL

SEQ ID NO: 747323 - protein, 25 aa, Mycobacterium
VLVGARLNWLLGHGESPQWAADAKF

SEQ ID NO: 747324 - protein, 18 aa, Mycobacterium
VLVGGAGFGPDGRYARLL

SEQ ID NO: 747325 - protein, 18 aa, Mycobacterium
VLVGGRFAFGKGEAAPAL

SEQ ID NO: 747326 - protein, 18 aa, Mycobacterium
VLVGHDWGGLASAGVAAY

SEQ ID NO: 747327 - protein, 17 aa, Mycobacterium
VLVINHIRPARNRKDRK

SEQ ID NO: 747328 - protein, 21 aa, Mycobacterium
VLVKASAGGGGRGMRVVRELS

SEQ ID NO: 747329 - protein, 25 aa, Mycobacterium
VLVKPEIMGGTGFLGAHADEVYHLE

SEQ ID NO: 747330 - protein, 26 aa, Mycobacterium
VLVKVAYCGICHSDLSLINGTFPTQA

SEQ ID NO: 747331 - protein, 26 aa, Mycobacterium
VLVKVEFCGICHSDLSLINGTFPAQV

SEQ ID NO: 747332 - protein, 30 aa, Mycobacterium
VLVKVSACGICGSDLHFAKHGARAIELSKQ

SEQ ID NO: 747333 - protein, 19 aa, Mycobacterium
VLVLERLEAAGAHPGEQVG

SEQ ID NO: 747334 - protein, 18 aa, Mycobacterium
VLVPAHIDAHTGYRFYDT

SEQ ID NO: 747335 - protein, 17 aa, Mycobacterium
VLVPAKGIERWLSQRLS

SEQ ID NO: 747336 - protein, 17 aa, Mycobacterium
VLVPALLDTNALRAQAH

SEQ ID NO: 747337 - protein, 24 aa, Mycobacterium
VLVPRKDMFVTPALQRFTGAIPGG

SEQ ID NO: 747338 - protein, 17 aa, Mycobacterium
VLVQALAGYDLRLYATP

SEQ ID NO: 747339 - protein, 18 aa, Mycobacterium
VLVRAFLRGPMHGAVSPP

SEQ ID NO: 747340 - protein, 19 aa, Mycobacterium
VLVRGGVVFTGYWHNEKAT

SEQ ID NO: 747341 - protein, 20 aa, Mycobacterium
VLVRGGVVFTGYWHNEKATA

SEQ ID NO: 747342 - protein, 17 aa, Mycobacterium
VLVRHAARTQKVPVLMA

SEQ ID NO: 747343 - protein, 21 aa, Mycobacterium
VLVRLMGELFLQPLVDAAWQR

SEQ ID NO: 747344 - protein, 30 aa, Mycobacterium
VLVRMRACGICGSDAFYITIGGLPPRQGHT

SEQ ID NO: 747345 - protein, 33 aa, Mycobacterium
VLVRPAPVPGYRGSRSFGFEEFDPFWQACIKAG

SEQ ID NO: 747346 - protein, 36 aa, Mycobacterium
VLVRPAPVPGYRGSRSFGFEEFDPFWQACIRAGIPV

SEQ ID NO: 747347 - protein, 17 aa, Mycobacterium
VLVRWSDIDMYQHINHA

SEQ ID NO: 747348 - protein, 17 aa, Mycobacterium
VLVSWLPQHHDMGLISA

SEQ ID NO: 747349 - protein, 20 aa, Mycobacterium
VLVTDRWLRAHPGVTPQARI

SEQ ID NO: 747350 - protein, 31 aa, Mycobacterium
VLVTGGNGWLGRWLVLDWLERLAPNGGKVYA

SEQ ID NO: 747351 - protein, 18 aa, Mycobacterium
VLVTIGFDPVEYDPRLWN

SEQ ID NO: 747352 - protein, 17 aa, Mycobacterium
VLVVDFGAQYAQLIARR

SEQ ID NO: 747353 - protein, 24 aa, Mycobacterium
VLWDARASIDLAVATGAKFVREIF

SEQ ID NO: 747354 - protein, 31 aa, Mycobacterium
VLWHMAAPCPVWLKQAWIDLLGPEVIWELYA

SEQ ID NO: 747355 - protein, 17 aa, Mycobacterium
VLWKPASTVPLLAMRLA

SEQ ID NO: 747356 - protein, 17 aa, Mycobacterium
VLYAEHGFNASTFAARV

SEQ ID NO: 747357 - protein, 17 aa, Mycobacterium
VLYEGYLLYPYRGDAAK

SEQ ID NO: 747358 - protein, 17 aa, Mycobacterium
VLYELPHGLRFTELLAL

SEQ ID NO: 747359 - protein, 17 aa, Mycobacterium
VLYEPYPIWGVPEYVPA

SEQ ID NO: 747360 - protein, 18 aa, Mycobacterium
VLYFPSLLPEISDEDPVA

SEQ ID NO: 747361 - protein, 24 aa, Mycobacterium
VLYLHGGGMIFGMRELGGLYDWLA

SEQ ID NO: 747362 - protein, 26 aa, Mycobacterium
VLYPRKGVSDLTRFTPEAVVEKYGLT

SEQ ID NO: 747363 - protein, 26 aa, Mycobacterium
VLYPRKGVSELTRFTPDAVVEKYGLT

SEQ ID NO: 747364 - protein, 21 aa, Mycobacterium
VLYRRWPSRLDLLKAVIRHRG

SEQ ID NO: 747365 - protein, 18 aa, Mycobacterium
VLYTRAGPEIGVAATKTF

SEQ ID NO: 747366 - protein, 17 aa, Mycobacterium
VLYWRMLTPPPLDRLPT

SEQ ID NO: 747367 - protein, 24 aa, Mycobacterium
VLYYHGGGFALGSIDTHDWVARSI

SEQ ID NO: 747368 - protein, 21 aa, Mycobacterium
VMAAAAAPYVSWMNTTAAQAQ

SEQ ID NO: 747369 - protein, 25 aa, Mycobacterium
VMAALRLDIPTVFVSGGPMEGGSAV

SEQ ID NO: 747370 - protein, 22 aa, Mycobacterium
VMAAMPRLLGAHYAAVQAYAAR

SEQ ID NO: 747371 - protein, 17 aa, Mycobacterium
VMAAWVILRAIDALLLM

SEQ ID NO: 747372 - protein, 23 aa, Mycobacterium
VMADAAAALAEFDVPTEVRVVSA

SEQ ID NO: 747373 - protein, 24 aa, Mycobacterium
VMADAAKALAEFDIAMEVRVVSAH

SEQ ID NO: 747374 - protein, 17 aa, Mycobacterium
VMADMPLTHTVALNAVT

SEQ ID NO: 747375 - protein, 19 aa, Mycobacterium
VMADPVMPPGIFINEDPPL

SEQ ID NO: 747376 - protein, 23 aa, Mycobacterium
VMAGREARGWLRVEAAGVQTKRQ

SEQ ID NO: 747377 - protein, 17 aa, Mycobacterium
VMAGSGPDRAWLICDDP

SEQ ID NO: 747378 - protein, 17 aa, Mycobacterium
VMAGWDVTVLIDRDEDV

SEQ ID NO: 747379 - protein, 21 aa, Mycobacterium
VMAHWLGRGADGWRLDAAYAV

SEQ ID NO: 747380 - protein, 23 aa, Mycobacterium
VMAKAFPASRFTGIDFSEEGLAA

SEQ ID NO: 747381 - protein, 19 aa, Mycobacterium
VMAKLPFTEHGFHLRPVPD

SEQ ID NO: 747382 - protein, 27 aa, Mycobacterium
VMAPRQWRGLRRWLGEPDDFQDPKYDV

SEQ ID NO: 747383 - protein, 26 aa, Mycobacterium
VMAPRQWRGLRRWLGEPEDFQDPKYD

SEQ ID NO: 747384 - protein, 26 aa, Mycobacterium
VMAPRQWRGLRRWLGEPPDFQDPKYD

SEQ ID NO: 747385 - protein, 26 aa, Mycobacterium
VMAPRQWRGLRRWLGEPQDFQDPRYD

SEQ ID NO: 747386 - protein, 21 aa, Mycobacterium
VMARGSRRLLLLAAPSVTKTV

SEQ ID NO: 747387 - protein, 38 aa, Mycobacterium
VMARNLLESFTLLANVSRLFVDKCVDGLVANEDHLRTL

SEQ ID NO: 747388 - protein, 25 aa, Mycobacterium
VMASWLPLCHDMGMVGFICIPMKTG

SEQ ID NO: 747389 - protein, 30 aa, Mycobacterium
VMAVIGKERFAEFLAGFHIVDEHFRTAPLH

SEQ ID NO: 747390 - protein, 18 aa, Mycobacterium
VMAVRRAVEKEGTPIAVT

SEQ ID NO: 747391 - protein, 18 aa, Mycobacterium
VMAWPHIGPDRSTWISYA

SEQ ID NO: 747392 - protein, 18 aa, Mycobacterium
VMCHSGFQIFGGGVLGGA

SEQ ID NO: 747393 - protein, 27 aa, Mycobacterium
VMCPICRKEQLTLVSWVFGDHLGAVSG

SEQ ID NO: 747394 - protein, 17 aa, Mycobacterium
VMCTATQIGEDWFDEDH

SEQ ID NO: 747395 - protein, 19 aa, Mycobacterium
VMDAEFLKDAGFVVVAPHT

SEQ ID NO: 747396 - protein, 25 aa, Mycobacterium
VMDNLKFLIENGIHAVVGTTGFTDE

SEQ ID NO: 747397 - protein, 25 aa, Mycobacterium
VMDNLKFLIGKGIHAVVGTTGFTDE

SEQ ID NO: 747398 - protein, 23 aa, Mycobacterium
VMDPRILTGALLYIPLLTRMLMN

SEQ ID NO: 747399 - protein, 18 aa, Mycobacterium
VMDRACVDECPVDCIYEG

SEQ ID NO: 747400 - protein, 18 aa, Mycobacterium
VMDRACVEECPVDCIYEG

SEQ ID NO: 747401 - protein, 23 aa, Mycobacterium
VMDRACVEECPVDCIYEGGRALY

SEQ ID NO: 747402 - protein, 17 aa, Mycobacterium
VMDRLRTNGPWESTQTH

SEQ ID NO: 747403 - protein, 23 aa, Mycobacterium
VMDRVNPVYIPRNHLVEDALTAA

SEQ ID NO: 747404 - protein, 17 aa, Mycobacterium
VMEGSRPLPAEAKLTVE

SEQ ID NO: 747405 - protein, 25 aa, Mycobacterium
VMFKIKHERTADCVLAGYRLHKSGG

SEQ ID NO: 747406 - protein, 24 aa, Mycobacterium
VMFKIKHERTADCVVAGYRVHKSG

SEQ ID NO: 747407 - protein, 24 aa, Mycobacterium
VMFNMCLHRGMQVCRAEIGNASNF

SEQ ID NO: 747408 - protein, 21 aa, Mycobacterium
VMFTAMPFFWVGGLITGLHAV

SEQ ID NO: 747409 - protein, 22 aa, Mycobacterium
VMGAQRLRWLGSELNGAPVDTG

SEQ ID NO: 747410 - protein, 25 aa, Mycobacterium
VMGDADMIVCGGVEGMIEALPIAAF

SEQ ID NO: 747411 - protein, 23 aa, Mycobacterium
VMGGREMDGWLSIDAEGVRTRRQ

SEQ ID NO: 747412 - protein, 25 aa, Mycobacterium
VMGLAELLAGLGIPYDSERGVRLAA

SEQ ID NO: 747413 - protein, 17 aa, Mycobacterium
VMGLLVMQAEWLAKRAV

SEQ ID NO: 747414 - protein, 18 aa, Mycobacterium
VMGRRLFRTYPFEEAFFS

SEQ ID NO: 747415 - protein, 19 aa, Mycobacterium
VMGSVCSLIQYLRSWSSDR

SEQ ID NO: 747416 - protein, 18 aa, Mycobacterium
VMGVPGIIVARTDAEAAN

SEQ ID NO: 747417 - protein, 19 aa, Mycobacterium
VMHAAAPCPVEIKKQMMDW

SEQ ID NO: 747418 - protein, 17 aa, Mycobacterium
VMHEGWRSDLPDELGEG

SEQ ID NO: 747419 - protein, 25 aa, Mycobacterium
VMHRLLRRYRFELAHPHYQPKWDYA

SEQ ID NO: 747420 - protein, 29 aa, Mycobacterium
VMIFGYMRLPAHLFGIGLYTVNLDLDRTG

SEQ ID NO: 747421 - protein, 24 aa, Mycobacterium
VMIGADFAPVFGRFPQNVLDGEIY

SEQ ID NO: 747422 - protein, 18 aa, Mycobacterium
VMIQNHFFQNVDIGLETM

SEQ ID NO: 747423 - protein, 20 aa, Mycobacterium
VMKVRAKIAAAVPISEMLDE

SEQ ID NO: 747424 - protein, 19 aa, Mycobacterium
VMLAASFLKDSNFAEEREV

SEQ ID NO: 747425 - protein, 18 aa, Mycobacterium
VMLATRFTEFAVHVVEVC

SEQ ID NO: 747426 - protein, 20 aa, Mycobacterium
VMLEISWEALERAGIDPLGL

SEQ ID NO: 747427 - protein, 18 aa, Mycobacterium
VMLGAALLARNAVDKGLT

SEQ ID NO: 747428 - protein, 18 aa, Mycobacterium
VMLGAALLARNAVEKGLA

SEQ ID NO: 747429 - protein, 18 aa, Mycobacterium
VMLGAALLARNAVEKGLV

SEQ ID NO: 747430 - protein, 34 aa, Mycobacterium
VMLKLSLPSEVNFYRPLIEHPKVMRVVALSGGYS

SEQ ID NO: 747431 - protein, 18 aa, Mycobacterium
VMLKLSLPTEANYYRPLI

SEQ ID NO: 747432 - protein, 19 aa, Mycobacterium
VMLKLTLPDVDNHYRELVE

SEQ ID NO: 747433 - protein, 30 aa, Mycobacterium
VMLLHGFGSFWWSWRHQLRGLAGARVVAVD

SEQ ID NO: 747434 - protein, 17 aa, Mycobacterium
VMLPKCESAAQVTALAP

SEQ ID NO: 747435 - protein, 17 aa, Mycobacterium
VMLPPTLIQVGGREMMV

SEQ ID NO: 747436 - protein, 25 aa, Mycobacterium
VMLVLFSTPWRLEGFQRDNPDIKLR

SEQ ID NO: 747437 - protein, 20 aa, Mycobacterium
VMMDMLRWHGAEEVEHKAVA

SEQ ID NO: 747438 - protein, 28 aa, Mycobacterium
VMMGGLGPAPFCGMLLGDLGADVVRIDA

SEQ ID NO: 747439 - protein, 28 aa, Mycobacterium
VMMGGLGPGPFCGMLLGDLGADVIRVDG

SEQ ID NO: 747440 - protein, 17 aa, Mycobacterium
VMMPRRRLTRAAQRARQ

SEQ ID NO: 747441 - protein, 18 aa, Mycobacterium
VMNESRIQGSLCYTGADF

SEQ ID NO: 747442 - protein, 19 aa, Mycobacterium
VMNESRIQGSLCYTSADFE

SEQ ID NO: 747443 - protein, 25 aa, Mycobacterium
VMNRHGWRAEHCDHFVIHQTSKASL

SEQ ID NO: 747444 - protein, 18 aa, Mycobacterium
VMPESTFSRIYQELINFC

SEQ ID NO: 747445 - protein, 22 aa, Mycobacterium
VMPMDVWRDGDTFIVELDVPGV

SEQ ID NO: 747446 - protein, 23 aa, Mycobacterium
VMPTACPECGTTLAHEKEGDADI

SEQ ID NO: 747447 - protein, 24 aa, Mycobacterium
VMPTSRAAGVWTTHGDLALPLLPT

SEQ ID NO: 747448 - protein, 19 aa, Mycobacterium
VMQHFTIPISFFDEAVFEE

SEQ ID NO: 747449 - protein, 20 aa, Mycobacterium
VMQICHHLHGGMGMDITYPM

SEQ ID NO: 747450 - protein, 20 aa, Mycobacterium
VMQICHHLHGGMGMDVTYPM

SEQ ID NO: 747451 - protein, 21 aa, Mycobacterium
VMQLCHHLHGGMGMDITYPMH

SEQ ID NO: 747452 - protein, 19 aa, Mycobacterium
VMQSPMLWDPIRYDETCPS

SEQ ID NO: 747453 - protein, 19 aa, Mycobacterium
VMREELCAAIGLTPEQLPY

SEQ ID NO: 747454 - protein, 21 aa, Mycobacterium
VMRELKGLRGGRVDLITMPSP

SEQ ID NO: 747455 - protein, 17 aa, Mycobacterium
VMRELYQNGVWAIFSTL

SEQ ID NO: 747456 - protein, 27 aa, Mycobacterium
VMREMGWRGACKRRRVRTTVADPAATR

SEQ ID NO: 747457 - protein, 19 aa, Mycobacterium
VMRHFARSLAEKNIRVNSV

SEQ ID NO: 747458 - protein, 18 aa, Mycobacterium
VMRLEGLDVIPSVLPTAP

SEQ ID NO: 747459 - protein, 18 aa, Mycobacterium
VMRLRPQPMQTFTELLSR

SEQ ID NO: 747460 - protein, 19 aa, Mycobacterium
VMRNWRFLQQNDVQILHGP

SEQ ID NO: 747461 - protein, 20 aa, Mycobacterium
VMRPFLKAYFRSEVHGLGSF

SEQ ID NO: 747462 - protein, 24 aa, Mycobacterium
VMRPGAKLAAWAPIASAAPPGEAG

SEQ ID NO: 747463 - protein, 19 aa, Mycobacterium
VMRPGDEIVVLPSGKSSRI

SEQ ID NO: 747464 - protein, 19 aa, Mycobacterium
VMRPGDEIVVLPSGKTSRI

SEQ ID NO: 747465 - protein, 26 aa, Mycobacterium
VMRQGYQLGEHVLRNALVAVVDTVAD

SEQ ID NO: 747466 - protein, 26 aa, Mycobacterium
VMRQGYQLGEHVLRNALVAVVETIAD

SEQ ID NO: 747467 - protein, 24 aa, Mycobacterium
VMRSACADFSRWQAHGVGRGAVMR

SEQ ID NO: 747468 - protein, 27 aa, Mycobacterium
VMRTWQTAHVMKRRRGPLPGDGAADNM

SEQ ID NO: 747469 - protein, 29 aa, Mycobacterium
VMRWRRPRWGARLGVEPVTALLFEATTLG

SEQ ID NO: 747470 - protein, 33 aa, Mycobacterium
VMSFIAVCGQCRWCASGMEYLCDAGIGTLTPGM

SEQ ID NO: 747471 - protein, 32 aa, Mycobacterium
VMSFVAVCGQCRWCASGIEYLCDQGIGTMVPG

SEQ ID NO: 747472 - protein, 18 aa, Mycobacterium
VMSLVTGLDFPFAAMGSV

SEQ ID NO: 747473 - protein, 23 aa, Mycobacterium
VMSNMGLHLAMRSADIEVRTTGV

SEQ ID NO: 747474 - protein, 23 aa, Mycobacterium
VMSQLRTALRMQVVAGYPIAEAL

SEQ ID NO: 747475 - protein, 25 aa, Mycobacterium
VMSQLRTALRMQVWAGHTIVEALQA

SEQ ID NO: 747476 - protein, 17 aa, Mycobacterium
VMSRYALAVQHERDLAM

SEQ ID NO: 747477 - protein, 20 aa, Mycobacterium
VMSSPVAWRCSARPAAVPTA

SEQ ID NO: 747478 - protein, 18 aa, Mycobacterium
VMSYRPGSIIDVVDIDLP

SEQ ID NO: 747479 - protein, 19 aa, Mycobacterium
VMTGFRVSRSGWYGIDPVA

SEQ ID NO: 747480 - protein, 19 aa, Mycobacterium
VMTGFRVSRSGWYGIDQVA

SEQ ID NO: 747481 - protein, 19 aa, Mycobacterium
VMTGFRVSRSGWYGLDPVD

SEQ ID NO: 747482 - protein, 19 aa, Mycobacterium
VMTGFRVSRSGWYGLDPVE

SEQ ID NO: 747483 - protein, 17 aa, Mycobacterium
VMTLTFGDPGMRTAAPP

SEQ ID NO: 747484 - protein, 18 aa, Mycobacterium
VMTNEIFGPILPVLTVKS

SEQ ID NO: 747485 - protein, 18 aa, Mycobacterium
VMTPCFWGAEPNEVDRGP

SEQ ID NO: 747486 - protein, 21 aa, Mycobacterium
VMTSVTALGRYGHAGDIAAVV

SEQ ID NO: 747487 - protein, 22 aa, Mycobacterium
VMTTPLFYGWWIAGAKYLMAHD

SEQ ID NO: 747488 - protein, 17 aa, Mycobacterium
VMTWLEEQGRGVAMEGG

SEQ ID NO: 747489 - protein, 17 aa, Mycobacterium
VMVLPISYWKLSDREIA

SEQ ID NO: 747490 - protein, 18 aa, Mycobacterium
VMVPRLPPSQARVLLMAA

SEQ ID NO: 747491 - protein, 17 aa, Mycobacterium
VMVRFVVCRKDDRHVIA

SEQ ID NO: 747492 - protein, 20 aa, Mycobacterium
VMVSRLRAAVSARRDPNFIV

SEQ ID NO: 747493 - protein, 22 aa, Mycobacterium
VMVSWLPLFHDMGMIGFLTVPM

SEQ ID NO: 747494 - protein, 22 aa, Mycobacterium
VMYATGISWPLADAGLSHVERP

SEQ ID NO: 747495 - protein, 23 aa, Mycobacterium
VMYATGISWPLADAGLSHVERPV

SEQ ID NO: 747496 - protein, 19 aa, Mycobacterium
VNAAALMDLIAAHRIPVIS

SEQ ID NO: 747497 - protein, 24 aa, Mycobacterium
VNAAGLDCFKRFTDISFEKWQQVI

SEQ ID NO: 747498 - protein, 18 aa, Mycobacterium
VNAAKWAIDEAIARQLPL

SEQ ID NO: 747499 - protein, 18 aa, Mycobacterium
VNAAYQLFHQVRRLVTVM

SEQ ID NO: 747500 - protein, 19 aa, Mycobacterium
VNACLDRLRRTKAHPTVPL

SEQ ID NO: 747501 - protein, 17 aa, Mycobacterium
VNACRRAGAHFSLVLTK

SEQ ID NO: 747502 - protein, 19 aa, Mycobacterium
VNADIPAAIDVSFIDEFDS

SEQ ID NO: 747503 - protein, 24 aa, Mycobacterium
VNADLWRRYMAILIEGMRRRDDQE

SEQ ID NO: 747504 - protein, 22 aa, Mycobacterium
VNAELRRTCPVAWNQNYGGFWF

SEQ ID NO: 747505 - protein, 21 aa, Mycobacterium
VNAETRLRVEEAIEQTGYRRN

SEQ ID NO: 747506 - protein, 17 aa, Mycobacterium
VNAFKHFAKAAEKSLMK

SEQ ID NO: 747507 - protein, 17 aa, Mycobacterium
VNAGYNIVTEAYGPLGV

SEQ ID NO: 747508 - protein, 27 aa, Mycobacterium
VNAIAPGLFPSRMTKELLAAGEDAVGS

SEQ ID NO: 747509 - protein, 25 aa, Mycobacterium
VNAIDWVCSAPEGLIGVEDIPLSAT

SEQ ID NO: 747510 - protein, 17 aa, Mycobacterium
VNAKIAALVTAVESGVA

SEQ ID NO: 747511 - protein, 31 aa, Mycobacterium
VNALAKLWAQACDWEPVLPTSLRFVQVGGSR

SEQ ID NO: 747512 - protein, 19 aa, Mycobacterium
VNALIEARVGTVIYGVADP

SEQ ID NO: 747513 - protein, 21 aa, Mycobacterium
VNALPRRGISALRHRPKRRPL

SEQ ID NO: 747514 - protein, 18 aa, Mycobacterium
VNALRHRAEIAVACDSLG

SEQ ID NO: 747515 - protein, 20 aa, Mycobacterium
VNAMWFAWDGEVLRFTHTTK

SEQ ID NO: 747516 - protein, 21 aa, Mycobacterium
VNANGIYVCRAIVSHRIPDGV

SEQ ID NO: 747517 - protein, 20 aa, Mycobacterium
VNANVFPGQSATGGNGGMGG

SEQ ID NO: 747518 - protein, 19 aa, Mycobacterium
VNAPAIAAVEAEYGEMWAQ

SEQ ID NO: 747519 - protein, 26 aa, Mycobacterium
VNAPAQALLGRPLIGNGDDGVAGTGQ

SEQ ID NO: 747520 - protein, 18 aa, Mycobacterium
VNAPLPFVTLNTVGPTLI

SEQ ID NO: 747521 - protein, 30 aa, Mycobacterium
VNAPTMAVLGRPLIGDGVDAAAGSGHNGGA

SEQ ID NO: 747522 - protein, 27 aa, Mycobacterium
VNAPTQALLGRALIGNGANGADGTGQN

SEQ ID NO: 747523 - protein, 25 aa, Mycobacterium
VNAQEWREELPLIEEWLQFIGEKLP

SEQ ID NO: 747524 - protein, 17 aa, Mycobacterium
VNARARDDLGWQPRYDY

SEQ ID NO: 747525 - protein, 24 aa, Mycobacterium
VNARYRMEQGFTFELNLAGVSDEH

SEQ ID NO: 747526 - protein, 26 aa, Mycobacterium
VNASGGCHWPDCDSSNTPQIQCQIAV

SEQ ID NO: 747527 - protein, 17 aa, Mycobacterium
VNASPLQTLEQNVLAAI

SEQ ID NO: 747528 - protein, 24 aa, Mycobacterium
VNASYRMEQGFTFELNLSGVSDEH

SEQ ID NO: 747529 - protein, 24 aa, Mycobacterium
VNAVQRCVAVLFAALHGDTNLRAT

SEQ ID NO: 747530 - protein, 19 aa, Mycobacterium
VNAVRGFIDSVAFVITQQR

SEQ ID NO: 747531 - protein, 21 aa, Mycobacterium
VNAYCPGVVGTDMWVEIDKRF

SEQ ID NO: 747532 - protein, 19 aa, Mycobacterium
VNAYLRRHDTFRSWFEHSG

SEQ ID NO: 747533 - protein, 28 aa, Mycobacterium
VNCTEPGGLCFCASMGTGPAAGPGYDLA

SEQ ID NO: 747534 - protein, 20 aa, Mycobacterium
VNCVCPGTIVTASFTETLRE

SEQ ID NO: 747535 - protein, 25 aa, Mycobacterium
VNDFALALARFSIRMNAVHPTNVNT

SEQ ID NO: 747536 - protein, 23 aa, Mycobacterium
VNDLLLPIVKGFGSETAYAKLTE

SEQ ID NO: 747537 - protein, 18 aa, Mycobacterium
VNDLLLPIVKGVGSERAY

SEQ ID NO: 747538 - protein, 21 aa, Mycobacterium
VNDRASCKFMKMITPAALLRC

SEQ ID NO: 747539 - protein, 21 aa, Mycobacterium
VNDRMKVAFIPNFNVQNAQVI

SEQ ID NO: 747540 - protein, 21 aa, Mycobacterium
VNDRMKVAFIPNFNVQSGQMI

SEQ ID NO: 747541 - protein, 24 aa, Mycobacterium
VNDWSARDLQAWEYVPLGPFLGKS

SEQ ID NO: 747542 - protein, 18 aa, Mycobacterium
VNEFGWTGPLGVTYPGVV

SEQ ID NO: 747543 - protein, 22 aa, Mycobacterium
VNEGMAGFYSFNKAGAQLSILI

SEQ ID NO: 747544 - protein, 19 aa, Mycobacterium
VNELCPEMIWQLRSSASGY

SEQ ID NO: 747545 - protein, 22 aa, Mycobacterium
VNELRAGQVWVNSSLAADPSMP

SEQ ID NO: 747546 - protein, 25 aa, Mycobacterium
VNERWPSYWAALFATHGYLPYDLLR

SEQ ID NO: 747547 - protein, 21 aa, Mycobacterium
VNESRPGAAFQLDELSKAIIE

SEQ ID NO: 747548 - protein, 18 aa, Mycobacterium
VNETDMRGRLQLHHVRAK

SEQ ID NO: 747549 - protein, 23 aa, Mycobacterium
VNETRIGDRWRLSSPHGGLGVDR

SEQ ID NO: 747550 - protein, 24 aa, Mycobacterium
VNETRPGDRWRLSSPHGGLRVDRA

SEQ ID NO: 747551 - protein, 17 aa, Mycobacterium
VNFFTSMFGRTLLDTIG

SEQ ID NO: 747552 - protein, 20 aa, Mycobacterium
VNFIPSRLTLDFAGAEATAS

SEQ ID NO: 747553 - protein, 18 aa, Mycobacterium
VNFMIDIRLDSVVDLDLF

SEQ ID NO: 747554 - protein, 19 aa, Mycobacterium
VNFPAELQGYLGKQVGYGQ

SEQ ID NO: 747555 - protein, 23 aa, Mycobacterium
VNFRDVLMALGMYPGAQPVLGGE

SEQ ID NO: 747556 - protein, 23 aa, Mycobacterium
VNFRDVLVALGMYPGGGELGVDG

SEQ ID NO: 747557 - protein, 25 aa, Mycobacterium
VNFRDVLVALGMYPGGGRLGAEGAG

SEQ ID NO: 747558 - protein, 21 aa, Mycobacterium
VNFRDVLVVLGMYPGQAPPLG

SEQ ID NO: 747559 - protein, 19 aa, Mycobacterium
VNFSVRHLMVSKVRGGFDT

SEQ ID NO: 747560 - protein, 23 aa, Mycobacterium
VNFYDRFCHLVLLSVPVDVAIAR

SEQ ID NO: 747561 - protein, 19 aa, Mycobacterium
VNGAPAYRLALQTREQHIR

SEQ ID NO: 747562 - protein, 18 aa, Mycobacterium
VNGAPTITFLDPFGIAMP

SEQ ID NO: 747563 - protein, 30 aa, Mycobacterium
VNGAWNWSSGCDHATWAFLGGPVIKDGRPV

SEQ ID NO: 747564 - protein, 18 aa, Mycobacterium
VNGAWQWSSGSEHATWAF

SEQ ID NO: 747565 - protein, 25 aa, Mycobacterium
VNGDWKIAVLRAYWDLPAMMLQFLR

SEQ ID NO: 747566 - protein, 19 aa, Mycobacterium
VNGFGRLTTPEAWLSTWSG

SEQ ID NO: 747567 - protein, 17 aa, Mycobacterium
VNGGAPVAVPSIIDSGG

SEQ ID NO: 747568 - protein, 21 aa, Mycobacterium
VNGICCGAGLDWVTTSDIVIA

SEQ ID NO: 747569 - protein, 21 aa, Mycobacterium
VNGICCGAGMDWVTTTDIVIA

SEQ ID NO: 747570 - protein, 23 aa, Mycobacterium
VNGIRVSGPFIADWSSAAPQLVL

SEQ ID NO: 747571 - protein, 17 aa, Mycobacterium
VNGKIRFPDNTNLVKHV

SEQ ID NO: 747572 - protein, 22 aa, Mycobacterium
VNGKLSLQRWVDVCATTPARMF

SEQ ID NO: 747573 - protein, 30 aa, Mycobacterium
VNGLAELGCFGMKIPSEYGGLSMSQVAYNR

SEQ ID NO: 747574 - protein, 30 aa, Mycobacterium
VNGLAELGCFGMKIPTEYGGLNMSQVAYNR

SEQ ID NO: 747575 - protein, 22 aa, Mycobacterium
VNGLCCGAGMDWVTTSDIVIAS

SEQ ID NO: 747576 - protein, 19 aa, Mycobacterium
VNGLFDFYTQVLGFKSRGA

SEQ ID NO: 747577 - protein, 18 aa, Mycobacterium
VNGLFEFYTETLGFKSRG

SEQ ID NO: 747578 - protein, 26 aa, Mycobacterium
VNGLRFTDIPVLIGLRGGANARARES

SEQ ID NO: 747579 - protein, 24 aa, Mycobacterium
VNGPAIGGGLCLALAADIRVASTS

SEQ ID NO: 747580 - protein, 24 aa, Mycobacterium
VNGPAIGGGLCLALAADVRVAAAS

SEQ ID NO: 747581 - protein, 31 aa, Mycobacterium
VNGPIPRPVDWRWPWGEVLDVLDDVGTDVRV

SEQ ID NO: 747582 - protein, 17 aa, Mycobacterium
VNGPLALAISDRLQQRY

SEQ ID NO: 747583 - protein, 17 aa, Mycobacterium
VNGPRGWATCNYVVASS

SEQ ID NO: 747584 - protein, 17 aa, Mycobacterium
VNGPRSWDLDVAVDVTL

SEQ ID NO: 747585 - protein, 29 aa, Mycobacterium
VNGPTQAWLGRPLIGNGTDGAAGTGQAGG

SEQ ID NO: 747586 - protein, 18 aa, Mycobacterium
VNGRKVWISKALESEKIL

SEQ ID NO: 747587 - protein, 17 aa, Mycobacterium
VNGRTALILPTLGRTDK

SEQ ID NO: 747588 - protein, 30 aa, Mycobacterium; identical to SEQ ID NO: 106181

SEQ ID NO: 747589 - protein, 20 aa, Mycobacterium
VNGSWNWSSGCDHATWCFAG

SEQ ID NO: 747590 - protein, 36 aa, Mycobacterium
VNGSWNWSSGCDHATWTFVGGPVIKDGRPVDFGSFL

SEQ ID NO: 747591 - protein, 22 aa, Mycobacterium
VNGVAFAGGFLLAQTCDLCVAS

SEQ ID NO: 747592 - protein, 18 aa, Mycobacterium
VNGVWQLRGDAVVPSGLD

SEQ ID NO: 747593 - protein, 26 aa, Mycobacterium
VNGYRGCSHACRYCFARPTHEYLDFN

SEQ ID NO: 747594 - protein, 26 aa, Mycobacterium
VNGYRGCSHACRYCFARPTHEYLEFD

SEQ ID NO: 747595 - protein, 29 aa, Mycobacterium
VNGYTELKADGSTACGCWIYSGVYADEVN

SEQ ID NO: 747596 - protein, 18 aa, Mycobacterium
VNHASWPTLRTFLPSLLL

SEQ ID NO: 747597 - protein, 21 aa, Mycobacterium
VNHEFGLPIRLFEIGASAGLN

SEQ ID NO: 747598 - protein, 23 aa, Mycobacterium
VNHEPFVTLGLHIGARTTSIVAT

SEQ ID NO: 747599 - protein, 19 aa, Mycobacterium
VNHLGISPKAYRERFRTAY

SEQ ID NO: 747600 - protein, 24 aa, Mycobacterium
VNIDESRAAFVYTPEPNFVGIDTF

SEQ ID NO: 747601 - protein, 20 aa, Mycobacterium
VNIEYLAKVVMSRADAQGTV

SEQ ID NO: 747602 - protein, 20 aa, Mycobacterium
VNIEYLASVVMARSDAEGNT

SEQ ID NO: 747603 - protein, 21 aa, Mycobacterium
VNIEYLASVVMERDGVAYPDT

SEQ ID NO: 747604 - protein, 23 aa, Mycobacterium
VNIGGVFWAIHAAIPHFGEGSRI

SEQ ID NO: 747605 - protein, 23 aa, Mycobacterium
VNIRIPGAPAFSIGYTQRADGRV

SEQ ID NO: 747606 - protein, 24 aa, Mycobacterium
VNIYRVVTNLGVFDFNGPDHQMRA

SEQ ID NO: 747607 - protein, 23 aa, Mycobacterium
VNKLRAGAEYSITQMFFDVDDYL

SEQ ID NO: 747608 - protein, 17 aa, Mycobacterium
VNKSAKVVRVYLPPDAN

SEQ ID NO: 747609 - protein, 24 aa, Mycobacterium
VNKTQAYVVWGLIRDKWNELGGSQ

SEQ ID NO: 747610 - protein, 20 aa, Mycobacterium
VNLAAALAIQGLKTLVIDLD

SEQ ID NO: 747611 - protein, 23 aa, Mycobacterium
VNLAAGLAQGGWRTLLVDCDPQG

SEQ ID NO: 747612 - protein, 17 aa, Mycobacterium
VNLAPGVPWTFETTMAD

SEQ ID NO: 747613 - protein, 18 aa, Mycobacterium
VNLDITWLRDESLEDADN

SEQ ID NO: 747614 - protein, 18 aa, Mycobacterium
VNLEFGGHGLGRTMHEDP

SEQ ID NO: 747615 - protein, 19 aa, Mycobacterium
VNLERAAAINSRLGGHIVQ

SEQ ID NO: 747616 - protein, 19 aa, Mycobacterium
VNLERAAAVNSRLGGHIVQ

SEQ ID NO: 747617 - protein, 20 aa, Mycobacterium
VNLERAAAVNSRLGGHIVQG

SEQ ID NO: 747618 - protein, 29 aa, Mycobacterium
VNLERAAAVNSRLGGHIVQGHVDGTGEII

SEQ ID NO: 747619 - protein, 17 aa, Mycobacterium
VNLERLRNRALFAGTGN

SEQ ID NO: 747620 - protein, 18 aa, Mycobacterium
VNLGRPDPNLNLPVVLGG

SEQ ID NO: 747621 - protein, 19 aa, Mycobacterium
VNLGWKLAAVIKGHAPDAL

SEQ ID NO: 747622 - protein, 17 aa, Mycobacterium
VNLGWKLAQVVNGTSPE

SEQ ID NO: 747623 - protein, 21 aa, Mycobacterium
VNLGWKLAQVVNRRSPESLLD

SEQ ID NO: 747624 - protein, 22 aa, Mycobacterium
VNLGWKLGQVVNRISPDSLLDT

SEQ ID NO: 747625 - protein, 23 aa, Mycobacterium
VNLGYGDPHFGYSTGYADVPTRF

SEQ ID NO: 747626 - protein, 25 aa, Mycobacterium
VNLGYGDPRYGYSTAPANIETPFGL

SEQ ID NO: 747627 - protein, 19 aa, Mycobacterium
VNLHRRYRLATTQLAAATE

SEQ ID NO: 747628 - protein, 23 aa, Mycobacterium
VNLHVRRQLAAAIADWIITNDWT

SEQ ID NO: 747629 - protein, 17 aa, Mycobacterium
VNLKAATMLAWQQALAA

SEQ ID NO: 747630 - protein, 21 aa, Mycobacterium
VNLLLAPAVFHGFDQAGVLSQ

SEQ ID NO: 747631 - protein, 26 aa, Mycobacterium
VNLNGPFFLCRAALPHLLERGGNIVN

SEQ ID NO: 747632 - protein, 24 aa, Mycobacterium
VNLNGPFFLCRAALPHLLETGGNI

SEQ ID NO: 747633 - protein, 19 aa, Mycobacterium
VNLNPGFDLNVKVPFDVPA

SEQ ID NO: 747634 - protein, 21 aa, Mycobacterium
VNLPNWLPLTFRIDGGDWFDV

SEQ ID NO: 747635 - protein, 22 aa, Mycobacterium
VNLPNWLPLTFRIGDGDWLDLD

SEQ ID NO: 747636 - protein, 20 aa, Mycobacterium
VNLRAHIRAADVLVPQWISR

SEQ ID NO: 747637 - protein, 22 aa, Mycobacterium
VNLRLLSLLDHRDMIETAREMA

SEQ ID NO: 747638 - protein, 20 aa, Mycobacterium
VNLRSAGIVERVRKFELDAG

SEQ ID NO: 747639 - protein, 18 aa, Mycobacterium
VNLSGVWKTVKAAVPHLI

SEQ ID NO: 747640 - protein, 20 aa, Mycobacterium
VNLSLGCDWIPRYYAAGQSP

SEQ ID NO: 747641 - protein, 20 aa, Mycobacterium
VNLTGTFLVVREALPALLDN

SEQ ID NO: 747642 - protein, 20 aa, Mycobacterium
VNLTGTFLVVREALSALLAN

SEQ ID NO: 747643 - protein, 18 aa, Mycobacterium
VNLTGTWRTLRATVPAMI

SEQ ID NO: 747644 - protein, 17 aa, Mycobacterium
VNLVKFLSSPAAAEVNG

SEQ ID NO: 747645 - protein, 28 aa, Mycobacterium
VNLWAPLMWTSLVVKAWMGEHGGVVINT

SEQ ID NO: 747646 - protein, 28 aa, Mycobacterium
VNLWGEPFGHPWGYPAVYDLVLRLRRST

SEQ ID NO: 747647 - protein, 18 aa, Mycobacterium
VNLYRPYLQLVVSAVVPA

SEQ ID NO: 747648 - protein, 20 aa, Mycobacterium
VNMFAHMRLTMGCHERLRAS

SEQ ID NO: 747649 - protein, 18 aa, Mycobacterium
VNMFERLPAPYGLVRAGV

SEQ ID NO: 747650 - protein, 25 aa, Mycobacterium
VNMILELLDAFGIPTAGAAGFEADD

SEQ ID NO: 747651 - protein, 27 aa, Mycobacterium
VNMTLLRFISFILKEIYPGGKLPQVDL

SEQ ID NO: 747652 - protein, 21 aa, Mycobacterium
VNNAGVCFMAHFDEISDADIR

SEQ ID NO: 747653 - protein, 17 aa, Mycobacterium
VNNEILALMAMGTGAPD

SEQ ID NO: 747654 - protein, 17 aa, Mycobacterium
VNNLDWTRPLSAIEFLR

SEQ ID NO: 747655 - protein, 27 aa, Mycobacterium
VNNPLGILYRDAYRAVPGIVSRVQNDY

SEQ ID NO: 747656 - protein, 17 aa, Mycobacterium
VNNTTVWSDPASGSHID

SEQ ID NO: 747657 - protein, 21 aa, Mycobacterium
VNNWLRLGFTEADVRKPGTDR

SEQ ID NO: 747658 - protein, 21 aa, Mycobacterium
VNNWLRLGFTEADVRTPGSDR

SEQ ID NO: 747659 - protein, 17 aa, Mycobacterium
VNPCQWAASDGVIGNSR

SEQ ID NO: 747660 - protein, 22 aa, Mycobacterium
VNPDAGLVLREVGTDVLGSARR

SEQ ID NO: 747661 - protein, 31 aa, Mycobacterium
VNPDEWRQELPLIEEWFEFVGDKLPTGVKDE

SEQ ID NO: 747662 - protein, 20 aa, Mycobacterium
VNPDVGLLLREVGLEVLGSA

SEQ ID NO: 747663 - protein, 19 aa, Mycobacterium
VNPIDWKLYSGAFGTDPDK

SEQ ID NO: 747664 - protein, 21 aa, Mycobacterium
VNPIMWNAFLGWVGVDQYDEG

SEQ ID NO: 747665 - protein, 23 aa, Mycobacterium
VNPIYNWPLPRLAVNIVGSDHGG

SEQ ID NO: 747666 - protein, 22 aa, Mycobacterium
VNPKEIWDVFAEEYLAPITPLE

SEQ ID NO: 747667 - protein, 17 aa, Mycobacterium
VNPKRCGHLDGKAVVET

SEQ ID NO: 747668 - protein, 20 aa, Mycobacterium
VNPKRVVIEVKIERVLGSSD

SEQ ID NO: 747669 - protein, 24 aa, Mycobacterium
VNPLEWLDDKFCSYIEDRRREPRN

SEQ ID NO: 747670 - protein, 22 aa, Mycobacterium
VNPRIHLFFGARYRCELYDLPT

SEQ ID NO: 747671 - protein, 20 aa, Mycobacterium
VNPRLNAIVRRLDEVADRQA

SEQ ID NO: 747672 - protein, 17 aa, Mycobacterium
VNPRVHLFFGARYRCEL

SEQ ID NO: 747673 - protein, 25 aa, Mycobacterium
VNPTGKFVVGGPMGDAGLTGRKIIV

SEQ ID NO: 747674 - protein, 25 aa, Mycobacterium
VNPVKLRLGIGYVIQNAGLMPHQRV

SEQ ID NO: 747675 - protein, 27 aa, Mycobacterium
VNPVPADAPFSYADSGQQGHDVIDGTA

SEQ ID NO: 747676 - protein, 28 aa, Mycobacterium
VNPYYRFDSCLLIGTSTWDVVKMRRVGV

SEQ ID NO: 747677 - protein, 23 aa, Mycobacterium
VNQRFLAYFADRDWDATAQLFAE

SEQ ID NO: 747678 - protein, 24 aa, Mycobacterium
VNRAFDATELWPFVENLAQRIGTF

SEQ ID NO: 747679 - protein, 26 aa, Mycobacterium
VNRARQSGMTTVFWLDDERPHENELR

SEQ ID NO: 747680 - protein, 20 aa, Mycobacterium
VNRARRIERFLSQNMMAAEQ

SEQ ID NO: 747681 - protein, 21 aa, Mycobacterium
VNRARRIERFLSQNMMAAEQF

SEQ ID NO: 747682 - protein, 18 aa, Mycobacterium
VNRARRKILHSALEGLRK

SEQ ID NO: 747683 - protein, 20 aa, Mycobacterium
VNRFEWAKAVFELVGADASR

SEQ ID NO: 747684 - protein, 17 aa, Mycobacterium
VNRHHWRIGVVAQAHAV

SEQ ID NO: 747685 - protein, 21 aa, Mycobacterium
VNRLPRTGSYFTRELPSAGKG

SEQ ID NO: 747686 - protein, 22 aa, Mycobacterium
VNRRATELLLALTNFTATSVPL

SEQ ID NO: 747687 - protein, 19 aa, Mycobacterium
VNRRFAEAAARAAGHGGTV

SEQ ID NO: 747688 - protein, 20 aa, Mycobacterium
VNRRFAEAAARTAAEGATVW

SEQ ID NO: 747689 - protein, 23 aa, Mycobacterium
VNRRFAEATARAAAEGATVWIQD

SEQ ID NO: 747690 - protein, 26 aa, Mycobacterium
VNRRFAEATARAAARGGTVWVQDYQL

SEQ ID NO: 747691 - protein, 17 aa, Mycobacterium
VNRRVRAALAPYPEDLV

SEQ ID NO: 747692 - protein, 22 aa, Mycobacterium
VNRTAFDRWGLVPRMLNAQRER

SEQ ID NO: 747693 - protein, 23 aa, Mycobacterium
VNRTAGGLYRWEGRYLRGEDEHV

SEQ ID NO: 747694 - protein, 28 aa, Mycobacterium
VNRVKTWLQFPQWFYFNIPVNTMVAPRL

SEQ ID NO: 747695 - protein, 23 aa, Mycobacterium
VNRWFYDCPPAFHRSLGDMYVSD

SEQ ID NO: 747696 - protein, 23 aa, Mycobacterium
VNRWFYDCPPAFHRTLGDMYVSD

SEQ ID NO: 747697 - protein, 17 aa, Mycobacterium
VNRWKAIAFSTAQYQLA

SEQ ID NO: 747698 - protein, 22 aa, Mycobacterium
VNRYPEFLPVVLPRLIADRVGM

SEQ ID NO: 747699 - protein, 17 aa, Mycobacterium
VNSARIFAGAGTGPMLA

SEQ ID NO: 747700 - protein, 18 aa, Mycobacterium
VNSARMFSGIGSGPMLSA

SEQ ID NO: 747701 - protein, 17 aa, Mycobacterium
VNSARMYAGPGPFSLMA

SEQ ID NO: 747702 - protein, 19 aa, Mycobacterium
VNSCGRCSSCDAGLEQYCK

SEQ ID NO: 747703 - protein, 24 aa, Mycobacterium
VNSEPRTGLSMGEHQAITAKEMGI

SEQ ID NO: 747704 - protein, 23 aa, Mycobacterium
VNSEPRTGLSMGEHQAITAKQMG

SEQ ID NO: 747705 - protein, 17 aa, Mycobacterium
VNSEPRTGMSMGEHAAV

SEQ ID NO: 747706 - protein, 21 aa, Mycobacterium
VNSETRWPVFTQEVLSQTSVR

SEQ ID NO: 747707 - protein, 30 aa, Mycobacterium
VNSFSKYFAMTGWRLGWLLVPDELKRAVDR

SEQ ID NO: 747708 - protein, 17 aa, Mycobacterium
VNSGLMYSGPGAGSMRE

SEQ ID NO: 747709 - protein, 18 aa, Mycobacterium
VNSGRMYAGAGVGPLVSA

SEQ ID NO: 747710 - protein, 26 aa, Mycobacterium
VNSLGGRGVFAVELLVRGDEVYFSDV

SEQ ID NO: 747711 - protein, 23 aa, Mycobacterium
VNSRSAAMGVGFIATAAARCAQA

SEQ ID NO: 747712 - protein, 17 aa, Mycobacterium
VNSSMAEIQAFYDEVFP

SEQ ID NO: 747713 - protein, 24 aa, Mycobacterium
VNSSYRMEQGFTFELNLAGVADEH

SEQ ID NO: 747714 - protein, 24 aa, Mycobacterium
VNSSYRMEQGFTFELNLAGVSDEH

SEQ ID NO: 747715 - protein, 25 aa, Mycobacterium
VNSTARGAFNLGFAPTVVAAATATR

SEQ ID NO: 747716 - protein, 30 aa, Mycobacterium
VNTCNVLTLWSARAVKSFALDAFNTGDYYG

SEQ ID NO: 747717 - protein, 23 aa, Mycobacterium
VNTDPYGAGWLLDVQVEGSDVAA

SEQ ID NO: 747718 - protein, 18 aa, Mycobacterium
VNTDVAFHSPAMDALTAD

SEQ ID NO: 747719 - protein, 17 aa, Mycobacterium
VNTELRRGHMAVLRDTL

SEQ ID NO: 747720 - protein, 37 aa, Mycobacterium
VNTEYTLGWKPRVGLARGIRHTVDWLCTTLEPGYATT

SEQ ID NO: 747721 - protein, 26 aa, Mycobacterium
VNTFGLDQVRYFLLREVPFGQDGSYT

SEQ ID NO: 747722 - protein, 17 aa, Mycobacterium
VNTGAFISGNYSNGFFV

SEQ ID NO: 747723 - protein, 17 aa, Mycobacterium
VNTGAFISGNYSNGLLW

SEQ ID NO: 747724 - protein, 18 aa, Mycobacterium
VNTGRLIAGAGAQPYLQA

SEQ ID NO: 747725 - protein, 19 aa, Mycobacterium
VNTGVYAFDITALRSALSR

SEQ ID NO: 747726 - protein, 25 aa, Mycobacterium
VNTHCNLDCPICFADSGHQPDGYAL

SEQ ID NO: 747727 - protein, 18 aa, Mycobacterium
VNTPRAFLGYAIECVLDL

SEQ ID NO: 747728 - protein, 22 aa, Mycobacterium
VNTRIGAALQRAGREPGEVRLL

SEQ ID NO: 747729 - protein, 17 aa, Mycobacterium
VNTVSMRGVVVIGEGEK

SEQ ID NO: 747730 - protein, 23 aa, Mycobacterium
VNTYRWVNAEGQTHLVKYHWMPK

SEQ ID NO: 747731 - protein, 17 aa, Mycobacterium
VNVAFRLASLPMGSEAL

SEQ ID NO: 747732 - protein, 23 aa, Mycobacterium
VNVAHILRGHFAHIEERLRLDSE

SEQ ID NO: 747733 - protein, 18 aa, Mycobacterium
VNVAPKLDAAQQHRLAVI

SEQ ID NO: 747734 - protein, 19 aa, Mycobacterium
VNVARRFSGDAVLEVVAMH

SEQ ID NO: 747735 - protein, 27 aa, Mycobacterium
VNVATRLWPFWALCRIVYVVDEPNRRG

SEQ ID NO: 747736 - protein, 18 aa, Mycobacterium
VNVDADFEPLYIISPDKK

SEQ ID NO: 747737 - protein, 18 aa, Mycobacterium
VNVDADFEPLYIISPEKK

SEQ ID NO: 747738 - protein, 24 aa, Mycobacterium
VNVDGELPPGVSAKDVILAVIAKI

SEQ ID NO: 747739 - protein, 21 aa, Mycobacterium
VNVDGRLPAGVSAKDIILALI

SEQ ID NO: 747740 - protein, 19 aa, Mycobacterium
VNVDLPGVIGLRNAVVPAH

SEQ ID NO: 747741 - protein, 20 aa, Mycobacterium
VNVDVLLRFLTACREATLPG

SEQ ID NO: 747742 - protein, 17 aa, Mycobacterium
VNVFGPVELTLALLPAL

SEQ ID NO: 747743 - protein, 26 aa, Mycobacterium
VNVGLPWSTQFTAFGAQVFVLSAQGP

SEQ ID NO: 747744 - protein, 18 aa, Mycobacterium
VNVKGVFLLTRALTPLLR

SEQ ID NO: 747745 - protein, 18 aa, Mycobacterium
VNVKPKFAVDAMVATIGQ

SEQ ID NO: 747746 - protein, 18 aa, Mycobacterium
VNVKPKFAVDAMVGTVGQ

SEQ ID NO: 747747 - protein, 24 aa, Mycobacterium
VNVLCSQGIWARHRKLAQTASALV

SEQ ID NO: 747748 - protein, 23 aa, Mycobacterium
VNVLCTPAVWARHRKLANAAPAM

SEQ ID NO: 747749 - protein, 23 aa, Mycobacterium
VNVLCTPGVWARHRKLANTAPAL

SEQ ID NO: 747750 - protein, 19 aa, Mycobacterium
VNVLCVSKDLPFAQKRFCG

SEQ ID NO: 747751 - protein, 23 aa, Mycobacterium
VNVNLRAPYILVQQLVPVMIERG

SEQ ID NO: 747752 - protein, 27 aa, Mycobacterium
VNVPDMFTRLLLSLLITGVAPRSFYIG

SEQ ID NO: 747753 - protein, 25 aa, Mycobacterium
VNVPGFPNLFLLAGPGSGTNALAGL

SEQ ID NO: 747754 - protein, 17 aa, Mycobacterium
VNVPLMIIAIGSVPQVS

SEQ ID NO: 747755 - protein, 25 aa, Mycobacterium
VNVPRRCCRPGCPHYAVATLTFVYS

SEQ ID NO: 747756 - protein, 23 aa, Mycobacterium
VNVRAPFVLSREVARRMIPRRAG

SEQ ID NO: 747757 - protein, 17 aa, Mycobacterium
VNVRIWIRPEHRKKGYG

SEQ ID NO: 747758 - protein, 25 aa, Mycobacterium
VNVSLPVFVARAFGGIIEDVDGNRL

SEQ ID NO: 747759 - protein, 17 aa, Mycobacterium
VNVSSIFGVMACPGQSS

SEQ ID NO: 747760 - protein, 19 aa, Mycobacterium
VNVSSVFGFVGIPSQSAYN

SEQ ID NO: 747761 - protein, 19 aa, Mycobacterium
VNVSYRLGTFGFLAPPGAP

SEQ ID NO: 747762 - protein, 18 aa, Mycobacterium
VNVTEMFRDPLVFSKIRT

SEQ ID NO: 747763 - protein, 25 aa, Mycobacterium
VNVTYRIGVFGGFELSDLGEGFDDN

SEQ ID NO: 747764 - protein, 24 aa, Mycobacterium
VNVTYRLGALGGLELSALGEGFDD

SEQ ID NO: 747765 - protein, 25 aa, Mycobacterium
VNVTYRLGVFGGFELGDLAGDFSDN

SEQ ID NO: 747766 - protein, 18 aa, Mycobacterium
VNVWKDNERFLASVVAPG

SEQ ID NO: 747767 - protein, 23 aa, Mycobacterium
VNWAIDWAVSWINWGIQLVNSVI

SEQ ID NO: 747768 - protein, 17 aa, Mycobacterium
VNWCPGLGTVLANEEVT

SEQ ID NO: 747769 - protein, 23 aa, Mycobacterium
VNWDVREGVFAPGVIDAMFAYHI

SEQ ID NO: 747770 - protein, 25 aa, Mycobacterium
VNWFRRGEDHRFLWPGFGENSRVMK

SEQ ID NO: 747771 - protein, 22 aa, Mycobacterium
VNWSGNRDRSWGIRPVGEGEPA

SEQ ID NO: 747772 - protein, 17 aa, Mycobacterium
VNYPLYVILSLLGLPES

SEQ ID NO: 747773 - protein, 19 aa, Mycobacterium
VNYPLYVILSLLGLPESDF

SEQ ID NO: 747774 - protein, 22 aa, Mycobacterium
VNYRLMPKHSIGMALDDCHDGY

SEQ ID NO: 747775 - protein, 17 aa, Mycobacterium
VPAAGAILADWGADVIK

SEQ ID NO: 747776 - protein, 19 aa, Mycobacterium
VPAAHRLAGHDLPLGELLS

SEQ ID NO: 747777 - protein, 21 aa, Mycobacterium
VPAAIRLLAALSYDLIVLETV

SEQ ID NO: 747778 - protein, 21 aa, Mycobacterium
VPAAIRLVGAIGYDVVLLETV

SEQ ID NO: 747779 - protein, 18 aa, Mycobacterium
VPAALCGVVGFKPAYGAI

SEQ ID NO: 747780 - protein, 19 aa, Mycobacterium
VPAALSRWLSTKLPGVTPD

SEQ ID NO: 747781 - protein, 25 aa, Mycobacterium
VPAAPRITRMWPRGTGRPLTGLLVA

SEQ ID NO: 747782 - protein, 20 aa, Mycobacterium
VPAARKRAFDGLTHRNIDDL

SEQ ID NO: 747783 - protein, 17 aa, Mycobacterium
VPAARWPLAPDAVDALR

SEQ ID NO: 747784 - protein, 19 aa, Mycobacterium
VPAAVRFLSCEPLIGPLDG

SEQ ID NO: 747785 - protein, 23 aa, Mycobacterium
VPADATPAYLGFNLFGHAIARAL

SEQ ID NO: 747786 - protein, 31 aa, Mycobacterium
VPADELAEWLAVARLRAGEAVSTPAPADTPP

SEQ ID NO: 747787 - protein, 19 aa, Mycobacterium
VPADHPNYVFGFGPAGDLA

SEQ ID NO: 747788 - protein, 24 aa, Mycobacterium
VPADLRVPFDPRDVIARIVDDSDF

SEQ ID NO: 747789 - protein, 23 aa, Mycobacterium
VPAEHAALLLARIAVNGQPLATR

SEQ ID NO: 747790 - protein, 18 aa, Mycobacterium
VPAERLRMLRSFDPRSGA

SEQ ID NO: 747791 - protein, 17 aa, Mycobacterium
VPAERSIDVSFHELNGN

SEQ ID NO: 747792 - protein, 21 aa, Mycobacterium
VPAESDGAVILYVVDAAAPGV

SEQ ID NO: 747793 - protein, 17 aa, Mycobacterium
VPAESRVLAALGPKMLA

SEQ ID NO: 747794 - protein, 26 aa, Mycobacterium
VPAFALGDYEWLLAFEAPELHRIVDL

SEQ ID NO: 747795 - protein, 19 aa, Mycobacterium
VPAGFAVAVVLSGRGVLRA

SEQ ID NO: 747796 - protein, 18 aa, Mycobacterium
VPAGFCRALTGDAVADKG

SEQ ID NO: 747797 - protein, 30 aa, Mycobacterium
VPAGRFARPAEIAWATAFLLCDQATYITGS

SEQ ID NO: 747798 - protein, 24 aa, Mycobacterium
VPAGTPRLGGSVRGRAAAPRASAY

SEQ ID NO: 747799 - protein, 24 aa, Mycobacterium
VPAHIPGHILAAGRRDPVKPLHIT

SEQ ID NO: 747800 - protein, 23 aa, Mycobacterium
VPAHLPGEHPMFKAMAAANGKDE

SEQ ID NO: 747801 - protein, 18 aa, Mycobacterium
VPAHRRRVGLMPQEGALF

SEQ ID NO: 747802 - protein, 27 aa, Mycobacterium
VPAHRVAVVLGSGWAPAAGELGTPATT

SEQ ID NO: 747803 - protein, 20 aa, Mycobacterium
VPAHTAANFEGLVLRVPETS

SEQ ID NO: 747804 - protein, 20 aa, Mycobacterium
VPAHVASNFEGLVVRVDDAD

SEQ ID NO: 747805 - protein, 20 aa, Mycobacterium
VPAHVASNFEGLVVRVDDSD

SEQ ID NO: 747806 - protein, 22 aa, Mycobacterium
VPAIEIKSDFLASGEPAVVGGL

SEQ ID NO: 747807 - protein, 17 aa, Mycobacterium
VPAKGWLIGEVHEGIAQ

SEQ ID NO: 747808 - protein, 19 aa, Mycobacterium
VPAKLLALGHPFRHPTVGD

SEQ ID NO: 747809 - protein, 20 aa, Mycobacterium
VPALAALMAGIAQRKVRVAE

SEQ ID NO: 747810 - protein, 22 aa, Mycobacterium
VPALELATALNLMNERTLFASF

SEQ ID NO: 747811 - protein, 19 aa, Mycobacterium
VPALGLVALFERLGFEGDL

SEQ ID NO: 747812 - protein, 24 aa, Mycobacterium
VPALPRLGPDDALPRCRRTVHRGA

SEQ ID NO: 747813 - protein, 23 aa, Mycobacterium
VPALPVPERLGGDGVGLPEVATV

SEQ ID NO: 747814 - protein, 21 aa, Mycobacterium
VPALRGKPFFDYLASEPALTE

SEQ ID NO: 747815 - protein, 17 aa, Mycobacterium
VPAMPIWMGVRSSVMQR

SEQ ID NO: 747816 - protein, 20 aa, Mycobacterium
VPAMWAALMNVDGFEDHDLS

SEQ ID NO: 747817 - protein, 22 aa, Mycobacterium
VPAPAAWRKSLDSLFPTRSPGG

SEQ ID NO: 747818 - protein, 17 aa, Mycobacterium
VPAPPDRVRDFYVDLDK

SEQ ID NO: 747819 - protein, 21 aa, Mycobacterium
VPARAELPWVERVAPPTEFES

SEQ ID NO: 747820 - protein, 21 aa, Mycobacterium
VPARFRLLEQFMLAQARSSVH

SEQ ID NO: 747821 - protein, 20 aa, Mycobacterium
VPARGRLLLIDSGEPGPGRR

SEQ ID NO: 747822 - protein, 18 aa, Mycobacterium
VPARIAVIGMGRLGGGEL

SEQ ID NO: 747823 - protein, 21 aa, Mycobacterium
VPARLHPGMFYALPQSPQLFK

SEQ ID NO: 747824 - protein, 17 aa, Mycobacterium
VPARPEVRLVKVSDAPT

SEQ ID NO: 747825 - protein, 23 aa, Mycobacterium
VPARWTLDHGRTFRPVDPDMLGE

SEQ ID NO: 747826 - protein, 21 aa, Mycobacterium
VPASCCGLVGLKPRRGRSSFA

SEQ ID NO: 747827 - protein, 24 aa, Mycobacterium
VPASGYVYRTSWRLATTDIDEHQR

SEQ ID NO: 747828 - protein, 26 aa, Mycobacterium
VPASHALAAACRRAYTAGKDRGASRF

SEQ ID NO: 747829 - protein, 17 aa, Mycobacterium
VPASLKWHDTARRSWLR

SEQ ID NO: 747830 - protein, 28 aa, Mycobacterium
VPASRPRIRLAYRLTPRRVLGPQRATGI

SEQ ID NO: 747831 - protein, 23 aa, Mycobacterium
VPASVWGGVAAVRFKHAMDRWGA

SEQ ID NO: 747832 - protein, 18 aa, Mycobacterium
VPATAPLTEVWVPGADLR

SEQ ID NO: 747833 - protein, 20 aa, Mycobacterium
VPATLARYIVEKGSITVDGI

SEQ ID NO: 747834 - protein, 21 aa, Mycobacterium
VPATVARYVVEKGSITVDGIS

SEQ ID NO: 747835 - protein, 21 aa, Mycobacterium
VPATWPTRRVVTGPGSARVQV

SEQ ID NO: 747836 - protein, 22 aa, Mycobacterium
VPAVAPWPAIPIPQDYFERQDE

SEQ ID NO: 747837 - protein, 19 aa, Mycobacterium
VPAVRARLVEIQRQLAAAA

SEQ ID NO: 747838 - protein, 27 aa, Mycobacterium
VPAVRDKLWARLRITPHEITRRFRVAA

SEQ ID NO: 747839 - protein, 18 aa, Mycobacterium
VPAWSEFVEVHWSPWGEA

SEQ ID NO: 747840 - protein, 18 aa, Mycobacterium
VPAYRTMDGMKVMDGTAQ

SEQ ID NO: 747841 - protein, 19 aa, Mycobacterium
VPCHKRFDLERVGGTAKLD

SEQ ID NO: 747842 - protein, 25 aa, Mycobacterium
VPDADRAAAFYGHVLGWTYDPATRQ

SEQ ID NO: 747843 - protein, 18 aa, Mycobacterium
VPDAEWDAVMAREAERAR

SEQ ID NO: 747844 - protein, 18 aa, Mycobacterium
VPDAGGMIIASDRTAARA

SEQ ID NO: 747845 - protein, 17 aa, Mycobacterium
VPDALFAVLVGATVARG

SEQ ID NO: 747846 - protein, 19 aa, Mycobacterium
VPDALTFRCATYGELDDAL

SEQ ID NO: 747847 - protein, 18 aa, Mycobacterium
VPDAVAFGKRWVTECLRA

SEQ ID NO: 747848 - protein, 21 aa, Mycobacterium
VPDAVWPAVVFTLSTLLDDPV

SEQ ID NO: 747849 - protein, 18 aa, Mycobacterium
VPDDGRWFTRVHGDDELD

SEQ ID NO: 747850 - protein, 25 aa, Mycobacterium
VPDDLRPGDLLAVAATGAYCYSLSS

SEQ ID NO: 747851 - protein, 24 aa, Mycobacterium
VPDDVLQCYLELVLDGLVARLASG

SEQ ID NO: 747852 - protein, 17 aa, Mycobacterium
VPDERRGAAFVSACALV

SEQ ID NO: 747853 - protein, 25 aa, Mycobacterium
VPDGGVHPFDLGFVNGFVRRVGGRV

SEQ ID NO: 747854 - protein, 19 aa, Mycobacterium
VPDGVPVYIEESGTSMAAP

SEQ ID NO: 747855 - protein, 22 aa, Mycobacterium
VPDHLNSLFPRTLWNPKNSGAA

SEQ ID NO: 747856 - protein, 19 aa, Mycobacterium
VPDHPDHVMYVWVDALTNY

SEQ ID NO: 747857 - protein, 24 aa, Mycobacterium
VPDIPRTDLLVVIGANPVVSHGSG

SEQ ID NO: 747858 - protein, 24 aa, Mycobacterium
VPDIVGPFLGRAAAAVKALTEQAQ

SEQ ID NO: 747859 - protein, 25 aa, Mycobacterium
VPDKELRAKLTPDYDFGCKRPAVSS

SEQ ID NO: 747860 - protein, 18 aa, Mycobacterium
VPDLGAGWTIRYTTDLTD

SEQ ID NO: 747861 - protein, 20 aa, Mycobacterium
VPDLPDWSSAVTVAQLMHHT

SEQ ID NO: 747862 - protein, 20 aa, Mycobacterium
VPDLPNLRRTFSVQLGDGLF

SEQ ID NO: 747863 - protein, 18 aa, Mycobacterium
VPDLPRKEVDAALISLYQ

SEQ ID NO: 747864 - protein, 22 aa, Mycobacterium
VPDLPSPYSLAVVQLDDSPVRV

SEQ ID NO: 747865 - protein, 21 aa, Mycobacterium
VPDMFTRMILSLAATGIAPGS

SEQ ID NO: 747866 - protein, 19 aa, Mycobacterium
VPDMLARLAEGIPVDGMEA

SEQ ID NO: 747867 - protein, 27 aa, Mycobacterium
VPDPEPRGAVLPPGRPGGRPWTYTPPV

SEQ ID NO: 747868 - protein, 20 aa, Mycobacterium
VPDPFLPEVEPVAADEDAVR

SEQ ID NO: 747869 - protein, 21 aa, Mycobacterium
VPDPPGPHLLVLARGPEGYRR

SEQ ID NO: 747870 - protein, 18 aa, Mycobacterium
VPDPQLPHGDWVLTRPRL

SEQ ID NO: 747871 - protein, 21 aa, Mycobacterium
VPDPRAVIVAIHGGATSSAYF

SEQ ID NO: 747872 - protein, 17 aa, Mycobacterium
VPDRFWAQVLPRVRQAH

SEQ ID NO: 747873 - protein, 18 aa, Mycobacterium
VPDRLRGAVTAMLTGVAV

SEQ ID NO: 747874 - protein, 31 aa, Mycobacterium
VPDRSAITFKIPNLWGLLKVKGRFTEFSGDG

SEQ ID NO: 747875 - protein, 17 aa, Mycobacterium
VPDRSWSQVSVSARECI

SEQ ID NO: 747876 - protein, 23 aa, Mycobacterium
VPDSLLRRLKQYSGRLATEAVHA

SEQ ID NO: 747877 - protein, 22 aa, Mycobacterium
VPDTFWPALAFMVVTLLDDPAA

SEQ ID NO: 747878 - protein, 21 aa, Mycobacterium
VPDVLRHRLVLTYDALADEIS

SEQ ID NO: 747879 - protein, 23 aa, Mycobacterium
VPDVRLADYTGRVLEWIVVGQPD

SEQ ID NO: 747880 - protein, 18 aa, Mycobacterium
VPDWLVWTHGCPGGESVA

SEQ ID NO: 747881 - protein, 22 aa, Mycobacterium
VPDYLLQILARFARALRESSSV

SEQ ID NO: 747882 - protein, 18 aa, Mycobacterium
VPDYLRLLAAGINVVSTS

SEQ ID NO: 747883 - protein, 24 aa, Mycobacterium
VPDYPKGVTVPAIVEVETGQVVTN

SEQ ID NO: 747884 - protein, 21 aa, Mycobacterium
VPEAAIGVFLYVRYQPAFPLS

SEQ ID NO: 747885 - protein, 18 aa, Mycobacterium
VPEADALLVRSATTVDAE

SEQ ID NO: 747886 - protein, 21 aa, Mycobacterium
VPEADALLVRSATTVDAEVLA

SEQ ID NO: 747887 - protein, 18 aa, Mycobacterium
VPEAQKATAVSVLEAAGH

SEQ ID NO: 747888 - protein, 25 aa, Mycobacterium
VPEARVIDRPGWISAAAQSMRLMAG

SEQ ID NO: 747889 - protein, 18 aa, Mycobacterium
VPECQRRNKVANVRATLD

SEQ ID NO: 747890 - protein, 18 aa, Mycobacterium
VPECQSPLFLDVDASDPQ

SEQ ID NO: 747891 - protein, 19 aa, Mycobacterium
VPECQSPLFLHVDAQDPDR

SEQ ID NO: 747892 - protein, 26 aa, Mycobacterium
VPEDLAFAESRIRPSTMAAEDLLHDM

SEQ ID NO: 747893 - protein, 21 aa, Mycobacterium
VPEDRFEVVAPARVRAAVLAA

SEQ ID NO: 747894 - protein, 17 aa, Mycobacterium
VPEEVAWQQGWITDEQL

SEQ ID NO: 747895 - protein, 18 aa, Mycobacterium
VPEFAHLPSVLGEGNKKL

SEQ ID NO: 747896 - protein, 17 aa, Mycobacterium
VPEGAIVVFSAHGVAPS

SEQ ID NO: 747897 - protein, 18 aa, Mycobacterium
VPEGSIVVFSAHGVAPTV

SEQ ID NO: 747898 - protein, 18 aa, Mycobacterium
VPEGSTPTTSGWEVTTHG

SEQ ID NO: 747899 - protein, 24 aa, Mycobacterium
VPEGSVLVPFAWQGVTLHAAGASA

SEQ ID NO: 747900 - protein, 19 aa, Mycobacterium
VPEHVFALSLPRSVTTAVP

SEQ ID NO: 747901 - protein, 19 aa, Mycobacterium
VPEPEPGKATVDWTLACAP

SEQ ID NO: 747902 - protein, 17 aa, Mycobacterium
VPEPGQPLRAYIIEANS

SEQ ID NO: 747903 - protein, 17 aa, Mycobacterium
VPEPLKLAGSPEQKKKF

SEQ ID NO: 747904 - protein, 24 aa, Mycobacterium
VPEPLRYRLVRMIRAAADERREDL

SEQ ID NO: 747905 - protein, 19 aa, Mycobacterium
VPEPVLALIGKDLPPVSGP

SEQ ID NO: 747906 - protein, 19 aa, Mycobacterium
VPEQACLQIGVGGLPQAVC

SEQ ID NO: 747907 - protein, 23 aa, Mycobacterium
VPEQRKLVRRFRGITRGEVVRLL

SEQ ID NO: 747908 - protein, 17 aa, Mycobacterium
VPERGRLPKATIRAYDE

SEQ ID NO: 747909 - protein, 24 aa, Mycobacterium
VPERLEIKVPLWGQIDQAAPPDTS

SEQ ID NO: 747910 - protein, 22 aa, Mycobacterium
VPERWRRRVQSWIAGGADLDAA

SEQ ID NO: 747911 - protein, 23 aa, Mycobacterium
VPESIRAGLRMEELDLEYLEDPC

SEQ ID NO: 747912 - protein, 25 aa, Mycobacterium
VPESKRFCWNCGKPVGRSSKKSKGT

SEQ ID NO: 747913 - protein, 25 aa, Mycobacterium
VPESKRFCWNCGRPVGRSDAEGTGA

SEQ ID NO: 747914 - protein, 27 aa, Mycobacterium
VPESTRYEAWSFPDFATGADALRAVVQ

SEQ ID NO: 747915 - protein, 22 aa, Mycobacterium
VPESWQAFCEYWDRKCREELEI

SEQ ID NO: 747916 - protein, 24 aa, Mycobacterium
VPETRLGETLAAFIVPTDLVHPPR

SEQ ID NO: 747917 - protein, 22 aa, Mycobacterium
VPEVLEVRGEVFFRVADFQALN

SEQ ID NO: 747918 - protein, 26 aa, Mycobacterium
VPEVTELKAAVLALIEGVAPHAVLAT

SEQ ID NO: 747919 - protein, 20 aa, Mycobacterium
VPFAARFAGPCDVDALIEAV

SEQ ID NO: 747920 - protein, 19 aa, Mycobacterium
VPFAARWPVEVHIYPNRFV

SEQ ID NO: 747921 - protein, 20 aa, Mycobacterium
VPFAARWPVEVHIYPNRFVR

SEQ ID NO: 747922 - protein, 22 aa, Mycobacterium
VPFAIAMVKFTFPNQNLLPVSA

SEQ ID NO: 747923 - protein, 28 aa, Mycobacterium
VPFEISVAGIVVRGRIDAVFGPDSAEDT

SEQ ID NO: 747924 - protein, 20 aa, Mycobacterium
VPFELTRRGALTAELPGESA

SEQ ID NO: 747925 - protein, 21 aa, Mycobacterium
VPFERVLELAPWLKKPPPRGG

SEQ ID NO: 747926 - protein, 32 aa, Mycobacterium
VPFGEQWYGYFVRRIAERPANMTFFLRALVSG

SEQ ID NO: 747927 - protein, 17 aa, Mycobacterium
VPFGPDLLFAASDVPGL

SEQ ID NO: 747928 - protein, 19 aa, Mycobacterium
VPFGPVMSARAPWLERMGR

SEQ ID NO: 747929 - protein, 21 aa, Mycobacterium
VPFGTQWYGYFMRRLAERPAN

SEQ ID NO: 747930 - protein, 23 aa, Mycobacterium
VPFLELTLAEWNRVLDINSTGTF

SEQ ID NO: 747931 - protein, 31 aa, Mycobacterium
VPFLHPDLKWDFRLPRVVSINVSGHKYGLTY

SEQ ID NO: 747932 - protein, 31 aa, Mycobacterium
VPFLHPDLQWDFRLPRVVSINVSGHKYGLTY

SEQ ID NO: 747933 - protein, 31 aa, Mycobacterium
VPFLHPELHWDFRLPRVVSINVSGHKYGLTY

SEQ ID NO: 747934 - protein, 31 aa, Mycobacterium
VPFLHPELKWDFRLPRVVSINVSGHKYGLTY

SEQ ID NO: 747935 - protein, 23 aa, Mycobacterium
VPFLSICLSHQVLCRQLGLPIRR

SEQ ID NO: 747936 - protein, 18 aa, Mycobacterium
VPFPPLAERFERLEETLQ

SEQ ID NO: 747937 - protein, 20 aa, Mycobacterium
VPFRFHYEGPGGLLDGPEIM

SEQ ID NO: 747938 - protein, 21 aa, Mycobacterium
VPFRFHYEGPGGLLGGPEIMT

SEQ ID NO: 747939 - protein, 19 aa, Mycobacterium
VPFRPHRGIVLIVEEPSDG

SEQ ID NO: 747940 - protein, 19 aa, Mycobacterium
VPFRPHRGVLLIVEEPTDG

SEQ ID NO: 747941 - protein, 25 aa, Mycobacterium
VPFSGGFLLQDRAKFHSSFGADLPT

SEQ ID NO: 747942 - protein, 21 aa, Mycobacterium
VPFSPALCPYKTSFPNNHYYL

SEQ ID NO: 747943 - protein, 18 aa, Mycobacterium
VPFTEGFGMTETAPMVSV

SEQ ID NO: 747944 - protein, 30 aa, Mycobacterium
VPFTKRGRMADEYLEAMFELWHSDSPSYDG

SEQ ID NO: 747945 - protein, 20 aa, Mycobacterium
VPFTLTRRGALTAELPGESA

SEQ ID NO: 747946 - protein, 18 aa, Mycobacterium
VPGAAEFAYPLSELEQAQ

SEQ ID NO: 747947 - protein, 21 aa, Mycobacterium
VPGAARIPSRYVVAMLATGRD

SEQ ID NO: 747948 - protein, 20 aa, Mycobacterium
VPGACWKHPKGPGSSIDDVP

SEQ ID NO: 747949 - protein, 22 aa, Mycobacterium
VPGAETGAVWVFSGHGSHWAGM

SEQ ID NO: 747950 - protein, 18 aa, Mycobacterium
VPGAPYVLAGSHLDSQPR

SEQ ID NO: 747951 - protein, 19 aa, Mycobacterium
VPGASYWYAHADQWRYDGY

SEQ ID NO: 747952 - protein, 34 aa, Mycobacterium
VPGATSVCWWLLDGKPGFQLELFEFSKPHPRPIP

SEQ ID NO: 747953 - protein, 17 aa, Mycobacterium
VPGDCGASTGAAIATGA

SEQ ID NO: 747954 - protein, 23 aa, Mycobacterium
VPGDPRVGLAQVYGAPGTASATI

SEQ ID NO: 747955 - protein, 27 aa, Mycobacterium
VPGDPVFLPTVWDAWSAKLAADAGFAA

SEQ ID NO: 747956 - protein, 21 aa, Mycobacterium
VPGDSGMVWHLTENRARPAPL

SEQ ID NO: 747957 - protein, 18 aa, Mycobacterium
VPGEGLLRVDETKSAAGR

SEQ ID NO: 747958 - protein, 24 aa, Mycobacterium
VPGELRIGMRVRVQFHAVGPDVTL

SEQ ID NO: 747959 - protein, 19 aa, Mycobacterium
VPGETLLETARRAGLEPPF

SEQ ID NO: 747960 - protein, 24 aa, Mycobacterium
VPGETVAAYIARRTGCAAATLRMD

SEQ ID NO: 747961 - protein, 22 aa, Mycobacterium
VPGETVAAYVARRAGCADATSA

SEQ ID NO: 747962 - protein, 22 aa, Mycobacterium
VPGETYAVLRFSGDRSPATVAA

SEQ ID NO: 747963 - protein, 18 aa, Mycobacterium
VPGFDRLEITTCLRRGEI

SEQ ID NO: 747964 - protein, 21 aa, Mycobacterium
VPGFPNFYCMYGPGTNAVNGA

SEQ ID NO: 747965 - protein, 18 aa, Mycobacterium
VPGFPNLFISSAPNYSPG

SEQ ID NO: 747966 - protein, 26 aa, Mycobacterium
VPGGAMFPRPAAWSITTQPLPGLEGG

SEQ ID NO: 747967 - protein, 19 aa, Mycobacterium
VPGGQRLGGRVGQPQHPGG

SEQ ID NO: 747968 - protein, 24 aa, Mycobacterium
VPGGTPAKWARIWTQRHPDVSLQL

SEQ ID NO: 747969 - protein, 21 aa, Mycobacterium
VPGGYRLSGSIRWASNLYHDS

SEQ ID NO: 747970 - protein, 25 aa, Mycobacterium
VPGHDWSYRAAHAGHTCTLTAGIGD

SEQ ID NO: 747971 - protein, 19 aa, Mycobacterium
VPGHNRWHPDIPAAATVKP

SEQ ID NO: 747972 - protein, 25 aa, Mycobacterium
VPGIPRLGVPALRMSDAGLGVTNPG

SEQ ID NO: 747973 - protein, 17 aa, Mycobacterium
VPGIRAALRATPAPIVG

SEQ ID NO: 747974 - protein, 24 aa, Mycobacterium
VPGISADRLLCWEDVIGRQSTHYE

SEQ ID NO: 747975 - protein, 21 aa, Mycobacterium
VPGIYQVRGFDLSNITFVEGD

SEQ ID NO: 747976 - protein, 22 aa, Mycobacterium
VPGIYQVRGFDLSNITFVEGDT

SEQ ID NO: 747977 - protein, 17 aa, Mycobacterium
VPGKFYWMSTTQLRWRP

SEQ ID NO: 747978 - protein, 18 aa, Mycobacterium
VPGKLTSFALWGGGVLDL

SEQ ID NO: 747979 - protein, 23 aa, Mycobacterium
VPGKRGRPGTVVDRDEHPRADID

SEQ ID NO: 747980 - protein, 21 aa, Mycobacterium
VPGLGALVWMGRGDRPEPALL

SEQ ID NO: 747981 - protein, 28 aa, Mycobacterium
VPGLPASRCTKVAGAGGLVPRYWCVAAA

SEQ ID NO: 747982 - protein, 29 aa, Mycobacterium
VPGLRALVRLVIYWGQEALAFGMTKRPNL

SEQ ID NO: 747983 - protein, 17 aa, Mycobacterium
VPGLRRRLTPALRQLGA

SEQ ID NO: 747984 - protein, 19 aa, Mycobacterium
VPGMRAKLFDAARLAAGAI

SEQ ID NO: 747985 - protein, 18 aa, Mycobacterium
VPGNCDIAAMNHALNAYL

SEQ ID NO: 747986 - protein, 23 aa, Mycobacterium
VPGNPRVGLAQVYGAPGTASATI

SEQ ID NO: 747987 - protein, 24 aa, Mycobacterium
VPGPDRVPLLALLRSTPLTEDQIR

SEQ ID NO: 747988 - protein, 20 aa, Mycobacterium
VPGPESLPWVAPHLAESDES

SEQ ID NO: 747989 - protein, 20 aa, Mycobacterium
VPGPLAPHIACPTTSGTGSE

SEQ ID NO: 747990 - protein, 18 aa, Mycobacterium
VPGPRRRVTILGREVIRL

SEQ ID NO: 747991 - protein, 23 aa, Mycobacterium
VPGPRSPLYCAGRRVCEHYPVST

SEQ ID NO: 747992 - protein, 25 aa, Mycobacterium
VPGPTALLAPEWVPWEHRVRPGDLS

SEQ ID NO: 747993 - protein, 23 aa, Mycobacterium
VPGQARAALISAVPQQLQALASG

SEQ ID NO: 747994 - protein, 18 aa, Mycobacterium
VPGQCDISAMDHAVNSYL

SEQ ID NO: 747995 - protein, 20 aa, Mycobacterium
VPGRGVARYLAKYVTKSLAD

SEQ ID NO: 747996 - protein, 17 aa, Mycobacterium
VPGRPRALVLAPTRELA

SEQ ID NO: 747997 - protein, 34 aa, Mycobacterium
VPGRPRLLLGAFDLAGLGYRIEEFFVSGAASCYA

SEQ ID NO: 747998 - protein, 17 aa, Mycobacterium
VPGRSAAALSSWLSEQS

SEQ ID NO: 747999 - protein, 20 aa, Mycobacterium
VPGSKLGVDFWVDGVNPPGY

SEQ ID NO: 748000 - protein, 18 aa, Mycobacterium
VPGTAWYNDPHKFAVEAQ

SEQ ID NO: 748001 - protein, 20 aa, Mycobacterium
VPGTCWLVDLPGDGSNVNAP

SEQ ID NO: 748002 - protein, 22 aa, Mycobacterium
VPGTICNREGGFLTSWQPDEFD

SEQ ID NO: 748003 - protein, 22 aa, Mycobacterium
VPGTRLAGLIGESADVPCYHHQ

SEQ ID NO: 748004 - protein, 21 aa, Mycobacterium
VPGTRLLAWVRWFESDTFARL

SEQ ID NO: 748005 - protein, 26 aa, Mycobacterium
VPGTSLPGVMKLAGLVTNTPAVGALP

SEQ ID NO: 748006 - protein, 21 aa, Mycobacterium
VPGTVPVLVHPAPRGVLGEAA

SEQ ID NO: 748007 - protein, 21 aa, Mycobacterium
VPGTYGIGRWGKPTTNKDEKK

SEQ ID NO: 748008 - protein, 17 aa, Mycobacterium
VPGVGRIAGPTIGVLGQ

SEQ ID NO: 748009 - protein, 21 aa, Mycobacterium
VPGVLVALDWQTLTCQSDAGC

SEQ ID NO: 748010 - protein, 22 aa, Mycobacterium
VPGVYVTGWIKRGPRGVIGTNR

SEQ ID NO: 748011 - protein, 19 aa, Mycobacterium
VPGWVRVSSMLTRRVGSRR

SEQ ID NO: 748012 - protein, 19 aa, Mycobacterium
VPGYAKWLADQDMTPAYEL

SEQ ID NO: 748013 - protein, 19 aa, Mycobacterium
VPGYGDWVDLVVDFLEYER

SEQ ID NO: 748014 - protein, 17 aa, Mycobacterium
VPGYPNFFMLYGPNTNV

SEQ ID NO: 748015 - protein, 17 aa, Mycobacterium
VPGYRLKQDVQFDRVDE

SEQ ID NO: 748016 - protein, 18 aa, Mycobacterium
VPGYRLKQKVQFQRYTRN

SEQ ID NO: 748017 - protein, 23 aa, Mycobacterium
VPGYRLKQRVQFDACTAANPLFI

SEQ ID NO: 748018 - protein, 18 aa, Mycobacterium
VPHDEWSEARPEEVESIV

SEQ ID NO: 748019 - protein, 20 aa, Mycobacterium
VPHIRGCDYWNIRWIHVDDP

SEQ ID NO: 748020 - protein, 21 aa, Mycobacterium
VPHLHVHVFPGYQLTDFSFEN

SEQ ID NO: 748021 - protein, 28 aa, Mycobacterium
VPHLIRLHHSRFPQARFELHQRSGQGVL

SEQ ID NO: 748022 - protein, 22 aa, Mycobacterium
VPHLPAAGEMVFFDRSWYNRAG

SEQ ID NO: 748023 - protein, 18 aa, Mycobacterium
VPHPRAFQDAMLRGQLLH

SEQ ID NO: 748024 - protein, 19 aa, Mycobacterium
VPHQRERCTLREQLGGSGP

SEQ ID NO: 748025 - protein, 20 aa, Mycobacterium
VPHRIYRPAVVVGDSRTGEM

SEQ ID NO: 748026 - protein, 20 aa, Mycobacterium
VPHRKVEMMDPFMMIFTSGT

SEQ ID NO: 748027 - protein, 21 aa, Mycobacterium
VPHSGTYWAHPHVGLDADYGL

SEQ ID NO: 748028 - protein, 26 aa, Mycobacterium
VPHTVRLVPLRGRREVHGLTLDPPGR

SEQ ID NO: 748029 - protein, 20 aa, Mycobacterium
VPHVKRIDGVDTWIYDQARA

SEQ ID NO: 748030 - protein, 25 aa, Mycobacterium
VPIDALELLSPVTAPCRVVAQMTNF

SEQ ID NO: 748031 - protein, 26 aa, Mycobacterium
VPIDLRADWPAALRAAGFDPAAPTAW

SEQ ID NO: 748032 - protein, 25 aa, Mycobacterium
VPIDLRDDWPAALADAGFDAAQPTA

SEQ ID NO: 748033 - protein, 23 aa, Mycobacterium
VPIDLRHDWPAALREAGFDTARP

SEQ ID NO: 748034 - protein, 22 aa, Mycobacterium
VPIDLRQDWPKALREAGFDASR

SEQ ID NO: 748035 - protein, 27 aa, Mycobacterium
VPIDPSWPAARVELVLSDCGPSMIVTE

SEQ ID NO: 748036 - protein, 23 aa, Mycobacterium
VPIDRIVSLGAFEHFADGAGDAG

SEQ ID NO: 748037 - protein, 26 aa, Mycobacterium
VPIERTVEFLQWFLGTIPIEPIWLCP

SEQ ID NO: 748038 - protein, 33 aa, Mycobacterium
VPIGAGCKVCERPACPQRAFPYIGRPVKVDPHA

SEQ ID NO: 748039 - protein, 36 aa, Mycobacterium
VPIGAPVGGAGVFVLDVWLRPVPPGTVGELYVAGAG

SEQ ID NO: 748040 - protein, 19 aa, Mycobacterium
VPIGAPVPGAGVFVLDSWL

SEQ ID NO: 748041 - protein, 36 aa, Mycobacterium
VPIGAPVSGAGVFVLDGWLRPVPPGTVGELYVAGTG

SEQ ID NO: 748042 - protein, 27 aa, Mycobacterium
VPIGPGCKVCVRESCAQRAFPYIGRSV

SEQ ID NO: 748043 - protein, 20 aa, Mycobacterium
VPIGSPIPGAAMFVLDKWLQ

SEQ ID NO: 748044 - protein, 21 aa, Mycobacterium
VPIKKGEAVLLSYVSANRDED

SEQ ID NO: 748045 - protein, 17 aa, Mycobacterium
VPILCLTKTDLAPAEPF

SEQ ID NO: 748046 - protein, 20 aa, Mycobacterium
VPILGSLVRRGMIVIRYTGR

SEQ ID NO: 748047 - protein, 25 aa, Mycobacterium
VPILKGDKGQPCWPDGVVGSLTHCS

SEQ ID NO: 748048 - protein, 25 aa, Mycobacterium
VPILKGDKGQPCWPDGVVGSLTHCT

SEQ ID NO: 748049 - protein, 20 aa, Mycobacterium
VPILRAEITASLGMSEPSAG

SEQ ID NO: 748050 - protein, 22 aa, Mycobacterium
VPIMIRGTVFGHLYLTHVDPGR

SEQ ID NO: 748051 - protein, 18 aa, Mycobacterium
VPINFRLAPAEIEYIVGH

SEQ ID NO: 748052 - protein, 24 aa, Mycobacterium
VPINRGEMVVICLAGANRDPSVFP

SEQ ID NO: 748053 - protein, 19 aa, Mycobacterium
VPIPAGAVIDVCIGSANRD

SEQ ID NO: 748054 - protein, 22 aa, Mycobacterium
VPIPAGCSVLPMLGSTNRQEDR

SEQ ID NO: 748055 - protein, 19 aa, Mycobacterium
VPIPDPRRNAARERLVLEG

SEQ ID NO: 748056 - protein, 22 aa, Mycobacterium
VPIPELPSRLAYADERRLAEVA

SEQ ID NO: 748057 - protein, 17 aa, Mycobacterium
VPIPGAPPSLAGLDRGC

SEQ ID NO: 748058 - protein, 17 aa, Mycobacterium
VPIPGAPPSLAGMDPGC

SEQ ID NO: 748059 - protein, 27 aa, Mycobacterium
VPIPVPMAYYSFGGWKASLFGDSHAHG

SEQ ID NO: 748060 - protein, 27 aa, Mycobacterium
VPIPVPMAYYSFGGWKASLFGDTHAHG

SEQ ID NO: 748061 - protein, 21 aa, Mycobacterium
VPIQLGAQWLQRAIRWAEDNG

SEQ ID NO: 748062 - protein, 17 aa, Mycobacterium
VPIRASCACRLDVSSCC

SEQ ID NO: 748063 - protein, 18 aa, Mycobacterium
VPIRKGQRVVMFYRSANF

SEQ ID NO: 748064 - protein, 17 aa, Mycobacterium
VPIRPGKGEALWRSLAA

SEQ ID NO: 748065 - protein, 19 aa, Mycobacterium
VPIRRSRGFAPLPMTVRVP

SEQ ID NO: 748066 - protein, 19 aa, Mycobacterium
VPISPRLRDAAAALLHRLG

SEQ ID NO: 748067 - protein, 19 aa, Mycobacterium
VPIVFTPDDIHLFVAGGSA

SEQ ID NO: 748068 - protein, 17 aa, Mycobacterium
VPIVPLIVWGAQRIWTK

SEQ ID NO: 748069 - protein, 33 aa, Mycobacterium
VPIYPGYVCAIVGSLLLGKPVKWMEDRSENLTS

SEQ ID NO: 748070 - protein, 19 aa, Mycobacterium
VPIYPGYVCAIVGSLVLGK

SEQ ID NO: 748071 - protein, 21 aa, Mycobacterium
VPIYPGYVCAIVGSLVLGKPV

SEQ ID NO: 748072 - protein, 21 aa, Mycobacterium
VPKERFVLYPGAGRDGDQTPV

SEQ ID NO: 748073 - protein, 22 aa, Mycobacterium
VPKERGRYAIPPGSDHGQDYRT

SEQ ID NO: 748074 - protein, 17 aa, Mycobacterium
VPKHAGITAFVLDMTSP

SEQ ID NO: 748075 - protein, 19 aa, Mycobacterium
VPKHAGLTYFLCDMRQPGI

SEQ ID NO: 748076 - protein, 19 aa, Mycobacterium
VPKHAGLTYFLCDMTQPGI

SEQ ID NO: 748077 - protein, 18 aa, Mycobacterium
VPKHKGITYFLLDMKTPG

SEQ ID NO: 748078 - protein, 25 aa, Mycobacterium
VPKKLLEEWLALWSDHYQLGEKLRV

SEQ ID NO: 748079 - protein, 25 aa, Mycobacterium
VPKKLLEEWLALWSEHNKLPERLHV

SEQ ID NO: 748080 - protein, 25 aa, Mycobacterium
VPKKLLEEWLAMWSEHYGLPEKLHV

SEQ ID NO: 748081 - protein, 23 aa, Mycobacterium
VPKKLLEEWLAMWSENYDLGEKL

SEQ ID NO: 748082 - protein, 24 aa, Mycobacterium
VPKRLAGQPDPWAHMSRHARSLAG

SEQ ID NO: 748083 - protein, 19 aa, Mycobacterium
VPKSPEWAAPISGLDAAEL

SEQ ID NO: 748084 - protein, 25 aa, Mycobacterium
VPKTLIQHLIRWVISSGEFNDEVNE

SEQ ID NO: 748085 - protein, 24 aa, Mycobacterium
VPKTLIQHLIRWVISSNQFDDVVN

SEQ ID NO: 748086 - protein, 29 aa, Mycobacterium
VPLAKACARVMLGASISQLRAEGMLARTG

SEQ ID NO: 748087 - protein, 22 aa, Mycobacterium
VPLALARPDLRIILLEPLLRRS

SEQ ID NO: 748088 - protein, 23 aa, Mycobacterium
VPLARAGAAYAELALLRGDPSDG

SEQ ID NO: 748089 - protein, 23 aa, Mycobacterium
VPLARRGGTVLIYGVTREDDLVR

SEQ ID NO: 748090 - protein, 19 aa, Mycobacterium
VPLAWPFIPTSWRWHPASH

SEQ ID NO: 748091 - protein, 23 aa, Mycobacterium
VPLDAFDVVLAFNVLHVAPDLTG

SEQ ID NO: 748092 - protein, 19 aa, Mycobacterium
VPLDINLPWFMRGPGAVTG

SEQ ID NO: 748093 - protein, 22 aa, Mycobacterium
VPLDQARAILFLACDLSAFVTG

SEQ ID NO: 748094 - protein, 22 aa, Mycobacterium
VPLDRRLCIPLVHADDVAAALV

SEQ ID NO: 748095 - protein, 20 aa, Mycobacterium
VPLEGAPWFALSERNSPGSI

SEQ ID NO: 748096 - protein, 28 aa, Mycobacterium
VPLEHLAFFVLDGWLRKVPVGVVGELYV

SEQ ID NO: 748097 - protein, 27 aa, Mycobacterium
VPLEHLSFFVLDGWLRQVPVGVVGELY

SEQ ID NO: 748098 - protein, 17 aa, Mycobacterium
VPLEMGASWIHGTTDNP

SEQ ID NO: 748099 - protein, 19 aa, Mycobacterium
VPLGAFSRAVSLGVAHEPA

SEQ ID NO: 748100 - protein, 19 aa, Mycobacterium
VPLGARWPVYEQSLVGTWV

SEQ ID NO: 748101 - protein, 23 aa, Mycobacterium
VPLGDRLVLIVGDVVGHGVEAAA

SEQ ID NO: 748102 - protein, 19 aa, Mycobacterium
VPLGVFYSMIEIIAPVLEE

SEQ ID NO: 748103 - protein, 18 aa, Mycobacterium
VPLGVVGMIYEGRPNVTV

SEQ ID NO: 748104 - protein, 19 aa, Mycobacterium
VPLHLPSTFATWNALSDNA

SEQ ID NO: 748105 - protein, 31 aa, Mycobacterium
VPLHPAVSMFSRTLVRVGFIAGDGLRKLAHT

SEQ ID NO: 748106 - protein, 20 aa, Mycobacterium
VPLIRSIMDLAVPFTYFLGS

SEQ ID NO: 748107 - protein, 18 aa, Mycobacterium
VPLLAGLNELAPWVRQWH

SEQ ID NO: 748108 - protein, 19 aa, Mycobacterium
VPLLDELVDLLGRDKAAEE

SEQ ID NO: 748109 - protein, 18 aa, Mycobacterium
VPLLELLRSTPLTEDQIK

SEQ ID NO: 748110 - protein, 18 aa, Mycobacterium
VPLLEQLDALGITRRGEA

SEQ ID NO: 748111 - protein, 19 aa, Mycobacterium
VPLLGRIPLDPALVAAGDS

SEQ ID NO: 748112 - protein, 17 aa, Mycobacterium
VPLLHRIATGVEDRPLN

SEQ ID NO: 748113 - protein, 18 aa, Mycobacterium
VPLLHRITTDTERPLTGI

SEQ ID NO: 748114 - protein, 17 aa, Mycobacterium
VPLLHRVSSDENRPLTG

SEQ ID NO: 748115 - protein, 19 aa, Mycobacterium
VPLLRGCVVVATHDSDGDL

SEQ ID NO: 748116 - protein, 25 aa, Mycobacterium
VPLLRGDQWWALGMSEPEAGSDFAG

SEQ ID NO: 748117 - protein, 25 aa, Mycobacterium
VPLLTRATPYIGHFQIRNRGTLGGS

SEQ ID NO: 748118 - protein, 21 aa, Mycobacterium
VPLLTRLGGFYQQTGSSLADL

SEQ ID NO: 748119 - protein, 19 aa, Mycobacterium
VPLMGADGYFALINQTQSV

SEQ ID NO: 748120 - protein, 17 aa, Mycobacterium
VPLMLEHSGGGSIINIT

SEQ ID NO: 748121 - protein, 28 aa, Mycobacterium
VPLMPPQMLHMILPRKDYQIVDDSWDVV

SEQ ID NO: 748122 - protein, 22 aa, Mycobacterium
VPLPAAARWAMRIPGGKAVQRW

SEQ ID NO: 748123 - protein, 25 aa, Mycobacterium
VPLPDPRLDKLAELFGSEKTVPAPV

SEQ ID NO: 748124 - protein, 22 aa, Mycobacterium
VPLPDPRLDKLAEMFDSEKIVP

SEQ ID NO: 748125 - protein, 22 aa, Mycobacterium
VPLPDPRLDKLAEVFGSARTLP

SEQ ID NO: 748126 - protein, 26 aa, Mycobacterium
VPLPELPSILCATDLAPADTAGLDPE

SEQ ID NO: 748127 - protein, 19 aa, Mycobacterium
VPLPKYADFVVAGRDLSTA

SEQ ID NO: 748128 - protein, 23 aa, Mycobacterium
VPLPSKWRIAFGEPIHTADYATT

SEQ ID NO: 748129 - protein, 23 aa, Mycobacterium
VPLPSKWRIAFGEPIYTADYGSG

SEQ ID NO: 748130 - protein, 23 aa, Mycobacterium
VPLPSKWRIAFGEPIYTNDYSAS

SEQ ID NO: 748131 - protein, 24 aa, Mycobacterium
VPLPVNFEVALLFLAIGMSVTPSG

SEQ ID NO: 748132 - protein, 19 aa, Mycobacterium
VPLQPRFGADSATHHRHSG

SEQ ID NO: 748133 - protein, 18 aa, Mycobacterium
VPLRARIAERLEQSGPTV

SEQ ID NO: 748134 - protein, 17 aa, Mycobacterium
VPLRGRREVHGLTLDAP

SEQ ID NO: 748135 - protein, 17 aa, Mycobacterium
VPLRGTREVHGLSLDPP

SEQ ID NO: 748136 - protein, 21 aa, Mycobacterium
VPLRGTREVYGLSINPPGRLD

SEQ ID NO: 748137 - protein, 23 aa, Mycobacterium
VPLRLKDWHEVYEDFDEGTLREQ

SEQ ID NO: 748138 - protein, 17 aa, Mycobacterium
VPLRNVRCRVVSQAGRD

SEQ ID NO: 748139 - protein, 20 aa, Mycobacterium
VPLRQNVRMRLAGGRTAKRA

SEQ ID NO: 748140 - protein, 17 aa, Mycobacterium
VPLSGALVLGWGEPNTS

SEQ ID NO: 748141 - protein, 19 aa, Mycobacterium
VPLSGTWIEIRFTLTDVVR

SEQ ID NO: 748142 - protein, 25 aa, Mycobacterium
VPLSKALSGYSAWVTGIRRVEAPTR

SEQ ID NO: 748143 - protein, 28 aa, Mycobacterium
VPLSRACLLGCGITTGWGSAVNTANVSP

SEQ ID NO: 748144 - protein, 25 aa, Mycobacterium
VPLTKALRGYSAWVTGIRRVEAPTR

SEQ ID NO: 748145 - protein, 24 aa, Mycobacterium
VPLTLKIPGLTGFTTGKPRSLKPG

SEQ ID NO: 748146 - protein, 20 aa, Mycobacterium
VPLTRLESGTSHLVIGATGN

SEQ ID NO: 748147 - protein, 18 aa, Mycobacterium
VPLVADLFEGVRLPRTEA

SEQ ID NO: 748148 - protein, 17 aa, Mycobacterium
VPLVLGVADAVRAAGIA

SEQ ID NO: 748149 - protein, 17 aa, Mycobacterium
VPLVLGVADAVREAGIA

SEQ ID NO: 748150 - protein, 21 aa, Mycobacterium
VPLYEERYVLLAPPEMLPPGV

SEQ ID NO: 748151 - protein, 18 aa, Mycobacterium
VPLYGYRAKDVTQDYQAV

SEQ ID NO: 748152 - protein, 20 aa, Mycobacterium
VPLYQERYVLLSPAEMLGSG

SEQ ID NO: 748153 - protein, 17 aa, Mycobacterium
VPMCRAMSTVSVTPMDF

SEQ ID NO: 748154 - protein, 23 aa, Mycobacterium
VPMFAFGHGLSYTRFDYRDLVLT

SEQ ID NO: 748155 - protein, 21 aa, Mycobacterium
VPMLLPICSHHYLPAGRGSFG

SEQ ID NO: 748156 - protein, 19 aa, Mycobacterium
VPMLLRAGLGVAMGNAHPD

SEQ ID NO: 748157 - protein, 24 aa, Mycobacterium
VPMPAGRGLFFGTLYPAFWRFPPV

SEQ ID NO: 748158 - protein, 17 aa, Mycobacterium
VPMPVVPLLPIVPLDRR

SEQ ID NO: 748159 - protein, 21 aa, Mycobacterium
VPMREDMCIMLAARKVPAALK

SEQ ID NO: 748160 - protein, 22 aa, Mycobacterium
VPMREDMCIMLAARKVPAALKW

SEQ ID NO: 748161 - protein, 21 aa, Mycobacterium
VPMREDMCIMLAARKVPGALK

SEQ ID NO: 748162 - protein, 17 aa, Mycobacterium
VPMSAPLLFTANDCLDI

SEQ ID NO: 748163 - protein, 21 aa, Mycobacterium
VPMSQLIRWAATSHHYLAVFD

SEQ ID NO: 748164 - protein, 20 aa, Mycobacterium
VPMTMAAHLMNWESPEDIAF

SEQ ID NO: 748165 - protein, 18 aa, Mycobacterium
VPMVDAMVHFNLVEHLSG

SEQ ID NO: 748166 - protein, 17 aa, Mycobacterium
VPMVRGGPQENRLRAGT

SEQ ID NO: 748167 - protein, 18 aa, Mycobacterium
VPMYFAGELVKVTPMDFM

SEQ ID NO: 748168 - protein, 19 aa, Mycobacterium
VPMYFGGELVKVTPMDFMR

SEQ ID NO: 748169 - protein, 23 aa, Mycobacterium
VPNAAALPFRYTINGYRGCSHAC

SEQ ID NO: 748170 - protein, 23 aa, Mycobacterium
VPNAGTYWAHPHVGLEDDHGLYL

SEQ ID NO: 748171 - protein, 19 aa, Mycobacterium
VPNARVGHIGLYRDPKTLV

SEQ ID NO: 748172 - protein, 24 aa, Mycobacterium
VPNFAFGHGLTYTSFGYRDLAVSG

SEQ ID NO: 748173 - protein, 23 aa, Mycobacterium
VPNKNIRLGIEWIDHYSDALPLT

SEQ ID NO: 748174 - protein, 20 aa, Mycobacterium
VPNMLSRASLAPNALAADPS

SEQ ID NO: 748175 - protein, 24 aa, Mycobacterium
VPNRVCALARIDIPIMQAPMTYIA

SEQ ID NO: 748176 - protein, 17 aa, Mycobacterium
VPNSADWHVIRKAGTEI

SEQ ID NO: 748177 - protein, 23 aa, Mycobacterium
VPNSRWATAVPWESTVDGAVLSQ

SEQ ID NO: 748178 - protein, 17 aa, Mycobacterium
VPNVAAAVVGGKGVLAD

SEQ ID NO: 748179 - protein, 21 aa, Mycobacterium
VPNVELFRRLAHVMEFDDESM

SEQ ID NO: 748180 - protein, 20 aa, Mycobacterium
VPNVELFRRLARTMEFDEES

SEQ ID NO: 748181 - protein, 25 aa, Mycobacterium
VPPAFCITTAVGLRYLADPAATMDA

SEQ ID NO: 748182 - protein, 25 aa, Mycobacterium
VPPAKLIGWTARFLGMVKPGDQVDF

SEQ ID NO: 748183 - protein, 27 aa, Mycobacterium
VPPALILENRLQLVTLIATNIFGQNTP

SEQ ID NO: 748184 - protein, 23 aa, Mycobacterium
VPPDERTTLWLGMSQPGYSRRLD

SEQ ID NO: 748185 - protein, 17 aa, Mycobacterium
VPPDPVATLILTELRSA

SEQ ID NO: 748186 - protein, 27 aa, Mycobacterium
VPPDRRVVAGLGPRVVGLSAQRSAGVI

SEQ ID NO: 748187 - protein, 17 aa, Mycobacterium
VPPDRWDADAFYDPDPS

SEQ ID NO: 748188 - protein, 22 aa, Mycobacterium
VPPDSIAAVAEWAAQRDTPLHF

SEQ ID NO: 748189 - protein, 19 aa, Mycobacterium
VPPEARWEALAGNAKSPDI

SEQ ID NO: 748190 - protein, 21 aa, Mycobacterium
VPPEDEFWLTLAPTNRLVTAR

SEQ ID NO: 748191 - protein, 17 aa, Mycobacterium
VPPELRSIFVVTAPASP

SEQ ID NO: 748192 - protein, 28 aa, Mycobacterium
VPPEMRDCMRRILKGFVERITHDEALSA

SEQ ID NO: 748193 - protein, 20 aa, Mycobacterium
VPPEVIFTVRLVSDTVVSLE

SEQ ID NO: 748194 - protein, 17 aa, Mycobacterium
VPPEVTDLAGLLAGPGQ

SEQ ID NO: 748195 - protein, 23 aa, Mycobacterium
VPPFAPWIPKWLWALQRRMLSPF

SEQ ID NO: 748196 - protein, 21 aa, Mycobacterium
VPPFSPFANRLHCNPSPSGAL

SEQ ID NO: 748197 - protein, 21 aa, Mycobacterium
VPPGFSHCLLLAEGHVVASGL

SEQ ID NO: 748198 - protein, 18 aa, Mycobacterium
VPPGGLHLWLRLPDQTDL

SEQ ID NO: 748199 - protein, 17 aa, Mycobacterium
VPPGRFGKLIGEGLPGN

SEQ ID NO: 748200 - protein, 22 aa, Mycobacterium
VPPHARGVAMLAQDPLLFPHMS

SEQ ID NO: 748201 - protein, 34 aa, Mycobacterium
VPPHDYTATVVIAGFSYDVPIMGTPIGGIVPGLL

SEQ ID NO: 748202 - protein, 17 aa, Mycobacterium
VPPHVVAANRFALLTLI

SEQ ID NO: 748203 - protein, 17 aa, Mycobacterium
VPPIAFGHALGYGLRPG

SEQ ID NO: 748204 - protein, 20 aa, Mycobacterium
VPPIRRSWVGGRPIVADGQM

SEQ ID NO: 748205 - protein, 22 aa, Mycobacterium
VPPLPARWEEHAEFDLDWHLHR

SEQ ID NO: 748206 - protein, 27 aa, Mycobacterium
VPPLPPRAPLLPVPPNVAAVLVVVPAP

SEQ ID NO: 748207 - protein, 24 aa, Mycobacterium
VPPLPRGAAWVFVEVVGDTAEEAL

SEQ ID NO: 748208 - protein, 18 aa, Mycobacterium
VPPLPVVSWMYESEIYRR

SEQ ID NO: 748209 - protein, 26 aa, Mycobacterium
VPPLRTLYRDRLLVLGALDVASVVEN

SEQ ID NO: 748210 - protein, 19 aa, Mycobacterium
VPPMPAPVEPKGPGMWEEI

SEQ ID NO: 748211 - protein, 23 aa, Mycobacterium
VPPPDYVPLLALLGRRLSNDEVK

SEQ ID NO: 748212 - protein, 17 aa, Mycobacterium
VPPPGPLGRHFPFDPSQ

SEQ ID NO: 748213 - protein, 20 aa, Mycobacterium
VPPRRLRAVSAVGESFPLYC

SEQ ID NO: 748214 - protein, 17 aa, Mycobacterium
VPPRRLVGGGSRNPAAP

SEQ ID NO: 748215 - protein, 27 aa, Mycobacterium
VPPRWLPGPRELRAWTLAAGHPEGDHY

SEQ ID NO: 748216 - protein, 27 aa, Mycobacterium
VPPRWLPGPRELRAWTLAAGNPEGEHY

SEQ ID NO: 748217 - protein, 23 aa, Mycobacterium
VPPSAMKPMIAMLGREGMAEGAR

SEQ ID NO: 748218 - protein, 18 aa, Mycobacterium
VPPSIVFANREQLLLLIA

SEQ ID NO: 748219 - protein, 20 aa, Mycobacterium
VPPTAPFVGGMTRVDVEPTG

SEQ ID NO: 748220 - protein, 19 aa, Mycobacterium
VPPTIRYDLVGQKPDHING

SEQ ID NO: 748221 - protein, 17 aa, Mycobacterium
VPPTPWSAQGMFDVLRD

SEQ ID NO: 748222 - protein, 22 aa, Mycobacterium
VPPTVWGGVAATRFRDVVERWN

SEQ ID NO: 748223 - protein, 20 aa, Mycobacterium
VPPVPPWPPAPWIPPVPVPA

SEQ ID NO: 748224 - protein, 20 aa, Mycobacterium
VPQCPRRWRYLSPAIPADLE

SEQ ID NO: 748225 - protein, 23 aa, Mycobacterium
VPQELQRRIALRHSVDMVRVTMD

SEQ ID NO: 748226 - protein, 29 aa, Mycobacterium
VPQFEVMYLLSGCAPEAVEHLRAGLEQIG

SEQ ID NO: 748227 - protein, 24 aa, Mycobacterium
VPQHRAGPAYAEFALMRGDPSDGL

SEQ ID NO: 748228 - protein, 28 aa, Mycobacterium
VPQLDAKVLWQLKRALPGPFTRTLGLVE

SEQ ID NO: 748229 - protein, 21 aa, Mycobacterium
VPQLEGLIALSNRMQSFFREW

SEQ ID NO: 748230 - protein, 18 aa, Mycobacterium
VPQLSWPRPYHPMINFFD

SEQ ID NO: 748231 - protein, 17 aa, Mycobacterium
VPQLWKDMDTTLAAAPL

SEQ ID NO: 748232 - protein, 25 aa, Mycobacterium
VPQPTEFWIPPGATLRIIGPGDKEV

SEQ ID NO: 748233 - protein, 19 aa, Mycobacterium
VPQRDALEVALGMATGSSP

SEQ ID NO: 748234 - protein, 17 aa, Mycobacterium
VPQRFLKGIPYDTPIQG

SEQ ID NO: 748235 - protein, 22 aa, Mycobacterium
VPQRKGDALIFDRDEGIRPDTT

SEQ ID NO: 748236 - protein, 19 aa, Mycobacterium
VPQRLIGLARIWEEILGRP

SEQ ID NO: 748237 - protein, 21 aa, Mycobacterium
VPQSRCVLEPDGVRAGADLLG

SEQ ID NO: 748238 - protein, 21 aa, Mycobacterium
VPQWPRRWRFLSPAIPADPQG

SEQ ID NO: 748239 - protein, 20 aa, Mycobacterium
VPQWPRRWRYLSPAIPSDRS

SEQ ID NO: 748240 - protein, 19 aa, Mycobacterium
VPRAARAVEEIVAALHGAA

SEQ ID NO: 748241 - protein, 19 aa, Mycobacterium
VPRAARAVEEIVAALRTTS

SEQ ID NO: 748242 - protein, 22 aa, Mycobacterium
VPRAAVEPLVLMLAPLAPHLAE

SEQ ID NO: 748243 - protein, 26 aa, Mycobacterium
VPRAEVLRPGLLVLPVRGAARYFGSE

SEQ ID NO: 748244 - protein, 25 aa, Mycobacterium
VPRAEVLRPGLLVLSVRGAARYFGS

SEQ ID NO: 748245 - protein, 17 aa, Mycobacterium
VPRARREPLLAAAAALR

SEQ ID NO: 748246 - protein, 17 aa, Mycobacterium
VPRAVRAVEEIVAALQS

SEQ ID NO: 748247 - protein, 17 aa, Mycobacterium
VPRAVRFPTGPVSADAV

SEQ ID NO: 748248 - protein, 24 aa, Mycobacterium
VPRAWRELLHGWPGLDAAELAELA

SEQ ID NO: 748249 - protein, 25 aa, Mycobacterium
VPRDIAGRVRLDWESLSQRIHPAAS

SEQ ID NO: 748250 - protein, 19 aa, Mycobacterium
VPRDRIESVARDFATARAA

SEQ ID NO: 748251 - protein, 24 aa, Mycobacterium
VPREIGGRMRLDWESLSQRIHPAE

SEQ ID NO: 748252 - protein, 27 aa, Mycobacterium
VPRGISFLLNRNRLNVAISRAQFTAVI

SEQ ID NO: 748253 - protein, 21 aa, Mycobacterium
VPRGISFLLNRNRLNVAVSRA

SEQ ID NO: 748254 - protein, 24 aa, Mycobacterium
VPRGQHAVAVFTPRDVAVYLSPPG

SEQ ID NO: 748255 - protein, 21 aa, Mycobacterium
VPRGYRLVARPGAVSRRAISL

SEQ ID NO: 748256 - protein, 23 aa, Mycobacterium
VPRHILDSWVLRTFIVHLRENRF

SEQ ID NO: 748257 - protein, 26 aa, Mycobacterium
VPRIFKRIRPAFTYQRSLDVLTAARD

SEQ ID NO: 748258 - protein, 26 aa, Mycobacterium
VPRIFKRVRPAFSYQRSLDVITAARD

SEQ ID NO: 748259 - protein, 27 aa, Mycobacterium
VPRIFRRIRPAFSYRRSLDVLTAARDA

SEQ ID NO: 748260 - protein, 19 aa, Mycobacterium
VPRILGVTTDSEFSEAPLV

SEQ ID NO: 748261 - protein, 21 aa, Mycobacterium
VPRITAAAGRAGRPAPRIVAG

SEQ ID NO: 748262 - protein, 26 aa, Mycobacterium
VPRLLKWDKNRVAARIDELLDLVNLD

SEQ ID NO: 748263 - protein, 20 aa, Mycobacterium
VPRLQRRTAPAVAPVTLDPN

SEQ ID NO: 748264 - protein, 23 aa, Mycobacterium
VPRLVPGWTKPIVIGRHAFGDQY

SEQ ID NO: 748265 - protein, 21 aa, Mycobacterium
VPRNELIAFFVASDVMLVTPL

SEQ ID NO: 748266 - protein, 23 aa, Mycobacterium
VPRPETEALLAWVTAQPLPARPV

SEQ ID NO: 748267 - protein, 18 aa, Mycobacterium
VPRPWQLGAEMLRVTRPG

SEQ ID NO: 748268 - protein, 20 aa, Mycobacterium
VPRPWQLGAEMLRVTRPGGL

SEQ ID NO: 748269 - protein, 18 aa, Mycobacterium
VPRPWQLGGEMLRVTRPG

SEQ ID NO: 748270 - protein, 24 aa, Mycobacterium
VPRQSAPDWIKSGPLSTGDANGYV

SEQ ID NO: 748271 - protein, 28 aa, Mycobacterium
VPRRGEIIYRFAVQAAQAINRFGTAETR

SEQ ID NO: 748272 - protein, 22 aa, Mycobacterium
VPRRGLKTAIAMVRERRRNKVA

SEQ ID NO: 748273 - protein, 18 aa, Mycobacterium
VPRSLWFVDEVKRSPAGK

SEQ ID NO: 748274 - protein, 17 aa, Mycobacterium
VPRSTCRALEFHRAVEV

SEQ ID NO: 748275 - protein, 17 aa, Mycobacterium
VPRSVCSNVGQLVSAFC

SEQ ID NO: 748276 - protein, 28 aa, Mycobacterium
VPRTDSCRVMLCSSLAATIGGKGQLMYA

SEQ ID NO: 748277 - protein, 22 aa, Mycobacterium
VPRTKRGVISYAARDIGERLNA

SEQ ID NO: 748278 - protein, 22 aa, Mycobacterium
VPRTKVEKWQRIGRGRRDLHRR

SEQ ID NO: 748279 - protein, 23 aa, Mycobacterium
VPRTPRLGAAFEIADFVSDQMHT

SEQ ID NO: 748280 - protein, 19 aa, Mycobacterium
VPRVDACIRRVGDCRERGD

SEQ ID NO: 748281 - protein, 20 aa, Mycobacterium
VPRVWDMLFGTFQSEVRRRS

SEQ ID NO: 748282 - protein, 26 aa, Mycobacterium
VPRVWEKLRAGIEFAVANEPDDVKRQ

SEQ ID NO: 748283 - protein, 19 aa, Mycobacterium
VPRYNEFRRQLRLKPATSF

SEQ ID NO: 748284 - protein, 24 aa, Mycobacterium
VPRYTEAASLAWLFYTSGTTGRSK

SEQ ID NO: 748285 - protein, 19 aa, Mycobacterium
VPRYVEFLDELPLNATGKV

SEQ ID NO: 748286 - protein, 17 aa, Mycobacterium
VPSAGAVLADWGADVIK

SEQ ID NO: 748287 - protein, 17 aa, Mycobacterium
VPSAGAVLADWGADVVK

SEQ ID NO: 748288 - protein, 25 aa, Mycobacterium
VPSANARWGNNVAILAGDYLLATAS

SEQ ID NO: 748289 - protein, 17 aa, Mycobacterium
VPSARRYLPGSLIMETT

SEQ ID NO: 748290 - protein, 20 aa, Mycobacterium
VPSARVGHIGLYRDPKIRVA

SEQ ID NO: 748291 - protein, 20 aa, Mycobacterium
VPSCAGWTIADLIWHVGVVH

SEQ ID NO: 748292 - protein, 19 aa, Mycobacterium
VPSDANFVLFGKFADAPAA

SEQ ID NO: 748293 - protein, 23 aa, Mycobacterium
VPSDMKGLWGFVPACSTPDAADV

SEQ ID NO: 748294 - protein, 21 aa, Mycobacterium
VPSEVQLEWARVEATAETAGA

SEQ ID NO: 748295 - protein, 20 aa, Mycobacterium
VPSFAEFWAAGHVELPTDTG

SEQ ID NO: 748296 - protein, 19 aa, Mycobacterium
VPSFARWPYEVSLYPHRQV

SEQ ID NO: 748297 - protein, 19 aa, Mycobacterium
VPSFDEFWDRGYLELPTDA

SEQ ID NO: 748298 - protein, 28 aa, Mycobacterium
VPSHAELAWVLGCFTGFGQASRMTQFKD

SEQ ID NO: 748299 - protein, 18 aa, Mycobacterium
VPSKSFIAATGVRTELRR

SEQ ID NO: 748300 - protein, 17 aa, Mycobacterium
VPSLLGLFLSLPGVNQW

SEQ ID NO: 748301 - protein, 22 aa, Mycobacterium
VPSLWAEFVARWEIQSPSPDPA

SEQ ID NO: 748302 - protein, 21 aa, Mycobacterium
VPSLWAEFVARWETRAPSPDP

SEQ ID NO: 748303 - protein, 18 aa, Mycobacterium
VPSMLDMILDLGGDRLGN

SEQ ID NO: 748304 - protein, 18 aa, Mycobacterium
VPSMLDMILELGGDQLGG

SEQ ID NO: 748305 - protein, 17 aa, Mycobacterium
VPSNVVVPYFWSDQYDV

SEQ ID NO: 748306 - protein, 18 aa, Mycobacterium
VPSPAFVVSADWSIGGWN

SEQ ID NO: 748307 - protein, 18 aa, Mycobacterium
VPSPPGFGAANTPTDAQP

SEQ ID NO: 748308 - protein, 19 aa, Mycobacterium
VPSPYSWEVPSAGNARFTW

SEQ ID NO: 748309 - protein, 17 aa, Mycobacterium
VPSRAFPQRDMDAALTT

SEQ ID NO: 748310 - protein, 18 aa, Mycobacterium
VPSRPAKLLVSGGIGTGK

SEQ ID NO: 748311 - protein, 18 aa, Mycobacterium
VPSRRLNPTPAISAEHAA

SEQ ID NO: 748312 - protein, 18 aa, Mycobacterium
VPSSGLWDKVLTDGHASL

SEQ ID NO: 748313 - protein, 31 aa, Mycobacterium
VPSSIPTYFMAAATPLYGMSSILGMAQTGQG

SEQ ID NO: 748314 - protein, 17 aa, Mycobacterium
VPSSLGIEYPDIAPDDA

SEQ ID NO: 748315 - protein, 18 aa, Mycobacterium
VPSSLGMSGSRSIPSPDA

SEQ ID NO: 748316 - protein, 19 aa, Mycobacterium
VPSSLSVIEPPVWTSHEAL

SEQ ID NO: 748317 - protein, 23 aa, Mycobacterium
VPSSMVLLSPWLDLGMTNPNIAF

SEQ ID NO: 748318 - protein, 20 aa, Mycobacterium
VPSVELRAAAIIGAGSASFE

SEQ ID NO: 748319 - protein, 44 aa, Mycobacterium
VPSVKVGFYGRVRRCGMVSPTVFWPIPRVYSGLVRIDRYETTPW

SEQ ID NO: 748320 - protein, 18 aa, Mycobacterium
VPTAWSAEGLIIYLPSAA

SEQ ID NO: 748321 - protein, 25 aa, Mycobacterium
VPTCGDWTLKQLFRHVGRGNRWAAQ

SEQ ID NO: 748322 - protein, 23 aa, Mycobacterium
VPTCPEWTLRQLFRHVGRGDRWA

SEQ ID NO: 748323 - protein, 24 aa, Mycobacterium
VPTDGGYIFTGRWQFSSGTDACDW

SEQ ID NO: 748324 - protein, 17 aa, Mycobacterium
VPTERWVYPQTGTEAHD

SEQ ID NO: 748325 - protein, 21 aa, Mycobacterium
VPTFRMLAGLSGRVPLVSIVS

SEQ ID NO: 748326 - protein, 18 aa, Mycobacterium
VPTGGDWVRPDMVRALRK

SEQ ID NO: 748327 - protein, 22 aa, Mycobacterium
VPTGRAAKFLALQQEVIKQDFF

SEQ ID NO: 748328 - protein, 28 aa, Mycobacterium
VPTHSQLAWVLGCFTGFGQASRMTQFKD

SEQ ID NO: 748329 - protein, 25 aa, Mycobacterium
VPTHVKPRLLGHWGTTPGLNLIYAH

SEQ ID NO: 748330 - protein, 19 aa, Mycobacterium
VPTIMAFRDGILVYSQPGA

SEQ ID NO: 748331 - protein, 17 aa, Mycobacterium
VPTIWNDVRHFLGCEPG

SEQ ID NO: 748332 - protein, 27 aa, Mycobacterium
VPTKTLPLVQLLPFLKSQEASLKAKID

SEQ ID NO: 748333 - protein, 18 aa, Mycobacterium
VPTLKALLDGGAKVVVAA

SEQ ID NO: 748334 - protein, 19 aa, Mycobacterium
VPTLLTRLVSELKLTGTDV

SEQ ID NO: 748335 - protein, 25 aa, Mycobacterium
VPTPEMRLDMPLLDFFSHGGALKSS

SEQ ID NO: 748336 - protein, 19 aa, Mycobacterium
VPTPYSWEVPSAGDARFTW

SEQ ID NO: 748337 - protein, 25 aa, Mycobacterium
VPTRFARGWHCLGLIRDFGDGKPHA

SEQ ID NO: 748338 - protein, 22 aa, Mycobacterium
VPTRQGQWWYYARTFEGKQYRV

SEQ ID NO: 748339 - protein, 17 aa, Mycobacterium
VPTSRRVLAALGDKVLK

SEQ ID NO: 748340 - protein, 22 aa, Mycobacterium
VPTSRYVLRDPFAAPAADDPTG

SEQ ID NO: 748341 - protein, 20 aa, Mycobacterium
VPTVLPASVLARLFRTDQGR

SEQ ID NO: 748342 - protein, 17 aa, Mycobacterium
VPTVVGLQARFAPAIRR

SEQ ID NO: 748343 - protein, 23 aa, Mycobacterium
VPTVWPGTPYPLGATYDGAGTNF

SEQ ID NO: 748344 - protein, 24 aa, Mycobacterium
VPTWAGVAYVCFIVDAYSRMIVGW

SEQ ID NO: 748345 - protein, 22 aa, Mycobacterium
VPTWNYEVLNVYGTLRVHDDPD

SEQ ID NO: 748346 - protein, 20 aa, Mycobacterium
VPTYRFLRRYAGVVTNPRHP

SEQ ID NO: 748347 - protein, 17 aa, Mycobacterium
VPVAAHWIADRQIVPSL

SEQ ID NO: 748348 - protein, 17 aa, Mycobacterium
VPVAARRDRDWSHQGYE

SEQ ID NO: 748349 - protein, 20 aa, Mycobacterium
VPVAAVRLLAPIPRPPSIRD

SEQ ID NO: 748350 - protein, 34 aa, Mycobacterium
VPVADRAPIIAAYKPKAGKVVDGYFAQLPDDADH

SEQ ID NO: 748351 - protein, 19 aa, Mycobacterium
VPVAGLLALTARTLRQAEF

SEQ ID NO: 748352 - protein, 24 aa, Mycobacterium
VPVAGWDFSWLDGRATEERPSWGY

SEQ ID NO: 748353 - protein, 24 aa, Mycobacterium
VPVAHARAAARLIPDATLKVVAEA

SEQ ID NO: 748354 - protein, 18 aa, Mycobacterium
VPVAVAVLRSSLNSTGSG

SEQ ID NO: 748355 - protein, 17 aa, Mycobacterium
VPVCVGYTVDGKRVDEM

SEQ ID NO: 748356 - protein, 17 aa, Mycobacterium
VPVDGFWSVTVYNKDGY

SEQ ID NO: 748357 - protein, 24 aa, Mycobacterium
VPVDGGYIFNGRWQFSSGTDHCDW

SEQ ID NO: 748358 - protein, 19 aa, Mycobacterium
VPVDIGWFVHHIRRTPQGA

SEQ ID NO: 748359 - protein, 23 aa, Mycobacterium
VPVDLRDDWPTALAAAGFDRTQP

SEQ ID NO: 748360 - protein, 26 aa, Mycobacterium
VPVDLRHDWPSALRQAGFDAGRPAAW

SEQ ID NO: 748361 - protein, 21 aa, Mycobacterium
VPVDLRQDWPKALQEAGFDAS

SEQ ID NO: 748362 - protein, 23 aa, Mycobacterium
VPVDLRQDWPKALRQAGFDASAP

SEQ ID NO: 748363 - protein, 24 aa, Mycobacterium
VPVDRFAGFVVEVGMPRGWEPLDA

SEQ ID NO: 748364 - protein, 21 aa, Mycobacterium
VPVEAARTWVGLAGTMTTLSA

SEQ ID NO: 748365 - protein, 17 aa, Mycobacterium
VPVEAGIYRVNRVINPD

SEQ ID NO: 748366 - protein, 18 aa, Mycobacterium
VPVEAGIYRVNRVVNPDR

SEQ ID NO: 748367 - protein, 21 aa, Mycobacterium
VPVEEARTWVGLAGTMTTLSA

SEQ ID NO: 748368 - protein, 22 aa, Mycobacterium
VPVEGARTWIGLAGTMTTLSAL

SEQ ID NO: 748369 - protein, 20 aa, Mycobacterium
VPVELAWKRVRDGKLGTRNA

SEQ ID NO: 748370 - protein, 17 aa, Mycobacterium
VPVELDVSAGFDITELP

SEQ ID NO: 748371 - protein, 18 aa, Mycobacterium
VPVFDVGEVVDLIERERV

SEQ ID NO: 748372 - protein, 20 aa, Mycobacterium
VPVFNFCDGTGLATDDPRGL

SEQ ID NO: 748373 - protein, 25 aa, Mycobacterium
VPVFPSYRLDHQFEVIKLVGELSDV

SEQ ID NO: 748374 - protein, 17 aa, Mycobacterium
VPVGAPGEIWVRGYSLM

SEQ ID NO: 748375 - protein, 22 aa, Mycobacterium
VPVGARVGSFGWNTQRHLELYL

SEQ ID NO: 748376 - protein, 33 aa, Mycobacterium
VPVGFEAWIGWFLYRLSPGLMRGALGIAQMSLA

SEQ ID NO: 748377 - protein, 25 aa, Mycobacterium
VPVGPRAACRLLRSEADLVVCSTTP

SEQ ID NO: 748378 - protein, 19 aa, Mycobacterium
VPVGPSIGKYGWLSRRSLR

SEQ ID NO: 748379 - protein, 18 aa, Mycobacterium
VPVGSPPTPSGWEVTTHG

SEQ ID NO: 748380 - protein, 18 aa, Mycobacterium
VPVGTALSPLAFLDSLGT

SEQ ID NO: 748381 - protein, 17 aa, Mycobacterium
VPVGVGFAKRAGLVRDG

SEQ ID NO: 748382 - protein, 17 aa, Mycobacterium
VPVGWNYFGRAVFSTRK

SEQ ID NO: 748383 - protein, 20 aa, Mycobacterium
VPVGWRRPRDSPTASEGSVE

SEQ ID NO: 748384 - protein, 23 aa, Mycobacterium
VPVHAECAGLIYLVSELDGYPMC

SEQ ID NO: 748385 - protein, 25 aa, Mycobacterium
VPVHSIRLAGLVAHQEVLFGTLGET

SEQ ID NO: 748386 - protein, 43 aa, Mycobacterium
VPVICALLGAPARDWARFSAWADEIFKMFSWDLGEHAEAVETA

SEQ ID NO: 748387 - protein, 21 aa, Mycobacterium
VPVIETRIVRREGIRRAFGAT

SEQ ID NO: 748388 - protein, 17 aa, Mycobacterium
VPVIGPFFRRGLMLLDF

SEQ ID NO: 748389 - protein, 18 aa, Mycobacterium
VPVIGPFFRRGLMLLDFE

SEQ ID NO: 748390 - protein, 18 aa, Mycobacterium
VPVIVWGAHRIWPKDHPK

SEQ ID NO: 748391 - protein, 18 aa, Mycobacterium
VPVKGRLVVAAMAVGATA

SEQ ID NO: 748392 - protein, 21 aa, Mycobacterium
VPVLAAAPMRGGLPTAVPTDP

SEQ ID NO: 748393 - protein, 30 aa, Mycobacterium
VPVLAAFPHKVPRGVGFFKRSGLVRQGTAE

SEQ ID NO: 748394 - protein, 21 aa, Mycobacterium
VPVLLGRCVELLTPALTRHDA

SEQ ID NO: 748395 - protein, 19 aa, Mycobacterium
VPVLLLTGWQDIFLDQTLH

SEQ ID NO: 748396 - protein, 19 aa, Mycobacterium
VPVLPVLTDGLPRCRQTVH

SEQ ID NO: 748397 - protein, 32 aa, Mycobacterium
VPVLVIASQVPRAGMGLRRGMLHQLDDQKASA

SEQ ID NO: 748398 - protein, 18 aa, Mycobacterium
VPVMFDRIMELPEDVLNR

SEQ ID NO: 748399 - protein, 17 aa, Mycobacterium
VPVMFDRIMELPEEVLD

SEQ ID NO: 748400 - protein, 17 aa, Mycobacterium
VPVMIERGGGAVVNVGT

SEQ ID NO: 748401 - protein, 19 aa, Mycobacterium
VPVMLQRIVDLPAKVRQKY

SEQ ID NO: 748402 - protein, 33 aa, Mycobacterium
VPVNPESWFIYGLYRLSPSFSRTLTGIGSFELA

SEQ ID NO: 748403 - protein, 20 aa, Mycobacterium
VPVPDAALFVLDRWMRPVPP

SEQ ID NO: 748404 - protein, 17 aa, Mycobacterium
VPVPGGLRRRHVQTLAD

SEQ ID NO: 748405 - protein, 17 aa, Mycobacterium
VPVPGVLRKVPESIALL

SEQ ID NO: 748406 - protein, 19 aa, Mycobacterium
VPVPLARLDGMDSLLSIVQ

SEQ ID NO: 748407 - protein, 19 aa, Mycobacterium
VPVPPGWGGYLIAPEVVEF

SEQ ID NO: 748408 - protein, 17 aa, Mycobacterium
VPVPRNVPWFPADIDHW

SEQ ID NO: 748409 - protein, 17 aa, Mycobacterium
VPVQAVWLPHSVSAIRT

SEQ ID NO: 748410 - protein, 20 aa, Mycobacterium
VPVRIYRGGPSPAPVVVYCH

SEQ ID NO: 748411 - protein, 29 aa, Mycobacterium
VPVRLAELFAEAGLPPGVFQVVHGDKEAV

SEQ ID NO: 748412 - protein, 27 aa, Mycobacterium
VPVRLAELFIEAGLPPGVFQVVQGDKE

SEQ ID NO: 748413 - protein, 29 aa, Mycobacterium
VPVRLVLRLPEWQLAVPQVGGPGQEAQRV

SEQ ID NO: 748414 - protein, 19 aa, Mycobacterium
VPVRPDWTGPESIFGYEDA

SEQ ID NO: 748415 - protein, 26 aa, Mycobacterium
VPVRRVGKHLVCTVFDLMLAHYGVAR

SEQ ID NO: 748416 - protein, 24 aa, Mycobacterium
VPVRTEAWLGYVLGRVAPGINRRT

SEQ ID NO: 748417 - protein, 17 aa, Mycobacterium
VPVRVSRDFAASLERIG

SEQ ID NO: 748418 - protein, 17 aa, Mycobacterium
VPVRYLPNFSAAAEQVA

SEQ ID NO: 748419 - protein, 17 aa, Mycobacterium
VPVRYLPNFSAVAEQVA

SEQ ID NO: 748420 - protein, 17 aa, Mycobacterium
VPVSAAVWREGHEAVAA

SEQ ID NO: 748421 - protein, 17 aa, Mycobacterium
VPVSASVWREGHEAVAA

SEQ ID NO: 748422 - protein, 17 aa, Mycobacterium
VPVSGIRFDGVRVAPWQ

SEQ ID NO: 748423 - protein, 20 aa, Mycobacterium
VPVSGLLALTARTLRQAEFV

SEQ ID NO: 748424 - protein, 20 aa, Mycobacterium
VPVSGLLALTARTLRQSEFA

SEQ ID NO: 748425 - protein, 20 aa, Mycobacterium
VPVSGLLAVTARTLRQSEFV

SEQ ID NO: 748426 - protein, 22 aa, Mycobacterium
VPVSSIAARWGLVNASHFSRLF

SEQ ID NO: 748427 - protein, 22 aa, Mycobacterium
VPVTQWVPFADWADGRVLLDDR

SEQ ID NO: 748428 - protein, 17 aa, Mycobacterium
VPVVAGRSGGAPETVLD

SEQ ID NO: 748429 - protein, 21 aa, Mycobacterium
VPVVDHLRLNYLDDHDFDSDI

SEQ ID NO: 748430 - protein, 20 aa, Mycobacterium
VPVVDVWTGWSDRAGTRRWT

SEQ ID NO: 748431 - protein, 18 aa, Mycobacterium
VPVVKGLVAQGVTVSIDT

SEQ ID NO: 748432 - protein, 17 aa, Mycobacterium
VPVVSGPAVQAGPLPAY

SEQ ID NO: 748433 - protein, 18 aa, Mycobacterium
VPVYPTCHYVMGGIPTTV

SEQ ID NO: 748434 - protein, 25 aa, Mycobacterium
VPWEPICAPDLLLAQALLRTKQIKL

SEQ ID NO: 748435 - protein, 17 aa, Mycobacterium
VPWREGFRRMIAARHPE

SEQ ID NO: 748436 - protein, 21 aa, Mycobacterium
VPYAELHAHSAFSFLDGASTP

SEQ ID NO: 748437 - protein, 17 aa, Mycobacterium
VPYDAAMRLVDVNYKAV

SEQ ID NO: 748438 - protein, 19 aa, Mycobacterium
VPYDVAMRVVEVNFKAVLT

SEQ ID NO: 748439 - protein, 18 aa, Mycobacterium
VPYFASVVPHVHRMEPGY

SEQ ID NO: 748440 - protein, 23 aa, Mycobacterium
VPYFPLGSAFPGFPKVSQNAVVR

SEQ ID NO: 748441 - protein, 20 aa, Mycobacterium
VPYFSLAMLPGGRRGRQSPP

SEQ ID NO: 748442 - protein, 20 aa, Mycobacterium
VPYFSLAMLPGGRRSTVVAG

SEQ ID NO: 748443 - protein, 18 aa, Mycobacterium
VPYLQVWNLTGQPAAVVP

SEQ ID NO: 748444 - protein, 22 aa, Mycobacterium
VPYPAGHSALLHRVGKHGLLVS

SEQ ID NO: 748445 - protein, 25 aa, Mycobacterium
VPYPPLCDWTRRALTCGVALQCSPS

SEQ ID NO: 748446 - protein, 24 aa, Mycobacterium
VPYRANMWALRALGVRRVFAPCAV

SEQ ID NO: 748447 - protein, 25 aa, Mycobacterium
VPYRANMWALRAVGVRRVFAPCAVG

SEQ ID NO: 748448 - protein, 20 aa, Mycobacterium
VPYRTGRRVKIGDAEWLSMF

SEQ ID NO: 748449 - protein, 30 aa, Mycobacterium
VPYRYRLTSRYEIPCTVAGTVTVDGTHYRV

SEQ ID NO: 748450 - protein, 17 aa, Mycobacterium
VPYTRGLHEVGGRVWAW

SEQ ID NO: 748451 - protein, 19 aa, Mycobacterium
VPYTYWGVGCVDPDVYRTA

SEQ ID NO: 748452 - protein, 25 aa, Mycobacterium
VQAAELAPGPALRCAEAVARGDASA

SEQ ID NO: 748453 - protein, 19 aa, Mycobacterium
VQAALAFAFERYDGGGLPA

SEQ ID NO: 748454 - protein, 23 aa, Mycobacterium
VQAARRAFAGWSLSTREQRLDLL

SEQ ID NO: 748455 - protein, 17 aa, Mycobacterium
VQAAWAVLVAYYNRLRC

SEQ ID NO: 748456 - protein, 19 aa, Mycobacterium
VQACVAAGVNITFKLLYNE

SEQ ID NO: 748457 - protein, 17 aa, Mycobacterium
VQACVAAGVNITYKILY

SEQ ID NO: 748458 - protein, 17 aa, Mycobacterium
VQACVDAGIPVTVVPGV

SEQ ID NO: 748459 - protein, 20 aa, Mycobacterium
VQADIYLGQRLEMKALELDE

SEQ ID NO: 748460 - protein, 17 aa, Mycobacterium
VQADPGLREDLHALAGD

SEQ ID NO: 748461 - protein, 20 aa, Mycobacterium
VQADVPFFFKQWGGRTPKAL

SEQ ID NO: 748462 - protein, 25 aa, Mycobacterium
VQAEFDRLRALGVRFTQEPTEMGPV

SEQ ID NO: 748463 - protein, 23 aa, Mycobacterium
VQAELPPLAGIVHAAGEIGTTPL

SEQ ID NO: 748464 - protein, 17 aa, Mycobacterium
VQAFGVLLVALQPVDER

SEQ ID NO: 748465 - protein, 25 aa, Mycobacterium
VQAGDWPAAIGALVDAPAVVANGFL

SEQ ID NO: 748466 - protein, 20 aa, Mycobacterium
VQAGELLFRAQGRSLALTDC

SEQ ID NO: 748467 - protein, 25 aa, Mycobacterium
VQAGERRGLAPGQRRMWFMQTKDPA

SEQ ID NO: 748468 - protein, 22 aa, Mycobacterium
VQAGLRTDYLFRIANQRGGIVL

SEQ ID NO: 748469 - protein, 25 aa, Mycobacterium
VQAGPLWLIAHLSRAGWLRWSDKLA

SEQ ID NO: 748470 - protein, 18 aa, Mycobacterium
VQALIRWDPVGHAATELA

SEQ ID NO: 748471 - protein, 18 aa, Mycobacterium
VQALIRWDPVGHADAELD

SEQ ID NO: 748472 - protein, 18 aa, Mycobacterium
VQALIRWDPVGHAEAELD

SEQ ID NO: 748473 - protein, 19 aa, Mycobacterium
VQALRHLALVVADEPEVGA

SEQ ID NO: 748474 - protein, 21 aa, Mycobacterium
VQALRSGECDLALAGGVTVMA

SEQ ID NO: 748475 - protein, 26 aa, Mycobacterium
VQALTRTAGFQWARHNICVNAIAPIA

SEQ ID NO: 748476 - protein, 17 aa, Mycobacterium
VQANVEFALSLAHVPRS

SEQ ID NO: 748477 - protein, 23 aa, Mycobacterium
VQAPESYGGWGLSHIGQAVIFEA

SEQ ID NO: 748478 - protein, 17 aa, Mycobacterium
VQAPYGLVVPVISQADT

SEQ ID NO: 748479 - protein, 18 aa, Mycobacterium
VQAQRVINRLAVACGSRA

SEQ ID NO: 748480 - protein, 20 aa, Mycobacterium
VQARELLPERALMGDASAIV

SEQ ID NO: 748481 - protein, 29 aa, Mycobacterium
VQARPGCRPSLAELDGFVRGLIAGYKVPR

SEQ ID NO: 748482 - protein, 17 aa, Mycobacterium
VQARSVLLWGKGGKQRL

SEQ ID NO: 748483 - protein, 17 aa, Mycobacterium
VQARTATVIAERLAAVP

SEQ ID NO: 748484 - protein, 19 aa, Mycobacterium
VQASAAAIFELIADPARQR

SEQ ID NO: 748485 - protein, 18 aa, Mycobacterium
VQASRLGKMIAEQSEGTE

SEQ ID NO: 748486 - protein, 27 aa, Mycobacterium
VQATRCMDCGIPFCHNGCPLGNLIPEW

SEQ ID NO: 748487 - protein, 34 aa, Mycobacterium
VQCAADLRGPVLIGVRPEGWRLTAPDAGIAVKVG

SEQ ID NO: 748488 - protein, 28 aa, Mycobacterium
VQCFLRAHPSYWRRLPSRVVWADPDWDA

SEQ ID NO: 748489 - protein, 18 aa, Mycobacterium
VQCGHAFQQATTFHRRRP

SEQ ID NO: 748490 - protein, 18 aa, Mycobacterium
VQCTRPWVMPYGAGDITY

SEQ ID NO: 748491 - protein, 24 aa, Mycobacterium
VQDAWLRWSTHRGAAVEDLKAWLT

SEQ ID NO: 748492 - protein, 19 aa, Mycobacterium
VQDGCPLLGTWQSIVLVDL

SEQ ID NO: 748493 - protein, 23 aa, Mycobacterium
VQDGLWLRMLDIPAVLQARTYDA

SEQ ID NO: 748494 - protein, 22 aa, Mycobacterium
VQDGRAALMVHLSHAVTDGVGG

SEQ ID NO: 748495 - protein, 24 aa, Mycobacterium
VQDMLWSASMDRINLMTDSARDLV

SEQ ID NO: 748496 - protein, 25 aa, Mycobacterium
VQDPLRWLRCLTQYRGTNSGAPNFA

SEQ ID NO: 748497 - protein, 19 aa, Mycobacterium
VQDVAGWKVALANAPLRMV

SEQ ID NO: 748498 - protein, 24 aa, Mycobacterium
VQEACLHLGHSICEMVEAALFPGP

SEQ ID NO: 748499 - protein, 19 aa, Mycobacterium
VQEADGLVEEVVQRLTASF

SEQ ID NO: 748500 - protein, 19 aa, Mycobacterium
VQEDWSFAFGWQALEAVAD

SEQ ID NO: 748501 - protein, 27 aa, Mycobacterium
VQEGLWPNMIPRGGVLGTQHLVDVLDG

SEQ ID NO: 748502 - protein, 19 aa, Mycobacterium
VQELFEARIPRGKAPIADV

SEQ ID NO: 748503 - protein, 21 aa, Mycobacterium
VQELPYVTLLLRIRGNTAAER

SEQ ID NO: 748504 - protein, 19 aa, Mycobacterium
VQFALKRAKAGELLLGGAA

SEQ ID NO: 748505 - protein, 20 aa, Mycobacterium
VQFGRAIGSFQALKHRMADL

SEQ ID NO: 748506 - protein, 19 aa, Mycobacterium
VQFGSAVERIETVLASPRE

SEQ ID NO: 748507 - protein, 24 aa, Mycobacterium
VQFHYDISNDFFKLWQDPSQTYSC

SEQ ID NO: 748508 - protein, 31 aa, Mycobacterium
VQFIGNLLPPAMKWKMFFSRQAANRNYLHDG

SEQ ID NO: 748509 - protein, 19 aa, Mycobacterium
VQFSARFLFLGTGYYDYDA

SEQ ID NO: 748510 - protein, 19 aa, Mycobacterium
VQFTNHFKEGGPGGPKFKQ

SEQ ID NO: 748511 - protein, 24 aa, Mycobacterium
VQFYCVDLGGGGLMYLEDLPHVGG

SEQ ID NO: 748512 - protein, 22 aa, Mycobacterium
VQGAWAALVAYYNRLRCGTGEY

SEQ ID NO: 748513 - protein, 17 aa, Mycobacterium
VQGFWNREYDILVCTTI

SEQ ID NO: 748514 - protein, 18 aa, Mycobacterium
VQGGGFAGPLLDGFDNLY

SEQ ID NO: 748515 - protein, 17 aa, Mycobacterium
VQGGITAAVRFTLREAE

SEQ ID NO: 748516 - protein, 18 aa, Mycobacterium
VQGGRPEALAGLGGADPA

SEQ ID NO: 748517 - protein, 18 aa, Mycobacterium
VQGGRPEALGGLGGAAPD

SEQ ID NO: 748518 - protein, 17 aa, Mycobacterium
VQGHGGIVLEHLKALRL

SEQ ID NO: 748519 - protein, 21 aa, Mycobacterium
VQGLGSWPIAAGRGGKWSTRP

SEQ ID NO: 748520 - protein, 20 aa, Mycobacterium
VQGLLPGVVKTVVNHHPKGV

SEQ ID NO: 748521 - protein, 17 aa, Mycobacterium
VQGLVGWQDYAVVSDTT

SEQ ID NO: 748522 - protein, 17 aa, Mycobacterium
VQGLVLGGYRFAEFRSA

SEQ ID NO: 748523 - protein, 21 aa, Mycobacterium
VQGMCTAGAFYFINESDVVIC

SEQ ID NO: 748524 - protein, 21 aa, Mycobacterium
VQGMCTAGAFYFVNESDVVIC

SEQ ID NO: 748525 - protein, 24 aa, Mycobacterium
VQGPRAEVVVALKGTSPVGLSRSV

SEQ ID NO: 748526 - protein, 25 aa, Mycobacterium
VQGPRSADVLQRLGLPTDMEYMAYA

SEQ ID NO: 748527 - protein, 23 aa, Mycobacterium
VQGRELATVTAWRDVSALEGRLY

SEQ ID NO: 748528 - protein, 19 aa, Mycobacterium
VQGSGWAALGWDTLGNKLL

SEQ ID NO: 748529 - protein, 24 aa, Mycobacterium
VQGSGWGALAWDPIGRRLVVHQIH

SEQ ID NO: 748530 - protein, 28 aa, Mycobacterium
VQGSSRYPGGVALRFARVLRYRDDKSPD

SEQ ID NO: 748531 - protein, 24 aa, Mycobacterium
VQHEVEALQALPFGNKQELIESRI

SEQ ID NO: 748532 - protein, 17 aa, Mycobacterium
VQHGPSPAIGLVVLDRA

SEQ ID NO: 748533 - protein, 17 aa, Mycobacterium
VQHGYWLETLRRAVTSN

SEQ ID NO: 748534 - protein, 22 aa, Mycobacterium
VQHLKCGDRVILTFDSCGGCDR

SEQ ID NO: 748535 - protein, 29 aa, Mycobacterium
VQHNLARLAELLLLWRHGAPDHREVVYLA

SEQ ID NO: 748536 - protein, 29 aa, Mycobacterium
VQHNLARLAELLLLWRHGTPDHREVVYLA

SEQ ID NO: 748537 - protein, 20 aa, Mycobacterium
VQHQRIRGAVTLNDGDHIRI

SEQ ID NO: 748538 - protein, 18 aa, Mycobacterium
VQHRSRLRSSAGELPVCA

SEQ ID NO: 748539 - protein, 25 aa, Mycobacterium
VQHTRLRPAVNLGLDVLNTALREIV

SEQ ID NO: 748540 - protein, 25 aa, Mycobacterium
VQHTRLRPAVNLGLDVLNTALRELI

SEQ ID NO: 748541 - protein, 19 aa, Mycobacterium
VQIGAWRGPSAEVFAAAHV

SEQ ID NO: 748542 - protein, 28 aa, Mycobacterium
VQIIPADPAMAWRYLEVAANGSEPEEQI

SEQ ID NO: 748543 - protein, 18 aa, Mycobacterium
VQIIPADPVMAWRYVELD

SEQ ID NO: 748544 - protein, 26 aa, Mycobacterium
VQIIPPEPAMAWRYLQLDADDTDPDG

SEQ ID NO: 748545 - protein, 22 aa, Mycobacterium
VQIKRGQRVVMFYRSANFDEEV

SEQ ID NO: 748546 - protein, 24 aa, Mycobacterium
VQIPKLRVGSFFPSLLERRRRIDK

SEQ ID NO: 748547 - protein, 23 aa, Mycobacterium
VQIPRFCDHPLLDPVGACRQCLV

SEQ ID NO: 748548 - protein, 18 aa, Mycobacterium
VQIRDGAVYVDVSAISEF

SEQ ID NO: 748549 - protein, 29 aa, Mycobacterium
VQIRGSEHFCRLVRPWSCTAVPIHDPLSG

SEQ ID NO: 748550 - protein, 17 aa, Mycobacterium
VQIRRAGAGTALIDPVN

SEQ ID NO: 748551 - protein, 25 aa, Mycobacterium
VQKAQKQARRWSRDSVAEAVRVVAA

SEQ ID NO: 748552 - protein, 24 aa, Mycobacterium
VQKDWRLIAMLDMGWEKYQVAAEY

SEQ ID NO: 748553 - protein, 23 aa, Mycobacterium
VQKFREVMENEYLGRKMIDGPAP

SEQ ID NO: 748554 - protein, 28 aa, Mycobacterium
VQKKGSALVPSWVAFAVVGLLEQHFGRL

SEQ ID NO: 748555 - protein, 23 aa, Mycobacterium
VQKLAEEVLCRFLARQSDAMLAG

SEQ ID NO: 748556 - protein, 24 aa, Mycobacterium
VQLAEWYRLRGLSGPAGRFGESAA

SEQ ID NO: 748557 - protein, 23 aa, Mycobacterium
VQLAVYRLAWAALLGCSESSVRT

SEQ ID NO: 748558 - protein, 27 aa, Mycobacterium
VQLGDDWPSHILVPAIHRNRAEVREIF

SEQ ID NO: 748559 - protein, 17 aa, Mycobacterium
VQLGRDCVARVERKLLD

SEQ ID NO: 748560 - protein, 17 aa, Mycobacterium
VQLIDPFSVGFNLAKGA

SEQ ID NO: 748561 - protein, 22 aa, Mycobacterium
VQLLALRGARVLGIAGPGNADW

SEQ ID NO: 748562 - protein, 31 aa, Mycobacterium
VQLLGPFNVLRPAWKAMVDQGYGRILNISSG

SEQ ID NO: 748563 - protein, 19 aa, Mycobacterium
VQLLLRVGVYARIKRAKKA

SEQ ID NO: 748564 - protein, 18 aa, Mycobacterium
VQLLRALAIAQLTDSGLA

SEQ ID NO: 748565 - protein, 21 aa, Mycobacterium
VQLNHEFHRAINIAADSPKLA

SEQ ID NO: 748566 - protein, 21 aa, Mycobacterium
VQLPAWYRQNPGLARDLAFIA

SEQ ID NO: 748567 - protein, 17 aa, Mycobacterium
VQLPEPVQMASADEAIP

SEQ ID NO: 748568 - protein, 22 aa, Mycobacterium
VQLPGLPRSWLLTKHADVRLVS

SEQ ID NO: 748569 - protein, 19 aa, Mycobacterium
VQLPLRTGDAVFFNPALFH

SEQ ID NO: 748570 - protein, 22 aa, Mycobacterium
VQLPNCPAEWTWNVKNESASSA

SEQ ID NO: 748571 - protein, 28 aa, Mycobacterium
VQLQQTICFLGYCTTITTTVYDGSVGGW

SEQ ID NO: 748572 - protein, 17 aa, Mycobacterium
VQLRWLRRTGRDYELGM

SEQ ID NO: 748573 - protein, 24 aa, Mycobacterium
VQLTRKKLGTGLIEAFSSTCTHCA

SEQ ID NO: 748574 - protein, 26 aa, Mycobacterium
VQLTRKRLGTGLIEAFSSSCPQCSGR

SEQ ID NO: 748575 - protein, 26 aa, Mycobacterium
VQLTRKRLGTGLIEAFSTSCTHCGGR

SEQ ID NO: 748576 - protein, 23 aa, Mycobacterium
VQLVGPRAKAMWVSTFHSTCVRI

SEQ ID NO: 748577 - protein, 17 aa, Mycobacterium
VQLWPHRHGTDAMFAGA

SEQ ID NO: 748578 - protein, 23 aa, Mycobacterium
VQLYRYLLEQSLLAAGQAEHAPT

SEQ ID NO: 748579 - protein, 25 aa, Mycobacterium
VQMGCGRTGAFFSFEEAGIVPDIVT

SEQ ID NO: 748580 - protein, 26 aa, Mycobacterium
VQMGCGRTGPFFSFEAAGIVPDIVTL

SEQ ID NO: 748581 - protein, 25 aa, Mycobacterium
VQMGCGRTGSFFSFEEAGIKPDIVT

SEQ ID NO: 748582 - protein, 17 aa, Mycobacterium
VQMIYREVEGLPKGSVK

SEQ ID NO: 748583 - protein, 26 aa, Mycobacterium
VQMMPWLEPEPVRWAIDNVHVRVGPG

SEQ ID NO: 748584 - protein, 24 aa, Mycobacterium
VQMNQAAFRWGRVAVANPAEFRTA

SEQ ID NO: 748585 - protein, 24 aa, Mycobacterium
VQMSRARALLLGRDFVIPEDVKAL

SEQ ID NO: 748586 - protein, 23 aa, Mycobacterium
VQNARLAASVAERGGTPLEFTSL

SEQ ID NO: 748587 - protein, 18 aa, Mycobacterium
VQNLPGYQGQGGAGSAST

SEQ ID NO: 748588 - protein, 25 aa, Mycobacterium
VQNNIEFLRFLLADERVQAGDLDTA

SEQ ID NO: 748589 - protein, 22 aa, Mycobacterium
VQPDLKVLVNLGYGDPNYGYST

SEQ ID NO: 748590 - protein, 23 aa, Mycobacterium
VQPDLRVLVELGYDRTAYQDVPT

SEQ ID NO: 748591 - protein, 17 aa, Mycobacterium
VQPDPFAEPGWFRTDDL

SEQ ID NO: 748592 - protein, 23 aa, Mycobacterium
VQPELRKGRYPDRKTARRVSEVV

SEQ ID NO: 748593 - protein, 23 aa, Mycobacterium
VQPELRKGRYPDRKVARRVSEVV

SEQ ID NO: 748594 - protein, 23 aa, Mycobacterium
VQPESMTFTGLMVGTVPLGLTAT

SEQ ID NO: 748595 - protein, 17 aa, Mycobacterium
VQPEVAAVGPLVEALAE

SEQ ID NO: 748596 - protein, 27 aa, Mycobacterium
VQPGFGRTGDDMWGFARHNVVPDLVTM

SEQ ID NO: 748597 - protein, 28 aa, Mycobacterium
VQPGFGRTGETWWGFIRHGVVPDLVTMG

SEQ ID NO: 748598 - protein, 19 aa, Mycobacterium
VQPGSGVRGMIAKKGNIPV

SEQ ID NO: 748599 - protein, 26 aa, Mycobacterium
VQPHCPRSPVIPGIVWYSAETQPDGW

SEQ ID NO: 748600 - protein, 22 aa, Mycobacterium
VQPHLPKPWGRDATPVEQIIIA

SEQ ID NO: 748601 - protein, 20 aa, Mycobacterium
VQPLCARFGLPYTTGPLTRQ

SEQ ID NO: 748602 - protein, 25 aa, Mycobacterium
VQPLGFLMYRVMAVLQPAVAAQLQQ

SEQ ID NO: 748603 - protein, 17 aa, Mycobacterium
VQPRAGPHQRLLRERVD

SEQ ID NO: 748604 - protein, 19 aa, Mycobacterium
VQPRPSVHDPVRPQSNDAF

SEQ ID NO: 748605 - protein, 18 aa, Mycobacterium
VQPTLPILLANLVSINEV

SEQ ID NO: 748606 - protein, 20 aa, Mycobacterium
VQPVPWPAANSMLDVIAPYG

SEQ ID NO: 748607 - protein, 18 aa, Mycobacterium
VQPVSPVFLYAHNDGELQ

SEQ ID NO: 748608 - protein, 17 aa, Mycobacterium
VQPYLAWLTYTAESAAH

SEQ ID NO: 748609 - protein, 17 aa, Mycobacterium
VQQCLRSPLRLTTEEER

SEQ ID NO: 748610 - protein, 24 aa, Mycobacterium
VQQDWLAASPLCFVATTDAEGRVD

SEQ ID NO: 748611 - protein, 18 aa, Mycobacterium
VQQIARWAGCIGNDQRVV

SEQ ID NO: 748612 - protein, 24 aa, Mycobacterium
VQQKRIVVVGHFFGRQVWAGEEHR

SEQ ID NO: 748613 - protein, 17 aa, Mycobacterium
VQQPLAIAIFTRTPDCD

SEQ ID NO: 748614 - protein, 18 aa, Mycobacterium
VQQVHLYGGYNITRAAWP

SEQ ID NO: 748615 - protein, 19 aa, Mycobacterium
VQQWHKAMHMFQLGFDVNP

SEQ ID NO: 748616 - protein, 25 aa, Mycobacterium
VQRARECLRLLGVATEVLRGRQRTY

SEQ ID NO: 748617 - protein, 21 aa, Mycobacterium
VQRARRLERFLSQNMMAAEQF

SEQ ID NO: 748618 - protein, 19 aa, Mycobacterium
VQRELRRRTGILVPVDAFD

SEQ ID NO: 748619 - protein, 21 aa, Mycobacterium
VQRFIRYGDEFAVDVADRSFE

SEQ ID NO: 748620 - protein, 19 aa, Mycobacterium
VQRFPDLQLLVVGRGDEDQ

SEQ ID NO: 748621 - protein, 30 aa, Mycobacterium
VQRFPEAMVRPRWLWKFGKTLRPPDLRVPN

SEQ ID NO: 748622 - protein, 26 aa, Mycobacterium
VQRHGPAVLRVCTFVLGPLDAEDAWS

SEQ ID NO: 748623 - protein, 24 aa, Mycobacterium
VQRHGPDAGTWCEAWTVRDIVVHQ

SEQ ID NO: 748624 - protein, 18 aa, Mycobacterium
VQRIKGINPFLGPFGALF

SEQ ID NO: 748625 - protein, 20 aa, Mycobacterium
VQRLAEFAQMLPMGGSEDPD

SEQ ID NO: 748626 - protein, 20 aa, Mycobacterium
VQRLCQWGFDVLDAHRIEWW

SEQ ID NO: 748627 - protein, 23 aa, Mycobacterium
VQRLELVRRIGIEIDNDVVELGT

SEQ ID NO: 748628 - protein, 22 aa, Mycobacterium
VQRLELVRRIGLVIDYDAVELG

SEQ ID NO: 748629 - protein, 23 aa, Mycobacterium
VQRLEPRMRLVARDIVDTIIDKG

SEQ ID NO: 748630 - protein, 18 aa, Mycobacterium
VQRLPVRRWLGGARSERR

SEQ ID NO: 748631 - protein, 17 aa, Mycobacterium
VQRLQRGRRHGVLGQDV

SEQ ID NO: 748632 - protein, 18 aa, Mycobacterium
VQRLWAGWAPSFAIIEHK

SEQ ID NO: 748633 - protein, 20 aa, Mycobacterium
VQRLWAGWLPPFAIVEHVGR

SEQ ID NO: 748634 - protein, 21 aa, Mycobacterium
VQRPILAPIYLPDIRVACTPY

SEQ ID NO: 748635 - protein, 17 aa, Mycobacterium
VQRRARAAQLLRTVMGR

SEQ ID NO: 748636 - protein, 24 aa, Mycobacterium
VQRRWPAVPALRVRPRRAATAAHY

SEQ ID NO: 748637 - protein, 23 aa, Mycobacterium
VQRSGAFLMHAWDVLRTVDPQAP

SEQ ID NO: 748638 - protein, 28 aa, Mycobacterium
VQRTELRPPPWTGPGVRYRDAMAVLNDA

SEQ ID NO: 748639 - protein, 19 aa, Mycobacterium
VQRTHEWAERCLAEHHRLQ

SEQ ID NO: 748640 - protein, 17 aa, Mycobacterium
VQRTRLQPGRMFLVDTT

SEQ ID NO: 748641 - protein, 25 aa, Mycobacterium
VQRVEMWGGVPVWLVTRYQEARNLL

SEQ ID NO: 748642 - protein, 19 aa, Mycobacterium
VQRVFYGWAQVWRTKAREA

SEQ ID NO: 748643 - protein, 18 aa, Mycobacterium
VQRVFYGWAQVWRTKSRE

SEQ ID NO: 748644 - protein, 19 aa, Mycobacterium
VQRVFYGWAQVWRTKSREA

SEQ ID NO: 748645 - protein, 24 aa, Mycobacterium
VQRVKTWLQFPQWFYNDSPPNTMV

SEQ ID NO: 748646 - protein, 24 aa, Mycobacterium
VQRVKTWLQFPQWFYNNLPVNTMV

SEQ ID NO: 748647 - protein, 20 aa, Mycobacterium
VQRVLALDVELVAGRRGEGL

SEQ ID NO: 748648 - protein, 18 aa, Mycobacterium
VQSCVQMHGGIGVTWEHD

SEQ ID NO: 748649 - protein, 19 aa, Mycobacterium
VQSCVQMHGGIGVTWEHDL

SEQ ID NO: 748650 - protein, 17 aa, Mycobacterium
VQSELGDSIGLLAQGSW

SEQ ID NO: 748651 - protein, 18 aa, Mycobacterium
VQSFAHGLAPYIPNIAGE

SEQ ID NO: 748652 - protein, 25 aa, Mycobacterium
VQSGKYRRVLALAWEKQSESNAMWA

SEQ ID NO: 748653 - protein, 18 aa, Mycobacterium
VQSLIRWDPVGHAEADLA

SEQ ID NO: 748654 - protein, 22 aa, Mycobacterium
VQSLRLYERHGLVTPARSEGGT

SEQ ID NO: 748655 - protein, 26 aa, Mycobacterium
VQSLSMTPLVNWRIPGPELKFEERWM

SEQ ID NO: 748656 - protein, 34 aa, Mycobacterium
VQSLSMTPLVNWRIPGPELKFEERWMPPTHVETP

SEQ ID NO: 748657 - protein, 23 aa, Mycobacterium
VQSLTGRPLIGNGANGTPGTGAD

SEQ ID NO: 748658 - protein, 30 aa, Mycobacterium
VQSMLPPRFQPRASWNANLSILNTIRQFET

SEQ ID NO: 748659 - protein, 25 aa, Mycobacterium
VQSRLLRIGPWFSQNLRCVIDNRRA

SEQ ID NO: 748660 - protein, 24 aa, Mycobacterium
VQSVMRWATRHRVAVVPRGAGSGL

SEQ ID NO: 748661 - protein, 20 aa, Mycobacterium
VQSYAPRRQKHCLMNADGWG

SEQ ID NO: 748662 - protein, 21 aa, Mycobacterium
VQTAKLLGFHWTKRHLDKPGM

SEQ ID NO: 748663 - protein, 24 aa, Mycobacterium
VQTDDFYGLLGIPFVDQPEEHVVT

SEQ ID NO: 748664 - protein, 24 aa, Mycobacterium
VQTELRKGRYPDRKIARKVSEVVR

SEQ ID NO: 748665 - protein, 24 aa, Mycobacterium
VQTFSYRGTKRVCLPGQWHVLHPD

SEQ ID NO: 748666 - protein, 25 aa, Mycobacterium
VQTGFARSGAMFACEHEGIEPDLIC

SEQ ID NO: 748667 - protein, 25 aa, Mycobacterium
VQTGFARTGALFACEHENVVPDLIV

SEQ ID NO: 748668 - protein, 24 aa, Mycobacterium
VQTGFARTGAMFACDHENVEPDLI

SEQ ID NO: 748669 - protein, 25 aa, Mycobacterium
VQTGFARTGAMFACEHEGIDPDLIV

SEQ ID NO: 748670 - protein, 26 aa, Mycobacterium
VQTGFARTGAMFACEHEGPDGLVPDL

SEQ ID NO: 748671 - protein, 26 aa, Mycobacterium
VQTGFARTGAMFACEHEGPNGLEPDL

SEQ ID NO: 748672 - protein, 25 aa, Mycobacterium
VQTGFARTGAMFACEHEGTDGLEPD

SEQ ID NO: 748673 - protein, 24 aa, Mycobacterium
VQTGFGRTGQYFGHQHFGVTPDVL

SEQ ID NO: 748674 - protein, 24 aa, Mycobacterium
VQTGIGRTGAFYAHQHDGITPDVV

SEQ ID NO: 748675 - protein, 24 aa, Mycobacterium
VQTGIGRTGTFFAHQQAGITPDVV

SEQ ID NO: 748676 - protein, 20 aa, Mycobacterium
VQTGMGRTGTFFAHQHDGIT

SEQ ID NO: 748677 - protein, 25 aa, Mycobacterium
VQTGVGRTGAFFAHQHDGIVPDVVT

SEQ ID NO: 748678 - protein, 25 aa, Mycobacterium
VQTGYGRTGKFWGGEHFDAKPDILV

SEQ ID NO: 748679 - protein, 18 aa, Mycobacterium
VQTILRWAGANRVAVVTR

SEQ ID NO: 748680 - protein, 17 aa, Mycobacterium
VQTIWARSVVRDLEDAY

SEQ ID NO: 748681 - protein, 27 aa, Mycobacterium
VQTLIRLGCPRAKVSVLSAGVEVDDAV

SEQ ID NO: 748682 - protein, 22 aa, Mycobacterium
VQTLTGRPLIGNGTPGAAGSGA

SEQ ID NO: 748683 - protein, 24 aa, Mycobacterium
VQTMVRPGLLAWRDVARVMSENPA

SEQ ID NO: 748684 - protein, 25 aa, Mycobacterium
VQTNIEFLRFLLADERVRAGDLDTA

SEQ ID NO: 748685 - protein, 19 aa, Mycobacterium
VQTQFGAGIGRVLAGEIVR

SEQ ID NO: 748686 - protein, 17 aa, Mycobacterium
VQTRAMAMLTRREVEVL

SEQ ID NO: 748687 - protein, 18 aa, Mycobacterium
VQTRVWRGRPDPLRDARA

SEQ ID NO: 748688 - protein, 22 aa, Mycobacterium
VQTVLRWACAHGVPVVTRGAGS

SEQ ID NO: 748689 - protein, 18 aa, Mycobacterium
VQTVLRWATANRVPVVPR

SEQ ID NO: 748690 - protein, 18 aa, Mycobacterium
VQTVLRWATANRVPVVTR

SEQ ID NO: 748691 - protein, 17 aa, Mycobacterium
VQTVRAFIDRDVKPTVR

SEQ ID NO: 748692 - protein, 19 aa, Mycobacterium
VQTVREWLAAEPFRAPEAA

SEQ ID NO: 748693 - protein, 17 aa, Mycobacterium
VQTVWRHIRTEVLGGQY

SEQ ID NO: 748694 - protein, 23 aa, Mycobacterium
VQTYCPPGDVLVEPTFVPRPGGT

SEQ ID NO: 748695 - protein, 26 aa, Mycobacterium
VQVAPRWLFPPFVAVFSPRGVRDVLG

SEQ ID NO: 748696 - protein, 17 aa, Mycobacterium
VQVGLSMLARLVDQAGE

SEQ ID NO: 748697 - protein, 26 aa, Mycobacterium
VQVHPGFRGCLTLELVNLGKMPLAIT

SEQ ID NO: 748698 - protein, 19 aa, Mycobacterium
VQVILADPVIAWRYLDLRG

SEQ ID NO: 748699 - protein, 24 aa, Mycobacterium
VQVIPADPAMAWRYIQLGAEDLDP

SEQ ID NO: 748700 - protein, 18 aa, Mycobacterium
VQVIPAKPVIGWQDVELD

SEQ ID NO: 748701 - protein, 21 aa, Mycobacterium
VQVLAVLAGWGVKLDDVEDRL

SEQ ID NO: 748702 - protein, 25 aa, Mycobacterium
VQVLGFREHASWALASDTLEFVDLE

SEQ ID NO: 748703 - protein, 18 aa, Mycobacterium
VQVLTEFETAFGCPVLEG

SEQ ID NO: 748704 - protein, 22 aa, Mycobacterium
VQVMGGAALHFGNVAEMKTGEG

SEQ ID NO: 748705 - protein, 23 aa, Mycobacterium
VQVMPADPALAWQYVELSSADAD

SEQ ID NO: 748706 - protein, 23 aa, Mycobacterium
VQVPAEHVVPFTAIFTEPTVYGS

SEQ ID NO: 748707 - protein, 26 aa, Mycobacterium
VQVPALMRGYLRLGAKVLGEPAHDPD

SEQ ID NO: 748708 - protein, 18 aa, Mycobacterium
VQVPGFRAAKGFEPVALC

SEQ ID NO: 748709 - protein, 19 aa, Mycobacterium
VQVPLRRGDAVFFNPALYH

SEQ ID NO: 748710 - protein, 17 aa, Mycobacterium
VQVRLVGMLSTRLRLRE

SEQ ID NO: 748711 - protein, 20 aa, Mycobacterium
VQVRNGGLVRVWHGVYGAAQ

SEQ ID NO: 748712 - protein, 17 aa, Mycobacterium
VQVRRGAIPDCMAHWTL

SEQ ID NO: 748713 - protein, 25 aa, Mycobacterium
VQVRTGEWFYLRPVLPGDVERTLNG

SEQ ID NO: 748714 - protein, 17 aa, Mycobacterium
VQVSAPVATLFDLIADP

SEQ ID NO: 748715 - protein, 23 aa, Mycobacterium
VQVSHLMPTFAGRSLTERFGLSA

SEQ ID NO: 748716 - protein, 20 aa, Mycobacterium
VQVSVAMCADVLRAELDIPD

SEQ ID NO: 748717 - protein, 19 aa, Mycobacterium
VQVVDVWTGWSDRRGKVPW

SEQ ID NO: 748718 - protein, 26 aa, Mycobacterium
VQVVGNRPKIGWRRYEAQAVLSRLLN

SEQ ID NO: 748719 - protein, 18 aa, Mycobacterium
VQVYRLDLASGDLGELLH

SEQ ID NO: 748720 - protein, 18 aa, Mycobacterium
VQWAQAAARHGIALDPRF

SEQ ID NO: 748721 - protein, 19 aa, Mycobacterium
VQYAKTWRTLAKLSLPDKY

SEQ ID NO: 748722 - protein, 19 aa, Mycobacterium
VQYAKTWRTLAKLSLPNKY

SEQ ID NO: 748723 - protein, 19 aa, Mycobacterium
VQYGKSWRTIAKLSLPDRF

SEQ ID NO: 748724 - protein, 18 aa, Mycobacterium
VQYHLGKVFTKLGITSRS

SEQ ID NO: 748725 - protein, 17 aa, Mycobacterium
VQYIPIGDVLPGRLSPS

SEQ ID NO: 748726 - protein, 18 aa, Mycobacterium
VQYKALVGAGRMIPRGLL

SEQ ID NO: 748727 - protein, 20 aa, Mycobacterium
VQYLKARYNALVTNPLFASM

SEQ ID NO: 748728 - protein, 27 aa, Mycobacterium
VQYRLPNYYRWLLYEADHAGAYRYHRM

SEQ ID NO: 748729 - protein, 18 aa, Mycobacterium
VQYTCKGANTAPPLAWSA

SEQ ID NO: 748730 - protein, 19 aa, Mycobacterium
VRAAAATMFFGETAESLAA

SEQ ID NO: 748731 - protein, 27 aa, Mycobacterium
VRAAAFHYRFVASLFAGTESYVATEAA

SEQ ID NO: 748732 - protein, 21 aa, Mycobacterium
VRAAEVMALLGPNGAGKTTTV

SEQ ID NO: 748733 - protein, 27 aa, Mycobacterium
VRAAGDAYGWCAQDRILQCAPLTSDIS

SEQ ID NO: 748734 - protein, 18 aa, Mycobacterium
VRAAILALLAERPMHGYE

SEQ ID NO: 748735 - protein, 25 aa, Mycobacterium
VRAAIRSGFRFDAMISRMAVTDTSD

SEQ ID NO: 748736 - protein, 20 aa, Mycobacterium
VRAAMRAIIARYRRHQPILI

SEQ ID NO: 748737 - protein, 24 aa, Mycobacterium
VRAAPRDAPGVLIQEVMVGGPADR

SEQ ID NO: 748738 - protein, 18 aa, Mycobacterium
VRAAQPISAGWSGTEHLD

SEQ ID NO: 748739 - protein, 17 aa, Mycobacterium
VRAARLLADAGLVLYPG

SEQ ID NO: 748740 - protein, 32 aa, Mycobacterium
VRAARLYEVLARPGARHRPAIAATIQGLRDAA

SEQ ID NO: 748741 - protein, 19 aa, Mycobacterium
VRAAVAMTLTSRFPIVLWL

SEQ ID NO: 748742 - protein, 18 aa, Mycobacterium
VRAAVPINAPTAPPKVLW

SEQ ID NO: 748743 - protein, 26 aa, Mycobacterium
VRAAWPDGLPLFFRVSATDWLGGDTD

SEQ ID NO: 748744 - protein, 17 aa, Mycobacterium
VRACARLENAACSARLG

SEQ ID NO: 748745 - protein, 26 aa, Mycobacterium
VRACFRCPLCTEQLRATDDLLLVAGM

SEQ ID NO: 748746 - protein, 24 aa, Mycobacterium
VRACGEIQGTFALTIEGRGFESKV

SEQ ID NO: 748747 - protein, 18 aa, Mycobacterium
VRACRQITEDGAFVCYPG

SEQ ID NO: 748748 - protein, 26 aa, Mycobacterium
VRADAPWCPWNIEFIRRMNGLASVDD

SEQ ID NO: 748749 - protein, 19 aa, Mycobacterium
VRADARLAAAHIVHESRAV

SEQ ID NO: 748750 - protein, 21 aa, Mycobacterium
VRADARLAAAHIVRESRAVIA

SEQ ID NO: 748751 - protein, 18 aa, Mycobacterium
VRADARMAAARTVHECRA

SEQ ID NO: 748752 - protein, 21 aa, Mycobacterium
VRADLPAHVAISGHPNVTVTP

SEQ ID NO: 748753 - protein, 19 aa, Mycobacterium
VRADYWPDSLIRSVAQEYG

SEQ ID NO: 748754 - protein, 17 aa, Mycobacterium
VRAEAGALWDDVVVTSL

SEQ ID NO: 748755 - protein, 25 aa, Mycobacterium
VRAEEEAFVLLALQAPVAGDLRAIV

SEQ ID NO: 748756 - protein, 17 aa, Mycobacterium
VRAEFDHELEVSDLLGG

SEQ ID NO: 748757 - protein, 23 aa, Mycobacterium
VRAEIAAAFSLDGPAAVDLNVAL

SEQ ID NO: 748758 - protein, 18 aa, Mycobacterium
VRAEIGVALSAMKINAVV

SEQ ID NO: 748759 - protein, 17 aa, Mycobacterium
VRAEIIATLSASKIKAT

SEQ ID NO: 748760 - protein, 18 aa, Mycobacterium
VRAEWLAPLLDPVPALVV

SEQ ID NO: 748761 - protein, 27 aa, Mycobacterium
VRAFCIACLNPVVGRDRFDFVVDLGAE

SEQ ID NO: 748762 - protein, 18 aa, Mycobacterium
VRAFLKYQIITVTTPDNA

SEQ ID NO: 748763 - protein, 23 aa, Mycobacterium
VRAFSRHATWWSRLGAPLTSAIQ

SEQ ID NO: 748764 - protein, 29 aa, Mycobacterium
VRAGGGIFWTRLGLLLQFNPWGDTEWTTN

SEQ ID NO: 748765 - protein, 19 aa, Mycobacterium
VRAGLGVSILPSAGLPELP

SEQ ID NO: 748766 - protein, 18 aa, Mycobacterium
VRAGLVINAAGVWAGQVD

SEQ ID NO: 748767 - protein, 17 aa, Mycobacterium
VRAGRGYSFTVPVERPM

SEQ ID NO: 748768 - protein, 23 aa, Mycobacterium
VRAGVEMPARSSSALRILAAHAS

SEQ ID NO: 748769 - protein, 18 aa, Mycobacterium
VRAGVLAYLRYDELHPHG

SEQ ID NO: 748770 - protein, 27 aa, Mycobacterium
VRAHAAWLRIDARFGSVYRRRGDPALV

SEQ ID NO: 748771 - protein, 27 aa, Mycobacterium
VRAHAHAIWLVQCDLDLKASMVELLDI

SEQ ID NO: 748772 - protein, 21 aa, Mycobacterium
VRAHCAPVLGLAKHVDPQSYW

SEQ ID NO: 748773 - protein, 27 aa, Mycobacterium
VRAIRAALPLLRAADWARVVTLSAHSI

SEQ ID NO: 748774 - protein, 19 aa, Mycobacterium
VRAKFELRTKPSIAGRKVG

SEQ ID NO: 748775 - protein, 23 aa, Mycobacterium
VRAKRLDEVAGRFIERHPDAIGL

SEQ ID NO: 748776 - protein, 23 aa, Mycobacterium
VRAKTWKGVRYAAPPLRDLRFRA

SEQ ID NO: 748777 - protein, 18 aa, Mycobacterium
VRAKVRFHGRLVDAFILE

SEQ ID NO: 748778 - protein, 18 aa, Mycobacterium
VRAKYGWTDVARFAALGI

SEQ ID NO: 748779 - protein, 25 aa, Mycobacterium
VRALALRAYQFFRWAVTEDFLVAFG

SEQ ID NO: 748780 - protein, 27 aa, Mycobacterium
VRALDRCLRVAWTLADLGGRDLPAAED

SEQ ID NO: 748781 - protein, 19 aa, Mycobacterium
VRALEAFAYTPALTELDDL

SEQ ID NO: 748782 - protein, 19 aa, Mycobacterium
VRALEAFGRTAAASELTGL

SEQ ID NO: 748783 - protein, 18 aa, Mycobacterium
VRALEAFGRTPAAAELQD

SEQ ID NO: 748784 - protein, 18 aa, Mycobacterium
VRALEAFGRTPAASELQD

SEQ ID NO: 748785 - protein, 20 aa, Mycobacterium
VRALERFLGVRLFNRAPAGL

SEQ ID NO: 748786 - protein, 26 aa, Mycobacterium
VRALFNMCLHRGMQVCRAEMGNASNF

SEQ ID NO: 748787 - protein, 18 aa, Mycobacterium
VRALGLEAFHIFGNSWGG

SEQ ID NO: 748788 - protein, 18 aa, Mycobacterium
VRALLARARELFGPNPVE

SEQ ID NO: 748789 - protein, 18 aa, Mycobacterium
VRALRWDDEIKRWRVGTN

SEQ ID NO: 748790 - protein, 19 aa, Mycobacterium
VRALSGGERLRATLACVLF

SEQ ID NO: 748791 - protein, 19 aa, Mycobacterium
VRALSRVVPMLKPIVPDPG

SEQ ID NO: 748792 - protein, 17 aa, Mycobacterium
VRAMDRLGLLALLTSAL

SEQ ID NO: 748793 - protein, 25 aa, Mycobacterium
VRAMDRPGLLALLAHALERAGADIR

SEQ ID NO: 748794 - protein, 24 aa, Mycobacterium
VRAMRYTLERLIRGLDTIAATGNI

SEQ ID NO: 748795 - protein, 18 aa, Mycobacterium
VRANMIFSADGAAAFGGR

SEQ ID NO: 748796 - protein, 18 aa, Mycobacterium
VRAPWNLPPQPDHAVGSS

SEQ ID NO: 748797 - protein, 24 aa, Mycobacterium
VRAPWREPACVPVVDGRVHLPSWL

SEQ ID NO: 748798 - protein, 18 aa, Mycobacterium
VRAQEIFDYSAYPNEYLM

SEQ ID NO: 748799 - protein, 19 aa, Mycobacterium
VRAQLGITINWRFFSLEEI

SEQ ID NO: 748800 - protein, 17 aa, Mycobacterium
VRAQLLVAMGRPLPEEM

SEQ ID NO: 748801 - protein, 18 aa, Mycobacterium
VRAQLLVAMGRPLPEEMH

SEQ ID NO: 748802 - protein, 20 aa, Mycobacterium
VRAQLRLDAVQSRQHGDGGS

SEQ ID NO: 748803 - protein, 19 aa, Mycobacterium
VRARIEHLRLAEKFDAVLL

SEQ ID NO: 748804 - protein, 27 aa, Mycobacterium
VRARLLHIRDVMFECMERGITRDGFLP

SEQ ID NO: 748805 - protein, 18 aa, Mycobacterium
VRARRLRAAKCQTRNLPL

SEQ ID NO: 748806 - protein, 17 aa, Mycobacterium
VRARRRPLTVAIVGSGP

SEQ ID NO: 748807 - protein, 19 aa, Mycobacterium
VRARSPLARAAREVLSVLG

SEQ ID NO: 748808 - protein, 19 aa, Mycobacterium
VRARVLGIGEGFLTEPWWC

SEQ ID NO: 748809 - protein, 19 aa, Mycobacterium
VRARVVINAAGVWAGQVDP

SEQ ID NO: 748810 - protein, 23 aa, Mycobacterium
VRASDGWIGINCLTGQHWLDVCA

SEQ ID NO: 748811 - protein, 23 aa, Mycobacterium
VRASPRLDAVIFGVGDFSLSQGA

SEQ ID NO: 748812 - protein, 17 aa, Mycobacterium
VRATCVMSTAGVVDPGQ

SEQ ID NO: 748813 - protein, 17 aa, Mycobacterium
VRATLEAARTVVDQNGG

SEQ ID NO: 748814 - protein, 17 aa, Mycobacterium
VRATLEAVRSVVRQSGS

SEQ ID NO: 748815 - protein, 17 aa, Mycobacterium
VRATMALTEPGGGSDLQ

SEQ ID NO: 748816 - protein, 28 aa, Mycobacterium
VRATRPATVVEFGMSFGISAVHLAAAVR

SEQ ID NO: 748817 - protein, 18 aa, Mycobacterium
VRATRPGTVVEFGMSFGI

SEQ ID NO: 748818 - protein, 19 aa, Mycobacterium
VRATVPAMLSNAGREPALK

SEQ ID NO: 748819 - protein, 17 aa, Mycobacterium
VRAVAVFGNPGNRFNTP

SEQ ID NO: 748820 - protein, 23 aa, Mycobacterium
VRAVCQRAGLAARYFYESFGDKD

SEQ ID NO: 748821 - protein, 18 aa, Mycobacterium
VRAVFDVVAPVLVQGADM

SEQ ID NO: 748822 - protein, 17 aa, Mycobacterium
VRAVGVDFFTRWIDGDL

SEQ ID NO: 748823 - protein, 25 aa, Mycobacterium
VRAVGVDFMTRWAAGELDSADVDEP

SEQ ID NO: 748824 - protein, 18 aa, Mycobacterium
VRAVGVEFFTRWVSGDLV

SEQ ID NO: 748825 - protein, 24 aa, Mycobacterium
VRAVGVTFLTRWASGELVASDLDT

SEQ ID NO: 748826 - protein, 19 aa, Mycobacterium
VRAVLKLKSGIDIPSDLRA

SEQ ID NO: 748827 - protein, 20 aa, Mycobacterium
VRAYLEAMWDNRCRARVLSS

SEQ ID NO: 748828 - protein, 21 aa, Mycobacterium
VRCAGMLKPDIVYFGDSVPKD

SEQ ID NO: 748829 - protein, 23 aa, Mycobacterium
VRCAVQFFPSHDVYTWDAATLAG

SEQ ID NO: 748830 - protein, 23 aa, Mycobacterium
VRCGDLQLRPALYDDELTRVDGQ

SEQ ID NO: 748831 - protein, 21 aa, Mycobacterium
VRCGMVPAGVDVIWDNHRHVP

SEQ ID NO: 748832 - protein, 21 aa, Mycobacterium
VRCGMVPAGVDVIWHNHQHVP

SEQ ID NO: 748833 - protein, 18 aa, Mycobacterium
VRCSMWSTDLMQISARVV

SEQ ID NO: 748834 - protein, 17 aa, Mycobacterium
VRDACPQVLVRIGLAPA

SEQ ID NO: 748835 - protein, 24 aa, Mycobacterium
VRDAFKQYGDFVALDHVDFVVPAG

SEQ ID NO: 748836 - protein, 26 aa, Mycobacterium
VRDAFRKGDCWFNTGDVMSPQGMGHA

SEQ ID NO: 748837 - protein, 18 aa, Mycobacterium
VRDALQVMIERTRAVHAD

SEQ ID NO: 748838 - protein, 26 aa, Mycobacterium
VRDAPRIDAVLPMFLEFARGAVLVAH

SEQ ID NO: 748839 - protein, 17 aa, Mycobacterium
VRDAQRAGAPFMSTERA

SEQ ID NO: 748840 - protein, 20 aa, Mycobacterium
VRDARLQIAFYFTVKTYDSL

SEQ ID NO: 748841 - protein, 19 aa, Mycobacterium
VRDCARFFESAELHYRNPK

SEQ ID NO: 748842 - protein, 26 aa, Mycobacterium
VRDDLRIGPHRVWWLSGLAADPAVTA

SEQ ID NO: 748843 - protein, 21 aa, Mycobacterium
VRDDPRSWIAQPMMELSTVPT

SEQ ID NO: 748844 - protein, 19 aa, Mycobacterium
VRDEAQWPLPSTRWTPLYL

SEQ ID NO: 748845 - protein, 17 aa, Mycobacterium
VRDEGRELYAIEGFGVP

SEQ ID NO: 748846 - protein, 24 aa, Mycobacterium
VRDEGRWEVRWSATGLHPRLGEHQ

SEQ ID NO: 748847 - protein, 23 aa, Mycobacterium
VRDELPHSLAVVIDECSEREGRP

SEQ ID NO: 748848 - protein, 22 aa, Mycobacterium
VRDELPHSLAVVIDEVEERPGR

SEQ ID NO: 748849 - protein, 30 aa, Mycobacterium
VRDEVEPLEVLFPGCEFLPLDDQRRRIVDP

SEQ ID NO: 748850 - protein, 25 aa, Mycobacterium
VRDFARASFKYGLNAKWPVYLSTKN

SEQ ID NO: 748851 - protein, 25 aa, Mycobacterium
VRDFARASLAYGLNAKWPVYLSTKN

SEQ ID NO: 748852 - protein, 21 aa, Mycobacterium
VRDFYRFGEIGAVPAFGAHRS

SEQ ID NO: 748853 - protein, 22 aa, Mycobacterium
VRDGAACLVEPHLHRLTHSARL

SEQ ID NO: 748854 - protein, 18 aa, Mycobacterium
VRDGAIAHWREYWDTAHV

SEQ ID NO: 748855 - protein, 25 aa, Mycobacterium
VRDGCSRRVIGWAIDEHMRTDLVEA

SEQ ID NO: 748856 - protein, 19 aa, Mycobacterium
VRDGDVPTSSGWEVTTHGG

SEQ ID NO: 748857 - protein, 19 aa, Mycobacterium
VRDGERVAGVGVRDLDGGR

SEQ ID NO: 748858 - protein, 26 aa, Mycobacterium
VRDGKPEFSRRLAVAFRDHNAEIGAH

SEQ ID NO: 748859 - protein, 20 aa, Mycobacterium
VRDGKVCALWDIANPDKFSG

SEQ ID NO: 748860 - protein, 19 aa, Mycobacterium
VRDGLKPVHRRVLYAMFDS

SEQ ID NO: 748861 - protein, 20 aa, Mycobacterium
VRDGLKPVHRRVLYAMYDSG

SEQ ID NO: 748862 - protein, 20 aa, Mycobacterium
VRDGMLWMRSMGTLKRVDVV

SEQ ID NO: 748863 - protein, 21 aa, Mycobacterium
VRDGRACLIESHLQRLTQSAV

SEQ ID NO: 748864 - protein, 17 aa, Mycobacterium
VRDGRGAVVAAISVSGP

SEQ ID NO: 748865 - protein, 17 aa, Mycobacterium
VRDGSLSLSAWSENDTP

SEQ ID NO: 748866 - protein, 20 aa, Mycobacterium
VRDGVQFCEVCGNVSDKERC

SEQ ID NO: 748867 - protein, 19 aa, Mycobacterium
VRDGVTFCSVCGNVSDEER

SEQ ID NO: 748868 - protein, 19 aa, Mycobacterium
VRDIWRFWYQIPIMLPVIG

SEQ ID NO: 748869 - protein, 19 aa, Mycobacterium
VRDLAFRASPVAQIVVTGE

SEQ ID NO: 748870 - protein, 20 aa, Mycobacterium
VRDLAFRASPVAQIVVTGED

SEQ ID NO: 748871 - protein, 24 aa, Mycobacterium
VRDLAIRAFHAIDCQGLARVDFFL

SEQ ID NO: 748872 - protein, 18 aa, Mycobacterium
VRDLGDFHVGVASFPEGH

SEQ ID NO: 748873 - protein, 23 aa, Mycobacterium
VRDLPYDIAESFRYLGAGERTAS

SEQ ID NO: 748874 - protein, 18 aa, Mycobacterium
VRDNCRRAGPAGGAVVIA

SEQ ID NO: 748875 - protein, 26 aa, Mycobacterium
VRDPEFPDTFWVNPFGMNFRHITVSD

SEQ ID NO: 748876 - protein, 23 aa, Mycobacterium
VRDPRFGHVVTQDFATYHISSHA

SEQ ID NO: 748877 - protein, 18 aa, Mycobacterium
VRDPRWIALAGPAPRIQL

SEQ ID NO: 748878 - protein, 18 aa, Mycobacterium
VRDPRWIALAGRAPRIQV

SEQ ID NO: 748879 - protein, 22 aa, Mycobacterium
VRDRIKVYSWIGGDRPSETAKA

SEQ ID NO: 748880 - protein, 19 aa, Mycobacterium
VRDRIRIARDFTARHRDLH

SEQ ID NO: 748881 - protein, 20 aa, Mycobacterium
VRDRLNPKLAVSGIVITMFD

SEQ ID NO: 748882 - protein, 23 aa, Mycobacterium
VRDRLNPRLDISGILLTRYDPRT

SEQ ID NO: 748883 - protein, 17 aa, Mycobacterium
VRDRVAALVAELGDDAQ

SEQ ID NO: 748884 - protein, 26 aa, Mycobacterium
VRDSGWGRSGPWALQDFTDLVAIAVQ

SEQ ID NO: 748885 - protein, 18 aa, Mycobacterium
VRDSRLHLMVTMRSNDAY

SEQ ID NO: 748886 - protein, 18 aa, Mycobacterium
VRDSRVVTISSLGHRLRA

SEQ ID NO: 748887 - protein, 23 aa, Mycobacterium
VRDVARWLVVYLKRAGGQSQFSV

SEQ ID NO: 748888 - protein, 24 aa, Mycobacterium
VRDVIRFCAEYGIGRAAAALRALD

SEQ ID NO: 748889 - protein, 17 aa, Mycobacterium
VRDVLGLDSDVVEMTPP

SEQ ID NO: 748890 - protein, 17 aa, Mycobacterium
VRDVRFEQMLLLDDETP

SEQ ID NO: 748891 - protein, 24 aa, Mycobacterium
VRDWSAVCIGRMRRGRSIRVEGLG

SEQ ID NO: 748892 - protein, 18 aa, Mycobacterium
VRDYHDAIEWAARQPWST

SEQ ID NO: 748893 - protein, 23 aa, Mycobacterium
VREAIHAVFLYHAIKAGLDMGIV

SEQ ID NO: 748894 - protein, 19 aa, Mycobacterium
VREALRLGHNYVGTEHQLL

SEQ ID NO: 748895 - protein, 22 aa, Mycobacterium
VREARLCRKYGAAVVVMAFDEK

SEQ ID NO: 748896 - protein, 24 aa, Mycobacterium
VREARLCRKYGAAVVVMAFDEQGQ

SEQ ID NO: 748897 - protein, 17 aa, Mycobacterium
VREAVGVVGAITPWNFP

SEQ ID NO: 748898 - protein, 26 aa, Mycobacterium
VREDLAFAESRIRPSTMAAEDLLHDI

SEQ ID NO: 748899 - protein, 25 aa, Mycobacterium
VREEAPPFVKRTFVDGVVLPVIADP

SEQ ID NO: 748900 - protein, 21 aa, Mycobacterium
VREFPDLTVLSGPRVSASQGE

SEQ ID NO: 748901 - protein, 24 aa, Mycobacterium
VREGAVGVHSIFGGAFTVEAQATG

SEQ ID NO: 748902 - protein, 17 aa, Mycobacterium
VREGFSADLARALKDDI

SEQ ID NO: 748903 - protein, 22 aa, Mycobacterium
VREICGLATMRIRPAIGTVAIK

SEQ ID NO: 748904 - protein, 25 aa, Mycobacterium
VREIKRIAKAVGIDEARLGLILEVA

SEQ ID NO: 748905 - protein, 21 aa, Mycobacterium
VREIPAAEFFTGLWETALASD

SEQ ID NO: 748906 - protein, 18 aa, Mycobacterium
VREIPLAEVEKAVVQVEF

SEQ ID NO: 748907 - protein, 29 aa, Mycobacterium
VREIRTMWRQMWELSDECWAQMNTTLMSA

SEQ ID NO: 748908 - protein, 24 aa, Mycobacterium
VREKIRIPLCTNMCVVAFEDFAPA

SEQ ID NO: 748909 - protein, 23 aa, Mycobacterium
VREKVEPLDLVWPHLQFTPLNEA

SEQ ID NO: 748910 - protein, 21 aa, Mycobacterium
VRELARMAVAFANECSVCQNT

SEQ ID NO: 748911 - protein, 19 aa, Mycobacterium
VRELLELTSRLHANLLDRH

SEQ ID NO: 748912 - protein, 19 aa, Mycobacterium
VRELPGLDEASAWLRNNRP

SEQ ID NO: 748913 - protein, 18 aa, Mycobacterium
VRELPTPAAGPVGITATH

SEQ ID NO: 748914 - protein, 25 aa, Mycobacterium
VRELRRRVCEGFLGLRVVPWLWNAP

SEQ ID NO: 748915 - protein, 25 aa, Mycobacterium
VRELSRAYPYCPLALALTDGTELEV

SEQ ID NO: 748916 - protein, 26 aa, Mycobacterium
VREMPHRVAGWCDYNSFFVSEDAVTQ

SEQ ID NO: 748917 - protein, 22 aa, Mycobacterium
VREPAHRVLVVLGFPDIASAGD

SEQ ID NO: 748918 - protein, 27 aa, Mycobacterium
VRERAGAAFQRWIARITARLCDDGVPV

SEQ ID NO: 748919 - protein, 19 aa, Mycobacterium
VRERGVPRYNDFRRMLRLR

SEQ ID NO: 748920 - protein, 20 aa, Mycobacterium
VRERLDWERVRALTADNDYA

SEQ ID NO: 748921 - protein, 18 aa, Mycobacterium
VRERRLDAAPGILIPAFA

SEQ ID NO: 748922 - protein, 23 aa, Mycobacterium
VRERRLDAAPGILLPQLAGYTEK

SEQ ID NO: 748923 - protein, 19 aa, Mycobacterium
VRERVRRAAEIAGRDPGEI

SEQ ID NO: 748924 - protein, 17 aa, Mycobacterium
VRESIGAVAVFKSVDVV

SEQ ID NO: 748925 - protein, 22 aa, Mycobacterium
VRESLRRSLSFNGYTVELAHDG

SEQ ID NO: 748926 - protein, 24 aa, Mycobacterium
VRESMCRSACRIIDGSLPAHRSAE

SEQ ID NO: 748927 - protein, 19 aa, Mycobacterium
VRETMTFKSVPDALAVAAP

SEQ ID NO: 748928 - protein, 23 aa, Mycobacterium
VRETRLALVATGFAYSTVRRERQ

SEQ ID NO: 748929 - protein, 17 aa, Mycobacterium
VREVFVFDGADGAAVTW

SEQ ID NO: 748930 - protein, 24 aa, Mycobacterium
VREVPVGTARPVWIDDADFDITYH

SEQ ID NO: 748931 - protein, 24 aa, Mycobacterium
VREVRIGMARPVWIDDPDFDITYH

SEQ ID NO: 748932 - protein, 22 aa, Mycobacterium
VREVRMPAGRGTFLKLATPLFY

SEQ ID NO: 748933 - protein, 25 aa, Mycobacterium
VREVSLGRSFPLVGVSGGPTTSAVA

SEQ ID NO: 748934 - protein, 27 aa, Mycobacterium
VREVSRLRSRFGFLAIHGGDLEKMTDV

SEQ ID NO: 748935 - protein, 17 aa, Mycobacterium
VREWEKLEQFVEGRLRR

SEQ ID NO: 748936 - protein, 25 aa, Mycobacterium
VREWLTSWSKPGLIPVALVVVNVFV

SEQ ID NO: 748937 - protein, 17 aa, Mycobacterium
VRFARRIDAGMTHVNDS

SEQ ID NO: 748938 - protein, 17 aa, Mycobacterium
VRFAYAVAGPRLTLVEP

SEQ ID NO: 748939 - protein, 17 aa, Mycobacterium
VRFDIAIDLSVPLPGFL

SEQ ID NO: 748940 - protein, 18 aa, Mycobacterium
VRFDLILDLAAPYPTFLV

SEQ ID NO: 748941 - protein, 18 aa, Mycobacterium
VRFDNRLLGSVSHAPHID

SEQ ID NO: 748942 - protein, 17 aa, Mycobacterium
VRFDRYGGREVLYIADV

SEQ ID NO: 748943 - protein, 22 aa, Mycobacterium
VRFEYAGAIPAELRDRYHVARL

SEQ ID NO: 748944 - protein, 18 aa, Mycobacterium
VRFHDWRAPFDAFAHLPN

SEQ ID NO: 748945 - protein, 20 aa, Mycobacterium
VRFIGQRVAAVVADSVAVAE

SEQ ID NO: 748946 - protein, 21 aa, Mycobacterium
VRFKGRSWIQITGRNNYAAFS

SEQ ID NO: 748947 - protein, 19 aa, Mycobacterium
VRFLEAFGRIDVRDEAREV

SEQ ID NO: 748948 - protein, 18 aa, Mycobacterium
VRFLPYGIAVSVLDNDSP

SEQ ID NO: 748949 - protein, 20 aa, Mycobacterium
VRFMQPREFGVAMPALAVLP

SEQ ID NO: 748950 - protein, 17 aa, Mycobacterium
VRFPELKLCMIHGADPW

SEQ ID NO: 748951 - protein, 18 aa, Mycobacterium
VRFPTWTGKSGFAVREFS

SEQ ID NO: 748952 - protein, 19 aa, Mycobacterium
VRFRWAPDSVAIWDNRAVQ

SEQ ID NO: 748953 - protein, 17 aa, Mycobacterium
VRFTSPHPAEFTDDVIE

SEQ ID NO: 748954 - protein, 25 aa, Mycobacterium
VRFTTRAEYAFRHPLVRTVAYEAQL

SEQ ID NO: 748955 - protein, 26 aa, Mycobacterium
VRFYERKEIRDIVAYLRVLTNPGDAV

SEQ ID NO: 748956 - protein, 18 aa, Mycobacterium
VRFYRGGSAPAPAVVYCH

SEQ ID NO: 748957 - protein, 24 aa, Mycobacterium
VRGAHSQLALALWAVQQLFPGATL

SEQ ID NO: 748958 - protein, 27 aa, Mycobacterium
VRGAMGFRLLVDKRKGAALNLFSDTPN

SEQ ID NO: 748959 - protein, 27 aa, Mycobacterium
VRGATYWDPLATLGFLAARTARIRLAT

SEQ ID NO: 748960 - protein, 19 aa, Mycobacterium
VRGCRITAFGLTFKAATSD

SEQ ID NO: 748961 - protein, 17 aa, Mycobacterium
VRGCVWDGNRWADLTTV

SEQ ID NO: 748962 - protein, 25 aa, Mycobacterium
VRGDARSGARLEIADGYHRVCASYI

SEQ ID NO: 748963 - protein, 19 aa, Mycobacterium
VRGDEPWLIGDGWKNTPVV

SEQ ID NO: 748964 - protein, 21 aa, Mycobacterium
VRGDEVYFCDVSARPYDSGLV

SEQ ID NO: 748965 - protein, 26 aa, Mycobacterium
VRGDPRLSAIRAWVALNVGLFDDARI

SEQ ID NO: 748966 - protein, 19 aa, Mycobacterium
VRGEAMMREALAQLEKAAA

SEQ ID NO: 748967 - protein, 24 aa, Mycobacterium
VRGEDRFDMSLSFHHALLDGWSVV

SEQ ID NO: 748968 - protein, 18 aa, Mycobacterium
VRGEFGFLDSCFANAGVR

SEQ ID NO: 748969 - protein, 19 aa, Mycobacterium
VRGEGAGVVVLKRLDDAMR

SEQ ID NO: 748970 - protein, 18 aa, Mycobacterium
VRGFEVLDQVAFSERHLR

SEQ ID NO: 748971 - protein, 18 aa, Mycobacterium
VRGFPVGPGYLIDGKPVI

SEQ ID NO: 748972 - protein, 18 aa, Mycobacterium
VRGGEGFFDRQEIKQALV

SEQ ID NO: 748973 - protein, 18 aa, Mycobacterium
VRGGEGFFNRQEIKQALL

SEQ ID NO: 748974 - protein, 18 aa, Mycobacterium
VRGGEGFFNRQEVKQAMV

SEQ ID NO: 748975 - protein, 18 aa, Mycobacterium
VRGGEGFFSRQEIRQALL

SEQ ID NO: 748976 - protein, 18 aa, Mycobacterium
VRGGEGFFSRQEIRQALV

SEQ ID NO: 748977 - protein, 18 aa, Mycobacterium
VRGGEGFFTRQEVRQALV

SEQ ID NO: 748978 - protein, 20 aa, Mycobacterium
VRGGGFGHALMRSRLDRCDA

SEQ ID NO: 748979 - protein, 21 aa, Mycobacterium
VRGGICVEPVLGSRSYDVMSA

SEQ ID NO: 748980 - protein, 25 aa, Mycobacterium
VRGGICVTPVLGSRSYDVMSAIGPA

SEQ ID NO: 748981 - protein, 17 aa, Mycobacterium
VRGGIPYAIAKSLAAAP

SEQ ID NO: 748982 - protein, 18 aa, Mycobacterium
VRGGLGGFAGLFALRGGY

SEQ ID NO: 748983 - protein, 18 aa, Mycobacterium
VRGGLGGFAGLFALRNDY

SEQ ID NO: 748984 - protein, 20 aa, Mycobacterium
VRGGRLSRQSAWQVLQDAAE

SEQ ID NO: 748985 - protein, 24 aa, Mycobacterium
VRGGRLSRQSAWQVLQDAAERAGI

SEQ ID NO: 748986 - protein, 21 aa, Mycobacterium
VRGGRVRGQRGWIVEKSSEPA

SEQ ID NO: 748987 - protein, 27 aa, Mycobacterium
VRGGVEIRARRAVLTACSPKTTLTRLL

SEQ ID NO: 748988 - protein, 19 aa, Mycobacterium
VRGGVGKLVALSAINADDD

SEQ ID NO: 748989 - protein, 17 aa, Mycobacterium
VRGHGRLAGARRVTVTA

SEQ ID NO: 748990 - protein, 27 aa, Mycobacterium
VRGHIDCWDLKTGEHLWRTYTVPKPGE

SEQ ID NO: 748991 - protein, 17 aa, Mycobacterium
VRGIRRAAPDADVYEST

SEQ ID NO: 748992 - protein, 27 aa, Mycobacterium
VRGKGYPTFCPTGPWLFTTGSDTTFET

SEQ ID NO: 748993 - protein, 17 aa, Mycobacterium
VRGKTCVITDDMIDTGG

SEQ ID NO: 748994 - protein, 25 aa, Mycobacterium
VRGLAREIACAFDLDYVDLADVEPL

SEQ ID NO: 748995 - protein, 19 aa, Mycobacterium
VRGLARLRSVLALVDGGSE

SEQ ID NO: 748996 - protein, 21 aa, Mycobacterium
VRGLLDLLVWAGIEPVGVPMD

SEQ ID NO: 748997 - protein, 23 aa, Mycobacterium
VRGLRFLMRKNKIDEYEAHGTFI

SEQ ID NO: 748998 - protein, 18 aa, Mycobacterium
VRGLVDIDLTDERSLAAA

SEQ ID NO: 748999 - protein, 20 aa, Mycobacterium
VRGPEVVDLLSALNTGHDGG

SEQ ID NO: 749000 - protein, 19 aa, Mycobacterium
VRGPRAEIVLQLRDPGPIT

SEQ ID NO: 749001 - protein, 19 aa, Mycobacterium
VRGPWIAGSYYLTADDAKF

SEQ ID NO: 749002 - protein, 19 aa, Mycobacterium
VRGPWITGGYYLGRDAEKF

SEQ ID NO: 749003 - protein, 30 aa, Mycobacterium
VRGQRFGVCGYCMGGRISLVVAGRLGDRVA

SEQ ID NO: 749004 - protein, 21 aa, Mycobacterium
VRGQSLWRIPGQRARRAVRGL

SEQ ID NO: 749005 - protein, 24 aa, Mycobacterium
VRGRGGMSLGEFWATEGPLSYLGM

SEQ ID NO: 749006 - protein, 24 aa, Mycobacterium
VRGRGLMCAFSLPTAEERDHLVQR

SEQ ID NO: 749007 - protein, 20 aa, Mycobacterium
VRGRLQRGETVLVHGAAGGI

SEQ ID NO: 749008 - protein, 21 aa, Mycobacterium
VRGRRAACEVVRPPFVAVKTR

SEQ ID NO: 749009 - protein, 19 aa, Mycobacterium
VRGRREITPLGTVIVDDAH

SEQ ID NO: 749010 - protein, 18 aa, Mycobacterium
VRGRSMYPPLVGLSKEDL

SEQ ID NO: 749011 - protein, 17 aa, Mycobacterium
VRGRVPVAVSVPVVDVR

SEQ ID NO: 749012 - protein, 17 aa, Mycobacterium
VRGSAVLVRGEQQPDGA

SEQ ID NO: 749013 - protein, 26 aa, Mycobacterium
VRGSDPIELWAWIGAYDHVVLCQLWG

SEQ ID NO: 749014 - protein, 18 aa, Mycobacterium
VRGSERREILVPFVSAIV

SEQ ID NO: 749015 - protein, 19 aa, Mycobacterium
VRGSGGFGRAFMHADDKER

SEQ ID NO: 749016 - protein, 23 aa, Mycobacterium
VRGSRMAVRKGLTMPIYEAELLA

SEQ ID NO: 749017 - protein, 17 aa, Mycobacterium
VRGTRLAIHKTLDLPLH

SEQ ID NO: 749018 - protein, 17 aa, Mycobacterium
VRGTRLAIHKTLDLPLL

SEQ ID NO: 749019 - protein, 17 aa, Mycobacterium
VRGTRLAILKGIDLPLP

SEQ ID NO: 749020 - protein, 18 aa, Mycobacterium
VRGTRLGLAHGHQASGAD

SEQ ID NO: 749021 - protein, 18 aa, Mycobacterium
VRGVAMVATSFDLRDPSV

SEQ ID NO: 749022 - protein, 25 aa, Mycobacterium
VRGVCKHAGVVARYFYENFTDLDQL

SEQ ID NO: 749023 - protein, 25 aa, Mycobacterium
VRGVLERLAELGFDMVQPVTTANET

SEQ ID NO: 749024 - protein, 18 aa, Mycobacterium
VRGVLYFRTKRWPDVLNQ

SEQ ID NO: 749025 - protein, 25 aa, Mycobacterium
VRGVYLMCRQFLPAMTTRGRGDIIN

SEQ ID NO: 749026 - protein, 19 aa, Mycobacterium
VRGWGGVTLDEVWGTQAHA

SEQ ID NO: 749027 - protein, 17 aa, Mycobacterium
VRGWLRRVIRPGVSGEF

SEQ ID NO: 749028 - protein, 23 aa, Mycobacterium
VRGYGDFWSYCLVAEGAVDIAVE

SEQ ID NO: 749029 - protein, 18 aa, Mycobacterium
VRHAEIPLVSDIVLATED

SEQ ID NO: 749030 - protein, 18 aa, Mycobacterium
VRHFARFTKLNVRLAIVA

SEQ ID NO: 749031 - protein, 20 aa, Mycobacterium
VRHFDHLNVIAGFDELARKL

SEQ ID NO: 749032 - protein, 19 aa, Mycobacterium
VRHGLTLGGPIAIEIGNTE

SEQ ID NO: 749033 - protein, 24 aa, Mycobacterium
VRHGPRPPIGLVVLDRAPASIVAA

SEQ ID NO: 749034 - protein, 18 aa, Mycobacterium
VRHICDIPARNAEVTSWP

SEQ ID NO: 749035 - protein, 19 aa, Mycobacterium
VRHILPFVLVNRLAQDRDA

SEQ ID NO: 749036 - protein, 26 aa, Mycobacterium
VRHKVKRVEAMFGESLRSPALITAIH

SEQ ID NO: 749037 - protein, 17 aa, Mycobacterium
VRHLHKVVVDWVEAYRR

SEQ ID NO: 749038 - protein, 18 aa, Mycobacterium
VRHLPTQLVEAFRSTLEE

SEQ ID NO: 749039 - protein, 24 aa, Mycobacterium
VRHLVELSGAPVLRIVASGGGTCV

SEQ ID NO: 749040 - protein, 18 aa, Mycobacterium
VRHNMPFGEVGKGEYGTY

SEQ ID NO: 749041 - protein, 17 aa, Mycobacterium
VRHPGVDKIAFTGSSAV

SEQ ID NO: 749042 - protein, 21 aa, Mycobacterium
VRHQCPFHPQRIAGEVEAVGG

SEQ ID NO: 749043 - protein, 18 aa, Mycobacterium
VRHRIAFLPDYDMSMARL

SEQ ID NO: 749044 - protein, 17 aa, Mycobacterium
VRHRLEITIPGSNTTVT

SEQ ID NO: 749045 - protein, 20 aa, Mycobacterium
VRHRLLAAWIAMLSGDLSGA

SEQ ID NO: 749046 - protein, 23 aa, Mycobacterium
VRHTVLPIARWQYDIVAADGGCR

SEQ ID NO: 749047 - protein, 17 aa, Mycobacterium
VRHTYDWSKVTDKKLLE

SEQ ID NO: 749048 - protein, 19 aa, Mycobacterium
VRHVLGGSVADDLVVVAID

SEQ ID NO: 749049 - protein, 19 aa, Mycobacterium
VRHVRCFSPSCADDAREII

SEQ ID NO: 749050 - protein, 17 aa, Mycobacterium
VRHWKLSPTDLASLDKW

SEQ ID NO: 749051 - protein, 19 aa, Mycobacterium
VRIAAPLALLPPWDDALER

SEQ ID NO: 749052 - protein, 17 aa, Mycobacterium
VRIAGWPTVSIQPADTI

SEQ ID NO: 749053 - protein, 24 aa, Mycobacterium
VRIARADEALPFTAIAADASLVRA

SEQ ID NO: 749054 - protein, 24 aa, Mycobacterium
VRIATEPGDYVFIPPYLPHREENP

SEQ ID NO: 749055 - protein, 26 aa, Mycobacterium
VRIDHIIGMFRLWWIPKGAAPTDGTY

SEQ ID NO: 749056 - protein, 19 aa, Mycobacterium
VRIDLPVALMERAATTGWC

SEQ ID NO: 749057 - protein, 17 aa, Mycobacterium
VRIDRFDVLDIRRPDDF

SEQ ID NO: 749058 - protein, 18 aa, Mycobacterium
VRIESVWADPGRRSEVHR

SEQ ID NO: 749059 - protein, 19 aa, Mycobacterium
VRIEVPATLARYIVEKGSI

SEQ ID NO: 749060 - protein, 19 aa, Mycobacterium
VRIGEHRVLVLVGRIHAYE

SEQ ID NO: 749061 - protein, 26 aa, Mycobacterium
VRIGELMGGPVARWAEETDHNPPRLE

SEQ ID NO: 749062 - protein, 19 aa, Mycobacterium
VRIGKLVKRFQRVLEAMTS

SEQ ID NO: 749063 - protein, 20 aa, Mycobacterium
VRIHGGYGYSCEYDVERYFR

SEQ ID NO: 749064 - protein, 21 aa, Mycobacterium
VRIHGGYGYSTEFDVERYFRD

SEQ ID NO: 749065 - protein, 19 aa, Mycobacterium
VRIHIVWRGDSAISGGSLY

SEQ ID NO: 749066 - protein, 21 aa, Mycobacterium
VRIIEISSFVAVPLAGMTLAQ

SEQ ID NO: 749067 - protein, 24 aa, Mycobacterium
VRIIPELVEHAGFVKVFQDVPRWV

SEQ ID NO: 749068 - protein, 21 aa, Mycobacterium
VRIKNRVEFDFDLPPIQLQAV

SEQ ID NO: 749069 - protein, 18 aa, Mycobacterium
VRIKPWRSGNRKINAALY

SEQ ID NO: 749070 - protein, 18 aa, Mycobacterium
VRILRRFGALDIDDDTGA

SEQ ID NO: 749071 - protein, 17 aa, Mycobacterium
VRINDVPEVLGVRSYAA

SEQ ID NO: 749072 - protein, 19 aa, Mycobacterium
VRIPAAWTHLIGIKPQRGR

SEQ ID NO: 749073 - protein, 17 aa, Mycobacterium
VRIPAAWTHLVGIKPQR

SEQ ID NO: 749074 - protein, 21 aa, Mycobacterium
VRIPVPHCYHCEIAGEGADFV

SEQ ID NO: 749075 - protein, 18 aa, Mycobacterium
VRIQHRSGVQWTLNTAGL

SEQ ID NO: 749076 - protein, 19 aa, Mycobacterium
VRIQVPATVARYVVEKGSI

SEQ ID NO: 749077 - protein, 21 aa, Mycobacterium
VRIRVPVHVMFDGSVPYTGSL

SEQ ID NO: 749078 - protein, 19 aa, Mycobacterium
VRISPRLRDTAALLARRLG

SEQ ID NO: 749079 - protein, 23 aa, Mycobacterium
VRISTSPGDYVFIPPYLPHREEN

SEQ ID NO: 749080 - protein, 20 aa, Mycobacterium
VRITLGIALAKLGMVNPALS

SEQ ID NO: 749081 - protein, 17 aa, Mycobacterium
VRITRRIDLGDTVLHRF

SEQ ID NO: 749082 - protein, 17 aa, Mycobacterium
VRITVGLVTGDVEDVAE

SEQ ID NO: 749083 - protein, 24 aa, Mycobacterium
VRIVDEVKIAFGLNQAVFDELSDN

SEQ ID NO: 749084 - protein, 17 aa, Mycobacterium
VRIVPRDLLAPLPGKAS

SEQ ID NO: 749085 - protein, 17 aa, Mycobacterium
VRIVSWGVAGVAPKIMG

SEQ ID NO: 749086 - protein, 26 aa, Mycobacterium
VRKAAEIEAAFGVRLACPLDEFNAAR

SEQ ID NO: 749087 - protein, 18 aa, Mycobacterium
VRKAIDFVIDLQVGNGEI

SEQ ID NO: 749088 - protein, 19 aa, Mycobacterium
VRKAIDFVIDMQVGNGGIA

SEQ ID NO: 749089 - protein, 21 aa, Mycobacterium
VRKDLDIEAAGEWLARILFSL

SEQ ID NO: 749090 - protein, 31 aa, Mycobacterium
VRKEFKGANPWIMISAFHLKIDGCVGQSFVR

SEQ ID NO: 749091 - protein, 21 aa, Mycobacterium
VRKEKYLAAKALGYELASYIS

SEQ ID NO: 749092 - protein, 24 aa, Mycobacterium
VRKEWGWAKPMWIWAGRTSRSPSS

SEQ ID NO: 749093 - protein, 18 aa, Mycobacterium
VRKFCKQETVVAPRTSVG

SEQ ID NO: 749094 - protein, 23 aa, Mycobacterium
VRKGRPGVVALTYGVLNAVRIVV

SEQ ID NO: 749095 - protein, 25 aa, Mycobacterium
VRKGTMKSQPWILAYEDANVDVGLA

SEQ ID NO: 749096 - protein, 26 aa, Mycobacterium
VRKIVAGLRRWGRRITRTGVVAAPTV

SEQ ID NO: 749097 - protein, 29 aa, Mycobacterium
VRKKAEAALRERFGYDAWVLVYDLETVRA

SEQ ID NO: 749098 - protein, 22 aa, Mycobacterium
VRKKRFEGVVAKKWDSTYQPGR

SEQ ID NO: 749099 - protein, 24 aa, Mycobacterium
VRKLALELGKIGVLGMHLHGYGCS

SEQ ID NO: 749100 - protein, 21 aa, Mycobacterium
VRKPRPIYRVRGGNTSRTPVL

SEQ ID NO: 749101 - protein, 24 aa, Mycobacterium
VRKPVPPLSWWRGIRARKTLEDYF

SEQ ID NO: 749102 - protein, 26 aa, Mycobacterium
VRKQLRADWGEWEAGGAYLGEIPHTV

SEQ ID NO: 749103 - protein, 20 aa, Mycobacterium
VRKQRKTYTAKYVVLAAGTW

SEQ ID NO: 749104 - protein, 26 aa, Mycobacterium
VRKSADLRPARSFAVDYAGWMGLSQE

SEQ ID NO: 749105 - protein, 21 aa, Mycobacterium
VRKSAVLSLSRWVSTEPAVRE

SEQ ID NO: 749106 - protein, 18 aa, Mycobacterium
VRKSIRCGSNGYGLKALE

SEQ ID NO: 749107 - protein, 20 aa, Mycobacterium
VRKSMYVEAGLWRTDVFEAV

SEQ ID NO: 749108 - protein, 25 aa, Mycobacterium
VRKTLSDFAEGAGLKPSDTDDTRSP

SEQ ID NO: 749109 - protein, 18 aa, Mycobacterium
VRKTRGLVVRGWTERDVT

SEQ ID NO: 749110 - protein, 17 aa, Mycobacterium
VRKVMAMDVNRARADDV

SEQ ID NO: 749111 - protein, 22 aa, Mycobacterium
VRKVRHLVGFVFTDPDRQILMP

SEQ ID NO: 749112 - protein, 23 aa, Mycobacterium
VRKWMRRKHVLLEAPQLPGRGWV

SEQ ID NO: 749113 - protein, 17 aa, Mycobacterium
VRLACPLDEFNAARHVS

SEQ ID NO: 749114 - protein, 27 aa, Mycobacterium
VRLAEALKRFGPIFAQYYGQSEAPMVI

SEQ ID NO: 749115 - protein, 20 aa, Mycobacterium
VRLAETWLDGVTPIPAGTTR

SEQ ID NO: 749116 - protein, 19 aa, Mycobacterium
VRLAETWLDGVTPLPAGTT

SEQ ID NO: 749117 - protein, 23 aa, Mycobacterium
VRLAGHYGFAPDFCHASDPKSKG

SEQ ID NO: 749118 - protein, 19 aa, Mycobacterium
VRLAGLVAHQEILFGTEGE

SEQ ID NO: 749119 - protein, 19 aa, Mycobacterium
VRLAKSCAAEGAHGLLVVT

SEQ ID NO: 749120 - protein, 17 aa, Mycobacterium
VRLALATGRLDIRTDAV

SEQ ID NO: 749121 - protein, 21 aa, Mycobacterium
VRLAPVGGVDLGWWTGSRLVV

SEQ ID NO: 749122 - protein, 25 aa, Mycobacterium
VRLARAGMAVAVHYAGNRDRAQQTA

SEQ ID NO: 749123 - protein, 24 aa, Mycobacterium
VRLAREGADIIALDICAPASDCLT

SEQ ID NO: 749124 - protein, 19 aa, Mycobacterium
VRLARGYSYAEEFAGTNGI

SEQ ID NO: 749125 - protein, 22 aa, Mycobacterium
VRLASHYGFAPDFCHASDPQSK

SEQ ID NO: 749126 - protein, 23 aa, Mycobacterium
VRLASHYGFAPDFCHASDPQSKG

SEQ ID NO: 749127 - protein, 17 aa, Mycobacterium
VRLATLLATNAFGQNTA

SEQ ID NO: 749128 - protein, 20 aa, Mycobacterium
VRLDGAVIFDGVKVEAGSVI

SEQ ID NO: 749129 - protein, 21 aa, Mycobacterium
VRLDGDLLYLDRYWREEEQVR

SEQ ID NO: 749130 - protein, 23 aa, Mycobacterium
VRLDGVDAFAGHLVVSYRREALP

SEQ ID NO: 749131 - protein, 20 aa, Mycobacterium
VRLDGYRLQPINTIEVLGLE

SEQ ID NO: 749132 - protein, 18 aa, Mycobacterium
VRLDRMFRVFNNTRYTHI

SEQ ID NO: 749133 - protein, 17 aa, Mycobacterium
VRLDRYWRVDGGQVSET

SEQ ID NO: 749134 - protein, 27 aa, Mycobacterium
VRLEGACNGCSMSAVTLRQLVETALLE

SEQ ID NO: 749135 - protein, 24 aa, Mycobacterium
VRLENCAAEWICAPGASTDRAILY

SEQ ID NO: 749136 - protein, 18 aa, Mycobacterium
VRLGEAFDGQTFVFYDPK

SEQ ID NO: 749137 - protein, 18 aa, Mycobacterium
VRLGEVIRAAGIGEVVES

SEQ ID NO: 749138 - protein, 20 aa, Mycobacterium
VRLGGPRLKDVAGLSLTKLF

SEQ ID NO: 749139 - protein, 21 aa, Mycobacterium
VRLGKVYGNLMVDVRATNGKL

SEQ ID NO: 749140 - protein, 19 aa, Mycobacterium
VRLGLAERLAHHLGAPAVR

SEQ ID NO: 749141 - protein, 17 aa, Mycobacterium
VRLGLDLIIVVFNDNGL

SEQ ID NO: 749142 - protein, 17 aa, Mycobacterium
VRLGLDLIVVVFNDSSL

SEQ ID NO: 749143 - protein, 17 aa, Mycobacterium
VRLGLGAVRHIGDDLAE

SEQ ID NO: 749144 - protein, 19 aa, Mycobacterium
VRLGLGAVRHIGDDLAEQL

SEQ ID NO: 749145 - protein, 21 aa, Mycobacterium
VRLGLVIDGRYHWRAYSLTSD

SEQ ID NO: 749146 - protein, 24 aa, Mycobacterium
VRLGNKRLQVRWMTPVEYARLMGA

SEQ ID NO: 749147 - protein, 19 aa, Mycobacterium
VRLGVKVAGALEAAHRVGT

SEQ ID NO: 749148 - protein, 18 aa, Mycobacterium
VRLHASVNGAVWREVSSS

SEQ ID NO: 749149 - protein, 20 aa, Mycobacterium
VRLHGGPVLAELSERFGAAA

SEQ ID NO: 749150 - protein, 23 aa, Mycobacterium
VRLHPDIRLYCAIPQERSLTAET

SEQ ID NO: 749151 - protein, 29 aa, Mycobacterium
VRLHPEAIAALGIREWDAISLTGSRTTAA

SEQ ID NO: 749152 - protein, 27 aa, Mycobacterium
VRLHPEAIAALGIREWDAVSLTGARTT

SEQ ID NO: 749153 - protein, 26 aa, Mycobacterium
VRLHPEVLAALGIREWDAVALTGTRT

SEQ ID NO: 749154 - protein, 17 aa, Mycobacterium
VRLHPSRRADAQDLFFD

SEQ ID NO: 749155 - protein, 19 aa, Mycobacterium
VRLIALRGAGGYFSAGADL

SEQ ID NO: 749156 - protein, 17 aa, Mycobacterium
VRLIGWLRPGAVIAIRR

SEQ ID NO: 749157 - protein, 17 aa, Mycobacterium
VRLKGADAMREAWQTDG

SEQ ID NO: 749158 - protein, 25 aa, Mycobacterium
VRLKGAEALQDAWRQADIDVTDPSR

SEQ ID NO: 749159 - protein, 21 aa, Mycobacterium
VRLKGAEAMREAWVQDGVDPT

SEQ ID NO: 749160 - protein, 21 aa, Mycobacterium
VRLKGGDPFVFARGYEEVIAC

SEQ ID NO: 749161 - protein, 20 aa, Mycobacterium
VRLKGGDPFVFARGYEEVLA

SEQ ID NO: 749162 - protein, 21 aa, Mycobacterium
VRLKGGDPFVFARGYEEVQAC

SEQ ID NO: 749163 - protein, 17 aa, Mycobacterium
VRLLAPILASKVVAMGK

SEQ ID NO: 749164 - protein, 19 aa, Mycobacterium
VRLLAPIPRPPSIRDSLCF

SEQ ID NO: 749165 - protein, 18 aa, Mycobacterium
VRLLGAALQTLGERPDIQ

SEQ ID NO: 749166 - protein, 23 aa, Mycobacterium
VRLLKAGELVGVYPEATISRSFE

SEQ ID NO: 749167 - protein, 22 aa, Mycobacterium
VRLLKCGPWHQGGWDPIPERCA

SEQ ID NO: 749168 - protein, 18 aa, Mycobacterium
VRLLLNTRVTEIDRATKS

SEQ ID NO: 749169 - protein, 18 aa, Mycobacterium
VRLLNMVPYFQANPKVTR

SEQ ID NO: 749170 - protein, 17 aa, Mycobacterium
VRLLNMVPYFQANPRIT

SEQ ID NO: 749171 - protein, 18 aa, Mycobacterium
VRLLNMVPYFQANPRITR

SEQ ID NO: 749172 - protein, 18 aa, Mycobacterium
VRLLNMVPYFQANPRITY

SEQ ID NO: 749173 - protein, 18 aa, Mycobacterium
VRLLNMVPYFQANPRVTR

SEQ ID NO: 749174 - protein, 18 aa, Mycobacterium
VRLLRHVYNVSGIPRLTS

SEQ ID NO: 749175 - protein, 18 aa, Mycobacterium
VRLLRPGGAIVVHRAALG

SEQ ID NO: 749176 - protein, 18 aa, Mycobacterium
VRLLRSGGAIVVHRAALG

SEQ ID NO: 749177 - protein, 26 aa, Mycobacterium
VRLLSEERLPCAHIPIAASTRESFTV

SEQ ID NO: 749178 - protein, 31 aa, Mycobacterium
VRLLSPILRPALRAVLMVQRRLEGRGPYADP

SEQ ID NO: 749179 - protein, 26 aa, Mycobacterium
VRLLVGHSFGGAAVFSAAHGCPSVAA

SEQ ID NO: 749180 - protein, 17 aa, Mycobacterium
VRLMYRLLHATPFGDYD

SEQ ID NO: 749181 - protein, 26 aa, Mycobacterium
VRLNAALLPAMYTRGAGSIVNVSSTV

SEQ ID NO: 749182 - protein, 19 aa, Mycobacterium
VRLNHAFHRGVNIAAGSPK

SEQ ID NO: 749183 - protein, 19 aa, Mycobacterium
VRLNHAFHRGVNRAAESPK

SEQ ID NO: 749184 - protein, 19 aa, Mycobacterium
VRLPAAFTGIVGHKPTHGL

SEQ ID NO: 749185 - protein, 25 aa, Mycobacterium
VRLPAAPSYRSFVTWLSEQDRGAAQ

SEQ ID NO: 749186 - protein, 26 aa, Mycobacterium
VRLPDALKRFPVTRVVSSPQRRAVQT

SEQ ID NO: 749187 - protein, 17 aa, Mycobacterium
VRLPEDMILGGREKFEE

SEQ ID NO: 749188 - protein, 18 aa, Mycobacterium
VRLPEWRAQIAKDLGRRG

SEQ ID NO: 749189 - protein, 27 aa, Mycobacterium
VRLPGFRPGKAPIRLLEARFGREAMLD

SEQ ID NO: 749190 - protein, 25 aa, Mycobacterium
VRLPQKVGIGLARRMSMTGDYLSAA

SEQ ID NO: 749191 - protein, 25 aa, Mycobacterium
VRLPQKVGVGLARRMSLTGDYLSAQ

SEQ ID NO: 749192 - protein, 25 aa, Mycobacterium
VRLPQKVGVGLARRMSMTGDYLSAA

SEQ ID NO: 749193 - protein, 24 aa, Mycobacterium
VRLPRIPTRFPMYLSAVKRVQIVH

SEQ ID NO: 749194 - protein, 17 aa, Mycobacterium
VRLPRSVHRAAGPCGFA

SEQ ID NO: 749195 - protein, 23 aa, Mycobacterium
VRLPRTEAAHARMFQLPLYPTLT

SEQ ID NO: 749196 - protein, 23 aa, Mycobacterium
VRLPWDYRRVYGVDPDEQSVASA

SEQ ID NO: 749197 - protein, 17 aa, Mycobacterium
VRLQGWEQFDEPVDRIV

SEQ ID NO: 749198 - protein, 23 aa, Mycobacterium
VRLRALERLELEALPRQGTGKGE

SEQ ID NO: 749199 - protein, 25 aa, Mycobacterium
VRLRDAAQWSRIRLADRDHLEPWEP

SEQ ID NO: 749200 - protein, 22 aa, Mycobacterium
VRLRDGLELVLLQANYADGPDE

SEQ ID NO: 749201 - protein, 23 aa, Mycobacterium
VRLREILEVGAARMAAVRTLAAV

SEQ ID NO: 749202 - protein, 24 aa, Mycobacterium
VRLRELADRLGITVRIAHIEGDDL

SEQ ID NO: 749203 - protein, 17 aa, Mycobacterium
VRLRKALELLARRHPSL

SEQ ID NO: 749204 - protein, 20 aa, Mycobacterium
VRLRLPWDPSNVTLGDMVHG

SEQ ID NO: 749205 - protein, 22 aa, Mycobacterium
VRLRPRPHQTFRELLAQTRDGA

SEQ ID NO: 749206 - protein, 20 aa, Mycobacterium
VRLRQEKIAGITVPDLEVDD

SEQ ID NO: 749207 - protein, 19 aa, Mycobacterium
VRLRRLRRLLKWIYHIESR

SEQ ID NO: 749208 - protein, 17 aa, Mycobacterium
VRLSAPNKHHFVYDLSP

SEQ ID NO: 749209 - protein, 19 aa, Mycobacterium
VRLSPGALRGIGRLADVAG

SEQ ID NO: 749210 - protein, 17 aa, Mycobacterium
VRLSRYSYLVSLLPPQI

SEQ ID NO: 749211 - protein, 18 aa, Mycobacterium
VRLSTRLTDSPACLITDA

SEQ ID NO: 749212 - protein, 18 aa, Mycobacterium
VRLSTRLTDSPACLITDT

SEQ ID NO: 749213 - protein, 24 aa, Mycobacterium
VRLTELPAGMPVAVVVRQLTEHVQ

SEQ ID NO: 749214 - protein, 20 aa, Mycobacterium
VRLVAHPKPRVRVTRAAGAM

SEQ ID NO: 749215 - protein, 18 aa, Mycobacterium
VRLVMSNLFGFNAPAIAA

SEQ ID NO: 749216 - protein, 20 aa, Mycobacterium
VRLWEHWGKPEIVWYRGGHT

SEQ ID NO: 749217 - protein, 21 aa, Mycobacterium
VRLWQEIAGLPAERIQRRGME

SEQ ID NO: 749218 - protein, 25 aa, Mycobacterium
VRMFLHHVPGFSFLPNRRPPDPNQI

SEQ ID NO: 749219 - protein, 24 aa, Mycobacterium
VRMFLHHVPGFSFLPNRRPPEPNQ

SEQ ID NO: 749220 - protein, 18 aa, Mycobacterium
VRMIRPVANPALYLYAAI

SEQ ID NO: 749221 - protein, 18 aa, Mycobacterium
VRMLDMRGLYQSFSGDDG

SEQ ID NO: 749222 - protein, 18 aa, Mycobacterium
VRMLDMRGMYRDFTGDEC

SEQ ID NO: 749223 - protein, 21 aa, Mycobacterium
VRMLVVPGSMRVRAQAEAEGL

SEQ ID NO: 749224 - protein, 20 aa, Mycobacterium
VRMPAFGLDGPWRDRVGFAQ

SEQ ID NO: 749225 - protein, 20 aa, Mycobacterium
VRMPGFGLEGPWRDNPAFAY

SEQ ID NO: 749226 - protein, 32 aa, Mycobacterium
VRMPGLESPRAFGLMEVLRWAPIGDQDGATAI

SEQ ID NO: 749227 - protein, 22 aa, Mycobacterium
VRMRDAAAWSRIRLADQHHLEP

SEQ ID NO: 749228 - protein, 17 aa, Mycobacterium
VRMSELAAHPVVRTEYP

SEQ ID NO: 749229 - protein, 19 aa, Mycobacterium
VRMSKRAGTVITLDDLVEA

SEQ ID NO: 749230 - protein, 32 aa, Mycobacterium
VRMTDAWPLRPDARILLCSSVSGVWGGYGHAG

SEQ ID NO: 749231 - protein, 20 aa, Mycobacterium
VRMVGLELVELADDLVAPRG

SEQ ID NO: 749232 - protein, 22 aa, Mycobacterium
VRNCRRLRDGQPLANLVNQPTG

SEQ ID NO: 749233 - protein, 19 aa, Mycobacterium
VRNGIDFKVADLSLAEYGR

SEQ ID NO: 749234 - protein, 22 aa, Mycobacterium
VRNGLEPCIARAKAYAPYSDLI

SEQ ID NO: 749235 - protein, 20 aa, Mycobacterium
VRNGNRWRIYAVDPGNNRVA

SEQ ID NO: 749236 - protein, 20 aa, Mycobacterium
VRNGNRWRVAGIDEKTNRVA

SEQ ID NO: 749237 - protein, 19 aa, Mycobacterium
VRNGNRWRVAGVDETTNRV

SEQ ID NO: 749238 - protein, 21 aa, Mycobacterium
VRNGYRYTVHRVRADGSVIAT

SEQ ID NO: 749239 - protein, 20 aa, Mycobacterium
VRNIWRFWYQIPISLPVIGP

SEQ ID NO: 749240 - protein, 18 aa, Mycobacterium
VRNLASWLQSAPVTMPER

SEQ ID NO: 749241 - protein, 17 aa, Mycobacterium
VRNLPGVHVISPDQLNT

SEQ ID NO: 749242 - protein, 22 aa, Mycobacterium
VRNLRVSLDRVVRDRVSDAMPV

SEQ ID NO: 749243 - protein, 21 aa, Mycobacterium
VRNLWAYVVIFCGHFPDGAEK

SEQ ID NO: 749244 - protein, 38 aa, Mycobacterium
VRNRAGVLALDIRPALRGRLALAWRLDGPVGPAARAFL

SEQ ID NO: 749245 - protein, 24 aa, Mycobacterium
VRNRESFGVLAAHADYLNPASDAE

SEQ ID NO: 749246 - protein, 19 aa, Mycobacterium
VRNRFTFDCAEWDVATEEL

SEQ ID NO: 749247 - protein, 17 aa, Mycobacterium
VRNRFTFDCAEWDVDTE

SEQ ID NO: 749248 - protein, 17 aa, Mycobacterium
VRNRFVLYCEERDARTG

SEQ ID NO: 749249 - protein, 23 aa, Mycobacterium
VRNRPALRTELGRLLRARTTQVW

SEQ ID NO: 749250 - protein, 24 aa, Mycobacterium
VRNRPLLRKAPTWPSERRNPLGKD

SEQ ID NO: 749251 - protein, 17 aa, Mycobacterium
VRNRRTGNNFKINAKFV

SEQ ID NO: 749252 - protein, 18 aa, Mycobacterium
VRNRYDLSSLRLAVHAAA

SEQ ID NO: 749253 - protein, 24 aa, Mycobacterium
VRNWLPEPGVVWLWQPTPATVANA

SEQ ID NO: 749254 - protein, 23 aa, Mycobacterium
VRNWPRRRRVLSKAANTYSRLIL

SEQ ID NO: 749255 - protein, 20 aa, Mycobacterium
VRNWPWRRLALSKTANTYSR

SEQ ID NO: 749256 - protein, 20 aa, Mycobacterium
VRPAFGLMCDQLYGRIVLAS

SEQ ID NO: 749257 - protein, 23 aa, Mycobacterium
VRPALAKWRVDRGLPGDPMAAYA

SEQ ID NO: 749258 - protein, 19 aa, Mycobacterium
VRPARRFAKALARAAGGVA

SEQ ID NO: 749259 - protein, 23 aa, Mycobacterium
VRPDELHLGFNFKLVEADFDADQ

SEQ ID NO: 749260 - protein, 24 aa, Mycobacterium
VRPDELHLGFNFRLTRTEFDATEI

SEQ ID NO: 749261 - protein, 21 aa, Mycobacterium
VRPDGSGRWRADFAEVEPDPV

SEQ ID NO: 749262 - protein, 19 aa, Mycobacterium
VRPDLVLKGGAIAWAAMGD

SEQ ID NO: 749263 - protein, 30 aa, Mycobacterium
VRPDRSVTLALRWLVSFSKARREKTMIERL

SEQ ID NO: 749264 - protein, 17 aa, Mycobacterium
VRPEQRGAGLGKALLSA

SEQ ID NO: 749265 - protein, 17 aa, Mycobacterium
VRPGCAVAVRLDAGHSR

SEQ ID NO: 749266 - protein, 19 aa, Mycobacterium
VRPGCAVAVRLDAGHSRET

SEQ ID NO: 749267 - protein, 21 aa, Mycobacterium
VRPGEVHGFLGPNGAGKSTTI

SEQ ID NO: 749268 - protein, 18 aa, Mycobacterium
VRPGFDFAGFNRLADEME

SEQ ID NO: 749269 - protein, 20 aa, Mycobacterium
VRPGLLTWRDIARVMSERPA

SEQ ID NO: 749270 - protein, 23 aa, Mycobacterium
VRPGPPPTVWSERWRQRWAPATP

SEQ ID NO: 749271 - protein, 22 aa, Mycobacterium
VRPGPPPTVWSERWRQRWSPPT

SEQ ID NO: 749272 - protein, 18 aa, Mycobacterium
VRPGRGWPGDPATSRTAV

SEQ ID NO: 749273 - protein, 21 aa, Mycobacterium
VRPGRTVRARIEHLRLAEKFD

SEQ ID NO: 749274 - protein, 26 aa, Mycobacterium
VRPGTDAWCLAALAAVLVQENLCDEE

SEQ ID NO: 749275 - protein, 20 aa, Mycobacterium
VRPGVDVLFLDTGYHFAETI

SEQ ID NO: 749276 - protein, 20 aa, Mycobacterium
VRPGVDVLFLDTGYHFVETI

SEQ ID NO: 749277 - protein, 20 aa, Mycobacterium
VRPGVPVVFLDTGYHFAETI

SEQ ID NO: 749278 - protein, 21 aa, Mycobacterium
VRPGYNFADADAALAYGNGIC

SEQ ID NO: 749279 - protein, 25 aa, Mycobacterium
VRPIAPGLYSWLPLGLRVLRNIERV

SEQ ID NO: 749280 - protein, 22 aa, Mycobacterium
VRPIGFEPLTWVRALAAEDPIP

SEQ ID NO: 749281 - protein, 20 aa, Mycobacterium
VRPIVRYLFDRPMLPRINAI

SEQ ID NO: 749282 - protein, 18 aa, Mycobacterium
VRPKAALDKSDFDELAKA

SEQ ID NO: 749283 - protein, 19 aa, Mycobacterium
VRPLAHVPHIRGCDYWNIR

SEQ ID NO: 749284 - protein, 18 aa, Mycobacterium
VRPLGLDRYGVRFRIESN

SEQ ID NO: 749285 - protein, 21 aa, Mycobacterium
VRPLINVTYPPPTVQLTLTGG

SEQ ID NO: 749286 - protein, 33 aa, Mycobacterium
VRPLRARAALARRYLAVEGHRVLAHLAATLPLA

SEQ ID NO: 749287 - protein, 17 aa, Mycobacterium
VRPPELRRRGAARERAA

SEQ ID NO: 749288 - protein, 21 aa, Mycobacterium
VRPPGRVGRRGVATFSVPAVT

SEQ ID NO: 749289 - protein, 26 aa, Mycobacterium
VRPPKGCPVSGVARTYRGRPLIQLSA

SEQ ID NO: 749290 - protein, 20 aa, Mycobacterium
VRPPRQVPGASYWYAHADQW

SEQ ID NO: 749291 - protein, 17 aa, Mycobacterium
VRPPVGWIPQRDGRVAL

SEQ ID NO: 749292 - protein, 18 aa, Mycobacterium
VRPQFRRRGLARKLLATL

SEQ ID NO: 749293 - protein, 22 aa, Mycobacterium
VRPQLPAAWGRVALTDLRLGSA

SEQ ID NO: 749294 - protein, 20 aa, Mycobacterium
VRPRGIIYHRALGARFADLL

SEQ ID NO: 749295 - protein, 20 aa, Mycobacterium
VRPRRGAPLITEAAVIATGA

SEQ ID NO: 749296 - protein, 17 aa, Mycobacterium
VRPRVWFGEQWITSILD

SEQ ID NO: 749297 - protein, 17 aa, Mycobacterium
VRPRVWFGEQWITSVLD

SEQ ID NO: 749298 - protein, 21 aa, Mycobacterium
VRPSDEYRYLVIASPAGAYFP

SEQ ID NO: 749299 - protein, 22 aa, Mycobacterium
VRPSNEYRYLLIASPAGAYFKG

SEQ ID NO: 749300 - protein, 17 aa, Mycobacterium
VRPSTDLLLQHKHPEDR

SEQ ID NO: 749301 - protein, 21 aa, Mycobacterium
VRPTGAVLHRPATPGVPTASG

SEQ ID NO: 749302 - protein, 20 aa, Mycobacterium
VRPTHFAGMLTVVLKLFNII

SEQ ID NO: 749303 - protein, 17 aa, Mycobacterium
VRPTVWGAVPRVWEKLK

SEQ ID NO: 749304 - protein, 17 aa, Mycobacterium
VRPTVWGGVPRVWEKLR

SEQ ID NO: 749305 - protein, 21 aa, Mycobacterium
VRPVGFSPLTWVRALTAEEPV

SEQ ID NO: 749306 - protein, 27 aa, Mycobacterium
VRPVTAFTLRLAQAMHRRAHRCRVMAF

SEQ ID NO: 749307 - protein, 18 aa, Mycobacterium
VRPVTPPLVHDFHLPPSG

SEQ ID NO: 749308 - protein, 19 aa, Mycobacterium
VRPVTPPLVHDFHLPPSGG

SEQ ID NO: 749309 - protein, 18 aa, Mycobacterium
VRPVVGVVTFISRGTDDD

SEQ ID NO: 749310 - protein, 25 aa, Mycobacterium
VRPWPPELLAAFAAMGTEIFETMFG

SEQ ID NO: 749311 - protein, 22 aa, Mycobacterium
VRPYSGAVCQYVLSRKTQPEPG

SEQ ID NO: 749312 - protein, 17 aa, Mycobacterium
VRQACVNPARALGLPAA

SEQ ID NO: 749313 - protein, 25 aa, Mycobacterium
VRQAFPVMCRAGYGRIVLTSSIGGL

SEQ ID NO: 749314 - protein, 26 aa, Mycobacterium
VRQAHFPKMHDWLVSYVVKKNPHAEK

SEQ ID NO: 749315 - protein, 20 aa, Mycobacterium
VRQALARGAARVYATARRPH

SEQ ID NO: 749316 - protein, 23 aa, Mycobacterium
VRQALRMRPDRIVIGEVRGPEVV

SEQ ID NO: 749317 - protein, 19 aa, Mycobacterium
VRQFVKMSVFLPDRLAFPI

SEQ ID NO: 749318 - protein, 19 aa, Mycobacterium
VRQGKRFELEFDGEISDSD

SEQ ID NO: 749319 - protein, 17 aa, Mycobacterium
VRQGSAFAVPKVLRSGR

SEQ ID NO: 749320 - protein, 20 aa, Mycobacterium
VRQHIGMVFQHFNLFPHMTV

SEQ ID NO: 749321 - protein, 19 aa, Mycobacterium
VRQIPYTIACDMLLTGRHI

SEQ ID NO: 749322 - protein, 22 aa, Mycobacterium
VRQIPYTVACDILLTGRHISAA

SEQ ID NO: 749323 - protein, 20 aa, Mycobacterium
VRQIPYTVACDLLLTGRHIT

SEQ ID NO: 749324 - protein, 23 aa, Mycobacterium
VRQIPYTVACDLLLTGRHITAAE

SEQ ID NO: 749325 - protein, 19 aa, Mycobacterium
VRQIPYTVACDLLMTGRHI

SEQ ID NO: 749326 - protein, 22 aa, Mycobacterium
VRQLAIRAFEAIDCQGLARVDF

SEQ ID NO: 749327 - protein, 23 aa, Mycobacterium
VRQLHDWAAPAYEIAQTFADIGG

SEQ ID NO: 749328 - protein, 25 aa, Mycobacterium
VRQLIELSGAPALRLVASGGGTRVQ

SEQ ID NO: 749329 - protein, 27 aa, Mycobacterium
VRQLRLRDVGGIVVIDFIDMVLESNRD

SEQ ID NO: 749330 - protein, 25 aa, Mycobacterium
VRQMIADRELETWLVVDMSASLDFG

SEQ ID NO: 749331 - protein, 20 aa, Mycobacterium
VRQPGVLDFLTYVVTSAAAG

SEQ ID NO: 749332 - protein, 23 aa, Mycobacterium
VRQPRPGAPLVVRIDHPRDEAEH

SEQ ID NO: 749333 - protein, 19 aa, Mycobacterium
VRQRPGWRRRLIDDTGSVP

SEQ ID NO: 749334 - protein, 21 aa, Mycobacterium
VRQRVPFFVDYVRRFTDLPFL

SEQ ID NO: 749335 - protein, 17 aa, Mycobacterium
VRQSCSYTAELFERPDV

SEQ ID NO: 749336 - protein, 20 aa, Mycobacterium
VRQSGRPWPLDRYVTEALEA

SEQ ID NO: 749337 - protein, 19 aa, Mycobacterium
VRQVCARTLGLPALPAEVV

SEQ ID NO: 749338 - protein, 26 aa, Mycobacterium
VRQVILPLWNAWSFLQLYAPKPGTWR

SEQ ID NO: 749339 - protein, 33 aa, Mycobacterium
VRQVLRLRPAPEFEAWLTGLGMADANGRILPID

SEQ ID NO: 749340 - protein, 25 aa, Mycobacterium
VRQVPRLRHIARFGAGYDGIDPVAL

SEQ ID NO: 749341 - protein, 21 aa, Mycobacterium
VRQWIEAEVPAAWRSAAAKDA

SEQ ID NO: 749342 - protein, 25 aa, Mycobacterium
VRRAEAIRLGDYCLGLYGARDYLAE

SEQ ID NO: 749343 - protein, 18 aa, Mycobacterium
VRRAISRTFNRAGYTVRG

SEQ ID NO: 749344 - protein, 21 aa, Mycobacterium
VRRAKAVGALVVLDACQSVPH

SEQ ID NO: 749345 - protein, 26 aa, Mycobacterium
VRRAPRTRFAGVAYRACDEVDVLRLA

SEQ ID NO: 749346 - protein, 21 aa, Mycobacterium
VRRAQPGWQPRALEPALSTML

SEQ ID NO: 749347 - protein, 19 aa, Mycobacterium
VRRASRMLVAGAALRVPLI

SEQ ID NO: 749348 - protein, 33 aa, Mycobacterium; identical to SEQ ID NO: 211997

SEQ ID NO: 749349 - protein, 25 aa, Mycobacterium
VRRDELPTRVLLLSAHDDAAIVYRA

SEQ ID NO: 749350 - protein, 24 aa, Mycobacterium
VRRDPRVAVTIADPGKVGKVMRPY

SEQ ID NO: 749351 - protein, 20 aa, Mycobacterium
VRREAFRLFELNGYAQTTVD

SEQ ID NO: 749352 - protein, 27 aa, Mycobacterium
VRRENRRGWGLPGTFLHPGERLSDAVK

SEQ ID NO: 749353 - protein, 23 aa, Mycobacterium
VRRFARERSRWLFSNPDMIHLSI

SEQ ID NO: 749354 - protein, 23 aa, Mycobacterium
VRRFARERSRWLFSNPDMVHLSI

SEQ ID NO: 749355 - protein, 24 aa, Mycobacterium
VRRFNEAFSPYGFKPEAIKPSYGL

SEQ ID NO: 749356 - protein, 27 aa, Mycobacterium
VRRGAIPDCMAHWTLARLTTLGVAADM

SEQ ID NO: 749357 - protein, 17 aa, Mycobacterium
VRRGDYLYNFWRDAANP

SEQ ID NO: 749358 - protein, 21 aa, Mycobacterium
VRRGEGVVVPQVFFTQSGEVV

SEQ ID NO: 749359 - protein, 17 aa, Mycobacterium
VRRGIDLDVIFQAYRRG

SEQ ID NO: 749360 - protein, 17 aa, Mycobacterium
VRRGRRNRFTGAAFRAF

SEQ ID NO: 749361 - protein, 23 aa, Mycobacterium
VRRHKVDAAILFSDIVVPLKAAG

SEQ ID NO: 749362 - protein, 23 aa, Mycobacterium
VRRHLRLPGSFVVSIGCETGRPE

SEQ ID NO: 749363 - protein, 19 aa, Mycobacterium
VRRIIPLAASMKHKKFFGE

SEQ ID NO: 749364 - protein, 19 aa, Mycobacterium
VRRIPMSPKALLAVGRISD

SEQ ID NO: 749365 - protein, 24 aa, Mycobacterium
VRRITKSIALFVARWCGVEDTAAR

SEQ ID NO: 749366 - protein, 27 aa, Mycobacterium
VRRKAEAALRERFGYDAWVLAYDIGTV

SEQ ID NO: 749367 - protein, 40 aa, Mycobacterium
VRRLARLHTPLPLLAFTAWPEVRSQLAMTWGTETFIVPEM

SEQ ID NO: 749368 - protein, 40 aa, Mycobacterium; identical to SEQ ID NO: 210324

SEQ ID NO: 749369 - protein, 25 aa, Mycobacterium
VRRLARLRGATILAHNYQLPAIQDV

SEQ ID NO: 749370 - protein, 18 aa, Mycobacterium
VRRLCDKHGALLVIDEMI

SEQ ID NO: 749371 - protein, 18 aa, Mycobacterium
VRRLERLPNLAVDDLQLP

SEQ ID NO: 749372 - protein, 26 aa, Mycobacterium
VRRLGHVPLAIAMAASYFRNADEDVA

SEQ ID NO: 749373 - protein, 18 aa, Mycobacterium
VRRLPAAALRTITGLGAL

SEQ ID NO: 749374 - protein, 19 aa, Mycobacterium
VRRLPRLRDAGVTPEQAFA

SEQ ID NO: 749375 - protein, 26 aa, Mycobacterium
VRRMMKGNPIPLPWLQPEDVSRAVVY

SEQ ID NO: 749376 - protein, 18 aa, Mycobacterium
VRRMMPRMPRDVLDDMVS

SEQ ID NO: 749377 - protein, 18 aa, Mycobacterium
VRRMRRLTISFHVTVANY

SEQ ID NO: 749378 - protein, 18 aa, Mycobacterium
VRRMRRLTLSFHVTVANY

SEQ ID NO: 749379 - protein, 17 aa, Mycobacterium
VRRMRRLTVSFHVTVAN

SEQ ID NO: 749380 - protein, 19 aa, Mycobacterium
VRRMRRLTVSFHVTVANYE

SEQ ID NO: 749381 - protein, 20 aa, Mycobacterium
VRRNHCGELEFVGRADEQVK

SEQ ID NO: 749382 - protein, 22 aa, Mycobacterium
VRRRAEEGWVRAGSVDAAAVDD

SEQ ID NO: 749383 - protein, 21 aa, Mycobacterium
VRRRCEDVGRDPATLETSTLT

SEQ ID NO: 749384 - protein, 21 aa, Mycobacterium
VRRRFELVGAVGSVRVFDDYA

SEQ ID NO: 749385 - protein, 27 aa, Mycobacterium
VRRRGQARVAGFLLEWEEKPYEWISGR

SEQ ID NO: 749386 - protein, 29 aa, Mycobacterium
VRRRGVTVLHMVPSLLGSVLLLPEARELR

SEQ ID NO: 749387 - protein, 23 aa, Mycobacterium
VRRRIRASWLQRGAAEAELGWVD

SEQ ID NO: 749388 - protein, 23 aa, Mycobacterium
VRRRLRKSWLERGASDAELSWIA

SEQ ID NO: 749389 - protein, 23 aa, Mycobacterium
VRRRMTLSLADDAVFEALVMRKR

SEQ ID NO: 749390 - protein, 27 aa, Mycobacterium
VRRRNLPIMFPLEVRFGAPDDAFLSTA

SEQ ID NO: 749391 - protein, 24 aa, Mycobacterium
VRRRRKTFTAEHVILAAGTYGTQK

SEQ ID NO: 749392 - protein, 23 aa, Mycobacterium
VRRRTGRTVQEWIIERRMAQARE

SEQ ID NO: 749393 - protein, 20 aa, Mycobacterium
VRRRVIRLWLLAGGAQDLND

SEQ ID NO: 749394 - protein, 24 aa, Mycobacterium
VRRRWTRLGQQVFRAVAELPQTTV

SEQ ID NO: 749395 - protein, 17 aa, Mycobacterium
VRRRYWMVIPRELRQVG

SEQ ID NO: 749396 - protein, 21 aa, Mycobacterium
VRRSCQAHGGFYLGSIGGPAA

SEQ ID NO: 749397 - protein, 17 aa, Mycobacterium
VRRSGVIDPERVLAVET

SEQ ID NO: 749398 - protein, 23 aa, Mycobacterium
VRRSNALLDWAYGRRFQYTEHMS

SEQ ID NO: 749399 - protein, 18 aa, Mycobacterium
VRRSSCGATFEALSDNAR

SEQ ID NO: 749400 - protein, 19 aa, Mycobacterium
VRRSTVYGGDLVRIDPSTG

SEQ ID NO: 749401 - protein, 25 aa, Mycobacterium
VRRSYRTPLFLARLAAAARVYERGF

SEQ ID NO: 749402 - protein, 21 aa, Mycobacterium
VRRVHRSGSYVLPMPEGKDVK

SEQ ID NO: 749403 - protein, 21 aa, Mycobacterium
VRRVKGGWISTGQPWSYDEPR

SEQ ID NO: 749404 - protein, 17 aa, Mycobacterium
VRRVLGLDAEARAARPV

SEQ ID NO: 749405 - protein, 19 aa, Mycobacterium
VRRVPEVLGQFPVSCLAEE

SEQ ID NO: 749406 - protein, 17 aa, Mycobacterium
VRRVPLFGLGCVAGAAG

SEQ ID NO: 749407 - protein, 24 aa, Mycobacterium
VRRWAVAHPAQWALLYGSPVPGYH

SEQ ID NO: 749408 - protein, 18 aa, Mycobacterium
VRRWWVAAELAMARGDGE

SEQ ID NO: 749409 - protein, 18 aa, Mycobacterium
VRRYGMVSPTVFWPIPRV

SEQ ID NO: 749410 - protein, 18 aa, Mycobacterium
VRSAELWFHHRGSPLLLE

SEQ ID NO: 749411 - protein, 20 aa, Mycobacterium
VRSAELWLYHSGGPLHLEVG

SEQ ID NO: 749412 - protein, 23 aa, Mycobacterium
VRSALCALGELLVGVAEQDSAEN

SEQ ID NO: 749413 - protein, 19 aa, Mycobacterium
VRSDAKLKRLVPLVKELIA

SEQ ID NO: 749414 - protein, 17 aa, Mycobacterium
VRSDLAAGWLAVTRDPR

SEQ ID NO: 749415 - protein, 19 aa, Mycobacterium
VRSEGAGVVVLKRLSDAVR

SEQ ID NO: 749416 - protein, 22 aa, Mycobacterium
VRSEGCAMLVLKRLPDAVRDGD

SEQ ID NO: 749417 - protein, 19 aa, Mycobacterium
VRSEGCAVVLLKRLRDALR

SEQ ID NO: 749418 - protein, 17 aa, Mycobacterium
VRSEVTEVGRILGYTPY

SEQ ID NO: 749419 - protein, 22 aa, Mycobacterium
VRSGAGTRFVAPVNVGDGAYTG

SEQ ID NO: 749420 - protein, 25 aa, Mycobacterium
VRSGLPFGTCLDAIYLHPCGSAEFR

SEQ ID NO: 749421 - protein, 24 aa, Mycobacterium
VRSGLPFGTCLDATYLHPNGAAEF

SEQ ID NO: 749422 - protein, 25 aa, Mycobacterium
VRSGLPFGTCLDTAYLHPCGSDEFK

SEQ ID NO: 749423 - protein, 25 aa, Mycobacterium
VRSGLPFGTCLTASYLHPCGTDEFK

SEQ ID NO: 749424 - protein, 18 aa, Mycobacterium
VRSGNIFRDGSIPYQRFR

SEQ ID NO: 749425 - protein, 18 aa, Mycobacterium
VRSGNVFRDGTIPYQRFR

SEQ ID NO: 749426 - protein, 17 aa, Mycobacterium
VRSGWDDLVLAGGVESM

SEQ ID NO: 749427 - protein, 20 aa, Mycobacterium
VRSHRLRNNFSWINNYYDDM

SEQ ID NO: 749428 - protein, 18 aa, Mycobacterium
VRSHRLRNNFSWTNSYYD

SEQ ID NO: 749429 - protein, 23 aa, Mycobacterium
VRSHRLRNNFSWTNSYYDDMAWL

SEQ ID NO: 749430 - protein, 23 aa, Mycobacterium
VRSKVKAVLVQKGFLDQDYTAPA

SEQ ID NO: 749431 - protein, 23 aa, Mycobacterium
VRSLLRRRSDAIRQRCTTYQQWR

SEQ ID NO: 749432 - protein, 25 aa, Mycobacterium
VRSLVWIRGRLHPVPADMIGATLDL

SEQ ID NO: 749433 - protein, 22 aa, Mycobacterium
VRSLVWIRGRLQHVPNGEVADL

SEQ ID NO: 749434 - protein, 19 aa, Mycobacterium
VRSMDRPGLLALLTRALER

SEQ ID NO: 749435 - protein, 18 aa, Mycobacterium
VRSMLSFQLFTFGENLGA

SEQ ID NO: 749436 - protein, 24 aa, Mycobacterium
VRSMRYTLERLIRGLDTIAATGNI

SEQ ID NO: 749437 - protein, 20 aa, Mycobacterium
VRSNFLGLFGPAIAAAEAQY

SEQ ID NO: 749438 - protein, 25 aa, Mycobacterium
VRSNPRLQLALAWANIVLHRVPAAR

SEQ ID NO: 749439 - protein, 21 aa, Mycobacterium
VRSPCGAQRRLALSTVGVPRV

SEQ ID NO: 749440 - protein, 20 aa, Mycobacterium
VRSPEVAAAYMVTRRLFKVD

SEQ ID NO: 749441 - protein, 25 aa, Mycobacterium
VRSPRLLYRVPNMRSTYRVVPLDVG

SEQ ID NO: 749442 - protein, 29 aa, Mycobacterium
VRSPRRLGRRGPLHVVDWQNVRGLTPSAL

SEQ ID NO: 749443 - protein, 22 aa, Mycobacterium
VRSPWRGIHSLAVLGGNGGVGK

SEQ ID NO: 749444 - protein, 22 aa, Mycobacterium
VRSQSWDLVRDGIFVGYQLDRV

SEQ ID NO: 749445 - protein, 21 aa, Mycobacterium
VRSRRAGETASIFLPSVPNLL

SEQ ID NO: 749446 - protein, 18 aa, Mycobacterium
VRSRRIAGVMADVKAKAR

SEQ ID NO: 749447 - protein, 24 aa, Mycobacterium
VRSRRPGETASIFLPSVPNLLQLA

SEQ ID NO: 749448 - protein, 24 aa, Mycobacterium
VRSRRPGETASIFLPSVPSLLQLA

SEQ ID NO: 749449 - protein, 19 aa, Mycobacterium
VRSRRSWGIGDLTDLTDLA

SEQ ID NO: 749450 - protein, 23 aa, Mycobacterium
VRSRSDLLSALPDRLRDRVIQLQ

SEQ ID NO: 749451 - protein, 17 aa, Mycobacterium
VRSRSLQKIGLRAAGLV

SEQ ID NO: 749452 - protein, 19 aa, Mycobacterium
VRSRVRAMVDFMATRTAFF

SEQ ID NO: 749453 - protein, 17 aa, Mycobacterium
VRSSMTLFAQAAAGADD

SEQ ID NO: 749454 - protein, 26 aa, Mycobacterium
VRSSPEMIDWLSSYGVPFSPALCPYK

SEQ ID NO: 749455 - protein, 20 aa, Mycobacterium
VRSTRGWSAAPVRHGVSAVR

SEQ ID NO: 749456 - protein, 23 aa, Mycobacterium
VRSVGMPAWLSYTIDGARTRAGQ

SEQ ID NO: 749457 - protein, 18 aa, Mycobacterium
VRSVLTCTSATGVCAMCY

SEQ ID NO: 749458 - protein, 18 aa, Mycobacterium
VRSVLTCTTGTGVCAMCY

SEQ ID NO: 749459 - protein, 24 aa, Mycobacterium
VRSVPRTGASLGRALAAAGVPVED

SEQ ID NO: 749460 - protein, 26 aa, Mycobacterium
VRSVRYRIPMILAIIGGNPMRFEPYV

SEQ ID NO: 749461 - protein, 20 aa, Mycobacterium
VRSWRRARHLPAASSSATDD

SEQ ID NO: 749462 - protein, 19 aa, Mycobacterium
VRSYCRGWPAVMETAKDSW

SEQ ID NO: 749463 - protein, 23 aa, Mycobacterium
VRSYKLRGAYNLLMQLTPEEKAA

SEQ ID NO: 749464 - protein, 23 aa, Mycobacterium
VRSYKLRGAYNLLVQLSDEELAA

SEQ ID NO: 749465 - protein, 23 aa, Mycobacterium
VRSYKLRGAYNLLVQLSETELAA

SEQ ID NO: 749466 - protein, 23 aa, Mycobacterium
VRSYKLRGAYNLLVQLTAEELAA

SEQ ID NO: 749467 - protein, 20 aa, Mycobacterium
VRSYKLRGAYNLLVQLTDED

SEQ ID NO: 749468 - protein, 26 aa, Mycobacterium
VRSYNCLKREGVHTVGELVARTESDL

SEQ ID NO: 749469 - protein, 18 aa, Mycobacterium
VRSYSGGMRRRLDLAVSL

SEQ ID NO: 749470 - protein, 21 aa, Mycobacterium
VRTAAGIGFPGWDPTTSYLIA

SEQ ID NO: 749471 - protein, 25 aa, Mycobacterium
VRTAARLAGSAARRARVDGRPLFAA

SEQ ID NO: 749472 - protein, 19 aa, Mycobacterium
VRTAFYYVRAGTTVVPDEL

SEQ ID NO: 749473 - protein, 17 aa, Mycobacterium
VRTAFYYVRSGITVVPD

SEQ ID NO: 749474 - protein, 17 aa, Mycobacterium
VRTAMGGVQARRLCPRA

SEQ ID NO: 749475 - protein, 17 aa, Mycobacterium
VRTARQRLAAYITPIPV

SEQ ID NO: 749476 - protein, 18 aa, Mycobacterium
VRTAVLLFDEVVVVAHEP

SEQ ID NO: 749477 - protein, 20 aa, Mycobacterium
VRTAWMSVHPQFDGNRITGY

SEQ ID NO: 749478 - protein, 33 aa, Mycobacterium; identical to SEQ ID NO: 12677

SEQ ID NO: 749479 - protein, 34 aa, Mycobacterium
VRTCDCFNIPIIMLVDVPGFLPGTGQEYNGIIRR

SEQ ID NO: 749480 - protein, 29 aa, Mycobacterium
VRTCDCFNIPIVMFVDVPGFLPGTDQEYN

SEQ ID NO: 749481 - protein, 33 aa, Mycobacterium
VRTCDCFNIPIVMLVDVPGFLPGTGQEYNGIIR

SEQ ID NO: 749482 - protein, 24 aa, Mycobacterium
VRTCGRSCGGRVRFLTDPVPAPTC

SEQ ID NO: 749483 - protein, 18 aa, Mycobacterium
VRTCIGCRKRELAADLLR

SEQ ID NO: 749484 - protein, 19 aa, Mycobacterium
VRTDLRRAPNLGFDIDVEH

SEQ ID NO: 749485 - protein, 21 aa, Mycobacterium
VRTDPRIAPLRAPDLSALPPA

SEQ ID NO: 749486 - protein, 21 aa, Mycobacterium
VRTEFHARAGIDMAGTPSFMW

SEQ ID NO: 749487 - protein, 32 aa, Mycobacterium
VRTEFHARAGIDMAKSPSFLWLEVDDVVNQSL

SEQ ID NO: 749488 - protein, 19 aa, Mycobacterium
VRTELPFQTIMTGYGLTEA

SEQ ID NO: 749489 - protein, 20 aa, Mycobacterium
VRTELPFQTLMTGYGLTEAG

SEQ ID NO: 749490 - protein, 18 aa, Mycobacterium
VRTELRRAPRLGYSIDFE

SEQ ID NO: 749491 - protein, 24 aa, Mycobacterium
VRTFARRRIDAILAGVPAAASPDD

SEQ ID NO: 749492 - protein, 24 aa, Mycobacterium
VRTFARRRIDTILAGVEPVDDASR

SEQ ID NO: 749493 - protein, 18 aa, Mycobacterium
VRTFQGLCTTEFPNCFIE

SEQ ID NO: 749494 - protein, 23 aa, Mycobacterium
VRTGCAAPTLAALREQVARTLDV

SEQ ID NO: 749495 - protein, 25 aa, Mycobacterium
VRTGDPVVRCRAVLLTVDHQAANEI

SEQ ID NO: 749496 - protein, 27 aa, Mycobacterium
VRTGMAVYDWMCWRMNKKAEDRQRREL

SEQ ID NO: 749497 - protein, 27 aa, Mycobacterium
VRTGMSVYDWMCWRMNKKAEDRQRREL

SEQ ID NO: 749498 - protein, 20 aa, Mycobacterium
VRTGVRIIIVGGQFDVLTAL

SEQ ID NO: 749499 - protein, 24 aa, Mycobacterium
VRTHGDRLLVRFDGVADRDAADAL

SEQ ID NO: 749500 - protein, 24 aa, Mycobacterium
VRTHGPRNAFPLAVPGYGSPARRF

SEQ ID NO: 749501 - protein, 24 aa, Mycobacterium
VRTIARAALFLADRTGERTVLDDD

SEQ ID NO: 749502 - protein, 36 aa, Mycobacterium
VRTIELRQGLKVGAPEEIAWRAGFIDDDQLATRAKE

SEQ ID NO: 749503 - protein, 19 aa, Mycobacterium
VRTILRSGCYLTHDDGLYA

SEQ ID NO: 749504 - protein, 18 aa, Mycobacterium
VRTLADMNCKVLLEIGPQ

SEQ ID NO: 749505 - protein, 21 aa, Mycobacterium
VRTLADMNCRVLLEIGPRPVL

SEQ ID NO: 749506 - protein, 19 aa, Mycobacterium
VRTLWLGQMYHYDSITMAA

SEQ ID NO: 749507 - protein, 18 aa, Mycobacterium
VRTPFGLFPDVSPGTIVD

SEQ ID NO: 749508 - protein, 18 aa, Mycobacterium
VRTPLPVTLPEPMAAQLA

SEQ ID NO: 749509 - protein, 19 aa, Mycobacterium
VRTPSAFLFDEPLSNLDAK

SEQ ID NO: 749510 - protein, 17 aa, Mycobacterium
VRTRFFDDFFLNAARDG

SEQ ID NO: 749511 - protein, 23 aa, Mycobacterium
VRTRLIELFELFDPADPEVIAGR

SEQ ID NO: 749512 - protein, 26 aa, Mycobacterium
VRTRRALCGELLLRAEPDGDLFRVTM

SEQ ID NO: 749513 - protein, 18 aa, Mycobacterium
VRTRRSAEDFPRSEHLAW

SEQ ID NO: 749514 - protein, 19 aa, Mycobacterium
VRTSARYGVDAHIDKVRWP

SEQ ID NO: 749515 - protein, 19 aa, Mycobacterium
VRTSLFANIEGLRDADRRY

SEQ ID NO: 749516 - protein, 18 aa, Mycobacterium
VRTVEEWLAAEPFRAPEA

SEQ ID NO: 749517 - protein, 19 aa, Mycobacterium
VRTVVRFSHPMFGEAVRRR

SEQ ID NO: 749518 - protein, 24 aa, Mycobacterium
VRTYILECALRWMRDFHADGLRLD

SEQ ID NO: 749519 - protein, 20 aa, Mycobacterium
VRVAAAIACHNGDSGQAAAL

SEQ ID NO: 749520 - protein, 20 aa, Mycobacterium
VRVAEGLGCKAIRVTEPDQI

SEQ ID NO: 749521 - protein, 20 aa, Mycobacterium
VRVALIDGQWVAFPTVEQLE

SEQ ID NO: 749522 - protein, 22 aa, Mycobacterium
VRVAPMRPFRALGRGKRIASDF

SEQ ID NO: 749523 - protein, 20 aa, Mycobacterium
VRVASWPGLLSTTTIFGVRE

SEQ ID NO: 749524 - protein, 17 aa, Mycobacterium
VRVDGNDVLACYAVTAE

SEQ ID NO: 749525 - protein, 18 aa, Mycobacterium
VRVDRQTLTLGYAGVYSS

SEQ ID NO: 749526 - protein, 17 aa, Mycobacterium
VRVDSWEGLVFVNLDPE

SEQ ID NO: 749527 - protein, 17 aa, Mycobacterium
VRVEVVVDDAAVDKVVD

SEQ ID NO: 749528 - protein, 24 aa, Mycobacterium
VRVFYECYRNHDAFQAHEAAPHTR

SEQ ID NO: 749529 - protein, 19 aa, Mycobacterium
VRVGAKLRARAEISAVAQL

SEQ ID NO: 749530 - protein, 19 aa, Mycobacterium
VRVGLPIVDLLTGMFAAVG

SEQ ID NO: 749531 - protein, 19 aa, Mycobacterium
VRVGRDVPGFIGNRLQHAL

SEQ ID NO: 749532 - protein, 20 aa, Mycobacterium
VRVGVPFPVAALEVMRYACG

SEQ ID NO: 749533 - protein, 32 aa, Mycobacterium
VRVHLRPNHAFRLPGGHVPIIMIGPGTGIAPF

SEQ ID NO: 749534 - protein, 21 aa, Mycobacterium
VRVIRDFFRRLPASVDVGTRV

SEQ ID NO: 749535 - protein, 20 aa, Mycobacterium
VRVIRDFLRHLPVEVDIETR

SEQ ID NO: 749536 - protein, 18 aa, Mycobacterium
VRVIRRWGPARIGYLLSI

SEQ ID NO: 749537 - protein, 20 aa, Mycobacterium
VRVLAGPVSVIGRLTIPDRP

SEQ ID NO: 749538 - protein, 18 aa, Mycobacterium
VRVLKPGGRFVFAGEPTT

SEQ ID NO: 749539 - protein, 18 aa, Mycobacterium
VRVLLRAGLRDGVTAARA

SEQ ID NO: 749540 - protein, 23 aa, Mycobacterium
VRVLPWQECPGAIGSASRIRGMT

SEQ ID NO: 749541 - protein, 22 aa, Mycobacterium
VRVLRASALVGLASEAVGIGSR

SEQ ID NO: 749542 - protein, 23 aa, Mycobacterium
VRVLRPGGRFVFAGEPTTVGDTY

SEQ ID NO: 749543 - protein, 23 aa, Mycobacterium
VRVLRRAVELGVNFIDTADSYGP

SEQ ID NO: 749544 - protein, 24 aa, Mycobacterium
VRVLRRAVELGVNFIDTADSYGPY

SEQ ID NO: 749545 - protein, 19 aa, Mycobacterium
VRVLTRLPQRSVVTLATNV

SEQ ID NO: 749546 - protein, 17 aa, Mycobacterium
VRVLVVGTPEWSELIGR

SEQ ID NO: 749547 - protein, 17 aa, Mycobacterium
VRVNFGLLRWVIAAPQY

SEQ ID NO: 749548 - protein, 22 aa, Mycobacterium
VRVPDARIQLIAVDDVSTQVAH

SEQ ID NO: 749549 - protein, 20 aa, Mycobacterium
VRVPHGFAITAEAYRHMLDS

SEQ ID NO: 749550 - protein, 20 aa, Mycobacterium
VRVPIRWLADMRAMSTDPRL

SEQ ID NO: 749551 - protein, 21 aa, Mycobacterium
VRVPKDALWRAQTQRAVENFP

SEQ ID NO: 749552 - protein, 19 aa, Mycobacterium
VRVPKVFWEYTTERVLTME

SEQ ID NO: 749553 - protein, 17 aa, Mycobacterium
VRVPLGFLADWMNYAHT

SEQ ID NO: 749554 - protein, 28 aa, Mycobacterium
VRVPRSVEALGRIDVVCFDKTGTLSQNR

SEQ ID NO: 749555 - protein, 17 aa, Mycobacterium
VRVPVHFSIAEHEKVWQ

SEQ ID NO: 749556 - protein, 18 aa, Mycobacterium
VRVPVRFTLGRHDNVFRS

SEQ ID NO: 749557 - protein, 24 aa, Mycobacterium
VRVPWPATAGFGYVKLKSAESSWP

SEQ ID NO: 749558 - protein, 18 aa, Mycobacterium
VRVQRLISYRGFSEQDAR

SEQ ID NO: 749559 - protein, 17 aa, Mycobacterium
VRVQRQVDEFFGVEEAD

SEQ ID NO: 749560 - protein, 26 aa, Mycobacterium
VRVRALPSWLRLDARFGSVYRHRADL

SEQ ID NO: 749561 - protein, 19 aa, Mycobacterium
VRVRDGTGLVGPLVIPSVT

SEQ ID NO: 749562 - protein, 20 aa, Mycobacterium
VRVRDGVGLVGPLVIPGTTS

SEQ ID NO: 749563 - protein, 22 aa, Mycobacterium
VRVREVAAFIPGAMRGLVSEKQ

SEQ ID NO: 749564 - protein, 21 aa, Mycobacterium
VRVRGAIDFLRLEARCDTFLL

SEQ ID NO: 749565 - protein, 18 aa, Mycobacterium
VRVRLAAQGWPFDDADQA

SEQ ID NO: 749566 - protein, 23 aa, Mycobacterium
VRVRRVPEFGGCTSWVQLPIAPS

SEQ ID NO: 749567 - protein, 24 aa, Mycobacterium
VRVSLPSAVARYVVEKGSITVDGV

SEQ ID NO: 749568 - protein, 19 aa, Mycobacterium
VRVSRDFAASLERIGWPVE

SEQ ID NO: 749569 - protein, 18 aa, Mycobacterium
VRVTEMFNYATYPDRAAV

SEQ ID NO: 749570 - protein, 24 aa, Mycobacterium
VRVTRPGGTLGLISWTPEGFIGHL

SEQ ID NO: 749571 - protein, 18 aa, Mycobacterium
VRVTVIAAGFDAGGPSRK

SEQ ID NO: 749572 - protein, 20 aa, Mycobacterium
VRVTVIAAGFDSAGPSRKPV

SEQ ID NO: 749573 - protein, 18 aa, Mycobacterium
VRVTVIAAGFSAAGPGRR

SEQ ID NO: 749574 - protein, 22 aa, Mycobacterium
VRVVDLRWLAPLPVDDMAREAA

SEQ ID NO: 749575 - protein, 19 aa, Mycobacterium
VRVYHELNRLWPAERAYAA

SEQ ID NO: 749576 - protein, 19 aa, Mycobacterium
VRVYQRFATLDGISNGRAE

SEQ ID NO: 749577 - protein, 18 aa, Mycobacterium
VRVYRPAGPAPLPALVFA

SEQ ID NO: 749578 - protein, 20 aa, Mycobacterium
VRWELPAAVVERRIRAVTPN

SEQ ID NO: 749579 - protein, 17 aa, Mycobacterium
VRWLTIWNDTVDAMYRG

SEQ ID NO: 749580 - protein, 22 aa, Mycobacterium
VRWMGSGPLTGLAEIQLPDLQP

SEQ ID NO: 749581 - protein, 24 aa, Mycobacterium
VRWNCKAGKCGSCSAEINGKPRLM

SEQ ID NO: 749582 - protein, 25 aa, Mycobacterium
VRWNCKAGKCGSCSAEINGVPRLLC

SEQ ID NO: 749583 - protein, 25 aa, Mycobacterium
VRWNCKAGKCGSCSAEINGYPKLMC

SEQ ID NO: 749584 - protein, 25 aa, Mycobacterium
VRWNCKAGKCGSCSAEINGYPRLLC

SEQ ID NO: 749585 - protein, 23 aa, Mycobacterium
VRWPEQLRPALSTVGFATELRDL

SEQ ID NO: 749586 - protein, 19 aa, Mycobacterium
VRWRADGQLDYLGRADEQV

SEQ ID NO: 749587 - protein, 20 aa, Mycobacterium
VRWRPWRSYATQHLWTALDH

SEQ ID NO: 749588 - protein, 18 aa, Mycobacterium
VRWRSGRRWAPSFRFPEG

SEQ ID NO: 749589 - protein, 21 aa, Mycobacterium
VRWSADGQLEYIGRADEQVKI

SEQ ID NO: 749590 - protein, 17 aa, Mycobacterium
VRYGELISHERDLDLRA

SEQ ID NO: 749591 - protein, 17 aa, Mycobacterium
VRYGELLSHERVLDLRA

SEQ ID NO: 749592 - protein, 17 aa, Mycobacterium
VRYICARLENPDAEPDR

SEQ ID NO: 749593 - protein, 23 aa, Mycobacterium
VRYIDRFLMFYIRTADRLQRTAP

SEQ ID NO: 749594 - protein, 23 aa, Mycobacterium
VRYIDRFLMYYIRTADRLQRTAP

SEQ ID NO: 749595 - protein, 17 aa, Mycobacterium
VRYLPNFSAAAEQVAAV

SEQ ID NO: 749596 - protein, 17 aa, Mycobacterium
VRYNLPYRRRRPKGPPS

SEQ ID NO: 749597 - protein, 21 aa, Mycobacterium
VRYPALAEWGIPTAQALTEVR

SEQ ID NO: 749598 - protein, 18 aa, Mycobacterium
VRYPELWRDNGGFDAEGV

SEQ ID NO: 749599 - protein, 18 aa, Mycobacterium
VRYPELWRDNGSFDAQAV

SEQ ID NO: 749600 - protein, 17 aa, Mycobacterium
VRYPPAQAHTILRREPP

SEQ ID NO: 749601 - protein, 20 aa, Mycobacterium
VRYPSLEAFIALMSSEQVQA

SEQ ID NO: 749602 - protein, 21 aa, Mycobacterium
VRYPYARGVLVEMYREAKARI

SEQ ID NO: 749603 - protein, 24 aa, Mycobacterium
VRYPYARGVLVEMYREAKARLGDP

SEQ ID NO: 749604 - protein, 21 aa, Mycobacterium
VRYPYARGVLVEMYREAKGRL

SEQ ID NO: 749605 - protein, 25 aa, Mycobacterium
VRYPYARGVLVEMYREARARLGDPV

SEQ ID NO: 749606 - protein, 17 aa, Mycobacterium
VRYRAFDLFEPGRPRMH

SEQ ID NO: 749607 - protein, 26 aa, Mycobacterium
VRYRLRRLKQLTGRDVARPRDIAELH

SEQ ID NO: 749608 - protein, 22 aa, Mycobacterium
VRYRTGGVIEFVGRVDHRVKIS

SEQ ID NO: 749609 - protein, 18 aa, Mycobacterium
VRYTELRPFVLHMNHTGP

SEQ ID NO: 749610 - protein, 26 aa, Mycobacterium
VRYTGVSNFSGWQLMKSLSLAERHGR

SEQ ID NO: 749611 - protein, 20 aa, Mycobacterium
VRYTRDAGALAILPAALSCR

SEQ ID NO: 749612 - protein, 21 aa, Mycobacterium
VRYVDRFVMYYIRTADRLQRT

SEQ ID NO: 749613 - protein, 19 aa, Mycobacterium
VRYYADLLRGYQFSEDLGD

SEQ ID NO: 749614 - protein, 18 aa, Mycobacterium
VSAAGGFGLLPAGYRTIT

SEQ ID NO: 749615 - protein, 20 aa, Mycobacterium
VSAAIAALFGAHAQEYQAAA

SEQ ID NO: 749616 - protein, 19 aa, Mycobacterium
VSAAIAALFSENAQTYQAI

SEQ ID NO: 749617 - protein, 21 aa, Mycobacterium
VSAAIAHLFGAYGQEFQALNG

SEQ ID NO: 749618 - protein, 20 aa, Mycobacterium
VSAAIASLFGSYAQEFQQLT

SEQ ID NO: 749619 - protein, 19 aa, Mycobacterium
VSAAIATLFNTYAEEYQQL

SEQ ID NO: 749620 - protein, 25 aa, Mycobacterium
VSAAISGLFNAYGREFQALSAQAAT

SEQ ID NO: 749621 - protein, 22 aa, Mycobacterium
VSAALAAVFSGHALDYQALSAQ

SEQ ID NO: 749622 - protein, 18 aa, Mycobacterium
VSAALGWNLVPHTIVRDG

SEQ ID NO: 749623 - protein, 18 aa, Mycobacterium
VSAALGWNVVPYTIIRDG

SEQ ID NO: 749624 - protein, 20 aa, Mycobacterium
VSAALKRTATSMATAADIYS

SEQ ID NO: 749625 - protein, 17 aa, Mycobacterium
VSAALVKRGLEPDRLSW

SEQ ID NO: 749626 - protein, 24 aa, Mycobacterium
VSAAVAALFSGHALDYQALSTQVA

SEQ ID NO: 749627 - protein, 21 aa, Mycobacterium
VSAAVATLFSSYGQAYQSLSA

SEQ ID NO: 749628 - protein, 18 aa, Mycobacterium
VSAAYRLQEIVYDDSPVH

SEQ ID NO: 749629 - protein, 17 aa, Mycobacterium
VSACGHPAPSEPSTTLS

SEQ ID NO: 749630 - protein, 19 aa, Mycobacterium
VSACGLGRIRGVRTAVRVR

SEQ ID NO: 749631 - protein, 19 aa, Mycobacterium
VSACVPALIHAAANDDAFR

SEQ ID NO: 749632 - protein, 25 aa, Mycobacterium
VSADAALGLLRRHKIEKLPIVDGHG

SEQ ID NO: 749633 - protein, 24 aa, Mycobacterium
VSADAALGLLRRNKIEKLPVVDGH

SEQ ID NO: 749634 - protein, 20 aa, Mycobacterium
VSADAFCWSMVRSLVGAVLA

SEQ ID NO: 749635 - protein, 19 aa, Mycobacterium
VSADARMTPGSVVTEQVAG

SEQ ID NO: 749636 - protein, 22 aa, Mycobacterium
VSADELRGRFGFYFDKFDVRPE

SEQ ID NO: 749637 - protein, 17 aa, Mycobacterium
VSADFEAAGLLLSAADA

SEQ ID NO: 749638 - protein, 29 aa, Mycobacterium
VSADRIGAALRWFGLDGVEHPASADAADL

SEQ ID NO: 749639 - protein, 31 aa, Mycobacterium
VSADRWKLGQLRAGDTVRFIRIEASRSASLR

SEQ ID NO: 749640 - protein, 28 aa, Mycobacterium
VSAEAATLYDMFVRTLGVSAGTYAAAET

SEQ ID NO: 749641 - protein, 18 aa, Mycobacterium
VSAECVRKDLAQLEARGL

SEQ ID NO: 749642 - protein, 23 aa, Mycobacterium
VSAEFAHVFSALGVHVTIVVRGD

SEQ ID NO: 749643 - protein, 17 aa, Mycobacterium
VSAEFGMTGKICLTPDQ

SEQ ID NO: 749644 - protein, 28 aa, Mycobacterium
VSAELPRTVTFKVLKRQLAAQGLECDDP

SEQ ID NO: 749645 - protein, 20 aa, Mycobacterium
VSAEQAFRVLQWRSQETNTK

SEQ ID NO: 749646 - protein, 23 aa, Mycobacterium
VSAEVLRRFGFEHPMGPDWNGFH

SEQ ID NO: 749647 - protein, 24 aa, Mycobacterium
VSAFSRPAIWWSKLGGPVVSVAQR

SEQ ID NO: 749648 - protein, 24 aa, Mycobacterium
VSAGCAGFGYALGVAADMIRGGTA

SEQ ID NO: 749649 - protein, 17 aa, Mycobacterium
VSAGGRGLAGLTPAGEA

SEQ ID NO: 749650 - protein, 20 aa, Mycobacterium
VSAGIAALFGAHGQAYQELS

SEQ ID NO: 749651 - protein, 18 aa, Mycobacterium
VSAGLSWQDTALLRAYGR

SEQ ID NO: 749652 - protein, 17 aa, Mycobacterium
VSAGPLREWLHKQRTGR

SEQ ID NO: 749653 - protein, 18 aa, Mycobacterium
VSAGSILRNLDPERFEVV

SEQ ID NO: 749654 - protein, 20 aa, Mycobacterium
VSAGVAALFSAYAQAYQKLG

SEQ ID NO: 749655 - protein, 21 aa, Mycobacterium
VSAGVPLRLISVLKTAHSSPE

SEQ ID NO: 749656 - protein, 20 aa, Mycobacterium
VSAIRTKLFAAVRESGVVST

SEQ ID NO: 749657 - protein, 20 aa, Mycobacterium
VSAIRVGDRVVVPFQISCGT

SEQ ID NO: 749658 - protein, 21 aa, Mycobacterium
VSAKGEFLGGAIAPGLQVSSD

SEQ ID NO: 749659 - protein, 19 aa, Mycobacterium
VSAKGEFLGGAIAPGVQVS

SEQ ID NO: 749660 - protein, 21 aa, Mycobacterium
VSAKGEFLGGAIAPGVQVSSD

SEQ ID NO: 749661 - protein, 25 aa, Mycobacterium
VSALAEYRGAVLVASHDLGFLEDIG

SEQ ID NO: 749662 - protein, 19 aa, Mycobacterium
VSALAREVVYDRLLFEPTF

SEQ ID NO: 749663 - protein, 18 aa, Mycobacterium
VSALEPMGMLALGVPYGE

SEQ ID NO: 749664 - protein, 20 aa, Mycobacterium
VSALFDAVGVVLNVPEQQLD

SEQ ID NO: 749665 - protein, 18 aa, Mycobacterium
VSALGWREHLARIMAEPD

SEQ ID NO: 749666 - protein, 18 aa, Mycobacterium
VSALGYLAACTDRVQLAS

SEQ ID NO: 749667 - protein, 18 aa, Mycobacterium
VSALKAGELVVMPTDTVY

SEQ ID NO: 749668 - protein, 27 aa, Mycobacterium
VSALKALEGDAEWGKTVADLMDAVDES

SEQ ID NO: 749669 - protein, 25 aa, Mycobacterium
VSALKALEGDEKWVKSVQELMAAVD

SEQ ID NO: 749670 - protein, 29 aa, Mycobacterium
VSALKALEGDPKWVKSVEELMEAVDASIP

SEQ ID NO: 749671 - protein, 32 aa, Mycobacterium
VSALLAAQGFRVIVPYARGFGSTRFLSKDTLR

SEQ ID NO: 749672 - protein, 17 aa, Mycobacterium
VSALLFVTARQVAADQH

SEQ ID NO: 749673 - protein, 19 aa, Mycobacterium
VSALLVRVGDRGVAPDQLE

SEQ ID NO: 749674 - protein, 19 aa, Mycobacterium
VSALNRPVSTTGEAGNQNT

SEQ ID NO: 749675 - protein, 20 aa, Mycobacterium
VSALRAGDCDVALTGGVCVL

SEQ ID NO: 749676 - protein, 28 aa, Mycobacterium
VSALRANHPLFRRRRFFNGKPVGRRGEA

SEQ ID NO: 749677 - protein, 24 aa, Mycobacterium
VSALRRPVAMMARMTLRKAPAKVV

SEQ ID NO: 749678 - protein, 21 aa, Mycobacterium
VSALTAAQFAAHAQMYQAVSA

SEQ ID NO: 749679 - protein, 22 aa, Mycobacterium
VSALTAAQFAAHAQMYQAVSAQ

SEQ ID NO: 749680 - protein, 31 aa, Mycobacterium
VSALVVFEVMVRPLIRLSLGKRQAMRRIVPA

SEQ ID NO: 749681 - protein, 30 aa, Mycobacterium
VSALVVFEVMVRPLIRLSLGKRQPMRRIVQ

SEQ ID NO: 749682 - protein, 17 aa, Mycobacterium
VSAMKEFLVQFVQDELL

SEQ ID NO: 749683 - protein, 22 aa, Mycobacterium
VSANAYLGGWGIASALARGADV

SEQ ID NO: 749684 - protein, 26 aa, Mycobacterium
VSAPAKKWLAARGFDPIYGARPLRRL

SEQ ID NO: 749685 - protein, 27 aa, Mycobacterium
VSAPALSRRWWAAEGLGAHSRVGSEEE

SEQ ID NO: 749686 - protein, 21 aa, Mycobacterium
VSAPDGGPFGGILGGPTPATG

SEQ ID NO: 749687 - protein, 17 aa, Mycobacterium
VSAPGIFKRSMQWPYAP

SEQ ID NO: 749688 - protein, 17 aa, Mycobacterium
VSAPRFTVFPGSDADVI

SEQ ID NO: 749689 - protein, 25 aa, Mycobacterium
VSAQAESFHRWFSQALSAAAGSYAS

SEQ ID NO: 749690 - protein, 18 aa, Mycobacterium
VSAQLKVYGTEGRKGQLD

SEQ ID NO: 749691 - protein, 17 aa, Mycobacterium
VSAQLPLSLAIATESSG

SEQ ID NO: 749692 - protein, 21 aa, Mycobacterium
VSARELLPERALLGDADAVTA

SEQ ID NO: 749693 - protein, 17 aa, Mycobacterium
VSARFAIAAAETVAAAA

SEQ ID NO: 749694 - protein, 23 aa, Mycobacterium
VSARGVLRGVHFAQVPPSQAKYV

SEQ ID NO: 749695 - protein, 23 aa, Mycobacterium
VSARLRASGGLFLGKTNIAEGGY

SEQ ID NO: 749696 - protein, 25 aa, Mycobacterium
VSARPSDSVAIALRVGVPIYVEEPV

SEQ ID NO: 749697 - protein, 17 aa, Mycobacterium
VSARRDPNFIVCARTDA

SEQ ID NO: 749698 - protein, 17 aa, Mycobacterium
VSARSAGSAGPADRGVG

SEQ ID NO: 749699 - protein, 26 aa, Mycobacterium
VSARTGAGMAAWFGWLRRFVRGVPTG

SEQ ID NO: 749700 - protein, 17 aa, Mycobacterium
VSARTPAGLAAQAERLH

SEQ ID NO: 749701 - protein, 17 aa, Mycobacterium
VSARYGALGVVGSDEKL

SEQ ID NO: 749702 - protein, 18 aa, Mycobacterium
VSASFLPASYFDGVTMAG

SEQ ID NO: 749703 - protein, 17 aa, Mycobacterium
VSASFLWAPDPGPMRLV

SEQ ID NO: 749704 - protein, 21 aa, Mycobacterium
VSASGAAFWGRHGAAGLLLRA

SEQ ID NO: 749705 - protein, 20 aa, Mycobacterium
VSASIAALFDAHSQVYQALS

SEQ ID NO: 749706 - protein, 18 aa, Mycobacterium
VSAVGATLAFSIEAQVES

SEQ ID NO: 749707 - protein, 17 aa, Mycobacterium
VSAVGLADVLAALRSGA

SEQ ID NO: 749708 - protein, 17 aa, Mycobacterium
VSAVLAGLVEAPQGHEE

SEQ ID NO: 749709 - protein, 22 aa, Mycobacterium
VSAWDLARHRTALALPTLTEYQ

SEQ ID NO: 749710 - protein, 24 aa, Mycobacterium
VSAWSELHAKFGKLPFETLFEPAI

SEQ ID NO: 749711 - protein, 17 aa, Mycobacterium
VSAYFAICPTEVVRNDD

SEQ ID NO: 749712 - protein, 29 aa, Mycobacterium
VSCDVGMGFSWARPTSFARPVVALPNGLL

SEQ ID NO: 749713 - protein, 23 aa, Mycobacterium
VSCGHVARSLWAVIVNPDTGAEL

SEQ ID NO: 749714 - protein, 23 aa, Mycobacterium
VSCPPRDVAALAAAVCGVLDDPA

SEQ ID NO: 749715 - protein, 17 aa, Mycobacterium
VSCVAWSHDLCTPTEQH

SEQ ID NO: 749716 - protein, 17 aa, Mycobacterium
VSCVKPQGALYAFPRLD

SEQ ID NO: 749717 - protein, 23 aa, Mycobacterium
VSDDIRRMLGYSIHPPFVGAVDG

SEQ ID NO: 749718 - protein, 23 aa, Mycobacterium
VSDDIRRMLGYSIHPPFVGNVDG

SEQ ID NO: 749719 - protein, 24 aa, Mycobacterium
VSDDLPRLIAMLFSVLSTMDSDSD

SEQ ID NO: 749720 - protein, 17 aa, Mycobacterium
VSDEAKFITGVAWPLDA

SEQ ID NO: 749721 - protein, 20 aa, Mycobacterium
VSDEALSMVIVRENTEGEYS

SEQ ID NO: 749722 - protein, 21 aa, Mycobacterium
VSDEFAGRMQSWWAQAATERE

SEQ ID NO: 749723 - protein, 18 aa, Mycobacterium
VSDEFFALFLDPTMAYTC

SEQ ID NO: 749724 - protein, 22 aa, Mycobacterium
VSDEIHAPLVMRGARFTPYLSV

SEQ ID NO: 749725 - protein, 22 aa, Mycobacterium
VSDEMQRRWLAFAHTGVPGDGW

SEQ ID NO: 749726 - protein, 32 aa, Mycobacterium
VSDFAIYDVAYWWKIKGGKLIHLPAPLITPKG

SEQ ID NO: 749727 - protein, 18 aa, Mycobacterium
VSDFARHAAIALALAAGR

SEQ ID NO: 749728 - protein, 24 aa, Mycobacterium
VSDFRGVAGFSVLRTERPGSAIGA

SEQ ID NO: 749729 - protein, 17 aa, Mycobacterium
VSDGLWDTPASRHEAAC

SEQ ID NO: 749730 - protein, 18 aa, Mycobacterium
VSDGVVLHRELHWGEDSS

SEQ ID NO: 749731 - protein, 22 aa, Mycobacterium
VSDHQLLSWARDDLATVFGVTV

SEQ ID NO: 749732 - protein, 18 aa, Mycobacterium
VSDLEGWGQVCDSGGFLD

SEQ ID NO: 749733 - protein, 20 aa, Mycobacterium
VSDLEGYLPLGVERVLLGLP

SEQ ID NO: 749734 - protein, 20 aa, Mycobacterium
VSDLFGKAGRHWLARQLLPA

SEQ ID NO: 749735 - protein, 23 aa, Mycobacterium
VSDLLCRLICGCIQMGSYPDFPE

SEQ ID NO: 749736 - protein, 19 aa, Mycobacterium
VSDLSRYGGGDSPIIDIFI

SEQ ID NO: 749737 - protein, 22 aa, Mycobacterium
VSDMFYSIWWPKEPGGASDIPP

SEQ ID NO: 749738 - protein, 21 aa, Mycobacterium
VSDMFYSIWWPKLPGETSDIP

SEQ ID NO: 749739 - protein, 23 aa, Mycobacterium
VSDPIDPARLAAGDIGMFTDRHA

SEQ ID NO: 749740 - protein, 20 aa, Mycobacterium
VSDPSGLFLDQRPLAVPGTA

SEQ ID NO: 749741 - protein, 19 aa, Mycobacterium
VSDRISVVIAVPAERQAWA

SEQ ID NO: 749742 - protein, 22 aa, Mycobacterium
VSDRLFDAIIAWGDEAAIMRRV

SEQ ID NO: 749743 - protein, 22 aa, Mycobacterium
VSDRLFNAIIAWGDEDAIMGRV

SEQ ID NO: 749744 - protein, 21 aa, Mycobacterium
VSDVCRALRHTGRRVMLVPTM

SEQ ID NO: 749745 - protein, 18 aa, Mycobacterium
VSDVVSIARYVAAPDGVR

SEQ ID NO: 749746 - protein, 18 aa, Mycobacterium
VSDWPRYSGKAIAGVSGF

SEQ ID NO: 749747 - protein, 23 aa, Mycobacterium
VSEAAGNLARIGSLIETANSAAA

SEQ ID NO: 749748 - protein, 18 aa, Mycobacterium
VSEAAPAPGGPRRVALVG

SEQ ID NO: 749749 - protein, 24 aa, Mycobacterium
VSEADRILAIVPMFHANAWGLIYA

SEQ ID NO: 749750 - protein, 24 aa, Mycobacterium
VSEADRVLAIVPMFHANAWGLIYA

SEQ ID NO: 749751 - protein, 28 aa, Mycobacterium
VSEAFAFASSFGAPVVFFCQNNQWAISE

SEQ ID NO: 749752 - protein, 21 aa, Mycobacterium
VSEAFAHPVVVGYDEGRWTAR

SEQ ID NO: 749753 - protein, 20 aa, Mycobacterium
VSEALPQVLAIELPQPECFE

SEQ ID NO: 749754 - protein, 24 aa, Mycobacterium
VSEALRPLGPPAYVLPEEPLLVAP

SEQ ID NO: 749755 - protein, 25 aa, Mycobacterium
VSEAYKHLKPVAAYGSGLDLLRAAS

SEQ ID NO: 749756 - protein, 18 aa, Mycobacterium
VSEDARYITGVALPVDAG

SEQ ID NO: 749757 - protein, 23 aa, Mycobacterium
VSEDIRRMLGYSIHPPFIGQVDG

SEQ ID NO: 749758 - protein, 18 aa, Mycobacterium
VSEDRVTVLSARSQDVIG

SEQ ID NO: 749759 - protein, 22 aa, Mycobacterium
VSEEGLAALAARVDELGRELAQ

SEQ ID NO: 749760 - protein, 17 aa, Mycobacterium
VSEEWLARAIHERYSER

SEQ ID NO: 749761 - protein, 23 aa, Mycobacterium
VSEFGVPVVPGISRPGLTDDDLI

SEQ ID NO: 749762 - protein, 18 aa, Mycobacterium
VSEFGYVVARAVVSARET

SEQ ID NO: 749763 - protein, 17 aa, Mycobacterium
VSEFICRLLNYMDDNGF

SEQ ID NO: 749764 - protein, 17 aa, Mycobacterium
VSEGIPYSSLVSAAESD

SEQ ID NO: 749765 - protein, 25 aa, Mycobacterium
VSEIDARHLVAVLGHDRERIAPEVA

SEQ ID NO: 749766 - protein, 18 aa, Mycobacterium
VSEIDCPVDKVWERVTTQ

SEQ ID NO: 749767 - protein, 20 aa, Mycobacterium
VSEIDCPVERVWQTVTTQEG

SEQ ID NO: 749768 - protein, 19 aa, Mycobacterium
VSELCGLDIDDIDRPRKVL

SEQ ID NO: 749769 - protein, 19 aa, Mycobacterium
VSELCGLDIDDIDTSRRVV

SEQ ID NO: 749770 - protein, 25 aa, Mycobacterium
VSELGRSGGVLAVMSALENRNNYIQ

SEQ ID NO: 749771 - protein, 18 aa, Mycobacterium
VSELKRLATPASVDSIPS

SEQ ID NO: 749772 - protein, 24 aa, Mycobacterium
VSELPLRERIEIVVDTAWSCYSSP

SEQ ID NO: 749773 - protein, 22 aa, Mycobacterium
VSELPLRERIEVVVDTAWGCYS

SEQ ID NO: 749774 - protein, 18 aa, Mycobacterium
VSELVRFITTPRCIQAMI

SEQ ID NO: 749775 - protein, 24 aa, Mycobacterium
VSEPDPRFATLLQEQFGGANGELK

SEQ ID NO: 749776 - protein, 21 aa, Mycobacterium
VSEPFSTPGTGFWAKLEGHNP

SEQ ID NO: 749777 - protein, 21 aa, Mycobacterium
VSEPVLSRVFEYWKNVDPELG

SEQ ID NO: 749778 - protein, 23 aa, Mycobacterium
VSESLPEFPWDTLADAKTLAGSH

SEQ ID NO: 749779 - protein, 20 aa, Mycobacterium
VSESPWAVVHFTVRLPEGTA

SEQ ID NO: 749780 - protein, 22 aa, Mycobacterium
VSETGYGWWLKTAQGAVRIDTD

SEQ ID NO: 749781 - protein, 19 aa, Mycobacterium
VSEWLRTIPAFGLDAESVP

SEQ ID NO: 749782 - protein, 22 aa, Mycobacterium
VSEWPGIDWPATQSMAEQVLAE

SEQ ID NO: 749783 - protein, 18 aa, Mycobacterium
VSFDFERLLPGASRYTLR

SEQ ID NO: 749784 - protein, 20 aa, Mycobacterium
VSFDYGAAFDRSRKVADGRV

SEQ ID NO: 749785 - protein, 20 aa, Mycobacterium
VSFEAFAAFVDRTIADATEL

SEQ ID NO: 749786 - protein, 34 aa, Mycobacterium
VSFEEMLEMAACGAKVLMLRCVEYARRYNVPIHV

SEQ ID NO: 749787 - protein, 23 aa, Mycobacterium
VSFELRQGRTLGIVGESGSGKST

SEQ ID NO: 749788 - protein, 27 aa, Mycobacterium
VSFGGSCHFMPPEAFIERPMRWLEALS

SEQ ID NO: 749789 - protein, 19 aa, Mycobacterium
VSFGHEIDREVGIGAPDTP

SEQ ID NO: 749790 - protein, 27 aa, Mycobacterium
VSFGKWTRRAWMGAGYLVARTLDADGV

SEQ ID NO: 749791 - protein, 20 aa, Mycobacterium
VSFIGPHVLTGVAVFLTNSG

SEQ ID NO: 749792 - protein, 25 aa, Mycobacterium
VSFKTSIRNGMPWIADEHFTLGDRV

SEQ ID NO: 749793 - protein, 27 aa, Mycobacterium
VSFLQRPARWMQLLAKESHAFSASPNF

SEQ ID NO: 749794 - protein, 18 aa, Mycobacterium
VSFPELPAQCGLPSLHTG

SEQ ID NO: 749795 - protein, 21 aa, Mycobacterium
VSFRKKHPVFRRRRFFEGKPL

SEQ ID NO: 749796 - protein, 19 aa, Mycobacterium
VSFRLRRGSTLAVVGESGS

SEQ ID NO: 749797 - protein, 32 aa, Mycobacterium
VSFTGPHGSFFLREAERPILLLAGGTGLAPVL

SEQ ID NO: 749798 - protein, 17 aa, Mycobacterium
VSFTRHYTGSLACVPSR

SEQ ID NO: 749799 - protein, 18 aa, Mycobacterium
VSFWRAVQTRVWRGRPDP

SEQ ID NO: 749800 - protein, 19 aa, Mycobacterium
VSFWRAVQTRVWRGRPDPL

SEQ ID NO: 749801 - protein, 26 aa, Mycobacterium
VSGAFLAKLGCSFVVVGHSERRTYHN

SEQ ID NO: 749802 - protein, 21 aa, Mycobacterium
VSGAIAKLFGMFGQEYQSVVA

SEQ ID NO: 749803 - protein, 19 aa, Mycobacterium
VSGALRRLCGSELREVLQV

SEQ ID NO: 749804 - protein, 17 aa, Mycobacterium
VSGALSAARRGRAQPGR

SEQ ID NO: 749805 - protein, 18 aa, Mycobacterium
VSGARIQLFAALVHDGNR

SEQ ID NO: 749806 - protein, 17 aa, Mycobacterium
VSGAVGLIVAQHAGGFD

SEQ ID NO: 749807 - protein, 23 aa, Mycobacterium
VSGDTLWGIAERFYGDGNKYQVL

SEQ ID NO: 749808 - protein, 17 aa, Mycobacterium
VSGDVLLAIGATTTAEA

SEQ ID NO: 749809 - protein, 25 aa, Mycobacterium
VSGEAFRWWKHMVLSNPDSIIIVVH

SEQ ID NO: 749810 - protein, 22 aa, Mycobacterium
VSGEGCVMLLLKPLDDAQRDGD

SEQ ID NO: 749811 - protein, 17 aa, Mycobacterium
VSGELAFNQALVANEAA

SEQ ID NO: 749812 - protein, 20 aa, Mycobacterium
VSGENVFFCATGVTDGDLLQ

SEQ ID NO: 749813 - protein, 25 aa, Mycobacterium
VSGERFGVCGYCMGGRISVLLAGRQ

SEQ ID NO: 749814 - protein, 25 aa, Mycobacterium
VSGETFGTTGYCMGGRTSLVVAGRV

SEQ ID NO: 749815 - protein, 33 aa, Mycobacterium
VSGFGNTAVGTAFGVGVSSGFFNTGYSEAIGPF

SEQ ID NO: 749816 - protein, 19 aa, Mycobacterium
VSGFMPWVGDIALAHKIIA

SEQ ID NO: 749817 - protein, 27 aa, Mycobacterium
VSGGDLDRAFAIACRMRTGNVTINGKS

SEQ ID NO: 749818 - protein, 17 aa, Mycobacterium
VSGGEPLLGTWQSVVLV

SEQ ID NO: 749819 - protein, 18 aa, Mycobacterium
VSGGIAWIPAHHRCPDRE

SEQ ID NO: 749820 - protein, 18 aa, Mycobacterium
VSGGIAWIPAHQRSPDRD

SEQ ID NO: 749821 - protein, 18 aa, Mycobacterium
VSGGIVWIPAHDRAEGEL

SEQ ID NO: 749822 - protein, 18 aa, Mycobacterium
VSGGIVWIPAHDRAGEPL

SEQ ID NO: 749823 - protein, 25 aa, Mycobacterium
VSGGRFCFGVGVGWLREEVANHGVD

SEQ ID NO: 749824 - protein, 18 aa, Mycobacterium
VSGGTARLSRLLGELLVS

SEQ ID NO: 749825 - protein, 22 aa, Mycobacterium
VSGGTRRNLDWVAPHVDVSAVG

SEQ ID NO: 749826 - protein, 25 aa, Mycobacterium
VSGHAYAGELLFLYNGVRPRNVMPV

SEQ ID NO: 749827 - protein, 18 aa, Mycobacterium
VSGHAYSGELLFLYNGVR

SEQ ID NO: 749828 - protein, 17 aa, Mycobacterium
VSGHPVGSGFARVSSAE

SEQ ID NO: 749829 - protein, 25 aa, Mycobacterium
VSGKEELLRLAVDRALDALFAATEA

SEQ ID NO: 749830 - protein, 25 aa, Mycobacterium
VSGKRLGSCIGVYAFYDFDGEPIYV

SEQ ID NO: 749831 - protein, 19 aa, Mycobacterium
VSGKWALERGAHRGIGVDG

SEQ ID NO: 749832 - protein, 18 aa, Mycobacterium
VSGLMCRTILQGLASHAP

SEQ ID NO: 749833 - protein, 21 aa, Mycobacterium
VSGLTALQFAAHAQIYQAVSA

SEQ ID NO: 749834 - protein, 17 aa, Mycobacterium
VSGLVRLGGEGARVEPA

SEQ ID NO: 749835 - protein, 17 aa, Mycobacterium
VSGNFLWAPDPGPMRLV

SEQ ID NO: 749836 - protein, 19 aa, Mycobacterium
VSGPRADFDAVRTALEAIG

SEQ ID NO: 749837 - protein, 18 aa, Mycobacterium
VSGPRYLGGAGRWRDSGM

SEQ ID NO: 749838 - protein, 23 aa, Mycobacterium
VSGPSAHHMSKWVRSRFGNPTPK

SEQ ID NO: 749839 - protein, 19 aa, Mycobacterium
VSGPTRLTVETVRRGDERL

SEQ ID NO: 749840 - protein, 21 aa, Mycobacterium
VSGPWAIRHNYVLDFLAFHRD

SEQ ID NO: 749841 - protein, 17 aa, Mycobacterium
VSGQLRAGEFIRPETVA

SEQ ID NO: 749842 - protein, 22 aa, Mycobacterium
VSGQLRPGGTIVEPTSGNTGVG

SEQ ID NO: 749843 - protein, 19 aa, Mycobacterium
VSGQLSPIVGALTEPRQAL

SEQ ID NO: 749844 - protein, 17 aa, Mycobacterium
VSGRLMLAAGSRRSAWW

SEQ ID NO: 749845 - protein, 19 aa, Mycobacterium
VSGRLTLRGNEFELTLAGV

SEQ ID NO: 749846 - protein, 17 aa, Mycobacterium
VSGRSGPRLFPPGPASG

SEQ ID NO: 749847 - protein, 25 aa, Mycobacterium
VSGRWGDPATALWPDRVGEMSIRLI

SEQ ID NO: 749848 - protein, 31 aa, Mycobacterium
VSGSCVALLFSRCIPAIVAMTAVLKTGAAYL

SEQ ID NO: 749849 - protein, 18 aa, Mycobacterium
VSGSVLLRGDELLGRSDQ

SEQ ID NO: 749850 - protein, 20 aa, Mycobacterium
VSGVACLPAGTAGTAGTVTA

SEQ ID NO: 749851 - protein, 30 aa, Mycobacterium
VSHAAIVNHVLWMRAHYAVGPKDVYLQKTA

SEQ ID NO: 749852 - protein, 20 aa, Mycobacterium
VSHAAVFPACRAVVHHGGAG

SEQ ID NO: 749853 - protein, 26 aa, Mycobacterium
VSHAGRITAPRGWELVRHAGPLPTNP

SEQ ID NO: 749854 - protein, 23 aa, Mycobacterium
VSHCGNEPMILLIGSLQVIWSAH

SEQ ID NO: 749855 - protein, 27 aa, Mycobacterium
VSHCRRSGFEPRLLINPVQGTPPHTAV

SEQ ID NO: 749856 - protein, 19 aa, Mycobacterium
VSHDICSAVHPLALASPFF

SEQ ID NO: 749857 - protein, 23 aa, Mycobacterium
VSHLAPARTALRTWLTRTQLDPE

SEQ ID NO: 749858 - protein, 19 aa, Mycobacterium
VSHMACSFWLAVDPSALPD

SEQ ID NO: 749859 - protein, 21 aa, Mycobacterium
VSHMACSFWLAVDPSHLPDPG

SEQ ID NO: 749860 - protein, 17 aa, Mycobacterium
VSHMLGFDTPDTMVAEA

SEQ ID NO: 749861 - protein, 17 aa, Mycobacterium
VSHMPAWARRWQRLLFD

SEQ ID NO: 749862 - protein, 35 aa, Mycobacterium
VSHMPRWARDWQRLLFDNGWLLPGQPPEFGGRNAT

SEQ ID NO: 749863 - protein, 21 aa, Mycobacterium
VSHRRALLKLAPDLQEATRRG

SEQ ID NO: 749864 - protein, 19 aa, Mycobacterium
VSHRVGVSVFERYTGPYTD

SEQ ID NO: 749865 - protein, 17 aa, Mycobacterium
VSHTEEFNRVLLDFLAE

SEQ ID NO: 749866 - protein, 17 aa, Mycobacterium
VSIARYVAAPDGVRLSV

SEQ ID NO: 749867 - protein, 17 aa, Mycobacterium
VSIELTHHGHPLDDERN

SEQ ID NO: 749868 - protein, 25 aa, Mycobacterium
VSIFCATCYEWAILDLAILAVGGVT

SEQ ID NO: 749869 - protein, 25 aa, Mycobacterium
VSIFSATCYEWAILDLAILAVGAVT

SEQ ID NO: 749870 - protein, 21 aa, Mycobacterium
VSIGAILAVPGIRAALRATPA

SEQ ID NO: 749871 - protein, 28 aa, Mycobacterium
VSIGEIFGMLAAGARLVIPKPGGLTDIG

SEQ ID NO: 749872 - protein, 19 aa, Mycobacterium
VSIKEQWFSLFGLGRRLGL

SEQ ID NO: 749873 - protein, 27 aa, Mycobacterium
VSILHDLYQRWPFFRSVLSNLAQVLAK

SEQ ID NO: 749874 - protein, 27 aa, Mycobacterium
VSIPDYPNFFLVLGPYGYVFGPYHMLI

SEQ ID NO: 749875 - protein, 19 aa, Mycobacterium
VSIPVLRKDFIVRPYQIHE

SEQ ID NO: 749876 - protein, 20 aa, Mycobacterium
VSIQAVAAFAAEGAAMLALN

SEQ ID NO: 749877 - protein, 17 aa, Mycobacterium
VSIRCAQLSADRRTALA

SEQ ID NO: 749878 - protein, 17 aa, Mycobacterium
VSIRPGDLLVMSTDGIA

SEQ ID NO: 749879 - protein, 20 aa, Mycobacterium
VSIRSRAEWARRYQEKQLAT

SEQ ID NO: 749880 - protein, 18 aa, Mycobacterium
VSISCHQIHASDPRGAQR

SEQ ID NO: 749881 - protein, 23 aa, Mycobacterium
VSISSAYIWQLRNGIKTNPTVQH

SEQ ID NO: 749882 - protein, 24 aa, Mycobacterium
VSKAEAIRKFRILPVDFTEDTGEL

SEQ ID NO: 749883 - protein, 21 aa, Mycobacterium
VSKAFSQKGLARWQDELVGRV

SEQ ID NO: 749884 - protein, 22 aa, Mycobacterium
VSKAGGFGVLGAVGYTPEQLEI

SEQ ID NO: 749885 - protein, 17 aa, Mycobacterium
VSKALVLAYFGSKEDLY

SEQ ID NO: 749886 - protein, 18 aa, Mycobacterium
VSKARPGGLVEGRRLTKV

SEQ ID NO: 749887 - protein, 27 aa, Mycobacterium
VSKDLPFAQARFCGAEGIENVKTASAF

SEQ ID NO: 749888 - protein, 21 aa, Mycobacterium
VSKLLAEACEKGGATFYGTGM

SEQ ID NO: 749889 - protein, 22 aa, Mycobacterium
VSKLLWANWHRDLGELAMDVVG

SEQ ID NO: 749890 - protein, 23 aa, Mycobacterium
VSKLLWANWHRDLGELAMEIIGT

SEQ ID NO: 749891 - protein, 21 aa, Mycobacterium
VSKLLWANWHRELGEIAMDVQ

SEQ ID NO: 749892 - protein, 22 aa, Mycobacterium
VSKLLWANWHRGLGELAMDVIG

SEQ ID NO: 749893 - protein, 22 aa, Mycobacterium
VSKLLWANWHRSLGELAMDVIG

SEQ ID NO: 749894 - protein, 22 aa, Mycobacterium
VSKLLWANWHRSLGELAMDVVG

SEQ ID NO: 749895 - protein, 22 aa, Mycobacterium
VSKLRRLMAGAGIETRELLANM

SEQ ID NO: 749896 - protein, 17 aa, Mycobacterium
VSLACALVCHPTLLVLD

SEQ ID NO: 749897 - protein, 20 aa, Mycobacterium
VSLAELWKSVGVRPDAVIGH

SEQ ID NO: 749898 - protein, 20 aa, Mycobacterium
VSLAELWKSVGVSPDAVIGH

SEQ ID NO: 749899 - protein, 17 aa, Mycobacterium
VSLALRVAMLSDCPGVS

SEQ ID NO: 749900 - protein, 18 aa, Mycobacterium
VSLAMPWYHRLPDYARLF

SEQ ID NO: 749901 - protein, 17 aa, Mycobacterium
VSLAYTVDSRWRNRDEY

SEQ ID NO: 749902 - protein, 27 aa, Mycobacterium
VSLDGGVREACLWSAGLAGARRRATVL

SEQ ID NO: 749903 - protein, 20 aa, Mycobacterium
VSLDLARAVYKNIGSADTAL

SEQ ID NO: 749904 - protein, 22 aa, Mycobacterium
VSLDRVVPRVGFSMATDSAELF

SEQ ID NO: 749905 - protein, 21 aa, Mycobacterium
VSLDTFVDWLIADGHEIERVD

SEQ ID NO: 749906 - protein, 20 aa, Mycobacterium
VSLEMAEYVSTIFTEVIVAP

SEQ ID NO: 749907 - protein, 17 aa, Mycobacterium
VSLEMARSMDLYAAMSI

SEQ ID NO: 749908 - protein, 26 aa, Mycobacterium
VSLEQRIAAAWLWSRGSAVIAGAAAA

SEQ ID NO: 749909 - protein, 18 aa, Mycobacterium
VSLERNMQCGVAMCGHCQ

SEQ ID NO: 749910 - protein, 38 aa, Mycobacterium
VSLERNMQCGVGWCGHCQLGPLLLCRDGPVVSYDVAGP

SEQ ID NO: 749911 - protein, 17 aa, Mycobacterium
VSLFDPRRLAALLEIPS

SEQ ID NO: 749912 - protein, 28 aa, Mycobacterium
VSLFGAQFITWRGIPIIPSDKVPVKDAK

SEQ ID NO: 749913 - protein, 27 aa, Mycobacterium
VSLFGAQFITWRGIPLIPSDKVPVVDG

SEQ ID NO: 749914 - protein, 19 aa, Mycobacterium
VSLGGSVREACLWSSGFAA

SEQ ID NO: 749915 - protein, 17 aa, Mycobacterium
VSLGLLQVWQALTESVS

SEQ ID NO: 749916 - protein, 23 aa, Mycobacterium
VSLGTFVAVVPWWNPIRLATQIA

SEQ ID NO: 749917 - protein, 19 aa, Mycobacterium
VSLIGAGMRSHPGVTATFC

SEQ ID NO: 749918 - protein, 21 aa, Mycobacterium
VSLIGGRAYRGIALTGKPGVG

SEQ ID NO: 749919 - protein, 20 aa, Mycobacterium
VSLKLGFAGDEFGYALDLGL

SEQ ID NO: 749920 - protein, 24 aa, Mycobacterium
VSLKLGFAGSDFGYAMDLGLPQAS

SEQ ID NO: 749921 - protein, 21 aa, Mycobacterium
VSLLGSGLWALGHTVALTTHL

SEQ ID NO: 749922 - protein, 23 aa, Mycobacterium
VSLLGSGLWSLGHTVALTRHLGQ

SEQ ID NO: 749923 - protein, 25 aa, Mycobacterium
VSLPDGKHVWEWSPREVAGVDFAEL

SEQ ID NO: 749924 - protein, 18 aa, Mycobacterium
VSLPLPAIGRFARDAASL

SEQ ID NO: 749925 - protein, 17 aa, Mycobacterium
VSLPRIVSGELYGSFLP

SEQ ID NO: 749926 - protein, 17 aa, Mycobacterium
VSLPRRGTLVAWTTQGF

SEQ ID NO: 749927 - protein, 27 aa, Mycobacterium
VSLQAAAFHERFVQTLFGGAAAYTAAE

SEQ ID NO: 749928 - protein, 20 aa, Mycobacterium
VSLQLGALVEPMSVAYHAAT

SEQ ID NO: 749929 - protein, 17 aa, Mycobacterium
VSLRDGLQIEKPIPLAA

SEQ ID NO: 749930 - protein, 22 aa, Mycobacterium
VSLRDPYPFFARKRRESGVFRG

SEQ ID NO: 749931 - protein, 17 aa, Mycobacterium
VSLRGFVFDVATGKLNE

SEQ ID NO: 749932 - protein, 23 aa, Mycobacterium
VSLRGRLAAFDLLDDHCRQQWVQ

SEQ ID NO: 749933 - protein, 19 aa, Mycobacterium
VSLRIGRGEIVALIGRSGS

SEQ ID NO: 749934 - protein, 22 aa, Mycobacterium
VSLRKGACARRQVAEALAAAYV

SEQ ID NO: 749935 - protein, 26 aa, Mycobacterium
VSLRRFSQRPGEVLVLGQVVETRVRV

SEQ ID NO: 749936 - protein, 22 aa, Mycobacterium
VSLRRHLFDHLDGVDLKAIGDA

SEQ ID NO: 749937 - protein, 24 aa, Mycobacterium
VSLRRPALTRALLAYRHRRLPEAR

SEQ ID NO: 749938 - protein, 17 aa, Mycobacterium
VSLRVTFGDVWALLVDG

SEQ ID NO: 749939 - protein, 35 aa, Mycobacterium
VSLSLRPETQLALGKWGMLSPHGKCYAFDSRADGF

SEQ ID NO: 749940 - protein, 17 aa, Mycobacterium
VSLSSLAARQSGKIHFD

SEQ ID NO: 749941 - protein, 19 aa, Mycobacterium
VSLVAEWTAGATIVGVIPQ

SEQ ID NO: 749942 - protein, 18 aa, Mycobacterium
VSLVGAGMRSHPGVTATF

SEQ ID NO: 749943 - protein, 24 aa, Mycobacterium
VSLVGGRAKYMWVSTFHSTCVRIL

SEQ ID NO: 749944 - protein, 23 aa, Mycobacterium
VSLYRPGQGPVWTADYPSDTRFS

SEQ ID NO: 749945 - protein, 24 aa, Mycobacterium
VSMAAAAASYVAWTRITGTQAEQA

SEQ ID NO: 749946 - protein, 19 aa, Mycobacterium
VSMAAQWWLDVREPKKEVV

SEQ ID NO: 749947 - protein, 20 aa, Mycobacterium
VSMALRYEGWNIATAGDGAS

SEQ ID NO: 749948 - protein, 20 aa, Mycobacterium
VSMALRYEGWNIATASDGAS

SEQ ID NO: 749949 - protein, 20 aa, Mycobacterium
VSMALRYEGWNISTAGDGES

SEQ ID NO: 749950 - protein, 17 aa, Mycobacterium
VSMASWLGLERVAVGER

SEQ ID NO: 749951 - protein, 28 aa, Mycobacterium
VSMFPDEREILFPAGTKFYVIDKTLDAL

SEQ ID NO: 749952 - protein, 18 aa, Mycobacterium
VSMITALRAHNEFDVNRM

SEQ ID NO: 749953 - protein, 35 aa, Mycobacterium
VSMLPFRFTVNAFRGCAHACRYCFARPTHEYLEFD

SEQ ID NO: 749954 - protein, 20 aa, Mycobacterium
VSMQSAALFSAHGLERTGAG

SEQ ID NO: 749955 - protein, 27 aa, Mycobacterium
VSMSAFRSAVFVPGYASSKMGLIALTM

SEQ ID NO: 749956 - protein, 23 aa, Mycobacterium
VSMSVDCARYWLDSDRPISKSDA

SEQ ID NO: 749957 - protein, 19 aa, Mycobacterium
VSMVADLFHAEGLRDDDPS

SEQ ID NO: 749958 - protein, 17 aa, Mycobacterium
VSNAIAGNSGYLNYGSL

SEQ ID NO: 749959 - protein, 25 aa, Mycobacterium
VSNALCAAAVALECGATLDQVATAL

SEQ ID NO: 749960 - protein, 25 aa, Mycobacterium
VSNALCAAAVALECGATPQQVADAL

SEQ ID NO: 749961 - protein, 17 aa, Mycobacterium
VSNGAGWLAGRTAADLA

SEQ ID NO: 749962 - protein, 31 aa, Mycobacterium
VSNGIDVMSGFPLDRGWDVAGLFDPDPDAEG

SEQ ID NO: 749963 - protein, 28 aa, Mycobacterium
VSNLPAALAHLPADIQLGTHSLMAADPG

SEQ ID NO: 749964 - protein, 28 aa, Mycobacterium
VSNLRLGHVLGQAILRTARRHEAAAQRR

SEQ ID NO: 749965 - protein, 19 aa, Mycobacterium
VSNQFGYGQLIFAALGNAT

SEQ ID NO: 749966 - protein, 22 aa, Mycobacterium
VSNRLRAPVPVVDDVDVPRVLS

SEQ ID NO: 749967 - protein, 25 aa, Mycobacterium
VSNRLRPTLHLFLALTANSAVYRKA

SEQ ID NO: 749968 - protein, 17 aa, Mycobacterium
VSNRPAIYVATYFGNPG

SEQ ID NO: 749969 - protein, 25 aa, Mycobacterium
VSNTFYEWVLGPSMTYTCAVYPNAD

SEQ ID NO: 749970 - protein, 24 aa, Mycobacterium
VSNTFYEWVLGPSMTYTCAVYPNE

SEQ ID NO: 749971 - protein, 25 aa, Mycobacterium
VSNVAYTKKLWQAIVGQNVSGNDAL

SEQ ID NO: 749972 - protein, 20 aa, Mycobacterium
VSNVPGPREPLYFNGSRLEA

SEQ ID NO: 749973 - protein, 24 aa, Mycobacterium
VSNWNVKAPIRWTDINTDDMRPTR

SEQ ID NO: 749974 - protein, 25 aa, Mycobacterium
VSPADRGRFLMKIAAVVDRHRDQLT

SEQ ID NO: 749975 - protein, 17 aa, Mycobacterium
VSPAKARDGEWISTFAP

SEQ ID NO: 749976 - protein, 19 aa, Mycobacterium
VSPALAIERVIDLALRAVP

SEQ ID NO: 749977 - protein, 18 aa, Mycobacterium
VSPALAIERVIDLALREV

SEQ ID NO: 749978 - protein, 18 aa, Mycobacterium
VSPAPTFSVSRPQPNDSV

SEQ ID NO: 749979 - protein, 19 aa, Mycobacterium
VSPASMRKFYEAFAPYGLR

SEQ ID NO: 749980 - protein, 19 aa, Mycobacterium
VSPASMRKFYEAFSPYGLR

SEQ ID NO: 749981 - protein, 27 aa, Mycobacterium
VSPAVFWPIPRVYSGLVRIDRHADAAW

SEQ ID NO: 749982 - protein, 23 aa, Mycobacterium
VSPDGGFLVASWNVPAPGAALRS

SEQ ID NO: 749983 - protein, 18 aa, Mycobacterium
VSPDGHFTFTYKVNGQPV

SEQ ID NO: 749984 - protein, 23 aa, Mycobacterium
VSPDLPPGQALTVYGGVPEAPED

SEQ ID NO: 749985 - protein, 24 aa, Mycobacterium
VSPDPKPSVGLGVGEVGYLITGVK

SEQ ID NO: 749986 - protein, 24 aa, Mycobacterium
VSPEELPAAWAYKRFRDLEEKESY

SEQ ID NO: 749987 - protein, 21 aa, Mycobacterium
VSPELTDWARRTLAEAGAVVI

SEQ ID NO: 749988 - protein, 17 aa, Mycobacterium
VSPEPKASAGLGVGEVG

SEQ ID NO: 749989 - protein, 17 aa, Mycobacterium
VSPEPKPSAGLGVGEVG

SEQ ID NO: 749990 - protein, 19 aa, Mycobacterium
VSPETSWLALNRLIPPLVK

SEQ ID NO: 749991 - protein, 17 aa, Mycobacterium
VSPEWFVGSARRELVLD

SEQ ID NO: 749992 - protein, 21 aa, Mycobacterium
VSPHPLITMLVAHQLDNNTKV

SEQ ID NO: 749993 - protein, 19 aa, Mycobacterium
VSPKPRLAKLFAEPSIFDG

SEQ ID NO: 749994 - protein, 18 aa, Mycobacterium
VSPLARIILPRPGEPLDV

SEQ ID NO: 749995 - protein, 25 aa, Mycobacterium
VSPLAYFRIDGKLIIIGSFAGSPVS

SEQ ID NO: 749996 - protein, 18 aa, Mycobacterium
VSPLCKAMSRLGGVTMAK

SEQ ID NO: 749997 - protein, 20 aa, Mycobacterium
VSPLPIGWAEHVLADGHWGA

SEQ ID NO: 749998 - protein, 23 aa, Mycobacterium
VSPLRPLDSMYRAFCQLLTDQLS

SEQ ID NO: 749999 - protein, 17 aa, Mycobacterium
VSPLVVWLGSAGSRDVT

SEQ ID NO: 750000 - protein, 20 aa, Mycobacterium
VSPMPIGWAEHVLADGHWGR

SEQ ID NO: 750001 - protein, 20 aa, Mycobacterium
VSPMPIGWAEHVMADGHWGR

SEQ ID NO: 750002 - protein, 17 aa, Mycobacterium
VSPPSYRNPALARRVNV

SEQ ID NO: 750003 - protein, 28 aa, Mycobacterium
VSPRGYRALAGIPRLQFAHADLLVRSFG

SEQ ID NO: 750004 - protein, 25 aa, Mycobacterium
VSPRGYRALASIPRLQFAHSDLLVR

SEQ ID NO: 750005 - protein, 17 aa, Mycobacterium
VSPRLLNGVMKRSTPQP

SEQ ID NO: 750006 - protein, 29 aa, Mycobacterium
VSPRPRRANLGWRNLFRQRLGVAVPTDHR

SEQ ID NO: 750007 - protein, 17 aa, Mycobacterium
VSPTPVRLVQAAVDLVD

SEQ ID NO: 750008 - protein, 18 aa, Mycobacterium
VSPVLWKKVAPKLSAGRV

SEQ ID NO: 750009 - protein, 17 aa, Mycobacterium
VSPWSPREAELLAVTLQ

SEQ ID NO: 750010 - protein, 19 aa, Mycobacterium
VSPYLTVHFSPWQYEDHDD

SEQ ID NO: 750011 - protein, 28 aa, Mycobacterium
VSQAGRDCLDWVPGELWIGGDSVASGYR

SEQ ID NO: 750012 - protein, 26 aa, Mycobacterium
VSQELSDLIFNLGIGNVGTFNLGSGN

SEQ ID NO: 750013 - protein, 25 aa, Mycobacterium
VSQESLFKWQRLRLARVEATQPEHV

SEQ ID NO: 750014 - protein, 17 aa, Mycobacterium
VSQFPRVWATITTADAR

SEQ ID NO: 750015 - protein, 24 aa, Mycobacterium
VSQKPAWLDRAWARIREEVAAGRQ

SEQ ID NO: 750016 - protein, 26 aa, Mycobacterium
VSQLAKSAMPLAMGLAPVALSAGMSA

SEQ ID NO: 750017 - protein, 24 aa, Mycobacterium
VSQLNRCLFCLDLHTRVALEEGES

SEQ ID NO: 750018 - protein, 23 aa, Mycobacterium
VSQRWLREIADGKIFGNAFSEKG

SEQ ID NO: 750019 - protein, 17 aa, Mycobacterium
VSQWTPREVELLKVTLR

SEQ ID NO: 750020 - protein, 18 aa, Mycobacterium
VSRACYRGAPWLESLAYK

SEQ ID NO: 750021 - protein, 21 aa, Mycobacterium
VSRAFMPKRIRAIEDKVRAFC

SEQ ID NO: 750022 - protein, 18 aa, Mycobacterium
VSRAGDWFGSPVNLAARM

SEQ ID NO: 750023 - protein, 20 aa, Mycobacterium
VSRAGDWFGSPVNVASRVTS

SEQ ID NO: 750024 - protein, 26 aa, Mycobacterium
VSRAHRGVLFLDEFAEMGARALEALR

SEQ ID NO: 750025 - protein, 17 aa, Mycobacterium
VSRAMFNELWPGFDPDE

SEQ ID NO: 750026 - protein, 27 aa, Mycobacterium
VSRANPHWHRTGPSIAIFAGPQGYISP

SEQ ID NO: 750027 - protein, 18 aa, Mycobacterium
VSRCRRIFSTRKVGHAGT

SEQ ID NO: 750028 - protein, 24 aa, Mycobacterium
VSRDIPLRLVYVIDPLEPSGGGGR

SEQ ID NO: 750029 - protein, 25 aa, Mycobacterium
VSRDRAAAFLSRFPQIDFVDVDGAG

SEQ ID NO: 750030 - protein, 18 aa, Mycobacterium
VSRDVWWAGTGGATRNRY

SEQ ID NO: 750031 - protein, 22 aa, Mycobacterium
VSREVLRAGPSISEVRAAAERM

SEQ ID NO: 750032 - protein, 18 aa, Mycobacterium
VSRFDEYGEFTGGYSDEP

SEQ ID NO: 750033 - protein, 24 aa, Mycobacterium
VSRFVAAPGGRSGWSTIFEDMSRR

SEQ ID NO: 750034 - protein, 19 aa, Mycobacterium
VSRGEFIAVLGPNGSGKTS

SEQ ID NO: 750035 - protein, 17 aa, Mycobacterium
VSRGGWYGLDPVAADLF

SEQ ID NO: 750036 - protein, 28 aa, Mycobacterium
VSRGQEVVEFACGIPHLLKGSYTENAST

SEQ ID NO: 750037 - protein, 17 aa, Mycobacterium
VSRGRFPHQKVFRQWSR

SEQ ID NO: 750038 - protein, 18 aa, Mycobacterium
VSRHQIHPPALYIGDSAA

SEQ ID NO: 750039 - protein, 18 aa, Mycobacterium
VSRILIDPSALWGPPLTT

SEQ ID NO: 750040 - protein, 24 aa, Mycobacterium
VSRIRRFAHPVLLERFRAAELATA

SEQ ID NO: 750041 - protein, 24 aa, Mycobacterium
VSRLFAERCIVGLVANVDHLRELA

SEQ ID NO: 750042 - protein, 20 aa, Mycobacterium
VSRLNRVFAVLHSPGRGPYS

SEQ ID NO: 750043 - protein, 20 aa, Mycobacterium
VSRLPAPLRRGRVRPLGLDR

SEQ ID NO: 750044 - protein, 24 aa, Mycobacterium
VSRLPAQWRRGPIRPLGLDRYGVQ

SEQ ID NO: 750045 - protein, 27 aa, Mycobacterium
VSRLPEALSRFPITRVISSPQRRAVQT

SEQ ID NO: 750046 - protein, 23 aa, Mycobacterium
VSRLRRHARLRKKIAGTPERPRL

SEQ ID NO: 750047 - protein, 23 aa, Mycobacterium
VSRLRRHARLRKKIAGTPQRPRL

SEQ ID NO: 750048 - protein, 22 aa, Mycobacterium
VSRLRRHARLRKKIEGTPQRPR

SEQ ID NO: 750049 - protein, 22 aa, Mycobacterium
VSRLTTALALAEWIEQHAHACE

SEQ ID NO: 750050 - protein, 23 aa, Mycobacterium
VSRNRRFTVARGRLEDYRAVRAR

SEQ ID NO: 750051 - protein, 18 aa, Mycobacterium
VSRNRYWGSPIPVWKSDD

SEQ ID NO: 750052 - protein, 17 aa, Mycobacterium
VSRRAGLDPDVDLYPRL

SEQ ID NO: 750053 - protein, 21 aa, Mycobacterium
VSRRHVIEVTDGLIPELQGRG

SEQ ID NO: 750054 - protein, 18 aa, Mycobacterium
VSRRSDVFSSYENGVIPR

SEQ ID NO: 750055 - protein, 17 aa, Mycobacterium
VSRRSDVFSSYENTVIP

SEQ ID NO: 750056 - protein, 18 aa, Mycobacterium
VSRSGWYGIDPVAADLFT

SEQ ID NO: 750057 - protein, 17 aa, Mycobacterium
VSRSGWYGLDPVEADLL

SEQ ID NO: 750058 - protein, 21 aa, Mycobacterium
VSRSRRFGVVSTKLADYRRVR

SEQ ID NO: 750059 - protein, 34 aa, Mycobacterium
VSRSVKYFLNRIGLFPTYVRQILSESEFDSSTVD

SEQ ID NO: 750060 - protein, 23 aa, Mycobacterium
VSRVCAALPATSWGVRAAGDPGL

SEQ ID NO: 750061 - protein, 25 aa, Mycobacterium
VSRVEPIWSAWIERWPTASATAAAG

SEQ ID NO: 750062 - protein, 26 aa, Mycobacterium
VSRVLPRSIALRMALMGKHERMSAER

SEQ ID NO: 750063 - protein, 26 aa, Mycobacterium
VSRVLPRSIALRMALMGKHERMSAGR

SEQ ID NO: 750064 - protein, 17 aa, Mycobacterium
VSRWVFNCYVLHGGDGA

SEQ ID NO: 750065 - protein, 25 aa, Mycobacterium
VSRYTRARFAPAFGPNASLEYLPPG

SEQ ID NO: 750066 - protein, 26 aa, Mycobacterium
VSRYTRGRFASAFGPRAALEYLPSGV

SEQ ID NO: 750067 - protein, 25 aa, Mycobacterium
VSRYTRSRFAPAFGPAASLEYLPPG

SEQ ID NO: 750068 - protein, 25 aa, Mycobacterium
VSRYTRSRFAPAFGPKASLEYLPSG

SEQ ID NO: 750069 - protein, 25 aa, Mycobacterium
VSRYTRSRFASAFGPSAALEHLPPG

SEQ ID NO: 750070 - protein, 21 aa, Mycobacterium
VSSACSFLGLDPLQVANEGKI

SEQ ID NO: 750071 - protein, 17 aa, Mycobacterium
VSSAENWVDLMLDPRPM

SEQ ID NO: 750072 - protein, 17 aa, Mycobacterium
VSSAIRDGARIIVLSDR

SEQ ID NO: 750073 - protein, 25 aa, Mycobacterium
VSSALRFGLAFCEASGPRLVRRSGN

SEQ ID NO: 750074 - protein, 23 aa, Mycobacterium
VSSAPIFLCLREVREWAQNTKDS

SEQ ID NO: 750075 - protein, 40 aa, Mycobacterium
VSSAQFPRPAPRPSYSALGGRAWAAAGLTPLRPWRSALAA

SEQ ID NO: 750076 - protein, 23 aa, Mycobacterium
VSSARPRTLIIGADLAPAGAAAI

SEQ ID NO: 750077 - protein, 19 aa, Mycobacterium
VSSASRARAARWLPDTPVL

SEQ ID NO: 750078 - protein, 19 aa, Mycobacterium
VSSAVALVVADTAGGFDHR

SEQ ID NO: 750079 - protein, 23 aa, Mycobacterium
VSSCAFGGGSLDELFITTSRQGL

SEQ ID NO: 750080 - protein, 25 aa, Mycobacterium
VSSDSYRPREVVVRINGLDTNWHSD

SEQ ID NO: 750081 - protein, 17 aa, Mycobacterium
VSSDWPFMVSKDSAADY

SEQ ID NO: 750082 - protein, 20 aa, Mycobacterium
VSSESAWHVSARQTRGNLPA

SEQ ID NO: 750083 - protein, 22 aa, Mycobacterium
VSSGGDHYADWQSVYEDNAVWI

SEQ ID NO: 750084 - protein, 18 aa, Mycobacterium
VSSGLAFAPLKVTPSYNA

SEQ ID NO: 750085 - protein, 25 aa, Mycobacterium
VSSGLLRYAHCPVAIVHDEDASAPD

SEQ ID NO: 750086 - protein, 24 aa, Mycobacterium
VSSGPNLFETLGFTYIGPTDGHDV

SEQ ID NO: 750087 - protein, 24 aa, Mycobacterium
VSSIGGPNFLGWQHPPTSTTVTAP

SEQ ID NO: 750088 - protein, 23 aa, Mycobacterium
VSSIGGPSFLGWEHPPATATSTG

SEQ ID NO: 750089 - protein, 26 aa, Mycobacterium
VSSILGLTAMPGWGLYCAGKFALNGM

SEQ ID NO: 750090 - protein, 24 aa, Mycobacterium
VSSLAELFAQIGMRPATAHDDAFA

SEQ ID NO: 750091 - protein, 18 aa, Mycobacterium
VSSLKVAVHAAAPCPVEV

SEQ ID NO: 750092 - protein, 20 aa, Mycobacterium
VSSLWAIAPRDVAKVVEECH

SEQ ID NO: 750093 - protein, 19 aa, Mycobacterium
VSSNLARFDAMRFGLRVGD

SEQ ID NO: 750094 - protein, 23 aa, Mycobacterium
VSSPRPVLFVAPSARLARVPWGL

SEQ ID NO: 750095 - protein, 25 aa, Mycobacterium
VSSPRVLSDLFWLGRYGERAENLVR

SEQ ID NO: 750096 - protein, 22 aa, Mycobacterium
VSSRAANPVAEWVAHGKVRNIR

SEQ ID NO: 750097 - protein, 33 aa, Mycobacterium
VSSRAKLNWWESRALYGWTVLVPRTKDQAGEMS

SEQ ID NO: 750098 - protein, 29 aa, Mycobacterium
VSSREDLLRLGLQIGDFVALITSPELTAD

SEQ ID NO: 750099 - protein, 22 aa, Mycobacterium
VSSRELLPERALLGDKAAIAAL

SEQ ID NO: 750100 - protein, 26 aa, Mycobacterium
VSSRVLQIAFGWRGQDELILLDIEEM

SEQ ID NO: 750101 - protein, 18 aa, Mycobacterium
VSSSCPAEPALPAEHQHQ

SEQ ID NO: 750102 - protein, 26 aa, Mycobacterium
VSSSLVRRARCPVAIIRDEDPLMPDP

SEQ ID NO: 750103 - protein, 28 aa, Mycobacterium
VSSTTTAAVWLRYWVDEIKKPKVRPNTY

SEQ ID NO: 750104 - protein, 17 aa, Mycobacterium
VSSVGYTALLVAGWRAL

SEQ ID NO: 750105 - protein, 26 aa, Mycobacterium
VSSWICGGTPPICFGFGSMPVESPAD

SEQ ID NO: 750106 - protein, 22 aa, Mycobacterium
VSSYLQGHGWKTTSMTSDELLV

SEQ ID NO: 750107 - protein, 21 aa, Mycobacterium
VSTAIAALFAGHAQAYQALST

SEQ ID NO: 750108 - protein, 20 aa, Mycobacterium
VSTAIAALFAGHAREYHSLS

SEQ ID NO: 750109 - protein, 20 aa, Mycobacterium
VSTAIAGLFGGYGQQYQAVV

SEQ ID NO: 750110 - protein, 19 aa, Mycobacterium
VSTAIATLFSQYAKNYQVV

SEQ ID NO: 750111 - protein, 23 aa, Mycobacterium
VSTALSGMGFRVVPSDANFVLFG

SEQ ID NO: 750112 - protein, 27 aa, Mycobacterium
VSTANGCPRTKMVLGGYSQGAAVMGFV

SEQ ID NO: 750113 - protein, 28 aa, Mycobacterium
VSTASRAAAGPTLGLLAAGADEVSVGIA

SEQ ID NO: 750114 - protein, 20 aa, Mycobacterium
VSTAVAALFSGHARVYQAVS

SEQ ID NO: 750115 - protein, 19 aa, Mycobacterium
VSTCNLLLIAGHETTVNLI

SEQ ID NO: 750116 - protein, 19 aa, Mycobacterium
VSTCVLLLVAGHETTVNLI

SEQ ID NO: 750117 - protein, 22 aa, Mycobacterium
VSTDHCPFCMKGQKDMGIGDFS

SEQ ID NO: 750118 - protein, 27 aa, Mycobacterium
VSTDHCPFCMRGQKELGRDDFSKIPNG

SEQ ID NO: 750119 - protein, 28 aa, Mycobacterium
VSTELPRTVTFKVLKRQLAAQGVDCGDP

SEQ ID NO: 750120 - protein, 23 aa, Mycobacterium
VSTHLCQVLGFLAMEPPSALDAD

SEQ ID NO: 750121 - protein, 18 aa, Mycobacterium
VSTIRVLRAVEQFDESGG

SEQ ID NO: 750122 - protein, 20 aa, Mycobacterium
VSTLKFKSALVRAIQVCAAL

SEQ ID NO: 750123 - protein, 24 aa, Mycobacterium
VSTPRGSISLPLVVTDMPDRVVWL

SEQ ID NO: 750124 - protein, 24 aa, Mycobacterium
VSTQMSLRYAHLFDHTVRTEYERA

SEQ ID NO: 750125 - protein, 25 aa, Mycobacterium
VSTRPRPEVFAAYGRTFPDLTLTGD

SEQ ID NO: 750126 - protein, 25 aa, Mycobacterium
VSTRTARMDLVFSLAERWTDGGQPA

SEQ ID NO: 750127 - protein, 20 aa, Mycobacterium
VSTRVPGGVIAPDYGPGRRL

SEQ ID NO: 750128 - protein, 18 aa, Mycobacterium
VSTTLARAAMQPFPSLPL

SEQ ID NO: 750129 - protein, 26 aa, Mycobacterium
VSTVAGALWEWPPSVCGRHHDQSVLG

SEQ ID NO: 750130 - protein, 26 aa, Mycobacterium
VSTVSSIFLMCLEDRVLAYGDCAIVP

SEQ ID NO: 750131 - protein, 17 aa, Mycobacterium
VSTYRGTIRVLPVTDSN

SEQ ID NO: 750132 - protein, 20 aa, Mycobacterium
VSVADRLDTGYVWINGSGSH

SEQ ID NO: 750133 - protein, 18 aa, Mycobacterium
VSVAELWDQGATLADLAE

SEQ ID NO: 750134 - protein, 18 aa, Mycobacterium
VSVALTVRDYRGADRSVQ

SEQ ID NO: 750135 - protein, 19 aa, Mycobacterium
VSVAMPMFHGLGLGMLMLT

SEQ ID NO: 750136 - protein, 24 aa, Mycobacterium
VSVAVRHYGMFRGRFNISAADLAK

SEQ ID NO: 750137 - protein, 24 aa, Mycobacterium
VSVDARPLFARGGGIHCITQQQPA

SEQ ID NO: 750138 - protein, 27 aa, Mycobacterium
VSVDGRDLRRCYSMSSAPVEEELRITV

SEQ ID NO: 750139 - protein, 24 aa, Mycobacterium
VSVDMLKYYAGWVGKIHGESANLV

SEQ ID NO: 750140 - protein, 18 aa, Mycobacterium
VSVDYRLAPEHPFPAGVD

SEQ ID NO: 750141 - protein, 17 aa, Mycobacterium
VSVDYRLAPEHPYPAAV

SEQ ID NO: 750142 - protein, 17 aa, Mycobacterium
VSVEFAIELGRLGGLGV

SEQ ID NO: 750143 - protein, 17 aa, Mycobacterium
VSVEFGMTGKICLSPEQ

SEQ ID NO: 750144 - protein, 17 aa, Mycobacterium
VSVEFGMTGKICLTPDQ

SEQ ID NO: 750145 - protein, 18 aa, Mycobacterium
VSVGAKGCVTFRKEPVRE

SEQ ID NO: 750146 - protein, 25 aa, Mycobacterium
VSVGASTRFTAQVSLARKYTTMANT

SEQ ID NO: 750147 - protein, 19 aa, Mycobacterium
VSVGKSWWARAGVGALGVG

SEQ ID NO: 750148 - protein, 24 aa, Mycobacterium
VSVGPAAGMSGVFVNVNRGKRSAV

SEQ ID NO: 750149 - protein, 25 aa, Mycobacterium
VSVGRLVPRKGFETLICALPRIRGA

SEQ ID NO: 750150 - protein, 17 aa, Mycobacterium
VSVGYPREWAQRKPYSW

SEQ ID NO: 750151 - protein, 17 aa, Mycobacterium
VSVGYPREWRRRKPHSW

SEQ ID NO: 750152 - protein, 21 aa, Mycobacterium
VSVGYPREWRRRKPPSWLRQV

SEQ ID NO: 750153 - protein, 21 aa, Mycobacterium
VSVGYPREWRRRKPYRWLRQI

SEQ ID NO: 750154 - protein, 19 aa, Mycobacterium
VSVGYRLAPENPWPAAAED

SEQ ID NO: 750155 - protein, 23 aa, Mycobacterium
VSVHVRGSVVLQRLYEKNQSSDI

SEQ ID NO: 750156 - protein, 17 aa, Mycobacterium
VSVKDLRKVPADRIRDW

SEQ ID NO: 750157 - protein, 17 aa, Mycobacterium
VSVLADGLDGWKSAGGR

SEQ ID NO: 750158 - protein, 20 aa, Mycobacterium
VSVLIAAQFATHAQMYQTVC

SEQ ID NO: 750159 - protein, 37 aa, Mycobacterium
VSVLPYRFGTHSGWLEACYDLGTAVIAPSCGFYSEQR

SEQ ID NO: 750160 - protein, 25 aa, Mycobacterium
VSVLPYRFGTHSGWLEASYDLGTAV

SEQ ID NO: 750161 - protein, 21 aa, Mycobacterium
VSVLRAAAVAVRQCADAGEGL

SEQ ID NO: 750162 - protein, 25 aa, Mycobacterium
VSVMRKHRLAECLLVDIIGLPWEDV

SEQ ID NO: 750163 - protein, 17 aa, Mycobacterium
VSVPAMVIAAPSSGSGK

SEQ ID NO: 750164 - protein, 18 aa, Mycobacterium
VSVPARPSLSVHAYSPPL

SEQ ID NO: 750165 - protein, 29 aa, Mycobacterium
VSVPKFPNMFSITGPYGFVLGSYLWMIEA

SEQ ID NO: 750166 - protein, 26 aa, Mycobacterium
VSVPNFWAADLPRSFIVCEQDQAMPR

SEQ ID NO: 750167 - protein, 18 aa, Mycobacterium
VSVPSLFAARVAEAPGAV

SEQ ID NO: 750168 - protein, 18 aa, Mycobacterium
VSVQWGQWTVHFDLDAAS

SEQ ID NO: 750169 - protein, 17 aa, Mycobacterium
VSVRAGVEVTVFETTEA

SEQ ID NO: 750170 - protein, 18 aa, Mycobacterium
VSVRAGVEVTVFETTEAL

SEQ ID NO: 750171 - protein, 25 aa, Mycobacterium
VSVRCELWGGCAWINLDDAAPALRA

SEQ ID NO: 750172 - protein, 24 aa, Mycobacterium
VSVRCEVWGGCAWINLDDDAPPFR

SEQ ID NO: 750173 - protein, 24 aa, Mycobacterium
VSVRELPQRFALQLNDTHPSIGVA

SEQ ID NO: 750174 - protein, 22 aa, Mycobacterium
VSVSCYYPLLLAAARWHGVTVQ

SEQ ID NO: 750175 - protein, 18 aa, Mycobacterium
VSVSLFDALVEWMSQPLY

SEQ ID NO: 750176 - protein, 18 aa, Mycobacterium
VSVSRAAVADVEYKHDGA

SEQ ID NO: 750177 - protein, 25 aa, Mycobacterium
VSVTMPGKFAALAFADERTERAERV

SEQ ID NO: 750178 - protein, 26 aa, Mycobacterium
VSVTMPGKFAALRFADERTARAEQVG

SEQ ID NO: 750179 - protein, 25 aa, Mycobacterium
VSVTMPGKFAALRFADERTERAGRV

SEQ ID NO: 750180 - protein, 19 aa, Mycobacterium
VSVVDPGWVWPLNPALTEL

SEQ ID NO: 750181 - protein, 19 aa, Mycobacterium
VSVVDVWTGWSDRAGTQRW

SEQ ID NO: 750182 - protein, 17 aa, Mycobacterium
VSVVRYTPFRPFVIHVN

SEQ ID NO: 750183 - protein, 23 aa, Mycobacterium
VSVWEIFAALLGGGRLVVIPEHV

SEQ ID NO: 750184 - protein, 23 aa, Mycobacterium
VSVWEILGALLGGGRVVVVPEDI

SEQ ID NO: 750185 - protein, 23 aa, Mycobacterium
VSVWEIWGALLSGGRLVVVPEQV

SEQ ID NO: 750186 - protein, 25 aa, Mycobacterium
VSVYARCYLGLAAKFALDIATALAE

SEQ ID NO: 750187 - protein, 25 aa, Mycobacterium
VSWGDSRPGNVIYRDFEPVALLDWE

SEQ ID NO: 750188 - protein, 17 aa, Mycobacterium
VSWIAVSAVHVYEPQNG

SEQ ID NO: 750189 - protein, 20 aa, Mycobacterium
VSYAESFGAKGYRITAADQL

SEQ ID NO: 750190 - protein, 18 aa, Mycobacterium
VSYAKFLVRQGADAGAGG

SEQ ID NO: 750191 - protein, 20 aa, Mycobacterium
VSYAKSFGAKGYRITSAEEL

SEQ ID NO: 750192 - protein, 39 aa, Mycobacterium
VSYAYGRGGQSGRCKAHDYRGATFRVESAVKARWQTPAS

SEQ ID NO: 750193 - protein, 20 aa, Mycobacterium
VSYDALWNGRRFVVQDTGGW

SEQ ID NO: 750194 - protein, 19 aa, Mycobacterium
VSYDALWSGRRFVVQDTGG

SEQ ID NO: 750195 - protein, 20 aa, Mycobacterium
VSYDANWLGRRFVVQDTGGW

SEQ ID NO: 750196 - protein, 19 aa, Mycobacterium
VSYDASWLGQKFVVQDTGG

SEQ ID NO: 750197 - protein, 24 aa, Mycobacterium
VSYECLAHVPSYARWLSGQDWTPA

SEQ ID NO: 750198 - protein, 19 aa, Mycobacterium
VSYEGVWRRPSDGAAGLPA

SEQ ID NO: 750199 - protein, 17 aa, Mycobacterium
VSYGYGLFTGGLGAHYG

SEQ ID NO: 750200 - protein, 18 aa, Mycobacterium
VSYLCHMAKMGVDEVESM

SEQ ID NO: 750201 - protein, 19 aa, Mycobacterium
VSYLLPHLVGGVFGLDPRC

SEQ ID NO: 750202 - protein, 23 aa, Mycobacterium
VSYLNKMLWILTGNFAKKGGQHL

SEQ ID NO: 750203 - protein, 17 aa, Mycobacterium
VSYLRKKIDTGREPMIH

SEQ ID NO: 750204 - protein, 26 aa, Mycobacterium
VSYRDLAGFGRRFIDVAADDLIADVV

SEQ ID NO: 750205 - protein, 25 aa, Mycobacterium
VSYRDLAGFGRRFIDVSSEDLIADV

SEQ ID NO: 750206 - protein, 23 aa, Mycobacterium
VSYRDLAGFGRRFIEVDPTDLEA

SEQ ID NO: 750207 - protein, 32 aa, Mycobacterium
VSYVATTPITSWNNFDVMEFIDNTQTLEPVTD

SEQ ID NO: 750208 - protein, 20 aa, Mycobacterium
VTAADRFERIGAMVLAGDAA

SEQ ID NO: 750209 - protein, 29 aa, Mycobacterium
VTAADRIYSPMPFFWVGGLTMVVLQALST

SEQ ID NO: 750210 - protein, 27 aa, Mycobacterium
VTAADRWGKYLGLRADPLWLIAHLSRA

SEQ ID NO: 750211 - protein, 24 aa, Mycobacterium
VTAADWPPHDLLAAAAEHLHDISA

SEQ ID NO: 750212 - protein, 19 aa, Mycobacterium
VTAAIKTLVPALVGGLQQN

SEQ ID NO: 750213 - protein, 24 aa, Mycobacterium
VTAALPEYMVPAAYVELDEIPITT

SEQ ID NO: 750214 - protein, 21 aa, Mycobacterium
VTAALVRHGWTDGLPPNDQVF

SEQ ID NO: 750215 - protein, 23 aa, Mycobacterium
VTAANRWGKYLGLQAGDLHLITH

SEQ ID NO: 750216 - protein, 17 aa, Mycobacterium
VTAARRAFSGWAQSTRE

SEQ ID NO: 750217 - protein, 18 aa, Mycobacterium
VTAARWPDRTAIVDDDGA

SEQ ID NO: 750218 - protein, 32 aa, Mycobacterium
VTAASRSALRQGIKLAIGLREPGYHFLAVLTL

SEQ ID NO: 750219 - protein, 21 aa, Mycobacterium
VTAAWRKLLTNALAGFMALAG

SEQ ID NO: 750220 - protein, 24 aa, Mycobacterium
VTADAALGLLRRNKIEKLPIVDGE

SEQ ID NO: 750221 - protein, 20 aa, Mycobacterium
VTADAFCWNMVRSLVGALLK

SEQ ID NO: 750222 - protein, 24 aa, Mycobacterium
VTADPDWMTAFALHLEACNFESII

SEQ ID NO: 750223 - protein, 19 aa, Mycobacterium
VTADPEWMVAFARHLEACG

SEQ ID NO: 750224 - protein, 25 aa, Mycobacterium
VTADQRIRQAAPFLSYGPFTGNAPR

SEQ ID NO: 750225 - protein, 28 aa, Mycobacterium
VTAEALAAVNLMSLFGLHRELRGAAIGH

SEQ ID NO: 750226 - protein, 26 aa, Mycobacterium
VTAEIQYILDFGWFPFPLPPLPSFPV

SEQ ID NO: 750227 - protein, 17 aa, Mycobacterium
VTAELDASVSDAQATPP

SEQ ID NO: 750228 - protein, 17 aa, Mycobacterium
VTAELPAKVGAMRAHAT

SEQ ID NO: 750229 - protein, 17 aa, Mycobacterium
VTAELPIRGEHFAPNGF

SEQ ID NO: 750230 - protein, 25 aa, Mycobacterium
VTAELPPGFAEPAHHWLLTLLVGGA

SEQ ID NO: 750231 - protein, 23 aa, Mycobacterium
VTAFAANSAEGWDMATASVHDLF

SEQ ID NO: 750232 - protein, 19 aa, Mycobacterium
VTAFAERSKFAEAFKALEQ

SEQ ID NO: 750233 - protein, 29 aa, Mycobacterium
VTAFEPRPAQARDLAAMFAAVGAPVRVEA

SEQ ID NO: 750234 - protein, 23 aa, Mycobacterium
VTAFSRPATWWSKAARPVVSVAQ

SEQ ID NO: 750235 - protein, 19 aa, Mycobacterium
VTAGLPFLVRAVATSAAEP

SEQ ID NO: 750236 - protein, 28 aa, Mycobacterium
VTAHLTAALKLAGTHPARLVVVDLQAVD

SEQ ID NO: 750237 - protein, 25 aa, Mycobacterium
VTAKLRSAGIPILGKTNMDEFAMGS

SEQ ID NO: 750238 - protein, 23 aa, Mycobacterium
VTAKRVLLATGMQYCPPSLPGMD

SEQ ID NO: 750239 - protein, 19 aa, Mycobacterium
VTALALRPGGSIPTADLTV

SEQ ID NO: 750240 - protein, 18 aa, Mycobacterium
VTALCVAGGVVSESENKT

SEQ ID NO: 750241 - protein, 18 aa, Mycobacterium
VTALGRLDVVVANAGIHI

SEQ ID NO: 750242 - protein, 27 aa, Mycobacterium
VTALKQSRLWQILGMRSADTYVPEWMW

SEQ ID NO: 750243 - protein, 17 aa, Mycobacterium
VTALLDLHVVDGRLRRA

SEQ ID NO: 750244 - protein, 19 aa, Mycobacterium
VTALVEFPPAGTLTGIAKR

SEQ ID NO: 750245 - protein, 24 aa, Mycobacterium
VTANCFCPGMVSTGLVRDSRVLTA

SEQ ID NO: 750246 - protein, 19 aa, Mycobacterium
VTANHRHPVVAAVTITTST

SEQ ID NO: 750247 - protein, 28 aa, Mycobacterium
VTAPAGFRAAGIAAGIKASGKRDLALVF

SEQ ID NO: 750248 - protein, 27 aa, Mycobacterium
VTAPAGFRAAGIAAGIKASGNRDLALV

SEQ ID NO: 750249 - protein, 24 aa, Mycobacterium
VTAPKWYFVYNHIKTFHAIAACNL

SEQ ID NO: 750250 - protein, 18 aa, Mycobacterium
VTAPMLLEVYLERIERLD

SEQ ID NO: 750251 - protein, 24 aa, Mycobacterium
VTAPMRGPGFAKLRELADVIYDPW

SEQ ID NO: 750252 - protein, 19 aa, Mycobacterium
VTAPRHWKVISNGATVSVT

SEQ ID NO: 750253 - protein, 25 aa, Mycobacterium
VTAPRLFCDMLPRDAVPPKLLRDLE

SEQ ID NO: 750254 - protein, 21 aa, Mycobacterium
VTAQFGTPAWIISQGPQVLLD

SEQ ID NO: 750255 - protein, 23 aa, Mycobacterium
VTAQLPLSLAIVFEPEDPEQVAV

SEQ ID NO: 750256 - protein, 23 aa, Mycobacterium
VTAQPRCGLWLSGARGSVATTSI

SEQ ID NO: 750257 - protein, 17 aa, Mycobacterium
VTAQRILGELAHGSEAS

SEQ ID NO: 750258 - protein, 24 aa, Mycobacterium
VTAQVFPRPIGLMIGLELSANPFV

SEQ ID NO: 750259 - protein, 27 aa, Mycobacterium
VTARAQMIGGIIWGWGKATLEASTQEP

SEQ ID NO: 750260 - protein, 17 aa, Mycobacterium
VTARARYWAEKAAKMPA

SEQ ID NO: 750261 - protein, 23 aa, Mycobacterium
VTARDGLTFTGWLFRPREGVETI

SEQ ID NO: 750262 - protein, 17 aa, Mycobacterium
VTAREAAAFIEVGSTLS

SEQ ID NO: 750263 - protein, 19 aa, Mycobacterium
VTAREEREGESLDERLAAE

SEQ ID NO: 750264 - protein, 25 aa, Mycobacterium
VTARLRAAGIPILGKTNMDEFAMGS

SEQ ID NO: 750265 - protein, 21 aa, Mycobacterium
VTARPLPGFDQAAIDGYAVRS

SEQ ID NO: 750266 - protein, 23 aa, Mycobacterium
VTARRDETGWVLSGTGRHVLDGD

SEQ ID NO: 750267 - protein, 22 aa, Mycobacterium
VTARTRGGVIMGVRHSELPIHG

SEQ ID NO: 750268 - protein, 19 aa, Mycobacterium
VTASTQWWEIGLFTTVDEI

SEQ ID NO: 750269 - protein, 17 aa, Mycobacterium
VTATGCRAILYSTTRPQ

SEQ ID NO: 750270 - protein, 19 aa, Mycobacterium
VTATRARLMAPLSGQGAMA

SEQ ID NO: 750271 - protein, 23 aa, Mycobacterium
VTAVACPRFVDFVERGVTSGRQV

SEQ ID NO: 750272 - protein, 17 aa, Mycobacterium
VTAVPWSIVEIGLSSVA

SEQ ID NO: 750273 - protein, 36 aa, Mycobacterium
VTAVTRCWMSLFSPRVITYRASRGFLGTPAMAVVVQ

SEQ ID NO: 750274 - protein, 17 aa, Mycobacterium
VTAWCARMDVLTTDLRV

SEQ ID NO: 750275 - protein, 22 aa, Mycobacterium
VTAYRKGNVLAIALGHGKTDWV

SEQ ID NO: 750276 - protein, 22 aa, Mycobacterium
VTAYRRLLVPVAVMTEAAARGD

SEQ ID NO: 750277 - protein, 29 aa, Mycobacterium
VTCAMGTRPGARVLLDTALRICKRAETPL

SEQ ID NO: 750278 - protein, 18 aa, Mycobacterium
VTCGPSRFTGVLHAREVP

SEQ ID NO: 750279 - protein, 17 aa, Mycobacterium
VTCHKILNDHGLAVPNW

SEQ ID NO: 750280 - protein, 24 aa, Mycobacterium
VTCMSSSLPTLFRRAADYQRQITL

SEQ ID NO: 750281 - protein, 25 aa, Mycobacterium
VTCMSSSLPTLFRRAADYQRQITLT

SEQ ID NO: 750282 - protein, 17 aa, Mycobacterium
VTCNVIVPAAVTRMAEG

SEQ ID NO: 750283 - protein, 17 aa, Mycobacterium
VTCPLQDLHIVSPYLGR

SEQ ID NO: 750284 - protein, 19 aa, Mycobacterium
VTCSDEGRLGEVVAVSADG

SEQ ID NO: 750285 - protein, 19 aa, Mycobacterium
VTCSIFVDQIHYWGDVIVD

SEQ ID NO: 750286 - protein, 25 aa, Mycobacterium
VTDARRREVYWARYHDGARVAGPSV

SEQ ID NO: 750287 - protein, 24 aa, Mycobacterium
VTDARRREVYWARYRDGRRVDGPA

SEQ ID NO: 750288 - protein, 24 aa, Mycobacterium
VTDARRREVYWARYRDGVRTGGPG

SEQ ID NO: 750289 - protein, 26 aa, Mycobacterium
VTDCARPRPTSVLQIHGTADQSVPYD

SEQ ID NO: 750290 - protein, 17 aa, Mycobacterium
VTDCGGLPDAVRGLDSS

SEQ ID NO: 750291 - protein, 29 aa, Mycobacterium
VTDDFPLAMAWAHLRTLRLADGPDEVHKR

SEQ ID NO: 750292 - protein, 28 aa, Mycobacterium
VTDFEPGRRWAWEVAGIPATRHWVDPIG

SEQ ID NO: 750293 - protein, 25 aa, Mycobacterium
VTDFLMLCESFRLPVISLCDTPGFM

SEQ ID NO: 750294 - protein, 18 aa, Mycobacterium
VTDGWSLGRLSMVGRDRV

SEQ ID NO: 750295 - protein, 18 aa, Mycobacterium
VTDISRWREVAAVHAEFF

SEQ ID NO: 750296 - protein, 19 aa, Mycobacterium
VTDISRWREVGAVHEEVFG

SEQ ID NO: 750297 - protein, 18 aa, Mycobacterium
VTDISRWREVGDVHAQVF

SEQ ID NO: 750298 - protein, 18 aa, Mycobacterium
VTDISRWREVGLVHGAFF

SEQ ID NO: 750299 - protein, 33 aa, Mycobacterium
VTDKRTGESFCLKAWKSFGIAGVILGDQTPCAP

SEQ ID NO: 750300 - protein, 26 aa, Mycobacterium
VTDKYWPPVRRIDGVHGDRNLVCSCP

SEQ ID NO: 750301 - protein, 26 aa, Mycobacterium
VTDLAHGWVPPGLMLPEGVQLLEPQR

SEQ ID NO: 750302 - protein, 22 aa, Mycobacterium
VTDLGAAFARLMRAEGARQVVI

SEQ ID NO: 750303 - protein, 17 aa, Mycobacterium
VTDLGLAVEVVRGRAEE

SEQ ID NO: 750304 - protein, 17 aa, Mycobacterium
VTDLSRYGGGDEPILDI

SEQ ID NO: 750305 - protein, 19 aa, Mycobacterium
VTDLSVWPPVGAEAVDVAG

SEQ ID NO: 750306 - protein, 19 aa, Mycobacterium
VTDLVSLVRYATGVDDELV

SEQ ID NO: 750307 - protein, 20 aa, Mycobacterium
VTDLYGAALERMLRAAVTAA

SEQ ID NO: 750308 - protein, 24 aa, Mycobacterium
VTDMAHFFYIHFGLPTYFKNVFEG

SEQ ID NO: 750309 - protein, 25 aa, Mycobacterium
VTDMAHFYYIHFGFPTYFKNVFEGH

SEQ ID NO: 750310 - protein, 30 aa, Mycobacterium; identical to SEQ ID NO: 106483

SEQ ID NO: 750311 - protein, 22 aa, Mycobacterium
VTDNFQGQGYWVVELAAGSRAP

SEQ ID NO: 750312 - protein, 17 aa, Mycobacterium
VTDNIVMPWVFDGLGFD

SEQ ID NO: 750313 - protein, 26 aa, Mycobacterium
VTDPAWRRRPCWYLIATEDRMIPLAA

SEQ ID NO: 750314 - protein, 19 aa, Mycobacterium
VTDPEGAFTFYTEVLGFRP

SEQ ID NO: 750315 - protein, 34 aa, Mycobacterium
VTDPGLDWAVAVGRNASGMPTYWVATNDGATYIP

SEQ ID NO: 750316 - protein, 18 aa, Mycobacterium
VTDPMAWTGADFTSKEDF

SEQ ID NO: 750317 - protein, 21 aa, Mycobacterium
VTDPRAVAVAGIRDETWLRLV

SEQ ID NO: 750318 - protein, 17 aa, Mycobacterium
VTDRLAKMLRFAVDEVF

SEQ ID NO: 750319 - protein, 21 aa, Mycobacterium
VTDRLPCYALYTDPPLGRVGM

SEQ ID NO: 750320 - protein, 25 aa, Mycobacterium
VTDRMRPLRVEDHVVHQIWMPYHWG

SEQ ID NO: 750321 - protein, 22 aa, Mycobacterium
VTDRPSFIALRTIIGYPAPTKM

SEQ ID NO: 750322 - protein, 17 aa, Mycobacterium
VTDRPSFISLRTIIGYP

SEQ ID NO: 750323 - protein, 36 aa, Mycobacterium
VTDRTWRGIGMIASSGWRLSPAYRHFDAEHRFAATD

SEQ ID NO: 750324 - protein, 29 aa, Mycobacterium
VTDRVRPGNCFAPFHWNDVFGEYLSINAV

SEQ ID NO: 750325 - protein, 19 aa, Mycobacterium
VTDSGRLEITWHGETVVDV

SEQ ID NO: 750326 - protein, 28 aa, Mycobacterium
VTDSGSFRWATPRGHRLAARLLDLGADG

SEQ ID NO: 750327 - protein, 24 aa, Mycobacterium
VTDSLDCFFVYLARHPDHRHQLVE

SEQ ID NO: 750328 - protein, 24 aa, Mycobacterium
VTDSLDCFFVYLARHPEHRRQLIE

SEQ ID NO: 750329 - protein, 25 aa, Mycobacterium
VTDVAHGWIPPGIALPQGVRLLPPK

SEQ ID NO: 750330 - protein, 25 aa, Mycobacterium
VTDVMAIGAIAAWRELGLSVPDDVG

SEQ ID NO: 750331 - protein, 22 aa, Mycobacterium
VTDYAVQCFAEYGVHTDETGRY

SEQ ID NO: 750332 - protein, 18 aa, Mycobacterium
VTEALCKRWSPGLRLLPA

SEQ ID NO: 750333 - protein, 26 aa, Mycobacterium
VTEANCAGVDRFARVRDIALSDFVTA

SEQ ID NO: 750334 - protein, 18 aa, Mycobacterium
VTECAIRALVARRQPMVA

SEQ ID NO: 750335 - protein, 30 aa, Mycobacterium
VTEDVLRLLGLPAEEARQICKRPLPSLDGA

SEQ ID NO: 750336 - protein, 18 aa, Mycobacterium
VTEEVFGPLVAFQRAASL

SEQ ID NO: 750337 - protein, 24 aa, Mycobacterium
VTEFLRPIFRRHWSYVEPGVSVDD

SEQ ID NO: 750338 - protein, 17 aa, Mycobacterium
VTEGKKVLEFAVIPTDK

SEQ ID NO: 750339 - protein, 24 aa, Mycobacterium
VTEGTVTRWLKKVGDEVGVDEPLV

SEQ ID NO: 750340 - protein, 23 aa, Mycobacterium
VTEGTVTRWLKKVGDSVGVDDPL

SEQ ID NO: 750341 - protein, 17 aa, Mycobacterium
VTEHLRAKVAAFQSTAT

SEQ ID NO: 750342 - protein, 21 aa, Mycobacterium
VTEIPGPLSLELSKRRAAAVS

SEQ ID NO: 750343 - protein, 23 aa, Mycobacterium
VTEIPRLPSGKVLRRVLKERHGR

SEQ ID NO: 750344 - protein, 23 aa, Mycobacterium
VTEKRMFGGLAFLVHGHMTVAAK

SEQ ID NO: 750345 - protein, 17 aa, Mycobacterium
VTEKVRFGHKVVGAEWS

SEQ ID NO: 750346 - protein, 23 aa, Mycobacterium
VTEKWLRELLIAKDWIYSQQDSR

SEQ ID NO: 750347 - protein, 25 aa, Mycobacterium
VTELAIKGDEAWENIFPPTEEQPEW

SEQ ID NO: 750348 - protein, 18 aa, Mycobacterium
VTELGLPAFRAKQIANQY

SEQ ID NO: 750349 - protein, 19 aa, Mycobacterium
VTELITGLDLVRAQLLVAM

SEQ ID NO: 750350 - protein, 18 aa, Mycobacterium
VTELKYYAATQIQLGEIP

SEQ ID NO: 750351 - protein, 17 aa, Mycobacterium
VTELLYRYAELIDAGDF

SEQ ID NO: 750352 - protein, 26 aa, Mycobacterium
VTEMKAIAVGPDLSRTIARIEKVGYT

SEQ ID NO: 750353 - protein, 26 aa, Mycobacterium
VTEPMLFEWTDRDTLLYALGVGAGLD

SEQ ID NO: 750354 - protein, 26 aa, Mycobacterium
VTEPMLFEWTDRETLLYALGVGAGTE

SEQ ID NO: 750355 - protein, 25 aa, Mycobacterium
VTEPPVEGSWAWLPDEAAGSRVHWR

SEQ ID NO: 750356 - protein, 20 aa, Mycobacterium
VTEQEIDWAVGQFAMALREA

SEQ ID NO: 750357 - protein, 22 aa, Mycobacterium
VTERLLRLFGLDAQEARTICQR

SEQ ID NO: 750358 - protein, 26 aa, Mycobacterium
VTERMRARIAAVMGYADRSAVDPAVP

SEQ ID NO: 750359 - protein, 17 aa, Mycobacterium
VTESLRASYPLGHGHGP

SEQ ID NO: 750360 - protein, 29 aa, Mycobacterium
VTETLHFGKPLVVLPLFWDQYENAQRIDE

SEQ ID NO: 750361 - protein, 26 aa, Mycobacterium
VTEVPMKRFDLMNGIQVRGTYAVSQA

SEQ ID NO: 750362 - protein, 24 aa, Mycobacterium
VTEVREVLTALGFLEDPDEVLATG

SEQ ID NO: 750363 - protein, 29 aa, Mycobacterium
VTEVRWWGARPLWFALWSGVFERFPGLRW

SEQ ID NO: 750364 - protein, 29 aa, Mycobacterium
VTEVRWWGARPLWFALWSGVFERFPRLRW

SEQ ID NO: 750365 - protein, 23 aa, Mycobacterium
VTEVVSSMAVWQGQQSKMFVDGV

SEQ ID NO: 750366 - protein, 18 aa, Mycobacterium
VTEWDEWGNPLADKDVYS

SEQ ID NO: 750367 - protein, 25 aa, Mycobacterium
VTEYCWGAVWGRDGLSRKTRSMLNL

SEQ ID NO: 750368 - protein, 18 aa, Mycobacterium
VTEYCWGAVWGREELPRK

SEQ ID NO: 750369 - protein, 21 aa, Mycobacterium
VTEYNVRFTAVVPVPNDGKGA

SEQ ID NO: 750370 - protein, 29 aa, Mycobacterium
VTFAADWSFGFDVGMTFLEIHGPVPRLRE

SEQ ID NO: 750371 - protein, 20 aa, Mycobacterium
VTFCRICEPLCGMIATVEDG

SEQ ID NO: 750372 - protein, 25 aa, Mycobacterium
VTFDGYRLGAVVVMDNRPRQLTADE

SEQ ID NO: 750373 - protein, 18 aa, Mycobacterium
VTFEEMLEMAACGAKVLM

SEQ ID NO: 750374 - protein, 19 aa, Mycobacterium
VTFGDVWALLVDGEFGRGL

SEQ ID NO: 750375 - protein, 18 aa, Mycobacterium
VTFGDVWALLVDGKFGQG

SEQ ID NO: 750376 - protein, 28 aa, Mycobacterium
VTFGGLKPVHALGECGRVELIDIGLDLA

SEQ ID NO: 750377 - protein, 19 aa, Mycobacterium
VTFHPSYAYEDFIEGFRPQ

SEQ ID NO: 750378 - protein, 24 aa, Mycobacterium
VTFRYDWEAVVTPVLDFALGLPGV

SEQ ID NO: 750379 - protein, 24 aa, Mycobacterium
VTFSDGRTAPFTVVGADPTSDIAV

SEQ ID NO: 750380 - protein, 17 aa, Mycobacterium
VTFSSTYIRSCVDAGDM

SEQ ID NO: 750381 - protein, 23 aa, Mycobacterium
VTFTKARLADGVLGVRPEYLAAA

SEQ ID NO: 750382 - protein, 23 aa, Mycobacterium
VTFVRPSLRNGLWHLTAWLATGV

SEQ ID NO: 750383 - protein, 28 aa, Mycobacterium
VTGAAKWSLKIAREWSGERVQWGKPLGK

SEQ ID NO: 750384 - protein, 19 aa, Mycobacterium
VTGAARSFVRRHINEDTLA

SEQ ID NO: 750385 - protein, 20 aa, Mycobacterium
VTGAGRWGKYLGVQAGPLWL

SEQ ID NO: 750386 - protein, 24 aa, Mycobacterium
VTGATRWGKYLGLQAGDLYLVTHL

SEQ ID NO: 750387 - protein, 20 aa, Mycobacterium
VTGAWNFGSGIGHSHYVAAG

SEQ ID NO: 750388 - protein, 24 aa, Mycobacterium
VTGCGACAGCATRDPVMCHNGFQI

SEQ ID NO: 750389 - protein, 26 aa, Mycobacterium
VTGCGRCAGCLTLDPVKCVHGPQIFG

SEQ ID NO: 750390 - protein, 17 aa, Mycobacterium
VTGDAGLPILGHIIEMF

SEQ ID NO: 750391 - protein, 22 aa, Mycobacterium
VTGDLPFPLPVVGGHEGAGTVV

SEQ ID NO: 750392 - protein, 18 aa, Mycobacterium
VTGDPCEAVAYFKDTGDP

SEQ ID NO: 750393 - protein, 17 aa, Mycobacterium
VTGDTFAPVRAVLGGGG

SEQ ID NO: 750394 - protein, 17 aa, Mycobacterium
VTGDTFAPVRAVLSGPR

SEQ ID NO: 750395 - protein, 22 aa, Mycobacterium
VTGEGGIRLHDVWRDGAYAYLG

SEQ ID NO: 750396 - protein, 27 aa, Mycobacterium
VTGEPRLRLLGFERVELEPGQSCAVEI

SEQ ID NO: 750397 - protein, 19 aa, Mycobacterium
VTGEPRSGTTLMHALMSVD

SEQ ID NO: 750398 - protein, 22 aa, Mycobacterium
VTGEPRSGTTLMHALMSVDPQA

SEQ ID NO: 750399 - protein, 24 aa, Mycobacterium
VTGEPSYAMDLCLSSPNGDHNHAG

SEQ ID NO: 750400 - protein, 23 aa, Mycobacterium
VTGEVPRHEVILFYAKDGLAVLA

SEQ ID NO: 750401 - protein, 19 aa, Mycobacterium
VTGGDRLHFELVRELLDVE

SEQ ID NO: 750402 - protein, 19 aa, Mycobacterium
VTGGGWGFLLSKLSRQGAK

SEQ ID NO: 750403 - protein, 24 aa, Mycobacterium
VTGGKRLDPGFFYAPTLLTNVDPD

SEQ ID NO: 750404 - protein, 24 aa, Mycobacterium
VTGGKRLDPGYFYAPTLLTDVDPD

SEQ ID NO: 750405 - protein, 23 aa, Mycobacterium
VTGGKRLDPGYFYAPTLLTNVDP

SEQ ID NO: 750406 - protein, 24 aa, Mycobacterium
VTGGKRLDPGYFYAPTLLTNVDPD

SEQ ID NO: 750407 - protein, 17 aa, Mycobacterium
VTGGLTFAGGPWSNYVM

SEQ ID NO: 750408 - protein, 17 aa, Mycobacterium
VTGGLTFAGGPWSNYVT

SEQ ID NO: 750409 - protein, 20 aa, Mycobacterium
VTGGNRWLSQPAAIFCSADP

SEQ ID NO: 750410 - protein, 23 aa, Mycobacterium
VTGGRRGLGAAIVDEVLNRGARK

SEQ ID NO: 750411 - protein, 23 aa, Mycobacterium
VTGHLGQHIARWLAQAGASHLVL

SEQ ID NO: 750412 - protein, 18 aa, Mycobacterium
VTGHREFVYVAAHHGAMV

SEQ ID NO: 750413 - protein, 24 aa, Mycobacterium
VTGIERDGAGWAVTGEGGLTDAVD

SEQ ID NO: 750414 - protein, 17 aa, Mycobacterium
VTGIFLVPAQWQAVCAA

SEQ ID NO: 750415 - protein, 21 aa, Mycobacterium
VTGKKLRALMSWVDRPITETA

SEQ ID NO: 750416 - protein, 23 aa, Mycobacterium
VTGLDIPNAYLFGVSAMQPHSRG

SEQ ID NO: 750417 - protein, 28 aa, Mycobacterium
VTGLGVVCGLGMNWQSMWDGLVNGRSAI

SEQ ID NO: 750418 - protein, 19 aa, Mycobacterium
VTGLPEFRPGDDVAAAIAG

SEQ ID NO: 750419 - protein, 17 aa, Mycobacterium
VTGLRLMSRMAQTGKSL

SEQ ID NO: 750420 - protein, 27 aa, Mycobacterium
VTGMKDLQRLPGLVAIAYQHETSRCGD

SEQ ID NO: 750421 - protein, 23 aa, Mycobacterium
VTGMPALTVPAGFGSDGLPIGLQ

SEQ ID NO: 750422 - protein, 21 aa, Mycobacterium
VTGMTCSHCVAAVSAELGALA

SEQ ID NO: 750423 - protein, 21 aa, Mycobacterium
VTGPAGERWEVYTVLADSETF

SEQ ID NO: 750424 - protein, 21 aa, Mycobacterium
VTGPGGERWEVYTVIADSDTF

SEQ ID NO: 750425 - protein, 21 aa, Mycobacterium
VTGPGGERWEVYTVLADSETF

SEQ ID NO: 750426 - protein, 21 aa, Mycobacterium
VTGQQWLDFCVMVECPELEDI

SEQ ID NO: 750427 - protein, 20 aa, Mycobacterium
VTGQQWLDFVAMVECPQLGE

SEQ ID NO: 750428 - protein, 20 aa, Mycobacterium
VTGQWRWREAAAQLLDAALD

SEQ ID NO: 750429 - protein, 28 aa, Mycobacterium
VTGRRPGWREARWLMVVVNYRAARWSDV

SEQ ID NO: 750430 - protein, 24 aa, Mycobacterium
VTGRVRFGSVTARHPFGTALKRLL

SEQ ID NO: 750431 - protein, 28 aa, Mycobacterium
VTGSCKWSLKIAREWSRERVQWGKPVGK

SEQ ID NO: 750432 - protein, 31 aa, Mycobacterium
VTGSEHLVSWLKAVIFGAAERWTDVIDEVKG

SEQ ID NO: 750433 - protein, 17 aa, Mycobacterium
VTGSGLANLARRAQDVG

SEQ ID NO: 750434 - protein, 17 aa, Mycobacterium
VTGSVEFDSRAVGPGGL

SEQ ID NO: 750435 - protein, 17 aa, Mycobacterium
VTGTFTGMGLRGNASAP

SEQ ID NO: 750436 - protein, 19 aa, Mycobacterium
VTGVPILFASTGEKLEDFD

SEQ ID NO: 750437 - protein, 22 aa, Mycobacterium
VTGWAEAIWDTGIAFGTIGVAR

SEQ ID NO: 750438 - protein, 19 aa, Mycobacterium
VTGWFMIGWSAEFEVGDVK

SEQ ID NO: 750439 - protein, 20 aa, Mycobacterium
VTGWFMVGWSPEFPIGEVRP

SEQ ID NO: 750440 - protein, 20 aa, Mycobacterium
VTGWFMVGWSPEFPVGEVRP

SEQ ID NO: 750441 - protein, 28 aa, Mycobacterium
VTGYDILFFWVARMMMFGTFVADGPALH

SEQ ID NO: 750442 - protein, 28 aa, Mycobacterium
VTGYDILFFWVARMMMFGTFVGADDAIT

SEQ ID NO: 750443 - protein, 28 aa, Mycobacterium
VTGYDILFFWVARMMMFGTFVGDDDAIT

SEQ ID NO: 750444 - protein, 28 aa, Mycobacterium
VTGYDILFFWVARMMMFGTFVGGDDVIT

SEQ ID NO: 750445 - protein, 28 aa, Mycobacterium
VTGYDILFFWVARMMMFGTFVGGDEVIT

SEQ ID NO: 750446 - protein, 28 aa, Mycobacterium
VTGYDILFFWVARMMMFGTFVGGDPAII

SEQ ID NO: 750447 - protein, 19 aa, Mycobacterium
VTHAIPCFETIWMRILDHP

SEQ ID NO: 750448 - protein, 17 aa, Mycobacterium
VTHDEFRPLKALAARMA

SEQ ID NO: 750449 - protein, 19 aa, Mycobacterium
VTHDVVLGGQCLRKNDRVV

SEQ ID NO: 750450 - protein, 17 aa, Mycobacterium
VTHDVWSRARTEEVESI

SEQ ID NO: 750451 - protein, 28 aa, Mycobacterium
VTHGARPGERVALLLPRTGEAIAAILAV

SEQ ID NO: 750452 - protein, 25 aa, Mycobacterium
VTHIDWERRRCFVEAVDGGGKAKWS

SEQ ID NO: 750453 - protein, 23 aa, Mycobacterium
VTHIPCWLITDIDSFHRYVVAGH

SEQ ID NO: 750454 - protein, 24 aa, Mycobacterium
VTHIPCWLITDIRSFHRYVVGGHL

SEQ ID NO: 750455 - protein, 20 aa, Mycobacterium
VTHRTEYRYSDIVTSSYGRG

SEQ ID NO: 750456 - protein, 24 aa, Mycobacterium
VTHRVRTAFDLGRYQPRTRAMGCL

SEQ ID NO: 750457 - protein, 17 aa, Mycobacterium
VTHSKILRMIDSVRANQ

SEQ ID NO: 750458 - protein, 17 aa, Mycobacterium
VTHSVWFHQPLDVARWL

SEQ ID NO: 750459 - protein, 19 aa, Mycobacterium
VTIAHRRALDLGRARSRRA

SEQ ID NO: 750460 - protein, 25 aa, Mycobacterium
VTIAPELPGAISAIEMLSGRGVVAA

SEQ ID NO: 750461 - protein, 23 aa, Mycobacterium
VTIARSTPVFGWQDQHGHCEVVY

SEQ ID NO: 750462 - protein, 17 aa, Mycobacterium
VTIGDHFELLAMGSTAS

SEQ ID NO: 750463 - protein, 18 aa, Mycobacterium
VTIKDGAGLNAPDARFFV

SEQ ID NO: 750464 - protein, 25 aa, Mycobacterium
VTILEEARIPFLREPFGPTIDTIGL

SEQ ID NO: 750465 - protein, 24 aa, Mycobacterium
VTILEEARVPFLKDAFAADITTTG

SEQ ID NO: 750466 - protein, 26 aa, Mycobacterium
VTILEEARVPFLRDVFGAEITTTGLL

SEQ ID NO: 750467 - protein, 25 aa, Mycobacterium
VTILEEARVPFLREPFGADITTIGL

SEQ ID NO: 750468 - protein, 19 aa, Mycobacterium
VTIPAGKPVFLINGAANRD

SEQ ID NO: 750469 - protein, 23 aa, Mycobacterium
VTIPEGKPVFLLAGSANRDPDAF

SEQ ID NO: 750470 - protein, 17 aa, Mycobacterium
VTIPRGAMVVPLLTSAN

SEQ ID NO: 750471 - protein, 18 aa, Mycobacterium
VTIPTELDASMRGRVAER

SEQ ID NO: 750472 - protein, 17 aa, Mycobacterium
VTISGWVWEVETRRLRP

SEQ ID NO: 750473 - protein, 18 aa, Mycobacterium
VTISKLWELFVAEDATLV

SEQ ID NO: 750474 - protein, 18 aa, Mycobacterium
VTIVDDWSGFGQRTTASG

SEQ ID NO: 750475 - protein, 17 aa, Mycobacterium
VTIVTDWLVRHDFASAE

SEQ ID NO: 750476 - protein, 23 aa, Mycobacterium
VTIYLGPRPSYLVTSHDLVRDML

SEQ ID NO: 750477 - protein, 20 aa, Mycobacterium
VTKALPGIHPVIGLDSGGAM

SEQ ID NO: 750478 - protein, 22 aa, Mycobacterium
VTKDVNVALRIASLPMGSEALA

SEQ ID NO: 750479 - protein, 19 aa, Mycobacterium
VTKHARLLIGAVVLPLHDP

SEQ ID NO: 750480 - protein, 23 aa, Mycobacterium
VTKKLAAPVGMRSDCLGVYAPMP

SEQ ID NO: 750481 - protein, 27 aa, Mycobacterium
VTKKLPAPVGIRADCLGVQSPMPEWAE

SEQ ID NO: 750482 - protein, 19 aa, Mycobacterium
VTKLIRWTGFSPDKVARIC

SEQ ID NO: 750483 - protein, 35 aa, Mycobacterium
VTKRAGFSSVRYGFVPRRFRLLLVAVGARKLAEPE

SEQ ID NO: 750484 - protein, 23 aa, Mycobacterium
VTKRTGIELTESMAMWPGAAVSG

SEQ ID NO: 750485 - protein, 22 aa, Mycobacterium
VTKSGLSIREWLISLREAGLGT

SEQ ID NO: 750486 - protein, 21 aa, Mycobacterium
VTKSGLSIREWLTALREAGLG

SEQ ID NO: 750487 - protein, 17 aa, Mycobacterium
VTKSGLSVRDWLTSLRE

SEQ ID NO: 750488 - protein, 22 aa, Mycobacterium
VTKSGLSVREWLIGLREAGLDT

SEQ ID NO: 750489 - protein, 26 aa, Mycobacterium
VTKTWELGPGWAKHVTVEFALGTREG

SEQ ID NO: 750490 - protein, 17 aa, Mycobacterium
VTKVFWSDLDVALHQTA

SEQ ID NO: 750491 - protein, 19 aa, Mycobacterium
VTLAGPVPLIYTAAPSDEW

SEQ ID NO: 750492 - protein, 17 aa, Mycobacterium
VTLALSYHVLFLYMPEP

SEQ ID NO: 750493 - protein, 18 aa, Mycobacterium
VTLAMVLAAFEWGTQRGT

SEQ ID NO: 750494 - protein, 24 aa, Mycobacterium
VTLAVLRLGRPVRYEFTRVDEFVR

SEQ ID NO: 750495 - protein, 18 aa, Mycobacterium
VTLCKKPGKPVNFVPVID

SEQ ID NO: 750496 - protein, 17 aa, Mycobacterium
VTLCKTVGKPVNFVPVI

SEQ ID NO: 750497 - protein, 24 aa, Mycobacterium
VTLERLDGLTGWIIGPHDNAGYPE

SEQ ID NO: 750498 - protein, 17 aa, Mycobacterium
VTLESIWHECLEPRRRH

SEQ ID NO: 750499 - protein, 17 aa, Mycobacterium
VTLGKLLPGQTVHVRSY

SEQ ID NO: 750500 - protein, 26 aa, Mycobacterium
VTLGPRGRHVVLAKSFGGPQVTNDGV

SEQ ID NO: 750501 - protein, 26 aa, Mycobacterium
VTLGPRGRHVVLAKSFGGPTITNDGV

SEQ ID NO: 750502 - protein, 26 aa, Mycobacterium
VTLGPRGRHVVLAKSFGGPTVTNDGV

SEQ ID NO: 750503 - protein, 26 aa, Mycobacterium
VTLGPRGRHVVLAKSWGGPTVTNDGV

SEQ ID NO: 750504 - protein, 18 aa, Mycobacterium
VTLHLSWSAPVSLNKLAA

SEQ ID NO: 750505 - protein, 20 aa, Mycobacterium
VTLKRFSPGSAERFRESAIE

SEQ ID NO: 750506 - protein, 17 aa, Mycobacterium
VTLKRGGQSVSISETHG

SEQ ID NO: 750507 - protein, 18 aa, Mycobacterium
VTLLFEVKNIRQWIYPSA

SEQ ID NO: 750508 - protein, 21 aa, Mycobacterium
VTLLIPGGMHTPFFDGRTEQY

SEQ ID NO: 750509 - protein, 18 aa, Mycobacterium
VTLLPLYFELDGTFPNHE

SEQ ID NO: 750510 - protein, 18 aa, Mycobacterium
VTLLRDRLIGALHVAAEH

SEQ ID NO: 750511 - protein, 23 aa, Mycobacterium
VTLLWDVLAAKGFEKDTYFYQVT

SEQ ID NO: 750512 - protein, 25 aa, Mycobacterium
VTLNEEYPRLKVYRGPRRKGVRYFG

SEQ ID NO: 750513 - protein, 36 aa, Mycobacterium
VTLNEEYPRLMVYRGPRRKGVRYFGPYSHAWAIRET

SEQ ID NO: 750514 - protein, 23 aa, Mycobacterium
VTLPCGTCDRCVAGVTAKCRTLR

SEQ ID NO: 750515 - protein, 22 aa, Mycobacterium
VTLPDGYGPWLVDVGFGGQTLT

SEQ ID NO: 750516 - protein, 19 aa, Mycobacterium
VTLPEAFKKSVRAVTDGGW

SEQ ID NO: 750517 - protein, 19 aa, Mycobacterium
VTLPEAFKKSVRAVTEAGW

SEQ ID NO: 750518 - protein, 19 aa, Mycobacterium
VTLPGAAIWHMAWSDKDDA

SEQ ID NO: 750519 - protein, 23 aa, Mycobacterium
VTLPGAAIWHMAWSDKDDAIDWQ

SEQ ID NO: 750520 - protein, 23 aa, Mycobacterium
VTLPGAAVWHMAWSDKDDAIDWQ

SEQ ID NO: 750521 - protein, 17 aa, Mycobacterium
VTLPLEAPVGLAKSAPP

SEQ ID NO: 750522 - protein, 18 aa, Mycobacterium
VTLPNYGGSTLWANTATA

SEQ ID NO: 750523 - protein, 24 aa, Mycobacterium
VTLPTRLSPAWVYSKAMRRRAPWL

SEQ ID NO: 750524 - protein, 25 aa, Mycobacterium
VTLQRIKDNFALFDFELGAEDFDAV

SEQ ID NO: 750525 - protein, 17 aa, Mycobacterium
VTLQRVWDLAAVAAGPS

SEQ ID NO: 750526 - protein, 18 aa, Mycobacterium
VTLQRVWDLSAAAAGPAS

SEQ ID NO: 750527 - protein, 24 aa, Mycobacterium
VTLRAARAGDDWNIDGTVRHVLGG

SEQ ID NO: 750528 - protein, 17 aa, Mycobacterium
VTLRDGMHAIGHRYDRG

SEQ ID NO: 750529 - protein, 18 aa, Mycobacterium
VTLRDGMHAIRHQISPTA

SEQ ID NO: 750530 - protein, 17 aa, Mycobacterium
VTLRLAFGGDVRGYDSY

SEQ ID NO: 750531 - protein, 19 aa, Mycobacterium
VTLRPDPRGRQAGVQGSQQ

SEQ ID NO: 750532 - protein, 24 aa, Mycobacterium
VTLRRLGEIALRIKYLEVLCQRSI

SEQ ID NO: 750533 - protein, 23 aa, Mycobacterium
VTLRRLGEIAVRIKYLEVLCQRS

SEQ ID NO: 750534 - protein, 21 aa, Mycobacterium
VTLRRMVHYFPDVLRERFDAE

SEQ ID NO: 750535 - protein, 24 aa, Mycobacterium
VTLRVLRGRLLRRPTDKTKPVQIV

SEQ ID NO: 750536 - protein, 20 aa, Mycobacterium
VTLRVPLRRVHLSTGADFDL

SEQ ID NO: 750537 - protein, 24 aa, Mycobacterium
VTLTLRTTHQFKGFHAGQFVQLGV

SEQ ID NO: 750538 - protein, 25 aa, Mycobacterium
VTLVRAVCAGRRLVELDGPEIGALA

SEQ ID NO: 750539 - protein, 25 aa, Mycobacterium
VTLVRAVCAGRRLVELDGPEVGALA

SEQ ID NO: 750540 - protein, 20 aa, Mycobacterium
VTLWAPRWRDAGDEWEAFLG

SEQ ID NO: 750541 - protein, 17 aa, Mycobacterium
VTMGPLISREHLDRVEG

SEQ ID NO: 750542 - protein, 22 aa, Mycobacterium
VTMHIPMHLRYDVVEDGPASSL

SEQ ID NO: 750543 - protein, 25 aa, Mycobacterium
VTMNFRLGVLGSLYAPDWHGADSTN

SEQ ID NO: 750544 - protein, 23 aa, Mycobacterium
VTMPNFAGLSPWHAPTGPVPAYP

SEQ ID NO: 750545 - protein, 24 aa, Mycobacterium
VTMSCEWFFCASGYYRYDEGYTPE

SEQ ID NO: 750546 - protein, 27 aa, Mycobacterium
VTMVPYRGVNIAMMICYDVEFPENARM

SEQ ID NO: 750547 - protein, 18 aa, Mycobacterium
VTNAGRKCVLVPGDLSDA

SEQ ID NO: 750548 - protein, 25 aa, Mycobacterium
VTNCGNSWPMARLTLALSPATLPKM

SEQ ID NO: 750549 - protein, 18 aa, Mycobacterium
VTNGLAWVMHTPPQWWVD

SEQ ID NO: 750550 - protein, 18 aa, Mycobacterium
VTNKIARRMVVPPHRDGG

SEQ ID NO: 750551 - protein, 19 aa, Mycobacterium
VTNKIARRMVVPPQRDGGQ

SEQ ID NO: 750552 - protein, 17 aa, Mycobacterium
VTNLLDWYDGSRRDLPW

SEQ ID NO: 750553 - protein, 35 aa, Mycobacterium
VTNNRFGFGVGIGWAPEEFEWCGVPYKRRGARVDE

SEQ ID NO: 750554 - protein, 18 aa, Mycobacterium
VTNPAHWAVLLYEDTALC

SEQ ID NO: 750555 - protein, 20 aa, Mycobacterium
VTNRPNRRIVIMPSEDEPKD

SEQ ID NO: 750556 - protein, 25 aa, Mycobacterium
VTPALLWLFIRGVRFMYSVDPYLPP

SEQ ID NO: 750557 - protein, 18 aa, Mycobacterium
VTPANGWADVAMPADYAR

SEQ ID NO: 750558 - protein, 24 aa, Mycobacterium
VTPAVGALLSMLAKLSGGKAVAEV

SEQ ID NO: 750559 - protein, 17 aa, Mycobacterium
VTPDFAPYGKRIIRDPG

SEQ ID NO: 750560 - protein, 17 aa, Mycobacterium
VTPDPFAEPGWFRTDDI

SEQ ID NO: 750561 - protein, 17 aa, Mycobacterium
VTPDYDPPFAFDGRIHR

SEQ ID NO: 750562 - protein, 26 aa, Mycobacterium
VTPELVRRLCWDWAPVAAAEITSTID

SEQ ID NO: 750563 - protein, 17 aa, Mycobacterium
VTPEVLRRNLIESPAWY

SEQ ID NO: 750564 - protein, 18 aa, Mycobacterium
VTPFFPLAGPAGMIPLPS

SEQ ID NO: 750565 - protein, 18 aa, Mycobacterium
VTPFIWRMDVFGRPHLEQ

SEQ ID NO: 750566 - protein, 21 aa, Mycobacterium
VTPGYITMGGFIPAQDAQGWY

SEQ ID NO: 750567 - protein, 25 aa, Mycobacterium
VTPIPGDVCFFGFEPWEIGNPAYGY

SEQ ID NO: 750568 - protein, 25 aa, Mycobacterium
VTPLFSIYVSPRIRTAIAKIAGRLM

SEQ ID NO: 750569 - protein, 21 aa, Mycobacterium
VTPLRARIAERLDQSGPTVSQ

SEQ ID NO: 750570 - protein, 17 aa, Mycobacterium
VTPLTWSEVTRGWIEEL

SEQ ID NO: 750571 - protein, 19 aa, Mycobacterium
VTPNTGWLPRAILDDDGFV

SEQ ID NO: 750572 - protein, 24 aa, Mycobacterium
VTPPMRLRPKILPNGTQDSGEILV

SEQ ID NO: 750573 - protein, 22 aa, Mycobacterium
VTPPRRFGALSIDVAAREVRIA

SEQ ID NO: 750574 - protein, 18 aa, Mycobacterium
VTPRHADGWLREPLERAC

SEQ ID NO: 750575 - protein, 17 aa, Mycobacterium
VTPSRAGGLIFTDLALT

SEQ ID NO: 750576 - protein, 26 aa, Mycobacterium
VTPTGWPYLQYRSGPAGFVRHLGGNT

SEQ ID NO: 750577 - protein, 25 aa, Mycobacterium
VTPVLMNLCRSYRLHGELDVDKLRA

SEQ ID NO: 750578 - protein, 25 aa, Mycobacterium
VTPVNPRPAPPVTPGKPVTPGVPVT

SEQ ID NO: 750579 - protein, 26 aa, Mycobacterium
VTPWNFPIAIPAWKMAPALVSGNAVV

SEQ ID NO: 750580 - protein, 18 aa, Mycobacterium
VTPWRTGLLLGVDEFEAK

SEQ ID NO: 750581 - protein, 18 aa, Mycobacterium
VTPWRTGLLLGVNEFEAR

SEQ ID NO: 750582 - protein, 18 aa, Mycobacterium
VTQANTLRRSRTILTDEP

SEQ ID NO: 750583 - protein, 30 aa, Mycobacterium
VTQCLKLISRPGCERICRYAFEYARRHGRS

SEQ ID NO: 750584 - protein, 19 aa, Mycobacterium
VTQIARWAGCIGNRSTVIP

SEQ ID NO: 750585 - protein, 19 aa, Mycobacterium
VTQIARWAGCVGNRSTIVP

SEQ ID NO: 750586 - protein, 17 aa, Mycobacterium
VTQLLDRFEGWKAVDVA

SEQ ID NO: 750587 - protein, 22 aa, Mycobacterium
VTQRAHCPAAIIRTDPDTELSD

SEQ ID NO: 750588 - protein, 24 aa, Mycobacterium
VTQRGQWALCGGKTVTVTAPGQPA

SEQ ID NO: 750589 - protein, 26 aa, Mycobacterium
VTQRHLKRLWGLPATQLGVVAWPAQR

SEQ ID NO: 750590 - protein, 19 aa, Mycobacterium
VTQRTARRYSYSDRLRYYW

SEQ ID NO: 750591 - protein, 27 aa, Mycobacterium
VTQSYRLLKHGGVDRVLFLVDRNNLAD

SEQ ID NO: 750592 - protein, 26 aa, Mycobacterium
VTQTTYSSGFDWPILGGSGNTTVSNL

SEQ ID NO: 750593 - protein, 24 aa, Mycobacterium
VTQWKNALLDLSLRNRLINFTDRA

SEQ ID NO: 750594 - protein, 25 aa, Mycobacterium
VTQWPRSARALWAMTRRFRAADYLF

SEQ ID NO: 750595 - protein, 20 aa, Mycobacterium
VTQWVPFADWVDGRVLLGDR

SEQ ID NO: 750596 - protein, 18 aa, Mycobacterium
VTQYELWKAIWSGLNDGN

SEQ ID NO: 750597 - protein, 19 aa, Mycobacterium
VTQYELWKAVWSALNDGNF

SEQ ID NO: 750598 - protein, 20 aa, Mycobacterium
VTQYELWKAVWSSINDANFH

SEQ ID NO: 750599 - protein, 24 aa, Mycobacterium
VTRAAWPHMREQKFGRVVMATSTS

SEQ ID NO: 750600 - protein, 23 aa, Mycobacterium
VTRAELFRRAGIPVPDPDDDDPL

SEQ ID NO: 750601 - protein, 25 aa, Mycobacterium
VTRAPNVAEGWTLTRLTAPSRLFGA

SEQ ID NO: 750602 - protein, 23 aa, Mycobacterium
VTRARNSGMTVVFWLDTERPHEV

SEQ ID NO: 750603 - protein, 23 aa, Mycobacterium
VTRCATPLKWVRLDSAPFTDRLV

SEQ ID NO: 750604 - protein, 19 aa, Mycobacterium
VTRDKKWKPFNLGNLLYNT

SEQ ID NO: 750605 - protein, 18 aa, Mycobacterium
VTREAIGVVGAITPWNFP

SEQ ID NO: 750606 - protein, 17 aa, Mycobacterium
VTREEMDAWALRSHRNA

SEQ ID NO: 750607 - protein, 25 aa, Mycobacterium
VTREIPWEMKISGLRARLGGARMRL

SEQ ID NO: 750608 - protein, 25 aa, Mycobacterium
VTREPRGDGGFGYDPVFLPEGSERT

SEQ ID NO: 750609 - protein, 19 aa, Mycobacterium
VTRGEVHGVWVDRPLARFS

SEQ ID NO: 750610 - protein, 26 aa, Mycobacterium
VTRGRESGMNVVFWLDTERPHEVELR

SEQ ID NO: 750611 - protein, 23 aa, Mycobacterium
VTRHRVPALLVERIDGVPVLESR

SEQ ID NO: 750612 - protein, 23 aa, Mycobacterium
VTRIARALPRMMWTTWSDQLLVG

SEQ ID NO: 750613 - protein, 22 aa, Mycobacterium
VTRLAQEFPLYDGLEDWALVGR

SEQ ID NO: 750614 - protein, 27 aa, Mycobacterium
VTRLRDDLCPDWPQPAQHGGSYRIEVT

SEQ ID NO: 750615 - protein, 25 aa, Mycobacterium
VTRLRDDLCPEWPQPAQEGGSYRVE

SEQ ID NO: 750616 - protein, 17 aa, Mycobacterium
VTRLREDLCPDWPQPAQ

SEQ ID NO: 750617 - protein, 23 aa, Mycobacterium
VTRLREDLCPDWPQPAQEGGSYR

SEQ ID NO: 750618 - protein, 24 aa, Mycobacterium
VTRLRTEPWLGPASLSMAAAAQPL

SEQ ID NO: 750619 - protein, 31 aa, Mycobacterium
VTRMLELVHHFGRSMRARRRGGILLVGSTAA

SEQ ID NO: 750620 - protein, 17 aa, Mycobacterium
VTRMRHLPATVVSSTLK

SEQ ID NO: 750621 - protein, 18 aa, Mycobacterium
VTRMRHLPATVVSTTLDG

SEQ ID NO: 750622 - protein, 21 aa, Mycobacterium
VTRNEWTVAYLLEELAGRPDD

SEQ ID NO: 750623 - protein, 24 aa, Mycobacterium
VTRNGLRIGALVRMSELAAHPVVR

SEQ ID NO: 750624 - protein, 25 aa, Mycobacterium
VTRPLAHNGRVFWKLTDTDSEELVW

SEQ ID NO: 750625 - protein, 21 aa, Mycobacterium
VTRPLGGLFSFGTRGSLPPRF

SEQ ID NO: 750626 - protein, 18 aa, Mycobacterium
VTRPTAWSAEGLLMYLPP

SEQ ID NO: 750627 - protein, 17 aa, Mycobacterium
VTRRAFLNGGRTALISN

SEQ ID NO: 750628 - protein, 19 aa, Mycobacterium
VTRRAFLNGGRTALISNGA

SEQ ID NO: 750629 - protein, 22 aa, Mycobacterium
VTRRLGDSITFVIHIPLSIDLL

SEQ ID NO: 750630 - protein, 17 aa, Mycobacterium
VTRRLKFVTTVYIPAMR

SEQ ID NO: 750631 - protein, 21 aa, Mycobacterium
VTRRRACWLNQTFKSALDALE

SEQ ID NO: 750632 - protein, 25 aa, Mycobacterium
VTRRRHLLAQFLFRGDAVDLPVRAL

SEQ ID NO: 750633 - protein, 25 aa, Mycobacterium
VTRRYWWHAWWWIPQAIVRGGVDKV

SEQ ID NO: 750634 - protein, 21 aa, Mycobacterium
VTRSCRAAGFVPHREHSAPGT

SEQ ID NO: 750635 - protein, 17 aa, Mycobacterium
VTRSGWCTGTTAANNCH

SEQ ID NO: 750636 - protein, 21 aa, Mycobacterium
VTRSLPAIEHFLDLLRADPRL

SEQ ID NO: 750637 - protein, 24 aa, Mycobacterium
VTRTAVCQPGLFNAEVKKAAAEHG

SEQ ID NO: 750638 - protein, 24 aa, Mycobacterium
VTRTAVCQPGLFNAEVKQAAAEHG

SEQ ID NO: 750639 - protein, 18 aa, Mycobacterium
VTRTEAAIDLVERHAAHN

SEQ ID NO: 750640 - protein, 19 aa, Mycobacterium
VTRTELFERGGFDVRAPED

SEQ ID NO: 750641 - protein, 17 aa, Mycobacterium
VTRYGGGAQGLARARAM

SEQ ID NO: 750642 - protein, 26 aa, Mycobacterium
VTSAAWESKPSWQIRTLQDLALPLEE

SEQ ID NO: 750643 - protein, 20 aa, Mycobacterium
VTSADRWKLGQLAPGATVRF

SEQ ID NO: 750644 - protein, 19 aa, Mycobacterium
VTSAGTFGTGAFRANLQAA

SEQ ID NO: 750645 - protein, 18 aa, Mycobacterium
VTSAKMYAGPGAGSLLLA

SEQ ID NO: 750646 - protein, 23 aa, Mycobacterium
VTSALACQAWQGPAAAAMAAAAA

SEQ ID NO: 750647 - protein, 22 aa, Mycobacterium
VTSAPWLPGQVHVFIHGEAQTV

SEQ ID NO: 750648 - protein, 27 aa, Mycobacterium
VTSCLRCADLHRSDRDAAWPAIAAQLS

SEQ ID NO: 750649 - protein, 26 aa, Mycobacterium
VTSCLRCADLHRSDRDPAWPAIAAQL

SEQ ID NO: 750650 - protein, 19 aa, Mycobacterium
VTSCLRCADLHRSDVDRAW

SEQ ID NO: 750651 - protein, 27 aa, Mycobacterium
VTSDIALRFARDMVGRLDVDWTAAGFD

SEQ ID NO: 750652 - protein, 32 aa, Mycobacterium
VTSFIAVCGQCRWCATGMEYLCDTGYGTLAPG

SEQ ID NO: 750653 - protein, 32 aa, Mycobacterium
VTSFVAVCGQCRWCASGMEYLCDTGAGTLAPG

SEQ ID NO: 750654 - protein, 33 aa, Mycobacterium
VTSFVAVCGQCRWCASGMEYLCDTGSGTLAPGM

SEQ ID NO: 750655 - protein, 18 aa, Mycobacterium
VTSGLGLLLNPVATVPVI

SEQ ID NO: 750656 - protein, 21 aa, Mycobacterium
VTSGRVSYVLGLEGPAVSVDT

SEQ ID NO: 750657 - protein, 24 aa, Mycobacterium
VTSKIELFTGIALLIQRDPITTAK

SEQ ID NO: 750658 - protein, 23 aa, Mycobacterium
VTSKIRLATAVAIPVEHDPITLA

SEQ ID NO: 750659 - protein, 26 aa, Mycobacterium
VTSLAVLRLLAGRARITNGEILFRGE

SEQ ID NO: 750660 - protein, 18 aa, Mycobacterium
VTSLLRFAGGLHIVAGRV

SEQ ID NO: 750661 - protein, 18 aa, Mycobacterium
VTSLLRFAGGLHIVGGRV

SEQ ID NO: 750662 - protein, 27 aa, Mycobacterium
VTSLPARAVVRWRHIHEFDDTGDGRTR

SEQ ID NO: 750663 - protein, 22 aa, Mycobacterium
VTSMARPPLPRFPEDGQLRGSL

SEQ ID NO: 750664 - protein, 24 aa, Mycobacterium
VTSMPAYDINLFLDGIEQIVDGDP

SEQ ID NO: 750665 - protein, 20 aa, Mycobacterium
VTSPEELHHLLATEQVTVLS

SEQ ID NO: 750666 - protein, 21 aa, Mycobacterium
VTSPGHAPVTWNFGTAQATDT

SEQ ID NO: 750667 - protein, 18 aa, Mycobacterium
VTSRAAVDARVFVTDRMR

SEQ ID NO: 750668 - protein, 20 aa, Mycobacterium
VTSRASDIGSFIRTQRETAQ

SEQ ID NO: 750669 - protein, 25 aa, Mycobacterium
VTSRLRAAGIPILGKTNMDEFAMGS

SEQ ID NO: 750670 - protein, 29 aa, Mycobacterium
VTSVQACGRAFVKGIERRSRRINCPGWVG

SEQ ID NO: 750671 - protein, 33 aa, Mycobacterium
VTSWSRTGLPLSRLRLADELVEIDSAALRFDSG

SEQ ID NO: 750672 - protein, 18 aa, Mycobacterium
VTTAELFDRNGFVGTSAQ

SEQ ID NO: 750673 - protein, 18 aa, Mycobacterium
VTTAELRARFDGSGVSVV

SEQ ID NO: 750674 - protein, 24 aa, Mycobacterium
VTTCPFEEFDRAWAAAKAGEVVKP

SEQ ID NO: 750675 - protein, 22 aa, Mycobacterium
VTTDLAPMVAFYEDFLELEPQG

SEQ ID NO: 750676 - protein, 29 aa, Mycobacterium
VTTGRLGLIPLRWALACLLIDIGSVTFST

SEQ ID NO: 750677 - protein, 18 aa, Mycobacterium
VTTHFRWDALPVVREVRD

SEQ ID NO: 750678 - protein, 19 aa, Mycobacterium
VTTIGWRLGHIIVGVLGAR

SEQ ID NO: 750679 - protein, 24 aa, Mycobacterium
VTTKIELFTGVALLIQRDVIHTAK

SEQ ID NO: 750680 - protein, 18 aa, Mycobacterium
VTTLARRRGLKTLNIVRR

SEQ ID NO: 750681 - protein, 26 aa, Mycobacterium
VTTLPAGMPAVAWAGPGGYGTGPRYG

SEQ ID NO: 750682 - protein, 24 aa, Mycobacterium
VTTLPAYNLKLFLDGILQVLDGDP

SEQ ID NO: 750683 - protein, 29 aa, Mycobacterium
VTTMAACIGGVFRECRPENVIAIDAVPGF

SEQ ID NO: 750684 - protein, 24 aa, Mycobacterium
VTTMARWNPAAILAYIGEQTNGVT

SEQ ID NO: 750685 - protein, 20 aa, Mycobacterium
VTTMIAVPVMLQRIVDLPAK

SEQ ID NO: 750686 - protein, 20 aa, Mycobacterium
VTTMMGGIVQQVTVTDKAAN

SEQ ID NO: 750687 - protein, 30 aa, Mycobacterium
VTTMTAEPRRTRLAAIATVAAAATDTADRA

SEQ ID NO: 750688 - protein, 24 aa, Mycobacterium
VTTNIEFLRFLLADDDVAAGRLDT

SEQ ID NO: 750689 - protein, 18 aa, Mycobacterium
VTTPTVFRDVEQVRAAVA

SEQ ID NO: 750690 - protein, 20 aa, Mycobacterium
VTTPVGWPVLGAGQTDTSRV

SEQ ID NO: 750691 - protein, 18 aa, Mycobacterium
VTTRIRLSMYVLNAAFYK

SEQ ID NO: 750692 - protein, 25 aa, Mycobacterium
VTTRLRAAGIPILGKTNMDEFAMGS

SEQ ID NO: 750693 - protein, 19 aa, Mycobacterium
VTTRPAPNCMVYVTVLLPV

SEQ ID NO: 750694 - protein, 18 aa, Mycobacterium
VTTTLKLSMYVLNSAFYK

SEQ ID NO: 750695 - protein, 19 aa, Mycobacterium
VTTVRCFQDNALLKSILST

SEQ ID NO: 750696 - protein, 17 aa, Mycobacterium
VTTYCPFQLGPSSAAAR

SEQ ID NO: 750697 - protein, 18 aa, Mycobacterium
VTVADFFLAGSLEQRIPG

SEQ ID NO: 750698 - protein, 23 aa, Mycobacterium
VTVAEALAAVDFVLPALEIIDSR

SEQ ID NO: 750699 - protein, 27 aa, Mycobacterium
VTVARFPKFDWPRIEAPYIRPRADMDA

SEQ ID NO: 750700 - protein, 25 aa, Mycobacterium
VTVAVDLRDDWPAALREAGFDATQP

SEQ ID NO: 750701 - protein, 18 aa, Mycobacterium
VTVAYDLGGGCIVIADRG

SEQ ID NO: 750702 - protein, 25 aa, Mycobacterium
VTVCDARAVFATRARFPTADEVVVE

SEQ ID NO: 750703 - protein, 25 aa, Mycobacterium
VTVDLGDDCWFNLRSSNTEPLLRLN

SEQ ID NO: 750704 - protein, 20 aa, Mycobacterium
VTVDPEWDRPGDSVTNDHEF

SEQ ID NO: 750705 - protein, 17 aa, Mycobacterium
VTVEALEHFGFHRYDDF

SEQ ID NO: 750706 - protein, 19 aa, Mycobacterium
VTVERLERKLGIKGSDTAA

SEQ ID NO: 750707 - protein, 22 aa, Mycobacterium
VTVETAVLCDLCHGKGTNGNSS

SEQ ID NO: 750708 - protein, 18 aa, Mycobacterium
VTVFHLSPTPGFGNSGGA

SEQ ID NO: 750709 - protein, 25 aa, Mycobacterium
VTVGIPMRCVFALTAMGFLPQTGDE

SEQ ID NO: 750710 - protein, 18 aa, Mycobacterium
VTVGRIAYLLGLKGPAVA

SEQ ID NO: 750711 - protein, 21 aa, Mycobacterium
VTVHRGVALTSFYQCGDLYRI

SEQ ID NO: 750712 - protein, 21 aa, Mycobacterium
VTVHVPVGVLARLGGENFAWQ

SEQ ID NO: 750713 - protein, 18 aa, Mycobacterium
VTVICKILGVPVEDEPMF

SEQ ID NO: 750714 - protein, 25 aa, Mycobacterium
VTVIDPRWVLPVADGIGDLAVAHKL

SEQ ID NO: 750715 - protein, 24 aa, Mycobacterium
VTVIDPRWVLPVPDGVRELAVRHK

SEQ ID NO: 750716 - protein, 24 aa, Mycobacterium
VTVIDPRWVLPVSDGIVELAAQHK

SEQ ID NO: 750717 - protein, 24 aa, Mycobacterium
VTVIDPRWVLPVSDNLLDLAARHK

SEQ ID NO: 750718 - protein, 19 aa, Mycobacterium
VTVILELKFKPDAVPQARD

SEQ ID NO: 750719 - protein, 17 aa, Mycobacterium
VTVIPQRADEFTCSSCF

SEQ ID NO: 750720 - protein, 17 aa, Mycobacterium
VTVKGDMTGPVSAKMVL

SEQ ID NO: 750721 - protein, 17 aa, Mycobacterium
VTVKTTWTGAGGVKGFF

SEQ ID NO: 750722 - protein, 17 aa, Mycobacterium
VTVLGMRALDVLGEVTV

SEQ ID NO: 750723 - protein, 27 aa, Mycobacterium
VTVLLKALGWTSERITERFGFSEIMMS

SEQ ID NO: 750724 - protein, 17 aa, Mycobacterium
VTVLSARSQDVIGTVRV

SEQ ID NO: 750725 - protein, 17 aa, Mycobacterium
VTVNAILPGNILTEGLV

SEQ ID NO: 750726 - protein, 18 aa, Mycobacterium
VTVNFRFAPDRSVPDALQ

SEQ ID NO: 750727 - protein, 18 aa, Mycobacterium
VTVNFRFAPDRSVTAALQ

SEQ ID NO: 750728 - protein, 20 aa, Mycobacterium
VTVPANFTSGLLLGSSAQVF

SEQ ID NO: 750729 - protein, 17 aa, Mycobacterium
VTVPELGTFVAERPPIA

SEQ ID NO: 750730 - protein, 19 aa, Mycobacterium
VTVPELGTFVAPLPPIAVL

SEQ ID NO: 750731 - protein, 24 aa, Mycobacterium
VTVPELLSAALTAWIAERDGEATF

SEQ ID NO: 750732 - protein, 23 aa, Mycobacterium
VTVPGRAALLLGDRSTSLTRSLR

SEQ ID NO: 750733 - protein, 18 aa, Mycobacterium
VTVPPGWTVATTELSFVL

SEQ ID NO: 750734 - protein, 18 aa, Mycobacterium
VTVQPGLVAANRAQLVSL

SEQ ID NO: 750735 - protein, 20 aa, Mycobacterium
VTVRARFAVLAIPPNLYSTI

SEQ ID NO: 750736 - protein, 24 aa, Mycobacterium
VTVREVCREAGLAARYFYESFTDK

SEQ ID NO: 750737 - protein, 20 aa, Mycobacterium
VTVRGAVSIARRLQDPLAEL

SEQ ID NO: 750738 - protein, 17 aa, Mycobacterium
VTVRHCARVAMGELGLP

SEQ ID NO: 750739 - protein, 19 aa, Mycobacterium
VTVSFPVECWKQPRVPDSG

SEQ ID NO: 750740 - protein, 19 aa, Mycobacterium
VTVSHELDAELPLADAVLM

SEQ ID NO: 750741 - protein, 23 aa, Mycobacterium
VTVVDPRWVLPVPAAINTLAAAH

SEQ ID NO: 750742 - protein, 24 aa, Mycobacterium
VTVVDPRWVLPVPDAVLELAVAHK

SEQ ID NO: 750743 - protein, 25 aa, Mycobacterium
VTVVDPRWVLPVPEALADLARDHKL

SEQ ID NO: 750744 - protein, 18 aa, Mycobacterium
VTVVLVAADGEWTRRRAG

SEQ ID NO: 750745 - protein, 23 aa, Mycobacterium
VTVVPCPSVLAIWEAIDTRDADG

SEQ ID NO: 750746 - protein, 26 aa, Mycobacterium
VTVYVRPAAWGVWTFYQLSDEERQAL

SEQ ID NO: 750747 - protein, 19 aa, Mycobacterium
VTWDSEWDVRIEIPDLLRW

SEQ ID NO: 750748 - protein, 19 aa, Mycobacterium
VTYAEGFGAKGYRINSADE

SEQ ID NO: 750749 - protein, 25 aa, Mycobacterium
VTYAESFGAKGYRITHADELLPTLR

SEQ ID NO: 750750 - protein, 27 aa, Mycobacterium
VTYALEWEPLSLVGRLFGARLAAQAGE

SEQ ID NO: 750751 - protein, 24 aa, Mycobacterium
VTYDSDYNPGPPYGTSGQSGATGA

SEQ ID NO: 750752 - protein, 17 aa, Mycobacterium
VTYEEYNALKAWLINVG

SEQ ID NO: 750753 - protein, 19 aa, Mycobacterium
VTYELSVDLAMPMIGLLKR

SEQ ID NO: 750754 - protein, 18 aa, Mycobacterium
VTYERLRETPLQWPCPPT

SEQ ID NO: 750755 - protein, 19 aa, Mycobacterium
VTYLKEIWHAIQTQEISGS

SEQ ID NO: 750756 - protein, 17 aa, Mycobacterium
VTYSKLAGRHLLESWIR

SEQ ID NO: 750757 - protein, 24 aa, Mycobacterium
VTYVFSLDGTVVMRGGPGEVHSTR

SEQ ID NO: 750758 - protein, 20 aa, Mycobacterium
VVAAAFEWTHWTVVHPSLVA

SEQ ID NO: 750759 - protein, 19 aa, Mycobacterium
VVAAAPGVIEWPLAGPEIV

SEQ ID NO: 750760 - protein, 19 aa, Mycobacterium
VVAAARWARSELDYLPGTT

SEQ ID NO: 750761 - protein, 27 aa, Mycobacterium
VVAACKSGGLLPFANFNRIHAVPPCNV

SEQ ID NO: 750762 - protein, 19 aa, Mycobacterium
VVAACRRAGAQFSLVLTKT

SEQ ID NO: 750763 - protein, 19 aa, Mycobacterium
VVAAEGAFHGRTMGSLALT

SEQ ID NO: 750764 - protein, 22 aa, Mycobacterium
VVAAGICDRVDKITVNEAADTT

SEQ ID NO: 750765 - protein, 18 aa, Mycobacterium
VVAAHIVNLCWHGLKHLE

SEQ ID NO: 750766 - protein, 19 aa, Mycobacterium
VVAAKPGLLSSVDLPLTIP

SEQ ID NO: 750767 - protein, 19 aa, Mycobacterium
VVAALCGSPSQARKHADAG

SEQ ID NO: 750768 - protein, 17 aa, Mycobacterium
VVAALHWDGDVKGLIAS

SEQ ID NO: 750769 - protein, 21 aa, Mycobacterium
VVAAPEFDGDLALVEALLAAA

SEQ ID NO: 750770 - protein, 17 aa, Mycobacterium
VVAASCGIEPTRIVEYK

SEQ ID NO: 750771 - protein, 28 aa, Mycobacterium
VVAASRWARSELEYLPGTTGVYSTGLDA

SEQ ID NO: 750772 - protein, 26 aa, Mycobacterium
VVAAVPMRPALSLLPVVEAISIPHSV

SEQ ID NO: 750773 - protein, 18 aa, Mycobacterium
VVACGPRSIATLSNDGYA

SEQ ID NO: 750774 - protein, 17 aa, Mycobacterium
VVACLAIHHAGAAMVPL

SEQ ID NO: 750775 - protein, 17 aa, Mycobacterium
VVACMDARLNPYGLLGL

SEQ ID NO: 750776 - protein, 17 aa, Mycobacterium
VVACPDCNSVSAVVEVE

SEQ ID NO: 750777 - protein, 18 aa, Mycobacterium
VVACSGLDVLSHALESYT

SEQ ID NO: 750778 - protein, 24 aa, Mycobacterium
VVACVSRLVPRKGQDMLIRALPAI

SEQ ID NO: 750779 - protein, 24 aa, Mycobacterium
VVADAARLTVVWIADWADDTVHLS

SEQ ID NO: 750780 - protein, 19 aa, Mycobacterium
VVADAQWAAEIRRLAKLRG

SEQ ID NO: 750781 - protein, 17 aa, Mycobacterium
VVADAYAQLAARVVGER

SEQ ID NO: 750782 - protein, 25 aa, Mycobacterium
VVADGVAALGRLDIIVANAGVAAPQ

SEQ ID NO: 750783 - protein, 23 aa, Mycobacterium
VVADRLAAGGARVRQLAVSHAFH

SEQ ID NO: 750784 - protein, 25 aa, Mycobacterium
VVADSGARFWGRFGAAGLLLRAPLP

SEQ ID NO: 750785 - protein, 24 aa, Mycobacterium
VVADWLNLHGWRATAHNSADEMRR

SEQ ID NO: 750786 - protein, 23 aa, Mycobacterium
VVADWPRPSGITLDPVAAQRISD

SEQ ID NO: 750787 - protein, 17 aa, Mycobacterium
VVAEAMVALVLARAALE

SEQ ID NO: 750788 - protein, 31 aa, Mycobacterium
VVAEERAMFGLPEVKRGLIAGAGGVFRIIEQ

SEQ ID NO: 750789 - protein, 25 aa, Mycobacterium
VVAELRSGMTIGLGGWGSRRKPMAF

SEQ ID NO: 750790 - protein, 21 aa, Mycobacterium
VVAEPFAMWAIEDDFADGRPP

SEQ ID NO: 750791 - protein, 17 aa, Mycobacterium
VVAEPRPGYGSAVHAGV

SEQ ID NO: 750792 - protein, 27 aa, Mycobacterium
VVAEQARWGDGWVKLIGDWIDRGAGDL

SEQ ID NO: 750793 - protein, 22 aa, Mycobacterium
VVAESPTALVIDLSAVEFLGSV

SEQ ID NO: 750794 - protein, 24 aa, Mycobacterium
VVAESVAGGFAWLYKVLSTFEDNG

SEQ ID NO: 750795 - protein, 17 aa, Mycobacterium
VVAETLTTLVLRGEGGF

SEQ ID NO: 750796 - protein, 22 aa, Mycobacterium
VVAEVADRVVVMYAGQIVEDGT

SEQ ID NO: 750797 - protein, 22 aa, Mycobacterium
VVAEVRAELLASVDAAVSAGVD

SEQ ID NO: 750798 - protein, 25 aa, Mycobacterium
VVAEVRRALKPGGKFIYTVRHTRDE

SEQ ID NO: 750799 - protein, 22 aa, Mycobacterium
VVAEVRTELLAAVDAAVTAGVE

SEQ ID NO: 750800 - protein, 26 aa, Mycobacterium
VVAEWLIRWLRETGVSVLLMDPLGSF

SEQ ID NO: 750801 - protein, 33 aa, Mycobacterium
VVAEWQLLADLSFADYLMWVHRDDDAFVCVAQC

SEQ ID NO: 750802 - protein, 25 aa, Mycobacterium
VVAFAKEYGVPIAIKAAFGGGGRGM

SEQ ID NO: 750803 - protein, 20 aa, Mycobacterium
VVAFASWPQQCVLRGTLAGI

SEQ ID NO: 750804 - protein, 38 aa, Mycobacterium
VVAFRKQHPVFRRRRFFEGKPIRSGDQVRDIAWLTRAG

SEQ ID NO: 750805 - protein, 24 aa, Mycobacterium
VVAGARWAGARVMTFRHNDPESLR

SEQ ID NO: 750806 - protein, 28 aa, Mycobacterium
VVAGCNLPNCPRATLFDASERDYRAVVV

SEQ ID NO: 750807 - protein, 24 aa, Mycobacterium
VVAGFPGTVASFWQQAGRSGRRGQ

SEQ ID NO: 750808 - protein, 19 aa, Mycobacterium
VVAGLKLQGLRNRKVLDET

SEQ ID NO: 750809 - protein, 19 aa, Mycobacterium
VVAGLRLQGVRNKKTLDEV

SEQ ID NO: 750810 - protein, 26 aa, Mycobacterium
VVAHARRHGVALLWVMEAAPVDDVRA

SEQ ID NO: 750811 - protein, 23 aa, Mycobacterium
VVAHFEWTGPLGVTYPGVVADGI

SEQ ID NO: 750812 - protein, 18 aa, Mycobacterium
VVAHGGFGVAQRIVQRDG

SEQ ID NO: 750813 - protein, 23 aa, Mycobacterium
VVAIARPLLAPAIESATAVQGWL

SEQ ID NO: 750814 - protein, 23 aa, Mycobacterium
VVAIGITPEGSWVLTDGDPAALA

SEQ ID NO: 750815 - protein, 19 aa, Mycobacterium
VVAIGQRLGISAPDIDLLS

SEQ ID NO: 750816 - protein, 28 aa, Mycobacterium
VVAISINGPRAWDLDLAIDFSFAEPAEN

SEQ ID NO: 750817 - protein, 17 aa, Mycobacterium
VVAKAEPLASVPALPYP

SEQ ID NO: 750818 - protein, 18 aa, Mycobacterium
VVAKGSNLEFALGYSHPV

SEQ ID NO: 750819 - protein, 19 aa, Mycobacterium
VVALARFGIGAVVFSGVAG

SEQ ID NO: 750820 - protein, 24 aa, Mycobacterium
VVALARPLLAPAIESADAVEDRLQ

SEQ ID NO: 750821 - protein, 18 aa, Mycobacterium
VVALARTHLDRALANASD

SEQ ID NO: 750822 - protein, 19 aa, Mycobacterium
VVALCGEVFPVTKAAKPGS

SEQ ID NO: 750823 - protein, 19 aa, Mycobacterium
VVALCGEVFPVTRSAKPGS

SEQ ID NO: 750824 - protein, 23 aa, Mycobacterium
VVALDRFEALAGFRDPGDTVDLF

SEQ ID NO: 750825 - protein, 21 aa, Mycobacterium
VVALERLGRWNVPGPVTESIA

SEQ ID NO: 750826 - protein, 19 aa, Mycobacterium
VVALGESQSAMFLTTYVNA

SEQ ID NO: 750827 - protein, 20 aa, Mycobacterium
VVALGGFGWQIALRLPGTSG

SEQ ID NO: 750828 - protein, 18 aa, Mycobacterium
VVALGMGGMGYAFGAGIG

SEQ ID NO: 750829 - protein, 17 aa, Mycobacterium
VVALPMRVRFRGITTRE

SEQ ID NO: 750830 - protein, 19 aa, Mycobacterium
VVALRAGPSGGFGDPADAL

SEQ ID NO: 750831 - protein, 23 aa, Mycobacterium
VVALRSAQLITFTAMDIDDPRAL

SEQ ID NO: 750832 - protein, 25 aa, Mycobacterium
VVALTGFRPDLSFLSEIRLELDPIL

SEQ ID NO: 750833 - protein, 27 aa, Mycobacterium
VVALTVLWLLNIGEYLQDLTLRRTRRA

SEQ ID NO: 750834 - protein, 20 aa, Mycobacterium
VVAMFRPKLDAAAAVHTLSL

SEQ ID NO: 750835 - protein, 18 aa, Mycobacterium
VVAMLRRGEFQQRSTELG

SEQ ID NO: 750836 - protein, 25 aa, Mycobacterium
VVANADFIGGFGLWVDEQRLLHHTY

SEQ ID NO: 750837 - protein, 19 aa, Mycobacterium
VVANGTFTQTLFGDGGNGG

SEQ ID NO: 750838 - protein, 18 aa, Mycobacterium
VVANLMRNLWAYVVIFCG

SEQ ID NO: 750839 - protein, 17 aa, Mycobacterium
VVANMLAGLGVIAEPKL

SEQ ID NO: 750840 - protein, 17 aa, Mycobacterium
VVAPAQWTGELSDRKAR

SEQ ID NO: 750841 - protein, 24 aa, Mycobacterium
VVAPDQTCLWGFGRAASLEHPQIW

SEQ ID NO: 750842 - protein, 17 aa, Mycobacterium
VVAPFSRGYAPTGPAPD

SEQ ID NO: 750843 - protein, 17 aa, Mycobacterium
VVAPFTRGYAPSEIPAD

SEQ ID NO: 750844 - protein, 20 aa, Mycobacterium
VVAPITFLAVAGRRVQHKIF

SEQ ID NO: 750845 - protein, 17 aa, Mycobacterium
VVAPLAPLHGWGPDPYL

SEQ ID NO: 750846 - protein, 18 aa, Mycobacterium
VVAPRLRAGQARVLLMAA

SEQ ID NO: 750847 - protein, 18 aa, Mycobacterium
VVAPRLRPPQARVLLMAA

SEQ ID NO: 750848 - protein, 29 aa, Mycobacterium
VVAPSGRDCLDWVPGELWVGGVNVAAGYR

SEQ ID NO: 750849 - protein, 24 aa, Mycobacterium
VVAPVWPSNPWTAAYRQDRAEPSE

SEQ ID NO: 750850 - protein, 26 aa, Mycobacterium
VVARAAIAHAAWRGADTVGEPDIRVA

SEQ ID NO: 750851 - protein, 22 aa, Mycobacterium
VVARAGDIAGIRYCAGATRDGS

SEQ ID NO: 750852 - protein, 25 aa, Mycobacterium
VVARAGRLDLMFNNAGIVWGGDTEL

SEQ ID NO: 750853 - protein, 24 aa, Mycobacterium
VVARARAAGVLCRPRDVFIEQTVS

SEQ ID NO: 750854 - protein, 28 aa, Mycobacterium
VVARASALYLRRGVQPGGRFWSTPVDLP

SEQ ID NO: 750855 - protein, 25 aa, Mycobacterium
VVARAVLKAATSRRPKVRYPAGALA

SEQ ID NO: 750856 - protein, 22 aa, Mycobacterium
VVARFCGRELILDAELEDTIAN

SEQ ID NO: 750857 - protein, 23 aa, Mycobacterium
VVARGELVYAVLNLYPYNPGHLM

SEQ ID NO: 750858 - protein, 25 aa, Mycobacterium
VVARIDWARFLPLYQQAGKRSFLEE

SEQ ID NO: 750859 - protein, 25 aa, Mycobacterium
VVARIDWARFLPLYQQAGRRAFLAE

SEQ ID NO: 750860 - protein, 23 aa, Mycobacterium
VVARLKARDVAVVEVSREHGIDL

SEQ ID NO: 750861 - protein, 18 aa, Mycobacterium
VVARLRAAALAVDSDGAQ

SEQ ID NO: 750862 - protein, 20 aa, Mycobacterium
VVARPKIRQPLGMGSYTEAA

SEQ ID NO: 750863 - protein, 18 aa, Mycobacterium
VVARQLWRDSGLKPQDIQ

SEQ ID NO: 750864 - protein, 25 aa, Mycobacterium
VVARVDWSRFLPLYQQAGRRGFLAE

SEQ ID NO: 750865 - protein, 18 aa, Mycobacterium
VVARYQGAIAVRFDDPLA

SEQ ID NO: 750866 - protein, 18 aa, Mycobacterium
VVASFALTEPGAGSNPAG

SEQ ID NO: 750867 - protein, 23 aa, Mycobacterium
VVASGFGRKAQWFRNIAANPRVR

SEQ ID NO: 750868 - protein, 25 aa, Mycobacterium
VVASKWIPFGPVMTSRAQWLEDVGL

SEQ ID NO: 750869 - protein, 17 aa, Mycobacterium
VVATAFPHAVELLSSGA

SEQ ID NO: 750870 - protein, 18 aa, Mycobacterium
VVATETFAPILYVLTYDR

SEQ ID NO: 750871 - protein, 24 aa, Mycobacterium
VVATGAWTRPFLAPYGVDIPIRVI

SEQ ID NO: 750872 - protein, 24 aa, Mycobacterium
VVATPIMRWLHDFDGPVDEYNQTV

SEQ ID NO: 750873 - protein, 20 aa, Mycobacterium
VVAVARPLLPAAIESTAAVV

SEQ ID NO: 750874 - protein, 19 aa, Mycobacterium
VVAVGRNAERLQWLRSAGA

SEQ ID NO: 750875 - protein, 24 aa, Mycobacterium
VVAVGVAWHAGVGMYPWLPTNMGN

SEQ ID NO: 750876 - protein, 23 aa, Mycobacterium
VVAVREAYHGWTYGTDAVSTSTA

SEQ ID NO: 750877 - protein, 25 aa, Mycobacterium
VVAVRRGKARLVLRRETVDDLLSLE

SEQ ID NO: 750878 - protein, 20 aa, Mycobacterium
VVAVTRWTVRLAESGWGNTV

SEQ ID NO: 750879 - protein, 18 aa, Mycobacterium
VVAYERWEQLPAHDQGQH

SEQ ID NO: 750880 - protein, 18 aa, Mycobacterium
VVAYPGSSWLDMLRPKPS

SEQ ID NO: 750881 - protein, 24 aa, Mycobacterium
VVAYRLSGSLAMPVAITRSNCAGT

SEQ ID NO: 750882 - protein, 21 aa, Mycobacterium
VVCAIPARYITPVSEKKPKPL

SEQ ID NO: 750883 - protein, 21 aa, Mycobacterium
VVCAVDAVVARQLIPDLPEAM

SEQ ID NO: 750884 - protein, 18 aa, Mycobacterium
VVCDRVHQVLGRSDATQD

SEQ ID NO: 750885 - protein, 19 aa, Mycobacterium
VVCFPERWLDLRYVGPAKD

SEQ ID NO: 750886 - protein, 19 aa, Mycobacterium
VVCFPERWLDLRYVGPGTG

SEQ ID NO: 750887 - protein, 20 aa, Mycobacterium
VVCGVQGWAAGLGANLALAA

SEQ ID NO: 750888 - protein, 19 aa, Mycobacterium
VVCHLARDAGAPSIVGQAL

SEQ ID NO: 750889 - protein, 19 aa, Mycobacterium
VVCLSCRYTISRAALAEQL

SEQ ID NO: 750890 - protein, 19 aa, Mycobacterium
VVCLVCRELAARHCEDPPT

SEQ ID NO: 750891 - protein, 30 aa, Mycobacterium
VVCPDGWSVAPARLPFTLGAGEYLEADVVL

SEQ ID NO: 750892 - protein, 18 aa, Mycobacterium
VVCPVCDGRHWIPTADTV

SEQ ID NO: 750893 - protein, 17 aa, Mycobacterium
VVCRKDDRHVIAVRNGD

SEQ ID NO: 750894 - protein, 21 aa, Mycobacterium
VVCRRELAEAVLAVTGVADRR

SEQ ID NO: 750895 - protein, 17 aa, Mycobacterium
VVCTLRERMAFPSTLIA

SEQ ID NO: 750896 - protein, 17 aa, Mycobacterium
VVCVGDIAALNVRIRLA

SEQ ID NO: 750897 - protein, 23 aa, Mycobacterium
VVCVQRFGPLIAEIPDTVRVIRQ

SEQ ID NO: 750898 - protein, 23 aa, Mycobacterium
VVCVSRLVPRKGQDMLIKALPAI

SEQ ID NO: 750899 - protein, 23 aa, Mycobacterium
VVDALARWGRRLVQTREPGDVLQ

SEQ ID NO: 750900 - protein, 21 aa, Mycobacterium
VVDARAWLRDPAPLFHTNVEG

SEQ ID NO: 750901 - protein, 27 aa, Mycobacterium
VVDARPWLRDPRPMWRTNVDGLRTVLD

SEQ ID NO: 750902 - protein, 18 aa, Mycobacterium
VVDAYPFERDADGYQSYV

SEQ ID NO: 750903 - protein, 25 aa, Mycobacterium
VVDAYRYWTRPAIVADIDTRRHPLH

SEQ ID NO: 750904 - protein, 24 aa, Mycobacterium
VVDCPMCGGMLKPDIVYFGDSVPK

SEQ ID NO: 750905 - protein, 20 aa, Mycobacterium
VVDDACLLPGMAYVDAALSV

SEQ ID NO: 750906 - protein, 19 aa, Mycobacterium
VVDDIFSRDPWRVRCLEIR

SEQ ID NO: 750907 - protein, 17 aa, Mycobacterium
VVDEIKAAGGRAVANYD

SEQ ID NO: 750908 - protein, 25 aa, Mycobacterium
VVDEIPRLPSGKVLRRVLRERAMGA

SEQ ID NO: 750909 - protein, 26 aa, Mycobacterium
VVDELPRGAALKVDRRRLIALLEDLG

SEQ ID NO: 750910 - protein, 21 aa, Mycobacterium
VVDGCAPFVLFGMPDAERIRN

SEQ ID NO: 750911 - protein, 19 aa, Mycobacterium
VVDGCAPFVLFGVPDADEL

SEQ ID NO: 750912 - protein, 23 aa, Mycobacterium
VVDGHVRLPLREVMWGADPELLQ

SEQ ID NO: 750913 - protein, 25 aa, Mycobacterium
VVDGIRADCFWMMGPPTPADQVVSS

SEQ ID NO: 750914 - protein, 18 aa, Mycobacterium
VVDGPRFLAMREAVEQVS

SEQ ID NO: 750915 - protein, 24 aa, Mycobacterium
VVDGRGRLTGLITVKDFVKTEQHP

SEQ ID NO: 750916 - protein, 19 aa, Mycobacterium
VVDGTAWITGADETGRHVV

SEQ ID NO: 750917 - protein, 17 aa, Mycobacterium
VVDGVAWLTINRPEARN

SEQ ID NO: 750918 - protein, 25 aa, Mycobacterium
VVDHRDVFGLLGLVDEVGLVGADHR

SEQ ID NO: 750919 - protein, 23 aa, Mycobacterium
VVDIERAGLITGRVLDVGCGTGE

SEQ ID NO: 750920 - protein, 26 aa, Mycobacterium
VVDIISMHMGWGWGGYGVGPLKFAHQ

SEQ ID NO: 750921 - protein, 36 aa, Mycobacterium
VVDKRGHLHCPFNRMCEVVRRNDRRSAINAMDLALP

SEQ ID NO: 750922 - protein, 19 aa, Mycobacterium
VVDLPGLDWSTVKGEAEET

SEQ ID NO: 750923 - protein, 18 aa, Mycobacterium
VVDLRAGLIESWTPIPGR

SEQ ID NO: 750924 - protein, 20 aa, Mycobacterium
VVDNVIRWIGEEGPNAEGTR

SEQ ID NO: 750925 - protein, 19 aa, Mycobacterium
VVDNVRYFASLYGFGRQAA

SEQ ID NO: 750926 - protein, 25 aa, Mycobacterium
VVDPARRMAFNWAAGKGLGDYAEAP

SEQ ID NO: 750927 - protein, 29 aa, Mycobacterium
VVDPKIEPTFHAWSRIGAGAPVIFEAVGV

SEQ ID NO: 750928 - protein, 18 aa, Mycobacterium
VVDPRAAKRLAATVDARL

SEQ ID NO: 750929 - protein, 18 aa, Mycobacterium
VVDPVGFGRTAEGALEEL

SEQ ID NO: 750930 - protein, 18 aa, Mycobacterium
VVDQCVQLHGGYGYMLEY

SEQ ID NO: 750931 - protein, 18 aa, Mycobacterium
VVDRASGAVKWTATANDL

SEQ ID NO: 750932 - protein, 24 aa, Mycobacterium
VVDRCLSEGSAEWMVGGRTLTLKR

SEQ ID NO: 750933 - protein, 23 aa, Mycobacterium
VVDRCLTEGSAEWMVGGRTLTLK

SEQ ID NO: 750934 - protein, 23 aa, Mycobacterium
VVDRFGWTGPLGVTYPGVVTHGI

SEQ ID NO: 750935 - protein, 17 aa, Mycobacterium
VVDRGVAELGRLDIILA

SEQ ID NO: 750936 - protein, 19 aa, Mycobacterium
VVDRIPLGPFAIRTSYRAR

SEQ ID NO: 750937 - protein, 19 aa, Mycobacterium
VVDRIPLGPLTIRTVYRAR

SEQ ID NO: 750938 - protein, 24 aa, Mycobacterium
VVDRLATRLPVALRQGRVRPLGLD

SEQ ID NO: 750939 - protein, 19 aa, Mycobacterium
VVDRLRKAGAVILGKTAMC

SEQ ID NO: 750940 - protein, 21 aa, Mycobacterium
VVDRWAPGRVMVNAYGPTEST

SEQ ID NO: 750941 - protein, 21 aa, Mycobacterium
VVDSFVYDFLDPVVNDPLNLE

SEQ ID NO: 750942 - protein, 26 aa, Mycobacterium
VVDTSLGWRFTNPRFAQMDAGIAADA

SEQ ID NO: 750943 - protein, 39 aa, Mycobacterium
VVDVMRKVFPLSIVQHFARIWLGGFNWIMYQVCRKAPGF

SEQ ID NO: 750944 - protein, 19 aa, Mycobacterium
VVDVWKGWADREGEVPWSA

SEQ ID NO: 750945 - protein, 17 aa, Mycobacterium
VVDYALRRRALLAEVYS

SEQ ID NO: 750946 - protein, 17 aa, Mycobacterium
VVDYALRRRSLLAEVYS

SEQ ID NO: 750947 - protein, 19 aa, Mycobacterium
VVDYKTNWLGTGDAPLTAA

SEQ ID NO: 750948 - protein, 26 aa, Mycobacterium
VVDYLGLKVGMMICYDVEFPENPRMA

SEQ ID NO: 750949 - protein, 24 aa, Mycobacterium
VVEAARFSSAFTFQYSKRPGTPAA

SEQ ID NO: 750950 - protein, 25 aa, Mycobacterium
VVEADWPLLAAAYRTRGSLHIVDDL

SEQ ID NO: 750951 - protein, 18 aa, Mycobacterium
VVEAELLRLDGRLPGLAG

SEQ ID NO: 750952 - protein, 18 aa, Mycobacterium
VVEAFLAASRGGDIASLL

SEQ ID NO: 750953 - protein, 20 aa, Mycobacterium
VVEALGGPGRNAAVTDAMPA

SEQ ID NO: 750954 - protein, 18 aa, Mycobacterium
VVEARPVAMFKMTDEAGG

SEQ ID NO: 750955 - protein, 24 aa, Mycobacterium
VVEAVKFLLRPDIDHLVGETIVAD

SEQ ID NO: 750956 - protein, 17 aa, Mycobacterium
VVEAVPRPDASVVDANQ

SEQ ID NO: 750957 - protein, 22 aa, Mycobacterium
VVEDVAWCYPDPPPESLPIKGF

SEQ ID NO: 750958 - protein, 25 aa, Mycobacterium
VVEEKRPLIELGLKDVLYGTAGAPM

SEQ ID NO: 750959 - protein, 19 aa, Mycobacterium
VVEELSCGVLFITHSIQEA

SEQ ID NO: 750960 - protein, 21 aa, Mycobacterium
VVEFWLMGTHRGYLGKIPPTG

SEQ ID NO: 750961 - protein, 28 aa, Mycobacterium
VVEGDAAARCGISMKGIDIVVGGNIGHM

SEQ ID NO: 750962 - protein, 28 aa, Mycobacterium
VVEGDAAARCGISMKGVDIVVGGNVGHM

SEQ ID NO: 750963 - protein, 22 aa, Mycobacterium
VVEGRWKGSIARIPAGQNGFGY

SEQ ID NO: 750964 - protein, 23 aa, Mycobacterium
VVEINEAFAPVVLAWAKELDVDL

SEQ ID NO: 750965 - protein, 23 aa, Mycobacterium
VVEINEAFAPVVLAWLKEIKADP

SEQ ID NO: 750966 - protein, 26 aa, Mycobacterium
VVELLRFCLEQGYQLRVIEQMPLDAG

SEQ ID NO: 750967 - protein, 25 aa, Mycobacterium
VVELLRSRIFFDWFDAVGVDDIPAV

SEQ ID NO: 750968 - protein, 18 aa, Mycobacterium
VVELPGLNWSAVEAEAQV

SEQ ID NO: 750969 - protein, 31 aa, Mycobacterium
VVELRRRGVTWSRIGAALGITRQSAWERFSG

SEQ ID NO: 750970 - protein, 29 aa, Mycobacterium
VVELRRSRPYWGPRRLVFELAKRRVSPVP

SEQ ID NO: 750971 - protein, 24 aa, Mycobacterium
VVELSLALHRVFESPYDPIIFDTG

SEQ ID NO: 750972 - protein, 17 aa, Mycobacterium
VVELVVLLASAGGLDAL

SEQ ID NO: 750973 - protein, 17 aa, Mycobacterium
VVEMQFDAFAYPAFEQV

SEQ ID NO: 750974 - protein, 25 aa, Mycobacterium
VVEPKYWGGVCLNVGCIPSKALLRN

SEQ ID NO: 750975 - protein, 25 aa, Mycobacterium
VVEPRKEWVLEFTIGAAPRSSAVVA

SEQ ID NO: 750976 - protein, 17 aa, Mycobacterium
VVEQAAVLGQTFDLPAL

SEQ ID NO: 750977 - protein, 26 aa, Mycobacterium
VVEQARFAGAFTFQYSKRPGTPAADM

SEQ ID NO: 750978 - protein, 19 aa, Mycobacterium
VVERNASVYIWHDVDRREP

SEQ ID NO: 750979 - protein, 27 aa, Mycobacterium
VVERRARWVVRVIVSMLLFPGHDEADE

SEQ ID NO: 750980 - protein, 18 aa, Mycobacterium
VVESALADLDCGRWRGSS

SEQ ID NO: 750981 - protein, 20 aa, Mycobacterium
VVESAQFKSMMKGFTTSEGG

SEQ ID NO: 750982 - protein, 22 aa, Mycobacterium
VVESICGHDGFLVETEAVGNLI

SEQ ID NO: 750983 - protein, 18 aa, Mycobacterium
VVESPPPAPPRWEYDADF

SEQ ID NO: 750984 - protein, 17 aa, Mycobacterium
VVETLTWRTRLIDDTQT

SEQ ID NO: 750985 - protein, 22 aa, Mycobacterium
VVETLVALATRFVEIRETAWRV

SEQ ID NO: 750986 - protein, 27 aa, Mycobacterium
VVETMVRPGLLTWRGVAKVMSEAPAAI

SEQ ID NO: 750987 - protein, 25 aa, Mycobacterium
VVEVYRPRLAGPVPQADEVVATAVR

SEQ ID NO: 750988 - protein, 23 aa, Mycobacterium
VVFAGAYHGWGFHEDGAASGLRA

SEQ ID NO: 750989 - protein, 23 aa, Mycobacterium
VVFEALAGMAARCRDAANGEVGQ

SEQ ID NO: 750990 - protein, 18 aa, Mycobacterium
VVFEALAGMAARRRDAAQ

SEQ ID NO: 750991 - protein, 17 aa, Mycobacterium
VVFECVGAPGLIQKLVE

SEQ ID NO: 750992 - protein, 20 aa, Mycobacterium
VVFEEEYFRAGAPGRASANG

SEQ ID NO: 750993 - protein, 18 aa, Mycobacterium
VVFGAGTRAECLDYVEAN

SEQ ID NO: 750994 - protein, 18 aa, Mycobacterium
VVFGAVAAVRAMRAGGAG

SEQ ID NO: 750995 - protein, 17 aa, Mycobacterium
VVFGDAFHTPAQLSHLH

SEQ ID NO: 750996 - protein, 18 aa, Mycobacterium
VVFGHEFVGRIAAYGPDT

SEQ ID NO: 750997 - protein, 18 aa, Mycobacterium
VVFHLAITPDRGYCLSVR

SEQ ID NO: 750998 - protein, 17 aa, Mycobacterium
VVFHLAITPDRGYCMSI

SEQ ID NO: 750999 - protein, 20 aa, Mycobacterium
VVFHPARRGFLRSQPERVQI

SEQ ID NO: 751000 - protein, 17 aa, Mycobacterium
VVFLHGGGWTVGDLDTY

SEQ ID NO: 751001 - protein, 24 aa, Mycobacterium
VVFNEFLPAVARMRALDPVISELV

SEQ ID NO: 751002 - protein, 17 aa, Mycobacterium
VVFNGHYLTWFDEACTG

SEQ ID NO: 751003 - protein, 25 aa, Mycobacterium
VVFQPDFDTAILLTRFLVGSWQYRR

SEQ ID NO: 751004 - protein, 24 aa, Mycobacterium
VVFQQPRLFPWRTVGGNVELALKY

SEQ ID NO: 751005 - protein, 17 aa, Mycobacterium
VVFVRYALPGERVRVRV

SEQ ID NO: 751006 - protein, 20 aa, Mycobacterium
VVGADRWGKYLGLRTDDLYL

SEQ ID NO: 751007 - protein, 24 aa, Mycobacterium
VVGAEVFRYYPYVPGEYLPEGTDL

SEQ ID NO: 751008 - protein, 19 aa, Mycobacterium
VVGAPQVRRAEAIRLGDYC

SEQ ID NO: 751009 - protein, 20 aa, Mycobacterium
VVGARLRWSASRADSCAGGG

SEQ ID NO: 751010 - protein, 24 aa, Mycobacterium
VVGARRTAEELGRAFPGAQVITSG

SEQ ID NO: 751011 - protein, 24 aa, Mycobacterium
VVGCGMAGPVMKMRAKIAAGTPIA

SEQ ID NO: 751012 - protein, 20 aa, Mycobacterium
VVGCGPGPFTGLRAGMATAA

SEQ ID NO: 751013 - protein, 20 aa, Mycobacterium
VVGCGPGPFTGLRVGMASAA

SEQ ID NO: 751014 - protein, 20 aa, Mycobacterium
VVGCGPGPFTGLRVGMATAA

SEQ ID NO: 751015 - protein, 21 aa, Mycobacterium
VVGCGPGPFTGLRVGMATAAA

SEQ ID NO: 751016 - protein, 17 aa, Mycobacterium
VVGCGPIGIAIIAALRA

SEQ ID NO: 751017 - protein, 21 aa, Mycobacterium
VVGDAFARVFGGSIVPQEVQA

SEQ ID NO: 751018 - protein, 18 aa, Mycobacterium
VVGDFAYPLPVAVICRLL

SEQ ID NO: 751019 - protein, 18 aa, Mycobacterium
VVGDKLWRDSGLKPQDIS

SEQ ID NO: 751020 - protein, 22 aa, Mycobacterium
VVGDVGGGWAVAMHLMQYERGM

SEQ ID NO: 751021 - protein, 27 aa, Mycobacterium
VVGECIECPFHGWRWGPEGTNTYIPYQ

SEQ ID NO: 751022 - protein, 17 aa, Mycobacterium
VVGELYLGGAQLARGYR

SEQ ID NO: 751023 - protein, 27 aa, Mycobacterium
VVGESMVDAAICDGDWVVVRQQNVADN

SEQ ID NO: 751024 - protein, 19 aa, Mycobacterium
VVGEVKIAFGLNQALFDEL

SEQ ID NO: 751025 - protein, 24 aa, Mycobacterium
VVGEVWLKGPAVTPGYWNLPNEQY

SEQ ID NO: 751026 - protein, 29 aa, Mycobacterium
VVGEWQLLADLSFADYLMWVARDDGALVC

SEQ ID NO: 751027 - protein, 33 aa, Mycobacterium
VVGEWQLLADLSFADYLMWVRRDDGHLVCVAQV

SEQ ID NO: 751028 - protein, 31 aa, Mycobacterium
VVGEWQLLADLSFADYLMWVRRDDGKLVCVA

SEQ ID NO: 751029 - protein, 33 aa, Mycobacterium
VVGEWQLLADLSFADYLMWVRRDDGVLVCVAQC

SEQ ID NO: 751030 - protein, 34 aa, Mycobacterium
VVGEWQLLADLSFADYLMWVRRDDGVLVCVAQCR

SEQ ID NO: 751031 - protein, 17 aa, Mycobacterium
VVGFIWQVLGRIGVGRK

SEQ ID NO: 751032 - protein, 20 aa, Mycobacterium
VVGFLDGWRGLLEDRRIQLA

SEQ ID NO: 751033 - protein, 25 aa, Mycobacterium
VVGGARIALSRGLRPDRFLNEVRRY

SEQ ID NO: 751034 - protein, 17 aa, Mycobacterium
VVGGGPMSVEFSTILAG

SEQ ID NO: 751035 - protein, 18 aa, Mycobacterium
VVGGRCRTVAEDGYEFVA

SEQ ID NO: 751036 - protein, 23 aa, Mycobacterium
VVGGRRFPGLAVDVGNPHLACLD

SEQ ID NO: 751037 - protein, 25 aa, Mycobacterium
VVGHGLNSVEVISAVTNYLKSSQSA

SEQ ID NO: 751038 - protein, 24 aa, Mycobacterium
VVGHRRSLLPAGITAVAGKFFGGD

SEQ ID NO: 751039 - protein, 18 aa, Mycobacterium
VVGHRWLTDHSWNRPSWT

SEQ ID NO: 751040 - protein, 24 aa, Mycobacterium
VVGHSFGGALAMRLAAARPDRVAA

SEQ ID NO: 751041 - protein, 17 aa, Mycobacterium
VVGHSMGGFVVQKYLED

SEQ ID NO: 751042 - protein, 18 aa, Mycobacterium
VVGIFTFPGHGYTPGHRA

SEQ ID NO: 751043 - protein, 20 aa, Mycobacterium
VVGIPLGILARYGHEPNQDI

SEQ ID NO: 751044 - protein, 31 aa, Mycobacterium
VVGKSPIVARGWRSPLQLLFIDGGHTEAAAA

SEQ ID NO: 751045 - protein, 18 aa, Mycobacterium
VVGKSPVVASGWRAPLRF

SEQ ID NO: 751046 - protein, 20 aa, Mycobacterium
VVGLAARFSPERVEVATGVP

SEQ ID NO: 751047 - protein, 17 aa, Mycobacterium
VVGLAGFQGRYPNQLSG

SEQ ID NO: 751048 - protein, 24 aa, Mycobacterium
VVGLEKLGGIPIVRFDNLNGMGEY

SEQ ID NO: 751049 - protein, 30 aa, Mycobacterium
VVGLELARRLAREWLGYEFDPTSKSAEKVQ

SEQ ID NO: 751050 - protein, 24 aa, Mycobacterium
VVGLNIPTGIPLRYDLDENLKPVK

SEQ ID NO: 751051 - protein, 19 aa, Mycobacterium
VVGLTYPLSNLLLGVSNAL

SEQ ID NO: 751052 - protein, 21 aa, Mycobacterium
VVGLVAIPWAQGDRSGVAFRA

SEQ ID NO: 751053 - protein, 18 aa, Mycobacterium
VVGMAGRFPGANDLSTFW

SEQ ID NO: 751054 - protein, 18 aa, Mycobacterium
VVGMSLGGLTAIRLGALA

SEQ ID NO: 751055 - protein, 18 aa, Mycobacterium
VVGPRERGHFGGAAVSEI

SEQ ID NO: 751056 - protein, 19 aa, Mycobacterium
VVGPRERGHFGGAAVSEIY

SEQ ID NO: 751057 - protein, 27 aa, Mycobacterium
VVGPRHLRDPLLQFGRPLDVDARAAVV

SEQ ID NO: 751058 - protein, 17 aa, Mycobacterium
VVGPSFWGDGQYPPSDA

SEQ ID NO: 751059 - protein, 31 aa, Mycobacterium
VVGQIIPWNFPILMATWKLAPALAAGNAVVL

SEQ ID NO: 751060 - protein, 35 aa, Mycobacterium; identical to SEQ ID NO: 86021

SEQ ID NO: 751061 - protein, 31 aa, Mycobacterium
VVGQIIPWNFPLLMASWKLAPALAAGNTVVL

SEQ ID NO: 751062 - protein, 30 aa, Mycobacterium
VVGQIIPWNFPLLMATWKLAPALAAGNAVV

SEQ ID NO: 751063 - protein, 24 aa, Mycobacterium
VVGQLMHTLPIGWVEPEDIANAVL

SEQ ID NO: 751064 - protein, 19 aa, Mycobacterium
VVGQQLWAQSGLKPSDIQT

SEQ ID NO: 751065 - protein, 18 aa, Mycobacterium
VVGQRFSWVGHWSGRPLL

SEQ ID NO: 751066 - protein, 19 aa, Mycobacterium
VVGQSGLQQSLLIGLLTGG

SEQ ID NO: 751067 - protein, 23 aa, Mycobacterium
VVGRKALNYYSFRNRKVTEAWTG

SEQ ID NO: 751068 - protein, 30 aa, Mycobacterium
VVGRPLTERALLRFARAWELAEAPRRQPQI

SEQ ID NO: 751069 - protein, 19 aa, Mycobacterium
VVGRYCSQLPIAVISEILG

SEQ ID NO: 751070 - protein, 23 aa, Mycobacterium
VVGSRFDPMLAKVIVHAADRDTA

SEQ ID NO: 751071 - protein, 25 aa, Mycobacterium
VVGTACFRRYHLGRNGAAHGGAVAH

SEQ ID NO: 751072 - protein, 19 aa, Mycobacterium
VVGTDMWVEIDKRFAELTG

SEQ ID NO: 751073 - protein, 26 aa, Mycobacterium
VVGVLKGPLCSGVVLPGANLVIITET

SEQ ID NO: 751074 - protein, 22 aa, Mycobacterium
VVGVLRQRCDPVLVMAAQGQPL

SEQ ID NO: 751075 - protein, 22 aa, Mycobacterium
VVGWASGFDGMMERIVTDGDGL

SEQ ID NO: 751076 - protein, 21 aa, Mycobacterium
VVGWDFSWLEGRATEERPSWG

SEQ ID NO: 751077 - protein, 26 aa, Mycobacterium
VVGYRGEGAFSRVPFGSASTGLVNYA

SEQ ID NO: 751078 - protein, 18 aa, Mycobacterium
VVHAAAPCPPAIKRQMIE

SEQ ID NO: 751079 - protein, 21 aa, Mycobacterium
VVHAPDLHFLIFFDQPTPADV

SEQ ID NO: 751080 - protein, 18 aa, Mycobacterium
VVHGCEAFLPAMIESGRG

SEQ ID NO: 751081 - protein, 18 aa, Mycobacterium
VVHPRLKIIDSVLRAAIR

SEQ ID NO: 751082 - protein, 18 aa, Mycobacterium
VVHRAHCPVAVIRDEDPE

SEQ ID NO: 751083 - protein, 19 aa, Mycobacterium
VVHRLRALYRDHLLVLAAL

SEQ ID NO: 751084 - protein, 21 aa, Mycobacterium
VVHRRGRLRTMELEFEGGPSG

SEQ ID NO: 751085 - protein, 23 aa, Mycobacterium
VVHVIRNAMRFVSYKDRKKVATS

SEQ ID NO: 751086 - protein, 18 aa, Mycobacterium
VVHYGRIRALHGVSLVVH

SEQ ID NO: 751087 - protein, 18 aa, Mycobacterium
VVHYLHRPVPREDLIAFF

SEQ ID NO: 751088 - protein, 25 aa, Mycobacterium
VVIAIALSCRPELLLADEPTTALDA

SEQ ID NO: 751089 - protein, 24 aa, Mycobacterium
VVIARGHWPAVLGAISGDRGAAAY

SEQ ID NO: 751090 - protein, 17 aa, Mycobacterium
VVIARNYLLPRQSERAA

SEQ ID NO: 751091 - protein, 17 aa, Mycobacterium
VVIASGFDRPNIALEVF

SEQ ID NO: 751092 - protein, 22 aa, Mycobacterium
VVIDGVYHWRAYSLTSDPRPED

SEQ ID NO: 751093 - protein, 22 aa, Mycobacterium
VVIDGVYHWRAYSLTSDPVPED

SEQ ID NO: 751094 - protein, 17 aa, Mycobacterium
VVIEVKIERVLGSSDLL

SEQ ID NO: 751095 - protein, 19 aa, Mycobacterium
VVIGEPFLAAAETLRAAGY

SEQ ID NO: 751096 - protein, 19 aa, Mycobacterium
VVIGGGVAKAGRLLFDPLR

SEQ ID NO: 751097 - protein, 24 aa, Mycobacterium
VVIGIADARWGRRVHAVVQVAAPL

SEQ ID NO: 751098 - protein, 20 aa, Mycobacterium
VVIHDRLLRVLAYSRLQQHA

SEQ ID NO: 751099 - protein, 24 aa, Mycobacterium
VVIIGRRGPLQSAFTTLELRELGE

SEQ ID NO: 751100 - protein, 17 aa, Mycobacterium
VVIPDPCHQCMGDGRVR

SEQ ID NO: 751101 - protein, 25 aa, Mycobacterium
VVIPRRSVRAFAWVGSHAPRRMWLP

SEQ ID NO: 751102 - protein, 18 aa, Mycobacterium
VVIQEWIEGIPLSHIIRE

SEQ ID NO: 751103 - protein, 21 aa, Mycobacterium
VVIQPRSGSLIAVGNGSADTD

SEQ ID NO: 751104 - protein, 25 aa, Mycobacterium
VVISDFLGPINWMRPLRAIAARHEV

SEQ ID NO: 751105 - protein, 25 aa, Mycobacterium
VVISKAWPQREEFLAALRKAVDEAP

SEQ ID NO: 751106 - protein, 19 aa, Mycobacterium
VVISRLAHIIPLMRAQLEK

SEQ ID NO: 751107 - protein, 25 aa, Mycobacterium
VVITGDPDLDCTLAATLRDPGRAGI

SEQ ID NO: 751108 - protein, 24 aa, Mycobacterium
VVKAEPKMPLGVFINEDPPLHTVH

SEQ ID NO: 751109 - protein, 20 aa, Mycobacterium
VVKDAFGREGDQGVEFVKVA

SEQ ID NO: 751110 - protein, 17 aa, Mycobacterium
VVKIARWAALSAGSDVL

SEQ ID NO: 751111 - protein, 17 aa, Mycobacterium
VVKKLFAKVPRTQKIAR

SEQ ID NO: 751112 - protein, 21 aa, Mycobacterium
VVKLARIAGQYAKPRSSDTDA

SEQ ID NO: 751113 - protein, 23 aa, Mycobacterium
VVKLDRLDAEVPYLERVSPQQRA

SEQ ID NO: 751114 - protein, 25 aa, Mycobacterium
VVKQQGVWRISRWVVTADQTETGLP

SEQ ID NO: 751115 - protein, 23 aa, Mycobacterium
VVKRGPNVGSHFVLNQPVMTAGR

SEQ ID NO: 751116 - protein, 21 aa, Mycobacterium
VVKVARIAGQYAKPRSADTDA

SEQ ID NO: 751117 - protein, 22 aa, Mycobacterium
VVKVARIAGQYAKPRSADTDAL

SEQ ID NO: 751118 - protein, 20 aa, Mycobacterium
VVKVARIAGQYAKPRSSDVD

SEQ ID NO: 751119 - protein, 23 aa, Mycobacterium
VVKVARIAGQYAKPRSSDVDALG

SEQ ID NO: 751120 - protein, 18 aa, Mycobacterium
VVKVVGFVASAPGFHGQP

SEQ ID NO: 751121 - protein, 23 aa, Mycobacterium
VVLAEHRSSGLLIADERPLPSVD

SEQ ID NO: 751122 - protein, 18 aa, Mycobacterium
VVLAELTSVLGIEPAGVD

SEQ ID NO: 751123 - protein, 23 aa, Mycobacterium
VVLAEVFSLFGLFETQHQPMIAI

SEQ ID NO: 751124 - protein, 19 aa, Mycobacterium
VVLAHGFAAFRELRLDAYA

SEQ ID NO: 751125 - protein, 25 aa, Mycobacterium
VVLARRIGTAAAYLSAKRTGRGRAL

SEQ ID NO: 751126 - protein, 22 aa, Mycobacterium
VVLCASAIESVRILLNSRTATH

SEQ ID NO: 751127 - protein, 17 aa, Mycobacterium
VVLDAPEQRAAVAGAAR

SEQ ID NO: 751128 - protein, 17 aa, Mycobacterium
VVLDDQWTVITADGSRA

SEQ ID NO: 751129 - protein, 24 aa, Mycobacterium
VVLDPWGHFDGLRAWLSELADTGY

SEQ ID NO: 751130 - protein, 20 aa, Mycobacterium
VVLDYVWGPPTAKGMVDLVT

SEQ ID NO: 751131 - protein, 17 aa, Mycobacterium
VVLEFAATVDAEIGRRL

SEQ ID NO: 751132 - protein, 26 aa, Mycobacterium
VVLELGWGRLIFGQTFADPERLAEVL

SEQ ID NO: 751133 - protein, 19 aa, Mycobacterium
VVLERFPVPVLAIAEDGSI

SEQ ID NO: 751134 - protein, 22 aa, Mycobacterium
VVLESFPPCVVNIISGSGAVAG

SEQ ID NO: 751135 - protein, 25 aa, Mycobacterium
VVLETGNPVAMPWRDRVNAIVQAWY

SEQ ID NO: 751136 - protein, 23 aa, Mycobacterium
VVLFEALASFTIIADDVDWQQRM

SEQ ID NO: 751137 - protein, 18 aa, Mycobacterium
VVLGELHAALKALSAGHP

SEQ ID NO: 751138 - protein, 17 aa, Mycobacterium
VVLGGGLLVNQPGLVAD

SEQ ID NO: 751139 - protein, 19 aa, Mycobacterium
VVLGNTWFWPADTLTMKMF

SEQ ID NO: 751140 - protein, 23 aa, Mycobacterium
VVLGRLAVEAAKLLRGKHKPTFT

SEQ ID NO: 751141 - protein, 25 aa, Mycobacterium
VVLGRPVTARAFGAVARELAALGIN

SEQ ID NO: 751142 - protein, 20 aa, Mycobacterium
VVLGSGWAPAVAELGDPVGV

SEQ ID NO: 751143 - protein, 19 aa, Mycobacterium
VVLGSGWRPAADALGPPTA

SEQ ID NO: 751144 - protein, 27 aa, Mycobacterium
VVLHLGCGLDGRFFRLAPGPGVEWFDV

SEQ ID NO: 751145 - protein, 19 aa, Mycobacterium
VVLIDGELTWFVERGGRSL

SEQ ID NO: 751146 - protein, 18 aa, Mycobacterium
VVLISGERVIPQWVKIRN

SEQ ID NO: 751147 - protein, 24 aa, Mycobacterium
VVLKPAPDTPWCAAVLGELIADCT

SEQ ID NO: 751148 - protein, 24 aa, Mycobacterium
VVLKPAPDTPWCAAVLGELIAEHT

SEQ ID NO: 751149 - protein, 24 aa, Mycobacterium
VVLKPAPDTPWCGAVLGEIIADHT

SEQ ID NO: 751150 - protein, 23 aa, Mycobacterium
VVLKVLRFLGTLPILEPLLPLPG

SEQ ID NO: 751151 - protein, 26 aa, Mycobacterium
VVLLARRKLLLDEVVEIIGPSAVPIV

SEQ ID NO: 751152 - protein, 18 aa, Mycobacterium
VVLLDGFAGRGRYPDGKP

SEQ ID NO: 751153 - protein, 25 aa, Mycobacterium
VVLLKTRLRQGLPHDVLNPAERRRA

SEQ ID NO: 751154 - protein, 26 aa, Mycobacterium
VVLLPRPLPTPVLAFAVRQVDAAAGI

SEQ ID NO: 751155 - protein, 26 aa, Mycobacterium
VVLLSFPQTFSGYFAPAGVNGVLGIG

SEQ ID NO: 751156 - protein, 23 aa, Mycobacterium
VVLLSPRPGRIVEEIAVPVARRH

SEQ ID NO: 751157 - protein, 18 aa, Mycobacterium
VVLNELLERAGVGPEIVD

SEQ ID NO: 751158 - protein, 31 aa, Mycobacterium
VVLNLWRPGWLPWVIHAMRLGAGVRDGIPTA

SEQ ID NO: 751159 - protein, 20 aa, Mycobacterium
VVLPARYEPSSEFVLQAMAC

SEQ ID NO: 751160 - protein, 24 aa, Mycobacterium
VVLPDAPVKIFLTASAETRARRRN

SEQ ID NO: 751161 - protein, 33 aa, Mycobacterium
VVLPPARASVRWDVVKTDGWSSSRLEEAIEAAA

SEQ ID NO: 751162 - protein, 17 aa, Mycobacterium
VVLPRLEIPPLLVELVQ

SEQ ID NO: 751163 - protein, 22 aa, Mycobacterium
VVLREILRRVDLATTTAPDERY

SEQ ID NO: 751164 - protein, 20 aa, Mycobacterium
VVLREILRRVDLQTTTAPGE

SEQ ID NO: 751165 - protein, 25 aa, Mycobacterium
VVLREILRRVELCPTTAVDERQKLK

SEQ ID NO: 751166 - protein, 18 aa, Mycobacterium
VVLREILRRVELDTTAAP

SEQ ID NO: 751167 - protein, 23 aa, Mycobacterium
VVLREILRRVELNTTTAPDEKQQ

SEQ ID NO: 751168 - protein, 17 aa, Mycobacterium
VVLRPGVETLDLEQRER

SEQ ID NO: 751169 - protein, 17 aa, Mycobacterium
VVLRSPFLRDLTEMETS

SEQ ID NO: 751170 - protein, 20 aa, Mycobacterium
VVLRTWQTAHVMKRRRGTLP

SEQ ID NO: 751171 - protein, 25 aa, Mycobacterium
VVLSWAAVHKPDFDRVNVNGGAIAL

SEQ ID NO: 751172 - protein, 25 aa, Mycobacterium
VVLTEEPFPRFSVVRTTNGRPTLGP

SEQ ID NO: 751173 - protein, 18 aa, Mycobacterium
VVLTEGWQAGGGGLKIPP

SEQ ID NO: 751174 - protein, 25 aa, Mycobacterium
VVMAGFPGTVASFWQQAGRSGRRGQ

SEQ ID NO: 751175 - protein, 24 aa, Mycobacterium
VVMCGDNRMSLSVSQLRNDLLHDV

SEQ ID NO: 751176 - protein, 25 aa, Mycobacterium
VVMGCLPLFHVFGLTCGLNASVIAG

SEQ ID NO: 751177 - protein, 27 aa, Mycobacterium
VVMKRMGIGGIYLGGWATSAKGSISED

SEQ ID NO: 751178 - protein, 18 aa, Mycobacterium
VVMLGEYPGRAVITVERL

SEQ ID NO: 751179 - protein, 25 aa, Mycobacterium
VVMSFSAAAVWRIRRAAPLLPTVLL

SEQ ID NO: 751180 - protein, 24 aa, Mycobacterium
VVMSPRPGRIVEMLDVDLPAERTY

SEQ ID NO: 751181 - protein, 19 aa, Mycobacterium
VVMTDGLPWTWETFPDYLN

SEQ ID NO: 751182 - protein, 19 aa, Mycobacterium
VVMVARPRLPAGVSSVGTV

SEQ ID NO: 751183 - protein, 30 aa, Mycobacterium
VVNAPAQALLGRPLIGNGANGADGTGAAGG

SEQ ID NO: 751184 - protein, 19 aa, Mycobacterium
VVNGFGFEAGKPLASSNRI

SEQ ID NO: 751185 - protein, 20 aa, Mycobacterium
VVNGRKVWISKAVESDKILL

SEQ ID NO: 751186 - protein, 19 aa, Mycobacterium
VVNLLSWRYRDPGLLLAER

SEQ ID NO: 751187 - protein, 18 aa, Mycobacterium
VVNLLSWRYRDPGLLLAG

SEQ ID NO: 751188 - protein, 19 aa, Mycobacterium
VVNLRRLDSGIGMAAEGDQ

SEQ ID NO: 751189 - protein, 25 aa, Mycobacterium
VVNPCLSGGALEIFLTPQLPAPLIR

SEQ ID NO: 751190 - protein, 26 aa, Mycobacterium
VVNPDAGLVLREVGLEVLGSARRVVV

SEQ ID NO: 751191 - protein, 20 aa, Mycobacterium
VVNQLHWLIIILDSYPPVPH

SEQ ID NO: 751192 - protein, 17 aa, Mycobacterium
VVNRARQQVVRFTEDSF

SEQ ID NO: 751193 - protein, 19 aa, Mycobacterium
VVNRSLPRGKRLAENIRGY

SEQ ID NO: 751194 - protein, 24 aa, Mycobacterium
VVNSRSAAMGVGFAALAAARAAGA

SEQ ID NO: 751195 - protein, 18 aa, Mycobacterium
VVNYRLLPKHSIGMALDD

SEQ ID NO: 751196 - protein, 24 aa, Mycobacterium
VVPACASYDCVTIFAADLPTAQAA

SEQ ID NO: 751197 - protein, 17 aa, Mycobacterium
VVPADLAPDSAWTRRNP

SEQ ID NO: 751198 - protein, 17 aa, Mycobacterium
VVPAERADFGWRVVDAL

SEQ ID NO: 751199 - protein, 18 aa, Mycobacterium
VVPASRWPNPPAGVAAEN

SEQ ID NO: 751200 - protein, 26 aa, Mycobacterium
VVPEAKRFCWNCGKPVGRSSKGVKGE

SEQ ID NO: 751201 - protein, 18 aa, Mycobacterium
VVPEFPGLDGIDYMTNTG

SEQ ID NO: 751202 - protein, 19 aa, Mycobacterium
VVPEFPMSRAPGCPFAPPP

SEQ ID NO: 751203 - protein, 23 aa, Mycobacterium
VVPEHLVIIGGSYIALEFAQMYR

SEQ ID NO: 751204 - protein, 19 aa, Mycobacterium
VVPEHPFLLLGQTTTADPT

SEQ ID NO: 751205 - protein, 19 aa, Mycobacterium
VVPELPKTRSGKIMRRLLR

SEQ ID NO: 751206 - protein, 17 aa, Mycobacterium
VVPEVAAGPALVVATPG

SEQ ID NO: 751207 - protein, 18 aa, Mycobacterium
VVPFGCLAEAAPPPETAV

SEQ ID NO: 751208 - protein, 32 aa, Mycobacterium; identical to SEQ ID NO: 86032

SEQ ID NO: 751209 - protein, 20 aa, Mycobacterium
VVPFRPHRGIVLIVEEPTGT

SEQ ID NO: 751210 - protein, 21 aa, Mycobacterium
VVPFRPHRGVVLIVEEPTDGR

SEQ ID NO: 751211 - protein, 23 aa, Mycobacterium
VVPGIYQVRGFDISNISFVEGDT

SEQ ID NO: 751212 - protein, 18 aa, Mycobacterium
VVPGPCVLFAKLNPRIPR

SEQ ID NO: 751213 - protein, 23 aa, Mycobacterium
VVPGPVETPGLLGLAPAGREQEL

SEQ ID NO: 751214 - protein, 37 aa, Mycobacterium
VVPIGAPVPGAGVFVLDSWLRPVPPGTVGELYVAGAG

SEQ ID NO: 751215 - protein, 18 aa, Mycobacterium
VVPIKDVIRMAGHANHYL

SEQ ID NO: 751216 - protein, 22 aa, Mycobacterium
VVPIKDVIRMGGHANHYLAVFD

SEQ ID NO: 751217 - protein, 21 aa, Mycobacterium
VVPKLRGKPIFEYLADEGELA

SEQ ID NO: 751218 - protein, 21 aa, Mycobacterium
VVPKPLKGMPPFSGPQGPFAG

SEQ ID NO: 751219 - protein, 18 aa, Mycobacterium
VVPLDFLVVQLFDVYEFE

SEQ ID NO: 751220 - protein, 21 aa, Mycobacterium
VVPLDPALPVADQRARAGAAG

SEQ ID NO: 751221 - protein, 19 aa, Mycobacterium
VVPLFEWYRQLLPDRLHQI

SEQ ID NO: 751222 - protein, 25 aa, Mycobacterium
VVPLGAPVPGAALFVLDGWLRPVPP

SEQ ID NO: 751223 - protein, 19 aa, Mycobacterium
VVPLGWPIGKYGPTTRRPV

SEQ ID NO: 751224 - protein, 24 aa, Mycobacterium
VVPLKAAGIGLDIVPDVGPVIDNP

SEQ ID NO: 751225 - protein, 17 aa, Mycobacterium
VVPLPGFVLKRAVKGTV

SEQ ID NO: 751226 - protein, 22 aa, Mycobacterium
VVPLRARIAERLDQSGPTVSQT

SEQ ID NO: 751227 - protein, 19 aa, Mycobacterium
VVPLVLRLSPELTVAEFCR

SEQ ID NO: 751228 - protein, 22 aa, Mycobacterium
VVPMREDMCILLAARRVPAALK

SEQ ID NO: 751229 - protein, 22 aa, Mycobacterium
VVPMREDMCIMLAARKTAGALK

SEQ ID NO: 751230 - protein, 23 aa, Mycobacterium
VVPMTRPTLRETIARLAPGTPLR

SEQ ID NO: 751231 - protein, 23 aa, Mycobacterium
VVPPCTITADLAREGLAILDRAL

SEQ ID NO: 751232 - protein, 17 aa, Mycobacterium
VVPPGVVQLRLVSTASH

SEQ ID NO: 751233 - protein, 17 aa, Mycobacterium
VVPPQYRELLAAQTTNA

SEQ ID NO: 751234 - protein, 22 aa, Mycobacterium
VVPQLARYVTAWPRDLDVEAMT

SEQ ID NO: 751235 - protein, 21 aa, Mycobacterium
VVPRASMPKFLSAARALAAAA

SEQ ID NO: 751236 - protein, 17 aa, Mycobacterium
VVPRASMPKFLSTAKGL

SEQ ID NO: 751237 - protein, 21 aa, Mycobacterium
VVPRGAMPKFLSAARGLAAAA

SEQ ID NO: 751238 - protein, 28 aa, Mycobacterium
VVPRRGGDKLAFAKGFMVRRDPDLEATA

SEQ ID NO: 751239 - protein, 19 aa, Mycobacterium
VVPRRRVRRAGHPGRRRGR

SEQ ID NO: 751240 - protein, 30 aa, Mycobacterium
VVPSPPPAPPRWEHYRDFDLGYHLRRTTIS

SEQ ID NO: 751241 - protein, 25 aa, Mycobacterium
VVPSRRVAMPLSWDDPSAREAMERY

SEQ ID NO: 751242 - protein, 21 aa, Mycobacterium
VVPTGGDWVRPEVVRRLRVEA

SEQ ID NO: 751243 - protein, 24 aa, Mycobacterium
VVPTPRLFGIPAIADTLDTIAAGY

SEQ ID NO: 751244 - protein, 17 aa, Mycobacterium
VVPTRVGVDVPVAVVGM

SEQ ID NO: 751245 - protein, 17 aa, Mycobacterium
VVPTVPIEMIWQNGRPP

SEQ ID NO: 751246 - protein, 18 aa, Mycobacterium
VVPVFNWQYGGWGYWFFG

SEQ ID NO: 751247 - protein, 22 aa, Mycobacterium
VVPVLRKRGLFRHEYTGTTLRA

SEQ ID NO: 751248 - protein, 29 aa, Mycobacterium
VVPVPGLRYTEAEWARMLAKQAELQAELD

SEQ ID NO: 751249 - protein, 24 aa, Mycobacterium
VVPVPPAYMGFHLSNLWGESLDYA

SEQ ID NO: 751250 - protein, 23 aa, Mycobacterium
VVPYAELHAHSAFSFLDGASLPE

SEQ ID NO: 751251 - protein, 35 aa, Mycobacterium
VVPYDFALDRELWRWVPEHISLHLTRTPHVPLSVT

SEQ ID NO: 751252 - protein, 27 aa, Mycobacterium
VVPYLHFEGLRTLALPLRIHLESAGFG

SEQ ID NO: 751253 - protein, 18 aa, Mycobacterium
VVPYYPYFSFVQRPFEMS

SEQ ID NO: 751254 - protein, 32 aa, Mycobacterium
VVQAAIAVLKAWDWERRPVAVMGLDSDTHPRL

SEQ ID NO: 751255 - protein, 25 aa, Mycobacterium
VVQGIWRLGAAMTMLQQPTSQADLA

SEQ ID NO: 751256 - protein, 25 aa, Mycobacterium
VVQKARFTSAFTFQYSPRPGTPAAD

SEQ ID NO: 751257 - protein, 24 aa, Mycobacterium
VVQPRSGFDTHPHRDMEIVTWVLE

SEQ ID NO: 751258 - protein, 25 aa, Mycobacterium
VVQQIWMPYHWGYSGLVDGDVVNDL

SEQ ID NO: 751259 - protein, 23 aa, Mycobacterium
VVQRLELVRRIGLVIDDDVVELG

SEQ ID NO: 751260 - protein, 25 aa, Mycobacterium
VVQRLEMVRRISLEIDADVVELGTD

SEQ ID NO: 751261 - protein, 26 aa, Mycobacterium
VVQRLEMVRRISLELDSDVVELGTDG

SEQ ID NO: 751262 - protein, 24 aa, Mycobacterium
VVQRMRLQPGRMFLVDTAQGRIVS

SEQ ID NO: 751263 - protein, 17 aa, Mycobacterium
VVQRMWAKPAVTVIGID

SEQ ID NO: 751264 - protein, 18 aa, Mycobacterium
VVQRRVGTEWAANRITVA

SEQ ID NO: 751265 - protein, 18 aa, Mycobacterium
VVQRVITDLGVFDVTGTE

SEQ ID NO: 751266 - protein, 19 aa, Mycobacterium
VVQTCIRYSPDQRCRFCTI

SEQ ID NO: 751267 - protein, 18 aa, Mycobacterium
VVQYHFGDLGGLLMAVVD

SEQ ID NO: 751268 - protein, 21 aa, Mycobacterium
VVRAADGWVGINCLTGQHWLD

SEQ ID NO: 751269 - protein, 24 aa, Mycobacterium
VVRAEVALLKILALQFIMSDPRHL

SEQ ID NO: 751270 - protein, 17 aa, Mycobacterium
VVRAFAGIGTAALDPFV

SEQ ID NO: 751271 - protein, 17 aa, Mycobacterium
VVRAFAGVGSAALDPFV

SEQ ID NO: 751272 - protein, 18 aa, Mycobacterium
VVRAGGARRSARVVCYDD

SEQ ID NO: 751273 - protein, 18 aa, Mycobacterium
VVRAGRRLIVTAVDVTDA

SEQ ID NO: 751274 - protein, 18 aa, Mycobacterium
VVRALEWTGDMFGNHEKF

SEQ ID NO: 751275 - protein, 19 aa, Mycobacterium
VVRARDILTRMPLPEPTDA

SEQ ID NO: 751276 - protein, 17 aa, Mycobacterium
VVRCLRERIPDLHFSVS

SEQ ID NO: 751277 - protein, 21 aa, Mycobacterium
VVRDFSWTGPVGVTYPGVIVR

SEQ ID NO: 751278 - protein, 22 aa, Mycobacterium
VVREAFRKHLLVNALEQDGQVW

SEQ ID NO: 751279 - protein, 18 aa, Mycobacterium
VVREGLSADLARALHDDA

SEQ ID NO: 751280 - protein, 19 aa, Mycobacterium
VVRELFSGIASEIIEVEPQ

SEQ ID NO: 751281 - protein, 17 aa, Mycobacterium
VVRERLEVALGVVPVEG

SEQ ID NO: 751282 - protein, 19 aa, Mycobacterium
VVRERLVELQRAMAAGPDR

SEQ ID NO: 751283 - protein, 19 aa, Mycobacterium
VVRGEACADSFYAALESAV

SEQ ID NO: 751284 - protein, 19 aa, Mycobacterium
VVRGEACADSFYGAFEAAA

SEQ ID NO: 751285 - protein, 19 aa, Mycobacterium
VVRGEACADSFYTAFESAV

SEQ ID NO: 751286 - protein, 26 aa, Mycobacterium
VVRGKAALRRYWIAALERIPDLRFTV

SEQ ID NO: 751287 - protein, 25 aa, Mycobacterium
VVRGPGADDCAIWCSAIGGDGYGRF

SEQ ID NO: 751288 - protein, 26 aa, Mycobacterium
VVRIAAPCRLLDDWIAPGAARAMHNR

SEQ ID NO: 751289 - protein, 18 aa, Mycobacterium
VVRIVALLVQPVMPESAA

SEQ ID NO: 751290 - protein, 17 aa, Mycobacterium
VVRKDTHAHAWALRMSP

SEQ ID NO: 751291 - protein, 23 aa, Mycobacterium
VVRKRVEGIGFFAGLLGQHTVDA

SEQ ID NO: 751292 - protein, 17 aa, Mycobacterium
VVRKYPVVPGIDLTGEV

SEQ ID NO: 751293 - protein, 18 aa, Mycobacterium
VVRLARKYFKSHLDSSVR

SEQ ID NO: 751294 - protein, 20 aa, Mycobacterium
VVRLLRRLGCEVEFPAEQTC

SEQ ID NO: 751295 - protein, 24 aa, Mycobacterium
VVRLRPGPRQTFRELLAQTRDSAV

SEQ ID NO: 751296 - protein, 20 aa, Mycobacterium
VVRMPARYSSFDAVAAEPPP

SEQ ID NO: 751297 - protein, 24 aa, Mycobacterium
VVRPIGFEPLAWVRALAAEDPVPS

SEQ ID NO: 751298 - protein, 23 aa, Mycobacterium
VVRPIGFEPMRWIRALAAEEPLP

SEQ ID NO: 751299 - protein, 18 aa, Mycobacterium
VVRPSLQVAGLRLLQWRS

SEQ ID NO: 751300 - protein, 26 aa, Mycobacterium
VVRQARFAAAFTFQYSKRPGTPAADF

SEQ ID NO: 751301 - protein, 26 aa, Mycobacterium
VVRQARFAAAFTFQYSKRPGTPAAEL

SEQ ID NO: 751302 - protein, 25 aa, Mycobacterium
VVRQARFSAAFTFQYSKRPGTPAAE

SEQ ID NO: 751303 - protein, 21 aa, Mycobacterium
VVRRLKAAGAVIIGKTNTCEL

SEQ ID NO: 751304 - protein, 19 aa, Mycobacterium
VVRRLKAAGAVIVGKTNTC

SEQ ID NO: 751305 - protein, 17 aa, Mycobacterium
VVRRYGVAFERPGPRLR

SEQ ID NO: 751306 - protein, 17 aa, Mycobacterium
VVRSARMAAVTAILHSA

SEQ ID NO: 751307 - protein, 24 aa, Mycobacterium
VVRSVGALSEWLFWRSTKEVEDAQ

SEQ ID NO: 751308 - protein, 26 aa, Mycobacterium
VVRTGARQAFKYAVGEWTDVDGDEKR

SEQ ID NO: 751309 - protein, 19 aa, Mycobacterium
VVRVITSLLQFPGRDDADE

SEQ ID NO: 751310 - protein, 25 aa, Mycobacterium
VVRVLRPGGYFAYADLRPSNEIPDW

SEQ ID NO: 751311 - protein, 18 aa, Mycobacterium
VVRVRLVPGTGQFNLDGR

SEQ ID NO: 751312 - protein, 26 aa, Mycobacterium
VVRVSELPFVLPIVELGFDYPDYLLA

SEQ ID NO: 751313 - protein, 24 aa, Mycobacterium
VVRVSELPYIVPIVEHGFDPPNYV

SEQ ID NO: 751314 - protein, 21 aa, Mycobacterium
VVRYCRARVGTIERSGLTADD

SEQ ID NO: 751315 - protein, 17 aa, Mycobacterium
VVSAGFMRILGPQFLSR

SEQ ID NO: 751316 - protein, 17 aa, Mycobacterium
VVSANPREAEWLDVPHR

SEQ ID NO: 751317 - protein, 25 aa, Mycobacterium
VVSAPALGRRWWAGQGQGAFTSFAG

SEQ ID NO: 751318 - protein, 19 aa, Mycobacterium
VVSARGAWLTLIHDGQPIE

SEQ ID NO: 751319 - protein, 18 aa, Mycobacterium
VVSDFAYPLPVAVICRLL

SEQ ID NO: 751320 - protein, 25 aa, Mycobacterium
VVSELPLDRGWDLGRLYDPDPDRLG

SEQ ID NO: 751321 - protein, 22 aa, Mycobacterium
VVSERIAVAFGCEPPLRELLNG

SEQ ID NO: 751322 - protein, 19 aa, Mycobacterium
VVSGGFRRIIEPLAQELNL

SEQ ID NO: 751323 - protein, 19 aa, Mycobacterium
VVSGGFRRIIEPLARELNL

SEQ ID NO: 751324 - protein, 22 aa, Mycobacterium
VVSGRLEILAGDRIEILEQGDT

SEQ ID NO: 751325 - protein, 18 aa, Mycobacterium
VVSGWRADTFVAGAPEPR

SEQ ID NO: 751326 - protein, 19 aa, Mycobacterium
VVSHFSWSLSPTVLGDDFD

SEQ ID NO: 751327 - protein, 18 aa, Mycobacterium
VVSIFIADFVPRVRAGLQ

SEQ ID NO: 751328 - protein, 32 aa, Mycobacterium
VVSIFSRPDTGSGWVCHAEGTLSTGSVEPGAD

SEQ ID NO: 751329 - protein, 17 aa, Mycobacterium
VVSIRVMEPTAQYPHGY

SEQ ID NO: 751330 - protein, 22 aa, Mycobacterium
VVSLSSLAARRGRIHFDDLQFE

SEQ ID NO: 751331 - protein, 19 aa, Mycobacterium
VVSMLDVRAFKLWAALSGV

SEQ ID NO: 751332 - protein, 18 aa, Mycobacterium
VVSMPHGWGHDKPGTRMA

SEQ ID NO: 751333 - protein, 17 aa, Mycobacterium
VVSPRFGTPPAAELLRQ

SEQ ID NO: 751334 - protein, 19 aa, Mycobacterium
VVSRATWAVAQVLRGRGGA

SEQ ID NO: 751335 - protein, 17 aa, Mycobacterium
VVSREIGRPAVVGCGDG

SEQ ID NO: 751336 - protein, 17 aa, Mycobacterium
VVSRKCDVPFLYRFELM

SEQ ID NO: 751337 - protein, 24 aa, Mycobacterium
VVSRKCGVPYLYRFELMGTADDVA

SEQ ID NO: 751338 - protein, 18 aa, Mycobacterium
VVSRKLDKMGWRSSDTAE

SEQ ID NO: 751339 - protein, 19 aa, Mycobacterium
VVSRLRRAGAVLLGKLHMC

SEQ ID NO: 751340 - protein, 27 aa, Mycobacterium
VVSRPDHAVSIGMVFRALMGETELLRE

SEQ ID NO: 751341 - protein, 18 aa, Mycobacterium
VVSRRYRHAVGEHKVVIT

SEQ ID NO: 751342 - protein, 19 aa, Mycobacterium
VVSRWKAETSWAQRVSLAH

SEQ ID NO: 751343 - protein, 23 aa, Mycobacterium
VVSSLEMRNLQALGSPNTDNLAF

SEQ ID NO: 751344 - protein, 23 aa, Mycobacterium
VVSSRMLAAIARRHGATHVETLT

SEQ ID NO: 751345 - protein, 24 aa, Mycobacterium
VVSWGDARFGNLMFGPDQKVTGVF

SEQ ID NO: 751346 - protein, 24 aa, Mycobacterium
VVSWLGAGNVDWVRINGFGTPWWA

SEQ ID NO: 751347 - protein, 17 aa, Mycobacterium
VVTANLIRRDGVLAATL

SEQ ID NO: 751348 - protein, 19 aa, Mycobacterium
VVTAYACTSGSFVSGVTGE

SEQ ID NO: 751349 - protein, 18 aa, Mycobacterium
VVTDHVWHRGQQVGLVDV

SEQ ID NO: 751350 - protein, 20 aa, Mycobacterium
VVTDHVWRRGQEVGLVDVHP

SEQ ID NO: 751351 - protein, 19 aa, Mycobacterium
VVTEAPRTPVRSVAVRVHG

SEQ ID NO: 751352 - protein, 26 aa, Mycobacterium
VVTEGFLKQIYPGAVAKSMGFAIEDL

SEQ ID NO: 751353 - protein, 18 aa, Mycobacterium
VVTGAAPTGDRRDRWGNR

SEQ ID NO: 751354 - protein, 18 aa, Mycobacterium
VVTGECDPIRDWGERYAQ

SEQ ID NO: 751355 - protein, 17 aa, Mycobacterium
VVTGGTRGIGRAVVEGL

SEQ ID NO: 751356 - protein, 34 aa, Mycobacterium
VVTGHGAFILPVFRKARFLTLAMCEAEVAEKCVT

SEQ ID NO: 751357 - protein, 31 aa, Mycobacterium
VVTGHGAFVVPFFRKAAFLTLAMCESEVAEK

SEQ ID NO: 751358 - protein, 31 aa, Mycobacterium
VVTGHGSFVVPFFRKVRFLTLAMCEAEVAEK

SEQ ID NO: 751359 - protein, 18 aa, Mycobacterium
VVTGPVFVEGAQPGDVLK

SEQ ID NO: 751360 - protein, 21 aa, Mycobacterium
VVTGRAKVSVPLVGGKLEDLV

SEQ ID NO: 751361 - protein, 24 aa, Mycobacterium
VVTGRPSPRWGNEVVAIVQLAEGA

SEQ ID NO: 751362 - protein, 18 aa, Mycobacterium
VVTLGSRGARYAGADGEY

SEQ ID NO: 751363 - protein, 17 aa, Mycobacterium
VVTLRSKLLVGLAGPGG

SEQ ID NO: 751364 - protein, 18 aa, Mycobacterium
VVTLSFAGQTWWAAIEDI

SEQ ID NO: 751365 - protein, 21 aa, Mycobacterium
VVTMGDGWSAGALRDYENQAS

SEQ ID NO: 751366 - protein, 18 aa, Mycobacterium
VVTNWRIATHPVAHSVSD

SEQ ID NO: 751367 - protein, 19 aa, Mycobacterium
VVTPFRLYDCAPQSDGAAA

SEQ ID NO: 751368 - protein, 18 aa, Mycobacterium
VVTPNLRKWRIFERNDFS

SEQ ID NO: 751369 - protein, 18 aa, Mycobacterium
VVTPWLLAEPDRFAVLHG

SEQ ID NO: 751370 - protein, 18 aa, Mycobacterium
VVTRDLPVLREVFGDTVG

SEQ ID NO: 751371 - protein, 20 aa, Mycobacterium
VVTRDVRRAMTMLLVACPCA

SEQ ID NO: 751372 - protein, 19 aa, Mycobacterium
VVTRICLNVLQSARARHET

SEQ ID NO: 751373 - protein, 17 aa, Mycobacterium
VVTRMGLLDEMRARSLD

SEQ ID NO: 751374 - protein, 19 aa, Mycobacterium
VVTRPEFANPLGTLHGGIC

SEQ ID NO: 751375 - protein, 21 aa, Mycobacterium
VVTRRCFELGLHMNIVQLPGM

SEQ ID NO: 751376 - protein, 19 aa, Mycobacterium
VVTRREFAGMISVTIESGD

SEQ ID NO: 751377 - protein, 17 aa, Mycobacterium
VVTSLHLLGGARADANR

SEQ ID NO: 751378 - protein, 22 aa, Mycobacterium
VVTVSSMAHWPGRIRLDDLNWQ

SEQ ID NO: 751379 - protein, 22 aa, Mycobacterium
VVTVSSMAHWPGRISLDDLNWE

SEQ ID NO: 751380 - protein, 21 aa, Mycobacterium
VVTVSSMAHWTGRINLADLNY

SEQ ID NO: 751381 - protein, 28 aa, Mycobacterium
VVTYRLWRDLARGWRITMPNLEQTGQLR

SEQ ID NO: 751382 - protein, 17 aa, Mycobacterium
VVVAAGRPCQSCPNCRR

SEQ ID NO: 751383 - protein, 18 aa, Mycobacterium
VVVAAGRPCQSCPNCRRG

SEQ ID NO: 751384 - protein, 24 aa, Mycobacterium
VVVAALERLGRSAAEVTRTVADLT

SEQ ID NO: 751385 - protein, 21 aa, Mycobacterium
VVVAAPWPDPVDVLPPPHDNR

SEQ ID NO: 751386 - protein, 24 aa, Mycobacterium
VVVACSAISHASRQRAERRLPDTA

SEQ ID NO: 751387 - protein, 24 aa, Mycobacterium
VVVACSAISHASRQRAQRRLPDTP

SEQ ID NO: 751388 - protein, 23 aa, Mycobacterium
VVVACSAISRASRQRAQQRLPDT

SEQ ID NO: 751389 - protein, 17 aa, Mycobacterium
VVVAFVVGTGDPVDAAA

SEQ ID NO: 751390 - protein, 23 aa, Mycobacterium
VVVAGRLLAAVGANLPKGPECQV

SEQ ID NO: 751391 - protein, 24 aa, Mycobacterium
VVVAGRPSERWGQEVVAVVALAEG

SEQ ID NO: 751392 - protein, 24 aa, Mycobacterium
VVVAGRPSERWGQEVVAVVALDPD

SEQ ID NO: 751393 - protein, 24 aa, Mycobacterium
VVVAGRPSERWGQEVVAVVALDSG

SEQ ID NO: 751394 - protein, 17 aa, Mycobacterium
VVVALRDDLDLVLVDAS

SEQ ID NO: 751395 - protein, 34 aa, Mycobacterium
VVVAPVFGALLARGWRIFFAHRTFAWSSDAVGQA

SEQ ID NO: 751396 - protein, 18 aa, Mycobacterium
VVVAVRPGTNFTRTDSLN

SEQ ID NO: 751397 - protein, 20 aa, Mycobacterium
VVVCLSRLVPRKGQDMLIRA

SEQ ID NO: 751398 - protein, 18 aa, Mycobacterium
VVVDECHYYRGVFGSNVA

SEQ ID NO: 751399 - protein, 23 aa, Mycobacterium
VVVDGGGAPLGWIDAEGARRHRD

SEQ ID NO: 751400 - protein, 19 aa, Mycobacterium
VVVDGLRYGTAVRLGFGYD

SEQ ID NO: 751401 - protein, 18 aa, Mycobacterium
VVVEARWRADALAEMIAD

SEQ ID NO: 751402 - protein, 21 aa, Mycobacterium
VVVGHSFGGAVALRLSVVRPD

SEQ ID NO: 751403 - protein, 18 aa, Mycobacterium
VVVGLAVDEIGRPRPRAD

SEQ ID NO: 751404 - protein, 25 aa, Mycobacterium
VVVGLPMRCVFALTAMGFLPQPAEA

SEQ ID NO: 751405 - protein, 18 aa, Mycobacterium
VVVHLAFIKLGSRAESAQ

SEQ ID NO: 751406 - protein, 19 aa, Mycobacterium
VVVHPSWWPVARVGVVTRA

SEQ ID NO: 751407 - protein, 25 aa, Mycobacterium
VVVKGLMWRSHLDQFAYSEEQNRHL

SEQ ID NO: 751408 - protein, 17 aa, Mycobacterium
VVVKRGTGRPVAAPHLY

SEQ ID NO: 751409 - protein, 25 aa, Mycobacterium
VVVKRSVLTAHPWVANNLVDAFERA

SEQ ID NO: 751410 - protein, 22 aa, Mycobacterium
VVVLALRPSHAGPRSFATVLTA

SEQ ID NO: 751411 - protein, 23 aa, Mycobacterium
VVVLALRPSHVGTRSFVTVLRAV

SEQ ID NO: 751412 - protein, 18 aa, Mycobacterium
VVVLGHCHERISPLVDEL

SEQ ID NO: 751413 - protein, 20 aa, Mycobacterium
VVVLGRRGPLQATFTTLELR

SEQ ID NO: 751414 - protein, 21 aa, Mycobacterium
VVVLPDFGERYLSTALFADLS

SEQ ID NO: 751415 - protein, 20 aa, Mycobacterium
VVVLPDFGERYLSTPLFADL

SEQ ID NO: 751416 - protein, 19 aa, Mycobacterium
VVVLTRFAGFLADIGVESI

SEQ ID NO: 751417 - protein, 17 aa, Mycobacterium
VVVNPVLETSEVPETMP

SEQ ID NO: 751418 - protein, 17 aa, Mycobacterium
VVVNPVLETSQIPETMP

SEQ ID NO: 751419 - protein, 26 aa, Mycobacterium
VVVPAAHADFGWQVVDAGGWPGARLA

SEQ ID NO: 751420 - protein, 17 aa, Mycobacterium
VVVPACRLAAEQATQQW

SEQ ID NO: 751421 - protein, 25 aa, Mycobacterium
VVVPEVLEGLAALGVSTPVLAAGGI

SEQ ID NO: 751422 - protein, 17 aa, Mycobacterium
VVVPGFDFGDFALGAPT

SEQ ID NO: 751423 - protein, 23 aa, Mycobacterium
VVVRGVVHPAVLGRGALAHVSVM

SEQ ID NO: 751424 - protein, 17 aa, Mycobacterium
VVVRILGGYRAWQSGVD

SEQ ID NO: 751425 - protein, 18 aa, Mycobacterium
VVVSALFQGAFATVSGPA

SEQ ID NO: 751426 - protein, 18 aa, Mycobacterium
VVVSLEPFALGAFNDCSI

SEQ ID NO: 751427 - protein, 17 aa, Mycobacterium
VVVSWLPLFHDMGMMGF

SEQ ID NO: 751428 - protein, 25 aa, Mycobacterium
VVVTGRPSVRWGSEVVAIVQLAPGR

SEQ ID NO: 751429 - protein, 18 aa, Mycobacterium
VVVTGRRNAYQGVIRVET

SEQ ID NO: 751430 - protein, 19 aa, Mycobacterium
VVVVACLRGVIAPWPRIST

SEQ ID NO: 751431 - protein, 19 aa, Mycobacterium
VVVVACLRGVIPPWPTVAT

SEQ ID NO: 751432 - protein, 21 aa, Mycobacterium
VVVVGHSFGAGLAMHLAAARP

SEQ ID NO: 751433 - protein, 20 aa, Mycobacterium
VVVVGHSFGGAVALQLAAAH

SEQ ID NO: 751434 - protein, 17 aa, Mycobacterium
VVVVGMACRLPGGIESA

SEQ ID NO: 751435 - protein, 17 aa, Mycobacterium
VVVVHADMEVRLRRLVH

SEQ ID NO: 751436 - protein, 17 aa, Mycobacterium
VVVVRMGFLPAPCRVVY

SEQ ID NO: 751437 - protein, 18 aa, Mycobacterium
VVVYCHAGGFALGNLDTD

SEQ ID NO: 751438 - protein, 21 aa, Mycobacterium
VVVYHWGSPKIVSAGTANVVR

SEQ ID NO: 751439 - protein, 17 aa, Mycobacterium
VVWFGRLTAEKAPHLAI

SEQ ID NO: 751440 - protein, 19 aa, Mycobacterium
VVWLAGGLLKGASVDAEVA

SEQ ID NO: 751441 - protein, 27 aa, Mycobacterium
VVWVPWRRPGFQLGLDIADIKRRNPQA

SEQ ID NO: 751442 - protein, 27 aa, Mycobacterium
VVWVQLRPALLELKSHGGIIQGELSFA

SEQ ID NO: 751443 - protein, 21 aa, Mycobacterium
VVYFLRKLIWTVPDFTAEPYF

SEQ ID NO: 751444 - protein, 23 aa, Mycobacterium
VVYKARILGDWFINGKDPVPDLA

SEQ ID NO: 751445 - protein, 21 aa, Mycobacterium
VVYPHARPVPLPTYPFQHHRY

SEQ ID NO: 751446 - protein, 21 aa, Mycobacterium
VVYRAGIRRVARLVHALPPAP

SEQ ID NO: 751447 - protein, 23 aa, Mycobacterium
VVYRCAQPLLDRTVAVKVLTTDL

SEQ ID NO: 751448 - protein, 24 aa, Mycobacterium
VVYSFAVVHGFPGMPDLLLVPAVL

SEQ ID NO: 751449 - protein, 22 aa, Mycobacterium
VVYYHGGGWALGSLDTHDHVAR

SEQ ID NO: 751450 - protein, 28 aa, Mycobacterium
VWAAESGFLFPVLSDFWPHGAVSQAYGV

SEQ ID NO: 751451 - protein, 18 aa, Mycobacterium
VWAATRWVADNADQIGAD

SEQ ID NO: 751452 - protein, 18 aa, Mycobacterium
VWAEVDLGVIAARDRHGL

SEQ ID NO: 751453 - protein, 18 aa, Mycobacterium
VWAGHYGGDAVWDFSPGS

SEQ ID NO: 751454 - protein, 18 aa, Mycobacterium
VWAHLALDPPVAHSRPSI

SEQ ID NO: 751455 - protein, 18 aa, Mycobacterium
VWALMDFGFRVVISSRFG

SEQ ID NO: 751456 - protein, 19 aa, Mycobacterium
VWANRRLLLATADARRHGC

SEQ ID NO: 751457 - protein, 24 aa, Mycobacterium
VWAPLCAPCDVFAPTYEGSSDKHP

SEQ ID NO: 751458 - protein, 19 aa, Mycobacterium
VWAPSGCRPGDRRPVMVWV

SEQ ID NO: 751459 - protein, 25 aa, Mycobacterium
VWAWFSRPGAMPRLVPPWQPMTALV

SEQ ID NO: 751460 - protein, 22 aa, Mycobacterium
VWCDGRVVGAWAHDADGRVDVR

SEQ ID NO: 751461 - protein, 21 aa, Mycobacterium
VWDAWSARLAVDAGFAALTVG

SEQ ID NO: 751462 - protein, 23 aa, Mycobacterium
VWDMMGRPWLTRTAESALNPLIG

SEQ ID NO: 751463 - protein, 21 aa, Mycobacterium
VWDMMSQPWLTRTAEAALNPL

SEQ ID NO: 751464 - protein, 17 aa, Mycobacterium
VWDRLKGVIEGNGCVTH

SEQ ID NO: 751465 - protein, 23 aa, Mycobacterium
VWDVVRRVLKYAVKHGALDSNPA

SEQ ID NO: 751466 - protein, 25 aa, Mycobacterium
VWEICGALLHGGRLVIVPEPVTRAP

SEQ ID NO: 751467 - protein, 17 aa, Mycobacterium
VWELFWPDFPADGLYKF

SEQ ID NO: 751468 - protein, 18 aa, Mycobacterium
VWELFWPDFPTNGLYKFR

SEQ ID NO: 751469 - protein, 29 aa, Mycobacterium
VWELFWPGFPADGLYKFRVHGADGVVTDR

SEQ ID NO: 751470 - protein, 29 aa, Mycobacterium
VWELFWPGFPLEGLYKFRVHGADGVVTER

SEQ ID NO: 751471 - protein, 20 aa, Mycobacterium
VWELFWPGFPPDGLYKFRVH

SEQ ID NO: 751472 - protein, 24 aa, Mycobacterium
VWEPKTEKVRQLFADAGIRIPNQD

SEQ ID NO: 751473 - protein, 20 aa, Mycobacterium
VWESMVSALVDWWRHHPERS

SEQ ID NO: 751474 - protein, 29 aa, Mycobacterium
VWEWTASPLRPWPGFAPMIYQRYSQPFFD

SEQ ID NO: 751475 - protein, 30 aa, Mycobacterium
VWEWTASPLRPWPGFVPMIYERYSQPFFDG

SEQ ID NO: 751476 - protein, 19 aa, Mycobacterium
VWFDRAMVWAYAFNHEESI

SEQ ID NO: 751477 - protein, 22 aa, Mycobacterium
VWFGERWIDSILDLFKENVRYF

SEQ ID NO: 751478 - protein, 25 aa, Mycobacterium
VWFPYPGSNVVLCLGMCGQMIYVNR

SEQ ID NO: 751479 - protein, 18 aa, Mycobacterium
VWFQRGPLDEAIRASIAI

SEQ ID NO: 751480 - protein, 17 aa, Mycobacterium
VWFREPYLRTVIYRTAR

SEQ ID NO: 751481 - protein, 17 aa, Mycobacterium
VWGAFGLLAEMVAEGRS

SEQ ID NO: 751482 - protein, 22 aa, Mycobacterium
VWGDVELAWRLDAAGRYGPPRR

SEQ ID NO: 751483 - protein, 19 aa, Mycobacterium
VWGGVPRVWEKLRAGIEFA

SEQ ID NO: 751484 - protein, 19 aa, Mycobacterium
VWGIARFTDAAARENLEKS

SEQ ID NO: 751485 - protein, 19 aa, Mycobacterium
VWGIARFTDPTARQGLEAA

SEQ ID NO: 751486 - protein, 18 aa, Mycobacterium
VWGWDEAYVGARVSDPFA

SEQ ID NO: 751487 - protein, 25 aa, Mycobacterium
VWHLLCEDAESLALIGACGVRQVVV

SEQ ID NO: 751488 - protein, 18 aa, Mycobacterium
VWHRDPHGAWTFYATTPG

SEQ ID NO: 751489 - protein, 23 aa, Mycobacterium
VWHVGDKLAALRMDSVLLQGAGA

SEQ ID NO: 751490 - protein, 26 aa, Mycobacterium
VWKLGATPQPVSWRLPLAERRAIVEL

SEQ ID NO: 751491 - protein, 23 aa, Mycobacterium
VWKSYLKAHEELFLHAVKCFKDT

SEQ ID NO: 751492 - protein, 17 aa, Mycobacterium
VWLCDSFAGVPPPDVAN

SEQ ID NO: 751493 - protein, 18 aa, Mycobacterium
VWLDPRSDTYVVLLSNSI

SEQ ID NO: 751494 - protein, 25 aa, Mycobacterium
VWLEAGKQGFLGMAVPEEYGGGGNP

SEQ ID NO: 751495 - protein, 19 aa, Mycobacterium
VWLEPSLDGVVLHYFLHAE

SEQ ID NO: 751496 - protein, 25 aa, Mycobacterium
VWLREGLRFWMRTAITHQLFTWTTA

SEQ ID NO: 751497 - protein, 19 aa, Mycobacterium
VWLRVAGDESCARALSTAR

SEQ ID NO: 751498 - protein, 18 aa, Mycobacterium
VWLSHEYVRAAPGGIGAA

SEQ ID NO: 751499 - protein, 20 aa, Mycobacterium
VWLSNLLAWLTRRASATDVA

SEQ ID NO: 751500 - protein, 19 aa, Mycobacterium
VWMDLRPAAVSDDLADTLD

SEQ ID NO: 751501 - protein, 20 aa, Mycobacterium
VWNPEFLREGFAVQGTLHPD

SEQ ID NO: 751502 - protein, 20 aa, Mycobacterium
VWNPGFNQWGFWFFGVWIPL

SEQ ID NO: 751503 - protein, 21 aa, Mycobacterium
VWNQYRIASTVYYVNLSANRP

SEQ ID NO: 751504 - protein, 17 aa, Mycobacterium
VWPAYALKIAPTPTLAN

SEQ ID NO: 751505 - protein, 25 aa, Mycobacterium
VWPELRFQRRRGLARQDAWSGDAFA

SEQ ID NO: 751506 - protein, 27 aa, Mycobacterium
VWPQTVCKWRARFVKDRLDGLTDEPRP

SEQ ID NO: 751507 - protein, 19 aa, Mycobacterium
VWQAASLLLAYPDDELPGR

SEQ ID NO: 751508 - protein, 18 aa, Mycobacterium
VWQGCKLTDVTVSYTNGQ

SEQ ID NO: 751509 - protein, 20 aa, Mycobacterium
VWQHARSVLAQRGCDQATEA

SEQ ID NO: 751510 - protein, 19 aa, Mycobacterium
VWQRIVAAIKRDPYGRTAR

SEQ ID NO: 751511 - protein, 19 aa, Mycobacterium
VWQRIVVAIKRDPYGRTAR

SEQ ID NO: 751512 - protein, 21 aa, Mycobacterium
VWQRMGDAFLGAVAELKYGDI

SEQ ID NO: 751513 - protein, 24 aa, Mycobacterium
VWQVRASYESKPYRGHLIRTYGGV

SEQ ID NO: 751514 - protein, 19 aa, Mycobacterium
VWRALRASMRSVLEETSLS

SEQ ID NO: 751515 - protein, 19 aa, Mycobacterium
VWRALRASMRSVLEQTSLA

SEQ ID NO: 751516 - protein, 21 aa, Mycobacterium
VWRQPELKAAGAAMATTALAS

SEQ ID NO: 751517 - protein, 18 aa, Mycobacterium
VWRTEGYCHCMFTALDTL

SEQ ID NO: 751518 - protein, 25 aa, Mycobacterium
VWRTFAHERLEAMAGAATVPVVNAL

SEQ ID NO: 751519 - protein, 25 aa, Mycobacterium
VWRTFGQDRLDAMAGVATVPVINGL

SEQ ID NO: 751520 - protein, 19 aa, Mycobacterium
VWRTFGQDRLEAMAEAATV

SEQ ID NO: 751521 - protein, 24 aa, Mycobacterium
VWRTFGQDRLQAMASTATVPVVNA

SEQ ID NO: 751522 - protein, 21 aa, Mycobacterium
VWSERWRQRWAPATPVPVTTG

SEQ ID NO: 751523 - protein, 22 aa, Mycobacterium
VWSGRVNPRLAEVVADLPPGRA

SEQ ID NO: 751524 - protein, 30 aa, Mycobacterium
VWSMAAKLPPGWPMLVASWLAQAEGARGNA

SEQ ID NO: 751525 - protein, 19 aa, Mycobacterium
VWSVTSWSELNRDGVSVEK

SEQ ID NO: 751526 - protein, 18 aa, Mycobacterium
VWTEICAYGTAVQAVPVT

SEQ ID NO: 751527 - protein, 18 aa, Mycobacterium
VWTERGGPATIVPMFLLY

SEQ ID NO: 751528 - protein, 29 aa, Mycobacterium
VWTSAAHKARWGVCLARTDPDAPKHKGIT

SEQ ID NO: 751529 - protein, 28 aa, Mycobacterium
VWTSAAQKAHWGVCLARTDPEAAKHKGI

SEQ ID NO: 751530 - protein, 25 aa, Mycobacterium
VWTSLAHMCQWGLATVRTDPDAAKH

SEQ ID NO: 751531 - protein, 27 aa, Mycobacterium
VWTSYALMASWCVLAACTDPEAPKPKR

SEQ ID NO: 751532 - protein, 25 aa, Mycobacterium
VWTVGFCGFAPGFAYLVGGDPRLAI

SEQ ID NO: 751533 - protein, 20 aa, Mycobacterium
VWVAKLAVDFRQEFNKDVVI

SEQ ID NO: 751534 - protein, 24 aa, Mycobacterium
VWVARLAVDFRQRFNKDVIIDMLC

SEQ ID NO: 751535 - protein, 23 aa, Mycobacterium
VWVNCYHVYPAHSAFGGYKQSGI

SEQ ID NO: 751536 - protein, 23 aa, Mycobacterium
VWVPAAAPLPAVWVPGADLRAAD

SEQ ID NO: 751537 - protein, 25 aa, Mycobacterium
VWVRTDEQWRWLAHTLTVERLKELL

SEQ ID NO: 751538 - protein, 19 aa, Mycobacterium
VWVSGPAVVRGYLADPENT

SEQ ID NO: 751539 - protein, 19 aa, Mycobacterium
VWVSGRSALELKIAQRSRD

SEQ ID NO: 751540 - protein, 22 aa, Mycobacterium
VYACGPPALVDAVRELHPHAES

SEQ ID NO: 751541 - protein, 17 aa, Mycobacterium
VYADSTVIYPGHGDDTV

SEQ ID NO: 751542 - protein, 25 aa, Mycobacterium
VYAEDCTGCNLCVEACPAVVPGKPV

SEQ ID NO: 751543 - protein, 23 aa, Mycobacterium
VYAEDPAREFLPTGGTVALARFS

SEQ ID NO: 751544 - protein, 18 aa, Mycobacterium
VYAEDWVNLVALAVNEEN

SEQ ID NO: 751545 - protein, 23 aa, Mycobacterium
VYAEGLRALYLYATTFQDAVAAK

SEQ ID NO: 751546 - protein, 24 aa, Mycobacterium
VYAEHPFDVVGWDGCLYPYRFNIS

SEQ ID NO: 751547 - protein, 25 aa, Mycobacterium
VYAEIRFAPELHIDGGLSLDAVVEA

SEQ ID NO: 751548 - protein, 26 aa, Mycobacterium
VYAEIRFAPELHIDRGLSFDAIVDAV

SEQ ID NO: 751549 - protein, 19 aa, Mycobacterium
VYAEIRFAPELHINQGLTF

SEQ ID NO: 751550 - protein, 18 aa, Mycobacterium
VYAGALLIERASWEREVS

SEQ ID NO: 751551 - protein, 18 aa, Mycobacterium
VYAGSVVVRGRLVVTAEA

SEQ ID NO: 751552 - protein, 24 aa, Mycobacterium
VYALPSYFMAAATPLYSLSSILGM

SEQ ID NO: 751553 - protein, 18 aa, Mycobacterium
VYAPMPAWADGSAAHYVQ

SEQ ID NO: 751554 - protein, 27 aa, Mycobacterium
VYAPTFELGEWIIPQGYSIVVAIGQVH

SEQ ID NO: 751555 - protein, 24 aa, Mycobacterium
VYATGFGSMNGWAADLIGQDVADK

SEQ ID NO: 751556 - protein, 23 aa, Mycobacterium
VYATGYGSMNGWAADLIGQDVAD

SEQ ID NO: 751557 - protein, 18 aa, Mycobacterium
VYCALKSGSGCRVAILVP

SEQ ID NO: 751558 - protein, 19 aa, Mycobacterium
VYCASGPRHPELLDLATRL

SEQ ID NO: 751559 - protein, 21 aa, Mycobacterium
VYDAALAWAGRFREHPPEVLA

SEQ ID NO: 751560 - protein, 24 aa, Mycobacterium
VYDAARAAFRRAWGAEPIDMGMGG

SEQ ID NO: 751561 - protein, 18 aa, Mycobacterium
VYDAARAAFRRAWGTDPI

SEQ ID NO: 751562 - protein, 23 aa, Mycobacterium
VYDAGLAWVHFPVGLGGLDAPPA

SEQ ID NO: 751563 - protein, 21 aa, Mycobacterium
VYDAYRLPGFLGTQPQHPYVV

SEQ ID NO: 751564 - protein, 18 aa, Mycobacterium
VYDFVVCGSGSSGSVVAR

SEQ ID NO: 751565 - protein, 21 aa, Mycobacterium
VYDGVPLAGVTIRIEDSRISL

SEQ ID NO: 751566 - protein, 17 aa, Mycobacterium
VYDLCARALDALLPPGG

SEQ ID NO: 751567 - protein, 18 aa, Mycobacterium
VYDLVEWAAAQPWSTGAV

SEQ ID NO: 751568 - protein, 25 aa, Mycobacterium
VYDMPARAKEAFGIQKRQRQMDRCR

SEQ ID NO: 751569 - protein, 17 aa, Mycobacterium
VYDPNFRPRLTTAEDAR

SEQ ID NO: 751570 - protein, 26 aa, Mycobacterium
VYDRVSAELSVAVADAMDHAEDSLRA

SEQ ID NO: 751571 - protein, 21 aa, Mycobacterium
VYDVADGRPHLRLENRVLPAG

SEQ ID NO: 751572 - protein, 26 aa, Mycobacterium
VYDVFHIDRGYPLFVENLQSLGAEVE

SEQ ID NO: 751573 - protein, 26 aa, Mycobacterium
VYDVVHGRPHLRLENRVLPAGPTVVD

SEQ ID NO: 751574 - protein, 26 aa, Mycobacterium
VYDVVRRLDWPAGYDARALGNAFLAT

SEQ ID NO: 751575 - protein, 25 aa, Mycobacterium
VYEDFLPRSAAGIFRSNLDGDGAYG

SEQ ID NO: 751576 - protein, 20 aa, Mycobacterium
VYEDGRIVRDFVFIDDVVDA

SEQ ID NO: 751577 - protein, 19 aa, Mycobacterium
VYEDMASRAPQEFPSDSRR

SEQ ID NO: 751578 - protein, 31 aa, Mycobacterium
VYEDRCGPIIAEWLGERGFSFDEPEVVADGE

SEQ ID NO: 751579 - protein, 23 aa, Mycobacterium
VYELPDWLAETIAAHGRTYAEHA

SEQ ID NO: 751580 - protein, 25 aa, Mycobacterium
VYEQLPGYALPLFVRVVESIEQTTT

SEQ ID NO: 751581 - protein, 25 aa, Mycobacterium
VYFALLARRRMDLYGATLEDFAQVK

SEQ ID NO: 751582 - protein, 24 aa, Mycobacterium
VYFALLARRRMDLYGATPEDFAEV

SEQ ID NO: 751583 - protein, 18 aa, Mycobacterium
VYFCDSRSPWQRGSNENA

SEQ ID NO: 751584 - protein, 17 aa, Mycobacterium
VYFRPDEAFPLDRCDPD

SEQ ID NO: 751585 - protein, 23 aa, Mycobacterium
VYFVERLVDCLAFELKMDPAEVR

SEQ ID NO: 751586 - protein, 19 aa, Mycobacterium
VYGARKLWKTARRAGHDVG

SEQ ID NO: 751587 - protein, 24 aa, Mycobacterium
VYGDAVTLLPSWETLPHERLSPGV

SEQ ID NO: 751588 - protein, 23 aa, Mycobacterium
VYGEGKPYCVALVSLDTEAITDW

SEQ ID NO: 751589 - protein, 40 aa, Mycobacterium
VYGERVFVGYRWYDARALEVTFPFGHGLSYTAFAFSDLEV

SEQ ID NO: 751590 - protein, 19 aa, Mycobacterium
VYGETCPQYLYLSLEDNLG

SEQ ID NO: 751591 - protein, 21 aa, Mycobacterium
VYGEYRIVDLLGRRNAADSTA

SEQ ID NO: 751592 - protein, 17 aa, Mycobacterium
VYGMVSGAAPLVGLGPD

SEQ ID NO: 751593 - protein, 21 aa, Mycobacterium
VYGRPSERLTVVGITGTSGKT

SEQ ID NO: 751594 - protein, 17 aa, Mycobacterium
VYGSCAGMILLASEILD

SEQ ID NO: 751595 - protein, 18 aa, Mycobacterium
VYGVSAQVLGPVERGDEM

SEQ ID NO: 751596 - protein, 27 aa, Mycobacterium
VYHPELRIAPPFTEWEFSGDMIRMPEF

SEQ ID NO: 751597 - protein, 19 aa, Mycobacterium
VYHSLKSVLKKQGLSTGLG

SEQ ID NO: 751598 - protein, 17 aa, Mycobacterium
VYIATPLAECEKRDPKG

SEQ ID NO: 751599 - protein, 18 aa, Mycobacterium
VYKGFAALSGAAFADGSL

SEQ ID NO: 751600 - protein, 20 aa, Mycobacterium
VYKGLRRRAAAAGLDVIMIE

SEQ ID NO: 751601 - protein, 25 aa, Mycobacterium
VYKMPANQFNLAWSADRIGAMRNQV

SEQ ID NO: 751602 - protein, 23 aa, Mycobacterium
VYKPTSGSIVFNGKPLRRLRRHQ

SEQ ID NO: 751603 - protein, 22 aa, Mycobacterium
VYLADCRKLGITVLPPDVNESL

SEQ ID NO: 751604 - protein, 17 aa, Mycobacterium
VYLDIPITGTLGVFTVD

SEQ ID NO: 751605 - protein, 21 aa, Mycobacterium
VYLDLRVKIAKNWQRDPKQLG

SEQ ID NO: 751606 - protein, 21 aa, Mycobacterium
VYLDLRVKVAKNWQRDPKQLG

SEQ ID NO: 751607 - protein, 31 aa, Mycobacterium
VYLGASWEGGWRCGEVVLSLVADHARAAWSA

SEQ ID NO: 751608 - protein, 18 aa, Mycobacterium
VYLGCCTPAAAWRDIVEN

SEQ ID NO: 751609 - protein, 25 aa, Mycobacterium
VYLLSRAPGGLGLHAALTGAPFSGA

SEQ ID NO: 751610 - protein, 24 aa, Mycobacterium
VYLQHGFGAFGLLYQPLAIELAQQ

SEQ ID NO: 751611 - protein, 19 aa, Mycobacterium
VYLRRALTSTELWPVALKE

SEQ ID NO: 751612 - protein, 18 aa, Mycobacterium
VYLSAGVHPCLQSRIAAA

SEQ ID NO: 751613 - protein, 40 aa, Mycobacterium
VYLTRPSLVHFLRTGEEFGWRAAELFDVIGGGVVNVEISG

SEQ ID NO: 751614 - protein, 18 aa, Mycobacterium
VYMADLLRRKNLSVEPDQ

SEQ ID NO: 751615 - protein, 19 aa, Mycobacterium
VYNACKAGVIGFTRNLAHE

SEQ ID NO: 751616 - protein, 18 aa, Mycobacterium
VYNACKSGVIGFTRNLAH

SEQ ID NO: 751617 - protein, 24 aa, Mycobacterium
VYNAVLKRYWYHAWWFYAHTIVRG

SEQ ID NO: 751618 - protein, 19 aa, Mycobacterium
VYNFGELQSGLVNVGNTVS

SEQ ID NO: 751619 - protein, 27 aa, Mycobacterium
VYNPLRFASAAMKWCRKAAELGTLTDE

SEQ ID NO: 751620 - protein, 24 aa, Mycobacterium
VYNTLLALLFEWGVGLQHVELGKI

SEQ ID NO: 751621 - protein, 17 aa, Mycobacterium
VYPGLSQRVHDMFAERG

SEQ ID NO: 751622 - protein, 19 aa, Mycobacterium
VYPIPEPFLVIATQNPVDQ

SEQ ID NO: 751623 - protein, 20 aa, Mycobacterium
VYPLAALLTELACRGHEIHL

SEQ ID NO: 751624 - protein, 17 aa, Mycobacterium
VYPLVLVTYEIVCSKGY

SEQ ID NO: 751625 - protein, 28 aa, Mycobacterium
VYPRESPGGWQLIGRTSAVLWDIDRENP

SEQ ID NO: 751626 - protein, 22 aa, Mycobacterium
VYPVDLRFLLAPPVAPTESTNL

SEQ ID NO: 751627 - protein, 27 aa, Mycobacterium
VYQAALFDGRFVGFADFLIRDGERYRI

SEQ ID NO: 751628 - protein, 26 aa, Mycobacterium
VYQAAMFDGRFLGFADFVVREGEHYL

SEQ ID NO: 751629 - protein, 27 aa, Mycobacterium
VYQAAMFDGRFVGFADFLLRDGERYRV

SEQ ID NO: 751630 - protein, 17 aa, Mycobacterium
VYQLTCSPLHNYVPAAM

SEQ ID NO: 751631 - protein, 20 aa, Mycobacterium
VYQRSKWGGEVAVRETIASG

SEQ ID NO: 751632 - protein, 21 aa, Mycobacterium
VYQRTPIWIFPKFDPTTPRAV

SEQ ID NO: 751633 - protein, 25 aa, Mycobacterium
VYQTYGGLIARREFEPAGFAARLGL

SEQ ID NO: 751634 - protein, 18 aa, Mycobacterium
VYRAELALVETARKSGIR

SEQ ID NO: 751635 - protein, 18 aa, Mycobacterium
VYRAELALVETARKTGIR

SEQ ID NO: 751636 - protein, 17 aa, Mycobacterium
VYRAGLARTRRMARQLV

SEQ ID NO: 751637 - protein, 26 aa, Mycobacterium
VYRDGVKVVDLWGGYRNGVARQPWQP

SEQ ID NO: 751638 - protein, 20 aa, Mycobacterium
VYRIHGERGTARFFNITVQG

SEQ ID NO: 751639 - protein, 18 aa, Mycobacterium
VYRIKGLVRLGDRTLAVH

SEQ ID NO: 751640 - protein, 26 aa, Mycobacterium
VYRKVHLYDAFGYKESDRVIAADPAI

SEQ ID NO: 751641 - protein, 17 aa, Mycobacterium
VYRLGEWAIPRGDSIIV

SEQ ID NO: 751642 - protein, 21 aa, Mycobacterium
VYRLTGELAEWFGVDAGTLRE

SEQ ID NO: 751643 - protein, 18 aa, Mycobacterium
VYRMAWAALAGVAESSVR

SEQ ID NO: 751644 - protein, 19 aa, Mycobacterium
VYRMMVRMRLAEEALVEAW

SEQ ID NO: 751645 - protein, 22 aa, Mycobacterium
VYRNFWTFFFHTFWKVREIRTM

SEQ ID NO: 751646 - protein, 21 aa, Mycobacterium
VYRPRRAALEHLLDAHLASGE

SEQ ID NO: 751647 - protein, 20 aa, Mycobacterium
VYRQELFGPVAVVYKAGSEE

SEQ ID NO: 751648 - protein, 21 aa, Mycobacterium
VYRRLEMSLDEIASVLDEGDE

SEQ ID NO: 751649 - protein, 21 aa, Mycobacterium
VYRRWPDTRSIIAALLTSHIT

SEQ ID NO: 751650 - protein, 22 aa, Mycobacterium
VYRRWPDVRTLVAELLTREMGS

SEQ ID NO: 751651 - protein, 20 aa, Mycobacterium
VYRSDYPGLVALLPTALAET

SEQ ID NO: 751652 - protein, 22 aa, Mycobacterium
VYRSELLFRHGIDPFRPGRDVG

SEQ ID NO: 751653 - protein, 20 aa, Mycobacterium
VYRTRFGALLTAAADRRAAL

SEQ ID NO: 751654 - protein, 26 aa, Mycobacterium
VYRWSGRGRPRYRLMTADDRAALDEE

SEQ ID NO: 751655 - protein, 19 aa, Mycobacterium
VYRYLLKRNRRLYAVAYTI

SEQ ID NO: 751656 - protein, 20 aa, Mycobacterium
VYSCGALVHAGTLVIPIGIC

SEQ ID NO: 751657 - protein, 19 aa, Mycobacterium
VYSCGGLVHAGMLVLPYGI

SEQ ID NO: 751658 - protein, 18 aa, Mycobacterium
VYSGLRIGTLAAHPHDPN

SEQ ID NO: 751659 - protein, 26 aa, Mycobacterium
VYSHKWSVGDTVIWDNQGVLHRAAPY

SEQ ID NO: 751660 - protein, 20 aa, Mycobacterium
VYSKAMRRRAPWLQESAHRQ

SEQ ID NO: 751661 - protein, 18 aa, Mycobacterium
VYSNYGFTVLAETIESES

SEQ ID NO: 751662 - protein, 18 aa, Mycobacterium
VYSPLVWYVVDGARVAYK

SEQ ID NO: 751663 - protein, 18 aa, Mycobacterium
VYSPQSWSTIPGGPFLSF

SEQ ID NO: 751664 - protein, 23 aa, Mycobacterium
VYSPRVEGVHLRFGPVARGGLRW

SEQ ID NO: 751665 - protein, 24 aa, Mycobacterium
VYSRADAGAGWVLHAEGTLTNGSL

SEQ ID NO: 751666 - protein, 25 aa, Mycobacterium
VYSWGAHGFRGRWLVNGSSKGIVEL

SEQ ID NO: 751667 - protein, 18 aa, Mycobacterium
VYTAWGGFAYGRGLDGAA

SEQ ID NO: 751668 - protein, 18 aa, Mycobacterium
VYTAWGGFAYGRGLDGAP

SEQ ID NO: 751669 - protein, 21 aa, Mycobacterium
VYTLSGCWHYLEYPDQLQTAG

SEQ ID NO: 751670 - protein, 23 aa, Mycobacterium
VYVAAPDHIVEWPADAGEGDLLP

SEQ ID NO: 751671 - protein, 20 aa, Mycobacterium
VYVCGPTPMLEAVRAARARH

SEQ ID NO: 751672 - protein, 18 aa, Mycobacterium
VYVDARIEDIENWYISRF

SEQ ID NO: 751673 - protein, 18 aa, Mycobacterium
VYVDARIEDIEQWYISRF

SEQ ID NO: 751674 - protein, 20 aa, Mycobacterium
VYVGGRLIGLVGALYADAVR

SEQ ID NO: 751675 - protein, 20 aa, Mycobacterium
VYVHRLRKYIGAYIATLGGA

SEQ ID NO: 751676 - protein, 20 aa, Mycobacterium
VYVLRPCIVAGPKATALADA

SEQ ID NO: 751677 - protein, 17 aa, Mycobacterium
VYVPGASSTGISRKLPD

SEQ ID NO: 751678 - protein, 17 aa, Mycobacterium
VYVRACEIRTRRYGAYE

SEQ ID NO: 751679 - protein, 17 aa, Mycobacterium
VYVSFTIRLYRVRTEHR

SEQ ID NO: 751680 - protein, 18 aa, Mycobacterium
VYVSVNYRLGGLGCVDLS

SEQ ID NO: 751681 - protein, 19 aa, Mycobacterium
VYVTLPPLFVVKAGDERIY

SEQ ID NO: 751682 - protein, 21 aa, Mycobacterium
VYVVRKRIEHELGNQGSGRGS

SEQ ID NO: 751683 - protein, 18 aa, Mycobacterium
VYYMPQWDTFALSRFEDI

SEQ ID NO: 751684 - protein, 23 aa, Mycobacterium
VYYQVLGGWKLATLLEVSYQRHL

SEQ ID NO: 751685 - protein, 19 aa, Mycobacterium
VYYRHELMYATGRVDGVEV

SEQ ID NO: 751686 - protein, 27 aa, Mycobacterium
VYYTRAGGDAQAWYRILLYGPMHNPVI

SEQ ID NO: 751687 - protein, 20 aa, Mycobacterium
VYYWMFGGWLRKRRNIRDMT

SEQ ID NO: 751688 - protein, 33 aa, Mycobacterium
WAAAAPHGVFGPRVRWRMMLKALRDNGFPVEQQ

SEQ ID NO: 751689 - protein, 17 aa, Mycobacterium
WAAAFGGLEAQRVELPT

SEQ ID NO: 751690 - protein, 24 aa, Mycobacterium
WAAAIGALGRPTAVLPQADVPGFA

SEQ ID NO: 751691 - protein, 20 aa, Mycobacterium
WAAAIYLSGLALRTGATTEE

SEQ ID NO: 751692 - protein, 18 aa, Mycobacterium
WAAAVAYARTLPGIDPDR

SEQ ID NO: 751693 - protein, 17 aa, Mycobacterium
WAAAYHFVYTTQGADAL

SEQ ID NO: 751694 - protein, 19 aa, Mycobacterium
WAAAYLPLVRVLRTLAAEG

SEQ ID NO: 751695 - protein, 19 aa, Mycobacterium
WAADVAAMVGYHGGASAAA

SEQ ID NO: 751696 - protein, 17 aa, Mycobacterium
WAAEAGKQFVLNASPVP

SEQ ID NO: 751697 - protein, 18 aa, Mycobacterium
WAAECVYVPINYKLHPRE

SEQ ID NO: 751698 - protein, 20 aa, Mycobacterium
WAAENGWPAFGDALLDLAAQ

SEQ ID NO: 751699 - protein, 30 aa, Mycobacterium
WAAEVRRLVELRGATLLAHNYQLPAIQDVA

SEQ ID NO: 751700 - protein, 25 aa, Mycobacterium
WAAFARAALFPALVRGLDDGVRDAR

SEQ ID NO: 751701 - protein, 25 aa, Mycobacterium
WAAFARSALFPALVRALDDGIHDPR

SEQ ID NO: 751702 - protein, 19 aa, Mycobacterium
WAAGAHLPITLPSGRVRQY

SEQ ID NO: 751703 - protein, 20 aa, Mycobacterium
WAAGIPWDADLPPVRACPEG

SEQ ID NO: 751704 - protein, 25 aa, Mycobacterium
WAAHARGAVLVRRGEFEAALDNLGA

SEQ ID NO: 751705 - protein, 19 aa, Mycobacterium
WAAHPGAEPDGWGAALDPD

SEQ ID NO: 751706 - protein, 20 aa, Mycobacterium
WAAIADRWSLELTVVNPLVD

SEQ ID NO: 751707 - protein, 19 aa, Mycobacterium
WAAIFATEPDFFWSPVNSL

SEQ ID NO: 751708 - protein, 17 aa, Mycobacterium
WAAKGIRVNAVAPGTID

SEQ ID NO: 751709 - protein, 17 aa, Mycobacterium
WAAKGTSLLGVRAVITE

SEQ ID NO: 751710 - protein, 19 aa, Mycobacterium
WAAKGTVLLGVKAVITESF

SEQ ID NO: 751711 - protein, 19 aa, Mycobacterium
WAAKLPEHMLSAPADSIVA

SEQ ID NO: 751712 - protein, 24 aa, Mycobacterium
WAAKRAALTLVHRVPRSAGRELAY

SEQ ID NO: 751713 - protein, 17 aa, Mycobacterium
WAALAAGLPETVPAVTV

SEQ ID NO: 751714 - protein, 18 aa, Mycobacterium
WAALAHVPALRALPEYDL

SEQ ID NO: 751715 - protein, 18 aa, Mycobacterium
WAALTAEIGDRVQIVGDD

SEQ ID NO: 751716 - protein, 17 aa, Mycobacterium
WAALTASIGDRVQIVGD

SEQ ID NO: 751717 - protein, 17 aa, Mycobacterium
WAAMPFDERAAVFLRAA

SEQ ID NO: 751718 - protein, 23 aa, Mycobacterium
WAANPAPFLGQIVSNQFGYGQLI

SEQ ID NO: 751719 - protein, 17 aa, Mycobacterium
WAAPATRQVAALSSAGL

SEQ ID NO: 751720 - protein, 19 aa, Mycobacterium
WAAQHHRPGVWLVRDPSQR

SEQ ID NO: 751721 - protein, 25 aa, Mycobacterium
WAARPLPLPDMCYGAVLSGDTELSD

SEQ ID NO: 751722 - protein, 17 aa, Mycobacterium
WAASFGALHGAVHRMMA

SEQ ID NO: 751723 - protein, 25 aa, Mycobacterium
WAASHRPATELGRMYVHDGVVAVEL

SEQ ID NO: 751724 - protein, 19 aa, Mycobacterium
WAASVCGGHVGRARRLATD

SEQ ID NO: 751725 - protein, 17 aa, Mycobacterium
WAATLQPGWQRRRITNF

SEQ ID NO: 751726 - protein, 17 aa, Mycobacterium
WAATLWVAGHAAELGGD

SEQ ID NO: 751727 - protein, 19 aa, Mycobacterium
WAAVRLDVIGVRIGRSANP

SEQ ID NO: 751728 - protein, 17 aa, Mycobacterium
WACCDAGDWSARVTLSF

SEQ ID NO: 751729 - protein, 17 aa, Mycobacterium
WACDDWDAASAEVAAAL

SEQ ID NO: 751730 - protein, 18 aa, Mycobacterium
WACRRWPQRMRARLIELA

SEQ ID NO: 751731 - protein, 25 aa, Mycobacterium
WADAIGELLVRKGAGFSRAAVEHAA

SEQ ID NO: 751732 - protein, 19 aa, Mycobacterium
WADAQLVAAAVSFDVCTAA

SEQ ID NO: 751733 - protein, 19 aa, Mycobacterium
WADAQVIDAIWQLRQSQSL

SEQ ID NO: 751734 - protein, 19 aa, Mycobacterium
WADAVLNPINIRWSPPEIA

SEQ ID NO: 751735 - protein, 17 aa, Mycobacterium
WADAYFAFAERYFDRSE

SEQ ID NO: 751736 - protein, 18 aa, Mycobacterium
WADCDGHPENAVSRDELL

SEQ ID NO: 751737 - protein, 25 aa, Mycobacterium
WADDAVAVATGWHRVAAYLARARVA

SEQ ID NO: 751738 - protein, 17 aa, Mycobacterium
WADDIVFRAELSPGAAR

SEQ ID NO: 751739 - protein, 24 aa, Mycobacterium
WADGPRTYLGLGVDGFPNLFLVSG

SEQ ID NO: 751740 - protein, 18 aa, Mycobacterium
WADGTIELRNRFTGETQP

SEQ ID NO: 751741 - protein, 17 aa, Mycobacterium
WADLIIFAGNCALDSMG

SEQ ID NO: 751742 - protein, 18 aa, Mycobacterium
WADLLVFTGNVALESMGF

SEQ ID NO: 751743 - protein, 27 aa, Mycobacterium
WADLPWLRSLTKLPLILKGICHPDDVR

SEQ ID NO: 751744 - protein, 17 aa, Mycobacterium
WADLYLPAGPQQVDSIP

SEQ ID NO: 751745 - protein, 17 aa, Mycobacterium
WADNDMFGHLNNAVYYQ

SEQ ID NO: 751746 - protein, 23 aa, Mycobacterium
WADNLRHTVRFSAAVQAALEDGH

SEQ ID NO: 751747 - protein, 24 aa, Mycobacterium
WADPEAGSSFGFVHNRLLTPLLFD

SEQ ID NO: 751748 - protein, 23 aa, Mycobacterium
WADPESGSAFGYVHNRLLTLLLF

SEQ ID NO: 751749 - protein, 24 aa, Mycobacterium
WADPETGSSFGFVHNRLLTPLLFD

SEQ ID NO: 751750 - protein, 18 aa, Mycobacterium
WADPGARRPGEINHRDGG

SEQ ID NO: 751751 - protein, 24 aa, Mycobacterium
WADPKRRIAVGLAHNHLILPNPMH

SEQ ID NO: 751752 - protein, 20 aa, Mycobacterium
WADRIPGAVFAIGNAPTALF

SEQ ID NO: 751753 - protein, 19 aa, Mycobacterium
WADRLPGAVLAIGNAPTAL

SEQ ID NO: 751754 - protein, 26 aa, Mycobacterium
WADRYAGKFDDGWDAYRQRVFDRAKD

SEQ ID NO: 751755 - protein, 20 aa, Mycobacterium
WADVDYPDVIALRRALLPCR

SEQ ID NO: 751756 - protein, 25 aa, Mycobacterium
WAEAKPDILGGLLTLAAKVHYRLPD

SEQ ID NO: 751757 - protein, 21 aa, Mycobacterium
WAEAPRKLITGGRTVRLDGYR

SEQ ID NO: 751758 - protein, 17 aa, Mycobacterium
WAEASSFATPFVTDPAL

SEQ ID NO: 751759 - protein, 20 aa, Mycobacterium
WAECLDAVMVVDSSRWKKWK

SEQ ID NO: 751760 - protein, 18 aa, Mycobacterium
WAEDMKIGDATVLKQVDH

SEQ ID NO: 751761 - protein, 19 aa, Mycobacterium
WAEEYTEVVYKLWEGSWDD

SEQ ID NO: 751762 - protein, 18 aa, Mycobacterium
WAEGAAMFVLQRKSAALR

SEQ ID NO: 751763 - protein, 19 aa, Mycobacterium
WAEGAAMFVLQRKSAAVRA

SEQ ID NO: 751764 - protein, 17 aa, Mycobacterium
WAEGALRTAPWSEDAAK

SEQ ID NO: 751765 - protein, 19 aa, Mycobacterium
WAEGDRVVVAAGRPCQSCP

SEQ ID NO: 751766 - protein, 24 aa, Mycobacterium
WAEGPRTYLGLGVDGFPNLFLVSG

SEQ ID NO: 751767 - protein, 19 aa, Mycobacterium
WAEHIGFVYPPALAADLEP

SEQ ID NO: 751768 - protein, 20 aa, Mycobacterium
WAEIKRRLAAEQHDFYVLDE

SEQ ID NO: 751769 - protein, 17 aa, Mycobacterium
WAELVYDGLWYSPLKTA

SEQ ID NO: 751770 - protein, 18 aa, Mycobacterium
WAENGRRWRRLHVHYPAT

SEQ ID NO: 751771 - protein, 21 aa, Mycobacterium
WAEPDPRLSRHVVPENRLRAY

SEQ ID NO: 751772 - protein, 17 aa, Mycobacterium
WAERGVMLLNRVLTVRP

SEQ ID NO: 751773 - protein, 18 aa, Mycobacterium
WAESAGLDSAWIPQIPND

SEQ ID NO: 751774 - protein, 19 aa, Mycobacterium
WAESGRRALYISGEESAGQ

SEQ ID NO: 751775 - protein, 22 aa, Mycobacterium
WAESRRYLGLDALSKSRAVNDT

SEQ ID NO: 751776 - protein, 23 aa, Mycobacterium
WAESRRYLGLDVLSKSRADHTPS

SEQ ID NO: 751777 - protein, 24 aa, Mycobacterium
WAEVHGYPLMPIDGILVGTAAMAT

SEQ ID NO: 751778 - protein, 22 aa, Mycobacterium
WAFAEGFGYAYERTVLLERMRR

SEQ ID NO: 751779 - protein, 18 aa, Mycobacterium
WAFAHLPFAKKIYRTRLW

SEQ ID NO: 751780 - protein, 21 aa, Mycobacterium
WAFLGGPVIKDGRPVDFGSFL

SEQ ID NO: 751781 - protein, 20 aa, Mycobacterium
WAFTHLPWAKKLYRTRLWLR

SEQ ID NO: 751782 - protein, 19 aa, Mycobacterium
WAGACKPGDGLGIAGDEVL

SEQ ID NO: 751783 - protein, 21 aa, Mycobacterium
WAGACRPGDGLGITGDEVVVV

SEQ ID NO: 751784 - protein, 17 aa, Mycobacterium
WAGADGRPNRVEHWSNV

SEQ ID NO: 751785 - protein, 25 aa, Mycobacterium
WAGAGYKAGFAYRDAMVVDPYRLVT

SEQ ID NO: 751786 - protein, 17 aa, Mycobacterium
WAGALIGTGWGRPDTFT

SEQ ID NO: 751787 - protein, 17 aa, Mycobacterium
WAGALTLGVAKIVENME

SEQ ID NO: 751788 - protein, 19 aa, Mycobacterium
WAGAVTLGVAKIVENMEIG

SEQ ID NO: 751789 - protein, 20 aa, Mycobacterium
WAGCKRVHMQNVAGWQSVPV

SEQ ID NO: 751790 - protein, 18 aa, Mycobacterium
WAGCTAVAFERDERRRHN

SEQ ID NO: 751791 - protein, 19 aa, Mycobacterium
WAGELAELPTLLAEKTKAP

SEQ ID NO: 751792 - protein, 35 aa, Mycobacterium
WAGEVLLREAHDLAGLPVRVFRSDMILAHSDYHGQ

SEQ ID NO: 751793 - protein, 17 aa, Mycobacterium
WAGEVLLREAHDLCELP

SEQ ID NO: 751794 - protein, 24 aa, Mycobacterium
WAGFARAALFPTLAAALDCGTGDP

SEQ ID NO: 751795 - protein, 19 aa, Mycobacterium
WAGGMVRGALGAATVVEHV

SEQ ID NO: 751796 - protein, 17 aa, Mycobacterium
WAGGSPPAELDWIESIL

SEQ ID NO: 751797 - protein, 18 aa, Mycobacterium
WAGHPFMAQILIKAEPKP

SEQ ID NO: 751798 - protein, 17 aa, Mycobacterium
WAGKGIRVNAVAPGAIE

SEQ ID NO: 751799 - protein, 17 aa, Mycobacterium
WAGLARTELLFAAVEPL

SEQ ID NO: 751800 - protein, 18 aa, Mycobacterium
WAGLPSHPHHDRARHYLP

SEQ ID NO: 751801 - protein, 19 aa, Mycobacterium
WAGLSALTPDSDFDQARAI

SEQ ID NO: 751802 - protein, 18 aa, Mycobacterium
WAGNAAKAVFYCRRAADQ

SEQ ID NO: 751803 - protein, 20 aa, Mycobacterium
WAGPFAERAASEFTLQAWAG

SEQ ID NO: 751804 - protein, 18 aa, Mycobacterium
WAGPGDVVLVAGKGHETG

SEQ ID NO: 751805 - protein, 17 aa, Mycobacterium
WAGQKTRLWSSVYKELE

SEQ ID NO: 751806 - protein, 25 aa, Mycobacterium
WAGQLRAGSWIAFQVPGNFDAPSHR

SEQ ID NO: 751807 - protein, 23 aa, Mycobacterium
WAGRITSFPADWSNVGFDAETRA

SEQ ID NO: 751808 - protein, 17 aa, Mycobacterium
WAGRLDKIMAMRKRHGP

SEQ ID NO: 751809 - protein, 26 aa, Mycobacterium
WAGRPMRCHLFAFGVSYDGPIRHQAE

SEQ ID NO: 751810 - protein, 17 aa, Mycobacterium
WAGRVCGDTFAPVRALL

SEQ ID NO: 751811 - protein, 18 aa, Mycobacterium
WAGSGIRLNALVPGAIMT

SEQ ID NO: 751812 - protein, 19 aa, Mycobacterium
WAGSPAIRLTASALPTAGL

SEQ ID NO: 751813 - protein, 26 aa, Mycobacterium
WAGSYPDRFIPIAILPTWNPEAMCRE

SEQ ID NO: 751814 - protein, 25 aa, Mycobacterium
WAGSYPDRFIPIAILPTWTPEGMCN

SEQ ID NO: 751815 - protein, 20 aa, Mycobacterium
WAGTCAARLATAFDDDAGAP

SEQ ID NO: 751816 - protein, 19 aa, Mycobacterium
WAGTCKPGDGLGIAGDEVL

SEQ ID NO: 751817 - protein, 17 aa, Mycobacterium
WAGTHRIAVVPRGMGTG

SEQ ID NO: 751818 - protein, 17 aa, Mycobacterium
WAGTLVVVSHDRYLIER

SEQ ID NO: 751819 - protein, 18 aa, Mycobacterium
WAGTSARAANARVEQHTK

SEQ ID NO: 751820 - protein, 17 aa, Mycobacterium
WAGVAYVCFIVDAHSRM

SEQ ID NO: 751821 - protein, 25 aa, Mycobacterium
WAGVDPRAANTMVHIFAEPSVVDAK

SEQ ID NO: 751822 - protein, 18 aa, Mycobacterium
WAGVFAGLNARRVELPTY

SEQ ID NO: 751823 - protein, 25 aa, Mycobacterium
WAHDGNRIAVRFAYEHHDDSGNWFR

SEQ ID NO: 751824 - protein, 17 aa, Mycobacterium
WAHFRRHGFGFPGETEA

SEQ ID NO: 751825 - protein, 25 aa, Mycobacterium
WAHGPRTYLGLGVDGFPNLFLISGP

SEQ ID NO: 751826 - protein, 20 aa, Mycobacterium
WAHGSSRAILDGGVPATPPP

SEQ ID NO: 751827 - protein, 20 aa, Mycobacterium
WAHRALWHLIFSGALDRHPD

SEQ ID NO: 751828 - protein, 20 aa, Mycobacterium
WAHRCAEALTAPKFWNQGGT

SEQ ID NO: 751829 - protein, 18 aa, Mycobacterium
WAHRMAVEYLLTAATPFG

SEQ ID NO: 751830 - protein, 19 aa, Mycobacterium
WAHSGKRALYLSGEESAGQ

SEQ ID NO: 751831 - protein, 26 aa, Mycobacterium
WAHSTLSRFRGIGVSTVFSHGATLRT

SEQ ID NO: 751832 - protein, 19 aa, Mycobacterium
WAIAHRLGVEIPEDRGYGH

SEQ ID NO: 751833 - protein, 24 aa, Mycobacterium
WAIDEIRPAKIYANFNGFEPGVAR

SEQ ID NO: 751834 - protein, 21 aa, Mycobacterium
WAIDGGRPALLDRLADPVQRA

SEQ ID NO: 751835 - protein, 18 aa, Mycobacterium
WAIGRVRPNTGWLPGELL

SEQ ID NO: 751836 - protein, 17 aa, Mycobacterium
WAKAHWRALEFNYGAAP

SEQ ID NO: 751837 - protein, 22 aa, Mycobacterium
WAKAVISEPVFNSERFDEIWNR

SEQ ID NO: 751838 - protein, 19 aa, Mycobacterium
WAKEQGIAITAEVTPHHLL

SEQ ID NO: 751839 - protein, 22 aa, Mycobacterium
WAKETGRWLIADEIYQFQYYLE

SEQ ID NO: 751840 - protein, 17 aa, Mycobacterium
WAKKQGISITAEVTPHH

SEQ ID NO: 751841 - protein, 17 aa, Mycobacterium
WAKPIVVHSSWARQGDP

SEQ ID NO: 751842 - protein, 24 aa, Mycobacterium
WAKQRGHRGLAYVLIADDGTLGGP

SEQ ID NO: 751843 - protein, 24 aa, Mycobacterium
WAKQRGHRGLAYVLVADDGTLGGP

SEQ ID NO: 751844 - protein, 17 aa, Mycobacterium
WAKSQGISITAEVTPHH

SEQ ID NO: 751845 - protein, 19 aa, Mycobacterium
WAKTWEFQALLKARAAVGD

SEQ ID NO: 751846 - protein, 19 aa, Mycobacterium
WAKTWEFQALMKARAAVGD

SEQ ID NO: 751847 - protein, 17 aa, Mycobacterium
WALAAAAARHGAEITTG

SEQ ID NO: 751848 - protein, 18 aa, Mycobacterium
WALAEAHAGDGEDQVVYR

SEQ ID NO: 751849 - protein, 18 aa, Mycobacterium
WALAHPDRTLAVLAALPA

SEQ ID NO: 751850 - protein, 25 aa, Mycobacterium
WALDTAAGVPLVFLTAFYGLSDLAG

SEQ ID NO: 751851 - protein, 23 aa, Mycobacterium
WALGEAMMRQALAQLKAAGHSAK

SEQ ID NO: 751852 - protein, 25 aa, Mycobacterium
WALKHWHFGPLYTRDEYIRLQTRHV

SEQ ID NO: 751853 - protein, 17 aa, Mycobacterium
WALLKFLNDDRYAIDPK

SEQ ID NO: 751854 - protein, 18 aa, Mycobacterium
WALPGGRLDPGETAVDAA

SEQ ID NO: 751855 - protein, 18 aa, Mycobacterium
WALPGGRLDPGETAVEAA

SEQ ID NO: 751856 - protein, 18 aa, Mycobacterium
WALPGGRLDPGETVVEAA

SEQ ID NO: 751857 - protein, 18 aa, Mycobacterium
WALPHLPKPWGRASSPVE

SEQ ID NO: 751858 - protein, 17 aa, Mycobacterium
WALPLAVVVEGRAVGVQ

SEQ ID NO: 751859 - protein, 19 aa, Mycobacterium
WALPRAANQFWMRSEPERA

SEQ ID NO: 751860 - protein, 29 aa, Mycobacterium
WALPTRFGRRYRAALRDAPHLTLWTGLTC

SEQ ID NO: 751861 - protein, 18 aa, Mycobacterium
WALQTAVEYAKVREQFGK

SEQ ID NO: 751862 - protein, 17 aa, Mycobacterium
WALSGNFYRRLDAGQPW

SEQ ID NO: 751863 - protein, 17 aa, Mycobacterium
WALSRHQDVLQGFRNST

SEQ ID NO: 751864 - protein, 17 aa, Mycobacterium
WALTQANAAAAGPTTSL

SEQ ID NO: 751865 - protein, 19 aa, Mycobacterium
WALTSNCPVPGPVPTSPAN

SEQ ID NO: 751866 - protein, 17 aa, Mycobacterium
WALWYSGYLQARLWDRA

SEQ ID NO: 751867 - protein, 23 aa, Mycobacterium
WAMCRKRRAAQCYRSQLEPAGGE

SEQ ID NO: 751868 - protein, 21 aa, Mycobacterium
WAMLGDGRWSDGRGDNIFDGS

SEQ ID NO: 751869 - protein, 17 aa, Mycobacterium
WAMSYRVNAGLGDIAFF

SEQ ID NO: 751870 - protein, 17 aa, Mycobacterium
WANALGAMLAEMSGVVD

SEQ ID NO: 751871 - protein, 18 aa, Mycobacterium
WANDPGDNSVVHFFGPYA

SEQ ID NO: 751872 - protein, 18 aa, Mycobacterium
WANFDRLAPTAVEEIVRW

SEQ ID NO: 751873 - protein, 19 aa, Mycobacterium
WANGVLNPVNIRWTPAEIA

SEQ ID NO: 751874 - protein, 19 aa, Mycobacterium
WANHQWHQLARAFLMYTTQ

SEQ ID NO: 751875 - protein, 24 aa, Mycobacterium
WANLLDLLAALGLVAEPVRVDDDG

SEQ ID NO: 751876 - protein, 17 aa, Mycobacterium
WAPAEGKLALVIHHLAV

SEQ ID NO: 751877 - protein, 18 aa, Mycobacterium
WAPAGVRVDVGFDRKRLL

SEQ ID NO: 751878 - protein, 18 aa, Mycobacterium
WAPDSVAIWDNRAVQHYA

SEQ ID NO: 751879 - protein, 20 aa, Mycobacterium
WAPECAYAPGLEHDYAAAGV

SEQ ID NO: 751880 - protein, 19 aa, Mycobacterium
WAPECAYAPGMERDYAAAG

SEQ ID NO: 751881 - protein, 17 aa, Mycobacterium
WAPEVRAAVAMTLTSRF

SEQ ID NO: 751882 - protein, 18 aa, Mycobacterium
WAPFAVGLEQARDWLRRF

SEQ ID NO: 751883 - protein, 17 aa, Mycobacterium
WAPLVPFVHDGVISSLR

SEQ ID NO: 751884 - protein, 17 aa, Mycobacterium
WAPQWWSEIPLPPEPEP

SEQ ID NO: 751885 - protein, 18 aa, Mycobacterium
WAPVPLLSVALYRKYRPA

SEQ ID NO: 751886 - protein, 17 aa, Mycobacterium
WAPVVRGGWQTESEIVA

SEQ ID NO: 751887 - protein, 20 aa, Mycobacterium
WAQAPPRRLVFAADVPKLDQ

SEQ ID NO: 751888 - protein, 23 aa, Mycobacterium
WAQARGLEPLAYFVDAETAAVDY

SEQ ID NO: 751889 - protein, 19 aa, Mycobacterium
WAQDACAMYRYANASASAA

SEQ ID NO: 751890 - protein, 20 aa, Mycobacterium
WAQDVAAMFGYHAGASAAAS

SEQ ID NO: 751891 - protein, 19 aa, Mycobacterium
WAQEYVDVVYKLWEGSWDE

SEQ ID NO: 751892 - protein, 18 aa, Mycobacterium
WAQGDRSGVAFRADAITP

SEQ ID NO: 751893 - protein, 18 aa, Mycobacterium
WAQGDRSGVAFRADALTP

SEQ ID NO: 751894 - protein, 17 aa, Mycobacterium
WAQKAMVLAARVLPQPV

SEQ ID NO: 751895 - protein, 21 aa, Mycobacterium
WAQLDGRARLIVGGRVNRFIP

SEQ ID NO: 751896 - protein, 17 aa, Mycobacterium
WAQLDTVFGHFRHLLRT

SEQ ID NO: 751897 - protein, 22 aa, Mycobacterium
WAQLEPGMTAWDLYGGAGVFAA

SEQ ID NO: 751898 - protein, 18 aa, Mycobacterium
WAQLQLPRVPGMEPLVMG

SEQ ID NO: 751899 - protein, 27 aa, Mycobacterium
WAQPLPSTFARWREYRRLHKRLRRRGR

SEQ ID NO: 751900 - protein, 18 aa, Mycobacterium
WAQQAFTDFSVVPPDTGI

SEQ ID NO: 751901 - protein, 20 aa, Mycobacterium
WAQRQFPHDLWCDVADAGLF

SEQ ID NO: 751902 - protein, 21 aa, Mycobacterium
WAQSYGFPLMPIDGILVGTAA

SEQ ID NO: 751903 - protein, 21 aa, Mycobacterium
WAQYRRAGAVSLPAAGSSFRQ

SEQ ID NO: 751904 - protein, 21 aa, Mycobacterium
WARATGLNAVRVFLHDLLWAQ

SEQ ID NO: 751905 - protein, 18 aa, Mycobacterium
WARDVLRDLSDTMNARLT

SEQ ID NO: 751906 - protein, 25 aa, Mycobacterium
WARDYWISFDRLRALDRVRTVHGAL

SEQ ID NO: 751907 - protein, 25 aa, Mycobacterium
WAREHGWPAFADRLLELARAAEPGS

SEQ ID NO: 751908 - protein, 18 aa, Mycobacterium
WARGCGRALSIALVALPY

SEQ ID NO: 751909 - protein, 25 aa, Mycobacterium
WARLRREGLAWITAHRGGNPAPVMA

SEQ ID NO: 751910 - protein, 17 aa, Mycobacterium
WARLWEIEADQWRDVID

SEQ ID NO: 751911 - protein, 18 aa, Mycobacterium
WARMLRVHLDGGFHLSQP

SEQ ID NO: 751912 - protein, 18 aa, Mycobacterium
WARPDTPEPLGMPLQTTL

SEQ ID NO: 751913 - protein, 18 aa, Mycobacterium
WARPRGVAPDALFALMCG

SEQ ID NO: 751914 - protein, 19 aa, Mycobacterium
WARPRGVAPDALFALMCGD

SEQ ID NO: 751915 - protein, 19 aa, Mycobacterium
WARQDFPALAPAIRVPVRF

SEQ ID NO: 751916 - protein, 28 aa, Mycobacterium
WARRWQRLLFDNGWLLPGQPPEFGGRNA

SEQ ID NO: 751917 - protein, 28 aa, Mycobacterium
WARRWQRLLFDSGWLLPGNPPEFGGRNA

SEQ ID NO: 751918 - protein, 19 aa, Mycobacterium
WARSELDYLPGTTGVHSSG

SEQ ID NO: 751919 - protein, 17 aa, Mycobacterium
WARSGHLTLPRGGDFVL

SEQ ID NO: 751920 - protein, 17 aa, Mycobacterium
WARVRGDKLAYRFVDFS

SEQ ID NO: 751921 - protein, 18 aa, Mycobacterium
WARWSHKRITAALDALVL

SEQ ID NO: 751922 - protein, 23 aa, Mycobacterium
WARWVDVGGALVIHDVFPDPADG

SEQ ID NO: 751923 - protein, 20 aa, Mycobacterium
WASADWRLRRGRLVLIEGDS

SEQ ID NO: 751924 - protein, 18 aa, Mycobacterium
WASAHADLATAYLTMPMV

SEQ ID NO: 751925 - protein, 18 aa, Mycobacterium
WASEADRIVVVWRTNGTA

SEQ ID NO: 751926 - protein, 34 aa, Mycobacterium
WASEDLEDWKAWARWRVIHARAGLLTDDLVAEDF

SEQ ID NO: 751927 - protein, 19 aa, Mycobacterium
WASETGWPQFADRLVELAR

SEQ ID NO: 751928 - protein, 19 aa, Mycobacterium
WASEWDRQNAWAMLQEQSE

SEQ ID NO: 751929 - protein, 25 aa, Mycobacterium
WASGVRRIATEAGITVVAGMFTPAD

SEQ ID NO: 751930 - protein, 22 aa, Mycobacterium
WASIIPAGWSFLLALRSRGLGS

SEQ ID NO: 751931 - protein, 25 aa, Mycobacterium
WASLGEIRLFIGWNDRGWFVVTDSD

SEQ ID NO: 751932 - protein, 23 aa, Mycobacterium
WASLKRSRFFAGLDDDALVAVAA

SEQ ID NO: 751933 - protein, 22 aa, Mycobacterium
WASRPLKFAKLLPATIGVIPAW

SEQ ID NO: 751934 - protein, 18 aa, Mycobacterium
WASRTGLDRELTRTLAET

SEQ ID NO: 751935 - protein, 17 aa, Mycobacterium
WASSGHVGFKGSRKSTP

SEQ ID NO: 751936 - protein, 18 aa, Mycobacterium
WASSGHVGFKGSRKSTPF

SEQ ID NO: 751937 - protein, 19 aa, Mycobacterium
WASSGHVGFKGSRKSTPFA

SEQ ID NO: 751938 - protein, 19 aa, Mycobacterium
WASTAERVVLVWRAGGQYR

SEQ ID NO: 751939 - protein, 23 aa, Mycobacterium
WASTGRRALYLSGEESAGQIRLR

SEQ ID NO: 751940 - protein, 19 aa, Mycobacterium
WATACQKAFADLNVDPDRV

SEQ ID NO: 751941 - protein, 18 aa, Mycobacterium
WATEGPLSYLGMAVAGFP

SEQ ID NO: 751942 - protein, 17 aa, Mycobacterium
WATELPHGSWIAVQVPG

SEQ ID NO: 751943 - protein, 34 aa, Mycobacterium
WATEPLSDWKLWASWRLICARAPYLTDPLVNENF

SEQ ID NO: 751944 - protein, 18 aa, Mycobacterium
WATESDLIAALQAGDGKA

SEQ ID NO: 751945 - protein, 17 aa, Mycobacterium
WATEVANASPLQSLEQQ

SEQ ID NO: 751946 - protein, 19 aa, Mycobacterium
WATFHPVQSLMSWDSTGPN

SEQ ID NO: 751947 - protein, 17 aa, Mycobacterium
WATKCELVHAALVHTLP

SEQ ID NO: 751948 - protein, 17 aa, Mycobacterium
WATKDVVGAHRFLQRAW

SEQ ID NO: 751949 - protein, 20 aa, Mycobacterium
WATLHYPGAVQTHFWSAQDY

SEQ ID NO: 751950 - protein, 18 aa, Mycobacterium
WATLQPENWWAPQPPTEP

SEQ ID NO: 751951 - protein, 17 aa, Mycobacterium
WATPSAFIDVYRRTLGQ

SEQ ID NO: 751952 - protein, 20 aa, Mycobacterium
WATPVERLGAALLQLLLASW

SEQ ID NO: 751953 - protein, 22 aa, Mycobacterium
WATQGRFAWEQAGIRNNRPADA

SEQ ID NO: 751954 - protein, 18 aa, Mycobacterium
WATSADRIVVVWRAEGGH

SEQ ID NO: 751955 - protein, 25 aa, Mycobacterium
WATTEGWPGFADRLLELARAAEAGS

SEQ ID NO: 751956 - protein, 17 aa, Mycobacterium
WATVEGRAELVGPDDTQ

SEQ ID NO: 751957 - protein, 24 aa, Mycobacterium
WATWPEFRRLEAMGLTMYGQMTAG

SEQ ID NO: 751958 - protein, 18 aa, Mycobacterium
WAVADLEAVLGAGIVPVN

SEQ ID NO: 751959 - protein, 26 aa, Mycobacterium
WAVAHPGCALAVLAALPAWSGDPDTA

SEQ ID NO: 751960 - protein, 25 aa, Mycobacterium
WAVAHPSRWALLYGSPVPGYHAPPE

SEQ ID NO: 751961 - protein, 19 aa, Mycobacterium
WAVALACQGSMALRRKFSA

SEQ ID NO: 751962 - protein, 27 aa, Mycobacterium
WAVALDRGGQVRWFGLDGVEHTGGPLV

SEQ ID NO: 751963 - protein, 20 aa, Mycobacterium
WAVAMDRGGQLRWFGLDGVE

SEQ ID NO: 751964 - protein, 20 aa, Mycobacterium
WAVCEPGRGWSPLDPTVTAT

SEQ ID NO: 751965 - protein, 32 aa, Mycobacterium
WAVGEPDYPAAVWRFRLVPRDGGTNLTYRTQI

SEQ ID NO: 751966 - protein, 40 aa, Mycobacterium
WAVKRGARCILIRPAPVPGFRGPRSFAVPEFDPFWERVVE

SEQ ID NO: 751967 - protein, 19 aa, Mycobacterium
WAVLCEQVGAAALLIPEES

SEQ ID NO: 751968 - protein, 18 aa, Mycobacterium
WAVLRIDVIGVRVGRSRD

SEQ ID NO: 751969 - protein, 18 aa, Mycobacterium
WAVPRAANQFWMLGEPER

SEQ ID NO: 751970 - protein, 17 aa, Mycobacterium
WAVQRLIAGLSHIGADR

SEQ ID NO: 751971 - protein, 29 aa, Mycobacterium
WAVRYTWPRFVCGLPREFFAAVRTELAER

SEQ ID NO: 751972 - protein, 18 aa, Mycobacterium
WAVYAGWVHLAAGRLSAA

SEQ ID NO: 751973 - protein, 17 aa, Mycobacterium
WAWTLPDGGYGWSNAGL

SEQ ID NO: 751974 - protein, 28 aa, Mycobacterium
WAYAAGWRVVRAMPEFAARNVFDAGAHY

SEQ ID NO: 751975 - protein, 29 aa, Mycobacterium
WAYASGWLAVRAMPEFAARNAFGAAARYA

SEQ ID NO: 751976 - protein, 26 aa, Mycobacterium
WAYGDDRIAVRFAYEYHDAAGQWFRA

SEQ ID NO: 751977 - protein, 21 aa, Mycobacterium
WCADHPEALADGGYRQSKEAI

SEQ ID NO: 751978 - protein, 22 aa, Mycobacterium
WCAFARTGVPGAGWPSHVSADH

SEQ ID NO: 751979 - protein, 18 aa, Mycobacterium
WCAGRGRAAESVKQRVDD

SEQ ID NO: 751980 - protein, 17 aa, Mycobacterium
WCALAERYGDDWHRWPK

SEQ ID NO: 751981 - protein, 22 aa, Mycobacterium
WCALTIRLLGRTEIRRLAKELE

SEQ ID NO: 751982 - protein, 19 aa, Mycobacterium
WCAQAARVLDTEFGENLST

SEQ ID NO: 751983 - protein, 21 aa, Mycobacterium
WCARAIAEHGDRVAVGLDAQT

SEQ ID NO: 751984 - protein, 17 aa, Mycobacterium
WCAVATNVLGGCRGSTG

SEQ ID NO: 751985 - protein, 17 aa, Mycobacterium
WCDEIAVGEVLRMKYFD

SEQ ID NO: 751986 - protein, 19 aa, Mycobacterium
WCEEYRVVPEPEPGKATVD

SEQ ID NO: 751987 - protein, 20 aa, Mycobacterium
WCELTIRLLGRTEIRRLAKE

SEQ ID NO: 751988 - protein, 20 aa, Mycobacterium
WCGHGEPLLRCTRCGSDTVR

SEQ ID NO: 751989 - protein, 17 aa, Mycobacterium
WCGLFGVKPQRDRVSLE

SEQ ID NO: 751990 - protein, 20 aa, Mycobacterium
WCGLRKGEVFALRRCDIAAD

SEQ ID NO: 751991 - protein, 24 aa, Mycobacterium
WCGRAEPALRCARCGSDAVRAVVI

SEQ ID NO: 751992 - protein, 26 aa, Mycobacterium
WCIDDVARGLAWRWTQQAATYKTMPP

SEQ ID NO: 751993 - protein, 19 aa, Mycobacterium
WCLDGHGAPRCTRLDLDRV

SEQ ID NO: 751994 - protein, 18 aa, Mycobacterium
WCNAFRGAVDDLRAAGAT

SEQ ID NO: 751995 - protein, 20 aa, Mycobacterium
WCPKCQHEAPIAADVAAAHP

SEQ ID NO: 751996 - protein, 17 aa, Mycobacterium
WCRERLAHFKCPRDVHF

SEQ ID NO: 751997 - protein, 17 aa, Mycobacterium
WCRERLAHFKCPREVHL

SEQ ID NO: 751998 - protein, 19 aa, Mycobacterium
WCRLIRAMEVVRDGGTITD

SEQ ID NO: 751999 - protein, 18 aa, Mycobacterium
WCRMLVLSAARTARRDGV

SEQ ID NO: 752000 - protein, 17 aa, Mycobacterium
WCSGMRAKLGLPAVTEA

SEQ ID NO: 752001 - protein, 26 aa, Mycobacterium
WCTAGHPLADLAWLLVNWPSSTETGA

SEQ ID NO: 752002 - protein, 22 aa, Mycobacterium
WCTREQIPAIPYGGGSSVVGGV

SEQ ID NO: 752003 - protein, 17 aa, Mycobacterium
WCVDFGAMLMRLDGLDL

SEQ ID NO: 752004 - protein, 20 aa, Mycobacterium
WCVGWLRYGLAVDVDAVKPM

SEQ ID NO: 752005 - protein, 18 aa, Mycobacterium
WCVISIGSDEEWRCAAGV

SEQ ID NO: 752006 - protein, 18 aa, Mycobacterium
WCVVPSPAVSRVVKLCDP

SEQ ID NO: 752007 - protein, 29 aa, Mycobacterium
WCYATDEMRAWWGGMWAERILRSDLSAQL

SEQ ID NO: 752008 - protein, 25 aa, Mycobacterium
WCYRSEVRANWKLYMDAFQEFYHAP

SEQ ID NO: 752009 - protein, 20 aa, Mycobacterium
WDAAAAWPDIIRVAADHADA

SEQ ID NO: 752010 - protein, 18 aa, Mycobacterium
WDAAAFCLVDKRSLHLTY

SEQ ID NO: 752011 - protein, 19 aa, Mycobacterium
WDAAAGQLVRVARGGVIKV

SEQ ID NO: 752012 - protein, 21 aa, Mycobacterium
WDAAANAFAARGAGIEIGPAQ

SEQ ID NO: 752013 - protein, 20 aa, Mycobacterium
WDAAFRRCTELLAPVIDEYG

SEQ ID NO: 752014 - protein, 20 aa, Mycobacterium
WDAAFRRCTELLAPVIDTYG

SEQ ID NO: 752015 - protein, 18 aa, Mycobacterium
WDAARHWYGAGFHPAIQL

SEQ ID NO: 752016 - protein, 20 aa, Mycobacterium
WDADMPRWEPGSKALATRAA

SEQ ID NO: 752017 - protein, 28 aa, Mycobacterium
WDADRAAGAYAHRWWVRRTLADALREAA

SEQ ID NO: 752018 - protein, 20 aa, Mycobacterium
WDADRAWTFLQTHSAMAEEN

SEQ ID NO: 752019 - protein, 26 aa, Mycobacterium
WDAFMATPRYAEWLLNDADMISAYEY

SEQ ID NO: 752020 - protein, 17 aa, Mycobacterium
WDAGGAYLGEIPHTVRV

SEQ ID NO: 752021 - protein, 19 aa, Mycobacterium
WDAGPAWPEIEGVAAAHAE

SEQ ID NO: 752022 - protein, 17 aa, Mycobacterium
WDAGPKFSTELVDVDPG

SEQ ID NO: 752023 - protein, 18 aa, Mycobacterium
WDAGRGASLGTFFIGQCL

SEQ ID NO: 752024 - protein, 18 aa, Mycobacterium
WDAGSALGDGMRDEVLAG

SEQ ID NO: 752025 - protein, 18 aa, Mycobacterium
WDAHREWMSYPVDRRRDL

SEQ ID NO: 752026 - protein, 23 aa, Mycobacterium
WDAIAPLLRRWHTGISSVEVQSF

SEQ ID NO: 752027 - protein, 17 aa, Mycobacterium
WDAILGINVGGVISGSR

SEQ ID NO: 752028 - protein, 20 aa, Mycobacterium
WDAKSAWPEIELVAANHTEA

SEQ ID NO: 752029 - protein, 24 aa, Mycobacterium
WDALAGELGSAVASFGSVTSSLAE

SEQ ID NO: 752030 - protein, 18 aa, Mycobacterium
WDALGRWEKPFLAIFGKR

SEQ ID NO: 752031 - protein, 18 aa, Mycobacterium
WDALQLRAGDIVISTPSK

SEQ ID NO: 752032 - protein, 21 aa, Mycobacterium
WDALYKANLRHVLLCTQRVAR

SEQ ID NO: 752033 - protein, 32 aa, Mycobacterium
WDALYRANLRHVLLCSQRVARKMVSEGLSGSI

SEQ ID NO: 752034 - protein, 26 aa, Mycobacterium
WDALYRANLRHVLLCTQRIARQLVSA

SEQ ID NO: 752035 - protein, 26 aa, Mycobacterium
WDALYRANLRHVLLCTQRTARRLVAA

SEQ ID NO: 752036 - protein, 26 aa, Mycobacterium
WDALYRSNLRHVLLCTQRVARRLVAA

SEQ ID NO: 752037 - protein, 17 aa, Mycobacterium
WDAPFSYTARRYAETHD

SEQ ID NO: 752038 - protein, 19 aa, Mycobacterium
WDAPMFDETYSFGGLPTGR

SEQ ID NO: 752039 - protein, 18 aa, Mycobacterium
WDAPVAGTGPEVFADVAA

SEQ ID NO: 752040 - protein, 25 aa, Mycobacterium
WDAQLMFFLGHGYRVVAHDRRGHGR

SEQ ID NO: 752041 - protein, 17 aa, Mycobacterium
WDASLAIGAVAVINGAV

SEQ ID NO: 752042 - protein, 17 aa, Mycobacterium
WDATRLAGQAALQTTDS

SEQ ID NO: 752043 - protein, 20 aa, Mycobacterium
WDAVSCMWTLHQLPDFDTLR

SEQ ID NO: 752044 - protein, 17 aa, Mycobacterium
WDAYRQRVFDRAKDKGW

SEQ ID NO: 752045 - protein, 17 aa, Mycobacterium
WDDELLSFFNIPRAMLP

SEQ ID NO: 752046 - protein, 22 aa, Mycobacterium
WDDEVRLALSVMLPEERLNPEG

SEQ ID NO: 752047 - protein, 25 aa, Mycobacterium
WDDFFRPLHRPLRALPYVADDLDAT

SEQ ID NO: 752048 - protein, 17 aa, Mycobacterium
WDDIGPRIQRVLSTGQA

SEQ ID NO: 752049 - protein, 17 aa, Mycobacterium
WDDIVSRIFGRIDPISM

SEQ ID NO: 752050 - protein, 25 aa, Mycobacterium
WDDLKVWRRRVDAFQSQLRRDTTAL

SEQ ID NO: 752051 - protein, 21 aa, Mycobacterium
WDDLLRPGVEVITPSPLSSGS

SEQ ID NO: 752052 - protein, 23 aa, Mycobacterium
WDDLRTEAVIDRFDEVLAPTHYT

SEQ ID NO: 752053 - protein, 20 aa, Mycobacterium
WDDMIGVNLSGVWKTVKAAV

SEQ ID NO: 752054 - protein, 24 aa, Mycobacterium
WDDMIGVNLSGVWKTVKAGVPHIL

SEQ ID NO: 752055 - protein, 19 aa, Mycobacterium
WDDNYPARIGVMPREGGNR

SEQ ID NO: 752056 - protein, 18 aa, Mycobacterium
WDDVRAHGAVGFVGAGAM

SEQ ID NO: 752057 - protein, 23 aa, Mycobacterium
WDELYRINLQHVFLVTRAFLPAM

SEQ ID NO: 752058 - protein, 20 aa, Mycobacterium
WDERLCLAPDGDFFRTIRHG

SEQ ID NO: 752059 - protein, 19 aa, Mycobacterium
WDEVFAVNVRGVYLMCRQF

SEQ ID NO: 752060 - protein, 24 aa, Mycobacterium
WDEVPDCHPDVFTLGTVPDRFAEM

SEQ ID NO: 752061 - protein, 18 aa, Mycobacterium
WDEVPTCRPEEFTIATVP

SEQ ID NO: 752062 - protein, 17 aa, Mycobacterium
WDFAASVGAKLARPEPP

SEQ ID NO: 752063 - protein, 27 aa, Mycobacterium
WDFAHEFGLPIVEVIAGGDISEAAYAG

SEQ ID NO: 752064 - protein, 26 aa, Mycobacterium
WDFAHELGLPIVEVIAGGDISQGAYP

SEQ ID NO: 752065 - protein, 25 aa, Mycobacterium
WDFDALWTALKTLYPVSLKPEELIA

SEQ ID NO: 752066 - protein, 24 aa, Mycobacterium
WDFPIKEFHPFPRALLGVGAHDII

SEQ ID NO: 752067 - protein, 18 aa, Mycobacterium
WDFPTLAHVWDYRSKAII

SEQ ID NO: 752068 - protein, 17 aa, Mycobacterium
WDGAWDPTLPMVPSANI

SEQ ID NO: 752069 - protein, 18 aa, Mycobacterium
WDGDCDVALAGGVNIMVG

SEQ ID NO: 752070 - protein, 19 aa, Mycobacterium
WDGDITGLVRSHLKATLKH

SEQ ID NO: 752071 - protein, 18 aa, Mycobacterium
WDGFRALVFRDGDDVVLQ

SEQ ID NO: 752072 - protein, 20 aa, Mycobacterium
WDGFRSIVFRDGDEIEFGSR

SEQ ID NO: 752073 - protein, 27 aa, Mycobacterium
WDGKSGWRVGAHAPRAHRLRIGDSTEL

SEQ ID NO: 752074 - protein, 30 aa, Mycobacterium; identical to SEQ ID NO: 106707

SEQ ID NO: 752075 - protein, 19 aa, Mycobacterium
WDGMPEFLAGYAPAVVAAI

SEQ ID NO: 752076 - protein, 20 aa, Mycobacterium
WDGPAAVCFTDGTVIGAVLD

SEQ ID NO: 752077 - protein, 17 aa, Mycobacterium
WDGRDHYLAGIYRTALH

SEQ ID NO: 752078 - protein, 17 aa, Mycobacterium
WDGSRICVGGQSAGGNL

SEQ ID NO: 752079 - protein, 27 aa, Mycobacterium
WDGVAPLLRDRFRLVAIDNRGAGKSSN

SEQ ID NO: 752080 - protein, 23 aa, Mycobacterium
WDHIGDMGIGFCLDTCHAWAAGE

SEQ ID NO: 752081 - protein, 22 aa, Mycobacterium
WDHLEAGLVQRSRLLDAVLTDV

SEQ ID NO: 752082 - protein, 18 aa, Mycobacterium
WDHPIIHPHTADPDHHGF

SEQ ID NO: 752083 - protein, 17 aa, Mycobacterium
WDHSIPLDGKRIAVLGT

SEQ ID NO: 752084 - protein, 20 aa, Mycobacterium
WDIAEPRLALQARQDSAVAA

SEQ ID NO: 752085 - protein, 18 aa, Mycobacterium
WDIAQSWTGFSEQPKYEN

SEQ ID NO: 752086 - protein, 19 aa, Mycobacterium
WDIDIVALSSIVHREDYSS

SEQ ID NO: 752087 - protein, 17 aa, Mycobacterium
WDIGPTWQVESDPSKTS

SEQ ID NO: 752088 - protein, 17 aa, Mycobacterium
WDIREVVAAAATVATVF

SEQ ID NO: 752089 - protein, 17 aa, Mycobacterium
WDISAELTGCEWQDSHP

SEQ ID NO: 752090 - protein, 18 aa, Mycobacterium
WDISPGDLATIWRGGCII

SEQ ID NO: 752091 - protein, 21 aa, Mycobacterium
WDIVSGVGYTALLVAGWRALD

SEQ ID NO: 752092 - protein, 17 aa, Mycobacterium
WDIVSSVGFTALGVAAA

SEQ ID NO: 752093 - protein, 28 aa, Mycobacterium
WDIWKQRLERVLPRRPDFVFASEPYGED

SEQ ID NO: 752094 - protein, 23 aa, Mycobacterium
WDIYACVRQALAVLDPVPETLPD

SEQ ID NO: 752095 - protein, 17 aa, Mycobacterium
WDKKGYKIPGGTPSSPG

SEQ ID NO: 752096 - protein, 20 aa, Mycobacterium
WDKLFRFLALDRLQARLHRW

SEQ ID NO: 752097 - protein, 26 aa, Mycobacterium
WDKPEIIEKLELPAGVNVKRVPQWGI

SEQ ID NO: 752098 - protein, 26 aa, Mycobacterium
WDKPEIIEKLELPPGVNVKRVPQWGI

SEQ ID NO: 752099 - protein, 17 aa, Mycobacterium
WDLAVFGHRGSLSFTGI

SEQ ID NO: 752100 - protein, 17 aa, Mycobacterium
WDLCVGHAGRITAPRGW

SEQ ID NO: 752101 - protein, 26 aa, Mycobacterium
WDLDRSFKVGGCFAGPQNMKLRDVLS

SEQ ID NO: 752102 - protein, 21 aa, Mycobacterium
WDLDVVAGWNSSGLRQTKAGR

SEQ ID NO: 752103 - protein, 22 aa, Mycobacterium
WDLFRYPGIRSDSDMHTLGFRF

SEQ ID NO: 752104 - protein, 25 aa, Mycobacterium
WDLGDARGTVMLRMPLHPVAIELLR

SEQ ID NO: 752105 - protein, 26 aa, Mycobacterium
WDLGDTRGSVMLRMPLHPVAIELLRE

SEQ ID NO: 752106 - protein, 19 aa, Mycobacterium
WDLIMRIASPRGFMATEDV

SEQ ID NO: 752107 - protein, 23 aa, Mycobacterium
WDLLLVCGDPAAADTYYGGFDKT

SEQ ID NO: 752108 - protein, 18 aa, Mycobacterium
WDLLRQRRALRETGQDPR

SEQ ID NO: 752109 - protein, 19 aa, Mycobacterium
WDLNEPWVIDEIEIGDPRP

SEQ ID NO: 752110 - protein, 17 aa, Mycobacterium
WDLPADLDMETYLARKK

SEQ ID NO: 752111 - protein, 19 aa, Mycobacterium
WDLPRYRGALAAGPEDPER

SEQ ID NO: 752112 - protein, 17 aa, Mycobacterium
WDLPVKIGGHLKEPIDE

SEQ ID NO: 752113 - protein, 17 aa, Mycobacterium
WDLPVRIGGHLVDNIDD

SEQ ID NO: 752114 - protein, 17 aa, Mycobacterium
WDLPYPRSVAAFPAPWL

SEQ ID NO: 752115 - protein, 19 aa, Mycobacterium
WDLRDEPNVLLVHYQDLKK

SEQ ID NO: 752116 - protein, 17 aa, Mycobacterium
WDLTALADDCARDGVYE

SEQ ID NO: 752117 - protein, 25 aa, Mycobacterium
WDLTGLRLATKLHEWEPKHGVRYGA

SEQ ID NO: 752118 - protein, 27 aa, Mycobacterium
WDLTGLRLATTLHEWQPRDGVRYGAVS

SEQ ID NO: 752119 - protein, 30 aa, Mycobacterium
WDLVGRDTLCWPYGLHLHRDLLAVADSGNN

SEQ ID NO: 752120 - protein, 27 aa, Mycobacterium
WDLVIAVHLRGHFLLTRNAATYWRSKA

SEQ ID NO: 752121 - protein, 26 aa, Mycobacterium
WDMDLAMKAVPLWSSRGCMPGKLMPV

SEQ ID NO: 752122 - protein, 17 aa, Mycobacterium
WDMPYLGMQVLIEGLAL

SEQ ID NO: 752123 - protein, 26 aa, Mycobacterium
WDMSFLTTLFAYEWDVALSPAGMWQW

SEQ ID NO: 752124 - protein, 25 aa, Mycobacterium
WDMVQPRAGAHPVKLPSYPWQTKRF

SEQ ID NO: 752125 - protein, 19 aa, Mycobacterium
WDNRCRARVLSSGDTPAGF

SEQ ID NO: 752126 - protein, 19 aa, Mycobacterium
WDNVRACHPVFAGDTLYAS

SEQ ID NO: 752127 - protein, 18 aa, Mycobacterium
WDPAELGPVVADLLAKSR

SEQ ID NO: 752128 - protein, 18 aa, Mycobacterium
WDPAELGPVVGDLLAKAR

SEQ ID NO: 752129 - protein, 19 aa, Mycobacterium
WDPAELGRVVADLLAKARP

SEQ ID NO: 752130 - protein, 19 aa, Mycobacterium
WDPAGWPRPKSSAACGPGP

SEQ ID NO: 752131 - protein, 17 aa, Mycobacterium
WDPALTQAFLRGPMHGA

SEQ ID NO: 752132 - protein, 23 aa, Mycobacterium
WDPARQARRGRAFADDLPRRDLN

SEQ ID NO: 752133 - protein, 20 aa, Mycobacterium
WDPASTYVRKAPYFDGMPAE

SEQ ID NO: 752134 - protein, 26 aa, Mycobacterium
WDPATGARRRFPWGTAEPTADVANLG

SEQ ID NO: 752135 - protein, 19 aa, Mycobacterium
WDPDAAVGLMLEHRVTHMA

SEQ ID NO: 752136 - protein, 18 aa, Mycobacterium
WDPDGYAGSVAVNMFAHM

SEQ ID NO: 752137 - protein, 26 aa, Mycobacterium
WDPEIGARRRFPWGAEAPARDRANLG

SEQ ID NO: 752138 - protein, 25 aa, Mycobacterium
WDPFPEFLGGLRLAGAEVVPVRVYR

SEQ ID NO: 752139 - protein, 25 aa, Mycobacterium
WDPFPRPGPQPAPRPGIHNSGWVQS

SEQ ID NO: 752140 - protein, 17 aa, Mycobacterium
WDPLATLGYVSARTSRI

SEQ ID NO: 752141 - protein, 20 aa, Mycobacterium
WDPPEEKLYPVIDGLLEAWH

SEQ ID NO: 752142 - protein, 17 aa, Mycobacterium
WDPPVTASMRLVSIIDD

SEQ ID NO: 752143 - protein, 18 aa, Mycobacterium
WDPPVVKVNYALDGPIPW

SEQ ID NO: 752144 - protein, 19 aa, Mycobacterium
WDPPVVKVNYALGGPVPWR

SEQ ID NO: 752145 - protein, 21 aa, Mycobacterium
WDPRMPDFPGEFTGEQIHSHH

SEQ ID NO: 752146 - protein, 20 aa, Mycobacterium
WDPSRWPRRASAAGPAPQSL

SEQ ID NO: 752147 - protein, 27 aa, Mycobacterium
WDPVAGARRRFPWGSAQPSAALANLGG

SEQ ID NO: 752148 - protein, 18 aa, Mycobacterium
WDPVLVRAFLRGPMHGAV

SEQ ID NO: 752149 - protein, 19 aa, Mycobacterium
WDQIARRRVYLHTARWTSL

SEQ ID NO: 752150 - protein, 17 aa, Mycobacterium
WDQRAPIGWDMKDPTPV

SEQ ID NO: 752151 - protein, 17 aa, Mycobacterium
WDQRAPIGWNMKDPTPV

SEQ ID NO: 752152 - protein, 19 aa, Mycobacterium
WDQRLCLVPNGDLFRAIRH

SEQ ID NO: 752153 - protein, 19 aa, Mycobacterium
WDQRLCLVPNGDLFRGIRH

SEQ ID NO: 752154 - protein, 20 aa, Mycobacterium
WDQRVARHRDRRPGHWSTVE

SEQ ID NO: 752155 - protein, 27 aa, Mycobacterium
WDQVIAVHLRGHFLLTRNAATYWRSKA

SEQ ID NO: 752156 - protein, 30 aa, Mycobacterium
WDQVMRLRDLLKFDFYFADSAAFRANIAEE

SEQ ID NO: 752157 - protein, 23 aa, Mycobacterium
WDQWRAVQCPALLLEADDTVTPA

SEQ ID NO: 752158 - protein, 19 aa, Mycobacterium
WDRADAVRRLSEAYGAEAG

SEQ ID NO: 752159 - protein, 20 aa, Mycobacterium
WDRELYRFVSDHRKGQRPVL

SEQ ID NO: 752160 - protein, 19 aa, Mycobacterium
WDRGEARRTSLVLIGTDID

SEQ ID NO: 752161 - protein, 20 aa, Mycobacterium
WDRLASELDTAARSFGSVIG

SEQ ID NO: 752162 - protein, 19 aa, Mycobacterium
WDRLCTALTPGNVVLADQG

SEQ ID NO: 752163 - protein, 18 aa, Mycobacterium
WDRMAVIVRSVPRTGASL

SEQ ID NO: 752164 - protein, 19 aa, Mycobacterium
WDRNYVHSLEWLWLTEPLS

SEQ ID NO: 752165 - protein, 19 aa, Mycobacterium
WDRPGRHALELIDEIQTRI

SEQ ID NO: 752166 - protein, 19 aa, Mycobacterium
WDRPGRHALELMDEINERI

SEQ ID NO: 752167 - protein, 17 aa, Mycobacterium
WDRRPGWFRKVAGKATG

SEQ ID NO: 752168 - protein, 21 aa, Mycobacterium
WDRRPGWFRKVAGLATGVKDR

SEQ ID NO: 752169 - protein, 20 aa, Mycobacterium
WDRRQICTKPFWTPGRAGME

SEQ ID NO: 752170 - protein, 17 aa, Mycobacterium
WDRTLLFRRLKELHLEF

SEQ ID NO: 752171 - protein, 21 aa, Mycobacterium
WDSDRLYSWAVCEPTTAEMVA

SEQ ID NO: 752172 - protein, 18 aa, Mycobacterium
WDSEAASLLSARLQSFGQ

SEQ ID NO: 752173 - protein, 18 aa, Mycobacterium
WDSKAEWILAGSGDELDP

SEQ ID NO: 752174 - protein, 20 aa, Mycobacterium
WDSLPADRPIVYATLGTSGG

SEQ ID NO: 752175 - protein, 17 aa, Mycobacterium
WDSMPLKLFAGGNAKFW

SEQ ID NO: 752176 - protein, 19 aa, Mycobacterium
WDSPRAVAYRTHYGVGKRS

SEQ ID NO: 752177 - protein, 20 aa, Mycobacterium
WDSRVALHRARRPPTWLTIE

SEQ ID NO: 752178 - protein, 17 aa, Mycobacterium
WDSRVYAAVALHPTRAG

SEQ ID NO: 752179 - protein, 24 aa, Mycobacterium
WDSTAQRGAIIWFTGLPASGKSTI

SEQ ID NO: 752180 - protein, 17 aa, Mycobacterium
WDTALPMDTSRPIEFSL

SEQ ID NO: 752181 - protein, 23 aa, Mycobacterium
WDTEFARRRWGGLLAPPALLMGW

SEQ ID NO: 752182 - protein, 17 aa, Mycobacterium
WDTELVGPLVDRTIAKF

SEQ ID NO: 752183 - protein, 17 aa, Mycobacterium
WDTIIGVNVRGVINGSR

SEQ ID NO: 752184 - protein, 19 aa, Mycobacterium
WDTLRSMGFDDSRIGDSRS

SEQ ID NO: 752185 - protein, 18 aa, Mycobacterium
WDTLVLVDAVPSRGDPGA

SEQ ID NO: 752186 - protein, 19 aa, Mycobacterium
WDTPGRWTTNFSAISVYDP

SEQ ID NO: 752187 - protein, 24 aa, Mycobacterium
WDTPVAAKLPWFTLGDPYVSGHVT

SEQ ID NO: 752188 - protein, 17 aa, Mycobacterium
WDTRARVAAPYRVIQFA

SEQ ID NO: 752189 - protein, 18 aa, Mycobacterium
WDTRQRDSIAITLRDALL

SEQ ID NO: 752190 - protein, 21 aa, Mycobacterium
WDVDGSITLAGYVVPHHPAPG

SEQ ID NO: 752191 - protein, 23 aa, Mycobacterium
WDVGIKAAAVYVERISDSDERLF

SEQ ID NO: 752192 - protein, 19 aa, Mycobacterium
WDVGIKDKAVYLERVSDGD

SEQ ID NO: 752193 - protein, 24 aa, Mycobacterium
WDVGTRPPLVLGVEGAGVIRSVGS

SEQ ID NO: 752194 - protein, 18 aa, Mycobacterium
WDVLANGLESAARGYTAA

SEQ ID NO: 752195 - protein, 24 aa, Mycobacterium
WDVLARYGNMLSVSLIFVLEMMVQ

SEQ ID NO: 752196 - protein, 17 aa, Mycobacterium
WDVLCNQVGVAGIALPE

SEQ ID NO: 752197 - protein, 21 aa, Mycobacterium
WDVLEAGLVQRSRLLDAVLAD

SEQ ID NO: 752198 - protein, 18 aa, Mycobacterium
WDVLRRVLRYALHHGAIV

SEQ ID NO: 752199 - protein, 18 aa, Mycobacterium
WDVLTEVITRTGEDLITV

SEQ ID NO: 752200 - protein, 17 aa, Mycobacterium
WDVPIGGMGAVSGALAA

SEQ ID NO: 752201 - protein, 22 aa, Mycobacterium
WDVPKHKGLSFFVIPMKQPGIE

SEQ ID NO: 752202 - protein, 22 aa, Mycobacterium
WDVRCAPAAFRFMSQARHIGKV

SEQ ID NO: 752203 - protein, 19 aa, Mycobacterium
WDWASDAPDGWHVVEAGRR

SEQ ID NO: 752204 - protein, 27 aa, Mycobacterium
WDWLELPDPPALWGWGKTAHLLVGSLA

SEQ ID NO: 752205 - protein, 21 aa, Mycobacterium
WDWQPSHVFEYLAGRGIAPNP

SEQ ID NO: 752206 - protein, 17 aa, Mycobacterium
WDYATAVGHEINAPVPL

SEQ ID NO: 752207 - protein, 18 aa, Mycobacterium
WDYCFPSDIYGNANPESF

SEQ ID NO: 752208 - protein, 17 aa, Mycobacterium
WDYRGRARARRGGQQVR

SEQ ID NO: 752209 - protein, 21 aa, Mycobacterium
WDYRRLRAVTDAVARRLSGHG

SEQ ID NO: 752210 - protein, 17 aa, Mycobacterium
WDYVRQFTDFTGYQHRV

SEQ ID NO: 752211 - protein, 26 aa, Mycobacterium
WEAAFLAGKCFLEYRRRQGQKRSPLP

SEQ ID NO: 752212 - protein, 18 aa, Mycobacterium
WEAAGGPVIERSVVAAAP

SEQ ID NO: 752213 - protein, 17 aa, Mycobacterium
WEAAGLRNDGRVVKVQA

SEQ ID NO: 752214 - protein, 24 aa, Mycobacterium
WEAAKCLVDPPLLVANVHELLTVA

SEQ ID NO: 752215 - protein, 27 aa, Mycobacterium
WEAARPVAPRGALAVDFVLDLNPPEIT

SEQ ID NO: 752216 - protein, 21 aa, Mycobacterium
WEAEFPRDVWELHRLGVEGRK

SEQ ID NO: 752217 - protein, 23 aa, Mycobacterium
WEAEYPRDVWRMHRLGYEGHYTL

SEQ ID NO: 752218 - protein, 18 aa, Mycobacterium
WEAFLGKDEDLYVLESVA

SEQ ID NO: 752219 - protein, 18 aa, Mycobacterium
WEAGGAYLGEIPHTVRVV

SEQ ID NO: 752220 - protein, 18 aa, Mycobacterium
WEAGHVRDVLQYYSASPE

SEQ ID NO: 752221 - protein, 17 aa, Mycobacterium
WEAGVALADSLLARYRD

SEQ ID NO: 752222 - protein, 18 aa, Mycobacterium
WEAIPLLDNHARIWGSRA

SEQ ID NO: 752223 - protein, 19 aa, Mycobacterium
WEALEHAGIPPSSLRRSQT

SEQ ID NO: 752224 - protein, 17 aa, Mycobacterium
WEALEHAGLPPDSLSGT

SEQ ID NO: 752225 - protein, 19 aa, Mycobacterium
WEALERAGIDPARLRGSAT

SEQ ID NO: 752226 - protein, 26 aa, Mycobacterium
WEALERAGIDPLGLRGSATGVFAGVI

SEQ ID NO: 752227 - protein, 20 aa, Mycobacterium
WEALERAGIEPGGLRGSATG

SEQ ID NO: 752228 - protein, 19 aa, Mycobacterium
WEALGRAGFSGGKVLEPGC

SEQ ID NO: 752229 - protein, 17 aa, Mycobacterium
WEAMARVLAHLRRDDLA

SEQ ID NO: 752230 - protein, 19 aa, Mycobacterium
WEAMRFAVTTRPTFWSRRQ

SEQ ID NO: 752231 - protein, 21 aa, Mycobacterium
WEAPDPRLARHVVPQNRLRAY

SEQ ID NO: 752232 - protein, 28 aa, Mycobacterium
WEARTAWQKGRFAGWFPIGVSMAVWASD

SEQ ID NO: 752233 - protein, 19 aa, Mycobacterium
WEATLAYRRELWSYGLGVA

SEQ ID NO: 752234 - protein, 28 aa, Mycobacterium
WEATLSVNLWGVIYGCEIFVPRLRAKGS

SEQ ID NO: 752235 - protein, 22 aa, Mycobacterium
WEAVDSRLGRRVAVKVLKNEFS

SEQ ID NO: 752236 - protein, 17 aa, Mycobacterium
WEAVELLNATSGATDVQ

SEQ ID NO: 752237 - protein, 21 aa, Mycobacterium
WECGTAFYGRADARYCSAACR

SEQ ID NO: 752238 - protein, 20 aa, Mycobacterium
WEDGWDRLGGSPALPTAADL

SEQ ID NO: 752239 - protein, 27 aa, Mycobacterium
WEDIPGLRWPDVDMRGGRVSFDALRRA

SEQ ID NO: 752240 - protein, 24 aa, Mycobacterium
WEDLKVGVEFDGAQHWLDARQRSH

SEQ ID NO: 752241 - protein, 17 aa, Mycobacterium
WEDLVSFVVTQPERLAA

SEQ ID NO: 752242 - protein, 17 aa, Mycobacterium
WEDVADWDFVCTQLAAA

SEQ ID NO: 752243 - protein, 22 aa, Mycobacterium
WEDVHAEACRWEHVMSEEVERR

SEQ ID NO: 752244 - protein, 21 aa, Mycobacterium
WEECLHKAAPVVGLPAPTTAT

SEQ ID NO: 752245 - protein, 17 aa, Mycobacterium
WEEFVPIGRLVQVDIDA

SEQ ID NO: 752246 - protein, 18 aa, Mycobacterium
WEEHAEFDLDWHLHRVSA

SEQ ID NO: 752247 - protein, 19 aa, Mycobacterium
WEELLPRFEKIEVIGEPEY

SEQ ID NO: 752248 - protein, 20 aa, Mycobacterium
WEFDEKYGGLGVKDFRFNQI

SEQ ID NO: 752249 - protein, 17 aa, Mycobacterium
WEFDLANGRWTHSGATQ

SEQ ID NO: 752250 - protein, 17 aa, Mycobacterium
WEFESMPAAMRFLTSES

SEQ ID NO: 752251 - protein, 19 aa, Mycobacterium
WEFGVQLVPESDEFNFGFD

SEQ ID NO: 752252 - protein, 19 aa, Mycobacterium
WEFLPKGIDGFRERFGSEA

SEQ ID NO: 752253 - protein, 18 aa, Mycobacterium
WEFNQPWSVEDIEIGDPV

SEQ ID NO: 752254 - protein, 17 aa, Mycobacterium
WEFPQGTAPDLADLEPA

SEQ ID NO: 752255 - protein, 18 aa, Mycobacterium
WEFYLAYSEAGFRSGYLD

SEQ ID NO: 752256 - protein, 22 aa, Mycobacterium
WEGEARDAYAVKVKDHGEEFFQ

SEQ ID NO: 752257 - protein, 18 aa, Mycobacterium
WEGFTDAYRDLAFPGGIR

SEQ ID NO: 752258 - protein, 25 aa, Mycobacterium
WEGGWRCGEVVLSLVADHARAAWSA

SEQ ID NO: 752259 - protein, 19 aa, Mycobacterium
WEGLERAGYSPAALRGSRS

SEQ ID NO: 752260 - protein, 17 aa, Mycobacterium
WEGLSKFLDRRQLIGFC

SEQ ID NO: 752261 - protein, 29 aa, Mycobacterium
WEGSLAIPVGLPLILGHEMVGRIIAIGDG

SEQ ID NO: 752262 - protein, 20 aa, Mycobacterium
WEGVGTLEAWTTPYDREGRP

SEQ ID NO: 752263 - protein, 19 aa, Mycobacterium
WEGVRDCTEFGAAAPQRRR

SEQ ID NO: 752264 - protein, 17 aa, Mycobacterium
WEGVVSIFRDYGYRRLR

SEQ ID NO: 752265 - protein, 17 aa, Mycobacterium
WEGVVSVFRDYGYRRLR

SEQ ID NO: 752266 - protein, 18 aa, Mycobacterium
WEHALAGMPERLELPTDR

SEQ ID NO: 752267 - protein, 17 aa, Mycobacterium
WEHDAHLYFKRAHGSAL

SEQ ID NO: 752268 - protein, 30 aa, Mycobacterium
WEHDAHLYLKRLLGWSAFLGGPDRYLTEIG

SEQ ID NO: 752269 - protein, 25 aa, Mycobacterium
WEHDLHLFLRRIKVDEAFNGSVAEH

SEQ ID NO: 752270 - protein, 17 aa, Mycobacterium
WEHEMSPDLHIVQIGKQ

SEQ ID NO: 752271 - protein, 17 aa, Mycobacterium
WEHHAHLYLRRAHANGR

SEQ ID NO: 752272 - protein, 19 aa, Mycobacterium
WEHNHIYKPFIESLPSSDP

SEQ ID NO: 752273 - protein, 23 aa, Mycobacterium
WEHTDWTTICAAYDRLLQLTDSP

SEQ ID NO: 752274 - protein, 26 aa, Mycobacterium
WEIDEIRPSFILSNAINIADAPFEFP

SEQ ID NO: 752275 - protein, 21 aa, Mycobacterium
WEIELYKDWGETRVGDQDLST

SEQ ID NO: 752276 - protein, 17 aa, Mycobacterium
WEIEPRAEWGGRRFPPT

SEQ ID NO: 752277 - protein, 21 aa, Mycobacterium
WEIFAPLLRGGRVVVVPEAVV

SEQ ID NO: 752278 - protein, 20 aa, Mycobacterium
WEILGALLTGARLVVIPEDV

SEQ ID NO: 752279 - protein, 17 aa, Mycobacterium
WEILLRLAGAVLGTAVP

SEQ ID NO: 752280 - protein, 23 aa, Mycobacterium
WEINEAFAAVPLKTMRDLDIDPD

SEQ ID NO: 752281 - protein, 24 aa, Mycobacterium
WEINEAFAAVPLKTMRDLGIDPEV

SEQ ID NO: 752282 - protein, 21 aa, Mycobacterium
WEINEAFASVPIAACKEYGLD

SEQ ID NO: 752283 - protein, 20 aa, Mycobacterium
WEINEAFASVPIAACREYGI

SEQ ID NO: 752284 - protein, 20 aa, Mycobacterium
WEINEAFASVPIAACREYGL

SEQ ID NO: 752285 - protein, 21 aa, Mycobacterium
WEINEAFASVPIAAVREYGID

SEQ ID NO: 752286 - protein, 18 aa, Mycobacterium
WEIPIGLRESDMEVAYSH

SEQ ID NO: 752287 - protein, 17 aa, Mycobacterium
WEIQRVCGEVFGLTVRS

SEQ ID NO: 752288 - protein, 18 aa, Mycobacterium
WEIQRVCGEVFGLTVRSR

SEQ ID NO: 752289 - protein, 22 aa, Mycobacterium
WEISEALLPHLAPLLEGPATWD

SEQ ID NO: 752290 - protein, 23 aa, Mycobacterium
WEISNALLRGGRLVVVPEAVAGS

SEQ ID NO: 752291 - protein, 21 aa, Mycobacterium
WEIVKPELNYRVGWGGRTESY

SEQ ID NO: 752292 - protein, 18 aa, Mycobacterium
WEIYVGGAAGAHIRKGDL

SEQ ID NO: 752293 - protein, 19 aa, Mycobacterium
WEKACAWDPATGARRRFPW

SEQ ID NO: 752294 - protein, 17 aa, Mycobacterium
WEKAGLRGSGRPVKLQA

SEQ ID NO: 752295 - protein, 19 aa, Mycobacterium
WEKFYGSAHAGTWPYGLPE

SEQ ID NO: 752296 - protein, 19 aa, Mycobacterium
WEKIEGLRFRRKLRMRLYG

SEQ ID NO: 752297 - protein, 17 aa, Mycobacterium
WEKLFRFLALDRLQTRL

SEQ ID NO: 752298 - protein, 20 aa, Mycobacterium
WEKMPESFLAALDSEFGIST

SEQ ID NO: 752299 - protein, 18 aa, Mycobacterium
WEKYALIVSHTIPFDKVH

SEQ ID NO: 752300 - protein, 28 aa, Mycobacterium
WELAATKLGRFVGLVVIDRGHPRTADRD

SEQ ID NO: 752301 - protein, 20 aa, Mycobacterium
WELADRLRLASACATCSVRG

SEQ ID NO: 752302 - protein, 19 aa, Mycobacterium
WELEDLAFAILHPKKYEEI

SEQ ID NO: 752303 - protein, 19 aa, Mycobacterium
WELFKSARPSTTVDEIVRY

SEQ ID NO: 752304 - protein, 27 aa, Mycobacterium
WELFSTWAQDIFKIVSFDIDLAAEEPT

SEQ ID NO: 752305 - protein, 26 aa, Mycobacterium
WELFWPGMTLGALYKFRVHGADGSVT

SEQ ID NO: 752306 - protein, 19 aa, Mycobacterium
WELGEGWAKHVTVEVALGT

SEQ ID NO: 752307 - protein, 20 aa, Mycobacterium
WELLVDVEGWPAWTKSMREI

SEQ ID NO: 752308 - protein, 18 aa, Mycobacterium
WELSFPKRPGMPDHGHTV

SEQ ID NO: 752309 - protein, 28 aa, Mycobacterium
WELTATRLGRFVGLVVIDRGHPRAGDRD

SEQ ID NO: 752310 - protein, 28 aa, Mycobacterium
WELYGKCHGYMACLPRGRVRVIRHDLPV

SEQ ID NO: 752311 - protein, 25 aa, Mycobacterium
WEMVEKRLAATINERHRVVLGAVLR

SEQ ID NO: 752312 - protein, 21 aa, Mycobacterium
WENTCLIASNGSVEWMCVPRP

SEQ ID NO: 752313 - protein, 20 aa, Mycobacterium
WEPAFFGVRPDLVLKGGAIA

SEQ ID NO: 752314 - protein, 17 aa, Mycobacterium
WEPARLYPPDVLGSGLS

SEQ ID NO: 752315 - protein, 18 aa, Mycobacterium
WEPDVAVADIMRHRVTYS

SEQ ID NO: 752316 - protein, 27 aa, Mycobacterium
WEPEPLRWLGVRGLYIAYKLADRHEAG

SEQ ID NO: 752317 - protein, 18 aa, Mycobacterium
WEPGRVLVTIGIRQARSI

SEQ ID NO: 752318 - protein, 18 aa, Mycobacterium
WEPGWFLTYHYWPTAVDK

SEQ ID NO: 752319 - protein, 17 aa, Mycobacterium
WEPGWLVADKQSGRYAD

SEQ ID NO: 752320 - protein, 18 aa, Mycobacterium
WEPGWYLTYHYWPTAVDK

SEQ ID NO: 752321 - protein, 17 aa, Mycobacterium
WEPGWYLTYHYWPTTVD

SEQ ID NO: 752322 - protein, 23 aa, Mycobacterium
WEPKTEKVRQLFADAGIRIPTQD

SEQ ID NO: 752323 - protein, 18 aa, Mycobacterium
WEPLPIQYIDYALWQRAC

SEQ ID NO: 752324 - protein, 23 aa, Mycobacterium
WEPNYVHSIDWRWLTVPLAPGPG

SEQ ID NO: 752325 - protein, 17 aa, Mycobacterium
WEPPVPVAITSGTDTDT

SEQ ID NO: 752326 - protein, 20 aa, Mycobacterium
WEPRMQRRLFSLIYADASEL

SEQ ID NO: 752327 - protein, 19 aa, Mycobacterium
WEPTAALVICDAYHMDSDE

SEQ ID NO: 752328 - protein, 21 aa, Mycobacterium
WEPTMEALLLGAFISEGFVSE

SEQ ID NO: 752329 - protein, 18 aa, Mycobacterium
WEPTVVRPICNALIDEFI

SEQ ID NO: 752330 - protein, 20 aa, Mycobacterium
WEPVRGCWSLRPRGTATTPL

SEQ ID NO: 752331 - protein, 19 aa, Mycobacterium
WEPWVHALPVEFTSADQVY

SEQ ID NO: 752332 - protein, 17 aa, Mycobacterium
WEQARRFQGGAADPEAL

SEQ ID NO: 752333 - protein, 28 aa, Mycobacterium
WEQGVEFAMARACAAGALATLVPGAGDC

SEQ ID NO: 752334 - protein, 24 aa, Mycobacterium
WEQHPRIEWEIIMVEASRPLKLDP

SEQ ID NO: 752335 - protein, 20 aa, Mycobacterium
WEQIAALKAHVTGIPVLGNG

SEQ ID NO: 752336 - protein, 17 aa, Mycobacterium
WEQIKKFAVLDRELSIE

SEQ ID NO: 752337 - protein, 17 aa, Mycobacterium
WEQIKKFTILDRELSIE

SEQ ID NO: 752338 - protein, 23 aa, Mycobacterium
WEQLRQTYLRLGHQVELVEPEPG

SEQ ID NO: 752339 - protein, 24 aa, Mycobacterium
WEQVADWDYVCEQLAAAEPWWEPG

SEQ ID NO: 752340 - protein, 17 aa, Mycobacterium
WERAEAIAAAWHEQGIR

SEQ ID NO: 752341 - protein, 17 aa, Mycobacterium
WERAELFNQLVAEFLSQ

SEQ ID NO: 752342 - protein, 18 aa, Mycobacterium
WERAHSVPAPGWAVNRKR

SEQ ID NO: 752343 - protein, 21 aa, Mycobacterium
WERELDGGGLFGERNARTVVK

SEQ ID NO: 752344 - protein, 17 aa, Mycobacterium
WERESRGAAYVVATPSP

SEQ ID NO: 752345 - protein, 20 aa, Mycobacterium
WERFAALPFSEVRKATFDTG

SEQ ID NO: 752346 - protein, 17 aa, Mycobacterium
WERFEVPDEAIGCGFTE

SEQ ID NO: 752347 - protein, 19 aa, Mycobacterium
WERFYGSAHAGSWPYGLPE

SEQ ID NO: 752348 - protein, 18 aa, Mycobacterium
WERFYGSAHSGSWPYGLP

SEQ ID NO: 752349 - protein, 17 aa, Mycobacterium
WERGVEFLTAVGHMCDE

SEQ ID NO: 752350 - protein, 23 aa, Mycobacterium
WERILCSAGKRGLQMALAPEDLV

SEQ ID NO: 752351 - protein, 24 aa, Mycobacterium
WERINRFESGVVRVYLAAPDLQAG

SEQ ID NO: 752352 - protein, 17 aa, Mycobacterium
WERLCAMGATTMAVPES

SEQ ID NO: 752353 - protein, 19 aa, Mycobacterium
WERLQRFAVITQFTTLTDA

SEQ ID NO: 752354 - protein, 18 aa, Mycobacterium
WERLSEVAVHLATETAAL

SEQ ID NO: 752355 - protein, 19 aa, Mycobacterium
WERLWPQLGRQATAHSQPS

SEQ ID NO: 752356 - protein, 18 aa, Mycobacterium
WERMRPVLEDTLGAPITD

SEQ ID NO: 752357 - protein, 17 aa, Mycobacterium
WERPEKPDPLGMPLQTA

SEQ ID NO: 752358 - protein, 17 aa, Mycobacterium
WERPPGLATPQCFVVLR

SEQ ID NO: 752359 - protein, 29 aa, Mycobacterium
WERQGRAGSRVSIRWEIPCDTAPGQYRIV

SEQ ID NO: 752360 - protein, 18 aa, Mycobacterium
WERREYDKFAAYGASKTA

SEQ ID NO: 752361 - protein, 17 aa, Mycobacterium
WERRLRPLGVPAAAVRS

SEQ ID NO: 752362 - protein, 17 aa, Mycobacterium
WERRRYSPWLAYSQSKL

SEQ ID NO: 752363 - protein, 22 aa, Mycobacterium
WERRSRLTPVLPETGETGPESW

SEQ ID NO: 752364 - protein, 18 aa, Mycobacterium
WERSGLRAWPGDLPELPH

SEQ ID NO: 752365 - protein, 21 aa, Mycobacterium
WERTDWVAICSAYDRLWQLTG

SEQ ID NO: 752366 - protein, 20 aa, Mycobacterium
WERTHLDSLQAAYCLLHAWL

SEQ ID NO: 752367 - protein, 19 aa, Mycobacterium
WERTIREFTELLKSEDAKE

SEQ ID NO: 752368 - protein, 20 aa, Mycobacterium
WERVLDAGGLFGERNIRMVV

SEQ ID NO: 752369 - protein, 23 aa, Mycobacterium
WERVWPASRWQRYLRAQLDGNYS

SEQ ID NO: 752370 - protein, 23 aa, Mycobacterium
WESADLDALVALLTDDIFMSMPP

SEQ ID NO: 752371 - protein, 23 aa, Mycobacterium
WESADYCKERLGLDKPLGAIDRS

SEQ ID NO: 752372 - protein, 22 aa, Mycobacterium
WESGKNRLVLIVHHLAVDAVSW

SEQ ID NO: 752373 - protein, 17 aa, Mycobacterium
WESLRGIQATFPLSYGP

SEQ ID NO: 752374 - protein, 23 aa, Mycobacterium
WESQLDPDLLWLGDHVIDDLVVL

SEQ ID NO: 752375 - protein, 19 aa, Mycobacterium
WESQLGPDLLWLSDHVIDD

SEQ ID NO: 752376 - protein, 20 aa, Mycobacterium
WESVFGGPAWTRVTDPNGTP

SEQ ID NO: 752377 - protein, 18 aa, Mycobacterium
WESVKRHFLEIGIDTQTQ

SEQ ID NO: 752378 - protein, 20 aa, Mycobacterium
WETAAVFPIPALTAEQVVGD

SEQ ID NO: 752379 - protein, 17 aa, Mycobacterium
WETFCYQVKAAGQQIFK

SEQ ID NO: 752380 - protein, 25 aa, Mycobacterium
WETFLTSELPEWLSANRSVKPTGSA

SEQ ID NO: 752381 - protein, 19 aa, Mycobacterium
WETLRAMGFDDAHIADSRT

SEQ ID NO: 752382 - protein, 17 aa, Mycobacterium
WETPVPGVARVAMRDVE

SEQ ID NO: 752383 - protein, 17 aa, Mycobacterium
WETRRLGVTDLDFRPQV

SEQ ID NO: 752384 - protein, 17 aa, Mycobacterium
WEVIDATTWTPGQLRDV

SEQ ID NO: 752385 - protein, 19 aa, Mycobacterium
WEVNDGWVRWGYTLEPDGD

SEQ ID NO: 752386 - protein, 25 aa, Mycobacterium
WEVPSAGNARFTWEYDEGRARLLSL

SEQ ID NO: 752387 - protein, 26 aa, Mycobacterium
WEVQGRGELALAVLVETMRREGFELT

SEQ ID NO: 752388 - protein, 18 aa, Mycobacterium
WEVSAAGPFDRWPTGMGF

SEQ ID NO: 752389 - protein, 18 aa, Mycobacterium
WEVTKAFHDRGLPLSVGY

SEQ ID NO: 752390 - protein, 51 aa, Mycobacterium
WEWLRSHLTEQRFAELVPECRGLTIRRFEFPNLKALNFVVAGFLGDGVASC

SEQ ID NO: 752391 - protein, 28 aa, Mycobacterium
WEWPENPRFLMCTPLSHAGAAFFTPVIV

SEQ ID NO: 752392 - protein, 20 aa, Mycobacterium
WEYAMSGSRVSNTRIIVEGF

SEQ ID NO: 752393 - protein, 19 aa, Mycobacterium
WEYDWPTPRWRQHLDAQLE

SEQ ID NO: 752394 - protein, 25 aa, Mycobacterium
WEYRPWRAEALYAIARQYRDDQRYQ

SEQ ID NO: 752395 - protein, 18 aa, Mycobacterium
WEYSPESYTGTELSYAKE

SEQ ID NO: 752396 - protein, 17 aa, Mycobacterium
WFAAELGGGLGRQDILI

SEQ ID NO: 752397 - protein, 20 aa, Mycobacterium
WFAEPPGWLEHRIKEHQNIR

SEQ ID NO: 752398 - protein, 18 aa, Mycobacterium
WFAGGTVLVLRRIRTELD

SEQ ID NO: 752399 - protein, 19 aa, Mycobacterium
WFANLRNTVRFDRAAAAAV

SEQ ID NO: 752400 - protein, 28 aa, Mycobacterium
WFAPKDLRLFYQIRQNWRGKAVLLKLIW

SEQ ID NO: 752401 - protein, 25 aa, Mycobacterium
WFAPKDLRLFYQVRQSWKGKAVLVK

SEQ ID NO: 752402 - protein, 30 aa, Mycobacterium
WFASKKGGADWVEWGGCGMVHPNVLRAAGI

SEQ ID NO: 752403 - protein, 19 aa, Mycobacterium
WFASNCAGQAFVVLAKPEG

SEQ ID NO: 752404 - protein, 18 aa, Mycobacterium
WFDAEGIAGVGMGMITLR

SEQ ID NO: 752405 - protein, 20 aa, Mycobacterium
WFDDPDLMSWLSTARLDLFG

SEQ ID NO: 752406 - protein, 25 aa, Mycobacterium
WFDEHGVSFARHYTGSLACVPSRPT

SEQ ID NO: 752407 - protein, 20 aa, Mycobacterium
WFDIEPCYVYHPLNAYSEHR

SEQ ID NO: 752408 - protein, 19 aa, Mycobacterium
WFDIEPCYVYHPLNAYSEL

SEQ ID NO: 752409 - protein, 19 aa, Mycobacterium
WFDIEPCYVYHPLNAYSEM

SEQ ID NO: 752410 - protein, 19 aa, Mycobacterium
WFDIEPCYVYHPLNAYTET

SEQ ID NO: 752411 - protein, 17 aa, Mycobacterium
WFDRTTLFASGLVSTGI

SEQ ID NO: 752412 - protein, 17 aa, Mycobacterium
WFDRYARSFAGTIAGGT

SEQ ID NO: 752413 - protein, 17 aa, Mycobacterium
WFEARIAYRADSLADLA

SEQ ID NO: 752414 - protein, 24 aa, Mycobacterium
WFEEHGVSFARHYTGSLACVPSRP

SEQ ID NO: 752415 - protein, 18 aa, Mycobacterium
WFEELRLAEATLFVQDWG

SEQ ID NO: 752416 - protein, 20 aa, Mycobacterium
WFELRGRVIGTGRATRTVNR

SEQ ID NO: 752417 - protein, 27 aa, Mycobacterium
WFENAKFGIFIHWGLYSVPGWAPLEAD

SEQ ID NO: 752418 - protein, 17 aa, Mycobacterium
WFFERRNVLPGMTRISE

SEQ ID NO: 752419 - protein, 24 aa, Mycobacterium
WFFLNEVWPLVLARTPDAHLNVIG

SEQ ID NO: 752420 - protein, 19 aa, Mycobacterium
WFGAHGWTALGTPLVEYLR

SEQ ID NO: 752421 - protein, 18 aa, Mycobacterium
WFGASRATVYVDHPVHAR

SEQ ID NO: 752422 - protein, 33 aa, Mycobacterium
WFGGNCNRCIPCRRGSFMQCERMQVPSWHYPGG

SEQ ID NO: 752423 - protein, 17 aa, Mycobacterium
WFGHPGHRGDDAVRRAA

SEQ ID NO: 752424 - protein, 18 aa, Mycobacterium
WFGLDGVEHTGGPLVDFD

SEQ ID NO: 752425 - protein, 17 aa, Mycobacterium
WFGYLSYPDPGACESAP

SEQ ID NO: 752426 - protein, 22 aa, Mycobacterium
WFHAAADLSDWMLYDMASPSSA

SEQ ID NO: 752427 - protein, 27 aa, Mycobacterium
WFHRPFRPDIWHRYELRAANHNDSRGL

SEQ ID NO: 752428 - protein, 20 aa, Mycobacterium
WFHYRMRGANDVFNMALALR

SEQ ID NO: 752429 - protein, 19 aa, Mycobacterium
WFIEELRVSLWAQQLGTAR

SEQ ID NO: 752430 - protein, 25 aa, Mycobacterium
WFIGHLPLAVPVGASFGETARGAQA

SEQ ID NO: 752431 - protein, 19 aa, Mycobacterium
WFKDEYEISESDRLLQVAS

SEQ ID NO: 752432 - protein, 18 aa, Mycobacterium
WFLAGHVVIGRPRGRHGP

SEQ ID NO: 752433 - protein, 17 aa, Mycobacterium
WFLALIARERGEEDAAV

SEQ ID NO: 752434 - protein, 20 aa, Mycobacterium
WFLAPGLITDRVWNYARDNG

SEQ ID NO: 752435 - protein, 17 aa, Mycobacterium
WFLGPNQLRADPMPIER

SEQ ID NO: 752436 - protein, 17 aa, Mycobacterium
WFLIEALLEQGADDLTI

SEQ ID NO: 752437 - protein, 18 aa, Mycobacterium
WFLLCGMDGVTVTTADGR

SEQ ID NO: 752438 - protein, 19 aa, Mycobacterium
WFMRSFRADEWLLYDQSSP

SEQ ID NO: 752439 - protein, 27 aa, Mycobacterium
WFMYFCPGCGHAPHHVFKDWADRYRGR

SEQ ID NO: 752440 - protein, 17 aa, Mycobacterium
WFNKGTNDFGLAHSGEL

SEQ ID NO: 752441 - protein, 29 aa, Mycobacterium
WFPDKKGGPGWVEWGGCGMVNPNVLRACG

SEQ ID NO: 752442 - protein, 17 aa, Mycobacterium
WFPSLKIYNRLGQLYTA

SEQ ID NO: 752443 - protein, 18 aa, Mycobacterium
WFQSKWAPYQLADADWRI

SEQ ID NO: 752444 - protein, 22 aa, Mycobacterium
WFREEFEALGVPFERRAARTAE

SEQ ID NO: 752445 - protein, 19 aa, Mycobacterium
WFRETWRSALTLGQSSLPA

SEQ ID NO: 752446 - protein, 21 aa, Mycobacterium
WFRRHEVVYERLAPRCEGRDV

SEQ ID NO: 752447 - protein, 20 aa, Mycobacterium
WFRRHEVVYQRLAGRCAGRE

SEQ ID NO: 752448 - protein, 21 aa, Mycobacterium
WFRRHEVVYQRLAHRCAGRDV

SEQ ID NO: 752449 - protein, 21 aa, Mycobacterium
WFRRHEVVYQRLAPRCAGRDV

SEQ ID NO: 752450 - protein, 20 aa, Mycobacterium
WFRRHEVVYRRLVERCRDRD

SEQ ID NO: 752451 - protein, 21 aa, Mycobacterium
WFRVATEIDVGAWSDDPAWQG

SEQ ID NO: 752452 - protein, 21 aa, Mycobacterium
WFRYHHLFAEFLRHRLERDHP

SEQ ID NO: 752453 - protein, 24 aa, Mycobacterium
WFSLDAGSGFTYWPHGPLKAPQRI

SEQ ID NO: 752454 - protein, 24 aa, Mycobacterium
WFSLDPGSGFTYWPDGPLKAPKRV

SEQ ID NO: 752455 - protein, 22 aa, Mycobacterium
WFSSALWPFSTLGWPEKTPELE

SEQ ID NO: 752456 - protein, 23 aa, Mycobacterium
WFSSALWPFSTLGWPELTPELEK

SEQ ID NO: 752457 - protein, 20 aa, Mycobacterium
WFSSALWPFSTMGWPDHTPE

SEQ ID NO: 752458 - protein, 20 aa, Mycobacterium
WFSSALWPFSTMGWPEATPE

SEQ ID NO: 752459 - protein, 18 aa, Mycobacterium
WFSYVCPGAGHAPHHVFK

SEQ ID NO: 752460 - protein, 19 aa, Mycobacterium
WFSYVCPGAGHAPHHVFKE

SEQ ID NO: 752461 - protein, 18 aa, Mycobacterium
WFTAPGVTERGWGPIVKA

SEQ ID NO: 752462 - protein, 20 aa, Mycobacterium
WFTASVACRGACRNAIACKQ

SEQ ID NO: 752463 - protein, 18 aa, Mycobacterium
WFTEAYWPAFRRVDFLRA

SEQ ID NO: 752464 - protein, 26 aa, Mycobacterium
WFTERPRQRLAVLLYEIGIVGFGVDP

SEQ ID NO: 752465 - protein, 26 aa, Mycobacterium
WFTRAEVRSALEAGDWTTASDSRLML

SEQ ID NO: 752466 - protein, 17 aa, Mycobacterium
WFTTKYPVSLSVGGLSW

SEQ ID NO: 752467 - protein, 20 aa, Mycobacterium
WFTYLCPGAGHAPHHVFKEW

SEQ ID NO: 752468 - protein, 17 aa, Mycobacterium
WFVDGLVGGSIGFGGEE

SEQ ID NO: 752469 - protein, 19 aa, Mycobacterium
WFVGGKINVAYNCVDRHVE

SEQ ID NO: 752470 - protein, 17 aa, Mycobacterium
WFWPAAAAHPSLPRGAL

SEQ ID NO: 752471 - protein, 18 aa, Mycobacterium
WFYIVRFNLAELWHGYTG

SEQ ID NO: 752472 - protein, 18 aa, Mycobacterium
WFYIVRFNLSELFYGYTG

SEQ ID NO: 752473 - protein, 18 aa, Mycobacterium
WGAALAGRFRRLVHYSCL

SEQ ID NO: 752474 - protein, 17 aa, Mycobacterium
WGAALAGRLRRLVHYSC

SEQ ID NO: 752475 - protein, 20 aa, Mycobacterium
WGAAVAWGVASYVPARLATL

SEQ ID NO: 752476 - protein, 19 aa, Mycobacterium
WGADVIKIEHPVRGDTQRG

SEQ ID NO: 752477 - protein, 19 aa, Mycobacterium
WGADVIKVEHPLRGDTQRG

SEQ ID NO: 752478 - protein, 19 aa, Mycobacterium
WGADVIKVEHPVRGDTQRG

SEQ ID NO: 752479 - protein, 19 aa, Mycobacterium
WGADVVKIEHPVTGDAQRG

SEQ ID NO: 752480 - protein, 19 aa, Mycobacterium
WGAFARRYVDANFGSTGTG

SEQ ID NO: 752481 - protein, 17 aa, Mycobacterium
WGAGFAKSVAVFLNGHG

SEQ ID NO: 752482 - protein, 19 aa, Mycobacterium
WGAGFKFGASLLGLPVGDH

SEQ ID NO: 752483 - protein, 18 aa, Mycobacterium
WGALHGGIDIANSIGTPI

SEQ ID NO: 752484 - protein, 18 aa, Mycobacterium
WGALMKRAIEKYDVDVIG

SEQ ID NO: 752485 - protein, 26 aa, Mycobacterium
WGAMLDSYVPGRWVYKSLSVNYRTPA

SEQ ID NO: 752486 - protein, 23 aa, Mycobacterium
WGAQGYPQMLLRVGWAADSAAAL

SEQ ID NO: 752487 - protein, 19 aa, Mycobacterium
WGATPVKAPALEEILAATG

SEQ ID NO: 752488 - protein, 17 aa, Mycobacterium
WGAVLAGLIVVPSPLPD

SEQ ID NO: 752489 - protein, 17 aa, Mycobacterium
WGAVWGRDELPRKTRSM

SEQ ID NO: 752490 - protein, 18 aa, Mycobacterium
WGAVWGREELPRKTRSML

SEQ ID NO: 752491 - protein, 21 aa, Mycobacterium
WGAWAEIGRAIALAESTDAAI

SEQ ID NO: 752492 - protein, 31 aa, Mycobacterium
WGAYLSGMWLYRLSFAKAKWHSLTGRPLSGV

SEQ ID NO: 752493 - protein, 31 aa, Mycobacterium
WGAYLSGMWLYRLSFAKVKWHSLTGRPLTGA

SEQ ID NO: 752494 - protein, 31 aa, Mycobacterium
WGAYLTGMWLYRLSLAKVKWHALTGRPLTGV

SEQ ID NO: 752495 - protein, 30 aa, Mycobacterium; identical to SEQ ID NO: 208464

SEQ ID NO: 752496 - protein, 30 aa, Mycobacterium
WGCGAKLVLLPRFSASSFWSDVAKYGATVF

SEQ ID NO: 752497 - protein, 21 aa, Mycobacterium
WGDDPCAYLGVAVSGFPNFFM

SEQ ID NO: 752498 - protein, 17 aa, Mycobacterium
WGDHTLVGVGLARLDPA

SEQ ID NO: 752499 - protein, 19 aa, Mycobacterium
WGDPVLPGAPQFDVTKQTG

SEQ ID NO: 752500 - protein, 18 aa, Mycobacterium
WGEAVTAIVVLRSDASSD

SEQ ID NO: 752501 - protein, 18 aa, Mycobacterium
WGEAVTAVVVLRADAARD

SEQ ID NO: 752502 - protein, 18 aa, Mycobacterium
WGEAVTAVVVLRADAPRD

SEQ ID NO: 752503 - protein, 18 aa, Mycobacterium
WGEAVTAVVVLRPDAASD

SEQ ID NO: 752504 - protein, 17 aa, Mycobacterium
WGEAVTAVVVLRPDADR

SEQ ID NO: 752505 - protein, 17 aa, Mycobacterium
WGEAVTAVVVLRSDAPR

SEQ ID NO: 752506 - protein, 17 aa, Mycobacterium
WGEFGAFVEYEPPEAAA

SEQ ID NO: 752507 - protein, 20 aa, Mycobacterium
WGEGAGMVLVERESRARREG

SEQ ID NO: 752508 - protein, 23 aa, Mycobacterium
WGEGPPVYLVHGWGGRRPHLGMF

SEQ ID NO: 752509 - protein, 24 aa, Mycobacterium
WGELPPLIMRRVGYGAGQHNSLEA

SEQ ID NO: 752510 - protein, 17 aa, Mycobacterium
WGELVYDGLWFSPLKSA

SEQ ID NO: 752511 - protein, 22 aa, Mycobacterium
WGEPPAAVAEKVEWIRRAAAGQ

SEQ ID NO: 752512 - protein, 17 aa, Mycobacterium
WGERISSFPADFSNVGI

SEQ ID NO: 752513 - protein, 17 aa, Mycobacterium
WGESMSRQAGGRAGGSG

SEQ ID NO: 752514 - protein, 17 aa, Mycobacterium
WGETKLGSVGRPLPGID

SEQ ID NO: 752515 - protein, 17 aa, Mycobacterium
WGEVKCYGGAVVLGPTE

SEQ ID NO: 752516 - protein, 19 aa, Mycobacterium
WGFDADGFAAAGIGAHACG

SEQ ID NO: 752517 - protein, 18 aa, Mycobacterium
WGFDAEAALGVTTAELCE

SEQ ID NO: 752518 - protein, 19 aa, Mycobacterium
WGFDPEHRAPYGVDFLHNT

SEQ ID NO: 752519 - protein, 18 aa, Mycobacterium
WGFELEDVRAHFDVFYGD

SEQ ID NO: 752520 - protein, 18 aa, Mycobacterium
WGGAFKYAASLLGLPIGA

SEQ ID NO: 752521 - protein, 17 aa, Mycobacterium
WGGALAQQFAFQNPRRC

SEQ ID NO: 752522 - protein, 30 aa, Mycobacterium; identical to SEQ ID NO: 92647

SEQ ID NO: 752523 - protein, 30 aa, Mycobacterium
WGGATYDVALRFLKEDPWERLAALREAVPN

SEQ ID NO: 752524 - protein, 24 aa, Mycobacterium
WGGATYDVALRFLKEDPWERLATL

SEQ ID NO: 752525 - protein, 24 aa, Mycobacterium
WGGATYDVALRFLKEDPWERLAVL

SEQ ID NO: 752526 - protein, 20 aa, Mycobacterium
WGGCAYCGATGTALQRDCVQ

SEQ ID NO: 752527 - protein, 23 aa, Mycobacterium
WGGDGKCKLVPYAKRTPKLARTR

SEQ ID NO: 752528 - protein, 23 aa, Mycobacterium
WGGDGKCKLVPYAKRTPRLARTR

SEQ ID NO: 752529 - protein, 26 aa, Mycobacterium
WGGDPAPLWPDRVGEMSVRQIDGLTM

SEQ ID NO: 752530 - protein, 17 aa, Mycobacterium
WGGEIHPDLAPRPGDIV

SEQ ID NO: 752531 - protein, 19 aa, Mycobacterium
WGGELNALVITVGPGAAGT

SEQ ID NO: 752532 - protein, 27 aa, Mycobacterium
WGGGAPEFVDRLPAMLGLHDDATDFVP

SEQ ID NO: 752533 - protein, 19 aa, Mycobacterium
WGGGHVLNVVMHRPELVRT

SEQ ID NO: 752534 - protein, 17 aa, Mycobacterium
WGGGRLDPRPSPDEVVA

SEQ ID NO: 752535 - protein, 19 aa, Mycobacterium
WGGIMSRVAAARGIAGTVI

SEQ ID NO: 752536 - protein, 26 aa, Mycobacterium
WGGKPGRPLAWHSLGEALLNGRWIKL

SEQ ID NO: 752537 - protein, 28 aa, Mycobacterium
WGGLRIADVEKRLCGEHVSIIAYDSDTA

SEQ ID NO: 752538 - protein, 20 aa, Mycobacterium
WGGPATMFGSGGAGGNGGDA

SEQ ID NO: 752539 - protein, 17 aa, Mycobacterium
WGGPFMLKGVMRVDDAK

SEQ ID NO: 752540 - protein, 19 aa, Mycobacterium
WGGPIGMAVSVERADRVRG

SEQ ID NO: 752541 - protein, 19 aa, Mycobacterium
WGGPISMAVAVERAERVRG

SEQ ID NO: 752542 - protein, 18 aa, Mycobacterium
WGGPPIGAIVFRDPVLLN

SEQ ID NO: 752543 - protein, 17 aa, Mycobacterium
WGGPPIGAMVFREPALM

SEQ ID NO: 752544 - protein, 18 aa, Mycobacterium
WGGQAAFWGPIAGVSDDE

SEQ ID NO: 752545 - protein, 17 aa, Mycobacterium
WGGRFAGGPAPALAALS

SEQ ID NO: 752546 - protein, 18 aa, Mycobacterium
WGGTKPGVGLDCSGLTQW

SEQ ID NO: 752547 - protein, 18 aa, Mycobacterium
WGGVAQEPFLNVVLIADD

SEQ ID NO: 752548 - protein, 24 aa, Mycobacterium
WGGYRLAPGPGLKRNRKELRIIAG

SEQ ID NO: 752549 - protein, 17 aa, Mycobacterium
WGHDRVAQVITFGTIKT

SEQ ID NO: 752550 - protein, 21 aa, Mycobacterium
WGHRISHWLWLRGARLAARAL

SEQ ID NO: 752551 - protein, 27 aa, Mycobacterium
WGHRISHWLWRRNARLVARALGEINRI

SEQ ID NO: 752552 - protein, 18 aa, Mycobacterium
WGIAGWNAAYQRLYPNVA

SEQ ID NO: 752553 - protein, 18 aa, Mycobacterium
WGIARFADAAARAGLEKA

SEQ ID NO: 752554 - protein, 20 aa, Mycobacterium
WGIGECGVCGEKLRAVTKRG

SEQ ID NO: 752555 - protein, 19 aa, Mycobacterium
WGIVMAGGIAVAVNTRSAQ

SEQ ID NO: 752556 - protein, 33 aa, Mycobacterium
WGKSGGGYWSFPHGHLCLWTWAANPQDRPLWDK

SEQ ID NO: 752557 - protein, 34 aa, Mycobacterium
WGKSGGGYWSFPHGHLCLWTWAANPQDRPLWDRL

SEQ ID NO: 752558 - protein, 22 aa, Mycobacterium
WGKTLKYAAVFGSAATGRMTLH

SEQ ID NO: 752559 - protein, 17 aa, Mycobacterium
WGKTVADLMDAVDESIP

SEQ ID NO: 752560 - protein, 18 aa, Mycobacterium
WGKYLGLRTDDLYLVAHL

SEQ ID NO: 752561 - protein, 25 aa, Mycobacterium
WGLAAKGFAAKGGWGPGMHGDYLVR

SEQ ID NO: 752562 - protein, 17 aa, Mycobacterium
WGLAGNAAFVVAPRALT

SEQ ID NO: 752563 - protein, 17 aa, Mycobacterium
WGLAISKRLEWHNNPDN

SEQ ID NO: 752564 - protein, 30 aa, Mycobacterium
WGLDYSFCSRLPPSALECGADLCIGSVHKS

SEQ ID NO: 752565 - protein, 17 aa, Mycobacterium
WGLEYLFGVLEAGKKGA

SEQ ID NO: 752566 - protein, 17 aa, Mycobacterium
WGLEYLFGVLEAGPAGA

SEQ ID NO: 752567 - protein, 17 aa, Mycobacterium
WGLEYLFGVLEAGPTGR

SEQ ID NO: 752568 - protein, 18 aa, Mycobacterium
WGLEYLWGVLTPGDEFQP

SEQ ID NO: 752569 - protein, 18 aa, Mycobacterium
WGLGDYFFPLKYGQRLAE

SEQ ID NO: 752570 - protein, 17 aa, Mycobacterium
WGLGRVIGHQELGEYWG

SEQ ID NO: 752571 - protein, 19 aa, Mycobacterium
WGLSRSRLDEYSALSHERA

SEQ ID NO: 752572 - protein, 17 aa, Mycobacterium
WGLTEGYGLMVGGSDAD

SEQ ID NO: 752573 - protein, 17 aa, Mycobacterium
WGLTEGYGLMVGGSDDD

SEQ ID NO: 752574 - protein, 19 aa, Mycobacterium
WGLVARRYGELAASGPSAP

SEQ ID NO: 752575 - protein, 17 aa, Mycobacterium
WGLVPNWATARQDGRPE

SEQ ID NO: 752576 - protein, 18 aa, Mycobacterium
WGLVRYAKITTIKAIADI

SEQ ID NO: 752577 - protein, 17 aa, Mycobacterium
WGLYCAGKFALNGMSEA

SEQ ID NO: 752578 - protein, 18 aa, Mycobacterium
WGMLEKLAPAFLAGVPSI

SEQ ID NO: 752579 - protein, 22 aa, Mycobacterium
WGMRVPRRLRELHVQISRATAD

SEQ ID NO: 752580 - protein, 22 aa, Mycobacterium
WGMRVPRRLRELHVQISRTTGD

SEQ ID NO: 752581 - protein, 23 aa, Mycobacterium
WGNCSSLYTPFCGLDGDEIDYGA

SEQ ID NO: 752582 - protein, 19 aa, Mycobacterium
WGNHEWDTMTAMPAVNAAH

SEQ ID NO: 752583 - protein, 27 aa, Mycobacterium
WGNHGAALLDIGMTWSAYRDATQALIE

SEQ ID NO: 752584 - protein, 17 aa, Mycobacterium
WGNPAIGIRNAIAPPLR

SEQ ID NO: 752585 - protein, 20 aa, Mycobacterium
WGNQRDGIGLMWKSVSRNKK

SEQ ID NO: 752586 - protein, 17 aa, Mycobacterium
WGNRAVLAQPARTPVSI

SEQ ID NO: 752587 - protein, 17 aa, Mycobacterium
WGPARIGYMLGVHPSTV

SEQ ID NO: 752588 - protein, 23 aa, Mycobacterium
WGPGKARAVQEFASVNGIDLSRS

SEQ ID NO: 752589 - protein, 18 aa, Mycobacterium
WGPHLIRLLHHAEHWATT

SEQ ID NO: 752590 - protein, 24 aa, Mycobacterium
WGPIHGCHVFTPILREAGRAVGPR

SEQ ID NO: 752591 - protein, 18 aa, Mycobacterium
WGPKMVDVLREFATDVRG

SEQ ID NO: 752592 - protein, 17 aa, Mycobacterium
WGPLAWMLLAQALGQLG

SEQ ID NO: 752593 - protein, 17 aa, Mycobacterium
WGPLWLCGRKSSNSLSR

SEQ ID NO: 752594 - protein, 18 aa, Mycobacterium
WGPPPGDLFVDRTHDPDG

SEQ ID NO: 752595 - protein, 19 aa, Mycobacterium
WGPPPGELFVDTSANPDGD

SEQ ID NO: 752596 - protein, 20 aa, Mycobacterium
WGPPSYPGCRPAPIQHELST

SEQ ID NO: 752597 - protein, 18 aa, Mycobacterium
WGPPTAKGMVDLVTNRRD

SEQ ID NO: 752598 - protein, 22 aa, Mycobacterium
WGPQGYPGVLFVAAGTEAEFAA

SEQ ID NO: 752599 - protein, 19 aa, Mycobacterium
WGPSGGWQRALPVATTRRR

SEQ ID NO: 752600 - protein, 17 aa, Mycobacterium
WGPSRDGFRELLESPVV

SEQ ID NO: 752601 - protein, 30 aa, Mycobacterium
WGPTWSGSLKSLWLGDGEAVGDILVGAELA

SEQ ID NO: 752602 - protein, 29 aa, Mycobacterium
WGPTWSGSLKSLWLGEGEAIGDILVGAEL

SEQ ID NO: 752603 - protein, 29 aa, Mycobacterium
WGPTWSGSLKSLWLGEGEAIGDILVGEEL

SEQ ID NO: 752604 - protein, 29 aa, Mycobacterium
WGPTWSGSLKSLWLGEGEAIGDVLVGEEL

SEQ ID NO: 752605 - protein, 17 aa, Mycobacterium
WGPVVTAQADWLRETGR

SEQ ID NO: 752606 - protein, 21 aa, Mycobacterium
WGPWAEIGRAIALAESSDAAI

SEQ ID NO: 752607 - protein, 22 aa, Mycobacterium
WGPWAEIGRAIALAESSDAAIA

SEQ ID NO: 752608 - protein, 30 aa, Mycobacterium
WGQDSFEFFPNFTLLFWVPGWYLTYNYWPT

SEQ ID NO: 752609 - protein, 30 aa, Mycobacterium
WGQDSFEFFPNFTLLLWVPGWYLTYNYWPT

SEQ ID NO: 752610 - protein, 17 aa, Mycobacterium
WGQGWLATCQQAFADLD

SEQ ID NO: 752611 - protein, 18 aa, Mycobacterium
WGQLAMPGPDDYRLMELV

SEQ ID NO: 752612 - protein, 18 aa, Mycobacterium
WGQYRVVKSALPKLSSDA

SEQ ID NO: 752613 - protein, 17 aa, Mycobacterium
WGRDPGADAARMIVTPE

SEQ ID NO: 752614 - protein, 18 aa, Mycobacterium
WGREVVGTATGVVRFIGV

SEQ ID NO: 752615 - protein, 26 aa, Mycobacterium
WGRIVPGASADLVWLDRDPRTVPPLE

SEQ ID NO: 752616 - protein, 27 aa, Mycobacterium
WGRNGRPRIAGVSSFGFAGTNAHVILE

SEQ ID NO: 752617 - protein, 24 aa, Mycobacterium
WGRPASEPDGGWAVIDVETSGFRP

SEQ ID NO: 752618 - protein, 25 aa, Mycobacterium
WGRPRIRLSGAIGEYLADMTMHVTL

SEQ ID NO: 752619 - protein, 28 aa, Mycobacterium
WGRRKLPYRRSVVCGSAKQAVSLLTAPA

SEQ ID NO: 752620 - protein, 23 aa, Mycobacterium
WGSADLRRWLPLDVGRPLRSTLV

SEQ ID NO: 752621 - protein, 19 aa, Mycobacterium
WGSAFADLPAAIKAMKDKV

SEQ ID NO: 752622 - protein, 17 aa, Mycobacterium
WGSAQPSAALANLGGDA

SEQ ID NO: 752623 - protein, 22 aa, Mycobacterium
WGSCGKPFAGMDVRIVDPDSGE

SEQ ID NO: 752624 - protein, 21 aa, Mycobacterium
WGSGFDCVSVFLNGDAIPAPD

SEQ ID NO: 752625 - protein, 24 aa, Mycobacterium
WGSIHGCHVFTPILREAGPSPRGI

SEQ ID NO: 752626 - protein, 17 aa, Mycobacterium
WGSIQAWAAVTDDSVMP

SEQ ID NO: 752627 - protein, 17 aa, Mycobacterium
WGSIQGWAAVTADSVME

SEQ ID NO: 752628 - protein, 21 aa, Mycobacterium
WGSLLPAVWSFMLAARNRGLG

SEQ ID NO: 752629 - protein, 20 aa, Mycobacterium
WGSMEAVGGQSTWRLGGAFN

SEQ ID NO: 752630 - protein, 18 aa, Mycobacterium
WGSQWEHVRLPDDARDDD

SEQ ID NO: 752631 - protein, 24 aa, Mycobacterium
WGSSDFRRWLPLDIRRPLRSTLIT

SEQ ID NO: 752632 - protein, 19 aa, Mycobacterium
WGSSYGPIGEACRRARRKG

SEQ ID NO: 752633 - protein, 18 aa, Mycobacterium
WGSSYGPIGEACRRARRR

SEQ ID NO: 752634 - protein, 24 aa, Mycobacterium
WGSVEWTNLVTLYLRACESRSKRP

SEQ ID NO: 752635 - protein, 20 aa, Mycobacterium
WGSVEWTNLVTLYLRAHESR

SEQ ID NO: 752636 - protein, 18 aa, Mycobacterium
WGTAAAVEAVQHARRAAG

SEQ ID NO: 752637 - protein, 17 aa, Mycobacterium
WGTAFSVAAPDAANGKA

SEQ ID NO: 752638 - protein, 29 aa, Mycobacterium
WGTDVLKRLRGMFAFALWDTVTRELFCAR

SEQ ID NO: 752639 - protein, 17 aa, Mycobacterium
WGTGRGWAGVRLPVQRQ

SEQ ID NO: 752640 - protein, 24 aa, Mycobacterium
WGTRPCAYLGITVPDFPNLFLIYG

SEQ ID NO: 752641 - protein, 17 aa, Mycobacterium
WGTTVASIVARRSPTLQ

SEQ ID NO: 752642 - protein, 17 aa, Mycobacterium
WGTVPALVADLLTDMAE

SEQ ID NO: 752643 - protein, 20 aa, Mycobacterium
WGVALHGLYAVRDRETTEAG

SEQ ID NO: 752644 - protein, 22 aa, Mycobacterium
WGVDRFRLEGVAHRAKLSPDYV

SEQ ID NO: 752645 - protein, 17 aa, Mycobacterium
WGVETLDPGYPITTADL

SEQ ID NO: 752646 - protein, 18 aa, Mycobacterium
WGVFDGYHSIPFSPAGTL

SEQ ID NO: 752647 - protein, 19 aa, Mycobacterium
WGVIHGCEVFVPRLRERGF

SEQ ID NO: 752648 - protein, 25 aa, Mycobacterium
WGVIHGCQVFTPLLREQRFGGIINV

SEQ ID NO: 752649 - protein, 17 aa, Mycobacterium
WGVIYGCETFVPRLRSS

SEQ ID NO: 752650 - protein, 17 aa, Mycobacterium
WGVKGRFAGSEGGGDRA

SEQ ID NO: 752651 - protein, 22 aa, Mycobacterium
WGVMGIGMGYAIAAAVETGGPV

SEQ ID NO: 752652 - protein, 20 aa, Mycobacterium
WGVMGVGMGYAIAAAVEGSG

SEQ ID NO: 752653 - protein, 17 aa, Mycobacterium
WGVPLEMGASWIHGTTD

SEQ ID NO: 752654 - protein, 21 aa, Mycobacterium
WGVQRLPLFDPIRPVMALLEF

SEQ ID NO: 752655 - protein, 27 aa, Mycobacterium
WGVRDWWSMDWIWSALHLDDGTHLHGV

SEQ ID NO: 752656 - protein, 26 aa, Mycobacterium
WGVRDWWSMDWLWSALHLNDGTHLHG

SEQ ID NO: 752657 - protein, 27 aa, Mycobacterium
WGVRDWWSMDWMWSALHLDDGTHLHGV

SEQ ID NO: 752658 - protein, 26 aa, Mycobacterium
WGVRDWWSMDWMWSAVHLDDGTHLHG

SEQ ID NO: 752659 - protein, 25 aa, Mycobacterium
WGVRRISLGSAMARAALGAFVGGAR

SEQ ID NO: 752660 - protein, 17 aa, Mycobacterium
WGVRTLRQLQKWLSGSG

SEQ ID NO: 752661 - protein, 17 aa, Mycobacterium
WGVTTLWIGSGPRPPAG

SEQ ID NO: 752662 - protein, 17 aa, Mycobacterium
WGYACLVGDGTVAEADR

SEQ ID NO: 752663 - protein, 23 aa, Mycobacterium
WGYAPEYVDGMWGMLQTSEPEDF

SEQ ID NO: 752664 - protein, 19 aa, Mycobacterium
WGYAPEYVEGMWRMLQASE

SEQ ID NO: 752665 - protein, 24 aa, Mycobacterium
WGYKRYWLAEHHFVAVASSSPVTL

SEQ ID NO: 752666 - protein, 19 aa, Mycobacterium
WGYRRFWVAEHHFVAVAST

SEQ ID NO: 752667 - protein, 17 aa, Mycobacterium
WHAALPVGRLDTAVASR

SEQ ID NO: 752668 - protein, 20 aa, Mycobacterium
WHAAVDISVRPDVVVPANAV

SEQ ID NO: 752669 - protein, 21 aa, Mycobacterium
WHADVEFSVEPGVVVPANAVA

SEQ ID NO: 752670 - protein, 18 aa, Mycobacterium
WHAFGRAVAGAKASAEAQ

SEQ ID NO: 752671 - protein, 18 aa, Mycobacterium
WHAICLAYDRLLTMTDSP

SEQ ID NO: 752672 - protein, 17 aa, Mycobacterium
WHAKEELAHYGVQPDWF

SEQ ID NO: 752673 - protein, 20 aa, Mycobacterium
WHALPARLLAEVLRLRGWRV

SEQ ID NO: 752674 - protein, 19 aa, Mycobacterium
WHALRAMGIDDQYEGFGAL

SEQ ID NO: 752675 - protein, 23 aa, Mycobacterium
WHAMAVEHVRRALPPPDAEPAGD

SEQ ID NO: 752676 - protein, 25 aa, Mycobacterium
WHARVPDWRDYYLGLDQHRHYAYLK

SEQ ID NO: 752677 - protein, 25 aa, Mycobacterium
WHARVPDWRDYYLGLDQRRHYAYLK

SEQ ID NO: 752678 - protein, 20 aa, Mycobacterium
WHARVPDWRDYYLSLDQTRH

SEQ ID NO: 752679 - protein, 21 aa, Mycobacterium
WHASGLQRRWLAASERGGSVG

SEQ ID NO: 752680 - protein, 20 aa, Mycobacterium
WHASKELDWLYPAQGHVVPE

SEQ ID NO: 752681 - protein, 17 aa, Mycobacterium
WHATARLASPGERDEIW

SEQ ID NO: 752682 - protein, 17 aa, Mycobacterium
WHAVRRGEVGKRDVAIV

SEQ ID NO: 752683 - protein, 19 aa, Mycobacterium
WHAVVKQYRPAVAGLPPAA

SEQ ID NO: 752684 - protein, 19 aa, Mycobacterium
WHDLGRYLGVYGHPDVSSP

SEQ ID NO: 752685 - protein, 20 aa, Mycobacterium
WHDLGRYLGVYGHPDVSSPR

SEQ ID NO: 752686 - protein, 19 aa, Mycobacterium
WHDLGRYLGVYGHPDVVSP

SEQ ID NO: 752687 - protein, 17 aa, Mycobacterium
WHDSVGWFITNSVLESA

SEQ ID NO: 752688 - protein, 17 aa, Mycobacterium
WHDVRAGDYVRVPGDAL

SEQ ID NO: 752689 - protein, 19 aa, Mycobacterium
WHDVSAWTRMSILNTARSG

SEQ ID NO: 752690 - protein, 19 aa, Mycobacterium
WHEGPVWLERVLRALPQAG

SEQ ID NO: 752691 - protein, 25 aa, Mycobacterium
WHEIDGVVIPAPFDMRALLTDPRLQ

SEQ ID NO: 752692 - protein, 17 aa, Mycobacterium
WHEPTEWLNLPVGGVAL

SEQ ID NO: 752693 - protein, 24 aa, Mycobacterium
WHERETYDFFGIIFDGHPSLTRIE

SEQ ID NO: 752694 - protein, 24 aa, Mycobacterium
WHERETYDFFGIVFDGHPSLTRIE

SEQ ID NO: 752695 - protein, 22 aa, Mycobacterium
WHETICDALLDGARKVAEQAGV

SEQ ID NO: 752696 - protein, 23 aa, Mycobacterium
WHETRRGTGLPGDVRVIGQIPIC

SEQ ID NO: 752697 - protein, 17 aa, Mycobacterium
WHFIPFAGGARACIGEH

SEQ ID NO: 752698 - protein, 19 aa, Mycobacterium
WHFRLEPIPAGTRLTQAFQ

SEQ ID NO: 752699 - protein, 26 aa, Mycobacterium
WHFTDMKAYRAALVASWNTFLENDRR

SEQ ID NO: 752700 - protein, 18 aa, Mycobacterium
WHGDCAALHALFIAIERC

SEQ ID NO: 752701 - protein, 17 aa, Mycobacterium
WHGLIPVSTSEPLYGSG

SEQ ID NO: 752702 - protein, 18 aa, Mycobacterium
WHGPGKLTVGDCLPNPVA

SEQ ID NO: 752703 - protein, 24 aa, Mycobacterium
WHGRSPRLWLITGGGLAVHDGEPG

SEQ ID NO: 752704 - protein, 17 aa, Mycobacterium
WHGTVLAAIEFSEMVTP

SEQ ID NO: 752705 - protein, 20 aa, Mycobacterium
WHHDVTWRPEPSILAILHAI

SEQ ID NO: 752706 - protein, 24 aa, Mycobacterium
WHHKPRYHVGAVMRSRWDLASPAA

SEQ ID NO: 752707 - protein, 20 aa, Mycobacterium
WHHTACILCECNCGIVVQVE

SEQ ID NO: 752708 - protein, 18 aa, Mycobacterium
WHILMKGAIILAAVGDLD

SEQ ID NO: 752709 - protein, 17 aa, Mycobacterium
WHISRTLTNAVLRQAGT

SEQ ID NO: 752710 - protein, 24 aa, Mycobacterium
WHIVLGYLADAWIAVRSGTAPKAP

SEQ ID NO: 752711 - protein, 17 aa, Mycobacterium
WHKLSVQPYAAMFWHSF

SEQ ID NO: 752712 - protein, 26 aa, Mycobacterium
WHKYWIETRLQWYVDLGIERDNLRLY

SEQ ID NO: 752713 - protein, 19 aa, Mycobacterium
WHLGRMTYRYSRAPDHEAV

SEQ ID NO: 752714 - protein, 17 aa, Mycobacterium
WHLPRLIGARRAAAAYL

SEQ ID NO: 752715 - protein, 17 aa, Mycobacterium
WHMLQPLWLDDLSEERR

SEQ ID NO: 752716 - protein, 23 aa, Mycobacterium
WHNAWPEFVPFLDYPVELRKIVY

SEQ ID NO: 752717 - protein, 19 aa, Mycobacterium
WHNLCAALGSPSWATDPAL

SEQ ID NO: 752718 - protein, 17 aa, Mycobacterium
WHNRQWAHHVPVMRETI

SEQ ID NO: 752719 - protein, 17 aa, Mycobacterium
WHNWRVTWNPSGMYFWL

SEQ ID NO: 752720 - protein, 18 aa, Mycobacterium
WHPDIWLDSEDALELAGR

SEQ ID NO: 752721 - protein, 18 aa, Mycobacterium
WHPGEPWIADTTLGRVLF

SEQ ID NO: 752722 - protein, 17 aa, Mycobacterium
WHPLPFHAVFDAPLYGE

SEQ ID NO: 752723 - protein, 17 aa, Mycobacterium
WHQHRVLDGIGHNVPQE

SEQ ID NO: 752724 - protein, 30 aa, Mycobacterium
WHQLARAFLMYTTQRWPDVLLTAAEELPPQ

SEQ ID NO: 752725 - protein, 18 aa, Mycobacterium
WHQQLAFRDALRIDPDLV

SEQ ID NO: 752726 - protein, 17 aa, Mycobacterium
WHQSWATACQKAFADLN

SEQ ID NO: 752727 - protein, 22 aa, Mycobacterium
WHRAGSARAWWVLSAAGIDNVR

SEQ ID NO: 752728 - protein, 22 aa, Mycobacterium
WHRDPSCTWTFYATTPGQQSCA

SEQ ID NO: 752729 - protein, 19 aa, Mycobacterium
WHRHPWGQVHLRAQNVAER

SEQ ID NO: 752730 - protein, 24 aa, Mycobacterium
WHRKEWEPFWAAAEEAGMVIAFHI

SEQ ID NO: 752731 - protein, 23 aa, Mycobacterium
WHRQGSNLFCWRPVGKTWNETTK

SEQ ID NO: 752732 - protein, 17 aa, Mycobacterium
WHRSGLQRRWLSVSERG

SEQ ID NO: 752733 - protein, 20 aa, Mycobacterium
WHRSHVLEPVDPVAYKQFLT

SEQ ID NO: 752734 - protein, 17 aa, Mycobacterium
WHRTMDWLLLAPTLSAQ

SEQ ID NO: 752735 - protein, 19 aa, Mycobacterium
WHRVAAYLARARVATAQGL

SEQ ID NO: 752736 - protein, 17 aa, Mycobacterium
WHRVATFRAPPGAAGVR

SEQ ID NO: 752737 - protein, 27 aa, Mycobacterium
WHSATGLWNKWGRYGLFNFHSHTNPKP

SEQ ID NO: 752738 - protein, 17 aa, Mycobacterium
WHSPSVGMARCLRVQQN

SEQ ID NO: 752739 - protein, 17 aa, Mycobacterium
WHSSLHWAAAQRGLARR

SEQ ID NO: 752740 - protein, 21 aa, Mycobacterium
WHSTACILCECNCGIVVQLDD

SEQ ID NO: 752741 - protein, 17 aa, Mycobacterium
WHTDVTFVDRIPKASLL

SEQ ID NO: 752742 - protein, 19 aa, Mycobacterium
WHTMRLPELAIYGVNDITM

SEQ ID NO: 752743 - protein, 24 aa, Mycobacterium
WHTRARGADGLAWAHRGTDPEAAA

SEQ ID NO: 752744 - protein, 18 aa, Mycobacterium
WHVARPVPERSVIARAAE

SEQ ID NO: 752745 - protein, 17 aa, Mycobacterium
WHVGGAKLSAVATAAGG

SEQ ID NO: 752746 - protein, 17 aa, Mycobacterium
WHVGPRIYPAGHAVTPY

SEQ ID NO: 752747 - protein, 21 aa, Mycobacterium
WHVVDARGWTPQHLHTAIDEA

SEQ ID NO: 752748 - protein, 17 aa, Mycobacterium
WHWNYTASRHSWQQPLP

SEQ ID NO: 752749 - protein, 17 aa, Mycobacterium
WHYWWQAHLQDCLIDAQ

SEQ ID NO: 752750 - protein, 18 aa, Mycobacterium
WIAAERGFIDAVIDPHET

SEQ ID NO: 752751 - protein, 18 aa, Mycobacterium
WIAEGDFDVLHIHEPNAP

SEQ ID NO: 752752 - protein, 26 aa, Mycobacterium
WIAGPRGVGMLAVRRELMESLRPRLA

SEQ ID NO: 752753 - protein, 20 aa, Mycobacterium
WIAKSADGWITTPRDFTIDE

SEQ ID NO: 752754 - protein, 17 aa, Mycobacterium
WIARVMISLGSVPGNRI

SEQ ID NO: 752755 - protein, 23 aa, Mycobacterium
WIASCFHGRLPWVRTQRTNPFGD

SEQ ID NO: 752756 - protein, 17 aa, Mycobacterium
WIASFRSGMQVFEVIDG

SEQ ID NO: 752757 - protein, 17 aa, Mycobacterium
WIASRWPGLLPEVQRLL

SEQ ID NO: 752758 - protein, 19 aa, Mycobacterium
WIATQKERFVRITPQTLTG

SEQ ID NO: 752759 - protein, 17 aa, Mycobacterium
WIATRYDDCYEILRDWR

SEQ ID NO: 752760 - protein, 19 aa, Mycobacterium
WIATTCLPSTSPSVSKVGP

SEQ ID NO: 752761 - protein, 17 aa, Mycobacterium
WIAYRLCGESGTEPSQA

SEQ ID NO: 752762 - protein, 17 aa, Mycobacterium
WIDIRFTLPANTVDGGI

SEQ ID NO: 752763 - protein, 18 aa, Mycobacterium
WIDLLGPEVIWELYAGTE

SEQ ID NO: 752764 - protein, 18 aa, Mycobacterium
WIDMFTLWPEPASGGIDH

SEQ ID NO: 752765 - protein, 17 aa, Mycobacterium
WIDPILVAGPWILFGVA

SEQ ID NO: 752766 - protein, 20 aa, Mycobacterium
WIDPNSVPDWLIPRDLTGTV

SEQ ID NO: 752767 - protein, 18 aa, Mycobacterium
WIDPRVMGHVTALADPES

SEQ ID NO: 752768 - protein, 18 aa, Mycobacterium
WIDPRVSGHVAALADPAT

SEQ ID NO: 752769 - protein, 22 aa, Mycobacterium
WIDTRLQWYVDLGIDAENLRLF

SEQ ID NO: 752770 - protein, 22 aa, Mycobacterium
WIDTRLQWYVDLGIDPENLRLY

SEQ ID NO: 752771 - protein, 22 aa, Mycobacterium
WIDTRLQWYVDLGIDRDNLRLY

SEQ ID NO: 752772 - protein, 24 aa, Mycobacterium
WIDTRLQWYVELGIDPENLRLFEH

SEQ ID NO: 752773 - protein, 24 aa, Mycobacterium
WIDTRLQWYVELGIDPQNLRLWEH

SEQ ID NO: 752774 - protein, 18 aa, Mycobacterium
WIEECFGASSAVELAVHD

SEQ ID NO: 752775 - protein, 20 aa, Mycobacterium
WIEIIGRGHGLSWEMLPDAA

SEQ ID NO: 752776 - protein, 19 aa, Mycobacterium
WIEQMKRIGIFGLAVPEEY

SEQ ID NO: 752777 - protein, 19 aa, Mycobacterium
WIEQMKRIGIFGLAVSEEY

SEQ ID NO: 752778 - protein, 19 aa, Mycobacterium
WIEQMKRIGIYGLAIGEAY

SEQ ID NO: 752779 - protein, 19 aa, Mycobacterium
WIEQMKRIGIYGLAIPEEY

SEQ ID NO: 752780 - protein, 19 aa, Mycobacterium
WIEQMKRIGIYGLAVPEEY

SEQ ID NO: 752781 - protein, 21 aa, Mycobacterium
WIERFERCWELLGDRRGVLLV

SEQ ID NO: 752782 - protein, 21 aa, Mycobacterium
WIERFERCWQLLGDRHGVLLV

SEQ ID NO: 752783 - protein, 18 aa, Mycobacterium
WIEYEPYGTVLIIGAWNY

SEQ ID NO: 752784 - protein, 28 aa, Mycobacterium
WIFNYNWQWECFRGEGLPREYAAARSLV

SEQ ID NO: 752785 - protein, 18 aa, Mycobacterium
WIFVHMIAEYARHCGHAD

SEQ ID NO: 752786 - protein, 18 aa, Mycobacterium
WIGAEVVLSGEADIALCT

SEQ ID NO: 752787 - protein, 25 aa, Mycobacterium
WIGCDGQTGLGLPDWADLARAYRIP

SEQ ID NO: 752788 - protein, 20 aa, Mycobacterium
WIGEAREWMTLWTMGLNQST

SEQ ID NO: 752789 - protein, 17 aa, Mycobacterium
WIGGPGIGAVHLDKGCY

SEQ ID NO: 752790 - protein, 19 aa, Mycobacterium
WIGGRGRLVTFSVQNRAIA

SEQ ID NO: 752791 - protein, 19 aa, Mycobacterium
WIGLTAEYLLAVRHDPQQA

SEQ ID NO: 752792 - protein, 18 aa, Mycobacterium
WIGMAPFLRRDHLIQNLG

SEQ ID NO: 752793 - protein, 17 aa, Mycobacterium
WIGNIDLSFPYLDTAAT

SEQ ID NO: 752794 - protein, 20 aa, Mycobacterium
WIGTSWKMNKGLAESRGYAR

SEQ ID NO: 752795 - protein, 18 aa, Mycobacterium
WIGYDPPQVPGFDDIGKS

SEQ ID NO: 752796 - protein, 17 aa, Mycobacterium
WIHNELRRICGGPPVAA

SEQ ID NO: 752797 - protein, 40 aa, Mycobacterium
WIHPEHRKKGYGTAALRKSRSEMAWAFPAVPMVVRAPAAN

SEQ ID NO: 752798 - protein, 17 aa, Mycobacterium
WIHRAAHDLMGVNPEAT

SEQ ID NO: 752799 - protein, 17 aa, Mycobacterium
WIHRESDGAFDLQTGPV

SEQ ID NO: 752800 - protein, 17 aa, Mycobacterium
WIIPSIVAFGTEEQKQR

SEQ ID NO: 752801 - protein, 23 aa, Mycobacterium
WIITLRPSGAFFPVEQLLVHAQW

SEQ ID NO: 752802 - protein, 18 aa, Mycobacterium
WIKALSDGCTEGRVITAA

SEQ ID NO: 752803 - protein, 20 aa, Mycobacterium
WIKAQAYRLQTFGTVTRLAA

SEQ ID NO: 752804 - protein, 20 aa, Mycobacterium
WIKAQAYRLQTFGTVTRLAE

SEQ ID NO: 752805 - protein, 23 aa, Mycobacterium
WIKDKYPSLFARIKEKVAAGQFI

SEQ ID NO: 752806 - protein, 19 aa, Mycobacterium
WIKRALGDGRYRVMQKAIE

SEQ ID NO: 752807 - protein, 20 aa, Mycobacterium
WILCAAIAHNLQRAAGILAG

SEQ ID NO: 752808 - protein, 19 aa, Mycobacterium
WILCAVIAHNLLRAVGVLA

SEQ ID NO: 752809 - protein, 26 aa, Mycobacterium
WILDELRELAAVLGIARDAEVLAERY

SEQ ID NO: 752810 - protein, 17 aa, Mycobacterium
WILDLGPGDILTRLTAP

SEQ ID NO: 752811 - protein, 21 aa, Mycobacterium
WILNGAKCWITNGGKSSWYTV

SEQ ID NO: 752812 - protein, 22 aa, Mycobacterium
WILNGAKCWITNGGKSSWYTVM

SEQ ID NO: 752813 - protein, 20 aa, Mycobacterium
WILNGRKVFISGVNEANAVL

SEQ ID NO: 752814 - protein, 19 aa, Mycobacterium
WILPEKWCADNGVEIRTGA

SEQ ID NO: 752815 - protein, 17 aa, Mycobacterium
WILRAILSLLTVEGPRQ

SEQ ID NO: 752816 - protein, 17 aa, Mycobacterium
WILRTILSLLSVRGPRH

SEQ ID NO: 752817 - protein, 18 aa, Mycobacterium
WILRTVLSLLSVRGPRHR

SEQ ID NO: 752818 - protein, 17 aa, Mycobacterium
WIMRTLMSIEVLPAISV

SEQ ID NO: 752819 - protein, 18 aa, Mycobacterium
WINAHPDYADFRVDLDHE

SEQ ID NO: 752820 - protein, 17 aa, Mycobacterium
WINDIWAGASPTSPMYG

SEQ ID NO: 752821 - protein, 22 aa, Mycobacterium
WINDWHMVNAMYPFGGVKQSGL

SEQ ID NO: 752822 - protein, 17 aa, Mycobacterium
WINQGALEVSHDAAGRK

SEQ ID NO: 752823 - protein, 19 aa, Mycobacterium
WINVLVCGPDLPTVALNDF

SEQ ID NO: 752824 - protein, 19 aa, Mycobacterium
WIPPHVRLPAHVSLLEPSA

SEQ ID NO: 752825 - protein, 17 aa, Mycobacterium
WIQPTWPREHGGRSLNL

SEQ ID NO: 752826 - protein, 18 aa, Mycobacterium
WIQPVVDGLGLAPMAVCA

SEQ ID NO: 752827 - protein, 17 aa, Mycobacterium
WIQQLALNTHSWSAAPN

SEQ ID NO: 752828 - protein, 19 aa, Mycobacterium
WIRDKDLRAKFTPDYDCGC

SEQ ID NO: 752829 - protein, 19 aa, Mycobacterium
WIREMLPIGELREILSAAA

SEQ ID NO: 752830 - protein, 19 aa, Mycobacterium
WIREMLPIGELREILSAAT

SEQ ID NO: 752831 - protein, 23 aa, Mycobacterium
WIREVRQQLGITVDWRFFSLEEV

SEQ ID NO: 752832 - protein, 27 aa, Mycobacterium
WIRIEDVPEIWDRLASVGLTTTEACGD

SEQ ID NO: 752833 - protein, 19 aa, Mycobacterium
WIRLHRRFDIDAMLRHIES

SEQ ID NO: 752834 - protein, 40 aa, Mycobacterium
WIRPEHRKKGYGTAALRKSRSEMAWAFPAVPMVVRAPAAH

SEQ ID NO: 752835 - protein, 18 aa, Mycobacterium
WISAEPELYIALDRDLTA

SEQ ID NO: 752836 - protein, 17 aa, Mycobacterium
WISARNFGCDGEPLPVV

SEQ ID NO: 752837 - protein, 26 aa, Mycobacterium
WISDRRPKLGWCWDRNPHTWLGTASC

SEQ ID NO: 752838 - protein, 25 aa, Mycobacterium
WISEGFPEMRVAVIPRDQISFNDGW

SEQ ID NO: 752839 - protein, 24 aa, Mycobacterium
WISEGFPEMRVAVIPRSEISFDDG

SEQ ID NO: 752840 - protein, 17 aa, Mycobacterium
WISKLFPQKMFKKVNQL

SEQ ID NO: 752841 - protein, 27 aa, Mycobacterium
WITALARPVIRWFVWDLTRSELVGLVG

SEQ ID NO: 752842 - protein, 17 aa, Mycobacterium
WITANGHSAVLVVHDDS

SEQ ID NO: 752843 - protein, 25 aa, Mycobacterium
WITDRGFRGLSLRPFMIGRPASDPA

SEQ ID NO: 752844 - protein, 23 aa, Mycobacterium
WITDVKSGLLFVWHDAEGNGPTD

SEQ ID NO: 752845 - protein, 24 aa, Mycobacterium
WITGAADPRCKILIVMGRTNPDAA

SEQ ID NO: 752846 - protein, 26 aa, Mycobacterium
WITKNYREAYGMFAVNGILFNHESPR

SEQ ID NO: 752847 - protein, 17 aa, Mycobacterium
WITSILDLFKENARYFP

SEQ ID NO: 752848 - protein, 17 aa, Mycobacterium
WIVGLQADRHWPALCRV

SEQ ID NO: 752849 - protein, 24 aa, Mycobacterium
WIVRVVLSLAYWPLASSRVERNVL

SEQ ID NO: 752850 - protein, 23 aa, Mycobacterium
WIVRVVMSLAVWPIGDAAAEAGL

SEQ ID NO: 752851 - protein, 17 aa, Mycobacterium
WIVWQLTGRYVRNISTA

SEQ ID NO: 752852 - protein, 21 aa, Mycobacterium
WIVYEEEYFRAGAPGRASANG

SEQ ID NO: 752853 - protein, 17 aa, Mycobacterium
WIYLHMIGEYARHNGHA

SEQ ID NO: 752854 - protein, 17 aa, Mycobacterium
WKAAAGLTVGAGAFHPT

SEQ ID NO: 752855 - protein, 18 aa, Mycobacterium
WKAFAPAWAGKVAIEAVD

SEQ ID NO: 752856 - protein, 26 aa, Mycobacterium
WKAGPALACGNAFILKPSERDPSVPL

SEQ ID NO: 752857 - protein, 26 aa, Mycobacterium
WKAGPALACGNAFLLKPSERDPSVPV

SEQ ID NO: 752858 - protein, 17 aa, Mycobacterium
WKAGQPVSLSPTEFTLL

SEQ ID NO: 752859 - protein, 20 aa, Mycobacterium
WKAGVEAALERLLESAQLEQ

SEQ ID NO: 752860 - protein, 21 aa, Mycobacterium
WKAGVEFDGAHHWTDPAQRAR

SEQ ID NO: 752861 - protein, 18 aa, Mycobacterium
WKALTSAHAHDFEPAEDK

SEQ ID NO: 752862 - protein, 18 aa, Mycobacterium
WKAYLGTRNFTLLQQILD

SEQ ID NO: 752863 - protein, 19 aa, Mycobacterium
WKAYMRRATNTVNYSSDLP

SEQ ID NO: 752864 - protein, 22 aa, Mycobacterium
WKDAAAPLWTFPRVAWERELLP

SEQ ID NO: 752865 - protein, 18 aa, Mycobacterium
WKDHPIWKLTFGSQHPIL

SEQ ID NO: 752866 - protein, 20 aa, Mycobacterium
WKDNERFLASVVAPGRDNAV

SEQ ID NO: 752867 - protein, 19 aa, Mycobacterium
WKDVDPVTGRDTMSMTLTD

SEQ ID NO: 752868 - protein, 19 aa, Mycobacterium
WKDVMIRTWVDDELVQDES

SEQ ID NO: 752869 - protein, 21 aa, Mycobacterium
WKEAGTPGFAKFVDIAHSQAE

SEQ ID NO: 752870 - protein, 21 aa, Mycobacterium
WKEERGQRIFIDFNQNARDRT

SEQ ID NO: 752871 - protein, 44 aa, Mycobacterium
WKFGLSGSCCEACGFVHLPPGRVCKSCGATDRMGTIPVAAMRGT

SEQ ID NO: 752872 - protein, 20 aa, Mycobacterium
WKFRQRTIVADWAYRNDPSR

SEQ ID NO: 752873 - protein, 25 aa, Mycobacterium
WKFYGDIRGVLGFQRLAGTENCIEQ

SEQ ID NO: 752874 - protein, 20 aa, Mycobacterium
WKGATAVVSRYYNLVLADCG

SEQ ID NO: 752875 - protein, 19 aa, Mycobacterium
WKGGEFYTGHKANGFMKKL

SEQ ID NO: 752876 - protein, 18 aa, Mycobacterium
WKGGGSFTGSPFQGIEAT

SEQ ID NO: 752877 - protein, 20 aa, Mycobacterium
WKHGACRALGLPHANQADIA

SEQ ID NO: 752878 - protein, 21 aa, Mycobacterium
WKHVVCDGSAEVRRMRRLTVS

SEQ ID NO: 752879 - protein, 18 aa, Mycobacterium
WKIFGDWRGLLQGPWAGS

SEQ ID NO: 752880 - protein, 24 aa, Mycobacterium
WKIGWACGPAQLIAGMRAAKQYLS

SEQ ID NO: 752881 - protein, 24 aa, Mycobacterium
WKIGWACGPAQLISGVRAAKQYLS

SEQ ID NO: 752882 - protein, 24 aa, Mycobacterium
WKIGWACGPQELIAGVRAAKQYMS

SEQ ID NO: 752883 - protein, 21 aa, Mycobacterium
WKIGWACGTPELVAGVRAAKQ

SEQ ID NO: 752884 - protein, 26 aa, Mycobacterium
WKIPRVKIKIGESWGSDERRDLDRIA

SEQ ID NO: 752885 - protein, 19 aa, Mycobacterium
WKISGRASFIAGHDNQMHA

SEQ ID NO: 752886 - protein, 35 aa, Mycobacterium
WKKAVVERTGLPFSRIRILMRLSRTPMTVKQIAAA

SEQ ID NO: 752887 - protein, 26 aa, Mycobacterium
WKKLPAKARRAILEGCDHQVHVRYKN

SEQ ID NO: 752888 - protein, 21 aa, Mycobacterium
WKKQGEIVFPVFSSKDAMEGA

SEQ ID NO: 752889 - protein, 21 aa, Mycobacterium
WKKSFGLHPLLAFLDRPEIAG

SEQ ID NO: 752890 - protein, 18 aa, Mycobacterium
WKKTGQILANEGFHVVAL

SEQ ID NO: 752891 - protein, 17 aa, Mycobacterium
WKKTGQILGEQGLHVVA

SEQ ID NO: 752892 - protein, 17 aa, Mycobacterium
WKKYNIFNLVWNTLLAL

SEQ ID NO: 752893 - protein, 17 aa, Mycobacterium
WKLAATIGGEAPEHLLD

SEQ ID NO: 752894 - protein, 17 aa, Mycobacterium
WKLAMTVVSHEREPSTL

SEQ ID NO: 752895 - protein, 17 aa, Mycobacterium
WKLAPALAAGNAVVLKP

SEQ ID NO: 752896 - protein, 24 aa, Mycobacterium
WKLAPALAAGNCVVLKPAEQTPAS

SEQ ID NO: 752897 - protein, 17 aa, Mycobacterium
WKLATEVDRVVAKFDRD

SEQ ID NO: 752898 - protein, 27 aa, Mycobacterium
WKLEFQRRGAPHIHLWMTPPPAVGRSG

SEQ ID NO: 752899 - protein, 25 aa, Mycobacterium
WKLESEGGFSPVRRRIFQLEIARAH

SEQ ID NO: 752900 - protein, 29 aa, Mycobacterium
WKLFSGWTDDILKAFSWDAAAQQPAILAA

SEQ ID NO: 752901 - protein, 20 aa, Mycobacterium
WKLGAVPQPLSARLPDAELA

SEQ ID NO: 752902 - protein, 21 aa, Mycobacterium
WKLGAVPQPLSARMPDAELGA

SEQ ID NO: 752903 - protein, 17 aa, Mycobacterium
WKLNPNGTINTGGASLD

SEQ ID NO: 752904 - protein, 17 aa, Mycobacterium
WKLNPVFDECGFDYYTG

SEQ ID NO: 752905 - protein, 17 aa, Mycobacterium
WKLSGPTTVNAIITAAT

SEQ ID NO: 752906 - protein, 20 aa, Mycobacterium
WKLSKDPLFVAKVRDIVGLY

SEQ ID NO: 752907 - protein, 19 aa, Mycobacterium
WKLVRSFDDPGTWTEPGVR

SEQ ID NO: 752908 - protein, 18 aa, Mycobacterium
WKLYSGAFGTDPDKLPMR

SEQ ID NO: 752909 - protein, 17 aa, Mycobacterium
WKMSAMLTLGYPRGKWA

SEQ ID NO: 752910 - protein, 29 aa, Mycobacterium
WKNFVRGPVKLMRDAWEPVLRNWQEMSAS

SEQ ID NO: 752911 - protein, 20 aa, Mycobacterium
WKNPTRWLAERLNRGELRGV

SEQ ID NO: 752912 - protein, 22 aa, Mycobacterium
WKPASTVPLLAIRLAEALTEAG

SEQ ID NO: 752913 - protein, 23 aa, Mycobacterium
WKPASTVPLLAMRLAQAFDAAGL

SEQ ID NO: 752914 - protein, 19 aa, Mycobacterium
WKPAVRPTILTWGLLGPGK

SEQ ID NO: 752915 - protein, 23 aa, Mycobacterium
WKPEAEGGFSRVHRRIWELEKRR

SEQ ID NO: 752916 - protein, 19 aa, Mycobacterium
WKPFIIRLSNSVTRDSAHL

SEQ ID NO: 752917 - protein, 21 aa, Mycobacterium
WKPIGGFPVTVGWIHAIRRGQ

SEQ ID NO: 752918 - protein, 25 aa, Mycobacterium
WKPLGGFPVTAGWFSAIRRGQARLH

SEQ ID NO: 752919 - protein, 26 aa, Mycobacterium
WKPLLFGDDGGRAFLEIMRGFELTPE

SEQ ID NO: 752920 - protein, 18 aa, Mycobacterium
WKPMLGMTGPTALELEFG

SEQ ID NO: 752921 - protein, 20 aa, Mycobacterium
WKPPQPASFPHRGRGIALMR

SEQ ID NO: 752922 - protein, 18 aa, Mycobacterium
WKPPSAIPDTYRGRGIGI

SEQ ID NO: 752923 - protein, 26 aa, Mycobacterium
WKPSELTPLTALACQALLTRAAADVG

SEQ ID NO: 752924 - protein, 20 aa, Mycobacterium
WKPSPGSVYPTLQLLTDEGL

SEQ ID NO: 752925 - protein, 18 aa, Mycobacterium
WKPVAGVHSLVWEEAQLA

SEQ ID NO: 752926 - protein, 21 aa, Mycobacterium
WKQNFRGGAAVQVVYDGKTTA

SEQ ID NO: 752927 - protein, 27 aa, Mycobacterium
WKQRESLKTLGLRKIRQTVVREDNAQT

SEQ ID NO: 752928 - protein, 27 aa, Mycobacterium
WKQRLVSAGVRPAGMWAYEAHRVAAQR

SEQ ID NO: 752929 - protein, 19 aa, Mycobacterium
WKQYRILDQSFVIVRGKDQ

SEQ ID NO: 752930 - protein, 18 aa, Mycobacterium
WKRDEVDHALALTQPAHA

SEQ ID NO: 752931 - protein, 18 aa, Mycobacterium
WKRDEVDHALGLTDPAHA

SEQ ID NO: 752932 - protein, 24 aa, Mycobacterium
WKRDGRPLLETALDGLARDKPLSA

SEQ ID NO: 752933 - protein, 25 aa, Mycobacterium
WKRRHPRLRVESVAVHAGLLDYPAG

SEQ ID NO: 752934 - protein, 17 aa, Mycobacterium
WKSAFGSGKGNDAIGSG

SEQ ID NO: 752935 - protein, 17 aa, Mycobacterium
WKSHPKLATPDLQICVA

SEQ ID NO: 752936 - protein, 25 aa, Mycobacterium
WKSLGKDVTHWDEWGSNPAEALGKT

SEQ ID NO: 752937 - protein, 18 aa, Mycobacterium
WKSLRRVPVGGEALPGPV

SEQ ID NO: 752938 - protein, 24 aa, Mycobacterium
WKSRGLDLSPLFAVPDTASQRRRT

SEQ ID NO: 752939 - protein, 18 aa, Mycobacterium
WKTAAALDPQTYDPKFKG

SEQ ID NO: 752940 - protein, 20 aa, Mycobacterium
WKTDFPGWTGMFLNETALRP

SEQ ID NO: 752941 - protein, 17 aa, Mycobacterium
WKTPSFFLTHPQGIAAF

SEQ ID NO: 752942 - protein, 21 aa, Mycobacterium
WKTRVELANAIFDYIEIFHNR

SEQ ID NO: 752943 - protein, 22 aa, Mycobacterium
WKVEIGTNLWALPRGVARTGQA

SEQ ID NO: 752944 - protein, 19 aa, Mycobacterium
WKVGVQYDGIQHWTDPTQR

SEQ ID NO: 752945 - protein, 24 aa, Mycobacterium
WKVIESRLRAAAAADLVLAVYNPA

SEQ ID NO: 752946 - protein, 17 aa, Mycobacterium
WKVKRIRNTPRVTLATC

SEQ ID NO: 752947 - protein, 17 aa, Mycobacterium
WKVRCVTGAPEAAVAAP

SEQ ID NO: 752948 - protein, 17 aa, Mycobacterium
WKVREIPLAEVEKAVVQ

SEQ ID NO: 752949 - protein, 18 aa, Mycobacterium
WKVTEIDPGVSWTWEQRG

SEQ ID NO: 752950 - protein, 21 aa, Mycobacterium
WKVVESFPALGADGGADGDVK

SEQ ID NO: 752951 - protein, 19 aa, Mycobacterium
WKYLMALFNAKIDENADPK

SEQ ID NO: 752952 - protein, 19 aa, Mycobacterium
WKYLMALFNSKIDEHADPK

SEQ ID NO: 752953 - protein, 19 aa, Mycobacterium
WKYLMALFSSKIDEYADPK

SEQ ID NO: 752954 - protein, 19 aa, Mycobacterium
WKYLTALFNAKIDEHADPK

SEQ ID NO: 752955 - protein, 21 aa, Mycobacterium
WLAAHPRFHMHFTPNYSSWLS

SEQ ID NO: 752956 - protein, 17 aa, Mycobacterium
WLAAIDRGGPAGVQATR

SEQ ID NO: 752957 - protein, 17 aa, Mycobacterium
WLAALGVGKGDRVILML

SEQ ID NO: 752958 - protein, 21 aa, Mycobacterium
WLAAPKRLPGRLEMETQRGKR

SEQ ID NO: 752959 - protein, 21 aa, Mycobacterium
WLAARAEGLGMGWVSIFEPQP

SEQ ID NO: 752960 - protein, 18 aa, Mycobacterium
WLAARGWKVQGSHALELA

SEQ ID NO: 752961 - protein, 17 aa, Mycobacterium
WLADGHFVLLGYQQCVV

SEQ ID NO: 752962 - protein, 19 aa, Mycobacterium
WLADGRPALVNADSGPALL

SEQ ID NO: 752963 - protein, 26 aa, Mycobacterium
WLADGWLPLLHKWFDLAVASGIPEPN

SEQ ID NO: 752964 - protein, 20 aa, Mycobacterium
WLADLEYLVAAILSELNRII

SEQ ID NO: 752965 - protein, 17 aa, Mycobacterium
WLADLVRRSPWAEMFQS

SEQ ID NO: 752966 - protein, 17 aa, Mycobacterium
WLADRVDALKSLDDVKL

SEQ ID NO: 752967 - protein, 26 aa, Mycobacterium
WLADTWRDRFEEMLTRAEARLNEKDS

SEQ ID NO: 752968 - protein, 19 aa, Mycobacterium
WLAEARNLLELEPYPEMDG

SEQ ID NO: 752969 - protein, 17 aa, Mycobacterium
WLAEGLLIYLPPEAQDR

SEQ ID NO: 752970 - protein, 25 aa, Mycobacterium
WLAEHVVDGRRCGLTVVGTHLPHGG

SEQ ID NO: 752971 - protein, 17 aa, Mycobacterium
WLAENWTGVTLPKSDDP

SEQ ID NO: 752972 - protein, 18 aa, Mycobacterium
WLAEQAWFDVPLSQGTGG

SEQ ID NO: 752973 - protein, 17 aa, Mycobacterium
WLAGAAEPAIFAIQVGL

SEQ ID NO: 752974 - protein, 19 aa, Mycobacterium
WLAGPRGVGVLAVRPELAE

SEQ ID NO: 752975 - protein, 22 aa, Mycobacterium
WLAGRLRAPLNRVIRYIFEGLR

SEQ ID NO: 752976 - protein, 18 aa, Mycobacterium
WLAHIDWTPDLAPVTAAT

SEQ ID NO: 752977 - protein, 21 aa, Mycobacterium
WLALNCRRHMELYGTTREQLG

SEQ ID NO: 752978 - protein, 26 aa, Mycobacterium
WLANRSWNRPSWTVAELEAAKAGRTI

SEQ ID NO: 752979 - protein, 20 aa, Mycobacterium
WLAPEPGATVARVLDAERRE

SEQ ID NO: 752980 - protein, 30 aa, Mycobacterium
WLAPTASFAASPFRWLAWLSESRAGLTAAP

SEQ ID NO: 752981 - protein, 19 aa, Mycobacterium
WLAPYTGSAIAQHWMYDGK

SEQ ID NO: 752982 - protein, 18 aa, Mycobacterium
WLAPYTGSAIGQHWMYNG

SEQ ID NO: 752983 - protein, 17 aa, Mycobacterium
WLAPYTGSALGQHWMYQ

SEQ ID NO: 752984 - protein, 26 aa, Mycobacterium
WLAPYTGSAVAQHWMYDGKHVLIVFD

SEQ ID NO: 752985 - protein, 18 aa, Mycobacterium
WLARADEGLDATLVYAYE

SEQ ID NO: 752986 - protein, 28 aa, Mycobacterium
WLARDVSSLGWRCYRLDAADRPAGWQPA

SEQ ID NO: 752987 - protein, 17 aa, Mycobacterium
WLARRVEIAEHWREVHP

SEQ ID NO: 752988 - protein, 18 aa, Mycobacterium
WLATEWGSALEGFIMDHL

SEQ ID NO: 752989 - protein, 27 aa, Mycobacterium
WLATSRELPWRRPIASLNYLLSSHVWR

SEQ ID NO: 752990 - protein, 18 aa, Mycobacterium
WLAVPVVWIPPATETTAR

SEQ ID NO: 752991 - protein, 18 aa, Mycobacterium
WLAVSGYRRIDDETAPFC

SEQ ID NO: 752992 - protein, 17 aa, Mycobacterium
WLCANEALHTPGIEGLV

SEQ ID NO: 752993 - protein, 18 aa, Mycobacterium
WLCAPRWDSDAVFSNLIG

SEQ ID NO: 752994 - protein, 27 aa, Mycobacterium
WLCDRSWNRPRWKIDELVEAKAGRSIS

SEQ ID NO: 752995 - protein, 17 aa, Mycobacterium
WLCLEGRPDPVDEFEQP

SEQ ID NO: 752996 - protein, 22 aa, Mycobacterium
WLCLPRFDSPSVFARLLDADAG

SEQ ID NO: 752997 - protein, 18 aa, Mycobacterium
WLCSVMGKSGLFNDYLVK

SEQ ID NO: 752998 - protein, 29 aa, Mycobacterium
WLCSVMGKSGLFSDYLIKMAQVITWFSLD

SEQ ID NO: 752999 - protein, 17 aa, Mycobacterium
WLCVGPVADLPDVPDLE

SEQ ID NO: 753000 - protein, 20 aa, Mycobacterium
WLDAEYRLTGTDVRVIVALG

SEQ ID NO: 753001 - protein, 20 aa, Mycobacterium
WLDAQCAALVTLADGYEHPG

SEQ ID NO: 753002 - protein, 18 aa, Mycobacterium
WLDCPDRGVGLTITSQLH

SEQ ID NO: 753003 - protein, 17 aa, Mycobacterium
WLDDIFIGYLVERRREP

SEQ ID NO: 753004 - protein, 23 aa, Mycobacterium
WLDDRKWAYVRLEGRAFGDVPLN

SEQ ID NO: 753005 - protein, 25 aa, Mycobacterium
WLDDRKWAYVRLEGRAFGDVPLNLE

SEQ ID NO: 753006 - protein, 18 aa, Mycobacterium
WLDEVWGFNYQNRIFTTP

SEQ ID NO: 753007 - protein, 35 aa, Mycobacterium
WLDGEGWLRITDRLREMIKVRGFQVAPAEVEAVLH

SEQ ID NO: 753008 - protein, 24 aa, Mycobacterium
WLDGTLPAFTSWVNPAATRTRDAV

SEQ ID NO: 753009 - protein, 18 aa, Mycobacterium
WLDHPEFGERFRGTLRVN

SEQ ID NO: 753010 - protein, 18 aa, Mycobacterium
WLDLCAGPGGKTALLAAL

SEQ ID NO: 753011 - protein, 22 aa, Mycobacterium
WLDLPARPALIGTRGPDGKPFG

SEQ ID NO: 753012 - protein, 18 aa, Mycobacterium
WLDMLPMELVTGSPELGL

SEQ ID NO: 753013 - protein, 18 aa, Mycobacterium
WLDPALTTPYAWYQYFFN

SEQ ID NO: 753014 - protein, 17 aa, Mycobacterium
WLDPAMTTPYAWYQYFF

SEQ ID NO: 753015 - protein, 22 aa, Mycobacterium
WLDPEMTSPYAWYQYFINTADA

SEQ ID NO: 753016 - protein, 23 aa, Mycobacterium
WLDPEMTSPYAWYQYFVNTADAD

SEQ ID NO: 753017 - protein, 29 aa, Mycobacterium
WLDPFTEFRFPRIGTAVFDGIEIELRGAI

SEQ ID NO: 753018 - protein, 17 aa, Mycobacterium
WLDPMIALAFAAAASSR

SEQ ID NO: 753019 - protein, 23 aa, Mycobacterium
WLDPQLTSPYAWYQYFVNTSDAD

SEQ ID NO: 753020 - protein, 17 aa, Mycobacterium
WLDPSINDFWTTYQTNQ

SEQ ID NO: 753021 - protein, 18 aa, Mycobacterium
WLDQRGITALTELDTHLC

SEQ ID NO: 753022 - protein, 19 aa, Mycobacterium
WLDQRGWETVALSLETLLN

SEQ ID NO: 753023 - protein, 20 aa, Mycobacterium
WLDRPGPIPLGRTGYHGRAV

SEQ ID NO: 753024 - protein, 24 aa, Mycobacterium
WLDRQQAIMAIEFPVEDCPEVAGI

SEQ ID NO: 753025 - protein, 18 aa, Mycobacterium
WLEAPGREGAFIVNIGEL

SEQ ID NO: 753026 - protein, 17 aa, Mycobacterium
WLEATAIQTGQTARQAA

SEQ ID NO: 753027 - protein, 19 aa, Mycobacterium
WLEEQERGVAIAGGVVPIV

SEQ ID NO: 753028 - protein, 25 aa, Mycobacterium
WLEKQWLGCSVDRWLENKTWNDVLA

SEQ ID NO: 753029 - protein, 25 aa, Mycobacterium
WLELPDPPASWGWGKTAHLLVGSLA

SEQ ID NO: 753030 - protein, 28 aa, Mycobacterium
WLELVDRYRITVTWAPNFAYQLVTARLQ

SEQ ID NO: 753031 - protein, 18 aa, Mycobacterium
WLEQGLFHLDELPPGDYV

SEQ ID NO: 753032 - protein, 18 aa, Mycobacterium
WLERCIFPAEARLADTAL

SEQ ID NO: 753033 - protein, 25 aa, Mycobacterium
WLERGEVILSGSFTKPVFAEPGDTF

SEQ ID NO: 753034 - protein, 19 aa, Mycobacterium
WLERVLRALPEAGIQVGTL

SEQ ID NO: 753035 - protein, 19 aa, Mycobacterium
WLERVLRALPEAGVRVGTL

SEQ ID NO: 753036 - protein, 23 aa, Mycobacterium
WLESFDGLLARSGPARARYLMLR

SEQ ID NO: 753037 - protein, 21 aa, Mycobacterium
WLESRRTVMFVTHDVTEAVQL

SEQ ID NO: 753038 - protein, 23 aa, Mycobacterium
WLETFRRNWVPRLDALATEIARG

SEQ ID NO: 753039 - protein, 19 aa, Mycobacterium
WLETHSWNRPEWTVEQLIA

SEQ ID NO: 753040 - protein, 25 aa, Mycobacterium
WLETVPGGWRRALARQARGATIVVV

SEQ ID NO: 753041 - protein, 18 aa, Mycobacterium
WLEVRLPPPPAPVENTPV

SEQ ID NO: 753042 - protein, 17 aa, Mycobacterium
WLFPSLCAPTGRVPARS

SEQ ID NO: 753043 - protein, 19 aa, Mycobacterium
WLGAHPSYTLSKYGMTLLS

SEQ ID NO: 753044 - protein, 26 aa, Mycobacterium
WLGEGTGMPEEWLKQKLNEHGIPVPL

SEQ ID NO: 753045 - protein, 19 aa, Mycobacterium
WLGEWTFAFPQGSMTDEPI

SEQ ID NO: 753046 - protein, 20 aa, Mycobacterium
WLGFADRLDNLLADFRPATQ

SEQ ID NO: 753047 - protein, 17 aa, Mycobacterium
WLGGGGVAQGYWGEPSK

SEQ ID NO: 753048 - protein, 17 aa, Mycobacterium
WLGHSTFTLTLDTYGDY

SEQ ID NO: 753049 - protein, 25 aa, Mycobacterium
WLGMGRDLYGRFPAFAKAFDTVADA

SEQ ID NO: 753050 - protein, 24 aa, Mycobacterium
WLGPAQELVRAWLLGNLAAPPNAA

SEQ ID NO: 753051 - protein, 17 aa, Mycobacterium
WLGPKRLVPPMVMVTSP

SEQ ID NO: 753052 - protein, 26 aa, Mycobacterium
WLGRFELRPGFEVVLTPAAPLDPIGE

SEQ ID NO: 753053 - protein, 24 aa, Mycobacterium
WLGSDVWMAHCVHLSKGDIAKLAA

SEQ ID NO: 753054 - protein, 25 aa, Mycobacterium
WLGSDYELALLLRDIFTAAGGTHDN

SEQ ID NO: 753055 - protein, 18 aa, Mycobacterium
WLGVSRTPIREALARLEQ

SEQ ID NO: 753056 - protein, 22 aa, Mycobacterium
WLHEEWGFRYQDRIFTVPVVSL

SEQ ID NO: 753057 - protein, 24 aa, Mycobacterium
WLHFPQFGSPAWTFNKALWEYARL

SEQ ID NO: 753058 - protein, 17 aa, Mycobacterium
WLHGMWKGEKFVERLTY

SEQ ID NO: 753059 - protein, 18 aa, Mycobacterium
WLHGPTVVRGYLGDPSIT

SEQ ID NO: 753060 - protein, 20 aa, Mycobacterium
WLHPPGIDFGPALVADVEIA

SEQ ID NO: 753061 - protein, 17 aa, Mycobacterium
WLHRLRGPVRVVYEAGP

SEQ ID NO: 753062 - protein, 25 aa, Mycobacterium
WLHRLRIVGIDLRDPAQVVALADTV

SEQ ID NO: 753063 - protein, 25 aa, Mycobacterium
WLHSRGALPTAAWHYQRWHGRRWYR

SEQ ID NO: 753064 - protein, 21 aa, Mycobacterium
WLHTARPGSWDGIAGNPPYIR

SEQ ID NO: 753065 - protein, 18 aa, Mycobacterium
WLHTLGFRGHITSKSRRY

SEQ ID NO: 753066 - protein, 18 aa, Mycobacterium
WLHTLGYRGHITTKSRHY

SEQ ID NO: 753067 - protein, 17 aa, Mycobacterium
WLIAAGHDIRRIEDYDE

SEQ ID NO: 753068 - protein, 20 aa, Mycobacterium
WLIDPGDTFLVPSPIAHIGG

SEQ ID NO: 753069 - protein, 19 aa, Mycobacterium
WLIGDGWKNTPVVDDRIIW

SEQ ID NO: 753070 - protein, 18 aa, Mycobacterium
WLIGKDIMGPRAVAKGFT

SEQ ID NO: 753071 - protein, 26 aa, Mycobacterium
WLIIILDSYPPVPHRLTGPIKETFIA

SEQ ID NO: 753072 - protein, 19 aa, Mycobacterium
WLIPADRRYSALAHGSTVE

SEQ ID NO: 753073 - protein, 18 aa, Mycobacterium
WLIRVFLGLWAWPLKDPA

SEQ ID NO: 753074 - protein, 18 aa, Mycobacterium
WLISRFAQELGLPATEID

SEQ ID NO: 753075 - protein, 20 aa, Mycobacterium
WLITGARGAKTWIIMANLEA

SEQ ID NO: 753076 - protein, 17 aa, Mycobacterium
WLKAFRTSAEAVVALYA

SEQ ID NO: 753077 - protein, 17 aa, Mycobacterium
WLKASRANFGAVDNLTG

SEQ ID NO: 753078 - protein, 18 aa, Mycobacterium
WLKDRSWSRPTWSIAELE

SEQ ID NO: 753079 - protein, 20 aa, Mycobacterium
WLKGISQLIGGISIGGGGGS

SEQ ID NO: 753080 - protein, 19 aa, Mycobacterium
WLLAARRDLLAALSEDDPK

SEQ ID NO: 753081 - protein, 23 aa, Mycobacterium
WLLAEYDRFALLHGDYRLDNLLF

SEQ ID NO: 753082 - protein, 17 aa, Mycobacterium
WLLDAACRDDAAARIAA

SEQ ID NO: 753083 - protein, 25 aa, Mycobacterium
WLLDPSIPLPEVFKQYAETLARDFA

SEQ ID NO: 753084 - protein, 17 aa, Mycobacterium
WLLDRGFDVDQIRDAFI

SEQ ID NO: 753085 - protein, 17 aa, Mycobacterium
WLLHAGDAFYHHSEIDG

SEQ ID NO: 753086 - protein, 21 aa, Mycobacterium
WLLIKTDFLMHAARHPDLAQR

SEQ ID NO: 753087 - protein, 20 aa, Mycobacterium
WLLKQAFYYSLTTINDAMRV

SEQ ID NO: 753088 - protein, 21 aa, Mycobacterium
WLLKQAFYYSLTTINEAMREH

SEQ ID NO: 753089 - protein, 30 aa, Mycobacterium
WLLNGQKIWSSRAVFGERGFGLFRSDPEAQ

SEQ ID NO: 753090 - protein, 17 aa, Mycobacterium
WLLPKAMWLKKHDPDAY

SEQ ID NO: 753091 - protein, 17 aa, Mycobacterium
WLLRGGDPARPGMLPPA

SEQ ID NO: 753092 - protein, 23 aa, Mycobacterium
WLLRPVSVEAFLDEIWAIRHHHI

SEQ ID NO: 753093 - protein, 22 aa, Mycobacterium
WLLSHWTCVFGTPACQGTVAGR

SEQ ID NO: 753094 - protein, 18 aa, Mycobacterium
WLLSRTADLSTEYARTGR

SEQ ID NO: 753095 - protein, 37 aa, Mycobacterium
WLMADFDGRIGPAVEEFVRWATPVIQFARFATEDVEV

SEQ ID NO: 753096 - protein, 18 aa, Mycobacterium
WLMEDFDDRIGVAVEEMV

SEQ ID NO: 753097 - protein, 18 aa, Mycobacterium
WLNAAAVRAGEAALQAKE

SEQ ID NO: 753098 - protein, 21 aa, Mycobacterium
WLNDGRWDRMGRWLATVSTRD

SEQ ID NO: 753099 - protein, 17 aa, Mycobacterium
WLNDKFHAYIEDRRREP

SEQ ID NO: 753100 - protein, 17 aa, Mycobacterium
WLNEIPIEVALDPAKLA

SEQ ID NO: 753101 - protein, 18 aa, Mycobacterium
WLNGLVGLGDRISVRRAD

SEQ ID NO: 753102 - protein, 23 aa, Mycobacterium
WLNGNGGLDWAVARTADSSQRLY

SEQ ID NO: 753103 - protein, 20 aa, Mycobacterium
WLNLVEVFFSIITRQEIRRG

SEQ ID NO: 753104 - protein, 19 aa, Mycobacterium
WLNNHVPFHANWVRLKSFW

SEQ ID NO: 753105 - protein, 25 aa, Mycobacterium
WLNPEFYLFRHGLRLDEVTAETRTA

SEQ ID NO: 753106 - protein, 18 aa, Mycobacterium
WLNQGALESNARAVQHGA

SEQ ID NO: 753107 - protein, 21 aa, Mycobacterium
WLNQVEIYFSILQRKAINPND

SEQ ID NO: 753108 - protein, 19 aa, Mycobacterium
WLNRFRWNRCTTGDTRSGR

SEQ ID NO: 753109 - protein, 20 aa, Mycobacterium
WLNRFRWNRCTTGDTRTGRQ

SEQ ID NO: 753110 - protein, 17 aa, Mycobacterium
WLNRYFSPCADRFSDLL

SEQ ID NO: 753111 - protein, 21 aa, Mycobacterium
WLPDSLALAGVFPRNRETTWR

SEQ ID NO: 753112 - protein, 18 aa, Mycobacterium
WLPDTEVRFVWHEPGPIA

SEQ ID NO: 753113 - protein, 19 aa, Mycobacterium
WLPDYCPRCNPLGHNADRC

SEQ ID NO: 753114 - protein, 19 aa, Mycobacterium
WLPEFSDMRVLKNPEGPLD

SEQ ID NO: 753115 - protein, 27 aa, Mycobacterium
WLPFFHDMGLMFGIIMPLLEGFHSVLT

SEQ ID NO: 753116 - protein, 25 aa, Mycobacterium
WLPFYHDMGLMLGIILPMINQDTAV

SEQ ID NO: 753117 - protein, 25 aa, Mycobacterium
WLPFYHDMGLMLGVILPMINQDTAV

SEQ ID NO: 753118 - protein, 19 aa, Mycobacterium
WLPLAERTLDFVARAADNR

SEQ ID NO: 753119 - protein, 26 aa, Mycobacterium
WLPLFHDMGLILGICAPLVAGRSAVL

SEQ ID NO: 753120 - protein, 17 aa, Mycobacterium
WLPLVGRAQQFAADAAD

SEQ ID NO: 753121 - protein, 17 aa, Mycobacterium
WLPNGCMATSGSLIRWF

SEQ ID NO: 753122 - protein, 19 aa, Mycobacterium
WLPPFAIVEHVGRRSGKPY

SEQ ID NO: 753123 - protein, 17 aa, Mycobacterium
WLPQERILFTGNLFGPL

SEQ ID NO: 753124 - protein, 17 aa, Mycobacterium
WLPTPARHRARAASAKL

SEQ ID NO: 753125 - protein, 17 aa, Mycobacterium
WLPTSFRDSVRVLAHTL

SEQ ID NO: 753126 - protein, 19 aa, Mycobacterium
WLPVIDRVVVLGADGAALA

SEQ ID NO: 753127 - protein, 27 aa, Mycobacterium
WLPYEARVQISLHWNRGHIRTHTRAEA

SEQ ID NO: 753128 - protein, 28 aa, Mycobacterium
WLPYEARVQISMRWNRGYIRTHTREEAQ

SEQ ID NO: 753129 - protein, 18 aa, Mycobacterium
WLQDRGFDGERVVIAGDS

SEQ ID NO: 753130 - protein, 18 aa, Mycobacterium
WLQDRGYDGDRVVVAGDS

SEQ ID NO: 753131 - protein, 19 aa, Mycobacterium
WLQEHGVTIWDEWASETGD

SEQ ID NO: 753132 - protein, 19 aa, Mycobacterium
WLQICFVWLLRTTDTWWST

SEQ ID NO: 753133 - protein, 24 aa, Mycobacterium
WLQLFLDELRVCLHCCGARDLTSL

SEQ ID NO: 753134 - protein, 18 aa, Mycobacterium
WLQRERVGKAFSYWPTMT

SEQ ID NO: 753135 - protein, 18 aa, Mycobacterium
WLQRGGVTAAIIRPDRTV

SEQ ID NO: 753136 - protein, 21 aa, Mycobacterium
WLRAHVPPVDGVLCSTATRTR

SEQ ID NO: 753137 - protein, 20 aa, Mycobacterium
WLRALCLEAGVDDVGFVSVD

SEQ ID NO: 753138 - protein, 19 aa, Mycobacterium
WLRASLREVDEAASVPGAP

SEQ ID NO: 753139 - protein, 17 aa, Mycobacterium
WLRDAVRRVADGVLEVV

SEQ ID NO: 753140 - protein, 17 aa, Mycobacterium
WLRDFLDELGVSQATVV

SEQ ID NO: 753141 - protein, 20 aa, Mycobacterium
WLRDGIVCPAQLGTAGYLFE

SEQ ID NO: 753142 - protein, 20 aa, Mycobacterium
WLRDGIVCPAQLGTSGYLFE

SEQ ID NO: 753143 - protein, 21 aa, Mycobacterium
WLRDHFGIRSWCLVGDDYIWP

SEQ ID NO: 753144 - protein, 20 aa, Mycobacterium
WLRDQRITVGLGRTPIDDPA

SEQ ID NO: 753145 - protein, 17 aa, Mycobacterium
WLRDRLASRLDELGSYP

SEQ ID NO: 753146 - protein, 20 aa, Mycobacterium
WLREDHLAFFVLDVVAELER

SEQ ID NO: 753147 - protein, 22 aa, Mycobacterium
WLRELWGGPFMLKGVIRVDDAK

SEQ ID NO: 753148 - protein, 19 aa, Mycobacterium
WLRELWGGPFMLKGVMRVD

SEQ ID NO: 753149 - protein, 17 aa, Mycobacterium
WLREPLLRACRDGNSTL

SEQ ID NO: 753150 - protein, 19 aa, Mycobacterium
WLREYARLIDENAQHLTDL

SEQ ID NO: 753151 - protein, 18 aa, Mycobacterium
WLREYLRGLIARRRSQPG

SEQ ID NO: 753152 - protein, 18 aa, Mycobacterium
WLRGPTVVRGYLGDPAIT

SEQ ID NO: 753153 - protein, 20 aa, Mycobacterium
WLRGRGWDVTTATFAELMAR

SEQ ID NO: 753154 - protein, 21 aa, Mycobacterium
WLRGRGWHASVLTAERLLARY

SEQ ID NO: 753155 - protein, 24 aa, Mycobacterium
WLRISYADACRRVRDAKQLSPRLS

SEQ ID NO: 753156 - protein, 18 aa, Mycobacterium
WLRLRGYQPDQIVLAGDS

SEQ ID NO: 753157 - protein, 20 aa, Mycobacterium
WLRMRERLGLDVNVQALTYH

SEQ ID NO: 753158 - protein, 23 aa, Mycobacterium
WLRNSTRGALAMDPRRMAMMFEE

SEQ ID NO: 753159 - protein, 17 aa, Mycobacterium
WLRPNIVGGALPARGGL

SEQ ID NO: 753160 - protein, 21 aa, Mycobacterium
WLRPVPEGVVGELYVAGRGVA

SEQ ID NO: 753161 - protein, 18 aa, Mycobacterium
WLRPVPSGAAGELYLAGG

SEQ ID NO: 753162 - protein, 24 aa, Mycobacterium
WLRREDTCLLLAPHHDVGFTDDLA

SEQ ID NO: 753163 - protein, 17 aa, Mycobacterium
WLRTARLNAARDLFPVF

SEQ ID NO: 753164 - protein, 17 aa, Mycobacterium
WLSARFRGEPLPTGPRR

SEQ ID NO: 753165 - protein, 17 aa, Mycobacterium
WLSDRSWNRPRWTIGEL

SEQ ID NO: 753166 - protein, 22 aa, Mycobacterium
WLSEHYDDLVGWRRHIHRHPEL

SEQ ID NO: 753167 - protein, 19 aa, Mycobacterium
WLSERNLGRVIPKLWRDWC

SEQ ID NO: 753168 - protein, 18 aa, Mycobacterium
WLSIEVHHALNLVTLGQF

SEQ ID NO: 753169 - protein, 17 aa, Mycobacterium
WLSKLKLAVGETASVGR

SEQ ID NO: 753170 - protein, 18 aa, Mycobacterium
WLSQIIGHFGKFTATAGL

SEQ ID NO: 753171 - protein, 18 aa, Mycobacterium
WLSQPAAIFCSADPALSP

SEQ ID NO: 753172 - protein, 17 aa, Mycobacterium
WLSTARLDLFGHLIGHL

SEQ ID NO: 753173 - protein, 19 aa, Mycobacterium
WLSTTWHGPSSMAMAQALE

SEQ ID NO: 753174 - protein, 17 aa, Mycobacterium
WLTAEYAMLPSATHTRS

SEQ ID NO: 753175 - protein, 19 aa, Mycobacterium
WLTAHGWAVEPVRNTLDLQ

SEQ ID NO: 753176 - protein, 18 aa, Mycobacterium
WLTALAHRNDVTWTQILR

SEQ ID NO: 753177 - protein, 20 aa, Mycobacterium
WLTALLRATLTAVRRTAAEQ

SEQ ID NO: 753178 - protein, 21 aa, Mycobacterium
WLTATRARNALVLVRGKPTDQ

SEQ ID NO: 753179 - protein, 20 aa, Mycobacterium
WLTDLERLHGLESFVDDPAF

SEQ ID NO: 753180 - protein, 17 aa, Mycobacterium
WLTDRFAGLPLTEHVIR

SEQ ID NO: 753181 - protein, 17 aa, Mycobacterium
WLTEGVADFVARPTTSR

SEQ ID NO: 753182 - protein, 32 aa, Mycobacterium
WLTEHLKQRWARGAGGLLLITHDRWFLDEVAT

SEQ ID NO: 753183 - protein, 17 aa, Mycobacterium
WLTESVRSFAENVGSVV

SEQ ID NO: 753184 - protein, 18 aa, Mycobacterium
WLTGAARYAGLLEHLASW

SEQ ID NO: 753185 - protein, 17 aa, Mycobacterium
WLTGGRRPWVALKLMTY

SEQ ID NO: 753186 - protein, 18 aa, Mycobacterium
WLTGVARYSGLLEHLASW

SEQ ID NO: 753187 - protein, 18 aa, Mycobacterium
WLTLPAAAGPIVLAFNAG

SEQ ID NO: 753188 - protein, 19 aa, Mycobacterium
WLTRGGLREGSDWLDAGLA

SEQ ID NO: 753189 - protein, 18 aa, Mycobacterium
WLTTYAFSTENWRRPADE

SEQ ID NO: 753190 - protein, 25 aa, Mycobacterium
WLTVLLRRDLGLLLLINVPGGEPTR

SEQ ID NO: 753191 - protein, 21 aa, Mycobacterium
WLTVLLRRDLGLVVMMGVPGR

SEQ ID NO: 753192 - protein, 24 aa, Mycobacterium
WLTWDEAVECERSFGPVALDGGTW

SEQ ID NO: 753193 - protein, 17 aa, Mycobacterium
WLVCVHGTEMGRAPLDL

SEQ ID NO: 753194 - protein, 20 aa, Mycobacterium
WLVDTCGLPPKHIVIAGDSA

SEQ ID NO: 753195 - protein, 20 aa, Mycobacterium
WLVDWRFPNRLNRNRWSFKI

SEQ ID NO: 753196 - protein, 18 aa, Mycobacterium
WLVGQLLVHYQRLLADGL

SEQ ID NO: 753197 - protein, 21 aa, Mycobacterium
WLVGSARAMLALARQHAMDRV

SEQ ID NO: 753198 - protein, 20 aa, Mycobacterium
WLVGSDRWRQAAIDRGEENP

SEQ ID NO: 753199 - protein, 17 aa, Mycobacterium
WLVNAGPIYVMARIDDP

SEQ ID NO: 753200 - protein, 19 aa, Mycobacterium
WLVPQWRTDEILLDRLRQF

SEQ ID NO: 753201 - protein, 17 aa, Mycobacterium
WLVSATRPAGIRRLFIR

SEQ ID NO: 753202 - protein, 19 aa, Mycobacterium
WLVSHVPLGRAGRPEEVAA

SEQ ID NO: 753203 - protein, 17 aa, Mycobacterium
WLVTPRHADGWLREPLE

SEQ ID NO: 753204 - protein, 21 aa, Mycobacterium
WLYECCASRIWAVRVAAGRPF

SEQ ID NO: 753205 - protein, 18 aa, Mycobacterium
WLYGKDVLDLVRLGKLAV

SEQ ID NO: 753206 - protein, 24 aa, Mycobacterium
WLYLRPDNPMGFRIGITKEDGSKT

SEQ ID NO: 753207 - protein, 19 aa, Mycobacterium
WLYRHFPDKPTLVGAAIIR

SEQ ID NO: 753208 - protein, 17 aa, Mycobacterium
WLYRLASEPRRLARRYL

SEQ ID NO: 753209 - protein, 18 aa, Mycobacterium
WLYSNMFHIRGAVLERIG

SEQ ID NO: 753210 - protein, 17 aa, Mycobacterium
WMAAAALVRGRDEGGTV

SEQ ID NO: 753211 - protein, 17 aa, Mycobacterium
WMAAAALVRSRADGGVV

SEQ ID NO: 753212 - protein, 29 aa, Mycobacterium
WMAAEAQRVMQICHHLHGGLGVDITYPMN

SEQ ID NO: 753213 - protein, 21 aa, Mycobacterium
WMADLIREFALCPPPTEQVEA

SEQ ID NO: 753214 - protein, 17 aa, Mycobacterium
WMADSGVLEPGRDYVIK

SEQ ID NO: 753215 - protein, 22 aa, Mycobacterium
WMALGVGPWFVIRGIPQRVTYR

SEQ ID NO: 753216 - protein, 19 aa, Mycobacterium
WMARVLSASWDRIEQLADW

SEQ ID NO: 753217 - protein, 26 aa, Mycobacterium
WMCHPEPDSAAVFAHLLGGPEAGHFT

SEQ ID NO: 753218 - protein, 17 aa, Mycobacterium
WMCPERLTAELADVAYE

SEQ ID NO: 753219 - protein, 25 aa, Mycobacterium
WMCVPRPDSPSIFGAVLDRGAGHFR

SEQ ID NO: 753220 - protein, 26 aa, Mycobacterium
WMCVPRPDSPSVFGAILDRSAGHFRL

SEQ ID NO: 753221 - protein, 27 aa, Mycobacterium
WMCVPRPDSPSVFGAILDRSAGHFRLG

SEQ ID NO: 753222 - protein, 19 aa, Mycobacterium
WMDEGWSPKLISQVLAEVY

SEQ ID NO: 753223 - protein, 18 aa, Mycobacterium
WMDHGVKVFRVDNPHTKP

SEQ ID NO: 753224 - protein, 18 aa, Mycobacterium
WMDRYASFVAAKRGMAES

SEQ ID NO: 753225 - protein, 19 aa, Mycobacterium
WMELTGYWWPKHAGRYAAL

SEQ ID NO: 753226 - protein, 17 aa, Mycobacterium
WMGQPRTCAGSFIDYFD

SEQ ID NO: 753227 - protein, 23 aa, Mycobacterium
WMGSLLTDRVRAIIANNPEKFGH

SEQ ID NO: 753228 - protein, 23 aa, Mycobacterium
WMGSLLTDRVRGIIASNPEKFGR

SEQ ID NO: 753229 - protein, 20 aa, Mycobacterium
WMGTVIAMAQQRAAAAAAQA

SEQ ID NO: 753230 - protein, 20 aa, Mycobacterium
WMIEELRVSLWAQQLGTARP

SEQ ID NO: 753231 - protein, 25 aa, Mycobacterium
WMLERAMREWARLDPVAAENIRAAD

SEQ ID NO: 753232 - protein, 17 aa, Mycobacterium
WMLLAAIDALIDGNRTA

SEQ ID NO: 753233 - protein, 21 aa, Mycobacterium
WMLQNRLKALRIFERKPMPRW

SEQ ID NO: 753234 - protein, 27 aa, Mycobacterium
WMLQTRLKALRIFDRKPMPTWGSNLGG

SEQ ID NO: 753235 - protein, 26 aa, Mycobacterium
WMLQTRLKALRIFERKPMPNWGSNLA

SEQ ID NO: 753236 - protein, 17 aa, Mycobacterium
WMMWNFQVAGLLVGATI

SEQ ID NO: 753237 - protein, 18 aa, Mycobacterium
WMNDPAIHSSTWEWDMVA

SEQ ID NO: 753238 - protein, 18 aa, Mycobacterium
WMNDPDIHSSVWDWDTAS

SEQ ID NO: 753239 - protein, 17 aa, Mycobacterium
WMNDPEIHSSSWEWDMV

SEQ ID NO: 753240 - protein, 20 aa, Mycobacterium
WMNRKGFHALDEVRGLLAAP

SEQ ID NO: 753241 - protein, 33 aa, Mycobacterium
WMNRPHLAAAWEYDWPAPRWERHLGAQLDGTYS

SEQ ID NO: 753242 - protein, 17 aa, Mycobacterium
WMPAVIAAADKRLQGKR

SEQ ID NO: 753243 - protein, 26 aa, Mycobacterium
WMPEDLRPGDLLGVAATGAYCYSLSS

SEQ ID NO: 753244 - protein, 17 aa, Mycobacterium
WMPFGLRTMQIADMLAT

SEQ ID NO: 753245 - protein, 32 aa, Mycobacterium
WMPIGGWALRAIVAALMEWQRKSELSGDRAGM

SEQ ID NO: 753246 - protein, 17 aa, Mycobacterium
WMPRAKRAPIRAVQEAI

SEQ ID NO: 753247 - protein, 22 aa, Mycobacterium
WMPSTRVRRSDWHELFARNLEA

SEQ ID NO: 753248 - protein, 25 aa, Mycobacterium
WMPVGRRVAIVGGDLVALELAEFLA

SEQ ID NO: 753249 - protein, 18 aa, Mycobacterium
WMPVGSAVATGMRVSLHN

SEQ ID NO: 753250 - protein, 22 aa, Mycobacterium
WMQDLQTMMSIFGTPFFVCTSS

SEQ ID NO: 753251 - protein, 25 aa, Mycobacterium
WMQIEAFRLLTLQTAWKIDRHNDYQ

SEQ ID NO: 753252 - protein, 17 aa, Mycobacterium
WMQLLIVTVRIATLPGL

SEQ ID NO: 753253 - protein, 19 aa, Mycobacterium
WMRAREALIRTDVFGSDGL

SEQ ID NO: 753254 - protein, 27 aa, Mycobacterium
WMRDEAPVYYSERWDFYALTRNEDVVA

SEQ ID NO: 753255 - protein, 29 aa, Mycobacterium
WMRECNASFKTAVKFINWRTPGEGSPVAR

SEQ ID NO: 753256 - protein, 21 aa, Mycobacterium
WMRELFPFDHVVTVAVENPQH

SEQ ID NO: 753257 - protein, 18 aa, Mycobacterium
WMRELGQFDQPGIVDAAY

SEQ ID NO: 753258 - protein, 17 aa, Mycobacterium
WMRKRHHGLAWGVFHRR

SEQ ID NO: 753259 - protein, 21 aa, Mycobacterium
WMRLWRVAPQVLGGCRPIKVT

SEQ ID NO: 753260 - protein, 17 aa, Mycobacterium
WMRPLRAIAARHEVLAI

SEQ ID NO: 753261 - protein, 17 aa, Mycobacterium
WMRPLRAIGGRHEVLGI

SEQ ID NO: 753262 - protein, 17 aa, Mycobacterium
WMRRKYLLLEAPQLPGR

SEQ ID NO: 753263 - protein, 23 aa, Mycobacterium
WMRRLSGEIDRPVSFALIQVDAD

SEQ ID NO: 753264 - protein, 17 aa, Mycobacterium
WMRVWQIAGRVDELPNV

SEQ ID NO: 753265 - protein, 17 aa, Mycobacterium
WMRYGWPTEVGGLGGPA

SEQ ID NO: 753266 - protein, 18 aa, Mycobacterium
WMRYGWPVDVGGLGGPAL

SEQ ID NO: 753267 - protein, 27 aa, Mycobacterium
WMSGGRLMVTFGVGWLAKEFELLGVPF

SEQ ID NO: 753268 - protein, 17 aa, Mycobacterium
WMSPMCQYSAAPAGPLL

SEQ ID NO: 753269 - protein, 17 aa, Mycobacterium
WMSPPRSVLDKPVQAPI

SEQ ID NO: 753270 - protein, 27 aa, Mycobacterium
WMSPVEQIRMSLAMAGWPKSDRKRREG

SEQ ID NO: 753271 - protein, 28 aa, Mycobacterium
WMSTTQLRWRPIDFWPADTTVSIDASGT

SEQ ID NO: 753272 - protein, 18 aa, Mycobacterium
WMTEFSRQWGSFLDTTDS

SEQ ID NO: 753273 - protein, 28 aa, Mycobacterium
WMTPTQVRWRPFQFWPANTAVNIDAAGT

SEQ ID NO: 753274 - protein, 19 aa, Mycobacterium
WMTRLMLGFGSTVQVLEPE

SEQ ID NO: 753275 - protein, 17 aa, Mycobacterium
WMVAFARHLEACGFESI

SEQ ID NO: 753276 - protein, 17 aa, Mycobacterium
WMYDGKHVLIVFDDLSK

SEQ ID NO: 753277 - protein, 17 aa, Mycobacterium
WMYDGKHVLIVFDDLTK

SEQ ID NO: 753278 - protein, 18 aa, Mycobacterium
WMYQGKHVLIVFDDLTKQ

SEQ ID NO: 753279 - protein, 23 aa, Mycobacterium
WNAADPGWAYGLYYAILSPLATG

SEQ ID NO: 753280 - protein, 26 aa, Mycobacterium
WNAAISVNLWGVIYGCETFVPRLRSN

SEQ ID NO: 753281 - protein, 18 aa, Mycobacterium
WNAGPGKRVAVVGLGGLG

SEQ ID NO: 753282 - protein, 18 aa, Mycobacterium
WNAIAGSFVDNFSLDDRR

SEQ ID NO: 753283 - protein, 18 aa, Mycobacterium
WNAIRHAKPIAVGLNCAL

SEQ ID NO: 753284 - protein, 19 aa, Mycobacterium
WNAIRHAKPIAVGLNCALG

SEQ ID NO: 753285 - protein, 21 aa, Mycobacterium
WNAIRHARPIAVGLNCALGAP

SEQ ID NO: 753286 - protein, 17 aa, Mycobacterium
WNAPIAAPTRAAIRTVV

SEQ ID NO: 753287 - protein, 29 aa, Mycobacterium
WNARYTWPRFVCALPREFFAAVRAELDAR

SEQ ID NO: 753288 - protein, 20 aa, Mycobacterium
WNARYVWPKFVCALPSEFFA

SEQ ID NO: 753289 - protein, 23 aa, Mycobacterium
WNCDKGRWAFSYATQPDLLTTPL

SEQ ID NO: 753290 - protein, 24 aa, Mycobacterium
WNCDKGRWAFTYATAGDRITEPMV

SEQ ID NO: 753291 - protein, 24 aa, Mycobacterium
WNCDKGRWAFTYATAGDRLTTPLV

SEQ ID NO: 753292 - protein, 23 aa, Mycobacterium
WNCDKGRWAFTYATQPDVITTPL

SEQ ID NO: 753293 - protein, 24 aa, Mycobacterium
WNCDKGRWAFTYATRPDVITTPLI

SEQ ID NO: 753294 - protein, 24 aa, Mycobacterium
WNCDKGRWAFTYATVGDRITTPML

SEQ ID NO: 753295 - protein, 17 aa, Mycobacterium
WNCQVFVLDAGLCPVPV

SEQ ID NO: 753296 - protein, 23 aa, Mycobacterium
WNDLACALMEDFSALSRRDRNLI

SEQ ID NO: 753297 - protein, 17 aa, Mycobacterium
WNDNVGRDTDPVDPDFG

SEQ ID NO: 753298 - protein, 25 aa, Mycobacterium
WNDRVRRLAGALTERGISRGDVVAF

SEQ ID NO: 753299 - protein, 17 aa, Mycobacterium
WNDYNFALQGDVKRFRA

SEQ ID NO: 753300 - protein, 24 aa, Mycobacterium
WNEEIKGCWILARYNDGRPSQLRL

SEQ ID NO: 753301 - protein, 22 aa, Mycobacterium
WNEEIRATWAREERLAASPATV

SEQ ID NO: 753302 - protein, 24 aa, Mycobacterium
WNEELYELRGPELIRIDTPTDASV

SEQ ID NO: 753303 - protein, 17 aa, Mycobacterium
WNERIVCVAITGYGLNG

SEQ ID NO: 753304 - protein, 19 aa, Mycobacterium
WNGEQSWPGSGPAPVKPFP

SEQ ID NO: 753305 - protein, 19 aa, Mycobacterium
WNGGFPVDWGVSAHPKNDD

SEQ ID NO: 753306 - protein, 21 aa, Mycobacterium
WNGPLFKFALFQVASEEFYLF

SEQ ID NO: 753307 - protein, 18 aa, Mycobacterium
WNHIITKLTENFARSEPA

SEQ ID NO: 753308 - protein, 20 aa, Mycobacterium
WNHLVRFAFCKREDTLDEAI

SEQ ID NO: 753309 - protein, 18 aa, Mycobacterium
WNIERVKGGSMVAGGLFN

SEQ ID NO: 753310 - protein, 17 aa, Mycobacterium
WNIQYFGRTTYLGSRAA

SEQ ID NO: 753311 - protein, 19 aa, Mycobacterium
WNKLPSADAITHFAFGCGD

SEQ ID NO: 753312 - protein, 17 aa, Mycobacterium
WNKPSFAKELFLGRFPL

SEQ ID NO: 753313 - protein, 19 aa, Mycobacterium
WNLDFAAALTRLLTATCCG

SEQ ID NO: 753314 - protein, 17 aa, Mycobacterium
WNLDFASALTRLLTATC

SEQ ID NO: 753315 - protein, 18 aa, Mycobacterium
WNLDFASALTRLLTATCE

SEQ ID NO: 753316 - protein, 24 aa, Mycobacterium
WNLDLGALLPALSVRNSHGRNGDG

SEQ ID NO: 753317 - protein, 19 aa, Mycobacterium
WNLDLGDIVPALTVAHRSA

SEQ ID NO: 753318 - protein, 18 aa, Mycobacterium
WNLDLGDVVPALTVATGD

SEQ ID NO: 753319 - protein, 25 aa, Mycobacterium
WNLLECRSPAAARGRGVVTANLIRR

SEQ ID NO: 753320 - protein, 26 aa, Mycobacterium
WNLLGWPAINVPAGFTVEGLPIGVQL

SEQ ID NO: 753321 - protein, 26 aa, Mycobacterium
WNLLGWPSINVPAGFTSDGLPIGVQL

SEQ ID NO: 753322 - protein, 23 aa, Mycobacterium
WNLSGLKAALAIAGTEAVADLHR

SEQ ID NO: 753323 - protein, 19 aa, Mycobacterium
WNPEFLREGFAVHDTLHPD

SEQ ID NO: 753324 - protein, 19 aa, Mycobacterium
WNPEFLREGFAVRDTLRPD

SEQ ID NO: 753325 - protein, 17 aa, Mycobacterium
WNPEFLREGYAVKDTLH

SEQ ID NO: 753326 - protein, 23 aa, Mycobacterium
WNPKIAAGQTVTFGFQASPGGGS

SEQ ID NO: 753327 - protein, 17 aa, Mycobacterium
WNPLRWFEEDEPVYGHP

SEQ ID NO: 753328 - protein, 17 aa, Mycobacterium
WNPLSVRGLRQLGEVAL

SEQ ID NO: 753329 - protein, 17 aa, Mycobacterium
WNPQRASSMPVNRYRPF

SEQ ID NO: 753330 - protein, 17 aa, Mycobacterium
WNPQRGSAMPVNRYRSF

SEQ ID NO: 753331 - protein, 17 aa, Mycobacterium
WNPRLIFGSVKGFNDDS

SEQ ID NO: 753332 - protein, 17 aa, Mycobacterium
WNQLPMPVQRVAQALPL

SEQ ID NO: 753333 - protein, 24 aa, Mycobacterium
WNRADYRPLDGFVYAITPFNFTSI

SEQ ID NO: 753334 - protein, 22 aa, Mycobacterium
WNRAGSARAWWLLTTAGVANVR

SEQ ID NO: 753335 - protein, 23 aa, Mycobacterium
WNRAGSARAWWVLRAAGIEDVRI

SEQ ID NO: 753336 - protein, 22 aa, Mycobacterium
WNRAGSARAWWVLTAAGLDNVR

SEQ ID NO: 753337 - protein, 17 aa, Mycobacterium
WNRHHIESVQIDVPEDI

SEQ ID NO: 753338 - protein, 19 aa, Mycobacterium
WNRLCEALTPGNVVLADQG

SEQ ID NO: 753339 - protein, 18 aa, Mycobacterium
WNRPEWTVEQLIAAKKGR

SEQ ID NO: 753340 - protein, 24 aa, Mycobacterium
WNRSDYRPLDGFVYAITPFNFTSI

SEQ ID NO: 753341 - protein, 24 aa, Mycobacterium
WNRSEYRPLDGFVYAITPFNFTSI

SEQ ID NO: 753342 - protein, 22 aa, Mycobacterium
WNRTLERCLPVEAAGARVASHV

SEQ ID NO: 753343 - protein, 18 aa, Mycobacterium
WNRTRGWRGQRAAAGAGR

SEQ ID NO: 753344 - protein, 20 aa, Mycobacterium
WNSIRHAKPIAVGLNCALGA

SEQ ID NO: 753345 - protein, 19 aa, Mycobacterium
WNSPRAIAYRNHYSLDDQG

SEQ ID NO: 753346 - protein, 19 aa, Mycobacterium
WNSPRAVAYRTHYGFGDQH

SEQ ID NO: 753347 - protein, 20 aa, Mycobacterium
WNTARWLRAVAEKAGFDVDW

SEQ ID NO: 753348 - protein, 19 aa, Mycobacterium
WNTNFGFIGAMLPETGNKR

SEQ ID NO: 753349 - protein, 23 aa, Mycobacterium
WNTRPRGGTPYRVIQYAVNPLKP

SEQ ID NO: 753350 - protein, 27 aa, Mycobacterium
WNVDLQPGGAVIGAFLGSRRDTPVWVN

SEQ ID NO: 753351 - protein, 27 aa, Mycobacterium
WNVDRHTYRLDWCTVREVEPEILAAAT

SEQ ID NO: 753352 - protein, 17 aa, Mycobacterium
WNVPFFLAANKLGPALL

SEQ ID NO: 753353 - protein, 25 aa, Mycobacterium
WNVPKKLTTFAFWGNGVVDLRYADF

SEQ ID NO: 753354 - protein, 17 aa, Mycobacterium
WNVPLFLAINKLGPALL

SEQ ID NO: 753355 - protein, 21 aa, Mycobacterium
WNVRAIWEMYAGWFRHQSTTE

SEQ ID NO: 753356 - protein, 17 aa, Mycobacterium
WNVVRLPPQMALASCEF

SEQ ID NO: 753357 - protein, 17 aa, Mycobacterium
WNWAAHADPDVVRRHGG

SEQ ID NO: 753358 - protein, 30 aa, Mycobacterium
WNYLRRNYKVLLCYGDPAWFSATLGAWSAK

SEQ ID NO: 753359 - protein, 20 aa, Mycobacterium
WNYPVALGYWDVIPALLAGC

SEQ ID NO: 753360 - protein, 20 aa, Mycobacterium
WPAAARGPFDLKGFDAPVDA

SEQ ID NO: 753361 - protein, 17 aa, Mycobacterium
WPAAGAVGPLIREPDGT

SEQ ID NO: 753362 - protein, 19 aa, Mycobacterium
WPAALLTPGAVRHTDGPPD

SEQ ID NO: 753363 - protein, 17 aa, Mycobacterium
WPAALRAKGFDPTRPTA

SEQ ID NO: 753364 - protein, 25 aa, Mycobacterium
WPAALRRVGFDAAQPTVWVAEQLLV

SEQ ID NO: 753365 - protein, 18 aa, Mycobacterium
WPAANSMLDVIAPYGRRV

SEQ ID NO: 753366 - protein, 20 aa, Mycobacterium
WPAAVKDIRNILAHQGTEPH

SEQ ID NO: 753367 - protein, 17 aa, Mycobacterium
WPADALTMIGMQRLTSL

SEQ ID NO: 753368 - protein, 21 aa, Mycobacterium
WPADEYRAGVVQNSFDKQFVR

SEQ ID NO: 753369 - protein, 19 aa, Mycobacterium
WPADFGHYGPLVLRMAWHF

SEQ ID NO: 753370 - protein, 22 aa, Mycobacterium
WPADPKGLAGFPGRPCPSASRR

SEQ ID NO: 753371 - protein, 21 aa, Mycobacterium
WPADVIRRAAGNAARALDGKV

SEQ ID NO: 753372 - protein, 29 aa, Mycobacterium
WPADYGNYAGLFVRMSWHAAGTYRIFDGR

SEQ ID NO: 753373 - protein, 25 aa, Mycobacterium
WPAFADVPAGWRVVYGESDRAACLE

SEQ ID NO: 753374 - protein, 21 aa, Mycobacterium
WPAFAEVPAGWRVVFGEAARA

SEQ ID NO: 753375 - protein, 19 aa, Mycobacterium
WPAFGDALLDLAAQSAPGS

SEQ ID NO: 753376 - protein, 17 aa, Mycobacterium
WPAGPYMATVLECQEEN

SEQ ID NO: 753377 - protein, 19 aa, Mycobacterium
WPAGTPVLFPRPTKNIDGT

SEQ ID NO: 753378 - protein, 19 aa, Mycobacterium
WPAICAQLRETVGVADRAT

SEQ ID NO: 753379 - protein, 23 aa, Mycobacterium
WPAIGLIAATGFGVWRPDETVQV

SEQ ID NO: 753380 - protein, 19 aa, Mycobacterium
WPALCSGLRAEARAGRMLP

SEQ ID NO: 753381 - protein, 18 aa, Mycobacterium
WPALGGMGNASWVQLSGH

SEQ ID NO: 753382 - protein, 18 aa, Mycobacterium
WPALIALLQSGRLDVDGI

SEQ ID NO: 753383 - protein, 25 aa, Mycobacterium
WPALLRGNALVVWAGQMDVAALRWL

SEQ ID NO: 753384 - protein, 18 aa, Mycobacterium
WPALNLFYNTAFDAAHQL

SEQ ID NO: 753385 - protein, 18 aa, Mycobacterium
WPAPQGWSSPQQWAGPPD

SEQ ID NO: 753386 - protein, 21 aa, Mycobacterium
WPARLQQRVRRVAREHNATSF

SEQ ID NO: 753387 - protein, 23 aa, Mycobacterium
WPARLTKARLHFVTGKGGTGKST

SEQ ID NO: 753388 - protein, 19 aa, Mycobacterium
WPARVAAIEEGLRSGLEPA

SEQ ID NO: 753389 - protein, 18 aa, Mycobacterium
WPASGVDFAGKRVGVIGT

SEQ ID NO: 753390 - protein, 20 aa, Mycobacterium
WPASLRPALATAGFATGVRD

SEQ ID NO: 753391 - protein, 21 aa, Mycobacterium
WPATAHGPLTLKGFDAPVTAF

SEQ ID NO: 753392 - protein, 20 aa, Mycobacterium
WPATEIRRAAVSSFGVSGTN

SEQ ID NO: 753393 - protein, 19 aa, Mycobacterium
WPAVCSGLRSEARRGRMLP

SEQ ID NO: 753394 - protein, 19 aa, Mycobacterium
WPAVIEKFPSAVLALTGGG

SEQ ID NO: 753395 - protein, 17 aa, Mycobacterium
WPAVMRVARRLYDTGEA

SEQ ID NO: 753396 - protein, 20 aa, Mycobacterium
WPDALWRIVRETEEPDSERF

SEQ ID NO: 753397 - protein, 18 aa, Mycobacterium
WPDATLRAVDDVEAGGLV

SEQ ID NO: 753398 - protein, 22 aa, Mycobacterium
WPDHACRGCSMIADHVGHLAHL

SEQ ID NO: 753399 - protein, 25 aa, Mycobacterium
WPDKPGVAGCAAMDGTVLVNLINTK

SEQ ID NO: 753400 - protein, 44 aa, Mycobacterium
WPDMLDEMRATAGWRRYPMRLISPLARRFLKSRAAYRDTPGRYA

SEQ ID NO: 753401 - protein, 19 aa, Mycobacterium
WPDMTKPVIGAINGAAVTG

SEQ ID NO: 753402 - protein, 21 aa, Mycobacterium
WPDPAAHSFRGPGLRNSVMFG

SEQ ID NO: 753403 - protein, 17 aa, Mycobacterium
WPDPAAHSFRGPTKRNR

SEQ ID NO: 753404 - protein, 23 aa, Mycobacterium
WPDRVITHAPLWCAVDLRDGNQA

SEQ ID NO: 753405 - protein, 22 aa, Mycobacterium
WPDSFWRYAKVLALLTDPASHG

SEQ ID NO: 753406 - protein, 17 aa, Mycobacterium
WPDVDSAGTVSLLSTLR

SEQ ID NO: 753407 - protein, 20 aa, Mycobacterium
WPDVRDAYLRAWEFRPTRAE

SEQ ID NO: 753408 - protein, 25 aa, Mycobacterium
WPDWGRPRRAGVSSFGMGGTNAHLL

SEQ ID NO: 753409 - protein, 17 aa, Mycobacterium
WPEAREWLGQRGYDSTL

SEQ ID NO: 753410 - protein, 21 aa, Mycobacterium
WPEGKIRTVFEPVVKTTIIAP

SEQ ID NO: 753411 - protein, 22 aa, Mycobacterium
WPEHAGGLGGPAILRAIVGEEV

SEQ ID NO: 753412 - protein, 26 aa, Mycobacterium
WPEHGCIGCSLMADHIGNLAHLNARD

SEQ ID NO: 753413 - protein, 18 aa, Mycobacterium
WPEHIPGTTVNRACGSSQ

SEQ ID NO: 753414 - protein, 19 aa, Mycobacterium
WPEHIPGTTVNRACGSSQQ

SEQ ID NO: 753415 - protein, 18 aa, Mycobacterium
WPEHKELFDKAWGSQDII

SEQ ID NO: 753416 - protein, 17 aa, Mycobacterium
WPEIELVAANHTEALRG

SEQ ID NO: 753417 - protein, 17 aa, Mycobacterium
WPELAEAALAIRAGALW

SEQ ID NO: 753418 - protein, 19 aa, Mycobacterium
WPELDELSAAAMCYTSGTT

SEQ ID NO: 753419 - protein, 22 aa, Mycobacterium
WPELGIPIVMSDLKFMRFIAKE

SEQ ID NO: 753420 - protein, 28 aa, Mycobacterium
WPENDFPPKLVGRMVLNRNVDNFFNDNE

SEQ ID NO: 753421 - protein, 18 aa, Mycobacterium
WPEPDHLRLVTLPWSRDL

SEQ ID NO: 753422 - protein, 19 aa, Mycobacterium
WPEPLRSKALAGRAPAKPA

SEQ ID NO: 753423 - protein, 19 aa, Mycobacterium
WPEPLRSKALAGRPPAKPQ

SEQ ID NO: 753424 - protein, 19 aa, Mycobacterium
WPEPLRTKALQGRGPARPV

SEQ ID NO: 753425 - protein, 27 aa, Mycobacterium
WPERPKFLMCTPLSHAGAAFFMPTLMK

SEQ ID NO: 753426 - protein, 18 aa, Mycobacterium
WPEVESWVSDSGLSAAEL

SEQ ID NO: 753427 - protein, 17 aa, Mycobacterium
WPEVPELILSDRDAQAP

SEQ ID NO: 753428 - protein, 18 aa, Mycobacterium
WPEVTIIWEIDGFADYSR

SEQ ID NO: 753429 - protein, 24 aa, Mycobacterium
WPFPNATGLPGYFETLSPPHVPTV

SEQ ID NO: 753430 - protein, 25 aa, Mycobacterium
WPGAGPRPLISYAPGTQGQGNQCAP

SEQ ID NO: 753431 - protein, 20 aa, Mycobacterium
WPGAPRPVAARELLPERALL

SEQ ID NO: 753432 - protein, 18 aa, Mycobacterium
WPGARLMTTRGLGRLAHF

SEQ ID NO: 753433 - protein, 24 aa, Mycobacterium
WPGEERLLRLGLESLRLWHDGGFL

SEQ ID NO: 753434 - protein, 24 aa, Mycobacterium
WPGEERLLRLGLESLRLWRDGGFL

SEQ ID NO: 753435 - protein, 24 aa, Mycobacterium
WPGFPPDGLYKFRVHGADGSVTDR

SEQ ID NO: 753436 - protein, 18 aa, Mycobacterium
WPGGVTVYDIRTEAMTPL

SEQ ID NO: 753437 - protein, 19 aa, Mycobacterium
WPGHVIAAVAAPPERLLVG

SEQ ID NO: 753438 - protein, 17 aa, Mycobacterium
WPGKLVVKGIQTLDDAR

SEQ ID NO: 753439 - protein, 18 aa, Mycobacterium
WPGLAAREVACSAWPAGA

SEQ ID NO: 753440 - protein, 19 aa, Mycobacterium
WPGLIEAYRDRLPIGDDWT

SEQ ID NO: 753441 - protein, 19 aa, Mycobacterium
WPGLIEAYRDRLPVGDDWT

SEQ ID NO: 753442 - protein, 21 aa, Mycobacterium
WPGMTLCFLEESLGNHREALA

SEQ ID NO: 753443 - protein, 24 aa, Mycobacterium
WPGNARIAVQFVLNYEEGAENNVL

SEQ ID NO: 753444 - protein, 20 aa, Mycobacterium
WPGNPYPLGATYDGAGTNFS

SEQ ID NO: 753445 - protein, 22 aa, Mycobacterium
WPGREVRGPDALAQIIEQTRNM

SEQ ID NO: 753446 - protein, 17 aa, Mycobacterium
WPGRIRLDDLNWQARRY

SEQ ID NO: 753447 - protein, 32 aa, Mycobacterium
WPGSGPAPVKPFPAPLLNLRPGTIPPSTVSAG

SEQ ID NO: 753448 - protein, 21 aa, Mycobacterium
WPGSVLEFLEVLGPLTDPRAH

SEQ ID NO: 753449 - protein, 30 aa, Mycobacterium
WPGTDRSWLDGWLLRACHGAPLCANSAVPL

SEQ ID NO: 753450 - protein, 17 aa, Mycobacterium
WPGTELVLGTVTKPWQP

SEQ ID NO: 753451 - protein, 29 aa, Mycobacterium
WPHADAIRFAVNYLRMFATDSAERIPRRP

SEQ ID NO: 753452 - protein, 17 aa, Mycobacterium
WPHARLGYAIEDAARHS

SEQ ID NO: 753453 - protein, 18 aa, Mycobacterium
WPHEPVDFTGKRVGVVGT

SEQ ID NO: 753454 - protein, 19 aa, Mycobacterium
WPHPACATPPTRPRVSPAR

SEQ ID NO: 753455 - protein, 20 aa, Mycobacterium
WPHQLLTAFAARRMQLPVKL

SEQ ID NO: 753456 - protein, 17 aa, Mycobacterium
WPHSIPTLAGADAVAGW

SEQ ID NO: 753457 - protein, 17 aa, Mycobacterium
WPHWATVITDVTWTTPE

SEQ ID NO: 753458 - protein, 17 aa, Mycobacterium
WPHWQFQAFASVDTKRM

SEQ ID NO: 753459 - protein, 26 aa, Mycobacterium
WPILPEEFTLLDAIFAMYATVGMTAD

SEQ ID NO: 753460 - protein, 26 aa, Mycobacterium
WPINQIACKVFPALATGCTMVLKPSE

SEQ ID NO: 753461 - protein, 25 aa, Mycobacterium
WPINQIACKVFPALATGNTMVLKPS

SEQ ID NO: 753462 - protein, 21 aa, Mycobacterium
WPINRGEMVVAYLAGANRDPA

SEQ ID NO: 753463 - protein, 20 aa, Mycobacterium
WPITGELFGFDAAAPYETRL

SEQ ID NO: 753464 - protein, 21 aa, Mycobacterium
WPKAFGGGGVFASVPFLNQYW

SEQ ID NO: 753465 - protein, 17 aa, Mycobacterium
WPKDALHIERFAAKPDA

SEQ ID NO: 753466 - protein, 19 aa, Mycobacterium
WPKDWPLQVIPRVSWADQR

SEQ ID NO: 753467 - protein, 17 aa, Mycobacterium
WPKVFGGGGVFSSIPFL

SEQ ID NO: 753468 - protein, 18 aa, Mycobacterium
WPKYFSRPEPDTSSDDSN

SEQ ID NO: 753469 - protein, 20 aa, Mycobacterium
WPLAADGTSIYWTGLNKGKR

SEQ ID NO: 753470 - protein, 17 aa, Mycobacterium
WPLAASGTSIYWTGLNK

SEQ ID NO: 753471 - protein, 20 aa, Mycobacterium
WPLADVRLLAPILASKVVAM

SEQ ID NO: 753472 - protein, 17 aa, Mycobacterium
WPLAHTRPSTTNEALDA

SEQ ID NO: 753473 - protein, 26 aa, Mycobacterium
WPLDRRIEGFLLRRGLVRLAEDGDAY

SEQ ID NO: 753474 - protein, 27 aa, Mycobacterium
WPLEYVDSFAGMFPRLGSAASTEPVRL

SEQ ID NO: 753475 - protein, 23 aa, Mycobacterium
WPLGDRIGVQFVYSTELFDAATV

SEQ ID NO: 753476 - protein, 20 aa, Mycobacterium
WPLPSTRWTPLYLHDAGLRA

SEQ ID NO: 753477 - protein, 23 aa, Mycobacterium
WPLSADGTSIYWTGLNKGKRSAT

SEQ ID NO: 753478 - protein, 20 aa, Mycobacterium
WPLSARSSAGLSAQAHRLHE

SEQ ID NO: 753479 - protein, 18 aa, Mycobacterium
WPLSVKGILVTEGVRGDG

SEQ ID NO: 753480 - protein, 17 aa, Mycobacterium
WPLTLNVVLHRQNIDRI

SEQ ID NO: 753481 - protein, 17 aa, Mycobacterium
WPLVDGAPPTLSDRDAA

SEQ ID NO: 753482 - protein, 21 aa, Mycobacterium
WPMIADGRVKPIIGAELPIEN

SEQ ID NO: 753483 - protein, 20 aa, Mycobacterium
WPMTCFLTSDGRPFFCGTYY

SEQ ID NO: 753484 - protein, 28 aa, Mycobacterium
WPNAIEIPERWRVVFGAASRADCVEYVE

SEQ ID NO: 753485 - protein, 17 aa, Mycobacterium
WPNALPWHVTSRGASGR

SEQ ID NO: 753486 - protein, 19 aa, Mycobacterium
WPNDYGNSGVVHFHGPFLY

SEQ ID NO: 753487 - protein, 17 aa, Mycobacterium
WPNIVAAQLDWDVELIG

SEQ ID NO: 753488 - protein, 17 aa, Mycobacterium
WPNLFLAEMNVMFVEPQ

SEQ ID NO: 753489 - protein, 22 aa, Mycobacterium
WPNLTGGQAIDFLTRMLGTEHI

SEQ ID NO: 753490 - protein, 18 aa, Mycobacterium
WPNLTGMQAIDFLCGLRG

SEQ ID NO: 753491 - protein, 19 aa, Mycobacterium
WPNLTGMQAIDFLTALRGD

SEQ ID NO: 753492 - protein, 17 aa, Mycobacterium
WPNSRSAVMGPAQLAGV

SEQ ID NO: 753493 - protein, 21 aa, Mycobacterium
WPNTAALCMPFQFPDGTPSAF

SEQ ID NO: 753494 - protein, 20 aa, Mycobacterium
WPNVSPRGGVLATQHLVDVI

SEQ ID NO: 753495 - protein, 25 aa, Mycobacterium
WPPAPRCRPGYWPWVDALANAMVLT

SEQ ID NO: 753496 - protein, 20 aa, Mycobacterium
WPPDEEEAFKAPIRAQYEDQ

SEQ ID NO: 753497 - protein, 18 aa, Mycobacterium
WPPENFDGLAALRRTIGI

SEQ ID NO: 753498 - protein, 17 aa, Mycobacterium
WPPGLSFEASEGAGEVQ

SEQ ID NO: 753499 - protein, 20 aa, Mycobacterium
WPPGMRLIVRRERPHPGAQL

SEQ ID NO: 753500 - protein, 22 aa, Mycobacterium
WPPHCRAGSTGAQFCPDLDVAP

SEQ ID NO: 753501 - protein, 20 aa, Mycobacterium
WPPHCRAGTPGADFHPYLDM

SEQ ID NO: 753502 - protein, 29 aa, Mycobacterium
WPPIAGGAHALPFVVGFMSERQTAGADPQ

SEQ ID NO: 753503 - protein, 19 aa, Mycobacterium
WPPKPAQRLLRLVATELPW

SEQ ID NO: 753504 - protein, 17 aa, Mycobacterium
WPPLSYSQLAMWFHYRM

SEQ ID NO: 753505 - protein, 17 aa, Mycobacterium
WPPPEPGGYSLIVDGRA

SEQ ID NO: 753506 - protein, 19 aa, Mycobacterium
WPPQLAPIGGIRFARRSSH

SEQ ID NO: 753507 - protein, 17 aa, Mycobacterium
WPPVPYPESLAIRLEDE

SEQ ID NO: 753508 - protein, 17 aa, Mycobacterium
WPQASAMCDDVLRALDP

SEQ ID NO: 753509 - protein, 21 aa, Mycobacterium
WPQHHAALLAVEICSLSWPTT

SEQ ID NO: 753510 - protein, 19 aa, Mycobacterium
WPQHHWAYRDLLGDPPPGL

SEQ ID NO: 753511 - protein, 18 aa, Mycobacterium
WPQPEAFNGVTVHGVLAR

SEQ ID NO: 753512 - protein, 19 aa, Mycobacterium
WPQPNFPVSNFFHGGAAPL

SEQ ID NO: 753513 - protein, 17 aa, Mycobacterium
WPQPSGIALDQVAAQRV

SEQ ID NO: 753514 - protein, 17 aa, Mycobacterium
WPQVETVLSREELEKIG

SEQ ID NO: 753515 - protein, 25 aa, Mycobacterium
WPRETLRLGEKYPLKAGLITSLGFG

SEQ ID NO: 753516 - protein, 22 aa, Mycobacterium
WPREYGGRGATVLEQLVYTEET

SEQ ID NO: 753517 - protein, 20 aa, Mycobacterium
WPRHRRLSVGGDDARSAALV

SEQ ID NO: 753518 - protein, 20 aa, Mycobacterium
WPRHRRLSVTADDGRSAAVV

SEQ ID NO: 753519 - protein, 26 aa, Mycobacterium
WPRKEIRDQRLVECVDVIRRLLKGEE

SEQ ID NO: 753520 - protein, 20 aa, Mycobacterium
WPRKYRRSSVYWKLIALDQR

SEQ ID NO: 753521 - protein, 20 aa, Mycobacterium
WPRNAHQLVDEWLGVTQLDG

SEQ ID NO: 753522 - protein, 22 aa, Mycobacterium
WPRNPVKHWVERDLVENGALGA

SEQ ID NO: 753523 - protein, 20 aa, Mycobacterium
WPRQALKDLLVMLAAGPSAV

SEQ ID NO: 753524 - protein, 18 aa, Mycobacterium
WPRRSAQFTKIMPRDYQR

SEQ ID NO: 753525 - protein, 23 aa, Mycobacterium
WPRRYRRSSFYWKLIGYDQRFGI

SEQ ID NO: 753526 - protein, 21 aa, Mycobacterium
WPRVDEALAAVGLNMPLAQET

SEQ ID NO: 753527 - protein, 20 aa, Mycobacterium
WPRVLNVWRANLLGSSSKGN

SEQ ID NO: 753528 - protein, 22 aa, Mycobacterium
WPRYRATDRACLLIGKKDTLAH

SEQ ID NO: 753529 - protein, 17 aa, Mycobacterium
WPSALRQRGFDAGQPTA

SEQ ID NO: 753530 - protein, 25 aa, Mycobacterium
WPSDAGFRKELFDLIDISFAQRRKT

SEQ ID NO: 753531 - protein, 20 aa, Mycobacterium
WPSDRGWYGEPYFDGESQTS

SEQ ID NO: 753532 - protein, 20 aa, Mycobacterium
WPSFEAHGGYFDLTHYGAVL

SEQ ID NO: 753533 - protein, 17 aa, Mycobacterium
WPSGIKEGASFVIPTMD

SEQ ID NO: 753534 - protein, 18 aa, Mycobacterium
WPSGTTVFEIDLPKVLEF

SEQ ID NO: 753535 - protein, 17 aa, Mycobacterium
WPSMGVEAYRLDDYRAE

SEQ ID NO: 753536 - protein, 28 aa, Mycobacterium
WPSPFGPGRPGWHVECAAIALSRINSGL

SEQ ID NO: 753537 - protein, 24 aa, Mycobacterium
WPSRLTKARLHFVSGKGGTGKSTI

SEQ ID NO: 753538 - protein, 18 aa, Mycobacterium
WPSSGLICADSHCTPNYK

SEQ ID NO: 753539 - protein, 25 aa, Mycobacterium
WPSVEKARMLLGWQARVDLRDGIAT

SEQ ID NO: 753540 - protein, 20 aa, Mycobacterium
WPTADAFRRQVFELVDIAFA

SEQ ID NO: 753541 - protein, 28 aa, Mycobacterium
WPTAMKKFVWPWLVGRRQVVVSSYPPHV

SEQ ID NO: 753542 - protein, 17 aa, Mycobacterium
WPTARPSVDPVLRRYST

SEQ ID NO: 753543 - protein, 25 aa, Mycobacterium
WPTDEAFRRQVFRLVDIAFAQRRKT

SEQ ID NO: 753544 - protein, 19 aa, Mycobacterium
WPTDERFATGRARAANAAE

SEQ ID NO: 753545 - protein, 20 aa, Mycobacterium
WPTDVELRIRCLDQLHRALV

SEQ ID NO: 753546 - protein, 21 aa, Mycobacterium
WPTFAEIPAGWQVVYGEEERT

SEQ ID NO: 753547 - protein, 19 aa, Mycobacterium
WPTGMGFEEFYGFMGGEAH

SEQ ID NO: 753548 - protein, 20 aa, Mycobacterium
WPTGPLPPVRIAAADPPPGQ

SEQ ID NO: 753549 - protein, 21 aa, Mycobacterium
WPTGPSVRIYPLLKNLTLDIA

SEQ ID NO: 753550 - protein, 17 aa, Mycobacterium
WPTLEVNGQLLVWHDPE

SEQ ID NO: 753551 - protein, 17 aa, Mycobacterium
WPTLGLTLPEVLPDKLA

SEQ ID NO: 753552 - protein, 29 aa, Mycobacterium
WPTLRTFLPSLLLDRTFRSFVLANFAANG

SEQ ID NO: 753553 - protein, 27 aa, Mycobacterium
WPTNDARFLFHPAMKELTLDIASLVFM

SEQ ID NO: 753554 - protein, 17 aa, Mycobacterium
WPTPLKAAGFDPRQPSA

SEQ ID NO: 753555 - protein, 19 aa, Mycobacterium
WPTPRWRQHLDAQLEGTYS

SEQ ID NO: 753556 - protein, 17 aa, Mycobacterium
WPTRKPLRASFSLLTGW

SEQ ID NO: 753557 - protein, 19 aa, Mycobacterium
WPTRLRRLISDQVSLILRR

SEQ ID NO: 753558 - protein, 21 aa, Mycobacterium
WPTSRGFERFYGFMGGETDQW

SEQ ID NO: 753559 - protein, 18 aa, Mycobacterium
WPTVRRVRAARPGLTIWN

SEQ ID NO: 753560 - protein, 17 aa, Mycobacterium
WPTWYYCCCGGLFDIHQ

SEQ ID NO: 753561 - protein, 33 aa, Mycobacterium
WPVAGPLVGRLGWWLESRLSPRMHRRNQYLTVS

SEQ ID NO: 753562 - protein, 18 aa, Mycobacterium
WPVAHGGCDWSLTQHYIF

SEQ ID NO: 753563 - protein, 18 aa, Mycobacterium
WPVARLLRDAQVNTIWEG

SEQ ID NO: 753564 - protein, 18 aa, Mycobacterium
WPVGEEWLYQSWSAAYLP

SEQ ID NO: 753565 - protein, 18 aa, Mycobacterium
WPVLGGMGNASWVQLGGH

SEQ ID NO: 753566 - protein, 18 aa, Mycobacterium
WPVLGGMGNASWVQLSGH

SEQ ID NO: 753567 - protein, 20 aa, Mycobacterium
WPVLKDLLAAFLSEHGATAV

SEQ ID NO: 753568 - protein, 24 aa, Mycobacterium
WPVMPCAYTGFHLKPIGFFDGNPA

SEQ ID NO: 753569 - protein, 20 aa, Mycobacterium
WPVPELDEYVASFKALQRIQ

SEQ ID NO: 753570 - protein, 17 aa, Mycobacterium
WPVPPDAPDFVRTVTAA

SEQ ID NO: 753571 - protein, 23 aa, Mycobacterium
WPVPSGDVVDGWPAMSQDRIAAQ

SEQ ID NO: 753572 - protein, 17 aa, Mycobacterium
WPVPTAAAAVIGPSGVL

SEQ ID NO: 753573 - protein, 32 aa, Mycobacterium
WPVRPDARILLCSSVSGLWGGHGHAAYAAANR

SEQ ID NO: 753574 - protein, 20 aa, Mycobacterium
WPVRPLRRPVLALPDGTPGI

SEQ ID NO: 753575 - protein, 24 aa, Mycobacterium
WPVVAEPFTTWVLEDSFSDGRPPY

SEQ ID NO: 753576 - protein, 21 aa, Mycobacterium
WPVVLATRLGISVKEARRRCA

SEQ ID NO: 753577 - protein, 34 aa, Mycobacterium
WPWHARLGTAAVCWRLRRRYGLPVHDIAPMRVAR

SEQ ID NO: 753578 - protein, 18 aa, Mycobacterium
WPYFPFRGGEGVQDYQLG

SEQ ID NO: 753579 - protein, 27 aa, Mycobacterium
WPYPPEAIAPRYVEAMGGIDRVVELAD

SEQ ID NO: 753580 - protein, 35 aa, Mycobacterium
WQAARCVANWGGARADKGLRRWRSAARSAARQSRR

SEQ ID NO: 753581 - protein, 25 aa, Mycobacterium
WQAARCVASWNGSRVDKGLRRWRSV

SEQ ID NO: 753582 - protein, 20 aa, Mycobacterium
WQAARHWYRAGFQPAIQLCL

SEQ ID NO: 753583 - protein, 18 aa, Mycobacterium
WQAARYWYQAGMHPAIQL

SEQ ID NO: 753584 - protein, 18 aa, Mycobacterium
WQAARYWYQAGMHPAIQV

SEQ ID NO: 753585 - protein, 17 aa, Mycobacterium
WQAEGYRRYAVKMRAED

SEQ ID NO: 753586 - protein, 19 aa, Mycobacterium
WQAELPLIEEWFQFIGDKL

SEQ ID NO: 753587 - protein, 24 aa, Mycobacterium
WQAGDPEAAFAHFGRRFDDLSTEV

SEQ ID NO: 753588 - protein, 18 aa, Mycobacterium
WQAGGWVHGDVLDIGCGL

SEQ ID NO: 753589 - protein, 20 aa, Mycobacterium
WQAIEASGRFCVNVLTEKQK

SEQ ID NO: 753590 - protein, 19 aa, Mycobacterium
WQAIMSANLDSCFVVTSAV

SEQ ID NO: 753591 - protein, 20 aa, Mycobacterium
WQALCAADLPGLAHPTELGG

SEQ ID NO: 753592 - protein, 17 aa, Mycobacterium
WQALGARFVAARPQVQL

SEQ ID NO: 753593 - protein, 24 aa, Mycobacterium
WQALSRRDWEAIPTFLSDDCLYVD

SEQ ID NO: 753594 - protein, 20 aa, Mycobacterium
WQALSRRDWEAVKTFLSDDC

SEQ ID NO: 753595 - protein, 19 aa, Mycobacterium
WQAPDPRLARQVVPENRLR

SEQ ID NO: 753596 - protein, 17 aa, Mycobacterium
WQARTRPPVGWIEQTDG

SEQ ID NO: 753597 - protein, 34 aa, Mycobacterium
WQDGMEPFLGIAVHGFPNYFFISGPDNANAAVQL

SEQ ID NO: 753598 - protein, 20 aa, Mycobacterium
WQDKEQPIDYVVASGNGTVF

SEQ ID NO: 753599 - protein, 18 aa, Mycobacterium
WQDQHGHCEIVFNDVRVP

SEQ ID NO: 753600 - protein, 22 aa, Mycobacterium
WQDVDGAAFARVMAVSQLIGKA

SEQ ID NO: 753601 - protein, 17 aa, Mycobacterium
WQECSQVGMPRAVVITK

SEQ ID NO: 753602 - protein, 23 aa, Mycobacterium
WQEDKRWSPQWSDEQREKGYAGW

SEQ ID NO: 753603 - protein, 23 aa, Mycobacterium
WQEGRRWSPQWSDEQRAEGYAGW

SEQ ID NO: 753604 - protein, 17 aa, Mycobacterium
WQEIPATNMWNGVPPAG

SEQ ID NO: 753605 - protein, 24 aa, Mycobacterium
WQELADAIGRPVVWTTSALLGQHP

SEQ ID NO: 753606 - protein, 31 aa, Mycobacterium
WQELVLRTGATLKWYGVTAEGRIDLDSLVLD

SEQ ID NO: 753607 - protein, 17 aa, Mycobacterium
WQEVLSGVSGRVASALE

SEQ ID NO: 753608 - protein, 17 aa, Mycobacterium
WQEYPALGVTLTMSDIR

SEQ ID NO: 753609 - protein, 19 aa, Mycobacterium
WQFAATVGERLARPGPPSS

SEQ ID NO: 753610 - protein, 17 aa, Mycobacterium
WQFIAGWPDANSDDPED

SEQ ID NO: 753611 - protein, 17 aa, Mycobacterium
WQFIAPTFARYHQPGTS

SEQ ID NO: 753612 - protein, 28 aa, Mycobacterium
WQFLRSEFTGDIYAQWSLDRSLDVFLLH

SEQ ID NO: 753613 - protein, 24 aa, Mycobacterium
WQFNADLHLIDWLTEKGYTFDVVT

SEQ ID NO: 753614 - protein, 18 aa, Mycobacterium
WQFSSGTDACDWIILGAM

SEQ ID NO: 753615 - protein, 17 aa, Mycobacterium
WQFVAGWPDARSDNPED

SEQ ID NO: 753616 - protein, 23 aa, Mycobacterium
WQGDTGLTYQAWQAQWNQAMADL

SEQ ID NO: 753617 - protein, 19 aa, Mycobacterium
WQGGGNMIADVTLQRAVFQ

SEQ ID NO: 753618 - protein, 17 aa, Mycobacterium
WQHCTAMVPGFTGHTTA

SEQ ID NO: 753619 - protein, 18 aa, Mycobacterium
WQHCTAMVPGFTGTTTAA

SEQ ID NO: 753620 - protein, 17 aa, Mycobacterium
WQHELRDKFGIGAQLLL

SEQ ID NO: 753621 - protein, 17 aa, Mycobacterium
WQHGPLVAADLVLVGRF

SEQ ID NO: 753622 - protein, 17 aa, Mycobacterium
WQHLAVIMNDAVNADAS

SEQ ID NO: 753623 - protein, 17 aa, Mycobacterium
WQHLPVPFEVYADGIDL

SEQ ID NO: 753624 - protein, 17 aa, Mycobacterium
WQHLPVPFEVYADGISL

SEQ ID NO: 753625 - protein, 18 aa, Mycobacterium
WQHPTINALVAFLTAAEP

SEQ ID NO: 753626 - protein, 18 aa, Mycobacterium
WQHTRHWITAAAGAGRRT

SEQ ID NO: 753627 - protein, 20 aa, Mycobacterium
WQHVLDCLNGYLTLADALLA

SEQ ID NO: 753628 - protein, 17 aa, Mycobacterium
WQIAAGGLLRFATRPLQ

SEQ ID NO: 753629 - protein, 19 aa, Mycobacterium
WQIALRLPGASVMRKPRFG

SEQ ID NO: 753630 - protein, 19 aa, Mycobacterium
WQIEELRVSLWAQQLGTPR

SEQ ID NO: 753631 - protein, 19 aa, Mycobacterium
WQIHRRIGMDGSTLVRTLS

SEQ ID NO: 753632 - protein, 22 aa, Mycobacterium
WQIIGHTEVVLWDVTRPNPALL

SEQ ID NO: 753633 - protein, 26 aa, Mycobacterium
WQIPRVKIKIGESWGSDERRDLDRIA

SEQ ID NO: 753634 - protein, 17 aa, Mycobacterium
WQITGHKIWTSSAHRAD

SEQ ID NO: 753635 - protein, 24 aa, Mycobacterium
WQKALWQALCERIDADPPHIRHAK

SEQ ID NO: 753636 - protein, 27 aa, Mycobacterium
WQLAAAVRPTLFVFTSIGRLGHDRQGN

SEQ ID NO: 753637 - protein, 20 aa, Mycobacterium
WQLADEVLDDFLAPGKGEFI

SEQ ID NO: 753638 - protein, 19 aa, Mycobacterium
WQLADGDIIRLGHSEIIVR

SEQ ID NO: 753639 - protein, 21 aa, Mycobacterium
WQLEKALPVPVFVQSMAQVTI

SEQ ID NO: 753640 - protein, 17 aa, Mycobacterium
WQLFSGWTDDIKKIFDW

SEQ ID NO: 753641 - protein, 25 aa, Mycobacterium
WQLGELLEALNLYADEMINPLANSE

SEQ ID NO: 753642 - protein, 19 aa, Mycobacterium
WQLGLLIKIEGSIRRDVLE

SEQ ID NO: 753643 - protein, 17 aa, Mycobacterium
WQLGMTRHFLAGDAQPR

SEQ ID NO: 753644 - protein, 18 aa, Mycobacterium
WQLGMTRHFLAGEAQPQY

SEQ ID NO: 753645 - protein, 18 aa, Mycobacterium
WQLGMTRHFLNGEAQPRY

SEQ ID NO: 753646 - protein, 25 aa, Mycobacterium
WQLHVPLSPVVRGRDAARAELEKHN

SEQ ID NO: 753647 - protein, 18 aa, Mycobacterium
WQLIGRTDAVLWDLERPD

SEQ ID NO: 753648 - protein, 17 aa, Mycobacterium
WQLIGTTDTVIWDLDRN

SEQ ID NO: 753649 - protein, 26 aa, Mycobacterium
WQLLMSAWLDLPGRPSLVGTRGADGK

SEQ ID NO: 753650 - protein, 17 aa, Mycobacterium
WQLPPGALLIVEDAATA

SEQ ID NO: 753651 - protein, 24 aa, Mycobacterium
WQMAAKALRPLPVAHKEMSEEARV

SEQ ID NO: 753652 - protein, 20 aa, Mycobacterium
WQMRLTRRILSASGSPDQDP

SEQ ID NO: 753653 - protein, 17 aa, Mycobacterium
WQNIFGVWPADGAVTDE

SEQ ID NO: 753654 - protein, 23 aa, Mycobacterium
WQNVPLHLPSTFATWKGLSDNAC

SEQ ID NO: 753655 - protein, 24 aa, Mycobacterium
WQNWSLRVGFNYREGMTLHTVTYN

SEQ ID NO: 753656 - protein, 17 aa, Mycobacterium
WQPEPLPGQPLDRPFAW

SEQ ID NO: 753657 - protein, 22 aa, Mycobacterium
WQPHQVPAFLAAGYRCITFDNR

SEQ ID NO: 753658 - protein, 18 aa, Mycobacterium
WQPLPTWFGRLNGAGVSA

SEQ ID NO: 753659 - protein, 18 aa, Mycobacterium
WQPLYEFGTRTAPDIDLL

SEQ ID NO: 753660 - protein, 17 aa, Mycobacterium
WQPPFAGKRLRRRLRAA

SEQ ID NO: 753661 - protein, 18 aa, Mycobacterium
WQPQAGVMRAFEVPSVRA

SEQ ID NO: 753662 - protein, 17 aa, Mycobacterium
WQPRVDYRTGLATTVAW

SEQ ID NO: 753663 - protein, 23 aa, Mycobacterium
WQPRYDYRRILDCLAAEQDFRSP

SEQ ID NO: 753664 - protein, 17 aa, Mycobacterium
WQPTPMGVISLRRRFDL

SEQ ID NO: 753665 - protein, 26 aa, Mycobacterium
WQPVPGKGGMSVWVRLPAPMSSALSA

SEQ ID NO: 753666 - protein, 24 aa, Mycobacterium
WQQELWPTEEFELARSRVPVRLPE

SEQ ID NO: 753667 - protein, 24 aa, Mycobacterium
WQQPGIVFFRYVLGMPVEDIPLYI

SEQ ID NO: 753668 - protein, 20 aa, Mycobacterium
WQQVLRNLGIDIGKNGAINL

SEQ ID NO: 753669 - protein, 25 aa, Mycobacterium
WQQVTDWDFVCEQLALAEPRWEPGS

SEQ ID NO: 753670 - protein, 24 aa, Mycobacterium
WQQWWDWVPGAYWRHPFGPGSDID

SEQ ID NO: 753671 - protein, 22 aa, Mycobacterium
WQRAAELGWASLLVPEELGGGS

SEQ ID NO: 753672 - protein, 25 aa, Mycobacterium
WQRAEYDAAGLPFARRGDLLNHTLD

SEQ ID NO: 753673 - protein, 20 aa, Mycobacterium
WQRAQLRRWRDGDRAASPLH

SEQ ID NO: 753674 - protein, 24 aa, Mycobacterium
WQRCGCDPVALLGAVKPARLDELA

SEQ ID NO: 753675 - protein, 17 aa, Mycobacterium
WQRCWRIAQRAEPDLKS

SEQ ID NO: 753676 - protein, 20 aa, Mycobacterium
WQRDQMRRWRAGDVTASPLY

SEQ ID NO: 753677 - protein, 20 aa, Mycobacterium
WQRDRMRRWRDGDLTASPLY

SEQ ID NO: 753678 - protein, 34 aa, Mycobacterium
WQRELWPTEEFELARSRIPIGLPETELFAGIESS

SEQ ID NO: 753679 - protein, 19 aa, Mycobacterium
WQREMLAQIEVPYRVIDVA

SEQ ID NO: 753680 - protein, 17 aa, Mycobacterium
WQRKAVQMIAPMLGTDP

SEQ ID NO: 753681 - protein, 19 aa, Mycobacterium
WQRLFLFSRADTIYGGSNE

SEQ ID NO: 753682 - protein, 18 aa, Mycobacterium
WQRLFLFTRADTIYGGSN

SEQ ID NO: 753683 - protein, 19 aa, Mycobacterium
WQRLFLFTRADTIYGGSNE

SEQ ID NO: 753684 - protein, 27 aa, Mycobacterium
WQRLGVSGRAYWLGRWRDWMLDHRDDL

SEQ ID NO: 753685 - protein, 19 aa, Mycobacterium
WQRLVNRSAAIAIAPGPFV

SEQ ID NO: 753686 - protein, 17 aa, Mycobacterium
WQRLYLFSRADTIYGGS

SEQ ID NO: 753687 - protein, 17 aa, Mycobacterium
WQRRRIENFQILTAGGE

SEQ ID NO: 753688 - protein, 17 aa, Mycobacterium
WQRRVISNHGINLRTKL

SEQ ID NO: 753689 - protein, 20 aa, Mycobacterium
WQRVRQALLAARLVRVQPGR

SEQ ID NO: 753690 - protein, 22 aa, Mycobacterium
WQRWTRGGWRRWETTTTAEDHY

SEQ ID NO: 753691 - protein, 21 aa, Mycobacterium
WQSRMVSSLGVPVVLCSALGG

SEQ ID NO: 753692 - protein, 24 aa, Mycobacterium
WQSSRLEFLRAWLAGSDNAAVNRH

SEQ ID NO: 753693 - protein, 22 aa, Mycobacterium
WQTAHVMKRRRGALEGDGSGKN

SEQ ID NO: 753694 - protein, 21 aa, Mycobacterium
WQTAHVMKRRRGNLAGDTRAD

SEQ ID NO: 753695 - protein, 27 aa, Mycobacterium
WQTAHVMKRRRGTLPGDGRADNNRARR

SEQ ID NO: 753696 - protein, 17 aa, Mycobacterium
WQTALIRLSRLQISDEI

SEQ ID NO: 753697 - protein, 26 aa, Mycobacterium
WQTEDFAGGGFRRGEGFLCLMPSGPH

SEQ ID NO: 753698 - protein, 32 aa, Mycobacterium
WQTLYPFDWLARLPIPVNRRFRSAITDVRDLV

SEQ ID NO: 753699 - protein, 18 aa, Mycobacterium
WQTPEGIEVKPVYIGADR

SEQ ID NO: 753700 - protein, 18 aa, Mycobacterium
WQTPLAHMRRIAKADTVL

SEQ ID NO: 753701 - protein, 19 aa, Mycobacterium
WQTPLDWLNIPPGGVALDV

SEQ ID NO: 753702 - protein, 23 aa, Mycobacterium
WQTPNWWEAHVLGLAVWHAGAVS

SEQ ID NO: 753703 - protein, 17 aa, Mycobacterium
WQVALRMSGALAKPKPR

SEQ ID NO: 753704 - protein, 23 aa, Mycobacterium
WQVEERAAGGLLRLRSTKRAPGR

SEQ ID NO: 753705 - protein, 17 aa, Mycobacterium
WQVLLAVPADLAAQRAR

SEQ ID NO: 753706 - protein, 19 aa, Mycobacterium
WQVLPAELISPIEDAAKAG

SEQ ID NO: 753707 - protein, 27 aa, Mycobacterium
WQVLRLPRIPMRFPMYLPGPNRVMIVD

SEQ ID NO: 753708 - protein, 18 aa, Mycobacterium
WQVPKGVTLDSVIGKTMG

SEQ ID NO: 753709 - protein, 22 aa, Mycobacterium
WQVVDAGGWPGARLAEAIDAVA

SEQ ID NO: 753710 - protein, 17 aa, Mycobacterium
WQVVLAMVRRTGGTVPV

SEQ ID NO: 753711 - protein, 18 aa, Mycobacterium
WQWNRPVYDVQGGSPQLR

SEQ ID NO: 753712 - protein, 27 aa, Mycobacterium
WQYDGPRYAWLREVRDLVDGEELTPLL

SEQ ID NO: 753713 - protein, 22 aa, Mycobacterium
WQYELNGVLGLRNPAEQSRRVA

SEQ ID NO: 753714 - protein, 17 aa, Mycobacterium
WQYVRACRQRDRLRAAA

SEQ ID NO: 753715 - protein, 18 aa, Mycobacterium
WRAAANHFRLRRIDGRWQ

SEQ ID NO: 753716 - protein, 21 aa, Mycobacterium
WRAADQEMMRPLRALLVEPVA

SEQ ID NO: 753717 - protein, 19 aa, Mycobacterium
WRAAELLNELGARYVPDRV

SEQ ID NO: 753718 - protein, 20 aa, Mycobacterium
WRAAMWRKPAGHGINDPDFV

SEQ ID NO: 753719 - protein, 17 aa, Mycobacterium
WRAASIAPESACTSMQL

SEQ ID NO: 753720 - protein, 20 aa, Mycobacterium
WRAATRRLVLPWALQGIEPV

SEQ ID NO: 753721 - protein, 17 aa, Mycobacterium
WRAAWPREIAESASEPA

SEQ ID NO: 753722 - protein, 17 aa, Mycobacterium
WRADGLSGQSAAPGCPA

SEQ ID NO: 753723 - protein, 17 aa, Mycobacterium
WRADGYEGAYWCGDPHA

SEQ ID NO: 753724 - protein, 17 aa, Mycobacterium
WRADTFVAGAPEPRHDE

SEQ ID NO: 753725 - protein, 17 aa, Mycobacterium
WRADTFVAGTPEARHDE

SEQ ID NO: 753726 - protein, 17 aa, Mycobacterium
WRADTFVAGTPEPRHDE

SEQ ID NO: 753727 - protein, 18 aa, Mycobacterium
WRADTFVAGTPEPRHDEV

SEQ ID NO: 753728 - protein, 17 aa, Mycobacterium
WRAEADGGFTAVQRRIF

SEQ ID NO: 753729 - protein, 19 aa, Mycobacterium
WRAEAPADLRLLALNEQLA

SEQ ID NO: 753730 - protein, 31 aa, Mycobacterium
WRAEEPIVIVAPMFHAWGFSQLLLAASFACP

SEQ ID NO: 753731 - protein, 31 aa, Mycobacterium
WRAEEPIVIVAPMFHAWGFSQLVLAASLACT

SEQ ID NO: 753732 - protein, 31 aa, Mycobacterium
WRAEEPVVIVAPMFHAWGFSQLAFAASMACT

SEQ ID NO: 753733 - protein, 19 aa, Mycobacterium
WRAEHPEIAVIRVSVGPTC

SEQ ID NO: 753734 - protein, 21 aa, Mycobacterium
WRAEHPEIGFTCLIVGECAGG

SEQ ID NO: 753735 - protein, 23 aa, Mycobacterium
WRAELRRVGLLGGDAESEADVDE

SEQ ID NO: 753736 - protein, 21 aa, Mycobacterium
WRAEVLPEDKLQAVRQLQDDG

SEQ ID NO: 753737 - protein, 20 aa, Mycobacterium
WRAGDLELPLSYRYQPGAAD

SEQ ID NO: 753738 - protein, 23 aa, Mycobacterium
WRAGRFWWDWSETGEPDGRSLTT

SEQ ID NO: 753739 - protein, 35 aa, Mycobacterium
WRAGVEYRTGGPLPKFDFIPSALLPAWISDETIHG

SEQ ID NO: 753740 - protein, 18 aa, Mycobacterium
WRAHGAGVREIARRLRRA

SEQ ID NO: 753741 - protein, 19 aa, Mycobacterium
WRAIWRAVLAAGFELDQRR

SEQ ID NO: 753742 - protein, 19 aa, Mycobacterium
WRAKVRNLPSLDADPLRPA

SEQ ID NO: 753743 - protein, 18 aa, Mycobacterium
WRALDPQLRETFLGARAQ

SEQ ID NO: 753744 - protein, 33 aa, Mycobacterium
WRALDRGDLLPEWAIPPREEFDFGYPDDKIDAV

SEQ ID NO: 753745 - protein, 18 aa, Mycobacterium
WRALMADAREAARRLARA

SEQ ID NO: 753746 - protein, 17 aa, Mycobacterium
WRALTAIVYDNRDSWKR

SEQ ID NO: 753747 - protein, 17 aa, Mycobacterium
WRAMDAFYEEEERIVGH

SEQ ID NO: 753748 - protein, 24 aa, Mycobacterium
WRAPEYLQTLPLRRLASPREVARC

SEQ ID NO: 753749 - protein, 18 aa, Mycobacterium
WRAPSAKNRQPWDFVIVT

SEQ ID NO: 753750 - protein, 19 aa, Mycobacterium
WRAQIAKDLGRRGLERDRV

SEQ ID NO: 753751 - protein, 17 aa, Mycobacterium
WRAQLLGTVDFLGAART

SEQ ID NO: 753752 - protein, 18 aa, Mycobacterium
WRARVKGITVYRYGSRAG

SEQ ID NO: 753753 - protein, 17 aa, Mycobacterium
WRASGTLDDALKAQHVV

SEQ ID NO: 753754 - protein, 18 aa, Mycobacterium
WRAVIAGFVARRLSVKPT

SEQ ID NO: 753755 - protein, 17 aa, Mycobacterium
WRAVRRGLGSMSVAENL

SEQ ID NO: 753756 - protein, 19 aa, Mycobacterium
WRAVTGVNLDGAYHTAWAA

SEQ ID NO: 753757 - protein, 20 aa, Mycobacterium
WRAYALPALVALTAVVVYQT

SEQ ID NO: 753758 - protein, 18 aa, Mycobacterium
WRDAIGEACLAQRHADAA

SEQ ID NO: 753759 - protein, 18 aa, Mycobacterium
WRDALGLTAADRMQIMTP

SEQ ID NO: 753760 - protein, 17 aa, Mycobacterium
WRDALGLTAADRMQVMT

SEQ ID NO: 753761 - protein, 23 aa, Mycobacterium
WRDAVALHRRIAYVPGDVTLWPN

SEQ ID NO: 753762 - protein, 17 aa, Mycobacterium
WRDEADWIAPERRTHEA

SEQ ID NO: 753763 - protein, 33 aa, Mycobacterium
WRDFGLPPFERLRVIACGTSLNAGCVIGNLARE

SEQ ID NO: 753764 - protein, 29 aa, Mycobacterium
WRDFGLPSFERLRVIGCGTSLNAGTVIGN

SEQ ID NO: 753765 - protein, 22 aa, Mycobacterium
WRDGDWYVARLCPSPLSHDERQ

SEQ ID NO: 753766 - protein, 21 aa, Mycobacterium
WRDGEKFVVEFDLPGIDAKSL

SEQ ID NO: 753767 - protein, 21 aa, Mycobacterium
WRDGRFVGFEGSYGWGRDRVT

SEQ ID NO: 753768 - protein, 22 aa, Mycobacterium
WRDIADGLAPVAPRDTYKVRQA

SEQ ID NO: 753769 - protein, 27 aa, Mycobacterium
WRDKFAGKDGDGWKGRTPNLVMGSNVQ

SEQ ID NO: 753770 - protein, 20 aa, Mycobacterium
WRDLENLPRFMHHLKSVTPA

SEQ ID NO: 753771 - protein, 18 aa, Mycobacterium
WRDLEVLLQVLPRSSTGE

SEQ ID NO: 753772 - protein, 17 aa, Mycobacterium
WRDLFSPAVALADNGFD

SEQ ID NO: 753773 - protein, 18 aa, Mycobacterium
WRDLHTITAPTLLLWGRD

SEQ ID NO: 753774 - protein, 18 aa, Mycobacterium
WRDPRLAQSPTLHLGGSR

SEQ ID NO: 753775 - protein, 22 aa, Mycobacterium
WRDPRVAEAYQREALASDPTSE

SEQ ID NO: 753776 - protein, 23 aa, Mycobacterium
WRDRALAGLMLLSGLRSGELLTL

SEQ ID NO: 753777 - protein, 19 aa, Mycobacterium
WRDRFEQMLQRAEARLHPK

SEQ ID NO: 753778 - protein, 19 aa, Mycobacterium
WRDRFQQMLQRAEARLHPK

SEQ ID NO: 753779 - protein, 19 aa, Mycobacterium
WRDRFQQMLQRAEARLHPQ

SEQ ID NO: 753780 - protein, 19 aa, Mycobacterium
WRDRFQQMLQRAEARLHPR

SEQ ID NO: 753781 - protein, 20 aa, Mycobacterium
WRDRRLPMRYEPRPAAVDVY

SEQ ID NO: 753782 - protein, 18 aa, Mycobacterium
WRDSYPAAVRALLDDRDS

SEQ ID NO: 753783 - protein, 19 aa, Mycobacterium
WRDTLNMDWEGEAITALRA

SEQ ID NO: 753784 - protein, 22 aa, Mycobacterium
WRDWSVRCAALATHPAALDTRS

SEQ ID NO: 753785 - protein, 23 aa, Mycobacterium
WRDWSVRCAALATHPAALDTRSY

SEQ ID NO: 753786 - protein, 18 aa, Mycobacterium
WRDYSKLVIDRGDLYGNF

SEQ ID NO: 753787 - protein, 17 aa, Mycobacterium
WRDYTLFDHVERFDRPF

SEQ ID NO: 753788 - protein, 20 aa, Mycobacterium
WREAFRLPAMDHGRLGEQLD

SEQ ID NO: 753789 - protein, 17 aa, Mycobacterium
WREALLVAPDLLRKVTV

SEQ ID NO: 753790 - protein, 18 aa, Mycobacterium
WREHYPYLVNLAYQMLGD

SEQ ID NO: 753791 - protein, 26 aa, Mycobacterium
WREIDGVVIPPPFDLRTLLSGGRVQA

SEQ ID NO: 753792 - protein, 18 aa, Mycobacterium
WREIPQPVRSLVMLALIT

SEQ ID NO: 753793 - protein, 31 aa, Mycobacterium
WRELAKPLHLHRILLQRSWIPIFCSRFGEAV

SEQ ID NO: 753794 - protein, 20 aa, Mycobacterium
WRELFARNLETMFFMSQAVA

SEQ ID NO: 753795 - protein, 24 aa, Mycobacterium
WRELFTANLETMFFMSQAVAAEIR

SEQ ID NO: 753796 - protein, 18 aa, Mycobacterium
WRESLRAHAHRMRDTIQQ

SEQ ID NO: 753797 - protein, 28 aa, Mycobacterium
WREVDGVVIPPPFDLRTLLASGRVQATM

SEQ ID NO: 753798 - protein, 22 aa, Mycobacterium
WRFARTWLANLRHPAMMLRSMF

SEQ ID NO: 753799 - protein, 26 aa, Mycobacterium
WRFGTPPAANANFAWIQHILSKLAPT

SEQ ID NO: 753800 - protein, 20 aa, Mycobacterium
WRFITPPSAFIGAVIVDRGG

SEQ ID NO: 753801 - protein, 17 aa, Mycobacterium
WRFLSPPSAFLEGLTVG

SEQ ID NO: 753802 - protein, 19 aa, Mycobacterium
WRFVAEWTSKGEILTPGPA

SEQ ID NO: 753803 - protein, 18 aa, Mycobacterium
WRGAAPVQAALAAGDEVT

SEQ ID NO: 753804 - protein, 17 aa, Mycobacterium
WRGAAPVQASIAAGDEI

SEQ ID NO: 753805 - protein, 17 aa, Mycobacterium
WRGALPPENGFVHLDDV

SEQ ID NO: 753806 - protein, 19 aa, Mycobacterium
WRGAPLQVRVDDFLAHLGA

SEQ ID NO: 753807 - protein, 19 aa, Mycobacterium
WRGGKGVVCEYVCDGCGHT

SEQ ID NO: 753808 - protein, 17 aa, Mycobacterium
WRGGLPGTYETCGFDEQ

SEQ ID NO: 753809 - protein, 19 aa, Mycobacterium
WRGIAVLMVGGGLVSRCEV

SEQ ID NO: 753810 - protein, 18 aa, Mycobacterium
WRGLGFISQSALRLHDDF

SEQ ID NO: 753811 - protein, 17 aa, Mycobacterium
WRGLGFISQSALRLSDD

SEQ ID NO: 753812 - protein, 19 aa, Mycobacterium
WRGMFPARLFRLGPEDEPV

SEQ ID NO: 753813 - protein, 17 aa, Mycobacterium
WRGPIRLATEEARARAQ

SEQ ID NO: 753814 - protein, 24 aa, Mycobacterium
WRGQRLRALVALPELVAAAPDGCG

SEQ ID NO: 753815 - protein, 17 aa, Mycobacterium
WRGSICAAVEDPEGAAR

SEQ ID NO: 753816 - protein, 18 aa, Mycobacterium
WRGSICAAVEDPEGAARE

SEQ ID NO: 753817 - protein, 22 aa, Mycobacterium
WRGSSSFPGKIPVSANRAEIAR

SEQ ID NO: 753818 - protein, 25 aa, Mycobacterium
WRGYVERNRVAALMRDVRFLRIGEG

SEQ ID NO: 753819 - protein, 25 aa, Mycobacterium
WRHDALCRGMPWDFFYSPDDERGAR

SEQ ID NO: 753820 - protein, 22 aa, Mycobacterium
WRHFSPAVARRYLRGYRSRGTG

SEQ ID NO: 753821 - protein, 19 aa, Mycobacterium
WRHGAAVSVGLVFAAELGR

SEQ ID NO: 753822 - protein, 20 aa, Mycobacterium
WRHGAPDHREVVYLAHHIAA

SEQ ID NO: 753823 - protein, 17 aa, Mycobacterium
WRHGMWQGDLVVQGKRY

SEQ ID NO: 753824 - protein, 20 aa, Mycobacterium
WRHGTPDHREVVYLAHHIAG

SEQ ID NO: 753825 - protein, 19 aa, Mycobacterium
WRHLAPKGWFYNVMVTGVK

SEQ ID NO: 753826 - protein, 19 aa, Mycobacterium
WRHPLGHRWRWEFEALSPN

SEQ ID NO: 753827 - protein, 17 aa, Mycobacterium
WRHPRTDARNLTDVKHF

SEQ ID NO: 753828 - protein, 17 aa, Mycobacterium
WRHTGRLARIFPEVSVE

SEQ ID NO: 753829 - protein, 24 aa, Mycobacterium
WRIADCRAAAAAMAIRSGADELQI

SEQ ID NO: 753830 - protein, 21 aa, Mycobacterium
WRILFEDLNIAWAQHHHGQPV

SEQ ID NO: 753831 - protein, 20 aa, Mycobacterium
WRILKFRPATTPGVAVPDDL

SEQ ID NO: 753832 - protein, 17 aa, Mycobacterium
WRILLDDLNSVWEQHRS

SEQ ID NO: 753833 - protein, 20 aa, Mycobacterium
WRILLEDFNIAWAQHHGGQA

SEQ ID NO: 753834 - protein, 20 aa, Mycobacterium
WRILLEDFNIAWAQHHNGQP

SEQ ID NO: 753835 - protein, 20 aa, Mycobacterium
WRILLEDFNIAWAQHHSGQP

SEQ ID NO: 753836 - protein, 23 aa, Mycobacterium
WRILLEDINIAWAQHRSGQPVAL

SEQ ID NO: 753837 - protein, 21 aa, Mycobacterium
WRILLEDLNIAWAQHHGGRPV

SEQ ID NO: 753838 - protein, 21 aa, Mycobacterium
WRILLEDLNIAWAQHHSGQPV

SEQ ID NO: 753839 - protein, 21 aa, Mycobacterium
WRILLEDLNIAWAQHHSGQQV

SEQ ID NO: 753840 - protein, 22 aa, Mycobacterium
WRILLEDLNIAWAQHRAGQPVA

SEQ ID NO: 753841 - protein, 24 aa, Mycobacterium
WRILLEDLNIAWAQHRGGQPVALP

SEQ ID NO: 753842 - protein, 20 aa, Mycobacterium
WRILLEDLNIAWAQQQSGRP

SEQ ID NO: 753843 - protein, 28 aa, Mycobacterium
WRILLEDLNVAWAQRRSGLDVALSGAGT

SEQ ID NO: 753844 - protein, 20 aa, Mycobacterium
WRILNREGVRVSADVAAEGR

SEQ ID NO: 753845 - protein, 20 aa, Mycobacterium
WRINTYPGLACDVKSHLYSF

SEQ ID NO: 753846 - protein, 22 aa, Mycobacterium
WRIPGPELKFEERWMPPTHVET

SEQ ID NO: 753847 - protein, 18 aa, Mycobacterium
WRIRAVNSACERVSGHPR

SEQ ID NO: 753848 - protein, 17 aa, Mycobacterium
WRITAGRYAVAVGASAV

SEQ ID NO: 753849 - protein, 17 aa, Mycobacterium
WRITLPHPDAAKFDAAL

SEQ ID NO: 753850 - protein, 17 aa, Mycobacterium
WRKIAMATWRPRKDPII

SEQ ID NO: 753851 - protein, 19 aa, Mycobacterium
WRKLTKRQRDWVLFTEDQP

SEQ ID NO: 753852 - protein, 21 aa, Mycobacterium
WRKMAPLLAAAGWRVIAPFMR

SEQ ID NO: 753853 - protein, 20 aa, Mycobacterium
WRKMFGENFFYILYFQEPGV

SEQ ID NO: 753854 - protein, 24 aa, Mycobacterium
WRKNLLACTGIEYCKLSFTETRVR

SEQ ID NO: 753855 - protein, 18 aa, Mycobacterium
WRKQDLFFNAPANGPAGI

SEQ ID NO: 753856 - protein, 19 aa, Mycobacterium
WRKRLLRKAIDFADPLRCA

SEQ ID NO: 753857 - protein, 23 aa, Mycobacterium
WRKRYKSLCLHDPVWYDHLPYLP

SEQ ID NO: 753858 - protein, 24 aa, Mycobacterium
WRKRYKSLCLHDPVWYDHLPYLPF

SEQ ID NO: 753859 - protein, 20 aa, Mycobacterium
WRKTVVSILGPRSFRALRLD

SEQ ID NO: 753860 - protein, 20 aa, Mycobacterium
WRKVAPRLAKAGWRVVAPFM

SEQ ID NO: 753861 - protein, 18 aa, Mycobacterium
WRLAHLIVGVLGARTHSH

SEQ ID NO: 753862 - protein, 20 aa, Mycobacterium
WRLATVNVDVVPRVAQIFGV

SEQ ID NO: 753863 - protein, 17 aa, Mycobacterium
WRLDAAYTVPERFWAST

SEQ ID NO: 753864 - protein, 21 aa, Mycobacterium
WRLDGQKTWITDGHWADMGLA

SEQ ID NO: 753865 - protein, 18 aa, Mycobacterium
WRLDYPMAASVLATAGDL

SEQ ID NO: 753866 - protein, 27 aa, Mycobacterium
WRLFSQWAEDVVRVFGFSVDVAARQDH

SEQ ID NO: 753867 - protein, 21 aa, Mycobacterium
WRLGAAAVLISPAWKTTEIAH

SEQ ID NO: 753868 - protein, 21 aa, Mycobacterium
WRLGAAAVLLSPAWKQTEVGH

SEQ ID NO: 753869 - protein, 19 aa, Mycobacterium
WRLGHIIVGVLGARIASHF

SEQ ID NO: 753870 - protein, 19 aa, Mycobacterium
WRLIGQALDEDDDWQDWPA

SEQ ID NO: 753871 - protein, 20 aa, Mycobacterium
WRLKCPSHVLWLDAVDAAFP

SEQ ID NO: 753872 - protein, 18 aa, Mycobacterium
WRLLGSVDPRLRPHRVQG

SEQ ID NO: 753873 - protein, 21 aa, Mycobacterium
WRLLLAEGIEGRCRIVGVVDD

SEQ ID NO: 753874 - protein, 25 aa, Mycobacterium
WRLMGPSLRAGFGLDDMSDADMRAE

SEQ ID NO: 753875 - protein, 17 aa, Mycobacterium
WRLNGTADYVADADVAD

SEQ ID NO: 753876 - protein, 21 aa, Mycobacterium
WRLNSASIRDLFAANGLDPLG

SEQ ID NO: 753877 - protein, 17 aa, Mycobacterium
WRLPAPGGRRELDEAIG

SEQ ID NO: 753878 - protein, 20 aa, Mycobacterium
WRLPLAERRAIVELADSTLV

SEQ ID NO: 753879 - protein, 18 aa, Mycobacterium
WRLQADFDGSGIDERYFD

SEQ ID NO: 753880 - protein, 19 aa, Mycobacterium
WRLQATRSRVRDVQVNVDV

SEQ ID NO: 753881 - protein, 20 aa, Mycobacterium
WRLRALMAQRELYQTTDLVP

SEQ ID NO: 753882 - protein, 17 aa, Mycobacterium
WRLRGRPSAAEFIAYCA

SEQ ID NO: 753883 - protein, 19 aa, Mycobacterium
WRLRRGRLVLIEGDSPAGL

SEQ ID NO: 753884 - protein, 22 aa, Mycobacterium
WRLSCSSGQNLTARFVINCSGV

SEQ ID NO: 753885 - protein, 17 aa, Mycobacterium
WRLSKKGRKGKNAKKEP

SEQ ID NO: 753886 - protein, 25 aa, Mycobacterium
WRLTVPREYGGLGFGYQTLMSAVIT

SEQ ID NO: 753887 - protein, 20 aa, Mycobacterium
WRLVVDVNLIGAWNTCAAAL

SEQ ID NO: 753888 - protein, 20 aa, Mycobacterium
WRMAHVIVGVFAMRAHHHFG

SEQ ID NO: 753889 - protein, 21 aa, Mycobacterium
WRMALSQLWTAHIEWSPDLAP

SEQ ID NO: 753890 - protein, 19 aa, Mycobacterium
WRMASKSLRPLPVAHKEMS

SEQ ID NO: 753891 - protein, 18 aa, Mycobacterium
WRMELPLRHLEDLITRLS

SEQ ID NO: 753892 - protein, 20 aa, Mycobacterium
WRMSAGMPATIYRPSIVVGD

SEQ ID NO: 753893 - protein, 17 aa, Mycobacterium
WRMVHVGADLLRYRQGT

SEQ ID NO: 753894 - protein, 22 aa, Mycobacterium
WRNALRGARVVYFGRSPLTAAV

SEQ ID NO: 753895 - protein, 27 aa, Mycobacterium
WRNEFAARLMLRFAFERPGRKAATLQM

SEQ ID NO: 753896 - protein, 27 aa, Mycobacterium
WRNEVCARTALEIGFNRATGFARRLRS

SEQ ID NO: 753897 - protein, 17 aa, Mycobacterium
WRNFFLGGATELRDGKF

SEQ ID NO: 753898 - protein, 18 aa, Mycobacterium
WRNFFLSGAMELRDGNVG

SEQ ID NO: 753899 - protein, 18 aa, Mycobacterium
WRNFYLMGAYELRHGSVG

SEQ ID NO: 753900 - protein, 31 aa, Mycobacterium
WRNGAWYTARLCPTPLLAEERKTAVANHESD

SEQ ID NO: 753901 - protein, 17 aa, Mycobacterium
WRNGRPPAGLIVRNETL

SEQ ID NO: 753902 - protein, 25 aa, Mycobacterium
WRNHHNAWRPAHIHFSVFGTAFTQR

SEQ ID NO: 753903 - protein, 31 aa, Mycobacterium
WRNIASIPGGLRWTWETMKPLYTNGAVYGQA

SEQ ID NO: 753904 - protein, 32 aa, Mycobacterium
WRNLASIPGALRWTWDTMKPLYANGAVYREAD

SEQ ID NO: 753905 - protein, 18 aa, Mycobacterium
WRNLPDLLAASDIVSLHL

SEQ ID NO: 753906 - protein, 19 aa, Mycobacterium
WRNLPKVVFSRTLESVAWN

SEQ ID NO: 753907 - protein, 17 aa, Mycobacterium
WRNLSDLDVEWSVIGHL

SEQ ID NO: 753908 - protein, 23 aa, Mycobacterium
WRNLSVLYVCPLRALLNNLEPRL

SEQ ID NO: 753909 - protein, 17 aa, Mycobacterium
WRNPFSYQPEIWDYLKG

SEQ ID NO: 753910 - protein, 18 aa, Mycobacterium
WRNPFSYQPEIWDYLKGV

SEQ ID NO: 753911 - protein, 20 aa, Mycobacterium
WRNPLLPADSYIEFARQRAA

SEQ ID NO: 753912 - protein, 17 aa, Mycobacterium
WRNPPEVLHLANAASVD

SEQ ID NO: 753913 - protein, 26 aa, Mycobacterium
WRNRRGELEMSVAMVIANHADLADHV

SEQ ID NO: 753914 - protein, 23 aa, Mycobacterium
WRNSEDVFNYFLIDVDMSACQLT

SEQ ID NO: 753915 - protein, 20 aa, Mycobacterium
WRNYRGNLGFFAQHFRCLVL

SEQ ID NO: 753916 - protein, 17 aa, Mycobacterium
WRPALAAAERAKVVVIG

SEQ ID NO: 753917 - protein, 19 aa, Mycobacterium
WRPALRAPEISPLLPPMPV

SEQ ID NO: 753918 - protein, 21 aa, Mycobacterium
WRPDALLELAEQCDDAARRLC

SEQ ID NO: 753919 - protein, 22 aa, Mycobacterium
WRPEQLPAALLGAMRVLTDPVE

SEQ ID NO: 753920 - protein, 17 aa, Mycobacterium
WRPGAHLDVTLPSGAVR

SEQ ID NO: 753921 - protein, 25 aa, Mycobacterium
WRPGCPFCWRLRRALRRRRLPTREV

SEQ ID NO: 753922 - protein, 19 aa, Mycobacterium
WRPGVPIEVTHEIHTMALA

SEQ ID NO: 753923 - protein, 30 aa, Mycobacterium
WRPKVWPPVRRIDGAYGDRNLVCSCPPVEA

SEQ ID NO: 753924 - protein, 20 aa, Mycobacterium
WRPLGDYWFEGVSRAARARD

SEQ ID NO: 753925 - protein, 17 aa, Mycobacterium
WRPSGALFDQFLGAAET

SEQ ID NO: 753926 - protein, 18 aa, Mycobacterium
WRPSGALFDQFLGAAETD

SEQ ID NO: 753927 - protein, 20 aa, Mycobacterium
WRPTLSGERSAYVYYPGTAD

SEQ ID NO: 753928 - protein, 17 aa, Mycobacterium
WRPWRSYATQHLWTTLE

SEQ ID NO: 753929 - protein, 26 aa, Mycobacterium
WRQADKYDVPRICFVNKMDKIGADFY

SEQ ID NO: 753930 - protein, 29 aa, Mycobacterium
WRQAELHPAPGTWSWRPWSSIVDVEPGRL

SEQ ID NO: 753931 - protein, 17 aa, Mycobacterium
WRQAPGLTDADREAVDA

SEQ ID NO: 753932 - protein, 19 aa, Mycobacterium
WRQAVARGRAAQNLMAAPY

SEQ ID NO: 753933 - protein, 17 aa, Mycobacterium
WRQGTLFVEIVDKSGFR

SEQ ID NO: 753934 - protein, 18 aa, Mycobacterium
WRQHLWPTEKFELAHSRV

SEQ ID NO: 753935 - protein, 21 aa, Mycobacterium
WRQHVAVDLARRGLRRDRVLA

SEQ ID NO: 753936 - protein, 18 aa, Mycobacterium
WRQIDIPADDDIVIDRGR

SEQ ID NO: 753937 - protein, 22 aa, Mycobacterium
WRQKIYPGIGAPSWTADYGSET

SEQ ID NO: 753938 - protein, 22 aa, Mycobacterium
WRQKLYPGIGAPSWTADYGSET

SEQ ID NO: 753939 - protein, 20 aa, Mycobacterium
WRQRCHEASAAMAQWTPPDD

SEQ ID NO: 753940 - protein, 17 aa, Mycobacterium
WRQVVAMPEEVASLEAD

SEQ ID NO: 753941 - protein, 18 aa, Mycobacterium
WRRALRTLELVLDGAGGV

SEQ ID NO: 753942 - protein, 19 aa, Mycobacterium
WRRAVEVGAEQVLALPEDE

SEQ ID NO: 753943 - protein, 27 aa, Mycobacterium
WRRAVVAVLGPRGFRALRLDRNRNNIT

SEQ ID NO: 753944 - protein, 21 aa, Mycobacterium
WRRDDEWFAEIALDSDQIDEA

SEQ ID NO: 753945 - protein, 17 aa, Mycobacterium
WRREPVPGIPEAANTVV

SEQ ID NO: 753946 - protein, 23 aa, Mycobacterium
WRRERPRELARVVLIELLAWQFA

SEQ ID NO: 753947 - protein, 21 aa, Mycobacterium
WRRGMRDASAAAAPWPTGVLD

SEQ ID NO: 753948 - protein, 17 aa, Mycobacterium
WRRGPLTALERLAGPDI

SEQ ID NO: 753949 - protein, 18 aa, Mycobacterium
WRRGRFVGFEGSYGYGRD

SEQ ID NO: 753950 - protein, 25 aa, Mycobacterium
WRRGTLPPGQLGWRKVTEIRDQAAL

SEQ ID NO: 753951 - protein, 25 aa, Mycobacterium
WRRGTLPPGQLGWRRAIALRDQCAL

SEQ ID NO: 753952 - protein, 24 aa, Mycobacterium
WRRGTLPPGQLGWRRVSELRERCA

SEQ ID NO: 753953 - protein, 25 aa, Mycobacterium
WRRGTLPPGQLGWRTATDIRDQAAL

SEQ ID NO: 753954 - protein, 19 aa, Mycobacterium
WRRGTPLSDAEMIFQGAHT

SEQ ID NO: 753955 - protein, 18 aa, Mycobacterium
WRRHGVRVADVLPGLIDT

SEQ ID NO: 753956 - protein, 23 aa, Mycobacterium
WRRHLEGLPGPTLLSAALGSAES

SEQ ID NO: 753957 - protein, 18 aa, Mycobacterium
WRRIAEGLRHSKTRDAEA

SEQ ID NO: 753958 - protein, 17 aa, Mycobacterium
WRRIAGVVAGLSDRDDV

SEQ ID NO: 753959 - protein, 20 aa, Mycobacterium
WRRIGLIDCGERWAVFNTGM

SEQ ID NO: 753960 - protein, 17 aa, Mycobacterium
WRRIGLMDCGERWAVFT

SEQ ID NO: 753961 - protein, 17 aa, Mycobacterium
WRRIGLMDCGERWGVFT

SEQ ID NO: 753962 - protein, 24 aa, Mycobacterium
WRRPADEVRFLMGFNRDVVKRRRH

SEQ ID NO: 753963 - protein, 19 aa, Mycobacterium
WRRPNRRAPGGVLLPTLRA

SEQ ID NO: 753964 - protein, 17 aa, Mycobacterium
WRRRKPHSWLRQVLPDP

SEQ ID NO: 753965 - protein, 21 aa, Mycobacterium
WRRRKPPSWLRQVLPDPQYAP

SEQ ID NO: 753966 - protein, 19 aa, Mycobacterium
WRRRKPYRWLRQILPDPKY

SEQ ID NO: 753967 - protein, 17 aa, Mycobacterium
WRRRKPYSWLRQVLPDP

SEQ ID NO: 753968 - protein, 19 aa, Mycobacterium
WRRRKPYSWLRQVLPDPQY

SEQ ID NO: 753969 - protein, 19 aa, Mycobacterium
WRRSSLRGNTFRGFVRDYL

SEQ ID NO: 753970 - protein, 25 aa, Mycobacterium
WRRWDWVSGCPAGWHTVDAHQRIIV

SEQ ID NO: 753971 - protein, 17 aa, Mycobacterium
WRRWEPAVRTLLSAMPI

SEQ ID NO: 753972 - protein, 21 aa, Mycobacterium
WRRWWPDLRLQVVEDRADKGI

SEQ ID NO: 753973 - protein, 23 aa, Mycobacterium
WRRWWPDLRLTVVEDRAEKGHRW

SEQ ID NO: 753974 - protein, 17 aa, Mycobacterium
WRRYHPNPPKGKAIMYG

SEQ ID NO: 753975 - protein, 17 aa, Mycobacterium
WRSALVDSLQEAFFVCD

SEQ ID NO: 753976 - protein, 23 aa, Mycobacterium
WRSATCRVLAAAMGSRTANAGPV

SEQ ID NO: 753977 - protein, 23 aa, Mycobacterium
WRSATCRVLVAATGSRAANAGPV

SEQ ID NO: 753978 - protein, 21 aa, Mycobacterium
WRSDLAAAFGREPDELFSVPI

SEQ ID NO: 753979 - protein, 19 aa, Mycobacterium
WRSFELYPPQVQVAGATAI

SEQ ID NO: 753980 - protein, 20 aa, Mycobacterium
WRSGAPLVLSPDVDDPELGA

SEQ ID NO: 753981 - protein, 17 aa, Mycobacterium
WRSGGGSPHITAPKPTM

SEQ ID NO: 753982 - protein, 31 aa, Mycobacterium
WRSGLPGGLRPGDFVGVLGFTSIDYVVHYLA

SEQ ID NO: 753983 - protein, 18 aa, Mycobacterium
WRSLARSLARRPAAEVKR

SEQ ID NO: 753984 - protein, 17 aa, Mycobacterium
WRSLGDMGYVDRDGYLY

SEQ ID NO: 753985 - protein, 19 aa, Mycobacterium
WRSLPVPDTDTFKWDPSSS

SEQ ID NO: 753986 - protein, 18 aa, Mycobacterium
WRSLVSLIGAESLKDKLG

SEQ ID NO: 753987 - protein, 17 aa, Mycobacterium
WRSPALPEFDPFWRDVE

SEQ ID NO: 753988 - protein, 18 aa, Mycobacterium
WRSPALPEFDPFWRDVEA

SEQ ID NO: 753989 - protein, 19 aa, Mycobacterium
WRSPVRRVLTADLGDEPAV

SEQ ID NO: 753990 - protein, 17 aa, Mycobacterium
WRSTELVVSQADERRRA

SEQ ID NO: 753991 - protein, 21 aa, Mycobacterium
WRSTPAPVRGALVARLGELIS

SEQ ID NO: 753992 - protein, 19 aa, Mycobacterium
WRSTPVGNTVSFTWTNTAL

SEQ ID NO: 753993 - protein, 17 aa, Mycobacterium
WRSVPSRAFPQRDMDAA

SEQ ID NO: 753994 - protein, 17 aa, Mycobacterium
WRSVTAQALARRDELAR

SEQ ID NO: 753995 - protein, 18 aa, Mycobacterium
WRSWRTGERLDFRGDHYQ

SEQ ID NO: 753996 - protein, 21 aa, Mycobacterium
WRTAKTIIRNSEFVIARMYRK

SEQ ID NO: 753997 - protein, 17 aa, Mycobacterium
WRTALGFAAPSVLESHL

SEQ ID NO: 753998 - protein, 18 aa, Mycobacterium
WRTALGFAAPSVLESHLG

SEQ ID NO: 753999 - protein, 20 aa, Mycobacterium
WRTDHLGAAAKTWGDQATQL

SEQ ID NO: 754000 - protein, 17 aa, Mycobacterium
WRTEIQIEQLLAEQGDG

SEQ ID NO: 754001 - protein, 20 aa, Mycobacterium
WRTEYLYSRAATIYGGTAEV

SEQ ID NO: 754002 - protein, 21 aa, Mycobacterium
WRTFAEPELAYVYYAEQLNVP

SEQ ID NO: 754003 - protein, 17 aa, Mycobacterium
WRTGERLDFRGDHYQHT

SEQ ID NO: 754004 - protein, 18 aa, Mycobacterium
WRTGIAPRFEELVEHARA

SEQ ID NO: 754005 - protein, 20 aa, Mycobacterium
WRTIAKLSLPDRFLSDTRDD

SEQ ID NO: 754006 - protein, 17 aa, Mycobacterium
WRTILARGNGSGPVGLI

SEQ ID NO: 754007 - protein, 19 aa, Mycobacterium
WRTMLDVNLTGVWHTCRAG

SEQ ID NO: 754008 - protein, 17 aa, Mycobacterium
WRTPPFDPVGDRAKAMA

SEQ ID NO: 754009 - protein, 18 aa, Mycobacterium
WRTRGAEILSRIADPDVR

SEQ ID NO: 754010 - protein, 26 aa, Mycobacterium
WRTRKYKGACIFLNRPGWPKGIGCAL

SEQ ID NO: 754011 - protein, 22 aa, Mycobacterium
WRTTPAPVRGALVARLAELLTE

SEQ ID NO: 754012 - protein, 22 aa, Mycobacterium
WRTTPAPVRGALVARLGQLLVE

SEQ ID NO: 754013 - protein, 21 aa, Mycobacterium
WRTTPAPVRGTLVARLGQLLV

SEQ ID NO: 754014 - protein, 22 aa, Mycobacterium
WRTTPGPIRGALVARLGELLVE

SEQ ID NO: 754015 - protein, 19 aa, Mycobacterium
WRTVGPFKDDLSGLEPADR

SEQ ID NO: 754016 - protein, 17 aa, Mycobacterium
WRTVVDLPEDPLLHTLI

SEQ ID NO: 754017 - protein, 20 aa, Mycobacterium
WRTYLLHARMLRAMALLADQ

SEQ ID NO: 754018 - protein, 27 aa, Mycobacterium
WRVAEAHGRYAPTYFYRYDYTTRALRR

SEQ ID NO: 754019 - protein, 18 aa, Mycobacterium
WRVAGHRGGMLAGGILSS

SEQ ID NO: 754020 - protein, 19 aa, Mycobacterium
WRVAGMGPTMLAGRHADIL

SEQ ID NO: 754021 - protein, 17 aa, Mycobacterium
WRVAQAHSRHSSVYFYR

SEQ ID NO: 754022 - protein, 19 aa, Mycobacterium
WRVATRPWQLTRVVPVATS

SEQ ID NO: 754023 - protein, 22 aa, Mycobacterium
WRVDDIRVAKVYGKDESSDGSL

SEQ ID NO: 754024 - protein, 20 aa, Mycobacterium
WRVEALVLLAFSAYARGDGP

SEQ ID NO: 754025 - protein, 17 aa, Mycobacterium
WRVGDDVAHTELGHGWV

SEQ ID NO: 754026 - protein, 17 aa, Mycobacterium
WRVGELDDLAPLLEGLT

SEQ ID NO: 754027 - protein, 20 aa, Mycobacterium
WRVGFSGFAPGFAYLIGGDP

SEQ ID NO: 754028 - protein, 22 aa, Mycobacterium
WRVGGDPECCPSGMGTVRFQIG

SEQ ID NO: 754029 - protein, 21 aa, Mycobacterium
WRVGKKLLAWERPLRPSEREA

SEQ ID NO: 754030 - protein, 21 aa, Mycobacterium
WRVIDAGGWPASRLDDAVKAA

SEQ ID NO: 754031 - protein, 21 aa, Mycobacterium
WRVLLEDLNIAWGQHHHGQPV

SEQ ID NO: 754032 - protein, 26 aa, Mycobacterium
WRVLMRRCPSRSFTIVGDLAQRRSPA

SEQ ID NO: 754033 - protein, 19 aa, Mycobacterium
WRVLSRLGDGFALAPRGLL

SEQ ID NO: 754034 - protein, 18 aa, Mycobacterium
WRVPLAGPDGRQVLLDDI

SEQ ID NO: 754035 - protein, 18 aa, Mycobacterium
WRVPLSGPDGRPLLLEEV

SEQ ID NO: 754036 - protein, 22 aa, Mycobacterium
WRVSTKSTGRWVRKQRKTYTAK

SEQ ID NO: 754037 - protein, 20 aa, Mycobacterium
WRVTGWFMIGWSAEYPVGEV

SEQ ID NO: 754038 - protein, 19 aa, Mycobacterium
WRVTLRLPENLRTTVEAAA

SEQ ID NO: 754039 - protein, 30 aa, Mycobacterium
WRVVALEPYGGAWLNSWLDRDLGISGRLSV

SEQ ID NO: 754040 - protein, 18 aa, Mycobacterium
WRWIAVGPTLQLWADSSR

SEQ ID NO: 754041 - protein, 19 aa, Mycobacterium
WRWLANTLTVEFLKELLPE

SEQ ID NO: 754042 - protein, 20 aa, Mycobacterium
WRWMAAAALVRSRADGGVVM

SEQ ID NO: 754043 - protein, 18 aa, Mycobacterium
WRWRVDRTSLHLYTDPGM

SEQ ID NO: 754044 - protein, 20 aa, Mycobacterium
WRWRVGAPSLDLFSEPDMQL

SEQ ID NO: 754045 - protein, 19 aa, Mycobacterium
WRWSDAVFERSDIDHLTGL

SEQ ID NO: 754046 - protein, 21 aa, Mycobacterium
WRWVADATAVMLFLDDAAAPR

SEQ ID NO: 754047 - protein, 28 aa, Mycobacterium
WRYDSIRKGEGFEGLWEDVPRLTTPTTL

SEQ ID NO: 754048 - protein, 18 aa, Mycobacterium
WRYIRAAVPAVWGYTRRE

SEQ ID NO: 754049 - protein, 19 aa, Mycobacterium
WRYRDPGVLLGERLGAVPK

SEQ ID NO: 754050 - protein, 20 aa, Mycobacterium
WRYVAEWLAVPVVWIPPATE

SEQ ID NO: 754051 - protein, 17 aa, Mycobacterium
WRYVRATVPAMLSNAGR

SEQ ID NO: 754052 - protein, 17 aa, Mycobacterium
WSAAFAVYNRTVGQVLL

SEQ ID NO: 754053 - protein, 18 aa, Mycobacterium
WSAAPVRHGISVVHSGER

SEQ ID NO: 754054 - protein, 17 aa, Mycobacterium
WSAAPVRHGVSVVRSGE

SEQ ID NO: 754055 - protein, 17 aa, Mycobacterium
WSAAPVRHGVSVVRTGQ

SEQ ID NO: 754056 - protein, 21 aa, Mycobacterium
WSAAYLPLFRVLRALAGEDRR

SEQ ID NO: 754057 - protein, 23 aa, Mycobacterium
WSAAYLPLFRVLRTLADEGRRGL

SEQ ID NO: 754058 - protein, 17 aa, Mycobacterium
WSADCRALADARGLKGV

SEQ ID NO: 754059 - protein, 19 aa, Mycobacterium
WSADGALMVAVDWQGEGLQ

SEQ ID NO: 754060 - protein, 25 aa, Mycobacterium
WSADRAADFLARWRRAAESTLAPPH

SEQ ID NO: 754061 - protein, 17 aa, Mycobacterium
WSAEGLLMYLPPDAQDR

SEQ ID NO: 754062 - protein, 21 aa, Mycobacterium
WSAGDAELFRDATWVVSVDDD

SEQ ID NO: 754063 - protein, 17 aa, Mycobacterium
WSAGLAGARRRATVLAT

SEQ ID NO: 754064 - protein, 17 aa, Mycobacterium
WSAGLLQGGRHVFIPSF

SEQ ID NO: 754065 - protein, 19 aa, Mycobacterium
WSALLRAALRTAARVTGPA

SEQ ID NO: 754066 - protein, 18 aa, Mycobacterium
WSALPAPTFASAVPYREP

SEQ ID NO: 754067 - protein, 18 aa, Mycobacterium
WSAPAAAVAESFRRIETH

SEQ ID NO: 754068 - protein, 27 aa, Mycobacterium
WSAPHLEFLVAVARSCCGHAASVVVRN

SEQ ID NO: 754069 - protein, 25 aa, Mycobacterium
WSAPHLEFLVAVARSCVGHATSVVV

SEQ ID NO: 754070 - protein, 21 aa, Mycobacterium
WSAPLRWAGVHAAILTNSPET

SEQ ID NO: 754071 - protein, 18 aa, Mycobacterium
WSARAAAHGLALTPAMVF

SEQ ID NO: 754072 - protein, 20 aa, Mycobacterium
WSASPGIRLAATALPSAGLD

SEQ ID NO: 754073 - protein, 21 aa, Mycobacterium
WSCPQAASVPVAFVTAYSALI

SEQ ID NO: 754074 - protein, 19 aa, Mycobacterium
WSDAATVNADRGWQADEAD

SEQ ID NO: 754075 - protein, 19 aa, Mycobacterium
WSDAERGNWPPGFPEGKRP

SEQ ID NO: 754076 - protein, 23 aa, Mycobacterium
WSDALRWSQRVIALADGDPTMGA

SEQ ID NO: 754077 - protein, 20 aa, Mycobacterium
WSDEFIRDFFKNFIRGPVKL

SEQ ID NO: 754078 - protein, 20 aa, Mycobacterium
WSDEFIRDFWKNFVRGPVKL

SEQ ID NO: 754079 - protein, 17 aa, Mycobacterium
WSDEVARMHGYEPGTVT

SEQ ID NO: 754080 - protein, 21 aa, Mycobacterium
WSDGKNFYALGGQDWEPGQSK

SEQ ID NO: 754081 - protein, 17 aa, Mycobacterium
WSDGLPRREADLVRLSD

SEQ ID NO: 754082 - protein, 23 aa, Mycobacterium
WSDGPPPDWHSFGRVLNKNGVVA

SEQ ID NO: 754083 - protein, 27 aa, Mycobacterium
WSDIDVSEWPGIDWPATQSMAEQVLAE

SEQ ID NO: 754084 - protein, 17 aa, Mycobacterium
WSDKLAAAPLRPGKGPI

SEQ ID NO: 754085 - protein, 17 aa, Mycobacterium
WSDLEVVDLPGLDWSTV

SEQ ID NO: 754086 - protein, 18 aa, Mycobacterium
WSDPARVLVEYAQQRAEW

SEQ ID NO: 754087 - protein, 20 aa, Mycobacterium
WSDPQVRWLLSTVPTSMIFD

SEQ ID NO: 754088 - protein, 17 aa, Mycobacterium
WSDVVKLLTPVVNDAGL

SEQ ID NO: 754089 - protein, 17 aa, Mycobacterium
WSEAGKLGFIGVNLPEE

SEQ ID NO: 754090 - protein, 21 aa, Mycobacterium
WSEDPFPLLRQVIANQQGYAY

SEQ ID NO: 754091 - protein, 20 aa, Mycobacterium
WSEFGVRLQAIGAHVQKFAG

SEQ ID NO: 754092 - protein, 20 aa, Mycobacterium
WSEFVEVHWSPWGEAYVTPV

SEQ ID NO: 754093 - protein, 18 aa, Mycobacterium
WSELIPLLESGRLDVDGI

SEQ ID NO: 754094 - protein, 17 aa, Mycobacterium
WSERSWQVRDFLARNGL

SEQ ID NO: 754095 - protein, 22 aa, Mycobacterium
WSERWRQRWSPPTPVALDTAES

SEQ ID NO: 754096 - protein, 25 aa, Mycobacterium
WSEWLPQQRWYAGRNRELSRAEVNV

SEQ ID NO: 754097 - protein, 25 aa, Mycobacterium
WSEWLPQQRWYAGRNRELSSAEPSV

SEQ ID NO: 754098 - protein, 17 aa, Mycobacterium
WSEWVCDPGRPVARGEK

SEQ ID NO: 754099 - protein, 24 aa, Mycobacterium
WSFAEAAGVPVVFLTALYGLSVLG

SEQ ID NO: 754100 - protein, 19 aa, Mycobacterium
WSFAFGWQALEAVADTARG

SEQ ID NO: 754101 - protein, 26 aa, Mycobacterium
WSFALALRLAAYELLRADESDPVLLL

SEQ ID NO: 754102 - protein, 26 aa, Mycobacterium
WSFAVALRLAAYELLRADGSEPVLLL

SEQ ID NO: 754103 - protein, 30 aa, Mycobacterium
WSFDLELEAAAPVWDLHGALGIDRLSWASF

SEQ ID NO: 754104 - protein, 25 aa, Mycobacterium
WSFDRFYAEAARRIHLLPMLRWKCV

SEQ ID NO: 754105 - protein, 20 aa, Mycobacterium
WSFLTWAKPGSDWERRYAEV

SEQ ID NO: 754106 - protein, 20 aa, Mycobacterium
WSFPRSCNPTGALISSVRDQ

SEQ ID NO: 754107 - protein, 20 aa, Mycobacterium
WSFSHGRDWGSPKIPEKMDL

SEQ ID NO: 754108 - protein, 20 aa, Mycobacterium
WSFSHGRDWGSPKIPEQMDL

SEQ ID NO: 754109 - protein, 17 aa, Mycobacterium
WSGAGVVASHATATEVA

SEQ ID NO: 754110 - protein, 18 aa, Mycobacterium
WSGASYLEGLAWTAGANG

SEQ ID NO: 754111 - protein, 20 aa, Mycobacterium
WSGGVLFADLLTAYRARHSR

SEQ ID NO: 754112 - protein, 27 aa, Mycobacterium
WSGHGGAGGRGGWLIGNGGTGGNGGLS

SEQ ID NO: 754113 - protein, 20 aa, Mycobacterium
WSGHWGREPNALIGVEVDPA

SEQ ID NO: 754114 - protein, 18 aa, Mycobacterium
WSGPGARAALSTMREYVE

SEQ ID NO: 754115 - protein, 30 aa, Mycobacterium
WSGRIAVNPVHRIAPDGAWQVFEDRTASHP

SEQ ID NO: 754116 - protein, 21 aa, Mycobacterium
WSGRPLLAIHEEWVLTRDLPQ

SEQ ID NO: 754117 - protein, 20 aa, Mycobacterium
WSGRVNPRLAEVAADLPAGR

SEQ ID NO: 754118 - protein, 26 aa, Mycobacterium
WSGSGLWVNLTCRKRFIGDKLGEALD

SEQ ID NO: 754119 - protein, 23 aa, Mycobacterium
WSGTALHRRARRIALPTYPFRQT

SEQ ID NO: 754120 - protein, 25 aa, Mycobacterium
WSGTNLEFLVAVARSCTGHATSVVV

SEQ ID NO: 754121 - protein, 18 aa, Mycobacterium
WSGWERKRQHVMTFVGDD

SEQ ID NO: 754122 - protein, 21 aa, Mycobacterium
WSHKRITAALDALVLHFDQDA

SEQ ID NO: 754123 - protein, 20 aa, Mycobacterium
WSIGRPQPELARLIDQGLVR

SEQ ID NO: 754124 - protein, 18 aa, Mycobacterium
WSIRRLTSLVGYGRARGM

SEQ ID NO: 754125 - protein, 17 aa, Mycobacterium
WSIVWAAGSGVVGSTAD

SEQ ID NO: 754126 - protein, 23 aa, Mycobacterium
WSKRTGARHVILFEGRDAAGKGG

SEQ ID NO: 754127 - protein, 24 aa, Mycobacterium
WSLAEAAGVPVVFLTALYGLSVLA

SEQ ID NO: 754128 - protein, 20 aa, Mycobacterium
WSLAGLRVGYALGAPDVLAR

SEQ ID NO: 754129 - protein, 17 aa, Mycobacterium
WSLCQIYSHQATVGAFA

SEQ ID NO: 754130 - protein, 22 aa, Mycobacterium
WSLDRIKSVKKAAGVTVNDVVL

SEQ ID NO: 754131 - protein, 25 aa, Mycobacterium
WSLLKWLDEPCSFYDWRRSEEDGPR

SEQ ID NO: 754132 - protein, 18 aa, Mycobacterium
WSLMVLLAAWLAMRFGEL

SEQ ID NO: 754133 - protein, 17 aa, Mycobacterium
WSLPDAHPVHVGEEAPV

SEQ ID NO: 754134 - protein, 17 aa, Mycobacterium
WSLPIVLQEIFAGYFRE

SEQ ID NO: 754135 - protein, 17 aa, Mycobacterium
WSLSPTVLGDDFDEGMQ

SEQ ID NO: 754136 - protein, 26 aa, Mycobacterium
WSMALSLRLAAYELLRADGSDPVLLL

SEQ ID NO: 754137 - protein, 25 aa, Mycobacterium
WSMAQAAGVPVVFLTAYYGLSVLAG

SEQ ID NO: 754138 - protein, 26 aa, Mycobacterium
WSMGAMKLILLMGLRADVDRFNNAAN

SEQ ID NO: 754139 - protein, 18 aa, Mycobacterium
WSMHPSLSMFLSRAETLI

SEQ ID NO: 754140 - protein, 17 aa, Mycobacterium
WSMLAVLVRNRGKLVGQ

SEQ ID NO: 754141 - protein, 18 aa, Mycobacterium
WSMLPLARNALRRIGNDT

SEQ ID NO: 754142 - protein, 19 aa, Mycobacterium
WSMVPRRAFGLERRLQLRL

SEQ ID NO: 754143 - protein, 17 aa, Mycobacterium
WSNAGLIAGDGASLLVD

SEQ ID NO: 754144 - protein, 17 aa, Mycobacterium
WSNRAALTEPVPAPVSI

SEQ ID NO: 754145 - protein, 20 aa, Mycobacterium
WSNSLHWAGVHAGILANSPG

SEQ ID NO: 754146 - protein, 17 aa, Mycobacterium
WSNYDELAHTAVEEIVR

SEQ ID NO: 754147 - protein, 21 aa, Mycobacterium
WSPDAMVWPLLGVIDESLDEP

SEQ ID NO: 754148 - protein, 21 aa, Mycobacterium
WSPECYRCEWLDGVSTAAPGA

SEQ ID NO: 754149 - protein, 19 aa, Mycobacterium
WSPEGWVTIGGRVVADQPL

SEQ ID NO: 754150 - protein, 26 aa, Mycobacterium
WSPETFIRQGLLRFCFTAAEDARTQI

SEQ ID NO: 754151 - protein, 24 aa, Mycobacterium
WSPKRLPDSLLHYMRTRGKNKVIF

SEQ ID NO: 754152 - protein, 24 aa, Mycobacterium
WSPKRLPEALLHYMRTRGKNKVIF

SEQ ID NO: 754153 - protein, 24 aa, Mycobacterium
WSPKRLPESLLHYMRTRGKGKVIF

SEQ ID NO: 754154 - protein, 24 aa, Mycobacterium
WSPKRLPESLLHYMRTRGKNKVIF

SEQ ID NO: 754155 - protein, 24 aa, Mycobacterium
WSPKRLPESLLHYMRTRGPDKIIF

SEQ ID NO: 754156 - protein, 23 aa, Mycobacterium
WSPKRLPESLLHYMRTRGPDKVI

SEQ ID NO: 754157 - protein, 17 aa, Mycobacterium
WSPKSGYPGHAAYRDFH

SEQ ID NO: 754158 - protein, 18 aa, Mycobacterium
WSPKSGYPGHAAYRDFHT

SEQ ID NO: 754159 - protein, 17 aa, Mycobacterium
WSPRMRPSIDVDSLEDR

SEQ ID NO: 754160 - protein, 17 aa, Mycobacterium
WSPVLACALAHGVLPDL

SEQ ID NO: 754161 - protein, 19 aa, Mycobacterium
WSQASGLDLARLGTTATTE

SEQ ID NO: 754162 - protein, 21 aa, Mycobacterium
WSQCHSLAFDFSVWEIFGALL

SEQ ID NO: 754163 - protein, 17 aa, Mycobacterium
WSQCLGVGSVDRNANFF

SEQ ID NO: 754164 - protein, 18 aa, Mycobacterium
WSQDTVPAGYSWIDANDS

SEQ ID NO: 754165 - protein, 20 aa, Mycobacterium
WSQGIPLAYTRDLAAYWANE

SEQ ID NO: 754166 - protein, 19 aa, Mycobacterium
WSQGIPLAYTRELADYWAN

SEQ ID NO: 754167 - protein, 19 aa, Mycobacterium
WSQGIPLAYVQELCHSWAH

SEQ ID NO: 754168 - protein, 19 aa, Mycobacterium
WSQGMPLAYTRELADYWAN

SEQ ID NO: 754169 - protein, 19 aa, Mycobacterium
WSQRGALMDRCLSVMLQAW

SEQ ID NO: 754170 - protein, 25 aa, Mycobacterium
WSQTSLWLTFSYKGECIESNLIDAF

SEQ ID NO: 754171 - protein, 26 aa, Mycobacterium
WSQVMRLRDLLKFEFYFADSAAYREH

SEQ ID NO: 754172 - protein, 17 aa, Mycobacterium
WSQVTGRHLSEIRRSCA

SEQ ID NO: 754173 - protein, 17 aa, Mycobacterium
WSQWNDRVRRLAGALTE

SEQ ID NO: 754174 - protein, 17 aa, Mycobacterium
WSREIRSAVAVALTSRF

SEQ ID NO: 754175 - protein, 17 aa, Mycobacterium
WSRERYSGGGMISHAPP

SEQ ID NO: 754176 - protein, 17 aa, Mycobacterium
WSRERYSGGGMLSHTPP

SEQ ID NO: 754177 - protein, 17 aa, Mycobacterium
WSRFDELAPTAVEEIVR

SEQ ID NO: 754178 - protein, 27 aa, Mycobacterium
WSRNTALRVRCVRQLRDAMREHVEDLR

SEQ ID NO: 754179 - protein, 20 aa, Mycobacterium
WSRPTWSIAELEAAKRGRTV

SEQ ID NO: 754180 - protein, 25 aa, Mycobacterium
WSRSPLRRDCFRVLLELPGGVAGTA

SEQ ID NO: 754181 - protein, 22 aa, Mycobacterium
WSRWWPDLRLEVVEDRGEAGQR

SEQ ID NO: 754182 - protein, 18 aa, Mycobacterium
WSSAPAGYTRRIVAGSSS

SEQ ID NO: 754183 - protein, 17 aa, Mycobacterium
WSSAPNFAFDLAARKTT

SEQ ID NO: 754184 - protein, 24 aa, Mycobacterium
WSSCQRQAMCLDVTPGQTSVEVCK

SEQ ID NO: 754185 - protein, 17 aa, Mycobacterium
WSSCSSRRSISSMRPPI

SEQ ID NO: 754186 - protein, 24 aa, Mycobacterium
WSSDIRAGAGLVLAGLVADGDTEV

SEQ ID NO: 754187 - protein, 25 aa, Mycobacterium
WSSDIRAGAGLVLAGLVADGETEVH

SEQ ID NO: 754188 - protein, 24 aa, Mycobacterium
WSSDIRAGAGLVLAGLVADGVTEV

SEQ ID NO: 754189 - protein, 29 aa, Mycobacterium
WSSGCDHATWCFAGGPVIKDGRPVDFGSF

SEQ ID NO: 754190 - protein, 25 aa, Mycobacterium
WSSHLCTRPSVVFATEPMDEDPRWS

SEQ ID NO: 754191 - protein, 18 aa, Mycobacterium
WSSKLVHGGLRYLATGNV

SEQ ID NO: 754192 - protein, 25 aa, Mycobacterium
WSSLDELRAPNALQRVSQDEDLEKV

SEQ ID NO: 754193 - protein, 17 aa, Mycobacterium
WSSPSGRRLDLPNRGNV

SEQ ID NO: 754194 - protein, 25 aa, Mycobacterium
WSSQPDLLAVFPFPHALSMAVTLAD

SEQ ID NO: 754195 - protein, 18 aa, Mycobacterium
WSSRTRRIVIRSDRHTTV

SEQ ID NO: 754196 - protein, 21 aa, Mycobacterium
WSSSELEPFFELAGKALNLRN

SEQ ID NO: 754197 - protein, 20 aa, Mycobacterium
WSSYADHRMATAGAIIGLRV

SEQ ID NO: 754198 - protein, 17 aa, Mycobacterium
WSTDIVEAVDVVVTMGC

SEQ ID NO: 754199 - protein, 17 aa, Mycobacterium
WSTDVDVALYLKDETTH

SEQ ID NO: 754200 - protein, 21 aa, Mycobacterium
WSTGLLPRIAPTARDEEGRAD

SEQ ID NO: 754201 - protein, 23 aa, Mycobacterium
WSTIKVPLAIAALRSDWLRAKDL

SEQ ID NO: 754202 - protein, 17 aa, Mycobacterium
WSTILARGATSGPVGLI

SEQ ID NO: 754203 - protein, 29 aa, Mycobacterium
WSTIPGGPFLSFGQAYAWGQNGQSAAAYL

SEQ ID NO: 754204 - protein, 17 aa, Mycobacterium
WSTKGYLTPGANGVSRD

SEQ ID NO: 754205 - protein, 23 aa, Mycobacterium
WSTPSERQRALLRLADLIEDNAE

SEQ ID NO: 754206 - protein, 26 aa, Mycobacterium
WSTQRRFLLNLPMFGREQFHPDVDKL

SEQ ID NO: 754207 - protein, 18 aa, Mycobacterium
WSTVDAYLRPAMGRRNLS

SEQ ID NO: 754208 - protein, 17 aa, Mycobacterium
WSTWLLEHHCARGVEDF

SEQ ID NO: 754209 - protein, 18 aa, Mycobacterium
WSVAFGVRAGGAATEQIA

SEQ ID NO: 754210 - protein, 17 aa, Mycobacterium
WSVCMRMTLSGFYSHPW

SEQ ID NO: 754211 - protein, 30 aa, Mycobacterium
WSVFTSARWHVCVWPDVPVLLVCDHQQGRA

SEQ ID NO: 754212 - protein, 17 aa, Mycobacterium
WSVGDQLIIEWRALTVA

SEQ ID NO: 754213 - protein, 19 aa, Mycobacterium
WSVGMSYLVVGPELLASAA

SEQ ID NO: 754214 - protein, 23 aa, Mycobacterium
WSVLPEAEHTFWVSDFADSSVPF

SEQ ID NO: 754215 - protein, 18 aa, Mycobacterium
WSVPELTLADGRRVTELL

SEQ ID NO: 754216 - protein, 17 aa, Mycobacterium
WSVPLGFLAQTPPTVTP

SEQ ID NO: 754217 - protein, 18 aa, Mycobacterium
WSVPLHWAGVHAGILTSS

SEQ ID NO: 754218 - protein, 24 aa, Mycobacterium
WSVTGCAPETMGIGPVSAAAAALE

SEQ ID NO: 754219 - protein, 17 aa, Mycobacterium
WSWAEVRDHFRAIETDH

SEQ ID NO: 754220 - protein, 17 aa, Mycobacterium
WSWDAPFSYTARRYAET

SEQ ID NO: 754221 - protein, 19 aa, Mycobacterium
WSWQPEPLEGQPLAKPFAW

SEQ ID NO: 754222 - protein, 17 aa, Mycobacterium
WSYARAGIHLDRTTYQQ

SEQ ID NO: 754223 - protein, 19 aa, Mycobacterium
WSYDHWRDVLYPPGTPSSA

SEQ ID NO: 754224 - protein, 19 aa, Mycobacterium
WSYKQWAPEVTKVLEAVEN

SEQ ID NO: 754225 - protein, 18 aa, Mycobacterium
WSYLPGDVTDPALYTALA

SEQ ID NO: 754226 - protein, 20 aa, Mycobacterium
WSYVDFGPWPGNRSPDGSER

SEQ ID NO: 754227 - protein, 19 aa, Mycobacterium
WTAAQAPEAAGYWPAAAVA

SEQ ID NO: 754228 - protein, 22 aa, Mycobacterium
WTAEGLFDYLPPVAQDLLLDNV

SEQ ID NO: 754229 - protein, 21 aa, Mycobacterium
WTAEWWDPRRGSVDAIVANAQ

SEQ ID NO: 754230 - protein, 17 aa, Mycobacterium
WTAGELAHEIGLGGRGP

SEQ ID NO: 754231 - protein, 18 aa, Mycobacterium
WTAGNSRFNPGMFRGLAG

SEQ ID NO: 754232 - protein, 25 aa, Mycobacterium
WTAGRPCLSIHAAIVFTSPNPRVRD

SEQ ID NO: 754233 - protein, 20 aa, Mycobacterium
WTALARIPDGLSFVEAAPMG

SEQ ID NO: 754234 - protein, 18 aa, Mycobacterium
WTALGSWAEVTSRAEIGL

SEQ ID NO: 754235 - protein, 17 aa, Mycobacterium
WTALNFPTNTVIASQTS

SEQ ID NO: 754236 - protein, 23 aa, Mycobacterium
WTALQLAYFTGYAMWTYTAEPFN

SEQ ID NO: 754237 - protein, 18 aa, Mycobacterium
WTARALIFVINLYRHMVS

SEQ ID NO: 754238 - protein, 17 aa, Mycobacterium
WTARRIGGEFVPGSEVD

SEQ ID NO: 754239 - protein, 28 aa, Mycobacterium
WTCVEPLKKWRLDVEPNNSGIEWELYYE

SEQ ID NO: 754240 - protein, 18 aa, Mycobacterium
WTDADTFDICRPRQAHIA

SEQ ID NO: 754241 - protein, 21 aa, Mycobacterium
WTDAGAPLWTFPRAAWERELL

SEQ ID NO: 754242 - protein, 18 aa, Mycobacterium
WTDDEWHRVLDLNLSSAW

SEQ ID NO: 754243 - protein, 27 aa, Mycobacterium
WTDDEWRQVLDLNLSSAWYLSRAAVKP

SEQ ID NO: 754244 - protein, 22 aa, Mycobacterium
WTDDIKKIFDWNVAEDGPAILA

SEQ ID NO: 754245 - protein, 19 aa, Mycobacterium
WTDDPRWLIYLQDTNGDEN

SEQ ID NO: 754246 - protein, 18 aa, Mycobacterium
WTDDVGGLGPVSWLNTTD

SEQ ID NO: 754247 - protein, 18 aa, Mycobacterium
WTDEEWHQVLDLNLSSAW

SEQ ID NO: 754248 - protein, 23 aa, Mycobacterium
WTDEGLPLGVQFVGRLGADGDLL

SEQ ID NO: 754249 - protein, 24 aa, Mycobacterium
WTDELAQLPALLAEKVKAPTVVPG

SEQ ID NO: 754250 - protein, 17 aa, Mycobacterium
WTDELAQLPSLLAEKVK

SEQ ID NO: 754251 - protein, 18 aa, Mycobacterium
WTDLPGQHRGPVGTPVPQ

SEQ ID NO: 754252 - protein, 24 aa, Mycobacterium
WTDPEMLRQWWGPEKTLVPECRVD

SEQ ID NO: 754253 - protein, 18 aa, Mycobacterium
WTDPETGVAFALVHNRLL

SEQ ID NO: 754254 - protein, 21 aa, Mycobacterium
WTDRGLPLGVQLVGRLGADGD

SEQ ID NO: 754255 - protein, 20 aa, Mycobacterium
WTDRVRVLAADSGRQRELSF

SEQ ID NO: 754256 - protein, 24 aa, Mycobacterium
WTDRWPELVAAFTAATRAEEGNLW

SEQ ID NO: 754257 - protein, 24 aa, Mycobacterium
WTDRWPELVASFTAATRAEEGNLW

SEQ ID NO: 754258 - protein, 17 aa, Mycobacterium
WTEARSQLLALPGVGPW

SEQ ID NO: 754259 - protein, 17 aa, Mycobacterium
WTEGRLREAMDAAAGHT

SEQ ID NO: 754260 - protein, 19 aa, Mycobacterium
WTEKLPVLPVLQALFVGGK

SEQ ID NO: 754261 - protein, 18 aa, Mycobacterium
WTELPDFASVNWHEEGAA

SEQ ID NO: 754262 - protein, 22 aa, Mycobacterium
WTELPIAGGELHHFGWSACSSA

SEQ ID NO: 754263 - protein, 25 aa, Mycobacterium
WTELWGDALIRHDILAFTRRAAAQR

SEQ ID NO: 754264 - protein, 20 aa, Mycobacterium
WTENLTELRRYAGTVFSDES

SEQ ID NO: 754265 - protein, 21 aa, Mycobacterium
WTEQMVKTFGGFFPDPAAANT

SEQ ID NO: 754266 - protein, 20 aa, Mycobacterium
WTERIGGQLQRFVDFDDSPT

SEQ ID NO: 754267 - protein, 17 aa, Mycobacterium
WTEVALWGQGWPLGVDR

SEQ ID NO: 754268 - protein, 17 aa, Mycobacterium
WTEVYIPGAGWIGLDPT

SEQ ID NO: 754269 - protein, 29 aa, Mycobacterium
WTFEPGRIADGWGVQNCQPMSGMAGGSDR

SEQ ID NO: 754270 - protein, 20 aa, Mycobacterium
WTFGPTNAWDPLPADGGPTR

SEQ ID NO: 754271 - protein, 28 aa, Mycobacterium
WTFLGPRPANWWIRRRLHEVAVHRADAA

SEQ ID NO: 754272 - protein, 33 aa, Mycobacterium
WTFLGPRPASWWLRRWVHEVAVHRADAAIALKA

SEQ ID NO: 754273 - protein, 17 aa, Mycobacterium
WTFPRAAWDRELLPGAQ

SEQ ID NO: 754274 - protein, 17 aa, Mycobacterium
WTGAAPLASPLGSALGG

SEQ ID NO: 754275 - protein, 18 aa, Mycobacterium
WTGAQAETFAAMCESAGL

SEQ ID NO: 754276 - protein, 20 aa, Mycobacterium
WTGDLVKLLAADRAHAGPRV

SEQ ID NO: 754277 - protein, 24 aa, Mycobacterium
WTGKSGRLRWRWRGGCDARVVKSA

SEQ ID NO: 754278 - protein, 18 aa, Mycobacterium
WTGPVGVTYPGVIVRGEA

SEQ ID NO: 754279 - protein, 19 aa, Mycobacterium
WTGRLSAPVLEKLLDLPEP

SEQ ID NO: 754280 - protein, 32 aa, Mycobacterium
WTGRVVPWDQAWPGWDLTAVWEACDARARAEA

SEQ ID NO: 754281 - protein, 18 aa, Mycobacterium
WTGTRRTLDTAGRVEKFY

SEQ ID NO: 754282 - protein, 17 aa, Mycobacterium
WTHRNHRALGLDLRSPE

SEQ ID NO: 754283 - protein, 20 aa, Mycobacterium
WTHRSGRKSLLLGATADYVI

SEQ ID NO: 754284 - protein, 17 aa, Mycobacterium
WTHVRLSIYPDGGVARL

SEQ ID NO: 754285 - protein, 18 aa, Mycobacterium
WTIFDIPAVTGLFNSTSS

SEQ ID NO: 754286 - protein, 19 aa, Mycobacterium
WTIRWKPALNAFAITFADR

SEQ ID NO: 754287 - protein, 19 aa, Mycobacterium
WTISGSWHYMEYADQPQTA

SEQ ID NO: 754288 - protein, 28 aa, Mycobacterium
WTISRQLWWGHRIPIWYGPNGEQVCVGP

SEQ ID NO: 754289 - protein, 29 aa, Mycobacterium
WTITPDWRIDVGDTWIGRDPIEFAAQQQL

SEQ ID NO: 754290 - protein, 23 aa, Mycobacterium
WTKRSLNHWYRMFGPTFETSLGL

SEQ ID NO: 754291 - protein, 25 aa, Mycobacterium
WTKRSLNHWYRMMGPTFETSVGLEF

SEQ ID NO: 754292 - protein, 17 aa, Mycobacterium
WTLALLLQHPEHLDRLY

SEQ ID NO: 754293 - protein, 26 aa, Mycobacterium
WTLAMGHAMVRAGLTLSGPGAEQPWQ

SEQ ID NO: 754294 - protein, 25 aa, Mycobacterium
WTLAMGHSMVRAGLSLKKPGSSHAW

SEQ ID NO: 754295 - protein, 19 aa, Mycobacterium
WTLEDGLHALLEWIDKDCP

SEQ ID NO: 754296 - protein, 17 aa, Mycobacterium
WTLLKVPTLIACGDHDL

SEQ ID NO: 754297 - protein, 19 aa, Mycobacterium
WTLQMLLDLFEVEPAGENR

SEQ ID NO: 754298 - protein, 17 aa, Mycobacterium
WTLRWLLGRLGYRAYGW

SEQ ID NO: 754299 - protein, 19 aa, Mycobacterium
WTLSWDQWRKGSALNAGGN

SEQ ID NO: 754300 - protein, 18 aa, Mycobacterium
WTLTGLKSRIAVGRGGSP

SEQ ID NO: 754301 - protein, 23 aa, Mycobacterium
WTMQLPFGIGLPALVAVAASYDA

SEQ ID NO: 754302 - protein, 24 aa, Mycobacterium
WTMSAMVAFGYPLGRWDIAANRRP

SEQ ID NO: 754303 - protein, 22 aa, Mycobacterium
WTMTAEDRWLQFSSVSFDASLA

SEQ ID NO: 754304 - protein, 19 aa, Mycobacterium
WTNPDCRRAGTVHLGGTFA

SEQ ID NO: 754305 - protein, 17 aa, Mycobacterium
WTNPFNALLQWGPMIFA

SEQ ID NO: 754306 - protein, 24 aa, Mycobacterium
WTNSCGYFNGRFPAILPPGEVNTY

SEQ ID NO: 754307 - protein, 25 aa, Mycobacterium
WTNSYYDDMAWLALALERAQRLTGV

SEQ ID NO: 754308 - protein, 17 aa, Mycobacterium
WTNYQWHQLARTFLMYR

SEQ ID NO: 754309 - protein, 18 aa, Mycobacterium
WTPADWVDNSLQTWKRLC

SEQ ID NO: 754310 - protein, 20 aa, Mycobacterium
WTPAGLPLGVQFVGGLGSDG

SEQ ID NO: 754311 - protein, 20 aa, Mycobacterium
WTPATAPAWAKPVLAANPQL

SEQ ID NO: 754312 - protein, 23 aa, Mycobacterium
WTPEGFFGRMLAAIRPYRPSLSA

SEQ ID NO: 754313 - protein, 18 aa, Mycobacterium
WTPEGFFGRMLATIRPYR

SEQ ID NO: 754314 - protein, 22 aa, Mycobacterium
WTPEGFIGHLFATMKPYAPPPP

SEQ ID NO: 754315 - protein, 25 aa, Mycobacterium
WTPEYFCGKDVPILGWNSVTVPGAV

SEQ ID NO: 754316 - protein, 22 aa, Mycobacterium
WTPGEARFAVHAAMALVIDVGR

SEQ ID NO: 754317 - protein, 24 aa, Mycobacterium
WTPKPTEGFIARAAEHYVQRQQAG

SEQ ID NO: 754318 - protein, 23 aa, Mycobacterium
WTPQHGEPFLSNWTPVAAPQTIM

SEQ ID NO: 754319 - protein, 17 aa, Mycobacterium
WTPQWTDDQRAAGYAGW

SEQ ID NO: 754320 - protein, 17 aa, Mycobacterium
WTQCHSYAFDLSVFEMW

SEQ ID NO: 754321 - protein, 27 aa, Mycobacterium
WTQDSFFPWIWRRLRGLSSADGREPKR

SEQ ID NO: 754322 - protein, 20 aa, Mycobacterium
WTQFGVRLEAIGARIQQVAS

SEQ ID NO: 754323 - protein, 17 aa, Mycobacterium
WTQGRFPEFTTPDPSYH

SEQ ID NO: 754324 - protein, 23 aa, Mycobacterium
WTQHWRVASGLGVSAQDLLGVRD

SEQ ID NO: 754325 - protein, 19 aa, Mycobacterium
WTRDRPGLGAGEAAFEGFT

SEQ ID NO: 754326 - protein, 26 aa, Mycobacterium
WTRDTDGWFWLGRIAGPYFYDADEQA

SEQ ID NO: 754327 - protein, 28 aa, Mycobacterium
WTREANIRWGFDQEHRRPYGVEFLHNTW

SEQ ID NO: 754328 - protein, 19 aa, Mycobacterium
WTRGLPWVDKKIRESTQRR

SEQ ID NO: 754329 - protein, 29 aa, Mycobacterium
WTRGSRGPMAFNIPRSCSPTMPTTGSRVG

SEQ ID NO: 754330 - protein, 23 aa, Mycobacterium
WTRMSFAAAQANFFAAARHGIDA

SEQ ID NO: 754331 - protein, 17 aa, Mycobacterium
WTRRRVGGVAGARRISE

SEQ ID NO: 754332 - protein, 19 aa, Mycobacterium
WTRSRPGDRFIVAPQSDGG

SEQ ID NO: 754333 - protein, 24 aa, Mycobacterium
WTRVPFEVLERISTRITNEVPEVN

SEQ ID NO: 754334 - protein, 24 aa, Mycobacterium
WTRVPYEVLERISTRITNEVAEVN

SEQ ID NO: 754335 - protein, 24 aa, Mycobacterium
WTRVPYEVLERISTRITNEVREVN

SEQ ID NO: 754336 - protein, 28 aa, Mycobacterium
WTSAAHKARWGVCLARTDPDAPKHKGIT

SEQ ID NO: 754337 - protein, 28 aa, Mycobacterium
WTSAAHKARWGVCLARTDPEAPKHKGIT

SEQ ID NO: 754338 - protein, 25 aa, Mycobacterium
WTSGASDPRCKILIVMGRTNPEAAS

SEQ ID NO: 754339 - protein, 23 aa, Mycobacterium
WTSLALQSQWCFVVARTEPGSSR

SEQ ID NO: 754340 - protein, 19 aa, Mycobacterium
WTSLAVKSWMGEHGGSIVN

SEQ ID NO: 754341 - protein, 23 aa, Mycobacterium
WTSLIEYADYIWLAVRTNTEVKK

SEQ ID NO: 754342 - protein, 18 aa, Mycobacterium
WTSLYDMRFVEGPMPGKD

SEQ ID NO: 754343 - protein, 17 aa, Mycobacterium
WTSRDVWWAATQDPRSW

SEQ ID NO: 754344 - protein, 25 aa, Mycobacterium
WTSSPLRPWPGFTPMIYERYSTPFF

SEQ ID NO: 754345 - protein, 26 aa, Mycobacterium
WTSSPLRPWPGFTPMIYRQYSEPFFD

SEQ ID NO: 754346 - protein, 32 aa, Mycobacterium
WTTALVLARRGWRVVVAADRFGVDTVSTVAGA

SEQ ID NO: 754347 - protein, 19 aa, Mycobacterium
WTTAYRMLFTHAKITAGAR

SEQ ID NO: 754348 - protein, 26 aa, Mycobacterium
WTTEFVAWQLSRAWSEHRLSIRERAI

SEQ ID NO: 754349 - protein, 29 aa, Mycobacterium
WTTIPGGPFLSFGQAYAWGQNGQGAAAYL

SEQ ID NO: 754350 - protein, 18 aa, Mycobacterium
WTTLAGIGMVESHHGTYR

SEQ ID NO: 754351 - protein, 18 aa, Mycobacterium
WTTLSWVDANVWRRIVPK

SEQ ID NO: 754352 - protein, 20 aa, Mycobacterium
WTTLWWVRADGFAHILDTPD

SEQ ID NO: 754353 - protein, 17 aa, Mycobacterium
WTTNFSAISVYDPSTDT

SEQ ID NO: 754354 - protein, 17 aa, Mycobacterium
WTTPFTREGRPEKTFVA

SEQ ID NO: 754355 - protein, 24 aa, Mycobacterium
WTTQAHKSRWCTLYARTDPDAPKH

SEQ ID NO: 754356 - protein, 25 aa, Mycobacterium
WTTRAELRLAIVTWIERTYHRRRRQ

SEQ ID NO: 754357 - protein, 25 aa, Mycobacterium
WTTSPLRPWPGFTPMIYQQYSEPFF

SEQ ID NO: 754358 - protein, 18 aa, Mycobacterium
WTTSRLAKKYGKVYTINI

SEQ ID NO: 754359 - protein, 18 aa, Mycobacterium
WTTWHMIFWWSTALAHVR

SEQ ID NO: 754360 - protein, 20 aa, Mycobacterium
WTVKSALDLGVPVTGIAEAV

SEQ ID NO: 754361 - protein, 17 aa, Mycobacterium
WTVLSMDALVQRSSPVV

SEQ ID NO: 754362 - protein, 24 aa, Mycobacterium
WTVPMDLELTGPMAARLWVRLDGC

SEQ ID NO: 754363 - protein, 19 aa, Mycobacterium
WTWEQRGPGALAYARHDVT

SEQ ID NO: 754364 - protein, 19 aa, Mycobacterium
WTWREDMYAVAECLTPDSY

SEQ ID NO: 754365 - protein, 17 aa, Mycobacterium
WTYELAEPTSPYLVTLQ

SEQ ID NO: 754366 - protein, 18 aa, Mycobacterium
WTYRFLAAAHAWAVTEAA

SEQ ID NO: 754367 - protein, 19 aa, Mycobacterium
WTYSQAKPRDVIWNQNFGH

SEQ ID NO: 754368 - protein, 17 aa, Mycobacterium
WVAALGACVSEAEIKEH

SEQ ID NO: 754369 - protein, 19 aa, Mycobacterium
WVAAPDRLPPLGVVRHAPG

SEQ ID NO: 754370 - protein, 18 aa, Mycobacterium
WVAARGYKPNPIEPLRVM

SEQ ID NO: 754371 - protein, 19 aa, Mycobacterium
WVAEALWSSGVLTTATRVG

SEQ ID NO: 754372 - protein, 17 aa, Mycobacterium
WVAEDEVTNLPLHPGFA

SEQ ID NO: 754373 - protein, 24 aa, Mycobacterium
WVAEDWLTGVWAFIQGVKSHALVL

SEQ ID NO: 754374 - protein, 24 aa, Mycobacterium
WVAEHRPHLAASVVERGHEVAHHS

SEQ ID NO: 754375 - protein, 30 aa, Mycobacterium
WVAELRRRGVTWSRVGEALGITRQSAWERF

SEQ ID NO: 754376 - protein, 18 aa, Mycobacterium
WVAGGGRVDLFLDASRAM

SEQ ID NO: 754377 - protein, 19 aa, Mycobacterium
WVAKLAVDFRQEFKKDVVI

SEQ ID NO: 754378 - protein, 19 aa, Mycobacterium
WVAKLAVDFRQKFKKDVVI

SEQ ID NO: 754379 - protein, 22 aa, Mycobacterium
WVAREGRIPLGYFNDPDATRKT

SEQ ID NO: 754380 - protein, 26 aa, Mycobacterium
WVARIGTVVMSWRLRTRHGLPVHDIA

SEQ ID NO: 754381 - protein, 28 aa, Mycobacterium
WVARVGTVVMSWRLRTRHGLPVHDIAPM

SEQ ID NO: 754382 - protein, 22 aa, Mycobacterium
WVDADSGLGLGLDDVAPGTFNM

SEQ ID NO: 754383 - protein, 26 aa, Mycobacterium
WVDANVWRRIVPKGWFYNVMVTGVKP

SEQ ID NO: 754384 - protein, 28 aa, Mycobacterium
WVDGDADWAQWVCRIHAKPDRIPQLADA

SEQ ID NO: 754385 - protein, 24 aa, Mycobacterium
WVDGKPALLDCLEFDDKLRYVDCI

SEQ ID NO: 754386 - protein, 18 aa, Mycobacterium
WVDGLRDGHIEWMGAMAN

SEQ ID NO: 754387 - protein, 22 aa, Mycobacterium
WVDGPDRPALLAAVPEADALLV

SEQ ID NO: 754388 - protein, 17 aa, Mycobacterium
WVDHGTSVDLFLDHHRI

SEQ ID NO: 754389 - protein, 19 aa, Mycobacterium
WVDHVRKPVRFVDGVQLAE

SEQ ID NO: 754390 - protein, 17 aa, Mycobacterium
WVDIKRKPSDYVKDHIK

SEQ ID NO: 754391 - protein, 19 aa, Mycobacterium
WVDIRLVPDLSTLRRVPWE

SEQ ID NO: 754392 - protein, 20 aa, Mycobacterium
WVDNDWAGVVGDVLDHLERG

SEQ ID NO: 754393 - protein, 23 aa, Mycobacterium
WVDNLRHAVRFSAAVRAALDDGY

SEQ ID NO: 754394 - protein, 24 aa, Mycobacterium
WVDNLRHMVRFAAAVRAALEDGYR

SEQ ID NO: 754395 - protein, 24 aa, Mycobacterium
WVDNLRHTVRFAAAVQAALDDGYR

SEQ ID NO: 754396 - protein, 30 aa, Mycobacterium
WVDNTMDVWKRLCDPMAQQISSVWASSLPE

SEQ ID NO: 754397 - protein, 17 aa, Mycobacterium
WVDPEFRGRGLGTAGVA

SEQ ID NO: 754398 - protein, 19 aa, Mycobacterium
WVDPLAERWFVGRPELIGS

SEQ ID NO: 754399 - protein, 20 aa, Mycobacterium
WVDRLDRMLATLVRDRDTIG

SEQ ID NO: 754400 - protein, 23 aa, Mycobacterium
WVDRRTRLIRAWTAPVLLLQGAH

SEQ ID NO: 754401 - protein, 17 aa, Mycobacterium
WVDRYRDGSAMIVRTHH

SEQ ID NO: 754402 - protein, 18 aa, Mycobacterium
WVDSLLVRRHAELHVCAA

SEQ ID NO: 754403 - protein, 23 aa, Mycobacterium
WVDVKGPVVATAISAYQTANGAM

SEQ ID NO: 754404 - protein, 20 aa, Mycobacterium
WVEAEVFRLAGERLRQQAAT

SEQ ID NO: 754405 - protein, 20 aa, Mycobacterium
WVEAEVLRLAGERLRQQATM

SEQ ID NO: 754406 - protein, 18 aa, Mycobacterium
WVEAGIPRVKMKVGSDPD

SEQ ID NO: 754407 - protein, 17 aa, Mycobacterium
WVEIKRKPSEYVKDHIK

SEQ ID NO: 754408 - protein, 18 aa, Mycobacterium
WVELNPHPLYLPSRGLPP

SEQ ID NO: 754409 - protein, 18 aa, Mycobacterium
WVELYTGPITWQLRDRAA

SEQ ID NO: 754410 - protein, 18 aa, Mycobacterium
WVEMFGADALRFTLARGA

SEQ ID NO: 754411 - protein, 26 aa, Mycobacterium
WVENLCAPVLFPAAIGRLFDAGHDTF

SEQ ID NO: 754412 - protein, 38 aa, Mycobacterium
WVEPTVLPAQWPVLLCNGAVGIAEGWATKVPAHNPREV

SEQ ID NO: 754413 - protein, 22 aa, Mycobacterium
WVERPHYMPLFVAPQPISEPVA

SEQ ID NO: 754414 - protein, 18 aa, Mycobacterium
WVEVASWTDDAITGFLVN

SEQ ID NO: 754415 - protein, 19 aa, Mycobacterium
WVEYALRAPVMLVRNKDGA

SEQ ID NO: 754416 - protein, 18 aa, Mycobacterium
WVFEETLIRCPIENSLTR

SEQ ID NO: 754417 - protein, 18 aa, Mycobacterium
WVGAFAMALPNTRVVRRS

SEQ ID NO: 754418 - protein, 19 aa, Mycobacterium
WVGAICVDYPGTLLDLRHH

SEQ ID NO: 754419 - protein, 25 aa, Mycobacterium
WVGASPRWLALDGYQHSRRRTVARR

SEQ ID NO: 754420 - protein, 20 aa, Mycobacterium
WVGELAVPIYRGCEVTGVAQ

SEQ ID NO: 754421 - protein, 19 aa, Mycobacterium
WVGGDGCIVRLVAIADPTG

SEQ ID NO: 754422 - protein, 20 aa, Mycobacterium
WVGGDGCIVRLVAIVDPTGG

SEQ ID NO: 754423 - protein, 18 aa, Mycobacterium
WVGGSPPAELVWVEPILE

SEQ ID NO: 754424 - protein, 17 aa, Mycobacterium
WVGINCLTGQHWLDACA

SEQ ID NO: 754425 - protein, 18 aa, Mycobacterium
WVGKYLKTVTYQEVRSAE

SEQ ID NO: 754426 - protein, 17 aa, Mycobacterium
WVGLPLAGVQTRLVDDH

SEQ ID NO: 754427 - protein, 18 aa, Mycobacterium
WVGNIAISFPYLDSEATR

SEQ ID NO: 754428 - protein, 17 aa, Mycobacterium
WVGPAIMRYGTPAQKTQ

SEQ ID NO: 754429 - protein, 17 aa, Mycobacterium
WVGPALMRYGTAEQKAK

SEQ ID NO: 754430 - protein, 18 aa, Mycobacterium
WVGPALMRYGTEEQKAKH

SEQ ID NO: 754431 - protein, 17 aa, Mycobacterium
WVGPSSMAMAAAAAPYV

SEQ ID NO: 754432 - protein, 24 aa, Mycobacterium
WVGQRAQLLLGVFDDGPQRRVAGN

SEQ ID NO: 754433 - protein, 17 aa, Mycobacterium
WVGRCPDCGTWGSVSET

SEQ ID NO: 754434 - protein, 22 aa, Mycobacterium
WVGRDIAIGAARVRALTATSRC

SEQ ID NO: 754435 - protein, 29 aa, Mycobacterium
WVGRRSEPKQAWFPIDRSMILYYCSLVED

SEQ ID NO: 754436 - protein, 17 aa, Mycobacterium
WVGSRPRLWRSVINELA

SEQ ID NO: 754437 - protein, 17 aa, Mycobacterium
WVGVSVTMPGKFAALAF

SEQ ID NO: 754438 - protein, 18 aa, Mycobacterium
WVGVSVTMPGKFAALRFA

SEQ ID NO: 754439 - protein, 19 aa, Mycobacterium
WVGYGGAPIAPSLVRTVKN

SEQ ID NO: 754440 - protein, 17 aa, Mycobacterium
WVHALLCGPDMPTVAVV

SEQ ID NO: 754441 - protein, 17 aa, Mycobacterium
WVHDVVWAPRKAPVTEP

SEQ ID NO: 754442 - protein, 17 aa, Mycobacterium
WVHDVVWAPRPVPVPVS

SEQ ID NO: 754443 - protein, 20 aa, Mycobacterium
WVHFPEGMGGLGVSRGLQAV

SEQ ID NO: 754444 - protein, 19 aa, Mycobacterium
WVHPERRGLGLGTAGTATL

SEQ ID NO: 754445 - protein, 18 aa, Mycobacterium
WVHPERRGLGRGTAGTAT

SEQ ID NO: 754446 - protein, 18 aa, Mycobacterium
WVHRKRPGSAAAQAAEAA

SEQ ID NO: 754447 - protein, 20 aa, Mycobacterium
WVHSELDYMPGTTGVHSSAL

SEQ ID NO: 754448 - protein, 23 aa, Mycobacterium
WVHTYGQRCWLRQLHPYATREQE

SEQ ID NO: 754449 - protein, 26 aa, Mycobacterium
WVIANKAYTPWYLVRYWRLLKFKLAN

SEQ ID NO: 754450 - protein, 19 aa, Mycobacterium
WVIANRAYTPWYLVRYWRL

SEQ ID NO: 754451 - protein, 20 aa, Mycobacterium
WVIDGAKTWSTSAFAADYGL

SEQ ID NO: 754452 - protein, 20 aa, Mycobacterium
WVIEGLRGGDALSVVLKAHH

SEQ ID NO: 754453 - protein, 25 aa, Mycobacterium
WVIEPDLSNALAFIAPALATGGTVR

SEQ ID NO: 754454 - protein, 24 aa, Mycobacterium
WVIESRFAGPVPAWSAVGTQLVDD

SEQ ID NO: 754455 - protein, 21 aa, Mycobacterium
WVIFEEEYFRAGAPGRASANG

SEQ ID NO: 754456 - protein, 20 aa, Mycobacterium
WVINGAKTWSTSAFAADYGL

SEQ ID NO: 754457 - protein, 25 aa, Mycobacterium
WVISEYRPGAAQSRVLTAANLVGEL

SEQ ID NO: 754458 - protein, 17 aa, Mycobacterium
WVKDNISAFGGDPDNVT

SEQ ID NO: 754459 - protein, 38 aa, Mycobacterium
WVLAMGHSMIRAGFGLDGWRPDIVHAHDWLVAHPAVAL

SEQ ID NO: 754460 - protein, 26 aa, Mycobacterium
WVLDELRELAGILGMARDAEVLAERY

SEQ ID NO: 754461 - protein, 20 aa, Mycobacterium
WVLDGAKTWSTSAFAADYGL

SEQ ID NO: 754462 - protein, 22 aa, Mycobacterium
WVLESRCGECGFDPAATSFDQI

SEQ ID NO: 754463 - protein, 18 aa, Mycobacterium
WVLFPNYFMTVRAGECHV

SEQ ID NO: 754464 - protein, 17 aa, Mycobacterium
WVLGPSMTYTCACYPDA

SEQ ID NO: 754465 - protein, 17 aa, Mycobacterium
WVLGPSMTYTCACYPTE

SEQ ID NO: 754466 - protein, 17 aa, Mycobacterium
WVLGPSMTYTCAVYPDA

SEQ ID NO: 754467 - protein, 18 aa, Mycobacterium
WVLGWANERKIAALRAEL

SEQ ID NO: 754468 - protein, 17 aa, Mycobacterium
WVLLKGLETLAVRVDYS

SEQ ID NO: 754469 - protein, 17 aa, Mycobacterium
WVLLKGLETLAVRVECS

SEQ ID NO: 754470 - protein, 18 aa, Mycobacterium
WVLLKGLETMAIRVEHSN

SEQ ID NO: 754471 - protein, 17 aa, Mycobacterium
WVLPGFVDIHTHYDAEV

SEQ ID NO: 754472 - protein, 19 aa, Mycobacterium
WVLQLRGILHTEALRQALV

SEQ ID NO: 754473 - protein, 19 aa, Mycobacterium
WVLRNRAYTPWYLVRYWRL

SEQ ID NO: 754474 - protein, 20 aa, Mycobacterium
WVLRRPPLGHLLASAHDVVR

SEQ ID NO: 754475 - protein, 20 aa, Mycobacterium
WVLTKGKLPTSEWIDIVTTA

SEQ ID NO: 754476 - protein, 19 aa, Mycobacterium
WVLTKGKLPTSLWIEIVST

SEQ ID NO: 754477 - protein, 20 aa, Mycobacterium
WVLTKGKLPTSMWIEIVTTA

SEQ ID NO: 754478 - protein, 19 aa, Mycobacterium
WVLTKGKLPTSMWIEVITT

SEQ ID NO: 754479 - protein, 19 aa, Mycobacterium
WVLTKGKLPTSMWIEVVTT

SEQ ID NO: 754480 - protein, 23 aa, Mycobacterium
WVMAKPSAPWARPGEVVDTSLGW

SEQ ID NO: 754481 - protein, 26 aa, Mycobacterium
WVMRSACTDFARWRALGIGKDAIMRI

SEQ ID NO: 754482 - protein, 28 aa, Mycobacterium
WVMSDWGGTPGWECALAGLDQECGAQID

SEQ ID NO: 754483 - protein, 28 aa, Mycobacterium
WVMSDWGGTPGWECALGGLDQECGAQID

SEQ ID NO: 754484 - protein, 18 aa, Mycobacterium
WVNEPIVAVQRWAEHHGK

SEQ ID NO: 754485 - protein, 18 aa, Mycobacterium
WVNGQAIAVDGGISGAVA

SEQ ID NO: 754486 - protein, 22 aa, Mycobacterium
WVNLPRKDKFAAPRYQSIEGQQ

SEQ ID NO: 754487 - protein, 24 aa, Mycobacterium
WVNMLRCTLAAFGAGVGGADSLLV

SEQ ID NO: 754488 - protein, 17 aa, Mycobacterium
WVNMLRTTVAAFAAGVG

SEQ ID NO: 754489 - protein, 17 aa, Mycobacterium
WVNPDCGLKTRKVDEVT

SEQ ID NO: 754490 - protein, 20 aa, Mycobacterium
WVNVVMPVRPHWSAGQARFA

SEQ ID NO: 754491 - protein, 27 aa, Mycobacterium
WVPAHFPKDAWALARFDGTPLYEHADP

SEQ ID NO: 754492 - protein, 27 aa, Mycobacterium
WVPAHFPKDAWALARFDGTPLYEHSDP

SEQ ID NO: 754493 - protein, 23 aa, Mycobacterium
WVPAHFPKDSWALGRFDGTALYE

SEQ ID NO: 754494 - protein, 26 aa, Mycobacterium
WVPEKNRLPLAVGLKAPLSCLNEARF

SEQ ID NO: 754495 - protein, 19 aa, Mycobacterium
WVPGFRLVDFTGQTIRTLP

SEQ ID NO: 754496 - protein, 19 aa, Mycobacterium
WVPGYRLVDFTGQTVRTLP

SEQ ID NO: 754497 - protein, 22 aa, Mycobacterium
WVPLPFGRQAIDEFGTPVPDVT

SEQ ID NO: 754498 - protein, 36 aa, Mycobacterium
WVPMGAGNYTFPLGMETGWWATAPTLIVDGGAVNVP

SEQ ID NO: 754499 - protein, 17 aa, Mycobacterium
WVPQQSDADAWKNGQRQ

SEQ ID NO: 754500 - protein, 24 aa, Mycobacterium
WVPRGPEHFELFHWSLVERDAPEE

SEQ ID NO: 754501 - protein, 26 aa, Mycobacterium
WVPSPGMGLSGIWLGAVVADASGQNY

SEQ ID NO: 754502 - protein, 23 aa, Mycobacterium
WVPYFPLGSSFPGFPKVADHPAV

SEQ ID NO: 754503 - protein, 20 aa, Mycobacterium
WVQDNVEAFGGDPTRVTVAG

SEQ ID NO: 754504 - protein, 26 aa, Mycobacterium
WVQKFYGAECLFDLGDLPGAADSDVG

SEQ ID NO: 754505 - protein, 20 aa, Mycobacterium
WVQRKRPGSAAAEAAEKAAG

SEQ ID NO: 754506 - protein, 17 aa, Mycobacterium
WVQRPGSRVAMMVAEMV

SEQ ID NO: 754507 - protein, 17 aa, Mycobacterium
WVRDLTTRRALLDALKQ

SEQ ID NO: 754508 - protein, 22 aa, Mycobacterium
WVREMTWNWDCLLPDGTIEYNP

SEQ ID NO: 754509 - protein, 27 aa, Mycobacterium
WVREPLDLRGKFPLKAGLVTSLGFGHV

SEQ ID NO: 754510 - protein, 25 aa, Mycobacterium
WVRESRLRHAGALADAVEKLDVVST

SEQ ID NO: 754511 - protein, 32 aa, Mycobacterium
WVRETLRLGEKFPLKAGMLTSLGFGHVSGLVA

SEQ ID NO: 754512 - protein, 17 aa, Mycobacterium
WVRFATTGDPGWAPGEV

SEQ ID NO: 754513 - protein, 19 aa, Mycobacterium
WVRINDVPEVLGARTYSAD

SEQ ID NO: 754514 - protein, 17 aa, Mycobacterium
WVRINGFGTPWWADDIA

SEQ ID NO: 754515 - protein, 23 aa, Mycobacterium
WVRLKGAEAMRQAWDNDGVDVLN

SEQ ID NO: 754516 - protein, 23 aa, Mycobacterium
WVRLKGAEAMRQAWQSDGVDVLN

SEQ ID NO: 754517 - protein, 24 aa, Mycobacterium
WVRLKGAEAMRQAWRNDGVDVLDP

SEQ ID NO: 754518 - protein, 19 aa, Mycobacterium
WVRNDMDEFIRLTSPVGTF

SEQ ID NO: 754519 - protein, 18 aa, Mycobacterium
WVRNGFYINAYVTADAFC

SEQ ID NO: 754520 - protein, 18 aa, Mycobacterium
WVRPVVVGRIEYREFVGG

SEQ ID NO: 754521 - protein, 17 aa, Mycobacterium
WVRSLGVDGDQVISVMD

SEQ ID NO: 754522 - protein, 26 aa, Mycobacterium
WVRTDEEYRWLAHALTVDALRELLPE

SEQ ID NO: 754523 - protein, 18 aa, Mycobacterium
WVRVNGFGTEWWAGDLEM

SEQ ID NO: 754524 - protein, 18 aa, Mycobacterium
WVRVNGFGTPWWADDLAA

SEQ ID NO: 754525 - protein, 19 aa, Mycobacterium
WVSAEDRLLVTVLIGHLSL

SEQ ID NO: 754526 - protein, 19 aa, Mycobacterium
WVSGEDRLLVTVLISHLSL

SEQ ID NO: 754527 - protein, 24 aa, Mycobacterium
WVSGQLKLPGTELVRVLTELLQPV

SEQ ID NO: 754528 - protein, 17 aa, Mycobacterium
WVSLGMRLGARSYSQYL

SEQ ID NO: 754529 - protein, 17 aa, Mycobacterium
WVSLRPTVFATNFAGMW

SEQ ID NO: 754530 - protein, 19 aa, Mycobacterium
WVSRLAVDFRQKFNKDVVI

SEQ ID NO: 754531 - protein, 20 aa, Mycobacterium
WVSVFGGPAWTRVTEPDGTP

SEQ ID NO: 754532 - protein, 19 aa, Mycobacterium
WVSYALRPAQIEFWQGSPD

SEQ ID NO: 754533 - protein, 18 aa, Mycobacterium
WVTAEDRLLVTVLVGHLS

SEQ ID NO: 754534 - protein, 20 aa, Mycobacterium
WVTARGDAVFGLPELALGLI

SEQ ID NO: 754535 - protein, 18 aa, Mycobacterium
WVTGWRPRDLRGGNYPQV

SEQ ID NO: 754536 - protein, 18 aa, Mycobacterium
WVTPGAKADEDAAVSDRD

SEQ ID NO: 754537 - protein, 19 aa, Mycobacterium
WVTPVKAFMRTAATDTVVR

SEQ ID NO: 754538 - protein, 20 aa, Mycobacterium
WVTPVKEFMRTASSDTVVRG

SEQ ID NO: 754539 - protein, 19 aa, Mycobacterium
WVTPVKEFMRTATADTEIR

SEQ ID NO: 754540 - protein, 19 aa, Mycobacterium
WVTPVKEFMRTAVADTAVR

SEQ ID NO: 754541 - protein, 18 aa, Mycobacterium
WVTQAWQPAPTVYRYAVS

SEQ ID NO: 754542 - protein, 18 aa, Mycobacterium
WVTSAGFADVYIVSTGSV

SEQ ID NO: 754543 - protein, 17 aa, Mycobacterium
WVTTDSVGHLQITHLTG

SEQ ID NO: 754544 - protein, 18 aa, Mycobacterium
WVVDDIRPAFIHANAVVF

SEQ ID NO: 754545 - protein, 18 aa, Mycobacterium
WVVGYSGGKDSTAVLQIV

SEQ ID NO: 754546 - protein, 18 aa, Mycobacterium
WVVGYSGGKDSTAVLQLV

SEQ ID NO: 754547 - protein, 18 aa, Mycobacterium
WVVPPDRLPPRGVVRQAP

SEQ ID NO: 754548 - protein, 17 aa, Mycobacterium
WVVPTLLQHGSKEQVDR

SEQ ID NO: 754549 - protein, 23 aa, Mycobacterium
WVVQHGKPPWAMQFADLPGPDSR

SEQ ID NO: 754550 - protein, 22 aa, Mycobacterium
WVVRVVLSLVYWPGEDEEAERR

SEQ ID NO: 754551 - protein, 17 aa, Mycobacterium
WVVSFTHDRDPGVTYFY

SEQ ID NO: 754552 - protein, 20 aa, Mycobacterium
WVVTRFAVRQQRRLGRRSNV

SEQ ID NO: 754553 - protein, 19 aa, Mycobacterium
WVVYGGAPIAPSLVRSVKD

SEQ ID NO: 754554 - protein, 19 aa, Mycobacterium
WVWLPAVLAGRVFTHRLCA

SEQ ID NO: 754555 - protein, 19 aa, Mycobacterium
WVYDLRTNQHFTLKQNPLR

SEQ ID NO: 754556 - protein, 22 aa, Mycobacterium
WVYDLRTNQHFTLKQNPLRRHH

SEQ ID NO: 754557 - protein, 18 aa, Mycobacterium
WWAAPTILEHGTPEQIAQ

SEQ ID NO: 754558 - protein, 18 aa, Mycobacterium
WWAAPTILEHGTPEQIAR

SEQ ID NO: 754559 - protein, 23 aa, Mycobacterium
WWAATQDPRAWAALPRAGAVIFA

SEQ ID NO: 754560 - protein, 18 aa, Mycobacterium
WWAPLRANHRVFRRNALV

SEQ ID NO: 754561 - protein, 18 aa, Mycobacterium
WWAVPTILEHGSPELIEQ

SEQ ID NO: 754562 - protein, 18 aa, Mycobacterium
WWAVPTILEHGSPEQIEQ

SEQ ID NO: 754563 - protein, 17 aa, Mycobacterium
WWCRMVVLSADRVARRG

SEQ ID NO: 754564 - protein, 17 aa, Mycobacterium
WWDEERGQWQIHTVGAD

SEQ ID NO: 754565 - protein, 17 aa, Mycobacterium
WWDGQSWTDQVSHQGQL

SEQ ID NO: 754566 - protein, 24 aa, Mycobacterium
WWDVAIRLLIKYANLRIMTSAWSP

SEQ ID NO: 754567 - protein, 25 aa, Mycobacterium
WWDVAIRLLLKYSNLRLMTSAWSPK

SEQ ID NO: 754568 - protein, 17 aa, Mycobacterium
WWDVLRHGRNSEYAGYF

SEQ ID NO: 754569 - protein, 22 aa, Mycobacterium
WWERAVAAWPEYAEYQTKTDRQ

SEQ ID NO: 754570 - protein, 17 aa, Mycobacterium
WWERPYVAAGIFLYDQL

SEQ ID NO: 754571 - protein, 17 aa, Mycobacterium
WWERPYVAAGIFLYDQM

SEQ ID NO: 754572 - protein, 20 aa, Mycobacterium
WWFDDDRIYGPSGISLPMSL

SEQ ID NO: 754573 - protein, 18 aa, Mycobacterium
WWHDGWDLLLTPTVASLP

SEQ ID NO: 754574 - protein, 21 aa, Mycobacterium
WWHPVRLAHQIAYLDILSNGR

SEQ ID NO: 754575 - protein, 18 aa, Mycobacterium
WWHSLKQLGATHCLLVPT

SEQ ID NO: 754576 - protein, 19 aa, Mycobacterium
WWHTARSLPVGAFTDDQAT

SEQ ID NO: 754577 - protein, 28 aa, Mycobacterium
WWIRSQLRSLLVADVRARLRQSWLERGA

SEQ ID NO: 754578 - protein, 20 aa, Mycobacterium
WWIRSQLRSLLVDDVRRRLR

SEQ ID NO: 754579 - protein, 25 aa, Mycobacterium
WWITGAADPRCKILIVMGRTNPDGP

SEQ ID NO: 754580 - protein, 20 aa, Mycobacterium
WWKENGRGIWEMATGTGKTV

SEQ ID NO: 754581 - protein, 17 aa, Mycobacterium
WWLDVREPSKEVVAAHV

SEQ ID NO: 754582 - protein, 21 aa, Mycobacterium
WWLKQAFYFSLTAVNDAVKDH

SEQ ID NO: 754583 - protein, 20 aa, Mycobacterium
WWLQRRLLMCGMRVTSPAVD

SEQ ID NO: 754584 - protein, 17 aa, Mycobacterium
WWLTFSSAAALLGTPGQ

SEQ ID NO: 754585 - protein, 22 aa, Mycobacterium
WWLVGSARAMLALARQHALDRV

SEQ ID NO: 754586 - protein, 21 aa, Mycobacterium
WWNPIRLATQIAYLDIVSNGR

SEQ ID NO: 754587 - protein, 30 aa, Mycobacterium
WWPADYGHYGGLFIRMSWHAAGTYRIQDGR

SEQ ID NO: 754588 - protein, 17 aa, Mycobacterium
WWQAGHRSTEPGHALAL

SEQ ID NO: 754589 - protein, 21 aa, Mycobacterium
WWQAHLLDCLVDAQVRDPQPE

SEQ ID NO: 754590 - protein, 19 aa, Mycobacterium
WWSERGWEHRQRAGLAAPQ

SEQ ID NO: 754591 - protein, 24 aa, Mycobacterium
WWTEPPRLPSLYLHGRDDGCATPA

SEQ ID NO: 754592 - protein, 18 aa, Mycobacterium
WWTSSFVLAEGMPPSALA

SEQ ID NO: 754593 - protein, 19 aa, Mycobacterium
WWVEGEVDLDFHVRETAVV

SEQ ID NO: 754594 - protein, 27 aa, Mycobacterium
WWVFAELGRRLGYELGNLGDPDTSTDD

SEQ ID NO: 754595 - protein, 23 aa, Mycobacterium
WWVGSELMGTIFMREHNAICDRL

SEQ ID NO: 754596 - protein, 24 aa, Mycobacterium
WWVQRVGAVNTVFVAFPGIFGALA

SEQ ID NO: 754597 - protein, 19 aa, Mycobacterium
WWVYTCWREGLRRIDPAKI

SEQ ID NO: 754598 - protein, 20 aa, Mycobacterium
WWYDTRRIPAATVEQLARTL

SEQ ID NO: 754599 - protein, 20 aa, Mycobacterium
WWYEGPTWLERVLRALPEAG

SEQ ID NO: 754600 - protein, 20 aa, Mycobacterium
WWYFHELQGPYRGRRIEAVD

SEQ ID NO: 754601 - protein, 25 aa, Mycobacterium
WWYYAQPEYRDCLFVKVDDDDVFFE

SEQ ID NO: 754602 - protein, 19 aa, Mycobacterium
WWYYGRSFQGKQYGVQCRC

SEQ ID NO: 754603 - protein, 18 aa, Mycobacterium
WYAAPGIPHDGFLADALM

SEQ ID NO: 754604 - protein, 25 aa, Mycobacterium
WYAFDPCCPFGGYKNSGIGRENGPE

SEQ ID NO: 754605 - protein, 31 aa, Mycobacterium
WYAGGPALAAWRGLPPVGERSPEEWVGATVG

SEQ ID NO: 754606 - protein, 17 aa, Mycobacterium
WYAGRPLLVTANDYGLR

SEQ ID NO: 754607 - protein, 17 aa, Mycobacterium
WYAPIPAPGRANVAVGI

SEQ ID NO: 754608 - protein, 18 aa, Mycobacterium
WYCPECMEVTNSALCGHD

SEQ ID NO: 754609 - protein, 19 aa, Mycobacterium
WYCPECQEVTNSALCGHDS

SEQ ID NO: 754610 - protein, 18 aa, Mycobacterium
WYCRYGGELRRYRVEDAA

SEQ ID NO: 754611 - protein, 18 aa, Mycobacterium
WYDGSHVGHIFSRRVQQV

SEQ ID NO: 754612 - protein, 18 aa, Mycobacterium
WYDVLALDDHRIGIVVGD

SEQ ID NO: 754613 - protein, 18 aa, Mycobacterium
WYEDGAYLLGRPGQSMVI

SEQ ID NO: 754614 - protein, 19 aa, Mycobacterium
WYEGPTWLARVLRALPAAG

SEQ ID NO: 754615 - protein, 19 aa, Mycobacterium
WYEGPTWLERVLRALPEAG

SEQ ID NO: 754616 - protein, 19 aa, Mycobacterium
WYEGPTWLQRVLRALPAAG

SEQ ID NO: 754617 - protein, 21 aa, Mycobacterium
WYEGPTWLQRVLRAMPAAGVR

SEQ ID NO: 754618 - protein, 19 aa, Mycobacterium
WYEGPVWLERVLRALPAAG

SEQ ID NO: 754619 - protein, 23 aa, Mycobacterium
WYEHLGLCAKGEAEALLRSGATT

SEQ ID NO: 754620 - protein, 19 aa, Mycobacterium
WYEHLGLCPRGDAEHLLRS

SEQ ID NO: 754621 - protein, 19 aa, Mycobacterium
WYERAKKLAPKGTGAVLSF

SEQ ID NO: 754622 - protein, 18 aa, Mycobacterium
WYEVSNWARPGGECRHNL

SEQ ID NO: 754623 - protein, 20 aa, Mycobacterium
WYFRELGEVLLWRQSNKLVA

SEQ ID NO: 754624 - protein, 22 aa, Mycobacterium
WYFSHPQSQYFVIGRLAQDQVA

SEQ ID NO: 754625 - protein, 18 aa, Mycobacterium
WYFTSRTLQWDSVPSRHP

SEQ ID NO: 754626 - protein, 17 aa, Mycobacterium
WYGDCLPERDFPTLISL

SEQ ID NO: 754627 - protein, 17 aa, Mycobacterium
WYGLHELARISAGDKVL

SEQ ID NO: 754628 - protein, 28 aa, Mycobacterium
WYGPDELRFGYRTSILKGTSARVVLEVE

SEQ ID NO: 754629 - protein, 20 aa, Mycobacterium
WYGQRFPKPLARTREYVDIL

SEQ ID NO: 754630 - protein, 18 aa, Mycobacterium
WYGQSFPKPLARTREYID

SEQ ID NO: 754631 - protein, 18 aa, Mycobacterium
WYGTGSAFENWIGTDPDG

SEQ ID NO: 754632 - protein, 18 aa, Mycobacterium
WYGTGSAFEQWIAAGPQS

SEQ ID NO: 754633 - protein, 18 aa, Mycobacterium
WYGTGSAFEQWLAAGPES

SEQ ID NO: 754634 - protein, 18 aa, Mycobacterium
WYGTGTAFEQWIAAGPQS

SEQ ID NO: 754635 - protein, 20 aa, Mycobacterium
WYHTRDPKKGFVWKTTTNPN

SEQ ID NO: 754636 - protein, 19 aa, Mycobacterium
WYIREVDPTTLLLTGLTRD

SEQ ID NO: 754637 - protein, 19 aa, Mycobacterium
WYIRVVDPTVLLLTGLTRD

SEQ ID NO: 754638 - protein, 18 aa, Mycobacterium
WYLAEHLRQGIKDVEART

SEQ ID NO: 754639 - protein, 18 aa, Mycobacterium
WYLAWLAHEAEVAGVTAV

SEQ ID NO: 754640 - protein, 25 aa, Mycobacterium
WYLDEFGGWGKIKLFGAPTHELAEL

SEQ ID NO: 754641 - protein, 25 aa, Mycobacterium
WYLGKDGLPELFPWTPQTHRELLRQ

SEQ ID NO: 754642 - protein, 17 aa, Mycobacterium
WYLRALRADERMDDRPA

SEQ ID NO: 754643 - protein, 19 aa, Mycobacterium
WYLRQMLGAANFKAGRVLA

SEQ ID NO: 754644 - protein, 17 aa, Mycobacterium
WYLTDPTLQFSMAYYLQ

SEQ ID NO: 754645 - protein, 21 aa, Mycobacterium
WYLTDPTLRFTMAYYLQPEEL

SEQ ID NO: 754646 - protein, 21 aa, Mycobacterium
WYPAGPVRTGSVLTELGVDPS

SEQ ID NO: 754647 - protein, 19 aa, Mycobacterium
WYPLLRLPVNVTRSVAALA

SEQ ID NO: 754648 - protein, 22 aa, Mycobacterium
WYPLTPEPKYAVCEMSRSHHPD

SEQ ID NO: 754649 - protein, 17 aa, Mycobacterium
WYPRTPGSGDKLTIDPS

SEQ ID NO: 754650 - protein, 18 aa, Mycobacterium
WYQAQGWLVGANYIPASA

SEQ ID NO: 754651 - protein, 18 aa, Mycobacterium
WYQAQGWPVGANYITSNA

SEQ ID NO: 754652 - protein, 20 aa, Mycobacterium
WYQVPMSLPVIGPRLIADPK

SEQ ID NO: 754653 - protein, 25 aa, Mycobacterium
WYRAQELLELVGLPGRGDAYPAQLS

SEQ ID NO: 754654 - protein, 19 aa, Mycobacterium
WYRQLLPDRLHQIGEILPN

SEQ ID NO: 754655 - protein, 17 aa, Mycobacterium
WYRSHDRLHTGDQVSMA

SEQ ID NO: 754656 - protein, 17 aa, Mycobacterium
WYSLLGVDDSAQPGTYD

SEQ ID NO: 754657 - protein, 19 aa, Mycobacterium
WYSPLKRALESFVAHTQEH

SEQ ID NO: 754658 - protein, 19 aa, Mycobacterium
WYSPLKRSLEAFVADTQQH

SEQ ID NO: 754659 - protein, 19 aa, Mycobacterium
WYTNLRTTVRFDQAVARAA

SEQ ID NO: 754660 - protein, 17 aa, Mycobacterium
WYTRCITALRLTPVSTK

SEQ ID NO: 754661 - protein, 18 aa, Mycobacterium
WYTVKLCSESAELRLLGG

SEQ ID NO: 754662 - protein, 26 aa, Mycobacterium
WYTVLACFKLGIVIEGTLARACAGQA

SEQ ID NO: 754663 - protein, 18 aa, Mycobacterium
WYVGRVQGLLARVLTFPL

SEQ ID NO: 754664 - protein, 18 aa, Mycobacterium
WYYARTFEGKQYGVHCRC

SEQ ID NO: 754665 - protein, 17 aa, Mycobacterium
WYYPPTVITDITKNMPI

SEQ ID NO: 754666 - protein, 19 aa, Mycobacterium
WYYRQAWQTNLGLNVELAK

SEQ ID NO: 754667 - protein, 25 aa, Mycobacterium
YAAAAFGLRAHIVMPRETPNIKVQA

SEQ ID NO: 754668 - protein, 20 aa, Mycobacterium
YAAADRILGRLVKVTPSSKV

SEQ ID NO: 754669 - protein, 18 aa, Mycobacterium
YAAADRVLGRLVKVTPSS

SEQ ID NO: 754670 - protein, 26 aa, Mycobacterium
YAAAGRFGTVVAELTAGPWAGPTSAS

SEQ ID NO: 754671 - protein, 25 aa, Mycobacterium
YAAAGVFTRNRVKAAPVLWSQQVLS

SEQ ID NO: 754672 - protein, 19 aa, Mycobacterium
YAAAGWYVLPVRRVAGKAG

SEQ ID NO: 754673 - protein, 20 aa, Mycobacterium
YAAALGRAFQLTNFIRDIDE

SEQ ID NO: 754674 - protein, 20 aa, Mycobacterium
YAAAMTLSFLTRRHRDGHGE

SEQ ID NO: 754675 - protein, 20 aa, Mycobacterium
YAAANAFLDALAYRRCRDHL

SEQ ID NO: 754676 - protein, 25 aa, Mycobacterium
YAAARGSLYFGVPTVWLRVAGDESC

SEQ ID NO: 754677 - protein, 20 aa, Mycobacterium
YAAARVRAILRPPVTVSAAP

SEQ ID NO: 754678 - protein, 21 aa, Mycobacterium
YAAAVELGMPLGVHGAPGIHL

SEQ ID NO: 754679 - protein, 22 aa, Mycobacterium
YAACLPERFAEVMRVTADVLES

SEQ ID NO: 754680 - protein, 24 aa, Mycobacterium
YAACLPERFAEVMRVTREVLEAVA

SEQ ID NO: 754681 - protein, 19 aa, Mycobacterium
YAADCPHRAVAVEAIGGSD

SEQ ID NO: 754682 - protein, 25 aa, Mycobacterium
YAADHARNVLRPAAQRVGHPLRVAH

SEQ ID NO: 754683 - protein, 23 aa, Mycobacterium
YAADIDGVLRWARASRDRLGQLD

SEQ ID NO: 754684 - protein, 18 aa, Mycobacterium
YAADPVFGFSTGVLVDYV

SEQ ID NO: 754685 - protein, 18 aa, Mycobacterium
YAAFFVFWLGWPTSEVPG

SEQ ID NO: 754686 - protein, 25 aa, Mycobacterium
YAAFPLARLKRAMLIGIPESAIDVL

SEQ ID NO: 754687 - protein, 29 aa, Mycobacterium
YAAGDGWLAMEFIDGRPAISLAVRTDQLT

SEQ ID NO: 754688 - protein, 17 aa, Mycobacterium
YAAGLAVGFWKDADDLR

SEQ ID NO: 754689 - protein, 18 aa, Mycobacterium
YAAGLAVGFWRNTDELRE

SEQ ID NO: 754690 - protein, 18 aa, Mycobacterium
YAAGRWGSLDAQWDEIKA

SEQ ID NO: 754691 - protein, 25 aa, Mycobacterium
YAAGSGLQWVSLRPTVFASNFLGMW

SEQ ID NO: 754692 - protein, 26 aa, Mycobacterium
YAAGWRMVRALPEFAARNAFDAGAHY

SEQ ID NO: 754693 - protein, 17 aa, Mycobacterium
YAAHAYPRQVHFVDELP

SEQ ID NO: 754694 - protein, 18 aa, Mycobacterium
YAAHAYPRTVHFVTELPK

SEQ ID NO: 754695 - protein, 17 aa, Mycobacterium
YAAITLEVNTRRWAGVP

SEQ ID NO: 754696 - protein, 27 aa, Mycobacterium
YAAKAFLCGEIARWVDEEGLSLDVATG

SEQ ID NO: 754697 - protein, 26 aa, Mycobacterium
YAAKAFLCSEIARWIDEEGLSLDVCT

SEQ ID NO: 754698 - protein, 27 aa, Mycobacterium
YAAKAFLCSEIARWVDEEGLSLDVATG

SEQ ID NO: 754699 - protein, 27 aa, Mycobacterium
YAAKAFLCSEIARWVEEEGLSLDVATG

SEQ ID NO: 754700 - protein, 27 aa, Mycobacterium
YAAKAFLCSEIARWVNEEGLSIDVSTG

SEQ ID NO: 754701 - protein, 25 aa, Mycobacterium
YAALEFWSALHGFVLLEMTGVMDEI

SEQ ID NO: 754702 - protein, 25 aa, Mycobacterium
YAALEFWSAMHGFVLLEMTGVMNGI

SEQ ID NO: 754703 - protein, 29 aa, Mycobacterium
YAALFDRFGYRLVCCNSHSGSDAFFVDAA

SEQ ID NO: 754704 - protein, 17 aa, Mycobacterium
YAALGIRAPDGSLVSFV

SEQ ID NO: 754705 - protein, 21 aa, Mycobacterium
YAALLERIDPLGLAYLHVVID

SEQ ID NO: 754706 - protein, 19 aa, Mycobacterium
YAALMAGADLVLPDRHLDA

SEQ ID NO: 754707 - protein, 19 aa, Mycobacterium
YAALMAGADLVLPDRHLDP

SEQ ID NO: 754708 - protein, 18 aa, Mycobacterium
YAALMAGAGLVMPDRFLD

SEQ ID NO: 754709 - protein, 19 aa, Mycobacterium
YAALQAHRDGPVLLGHTLD

SEQ ID NO: 754710 - protein, 18 aa, Mycobacterium
YAALSAYHGGPVLLGHTL

SEQ ID NO: 754711 - protein, 26 aa, Mycobacterium
YAAPWKSRTAYQWACEVSVYVDGARR

SEQ ID NO: 754712 - protein, 27 aa, Mycobacterium
YAARAAWWLREVYDLPLAEIATVLRTT

SEQ ID NO: 754713 - protein, 21 aa, Mycobacterium
YAARGFPGIDACFVGNSHAGP

SEQ ID NO: 754714 - protein, 25 aa, Mycobacterium
YAARHLPRWMYVPDAALPALLDEGT

SEQ ID NO: 754715 - protein, 17 aa, Mycobacterium
YAARPLLDLPWDIADSP

SEQ ID NO: 754716 - protein, 17 aa, Mycobacterium
YAASAWIGSATVLAQAL

SEQ ID NO: 754717 - protein, 22 aa, Mycobacterium
YAATGKPGWFLFDGLVKHDLFT

SEQ ID NO: 754718 - protein, 22 aa, Mycobacterium
YAATGKPGWFLFDGLVKHDLLT

SEQ ID NO: 754719 - protein, 22 aa, Mycobacterium
YAATGKPGWFLFDGLVKHDLRT

SEQ ID NO: 754720 - protein, 20 aa, Mycobacterium
YAATGMGARHIVLRKVDGDE

SEQ ID NO: 754721 - protein, 28 aa, Mycobacterium
YAATTRFGRPVAHGMLVAGYVQTALTKL

SEQ ID NO: 754722 - protein, 17 aa, Mycobacterium
YAATVWPLRRRMLHRRA

SEQ ID NO: 754723 - protein, 19 aa, Mycobacterium
YAAVGFEYGYTVGNPDAVV

SEQ ID NO: 754724 - protein, 34 aa, Mycobacterium
YAAVTGLRYGNTVPLTYPFALTFPSVMSLVTGFD

SEQ ID NO: 754725 - protein, 30 aa, Mycobacterium
YAAYLGWAVRLARPGALIVADNVIREGQVL

SEQ ID NO: 754726 - protein, 18 aa, Mycobacterium
YADAATFLLSNGYVNGEV

SEQ ID NO: 754727 - protein, 19 aa, Mycobacterium
YADALGLGAVRPVTVADAG

SEQ ID NO: 754728 - protein, 18 aa, Mycobacterium
YADARALAYREFGSDQLA

SEQ ID NO: 754729 - protein, 17 aa, Mycobacterium
YADEGNCCIGTPEDAIE

SEQ ID NO: 754730 - protein, 25 aa, Mycobacterium
YADEPRLHAALAHLRAHAPVSLVDC

SEQ ID NO: 754731 - protein, 18 aa, Mycobacterium
YADGAITAREWIAARDPI

SEQ ID NO: 754732 - protein, 27 aa, Mycobacterium
YADGKRTRLWPGLRETFKSGSADIPLQ

SEQ ID NO: 754733 - protein, 21 aa, Mycobacterium
YADGRLSKRFVKIEHYVEFDG

SEQ ID NO: 754734 - protein, 23 aa, Mycobacterium
YADGYRGAARIVVDEDHRYLLGV

SEQ ID NO: 754735 - protein, 22 aa, Mycobacterium
YADIMLPATLWAEADAVMVNSG

SEQ ID NO: 754736 - protein, 20 aa, Mycobacterium
YADIVLPAALWAESEGVMVN

SEQ ID NO: 754737 - protein, 18 aa, Mycobacterium
YADLRPSNEIPDWEADLA

SEQ ID NO: 754738 - protein, 26 aa, Mycobacterium
YADLVAKLAPLPCRVAVDTSDAPLAA

SEQ ID NO: 754739 - protein, 18 aa, Mycobacterium
YADPAWAAENGWPAFGDA

SEQ ID NO: 754740 - protein, 18 aa, Mycobacterium
YADQWLLTRQVAGRPLKD

SEQ ID NO: 754741 - protein, 19 aa, Mycobacterium
YADQWNHLVRFTFAKRDVV

SEQ ID NO: 754742 - protein, 17 aa, Mycobacterium
YADRKAVTLGFEPEPGM

SEQ ID NO: 754743 - protein, 17 aa, Mycobacterium
YADRPALGWRARSSVTD

SEQ ID NO: 754744 - protein, 23 aa, Mycobacterium
YADRSGGVLPGYGGSKAALEHLT

SEQ ID NO: 754745 - protein, 32 aa, Mycobacterium
YADTHGGVKYCYNSSLAHCRIQVAGKAFERSE

SEQ ID NO: 754746 - protein, 20 aa, Mycobacterium
YADVARVMGLRCITVDDPEQ

SEQ ID NO: 754747 - protein, 26 aa, Mycobacterium
YADVEFAGAVAHRLNEAGGRDAVDSL

SEQ ID NO: 754748 - protein, 17 aa, Mycobacterium
YADVFKGDERWRGLPTP

SEQ ID NO: 754749 - protein, 26 aa, Mycobacterium
YADYCRQRVLLLQAWVRQVSSIVGKT

SEQ ID NO: 754750 - protein, 26 aa, Mycobacterium
YADYRRYRWDLALRRDYQRAAFEAGW

SEQ ID NO: 754751 - protein, 21 aa, Mycobacterium
YAEAYAEWRTLGDVLTPVSHR

SEQ ID NO: 754752 - protein, 18 aa, Mycobacterium
YAEEIAHIIGCEPSDVLR

SEQ ID NO: 754753 - protein, 28 aa, Mycobacterium
YAEEVSWKLSWPAGDHMGVVPWIQQRST

SEQ ID NO: 754754 - protein, 27 aa, Mycobacterium
YAEGGPWDSVWVYDHFHTVPVPTDEAT

SEQ ID NO: 754755 - protein, 19 aa, Mycobacterium
YAEGMDVRRTYDFMGDNAR

SEQ ID NO: 754756 - protein, 22 aa, Mycobacterium
YAEGMFPPMHLDAEIGDDGTVR

SEQ ID NO: 754757 - protein, 24 aa, Mycobacterium
YAEGPCVEAAWRHHVMHVEDLAVE

SEQ ID NO: 754758 - protein, 18 aa, Mycobacterium
YAEIMMLWVKPQHRRLLR

SEQ ID NO: 754759 - protein, 21 aa, Mycobacterium
YAEIPKGGTVTVLGLGPIGDM

SEQ ID NO: 754760 - protein, 24 aa, Mycobacterium
YAEIRSVDELDEFARGIAGPVVVK

SEQ ID NO: 754761 - protein, 18 aa, Mycobacterium
YAELIKRTQWWGRQMLIW

SEQ ID NO: 754762 - protein, 20 aa, Mycobacterium
YAELLARLEAKFADQPNAVL

SEQ ID NO: 754763 - protein, 17 aa, Mycobacterium
YAELYGWNTYYPEALLK

SEQ ID NO: 754764 - protein, 19 aa, Mycobacterium
YAEMLARAKEHSFAFPAIN

SEQ ID NO: 754765 - protein, 22 aa, Mycobacterium
YAEPGQVLGLTFTRKAAGQLLR

SEQ ID NO: 754766 - protein, 18 aa, Mycobacterium
YAEPGWASETGWPQFADR

SEQ ID NO: 754767 - protein, 18 aa, Mycobacterium
YAERHGWNVTVLDETTSD

SEQ ID NO: 754768 - protein, 18 aa, Mycobacterium
YAERHGWTVTLLDETTSD

SEQ ID NO: 754769 - protein, 18 aa, Mycobacterium
YAERHGWTVTMLGETTSD

SEQ ID NO: 754770 - protein, 18 aa, Mycobacterium
YAERHGWTVTVLDETTSD

SEQ ID NO: 754771 - protein, 18 aa, Mycobacterium
YAERHGWTVTVLGETTSD

SEQ ID NO: 754772 - protein, 17 aa, Mycobacterium
YAESYGEQIAVYVSPEH

SEQ ID NO: 754773 - protein, 18 aa, Mycobacterium
YAEVRFAPELHIDGGLSL

SEQ ID NO: 754774 - protein, 20 aa, Mycobacterium
YAEVSMLGFVLMTDALGGVN

SEQ ID NO: 754775 - protein, 19 aa, Mycobacterium
YAEYPRFHTLMAEQSGEVF

SEQ ID NO: 754776 - protein, 19 aa, Mycobacterium
YAFAVLRLAAQRNGDPPPR

SEQ ID NO: 754777 - protein, 24 aa, Mycobacterium
YAFDFSVWEIWSALLHGGRLVVVG

SEQ ID NO: 754778 - protein, 19 aa, Mycobacterium
YAFECPLLLGTTAVLLDRW

SEQ ID NO: 754779 - protein, 20 aa, Mycobacterium
YAFECPLLLGTTAVLMQRWN

SEQ ID NO: 754780 - protein, 22 aa, Mycobacterium
YAFEKRRFWLSGEGVSVDASGL

SEQ ID NO: 754781 - protein, 17 aa, Mycobacterium
YAFGVLRLAAQRNGSPP

SEQ ID NO: 754782 - protein, 17 aa, Mycobacterium
YAFQRRRFWLDGTSRAG

SEQ ID NO: 754783 - protein, 17 aa, Mycobacterium
YAFSLMLTFLKGRLQVV

SEQ ID NO: 754784 - protein, 18 aa, Mycobacterium
YAGAALARAACDEYSTPD

SEQ ID NO: 754785 - protein, 17 aa, Mycobacterium
YAGADAHDTYAIGERAE

SEQ ID NO: 754786 - protein, 20 aa, Mycobacterium
YAGADRILGRLIKVTPSSKV

SEQ ID NO: 754787 - protein, 20 aa, Mycobacterium
YAGADRVLGRLIKVTPSSKV

SEQ ID NO: 754788 - protein, 21 aa, Mycobacterium
YAGAFPAWLAPVQAVGIPVAD

SEQ ID NO: 754789 - protein, 22 aa, Mycobacterium
YAGAFPAWLAPVQVVGIPVADA

SEQ ID NO: 754790 - protein, 22 aa, Mycobacterium
YAGAFPAWLAPVQVVGIPVADD

SEQ ID NO: 754791 - protein, 22 aa, Mycobacterium
YAGAFPAWLSPVQAVGIPIADA

SEQ ID NO: 754792 - protein, 19 aa, Mycobacterium
YAGALGPRGLFACSAALRP

SEQ ID NO: 754793 - protein, 17 aa, Mycobacterium
YAGALGVRGLFACRQAL

SEQ ID NO: 754794 - protein, 19 aa, Mycobacterium
YAGCLPERFEEVVRVTTDV

SEQ ID NO: 754795 - protein, 25 aa, Mycobacterium
YAGDISPLEAWKLLSDNPNAVLVDV

SEQ ID NO: 754796 - protein, 21 aa, Mycobacterium
YAGEAWIHVQLLPSVDSKGLT

SEQ ID NO: 754797 - protein, 18 aa, Mycobacterium
YAGFAARIREAFAAIVPP

SEQ ID NO: 754798 - protein, 23 aa, Mycobacterium
YAGGEILRLLLAHPAYTAGRLRI

SEQ ID NO: 754799 - protein, 21 aa, Mycobacterium
YAGGEILRLLLGHPAYADGRL

SEQ ID NO: 754800 - protein, 21 aa, Mycobacterium
YAGGEILRLLLGHPAYAQGRL

SEQ ID NO: 754801 - protein, 24 aa, Mycobacterium
YAGGIRAGHQLKFWTPGGSSTPLL

SEQ ID NO: 754802 - protein, 20 aa, Mycobacterium
YAGGWLFDRAMAGWDVTVLV

SEQ ID NO: 754803 - protein, 20 aa, Mycobacterium
YAGGWLVDRVMAGWDVTVLI

SEQ ID NO: 754804 - protein, 17 aa, Mycobacterium
YAGHFDFGGARRPIAEF

SEQ ID NO: 754805 - protein, 19 aa, Mycobacterium
YAGHQFGGFQPRLGDGRAL

SEQ ID NO: 754806 - protein, 21 aa, Mycobacterium
YAGKYELFRGAVLALSQQLVD

SEQ ID NO: 754807 - protein, 18 aa, Mycobacterium
YAGLLAIRQYHIDRGDSG

SEQ ID NO: 754808 - protein, 23 aa, Mycobacterium
YAGLLEHLASWGIVAGAPDTERG

SEQ ID NO: 754809 - protein, 21 aa, Mycobacterium
YAGLLKAYPLVSLEDPLYEND

SEQ ID NO: 754810 - protein, 18 aa, Mycobacterium
YAGLTTDTGSFRWATARA

SEQ ID NO: 754811 - protein, 24 aa, Mycobacterium
YAGMARLAVIAAKMITGRKIHRRP

SEQ ID NO: 754812 - protein, 24 aa, Mycobacterium
YAGMGAGLYRHHPVFTTAIDEICA

SEQ ID NO: 754813 - protein, 17 aa, Mycobacterium
YAGPRVLATRSRIYPNT

SEQ ID NO: 754814 - protein, 18 aa, Mycobacterium
YAGQADWLIVTADGAVVV

SEQ ID NO: 754815 - protein, 17 aa, Mycobacterium
YAGRGAVRVAVQDREGR

SEQ ID NO: 754816 - protein, 17 aa, Mycobacterium
YAGRGSVRVGVADREGR

SEQ ID NO: 754817 - protein, 18 aa, Mycobacterium
YAGSGGKVILAFTDHLPN

SEQ ID NO: 754818 - protein, 18 aa, Mycobacterium
YAGTLARWSTQRRFLLNL

SEQ ID NO: 754819 - protein, 22 aa, Mycobacterium
YAGVALRLADWSSVQTRSRISV

SEQ ID NO: 754820 - protein, 18 aa, Mycobacterium
YAGVALRVADWSPVQTRS

SEQ ID NO: 754821 - protein, 29 aa, Mycobacterium
YAGVPIAFTRPVWRVDLFGSTESPPGTLD

SEQ ID NO: 754822 - protein, 17 aa, Mycobacterium
YAGVTMEGIAKAAGVAK

SEQ ID NO: 754823 - protein, 20 aa, Mycobacterium
YAHAALAARGEWVTNEKGLL

SEQ ID NO: 754824 - protein, 25 aa, Mycobacterium
YAHAIALFLRWCARTGRSWQAGVEQ

SEQ ID NO: 754825 - protein, 20 aa, Mycobacterium
YAHALAGAGFLVERHLGIGN

SEQ ID NO: 754826 - protein, 18 aa, Mycobacterium
YAHARLCALARNAADLGL

SEQ ID NO: 754827 - protein, 25 aa, Mycobacterium
YAHPERIGTLIGWQSTMHAAGVSVR

SEQ ID NO: 754828 - protein, 24 aa, Mycobacterium
YAHRVASLMGRRADAVTLYRGVAV

SEQ ID NO: 754829 - protein, 27 aa, Mycobacterium
YAHSIALFLRWCARSGRSWQAGVEGFA

SEQ ID NO: 754830 - protein, 18 aa, Mycobacterium
YAHVRAFVLVPWSAVDAS

SEQ ID NO: 754831 - protein, 23 aa, Mycobacterium
YAHWARRTADPSARRIADETARF

SEQ ID NO: 754832 - protein, 21 aa, Mycobacterium
YAIAALRAEPVDSYGVGTSVV

SEQ ID NO: 754833 - protein, 24 aa, Mycobacterium
YAIGKAAPVGLFIETFGTATVDPV

SEQ ID NO: 754834 - protein, 19 aa, Mycobacterium
YAINNSFGFGGHNVALAFG

SEQ ID NO: 754835 - protein, 17 aa, Mycobacterium
YAIPGVAVAIWVDGQEF

SEQ ID NO: 754836 - protein, 23 aa, Mycobacterium
YAIPPQWGGLGLNLVQDVELAME

SEQ ID NO: 754837 - protein, 23 aa, Mycobacterium
YAIRARHAFIYVRGEVLPVLRRL

SEQ ID NO: 754838 - protein, 19 aa, Mycobacterium
YAIRLCAQFVAGEEAVTED

SEQ ID NO: 754839 - protein, 20 aa, Mycobacterium
YAIRSRIRFNTKVQAAEYDE

SEQ ID NO: 754840 - protein, 20 aa, Mycobacterium
YAITGTRGSGVIGINGAAAH

SEQ ID NO: 754841 - protein, 18 aa, Mycobacterium
YAKAFGMDVIAWSQNLTE

SEQ ID NO: 754842 - protein, 21 aa, Mycobacterium
YAKALQFYRDVFGWTVNTVAD

SEQ ID NO: 754843 - protein, 25 aa, Mycobacterium
YAKALRRYRFGSGAAKVDFVLSDEI

SEQ ID NO: 754844 - protein, 17 aa, Mycobacterium
YAKARAGEISDFTGVNA

SEQ ID NO: 754845 - protein, 26 aa, Mycobacterium
YAKCAELDLPLCINTGIPGPPIPGEV

SEQ ID NO: 754846 - protein, 25 aa, Mycobacterium
YAKCAELDLPLCVNTGIPGPPIPGE

SEQ ID NO: 754847 - protein, 20 aa, Mycobacterium
YAKEAPGWTVTTSVRAGEHR

SEQ ID NO: 754848 - protein, 23 aa, Mycobacterium
YAKGMSSHFVWLNRGKRSVALDL

SEQ ID NO: 754849 - protein, 17 aa, Mycobacterium
YAKHCVKKYGLASRIRF

SEQ ID NO: 754850 - protein, 23 aa, Mycobacterium
YAKLLRDIPFRVGAVVQPPAYYA

SEQ ID NO: 754851 - protein, 25 aa, Mycobacterium
YAKLRRLRRLAGIWLAAQGGSWSSV

SEQ ID NO: 754852 - protein, 21 aa, Mycobacterium
YAKSRLAPYKAPKTVEFVDAI

SEQ ID NO: 754853 - protein, 20 aa, Mycobacterium
YAKTELRPGAQGSTTELTTG

SEQ ID NO: 754854 - protein, 21 aa, Mycobacterium
YAKTFLRQLEQCLGLAQDKGV

SEQ ID NO: 754855 - protein, 28 aa, Mycobacterium
YAKYSETRAAHWLLLLGADRVDAIEHHL

SEQ ID NO: 754856 - protein, 24 aa, Mycobacterium
YALAASRLYPGWVAYEKRAEGVRR

SEQ ID NO: 754857 - protein, 18 aa, Mycobacterium
YALARLIQSYGVEPAIMA

SEQ ID NO: 754858 - protein, 18 aa, Mycobacterium
YALARPADAISIADVLRC

SEQ ID NO: 754859 - protein, 42 aa, Mycobacterium
YALASGKPLDHWDFYMALGYFKIAIIAAGIAYRARMGGGVAE

SEQ ID NO: 754860 - protein, 17 aa, Mycobacterium
YALAYHVVFIPPAEVDR

SEQ ID NO: 754861 - protein, 19 aa, Mycobacterium
YALAYHVVFIPPAEVDRRG

SEQ ID NO: 754862 - protein, 20 aa, Mycobacterium
YALDGPIPWRSERLRQPGTI

SEQ ID NO: 754863 - protein, 24 aa, Mycobacterium
YALEAEKFWPRVWQMACRLEEIPQ

SEQ ID NO: 754864 - protein, 19 aa, Mycobacterium
YALFLGRYAPYKGAHLALE

SEQ ID NO: 754865 - protein, 24 aa, Mycobacterium
YALGLRKVLLASGARVYEQTPVQD

SEQ ID NO: 754866 - protein, 19 aa, Mycobacterium
YALGWSGAGGDALRERTSA

SEQ ID NO: 754867 - protein, 17 aa, Mycobacterium
YALKASPQFSDRRQAVA

SEQ ID NO: 754868 - protein, 27 aa, Mycobacterium
YALLPWRTARKNIEFGLEAKGLPASER

SEQ ID NO: 754869 - protein, 24 aa, Mycobacterium
YALMRRGQTLFTYLHLAASLPCTQ

SEQ ID NO: 754870 - protein, 19 aa, Mycobacterium
YALPNLRALNFVIEGILGQ

SEQ ID NO: 754871 - protein, 27 aa, Mycobacterium
YALRSVNMFAPWIRRIFIATDSAPPRW

SEQ ID NO: 754872 - protein, 27 aa, Mycobacterium
YALRSVNMFAPWIRRIFIATDSTPPPW

SEQ ID NO: 754873 - protein, 19 aa, Mycobacterium
YALSEWQRILDINVTGVFL

SEQ ID NO: 754874 - protein, 25 aa, Mycobacterium
YALSGAGLWPLLALLASAADDPAGA

SEQ ID NO: 754875 - protein, 23 aa, Mycobacterium
YALSLKVWLDFLHAVDVRWDHAS

SEQ ID NO: 754876 - protein, 20 aa, Mycobacterium
YALSRICGIVKPPVTVTDPP

SEQ ID NO: 754877 - protein, 18 aa, Mycobacterium
YALTLAREGASVVVNDLG

SEQ ID NO: 754878 - protein, 17 aa, Mycobacterium
YAMCTPLPRQGEVEDVA

SEQ ID NO: 754879 - protein, 18 aa, Mycobacterium
YAMGPGIRRLLRLGMTAP

SEQ ID NO: 754880 - protein, 29 aa, Mycobacterium
YAMGRIHRVSWLWALLLFRRRRIPDGAWI

SEQ ID NO: 754881 - protein, 22 aa, Mycobacterium
YAMVRWKNVLRQAAVYGACRKW

SEQ ID NO: 754882 - protein, 17 aa, Mycobacterium
YAMWRVAVSMGQLNEPW

SEQ ID NO: 754883 - protein, 25 aa, Mycobacterium
YANAIKVLAVREVMRLLDGQAAGPA

SEQ ID NO: 754884 - protein, 17 aa, Mycobacterium
YANGHAWATGIFGGGAW

SEQ ID NO: 754885 - protein, 17 aa, Mycobacterium
YANLSKDCVVIGAVDYL

SEQ ID NO: 754886 - protein, 18 aa, Mycobacterium
YANPATPFVAEFVGLHNK

SEQ ID NO: 754887 - protein, 20 aa, Mycobacterium
YANRDELILAALEFWMDEHH

SEQ ID NO: 754888 - protein, 17 aa, Mycobacterium
YANRRITLIDSIPADAV

SEQ ID NO: 754889 - protein, 30 aa, Mycobacterium
YANSEAPCIGRWAALHAGLPISVPGLQIDR

SEQ ID NO: 754890 - protein, 21 aa, Mycobacterium
YANTRGWDLSIWLSLNDPERI

SEQ ID NO: 754891 - protein, 23 aa, Mycobacterium
YAPDIDGVLEWARDAAQRLAQLD

SEQ ID NO: 754892 - protein, 18 aa, Mycobacterium
YAPGALRIAGMGATHATE

SEQ ID NO: 754893 - protein, 18 aa, Mycobacterium
YAPGVYLFRGPSGEVLYV

SEQ ID NO: 754894 - protein, 18 aa, Mycobacterium
YAPLFRKLLKGTRLRIDV

SEQ ID NO: 754895 - protein, 17 aa, Mycobacterium
YAPLMAYLVRSLQAGGE

SEQ ID NO: 754896 - protein, 17 aa, Mycobacterium
YAPLPRMTDVEPLPVDV

SEQ ID NO: 754897 - protein, 18 aa, Mycobacterium
YAPLPWLPDDSYRQVVTE

SEQ ID NO: 754898 - protein, 19 aa, Mycobacterium
YAPLPWLPDEVYRDIVANI

SEQ ID NO: 754899 - protein, 23 aa, Mycobacterium
YAPLPWLPDEVYREIVGQIVEPV

SEQ ID NO: 754900 - protein, 17 aa, Mycobacterium
YAPLRHPGDAFAYDIFS

SEQ ID NO: 754901 - protein, 38 aa, Mycobacterium
YAPPPRMLVFGAIDFAAALARQGSFLGYRVTVCDARPV

SEQ ID NO: 754902 - protein, 17 aa, Mycobacterium
YAPQGWYPKAERSLTLN

SEQ ID NO: 754903 - protein, 20 aa, Mycobacterium
YAPQLWRYWAEHLDPDRARR

SEQ ID NO: 754904 - protein, 17 aa, Mycobacterium
YAPQWKGADAFDAAAEE

SEQ ID NO: 754905 - protein, 20 aa, Mycobacterium
YAPTSQWNNGFVANYTITNT

SEQ ID NO: 754906 - protein, 18 aa, Mycobacterium
YAPVSIADLRRWAIDQDT

SEQ ID NO: 754907 - protein, 19 aa, Mycobacterium
YAPYVEKLLLDGARSKLTR

SEQ ID NO: 754908 - protein, 20 aa, Mycobacterium
YAQEIFEGLKAYRWADDSVV

SEQ ID NO: 754909 - protein, 30 aa, Mycobacterium
YAQEIFEGLKAYRWADGSIVSFRAEANAAR

SEQ ID NO: 754910 - protein, 17 aa, Mycobacterium
YAQLRAGVEAVFASWNS

SEQ ID NO: 754911 - protein, 18 aa, Mycobacterium
YAQLRKAKGITHEQAREI

SEQ ID NO: 754912 - protein, 18 aa, Mycobacterium
YAQLRKAKGVTVEQAREI

SEQ ID NO: 754913 - protein, 31 aa, Mycobacterium
YAQQRAEWGWRLVAAASTLPTPALRDAGVEH

SEQ ID NO: 754914 - protein, 23 aa, Mycobacterium
YAQRRWWSDAGWTHRQQAGLTRP

SEQ ID NO: 754915 - protein, 17 aa, Mycobacterium
YAQSILYMRLRRDRFVL

SEQ ID NO: 754916 - protein, 26 aa, Mycobacterium
YAQTDWRLERHDVVKAFSLLRNHYSV

SEQ ID NO: 754917 - protein, 34 aa, Mycobacterium
YAQVTGLRFGDAVPLTYPFTLTFPAVMSLVTGLD

SEQ ID NO: 754918 - protein, 38 aa, Mycobacterium
YARALSTLTWRVATNVTRLPGLGSWRRPQAELDESSRA

SEQ ID NO: 754919 - protein, 17 aa, Mycobacterium
YARAMLTAWAADPNSPM

SEQ ID NO: 754920 - protein, 26 aa, Mycobacterium
YARANGFRDIICPPLYLQYAVLGVSR

SEQ ID NO: 754921 - protein, 17 aa, Mycobacterium
YARASAAVIARRAQVSD

SEQ ID NO: 754922 - protein, 24 aa, Mycobacterium
YARAVKEWTEFLAEHGVGLFDSRD

SEQ ID NO: 754923 - protein, 18 aa, Mycobacterium
YARCGDLDIAYQVLGDGP

SEQ ID NO: 754924 - protein, 18 aa, Mycobacterium
YARDAARAARWWELSETC

SEQ ID NO: 754925 - protein, 17 aa, Mycobacterium
YAREIEELYAPDLHPEV

SEQ ID NO: 754926 - protein, 19 aa, Mycobacterium
YARELSNLADLARRNGAAD

SEQ ID NO: 754927 - protein, 17 aa, Mycobacterium
YAREVLDGAAPLASGSW

SEQ ID NO: 754928 - protein, 26 aa, Mycobacterium
YARFLRRGRKAPGFFVRSADNRYLLH

SEQ ID NO: 754929 - protein, 23 aa, Mycobacterium
YARGGAAMEAVWVRAQEHGLAVQ

SEQ ID NO: 754930 - protein, 17 aa, Mycobacterium
YARGTWDDIEMAYYQRL

SEQ ID NO: 754931 - protein, 19 aa, Mycobacterium
YARHTGGDFVFRIEDTDAA

SEQ ID NO: 754932 - protein, 19 aa, Mycobacterium
YARHTGGDFVFRIEDTDAQ

SEQ ID NO: 754933 - protein, 20 aa, Mycobacterium
YARKHPRLTSHWVSATASAR

SEQ ID NO: 754934 - protein, 23 aa, Mycobacterium
YARNEIYTLLPAFAPADPGKENT

SEQ ID NO: 754935 - protein, 22 aa, Mycobacterium
YARQHATGAWAAYEPAALELDQ

SEQ ID NO: 754936 - protein, 20 aa, Mycobacterium
YARQRPRLLADWLAGDAGDL

SEQ ID NO: 754937 - protein, 18 aa, Mycobacterium
YARQRPRVLSDWLDGGRG

SEQ ID NO: 754938 - protein, 20 aa, Mycobacterium
YARRTWRLRRRDWIHRCGAP

SEQ ID NO: 754939 - protein, 24 aa, Mycobacterium
YARRVEVPTGYSLFRGDIVRPPHA

SEQ ID NO: 754940 - protein, 23 aa, Mycobacterium
YARSEGGGMLVLKRISDARRDGD

SEQ ID NO: 754941 - protein, 22 aa, Mycobacterium
YARSGMDVAVLRAGGDPAPVDE

SEQ ID NO: 754942 - protein, 24 aa, Mycobacterium
YARTLEILERFYGLVLTDCGTGLL

SEQ ID NO: 754943 - protein, 19 aa, Mycobacterium
YARTPAWLLHPGDHVEVEV

SEQ ID NO: 754944 - protein, 24 aa, Mycobacterium
YARTWRYLLDMDLVRKIKYHGASV

SEQ ID NO: 754945 - protein, 27 aa, Mycobacterium
YARVAREALPHAILIADRFHLVKKAND

SEQ ID NO: 754946 - protein, 20 aa, Mycobacterium
YARVDGRPVGVIANQPMHMS

SEQ ID NO: 754947 - protein, 20 aa, Mycobacterium
YARVDGRPVGVVANQPMHMS

SEQ ID NO: 754948 - protein, 19 aa, Mycobacterium
YARYADWKKVQRPLIKPSD

SEQ ID NO: 754949 - protein, 21 aa, Mycobacterium
YASAKAAAWALTDAVRTELAP

SEQ ID NO: 754950 - protein, 27 aa, Mycobacterium
YASEDWMARFILGFGAEVQVLAPESLA

SEQ ID NO: 754951 - protein, 17 aa, Mycobacterium
YASGAARDIVARARALG

SEQ ID NO: 754952 - protein, 21 aa, Mycobacterium
YASGTAVCWDDPGVRACFRCP

SEQ ID NO: 754953 - protein, 18 aa, Mycobacterium
YASIFPACRAVVHHGGSG

SEQ ID NO: 754954 - protein, 23 aa, Mycobacterium
YASLNFPSFLPGFAGQRLQQVTK

SEQ ID NO: 754955 - protein, 24 aa, Mycobacterium
YASLNFPSFLPGFAGQRLQQVTKD

SEQ ID NO: 754956 - protein, 23 aa, Mycobacterium
YASLNFPSFLPGFAGQRLQQVTT

SEQ ID NO: 754957 - protein, 24 aa, Mycobacterium
YASLNFPSFLPGFAGQRLQQVTTD

SEQ ID NO: 754958 - protein, 17 aa, Mycobacterium
YASLSKECVVIGAVDYL

SEQ ID NO: 754959 - protein, 19 aa, Mycobacterium
YASNVALQLAKKVGANPRE

SEQ ID NO: 754960 - protein, 23 aa, Mycobacterium
YASQTWSGLILDEAQYVKNRHAK

SEQ ID NO: 754961 - protein, 25 aa, Mycobacterium
YASRGHVPATNWVLREKRAWAELAE

SEQ ID NO: 754962 - protein, 23 aa, Mycobacterium
YASRPLLDLPWDIEESPSGVAVA

SEQ ID NO: 754963 - protein, 24 aa, Mycobacterium
YASRQAREAYRWMRANQPVFRDRN

SEQ ID NO: 754964 - protein, 17 aa, Mycobacterium
YASRVGAKFLKQYPQSR

SEQ ID NO: 754965 - protein, 20 aa, Mycobacterium
YASTRIGGVPGILVKPLDAD

SEQ ID NO: 754966 - protein, 22 aa, Mycobacterium
YASVTFPWYALGRQVHVRGRVT

SEQ ID NO: 754967 - protein, 22 aa, Mycobacterium
YASVTFPWYLLGRQVHIRGAVS

SEQ ID NO: 754968 - protein, 32 aa, Mycobacterium
YATAEAANASPLEFLLDAVNAPTQTLFGRDLI

SEQ ID NO: 754969 - protein, 24 aa, Mycobacterium
YATAEALLAHGARVVIGDRDVALQ

SEQ ID NO: 754970 - protein, 19 aa, Mycobacterium
YATAEAWLQRQGVLDLVDQ

SEQ ID NO: 754971 - protein, 25 aa, Mycobacterium
YATALRRYRFGSGVAKVDFVLNGDI

SEQ ID NO: 754972 - protein, 18 aa, Mycobacterium
YATATAWLERQGIMGVIT

SEQ ID NO: 754973 - protein, 18 aa, Mycobacterium
YATAVGHDIHVPDSLADY

SEQ ID NO: 754974 - protein, 19 aa, Mycobacterium
YATAVGHEINAPVPLSEYV

SEQ ID NO: 754975 - protein, 21 aa, Mycobacterium
YATFRSVLWARWPSAGPPPFF

SEQ ID NO: 754976 - protein, 19 aa, Mycobacterium
YATGIDRRDWRLFRTVFTD

SEQ ID NO: 754977 - protein, 19 aa, Mycobacterium
YATIFPACRAVVHHGGSGT

SEQ ID NO: 754978 - protein, 18 aa, Mycobacterium
YATIVMDYYALRLLGSAA

SEQ ID NO: 754979 - protein, 23 aa, Mycobacterium
YATLARYVLGFALQLPGATDGGG

SEQ ID NO: 754980 - protein, 19 aa, Mycobacterium
YATNVRRILYLASFQLQPG

SEQ ID NO: 754981 - protein, 22 aa, Mycobacterium
YATPETREWWGGMWAERILHST

SEQ ID NO: 754982 - protein, 23 aa, Mycobacterium
YATPRPGTDLVVLADELVTEPRI

SEQ ID NO: 754983 - protein, 23 aa, Mycobacterium
YATRTVEPWGVVTEKGRWYLVGH

SEQ ID NO: 754984 - protein, 19 aa, Mycobacterium
YATRVEGYPGLVVHGPLVT

SEQ ID NO: 754985 - protein, 27 aa, Mycobacterium
YATSDPRSACFYSRRTVELLVDYLYGV

SEQ ID NO: 754986 - protein, 17 aa, Mycobacterium
YATSKWAGEVLLREAHD

SEQ ID NO: 754987 - protein, 17 aa, Mycobacterium
YATTVFAEMSALAARVG

SEQ ID NO: 754988 - protein, 17 aa, Mycobacterium
YATTVFAEMSALATRIG

SEQ ID NO: 754989 - protein, 19 aa, Mycobacterium
YATVFPGCRAVVHHGGSGT

SEQ ID NO: 754990 - protein, 17 aa, Mycobacterium
YATVVAYVYSAGISTGV

SEQ ID NO: 754991 - protein, 18 aa, Mycobacterium
YAVARAFVDARIQTIYGG

SEQ ID NO: 754992 - protein, 20 aa, Mycobacterium
YAVCDDRRTLLWLANQRAVE

SEQ ID NO: 754993 - protein, 21 aa, Mycobacterium
YAVDLRFLLSPPVGATESTNP

SEQ ID NO: 754994 - protein, 19 aa, Mycobacterium
YAVDPVFVAESWVTQAHGT

SEQ ID NO: 754995 - protein, 27 aa, Mycobacterium
YAVGGGPRLGTGLALAAQVRRGTSAAA

SEQ ID NO: 754996 - protein, 17 aa, Mycobacterium
YAVGKRVGDAMFPVDFL

SEQ ID NO: 754997 - protein, 20 aa, Mycobacterium
YAVHPWGLYLARPTPGRAQF

SEQ ID NO: 754998 - protein, 19 aa, Mycobacterium
YAVHPWGLYLARPTPGRVQ

SEQ ID NO: 754999 - protein, 19 aa, Mycobacterium
YAVHPWGLYVARPTPGRAQ

SEQ ID NO: 755000 - protein, 21 aa, Mycobacterium
YAVKYERAFEASAALKDYFLE

SEQ ID NO: 755001 - protein, 20 aa, Mycobacterium
YAVLAAGWPEHIPGTTVNRA

SEQ ID NO: 755002 - protein, 17 aa, Mycobacterium
YAVLAVIIAEAMAELDQ

SEQ ID NO: 755003 - protein, 18 aa, Mycobacterium
YAVLEPDSGVLIADGIVE

SEQ ID NO: 755004 - protein, 19 aa, Mycobacterium
YAVLLPDVYYREGDWAPFT

SEQ ID NO: 755005 - protein, 18 aa, Mycobacterium
YAVNNSFGFGGHNVAITF

SEQ ID NO: 755006 - protein, 19 aa, Mycobacterium
YAVPHWPAQWGGGLPVDKQ

SEQ ID NO: 755007 - protein, 21 aa, Mycobacterium
YAVPLDWSQPLALGTFYDTIL

SEQ ID NO: 755008 - protein, 22 aa, Mycobacterium
YAVPRLLARNNLTLQDFDFYEI

SEQ ID NO: 755009 - protein, 18 aa, Mycobacterium
YAVQACLDALIASGSGRV

SEQ ID NO: 755010 - protein, 23 aa, Mycobacterium
YAVQSYLEYQGRKLLARFDAGTY

SEQ ID NO: 755011 - protein, 17 aa, Mycobacterium
YAVRVAAFSAFFHQGQI

SEQ ID NO: 755012 - protein, 21 aa, Mycobacterium
YAVVDGEIWFETKAKSQKAVN

SEQ ID NO: 755013 - protein, 20 aa, Mycobacterium
YAVVDGEIWLETKAKSQKAV

SEQ ID NO: 755014 - protein, 23 aa, Mycobacterium
YAWTRDRLTVAILRDVASEILVF

SEQ ID NO: 755015 - protein, 19 aa, Mycobacterium
YAYALLRRNAERTGEGPPR

SEQ ID NO: 755016 - protein, 17 aa, Mycobacterium
YAYQRPAPIETFPVLSQ

SEQ ID NO: 755017 - protein, 37 aa, Mycobacterium
YCAERFGCSPLDYMEELGWLGPDVWFAHGVHFDDASI

SEQ ID NO: 755018 - protein, 18 aa, Mycobacterium
YCAGSVAHFDWLVGCGVP

SEQ ID NO: 755019 - protein, 21 aa, Mycobacterium
YCARPDLTAERFVRYQDQNWY

SEQ ID NO: 755020 - protein, 17 aa, Mycobacterium
YCDRYAFADLADRLEQL

SEQ ID NO: 755021 - protein, 17 aa, Mycobacterium
YCDVNAGSARDLRVALL

SEQ ID NO: 755022 - protein, 21 aa, Mycobacterium
YCGIEDFLHRVRIRVGDVPVG

SEQ ID NO: 755023 - protein, 18 aa, Mycobacterium
YCGTHWKLNPVFDECGFD

SEQ ID NO: 755024 - protein, 19 aa, Mycobacterium
YCHAGGFALGNLDTDHRQC

SEQ ID NO: 755025 - protein, 17 aa, Mycobacterium
YCKERLGLDKALGSIDR

SEQ ID NO: 755026 - protein, 24 aa, Mycobacterium
YCLGRPWWRRGLMSEAMSVLIDDT

SEQ ID NO: 755027 - protein, 17 aa, Mycobacterium
YCLLHGDGFAMYRVHNS

SEQ ID NO: 755028 - protein, 25 aa, Mycobacterium
YCLVEKLRTALGLEIPGLANPDEDA

SEQ ID NO: 755029 - protein, 20 aa, Mycobacterium
YCMGGRTSLIVAGRVPDRVA

SEQ ID NO: 755030 - protein, 20 aa, Mycobacterium
YCMGGRTSLVVAGRVPQRVA

SEQ ID NO: 755031 - protein, 25 aa, Mycobacterium
YCMPQLDAKIGWNIKRMAPGTYTRA

SEQ ID NO: 755032 - protein, 20 aa, Mycobacterium
YCMPQLDAKIGWTVKRLAPQ

SEQ ID NO: 755033 - protein, 19 aa, Mycobacterium
YCNPDGPPPAKLIRDLQTN

SEQ ID NO: 755034 - protein, 20 aa, Mycobacterium
YCPHEGGPLCSGRARGRTVV

SEQ ID NO: 755035 - protein, 18 aa, Mycobacterium
YCRIGERSSHTWFVLQEI

SEQ ID NO: 755036 - protein, 17 aa, Mycobacterium
YCRIVVGALAAVATCRI

SEQ ID NO: 755037 - protein, 18 aa, Mycobacterium
YCRLLTDVFPDWATRHEV

SEQ ID NO: 755038 - protein, 18 aa, Mycobacterium
YCRRGDENLCPKSLYTGW

SEQ ID NO: 755039 - protein, 18 aa, Mycobacterium
YCRRGDENLCPKSRYTGW

SEQ ID NO: 755040 - protein, 19 aa, Mycobacterium
YCRRYRPAARRPQPIDTGM

SEQ ID NO: 755041 - protein, 17 aa, Mycobacterium
YCSDFGRTWIVGRDPQP

SEQ ID NO: 755042 - protein, 20 aa, Mycobacterium
YCSQLPIAVISEILGVPAHD

SEQ ID NO: 755043 - protein, 20 aa, Mycobacterium
YCSRLKTALKAEGIPYTEVD

SEQ ID NO: 755044 - protein, 18 aa, Mycobacterium
YCSRSMRLNSAGVRADGS

SEQ ID NO: 755045 - protein, 27 aa, Mycobacterium
YCTCGDIRGVEWLGVVHRWSRSPQAGT

SEQ ID NO: 755046 - protein, 20 aa, Mycobacterium
YCTGYERFERYLLGVDDGVP

SEQ ID NO: 755047 - protein, 17 aa, Mycobacterium
YCTTVGLVRRDKDGRYH

SEQ ID NO: 755048 - protein, 17 aa, Mycobacterium
YCVGKWHLAPEETMTAA

SEQ ID NO: 755049 - protein, 17 aa, Mycobacterium
YCVVDARPWLRDPRPMW

SEQ ID NO: 755050 - protein, 17 aa, Mycobacterium
YCVVKSGFGLEFAKTAD

SEQ ID NO: 755051 - protein, 21 aa, Mycobacterium
YDAAAAWVRMAHAYRGKLTGL

SEQ ID NO: 755052 - protein, 17 aa, Mycobacterium
YDAAARAQAQWAAKPPV

SEQ ID NO: 755053 - protein, 18 aa, Mycobacterium
YDAAELAAMMGRSTSELP

SEQ ID NO: 755054 - protein, 25 aa, Mycobacterium
YDAAPLGRICLCRVHDGRIEENFIG

SEQ ID NO: 755055 - protein, 18 aa, Mycobacterium
YDAATLRALVDVGTHNAF

SEQ ID NO: 755056 - protein, 17 aa, Mycobacterium
YDAEKGFGFLSQEDGED

SEQ ID NO: 755057 - protein, 19 aa, Mycobacterium
YDAEKGFGFLSQEDGEDVY

SEQ ID NO: 755058 - protein, 23 aa, Mycobacterium
YDAFELRDGRLIVVVGDVAGHGV

SEQ ID NO: 755059 - protein, 21 aa, Mycobacterium
YDAFFCVVDLHAITVPQDPET

SEQ ID NO: 755060 - protein, 40 aa, Mycobacterium
YDAFGHPAFRVKFFKGKLKSGFTALEWNSITRKFVLPGSS

SEQ ID NO: 755061 - protein, 18 aa, Mycobacterium
YDAGAAYWWQNTRATVLF

SEQ ID NO: 755062 - protein, 22 aa, Mycobacterium
YDAGCGPGFRIVASRAVPGGTT

SEQ ID NO: 755063 - protein, 19 aa, Mycobacterium
YDAGLHWFRAALATRSPED

SEQ ID NO: 755064 - protein, 23 aa, Mycobacterium
YDAGLPLAVFPAGTFNHFAKDIG

SEQ ID NO: 755065 - protein, 23 aa, Mycobacterium
YDAIDQWAFCALTNSPGARTFYD

SEQ ID NO: 755066 - protein, 17 aa, Mycobacterium
YDAMLAKVIAWAPTRAE

SEQ ID NO: 755067 - protein, 19 aa, Mycobacterium
YDAMWARNAGAMYAYADAA

SEQ ID NO: 755068 - protein, 20 aa, Mycobacterium
YDANGMAALWTSSANEEVNP

SEQ ID NO: 755069 - protein, 24 aa, Mycobacterium
YDAPEIVIPFLVPDGAHDYPDDRR

SEQ ID NO: 755070 - protein, 17 aa, Mycobacterium
YDAPTWAGRERRRIRDW

SEQ ID NO: 755071 - protein, 17 aa, Mycobacterium
YDARARLLESFSRKTLN

SEQ ID NO: 755072 - protein, 19 aa, Mycobacterium
YDATGAWVRAARSHPGTLT

SEQ ID NO: 755073 - protein, 23 aa, Mycobacterium
YDATVEVAMRLGVDPRKADQMVR

SEQ ID NO: 755074 - protein, 17 aa, Mycobacterium
YDDAAGVTARFNRNVLA

SEQ ID NO: 755075 - protein, 18 aa, Mycobacterium
YDDEYELTDRWRIGRRVL

SEQ ID NO: 755076 - protein, 23 aa, Mycobacterium
YDDFFRFAHRVLPDDGVMLLHTI

SEQ ID NO: 755077 - protein, 17 aa, Mycobacterium
YDDGVGWTLVRSDQQRA

SEQ ID NO: 755078 - protein, 22 aa, Mycobacterium
YDDLKPLLQFIVAGGLATTVKA

SEQ ID NO: 755079 - protein, 23 aa, Mycobacterium
YDDLRVIDNVRYFAALYGTSPAA

SEQ ID NO: 755080 - protein, 24 aa, Mycobacterium
YDDRTGPLIVEWLAKRGYDVTEQM

SEQ ID NO: 755081 - protein, 19 aa, Mycobacterium
YDDVVAWRDGHRYVTQLCR

SEQ ID NO: 755082 - protein, 24 aa, Mycobacterium
YDEALWRLLCEQVGAAVLVVPEEL

SEQ ID NO: 755083 - protein, 24 aa, Mycobacterium
YDEALWTMLCEQVGAAALVVPEEL

SEQ ID NO: 755084 - protein, 22 aa, Mycobacterium
YDEARAIALQMERLITDIGQYG

SEQ ID NO: 755085 - protein, 24 aa, Mycobacterium
YDEFCTYWEGMLERFVPHQTVRYG

SEQ ID NO: 755086 - protein, 17 aa, Mycobacterium
YDEFLARFVRASESLIA

SEQ ID NO: 755087 - protein, 26 aa, Mycobacterium
YDEGENFAFLGGRDWEPSDVKLPKAV

SEQ ID NO: 755088 - protein, 29 aa, Mycobacterium
YDEGGPAPARRAAVICLDRSANATYKGFV

SEQ ID NO: 755089 - protein, 17 aa, Mycobacterium
YDEGKLKLDELITTRYR

SEQ ID NO: 755090 - protein, 26 aa, Mycobacterium
YDEIAERGWPVFLVSTVAREGLQPLI

SEQ ID NO: 755091 - protein, 18 aa, Mycobacterium
YDELPATLLDMLAEHVDT

SEQ ID NO: 755092 - protein, 18 aa, Mycobacterium
YDEMKIVLEGEFHLENVD

SEQ ID NO: 755093 - protein, 24 aa, Mycobacterium
YDEPRVAAINLRRHLLDGIRSASF

SEQ ID NO: 755094 - protein, 19 aa, Mycobacterium
YDERGCGLSDWDVGDFTFD

SEQ ID NO: 755095 - protein, 23 aa, Mycobacterium
YDESFGLPGLAAFCRDAIHANAD

SEQ ID NO: 755096 - protein, 26 aa, Mycobacterium
YDEVFFPGLRQEWRGTRPFVGALTLE

SEQ ID NO: 755097 - protein, 25 aa, Mycobacterium
YDFAGEIPFPVSTYRGTIRVLPVTD

SEQ ID NO: 755098 - protein, 25 aa, Mycobacterium
YDFGCKRPTFSNSYYRTFTKPHVHL

SEQ ID NO: 755099 - protein, 27 aa, Mycobacterium
YDFGCKRPTFSNTYFRAFTKKNVSLET

SEQ ID NO: 755100 - protein, 24 aa, Mycobacterium
YDFGCKRPTLSNTYYRTFNKKHVH

SEQ ID NO: 755101 - protein, 17 aa, Mycobacterium
YDFGGWFDRLPPLVRAA

SEQ ID NO: 755102 - protein, 21 aa, Mycobacterium
YDFGPEIGKRYLVDFPSPVSY

SEQ ID NO: 755103 - protein, 18 aa, Mycobacterium
YDFLDPVVNDPLNLEVWA

SEQ ID NO: 755104 - protein, 18 aa, Mycobacterium
YDFVICGSGSSGSVVAGR

SEQ ID NO: 755105 - protein, 36 aa, Mycobacterium
YDGAADFPRYPINFLADLNAFLGIQSLHGQYPSLTP

SEQ ID NO: 755106 - protein, 17 aa, Mycobacterium
YDGFWYLSSYEAVSHTA

SEQ ID NO: 755107 - protein, 22 aa, Mycobacterium
YDGGAGCWRIEAGDYTAAVGIS

SEQ ID NO: 755108 - protein, 18 aa, Mycobacterium
YDGGGLDVACLGFAEVDR

SEQ ID NO: 755109 - protein, 27 aa, Mycobacterium
YDGIRVHRVPSRMFPKVTTLPLGVPTP

SEQ ID NO: 755110 - protein, 22 aa, Mycobacterium
YDGPRAAFAAAQRWRRRAEHPL

SEQ ID NO: 755111 - protein, 19 aa, Mycobacterium
YDGPWRDLVHHSGRVLQAL

SEQ ID NO: 755112 - protein, 18 aa, Mycobacterium
YDGRAAVTKLDLVNYYRA

SEQ ID NO: 755113 - protein, 18 aa, Mycobacterium
YDGRVMEPTVLPSRFPNL

SEQ ID NO: 755114 - protein, 27 aa, Mycobacterium
YDGVLGRLWLSRGGTYVLANIRGGGEY

SEQ ID NO: 755115 - protein, 17 aa, Mycobacterium
YDGVLLCTVTRRSTLPR

SEQ ID NO: 755116 - protein, 17 aa, Mycobacterium
YDHEQGFRLKVAENACR

SEQ ID NO: 755117 - protein, 18 aa, Mycobacterium
YDHFTPFVFTQLEELGFC

SEQ ID NO: 755118 - protein, 18 aa, Mycobacterium
YDHFTPFVFVQLEELGFC

SEQ ID NO: 755119 - protein, 19 aa, Mycobacterium
YDHQAPRWQEIDGGAYAAF

SEQ ID NO: 755120 - protein, 17 aa, Mycobacterium
YDHVAPIDTFEQAVKIL

SEQ ID NO: 755121 - protein, 17 aa, Mycobacterium
YDHVAPIETFEQAVKIV

SEQ ID NO: 755122 - protein, 17 aa, Mycobacterium
YDIAALLAAHPVSVNGA

SEQ ID NO: 755123 - protein, 18 aa, Mycobacterium
YDIAGALTGFHTDDIVSG

SEQ ID NO: 755124 - protein, 23 aa, Mycobacterium
YDIKVLVLKANGKGFCSGHAIGN

SEQ ID NO: 755125 - protein, 25 aa, Mycobacterium
YDILTPLIWRLDTFWLSMRDQTPWV

SEQ ID NO: 755126 - protein, 23 aa, Mycobacterium
YDILTPLIWRLDTFWVSMRDQTP

SEQ ID NO: 755127 - protein, 17 aa, Mycobacterium
YDIPGRSGVPIEPETIR

SEQ ID NO: 755128 - protein, 25 aa, Mycobacterium
YDIPPRSVVPIAWDTLRKLAEHPNI

SEQ ID NO: 755129 - protein, 24 aa, Mycobacterium
YDIPPRSVVPIEWDTIRRLAQHPN

SEQ ID NO: 755130 - protein, 17 aa, Mycobacterium
YDIPQLLSMYKARKLNI

SEQ ID NO: 755131 - protein, 17 aa, Mycobacterium
YDIPVDIIWHGGEPTLL

SEQ ID NO: 755132 - protein, 22 aa, Mycobacterium
YDISNEFFALFLGPTMGYTCGY

SEQ ID NO: 755133 - protein, 23 aa, Mycobacterium
YDIYRGVVTYVRVMDGKIVPRER

SEQ ID NO: 755134 - protein, 23 aa, Mycobacterium
YDIYRGVVTYVRVVDGKIVPRER

SEQ ID NO: 755135 - protein, 21 aa, Mycobacterium
YDIYRGVVTYVRVVDGRITPR

SEQ ID NO: 755136 - protein, 18 aa, Mycobacterium
YDKAFPEAARLMALGGAQ

SEQ ID NO: 755137 - protein, 19 aa, Mycobacterium
YDKAGLWPYLEKLGFYLVG

SEQ ID NO: 755138 - protein, 20 aa, Mycobacterium
YDKAGLWPYLEKLGFYLVGY

SEQ ID NO: 755139 - protein, 19 aa, Mycobacterium
YDKCELETYTALSAELKVN

SEQ ID NO: 755140 - protein, 18 aa, Mycobacterium
YDKGEGWTPQFGSKKEDY

SEQ ID NO: 755141 - protein, 22 aa, Mycobacterium
YDKRLSATWKFLRSATAEQVAA

SEQ ID NO: 755142 - protein, 17 aa, Mycobacterium
YDLANRGLLPASFALVG

SEQ ID NO: 755143 - protein, 17 aa, Mycobacterium
YDLAPNGHRTDVTLTYD

SEQ ID NO: 755144 - protein, 17 aa, Mycobacterium
YDLAWAAMVRMLDRTQP

SEQ ID NO: 755145 - protein, 17 aa, Mycobacterium
YDLDELPEHLIVVGSGV

SEQ ID NO: 755146 - protein, 20 aa, Mycobacterium
YDLFARKVIPYFKGQLEAPR

SEQ ID NO: 755147 - protein, 24 aa, Mycobacterium
YDLGEGHPLLGRRMPDLDLITADG

SEQ ID NO: 755148 - protein, 22 aa, Mycobacterium
YDLHKEWAVIQALGKHTKVPVP

SEQ ID NO: 755149 - protein, 17 aa, Mycobacterium
YDLKRPLLDPALGAALY

SEQ ID NO: 755150 - protein, 22 aa, Mycobacterium
YDLLAFCRWLGSVDVELSSVTT

SEQ ID NO: 755151 - protein, 18 aa, Mycobacterium
YDLLDSWDTLVLVDAVPS

SEQ ID NO: 755152 - protein, 32 aa, Mycobacterium
YDLLRGKLWHDTRCEWWYRQNVLVYATDDVAH

SEQ ID NO: 755153 - protein, 24 aa, Mycobacterium
YDLMARKVIPHFKRQLEASRASHD

SEQ ID NO: 755154 - protein, 18 aa, Mycobacterium
YDLMARKVIPHFMGQLEA

SEQ ID NO: 755155 - protein, 18 aa, Mycobacterium
YDLPFLQQWVYRPPHDEV

SEQ ID NO: 755156 - protein, 24 aa, Mycobacterium
YDLPFLQQWVYRPPHNEVIAQLRN

SEQ ID NO: 755157 - protein, 17 aa, Mycobacterium
YDLPLATLHHVPMRPNG

SEQ ID NO: 755158 - protein, 26 aa, Mycobacterium
YDLPPSQANFVWLPLVGRAQQFAADA

SEQ ID NO: 755159 - protein, 20 aa, Mycobacterium
YDLPTRVLLISAHDESAIVY

SEQ ID NO: 755160 - protein, 18 aa, Mycobacterium
YDLPVKIGGHLKVRDFDK

SEQ ID NO: 755161 - protein, 17 aa, Mycobacterium
YDLRPDQALVITIPVSD

SEQ ID NO: 755162 - protein, 20 aa, Mycobacterium
YDLSAGFPLLTTKKVHFKSV

SEQ ID NO: 755163 - protein, 27 aa, Mycobacterium
YDLSHPWGHGAPAWPYFEDVKIERLHG

SEQ ID NO: 755164 - protein, 27 aa, Mycobacterium
YDLSHPWGHGAPAWPYFEDVKIERLHN

SEQ ID NO: 755165 - protein, 28 aa, Mycobacterium
YDLSHPWGLGTPCWPYFEDVKIERLHNM

SEQ ID NO: 755166 - protein, 22 aa, Mycobacterium
YDLSSLRFIMWGATPVSAGIAE

SEQ ID NO: 755167 - protein, 17 aa, Mycobacterium
YDLSSLRVVFAGGEALP

SEQ ID NO: 755168 - protein, 17 aa, Mycobacterium
YDLSSLYAIGTGGAATN

SEQ ID NO: 755169 - protein, 18 aa, Mycobacterium
YDLSVRWGTALAGRLPRI

SEQ ID NO: 755170 - protein, 24 aa, Mycobacterium
YDLTSLRAMLCGSAPAPIWLWHNV

SEQ ID NO: 755171 - protein, 27 aa, Mycobacterium
YDLVAEMPRFGWPTVVVSGGHDLTTPA

SEQ ID NO: 755172 - protein, 18 aa, Mycobacterium
YDLWPQVLLEAAHAVAHP

SEQ ID NO: 755173 - protein, 17 aa, Mycobacterium
YDMIKAVDRAAGIDGIR

SEQ ID NO: 755174 - protein, 17 aa, Mycobacterium
YDMPVAVWRQLMAQHYP

SEQ ID NO: 755175 - protein, 20 aa, Mycobacterium
YDMYRLLALAKYEERYVIPT

SEQ ID NO: 755176 - protein, 24 aa, Mycobacterium
YDNGTQMPLMWTQLIPATLEGKAL

SEQ ID NO: 755177 - protein, 22 aa, Mycobacterium
YDNKLRPLLLREHKLTDVEARA

SEQ ID NO: 755178 - protein, 18 aa, Mycobacterium
YDNLRAANPRIVLAESSA

SEQ ID NO: 755179 - protein, 20 aa, Mycobacterium
YDNLVRPIANSFVYNLVDPI

SEQ ID NO: 755180 - protein, 18 aa, Mycobacterium
YDPAFAFEIAYIIESGLQ

SEQ ID NO: 755181 - protein, 20 aa, Mycobacterium
YDPDEDRFLLAGADVSAEIR

SEQ ID NO: 755182 - protein, 18 aa, Mycobacterium
YDPDRYEGLVGVYAGSGQ

SEQ ID NO: 755183 - protein, 18 aa, Mycobacterium
YDPEFKLATTKRGITAGM

SEQ ID NO: 755184 - protein, 25 aa, Mycobacterium
YDPFVERALEPWSFGIYAGGQSILV

SEQ ID NO: 755185 - protein, 17 aa, Mycobacterium
YDPIPVRDDLAKALVAY

SEQ ID NO: 755186 - protein, 20 aa, Mycobacterium
YDPIWPLHGIRIIPGPSSLW

SEQ ID NO: 755187 - protein, 21 aa, Mycobacterium
YDPLGAVLIIGPWNYPLYLSL

SEQ ID NO: 755188 - protein, 20 aa, Mycobacterium
YDPPWGRPLLGVRRALTHAA

SEQ ID NO: 755189 - protein, 21 aa, Mycobacterium
YDPRRGSLVGALVVDEESELY

SEQ ID NO: 755190 - protein, 25 aa, Mycobacterium
YDPWFAKARAAGAIEAREMDEGMLR

SEQ ID NO: 755191 - protein, 24 aa, Mycobacterium
YDPWFAKARTSGAIEAREMDEGML

SEQ ID NO: 755192 - protein, 20 aa, Mycobacterium
YDPWFAKARTTGAIESREMD

SEQ ID NO: 755193 - protein, 24 aa, Mycobacterium
YDQGYRPGGGYGPPGGGQPGGAQQ

SEQ ID NO: 755194 - protein, 23 aa, Mycobacterium
YDQGYRQGGGYGQPPGGGYGQPP

SEQ ID NO: 755195 - protein, 19 aa, Mycobacterium
YDQKTTWSKFFTPGDELEQ

SEQ ID NO: 755196 - protein, 19 aa, Mycobacterium
YDQLIKRDKVHGSLYTDPT

SEQ ID NO: 755197 - protein, 18 aa, Mycobacterium
YDQLIPGRGVGVLLDDGS

SEQ ID NO: 755198 - protein, 25 aa, Mycobacterium
YDQMWASDVAAMFGYHADASAAVAK

SEQ ID NO: 755199 - protein, 26 aa, Mycobacterium
YDRALELGCGTGFFLLNLIQAGVARR

SEQ ID NO: 755200 - protein, 21 aa, Mycobacterium
YDRAMARLGLAVTRGLLLDLV

SEQ ID NO: 755201 - protein, 22 aa, Mycobacterium
YDRAYYPAGIARHFAAILGSGS

SEQ ID NO: 755202 - protein, 26 aa, Mycobacterium
YDRDGRPRWTPTIAHLSDGRRVVARS

SEQ ID NO: 755203 - protein, 17 aa, Mycobacterium
YDRERVINDPNGPQSLL

SEQ ID NO: 755204 - protein, 17 aa, Mycobacterium
YDRHGFRGNPFVLTQLL

SEQ ID NO: 755205 - protein, 17 aa, Mycobacterium
YDRKALRKRAIELLELV

SEQ ID NO: 755206 - protein, 29 aa, Mycobacterium
YDRPANAFVAGFIGSPAMKFFDAQLGDRT

SEQ ID NO: 755207 - protein, 18 aa, Mycobacterium
YDRPATVFVASFIGQANL

SEQ ID NO: 755208 - protein, 21 aa, Mycobacterium
YDRPLYALGFDTIFAGPAGDF

SEQ ID NO: 755209 - protein, 25 aa, Mycobacterium
YDRRDLRETGFWRFVNDPNDPGESQ

SEQ ID NO: 755210 - protein, 19 aa, Mycobacterium
YDRREVIERALLRELDQPA

SEQ ID NO: 755211 - protein, 22 aa, Mycobacterium
YDRRWLHEQGIALTMSDIRFLK

SEQ ID NO: 755212 - protein, 22 aa, Mycobacterium
YDRRWLHEQGIALTMSDLRFLK

SEQ ID NO: 755213 - protein, 18 aa, Mycobacterium
YDRRYGLDDTHLHSIAQL

SEQ ID NO: 755214 - protein, 18 aa, Mycobacterium
YDRRYGLDDTHLRAIAAL

SEQ ID NO: 755215 - protein, 22 aa, Mycobacterium
YDRVAPGLGKRLRESALAVHGV

SEQ ID NO: 755216 - protein, 23 aa, Mycobacterium
YDSAYHLELDWWTAPFEVSEGIP

SEQ ID NO: 755217 - protein, 24 aa, Mycobacterium
YDSCEIDEILTLRVMALTDEEKLL

SEQ ID NO: 755218 - protein, 17 aa, Mycobacterium
YDSDKGFGFLSQEEGED

SEQ ID NO: 755219 - protein, 24 aa, Mycobacterium
YDSDPRKAKAATFIPEVSGAADLS

SEQ ID NO: 755220 - protein, 17 aa, Mycobacterium
YDSGARSLITALKSEEK

SEQ ID NO: 755221 - protein, 17 aa, Mycobacterium
YDSGWVIHRHFRQGNEH

SEQ ID NO: 755222 - protein, 22 aa, Mycobacterium
YDSRFPPEWRLSKKQRPNRKKK

SEQ ID NO: 755223 - protein, 21 aa, Mycobacterium
YDSRIGRRFLNAGLGFGGGCL

SEQ ID NO: 755224 - protein, 18 aa, Mycobacterium
YDSSRLLEWGVVDKVLPS

SEQ ID NO: 755225 - protein, 26 aa, Mycobacterium
YDSSRRFSVAVGHRLTPDSEPVLTKS

SEQ ID NO: 755226 - protein, 19 aa, Mycobacterium
YDTGLPLQAVCDLEPYWEA

SEQ ID NO: 755227 - protein, 19 aa, Mycobacterium
YDTGLSLAAVCALEPYWEA

SEQ ID NO: 755228 - protein, 18 aa, Mycobacterium
YDTGLYLQFRAATPDDFH

SEQ ID NO: 755229 - protein, 17 aa, Mycobacterium
YDTGLYLQFRATTPDDF

SEQ ID NO: 755230 - protein, 19 aa, Mycobacterium
YDTGVSLTSVCDLEPYWEA

SEQ ID NO: 755231 - protein, 18 aa, Mycobacterium
YDTLPGLRRRLARAQHLS

SEQ ID NO: 755232 - protein, 18 aa, Mycobacterium
YDTPSGPGVRLDSGVEAG

SEQ ID NO: 755233 - protein, 24 aa, Mycobacterium
YDTRGDTLAVRWPAALHRQITELA

SEQ ID NO: 755234 - protein, 17 aa, Mycobacterium
YDTSSAEQVRWVLEDSG

SEQ ID NO: 755235 - protein, 28 aa, Mycobacterium
YDTWLECLPRGKARRSVAVSALPSLTKV

SEQ ID NO: 755236 - protein, 24 aa, Mycobacterium
YDVPVAEYWPEFGANGKSEVTVSD

SEQ ID NO: 755237 - protein, 17 aa, Mycobacterium
YDVQERFLATLDAELYN

SEQ ID NO: 755238 - protein, 24 aa, Mycobacterium
YDVSNAFYEWVLGPSMTYTCAVYP

SEQ ID NO: 755239 - protein, 22 aa, Mycobacterium
YDVVDATAWPPGRLAEAVEAVA

SEQ ID NO: 755240 - protein, 25 aa, Mycobacterium
YDVVDGRPHLRLENRVLPAGPTVVD

SEQ ID NO: 755241 - protein, 18 aa, Mycobacterium
YDVVQWIAGQPWSDGRVV

SEQ ID NO: 755242 - protein, 17 aa, Mycobacterium
YDVYLWLLEEMKSVRYD

SEQ ID NO: 755243 - protein, 18 aa, Mycobacterium
YDWLARRYVADSGVPMLL

SEQ ID NO: 755244 - protein, 21 aa, Mycobacterium
YDWTPHTGIIIGRLDDGSRFL

SEQ ID NO: 755245 - protein, 22 aa, Mycobacterium
YDWYADLPVAAPQVFGDQTDVP

SEQ ID NO: 755246 - protein, 22 aa, Mycobacterium
YDYPQAVPIMVDWLQNLDERIP

SEQ ID NO: 755247 - protein, 36 aa, Mycobacterium
YDYTADWKLRHLIKKYSDFIAWPIRMEVEKRVPAPH

SEQ ID NO: 755248 - protein, 18 aa, Mycobacterium
YDYTYRPAPQTMYDIDVV

SEQ ID NO: 755249 - protein, 18 aa, Mycobacterium
YDYVTGCVSVPVADPDGL

SEQ ID NO: 755250 - protein, 23 aa, Mycobacterium
YEAAHTSLAWARTQLAELQAQPD

SEQ ID NO: 755251 - protein, 19 aa, Mycobacterium
YEAAIALFVDRGFETTSMD

SEQ ID NO: 755252 - protein, 17 aa, Mycobacterium
YEAFCGVVSDAAAEAAA

SEQ ID NO: 755253 - protein, 19 aa, Mycobacterium
YEAGERRIDFAFIEGLATR

SEQ ID NO: 755254 - protein, 20 aa, Mycobacterium
YEAGSGLLARATLLRERGGP

SEQ ID NO: 755255 - protein, 18 aa, Mycobacterium
YEAGYEVTQWYTAGKATG

SEQ ID NO: 755256 - protein, 17 aa, Mycobacterium
YEAILAAALRLFHEHGF

SEQ ID NO: 755257 - protein, 29 aa, Mycobacterium
YEAKTTFGRIGVKVWIYKGDIVGGKRELA

SEQ ID NO: 755258 - protein, 18 aa, Mycobacterium
YEALAYRQAERLRRSVAL

SEQ ID NO: 755259 - protein, 29 aa, Mycobacterium
YEALFGQPLPDVWHDIGFITVNRRMLVDD

SEQ ID NO: 755260 - protein, 19 aa, Mycobacterium
YEALRRFNERIVCVAITGY

SEQ ID NO: 755261 - protein, 17 aa, Mycobacterium
YEAMKLRLLNAGHQGLC

SEQ ID NO: 755262 - protein, 17 aa, Mycobacterium
YEAMMALSIASAKDVEP

SEQ ID NO: 755263 - protein, 22 aa, Mycobacterium
YEARFRPSWLPIPMRSIQRLVS

SEQ ID NO: 755264 - protein, 18 aa, Mycobacterium
YECNTCLVSNGLSTMGFA

SEQ ID NO: 755265 - protein, 18 aa, Mycobacterium
YEDAHAIAECRLTATRNV

SEQ ID NO: 755266 - protein, 25 aa, Mycobacterium
YEDIKAAIDDCWRQIDIPADDDIVI

SEQ ID NO: 755267 - protein, 17 aa, Mycobacterium
YEDLGLLPPPARSASGY

SEQ ID NO: 755268 - protein, 17 aa, Mycobacterium
YEDMASRTPQEFPSDAR

SEQ ID NO: 755269 - protein, 17 aa, Mycobacterium
YEDVGLLTADPDIGADL

SEQ ID NO: 755270 - protein, 26 aa, Mycobacterium
YEDVTGRLRVRWVPQRVLQGVSYDTP

SEQ ID NO: 755271 - protein, 17 aa, Mycobacterium
YEEGAYQVGRKGQSFLP

SEQ ID NO: 755272 - protein, 17 aa, Mycobacterium
YEEIDWDTAIVEIAEGF

SEQ ID NO: 755273 - protein, 23 aa, Mycobacterium
YEEIQKASGINVSFADLVVLGGN

SEQ ID NO: 755274 - protein, 18 aa, Mycobacterium
YEELNLLVAPMVRSGAEP

SEQ ID NO: 755275 - protein, 18 aa, Mycobacterium
YEELNLLVAPMVRTGAEP

SEQ ID NO: 755276 - protein, 20 aa, Mycobacterium
YEELNLLVAPMVRTGAEPIG

SEQ ID NO: 755277 - protein, 18 aa, Mycobacterium
YEEMWAADVSAMVGYHGG

SEQ ID NO: 755278 - protein, 25 aa, Mycobacterium
YEEMWAQDVAAMFGYHSGASAVAAA

SEQ ID NO: 755279 - protein, 25 aa, Mycobacterium
YEESWQEFREAASRIVGDAKEIESR

SEQ ID NO: 755280 - protein, 17 aa, Mycobacterium
YEEVLGLEVIQPSSRSM

SEQ ID NO: 755281 - protein, 25 aa, Mycobacterium
YEEVRRPAPGPGEVLVRVAATSFNP

SEQ ID NO: 755282 - protein, 18 aa, Mycobacterium
YEFDIDWQLAGTAEVAPP

SEQ ID NO: 755283 - protein, 25 aa, Mycobacterium
YEFGCKRPTYSNSYYRMFTKPNVHL

SEQ ID NO: 755284 - protein, 22 aa, Mycobacterium
YEFGDGHPLLGRRMPDLDVVTA

SEQ ID NO: 755285 - protein, 20 aa, Mycobacterium
YEFIECPIWAGGAGAVGPPA

SEQ ID NO: 755286 - protein, 17 aa, Mycobacterium
YEFKSWRHKNAIADAPL

SEQ ID NO: 755287 - protein, 18 aa, Mycobacterium
YEFLDGEPEFGAPSDMPL

SEQ ID NO: 755288 - protein, 25 aa, Mycobacterium
YEFVGRLRLLWRGFDGGQDVRRYIA

SEQ ID NO: 755289 - protein, 24 aa, Mycobacterium
YEFVGRLRLLWRGFDGGQEAREFI

SEQ ID NO: 755290 - protein, 17 aa, Mycobacterium
YEGEVVKTWSWQDFPQL

SEQ ID NO: 755291 - protein, 26 aa, Mycobacterium
YEGFMRDIPCPECNGTRLKPEILAVT

SEQ ID NO: 755292 - protein, 22 aa, Mycobacterium
YEGKRAYYYAKLEGPGPNGQYT

SEQ ID NO: 755293 - protein, 22 aa, Mycobacterium
YEGLPVDGYTAWLQNMAADDRI

SEQ ID NO: 755294 - protein, 18 aa, Mycobacterium
YEGLPVEGYTKWLENMAA

SEQ ID NO: 755295 - protein, 17 aa, Mycobacterium
YEGLRVDLVEAREQLVE

SEQ ID NO: 755296 - protein, 18 aa, Mycobacterium
YEGLTANEALYDWNYQHQ

SEQ ID NO: 755297 - protein, 21 aa, Mycobacterium
YEGMWASAVATMAGYHSGVSV

SEQ ID NO: 755298 - protein, 19 aa, Mycobacterium
YEGPKGGPGMREMLAITGA

SEQ ID NO: 755299 - protein, 27 aa, Mycobacterium
YEGPKGGPGMREMLAITGAIKGAGLGK

SEQ ID NO: 755300 - protein, 28 aa, Mycobacterium
YEGPKGGPGMREMLAITGAIKGAGLGKD

SEQ ID NO: 755301 - protein, 21 aa, Mycobacterium
YEGPRGGPGMQEMLYPTSFLK

SEQ ID NO: 755302 - protein, 17 aa, Mycobacterium
YEGPTGIAGVFQDACVQ

SEQ ID NO: 755303 - protein, 20 aa, Mycobacterium
YEGRPSWVRLDRVLDVPEES

SEQ ID NO: 755304 - protein, 19 aa, Mycobacterium
YEGRSSWVRLDRVLDVPEE

SEQ ID NO: 755305 - protein, 18 aa, Mycobacterium
YEGVDAFARLMVDEPTMG

SEQ ID NO: 755306 - protein, 17 aa, Mycobacterium
YEGVTMPQLPNTFMVFG

SEQ ID NO: 755307 - protein, 17 aa, Mycobacterium
YEGYLLYPYRGTSSKNQ

SEQ ID NO: 755308 - protein, 24 aa, Mycobacterium
YEHFQARCRSIHMIPFDPHLAEGA

SEQ ID NO: 755309 - protein, 24 aa, Mycobacterium
YEHGNRLRCYVVGVSRGSREPLIT

SEQ ID NO: 755310 - protein, 18 aa, Mycobacterium
YEHHFGHRFVMHMCGQDG

SEQ ID NO: 755311 - protein, 17 aa, Mycobacterium
YEHLGLCEKGEAEQLLR

SEQ ID NO: 755312 - protein, 29 aa, Mycobacterium
YEHPANLFVAGFIGSPAMNFFPATLTPIG

SEQ ID NO: 755313 - protein, 28 aa, Mycobacterium
YEHPANLFVAGFIGSPAMNFLPATLTPI

SEQ ID NO: 755314 - protein, 28 aa, Mycobacterium
YEHPYPHCWRCRNPLIYRAVSSWFVTVT

SEQ ID NO: 755315 - protein, 29 aa, Mycobacterium
YEHSYPHCWRCRNPLIYRAVSSWFVKVTQ

SEQ ID NO: 755316 - protein, 29 aa, Mycobacterium
YEHSYPHCWRCRNPLIYRAVSSWFVRVTE

SEQ ID NO: 755317 - protein, 18 aa, Mycobacterium
YEICRRLDGMPLAIELAA

SEQ ID NO: 755318 - protein, 21 aa, Mycobacterium
YEIDIAKLLDFPLMTDMRDPL

SEQ ID NO: 755319 - protein, 17 aa, Mycobacterium
YEIGLKTLGWLAGATEV

SEQ ID NO: 755320 - protein, 17 aa, Mycobacterium
YEIGVSNMLWGNDFPHP

SEQ ID NO: 755321 - protein, 17 aa, Mycobacterium
YEIKDPRLTMVTVTDTR

SEQ ID NO: 755322 - protein, 18 aa, Mycobacterium
YEILGPLPRKNIDTGMGV

SEQ ID NO: 755323 - protein, 17 aa, Mycobacterium
YEIPCTVSGTVTIGDTS

SEQ ID NO: 755324 - protein, 38 aa, Mycobacterium
YEISSADGWRAHPDRVWAWYLWRHHMMSAVGPNNAHRA

SEQ ID NO: 755325 - protein, 25 aa, Mycobacterium
YEKAHLPPGAWPPTSWYADWVSGLD

SEQ ID NO: 755326 - protein, 17 aa, Mycobacterium
YEKAPICPGEAEEGPTQ

SEQ ID NO: 755327 - protein, 23 aa, Mycobacterium
YEKGLRDIMRYHVSMTSSINFPD

SEQ ID NO: 755328 - protein, 25 aa, Mycobacterium
YEKLEAFANFGFPESHALSFASLVF

SEQ ID NO: 755329 - protein, 24 aa, Mycobacterium
YEKLEAFANFGFPESHSLSFASLV

SEQ ID NO: 755330 - protein, 17 aa, Mycobacterium
YEKNTRIAAGRVQELIA

SEQ ID NO: 755331 - protein, 17 aa, Mycobacterium
YELALAFAEEVKKAAET

SEQ ID NO: 755332 - protein, 18 aa, Mycobacterium
YELARRVATNSIGFVAPI

SEQ ID NO: 755333 - protein, 24 aa, Mycobacterium
YELDRIGARLSEPIRIALAGTLKA

SEQ ID NO: 755334 - protein, 26 aa, Mycobacterium
YELERKAVFRRAWLNVGRVEQVPRKG

SEQ ID NO: 755335 - protein, 18 aa, Mycobacterium
YELFAREVIPHFKGQLTA

SEQ ID NO: 755336 - protein, 35 aa, Mycobacterium
YELGSLIWRSRWVTTDGIVECREALAFPGDPHTAV

SEQ ID NO: 755337 - protein, 19 aa, Mycobacterium
YELIDPGGQRWVMQTWSQV

SEQ ID NO: 755338 - protein, 29 aa, Mycobacterium
YELLDCRLTDAGFTWYEVSNWSRPDGECR

SEQ ID NO: 755339 - protein, 23 aa, Mycobacterium
YELLKLRVEVFVVEQATPYPELD

SEQ ID NO: 755340 - protein, 19 aa, Mycobacterium
YELLPAWDQAEVVFDALVE

SEQ ID NO: 755341 - protein, 23 aa, Mycobacterium
YELLPAWDRAGVVFDALVAAVRA

SEQ ID NO: 755342 - protein, 19 aa, Mycobacterium
YELLPSWDDAGAVFDALLP

SEQ ID NO: 755343 - protein, 17 aa, Mycobacterium
YELLRYADYNQFDSDIY

SEQ ID NO: 755344 - protein, 24 aa, Mycobacterium
YELPHGLRFTELLALHGVSSEQVR

SEQ ID NO: 755345 - protein, 24 aa, Mycobacterium
YELQRRLAPRGKTIAVAAHPGTST

SEQ ID NO: 755346 - protein, 17 aa, Mycobacterium
YELSYGFCLPTVTVAGP

SEQ ID NO: 755347 - protein, 20 aa, Mycobacterium
YELVGCYAWSADKVGRDAGE

SEQ ID NO: 755348 - protein, 18 aa, Mycobacterium
YELVQRLTAQPKYVQGGA

SEQ ID NO: 755349 - protein, 29 aa, Mycobacterium
YEMIDFLIRKGVRLIRCAGWSDYYPNHNG

SEQ ID NO: 755350 - protein, 20 aa, Mycobacterium
YEMLARADSVGVFQVESRAQ

SEQ ID NO: 755351 - protein, 18 aa, Mycobacterium
YEMRPDWSRTYAHGNELK

SEQ ID NO: 755352 - protein, 25 aa, Mycobacterium
YENVLGFRFWWELDPPDGPTAKLVQ

SEQ ID NO: 755353 - protein, 32 aa, Mycobacterium
YEPETSVALGFGFRCGFLGLLHMEISRERLER

SEQ ID NO: 755354 - protein, 21 aa, Mycobacterium
YEPGLRKLLRDNLAAGRLHFT

SEQ ID NO: 755355 - protein, 17 aa, Mycobacterium
YEPGMVAAMSARRVESS

SEQ ID NO: 755356 - protein, 17 aa, Mycobacterium
YEPGPICVEGEPATCFY

SEQ ID NO: 755357 - protein, 26 aa, Mycobacterium
YEPGSLIWRDRWITRDGIIECREALA

SEQ ID NO: 755358 - protein, 25 aa, Mycobacterium
YEPKWDGFRSICFRDGDDVELGSRN

SEQ ID NO: 755359 - protein, 25 aa, Mycobacterium
YEPKWDGFRSICFRDGDEVELGSRN

SEQ ID NO: 755360 - protein, 28 aa, Mycobacterium
YEPLLKRLPEGTPMFGFERVEGTIEERA

SEQ ID NO: 755361 - protein, 26 aa, Mycobacterium
YEPLMKRLPADVPVYGLERVEGSIEE

SEQ ID NO: 755362 - protein, 25 aa, Mycobacterium
YEPLSGADFPAGWQKLNGTQALSFV

SEQ ID NO: 755363 - protein, 26 aa, Mycobacterium
YEPPVTAPRARVRRRAAARPAGPPSH

SEQ ID NO: 755364 - protein, 25 aa, Mycobacterium
YEPRTLIWRSRWVTDDGIVECREAL

SEQ ID NO: 755365 - protein, 18 aa, Mycobacterium
YEPVHAVTYFAPEARAAL

SEQ ID NO: 755366 - protein, 18 aa, Mycobacterium
YEPVMGMEVHVELSTATK

SEQ ID NO: 755367 - protein, 17 aa, Mycobacterium
YEQCVGVTYQYLHADTD

SEQ ID NO: 755368 - protein, 19 aa, Mycobacterium
YEQDVVWPQVELAISREEL

SEQ ID NO: 755369 - protein, 25 aa, Mycobacterium
YEQIIDRLIEWVAFTPLQNATGEPA

SEQ ID NO: 755370 - protein, 18 aa, Mycobacterium
YEQLRAGIGAVFASWNSP

SEQ ID NO: 755371 - protein, 20 aa, Mycobacterium
YEQPEPMAPYLATLQIGDYQ

SEQ ID NO: 755372 - protein, 17 aa, Mycobacterium
YEQRPPAGYGPPPGYPD

SEQ ID NO: 755373 - protein, 26 aa, Mycobacterium
YERALELGCGTGFFLLNLIQAGVARR

SEQ ID NO: 755374 - protein, 20 aa, Mycobacterium
YERDGEWVLAIGARASVELD

SEQ ID NO: 755375 - protein, 22 aa, Mycobacterium
YERDGRTWLRAGAGIIEASQPE

SEQ ID NO: 755376 - protein, 22 aa, Mycobacterium
YERDGRTWLRAGAGIIEESTPE

SEQ ID NO: 755377 - protein, 18 aa, Mycobacterium
YERFAGLVSPSLGKTFWG

SEQ ID NO: 755378 - protein, 25 aa, Mycobacterium
YERFWSHFAARDWAAVGTIVSESLS

SEQ ID NO: 755379 - protein, 20 aa, Mycobacterium
YERHIACTRLPALQETMRRS

SEQ ID NO: 755380 - protein, 20 aa, Mycobacterium
YERHRIAAGVALRGISGFGT

SEQ ID NO: 755381 - protein, 17 aa, Mycobacterium
YERISGLRFDDWIGGAA

SEQ ID NO: 755382 - protein, 25 aa, Mycobacterium
YERIVPRPTTPFAQALRLALIDAAP

SEQ ID NO: 755383 - protein, 18 aa, Mycobacterium
YERLGIPTIATVPWTTDR

SEQ ID NO: 755384 - protein, 19 aa, Mycobacterium
YERLHAAITRLNRNMQRNP

SEQ ID NO: 755385 - protein, 23 aa, Mycobacterium
YERLKRRLQIELLKLQRHSKRTG

SEQ ID NO: 755386 - protein, 21 aa, Mycobacterium
YERNIACTRLPALRESMRRSL

SEQ ID NO: 755387 - protein, 26 aa, Mycobacterium
YERPRAEGPWAIGHGMATCTMGSFRF

SEQ ID NO: 755388 - protein, 19 aa, Mycobacterium
YERSGEWVLATGVHAMIEL

SEQ ID NO: 755389 - protein, 22 aa, Mycobacterium
YERSLVAFCRNLAAQIEEPVLA

SEQ ID NO: 755390 - protein, 17 aa, Mycobacterium
YERTLIGRALDFWNEEL

SEQ ID NO: 755391 - protein, 24 aa, Mycobacterium
YERVKPVFKKWASMVVRAGEPGAG

SEQ ID NO: 755392 - protein, 23 aa, Mycobacterium
YERWKETAFQYAWLLAAAGCDDS

SEQ ID NO: 755393 - protein, 23 aa, Mycobacterium
YERWKETAFQYAWLLAAAGCDTE

SEQ ID NO: 755394 - protein, 23 aa, Mycobacterium
YERWKETAFQYAWLLDVAKAETG

SEQ ID NO: 755395 - protein, 18 aa, Mycobacterium
YERYAEWKKVQRPLINPS

SEQ ID NO: 755396 - protein, 18 aa, Mycobacterium
YERYIACARQPGLRDIQR

SEQ ID NO: 755397 - protein, 22 aa, Mycobacterium
YESAETWQALGMGQPEVTPEVA

SEQ ID NO: 755398 - protein, 17 aa, Mycobacterium
YESARGIKLLRREPLGT

SEQ ID NO: 755399 - protein, 23 aa, Mycobacterium
YESHWRRKLLRRETLNTYDSILA

SEQ ID NO: 755400 - protein, 19 aa, Mycobacterium
YESLLKGGTFGVGTLPIPG

SEQ ID NO: 755401 - protein, 18 aa, Mycobacterium
YESLRWLPDTEVRFVWHE

SEQ ID NO: 755402 - protein, 24 aa, Mycobacterium
YESNVVAVLGMPVGKVTKITPMPG

SEQ ID NO: 755403 - protein, 21 aa, Mycobacterium
YESRTAPWVIGEPQPAVVELE

SEQ ID NO: 755404 - protein, 21 aa, Mycobacterium
YESVFGWPVLLEVPDNADEAT

SEQ ID NO: 755405 - protein, 21 aa, Mycobacterium
YESVFSWPVLIEVPDNADDAT

SEQ ID NO: 755406 - protein, 19 aa, Mycobacterium
YETAYAFFVSGLGFKVSDL

SEQ ID NO: 755407 - protein, 25 aa, Mycobacterium
YETGLAELCTLTWTVYSLPGAPILD

SEQ ID NO: 755408 - protein, 20 aa, Mycobacterium
YETGVAFSFSVFPFMGSGFV

SEQ ID NO: 755409 - protein, 18 aa, Mycobacterium
YETLRRINDQIVMLHITG

SEQ ID NO: 755410 - protein, 26 aa, Mycobacterium
YETPPGLQLLHCIAFDAAVTGGQTWF

SEQ ID NO: 755411 - protein, 20 aa, Mycobacterium
YEVAHDGRLLAAHMVNGIVI

SEQ ID NO: 755412 - protein, 20 aa, Mycobacterium
YEVALDFPVSRRVRQESKTL

SEQ ID NO: 755413 - protein, 25 aa, Mycobacterium
YEVARLLTHPRFLAQVRAEFPAGEN

SEQ ID NO: 755414 - protein, 20 aa, Mycobacterium
YEVARLSLSPAVVAAVTAEF

SEQ ID NO: 755415 - protein, 18 aa, Mycobacterium
YEVASGWIEPGTMGGMRF

SEQ ID NO: 755416 - protein, 24 aa, Mycobacterium
YEVDLAGCKRVTMQNVAGWKNVPV

SEQ ID NO: 755417 - protein, 23 aa, Mycobacterium
YEVDWAGCRRVNMQNVAGWNNVP

SEQ ID NO: 755418 - protein, 23 aa, Mycobacterium
YEVEIGLVIGRAIPLGTNLSDAN

SEQ ID NO: 755419 - protein, 20 aa, Mycobacterium
YEVGARLAGARVQRADSLTQ

SEQ ID NO: 755420 - protein, 18 aa, Mycobacterium
YEVILGNGGSTAFWDAAA

SEQ ID NO: 755421 - protein, 26 aa, Mycobacterium
YEVKGCIAHGGLGWVYLAVDHNVNDR

SEQ ID NO: 755422 - protein, 27 aa, Mycobacterium
YEVKGCIAHGGLGWVYLAVDKNVNDRP

SEQ ID NO: 755423 - protein, 28 aa, Mycobacterium
YEVKGCIAHGGMGWVYLALDHNVNDRPV

SEQ ID NO: 755424 - protein, 21 aa, Mycobacterium
YEVLRDALGRRGVDVVPAMTR

SEQ ID NO: 755425 - protein, 17 aa, Mycobacterium
YEVLRRMRARNVWTPVL

SEQ ID NO: 755426 - protein, 25 aa, Mycobacterium
YEVMDRLKPGIIMCREKQDTTSANL

SEQ ID NO: 755427 - protein, 22 aa, Mycobacterium
YEVNEAFAPVPLAWLRDIGADE

SEQ ID NO: 755428 - protein, 20 aa, Mycobacterium
YEVPARIFVVDELPRGAALK

SEQ ID NO: 755429 - protein, 17 aa, Mycobacterium
YEVPVDFVVETEPFSED

SEQ ID NO: 755430 - protein, 23 aa, Mycobacterium
YEVSPVLWKKVGRNLSAGRVQSV

SEQ ID NO: 755431 - protein, 25 aa, Mycobacterium
YEVVNRLKPGIIMCREKQDSTSAVL

SEQ ID NO: 755432 - protein, 19 aa, Mycobacterium
YEVVSGMADMGLFGLPFPE

SEQ ID NO: 755433 - protein, 18 aa, Mycobacterium
YEVVTAVLGAIRREMDRL

SEQ ID NO: 755434 - protein, 23 aa, Mycobacterium
YEWAPLRLPPEVTRLSASTRLSI

SEQ ID NO: 755435 - protein, 25 aa, Mycobacterium
YEWFSQPDFRGCMFINTAGELGGTS

SEQ ID NO: 755436 - protein, 24 aa, Mycobacterium
YEWPADRQSLSWTLQSSSLLKALE

SEQ ID NO: 755437 - protein, 27 aa, Mycobacterium
YEWRTRSGCYFCFYQRKAEWVGLAEKH

SEQ ID NO: 755438 - protein, 20 aa, Mycobacterium
YEYDGQWVLALGVQTMVELD

SEQ ID NO: 755439 - protein, 20 aa, Mycobacterium
YEYGFFWYLYNDAGIEMEVK

SEQ ID NO: 755440 - protein, 21 aa, Mycobacterium
YEYGRPWSVEEFELDPPKAGE

SEQ ID NO: 755441 - protein, 20 aa, Mycobacterium
YEYGRPWTVDEFDLDPPRSG

SEQ ID NO: 755442 - protein, 17 aa, Mycobacterium
YEYKKAFDAEALAYETP

SEQ ID NO: 755443 - protein, 18 aa, Mycobacterium
YEYKKAFDAESLGYETPL

SEQ ID NO: 755444 - protein, 28 aa, Mycobacterium
YEYPEGKRAGLWPGLRETFKSGTSEPPL

SEQ ID NO: 755445 - protein, 17 aa, Mycobacterium
YFAAEAGDESWGYQSVL

SEQ ID NO: 755446 - protein, 17 aa, Mycobacterium
YFAAWGVYVIVGYEQST

SEQ ID NO: 755447 - protein, 17 aa, Mycobacterium
YFADVGINLDSRLRVLA

SEQ ID NO: 755448 - protein, 18 aa, Mycobacterium
YFAERARGGVALIITGGY

SEQ ID NO: 755449 - protein, 21 aa, Mycobacterium
YFAESFVKRGLVVDGGGCYLL

SEQ ID NO: 755450 - protein, 17 aa, Mycobacterium
YFAEVNLVGFYDLASEL

SEQ ID NO: 755451 - protein, 27 aa, Mycobacterium
YFAGARISRFYPFGAPFDGGALFVTVA

SEQ ID NO: 755452 - protein, 18 aa, Mycobacterium
YFALAMLTGDGRRRVGTG

SEQ ID NO: 755453 - protein, 18 aa, Mycobacterium
YFASAFADAGARYIGVEP

SEQ ID NO: 755454 - protein, 23 aa, Mycobacterium
YFASWFERYARSFGGTIAGGTSE

SEQ ID NO: 755455 - protein, 24 aa, Mycobacterium
YFASWFERYARSFSGTIAGGTSEI

SEQ ID NO: 755456 - protein, 17 aa, Mycobacterium
YFCDPHSPWQRGSNENT

SEQ ID NO: 755457 - protein, 22 aa, Mycobacterium
YFCELYDLRTLWQVAAHNPWLS

SEQ ID NO: 755458 - protein, 22 aa, Mycobacterium
YFCPHHRSYGAGAMEAYAEMID

SEQ ID NO: 755459 - protein, 27 aa, Mycobacterium
YFDCPGHPALSLLRTGAAAGFTVVALD

SEQ ID NO: 755460 - protein, 24 aa, Mycobacterium
YFDCPGHPSSSLLRSGAAAGFTVV

SEQ ID NO: 755461 - protein, 18 aa, Mycobacterium
YFDDLFLMAAEKRFLSVE

SEQ ID NO: 755462 - protein, 24 aa, Mycobacterium
YFDFTFAGLPAYRQHLGRKVRFMA

SEQ ID NO: 755463 - protein, 17 aa, Mycobacterium
YFDHLRSKCPVVKEPHY

SEQ ID NO: 755464 - protein, 20 aa, Mycobacterium
YFDIPLIMLHHFPMRPNGQL

SEQ ID NO: 755465 - protein, 20 aa, Mycobacterium
YFDSLIGWERYRASQFGIAH

SEQ ID NO: 755466 - protein, 23 aa, Mycobacterium
YFDSPRFEGIIRLYTARQVAEQR

SEQ ID NO: 755467 - protein, 19 aa, Mycobacterium
YFECAWAGNAAKAVFYCRR

SEQ ID NO: 755468 - protein, 17 aa, Mycobacterium
YFEELREGDRVSVKPHA

SEQ ID NO: 755469 - protein, 19 aa, Mycobacterium
YFEKPRTTIGWKGLINDPG

SEQ ID NO: 755470 - protein, 23 aa, Mycobacterium
YFEMLGRPWRDARKLTVPGVAQA

SEQ ID NO: 755471 - protein, 20 aa, Mycobacterium
YFEMLGRPWRDARRLTVPGV

SEQ ID NO: 755472 - protein, 17 aa, Mycobacterium
YFEMLGRPWRTERRPTV

SEQ ID NO: 755473 - protein, 18 aa, Mycobacterium
YFFGRFCQAIRRKRELPR

SEQ ID NO: 755474 - protein, 18 aa, Mycobacterium
YFFRDGRGPGGVRPPNNW

SEQ ID NO: 755475 - protein, 25 aa, Mycobacterium
YFFVVELLDAASFWQSVRSGVLESL

SEQ ID NO: 755476 - protein, 18 aa, Mycobacterium
YFGAHSFNQLMPVLGAEG

SEQ ID NO: 755477 - protein, 17 aa, Mycobacterium
YFGDGAVAEGAFHESLN

SEQ ID NO: 755478 - protein, 24 aa, Mycobacterium
YFGDLRTGMLGVWIGAIQNMYPEL

SEQ ID NO: 755479 - protein, 18 aa, Mycobacterium
YFGDNRMYLIGPRPAVLQ

SEQ ID NO: 755480 - protein, 19 aa, Mycobacterium
YFGEMGVLFHMPRSATVRA

SEQ ID NO: 755481 - protein, 21 aa, Mycobacterium
YFGGEAVPLFGWNSVTVPGAV

SEQ ID NO: 755482 - protein, 19 aa, Mycobacterium
YFGGNAIPLVGWNAVTVPG

SEQ ID NO: 755483 - protein, 18 aa, Mycobacterium
YFGPRPKNPLNYVTKPQH

SEQ ID NO: 755484 - protein, 27 aa, Mycobacterium
YFGVRLPAPVPYRSFITWLSEQDRAAA

SEQ ID NO: 755485 - protein, 22 aa, Mycobacterium
YFHLPAELIGGGTKEIQLNIIA

SEQ ID NO: 755486 - protein, 20 aa, Mycobacterium
YFHQPCDLGRAGLPEEVASI

SEQ ID NO: 755487 - protein, 24 aa, Mycobacterium
YFLCAHPSLSPASAVALTLRAVGG

SEQ ID NO: 755488 - protein, 31 aa, Mycobacterium
YFLDRGLRDTGRWRVPLILRLDPQVGPEDIR

SEQ ID NO: 755489 - protein, 18 aa, Mycobacterium
YFLPDAVAANVAVSEQQW

SEQ ID NO: 755490 - protein, 17 aa, Mycobacterium
YFLTHWARDRASGRFSV

SEQ ID NO: 755491 - protein, 17 aa, Mycobacterium
YFLWLRAQTDRWLAGDE

SEQ ID NO: 755492 - protein, 25 aa, Mycobacterium
YFNAFPASYWRRWSTLENVVLHIEL

SEQ ID NO: 755493 - protein, 20 aa, Mycobacterium
YFPLGSALPGFPKVADDPVV

SEQ ID NO: 755494 - protein, 17 aa, Mycobacterium
YFPPDSRPGAKTPGAPV

SEQ ID NO: 755495 - protein, 18 aa, Mycobacterium
YFPPEIRAFFDYVKQEQQ

SEQ ID NO: 755496 - protein, 28 aa, Mycobacterium
YFPPRARGFAPFPLEPARLIMERAGSLV

SEQ ID NO: 755497 - protein, 19 aa, Mycobacterium
YFPSKVHLLVSALEREFEQ

SEQ ID NO: 755498 - protein, 25 aa, Mycobacterium
YFQAYAAACALHFAEKALAEIRAGR

SEQ ID NO: 755499 - protein, 17 aa, Mycobacterium
YFQFPVAKYGLALDNWS

SEQ ID NO: 755500 - protein, 33 aa, Mycobacterium
YFRASERGIISIRHVADRMPPLADAMSAAKRSI

SEQ ID NO: 755501 - protein, 25 aa, Mycobacterium
YFRASGVPLLAVWGRGDEIFGPAGA

SEQ ID NO: 755502 - protein, 17 aa, Mycobacterium
YFRDFWGADSGMLAALY

SEQ ID NO: 755503 - protein, 33 aa, Mycobacterium
YFRDHGWSLKVPRRLKELNVRLNAARADLTQEL

SEQ ID NO: 755504 - protein, 21 aa, Mycobacterium
YFRPAPEANTIVWLIWHTGRM

SEQ ID NO: 755505 - protein, 22 aa, Mycobacterium
YFRQFLRRRAALAVNASSTDED

SEQ ID NO: 755506 - protein, 24 aa, Mycobacterium
YFRTAHGIFGWGLQLTDRPGAFTI

SEQ ID NO: 755507 - protein, 23 aa, Mycobacterium
YFRTRKALLHAIATRLAELDVAD

SEQ ID NO: 755508 - protein, 19 aa, Mycobacterium
YFSAARRGLVPGPFQFLRV

SEQ ID NO: 755509 - protein, 19 aa, Mycobacterium
YFSAPKMAWIRANLTRDGV

SEQ ID NO: 755510 - protein, 23 aa, Mycobacterium
YFSEAFAEAGIRYLGVEPDPSEM

SEQ ID NO: 755511 - protein, 25 aa, Mycobacterium
YFSRKDARAYLEFAQQLDAAMDLAL

SEQ ID NO: 755512 - protein, 18 aa, Mycobacterium
YFSSIKDLTRLLGGPAHR

SEQ ID NO: 755513 - protein, 26 aa, Mycobacterium
YFTATGRPTGEWAAAVKRLQAADAEV

SEQ ID NO: 755514 - protein, 23 aa, Mycobacterium
YFTHWGGAFKFAASVLGLPIGAY

SEQ ID NO: 755515 - protein, 23 aa, Mycobacterium
YFTHWGGAFKYAASLLGLPIGAY

SEQ ID NO: 755516 - protein, 18 aa, Mycobacterium
YFTITGVQWEIYKQQLDG

SEQ ID NO: 755517 - protein, 23 aa, Mycobacterium
YFTNDRLGSIVLFVRDEAPTVLT

SEQ ID NO: 755518 - protein, 20 aa, Mycobacterium
YFTRMLAGLGDALGFDVDTP

SEQ ID NO: 755519 - protein, 17 aa, Mycobacterium
YFTRMMAGLGDELGFDV

SEQ ID NO: 755520 - protein, 17 aa, Mycobacterium
YFTRMMAGLGDEMGFDV

SEQ ID NO: 755521 - protein, 19 aa, Mycobacterium
YFTSRWPHEPVDFTGKRVG

SEQ ID NO: 755522 - protein, 18 aa, Mycobacterium
YFTVLPLAKRMESAGLAY

SEQ ID NO: 755523 - protein, 20 aa, Mycobacterium
YFVAEVLRIISGGRIIWDPA

SEQ ID NO: 755524 - protein, 17 aa, Mycobacterium
YFVERLVDCLAYELKMD

SEQ ID NO: 755525 - protein, 17 aa, Mycobacterium
YFVPKMLYGPGVAADPE

SEQ ID NO: 755526 - protein, 18 aa, Mycobacterium
YFVRMWNQAALAMDVYQA

SEQ ID NO: 755527 - protein, 19 aa, Mycobacterium
YFVYRLIKRLKKSANNAPY

SEQ ID NO: 755528 - protein, 20 aa, Mycobacterium
YFVYRLIKRLKKSANNAPYH

SEQ ID NO: 755529 - protein, 32 aa, Mycobacterium
YFYRLRRGELFGCGLGRLKPPKGKRWGEVKCY

SEQ ID NO: 755530 - protein, 17 aa, Mycobacterium
YGAACAGLMGLDIDEVH

SEQ ID NO: 755531 - protein, 17 aa, Mycobacterium
YGAAGFTQYQFVVPTTA

SEQ ID NO: 755532 - protein, 20 aa, Mycobacterium
YGAAGVAMGTRFLLTSDSSV

SEQ ID NO: 755533 - protein, 20 aa, Mycobacterium
YGAAGVAMGTRFLLTSDSTV

SEQ ID NO: 755534 - protein, 17 aa, Mycobacterium
YGAAGYAVLERTIAALR

SEQ ID NO: 755535 - protein, 17 aa, Mycobacterium
YGAALGWPTDSEAHRPG

SEQ ID NO: 755536 - protein, 17 aa, Mycobacterium
YGAALPWPSRGTDGDTA

SEQ ID NO: 755537 - protein, 22 aa, Mycobacterium
YGACPECAGLGIKKEVDPDLVV

SEQ ID NO: 755538 - protein, 18 aa, Mycobacterium
YGACRSLGLLDAVIERAA

SEQ ID NO: 755539 - protein, 19 aa, Mycobacterium
YGADAIIYGTGFAIPDQLP

SEQ ID NO: 755540 - protein, 23 aa, Mycobacterium
YGAECATWRNFFLSGATELAAGN

SEQ ID NO: 755541 - protein, 25 aa, Mycobacterium
YGAEMLVEIARFWVGLASFDEARDR

SEQ ID NO: 755542 - protein, 24 aa, Mycobacterium
YGAEMLVEITKFWVSAANLDPHRD

SEQ ID NO: 755543 - protein, 26 aa, Mycobacterium
YGAFTEWPVPAELALPLPVGQVRMRI

SEQ ID NO: 755544 - protein, 17 aa, Mycobacterium
YGAGKVIIWDAGTYDVE

SEQ ID NO: 755545 - protein, 18 aa, Mycobacterium
YGAITAPTLVVWTSDDPT

SEQ ID NO: 755546 - protein, 25 aa, Mycobacterium
YGALKARLADRWTDRLAAATRDAVA

SEQ ID NO: 755547 - protein, 23 aa, Mycobacterium
YGALRKLLAVPILLGAESRSGVP

SEQ ID NO: 755548 - protein, 25 aa, Mycobacterium
YGAQFITWRGIPIVPSDKVPVEDGT

SEQ ID NO: 755549 - protein, 17 aa, Mycobacterium
YGARMAGVVFPGETLRV

SEQ ID NO: 755550 - protein, 21 aa, Mycobacterium
YGASPRASLGIISAARALALV

SEQ ID NO: 755551 - protein, 35 aa, Mycobacterium
YGASPRATIAFCESARALALLRGRNHVRPEDIQHL

SEQ ID NO: 755552 - protein, 34 aa, Mycobacterium
YGASPRATIAFCKAARALALLADRNHVLPDDIKA

SEQ ID NO: 755553 - protein, 26 aa, Mycobacterium
YGASWSIGGLSRWGHLQNRPVGPIFF

SEQ ID NO: 755554 - protein, 19 aa, Mycobacterium
YGAVWQREDIGVITTVIDV

SEQ ID NO: 755555 - protein, 17 aa, Mycobacterium
YGAWFDRYTRTFAATIA

SEQ ID NO: 755556 - protein, 27 aa, Mycobacterium
YGAYDIPGAWLARGGVPVYERAVLIRD

SEQ ID NO: 755557 - protein, 28 aa, Mycobacterium
YGAYEICTDPSFSIARLSLLDRGMVFAI

SEQ ID NO: 755558 - protein, 40 aa, Mycobacterium
YGAYEICTDPSFSIARLSLLDRGMVFAIAHVRGGGEMGRL

SEQ ID NO: 755559 - protein, 17 aa, Mycobacterium
YGCPTFVHPADRHMLTD

SEQ ID NO: 755560 - protein, 17 aa, Mycobacterium
YGCSGPIPAAPNGANLV

SEQ ID NO: 755561 - protein, 24 aa, Mycobacterium
YGDAELPWARALDAMKALPSEETP

SEQ ID NO: 755562 - protein, 20 aa, Mycobacterium
YGDCGQELFGVVGRCPGYDA

SEQ ID NO: 755563 - protein, 20 aa, Mycobacterium
YGDFRLVEMLGRRNAQDTTA

SEQ ID NO: 755564 - protein, 20 aa, Mycobacterium
YGDGGLHVGWLSSGDHVVGL

SEQ ID NO: 755565 - protein, 22 aa, Mycobacterium
YGDGQIGQWRARAMALVMLALP

SEQ ID NO: 755566 - protein, 21 aa, Mycobacterium
YGDGSLSAGIFNTGTHNAGLL

SEQ ID NO: 755567 - protein, 24 aa, Mycobacterium
YGDLFPHAVKWRGVTYLEDGLHRA

SEQ ID NO: 755568 - protein, 18 aa, Mycobacterium
YGDLLPVVLLDGTEHSYW

SEQ ID NO: 755569 - protein, 19 aa, Mycobacterium
YGDRLPVVLLDGVEHSYWE

SEQ ID NO: 755570 - protein, 19 aa, Mycobacterium
YGDVVTLDIPVFGRTVLVT

SEQ ID NO: 755571 - protein, 24 aa, Mycobacterium
YGEELCAWVRMRPDRVVIDAVAIR

SEQ ID NO: 755572 - protein, 26 aa, Mycobacterium
YGEEVCAWIRMRPGRTALDAAAVREF

SEQ ID NO: 755573 - protein, 23 aa, Mycobacterium
YGEGIRASLRYQYYETSDGNYVV

SEQ ID NO: 755574 - protein, 23 aa, Mycobacterium
YGEGMANFFRMVHLAGVTTCLDM

SEQ ID NO: 755575 - protein, 18 aa, Mycobacterium
YGELDRTRVVACLHSLAR

SEQ ID NO: 755576 - protein, 25 aa, Mycobacterium
YGELRYPDLADWGIPTAQAIVEVRQ

SEQ ID NO: 755577 - protein, 25 aa, Mycobacterium
YGEPAHAALTAWLHEGRPALATADS

SEQ ID NO: 755578 - protein, 21 aa, Mycobacterium
YGEPELTDFGIARMSGGFQTA

SEQ ID NO: 755579 - protein, 17 aa, Mycobacterium
YGERVAVVLSGLRKLES

SEQ ID NO: 755580 - protein, 23 aa, Mycobacterium
YGETKLIGEWLLRDAGRASGLRH

SEQ ID NO: 755581 - protein, 19 aa, Mycobacterium
YGEVLLVRMGDAGPEATVF

SEQ ID NO: 755582 - protein, 24 aa, Mycobacterium
YGEVLPLPMVSWLYEHGNFRRFTH

SEQ ID NO: 755583 - protein, 20 aa, Mycobacterium
YGEVMRWALLGSEERMSAQT

SEQ ID NO: 755584 - protein, 25 aa, Mycobacterium
YGEVRRDRCGPSRLRRLRGQVAEAM

SEQ ID NO: 755585 - protein, 22 aa, Mycobacterium
YGFARQRFWLGGGRDALPAKAG

SEQ ID NO: 755586 - protein, 22 aa, Mycobacterium
YGFDSFQFFPNFVLIFGSSGFS

SEQ ID NO: 755587 - protein, 17 aa, Mycobacterium
YGFGAHTDLEWIEAVAG

SEQ ID NO: 755588 - protein, 27 aa, Mycobacterium
YGFGCKRPSFSNTYLKTFNRPNVALVT

SEQ ID NO: 755589 - protein, 21 aa, Mycobacterium
YGFGSMVMSLLGFDHQSATFA

SEQ ID NO: 755590 - protein, 21 aa, Mycobacterium
YGFGSMVMSLLGFDHQVATFA

SEQ ID NO: 755591 - protein, 20 aa, Mycobacterium
YGFGSMVMSLLGFDNQSATF

SEQ ID NO: 755592 - protein, 31 aa, Mycobacterium
YGFLSENSEFVWACTAAGYTFVGPDADVLDL

SEQ ID NO: 755593 - protein, 20 aa, Mycobacterium
YGGAGARGFSPVPTLYTEDD

SEQ ID NO: 755594 - protein, 19 aa, Mycobacterium
YGGAGSFEQPGGTGGAGGT

SEQ ID NO: 755595 - protein, 18 aa, Mycobacterium
YGGALLPRLVTGGEAARL

SEQ ID NO: 755596 - protein, 18 aa, Mycobacterium
YGGATTWASTVAAYEQLP

SEQ ID NO: 755597 - protein, 18 aa, Mycobacterium
YGGCKSWVDLPVRAETAA

SEQ ID NO: 755598 - protein, 17 aa, Mycobacterium
YGGGMKICPGADPRDGL

SEQ ID NO: 755599 - protein, 17 aa, Mycobacterium
YGGGSQYYSMWVVGADK

SEQ ID NO: 755600 - protein, 18 aa, Mycobacterium
YGGHLARLGFPGNGPTGC

SEQ ID NO: 755601 - protein, 18 aa, Mycobacterium
YGGLLARIASATQRLGQQ

SEQ ID NO: 755602 - protein, 22 aa, Mycobacterium
YGGLRAARRLGVPTVAVYQTDV

SEQ ID NO: 755603 - protein, 17 aa, Mycobacterium
YGGQGLAYEYQRAFDEE

SEQ ID NO: 755604 - protein, 18 aa, Mycobacterium
YGGQGLPYEYQRAFDEES

SEQ ID NO: 755605 - protein, 34 aa, Mycobacterium
YGGSKVGLPLVRRALELLPDVGFVNAYGLTETSS

SEQ ID NO: 755606 - protein, 34 aa, Mycobacterium; identical to SEQ ID NO: 143533

SEQ ID NO: 755607 - protein, 18 aa, Mycobacterium
YGGSTLWASTVAAYQHLP

SEQ ID NO: 755608 - protein, 17 aa, Mycobacterium
YGGTFRLIDKVFTQWGV

SEQ ID NO: 755609 - protein, 23 aa, Mycobacterium
YGGTFRLIDKVFTQWNVDYTPVA

SEQ ID NO: 755610 - protein, 18 aa, Mycobacterium
YGGTTAWASTEAAYDRLP

SEQ ID NO: 755611 - protein, 20 aa, Mycobacterium
YGGVFTLRVAGVGTIVYLAD

SEQ ID NO: 755612 - protein, 24 aa, Mycobacterium
YGGYLRASLPPFWQTTNGAQVREA

SEQ ID NO: 755613 - protein, 17 aa, Mycobacterium
YGHAFKTFVEKFPTVLS

SEQ ID NO: 755614 - protein, 19 aa, Mycobacterium
YGHFEGHLSLHYKVAIPED

SEQ ID NO: 755615 - protein, 18 aa, Mycobacterium
YGHTEAWQLAERQSAQIG

SEQ ID NO: 755616 - protein, 17 aa, Mycobacterium
YGHTRAWQIAEEQSGKI

SEQ ID NO: 755617 - protein, 24 aa, Mycobacterium
YGIAPRYPADFVLDIMNNRLPQVS

SEQ ID NO: 755618 - protein, 26 aa, Mycobacterium
YGIDDARAFEVLKLSSQLAQVKLATV

SEQ ID NO: 755619 - protein, 25 aa, Mycobacterium
YGIDESTAFVLLKWRSQENNVKLRP

SEQ ID NO: 755620 - protein, 18 aa, Mycobacterium
YGIDPEDVAGVLAEYGWR

SEQ ID NO: 755621 - protein, 18 aa, Mycobacterium
YGIGLDYRVEGITTVTGS

SEQ ID NO: 755622 - protein, 17 aa, Mycobacterium
YGIMYRGAVAVPMNPLL

SEQ ID NO: 755623 - protein, 17 aa, Mycobacterium
YGIPGVAVGVWAGGQEY

SEQ ID NO: 755624 - protein, 26 aa, Mycobacterium
YGISAERAFDILVWRSQESNLKVRDV

SEQ ID NO: 755625 - protein, 26 aa, Mycobacterium
YGISARRAFDILVWRSQETNLKLRDL

SEQ ID NO: 755626 - protein, 34 aa, Mycobacterium
YGIVFPDWKPVDFKVWPAENGFVQRYRWEGTNAN

SEQ ID NO: 755627 - protein, 22 aa, Mycobacterium
YGKDGYAQLVLRSSGTPVSGSA

SEQ ID NO: 755628 - protein, 25 aa, Mycobacterium
YGKISSRGLPHWADPGARRPGEINH

SEQ ID NO: 755629 - protein, 31 aa, Mycobacterium
YGKTPTQVLLRWNLQLGNAVIFGSSNAEHIA

SEQ ID NO: 755630 - protein, 18 aa, Mycobacterium
YGKVAWDVRAIWENYSGW

SEQ ID NO: 755631 - protein, 18 aa, Mycobacterium
YGLAAADGVMRWLEEHQR

SEQ ID NO: 755632 - protein, 18 aa, Mycobacterium
YGLAAADGVMRWLEEQER

SEQ ID NO: 755633 - protein, 17 aa, Mycobacterium
YGLAAADGVMRWLEERG

SEQ ID NO: 755634 - protein, 17 aa, Mycobacterium
YGLDGELTFIQQEDEFF

SEQ ID NO: 755635 - protein, 21 aa, Mycobacterium
YGLDPDRIWTTVYFDDDEAVR

SEQ ID NO: 755636 - protein, 31 aa, Mycobacterium
YGLGYISPWVKLPAPVKFAFADESIPIAERA

SEQ ID NO: 755637 - protein, 26 aa, Mycobacterium
YGLIEWKMDLELGAHYYVKFGNPDVV

SEQ ID NO: 755638 - protein, 20 aa, Mycobacterium
YGLIEWKMDLELGEHHHVSF

SEQ ID NO: 755639 - protein, 22 aa, Mycobacterium
YGLIEWKMDLELGEHYYVKFGN

SEQ ID NO: 755640 - protein, 19 aa, Mycobacterium
YGLIGFNMPEEFGGGGSDD

SEQ ID NO: 755641 - protein, 19 aa, Mycobacterium
YGLIGFNMPEEFGGGGTDD

SEQ ID NO: 755642 - protein, 21 aa, Mycobacterium
YGLIGGTAWSVRAGRAAARDF

SEQ ID NO: 755643 - protein, 24 aa, Mycobacterium
YGLIHADLRLANLLVDSSTPQRTI

SEQ ID NO: 755644 - protein, 20 aa, Mycobacterium
YGLLRRGQILFTYLHLAASL

SEQ ID NO: 755645 - protein, 17 aa, Mycobacterium
YGLNMPIAREVDAVINH

SEQ ID NO: 755646 - protein, 18 aa, Mycobacterium
YGLPDFSKYFGAAGFVPL

SEQ ID NO: 755647 - protein, 17 aa, Mycobacterium
YGLPGDSLNGFTEALRR

SEQ ID NO: 755648 - protein, 17 aa, Mycobacterium
YGLPLVAACAAAGTDYA

SEQ ID NO: 755649 - protein, 17 aa, Mycobacterium
YGLPMALTLFRRDLDVW

SEQ ID NO: 755650 - protein, 17 aa, Mycobacterium
YGLRRYIEFNSLVDRAH

SEQ ID NO: 755651 - protein, 18 aa, Mycobacterium
YGLRRYIRFNSHVDRAHW

SEQ ID NO: 755652 - protein, 17 aa, Mycobacterium
YGLRRYVEFNSLVDRAY

SEQ ID NO: 755653 - protein, 25 aa, Mycobacterium
YGLSELWFVTRLMRTAPVSREMVLN

SEQ ID NO: 755654 - protein, 17 aa, Mycobacterium
YGLSPRIRFAVKVTEAW

SEQ ID NO: 755655 - protein, 19 aa, Mycobacterium
YGLTWKWPEVDCAHPLDDG

SEQ ID NO: 755656 - protein, 19 aa, Mycobacterium
YGLTYPGVGFVVWRGPEYL

SEQ ID NO: 755657 - protein, 19 aa, Mycobacterium
YGLTYPGVGFVVWRNKEHL

SEQ ID NO: 755658 - protein, 19 aa, Mycobacterium
YGLTYPGVGFVVWRSPEYL

SEQ ID NO: 755659 - protein, 18 aa, Mycobacterium
YGLVGRGDRVTVLTSAQH

SEQ ID NO: 755660 - protein, 19 aa, Mycobacterium
YGLWATLRIARLLNGRRGR

SEQ ID NO: 755661 - protein, 17 aa, Mycobacterium
YGLYLPVIIDDPRERGR

SEQ ID NO: 755662 - protein, 24 aa, Mycobacterium
YGMAESTCAVTMPACGQGLRIDER

SEQ ID NO: 755663 - protein, 24 aa, Mycobacterium
YGMGVASRAAWAWTRHLHSRADRT

SEQ ID NO: 755664 - protein, 31 aa, Mycobacterium
YGMVSPTVFWPIPRVYSGLVRIDRYETSPWP

SEQ ID NO: 755665 - protein, 23 aa, Mycobacterium
YGNAKWAGEVLLREAHDLCGLPV

SEQ ID NO: 755666 - protein, 21 aa, Mycobacterium
YGNAVVWKPASTVPLLAIRLA

SEQ ID NO: 755667 - protein, 17 aa, Mycobacterium
YGNAYVCDVNFMGFFPG

SEQ ID NO: 755668 - protein, 24 aa, Mycobacterium
YGNKISWADLIAYAGNAALEQSGF

SEQ ID NO: 755669 - protein, 19 aa, Mycobacterium
YGNKISWADLITYAGNVAL

SEQ ID NO: 755670 - protein, 21 aa, Mycobacterium
YGNKISWADLLVFTGNVALES

SEQ ID NO: 755671 - protein, 24 aa, Mycobacterium
YGNKLSWADLIVFAGNHAMDTMGF

SEQ ID NO: 755672 - protein, 18 aa, Mycobacterium
YGNKPVEFGVLPKDALGG

SEQ ID NO: 755673 - protein, 23 aa, Mycobacterium
YGNLCEMDRLLAVGQKHGIPVIE

SEQ ID NO: 755674 - protein, 26 aa, Mycobacterium
YGNSMLYKRFRVRSQVWMFGLTPGTV

SEQ ID NO: 755675 - protein, 18 aa, Mycobacterium
YGNTELPGLFAAGEVART

SEQ ID NO: 755676 - protein, 24 aa, Mycobacterium
YGNVLRFLPPLSMPDELLQEALAV

SEQ ID NO: 755677 - protein, 18 aa, Mycobacterium
YGNVVRFLPPLSIGDDLL

SEQ ID NO: 755678 - protein, 21 aa, Mycobacterium
YGPAAVCARLAELGGLSRTVL

SEQ ID NO: 755679 - protein, 24 aa, Mycobacterium
YGPACPQPVFPNMPLDLGAPQGED

SEQ ID NO: 755680 - protein, 19 aa, Mycobacterium
YGPAGTWLKVPLGKLATER

SEQ ID NO: 755681 - protein, 44 aa, Mycobacterium
YGPGSAMARATWRMCRDCGYYVPLGGALGVMFGVCANEYAADGH

SEQ ID NO: 755682 - protein, 17 aa, Mycobacterium
YGPIMTMPILSLGDVAI

SEQ ID NO: 755683 - protein, 24 aa, Mycobacterium
YGPLVLRMAWHFAGTYRIGDGRGG

SEQ ID NO: 755684 - protein, 21 aa, Mycobacterium
YGPNLALLAAHGFDRRLLPVL

SEQ ID NO: 755685 - protein, 24 aa, Mycobacterium
YGPPGCGKTFLARAVAGELGANFY

SEQ ID NO: 755686 - protein, 21 aa, Mycobacterium
YGPPRRWLVVTGTNGKTTTTS

SEQ ID NO: 755687 - protein, 24 aa, Mycobacterium
YGPPWHCASPGIPAHRGSDGLVGR

SEQ ID NO: 755688 - protein, 20 aa, Mycobacterium
YGPQTGEPMFGMAVQGVVSR

SEQ ID NO: 755689 - protein, 24 aa, Mycobacterium
YGPSYQHPPAWDLAGRRGDYVNGA

SEQ ID NO: 755690 - protein, 17 aa, Mycobacterium
YGPTFGIGGADGATGPL

SEQ ID NO: 755691 - protein, 24 aa, Mycobacterium
YGPYLDRVGLRPGQRHHPSDNTDE

SEQ ID NO: 755692 - protein, 18 aa, Mycobacterium
YGPYLKRGKDSRSLATED

SEQ ID NO: 755693 - protein, 17 aa, Mycobacterium
YGPYLKRGTDSRSLATE

SEQ ID NO: 755694 - protein, 17 aa, Mycobacterium
YGQALAESEIQPLGRPD

SEQ ID NO: 755695 - protein, 29 aa, Mycobacterium
YGQEIFEGLKAYRWADGSIVSFRPEANAA

SEQ ID NO: 755696 - protein, 20 aa, Mycobacterium
YGQHVALDFVARIRGQKKFA

SEQ ID NO: 755697 - protein, 20 aa, Mycobacterium
YGQHVALDFVARIRGQKKFE

SEQ ID NO: 755698 - protein, 19 aa, Mycobacterium
YGQHVALDFVGRIRGQHKF

SEQ ID NO: 755699 - protein, 17 aa, Mycobacterium
YGQLRARVEGVSEKVLI

SEQ ID NO: 755700 - protein, 23 aa, Mycobacterium
YGQLSCSVFNAAGQRIMASGSPS

SEQ ID NO: 755701 - protein, 29 aa, Mycobacterium
YGQRLPAPPSYRSYLMWLVAQDHAAAQAA

SEQ ID NO: 755702 - protein, 24 aa, Mycobacterium
YGQVLSRFGDLYGTVVNIAARLTG

SEQ ID NO: 755703 - protein, 23 aa, Mycobacterium
YGRAKLAVMLWGLELDRRQRVAR

SEQ ID NO: 755704 - protein, 21 aa, Mycobacterium
YGRAYPNKLAKVIAEEFRAVG

SEQ ID NO: 755705 - protein, 17 aa, Mycobacterium
YGRELDLIGPRFVDSLG

SEQ ID NO: 755706 - protein, 23 aa, Mycobacterium
YGRGEGAGMVVLRRLEDALRDGD

SEQ ID NO: 755707 - protein, 28 aa, Mycobacterium
YGRGFPFSLVFARLYAARGYHVVLQSVR

SEQ ID NO: 755708 - protein, 23 aa, Mycobacterium
YGRKISWSDLMIFAGNRALESMG

SEQ ID NO: 755709 - protein, 23 aa, Mycobacterium
YGRLRRGQTLFTYLHLAASRPCT

SEQ ID NO: 755710 - protein, 24 aa, Mycobacterium
YGRLTPWGRLAAYRAEYDDVVDRL

SEQ ID NO: 755711 - protein, 22 aa, Mycobacterium
YGRPDPRQGYPEQGGYPEQGGY

SEQ ID NO: 755712 - protein, 25 aa, Mycobacterium
YGRPKRLRLGICVTDAGRRNPAVTA

SEQ ID NO: 755713 - protein, 20 aa, Mycobacterium
YGRRLYELMSAYWPTADKAP

SEQ ID NO: 755714 - protein, 19 aa, Mycobacterium
YGRYTLRTYFRPDVTGKTV

SEQ ID NO: 755715 - protein, 17 aa, Mycobacterium
YGSAGFLQYQFVVPTEA

SEQ ID NO: 755716 - protein, 21 aa, Mycobacterium
YGSAGKVFGGMGVLGPTRMDY

SEQ ID NO: 755717 - protein, 25 aa, Mycobacterium
YGSASILPISWAYIRMMGADGLRAA

SEQ ID NO: 755718 - protein, 24 aa, Mycobacterium
YGSASILPISWAYIRMMGAEGLRA

SEQ ID NO: 755719 - protein, 24 aa, Mycobacterium
YGSASILPITWAYIRMMGAAGLRS

SEQ ID NO: 755720 - protein, 24 aa, Mycobacterium
YGSASILPITWAYIRMMGADGLRA

SEQ ID NO: 755721 - protein, 24 aa, Mycobacterium
YGSASILPITWAYIRMMGPDGLRA

SEQ ID NO: 755722 - protein, 31 aa, Mycobacterium
YGSASILPITWMYIRMMGADGLRAATLTAIA

SEQ ID NO: 755723 - protein, 19 aa, Mycobacterium
YGSFTEWSLPPLLPVGQVR

SEQ ID NO: 755724 - protein, 19 aa, Mycobacterium
YGSGWWPFLTPPERIAERL

SEQ ID NO: 755725 - protein, 19 aa, Mycobacterium
YGSITAPTLVVWTSDDPTA

SEQ ID NO: 755726 - protein, 22 aa, Mycobacterium
YGSLEVFSGVDLAIDRGSRVVV

SEQ ID NO: 755727 - protein, 20 aa, Mycobacterium
YGSLEVFTGVDLAIDRGSRV

SEQ ID NO: 755728 - protein, 20 aa, Mycobacterium
YGSLPARGTIFVSVANRDKR

SEQ ID NO: 755729 - protein, 20 aa, Mycobacterium
YGSLSRRRFVAAARAYVPEL

SEQ ID NO: 755730 - protein, 22 aa, Mycobacterium
YGSNFPGFFAEYAIADHTLVFS

SEQ ID NO: 755731 - protein, 18 aa, Mycobacterium
YGSRSCVLRRRDAGAAHA

SEQ ID NO: 755732 - protein, 19 aa, Mycobacterium
YGSSVVGFQDGWRGLLENR

SEQ ID NO: 755733 - protein, 20 aa, Mycobacterium
YGSTAPRLVTPDVLVNTPQV

SEQ ID NO: 755734 - protein, 18 aa, Mycobacterium
YGSWFDRYARTFAGTIAG

SEQ ID NO: 755735 - protein, 18 aa, Mycobacterium
YGSYKIAKAALLAMSQSL

SEQ ID NO: 755736 - protein, 21 aa, Mycobacterium
YGTEVPDGLVIEATLDGHGKL

SEQ ID NO: 755737 - protein, 17 aa, Mycobacterium
YGTEVSYQLTIDLRVSV

SEQ ID NO: 755738 - protein, 17 aa, Mycobacterium
YGTGAFLLAQLGTEPVR

SEQ ID NO: 755739 - protein, 20 aa, Mycobacterium
YGTGVSDLFPTVVAQAKEAD

SEQ ID NO: 755740 - protein, 18 aa, Mycobacterium
YGTLTSYLLDVVNLVAGN

SEQ ID NO: 755741 - protein, 20 aa, Mycobacterium
YGTPELLLRSGIGPAGELAG

SEQ ID NO: 755742 - protein, 21 aa, Mycobacterium
YGTTKETLGWIALNQRANAEL

SEQ ID NO: 755743 - protein, 22 aa, Mycobacterium
YGTTRETLGWIALNQRANAALN

SEQ ID NO: 755744 - protein, 17 aa, Mycobacterium
YGTVAINAWTGVGYLTP

SEQ ID NO: 755745 - protein, 17 aa, Mycobacterium
YGTVAWDVRAIWENYSG

SEQ ID NO: 755746 - protein, 25 aa, Mycobacterium
YGTWGGEIRPGFEPQPGDVVAHEHW

SEQ ID NO: 755747 - protein, 26 aa, Mycobacterium
YGTYFKGHLYIAGRIKDLVIIDGRNH

SEQ ID NO: 755748 - protein, 26 aa, Mycobacterium
YGVARALRPLLIDTVVGFIGPEYLYD

SEQ ID NO: 755749 - protein, 17 aa, Mycobacterium
YGVCSLDAIGGQTSGDT

SEQ ID NO: 755750 - protein, 20 aa, Mycobacterium
YGVDAHIDKVRWPDIVERVF

SEQ ID NO: 755751 - protein, 26 aa, Mycobacterium
YGVDAHIDRVRWDDIVSRVFGRIDPI

SEQ ID NO: 755752 - protein, 18 aa, Mycobacterium
YGVDGLRIADGSIMPRIT

SEQ ID NO: 755753 - protein, 17 aa, Mycobacterium
YGVDPEGLVAMYDGSFW

SEQ ID NO: 755754 - protein, 27 aa, Mycobacterium
YGVDPLILRQAYPVPQDPYGLAGSNQL

SEQ ID NO: 755755 - protein, 36 aa, Mycobacterium
YGVDPLILRQAYPVPRAPYGLAGSRALSWVTQTASN

SEQ ID NO: 755756 - protein, 25 aa, Mycobacterium
YGVDPLILRQAYPVSQAPYGLAGSR

SEQ ID NO: 755757 - protein, 19 aa, Mycobacterium
YGVERACAIGSAKSNLGHT

SEQ ID NO: 755758 - protein, 24 aa, Mycobacterium
YGVHFCLGAALARMEINSFFSELV

SEQ ID NO: 755759 - protein, 24 aa, Mycobacterium
YGVHFCLGAALARMEINSFFTELL

SEQ ID NO: 755760 - protein, 23 aa, Mycobacterium
YGVHFCLGAALARMEINSLFTEL

SEQ ID NO: 755761 - protein, 25 aa, Mycobacterium
YGVHFCLGAALARMEMNSLFSELLP

SEQ ID NO: 755762 - protein, 24 aa, Mycobacterium
YGVHFCLGAALARMEVNSFFTELL

SEQ ID NO: 755763 - protein, 18 aa, Mycobacterium
YGVPIAIKAAFGGGGRGM

SEQ ID NO: 755764 - protein, 23 aa, Mycobacterium
YGVPSPRLGGALTDEEVWDAYVY

SEQ ID NO: 755765 - protein, 19 aa, Mycobacterium
YGVRKLWKAARRAGYDVGR

SEQ ID NO: 755766 - protein, 23 aa, Mycobacterium
YGVRLRIALDPDFIEEYNEFVKD

SEQ ID NO: 755767 - protein, 19 aa, Mycobacterium
YGVRPLRLAWRNRQRIPRF

SEQ ID NO: 755768 - protein, 20 aa, Mycobacterium
YGVRSRIRFNTKVQAADFDD

SEQ ID NO: 755769 - protein, 19 aa, Mycobacterium
YGVSTGFGALATRHVAPEL

SEQ ID NO: 755770 - protein, 28 aa, Mycobacterium
YGVTGYDWETCWRDYRLGMPHTVLISAL

SEQ ID NO: 755771 - protein, 19 aa, Mycobacterium
YGVVADPFGHHWSLGQPVR

SEQ ID NO: 755772 - protein, 18 aa, Mycobacterium
YGWDEMPEVLTSKQAGHK

SEQ ID NO: 755773 - protein, 19 aa, Mycobacterium
YGWSKRIVIEYIEEMSLQL

SEQ ID NO: 755774 - protein, 23 aa, Mycobacterium
YGYDRPLYALGFDTLFAGPAGEF

SEQ ID NO: 755775 - protein, 25 aa, Mycobacterium
YGYFVRRLAERPANLTFFLRALAER

SEQ ID NO: 755776 - protein, 23 aa, Mycobacterium
YGYQRPLFALGFDTLFAGPAAEF

SEQ ID NO: 755777 - protein, 25 aa, Mycobacterium
YGYRVSRYELDLEYKVAINRLTGTA

SEQ ID NO: 755778 - protein, 19 aa, Mycobacterium
YHAELDWWTSPFALAEGVP

SEQ ID NO: 755779 - protein, 21 aa, Mycobacterium
YHAELDWWTSSFVLAEGMPPS

SEQ ID NO: 755780 - protein, 22 aa, Mycobacterium
YHAFAGSLIRDYGLLLPVEPDT

SEQ ID NO: 755781 - protein, 23 aa, Mycobacterium
YHAIEGKGAFLGGQRINASAADS

SEQ ID NO: 755782 - protein, 18 aa, Mycobacterium
YHALRASNRIAIERGKAF

SEQ ID NO: 755783 - protein, 24 aa, Mycobacterium
YHALRASNRIAIERGSKFGGFERS

SEQ ID NO: 755784 - protein, 26 aa, Mycobacterium
YHALRASNRIAIERGTKFGGFDRSKY

SEQ ID NO: 755785 - protein, 24 aa, Mycobacterium
YHALRASNRISIERGTHFKGFERS

SEQ ID NO: 755786 - protein, 18 aa, Mycobacterium
YHALSIGWLMGRLAKAVT

SEQ ID NO: 755787 - protein, 20 aa, Mycobacterium
YHALTWGPLMREIIWATTGK

SEQ ID NO: 755788 - protein, 21 aa, Mycobacterium
YHALTWGPLVREIVLGATGKG

SEQ ID NO: 755789 - protein, 25 aa, Mycobacterium
YHALWEPKIPLGRMGRPEELTGLYL

SEQ ID NO: 755790 - protein, 17 aa, Mycobacterium
YHAWRYNLDGDLTFVQQ

SEQ ID NO: 755791 - protein, 18 aa, Mycobacterium
YHAYPAHAAFGGYKQSGI

SEQ ID NO: 755792 - protein, 17 aa, Mycobacterium
YHCPLTYRPLLERDRRM

SEQ ID NO: 755793 - protein, 23 aa, Mycobacterium
YHDLSGFGRRFIDVDPEDLLAEV

SEQ ID NO: 755794 - protein, 20 aa, Mycobacterium
YHDPDLLRAALCEKDRMVLP

SEQ ID NO: 755795 - protein, 23 aa, Mycobacterium
YHDTEIIRWLFTPDPSLTVTRDG

SEQ ID NO: 755796 - protein, 19 aa, Mycobacterium
YHDTEIVRWLFTPDPSLTV

SEQ ID NO: 755797 - protein, 18 aa, Mycobacterium
YHEFLIKKSRMPSQTPPS

SEQ ID NO: 755798 - protein, 18 aa, Mycobacterium
YHERMIWGRGDGSGLFAV

SEQ ID NO: 755799 - protein, 24 aa, Mycobacterium
YHERRAVGMGSEFASGAGSEGGHA

SEQ ID NO: 755800 - protein, 24 aa, Mycobacterium
YHERRAVGMGSEFASGGGSEGGHT

SEQ ID NO: 755801 - protein, 34 aa, Mycobacterium
YHEYRYRQAFEESRCVPVLLGALGSIKGTDTGAR

SEQ ID NO: 755802 - protein, 23 aa, Mycobacterium
YHGAEGLTAIARRVHAHAEAIAA

SEQ ID NO: 755803 - protein, 19 aa, Mycobacterium
YHGAPGLTAIARRVHAHAD

SEQ ID NO: 755804 - protein, 24 aa, Mycobacterium
YHGELLPRSAAPAVARLRLELSTS

SEQ ID NO: 755805 - protein, 28 aa, Mycobacterium
YHGGASALAARLAPWQQALGAAPGAAAS

SEQ ID NO: 755806 - protein, 21 aa, Mycobacterium
YHGGGFCLGGLDTHDPLARAH

SEQ ID NO: 755807 - protein, 19 aa, Mycobacterium
YHGGGWALGDLDTHDAVCR

SEQ ID NO: 755808 - protein, 21 aa, Mycobacterium
YHGKGEFGQFLARLAEKSTTA

SEQ ID NO: 755809 - protein, 20 aa, Mycobacterium
YHGLQWTWRQYLAESAARAA

SEQ ID NO: 755810 - protein, 24 aa, Mycobacterium
YHGVTWGPLMREIISAATGRSIRD

SEQ ID NO: 755811 - protein, 26 aa, Mycobacterium
YHGVVFAELGPPAFALKARVQLLRDL

SEQ ID NO: 755812 - protein, 17 aa, Mycobacterium
YHGWRYDLQGALKFVQQ

SEQ ID NO: 755813 - protein, 18 aa, Mycobacterium
YHGYPWLIHRLAYRHTNH

SEQ ID NO: 755814 - protein, 17 aa, Mycobacterium
YHIFSAKLDDCIKPIIV

SEQ ID NO: 755815 - protein, 18 aa, Mycobacterium
YHIKGVIGPDEFHSGYPD

SEQ ID NO: 755816 - protein, 22 aa, Mycobacterium
YHKHLRLSARRMGLPDGGRGLV

SEQ ID NO: 755817 - protein, 24 aa, Mycobacterium
YHKRLTDFMTEYVFPAEADYDKFR

SEQ ID NO: 755818 - protein, 17 aa, Mycobacterium
YHLDFLSTVDIRGRDGR

SEQ ID NO: 755819 - protein, 26 aa, Mycobacterium
YHLDRGWCEHLAFLADIRESIHLRAL

SEQ ID NO: 755820 - protein, 26 aa, Mycobacterium
YHLFRAAPRLGRWVIRKATISVLPKG

SEQ ID NO: 755821 - protein, 20 aa, Mycobacterium
YHLIPEPFEQIAQWTESFET

SEQ ID NO: 755822 - protein, 25 aa, Mycobacterium
YHLKTYRPGTTFAVLEGRESIGGTW

SEQ ID NO: 755823 - protein, 17 aa, Mycobacterium
YHLLWELTHVCFEHPGL

SEQ ID NO: 755824 - protein, 17 aa, Mycobacterium
YHLMGFDIGSFTPIFVM

SEQ ID NO: 755825 - protein, 17 aa, Mycobacterium
YHLTRIYAKLGIRSRSE

SEQ ID NO: 755826 - protein, 31 aa, Mycobacterium
YHLTTLFPPVRPRGFLEVRYLDSVPDAVWPA

SEQ ID NO: 755827 - protein, 29 aa, Mycobacterium
YHLTTLFPPVRPRQWLEIRYLDSLSDVFW

SEQ ID NO: 755828 - protein, 28 aa, Mycobacterium
YHLTTLFPPVRPRQWLEIRYLDSVPDAL

SEQ ID NO: 755829 - protein, 28 aa, Mycobacterium
YHLTTLFPPVRPRQWLEIRYLDSVPDTF

SEQ ID NO: 755830 - protein, 21 aa, Mycobacterium
YHLTTLFPPVRPRRWLEIRYL

SEQ ID NO: 755831 - protein, 22 aa, Mycobacterium
YHLTTLFPPVRPRRWLEIRYLD

SEQ ID NO: 755832 - protein, 21 aa, Mycobacterium
YHLTTLFPPVRPRRWLELRYL

SEQ ID NO: 755833 - protein, 25 aa, Mycobacterium
YHMKEPGRWSGWVRIDGERIGVDGF

SEQ ID NO: 755834 - protein, 25 aa, Mycobacterium
YHMKEPGRWSGWVTIDGERVSVDGF

SEQ ID NO: 755835 - protein, 24 aa, Mycobacterium
YHNRRMPYTIGLLGSVPRLDATQG

SEQ ID NO: 755836 - protein, 26 aa, Mycobacterium
YHPPPRPDVLFVWQVAVAPSAQGTGL

SEQ ID NO: 755837 - protein, 19 aa, Mycobacterium
YHPTWDLLTAVSMGGDEPN

SEQ ID NO: 755838 - protein, 19 aa, Mycobacterium
YHQLLVWDMMGRPWLTRTA

SEQ ID NO: 755839 - protein, 18 aa, Mycobacterium
YHQLPAWIDQATRERAEA

SEQ ID NO: 755840 - protein, 18 aa, Mycobacterium
YHQLPGWVSAAAREFAEA

SEQ ID NO: 755841 - protein, 18 aa, Mycobacterium
YHQMNPWDVPIGGMGAVT

SEQ ID NO: 755842 - protein, 19 aa, Mycobacterium
YHQRCWLRQLTPPANREQE

SEQ ID NO: 755843 - protein, 17 aa, Mycobacterium
YHRADLILAELTEADVD

SEQ ID NO: 755844 - protein, 19 aa, Mycobacterium
YHRDDCLPGGEGGFHLCAA

SEQ ID NO: 755845 - protein, 32 aa, Mycobacterium
YHREIAMNFTMDGPWGTWVNRWTAEENRHSIA

SEQ ID NO: 755846 - protein, 20 aa, Mycobacterium
YHRELQWWTANVRHSDGVPA

SEQ ID NO: 755847 - protein, 22 aa, Mycobacterium
YHRFYDSCRVLPQGDEEPGDLH

SEQ ID NO: 755848 - protein, 17 aa, Mycobacterium
YHRGDLVARLHADGRVQ

SEQ ID NO: 755849 - protein, 17 aa, Mycobacterium
YHRKWASALDRLTFLID

SEQ ID NO: 755850 - protein, 21 aa, Mycobacterium
YHRMLDRRGPLVLPTAAAVGL

SEQ ID NO: 755851 - protein, 17 aa, Mycobacterium
YHRTKFEAERLVRAAPG

SEQ ID NO: 755852 - protein, 19 aa, Mycobacterium
YHRTRRWPDLCALTDVCPP

SEQ ID NO: 755853 - protein, 17 aa, Mycobacterium
YHSEPLGGFTGWHPQRP

SEQ ID NO: 755854 - protein, 23 aa, Mycobacterium
YHSGELWQAVAPLHYFNDRAGSI

SEQ ID NO: 755855 - protein, 26 aa, Mycobacterium
YHSLWMPDHLVSFWPDSIWTPEFTDL

SEQ ID NO: 755856 - protein, 25 aa, Mycobacterium
YHTAGTCVFEFPVALGTLPDAPKLP

SEQ ID NO: 755857 - protein, 17 aa, Mycobacterium
YHTEWPVGSGKYLRPHD

SEQ ID NO: 755858 - protein, 26 aa, Mycobacterium
YHTVWFELHEELILAVGLTREEAARS

SEQ ID NO: 755859 - protein, 21 aa, Mycobacterium
YHTYPRLVGETGGKDFVLAHS

SEQ ID NO: 755860 - protein, 19 aa, Mycobacterium
YHWIEYPQRAQAVAIVRRT

SEQ ID NO: 755861 - protein, 20 aa, Mycobacterium
YHYFECAWAGNAAKAVEYCR

SEQ ID NO: 755862 - protein, 25 aa, Mycobacterium
YHYSYPAHEVWTILISPQLFGQWIK

SEQ ID NO: 755863 - protein, 24 aa, Mycobacterium
YHYYASKALILFDIYRQAAEGTLA

SEQ ID NO: 755864 - protein, 18 aa, Mycobacterium
YIADGTYFYGFSGDGTLR

SEQ ID NO: 755865 - protein, 18 aa, Mycobacterium
YIAGQAFNSGGLGIVHSI

SEQ ID NO: 755866 - protein, 21 aa, Mycobacterium
YIALCDLMHRRGLAGATVLLG

SEQ ID NO: 755867 - protein, 18 aa, Mycobacterium
YIALRLNPALVRDAFVAP

SEQ ID NO: 755868 - protein, 24 aa, Mycobacterium
YIANEFPLTVLLIGIGLHERNALL

SEQ ID NO: 755869 - protein, 31 aa, Mycobacterium
YIAPTLVRTFMKWGREIPFAHDLSSLRLLGS

SEQ ID NO: 755870 - protein, 20 aa, Mycobacterium
YIASRTDIALGMFNSPSSGY

SEQ ID NO: 755871 - protein, 17 aa, Mycobacterium
YIATSLRLLDRKIVRLP

SEQ ID NO: 755872 - protein, 20 aa, Mycobacterium
YIAYYRHIDYVLSAVESGPV

SEQ ID NO: 755873 - protein, 24 aa, Mycobacterium
YIDHCWGTEPFAAGGPHPAAPPFA

SEQ ID NO: 755874 - protein, 17 aa, Mycobacterium
YIEFNSLVDRAHWDDDE

SEQ ID NO: 755875 - protein, 20 aa, Mycobacterium
YIEGAEVANGFYVLRAPDRD

SEQ ID NO: 755876 - protein, 22 aa, Mycobacterium
YIEGRAAMFAGLADSTLSRDDG

SEQ ID NO: 755877 - protein, 19 aa, Mycobacterium
YIEIECVRGEFDAVQDAFV

SEQ ID NO: 755878 - protein, 18 aa, Mycobacterium
YIEIWNLVFMQNERGEGT

SEQ ID NO: 755879 - protein, 24 aa, Mycobacterium
YIERVARNFLKYRGEGERFAQWAM

SEQ ID NO: 755880 - protein, 23 aa, Mycobacterium
YIESLDAIGAWPPISESHVEMDA

SEQ ID NO: 755881 - protein, 22 aa, Mycobacterium
YIFRYGEGTAMAIMHPDNSVAR

SEQ ID NO: 755882 - protein, 19 aa, Mycobacterium
YIGEICRYLLNQPAKSTDR

SEQ ID NO: 755883 - protein, 25 aa, Mycobacterium
YIGIGLLMDGRWRWRSYSLTSTPAA

SEQ ID NO: 755884 - protein, 26 aa, Mycobacterium
YIGIGLLVEGRWRWRSYSLTSPPAER

SEQ ID NO: 755885 - protein, 17 aa, Mycobacterium
YIGQPIPIDGLYLGSAG

SEQ ID NO: 755886 - protein, 31 aa, Mycobacterium
YIGRSGLTASRFVPCPFGEPGARMYRTGDLV

SEQ ID NO: 755887 - protein, 17 aa, Mycobacterium
YIGTALRLLEHKISHLP

SEQ ID NO: 755888 - protein, 31 aa, Mycobacterium
YIHQARINMMPGFTGTGFYWHSDFETWHAED

SEQ ID NO: 755889 - protein, 18 aa, Mycobacterium
YIHRLRKYIGAYLAILGS

SEQ ID NO: 755890 - protein, 18 aa, Mycobacterium
YIHRLRKYIGAYMAVLGR

SEQ ID NO: 755891 - protein, 24 aa, Mycobacterium
YIIERMPLTAGDIVFTGTTDGVGF

SEQ ID NO: 755892 - protein, 28 aa, Mycobacterium
YIKEKPRGPGYVCDIVYYCEDLPVTVYA

SEQ ID NO: 755893 - protein, 17 aa, Mycobacterium
YILAIVAGVLRAVVDDG

SEQ ID NO: 755894 - protein, 24 aa, Mycobacterium
YILGHSRAGGFLVEADLVPTAEAA

SEQ ID NO: 755895 - protein, 17 aa, Mycobacterium
YILLTTFTKDGRPKPTP

SEQ ID NO: 755896 - protein, 31 aa, Mycobacterium
YIMKADHGLALPRRLQIEFSQVVQKITDGEG

SEQ ID NO: 755897 - protein, 32 aa, Mycobacterium
YIMKADHGLVLPRRLQIEFSQVIQKISEGEGG

SEQ ID NO: 755898 - protein, 32 aa, Mycobacterium
YIMKSDHGLVLPRRLQIEFAQSIQRITDGEGG

SEQ ID NO: 755899 - protein, 18 aa, Mycobacterium
YINAYVTADAFCWNMVRS

SEQ ID NO: 755900 - protein, 26 aa, Mycobacterium
YINGTPIPIFYDFGPITVDETTTDPI

SEQ ID NO: 755901 - protein, 24 aa, Mycobacterium
YINSRPSPLVAYWFGPDDADFRHF

SEQ ID NO: 755902 - protein, 20 aa, Mycobacterium
YIPAGVFVPRSVRVLATDLV

SEQ ID NO: 755903 - protein, 21 aa, Mycobacterium
YIPELLMRAPEVIQMYADGPS

SEQ ID NO: 755904 - protein, 26 aa, Mycobacterium
YIPEPWRSKFFLDHKVGELIYYDAPD

SEQ ID NO: 755905 - protein, 26 aa, Mycobacterium
YIPEPWRSKYFLDHKVGELIYYDAPD

SEQ ID NO: 755906 - protein, 26 aa, Mycobacterium
YIPEPWRSKYFLSHRVGEQIYYDAPD

SEQ ID NO: 755907 - protein, 24 aa, Mycobacterium
YIPEPWRSKYFLTRKIGEQIYYDA

SEQ ID NO: 755908 - protein, 17 aa, Mycobacterium
YIPERKLAVIEMATASG

SEQ ID NO: 755909 - protein, 33 aa, Mycobacterium
YIPLVGWAMSASFQAPICAAGMAVVGGALAYLT

SEQ ID NO: 755910 - protein, 22 aa, Mycobacterium
YIPPGCPWDNGYIESFNNRLRR

SEQ ID NO: 755911 - protein, 18 aa, Mycobacterium
YIPRHMVNRATLPVFQRL

SEQ ID NO: 755912 - protein, 28 aa, Mycobacterium
YIPTEARPWPARRTRVAAVSSFGAGGIN

SEQ ID NO: 755913 - protein, 18 aa, Mycobacterium
YIQFLFPGANAAGLTYPA

SEQ ID NO: 755914 - protein, 24 aa, Mycobacterium
YIQRAIMFQRCLDVTARLIIAASR

SEQ ID NO: 755915 - protein, 18 aa, Mycobacterium
YIRDFKQMGLFLNEIQGF

SEQ ID NO: 755916 - protein, 20 aa, Mycobacterium
YIRDQGWQTYGEVVVRFEQS

SEQ ID NO: 755917 - protein, 18 aa, Mycobacterium
YIRFNSHVDRAHWDDDEQ

SEQ ID NO: 755918 - protein, 19 aa, Mycobacterium
YIRHLFKAKEMLSATLCTI

SEQ ID NO: 755919 - protein, 17 aa, Mycobacterium
YIRRVRLSRAHQELVTG

SEQ ID NO: 755920 - protein, 17 aa, Mycobacterium
YIRSCVDAGDVVAAMEA

SEQ ID NO: 755921 - protein, 23 aa, Mycobacterium
YISADFARPEYWSNRGKLDVPKE

SEQ ID NO: 755922 - protein, 25 aa, Mycobacterium
YISIPLLIAEAGGDPWAINQSLQLG

SEQ ID NO: 755923 - protein, 23 aa, Mycobacterium
YISPRGVPIEVMAPIRDESDMFL

SEQ ID NO: 755924 - protein, 19 aa, Mycobacterium
YISRFLKMREGAFADPASH

SEQ ID NO: 755925 - protein, 18 aa, Mycobacterium
YISYLRKKIDADRDPMIH

SEQ ID NO: 755926 - protein, 18 aa, Mycobacterium
YISYLRKKIDADREPMIH

SEQ ID NO: 755927 - protein, 19 aa, Mycobacterium
YITARFLPDKAIDLVDEAA

SEQ ID NO: 755928 - protein, 23 aa, Mycobacterium
YITKPRGQMHAMWNAGNEPGRII

SEQ ID NO: 755929 - protein, 24 aa, Mycobacterium
YITKSGYDYTWFVLNAKIIEKEFA

SEQ ID NO: 755930 - protein, 25 aa, Mycobacterium
YIVEKRFNLSWAIEGTRSRTGKMLP

SEQ ID NO: 755931 - protein, 17 aa, Mycobacterium
YIVLESKALSDCVVLEL

SEQ ID NO: 755932 - protein, 29 aa, Mycobacterium
YIVPTYVPGRCAVQLNAGGALRFTLTNNR

SEQ ID NO: 755933 - protein, 24 aa, Mycobacterium
YIVVDECHYYRGIFGSNVAMVLRR

SEQ ID NO: 755934 - protein, 26 aa, Mycobacterium
YIWAPLCPPCAVLTPTYEGSSDKHPD

SEQ ID NO: 755935 - protein, 24 aa, Mycobacterium
YIYAATGKPGWFLFDGLVRHDLRT

SEQ ID NO: 755936 - protein, 24 aa, Mycobacterium
YKAAERLPGMDLPEQFVPVEHSDA

SEQ ID NO: 755937 - protein, 20 aa, Mycobacterium
YKADAMWGPSSDPAWQRNDP

SEQ ID NO: 755938 - protein, 19 aa, Mycobacterium
YKAVRPARGRSVAVEADDE

SEQ ID NO: 755939 - protein, 20 aa, Mycobacterium
YKAVRPRPRRMTGDLDAYGL

SEQ ID NO: 755940 - protein, 17 aa, Mycobacterium
YKAWFPLTARWLGFEDA

SEQ ID NO: 755941 - protein, 23 aa, Mycobacterium
YKAWFPLTKRWLGFEDAHIVFDL

SEQ ID NO: 755942 - protein, 20 aa, Mycobacterium
YKCGEAWSTLVHHRPSDRRV

SEQ ID NO: 755943 - protein, 25 aa, Mycobacterium
YKDRLSDGPLIFCVFNNEDLNQVTW

SEQ ID NO: 755944 - protein, 18 aa, Mycobacterium
YKDVPCTNTLQFFVRDSR

SEQ ID NO: 755945 - protein, 28 aa, Mycobacterium
YKELARQVRLPGFRPGKAPAKLLEARFG

SEQ ID NO: 755946 - protein, 18 aa, Mycobacterium
YKELKSLVRSGGLHTVCE

SEQ ID NO: 755947 - protein, 19 aa, Mycobacterium
YKFADEFHPELQFDKPYLL

SEQ ID NO: 755948 - protein, 34 aa, Mycobacterium
YKGGLRFHPSVSLSIIKFLGFEQMFKNALTGLPI

SEQ ID NO: 755949 - protein, 20 aa, Mycobacterium
YKGGLRFHPSVYLGIVKFLG

SEQ ID NO: 755950 - protein, 26 aa, Mycobacterium
YKGHRWTWELFDAHWWDGITNGHDWL

SEQ ID NO: 755951 - protein, 18 aa, Mycobacterium
YKGISIPTASRINGVRGG

SEQ ID NO: 755952 - protein, 17 aa, Mycobacterium
YKGMKLMASHLGGTRNP

SEQ ID NO: 755953 - protein, 17 aa, Mycobacterium
YKGPWAYAPGAVFTDLA

SEQ ID NO: 755954 - protein, 37 aa, Mycobacterium
YKGTADLFLWPTLYLWEFPKPTISAIHGYCMGGGIYL

SEQ ID NO: 755955 - protein, 20 aa, Mycobacterium
YKGYSAIAIRAEMTANREDS

SEQ ID NO: 755956 - protein, 17 aa, Mycobacterium
YKHHPLDVEGWRGDNFP

SEQ ID NO: 755957 - protein, 22 aa, Mycobacterium
YKIWDNRLCLILDGDLFQSIGR

SEQ ID NO: 755958 - protein, 20 aa, Mycobacterium
YKKMVKRGGGAIVNQSSTAA

SEQ ID NO: 755959 - protein, 20 aa, Mycobacterium
YKKSNVMFGIDLAKRDIAKG

SEQ ID NO: 755960 - protein, 18 aa, Mycobacterium
YKLAAQRLNMHFNTVKYR

SEQ ID NO: 755961 - protein, 21 aa, Mycobacterium
YKLDFDIEGAALYNVPALTNQ

SEQ ID NO: 755962 - protein, 29 aa, Mycobacterium
YKLIGWRHNVCGYRRFFSITSLAGIRQED

SEQ ID NO: 755963 - protein, 21 aa, Mycobacterium
YKLKLRQNMKYADGTPIKASD

SEQ ID NO: 755964 - protein, 26 aa, Mycobacterium
YKLPKAVVFRPAIERSPAGKADYRWA

SEQ ID NO: 755965 - protein, 21 aa, Mycobacterium
YKLPKEIVFCPKVQRSPAGKP

SEQ ID NO: 755966 - protein, 19 aa, Mycobacterium
YKLSGFGRECHKMALEHYQ

SEQ ID NO: 755967 - protein, 17 aa, Mycobacterium
YKLVNLRVNAAMTKGVL

SEQ ID NO: 755968 - protein, 26 aa, Mycobacterium
YKLVPGAAIPSMFDPSSPVLARCRAI

SEQ ID NO: 755969 - protein, 23 aa, Mycobacterium
YKLVPTGAIPPMLDPESPVLQRA

SEQ ID NO: 755970 - protein, 25 aa, Mycobacterium
YKLVPTGAIPSMFEPGSPVLDRAGV

SEQ ID NO: 755971 - protein, 18 aa, Mycobacterium
YKLYEMRLRQELVKASKP

SEQ ID NO: 755972 - protein, 17 aa, Mycobacterium
YKMAKSALLSMSHSLAT

SEQ ID NO: 755973 - protein, 21 aa, Mycobacterium
YKMPPNHFDLAWSADKVGAMR

SEQ ID NO: 755974 - protein, 17 aa, Mycobacterium
YKMPWGTVHPTTISAPI

SEQ ID NO: 755975 - protein, 23 aa, Mycobacterium
YKMPWSTMFPLGISSATIGICEG

SEQ ID NO: 755976 - protein, 24 aa, Mycobacterium
YKMVFGHRGINIPVMDHATGRVAV

SEQ ID NO: 755977 - protein, 17 aa, Mycobacterium
YKNKYAIVQYLKEMADQ

SEQ ID NO: 755978 - protein, 19 aa, Mycobacterium
YKPAAELIAGFAIRTAVLT

SEQ ID NO: 755979 - protein, 19 aa, Mycobacterium
YKPAPELIAGFAIRTALPK

SEQ ID NO: 755980 - protein, 19 aa, Mycobacterium
YKPELPGGKPAGGRSLNAK

SEQ ID NO: 755981 - protein, 22 aa, Mycobacterium
YKPELPGGRPGGGRSLSAGPID

SEQ ID NO: 755982 - protein, 17 aa, Mycobacterium
YKPLNWMSPPCWLTEEP

SEQ ID NO: 755983 - protein, 17 aa, Mycobacterium
YKPLNWMSPPCWLTEET

SEQ ID NO: 755984 - protein, 17 aa, Mycobacterium
YKPLNWMSPPCWVTEQD

SEQ ID NO: 755985 - protein, 22 aa, Mycobacterium
YKPSELTPLMGQRLVEALLDGG

SEQ ID NO: 755986 - protein, 25 aa, Mycobacterium
YKPSGLDKRAAWEDTWALQRREDAG

SEQ ID NO: 755987 - protein, 21 aa, Mycobacterium
YKPYVDITLWPYPDGSGYNFS

SEQ ID NO: 755988 - protein, 17 aa, Mycobacterium
YKQVALFSATMPAAIRK

SEQ ID NO: 755989 - protein, 17 aa, Mycobacterium
YKQVALFSATMPPAIKK

SEQ ID NO: 755990 - protein, 18 aa, Mycobacterium
YKRAFRIAGSGPAILLIH

SEQ ID NO: 755991 - protein, 18 aa, Mycobacterium
YKRAFRIAGSGPAILLVH

SEQ ID NO: 755992 - protein, 18 aa, Mycobacterium
YKRAIWWAQYGAARLKYR

SEQ ID NO: 755993 - protein, 20 aa, Mycobacterium
YKRGELVVIVAGAPPGTVGS

SEQ ID NO: 755994 - protein, 30 aa, Mycobacterium
YKRHAGLDLLPRLLLRGGDRGDELDVAVVR

SEQ ID NO: 755995 - protein, 20 aa, Mycobacterium
YKRVLLKLGGEMFGGGQVGL

SEQ ID NO: 755996 - protein, 17 aa, Mycobacterium
YKSPRLVKPEILESTRF

SEQ ID NO: 755997 - protein, 23 aa, Mycobacterium
YKSYRGMGSLGAMQGRGGAKSYS

SEQ ID NO: 755998 - protein, 23 aa, Mycobacterium
YKSYRGMGSLGAMQGRGGGKSYS

SEQ ID NO: 755999 - protein, 22 aa, Mycobacterium
YKTEEAKFLAVVDDVAERHAKG

SEQ ID NO: 756000 - protein, 26 aa, Mycobacterium
YKTGRGSIKMRGVVEIEEDSRGRTSI

SEQ ID NO: 756001 - protein, 19 aa, Mycobacterium
YKTVDPYYGTSFYTIDFGG

SEQ ID NO: 756002 - protein, 19 aa, Mycobacterium
YKVALPLHPEYRTMPMVWY

SEQ ID NO: 756003 - protein, 19 aa, Mycobacterium
YKVAVGDLVKVEKIDSEPG

SEQ ID NO: 756004 - protein, 19 aa, Mycobacterium
YKVAVGDVVKVEKLESDPG

SEQ ID NO: 756005 - protein, 17 aa, Mycobacterium
YKVAVGDVVKVEKLESE

SEQ ID NO: 756006 - protein, 19 aa, Mycobacterium
YKVFLNLLRERFETDKDKW

SEQ ID NO: 756007 - protein, 36 aa, Mycobacterium
YKVGLGSVRYLLAVGDLIIGWRLLVQAGVAHAALAD

SEQ ID NO: 756008 - protein, 23 aa, Mycobacterium
YKVGLGSVRYLLAVGDLLIGWRL

SEQ ID NO: 756009 - protein, 23 aa, Mycobacterium
YKVPRYVRFVDEWPMSGTKIRKV

SEQ ID NO: 756010 - protein, 19 aa, Mycobacterium
YKVSARGGLLLYGPPGCGK

SEQ ID NO: 756011 - protein, 23 aa, Mycobacterium
YKWRKWLEFDCNWKVALEAFNET

SEQ ID NO: 756012 - protein, 17 aa, Mycobacterium
YKYLVEVSREPELDKIR

SEQ ID NO: 756013 - protein, 19 aa, Mycobacterium
YKYVLKEYVGYVVEKRFNL

SEQ ID NO: 756014 - protein, 18 aa, Mycobacterium
YLAAEPRDFLAVATPGSG

SEQ ID NO: 756015 - protein, 18 aa, Mycobacterium
YLAAHGWQVDIRTTDDAF

SEQ ID NO: 756016 - protein, 19 aa, Mycobacterium
YLAAYNLVCGPVLDDQNHL

SEQ ID NO: 756017 - protein, 19 aa, Mycobacterium
YLACIRLGAVFVPLQTSST

SEQ ID NO: 756018 - protein, 24 aa, Mycobacterium
YLADPAATMDAIWDDVLDRMGWLE

SEQ ID NO: 756019 - protein, 18 aa, Mycobacterium
YLAECLAVARAEGARLPD

SEQ ID NO: 756020 - protein, 18 aa, Mycobacterium
YLAELGLLDRIYSIQKQR

SEQ ID NO: 756021 - protein, 17 aa, Mycobacterium
YLAGAGVGSGYWRRTAL

SEQ ID NO: 756022 - protein, 23 aa, Mycobacterium
YLAGEAAAYAHTWSVTSRANAKF

SEQ ID NO: 756023 - protein, 19 aa, Mycobacterium
YLAGIYRTALHTVVSDLVQ

SEQ ID NO: 756024 - protein, 20 aa, Mycobacterium
YLAGLARRRQRVLIRVTPDI

SEQ ID NO: 756025 - protein, 18 aa, Mycobacterium
YLAGLCGALRLYHESMGV

SEQ ID NO: 756026 - protein, 27 aa, Mycobacterium
YLAGLCGALRRYHEAFGVPISTLPMAV

SEQ ID NO: 756027 - protein, 27 aa, Mycobacterium
YLAGLCGALRRYHEALGVPISTLPMAV

SEQ ID NO: 756028 - protein, 19 aa, Mycobacterium
YLAGPRTLSEFIVPTINDA

SEQ ID NO: 756029 - protein, 17 aa, Mycobacterium
YLAGRGVGHGYVRRPGL

SEQ ID NO: 756030 - protein, 21 aa, Mycobacterium
YLAGRGVGIGYVRRSGLTASR

SEQ ID NO: 756031 - protein, 20 aa, Mycobacterium
YLAGRPGYRHVVATEDFHID

SEQ ID NO: 756032 - protein, 18 aa, Mycobacterium
YLAGVGYTLADLTERLGI

SEQ ID NO: 756033 - protein, 18 aa, Mycobacterium
YLAGYRFGGDIDGYPEGE

SEQ ID NO: 756034 - protein, 19 aa, Mycobacterium
YLAGYRFSGDVDGYGEGEL

SEQ ID NO: 756035 - protein, 18 aa, Mycobacterium
YLAIAGRRRPMVPIRLPG

SEQ ID NO: 756036 - protein, 27 aa, Mycobacterium
YLAILDALRWLGLDWDEGPEVGGPYEP

SEQ ID NO: 756037 - protein, 28 aa, Mycobacterium
YLALLDALRWLGLDWDEGPEVDGPYGPY

SEQ ID NO: 756038 - protein, 27 aa, Mycobacterium
YLALLDALRWLGLNWDEGPEVGGPYGP

SEQ ID NO: 756039 - protein, 25 aa, Mycobacterium
YLALLDALRWLGMDWDEGPEVGGPY

SEQ ID NO: 756040 - protein, 18 aa, Mycobacterium
YLANYHLAWFIAITRGDS

SEQ ID NO: 756041 - protein, 17 aa, Mycobacterium
YLAPRKNRLNVWVQGIG

SEQ ID NO: 756042 - protein, 22 aa, Mycobacterium
YLAQLYSIIGIRASEAAQQLLG

SEQ ID NO: 756043 - protein, 17 aa, Mycobacterium
YLARAAVDPALRLPRVV

SEQ ID NO: 756044 - protein, 21 aa, Mycobacterium
YLARPVFQPLFYDSNQRELSA

SEQ ID NO: 756045 - protein, 21 aa, Mycobacterium
YLARQLKTWGGQWESIKELPT

SEQ ID NO: 756046 - protein, 19 aa, Mycobacterium
YLASDWKLESEGGFSPVRR

SEQ ID NO: 756047 - protein, 17 aa, Mycobacterium
YLASDYWRSQGVLDNID

SEQ ID NO: 756048 - protein, 28 aa, Mycobacterium
YLASLLSCQIVTWRFWAAKLGISVDDIS

SEQ ID NO: 756049 - protein, 17 aa, Mycobacterium
YLASSWAAITDVVNRPE

SEQ ID NO: 756050 - protein, 20 aa, Mycobacterium
YLASSYGHWVYSIRSGRGAI

SEQ ID NO: 756051 - protein, 24 aa, Mycobacterium
YLATRVAFQLGLRGPAINVQTACS

SEQ ID NO: 756052 - protein, 30 aa, Mycobacterium
YLATVIDCFSRRLVGWSIADHMSYMDSYGA

SEQ ID NO: 756053 - protein, 20 aa, Mycobacterium
YLCADAGFAAADRALQTHGG

SEQ ID NO: 756054 - protein, 20 aa, Mycobacterium
YLCADAGFTAADRALQTHGG

SEQ ID NO: 756055 - protein, 24 aa, Mycobacterium
YLCRTRPWPGELYEAFRNMGTEIF

SEQ ID NO: 756056 - protein, 17 aa, Mycobacterium
YLCVGVRTATPGPVSDY

SEQ ID NO: 756057 - protein, 20 aa, Mycobacterium
YLDALAYARRVMGLPATTVN

SEQ ID NO: 756058 - protein, 19 aa, Mycobacterium
YLDALAYARRVMGLPATVV

SEQ ID NO: 756059 - protein, 24 aa, Mycobacterium
YLDARAIGNFAIRFPTITAACAAA

SEQ ID NO: 756060 - protein, 18 aa, Mycobacterium
YLDARGVAGVADRFPTVT

SEQ ID NO: 756061 - protein, 19 aa, Mycobacterium
YLDDQPVFLGRNGRISVFP

SEQ ID NO: 756062 - protein, 22 aa, Mycobacterium
YLDFAGNADFAIAIRTALMRGG

SEQ ID NO: 756063 - protein, 18 aa, Mycobacterium
YLDHFGFGFVMFVNGYRA

SEQ ID NO: 756064 - protein, 18 aa, Mycobacterium
YLDHLGMIVSDFQFFPGQ

SEQ ID NO: 756065 - protein, 21 aa, Mycobacterium
YLDICAEVAAAGYKGFQILDA

SEQ ID NO: 756066 - protein, 25 aa, Mycobacterium
YLDKGPEVWRIRITKLTSTPPPRIL

SEQ ID NO: 756067 - protein, 17 aa, Mycobacterium
YLDLGSLALNGFTIPTI

SEQ ID NO: 756068 - protein, 17 aa, Mycobacterium
YLDLLGVEGIWLNPVTR

SEQ ID NO: 756069 - protein, 17 aa, Mycobacterium
YLDLPRVSGLAVSPDGT

SEQ ID NO: 756070 - protein, 19 aa, Mycobacterium
YLDMPRQYGALIGLVQGLL

SEQ ID NO: 756071 - protein, 18 aa, Mycobacterium
YLDRDAIAVIEGDGAVSQ

SEQ ID NO: 756072 - protein, 25 aa, Mycobacterium
YLDRGPEMLSFVLANSPLKLDWVPN

SEQ ID NO: 756073 - protein, 22 aa, Mycobacterium
YLDRGPEMLSFVLKHSPLKLCW

SEQ ID NO: 756074 - protein, 18 aa, Mycobacterium
YLDRIQAFLDTRAPDLKV

SEQ ID NO: 756075 - protein, 20 aa, Mycobacterium
YLDSHLAYQRACLHAIDYLT

SEQ ID NO: 756076 - protein, 26 aa, Mycobacterium
YLDTEPWRAAPLLEYLRKMVFWSEVT

SEQ ID NO: 756077 - protein, 17 aa, Mycobacterium
YLDWDLATEPERYAKRL

SEQ ID NO: 756078 - protein, 17 aa, Mycobacterium
YLDWDLATEPQRYAKRL

SEQ ID NO: 756079 - protein, 20 aa, Mycobacterium
YLEACGWTSVATPMAELLAG

SEQ ID NO: 756080 - protein, 17 aa, Mycobacterium
YLEAVPDDIAWCRLRDF

SEQ ID NO: 756081 - protein, 26 aa, Mycobacterium
YLEAWCRTAEAVRLFRFDRIVDARVL

SEQ ID NO: 756082 - protein, 23 aa, Mycobacterium
YLECAQACGLALLGGPPTPETAM

SEQ ID NO: 756083 - protein, 20 aa, Mycobacterium
YLEEVTMPGLLRGLQRSGRD

SEQ ID NO: 756084 - protein, 22 aa, Mycobacterium
YLEGKALPGIEVLGEAQPDRDK

SEQ ID NO: 756085 - protein, 18 aa, Mycobacterium
YLEGLAWTAGANGNLRRA

SEQ ID NO: 756086 - protein, 17 aa, Mycobacterium
YLEGLDWSAAQRADQDL

SEQ ID NO: 756087 - protein, 24 aa, Mycobacterium
YLEHSGLRGLIRVVGMEHPRLRAT

SEQ ID NO: 756088 - protein, 18 aa, Mycobacterium
YLEQVSLLDIALRIWRPR

SEQ ID NO: 756089 - protein, 24 aa, Mycobacterium
YLESAVWRPNLAVYSGTRVLRVLC

SEQ ID NO: 756090 - protein, 20 aa, Mycobacterium
YLESLRKLARECGVADHVTF

SEQ ID NO: 756091 - protein, 26 aa, Mycobacterium
YLESLRRLRGLGARTVLPGHGPDLPN

SEQ ID NO: 756092 - protein, 19 aa, Mycobacterium
YLFAAAVGWVRPVAHDGAI

SEQ ID NO: 756093 - protein, 21 aa, Mycobacterium
YLFAVKACFAAFRSGTLEHHG

SEQ ID NO: 756094 - protein, 18 aa, Mycobacterium
YLFDQFIELMAAPNRGKG

SEQ ID NO: 756095 - protein, 17 aa, Mycobacterium
YLFEPIVQSGLFNTLDW

SEQ ID NO: 756096 - protein, 24 aa, Mycobacterium
YLFKHPKVDFIWVTGGPKIVALAN

SEQ ID NO: 756097 - protein, 22 aa, Mycobacterium
YLFPHTRRVLLLQSTRTDEAPW

SEQ ID NO: 756098 - protein, 18 aa, Mycobacterium
YLFQALRVGAAGYLLKSI

SEQ ID NO: 756099 - protein, 19 aa, Mycobacterium
YLGAIGMAAVEAHERELVA

SEQ ID NO: 756100 - protein, 18 aa, Mycobacterium
YLGAIGMDAVEAHERELV

SEQ ID NO: 756101 - protein, 26 aa, Mycobacterium
YLGALGMTGLTAWIGIRDVGRPRAGE

SEQ ID NO: 756102 - protein, 22 aa, Mycobacterium
YLGDFRFYLDFYTKQGPNGLEV

SEQ ID NO: 756103 - protein, 23 aa, Mycobacterium
YLGDFRFYLDFYTRQSSRGIELH

SEQ ID NO: 756104 - protein, 19 aa, Mycobacterium
YLGEKICAAVVFTGPAVTL

SEQ ID NO: 756105 - protein, 20 aa, Mycobacterium
YLGEKICAAVVFTGPPLTLA

SEQ ID NO: 756106 - protein, 18 aa, Mycobacterium
YLGFQLGSLWYISLDYIN

SEQ ID NO: 756107 - protein, 23 aa, Mycobacterium
YLGFQLGSLWYISLDYINHQTSL

SEQ ID NO: 756108 - protein, 18 aa, Mycobacterium
YLGGAGHWRDSGMAGTPS

SEQ ID NO: 756109 - protein, 18 aa, Mycobacterium
YLGGRPPYGYRLVDAGPH

SEQ ID NO: 756110 - protein, 18 aa, Mycobacterium
YLGHTQWAVAPYIEPPLA

SEQ ID NO: 756111 - protein, 24 aa, Mycobacterium
YLGIPGLLDAASMRDLLRRRQDEQ

SEQ ID NO: 756112 - protein, 18 aa, Mycobacterium
YLGIVTRLTNSWDYTLAE

SEQ ID NO: 756113 - protein, 17 aa, Mycobacterium
YLGKYVVLYGDGNNNIQ

SEQ ID NO: 756114 - protein, 22 aa, Mycobacterium
YLGLALDFGERVDLGGATAAGM

SEQ ID NO: 756115 - protein, 22 aa, Mycobacterium
YLGLALDFGERVDLGGATSAGM

SEQ ID NO: 756116 - protein, 24 aa, Mycobacterium
YLGLPYYGRWLLAVARVLTEKHHI

SEQ ID NO: 756117 - protein, 23 aa, Mycobacterium
YLGPEVPKDTWLWQDNIPAGNDL

SEQ ID NO: 756118 - protein, 27 aa, Mycobacterium
YLGPVHVCAAFLPGMIETHAGGRVVNV

SEQ ID NO: 756119 - protein, 18 aa, Mycobacterium
YLGRDAQHLYVFQRTPST

SEQ ID NO: 756120 - protein, 23 aa, Mycobacterium
YLGRPGLTASRFVACPFGGEGAR

SEQ ID NO: 756121 - protein, 17 aa, Mycobacterium
YLGTARHLEVQVVGQPP

SEQ ID NO: 756122 - protein, 25 aa, Mycobacterium
YLGVFRVVSNLGVFDFNGPEHQMRA

SEQ ID NO: 756123 - protein, 18 aa, Mycobacterium
YLGYGKPQWESIEAAVFD

SEQ ID NO: 756124 - protein, 22 aa, Mycobacterium
YLHCGPTGAGHFVKMVHNGIEY

SEQ ID NO: 756125 - protein, 18 aa, Mycobacterium
YLHEMSSWNSLSVSEQEL

SEQ ID NO: 756126 - protein, 20 aa, Mycobacterium
YLHHLFKAKELLAATLCTIH

SEQ ID NO: 756127 - protein, 18 aa, Mycobacterium
YLHQNVTLAWDFPVDEDA

SEQ ID NO: 756128 - protein, 21 aa, Mycobacterium
YLHYGKGRHPAALNYGDTMAY

SEQ ID NO: 756129 - protein, 21 aa, Mycobacterium
YLHYGKGRHPAAVNYGDTMAY

SEQ ID NO: 756130 - protein, 18 aa, Mycobacterium
YLHYRMIDVSSIKELCRR

SEQ ID NO: 756131 - protein, 18 aa, Mycobacterium
YLICEGAKPAETFKLPAD

SEQ ID NO: 756132 - protein, 18 aa, Mycobacterium
YLIDHCGSPPPWAKEIDG

SEQ ID NO: 756133 - protein, 21 aa, Mycobacterium
YLIEHGDEWMVWDTGLDENLI

SEQ ID NO: 756134 - protein, 18 aa, Mycobacterium
YLIKLGGPLDARKVISEH

SEQ ID NO: 756135 - protein, 23 aa, Mycobacterium
YLIKSKVGRRNVYELNPQGRLRH

SEQ ID NO: 756136 - protein, 18 aa, Mycobacterium
YLINGRIPASPMTFNAKP

SEQ ID NO: 756137 - protein, 17 aa, Mycobacterium
YLISFFGALYSGRIAVP

SEQ ID NO: 756138 - protein, 34 aa, Mycobacterium
YLIVNPFFHIFGYKAGCIASLIRGATIVPVPIFE

SEQ ID NO: 756139 - protein, 17 aa, Mycobacterium
YLKPGLRRRNLNVVTDA

SEQ ID NO: 756140 - protein, 22 aa, Mycobacterium
YLKRYLRWVPQQSDADAWKNGQ

SEQ ID NO: 756141 - protein, 20 aa, Mycobacterium
YLKYLKGCADLFRDGYTDVC

SEQ ID NO: 756142 - protein, 18 aa, Mycobacterium
YLLAAEAAWRELVKTRGS

SEQ ID NO: 756143 - protein, 25 aa, Mycobacterium
YLLAAREITARHGALLVLDEVQTGI

SEQ ID NO: 756144 - protein, 18 aa, Mycobacterium
YLLAFGRVKDDLRRSQTE

SEQ ID NO: 756145 - protein, 25 aa, Mycobacterium
YLLAHLVDVDMPFTIAVPGGGCVQL

SEQ ID NO: 756146 - protein, 18 aa, Mycobacterium
YLLAQARVGAYARELGEE

SEQ ID NO: 756147 - protein, 19 aa, Mycobacterium
YLLAWPQHHAALLAVEICS

SEQ ID NO: 756148 - protein, 18 aa, Mycobacterium
YLLDLHRQGKFPFDKLIT

SEQ ID NO: 756149 - protein, 19 aa, Mycobacterium
YLLDPRVVDGTSWITGADE

SEQ ID NO: 756150 - protein, 18 aa, Mycobacterium
YLLDTFAGLDPRFVTENE

SEQ ID NO: 756151 - protein, 18 aa, Mycobacterium
YLLDTFAGLDPRYVTEAE

SEQ ID NO: 756152 - protein, 18 aa, Mycobacterium
YLLEETYELFDAVHGGDL

SEQ ID NO: 756153 - protein, 18 aa, Mycobacterium
YLLEETYELLDAVHRGDV

SEQ ID NO: 756154 - protein, 18 aa, Mycobacterium
YLLEETYELLDAVHSGSV

SEQ ID NO: 756155 - protein, 22 aa, Mycobacterium
YLLERLRAWGVEQVFGYPGDGI

SEQ ID NO: 756156 - protein, 17 aa, Mycobacterium
YLLGCLEQLAAEFPGVV

SEQ ID NO: 756157 - protein, 17 aa, Mycobacterium
YLLIASPAGAYFKGGVN

SEQ ID NO: 756158 - protein, 25 aa, Mycobacterium
YLLKDRVADVPAFLDAVEVVGAGGT

SEQ ID NO: 756159 - protein, 17 aa, Mycobacterium
YLLLGLRFDRIEDGYVD

SEQ ID NO: 756160 - protein, 19 aa, Mycobacterium
YLLPHLKPGMTVLDVGCGP

SEQ ID NO: 756161 - protein, 18 aa, Mycobacterium
YLLPRIEAHLESRGFFDD

SEQ ID NO: 756162 - protein, 25 aa, Mycobacterium
YLLSSGFPFLPLSHHIIKNSAKVMS

SEQ ID NO: 756163 - protein, 23 aa, Mycobacterium
YLLWARANVVAGYRYSVEARQES

SEQ ID NO: 756164 - protein, 18 aa, Mycobacterium
YLLYLDFKVDDTMHTATF

SEQ ID NO: 756165 - protein, 26 aa, Mycobacterium
YLMAHPCPMCLGSLYYCSPKEVIFLI

SEQ ID NO: 756166 - protein, 18 aa, Mycobacterium
YLMFSVFAVAPGELGEDR

SEQ ID NO: 756167 - protein, 18 aa, Mycobacterium
YLMFSVFSVKPGVLGDDD

SEQ ID NO: 756168 - protein, 18 aa, Mycobacterium
YLMFSVFSVRPGELGDHR

SEQ ID NO: 756169 - protein, 17 aa, Mycobacterium
YLMPNAIVAVDRIPLTA

SEQ ID NO: 756170 - protein, 17 aa, Mycobacterium
YLMRALPRVARAVSSNP

SEQ ID NO: 756171 - protein, 24 aa, Mycobacterium
YLMVSLRSLPLVILIGRPEARIPV

SEQ ID NO: 756172 - protein, 23 aa, Mycobacterium
YLMVSLRSLPLVMLIGRPEARIP

SEQ ID NO: 756173 - protein, 20 aa, Mycobacterium
YLNAINVMRGAEAISTYAPI

SEQ ID NO: 756174 - protein, 18 aa, Mycobacterium
YLNDRVVALPELLRDAGY

SEQ ID NO: 756175 - protein, 29 aa, Mycobacterium
YLNDRVVALPELLRDAGYLTLMSGKWHLG

SEQ ID NO: 756176 - protein, 23 aa, Mycobacterium
YLNRPRWPDVKGRDTFAGVSVHS

SEQ ID NO: 756177 - protein, 33 aa, Mycobacterium
YLNRPRWPELPGRETFSGISLHSARWDPNLDLT

SEQ ID NO: 756178 - protein, 21 aa, Mycobacterium
YLNSGGNAWVRVNDASSDFWS

SEQ ID NO: 756179 - protein, 22 aa, Mycobacterium
YLPDDVDAFLAMHDLTKNDIGA

SEQ ID NO: 756180 - protein, 18 aa, Mycobacterium
YLPDGNIEYLGRRDDQVK

SEQ ID NO: 756181 - protein, 23 aa, Mycobacterium
YLPGEALLALYRHRGAVIDAGVG

SEQ ID NO: 756182 - protein, 18 aa, Mycobacterium
YLPGGTLLESGYLPPAAV

SEQ ID NO: 756183 - protein, 20 aa, Mycobacterium
YLPKPFSMRVLVARVAALLR

SEQ ID NO: 756184 - protein, 28 aa, Mycobacterium
YLPPGCFADGVLRPAVGSSWCEWKGKAS

SEQ ID NO: 756185 - protein, 24 aa, Mycobacterium
YLPPQLREKLGFGWTAAQQRRFDR

SEQ ID NO: 756186 - protein, 26 aa, Mycobacterium
YLPPVGIGEVMRAGGLGEIVASKTPR

SEQ ID NO: 756187 - protein, 21 aa, Mycobacterium
YLPSAPRCKLCNNPFGGPVGR

SEQ ID NO: 756188 - protein, 27 aa, Mycobacterium
YLPTAIAPAAFRWLGRRDAPNRLMNVA

SEQ ID NO: 756189 - protein, 18 aa, Mycobacterium
YLPYDLLRGKLWHDTRCE

SEQ ID NO: 756190 - protein, 19 aa, Mycobacterium
YLQEALRWLPADINAGAAL

SEQ ID NO: 756191 - protein, 19 aa, Mycobacterium
YLQINPYFHTFGLKAGLVT

SEQ ID NO: 756192 - protein, 24 aa, Mycobacterium
YLRADELHLGFNFRLVKADYDAAE

SEQ ID NO: 756193 - protein, 20 aa, Mycobacterium
YLRAGAIARFAPVMGEVVAA

SEQ ID NO: 756194 - protein, 23 aa, Mycobacterium
YLRALGALPRFAGRSTVRTWLLS

SEQ ID NO: 756195 - protein, 20 aa, Mycobacterium
YLRASGMALPLADNSVDICL

SEQ ID NO: 756196 - protein, 25 aa, Mycobacterium
YLRASGVPLLAVWGDKDPFFGPDGA

SEQ ID NO: 756197 - protein, 17 aa, Mycobacterium
YLRCACRRGCAYTTSVP

SEQ ID NO: 756198 - protein, 25 aa, Mycobacterium
YLRDDLPFALALVIRSVLQRFRRTR

SEQ ID NO: 756199 - protein, 19 aa, Mycobacterium
YLRDHVCPQLIGRDAQRIE

SEQ ID NO: 756200 - protein, 18 aa, Mycobacterium
YLREHITYGYAITVHSAQ

SEQ ID NO: 756201 - protein, 23 aa, Mycobacterium
YLREHPDRIPAFIEESLRMHSPT

SEQ ID NO: 756202 - protein, 22 aa, Mycobacterium
YLRERRSALSGSGFRRMCRDEF

SEQ ID NO: 756203 - protein, 18 aa, Mycobacterium
YLRFGFEVTGEITVPGGG

SEQ ID NO: 756204 - protein, 18 aa, Mycobacterium
YLRGACRVAFDAPLVVAN

SEQ ID NO: 756205 - protein, 22 aa, Mycobacterium
YLRGHLPGAVYVSLEAELSDHT

SEQ ID NO: 756206 - protein, 20 aa, Mycobacterium
YLRGPGFKGMREYLRRNTAE

SEQ ID NO: 756207 - protein, 17 aa, Mycobacterium
YLRGRAALIDLKHAKPA

SEQ ID NO: 756208 - protein, 22 aa, Mycobacterium
YLRGTPLGPLRSEAWIDRTEGV

SEQ ID NO: 756209 - protein, 22 aa, Mycobacterium
YLRHFGVPLVDGYCDRYAFADL

SEQ ID NO: 756210 - protein, 19 aa, Mycobacterium
YLRIREWQDLVGQLRSICR

SEQ ID NO: 756211 - protein, 24 aa, Mycobacterium
YLRKFGLSRVRVRELVHDGSLPGV

SEQ ID NO: 756212 - protein, 24 aa, Mycobacterium
YLRLAESIVAAGAHVLAIKDMAGL

SEQ ID NO: 756213 - protein, 21 aa, Mycobacterium
YLRLYPDDVITARFVVINGCR

SEQ ID NO: 756214 - protein, 24 aa, Mycobacterium
YLRMDDFPARLVIVPGERDRLDEA

SEQ ID NO: 756215 - protein, 24 aa, Mycobacterium
YLRMDDFPARLVIVPGTQDRLAEA

SEQ ID NO: 756216 - protein, 25 aa, Mycobacterium
YLRMDEFPARLIIVPGENDRLLESG

SEQ ID NO: 756217 - protein, 19 aa, Mycobacterium
YLRNGCVYGSLTSELLEAD

SEQ ID NO: 756218 - protein, 25 aa, Mycobacterium
YLRPDELHLGFNFRLARIEFDGAEI

SEQ ID NO: 756219 - protein, 25 aa, Mycobacterium
YLRPDELHLGFNFRLARTDFDAAEI

SEQ ID NO: 756220 - protein, 24 aa, Mycobacterium
YLRPDELHLGFNFRLTKIDFDADQ

SEQ ID NO: 756221 - protein, 23 aa, Mycobacterium
YLRPETAQGIFINFANVVTTSRK

SEQ ID NO: 756222 - protein, 22 aa, Mycobacterium
YLRPETAQGIFINFKNVVTTSR

SEQ ID NO: 756223 - protein, 18 aa, Mycobacterium
YLRRALTSTELWPVGLED

SEQ ID NO: 756224 - protein, 18 aa, Mycobacterium
YLRRASLNRAMFGAPEDH

SEQ ID NO: 756225 - protein, 17 aa, Mycobacterium
YLRRESISRALMVVLDR

SEQ ID NO: 756226 - protein, 19 aa, Mycobacterium
YLRRFTAALDASIRGGFIL

SEQ ID NO: 756227 - protein, 22 aa, Mycobacterium
YLRRLLSGEVIDFIELDMPEHT

SEQ ID NO: 756228 - protein, 17 aa, Mycobacterium
YLRSEGWTIEQYDITGY

SEQ ID NO: 756229 - protein, 19 aa, Mycobacterium
YLRTLAGFNEVDWYVRHLL

SEQ ID NO: 756230 - protein, 25 aa, Mycobacterium
YLRTLEVLERFYSLVLTDCGTGLIH

SEQ ID NO: 756231 - protein, 23 aa, Mycobacterium
YLRTLPADGWLRVLCSTNQIGQH

SEQ ID NO: 756232 - protein, 22 aa, Mycobacterium
YLRTPRVANEMIARRELTSQGA

SEQ ID NO: 756233 - protein, 23 aa, Mycobacterium
YLRTSGVPVLAVWGRNDPIFGPD

SEQ ID NO: 756234 - protein, 25 aa, Mycobacterium
YLRYGRGRHPAGLNCGDTMAYATAK

SEQ ID NO: 756235 - protein, 18 aa, Mycobacterium
YLSAEWPLGQWDFVDPEA

SEQ ID NO: 756236 - protein, 17 aa, Mycobacterium
YLSAWRAKVKGITVYRY

SEQ ID NO: 756237 - protein, 26 aa, Mycobacterium
YLSDPRLRRIFTFQSLYAGVAPRDAL

SEQ ID NO: 756238 - protein, 20 aa, Mycobacterium
YLSDSFARVVGWAPEHVTVR

SEQ ID NO: 756239 - protein, 26 aa, Mycobacterium
YLSGAKLDVIVPMSFLCDGYGLNVTL

SEQ ID NO: 756240 - protein, 26 aa, Mycobacterium
YLSGEWAQAYGFPAMPVDGILVGTAA

SEQ ID NO: 756241 - protein, 19 aa, Mycobacterium
YLSGIRSTYPLSYGPQSDG

SEQ ID NO: 756242 - protein, 17 aa, Mycobacterium
YLSGRWAEVHGYPLMPI

SEQ ID NO: 756243 - protein, 18 aa, Mycobacterium
YLSKSGVVAVGEIGYDSM

SEQ ID NO: 756244 - protein, 25 aa, Mycobacterium
YLSQTFRQACCTLGINLQPAHPDCP

SEQ ID NO: 756245 - protein, 17 aa, Mycobacterium
YLSRAICDDRWLDRPGP

SEQ ID NO: 756246 - protein, 26 aa, Mycobacterium
YLSRDLTIRLGREVTRISHDATGVRV

SEQ ID NO: 756247 - protein, 18 aa, Mycobacterium
YLSSAVTGMAPWDGTSFW

SEQ ID NO: 756248 - protein, 17 aa, Mycobacterium
YLSSVCTGSLILAAAGL

SEQ ID NO: 756249 - protein, 18 aa, Mycobacterium
YLTAGLQPVDCRFCHVTV

SEQ ID NO: 756250 - protein, 24 aa, Mycobacterium
YLTAGPKEARAWVIHQGDTAPKAA

SEQ ID NO: 756251 - protein, 18 aa, Mycobacterium
YLTALGMPAVEAHEAELV

SEQ ID NO: 756252 - protein, 37 aa, Mycobacterium
YLTDWAGPNARIKSIGLRLGVPWYAYDTVTFRGEVTA

SEQ ID NO: 756253 - protein, 19 aa, Mycobacterium
YLTEAIPVQIVWGTKDVVV

SEQ ID NO: 756254 - protein, 21 aa, Mycobacterium
YLTEHVYRPLGMTDSTFAPSD

SEQ ID NO: 756255 - protein, 19 aa, Mycobacterium
YLTEKGHVVVCGRVKDVII

SEQ ID NO: 756256 - protein, 20 aa, Mycobacterium
YLTGCADGFRVGYIDVNQFT

SEQ ID NO: 756257 - protein, 21 aa, Mycobacterium
YLTGCAEGFREGWIDVVQFTC

SEQ ID NO: 756258 - protein, 22 aa, Mycobacterium
YLTGCAKAFRTGYIDVNQFTLQ

SEQ ID NO: 756259 - protein, 18 aa, Mycobacterium
YLTGCAQLFRDGQVDVVQ

SEQ ID NO: 756260 - protein, 17 aa, Mycobacterium
YLTGCRELFRDGYTDVC

SEQ ID NO: 756261 - protein, 20 aa, Mycobacterium
YLTGRGWRVSTRPRRDLFGD

SEQ ID NO: 756262 - protein, 24 aa, Mycobacterium
YLTIDGRMIIVGSYAGAPRHPAWV

SEQ ID NO: 756263 - protein, 24 aa, Mycobacterium
YLTIRGLKTLPLRMQRHSENATAV

SEQ ID NO: 756264 - protein, 24 aa, Mycobacterium
YLTKRRLSYSIGFALTQTIATAIE

SEQ ID NO: 756265 - protein, 17 aa, Mycobacterium
YLTLRLTGVASLTVDVE

SEQ ID NO: 756266 - protein, 25 aa, Mycobacterium
YLTMLSWYALCGIVEVGGSLEKFNS

SEQ ID NO: 756267 - protein, 23 aa, Mycobacterium
YLTPAATWGAFPGHVINDVQSGI

SEQ ID NO: 756268 - protein, 19 aa, Mycobacterium
YLTQAIPVQIIWGSRDAVV

SEQ ID NO: 756269 - protein, 20 aa, Mycobacterium
YLTQAIPVQIIWGSRDVVVP

SEQ ID NO: 756270 - protein, 24 aa, Mycobacterium
YLTQCCYTVHTIFDVKPETDVFWC

SEQ ID NO: 756271 - protein, 19 aa, Mycobacterium
YLTQSVPVQLIWGSQDSVI

SEQ ID NO: 756272 - protein, 18 aa, Mycobacterium
YLTTLGIGPYTPTGVIGY

SEQ ID NO: 756273 - protein, 22 aa, Mycobacterium
YLTTRPFLEFHVRQRVQRLGNV

SEQ ID NO: 756274 - protein, 20 aa, Mycobacterium
YLTVPMYFGAELVKITPMDF

SEQ ID NO: 756275 - protein, 19 aa, Mycobacterium
YLTVTGRISEFIVRGGKNI

SEQ ID NO: 756276 - protein, 25 aa, Mycobacterium
YLVAEAPGQVWLAGAGRVTILEEVR

SEQ ID NO: 756277 - protein, 18 aa, Mycobacterium
YLVAFFGALYAGRIAVPL

SEQ ID NO: 756278 - protein, 17 aa, Mycobacterium
YLVARRVLPDGSAHVFH

SEQ ID NO: 756279 - protein, 17 aa, Mycobacterium
YLVDAKVATAIAVDDGT

SEQ ID NO: 756280 - protein, 25 aa, Mycobacterium
YLVEKRFNLNWSIEGTRSRTGKMLP

SEQ ID NO: 756281 - protein, 21 aa, Mycobacterium
YLVELARWSGRYGSRAGVPAH

SEQ ID NO: 756282 - protein, 18 aa, Mycobacterium
YLVGIGFDPALIHSELFG

SEQ ID NO: 756283 - protein, 17 aa, Mycobacterium
YLVGVALSVDPEGDTDT

SEQ ID NO: 756284 - protein, 24 aa, Mycobacterium
YLVHPELPAGVGAEGVGIVEAVGP

SEQ ID NO: 756285 - protein, 22 aa, Mycobacterium
YLVHQRRLFPLIARSYALQYAQ

SEQ ID NO: 756286 - protein, 25 aa, Mycobacterium
YLVLAKWKLAIVLEQGFQRAGDDEK

SEQ ID NO: 756287 - protein, 25 aa, Mycobacterium
YLVLANWKLGIVLEKTYAAAVRPGP

SEQ ID NO: 756288 - protein, 25 aa, Mycobacterium
YLVLANWKLGIVLEKTYAAGVRTGK

SEQ ID NO: 756289 - protein, 23 aa, Mycobacterium
YLVPGMRQRGWGRIIQIGGGLAL

SEQ ID NO: 756290 - protein, 20 aa, Mycobacterium
YLVRYWRLLKFKLANPHIIT

SEQ ID NO: 756291 - protein, 22 aa, Mycobacterium
YLVSLLPRRIVDDLGARVQLAR

SEQ ID NO: 756292 - protein, 22 aa, Mycobacterium
YLVSLPAAHNFPLACPGILGSM

SEQ ID NO: 756293 - protein, 25 aa, Mycobacterium
YLVTVITWHRHIGGLIAQAKADIGN

SEQ ID NO: 756294 - protein, 23 aa, Mycobacterium
YLWVRGATAYGRFCVETGRLSEA

SEQ ID NO: 756295 - protein, 19 aa, Mycobacterium
YLYEFAQSFDGKSPTEIAA

SEQ ID NO: 756296 - protein, 17 aa, Mycobacterium
YLYHDVVLVRTPATALH

SEQ ID NO: 756297 - protein, 22 aa, Mycobacterium
YLYIKDRIKDMIISGGENIYPA

SEQ ID NO: 756298 - protein, 26 aa, Mycobacterium
YLYRFDFATPMLRLLRLGAAHATELP

SEQ ID NO: 756299 - protein, 20 aa, Mycobacterium
YMACLPRGRVRVVRHDLPDT

SEQ ID NO: 756300 - protein, 20 aa, Mycobacterium
YMAGSRLGFERNVVQLHQVL

SEQ ID NO: 756301 - protein, 18 aa, Mycobacterium
YMAIPALWGGSGVFKGFG

SEQ ID NO: 756302 - protein, 17 aa, Mycobacterium
YMAKIFNDAWMSSYGFL

SEQ ID NO: 756303 - protein, 27 aa, Mycobacterium
YMALQLGWRLFEPMLRSATGLDELPQA

SEQ ID NO: 756304 - protein, 17 aa, Mycobacterium
YMAQVLIKAEPRPSWGH

SEQ ID NO: 756305 - protein, 18 aa, Mycobacterium
YMAREFGNAGSRTHGYGQ

SEQ ID NO: 756306 - protein, 24 aa, Mycobacterium
YMDFTFAGLPAFLQKKGRKVRFMA

SEQ ID NO: 756307 - protein, 19 aa, Mycobacterium
YMFSPKVLDRAFTFEFRVT

SEQ ID NO: 756308 - protein, 17 aa, Mycobacterium
YMGPFGWLGLDLTAAEV

SEQ ID NO: 756309 - protein, 22 aa, Mycobacterium
YMGRGFAKATLFGPTEVAEQYG

SEQ ID NO: 756310 - protein, 19 aa, Mycobacterium
YMHHLFKAKEILASTLATI

SEQ ID NO: 756311 - protein, 18 aa, Mycobacterium
YMHKRRDGVIDGNETERL

SEQ ID NO: 756312 - protein, 24 aa, Mycobacterium
YMHPEAMAGLGLQSGAAVSVTSGH

SEQ ID NO: 756313 - protein, 18 aa, Mycobacterium
YMIGSSFGSIIGSLVARC

SEQ ID NO: 756314 - protein, 25 aa, Mycobacterium
YMIRVKEMWESVKIVEQCLDKLKPG

SEQ ID NO: 756315 - protein, 22 aa, Mycobacterium
YMIRVNEMWESIKIIEQCLDKL

SEQ ID NO: 756316 - protein, 22 aa, Mycobacterium
YMIRVNEMWESIKIVEQCLDKL

SEQ ID NO: 756317 - protein, 19 aa, Mycobacterium
YMKMITPAALLRCLVEGAD

SEQ ID NO: 756318 - protein, 19 aa, Mycobacterium
YMKMITPAALLRCLVEGRD

SEQ ID NO: 756319 - protein, 19 aa, Mycobacterium
YMKYLRGCEHYFTDEMLDC

SEQ ID NO: 756320 - protein, 23 aa, Mycobacterium
YMLKSVAAKDVWVRPTERAIAEA

SEQ ID NO: 756321 - protein, 17 aa, Mycobacterium
YMLPSSFVTLESLPLTV

SEQ ID NO: 756322 - protein, 17 aa, Mycobacterium
YMMAKLIIKLINSVAEI

SEQ ID NO: 756323 - protein, 26 aa, Mycobacterium
YMMEYRVARAYVDGRIQTIFGGTTEI

SEQ ID NO: 756324 - protein, 19 aa, Mycobacterium
YMPDRHRITSAAMQLDLTG

SEQ ID NO: 756325 - protein, 25 aa, Mycobacterium
YMREYRVSQAFVDARIQTIYGGTNE

SEQ ID NO: 756326 - protein, 17 aa, Mycobacterium
YMRPLLRRSNLTILTGA

SEQ ID NO: 756327 - protein, 17 aa, Mycobacterium
YMSKIFNDAWMSSYGFL

SEQ ID NO: 756328 - protein, 20 aa, Mycobacterium
YMSVRSWDTPGRWTTNFSAI

SEQ ID NO: 756329 - protein, 23 aa, Mycobacterium
YMVRLYRAQRRFSTAAGSFPRRC

SEQ ID NO: 756330 - protein, 25 aa, Mycobacterium
YMYAMGAGFADIFYHLGTDEQKKWA

SEQ ID NO: 756331 - protein, 19 aa, Mycobacterium
YMYFPDEFVPVSSRAAIDH

SEQ ID NO: 756332 - protein, 19 aa, Mycobacterium
YNAHPHFREMAPDLSGGRA

SEQ ID NO: 756333 - protein, 20 aa, Mycobacterium
YNAICSVYGHLHIPRTTWYD

SEQ ID NO: 756334 - protein, 17 aa, Mycobacterium
YNALPPGGIMLLHTIVR

SEQ ID NO: 756335 - protein, 24 aa, Mycobacterium
YNANLPKLNSFVLPGGTALSALLH

SEQ ID NO: 756336 - protein, 22 aa, Mycobacterium
YNAVLKRYWYHAWWFYAHSIVR

SEQ ID NO: 756337 - protein, 21 aa, Mycobacterium
YNAWTQLPFVDAIYGHNREAI

SEQ ID NO: 756338 - protein, 17 aa, Mycobacterium
YNDFEIVAANLLDGDPR

SEQ ID NO: 756339 - protein, 23 aa, Mycobacterium
YNDIPMTFHFRGPGTALDGDEPM

SEQ ID NO: 756340 - protein, 24 aa, Mycobacterium
YNDLCDLMALAARGAVNLHTQKYA

SEQ ID NO: 756341 - protein, 18 aa, Mycobacterium
YNDLRIVDNVRYFATLYG

SEQ ID NO: 756342 - protein, 19 aa, Mycobacterium
YNDLRVVDNVRYFASLYGF

SEQ ID NO: 756343 - protein, 18 aa, Mycobacterium
YNERAAEVGDHFDTPDAD

SEQ ID NO: 756344 - protein, 20 aa, Mycobacterium
YNGDGYDPFIDKLLKDGEPR

SEQ ID NO: 756345 - protein, 19 aa, Mycobacterium
YNGKCLRASAGSIFAIPVI

SEQ ID NO: 756346 - protein, 18 aa, Mycobacterium
YNGKCLRASAGSIFNIPV

SEQ ID NO: 756347 - protein, 20 aa, Mycobacterium
YNGKCLRASAGSIFSIPVIS

SEQ ID NO: 756348 - protein, 21 aa, Mycobacterium
YNGKFPPPVKFQIAYDPGHVW

SEQ ID NO: 756349 - protein, 22 aa, Mycobacterium
YNGKRDIVFEMAMNVPIGDCTM

SEQ ID NO: 756350 - protein, 17 aa, Mycobacterium
YNGLPLGDLDIFETMSR

SEQ ID NO: 756351 - protein, 25 aa, Mycobacterium
YNGPACAYVANPFGGYQVNAQGERF

SEQ ID NO: 756352 - protein, 18 aa, Mycobacterium
YNHAFRYPSAMDAFNDFN

SEQ ID NO: 756353 - protein, 17 aa, Mycobacterium
YNHGFLRARMQLLHDEA

SEQ ID NO: 756354 - protein, 24 aa, Mycobacterium
YNHGFLRQRMQLLQEEFAKNGQEG

SEQ ID NO: 756355 - protein, 17 aa, Mycobacterium
YNHYAVGWAHALCAPYQ

SEQ ID NO: 756356 - protein, 22 aa, Mycobacterium
YNHYPIGWAMAFNTPYKLFKRY

SEQ ID NO: 756357 - protein, 22 aa, Mycobacterium
YNHYPIGWAMAFNTPYKLYKRY

SEQ ID NO: 756358 - protein, 32 aa, Mycobacterium
YNIAGLPFPLSSAILPRFLYTKQIGQRLNSYY

SEQ ID NO: 756359 - protein, 26 aa, Mycobacterium
YNIEYRRVGSGGGWPTTFHDVATALD

SEQ ID NO: 756360 - protein, 21 aa, Mycobacterium
YNIKTNAIAPIAATRMTQDIL

SEQ ID NO: 756361 - protein, 20 aa, Mycobacterium
YNKAGLWPYLEKLGFFLVGY

SEQ ID NO: 756362 - protein, 25 aa, Mycobacterium
YNKAWEAFDPFDLSGSLARARMELQ

SEQ ID NO: 756363 - protein, 21 aa, Mycobacterium
YNKGDYGFFWITAVTTDGDIV

SEQ ID NO: 756364 - protein, 18 aa, Mycobacterium
YNKGWEAFDPVDLAASLA

SEQ ID NO: 756365 - protein, 22 aa, Mycobacterium
YNKHMIFPKPGVDLSDPDSFAS

SEQ ID NO: 756366 - protein, 18 aa, Mycobacterium
YNKQRMTVILDGRQAKAL

SEQ ID NO: 756367 - protein, 24 aa, Mycobacterium
YNKSVTHLAAWLLRGLRRLGVTVP

SEQ ID NO: 756368 - protein, 19 aa, Mycobacterium
YNLARVIAVELGFDFLPGT

SEQ ID NO: 756369 - protein, 30 aa, Mycobacterium
YNLEWKPVGGFPVRFGWISAIRRGHAELHR

SEQ ID NO: 756370 - protein, 18 aa, Mycobacterium
YNLFANIRPARALSKSVR

SEQ ID NO: 756371 - protein, 18 aa, Mycobacterium
YNLGKFWRDNRFQAFEGI

SEQ ID NO: 756372 - protein, 19 aa, Mycobacterium
YNLGWKLAAVIYGAPEKLL

SEQ ID NO: 756373 - protein, 31 aa, Mycobacterium
YNLIPSLFTEHAFYFGDTHVRLRGKEQAHFL

SEQ ID NO: 756374 - protein, 29 aa, Mycobacterium
YNLIPSLFTEHAFYFGDTHVRLRGREQAH

SEQ ID NO: 756375 - protein, 18 aa, Mycobacterium
YNLLCRPAVVAVADGQAR

SEQ ID NO: 756376 - protein, 18 aa, Mycobacterium
YNLLHAWLQTPLTFAKWD

SEQ ID NO: 756377 - protein, 25 aa, Mycobacterium
YNLLRSGGYGGPGFGGLVYTDDLSS

SEQ ID NO: 756378 - protein, 24 aa, Mycobacterium
YNLPARYERYAQLATAMGVDTRNM

SEQ ID NO: 756379 - protein, 17 aa, Mycobacterium
YNLQWKPIGGFPVTVGW

SEQ ID NO: 756380 - protein, 29 aa, Mycobacterium
YNLQWKPVGGFPITFGWLHAVRRGQARLH

SEQ ID NO: 756381 - protein, 17 aa, Mycobacterium
YNLQWKPVGGFPITVGW

SEQ ID NO: 756382 - protein, 17 aa, Mycobacterium
YNLQWKPVGGFPVTLGW

SEQ ID NO: 756383 - protein, 26 aa, Mycobacterium
YNPDYLPGTLLPPGIRATADAAEALA

SEQ ID NO: 756384 - protein, 18 aa, Mycobacterium
YNPGHLMVVPYRRVAELE

SEQ ID NO: 756385 - protein, 18 aa, Mycobacterium
YNPGLRLIGVDTVGSTIF

SEQ ID NO: 756386 - protein, 27 aa, Mycobacterium
YNPLRFVQATLKWCRKAQELGTLDEAG

SEQ ID NO: 756387 - protein, 18 aa, Mycobacterium
YNPLWPDIDELVRLLESG

SEQ ID NO: 756388 - protein, 19 aa, Mycobacterium
YNPLWPNIDELVGLLESGV

SEQ ID NO: 756389 - protein, 18 aa, Mycobacterium
YNPLWPNIDELVRLLESG

SEQ ID NO: 756390 - protein, 18 aa, Mycobacterium
YNPLWPNMDELVRLLESG

SEQ ID NO: 756391 - protein, 17 aa, Mycobacterium
YNPRLRRAYRIEDGIPV

SEQ ID NO: 756392 - protein, 17 aa, Mycobacterium
YNPRLRRAYRIENSIPV

SEQ ID NO: 756393 - protein, 22 aa, Mycobacterium
YNPRYYPALVEASGYRKKFDTA

SEQ ID NO: 756394 - protein, 22 aa, Mycobacterium
YNPWDERICLAPNGDLFKAIRD

SEQ ID NO: 756395 - protein, 17 aa, Mycobacterium
YNQEAWYNNTLKTQLER

SEQ ID NO: 756396 - protein, 17 aa, Mycobacterium
YNQHLYDAATLRALVDV

SEQ ID NO: 756397 - protein, 17 aa, Mycobacterium
YNRKALDPDQVVDGVLE

SEQ ID NO: 756398 - protein, 26 aa, Mycobacterium
YNRRSRFPHRWWWVTLTDEAFPRLSV

SEQ ID NO: 756399 - protein, 28 aa, Mycobacterium
YNRRSRFPHRWWWVVLSEEAFPRLAVVR

SEQ ID NO: 756400 - protein, 19 aa, Mycobacterium
YNRSWNCGVEGPTDDPQIL

SEQ ID NO: 756401 - protein, 25 aa, Mycobacterium
YNSQVVGFQDGWRGLLENRRIHLHN

SEQ ID NO: 756402 - protein, 18 aa, Mycobacterium
YNTAFAYLDDLRESGRLT

SEQ ID NO: 756403 - protein, 17 aa, Mycobacterium
YNTEGLPYFSIGMANNF

SEQ ID NO: 756404 - protein, 17 aa, Mycobacterium
YNTFGFFAPHNQYAANR

SEQ ID NO: 756405 - protein, 17 aa, Mycobacterium
YNTLLMLLFEWGVGTQH

SEQ ID NO: 756406 - protein, 30 aa, Mycobacterium
YNTLSFLWRELAGFSRDDWALPLAVVVEGR

SEQ ID NO: 756407 - protein, 23 aa, Mycobacterium
YNTMLCIFFEWGVGLQHLEVGKI

SEQ ID NO: 756408 - protein, 35 aa, Mycobacterium
YNTRLEAHLGQRLQLRFADVVGEGRGKRPVREIVG

SEQ ID NO: 756409 - protein, 17 aa, Mycobacterium
YNTYCVGKWHLAPEETM

SEQ ID NO: 756410 - protein, 19 aa, Mycobacterium
YNVAFRRCDQEAAYHNFFS

SEQ ID NO: 756411 - protein, 24 aa, Mycobacterium
YNVANCLLALAILDAVGVSPEQAA

SEQ ID NO: 756412 - protein, 24 aa, Mycobacterium
YNVANCLVAIAILDVLGVSAATAA

SEQ ID NO: 756413 - protein, 23 aa, Mycobacterium
YNVEELIRYAIEHRDEVEQIAES

SEQ ID NO: 756414 - protein, 23 aa, Mycobacterium
YNVLRAAWPHFREQSYGRIVVAT

SEQ ID NO: 756415 - protein, 18 aa, Mycobacterium
YNVNLFLDGIQQFVNGDP

SEQ ID NO: 756416 - protein, 17 aa, Mycobacterium
YNWAQEYVDVVYKLWEG

SEQ ID NO: 756417 - protein, 24 aa, Mycobacterium
YNWIKEFDPRFNIRYRDDKSYPVL

SEQ ID NO: 756418 - protein, 24 aa, Mycobacterium
YNWIKEFDPRFNVRYRDDKSYPVL

SEQ ID NO: 756419 - protein, 21 aa, Mycobacterium
YNWLTGIRIQDGLLKQLGSQG

SEQ ID NO: 756420 - protein, 17 aa, Mycobacterium
YPAAVTVGEVWVHDNAR

SEQ ID NO: 756421 - protein, 26 aa, Mycobacterium
YPADQLRWWAEHILLWHRDGHRVVVY

SEQ ID NO: 756422 - protein, 19 aa, Mycobacterium
YPAGHGFAVPDHLSVYDEA

SEQ ID NO: 756423 - protein, 18 aa, Mycobacterium
YPAGSLLAADYEEFLAGA

SEQ ID NO: 756424 - protein, 18 aa, Mycobacterium
YPAGSLLAVEYEAFLSGT

SEQ ID NO: 756425 - protein, 19 aa, Mycobacterium
YPAGVDWVLAFWGTVMAGG

SEQ ID NO: 756426 - protein, 19 aa, Mycobacterium
YPAGVWVIDIGELRDGALL

SEQ ID NO: 756427 - protein, 21 aa, Mycobacterium
YPALHTFCGPTRKLGGDCADF

SEQ ID NO: 756428 - protein, 20 aa, Mycobacterium
YPALNKRAGVPFDVVGTKGC

SEQ ID NO: 756429 - protein, 18 aa, Mycobacterium
YPAPAPRFSRSVPSAPKA

SEQ ID NO: 756430 - protein, 23 aa, Mycobacterium
YPAPDPFEPFAIAAVELAGEGLI

SEQ ID NO: 756431 - protein, 18 aa, Mycobacterium
YPAPSDWTRRTLTCGVAL

SEQ ID NO: 756432 - protein, 18 aa, Mycobacterium
YPAQLKAAALGAGAIAQV

SEQ ID NO: 756433 - protein, 22 aa, Mycobacterium
YPARFIPMAIPVIWDAEACAAE

SEQ ID NO: 756434 - protein, 18 aa, Mycobacterium
YPARIGVMPRDGGNEDVR

SEQ ID NO: 756435 - protein, 17 aa, Mycobacterium
YPARIGVMPREGGNRDV

SEQ ID NO: 756436 - protein, 18 aa, Mycobacterium
YPARIGVMPREGGNSDIR

SEQ ID NO: 756437 - protein, 19 aa, Mycobacterium
YPASAILTNYLPRYLRGIC

SEQ ID NO: 756438 - protein, 17 aa, Mycobacterium
YPASIPIDGVALNITCT

SEQ ID NO: 756439 - protein, 18 aa, Mycobacterium
YPATEPWSPSNTVRTVAV

SEQ ID NO: 756440 - protein, 21 aa, Mycobacterium
YPATSLCLYDASAIGDEVLMD

SEQ ID NO: 756441 - protein, 28 aa, Mycobacterium
YPATWQAPLRWAIRGALAVRAGLVVGNS

SEQ ID NO: 756442 - protein, 20 aa, Mycobacterium
YPAVMNVLLALRMAERTGEG

SEQ ID NO: 756443 - protein, 21 aa, Mycobacterium
YPAVRLDLRLVELADADDAAP

SEQ ID NO: 756444 - protein, 18 aa, Mycobacterium
YPCDHFGVYHGQECHELV

SEQ ID NO: 756445 - protein, 24 aa, Mycobacterium
YPDAAAEPVEFARRLSRAIAAEVH

SEQ ID NO: 756446 - protein, 22 aa, Mycobacterium
YPDAHFEYDFAPRGERSIARGY

SEQ ID NO: 756447 - protein, 20 aa, Mycobacterium
YPDAPKLPAVVGYEVAGTVE

SEQ ID NO: 756448 - protein, 21 aa, Mycobacterium
YPDAPKLPAVVGYEVAGTVEA

SEQ ID NO: 756449 - protein, 17 aa, Mycobacterium
YPDDARLGPSLRVVVTA

SEQ ID NO: 756450 - protein, 21 aa, Mycobacterium
YPDDLRAGLRVDKLTNRSVTY

SEQ ID NO: 756451 - protein, 23 aa, Mycobacterium
YPDELLHCIWAWQNRDANLVRSR

SEQ ID NO: 756452 - protein, 21 aa, Mycobacterium
YPDERAKWWSDFDGLAATAVE

SEQ ID NO: 756453 - protein, 25 aa, Mycobacterium
YPDFPEKYWLPIPVDVTAEAIVHAS

SEQ ID NO: 756454 - protein, 18 aa, Mycobacterium
YPDFPGTFTGTALHSHHY

SEQ ID NO: 756455 - protein, 19 aa, Mycobacterium
YPDFPRPPVPTGDGAALDF

SEQ ID NO: 756456 - protein, 18 aa, Mycobacterium
YPDGCQLTLLESKTLRHN

SEQ ID NO: 756457 - protein, 24 aa, Mycobacterium
YPDHRYDTKLAWWDRTTFTKHAEP

SEQ ID NO: 756458 - protein, 23 aa, Mycobacterium
YPDKRSALLPLLHLVQGEDSYLT

SEQ ID NO: 756459 - protein, 25 aa, Mycobacterium
YPDLKIPYHSRWRHFEAGGIDRRQQ

SEQ ID NO: 756460 - protein, 23 aa, Mycobacterium
YPDMAEFLVRIGIDSISLNPDVV

SEQ ID NO: 756461 - protein, 24 aa, Mycobacterium
YPDPHVKAAALLHSLTRNHALVDG

SEQ ID NO: 756462 - protein, 19 aa, Mycobacterium
YPDQWELFRRERPHSTADE

SEQ ID NO: 756463 - protein, 19 aa, Mycobacterium
YPDRIIGCQLPWLLDPELG

SEQ ID NO: 756464 - protein, 23 aa, Mycobacterium
YPDRSGGVLPGYGGSKAALEHLT

SEQ ID NO: 756465 - protein, 20 aa, Mycobacterium
YPDSLALCIVDAIFSSGARH

SEQ ID NO: 756466 - protein, 20 aa, Mycobacterium
YPDTHWRFQYSPESYTGTEL

SEQ ID NO: 756467 - protein, 20 aa, Mycobacterium
YPDTNWRWEYSPESYTGTEL

SEQ ID NO: 756468 - protein, 22 aa, Mycobacterium
YPEASRAAAIVRRTVPGAAAPL

SEQ ID NO: 756469 - protein, 22 aa, Mycobacterium
YPEAVTHFALNRDEFVGWAKLV

SEQ ID NO: 756470 - protein, 26 aa, Mycobacterium
YPEGAPRAAVEPLVLMLAPLAPHLAE

SEQ ID NO: 756471 - protein, 22 aa, Mycobacterium
YPELKKPDGAGIGRDYLEKMLQ

SEQ ID NO: 756472 - protein, 24 aa, Mycobacterium
YPENLPRVNAHGGPGGAPGCWQPI

SEQ ID NO: 756473 - protein, 19 aa, Mycobacterium
YPENRLVALAHSLVARGVI

SEQ ID NO: 756474 - protein, 23 aa, Mycobacterium
YPEQRAKWWSNYDELAHTAVEEI

SEQ ID NO: 756475 - protein, 18 aa, Mycobacterium
YPERGVNAADAFTIAQVA

SEQ ID NO: 756476 - protein, 22 aa, Mycobacterium
YPERVEKLFLMSSPIIATGNNT

SEQ ID NO: 756477 - protein, 28 aa, Mycobacterium
YPEVKKWLAEVLPNFPVYAHMLGNFSVR

SEQ ID NO: 756478 - protein, 22 aa, Mycobacterium
YPEVPFIPAMDIVGASRAHHTE

SEQ ID NO: 756479 - protein, 20 aa, Mycobacterium
YPEWELLVQIMSDDEHPELD

SEQ ID NO: 756480 - protein, 20 aa, Mycobacterium
YPFLEFRQSRPAVRREQIRS

SEQ ID NO: 756481 - protein, 25 aa, Mycobacterium
YPFNSFDWASIWPTLTQRFTVVAPD

SEQ ID NO: 756482 - protein, 17 aa, Mycobacterium
YPFRLLPPRTMRGLIGR

SEQ ID NO: 756483 - protein, 25 aa, Mycobacterium
YPFVLPVAVLEKMRFIHTVIDEVTS

SEQ ID NO: 756484 - protein, 19 aa, Mycobacterium
YPFVRLHQPSAFYGVNSLK

SEQ ID NO: 756485 - protein, 17 aa, Mycobacterium
YPGAPGQWWQQQVVLGL

SEQ ID NO: 756486 - protein, 22 aa, Mycobacterium
YPGAQVHAIFARYGYSPADDSP

SEQ ID NO: 756487 - protein, 18 aa, Mycobacterium
YPGDRPDVLASLRELGFD

SEQ ID NO: 756488 - protein, 18 aa, Mycobacterium
YPGGCTTQSIVMRSKSGT

SEQ ID NO: 756489 - protein, 19 aa, Mycobacterium
YPGGCTTQSIVMRSKSGTV

SEQ ID NO: 756490 - protein, 19 aa, Mycobacterium
YPGGLRKRAIGDLLAKHPT

SEQ ID NO: 756491 - protein, 18 aa, Mycobacterium
YPGITSFVERVFRELNAF

SEQ ID NO: 756492 - protein, 33 aa, Mycobacterium
YPGLRVRVAVSIGPWKGAVAWDVSTGDPIVPPP

SEQ ID NO: 756493 - protein, 17 aa, Mycobacterium
YPGLVALLPTALAETEA

SEQ ID NO: 756494 - protein, 17 aa, Mycobacterium
YPGMAMPGNAARITYSA

SEQ ID NO: 756495 - protein, 21 aa, Mycobacterium
YPGMHAFCGPTRKLGGDCADF

SEQ ID NO: 756496 - protein, 22 aa, Mycobacterium
YPGPRWLVGDLAELDLPARGIA

SEQ ID NO: 756497 - protein, 25 aa, Mycobacterium
YPGQDGRDGGLLIGNGGNGAAGDFG

SEQ ID NO: 756498 - protein, 18 aa, Mycobacterium
YPGQWPQPAPAAPQPYGG

SEQ ID NO: 756499 - protein, 25 aa, Mycobacterium
YPGRFIPCGILPLFDVAEAAKEVKR

SEQ ID NO: 756500 - protein, 18 aa, Mycobacterium
YPGRRVVTVDAREIFARG

SEQ ID NO: 756501 - protein, 19 aa, Mycobacterium
YPGSNVALCVGMCGQLIYI

SEQ ID NO: 756502 - protein, 19 aa, Mycobacterium
YPGVLGRPVRVGGVKVRTG

SEQ ID NO: 756503 - protein, 22 aa, Mycobacterium
YPGVRYRAFDLFEAGPDRIAQI

SEQ ID NO: 756504 - protein, 24 aa, Mycobacterium
YPGYSGSLDHIWALAEHPPAGTGL

SEQ ID NO: 756505 - protein, 19 aa, Mycobacterium
YPHLLALSASSPWWTGVDT

SEQ ID NO: 756506 - protein, 20 aa, Mycobacterium
YPHLRGMHKPLLPEGIAQPE

SEQ ID NO: 756507 - protein, 20 aa, Mycobacterium
YPHMWSWDAAFVAIGLAPLS

SEQ ID NO: 756508 - protein, 17 aa, Mycobacterium
YPHWDISEDGIAAADEF

SEQ ID NO: 756509 - protein, 24 aa, Mycobacterium
YPIAEVRKALMLRAEVPVITVDAR

SEQ ID NO: 756510 - protein, 23 aa, Mycobacterium
YPIARWINIGQLIFSYQASRKFP

SEQ ID NO: 756511 - protein, 17 aa, Mycobacterium
YPILCAFGAGEPFGASD

SEQ ID NO: 756512 - protein, 17 aa, Mycobacterium
YPIPEPFLVIATQNPVD

SEQ ID NO: 756513 - protein, 17 aa, Mycobacterium
YPIPVEDCYAALLWLAH

SEQ ID NO: 756514 - protein, 18 aa, Mycobacterium
YPIVFAHGITCAIEVWAH

SEQ ID NO: 756515 - protein, 17 aa, Mycobacterium
YPIVLIRLAAIEPDELE

SEQ ID NO: 756516 - protein, 26 aa, Mycobacterium
YPIVRCKDGYVRICVLAKRQWQGMFT

SEQ ID NO: 756517 - protein, 24 aa, Mycobacterium
YPIVRKLFATFGIDAMAKEALDKR

SEQ ID NO: 756518 - protein, 21 aa, Mycobacterium
YPIYDRIRRGGPLALPEANLA

SEQ ID NO: 756519 - protein, 17 aa, Mycobacterium
YPKGITVPAIVDVPSGA

SEQ ID NO: 756520 - protein, 24 aa, Mycobacterium
YPKTRRIRFWFGDPVPMRRHFADN

SEQ ID NO: 756521 - protein, 25 aa, Mycobacterium
YPKVRGVRQLRELLPLIDAGAQSPR

SEQ ID NO: 756522 - protein, 21 aa, Mycobacterium
YPKVVELVPVFAEYQEKTARP

SEQ ID NO: 756523 - protein, 21 aa, Mycobacterium
YPLAELLTGYLARFKDDLRHR

SEQ ID NO: 756524 - protein, 28 aa, Mycobacterium
YPLERSRPLWEMWFIEGLEGGRAATLTK

SEQ ID NO: 756525 - protein, 27 aa, Mycobacterium
YPLFAECVELAMPFCTQVGHTGPLRPS

SEQ ID NO: 756526 - protein, 20 aa, Mycobacterium
YPLGKGWRPKVWPPVRRIDG

SEQ ID NO: 756527 - protein, 19 aa, Mycobacterium
YPLKAGLITSLGFGHVSGL

SEQ ID NO: 756528 - protein, 19 aa, Mycobacterium
YPLLGPWGSARVFSPQKGA

SEQ ID NO: 756529 - protein, 21 aa, Mycobacterium
YPLLRELRRKAAVHPGWPEMG

SEQ ID NO: 756530 - protein, 20 aa, Mycobacterium
YPLNAGVDFVGRCERALRAV

SEQ ID NO: 756531 - protein, 21 aa, Mycobacterium
YPLPLSRRRLRALGQDVRQTA

SEQ ID NO: 756532 - protein, 23 aa, Mycobacterium
YPLPVAVICRLLGVPIEDEPKFS

SEQ ID NO: 756533 - protein, 20 aa, Mycobacterium
YPLRCRPIRDLLVDYLRERQ

SEQ ID NO: 756534 - protein, 18 aa, Mycobacterium
YPLREFIAQLGADDQRTL

SEQ ID NO: 756535 - protein, 17 aa, Mycobacterium
YPLRMVYEGSVRGTGGL

SEQ ID NO: 756536 - protein, 23 aa, Mycobacterium
YPLRSGCNQVHFWWYRTSRRTQT

SEQ ID NO: 756537 - protein, 24 aa, Mycobacterium
YPLSAVTEALCNRWQPGVRLLPAS

SEQ ID NO: 756538 - protein, 17 aa, Mycobacterium
YPLSTGQRRMWFLQAMD

SEQ ID NO: 756539 - protein, 22 aa, Mycobacterium
YPLTEARAAFRRMQQARHIGKI

SEQ ID NO: 756540 - protein, 24 aa, Mycobacterium
YPLTRGAAGIALLASMPPRPGERD

SEQ ID NO: 756541 - protein, 19 aa, Mycobacterium
YPLVSGIVAVVGRRRVFIG

SEQ ID NO: 756542 - protein, 17 aa, Mycobacterium
YPLYPARFDYPAEDRLI

SEQ ID NO: 756543 - protein, 19 aa, Mycobacterium
YPMFKRLRDEAPLYYNSEY

SEQ ID NO: 756544 - protein, 17 aa, Mycobacterium
YPMLARALLSGASGQLR

SEQ ID NO: 756545 - protein, 17 aa, Mycobacterium
YPMVYDMPARAKEAFGT

SEQ ID NO: 756546 - protein, 17 aa, Mycobacterium
YPMVYDMPARAKQAFGT

SEQ ID NO: 756547 - protein, 20 aa, Mycobacterium
YPNAEKFFWVQEEPANQGAW

SEQ ID NO: 756548 - protein, 21 aa, Mycobacterium
YPNFMLLIWEPGWYLTYHYWP

SEQ ID NO: 756549 - protein, 17 aa, Mycobacterium
YPNGFGGSGGTGGNGGN

SEQ ID NO: 756550 - protein, 24 aa, Mycobacterium
YPNMFSITGPYGFVLGSYLWMIEA

SEQ ID NO: 756551 - protein, 33 aa, Mycobacterium
YPNTAPAEWLVRGGVMLPVYQREAMWLSFSASE

SEQ ID NO: 756552 - protein, 25 aa, Mycobacterium
YPNVDPALLLNCMLLAATESGVTGD

SEQ ID NO: 756553 - protein, 17 aa, Mycobacterium
YPPAQAHTILRREPPGS

SEQ ID NO: 756554 - protein, 17 aa, Mycobacterium
YPPDLRMLRLIDADAHR

SEQ ID NO: 756555 - protein, 20 aa, Mycobacterium
YPPEAIDWLLPPGAHDVLDL

SEQ ID NO: 756556 - protein, 22 aa, Mycobacterium
YPPEGFGAPKDRRGHAADADVG

SEQ ID NO: 756557 - protein, 20 aa, Mycobacterium
YPPEVYGGAGVHVTELVAQL

SEQ ID NO: 756558 - protein, 17 aa, Mycobacterium
YPPGAGELTTFAVPTSG

SEQ ID NO: 756559 - protein, 30 aa, Mycobacterium
YPPGIGIAELRQAIAAQRRRLFGIDYDPDT

SEQ ID NO: 756560 - protein, 18 aa, Mycobacterium
YPPGLGFAPLRQAIADQR

SEQ ID NO: 756561 - protein, 19 aa, Mycobacterium
YPPGLGIPELRRAITADRL

SEQ ID NO: 756562 - protein, 19 aa, Mycobacterium
YPPGMGIPALRQAIAAQRR

SEQ ID NO: 756563 - protein, 20 aa, Mycobacterium
YPPIGSFRHGASVSQWYANP

SEQ ID NO: 756564 - protein, 18 aa, Mycobacterium
YPPISRGVSKIVGVSDDH

SEQ ID NO: 756565 - protein, 21 aa, Mycobacterium
YPPKPSMRIISDIFGYTSAKM

SEQ ID NO: 756566 - protein, 26 aa, Mycobacterium
YPPLRMMFDRCVEFLPALRSAAPDVI

SEQ ID NO: 756567 - protein, 25 aa, Mycobacterium
YPPLRRPARRRVFTVANQKGGVGKT

SEQ ID NO: 756568 - protein, 18 aa, Mycobacterium
YPPMGPELVAPVVGLLAH

SEQ ID NO: 756569 - protein, 25 aa, Mycobacterium
YPPMGPELVAPVVGWLAHESCSVSG

SEQ ID NO: 756570 - protein, 25 aa, Mycobacterium
YPPMGPELVAPVVGWLAHESCSVTG

SEQ ID NO: 756571 - protein, 17 aa, Mycobacterium
YPPPPPYPAPDPFEPFA

SEQ ID NO: 756572 - protein, 20 aa, Mycobacterium
YPQEIENVLTLHPKVFDVAV

SEQ ID NO: 756573 - protein, 25 aa, Mycobacterium
YPQFQRWSISLLSWILNPERGLAAS

SEQ ID NO: 756574 - protein, 22 aa, Mycobacterium
YPQFQRWSISLLSWMLNPERGL

SEQ ID NO: 756575 - protein, 19 aa, Mycobacterium
YPQMLLRLGWAPNSAAALP

SEQ ID NO: 756576 - protein, 20 aa, Mycobacterium
YPQRIIPLQLPWLADPQLAP

SEQ ID NO: 756577 - protein, 23 aa, Mycobacterium
YPQTRSALLPLLHLVQAQDGCLT

SEQ ID NO: 756578 - protein, 19 aa, Mycobacterium
YPQYWPGYYAVFFDDPING

SEQ ID NO: 756579 - protein, 19 aa, Mycobacterium
YPRAFSYYRGERIEVLEAQ

SEQ ID NO: 756580 - protein, 17 aa, Mycobacterium
YPRAVSLEDRFAGLLPE

SEQ ID NO: 756581 - protein, 24 aa, Mycobacterium
YPREGRTVLFLGRYDEPRKGMAVL

SEQ ID NO: 756582 - protein, 25 aa, Mycobacterium
YPREIPRASLAPVIQAPPVRGTSAL

SEQ ID NO: 756583 - protein, 21 aa, Mycobacterium
YPRELPFVIGSEVCGTVVALG

SEQ ID NO: 756584 - protein, 22 aa, Mycobacterium
YPRETLWRPPVLTMSAAEGTGL

SEQ ID NO: 756585 - protein, 20 aa, Mycobacterium
YPRGKWAVAANRLPVHEVSS

SEQ ID NO: 756586 - protein, 18 aa, Mycobacterium
YPRIPRRVSGYNLDSLLP

SEQ ID NO: 756587 - protein, 21 aa, Mycobacterium
YPRLRVVHVLSQPASAWPGET

SEQ ID NO: 756588 - protein, 18 aa, Mycobacterium
YPRLVMSVVRAVGDAAAD

SEQ ID NO: 756589 - protein, 21 aa, Mycobacterium
YPRRAMRLHECATVLARDYDD

SEQ ID NO: 756590 - protein, 17 aa, Mycobacterium
YPRRIWFVDELPKGPTG

SEQ ID NO: 756591 - protein, 25 aa, Mycobacterium
YPSGEGLHVGHPLGYIATDVYARYY

SEQ ID NO: 756592 - protein, 25 aa, Mycobacterium
YPSIDGEVLLNCMLLAATASSVSGD

SEQ ID NO: 756593 - protein, 22 aa, Mycobacterium
YPSIGCAPCTAKPAVGEDPRSG

SEQ ID NO: 756594 - protein, 22 aa, Mycobacterium
YPSIGCAPCTAKPVAGADPRSG

SEQ ID NO: 756595 - protein, 20 aa, Mycobacterium
YPSIGCAPCTVKPAAGADPR

SEQ ID NO: 756596 - protein, 24 aa, Mycobacterium
YPSLRYPGVANWAAAEFVEAAVRS

SEQ ID NO: 756597 - protein, 17 aa, Mycobacterium
YPSQVFLTLFGLPLEDR

SEQ ID NO: 756598 - protein, 18 aa, Mycobacterium
YPSRIIAGLLGLPEQDYP

SEQ ID NO: 756599 - protein, 29 aa, Mycobacterium
YPSRLASLASAWREPAAWEGMSRAGGVDF

SEQ ID NO: 756600 - protein, 22 aa, Mycobacterium
YPSTLGYKGFPKSCCTSLNEII

SEQ ID NO: 756601 - protein, 17 aa, Mycobacterium
YPTAAPDDWELVPAGQR

SEQ ID NO: 756602 - protein, 17 aa, Mycobacterium
YPTAFLKGRGLGASCAL

SEQ ID NO: 756603 - protein, 19 aa, Mycobacterium
YPTAPWPTDEAFRRQVFRL

SEQ ID NO: 756604 - protein, 18 aa, Mycobacterium
YPTATSIQKCIRTPDIDE

SEQ ID NO: 756605 - protein, 21 aa, Mycobacterium
YPTELPYISALHQYRDSERQR

SEQ ID NO: 756606 - protein, 18 aa, Mycobacterium
YPTGHSALLHRIGQHGLL

SEQ ID NO: 756607 - protein, 20 aa, Mycobacterium
YPTLCRLFAELGVATQESEM

SEQ ID NO: 756608 - protein, 18 aa, Mycobacterium
YPTPGHAVGLSFSVAPDV

SEQ ID NO: 756609 - protein, 19 aa, Mycobacterium
YPTPVTFCEIFPPDDFPLY

SEQ ID NO: 756610 - protein, 18 aa, Mycobacterium
YPTRLVVTRTMSKAFAFA

SEQ ID NO: 756611 - protein, 17 aa, Mycobacterium
YPTVSSLAVYLSSREFA

SEQ ID NO: 756612 - protein, 19 aa, Mycobacterium
YPTVYLTFIGIRTGTRRQP

SEQ ID NO: 756613 - protein, 17 aa, Mycobacterium
YPTYRRLRDEAPLYYNE

SEQ ID NO: 756614 - protein, 17 aa, Mycobacterium
YPTYRRLRDEAPVYRND

SEQ ID NO: 756615 - protein, 24 aa, Mycobacterium
YPVAVSVGALRWAQVVAGDAALGA

SEQ ID NO: 756616 - protein, 22 aa, Mycobacterium
YPVGHMTTMAWLGVRPGDVHLA

SEQ ID NO: 756617 - protein, 21 aa, Mycobacterium
YPVGLTVQGLVGWQDYAVVSD

SEQ ID NO: 756618 - protein, 26 aa, Mycobacterium
YPVIDEAFRPYAIRRYTLGGGAEPVE

SEQ ID NO: 756619 - protein, 19 aa, Mycobacterium
YPVKWKDYSKLVIDRNDLY

SEQ ID NO: 756620 - protein, 18 aa, Mycobacterium
YPVLMAADILLYQTNVVP

SEQ ID NO: 756621 - protein, 19 aa, Mycobacterium
YPVNEAFALLDSLGSPPVW

SEQ ID NO: 756622 - protein, 22 aa, Mycobacterium
YPVTTLRLAMYAVEQGLHEINS

SEQ ID NO: 756623 - protein, 19 aa, Mycobacterium
YPVTYFEMLGRPWRDARKL

SEQ ID NO: 756624 - protein, 19 aa, Mycobacterium
YPVTYFEMLGRPWRTERRP

SEQ ID NO: 756625 - protein, 19 aa, Mycobacterium
YPVVRRILDRANVTLTEII

SEQ ID NO: 756626 - protein, 25 aa, Mycobacterium
YPVVRRILDRTGVALAEIIGDERSL

SEQ ID NO: 756627 - protein, 20 aa, Mycobacterium
YPVWQRMRDALPLYHHEKYG

SEQ ID NO: 756628 - protein, 19 aa, Mycobacterium
YPVWRRMRDEAPLYYNDKY

SEQ ID NO: 756629 - protein, 18 aa, Mycobacterium
YPVYKRLRDEAPLYYNEK

SEQ ID NO: 756630 - protein, 17 aa, Mycobacterium
YPWGVAVDPNTRTVYVT

SEQ ID NO: 756631 - protein, 17 aa, Mycobacterium
YPWIPTLKLHYVRIIPA

SEQ ID NO: 756632 - protein, 22 aa, Mycobacterium
YPWTRGDGRRKFGFYEEDQQPA

SEQ ID NO: 756633 - protein, 22 aa, Mycobacterium
YPYAQRDYLAWVEAGRPERTYR

SEQ ID NO: 756634 - protein, 17 aa, Mycobacterium
YPYLIGGGPSIGFGSGM

SEQ ID NO: 756635 - protein, 18 aa, Mycobacterium
YPYLVPLIDREIRRPTYV

SEQ ID NO: 756636 - protein, 24 aa, Mycobacterium
YPYPDGLDSCWVRANMITSVDGGA

SEQ ID NO: 756637 - protein, 19 aa, Mycobacterium
YPYVTALEIKKALRLKAAF

SEQ ID NO: 756638 - protein, 19 aa, Mycobacterium
YPYYKRLRDDAPLYRNEEL

SEQ ID NO: 756639 - protein, 19 aa, Mycobacterium
YPYYKRLRDEAPLYRNDEL

SEQ ID NO: 756640 - protein, 19 aa, Mycobacterium
YPYYKRLRDEAPLYRNDER

SEQ ID NO: 756641 - protein, 20 aa, Mycobacterium
YPYYRRLRDEAPLYHNEELG

SEQ ID NO: 756642 - protein, 20 aa, Mycobacterium
YPYYRRLRDEAPLYHNQELG

SEQ ID NO: 756643 - protein, 19 aa, Mycobacterium
YPYYRRLRDEAPLYRNDDL

SEQ ID NO: 756644 - protein, 17 aa, Mycobacterium
YQAADWLRAHAHIDVGM

SEQ ID NO: 756645 - protein, 26 aa, Mycobacterium
YQAAMFDGRFAGFADFLILSDGQYRL

SEQ ID NO: 756646 - protein, 26 aa, Mycobacterium
YQAAMFDGRFAGFADFLLLEEGPDGQ

SEQ ID NO: 756647 - protein, 26 aa, Mycobacterium
YQAAMFDGRFLGFADFLVRDGEQYRV

SEQ ID NO: 756648 - protein, 26 aa, Mycobacterium
YQAAMFDGRFVGFADFLIRDRERYRI

SEQ ID NO: 756649 - protein, 17 aa, Mycobacterium
YQAAMRLLLNFSPKTLN

SEQ ID NO: 756650 - protein, 35 aa, Mycobacterium
YQAEIDAPCELIDFWRFNVAFARQILAQQPISSPG

SEQ ID NO: 756651 - protein, 35 aa, Mycobacterium
YQAEIDAPCELVDFWRFNVAFARQILAQQPISGPG

SEQ ID NO: 756652 - protein, 35 aa, Mycobacterium
YQAEIDAPCELVDFWRFNVAFARQILDQQPVSAKG

SEQ ID NO: 756653 - protein, 18 aa, Mycobacterium
YQAKLDWVEKFMAGEVEP

SEQ ID NO: 756654 - protein, 19 aa, Mycobacterium
YQAKLDWVEKFMVDELEPL

SEQ ID NO: 756655 - protein, 18 aa, Mycobacterium
YQALLFIPKHAPFDLFNR

SEQ ID NO: 756656 - protein, 17 aa, Mycobacterium
YQALMPEFWKKVQQQEQ

SEQ ID NO: 756657 - protein, 18 aa, Mycobacterium
YQALRADILAGRIAPGSR

SEQ ID NO: 756658 - protein, 17 aa, Mycobacterium
YQCAIDAVAGRCFPSYA

SEQ ID NO: 756659 - protein, 24 aa, Mycobacterium
YQDIIPMHECRSAKQLAAVIDGLL

SEQ ID NO: 756660 - protein, 21 aa, Mycobacterium
YQDLQDIIAILGIDELSEEDK

SEQ ID NO: 756661 - protein, 19 aa, Mycobacterium
YQEEWPHADAIRFAVNYLR

SEQ ID NO: 756662 - protein, 26 aa, Mycobacterium
YQELSARAALFHDEFVRVLSAGADAY

SEQ ID NO: 756663 - protein, 19 aa, Mycobacterium
YQEVITMHECRSAKQLAAV

SEQ ID NO: 756664 - protein, 17 aa, Mycobacterium
YQEWLDRNLVPLDALPA

SEQ ID NO: 756665 - protein, 21 aa, Mycobacterium
YQFEVANPLGPSGDYQAISAA

SEQ ID NO: 756666 - protein, 17 aa, Mycobacterium
YQFGDSKPVYALEGSIA

SEQ ID NO: 756667 - protein, 20 aa, Mycobacterium
YQFGKLGAKVIVVARREDLL

SEQ ID NO: 756668 - protein, 18 aa, Mycobacterium
YQFLAGLITRERLDMEIL

SEQ ID NO: 756669 - protein, 20 aa, Mycobacterium
YQFPHLVERLILVAPGGVTK

SEQ ID NO: 756670 - protein, 21 aa, Mycobacterium
YQFPHLVERLILVGAGGVTKD

SEQ ID NO: 756671 - protein, 23 aa, Mycobacterium
YQGDNWWLRARILSQIDGLGLSL

SEQ ID NO: 756672 - protein, 17 aa, Mycobacterium
YQGGSGWTLSAAQQDAI

SEQ ID NO: 756673 - protein, 20 aa, Mycobacterium
YQGLPMPLLFVCEDNGIGIS

SEQ ID NO: 756674 - protein, 19 aa, Mycobacterium
YQGPQALGMPELHKLTPAL

SEQ ID NO: 756675 - protein, 17 aa, Mycobacterium
YQGRLRHHLPLTFHGCY

SEQ ID NO: 756676 - protein, 29 aa, Mycobacterium
YQGSVREACLWSRGLAAAGVRRRASILDS

SEQ ID NO: 756677 - protein, 18 aa, Mycobacterium
YQGTQTWPAGRPAPGRER

SEQ ID NO: 756678 - protein, 17 aa, Mycobacterium
YQGVIGLGTGMVIDPGG

SEQ ID NO: 756679 - protein, 23 aa, Mycobacterium
YQHPLRYAVDFGDWTLFDDTGLK

SEQ ID NO: 756680 - protein, 31 aa, Mycobacterium
YQIGCGIMGGPVELTAGIGLSGGFGTSGLTS

SEQ ID NO: 756681 - protein, 18 aa, Mycobacterium
YQIHVFAVAVDPAGDVFV

SEQ ID NO: 756682 - protein, 27 aa, Mycobacterium
YQINYLRCIGCGFCIEACPTRALTMIN

SEQ ID NO: 756683 - protein, 20 aa, Mycobacterium
YQIRIPVPFTPGSELAGEVL

SEQ ID NO: 756684 - protein, 17 aa, Mycobacterium
YQISRPVALIGASMGGL

SEQ ID NO: 756685 - protein, 18 aa, Mycobacterium
YQKLTALENLRFFASLYA

SEQ ID NO: 756686 - protein, 17 aa, Mycobacterium
YQLAPVKARGGMFDQLC

SEQ ID NO: 756687 - protein, 24 aa, Mycobacterium
YQLCANLLLAECNWLVPVNNPRLL

SEQ ID NO: 756688 - protein, 23 aa, Mycobacterium
YQLDIEIWPTCIVLPAEYRIALQ

SEQ ID NO: 756689 - protein, 29 aa, Mycobacterium
YQLDRVFALRLGKDLAQPRSNGCSYADSP

SEQ ID NO: 756690 - protein, 17 aa, Mycobacterium
YQLGADIIFAFDELTTL

SEQ ID NO: 756691 - protein, 18 aa, Mycobacterium
YQLLRHRAAGPGLTRRAA

SEQ ID NO: 756692 - protein, 23 aa, Mycobacterium
YQLPEAQLDRFLMKLNVSLPERD

SEQ ID NO: 756693 - protein, 23 aa, Mycobacterium
YQLPEHARRGFVTETLGSVADDT

SEQ ID NO: 756694 - protein, 19 aa, Mycobacterium
YQLRMSRYYAKTITDEQYQ

SEQ ID NO: 756695 - protein, 19 aa, Mycobacterium
YQLVHPAMRVQLEVRDVSA

SEQ ID NO: 756696 - protein, 30 aa, Mycobacterium
YQLVNIPAQIWIRLTGVTGNKIIPPVFNPF

SEQ ID NO: 756697 - protein, 19 aa, Mycobacterium
YQLYRWCEPGVYRPGQPGF

SEQ ID NO: 756698 - protein, 19 aa, Mycobacterium
YQMLTRFYAAVPEWIAGFA

SEQ ID NO: 756699 - protein, 19 aa, Mycobacterium
YQMPPLRPSAWQMTNDGVA

SEQ ID NO: 756700 - protein, 26 aa, Mycobacterium
YQPACGKAGCSTYKWETFLTSELPEW

SEQ ID NO: 756701 - protein, 26 aa, Mycobacterium
YQPACGKAGCSTYKWETFLTSELPQY

SEQ ID NO: 756702 - protein, 17 aa, Mycobacterium
YQPGMLSAAWGVGIRQL

SEQ ID NO: 756703 - protein, 18 aa, Mycobacterium
YQPLGVVLAVMPWNFPLW

SEQ ID NO: 756704 - protein, 26 aa, Mycobacterium
YQPMCKRLVMSSGFYRAIQRDDVELV

SEQ ID NO: 756705 - protein, 18 aa, Mycobacterium
YQPPAGLERFVRCRDLTC

SEQ ID NO: 756706 - protein, 17 aa, Mycobacterium
YQPREAAAWLASAVEGA

SEQ ID NO: 756707 - protein, 18 aa, Mycobacterium
YQPTEEWIRADAAENYDR

SEQ ID NO: 756708 - protein, 19 aa, Mycobacterium
YQPWLDRLLAMDWDNPEHR

SEQ ID NO: 756709 - protein, 18 aa, Mycobacterium
YQQARRPDLILLDLNLPK

SEQ ID NO: 756710 - protein, 17 aa, Mycobacterium
YQQRLGRKVRFMAKQEV

SEQ ID NO: 756711 - protein, 19 aa, Mycobacterium
YQQTVPFFSLFMATLRADP

SEQ ID NO: 756712 - protein, 26 aa, Mycobacterium
YQRALDEWRLLSAAALVGLVEATMEI

SEQ ID NO: 756713 - protein, 22 aa, Mycobacterium
YQRARGKGGLVRVTWAEATEMI

SEQ ID NO: 756714 - protein, 24 aa, Mycobacterium
YQRCAAEAQLGFGEPALYAEALLD

SEQ ID NO: 756715 - protein, 17 aa, Mycobacterium
YQRGLALVDEAKRAELK

SEQ ID NO: 756716 - protein, 18 aa, Mycobacterium
YQRIFDRLRVRYVIVSAV

SEQ ID NO: 756717 - protein, 19 aa, Mycobacterium
YQRIFERLRVRYVIVSAVS

SEQ ID NO: 756718 - protein, 18 aa, Mycobacterium
YQRIFNRLRVRYVIVSAV

SEQ ID NO: 756719 - protein, 18 aa, Mycobacterium
YQRIKALTFQVGVDLVES

SEQ ID NO: 756720 - protein, 21 aa, Mycobacterium
YQRLRDLGIAILREVGVDTGG

SEQ ID NO: 756721 - protein, 31 aa, Mycobacterium
YQRRTCGIAAHSVAWTMWDRVGMSAQVEHVE

SEQ ID NO: 756722 - protein, 28 aa, Mycobacterium
YQRSYAWGDEAVGFFIRDIEAMLDQPAG

SEQ ID NO: 756723 - protein, 17 aa, Mycobacterium
YQRYAKEVMPFLEAVGA

SEQ ID NO: 756724 - protein, 25 aa, Mycobacterium
YQRYPRYRWDIALRRDYQRAAFEAG

SEQ ID NO: 756725 - protein, 17 aa, Mycobacterium
YQSAIGIFTTPEELQQQ

SEQ ID NO: 756726 - protein, 26 aa, Mycobacterium
YQSFRPAPAGADWPAEAVWPPHGVPR

SEQ ID NO: 756727 - protein, 25 aa, Mycobacterium
YQSHPRIDCVWEFREPLEPRNNAGG

SEQ ID NO: 756728 - protein, 24 aa, Mycobacterium
YQSTLRLLHYYAFPAELVGRDDVW

SEQ ID NO: 756729 - protein, 22 aa, Mycobacterium
YQTDVLPQWLVGQLLVHYQRLL

SEQ ID NO: 756730 - protein, 18 aa, Mycobacterium
YQTICRKASYMALSNKVT

SEQ ID NO: 756731 - protein, 17 aa, Mycobacterium
YQTMRGYQVDRRFGWDT

SEQ ID NO: 756732 - protein, 25 aa, Mycobacterium
YQTSWKPGWASAAAWTDDPLFEARV

SEQ ID NO: 756733 - protein, 17 aa, Mycobacterium
YQTVCAQATMIHESFVK

SEQ ID NO: 756734 - protein, 22 aa, Mycobacterium
YQVHSLHGYFLRAGDARSPSVY

SEQ ID NO: 756735 - protein, 18 aa, Mycobacterium
YQVPIWPERLLTRDNGAE

SEQ ID NO: 756736 - protein, 17 aa, Mycobacterium
YQVPLWPERLLTRDNAE

SEQ ID NO: 756737 - protein, 17 aa, Mycobacterium
YQVPVLLAALGPTMLRL

SEQ ID NO: 756738 - protein, 18 aa, Mycobacterium
YQVRGFDISNITFVEGDT

SEQ ID NO: 756739 - protein, 18 aa, Mycobacterium
YRAAGYWRDQLLDSVLRT

SEQ ID NO: 756740 - protein, 23 aa, Mycobacterium
YRAAHNIGHFRFVECSRLVNGRP

SEQ ID NO: 756741 - protein, 17 aa, Mycobacterium
YRAAKAFFERLATECGF

SEQ ID NO: 756742 - protein, 18 aa, Mycobacterium
YRAALVVDSVERAREGLA

SEQ ID NO: 756743 - protein, 19 aa, Mycobacterium
YRAAPELIAGFAIRTAVTT

SEQ ID NO: 756744 - protein, 36 aa, Mycobacterium
YRAARARLGRPLRIAHAWSLSFDASWQPMVGLLDGH

SEQ ID NO: 756745 - protein, 20 aa, Mycobacterium
YRADGCYQLGYEFAKRAAEI

SEQ ID NO: 756746 - protein, 19 aa, Mycobacterium
YRADIGIKDGKIVDVVRRG

SEQ ID NO: 756747 - protein, 19 aa, Mycobacterium
YRADIGIKDGMIVDVVRRG

SEQ ID NO: 756748 - protein, 19 aa, Mycobacterium
YRADPGLIERVRDRLDGFT

SEQ ID NO: 756749 - protein, 17 aa, Mycobacterium
YRADPRTGPGVLASPDL

SEQ ID NO: 756750 - protein, 21 aa, Mycobacterium
YRADRYLGIIDRVRTAIPHAA

SEQ ID NO: 756751 - protein, 25 aa, Mycobacterium
YRADRYLGIIERVRAAMPHAAITTD

SEQ ID NO: 756752 - protein, 18 aa, Mycobacterium
YRADSWRTAQRAHAPAAV

SEQ ID NO: 756753 - protein, 21 aa, Mycobacterium
YRADWCRVIDFPLTEPTHISA

SEQ ID NO: 756754 - protein, 21 aa, Mycobacterium
YRAECPVGAAVRHDLRPWPTY

SEQ ID NO: 756755 - protein, 23 aa, Mycobacterium
YRAERYLGIIERVRAAMPHAAIT

SEQ ID NO: 756756 - protein, 25 aa, Mycobacterium
YRAEYVMSFVEKWDELIDWDARSES

SEQ ID NO: 756757 - protein, 24 aa, Mycobacterium
YRAFNERSGMRFGQVQTRLAGDAR

SEQ ID NO: 756758 - protein, 24 aa, Mycobacterium
YRAFNERSGMRFGQVQTRLTANAD

SEQ ID NO: 756759 - protein, 24 aa, Mycobacterium
YRAFNERSGMRFGQVQTRLTENAD

SEQ ID NO: 756760 - protein, 26 aa, Mycobacterium
YRAFNERSGMRFGQVQTRLVGNAGVQ

SEQ ID NO: 756761 - protein, 20 aa, Mycobacterium
YRAGTLLLRGSPFALGCLAG

SEQ ID NO: 756762 - protein, 17 aa, Mycobacterium
YRAGVKIAVGTDAPAIP

SEQ ID NO: 756763 - protein, 21 aa, Mycobacterium
YRAIFDWYDSLLVCLTATPKD

SEQ ID NO: 756764 - protein, 25 aa, Mycobacterium
YRAIVSELTGGSWAGPSSSVMAAAA

SEQ ID NO: 756765 - protein, 22 aa, Mycobacterium
YRALFLPPFVAHGFQTLVDNTE

SEQ ID NO: 756766 - protein, 37 aa, Mycobacterium; identical to SEQ ID NO: 92854

SEQ ID NO: 756767 - protein, 37 aa, Mycobacterium
YRALGFPTRMFTVLFALGRMPGWIAHWREMHDEGDSK

SEQ ID NO: 756768 - protein, 37 aa, Mycobacterium
YRALGFPVRMFTVLFALGRLPGWIAHWREMHDEGDSK

SEQ ID NO: 756769 - protein, 17 aa, Mycobacterium
YRALGLTGWTYDRIECD

SEQ ID NO: 756770 - protein, 19 aa, Mycobacterium
YRALKDHRDVMFPFMTVKF

SEQ ID NO: 756771 - protein, 24 aa, Mycobacterium
YRALKEASYRLGARTLNHQFGAPM

SEQ ID NO: 756772 - protein, 25 aa, Mycobacterium
YRALKEASYRLGARTLYHQFGAPLF

SEQ ID NO: 756773 - protein, 19 aa, Mycobacterium
YRALMRIGVAEFVPEFAHL

SEQ ID NO: 756774 - protein, 17 aa, Mycobacterium
YRALRLLADSARNGAVA

SEQ ID NO: 756775 - protein, 22 aa, Mycobacterium
YRANLWALRSLGVRRVFAPCAV

SEQ ID NO: 756776 - protein, 18 aa, Mycobacterium
YRAPATFTEEVLAGIYSQ

SEQ ID NO: 756777 - protein, 32 aa, Mycobacterium
YRAPMWEMNWHTPKLLAEFGFLYDSTLMDSDH

SEQ ID NO: 756778 - protein, 22 aa, Mycobacterium
YRAPVARYWPEFAANGKEAITV

SEQ ID NO: 756779 - protein, 17 aa, Mycobacterium
YRARCAVNVDGVVRLSE

SEQ ID NO: 756780 - protein, 17 aa, Mycobacterium
YRASQVGVRIEVVVRGI

SEQ ID NO: 756781 - protein, 20 aa, Mycobacterium
YRASVAHGLMTWLATASAGE

SEQ ID NO: 756782 - protein, 23 aa, Mycobacterium
YRATLEHLASWGIVAAAPDTEKG

SEQ ID NO: 756783 - protein, 24 aa, Mycobacterium
YRATRRIALELATAPHLAVGAEVP

SEQ ID NO: 756784 - protein, 21 aa, Mycobacterium
YRAVAHLHPPAVVAADLAGIT

SEQ ID NO: 756785 - protein, 25 aa, Mycobacterium
YRAVAHLTRYVGWLIGVEDRWLPTS

SEQ ID NO: 756786 - protein, 20 aa, Mycobacterium
YRAVDRAGAIAGAAGAKLIV

SEQ ID NO: 756787 - protein, 29 aa, Mycobacterium
YRAVFSQGVGVAWPVSRTFNAARGIKTTT

SEQ ID NO: 756788 - protein, 22 aa, Mycobacterium
YRAVGGSERLRIWVMRRTTIAF

SEQ ID NO: 756789 - protein, 17 aa, Mycobacterium
YRAVLALLLLTGSMGRN

SEQ ID NO: 756790 - protein, 17 aa, Mycobacterium
YRAVSSWFIKVTEFRDR

SEQ ID NO: 756791 - protein, 18 aa, Mycobacterium
YRCGEAWSTHIHHRPSGR

SEQ ID NO: 756792 - protein, 18 aa, Mycobacterium
YRCGPYGVLIVRDDDGEI

SEQ ID NO: 756793 - protein, 17 aa, Mycobacterium
YRCPEYFQEYYGPAINA

SEQ ID NO: 756794 - protein, 19 aa, Mycobacterium
YRCPIGQRLVVRGRIGTLL

SEQ ID NO: 756795 - protein, 19 aa, Mycobacterium
YRDAARTAAEFERRQHGDG

SEQ ID NO: 756796 - protein, 18 aa, Mycobacterium
YRDAEGWVLDGTARHVLD

SEQ ID NO: 756797 - protein, 18 aa, Mycobacterium
YRDAGALKNKLKYYERMG

SEQ ID NO: 756798 - protein, 17 aa, Mycobacterium
YRDALGFEVRLDVGHGT

SEQ ID NO: 756799 - protein, 19 aa, Mycobacterium
YRDALRLAREVVRNPSTQL

SEQ ID NO: 756800 - protein, 18 aa, Mycobacterium
YRDAMRLGYLQDIADAGA

SEQ ID NO: 756801 - protein, 18 aa, Mycobacterium
YRDARRGAGITGPGHVTA

SEQ ID NO: 756802 - protein, 20 aa, Mycobacterium
YRDCALPTPVRVEGAGLCTV

SEQ ID NO: 756803 - protein, 22 aa, Mycobacterium
YRDESKWVPLLWRRDLDAGHWA

SEQ ID NO: 756804 - protein, 23 aa, Mycobacterium
YRDGAKVVDLWGGYRNGLTKDPW

SEQ ID NO: 756805 - protein, 22 aa, Mycobacterium
YRDHCPICRDSLAGAQLLGTLL

SEQ ID NO: 756806 - protein, 24 aa, Mycobacterium
YRDHDRLRCGDEVTMAHDALEAYR

SEQ ID NO: 756807 - protein, 24 aa, Mycobacterium
YRDHEICGMPAPSSGGIAVAATLG

SEQ ID NO: 756808 - protein, 21 aa, Mycobacterium
YRDKSEFGLGPGLVRPGKESA

SEQ ID NO: 756809 - protein, 19 aa, Mycobacterium
YRDKWPALTKAFTDATRAE

SEQ ID NO: 756810 - protein, 19 aa, Mycobacterium
YRDLGFDGLVFHPCVETID

SEQ ID NO: 756811 - protein, 19 aa, Mycobacterium
YRDLVDLTLYAGAVDINGD

SEQ ID NO: 756812 - protein, 27 aa, Mycobacterium
YRDLWTSWTRHFWRLQDLVALCRQALK

SEQ ID NO: 756813 - protein, 26 aa, Mycobacterium
YRDQDWRFLLDREGHSYNDFGHFIHD

SEQ ID NO: 756814 - protein, 19 aa, Mycobacterium
YRDQVGFALDVDYAPAPGF

SEQ ID NO: 756815 - protein, 20 aa, Mycobacterium
YRDRGCPEPAPLSPELIREM

SEQ ID NO: 756816 - protein, 25 aa, Mycobacterium
YRDRRIGWSDSWAKAAPGANPYARL

SEQ ID NO: 756817 - protein, 23 aa, Mycobacterium
YRDRTCVVPGCGASRGLHAHHLW

SEQ ID NO: 756818 - protein, 23 aa, Mycobacterium
YRDSWPPFFDFLAGGAQFELVEL

SEQ ID NO: 756819 - protein, 17 aa, Mycobacterium
YRDVLGMDVVFETLISG

SEQ ID NO: 756820 - protein, 18 aa, Mycobacterium
YRDVLVPLNGRWLFAHRR

SEQ ID NO: 756821 - protein, 17 aa, Mycobacterium
YRDYIGWLAARDPEAGR

SEQ ID NO: 756822 - protein, 18 aa, Mycobacterium
YRDYIGWLAGRDHDASRA

SEQ ID NO: 756823 - protein, 17 aa, Mycobacterium
YRDYIGWLASRDPEASQ

SEQ ID NO: 756824 - protein, 18 aa, Mycobacterium
YRDYIGWLERCDVEQGQR

SEQ ID NO: 756825 - protein, 26 aa, Mycobacterium
YREAALRLDRHFAISVIDCGSTMDAP

SEQ ID NO: 756826 - protein, 25 aa, Mycobacterium
YREAALRLDRHFTISIIDCGSTMDA

SEQ ID NO: 756827 - protein, 24 aa, Mycobacterium
YREAALRLDRHFTISVIDCGSTMD

SEQ ID NO: 756828 - protein, 26 aa, Mycobacterium
YREAKGRLGDPVLAWADIQADPERRR

SEQ ID NO: 756829 - protein, 17 aa, Mycobacterium
YREAPLMGIWEGSGNVS

SEQ ID NO: 756830 - protein, 17 aa, Mycobacterium
YREARRVTVAGGGLAMW

SEQ ID NO: 756831 - protein, 17 aa, Mycobacterium
YREEAGKTGPFQIHVIS

SEQ ID NO: 756832 - protein, 18 aa, Mycobacterium
YREGCAVAPIVVESTPAS

SEQ ID NO: 756833 - protein, 19 aa, Mycobacterium
YREGLGFEVLPLSGGERPP

SEQ ID NO: 756834 - protein, 19 aa, Mycobacterium
YREGLSAVRIDGGVAGNVI

SEQ ID NO: 756835 - protein, 26 aa, Mycobacterium
YREGNHLKAWLARIMSNAWIDRHRSA

SEQ ID NO: 756836 - protein, 22 aa, Mycobacterium
YREIPAAEFFTGLWETAMEPDE

SEQ ID NO: 756837 - protein, 19 aa, Mycobacterium
YRELEAFAAFASDLDATSK

SEQ ID NO: 756838 - protein, 25 aa, Mycobacterium
YRELEAMPDLIKRVLAGMDSVAALA

SEQ ID NO: 756839 - protein, 25 aa, Mycobacterium
YRELEAMPDLVARVISAIKPVADLA

SEQ ID NO: 756840 - protein, 24 aa, Mycobacterium
YRELEAMPDLVARVLAMIEPVAAL

SEQ ID NO: 756841 - protein, 25 aa, Mycobacterium
YRELEGMPDLVARVISGVKPVADLA

SEQ ID NO: 756842 - protein, 20 aa, Mycobacterium
YRELESFAAFASDLDAASKA

SEQ ID NO: 756843 - protein, 20 aa, Mycobacterium
YRELESFAAFASDLDATSKA

SEQ ID NO: 756844 - protein, 18 aa, Mycobacterium
YRELKNPLRTVGALLDAR

SEQ ID NO: 756845 - protein, 23 aa, Mycobacterium
YREMCPRIMAMTVRDGKVCALWD

SEQ ID NO: 756846 - protein, 24 aa, Mycobacterium
YREMMKHAWGPVRVAIAAEQAHGA

SEQ ID NO: 756847 - protein, 25 aa, Mycobacterium
YREPRPMVYSGLYPVDGSDYPVLRD

SEQ ID NO: 756848 - protein, 21 aa, Mycobacterium
YRERGLRVAVLAVDPSSPYSG

SEQ ID NO: 756849 - protein, 19 aa, Mycobacterium
YRESARFGAKLWVVPANMA

SEQ ID NO: 756850 - protein, 26 aa, Mycobacterium
YRETAMSIPLRWFHTSTTILACCVLG

SEQ ID NO: 756851 - protein, 26 aa, Mycobacterium
YRETVYRIMGRWLKGVFPVSTGLVVE

SEQ ID NO: 756852 - protein, 23 aa, Mycobacterium
YREVFPFLLRLYHRILQTRNPNY

SEQ ID NO: 756853 - protein, 25 aa, Mycobacterium
YREVVAELTGGPWLGPSSGAMAAAV

SEQ ID NO: 756854 - protein, 18 aa, Mycobacterium
YREWLSIHRVWRSKLPEV

SEQ ID NO: 756855 - protein, 17 aa, Mycobacterium
YREYRLETPEGGPAHDA

SEQ ID NO: 756856 - protein, 22 aa, Mycobacterium
YRFDFATPLLRVARLHAAHATE

SEQ ID NO: 756857 - protein, 24 aa, Mycobacterium
YRFDIAAGTAIRFEPGVAQQVRLV

SEQ ID NO: 756858 - protein, 19 aa, Mycobacterium
YRFDLEALVPIAGKIGPTV

SEQ ID NO: 756859 - protein, 23 aa, Mycobacterium
YRFDSGEQLKVWRAMEDADEVPV

SEQ ID NO: 756860 - protein, 18 aa, Mycobacterium
YRFHRRLASFSRLIRFDH

SEQ ID NO: 756861 - protein, 25 aa, Mycobacterium
YRFKVELQCNWKIFVDGFAESYHGP

SEQ ID NO: 756862 - protein, 19 aa, Mycobacterium
YRFNHAIVRQSLLAELASV

SEQ ID NO: 756863 - protein, 18 aa, Mycobacterium
YRFRFPRQQRGRFLCIAD

SEQ ID NO: 756864 - protein, 18 aa, Mycobacterium
YRFSAFRSAKTAPKDAGL

SEQ ID NO: 756865 - protein, 19 aa, Mycobacterium
YRFTEFRSGKTAPKDKGLR

SEQ ID NO: 756866 - protein, 22 aa, Mycobacterium
YRFVPEVYRKPLVVAGFEPLDI

SEQ ID NO: 756867 - protein, 18 aa, Mycobacterium
YRGADPVLLRDDTHPAIT

SEQ ID NO: 756868 - protein, 24 aa, Mycobacterium
YRGAGRPEATFALERSLDAAAREL

SEQ ID NO: 756869 - protein, 25 aa, Mycobacterium
YRGARGIRQLRELLPLVDGGAESPR

SEQ ID NO: 756870 - protein, 20 aa, Mycobacterium
YRGAVAYARTKRMQVAFTPI

SEQ ID NO: 756871 - protein, 23 aa, Mycobacterium
YRGDGRLAIVLGHGKTDWVKNVL

SEQ ID NO: 756872 - protein, 19 aa, Mycobacterium
YRGDRCTLMTTAARGVDDP

SEQ ID NO: 756873 - protein, 17 aa, Mycobacterium
YRGFWRGYFATRSAPLG

SEQ ID NO: 756874 - protein, 21 aa, Mycobacterium
YRGGTVPGFPNLFISSAPNYS

SEQ ID NO: 756875 - protein, 18 aa, Mycobacterium
YRGHPFIRVPEVIDDASN

SEQ ID NO: 756876 - protein, 21 aa, Mycobacterium
YRGHQWFDDCVEFCEKYDQNC

SEQ ID NO: 756877 - protein, 23 aa, Mycobacterium
YRGIDVVHWRKAYTGNQQIQVFL

SEQ ID NO: 756878 - protein, 25 aa, Mycobacterium
YRGISGRNAVMFGPPGRLYTYRSHG

SEQ ID NO: 756879 - protein, 18 aa, Mycobacterium
YRGPDWPVLVFDRELRVE

SEQ ID NO: 756880 - protein, 21 aa, Mycobacterium
YRGPLRYAVDMGEWTLFDDTG

SEQ ID NO: 756881 - protein, 18 aa, Mycobacterium
YRGPSARNRVMFGPPGRL

SEQ ID NO: 756882 - protein, 20 aa, Mycobacterium
YRGRDVLVFGLARGGVPVAW

SEQ ID NO: 756883 - protein, 25 aa, Mycobacterium
YRGREICGMPPPSSGGIAVAATLGI

SEQ ID NO: 756884 - protein, 19 aa, Mycobacterium
YRGRPALWSQDTIPDGYSW

SEQ ID NO: 756885 - protein, 18 aa, Mycobacterium
YRGRVGIATAEIRSGLYH

SEQ ID NO: 756886 - protein, 28 aa, Mycobacterium
YRGSVREACLWSAGLAEPGVRRRASILD

SEQ ID NO: 756887 - protein, 24 aa, Mycobacterium
YRGSWCPYCNAQLAAFSRALDTLS

SEQ ID NO: 756888 - protein, 22 aa, Mycobacterium
YRGTWPQIWIAAHGPRMLRVVG

SEQ ID NO: 756889 - protein, 18 aa, Mycobacterium
YRGVPPPTVSMYGAQFIT

SEQ ID NO: 756890 - protein, 17 aa, Mycobacterium
YRHAGAVRREIGVPTVF

SEQ ID NO: 756891 - protein, 17 aa, Mycobacterium
YRHAVPLAVEVTRRALA

SEQ ID NO: 756892 - protein, 19 aa, Mycobacterium
YRHNQVFRGPRHLWVDFAA

SEQ ID NO: 756893 - protein, 19 aa, Mycobacterium
YRHNTTFAQRAQWANATAD

SEQ ID NO: 756894 - protein, 20 aa, Mycobacterium
YRHPFGRRLWELPAGLLDAS

SEQ ID NO: 756895 - protein, 17 aa, Mycobacterium
YRHPRSGQLVAMESRAR

SEQ ID NO: 756896 - protein, 19 aa, Mycobacterium
YRHTLRTILTLALPDDRRK

SEQ ID NO: 756897 - protein, 20 aa, Mycobacterium
YRIAAKLAAMAQDLAERDSG

SEQ ID NO: 756898 - protein, 20 aa, Mycobacterium
YRIAATLAVYLEENRSPAKA

SEQ ID NO: 756899 - protein, 20 aa, Mycobacterium
YRIAVTSARRSEELCALLSR

SEQ ID NO: 756900 - protein, 26 aa, Mycobacterium
YRIDHTLGLPMGWHRGYHSLTAPVIG

SEQ ID NO: 756901 - protein, 19 aa, Mycobacterium
YRIECGEVAAALTALDGVD

SEQ ID NO: 756902 - protein, 20 aa, Mycobacterium
YRIEFAGFIGSNFDSPLSLL

SEQ ID NO: 756903 - protein, 25 aa, Mycobacterium
YRIGELTAALAALGVDRPRYLGGAG

SEQ ID NO: 756904 - protein, 17 aa, Mycobacterium
YRIGRVEDIGRGVARAV

SEQ ID NO: 756905 - protein, 30 aa, Mycobacterium
YRIPEIRPAQAISIRPGDLLVMSTDGIGED

SEQ ID NO: 756906 - protein, 20 aa, Mycobacterium
YRIPFARLDAAGGLDDPSIR

SEQ ID NO: 756907 - protein, 17 aa, Mycobacterium
YRISAGLFEDFLNSMRM

SEQ ID NO: 756908 - protein, 21 aa, Mycobacterium
YRISEDITRSLGELARAQHTT

SEQ ID NO: 756909 - protein, 25 aa, Mycobacterium
YRISEFAEIVGFYGLSYWYPFQVTA

SEQ ID NO: 756910 - protein, 18 aa, Mycobacterium
YRISGNRGDSVYFSATAY

SEQ ID NO: 756911 - protein, 19 aa, Mycobacterium
YRISSAAVRSHDFVEGIRA

SEQ ID NO: 756912 - protein, 17 aa, Mycobacterium
YRISVADARNRRDGRAI

SEQ ID NO: 756913 - protein, 21 aa, Mycobacterium
YRITGSKAWITHGGIADFYNL

SEQ ID NO: 756914 - protein, 20 aa, Mycobacterium
YRIYEMRLRQGLTASKSELP

SEQ ID NO: 756915 - protein, 31 aa, Mycobacterium
YRKAKLPKGVMVWDRSRLIEAQRVLADTVGV

SEQ ID NO: 756916 - protein, 19 aa, Mycobacterium
YRKFLDRSLIGRVPLIGGG

SEQ ID NO: 756917 - protein, 19 aa, Mycobacterium
YRKGWLKKINVISSSMVFE

SEQ ID NO: 756918 - protein, 17 aa, Mycobacterium
YRKLGISSRAELGRRMD

SEQ ID NO: 756919 - protein, 19 aa, Mycobacterium
YRKMVMPFFTNKVVALNHD

SEQ ID NO: 756920 - protein, 21 aa, Mycobacterium
YRKPIKFGEDVVITWRRDGDA

SEQ ID NO: 756921 - protein, 17 aa, Mycobacterium
YRKQMVNLMRWKLEHEL

SEQ ID NO: 756922 - protein, 19 aa, Mycobacterium
YRKRAEQRLLAGQRRLASA

SEQ ID NO: 756923 - protein, 25 aa, Mycobacterium
YRKVERRDKLEFVADLLPQVFRWAR

SEQ ID NO: 756924 - protein, 18 aa, Mycobacterium
YRLAETICVPQPIRRPPI

SEQ ID NO: 756925 - protein, 23 aa, Mycobacterium
YRLAGDYSLPCILSVDGTEIGYI

SEQ ID NO: 756926 - protein, 22 aa, Mycobacterium
YRLAPEFPYPAPVEDCYSALKW

SEQ ID NO: 756927 - protein, 21 aa, Mycobacterium
YRLAPENPWPAAAEDVYSVTR

SEQ ID NO: 756928 - protein, 20 aa, Mycobacterium
YRLAPESRFPTAVNDAIDAV

SEQ ID NO: 756929 - protein, 20 aa, Mycobacterium
YRLAPEWPPPAQFDDAYTAT

SEQ ID NO: 756930 - protein, 20 aa, Mycobacterium
YRLDGVKSLVPAAADAELFI

SEQ ID NO: 756931 - protein, 20 aa, Mycobacterium
YRLDGVKSLVPAAADAELFV

SEQ ID NO: 756932 - protein, 23 aa, Mycobacterium
YRLDIPAATAVRFEPGVAHTVSL

SEQ ID NO: 756933 - protein, 27 aa, Mycobacterium
YRLDLACLLGCGFITGWGSSVYAANVR

SEQ ID NO: 756934 - protein, 19 aa, Mycobacterium
YRLELFGSDGTIIGDGDLR

SEQ ID NO: 756935 - protein, 27 aa, Mycobacterium
YRLELPRPDYHASWDYGGMPVPKDGMP

SEQ ID NO: 756936 - protein, 20 aa, Mycobacterium
YRLERACLVACGVTTGVGTA

SEQ ID NO: 756937 - protein, 18 aa, Mycobacterium
YRLEVRRLADEPLFSRSF

SEQ ID NO: 756938 - protein, 19 aa, Mycobacterium
YRLFYERPVHLVRGQGSHL

SEQ ID NO: 756939 - protein, 19 aa, Mycobacterium
YRLGAFGFSGHPALEDPTT

SEQ ID NO: 756940 - protein, 18 aa, Mycobacterium
YRLGGAPYLLNLMAGRHL

SEQ ID NO: 756941 - protein, 19 aa, Mycobacterium
YRLGMPHTVLISALGFAFA

SEQ ID NO: 756942 - protein, 19 aa, Mycobacterium
YRLGPSLITLGHRAQESMR

SEQ ID NO: 756943 - protein, 26 aa, Mycobacterium
YRLGRGIKAGRVWTNCYHQYPAHAAF

SEQ ID NO: 756944 - protein, 20 aa, Mycobacterium
YRLITLKGRVTGPAELPDDR

SEQ ID NO: 756945 - protein, 18 aa, Mycobacterium
YRLLGAPEHRSCADNLRE

SEQ ID NO: 756946 - protein, 20 aa, Mycobacterium
YRLLPKHSIGMALDDCHDGY

SEQ ID NO: 756947 - protein, 17 aa, Mycobacterium
YRLLPSRFVAALAAAGP

SEQ ID NO: 756948 - protein, 25 aa, Mycobacterium
YRLLQRLGADVADYGFVETSAKQDG

SEQ ID NO: 756949 - protein, 25 aa, Mycobacterium
YRLLQRLGADVAEYGFVETSAKQDG

SEQ ID NO: 756950 - protein, 18 aa, Mycobacterium
YRLLVFAGSPWEQQLAEW

SEQ ID NO: 756951 - protein, 18 aa, Mycobacterium
YRLNWPPEAVVFEIDQPK

SEQ ID NO: 756952 - protein, 26 aa, Mycobacterium
YRLPGYYRWLLYEADHAGAYRFHRIF

SEQ ID NO: 756953 - protein, 17 aa, Mycobacterium
YRLPLVHLLIAARGLPA

SEQ ID NO: 756954 - protein, 20 aa, Mycobacterium
YRLQPINTIDVLGLDGDRLT

SEQ ID NO: 756955 - protein, 20 aa, Mycobacterium
YRLQPINTIEVLGLEGDRLT

SEQ ID NO: 756956 - protein, 17 aa, Mycobacterium
YRLRTRRPVRGHEDDHD

SEQ ID NO: 756957 - protein, 20 aa, Mycobacterium
YRLSAEGLRALLDRLPDPLV

SEQ ID NO: 756958 - protein, 19 aa, Mycobacterium
YRLSASAKLPGRRGLSTRW

SEQ ID NO: 756959 - protein, 20 aa, Mycobacterium
YRLSKEAVILYTMRSATALG

SEQ ID NO: 756960 - protein, 24 aa, Mycobacterium
YRLSPETDELWVLGDICSGGVASM

SEQ ID NO: 756961 - protein, 22 aa, Mycobacterium
YRLTADNRIVWGGYDAVYHFGR

SEQ ID NO: 756962 - protein, 20 aa, Mycobacterium
YRLTAEVADWFGVDAGTLRE

SEQ ID NO: 756963 - protein, 21 aa, Mycobacterium
YRLTESVWRIGSRALTINAIE

SEQ ID NO: 756964 - protein, 23 aa, Mycobacterium
YRLTGDIPAGAFVRDGHTGPGGT

SEQ ID NO: 756965 - protein, 21 aa, Mycobacterium
YRLTLRNGVLIHRKVAADPAT

SEQ ID NO: 756966 - protein, 21 aa, Mycobacterium
YRLTLRNGVLVHRRTEPDPSS

SEQ ID NO: 756967 - protein, 17 aa, Mycobacterium
YRLTPRTGRTHQLRVHM

SEQ ID NO: 756968 - protein, 20 aa, Mycobacterium
YRLTPRTGRTHQLRVHMAGL

SEQ ID NO: 756969 - protein, 20 aa, Mycobacterium
YRLTVGLRRALKASTASGGA

SEQ ID NO: 756970 - protein, 17 aa, Mycobacterium
YRLTWRHRRQNVSLPAA

SEQ ID NO: 756971 - protein, 21 aa, Mycobacterium
YRLVDFSGAVVRTLPATVALK

SEQ ID NO: 756972 - protein, 17 aa, Mycobacterium
YRLVELLGHGGMGEVWR

SEQ ID NO: 756973 - protein, 18 aa, Mycobacterium
YRLVNVFHNLGSLLRQNG

SEQ ID NO: 756974 - protein, 17 aa, Mycobacterium
YRLVRGIAHNATRADPE

SEQ ID NO: 756975 - protein, 19 aa, Mycobacterium
YRLWPRVVAEAARQVPHPV

SEQ ID NO: 756976 - protein, 20 aa, Mycobacterium
YRMALLRWLSVCDIRDEHGQ

SEQ ID NO: 756977 - protein, 28 aa, Mycobacterium
YRMDKRFIAADGRIVWCDLTAVLVQGPR

SEQ ID NO: 756978 - protein, 17 aa, Mycobacterium
YRMFAKLGVADRDQLAK

SEQ ID NO: 756979 - protein, 19 aa, Mycobacterium
YRMLPKYGLAEAIDDAVAG

SEQ ID NO: 756980 - protein, 21 aa, Mycobacterium
YRMMEGFGVHTFRLVNADGQG

SEQ ID NO: 756981 - protein, 20 aa, Mycobacterium
YRMMQGFGVHTFRLVNDAGE

SEQ ID NO: 756982 - protein, 20 aa, Mycobacterium
YRMMQGFGVHTFRLVNDRGE

SEQ ID NO: 756983 - protein, 27 aa, Mycobacterium
YRMPDYYRWLLYKADHGPAYRYHRMFL

SEQ ID NO: 756984 - protein, 17 aa, Mycobacterium
YRMPGMDGAQVAAAVRS

SEQ ID NO: 756985 - protein, 17 aa, Mycobacterium
YRMPGMDGGQVAAAVRS

SEQ ID NO: 756986 - protein, 22 aa, Mycobacterium
YRMPQMSGIEFLESAMDLYPMA

SEQ ID NO: 756987 - protein, 18 aa, Mycobacterium
YRNCFGRNSVDNAGMTLV

SEQ ID NO: 756988 - protein, 20 aa, Mycobacterium
YRNGGILQYVLRNMLKSGQK

SEQ ID NO: 756989 - protein, 17 aa, Mycobacterium
YRNKRVFLVAGTSPDPL

SEQ ID NO: 756990 - protein, 19 aa, Mycobacterium
YRNLLPLRRLRDRFTANDS

SEQ ID NO: 756991 - protein, 21 aa, Mycobacterium
YRNNWKRLGFSDEEVTKPGSD

SEQ ID NO: 756992 - protein, 25 aa, Mycobacterium
YRNPANVFVAGFIGSPAMNLFTLPL

SEQ ID NO: 756993 - protein, 20 aa, Mycobacterium
YRNVCDEIKTLAADIRAGNG

SEQ ID NO: 756994 - protein, 30 aa, Mycobacterium
YRNWEGLTAWAVRWLRDFTGHHPSPGLDAI

SEQ ID NO: 756995 - protein, 20 aa, Mycobacterium
YRPAAEFEELTGAKILQFFG

SEQ ID NO: 756996 - protein, 20 aa, Mycobacterium
YRPAAEFEELTGATILQFYG

SEQ ID NO: 756997 - protein, 18 aa, Mycobacterium
YRPADRLADMDIAGIEAS

SEQ ID NO: 756998 - protein, 19 aa, Mycobacterium
YRPAGAPEFDRLVRRLSRF

SEQ ID NO: 756999 - protein, 17 aa, Mycobacterium
YRPAPAALRDRVPINAT

SEQ ID NO: 757000 - protein, 25 aa, Mycobacterium
YRPAPPGLRANMIFSADGAAAFGGR

SEQ ID NO: 757001 - protein, 17 aa, Mycobacterium
YRPDPGQARDLAFVMFS

SEQ ID NO: 757002 - protein, 21 aa, Mycobacterium
YRPGELVRGRWGLLEPPEPWL

SEQ ID NO: 757003 - protein, 19 aa, Mycobacterium
YRPGFHPSQLGGLGLAVDY

SEQ ID NO: 757004 - protein, 17 aa, Mycobacterium
YRPGLIAAEENHVRHPY

SEQ ID NO: 757005 - protein, 18 aa, Mycobacterium
YRPIGWDAAYRLIADQLG

SEQ ID NO: 757006 - protein, 29 aa, Mycobacterium
YRPIGWDEAYRLIAEHLKALGSPDEALFY

SEQ ID NO: 757007 - protein, 29 aa, Mycobacterium
YRPIKDGPRIAVRLAWWRDHRPRGLDELV

SEQ ID NO: 757008 - protein, 19 aa, Mycobacterium
YRPLPRPEVIAKLDSEGLL

SEQ ID NO: 757009 - protein, 18 aa, Mycobacterium
YRPLQILGARVVDLEDAL

SEQ ID NO: 757010 - protein, 18 aa, Mycobacterium
YRPNLVIATPPDYPPYAE

SEQ ID NO: 757011 - protein, 20 aa, Mycobacterium
YRPPEILQRRILRKDPSRAR

SEQ ID NO: 757012 - protein, 27 aa, Mycobacterium
YRPSDEKLDWARRVLAASRNERGVFAF

SEQ ID NO: 757013 - protein, 17 aa, Mycobacterium
YRPSREDALLCGDFYDV

SEQ ID NO: 757014 - protein, 22 aa, Mycobacterium
YRPSREGALLCGDFYDVVQTPD

SEQ ID NO: 757015 - protein, 17 aa, Mycobacterium
YRPSVAARSLRNGRTGI

SEQ ID NO: 757016 - protein, 21 aa, Mycobacterium
YRPTRCASRIGCPILVQIADF

SEQ ID NO: 757017 - protein, 27 aa, Mycobacterium
YRPVTDILRTEGRFEVVSQYEPAGDQP

SEQ ID NO: 757018 - protein, 24 aa, Mycobacterium
YRPWAGEIRARHTGSLVSDRSGAI

SEQ ID NO: 757019 - protein, 24 aa, Mycobacterium
YRPWAGEIRARHTGSLVSDRSGQI

SEQ ID NO: 757020 - protein, 24 aa, Mycobacterium
YRQAERLRRSVALLRERPADEPLW

SEQ ID NO: 757021 - protein, 17 aa, Mycobacterium
YRQARPGPAADIVASLA

SEQ ID NO: 757022 - protein, 25 aa, Mycobacterium
YRQCAAEAQLAFGNPAVFAEAYLGT

SEQ ID NO: 757023 - protein, 24 aa, Mycobacterium
YRQDVRPPWSIGAPQPELAALIEG

SEQ ID NO: 757024 - protein, 17 aa, Mycobacterium
YRQETIRMFGLPESGLA

SEQ ID NO: 757025 - protein, 22 aa, Mycobacterium
YRQLDYWARTSLVVPSIRGAAG

SEQ ID NO: 757026 - protein, 20 aa, Mycobacterium
YRQLDYWARTSLVVPSIRSA

SEQ ID NO: 757027 - protein, 21 aa, Mycobacterium
YRQLDYWARTSLVVPSIRSAA

SEQ ID NO: 757028 - protein, 24 aa, Mycobacterium
YRQLEHRLGPWVSRHREVHVQPAA

SEQ ID NO: 757029 - protein, 18 aa, Mycobacterium
YRQLQTWWGATAAAIEAC

SEQ ID NO: 757030 - protein, 17 aa, Mycobacterium
YRQLWQARDERFGAVTG

SEQ ID NO: 757031 - protein, 21 aa, Mycobacterium
YRQNPGLARDLAFIAFSAVGG

SEQ ID NO: 757032 - protein, 21 aa, Mycobacterium
YRQNPGLARDLAFIAFSGIGG

SEQ ID NO: 757033 - protein, 26 aa, Mycobacterium
YRQPEGANIRYLRRLRESLNTTVPMI

SEQ ID NO: 757034 - protein, 27 aa, Mycobacterium
YRQPVTRARVSAVRGVNVDAVMRTLLA

SEQ ID NO: 757035 - protein, 27 aa, Mycobacterium
YRQPVTRARVSAVRGVNVDAVMRTLMA

SEQ ID NO: 757036 - protein, 27 aa, Mycobacterium
YRQPVTRSRVSAVRGVNVDAVMRTLLM

SEQ ID NO: 757037 - protein, 24 aa, Mycobacterium
YRQQRPCGVFGFGDRGFDPVSLCG

SEQ ID NO: 757038 - protein, 19 aa, Mycobacterium
YRQSALASRARHFAGNPWA

SEQ ID NO: 757039 - protein, 17 aa, Mycobacterium
YRQVLDLEVLFESEQFV

SEQ ID NO: 757040 - protein, 25 aa, Mycobacterium
YRQVLDRLIDWVSFTPLQNVTGEPA

SEQ ID NO: 757041 - protein, 18 aa, Mycobacterium
YRRAAGFVERVVATWAER

SEQ ID NO: 757042 - protein, 22 aa, Mycobacterium
YRRAGVIVRIWRIPGTRSNVGI

SEQ ID NO: 757043 - protein, 20 aa, Mycobacterium
YRRALRVIRARLSATGAEIL

SEQ ID NO: 757044 - protein, 23 aa, Mycobacterium
YRRCPHGKPLWCSTTHGEGDVHV

SEQ ID NO: 757045 - protein, 23 aa, Mycobacterium
YRRCQHGKPLWCSTSHGEGDIPV

SEQ ID NO: 757046 - protein, 24 aa, Mycobacterium
YRRDGWWQGLGPYDLVLDALGGTS

SEQ ID NO: 757047 - protein, 23 aa, Mycobacterium
YRREALPRIQLWPFGPEGEYGEP

SEQ ID NO: 757048 - protein, 22 aa, Mycobacterium
YRRELWSYGLGVADAMDTAQRG

SEQ ID NO: 757049 - protein, 25 aa, Mycobacterium
YRRFGSGAGVPLVLALRFRGTMDHW

SEQ ID NO: 757050 - protein, 27 aa, Mycobacterium
YRRFLERKLRETFGFEGSPIRVNVRVR

SEQ ID NO: 757051 - protein, 27 aa, Mycobacterium
YRRFLERRLRESFGFDGTPIRINVRVR

SEQ ID NO: 757052 - protein, 18 aa, Mycobacterium
YRRFPTKADLVLAALEQS

SEQ ID NO: 757053 - protein, 18 aa, Mycobacterium
YRRFTHTVLLRLPSGIDR

SEQ ID NO: 757054 - protein, 19 aa, Mycobacterium
YRRKFRHILVDEYQDTNHA

SEQ ID NO: 757055 - protein, 18 aa, Mycobacterium
YRRLDSRLHLAIAEAAGV

SEQ ID NO: 757056 - protein, 24 aa, Mycobacterium
YRRLFSVLLDEGWTDDIPAAVDAA

SEQ ID NO: 757057 - protein, 24 aa, Mycobacterium
YRRLIADPALTHFFDGVDMKRLKT

SEQ ID NO: 757058 - protein, 20 aa, Mycobacterium
YRRLKAAVVAAGRHADDLKV

SEQ ID NO: 757059 - protein, 31 aa, Mycobacterium
YRRLLEAYARICGRWHAAVPVGNTLDTAIAS

SEQ ID NO: 757060 - protein, 17 aa, Mycobacterium
YRRLLRAGVPAVGRVVA

SEQ ID NO: 757061 - protein, 23 aa, Mycobacterium
YRRLLTRAGLRFVRSASATAGYQ

SEQ ID NO: 757062 - protein, 24 aa, Mycobacterium
YRRLRAKARIKFLVKDWGVEKFRE

SEQ ID NO: 757063 - protein, 27 aa, Mycobacterium
YRRLRAKARLKFLIKDWGVEKFRQVLE

SEQ ID NO: 757064 - protein, 27 aa, Mycobacterium
YRRLRAKARLKFLVKDWGVAKFREILE

SEQ ID NO: 757065 - protein, 17 aa, Mycobacterium
YRRNELNESQVLALNEI

SEQ ID NO: 757066 - protein, 18 aa, Mycobacterium
YRRPFEFQTLLASTQLAK

SEQ ID NO: 757067 - protein, 29 aa, Mycobacterium
YRRPRKYWVLKGFHGFRLKELFDTYPDAR

SEQ ID NO: 757068 - protein, 25 aa, Mycobacterium
YRRQELWTEIGWAHRCAEALTAPKF

SEQ ID NO: 757069 - protein, 18 aa, Mycobacterium
YRRQRWCRRADLRRRRGR

SEQ ID NO: 757070 - protein, 24 aa, Mycobacterium
YRRRAYEAWPKIVITDVDSTGLPD

SEQ ID NO: 757071 - protein, 34 aa, Mycobacterium
YRRRLRPASHYSLGWLPRWAKLGSAVPRLANRAA

SEQ ID NO: 757072 - protein, 30 aa, Mycobacterium
YRRRPQWRRIGLIDCGERWAAFNTGMGVDA

SEQ ID NO: 757073 - protein, 20 aa, Mycobacterium
YRRRRSRVGGFPSVLGSEPA

SEQ ID NO: 757074 - protein, 17 aa, Mycobacterium
YRRRSALAVAAREVLGV

SEQ ID NO: 757075 - protein, 19 aa, Mycobacterium
YRRRVGATMVARAFEQART

SEQ ID NO: 757076 - protein, 28 aa, Mycobacterium
YRRSFARYPRLIPLLTIHAVNSTQAFRM

SEQ ID NO: 757077 - protein, 26 aa, Mycobacterium
YRRSGRSGLDLPAFSFGLWQKFGTDY

SEQ ID NO: 757078 - protein, 17 aa, Mycobacterium
YRRVRRGLASVAGVAEW

SEQ ID NO: 757079 - protein, 20 aa, Mycobacterium
YRRVTPRIFAVWLAARFLQL

SEQ ID NO: 757080 - protein, 17 aa, Mycobacterium
YRRWAEFTDNLSWPQLI

SEQ ID NO: 757081 - protein, 24 aa, Mycobacterium
YRRWKTLPRLLADALIIHIDADIP

SEQ ID NO: 757082 - protein, 24 aa, Mycobacterium
YRRWPDRRALLRDTLMAVASTSFP

SEQ ID NO: 757083 - protein, 28 aa, Mycobacterium
YRRYAIERPHMYRLMFGSTSAHGIKAPA

SEQ ID NO: 757084 - protein, 26 aa, Mycobacterium
YRRYAIKRPHVYRLMFGSTSAHGINA

SEQ ID NO: 757085 - protein, 18 aa, Mycobacterium
YRSALNWLGDNASCVLQT

SEQ ID NO: 757086 - protein, 20 aa, Mycobacterium
YRSALWPGRNAEIDERMIRF

SEQ ID NO: 757087 - protein, 19 aa, Mycobacterium
YRSAVGQRVVVRGRIGDLL

SEQ ID NO: 757088 - protein, 23 aa, Mycobacterium
YRSAWWPSTLPTLIVSGSADRIV

SEQ ID NO: 757089 - protein, 23 aa, Mycobacterium
YRSDELQIFLYARPDSGVVYSRV

SEQ ID NO: 757090 - protein, 20 aa, Mycobacterium
YRSELLYRHGIDPFRPGRDV

SEQ ID NO: 757091 - protein, 22 aa, Mycobacterium
YRSELPVMERYAAKAAELGVQS

SEQ ID NO: 757092 - protein, 18 aa, Mycobacterium
YRSEVLFRRRIDPYREGS

SEQ ID NO: 757093 - protein, 17 aa, Mycobacterium
YRSFVSWLADQDLDAAR

SEQ ID NO: 757094 - protein, 17 aa, Mycobacterium
YRSGKLLLDEAVTTEYK

SEQ ID NO: 757095 - protein, 21 aa, Mycobacterium
YRSITKLPIILKGICDSDDVR

SEQ ID NO: 757096 - protein, 27 aa, Mycobacterium
YRSIWMYLKELEFRQGFIDIPVNGVLV

SEQ ID NO: 757097 - protein, 20 aa, Mycobacterium
YRSKCAAIARISADGTAEVC

SEQ ID NO: 757098 - protein, 19 aa, Mycobacterium
YRSLPGLGVVLGARVLGEF

SEQ ID NO: 757099 - protein, 19 aa, Mycobacterium
YRSMLRRGFTAESYGVSMH

SEQ ID NO: 757100 - protein, 25 aa, Mycobacterium
YRSPESIGSLMGWQATLEAANLTLR

SEQ ID NO: 757101 - protein, 18 aa, Mycobacterium
YRSPFGVSGERGVELAIA

SEQ ID NO: 757102 - protein, 22 aa, Mycobacterium
YRSPLKYAVYFEDWILFDDTGL

SEQ ID NO: 757103 - protein, 17 aa, Mycobacterium
YRSQRTVQEYSAIVDKL

SEQ ID NO: 757104 - protein, 24 aa, Mycobacterium
YRSRCARRAPAWASLPVQYIDYAL

SEQ ID NO: 757105 - protein, 23 aa, Mycobacterium
YRSREVLELDAAKRWCRAGEVDS

SEQ ID NO: 757106 - protein, 22 aa, Mycobacterium
YRSRFAITGARQIVRHTMTDPG

SEQ ID NO: 757107 - protein, 22 aa, Mycobacterium
YRSRSTGEIVFWGTGSAANPRE

SEQ ID NO: 757108 - protein, 17 aa, Mycobacterium
YRSSLVPRRNAELDERM

SEQ ID NO: 757109 - protein, 25 aa, Mycobacterium
YRSTIRVRLIHSFVRRHVAAMPDWR

SEQ ID NO: 757110 - protein, 17 aa, Mycobacterium
YRSYLTWLAAQDRTAAR

SEQ ID NO: 757111 - protein, 17 aa, Mycobacterium
YRTAEFFLRDDPGNDPR

SEQ ID NO: 757112 - protein, 19 aa, Mycobacterium
YRTAYRRTRAGVAVWEVRP

SEQ ID NO: 757113 - protein, 19 aa, Mycobacterium
YRTDFARDRARVLHSAAFR

SEQ ID NO: 757114 - protein, 25 aa, Mycobacterium
YRTDRPCRSAGRIGGPLVVSMRPLP

SEQ ID NO: 757115 - protein, 21 aa, Mycobacterium
YRTEGLVNFLAQLGRDHRKFG

SEQ ID NO: 757116 - protein, 25 aa, Mycobacterium
YRTEGPANPLILVFGRVSELSTCSW

SEQ ID NO: 757117 - protein, 20 aa, Mycobacterium
YRTGDLVRRNHCGELEFVGR

SEQ ID NO: 757118 - protein, 18 aa, Mycobacterium
YRTKVMWWDRRTLSAHAE

SEQ ID NO: 757119 - protein, 24 aa, Mycobacterium
YRTLHRLGPDASRVALVKPAGQVG

SEQ ID NO: 757120 - protein, 25 aa, Mycobacterium
YRTLKEASYRLGARTLFHQFSAPMY

SEQ ID NO: 757121 - protein, 19 aa, Mycobacterium
YRTLLALLLKYMSSAKAHG

SEQ ID NO: 757122 - protein, 19 aa, Mycobacterium
YRTLLEFFFQIHDPTTKNR

SEQ ID NO: 757123 - protein, 20 aa, Mycobacterium
YRTLRLMESNGWVHAKPVVQ

SEQ ID NO: 757124 - protein, 47 aa, Mycobacterium
YRTMLMHLMRIASTFGFVPIGGWALRAIVAALMEWERKSELSGDRAG

SEQ ID NO: 757125 - protein, 18 aa, Mycobacterium
YRTPARPDVIASLDAEGL

SEQ ID NO: 757126 - protein, 18 aa, Mycobacterium
YRTPGGAGIRLDGGTTLG

SEQ ID NO: 757127 - protein, 17 aa, Mycobacterium
YRTVRIGSHTARLLLAK

SEQ ID NO: 757128 - protein, 20 aa, Mycobacterium
YRVAAKLRLMADELTERDSG

SEQ ID NO: 757129 - protein, 18 aa, Mycobacterium
YRVARAVERRGRPIDDER

SEQ ID NO: 757130 - protein, 17 aa, Mycobacterium
YRVAVEVRPADLADPQE

SEQ ID NO: 757131 - protein, 18 aa, Mycobacterium
YRVFAELAPHPLLTRAVE

SEQ ID NO: 757132 - protein, 19 aa, Mycobacterium
YRVFAELAPHPLLTRAVEK

SEQ ID NO: 757133 - protein, 18 aa, Mycobacterium
YRVFAELSPHPLLTRAVD

SEQ ID NO: 757134 - protein, 19 aa, Mycobacterium
YRVGLPLTGRWREVINTDA

SEQ ID NO: 757135 - protein, 18 aa, Mycobacterium
YRVHPALLDACFQSVAAH

SEQ ID NO: 757136 - protein, 26 aa, Mycobacterium
YRVHPARLTAPVTMRLAHALVCDDYL

SEQ ID NO: 757137 - protein, 24 aa, Mycobacterium
YRVLCPDLRGSGWSSAPRTSYRKD

SEQ ID NO: 757138 - protein, 25 aa, Mycobacterium
YRVLDMGCGMGRVARPLTTFLDPAK

SEQ ID NO: 757139 - protein, 17 aa, Mycobacterium
YRVLHVAARITRGARQL

SEQ ID NO: 757140 - protein, 17 aa, Mycobacterium
YRVLHVAARITRGARQV

SEQ ID NO: 757141 - protein, 34 aa, Mycobacterium
YRVMRSDRGFFCLPEVNVGLPFTPGMSALCQGRM

SEQ ID NO: 757142 - protein, 25 aa, Mycobacterium
YRVNGAKAWITHGGIADFYSLFART

SEQ ID NO: 757143 - protein, 18 aa, Mycobacterium
YRVPIGEALRLWYDLLSR

SEQ ID NO: 757144 - protein, 25 aa, Mycobacterium
YRVRELRVFDAFPLTHHIESFALLT

SEQ ID NO: 757145 - protein, 23 aa, Mycobacterium
YRVSAQQAFRVLQWRSQETNVKL

SEQ ID NO: 757146 - protein, 20 aa, Mycobacterium
YRVSRAALREAVRLLEYHSV

SEQ ID NO: 757147 - protein, 17 aa, Mycobacterium
YRVVAALAGTPVPVARA

SEQ ID NO: 757148 - protein, 18 aa, Mycobacterium
YRVVELLGRRNAQESTAQ

SEQ ID NO: 757149 - protein, 19 aa, Mycobacterium
YRVVGRVAALNSLLVALAH

SEQ ID NO: 757150 - protein, 17 aa, Mycobacterium
YRVVLSDSARYEAAVAQ

SEQ ID NO: 757151 - protein, 18 aa, Mycobacterium
YRWHPFAIDPEVDYEGEP

SEQ ID NO: 757152 - protein, 30 aa, Mycobacterium
YRWMNLMARLPRKALPLIVKRIAQGVGGAV

SEQ ID NO: 757153 - protein, 17 aa, Mycobacterium
YRYCWIRDQCYTGQAVA

SEQ ID NO: 757154 - protein, 30 aa, Mycobacterium
YRYDARLAPMWLPFRWPGRQGVTLTDDGRF

SEQ ID NO: 757155 - protein, 22 aa, Mycobacterium
YRYFASEGFLPGYSFPRLPLSA

SEQ ID NO: 757156 - protein, 18 aa, Mycobacterium
YRYFGTRSGLLIALVQDF

SEQ ID NO: 757157 - protein, 21 aa, Mycobacterium
YRYFPEPDLEPVAPSAELIEK

SEQ ID NO: 757158 - protein, 21 aa, Mycobacterium
YRYFPEPDLEPVAPSAELVEQ

SEQ ID NO: 757159 - protein, 22 aa, Mycobacterium
YRYFPEPDLEPVAPSPELVERL

SEQ ID NO: 757160 - protein, 21 aa, Mycobacterium
YRYFPEPDLEPVAPSRELVEE

SEQ ID NO: 757161 - protein, 21 aa, Mycobacterium
YRYFPEPDLEPVAPSRELVER

SEQ ID NO: 757162 - protein, 25 aa, Mycobacterium
YRYFPIEPHWLFPGIQWLPYEARVQ

SEQ ID NO: 757163 - protein, 26 aa, Mycobacterium
YRYFPIEPHWLFPGMQWLPYEARVQI

SEQ ID NO: 757164 - protein, 17 aa, Mycobacterium
YRYFPSKVHLLVSALER

SEQ ID NO: 757165 - protein, 29 aa, Mycobacterium
YRYFPVEPHWLFPGMQFMPVAARTQVAKR

SEQ ID NO: 757166 - protein, 19 aa, Mycobacterium
YRYIDYWGTAVTAFDLHAP

SEQ ID NO: 757167 - protein, 20 aa, Mycobacterium
YRYLPTFILRGLSRLHIRFE

SEQ ID NO: 757168 - protein, 18 aa, Mycobacterium
YRYLRALDTKHWDDFADT

SEQ ID NO: 757169 - protein, 18 aa, Mycobacterium
YRYLRALDTKHWDEFADT

SEQ ID NO: 757170 - protein, 17 aa, Mycobacterium
YRYLRARGNSIEGGTSE

SEQ ID NO: 757171 - protein, 17 aa, Mycobacterium
YRYNGRWVSKQADTEVL

SEQ ID NO: 757172 - protein, 25 aa, Mycobacterium
YRYPFGETVDAWVPIGLSDPDGSVG

SEQ ID NO: 757173 - protein, 19 aa, Mycobacterium
YRYPFRPATIGSYRSALNW

SEQ ID NO: 757174 - protein, 17 aa, Mycobacterium
YRYRARCAVNVDGVVRL

SEQ ID NO: 757175 - protein, 17 aa, Mycobacterium
YRYSWVRDASLTLEALW

SEQ ID NO: 757176 - protein, 20 aa, Mycobacterium
YRYVEEELLYLLTDSNARAL

SEQ ID NO: 757177 - protein, 18 aa, Mycobacterium
YSAALMVPYGIQLASTLT

SEQ ID NO: 757178 - protein, 28 aa, Mycobacterium
YSAANWLALNCRRHMELYGTTKEQLGWI

SEQ ID NO: 757179 - protein, 28 aa, Mycobacterium
YSAANWLALNCRRHMELYGTTKEQLGWV

SEQ ID NO: 757180 - protein, 19 aa, Mycobacterium
YSAARARLTDMHKVARAFG

SEQ ID NO: 757181 - protein, 18 aa, Mycobacterium
YSAASCYSSITAGLAGKW

SEQ ID NO: 757182 - protein, 24 aa, Mycobacterium
YSAEPGCGPTVIFASATTDSPGAT

SEQ ID NO: 757183 - protein, 17 aa, Mycobacterium
YSALTWLAGLPSVDRYR

SEQ ID NO: 757184 - protein, 17 aa, Mycobacterium
YSALVIERDDLYGNYRR

SEQ ID NO: 757185 - protein, 20 aa, Mycobacterium
YSAPGACVRATWLRTRPELF

SEQ ID NO: 757186 - protein, 21 aa, Mycobacterium
YSAPGYAFFWNVDQKKMEILG

SEQ ID NO: 757187 - protein, 17 aa, Mycobacterium
YSARLLASDGVDHASAS

SEQ ID NO: 757188 - protein, 18 aa, Mycobacterium
YSATQGWDDLECDPAELR

SEQ ID NO: 757189 - protein, 18 aa, Mycobacterium
YSAVIAQLEGESWTGSAS

SEQ ID NO: 757190 - protein, 17 aa, Mycobacterium
YSAYKGRTGREIRVFTL

SEQ ID NO: 757191 - protein, 17 aa, Mycobacterium
YSDAWRGVDEEPLSHGL

SEQ ID NO: 757192 - protein, 25 aa, Mycobacterium
YSDCSWSVTGTGQFRPLAGSDPAVG

SEQ ID NO: 757193 - protein, 21 aa, Mycobacterium
YSDDEIVAFLTIEPMTQGHTL

SEQ ID NO: 757194 - protein, 18 aa, Mycobacterium
YSDFRRTTALGRISDPVW

SEQ ID NO: 757195 - protein, 34 aa, Mycobacterium
YSDFSVWILDVERVRWVGGYGRMDSASGAEYHSA

SEQ ID NO: 757196 - protein, 34 aa, Mycobacterium
YSDFTLWVLRVSRVRWVGGYGRMDSATGEAYAAA

SEQ ID NO: 757197 - protein, 28 aa, Mycobacterium
YSDGFIAPAGFDFGRWRFETACHRSADT

SEQ ID NO: 757198 - protein, 18 aa, Mycobacterium
YSDHLWVYGATAYGRFCV

SEQ ID NO: 757199 - protein, 21 aa, Mycobacterium
YSDNVGWVYRTLFARVGNRTD

SEQ ID NO: 757200 - protein, 26 aa, Mycobacterium
YSDQAALDWHNFVAFRGRELAPEGRL

SEQ ID NO: 757201 - protein, 29 aa, Mycobacterium
YSDRLVADILRTLRWLNETTGITILSGLA

SEQ ID NO: 757202 - protein, 20 aa, Mycobacterium
YSDYPRFHTLMAEMSGEVFD

SEQ ID NO: 757203 - protein, 19 aa, Mycobacterium
YSEAIALARLGWAALAVGT

SEQ ID NO: 757204 - protein, 21 aa, Mycobacterium
YSEAVALARLGWASLAVGTGQ

SEQ ID NO: 757205 - protein, 17 aa, Mycobacterium
YSEFKSMLSQAAVAHRI

SEQ ID NO: 757206 - protein, 21 aa, Mycobacterium
YSEIFAMSYARPAAVADGLAE

SEQ ID NO: 757207 - protein, 20 aa, Mycobacterium
YSEPCFDIAVAASFSPTGPR

SEQ ID NO: 757208 - protein, 19 aa, Mycobacterium
YSEPCTLREPAFAALEKLE

SEQ ID NO: 757209 - protein, 18 aa, Mycobacterium
YSEPKRRGGQAASAAPLR

SEQ ID NO: 757210 - protein, 19 aa, Mycobacterium
YSESGLKRQFVKQLESRNI

SEQ ID NO: 757211 - protein, 22 aa, Mycobacterium
YSFEPNPYWSRLFAPGSELKQY

SEQ ID NO: 757212 - protein, 24 aa, Mycobacterium
YSFERVRALIVERLPSMPQLRWRV

SEQ ID NO: 757213 - protein, 20 aa, Mycobacterium
YSFEVSDRFGNCGITGVIVV

SEQ ID NO: 757214 - protein, 18 aa, Mycobacterium
YSFGKSFDRNRLDSLTLG

SEQ ID NO: 757215 - protein, 24 aa, Mycobacterium
YSFGMRNAITLSWADNTGATRIYT

SEQ ID NO: 757216 - protein, 20 aa, Mycobacterium
YSFLPIIRAFAGPAGIDVQT

SEQ ID NO: 757217 - protein, 19 aa, Mycobacterium
YSFSEEVQQEWVWTETMPT

SEQ ID NO: 757218 - protein, 24 aa, Mycobacterium
YSFSQFKRSALPNGPKVSAGGSLS

SEQ ID NO: 757219 - protein, 21 aa, Mycobacterium
YSGDLMLAFSTGNRGIPPYAW

SEQ ID NO: 757220 - protein, 18 aa, Mycobacterium
YSGGLGILAGDHLKSASD

SEQ ID NO: 757221 - protein, 27 aa, Mycobacterium
YSGGMFRRVDVASALVVPPQVLFLDEP

SEQ ID NO: 757222 - protein, 30 aa, Mycobacterium
YSGGMVRRLEVAQALVNRPSLLVLDEPTVG

SEQ ID NO: 757223 - protein, 18 aa, Mycobacterium
YSGGRFRLGLGSQIKVHI

SEQ ID NO: 757224 - protein, 25 aa, Mycobacterium
YSGGTSPRALAMFVEAATELIGGHR

SEQ ID NO: 757225 - protein, 25 aa, Mycobacterium
YSGIFAKVNGGGFLTDYYPDAYKAI

SEQ ID NO: 757226 - protein, 21 aa, Mycobacterium
YSGKKEFVFLGLLSLPHNDDG

SEQ ID NO: 757227 - protein, 17 aa, Mycobacterium
YSGLDWRCAQWLHDHEV

SEQ ID NO: 757228 - protein, 23 aa, Mycobacterium
YSGLLEHLASWGIVAGAPDTQRG

SEQ ID NO: 757229 - protein, 21 aa, Mycobacterium
YSGLLEHLASWGIVTGAPDTQ

SEQ ID NO: 757230 - protein, 19 aa, Mycobacterium
YSGLRVCEYLPGKAMVMQM

SEQ ID NO: 757231 - protein, 26 aa, Mycobacterium
YSGPAFLLPGMLVWGFTGQIISAMLE

SEQ ID NO: 757232 - protein, 20 aa, Mycobacterium
YSGPFSGAANLAYLYQTFMT

SEQ ID NO: 757233 - protein, 24 aa, Mycobacterium
YSGPQRYWWMPGVTQVVPNWNDPN

SEQ ID NO: 757234 - protein, 18 aa, Mycobacterium
YSGPSWLAPVALKSLTKL

SEQ ID NO: 757235 - protein, 18 aa, Mycobacterium
YSGPTAALTDVWRALRAS

SEQ ID NO: 757236 - protein, 24 aa, Mycobacterium
YSGPTASLTDVWRALRASMRSVLE

SEQ ID NO: 757237 - protein, 17 aa, Mycobacterium
YSGQICESGTRLLVSDT

SEQ ID NO: 757238 - protein, 19 aa, Mycobacterium
YSGRVCGATFDLTMFDTAL

SEQ ID NO: 757239 - protein, 17 aa, Mycobacterium
YSGSLLREGDDWYERGP

SEQ ID NO: 757240 - protein, 18 aa, Mycobacterium
YSGTVTMTLVDLGVSAID

SEQ ID NO: 757241 - protein, 18 aa, Mycobacterium
YSGVPVRVCRTGYTGEHG

SEQ ID NO: 757242 - protein, 19 aa, Mycobacterium
YSGVPVRVCRTGYTGEHGY

SEQ ID NO: 757243 - protein, 24 aa, Mycobacterium
YSHEWSVGDTVIWDNRGVLHRAAP

SEQ ID NO: 757244 - protein, 20 aa, Mycobacterium
YSHKRGWEGVIAKRRDSGYQ

SEQ ID NO: 757245 - protein, 19 aa, Mycobacterium
YSHKYGFRFSVLTRPPWAG

SEQ ID NO: 757246 - protein, 24 aa, Mycobacterium
YSHSWSVGDTVIWDNNGVLHRAAP

SEQ ID NO: 757247 - protein, 24 aa, Mycobacterium
YSHSWSVGDTVIWDNRGVLHRAAP

SEQ ID NO: 757248 - protein, 25 aa, Mycobacterium
YSIAHLKYFASLARSYAFEETGPLI

SEQ ID NO: 757249 - protein, 19 aa, Mycobacterium
YSILPVARWQYDIVAADGG

SEQ ID NO: 757250 - protein, 29 aa, Mycobacterium
YSIPVGRGRFRGAGLIDCGPSRPPYTDAP

SEQ ID NO: 757251 - protein, 17 aa, Mycobacterium
YSIVYVYDIAELAILAA

SEQ ID NO: 757252 - protein, 24 aa, Mycobacterium
YSKAIDGSFEWDQALFSYNFGDPD

SEQ ID NO: 757253 - protein, 24 aa, Mycobacterium
YSKAIDGSFEWNQSLFSYNFGDPD

SEQ ID NO: 757254 - protein, 17 aa, Mycobacterium
YSKGITVPAIVEVATGE

SEQ ID NO: 757255 - protein, 24 aa, Mycobacterium
YSKKFDTACFRWSVDENPSVQQRL

SEQ ID NO: 757256 - protein, 17 aa, Mycobacterium
YSKRPGTPAADFDEQLP

SEQ ID NO: 757257 - protein, 40 aa, Mycobacterium
YSKVSGRDLAHWDFYMALAYFKLAIIAAGIDYRRREGADG

SEQ ID NO: 757258 - protein, 19 aa, Mycobacterium
YSLAEAMSDVAGRAASLPV

SEQ ID NO: 757259 - protein, 26 aa, Mycobacterium
YSLCGRPGRRTDYRIAIRRIADGGGG

SEQ ID NO: 757260 - protein, 23 aa, Mycobacterium
YSLEVPAALITRLQQTADLFGKG

SEQ ID NO: 757261 - protein, 24 aa, Mycobacterium
YSLLRPGGELRYLEHVAGTGFQAR

SEQ ID NO: 757262 - protein, 18 aa, Mycobacterium
YSMASPLGRCIAGARPGE

SEQ ID NO: 757263 - protein, 17 aa, Mycobacterium
YSMHPGWADTPGVATSL

SEQ ID NO: 757264 - protein, 25 aa, Mycobacterium
YSMPGRADWAVHIALWRRDAGTLTD

SEQ ID NO: 757265 - protein, 22 aa, Mycobacterium
YSNCPKYIARRDISEIGPSLPG

SEQ ID NO: 757266 - protein, 20 aa, Mycobacterium
YSNEAPKFFNSNGQPLSDHS

SEQ ID NO: 757267 - protein, 26 aa, Mycobacterium
YSNGLFARGEHQGVTNLSYSIKVSPF

SEQ ID NO: 757268 - protein, 32 aa, Mycobacterium
YSNGLFWQDDYRLLGIDLKINFGGTSGDYAVS

SEQ ID NO: 757269 - protein, 23 aa, Mycobacterium
YSNLLEHLASWGIVAGAPDTQRG

SEQ ID NO: 757270 - protein, 21 aa, Mycobacterium
YSNMLRARWARNLAAENRVGH

SEQ ID NO: 757271 - protein, 20 aa, Mycobacterium
YSNSEFLVFMRTGGTVVSAP

SEQ ID NO: 757272 - protein, 23 aa, Mycobacterium
YSPAYGARPGWLYDLTRRHPDAS

SEQ ID NO: 757273 - protein, 20 aa, Mycobacterium
YSPESAQIFGLQETRYEGPT

SEQ ID NO: 757274 - protein, 18 aa, Mycobacterium
YSPGALRQTIDFYRGSNL

SEQ ID NO: 757275 - protein, 18 aa, Mycobacterium
YSPIAWRTVTHRKRDIGV

SEQ ID NO: 757276 - protein, 23 aa, Mycobacterium
YSPRFDGGVERLLARAEAGDASD

SEQ ID NO: 757277 - protein, 21 aa, Mycobacterium
YSPRVEGVHLRFGPVARGGLR

SEQ ID NO: 757278 - protein, 26 aa, Mycobacterium
YSPSELMSGALPVARQLFGNDIAPAE

SEQ ID NO: 757279 - protein, 20 aa, Mycobacterium
YSPSLGRYVFYPRTLAPGTL

SEQ ID NO: 757280 - protein, 19 aa, Mycobacterium
YSPSSPLGGALIDAKVGET

SEQ ID NO: 757281 - protein, 19 aa, Mycobacterium
YSPYAWRSVTYRKRDIGVR

SEQ ID NO: 757282 - protein, 19 aa, Mycobacterium
YSQDQGWEGVVAKRLDSTY

SEQ ID NO: 757283 - protein, 28 aa, Mycobacterium
YSQLFGWRIDFLDGMPVPYWVIRVAGRD

SEQ ID NO: 757284 - protein, 23 aa, Mycobacterium
YSQLQLPGGETIDLYNLHTNTGG

SEQ ID NO: 757285 - protein, 20 aa, Mycobacterium
YSQPVLYKHFAGMEELADAV

SEQ ID NO: 757286 - protein, 19 aa, Mycobacterium
YSQPVLYKHFSGMDHLAEA

SEQ ID NO: 757287 - protein, 24 aa, Mycobacterium
YSQWLSRQDWTPSYQRHRRNLQLI

SEQ ID NO: 757288 - protein, 22 aa, Mycobacterium
YSRAVRVGAHIAVAGTTAARPN

SEQ ID NO: 757289 - protein, 17 aa, Mycobacterium
YSRDAKFSPAREALDNP

SEQ ID NO: 757290 - protein, 22 aa, Mycobacterium
YSREEILTALGFASLQRTPSTM

SEQ ID NO: 757291 - protein, 18 aa, Mycobacterium
YSRGKGDRNLRLDTVTVV

SEQ ID NO: 757292 - protein, 19 aa, Mycobacterium
YSRKRGWEGVIAKRRDSGY

SEQ ID NO: 757293 - protein, 18 aa, Mycobacterium
YSRLCLAYPKGRDPGARM

SEQ ID NO: 757294 - protein, 25 aa, Mycobacterium
YSRLYEAGKFFGWLDQRGITALTEL

SEQ ID NO: 757295 - protein, 24 aa, Mycobacterium
YSRRKHLEAGYEFVNTPHITKEQL

SEQ ID NO: 757296 - protein, 23 aa, Mycobacterium
YSRRRGWRLSEHYTVPPMPFSFT

SEQ ID NO: 757297 - protein, 23 aa, Mycobacterium
YSRSEGGGMLVLKRLSDARRDGD

SEQ ID NO: 757298 - protein, 17 aa, Mycobacterium
YSRVRVDGVVHSLTDPP

SEQ ID NO: 757299 - protein, 20 aa, Mycobacterium
YSRWSFQHVEDMVPTALIPR

SEQ ID NO: 757300 - protein, 18 aa, Mycobacterium
YSSARGCDLAMVRRGIAP

SEQ ID NO: 757301 - protein, 18 aa, Mycobacterium
YSSARGCDLAMVRRGISP

SEQ ID NO: 757302 - protein, 27 aa, Mycobacterium
YSSTIPEIPWHYDVTAPIEIPISGNVN

SEQ ID NO: 757303 - protein, 18 aa, Mycobacterium
YSSYLWRDIAPALAQHRS

SEQ ID NO: 757304 - protein, 26 aa, Mycobacterium
YSTGCEFKRPTPAWWFDDTHLHGPDG

SEQ ID NO: 757305 - protein, 17 aa, Mycobacterium
YSTGVKLPGAIGAMRKE

SEQ ID NO: 757306 - protein, 17 aa, Mycobacterium
YSTLGGWLATRSGGHFA

SEQ ID NO: 757307 - protein, 26 aa, Mycobacterium
YSTLQAGPEFARWLAERGPARMPDIA

SEQ ID NO: 757308 - protein, 25 aa, Mycobacterium
YSTLQAGPEFARWLDDRGPAAVPGT

SEQ ID NO: 757309 - protein, 25 aa, Mycobacterium
YSTLQAGPEFARWLDERGPADLPDI

SEQ ID NO: 757310 - protein, 26 aa, Mycobacterium
YSTLQSGPEFARWLQERGRVRMPDIA

SEQ ID NO: 757311 - protein, 27 aa, Mycobacterium
YSTPLLKLLLVRAAHATELPYVWGNLG

SEQ ID NO: 757312 - protein, 35 aa, Mycobacterium
YSTPLLKVLLVRAAHATELPYVWGNLGAPKDPTLK

SEQ ID NO: 757313 - protein, 25 aa, Mycobacterium
YSTVLVNFLLQRKLETFVEHNIVDV

SEQ ID NO: 757314 - protein, 18 aa, Mycobacterium
YSVAMARFVETFVRVLGD

SEQ ID NO: 757315 - protein, 23 aa, Mycobacterium
YSVARAFVDARIQTIYGGTNEIM

SEQ ID NO: 757316 - protein, 21 aa, Mycobacterium
YSVASCVKWTEPVFPTRPDRP

SEQ ID NO: 757317 - protein, 22 aa, Mycobacterium
YSVCVSPSMLPVEVPRGQTLKV

SEQ ID NO: 757318 - protein, 22 aa, Mycobacterium
YSVDLPGVIALRDRLLPTSRQA

SEQ ID NO: 757319 - protein, 22 aa, Mycobacterium
YSVDLPPVMELRNQLLPNDERI

SEQ ID NO: 757320 - protein, 18 aa, Mycobacterium
YSVFRSIEEPLRIHRVGD

SEQ ID NO: 757321 - protein, 17 aa, Mycobacterium
YSVGLGMLEKVNHSQTM

SEQ ID NO: 757322 - protein, 26 aa, Mycobacterium
YSVGRDCVQAHLAALDLVYTGIIEDI

SEQ ID NO: 757323 - protein, 21 aa, Mycobacterium
YSVKYKRAFEASAALKDYFLD

SEQ ID NO: 757324 - protein, 17 aa, Mycobacterium
YSVLAQMVGDAFAELDE

SEQ ID NO: 757325 - protein, 19 aa, Mycobacterium
YSVLGSWGCGAKLVLLPRF

SEQ ID NO: 757326 - protein, 23 aa, Mycobacterium
YSVLVAAFMAWIASRGRQRDIVI

SEQ ID NO: 757327 - protein, 36 aa, Mycobacterium
YSVPDAVAFAKRWVTECIRSAYPLGQGHGPVSALFR

SEQ ID NO: 757328 - protein, 19 aa, Mycobacterium
YSVPMARFVDTFSRVLGDP

SEQ ID NO: 757329 - protein, 19 aa, Mycobacterium
YSVPMARFVQTFVRVLGDP

SEQ ID NO: 757330 - protein, 17 aa, Mycobacterium
YSVPRIPPGAYIELGEA

SEQ ID NO: 757331 - protein, 17 aa, Mycobacterium
YSVRSRRSWGIGDLTDL

SEQ ID NO: 757332 - protein, 27 aa, Mycobacterium
YSVRYDWPVRTGIIVGRLDSDGSRFMA

SEQ ID NO: 757333 - protein, 23 aa, Mycobacterium
YSVWEIFGALLGGARLVVVPEHV

SEQ ID NO: 757334 - protein, 23 aa, Mycobacterium
YSVWEIFGALLGGGRVVVVPEHI

SEQ ID NO: 757335 - protein, 25 aa, Mycobacterium
YSWNPRYPARIGVMPRDGGSADVRW

SEQ ID NO: 757336 - protein, 22 aa, Mycobacterium
YSYAEPFWKAGYQLHAHINGDL

SEQ ID NO: 757337 - protein, 17 aa, Mycobacterium
YSYFTWRTAKWELTEFG

SEQ ID NO: 757338 - protein, 19 aa, Mycobacterium
YSYLVSLLPSRIVEDLGAG

SEQ ID NO: 757339 - protein, 24 aa, Mycobacterium
YSYSFDLNADWTRLWSSQPEILAY

SEQ ID NO: 757340 - protein, 25 aa, Mycobacterium
YSYSFDLNPDWSRLWSAQPEILAYF

SEQ ID NO: 757341 - protein, 24 aa, Mycobacterium
YSYSFDLNPGWSRLWSGQPEILAY

SEQ ID NO: 757342 - protein, 21 aa, Mycobacterium
YTAELSWLSTTWHGPSSMAMA

SEQ ID NO: 757343 - protein, 17 aa, Mycobacterium
YTAGALDASDLCTRVTP

SEQ ID NO: 757344 - protein, 22 aa, Mycobacterium
YTAGGLPLQFPESVTDDEQMIA

SEQ ID NO: 757345 - protein, 18 aa, Mycobacterium
YTAHWYGRTLHFGVREHA

SEQ ID NO: 757346 - protein, 19 aa, Mycobacterium
YTAKPGAFRRPNGQAFSSH

SEQ ID NO: 757347 - protein, 19 aa, Mycobacterium
YTAKPGAFRRPNGQAFTSH

SEQ ID NO: 757348 - protein, 17 aa, Mycobacterium
YTALAGPTWRNEIDSSI

SEQ ID NO: 757349 - protein, 19 aa, Mycobacterium
YTALFLRELNRGGIPGLLR

SEQ ID NO: 757350 - protein, 18 aa, Mycobacterium
YTALPGYEKVGLRRTLLG

SEQ ID NO: 757351 - protein, 17 aa, Mycobacterium
YTALTMGGIAARARTGK

SEQ ID NO: 757352 - protein, 26 aa, Mycobacterium
YTAPEISARVLMKLKRDAEAYLGEDI

SEQ ID NO: 757353 - protein, 17 aa, Mycobacterium
YTAPSMNEIETWSPDRV

SEQ ID NO: 757354 - protein, 25 aa, Mycobacterium
YTARTAGHPPVWTPLPVHYADYTLW

SEQ ID NO: 757355 - protein, 25 aa, Mycobacterium
YTCGVEGFPALVVHGPLLVLYMAEL

SEQ ID NO: 757356 - protein, 20 aa, Mycobacterium
YTCHFIRPGWKLPRRATAGQ

SEQ ID NO: 757357 - protein, 20 aa, Mycobacterium
YTCHYIRPGWKLPRRATAGQ

SEQ ID NO: 757358 - protein, 20 aa, Mycobacterium
YTCHYVRPGWKLPRRASANP

SEQ ID NO: 757359 - protein, 20 aa, Mycobacterium
YTCYVKFAAVSPRAQAEHVF

SEQ ID NO: 757360 - protein, 18 aa, Mycobacterium
YTDALIWTPAHLAVDVAA

SEQ ID NO: 757361 - protein, 17 aa, Mycobacterium
YTDGTGYAFEKETRTAE

SEQ ID NO: 757362 - protein, 23 aa, Mycobacterium
YTDGVLRLTVPVAEAAKPRKVAI

SEQ ID NO: 757363 - protein, 24 aa, Mycobacterium
YTDIALPANMVFIGEVGLAGDIRR

SEQ ID NO: 757364 - protein, 26 aa, Mycobacterium
YTDPQWRALAAIDWDPSFGDRHVSLV

SEQ ID NO: 757365 - protein, 24 aa, Mycobacterium
YTDRRIGWSDTWYKSTAGANPYAH

SEQ ID NO: 757366 - protein, 23 aa, Mycobacterium
YTEAASWARRFVDGPPLALAAAK

SEQ ID NO: 757367 - protein, 23 aa, Mycobacterium
YTEAGFRLTRVVPTACPYSLIEG

SEQ ID NO: 757368 - protein, 23 aa, Mycobacterium
YTEEELRILLAPMAASGAEPLGS

SEQ ID NO: 757369 - protein, 25 aa, Mycobacterium
YTEEMPIAVPWSLPDAHPVHVGEEA

SEQ ID NO: 757370 - protein, 28 aa, Mycobacterium
YTEEMPVAVPWSLPAARPVHAGDPDDPA

SEQ ID NO: 757371 - protein, 26 aa, Mycobacterium
YTEEMPVAVPWSLRDAHPVHMGADAP

SEQ ID NO: 757372 - protein, 28 aa, Mycobacterium
YTEEMPVAVPWSLSAARPVHSGADAPVL

SEQ ID NO: 757373 - protein, 18 aa, Mycobacterium
YTEFKSMLTQAAVAKRIA

SEQ ID NO: 757374 - protein, 21 aa, Mycobacterium
YTEHHYGVFHGREAVRDWIVA

SEQ ID NO: 757375 - protein, 22 aa, Mycobacterium
YTEHHYGVFHGREAVRDWIVAV

SEQ ID NO: 757376 - protein, 26 aa, Mycobacterium
YTEILPMPFLPAGVFDAWGLDDNDPR

SEQ ID NO: 757377 - protein, 18 aa, Mycobacterium
YTELKGLVRREGLHTVCE

SEQ ID NO: 757378 - protein, 18 aa, Mycobacterium
YTELKSLVRREGLHTVCE

SEQ ID NO: 757379 - protein, 18 aa, Mycobacterium
YTERIDVVLGARTRRELD

SEQ ID NO: 757380 - protein, 29 aa, Mycobacterium
YTEVLGFRSRGAFRVPLPKEFGPVRVRFL

SEQ ID NO: 757381 - protein, 19 aa, Mycobacterium
YTFECPLLLGTTAVLMDRW

SEQ ID NO: 757382 - protein, 20 aa, Mycobacterium
YTFNLCVSNVPGPREPLYFN

SEQ ID NO: 757383 - protein, 18 aa, Mycobacterium
YTGADFESVIALMADGRY

SEQ ID NO: 757384 - protein, 19 aa, Mycobacterium
YTGGLWVGKYLKTVTYQEV

SEQ ID NO: 757385 - protein, 24 aa, Mycobacterium
YTGLHWFRAALDARPADEPIIDSV

SEQ ID NO: 757386 - protein, 21 aa, Mycobacterium
YTGLHWFRAALDARPVDETII

SEQ ID NO: 757387 - protein, 22 aa, Mycobacterium
YTGLNWFRAALDARPAGEPIID

SEQ ID NO: 757388 - protein, 17 aa, Mycobacterium
YTGNMLLCEDVLVESGV

SEQ ID NO: 757389 - protein, 18 aa, Mycobacterium
YTGPASGIHRLRFDTATY

SEQ ID NO: 757390 - protein, 22 aa, Mycobacterium
YTGPYLPGYVARTSAYRKRADA

SEQ ID NO: 757391 - protein, 22 aa, Mycobacterium
YTGQIKWLFDKLLGPRPHWSER

SEQ ID NO: 757392 - protein, 18 aa, Mycobacterium
YTGTGWRDGLDEPFVGAM

SEQ ID NO: 757393 - protein, 20 aa, Mycobacterium
YTGVDRWRPLGDYWFEGVSR

SEQ ID NO: 757394 - protein, 20 aa, Mycobacterium
YTHFAELCEILARYDVTFSL

SEQ ID NO: 757395 - protein, 22 aa, Mycobacterium
YTHRPSWPDGIAVGKTAVSSSI

SEQ ID NO: 757396 - protein, 19 aa, Mycobacterium
YTHYMTWNRMHLVHAQQTV

SEQ ID NO: 757397 - protein, 19 aa, Mycobacterium
YTIANPRTDWCFTTEADPG

SEQ ID NO: 757398 - protein, 20 aa, Mycobacterium
YTICRPESLPAPIHSADALV

SEQ ID NO: 757399 - protein, 24 aa, Mycobacterium
YTIKRLPHELIRFMKTGTGRRKVM

SEQ ID NO: 757400 - protein, 29 aa, Mycobacterium
YTILAASLAYQFGLEWGAEESRDFRFAVI

SEQ ID NO: 757401 - protein, 29 aa, Mycobacterium
YTILAASLAYQFGLEWGAQRSRDFRFAVI

SEQ ID NO: 757402 - protein, 23 aa, Mycobacterium
YTITTRLPAVFANVVAQGDGDRI

SEQ ID NO: 757403 - protein, 25 aa, Mycobacterium
YTKCAELDLPLCVNTGLPGPPIPGE

SEQ ID NO: 757404 - protein, 23 aa, Mycobacterium
YTKGRDGGFLWAPMRDKAGRPQY

SEQ ID NO: 757405 - protein, 27 aa, Mycobacterium
YTKGYKFSTYATWWIRQAITRAMADQA

SEQ ID NO: 757406 - protein, 18 aa, Mycobacterium
YTKKLWQAIVGQNISGND

SEQ ID NO: 757407 - protein, 17 aa, Mycobacterium
YTKRMQRALNFEGTDVP

SEQ ID NO: 757408 - protein, 23 aa, Mycobacterium
YTKVRNCMYVNGFLGTIMVAPLI

SEQ ID NO: 757409 - protein, 21 aa, Mycobacterium
YTLARRRGFRAARSAVLAGDR

SEQ ID NO: 757410 - protein, 20 aa, Mycobacterium
YTLDAAKSVARRDISAKADL

SEQ ID NO: 757411 - protein, 19 aa, Mycobacterium
YTLGPDGKKAFFDKNGTQI

SEQ ID NO: 757412 - protein, 18 aa, Mycobacterium
YTLKEARVPSGTIPAGKP

SEQ ID NO: 757413 - protein, 27 aa, Mycobacterium
YTLKEPFGVVGLIFPWNGPIFNASAKL

SEQ ID NO: 757414 - protein, 27 aa, Mycobacterium
YTLKEPYSVVGLIFPWNGPIFNASAKL

SEQ ID NO: 757415 - protein, 18 aa, Mycobacterium
YTLPRIVGAGVAFDMILT

SEQ ID NO: 757416 - protein, 17 aa, Mycobacterium
YTLRFKDLHTGELYDDT

SEQ ID NO: 757417 - protein, 26 aa, Mycobacterium
YTLRFKDLRTGELYPDEIADIGAGAT

SEQ ID NO: 757418 - protein, 20 aa, Mycobacterium
YTLRFKDLRTGELYRDEIAD

SEQ ID NO: 757419 - protein, 22 aa, Mycobacterium
YTLRFKDLRTGKRYDDEITGIG

SEQ ID NO: 757420 - protein, 21 aa, Mycobacterium
YTLRFKDLRTGQRYPDEIADI

SEQ ID NO: 757421 - protein, 21 aa, Mycobacterium
YTLRLPLDVLVVASANPEDYT

SEQ ID NO: 757422 - protein, 19 aa, Mycobacterium
YTLTRFPFLAVNDDTFVLL

SEQ ID NO: 757423 - protein, 18 aa, Mycobacterium
YTLWAPRWRDSGDEWEAF

SEQ ID NO: 757424 - protein, 24 aa, Mycobacterium
YTNFCNLFDLCAVSVPAGTAGDAQ

SEQ ID NO: 757425 - protein, 20 aa, Mycobacterium
YTNFEELCDIFARYDVTFSL

SEQ ID NO: 757426 - protein, 31 aa, Mycobacterium
YTNFEELCDILARYDVTFSLGDGLRPGSIAD

SEQ ID NO: 757427 - protein, 21 aa, Mycobacterium
YTNQQLYDWMVGQLATVYFRA

SEQ ID NO: 757428 - protein, 21 aa, Mycobacterium
YTNVMAVWTILRAMDALDLLP

SEQ ID NO: 757429 - protein, 21 aa, Mycobacterium
YTNYTPVPLYGYRAKDVTQDY

SEQ ID NO: 757430 - protein, 23 aa, Mycobacterium
YTPARSAVGFGLERLPGQRRTTS

SEQ ID NO: 757431 - protein, 17 aa, Mycobacterium
YTPAVLFISTADQGADQ

SEQ ID NO: 757432 - protein, 17 aa, Mycobacterium
YTPLAWLGSSTHRLRLG

SEQ ID NO: 757433 - protein, 17 aa, Mycobacterium
YTPLAWWGSATRRVRLG

SEQ ID NO: 757434 - protein, 17 aa, Mycobacterium
YTPLAWWGSDTSRIRLG

SEQ ID NO: 757435 - protein, 22 aa, Mycobacterium
YTPLVECGRVPAMVTLTYPGEW

SEQ ID NO: 757436 - protein, 24 aa, Mycobacterium
YTPRLARRSAPPSGTPLHLRGDAT

SEQ ID NO: 757437 - protein, 23 aa, Mycobacterium
YTPRMRVGIHTGRPHRLAADWLG

SEQ ID NO: 757438 - protein, 21 aa, Mycobacterium
YTPRMRVGIHTGRPQRLASDW

SEQ ID NO: 757439 - protein, 20 aa, Mycobacterium
YTQARWWSDRGWQYRLSAGL

SEQ ID NO: 757440 - protein, 18 aa, Mycobacterium
YTQLKGLVRREGLHTVCE

SEQ ID NO: 757441 - protein, 25 aa, Mycobacterium
YTQLRFPKNRGMRIDFILGSPTLAE

SEQ ID NO: 757442 - protein, 19 aa, Mycobacterium
YTQTLTLWNGVPRVDCRTT

SEQ ID NO: 757443 - protein, 18 aa, Mycobacterium
YTQTLTLWRGVARVDCRT

SEQ ID NO: 757444 - protein, 27 aa, Mycobacterium
YTQVMKWMQRWPIRSYAARKWFTTADA

SEQ ID NO: 757445 - protein, 17 aa, Mycobacterium
YTRAGFHPDDWDSTEVL

SEQ ID NO: 757446 - protein, 24 aa, Mycobacterium
YTRAKAGNIGVCIGTSGPAGTDMI

SEQ ID NO: 757447 - protein, 25 aa, Mycobacterium
YTRAKYAPYVERLLLDGARTKLTRA

SEQ ID NO: 757448 - protein, 25 aa, Mycobacterium
YTRARICASSGFGVVSIQGDTLADY

SEQ ID NO: 757449 - protein, 23 aa, Mycobacterium
YTRESGHRLVLFATDAHGQMAAV

SEQ ID NO: 757450 - protein, 25 aa, Mycobacterium
YTRLAGRPGGWVSLTALRAELDAPR

SEQ ID NO: 757451 - protein, 20 aa, Mycobacterium
YTRREPFGVTGHIIAWNYPM

SEQ ID NO: 757452 - protein, 24 aa, Mycobacterium
YTRTLDILERFYGLVLTDCGTGLL

SEQ ID NO: 757453 - protein, 24 aa, Mycobacterium
YTRVLDVLERFYGLVLTDCGPGLL

SEQ ID NO: 757454 - protein, 19 aa, Mycobacterium
YTRYGSARSLYHFHVDNAS

SEQ ID NO: 757455 - protein, 26 aa, Mycobacterium
YTSADIRALYAFKRLAWWPYSVAMRQ

SEQ ID NO: 757456 - protein, 26 aa, Mycobacterium
YTSAIAMKSGWTWRTPLLGRFGSGYV

SEQ ID NO: 757457 - protein, 18 aa, Mycobacterium
YTSALAVIEAAMELPELG

SEQ ID NO: 757458 - protein, 21 aa, Mycobacterium
YTSANVGWWYAMNASNDVIVT

SEQ ID NO: 757459 - protein, 23 aa, Mycobacterium
YTSEWKIRELVKQYSDFIAWPVR

SEQ ID NO: 757460 - protein, 34 aa, Mycobacterium
YTSEWKIRGLVKKYSDFIAWPIRMEVERRQPPTE

SEQ ID NO: 757461 - protein, 17 aa, Mycobacterium
YTSLLNRTVVVLNDSDG

SEQ ID NO: 757462 - protein, 21 aa, Mycobacterium
YTSRMPLGVVGILSSFNHPLM

SEQ ID NO: 757463 - protein, 21 aa, Mycobacterium
YTSTLPPEWADLDVDPADLVV

SEQ ID NO: 757464 - protein, 26 aa, Mycobacterium
YTSVDIRALYLFKRTLWWPYSVAMRV

SEQ ID NO: 757465 - protein, 17 aa, Mycobacterium
YTTGFAGADGHRDMAPR

SEQ ID NO: 757466 - protein, 20 aa, Mycobacterium
YTTLEVVRIVALLVQPVMPE

SEQ ID NO: 757467 - protein, 26 aa, Mycobacterium
YTTLEVVTSPSWRRGLATLGKTLKHR

SEQ ID NO: 757468 - protein, 18 aa, Mycobacterium
YTTMLKKYGVTVLLNKKV

SEQ ID NO: 757469 - protein, 19 aa, Mycobacterium
YTTPFRWAEDMKIGDATVL

SEQ ID NO: 757470 - protein, 24 aa, Mycobacterium
YTTRPGSWIFFPAWNTTTGDLPPT

SEQ ID NO: 757471 - protein, 29 aa, Mycobacterium
YTTSWCGYCFRLKTALKTEGITYTEVDIE

SEQ ID NO: 757472 - protein, 23 aa, Mycobacterium
YTTSWCGYCHRLMSVLKSNGIPY

SEQ ID NO: 757473 - protein, 17 aa, Mycobacterium
YTVACDLLLTGRHITAA

SEQ ID NO: 757474 - protein, 25 aa, Mycobacterium
YTVASAAAWKLTPFASPQPDTNPAG

SEQ ID NO: 757475 - protein, 25 aa, Mycobacterium
YTVDVMSHWLARGADGWRLDAAYAV

SEQ ID NO: 757476 - protein, 21 aa, Mycobacterium
YTVKDLRTWHGTVLAAAAFAD

SEQ ID NO: 757477 - protein, 20 aa, Mycobacterium
YTVKGIKLAINYGLNKVRFP

SEQ ID NO: 757478 - protein, 24 aa, Mycobacterium
YTVPPRWLFLRIETDEGLVGWGEP

SEQ ID NO: 757479 - protein, 27 aa, Mycobacterium
YTVRYDWPVRTGLIIGRLDDDGSRFLA

SEQ ID NO: 757480 - protein, 27 aa, Mycobacterium
YTVRYDWPVRTGLIVGRLDGDGSRFLA

SEQ ID NO: 757481 - protein, 37 aa, Mycobacterium
YTVSLTHCMPVSLGLEGAGLGTMWGRQLAESMLAEAG

SEQ ID NO: 757482 - protein, 25 aa, Mycobacterium
YTVVFRRLHDGIAFGHTMVHLPPAV

SEQ ID NO: 757483 - protein, 17 aa, Mycobacterium
YTYCQGVVLGLETELAA

SEQ ID NO: 757484 - protein, 17 aa, Mycobacterium
YTYCQGVVLGLETELAV

SEQ ID NO: 757485 - protein, 18 aa, Mycobacterium
YTYCQGVVLGLEVELAVR

SEQ ID NO: 757486 - protein, 17 aa, Mycobacterium
YTYREYRAELAATTAES

SEQ ID NO: 757487 - protein, 18 aa, Mycobacterium
YTYRQCQIQDPKSVDALA

SEQ ID NO: 757488 - protein, 24 aa, Mycobacterium
YTYVHGPEAWEIASMLEAQHVLFD

SEQ ID NO: 757489 - protein, 19 aa, Mycobacterium
YVAAAAYEAAFAMTVPPPV

SEQ ID NO: 757490 - protein, 17 aa, Mycobacterium
YVAAGFRVVALLNEPSA

SEQ ID NO: 757491 - protein, 18 aa, Mycobacterium
YVAAHLPYLAWLQQASAD

SEQ ID NO: 757492 - protein, 25 aa, Mycobacterium
YVAAHVPYLMWLMRASATSAQAAAQ

SEQ ID NO: 757493 - protein, 17 aa, Mycobacterium
YVAAPVMPTGKVIGFLH

SEQ ID NO: 757494 - protein, 24 aa, Mycobacterium
YVAARTKWFDDFFLAASAAGLAQI

SEQ ID NO: 757495 - protein, 30 aa, Mycobacterium
YVADRFPVMPLPSWLSNPMDPISIRDVLHY

SEQ ID NO: 757496 - protein, 18 aa, Mycobacterium
YVAECLAVARAEGARLPD

SEQ ID NO: 757497 - protein, 17 aa, Mycobacterium
YVAGAGVACGYWRRAGL

SEQ ID NO: 757498 - protein, 25 aa, Mycobacterium
YVAGLRRSPAWEVLRPLAQPMGEEL

SEQ ID NO: 757499 - protein, 24 aa, Mycobacterium
YVAKLHNLGFTWPWSSDADKTGWV

SEQ ID NO: 757500 - protein, 27 aa, Mycobacterium
YVALRRWLLLRLARRYGKVFSVNLPLY

SEQ ID NO: 757501 - protein, 23 aa, Mycobacterium
YVASCGADFGAVIDVVDTRTRKI

SEQ ID NO: 757502 - protein, 21 aa, Mycobacterium
YVASCGADFGAVVDVVDSRAR

SEQ ID NO: 757503 - protein, 18 aa, Mycobacterium
YVATALKLLERKVVQTPP

SEQ ID NO: 757504 - protein, 23 aa, Mycobacterium
YVCAIVGSLVLGKPVKWMEDRSE

SEQ ID NO: 757505 - protein, 21 aa, Mycobacterium
YVCFRRQGFQKTTIVDIARLA

SEQ ID NO: 757506 - protein, 18 aa, Mycobacterium
YVCPLPVEVSAVPKALKI

SEQ ID NO: 757507 - protein, 18 aa, Mycobacterium
YVDALMPMVWTACEREDF

SEQ ID NO: 757508 - protein, 17 aa, Mycobacterium
YVDAMAPTTGWAGSEDE

SEQ ID NO: 757509 - protein, 25 aa, Mycobacterium
YVDDPELFTGFIAWTAEVLDARGVP

SEQ ID NO: 757510 - protein, 17 aa, Mycobacterium
YVDGELYLTGRIKDLIV

SEQ ID NO: 757511 - protein, 22 aa, Mycobacterium
YVDGEPALDIWAGAAAAGQGWT

SEQ ID NO: 757512 - protein, 32 aa, Mycobacterium
YVDGEPVLDIWAGEARPGMPWTHDTAPIVYSA

SEQ ID NO: 757513 - protein, 26 aa, Mycobacterium
YVDGKRTGLWPGLRDTFKSGTSAPPL

SEQ ID NO: 757514 - protein, 26 aa, Mycobacterium
YVDGKRTRLWPGLQETFKSGSAEIPL

SEQ ID NO: 757515 - protein, 25 aa, Mycobacterium
YVDGKRVGLWPGLADTFGSGKVDIP

SEQ ID NO: 757516 - protein, 25 aa, Mycobacterium
YVDGKRVGLWPGLADTFGSGSGAVD

SEQ ID NO: 757517 - protein, 17 aa, Mycobacterium
YVDGVSVVDVWTGWSDR

SEQ ID NO: 757518 - protein, 22 aa, Mycobacterium
YVDLRADMLSNLIKAGFSLEKG

SEQ ID NO: 757519 - protein, 18 aa, Mycobacterium
YVDLSTVGSRVAVQIHDR

SEQ ID NO: 757520 - protein, 25 aa, Mycobacterium
YVDLVCSWGPLILGHAHPAVVEAVQ

SEQ ID NO: 757521 - protein, 18 aa, Mycobacterium
YVDPLRAGEFHFTREWFQ

SEQ ID NO: 757522 - protein, 25 aa, Mycobacterium
YVDVPGYYPFWAITKHADVMAIERD

SEQ ID NO: 757523 - protein, 18 aa, Mycobacterium
YVEAEFDAAGIPFPSPAQ

SEQ ID NO: 757524 - protein, 18 aa, Mycobacterium
YVEAPVYDEFVAKVTEKV

SEQ ID NO: 757525 - protein, 24 aa, Mycobacterium
YVECPLHSSKFCLKTGAVDGLPAT

SEQ ID NO: 757526 - protein, 17 aa, Mycobacterium
YVEFNSLVDRAYWDDEE

SEQ ID NO: 757527 - protein, 26 aa, Mycobacterium
YVEKGPEVWRIRISKLTTTPLPRVLA

SEQ ID NO: 757528 - protein, 21 aa, Mycobacterium
YVELVCTAMLDACAPAAKWVD

SEQ ID NO: 757529 - protein, 21 aa, Mycobacterium
YVEPYRAELHRLGRPVFGHTF

SEQ ID NO: 757530 - protein, 17 aa, Mycobacterium
YVERCSGLRNLKTRARR

SEQ ID NO: 757531 - protein, 23 aa, Mycobacterium
YVERPGWERYASPAPEDFGKYQT

SEQ ID NO: 757532 - protein, 21 aa, Mycobacterium
YVERYMKLLAPKWQMMSDPAL

SEQ ID NO: 757533 - protein, 22 aa, Mycobacterium
YVERYMKLLAPKWQMMSDPQLT

SEQ ID NO: 757534 - protein, 19 aa, Mycobacterium
YVERYMKLLAPNWQMMSDP

SEQ ID NO: 757535 - protein, 20 aa, Mycobacterium
YVESLGWLGDDVWFAHGVHL

SEQ ID NO: 757536 - protein, 20 aa, Mycobacterium
YVESLGWLGSDVWMAHCVHL

SEQ ID NO: 757537 - protein, 26 aa, Mycobacterium
YVEVLPTPFLPAGVFDLWGLTADDPR

SEQ ID NO: 757538 - protein, 22 aa, Mycobacterium
YVEWAIKLGHPGTVVVVDNVTR

SEQ ID NO: 757539 - protein, 22 aa, Mycobacterium
YVEWAVRLARPGAVVVVDNVIR

SEQ ID NO: 757540 - protein, 29 aa, Mycobacterium
YVFGAELFPRMRIPQAWYDAGIAVRADNL

SEQ ID NO: 757541 - protein, 17 aa, Mycobacterium
YVFLAGRTKDLIIRGGH

SEQ ID NO: 757542 - protein, 18 aa, Mycobacterium
YVGADWPVEFGGRDDRSA

SEQ ID NO: 757543 - protein, 20 aa, Mycobacterium
YVGALGPRLTRAVAQHADGL

SEQ ID NO: 757544 - protein, 19 aa, Mycobacterium
YVGALPGRIVRAIGEAGSM

SEQ ID NO: 757545 - protein, 18 aa, Mycobacterium
YVGALPGRIVRAISEAGS

SEQ ID NO: 757546 - protein, 24 aa, Mycobacterium
YVGDRFPLMPIPSWMDNPIDPISI

SEQ ID NO: 757547 - protein, 25 aa, Mycobacterium
YVGDWAAKLERVWSKEQPDVVHAYG

SEQ ID NO: 757548 - protein, 20 aa, Mycobacterium
YVGEAWIHVQLLPSVDGKGL

SEQ ID NO: 757549 - protein, 26 aa, Mycobacterium
YVGFDIPNDFVVGYGLDYDERYRDLS

SEQ ID NO: 757550 - protein, 18 aa, Mycobacterium
YVGGTCVNTGCIPTKTLV

SEQ ID NO: 757551 - protein, 25 aa, Mycobacterium
YVGGVRMPIRWVVKMAAMSGNPDLN

SEQ ID NO: 757552 - protein, 18 aa, Mycobacterium
YVGIPILRLHDTIYRKTN

SEQ ID NO: 757553 - protein, 18 aa, Mycobacterium
YVGIVYRRLFLSLHDIGE

SEQ ID NO: 757554 - protein, 24 aa, Mycobacterium
YVGLKTHCKTCLVVRREGSAIRRY

SEQ ID NO: 757555 - protein, 24 aa, Mycobacterium
YVGLLRLWYSVKISRDPAGNPLTA

SEQ ID NO: 757556 - protein, 24 aa, Mycobacterium
YVGQKRFSLEGAETVIPMMDAAID

SEQ ID NO: 757557 - protein, 17 aa, Mycobacterium
YVGRGLIDAGVDVRTGA

SEQ ID NO: 757558 - protein, 22 aa, Mycobacterium
YVGRPGMTAARFVADPLRPGQR

SEQ ID NO: 757559 - protein, 17 aa, Mycobacterium
YVGSLMILRRPRAGLSY

SEQ ID NO: 757560 - protein, 17 aa, Mycobacterium
YVGSQARDGGVIVRVDP

SEQ ID NO: 757561 - protein, 18 aa, Mycobacterium
YVGTTAKSRDGWDSLGDL

SEQ ID NO: 757562 - protein, 20 aa, Mycobacterium
YVGVSGRFGLRGGPVLIGRT

SEQ ID NO: 757563 - protein, 19 aa, Mycobacterium
YVHDMRSWDSLSVTEQERV

SEQ ID NO: 757564 - protein, 20 aa, Mycobacterium
YVHNRLLTLLLFDIGSFAGL

SEQ ID NO: 757565 - protein, 24 aa, Mycobacterium
YVHNRLLTLLLFDVGSFAGLAPLL

SEQ ID NO: 757566 - protein, 33 aa, Mycobacterium
YVHTEFHARAGLEMPKVPSFMWLEVDDVVSQSL

SEQ ID NO: 757567 - protein, 24 aa, Mycobacterium
YVIASGFGKNSQWFRNIVANPRVR

SEQ ID NO: 757568 - protein, 19 aa, Mycobacterium
YVIEPAAGLTRSFMAFLID

SEQ ID NO: 757569 - protein, 18 aa, Mycobacterium
YVIKEVALDEGVRATFMP

SEQ ID NO: 757570 - protein, 18 aa, Mycobacterium
YVIKEVALEEGVRATFMP

SEQ ID NO: 757571 - protein, 19 aa, Mycobacterium
YVILCLPTPIGEDGAADLS

SEQ ID NO: 757572 - protein, 19 aa, Mycobacterium
YVINARMVRGLDYYTKTTF

SEQ ID NO: 757573 - protein, 19 aa, Mycobacterium
YVIRGVIGPDEFHSGYPGR

SEQ ID NO: 757574 - protein, 18 aa, Mycobacterium
YVKLDGAVGIIGNGAGLV

SEQ ID NO: 757575 - protein, 23 aa, Mycobacterium
YVKRQALTAARFVACPFGEPGTR

SEQ ID NO: 757576 - protein, 18 aa, Mycobacterium
YVKSELQYLLADAGATAL

SEQ ID NO: 757577 - protein, 18 aa, Mycobacterium
YVKSELQYLLADSGATAL

SEQ ID NO: 757578 - protein, 21 aa, Mycobacterium
YVKTRQVWKVPIGSHQGLSHP

SEQ ID NO: 757579 - protein, 23 aa, Mycobacterium
YVLACGKTLVIENGRLVGGTAAA

SEQ ID NO: 757580 - protein, 26 aa, Mycobacterium
YVLAHPCPMCLGSLYYCSPDEVIFLT

SEQ ID NO: 757581 - protein, 26 aa, Mycobacterium
YVLAHPCPMCLGSLYYCSPDEVVFLT

SEQ ID NO: 757582 - protein, 27 aa, Mycobacterium
YVLAHPCPMCLGSLYYCSPREVVFLTT

SEQ ID NO: 757583 - protein, 21 aa, Mycobacterium
YVLCQPLDVFAVVGCKTVEKF

SEQ ID NO: 757584 - protein, 17 aa, Mycobacterium
YVLGHSDYELGRLGRQA

SEQ ID NO: 757585 - protein, 20 aa, Mycobacterium
YVLGLARHIIRPELRGGAGF

SEQ ID NO: 757586 - protein, 20 aa, Mycobacterium
YVLGLARQVIRPEFRGGAGF

SEQ ID NO: 757587 - protein, 17 aa, Mycobacterium
YVLGMPVEDIPLYIETA

SEQ ID NO: 757588 - protein, 17 aa, Mycobacterium
YVLHARRYLAEGGPIHP

SEQ ID NO: 757589 - protein, 18 aa, Mycobacterium
YVLKRWLSSGGLLATKIP

SEQ ID NO: 757590 - protein, 18 aa, Mycobacterium
YVLKRWLSSGGVLATKIP

SEQ ID NO: 757591 - protein, 19 aa, Mycobacterium
YVLLPALSLRRWRRTLLAN

SEQ ID NO: 757592 - protein, 19 aa, Mycobacterium
YVLPTPLTLTVPFVVPLVG

SEQ ID NO: 757593 - protein, 22 aa, Mycobacterium
YVLSGRMRLILGDRDFTIDPGQ

SEQ ID NO: 757594 - protein, 17 aa, Mycobacterium
YVLTLVAPVVGRLAPGL

SEQ ID NO: 757595 - protein, 25 aa, Mycobacterium
YVLWSRLRVAITLVQGGDDLTGAAH

SEQ ID NO: 757596 - protein, 22 aa, Mycobacterium
YVNGKSWLMFGPFAGWSPKFLK

SEQ ID NO: 757597 - protein, 21 aa, Mycobacterium
YVNNWKRLGFNDEDLTSPGSD

SEQ ID NO: 757598 - protein, 20 aa, Mycobacterium
YVNNWKRLGFTEEDLERPGS

SEQ ID NO: 757599 - protein, 18 aa, Mycobacterium
YVNQPWTIRQYAGFSTAA

SEQ ID NO: 757600 - protein, 18 aa, Mycobacterium
YVNRPAMTAARFVADPFR

SEQ ID NO: 757601 - protein, 23 aa, Mycobacterium
YVPDLPPLRHAMTAGARVIGLTM

SEQ ID NO: 757602 - protein, 18 aa, Mycobacterium
YVPEITWPSATCTLTGLP

SEQ ID NO: 757603 - protein, 18 aa, Mycobacterium
YVPFPVLAQAVLRMLGDV

SEQ ID NO: 757604 - protein, 18 aa, Mycobacterium
YVPGMCDYAVLVDKQAKV

SEQ ID NO: 757605 - protein, 18 aa, Mycobacterium
YVPGYRLLNEPQFDDPSI

SEQ ID NO: 757606 - protein, 25 aa, Mycobacterium
YVPKQLFMPDGRVVPVCKVQVDPAP

SEQ ID NO: 757607 - protein, 27 aa, Mycobacterium
YVPLLLRAYELWAGLAADSGRDVYRMT

SEQ ID NO: 757608 - protein, 31 aa, Mycobacterium
YVPMLFAAGLPRLLRAVPVLGGRLRELLDPS

SEQ ID NO: 757609 - protein, 19 aa, Mycobacterium
YVPMLSMYAAMKATLMSFT

SEQ ID NO: 757610 - protein, 19 aa, Mycobacterium
YVPSAKLADFVRCRDMTCR

SEQ ID NO: 757611 - protein, 27 aa, Mycobacterium
YVPSLACGRCRAIARCRHCTGPLSLPE

SEQ ID NO: 757612 - protein, 23 aa, Mycobacterium
YVPSRPHLEWQLRKRVHDLDNVT

SEQ ID NO: 757613 - protein, 22 aa, Mycobacterium
YVPSRPHLEWQLRKRVRDTDNV

SEQ ID NO: 757614 - protein, 17 aa, Mycobacterium
YVPSRPHLEWQLRRRVL

SEQ ID NO: 757615 - protein, 18 aa, Mycobacterium
YVPVPVDLGDDWPRALTA

SEQ ID NO: 757616 - protein, 17 aa, Mycobacterium
YVPWSESTGKRWLGSFI

SEQ ID NO: 757617 - protein, 20 aa, Mycobacterium
YVQRMAKLLSGHLWESAGSP

SEQ ID NO: 757618 - protein, 18 aa, Mycobacterium
YVQSRVAAENLVMRYVSE

SEQ ID NO: 757619 - protein, 17 aa, Mycobacterium
YVRAGRWAREGRFPYAR

SEQ ID NO: 757620 - protein, 19 aa, Mycobacterium
YVRDPRIGGLVDDPVPTGG

SEQ ID NO: 757621 - protein, 20 aa, Mycobacterium
YVRELLSYLPPNNFTDPPRY

SEQ ID NO: 757622 - protein, 23 aa, Mycobacterium
YVRGEGSGVIVIKRLEDAIRDGD

SEQ ID NO: 757623 - protein, 17 aa, Mycobacterium
YVRKGSLWPATFGLACC

SEQ ID NO: 757624 - protein, 19 aa, Mycobacterium
YVRLLRFLPGDALMQRGYL

SEQ ID NO: 757625 - protein, 17 aa, Mycobacterium
YVRPELGGEILFGNSDL

SEQ ID NO: 757626 - protein, 18 aa, Mycobacterium
YVRPELGGEILFGNSDLG

SEQ ID NO: 757627 - protein, 21 aa, Mycobacterium
YVRPQFRRRGLARRLLATLAA

SEQ ID NO: 757628 - protein, 28 aa, Mycobacterium
YVRPVAPGVYSWLPLGLRVLRKIENIVR

SEQ ID NO: 757629 - protein, 21 aa, Mycobacterium
YVRRAPLVDGIDEFDADFFGF

SEQ ID NO: 757630 - protein, 18 aa, Mycobacterium
YVRRLDMVWEEFRVGAEY

SEQ ID NO: 757631 - protein, 24 aa, Mycobacterium
YVRRSGLTASRFVACPFGAPGARM

SEQ ID NO: 757632 - protein, 28 aa, Mycobacterium
YVRTADGWRLKTRAMTFIRRSGVHDSGR

SEQ ID NO: 757633 - protein, 33 aa, Mycobacterium
YVRTEFHARAGIDMSKSPSFMWLEVDDVVSQSL

SEQ ID NO: 757634 - protein, 19 aa, Mycobacterium
YVRTGDFLYDNGLREGSAL

SEQ ID NO: 757635 - protein, 18 aa, Mycobacterium
YVRVSAELPRTVTFKVLK

SEQ ID NO: 757636 - protein, 18 aa, Mycobacterium
YVSDADALHAEWSALENL

SEQ ID NO: 757637 - protein, 19 aa, Mycobacterium
YVSDGRFILGLGASGPQVI

SEQ ID NO: 757638 - protein, 21 aa, Mycobacterium
YVSDGRFRLGIGTSGPQVVEG

SEQ ID NO: 757639 - protein, 27 aa, Mycobacterium
YVSELPRPGSYCTKTVLGRSVLLTRTS

SEQ ID NO: 757640 - protein, 21 aa, Mycobacterium
YVSFCPASTSATWPLIRSTGK

SEQ ID NO: 757641 - protein, 18 aa, Mycobacterium
YVSMNMVRKNGLRRGDAV

SEQ ID NO: 757642 - protein, 25 aa, Mycobacterium
YVSPAVVGPAIWAAMADINAVALGA

SEQ ID NO: 757643 - protein, 24 aa, Mycobacterium
YVSPEGALALFGGWTGVDLAELGP

SEQ ID NO: 757644 - protein, 25 aa, Mycobacterium
YVSVNYRLGVLGAMELSSLSTPEHP

SEQ ID NO: 757645 - protein, 19 aa, Mycobacterium
YVTCEAVRIAALLVQPVMP

SEQ ID NO: 757646 - protein, 21 aa, Mycobacterium
YVTDAGPLLARLHKLVRADCT

SEQ ID NO: 757647 - protein, 17 aa, Mycobacterium
YVTFFFRKYDVGETRGE

SEQ ID NO: 757648 - protein, 29 aa, Mycobacterium
YVTGVGRGQGWRSLPAWPPVTTERALYLR

SEQ ID NO: 757649 - protein, 17 aa, Mycobacterium
YVTVPLLTHATKQILDQ

SEQ ID NO: 757650 - protein, 17 aa, Mycobacterium
YVVAGWRADTFVAGTPE

SEQ ID NO: 757651 - protein, 24 aa, Mycobacterium
YVVEKRFNLSWSIEGTRSRTGKML

SEQ ID NO: 757652 - protein, 25 aa, Mycobacterium
YVVEKRFNLSWSIEGTRSRTGKMLP

SEQ ID NO: 757653 - protein, 17 aa, Mycobacterium
YVVGGTFTGTVTGAGST

SEQ ID NO: 757654 - protein, 19 aa, Mycobacterium
YVVGPLLWQAGLLAPVEGG

SEQ ID NO: 757655 - protein, 28 aa, Mycobacterium
YVVGRKALAYYTFRHWDITESWTGFSEQ

SEQ ID NO: 757656 - protein, 28 aa, Mycobacterium
YVVGRKALAYYTFRNWDIAQSWTGFSEQ

SEQ ID NO: 757657 - protein, 25 aa, Mycobacterium
YVVGRKALGYFSFRQRTVVESWTGF

SEQ ID NO: 757658 - protein, 24 aa, Mycobacterium
YVVNRWKSILFQSVQYQLSRRFPR

SEQ ID NO: 757659 - protein, 20 aa, Mycobacterium
YVVPMVSFLDARKIPVSAEW

SEQ ID NO: 757660 - protein, 17 aa, Mycobacterium
YVVRLILTGAKETSQET

SEQ ID NO: 757661 - protein, 19 aa, Mycobacterium
YVVSGWRADTFVAGTPEAR

SEQ ID NO: 757662 - protein, 24 aa, Mycobacterium
YVVVDECHYYRGIFGSNVAMVLRR

SEQ ID NO: 757663 - protein, 25 aa, Mycobacterium
YVWGASGPEAFDCSGLVQWSYARAG

SEQ ID NO: 757664 - protein, 20 aa, Mycobacterium
YVYYPDCADVSIGAAAEIRG

SEQ ID NO: 757665 - protein, 18 aa, Mycobacterium
YWAAPGLVTSLRKANLIE

SEQ ID NO: 757666 - protein, 17 aa, Mycobacterium
YWARNHVGWRHMDDTAP

SEQ ID NO: 757667 - protein, 22 aa, Mycobacterium
YWDARELFRAAGVTFPEAKLVS

SEQ ID NO: 757668 - protein, 19 aa, Mycobacterium
YWDLPAMMLQFLRGGAQVA

SEQ ID NO: 757669 - protein, 18 aa, Mycobacterium
YWDLPAMMLQFLRSGAPA

SEQ ID NO: 757670 - protein, 20 aa, Mycobacterium
YWEIDEIRPAFIHANVPQVP

SEQ ID NO: 757671 - protein, 23 aa, Mycobacterium
YWELPAMMRQFLRTGSRALAPGL

SEQ ID NO: 757672 - protein, 17 aa, Mycobacterium
YWELVIGQFPEWDQVFN

SEQ ID NO: 757673 - protein, 19 aa, Mycobacterium
YWERVWLNRWRKSGYQAFD

SEQ ID NO: 757674 - protein, 17 aa, Mycobacterium
YWFEPNPYWSRLYAPGS

SEQ ID NO: 757675 - protein, 17 aa, Mycobacterium
YWFEPNPYWSRLYAPGT

SEQ ID NO: 757676 - protein, 19 aa, Mycobacterium
YWFGEGVLPILERKRLWHR

SEQ ID NO: 757677 - protein, 27 aa, Mycobacterium
YWFGEGVLPILERMGLWRHPNRQSHPA

SEQ ID NO: 757678 - protein, 27 aa, Mycobacterium
YWFGEGVLPLLERRGLWARPNGQSPPA

SEQ ID NO: 757679 - protein, 17 aa, Mycobacterium
YWGIIKADIGIRDGRIV

SEQ ID NO: 757680 - protein, 17 aa, Mycobacterium
YWGIIKADIGIRDGRVV

SEQ ID NO: 757681 - protein, 19 aa, Mycobacterium
YWGNVNPIGPRSVYDESKR

SEQ ID NO: 757682 - protein, 19 aa, Mycobacterium
YWGVGCVDPDVYRTAAEAG

SEQ ID NO: 757683 - protein, 23 aa, Mycobacterium
YWHRSGLTASRFVACPFGGTAGS

SEQ ID NO: 757684 - protein, 17 aa, Mycobacterium
YWHSDFETWHAEDGMPA

SEQ ID NO: 757685 - protein, 19 aa, Mycobacterium
YWITDLLARVDMSVIRVSK

SEQ ID NO: 757686 - protein, 19 aa, Mycobacterium
YWKLVELDQRFGIADRIEK

SEQ ID NO: 757687 - protein, 19 aa, Mycobacterium
YWLSQQGRLTHPMVLHEGD

SEQ ID NO: 757688 - protein, 19 aa, Mycobacterium
YWLSQQGRLTHPMVLRPGD

SEQ ID NO: 757689 - protein, 20 aa, Mycobacterium
YWNHYQLTFALYSVSDRAIP

SEQ ID NO: 757690 - protein, 24 aa, Mycobacterium
YWNIFKQNIGIMIAVAQLAATQRR

SEQ ID NO: 757691 - protein, 24 aa, Mycobacterium
YWNIFKQNIGIMIAVDQLAATQQR

SEQ ID NO: 757692 - protein, 24 aa, Mycobacterium
YWNMFKQNIGIMIAVAQLAATQQR

SEQ ID NO: 757693 - protein, 25 aa, Mycobacterium
YWPAENGVVMKTRWEGHTKDGVRMG

SEQ ID NO: 757694 - protein, 21 aa, Mycobacterium
YWPKLDAMYPDFANYRSYTDR

SEQ ID NO: 757695 - protein, 26 aa, Mycobacterium
YWQEWEDPRLIVAILHNNDLNQVTWE

SEQ ID NO: 757696 - protein, 22 aa, Mycobacterium
YWQGWDMHPGHLVTRWLATYGF

SEQ ID NO: 757697 - protein, 21 aa, Mycobacterium
YWRDAHTGLAHAIHVPSTVFH

SEQ ID NO: 757698 - protein, 20 aa, Mycobacterium
YWREAFRLPSMDHAELGRKL

SEQ ID NO: 757699 - protein, 22 aa, Mycobacterium
YWREAFRLPSMNLRKVAAQIDS

SEQ ID NO: 757700 - protein, 17 aa, Mycobacterium
YWRGARLAGNYPLSIAL

SEQ ID NO: 757701 - protein, 27 aa, Mycobacterium
YWRHCNEGPPSFVLGRRVVYRRAAVLE

SEQ ID NO: 757702 - protein, 18 aa, Mycobacterium
YWRRHARQPVEFAKSVHT

SEQ ID NO: 757703 - protein, 21 aa, Mycobacterium
YWRRQLFRDGLGWRYVGVLHE

SEQ ID NO: 757704 - protein, 18 aa, Mycobacterium
YWSAGDVDDVAWSYADPP

SEQ ID NO: 757705 - protein, 24 aa, Mycobacterium
YWSDRVYRLLRACVRDRDIAPPDR

SEQ ID NO: 757706 - protein, 28 aa, Mycobacterium
YWSPYSRRRFPLPEVFWSRLFGVRLVKR

SEQ ID NO: 757707 - protein, 20 aa, Mycobacterium
YWSVPFLAMMHRVAADADES

SEQ ID NO: 757708 - protein, 24 aa, Mycobacterium
YWTMFKQNIGIMIAVAQLAATQPR

SEQ ID NO: 757709 - protein, 17 aa, Mycobacterium
YWWQNTRATVLFEPAMR

SEQ ID NO: 757710 - protein, 17 aa, Mycobacterium
YWYFKLYGHEKVKLLDG

SEQ ID NO: 757711 - protein, 20 aa, Mycobacterium
YWYRNIRQTVQFDQAVRSAS

SEQ ID NO: 757712 - protein, 18 aa, Mycobacterium
YYAARTVLRREFGIREMP

SEQ ID NO: 757713 - protein, 24 aa, Mycobacterium
YYADFEGVMAFLQRRMEQTDSEQM

SEQ ID NO: 757714 - protein, 24 aa, Mycobacterium
YYADFEGVMAFLQRRMEQTDSEQT

SEQ ID NO: 757715 - protein, 27 aa, Mycobacterium
YYAMTPSGFEWELGWNPIVVDENTWEP

SEQ ID NO: 757716 - protein, 19 aa, Mycobacterium
YYAPLRLIRGVAPQMVARG

SEQ ID NO: 757717 - protein, 19 aa, Mycobacterium
YYASKSLILYDIYKGAADF

SEQ ID NO: 757718 - protein, 27 aa, Mycobacterium
YYAVTPSGFEWELGWNPIVVDESTWEP

SEQ ID NO: 757719 - protein, 23 aa, Mycobacterium
YYDETKESLAWRIRRFDSGMAWA

SEQ ID NO: 757720 - protein, 19 aa, Mycobacterium
YYDGSACHLDLVALATRDK

SEQ ID NO: 757721 - protein, 17 aa, Mycobacterium
YYDWPTQCELWFGDHPT

SEQ ID NO: 757722 - protein, 19 aa, Mycobacterium
YYEKWLGGISQFFVDKGYL

SEQ ID NO: 757723 - protein, 20 aa, Mycobacterium
YYERFGFVVTREIVLPDGGP

SEQ ID NO: 757724 - protein, 17 aa, Mycobacterium
YYEYLPGWWAPQVPGPH

SEQ ID NO: 757725 - protein, 18 aa, Mycobacterium
YYFRDFWGADSGMLAALY

SEQ ID NO: 757726 - protein, 22 aa, Mycobacterium
YYFRGDVPMDEFIASQPRPVGV

SEQ ID NO: 757727 - protein, 22 aa, Mycobacterium
YYGDMALRCGYVEGVAVTEEHR

SEQ ID NO: 757728 - protein, 21 aa, Mycobacterium
YYGQMWPRNAAAGAAYGAALR

SEQ ID NO: 757729 - protein, 23 aa, Mycobacterium
YYIGYKFQKGLALADDATRQELK

SEQ ID NO: 757730 - protein, 18 aa, Mycobacterium
YYKRAEITANVFDEDGYY

SEQ ID NO: 757731 - protein, 20 aa, Mycobacterium
YYLASLLSCQVVTYRFWAER

SEQ ID NO: 757732 - protein, 26 aa, Mycobacterium
YYLVLAKWKLAIVLEQGFQRAGDDEK

SEQ ID NO: 757733 - protein, 27 aa, Mycobacterium
YYMIPSPHLPLLDPVRAIPVIGTPIAD

SEQ ID NO: 757734 - protein, 25 aa, Mycobacterium
YYNHGFLRQRMQVLQDEFAKHGEEG

SEQ ID NO: 757735 - protein, 21 aa, Mycobacterium
YYNRLRCGAGDYIDFSRFDAL

SEQ ID NO: 757736 - protein, 18 aa, Mycobacterium
YYNRLRCGTGDYIDFSWF

SEQ ID NO: 757737 - protein, 19 aa, Mycobacterium
YYNRLRCGTGEYIDFSRFD

SEQ ID NO: 757738 - protein, 19 aa, Mycobacterium
YYPAALFEVIPQVNAEVRD

SEQ ID NO: 757739 - protein, 17 aa, Mycobacterium
YYPELPGGSALGSTINV

SEQ ID NO: 757740 - protein, 18 aa, Mycobacterium
YYPQGWQMACHVHGDAGV

SEQ ID NO: 757741 - protein, 26 aa, Mycobacterium
YYPTGGRWNNWAEFFHSDSINNLAYG

SEQ ID NO: 757742 - protein, 17 aa, Mycobacterium
YYQACRAAADWMTGKHD

SEQ ID NO: 757743 - protein, 19 aa, Mycobacterium
YYQRIGVSFELPNHYQKLT

SEQ ID NO: 757744 - protein, 22 aa, Mycobacterium
YYRALAQWRAAALLQAELGRQR

SEQ ID NO: 757745 - protein, 22 aa, Mycobacterium
YYRLRGASIYDVPEGGVPVYIA

SEQ ID NO: 757746 - protein, 20 aa, Mycobacterium
YYRPELDGLPEMGLVGQQLW

SEQ ID NO: 757747 - protein, 17 aa, Mycobacterium
YYRPELDGLPEMGLVGR

SEQ ID NO: 757748 - protein, 20 aa, Mycobacterium
YYRPGFHPSQLGGLERAVDY

SEQ ID NO: 757749 - protein, 17 aa, Mycobacterium
YYRRLYRDIPSGQVPLA

SEQ ID NO: 757750 - protein, 19 aa, Mycobacterium
YYRRRAAGGVGLIITEGVF

SEQ ID NO: 757751 - protein, 23 aa, Mycobacterium
YYRRWAKTWEFQALLKARPAAGD

SEQ ID NO: 757752 - protein, 23 aa, Mycobacterium
YYRRWAKTWEFQALLKARPAVGD

SEQ ID NO: 757753 - protein, 19 aa, Mycobacterium
YYSATLFDPRERPLCDARY

SEQ ID NO: 757754 - protein, 18 aa, Mycobacterium
YYSFGGLTIDPCALQPHM

SEQ ID NO: 757755 - protein, 24 aa, Mycobacterium
YYSLKPRRLRVWHPGYGTVLTGPG

SEQ ID NO: 757756 - protein, 19 aa, Mycobacterium
YYSPLRLIRGFAPGMRERG

SEQ ID NO: 757757 - protein, 23 aa, Mycobacterium
YYSQGRRAVSMVPVKRFDDQLNA

SEQ ID NO: 757758 - protein, 18 aa, Mycobacterium
YYSSIKDLTRLLGGPTHR

SEQ ID NO: 757759 - protein, 18 aa, Mycobacterium
YYSTIKDLSRLVGGSSER

SEQ ID NO: 757760 - protein, 18 aa, Mycobacterium
YYTSEHEWVLRTGDDTVR

SEQ ID NO: 757761 - protein, 17 aa, Mycobacterium
YYVLEKFAYIVMDSSTY

SEQ ID NO: 757762 - protein, 18 aa, Mycobacterium
YYWAFGGWLRKRRNIRDM

SEQ ID NO: 757763 - protein, 21 aa, Mycobacterium
YYWPKLVELYADFDKYQSYTT

SEQ ID NO: 757764 - protein, 18 aa, Mycobacterium
LDELIGFFVNTLVLRTHT

SEQ ID NO: 757765 - protein, 22 aa, Mycobacterium
LKKRAADVLAYFDRPGTSNGPT

SEQ ID NO: 757766 - protein, 17 aa, Mycobacterium
QRPQEWRDRVDVVAMDG

SEQ ID NO: 757767 - protein, 17 aa, Mycobacterium
RSKKAFADWLAQRPQEW

SEQ ID NO: 757768 - protein, 28 aa, Mycobacterium
GERPPRVPLSFAQSRLWFLEQLQGPSAV

SEQ ID NO: 757769 - protein, 18 aa, Mycobacterium
VVDARGWTPQHLHTAIDE

SEQ ID NO: 757770 - protein, 21 aa, Mycobacterium
HHPPTRIAFMLTDTTPTAIIT

SEQ ID NO: 757771 - protein, 17 aa, Mycobacterium
WRWATSIATAWQTIRTA

SEQ ID NO: 757772 - protein, 22 aa, Mycobacterium
DKALEGFTMFALNQGEVCTCPS

SEQ ID NO: 757773 - protein, 23 aa, Mycobacterium
QRGEPVSCFLLRIEDNMESIGRS

SEQ ID NO: 757774 - protein, 24 aa, Mycobacterium
AEATSLVNLCTWPAGTRLVLRKER

SEQ ID NO: 757775 - protein, 19 aa, Mycobacterium
AKTTFGRIGVKVWIYKGDI

SEQ ID NO: 757776 - protein, 25 aa, Mycobacterium
CGKYKRVRFKGIICERCGVEVTRAK

SEQ ID NO: 757777 - protein, 20 aa, Mycobacterium
DGLCSAYRILGFDSAAEGDN

SEQ ID NO: 757778 - protein, 18 aa, Mycobacterium
GTTQRFGVPMGFGGPHAG

SEQ ID NO: 757779 - protein, 23 aa, Mycobacterium
LFFKEKRYDLARVGRYKVNKKLG

SEQ ID NO: 757780 - protein, 17 aa, Mycobacterium
LGVLPGMGGSQRLTRAI

SEQ ID NO: 757781 - protein, 18 aa, Mycobacterium
PELRPMVQLDGGRFATSD

SEQ ID NO: 757782 - protein, 26 aa, Mycobacterium
QCGLPKLMALELFKPFVMKRLVDLNH

SEQ ID NO: 757783 - protein, 18 aa, Mycobacterium
QEDFIGIHFFSPVDKMPL

SEQ ID NO: 757784 - protein, 18 aa, Mycobacterium
RIGVKVWIYKGDIVGGKR

SEQ ID NO: 757785 - protein, 20 aa, Mycobacterium
RRGGLSATRFVACPFGAAGS

SEQ ID NO: 757786 - protein, 18 aa, Mycobacterium
VVRLRFGLTDGQPRTLDE

SEQ ID NO: 757787 - protein, 18 aa, Mycobacterium
AEEMLYLAMEDFRVDVVV

SEQ ID NO: 757788 - protein, 19 aa, Mycobacterium
AEPKWVLAMGVCASSGGMF

SEQ ID NO: 757789 - protein, 18 aa, Mycobacterium
AETGIIYIDEVDKIARKS

SEQ ID NO: 757790 - protein, 17 aa, Mycobacterium
ASFLRRDGSVWTTDKDG

SEQ ID NO: 757791 - protein, 20 aa, Mycobacterium
CMDCGIPFCHNGCPLGNLIP

SEQ ID NO: 757792 - protein, 20 aa, Mycobacterium
ELRIAQAQLVGWLEGLFHGI

SEQ ID NO: 757793 - protein, 17 aa, Mycobacterium
FGTSRWSSKLVHGGLRY

SEQ ID NO: 757794 - protein, 23 aa, Mycobacterium
GAKMVTAVACARVPKLTVVIGGS

SEQ ID NO: 757795 - protein, 25 aa, Mycobacterium
GHIELAAPVTHIWYFKGVPSRLGYL

SEQ ID NO: 757796 - protein, 17 aa, Mycobacterium
GPTRDWECYCGKYKRVR

SEQ ID NO: 757797 - protein, 21 aa, Mycobacterium
HHPPTRIAFMLTDTTPTAVLT

SEQ ID NO: 757798 - protein, 20 aa, Mycobacterium
KIDKGEFVFLIGPSGSGKST

SEQ ID NO: 757799 - protein, 18 aa, Mycobacterium
LYIALGISGAIQHRAGMQ

SEQ ID NO: 757800 - protein, 20 aa, Mycobacterium
PEFRAAVVLCDIEGLSYEEI

SEQ ID NO: 757801 - protein, 22 aa, Mycobacterium
PETSVALGFGFRCGFLGLLHME

SEQ ID NO: 757802 - protein, 25 aa, Mycobacterium
PIAKELPMEYALELNRLIELQMEGA

SEQ ID NO: 757803 - protein, 23 aa, Mycobacterium
QARTIRIPVHMVEVINKLGRIQR

SEQ ID NO: 757804 - protein, 17 aa, Mycobacterium
RALELGCGTGFFLLNLI

SEQ ID NO: 757805 - protein, 20 aa, Mycobacterium
RAQLLELVWGYDFAADTNVV

SEQ ID NO: 757806 - protein, 23 aa, Mycobacterium
RAYFRGECLRRFGADIAAASWDS

SEQ ID NO: 757807 - protein, 18 aa, Mycobacterium
RGVGFSFGFPVDARVWDA

SEQ ID NO: 757808 - protein, 20 aa, Mycobacterium
RPKHYWSIYQKMIVKGRDFD

SEQ ID NO: 757809 - protein, 18 aa, Mycobacterium
RTLAVAVYNHYKRIQAGE

SEQ ID NO: 757810 - protein, 23 aa, Mycobacterium
SGEQRLSGFLLWQSAYSEMWFTE

SEQ ID NO: 757811 - protein, 19 aa, Mycobacterium
SRMAIAMARAGGMGVLHRN

SEQ ID NO: 757812 - protein, 22 aa, Mycobacterium
AEAYRAISLLLRRPPGREAYPG

SEQ ID NO: 757813 - protein, 18 aa, Mycobacterium
AGAVVALLLPRSDHAILT

SEQ ID NO: 757814 - protein, 23 aa, Mycobacterium
AGPGQRVALVFGRCAQAVTAILA

SEQ ID NO: 757815 - protein, 20 aa, Mycobacterium
APARAYNPLFIWGESGLGKT

SEQ ID NO: 757816 - protein, 19 aa, Mycobacterium
DFIEACAWIKENLPGVHIS

SEQ ID NO: 757817 - protein, 17 aa, Mycobacterium
DGGNGFAGGTGGDGGTG

SEQ ID NO: 757818 - protein, 19 aa, Mycobacterium
DLLKCSFCGKSQKQVKKLI

SEQ ID NO: 757819 - protein, 20 aa, Mycobacterium
ELGQPLPLFIKWDDAEYGLR

SEQ ID NO: 757820 - protein, 18 aa, Mycobacterium
FAQSRLWFLEQLQGPSAV

SEQ ID NO: 757821 - protein, 20 aa, Mycobacterium
GKFLNNWRMAELHAKEAPDR

SEQ ID NO: 757822 - protein, 19 aa, Mycobacterium
GLEFPVVFVTGWEDGMFPH

SEQ ID NO: 757823 - protein, 18 aa, Mycobacterium
GVRDVVLCPGSRNAPLAF

SEQ ID NO: 757824 - protein, 23 aa, Mycobacterium
INEPRFPSFKGIMAAKKKEVTVL

SEQ ID NO: 757825 - protein, 18 aa, Mycobacterium
IRAGAGLVLAGLVADGDT

SEQ ID NO: 757826 - protein, 23 aa, Mycobacterium
KDPKRPSGSFIFAGPSGVGKTEL

SEQ ID NO: 757827 - protein, 25 aa, Mycobacterium
KKFRFPTFLGAFKYYTSYTLKTFDG

SEQ ID NO: 757828 - protein, 21 aa, Mycobacterium
LKKRAADVLAYFDRPGTSNGP

SEQ ID NO: 757829 - protein, 18 aa, Mycobacterium
LLESFLFYSGFYLPMYWS

SEQ ID NO: 757830 - protein, 18 aa, Mycobacterium
LLGLECVIYMGAVDTARQ

SEQ ID NO: 757831 - protein, 23 aa, Mycobacterium
LRALKRLKVVAAFQQSGNSPMGM

SEQ ID NO: 757832 - protein, 23 aa, Mycobacterium
LRLRDIGGIVVIDFIDMVLESNR

SEQ ID NO: 757833 - protein, 19 aa, Mycobacterium
LVVSLAKRYTGRGMAFLDL

SEQ ID NO: 757834 - protein, 18 aa, Mycobacterium
MRGGKFLNNWRMAELHAK

SEQ ID NO: 757835 - protein, 21 aa, Mycobacterium
PLPQTRFVLRKALAAHLPVIL

SEQ ID NO: 757836 - protein, 19 aa, Mycobacterium
PRARLSRRALRWALEALVC

SEQ ID NO: 757837 - protein, 17 aa, Mycobacterium
PRFSDVSSRIFGTPHDV

SEQ ID NO: 757838 - protein, 18 aa, Mycobacterium
RAHRGIVAVNELPDLAER

SEQ ID NO: 757839 - protein, 19 aa, Mycobacterium
RFLWMWPNARISVMGGEQA

SEQ ID NO: 757840 - protein, 18 aa, Mycobacterium
RGPMLHRALQQFLADVYW

SEQ ID NO: 757841 - protein, 19 aa, Mycobacterium
SNVQVVWEKFCRYFDVEPR

SEQ ID NO: 757842 - protein, 17 aa, Mycobacterium
TLKAVAVKAPFFGDRRK

SEQ ID NO: 757843 - protein, 23 aa, Mycobacterium
VERMHRACLILTFGGGTNEVQRD

SEQ ID NO: 757844 - protein, 18 aa, Mycobacterium
WNPKMKRFIFTDRNGIYI

SEQ ID NO: 757845 - protein, 18 aa, Mycobacterium
WPPVRRIDGAYGDRNLVC

SEQ ID NO: 757846 - protein, 18 aa, Mycobacterium
AAILASIAFHTRVTADDV

SEQ ID NO: 757847 - protein, 18 aa, Mycobacterium
ACPFGAPGSRMYRTGDLV

SEQ ID NO: 757848 - protein, 19 aa, Mycobacterium
ADEIVRWATPVTSFQRTAL

SEQ ID NO: 757849 - protein, 17 aa, Mycobacterium
AEYSLRGANLWDEVKDR

SEQ ID NO: 757850 - protein, 18 aa, Mycobacterium
AGGFGVLGAVGFTPEQLE

SEQ ID NO: 757851 - protein, 20 aa, Mycobacterium
AIQWPDGRMQFMLNERMMPA

SEQ ID NO: 757852 - protein, 17 aa, Mycobacterium
ALAGFGLTEPGAGSDAG

SEQ ID NO: 757853 - protein, 24 aa, Mycobacterium
AMSKFEVLTAMAFAAFADAPVDVA

SEQ ID NO: 757854 - protein, 19 aa, Mycobacterium
ANLRLVVSLAKRYTGRGMA

SEQ ID NO: 757855 - protein, 19 aa, Mycobacterium
ARPSPFYIMDEVEAALDDT

SEQ ID NO: 757856 - protein, 23 aa, Mycobacterium
ARYLFRRVVSWGRSSNVFLRNGA

SEQ ID NO: 757857 - protein, 20 aa, Mycobacterium
ASPPVKWPCFYGIDFPSPAE

SEQ ID NO: 757858 - protein, 18 aa, Mycobacterium
AVVPLSFTQSGLWFLEQV

SEQ ID NO: 757859 - protein, 17 aa, Mycobacterium
DHRGGRVGIDWSVGLQQ

SEQ ID NO: 757860 - protein, 21 aa, Mycobacterium
DIAEVLALLGVRPVWDDASRR

SEQ ID NO: 757861 - protein, 26 aa, Mycobacterium
DKFAPRLSFFWGIGMNFFMEVAKLRA

SEQ ID NO: 757862 - protein, 19 aa, Mycobacterium
DKPFLMPVEDVFTITGRGT

SEQ ID NO: 757863 - protein, 20 aa, Mycobacterium
DRPIADVCPVEWARMENRSV

SEQ ID NO: 757864 - protein, 19 aa, Mycobacterium
EEPPEHLIFIFATTEPEKV

SEQ ID NO: 757865 - protein, 19 aa, Mycobacterium
EICDGWLPIFYTPRMADTY

SEQ ID NO: 757866 - protein, 19 aa, Mycobacterium
ELKGKLDGYALRVPIPTGS

SEQ ID NO: 757867 - protein, 19 aa, Mycobacterium
ELMPLPIALAHRLSRRLTE

SEQ ID NO: 757868 - protein, 18 aa, Mycobacterium
ELRIGLATAEDIRQWSYG

SEQ ID NO: 757869 - protein, 19 aa, Mycobacterium
EPEAFKWIQRAAMDRRTTM

SEQ ID NO: 757870 - protein, 23 aa, Mycobacterium
ERPARLPLSYAQTRLWFLHKYEG

SEQ ID NO: 757871 - protein, 28 aa, Mycobacterium
ESFFRGAGWNVIKVVWGREWDALLHADR

SEQ ID NO: 757872 - protein, 17 aa, Mycobacterium
FNLSWSIEGTRSRTGKM

SEQ ID NO: 757873 - protein, 21 aa, Mycobacterium
FQRPNPFPAMSIRDNVVAGLK

SEQ ID NO: 757874 - protein, 17 aa, Mycobacterium
FRFVEEMIRLGADARTD

SEQ ID NO: 757875 - protein, 19 aa, Mycobacterium
FSLLPAWRGAAPVQAAIAA

SEQ ID NO: 757876 - protein, 18 aa, Mycobacterium
FSTYATWWIRQAITRAMA

SEQ ID NO: 757877 - protein, 19 aa, Mycobacterium
FVACPFGAAGSRMYRTGDL

SEQ ID NO: 757878 - protein, 17 aa, Mycobacterium
GDPRFSDVSSRIFGTPH

SEQ ID NO: 757879 - protein, 21 aa, Mycobacterium
GKPGAGVCPVRGHSNVQGDRT

SEQ ID NO: 757880 - protein, 17 aa, Mycobacterium
GRPVLVGGLGGRGVVAG

SEQ ID NO: 757881 - protein, 18 aa, Mycobacterium
GSMSLSFSDPRFDEVKAP

SEQ ID NO: 757882 - protein, 18 aa, Mycobacterium
GTNLKAWLYRILTNTYIN

SEQ ID NO: 757883 - protein, 22 aa, Mycobacterium
HAAKGLEWDAVFLVGLADGTLP

SEQ ID NO: 757884 - protein, 20 aa, Mycobacterium
HPHARIAFMLTDTTPTAVLT

SEQ ID NO: 757885 - protein, 18 aa, Mycobacterium
HPHLDELIGFFVNTLVLR

SEQ ID NO: 757886 - protein, 19 aa, Mycobacterium
IAEGCVRAGCALLGGETAE

SEQ ID NO: 757887 - protein, 18 aa, Mycobacterium
ITAVMPFYPYARQDKKHR

SEQ ID NO: 757888 - protein, 23 aa, Mycobacterium
IVKGLRTGTDFEYELQMAQMNKH

SEQ ID NO: 757889 - protein, 23 aa, Mycobacterium
IVSRGGSIMAAWCLAHHRESFLY

SEQ ID NO: 757890 - protein, 21 aa, Mycobacterium
KEGPAALPWGDLGVDVVVEST

SEQ ID NO: 757891 - protein, 17 aa, Mycobacterium
KIVGWKVATEMTQKLVT

SEQ ID NO: 757892 - protein, 22 aa, Mycobacterium
LHSVKVIPSRGAWLEFDVDKRD

SEQ ID NO: 757893 - protein, 18 aa, Mycobacterium
LMDLCTGVAFPAFPALLA

SEQ ID NO: 757894 - protein, 18 aa, Mycobacterium
LRPWVPVVSLVKGLEQGT

SEQ ID NO: 757895 - protein, 20 aa, Mycobacterium
LRYTMPLGEIIFDFFDSLKS

SEQ ID NO: 757896 - protein, 17 aa, Mycobacterium
LTAQDVFNNVARTCIEA

SEQ ID NO: 757897 - protein, 20 aa, Mycobacterium
MKPDVCWQLPIRRSQEWVTR

SEQ ID NO: 757898 - protein, 18 aa, Mycobacterium
NHAAGWVRMDFIVPSRGL

SEQ ID NO: 757899 - protein, 20 aa, Mycobacterium
PDYLGWDWKSKAGIPIVCVP

SEQ ID NO: 757900 - protein, 18 aa, Mycobacterium
PENPRFLMCTPLSHAGAA

SEQ ID NO: 757901 - protein, 25 aa, Mycobacterium
PGVLARVAALFSRRGFNIESLAVGA

SEQ ID NO: 757902 - protein, 21 aa, Mycobacterium
PNKNIRLVIEWLDRYAEALPL

SEQ ID NO: 757903 - protein, 19 aa, Mycobacterium
PSQIAQAGGQGGTGGTGGA

SEQ ID NO: 757904 - protein, 19 aa, Mycobacterium
QADKYDVPRICFVNKMDKI

SEQ ID NO: 757905 - protein, 21 aa, Mycobacterium
QGGPCARTVLDTALLHQVIAG

SEQ ID NO: 757906 - protein, 17 aa, Mycobacterium
QVLKEIQSRLGFLLDVG

SEQ ID NO: 757907 - protein, 18 aa, Mycobacterium
RAYRLDWPAGTTVYEIDQ

SEQ ID NO: 757908 - protein, 19 aa, Mycobacterium
RAYSPRFLWMWPNARISVM

SEQ ID NO: 757909 - protein, 20 aa, Mycobacterium
RFIRDTTWVSVRWYQPGGPL

SEQ ID NO: 757910 - protein, 19 aa, Mycobacterium
RFVACPFGPAGSRMYRSGD

SEQ ID NO: 757911 - protein, 20 aa, Mycobacterium
RGDIKVALFGNHAPKTVANF

SEQ ID NO: 757912 - protein, 20 aa, Mycobacterium
RLRELLKFEFLFSARAQFEK

SEQ ID NO: 757913 - protein, 18 aa, Mycobacterium
RPRRAGVSSFGFTGTNAH

SEQ ID NO: 757914 - protein, 17 aa, Mycobacterium
RRAKLYYLRELRGKKAK

SEQ ID NO: 757915 - protein, 21 aa, Mycobacterium
RRPDLPSGKGLVIAEGVLVVQ

SEQ ID NO: 757916 - protein, 17 aa, Mycobacterium
RRRGMAVIISDFLGPIN

SEQ ID NO: 757917 - protein, 17 aa, Mycobacterium
RVVKAHVPLSEMFGYVG

SEQ ID NO: 757918 - protein, 22 aa, Mycobacterium
RWRKRKWLCPSTVCTRKVFTES

SEQ ID NO: 757919 - protein, 18 aa, Mycobacterium
RYDLAVQEIFVFTPKGDV

SEQ ID NO: 757920 - protein, 17 aa, Mycobacterium
SDIRAGAGLVLAGLVAD

SEQ ID NO: 757921 - protein, 21 aa, Mycobacterium
SDLELYLFFSLLFSAGAETTR

SEQ ID NO: 757922 - protein, 18 aa, Mycobacterium
SGGLACFGEAIPAQAIAQ

SEQ ID NO: 757923 - protein, 18 aa, Mycobacterium
SRLWRLLLAPGRGIGRLV

SEQ ID NO: 757924 - protein, 23 aa, Mycobacterium
STLLLTLLFRFMRPLIENGHVFL

SEQ ID NO: 757925 - protein, 19 aa, Mycobacterium
TARLKCPFTSLGVAPEAAS

SEQ ID NO: 757926 - protein, 20 aa, Mycobacterium
TFDLRWKAACGLPITAGAFH

SEQ ID NO: 757927 - protein, 18 aa, Mycobacterium
TMGAEGSSGDGGTGGLGG

SEQ ID NO: 757928 - protein, 17 aa, Mycobacterium
TRTRFSFEMGIAQLGGH

SEQ ID NO: 757929 - protein, 20 aa, Mycobacterium
TVLACFKLGIVIEGTLARAC

SEQ ID NO: 757930 - protein, 17 aa, Mycobacterium
VDLSVRVLFEWPTVAGL

SEQ ID NO: 757931 - protein, 24 aa, Mycobacterium
VGGICIGCTMPGFPDKFMPFMDEP

SEQ ID NO: 757932 - protein, 25 aa, Mycobacterium
VGYWRRGGLSAARFVACPFGAAGSR

SEQ ID NO: 757933 - protein, 23 aa, Mycobacterium
VRPEPFGALLYHFGTRKLSFLKN

SEQ ID NO: 757934 - protein, 19 aa, Mycobacterium
VRVLFEWPTVAGLASCVGG

SEQ ID NO: 757935 - protein, 18 aa, Mycobacterium
WATWCGPCKMVAPVLEEI

SEQ ID NO: 757936 - protein, 18 aa, Mycobacterium
WGPRMWWWAQTMGIRKFQ

SEQ ID NO: 757937 - protein, 23 aa, Mycobacterium
WHERETYDFFGIIFDGHPSLTRI

SEQ ID NO: 757938 - protein, 19 aa, Mycobacterium
WKAACGLPITAGAFHSTTL

SEQ ID NO: 757939 - protein, 22 aa, Mycobacterium
WKDGEALFLRCNIWREAAENVA

SEQ ID NO: 757940 - protein, 19 aa, Mycobacterium
YANRFGYNVVRDFTGHGIG

SEQ ID NO: 757941 - protein, 18 aa, Mycobacterium
YHTFGGWKRSGFGDLNQH

SEQ ID NO: 757942 - protein, 18 aa, Mycobacterium
YWGGVCLNVGCIPSKALL

SEQ ID NO: 757943 - protein, 18 aa, Mycobacterium
ACIKAAADRVVFINTGFL

SEQ ID NO: 757944 - protein, 23 aa, Mycobacterium
ADTHARVGLLPTWGLSVRLPQKV

SEQ ID NO: 757945 - protein, 17 aa, Mycobacterium
AEIPLLVVITEGIPVQD

SEQ ID NO: 757946 - protein, 21 aa, Mycobacterium
AEIYVPFSWFEPMWLENLGFA

SEQ ID NO: 757947 - protein, 17 aa, Mycobacterium
AFEAGWIQPTWPREHGG

SEQ ID NO: 757948 - protein, 19 aa, Mycobacterium
AGPALACGNAFVLKPSERD

SEQ ID NO: 757949 - protein, 17 aa, Mycobacterium
AIHAVFLFHAIKAGLDM

SEQ ID NO: 757950 - protein, 20 aa, Mycobacterium
ALRPHFEWRGLGFISQSALR

SEQ ID NO: 757951 - protein, 21 aa, Mycobacterium
AMELGCDAVLLATAVTRAADP

SEQ ID NO: 757952 - protein, 19 aa, Mycobacterium
ANALRSWSVLRFEVTEDPS

SEQ ID NO: 757953 - protein, 17 aa, Mycobacterium
AQILAGFCDVALVIGAD

SEQ ID NO: 757954 - protein, 19 aa, Mycobacterium
ARGGLRWSDRREDFRTEIL

SEQ ID NO: 757955 - protein, 17 aa, Mycobacterium
ARLKVGIISAGRVGTAL

SEQ ID NO: 757956 - protein, 22 aa, Mycobacterium
ATLLTARCPVLFAPAMHTEMWL

SEQ ID NO: 757957 - protein, 18 aa, Mycobacterium
ATPELVAFMVRYTSGYLC

SEQ ID NO: 757958 - protein, 19 aa, Mycobacterium
AWPRFGLELPELLPDKLTG

SEQ ID NO: 757959 - protein, 18 aa, Mycobacterium
CARLRFILTAQRDHYLPL

SEQ ID NO: 757960 - protein, 21 aa, Mycobacterium
DELLGFCLLLLIAGHETTSNL

SEQ ID NO: 757961 - protein, 23 aa, Mycobacterium
DFVKLAEALGCVGLRCEREEDVA

SEQ ID NO: 757962 - protein, 19 aa, Mycobacterium
DGAPAWLRFFGCNPRHHSL

SEQ ID NO: 757963 - protein, 23 aa, Mycobacterium
DGYPRPGKTVLFLGRYDEPRKGM

SEQ ID NO: 757964 - protein, 21 aa, Mycobacterium
DLKICLSEGGIGWVAGLLDRL

SEQ ID NO: 757965 - protein, 18 aa, Mycobacterium
DMHPSMRLRIEHYLQHRD

SEQ ID NO: 757966 - protein, 22 aa, Mycobacterium
DQDRCRGWRMCVSGCPYKKVYF

SEQ ID NO: 757967 - protein, 18 aa, Mycobacterium
DRYLPIWIGQSEAAAIAL

SEQ ID NO: 757968 - protein, 19 aa, Mycobacterium
DSAGFKWLAPYTGSAIAQH

SEQ ID NO: 757969 - protein, 19 aa, Mycobacterium
EAVWWGKRVLGLPIHDNWW

SEQ ID NO: 757970 - protein, 18 aa, Mycobacterium
EDRLRTRFEWGLITDVQP

SEQ ID NO: 757971 - protein, 17 aa, Mycobacterium
EEFRMAVYYADVEGFPY

SEQ ID NO: 757972 - protein, 21 aa, Mycobacterium
EKEAWLSMVMLEWGSCGQVAT

SEQ ID NO: 757973 - protein, 19 aa, Mycobacterium
ELYEIRTLFGVMFQDGALF

SEQ ID NO: 757974 - protein, 22 aa, Mycobacterium
ELYPVLCGSAFKNKGVQPMLDA

SEQ ID NO: 757975 - protein, 23 aa, Mycobacterium
EMGWRGACKRRRVRTTIADPAAT

SEQ ID NO: 757976 - protein, 23 aa, Mycobacterium
EPLPRSLVWSAAWEMTREAELRA

SEQ ID NO: 757977 - protein, 17 aa, Mycobacterium
EPQRAGVWLARRPGLAR

SEQ ID NO: 757978 - protein, 21 aa, Mycobacterium
EQKRRWAVPILRAEMTASLGM

SEQ ID NO: 757979 - protein, 17 aa, Mycobacterium
ERAEVYASLGLRLDYDP

SEQ ID NO: 757980 - protein, 17 aa, Mycobacterium
FAFTHCRDVVVAVSKAG

SEQ ID NO: 757981 - protein, 18 aa, Mycobacterium
FDGLRLAGRPVRRPDLTI

SEQ ID NO: 757982 - protein, 18 aa, Mycobacterium
FDGRIITVPFSFKEIDDD

SEQ ID NO: 757983 - protein, 18 aa, Mycobacterium
FFVCSTHDWILFFTTQGR

SEQ ID NO: 757984 - protein, 21 aa, Mycobacterium
FLFYSGFYLPMYWSSRAKLTN

SEQ ID NO: 757985 - protein, 18 aa, Mycobacterium
FLHKELYREYALRPPKGV

SEQ ID NO: 757986 - protein, 17 aa, Mycobacterium
FPRLMVYRGPRRKGVRY

SEQ ID NO: 757987 - protein, 18 aa, Mycobacterium
FQHRRYWLDPAPRADVSA

SEQ ID NO: 757988 - protein, 17 aa, Mycobacterium
FTLAVGVGYLKREFAAL

SEQ ID NO: 757989 - protein, 18 aa, Mycobacterium
GAFPAWLAPVQVVGIPVA

SEQ ID NO: 757990 - protein, 18 aa, Mycobacterium
GAHFECWTMLGAWAEQTS

SEQ ID NO: 757991 - protein, 18 aa, Mycobacterium
GAVLAEWGADVVKVEHAV

SEQ ID NO: 757992 - protein, 19 aa, Mycobacterium
GAVSFRFGDRTQINGVPRD

SEQ ID NO: 757993 - protein, 20 aa, Mycobacterium
GCGMACPFCATGQGGLTRNL

SEQ ID NO: 757994 - protein, 17 aa, Mycobacterium
GCGTGFFLLNLIQSGVA

SEQ ID NO: 757995 - protein, 20 aa, Mycobacterium
GDARGGAALSVREVTGVPIL

SEQ ID NO: 757996 - protein, 21 aa, Mycobacterium
GDLRTGMMGVWIGAIQNMYPE

SEQ ID NO: 757997 - protein, 17 aa, Mycobacterium
GEIYFEGGYSFEYLNDP

SEQ ID NO: 757998 - protein, 17 aa, Mycobacterium
GEPFPYPVTVGYMYILK

SEQ ID NO: 757999 - protein, 18 aa, Mycobacterium
GIQLYVKRVFIMGDCDQL

SEQ ID NO: 758000 - protein, 20 aa, Mycobacterium
GKRVLGLPIHDNWWQTETGG

SEQ ID NO: 758001 - protein, 19 aa, Mycobacterium
GRLTLPAKFRDALAGGLMV

SEQ ID NO: 758002 - protein, 21 aa, Mycobacterium
GVACYPARFQLVLAANPCPCA

SEQ ID NO: 758003 - protein, 17 aa, Mycobacterium
GVDEVWAVGGAQAVALL

SEQ ID NO: 758004 - protein, 17 aa, Mycobacterium
GVSYGFLSSAIMEYLDW

SEQ ID NO: 758005 - protein, 17 aa, Mycobacterium
HAFNLWLDEDWGFDRPD

SEQ ID NO: 758006 - protein, 19 aa, Mycobacterium
HGLQLHGAMGFTWENDLQF

SEQ ID NO: 758007 - protein, 17 aa, Mycobacterium
HKKGSALVPSWVAFAVT

SEQ ID NO: 758008 - protein, 23 aa, Mycobacterium
IARFKRLDGFDVRFLTGTDEHGL

SEQ ID NO: 758009 - protein, 21 aa, Mycobacterium
IDAEIPLLVVITEGIPVQDSA

SEQ ID NO: 758010 - protein, 17 aa, Mycobacterium
IDNWRWAGVPIFLRAGK

SEQ ID NO: 758011 - protein, 19 aa, Mycobacterium
IDPWGGSYYVEWLTHQLAQ

SEQ ID NO: 758012 - protein, 23 aa, Mycobacterium
IFRARPSPFYVMDEVEAALDDVN

SEQ ID NO: 758013 - protein, 17 aa, Mycobacterium
IFWQVVDARGWTPQHLH

SEQ ID NO: 758014 - protein, 18 aa, Mycobacterium
IHAGEAFGLPSIHEAIAF

SEQ ID NO: 758015 - protein, 19 aa, Mycobacterium
IIPWNFPILMGAWKLAPAL

SEQ ID NO: 758016 - protein, 18 aa, Mycobacterium
ILGNLGLVIGGGFDTTTA

SEQ ID NO: 758017 - protein, 23 aa, Mycobacterium
INYLRCIGCGLCIEACPTRALTM

SEQ ID NO: 758018 - protein, 24 aa, Mycobacterium
INYLRCIGCGLCIEACPTRALTMT

SEQ ID NO: 758019 - protein, 17 aa, Mycobacterium
IPLLVVITEGIPVQDTA

SEQ ID NO: 758020 - protein, 20 aa, Mycobacterium
IPSRAYVSAFGFKGPDQQKP

SEQ ID NO: 758021 - protein, 19 aa, Mycobacterium
IQSRLGFLLDVGLDYLSLS

SEQ ID NO: 758022 - protein, 19 aa, Mycobacterium
IQSRLGFLLDVGLEYLSLS

SEQ ID NO: 758023 - protein, 22 aa, Mycobacterium
ISSARTAAQFGIEPRVAMLSYS

SEQ ID NO: 758024 - protein, 18 aa, Mycobacterium
ITAILPFYPYARQDKKHR

SEQ ID NO: 758025 - protein, 17 aa, Mycobacterium
ITLWPGMKIGQLCLLRL

SEQ ID NO: 758026 - protein, 21 aa, Mycobacterium
KAVKKLPGWVDVATREQFEVN

SEQ ID NO: 758027 - protein, 19 aa, Mycobacterium
KDLQDIIAILGIDELSEED

SEQ ID NO: 758028 - protein, 22 aa, Mycobacterium
KGKRYALPHARILMHQPLGGVT

SEQ ID NO: 758029 - protein, 21 aa, Mycobacterium
KGSALVPSWVAFAVTGLLEQH

SEQ ID NO: 758030 - protein, 20 aa, Mycobacterium
KHYGVSVAICPPRRGNRKGV

SEQ ID NO: 758031 - protein, 17 aa, Mycobacterium
KISELYDRVGFAAAGKF

SEQ ID NO: 758032 - protein, 17 aa, Mycobacterium
KLYLCAIKDVFSNRIVG

SEQ ID NO: 758033 - protein, 21 aa, Mycobacterium
KRFSSAILPAWARKSPQMSEV

SEQ ID NO: 758034 - protein, 20 aa, Mycobacterium
KRLVDFAAGLAFALRGSFDK

SEQ ID NO: 758035 - protein, 22 aa, Mycobacterium
KRWRDGQMALRWCAAGMVEAGK

SEQ ID NO: 758036 - protein, 18 aa, Mycobacterium
LACGNAFVLKPSERDPSV

SEQ ID NO: 758037 - protein, 17 aa, Mycobacterium
LAMPRLDMVTGLYYLTT

SEQ ID NO: 758038 - protein, 20 aa, Mycobacterium
LDLCPRIRVNAIAPGSILTS

SEQ ID NO: 758039 - protein, 17 aa, Mycobacterium
LDLPRDALIVFTGLSGS

SEQ ID NO: 758040 - protein, 17 aa, Mycobacterium
LEDWAKWGQARHDYFLR

SEQ ID NO: 758041 - protein, 20 aa, Mycobacterium
LELYDPFSFEIIRQLEAFGF

SEQ ID NO: 758042 - protein, 22 aa, Mycobacterium
LFALGRLPGWIAHWREMHDEGD

SEQ ID NO: 758043 - protein, 19 aa, Mycobacterium
LGPRGRHVVLAKAFGGPAV

SEQ ID NO: 758044 - protein, 17 aa, Mycobacterium
LGVKGRVLPMCPIALQI

SEQ ID NO: 758045 - protein, 18 aa, Mycobacterium
LGYDEAWFGEHHSGGYEL

SEQ ID NO: 758046 - protein, 18 aa, Mycobacterium
LGYYEWREGLLRGLAAHH

SEQ ID NO: 758047 - protein, 19 aa, Mycobacterium
LHTPLPLLAFTAWPEVRSQ

SEQ ID NO: 758048 - protein, 17 aa, Mycobacterium
LILADAIVRACEDNPDY

SEQ ID NO: 758049 - protein, 18 aa, Mycobacterium
LLAFTAFPKQIWRQIWSN

SEQ ID NO: 758050 - protein, 19 aa, Mycobacterium
LLVRGGVVFSGYWRNEQAT

SEQ ID NO: 758051 - protein, 18 aa, Mycobacterium
LPAGFSFVPGHEIVGIVE

SEQ ID NO: 758052 - protein, 20 aa, Mycobacterium
LPEGSGFEFVDKVVGGAVPR

SEQ ID NO: 758053 - protein, 19 aa, Mycobacterium
LPTVRGAFCLTFMDENTLY

SEQ ID NO: 758054 - protein, 19 aa, Mycobacterium
LQTGVRWKDLGLVVVDEEQ

SEQ ID NO: 758055 - protein, 23 aa, Mycobacterium
LRDRLSEVLPAYMVPAAFIEIDE

SEQ ID NO: 758056 - protein, 23 aa, Mycobacterium
LRDRLSEVLPAYMVPAAFMVIDE

SEQ ID NO: 758057 - protein, 23 aa, Mycobacterium
LRDRLSEVLPAYMVPAAFVVIDE

SEQ ID NO: 758058 - protein, 23 aa, Mycobacterium
LRLGEYDVLVGINLLREGLDLPE

SEQ ID NO: 758059 - protein, 18 aa, Mycobacterium
LRPGAIIRDLDLLRPIYA

SEQ ID NO: 758060 - protein, 19 aa, Mycobacterium
LRPSMLEFMDSVAINAVED

SEQ ID NO: 758061 - protein, 17 aa, Mycobacterium
LSKRGGGVALLLTNIRE

SEQ ID NO: 758062 - protein, 18 aa, Mycobacterium
LYARFWHKVLYDLGHVSS

SEQ ID NO: 758063 - protein, 18 aa, Mycobacterium
LYDRVGFAAAGKFNEFDN

SEQ ID NO: 758064 - protein, 18 aa, Mycobacterium
LYSRFWHKVLYDLGHVSS

SEQ ID NO: 758065 - protein, 18 aa, Mycobacterium
MGDHGMAVMLARGDLAIE

SEQ ID NO: 758066 - protein, 18 aa, Mycobacterium
MLDIRLKALRTFDKKPMP

SEQ ID NO: 758067 - protein, 18 aa, Mycobacterium
MQFLRGGRRWLLKSPQHL

SEQ ID NO: 758068 - protein, 21 aa, Mycobacterium
MSMARLLYWGCDVWLNNPLRP

SEQ ID NO: 758069 - protein, 20 aa, Mycobacterium
MWRRGDEVFAEVALPADAGV

SEQ ID NO: 758070 - protein, 17 aa, Mycobacterium
NEEFPRLMVYRGPRRKG

SEQ ID NO: 758071 - protein, 18 aa, Mycobacterium
NELSCYRYEVVLRKGPVG

SEQ ID NO: 758072 - protein, 19 aa, Mycobacterium
NFTGRSWPLADVRLLAPIL

SEQ ID NO: 758073 - protein, 19 aa, Mycobacterium
NHISFGFGVHRCMGNRLAE

SEQ ID NO: 758074 - protein, 18 aa, Mycobacterium
NNGFFWRGTGQGLIGADY

SEQ ID NO: 758075 - protein, 23 aa, Mycobacterium
NRKVLPGYILVRMELNDESWGAV

SEQ ID NO: 758076 - protein, 24 aa, Mycobacterium
NWWESRALYGWTVLVPRTKDQAGE

SEQ ID NO: 758077 - protein, 22 aa, Mycobacterium
PDNEFRVVLARRGQHWVSAVRV

SEQ ID NO: 758078 - protein, 18 aa, Mycobacterium
PELLSRAAALNWDTTAPA

SEQ ID NO: 758079 - protein, 17 aa, Mycobacterium
PFGALGARMYRTGDVVR

SEQ ID NO: 758080 - protein, 19 aa, Mycobacterium
PFSALAFKIAVHPFFGKLT

SEQ ID NO: 758081 - protein, 19 aa, Mycobacterium
PGALIGFLGPRVYQLLYGE

SEQ ID NO: 758082 - protein, 19 aa, Mycobacterium
PGRREGWDYPDMARESGTN

SEQ ID NO: 758083 - protein, 19 aa, Mycobacterium
PKVVICLVNGWAAGGGHSL

SEQ ID NO: 758084 - protein, 23 aa, Mycobacterium
PQRGRISTWPLPEAFNGITVNGV

SEQ ID NO: 758085 - protein, 18 aa, Mycobacterium
PSDSVAIALRVGVPIYVE

SEQ ID NO: 758086 - protein, 20 aa, Mycobacterium
PTGARLAGKHGIGLLSIGAT

SEQ ID NO: 758087 - protein, 18 aa, Mycobacterium
PTVIKWRDRFAAFGIEGL

SEQ ID NO: 758088 - protein, 19 aa, Mycobacterium
QADKYDVPRICFVNKMDKL

SEQ ID NO: 758089 - protein, 22 aa, Mycobacterium
QIPKLRAGSFFPSLLERRRRID

SEQ ID NO: 758090 - protein, 22 aa, Mycobacterium
QIYEMYRLLAIAKYEERYVIPT

SEQ ID NO: 758091 - protein, 17 aa, Mycobacterium
QLCILRLTSPAEHPYGS

SEQ ID NO: 758092 - protein, 20 aa, Mycobacterium
QLFKQLLMVAGMERYYQIAR

SEQ ID NO: 758093 - protein, 23 aa, Mycobacterium
QMGKDGWLTLNWPKEYGGQDRSP

SEQ ID NO: 758094 - protein, 18 aa, Mycobacterium
RAFCARLLGIAAQRVRVI

SEQ ID NO: 758095 - protein, 18 aa, Mycobacterium
RALIAVRGLHRFAAAEGL

SEQ ID NO: 758096 - protein, 19 aa, Mycobacterium
RAYRLDWPAGTTVYEIDQP

SEQ ID NO: 758097 - protein, 18 aa, Mycobacterium
RENLSWSAPRLHLVDLQY

SEQ ID NO: 758098 - protein, 17 aa, Mycobacterium
RGGGVALLLSNIREHGA

SEQ ID NO: 758099 - protein, 17 aa, Mycobacterium
RIRVNAIAPGSILTSAL

SEQ ID NO: 758100 - protein, 17 aa, Mycobacterium
RLLFKDEVRAVGRELGL

SEQ ID NO: 758101 - protein, 19 aa, Mycobacterium
RPSEVARLGYLAGIVATML

SEQ ID NO: 758102 - protein, 20 aa, Mycobacterium
RRCGWFDAVIARYATRVNGI

SEQ ID NO: 758103 - protein, 25 aa, Mycobacterium
RRFLERRLRETFGFEGSPIRINVRV

SEQ ID NO: 758104 - protein, 20 aa, Mycobacterium
RRGGLSATRFVACPFGAGGS

SEQ ID NO: 758105 - protein, 22 aa, Mycobacterium
RSYNCLKREGVHTVGELVARTE

SEQ ID NO: 758106 - protein, 18 aa, Mycobacterium
RTMRGYKVERRFGWDTHG

SEQ ID NO: 758107 - protein, 18 aa, Mycobacterium
RTRIRPHFFPFTEPSAEV

SEQ ID NO: 758108 - protein, 24 aa, Mycobacterium
RVEPEMLRRALLYAIERKRAELIA

SEQ ID NO: 758109 - protein, 17 aa, Mycobacterium
RVLAMAWEKQSESNAMW

SEQ ID NO: 758110 - protein, 17 aa, Mycobacterium
RYLRICVLTQYKSHSLD

SEQ ID NO: 758111 - protein, 23 aa, Mycobacterium
SDGRWIWRWDPAFISSNFDVLQG

SEQ ID NO: 758112 - protein, 22 aa, Mycobacterium
SKMNRFFLRGALVARLLSEAAW

SEQ ID NO: 758113 - protein, 17 aa, Mycobacterium
SMHFVPSLLGLFLSLPG

SEQ ID NO: 758114 - protein, 23 aa, Mycobacterium
SRKRNLVDFGFRLPSAVDNRPLT

SEQ ID NO: 758115 - protein, 17 aa, Mycobacterium
SRRSWWRIAAAIEDQSA

SEQ ID NO: 758116 - protein, 22 aa, Mycobacterium
STLLLTLLFRFMKPLVENGHIF

SEQ ID NO: 758117 - protein, 24 aa, Mycobacterium
SWFKTLKYAPAFPERFESIHHARD

SEQ ID NO: 758118 - protein, 18 aa, Mycobacterium
TALVAALCRQLRDELSLA

SEQ ID NO: 758119 - protein, 19 aa, Mycobacterium
TEAIKLVALVADRGAQVRM

SEQ ID NO: 758120 - protein, 19 aa, Mycobacterium
TGPQQIWSWDITDLRSPWR

SEQ ID NO: 758121 - protein, 18 aa, Mycobacterium
TGVAFPAFPALLAAEQGV

SEQ ID NO: 758122 - protein, 20 aa, Mycobacterium
THTKAAYLLHAWQPHLTGPT

SEQ ID NO: 758123 - protein, 19 aa, Mycobacterium
TIRLPVHLVEQVNKLARIK

SEQ ID NO: 758124 - protein, 20 aa, Mycobacterium
TKLVPFGAFVRVEEGIEGLV

SEQ ID NO: 758125 - protein, 23 aa, Mycobacterium
TLIKEKWLTANGVIGFFPANAVG

SEQ ID NO: 758126 - protein, 21 aa, Mycobacterium
TNTFPSWPLAHPFRRIAHNGE

SEQ ID NO: 758127 - protein, 25 aa, Mycobacterium
TNTFPSWPLAHPFRRVAHNGEINTV

SEQ ID NO: 758128 - protein, 18 aa, Mycobacterium
TSGWSLTAQDVFNNVART

SEQ ID NO: 758129 - protein, 18 aa, Mycobacterium
TSVPAFRPGAQFKAVVSG

SEQ ID NO: 758130 - protein, 24 aa, Mycobacterium
VARYLFRRVVSWGRSSNVFLRNGA

SEQ ID NO: 758131 - protein, 18 aa, Mycobacterium
VAVKAPFFGDRRKAFLED

SEQ ID NO: 758132 - protein, 23 aa, Mycobacterium
VCNEILPRWGVETVFVDGDDLSQ

SEQ ID NO: 758133 - protein, 20 aa, Mycobacterium
VDDWPLLRWRMRQYRHGRWG

SEQ ID NO: 758134 - protein, 19 aa, Mycobacterium
VECSPPYDWAEQTALMSSR

SEQ ID NO: 758135 - protein, 20 aa, Mycobacterium
VEIGGPFSLELCGGTHVHNS

SEQ ID NO: 758136 - protein, 23 aa, Mycobacterium
VKKLPTLRGRTIITMFYENSTRT

SEQ ID NO: 758137 - protein, 19 aa, Mycobacterium
VLGNWTGIPVFKLTEAETT

SEQ ID NO: 758138 - protein, 19 aa, Mycobacterium
VLGNWTGIPVFKLTEEETT

SEQ ID NO: 758139 - protein, 17 aa, Mycobacterium
VLVGGLGGRGVVAGASY

SEQ ID NO: 758140 - protein, 18 aa, Mycobacterium
VNGFCVGGGIGLVGNSDV

SEQ ID NO: 758141 - protein, 20 aa, Mycobacterium
VNQRWLGGMLTNFSTVHKRL

SEQ ID NO: 758142 - protein, 18 aa, Mycobacterium
VRLAELFVEAGLPPGVFQ

SEQ ID NO: 758143 - protein, 22 aa, Mycobacterium
VRSRLMLDIASWRRRRREELAA

SEQ ID NO: 758144 - protein, 21 aa, Mycobacterium
VTPKSSWPWVRTLLHSVFDQP

SEQ ID NO: 758145 - protein, 19 aa, Mycobacterium
VYFELRLADAWVWDMYRPA

SEQ ID NO: 758146 - protein, 18 aa, Mycobacterium
VYSGFAFGMGLERTLQFR

SEQ ID NO: 758147 - protein, 17 aa, Mycobacterium
WCSDIRAGAGLVLAGLV

SEQ ID NO: 758148 - protein, 17 aa, Mycobacterium
WFEGLLWFSDMLGEAVH

SEQ ID NO: 758149 - protein, 23 aa, Mycobacterium
WKDGEALFLRCNIWREAAENVAE

SEQ ID NO: 758150 - protein, 20 aa, Mycobacterium
WQVVDARGWTPQHLHTAIDE

SEQ ID NO: 758151 - protein, 17 aa, Mycobacterium
WRGKAFDNDAGWRIDYH

SEQ ID NO: 758152 - protein, 21 aa, Mycobacterium
WRRSGLTASRFVACPFGALGA

SEQ ID NO: 758153 - protein, 18 aa, Mycobacterium
WSSGCDHATWAFLGGPVI

SEQ ID NO: 758154 - protein, 17 aa, Mycobacterium
YDLCMSRNIPLSMTLGR

SEQ ID NO: 758155 - protein, 18 aa, Mycobacterium
YEGFSLPAVEAMASGTPI

SEQ ID NO: 758156 - protein, 20 aa, Mycobacterium
YRDADGWIYLAGRTADWMRV

SEQ ID NO: 758157 - protein, 18 aa, Mycobacterium
YREYALRPPKGVLLYGPP

SEQ ID NO: 758158 - protein, 17 aa, Mycobacterium
YRIAELALRDKIPLVML

SEQ ID NO: 758159 - protein, 18 aa, Mycobacterium
YRPFYLRNLLDAVQGRTL

SEQ ID NO: 758160 - protein, 20 aa, Mycobacterium
YRVLPYCWRDETPLSNHELR

SEQ ID NO: 758161 - protein, 18 aa, Mycobacterium
YVMPHWPKPWGRAADAVE

SEQ ID NO: 758162 - protein, 22 aa, Mycobacterium
YYADFEGVLAFLQRKMAQTESE

SEQ ID NO: 758163 - protein, 19 aa, Mycobacterium
AAALARQGSFLGYRVTVCD

SEQ ID NO: 758164 - protein, 24 aa, Mycobacterium
AAALTVRLSFDWAQLKPGDKVLIH

SEQ ID NO: 758165 - protein, 20 aa, Mycobacterium
AADEIVRWATPVSAFQRTAL

SEQ ID NO: 758166 - protein, 17 aa, Mycobacterium
AAHGRYGGVWAHDETRK

SEQ ID NO: 758167 - protein, 19 aa, Mycobacterium
AALAWARRFSDHPVDVLAA

SEQ ID NO: 758168 - protein, 18 aa, Mycobacterium
AALSRLGAIAVVMRPDAD

SEQ ID NO: 758169 - protein, 24 aa, Mycobacterium
AALTRVGAPYSWGATGPDAFDCSG

SEQ ID NO: 758170 - protein, 24 aa, Mycobacterium
AAMARRCVDAGWLLSLSGTASFRN

SEQ ID NO: 758171 - protein, 20 aa, Mycobacterium
AARLLVWRAGWMARNNQSFD

SEQ ID NO: 758172 - protein, 18 aa, Mycobacterium
AARRCPDATFLPSDPAAY

SEQ ID NO: 758173 - protein, 17 aa, Mycobacterium
AATCFPNLSFVHNWPKV

SEQ ID NO: 758174 - protein, 19 aa, Mycobacterium
AAVAALFSGHALDYQALST

SEQ ID NO: 758175 - protein, 17 aa, Mycobacterium
AAYAMRWVAKNVVAAGL

SEQ ID NO: 758176 - protein, 25 aa, Mycobacterium
ADALALAICHCWRAPMIARMAAAEA

SEQ ID NO: 758177 - protein, 21 aa, Mycobacterium
ADAYRAISLLLRRPPGREAFP

SEQ ID NO: 758178 - protein, 19 aa, Mycobacterium
ADFNFAWPTARIAVIGAEG

SEQ ID NO: 758179 - protein, 21 aa, Mycobacterium
ADLFLWPTLYLWEFPKPTISQ

SEQ ID NO: 758180 - protein, 20 aa, Mycobacterium
ADRLACWLVGCGVGRGDVVA

SEQ ID NO: 758181 - protein, 18 aa, Mycobacterium
ADVVVAWPTAQIAVMGAS

SEQ ID NO: 758182 - protein, 17 aa, Mycobacterium
AEAFPGLARTAALVRLV

SEQ ID NO: 758183 - protein, 17 aa, Mycobacterium
AEALCGAVGFIGFAVNG

SEQ ID NO: 758184 - protein, 17 aa, Mycobacterium
AEGFSWTPVHTMAGVDT

SEQ ID NO: 758185 - protein, 20 aa, Mycobacterium
AEGRGATMIFTRTKRTAQKV

SEQ ID NO: 758186 - protein, 18 aa, Mycobacterium
AEGVACYQLFISGLLDVT

SEQ ID NO: 758187 - protein, 18 aa, Mycobacterium
AEHGRSWSRWSFIGAGAP

SEQ ID NO: 758188 - protein, 18 aa, Mycobacterium
AEIARLALFLTTPAARHI

SEQ ID NO: 758189 - protein, 19 aa, Mycobacterium
AEKCTLCYPRMEVGLPTIC

SEQ ID NO: 758190 - protein, 17 aa, Mycobacterium
AELRPYTGWSVRDVICQ

SEQ ID NO: 758191 - protein, 23 aa, Mycobacterium
AELVRRLAVVHGRVTLSSGKEAD

SEQ ID NO: 758192 - protein, 21 aa, Mycobacterium
AENGRSWSRWSFIGAGAPSAL

SEQ ID NO: 758193 - protein, 21 aa, Mycobacterium
AENGRSWSRWSFIGAGAPTAL

SEQ ID NO: 758194 - protein, 17 aa, Mycobacterium
AEQCRRLDALGIGYEIV

SEQ ID NO: 758195 - protein, 22 aa, Mycobacterium
AEQMKMFLTRLGFGSKVVVTGD

SEQ ID NO: 758196 - protein, 17 aa, Mycobacterium
AETGLSCSVGISDNKQR

SEQ ID NO: 758197 - protein, 25 aa, Mycobacterium
AEVWRRGSVIGSWLLDLTAIALHES

SEQ ID NO: 758198 - protein, 21 aa, Mycobacterium
AEYVYRFAPLVGIYGGTLEVF

SEQ ID NO: 758199 - protein, 18 aa, Mycobacterium
AFERQWWKYAGSKEDAIK

SEQ ID NO: 758200 - protein, 19 aa, Mycobacterium
AFLELCPFAAWGSKFPVGG

SEQ ID NO: 758201 - protein, 22 aa, Mycobacterium
AFLREVVDFELPAPGSYATGIA

SEQ ID NO: 758202 - protein, 23 aa, Mycobacterium
AFLREVVDFELPPAGSYATGIAF

SEQ ID NO: 758203 - protein, 18 aa, Mycobacterium
AFQCPYHGWTYRNNGDLI

SEQ ID NO: 758204 - protein, 17 aa, Mycobacterium
AGFCMGGQFALVMSPKG

SEQ ID NO: 758205 - protein, 18 aa, Mycobacterium
AGILRYSRDLAFAAASAY

SEQ ID NO: 758206 - protein, 22 aa, Mycobacterium
AGPALACGNAFVLKPSERDPSV

SEQ ID NO: 758207 - protein, 20 aa, Mycobacterium
AGVARSGFYFYFDSKYAVLA

SEQ ID NO: 758208 - protein, 24 aa, Mycobacterium
AGVVRPDLVIGWWAAPTILEHGTP

SEQ ID NO: 758209 - protein, 23 aa, Mycobacterium
AHSQLAWVLGCFTGFGQASRMTQ

SEQ ID NO: 758210 - protein, 24 aa, Mycobacterium
AIAEAAQAFSVWRTTPAPVRGALV

SEQ ID NO: 758211 - protein, 18 aa, Mycobacterium
AIGGGLCLALAADIRVAS

SEQ ID NO: 758212 - protein, 26 aa, Mycobacterium
AILIRPAPVPGFRGPRSFALPEFDPF

SEQ ID NO: 758213 - protein, 23 aa, Mycobacterium
AIRAFRAAYEMGIATVAVYPYED

SEQ ID NO: 758214 - protein, 19 aa, Mycobacterium
AISGMNAVAGWRGAPRPVL

SEQ ID NO: 758215 - protein, 19 aa, Mycobacterium
AIVHLGFGFGIVFINPALE

SEQ ID NO: 758216 - protein, 24 aa, Mycobacterium
AIVKGLRTGTDFEYELQMAQMNKH

SEQ ID NO: 758217 - protein, 18 aa, Mycobacterium
AIVPWNFPFEVTINKLGQ

SEQ ID NO: 758218 - protein, 23 aa, Mycobacterium
AKAAPLWRVLVALSIRHVGPTAA

SEQ ID NO: 758219 - protein, 19 aa, Mycobacterium
AKVATGFAKPAGIYVLTEA

SEQ ID NO: 758220 - protein, 20 aa, Mycobacterium
AKWKLAIVLEQGFQRAGDDE

SEQ ID NO: 758221 - protein, 22 aa, Mycobacterium
ALASRARKAPGFALLGEPGQAR

SEQ ID NO: 758222 - protein, 22 aa, Mycobacterium
ALCARFRISGLPVVDDAGALVG

SEQ ID NO: 758223 - protein, 20 aa, Mycobacterium
ALHSPFWWLKCAVGVSNTDH

SEQ ID NO: 758224 - protein, 23 aa, Mycobacterium
ALSTARFEFRWNDQFALSLDPDT

SEQ ID NO: 758225 - protein, 18 aa, Mycobacterium
ALVPLSFAQSRLWFLEQL

SEQ ID NO: 758226 - protein, 22 aa, Mycobacterium
AMDRKVWLPSGGTLVIDRTEAM

SEQ ID NO: 758227 - protein, 19 aa, Mycobacterium
ANAVIFCGHFPDGAEKFTK

SEQ ID NO: 758228 - protein, 19 aa, Mycobacterium
ANEILKRAASFFGAELDRQ

SEQ ID NO: 758229 - protein, 18 aa, Mycobacterium
ANGIFLPHVLRYNASLPT

SEQ ID NO: 758230 - protein, 17 aa, Mycobacterium
ANIGFSFCYEAQRQVPA

SEQ ID NO: 758231 - protein, 18 aa, Mycobacterium
ANLRLVVSLAKRYTGRGM

SEQ ID NO: 758232 - protein, 20 aa, Mycobacterium
ANPFGGPGARMYRTGDLVCW

SEQ ID NO: 758233 - protein, 19 aa, Mycobacterium
APARAYNPLFIWGESGLGK

SEQ ID NO: 758234 - protein, 17 aa, Mycobacterium
APGCPFAPPPKVLELNA

SEQ ID NO: 758235 - protein, 19 aa, Mycobacterium
APIGWRLALRDPSAITAII

SEQ ID NO: 758236 - protein, 20 aa, Mycobacterium
APILDMLGGPRCTALVVGAA

SEQ ID NO: 758237 - protein, 20 aa, Mycobacterium
APMFHAWGFSQLVLAASLAC

SEQ ID NO: 758238 - protein, 18 aa, Mycobacterium
APVLTLRTDRDWIADIVR

SEQ ID NO: 758239 - protein, 20 aa, Mycobacterium
APVPGYRGPRSFALPEFDPF

SEQ ID NO: 758240 - protein, 23 aa, Mycobacterium
AQHWELRISPRFGHVPVDEISRK

SEQ ID NO: 758241 - protein, 19 aa, Mycobacterium
AQTVARWLVLYLRRPGGQT

SEQ ID NO: 758242 - protein, 17 aa, Mycobacterium
AQVALAWLISLPGVVAI

SEQ ID NO: 758243 - protein, 17 aa, Mycobacterium
ARAAGVMCRPRDVFVEQ

SEQ ID NO: 758244 - protein, 23 aa, Mycobacterium
AREFKPLVLVAGYSAYPRRVNFA

SEQ ID NO: 758245 - protein, 19 aa, Mycobacterium
ARGGLRWSDRRDDFRTEIL

SEQ ID NO: 758246 - protein, 19 aa, Mycobacterium
ARGRFPGRYRIAVLENLSR

SEQ ID NO: 758247 - protein, 18 aa, Mycobacterium
ARHLDCWVLGTVCKGGKE

SEQ ID NO: 758248 - protein, 19 aa, Mycobacterium
ARIALHVRVLYGRDPHHIT

SEQ ID NO: 758249 - protein, 21 aa, Mycobacterium
ARLTVPLGMIILRKGYGLGAM

SEQ ID NO: 758250 - protein, 20 aa, Mycobacterium
ARLVGAMSVPPTWEGSIPKG

SEQ ID NO: 758251 - protein, 22 aa, Mycobacterium
ARPRAGILRVREFLMKDSYSFD

SEQ ID NO: 758252 - protein, 19 aa, Mycobacterium
ARQLLDLMVHSVYSNKDSF

SEQ ID NO: 758253 - protein, 18 aa, Mycobacterium
ARYLRICVLTQYKSHSLD

SEQ ID NO: 758254 - protein, 21 aa, Mycobacterium
ASAFLGRLALIRIYNGKLRKG

SEQ ID NO: 758255 - protein, 17 aa, Mycobacterium
ASVHGWCIGGGVDLISA

SEQ ID NO: 758256 - protein, 19 aa, Mycobacterium
ASYLLSLRAAWQADNKIPN

SEQ ID NO: 758257 - protein, 20 aa, Mycobacterium
ATRWPAVRFAVRNTAVQGPN

SEQ ID NO: 758258 - protein, 24 aa, Mycobacterium
AVEEVLRWASPVAYWTRTAKVDVE

SEQ ID NO: 758259 - protein, 19 aa, Mycobacterium
AVELARSGAKIAISDIDNE

SEQ ID NO: 758260 - protein, 17 aa, Mycobacterium
AVLAEWGADVIKVEHAV

SEQ ID NO: 758261 - protein, 24 aa, Mycobacterium
AVLAFSRWRFVRFATDERASTTLA

SEQ ID NO: 758262 - protein, 24 aa, Mycobacterium
AVLPGCASRGGIRPLATGYAITAV

SEQ ID NO: 758263 - protein, 21 aa, Mycobacterium
AVVIDEAWRSGSLAGEISAQI

SEQ ID NO: 758264 - protein, 18 aa, Mycobacterium
AVVTRYELVDGFPRFDVD

SEQ ID NO: 758265 - protein, 17 aa, Mycobacterium
AWWKIAIDTAGYGRAGA

SEQ ID NO: 758266 - protein, 19 aa, Mycobacterium
CAELLYRAGLPRALYAIVP

SEQ ID NO: 758267 - protein, 19 aa, Mycobacterium
CAIQNLWLAARSEGLGMGW

SEQ ID NO: 758268 - protein, 17 aa, Mycobacterium
CALTSRLLVPRSHHDEI

SEQ ID NO: 758269 - protein, 25 aa, Mycobacterium
CDKGFPSYFLIVADLINYARSVDIR

SEQ ID NO: 758270 - protein, 17 aa, Mycobacterium
CDPEVVEALKFHLRDLA

SEQ ID NO: 758271 - protein, 23 aa, Mycobacterium
CDPPESFQLYGIVAHVLTYSAHR

SEQ ID NO: 758272 - protein, 18 aa, Mycobacterium
CEIFARYDVTFSLGDGLR

SEQ ID NO: 758273 - protein, 20 aa, Mycobacterium
CGWCKDRFGLSWQIVPDRLY

SEQ ID NO: 758274 - protein, 18 aa, Mycobacterium
CGWFDAVIARYATRVNGI

SEQ ID NO: 758275 - protein, 18 aa, Mycobacterium
CPMGSYVAPDAIKNPDGS

SEQ ID NO: 758276 - protein, 17 aa, Mycobacterium
CQGEGFVAVELLFLPGT

SEQ ID NO: 758277 - protein, 18 aa, Mycobacterium
CREALAVNVKPKFAVDAM

SEQ ID NO: 758278 - protein, 22 aa, Mycobacterium
CRSTQELRNWLMLRAYESGVVP

SEQ ID NO: 758279 - protein, 20 aa, Mycobacterium
CRTPTIASVHGWCIGGGVDL

SEQ ID NO: 758280 - protein, 24 aa, Mycobacterium
CTLCSCFPWPVLGLPPYWYKDPVF

SEQ ID NO: 758281 - protein, 22 aa, Mycobacterium
CYSLRIASAMAHDEGWLAEHML

SEQ ID NO: 758282 - protein, 19 aa, Mycobacterium
DAAGFKWLAPYTGSAIGQH

SEQ ID NO: 758283 - protein, 24 aa, Mycobacterium
DALVGLCWPAVFAAIGSAVTDTGV

SEQ ID NO: 758284 - protein, 19 aa, Mycobacterium
DANVWRKVVPKGWFYNVMV

SEQ ID NO: 758285 - protein, 17 aa, Mycobacterium
DAPTCPVAIAFPEGTPS

SEQ ID NO: 758286 - protein, 24 aa, Mycobacterium
DARFRDALFPVWRYHPFFTNTDLP

SEQ ID NO: 758287 - protein, 17 aa, Mycobacterium
DATQIFGGYGFMNEYSV

SEQ ID NO: 758288 - protein, 17 aa, Mycobacterium
DAVELPGWYRPNPGLAR

SEQ ID NO: 758289 - protein, 22 aa, Mycobacterium
DCIQVLGGIGCTWEHDAHLYLR

SEQ ID NO: 758290 - protein, 22 aa, Mycobacterium
DEILMELGLDWDRIIELKTAGA

SEQ ID NO: 758291 - protein, 17 aa, Mycobacterium
DEIRWALDLLRKRFAKV

SEQ ID NO: 758292 - protein, 17 aa, Mycobacterium
DEISVLVPDDFVGAVMG

SEQ ID NO: 758293 - protein, 17 aa, Mycobacterium
DERGMRTVMCILNGQLR

SEQ ID NO: 758294 - protein, 18 aa, Mycobacterium
DEVHLLPAPVFRMTADLQ

SEQ ID NO: 758295 - protein, 18 aa, Mycobacterium
DFNFAWPTARIAVIGADG

SEQ ID NO: 758296 - protein, 17 aa, Mycobacterium
DGAIAWLVGEEGRGVPT

SEQ ID NO: 758297 - protein, 18 aa, Mycobacterium
DGALGFWKAVREVFPATK

SEQ ID NO: 758298 - protein, 17 aa, Mycobacterium
DGTTWRVEIERAHMEED

SEQ ID NO: 758299 - protein, 19 aa, Mycobacterium
DHAAICWPLLVGMAKAKYY

SEQ ID NO: 758300 - protein, 20 aa, Mycobacterium
DHAAICWPLLVGMAKAKYYL

SEQ ID NO: 758301 - protein, 17 aa, Mycobacterium
DHLDWYVALACFKLGIV

SEQ ID NO: 758302 - protein, 22 aa, Mycobacterium
DKGRLTLPAKFRDALAGGLMVT

SEQ ID NO: 758303 - protein, 22 aa, Mycobacterium
DKWKFTVPFVCGATNLGEALRR

SEQ ID NO: 758304 - protein, 19 aa, Mycobacterium
DLADWRWGIDVNVLGVIHG

SEQ ID NO: 758305 - protein, 18 aa, Mycobacterium
DLLKCSFCGKSQKQVKKL

SEQ ID NO: 758306 - protein, 20 aa, Mycobacterium
DLPPRIVFVGGGYISFEFAH

SEQ ID NO: 758307 - protein, 18 aa, Mycobacterium
DLQDIIAILGIDELSEED

SEQ ID NO: 758308 - protein, 24 aa, Mycobacterium
DPGESRFYLSLGDELMRRFNGAAL

SEQ ID NO: 758309 - protein, 21 aa, Mycobacterium
DPGSVSYLFTRKGVVTLEKNG

SEQ ID NO: 758310 - protein, 18 aa, Mycobacterium
DQCPLCPGPTGLTSEVPA

SEQ ID NO: 758311 - protein, 19 aa, Mycobacterium
DRCEVEWIPPPGLDTGQAR

SEQ ID NO: 758312 - protein, 20 aa, Mycobacterium
DRCRGWRMCVSGCPYKKVYF

SEQ ID NO: 758313 - protein, 24 aa, Mycobacterium
DRDLALASVRAWNDWHLEVWAGSY

SEQ ID NO: 758314 - protein, 19 aa, Mycobacterium
DRKISERRVFPAVDVNPSG

SEQ ID NO: 758315 - protein, 21 aa, Mycobacterium
DRLGFDEAWFGEHHSGGYELI

SEQ ID NO: 758316 - protein, 22 aa, Mycobacterium
DRRPDLPSGKGLVIAEGVLVVQ

SEQ ID NO: 758317 - protein, 25 aa, Mycobacterium
DRSTTLALRWLVSFSRQRREKTMVE

SEQ ID NO: 758318 - protein, 17 aa, Mycobacterium
DRWAPGRVMVNVYGPTE

SEQ ID NO: 758319 - protein, 19 aa, Mycobacterium
DSADGVWSRMKFEGGVHRV

SEQ ID NO: 758320 - protein, 23 aa, Mycobacterium
DSGFRAGSVISHYYDSLLAKVIA

SEQ ID NO: 758321 - protein, 24 aa, Mycobacterium
DTGYRAPAAFGYRPFEGGLALKRL

SEQ ID NO: 758322 - protein, 22 aa, Mycobacterium
DTLRYLRDFRFGGDIDGYAEGE

SEQ ID NO: 758323 - protein, 17 aa, Mycobacterium
DVCPVEWARMENRSVLQ

SEQ ID NO: 758324 - protein, 20 aa, Mycobacterium
DVTLRGAVSIARRLQDPLAE

SEQ ID NO: 758325 - protein, 18 aa, Mycobacterium
DWPAKLRLLEGFRQRENL

SEQ ID NO: 758326 - protein, 18 aa, Mycobacterium
DYRLGVRMNHSIDIAAGA

SEQ ID NO: 758327 - protein, 18 aa, Mycobacterium
EADGDRYLPIWIGQSEAA

SEQ ID NO: 758328 - protein, 26 aa, Mycobacterium
EALEPARLGPWLANHGRRPRLINMYG

SEQ ID NO: 758329 - protein, 17 aa, Mycobacterium
EALGEGWFWPAAAAHPS

SEQ ID NO: 758330 - protein, 24 aa, Mycobacterium
EALKRLGIGGGFFSFGIMHYYLTG

SEQ ID NO: 758331 - protein, 25 aa, Mycobacterium
EALYHFAWDEFCDWYVELAKTQLAE

SEQ ID NO: 758332 - protein, 17 aa, Mycobacterium
EDFRFLIRLARQQGERL

SEQ ID NO: 758333 - protein, 19 aa, Mycobacterium
EDFVGALIYLLSDASSFYT

SEQ ID NO: 758334 - protein, 20 aa, Mycobacterium
EDRLRTRFEWGLITDVQPPE

SEQ ID NO: 758335 - protein, 25 aa, Mycobacterium
EEFARAAGMPGVFGMGLLHGGVLAQ

SEQ ID NO: 758336 - protein, 19 aa, Mycobacterium
EELARYGVQPDWFGLGDRD

SEQ ID NO: 758337 - protein, 17 aa, Mycobacterium
EELKQQWLPGIASGETI

SEQ ID NO: 758338 - protein, 23 aa, Mycobacterium
EELRPNDEWVLFGYDGVFQAFRD

SEQ ID NO: 758339 - protein, 20 aa, Mycobacterium
EEPKGVPVFAWKGETLEEYW

SEQ ID NO: 758340 - protein, 19 aa, Mycobacterium
EEPPEHLIFVFATTEPEKV

SEQ ID NO: 758341 - protein, 19 aa, Mycobacterium
EEVTACWSGNVACGPAPVT

SEQ ID NO: 758342 - protein, 19 aa, Mycobacterium
EFIGRLPVVASVTNLDKES

SEQ ID NO: 758343 - protein, 18 aa, Mycobacterium
EFMCVYWPSRGQEAIAAA

SEQ ID NO: 758344 - protein, 18 aa, Mycobacterium
EGLEIPLLIGGATTSRAH

SEQ ID NO: 758345 - protein, 20 aa, Mycobacterium
EGLLNYLALLGWAIADDHDV

SEQ ID NO: 758346 - protein, 19 aa, Mycobacterium
EGLPHIPVRLHARSWHRYP

SEQ ID NO: 758347 - protein, 19 aa, Mycobacterium
EGLPSVFVYDGYPGGAGFA

SEQ ID NO: 758348 - protein, 17 aa, Mycobacterium
EGTFEYQALLFIPSHAP

SEQ ID NO: 758349 - protein, 20 aa, Mycobacterium
EGVNLTFLPFIARAVIDALK

SEQ ID NO: 758350 - protein, 26 aa, Mycobacterium
EGVPRWRKGSGLGWLTAEYAMLPSAT

SEQ ID NO: 758351 - protein, 18 aa, Mycobacterium
EGVVSLGLYSRIFRNNIL

SEQ ID NO: 758352 - protein, 18 aa, Mycobacterium
EHDILAFERQWWKYAGSK

SEQ ID NO: 758353 - protein, 25 aa, Mycobacterium
EHPYPHCWRCRNPLIYRAVSSWFVA

SEQ ID NO: 758354 - protein, 25 aa, Mycobacterium
EHPYPHCWRCRNPLIYRAVSSWFVT

SEQ ID NO: 758355 - protein, 17 aa, Mycobacterium
EIAEGWQPIFYLPEKAQ

SEQ ID NO: 758356 - protein, 18 aa, Mycobacterium
EIARCLAELVTLDTPTVS

SEQ ID NO: 758357 - protein, 18 aa, Mycobacterium
EIPDHYRLYVSQKLARLE

SEQ ID NO: 758358 - protein, 19 aa, Mycobacterium
EIYPNLWAGVGLVRGGAGT

SEQ ID NO: 758359 - protein, 21 aa, Mycobacterium
EKEAWLSMVMLEWGSCGQLAV

SEQ ID NO: 758360 - protein, 23 aa, Mycobacterium
EKTLRFWLERGVDGFRIDVAHGM

SEQ ID NO: 758361 - protein, 20 aa, Mycobacterium
ELGQPLPLFIKWDDADYGLR

SEQ ID NO: 758362 - protein, 19 aa, Mycobacterium
ELHEIYKLGVVPIPTNKPM

SEQ ID NO: 758363 - protein, 18 aa, Mycobacterium
ELHEIYKLGVVPIPTNRP

SEQ ID NO: 758364 - protein, 17 aa, Mycobacterium
ELVAPVVGWLAHESCSV

SEQ ID NO: 758365 - protein, 17 aa, Mycobacterium
EMIAVAPSMLWSMTVDL

SEQ ID NO: 758366 - protein, 19 aa, Mycobacterium
EMLPHNAVEYFVSYYDYYQ

SEQ ID NO: 758367 - protein, 19 aa, Mycobacterium
EPARYIWKLEFQRRGAPHI

SEQ ID NO: 758368 - protein, 21 aa, Mycobacterium
EPRLSLQWWVRVESLAKAAGD

SEQ ID NO: 758369 - protein, 21 aa, Mycobacterium
EPRLSLQWWVRVETLAKAAGD

SEQ ID NO: 758370 - protein, 17 aa, Mycobacterium
EQARFAMRMIRRPVHDP

SEQ ID NO: 758371 - protein, 18 aa, Mycobacterium
ERTVLVLRFFESMTQTQI

SEQ ID NO: 758372 - protein, 29 aa, Mycobacterium
ESFFRGAGWNVIKVVWGREWDALLHADRD

SEQ ID NO: 758373 - protein, 21 aa, Mycobacterium
ESFGFKYGLPMDADMVMDVRF

SEQ ID NO: 758374 - protein, 18 aa, Mycobacterium
ETEVWRWYLIDKNAPDDV

SEQ ID NO: 758375 - protein, 24 aa, Mycobacterium
ETGLRRWMGLRGRLVQLGPFKMSA

SEQ ID NO: 758376 - protein, 20 aa, Mycobacterium
ETRGRFGTFISRFDPTDAAM

SEQ ID NO: 758377 - protein, 22 aa, Mycobacterium
ETRIARVFLDYCIDLHLAGQLD

SEQ ID NO: 758378 - protein, 22 aa, Mycobacterium
EVDRACAPWGLLGEDKQATLVA

SEQ ID NO: 758379 - protein, 18 aa, Mycobacterium
EVGPRIVPIIPDEARTFG

SEQ ID NO: 758380 - protein, 20 aa, Mycobacterium
EVGPRVAARFGRVLLELGGN

SEQ ID NO: 758381 - protein, 22 aa, Mycobacterium
EVPMKRFDLMNGIQVRGTYAVS

SEQ ID NO: 758382 - protein, 23 aa, Mycobacterium
EVPMKRFDLMNGIQVRGTYAVSQ

SEQ ID NO: 758383 - protein, 17 aa, Mycobacterium
EVRNFLVANALYWLQEF

SEQ ID NO: 758384 - protein, 19 aa, Mycobacterium
EVWPGRAYPLGATYDGAGT

SEQ ID NO: 758385 - protein, 22 aa, Mycobacterium
EYFEMMSAFLLDGARQVSAPTL

SEQ ID NO: 758386 - protein, 17 aa, Mycobacterium
FAFDAAWQPLVALLDGH

SEQ ID NO: 758387 - protein, 19 aa, Mycobacterium
FALLARRRMDLYGATTDDF

SEQ ID NO: 758388 - protein, 17 aa, Mycobacterium
FAPPIAYGALPKDALGA

SEQ ID NO: 758389 - protein, 18 aa, Mycobacterium
FAQSRLWFIDQLHGPSPV

SEQ ID NO: 758390 - protein, 17 aa, Mycobacterium
FARERSRWIFSNPDMIH

SEQ ID NO: 758391 - protein, 19 aa, Mycobacterium
FDEVARLGAQVTIFRLGSD

SEQ ID NO: 758392 - protein, 18 aa, Mycobacterium
FDGLRLAGRPVRRPDLTL

SEQ ID NO: 758393 - protein, 17 aa, Mycobacterium
FDLCTLPLNLAGHCGMS

SEQ ID NO: 758394 - protein, 23 aa, Mycobacterium
FDNWPLGWGFDHFWGFPSGAAGQ

SEQ ID NO: 758395 - protein, 19 aa, Mycobacterium
FDPLIFFRPRVQRLFDFHY

SEQ ID NO: 758396 - protein, 19 aa, Mycobacterium
FEFWREFLASLKARGLSGV

SEQ ID NO: 758397 - protein, 18 aa, Mycobacterium
FEFWREFLASLKARGLTG

SEQ ID NO: 758398 - protein, 18 aa, Mycobacterium
FEQACCSLGINLQPAHPD

SEQ ID NO: 758399 - protein, 22 aa, Mycobacterium
FEVNEAFAPVVLAWAHDTGADL

SEQ ID NO: 758400 - protein, 17 aa, Mycobacterium
FFGSFVFGTPGFPLSDV

SEQ ID NO: 758401 - protein, 17 aa, Mycobacterium
FFHRLGPVLARRLLLTG

SEQ ID NO: 758402 - protein, 17 aa, Mycobacterium
FFMRDVRSAQYFEQMKG

SEQ ID NO: 758403 - protein, 17 aa, Mycobacterium
FGEPIPVTSLLGFGSGM

SEQ ID NO: 758404 - protein, 17 aa, Mycobacterium
FGGAGGFGGASGFGTGG

SEQ ID NO: 758405 - protein, 20 aa, Mycobacterium
FGMPDAKAWIAYGASPRASL

SEQ ID NO: 758406 - protein, 18 aa, Mycobacterium
FGTVVARERAQAVAGLRA

SEQ ID NO: 758407 - protein, 18 aa, Mycobacterium
FGVPMGFGGPHAGYLAVH

SEQ ID NO: 758408 - protein, 18 aa, Mycobacterium
FGVPMGFGGPHAGYLSVH

SEQ ID NO: 758409 - protein, 19 aa, Mycobacterium
FKDAELLGMPWIVVVGRGW

SEQ ID NO: 758410 - protein, 19 aa, Mycobacterium
FKDAELLGVPWIVVVGRGW

SEQ ID NO: 758411 - protein, 17 aa, Mycobacterium
FKYPGIRSDSDMFTLGF

SEQ ID NO: 758412 - protein, 19 aa, Mycobacterium
FLDREGWDALTINALATQL

SEQ ID NO: 758413 - protein, 26 aa, Mycobacterium
FLHPELKWDFRLPRVVSINVSGHKYG

SEQ ID NO: 758414 - protein, 17 aa, Mycobacterium
FLMCTPLSHAGAAFFTP

SEQ ID NO: 758415 - protein, 19 aa, Mycobacterium
FPNLFATHRVRAVGDYASH

SEQ ID NO: 758416 - protein, 20 aa, Mycobacterium
FPPVELFMQLPWRTEIIQGL

SEQ ID NO: 758417 - protein, 20 aa, Mycobacterium
FPPVELFMQMPWRTEIVEGL

SEQ ID NO: 758418 - protein, 19 aa, Mycobacterium
FPRGLAAFIELRDQRCRTP

SEQ ID NO: 758419 - protein, 17 aa, Mycobacterium
FPTKEAVLFQDYETQLE

SEQ ID NO: 758420 - protein, 17 aa, Mycobacterium
FPTRMFTVLFALGRLPG

SEQ ID NO: 758421 - protein, 23 aa, Mycobacterium
FQAYAAACALHFAEKALTEIRAG

SEQ ID NO: 758422 - protein, 19 aa, Mycobacterium
FRASVCVLGPLVGRCKKAR

SEQ ID NO: 758423 - protein, 19 aa, Mycobacterium
FRASVCVLGPLVGRCKRAR

SEQ ID NO: 758424 - protein, 17 aa, Mycobacterium
FRDGVWLIELGDLSNGE

SEQ ID NO: 758425 - protein, 19 aa, Mycobacterium
FRECAARALLLPRRHPGKR

SEQ ID NO: 758426 - protein, 20 aa, Mycobacterium
FRGPRSFALPEFDPFWERVV

SEQ ID NO: 758427 - protein, 18 aa, Mycobacterium
FRHFPTKEAVLFQDYETQ

SEQ ID NO: 758428 - protein, 20 aa, Mycobacterium
FRHTFDWCVTSAFIMSQLVA

SEQ ID NO: 758429 - protein, 20 aa, Mycobacterium
FRLLVLRTAWLIDKHHDYQK

SEQ ID NO: 758430 - protein, 24 aa, Mycobacterium
FRPEVSDGLFLRLAVTSVDSLACA

SEQ ID NO: 758431 - protein, 17 aa, Mycobacterium
FRRKAVIIAVGGVYDPR

SEQ ID NO: 758432 - protein, 17 aa, Mycobacterium
FRYHGWGPRMWTWVQMM

SEQ ID NO: 758433 - protein, 17 aa, Mycobacterium
FSALAFKVATHPFFGKL

SEQ ID NO: 758434 - protein, 17 aa, Mycobacterium
FSDEFRIQLAWMRQSPP

SEQ ID NO: 758435 - protein, 17 aa, Mycobacterium
FSLWCGTTATADWHTRY

SEQ ID NO: 758436 - protein, 18 aa, Mycobacterium
FSPLRLPPDLDFTALFHG

SEQ ID NO: 758437 - protein, 18 aa, Mycobacterium
FSSLCWGERIAFDNPDSL

SEQ ID NO: 758438 - protein, 17 aa, Mycobacterium
FSTYATWWIRQAITRAM

SEQ ID NO: 758439 - protein, 20 aa, Mycobacterium
FTEHGLRLGVEAALRNLARV

SEQ ID NO: 758440 - protein, 19 aa, Mycobacterium
FTMDGPWGTWVNRWTAEEN

SEQ ID NO: 758441 - protein, 17 aa, Mycobacterium
FVACPFGAAGSRMYRTG

SEQ ID NO: 758442 - protein, 18 aa, Mycobacterium
FVACPFGAAGSRMYRTGD

SEQ ID NO: 758443 - protein, 17 aa, Mycobacterium
FVEAGLPPGVFQVVHGD

SEQ ID NO: 758444 - protein, 18 aa, Mycobacterium
FVSSPGYEHAWLNPDNTE

SEQ ID NO: 758445 - protein, 18 aa, Mycobacterium
FVVLDGLAKPGRLEGPDP

SEQ ID NO: 758446 - protein, 24 aa, Mycobacterium
FWASWCGPCRQFGPTFQASSEKHP

SEQ ID NO: 758447 - protein, 18 aa, Mycobacterium
FYCYSFEPNNDWTHFFAE

SEQ ID NO: 758448 - protein, 17 aa, Mycobacterium
FYFPRFRALCMAENATH

SEQ ID NO: 758449 - protein, 18 aa, Mycobacterium
GAEVRWASCNIFSTQDHA

SEQ ID NO: 758450 - protein, 23 aa, Mycobacterium
GAGGAAGWWGHGGIGGQGGTGGA

SEQ ID NO: 758451 - protein, 18 aa, Mycobacterium
GANLARREIRVVFDELRR

SEQ ID NO: 758452 - protein, 18 aa, Mycobacterium
GAPAHDWLTLTGGAIGYG

SEQ ID NO: 758453 - protein, 18 aa, Mycobacterium
GAPEELWDVLSLNNVPDD

SEQ ID NO: 758454 - protein, 17 aa, Mycobacterium
GAPMATKMTEWPGGVTV

SEQ ID NO: 758455 - protein, 19 aa, Mycobacterium
GCAGLRYNLFFDDRTLDGD

SEQ ID NO: 758456 - protein, 21 aa, Mycobacterium
GCAGLRYNLFFDDRTLDGDLT

SEQ ID NO: 758457 - protein, 19 aa, Mycobacterium
GCTKPCCTVGAYGCQVHHA

SEQ ID NO: 758458 - protein, 24 aa, Mycobacterium
GDDRVASLFLWHFVEEVEHRSSAL

SEQ ID NO: 758459 - protein, 17 aa, Mycobacterium
GDIAEWGKIGGMGPRIV

SEQ ID NO: 758460 - protein, 21 aa, Mycobacterium
GECSIEPWVFMNWRRAAYYLF

SEQ ID NO: 758461 - protein, 20 aa, Mycobacterium
GEGPRWFEGLLWFSDMLGEA

SEQ ID NO: 758462 - protein, 19 aa, Mycobacterium
GEKGEPCWPDGVVGSLTHC

SEQ ID NO: 758463 - protein, 17 aa, Mycobacterium
GEPFPYPVTVGYMYIMK

SEQ ID NO: 758464 - protein, 17 aa, Mycobacterium
GEVKDVLLLDVTPLSLG

SEQ ID NO: 758465 - protein, 18 aa, Mycobacterium
GFAGRAALGFGKRLTGKS

SEQ ID NO: 758466 - protein, 17 aa, Mycobacterium
GFLGRYLALEWLERMDL

SEQ ID NO: 758467 - protein, 19 aa, Mycobacterium
GGAAGWLIGNGGAGGQGGV

SEQ ID NO: 758468 - protein, 24 aa, Mycobacterium
GGAGGRGGLLIGLGGNGGTGGFSG

SEQ ID NO: 758469 - protein, 18 aa, Mycobacterium
GGLFGVLTNVVWTNRGPC

SEQ ID NO: 758470 - protein, 20 aa, Mycobacterium
GGPLTWPLHISLMLAKEYAL

SEQ ID NO: 758471 - protein, 17 aa, Mycobacterium
GGRSEAVLSHFVAQIDA

SEQ ID NO: 758472 - protein, 19 aa, Mycobacterium
GGVRDVVLCPGSRNAPLAF

SEQ ID NO: 758473 - protein, 20 aa, Mycobacterium
GGWYEHEWRAYGYGFPSAGT

SEQ ID NO: 758474 - protein, 23 aa, Mycobacterium
GHTWKCLADGLGAITHIATPKKG

SEQ ID NO: 758475 - protein, 21 aa, Mycobacterium
GIHVFLRIATDWDFVEVRRAG

SEQ ID NO: 758476 - protein, 19 aa, Mycobacterium
GKFLNNWRMAELHAQEAPD

SEQ ID NO: 758477 - protein, 18 aa, Mycobacterium
GKGMLLAIHLGRIKDAEG

SEQ ID NO: 758478 - protein, 17 aa, Mycobacterium
GKIRVAEGWAHGPEIDK

SEQ ID NO: 758479 - protein, 17 aa, Mycobacterium
GKKAVVFDDRWASARED

SEQ ID NO: 758480 - protein, 25 aa, Mycobacterium
GKLIAAAGWHAWRPAHLHVKVSAPG

SEQ ID NO: 758481 - protein, 17 aa, Mycobacterium
GKTPAQVLLRWNLQLGN

SEQ ID NO: 758482 - protein, 17 aa, Mycobacterium
GLAASKYWVCKRATPHA

SEQ ID NO: 758483 - protein, 21 aa, Mycobacterium
GLGTFSWPGAYGTWWQADPSA

SEQ ID NO: 758484 - protein, 19 aa, Mycobacterium
GLIEWKMDLELGAHYYVKF

SEQ ID NO: 758485 - protein, 18 aa, Mycobacterium
GLPADGWLRIIATCTEIG

SEQ ID NO: 758486 - protein, 23 aa, Mycobacterium
GLRGGILIPARWVGYPPYHDRRY

SEQ ID NO: 758487 - protein, 18 aa, Mycobacterium
GLVAIPWAQGDRSGVAFR

SEQ ID NO: 758488 - protein, 19 aa, Mycobacterium
GPRMWTWVQMMGLRKFQEM

SEQ ID NO: 758489 - protein, 28 aa, Mycobacterium
GPRPPRVPLSFAQSRLWFLEQLQGPSAV

SEQ ID NO: 758490 - protein, 18 aa, Mycobacterium
GPVLRPSSTLVRRIREFA

SEQ ID NO: 758491 - protein, 17 aa, Mycobacterium
GQLRWFGLDGVEHTGGP

SEQ ID NO: 758492 - protein, 17 aa, Mycobacterium
GRFTLAVGVGYLKREFA

SEQ ID NO: 758493 - protein, 21 aa, Mycobacterium
GRGPTPFRWSLTAGPAEPATV

SEQ ID NO: 758494 - protein, 19 aa, Mycobacterium
GRLAPRARVVLCGVISSYL

SEQ ID NO: 758495 - protein, 19 aa, Mycobacterium
GRLWLARGGTYVLANIRGG

SEQ ID NO: 758496 - protein, 17 aa, Mycobacterium
GRMLWSLPKGHIEMGET

SEQ ID NO: 758497 - protein, 17 aa, Mycobacterium
GRPFLAFLYGIAAHKVA

SEQ ID NO: 758498 - protein, 18 aa, Mycobacterium
GRVKQLLLKIGWPAEDLA

SEQ ID NO: 758499 - protein, 23 aa, Mycobacterium
GRWGRATLEVCFAILQSAYEDRE

SEQ ID NO: 758500 - protein, 18 aa, Mycobacterium
GSAKRITAILPFYPYARQ

SEQ ID NO: 758501 - protein, 27 aa, Mycobacterium
GSARKLAMEFARFLGLPPVRRMNVTDI

SEQ ID NO: 758502 - protein, 17 aa, Mycobacterium
GSDIAFLGGVINYILSN

SEQ ID NO: 758503 - protein, 23 aa, Mycobacterium
GSLRGTYRLTVCKPGSGDAPSVA

SEQ ID NO: 758504 - protein, 19 aa, Mycobacterium
GSMSLSFSDPRFDEVKAPV

SEQ ID NO: 758505 - protein, 20 aa, Mycobacterium
GTLARLEWIKARGYVITDTV

SEQ ID NO: 758506 - protein, 18 aa, Mycobacterium
GTPAKWARIWAQRHPDVL

SEQ ID NO: 758507 - protein, 18 aa, Mycobacterium
GVAYGYPGAPGQWWQQQV

SEQ ID NO: 758508 - protein, 23 aa, Mycobacterium
GVGFPTDPGLSFGGQGGAGGRGG

SEQ ID NO: 758509 - protein, 33 aa, Mycobacterium
GVGGRLYSGNGIPDIFGRPLIGDGADGAPGTGQ

SEQ ID NO: 758510 - protein, 20 aa, Mycobacterium
GVGLRAFELAVRYAQQRETF

SEQ ID NO: 758511 - protein, 20 aa, Mycobacterium
GVREACLWSPALAGAGVRRR

SEQ ID NO: 758512 - protein, 19 aa, Mycobacterium
GVVFYPVIPAGSWVATTEF

SEQ ID NO: 758513 - protein, 17 aa, Mycobacterium
GVWRGGASILMRAVLAA

SEQ ID NO: 758514 - protein, 17 aa, Mycobacterium
HAGHLVPLLALRRFQRA

SEQ ID NO: 758515 - protein, 24 aa, Mycobacterium
HAGKWRVVFFWPKDFTFVCPTEIA

SEQ ID NO: 758516 - protein, 18 aa, Mycobacterium
HDDWRWVIDIDLWGSIHA

SEQ ID NO: 758517 - protein, 20 aa, Mycobacterium
HDLYQRWPFFRSVLSNMAQV

SEQ ID NO: 758518 - protein, 19 aa, Mycobacterium
HFPTRADLIIAVYRHQVDA

SEQ ID NO: 758519 - protein, 21 aa, Mycobacterium
HGFGSFWWSWRHQLRGLTGAR

SEQ ID NO: 758520 - protein, 19 aa, Mycobacterium
HGPVRFPGVPTWFSQTPGR

SEQ ID NO: 758521 - protein, 21 aa, Mycobacterium
HGRRPRLINMYGITETTVHAS

SEQ ID NO: 758522 - protein, 18 aa, Mycobacterium
HMWFGDLVTMRWWDDLWL

SEQ ID NO: 758523 - protein, 18 aa, Mycobacterium
HMWFGDLVTMTWWDDLWL

SEQ ID NO: 758524 - protein, 18 aa, Mycobacterium
HPGCDVPGYLCEVHHVTD

SEQ ID NO: 758525 - protein, 20 aa, Mycobacterium
HPHARIAFMLTDTTPTAIIT

SEQ ID NO: 758526 - protein, 20 aa, Mycobacterium
HSAFKLLNWQGGSGNVLVSE

SEQ ID NO: 758527 - protein, 19 aa, Mycobacterium
HSLARLAIRDDIYASLRSL

SEQ ID NO: 758528 - protein, 19 aa, Mycobacterium
HSLARLAIRDDIYGSLRAL

SEQ ID NO: 758529 - protein, 22 aa, Mycobacterium
HSPLKLCWVPGYSDYYPETPGG

SEQ ID NO: 758530 - protein, 18 aa, Mycobacterium
HTEFPYIFCDATFCKVRV

SEQ ID NO: 758531 - protein, 19 aa, Mycobacterium
HTVRPAFEIIKTVPDVSTV

SEQ ID NO: 758532 - protein, 17 aa, Mycobacterium
HVPEWARRWQRLLFDNG

SEQ ID NO: 758533 - protein, 17 aa, Mycobacterium
HVVPRWGGDANFITIIG

SEQ ID NO: 758534 - protein, 18 aa, Mycobacterium
HVYEAALAWARRFSDHPV

SEQ ID NO: 758535 - protein, 18 aa, Mycobacterium
IAAGELHFSIGYSEPGAG

SEQ ID NO: 758536 - protein, 23 aa, Mycobacterium
IADRWEMADALNIRIHSERISDD

SEQ ID NO: 758537 - protein, 18 aa, Mycobacterium
IAGSCGMVIFGVTGDLAR

SEQ ID NO: 758538 - protein, 19 aa, Mycobacterium
IAHAWLFDHLIPIAGDVTG

SEQ ID NO: 758539 - protein, 17 aa, Mycobacterium
IAHAWSLSFDASWQPMV

SEQ ID NO: 758540 - protein, 25 aa, Mycobacterium
IAQARLGPGRIHHCMRALGGAERAL

SEQ ID NO: 758541 - protein, 17 aa, Mycobacterium
IATEIGRPVMVKAQVKV

SEQ ID NO: 758542 - protein, 19 aa, Mycobacterium
ICAFGRIGSMFACDDFGYV

SEQ ID NO: 758543 - protein, 19 aa, Mycobacterium
IDAPALWPGLPVRPVKGEV

SEQ ID NO: 758544 - protein, 24 aa, Mycobacterium
IDDIRWFDLYSCFPSAIEMTAEAL

SEQ ID NO: 758545 - protein, 27 aa, Mycobacterium
IDKFAPRLSFFWGIGMNFFMEVAKLRA

SEQ ID NO: 758546 - protein, 19 aa, Mycobacterium
IDLLLKRAASLGVQIRYET

SEQ ID NO: 758547 - protein, 17 aa, Mycobacterium
IDPEVYSGFAFGMGLER

SEQ ID NO: 758548 - protein, 18 aa, Mycobacterium
IDYARGRFDAIVPEDEQR

SEQ ID NO: 758549 - protein, 18 aa, Mycobacterium
IEAFRLLTLQTAWKIDQF

SEQ ID NO: 758550 - protein, 17 aa, Mycobacterium
IEAKGYCYGWHFYQAGD

SEQ ID NO: 758551 - protein, 20 aa, Mycobacterium
IEHWTRLPVEVELASEFRYR

SEQ ID NO: 758552 - protein, 19 aa, Mycobacterium
IEIGIKWLSLYAFSTENWK

SEQ ID NO: 758553 - protein, 19 aa, Mycobacterium
IEKMRVAGRIAAGALAEAG

SEQ ID NO: 758554 - protein, 19 aa, Mycobacterium
IELWPDWLPRRTFGSAPGQ

SEQ ID NO: 758555 - protein, 19 aa, Mycobacterium
IERFLQLWAEGSMTIAMPS

SEQ ID NO: 758556 - protein, 17 aa, Mycobacterium
IESRPAITLSWIRELPS

SEQ ID NO: 758557 - protein, 17 aa, Mycobacterium
IFLGRNGRISVFGSERA

SEQ ID NO: 758558 - protein, 20 aa, Mycobacterium
IGGARRCAAQSWSLDRIKSV

SEQ ID NO: 758559 - protein, 20 aa, Mycobacterium
IGGGMCFTFLAAQGYSVGTS

SEQ ID NO: 758560 - protein, 18 aa, Mycobacterium
IGGNWAFGNPNGHSSAYR

SEQ ID NO: 758561 - protein, 21 aa, Mycobacterium
IGRIKDLLIVYGRNHSPDDIE

SEQ ID NO: 758562 - protein, 18 aa, Mycobacterium
IHLEGPWLSRARCGAHDP

SEQ ID NO: 758563 - protein, 22 aa, Mycobacterium
IIVPGCLDLLFRGEIPEGVDPA

SEQ ID NO: 758564 - protein, 23 aa, Mycobacterium
IKELCRRWYPRIYFGQPPKGLAH

SEQ ID NO: 758565 - protein, 18 aa, Mycobacterium
IKLGPSLWHRDFHDAVIV

SEQ ID NO: 758566 - protein, 25 aa, Mycobacterium
ILASICFPSFPGFAGRLFATDDNDF

SEQ ID NO: 758567 - protein, 25 aa, Mycobacterium
ILGSMCFPSFPGFAGRLFATEDPEF

SEQ ID NO: 758568 - protein, 17 aa, Mycobacterium
INELLNWQVAASGETIA

SEQ ID NO: 758569 - protein, 17 aa, Mycobacterium
IPAVEAKGSLLLEDVGV

SEQ ID NO: 758570 - protein, 17 aa, Mycobacterium
IPFLPDVVREWRDKHPD

SEQ ID NO: 758571 - protein, 19 aa, Mycobacterium
IPSPAAGVLTKIVAQEDDT

SEQ ID NO: 758572 - protein, 19 aa, Mycobacterium
IPVGPRLGNVVVEVDHLDK

SEQ ID NO: 758573 - protein, 19 aa, Mycobacterium
IPVGPRLGNVVVEVEHLDK

SEQ ID NO: 758574 - protein, 21 aa, Mycobacterium
IPVKRLRQAGVLELLLALANE

SEQ ID NO: 758575 - protein, 17 aa, Mycobacterium
IQIPRFCDHPLLDPVGA

SEQ ID NO: 758576 - protein, 17 aa, Mycobacterium
IQLMAFAYDGAWAEYTV

SEQ ID NO: 758577 - protein, 19 aa, Mycobacterium
IRALYTFKRVAWWPYSVAM

SEQ ID NO: 758578 - protein, 19 aa, Mycobacterium
IRGLSKVAALEWGRDNIRV

SEQ ID NO: 758579 - protein, 17 aa, Mycobacterium
IRTLFGVMFQDGALFGS

SEQ ID NO: 758580 - protein, 27 aa, Mycobacterium
ISDLRAIPWVLAWSQSRVMLPGWYGTG

SEQ ID NO: 758581 - protein, 17 aa, Mycobacterium
ISGRVAFALGFEGPAVA

SEQ ID NO: 758582 - protein, 17 aa, Mycobacterium
ISSPGYEHAWLNPDNTE

SEQ ID NO: 758583 - protein, 23 aa, Mycobacterium
ITPWNFPVVLAFMKLAPALVAGN

SEQ ID NO: 758584 - protein, 18 aa, Mycobacterium
IVDDVIWGCVMQAGEQAL

SEQ ID NO: 758585 - protein, 25 aa, Mycobacterium
IVNYACIEWAVGVFRREAGGATECV

SEQ ID NO: 758586 - protein, 23 aa, Mycobacterium
IVSRGGSIMAAWCLAHHTESFLY

SEQ ID NO: 758587 - protein, 17 aa, Mycobacterium
IYFEGGYSFEYLNDPTK

SEQ ID NO: 758588 - protein, 23 aa, Mycobacterium
KAGPALACGNAFILKPSERDPSV

SEQ ID NO: 758589 - protein, 18 aa, Mycobacterium
KAGPMIAVKLHILTRKTL

SEQ ID NO: 758590 - protein, 19 aa, Mycobacterium
KAHEVRAYLTLAIITCEAM

SEQ ID NO: 758591 - protein, 24 aa, Mycobacterium
KANLKRAWELMGMRVHWQSSNDLV

SEQ ID NO: 758592 - protein, 23 aa, Mycobacterium
KCYSLRIASAMAHDEGWLAEHML

SEQ ID NO: 758593 - protein, 23 aa, Mycobacterium
KCYSLRIASAMARDEGWLAEHML

SEQ ID NO: 758594 - protein, 19 aa, Mycobacterium
KDARRGKEFARLIKNIEVA

SEQ ID NO: 758595 - protein, 18 aa, Mycobacterium
KDVHIGPSDHVGWLDDRK

SEQ ID NO: 758596 - protein, 21 aa, Mycobacterium
KEIAGRLAARIGSGLLVDVVE

SEQ ID NO: 758597 - protein, 23 aa, Mycobacterium
KEIQLRMVFGYDMFDDFPAVLAL

SEQ ID NO: 758598 - protein, 18 aa, Mycobacterium
KGEVKDVLLLDVTPLSLG

SEQ ID NO: 758599 - protein, 17 aa, Mycobacterium
KGFCAVAAEADWPDAYR

SEQ ID NO: 758600 - protein, 25 aa, Mycobacterium
KGIFTSNFGYRWGVLHAGIDLANSI

SEQ ID NO: 758601 - protein, 19 aa, Mycobacterium
KIVKFSGCYHGHSDALLAD

SEQ ID NO: 758602 - protein, 24 aa, Mycobacterium
KKFRFPTFLGAFKYYTSYTLKTFD

SEQ ID NO: 758603 - protein, 18 aa, Mycobacterium
KLHHPAAFCAALLRAQPM

SEQ ID NO: 758604 - protein, 24 aa, Mycobacterium
KLLRSDWLEPRWMVGIDPESEGLA

SEQ ID NO: 758605 - protein, 19 aa, Mycobacterium
KLREIRMALTLDKTFTKPE

SEQ ID NO: 758606 - protein, 19 aa, Mycobacterium
KLVPFGAFVRVEEGIEGLV

SEQ ID NO: 758607 - protein, 18 aa, Mycobacterium
KPGMTLLDIGCGWGTTMK

SEQ ID NO: 758608 - protein, 18 aa, Mycobacterium
KPLYGTSLVTGWASIHGF

SEQ ID NO: 758609 - protein, 22 aa, Mycobacterium
KQRSRLALWSRRLFGEAITQAQ

SEQ ID NO: 758610 - protein, 19 aa, Mycobacterium
KRRMFDLLVRMGYKEIEVG

SEQ ID NO: 758611 - protein, 20 aa, Mycobacterium
KSKLRTGGLLLNHCITRHDN

SEQ ID NO: 758612 - protein, 17 aa, Mycobacterium
KSVMFIIPWGSHWIIGT

SEQ ID NO: 758613 - protein, 18 aa, Mycobacterium
KTFWGWRDEQLPDGTLIW

SEQ ID NO: 758614 - protein, 22 aa, Mycobacterium
KTLRFWLERGVDGFRIDVAHGM

SEQ ID NO: 758615 - protein, 19 aa, Mycobacterium
KVPGARCALAWSVETASLA

SEQ ID NO: 758616 - protein, 18 aa, Mycobacterium
KVPRRLKELHLRLGAATA

SEQ ID NO: 758617 - protein, 20 aa, Mycobacterium
KVVVFRPLYAVGGQDLGYLP

SEQ ID NO: 758618 - protein, 21 aa, Mycobacterium
KWKFTVPFVCGATNLGEALRR

SEQ ID NO: 758619 - protein, 19 aa, Mycobacterium
KWQRSEPEFAYSDRERDGL

SEQ ID NO: 758620 - protein, 24 aa, Mycobacterium
KYAIEHWTRLPVEVELASEFRYRD

SEQ ID NO: 758621 - protein, 23 aa, Mycobacterium
LAAELRLPLVLVIDTAGPALSAD

SEQ ID NO: 758622 - protein, 20 aa, Mycobacterium
LAALRRPGSFLARQVPQFLK

SEQ ID NO: 758623 - protein, 17 aa, Mycobacterium
LAAWRLGAGRSRPGARV

SEQ ID NO: 758624 - protein, 17 aa, Mycobacterium
LADCRKLGITVLPPDVN

SEQ ID NO: 758625 - protein, 17 aa, Mycobacterium
LADLSFADYLMWVRRDD

SEQ ID NO: 758626 - protein, 20 aa, Mycobacterium
LAGCPRLKILATSREFFDID

SEQ ID NO: 758627 - protein, 21 aa, Mycobacterium
LALNHLVCTRFRSDALQIIAF

SEQ ID NO: 758628 - protein, 17 aa, Mycobacterium
LARDRWAVPLVHTAHTL

SEQ ID NO: 758629 - protein, 18 aa, Mycobacterium
LARLGKRVLRPGGVELTR

SEQ ID NO: 758630 - protein, 23 aa, Mycobacterium
LATQLRAGLFGVLYVLDEPSAGL

SEQ ID NO: 758631 - protein, 20 aa, Mycobacterium
LAWRTKRLIVFDVDSTLVQG

SEQ ID NO: 758632 - protein, 17 aa, Mycobacterium
LCPGSRNAPLAFALQDA

SEQ ID NO: 758633 - protein, 17 aa, Mycobacterium
LCRRRLLLDQTVLLAKN

SEQ ID NO: 758634 - protein, 23 aa, Mycobacterium
LDACRRCFASLFTDRAIHYRIDQ

SEQ ID NO: 758635 - protein, 21 aa, Mycobacterium
LDAPSVLGWAGFRDVAQRYSL

SEQ ID NO: 758636 - protein, 18 aa, Mycobacterium
LDEGRIVLVAGFQGVSQD

SEQ ID NO: 758637 - protein, 20 aa, Mycobacterium
LDERLHHLFARMPDARVHLY

SEQ ID NO: 758638 - protein, 22 aa, Mycobacterium
LDLCPRIRVNAIAPGSILTSAL

SEQ ID NO: 758639 - protein, 23 aa, Mycobacterium
LDVGCGWGGALVRAVEKYDVNVI

SEQ ID NO: 758640 - protein, 18 aa, Mycobacterium
LEGDAKWVESVEQLMEAV

SEQ ID NO: 758641 - protein, 18 aa, Mycobacterium
LELPDPPESWGWGKTAHL

SEQ ID NO: 758642 - protein, 18 aa, Mycobacterium
LELRTSWRNPPRALHLAN

SEQ ID NO: 758643 - protein, 18 aa, Mycobacterium
LEPPRFCAACGRRMIVQV

SEQ ID NO: 758644 - protein, 17 aa, Mycobacterium
LEPVGACRQCLVEVEGQ

SEQ ID NO: 758645 - protein, 20 aa, Mycobacterium
LEVEEVYLPLARLIHLQVAA

SEQ ID NO: 758646 - protein, 22 aa, Mycobacterium
LEVEEVYLPLARLIHLQVAARQ

SEQ ID NO: 758647 - protein, 17 aa, Mycobacterium
LEVWGWDEAYLGADLPD

SEQ ID NO: 758648 - protein, 17 aa, Mycobacterium
LEWDAVFLVGLADGTLP

SEQ ID NO: 758649 - protein, 18 aa, Mycobacterium
LFALLAYGEVAAFYRLTD

SEQ ID NO: 758650 - protein, 18 aa, Mycobacterium
LFKQLLMVAGMERYYQIA

SEQ ID NO: 758651 - protein, 18 aa, Mycobacterium
LFQAMGFLGDGAREIIAA

SEQ ID NO: 758652 - protein, 19 aa, Mycobacterium
LFYSGFYLPMYWSSRAKLT

SEQ ID NO: 758653 - protein, 17 aa, Mycobacterium
LGATLGFTVVALDRPGH

SEQ ID NO: 758654 - protein, 18 aa, Mycobacterium
LGDYDVLVGINLLREGLD

SEQ ID NO: 758655 - protein, 19 aa, Mycobacterium
LGEQCAFGLALIAPQLPPF

SEQ ID NO: 758656 - protein, 17 aa, Mycobacterium
LGVPGRPRRAGVSSFGI

SEQ ID NO: 758657 - protein, 23 aa, Mycobacterium
LHGECGWEYFAPVVVGDELTETR

SEQ ID NO: 758658 - protein, 19 aa, Mycobacterium
LHHPCCGDLVYGADPKLAK

SEQ ID NO: 758659 - protein, 19 aa, Mycobacterium
LHLPWQWGAAWFLDQLTDG

SEQ ID NO: 758660 - protein, 18 aa, Mycobacterium
LHPLSAPMTLRWLTDRFA

SEQ ID NO: 758661 - protein, 18 aa, Mycobacterium
LHYVKWYLDGTLTFRRSC

SEQ ID NO: 758662 - protein, 17 aa, Mycobacterium
LIAHCYRMLGSVHDAED

SEQ ID NO: 758663 - protein, 19 aa, Mycobacterium
LIGARLNWLLGHGESPQWS

SEQ ID NO: 758664 - protein, 25 aa, Mycobacterium
LIKSIGLRLGVPWYAYDTVTFSGEV

SEQ ID NO: 758665 - protein, 17 aa, Mycobacterium
LKAANTWHASRAIQEAR

SEQ ID NO: 758666 - protein, 17 aa, Mycobacterium
LKACIKAAADRVVFINT

SEQ ID NO: 758667 - protein, 20 aa, Mycobacterium
LKACIKAAADRVVFINTGFL

SEQ ID NO: 758668 - protein, 17 aa, Mycobacterium
LKFYASVRMDVRRIETL

SEQ ID NO: 758669 - protein, 18 aa, Mycobacterium
LKLSALRGLFSAVVEGPV

SEQ ID NO: 758670 - protein, 17 aa, Mycobacterium
LKNAIDWLSRPYGSGAL

SEQ ID NO: 758671 - protein, 21 aa, Mycobacterium
LKNVYAIAVGMGYSLGIGENT

SEQ ID NO: 758672 - protein, 17 aa, Mycobacterium
LKYLRGCSDLFRDGYTN

SEQ ID NO: 758673 - protein, 19 aa, Mycobacterium
LLADLSFADYLMWVRRDDG

SEQ ID NO: 758674 - protein, 18 aa, Mycobacterium
LLCNGAVGIAEGWATKVP

SEQ ID NO: 758675 - protein, 22 aa, Mycobacterium
LLDALRWLGLDWDEGPEVGGPY

SEQ ID NO: 758676 - protein, 18 aa, Mycobacterium
LLDRVSSKYALVIYAAKR

SEQ ID NO: 758677 - protein, 19 aa, Mycobacterium
LLDRVSSKYALVIYAAKRA

SEQ ID NO: 758678 - protein, 17 aa, Mycobacterium
LLEMGIRVRYLHSEVDT

SEQ ID NO: 758679 - protein, 23 aa, Mycobacterium
LLRARPGTRLVVAGVCMQPDTVH

SEQ ID NO: 758680 - protein, 24 aa, Mycobacterium
LLRREVPELAAFIDWEMCTIGDPL

SEQ ID NO: 758681 - protein, 19 aa, Mycobacterium
LLRSDILPLSFGFPFGFSA

SEQ ID NO: 758682 - protein, 17 aa, Mycobacterium
LLSGLLRAGRQVKDLVV

SEQ ID NO: 758683 - protein, 18 aa, Mycobacterium
LLTRNGWRSTTLAQIAGE

SEQ ID NO: 758684 - protein, 22 aa, Mycobacterium
LLVFGRRAGLGAADYVRALSSR

SEQ ID NO: 758685 - protein, 17 aa, Mycobacterium
LLVRERIELMLDPDTAF

SEQ ID NO: 758686 - protein, 18 aa, Mycobacterium
LMAAARLDLAAVFLYAGS

SEQ ID NO: 758687 - protein, 17 aa, Mycobacterium
LNEAGAPSAVWVVTPNG

SEQ ID NO: 758688 - protein, 24 aa, Mycobacterium
LNEFSLRVLHSFLADPGRPPRSGA

SEQ ID NO: 758689 - protein, 19 aa, Mycobacterium
LNFALGPFASMLDRARDLI

SEQ ID NO: 758690 - protein, 17 aa, Mycobacterium
LNSKTRRPSVCNAAETL

SEQ ID NO: 758691 - protein, 17 aa, Mycobacterium
LPHAVLMMIPEAWERHE

SEQ ID NO: 758692 - protein, 17 aa, Mycobacterium
LPLIWKRLVDAGMESGH

SEQ ID NO: 758693 - protein, 22 aa, Mycobacterium
LPTWQWEGLIGKSTRLVAVASA

SEQ ID NO: 758694 - protein, 23 aa, Mycobacterium
LPVKLCYAGPFFRYERPQAGRYR

SEQ ID NO: 758695 - protein, 19 aa, Mycobacterium
LQHPDTFARLGVDPPRGVL

SEQ ID NO: 758696 - protein, 19 aa, Mycobacterium
LQHPDTFARLGVEPPRGVL

SEQ ID NO: 758697 - protein, 20 aa, Mycobacterium
LQWLGIDCIWLPPFYDSPLR

SEQ ID NO: 758698 - protein, 17 aa, Mycobacterium
LRASVDWSHALLTEPER

SEQ ID NO: 758699 - protein, 18 aa, Mycobacterium
LRDLLKFDFYFADSAAFR

SEQ ID NO: 758700 - protein, 23 aa, Mycobacterium
LRDRLSEVLPAYMVPAAFMVIDQ

SEQ ID NO: 758701 - protein, 18 aa, Mycobacterium
LRGANLWDEVKDRLDRPG

SEQ ID NO: 758702 - protein, 18 aa, Mycobacterium
LRIAIVIWIERTYHRRRR

SEQ ID NO: 758703 - protein, 25 aa, Mycobacterium
LRIAPELFLKRCIVGGFDRVFELNR

SEQ ID NO: 758704 - protein, 20 aa, Mycobacterium
LRLADAWVWDMYRPARFVKQ

SEQ ID NO: 758705 - protein, 18 aa, Mycobacterium
LRLRGMSAMLARIKRRLR

SEQ ID NO: 758706 - protein, 17 aa, Mycobacterium
LRRCGAPLLSLRTDRDW

SEQ ID NO: 758707 - protein, 17 aa, Mycobacterium
LRTELRRAPRLGFEIDI

SEQ ID NO: 758708 - protein, 20 aa, Mycobacterium
LRTRVPFVHFFDGFRTSHEL

SEQ ID NO: 758709 - protein, 19 aa, Mycobacterium
LRWGQGAFRDFKVVPPGTG

SEQ ID NO: 758710 - protein, 17 aa, Mycobacterium
LSFSGGRHFCLGAALAR

SEQ ID NO: 758711 - protein, 18 aa, Mycobacterium
LSGGHLFSVYDGCREEGI

SEQ ID NO: 758712 - protein, 21 aa, Mycobacterium
LSGQVGWLARDRWAVPLVHTA

SEQ ID NO: 758713 - protein, 23 aa, Mycobacterium
LSKLARPTSTWTYMVNDNPLSDD

SEQ ID NO: 758714 - protein, 19 aa, Mycobacterium
LSKPFTFKRVEALRPAVQK

SEQ ID NO: 758715 - protein, 19 aa, Mycobacterium
LSKPFTFKRVEGLRPTIQQ

SEQ ID NO: 758716 - protein, 18 aa, Mycobacterium
LSKRGGGVALLLSNIREH

SEQ ID NO: 758717 - protein, 17 aa, Mycobacterium
LSWSAPRLHLVDLQYSD

SEQ ID NO: 758718 - protein, 19 aa, Mycobacterium
LSWSAPRLHLVDLQYSDVR

SEQ ID NO: 758719 - protein, 17 aa, Mycobacterium
LTFPGFLKAYVETVDEL

SEQ ID NO: 758720 - protein, 17 aa, Mycobacterium
LTPPVGVSGDWRPAHDE

SEQ ID NO: 758721 - protein, 17 aa, Mycobacterium
LVDCGRGVLQRAAAVGV

SEQ ID NO: 758722 - protein, 18 aa, Mycobacterium
LVDLRVARLLAYRAVSLQ

SEQ ID NO: 758723 - protein, 17 aa, Mycobacterium
LVDRWAPGRVMVNVYGP

SEQ ID NO: 758724 - protein, 20 aa, Mycobacterium
LVFGRRAGLGAADYVRALSS

SEQ ID NO: 758725 - protein, 19 aa, Mycobacterium
LVITHGWPGSIVEFHNVIE

SEQ ID NO: 758726 - protein, 18 aa, Mycobacterium
LVPFGAFVRVEEGIEGLV

SEQ ID NO: 758727 - protein, 19 aa, Mycobacterium
LVPPRVAMQILLTGDPITA

SEQ ID NO: 758728 - protein, 17 aa, Mycobacterium
LVRTCIFEVPKYLLSGG

SEQ ID NO: 758729 - protein, 18 aa, Mycobacterium
LWRFTPLKRLRGLHDGSA

SEQ ID NO: 758730 - protein, 21 aa, Mycobacterium
LYCRNRIEIVIAMLGIVKAGA

SEQ ID NO: 758731 - protein, 19 aa, Mycobacterium
LYEGFSLPAVEAMASGTPI

SEQ ID NO: 758732 - protein, 19 aa, Mycobacterium
LYFNLSLWSAYDVMLMHTV

SEQ ID NO: 758733 - protein, 22 aa, Mycobacterium
MALRLERFAVWLIFELLAVTLV

SEQ ID NO: 758734 - protein, 17 aa, Mycobacterium
MEIALTYIFGVGRTRSN

SEQ ID NO: 758735 - protein, 18 aa, Mycobacterium
MFFHRLGPVLARRLLLTG

SEQ ID NO: 758736 - protein, 17 aa, Mycobacterium
MFGGLAFLVNGNMSVAV

SEQ ID NO: 758737 - protein, 19 aa, Mycobacterium
MFLELSWEALERAGIEPGA

SEQ ID NO: 758738 - protein, 23 aa, Mycobacterium
MGAWAKRTGTIFIRRQTKDIPVY

SEQ ID NO: 758739 - protein, 17 aa, Mycobacterium
MGIPILYPWANRLGANT

SEQ ID NO: 758740 - protein, 23 aa, Mycobacterium
MGLARLWQSWGFEPDVVLGHSVG

SEQ ID NO: 758741 - protein, 22 aa, Mycobacterium
MGLARLWQSWGIEPDVVLGHSV

SEQ ID NO: 758742 - protein, 17 aa, Mycobacterium
MHARISGLADYFAVDEL

SEQ ID NO: 758743 - protein, 17 aa, Mycobacterium
MHPWGKWGRDFTEYGVV

SEQ ID NO: 758744 - protein, 25 aa, Mycobacterium
MIDVLRFWLGLGIDGFRLDAVPYLF

SEQ ID NO: 758745 - protein, 21 aa, Mycobacterium
MLEMLPTPWGLVRSGVAPDHP

SEQ ID NO: 758746 - protein, 19 aa, Mycobacterium
MPAMIRLGGKMYGADGRTK

SEQ ID NO: 758747 - protein, 18 aa, Mycobacterium
MPPALFAPIVENLAKADL

SEQ ID NO: 758748 - protein, 18 aa, Mycobacterium
MPYKSGFGPFAPEIYRAP

SEQ ID NO: 758749 - protein, 17 aa, Mycobacterium
MRAGLTWQQVVVLRAYA

SEQ ID NO: 758750 - protein, 18 aa, Mycobacterium
MRGGKFLNNWRMAELHAQ

SEQ ID NO: 758751 - protein, 18 aa, Mycobacterium
MRTVMCILNGQLRPVVVR

SEQ ID NO: 758752 - protein, 17 aa, Mycobacterium
MRVVRELSALPAEVEAA

SEQ ID NO: 758753 - protein, 20 aa, Mycobacterium
MSEVLPLLYLHGLSSNDFTP

SEQ ID NO: 758754 - protein, 18 aa, Mycobacterium
MSVGDLVIGWLLQQQAAV

SEQ ID NO: 758755 - protein, 19 aa, Mycobacterium
MVDAAICDGDWVVVRQQNV

SEQ ID NO: 758756 - protein, 18 aa, Mycobacterium
MVFGHRGINIPVIDHATG

SEQ ID NO: 758757 - protein, 22 aa, Mycobacterium
MVKAGVQWGLFGGAIENLGTER

SEQ ID NO: 758758 - protein, 19 aa, Mycobacterium
NDEWLKWLLVRRGSGGEFD

SEQ ID NO: 758759 - protein, 17 aa, Mycobacterium
NDGALGWAGTSPVGTFP

SEQ ID NO: 758760 - protein, 19 aa, Mycobacterium
NEDPGCPMGSYVAPDAIKN

SEQ ID NO: 758761 - protein, 18 aa, Mycobacterium
NEILKRAASFFGAELDRQ

SEQ ID NO: 758762 - protein, 19 aa, Mycobacterium
NFFPMGAWAKRTGTIFIRR

SEQ ID NO: 758763 - protein, 20 aa, Mycobacterium
NGGAAGWWGTGGAGGAGGEG

SEQ ID NO: 758764 - protein, 17 aa, Mycobacterium
NGIKIFGPGGHKLDDAT

SEQ ID NO: 758765 - protein, 20 aa, Mycobacterium
NIAPWLRAAHRYGAKVKWAE

SEQ ID NO: 758766 - protein, 24 aa, Mycobacterium
NIELWAVAVSTGFGGSAQPARAAG

SEQ ID NO: 758767 - protein, 17 aa, Mycobacterium
NLMPRWYIGSVLRHVDF

SEQ ID NO: 758768 - protein, 18 aa, Mycobacterium
NLVEYGFRLPSACDNRPL

SEQ ID NO: 758769 - protein, 23 aa, Mycobacterium
NRKVLPGYILVRMDLTDDSWAAV

SEQ ID NO: 758770 - protein, 19 aa, Mycobacterium
NRSTIRWTLHQLVASGVVS

SEQ ID NO: 758771 - protein, 21 aa, Mycobacterium
NRVSYFYDFRGPSVAVDTACS

SEQ ID NO: 758772 - protein, 27 aa, Mycobacterium
PAETFPATGVLPPWALISPHPENLSPD

SEQ ID NO: 758773 - protein, 19 aa, Mycobacterium
PALLRKQLKGAPMPAPRAI

SEQ ID NO: 758774 - protein, 19 aa, Mycobacterium
PALVGMPRWYAENGQYLTT

SEQ ID NO: 758775 - protein, 19 aa, Mycobacterium
PALVPLSFAQSRLWFLEQL

SEQ ID NO: 758776 - protein, 19 aa, Mycobacterium
PDIRCCILTGAGGYFCAGM

SEQ ID NO: 758777 - protein, 19 aa, Mycobacterium
PDLTIGFFLHIPFPPVELF

SEQ ID NO: 758778 - protein, 21 aa, Mycobacterium
PDPPESWGWGKTAHLLVGSLA

SEQ ID NO: 758779 - protein, 18 aa, Mycobacterium
PEATMCRFGVPLGPVAQP

SEQ ID NO: 758780 - protein, 20 aa, Mycobacterium
PEFIGRLPVVASVTNLDRES

SEQ ID NO: 758781 - protein, 17 aa, Mycobacterium
PEGFGRIAATTARQVML

SEQ ID NO: 758782 - protein, 20 aa, Mycobacterium
PEKRTRLGVGHFVETLETYR

SEQ ID NO: 758783 - protein, 23 aa, Mycobacterium
PERLRSGWLNGIKHWQVDYHTDG

SEQ ID NO: 758784 - protein, 17 aa, Mycobacterium
PETKGPMLINARADKVT

SEQ ID NO: 758785 - protein, 20 aa, Mycobacterium
PGAMARLGVWSGQGPQLDLH

SEQ ID NO: 758786 - protein, 17 aa, Mycobacterium
PGTEYVWFNNVETRPGQ

SEQ ID NO: 758787 - protein, 18 aa, Mycobacterium
PGTLEKWNLGYDVLSERN

SEQ ID NO: 758788 - protein, 19 aa, Mycobacterium
PGYPCYRNILSALGCEVVE

SEQ ID NO: 758789 - protein, 18 aa, Mycobacterium
PHGKQLWCSMSHDHGDER

SEQ ID NO: 758790 - protein, 19 aa, Mycobacterium
PHLEAFKAKGYEVLLLTDP

SEQ ID NO: 758791 - protein, 19 aa, Mycobacterium
PKAGPLIAVKLHILTRKTL

SEQ ID NO: 758792 - protein, 18 aa, Mycobacterium
PLLDLGWLLATWRQPDGS

SEQ ID NO: 758793 - protein, 17 aa, Mycobacterium
PLLDLGWMLVCWPDDPN

SEQ ID NO: 758794 - protein, 17 aa, Mycobacterium
PLRVKAAAVGLAADEYH

SEQ ID NO: 758795 - protein, 24 aa, Mycobacterium
PLWLRRRVGMCFQRPTPFPGTVAD

SEQ ID NO: 758796 - protein, 21 aa, Mycobacterium
PPDVIRRLGALGLLVMVTVTS

SEQ ID NO: 758797 - protein, 17 aa, Mycobacterium
PPTHFGFSLGDVTTGIM

SEQ ID NO: 758798 - protein, 17 aa, Mycobacterium
PQQRLLLEVAWEALEHA

SEQ ID NO: 758799 - protein, 23 aa, Mycobacterium
PRAEVLRPGLLVLPVRGAARFFG

SEQ ID NO: 758800 - protein, 17 aa, Mycobacterium
PRFLMCTPLSHAGAAFF

SEQ ID NO: 758801 - protein, 17 aa, Mycobacterium
PRVKIKIGESWGSDERR

SEQ ID NO: 758802 - protein, 17 aa, Mycobacterium
PSDSVAIALRVGVPIYV

SEQ ID NO: 758803 - protein, 17 aa, Mycobacterium
PSFPALLRKQLKGAPMP

SEQ ID NO: 758804 - protein, 17 aa, Mycobacterium
PSMRGVPFSFVRVDRAG

SEQ ID NO: 758805 - protein, 17 aa, Mycobacterium
PTFRGEMIWCQLFSEPG

SEQ ID NO: 758806 - protein, 19 aa, Mycobacterium
PTVIKWRDRFAAFGIEGLD

SEQ ID NO: 758807 - protein, 23 aa, Mycobacterium
PTWSGSLKSLWLGEGEAIGDILV

SEQ ID NO: 758808 - protein, 19 aa, Mycobacterium
PVGACATAAVSVEEGVDKI

SEQ ID NO: 758809 - protein, 18 aa, Mycobacterium
PVPMAYYSFGGWKASLFG

SEQ ID NO: 758810 - protein, 19 aa, Mycobacterium
PWLLMNWHRTMDWLLLAPT

SEQ ID NO: 758811 - protein, 18 aa, Mycobacterium
PYFLWRAEHVYNRHSGWT

SEQ ID NO: 758812 - protein, 18 aa, Mycobacterium
PYGQEWRALVAAMEGTLR

SEQ ID NO: 758813 - protein, 17 aa, Mycobacterium
PYTGWSVRDVICQDPDA

SEQ ID NO: 758814 - protein, 19 aa, Mycobacterium
QAKGFSLYAIRTILAGRSD

SEQ ID NO: 758815 - protein, 24 aa, Mycobacterium
QDFARASFSYGLNAKWPVYLSTKN

SEQ ID NO: 758816 - protein, 17 aa, Mycobacterium
QDIRFGLGAVRNVGANV

SEQ ID NO: 758817 - protein, 22 aa, Mycobacterium
QEVRWCPGCGDYVILNTIRNFL

SEQ ID NO: 758818 - protein, 24 aa, Mycobacterium
QEVRWCPGCGDYVILNTIRNFLPE

SEQ ID NO: 758819 - protein, 20 aa, Mycobacterium
QIGKFRLVFLTGPKQGDDDG

SEQ ID NO: 758820 - protein, 26 aa, Mycobacterium
QIIPWNFPILMAVWKLAPALAAGNAV

SEQ ID NO: 758821 - protein, 19 aa, Mycobacterium
QIRALVLGCAMDWLEDNKA

SEQ ID NO: 758822 - protein, 21 aa, Mycobacterium
QLFKQLLMVAGMERYYQIARC

SEQ ID NO: 758823 - protein, 19 aa, Mycobacterium
QLSLLRLGATLGFTVVALD

SEQ ID NO: 758824 - protein, 17 aa, Mycobacterium
QPGPGRGGMSLWVRLPA

SEQ ID NO: 758825 - protein, 29 aa, Mycobacterium
QQRPSRLVVCLDLDWRPQFRVDLVPSYKA

SEQ ID NO: 758826 - protein, 21 aa, Mycobacterium
QRAHECLRLLGVATEVLRGRQ

SEQ ID NO: 758827 - protein, 20 aa, Mycobacterium
QRFGVPMGFGGPHAGYLAVH

SEQ ID NO: 758828 - protein, 17 aa, Mycobacterium
QRLPFLPIRAGLGSDVR

SEQ ID NO: 758829 - protein, 20 aa, Mycobacterium
QRMEAAWGREYRRGRYMHKL

SEQ ID NO: 758830 - protein, 18 aa, Mycobacterium
QTGFARTGAMFACEHEGP

SEQ ID NO: 758831 - protein, 18 aa, Mycobacterium
QTTECWRQWINIGNFPDH

SEQ ID NO: 758832 - protein, 19 aa, Mycobacterium
QTTECWRQWINIGNFPDHP

SEQ ID NO: 758833 - protein, 22 aa, Mycobacterium
QVLGFREHASWALASDTLEFVD

SEQ ID NO: 758834 - protein, 18 aa, Mycobacterium
QYQLPGIVHGLRWIADGD

SEQ ID NO: 758835 - protein, 18 aa, Mycobacterium
RAAGIPILGKTNMDEFAM

SEQ ID NO: 758836 - protein, 19 aa, Mycobacterium
RAAGLKAANTWHASRAIQE

SEQ ID NO: 758837 - protein, 19 aa, Mycobacterium
RAEGVACYQLFISGLLDVT

SEQ ID NO: 758838 - protein, 19 aa, Mycobacterium
RAGSFSINGGNYFGADSPF

SEQ ID NO: 758839 - protein, 22 aa, Mycobacterium
RAGTNLKAWLYRILTNTYINSY

SEQ ID NO: 758840 - protein, 19 aa, Mycobacterium
RAGVLRFVVLDGLAKPGRL

SEQ ID NO: 758841 - protein, 20 aa, Mycobacterium
RAILRVAVWELLYADDVPEP

SEQ ID NO: 758842 - protein, 18 aa, Mycobacterium
RAYRLAWPAGTVVYEVDQ

SEQ ID NO: 758843 - protein, 17 aa, Mycobacterium
RCLKRQLARIVYRHLHT

SEQ ID NO: 758844 - protein, 19 aa, Mycobacterium
RDAHPRWGPTRIVYELQRD

SEQ ID NO: 758845 - protein, 23 aa, Mycobacterium
RDGQPRWTPIIAHLSDGRRVVAR

SEQ ID NO: 758846 - protein, 21 aa, Mycobacterium
RDGRWYWHWDPAFMTKPGDDP

SEQ ID NO: 758847 - protein, 25 aa, Mycobacterium
RELELRWAGLRAHNRWLADFCSLSP

SEQ ID NO: 758848 - protein, 23 aa, Mycobacterium
RELHVVEAWGLIFVSMAAQPPPF

SEQ ID NO: 758849 - protein, 20 aa, Mycobacterium
RELRSAGAVFGLLDVDDEFF

SEQ ID NO: 758850 - protein, 23 aa, Mycobacterium
REMAYEGKIDWAFAELLALGSLV

SEQ ID NO: 758851 - protein, 20 aa, Mycobacterium
REMLPHNAVEYFVSYYDYYQ

SEQ ID NO: 758852 - protein, 17 aa, Mycobacterium
REWGEPARYIWKLEFQR

SEQ ID NO: 758853 - protein, 19 aa, Mycobacterium
RFPEELGKMGFVFNFITYG

SEQ ID NO: 758854 - protein, 18 aa, Mycobacterium
RFRILPTLWEPGGDEITL

SEQ ID NO: 758855 - protein, 17 aa, Mycobacterium
RGAMIAIELVKSGTAEP

SEQ ID NO: 758856 - protein, 18 aa, Mycobacterium
RGFLRCVAALARAADTIG

SEQ ID NO: 758857 - protein, 18 aa, Mycobacterium
RGGLRWSDRRDDFRTEIL

SEQ ID NO: 758858 - protein, 18 aa, Mycobacterium
RGLRCIAPTWPLGAHPEP

SEQ ID NO: 758859 - protein, 20 aa, Mycobacterium
RGPIGLGYRVPCFVISPYSR

SEQ ID NO: 758860 - protein, 18 aa, Mycobacterium
RGRFRWWGLYTQRKPGYD

SEQ ID NO: 758861 - protein, 18 aa, Mycobacterium
RGTVMLRMPLHPVAIELL

SEQ ID NO: 758862 - protein, 17 aa, Mycobacterium
RGVGAWGEILGDTTVAA

SEQ ID NO: 758863 - protein, 24 aa, Mycobacterium
RHLFTVLMDREWKHGVAAAVDVTL

SEQ ID NO: 758864 - protein, 19 aa, Mycobacterium
RHWEHRWALSVLNTALGGG

SEQ ID NO: 758865 - protein, 20 aa, Mycobacterium
RIAGRLGLRPDVRRMPLFGL

SEQ ID NO: 758866 - protein, 18 aa, Mycobacterium
RIGHLVLCDAFRHPAVLA

SEQ ID NO: 758867 - protein, 17 aa, Mycobacterium
RIRGHAVEARLCAEDPA

SEQ ID NO: 758868 - protein, 17 aa, Mycobacterium
RKIAERRVFPAVDVNPS

SEQ ID NO: 758869 - protein, 19 aa, Mycobacterium
RKIVGWKVATEMTQKLVTD

SEQ ID NO: 758870 - protein, 23 aa, Mycobacterium
RLALGVGPSHHWIIRDMLGLPYE

SEQ ID NO: 758871 - protein, 17 aa, Mycobacterium
RLERLWLPGPDRLLDCV

SEQ ID NO: 758872 - protein, 20 aa, Mycobacterium
RLLAEVLRLRGWQVDFLGAQ

SEQ ID NO: 758873 - protein, 17 aa, Mycobacterium
RLRGWQVDFLGAQVPTP

SEQ ID NO: 758874 - protein, 18 aa, Mycobacterium
RLRLELDKGLGWKAEVEA

SEQ ID NO: 758875 - protein, 21 aa, Mycobacterium
RLSPGLKRSSLIGGIRYYDTV

SEQ ID NO: 758876 - protein, 19 aa, Mycobacterium
RLVDFAAGLAFALRGSFDK

SEQ ID NO: 758877 - protein, 22 aa, Mycobacterium
RMAFRSASYWDIVAQLDASVSD

SEQ ID NO: 758878 - protein, 22 aa, Mycobacterium
RMAFRSASYWDIVATLDASVSD

SEQ ID NO: 758879 - protein, 18 aa, Mycobacterium
RMGMRVEAVWKPREEWGF

SEQ ID NO: 758880 - protein, 18 aa, Mycobacterium
RMKFEGGVHRVQRVPVTE

SEQ ID NO: 758881 - protein, 24 aa, Mycobacterium
RMLTLPATFGLYVERAWPRHRRLS

SEQ ID NO: 758882 - protein, 20 aa, Mycobacterium
RPDLLVSLLTYWQRHPSLSY

SEQ ID NO: 758883 - protein, 18 aa, Mycobacterium
RPETAADEIVRWATPVSA

SEQ ID NO: 758884 - protein, 18 aa, Mycobacterium
RPFLRLEGSAVFRWAAFE

SEQ ID NO: 758885 - protein, 23 aa, Mycobacterium
RPGELIALLLPRTHRGIIAILAV

SEQ ID NO: 758886 - protein, 21 aa, Mycobacterium
RPGGRLGLVWNTRDERLGWVR

SEQ ID NO: 758887 - protein, 20 aa, Mycobacterium
RPGQKLRIVKYLAYGWSSLR

SEQ ID NO: 758888 - protein, 17 aa, Mycobacterium
RPKRYAAGFSRELEDEW

SEQ ID NO: 758889 - protein, 17 aa, Mycobacterium
RPLPVTRFDVRRAPAAL

SEQ ID NO: 758890 - protein, 18 aa, Mycobacterium
RPLRPSFVSGLRNEIQVV

SEQ ID NO: 758891 - protein, 17 aa, Mycobacterium
RPREVHVVPELPKTRSG

SEQ ID NO: 758892 - protein, 18 aa, Mycobacterium
RPRGRLMVVAIWEAPAGI

SEQ ID NO: 758893 - protein, 18 aa, Mycobacterium
RPRRAGVSSFGISGTNAH

SEQ ID NO: 758894 - protein, 22 aa, Mycobacterium
RQARFAAAFTFQYSKRPGTPAA

SEQ ID NO: 758895 - protein, 17 aa, Mycobacterium
RRAKRLIVFDVDSTLVQ

SEQ ID NO: 758896 - protein, 17 aa, Mycobacterium
RRCGWFDAVIARYATRV

SEQ ID NO: 758897 - protein, 25 aa, Mycobacterium
RRFLERRLREAFGFEGSPIRINVRV

SEQ ID NO: 758898 - protein, 18 aa, Mycobacterium
RRIIPPWVTLGSRLAVLP

SEQ ID NO: 758899 - protein, 18 aa, Mycobacterium
RRMFDLLVRMGYKEIEVG

SEQ ID NO: 758900 - protein, 19 aa, Mycobacterium
RRVFAHGFLLNRGEKMSKS

SEQ ID NO: 758901 - protein, 24 aa, Mycobacterium
RRWQRLLFDNGWLLPGQPPEFGGR

SEQ ID NO: 758902 - protein, 19 aa, Mycobacterium
RSAAYAMRWVAKNVVAAGL

SEQ ID NO: 758903 - protein, 18 aa, Mycobacterium
RSGFKEIHDRGGFLSGAT

SEQ ID NO: 758904 - protein, 22 aa, Mycobacterium
RSTTLALRWLVGYSRQRREKTM

SEQ ID NO: 758905 - protein, 22 aa, Mycobacterium
RSYNCLKREGVHTVGELVSRTE

SEQ ID NO: 758906 - protein, 23 aa, Mycobacterium
RSYNCLKREGVHTVGELVSRTES

SEQ ID NO: 758907 - protein, 22 aa, Mycobacterium
RSYSPRFLFAWPNSKSAVMGPA

SEQ ID NO: 758908 - protein, 22 aa, Mycobacterium
RTAFCHHVHFFATREAAEPWLA

SEQ ID NO: 758909 - protein, 17 aa, Mycobacterium
RTDRDWIADIVRFVESR

SEQ ID NO: 758910 - protein, 20 aa, Mycobacterium
RTIRLPVHLVEQVNKLARIK

SEQ ID NO: 758911 - protein, 17 aa, Mycobacterium
RTLRLDQMIRYYVEHQL

SEQ ID NO: 758912 - protein, 22 aa, Mycobacterium
RTLWSGMTWQYWKALRRLDPSE

SEQ ID NO: 758913 - protein, 19 aa, Mycobacterium
RTPTIASVHGWCIGGGVDL

SEQ ID NO: 758914 - protein, 22 aa, Mycobacterium
RTRKAGAVGLVMAEPLTYFFSD

SEQ ID NO: 758915 - protein, 19 aa, Mycobacterium
RVAALRRCVPMVGQIKDPT

SEQ ID NO: 758916 - protein, 18 aa, Mycobacterium
RVADGWIKAQAYRLQTFG

SEQ ID NO: 758917 - protein, 27 aa, Mycobacterium
RVEAVWKPREEWGFGIDNIEYFRPTGE

SEQ ID NO: 758918 - protein, 20 aa, Mycobacterium
RVIRTLRRLGIRSVAVYSDP

SEQ ID NO: 758919 - protein, 20 aa, Mycobacterium
RWFRHAGGVNPCLPETVSGR

SEQ ID NO: 758920 - protein, 17 aa, Mycobacterium
RYDLAVQEIFVFTPKGD

SEQ ID NO: 758921 - protein, 19 aa, Mycobacterium
RYRGLRAPHKIKMGVSGCA

SEQ ID NO: 758922 - protein, 25 aa, Mycobacterium
SAAHKARWGVCLARTDPDAPKHKGI

SEQ ID NO: 758923 - protein, 23 aa, Mycobacterium
SDDPRFLFYPAIKELTLDIASEV

SEQ ID NO: 758924 - protein, 22 aa, Mycobacterium
SDIKNLLPMFAVFKPTVVVSVP

SEQ ID NO: 758925 - protein, 24 aa, Mycobacterium
SDPLRAGMRLGLIPTVAPYVLPTV

SEQ ID NO: 758926 - protein, 17 aa, Mycobacterium
SDVADWCLLLARTDPAA

SEQ ID NO: 758927 - protein, 18 aa, Mycobacterium
SFGFKYGLPMDADMVMDV

SEQ ID NO: 758928 - protein, 18 aa, Mycobacterium
SFQLFPNFVMLFWGQGWY

SEQ ID NO: 758929 - protein, 25 aa, Mycobacterium
SFSRYELLRLLAFSRTGALPITKAS

SEQ ID NO: 758930 - protein, 20 aa, Mycobacterium
SGGMCQRALIAIGLAGRPRL

SEQ ID NO: 758931 - protein, 23 aa, Mycobacterium
SGGRVSLGVGFGWNTDELADHGV

SEQ ID NO: 758932 - protein, 23 aa, Mycobacterium
SGGRVSLGVGFGWNTDELADHNV

SEQ ID NO: 758933 - protein, 19 aa, Mycobacterium
SGLIKWAFLQNGKSLPRSS

SEQ ID NO: 758934 - protein, 17 aa, Mycobacterium
SHALSFASLVFYSSWFK

SEQ ID NO: 758935 - protein, 24 aa, Mycobacterium
SHFLPRIVRGECFFGIGMSEPDSG

SEQ ID NO: 758936 - protein, 17 aa, Mycobacterium
SHPIVFGHAVKVFYKDA

SEQ ID NO: 758937 - protein, 20 aa, Mycobacterium
SIFLMCLPDRVLAYGDCAII

SEQ ID NO: 758938 - protein, 22 aa, Mycobacterium
SKNPKEHFDFFPLTVDVEERMY

SEQ ID NO: 758939 - protein, 26 aa, Mycobacterium
SKPLVRLRVPFTLSRNEIDDVERGSQ

SEQ ID NO: 758940 - protein, 24 aa, Mycobacterium
SLEEVFIRAGIPYKVVGGVRFYER

SEQ ID NO: 758941 - protein, 18 aa, Mycobacterium
SMCFPTFTGFSARHLNMT

SEQ ID NO: 758942 - protein, 22 aa, Mycobacterium
SMMPMRVIGMLLGIPESEQVSV

SEQ ID NO: 758943 - protein, 19 aa, Mycobacterium
SNLKCLCRFHHLLKTFWTG

SEQ ID NO: 758944 - protein, 21 aa, Mycobacterium
SNLKCLCRFHHLLKTFWTGPR

SEQ ID NO: 758945 - protein, 22 aa, Mycobacterium
SNLSCGRFLLGLGASGPQVIEG

SEQ ID NO: 758946 - protein, 17 aa, Mycobacterium
SPEEVRFLMGFNRDVVR

SEQ ID NO: 758947 - protein, 20 aa, Mycobacterium
SPGYPCYRNILSALGCEVVE

SEQ ID NO: 758948 - protein, 17 aa, Mycobacterium
SRAGLGYEVIVSRLDDE

SEQ ID NO: 758949 - protein, 19 aa, Mycobacterium
SRGRFPGRYRLAVLENLSR

SEQ ID NO: 758950 - protein, 21 aa, Mycobacterium
SRIDIPGWLARTGFQMLDPIK

SEQ ID NO: 758951 - protein, 20 aa, Mycobacterium
SSFRYAGPAGRDWTTADLAG

SEQ ID NO: 758952 - protein, 20 aa, Mycobacterium
SSPVGFRWFRHAGGVNPCLP

SEQ ID NO: 758953 - protein, 22 aa, Mycobacterium
STKRVCRDCGFFLPLSGSLGAM

SEQ ID NO: 758954 - protein, 18 aa, Mycobacterium
STSRELPWRRPIASLNYL

SEQ ID NO: 758955 - protein, 24 aa, Mycobacterium
TAHFCSMCGPKFCSMRITADVRAY

SEQ ID NO: 758956 - protein, 18 aa, Mycobacterium
TAKLRAAQRVQRFLDAAQ

SEQ ID NO: 758957 - protein, 18 aa, Mycobacterium
TALPTCPPLVIWDLTTPQ

SEQ ID NO: 758958 - protein, 21 aa, Mycobacterium
TALRLPRDAKLVVDGQDVVAD

SEQ ID NO: 758959 - protein, 22 aa, Mycobacterium
TAWPPWRPGVLFTGDSLGAGKP

SEQ ID NO: 758960 - protein, 18 aa, Mycobacterium
TCHYCTFVTVPGKLRAQG

SEQ ID NO: 758961 - protein, 25 aa, Mycobacterium
TDEVSEAIASLFSGHALDYQSLGAR

SEQ ID NO: 758962 - protein, 24 aa, Mycobacterium
TDHRPEILLSFGFVPKMESRVGLI

SEQ ID NO: 758963 - protein, 19 aa, Mycobacterium
TDLAWARITYWRALLTSAV

SEQ ID NO: 758964 - protein, 21 aa, Mycobacterium
TEKPFLMPVEDVFTITGRGTV

SEQ ID NO: 758965 - protein, 17 aa, Mycobacterium
TESRMAIAMARAGGMGV

SEQ ID NO: 758966 - protein, 17 aa, Mycobacterium
TEVRPILLWHAFEESEH

SEQ ID NO: 758967 - protein, 22 aa, Mycobacterium
TGAGVSGLWLLSGMSDDGVLTT

SEQ ID NO: 758968 - protein, 17 aa, Mycobacterium
TGARWLCETFPTRLERG

SEQ ID NO: 758969 - protein, 26 aa, Mycobacterium
TGEVLSVPVGDAFLGRVINPLGQPID

SEQ ID NO: 758970 - protein, 25 aa, Mycobacterium
TGEVLSVPVGDAFLGRVVNPLGQPI

SEQ ID NO: 758971 - protein, 20 aa, Mycobacterium
TGLRWSELVGLRVGDIDLKA

SEQ ID NO: 758972 - protein, 18 aa, Mycobacterium
TGSFRWASARALRLAARL

SEQ ID NO: 758973 - protein, 17 aa, Mycobacterium
TIAHGFMTLSLLPRLQH

SEQ ID NO: 758974 - protein, 22 aa, Mycobacterium
TLDDVVKFLLPRGATKKAAKGA

SEQ ID NO: 758975 - protein, 17 aa, Mycobacterium
TLFRRFGSRAGLMMVLL

SEQ ID NO: 758976 - protein, 18 aa, Mycobacterium
TLFRRFGTRAGLMMVLLD

SEQ ID NO: 758977 - protein, 17 aa, Mycobacterium
TLGSLALMGVRVEELIV

SEQ ID NO: 758978 - protein, 17 aa, Mycobacterium
TMYAGWRAVIAGFVARR

SEQ ID NO: 758979 - protein, 18 aa, Mycobacterium
TNDARFLFHPAMKELTLD

SEQ ID NO: 758980 - protein, 25 aa, Mycobacterium
TNNRFGFGVGIGWAPEEFEWCGVPY

SEQ ID NO: 758981 - protein, 21 aa, Mycobacterium
TPEMAPRILAMAMRAAVEDNG

SEQ ID NO: 758982 - protein, 19 aa, Mycobacterium
TPPPTGWRLLDTAVEQAQI

SEQ ID NO: 758983 - protein, 20 aa, Mycobacterium
TPVPPLKWWRGIQARKTLED

SEQ ID NO: 758984 - protein, 17 aa, Mycobacterium
TQLCAFTAGVLRAEATH

SEQ ID NO: 758985 - protein, 17 aa, Mycobacterium
TRRPSVCNAAETLLVDA

SEQ ID NO: 758986 - protein, 18 aa, Mycobacterium
TRRVPGYHILKAHMSSSI

SEQ ID NO: 758987 - protein, 18 aa, Mycobacterium
TTLFPPVRPRQWLEIRYL

SEQ ID NO: 758988 - protein, 24 aa, Mycobacterium
VAACLKWEGGYVWACKNYDGDVQS

SEQ ID NO: 758989 - protein, 25 aa, Mycobacterium
VAACLKWEGGYVWACKNYDGDVQSD

SEQ ID NO: 758990 - protein, 18 aa, Mycobacterium
VAALLRWLADGHFVLLGY

SEQ ID NO: 758991 - protein, 18 aa, Mycobacterium
VACGYYVFEAENLDEALA

SEQ ID NO: 758992 - protein, 19 aa, Mycobacterium
VACPFGGPGARMYRTGDLV

SEQ ID NO: 758993 - protein, 18 aa, Mycobacterium
VAELAQWISVHGGARVRA

SEQ ID NO: 758994 - protein, 19 aa, Mycobacterium
VAGDWQLCRRRLLLDQTVL

SEQ ID NO: 758995 - protein, 24 aa, Mycobacterium
VAHFDWLVGCGVPFKAEFFSEPGW

SEQ ID NO: 758996 - protein, 17 aa, Mycobacterium
VALLKILALQFIMSDPR

SEQ ID NO: 758997 - protein, 26 aa, Mycobacterium
VALYRLLESWGMRPGLVMGHSVGELS

SEQ ID NO: 758998 - protein, 18 aa, Mycobacterium
VAVDGRFSGISIAINQRT

SEQ ID NO: 758999 - protein, 17 aa, Mycobacterium
VAVKAPFFGDRRKAFLD

SEQ ID NO: 759000 - protein, 18 aa, Mycobacterium
VCGPPSYTVSTFFHGVNH

SEQ ID NO: 759001 - protein, 17 aa, Mycobacterium
VCSTGLIGDRLPMDKVL

SEQ ID NO: 759002 - protein, 24 aa, Mycobacterium
VDERARAGLFLAMQYPVEVPGVSM

SEQ ID NO: 759003 - protein, 19 aa, Mycobacterium
VEEFVRWATPIMTFRRTAA

SEQ ID NO: 759004 - protein, 21 aa, Mycobacterium
VEFWAFDLLYLDGRSLLRARY

SEQ ID NO: 759005 - protein, 18 aa, Mycobacterium
VEIREFLEGYVIGQDTAK

SEQ ID NO: 759006 - protein, 18 aa, Mycobacterium
VELDERWVVIGPNGAGKT

SEQ ID NO: 759007 - protein, 18 aa, Mycobacterium
VETARLWLSLGHHDRHGV

SEQ ID NO: 759008 - protein, 18 aa, Mycobacterium
VFETLAWGRRHVVMGANQ

SEQ ID NO: 759009 - protein, 18 aa, Mycobacterium
VFETLSWGRRHVVMGANQ

SEQ ID NO: 759010 - protein, 17 aa, Mycobacterium
VFPSHYEPFGLVALEAA

SEQ ID NO: 759011 - protein, 17 aa, Mycobacterium
VGACARGLMSREDVDII

SEQ ID NO: 759012 - protein, 18 aa, Mycobacterium
VGAFPLALARRSLSGSNI

SEQ ID NO: 759013 - protein, 17 aa, Mycobacterium
VGAWGEILGDTTVAAAM

SEQ ID NO: 759014 - protein, 17 aa, Mycobacterium
VGEMFGRKVARLMEWCA

SEQ ID NO: 759015 - protein, 20 aa, Mycobacterium
VGLIGFGGAGGFGGASGFGT

SEQ ID NO: 759016 - protein, 25 aa, Mycobacterium
VGYWRRGGLSAARFVACPFGAGGSR

SEQ ID NO: 759017 - protein, 18 aa, Mycobacterium
VITHGWPGSIVEFHKVIE

SEQ ID NO: 759018 - protein, 19 aa, Mycobacterium
VKVPRRLKELHLRLGTATA

SEQ ID NO: 759019 - protein, 20 aa, Mycobacterium
VNGFCVGGGIGLVGNSDVIV

SEQ ID NO: 759020 - protein, 21 aa, Mycobacterium
VNQRWLGGMLTNFSTVHKRLQ

SEQ ID NO: 759021 - protein, 22 aa, Mycobacterium
VNSWSAAFARYGRTVGQVLLTA

SEQ ID NO: 759022 - protein, 17 aa, Mycobacterium
VPAHSQLAWVLGCFTGF

SEQ ID NO: 759023 - protein, 25 aa, Mycobacterium
VPAHSQLAWVLGCFTGFGQASRMTQ

SEQ ID NO: 759024 - protein, 18 aa, Mycobacterium
VPDIPRLPSGKVLRRVLK

SEQ ID NO: 759025 - protein, 21 aa, Mycobacterium
VPMFPNLFLLYGPNTNVGSGS

SEQ ID NO: 759026 - protein, 20 aa, Mycobacterium
VPPGRLGWGWAKFAFNSWTT

SEQ ID NO: 759027 - protein, 19 aa, Mycobacterium
VPRGISFLLNRNRLNVAVS

SEQ ID NO: 759028 - protein, 17 aa, Mycobacterium
VRLARAGADIVAIDACA

SEQ ID NO: 759029 - protein, 17 aa, Mycobacterium
VRVDTWGGWLWINMDPD

SEQ ID NO: 759030 - protein, 18 aa, Mycobacterium
VRVGYTLGSTGTCLQVDD

SEQ ID NO: 759031 - protein, 21 aa, Mycobacterium
VSCAIQNLWLAARAEGLGMGW

SEQ ID NO: 759032 - protein, 18 aa, Mycobacterium
VSEIIRWQTPLAYMRRVA

SEQ ID NO: 759033 - protein, 18 aa, Mycobacterium
VTQWTRWRQPVIGMPTTP

SEQ ID NO: 759034 - protein, 17 aa, Mycobacterium
VVEALKFHLRDLAVTFR

SEQ ID NO: 759035 - protein, 18 aa, Mycobacterium
VVEALKFHLRDLAVTFRF

SEQ ID NO: 759036 - protein, 19 aa, Mycobacterium
VVEFACGIPHLLKGGFTEN

SEQ ID NO: 759037 - protein, 17 aa, Mycobacterium
VVFRPLYAVGGQELGYL

SEQ ID NO: 759038 - protein, 17 aa, Mycobacterium
VVPDFQLSLAIGKEGQN

SEQ ID NO: 759039 - protein, 18 aa, Mycobacterium
VVVFRPLYAVGGQELGYL

SEQ ID NO: 759040 - protein, 17 aa, Mycobacterium
VWAMRYTLERAMRGQDT

SEQ ID NO: 759041 - protein, 19 aa, Mycobacterium
VWIGHDWGAAVVWNAPLLH

SEQ ID NO: 759042 - protein, 20 aa, Mycobacterium
VWVHPEWRGLGLGTAGTATV

SEQ ID NO: 759043 - protein, 24 aa, Mycobacterium
VYFELRLSDAWVWDMYRPARFVKQ

SEQ ID NO: 759044 - protein, 18 aa, Mycobacterium
VYPPCSAFEAWFVSAALD

SEQ ID NO: 759045 - protein, 17 aa, Mycobacterium
VYQCRACGAELFRSTEK

SEQ ID NO: 759046 - protein, 19 aa, Mycobacterium
WAGSLKRHGEWTVPTRLAL

SEQ ID NO: 759047 - protein, 18 aa, Mycobacterium
WAQHLRKPVRFYDGVTRL

SEQ ID NO: 759048 - protein, 17 aa, Mycobacterium
WDAVLAVNLLAPLRLTE

SEQ ID NO: 759049 - protein, 26 aa, Mycobacterium
WFVGKKGGPGWVEWGGCGMVHPNVLR

SEQ ID NO: 759050 - protein, 17 aa, Mycobacterium
WGAGFPERWWWGQAHDF

SEQ ID NO: 759051 - protein, 17 aa, Mycobacterium
WGGLRVGWIRAERSTLA

SEQ ID NO: 759052 - protein, 17 aa, Mycobacterium
WGKIGGMGPRIVGSGET

SEQ ID NO: 759053 - protein, 23 aa, Mycobacterium
WKIGAVPVPMHWDLPEWERDRVR

SEQ ID NO: 759054 - protein, 17 aa, Mycobacterium
WPGIDWPATQSMAEQVL

SEQ ID NO: 759055 - protein, 21 aa, Mycobacterium
WRGGCIIRAKFLNRIKDAFDE

SEQ ID NO: 759056 - protein, 17 aa, Mycobacterium
WRIKANWKIGAENFAGD

SEQ ID NO: 759057 - protein, 17 aa, Mycobacterium
WRPQFRVDLVPSYKAHR

SEQ ID NO: 759058 - protein, 17 aa, Mycobacterium
WSAPRLHLVDLQYSDVR

SEQ ID NO: 759059 - protein, 17 aa, Mycobacterium
WTMLGAWAEQTSRIQIG

SEQ ID NO: 759060 - protein, 17 aa, Mycobacterium
WWGARPLWFALWSGVFE

SEQ ID NO: 759061 - protein, 21 aa, Mycobacterium
YAFDPCCPFGGYKNSGIGREN

SEQ ID NO: 759062 - protein, 17 aa, Mycobacterium
YASLGLRLDYDPHLRRV

SEQ ID NO: 759063 - protein, 19 aa, Mycobacterium
YATCPACGGARYSDETLEV

SEQ ID NO: 759064 - protein, 18 aa, Mycobacterium
YAVPRLLARNGLTLQDFD

SEQ ID NO: 759065 - protein, 21 aa, Mycobacterium
YDILFFWVARMMMFGTFVGDD

SEQ ID NO: 759066 - protein, 21 aa, Mycobacterium
YDILFFWVARMMMFGTFVGGD

SEQ ID NO: 759067 - protein, 23 aa, Mycobacterium
YEIKGCIAHGGLGWVYLAFDKNV

SEQ ID NO: 759068 - protein, 21 aa, Mycobacterium
YEKLEGVPLTFAGKVNRLAIM

SEQ ID NO: 759069 - protein, 19 aa, Mycobacterium
YENAMRWYHWDPFTHIAKE

SEQ ID NO: 759070 - protein, 17 aa, Mycobacterium
YERKEIRDIVAYLRVLD

SEQ ID NO: 759071 - protein, 18 aa, Mycobacterium
YGDFRYAINNSFGFGGHN

SEQ ID NO: 759072 - protein, 24 aa, Mycobacterium
YGHYGGLFIRMSWHAAGTYRIHDG

SEQ ID NO: 759073 - protein, 20 aa, Mycobacterium
YIFCDATFCKVRVGAHVVSQ

SEQ ID NO: 759074 - protein, 23 aa, Mycobacterium
YKSEPWARLGVNVDHDFEPLYII

SEQ ID NO: 759075 - protein, 17 aa, Mycobacterium
YNPLFIWGESGLGKTHL

SEQ ID NO: 759076 - protein, 17 aa, Mycobacterium
YPIELGMTIRLARDKNY

SEQ ID NO: 759077 - protein, 19 aa, Mycobacterium
YPVGFAWAMCTPFQFTKQF

SEQ ID NO: 759078 - protein, 17 aa, Mycobacterium
YRFPGLLPGDRWCVTAL

SEQ ID NO: 759079 - protein, 22 aa, Mycobacterium
YRGCTHACRYCFARPTHEYLDF

SEQ ID NO: 759080 - protein, 18 aa, Mycobacterium
YRGLRAPHKIKMGVSGCA

SEQ ID NO: 759081 - protein, 18 aa, Mycobacterium
YRPGTRFGPMGIRRSTNL

SEQ ID NO: 759082 - protein, 17 aa, Mycobacterium
YRRVLAMAWEKQSESNA

SEQ ID NO: 759083 - protein, 19 aa, Mycobacterium
YRTMRGYKVERRFGWDTHG

SEQ ID NO: 759084 - protein, 20 aa, Mycobacterium
YSALRLAPRFVDPSTLNPPG

SEQ ID NO: 759085 - protein, 20 aa, Mycobacterium
YTHRPSWPAGIAVGKTAVSS

SEQ ID NO: 759086 - protein, 28 aa, Mycobacterium
YVALACFKLGIVIEGTWSRYLAGQANRE

SEQ ID NO: 759087 - protein, 17 aa, Mycobacterium
YWGGVCLNVGCIPSKAL

SEQ ID NO: 759088 - protein, 23 aa, Mycobacterium
YWYRNLREPVEFYSCVAQLLAHS

SEQ ID NO: 759089 - protein, 17 aa, Mycobacterium
AAAAGFPRPILHGLCTY

SEQ ID NO: 759090 - protein, 18 aa, Mycobacterium
AAAARLGDRLSIHDQPNL

SEQ ID NO: 759091 - protein, 17 aa, Mycobacterium
AAAARLGNRLSLHDQPN

SEQ ID NO: 759092 - protein, 23 aa, Mycobacterium
AAAARLLPAQSLQDLLAALPNLG

SEQ ID NO: 759093 - protein, 18 aa, Mycobacterium
AAAARWARTFGIGPFHVL

SEQ ID NO: 759094 - protein, 19 aa, Mycobacterium
AAAAWMFDYYPLRDITERP

SEQ ID NO: 759095 - protein, 20 aa, Mycobacterium
AAAAWNRLAVELGTTAASFE

SEQ ID NO: 759096 - protein, 19 aa, Mycobacterium
AAACLRKTDWLFPQYREIG

SEQ ID NO: 759097 - protein, 19 aa, Mycobacterium
AAACLRKTDWLFPQYRELG

SEQ ID NO: 759098 - protein, 27 aa, Mycobacterium
AAADEISAAIAELFGNHAQQYQALSAQ

SEQ ID NO: 759099 - protein, 27 aa, Mycobacterium
AAADEISMQIAALFGAHGQSFQAVSSQ

SEQ ID NO: 759100 - protein, 43 aa, Mycobacterium
AAADEVSTAIAAFFSAHAADYQRLAGQAAALHTQLERVLSAGA

SEQ ID NO: 759101 - protein, 19 aa, Mycobacterium
AAADRKILWCSPTRDQAER

SEQ ID NO: 759102 - protein, 24 aa, Mycobacterium
AAADRLDAILARRPIRLHPDRPNN

SEQ ID NO: 759103 - protein, 20 aa, Mycobacterium
AAAEPIELWAWVAAYDHVAL

SEQ ID NO: 759104 - protein, 19 aa, Mycobacterium
AAAERCGRIALPRRAHVSV

SEQ ID NO: 759105 - protein, 18 aa, Mycobacterium
AAAERRIMLAAARSLPED

SEQ ID NO: 759106 - protein, 23 aa, Mycobacterium
AAAFHYRFVASLFAGTESYVATE

SEQ ID NO: 759107 - protein, 17 aa, Mycobacterium
AAAGFHWLGLETLHCSP

SEQ ID NO: 759108 - protein, 19 aa, Mycobacterium
AAAGLKAMTSWHAQHAITV

SEQ ID NO: 759109 - protein, 19 aa, Mycobacterium
AAAGMRFPLFVKAVAGGGG

SEQ ID NO: 759110 - protein, 24 aa, Mycobacterium
AAAGRPWWEWAATYERAFSAAYDA

SEQ ID NO: 759111 - protein, 24 aa, Mycobacterium
AAAGRPWWEWAATYERAFTAAYDA

SEQ ID NO: 759112 - protein, 17 aa, Mycobacterium
AAAIPRRDEKVSAATGL

SEQ ID NO: 759113 - protein, 17 aa, Mycobacterium
AAALAMGAQGAWSGSQW

SEQ ID NO: 759114 - protein, 20 aa, Mycobacterium
AAALARQGSFLGYRVTVCDA

SEQ ID NO: 759115 - protein, 19 aa, Mycobacterium
AAALAWPGLEHQWLDGWFV

SEQ ID NO: 759116 - protein, 17 aa, Mycobacterium
AAALGLGGCESYPGVFQ

SEQ ID NO: 759117 - protein, 18 aa, Mycobacterium
AAALPRRRLAELLDAAAE

SEQ ID NO: 759118 - protein, 18 aa, Mycobacterium
AAALRPAPVGAYPAGASA

SEQ ID NO: 759119 - protein, 25 aa, Mycobacterium
AAALTVRLAFDWAQLKPGDKVLIHA

SEQ ID NO: 759120 - protein, 23 aa, Mycobacterium
AAALTVRLSFDWAQVKSGDKVLI

SEQ ID NO: 759121 - protein, 21 aa, Mycobacterium
AAAPARPALRFAQISDSRLGF

SEQ ID NO: 759122 - protein, 17 aa, Mycobacterium
AAARAHRALAEFRVRGV

SEQ ID NO: 759123 - protein, 24 aa, Mycobacterium
AAARAVSWPTMWLSSADSPITMRH

SEQ ID NO: 759124 - protein, 17 aa, Mycobacterium
AAARLPFLPIRAGLGSD

SEQ ID NO: 759125 - protein, 17 aa, Mycobacterium
AAARMGHRLTIVMDAWT

SEQ ID NO: 759126 - protein, 22 aa, Mycobacterium
AAARPWAALGVHQRGAMLSAAA

SEQ ID NO: 759127 - protein, 21 aa, Mycobacterium
AAARWPAVRFAVRNTAVQGPS

SEQ ID NO: 759128 - protein, 18 aa, Mycobacterium
AAASCYRSVIAGLTTGRW

SEQ ID NO: 759129 - protein, 17 aa, Mycobacterium
AAATAWDGLAGELAGAA

SEQ ID NO: 759130 - protein, 18 aa, Mycobacterium
AAATHGLRVFAMTKQNGL

SEQ ID NO: 759131 - protein, 17 aa, Mycobacterium
AACALLVGKWCDHHSEV

SEQ ID NO: 759132 - protein, 17 aa, Mycobacterium
AACGLRVTTIFGGVSQT

SEQ ID NO: 759133 - protein, 19 aa, Mycobacterium
AACPLTFPWNVLGWPSINV

SEQ ID NO: 759134 - protein, 20 aa, Mycobacterium
AACPLTWPWNLLGWPSINVP

SEQ ID NO: 759135 - protein, 18 aa, Mycobacterium
AACRAVWNTGLEQRREYR

SEQ ID NO: 759136 - protein, 17 aa, Mycobacterium
AACSLPFDAAVDCYGAF

SEQ ID NO: 759137 - protein, 23 aa, Mycobacterium
AACTARLRLGVGVLVTSLHDPLQ

SEQ ID NO: 759138 - protein, 20 aa, Mycobacterium
AACTERLRLGVGVLVTSLHE

SEQ ID NO: 759139 - protein, 21 aa, Mycobacterium
AACTNRLRLGVAVLVTSLHDP

SEQ ID NO: 759140 - protein, 20 aa, Mycobacterium
AACTQRLRLGVAVLVTSLHD

SEQ ID NO: 759141 - protein, 23 aa, Mycobacterium
AADACRRRMGQVLFKIHQPDYEA

SEQ ID NO: 759142 - protein, 17 aa, Mycobacterium
AADAFVWLRLYQQDLQA

SEQ ID NO: 759143 - protein, 21 aa, Mycobacterium
AADATVLWCCAIRHAVHTTEL

SEQ ID NO: 759144 - protein, 22 aa, Mycobacterium
AADCPKMKFVVGGYAQGAAVVD

SEQ ID NO: 759145 - protein, 23 aa, Mycobacterium
AADDVRAAYQWLLSTGHAAKDIV

SEQ ID NO: 759146 - protein, 23 aa, Mycobacterium
AADDVRAGWDWLPEASGLPPERI

SEQ ID NO: 759147 - protein, 24 aa, Mycobacterium
AADDVRAGWDWLPGACGLSPERMV

SEQ ID NO: 759148 - protein, 25 aa, Mycobacterium
AADEIVRWATPVTCFQRTALQDYEL

SEQ ID NO: 759149 - protein, 31 aa, Mycobacterium
AADEVSAAIASLFGTHALAYQAIGAQAATFH

SEQ ID NO: 759150 - protein, 25 aa, Mycobacterium
AADEVSTAIAALFSQHAKTYQLLAA

SEQ ID NO: 759151 - protein, 18 aa, Mycobacterium
AADFDGLLLLGGGDVDGS

SEQ ID NO: 759152 - protein, 18 aa, Mycobacterium
AADGYVFLAAPLPREWPA

SEQ ID NO: 759153 - protein, 19 aa, Mycobacterium
AADHSKLWFGIAAGLMALG

SEQ ID NO: 759154 - protein, 23 aa, Mycobacterium
AADHSKLWIGIGVGLALFGKPAA

SEQ ID NO: 759155 - protein, 26 aa, Mycobacterium
AADIYRIAHNVAWERWTDIAFGLTSN

SEQ ID NO: 759156 - protein, 18 aa, Mycobacterium
AADLFAWLGPAPDAVVGA

SEQ ID NO: 759157 - protein, 24 aa, Mycobacterium
AADMGCTRYVALLACYLMHRARSC

SEQ ID NO: 759158 - protein, 24 aa, Mycobacterium
AADPRFVCAYGWEVVEVAPRLNHP

SEQ ID NO: 759159 - protein, 18 aa, Mycobacterium
AADRGVVMIGLLADAFPL

SEQ ID NO: 759160 - protein, 24 aa, Mycobacterium
AADRIYSPMPFFWVGGLTMVVLQA

SEQ ID NO: 759161 - protein, 24 aa, Mycobacterium
AADRRFVCAYGWEVVEVAPRLDHR

SEQ ID NO: 759162 - protein, 18 aa, Mycobacterium
AADSLRWVQIASTGVDPV

SEQ ID NO: 759163 - protein, 17 aa, Mycobacterium
AAEAAGFASLWTYERLL

SEQ ID NO: 759164 - protein, 19 aa, Mycobacterium
AAECARRGIKVVVNAGGLN

SEQ ID NO: 759165 - protein, 18 aa, Mycobacterium
AAECGELSYTRSYRPTPP

SEQ ID NO: 759166 - protein, 19 aa, Mycobacterium
AAEEFRFHIGLAQLAGNAL

SEQ ID NO: 759167 - protein, 20 aa, Mycobacterium
AAEFASRLGVEPVYVPGTHL

SEQ ID NO: 759168 - protein, 19 aa, Mycobacterium
AAEFGRWVGPFAAPSANRR

SEQ ID NO: 759169 - protein, 19 aa, Mycobacterium
AAEGFPMNFGFIANGSASS

SEQ ID NO: 759170 - protein, 17 aa, Mycobacterium
AAEGLSWHQPLSTLFDV

SEQ ID NO: 759171 - protein, 21 aa, Mycobacterium
AAEHPRPDYVLLHISDTHLVG

SEQ ID NO: 759172 - protein, 22 aa, Mycobacterium
AAEHPRPEYVLLHISDTHLVGD

SEQ ID NO: 759173 - protein, 22 aa, Mycobacterium
AAELGGQCAFELALIAPQLPPF

SEQ ID NO: 759174 - protein, 17 aa, Mycobacterium
AAELMGIQIPRFCDHPL

SEQ ID NO: 759175 - protein, 18 aa, Mycobacterium
AAELRYGRIPEVEKKLDA

SEQ ID NO: 759176 - protein, 22 aa, Mycobacterium
AAERALTLAVEWAKDRVQGGQP

SEQ ID NO: 759177 - protein, 21 aa, Mycobacterium
AAERARLRFLLVDDAQQLDPQ

SEQ ID NO: 759178 - protein, 23 aa, Mycobacterium
AAERLSSVGFPFPDTRVRVVDAD

SEQ ID NO: 759179 - protein, 21 aa, Mycobacterium
AAESCGKCTPCRVGSVRGMEV

SEQ ID NO: 759180 - protein, 20 aa, Mycobacterium
AAEVSRAVWCPIEVRGLDRG

SEQ ID NO: 759181 - protein, 17 aa, Mycobacterium
AAEWRRLGTAIADTRRT

SEQ ID NO: 759182 - protein, 17 aa, Mycobacterium
AAFADRVADGWIKAQAY

SEQ ID NO: 759183 - protein, 18 aa, Mycobacterium
AAFAESWLSGLDSEQLET

SEQ ID NO: 759184 - protein, 18 aa, Mycobacterium
AAFARSALFPALVRALDD

SEQ ID NO: 759185 - protein, 19 aa, Mycobacterium
AAFASWKALGARFFALRPV

SEQ ID NO: 759186 - protein, 17 aa, Mycobacterium
AAFDHEQICVAIIKHAN

SEQ ID NO: 759187 - protein, 23 aa, Mycobacterium
AAFDLYSCFPFPVFNICDGTGLA

SEQ ID NO: 759188 - protein, 19 aa, Mycobacterium
AAFELLRWLSQEANIKLRP

SEQ ID NO: 759189 - protein, 18 aa, Mycobacterium
AAFHDDFVRILASGSNLY

SEQ ID NO: 759190 - protein, 18 aa, Mycobacterium
AAFLFAITIGNAMRIEPI

SEQ ID NO: 759191 - protein, 23 aa, Mycobacterium
AAFPRYHPKWAWWITKIPALREV

SEQ ID NO: 759192 - protein, 24 aa, Mycobacterium
AAFPRYHPRWAWWLTGVPVLREFL

SEQ ID NO: 759193 - protein, 23 aa, Mycobacterium
AAFPRYHPRWAWWMTSVPMLREF

SEQ ID NO: 759194 - protein, 24 aa, Mycobacterium
AAFPRYHPRWAWWVTSVPLLREFA

SEQ ID NO: 759195 - protein, 18 aa, Mycobacterium
AAFQAEFEGLLSGGAAAY

SEQ ID NO: 759196 - protein, 24 aa, Mycobacterium
AAFRWWLVLATLRWGVICRYQAER

SEQ ID NO: 759197 - protein, 24 aa, Mycobacterium
AAFSRGLWWSALRATDWAAADRQR

SEQ ID NO: 759198 - protein, 18 aa, Mycobacterium
AAFTRWKALGATFIAARP

SEQ ID NO: 759199 - protein, 19 aa, Mycobacterium
AAFTSGVWRDAPIHHRAKV

SEQ ID NO: 759200 - protein, 20 aa, Mycobacterium
AAGAPECLWRADGEAWTVSD

SEQ ID NO: 759201 - protein, 18 aa, Mycobacterium
AAGCPAPRADWVARLAER

SEQ ID NO: 759202 - protein, 27 aa, Mycobacterium
AAGDVPTLFAWRILDYWNWTNRPDRNH

SEQ ID NO: 759203 - protein, 18 aa, Mycobacterium
AAGEPWGSIARNILKYSP

SEQ ID NO: 759204 - protein, 25 aa, Mycobacterium
AAGGKGGNAVLFGAGGNGGIGGTGA

SEQ ID NO: 759205 - protein, 20 aa, Mycobacterium
AAGGKTLWGIPWTESESQAA

SEQ ID NO: 759206 - protein, 18 aa, Mycobacterium
AAGGRAFVSLPWPVPPGA

SEQ ID NO: 759207 - protein, 17 aa, Mycobacterium
AAGIPILGKTNMDEFAM

SEQ ID NO: 759208 - protein, 17 aa, Mycobacterium
AAGIPKAFCEIAGRTLL

SEQ ID NO: 759209 - protein, 19 aa, Mycobacterium
AAGLARVWSRHLGRPLAAD

SEQ ID NO: 759210 - protein, 25 aa, Mycobacterium
AAGLRCLLAYMWAHPGKQLLFMGQE

SEQ ID NO: 759211 - protein, 17 aa, Mycobacterium
AAGMAFHVILGMWMDGW

SEQ ID NO: 759212 - protein, 23 aa, Mycobacterium
AAGMPRPDWLVAPAIAYGASGEH

SEQ ID NO: 759213 - protein, 26 aa, Mycobacterium
AAGNAFEIGGAPAFAAVTPNATSGGA

SEQ ID NO: 759214 - protein, 17 aa, Mycobacterium
AAGPDFRPSVSLEVRLS

SEQ ID NO: 759215 - protein, 24 aa, Mycobacterium
AAGPELRANWSWAPSALDGAQADR

SEQ ID NO: 759216 - protein, 23 aa, Mycobacterium
AAGRAAPRLTVWVPVAVDPGAAA

SEQ ID NO: 759217 - protein, 19 aa, Mycobacterium
AAGRPTRRLGFLWRVASAP

SEQ ID NO: 759218 - protein, 17 aa, Mycobacterium
AAGRYVLDRAIFDALRR

SEQ ID NO: 759219 - protein, 19 aa, Mycobacterium
AAGTRLRGLVFPTPPAPIV

SEQ ID NO: 759220 - protein, 24 aa, Mycobacterium
AAGVCFPDLLLLRGEYQMRLDPPF

SEQ ID NO: 759221 - protein, 19 aa, Mycobacterium
AAGVLCWYGKDLSDPRGWM

SEQ ID NO: 759222 - protein, 20 aa, Mycobacterium
AAGVRPAGLWAYEAHRVAAQ

SEQ ID NO: 759223 - protein, 17 aa, Mycobacterium
AAGWLRYGLPSQFGGRD

SEQ ID NO: 759224 - protein, 19 aa, Mycobacterium
AAGYLCWRGKDLATARGWI

SEQ ID NO: 759225 - protein, 17 aa, Mycobacterium
AAHARFVAAAAKVNTLL

SEQ ID NO: 759226 - protein, 18 aa, Mycobacterium
AAHARFVEAAARVNTLLD

SEQ ID NO: 759227 - protein, 24 aa, Mycobacterium
AAHATELFAVFGLFKRWPALAGKK

SEQ ID NO: 759228 - protein, 17 aa, Mycobacterium
AAHGMRRISLVPGPSGF

SEQ ID NO: 759229 - protein, 24 aa, Mycobacterium
AAHLPRWPLIVLRTPKGWTGPKMV

SEQ ID NO: 759230 - protein, 18 aa, Mycobacterium
AAHLWSRTDLRPEDVDLA

SEQ ID NO: 759231 - protein, 17 aa, Mycobacterium
AAIAALFGAHGQAYQVL

SEQ ID NO: 759232 - protein, 18 aa, Mycobacterium
AAIADRWSLELTVVNPLV

SEQ ID NO: 759233 - protein, 17 aa, Mycobacterium
AAIARWSGDLTIAEDAV

SEQ ID NO: 759234 - protein, 18 aa, Mycobacterium
AAIATELQSFVTAISTDI

SEQ ID NO: 759235 - protein, 19 aa, Mycobacterium
AAIEGWMPFGRVFETLSWG

SEQ ID NO: 759236 - protein, 17 aa, Mycobacterium
AAIGGFRNWDAMVGRYL

SEQ ID NO: 759237 - protein, 18 aa, Mycobacterium
AAIGNWRLFSALLRSLDV

SEQ ID NO: 759238 - protein, 19 aa, Mycobacterium
AAIKRRGGLVIAQSPTDAL

SEQ ID NO: 759239 - protein, 18 aa, Mycobacterium
AAILASIAFHTRVHADDV

SEQ ID NO: 759240 - protein, 20 aa, Mycobacterium
AAILRYCSDHGIAVVPFGGG

SEQ ID NO: 759241 - protein, 19 aa, Mycobacterium
AAIPRGVGTKGVWRLPDRR

SEQ ID NO: 759242 - protein, 17 aa, Mycobacterium
AAIPSMFDPSSPVLARC

SEQ ID NO: 759243 - protein, 18 aa, Mycobacterium
AAIQMSLQLPARVAPEGD

SEQ ID NO: 759244 - protein, 17 aa, Mycobacterium
AAIRPGPDFEMYRDYHD

SEQ ID NO: 759245 - protein, 18 aa, Mycobacterium
AAISGLFNAYGREFQALS

SEQ ID NO: 759246 - protein, 17 aa, Mycobacterium
AAITVGLARGWPLVKSV

SEQ ID NO: 759247 - protein, 17 aa, Mycobacterium
AAITVGLSRGWPLPKSV

SEQ ID NO: 759248 - protein, 20 aa, Mycobacterium
AAKAFLCSEIARWVDEEGLS

SEQ ID NO: 759249 - protein, 17 aa, Mycobacterium
AAKARFAVYIGPLGADT

SEQ ID NO: 759250 - protein, 21 aa, Mycobacterium
AAKARFPQINWEITPGNSSPL

SEQ ID NO: 759251 - protein, 19 aa, Mycobacterium
AAKGLEWDAVFLVGLADGT

SEQ ID NO: 759252 - protein, 22 aa, Mycobacterium
AAKLRLPVQWVSRPTAEQRRRY

SEQ ID NO: 759253 - protein, 18 aa, Mycobacterium
AAKRLVQEGAYVFITGRD

SEQ ID NO: 759254 - protein, 22 aa, Mycobacterium
AAKRYPAILAMTSLNDTRVYYV

SEQ ID NO: 759255 - protein, 22 aa, Mycobacterium
AAKSGIPWTVVRATQFHELAEP

SEQ ID NO: 759256 - protein, 17 aa, Mycobacterium
AAKYAAEFNVPFAPPDV

SEQ ID NO: 759257 - protein, 17 aa, Mycobacterium
AALAMGLGDVTGRVLPK

SEQ ID NO: 759258 - protein, 17 aa, Mycobacterium
AALARSIPWGAAFDQPH

SEQ ID NO: 759259 - protein, 18 aa, Mycobacterium
AALAWPGTEQQWLGGWFA

SEQ ID NO: 759260 - protein, 19 aa, Mycobacterium
AALDAASAWGLDPFGAAVP

SEQ ID NO: 759261 - protein, 18 aa, Mycobacterium
AALDAGAAPAGWGAAPSQ

SEQ ID NO: 759262 - protein, 19 aa, Mycobacterium
AALDRFASEPAWVVKDDGL

SEQ ID NO: 759263 - protein, 18 aa, Mycobacterium
AALFPALVRGLDDGVRDA

SEQ ID NO: 759264 - protein, 17 aa, Mycobacterium
AALGGLVDRFGLAGERL

SEQ ID NO: 759265 - protein, 17 aa, Mycobacterium
AALGRAFVADGFDESTA

SEQ ID NO: 759266 - protein, 17 aa, Mycobacterium
AALGVGISLGHLTMPPA

SEQ ID NO: 759267 - protein, 17 aa, Mycobacterium
AALIARHRVDLIAIGNG

SEQ ID NO: 759268 - protein, 23 aa, Mycobacterium
AALIGPRCRAVWLLTARAETVGP

SEQ ID NO: 759269 - protein, 17 aa, Mycobacterium
AALKDLLERGGLRAGRT

SEQ ID NO: 759270 - protein, 18 aa, Mycobacterium
AALKRPGSFLARQVPQFL

SEQ ID NO: 759271 - protein, 18 aa, Mycobacterium
AALLCKWTDDVGGLGPVS

SEQ ID NO: 759272 - protein, 20 aa, Mycobacterium
AALLDRFGMFGIRISIAVLR

SEQ ID NO: 759273 - protein, 21 aa, Mycobacterium
AALLDRWAPGRIMLNAYGPTE

SEQ ID NO: 759274 - protein, 18 aa, Mycobacterium
AALLHRFGMFGIRISVAV

SEQ ID NO: 759275 - protein, 18 aa, Mycobacterium
AALLHRVEVDAGRRADEL

SEQ ID NO: 759276 - protein, 19 aa, Mycobacterium
AALLRRRFTIGLSNCPNSK

SEQ ID NO: 759277 - protein, 17 aa, Mycobacterium
AALLRWLGNGNFLLLGY

SEQ ID NO: 759278 - protein, 18 aa, Mycobacterium
AALPFGLWVPVLPGTRQV

SEQ ID NO: 759279 - protein, 18 aa, Mycobacterium
AALPLLRAADWARVVTLS

SEQ ID NO: 759280 - protein, 26 aa, Mycobacterium
AALPRPARRLPLLGAWIAELLDRNSR

SEQ ID NO: 759281 - protein, 19 aa, Mycobacterium
AALPRPPLFLMASSAAVYG

SEQ ID NO: 759282 - protein, 17 aa, Mycobacterium
AALQELQDALGLEQAPL

SEQ ID NO: 759283 - protein, 18 aa, Mycobacterium
AALQFPAFAGPVFDSLTT

SEQ ID NO: 759284 - protein, 17 aa, Mycobacterium
AALRAGLGWGMMPEQLG

SEQ ID NO: 759285 - protein, 18 aa, Mycobacterium
AALRAVPAERLWVNPDCG

SEQ ID NO: 759286 - protein, 18 aa, Mycobacterium
AALRAVPAQRLWVNPDCG

SEQ ID NO: 759287 - protein, 17 aa, Mycobacterium
AALRIGDRFDLARMLSD

SEQ ID NO: 759288 - protein, 19 aa, Mycobacterium
AALRKRLSTALVITEWCQL

SEQ ID NO: 759289 - protein, 17 aa, Mycobacterium
AALRPGDQLVLGASNPV

SEQ ID NO: 759290 - protein, 17 aa, Mycobacterium
AALRPGGRIVVMAYQSL

SEQ ID NO: 759291 - protein, 23 aa, Mycobacterium
AALRPRYLMMLAEILRFHRAASR

SEQ ID NO: 759292 - protein, 21 aa, Mycobacterium
AALRRLAVLIARDTPPSDVFT

SEQ ID NO: 759293 - protein, 19 aa, Mycobacterium
AALRRWAHRFYPDTQPAPS

SEQ ID NO: 759294 - protein, 20 aa, Mycobacterium
AALRTSHRFGAAIGALAAAV

SEQ ID NO: 759295 - protein, 21 aa, Mycobacterium
AALSRLGCPYVWGATGPGQFD

SEQ ID NO: 759296 - protein, 20 aa, Mycobacterium
AALSSRPAVVFSRRQLLEAV

SEQ ID NO: 759297 - protein, 24 aa, Mycobacterium
AALTARLAFDWAQLKPGDRVLIHA

SEQ ID NO: 759298 - protein, 23 aa, Mycobacterium
AALTELCALSWMVYSLPGTPVLD

SEQ ID NO: 759299 - protein, 19 aa, Mycobacterium
AALTGRPLIGNGANGTPGL

SEQ ID NO: 759300 - protein, 17 aa, Mycobacterium
AALTLVHRVPRSAGREL

SEQ ID NO: 759301 - protein, 17 aa, Mycobacterium
AALTRIVLPRSRYDEFV

SEQ ID NO: 759302 - protein, 19 aa, Mycobacterium
AALVGSMAVPQGWTQAAPA

SEQ ID NO: 759303 - protein, 19 aa, Mycobacterium
AALVGSMSVPQGWTQAAPA

SEQ ID NO: 759304 - protein, 17 aa, Mycobacterium
AALYFAGERSRYVTGTV

SEQ ID NO: 759305 - protein, 20 aa, Mycobacterium
AAMAAARGWPVLRVENPGKG

SEQ ID NO: 759306 - protein, 19 aa, Mycobacterium
AAMEVCRKIAPDILLGIPY

SEQ ID NO: 759307 - protein, 18 aa, Mycobacterium
AAMEVFEAGQLCLAISQS

SEQ ID NO: 759308 - protein, 20 aa, Mycobacterium
AAMFDGRFAGFADFLILSDG

SEQ ID NO: 759309 - protein, 20 aa, Mycobacterium
AAMFDGRFAGFADFLLLEEG

SEQ ID NO: 759310 - protein, 17 aa, Mycobacterium
AAMGWRADVHRLPDPAD

SEQ ID NO: 759311 - protein, 21 aa, Mycobacterium
AAMHARCPLAWTDTYGGHWVA

SEQ ID NO: 759312 - protein, 18 aa, Mycobacterium
AAMIPRLIATAAELARAT

SEQ ID NO: 759313 - protein, 20 aa, Mycobacterium
AAMPQTVWVTGCSSWYLGKD

SEQ ID NO: 759314 - protein, 18 aa, Mycobacterium
AAMSVQALIDWGIAPDAG

SEQ ID NO: 759315 - protein, 17 aa, Mycobacterium
AAMSVQALIDWGIAPEA

SEQ ID NO: 759316 - protein, 20 aa, Mycobacterium
AAMTECRRALGDAGLLGVAW

SEQ ID NO: 759317 - protein, 19 aa, Mycobacterium
AAMVRFIGVDGYRWMIRCV

SEQ ID NO: 759318 - protein, 23 aa, Mycobacterium
AANGVPIPIAWPDRLVAADYGLE

SEQ ID NO: 759319 - protein, 18 aa, Mycobacterium
AANLMKWTGISPQHVART

SEQ ID NO: 759320 - protein, 20 aa, Mycobacterium
AANLWPLGVFPNADSIAGNG

SEQ ID NO: 759321 - protein, 25 aa, Mycobacterium
AANSWLDAFMQWRRAQGLPATSIAW

SEQ ID NO: 759322 - protein, 22 aa, Mycobacterium
AANWRAAGWWENRSIRSLLADA

SEQ ID NO: 759323 - protein, 17 aa, Mycobacterium
AAPAGRVLLVWDAPNLD

SEQ ID NO: 759324 - protein, 23 aa, Mycobacterium
AAPARFARGWYCLGLIKDFGDGK

SEQ ID NO: 759325 - protein, 20 aa, Mycobacterium
AAPCPLIAACRLRRALAEAK

SEQ ID NO: 759326 - protein, 18 aa, Mycobacterium
AAPCPVWLKQAWIDLLGP

SEQ ID NO: 759327 - protein, 24 aa, Mycobacterium
AAPDCTICGVAAAGIAAHPAVTAG

SEQ ID NO: 759328 - protein, 22 aa, Mycobacterium
AAPGECVALLFSRSAEAIISIL

SEQ ID NO: 759329 - protein, 17 aa, Mycobacterium
AAPGGFDCSGLVMWAFQ

SEQ ID NO: 759330 - protein, 25 aa, Mycobacterium
AAPLLGVLCSISWQRPVPTVRVHGE

SEQ ID NO: 759331 - protein, 24 aa, Mycobacterium
AAPPGLLCALDLPLITGAGLVRPV

SEQ ID NO: 759332 - protein, 17 aa, Mycobacterium
AAPRPGRRIGLVYRSSS

SEQ ID NO: 759333 - protein, 17 aa, Mycobacterium
AAPRPPLRILYGTQTGN

SEQ ID NO: 759334 - protein, 18 aa, Mycobacterium
AAPTGWRVGGSAAPVRTD

SEQ ID NO: 759335 - protein, 18 aa, Mycobacterium
AAPTRMLLPRSRYDEGVA

SEQ ID NO: 759336 - protein, 24 aa, Mycobacterium
AAPWKSRTAYQWACEVSVYVDGAR

SEQ ID NO: 759337 - protein, 17 aa, Mycobacterium
AAPYARWLSAAAGHASG

SEQ ID NO: 759338 - protein, 19 aa, Mycobacterium
AAQKAHWGVCLARTDPEAA

SEQ ID NO: 759339 - protein, 20 aa, Mycobacterium
AAQLRQWFQYRIEGPGPVNN

SEQ ID NO: 759340 - protein, 18 aa, Mycobacterium
AAQQRWFRLSALAERVSA

SEQ ID NO: 759341 - protein, 17 aa, Mycobacterium
AAQRFGEFNGFWREDGF

SEQ ID NO: 759342 - protein, 18 aa, Mycobacterium
AAQRLGSIALTWDGGELT

SEQ ID NO: 759343 - protein, 24 aa, Mycobacterium
AAQSGRFAFQWTEFPWGCEHYEWT

SEQ ID NO: 759344 - protein, 18 aa, Mycobacterium
AAQSWSLDRFRAVAKCAG

SEQ ID NO: 759345 - protein, 21 aa, Mycobacterium
AAQVILRWHLQLGNVVIPKSV

SEQ ID NO: 759346 - protein, 23 aa, Mycobacterium
AARAAEFILGYTIGNDVSARDQQ

SEQ ID NO: 759347 - protein, 20 aa, Mycobacterium
AARAARLKWWTTDLQVRTAD

SEQ ID NO: 759348 - protein, 23 aa, Mycobacterium
AARAAWRGVFSGFETPTLVGTPG

SEQ ID NO: 759349 - protein, 18 aa, Mycobacterium
AARAFKAQALAAADAGAE

SEQ ID NO: 759350 - protein, 23 aa, Mycobacterium
AARAKAAGVALAIENASSLYADI

SEQ ID NO: 759351 - protein, 18 aa, Mycobacterium
AARCTAHLSVSVMEQVER

SEQ ID NO: 759352 - protein, 24 aa, Mycobacterium
AAREFKPLVLVGGYSAYPRRVNFA

SEQ ID NO: 759353 - protein, 23 aa, Mycobacterium
AARGLGVLVCFAGRVLQPLGLNK

SEQ ID NO: 759354 - protein, 23 aa, Mycobacterium
AARGRALIRWDNFELIRLSTWSH

SEQ ID NO: 759355 - protein, 18 aa, Mycobacterium
AARIPWQLADIGQHTDGH

SEQ ID NO: 759356 - protein, 22 aa, Mycobacterium
AARLADVAIVFAVRAEGEGYDL

SEQ ID NO: 759357 - protein, 23 aa, Mycobacterium
AARLETLPGWAWNGNAGHEQWLE

SEQ ID NO: 759358 - protein, 24 aa, Mycobacterium
AARLETLPGWVWRDSRADRWERGF

SEQ ID NO: 759359 - protein, 18 aa, Mycobacterium
AARLGLRTAFVARPLEFG

SEQ ID NO: 759360 - protein, 19 aa, Mycobacterium
AARLGRWVLTRSFTDYASL

SEQ ID NO: 759361 - protein, 20 aa, Mycobacterium
AARLKNVWAPGGLVQRSQGK

SEQ ID NO: 759362 - protein, 20 aa, Mycobacterium
AARLLRWVQLCGAETRVFGP

SEQ ID NO: 759363 - protein, 19 aa, Mycobacterium
AARLLVWRAGWMARNNHNF

SEQ ID NO: 759364 - protein, 20 aa, Mycobacterium
AARLLVWRAGWMARNNQQFD

SEQ ID NO: 759365 - protein, 24 aa, Mycobacterium
AARLPLPCRLGATLIFGRSAGVLA

SEQ ID NO: 759366 - protein, 22 aa, Mycobacterium
AARLRAALALLVWERRGESVRA

SEQ ID NO: 759367 - protein, 18 aa, Mycobacterium
AARNSAGFGAPRYGVKPI

SEQ ID NO: 759368 - protein, 32 aa, Mycobacterium
AARPALMPMDAWRDGNEFIVEFDLPGISGESL

SEQ ID NO: 759369 - protein, 21 aa, Mycobacterium
AARPGHEWLPLSLQLILAEIL

SEQ ID NO: 759370 - protein, 21 aa, Mycobacterium
AARPRLGAVAYRMLGSIDDAQ

SEQ ID NO: 759371 - protein, 18 aa, Mycobacterium
AARQCVRPDLGAVAPGKR

SEQ ID NO: 759372 - protein, 18 aa, Mycobacterium
AARRCPDATFLPSDPEAY

SEQ ID NO: 759373 - protein, 22 aa, Mycobacterium
AARRRLAAILAHHGLAVVTMNA

SEQ ID NO: 759374 - protein, 17 aa, Mycobacterium
AARRRLRVNGELVDADG

SEQ ID NO: 759375 - protein, 24 aa, Mycobacterium
AARRSGVEPLEIARRVAAVLNAGP

SEQ ID NO: 759376 - protein, 21 aa, Mycobacterium
AARSDIRWQPQVWKSFAEELG

SEQ ID NO: 759377 - protein, 24 aa, Mycobacterium
AARSGIGIVEGWRGTIVHRVEIDA

SEQ ID NO: 759378 - protein, 18 aa, Mycobacterium
AARSRLAAILADNGLAVV

SEQ ID NO: 759379 - protein, 22 aa, Mycobacterium
AARSRPALRPRILVTADMDDDG

SEQ ID NO: 759380 - protein, 19 aa, Mycobacterium
AARVLLVWDAPNLDMGLGS

SEQ ID NO: 759381 - protein, 18 aa, Mycobacterium
AARWLRGYLRELISQRRR

SEQ ID NO: 759382 - protein, 19 aa, Mycobacterium
AASAAPYVGWLYRTAEQTQ

SEQ ID NO: 759383 - protein, 19 aa, Mycobacterium
AASAIRWAVDLGLIPSADQ

SEQ ID NO: 759384 - protein, 22 aa, Mycobacterium
AASARFGLLLARTGPDKHRDLS

SEQ ID NO: 759385 - protein, 17 aa, Mycobacterium
AASCTKMLICDEAHTAG

SEQ ID NO: 759386 - protein, 22 aa, Mycobacterium
AASEHRLRIIGVTWNDEAAAQA

SEQ ID NO: 759387 - protein, 18 aa, Mycobacterium
AASELRPAALASPLSSLD

SEQ ID NO: 759388 - protein, 19 aa, Mycobacterium
AASFTWEFEDGTSLGQVAR

SEQ ID NO: 759389 - protein, 19 aa, Mycobacterium
AASLGRLSVPPSWAQSVPD

SEQ ID NO: 759390 - protein, 19 aa, Mycobacterium
AASLPEWTPVAALPAPTGM

SEQ ID NO: 759391 - protein, 22 aa, Mycobacterium
AASLTRLLGCPVFVDHRARLQV

SEQ ID NO: 759392 - protein, 17 aa, Mycobacterium
AASPLCFVATTDAEGRV

SEQ ID NO: 759393 - protein, 27 aa, Mycobacterium
AASRSALRQGIKLAIGLREPGYHFLAV

SEQ ID NO: 759394 - protein, 25 aa, Mycobacterium
AASVGGRLSVPVSWSAASTPAPVLG

SEQ ID NO: 759395 - protein, 20 aa, Mycobacterium
AASWQRLRTATALVPLDHAD

SEQ ID NO: 759396 - protein, 17 aa, Mycobacterium
AATAFEWGMISHITSAD

SEQ ID NO: 759397 - protein, 18 aa, Mycobacterium
AATCFPNLSFVHNWPKLP

SEQ ID NO: 759398 - protein, 17 aa, Mycobacterium
AATDWQDFLAFRGRELC

SEQ ID NO: 759399 - protein, 23 aa, Mycobacterium
AATEARYGQMWAQDAATMYAYAA

SEQ ID NO: 759400 - protein, 19 aa, Mycobacterium
AATEFWKTITLCAKHAPVD

SEQ ID NO: 759401 - protein, 19 aa, Mycobacterium
AATENWPPIPLPFGTYPVD

SEQ ID NO: 759402 - protein, 19 aa, Mycobacterium
AATFHAQFVQLMATSAGRY

SEQ ID NO: 759403 - protein, 22 aa, Mycobacterium
AATFSWEFDDGFSLGALARLDT

SEQ ID NO: 759404 - protein, 18 aa, Mycobacterium
AATGLGWTGLALAEDVGG

SEQ ID NO: 759405 - protein, 18 aa, Mycobacterium
AATGRPLIGNGANGAPGT

SEQ ID NO: 759406 - protein, 17 aa, Mycobacterium
AATGRPLIGNGTPGDAG

SEQ ID NO: 759407 - protein, 24 aa, Mycobacterium
AATHGRFQLGLGLGAPVIEGPSYG

SEQ ID NO: 759408 - protein, 19 aa, Mycobacterium
AATISVVWTNSGSAAATEK

SEQ ID NO: 759409 - protein, 17 aa, Mycobacterium
AATLCWRSRTIVGGHHA

SEQ ID NO: 759410 - protein, 26 aa, Mycobacterium
AATPWLAATVGFAWRTRLSVSASVDA

SEQ ID NO: 759411 - protein, 19 aa, Mycobacterium
AATRLGHSVAFFIGTAYGS

SEQ ID NO: 759412 - protein, 25 aa, Mycobacterium
AATRLRLRAGWTMLGLRLHRGDADV

SEQ ID NO: 759413 - protein, 20 aa, Mycobacterium
AATSRPAVRMGWVSSELAMF

SEQ ID NO: 759414 - protein, 21 aa, Mycobacterium
AATVRVGFRLGDPAAGELGVR

SEQ ID NO: 759415 - protein, 17 aa, Mycobacterium
AAVAAIFPTVTAPPPEQ

SEQ ID NO: 759416 - protein, 24 aa, Mycobacterium
AAVAKRRGWPILKFNSRGGVGLRR

SEQ ID NO: 759417 - protein, 18 aa, Mycobacterium
AAVASLFAGYGQAYQSIS

SEQ ID NO: 759418 - protein, 17 aa, Mycobacterium
AAVCPHVEWALSSTLSA

SEQ ID NO: 759419 - protein, 19 aa, Mycobacterium
AAVEARYGEMWAQDAAAMY

SEQ ID NO: 759420 - protein, 17 aa, Mycobacterium
AAVEAWGEGGSGATAAA

SEQ ID NO: 759421 - protein, 18 aa, Mycobacterium
AAVFAALGALAWSNVVRT

SEQ ID NO: 759422 - protein, 17 aa, Mycobacterium
AAVFAEGLIAYRLVHLI

SEQ ID NO: 759423 - protein, 18 aa, Mycobacterium
AAVGCGFITWTLKGNEHV

SEQ ID NO: 759424 - protein, 18 aa, Mycobacterium
AAVGDILAVSGGIGADGQ

SEQ ID NO: 759425 - protein, 20 aa, Mycobacterium
AAVGDWMLLAAIEALIDGHE

SEQ ID NO: 759426 - protein, 19 aa, Mycobacterium
AAVGGGWFGYLSYPDPGAC

SEQ ID NO: 759427 - protein, 17 aa, Mycobacterium
AAVIPYVDWLTVTAEQA

SEQ ID NO: 759428 - protein, 19 aa, Mycobacterium
AAVKPRLDLIVVEASGLAE

SEQ ID NO: 759429 - protein, 20 aa, Mycobacterium
AAVKRLKVGAARSFAATTQE

SEQ ID NO: 759430 - protein, 17 aa, Mycobacterium
AAVKRREWMAGRRDRLA

SEQ ID NO: 759431 - protein, 22 aa, Mycobacterium
AAVLDWRLPAPIGNTAADLGPL

SEQ ID NO: 759432 - protein, 21 aa, Mycobacterium
AAVLIRPKFRRWISVADAIAF

SEQ ID NO: 759433 - protein, 17 aa, Mycobacterium
AAVLLTFQRVADHQPPQ

SEQ ID NO: 759434 - protein, 24 aa, Mycobacterium
AAVLPCYWIYARVGAELMQRGSSD

SEQ ID NO: 759435 - protein, 17 aa, Mycobacterium
AAVLPTTVLQAAGADEV

SEQ ID NO: 759436 - protein, 17 aa, Mycobacterium
AAVLTVLARLGFGPDAD

SEQ ID NO: 759437 - protein, 18 aa, Mycobacterium
AAVLWKVGMAIPINTNPL

SEQ ID NO: 759438 - protein, 19 aa, Mycobacterium
AAVPAGWRVIGRVVDGPAR

SEQ ID NO: 759439 - protein, 17 aa, Mycobacterium
AAVQFDWDNARADADAV

SEQ ID NO: 759440 - protein, 19 aa, Mycobacterium
AAVQIRLHPAITVFAAIPQ

SEQ ID NO: 759441 - protein, 20 aa, Mycobacterium
AAVRGLRVVTVFGGVSQHKQ

SEQ ID NO: 759442 - protein, 18 aa, Mycobacterium
AAVSAYRCAGMGGSYAGV

SEQ ID NO: 759443 - protein, 17 aa, Mycobacterium
AAVSELLVGKGFTAGKV

SEQ ID NO: 759444 - protein, 18 aa, Mycobacterium
AAVSRLSYDNRLRSVDDV

SEQ ID NO: 759445 - protein, 18 aa, Mycobacterium
AAVTCFWNGNQINIIDTP

SEQ ID NO: 759446 - protein, 19 aa, Mycobacterium
AAVVRRLAADFPQSRSDWV

SEQ ID NO: 759447 - protein, 19 aa, Mycobacterium
AAVYLRFLRDLPLHTDVNE

SEQ ID NO: 759448 - protein, 19 aa, Mycobacterium
AAVYLRFLRELPLHTDVNE

SEQ ID NO: 759449 - protein, 23 aa, Mycobacterium
AAWACYEAWAWLQLGHGDIALVY

SEQ ID NO: 759450 - protein, 20 aa, Mycobacterium
AAWERQGWRVLPDDPSGPLT

SEQ ID NO: 759451 - protein, 17 aa, Mycobacterium
AAWKGLPSFAFRSQFRT

SEQ ID NO: 759452 - protein, 17 aa, Mycobacterium
AAWLRIDARFGSVYRRR

SEQ ID NO: 759453 - protein, 17 aa, Mycobacterium
AAWRAAFDHEQTCVAII

SEQ ID NO: 759454 - protein, 19 aa, Mycobacterium
AAYLLALRAAWQADNKIPN

SEQ ID NO: 759455 - protein, 20 aa, Mycobacterium
AAYRPGWRLSGFTGHCAVSH

SEQ ID NO: 759456 - protein, 17 aa, Mycobacterium
ACACTVRRGEVRMLRND

SEQ ID NO: 759457 - protein, 18 aa, Mycobacterium
ACAGCATRDPAMCVSGPQ

SEQ ID NO: 759458 - protein, 17 aa, Mycobacterium
ACAGCATRDPVMCHNGF

SEQ ID NO: 759459 - protein, 17 aa, Mycobacterium
ACAGCATRDPVMCHSGF

SEQ ID NO: 759460 - protein, 17 aa, Mycobacterium
ACANEDCRWAFYDRSRN

SEQ ID NO: 759461 - protein, 19 aa, Mycobacterium
ACARLGVMHSVVFAGFSAS

SEQ ID NO: 759462 - protein, 18 aa, Mycobacterium
ACASYDCVTIFAADLPTA

SEQ ID NO: 759463 - protein, 23 aa, Mycobacterium
ACDHFDVWPGHDWFDTAVTDQIA

SEQ ID NO: 759464 - protein, 24 aa, Mycobacterium
ACEGGIRVTGRWSWATGVMDGNWI

SEQ ID NO: 759465 - protein, 18 aa, Mycobacterium
ACESYDCVTIFAPSLTTA

SEQ ID NO: 759466 - protein, 26 aa, Mycobacterium
ACFAGPAPAGWRIIGRVLDGKADVLI

SEQ ID NO: 759467 - protein, 20 aa, Mycobacterium
ACFHCPSCIEQLRAADDVLL

SEQ ID NO: 759468 - protein, 17 aa, Mycobacterium
ACFPVKIHAASAGWTRA

SEQ ID NO: 759469 - protein, 19 aa, Mycobacterium
ACGDCPRVILGSPLAGESL

SEQ ID NO: 759470 - protein, 20 aa, Mycobacterium
ACGDCPRVILGSPLAGESLD

SEQ ID NO: 759471 - protein, 23 aa, Mycobacterium
ACGECPPCLKGFRSLCDRGAVLL

SEQ ID NO: 759472 - protein, 23 aa, Mycobacterium
ACGGRFALGLGLSHDWIINGQLG

SEQ ID NO: 759473 - protein, 19 aa, Mycobacterium
ACGICGSDLHFAAHGAQVL

SEQ ID NO: 759474 - protein, 20 aa, Mycobacterium
ACGICGSDLHFAQHGEDLLA

SEQ ID NO: 759475 - protein, 21 aa, Mycobacterium
ACGKAGCSTYKWETFLTSELP

SEQ ID NO: 759476 - protein, 26 aa, Mycobacterium
ACGLARHVLCFRTLWEATHGELMKQG

SEQ ID NO: 759477 - protein, 19 aa, Mycobacterium
ACGVLRLAGVAGYEGALAH

SEQ ID NO: 759478 - protein, 17 aa, Mycobacterium
ACIACDVCVKVCPTDVF

SEQ ID NO: 759479 - protein, 17 aa, Mycobacterium
ACIRAGIPVSMHASDSG

SEQ ID NO: 759480 - protein, 26 aa, Mycobacterium
ACLDKYARLFAWLGLWERHTDLAVIP

SEQ ID NO: 759481 - protein, 26 aa, Mycobacterium
ACLDRYARLFAWLGLWERHTDLAVIP

SEQ ID NO: 759482 - protein, 23 aa, Mycobacterium
ACLEHPTWWGGLVDLPVSPAPQD

SEQ ID NO: 759483 - protein, 17 aa, Mycobacterium
ACLRALVRHRLAVAHPG

SEQ ID NO: 759484 - protein, 24 aa, Mycobacterium
ACNRCWYCDHELYSCCDTTNPNAE

SEQ ID NO: 759485 - protein, 21 aa, Mycobacterium
ACPDCARGAFHAERPYEAEAV

SEQ ID NO: 759486 - protein, 17 aa, Mycobacterium
ACPFGAAGSRMYRTGDL

SEQ ID NO: 759487 - protein, 17 aa, Mycobacterium
ACPFGAPGARMYRTGDL

SEQ ID NO: 759488 - protein, 18 aa, Mycobacterium
ACPFGAPGARMYRTGDLV

SEQ ID NO: 759489 - protein, 17 aa, Mycobacterium
ACPFGGPGARMYRTGDL

SEQ ID NO: 759490 - protein, 19 aa, Mycobacterium
ACPPGRVDVIANYTAFLNL

SEQ ID NO: 759491 - protein, 23 aa, Mycobacterium
ACQKTKHFVMDWCVGVFHTQSGV

SEQ ID NO: 759492 - protein, 18 aa, Mycobacterium
ACQLAFWRHDEHLVCEAR

SEQ ID NO: 759493 - protein, 19 aa, Mycobacterium
ACQPGRPVASITAAAPGAT

SEQ ID NO: 759494 - protein, 17 aa, Mycobacterium
ACRQCLVEVEGQRKPMA

SEQ ID NO: 759495 - protein, 23 aa, Mycobacterium
ACSSSLVAIHWAMASLRSGECDL

SEQ ID NO: 759496 - protein, 23 aa, Mycobacterium
ACTNCRARRPAYCRKAVRLNQFG

SEQ ID NO: 759497 - protein, 19 aa, Mycobacterium
ACTTRLRLGVAVLVASQHD

SEQ ID NO: 759498 - protein, 19 aa, Mycobacterium
ACVAVDAGHRWLLHAGDAF

SEQ ID NO: 759499 - protein, 18 aa, Mycobacterium
ACVLWDCVPSKSFIAATG

SEQ ID NO: 759500 - protein, 20 aa, Mycobacterium
ACVQAGIPVCMHASDSGYAQ

SEQ ID NO: 759501 - protein, 21 aa, Mycobacterium
ACVVLRVARFFAEFDDMPDDY

SEQ ID NO: 759502 - protein, 19 aa, Mycobacterium
ACWAWRRLRIPVIALIHGR

SEQ ID NO: 759503 - protein, 19 aa, Mycobacterium
ADAALALLRAELRPGDVVL

SEQ ID NO: 759504 - protein, 17 aa, Mycobacterium
ADAFAISPVRFDAGTAA

SEQ ID NO: 759505 - protein, 23 aa, Mycobacterium
ADAFKLAALNAWEDGPISTFFAT

SEQ ID NO: 759506 - protein, 18 aa, Mycobacterium
ADAFRSWRLLVSRYGSPA

SEQ ID NO: 759507 - protein, 24 aa, Mycobacterium
ADAGARLHATWTWALSALSHNQVD

SEQ ID NO: 759508 - protein, 24 aa, Mycobacterium
ADAGRPWWEWAATFERAFSAAYDA

SEQ ID NO: 759509 - protein, 24 aa, Mycobacterium
ADAGRPWWEWAATYERAFDEAYES

SEQ ID NO: 759510 - protein, 24 aa, Mycobacterium
ADAGRPWWEWAATYERAFTAAYDA

SEQ ID NO: 759511 - protein, 25 aa, Mycobacterium
ADAIRFAVNYLRMFATDSAERIPRR

SEQ ID NO: 759512 - protein, 26 aa, Mycobacterium
ADALALAICHCWRAPMIAQMAKAHAL

SEQ ID NO: 759513 - protein, 25 aa, Mycobacterium
ADALALAICHCWRAPMIARIARAEA

SEQ ID NO: 759514 - protein, 25 aa, Mycobacterium
ADALALAICHCWRAPMIARLAAAET

SEQ ID NO: 759515 - protein, 25 aa, Mycobacterium
ADALALAICHCWRAPMISRMAAAEE

SEQ ID NO: 759516 - protein, 25 aa, Mycobacterium
ADALALAICHCWRAPMLARMAKAEA

SEQ ID NO: 759517 - protein, 17 aa, Mycobacterium
ADALARIDLTCTFADVT

SEQ ID NO: 759518 - protein, 18 aa, Mycobacterium
ADALKFVCCNADEGDSGT

SEQ ID NO: 759519 - protein, 19 aa, Mycobacterium
ADANVWRRVVPKGWFYNVM

SEQ ID NO: 759520 - protein, 21 aa, Mycobacterium
ADAPGGWVYEWSRVARDYAER

SEQ ID NO: 759521 - protein, 22 aa, Mycobacterium
ADAPRPAPVREWHAMAVEHVRR

SEQ ID NO: 759522 - protein, 21 aa, Mycobacterium
ADARAAALLQRIEARRAELDE

SEQ ID NO: 759523 - protein, 21 aa, Mycobacterium
ADARLAALIRRTCAQTLSLPP

SEQ ID NO: 759524 - protein, 25 aa, Mycobacterium
ADARYLWPSMFARVADEYDRRYGLD

SEQ ID NO: 759525 - protein, 23 aa, Mycobacterium
ADATAGSVFACFVRPQFQGRGVG

SEQ ID NO: 759526 - protein, 25 aa, Mycobacterium
ADAVLAGPCAWFFGNEAHGLDGATA

SEQ ID NO: 759527 - protein, 17 aa, Mycobacterium
ADAVLRWGMQRGSGLRV

SEQ ID NO: 759528 - protein, 20 aa, Mycobacterium
ADCGDKFDIVQSFTDDALTV

SEQ ID NO: 759529 - protein, 21 aa, Mycobacterium
ADCGYRRSWGIGRHIQGSQLF

SEQ ID NO: 759530 - protein, 19 aa, Mycobacterium
ADCHPILFLRMMERVKSGA

SEQ ID NO: 759531 - protein, 19 aa, Mycobacterium
ADCHPILFLRMMERVQAGA

SEQ ID NO: 759532 - protein, 17 aa, Mycobacterium
ADDAWLAKWSRAEAAVP

SEQ ID NO: 759533 - protein, 18 aa, Mycobacterium
ADDDWPRHEMDLPAGHGL

SEQ ID NO: 759534 - protein, 26 aa, Mycobacterium
ADDEVSVAIAALFSGHGQAYRAISAQ

SEQ ID NO: 759535 - protein, 20 aa, Mycobacterium
ADDGLRRWGVDPEVRDRFLG

SEQ ID NO: 759536 - protein, 21 aa, Mycobacterium
ADDIAHIWALLGLTVAGPDVP

SEQ ID NO: 759537 - protein, 18 aa, Mycobacterium
ADDPAIWDHPIIHPHTAD

SEQ ID NO: 759538 - protein, 26 aa, Mycobacterium
ADDRFRWSFAGARRLKGIKGDVKMFR

SEQ ID NO: 759539 - protein, 24 aa, Mycobacterium
ADEALRMGLVWRVCDPEDLLPEAR

SEQ ID NO: 759540 - protein, 18 aa, Mycobacterium
ADEFGRSGVRVNAIAPGP

SEQ ID NO: 759541 - protein, 24 aa, Mycobacterium
ADEHRRRIGVALARLRDPADPLDK

SEQ ID NO: 759542 - protein, 20 aa, Mycobacterium
ADEIIRWASPIIAFQRTALQ

SEQ ID NO: 759543 - protein, 19 aa, Mycobacterium
ADEIIRWATPITAFQRTAR

SEQ ID NO: 759544 - protein, 18 aa, Mycobacterium
ADEIVRWATPVTSFQRTA

SEQ ID NO: 759545 - protein, 19 aa, Mycobacterium
ADELGCRSLALVAFGTGVG

SEQ ID NO: 759546 - protein, 20 aa, Mycobacterium
ADELGCRSLALVAFGTGVGG

SEQ ID NO: 759547 - protein, 20 aa, Mycobacterium
ADELGCRSLGLVAFGTGVGG

SEQ ID NO: 759548 - protein, 23 aa, Mycobacterium
ADEPGRLLGFHWTKVHPDEPGLG

SEQ ID NO: 759549 - protein, 20 aa, Mycobacterium
ADERACLVLADRGYPTAHRA

SEQ ID NO: 759550 - protein, 19 aa, Mycobacterium
ADERARLPIDPEWGPGWHL

SEQ ID NO: 759551 - protein, 25 aa, Mycobacterium
ADEVSAAIAALFDEHALGYQTISAQ

SEQ ID NO: 759552 - protein, 31 aa, Mycobacterium
ADEVSAAIAALFGSHAREYQAISAQSAAFHE

SEQ ID NO: 759553 - protein, 22 aa, Mycobacterium
ADEVSAAISFLFGAHAQAYQAL

SEQ ID NO: 759554 - protein, 22 aa, Mycobacterium
ADEVSAAVAAVFSGHAQAYQAL

SEQ ID NO: 759555 - protein, 25 aa, Mycobacterium
ADEVSAAVTAMFGNHAQAYQAVSTQ

SEQ ID NO: 759556 - protein, 22 aa, Mycobacterium
ADEVSTAVAHVFDTYAQEYQTF

SEQ ID NO: 759557 - protein, 18 aa, Mycobacterium
ADFCRARGILLVADEVQT

SEQ ID NO: 759558 - protein, 20 aa, Mycobacterium
ADFIGGFGLWVDEQRLLHHT

SEQ ID NO: 759559 - protein, 17 aa, Mycobacterium
ADFLLALAVAYEVQCRF

SEQ ID NO: 759560 - protein, 20 aa, Mycobacterium
ADFMGGFALWVDEHQRLHHT

SEQ ID NO: 759561 - protein, 17 aa, Mycobacterium
ADFPILVAHGMSCVLHC

SEQ ID NO: 759562 - protein, 19 aa, Mycobacterium
ADFPLPWSIMHKVKAPTLL

SEQ ID NO: 759563 - protein, 18 aa, Mycobacterium
ADFPRYPLNFIADLNAVM

SEQ ID NO: 759564 - protein, 17 aa, Mycobacterium
ADFRAVDNLSGWFTTIT

SEQ ID NO: 759565 - protein, 18 aa, Mycobacterium
ADFRGASVAVDWPAELQQ

SEQ ID NO: 759566 - protein, 18 aa, Mycobacterium
ADFRGASVAVDWSAELQQ

SEQ ID NO: 759567 - protein, 26 aa, Mycobacterium
ADFWFDPLCPWAWITSRWILEVEKVR

SEQ ID NO: 759568 - protein, 29 aa, Mycobacterium
ADFWFDPLCPWCWITSRWILEVEKVRDIE

SEQ ID NO: 759569 - protein, 21 aa, Mycobacterium
ADGAPGGWLLGDGGAGGSGAP

SEQ ID NO: 759570 - protein, 19 aa, Mycobacterium
ADGDFRWAATLLDHAVFTD

SEQ ID NO: 759571 - protein, 19 aa, Mycobacterium
ADGDLRFTVTLADGRSITA

SEQ ID NO: 759572 - protein, 20 aa, Mycobacterium
ADGFLPALLDWCRSNDVVFI

SEQ ID NO: 759573 - protein, 19 aa, Mycobacterium
ADGFLPALQRWCRDNDVVF

SEQ ID NO: 759574 - protein, 26 aa, Mycobacterium
ADGGRYAFGANWSLDLPVGGAGGAGG

SEQ ID NO: 759575 - protein, 22 aa, Mycobacterium
ADGGVRLTGRWSWATGAMAADW

SEQ ID NO: 759576 - protein, 24 aa, Mycobacterium
ADGKRTRLWPGLRETFKSGSADIP

SEQ ID NO: 759577 - protein, 18 aa, Mycobacterium
ADGLGLPVLSVRAMVARS

SEQ ID NO: 759578 - protein, 18 aa, Mycobacterium
ADGLLISFERMNAVLEVD

SEQ ID NO: 759579 - protein, 23 aa, Mycobacterium
ADGLRSLPWDGLKLSRGEAAVPS

SEQ ID NO: 759580 - protein, 23 aa, Mycobacterium
ADGPRLHANWTWAPSALDEDLVR

SEQ ID NO: 759581 - protein, 17 aa, Mycobacterium
ADGPVAFVFLRQFGSAF

SEQ ID NO: 759582 - protein, 20 aa, Mycobacterium
ADGRGATMIFTRTKRTAQKV

SEQ ID NO: 759583 - protein, 18 aa, Mycobacterium
ADGRLHYVYNFLGERQQL

SEQ ID NO: 759584 - protein, 20 aa, Mycobacterium
ADGRRWRALFDWTSQRFDML

SEQ ID NO: 759585 - protein, 20 aa, Mycobacterium
ADGTFEWRFTPAVPSQLVIR

SEQ ID NO: 759586 - protein, 21 aa, Mycobacterium
ADGTPGGWLLGDGGAGGSAVA

SEQ ID NO: 759587 - protein, 21 aa, Mycobacterium
ADGTPGGWLLGDGGAGGSGLA

SEQ ID NO: 759588 - protein, 18 aa, Mycobacterium
ADGVYHLFGLLAKLAVLP

SEQ ID NO: 759589 - protein, 19 aa, Mycobacterium
ADGWCSLSLHAGGTVEELR

SEQ ID NO: 759590 - protein, 17 aa, Mycobacterium
ADGYLVISAYVPKHWDK

SEQ ID NO: 759591 - protein, 18 aa, Mycobacterium
ADHFRYFAAALRAQEGSL

SEQ ID NO: 759592 - protein, 17 aa, Mycobacterium
ADHPEALADGGYRQSKE

SEQ ID NO: 759593 - protein, 18 aa, Mycobacterium
ADHSKLWFAIAAGLLATK

SEQ ID NO: 759594 - protein, 18 aa, Mycobacterium
ADHSKLWFAMAAGLLASR

SEQ ID NO: 759595 - protein, 18 aa, Mycobacterium
ADHSKLWFVIAAGLGAVG

SEQ ID NO: 759596 - protein, 24 aa, Mycobacterium
ADIARKWGFWRLGPFTTVYRETYG

SEQ ID NO: 759597 - protein, 17 aa, Mycobacterium
ADIARWVAQEGLSLDVC

SEQ ID NO: 759598 - protein, 20 aa, Mycobacterium
ADIDGVLAWAVEARERLSAL

SEQ ID NO: 759599 - protein, 17 aa, Mycobacterium
ADIPFGGTVAVIGLGAV

SEQ ID NO: 759600 - protein, 21 aa, Mycobacterium
ADKAVPEWLWQAPACVKRAFL

SEQ ID NO: 759601 - protein, 18 aa, Mycobacterium
ADKFFGFAAAEFGEHTDP

SEQ ID NO: 759602 - protein, 18 aa, Mycobacterium
ADKLAVAGARVFRFRVGE

SEQ ID NO: 759603 - protein, 22 aa, Mycobacterium
ADKLDLRPGITFDTRVVSATLD

SEQ ID NO: 759604 - protein, 22 aa, Mycobacterium
ADKPRPVVFLFPGQGSQFSGMG

SEQ ID NO: 759605 - protein, 20 aa, Mycobacterium
ADKSELGWRMEVNDSGTWAF

SEQ ID NO: 759606 - protein, 17 aa, Mycobacterium
ADKWLPLLENRTPVVAA

SEQ ID NO: 759607 - protein, 18 aa, Mycobacterium
ADLAWGFVDSYVRASGDD

SEQ ID NO: 759608 - protein, 23 aa, Mycobacterium
ADLELGFAAARKFGADANDSGAD

SEQ ID NO: 759609 - protein, 19 aa, Mycobacterium
ADLERRVAQFLGFATVLTS

SEQ ID NO: 759610 - protein, 21 aa, Mycobacterium
ADLFLWPTLYLWEFPKPTISA

SEQ ID NO: 759611 - protein, 17 aa, Mycobacterium
ADLFRWLGPYPDAAVGS

SEQ ID NO: 759612 - protein, 17 aa, Mycobacterium
ADLGATCVSLWSGYSVD

SEQ ID NO: 759613 - protein, 17 aa, Mycobacterium
ADLGFLPGVKRLLDRTP

SEQ ID NO: 759614 - protein, 22 aa, Mycobacterium
ADLGPLRWLPAIPDVLAADPTW

SEQ ID NO: 759615 - protein, 24 aa, Mycobacterium
ADLGRPLIQVGFMRRFDDEYVRLK

SEQ ID NO: 759616 - protein, 23 aa, Mycobacterium
ADLLAAPILRPGSWIGGDRDGNP

SEQ ID NO: 759617 - protein, 23 aa, Mycobacterium
ADLLRLPMRVRRAVRETRAVFEA

SEQ ID NO: 759618 - protein, 18 aa, Mycobacterium
ADLLTDWARRSRRSPGGG

SEQ ID NO: 759619 - protein, 20 aa, Mycobacterium
ADLNFAWPTARIAVIGAEGA

SEQ ID NO: 759620 - protein, 18 aa, Mycobacterium
ADLPKAGVWSQWHSLVFD

SEQ ID NO: 759621 - protein, 21 aa, Mycobacterium
ADLPPAVGVLVEYEGSDSEAA

SEQ ID NO: 759622 - protein, 21 aa, Mycobacterium
ADLPPAVGVLVEYESASGDAT

SEQ ID NO: 759623 - protein, 21 aa, Mycobacterium
ADLPPAVGVLVEYQAGDADKG

SEQ ID NO: 759624 - protein, 21 aa, Mycobacterium
ADLPPAVGVLVEYQGGDKDAA

SEQ ID NO: 759625 - protein, 21 aa, Mycobacterium
ADLPPAVGVLVEYQGSDKEAA

SEQ ID NO: 759626 - protein, 20 aa, Mycobacterium
ADLPPAVGVLVEYTGAGAEA

SEQ ID NO: 759627 - protein, 21 aa, Mycobacterium
ADLPPAVGVLVEYTGDDKSAA

SEQ ID NO: 759628 - protein, 19 aa, Mycobacterium
ADLPRILELLARFTDDAVA

SEQ ID NO: 759629 - protein, 18 aa, Mycobacterium
ADLPWAQQLSEVWRMRDP

SEQ ID NO: 759630 - protein, 19 aa, Mycobacterium
ADLPWSQRLSEVWRMLDPE

SEQ ID NO: 759631 - protein, 25 aa, Mycobacterium
ADLRAIPWVLAWSQSRVMLPGWYGA

SEQ ID NO: 759632 - protein, 25 aa, Mycobacterium
ADLRAIPWVLAWSQSRVMLPGWYGT

SEQ ID NO: 759633 - protein, 17 aa, Mycobacterium
ADLRLDFEDGYGRRSDD

SEQ ID NO: 759634 - protein, 17 aa, Mycobacterium
ADLRPGDLLAVACTGAY

SEQ ID NO: 759635 - protein, 23 aa, Mycobacterium
ADLRPGLLVQLAFAAADFAFQQW

SEQ ID NO: 759636 - protein, 17 aa, Mycobacterium
ADLRQTYPFGMFAVPQS

SEQ ID NO: 759637 - protein, 20 aa, Mycobacterium
ADLRTDWPATLHAAGFEPGQ

SEQ ID NO: 759638 - protein, 17 aa, Mycobacterium
ADLRTDWSRALEAAGFD

SEQ ID NO: 759639 - protein, 17 aa, Mycobacterium
ADLRTDWSRPLEAAGFD

SEQ ID NO: 759640 - protein, 18 aa, Mycobacterium
ADLSRFPADIARVVVRLI

SEQ ID NO: 759641 - protein, 18 aa, Mycobacterium
ADLTRFPPDVARVVVRLI

SEQ ID NO: 759642 - protein, 23 aa, Mycobacterium
ADLVCSWGPMILGHAHPAVVEAV

SEQ ID NO: 759643 - protein, 17 aa, Mycobacterium
ADMDGIGSAITAANAAA

SEQ ID NO: 759644 - protein, 17 aa, Mycobacterium
ADMKSRIDAARLLVWRA

SEQ ID NO: 759645 - protein, 19 aa, Mycobacterium
ADMLPRPLLDVLFATDRET

SEQ ID NO: 759646 - protein, 21 aa, Mycobacterium
ADNCKLISWPIATLSPNGVRT

SEQ ID NO: 759647 - protein, 17 aa, Mycobacterium
ADNGWWSAFGKRRRGKN

SEQ ID NO: 759648 - protein, 24 aa, Mycobacterium
ADNSRTAADFGIRTRFDGVDMTAV

SEQ ID NO: 759649 - protein, 22 aa, Mycobacterium
ADPALILRELWDLHVEFGMQQP

SEQ ID NO: 759650 - protein, 19 aa, Mycobacterium
ADPAMAWRYLEVAANGSEP

SEQ ID NO: 759651 - protein, 21 aa, Mycobacterium
ADPFSRFSLLEAQLRQMSLDE

SEQ ID NO: 759652 - protein, 21 aa, Mycobacterium
ADPGLLRWFEDPKIGGIELKG

SEQ ID NO: 759653 - protein, 24 aa, Mycobacterium
ADPGRRLVLSWGWEGHGDPAPGES

SEQ ID NO: 759654 - protein, 20 aa, Mycobacterium
ADPNARFTVVLPRSEGIEYA

SEQ ID NO: 759655 - protein, 22 aa, Mycobacterium
ADPRLHAAISRFAERTGVPVVV

SEQ ID NO: 759656 - protein, 21 aa, Mycobacterium
ADPRPALGSAYRRVAPVQPNH

SEQ ID NO: 759657 - protein, 25 aa, Mycobacterium
ADPSLRIAILEARFAGFGASGRNGG

SEQ ID NO: 759658 - protein, 21 aa, Mycobacterium
ADPWVADFVYRLFATTPPTGR

SEQ ID NO: 759659 - protein, 17 aa, Mycobacterium
ADQDFTYRFSVPNAGTY

SEQ ID NO: 759660 - protein, 17 aa, Mycobacterium
ADQRIRQAAPFLSYGPF

SEQ ID NO: 759661 - protein, 23 aa, Mycobacterium
ADQRPEVMAAFLRAMRSTTDAIV

SEQ ID NO: 759662 - protein, 27 aa, Mycobacterium
ADQTLPWHPGRCAAVLIGDVVVGHAGQ

SEQ ID NO: 759663 - protein, 17 aa, Mycobacterium
ADQVRWVLQDSAAVALF

SEQ ID NO: 759664 - protein, 18 aa, Mycobacterium
ADQVWWEIWQQISPMLVS

SEQ ID NO: 759665 - protein, 23 aa, Mycobacterium
ADRAAGAYAHRWWVRRTLADALR

SEQ ID NO: 759666 - protein, 19 aa, Mycobacterium
ADRFGLRPMIQFGARVDHI

SEQ ID NO: 759667 - protein, 23 aa, Mycobacterium
ADRFPVMPLPSWLSNPMDPISIR

SEQ ID NO: 759668 - protein, 18 aa, Mycobacterium
ADRLAIQLGHRGVGPGDR

SEQ ID NO: 759669 - protein, 17 aa, Mycobacterium
ADRPAAVLLHLGPGLGN

SEQ ID NO: 759670 - protein, 17 aa, Mycobacterium
ADRPAVVPLSFAQNRLW

SEQ ID NO: 759671 - protein, 21 aa, Mycobacterium
ADRPGWATGFGRVIDEPDARI

SEQ ID NO: 759672 - protein, 20 aa, Mycobacterium
ADRRPHCAWTVIIDESHPEA

SEQ ID NO: 759673 - protein, 24 aa, Mycobacterium
ADRTRAGGGVCAIAAITGASTGPT

SEQ ID NO: 759674 - protein, 18 aa, Mycobacterium
ADRYLGIIERVRAAMPHA

SEQ ID NO: 759675 - protein, 18 aa, Mycobacterium
ADRYPKWWQAPLRWAFRT

SEQ ID NO: 759676 - protein, 20 aa, Mycobacterium
ADSAEYWHWVTLVQQAIVVI

SEQ ID NO: 759677 - protein, 23 aa, Mycobacterium
ADSAPAGWGWIAPYIGMIWPTGN

SEQ ID NO: 759678 - protein, 17 aa, Mycobacterium
ADSGIGFSCLWPETYIA

SEQ ID NO: 759679 - protein, 17 aa, Mycobacterium
ADSRAGLVVALREVADG

SEQ ID NO: 759680 - protein, 17 aa, Mycobacterium
ADSYKAYLMCFGSTGMF

SEQ ID NO: 759681 - protein, 17 aa, Mycobacterium
ADTAVCWDDHGVRACFR

SEQ ID NO: 759682 - protein, 17 aa, Mycobacterium
ADTIWVLHVGRLEEELR

SEQ ID NO: 759683 - protein, 23 aa, Mycobacterium
ADTLRFWLDRGIDGFRLDVAHGM

SEQ ID NO: 759684 - protein, 19 aa, Mycobacterium
ADTMWAFLRSKANTIEGGT

SEQ ID NO: 759685 - protein, 17 aa, Mycobacterium
ADTTRWRQLTATLDPHI

SEQ ID NO: 759686 - protein, 21 aa, Mycobacterium
ADVALILGVPMDFRLGFGAVF

SEQ ID NO: 759687 - protein, 17 aa, Mycobacterium
ADVAPPLVWSAPLGAAL

SEQ ID NO: 759688 - protein, 19 aa, Mycobacterium
ADVDPALVYHYFGSKEGLL

SEQ ID NO: 759689 - protein, 23 aa, Mycobacterium
ADVEAWGGLPLVLDLESTDADDV

SEQ ID NO: 759690 - protein, 19 aa, Mycobacterium
ADVEFARLYGFARPMGSRM

SEQ ID NO: 759691 - protein, 18 aa, Mycobacterium
ADVEKRLCGEHVSIIAYD

SEQ ID NO: 759692 - protein, 18 aa, Mycobacterium
ADVERLWLALSRLLPPPW

SEQ ID NO: 759693 - protein, 21 aa, Mycobacterium
ADVIRYLRWFTFLSAEELAEL

SEQ ID NO: 759694 - protein, 18 aa, Mycobacterium
ADVKFGIEPWFRYFQKIA

SEQ ID NO: 759695 - protein, 18 aa, Mycobacterium
ADVKFGIEPWFRYFQKVA

SEQ ID NO: 759696 - protein, 18 aa, Mycobacterium
ADVLARWPVPGPDDDKYT

SEQ ID NO: 759697 - protein, 17 aa, Mycobacterium
ADVLPLTPLQQGLLFQA

SEQ ID NO: 759698 - protein, 23 aa, Mycobacterium
ADVLRAWAAWCVDLPETINTSIA

SEQ ID NO: 759699 - protein, 24 aa, Mycobacterium
ADVLRIAPDPAWRVDVTEKAVTVS

SEQ ID NO: 759700 - protein, 20 aa, Mycobacterium
ADVLYRLAFRKIDMPDPRAE

SEQ ID NO: 759701 - protein, 19 aa, Mycobacterium
ADVMLRYNFPAAGLTDDAL

SEQ ID NO: 759702 - protein, 23 aa, Mycobacterium
ADVPMMIVAVGFAERIGAVLPEL

SEQ ID NO: 759703 - protein, 24 aa, Mycobacterium
ADVPPNSGMRWWAQWTPFTYPFNM

SEQ ID NO: 759704 - protein, 18 aa, Mycobacterium
ADVRALWPAPGPHDDKYT

SEQ ID NO: 759705 - protein, 20 aa, Mycobacterium
ADVRVCAVAAVAGVPAGPAH

SEQ ID NO: 759706 - protein, 19 aa, Mycobacterium
ADVTACLRTLVRRRLAVAH

SEQ ID NO: 759707 - protein, 19 aa, Mycobacterium
ADVVPADIGMFVDRHALAL

SEQ ID NO: 759708 - protein, 23 aa, Mycobacterium
ADVYRWPLIPALAMVAAMPALGA

SEQ ID NO: 759709 - protein, 18 aa, Mycobacterium
ADWEPLGAIAIGYAQQPA

SEQ ID NO: 759710 - protein, 17 aa, Mycobacterium
ADWEPLGAIAIGYPSEP

SEQ ID NO: 759711 - protein, 24 aa, Mycobacterium
ADWGDPRCPLWLKAETLQPIGAFK

SEQ ID NO: 759712 - protein, 17 aa, Mycobacterium
ADWGEWDAGGAYLGEIP

SEQ ID NO: 759713 - protein, 18 aa, Mycobacterium
ADWGEWEAGGAYLGEIPH

SEQ ID NO: 759714 - protein, 17 aa, Mycobacterium
ADWPRLVAPVFDAKKAV

SEQ ID NO: 759715 - protein, 17 aa, Mycobacterium
ADWPRLVAPVFDAKKSV

SEQ ID NO: 759716 - protein, 19 aa, Mycobacterium
ADWPTEWGGAGTKDALRAT

SEQ ID NO: 759717 - protein, 20 aa, Mycobacterium
ADWSFGFDVGMTFLEIHGPV

SEQ ID NO: 759718 - protein, 20 aa, Mycobacterium
ADYKGRRVIVYFYPAASTPG

SEQ ID NO: 759719 - protein, 20 aa, Mycobacterium
ADYKGRRVVVYFYPAASTPG

SEQ ID NO: 759720 - protein, 20 aa, Mycobacterium
ADYRGARVAVEWPPELQQRV

SEQ ID NO: 759721 - protein, 25 aa, Mycobacterium
ADYRGARVAVEWPPELQVLVRELAG

SEQ ID NO: 759722 - protein, 18 aa, Mycobacterium
ADYRIRLWEALRELERIH

SEQ ID NO: 759723 - protein, 20 aa, Mycobacterium
ADYRTRWTIPIGLREADLTV

SEQ ID NO: 759724 - protein, 19 aa, Mycobacterium
AEAALRERFGYDAWVLAYD

SEQ ID NO: 759725 - protein, 19 aa, Mycobacterium
AEAALYFASERSRYVTGTV

SEQ ID NO: 759726 - protein, 18 aa, Mycobacterium
AEAARLGFTVAVVPSGAV

SEQ ID NO: 759727 - protein, 21 aa, Mycobacterium
AEAAYRRGLSWSDAADTIDLG

SEQ ID NO: 759728 - protein, 20 aa, Mycobacterium
AEAEGLRVLGWRDVPTDDSS

SEQ ID NO: 759729 - protein, 17 aa, Mycobacterium
AEAFFLARLDEWDNTAV

SEQ ID NO: 759730 - protein, 17 aa, Mycobacterium
AEAFPGLARTAALVRLM

SEQ ID NO: 759731 - protein, 20 aa, Mycobacterium
AEAFSRYGAHLSRLNVLPVY

SEQ ID NO: 759732 - protein, 23 aa, Mycobacterium
AEAGVVWVLMHWRPVSAANPHQV

SEQ ID NO: 759733 - protein, 21 aa, Mycobacterium
AEAIERFGPIFAQYFGQSEAP

SEQ ID NO: 759734 - protein, 19 aa, Mycobacterium
AEAILRFATGSARHANLFH

SEQ ID NO: 759735 - protein, 21 aa, Mycobacterium
AEAIRRFGPIFAQYYGQSEAP

SEQ ID NO: 759736 - protein, 18 aa, Mycobacterium
AEALALAGHRVYASMRDT

SEQ ID NO: 759737 - protein, 17 aa, Mycobacterium
AEALFRWLGTKDGQNKV

SEQ ID NO: 759738 - protein, 20 aa, Mycobacterium
AEALGGGWFWPAAAAHPSLP

SEQ ID NO: 759739 - protein, 18 aa, Mycobacterium
AEALKYLAVHAGYTRVHN

SEQ ID NO: 759740 - protein, 18 aa, Mycobacterium
AEALRLAQQLVMPAGIMA

SEQ ID NO: 759741 - protein, 23 aa, Mycobacterium
AEALRPPNWIPWEERIRPGDLGP

SEQ ID NO: 759742 - protein, 20 aa, Mycobacterium
AEALVRWRHPVWGLLLPDSF

SEQ ID NO: 759743 - protein, 17 aa, Mycobacterium
AEAQLAFGNPAVFAEAY

SEQ ID NO: 759744 - protein, 25 aa, Mycobacterium
AEAQRVMQICHHLHGGLGVDITYPM

SEQ ID NO: 759745 - protein, 20 aa, Mycobacterium
AEARGQLRLVEMNQQVLGNL

SEQ ID NO: 759746 - protein, 23 aa, Mycobacterium
AEARNAINFQMAWDALEVAKSIA

SEQ ID NO: 759747 - protein, 21 aa, Mycobacterium
AEARYLWPSVFTQVADEYDRR

SEQ ID NO: 759748 - protein, 18 aa, Mycobacterium
AEAVCTWIARHFRIPLTI

SEQ ID NO: 759749 - protein, 18 aa, Mycobacterium
AEAVDAWLAERQQALAQQ

SEQ ID NO: 759750 - protein, 18 aa, Mycobacterium
AEAVWACRNLAATHYASG

SEQ ID NO: 759751 - protein, 17 aa, Mycobacterium
AEAWPPTAWFEGWATGI

SEQ ID NO: 759752 - protein, 19 aa, Mycobacterium
AEAYSGPWYIAVHGEPGAE

SEQ ID NO: 759753 - protein, 21 aa, Mycobacterium
AECLRAGAWDGLEPAELAGVL

SEQ ID NO: 759754 - protein, 20 aa, Mycobacterium
AECRTGQIIWGWPHCVQDTG

SEQ ID NO: 759755 - protein, 25 aa, Mycobacterium
AEDEVSTAIASLFSASAQEYQMVST

SEQ ID NO: 759756 - protein, 22 aa, Mycobacterium
AEDFAALLLYRLGRLPSDRSSI

SEQ ID NO: 759757 - protein, 22 aa, Mycobacterium
AEDFCLRIGFGGAKQEKLQELL

SEQ ID NO: 759758 - protein, 22 aa, Mycobacterium
AEDGRLRVCATFGQVDDCDSAL

SEQ ID NO: 759759 - protein, 17 aa, Mycobacterium
AEDIIIWSSTEFGYVTL

SEQ ID NO: 759760 - protein, 20 aa, Mycobacterium
AEDLVGLGIDGHRWGLASFN

SEQ ID NO: 759761 - protein, 23 aa, Mycobacterium
AEDPRVAGLIARVQIDAAAPGAV

SEQ ID NO: 759762 - protein, 22 aa, Mycobacterium
AEDPRVAGLIARVQLAASPPAA

SEQ ID NO: 759763 - protein, 23 aa, Mycobacterium
AEDPRVAGLIARVQLTASPSAAV

SEQ ID NO: 759764 - protein, 20 aa, Mycobacterium
AEDVWFPLFRPVSGAEPGRL

SEQ ID NO: 759765 - protein, 20 aa, Mycobacterium
AEEALRCGMVNHVVPLEDLR

SEQ ID NO: 759766 - protein, 24 aa, Mycobacterium
AEEALRMGLVWRICSPEELLPEAR

SEQ ID NO: 759767 - protein, 20 aa, Mycobacterium
AEEGNLWFEWSRSLDNPAEY

SEQ ID NO: 759768 - protein, 21 aa, Mycobacterium
AEEHARLGLWAGDRPAPPQTE

SEQ ID NO: 759769 - protein, 19 aa, Mycobacterium
AEELFDWLAHTTVAEIREL

SEQ ID NO: 759770 - protein, 19 aa, Mycobacterium
AEELVMWWNFVGRNHDEIV

SEQ ID NO: 759771 - protein, 18 aa, Mycobacterium
AEEMLYLAMEDFRVDIVV

SEQ ID NO: 759772 - protein, 21 aa, Mycobacterium
AEEVARVWALLGLTVTGPDVA

SEQ ID NO: 759773 - protein, 21 aa, Mycobacterium
AEEVDRACAPWGLMGEDKQAA

SEQ ID NO: 759774 - protein, 17 aa, Mycobacterium
AEEVMQWAGLDLLILRV

SEQ ID NO: 759775 - protein, 21 aa, Mycobacterium
AEFADIRWRLDVWNASAQVAN

SEQ ID NO: 759776 - protein, 17 aa, Mycobacterium
AEFARTLAAAGLVYAQS

SEQ ID NO: 759777 - protein, 20 aa, Mycobacterium
AEFDRLRALGVRFTQEPTEM

SEQ ID NO: 759778 - protein, 19 aa, Mycobacterium
AEFGELRWRDGAAVAVVLA

SEQ ID NO: 759779 - protein, 22 aa, Mycobacterium
AEFGRGGALFTITGTWMQQPLQ

SEQ ID NO: 759780 - protein, 22 aa, Mycobacterium
AEFKSAASIALSWRLPVVFVVE

SEQ ID NO: 759781 - protein, 22 aa, Mycobacterium
AEFPERAAVVLSGLRKLQGSLA

SEQ ID NO: 759782 - protein, 20 aa, Mycobacterium
AEFPRPAPRPAYSALSGRES

SEQ ID NO: 759783 - protein, 23 aa, Mycobacterium
AEFRARLPLIRDLPVVLAYAASA

SEQ ID NO: 759784 - protein, 28 aa, Mycobacterium
AEFSRLVALLRFPARFFTSAPISRVSAQ

SEQ ID NO: 759785 - protein, 26 aa, Mycobacterium
AEFYRRWSLVTTRVWPTLLQPLRTRA

SEQ ID NO: 759786 - protein, 17 aa, Mycobacterium
AEGCVREALVLAAALSI

SEQ ID NO: 759787 - protein, 20 aa, Mycobacterium
AEGFLPALLDWCRKNDVVFI

SEQ ID NO: 759788 - protein, 21 aa, Mycobacterium
AEGFPSLSGVILNGGLPLHPA

SEQ ID NO: 759789 - protein, 21 aa, Mycobacterium
AEGFPSLSTIILNGGLDLHPA

SEQ ID NO: 759790 - protein, 17 aa, Mycobacterium
AEGFSWTPVHTMSGVDT

SEQ ID NO: 759791 - protein, 17 aa, Mycobacterium
AEGFSWTPVHTVSGVDT

SEQ ID NO: 759792 - protein, 17 aa, Mycobacterium
AEGGIYTRADWILRHAS

SEQ ID NO: 759793 - protein, 18 aa, Mycobacterium
AEGIPGYKHIKIKEAYGL

SEQ ID NO: 759794 - protein, 19 aa, Mycobacterium
AEGKFGFAVKFHRIAADEG

SEQ ID NO: 759795 - protein, 20 aa, Mycobacterium
AEGLLGWLHRVLEHLPGPDR

SEQ ID NO: 759796 - protein, 24 aa, Mycobacterium
AEGLRVIAIRSRLMARMAGQGAVA

SEQ ID NO: 759797 - protein, 18 aa, Mycobacterium
AEGMPCYGSCAGMILLAT

SEQ ID NO: 759798 - protein, 20 aa, Mycobacterium
AEGMWKPGWIEFSGTALSVG

SEQ ID NO: 759799 - protein, 22 aa, Mycobacterium
AEGPPAWLRFFGCNPRHHSLAF

SEQ ID NO: 759800 - protein, 20 aa, Mycobacterium
AEGRLGWRTLDFELEVLETG

SEQ ID NO: 759801 - protein, 20 aa, Mycobacterium
AEGRLGWRTLDFEVEVLDTG

SEQ ID NO: 759802 - protein, 17 aa, Mycobacterium
AEGWVRWSTTVSEKLAE

SEQ ID NO: 759803 - protein, 20 aa, Mycobacterium
AEGYCLPTILSNALYMDRYP

SEQ ID NO: 759804 - protein, 21 aa, Mycobacterium
AEGYRYLLGFVHSAVERAFFG

SEQ ID NO: 759805 - protein, 17 aa, Mycobacterium
AEHGFRVVAPFSRGYAP

SEQ ID NO: 759806 - protein, 24 aa, Mycobacterium
AEHLYRLALPLGIYGGTLEVFRNM

SEQ ID NO: 759807 - protein, 21 aa, Mycobacterium
AEIADAVAFLLSEHASFITGS

SEQ ID NO: 759808 - protein, 21 aa, Mycobacterium
AEIDAPCELIDFWRFNVAFAR

SEQ ID NO: 759809 - protein, 21 aa, Mycobacterium
AEIDAPCELVDFWRFNVAFAR

SEQ ID NO: 759810 - protein, 33 aa, Mycobacterium
AEIDAPCELVDFWRFNVAFARQILDQQPVSAKG

SEQ ID NO: 759811 - protein, 18 aa, Mycobacterium
AEIERLHRELARQPHPLL

SEQ ID NO: 759812 - protein, 17 aa, Mycobacterium
AEIKRFGTWESIGDLGW

SEQ ID NO: 759813 - protein, 22 aa, Mycobacterium
AEIQYILDFGWFPFPLPPLPSF

SEQ ID NO: 759814 - protein, 23 aa, Mycobacterium
AEIRGGPHLKFQLLWYPGTTSDL

SEQ ID NO: 759815 - protein, 18 aa, Mycobacterium
AEIVAFLAGPARWVNGQV

SEQ ID NO: 759816 - protein, 19 aa, Mycobacterium
AEIVSGLAIVSALCRAWGA

SEQ ID NO: 759817 - protein, 18 aa, Mycobacterium
AEIWWRFREAIQTAPKLD

SEQ ID NO: 759818 - protein, 21 aa, Mycobacterium
AEIYVPFSWFEPMWLENLGFM

SEQ ID NO: 759819 - protein, 27 aa, Mycobacterium
AEKILRLRVGFAFGRAISRSGDWYGSP

SEQ ID NO: 759820 - protein, 17 aa, Mycobacterium
AEKLVWVEGNTTYVLIR

SEQ ID NO: 759821 - protein, 19 aa, Mycobacterium
AELAALCRAELAGYKQPRR

SEQ ID NO: 759822 - protein, 17 aa, Mycobacterium
AELAFRASVVVVNETEA

SEQ ID NO: 759823 - protein, 17 aa, Mycobacterium
AELAGGFSTIAGRRSAG

SEQ ID NO: 759824 - protein, 22 aa, Mycobacterium
AELAWVLGCFTGFGQASRMTQF

SEQ ID NO: 759825 - protein, 20 aa, Mycobacterium
AELDEIWKLVLLQQFHDILP

SEQ ID NO: 759826 - protein, 20 aa, Mycobacterium
AELDLPLCINTGIPGPPIPG

SEQ ID NO: 759827 - protein, 17 aa, Mycobacterium
AELDWAGARVRPTMIGH

SEQ ID NO: 759828 - protein, 19 aa, Mycobacterium
AELERRIAQFLGFATVLTS

SEQ ID NO: 759829 - protein, 20 aa, Mycobacterium
AELFAAWAVYLLVGYEQAIL

SEQ ID NO: 759830 - protein, 17 aa, Mycobacterium
AELFKPLPSMVVAHYLG

SEQ ID NO: 759831 - protein, 20 aa, Mycobacterium
AELFPRMRVPQAWYDAGIAA

SEQ ID NO: 759832 - protein, 22 aa, Mycobacterium
AELGATCVSLWSGYSVSYSDAA

SEQ ID NO: 759833 - protein, 21 aa, Mycobacterium
AELGEQCAFGLALIAPQLPPF

SEQ ID NO: 759834 - protein, 31 aa, Mycobacterium
AELGWRNRLGFRDAVAWTIDWERQVHGGADP

SEQ ID NO: 759835 - protein, 17 aa, Mycobacterium
AELHPFVELKGPRHTAP

SEQ ID NO: 759836 - protein, 17 aa, Mycobacterium
AELHTRLTLSFIVTPHT

SEQ ID NO: 759837 - protein, 20 aa, Mycobacterium
AELIARLGVVPDYHKMVDAF

SEQ ID NO: 759838 - protein, 18 aa, Mycobacterium
AELIPKLMSAGVIEVAPL

SEQ ID NO: 759839 - protein, 17 aa, Mycobacterium
AELKRIWTHSAYRKRGL

SEQ ID NO: 759840 - protein, 17 aa, Mycobacterium
AELKRIWTSSAHRRQGL

SEQ ID NO: 759841 - protein, 21 aa, Mycobacterium
AELKYGAVATVWNILDPLQLV

SEQ ID NO: 759842 - protein, 19 aa, Mycobacterium
AELLHRMCPAEGYRDDVVV

SEQ ID NO: 759843 - protein, 18 aa, Mycobacterium
AELLRRFIPFDVDAGVLR

SEQ ID NO: 759844 - protein, 22 aa, Mycobacterium
AELNLGALLFKRGSVHATNLRR

SEQ ID NO: 759845 - protein, 17 aa, Mycobacterium
AELPAAIVVQQHLGDHD

SEQ ID NO: 759846 - protein, 19 aa, Mycobacterium
AELPARCVVDGEIVIATDH

SEQ ID NO: 759847 - protein, 17 aa, Mycobacterium
AELPDRLGTHLTRHTGP

SEQ ID NO: 759848 - protein, 17 aa, Mycobacterium
AELPGRFLFGFDDGRGD

SEQ ID NO: 759849 - protein, 18 aa, Mycobacterium
AELPRPLTLDSFAGLPPA

SEQ ID NO: 759850 - protein, 17 aa, Mycobacterium
AELPRTVTFKVLKRQLA

SEQ ID NO: 759851 - protein, 17 aa, Mycobacterium
AELQWKLTRYLDGDPEP

SEQ ID NO: 759852 - protein, 22 aa, Mycobacterium
AELRARLRLAITRRRHALEGTL

SEQ ID NO: 759853 - protein, 19 aa, Mycobacterium
AELRFAMPGVRVADPKACQ

SEQ ID NO: 759854 - protein, 17 aa, Mycobacterium
AELRFGLYGSLSHPLEA

SEQ ID NO: 759855 - protein, 18 aa, Mycobacterium
AELRFPYLGLAKTFIADN

SEQ ID NO: 759856 - protein, 20 aa, Mycobacterium
AELRGPIWIVTRGAQRVADT

SEQ ID NO: 759857 - protein, 21 aa, Mycobacterium
AELRIAQAQLVGWLEGLFHGI

SEQ ID NO: 759858 - protein, 18 aa, Mycobacterium
AELRQFWNIDFDDAGAIG

SEQ ID NO: 759859 - protein, 17 aa, Mycobacterium
AELRQSWNVDFDDAGAI

SEQ ID NO: 759860 - protein, 23 aa, Mycobacterium
AELRTRLRGILARELGMPEDAVD

SEQ ID NO: 759861 - protein, 17 aa, Mycobacterium
AELVCWRGADGEVHAGP

SEQ ID NO: 759862 - protein, 22 aa, Mycobacterium
AELVRRLSLVHGRVTLSSGKQA

SEQ ID NO: 759863 - protein, 19 aa, Mycobacterium
AELWPDLNLGLPFTYHQGY

SEQ ID NO: 759864 - protein, 20 aa, Mycobacterium
AELWSGGLLHTGDVGYVADD

SEQ ID NO: 759865 - protein, 17 aa, Mycobacterium
AELWTHIARRLRGQPRA

SEQ ID NO: 759866 - protein, 24 aa, Mycobacterium
AELYLRDIPPFFALTDSNNTVAGH

SEQ ID NO: 759867 - protein, 17 aa, Mycobacterium
AEMGMSYHLPRIVGAGV

SEQ ID NO: 759868 - protein, 17 aa, Mycobacterium
AEMGMSYHLPRIVGTSV

SEQ ID NO: 759869 - protein, 21 aa, Mycobacterium
AEMLARAALPVGGFELLDPDA

SEQ ID NO: 759870 - protein, 17 aa, Mycobacterium
AEMLKGGVIMDVVTAEQ

SEQ ID NO: 759871 - protein, 21 aa, Mycobacterium
AEMPMRVIGMLIGIPEELQRS

SEQ ID NO: 759872 - protein, 21 aa, Mycobacterium
AEMPMRVIGMLVGMPDSLQRS

SEQ ID NO: 759873 - protein, 20 aa, Mycobacterium
AEMRARHAAVRFGDRSQATR

SEQ ID NO: 759874 - protein, 17 aa, Mycobacterium
AEMSGPISYIFRPDGTL

SEQ ID NO: 759875 - protein, 17 aa, Mycobacterium
AEMTVALLLTVTRHVLT

SEQ ID NO: 759876 - protein, 22 aa, Mycobacterium
AENGRSWSRWSFIGAGSPSALT

SEQ ID NO: 759877 - protein, 21 aa, Mycobacterium
AENKTRFVIVDAIGVTEHPFV

SEQ ID NO: 759878 - protein, 19 aa, Mycobacterium
AEPAGRCEFLTAYAKPFSL

SEQ ID NO: 759879 - protein, 19 aa, Mycobacterium
AEPAVAPWIHRGLTSQDVL

SEQ ID NO: 759880 - protein, 21 aa, Mycobacterium
AEPAWRVTPNIAIKDERPIGD

SEQ ID NO: 759881 - protein, 23 aa, Mycobacterium
AEPFRAWANFEFRDNRGRWHEVD

SEQ ID NO: 759882 - protein, 24 aa, Mycobacterium
AEPLPEFPTLFARWPSTLTVDGAQ

SEQ ID NO: 759883 - protein, 23 aa, Mycobacterium
AEPLPRISIFLSVFDVHVQRVPV

SEQ ID NO: 759884 - protein, 20 aa, Mycobacterium
AEPMRSYCMAFDVPGELTRS

SEQ ID NO: 759885 - protein, 20 aa, Mycobacterium
AEPNMRWRTFCNRLLAIADR

SEQ ID NO: 759886 - protein, 23 aa, Mycobacterium
AEPRPRVSIFLSIFDAHVQRSPV

SEQ ID NO: 759887 - protein, 23 aa, Mycobacterium
AEQCGRRLIGFSAELGGKNPMIV

SEQ ID NO: 759888 - protein, 18 aa, Mycobacterium
AEQCRRLDALGIDYEIVP

SEQ ID NO: 759889 - protein, 24 aa, Mycobacterium
AEQGEVLKAWFARRTERDLVIKQN

SEQ ID NO: 759890 - protein, 22 aa, Mycobacterium
AEQMKMFLTRLGFGSKIVVTGD

SEQ ID NO: 759891 - protein, 23 aa, Mycobacterium
AEQMKMFLTRLGFGSKIVVTGDI

SEQ ID NO: 759892 - protein, 23 aa, Mycobacterium
AEQMKMFLTRLGFGSKIVVTGDV

SEQ ID NO: 759893 - protein, 21 aa, Mycobacterium
AEQMLRGWEVLWLAQRAATRA

SEQ ID NO: 759894 - protein, 17 aa, Mycobacterium
AEQMLTWPGEPANMILD

SEQ ID NO: 759895 - protein, 17 aa, Mycobacterium
AEQRAAVIAVDMQGYSV

SEQ ID NO: 759896 - protein, 21 aa, Mycobacterium
AEQRFNLELSLCCTQAQTGRV

SEQ ID NO: 759897 - protein, 23 aa, Mycobacterium
AEQRTRFAIRLVDPVRQWKFSPM

SEQ ID NO: 759898 - protein, 21 aa, Mycobacterium
AEQRTRFAIRQVDPVRQWKLS

SEQ ID NO: 759899 - protein, 21 aa, Mycobacterium
AEQRWPRYSPASVELGVLSGL

SEQ ID NO: 759900 - protein, 17 aa, Mycobacterium
AEQVRWVLEDSGAVLAI

SEQ ID NO: 759901 - protein, 23 aa, Mycobacterium
AEQWSGFGDFGFSATVSSVSKPR

SEQ ID NO: 759902 - protein, 23 aa, Mycobacterium
AERAEEFLARWGLGESEGNPPQG

SEQ ID NO: 759903 - protein, 17 aa, Mycobacterium
AERCPPESVAGVYDAQP

SEQ ID NO: 759904 - protein, 18 aa, Mycobacterium
AERFGVHVVDGFGSTEGG

SEQ ID NO: 759905 - protein, 21 aa, Mycobacterium
AERILPVLMRLFQIKSGSPEA

SEQ ID NO: 759906 - protein, 24 aa, Mycobacterium
AERRMCGIFARLFGCRDVSVDDSF

SEQ ID NO: 759907 - protein, 21 aa, Mycobacterium
AERRRLALAAVEQWAAEHDIA

SEQ ID NO: 759908 - protein, 23 aa, Mycobacterium
AERRYGGAEGWPARYAGHLLAGL

SEQ ID NO: 759909 - protein, 20 aa, Mycobacterium
AERTAALGIRVLRYGSAPGL

SEQ ID NO: 759910 - protein, 29 aa, Mycobacterium
AESALPRLLKRLVIMGGAFDYRGNTTPVA

SEQ ID NO: 759911 - protein, 24 aa, Mycobacterium
AESRGLGCSICFAAQAGSQLDAIY

SEQ ID NO: 759912 - protein, 18 aa, Mycobacterium
AETARLAAVFAQLITTGN

SEQ ID NO: 759913 - protein, 21 aa, Mycobacterium
AETDRSFAFLTIFNKNRPGGT

SEQ ID NO: 759914 - protein, 17 aa, Mycobacterium
AETFLQVARAWAENSGR

SEQ ID NO: 759915 - protein, 17 aa, Mycobacterium
AETGIIYIDEVDKIARK

SEQ ID NO: 759916 - protein, 22 aa, Mycobacterium
AETGRSFAFLTIFNKNRPGGTV

SEQ ID NO: 759917 - protein, 26 aa, Mycobacterium
AETGVTVPFVIDWEGVEAAELVALTE

SEQ ID NO: 759918 - protein, 17 aa, Mycobacterium
AETPLLLAVDGKLVGLI

SEQ ID NO: 759919 - protein, 22 aa, Mycobacterium
AETPRPEYLAARTFRPFNEPVL

SEQ ID NO: 759920 - protein, 21 aa, Mycobacterium
AETRLGYSLIRAHTAAIIWSD

SEQ ID NO: 759921 - protein, 19 aa, Mycobacterium
AEVAALWSRLMTALGYPRY

SEQ ID NO: 759922 - protein, 23 aa, Mycobacterium
AEVAPRLGGPIAPCYHAAVDAQT

SEQ ID NO: 759923 - protein, 17 aa, Mycobacterium
AEVARLALFLTSPSARH

SEQ ID NO: 759924 - protein, 18 aa, Mycobacterium
AEVARLALFLTTSAARHI

SEQ ID NO: 759925 - protein, 19 aa, Mycobacterium
AEVARRLAAKGAKLVLTDL

SEQ ID NO: 759926 - protein, 21 aa, Mycobacterium
AEVAYQIAMRFCERELDLPPK

SEQ ID NO: 759927 - protein, 19 aa, Mycobacterium
AEVDLLIHLPVIALLANTA

SEQ ID NO: 759928 - protein, 19 aa, Mycobacterium
AEVGRLCVFLAGGQADFVN

SEQ ID NO: 759929 - protein, 19 aa, Mycobacterium
AEVGWSFFLGKKVVDRLEW

SEQ ID NO: 759930 - protein, 20 aa, Mycobacterium
AEVKAGILVVERQFGYLEFH

SEQ ID NO: 759931 - protein, 17 aa, Mycobacterium
AEVLKLINWELASAASE

SEQ ID NO: 759932 - protein, 17 aa, Mycobacterium
AEVLKLINWELASTEAA

SEQ ID NO: 759933 - protein, 17 aa, Mycobacterium
AEVLRAGYWTDLIGAAE

SEQ ID NO: 759934 - protein, 19 aa, Mycobacterium
AEVPARFEALAALGGLDRA

SEQ ID NO: 759935 - protein, 17 aa, Mycobacterium
AEVPIGGPLDWVPRRLA

SEQ ID NO: 759936 - protein, 18 aa, Mycobacterium
AEVTVFWKSHPKLATPDL

SEQ ID NO: 759937 - protein, 24 aa, Mycobacterium
AEVTYAAEFFRWFSEEAVRTDGAF

SEQ ID NO: 759938 - protein, 25 aa, Mycobacterium
AEVWRRGSVIGSWLLDLTAIALHDS

SEQ ID NO: 759939 - protein, 21 aa, Mycobacterium
AEVYVPFSWFEPMWLENLGFA

SEQ ID NO: 759940 - protein, 21 aa, Mycobacterium
AEVYVPFSWYEPMWLESLGFA

SEQ ID NO: 759941 - protein, 17 aa, Mycobacterium
AEWAHLVAGTSSIREGS

SEQ ID NO: 759942 - protein, 18 aa, Mycobacterium
AEWKVFLELCRKGYEQSK

SEQ ID NO: 759943 - protein, 21 aa, Mycobacterium
AEWKVFLGLLRSRFETDKGKW

SEQ ID NO: 759944 - protein, 19 aa, Mycobacterium
AEWLIRWLRETGVSVLLMD

SEQ ID NO: 759945 - protein, 23 aa, Mycobacterium
AEWPLARTRWRPMYLAAAGMLTA

SEQ ID NO: 759946 - protein, 18 aa, Mycobacterium
AEWRSWRHAAKRLVIGTN

SEQ ID NO: 759947 - protein, 18 aa, Mycobacterium
AEYARLDFLAGLRVVPAE

SEQ ID NO: 759948 - protein, 21 aa, Mycobacterium
AEYAYRFAPLVGIYGGTLEVF

SEQ ID NO: 759949 - protein, 17 aa, Mycobacterium
AEYDRFALLHGDYRLDN

SEQ ID NO: 759950 - protein, 23 aa, Mycobacterium
AEYFTVPLSNIWGTTLNILDRTG

SEQ ID NO: 759951 - protein, 20 aa, Mycobacterium
AEYFTVPLSNVWGTTLELVD

SEQ ID NO: 759952 - protein, 18 aa, Mycobacterium
AEYFVWFGGEYDVTNEDR

SEQ ID NO: 759953 - protein, 20 aa, Mycobacterium
AEYLSALGFQFEAFELEHLG

SEQ ID NO: 759954 - protein, 17 aa, Mycobacterium
AEYRGALQVATRQELVQ

SEQ ID NO: 759955 - protein, 22 aa, Mycobacterium
AEYVFRFAPLVGIYGGTLEVFR

SEQ ID NO: 759956 - protein, 23 aa, Mycobacterium
AEYVYRFAPLVGIYGGTLEVFRN

SEQ ID NO: 759957 - protein, 18 aa, Mycobacterium
AFAAKLAERVGCRRADDG

SEQ ID NO: 759958 - protein, 20 aa, Mycobacterium
AFAFAGGRLGYLIATPAVID

SEQ ID NO: 759959 - protein, 20 aa, Mycobacterium
AFAFAGGRLGYLVATPALID

SEQ ID NO: 759960 - protein, 17 aa, Mycobacterium
AFAGGWFHSGDLVRQDE

SEQ ID NO: 759961 - protein, 17 aa, Mycobacterium
AFAKGWVTECLRAAYPL

SEQ ID NO: 759962 - protein, 21 aa, Mycobacterium
AFAPARAGAWLSHHPHTRLIN

SEQ ID NO: 759963 - protein, 17 aa, Mycobacterium
AFARYHSDRGWPDLPSV

SEQ ID NO: 759964 - protein, 17 aa, Mycobacterium
AFASPRFECHFNVEVGK

SEQ ID NO: 759965 - protein, 17 aa, Mycobacterium
AFCGFDIEKVAGYTDAD

SEQ ID NO: 759966 - protein, 20 aa, Mycobacterium
AFDHFGWLGGFFAMDLPATS

SEQ ID NO: 759967 - protein, 17 aa, Mycobacterium
AFDKWRWIPLLNGNGDD

SEQ ID NO: 759968 - protein, 19 aa, Mycobacterium
AFDPCCPFGGYKNSGIGRE

SEQ ID NO: 759969 - protein, 20 aa, Mycobacterium
AFDPCCPFGGYKNSGIGREN

SEQ ID NO: 759970 - protein, 18 aa, Mycobacterium
AFDRWGLMPRMFVGAAER

SEQ ID NO: 759971 - protein, 24 aa, Mycobacterium
AFEESRCVPVLLGALGSIKGTDTG

SEQ ID NO: 759972 - protein, 17 aa, Mycobacterium
AFEHLRRAIALDDNLPY

SEQ ID NO: 759973 - protein, 20 aa, Mycobacterium
AFELIDWPVAVVIAAGHLLA

SEQ ID NO: 759974 - protein, 19 aa, Mycobacterium
AFERQWWKFAGAKEEAIKE

SEQ ID NO: 759975 - protein, 18 aa, Mycobacterium
AFESWRWSTPSERQRALL

SEQ ID NO: 759976 - protein, 17 aa, Mycobacterium
AFFDEFFLGAADAGVRQ

SEQ ID NO: 759977 - protein, 17 aa, Mycobacterium
AFFDEFFLGAADTGVRQ

SEQ ID NO: 759978 - protein, 19 aa, Mycobacterium
AFFPPIVAIALPFEHQHPS

SEQ ID NO: 759979 - protein, 19 aa, Mycobacterium
AFFPVLVCALSWAQRWFPS

SEQ ID NO: 759980 - protein, 17 aa, Mycobacterium
AFGAEWLVIRALSDLAG

SEQ ID NO: 759981 - protein, 18 aa, Mycobacterium
AFGKRWVTECLRAAYPLG

SEQ ID NO: 759982 - protein, 18 aa, Mycobacterium
AFGRARLAFLERHLDLAR

SEQ ID NO: 759983 - protein, 18 aa, Mycobacterium
AFGWDRINALLSRVDSIR

SEQ ID NO: 759984 - protein, 25 aa, Mycobacterium
AFHWWLVLATLRWGVICRFQAERHL

SEQ ID NO: 759985 - protein, 17 aa, Mycobacterium
AFIFPPSFLHWINYSVM

SEQ ID NO: 759986 - protein, 19 aa, Mycobacterium
AFIPQSVWRRMGDDFLGET

SEQ ID NO: 759987 - protein, 19 aa, Mycobacterium
AFLELCPFAAWGTKFPVGG

SEQ ID NO: 759988 - protein, 18 aa, Mycobacterium
AFLGRLALVRIYNGKLKK

SEQ ID NO: 759989 - protein, 18 aa, Mycobacterium
AFLGRLALVRIYNGKLRK

SEQ ID NO: 759990 - protein, 18 aa, Mycobacterium
AFLGYAIECVLDLRDGTG

SEQ ID NO: 759991 - protein, 25 aa, Mycobacterium
AFLLKRLEALGGKVIRPATVTSVTQ

SEQ ID NO: 759992 - protein, 21 aa, Mycobacterium
AFLLNHMLVWGFTGQVISAVL

SEQ ID NO: 759993 - protein, 17 aa, Mycobacterium
AFLPDWPGVPVGNEEGE

SEQ ID NO: 759994 - protein, 17 aa, Mycobacterium
AFLPIASRCRAQRKTTD

SEQ ID NO: 759995 - protein, 23 aa, Mycobacterium
AFLRCGAISRILAYVAPILLGGP

SEQ ID NO: 759996 - protein, 17 aa, Mycobacterium
AFNDWPAAVKDIRNILA

SEQ ID NO: 759997 - protein, 17 aa, Mycobacterium
AFNLGFGDITFGDKTSN

SEQ ID NO: 759998 - protein, 17 aa, Mycobacterium
AFPAWLAPVQVVGIPVA

SEQ ID NO: 759999 - protein, 21 aa, Mycobacterium
AFPLARLKRAMLIGIPESAID

SEQ ID NO: 760000 - protein, 23 aa, Mycobacterium
AFPSEIAEAVLFLSSPRSSFITG

SEQ ID NO: 760001 - protein, 20 aa, Mycobacterium
AFQPYLAWMGTVIAMAQQRA

SEQ ID NO: 760002 - protein, 18 aa, Mycobacterium
AFRLPWRAGTTVYEIDQP

SEQ ID NO: 760003 - protein, 18 aa, Mycobacterium
AFRPELRVPLLTVVTETD

SEQ ID NO: 760004 - protein, 18 aa, Mycobacterium
AFSPRPVPTVSIGHLHQV

SEQ ID NO: 760005 - protein, 18 aa, Mycobacterium
AFSPRPVPTVSVAHLHEV

SEQ ID NO: 760006 - protein, 18 aa, Mycobacterium
AFSPYGLRETAIKPSYGL

SEQ ID NO: 760007 - protein, 17 aa, Mycobacterium
AFSRPAIWWSKLGGPVV

SEQ ID NO: 760008 - protein, 17 aa, Mycobacterium
AFSRPATWWSKAGGPVV

SEQ ID NO: 760009 - protein, 17 aa, Mycobacterium
AFTAKKPSLAWAETYPG

SEQ ID NO: 760010 - protein, 18 aa, Mycobacterium
AFTALAARFLGPSLDGVR

SEQ ID NO: 760011 - protein, 23 aa, Mycobacterium
AFTLPELLGLVGLPDMTVVVDQE

SEQ ID NO: 760012 - protein, 19 aa, Mycobacterium
AFTRLAARFLGPAITGVEA

SEQ ID NO: 760013 - protein, 18 aa, Mycobacterium
AFVDAWLLRACAKLGIRL

SEQ ID NO: 760014 - protein, 18 aa, Mycobacterium
AFVLIPWLDVDPDATLTV

SEQ ID NO: 760015 - protein, 18 aa, Mycobacterium
AFVQRRLNLMKAPPATPA

SEQ ID NO: 760016 - protein, 19 aa, Mycobacterium
AFYPGRIDLGLGRSAQRRG

SEQ ID NO: 760017 - protein, 19 aa, Mycobacterium
AGAAFARWAAFRDAMPLVP

SEQ ID NO: 760018 - protein, 29 aa, Mycobacterium
AGACRAAGVGFSFGYPVDWRVQDADTGPP

SEQ ID NO: 760019 - protein, 17 aa, Mycobacterium
AGADITRHLEVQNAPAG

SEQ ID NO: 760020 - protein, 17 aa, Mycobacterium
AGAEAFRDGDDDPKGNI

SEQ ID NO: 760021 - protein, 23 aa, Mycobacterium
AGAEIRVGYFLAEDHALRLLNLR

SEQ ID NO: 760022 - protein, 17 aa, Mycobacterium
AGAELVFGDASTDVAFC

SEQ ID NO: 760023 - protein, 22 aa, Mycobacterium
AGAEVRVGYFLAEDHALRLLNL

SEQ ID NO: 760024 - protein, 20 aa, Mycobacterium
AGAFEVARAAMIHPLEVLAN

SEQ ID NO: 760025 - protein, 20 aa, Mycobacterium
AGAFPVWLAPVQVVGIPVAD

SEQ ID NO: 760026 - protein, 24 aa, Mycobacterium
AGAFTLDGLGGWFIDRIEGDPSNV

SEQ ID NO: 760027 - protein, 19 aa, Mycobacterium
AGAGGRGGLIGAAGGTGSI

SEQ ID NO: 760028 - protein, 17 aa, Mycobacterium
AGAGHWPWLEQPDTVAG

SEQ ID NO: 760029 - protein, 18 aa, Mycobacterium
AGAIALVVPAARWPLAPD

SEQ ID NO: 760030 - protein, 20 aa, Mycobacterium
AGAKFAAVFARRGLIAEFGI

SEQ ID NO: 760031 - protein, 18 aa, Mycobacterium
AGALAELDAAFATDRAPF

SEQ ID NO: 760032 - protein, 18 aa, Mycobacterium
AGALHWDDPESILAWLDA

SEQ ID NO: 760033 - protein, 20 aa, Mycobacterium
AGALPDHWTAHTLRHRFATR

SEQ ID NO: 760034 - protein, 17 aa, Mycobacterium
AGALWEWPPSVCGRHHD

SEQ ID NO: 760035 - protein, 25 aa, Mycobacterium
AGAMLIAVLGFRWQLVIFASPLLGV

SEQ ID NO: 760036 - protein, 17 aa, Mycobacterium
AGARVFRFRVGELDPGA

SEQ ID NO: 760037 - protein, 18 aa, Mycobacterium
AGATRLGLSGSRIVLDGF

SEQ ID NO: 760038 - protein, 18 aa, Mycobacterium
AGATVCAGPPVPADTTVT

SEQ ID NO: 760039 - protein, 17 aa, Mycobacterium
AGATYRPGTRFGPQGIR

SEQ ID NO: 760040 - protein, 18 aa, Mycobacterium
AGAVAHRLNEAGGRDAVD

SEQ ID NO: 760041 - protein, 20 aa, Mycobacterium
AGAVAPGFYGGMPPMGPVAS

SEQ ID NO: 760042 - protein, 20 aa, Mycobacterium
AGAVPSFLGYHGFPASICSS

SEQ ID NO: 760043 - protein, 19 aa, Mycobacterium
AGAVPSWISAAFVLEEGFG

SEQ ID NO: 760044 - protein, 19 aa, Mycobacterium
AGAVPSWISAAFVLEEGFP

SEQ ID NO: 760045 - protein, 20 aa, Mycobacterium
AGAVSFRFGDRTQLNGVPRD

SEQ ID NO: 760046 - protein, 18 aa, Mycobacterium
AGAVSRASARWCAGARWS

SEQ ID NO: 760047 - protein, 24 aa, Mycobacterium
AGAVTVPVNFLAHAGSDGGIGTGG

SEQ ID NO: 760048 - protein, 18 aa, Mycobacterium
AGAVVALLLPRSDHAILA

SEQ ID NO: 760049 - protein, 20 aa, Mycobacterium
AGCDSCYALALAARLKAMGS

SEQ ID NO: 760050 - protein, 22 aa, Mycobacterium
AGCGMACPFCATGQGGLKRNLS

SEQ ID NO: 760051 - protein, 22 aa, Mycobacterium
AGCGMACPFCATGQGGLQRNLT

SEQ ID NO: 760052 - protein, 21 aa, Mycobacterium
AGCGMACPFCATGQGGLTRNL

SEQ ID NO: 760053 - protein, 24 aa, Mycobacterium
AGCKICDRPACPQRAFPYLGHPVY

SEQ ID NO: 760054 - protein, 23 aa, Mycobacterium
AGCRRLKPALATYARFVRLNYLN

SEQ ID NO: 760055 - protein, 18 aa, Mycobacterium
AGDELYCDVWIDSIRKAH

SEQ ID NO: 760056 - protein, 24 aa, Mycobacterium
AGDEVSAAIAAVFSAHGQSYQTLS

SEQ ID NO: 760057 - protein, 28 aa, Mycobacterium
AGDEVSTAIATLFSEHAQSYQALSAQMA

SEQ ID NO: 760058 - protein, 23 aa, Mycobacterium
AGDGKGGLLLSTRGGYFRVDLTA

SEQ ID NO: 760059 - protein, 19 aa, Mycobacterium
AGDGRRCGLTVVGTHLPHG

SEQ ID NO: 760060 - protein, 21 aa, Mycobacterium
AGDGWLAMEFIDGRPAISLAV

SEQ ID NO: 760061 - protein, 19 aa, Mycobacterium
AGDPLRRWGPFPGGMADPE

SEQ ID NO: 760062 - protein, 20 aa, Mycobacterium
AGDTRLAAVLAELDDADTRA

SEQ ID NO: 760063 - protein, 17 aa, Mycobacterium
AGEAAWQVPSLSLADDA

SEQ ID NO: 760064 - protein, 29 aa, Mycobacterium
AGEAIDLLKGVLMPAIMSAVKPPVPPVPA

SEQ ID NO: 760065 - protein, 17 aa, Mycobacterium
AGEGARVGVHYGTNADT

SEQ ID NO: 760066 - protein, 19 aa, Mycobacterium
AGEIARLALFLASPQARHI

SEQ ID NO: 760067 - protein, 18 aa, Mycobacterium
AGELAAGLARIWSELLGR

SEQ ID NO: 760068 - protein, 18 aa, Mycobacterium
AGELCAPVRFLVRRDSVV

SEQ ID NO: 760069 - protein, 20 aa, Mycobacterium
AGELPFGYFARGWLDAQALK

SEQ ID NO: 760070 - protein, 26 aa, Mycobacterium
AGERARCATYPLLAVQAWATHHDTTL

SEQ ID NO: 760071 - protein, 24 aa, Mycobacterium
AGERPAVVPLSFAQSRLWFLHQLS

SEQ ID NO: 760072 - protein, 26 aa, Mycobacterium
AGETGTWGNAGLPGKAGDAGGAGAVG

SEQ ID NO: 760073 - protein, 17 aa, Mycobacterium
AGEVARFPANIDFAKSL

SEQ ID NO: 760074 - protein, 18 aa, Mycobacterium
AGEVIGYTGLDPGATVEN

SEQ ID NO: 760075 - protein, 22 aa, Mycobacterium
AGFAARAAWRWTKHLHGRADRT

SEQ ID NO: 760076 - protein, 17 aa, Mycobacterium
AGFALVIGVDRAGHGDA

SEQ ID NO: 760077 - protein, 20 aa, Mycobacterium
AGFASLWTYERLLFPADPVE

SEQ ID NO: 760078 - protein, 17 aa, Mycobacterium
AGFDAVWASEFYSRSGS

SEQ ID NO: 760079 - protein, 17 aa, Mycobacterium
AGFGAPRYGVKPIVMPK

SEQ ID NO: 760080 - protein, 18 aa, Mycobacterium
AGFGAPRYGVKPIVMPKP

SEQ ID NO: 760081 - protein, 18 aa, Mycobacterium
AGFHPEWPLIGAAHHLLR

SEQ ID NO: 760082 - protein, 20 aa, Mycobacterium
AGFQCGFCTAGMITTASTFT

SEQ ID NO: 760083 - protein, 22 aa, Mycobacterium
AGFQCGFCTAGMVLTAATLTGD

SEQ ID NO: 760084 - protein, 21 aa, Mycobacterium
AGFSARFADSVAMLAIDPHMF

SEQ ID NO: 760085 - protein, 24 aa, Mycobacterium
AGGAGGKAWLMGDGGSGGHGGNGG

SEQ ID NO: 760086 - protein, 23 aa, Mycobacterium
AGGAGGSAWLLGTGGTGGAGGWA

SEQ ID NO: 760087 - protein, 21 aa, Mycobacterium
AGGALPRWVGYSAPKPKTVVE

SEQ ID NO: 760088 - protein, 21 aa, Mycobacterium
AGGASQVHWAAGMVVTSGRRQ

SEQ ID NO: 760089 - protein, 24 aa, Mycobacterium
AGGATGWFGSTGMTGAGGAGGHGG

SEQ ID NO: 760090 - protein, 20 aa, Mycobacterium
AGGDGGWAFGSGGTGGTGGY

SEQ ID NO: 760091 - protein, 17 aa, Mycobacterium
AGGFGVLGAVGFSPEQL

SEQ ID NO: 760092 - protein, 17 aa, Mycobacterium
AGGFGVLGAVGFTPEQL

SEQ ID NO: 760093 - protein, 18 aa, Mycobacterium
AGGFTLDGLGGWFITGVE

SEQ ID NO: 760094 - protein, 20 aa, Mycobacterium
AGGGACPIRFRCVGCDHFRT

SEQ ID NO: 760095 - protein, 17 aa, Mycobacterium
AGGGGFGGFGLAGGGGT

SEQ ID NO: 760096 - protein, 18 aa, Mycobacterium
AGGGGLWFGNGGAGGIGG

SEQ ID NO: 760097 - protein, 17 aa, Mycobacterium
AGGIGLNLGNPGTPGSQ

SEQ ID NO: 760098 - protein, 23 aa, Mycobacterium
AGGIPAILGELWRGGHLHETVHS

SEQ ID NO: 760099 - protein, 18 aa, Mycobacterium
AGGIRPGLLSDFTALPPE

SEQ ID NO: 760100 - protein, 18 aa, Mycobacterium
AGGISGWELTPSVDGHFD

SEQ ID NO: 760101 - protein, 24 aa, Mycobacterium
AGGKGGVAAGIFDRGGTGGTGGNG

SEQ ID NO: 760102 - protein, 17 aa, Mycobacterium
AGGKMIRFVVCRKGGRH

SEQ ID NO: 760103 - protein, 25 aa, Mycobacterium
AGGLGGRGGLLLGNGGAGGVGGVGA

SEQ ID NO: 760104 - protein, 17 aa, Mycobacterium
AGGLYRWEGRYLRGEDE

SEQ ID NO: 760105 - protein, 20 aa, Mycobacterium
AGGMGIPAFYTPAGVGTAVA

SEQ ID NO: 760106 - protein, 20 aa, Mycobacterium
AGGMGIPAFYTPAGVGTQIA

SEQ ID NO: 760107 - protein, 21 aa, Mycobacterium
AGGMGIPGFYTPAGVGTQIAD

SEQ ID NO: 760108 - protein, 18 aa, Mycobacterium
AGGMGVLGCVRFNDPDEL

SEQ ID NO: 760109 - protein, 17 aa, Mycobacterium
AGGMGVLHRNLPVAEQA

SEQ ID NO: 760110 - protein, 25 aa, Mycobacterium
AGGNAIAFAGSTSFSSASGGAGGTG

SEQ ID NO: 760111 - protein, 24 aa, Mycobacterium
AGGNGGAGGWLFGDGGIGGTGGAG

SEQ ID NO: 760112 - protein, 24 aa, Mycobacterium
AGGNGGDAIGFGSGNGGLGGGGGA

SEQ ID NO: 760113 - protein, 23 aa, Mycobacterium
AGGNGGNGGWLFSNGGVGGAGGA

SEQ ID NO: 760114 - protein, 24 aa, Mycobacterium
AGGNGGRGGMFIGNGGAGGAGGTG

SEQ ID NO: 760115 - protein, 20 aa, Mycobacterium
AGGNGGWLWGYGGHGGAGGA

SEQ ID NO: 760116 - protein, 27 aa, Mycobacterium
AGGNGSSITALWGIYGGGAGGEGGSAT

SEQ ID NO: 760117 - protein, 21 aa, Mycobacterium
AGGPALLAFTGRRLFAVIVLT

SEQ ID NO: 760118 - protein, 18 aa, Mycobacterium
AGGPWAGLVGAGGGDGGI

SEQ ID NO: 760119 - protein, 21 aa, Mycobacterium
AGGSAGLWGAGGAGGAGGAGA

SEQ ID NO: 760120 - protein, 20 aa, Mycobacterium
AGGSAGLWGRGGDGGVGGDA

SEQ ID NO: 760121 - protein, 18 aa, Mycobacterium
AGGSAWLFGTGGVGGTGG

SEQ ID NO: 760122 - protein, 20 aa, Mycobacterium
AGGTGAWLFGNGGSGGAGGA

SEQ ID NO: 760123 - protein, 23 aa, Mycobacterium
AGHALKASIAWRTLRARLLSRRG

SEQ ID NO: 760124 - protein, 17 aa, Mycobacterium
AGHEITRAAGLKVLHLE

SEQ ID NO: 760125 - protein, 17 aa, Mycobacterium
AGHFVWVREALDLRGKF

SEQ ID NO: 760126 - protein, 17 aa, Mycobacterium
AGHGGKGGDGFSPATSG

SEQ ID NO: 760127 - protein, 17 aa, Mycobacterium
AGHPPVWTPLPVHYADY

SEQ ID NO: 760128 - protein, 18 aa, Mycobacterium
AGHPPVWTPLPVHYADYT

SEQ ID NO: 760129 - protein, 21 aa, Mycobacterium
AGHTAGWGGNGGYGGQGGGGA

SEQ ID NO: 760130 - protein, 17 aa, Mycobacterium
AGHWSVPPSRRFIPEDQ

SEQ ID NO: 760131 - protein, 23 aa, Mycobacterium
AGHYTLRAAIDWQQHKPNGSHLV

SEQ ID NO: 760132 - protein, 23 aa, Mycobacterium
AGHYTLRASVDWQQHKPNGAHVV

SEQ ID NO: 760133 - protein, 19 aa, Mycobacterium
AGIAALFGAFGREYQIVSS

SEQ ID NO: 760134 - protein, 17 aa, Mycobacterium
AGIAALFGSHGAAYQAV

SEQ ID NO: 760135 - protein, 17 aa, Mycobacterium
AGIEFPAPALLYGYGAY

SEQ ID NO: 760136 - protein, 18 aa, Mycobacterium
AGIFPEARLDTMTPEQLS

SEQ ID NO: 760137 - protein, 19 aa, Mycobacterium
AGIGCAFARPGRTVVIAGD

SEQ ID NO: 760138 - protein, 35 aa, Mycobacterium
AGIGPGQAVAICLPRSWQLVCVMLGIRRAGATVVP

SEQ ID NO: 760139 - protein, 18 aa, Mycobacterium
AGIGPIPAVTAVAASGLG

SEQ ID NO: 760140 - protein, 18 aa, Mycobacterium
AGIPAELVAAGFEDPDEI

SEQ ID NO: 760141 - protein, 18 aa, Mycobacterium
AGIPRLASFPGVAGADEY

SEQ ID NO: 760142 - protein, 17 aa, Mycobacterium
AGIPSLILWTAGDQPMW

SEQ ID NO: 760143 - protein, 17 aa, Mycobacterium
AGIPTLILWTAGDQPFW

SEQ ID NO: 760144 - protein, 18 aa, Mycobacterium
AGIQPVWLREGLRFWMRT

SEQ ID NO: 760145 - protein, 17 aa, Mycobacterium
AGITLFSPLRHWKAAEG

SEQ ID NO: 760146 - protein, 27 aa, Mycobacterium
AGIVPWNFPLLLAVWKLGPALAAGNTI

SEQ ID NO: 760147 - protein, 25 aa, Mycobacterium
AGIVRRLAEDGARVVFTYSSSVQQA

SEQ ID NO: 760148 - protein, 19 aa, Mycobacterium
AGKALIQWRSPSWFASMQQ

SEQ ID NO: 760149 - protein, 17 aa, Mycobacterium
AGKPFGFKPSAMVPAYG

SEQ ID NO: 760150 - protein, 22 aa, Mycobacterium
AGKTEFPGLVAIGQLIHEPELR

SEQ ID NO: 760151 - protein, 18 aa, Mycobacterium
AGLAGRFHFTLTFNSYTP

SEQ ID NO: 760152 - protein, 18 aa, Mycobacterium
AGLAMKWRWRDKFAGKDG

SEQ ID NO: 760153 - protein, 17 aa, Mycobacterium
AGLARYAAADAMQKGAM

SEQ ID NO: 760154 - protein, 18 aa, Mycobacterium
AGLARYASSLGMTVVLVD

SEQ ID NO: 760155 - protein, 26 aa, Mycobacterium
AGLDARCWRLPWPAGTTVYELDQPKV

SEQ ID NO: 760156 - protein, 17 aa, Mycobacterium
AGLDHLLTWGVLAAPLT

SEQ ID NO: 760157 - protein, 18 aa, Mycobacterium
AGLDLMLFHAWYLYRNLD

SEQ ID NO: 760158 - protein, 17 aa, Mycobacterium
AGLEIPLLIGGATTSRA

SEQ ID NO: 760159 - protein, 19 aa, Mycobacterium
AGLEMPKVPSFMWLEVDDV

SEQ ID NO: 760160 - protein, 18 aa, Mycobacterium
AGLFIGEPGTGWVADPGN

SEQ ID NO: 760161 - protein, 18 aa, Mycobacterium
AGLGIGFTAVLPRLTPAT

SEQ ID NO: 760162 - protein, 19 aa, Mycobacterium
AGLGIRFVAVLPRLTPATD

SEQ ID NO: 760163 - protein, 17 aa, Mycobacterium
AGLGWGMMPEQLGREGL

SEQ ID NO: 760164 - protein, 19 aa, Mycobacterium
AGLKLESWLGPAAASMATA

SEQ ID NO: 760165 - protein, 18 aa, Mycobacterium
AGLKWCRKAAELGTIDEA

SEQ ID NO: 760166 - protein, 18 aa, Mycobacterium
AGLLAGAVTLVWHAGEVR

SEQ ID NO: 760167 - protein, 23 aa, Mycobacterium
AGLLAGAVTLVWQAGKVLQVNTL

SEQ ID NO: 760168 - protein, 18 aa, Mycobacterium
AGLLAGAVTVVWQRGELL

SEQ ID NO: 760169 - protein, 18 aa, Mycobacterium
AGLLKIWEALIIVYPNGT

SEQ ID NO: 760170 - protein, 17 aa, Mycobacterium
AGLLTAWVATGFDVLAS

SEQ ID NO: 760171 - protein, 17 aa, Mycobacterium
AGLPEEWSPDSESSREV

SEQ ID NO: 760172 - protein, 17 aa, Mycobacterium
AGLPEEWSPESESSREL

SEQ ID NO: 760173 - protein, 17 aa, Mycobacterium
AGLPMGAKFGTLVHAVL

SEQ ID NO: 760174 - protein, 17 aa, Mycobacterium
AGLPRGLAVAGAYLDGI

SEQ ID NO: 760175 - protein, 17 aa, Mycobacterium
AGLRAAWLTMIAVASTH

SEQ ID NO: 760176 - protein, 27 aa, Mycobacterium
AGLRAGIPMLIRWLWLDQPIWAAGIEE

SEQ ID NO: 760177 - protein, 24 aa, Mycobacterium
AGLRAGVPMLILWLWLDQPMWAEA

SEQ ID NO: 760178 - protein, 19 aa, Mycobacterium
AGLRPKSLREFIGQPRVRE

SEQ ID NO: 760179 - protein, 19 aa, Mycobacterium
AGLRRRRMVVLPWLTPTIA

SEQ ID NO: 760180 - protein, 17 aa, Mycobacterium
AGLRVDAGLARLLGLSR

SEQ ID NO: 760181 - protein, 17 aa, Mycobacterium
AGLSLADIDAFEVNEAF

SEQ ID NO: 760182 - protein, 23 aa, Mycobacterium
AGLSLRPGYVLSDGFRVPGLPVP

SEQ ID NO: 760183 - protein, 22 aa, Mycobacterium
AGLSSPRIVGWIMRTDSSDLPW

SEQ ID NO: 760184 - protein, 17 aa, Mycobacterium
AGLSVGDVALWEINEAF

SEQ ID NO: 760185 - protein, 18 aa, Mycobacterium
AGLTASRFVACPFGAPGT

SEQ ID NO: 760186 - protein, 17 aa, Mycobacterium
AGLTGSRFVACPFGAPG

SEQ ID NO: 760187 - protein, 18 aa, Mycobacterium
AGLTGSRFVACPFGAPGA

SEQ ID NO: 760188 - protein, 24 aa, Mycobacterium
AGLTRWPFADVRGSHNLIYSRDKA

SEQ ID NO: 760189 - protein, 21 aa, Mycobacterium
AGLVRRLSVVHGRVTLSSGKE

SEQ ID NO: 760190 - protein, 18 aa, Mycobacterium
AGMAVDWRGAIGTANLVE

SEQ ID NO: 760191 - protein, 17 aa, Mycobacterium
AGMLRFAPLNSFPDNRN

SEQ ID NO: 760192 - protein, 17 aa, Mycobacterium
AGMPPEFTARARRALGP

SEQ ID NO: 760193 - protein, 18 aa, Mycobacterium
AGMQYCWVIRLTGDHITE

SEQ ID NO: 760194 - protein, 18 aa, Mycobacterium
AGNGTPGLTGRDTGGPGG

SEQ ID NO: 760195 - protein, 20 aa, Mycobacterium
AGNMSSWSALFPHASSTGSP

SEQ ID NO: 760196 - protein, 23 aa, Mycobacterium
AGNWACIVPHTWLWTSPLGPEVR

SEQ ID NO: 760197 - protein, 18 aa, Mycobacterium
AGNWGQWALLRAADSTVR

SEQ ID NO: 760198 - protein, 17 aa, Mycobacterium
AGPEFRGAPGYEGYLND

SEQ ID NO: 760199 - protein, 21 aa, Mycobacterium
AGPEFRRFALSSGVEARHTAL

SEQ ID NO: 760200 - protein, 17 aa, Mycobacterium
AGPFLNVALEYGGNLDF

SEQ ID NO: 760201 - protein, 23 aa, Mycobacterium
AGPHLRAGWTWAPSSVTEPQVQR

SEQ ID NO: 760202 - protein, 17 aa, Mycobacterium
AGPLGGVRRALRRAERL

SEQ ID NO: 760203 - protein, 24 aa, Mycobacterium
AGPLGWRGALRIGVKMAGALETAH

SEQ ID NO: 760204 - protein, 17 aa, Mycobacterium
AGPLLAFSGGHLCYQIE

SEQ ID NO: 760205 - protein, 23 aa, Mycobacterium
AGPTGRFRPLWAHNRADERKALT

SEQ ID NO: 760206 - protein, 25 aa, Mycobacterium
AGPYDRWPLGRGFERYYGFLGGDTH

SEQ ID NO: 760207 - protein, 24 aa, Mycobacterium
AGQDCPDWVPGELWIGGRGIARGY

SEQ ID NO: 760208 - protein, 18 aa, Mycobacterium
AGQPIFWVVRALELLEDF

SEQ ID NO: 760209 - protein, 26 aa, Mycobacterium
AGQSRWPEMMWLEFLFDRLGGPEVFE

SEQ ID NO: 760210 - protein, 22 aa, Mycobacterium
AGRAARIAKFWAAEAGARVAAT

SEQ ID NO: 760211 - protein, 17 aa, Mycobacterium
AGRDIKAGRVWTNCYHQ

SEQ ID NO: 760212 - protein, 23 aa, Mycobacterium
AGRPRPPSAPAWFVDAAPGLRQF

SEQ ID NO: 760213 - protein, 17 aa, Mycobacterium
AGRRAALEMVRRHRLLE

SEQ ID NO: 760214 - protein, 23 aa, Mycobacterium
AGRRADFLLGMVVSTGVGGGLVL

SEQ ID NO: 760215 - protein, 18 aa, Mycobacterium
AGRRFAMLSPIVATHRKL

SEQ ID NO: 760216 - protein, 19 aa, Mycobacterium
AGRRFARLAPIVATYRKLV

SEQ ID NO: 760217 - protein, 19 aa, Mycobacterium
AGRRFARLAPIVGTYRKLM

SEQ ID NO: 760218 - protein, 18 aa, Mycobacterium
AGRVVWHAAAIVAVGAAC

SEQ ID NO: 760219 - protein, 22 aa, Mycobacterium
AGRYGTKNGKGWTGDFDDETKA

SEQ ID NO: 760220 - protein, 18 aa, Mycobacterium
AGSGLQWVSLRPTVFASN

SEQ ID NO: 760221 - protein, 19 aa, Mycobacterium
AGSLPAEWWGADAPGSPPS

SEQ ID NO: 760222 - protein, 19 aa, Mycobacterium
AGSLPVEWWGADAPGSPPS

SEQ ID NO: 760223 - protein, 18 aa, Mycobacterium
AGSLWWRTVQAVAAEYPE

SEQ ID NO: 760224 - protein, 18 aa, Mycobacterium
AGSMPIFALYGIPHRDCG

SEQ ID NO: 760225 - protein, 17 aa, Mycobacterium
AGSWIAFQVPGNFDAPS

SEQ ID NO: 760226 - protein, 24 aa, Mycobacterium
AGTAATARPAISCDATDCVGVTAG

SEQ ID NO: 760227 - protein, 25 aa, Mycobacterium
AGTAGKGGLFGGSGSAGKAGATGAA

SEQ ID NO: 760228 - protein, 23 aa, Mycobacterium
AGTEIARLLPFVEWLRDAYPHQL

SEQ ID NO: 760229 - protein, 23 aa, Mycobacterium
AGTFAFAGAEAFRAEENTAKQNV

SEQ ID NO: 760230 - protein, 22 aa, Mycobacterium
AGTFPWVLAVTVPFRDEAQRAG

SEQ ID NO: 760231 - protein, 22 aa, Mycobacterium
AGTGGAGGFGVFPGGQTGQNGT

SEQ ID NO: 760232 - protein, 21 aa, Mycobacterium
AGTKGPIPWWWRPSGALFDQF

SEQ ID NO: 760233 - protein, 17 aa, Mycobacterium
AGTKGPVPWWWRPSGAL

SEQ ID NO: 760234 - protein, 26 aa, Mycobacterium
AGTLKRASSVVPRYGVRLTVMSRPPA

SEQ ID NO: 760235 - protein, 22 aa, Mycobacterium
AGTPVLAVFELRLTGSARTTGA

SEQ ID NO: 760236 - protein, 18 aa, Mycobacterium
AGTRKPVWFFAYPGKPSE

SEQ ID NO: 760237 - protein, 24 aa, Mycobacterium
AGVARPDLVIGWWAAPTILEHGTP

SEQ ID NO: 760238 - protein, 18 aa, Mycobacterium
AGVARSGFYFYFDSKYAV

SEQ ID NO: 760239 - protein, 22 aa, Mycobacterium
AGVCFPDLLMLRGEYQMKVPAP

SEQ ID NO: 760240 - protein, 24 aa, Mycobacterium
AGVERPDLVIGWWAAPTILEHGTP

SEQ ID NO: 760241 - protein, 21 aa, Mycobacterium
AGVFRGASRIHNLGFANLGIA

SEQ ID NO: 760242 - protein, 19 aa, Mycobacterium
AGVGMDWRAVYAGWGARLV

SEQ ID NO: 760243 - protein, 22 aa, Mycobacterium
AGVKGGEVLRHWATARSALEAW

SEQ ID NO: 760244 - protein, 18 aa, Mycobacterium
AGVLAEWMAGAGAEVEVA

SEQ ID NO: 760245 - protein, 18 aa, Mycobacterium
AGVLKPLPVRAFDIRCAA

SEQ ID NO: 760246 - protein, 18 aa, Mycobacterium
AGVLRFVVLDGLGRPGRL

SEQ ID NO: 760247 - protein, 23 aa, Mycobacterium
AGVLRPLPVTAFDVRRAPAALRY

SEQ ID NO: 760248 - protein, 24 aa, Mycobacterium
AGVNRPDLVIGWWAAPTILEHGTP

SEQ ID NO: 760249 - protein, 19 aa, Mycobacterium
AGVPCWSGGPARWAHVTVA

SEQ ID NO: 760250 - protein, 19 aa, Mycobacterium
AGVPGQCQQVWCPVCALAA

SEQ ID NO: 760251 - protein, 17 aa, Mycobacterium
AGVPVVFLTAYYGLSVL

SEQ ID NO: 760252 - protein, 23 aa, Mycobacterium
AGVPWPSEWSRAYFTPVTVLDGR

SEQ ID NO: 760253 - protein, 18 aa, Mycobacterium
AGVPWVLMHWRPVSDDNP

SEQ ID NO: 760254 - protein, 18 aa, Mycobacterium
AGVQFATFPETVVPYYPY

SEQ ID NO: 760255 - protein, 18 aa, Mycobacterium
AGVRRIVYLGGFVPDAPE

SEQ ID NO: 760256 - protein, 18 aa, Mycobacterium
AGVRRIVYLGGFVPDEDS

SEQ ID NO: 760257 - protein, 17 aa, Mycobacterium
AGVRRIVYLGGFVPEDD

SEQ ID NO: 760258 - protein, 18 aa, Mycobacterium
AGVSGEWSLPENFRSKLS

SEQ ID NO: 760259 - protein, 18 aa, Mycobacterium
AGVSSGLLRHHFGSKQEL

SEQ ID NO: 760260 - protein, 18 aa, Mycobacterium
AGVTWGVIQYHFGDRNGL

SEQ ID NO: 760261 - protein, 20 aa, Mycobacterium
AGVVRRWLRDRGELPNRPLV

SEQ ID NO: 760262 - protein, 18 aa, Mycobacterium
AGVWSQWHSLAFDVSVHE

SEQ ID NO: 760263 - protein, 18 aa, Mycobacterium
AGWAVGWKKDAFWGREAL

SEQ ID NO: 760264 - protein, 17 aa, Mycobacterium
AGWDFSWLDGRATEERP

SEQ ID NO: 760265 - protein, 19 aa, Mycobacterium
AGWLRYGLPASLGGRDGSN

SEQ ID NO: 760266 - protein, 19 aa, Mycobacterium
AGWLRYGLPASLGGRDGTN

SEQ ID NO: 760267 - protein, 18 aa, Mycobacterium
AGWMWRPLIEQMGSGYRF

SEQ ID NO: 760268 - protein, 20 aa, Mycobacterium
AGWSAVRWRNLTGGIVALHA

SEQ ID NO: 760269 - protein, 17 aa, Mycobacterium
AGWWIRRRLHEVAVHRV

SEQ ID NO: 760270 - protein, 25 aa, Mycobacterium
AGWWRAPLRWTLRGSLAVRSRLMVR

SEQ ID NO: 760271 - protein, 20 aa, Mycobacterium
AGWYEHEWRAYGYGFPSAKV

SEQ ID NO: 760272 - protein, 18 aa, Mycobacterium
AGYAGWRKAVQRTLDWVD

SEQ ID NO: 760273 - protein, 25 aa, Mycobacterium
AGYDRAFEFPGFVPAYIRPQFCEGR

SEQ ID NO: 760274 - protein, 18 aa, Mycobacterium
AGYPWWSLSPLGMDNDQA

SEQ ID NO: 760275 - protein, 18 aa, Mycobacterium
AGYTYPIQHSWRITNQTN

SEQ ID NO: 760276 - protein, 20 aa, Mycobacterium
AHAAWLWSRRRGVVGGHSAS

SEQ ID NO: 760277 - protein, 19 aa, Mycobacterium
AHAEHFWTWAIDMLGHGYT

SEQ ID NO: 760278 - protein, 21 aa, Mycobacterium
AHAGYMFKLWDQLVWGSTLVV

SEQ ID NO: 760279 - protein, 23 aa, Mycobacterium
AHAPEALPVLFGHIGEGNLHLNV

SEQ ID NO: 760280 - protein, 17 aa, Mycobacterium
AHARFVEAAARVNALLD

SEQ ID NO: 760281 - protein, 18 aa, Mycobacterium
AHCLRVMVELSPDAGTGT

SEQ ID NO: 760282 - protein, 17 aa, Mycobacterium
AHCWEPKRLRLHLFSIA

SEQ ID NO: 760283 - protein, 18 aa, Mycobacterium
AHDLAGLPVRVFRSDMIL

SEQ ID NO: 760284 - protein, 20 aa, Mycobacterium
AHDQFRWFAGGWAVNADLPT

SEQ ID NO: 760285 - protein, 20 aa, Mycobacterium
AHEFGLPIVEVIAGGDISEA

SEQ ID NO: 760286 - protein, 18 aa, Mycobacterium
AHELGLPIVEVIAGGDIS

SEQ ID NO: 760287 - protein, 19 aa, Mycobacterium
AHEPRPAFERTIPAGHSAA

SEQ ID NO: 760288 - protein, 17 aa, Mycobacterium
AHFECWTMLAAWAEQTS

SEQ ID NO: 760289 - protein, 17 aa, Mycobacterium
AHFECWTMLGAWAEQTS

SEQ ID NO: 760290 - protein, 21 aa, Mycobacterium
AHFGHKEFILCLGYGADHIKN

SEQ ID NO: 760291 - protein, 22 aa, Mycobacterium
AHFRRAHLRLAQIRLTNGEDLL

SEQ ID NO: 760292 - protein, 25 aa, Mycobacterium
AHFTLELLEAAGLPPGVINLLNGDG

SEQ ID NO: 760293 - protein, 20 aa, Mycobacterium
AHGPEEVWDRFIRVLTERIE

SEQ ID NO: 760294 - protein, 24 aa, Mycobacterium
AHGPVRFPGVPTWFSRTPGRVSGP

SEQ ID NO: 760295 - protein, 29 aa, Mycobacterium
AHGRTAAQVLLRWSIQLGNVVISRSANPE

SEQ ID NO: 760296 - protein, 30 aa, Mycobacterium
AHGRTPAQVLIRWSLQLGNIVIPRSSSPER

SEQ ID NO: 760297 - protein, 17 aa, Mycobacterium
AHGSALFERGETQILGV

SEQ ID NO: 760298 - protein, 26 aa, Mycobacterium
AHHIGRAGNMFSVFFGTEPVRDFQSA

SEQ ID NO: 760299 - protein, 17 aa, Mycobacterium
AHHPRLLLANAVHEGLL

SEQ ID NO: 760300 - protein, 17 aa, Mycobacterium
AHHPRLLVANAVHETML

SEQ ID NO: 760301 - protein, 20 aa, Mycobacterium
AHIFAQAGLRVWDVEELPTH

SEQ ID NO: 760302 - protein, 18 aa, Mycobacterium
AHILPVIFEWQVGHEVNG

SEQ ID NO: 760303 - protein, 20 aa, Mycobacterium
AHILVLRSRFPGGFTSEVRG

SEQ ID NO: 760304 - protein, 24 aa, Mycobacterium
AHIYGVLCAAGFAGGSVLDLGCGS

SEQ ID NO: 760305 - protein, 24 aa, Mycobacterium
AHLARAHLIYGEWLRRCNRRSDAR

SEQ ID NO: 760306 - protein, 26 aa, Mycobacterium
AHLISPWGTWEWMWPAAAGVDLPAGG

SEQ ID NO: 760307 - protein, 17 aa, Mycobacterium
AHLKLPIDVIATVPIAE

SEQ ID NO: 760308 - protein, 17 aa, Mycobacterium
AHLLGGVLVGHSVGAYV

SEQ ID NO: 760309 - protein, 20 aa, Mycobacterium
AHLRAFLTFAEHAQRFALDQ

SEQ ID NO: 760310 - protein, 17 aa, Mycobacterium
AHLRAFRAYAGHCQEIA

SEQ ID NO: 760311 - protein, 24 aa, Mycobacterium
AHLRRARFWWRYCRGPVGALHGRC

SEQ ID NO: 760312 - protein, 18 aa, Mycobacterium
AHLSRLNVLPVYGGSSYA

SEQ ID NO: 760313 - protein, 17 aa, Mycobacterium
AHLWAQYGLAGVLEHEG

SEQ ID NO: 760314 - protein, 17 aa, Mycobacterium
AHLWERVSIEFSNHTEE

SEQ ID NO: 760315 - protein, 17 aa, Mycobacterium
AHLYRLFPKLGVTNRAG

SEQ ID NO: 760316 - protein, 19 aa, Mycobacterium
AHMWFGDLVTMAWWDDLWL

SEQ ID NO: 760317 - protein, 18 aa, Mycobacterium
AHMWFGDLVTMKWWDDLW

SEQ ID NO: 760318 - protein, 22 aa, Mycobacterium
AHPAARIGFMLADAAPVAALTT

SEQ ID NO: 760319 - protein, 20 aa, Mycobacterium
AHPGRFVLGVGVGHPEHTGE

SEQ ID NO: 760320 - protein, 18 aa, Mycobacterium
AHPKWDFATGDMFNFGLA

SEQ ID NO: 760321 - protein, 21 aa, Mycobacterium
AHPRPDFKNRILAAFNDGMKH

SEQ ID NO: 760322 - protein, 23 aa, Mycobacterium
AHQGRLKYCYNFLGIDHYMVAAT

SEQ ID NO: 760323 - protein, 20 aa, Mycobacterium
AHRAKWGLLLARTDPNMPKH

SEQ ID NO: 760324 - protein, 18 aa, Mycobacterium
AHRCPPESVAHAYEPAPQ

SEQ ID NO: 760325 - protein, 23 aa, Mycobacterium
AHRFPAPAPPRWSTGRRAVIASL

SEQ ID NO: 760326 - protein, 18 aa, Mycobacterium
AHRSWPRIDLERFAEARR

SEQ ID NO: 760327 - protein, 23 aa, Mycobacterium
AHSELRFAVAEGFPDYKPELPGG

SEQ ID NO: 760328 - protein, 23 aa, Mycobacterium
AHSLALQRLRLDPVLDLQMRLGE

SEQ ID NO: 760329 - protein, 24 aa, Mycobacterium
AHSSCFSMALALKLGENHTPPQRL

SEQ ID NO: 760330 - protein, 17 aa, Mycobacterium
AHTRLRVGLPMAPNTVF

SEQ ID NO: 760331 - protein, 18 aa, Mycobacterium
AHVRPGVVGTHFESEWAL

SEQ ID NO: 760332 - protein, 18 aa, Mycobacterium
AHVRRLLIEAAWHHRTVH

SEQ ID NO: 760333 - protein, 17 aa, Mycobacterium
AHWAQWCFVVARTEKGS

SEQ ID NO: 760334 - protein, 19 aa, Mycobacterium
AHWQTAGVLLGIWWAGAEL

SEQ ID NO: 760335 - protein, 23 aa, Mycobacterium
AHYDWLVGCGVVFKPEFFDEPGW

SEQ ID NO: 760336 - protein, 20 aa, Mycobacterium
AHYLGAFAMTSAKQGLDVGQ

SEQ ID NO: 760337 - protein, 19 aa, Mycobacterium
AIAHAAWRGADTVGEPDIR

SEQ ID NO: 760338 - protein, 18 aa, Mycobacterium
AIALDWLRKHGYQDLASR

SEQ ID NO: 760339 - protein, 20 aa, Mycobacterium
AIALFLRWCARTGRSWQAGV

SEQ ID NO: 760340 - protein, 17 aa, Mycobacterium
AIANWRLFSILLRSLNI

SEQ ID NO: 760341 - protein, 26 aa, Mycobacterium
AIAQARLGPGRIHHCMRAIGAAERAL

SEQ ID NO: 760342 - protein, 27 aa, Mycobacterium
AIAQARLGPGRIHHCMRALGGAERALA

SEQ ID NO: 760343 - protein, 22 aa, Mycobacterium
AIARAAGIILTWNDIADLSAVV

SEQ ID NO: 760344 - protein, 17 aa, Mycobacterium
AICADCLREVRDPADRR

SEQ ID NO: 760345 - protein, 19 aa, Mycobacterium
AICHGPWTLVEAGVAVGRT

SEQ ID NO: 760346 - protein, 17 aa, Mycobacterium
AICKPEWIPEGTRVVNE

SEQ ID NO: 760347 - protein, 26 aa, Mycobacterium
AIDEIIRWATPVHCFQRTALDDVEIG

SEQ ID NO: 760348 - protein, 21 aa, Mycobacterium
AIDHFRYFAGVLRAQEGSLSQ

SEQ ID NO: 760349 - protein, 19 aa, Mycobacterium
AIDIPARWESMVKAMRNNG

SEQ ID NO: 760350 - protein, 24 aa, Mycobacterium
AIDLRDDWPAALLEAGFDPHARTA

SEQ ID NO: 760351 - protein, 20 aa, Mycobacterium
AIDSGEEWVVLRAEQLEIEP

SEQ ID NO: 760352 - protein, 25 aa, Mycobacterium
AIEEVFIRAGIPYKVVGGVRFYERR

SEQ ID NO: 760353 - protein, 18 aa, Mycobacterium
AIEIKSDFLASGEPAVVG

SEQ ID NO: 760354 - protein, 18 aa, Mycobacterium
AIELWKIVDRPNLLIKIP

SEQ ID NO: 760355 - protein, 18 aa, Mycobacterium
AIERPAVIPLSFAQSRLW

SEQ ID NO: 760356 - protein, 18 aa, Mycobacterium
AIGGGLCLALAADIRVAA

SEQ ID NO: 760357 - protein, 27 aa, Mycobacterium
AIGGTGGDGGRGFGIGKGGFGGGGGSA

SEQ ID NO: 760358 - protein, 18 aa, Mycobacterium
AIGMCFTGGYALAMAADD

SEQ ID NO: 760359 - protein, 19 aa, Mycobacterium
AIGREIHDPYALYAAIAAQ

SEQ ID NO: 760360 - protein, 20 aa, Mycobacterium
AIHHCVRAGIAFKATAGLHH

SEQ ID NO: 760361 - protein, 19 aa, Mycobacterium
AIHRFPGSMAKRIQTLAQI

SEQ ID NO: 760362 - protein, 17 aa, Mycobacterium
AIIQWRPLQWFAQRPPG

SEQ ID NO: 760363 - protein, 23 aa, Mycobacterium
AIIRRPRGGFTYEELLALVESRL

SEQ ID NO: 760364 - protein, 20 aa, Mycobacterium
AIKGDEAWENIFPPTEEQPE

SEQ ID NO: 760365 - protein, 25 aa, Mycobacterium
AIKREIFRLVGLDWKGFTSAVILPQ

SEQ ID NO: 760366 - protein, 17 aa, Mycobacterium
AIKRVLPGLGYRLTSRG

SEQ ID NO: 760367 - protein, 18 aa, Mycobacterium
AILAEFNHPLVIQAETMD

SEQ ID NO: 760368 - protein, 18 aa, Mycobacterium
AILDEWKTITGLDRKVDD

SEQ ID NO: 760369 - protein, 25 aa, Mycobacterium
AILIRPAPVPGFRGPRSFAVPEFDP

SEQ ID NO: 760370 - protein, 25 aa, Mycobacterium
AILLPAHWQTAAVLFGVWWIGAEAV

SEQ ID NO: 760371 - protein, 17 aa, Mycobacterium
AILPLYYLRRADIAETD

SEQ ID NO: 760372 - protein, 17 aa, Mycobacterium
AILSHFVAQIDAEESAD

SEQ ID NO: 760373 - protein, 19 aa, Mycobacterium
AIMSATWLRAVERFHEHAL

SEQ ID NO: 760374 - protein, 21 aa, Mycobacterium
AIPAWKIAPALVYGNTVVWKP

SEQ ID NO: 760375 - protein, 21 aa, Mycobacterium
AIPKLRAGSFFPSLLERRRRI

SEQ ID NO: 760376 - protein, 17 aa, Mycobacterium
AIPQQWGGLGLNLAQDV

SEQ ID NO: 760377 - protein, 22 aa, Mycobacterium
AIPRLLGAAGFDCSEVAMQRHR

SEQ ID NO: 760378 - protein, 23 aa, Mycobacterium
AIPSCKASVFVPFSVELQGDATT

SEQ ID NO: 760379 - protein, 19 aa, Mycobacterium
AIPTNWPGPTFAYRILTRK

SEQ ID NO: 760380 - protein, 28 aa, Mycobacterium
AIPVETIEFFWGLGIPVYEVWGESECVG

SEQ ID NO: 760381 - protein, 18 aa, Mycobacterium
AIQRHWFAAMEVLAEYSI

SEQ ID NO: 760382 - protein, 21 aa, Mycobacterium
AIRAFRAAYELEMATVAVYPY

SEQ ID NO: 760383 - protein, 23 aa, Mycobacterium
AIRAFRAAYELGIGTVAVYAYED

SEQ ID NO: 760384 - protein, 23 aa, Mycobacterium
AIRAFRAAYELGISTVAVFAYED

SEQ ID NO: 760385 - protein, 19 aa, Mycobacterium
AIRAFRAAYELGVGTVAVY

SEQ ID NO: 760386 - protein, 20 aa, Mycobacterium
AIRALCPQARIFGVEPELAG

SEQ ID NO: 760387 - protein, 17 aa, Mycobacterium
AIRAVSCSIALTRNYPY

SEQ ID NO: 760388 - protein, 18 aa, Mycobacterium
AIRQIEFLTRATAQRPDA

SEQ ID NO: 760389 - protein, 26 aa, Mycobacterium
AIRSIGCGFGLVKAQEKLGCGESVDR

SEQ ID NO: 760390 - protein, 18 aa, Mycobacterium
AIRSNFRSLPVVDVIQVR

SEQ ID NO: 760391 - protein, 25 aa, Mycobacterium
AIRWWLVLATLRWGVICLYQAERHL

SEQ ID NO: 760392 - protein, 22 aa, Mycobacterium
AISDAEEFGRWFGVRFDGPFVA

SEQ ID NO: 760393 - protein, 19 aa, Mycobacterium
AISGMNAVGGWRGAPRPVL

SEQ ID NO: 760394 - protein, 19 aa, Mycobacterium
AISGMNAVGGWRGAPRPVQ

SEQ ID NO: 760395 - protein, 21 aa, Mycobacterium
AITAPAWRNKPSWYQVSTQDR

SEQ ID NO: 760396 - protein, 23 aa, Mycobacterium
AITPKASWPWVRTLLHSVFDQPD

SEQ ID NO: 760397 - protein, 21 aa, Mycobacterium
AITRGVGWLRLNRADKRNALS

SEQ ID NO: 760398 - protein, 21 aa, Mycobacterium
AITRPRWFLQWAKTLHPPELR

SEQ ID NO: 760399 - protein, 17 aa, Mycobacterium
AITTRLLVPRARYDEAV

SEQ ID NO: 760400 - protein, 17 aa, Mycobacterium
AIVFGDWPAHTGARPAV

SEQ ID NO: 760401 - protein, 19 aa, Mycobacterium
AIVHLGFGFGIVFINPALA

SEQ ID NO: 760402 - protein, 18 aa, Mycobacterium
AIVPWNFPFEVTLNKLGQ

SEQ ID NO: 760403 - protein, 25 aa, Mycobacterium
AIVPWNFPLLLGIWKIGPALAAGNS

SEQ ID NO: 760404 - protein, 19 aa, Mycobacterium
AIVPWNMPQFLIATKLVPA

SEQ ID NO: 760405 - protein, 19 aa, Mycobacterium
AIVPWNMPQFLIVTKLVPA

SEQ ID NO: 760406 - protein, 18 aa, Mycobacterium
AIVRPLLRFFFRSWFRVE

SEQ ID NO: 760407 - protein, 19 aa, Mycobacterium
AIWRINELLNWQVAASGET

SEQ ID NO: 760408 - protein, 21 aa, Mycobacterium
AKAAFAEFIESLGLRPLDVGG

SEQ ID NO: 760409 - protein, 19 aa, Mycobacterium
AKACARVMLGASISQLREE

SEQ ID NO: 760410 - protein, 19 aa, Mycobacterium
AKADSAWHLHQLTANTELA

SEQ ID NO: 760411 - protein, 19 aa, Mycobacterium
AKAFLCGEIARWVDEEGLS

SEQ ID NO: 760412 - protein, 19 aa, Mycobacterium
AKAFLCSEIARWIDEEGLS

SEQ ID NO: 760413 - protein, 19 aa, Mycobacterium
AKAFLCSEIARWVDEEGLS

SEQ ID NO: 760414 - protein, 18 aa, Mycobacterium
AKAFLCSEIARWVEEEGL

SEQ ID NO: 760415 - protein, 18 aa, Mycobacterium
AKAFLCSEIARWVNEEGL

SEQ ID NO: 760416 - protein, 23 aa, Mycobacterium
AKAKARRGPLCLGIDPHPELLRA

SEQ ID NO: 760417 - protein, 17 aa, Mycobacterium
AKALRQFAYEAGVPLAQ

SEQ ID NO: 760418 - protein, 20 aa, Mycobacterium
AKAQRGPLCVGIDPHPELLR

SEQ ID NO: 760419 - protein, 17 aa, Mycobacterium
AKARAAGAIEAREMDEG

SEQ ID NO: 760420 - protein, 17 aa, Mycobacterium
AKARGLWNLFLPAESGL

SEQ ID NO: 760421 - protein, 20 aa, Mycobacterium
AKARLSWAGSTLVGVGVARL

SEQ ID NO: 760422 - protein, 18 aa, Mycobacterium
AKARRAILEGCDHQVHVR

SEQ ID NO: 760423 - protein, 24 aa, Mycobacterium
AKATETWRFPAFFHALLDAGIYPP

SEQ ID NO: 760424 - protein, 23 aa, Mycobacterium
AKATETWRFPPFFHALLERGVYP

SEQ ID NO: 760425 - protein, 24 aa, Mycobacterium
AKATETWRYPAFFHGLLSRGVYPP

SEQ ID NO: 760426 - protein, 20 aa, Mycobacterium
AKAWPRYVRIAADLPSTATH

SEQ ID NO: 760427 - protein, 21 aa, Mycobacterium
AKDRLLELSIAMHSTGPDVMG

SEQ ID NO: 760428 - protein, 21 aa, Mycobacterium
AKDRLLELSIDMHSTGPDVMG

SEQ ID NO: 760429 - protein, 18 aa, Mycobacterium
AKEALAVFDTCPVIERAL

SEQ ID NO: 760430 - protein, 17 aa, Mycobacterium
AKFAAVFARRGLIAEFG

SEQ ID NO: 760431 - protein, 17 aa, Mycobacterium
AKFMWPHMFNAVADEYD

SEQ ID NO: 760432 - protein, 18 aa, Mycobacterium
AKFVRRFGDVGGELHRAA

SEQ ID NO: 760433 - protein, 18 aa, Mycobacterium
AKGATGWFGASRATVYVD

SEQ ID NO: 760434 - protein, 22 aa, Mycobacterium
AKGLAHRGVQLWIPQQVVLEWA

SEQ ID NO: 760435 - protein, 22 aa, Mycobacterium
AKGRLRIAAAVGINGDVGAKAQ

SEQ ID NO: 760436 - protein, 19 aa, Mycobacterium
AKHDLRRTLGTVFVATAVG

SEQ ID NO: 760437 - protein, 19 aa, Mycobacterium
AKHWRRWRLTGDRSSYRST

SEQ ID NO: 760438 - protein, 19 aa, Mycobacterium
AKIGMYIALRLLRDGAHTT

SEQ ID NO: 760439 - protein, 18 aa, Mycobacterium
AKIGYPPMRVWGVPAAGL

SEQ ID NO: 760440 - protein, 21 aa, Mycobacterium
AKIIKFSGCYHGHVDALLADA

SEQ ID NO: 760441 - protein, 25 aa, Mycobacterium
AKIIWDVAFYWGFIGLLYMNNRYAR

SEQ ID NO: 760442 - protein, 18 aa, Mycobacterium
AKKAVVMTYILNAGTDYE

SEQ ID NO: 760443 - protein, 21 aa, Mycobacterium
AKKFRFPTFVGAFKYYTSYTL

SEQ ID NO: 760444 - protein, 22 aa, Mycobacterium
AKLAELQRLWLIEATKYNVVPL

SEQ ID NO: 760445 - protein, 17 aa, Mycobacterium
AKLGAVAVPVNWRLTAP

SEQ ID NO: 760446 - protein, 17 aa, Mycobacterium
AKLGCSFVVVGHSERRT

SEQ ID NO: 760447 - protein, 19 aa, Mycobacterium
AKLGCTFAVVGHSERRTYH

SEQ ID NO: 760448 - protein, 18 aa, Mycobacterium
AKLGCTFVVVGHSERRTY

SEQ ID NO: 760449 - protein, 19 aa, Mycobacterium
AKLKGYRLICVIPENTSIE

SEQ ID NO: 760450 - protein, 17 aa, Mycobacterium
AKLPADFRVVIIGAGIA

SEQ ID NO: 760451 - protein, 20 aa, Mycobacterium
AKLPPGWPMLVASWLAQAEG

SEQ ID NO: 760452 - protein, 23 aa, Mycobacterium
AKLPRWLSLPAQLVMQALIGHVR

SEQ ID NO: 760453 - protein, 18 aa, Mycobacterium
AKLPRWRLDLDDESIRFD

SEQ ID NO: 760454 - protein, 21 aa, Mycobacterium
AKLRAGTVWINAYRVVAPHVP

SEQ ID NO: 760455 - protein, 20 aa, Mycobacterium
AKLRLAGLVKGRREGTFVYY

SEQ ID NO: 760456 - protein, 17 aa, Mycobacterium
AKLRMARLVRTRRDGTT

SEQ ID NO: 760457 - protein, 19 aa, Mycobacterium
AKLRSHWARRLPATIVGRT

SEQ ID NO: 760458 - protein, 22 aa, Mycobacterium
AKLSELLGFLWPGRYRTFSQAD

SEQ ID NO: 760459 - protein, 17 aa, Mycobacterium
AKMSGLRRGFVKIFCRP

SEQ ID NO: 760460 - protein, 19 aa, Mycobacterium
AKNARLWRGLLRCTATADA

SEQ ID NO: 760461 - protein, 21 aa, Mycobacterium
AKPDALLPLARRETGECLAED

SEQ ID NO: 760462 - protein, 17 aa, Mycobacterium
AKPEIWAGVAAPVMIWS

SEQ ID NO: 760463 - protein, 24 aa, Mycobacterium
AKPFDAVVCSLVLCSVDDPEQVVS

SEQ ID NO: 760464 - protein, 17 aa, Mycobacterium
AKPFIAALCDAQAALAG

SEQ ID NO: 760465 - protein, 19 aa, Mycobacterium
AKPGSYRWLKGGRRPAQAP

SEQ ID NO: 760466 - protein, 17 aa, Mycobacterium
AKPGTWLYGRDVLDLIR

SEQ ID NO: 760467 - protein, 18 aa, Mycobacterium
AKPSAPWARPGEVVDTSL

SEQ ID NO: 760468 - protein, 18 aa, Mycobacterium
AKQLWFNRILPFARNLQA

SEQ ID NO: 760469 - protein, 19 aa, Mycobacterium
AKQRLVWRFCQQYPQAARR

SEQ ID NO: 760470 - protein, 18 aa, Mycobacterium
AKRPLAVYLSDWGTEEFT

SEQ ID NO: 760471 - protein, 22 aa, Mycobacterium
AKRRGWPILRFSSRGPVGLRRQ

SEQ ID NO: 760472 - protein, 17 aa, Mycobacterium
AKRRIVFRFFTSPIELR

SEQ ID NO: 760473 - protein, 17 aa, Mycobacterium
AKSAMPLAMGLAPVALS

SEQ ID NO: 760474 - protein, 17 aa, Mycobacterium
AKSCAPAGITVADVTLD

SEQ ID NO: 760475 - protein, 17 aa, Mycobacterium
AKSRATFQAALAGVEGG

SEQ ID NO: 760476 - protein, 21 aa, Mycobacterium
AKSSEVAIVFAVQHESEGTDL

SEQ ID NO: 760477 - protein, 19 aa, Mycobacterium
AKTISFAGAEAFRDGDDDP

SEQ ID NO: 760478 - protein, 23 aa, Mycobacterium
AKVDMPAFLPNLPVNMPAQMTLP

SEQ ID NO: 760479 - protein, 18 aa, Mycobacterium
AKVGWKGFHAIERDLWQG

SEQ ID NO: 760480 - protein, 19 aa, Mycobacterium
AKVLSRFVDAIVWRTFGQD

SEQ ID NO: 760481 - protein, 18 aa, Mycobacterium
AKVPWILMHWRSVDADHP

SEQ ID NO: 760482 - protein, 18 aa, Mycobacterium
AKVVDLWGGYRNGLTKDP

SEQ ID NO: 760483 - protein, 21 aa, Mycobacterium
AKWASSISGYWRRGRTEETFR

SEQ ID NO: 760484 - protein, 21 aa, Mycobacterium
AKWFLRRRITKLLPAGYPVDV

SEQ ID NO: 760485 - protein, 19 aa, Mycobacterium
AKWWIPERWAFIAEVPRTS

SEQ ID NO: 760486 - protein, 20 aa, Mycobacterium
AKYTICPAVAHGLDHEIGSV

SEQ ID NO: 760487 - protein, 20 aa, Mycobacterium
AKYTICPAVAHGLDHEVGSV

SEQ ID NO: 760488 - protein, 17 aa, Mycobacterium
ALAAVFSGHALDYQALS

SEQ ID NO: 760489 - protein, 19 aa, Mycobacterium
ALAAVNLMSLFGLHRELRG

SEQ ID NO: 760490 - protein, 19 aa, Mycobacterium
ALAAWRGLPPVGERSPEEW

SEQ ID NO: 760491 - protein, 18 aa, Mycobacterium
ALADELTCRFGVYAEALP

SEQ ID NO: 760492 - protein, 19 aa, Mycobacterium
ALADLCFTAGVGRAHLEHR

SEQ ID NO: 760493 - protein, 23 aa, Mycobacterium
ALAEAFAAAGARVVVADLDEPGA

SEQ ID NO: 760494 - protein, 20 aa, Mycobacterium
ALAEFAALRWQWHDLEVGRT

SEQ ID NO: 760495 - protein, 23 aa, Mycobacterium
ALAEILLPFGVPRFFQTDPSQFM

SEQ ID NO: 760496 - protein, 19 aa, Mycobacterium
ALAELRTLVGIYFDVICDL

SEQ ID NO: 760497 - protein, 17 aa, Mycobacterium
ALAESWDSVGLVCGDPD

SEQ ID NO: 760498 - protein, 17 aa, Mycobacterium
ALAIPIAIVNRGPTRGD

SEQ ID NO: 760499 - protein, 18 aa, Mycobacterium
ALAMLGLRRLHVKRVVLT

SEQ ID NO: 760500 - protein, 19 aa, Mycobacterium
ALAPKGAGAVLAFELDGGV

SEQ ID NO: 760501 - protein, 18 aa, Mycobacterium
ALAPRPSDWLVIWDQTLP

SEQ ID NO: 760502 - protein, 22 aa, Mycobacterium
ALARAGARVVLACRNQQTGRAA

SEQ ID NO: 760503 - protein, 18 aa, Mycobacterium
ALARDFLTIWFAQLHSQV

SEQ ID NO: 760504 - protein, 23 aa, Mycobacterium
ALARDFLTIWFAQLYRHVADIKA

SEQ ID NO: 760505 - protein, 24 aa, Mycobacterium
ALAREFLLSWFVYTAWELEEAKRI

SEQ ID NO: 760506 - protein, 18 aa, Mycobacterium
ALARLALREDLYRSLRDL

SEQ ID NO: 760507 - protein, 18 aa, Mycobacterium
ALARVCALNALAAVNSLV

SEQ ID NO: 760508 - protein, 18 aa, Mycobacterium
ALARYPRELPFLAPFNDG

SEQ ID NO: 760509 - protein, 17 aa, Mycobacterium
ALASILSWENWEQLFTL

SEQ ID NO: 760510 - protein, 19 aa, Mycobacterium
ALASILSWHRWEELFELAR

SEQ ID NO: 760511 - protein, 25 aa, Mycobacterium
ALASILSWQGWEELFQLARFVGVSR

SEQ ID NO: 760512 - protein, 22 aa, Mycobacterium
ALASRARKAPGFALLGEAGAEV

SEQ ID NO: 760513 - protein, 24 aa, Mycobacterium
ALASRARKAPGFALLGEKGQERDL

SEQ ID NO: 760514 - protein, 24 aa, Mycobacterium
ALASRARKAPGFALLGEQGEARDL

SEQ ID NO: 760515 - protein, 24 aa, Mycobacterium
ALASRARKAPGFALLGEQGETRDL

SEQ ID NO: 760516 - protein, 23 aa, Mycobacterium
ALASRARKAPGFALLGEQGEVRE

SEQ ID NO: 760517 - protein, 18 aa, Mycobacterium
ALAWLLKRSPVMLPIPGT

SEQ ID NO: 760518 - protein, 19 aa, Mycobacterium
ALAWLLKRSPVMLPIPGTS

SEQ ID NO: 760519 - protein, 17 aa, Mycobacterium
ALCALGLQSRVVAAALP

SEQ ID NO: 760520 - protein, 22 aa, Mycobacterium
ALCARFRISGLPVVDDDGALVG

SEQ ID NO: 760521 - protein, 22 aa, Mycobacterium
ALCARFRISGLPVVDESGALVG

SEQ ID NO: 760522 - protein, 23 aa, Mycobacterium
ALCDIFYPRVFLRHGGFLPSGTI

SEQ ID NO: 760523 - protein, 19 aa, Mycobacterium
ALCLRLLTVRARTRAELEA

SEQ ID NO: 760524 - protein, 22 aa, Mycobacterium
ALDALGYRGFWMGYFAARSAPL

SEQ ID NO: 760525 - protein, 18 aa, Mycobacterium
ALDALSYVLGDISSVTST

SEQ ID NO: 760526 - protein, 21 aa, Mycobacterium
ALDDWCYELAWPARPAPDTET

SEQ ID NO: 760527 - protein, 20 aa, Mycobacterium
ALDEWRLLTAAALVGLVEET

SEQ ID NO: 760528 - protein, 19 aa, Mycobacterium
ALDGDGLGTVWGRELATSM

SEQ ID NO: 760529 - protein, 18 aa, Mycobacterium
ALDGWPVNVALLGKGNTV

SEQ ID NO: 760530 - protein, 20 aa, Mycobacterium
ALDITGRWQAMVRAMRNNGR

SEQ ID NO: 760531 - protein, 22 aa, Mycobacterium
ALDLFLKIAMLRRAHPDRPHAC

SEQ ID NO: 760532 - protein, 17 aa, Mycobacterium
ALDLSKWLLAVCAAEPV

SEQ ID NO: 760533 - protein, 23 aa, Mycobacterium
ALDRLGYHEAWFGEHHSGGYELI

SEQ ID NO: 760534 - protein, 20 aa, Mycobacterium
ALDRWWKLRLEWAKGQDPLG

SEQ ID NO: 760535 - protein, 23 aa, Mycobacterium
ALDTAAGVPLVFLTAFYGLSDLA

SEQ ID NO: 760536 - protein, 18 aa, Mycobacterium
ALEAITINAAYQYREEQS

SEQ ID NO: 760537 - protein, 18 aa, Mycobacterium
ALECAWEAFERGGIDPSS

SEQ ID NO: 760538 - protein, 24 aa, Mycobacterium
ALEEVFIRAGIPYKVVGGVRFYER

SEQ ID NO: 760539 - protein, 19 aa, Mycobacterium
ALEGLGFRGFWQGYFAARS

SEQ ID NO: 760540 - protein, 17 aa, Mycobacterium
ALEKMIFGTDIALNGVI

SEQ ID NO: 760541 - protein, 18 aa, Mycobacterium
ALELARRGSGYGVAALCG

SEQ ID NO: 760542 - protein, 20 aa, Mycobacterium
ALELIDWPVALVIATGHVLA

SEQ ID NO: 760543 - protein, 20 aa, Mycobacterium
ALELIEWPVAVVIAAGHVMA

SEQ ID NO: 760544 - protein, 21 aa, Mycobacterium
ALEPLEVTSLWIAGETPETYP

SEQ ID NO: 760545 - protein, 17 aa, Mycobacterium
ALERAGIDPLGLRGSAT

SEQ ID NO: 760546 - protein, 18 aa, Mycobacterium
ALERARRALAEFQVEGLA

SEQ ID NO: 760547 - protein, 20 aa, Mycobacterium
ALERSRRALAEFTVEGLATV

SEQ ID NO: 760548 - protein, 25 aa, Mycobacterium
ALERYCKLRDAWLSARRDLLDRRNR

SEQ ID NO: 760549 - protein, 17 aa, Mycobacterium
ALESWLGAIARRLETPW

SEQ ID NO: 760550 - protein, 25 aa, Mycobacterium
ALETLSLPLLRAWLASASGAGVART

SEQ ID NO: 760551 - protein, 21 aa, Mycobacterium
ALETWPLSMFERFLPRHLEII

SEQ ID NO: 760552 - protein, 21 aa, Mycobacterium
ALETWPLSMFQRFLPRHLEII

SEQ ID NO: 760553 - protein, 22 aa, Mycobacterium
ALEYGKGVLLALHLGRRKDADT

SEQ ID NO: 760554 - protein, 22 aa, Mycobacterium
ALFDRFGYRLVCCNSHSGSDAF

SEQ ID NO: 760555 - protein, 20 aa, Mycobacterium
ALFDRPDWQQGFSAPDDGGA

SEQ ID NO: 760556 - protein, 23 aa, Mycobacterium
ALFERRHLLLLGWTKMRDGQLAS

SEQ ID NO: 760557 - protein, 18 aa, Mycobacterium
ALFGRPLIGNGSNGAPGT

SEQ ID NO: 760558 - protein, 18 aa, Mycobacterium
ALFLPPFVAHGFQTLVDN

SEQ ID NO: 760559 - protein, 20 aa, Mycobacterium
ALFLRPGGRMALVLPAELLS

SEQ ID NO: 760560 - protein, 17 aa, Mycobacterium
ALFPGSWSEWVCDPGRP

SEQ ID NO: 760561 - protein, 17 aa, Mycobacterium
ALFPVWRYHPFFTDSDE

SEQ ID NO: 760562 - protein, 17 aa, Mycobacterium
ALFQFLAPQGMRSLGTA

SEQ ID NO: 760563 - protein, 20 aa, Mycobacterium
ALFRGACAAAALAISNATLY

SEQ ID NO: 760564 - protein, 18 aa, Mycobacterium
ALGAVRWAARNAALRNAP

SEQ ID NO: 760565 - protein, 24 aa, Mycobacterium
ALGCTIKLLAICERLTSPKGKQKV

SEQ ID NO: 760566 - protein, 23 aa, Mycobacterium
ALGCTIKLLSICERITGDDGQER

SEQ ID NO: 760567 - protein, 23 aa, Mycobacterium
ALGCTIKLLSICERLTTDEGQQR

SEQ ID NO: 760568 - protein, 19 aa, Mycobacterium
ALGDFSGKFTDFFESNLGK

SEQ ID NO: 760569 - protein, 18 aa, Mycobacterium
ALGGPGRRTLFLLSSTDA

SEQ ID NO: 760570 - protein, 18 aa, Mycobacterium
ALGGRAGLFIGEPGTGWV

SEQ ID NO: 760571 - protein, 24 aa, Mycobacterium
ALGIDAATLLAVWTAEGRYDYRNL

SEQ ID NO: 760572 - protein, 18 aa, Mycobacterium
ALGLLYRWVEHAFGGREH

SEQ ID NO: 760573 - protein, 19 aa, Mycobacterium
ALGMFAGLEVGVWEMTEGV

SEQ ID NO: 760574 - protein, 18 aa, Mycobacterium
ALGPKLPELWGGSADLAG

SEQ ID NO: 760575 - protein, 18 aa, Mycobacterium
ALGRDFLTIWFAQLHHQV

SEQ ID NO: 760576 - protein, 26 aa, Mycobacterium
ALGRYGVCANAICPRARTAMTADVFG

SEQ ID NO: 760577 - protein, 24 aa, Mycobacterium
ALHAGWRALGWWLVGTSRAMLSLA

SEQ ID NO: 760578 - protein, 17 aa, Mycobacterium
ALHAWYTSARGLVTTAL

SEQ ID NO: 760579 - protein, 18 aa, Mycobacterium
ALHEQFVKLMSGGAAQYA

SEQ ID NO: 760580 - protein, 19 aa, Mycobacterium
ALHRCCVALDGVGRAAQEA

SEQ ID NO: 760581 - protein, 18 aa, Mycobacterium
ALHSPFWWLKCAVGTEKN

SEQ ID NO: 760582 - protein, 28 aa, Mycobacterium
ALHTQLERVLSAGAVAYAAAETTGTSPL

SEQ ID NO: 760583 - protein, 17 aa, Mycobacterium
ALIGLAHPDYRPWLAEC

SEQ ID NO: 760584 - protein, 19 aa, Mycobacterium
ALIGYRIPTPIPRISYADA

SEQ ID NO: 760585 - protein, 19 aa, Mycobacterium
ALIIRTGFMAARRGNWRDY

SEQ ID NO: 760586 - protein, 17 aa, Mycobacterium
ALIKSWAAQGWLHRIVD

SEQ ID NO: 760587 - protein, 24 aa, Mycobacterium
ALIRARFPALTARQVMQRIESTAH

SEQ ID NO: 760588 - protein, 17 aa, Mycobacterium
ALIRCWRERAARPASVG

SEQ ID NO: 760589 - protein, 17 aa, Mycobacterium
ALIWEFNQPWSVEDIEI

SEQ ID NO: 760590 - protein, 18 aa, Mycobacterium
ALKEGRLVVMPTDTVYGI

SEQ ID NO: 760591 - protein, 18 aa, Mycobacterium
ALKNVFAIASGMGYAIGI

SEQ ID NO: 760592 - protein, 23 aa, Mycobacterium
ALKQSRLWQILGMRSADTYVPEW

SEQ ID NO: 760593 - protein, 20 aa, Mycobacterium
ALKYRHGRVYGHDSQSGTVM

SEQ ID NO: 760594 - protein, 17 aa, Mycobacterium
ALLAAKFMGRWRSGAPL

SEQ ID NO: 760595 - protein, 17 aa, Mycobacterium
ALLAFSLAIGTHVIAAD

SEQ ID NO: 760596 - protein, 17 aa, Mycobacterium
ALLARRRMDLYGATLED

SEQ ID NO: 760597 - protein, 18 aa, Mycobacterium
ALLARRRMDLYGATLEDF

SEQ ID NO: 760598 - protein, 18 aa, Mycobacterium
ALLARRRMDLYGATPEDF

SEQ ID NO: 760599 - protein, 17 aa, Mycobacterium
ALLCPFDPLIFFRPRVK

SEQ ID NO: 760600 - protein, 17 aa, Mycobacterium
ALLCPFDPLIFFRPRVQ

SEQ ID NO: 760601 - protein, 18 aa, Mycobacterium
ALLDLRPLAPVVGVVAGE

SEQ ID NO: 760602 - protein, 17 aa, Mycobacterium
ALLDRPLIGNGANGAAG

SEQ ID NO: 760603 - protein, 23 aa, Mycobacterium
ALLFPGARGWITYLWVPPFASEK

SEQ ID NO: 760604 - protein, 19 aa, Mycobacterium
ALLGRPIIGNGADGAPGSG

SEQ ID NO: 760605 - protein, 22 aa, Mycobacterium
ALLGRPLFGNGINGAPGTGQDG

SEQ ID NO: 760606 - protein, 19 aa, Mycobacterium
ALLGRPLIGNGADGAPGTG

SEQ ID NO: 760607 - protein, 19 aa, Mycobacterium
ALLGRPLIGNGANAAPGSG

SEQ ID NO: 760608 - protein, 20 aa, Mycobacterium
ALLGRPLIGNGIDGTATNPN

SEQ ID NO: 760609 - protein, 20 aa, Mycobacterium
ALLGRPLIGNGTDGAPGTGA

SEQ ID NO: 760610 - protein, 17 aa, Mycobacterium
ALLGTAFHEWVQRYFQA

SEQ ID NO: 760611 - protein, 18 aa, Mycobacterium
ALLKEVGMGLDTADPDSS

SEQ ID NO: 760612 - protein, 19 aa, Mycobacterium
ALLPALRAAGFAVDYSEAG

SEQ ID NO: 760613 - protein, 20 aa, Mycobacterium
ALLRFPARFFTTAPVSRVAA

SEQ ID NO: 760614 - protein, 18 aa, Mycobacterium
ALLRKQLKGAPMPAPKAI

SEQ ID NO: 760615 - protein, 17 aa, Mycobacterium
ALLRLEGFRDWADIDVD

SEQ ID NO: 760616 - protein, 18 aa, Mycobacterium
ALLRRRKISMIKSIYPGQ

SEQ ID NO: 760617 - protein, 18 aa, Mycobacterium
ALLSGLLRAGRQVKDLVV

SEQ ID NO: 760618 - protein, 18 aa, Mycobacterium
ALLSGLLRAGRQVKDMVV

SEQ ID NO: 760619 - protein, 23 aa, Mycobacterium
ALLSRPSVNNVLRVAPRQFKMPR

SEQ ID NO: 760620 - protein, 17 aa, Mycobacterium
ALLSVSFGDDWAWVRRA

SEQ ID NO: 760621 - protein, 17 aa, Mycobacterium
ALLSVSFGTDWSWVARA

SEQ ID NO: 760622 - protein, 23 aa, Mycobacterium
ALLVLMCGVGLYAGFVQSPDDLL

SEQ ID NO: 760623 - protein, 17 aa, Mycobacterium
ALLVRRLDMLPVECVAR

SEQ ID NO: 760624 - protein, 25 aa, Mycobacterium
ALLVRRPELFEGIHFAQKQIGHLSS

SEQ ID NO: 760625 - protein, 24 aa, Mycobacterium
ALLWARRFAEYDVRWFEEPVSSDD

SEQ ID NO: 760626 - protein, 17 aa, Mycobacterium
ALMAVPVMLARILDLPQ

SEQ ID NO: 760627 - protein, 17 aa, Mycobacterium
ALMAWAQALGRMHVATV

SEQ ID NO: 760628 - protein, 18 aa, Mycobacterium
ALMPMVWVACEREDFVVE

SEQ ID NO: 760629 - protein, 21 aa, Mycobacterium
ALMRELWKPGWTEFGGRFYRT

SEQ ID NO: 760630 - protein, 18 aa, Mycobacterium
ALNGGGFLYAATEAASAS

SEQ ID NO: 760631 - protein, 19 aa, Mycobacterium
ALNGYAAWVTGLRRVESPT

SEQ ID NO: 760632 - protein, 24 aa, Mycobacterium
ALNPKMRVGDCIAEPMWVHRYGDR

SEQ ID NO: 760633 - protein, 18 aa, Mycobacterium
ALNTRPRKTLGWKTPAEA

SEQ ID NO: 760634 - protein, 26 aa, Mycobacterium
ALPAADADFSLSIFGLQLVKTGTANA

SEQ ID NO: 760635 - protein, 22 aa, Mycobacterium
ALPAARIEFMLADAAPVAAITT

SEQ ID NO: 760636 - protein, 23 aa, Mycobacterium
ALPAPEFDGGVAYRAPRDRLEQL

SEQ ID NO: 760637 - protein, 25 aa, Mycobacterium
ALPDARPTLWLGVPRVWHKIQAGIE

SEQ ID NO: 760638 - protein, 18 aa, Mycobacterium
ALPDRPSTTFADGRLSGT

SEQ ID NO: 760639 - protein, 23 aa, Mycobacterium
ALPEHTRWLPGDYRYCDVVATLA

SEQ ID NO: 760640 - protein, 22 aa, Mycobacterium
ALPELRPVPGRPFGVYIHVPFC

SEQ ID NO: 760641 - protein, 17 aa, Mycobacterium
ALPESRIGFVLSDAAPL

SEQ ID NO: 760642 - protein, 18 aa, Mycobacterium
ALPFRVVASYAIKSPPPG

SEQ ID NO: 760643 - protein, 21 aa, Mycobacterium
ALPGGRYGWRVSLPAMMSYWS

SEQ ID NO: 760644 - protein, 24 aa, Mycobacterium
ALPGHAPSGLGFRPDGTLLIVSTE

SEQ ID NO: 760645 - protein, 18 aa, Mycobacterium
ALPGSFTASLGWYRAGAG

SEQ ID NO: 760646 - protein, 18 aa, Mycobacterium
ALPIRRLGVLPGSGESVT

SEQ ID NO: 760647 - protein, 25 aa, Mycobacterium
ALPPRPEVRLLWKLIETAAAAEGAL

SEQ ID NO: 760648 - protein, 19 aa, Mycobacterium
ALPRDEWPSAIRRLVSGQI

SEQ ID NO: 760649 - protein, 19 aa, Mycobacterium
ALPRDFCDLLSPAMVDELI

SEQ ID NO: 760650 - protein, 31 aa, Mycobacterium
ALPRQPRFALLKGRRNYLCLNKIHSDGSTGD

SEQ ID NO: 760651 - protein, 20 aa, Mycobacterium
ALPRWRRIMEGLRHSKTRDA

SEQ ID NO: 760652 - protein, 24 aa, Mycobacterium
ALPVKLCYAGPFFRYERPQAGRYR

SEQ ID NO: 760653 - protein, 20 aa, Mycobacterium
ALQFLRGGGRWVLKSPQHLA

SEQ ID NO: 760654 - protein, 17 aa, Mycobacterium
ALQFPALAGPVFDSLTA

SEQ ID NO: 760655 - protein, 19 aa, Mycobacterium
ALQLGWRLFEPMLRSATGL

SEQ ID NO: 760656 - protein, 18 aa, Mycobacterium
ALQMPSIHTKYWYPLFEA

SEQ ID NO: 760657 - protein, 18 aa, Mycobacterium
ALQMPSIHTKYWYRLFEA

SEQ ID NO: 760658 - protein, 17 aa, Mycobacterium
ALRAAELVKAYPGSDAR

SEQ ID NO: 760659 - protein, 19 aa, Mycobacterium
ALRAIVAALMEWERKSELS

SEQ ID NO: 760660 - protein, 20 aa, Mycobacterium
ALRAIVAALMEWQRKSELSG

SEQ ID NO: 760661 - protein, 22 aa, Mycobacterium
ALRARFGTLKGVERAAENGDFV

SEQ ID NO: 760662 - protein, 24 aa, Mycobacterium
ALRDEFDFRYLVGVVSVMGDKDVD

SEQ ID NO: 760663 - protein, 20 aa, Mycobacterium
ALRDWLFRVTWALRIWHDLP

SEQ ID NO: 760664 - protein, 22 aa, Mycobacterium
ALREFGVRVLVIRPGQVRTRMS

SEQ ID NO: 760665 - protein, 22 aa, Mycobacterium
ALREFGVRVLVVRPGQVRTTTT

SEQ ID NO: 760666 - protein, 17 aa, Mycobacterium
ALRELSARLGLTARVAH

SEQ ID NO: 760667 - protein, 18 aa, Mycobacterium
ALRFGLAFCEASGPRLVR

SEQ ID NO: 760668 - protein, 22 aa, Mycobacterium
ALRGACLGVKLILFTGDSKPTV

SEQ ID NO: 760669 - protein, 23 aa, Mycobacterium
ALRGFPPVPSRWIDPGSLPEWLV

SEQ ID NO: 760670 - protein, 19 aa, Mycobacterium
ALRGFPPVPSRWIDPNSVP

SEQ ID NO: 760671 - protein, 25 aa, Mycobacterium
ALRIWRPRWARWTAHVVRSGGLIRD

SEQ ID NO: 760672 - protein, 24 aa, Mycobacterium
ALRIWRPRWAVWAAHVARSGGLVR

SEQ ID NO: 760673 - protein, 18 aa, Mycobacterium
ALRKAGTALSEFGIEGIH

SEQ ID NO: 760674 - protein, 17 aa, Mycobacterium
ALRKARTALAEFRIEGV

SEQ ID NO: 760675 - protein, 20 aa, Mycobacterium
ALRKRAAAVVTDIIGIEPPN

SEQ ID NO: 760676 - protein, 19 aa, Mycobacterium
ALRLAGLRPGMRVVSPSRP

SEQ ID NO: 760677 - protein, 18 aa, Mycobacterium
ALRPDWLTPSAFESLVLL

SEQ ID NO: 760678 - protein, 21 aa, Mycobacterium
ALRRAARCDGWMHGGGTEDLD

SEQ ID NO: 760679 - protein, 19 aa, Mycobacterium
ALRRACAAGALATLVPGAG

SEQ ID NO: 760680 - protein, 22 aa, Mycobacterium
ALRRAMPVLGICRGAQVLNVAL

SEQ ID NO: 760681 - protein, 17 aa, Mycobacterium
ALRRCGYGQLTASVERY

SEQ ID NO: 760682 - protein, 24 aa, Mycobacterium
ALRREYAEVLPLKGARISGSLHMT

SEQ ID NO: 760683 - protein, 19 aa, Mycobacterium
ALRRHFNWVRAWYDFAVPD

SEQ ID NO: 760684 - protein, 19 aa, Mycobacterium
ALRRHFNWVRSWYDFAVPD

SEQ ID NO: 760685 - protein, 20 aa, Mycobacterium
ALRRSIKFATFLDGIDAVRR

SEQ ID NO: 760686 - protein, 20 aa, Mycobacterium
ALRRSIKFGSFLAGIDAVRR

SEQ ID NO: 760687 - protein, 20 aa, Mycobacterium
ALRRSIKFPSFLAGIDAVRR

SEQ ID NO: 760688 - protein, 20 aa, Mycobacterium
ALRRVGGCWVLTNHPFLTGR

SEQ ID NO: 760689 - protein, 18 aa, Mycobacterium
ALRRWAHRFYPAAQTSTA

SEQ ID NO: 760690 - protein, 19 aa, Mycobacterium
ALRRWAHRFYPGAQPSAED

SEQ ID NO: 760691 - protein, 19 aa, Mycobacterium
ALRRWAHRFYPGTQPSPSD

SEQ ID NO: 760692 - protein, 21 aa, Mycobacterium
ALRWGAEVYHALKAVLKKAGL

SEQ ID NO: 760693 - protein, 21 aa, Mycobacterium
ALRWRLTGLGLRVIAHDPYSD

SEQ ID NO: 760694 - protein, 18 aa, Mycobacterium
ALSGLAPWQEVLSGVSGR

SEQ ID NO: 760695 - protein, 23 aa, Mycobacterium
ALSRECWRSVGGMDLRTFGRYGW

SEQ ID NO: 760696 - protein, 19 aa, Mycobacterium
ALSRFCYRLFGSRTLLVGH

SEQ ID NO: 760697 - protein, 18 aa, Mycobacterium
ALSRRWWAAEGLGAHSRV

SEQ ID NO: 760698 - protein, 18 aa, Mycobacterium
ALSSRPGIVLSRKQLLDT

SEQ ID NO: 760699 - protein, 23 aa, Mycobacterium
ALSSYRFPTGWFIVAFASDLAPG

SEQ ID NO: 760700 - protein, 23 aa, Mycobacterium
ALSTARFEFRWNDQFALSLDPDS

SEQ ID NO: 760701 - protein, 18 aa, Mycobacterium
ALSWTCGSMSYGELDTAA

SEQ ID NO: 760702 - protein, 17 aa, Mycobacterium
ALTALQFAAHAQMYQAV

SEQ ID NO: 760703 - protein, 21 aa, Mycobacterium
ALTEWLGYAWVCLSDTPPPFE

SEQ ID NO: 760704 - protein, 19 aa, Mycobacterium
ALTGRPLIGNGADGGPGQA

SEQ ID NO: 760705 - protein, 18 aa, Mycobacterium
ALTGRPLIGNGANGAPGT

SEQ ID NO: 760706 - protein, 19 aa, Mycobacterium
ALTGYGLGRIEGWPDDQTI

SEQ ID NO: 760707 - protein, 19 aa, Mycobacterium
ALTPRIVSLDVQYFGVMWP

SEQ ID NO: 760708 - protein, 20 aa, Mycobacterium
ALTPRPVPTVAIGHLHEQTV

SEQ ID NO: 760709 - protein, 17 aa, Mycobacterium
ALTRRFWHDEYLLNSYI

SEQ ID NO: 760710 - protein, 20 aa, Mycobacterium
ALTSQGWRGPASAAMLGAAE

SEQ ID NO: 760711 - protein, 19 aa, Mycobacterium
ALVAINRTRLVSLVTSNLL

SEQ ID NO: 760712 - protein, 18 aa, Mycobacterium
ALVEWKGNPGLSLLRHMI

SEQ ID NO: 760713 - protein, 18 aa, Mycobacterium
ALVFKHGIQLFGAMGFTW

SEQ ID NO: 760714 - protein, 17 aa, Mycobacterium
ALVGGMSVPQGWTEAAP

SEQ ID NO: 760715 - protein, 23 aa, Mycobacterium
ALVGQCWPAVFAAIGSAVTDSGV

SEQ ID NO: 760716 - protein, 23 aa, Mycobacterium
ALVGRCWPAVFAAIGSAATEAGF

SEQ ID NO: 760717 - protein, 18 aa, Mycobacterium
ALVLGDWPAQEAVTGQLP

SEQ ID NO: 760718 - protein, 17 aa, Mycobacterium
ALVLSDWPAPDNPAPEL

SEQ ID NO: 760719 - protein, 30 aa, Mycobacterium
ALVPSLERILRALGLIGWKWTPNGDGIVLS

SEQ ID NO: 760720 - protein, 18 aa, Mycobacterium
ALVRFGFAAGDGLRKLAG

SEQ ID NO: 760721 - protein, 19 aa, Mycobacterium
ALVRPSLNIAEWILPSVLA

SEQ ID NO: 760722 - protein, 19 aa, Mycobacterium
ALVSALWWVQWRITKSPED

SEQ ID NO: 760723 - protein, 26 aa, Mycobacterium
ALVSFEVFLRPALRAAMGLTDTQRPR

SEQ ID NO: 760724 - protein, 20 aa, Mycobacterium
ALWGRPGYVTALLGDRVGEI

SEQ ID NO: 760725 - protein, 17 aa, Mycobacterium
ALWPILLSIWEWERRWV

SEQ ID NO: 760726 - protein, 19 aa, Mycobacterium
ALWPVHAWRSDYMTDEDFT

SEQ ID NO: 760727 - protein, 21 aa, Mycobacterium
ALWRFLWKGHCAIGEVPAERW

SEQ ID NO: 760728 - protein, 18 aa, Mycobacterium
ALWWVHWRVTKNPEEAQR

SEQ ID NO: 760729 - protein, 19 aa, Mycobacterium
ALYGAWGVRVHDVRATADA

SEQ ID NO: 760730 - protein, 24 aa, Mycobacterium
ALYHFAWDEFCDWYVELAKTQLAE

SEQ ID NO: 760731 - protein, 17 aa, Mycobacterium
ALYPEWDVHTGRYRPEW

SEQ ID NO: 760732 - protein, 18 aa, Mycobacterium
AMAAAVQPYVTWMQTTAA

SEQ ID NO: 760733 - protein, 18 aa, Mycobacterium
AMAAWRLGAGRAQPGEPV

SEQ ID NO: 760734 - protein, 17 aa, Mycobacterium
AMAKRFVTDTCFDVADK

SEQ ID NO: 760735 - protein, 23 aa, Mycobacterium
AMAKRPLTEWSERFATLAGPWAP

SEQ ID NO: 760736 - protein, 17 aa, Mycobacterium
AMAKRYVTDTCFEVADK

SEQ ID NO: 760737 - protein, 17 aa, Mycobacterium
AMANCNWIDDDCATRGG

SEQ ID NO: 760738 - protein, 24 aa, Mycobacterium
AMANSIWPYVAWLRATAAATEQSA

SEQ ID NO: 760739 - protein, 19 aa, Mycobacterium
AMARACAAGALATLVPGAG

SEQ ID NO: 760740 - protein, 24 aa, Mycobacterium
AMARPEQRLALAFGALERIVGTQD

SEQ ID NO: 760741 - protein, 21 aa, Mycobacterium
AMCARFRISGLPVVDDKGSLV

SEQ ID NO: 760742 - protein, 21 aa, Mycobacterium
AMCARFRISGLPVVDDTGELV

SEQ ID NO: 760743 - protein, 23 aa, Mycobacterium
AMDRKVWLPSGGTLVIDRTEAMT

SEQ ID NO: 760744 - protein, 17 aa, Mycobacterium
AMDRLGFHEAWVGEHHS

SEQ ID NO: 760745 - protein, 19 aa, Mycobacterium
AMEAFGLLCRMEGIIPAIE

SEQ ID NO: 760746 - protein, 19 aa, Mycobacterium
AMEAFGLLCRTEGIIPAIE

SEQ ID NO: 760747 - protein, 21 aa, Mycobacterium
AMELGCDAVLLASAVTRAADP

SEQ ID NO: 760748 - protein, 21 aa, Mycobacterium
AMELGCDAVLLATAVTRASDP

SEQ ID NO: 760749 - protein, 19 aa, Mycobacterium
AMFDGRFLGFADFVVREGE

SEQ ID NO: 760750 - protein, 19 aa, Mycobacterium
AMFDGRFVGFADFLIRDRE

SEQ ID NO: 760751 - protein, 20 aa, Mycobacterium
AMFDGRFVGFADFLLRDGER

SEQ ID NO: 760752 - protein, 25 aa, Mycobacterium
AMGLPLPGAIAWHAVPRWFARRKDR

SEQ ID NO: 760753 - protein, 18 aa, Mycobacterium
AMGPAFWSELPVVFRELD

SEQ ID NO: 760754 - protein, 24 aa, Mycobacterium
AMGPDFWRELPLIFTELDADPEVR

SEQ ID NO: 760755 - protein, 17 aa, Mycobacterium
AMGSLKVADAVTVSFEG

SEQ ID NO: 760756 - protein, 18 aa, Mycobacterium
AMGVWRWGLGEIAYEQLH

SEQ ID NO: 760757 - protein, 17 aa, Mycobacterium
AMIGLALTVGWSMTAGG

SEQ ID NO: 760758 - protein, 20 aa, Mycobacterium
AMIKKLSIRLGVPAYPNDPM

SEQ ID NO: 760759 - protein, 17 aa, Mycobacterium
AMIRAGGKMWGADGRPK

SEQ ID NO: 760760 - protein, 17 aa, Mycobacterium
AMIRAGGKMWGADGRQK

SEQ ID NO: 760761 - protein, 18 aa, Mycobacterium
AMKKFVWPWLVGRRQVVV

SEQ ID NO: 760762 - protein, 20 aa, Mycobacterium
AMKSRNGWDLVVCVTELARR

SEQ ID NO: 760763 - protein, 18 aa, Mycobacterium
AMLDRLALDTARVAGIAD

SEQ ID NO: 760764 - protein, 17 aa, Mycobacterium
AMLDRLALTPARVEGIA

SEQ ID NO: 760765 - protein, 18 aa, Mycobacterium
AMLLMGWDSLFWGDVEKA

SEQ ID NO: 760766 - protein, 18 aa, Mycobacterium
AMLPPRWVAVGIGPADGV

SEQ ID NO: 760767 - protein, 19 aa, Mycobacterium
AMLSRLVIMGGMFDADGND

SEQ ID NO: 760768 - protein, 22 aa, Mycobacterium
AMMPMRVIGMLLGIPESEQVSV

SEQ ID NO: 760769 - protein, 24 aa, Mycobacterium
AMNFSMDGPWGFWVNRWTAEENRH

SEQ ID NO: 760770 - protein, 19 aa, Mycobacterium
AMPGFGWPTAVLSGGRDLT

SEQ ID NO: 760771 - protein, 19 aa, Mycobacterium
AMPPFRIYAGHEVVAERSL

SEQ ID NO: 760772 - protein, 24 aa, Mycobacterium
AMPPRAPVRLLWKAIDMAAAAEAA

SEQ ID NO: 760773 - protein, 28 aa, Mycobacterium
AMPVETLEFFWGLGIPVYEVWGESECVG

SEQ ID NO: 760774 - protein, 21 aa, Mycobacterium
AMQFLRGGRRWLLKSPQHLEQ

SEQ ID NO: 760775 - protein, 25 aa, Mycobacterium
AMRHLPFYGRWYRFLVLWPGSDKGL

SEQ ID NO: 760776 - protein, 23 aa, Mycobacterium
AMRRPRVGVMIARGDLAVEVGYE

SEQ ID NO: 760777 - protein, 17 aa, Mycobacterium
AMRYCLTEDALVRLPFG

SEQ ID NO: 760778 - protein, 23 aa, Mycobacterium
AMSAFKGLFPAAAAVGAQVAAAA

SEQ ID NO: 760779 - protein, 19 aa, Mycobacterium
AMSIPLRWFHTSTTILACC

SEQ ID NO: 760780 - protein, 24 aa, Mycobacterium
AMSKFEVLVAMAFVAFADAPVDIA

SEQ ID NO: 760781 - protein, 22 aa, Mycobacterium
AMTAFDWFSWRLNKKVEDTQRR

SEQ ID NO: 760782 - protein, 19 aa, Mycobacterium
AMTEFKMFYNLPVEGLDIP

SEQ ID NO: 760783 - protein, 24 aa, Mycobacterium
AMTGWQRLHFRFGIPAPLLEPLAV

SEQ ID NO: 760784 - protein, 24 aa, Mycobacterium
AMTGWQRLHFRFGLPAPLLEPLAV

SEQ ID NO: 760785 - protein, 25 aa, Mycobacterium
AMTPPIARPTLRWVNIVPGPLAGAL

SEQ ID NO: 760786 - protein, 23 aa, Mycobacterium
AMVECLIAFGMLGVDVMLLNNAL

SEQ ID NO: 760787 - protein, 18 aa, Mycobacterium
AMVERGRGGIVLFGSGAG

SEQ ID NO: 760788 - protein, 24 aa, Mycobacterium
AMYANKAVPCWMIFDEGYVRRYVT

SEQ ID NO: 760789 - protein, 17 aa, Mycobacterium
AMYRIVTLWVLRAGVDL

SEQ ID NO: 760790 - protein, 17 aa, Mycobacterium
ANADFMGGFALWVDEHQ

SEQ ID NO: 760791 - protein, 18 aa, Mycobacterium
ANADLWLSFAQDYRDETG

SEQ ID NO: 760792 - protein, 22 aa, Mycobacterium
ANAEAYCAGWYRTGDIGWLDGE

SEQ ID NO: 760793 - protein, 23 aa, Mycobacterium
ANAKRWGVLHVIWRQKLYPGIGA

SEQ ID NO: 760794 - protein, 19 aa, Mycobacterium
ANALIRWLAELGVSIAGTH

SEQ ID NO: 760795 - protein, 18 aa, Mycobacterium
ANALRPGDLAVWDGHVAM

SEQ ID NO: 760796 - protein, 21 aa, Mycobacterium
ANALRSWPVLRFEVTEDPSEG

SEQ ID NO: 760797 - protein, 19 aa, Mycobacterium
ANAMSWFWYLMALHPDARD

SEQ ID NO: 760798 - protein, 17 aa, Mycobacterium
ANARWGNNIAILAGDYL

SEQ ID NO: 760799 - protein, 21 aa, Mycobacterium
ANCAGVDRFARVRDIALSDFV

SEQ ID NO: 760800 - protein, 21 aa, Mycobacterium
ANDSRYGLVGAVWSADTERAA

SEQ ID NO: 760801 - protein, 19 aa, Mycobacterium
ANEKCDWMPAVASGDGRDQ

SEQ ID NO: 760802 - protein, 20 aa, Mycobacterium
ANERCDWMPAVASRDGKDEI

SEQ ID NO: 760803 - protein, 19 aa, Mycobacterium
ANETFSRWVGYRSEHLTGR

SEQ ID NO: 760804 - protein, 23 aa, Mycobacterium
ANEWPWRAAHLVVTLGSRGARYA

SEQ ID NO: 760805 - protein, 17 aa, Mycobacterium
ANFFPRYLRGISDDADA

SEQ ID NO: 760806 - protein, 22 aa, Mycobacterium
ANFKKPRFVDFLDELPRNLGGK

SEQ ID NO: 760807 - protein, 21 aa, Mycobacterium
ANGGAAGWLLGDGGAGGSGGL

SEQ ID NO: 760808 - protein, 18 aa, Mycobacterium
ANGIFLPHVLRYNASLPS

SEQ ID NO: 760809 - protein, 24 aa, Mycobacterium
ANGLRLPGAHSFFVGNPQIGKTFF

SEQ ID NO: 760810 - protein, 23 aa, Mycobacterium
ANIKRAWELMGMRVHWQSSNDLV

SEQ ID NO: 760811 - protein, 18 aa, Mycobacterium
ANLEFALGYSHPVVIEAP

SEQ ID NO: 760812 - protein, 19 aa, Mycobacterium
ANLFYRGLVFHRFPVIGDS

SEQ ID NO: 760813 - protein, 20 aa, Mycobacterium
ANLRANPVFELRDGEDVQTV

SEQ ID NO: 760814 - protein, 17 aa, Mycobacterium
ANLRARPQLAITFRNGW

SEQ ID NO: 760815 - protein, 18 aa, Mycobacterium
ANLREIWIPRGMFSEGYR

SEQ ID NO: 760816 - protein, 17 aa, Mycobacterium
ANLRLVVSLAKRYTGRG

SEQ ID NO: 760817 - protein, 18 aa, Mycobacterium
ANMPAPFFVPVKQLPQTR

SEQ ID NO: 760818 - protein, 20 aa, Mycobacterium
ANNGGPGRDGADGGDGGAGG

SEQ ID NO: 760819 - protein, 22 aa, Mycobacterium
ANPAAALTFHWPEVVRQVRVVG

SEQ ID NO: 760820 - protein, 18 aa, Mycobacterium
ANPCRRAQRRVRPLPAGL

SEQ ID NO: 760821 - protein, 24 aa, Mycobacterium
ANPHVIRFAGFLTRVGDAMRNMGI

SEQ ID NO: 760822 - protein, 18 aa, Mycobacterium
ANPNIDFIVCFFHHCAYS

SEQ ID NO: 760823 - protein, 20 aa, Mycobacterium
ANPRGDLMWRPGGGSGEDKP

SEQ ID NO: 760824 - protein, 17 aa, Mycobacterium
ANQRVRMPVPFAQARLL

SEQ ID NO: 760825 - protein, 24 aa, Mycobacterium
ANRAWRLYRRLGFTDIIRGYYFAG

SEQ ID NO: 760826 - protein, 24 aa, Mycobacterium
ANRAWRLYRRLGFTDVIREYHFAG

SEQ ID NO: 760827 - protein, 25 aa, Mycobacterium
ANRAWRLYRRLGFTDVIRGYHFAGD

SEQ ID NO: 760828 - protein, 22 aa, Mycobacterium
ANRNAFVRLVLSNVFGQNAPAI

SEQ ID NO: 760829 - protein, 17 aa, Mycobacterium
ANSQLLSLWGSAGAGGA

SEQ ID NO: 760830 - protein, 17 aa, Mycobacterium
ANSWLDAFVQWRRVRGL

SEQ ID NO: 760831 - protein, 22 aa, Mycobacterium
ANTGINGIALAPAGPGGTGGGG

SEQ ID NO: 760832 - protein, 19 aa, Mycobacterium
ANTYSRFLLGVGIHDITAG

SEQ ID NO: 760833 - protein, 18 aa, Mycobacterium
ANVGTIWFRVRVAGHPTH

SEQ ID NO: 760834 - protein, 19 aa, Mycobacterium
ANVQVVWEKFCRYFDVEPR

SEQ ID NO: 760835 - protein, 20 aa, Mycobacterium
ANYAKALRMFAVLPTIVAAD

SEQ ID NO: 760836 - protein, 21 aa, Mycobacterium
APADCGPLYTWSRSPGYNGPP

SEQ ID NO: 760837 - protein, 19 aa, Mycobacterium
APADLDWEATLAYRRELWS

SEQ ID NO: 760838 - protein, 19 aa, Mycobacterium
APAEVWETLQLGNCGPPIE

SEQ ID NO: 760839 - protein, 17 aa, Mycobacterium
APAGAALLCKWTDDVGG

SEQ ID NO: 760840 - protein, 17 aa, Mycobacterium
APAGREWTTADLAGKRI

SEQ ID NO: 760841 - protein, 20 aa, Mycobacterium
APAKKWLAARGFDPIYGARP

SEQ ID NO: 760842 - protein, 21 aa, Mycobacterium
APAMVRRGSGGIVLFGSGAGL

SEQ ID NO: 760843 - protein, 18 aa, Mycobacterium
APAPLVWAVNEMIYCANP

SEQ ID NO: 760844 - protein, 25 aa, Mycobacterium
APAQARIATVAAIAADRTRAGGGVC

SEQ ID NO: 760845 - protein, 19 aa, Mycobacterium
APARAGFRAALAAKLGTAA

SEQ ID NO: 760846 - protein, 19 aa, Mycobacterium
APARLAAIVDWEMTTVGDP

SEQ ID NO: 760847 - protein, 18 aa, Mycobacterium
APARRGGSLTSMVLPELR

SEQ ID NO: 760848 - protein, 21 aa, Mycobacterium
APARSGFRVGERVSAFGVLGG

SEQ ID NO: 760849 - protein, 18 aa, Mycobacterium
APAYRPVALALPASAAGL

SEQ ID NO: 760850 - protein, 18 aa, Mycobacterium
APDHPWVRAHPEWFTELP

SEQ ID NO: 760851 - protein, 25 aa, Mycobacterium
APDPGKWAGFELHRSITITEEFTLG

SEQ ID NO: 760852 - protein, 23 aa, Mycobacterium
APDRLRWVIAQAIGTIEDGIGIG

SEQ ID NO: 760853 - protein, 18 aa, Mycobacterium
APDRPGWFYPPTVITDIT

SEQ ID NO: 760854 - protein, 21 aa, Mycobacterium
APDVLRLAPPLIITDEQIGEF

SEQ ID NO: 760855 - protein, 20 aa, Mycobacterium
APEAPWVRPPLRSLRWMETF

SEQ ID NO: 760856 - protein, 22 aa, Mycobacterium
APEIPRMGSFEVMNRTIDIAQS

SEQ ID NO: 760857 - protein, 22 aa, Mycobacterium
APERLKSGWLNGIKHWQVDYTG

SEQ ID NO: 760858 - protein, 23 aa, Mycobacterium
APERLRSGWLNGIKHWQVDYTGK

SEQ ID NO: 760859 - protein, 24 aa, Mycobacterium
APERLRSGWLNGIKHWQVDYTGKC

SEQ ID NO: 760860 - protein, 18 aa, Mycobacterium
APESGEEIILFRASFAQQ

SEQ ID NO: 760861 - protein, 18 aa, Mycobacterium
APESVQINWVYRGGRADL

SEQ ID NO: 760862 - protein, 17 aa, Mycobacterium
APFGYPEVHYLTSPVRK

SEQ ID NO: 760863 - protein, 19 aa, Mycobacterium
APFIRFLVSDGWWITGQTI

SEQ ID NO: 760864 - protein, 18 aa, Mycobacterium
APFLRTVAVWGPSDQAWT

SEQ ID NO: 760865 - protein, 18 aa, Mycobacterium
APFSLSFSTHHVQLDTAA

SEQ ID NO: 760866 - protein, 20 aa, Mycobacterium
APFYCVTVIRVAKLGEAPLP

SEQ ID NO: 760867 - protein, 17 aa, Mycobacterium
APGALGLHAALTGAPFS

SEQ ID NO: 760868 - protein, 20 aa, Mycobacterium
APGATWFKNWHYWWQAHLQD

SEQ ID NO: 760869 - protein, 17 aa, Mycobacterium
APGAVALTCGGLSVTYR

SEQ ID NO: 760870 - protein, 17 aa, Mycobacterium
APGCTVSGYYCEVHHTT

SEQ ID NO: 760871 - protein, 24 aa, Mycobacterium
APGERFVLHPGEFVLGSTLELITL

SEQ ID NO: 760872 - protein, 21 aa, Mycobacterium
APGGTGGVGGWLYGNGGAGGA

SEQ ID NO: 760873 - protein, 17 aa, Mycobacterium
APGGWLLGDGGAGGSGA

SEQ ID NO: 760874 - protein, 17 aa, Mycobacterium
APGMPVLGISAGLHAVV

SEQ ID NO: 760875 - protein, 19 aa, Mycobacterium
APGPCRAAGTSDLTFASGW

SEQ ID NO: 760876 - protein, 18 aa, Mycobacterium
APGRRLLLGSGFELDYDY

SEQ ID NO: 760877 - protein, 17 aa, Mycobacterium
APGSLGLHAALTGAPFS

SEQ ID NO: 760878 - protein, 21 aa, Mycobacterium
APGVPGAPVFGEAGVVTPPAP

SEQ ID NO: 760879 - protein, 29 aa, Mycobacterium
APGWAKHAWSCFFAPWIAEATIFVYNYGR

SEQ ID NO: 760880 - protein, 17 aa, Mycobacterium
APHGWSFAEAAAVPVVF

SEQ ID NO: 760881 - protein, 17 aa, Mycobacterium
APHLARITCPALVINAD

SEQ ID NO: 760882 - protein, 18 aa, Mycobacterium
APHLDWLDVRFCGEEDDE

SEQ ID NO: 760883 - protein, 19 aa, Mycobacterium
APIFHAWGLGCLQISTPLR

SEQ ID NO: 760884 - protein, 19 aa, Mycobacterium
APIGWRLALRHPEAISAIV

SEQ ID NO: 760885 - protein, 25 aa, Mycobacterium
APITRPRIRFAYQLTPRRVLGENQV

SEQ ID NO: 760886 - protein, 19 aa, Mycobacterium
APKAFIFVSHIQRLGNGKP

SEQ ID NO: 760887 - protein, 17 aa, Mycobacterium
APLCAPCDVFAPTYEGS

SEQ ID NO: 760888 - protein, 21 aa, Mycobacterium
APLCPPCAVLTPTYEGSSDKH

SEQ ID NO: 760889 - protein, 19 aa, Mycobacterium
APLERVWRAISDAEEFGRW

SEQ ID NO: 760890 - protein, 17 aa, Mycobacterium
APLISWDNAFGLVKINP

SEQ ID NO: 760891 - protein, 19 aa, Mycobacterium
APLKLAFDYTRSVGPLLGE

SEQ ID NO: 760892 - protein, 18 aa, Mycobacterium
APLLRWGISHFDPDVRSP

SEQ ID NO: 760893 - protein, 20 aa, Mycobacterium
APLMKEWPDVLATPRPTPAY

SEQ ID NO: 760894 - protein, 26 aa, Mycobacterium
APLNELRTKCGLPLDLAQVVNGGGLN

SEQ ID NO: 760895 - protein, 18 aa, Mycobacterium
APLPFRFPFPSFATCIAE

SEQ ID NO: 760896 - protein, 17 aa, Mycobacterium
APLPLAAITPRWVARRL

SEQ ID NO: 760897 - protein, 17 aa, Mycobacterium
APLTWPAGWSAWPPRGY

SEQ ID NO: 760898 - protein, 19 aa, Mycobacterium
APLVITMIWLHAAMPRVFR

SEQ ID NO: 760899 - protein, 18 aa, Mycobacterium
APLVWCVAALLGQHPLSA

SEQ ID NO: 760900 - protein, 20 aa, Mycobacterium
APMALGWSRWRALDGGRSLG

SEQ ID NO: 760901 - protein, 17 aa, Mycobacterium
APMARPFYVATAANPEN

SEQ ID NO: 760902 - protein, 17 aa, Mycobacterium
APMARRLVDWPGGLTVF

SEQ ID NO: 760903 - protein, 22 aa, Mycobacterium
APMCGVLRGSAKFTERLTLGYR

SEQ ID NO: 760904 - protein, 19 aa, Mycobacterium
APMFHAWGFSQLAFAASMA

SEQ ID NO: 760905 - protein, 17 aa, Mycobacterium
APMPEINQALGRDQPAA

SEQ ID NO: 760906 - protein, 17 aa, Mycobacterium
APMPHPWFQLIFEGGEQ

SEQ ID NO: 760907 - protein, 18 aa, Mycobacterium
APMSYPFRDAEFGGKELA

SEQ ID NO: 760908 - protein, 19 aa, Mycobacterium
APMTLRWLRDRFAGRPISA

SEQ ID NO: 760909 - protein, 18 aa, Mycobacterium
APMTLRWLTDRFDRRPLT

SEQ ID NO: 760910 - protein, 18 aa, Mycobacterium
APMTLRWLTDRFEGRPLT

SEQ ID NO: 760911 - protein, 17 aa, Mycobacterium
APMWLPFRWPGRQGVTL

SEQ ID NO: 760912 - protein, 21 aa, Mycobacterium
APNLPEWNLRGSFSTGADGVF

SEQ ID NO: 760913 - protein, 18 aa, Mycobacterium
APPAIELSMMWRNDCESP

SEQ ID NO: 760914 - protein, 24 aa, Mycobacterium
APPDTDGWCSLSLHAGGTVDELRR

SEQ ID NO: 760915 - protein, 20 aa, Mycobacterium
APPGGWPVLAWAHGTVGLGD

SEQ ID NO: 760916 - protein, 17 aa, Mycobacterium
APPLPWSLVDLGLSSAA

SEQ ID NO: 760917 - protein, 17 aa, Mycobacterium
APPMVIETLQWMGGFGA

SEQ ID NO: 760918 - protein, 17 aa, Mycobacterium
APPRFAEEIAWWVWWCW

SEQ ID NO: 760919 - protein, 17 aa, Mycobacterium
APPRWEHYRDFDLGYHL

SEQ ID NO: 760920 - protein, 25 aa, Mycobacterium
APQAIWPRVRRALAAVGLALPLMHD

SEQ ID NO: 760921 - protein, 18 aa, Mycobacterium
APQAPLGMFARISPAGVV

SEQ ID NO: 760922 - protein, 18 aa, Mycobacterium
APQARLGLIAAIRDAGLD

SEQ ID NO: 760923 - protein, 17 aa, Mycobacterium
APQRLWAKPAITVIGID

SEQ ID NO: 760924 - protein, 18 aa, Mycobacterium
APRDEFLLLYGIDEDGQI

SEQ ID NO: 760925 - protein, 18 aa, Mycobacterium
APRFNEFYEKIWRGIGQK

SEQ ID NO: 760926 - protein, 19 aa, Mycobacterium
APRGGPLQGVRVVELTKVW

SEQ ID NO: 760927 - protein, 23 aa, Mycobacterium
APRIVAGIPVCLCANSEIDAAKD

SEQ ID NO: 760928 - protein, 23 aa, Mycobacterium
APRIVAGIPVCLCANSEIDTAKE

SEQ ID NO: 760929 - protein, 17 aa, Mycobacterium
APRLAFHAWVQQQCAEQ

SEQ ID NO: 760930 - protein, 21 aa, Mycobacterium
APRPRMLVFGAIDFAAALAHQ

SEQ ID NO: 760931 - protein, 20 aa, Mycobacterium
APRPRMLVFGAIDFAAALAR

SEQ ID NO: 760932 - protein, 22 aa, Mycobacterium
APRPRMLVFGAIDFAAAVAQQG

SEQ ID NO: 760933 - protein, 18 aa, Mycobacterium
APRRPWESCRCPRAGPPP

SEQ ID NO: 760934 - protein, 19 aa, Mycobacterium
APRTMLCGIAFRIHIDVAG

SEQ ID NO: 760935 - protein, 24 aa, Mycobacterium
APRWDTAIIGLDWDTAVLDERLAQ

SEQ ID NO: 760936 - protein, 24 aa, Mycobacterium
APRWNTAIVGLDWETTVLDERLRR

SEQ ID NO: 760937 - protein, 21 aa, Mycobacterium
APRWRWWRSSWWRVFSPAASC

SEQ ID NO: 760938 - protein, 21 aa, Mycobacterium
APSCALCGCRILGHGAEANGR

SEQ ID NO: 760939 - protein, 22 aa, Mycobacterium
APSEFRYYLPVLVRAVVGYFAD

SEQ ID NO: 760940 - protein, 18 aa, Mycobacterium
APSGLWRRIFPVLLLAQK

SEQ ID NO: 760941 - protein, 18 aa, Mycobacterium
APSKGWRRALLKVSGGLI

SEQ ID NO: 760942 - protein, 20 aa, Mycobacterium
APSLFRLRIPGGRAHLLNCY

SEQ ID NO: 760943 - protein, 31 aa, Mycobacterium
APTEPADMPGVWAVMAWARRQPMYSDPAMRT

SEQ ID NO: 760944 - protein, 19 aa, Mycobacterium
APTIIFGWGGGTLRSYVDA

SEQ ID NO: 760945 - protein, 21 aa, Mycobacterium
APTLREAWAVIAPMLAGATPV

SEQ ID NO: 760946 - protein, 23 aa, Mycobacterium
APTLRPGKPAGCAASDYKGVTVK

SEQ ID NO: 760947 - protein, 25 aa, Mycobacterium
APTQALFGRPLIGNGADGAAGTGQT

SEQ ID NO: 760948 - protein, 22 aa, Mycobacterium
APVEWHKMGAGWSWTRKAGSDT

SEQ ID NO: 760949 - protein, 18 aa, Mycobacterium
APVFEEFRSPGMVTTPDE

SEQ ID NO: 760950 - protein, 19 aa, Mycobacterium
APVGWRLALRDPAAITAII

SEQ ID NO: 760951 - protein, 17 aa, Mycobacterium
APVIDRWGAPIVVDTAG

SEQ ID NO: 760952 - protein, 18 aa, Mycobacterium
APVLFAMGRFLGADRVAG

SEQ ID NO: 760953 - protein, 18 aa, Mycobacterium
APVLRRMAEDLSDQSVSV

SEQ ID NO: 760954 - protein, 18 aa, Mycobacterium
APVLTLRTDRDWLADIVR

SEQ ID NO: 760955 - protein, 20 aa, Mycobacterium
APVPGYRGSRSFGFEEFDPF

SEQ ID NO: 760956 - protein, 18 aa, Mycobacterium
APVPGYRGSRSLGLPEFD

SEQ ID NO: 760957 - protein, 23 aa, Mycobacterium
APVRPEAWLGYFLSRLLPGLNRH

SEQ ID NO: 760958 - protein, 17 aa, Mycobacterium
APVRVGFRIGAPAVGEL

SEQ ID NO: 760959 - protein, 20 aa, Mycobacterium
APVTDWQLQFDLPSNESITN

SEQ ID NO: 760960 - protein, 19 aa, Mycobacterium
APVVPALGMALLGARAAGK

SEQ ID NO: 760961 - protein, 20 aa, Mycobacterium
APVYFNGRFGFWALSRFADV

SEQ ID NO: 760962 - protein, 20 aa, Mycobacterium
APVYRWPDLAGIAVATTAPR

SEQ ID NO: 760963 - protein, 23 aa, Mycobacterium
APWLEPEPICWAINHVRVRVGPG

SEQ ID NO: 760964 - protein, 22 aa, Mycobacterium
APWNYPMMMAIWKICPAVAAGN

SEQ ID NO: 760965 - protein, 19 aa, Mycobacterium
APYAPRLAGTPVLLDAIYD

SEQ ID NO: 760966 - protein, 23 aa, Mycobacterium
APYPELIDLLVLDAIANPHDPWD

SEQ ID NO: 760967 - protein, 18 aa, Mycobacterium
APYVERLLLDGARTKLTR

SEQ ID NO: 760968 - protein, 27 aa, Mycobacterium
AQAAAFHQRFVVALAAAAGSYGRAESA

SEQ ID NO: 760969 - protein, 25 aa, Mycobacterium
AQAARPVLFSTFLMWILANLFTKLP

SEQ ID NO: 760970 - protein, 24 aa, Mycobacterium
AQAARPVMFSTFLMWVLADLFTTL

SEQ ID NO: 760971 - protein, 24 aa, Mycobacterium
AQAFPRSRFTGIDFSDAAVAAGAA

SEQ ID NO: 760972 - protein, 18 aa, Mycobacterium
AQAFVCLPGGFGTLDELF

SEQ ID NO: 760973 - protein, 18 aa, Mycobacterium
AQAIRVAREFAHSAEESG

SEQ ID NO: 760974 - protein, 18 aa, Mycobacterium
AQAIRVAREFARNAEETR

SEQ ID NO: 760975 - protein, 18 aa, Mycobacterium
AQAIRVAREFARSAEESG

SEQ ID NO: 760976 - protein, 19 aa, Mycobacterium
AQAQGLRYIGFRHESDAGH

SEQ ID NO: 760977 - protein, 17 aa, Mycobacterium
AQARTGVFWVREMLPTH

SEQ ID NO: 760978 - protein, 17 aa, Mycobacterium
AQAVGAWTRSRGEHPDY

SEQ ID NO: 760979 - protein, 19 aa, Mycobacterium
AQCTFSWPPQMDLPGYKPN

SEQ ID NO: 760980 - protein, 18 aa, Mycobacterium
AQCTTAFCAVLSPDTGEL

SEQ ID NO: 760981 - protein, 19 aa, Mycobacterium
AQDDWKLRLIRTLSSRGIL

SEQ ID NO: 760982 - protein, 17 aa, Mycobacterium
AQDRFGRKVSWGVEVRS

SEQ ID NO: 760983 - protein, 23 aa, Mycobacterium
AQDSRAGAVLSRILSLTDDEVRA

SEQ ID NO: 760984 - protein, 18 aa, Mycobacterium
AQEKASVLSFVLAGHEPL

SEQ ID NO: 760985 - protein, 24 aa, Mycobacterium
AQELYFPVCFELAITKGPPTADDR

SEQ ID NO: 760986 - protein, 24 aa, Mycobacterium
AQELYFPVCFELAVTKGPPAPDDR

SEQ ID NO: 760987 - protein, 24 aa, Mycobacterium
AQELYFPVCFELAVTKGPPAPQDR

SEQ ID NO: 760988 - protein, 20 aa, Mycobacterium
AQEWVRFGWYFLITRRDPAG

SEQ ID NO: 760989 - protein, 18 aa, Mycobacterium
AQEYLVWRAAANHFELVR

SEQ ID NO: 760990 - protein, 18 aa, Mycobacterium
AQFSAWGALLARTDPDAP

SEQ ID NO: 760991 - protein, 24 aa, Mycobacterium
AQGDLRAAIELPLAATFGLGALGG

SEQ ID NO: 760992 - protein, 18 aa, Mycobacterium
AQGIPAQFLVDILSDLRT

SEQ ID NO: 760993 - protein, 19 aa, Mycobacterium
AQGLGGWFRLGRIANQQKA

SEQ ID NO: 760994 - protein, 17 aa, Mycobacterium
AQHKLPIVFVVLRNGEY

SEQ ID NO: 760995 - protein, 18 aa, Mycobacterium
AQHRLRFAAGNFYINDKP

SEQ ID NO: 760996 - protein, 23 aa, Mycobacterium
AQIKRLKVGAARRFSATTPRSLV

SEQ ID NO: 760997 - protein, 18 aa, Mycobacterium
AQIKRLKVGTTRRFSKTN

SEQ ID NO: 760998 - protein, 17 aa, Mycobacterium
AQIKRWSEEAAEQFVDA

SEQ ID NO: 760999 - protein, 18 aa, Mycobacterium
AQILAGFCDVALVIGADT

SEQ ID NO: 761000 - protein, 18 aa, Mycobacterium
AQILAGFCDVALVVGADT

SEQ ID NO: 761001 - protein, 18 aa, Mycobacterium
AQIRAGGLDAMLVSDLNN

SEQ ID NO: 761002 - protein, 19 aa, Mycobacterium
AQKAVDRFGRLDVVVNNVG

SEQ ID NO: 761003 - protein, 17 aa, Mycobacterium
AQLCAMASVAVHDFGFE

SEQ ID NO: 761004 - protein, 24 aa, Mycobacterium
AQLDRFAIRLELRYLSERDEAAML

SEQ ID NO: 761005 - protein, 24 aa, Mycobacterium
AQLDRFAIRLELRYLSERDETAML

SEQ ID NO: 761006 - protein, 24 aa, Mycobacterium
AQLDRFAIRLELRYLSERDETSML

SEQ ID NO: 761007 - protein, 17 aa, Mycobacterium
AQLDWPLAEALRYPAGL

SEQ ID NO: 761008 - protein, 19 aa, Mycobacterium
AQLELKWRAIKEDLERAHA

SEQ ID NO: 761009 - protein, 20 aa, Mycobacterium
AQLELKWRALKEELESRGAA

SEQ ID NO: 761010 - protein, 19 aa, Mycobacterium
AQLILRWHIELGHVVIPKT

SEQ ID NO: 761011 - protein, 17 aa, Mycobacterium
AQLLAPVPHELSAVAAA

SEQ ID NO: 761012 - protein, 22 aa, Mycobacterium
AQLLERFGMFGIRISIAGLAAG

SEQ ID NO: 761013 - protein, 19 aa, Mycobacterium
AQLMFFLGHGYRVVAHDRR

SEQ ID NO: 761014 - protein, 18 aa, Mycobacterium
AQLNLPWNRDFNALVYVL

SEQ ID NO: 761015 - protein, 19 aa, Mycobacterium
AQLNWPYGCGGIMLGTHKP

SEQ ID NO: 761016 - protein, 17 aa, Mycobacterium
AQLPLTMGHEFSGTITA

SEQ ID NO: 761017 - protein, 19 aa, Mycobacterium
AQLPPWLGSTFRRSAVLRY

SEQ ID NO: 761018 - protein, 19 aa, Mycobacterium
AQLPVPTVASAVLDPTQIV

SEQ ID NO: 761019 - protein, 18 aa, Mycobacterium
AQLSHWGALLARTDPSAP

SEQ ID NO: 761020 - protein, 21 aa, Mycobacterium
AQMPMKVISMLLGIPEDDQEY

SEQ ID NO: 761021 - protein, 18 aa, Mycobacterium
AQNAHWGVCLARTDPDAP

SEQ ID NO: 761022 - protein, 19 aa, Mycobacterium
AQPAWAYSVIALRWAAKYY

SEQ ID NO: 761023 - protein, 19 aa, Mycobacterium
AQPLWRVLVALSIRHVGPT

SEQ ID NO: 761024 - protein, 23 aa, Mycobacterium
AQPVCCPNCGPTLRLLTTEGEHA

SEQ ID NO: 761025 - protein, 20 aa, Mycobacterium
AQQAGALGIRFVDAPVTRSP

SEQ ID NO: 761026 - protein, 21 aa, Mycobacterium
AQQALEMGLVWRLCEPDQLDD

SEQ ID NO: 761027 - protein, 33 aa, Mycobacterium
AQQYQALSAQIARFHDQFVRSLSGAAQTYASAE

SEQ ID NO: 761028 - protein, 19 aa, Mycobacterium
AQRAGLELLAFGGRFVEIG

SEQ ID NO: 761029 - protein, 17 aa, Mycobacterium
AQRAGLELLAWGGRFVE

SEQ ID NO: 761030 - protein, 17 aa, Mycobacterium
AQRAGLELLSWGGRFVE

SEQ ID NO: 761031 - protein, 18 aa, Mycobacterium
AQRFGCPVVDLYSTTESG

SEQ ID NO: 761032 - protein, 20 aa, Mycobacterium
AQRGWPVFLVSTVTRENLQP

SEQ ID NO: 761033 - protein, 23 aa, Mycobacterium
AQRHGFEVWALWGMALRATVDAL

SEQ ID NO: 761034 - protein, 22 aa, Mycobacterium
AQRHLKRLWGLPGTQLGVVAWP

SEQ ID NO: 761035 - protein, 25 aa, Mycobacterium
AQRLGLRGDLLWSFRRRHTEIHARR

SEQ ID NO: 761036 - protein, 25 aa, Mycobacterium
AQRPAVEDWLYWRYVTGLLDSALTA

SEQ ID NO: 761037 - protein, 20 aa, Mycobacterium
AQRRLPLLLANGADVHVITR

SEQ ID NO: 761038 - protein, 24 aa, Mycobacterium
AQSALDMACRWARDRDVFGGRLAD

SEQ ID NO: 761039 - protein, 22 aa, Mycobacterium
AQSLFGRPLIGDGANATTPGGN

SEQ ID NO: 761040 - protein, 19 aa, Mycobacterium
AQSQVVAWWAPSYDEPNGG

SEQ ID NO: 761041 - protein, 19 aa, Mycobacterium
AQSVSRTMFGWLLGGLSRT

SEQ ID NO: 761042 - protein, 18 aa, Mycobacterium
AQVALAWLISYPGVVAIP

SEQ ID NO: 761043 - protein, 21 aa, Mycobacterium
AQVALAWLRYRADAFGVASVP

SEQ ID NO: 761044 - protein, 18 aa, Mycobacterium
AQVFPRPIGLMIGLELSA

SEQ ID NO: 761045 - protein, 23 aa, Mycobacterium
AQVPRIRWPAAAFPVRAVRAGVA

SEQ ID NO: 761046 - protein, 25 aa, Mycobacterium
AQVPRPARAAVRWLRATALERAGDI

SEQ ID NO: 761047 - protein, 21 aa, Mycobacterium
AQVRFPLRPFMGMMGVAFTQD

SEQ ID NO: 761048 - protein, 18 aa, Mycobacterium
AQVVLRWHVQRGDIVFPK

SEQ ID NO: 761049 - protein, 17 aa, Mycobacterium
AQWFARRRVDVLENTSV

SEQ ID NO: 761050 - protein, 17 aa, Mycobacterium
AQWRAASPLPGWDVKAL

SEQ ID NO: 761051 - protein, 23 aa, Mycobacterium
AQWREFAERAPLYTAREKAKELG

SEQ ID NO: 761052 - protein, 24 aa, Mycobacterium
AQYCFPHLRFIASVGEPLDPEAVW

SEQ ID NO: 761053 - protein, 24 aa, Mycobacterium
AQYQEVMSTYGIYSIDFDDEGAIL

SEQ ID NO: 761054 - protein, 25 aa, Mycobacterium
ARAAAACTGCAAGAAVAACAAGPES

SEQ ID NO: 761055 - protein, 18 aa, Mycobacterium
ARAAGFDAVEFWWPFAEA

SEQ ID NO: 761056 - protein, 19 aa, Mycobacterium
ARAAGLLLRPRDIFVEQTV

SEQ ID NO: 761057 - protein, 18 aa, Mycobacterium
ARAAGVLCRPRDVFIEQT

SEQ ID NO: 761058 - protein, 19 aa, Mycobacterium
ARAALARRYLAVEGHRVLA

SEQ ID NO: 761059 - protein, 19 aa, Mycobacterium
ARAALSWWRHRQSIIETGI

SEQ ID NO: 761060 - protein, 19 aa, Mycobacterium
ARAARLKWWTTELQVRTAD

SEQ ID NO: 761061 - protein, 17 aa, Mycobacterium
ARAAWRKALEGFEAPTL

SEQ ID NO: 761062 - protein, 21 aa, Mycobacterium
ARADEFTAWLGGTRVNPRFPS

SEQ ID NO: 761063 - protein, 17 aa, Mycobacterium
ARAEWAPEFALHEFASA

SEQ ID NO: 761064 - protein, 19 aa, Mycobacterium
ARAEWWYSRAATVMGGTAE

SEQ ID NO: 761065 - protein, 21 aa, Mycobacterium
ARAFLRMYYLNKACEIQIAAS

SEQ ID NO: 761066 - protein, 17 aa, Mycobacterium
ARAGIRWLTAYGTTELP

SEQ ID NO: 761067 - protein, 17 aa, Mycobacterium
ARAGSCRRCFVTLPTSA

SEQ ID NO: 761068 - protein, 19 aa, Mycobacterium
ARAGWLWSRRRGIVAGLAA

SEQ ID NO: 761069 - protein, 20 aa, Mycobacterium
ARAIPGRAAHGWRQNRGGVA

SEQ ID NO: 761070 - protein, 19 aa, Mycobacterium
ARAKEAFGIQKRQRQMDRC

SEQ ID NO: 761071 - protein, 19 aa, Mycobacterium
ARAKSGINGAAWQTRTVSA

SEQ ID NO: 761072 - protein, 19 aa, Mycobacterium
ARALGLPVVEVIAGGDISQ

SEQ ID NO: 761073 - protein, 19 aa, Mycobacterium
ARALHRWGLGVRRERSELA

SEQ ID NO: 761074 - protein, 24 aa, Mycobacterium
ARALIAVRGLHRFAAIEGLAPTDV

SEQ ID NO: 761075 - protein, 24 aa, Mycobacterium
ARALKELFDQLGLGRVPLVGNSLG

SEQ ID NO: 761076 - protein, 18 aa, Mycobacterium
ARALPPGHAFRTDDRLVK

SEQ ID NO: 761077 - protein, 17 aa, Mycobacterium
ARAPMAVTVADTLIGRV

SEQ ID NO: 761078 - protein, 17 aa, Mycobacterium
ARAPMWWRPDGRVPDDP

SEQ ID NO: 761079 - protein, 19 aa, Mycobacterium
ARAPWEIARPVGADGALAK

SEQ ID NO: 761080 - protein, 19 aa, Mycobacterium
ARARARLAGLLGYLKPAPD

SEQ ID NO: 761081 - protein, 18 aa, Mycobacterium
ARARASFEAGVWSQLPGR

SEQ ID NO: 761082 - protein, 22 aa, Mycobacterium
ARARFGDVLPFLVKVLAADEPL

SEQ ID NO: 761083 - protein, 19 aa, Mycobacterium
ARARLAVALHYLDKAGSVE

SEQ ID NO: 761084 - protein, 22 aa, Mycobacterium
ARARLTQMRDFYAFLLGEIPTL

SEQ ID NO: 761085 - protein, 19 aa, Mycobacterium
ARARRAGVSSFGFGGTNAH

SEQ ID NO: 761086 - protein, 18 aa, Mycobacterium
ARARRMCRELEQFDLVWI

SEQ ID NO: 761087 - protein, 20 aa, Mycobacterium
ARASALFLRRGDHPDGQVWS

SEQ ID NO: 761088 - protein, 17 aa, Mycobacterium
ARASFKYGLNAKWPVYL

SEQ ID NO: 761089 - protein, 21 aa, Mycobacterium
ARASLAYGLNAKWPVYLSTKN

SEQ ID NO: 761090 - protein, 20 aa, Mycobacterium
ARATWPLPEPTLAYFPNARF

SEQ ID NO: 761091 - protein, 18 aa, Mycobacterium
ARAVPLLIGLGVDALSVT

SEQ ID NO: 761092 - protein, 22 aa, Mycobacterium
ARAWRLPWPGGTVVYELDQPKV

SEQ ID NO: 761093 - protein, 17 aa, Mycobacterium
ARAWSSYAPTLVRLPDG

SEQ ID NO: 761094 - protein, 24 aa, Mycobacterium
ARAYRLDWPAGMTVFEIDQPEVIE

SEQ ID NO: 761095 - protein, 20 aa, Mycobacterium
ARAYRLSWPPGSVVYEVDQP

SEQ ID NO: 761096 - protein, 20 aa, Mycobacterium
ARAYVRFAIGHPGHYAVMFD

SEQ ID NO: 761097 - protein, 17 aa, Mycobacterium
ARCALAWSVETASLARE

SEQ ID NO: 761098 - protein, 18 aa, Mycobacterium
ARCALAWSVETASLAREH

SEQ ID NO: 761099 - protein, 20 aa, Mycobacterium
ARCGLPLATYFSGPKLRWLL

SEQ ID NO: 761100 - protein, 20 aa, Mycobacterium
ARCPMAWSDTYGGHWVAAGS

SEQ ID NO: 761101 - protein, 17 aa, Mycobacterium
ARDALLKAIRAATPSAS

SEQ ID NO: 761102 - protein, 17 aa, Mycobacterium
ARDCNFGGITLVEKVDP

SEQ ID NO: 761103 - protein, 25 aa, Mycobacterium
ARDIGFRMPTLWFADGHSTSAPVYL

SEQ ID NO: 761104 - protein, 19 aa, Mycobacterium
ARDVWYNRILPFAHNLSER

SEQ ID NO: 761105 - protein, 25 aa, Mycobacterium
ARDWQRLLFDNGWLLPGQPPEFGGR

SEQ ID NO: 761106 - protein, 17 aa, Mycobacterium
ARECLRTALEYAQTREQ

SEQ ID NO: 761107 - protein, 24 aa, Mycobacterium
AREEFNMPLALRFEGPLDSVALAA

SEQ ID NO: 761108 - protein, 18 aa, Mycobacterium
AREFARLGSFVAAVDALR

SEQ ID NO: 761109 - protein, 18 aa, Mycobacterium
AREFQRFLLAKQREITAV

SEQ ID NO: 761110 - protein, 22 aa, Mycobacterium
AREHGWPAFADRLLELARAAEP

SEQ ID NO: 761111 - protein, 20 aa, Mycobacterium
AREILGMVCDLYALSVIEED

SEQ ID NO: 761112 - protein, 19 aa, Mycobacterium
ARELLLDRVIDMAVERRGA

SEQ ID NO: 761113 - protein, 23 aa, Mycobacterium
ARELPVGLALRARLGAIGRAGEH

SEQ ID NO: 761114 - protein, 18 aa, Mycobacterium
ARERDGRISQRFFGAHTY

SEQ ID NO: 761115 - protein, 17 aa, Mycobacterium
AREVTWAQLGVRLAAIG

SEQ ID NO: 761116 - protein, 24 aa, Mycobacterium
ARFAFVCAVDMPLLSASLIDDLIG

SEQ ID NO: 761117 - protein, 22 aa, Mycobacterium
ARFATYPVLAVQGWAAFHDLKL

SEQ ID NO: 761118 - protein, 18 aa, Mycobacterium
ARFCPQFGQPVQVIPADP

SEQ ID NO: 761119 - protein, 18 aa, Mycobacterium
ARFEFRWHDQFALSLDPD

SEQ ID NO: 761120 - protein, 20 aa, Mycobacterium
ARFGVPLPRGLREEAGDMSW

SEQ ID NO: 761121 - protein, 20 aa, Mycobacterium
ARFGVPVPNLSAWRNGVVGD

SEQ ID NO: 761122 - protein, 19 aa, Mycobacterium
ARFGWPKRNGFVQPMVDAE

SEQ ID NO: 761123 - protein, 17 aa, Mycobacterium
ARFIAHSPFFCMATVGA

SEQ ID NO: 761124 - protein, 19 aa, Mycobacterium
ARFIKFMVTEIFPGGRLPS

SEQ ID NO: 761125 - protein, 17 aa, Mycobacterium
ARFNGTVLLEWLNVSGG

SEQ ID NO: 761126 - protein, 17 aa, Mycobacterium
ARFPGWHIPILGVTFDG

SEQ ID NO: 761127 - protein, 21 aa, Mycobacterium
ARFPKFDWPRIDAPYLRPGAD

SEQ ID NO: 761128 - protein, 20 aa, Mycobacterium
ARFPKFDWPRIEAPYIRPRA

SEQ ID NO: 761129 - protein, 17 aa, Mycobacterium
ARFRFVEEMMRLGADAR

SEQ ID NO: 761130 - protein, 18 aa, Mycobacterium
ARFRGCPFHNAAVESAGE

SEQ ID NO: 761131 - protein, 19 aa, Mycobacterium
ARFRLPLSLADHLPEIAAY

SEQ ID NO: 761132 - protein, 17 aa, Mycobacterium
ARFSAAFTFQYSKRPGT

SEQ ID NO: 761133 - protein, 17 aa, Mycobacterium
ARFSSAFTFQYSKRPGT

SEQ ID NO: 761134 - protein, 18 aa, Mycobacterium
ARFVKRFADIGGELRRAA

SEQ ID NO: 761135 - protein, 18 aa, Mycobacterium
ARFVKRFADLGGELRRAA

SEQ ID NO: 761136 - protein, 17 aa, Mycobacterium
ARFWPWLAYSGAILRGT

SEQ ID NO: 761137 - protein, 17 aa, Mycobacterium
ARGAAKLAGYRGAMYPW

SEQ ID NO: 761138 - protein, 24 aa, Mycobacterium
ARGEARFYLRAGALLTEAASLAGA

SEQ ID NO: 761139 - protein, 18 aa, Mycobacterium
ARGGAALSVREVTGVPIL

SEQ ID NO: 761140 - protein, 21 aa, Mycobacterium
ARGGCCGSGPAGPAVAAVAAV

SEQ ID NO: 761141 - protein, 17 aa, Mycobacterium
ARGLPVLGLCLGLQCIV

SEQ ID NO: 761142 - protein, 20 aa, Mycobacterium
ARGLPVLGLCLGLQCIVIEA

SEQ ID NO: 761143 - protein, 18 aa, Mycobacterium
ARGLRIARQLLLDIIDIG

SEQ ID NO: 761144 - protein, 18 aa, Mycobacterium
ARGLSVLHLRLAESRPND

SEQ ID NO: 761145 - protein, 17 aa, Mycobacterium
ARGLWNLFLPAESGLTN

SEQ ID NO: 761146 - protein, 17 aa, Mycobacterium
ARGNCAVDYGFHQILGG

SEQ ID NO: 761147 - protein, 25 aa, Mycobacterium
ARGPLASGMFGDFAAADAFHEAVTT

SEQ ID NO: 761148 - protein, 23 aa, Mycobacterium
ARGRLTAWFKEFVLTGVPWGLRR

SEQ ID NO: 761149 - protein, 20 aa, Mycobacterium
ARGSFFPVIPVCSSTGVGTL

SEQ ID NO: 761150 - protein, 20 aa, Mycobacterium
ARGSLYFGVPTVWLRVAGDE

SEQ ID NO: 761151 - protein, 19 aa, Mycobacterium
ARGSWALAVLEHGTGRIAV

SEQ ID NO: 761152 - protein, 19 aa, Mycobacterium
ARGTVRFSLGPGVSPADVD

SEQ ID NO: 761153 - protein, 17 aa, Mycobacterium
ARHLILIAMGRSKAEAV

SEQ ID NO: 761154 - protein, 18 aa, Mycobacterium
ARHLRLRPGMAASLAGNL

SEQ ID NO: 761155 - protein, 23 aa, Mycobacterium
ARHPRLTKAFLRFSNHLLFRSTL

SEQ ID NO: 761156 - protein, 22 aa, Mycobacterium
ARHPRLVLIIAHMGMPEYSEFL

SEQ ID NO: 761157 - protein, 19 aa, Mycobacterium
ARHPVKWGLGFGLPEPTTL

SEQ ID NO: 761158 - protein, 24 aa, Mycobacterium
ARHRGRLRFGVGVTDASRRHPAVT

SEQ ID NO: 761159 - protein, 20 aa, Mycobacterium
ARIAFDLATRIPLRARLYRV

SEQ ID NO: 761160 - protein, 19 aa, Mycobacterium
ARIAHHLGHRVIGVDLVGE

SEQ ID NO: 761161 - protein, 18 aa, Mycobacterium
ARIARLLPALALARIDGR

SEQ ID NO: 761162 - protein, 18 aa, Mycobacterium
ARIEFKLRDWLFARQRYW

SEQ ID NO: 761163 - protein, 20 aa, Mycobacterium
ARIGCGFITWSLAGNPRALD

SEQ ID NO: 761164 - protein, 17 aa, Mycobacterium
ARIGFVLGDAEPVVALS

SEQ ID NO: 761165 - protein, 18 aa, Mycobacterium
ARIKLADMRAGRMSDDDW

SEQ ID NO: 761166 - protein, 23 aa, Mycobacterium
ARIKRFIKTFVMFAAEHPDLIRI

SEQ ID NO: 761167 - protein, 26 aa, Mycobacterium
ARIKSIGLRLGVPWYAYDTVTFRGEV

SEQ ID NO: 761168 - protein, 21 aa, Mycobacterium
ARINMMPGFTGTGFYWHSDFE

SEQ ID NO: 761169 - protein, 17 aa, Mycobacterium
ARIPFLREPFGPTIDTI

SEQ ID NO: 761170 - protein, 20 aa, Mycobacterium
ARIQIAIAFDELFKRITNLR

SEQ ID NO: 761171 - protein, 21 aa, Mycobacterium
ARIRGCPRLSDSIAHAIAEGC

SEQ ID NO: 761172 - protein, 18 aa, Mycobacterium
ARIRSCPKLTDSIEHAVA

SEQ ID NO: 761173 - protein, 17 aa, Mycobacterium
ARISAGLSRQDLARLSR

SEQ ID NO: 761174 - protein, 19 aa, Mycobacterium
ARIVPWLSVARVARASTDD

SEQ ID NO: 761175 - protein, 18 aa, Mycobacterium
ARIVRRWSVPEVFWAWVS

SEQ ID NO: 761176 - protein, 18 aa, Mycobacterium
ARKAFGITVSDVLLAPTL

SEQ ID NO: 761177 - protein, 18 aa, Mycobacterium
ARKGCVFVSVNYRLGALG

SEQ ID NO: 761178 - protein, 18 aa, Mycobacterium
ARKPRFAILKGRGNYLCL

SEQ ID NO: 761179 - protein, 19 aa, Mycobacterium
ARKRLPVVLFAEGGGGRPG

SEQ ID NO: 761180 - protein, 20 aa, Mycobacterium
ARKSFVCGFHGWTYGLDGTC

SEQ ID NO: 761181 - protein, 17 aa, Mycobacterium
ARKVWAAGVQASRLGKM

SEQ ID NO: 761182 - protein, 17 aa, Mycobacterium
ARLAALIGEHARLAEAI

SEQ ID NO: 761183 - protein, 18 aa, Mycobacterium
ARLADRWTDRLAAATRDA

SEQ ID NO: 761184 - protein, 19 aa, Mycobacterium
ARLAEWFARQTLEPTVERL

SEQ ID NO: 761185 - protein, 19 aa, Mycobacterium
ARLAGLLIQRGLRPGDRVG

SEQ ID NO: 761186 - protein, 19 aa, Mycobacterium
ARLAMLLATNFFGINAPAI

SEQ ID NO: 761187 - protein, 17 aa, Mycobacterium
ARLATAFTQTWVATSDD

SEQ ID NO: 761188 - protein, 17 aa, Mycobacterium
ARLDLASVFFYNGSIMP

SEQ ID NO: 761189 - protein, 17 aa, Mycobacterium
ARLEAALTLPNRTEGVV

SEQ ID NO: 761190 - protein, 22 aa, Mycobacterium
ARLEALPGWVWGASGEQRWERG

SEQ ID NO: 761191 - protein, 17 aa, Mycobacterium
ARLGAVHSVVFGGFAPH

SEQ ID NO: 761192 - protein, 17 aa, Mycobacterium
ARLGFTVAVVPSGAVGA

SEQ ID NO: 761193 - protein, 18 aa, Mycobacterium
ARLGRAWLQFTAEGDGAV

SEQ ID NO: 761194 - protein, 18 aa, Mycobacterium
ARLGRGWSDERIEATLNE

SEQ ID NO: 761195 - protein, 18 aa, Mycobacterium
ARLGYALNRAHIGAVIWS

SEQ ID NO: 761196 - protein, 17 aa, Mycobacterium
ARLGYALNRTHTAAVIW

SEQ ID NO: 761197 - protein, 18 aa, Mycobacterium
ARLGYPLNRAHTAAIVWS

SEQ ID NO: 761198 - protein, 18 aa, Mycobacterium
ARLHARLGALIGEGVLEV

SEQ ID NO: 761199 - protein, 17 aa, Mycobacterium
ARLKARWAPEGLVQRSQ

SEQ ID NO: 761200 - protein, 17 aa, Mycobacterium
ARLKGLIDVGTYNASNA

SEQ ID NO: 761201 - protein, 19 aa, Mycobacterium
ARLKGYRLICVLPENTSVE

SEQ ID NO: 761202 - protein, 18 aa, Mycobacterium
ARLKVGIISAGRVGTALG

SEQ ID NO: 761203 - protein, 18 aa, Mycobacterium
ARLLICVDDGPGPDLPGA

SEQ ID NO: 761204 - protein, 19 aa, Mycobacterium
ARLLLCEFVIPEHDRDFHG

SEQ ID NO: 761205 - protein, 17 aa, Mycobacterium
ARLLLPVTADLLRGSGR

SEQ ID NO: 761206 - protein, 18 aa, Mycobacterium
ARLLPAHCWFEPHERWGV

SEQ ID NO: 761207 - protein, 17 aa, Mycobacterium
ARLLVWELINALRRDGV

SEQ ID NO: 761208 - protein, 24 aa, Mycobacterium
ARLPADLLDKWGIRVVPLHILLDG

SEQ ID NO: 761209 - protein, 23 aa, Mycobacterium
ARLPADLLQKWAIRVVPLHILLD

SEQ ID NO: 761210 - protein, 24 aa, Mycobacterium
ARLPRIPFPFPLYLREPRKVVVVH

SEQ ID NO: 761211 - protein, 17 aa, Mycobacterium
ARLRFILTAQRDHYLPL

SEQ ID NO: 761212 - protein, 19 aa, Mycobacterium
ARLRLADVMAEARERIGEE

SEQ ID NO: 761213 - protein, 21 aa, Mycobacterium
ARLRPGDMVDVPAAPYLHLFV

SEQ ID NO: 761214 - protein, 28 aa, Mycobacterium
ARLRRRLRIAHAWSFAFDAAWQPLVALL

SEQ ID NO: 761215 - protein, 18 aa, Mycobacterium
ARLRRTLPLMARLTLAKV

SEQ ID NO: 761216 - protein, 17 aa, Mycobacterium
ARLRVEIMTGALRPESF

SEQ ID NO: 761217 - protein, 23 aa, Mycobacterium
ARLRWSRRPEWGGLEVDADVVGT

SEQ ID NO: 761218 - protein, 17 aa, Mycobacterium
ARLSLQVTIQVRIPLIG

SEQ ID NO: 761219 - protein, 20 aa, Mycobacterium
ARLSPTFGARGWAPQGYYFT

SEQ ID NO: 761220 - protein, 17 aa, Mycobacterium
ARLSVVVGESWRAEALA

SEQ ID NO: 761221 - protein, 18 aa, Mycobacterium
ARLTAPVTMRLAHALVCD

SEQ ID NO: 761222 - protein, 19 aa, Mycobacterium
ARLTTQISLAGRYLVYVPG

SEQ ID NO: 761223 - protein, 21 aa, Mycobacterium
ARLTVGYALAWQGRGREADGV

SEQ ID NO: 761224 - protein, 21 aa, Mycobacterium
ARLTVPLGMIILRKAYGLGAM

SEQ ID NO: 761225 - protein, 21 aa, Mycobacterium
ARLTVPVGMIILRKGYGLGAM

SEQ ID NO: 761226 - protein, 17 aa, Mycobacterium
ARLWPSIVKSFPGYDGY

SEQ ID NO: 761227 - protein, 17 aa, Mycobacterium
ARMACPYANPGRFVSGR

SEQ ID NO: 761228 - protein, 17 aa, Mycobacterium
ARMAEVFAGFLSYTDAQ

SEQ ID NO: 761229 - protein, 19 aa, Mycobacterium
ARMAIAMARAGGMGVLHRN

SEQ ID NO: 761230 - protein, 18 aa, Mycobacterium
ARMALRWRHTHEFVDIGD

SEQ ID NO: 761231 - protein, 23 aa, Mycobacterium
ARMAPRLVGAVLIGRDRAAVAEA

SEQ ID NO: 761232 - protein, 23 aa, Mycobacterium
ARMAPRLVGAVLIGRDRQEVAEA

SEQ ID NO: 761233 - protein, 18 aa, Mycobacterium
ARMATEFVRYLRRSHDLT

SEQ ID NO: 761234 - protein, 18 aa, Mycobacterium
ARMDLVFSLAERWTETGE

SEQ ID NO: 761235 - protein, 17 aa, Mycobacterium
ARMEFMLGDAAPVAAVT

SEQ ID NO: 761236 - protein, 23 aa, Mycobacterium
ARMEMAIAFPALFRRFPSLEPAE

SEQ ID NO: 761237 - protein, 17 aa, Mycobacterium
ARMGHRLTIVMDAWTIS

SEQ ID NO: 761238 - protein, 17 aa, Mycobacterium
ARMPYFCVPRFVETVDE

SEQ ID NO: 761239 - protein, 17 aa, Mycobacterium
ARMPYFCVPRFVEVVGE

SEQ ID NO: 761240 - protein, 18 aa, Mycobacterium
ARMSARRFWVRYAAEAAG

SEQ ID NO: 761241 - protein, 18 aa, Mycobacterium
ARMWARLRIHLAETGQRV

SEQ ID NO: 761242 - protein, 24 aa, Mycobacterium
ARNFKPPLSWGMRMTGKKFMREYP

SEQ ID NO: 761243 - protein, 19 aa, Mycobacterium
ARNLLPVPWVEPVDVANAV

SEQ ID NO: 761244 - protein, 23 aa, Mycobacterium
ARNPRQHLAFGFGPHLCLGHNLA

SEQ ID NO: 761245 - protein, 17 aa, Mycobacterium
ARNSAGFGAPRYGVKPI

SEQ ID NO: 761246 - protein, 17 aa, Mycobacterium
ARNVFHWVFAFADGGLA

SEQ ID NO: 761247 - protein, 18 aa, Mycobacterium
ARNVLAFKLNPLVIKELP

SEQ ID NO: 761248 - protein, 20 aa, Mycobacterium
ARNWFGFGVAGNFAGHLEQA

SEQ ID NO: 761249 - protein, 19 aa, Mycobacterium
ARPAITLSWIRELPSLGAA

SEQ ID NO: 761250 - protein, 22 aa, Mycobacterium
ARPAKQFKWPVLRSDGTSQVFV

SEQ ID NO: 761251 - protein, 17 aa, Mycobacterium
ARPAPLVTYWFGPDDHD

SEQ ID NO: 761252 - protein, 21 aa, Mycobacterium
ARPAPQFEVMYLLTGCDAAAA

SEQ ID NO: 761253 - protein, 18 aa, Mycobacterium
ARPAVMPMDAWREGDKFV

SEQ ID NO: 761254 - protein, 20 aa, Mycobacterium
ARPDGTFVWTGRKFFTRPGE

SEQ ID NO: 761255 - protein, 17 aa, Mycobacterium
ARPELLGDMARQFGSQC

SEQ ID NO: 761256 - protein, 19 aa, Mycobacterium
ARPEYWLSQQGRLTHPMVL

SEQ ID NO: 761257 - protein, 19 aa, Mycobacterium
ARPGAFARLSPPWQPMRLV

SEQ ID NO: 761258 - protein, 22 aa, Mycobacterium
ARPGESVALLFSRSAEAIVSIL

SEQ ID NO: 761259 - protein, 22 aa, Mycobacterium
ARPKRYIPGFAIELEDESQLPA

SEQ ID NO: 761260 - protein, 25 aa, Mycobacterium
ARPPARLVGWTARFLGMVRPGDEVD

SEQ ID NO: 761261 - protein, 21 aa, Mycobacterium
ARPQIAVTFQRGWQWATVEGR

SEQ ID NO: 761262 - protein, 27 aa, Mycobacterium
ARPQLAITFRNGWQWATVEGRAELVGP

SEQ ID NO: 761263 - protein, 27 aa, Mycobacterium
ARPQLAVTFRNGWQWATVEGRAELAGP

SEQ ID NO: 761264 - protein, 22 aa, Mycobacterium
ARPRAGILRVREFVMKDSYSFD

SEQ ID NO: 761265 - protein, 20 aa, Mycobacterium
ARPSDSVAIALRVGVPIYVE

SEQ ID NO: 761266 - protein, 20 aa, Mycobacterium
ARPTPPWPTPKYRWPDSPPS

SEQ ID NO: 761267 - protein, 19 aa, Mycobacterium
ARPTSTWTYMVHDNPLADD

SEQ ID NO: 761268 - protein, 18 aa, Mycobacterium
ARPTSTWTYMVNDNPLSD

SEQ ID NO: 761269 - protein, 19 aa, Mycobacterium
ARPVIRWFVWDLTRSELVG

SEQ ID NO: 761270 - protein, 28 aa, Mycobacterium
ARPWTTRPAIPWPWRPAPLHPNEDGMTA

SEQ ID NO: 761271 - protein, 22 aa, Mycobacterium
ARPYRLPWPTGMRVYEIDQPEV

SEQ ID NO: 761272 - protein, 20 aa, Mycobacterium
ARQALTEAVLWPLQHPDTFA

SEQ ID NO: 761273 - protein, 17 aa, Mycobacterium
ARQCALNALAAVHALTG

SEQ ID NO: 761274 - protein, 17 aa, Mycobacterium
ARQEPGLSWAAGLRDDG

SEQ ID NO: 761275 - protein, 24 aa, Mycobacterium
ARQEPRLSWAAGLRDDGTTTLLVT

SEQ ID NO: 761276 - protein, 19 aa, Mycobacterium
ARQEWRIFVDLALAMGKPL

SEQ ID NO: 761277 - protein, 18 aa, Mycobacterium
ARQLKVFVERALGQWREY

SEQ ID NO: 761278 - protein, 19 aa, Mycobacterium
ARQLLDLMIHSVYSNKDSF

SEQ ID NO: 761279 - protein, 24 aa, Mycobacterium
ARQLPLRLVYVIPRREKHREPATS

SEQ ID NO: 761280 - protein, 19 aa, Mycobacterium
ARQRLEQVVIRFAGDSGDG

SEQ ID NO: 761281 - protein, 20 aa, Mycobacterium
ARQVLPMLIAKAVPGELKIV

SEQ ID NO: 761282 - protein, 31 aa, Mycobacterium
ARQWSAAGGDLWRVPSGWRVGEWAPATFRLH

SEQ ID NO: 761283 - protein, 20 aa, Mycobacterium
ARRAKRLIVFDVDSTLIQGE

SEQ ID NO: 761284 - protein, 18 aa, Mycobacterium
ARRARAKILAISREDQLA

SEQ ID NO: 761285 - protein, 19 aa, Mycobacterium
ARRAVAEFRIRGVATNIPF

SEQ ID NO: 761286 - protein, 18 aa, Mycobacterium
ARRFGCVVQDGFGSTEGG

SEQ ID NO: 761287 - protein, 17 aa, Mycobacterium
ARRGCVYVSANYRVGAF

SEQ ID NO: 761288 - protein, 17 aa, Mycobacterium
ARRGIKVVVNAGGLNPA

SEQ ID NO: 761289 - protein, 19 aa, Mycobacterium
ARRGWRVVVAADRFGVDTV

SEQ ID NO: 761290 - protein, 18 aa, Mycobacterium
ARRHGRWALRDSSGRVFE

SEQ ID NO: 761291 - protein, 24 aa, Mycobacterium
ARRIECSPLPFGRHRWVSSNGPTD

SEQ ID NO: 761292 - protein, 22 aa, Mycobacterium
ARRKGIKVAHAHLRYLSPLPAN

SEQ ID NO: 761293 - protein, 23 aa, Mycobacterium
ARRLARALHQWGFGASRERSQLA

SEQ ID NO: 761294 - protein, 20 aa, Mycobacterium
ARRLFGFPVVCAEGAALPMA

SEQ ID NO: 761295 - protein, 22 aa, Mycobacterium
ARRLKIPAERWVYPHAGTDAHD

SEQ ID NO: 761296 - protein, 19 aa, Mycobacterium
ARRLRLNSRMGLLADDVRV

SEQ ID NO: 761297 - protein, 26 aa, Mycobacterium
ARRLYASRGWLPWLGPTSVLAPTGPV

SEQ ID NO: 761298 - protein, 19 aa, Mycobacterium
ARRMAFNWAAGKGLGDYAE

SEQ ID NO: 761299 - protein, 23 aa, Mycobacterium
ARRPGWREARWVDVVTNYRAERW

SEQ ID NO: 761300 - protein, 20 aa, Mycobacterium
ARRQGIEILGPVGLAGRSAA

SEQ ID NO: 761301 - protein, 19 aa, Mycobacterium
ARRRFDWGVPLGVEVPLLA

SEQ ID NO: 761302 - protein, 18 aa, Mycobacterium
ARRRFPWGAEAPARDRAN

SEQ ID NO: 761303 - protein, 19 aa, Mycobacterium
ARRRFPWGSAQPSAALANL

SEQ ID NO: 761304 - protein, 19 aa, Mycobacterium
ARRRWARASAHLRAVAVAA

SEQ ID NO: 761305 - protein, 17 aa, Mycobacterium
ARRSDVFLTSFLPAHRK

SEQ ID NO: 761306 - protein, 19 aa, Mycobacterium
ARRSDVFLTSFLPAHRNKF

SEQ ID NO: 761307 - protein, 21 aa, Mycobacterium
ARRVARVCGCIAALLMAILGC

SEQ ID NO: 761308 - protein, 17 aa, Mycobacterium
ARRVLGGAIAFGGKATE

SEQ ID NO: 761309 - protein, 19 aa, Mycobacterium
ARSAIWRVLVRDFFQAWIR

SEQ ID NO: 761310 - protein, 20 aa, Mycobacterium
ARSALFPALVRALDDGIHDP

SEQ ID NO: 761311 - protein, 19 aa, Mycobacterium
ARSALTYPQWVAAGVEPEQ

SEQ ID NO: 761312 - protein, 18 aa, Mycobacterium
ARSASALSSRIADWEKES

SEQ ID NO: 761313 - protein, 18 aa, Mycobacterium
ARSGVDVVRLVAGDPLSI

SEQ ID NO: 761314 - protein, 20 aa, Mycobacterium
ARTAAAFGVAYRTAYHTLRS

SEQ ID NO: 761315 - protein, 17 aa, Mycobacterium
ARTAANVDKSWLGVNVH

SEQ ID NO: 761316 - protein, 19 aa, Mycobacterium
ARTCSMGVFKRHKQIDRPC

SEQ ID NO: 761317 - protein, 21 aa, Mycobacterium
ARTDLAWSLAERWSADGRPAG

SEQ ID NO: 761318 - protein, 21 aa, Mycobacterium
ARTDLLFSLAERWTGDGRSAG

SEQ ID NO: 761319 - protein, 21 aa, Mycobacterium
ARTEALPKLFAMVNNGDLQLQ

SEQ ID NO: 761320 - protein, 21 aa, Mycobacterium
ARTELMSSLGIPADIAAAIAE

SEQ ID NO: 761321 - protein, 17 aa, Mycobacterium
ARTFLMYRTQRWPDVLL

SEQ ID NO: 761322 - protein, 17 aa, Mycobacterium
ARTGFTGGLNWYRNFDR

SEQ ID NO: 761323 - protein, 21 aa, Mycobacterium
ARTGRTFACEHWGVVPDVYLL

SEQ ID NO: 761324 - protein, 19 aa, Mycobacterium
ARTGVFILDARQWFQSFPA

SEQ ID NO: 761325 - protein, 20 aa, Mycobacterium
ARTGVFWVREMLPTHKIREI

SEQ ID NO: 761326 - protein, 21 aa, Mycobacterium
ARTGVKLTSWIAGDQIQYLDT

SEQ ID NO: 761327 - protein, 23 aa, Mycobacterium
ARTHLLYGVWLRRRRRIVDARVH

SEQ ID NO: 761328 - protein, 22 aa, Mycobacterium
ARTIRIPVHMVEVINKLGRIQR

SEQ ID NO: 761329 - protein, 22 aa, Mycobacterium
ARTKIVPVSFGFPFGLSAVLPL

SEQ ID NO: 761330 - protein, 18 aa, Mycobacterium
ARTPLTYDFWGFPERFYD

SEQ ID NO: 761331 - protein, 19 aa, Mycobacterium
ARTRIRPHFFPFTEPSAEV

SEQ ID NO: 761332 - protein, 22 aa, Mycobacterium
ARTRKSFMCGFHGWTYDLTGAC

SEQ ID NO: 761333 - protein, 21 aa, Mycobacterium
ARTWRLPWPDGTVVYELDQPK

SEQ ID NO: 761334 - protein, 22 aa, Mycobacterium
ARVAARLAAAGWPLAGITHPPE

SEQ ID NO: 761335 - protein, 18 aa, Mycobacterium
ARVALPLVDKGAESPRET

SEQ ID NO: 761336 - protein, 21 aa, Mycobacterium
ARVAMKWGFGHLGRFSAEYRR

SEQ ID NO: 761337 - protein, 20 aa, Mycobacterium
ARVDCGLAGTVLRFVPPIAA

SEQ ID NO: 761338 - protein, 19 aa, Mycobacterium
ARVDCGLAGTVLRFVPPLA

SEQ ID NO: 761339 - protein, 21 aa, Mycobacterium
ARVDWSRFLPLYQQAGRRGFL

SEQ ID NO: 761340 - protein, 27 aa, Mycobacterium
ARVERAAMAACCWVTAGKAGRAERRAS

SEQ ID NO: 761341 - protein, 17 aa, Mycobacterium
ARVFAGQSTRHWEEVAE

SEQ ID NO: 761342 - protein, 19 aa, Mycobacterium
ARVGIATVYRHFPTREVLA

SEQ ID NO: 761343 - protein, 22 aa, Mycobacterium
ARVKCALLGWMACKDALAQASH

SEQ ID NO: 761344 - protein, 21 aa, Mycobacterium
ARVKCALLGWMACKDALAQAY

SEQ ID NO: 761345 - protein, 23 aa, Mycobacterium
ARVKCALLGWMAFKAAVAEARPL

SEQ ID NO: 761346 - protein, 22 aa, Mycobacterium
ARVKCALLGWMAFKDALAQACS

SEQ ID NO: 761347 - protein, 23 aa, Mycobacterium
ARVKCALLGWMAFKDALAQAITA

SEQ ID NO: 761348 - protein, 23 aa, Mycobacterium
ARVKCALLGWMAFKDALVQAIEH

SEQ ID NO: 761349 - protein, 20 aa, Mycobacterium
ARVKRLKVGTARRFSASTER

SEQ ID NO: 761350 - protein, 20 aa, Mycobacterium
ARVKSNFELFDFELDDSDMD

SEQ ID NO: 761351 - protein, 17 aa, Mycobacterium
ARVLAKFVDLVRAEIDD

SEQ ID NO: 761352 - protein, 18 aa, Mycobacterium
ARVLGRLRAHLCSDGRAV

SEQ ID NO: 761353 - protein, 17 aa, Mycobacterium
ARVLMKFIDLVNQNADE

SEQ ID NO: 761354 - protein, 18 aa, Mycobacterium
ARVLSRWQLHVDGGEPES

SEQ ID NO: 761355 - protein, 18 aa, Mycobacterium
ARVPARFPLRGVFHAAGV

SEQ ID NO: 761356 - protein, 17 aa, Mycobacterium
ARVPFLREPFGADITTI

SEQ ID NO: 761357 - protein, 23 aa, Mycobacterium
ARVPRPGFCAICRTLSERLPAVR

SEQ ID NO: 761358 - protein, 19 aa, Mycobacterium
ARVRAELLLAMLTGTPGTG

SEQ ID NO: 761359 - protein, 17 aa, Mycobacterium
ARVRELLDMVGLSAHAA

SEQ ID NO: 761360 - protein, 23 aa, Mycobacterium
ARVRGWRPFGMIPFNSSAKKCLE

SEQ ID NO: 761361 - protein, 21 aa, Mycobacterium
ARVSRRLVAMLARRGYSQTVA

SEQ ID NO: 761362 - protein, 18 aa, Mycobacterium
ARVSRYFPWQFGVDYDAI

SEQ ID NO: 761363 - protein, 18 aa, Mycobacterium
ARVSTPLFWDELAGCKPE

SEQ ID NO: 761364 - protein, 17 aa, Mycobacterium
ARVTRLPMTAARVWRAI

SEQ ID NO: 761365 - protein, 19 aa, Mycobacterium
ARVWPGITIPDGGIRYSSD

SEQ ID NO: 761366 - protein, 28 aa, Mycobacterium
ARWFPGFCSGELISAIAMTEPGTGSDLQ

SEQ ID NO: 761367 - protein, 17 aa, Mycobacterium
ARWGCLRAANLAWGCGD

SEQ ID NO: 761368 - protein, 18 aa, Mycobacterium
ARWGCLRAANLYWGCGDV

SEQ ID NO: 761369 - protein, 17 aa, Mycobacterium
ARWGNNIAILAGDYLFA

SEQ ID NO: 761370 - protein, 22 aa, Mycobacterium
ARWLHPGQRAFQIATQYALLTQ

SEQ ID NO: 761371 - protein, 20 aa, Mycobacterium
ARWLVRVMVSLLVFPGVDEA

SEQ ID NO: 761372 - protein, 18 aa, Mycobacterium
ARWMWDYFIDLIASRRRN

SEQ ID NO: 761373 - protein, 19 aa, Mycobacterium
ARYAQHWNFVGGPPDVFAH

SEQ ID NO: 761374 - protein, 19 aa, Mycobacterium
ARYAQHWNFVGGPPEEFAR

SEQ ID NO: 761375 - protein, 17 aa, Mycobacterium
ARYGIVWGAMGAARSAW

SEQ ID NO: 761376 - protein, 24 aa, Mycobacterium
ARYLRFGWAAARLDDLMNVLPARI

SEQ ID NO: 761377 - protein, 18 aa, Mycobacterium
ARYPRLIPLLTIHAVNST

SEQ ID NO: 761378 - protein, 17 aa, Mycobacterium
ARYQAFTSFTAHVRGPV

SEQ ID NO: 761379 - protein, 21 aa, Mycobacterium
ARYRAAGFWRPRTLCQELQES

SEQ ID NO: 761380 - protein, 22 aa, Mycobacterium
ARYRIPVRLAYGATEFAGSLCA

SEQ ID NO: 761381 - protein, 25 aa, Mycobacterium
ARYTWPRFVCALPREFFAAVRAELD

SEQ ID NO: 761382 - protein, 19 aa, Mycobacterium
ASADRCARGGLPRRTHVSV

SEQ ID NO: 761383 - protein, 18 aa, Mycobacterium
ASADWTLRRGRIVLLDGD

SEQ ID NO: 761384 - protein, 29 aa, Mycobacterium
ASAEATGAAPLQPVLDLINGPTQALLGRP

SEQ ID NO: 761385 - protein, 20 aa, Mycobacterium
ASAFEAARMAMIHPLAVAAN

SEQ ID NO: 761386 - protein, 21 aa, Mycobacterium
ASAFLGRLALIRIYKGRIKKG

SEQ ID NO: 761387 - protein, 20 aa, Mycobacterium
ASAFLGRLALIRIYNGRIRK

SEQ ID NO: 761388 - protein, 17 aa, Mycobacterium
ASALDWLLYDWLMAHRT

SEQ ID NO: 761389 - protein, 17 aa, Mycobacterium
ASALTWMVERACQQNLP

SEQ ID NO: 761390 - protein, 17 aa, Mycobacterium
ASAPMITEWCQLPEKTD

SEQ ID NO: 761391 - protein, 22 aa, Mycobacterium
ASARGVAAWAFAESRQPWDADG

SEQ ID NO: 761392 - protein, 17 aa, Mycobacterium
ASARLAAVLTHGGPALR

SEQ ID NO: 761393 - protein, 19 aa, Mycobacterium
ASATRLTPFTSPPPITDPV

SEQ ID NO: 761394 - protein, 26 aa, Mycobacterium
ASAVLDPTQIVNWLIYQPLHAAGQQF

SEQ ID NO: 761395 - protein, 19 aa, Mycobacterium
ASAWIAEGLFGYLAPGAQD

SEQ ID NO: 761396 - protein, 24 aa, Mycobacterium
ASAWNRLASELSFTADGYERVIKA

SEQ ID NO: 761397 - protein, 19 aa, Mycobacterium
ASCDCRKPGAGMLVRAARE

SEQ ID NO: 761398 - protein, 17 aa, Mycobacterium
ASDAVMCALDLQLAPLE

SEQ ID NO: 761399 - protein, 24 aa, Mycobacterium
ASDEWTEWRWNRILIEGSNCRDII

SEQ ID NO: 761400 - protein, 21 aa, Mycobacterium
ASDIEVRWAPSMAHAERELDF

SEQ ID NO: 761401 - protein, 18 aa, Mycobacterium
ASDLALAVIRFARQLRSQ

SEQ ID NO: 761402 - protein, 19 aa, Mycobacterium
ASDQCDAWTGLAAAGDVTP

SEQ ID NO: 761403 - protein, 19 aa, Mycobacterium
ASDVAAMFGYHADASAAVA

SEQ ID NO: 761404 - protein, 24 aa, Mycobacterium
ASDVRLAIVASTWHTKICDALLAG

SEQ ID NO: 761405 - protein, 17 aa, Mycobacterium
ASEAGLPDGVFNVVTGS

SEQ ID NO: 761406 - protein, 19 aa, Mycobacterium
ASEALSFVRQRHGLENGDL

SEQ ID NO: 761407 - protein, 24 aa, Mycobacterium
ASEFTGPMYACWPIEDRLDAFLLH

SEQ ID NO: 761408 - protein, 18 aa, Mycobacterium
ASEIDWPARWSAWKARRY

SEQ ID NO: 761409 - protein, 19 aa, Mycobacterium
ASELARFGSVFIKAGFSSM

SEQ ID NO: 761410 - protein, 25 aa, Mycobacterium
ASERARWATYPVMAVQGWAAHHNAT

SEQ ID NO: 761411 - protein, 19 aa, Mycobacterium
ASEVLAWVRAHLTEAHQTD

SEQ ID NO: 761412 - protein, 19 aa, Mycobacterium
ASFAESFVALGIIPGDGGT

SEQ ID NO: 761413 - protein, 17 aa, Mycobacterium
ASFAVALFGLMRAGAIP

SEQ ID NO: 761414 - protein, 17 aa, Mycobacterium
ASFKYGLNAKWPVYLST

SEQ ID NO: 761415 - protein, 22 aa, Mycobacterium
ASFLWWKLEPAIAELERLDGTV

SEQ ID NO: 761416 - protein, 20 aa, Mycobacterium
ASFRAGWAYLSLITVHIYYG

SEQ ID NO: 761417 - protein, 18 aa, Mycobacterium
ASFTRRFARYEPMPESAA

SEQ ID NO: 761418 - protein, 18 aa, Mycobacterium
ASGAARLLADWTAGQSDG

SEQ ID NO: 761419 - protein, 19 aa, Mycobacterium
ASGAARLLADWTRNGEDGP

SEQ ID NO: 761420 - protein, 21 aa, Mycobacterium
ASGDLAVKVLRGHARVASASG

SEQ ID NO: 761421 - protein, 22 aa, Mycobacterium
ASGLCLTLAPAIAVAWNPLIDS

SEQ ID NO: 761422 - protein, 24 aa, Mycobacterium
ASGLRLALVASTWHSEICDALLAG

SEQ ID NO: 761423 - protein, 23 aa, Mycobacterium
ASGLRSLPWEGLNLSHGEPAVTT

SEQ ID NO: 761424 - protein, 21 aa, Mycobacterium
ASGLRSLPWEGLNLSQGEPAI

SEQ ID NO: 761425 - protein, 19 aa, Mycobacterium
ASGMLLPLGVRRLRAYGST

SEQ ID NO: 761426 - protein, 23 aa, Mycobacterium
ASGRIKLAWFLLHVARYLPALIY

SEQ ID NO: 761427 - protein, 17 aa, Mycobacterium
ASGRKHLWLDVVALAQN

SEQ ID NO: 761428 - protein, 17 aa, Mycobacterium
ASGRPGAVLVDIPKDVL

SEQ ID NO: 761429 - protein, 21 aa, Mycobacterium
ASGRWPAVRFAVRHTVVQGPN

SEQ ID NO: 761430 - protein, 17 aa, Mycobacterium
ASGSRFLLFPTVAHSHA

SEQ ID NO: 761431 - protein, 18 aa, Mycobacterium
ASGSRFLVFMQRYTPAVL

SEQ ID NO: 761432 - protein, 17 aa, Mycobacterium
ASGVPLLAVWGDKDPFF

SEQ ID NO: 761433 - protein, 18 aa, Mycobacterium
ASGVRLAIVASTWHSQIC

SEQ ID NO: 761434 - protein, 18 aa, Mycobacterium
ASGWRQLILEARARVVAL

SEQ ID NO: 761435 - protein, 23 aa, Mycobacterium
ASHALAAACRRAYTAGKDRGASR

SEQ ID NO: 761436 - protein, 25 aa, Mycobacterium
ASHCYPHFRRFLAEVVRVLRPGGYF

SEQ ID NO: 761437 - protein, 19 aa, Mycobacterium
ASHHWPTWGAENIVEFLSL

SEQ ID NO: 761438 - protein, 20 aa, Mycobacterium
ASHHWPTWGRDSIVEFLSLQ

SEQ ID NO: 761439 - protein, 18 aa, Mycobacterium
ASHLVSRCGLVDRTPHAF

SEQ ID NO: 761440 - protein, 17 aa, Mycobacterium
ASILILFTPGAPREGYF

SEQ ID NO: 761441 - protein, 19 aa, Mycobacterium
ASILPISWAYIRMMGADGL

SEQ ID NO: 761442 - protein, 19 aa, Mycobacterium
ASILPISWAYIRMMGAEGL

SEQ ID NO: 761443 - protein, 20 aa, Mycobacterium
ASILPITWMYIRMMGADGLR

SEQ ID NO: 761444 - protein, 20 aa, Mycobacterium
ASILSWKHIPGIGAYAAAKA

SEQ ID NO: 761445 - protein, 22 aa, Mycobacterium
ASINRFATWWVVLERHGEMVRL

SEQ ID NO: 761446 - protein, 24 aa, Mycobacterium
ASIPIKRLRQAGVLDLLLALAQET

SEQ ID NO: 761447 - protein, 20 aa, Mycobacterium
ASKLRSMCREFGRDPTELKL

SEQ ID NO: 761448 - protein, 17 aa, Mycobacterium
ASLAEACARAADTDPDP

SEQ ID NO: 761449 - protein, 21 aa, Mycobacterium
ASLAQLWRSCGVLPDLSIGHS

SEQ ID NO: 761450 - protein, 18 aa, Mycobacterium
ASLCAAVGVPVREVAKFM

SEQ ID NO: 761451 - protein, 23 aa, Mycobacterium
ASLPELLGALAIQSVAGVVDQTQ

SEQ ID NO: 761452 - protein, 19 aa, Mycobacterium
ASLPRRHQLVLSRGPYHYD

SEQ ID NO: 761453 - protein, 19 aa, Mycobacterium
ASLPVALPLCPAAFADNPS

SEQ ID NO: 761454 - protein, 17 aa, Mycobacterium
ASLPWPFADDVTSFRYT

SEQ ID NO: 761455 - protein, 18 aa, Mycobacterium
ASLPYRIMHEFQIPLYDQ

SEQ ID NO: 761456 - protein, 17 aa, Mycobacterium
ASLRIGDRFDLARTLSD

SEQ ID NO: 761457 - protein, 18 aa, Mycobacterium
ASLSPRLMMRPATWVADS

SEQ ID NO: 761458 - protein, 19 aa, Mycobacterium
ASNAAVCWAARDAAMRNLP

SEQ ID NO: 761459 - protein, 18 aa, Mycobacterium
ASNCPRTKMVLGGYSQGA

SEQ ID NO: 761460 - protein, 20 aa, Mycobacterium
ASNGRFILGLGMTHAAVTEG

SEQ ID NO: 761461 - protein, 24 aa, Mycobacterium
ASPHGWRCVVPIGLVKPRSRGALT

SEQ ID NO: 761462 - protein, 23 aa, Mycobacterium
ASPKETWLRLLLIDAGFPAPETQ

SEQ ID NO: 761463 - protein, 25 aa, Mycobacterium
ASPLLGVLCSAYWQRPRVSVEVGAE

SEQ ID NO: 761464 - protein, 18 aa, Mycobacterium
ASPLPGWDVKALVSHMIG

SEQ ID NO: 761465 - protein, 17 aa, Mycobacterium
ASPLPGWNVKAVVSHII

SEQ ID NO: 761466 - protein, 22 aa, Mycobacterium
ASPLRPWPGFAPMIYQRYSQPF

SEQ ID NO: 761467 - protein, 24 aa, Mycobacterium
ASPRETWLRMVLIDAGLPVPVTQI

SEQ ID NO: 761468 - protein, 23 aa, Mycobacterium
ASPRFLLEFSRSFPDATVVRLER

SEQ ID NO: 761469 - protein, 22 aa, Mycobacterium
ASPRPGQCLRTFLREHGHVEVK

SEQ ID NO: 761470 - protein, 17 aa, Mycobacterium
ASPRWADPVDRLGCLRG

SEQ ID NO: 761471 - protein, 22 aa, Mycobacterium
ASPRWADPVNRLGCLRGISALT

SEQ ID NO: 761472 - protein, 22 aa, Mycobacterium
ASPRYLLDFSRRFPEVTLVRLE

SEQ ID NO: 761473 - protein, 18 aa, Mycobacterium
ASPSWRKGPRHIAGRGPR

SEQ ID NO: 761474 - protein, 18 aa, Mycobacterium
ASPWPAVPWVVSGKSGQA

SEQ ID NO: 761475 - protein, 19 aa, Mycobacterium
ASQALAFVRQRHGLENGDL

SEQ ID NO: 761476 - protein, 24 aa, Mycobacterium
ASQAMVWKRPRWSARLQRDPVADL

SEQ ID NO: 761477 - protein, 19 aa, Mycobacterium
ASQFLKFAPHPGLGPLPKD

SEQ ID NO: 761478 - protein, 19 aa, Mycobacterium
ASQFYLHFCVHRLAIDSGE

SEQ ID NO: 761479 - protein, 17 aa, Mycobacterium
ASQLGMPPWRVQKAQKQ

SEQ ID NO: 761480 - protein, 17 aa, Mycobacterium
ASRAFVPHSVWRRIGDD

SEQ ID NO: 761481 - protein, 17 aa, Mycobacterium
ASRAFVPRSVWDQMGDE

SEQ ID NO: 761482 - protein, 21 aa, Mycobacterium
ASRALAMAVQWARERHQFGRP

SEQ ID NO: 761483 - protein, 19 aa, Mycobacterium
ASRCARRLIDLHMVDGRLR

SEQ ID NO: 761484 - protein, 17 aa, Mycobacterium
ASRCGAVTPALRCAADP

SEQ ID NO: 761485 - protein, 20 aa, Mycobacterium
ASRFTGKFWKLLGAATDKNQ

SEQ ID NO: 761486 - protein, 18 aa, Mycobacterium
ASRLFLRYVIFGGEMLTF

SEQ ID NO: 761487 - protein, 18 aa, Mycobacterium
ASRLRIADVTAFAMESIP

SEQ ID NO: 761488 - protein, 19 aa, Mycobacterium
ASRVDEVLEMVGLASAADR

SEQ ID NO: 761489 - protein, 23 aa, Mycobacterium
ASSARDLVRLGSVVADANAAAAA

SEQ ID NO: 761490 - protein, 18 aa, Mycobacterium
ASSDIWKNIFWLQQRPGI

SEQ ID NO: 761491 - protein, 23 aa, Mycobacterium
ASSEAARAWWGNFLVRKANENGV

SEQ ID NO: 761492 - protein, 25 aa, Mycobacterium
ASSFYWPFGFALLGGRFWVADTGNR

SEQ ID NO: 761493 - protein, 17 aa, Mycobacterium
ASSLGLDGTEVFDITGI

SEQ ID NO: 761494 - protein, 20 aa, Mycobacterium
ASSLPEWTPALAIPCPNGLL

SEQ ID NO: 761495 - protein, 17 aa, Mycobacterium
ASSRGAGAIGFGGTAAK

SEQ ID NO: 761496 - protein, 17 aa, Mycobacterium
ASSRTAIEFAVRRLKGA

SEQ ID NO: 761497 - protein, 21 aa, Mycobacterium
ASSRWPAVRFAIRNTIVQGPN

SEQ ID NO: 761498 - protein, 26 aa, Mycobacterium
ASSRYPGGLALRFARVVRYRDDKGPA

SEQ ID NO: 761499 - protein, 18 aa, Mycobacterium
ASSVFCFVLGEALEQQGA

SEQ ID NO: 761500 - protein, 17 aa, Mycobacterium
ASTAQRIVLVWRTQTGE

SEQ ID NO: 761501 - protein, 23 aa, Mycobacterium
ASTKGDGLLVVFGHRAGQHNDAH

SEQ ID NO: 761502 - protein, 17 aa, Mycobacterium
ASTVRVAWRAKLMFSAS

SEQ ID NO: 761503 - protein, 17 aa, Mycobacterium
ASVDFGRPFGFLAVHRP

SEQ ID NO: 761504 - protein, 19 aa, Mycobacterium
ASVELKGKFPLTMTASPDG

SEQ ID NO: 761505 - protein, 19 aa, Mycobacterium
ASVLHAWRTWCVTLPESVN

SEQ ID NO: 761506 - protein, 17 aa, Mycobacterium
ASVMTHYRWLRALAGFG

SEQ ID NO: 761507 - protein, 18 aa, Mycobacterium
ASVTSGLVGQAWQGPASA

SEQ ID NO: 761508 - protein, 17 aa, Mycobacterium
ASVVLKFQKDLGIPDEK

SEQ ID NO: 761509 - protein, 17 aa, Mycobacterium
ASVWGGVAAVRFKHAMD

SEQ ID NO: 761510 - protein, 22 aa, Mycobacterium
ASWCGPCKAFAPTFAASSEKHP

SEQ ID NO: 761511 - protein, 17 aa, Mycobacterium
ASWFERFARSFSGTIAG

SEQ ID NO: 761512 - protein, 18 aa, Mycobacterium
ASWQRLRTAPALLPLGHG

SEQ ID NO: 761513 - protein, 20 aa, Mycobacterium
ASWRGAELVALYAWTDAELP

SEQ ID NO: 761514 - protein, 20 aa, Mycobacterium
ASYLLALRAAWQADNNIPNS

SEQ ID NO: 761515 - protein, 17 aa, Mycobacterium
ASYRMEQGFTFELNLSG

SEQ ID NO: 761516 - protein, 18 aa, Mycobacterium
ATAAQWSALSSQLVGTPP

SEQ ID NO: 761517 - protein, 18 aa, Mycobacterium
ATAFGGGHNVCYAAKAFL

SEQ ID NO: 761518 - protein, 19 aa, Mycobacterium
ATAFPKWLGRSWRRSAMLR

SEQ ID NO: 761519 - protein, 18 aa, Mycobacterium
ATAKARFVRVSPRKARRV

SEQ ID NO: 761520 - protein, 17 aa, Mycobacterium
ATAKTHWVRVLPTQITG

SEQ ID NO: 761521 - protein, 18 aa, Mycobacterium
ATALRDFAQRAGVPMAQT

SEQ ID NO: 761522 - protein, 18 aa, Mycobacterium
ATALREFAQHAGVPMAQT

SEQ ID NO: 761523 - protein, 18 aa, Mycobacterium
ATALRPAPVGAYPAGASA

SEQ ID NO: 761524 - protein, 17 aa, Mycobacterium
ATAMRRWMDSFGDWIAT

SEQ ID NO: 761525 - protein, 18 aa, Mycobacterium
ATARLTGRWLRGRLPTAY

SEQ ID NO: 761526 - protein, 21 aa, Mycobacterium
ATDCALPMMWALRRGVKVDTF

SEQ ID NO: 761527 - protein, 24 aa, Mycobacterium
ATDKRARFRAALESGRLQRFPGAF

SEQ ID NO: 761528 - protein, 22 aa, Mycobacterium
ATDLRGGVWGSYADHRMATAGA

SEQ ID NO: 761529 - protein, 21 aa, Mycobacterium
ATDPRAALWVRDDTHAAGLSV

SEQ ID NO: 761530 - protein, 23 aa, Mycobacterium
ATDPVPECLATRATVAAEAAALT

SEQ ID NO: 761531 - protein, 18 aa, Mycobacterium
ATEALAWGLVTEVAESTE

SEQ ID NO: 761532 - protein, 19 aa, Mycobacterium
ATEFNLPFQPVDVITDQYA

SEQ ID NO: 761533 - protein, 21 aa, Mycobacterium
ATEIPMGFGYPIDHPDLQSIT

SEQ ID NO: 761534 - protein, 22 aa, Mycobacterium
ATEIPMGFGYPIDRPDLPAVTE

SEQ ID NO: 761535 - protein, 17 aa, Mycobacterium
ATESALTWAGRCHPGDG

SEQ ID NO: 761536 - protein, 19 aa, Mycobacterium
ATFDLRVTAPLHWKVISNA

SEQ ID NO: 761537 - protein, 20 aa, Mycobacterium
ATFEWAFRWLDAHRPAGSAP

SEQ ID NO: 761538 - protein, 17 aa, Mycobacterium
ATFGVAYLTAWHSLCEV

SEQ ID NO: 761539 - protein, 22 aa, Mycobacterium
ATFNLNRLQAWHMSRNEPDDEE

SEQ ID NO: 761540 - protein, 22 aa, Mycobacterium
ATGARAAFLIRFGTGVLPEPKT

SEQ ID NO: 761541 - protein, 25 aa, Mycobacterium
ATGGFRSGDMSGFFNTAAGGSSYTG

SEQ ID NO: 761542 - protein, 18 aa, Mycobacterium
ATGKPGWFLFDGLVRHDL

SEQ ID NO: 761543 - protein, 18 aa, Mycobacterium
ATGLRLGIVASTWHGKIC

SEQ ID NO: 761544 - protein, 18 aa, Mycobacterium
ATGQFLWQNIFGVWPVTG

SEQ ID NO: 761545 - protein, 18 aa, Mycobacterium
ATGRFLWQNIFGVWPVSG

SEQ ID NO: 761546 - protein, 24 aa, Mycobacterium
ATGRLGLVPLRWALACLLIDLGSV

SEQ ID NO: 761547 - protein, 20 aa, Mycobacterium
ATGRPPRWVRPVVEELGFTP

SEQ ID NO: 761548 - protein, 21 aa, Mycobacterium
ATGRWPGVRFAVRNTAVQGPN

SEQ ID NO: 761549 - protein, 17 aa, Mycobacterium
ATGVPWARACAAALLAV

SEQ ID NO: 761550 - protein, 19 aa, Mycobacterium
ATGWFAGRVIRRFDVGDHV

SEQ ID NO: 761551 - protein, 26 aa, Mycobacterium
ATGYFLTRAAMRWYWAQYVGAQTVFD

SEQ ID NO: 761552 - protein, 18 aa, Mycobacterium
ATIAEVFARDGARVVAID

SEQ ID NO: 761553 - protein, 18 aa, Mycobacterium
ATIAEVFARDGARVVTID

SEQ ID NO: 761554 - protein, 19 aa, Mycobacterium
ATIDRAVAVPAILQNNKQH

SEQ ID NO: 761555 - protein, 20 aa, Mycobacterium
ATIRAEANLARFPEDVARVV

SEQ ID NO: 761556 - protein, 19 aa, Mycobacterium
ATKATRVADGWVVSGQKVW

SEQ ID NO: 761557 - protein, 22 aa, Mycobacterium
ATKGGEVLRHWAAARTALDAWR

SEQ ID NO: 761558 - protein, 25 aa, Mycobacterium
ATLARFAQRFARFHLHPRALRPSYG

SEQ ID NO: 761559 - protein, 17 aa, Mycobacterium
ATLAVSFVRRGEGYRVC

SEQ ID NO: 761560 - protein, 23 aa, Mycobacterium
ATLFPAEVPSFWQIYITVDDVAG

SEQ ID NO: 761561 - protein, 25 aa, Mycobacterium
ATLGRPEVDLGYFLFFDRVYSAGIG

SEQ ID NO: 761562 - protein, 23 aa, Mycobacterium
ATLHIALRLGHNFIGTEHLLLAI

SEQ ID NO: 761563 - protein, 17 aa, Mycobacterium
ATLKPVFNRDGTVTAGN

SEQ ID NO: 761564 - protein, 23 aa, Mycobacterium
ATLLTARCPVMFAPAMHTEMWLH

SEQ ID NO: 761565 - protein, 17 aa, Mycobacterium
ATLPARYAVSVGDKNLI

SEQ ID NO: 761566 - protein, 18 aa, Mycobacterium
ATLPRPPLFLMASSAAVY

SEQ ID NO: 761567 - protein, 22 aa, Mycobacterium
ATLRRFTGRFTRFNLPDKAVRP

SEQ ID NO: 761568 - protein, 24 aa, Mycobacterium
ATLRRFVDRFAHFNFRDHMMRPAY

SEQ ID NO: 761569 - protein, 20 aa, Mycobacterium
ATLRRRGCVVMEPASGRLTG

SEQ ID NO: 761570 - protein, 19 aa, Mycobacterium
ATLRYAGYIGWRGTVALSA

SEQ ID NO: 761571 - protein, 17 aa, Mycobacterium
ATLSFAILARRDSVHSA

SEQ ID NO: 761572 - protein, 17 aa, Mycobacterium
ATLWNFVSELAAHPLPP

SEQ ID NO: 761573 - protein, 18 aa, Mycobacterium
ATMARCFALWAGLIGAVS

SEQ ID NO: 761574 - protein, 22 aa, Mycobacterium
ATNEIRALMALPPGQQPDPSRL

SEQ ID NO: 761575 - protein, 17 aa, Mycobacterium
ATPAGGVAQVWVAAGRA

SEQ ID NO: 761576 - protein, 20 aa, Mycobacterium
ATPAPRYAGTRVQRVEDSRL

SEQ ID NO: 761577 - protein, 23 aa, Mycobacterium
ATPCGVCDSCVALAPNGPGNMDV

SEQ ID NO: 761578 - protein, 24 aa, Mycobacterium
ATPCGVCESCLALAPNAPGSIDVV

SEQ ID NO: 761579 - protein, 17 aa, Mycobacterium
ATPEFGEELLAWLRDRL

SEQ ID NO: 761580 - protein, 20 aa, Mycobacterium
ATPEMFRWWFWWHSFEPERY

SEQ ID NO: 761581 - protein, 21 aa, Mycobacterium
ATPGLRLAAVMAYDGQIAGVG

SEQ ID NO: 761582 - protein, 18 aa, Mycobacterium
ATPIMRWLRDVAGPVDQF

SEQ ID NO: 761583 - protein, 17 aa, Mycobacterium
ATPLKWVRLDSAPFTDR

SEQ ID NO: 761584 - protein, 23 aa, Mycobacterium
ATPLRPGSWRAYADHRMAMAGAI

SEQ ID NO: 761585 - protein, 22 aa, Mycobacterium
ATPRLAAIPGVRIVGTAQEKAS

SEQ ID NO: 761586 - protein, 22 aa, Mycobacterium
ATPRPCWRWKRTVAQTVSSMRR

SEQ ID NO: 761587 - protein, 20 aa, Mycobacterium
ATPRWRWFVAKADVGRHALF

SEQ ID NO: 761588 - protein, 19 aa, Mycobacterium
ATPRYLLDFSRRFPDAAVV

SEQ ID NO: 761589 - protein, 17 aa, Mycobacterium
ATPSFLGYHGFPASICA

SEQ ID NO: 761590 - protein, 25 aa, Mycobacterium
ATPWLAATVSFAWRIRLISSATIDA

SEQ ID NO: 761591 - protein, 22 aa, Mycobacterium
ATQWRLSGLGLRVIAHDPYNPD

SEQ ID NO: 761592 - protein, 25 aa, Mycobacterium
ATRARLLDRFGMFGIRISIAVLKAG

SEQ ID NO: 761593 - protein, 20 aa, Mycobacterium
ATRASCDIDYLFAQVDVESM

SEQ ID NO: 761594 - protein, 17 aa, Mycobacterium
ATRAVVIYLEYVGTTLG

SEQ ID NO: 761595 - protein, 23 aa, Mycobacterium
ATREIWVLLGPDLRGAWVHSNDY

SEQ ID NO: 761596 - protein, 19 aa, Mycobacterium
ATRGPAYWLKYNPYAEWYQ

SEQ ID NO: 761597 - protein, 18 aa, Mycobacterium
ATRLGLDLTHVIMRDNSY

SEQ ID NO: 761598 - protein, 18 aa, Mycobacterium
ATRRWELRASQGRPICGV

SEQ ID NO: 761599 - protein, 18 aa, Mycobacterium
ATRRWEMRASQGRPICGV

SEQ ID NO: 761600 - protein, 22 aa, Mycobacterium
ATRSGLVPLQWAVACLLADIGS

SEQ ID NO: 761601 - protein, 24 aa, Mycobacterium
ATSDPRSACFYSRRTVELLVDYLY

SEQ ID NO: 761602 - protein, 17 aa, Mycobacterium
ATSEGWSGLPIIANYAD

SEQ ID NO: 761603 - protein, 19 aa, Mycobacterium
ATSHWLTLPALKAFGAIPV

SEQ ID NO: 761604 - protein, 20 aa, Mycobacterium
ATSISRSWCPPRPRPPAAGW

SEQ ID NO: 761605 - protein, 27 aa, Mycobacterium
ATSIWPHGRWRLAFRGEANHAGTTRLV

SEQ ID NO: 761606 - protein, 23 aa, Mycobacterium
ATSRELPWRRPIASLNYLLSSHV

SEQ ID NO: 761607 - protein, 17 aa, Mycobacterium
ATSVCWWLLDGKPGFQL

SEQ ID NO: 761608 - protein, 18 aa, Mycobacterium
ATTAEAFRGGWFHTGDLG

SEQ ID NO: 761609 - protein, 17 aa, Mycobacterium
ATTCFWKDNQINIIDTP

SEQ ID NO: 761610 - protein, 24 aa, Mycobacterium
ATTCGRPFADFELRIDASDSGAAG

SEQ ID NO: 761611 - protein, 24 aa, Mycobacterium
ATTCGRPFADFELRIDSGESGESG

SEQ ID NO: 761612 - protein, 19 aa, Mycobacterium
ATTCGRPFAGFELRIDAET

SEQ ID NO: 761613 - protein, 23 aa, Mycobacterium
ATTEGWPGFADRLLELARAAEAG

SEQ ID NO: 761614 - protein, 24 aa, Mycobacterium
ATTGARVPLCFGFHPYLQLPGVPR

SEQ ID NO: 761615 - protein, 18 aa, Mycobacterium
ATTGFGWSRPGRSALAGN

SEQ ID NO: 761616 - protein, 17 aa, Mycobacterium
ATTLHEWQPRDGVRYGA

SEQ ID NO: 761617 - protein, 18 aa, Mycobacterium
ATTMARFPMCERCAAEYH

SEQ ID NO: 761618 - protein, 24 aa, Mycobacterium
ATTRFGRPVAHGMLVAGYVQTALT

SEQ ID NO: 761619 - protein, 18 aa, Mycobacterium
ATVAHAWSALLRAALRTA

SEQ ID NO: 761620 - protein, 19 aa, Mycobacterium
ATVKAGLGGAVEPVSASAA

SEQ ID NO: 761621 - protein, 19 aa, Mycobacterium
ATVKILVCEPQWVTDGYVD

SEQ ID NO: 761622 - protein, 18 aa, Mycobacterium
ATVPMRWRGTRWVLLGHD

SEQ ID NO: 761623 - protein, 17 aa, Mycobacterium
ATVRGGGLATVLSTARP

SEQ ID NO: 761624 - protein, 25 aa, Mycobacterium
ATVTDLRWLRERGLAAGIAAHAAAG

SEQ ID NO: 761625 - protein, 21 aa, Mycobacterium
ATWCGPCRMVSPALEQLAAER

SEQ ID NO: 761626 - protein, 22 aa, Mycobacterium
ATWRLNAAMWRAGFPPRLIHST

SEQ ID NO: 761627 - protein, 17 aa, Mycobacterium
ATWSRWGQTLFPIGVLY

SEQ ID NO: 761628 - protein, 17 aa, Mycobacterium
ATYFSGAKLQWILENVD

SEQ ID NO: 761629 - protein, 17 aa, Mycobacterium
ATYFSGGKLQWILENVE

SEQ ID NO: 761630 - protein, 17 aa, Mycobacterium
ATYFSGGKLQWLLENVD

SEQ ID NO: 761631 - protein, 17 aa, Mycobacterium
ATYFSGPKLRWLLDNDR

SEQ ID NO: 761632 - protein, 24 aa, Mycobacterium
AVAAKRGWPILKFSSRSGASPASQ

SEQ ID NO: 761633 - protein, 24 aa, Mycobacterium
AVAALKPRRIAVLSVHTSPLAQPG

SEQ ID NO: 761634 - protein, 25 aa, Mycobacterium
AVAARPGLTLGRARYAVHAAFALAV

SEQ ID NO: 761635 - protein, 17 aa, Mycobacterium
AVAASDLERLGSTISAA

SEQ ID NO: 761636 - protein, 18 aa, Mycobacterium
AVAAVLGMRCHLVQERWV

SEQ ID NO: 761637 - protein, 19 aa, Mycobacterium
AVACARAAYLAGFESTSNL

SEQ ID NO: 761638 - protein, 20 aa, Mycobacterium
AVACLRKTDWLFPQYRELGA

SEQ ID NO: 761639 - protein, 17 aa, Mycobacterium
AVADLFAAFGMFAVGFY

SEQ ID NO: 761640 - protein, 17 aa, Mycobacterium
AVADMMLYLSWSMAGRG

SEQ ID NO: 761641 - protein, 22 aa, Mycobacterium
AVADWLYWRYVAGLLANALADA

SEQ ID NO: 761642 - protein, 17 aa, Mycobacterium
AVAFPGLELAAVITSSQ

SEQ ID NO: 761643 - protein, 18 aa, Mycobacterium
AVAFQVGEAFGRREGAKL

SEQ ID NO: 761644 - protein, 21 aa, Mycobacterium
AVAGGRLGGFVIPGLSIGNRG

SEQ ID NO: 761645 - protein, 24 aa, Mycobacterium
AVAGIRFALSLGFRVRVAATVAAP

SEQ ID NO: 761646 - protein, 17 aa, Mycobacterium
AVAGRFGIDYRFSEAAK

SEQ ID NO: 761647 - protein, 18 aa, Mycobacterium
AVAGWRGAPRPVLARELL

SEQ ID NO: 761648 - protein, 19 aa, Mycobacterium
AVAGWRGAPRPVLARELLP

SEQ ID NO: 761649 - protein, 21 aa, Mycobacterium
AVAHPSRWALLYGSPVPGYHA

SEQ ID NO: 761650 - protein, 20 aa, Mycobacterium
AVAIKDGRIVAVGACDDVVQ

SEQ ID NO: 761651 - protein, 18 aa, Mycobacterium
AVAKARFVRVSPRKARRV

SEQ ID NO: 761652 - protein, 17 aa, Mycobacterium
AVAKARFVRVSPTKARR

SEQ ID NO: 761653 - protein, 23 aa, Mycobacterium
AVAKRRGWPILKFNSRGGVGLRR

SEQ ID NO: 761654 - protein, 17 aa, Mycobacterium
AVALAWLRARPGTVVPI

SEQ ID NO: 761655 - protein, 24 aa, Mycobacterium
AVALGIAGLAAWLPLTRHADVSAG

SEQ ID NO: 761656 - protein, 20 aa, Mycobacterium
AVALQARWGDGWVKLVGDWI

SEQ ID NO: 761657 - protein, 18 aa, Mycobacterium
AVALRLAAYELLRVEGSD

SEQ ID NO: 761658 - protein, 20 aa, Mycobacterium
AVAPRLFWRRKYRLLQRLGK

SEQ ID NO: 761659 - protein, 21 aa, Mycobacterium
AVARLRPDVVFIVSPNNPTGQ

SEQ ID NO: 761660 - protein, 23 aa, Mycobacterium
AVARVVDHWAMFESIRFDLNLVI

SEQ ID NO: 761661 - protein, 18 aa, Mycobacterium
AVAVCRRAGIPVIADGGL

SEQ ID NO: 761662 - protein, 19 aa, Mycobacterium
AVCDLEPYWEALRKVYAPF

SEQ ID NO: 761663 - protein, 19 aa, Mycobacterium
AVCPLQCRLRRGAAADDQP

SEQ ID NO: 761664 - protein, 23 aa, Mycobacterium
AVDAWARLAAEPRFPLDAVDSLH

SEQ ID NO: 761665 - protein, 17 aa, Mycobacterium
AVDDVWAATQWVAAHAE

SEQ ID NO: 761666 - protein, 20 aa, Mycobacterium
AVDEMIRWVTPVKEFMRTAT

SEQ ID NO: 761667 - protein, 26 aa, Mycobacterium
AVDEVSIQIAALFGAHAHSYQQLSAQ

SEQ ID NO: 761668 - protein, 27 aa, Mycobacterium
AVDLSGTSCGLICNGQDGTGQNGGILF

SEQ ID NO: 761669 - protein, 24 aa, Mycobacterium
AVDRAVLRVAVWELLHAVDVPEPV

SEQ ID NO: 761670 - protein, 17 aa, Mycobacterium
AVDVALFAIQQVVEPTS

SEQ ID NO: 761671 - protein, 20 aa, Mycobacterium
AVDVLWFFFGYTGFFTLLDD

SEQ ID NO: 761672 - protein, 19 aa, Mycobacterium
AVEAEYEQMWALDVSTMAT

SEQ ID NO: 761673 - protein, 18 aa, Mycobacterium
AVECGLRAMGVRAGGLVV

SEQ ID NO: 761674 - protein, 19 aa, Mycobacterium
AVELARSGAKVAISDVDLE

SEQ ID NO: 761675 - protein, 19 aa, Mycobacterium
AVELGRAGAKVAISDVDTA

SEQ ID NO: 761676 - protein, 25 aa, Mycobacterium
AVETTARVVLRFDLRKGAAAAQDSP

SEQ ID NO: 761677 - protein, 17 aa, Mycobacterium
AVEVPRPEFGVIRAAKV

SEQ ID NO: 761678 - protein, 19 aa, Mycobacterium
AVFCRAVIVGPPLELVLDV

SEQ ID NO: 761679 - protein, 17 aa, Mycobacterium
AVFRSRHLLLSAWIKMQ

SEQ ID NO: 761680 - protein, 18 aa, Mycobacterium
AVFTPGLAGLVLGEYRRI

SEQ ID NO: 761681 - protein, 23 aa, Mycobacterium
AVFTRYELVEGFPKFDVDDVYLG

SEQ ID NO: 761682 - protein, 18 aa, Mycobacterium
AVFTRYELVEGFPRFDID

SEQ ID NO: 761683 - protein, 19 aa, Mycobacterium
AVGAKTLWLQLGLRHDEVV

SEQ ID NO: 761684 - protein, 18 aa, Mycobacterium
AVGARRGAAVNARATGPT

SEQ ID NO: 761685 - protein, 25 aa, Mycobacterium
AVGDRLPLGAGFSFEAAQLLTAATP

SEQ ID NO: 761686 - protein, 18 aa, Mycobacterium
AVGFAEWLAITYGDDGVG

SEQ ID NO: 761687 - protein, 17 aa, Mycobacterium
AVGFAEWLSITYGGQGV

SEQ ID NO: 761688 - protein, 20 aa, Mycobacterium
AVGIAAYHCGDWAQALAELR

SEQ ID NO: 761689 - protein, 24 aa, Mycobacterium
AVGIAAYHCGDWAQALAELRAARR

SEQ ID NO: 761690 - protein, 20 aa, Mycobacterium
AVGIAAYHCGDWAQALSELR

SEQ ID NO: 761691 - protein, 20 aa, Mycobacterium
AVGIAAYHCGDWSQALAEFR

SEQ ID NO: 761692 - protein, 19 aa, Mycobacterium
AVGIAAYRCGDWAQALAEL

SEQ ID NO: 761693 - protein, 22 aa, Mycobacterium
AVGKRLYERFGIDEKPTASDDG

SEQ ID NO: 761694 - protein, 22 aa, Mycobacterium
AVGLARRWPLGRAVRFGIAAAS

SEQ ID NO: 761695 - protein, 20 aa, Mycobacterium
AVGPLQFDPKFSRSPVLASP

SEQ ID NO: 761696 - protein, 19 aa, Mycobacterium
AVGPLWRIAVLRLTEQQCR

SEQ ID NO: 761697 - protein, 22 aa, Mycobacterium
AVGPRCRRVWLVTMCGEQVDAR

SEQ ID NO: 761698 - protein, 20 aa, Mycobacterium
AVGPRLPWIPGLPPGMATWT

SEQ ID NO: 761699 - protein, 17 aa, Mycobacterium
AVGVPVREVAKFMGHAT

SEQ ID NO: 761700 - protein, 19 aa, Mycobacterium
AVHGFPNYFFISGPDNANA

SEQ ID NO: 761701 - protein, 19 aa, Mycobacterium
AVICARAGLKVNVIEAQPT

SEQ ID NO: 761702 - protein, 19 aa, Mycobacterium
AVICCPAFGAAGLVGKFNW

SEQ ID NO: 761703 - protein, 18 aa, Mycobacterium
AVIEAGVAQGVFRGVDVD

SEQ ID NO: 761704 - protein, 23 aa, Mycobacterium
AVIGKERFAEFLAGFHIVDEHFR

SEQ ID NO: 761705 - protein, 20 aa, Mycobacterium
AVIGRPCKDVSAAEAADSIL

SEQ ID NO: 761706 - protein, 25 aa, Mycobacterium
AVIKRFPIGVLLGIMPWNFPYYQVA

SEQ ID NO: 761707 - protein, 18 aa, Mycobacterium
AVILDHWGIIKADIGIRD

SEQ ID NO: 761708 - protein, 18 aa, Mycobacterium
AVINRLPVRYTFDNRYFN

SEQ ID NO: 761709 - protein, 19 aa, Mycobacterium
AVKARSAAMISLKTVIVNA

SEQ ID NO: 761710 - protein, 24 aa, Mycobacterium
AVKARWQTPASAVFSGEFDGLESD

SEQ ID NO: 761711 - protein, 23 aa, Mycobacterium
AVKLLPVWRHWISAALPHIRGPR

SEQ ID NO: 761712 - protein, 27 aa, Mycobacterium
AVKLWEHWDRCALHWFPGSHVLHVSQL

SEQ ID NO: 761713 - protein, 25 aa, Mycobacterium
AVKMPSQRGWRHWLYVTTRINLGLS

SEQ ID NO: 761714 - protein, 23 aa, Mycobacterium
AVKVRGGTVLAEFATLVDPQRSI

SEQ ID NO: 761715 - protein, 17 aa, Mycobacterium
AVLADWGADVVKIEHPV

SEQ ID NO: 761716 - protein, 17 aa, Mycobacterium
AVLAEWGAEVIKVEPRE

SEQ ID NO: 761717 - protein, 18 aa, Mycobacterium
AVLDRLAAYRARIVDIDG

SEQ ID NO: 761718 - protein, 18 aa, Mycobacterium
AVLDRLAAYRARTVDIDG

SEQ ID NO: 761719 - protein, 17 aa, Mycobacterium
AVLECREALAVNVKPKF

SEQ ID NO: 761720 - protein, 17 aa, Mycobacterium
AVLERLAAYEARSVDID

SEQ ID NO: 761721 - protein, 17 aa, Mycobacterium
AVLLCLGARGLKHSTQG

SEQ ID NO: 761722 - protein, 20 aa, Mycobacterium
AVLLQLRWWCLEGRHDPVDE

SEQ ID NO: 761723 - protein, 23 aa, Mycobacterium
AVLLRECIDFFAPYLAAAKLTGE

SEQ ID NO: 761724 - protein, 17 aa, Mycobacterium
AVLPCYWIYAEVGAALA

SEQ ID NO: 761725 - protein, 17 aa, Mycobacterium
AVLPDYMVPGAFAVIRE

SEQ ID NO: 761726 - protein, 18 aa, Mycobacterium
AVLPERWREIARPRANSA

SEQ ID NO: 761727 - protein, 19 aa, Mycobacterium
AVLPLSFAQSRLWFIDQLH

SEQ ID NO: 761728 - protein, 19 aa, Mycobacterium
AVLRFHYQLARFPLQLIED

SEQ ID NO: 761729 - protein, 23 aa, Mycobacterium
AVLRLHYQLARFPLQLIEDRVVT

SEQ ID NO: 761730 - protein, 19 aa, Mycobacterium
AVLRLQYRIARTPLQLFES

SEQ ID NO: 761731 - protein, 18 aa, Mycobacterium
AVLRPHRPGFGNVERPAA

SEQ ID NO: 761732 - protein, 17 aa, Mycobacterium
AVLRWVAADARQLGVDP

SEQ ID NO: 761733 - protein, 17 aa, Mycobacterium
AVLSHFVAQIDAEESAD

SEQ ID NO: 761734 - protein, 18 aa, Mycobacterium
AVLTGWRMLLDNGRMQDG

SEQ ID NO: 761735 - protein, 25 aa, Mycobacterium
AVLTRLRGMFAFALWDTATLELFCA

SEQ ID NO: 761736 - protein, 18 aa, Mycobacterium
AVLVVRELLRRCAIEVAC

SEQ ID NO: 761737 - protein, 17 aa, Mycobacterium
AVLWRYALRLTGDASQA

SEQ ID NO: 761738 - protein, 17 aa, Mycobacterium
AVLWRYALRLTGDTSQS

SEQ ID NO: 761739 - protein, 20 aa, Mycobacterium
AVMAARWNKVLGAWPITASF

SEQ ID NO: 761740 - protein, 18 aa, Mycobacterium
AVNAVRWAAAEALAREVC

SEQ ID NO: 761741 - protein, 20 aa, Mycobacterium
AVNFPLYVIMSLLGIPESDF

SEQ ID NO: 761742 - protein, 25 aa, Mycobacterium
AVNGHVRAGGFGLVGAADIAVAGPD

SEQ ID NO: 761743 - protein, 24 aa, Mycobacterium
AVNGHVRAGGFGLVGACDIVVAGP

SEQ ID NO: 761744 - protein, 27 aa, Mycobacterium
AVNLASRFSYWIPFSIPVLAPALMRRG

SEQ ID NO: 761745 - protein, 20 aa, Mycobacterium
AVNVPARLVSVYAPGCQPMD

SEQ ID NO: 761746 - protein, 17 aa, Mycobacterium
AVPAARYYIDYSDFTLW

SEQ ID NO: 761747 - protein, 17 aa, Mycobacterium
AVPARFSGVRVYGDVTE

SEQ ID NO: 761748 - protein, 17 aa, Mycobacterium
AVPDRFSLMHGDYRLDN

SEQ ID NO: 761749 - protein, 19 aa, Mycobacterium
AVPFSAYLFYKWAAHPGAE

SEQ ID NO: 761750 - protein, 18 aa, Mycobacterium
AVPGHTPGSIALYLPAAD

SEQ ID NO: 761751 - protein, 18 aa, Mycobacterium
AVPLEWRRLLHGWPDMTA

SEQ ID NO: 761752 - protein, 25 aa, Mycobacterium
AVPRHGWINLHFSLLPAWRGAAPVQ

SEQ ID NO: 761753 - protein, 23 aa, Mycobacterium
AVQAWRGFSRWLMRAYDVLVDED

SEQ ID NO: 761754 - protein, 19 aa, Mycobacterium
AVQRIMFRDGLVLNFEDYN

SEQ ID NO: 761755 - protein, 23 aa, Mycobacterium
AVRAWRSFSCWLMRAYDILVDED

SEQ ID NO: 761756 - protein, 23 aa, Mycobacterium
AVRAWRSFSCWLMRAYDVLVDED

SEQ ID NO: 761757 - protein, 19 aa, Mycobacterium
AVRDWPKPLGFVWGLADPV

SEQ ID NO: 761758 - protein, 23 aa, Mycobacterium
AVRDWPKPLGFVWGLDDPVATTN

SEQ ID NO: 761759 - protein, 23 aa, Mycobacterium
AVREYRLALVLADTAIPAYLSAP

SEQ ID NO: 761760 - protein, 23 aa, Mycobacterium
AVRFPVWSGRCGFAVQEFARRHG

SEQ ID NO: 761761 - protein, 19 aa, Mycobacterium
AVRGFPGFIDAGGAVDLRV

SEQ ID NO: 761762 - protein, 24 aa, Mycobacterium
AVRGTEVFWAVAFHGPEQLTLIVT

SEQ ID NO: 761763 - protein, 20 aa, Mycobacterium
AVRILERFPSRLALPKAHVV

SEQ ID NO: 761764 - protein, 20 aa, Mycobacterium
AVRKECLRRRGLIAESGVRP

SEQ ID NO: 761765 - protein, 18 aa, Mycobacterium
AVRLGLRKELEAIADESA

SEQ ID NO: 761766 - protein, 20 aa, Mycobacterium
AVRMDLGLRMGRFHQTYDLL

SEQ ID NO: 761767 - protein, 24 aa, Mycobacterium
AVRPEPFGALLYHFGTRKLSFLKN

SEQ ID NO: 761768 - protein, 17 aa, Mycobacterium
AVRPEWPQLVDAIAEVR

SEQ ID NO: 761769 - protein, 17 aa, Mycobacterium
AVRREWPLLVQAIAEVC

SEQ ID NO: 761770 - protein, 18 aa, Mycobacterium
AVRRLRDAGAIILGKATT

SEQ ID NO: 761771 - protein, 19 aa, Mycobacterium
AVRRRIWELEIGRAHTPWF

SEQ ID NO: 761772 - protein, 23 aa, Mycobacterium
AVRYEAWSFPDFETGAAALRAVT

SEQ ID NO: 761773 - protein, 19 aa, Mycobacterium
AVSCPLLVWVKTRDPKAYA

SEQ ID NO: 761774 - protein, 21 aa, Mycobacterium
AVSCYWDYAPSFGRGPFRNVI

SEQ ID NO: 761775 - protein, 17 aa, Mycobacterium
AVSFRFGDRTQINGVPR

SEQ ID NO: 761776 - protein, 22 aa, Mycobacterium
AVSGRVAYAFGFEGPAVTVDTA

SEQ ID NO: 761777 - protein, 19 aa, Mycobacterium
AVSGWAAKQPTVWWNEGTD

SEQ ID NO: 761778 - protein, 17 aa, Mycobacterium
AVSPWWLQRRLMLCGIR

SEQ ID NO: 761779 - protein, 19 aa, Mycobacterium
AVSSNGLWVGPFQQDTSYP

SEQ ID NO: 761780 - protein, 19 aa, Mycobacterium
AVSVPARLVSVYAPGVNPM

SEQ ID NO: 761781 - protein, 19 aa, Mycobacterium
AVTEGMWGIPWDKPVRRLN

SEQ ID NO: 761782 - protein, 18 aa, Mycobacterium
AVTLPLHWTADGLPLGVQ

SEQ ID NO: 761783 - protein, 25 aa, Mycobacterium
AVTTFIAGVFLRFVAGDQTFNDPDK

SEQ ID NO: 761784 - protein, 18 aa, Mycobacterium
AVTTRLRLGVAVLVTSLH

SEQ ID NO: 761785 - protein, 17 aa, Mycobacterium
AVTVVWQRGELLQVNEI

SEQ ID NO: 761786 - protein, 25 aa, Mycobacterium
AVVDLCSRFLPAMVERGRGAVLNVA

SEQ ID NO: 761787 - protein, 17 aa, Mycobacterium
AVVGRPVAEYGFEPMRF

SEQ ID NO: 761788 - protein, 17 aa, Mycobacterium
AVVGRPVAEYGFEPVRF

SEQ ID NO: 761789 - protein, 19 aa, Mycobacterium
AVVLLMWAGILAYLDRCDY

SEQ ID NO: 761790 - protein, 19 aa, Mycobacterium
AVVLRATWALARVLAEQPG

SEQ ID NO: 761791 - protein, 18 aa, Mycobacterium
AVVLRATWAVARVLAEQT

SEQ ID NO: 761792 - protein, 18 aa, Mycobacterium
AVVPLSFAQSRLWFTGQL

SEQ ID NO: 761793 - protein, 17 aa, Mycobacterium
AVVRPRGSWRSFDVVAE

SEQ ID NO: 761794 - protein, 17 aa, Mycobacterium
AVVRWRHIHEFDDTGDG

SEQ ID NO: 761795 - protein, 19 aa, Mycobacterium
AVWRGKWHGGLSFTGKCVA

SEQ ID NO: 761796 - protein, 19 aa, Mycobacterium
AVYRAELALVEVARKTGIR

SEQ ID NO: 761797 - protein, 21 aa, Mycobacterium
AVYRLAWARLHGCPTSAVRAA

SEQ ID NO: 761798 - protein, 24 aa, Mycobacterium
AVYRMAWAALRGCPESSVRTAFHY

SEQ ID NO: 761799 - protein, 18 aa, Mycobacterium
AWAFDKRPTLGFDTKAAE

SEQ ID NO: 761800 - protein, 17 aa, Mycobacterium
AWAGLKPPELAAVVSAV

SEQ ID NO: 761801 - protein, 17 aa, Mycobacterium
AWAGLKPPELAAVVSCV

SEQ ID NO: 761802 - protein, 26 aa, Mycobacterium
AWASYRWCAFYGFMLSIPMAVQLERS

SEQ ID NO: 761803 - protein, 21 aa, Mycobacterium
AWDGVRPCHRFRYCAPQPRRY

SEQ ID NO: 761804 - protein, 21 aa, Mycobacterium
AWDLGIRCCADIFEQLGGALE

SEQ ID NO: 761805 - protein, 23 aa, Mycobacterium
AWEALQIPVGVAFFFTNSALGRT

SEQ ID NO: 761806 - protein, 23 aa, Mycobacterium
AWEHGRFGAPYLRDSLLAAGALC

SEQ ID NO: 761807 - protein, 17 aa, Mycobacterium
AWELMGMRVHLQVSHIL

SEQ ID NO: 761808 - protein, 23 aa, Mycobacterium
AWERGRFGAPYLRDSLLAAGALC

SEQ ID NO: 761809 - protein, 19 aa, Mycobacterium
AWESKPSWQIRTLQDLALP

SEQ ID NO: 761810 - protein, 18 aa, Mycobacterium
AWEYVWPVSRWQRYLRAQ

SEQ ID NO: 761811 - protein, 17 aa, Mycobacterium
AWIEDWRLPAAPPGAVK

SEQ ID NO: 761812 - protein, 18 aa, Mycobacterium
AWLDRAWARIREEVAAGR

SEQ ID NO: 761813 - protein, 18 aa, Mycobacterium
AWLISVGADGEWPLFLDV

SEQ ID NO: 761814 - protein, 17 aa, Mycobacterium
AWLKLVRPLVITEGFAL

SEQ ID NO: 761815 - protein, 19 aa, Mycobacterium
AWLRARPGTVVPIIGARRM

SEQ ID NO: 761816 - protein, 17 aa, Mycobacterium
AWPHTGWYAEWVSGQDI

SEQ ID NO: 761817 - protein, 18 aa, Mycobacterium
AWPLHRRFGIAATARASF

SEQ ID NO: 761818 - protein, 20 aa, Mycobacterium
AWPPRMFSLLAGFVEAGESF

SEQ ID NO: 761819 - protein, 19 aa, Mycobacterium
AWPRFGLELPELLPEKLSG

SEQ ID NO: 761820 - protein, 19 aa, Mycobacterium
AWPRWASVITKVTWTSPEP

SEQ ID NO: 761821 - protein, 21 aa, Mycobacterium
AWPVLRRNLSVLALRGADPRE

SEQ ID NO: 761822 - protein, 19 aa, Mycobacterium
AWQPTWLKWSVSIIGKGAL

SEQ ID NO: 761823 - protein, 18 aa, Mycobacterium
AWRASQVEMITWLGELYG

SEQ ID NO: 761824 - protein, 19 aa, Mycobacterium
AWRAWLQMRVRIVDEYNRI

SEQ ID NO: 761825 - protein, 22 aa, Mycobacterium
AWRGELPPALALQIVERHGYDI

SEQ ID NO: 761826 - protein, 23 aa, Mycobacterium
AWRKALEGFEAPTLVAPRSVPGS

SEQ ID NO: 761827 - protein, 21 aa, Mycobacterium
AWRRRPCWYLIATEDRMIPLA

SEQ ID NO: 761828 - protein, 21 aa, Mycobacterium
AWRVNCLGAFLGMRAALGALS

SEQ ID NO: 761829 - protein, 17 aa, Mycobacterium
AWSGLKPAELAAVVSSV

SEQ ID NO: 761830 - protein, 21 aa, Mycobacterium
AWSPVALRLAEWLQKAEASLA

SEQ ID NO: 761831 - protein, 18 aa, Mycobacterium
AWTNRPGTEYVWFNNVET

SEQ ID NO: 761832 - protein, 21 aa, Mycobacterium
AWTPPRFGHVLVFRTPDPPSA

SEQ ID NO: 761833 - protein, 19 aa, Mycobacterium
AWVDLRSGPTFGTVFTAEI

SEQ ID NO: 761834 - protein, 20 aa, Mycobacterium
AWVNGLLCGPGMPTIAALDF

SEQ ID NO: 761835 - protein, 18 aa, Mycobacterium
AWWFPAFAPLPGGEPTVM

SEQ ID NO: 761836 - protein, 19 aa, Mycobacterium
AWWHERWRLINVLRKRDRI

SEQ ID NO: 761837 - protein, 17 aa, Mycobacterium
AYAAPSFVAGRPLIEVL

SEQ ID NO: 761838 - protein, 22 aa, Mycobacterium
AYAELRPDAWLSETVRAEMVRL

SEQ ID NO: 761839 - protein, 25 aa, Mycobacterium
AYAKRFGYNVVRAFTGHGVGPTFHN

SEQ ID NO: 761840 - protein, 20 aa, Mycobacterium
AYAPRLWRYWAQHLDPDRAR

SEQ ID NO: 761841 - protein, 24 aa, Mycobacterium
AYASRSAGCAPDWAPLPVQYVDYT

SEQ ID NO: 761842 - protein, 18 aa, Mycobacterium
AYATVLIREANYSQAHEL

SEQ ID NO: 761843 - protein, 17 aa, Mycobacterium
AYCSAKFAVRGFTDALR

SEQ ID NO: 761844 - protein, 21 aa, Mycobacterium
AYDIPGAWLARGGVPVYERAV

SEQ ID NO: 761845 - protein, 20 aa, Mycobacterium
AYDLLEEWDTLVLVDAVPSR

SEQ ID NO: 761846 - protein, 18 aa, Mycobacterium
AYDWLTWRVTKGAEDAQR

SEQ ID NO: 761847 - protein, 26 aa, Mycobacterium
AYEDLAWFCVRAWRFGAPASLGAGGL

SEQ ID NO: 761848 - protein, 17 aa, Mycobacterium
AYEGYRVLPYCWRDETP

SEQ ID NO: 761849 - protein, 24 aa, Mycobacterium
AYERRSLAIGSHWPFEQWGRFLPE

SEQ ID NO: 761850 - protein, 25 aa, Mycobacterium
AYERRSLAIGSHWPFEQWGRFLPEQ

SEQ ID NO: 761851 - protein, 31 aa, Mycobacterium
AYERRSLAIGSHWPFQEWGRFLPEQTTAVSI

SEQ ID NO: 761852 - protein, 20 aa, Mycobacterium
AYFPLGWPIACHVQGDAGVD

SEQ ID NO: 761853 - protein, 23 aa, Mycobacterium
AYFPLGWPMACHVMGDAGVDTIL

SEQ ID NO: 761854 - protein, 23 aa, Mycobacterium
AYFPRGIKPVSVWLSHEYVRASP

SEQ ID NO: 761855 - protein, 17 aa, Mycobacterium
AYFSHAWLRQAAGVGEM

SEQ ID NO: 761856 - protein, 19 aa, Mycobacterium
AYGSFEWGMFKAHAFVTRE

SEQ ID NO: 761857 - protein, 18 aa, Mycobacterium
AYHAFTFGWLLSGLARSV

SEQ ID NO: 761858 - protein, 19 aa, Mycobacterium
AYHCGDWAQALAELRAARR

SEQ ID NO: 761859 - protein, 19 aa, Mycobacterium
AYHCGDWAQALSELRAARR

SEQ ID NO: 761860 - protein, 17 aa, Mycobacterium
AYHLIKYHARIAINQTQ

SEQ ID NO: 761861 - protein, 17 aa, Mycobacterium
AYIARFAREANISHKDV

SEQ ID NO: 761862 - protein, 21 aa, Mycobacterium
AYIPGMCDYVVMVRNRSKVFL

SEQ ID NO: 761863 - protein, 22 aa, Mycobacterium
AYIQPRFPGAVPQGLFTPEQFW

SEQ ID NO: 761864 - protein, 18 aa, Mycobacterium
AYLARAGQRVMLLERLDV

SEQ ID NO: 761865 - protein, 18 aa, Mycobacterium
AYLARLVTRQALNTLRAQ

SEQ ID NO: 761866 - protein, 18 aa, Mycobacterium
AYLFYKWAAHPGAEPDGW

SEQ ID NO: 761867 - protein, 23 aa, Mycobacterium
AYLGHVIVLWSWALKQPNEASPG

SEQ ID NO: 761868 - protein, 18 aa, Mycobacterium
AYLPLGWQMACHVQGDAG

SEQ ID NO: 761869 - protein, 17 aa, Mycobacterium
AYLPRYRLAGADIGLRR

SEQ ID NO: 761870 - protein, 22 aa, Mycobacterium
AYLRATFDWHIDGCTPIGDECP

SEQ ID NO: 761871 - protein, 22 aa, Mycobacterium
AYLRPRAVIFHRSLGAKFADVL

SEQ ID NO: 761872 - protein, 23 aa, Mycobacterium
AYMLEILPALGFLHSVGLTYNDL

SEQ ID NO: 761873 - protein, 18 aa, Mycobacterium
AYNALPLRRAVHAVFECC

SEQ ID NO: 761874 - protein, 19 aa, Mycobacterium
AYNHAGDWEHMMKIWEGVM

SEQ ID NO: 761875 - protein, 18 aa, Mycobacterium
AYPLLKRGIRINAICPGP

SEQ ID NO: 761876 - protein, 19 aa, Mycobacterium
AYPRLQFSPLHSWVTDEDF

SEQ ID NO: 761877 - protein, 18 aa, Mycobacterium
AYQPGWRVTGLTSRSAVS

SEQ ID NO: 761878 - protein, 22 aa, Mycobacterium
AYRAAWREAVRVFGRNQVSTYL

SEQ ID NO: 761879 - protein, 20 aa, Mycobacterium
AYRCGESWSTLVAHRPTGRR

SEQ ID NO: 761880 - protein, 18 aa, Mycobacterium
AYRGHIFWDELFIFPVLN

SEQ ID NO: 761881 - protein, 17 aa, Mycobacterium
AYRGHIFWDELFVAPVV

SEQ ID NO: 761882 - protein, 18 aa, Mycobacterium
AYRLAWPAGTIVYEIDQP

SEQ ID NO: 761883 - protein, 18 aa, Mycobacterium
AYRLGRSVARLEASLSAP

SEQ ID NO: 761884 - protein, 19 aa, Mycobacterium
AYRLRWPAGTVVYEIDQPQ

SEQ ID NO: 761885 - protein, 18 aa, Mycobacterium
AYRLTWPAGTTVYELDQP

SEQ ID NO: 761886 - protein, 20 aa, Mycobacterium
AYRPLRRCIQVVYQNPYSSF

SEQ ID NO: 761887 - protein, 18 aa, Mycobacterium
AYRREVLEAIDLDGVDSK

SEQ ID NO: 761888 - protein, 22 aa, Mycobacterium
AYRREVLEAIGLEAVDSKGYCF

SEQ ID NO: 761889 - protein, 21 aa, Mycobacterium
AYRRPWRACDPIVLFSALSQV

SEQ ID NO: 761890 - protein, 18 aa, Mycobacterium
AYRVLRAWLHTLRDRLTV

SEQ ID NO: 761891 - protein, 18 aa, Mycobacterium
AYSEQWDKWHNGAGQVIR

SEQ ID NO: 761892 - protein, 25 aa, Mycobacterium
AYSHCIAHGFELRYGLDQQYRAVAS

SEQ ID NO: 761893 - protein, 24 aa, Mycobacterium
AYSHCIAHGFELRYGLEQQYRAVA

SEQ ID NO: 761894 - protein, 18 aa, Mycobacterium
AYSPRFLWMWPNARISVM

SEQ ID NO: 761895 - protein, 28 aa, Mycobacterium
AYSPRLRPGLPVSFPVDWSELDRVTPSD

SEQ ID NO: 761896 - protein, 23 aa, Mycobacterium
AYTKLKSFGGWLQALAGKWNQLA

SEQ ID NO: 761897 - protein, 24 aa, Mycobacterium
AYTQLPFKLAWAITIHKSQGQTLE

SEQ ID NO: 761898 - protein, 17 aa, Mycobacterium
AYTRGRFASAFGPDAAL

SEQ ID NO: 761899 - protein, 24 aa, Mycobacterium
AYVDPRWVRWLPLLPLDRSLSVSI

SEQ ID NO: 761900 - protein, 19 aa, Mycobacterium
AYVPKHWAKLCQLIGRPDL

SEQ ID NO: 761901 - protein, 17 aa, Mycobacterium
AYWWKIKGGKLIHLPAP

SEQ ID NO: 761902 - protein, 19 aa, Mycobacterium
AYWYRAVLWNVLMSADQTL

SEQ ID NO: 761903 - protein, 19 aa, Mycobacterium
CAAALPHLVARGGGSLVNI

SEQ ID NO: 761904 - protein, 24 aa, Mycobacterium
CAADLRGPVLIGVRPEGWRLTAPD

SEQ ID NO: 761905 - protein, 17 aa, Mycobacterium
CAADPGWAYGLYTAIAA

SEQ ID NO: 761906 - protein, 17 aa, Mycobacterium
CAAEAQLAFGNPAVFAE

SEQ ID NO: 761907 - protein, 21 aa, Mycobacterium
CAAGPRLPLAMARNLGADAAL

SEQ ID NO: 761908 - protein, 19 aa, Mycobacterium
CAAHSAAIRRCYDDCRSGP

SEQ ID NO: 761909 - protein, 19 aa, Mycobacterium
CAALPRILRDNGYVTAAFG

SEQ ID NO: 761910 - protein, 19 aa, Mycobacterium
CAAQSWSLDRIKSVKKAAG

SEQ ID NO: 761911 - protein, 18 aa, Mycobacterium
CAAQSWSLDRIKSVKRAA

SEQ ID NO: 761912 - protein, 19 aa, Mycobacterium
CAAQSWSLERIRAVKQAAG

SEQ ID NO: 761913 - protein, 18 aa, Mycobacterium
CAAQSWSLERVKAVKQAA

SEQ ID NO: 761914 - protein, 20 aa, Mycobacterium
CAAVGRISYLLGLRGPAVAV

SEQ ID NO: 761915 - protein, 18 aa, Mycobacterium
CAAWLWSRRRGIVAGRSA

SEQ ID NO: 761916 - protein, 17 aa, Mycobacterium
CADCLREVRDPADRRFG

SEQ ID NO: 761917 - protein, 21 aa, Mycobacterium
CADMLWSGIPLRFPRLNITLA

SEQ ID NO: 761918 - protein, 17 aa, Mycobacterium
CADPLLPLESSEIDAVR

SEQ ID NO: 761919 - protein, 17 aa, Mycobacterium
CAECGYSYCGTHWKLNP

SEQ ID NO: 761920 - protein, 23 aa, Mycobacterium
CAEEVDRACAPWGLLAEDKQATL

SEQ ID NO: 761921 - protein, 20 aa, Mycobacterium
CAELLYRAGLPRALYAVVPG

SEQ ID NO: 761922 - protein, 19 aa, Mycobacterium
CAERLDPALARWMSEHTTF

SEQ ID NO: 761923 - protein, 18 aa, Mycobacterium
CAFHWFPGNHLLHVSQPD

SEQ ID NO: 761924 - protein, 18 aa, Mycobacterium
CAGAERWLAISVATDEQW

SEQ ID NO: 761925 - protein, 18 aa, Mycobacterium
CAGITLFSPLRHWKAGPG

SEQ ID NO: 761926 - protein, 22 aa, Mycobacterium
CAHSGWQIAGSPDWAANLPEAL

SEQ ID NO: 761927 - protein, 24 aa, Mycobacterium
CAKGFPSYFLIVADLIGYAKSVGI

SEQ ID NO: 761928 - protein, 20 aa, Mycobacterium
CALDELILFRGRRVMTTILQ

SEQ ID NO: 761929 - protein, 17 aa, Mycobacterium
CAMAYQVHVGRWDQLDG

SEQ ID NO: 761930 - protein, 18 aa, Mycobacterium
CAMGTRPGARVLLDTALR

SEQ ID NO: 761931 - protein, 19 aa, Mycobacterium
CANAGIAPTAFREVSIEED

SEQ ID NO: 761932 - protein, 20 aa, Mycobacterium
CANAWLDALVTWRAAAGLPA

SEQ ID NO: 761933 - protein, 20 aa, Mycobacterium
CAPGEWGMAAVTGMGQRAAG

SEQ ID NO: 761934 - protein, 24 aa, Mycobacterium
CAPLAEIALDWVLDGAVAAGLPAR

SEQ ID NO: 761935 - protein, 20 aa, Mycobacterium
CAPVRPAVRLWVDGVLAGRY

SEQ ID NO: 761936 - protein, 19 aa, Mycobacterium
CARALAAIHRAEWNGLGLV

SEQ ID NO: 761937 - protein, 20 aa, Mycobacterium
CARLGATHSVVFGGFAAHEL

SEQ ID NO: 761938 - protein, 18 aa, Mycobacterium
CARLGIMHTVVFGGFTAH

SEQ ID NO: 761939 - protein, 20 aa, Mycobacterium
CARPRPTSVLQIHGTADQSV

SEQ ID NO: 761940 - protein, 24 aa, Mycobacterium
CASAWLDALVTWRRASGLPAAVIN

SEQ ID NO: 761941 - protein, 18 aa, Mycobacterium
CASTAMVLLVNWAGTCTV

SEQ ID NO: 761942 - protein, 19 aa, Mycobacterium
CAVGIPAATGWRMLSGDET

SEQ ID NO: 761943 - protein, 17 aa, Mycobacterium
CAVGIPTDSGWRMLSGD

SEQ ID NO: 761944 - protein, 18 aa, Mycobacterium
CAVPGAWPPVAIAGRRYM

SEQ ID NO: 761945 - protein, 18 aa, Mycobacterium
CAVPGAWPPVTIAGRRYM

SEQ ID NO: 761946 - protein, 21 aa, Mycobacterium
CAWPLHRRFGIAASARASFAV

SEQ ID NO: 761947 - protein, 20 aa, Mycobacterium
CAWPLHRRFGIAATARASFA

SEQ ID NO: 761948 - protein, 19 aa, Mycobacterium
CCFENRWNPDWLAVADKVR

SEQ ID NO: 761949 - protein, 17 aa, Mycobacterium
CDAWMGLAVAGDVSLNT

SEQ ID NO: 761950 - protein, 18 aa, Mycobacterium
CDCFNIPIVMFVDVPGFL

SEQ ID NO: 761951 - protein, 18 aa, Mycobacterium
CDDRWKLARRRIFVDESV

SEQ ID NO: 761952 - protein, 20 aa, Mycobacterium
CDERPCRVFAAKQAQDVVDK

SEQ ID NO: 761953 - protein, 17 aa, Mycobacterium
CDGCPAASSTLRDVFER

SEQ ID NO: 761954 - protein, 21 aa, Mycobacterium
CDGIGGACVLWDCVPSKSFIA

SEQ ID NO: 761955 - protein, 17 aa, Mycobacterium
CDILARYDVTFSLGDGL

SEQ ID NO: 761956 - protein, 17 aa, Mycobacterium
CDIRELRARLGLDSGYL

SEQ ID NO: 761957 - protein, 24 aa, Mycobacterium
CDKGFPSYFLIVADLINYARSVDI

SEQ ID NO: 761958 - protein, 24 aa, Mycobacterium
CDKGFPSYFLIVADLINYARSVGI

SEQ ID NO: 761959 - protein, 19 aa, Mycobacterium
CDKGRWAFTYATRPDVITT

SEQ ID NO: 761960 - protein, 22 aa, Mycobacterium
CDNLWWRIGHHFKVRAVPEKFQ

SEQ ID NO: 761961 - protein, 18 aa, Mycobacterium
CDPIRDWGERYAQRLRDA

SEQ ID NO: 761962 - protein, 18 aa, Mycobacterium
CDRHREALGNGYQLSKEA

SEQ ID NO: 761963 - protein, 24 aa, Mycobacterium
CDVVLCALPARYLTPMSDLKPKSL

SEQ ID NO: 761964 - protein, 19 aa, Mycobacterium
CEACGGLIRPDVVWFGEAL

SEQ ID NO: 761965 - protein, 17 aa, Mycobacterium
CEFAMAFDMRFAALGTT

SEQ ID NO: 761966 - protein, 24 aa, Mycobacterium
CELDLRIAFYPGITADEAWSEITA

SEQ ID NO: 761967 - protein, 17 aa, Mycobacterium
CERFGFGFVMYVGDSCA

SEQ ID NO: 761968 - protein, 24 aa, Mycobacterium
CERIIRFAFDLARTRRVKKVSSVT

SEQ ID NO: 761969 - protein, 20 aa, Mycobacterium
CESAHLPVIWATQVLESLAK

SEQ ID NO: 761970 - protein, 24 aa, Mycobacterium
CETMWCPSVSLSMWANAWLAGKAA

SEQ ID NO: 761971 - protein, 17 aa, Mycobacterium
CEYHGLHAFRWVAADGS

SEQ ID NO: 761972 - protein, 17 aa, Mycobacterium
CFAEFDWAAHPLGPPAD

SEQ ID NO: 761973 - protein, 18 aa, Mycobacterium
CFGMKIPTEYGGLGMSQV

SEQ ID NO: 761974 - protein, 18 aa, Mycobacterium
CFLALLRRFYELGVKELN

SEQ ID NO: 761975 - protein, 19 aa, Mycobacterium
CFPPAVALSQTWDPDLVER

SEQ ID NO: 761976 - protein, 22 aa, Mycobacterium
CFPTISELWLRLLEAYRDGRDD

SEQ ID NO: 761977 - protein, 19 aa, Mycobacterium
CFYEALGFTEVRRLAVPDP

SEQ ID NO: 761978 - protein, 22 aa, Mycobacterium
CGADFRLAEAADWEKFYGSAHA

SEQ ID NO: 761979 - protein, 24 aa, Mycobacterium
CGADFRLTDAAAWERFYGSAHAGS

SEQ ID NO: 761980 - protein, 24 aa, Mycobacterium
CGADFRLTDAAAWERFYGSAHSGS

SEQ ID NO: 761981 - protein, 24 aa, Mycobacterium
CGADFRLTDAAAWERFYGTPHAGS

SEQ ID NO: 761982 - protein, 24 aa, Mycobacterium
CGADFRLTDAAAWERYYGSKHAGS

SEQ ID NO: 761983 - protein, 24 aa, Mycobacterium
CGADFRLTDPAAWERFYGSPHAGS

SEQ ID NO: 761984 - protein, 22 aa, Mycobacterium
CGAPLLSLRTDRDWIADVMRFV

SEQ ID NO: 761985 - protein, 21 aa, Mycobacterium
CGAPLLSLRTDRDWISDIVRF

SEQ ID NO: 761986 - protein, 22 aa, Mycobacterium
CGAPVMSLRTDRDWIADIVRFV

SEQ ID NO: 761987 - protein, 17 aa, Mycobacterium
CGCIAALLMAILGCTSV

SEQ ID NO: 761988 - protein, 20 aa, Mycobacterium
CGDCPRVILGSPLAGESLDE

SEQ ID NO: 761989 - protein, 17 aa, Mycobacterium
CGDCPRVVLGSPLAGES

SEQ ID NO: 761990 - protein, 19 aa, Mycobacterium
CGDCPRVVLGSPLAGESLD

SEQ ID NO: 761991 - protein, 18 aa, Mycobacterium
CGEIARWVDEEGLSLDVA

SEQ ID NO: 761992 - protein, 18 aa, Mycobacterium
CGFASLLVEAARRAGVSG

SEQ ID NO: 761993 - protein, 18 aa, Mycobacterium
CGFCTPGMMITARALLDR

SEQ ID NO: 761994 - protein, 19 aa, Mycobacterium
CGGLGSWIAEFIARAGASE

SEQ ID NO: 761995 - protein, 29 aa, Mycobacterium
CGGPSCGLRMCKSCRGAFGSVQARLRTIG

SEQ ID NO: 761996 - protein, 17 aa, Mycobacterium
CGGRLSVGIGVGGRHED

SEQ ID NO: 761997 - protein, 21 aa, Mycobacterium
CGIAGLAAWLPLTRHADVSRG

SEQ ID NO: 761998 - protein, 20 aa, Mycobacterium
CGISPDVSRRSGLANMRSRA

SEQ ID NO: 761999 - protein, 22 aa, Mycobacterium
CGLDMLRWLLRVETSNGHLSPT

SEQ ID NO: 762000 - protein, 18 aa, Mycobacterium
CGLPRAEVVGVPVREAIT

SEQ ID NO: 762001 - protein, 18 aa, Mycobacterium
CGPAGRYVTGVALPVDAG

SEQ ID NO: 762002 - protein, 20 aa, Mycobacterium
CGPGRLVARLIQRGIPALGI

SEQ ID NO: 762003 - protein, 19 aa, Mycobacterium
CGPIGLAVICMLKAHGVRT

SEQ ID NO: 762004 - protein, 17 aa, Mycobacterium
CGPPIETGEGWLVLTHG

SEQ ID NO: 762005 - protein, 19 aa, Mycobacterium
CGPPPMVDAALMFLDANCV

SEQ ID NO: 762006 - protein, 18 aa, Mycobacterium
CGPPPMVEAVRTHLNTAG

SEQ ID NO: 762007 - protein, 18 aa, Mycobacterium
CGPPPMVEAVRTHLTNSG

SEQ ID NO: 762008 - protein, 18 aa, Mycobacterium
CGPVGLAVICHLKTRGVR

SEQ ID NO: 762009 - protein, 22 aa, Mycobacterium
CGQAFAEFVDWSLLDVLRGAAG

SEQ ID NO: 762010 - protein, 17 aa, Mycobacterium
CGRCPTCQAGLRNLCDL

SEQ ID NO: 762011 - protein, 18 aa, Mycobacterium
CGRLKDLLILAGRNIHPQ

SEQ ID NO: 762012 - protein, 18 aa, Mycobacterium
CGRRVRQLAVSHAFHSPL

SEQ ID NO: 762013 - protein, 20 aa, Mycobacterium
CGSCYFCARGLYSNCHNVNP

SEQ ID NO: 762014 - protein, 22 aa, Mycobacterium
CGSCYRCRRGDFVHCERSKVTG

SEQ ID NO: 762015 - protein, 20 aa, Mycobacterium
CGSTSRLLLHEAIADEVIDL

SEQ ID NO: 762016 - protein, 21 aa, Mycobacterium
CGTCESCQALAPSAPGSIDVV

SEQ ID NO: 762017 - protein, 20 aa, Mycobacterium
CGTCESCVALAPNGSGNVDV

SEQ ID NO: 762018 - protein, 21 aa, Mycobacterium
CGTCVPCRKGLFIHCVNGQVP

SEQ ID NO: 762019 - protein, 19 aa, Mycobacterium
CGVDPSWSVAFGVRAGGAA

SEQ ID NO: 762020 - protein, 21 aa, Mycobacterium
CGVIRRYQLPFGMNRAAAVAV

SEQ ID NO: 762021 - protein, 18 aa, Mycobacterium
CGVLVCFAGRVLEPLGLR

SEQ ID NO: 762022 - protein, 18 aa, Mycobacterium
CGVSYGFLSSAIMEYLDW

SEQ ID NO: 762023 - protein, 23 aa, Mycobacterium
CGVWRGGASILMRAVLAAYGDTT

SEQ ID NO: 762024 - protein, 18 aa, Mycobacterium
CGVWRGGASILMRAVLSA

SEQ ID NO: 762025 - protein, 20 aa, Mycobacterium
CGWCKDRFGLSWQIVPARLY

SEQ ID NO: 762026 - protein, 17 aa, Mycobacterium
CGWFDAVIARYATRVNG

SEQ ID NO: 762027 - protein, 24 aa, Mycobacterium
CGYARRSGLTASRFVACPFGAPGS

SEQ ID NO: 762028 - protein, 21 aa, Mycobacterium
CGYCVRLKKVLKNEGITFAEV

SEQ ID NO: 762029 - protein, 18 aa, Mycobacterium
CGYYGCLPYWSSGYVYPS

SEQ ID NO: 762030 - protein, 24 aa, Mycobacterium
CHGLQCGFCTPGFVMSITALLNDN

SEQ ID NO: 762031 - protein, 22 aa, Mycobacterium
CHGLQCGFCTPGFVTSITALLR

SEQ ID NO: 762032 - protein, 23 aa, Mycobacterium
CHNGCPLGNLIPEWNDLVRQGRW

SEQ ID NO: 762033 - protein, 24 aa, Mycobacterium
CHNGCPLGNLIPEWNDLVRRGRWR

SEQ ID NO: 762034 - protein, 24 aa, Mycobacterium
CHNGCPLGNLIPEWNDLVYRDRWR

SEQ ID NO: 762035 - protein, 18 aa, Mycobacterium
CIACGAIRTPGLEADAER

SEQ ID NO: 762036 - protein, 27 aa, Mycobacterium
CIARVLIQRARFVLCDEPTAMLDPIST

SEQ ID NO: 762037 - protein, 20 aa, Mycobacterium
CIDYARGRFDAIVPVEDQRE

SEQ ID NO: 762038 - protein, 20 aa, Mycobacterium
CIECPFHGWRWGPDGSNTYI

SEQ ID NO: 762039 - protein, 19 aa, Mycobacterium
CIGCGCLSLKICALANPGD

SEQ ID NO: 762040 - protein, 18 aa, Mycobacterium
CIGCGCLSLKTCQLTNPG

SEQ ID NO: 762041 - protein, 17 aa, Mycobacterium
CIHCMKCMPTVYSGTHC

SEQ ID NO: 762042 - protein, 17 aa, Mycobacterium
CILDRPRHAQLIEDVRA

SEQ ID NO: 762043 - protein, 18 aa, Mycobacterium
CILEHDWATVVMVDTQDG

SEQ ID NO: 762044 - protein, 20 aa, Mycobacterium
CIQVLGGIGCTWEHHAHLYL

SEQ ID NO: 762045 - protein, 17 aa, Mycobacterium
CIYAREPHVLVSKAPAE

SEQ ID NO: 762046 - protein, 21 aa, Mycobacterium
CKAARALALLADRNHVLPDDI

SEQ ID NO: 762047 - protein, 21 aa, Mycobacterium
CKASLDRLGLDYVDLYLIHWP

SEQ ID NO: 762048 - protein, 18 aa, Mycobacterium
CKLITWPIARCSARGIRT

SEQ ID NO: 762049 - protein, 23 aa, Mycobacterium
CKPEAGLKVARRFAHLTYRGEIE

SEQ ID NO: 762050 - protein, 22 aa, Mycobacterium
CKRGRPSYCFDTFNAEQKMTLT

SEQ ID NO: 762051 - protein, 17 aa, Mycobacterium
CLAHVPSYARWLSGQDW

SEQ ID NO: 762052 - protein, 20 aa, Mycobacterium
CLDGYRWLRAQGYAAEQIVL

SEQ ID NO: 762053 - protein, 25 aa, Mycobacterium
CLDKYARLFAWLGLWERHTDLAVIP

SEQ ID NO: 762054 - protein, 20 aa, Mycobacterium
CLGAALARTMLKALLTEVYT

SEQ ID NO: 762055 - protein, 20 aa, Mycobacterium
CLINACAHRGAMICRRKTDN

SEQ ID NO: 762056 - protein, 18 aa, Mycobacterium
CLIYVPFVGCVLHVSVTV

SEQ ID NO: 762057 - protein, 18 aa, Mycobacterium
CLLMFPRRDLTAGEAEAT

SEQ ID NO: 762058 - protein, 23 aa, Mycobacterium
CLNEARFGIVFGALGAARDSLET

SEQ ID NO: 762059 - protein, 23 aa, Mycobacterium
CLNEARFGIVFGALGAARDSLQA

SEQ ID NO: 762060 - protein, 19 aa, Mycobacterium
CLQRLGWFRVRVVPRHSPR

SEQ ID NO: 762061 - protein, 19 aa, Mycobacterium
CLRSILGGARVDYHGRHVA

SEQ ID NO: 762062 - protein, 18 aa, Mycobacterium
CLRSTFMYLGWLCGAGPN

SEQ ID NO: 762063 - protein, 23 aa, Mycobacterium
CLSEARFGIVFGSVGAARDCLEA

SEQ ID NO: 762064 - protein, 17 aa, Mycobacterium
CLSIHAAIVFTSPNPRV

SEQ ID NO: 762065 - protein, 20 aa, Mycobacterium
CLTGLSIRETVLFPIVRPHS

SEQ ID NO: 762066 - protein, 17 aa, Mycobacterium
CLVAIAILDVLGVSAAT

SEQ ID NO: 762067 - protein, 17 aa, Mycobacterium
CLVAIGMDLDIDGVRAR

SEQ ID NO: 762068 - protein, 22 aa, Mycobacterium
CMASGRISYALGVHGPSLTVDA

SEQ ID NO: 762069 - protein, 19 aa, Mycobacterium
CMAWTRMLVPLSRYSEALD

SEQ ID NO: 762070 - protein, 20 aa, Mycobacterium
CMDCGIPFCHKGCPLGNLIP

SEQ ID NO: 762071 - protein, 22 aa, Mycobacterium
CMSESLPTLFRQAGGYRRQLTF

SEQ ID NO: 762072 - protein, 25 aa, Mycobacterium
CNQLFCPVCALAALVEGEHHPLLAT

SEQ ID NO: 762073 - protein, 17 aa, Mycobacterium
CNQLLWRRDEFGLGGDD

SEQ ID NO: 762074 - protein, 17 aa, Mycobacterium
CNQRIKFSALYAKALAL

SEQ ID NO: 762075 - protein, 18 aa, Mycobacterium
CNRWASGRFDAGVFKEDW

SEQ ID NO: 762076 - protein, 23 aa, Mycobacterium
CPACPCTGTVWWAIAVDGLTLDM

SEQ ID NO: 762077 - protein, 18 aa, Mycobacterium
CPACSRLGPATDDELSCL

SEQ ID NO: 762078 - protein, 17 aa, Mycobacterium
CPCLLAVCSAGAGYDVI

SEQ ID NO: 762079 - protein, 21 aa, Mycobacterium
CPDCARGAFRADRPYEAEALR

SEQ ID NO: 762080 - protein, 17 aa, Mycobacterium
CPDREVVLVFVGDGSVP

SEQ ID NO: 762081 - protein, 17 aa, Mycobacterium
CPECLGLGIRKEVDPDL

SEQ ID NO: 762082 - protein, 21 aa, Mycobacterium
CPFGTECFAELARLEAGQSDV

SEQ ID NO: 762083 - protein, 23 aa, Mycobacterium
CPGLCPECGVPLAAEPGHQHDRI

SEQ ID NO: 762084 - protein, 24 aa, Mycobacterium
CPGPLGERAQWWWYQPFEPQPPPS

SEQ ID NO: 762085 - protein, 19 aa, Mycobacterium
CPHCATGFDVVHAGLSDSA

SEQ ID NO: 762086 - protein, 17 aa, Mycobacterium
CPHCQRPPRRLTPYAAA

SEQ ID NO: 762087 - protein, 20 aa, Mycobacterium
CPIPDPLDLLAFLAGHTTSL

SEQ ID NO: 762088 - protein, 20 aa, Mycobacterium
CPIPDPLDLLAFLAGRTTTL

SEQ ID NO: 762089 - protein, 20 aa, Mycobacterium
CPIPDPLDLLGFLAGRTTRL

SEQ ID NO: 762090 - protein, 29 aa, Mycobacterium
CPKCSGRLRKLFGSVGVVFKGSGFYRTDN

SEQ ID NO: 762091 - protein, 19 aa, Mycobacterium
CPLFDLAILVSYWMEPDDP

SEQ ID NO: 762092 - protein, 19 aa, Mycobacterium
CPLHCPYCSNPVALQNYRD

SEQ ID NO: 762093 - protein, 18 aa, Mycobacterium
CPLTWAWNLLGWPSINVP

SEQ ID NO: 762094 - protein, 23 aa, Mycobacterium
CPMAWSDAYGGHWVAAGSHEVFE

SEQ ID NO: 762095 - protein, 18 aa, Mycobacterium
CPMAWSETYNGHWVAADS

SEQ ID NO: 762096 - protein, 18 aa, Mycobacterium
CPPDSSGRNPIRYRNDGV

SEQ ID NO: 762097 - protein, 20 aa, Mycobacterium
CPQCDGRLRKIFGKVGVVFK

SEQ ID NO: 762098 - protein, 24 aa, Mycobacterium
CPRSIEFVNALPLSGAGKVLKREL

SEQ ID NO: 762099 - protein, 30 aa, Mycobacterium
CPTELLCLPLLRARYGLTFKEFRVTDAGGP

SEQ ID NO: 762100 - protein, 19 aa, Mycobacterium
CPVCLGLPGSLPVLNQTAV

SEQ ID NO: 762101 - protein, 20 aa, Mycobacterium
CPVCLGLPGSLPVLNRTAVE

SEQ ID NO: 762102 - protein, 19 aa, Mycobacterium
CPVCLGLPGSLPVVNEKAV

SEQ ID NO: 762103 - protein, 20 aa, Mycobacterium
CPVKREWPRLLSHIKNGYLK

SEQ ID NO: 762104 - protein, 20 aa, Mycobacterium
CPVKRQWPRLLSHIQQGYLT

SEQ ID NO: 762105 - protein, 20 aa, Mycobacterium
CPVWLKQAWIDLLGPEVIWE

SEQ ID NO: 762106 - protein, 19 aa, Mycobacterium
CPYHGWSYRNDGRIVGLPF

SEQ ID NO: 762107 - protein, 19 aa, Mycobacterium
CPYHGWSYRNDGRLIGLPF

SEQ ID NO: 762108 - protein, 20 aa, Mycobacterium
CPYRCTFCGTGAVSAMLGRT

SEQ ID NO: 762109 - protein, 19 aa, Mycobacterium
CQAERRHDMLFDHVAGLAA

SEQ ID NO: 762110 - protein, 26 aa, Mycobacterium
CQQVWCPVCALAALATGDQHPLLTAI

SEQ ID NO: 762111 - protein, 26 aa, Mycobacterium
CQQVWCPVCALAAVATGDQHPLVTVI

SEQ ID NO: 762112 - protein, 18 aa, Mycobacterium
CRAEGRSGLIGYLPTGFP

SEQ ID NO: 762113 - protein, 17 aa, Mycobacterium
CRAHLGLAFRMHVTAAT

SEQ ID NO: 762114 - protein, 17 aa, Mycobacterium
CRAMNWRSVREGAGIQH

SEQ ID NO: 762115 - protein, 20 aa, Mycobacterium
CRARSAGVSGEWSLPENFRS

SEQ ID NO: 762116 - protein, 22 aa, Mycobacterium
CRDKCHYCTFVTVPGKLRAEGK

SEQ ID NO: 762117 - protein, 22 aa, Mycobacterium
CRDKCHYCTFVTVPGKLRAQGQ

SEQ ID NO: 762118 - protein, 19 aa, Mycobacterium
CREALAINVKPKFAVDAMV

SEQ ID NO: 762119 - protein, 18 aa, Mycobacterium
CREALAVNVKPKFAIDAL

SEQ ID NO: 762120 - protein, 17 aa, Mycobacterium
CRGIEPTAMLQFWRGST

SEQ ID NO: 762121 - protein, 18 aa, Mycobacterium
CRGNCGAIVCRLVVDDDD

SEQ ID NO: 762122 - protein, 19 aa, Mycobacterium
CRKPRPGLVLAAARELGVP

SEQ ID NO: 762123 - protein, 17 aa, Mycobacterium
CRNGHGFIEATFATALV

SEQ ID NO: 762124 - protein, 17 aa, Mycobacterium
CRPHMLRHSFALRWYCI

SEQ ID NO: 762125 - protein, 18 aa, Mycobacterium
CRQGVCGECRIPVARGDI

SEQ ID NO: 762126 - protein, 18 aa, Mycobacterium
CRRAEVERLFALAAEPED

SEQ ID NO: 762127 - protein, 18 aa, Mycobacterium
CRRCGTCIECLHAGAGAG

SEQ ID NO: 762128 - protein, 19 aa, Mycobacterium
CRRSRLCLRVAGNGAMASV

SEQ ID NO: 762129 - protein, 26 aa, Mycobacterium
CRSGRAANCGRCWVIRCARVTSRHSA

SEQ ID NO: 762130 - protein, 18 aa, Mycobacterium
CRSPAAARGRGVVTANLI

SEQ ID NO: 762131 - protein, 20 aa, Mycobacterium
CRTPTIAAVHGWCIGGGVDL

SEQ ID NO: 762132 - protein, 17 aa, Mycobacterium
CRVRPGTLRVFEADPMD

SEQ ID NO: 762133 - protein, 18 aa, Mycobacterium
CRWCASGYTYLCDVGADI

SEQ ID NO: 762134 - protein, 21 aa, Mycobacterium
CRWPGCDVPAIGCDIDHTIPH

SEQ ID NO: 762135 - protein, 19 aa, Mycobacterium
CRYCGGRICPVCLEGMVSC

SEQ ID NO: 762136 - protein, 17 aa, Mycobacterium
CRYCRSHDLGVRDVSGR

SEQ ID NO: 762137 - protein, 17 aa, Mycobacterium
CRYRLPVTVVILNNGGV

SEQ ID NO: 762138 - protein, 18 aa, Mycobacterium
CSAEVPIPYAKHLEEAAL

SEQ ID NO: 762139 - protein, 17 aa, Mycobacterium
CSAFEAWFVSAALDDAA

SEQ ID NO: 762140 - protein, 18 aa, Mycobacterium
CSAFEAWFVSAALDDAAF

SEQ ID NO: 762141 - protein, 17 aa, Mycobacterium
CSAFEAWFVSAALDDTA

SEQ ID NO: 762142 - protein, 18 aa, Mycobacterium
CSANERLIHVDGPAFMVG

SEQ ID NO: 762143 - protein, 17 aa, Mycobacterium
CSDCGRIYWAGSHHARL

SEQ ID NO: 762144 - protein, 21 aa, Mycobacterium
CSDPARLAGWWAEHFGGTAHE

SEQ ID NO: 762145 - protein, 17 aa, Mycobacterium
CSDSFHLGDWVSAQRRK

SEQ ID NO: 762146 - protein, 20 aa, Mycobacterium
CSECQHVAPKWVGRCANCGT

SEQ ID NO: 762147 - protein, 18 aa, Mycobacterium
CSEIARWVEEEGLSLDVA

SEQ ID NO: 762148 - protein, 19 aa, Mycobacterium
CSGFGHALGIAADMIRGGS

SEQ ID NO: 762149 - protein, 18 aa, Mycobacterium
CSGRLRKLFHAVGVVFKG

SEQ ID NO: 762150 - protein, 18 aa, Mycobacterium
CSIKHQMASVIFSLEMSK

SEQ ID NO: 762151 - protein, 19 aa, Mycobacterium
CSIKHRLASVIFSLEMSKS

SEQ ID NO: 762152 - protein, 17 aa, Mycobacterium
CSILERIAFRLAPNAGP

SEQ ID NO: 762153 - protein, 19 aa, Mycobacterium
CSMKPRSDLVLQIAATSDS

SEQ ID NO: 762154 - protein, 17 aa, Mycobacterium
CSPSRFCWGVWLRGICR

SEQ ID NO: 762155 - protein, 18 aa, Mycobacterium
CSVEVPIPYAKHLEQAAL

SEQ ID NO: 762156 - protein, 18 aa, Mycobacterium
CSVPDIGTIWVRRATREE

SEQ ID NO: 762157 - protein, 19 aa, Mycobacterium
CSVSMPFKEDVLALVDEIE

SEQ ID NO: 762158 - protein, 19 aa, Mycobacterium
CSVSMPFKQDVMALVDEIE

SEQ ID NO: 762159 - protein, 17 aa, Mycobacterium
CSWAVKVPRRLKDLNSQ

SEQ ID NO: 762160 - protein, 17 aa, Mycobacterium
CTAHLSVSVMEQVERLA

SEQ ID NO: 762161 - protein, 25 aa, Mycobacterium
CTATGAVCLSGFPGAAYYLSDELLP

SEQ ID NO: 762162 - protein, 20 aa, Mycobacterium
CTDCWGRIASDIVTLARPEI

SEQ ID NO: 762163 - protein, 19 aa, Mycobacterium
CTGVAFPAFPALLAAEQGV

SEQ ID NO: 762164 - protein, 17 aa, Mycobacterium
CTKPCCTVGAYGCQVHH

SEQ ID NO: 762165 - protein, 21 aa, Mycobacterium
CTLRSWLGMWSLRVAQTRADP

SEQ ID NO: 762166 - protein, 17 aa, Mycobacterium
CTLRSWLSQWSYDDANG

SEQ ID NO: 762167 - protein, 22 aa, Mycobacterium
CTYHGRILWRPGALPAFSDDRW

SEQ ID NO: 762168 - protein, 18 aa, Mycobacterium
CTYWEGMLERFVPHQTVR

SEQ ID NO: 762169 - protein, 17 aa, Mycobacterium
CVAATLVVRGCDHASLL

SEQ ID NO: 762170 - protein, 21 aa, Mycobacterium
CVAGSRFLVQRGIYDAFVDAL

SEQ ID NO: 762171 - protein, 19 aa, Mycobacterium
CVELGIPIFVCAGIPGPRL

SEQ ID NO: 762172 - protein, 17 aa, Mycobacterium
CVERGILPGMQRLVRHI

SEQ ID NO: 762173 - protein, 17 aa, Mycobacterium
CVGIFDFYRGVGDIDAG

SEQ ID NO: 762174 - protein, 19 aa, Mycobacterium
CVLDERWPFAYLQVYADAA

SEQ ID NO: 762175 - protein, 19 aa, Mycobacterium
CVLDERWPFTYLQVYADAM

SEQ ID NO: 762176 - protein, 18 aa, Mycobacterium
CVLEWTVAITPRFVSWMP

SEQ ID NO: 762177 - protein, 18 aa, Mycobacterium
CVLWCSAIRHGVLTGDLD

SEQ ID NO: 762178 - protein, 19 aa, Mycobacterium
CVPCSSMGRLFDAVASILG

SEQ ID NO: 762179 - protein, 18 aa, Mycobacterium
CVSGPLLAGGYWNLPEAT

SEQ ID NO: 762180 - protein, 17 aa, Mycobacterium
CVTFRFRGHYFGDRMAY

SEQ ID NO: 762181 - protein, 17 aa, Mycobacterium
CVWEPRRGTDWGIDLDT

SEQ ID NO: 762182 - protein, 17 aa, Mycobacterium
CVYQILKRHYARYTPEM

SEQ ID NO: 762183 - protein, 19 aa, Mycobacterium
CWSVISGLVGGPWQGAASV

SEQ ID NO: 762184 - protein, 18 aa, Mycobacterium
CWTMLGAWAEQTSRIEIG

SEQ ID NO: 762185 - protein, 18 aa, Mycobacterium
CWTMLGAWAEQTSRIQIG

SEQ ID NO: 762186 - protein, 18 aa, Mycobacterium
CWTMLGAWAEQTSRVEIG

SEQ ID NO: 762187 - protein, 19 aa, Mycobacterium
CYAALRWLSVQGWIDPTRI

SEQ ID NO: 762188 - protein, 21 aa, Mycobacterium
CYDIRFPGLYTDLARRGAQVI

SEQ ID NO: 762189 - protein, 18 aa, Mycobacterium
CYDYIGHVLFTWNMPELW

SEQ ID NO: 762190 - protein, 18 aa, Mycobacterium
CYDYTGHVLFTWHLPELW

SEQ ID NO: 762191 - protein, 35 aa, Mycobacterium
CYDYTGHVLFTWHLPELWRRFTITLRRTLRRELRA

SEQ ID NO: 762192 - protein, 28 aa, Mycobacterium
CYGIAWRLAVLGLRRGEILALRWDAVDF

SEQ ID NO: 762193 - protein, 21 aa, Mycobacterium
CYSLRIASAMAHDEGWLAEHM

SEQ ID NO: 762194 - protein, 18 aa, Mycobacterium
DAAAAWAGLAEELSSAAS

SEQ ID NO: 762195 - protein, 17 aa, Mycobacterium
DAAAAWQGLAKELASAA

SEQ ID NO: 762196 - protein, 17 aa, Mycobacterium
DAAAPGWGCGRALVHRN

SEQ ID NO: 762197 - protein, 22 aa, Mycobacterium
DAAARVLLLWGRRPADPSRIRS

SEQ ID NO: 762198 - protein, 19 aa, Mycobacterium
DAAAVWAERGWRFPDRLDR

SEQ ID NO: 762199 - protein, 17 aa, Mycobacterium
DAAEIGSALAAANAAAA

SEQ ID NO: 762200 - protein, 17 aa, Mycobacterium
DAAELLIRLGLEAAQNQ

SEQ ID NO: 762201 - protein, 17 aa, Mycobacterium
DAAFGPADIRAWVGHYF

SEQ ID NO: 762202 - protein, 19 aa, Mycobacterium
DAAGFKWLAPYTGSALGQH

SEQ ID NO: 762203 - protein, 17 aa, Mycobacterium
DAAGLPPGVLNVVTGDG

SEQ ID NO: 762204 - protein, 17 aa, Mycobacterium
DAAIPLTWTFVEYSKFN

SEQ ID NO: 762205 - protein, 27 aa, Mycobacterium
DAALAAGLCGLRWVGAVGAVASGAALA

SEQ ID NO: 762206 - protein, 17 aa, Mycobacterium
DAALCLATLRAGVSIDG

SEQ ID NO: 762207 - protein, 17 aa, Mycobacterium
DAALCLATLRVGADPGG

SEQ ID NO: 762208 - protein, 21 aa, Mycobacterium
DAALLRGVWWPALHATRKVPP

SEQ ID NO: 762209 - protein, 19 aa, Mycobacterium
DAALQCIAVLLAARPELDI

SEQ ID NO: 762210 - protein, 17 aa, Mycobacterium
DAAPDWWWPALAFTAVA

SEQ ID NO: 762211 - protein, 19 aa, Mycobacterium
DAAPRIELVGVRKVFGDGR

SEQ ID NO: 762212 - protein, 21 aa, Mycobacterium
DAARLLVWRAGWMARNNQSFD

SEQ ID NO: 762213 - protein, 17 aa, Mycobacterium
DAASGRRGRPEPSPVAR

SEQ ID NO: 762214 - protein, 20 aa, Mycobacterium
DAATAPAWARPLLDDHRNLL

SEQ ID NO: 762215 - protein, 20 aa, Mycobacterium
DAATMPVRFVKSIGDAVMLV

SEQ ID NO: 762216 - protein, 17 aa, Mycobacterium
DAAVAWGGLAEELGTAA

SEQ ID NO: 762217 - protein, 18 aa, Mycobacterium
DACRAAGVGFSFGYPVDW

SEQ ID NO: 762218 - protein, 22 aa, Mycobacterium
DACRAAGVGFSFGYPVDWRVQD

SEQ ID NO: 762219 - protein, 18 aa, Mycobacterium
DACRDLGADLAINYRDTD

SEQ ID NO: 762220 - protein, 18 aa, Mycobacterium
DACSDVSVVFARGTHQEP

SEQ ID NO: 762221 - protein, 23 aa, Mycobacterium
DADARAGLFPEIERRGLTVDVLV

SEQ ID NO: 762222 - protein, 25 aa, Mycobacterium
DADEALRMGLVWRVCQPDELLPQAR

SEQ ID NO: 762223 - protein, 18 aa, Mycobacterium
DADFFAAWGKLAAVRTPT

SEQ ID NO: 762224 - protein, 24 aa, Mycobacterium
DADGRWRLGPALTELAAHVNDPLL

SEQ ID NO: 762225 - protein, 24 aa, Mycobacterium
DADLRPGLLVQLAFAAADFGFQQW

SEQ ID NO: 762226 - protein, 20 aa, Mycobacterium
DADMSGLFAAEWSALQAVVQ

SEQ ID NO: 762227 - protein, 18 aa, Mycobacterium
DADRGAGVTQEFRPCQPE

SEQ ID NO: 762228 - protein, 24 aa, Mycobacterium
DAEAAADCWSCFYQSRCALRALTL

SEQ ID NO: 762229 - protein, 17 aa, Mycobacterium
DAELVAWVKAVAGHARR

SEQ ID NO: 762230 - protein, 18 aa, Mycobacterium
DAERRALAALGWDDRHGD

SEQ ID NO: 762231 - protein, 17 aa, Mycobacterium
DAEWRMVLLVAVDGVVN

SEQ ID NO: 762232 - protein, 19 aa, Mycobacterium
DAEWWRLGLAEEIGGMPAP

SEQ ID NO: 762233 - protein, 25 aa, Mycobacterium
DAFGHPAFRVKFFKGKLKSGFTALE

SEQ ID NO: 762234 - protein, 19 aa, Mycobacterium
DAFNLGWKLAAVVRGQAGD

SEQ ID NO: 762235 - protein, 18 aa, Mycobacterium
DAFPSFRAEVERCADLFD

SEQ ID NO: 762236 - protein, 19 aa, Mycobacterium
DAFRINAELEFERNAERYQ

SEQ ID NO: 762237 - protein, 22 aa, Mycobacterium
DAFRPGVIDAMFARHIAELRRL

SEQ ID NO: 762238 - protein, 17 aa, Mycobacterium
DAFSTWRTTPAPVRGTL

SEQ ID NO: 762239 - protein, 24 aa, Mycobacterium
DAFTISKIRIKVVLHQWPGINITV

SEQ ID NO: 762240 - protein, 17 aa, Mycobacterium
DAGAGGFGGFGSTAGGT

SEQ ID NO: 762241 - protein, 25 aa, Mycobacterium
DAGAPALRMQLLWYPATTWDTSLPS

SEQ ID NO: 762242 - protein, 18 aa, Mycobacterium
DAGDCGACSVLIDDVAVH

SEQ ID NO: 762243 - protein, 25 aa, Mycobacterium
DAGDPVWWVVRALEFSQDFRTFARL

SEQ ID NO: 762244 - protein, 21 aa, Mycobacterium
DAGDVAACWPVPGPDDDKYTQ

SEQ ID NO: 762245 - protein, 24 aa, Mycobacterium
DAGDWSARVTLSFSGQSEQEWSYV

SEQ ID NO: 762246 - protein, 23 aa, Mycobacterium
DAGFKQFAEWDVCIVPRERLQLT

SEQ ID NO: 762247 - protein, 20 aa, Mycobacterium
DAGFRTGFVVARNAATGAAL

SEQ ID NO: 762248 - protein, 19 aa, Mycobacterium
DAGLGRRGIPEQFDAELWR

SEQ ID NO: 762249 - protein, 21 aa, Mycobacterium
DAGLRRLKLAAVRRTAPEVLI

SEQ ID NO: 762250 - protein, 19 aa, Mycobacterium
DAGLRWPRSTIFKVLDDLT

SEQ ID NO: 762251 - protein, 18 aa, Mycobacterium
DAGLSWVHFPEGFGGLGV

SEQ ID NO: 762252 - protein, 18 aa, Mycobacterium
DAGLSWVHFPEGMGGLGV

SEQ ID NO: 762253 - protein, 19 aa, Mycobacterium
DAGRYGLTLAHTVCLAGAF

SEQ ID NO: 762254 - protein, 17 aa, Mycobacterium
DAGVFMDTFSKWVSPAR

SEQ ID NO: 762255 - protein, 17 aa, Mycobacterium
DAGVLRLRIPVAEKAKP

SEQ ID NO: 762256 - protein, 18 aa, Mycobacterium
DAGWSRTDHYAWIAGLLL

SEQ ID NO: 762257 - protein, 22 aa, Mycobacterium
DAGYLVSRRGRYGGTFLADALP

SEQ ID NO: 762258 - protein, 22 aa, Mycobacterium
DAGYLVSRRGRYGGTFLADELP

SEQ ID NO: 762259 - protein, 20 aa, Mycobacterium
DAHLRSADFFDVENHPTATF

SEQ ID NO: 762260 - protein, 25 aa, Mycobacterium
DAHLYLKRLLGWSAFLGGPDRYLTE

SEQ ID NO: 762261 - protein, 25 aa, Mycobacterium
DAHLYLKRLLSWSAFLGGPDRYLTE

SEQ ID NO: 762262 - protein, 19 aa, Mycobacterium
DAIALAANWIWERGQEEDL

SEQ ID NO: 762263 - protein, 26 aa, Mycobacterium
DAIARGDWRAPLVIGDRLDTDIEGAH

SEQ ID NO: 762264 - protein, 18 aa, Mycobacterium
DAIDRWKALIIGTGAVGL

SEQ ID NO: 762265 - protein, 17 aa, Mycobacterium
DAIFGWEPVWGVDAWVA

SEQ ID NO: 762266 - protein, 18 aa, Mycobacterium
DAKARLGYQKVVLAGWSG

SEQ ID NO: 762267 - protein, 23 aa, Mycobacterium
DAKAVAAFSRWYAGGIDLSDPPA

SEQ ID NO: 762268 - protein, 19 aa, Mycobacterium
DAKKAVVFDDRWASAREDL

SEQ ID NO: 762269 - protein, 19 aa, Mycobacterium
DAKKRLGYQKVVLAGWSGG

SEQ ID NO: 762270 - protein, 19 aa, Mycobacterium
DAKKSVVFDDRWASAREDL

SEQ ID NO: 762271 - protein, 17 aa, Mycobacterium
DAKMPFQIEIGTKGGEQ

SEQ ID NO: 762272 - protein, 23 aa, Mycobacterium
DAKRALCGAAVIGSRFGADLLAL

SEQ ID NO: 762273 - protein, 22 aa, Mycobacterium
DAKWASSISGYWRRGRTEETFR

SEQ ID NO: 762274 - protein, 23 aa, Mycobacterium
DALCARFRISGLPVVDAQGALVG

SEQ ID NO: 762275 - protein, 17 aa, Mycobacterium
DALELLTMWSAGFPEPR

SEQ ID NO: 762276 - protein, 18 aa, Mycobacterium
DALGIKWAVVVGDREGAE

SEQ ID NO: 762277 - protein, 19 aa, Mycobacterium
DALGIKWSLLVGDRLGGEL

SEQ ID NO: 762278 - protein, 22 aa, Mycobacterium
DALKGAVVAPVITAHPTETRRR

SEQ ID NO: 762279 - protein, 19 aa, Mycobacterium
DALLPRYIATRVYAALLEA

SEQ ID NO: 762280 - protein, 21 aa, Mycobacterium
DALLPRYVATRVYAALLEAAA

SEQ ID NO: 762281 - protein, 17 aa, Mycobacterium
DALPRLVRRRALTYNVS

SEQ ID NO: 762282 - protein, 31 aa, Mycobacterium
DALPRRPQFALLKGRRNYLCLNKIHNGGAAD

SEQ ID NO: 762283 - protein, 18 aa, Mycobacterium
DALREWAKACGRQAETVY

SEQ ID NO: 762284 - protein, 17 aa, Mycobacterium
DALRILRLHLVHLLQTL

SEQ ID NO: 762285 - protein, 17 aa, Mycobacterium
DALTAWIAGCHHAGRPV

SEQ ID NO: 762286 - protein, 21 aa, Mycobacterium
DALVALVLDWNRPVKIFIETK

SEQ ID NO: 762287 - protein, 24 aa, Mycobacterium
DALVGLCWPAVFAAIGDAKTTDGT

SEQ ID NO: 762288 - protein, 24 aa, Mycobacterium
DALVGLCWPAVFSAIGSAVTDDGF

SEQ ID NO: 762289 - protein, 24 aa, Mycobacterium
DALVGPCWPAVFSAIGSAVTETGI

SEQ ID NO: 762290 - protein, 20 aa, Mycobacterium
DALWTRGWPTLRGSTLIDEA

SEQ ID NO: 762291 - protein, 20 aa, Mycobacterium
DAMANPRFREHIPLMIGGSG

SEQ ID NO: 762292 - protein, 18 aa, Mycobacterium
DAMIDWWGPGLVEYYGAT

SEQ ID NO: 762293 - protein, 20 aa, Mycobacterium
DAMPVLRWVRRMRSNSELPA

SEQ ID NO: 762294 - protein, 19 aa, Mycobacterium
DAMQIRWAPPFEMRSGFVR

SEQ ID NO: 762295 - protein, 22 aa, Mycobacterium
DAPAGGCPAGFGRIKPPVAGGS

SEQ ID NO: 762296 - protein, 22 aa, Mycobacterium
DAPAGLYVHWVVIGIAPGPGST

SEQ ID NO: 762297 - protein, 19 aa, Mycobacterium
DAPAVLGWAGFRDVAQRYS

SEQ ID NO: 762298 - protein, 19 aa, Mycobacterium
DAPAVLGWSAFRDVAQRYS

SEQ ID NO: 762299 - protein, 17 aa, Mycobacterium
DAPAVVANGLFNGQSTF

SEQ ID NO: 762300 - protein, 17 aa, Mycobacterium
DAPDVRAAHAFWSTVFS

SEQ ID NO: 762301 - protein, 17 aa, Mycobacterium
DAPEGWLTRIRIDKVGG

SEQ ID NO: 762302 - protein, 19 aa, Mycobacterium
DAPFAKWFVGGKINVAYNC

SEQ ID NO: 762303 - protein, 21 aa, Mycobacterium
DAPGKGWRLIQAVVAFPDVES

SEQ ID NO: 762304 - protein, 19 aa, Mycobacterium
DAPGVVCRWCGREEPSMRC

SEQ ID NO: 762305 - protein, 17 aa, Mycobacterium
DAPRIDAVLPMFLEFAR

SEQ ID NO: 762306 - protein, 17 aa, Mycobacterium
DAPRLAAIDAVRQHVAV

SEQ ID NO: 762307 - protein, 23 aa, Mycobacterium
DAQRAAAFYGHVLGWVFDPETQR

SEQ ID NO: 762308 - protein, 24 aa, Mycobacterium
DAQSRFGWHRGMLIPGARMQVSFL

SEQ ID NO: 762309 - protein, 17 aa, Mycobacterium
DARALEVTFPFGHGLSY

SEQ ID NO: 762310 - protein, 25 aa, Mycobacterium
DARAYRLDWPAGMTVFEIDQPEVIA

SEQ ID NO: 762311 - protein, 22 aa, Mycobacterium
DARAYRLPWPADMTVFEIDQPQ

SEQ ID NO: 762312 - protein, 22 aa, Mycobacterium
DARAYRLPWPDGTVVYEIDQPQ

SEQ ID NO: 762313 - protein, 21 aa, Mycobacterium
DARAYRLPWPPQTVVYEIDLP

SEQ ID NO: 762314 - protein, 25 aa, Mycobacterium
DAREALRMGLVWRVCEPAALLPEAR

SEQ ID NO: 762315 - protein, 22 aa, Mycobacterium
DARGQVLLPGFVDLHTHLREPG

SEQ ID NO: 762316 - protein, 19 aa, Mycobacterium
DARGVPFIFVRTDNAGNIS

SEQ ID NO: 762317 - protein, 24 aa, Mycobacterium
DARGYRLSWPPGMTVYEIDQPDVL

SEQ ID NO: 762318 - protein, 25 aa, Mycobacterium
DARGYRLTWPEGMTLFEIDQPEVIE

SEQ ID NO: 762319 - protein, 19 aa, Mycobacterium
DARIAALIRRVCAQTVSLP

SEQ ID NO: 762320 - protein, 20 aa, Mycobacterium
DARIKAHAAFGLMNSTPYSA

SEQ ID NO: 762321 - protein, 17 aa, Mycobacterium
DARLGWGPAAPAGDDLL

SEQ ID NO: 762322 - protein, 23 aa, Mycobacterium
DARLIEWCRWLGCVCVSVEYRLA

SEQ ID NO: 762323 - protein, 26 aa, Mycobacterium
DARLIPRLGLRPDIRRVPILGLGCVA

SEQ ID NO: 762324 - protein, 22 aa, Mycobacterium
DARLRAALLSAVLMVVASQRYL

SEQ ID NO: 762325 - protein, 24 aa, Mycobacterium
DARPDWELICGVARHLGFGDAFDH

SEQ ID NO: 762326 - protein, 19 aa, Mycobacterium
DARPDWQLICAVAEHLGFG

SEQ ID NO: 762327 - protein, 20 aa, Mycobacterium
DARSALLPLLHLVQAQDGYL

SEQ ID NO: 762328 - protein, 22 aa, Mycobacterium
DARSWRLPWPDGTVVYELDQPK

SEQ ID NO: 762329 - protein, 18 aa, Mycobacterium
DARVKIFLTASAETRARR

SEQ ID NO: 762330 - protein, 18 aa, Mycobacterium
DASAGWCVSIAITSALLV

SEQ ID NO: 762331 - protein, 17 aa, Mycobacterium
DASFGRRHQRLDDQVAE

SEQ ID NO: 762332 - protein, 20 aa, Mycobacterium
DASGRLGYRFDIHLQGPSET

SEQ ID NO: 762333 - protein, 26 aa, Mycobacterium
DASKWGRRGVNMFLEWSSTLRKHQVL

SEQ ID NO: 762334 - protein, 22 aa, Mycobacterium
DASMQYCWVMRVAGDQIVDVIG

SEQ ID NO: 762335 - protein, 23 aa, Mycobacterium
DASRRLPVFEVRVINGNVEIGML

SEQ ID NO: 762336 - protein, 17 aa, Mycobacterium
DASVSIHAVERFLGDTA

SEQ ID NO: 762337 - protein, 21 aa, Mycobacterium
DASYEFAEFGAVLSPGAGKVE

SEQ ID NO: 762338 - protein, 20 aa, Mycobacterium
DATAKGWRLTQAVVSFSDAQ

SEQ ID NO: 762339 - protein, 17 aa, Mycobacterium
DATELWPFVENLAQRIG

SEQ ID NO: 762340 - protein, 17 aa, Mycobacterium
DATRIVAWHSGERAGPT

SEQ ID NO: 762341 - protein, 25 aa, Mycobacterium
DATTMPKPWVKWSYEPARAEDVPAA

SEQ ID NO: 762342 - protein, 19 aa, Mycobacterium
DATWARLGANLAQRPGAVA

SEQ ID NO: 762343 - protein, 19 aa, Mycobacterium
DATYMWPWMFSKVADEYDR

SEQ ID NO: 762344 - protein, 18 aa, Mycobacterium
DAVALGFGGTVCIHPSQI

SEQ ID NO: 762345 - protein, 17 aa, Mycobacterium
DAVERWRVKAAQMADDV

SEQ ID NO: 762346 - protein, 23 aa, Mycobacterium
DAVGLRERARWTAEDELVKMGVD

SEQ ID NO: 762347 - protein, 17 aa, Mycobacterium
DAVGVLAGFPVEIAPTA

SEQ ID NO: 762348 - protein, 20 aa, Mycobacterium
DAVIAVHLRGHFLLTRNAAT

SEQ ID NO: 762349 - protein, 24 aa, Mycobacterium
DAVKARGSLRLSLGHTSTEADVDT

SEQ ID NO: 762350 - protein, 17 aa, Mycobacterium
DAVPFLFARDGAPGDPG

SEQ ID NO: 762351 - protein, 18 aa, Mycobacterium
DAVVEHWGPPPGHLFVDR

SEQ ID NO: 762352 - protein, 17 aa, Mycobacterium
DAVWRPANPLAHATAEQ

SEQ ID NO: 762353 - protein, 19 aa, Mycobacterium
DAWQRFGVWLLHKHFDPEP

SEQ ID NO: 762354 - protein, 17 aa, Mycobacterium
DAYRALGAWGLPVSEHT

SEQ ID NO: 762355 - protein, 17 aa, Mycobacterium
DAYRWLRLRGYQPDQIV

SEQ ID NO: 762356 - protein, 20 aa, Mycobacterium
DCAFLEKWPGVPVGNEEGEI

SEQ ID NO: 762357 - protein, 18 aa, Mycobacterium
DCAGLCPQCGVVLDTDPD

SEQ ID NO: 762358 - protein, 20 aa, Mycobacterium
DCAHDARWIYYSSGTTAAPK

SEQ ID NO: 762359 - protein, 19 aa, Mycobacterium
DCAPQWPAAEFASRLGVEP

SEQ ID NO: 762360 - protein, 19 aa, Mycobacterium
DCARLRFILTAQRDNYLPL

SEQ ID NO: 762361 - protein, 19 aa, Mycobacterium
DCARLRFILTAQRDQYLPL

SEQ ID NO: 762362 - protein, 20 aa, Mycobacterium
DCGMGWYFYDFGTAVSFFED

SEQ ID NO: 762363 - protein, 17 aa, Mycobacterium
DCGRIYWAGSHHARLAG

SEQ ID NO: 762364 - protein, 18 aa, Mycobacterium
DCGWQISDARGWSTTRLG

SEQ ID NO: 762365 - protein, 18 aa, Mycobacterium
DCILAMPVLADRMLRTAR

SEQ ID NO: 762366 - protein, 21 aa, Mycobacterium
DCIQVLGGIGCTWEHDAHLYL

SEQ ID NO: 762367 - protein, 18 aa, Mycobacterium
DCLREVRDPADRRFGHAF

SEQ ID NO: 762368 - protein, 23 aa, Mycobacterium
DCLSGRQAYDWGLAVEAPEPDEL

SEQ ID NO: 762369 - protein, 17 aa, Mycobacterium
DCPRVVLGSPLAGESLD

SEQ ID NO: 762370 - protein, 20 aa, Mycobacterium
DCPVCGVASCGSCRQETGGL

SEQ ID NO: 762371 - protein, 18 aa, Mycobacterium
DCPYPYFASPVELAASVD

SEQ ID NO: 762372 - protein, 18 aa, Mycobacterium
DCRDGACGTCKALCESGR

SEQ ID NO: 762373 - protein, 20 aa, Mycobacterium
DCTYYTALIMWIGCHADSHE

SEQ ID NO: 762374 - protein, 20 aa, Mycobacterium
DCVECPFHGWRWGPDGCNKY

SEQ ID NO: 762375 - protein, 20 aa, Mycobacterium
DCVECPFHGWRWGPDGTNRY

SEQ ID NO: 762376 - protein, 24 aa, Mycobacterium
DCWAVRPGGGWGWAVEPPGVTVAD

SEQ ID NO: 762377 - protein, 19 aa, Mycobacterium
DDAEIRWSVGFPDHPEPGL

SEQ ID NO: 762378 - protein, 22 aa, Mycobacterium
DDAEVFEALALLRASPGMDQAK

SEQ ID NO: 762379 - protein, 25 aa, Mycobacterium
DDAGRLGLIPLRWALACLLIDTESV

SEQ ID NO: 762380 - protein, 20 aa, Mycobacterium
DDARPGWTLADTVELAEHIK

SEQ ID NO: 762381 - protein, 17 aa, Mycobacterium
DDEFGFVVHGTMADPRW

SEQ ID NO: 762382 - protein, 22 aa, Mycobacterium
DDEGRWRLGPAVTELAAHVNDP

SEQ ID NO: 762383 - protein, 17 aa, Mycobacterium
DDFPRHPLNVIANMDAP

SEQ ID NO: 762384 - protein, 18 aa, Mycobacterium
DDGKVCLVVDGIEGDDVI

SEQ ID NO: 762385 - protein, 21 aa, Mycobacterium
DDGRSVLIISHFVADEHRFDR

SEQ ID NO: 762386 - protein, 25 aa, Mycobacterium
DDGRWIWRWDPAFITSNFQFLQGDP

SEQ ID NO: 762387 - protein, 18 aa, Mycobacterium
DDHRRAIAALGFGVLSKS

SEQ ID NO: 762388 - protein, 17 aa, Mycobacterium
DDHTWCLATEIDFDSTY

SEQ ID NO: 762389 - protein, 26 aa, Mycobacterium
DDIARLAHRVLRHRLILGFEAASARI

SEQ ID NO: 762390 - protein, 17 aa, Mycobacterium
DDICAVIVFGGHEMFSV

SEQ ID NO: 762391 - protein, 24 aa, Mycobacterium
DDIFCVADGPALLDCLEFDDQLRY

SEQ ID NO: 762392 - protein, 21 aa, Mycobacterium
DDIPGAWGLWFDLWAQAFRHD

SEQ ID NO: 762393 - protein, 23 aa, Mycobacterium
DDLEFRPPVVTVMGHVDHGKTRL

SEQ ID NO: 762394 - protein, 17 aa, Mycobacterium
DDLIAGAAYRWLRSWPT

SEQ ID NO: 762395 - protein, 17 aa, Mycobacterium
DDLIRWAIAHERAAEAC

SEQ ID NO: 762396 - protein, 17 aa, Mycobacterium
DDLKLLIVFNASTAEGK

SEQ ID NO: 762397 - protein, 18 aa, Mycobacterium
DDLPRLAARLERPAEPLV

SEQ ID NO: 762398 - protein, 17 aa, Mycobacterium
DDLPRLIAMLFSVLSTM

SEQ ID NO: 762399 - protein, 17 aa, Mycobacterium
DDLRAGLRMNIIGNPGV

SEQ ID NO: 762400 - protein, 17 aa, Mycobacterium
DDLRPGDLLAVAATGAY

SEQ ID NO: 762401 - protein, 17 aa, Mycobacterium
DDLRPGLRMNIIGNPGV

SEQ ID NO: 762402 - protein, 17 aa, Mycobacterium
DDLRPGLRMNVIGNPGV

SEQ ID NO: 762403 - protein, 18 aa, Mycobacterium
DDLRVAVVNAEFEALLVG

SEQ ID NO: 762404 - protein, 18 aa, Mycobacterium
DDLYLKFGEPIPVTSLLG

SEQ ID NO: 762405 - protein, 18 aa, Mycobacterium
DDMIGVNLSGVWKTVKAG

SEQ ID NO: 762406 - protein, 18 aa, Mycobacterium
DDNMPRVRLLDRYVSGDA

SEQ ID NO: 762407 - protein, 17 aa, Mycobacterium
DDPARWARWAAPCPIGD

SEQ ID NO: 762408 - protein, 18 aa, Mycobacterium
DDPCAFSFSGLKTAVARY

SEQ ID NO: 762409 - protein, 24 aa, Mycobacterium
DDPDLRFEMCLGVSGVHYPHETGR

SEQ ID NO: 762410 - protein, 22 aa, Mycobacterium
DDPEFRAPWSLAKKKRRSSPLS

SEQ ID NO: 762411 - protein, 17 aa, Mycobacterium
DDPELFTGFIAWTAEVL

SEQ ID NO: 762412 - protein, 22 aa, Mycobacterium
DDPGFRFALVISHENQHDETML

SEQ ID NO: 762413 - protein, 17 aa, Mycobacterium
DDPRFCDVLPLIEHAAE

SEQ ID NO: 762414 - protein, 24 aa, Mycobacterium
DDPRPRLLGALAMASVRIALDDWL

SEQ ID NO: 762415 - protein, 17 aa, Mycobacterium
DDPRWPPIPAQDFSNLP

SEQ ID NO: 762416 - protein, 18 aa, Mycobacterium
DDPVPFFNWRAGGLRSDV

SEQ ID NO: 762417 - protein, 26 aa, Mycobacterium
DDRLCIVPPFYHCFGMVMGTLGAVSH

SEQ ID NO: 762418 - protein, 22 aa, Mycobacterium
DDRTGPLIVEWLAKRGYDVTEQ

SEQ ID NO: 762419 - protein, 19 aa, Mycobacterium
DDSRLGFYRQLYRDNARFG

SEQ ID NO: 762420 - protein, 22 aa, Mycobacterium
DDTRPTIIIAYTIKGFGLPTQG

SEQ ID NO: 762421 - protein, 17 aa, Mycobacterium
DDVDAFLAMHDLTKNDI

SEQ ID NO: 762422 - protein, 21 aa, Mycobacterium
DDVRASGLLPTWEETNAFVEG

SEQ ID NO: 762423 - protein, 17 aa, Mycobacterium
DDWDGWVALTSAIGDRV

SEQ ID NO: 762424 - protein, 18 aa, Mycobacterium
DDWLIARWGCLRAANLAW

SEQ ID NO: 762425 - protein, 17 aa, Mycobacterium
DDWRWVIDIDLWGSIHT

SEQ ID NO: 762426 - protein, 22 aa, Mycobacterium
DDWVATGFPVEFLSLGTGGVGV

SEQ ID NO: 762427 - protein, 24 aa, Mycobacterium
DDYDLRTAFTWKFLRSADRRQVAA

SEQ ID NO: 762428 - protein, 17 aa, Mycobacterium
DDYTRWRLLEGLDDIGL

SEQ ID NO: 762429 - protein, 19 aa, Mycobacterium
DEAFKLGEVVAVFAPGGRL

SEQ ID NO: 762430 - protein, 18 aa, Mycobacterium
DEAIKLGDKVAVFGRGGV

SEQ ID NO: 762431 - protein, 18 aa, Mycobacterium
DEAIKLGDRVAVFGRGGV

SEQ ID NO: 762432 - protein, 19 aa, Mycobacterium
DEALKLADQVAVFRAGSLQ

SEQ ID NO: 762433 - protein, 17 aa, Mycobacterium
DEALPFTAIAVGASLAR

SEQ ID NO: 762434 - protein, 17 aa, Mycobacterium
DEALPLLAISVGASLVR

SEQ ID NO: 762435 - protein, 20 aa, Mycobacterium
DEALRLGERVAVFKGGSLQQ

SEQ ID NO: 762436 - protein, 20 aa, Mycobacterium
DEAMAGFATRVDVKIHADGS

SEQ ID NO: 762437 - protein, 23 aa, Mycobacterium
DEAMVLWPLLVLRTAVLNVSGAQ

SEQ ID NO: 762438 - protein, 17 aa, Mycobacterium
DEARAALSWWRHRQSII

SEQ ID NO: 762439 - protein, 21 aa, Mycobacterium
DEAWWFPAIQWPDGRMQFMLN

SEQ ID NO: 762440 - protein, 23 aa, Mycobacterium
DECMQLSGGIGFTWEYPLHYELR

SEQ ID NO: 762441 - protein, 24 aa, Mycobacterium
DECPPRPSPGWMFAAMPLIFPEGR

SEQ ID NO: 762442 - protein, 22 aa, Mycobacterium
DEEGRWRLGPAVSELAAHVNDS

SEQ ID NO: 762443 - protein, 17 aa, Mycobacterium
DEFKFPFDLLDSTKIIP

SEQ ID NO: 762444 - protein, 17 aa, Mycobacterium
DEFLRWLAGVRFTGEVW

SEQ ID NO: 762445 - protein, 17 aa, Mycobacterium
DEFQPFWAHNRTEERQA

SEQ ID NO: 762446 - protein, 23 aa, Mycobacterium
DEFRRPDLRLALMDRQGVYGAVM

SEQ ID NO: 762447 - protein, 17 aa, Mycobacterium
DEGEALFNAALRYFNGG

SEQ ID NO: 762448 - protein, 22 aa, Mycobacterium
DEGFRVGGWFGRIGTRDHEDWA

SEQ ID NO: 762449 - protein, 26 aa, Mycobacterium
DEGLCALGLRFSQDWMAPGERFSTLK

SEQ ID NO: 762450 - protein, 21 aa, Mycobacterium
DEGRFWLRTVVPRYYPIPDDG

SEQ ID NO: 762451 - protein, 19 aa, Mycobacterium
DEHGFRVILDYGHNEAAVG

SEQ ID NO: 762452 - protein, 31 aa, Mycobacterium
DEHRDRIGALWSRFSAVAARNPHAWNRDAVT

SEQ ID NO: 762453 - protein, 24 aa, Mycobacterium
DEHTCLYHYAWVRDRLLMVSLADV

SEQ ID NO: 762454 - protein, 18 aa, Mycobacterium
DEICRVDGLTGIYVGPAD

SEQ ID NO: 762455 - protein, 23 aa, Mycobacterium
DEIGRRCAWLLLDASGPLTLTLA

SEQ ID NO: 762456 - protein, 18 aa, Mycobacterium
DEIIRWATPVSAFQRTAN

SEQ ID NO: 762457 - protein, 23 aa, Mycobacterium
DEIKELLMHLAIYVGVPEVNYAF

SEQ ID NO: 762458 - protein, 17 aa, Mycobacterium
DEIKRYLDLEGVALHAL

SEQ ID NO: 762459 - protein, 23 aa, Mycobacterium
DEILRCARTLIIIGGYNGFSYAD

SEQ ID NO: 762460 - protein, 21 aa, Mycobacterium
DEIRINWVWNPPWGPDKITDD

SEQ ID NO: 762461 - protein, 21 aa, Mycobacterium
DEIRVPWELKPRRRSNPGHRS

SEQ ID NO: 762462 - protein, 22 aa, Mycobacterium
DEIRWALDLLRRRFAKVIWVPG

SEQ ID NO: 762463 - protein, 22 aa, Mycobacterium
DEIRWTLDLLRRRFAKVIWVPG

SEQ ID NO: 762464 - protein, 22 aa, Mycobacterium
DEISAAVAGMFAAHAQAYQALS

SEQ ID NO: 762465 - protein, 17 aa, Mycobacterium
DEIVRWATPVTAFQRTA

SEQ ID NO: 762466 - protein, 18 aa, Mycobacterium
DEIVRWATPVTSFQRTAL

SEQ ID NO: 762467 - protein, 21 aa, Mycobacterium
DEIWRFTPLRRLRGLHDGSAH

SEQ ID NO: 762468 - protein, 21 aa, Mycobacterium
DEIWRFTPLRRLRGLHNGTAG

SEQ ID NO: 762469 - protein, 19 aa, Mycobacterium
DEKGRRFLVQTAKIAYVEI

SEQ ID NO: 762470 - protein, 17 aa, Mycobacterium
DEKRMFGGLAFLIDGHL

SEQ ID NO: 762471 - protein, 17 aa, Mycobacterium
DELGCRTLGLVAFGTGV

SEQ ID NO: 762472 - protein, 20 aa, Mycobacterium
DELGECWGHFDAEDSVKALR

SEQ ID NO: 762473 - protein, 20 aa, Mycobacterium
DELGRLCCWVLLDATRPVSL

SEQ ID NO: 762474 - protein, 19 aa, Mycobacterium
DELHLGFNFRLTRTEFDAT

SEQ ID NO: 762475 - protein, 18 aa, Mycobacterium
DELHTAFQFDFLRSPWRA

SEQ ID NO: 762476 - protein, 21 aa, Mycobacterium
DELKINWVWNPPWGPDKITDD

SEQ ID NO: 762477 - protein, 19 aa, Mycobacterium
DELLPLLASMGMDTTRVGF

SEQ ID NO: 762478 - protein, 18 aa, Mycobacterium
DELLSLSNLDGWGRISDA

SEQ ID NO: 762479 - protein, 23 aa, Mycobacterium
DELPELLSGVSIVVVRILGGYRA

SEQ ID NO: 762480 - protein, 17 aa, Mycobacterium
DELPLPRPKFEIFVYSP

SEQ ID NO: 762481 - protein, 19 aa, Mycobacterium
DELPRLGIGKIDRRELVRR

SEQ ID NO: 762482 - protein, 20 aa, Mycobacterium
DELRAAPGLVYGYTAALDTA

SEQ ID NO: 762483 - protein, 18 aa, Mycobacterium
DELRELAAVLGIARDAEV

SEQ ID NO: 762484 - protein, 20 aa, Mycobacterium
DELRELAGILGMARDAEVLA

SEQ ID NO: 762485 - protein, 18 aa, Mycobacterium
DELRGFTAIRAWAKQFYP

SEQ ID NO: 762486 - protein, 20 aa, Mycobacterium
DELRINWVWNPPWGPDKITD

SEQ ID NO: 762487 - protein, 17 aa, Mycobacterium
DELRSLLRFVLDLLSDY

SEQ ID NO: 762488 - protein, 18 aa, Mycobacterium
DELTAWLDVVVEGFAAPD

SEQ ID NO: 762489 - protein, 24 aa, Mycobacterium
DELTLRYLLPMAHEGLRRWGVAPQ

SEQ ID NO: 762490 - protein, 17 aa, Mycobacterium
DEMARLGAQITIFRLGS

SEQ ID NO: 762491 - protein, 20 aa, Mycobacterium
DENGVRWIVGFNHDRDPGAT

SEQ ID NO: 762492 - protein, 24 aa, Mycobacterium
DEPELRFEMCLGVNGVHYPHETGR

SEQ ID NO: 762493 - protein, 17 aa, Mycobacterium
DEPLLIRAGRAFQSATD

SEQ ID NO: 762494 - protein, 24 aa, Mycobacterium
DEPQLRFEMCLGVSGVHYPHEAGR

SEQ ID NO: 762495 - protein, 24 aa, Mycobacterium
DEPRWPRYAPAAVERGVLSSLSFK

SEQ ID NO: 762496 - protein, 23 aa, Mycobacterium
DEPRYRPSAALQRFVHARDITCR

SEQ ID NO: 762497 - protein, 20 aa, Mycobacterium
DEPYTALAVVWSFLLDTSAG

SEQ ID NO: 762498 - protein, 22 aa, Mycobacterium
DEQKQRWAVPVLRAEMTASLGM

SEQ ID NO: 762499 - protein, 17 aa, Mycobacterium
DERGMRTVMCIINGQLR

SEQ ID NO: 762500 - protein, 17 aa, Mycobacterium
DERGMRTVMCIMNGQLR

SEQ ID NO: 762501 - protein, 20 aa, Mycobacterium
DERLGEVGRAFLVTRPGAQL

SEQ ID NO: 762502 - protein, 24 aa, Mycobacterium
DERLGEVPWAFVVRGDESVSEAGL

SEQ ID NO: 762503 - protein, 17 aa, Mycobacterium
DERPGWHALRRLAARIT

SEQ ID NO: 762504 - protein, 25 aa, Mycobacterium
DERSAGGWHAEWLVLRECLRLAGGA

SEQ ID NO: 762505 - protein, 18 aa, Mycobacterium
DESLWRLLCEQVGAAALV

SEQ ID NO: 762506 - protein, 19 aa, Mycobacterium
DESRWRMAVEKVLRGAGLR

SEQ ID NO: 762507 - protein, 20 aa, Mycobacterium
DETLPFISIRLWQPISENET

SEQ ID NO: 762508 - protein, 17 aa, Mycobacterium
DETLWRLLCEQVGAAAL

SEQ ID NO: 762509 - protein, 20 aa, Mycobacterium
DEVARLLALESFDILDTPPE

SEQ ID NO: 762510 - protein, 19 aa, Mycobacterium
DEVEVRWALLVGDRHGGEI

SEQ ID NO: 762511 - protein, 23 aa, Mycobacterium
DEVIPLLQCRTGFRSTYRPGETL

SEQ ID NO: 762512 - protein, 18 aa, Mycobacterium
DEVLPRVHLAAVQHAGGE

SEQ ID NO: 762513 - protein, 22 aa, Mycobacterium
DEVPARVAGLVERLKAAEKELE

SEQ ID NO: 762514 - protein, 17 aa, Mycobacterium
DEVRLLVGIDVIDTQSQ

SEQ ID NO: 762515 - protein, 22 aa, Mycobacterium
DEVSAAIAALFSGHGQAYQQIS

SEQ ID NO: 762516 - protein, 17 aa, Mycobacterium
DEVSAAIAAVFSAHGVQ

SEQ ID NO: 762517 - protein, 26 aa, Mycobacterium
DEVSAAVAKLFGGYAQQFQALGAQAS

SEQ ID NO: 762518 - protein, 22 aa, Mycobacterium
DEVSAGIAAVFGAHGRAYQALA

SEQ ID NO: 762519 - protein, 22 aa, Mycobacterium
DEVSAVIAALFAAHGQAYQTLS

SEQ ID NO: 762520 - protein, 22 aa, Mycobacterium
DEVSTRIAALFGAHGLEYQAVV

SEQ ID NO: 762521 - protein, 17 aa, Mycobacterium
DEVSVAVAALFGSHGET

SEQ ID NO: 762522 - protein, 22 aa, Mycobacterium
DEVTACLRALVKRRLDVAHPGY

SEQ ID NO: 762523 - protein, 22 aa, Mycobacterium
DEWPEQVGLDWFPPGEEPIVPR

SEQ ID NO: 762524 - protein, 25 aa, Mycobacterium
DFAARPALLATFPFPHLLTLDITLA

SEQ ID NO: 762525 - protein, 18 aa, Mycobacterium
DFAFRPGPCLPRMRATFP

SEQ ID NO: 762526 - protein, 18 aa, Mycobacterium
DFAGGGFRRGEGFLCLMP

SEQ ID NO: 762527 - protein, 18 aa, Mycobacterium
DFAKAFWNVVNWADVQAR

SEQ ID NO: 762528 - protein, 18 aa, Mycobacterium
DFAKAFWNVVNWADVQER

SEQ ID NO: 762529 - protein, 18 aa, Mycobacterium
DFAKAFWNVVNWADVQSR

SEQ ID NO: 762530 - protein, 17 aa, Mycobacterium
DFARASFKYGLNAKWPV

SEQ ID NO: 762531 - protein, 17 aa, Mycobacterium
DFARASLAYGLNAKWPV

SEQ ID NO: 762532 - protein, 17 aa, Mycobacterium
DFDRIKVSLPFHADHIV

SEQ ID NO: 762533 - protein, 17 aa, Mycobacterium
DFERIRHEFGFPGDDQV

SEQ ID NO: 762534 - protein, 17 aa, Mycobacterium
DFERIRHEFGFPGDDRV

SEQ ID NO: 762535 - protein, 17 aa, Mycobacterium
DFFFRKIVRDHGKALQF

SEQ ID NO: 762536 - protein, 22 aa, Mycobacterium
DFFSFYLCDIVLKLNGKGGQPV

SEQ ID NO: 762537 - protein, 18 aa, Mycobacterium
DFGDYRWAATLLDHAVFT

SEQ ID NO: 762538 - protein, 18 aa, Mycobacterium
DFGGPWALAWAAEHLGAV

SEQ ID NO: 762539 - protein, 20 aa, Mycobacterium
DFGGVWYWNRFPGIQCDNDA

SEQ ID NO: 762540 - protein, 21 aa, Mycobacterium
DFGRLRWAQLRDRVFGRTDAI

SEQ ID NO: 762541 - protein, 18 aa, Mycobacterium
DFGSRLYAALGIARDQTD

SEQ ID NO: 762542 - protein, 18 aa, Mycobacterium
DFITRPGVQHALATADTE

SEQ ID NO: 762543 - protein, 17 aa, Mycobacterium
DFLHGRWLVLRRGKRNI

SEQ ID NO: 762544 - protein, 18 aa, Mycobacterium
DFLHGRWLVLRRGKRNIA

SEQ ID NO: 762545 - protein, 17 aa, Mycobacterium
DFLHGRWLVLRRGKRTV

SEQ ID NO: 762546 - protein, 17 aa, Mycobacterium
DFLRMINDVFLLRNGAR

SEQ ID NO: 762547 - protein, 27 aa, Mycobacterium
DFLRSCSIKHRMASVIFSLEMSKSEIV

SEQ ID NO: 762548 - protein, 17 aa, Mycobacterium
DFMRSCSIKHGHASVIF

SEQ ID NO: 762549 - protein, 18 aa, Mycobacterium
DFMRSCSIKHQMASVIFS

SEQ ID NO: 762550 - protein, 18 aa, Mycobacterium
DFNFAWPTARIAVIGAEG

SEQ ID NO: 762551 - protein, 17 aa, Mycobacterium
DFPMFWDAEFLKHNAHI

SEQ ID NO: 762552 - protein, 22 aa, Mycobacterium
DFRPELPAAWLTEALYGLIGGT

SEQ ID NO: 762553 - protein, 19 aa, Mycobacterium
DFSIPSWAATVMRLVPGAQ

SEQ ID NO: 762554 - protein, 17 aa, Mycobacterium
DFSRPWVTVTLHGAAVR

SEQ ID NO: 762555 - protein, 17 aa, Mycobacterium
DFTALDALFAWYSTMGS

SEQ ID NO: 762556 - protein, 23 aa, Mycobacterium
DFVKLAEALGCVGLRCERAEDVV

SEQ ID NO: 762557 - protein, 23 aa, Mycobacterium
DFVKLAEALGCVGLRCEREEDVE

SEQ ID NO: 762558 - protein, 19 aa, Mycobacterium
DFVRHLGCYQAHFTTGNVL

SEQ ID NO: 762559 - protein, 20 aa, Mycobacterium
DFVSRGWLRFVYGGADVGGY

SEQ ID NO: 762560 - protein, 28 aa, Mycobacterium
DFWFDPLCPWCWITSRWILEVEKVRDIE

SEQ ID NO: 762561 - protein, 19 aa, Mycobacterium
DGAAGGWLLGDGGAGGSAP

SEQ ID NO: 762562 - protein, 19 aa, Mycobacterium
DGAAGGWLLGNGGAGGSGA

SEQ ID NO: 762563 - protein, 17 aa, Mycobacterium
DGADWVLRGTKYYISGV

SEQ ID NO: 762564 - protein, 18 aa, Mycobacterium
DGAFTLNGTRVWCAGAGF

SEQ ID NO: 762565 - protein, 17 aa, Mycobacterium
DGAIFHRVIDGFMIQGG

SEQ ID NO: 762566 - protein, 17 aa, Mycobacterium
DGALWCTRAVYKKMAKR

SEQ ID NO: 762567 - protein, 17 aa, Mycobacterium
DGALWCTRAVYKKMVKR

SEQ ID NO: 762568 - protein, 20 aa, Mycobacterium
DGAPAWLRFLGVNPRHHSLA

SEQ ID NO: 762569 - protein, 19 aa, Mycobacterium
DGARAEWAMGLWDDPTQSA

SEQ ID NO: 762570 - protein, 23 aa, Mycobacterium
DGARIPVSIVHRAGIEFPAPALL

SEQ ID NO: 762571 - protein, 19 aa, Mycobacterium
DGARLCTYCGALGDDDAST

SEQ ID NO: 762572 - protein, 19 aa, Mycobacterium
DGARVPISIVHRAGVQFPA

SEQ ID NO: 762573 - protein, 21 aa, Mycobacterium
DGARVPISIVHRAGVQFPAPT

SEQ ID NO: 762574 - protein, 25 aa, Mycobacterium
DGASNWYLEFARLAPLMEKDTHYEV

SEQ ID NO: 762575 - protein, 19 aa, Mycobacterium
DGAVIPGRLYVPAEGDDLP

SEQ ID NO: 762576 - protein, 17 aa, Mycobacterium
DGAWRFDTRTMFVDQVG

SEQ ID NO: 762577 - protein, 25 aa, Mycobacterium
DGDIWDWAVDWDEWKSMSALSDTRA

SEQ ID NO: 762578 - protein, 18 aa, Mycobacterium
DGDPVWLRFYGCNPRHHA

SEQ ID NO: 762579 - protein, 19 aa, Mycobacterium
DGDRLRITWRGETVVDVPP

SEQ ID NO: 762580 - protein, 17 aa, Mycobacterium
DGDYRFGQQIVVSHDGG

SEQ ID NO: 762581 - protein, 25 aa, Mycobacterium
DGERRLRIGAALGITGDVAAKARAL

SEQ ID NO: 762582 - protein, 18 aa, Mycobacterium
DGFARFWLHNGWVTMGGE

SEQ ID NO: 762583 - protein, 24 aa, Mycobacterium
DGFEISPRLAAAITDSAASLALDP

SEQ ID NO: 762584 - protein, 19 aa, Mycobacterium
DGFLPTLLDWCRKNDVVFI

SEQ ID NO: 762585 - protein, 26 aa, Mycobacterium
DGGAGGRGGLLFGVGGAGGAGGDGLD

SEQ ID NO: 762586 - protein, 24 aa, Mycobacterium
DGGAGGRGGWLIGTGGAGGLGGVG

SEQ ID NO: 762587 - protein, 26 aa, Mycobacterium
DGGAGGRGGWLWSAGGDGGAGGLGGT

SEQ ID NO: 762588 - protein, 19 aa, Mycobacterium
DGGDGRNGSTGAIGGNGGT

SEQ ID NO: 762589 - protein, 22 aa, Mycobacterium
DGGIGGHGGWLFGNAGAGGPGG

SEQ ID NO: 762590 - protein, 23 aa, Mycobacterium
DGGKAAGSLMSWTHDSAHVGPGV

SEQ ID NO: 762591 - protein, 19 aa, Mycobacterium
DGGLRYCINSASLRFIHRD

SEQ ID NO: 762592 - protein, 18 aa, Mycobacterium
DGGNGGFGYVLIAGPNVT

SEQ ID NO: 762593 - protein, 17 aa, Mycobacterium
DGGRAAIVLGDWNAIGS

SEQ ID NO: 762594 - protein, 18 aa, Mycobacterium
DGGRAALVLGDWPAQEAV

SEQ ID NO: 762595 - protein, 20 aa, Mycobacterium
DGGRAALVLSDWPAPDNPAP

SEQ ID NO: 762596 - protein, 25 aa, Mycobacterium
DGGTWFLPRAVGWARAAEMTLTGDR

SEQ ID NO: 762597 - protein, 22 aa, Mycobacterium
DGGVRLSGRWSWATGVMDGNWI

SEQ ID NO: 762598 - protein, 22 aa, Mycobacterium
DGGVRLSGRWSWATGVMDGNWT

SEQ ID NO: 762599 - protein, 24 aa, Mycobacterium
DGHRWEWSDAVARMHGYKPGQVQP

SEQ ID NO: 762600 - protein, 19 aa, Mycobacterium
DGIGIDEYVDWLIEAGHPI

SEQ ID NO: 762601 - protein, 17 aa, Mycobacterium
DGIGIDEYVDWLIEAGY

SEQ ID NO: 762602 - protein, 19 aa, Mycobacterium
DGIGIDEYVDWLIEAGYPI

SEQ ID NO: 762603 - protein, 17 aa, Mycobacterium
DGIGLDEFVDWLNESGC

SEQ ID NO: 762604 - protein, 23 aa, Mycobacterium
DGIGLDEYVDWLIDAGHRIQRIA

SEQ ID NO: 762605 - protein, 22 aa, Mycobacterium
DGIGLDEYVDWLIEAGYPIERV

SEQ ID NO: 762606 - protein, 19 aa, Mycobacterium
DGIGLDEYVDWLIEAGYPV

SEQ ID NO: 762607 - protein, 17 aa, Mycobacterium
DGIGLDEYVDWVIEAGY

SEQ ID NO: 762608 - protein, 19 aa, Mycobacterium
DGIGLDEYVDWVIEAGYPI

SEQ ID NO: 762609 - protein, 25 aa, Mycobacterium
DGISRLRFRLRWRDFRVTIDVNHVD

SEQ ID NO: 762610 - protein, 25 aa, Mycobacterium
DGISRLRFRLRWRGYRLTVDANHST

SEQ ID NO: 762611 - protein, 18 aa, Mycobacterium
DGITEWLERVAIQAGGQG

SEQ ID NO: 762612 - protein, 18 aa, Mycobacterium
DGITEWLERVAIQAGREG

SEQ ID NO: 762613 - protein, 22 aa, Mycobacterium
DGKCLRSTFLYVGWRCGADGTD

SEQ ID NO: 762614 - protein, 18 aa, Mycobacterium
DGKPALLDCLEFDDKLRY

SEQ ID NO: 762615 - protein, 23 aa, Mycobacterium
DGKPEFSRRLAVAFRDHNAEIGA

SEQ ID NO: 762616 - protein, 24 aa, Mycobacterium
DGKVYCCAILDCFSRMIVARTFST

SEQ ID NO: 762617 - protein, 17 aa, Mycobacterium
DGKWGRPAILMSPVAFL

SEQ ID NO: 762618 - protein, 18 aa, Mycobacterium
DGLFGVLTNVVWTSHGPC

SEQ ID NO: 762619 - protein, 20 aa, Mycobacterium
DGLFIPRAPTEFGIKDNPKL

SEQ ID NO: 762620 - protein, 17 aa, Mycobacterium
DGLGTVWGRELATSMLA

SEQ ID NO: 762621 - protein, 17 aa, Mycobacterium
DGLKFVWGDGAADFVTP

SEQ ID NO: 762622 - protein, 17 aa, Mycobacterium
DGLKRWNQIGTIVGKSW

SEQ ID NO: 762623 - protein, 18 aa, Mycobacterium
DGLLEIGRKLGIPPLATN

SEQ ID NO: 762624 - protein, 22 aa, Mycobacterium
DGLLWPEPWLALNPAFEPGGSV

SEQ ID NO: 762625 - protein, 17 aa, Mycobacterium
DGLRACLRSTLASGKLG

SEQ ID NO: 762626 - protein, 18 aa, Mycobacterium
DGLRCAGCVDTVTNALTA

SEQ ID NO: 762627 - protein, 19 aa, Mycobacterium
DGLRLPVVVTERGDTLVEP

SEQ ID NO: 762628 - protein, 20 aa, Mycobacterium
DGLRPLIFALWEMVKKYRDA

SEQ ID NO: 762629 - protein, 18 aa, Mycobacterium
DGLRRFNENLGYGLLGRR

SEQ ID NO: 762630 - protein, 18 aa, Mycobacterium
DGLRRFQRNLGHGLLGRR

SEQ ID NO: 762631 - protein, 17 aa, Mycobacterium
DGLRWSTTEQLGYNRRY

SEQ ID NO: 762632 - protein, 23 aa, Mycobacterium
DGLTVPRPAVFFDFDGTLSEIVD

SEQ ID NO: 762633 - protein, 25 aa, Mycobacterium
DGLVRSFGCEWGRYGITVNGLAPTV

SEQ ID NO: 762634 - protein, 17 aa, Mycobacterium
DGLWRLGPALTELAGHV

SEQ ID NO: 762635 - protein, 24 aa, Mycobacterium
DGMGGASGFSIVFPPGQDGGGGGI

SEQ ID NO: 762636 - protein, 19 aa, Mycobacterium
DGMPRRRLAELSGEPRRDP

SEQ ID NO: 762637 - protein, 22 aa, Mycobacterium
DGNRPAMEVLLLGGQPIRERVV

SEQ ID NO: 762638 - protein, 18 aa, Mycobacterium
DGNRRWARDAGYDDVSIG

SEQ ID NO: 762639 - protein, 18 aa, Mycobacterium
DGNRRWARSAGYTDVSHG

SEQ ID NO: 762640 - protein, 18 aa, Mycobacterium
DGNTRYTPRGNVGGHGGN

SEQ ID NO: 762641 - protein, 19 aa, Mycobacterium
DGPAFRAAVTVTFGGYKPV

SEQ ID NO: 762642 - protein, 18 aa, Mycobacterium
DGPARAWEHGRFGAPYLR

SEQ ID NO: 762643 - protein, 20 aa, Mycobacterium
DGPDGPCMVGLWRARDPGEL

SEQ ID NO: 762644 - protein, 20 aa, Mycobacterium
DGPFPYARDVSGLQVGILGL

SEQ ID NO: 762645 - protein, 22 aa, Mycobacterium
DGPLRRLECRIAPTQTGGIYYT

SEQ ID NO: 762646 - protein, 17 aa, Mycobacterium
DGPPPDWHSFGRVLNKN

SEQ ID NO: 762647 - protein, 18 aa, Mycobacterium
DGQIGQWRARAMALVMLA

SEQ ID NO: 762648 - protein, 19 aa, Mycobacterium
DGQLPKMRAIVGFAAETGD

SEQ ID NO: 762649 - protein, 19 aa, Mycobacterium
DGQRRMWFVQGFDPSGVLL

SEQ ID NO: 762650 - protein, 18 aa, Mycobacterium
DGRARSALLGRMYGDDGV

SEQ ID NO: 762651 - protein, 17 aa, Mycobacterium
DGRCPTCQGEGFVSVEL

SEQ ID NO: 762652 - protein, 17 aa, Mycobacterium
DGRCVGHPFPGMTDVRI

SEQ ID NO: 762653 - protein, 20 aa, Mycobacterium
DGRDLRRCYSMSSAPVEEEL

SEQ ID NO: 762654 - protein, 19 aa, Mycobacterium
DGRFYYARVAAVTDAGIRP

SEQ ID NO: 762655 - protein, 18 aa, Mycobacterium
DGRFYYARVASVSDAGVQ

SEQ ID NO: 762656 - protein, 18 aa, Mycobacterium
DGRIGFRSIVRTIADVLD

SEQ ID NO: 762657 - protein, 24 aa, Mycobacterium
DGRLLKLRLHPGVMTGYSHGELAD

SEQ ID NO: 762658 - protein, 25 aa, Mycobacterium
DGRLRLGARVRPGWFAQTHHHAGLM

SEQ ID NO: 762659 - protein, 18 aa, Mycobacterium
DGRMGFEVKIHRAAADGA

SEQ ID NO: 762660 - protein, 17 aa, Mycobacterium
DGRRWRLAVGDLAAGFD

SEQ ID NO: 762661 - protein, 21 aa, Mycobacterium
DGRVAARVCIWVNKFQEETTV

SEQ ID NO: 762662 - protein, 22 aa, Mycobacterium
DGRWIWRWDPAFITSNFQFLQG

SEQ ID NO: 762663 - protein, 21 aa, Mycobacterium
DGRWIWRWDPAFITSNLEFLR

SEQ ID NO: 762664 - protein, 18 aa, Mycobacterium
DGRWPRYRTAALDRTPVR

SEQ ID NO: 762665 - protein, 17 aa, Mycobacterium
DGRWRISKRTVLPMDGS

SEQ ID NO: 762666 - protein, 23 aa, Mycobacterium
DGRWSCVRWATLTPPFHPEPDVQ

SEQ ID NO: 762667 - protein, 17 aa, Mycobacterium
DGSFEWNQSLFSYNFGD

SEQ ID NO: 762668 - protein, 19 aa, Mycobacterium
DGSNRWPAVHRLDAAHLFR

SEQ ID NO: 762669 - protein, 23 aa, Mycobacterium
DGSRSAVRAALWAVDEALHRELP

SEQ ID NO: 762670 - protein, 20 aa, Mycobacterium
DGSSVLLHFHGHSSLGASGW

SEQ ID NO: 762671 - protein, 17 aa, Mycobacterium
DGSTWRVEIERAHMEED

SEQ ID NO: 762672 - protein, 23 aa, Mycobacterium
DGSVCKWARVLICEPPDRVVFTW

SEQ ID NO: 762673 - protein, 24 aa, Mycobacterium
DGSWWWELADDFDFGKHVTVVDLK

SEQ ID NO: 762674 - protein, 26 aa, Mycobacterium
DGTARPALEGGLNWPLDLTVGTDGDL

SEQ ID NO: 762675 - protein, 17 aa, Mycobacterium
DGTEVFDITGIEAINDG

SEQ ID NO: 762676 - protein, 23 aa, Mycobacterium
DGTPLPLQWGRYVPGKLVAAPYG

SEQ ID NO: 762677 - protein, 23 aa, Mycobacterium
DGTRIPVSIVHRADIEFPAPAVI

SEQ ID NO: 762678 - protein, 18 aa, Mycobacterium
DGTTWRIEIERAHMEEDT

SEQ ID NO: 762679 - protein, 17 aa, Mycobacterium
DGVGLDEYVDWLVDAGC

SEQ ID NO: 762680 - protein, 18 aa, Mycobacterium
DGVIFHRVIEGFMIQGGD

SEQ ID NO: 762681 - protein, 18 aa, Mycobacterium
DGVMRWLEERGRGVPLSG

SEQ ID NO: 762682 - protein, 26 aa, Mycobacterium
DGVPRWRKGSGLGWLTAEYAMLPSAT

SEQ ID NO: 762683 - protein, 20 aa, Mycobacterium
DGVRRLALRAAELSPEAQQD

SEQ ID NO: 762684 - protein, 20 aa, Mycobacterium
DGVSYGHTWLAPRDTTLALI

SEQ ID NO: 762685 - protein, 17 aa, Mycobacterium
DGVVAWACNDRPHLEQA

SEQ ID NO: 762686 - protein, 25 aa, Mycobacterium
DGVWARLKFEGGVHRVQRVPVTESQ

SEQ ID NO: 762687 - protein, 18 aa, Mycobacterium
DGVWWWTRSDGFLQLAPA

SEQ ID NO: 762688 - protein, 18 aa, Mycobacterium
DGVYDLGGQAARVVGKLR

SEQ ID NO: 762689 - protein, 17 aa, Mycobacterium
DGWLRLQMITNRGVKVW

SEQ ID NO: 762690 - protein, 20 aa, Mycobacterium
DGWLRPVPPGVVGELYVAGA

SEQ ID NO: 762691 - protein, 17 aa, Mycobacterium
DGWLRTGDMGSFDAHGF

SEQ ID NO: 762692 - protein, 19 aa, Mycobacterium
DGWTRLHFEFVCPQYSEVV

SEQ ID NO: 762693 - protein, 23 aa, Mycobacterium
DGYPELLPRITAMTVRDGKVCAV

SEQ ID NO: 762694 - protein, 23 aa, Mycobacterium
DGYPRPGKTVLFLGRYDEPRKGV

SEQ ID NO: 762695 - protein, 17 aa, Mycobacterium
DGYRAVHVIVRYHGRLI

SEQ ID NO: 762696 - protein, 19 aa, Mycobacterium
DGYWRSGDVGTIYPNGYLK

SEQ ID NO: 762697 - protein, 24 aa, Mycobacterium
DHCLDLPGLFVWRRYHPNPPKGKA

SEQ ID NO: 762698 - protein, 24 aa, Mycobacterium
DHCLDLPGLFVWRRYHPSRPDGKA

SEQ ID NO: 762699 - protein, 24 aa, Mycobacterium
DHCLDLPGLFVWRRYHPTPAPERG

SEQ ID NO: 762700 - protein, 24 aa, Mycobacterium
DHCLDLPGLFVWRRYHPTRPLGKA

SEQ ID NO: 762701 - protein, 22 aa, Mycobacterium
DHEARAAYRWMRAHQPVFRDRN

SEQ ID NO: 762702 - protein, 17 aa, Mycobacterium
DHFDVWPGNDWFDKTVT

SEQ ID NO: 762703 - protein, 17 aa, Mycobacterium
DHFLDFFAGRGYRALAL

SEQ ID NO: 762704 - protein, 23 aa, Mycobacterium
DHGRAAVAWVIARTFGDYVTSKV

SEQ ID NO: 762705 - protein, 24 aa, Mycobacterium
DHHLSGGVPVRWSDHHVRACFRCP

SEQ ID NO: 762706 - protein, 19 aa, Mycobacterium
DHIAPRPGRIWLRVTGYGE

SEQ ID NO: 762707 - protein, 18 aa, Mycobacterium
DHLAPYLKVRRLEFADLP

SEQ ID NO: 762708 - protein, 23 aa, Mycobacterium
DHLEMYRRMWVLRLLDMALEEMR

SEQ ID NO: 762709 - protein, 26 aa, Mycobacterium
DHLRRIGELWARFNAVAVDNPHAWIR

SEQ ID NO: 762710 - protein, 21 aa, Mycobacterium
DHLRRLEGIAGQVAGHRSARP

SEQ ID NO: 762711 - protein, 22 aa, Mycobacterium
DHLRVAVLLGAFVGLRVAEVAA

SEQ ID NO: 762712 - protein, 17 aa, Mycobacterium
DHPAGSVLIEFGHTKVM

SEQ ID NO: 762713 - protein, 19 aa, Mycobacterium
DHPAGSVLIEFGHTKVMCT

SEQ ID NO: 762714 - protein, 22 aa, Mycobacterium
DHPRIDCVWEYRQPLEPRNNGA

SEQ ID NO: 762715 - protein, 26 aa, Mycobacterium
DHRKRIGELWARFNAVAVDNPHAWIR

SEQ ID NO: 762716 - protein, 22 aa, Mycobacterium
DHVAARPYGVWVHGNNDTVGAA

SEQ ID NO: 762717 - protein, 17 aa, Mycobacterium
DHYRPSTALQRFIRSRD

SEQ ID NO: 762718 - protein, 17 aa, Mycobacterium
DIADGLAPVAPRDTYKV

SEQ ID NO: 762719 - protein, 22 aa, Mycobacterium
DIAEFLLEWCPRRFEGRPDDAA

SEQ ID NO: 762720 - protein, 22 aa, Mycobacterium
DIAEVLALLGVRPIWDEASRRV

SEQ ID NO: 762721 - protein, 22 aa, Mycobacterium
DIAEVLALLGVRPVWDDASRRV

SEQ ID NO: 762722 - protein, 21 aa, Mycobacterium
DIAEVLALLGVRPVWDEASRR

SEQ ID NO: 762723 - protein, 19 aa, Mycobacterium
DIAGALAWLVSDEARYITG

SEQ ID NO: 762724 - protein, 23 aa, Mycobacterium
DIALPLPIAIIGEWLGLDDSSAA

SEQ ID NO: 762725 - protein, 22 aa, Mycobacterium
DIAPRLGGPIAPCYHAAVDTST

SEQ ID NO: 762726 - protein, 23 aa, Mycobacterium
DIARRARHRPVWIKGFGEHIAFK

SEQ ID NO: 762727 - protein, 22 aa, Mycobacterium
DIAVHFPLYVIMSLLGIPESDF

SEQ ID NO: 762728 - protein, 17 aa, Mycobacterium
DICIYARESHVLVARSP

SEQ ID NO: 762729 - protein, 20 aa, Mycobacterium
DICNRWAAGRFDTGVFKEGQ

SEQ ID NO: 762730 - protein, 20 aa, Mycobacterium
DIDFAFAVGQLFATVPYAQL

SEQ ID NO: 762731 - protein, 22 aa, Mycobacterium
DIDFAFGVGQIFALVPYAQLIL

SEQ ID NO: 762732 - protein, 22 aa, Mycobacterium
DIDFAFGVGQLFATVPYAQLIL

SEQ ID NO: 762733 - protein, 23 aa, Mycobacterium
DIDPAELIAVGWDRLHRQLDAYI

SEQ ID NO: 762734 - protein, 23 aa, Mycobacterium
DIDRGGVFAAFFGTIALLSAEDQ

SEQ ID NO: 762735 - protein, 22 aa, Mycobacterium
DIDRGGVFAAFFGTVALLSPQD

SEQ ID NO: 762736 - protein, 24 aa, Mycobacterium
DIELPKRRLTVFTGVSGSGKSSLV

SEQ ID NO: 762737 - protein, 24 aa, Mycobacterium
DIEVAYRDGVRWVKGLQRLPDDAT

SEQ ID NO: 762738 - protein, 19 aa, Mycobacterium
DIEVPFRFVYSVDAPHLEV

SEQ ID NO: 762739 - protein, 19 aa, Mycobacterium
DIFITIIMGLVFQTKYLNG

SEQ ID NO: 762740 - protein, 19 aa, Mycobacterium
DIGCGWGACLDRAMRKFDV

SEQ ID NO: 762741 - protein, 18 aa, Mycobacterium
DIGCGWGACMARAAEKYD

SEQ ID NO: 762742 - protein, 18 aa, Mycobacterium
DIGCGWGATIARALERYD

SEQ ID NO: 762743 - protein, 17 aa, Mycobacterium
DIGCGWGGALKRAVERY

SEQ ID NO: 762744 - protein, 19 aa, Mycobacterium
DIIAAPAWDALRKNHDQIG

SEQ ID NO: 762745 - protein, 20 aa, Mycobacterium
DIIGRIGIESVRDRLTEAIE

SEQ ID NO: 762746 - protein, 23 aa, Mycobacterium
DIISMHMGWGWGGYGVGPLKFAH

SEQ ID NO: 762747 - protein, 21 aa, Mycobacterium
DIKLRACDRIEPGPRQVEVRV

SEQ ID NO: 762748 - protein, 19 aa, Mycobacterium
DIKRELCLATGVLNEDGVA

SEQ ID NO: 762749 - protein, 22 aa, Mycobacterium
DILELPLPVIIAVNGHVRAGGF

SEQ ID NO: 762750 - protein, 17 aa, Mycobacterium
DILGGLLTLAAKVHYRL

SEQ ID NO: 762751 - protein, 17 aa, Mycobacterium
DILPVSVGFPFGLSVIF

SEQ ID NO: 762752 - protein, 18 aa, Mycobacterium
DIPNDFVVGYGLDYDERY

SEQ ID NO: 762753 - protein, 24 aa, Mycobacterium
DIPSPLEWGCFTFGIIQSENHFTF

SEQ ID NO: 762754 - protein, 20 aa, Mycobacterium
DIPSRFAVIPRRGGTEDIRW

SEQ ID NO: 762755 - protein, 17 aa, Mycobacterium
DIQRSLPVFGWQDQHGH

SEQ ID NO: 762756 - protein, 22 aa, Mycobacterium
DIRAIPTLMAFKKGTPVLNRAG

SEQ ID NO: 762757 - protein, 20 aa, Mycobacterium
DIRALYAFKRLAWWPYSVAM

SEQ ID NO: 762758 - protein, 18 aa, Mycobacterium
DIRARFVVMASGPFHRPK

SEQ ID NO: 762759 - protein, 19 aa, Mycobacterium
DIRARFVVMASGSFNRPKL

SEQ ID NO: 762760 - protein, 21 aa, Mycobacterium
DIRGRIAVEVSRRITASLGPG

SEQ ID NO: 762761 - protein, 23 aa, Mycobacterium
DIRRPPEEWLFKAAFSVDGPVLI

SEQ ID NO: 762762 - protein, 17 aa, Mycobacterium
DIRSIPTLMAFKKGKLV

SEQ ID NO: 762763 - protein, 18 aa, Mycobacterium
DISAKKSEPEWMLDIRLK

SEQ ID NO: 762764 - protein, 17 aa, Mycobacterium
DISGKKNEPEWMLDIRL

SEQ ID NO: 762765 - protein, 17 aa, Mycobacterium
DISQALRAHGWQVPAYT

SEQ ID NO: 762766 - protein, 19 aa, Mycobacterium
DIVLFPAWVRRNPLKPSLL

SEQ ID NO: 762767 - protein, 21 aa, Mycobacterium
DIVLFPAWVRRSPVEPSPLDP

SEQ ID NO: 762768 - protein, 27 aa, Mycobacterium
DIVNWKWTDIPGALGFTDHLAFRVRTY

SEQ ID NO: 762769 - protein, 19 aa, Mycobacterium
DIVSWRWTDVPGALGVTNH

SEQ ID NO: 762770 - protein, 24 aa, Mycobacterium
DIWRRPDLAPGRRAPVLIQVPGGA

SEQ ID NO: 762771 - protein, 20 aa, Mycobacterium
DKAIKSVVPLLVGGLQANAD

SEQ ID NO: 762772 - protein, 24 aa, Mycobacterium
DKAIRLFWERGFEATSTRDLSSAL

SEQ ID NO: 762773 - protein, 18 aa, Mycobacterium
DKARELADEFGIDTEKVG

SEQ ID NO: 762774 - protein, 22 aa, Mycobacterium
DKDFWLQVGIDPIRIMTSSGTF

SEQ ID NO: 762775 - protein, 17 aa, Mycobacterium
DKFVGLVVVDRGHPRVA

SEQ ID NO: 762776 - protein, 20 aa, Mycobacterium
DKGPEVWRIRITKLTSTPPP

SEQ ID NO: 762777 - protein, 18 aa, Mycobacterium
DKGQPCWPDGVVGSLTHC

SEQ ID NO: 762778 - protein, 18 aa, Mycobacterium
DKGRPVMVWADIGELPYL

SEQ ID NO: 762779 - protein, 17 aa, Mycobacterium
DKGRWAFTYATVGDRIT

SEQ ID NO: 762780 - protein, 18 aa, Mycobacterium
DKIRCPWHGFDFDPFTGE

SEQ ID NO: 762781 - protein, 19 aa, Mycobacterium
DKIRTGARVHVHWADEPQG

SEQ ID NO: 762782 - protein, 18 aa, Mycobacterium
DKLAKWSVPLLRMGGRML

SEQ ID NO: 762783 - protein, 22 aa, Mycobacterium
DKLDLRSGITFNTRVVSAVLDE

SEQ ID NO: 762784 - protein, 26 aa, Mycobacterium
DKLETLRGWTFHRLEVLAVRLRGQSK

SEQ ID NO: 762785 - protein, 21 aa, Mycobacterium
DKLGGTCLHRGCIPTKALLHT

SEQ ID NO: 762786 - protein, 23 aa, Mycobacterium
DKLGSLLIRRGWVPVHIHFEDLS

SEQ ID NO: 762787 - protein, 20 aa, Mycobacterium
DKLTRWSVPFLRDGGRMLPI

SEQ ID NO: 762788 - protein, 19 aa, Mycobacterium
DKLYLPGLVKLRRLVDEGF

SEQ ID NO: 762789 - protein, 18 aa, Mycobacterium
DKMEVWAWTIVDRSMPEE

SEQ ID NO: 762790 - protein, 18 aa, Mycobacterium
DKPFWWGHFDRLNYPLDE

SEQ ID NO: 762791 - protein, 18 aa, Mycobacterium
DKPFWWSHFDRLNYPIDE

SEQ ID NO: 762792 - protein, 19 aa, Mycobacterium
DKRSMPIITEPGGLGPPGT

SEQ ID NO: 762793 - protein, 18 aa, Mycobacterium
DKRVELYFPGDRALAGHH

SEQ ID NO: 762794 - protein, 23 aa, Mycobacterium
DKSRLRLGLFGAKFPKEPLLRAL

SEQ ID NO: 762795 - protein, 18 aa, Mycobacterium
DKVDTRISVVGLNNTITY

SEQ ID NO: 762796 - protein, 18 aa, Mycobacterium
DKVFVVACGTAFHSGLLA

SEQ ID NO: 762797 - protein, 17 aa, Mycobacterium
DKVLPLYLPTGLPSCEG

SEQ ID NO: 762798 - protein, 20 aa, Mycobacterium
DKVVRWWLPERWTFVDEIPR

SEQ ID NO: 762799 - protein, 17 aa, Mycobacterium
DKWRGIEAPVMIVASGK

SEQ ID NO: 762800 - protein, 23 aa, Mycobacterium
DKYARLYAWLGLWERRTDLAVIP

SEQ ID NO: 762801 - protein, 21 aa, Mycobacterium
DLAAIGVRWELPVVWQSDRAP

SEQ ID NO: 762802 - protein, 18 aa, Mycobacterium
DLADRPAFRVAMVRTAEN

SEQ ID NO: 762803 - protein, 21 aa, Mycobacterium
DLADWRWGIDVNVLGVIHGIK

SEQ ID NO: 762804 - protein, 17 aa, Mycobacterium
DLAGRPPFRAALIRAAD

SEQ ID NO: 762805 - protein, 19 aa, Mycobacterium
DLAHGWVPPGLMLPEGVQL

SEQ ID NO: 762806 - protein, 18 aa, Mycobacterium
DLALAGGCALLLEPNGSV

SEQ ID NO: 762807 - protein, 22 aa, Mycobacterium
DLALLVKLDWLFTGSGDRWTEN

SEQ ID NO: 762808 - protein, 19 aa, Mycobacterium
DLALRCVMLLEDRGSIEVG

SEQ ID NO: 762809 - protein, 21 aa, Mycobacterium
DLAQWGAGFVPVIGGLVSAQI

SEQ ID NO: 762810 - protein, 17 aa, Mycobacterium
DLARLGHRVPLVGQAAG

SEQ ID NO: 762811 - protein, 18 aa, Mycobacterium
DLARLMRLPVMFAQLDDQ

SEQ ID NO: 762812 - protein, 22 aa, Mycobacterium
DLARRARHRPVWVKGFGEHVPF

SEQ ID NO: 762813 - protein, 24 aa, Mycobacterium
DLARRGRHRPVWIKGFGEHIAFKT

SEQ ID NO: 762814 - protein, 20 aa, Mycobacterium
DLASRLAAALGLSPVTNPVA

SEQ ID NO: 762815 - protein, 19 aa, Mycobacterium
DLAWQPPLWRALVARVDAV

SEQ ID NO: 762816 - protein, 18 aa, Mycobacterium
DLAWSRVTYWRALLAAAV

SEQ ID NO: 762817 - protein, 18 aa, Mycobacterium
DLCVTAFAGFAVVKPQVA

SEQ ID NO: 762818 - protein, 23 aa, Mycobacterium
DLDDEIFCVAALFHDSGTADEYN

SEQ ID NO: 762819 - protein, 24 aa, Mycobacterium
DLDDWKCWARWRLIRSRAPWLTRD

SEQ ID NO: 762820 - protein, 24 aa, Mycobacterium
DLDHWRWMWETNVIGTLRVTRALL

SEQ ID NO: 762821 - protein, 24 aa, Mycobacterium
DLDHWRWMWETNVLGTLRVTRALL

SEQ ID NO: 762822 - protein, 17 aa, Mycobacterium
DLDLNWLSSDPFYRDSL

SEQ ID NO: 762823 - protein, 18 aa, Mycobacterium
DLDLPRDALIVFTGLSGS

SEQ ID NO: 762824 - protein, 21 aa, Mycobacterium
DLDLRLVRYFTVVAEQRHFGR

SEQ ID NO: 762825 - protein, 22 aa, Mycobacterium
DLDPGLAIARWGIAYAVGPNYN

SEQ ID NO: 762826 - protein, 23 aa, Mycobacterium
DLDRPATGLLFFLASSRILNRRK

SEQ ID NO: 762827 - protein, 17 aa, Mycobacterium
DLDRPKLVFVFDEAHLL

SEQ ID NO: 762828 - protein, 24 aa, Mycobacterium
DLDWRAAFAGLRARTVTLPTYSFA

SEQ ID NO: 762829 - protein, 20 aa, Mycobacterium
DLDYWRPLMADLPEPLELPG

SEQ ID NO: 762830 - protein, 22 aa, Mycobacterium
DLEAWPRWGLTVAKAEMDGSAF

SEQ ID NO: 762831 - protein, 23 aa, Mycobacterium
DLEGRLPFELQRAVLSNGSVILE

SEQ ID NO: 762832 - protein, 24 aa, Mycobacterium
DLEHWRWMWETNVLGTLRVTRALL

SEQ ID NO: 762833 - protein, 24 aa, Mycobacterium
DLEHWRWMWETNVMGTLRVTRALL

SEQ ID NO: 762834 - protein, 24 aa, Mycobacterium
DLEHWRWMWETNVVGTLQVTRALL

SEQ ID NO: 762835 - protein, 17 aa, Mycobacterium
DLELGLAVLRAWNDWHL

SEQ ID NO: 762836 - protein, 23 aa, Mycobacterium
DLELPAGHGYCWFAGEAAESRAV

SEQ ID NO: 762837 - protein, 18 aa, Mycobacterium
DLERRVAGFLGFTDMFTS

SEQ ID NO: 762838 - protein, 20 aa, Mycobacterium
DLETDWPIRAAVLTTAEHHV

SEQ ID NO: 762839 - protein, 19 aa, Mycobacterium
DLEVARLLSNWATTESDPL

SEQ ID NO: 762840 - protein, 25 aa, Mycobacterium
DLEVWKSWARWRVIRARAAWLTDEV

SEQ ID NO: 762841 - protein, 25 aa, Mycobacterium
DLEVWKSWARWRVIRARASWLTDEL

SEQ ID NO: 762842 - protein, 19 aa, Mycobacterium
DLFPLRGAIVGANRVAELT

SEQ ID NO: 762843 - protein, 18 aa, Mycobacterium
DLGCGFPLLTTKKVHFKS

SEQ ID NO: 762844 - protein, 24 aa, Mycobacterium
DLGFRMPSIWFADGHRAVAPVYLY

SEQ ID NO: 762845 - protein, 18 aa, Mycobacterium
DLGGWGLSTEEFFDLVMA

SEQ ID NO: 762846 - protein, 18 aa, Mycobacterium
DLGLSYPALRAIRADVIL

SEQ ID NO: 762847 - protein, 17 aa, Mycobacterium
DLGRSAAGFALWHNDIG

SEQ ID NO: 762848 - protein, 22 aa, Mycobacterium
DLGRSAAGYALWAKGIDEYPEL

SEQ ID NO: 762849 - protein, 19 aa, Mycobacterium
DLGTVPMWRAFANSCNTTF

SEQ ID NO: 762850 - protein, 17 aa, Mycobacterium
DLGVPVYFCDSRSPWQR

SEQ ID NO: 762851 - protein, 17 aa, Mycobacterium
DLHESRRKLAIDLGATH

SEQ ID NO: 762852 - protein, 21 aa, Mycobacterium
DLHRARLALCQATRQVIANGL

SEQ ID NO: 762853 - protein, 17 aa, Mycobacterium
DLIPAWNLLSAPAREQF

SEQ ID NO: 762854 - protein, 17 aa, Mycobacterium
DLIREMMDWAACEHVPD

SEQ ID NO: 762855 - protein, 17 aa, Mycobacterium
DLIREMMDWAACEHVTD

SEQ ID NO: 762856 - protein, 19 aa, Mycobacterium
DLIRPRPPVSVALTDAQGL

SEQ ID NO: 762857 - protein, 21 aa, Mycobacterium
DLISWKVRVGDEVKLNQVLAD

SEQ ID NO: 762858 - protein, 24 aa, Mycobacterium
DLITPRPALTVPLADALGLALAAD

SEQ ID NO: 762859 - protein, 23 aa, Mycobacterium
DLKGKLLGLPVCRLLGMAHPAVP

SEQ ID NO: 762860 - protein, 18 aa, Mycobacterium
DLKMAATLVDVYANPLLT

SEQ ID NO: 762861 - protein, 20 aa, Mycobacterium
DLKRFGEWLTIFAGWKSEVP

SEQ ID NO: 762862 - protein, 17 aa, Mycobacterium
DLKSGVLSRVWHGIYGR

SEQ ID NO: 762863 - protein, 18 aa, Mycobacterium
DLKWAAGISPILGTSLRG

SEQ ID NO: 762864 - protein, 19 aa, Mycobacterium
DLLAGVAIVVVRILGGYRA

SEQ ID NO: 762865 - protein, 19 aa, Mycobacterium
DLLAHCLRQLVARSGVDPV

SEQ ID NO: 762866 - protein, 19 aa, Mycobacterium
DLLATATMDLDRIGNAINA

SEQ ID NO: 762867 - protein, 24 aa, Mycobacterium
DLLDEAWWFPAIQWPDGRMQFMLN

SEQ ID NO: 762868 - protein, 21 aa, Mycobacterium
DLLDIMKTWWALRNEPNVLLL

SEQ ID NO: 762869 - protein, 17 aa, Mycobacterium
DLLERFRDLIVLQAVPD

SEQ ID NO: 762870 - protein, 19 aa, Mycobacterium
DLLGERRFELALTHSPIGM

SEQ ID NO: 762871 - protein, 26 aa, Mycobacterium
DLLPILRIPGDTAFNVANVIRTPTDT

SEQ ID NO: 762872 - protein, 23 aa, Mycobacterium
DLLRFCLEHGYQLRVIEQMPLDA

SEQ ID NO: 762873 - protein, 17 aa, Mycobacterium
DLLRFTGPFNFSGSPTI

SEQ ID NO: 762874 - protein, 18 aa, Mycobacterium
DLLVKRADALGVQTRYET

SEQ ID NO: 762875 - protein, 19 aa, Mycobacterium
DLLWGLAVDAGFYSDQHRT

SEQ ID NO: 762876 - protein, 17 aa, Mycobacterium
DLMLAFSTGNRGIPPYA

SEQ ID NO: 762877 - protein, 23 aa, Mycobacterium
DLMLRAPFRLARDVLPHMRPGSA

SEQ ID NO: 762878 - protein, 24 aa, Mycobacterium
DLMSAWQWLHFRFGLPKPPLEPLA

SEQ ID NO: 762879 - protein, 21 aa, Mycobacterium
DLPADLFGPVANLKDWEVANS

SEQ ID NO: 762880 - protein, 19 aa, Mycobacterium
DLPAGWKVGEGMAIAMIAT

SEQ ID NO: 762881 - protein, 25 aa, Mycobacterium
DLPARTRLAAAWARANQRLLEAGAE

SEQ ID NO: 762882 - protein, 19 aa, Mycobacterium
DLPFAFARFCGAEGIENVT

SEQ ID NO: 762883 - protein, 24 aa, Mycobacterium
DLPGELMTALSQGLAQFGINLPPL

SEQ ID NO: 762884 - protein, 21 aa, Mycobacterium
DLPGFRPPTAIGHTGELLSMR

SEQ ID NO: 762885 - protein, 18 aa, Mycobacterium
DLPPRYPIVGGHEGSGVI

SEQ ID NO: 762886 - protein, 18 aa, Mycobacterium
DLPPYKGRWPEIWVAAHG

SEQ ID NO: 762887 - protein, 25 aa, Mycobacterium
DLPRLADRLDLPAGWSYQPRVLTEE

SEQ ID NO: 762888 - protein, 19 aa, Mycobacterium
DLPRLLSLYKRGELKLKEL

SEQ ID NO: 762889 - protein, 20 aa, Mycobacterium
DLPSAIYHRFARVHSYAAVH

SEQ ID NO: 762890 - protein, 20 aa, Mycobacterium
DLPSRFAVVPRRGGDIKWFE

SEQ ID NO: 762891 - protein, 20 aa, Mycobacterium
DLPSWQWESLITKPTRLVAV

SEQ ID NO: 762892 - protein, 19 aa, Mycobacterium
DLPTALLLRRNRIDDPDAR

SEQ ID NO: 762893 - protein, 18 aa, Mycobacterium
DLPVGGWGQRPTAEFGYL

SEQ ID NO: 762894 - protein, 18 aa, Mycobacterium
DLQDIIAILGIDELAEED

SEQ ID NO: 762895 - protein, 24 aa, Mycobacterium
DLQHWRWMWETNVLGTLRVTRALL

SEQ ID NO: 762896 - protein, 18 aa, Mycobacterium
DLQTRLTAVQARIPAADG

SEQ ID NO: 762897 - protein, 17 aa, Mycobacterium
DLRADWPTPLKAAGFDP

SEQ ID NO: 762898 - protein, 25 aa, Mycobacterium
DLRALSLPVLRSWLATAAGAGAART

SEQ ID NO: 762899 - protein, 20 aa, Mycobacterium
DLRARLQLMVDFMATRTAFF

SEQ ID NO: 762900 - protein, 18 aa, Mycobacterium
DLRCIFIEANPAYFCSLR

SEQ ID NO: 762901 - protein, 18 aa, Mycobacterium
DLRDDWPAALRAAGFDAA

SEQ ID NO: 762902 - protein, 18 aa, Mycobacterium
DLRDTWAIREVPLHILLD

SEQ ID NO: 762903 - protein, 17 aa, Mycobacterium
DLREDWPAALRAAGFDP

SEQ ID NO: 762904 - protein, 19 aa, Mycobacterium
DLREDWPAALRAAGFDPTK

SEQ ID NO: 762905 - protein, 19 aa, Mycobacterium
DLREDWPAALRAAGFDPTR

SEQ ID NO: 762906 - protein, 21 aa, Mycobacterium
DLRGQIARLARFFSIDPASLR

SEQ ID NO: 762907 - protein, 17 aa, Mycobacterium
DLRGRVLLAERLGRNIE

SEQ ID NO: 762908 - protein, 18 aa, Mycobacterium
DLRLTRRFLGHLTDEQLL

SEQ ID NO: 762909 - protein, 25 aa, Mycobacterium
DLRPEWSLPSEEEFTFGYDDGDIDA

SEQ ID NO: 762910 - protein, 23 aa, Mycobacterium
DLRPLRPAILYGIDTRASEEIEA

SEQ ID NO: 762911 - protein, 17 aa, Mycobacterium
DLRQNWPKALIEAGLDT

SEQ ID NO: 762912 - protein, 21 aa, Mycobacterium
DLRQRIGMVFQHFNLFPHRNV

SEQ ID NO: 762913 - protein, 17 aa, Mycobacterium
DLRTRLDAALAKPAAQQ

SEQ ID NO: 762914 - protein, 18 aa, Mycobacterium
DLRWHDLRHSGAVLAAAT

SEQ ID NO: 762915 - protein, 24 aa, Mycobacterium
DLSIPTRMGQWWYYARSFEGKQYG

SEQ ID NO: 762916 - protein, 22 aa, Mycobacterium
DLSRIHSVASFFVSRVDTEIDN

SEQ ID NO: 762917 - protein, 17 aa, Mycobacterium
DLSRLAEDVILWSSTEF

SEQ ID NO: 762918 - protein, 18 aa, Mycobacterium
DLSRSWARVDLDATIADW

SEQ ID NO: 762919 - protein, 17 aa, Mycobacterium
DLSSLRLLGSVGEPINP

SEQ ID NO: 762920 - protein, 18 aa, Mycobacterium
DLTLKFGGLQALDGVSFD

SEQ ID NO: 762921 - protein, 18 aa, Mycobacterium
DLTSFQWLGPSSAAMIAS

SEQ ID NO: 762922 - protein, 23 aa, Mycobacterium
DLVFAWRACRAVKSNAIVIVADG

SEQ ID NO: 762923 - protein, 18 aa, Mycobacterium
DLVIAVHLRGHFLLTRNA

SEQ ID NO: 762924 - protein, 23 aa, Mycobacterium
DLVPEYIGNLLLYFQPDSTATML

SEQ ID NO: 762925 - protein, 20 aa, Mycobacterium
DLVSLVMDWNRPVKMFIETK

SEQ ID NO: 762926 - protein, 22 aa, Mycobacterium
DLVWDFRLPRVVSINVSGHKYG

SEQ ID NO: 762927 - protein, 19 aa, Mycobacterium
DLVYTGIGALCWLPDIRRW

SEQ ID NO: 762928 - protein, 17 aa, Mycobacterium
DLWSAATGLGWTGLALA

SEQ ID NO: 762929 - protein, 17 aa, Mycobacterium
DLYDLKTLWTIASTNPW

SEQ ID NO: 762930 - protein, 22 aa, Mycobacterium
DMDQRLVGMIARIVETYGKYNS

SEQ ID NO: 762931 - protein, 24 aa, Mycobacterium
DMGRWAGKEWDHFLHGTPVGRILN

SEQ ID NO: 762932 - protein, 23 aa, Mycobacterium
DMIRFGSLFLRDGVSLTGQQVVP

SEQ ID NO: 762933 - protein, 18 aa, Mycobacterium
DMIVCGGVEGMIEALPIA

SEQ ID NO: 762934 - protein, 22 aa, Mycobacterium
DMKLPISLALGWPDRVPGVAAA

SEQ ID NO: 762935 - protein, 24 aa, Mycobacterium
DMKLPISLALGWPRRVPGAARYCD

SEQ ID NO: 762936 - protein, 24 aa, Mycobacterium
DMKLPISLALGWPRRVPGAATSCD

SEQ ID NO: 762937 - protein, 19 aa, Mycobacterium
DMLASAAADVAGIGSSVGA

SEQ ID NO: 762938 - protein, 29 aa, Mycobacterium
DMLDEMRATAGWRRYPMRLISPLARRFLK

SEQ ID NO: 762939 - protein, 22 aa, Mycobacterium
DMLEMLPTPWGLVRSGVAPDHP

SEQ ID NO: 762940 - protein, 17 aa, Mycobacterium
DMLTEWRSALAGSVATT

SEQ ID NO: 762941 - protein, 18 aa, Mycobacterium
DMMGRPWLTRTAESALNP

SEQ ID NO: 762942 - protein, 22 aa, Mycobacterium
DMPEVAMPLVFRLLGETGSHAS

SEQ ID NO: 762943 - protein, 18 aa, Mycobacterium
DMRRAIAVLGQISAEGMR

SEQ ID NO: 762944 - protein, 22 aa, Mycobacterium
DMSEALPLLARRLRDPHELPGA

SEQ ID NO: 762945 - protein, 22 aa, Mycobacterium
DMSMARLLYWGCDVWLNNPLRP

SEQ ID NO: 762946 - protein, 18 aa, Mycobacterium
DMSRRYAADFGFTSYDPA

SEQ ID NO: 762947 - protein, 23 aa, Mycobacterium
DMSWKDFDWLIGINIGGVVNGTK

SEQ ID NO: 762948 - protein, 20 aa, Mycobacterium
DNALKLLLLLGERPEIRLSE

SEQ ID NO: 762949 - protein, 20 aa, Mycobacterium
DNALKLLLLLGERPQIRLSE

SEQ ID NO: 762950 - protein, 18 aa, Mycobacterium
DNCWVFRNTINDEYAGPR

SEQ ID NO: 762951 - protein, 21 aa, Mycobacterium
DNEFRVVLARRGQHWVSAVRV

SEQ ID NO: 762952 - protein, 22 aa, Mycobacterium
DNGLIPLRWALACLLADIGSTA

SEQ ID NO: 762953 - protein, 19 aa, Mycobacterium
DNGRIVLMFCSFDKRCRII

SEQ ID NO: 762954 - protein, 17 aa, Mycobacterium
DNIRFFAGAARRLPGQA

SEQ ID NO: 762955 - protein, 21 aa, Mycobacterium
DNLRHMVRFAAAVRAALEDGY

SEQ ID NO: 762956 - protein, 20 aa, Mycobacterium
DNLRHTVRFAAAVQAALDDG

SEQ ID NO: 762957 - protein, 17 aa, Mycobacterium
DNLRHTVRFGAAVQAAL

SEQ ID NO: 762958 - protein, 20 aa, Mycobacterium
DNLRHTVRFGAAVQAALEDG

SEQ ID NO: 762959 - protein, 17 aa, Mycobacterium
DNPDRWAPPYAEAGAYN

SEQ ID NO: 762960 - protein, 19 aa, Mycobacterium
DNPHVDACFIVRSQSVHRI

SEQ ID NO: 762961 - protein, 25 aa, Mycobacterium
DNPWLTGLCTMRWAGRLLPAASRKL

SEQ ID NO: 762962 - protein, 25 aa, Mycobacterium
DNRAWRLYRRLGFTDILRGYYFAGD

SEQ ID NO: 762963 - protein, 24 aa, Mycobacterium
DNRIWQCPVVLLADIRSVGVQGDN

SEQ ID NO: 762964 - protein, 21 aa, Mycobacterium
DNRLSGGLYRWQSRYLRAEDQ

SEQ ID NO: 762965 - protein, 21 aa, Mycobacterium
DNSELGWRMEVEHDGDWHFFD

SEQ ID NO: 762966 - protein, 21 aa, Mycobacterium
DNSELGWRMEVEHDGEWSFFD

SEQ ID NO: 762967 - protein, 20 aa, Mycobacterium
DNSTRCGYALMAPSHSGSIV

SEQ ID NO: 762968 - protein, 17 aa, Mycobacterium
DNVFVALSWSKHPAPQT

SEQ ID NO: 762969 - protein, 19 aa, Mycobacterium
DNVIREFIETTGIPFLPMS

SEQ ID NO: 762970 - protein, 17 aa, Mycobacterium
DNWSLKLSEGWPDDADE

SEQ ID NO: 762971 - protein, 18 aa, Mycobacterium
DPAAKWLALQKMTFEVAW

SEQ ID NO: 762972 - protein, 18 aa, Mycobacterium
DPACIPLHHLVTADGEEA

SEQ ID NO: 762973 - protein, 21 aa, Mycobacterium
DPAFDLAFCLNHLLLKRIWKP

SEQ ID NO: 762974 - protein, 23 aa, Mycobacterium
DPALPAARMEFMLGDATPIAAVT

SEQ ID NO: 762975 - protein, 21 aa, Mycobacterium
DPAPPRWVLGVVRRLPWLSVV

SEQ ID NO: 762976 - protein, 21 aa, Mycobacterium
DPDALRPFLLVASFVNPHDIV

SEQ ID NO: 762977 - protein, 22 aa, Mycobacterium
DPDASVLVPVHWATFRLAPHPW

SEQ ID NO: 762978 - protein, 21 aa, Mycobacterium
DPDELRRHIGYVIQGAGLFPH

SEQ ID NO: 762979 - protein, 18 aa, Mycobacterium
DPDLPWPGRLPAPSPAVL

SEQ ID NO: 762980 - protein, 23 aa, Mycobacterium
DPDLRFELCLGVSGVHYPEDTGR

SEQ ID NO: 762981 - protein, 17 aa, Mycobacterium
DPDVSWRLHHQVAVRPE

SEQ ID NO: 762982 - protein, 23 aa, Mycobacterium
DPDWQRFHLIGAMNPVYFALLAR

SEQ ID NO: 762983 - protein, 22 aa, Mycobacterium
DPDYTLGMSWNFLARSTSGIPE

SEQ ID NO: 762984 - protein, 25 aa, Mycobacterium
DPEHALECIQRYGITHGQFVPAMFV

SEQ ID NO: 762985 - protein, 26 aa, Mycobacterium
DPELAWAAVRAWNDWHLEAWAGPYPE

SEQ ID NO: 762986 - protein, 18 aa, Mycobacterium
DPELRRPITELGMVKSID

SEQ ID NO: 762987 - protein, 18 aa, Mycobacterium
DPELRRPITELGMVKSIS

SEQ ID NO: 762988 - protein, 18 aa, Mycobacterium
DPEQGWMLSAVWLHPDNE

SEQ ID NO: 762989 - protein, 23 aa, Mycobacterium
DPETYRPGAILGRNGFDLASYYG

SEQ ID NO: 762990 - protein, 18 aa, Mycobacterium
DPEWLLAHMSDFGTRRCE

SEQ ID NO: 762991 - protein, 24 aa, Mycobacterium
DPGESRFYLSLADELMRRFNGATL

SEQ ID NO: 762992 - protein, 24 aa, Mycobacterium
DPGESRFYLSLGDELMRRFNGATL

SEQ ID NO: 762993 - protein, 20 aa, Mycobacterium
DPGLAAAHWGIAYSVGPNYN

SEQ ID NO: 762994 - protein, 22 aa, Mycobacterium
DPGLDWAVAVGRNASGMPTYWV

SEQ ID NO: 762995 - protein, 19 aa, Mycobacterium
DPGMCDAWMGLAVAGDVSL

SEQ ID NO: 762996 - protein, 24 aa, Mycobacterium
DPGRPRPSLPLAVRPDGVIDPVPM

SEQ ID NO: 762997 - protein, 21 aa, Mycobacterium
DPGSVAYLFSRKGVVTLEKNG

SEQ ID NO: 762998 - protein, 21 aa, Mycobacterium
DPGSVAYLFTRKGVVTLDKNG

SEQ ID NO: 762999 - protein, 21 aa, Mycobacterium
DPGSVSYLFSRKGVVTLDKDG

SEQ ID NO: 763000 - protein, 21 aa, Mycobacterium
DPGSVSYLFSRKGVVTLEKNG

SEQ ID NO: 763001 - protein, 22 aa, Mycobacterium
DPGSVSYLFSRKGVVTLEKNSL

SEQ ID NO: 763002 - protein, 17 aa, Mycobacterium
DPHAWAIPRLMGVAKAA

SEQ ID NO: 763003 - protein, 18 aa, Mycobacterium
DPHPELLNAWGLTVDAEG

SEQ ID NO: 763004 - protein, 23 aa, Mycobacterium
DPHPELLRAWGFDADAAGLARFS

SEQ ID NO: 763005 - protein, 20 aa, Mycobacterium
DPICPFAWVTSRWLLEAAQS

SEQ ID NO: 763006 - protein, 22 aa, Mycobacterium
DPIGRPIFYGRLTEMTDTDFQV

SEQ ID NO: 763007 - protein, 17 aa, Mycobacterium
DPIRLVWTLYEVAICSG

SEQ ID NO: 763008 - protein, 18 aa, Mycobacterium
DPITRIVGSLGIYTKIDF

SEQ ID NO: 763009 - protein, 22 aa, Mycobacterium
DPITRIVGSLGIYTKIDFENRE

SEQ ID NO: 763010 - protein, 19 aa, Mycobacterium
DPKAWLITTAWRRFIDVAR

SEQ ID NO: 763011 - protein, 19 aa, Mycobacterium
DPKDVVWYEAITSYLSGDF

SEQ ID NO: 763012 - protein, 24 aa, Mycobacterium
DPKKRLRTVEAWEVLPDFASVNWH

SEQ ID NO: 763013 - protein, 19 aa, Mycobacterium
DPLKVLGILTERELGKTYF

SEQ ID NO: 763014 - protein, 23 aa, Mycobacterium
DPLLPEVAWSWLVDAINSRTADV

SEQ ID NO: 763015 - protein, 23 aa, Mycobacterium
DPLLPEVAWSWLVDALDARANQV

SEQ ID NO: 763016 - protein, 23 aa, Mycobacterium
DPLLPEVAWSWLVDALEQRAEHV

SEQ ID NO: 763017 - protein, 23 aa, Mycobacterium
DPLLPEVAWSWLVEALESRTEHM

SEQ ID NO: 763018 - protein, 23 aa, Mycobacterium
DPLLPEVAWSWLVEALESRTEHV

SEQ ID NO: 763019 - protein, 21 aa, Mycobacterium
DPLLQWCVAGSIGSEYAADPD

SEQ ID NO: 763020 - protein, 22 aa, Mycobacterium
DPLLWSIPLHWAGVHAGILANS

SEQ ID NO: 763021 - protein, 24 aa, Mycobacterium
DPLMSRLGMMGGPAMGALGSLPGA

SEQ ID NO: 763022 - protein, 22 aa, Mycobacterium
DPLPRTLAWSAAWEMTRDAEMK

SEQ ID NO: 763023 - protein, 17 aa, Mycobacterium
DPLRWLRCLTQYRGTNS

SEQ ID NO: 763024 - protein, 20 aa, Mycobacterium
DPLWDCWKCALGDADGIITI

SEQ ID NO: 763025 - protein, 25 aa, Mycobacterium
DPLWLRRRVGMCFQRPTPFAGTVAD

SEQ ID NO: 763026 - protein, 20 aa, Mycobacterium
DPMYAMKMLTGYDANGSAAP

SEQ ID NO: 763027 - protein, 25 aa, Mycobacterium
DPNYSLRMSWDFLSRSTAGLLDWDD

SEQ ID NO: 763028 - protein, 18 aa, Mycobacterium
DPPFAFDGRIHRVIVDVS

SEQ ID NO: 763029 - protein, 23 aa, Mycobacterium
DPPIWRRIDLRSDLTLDVVHQVL

SEQ ID NO: 763030 - protein, 18 aa, Mycobacterium
DPPLKLVLLETAGQGGTL

SEQ ID NO: 763031 - protein, 20 aa, Mycobacterium
DPPPGLPGVRAFLEGAGVAR

SEQ ID NO: 763032 - protein, 18 aa, Mycobacterium
DPPRGGEVLVRMAVAGIC

SEQ ID NO: 763033 - protein, 17 aa, Mycobacterium
DPPRWLFENGPEFTHYE

SEQ ID NO: 763034 - protein, 23 aa, Mycobacterium
DPPYRGLVSMSFAWPTDDTGGYP

SEQ ID NO: 763035 - protein, 18 aa, Mycobacterium
DPQCARCKQAIGPGWLYL

SEQ ID NO: 763036 - protein, 21 aa, Mycobacterium
DPQGALALWSGWLGTDLSRFD

SEQ ID NO: 763037 - protein, 24 aa, Mycobacterium
DPQHRILLETAWRAVEHSGYAPTD

SEQ ID NO: 763038 - protein, 18 aa, Mycobacterium
DPQHRILMETAWRAVEHS

SEQ ID NO: 763039 - protein, 19 aa, Mycobacterium
DPQHRLLLETAWRAIEHSG

SEQ ID NO: 763040 - protein, 23 aa, Mycobacterium
DPQHRLLLETAWRAVEHSGIAPT

SEQ ID NO: 763041 - protein, 18 aa, Mycobacterium
DPQHRMLLELSWEALERA

SEQ ID NO: 763042 - protein, 22 aa, Mycobacterium
DPQISASMGIQWYRVKLDAEYV

SEQ ID NO: 763043 - protein, 18 aa, Mycobacterium
DPQMAWRYVELDGGDVDG

SEQ ID NO: 763044 - protein, 23 aa, Mycobacterium
DPQQRLALEVSWEALEHAGIPPR

SEQ ID NO: 763045 - protein, 18 aa, Mycobacterium
DPQQRLILEIAWETLESA

SEQ ID NO: 763046 - protein, 18 aa, Mycobacterium
DPQQRLLIEVAWEALEDA

SEQ ID NO: 763047 - protein, 19 aa, Mycobacterium
DPRASIAIVAPAMVSNPSA

SEQ ID NO: 763048 - protein, 23 aa, Mycobacterium
DPREIADIVAIRFALEPPAAGRA

SEQ ID NO: 763049 - protein, 18 aa, Mycobacterium
DPRFGHVVTQDFATYHIS

SEQ ID NO: 763050 - protein, 24 aa, Mycobacterium
DPRGRIRLAQFMLRSDLEPDLEVV

SEQ ID NO: 763051 - protein, 19 aa, Mycobacterium
DPRIKVLLLEAGGSDRNPL

SEQ ID NO: 763052 - protein, 21 aa, Mycobacterium
DPRLRRVFTFQSLYAGVAPQD

SEQ ID NO: 763053 - protein, 23 aa, Mycobacterium
DPRPGLLAHLAFAAGDYGFQRWI

SEQ ID NO: 763054 - protein, 18 aa, Mycobacterium
DPRQRLLLEVAWEALEDA

SEQ ID NO: 763055 - protein, 18 aa, Mycobacterium
DPRVRGHVLALADPATGL

SEQ ID NO: 763056 - protein, 21 aa, Mycobacterium
DPRVTALIDRCRDLAAEIGVD

SEQ ID NO: 763057 - protein, 25 aa, Mycobacterium
DPSASLWLAELWKEAGLPDGVFNVL

SEQ ID NO: 763058 - protein, 22 aa, Mycobacterium
DPTGGWTMTSWDGIPVAPASLP

SEQ ID NO: 763059 - protein, 22 aa, Mycobacterium
DPTGPCLEGWVTLTALAQATTR

SEQ ID NO: 763060 - protein, 18 aa, Mycobacterium
DPTLSAWFRPGEYFGGSL

SEQ ID NO: 763061 - protein, 19 aa, Mycobacterium
DPTRIKVLWALSQGESSVA

SEQ ID NO: 763062 - protein, 18 aa, Mycobacterium
DPTRPGIRSTLLTVADLD

SEQ ID NO: 763063 - protein, 24 aa, Mycobacterium
DPTTARWWPVKDFAGTAAKLIASV

SEQ ID NO: 763064 - protein, 19 aa, Mycobacterium
DPVCPFAWAASRWLLDAAH

SEQ ID NO: 763065 - protein, 20 aa, Mycobacterium
DPVCPFSWVTAHWLLDAAQS

SEQ ID NO: 763066 - protein, 20 aa, Mycobacterium
DPVFLPTVWDAWSAKLAADA

SEQ ID NO: 763067 - protein, 19 aa, Mycobacterium
DPVIPRLFQAMGFLGDGAR

SEQ ID NO: 763068 - protein, 19 aa, Mycobacterium
DPVKLRLGIGYVIQHAGLM

SEQ ID NO: 763069 - protein, 21 aa, Mycobacterium
DPVKLRLGIGYVIQNAGLMPH

SEQ ID NO: 763070 - protein, 22 aa, Mycobacterium
DPVKLRLGIGYVIQSAGLMPHL

SEQ ID NO: 763071 - protein, 23 aa, Mycobacterium
DPVKLRLGIGYVIQSAGLMPHLR

SEQ ID NO: 763072 - protein, 18 aa, Mycobacterium
DPVLRFLAARAFAKAGDI

SEQ ID NO: 763073 - protein, 17 aa, Mycobacterium
DPVRLSLHLGRRHRIGG

SEQ ID NO: 763074 - protein, 18 aa, Mycobacterium
DPWPSAGVRLEMLEEAVE

SEQ ID NO: 763075 - protein, 21 aa, Mycobacterium
DPWPVLRRWAATQPRAAIVER

SEQ ID NO: 763076 - protein, 17 aa, Mycobacterium
DPWRLGFPMAEMSADGT

SEQ ID NO: 763077 - protein, 18 aa, Mycobacterium
DPYCARGALRRVSQRLAD

SEQ ID NO: 763078 - protein, 19 aa, Mycobacterium
DPYCSRYALQRVADRLETA

SEQ ID NO: 763079 - protein, 19 aa, Mycobacterium
DPYGAGWLVDVRVSDVSAL

SEQ ID NO: 763080 - protein, 23 aa, Mycobacterium
DPYRLAGELGMPPWRVQKAQKQA

SEQ ID NO: 763081 - protein, 21 aa, Mycobacterium
DQAALDWHNFVAFRGRELAPE

SEQ ID NO: 763082 - protein, 17 aa, Mycobacterium
DQAEARGAWDIRMEANI

SEQ ID NO: 763083 - protein, 18 aa, Mycobacterium
DQAWCLADVLGAGSYPWV

SEQ ID NO: 763084 - protein, 24 aa, Mycobacterium
DQDDYLRWAVGAFRLATSGVADST

SEQ ID NO: 763085 - protein, 23 aa, Mycobacterium
DQDVWRYFASVAFPSEAMVRNVI

SEQ ID NO: 763086 - protein, 23 aa, Mycobacterium
DQEDYLRWAVGSFRLATSGVDDS

SEQ ID NO: 763087 - protein, 19 aa, Mycobacterium
DQEIKEWIDIGSVPIVQGT

SEQ ID NO: 763088 - protein, 17 aa, Mycobacterium
DQFTHCIDITPTVLEAV

SEQ ID NO: 763089 - protein, 24 aa, Mycobacterium
DQLCGPGGWVRRFVLGNIPVRFPV

SEQ ID NO: 763090 - protein, 19 aa, Mycobacterium
DQLFGWIAFEFGVYRYGLQ

SEQ ID NO: 763091 - protein, 17 aa, Mycobacterium
DQLILAGVYAFSGITAT

SEQ ID NO: 763092 - protein, 18 aa, Mycobacterium
DQLMNWRYTFGGVVRIGG

SEQ ID NO: 763093 - protein, 22 aa, Mycobacterium
DQLMPPYLRFVKGVVDAQDMSL

SEQ ID NO: 763094 - protein, 22 aa, Mycobacterium
DQLNEFFLLLAIAGNETTRNTL

SEQ ID NO: 763095 - protein, 23 aa, Mycobacterium
DQLNEFFLLLAIAGNETTRNTLS

SEQ ID NO: 763096 - protein, 17 aa, Mycobacterium
DQLRLAPTLDWIEAALP

SEQ ID NO: 763097 - protein, 24 aa, Mycobacterium
DQLRRVAHEVGFFYLVGHGVPQDL

SEQ ID NO: 763098 - protein, 22 aa, Mycobacterium
DQLWMCGLPGYSPGDLIDFDFV

SEQ ID NO: 763099 - protein, 23 aa, Mycobacterium
DQQEFRWSRFKNEEPAVMFATVG

SEQ ID NO: 763100 - protein, 17 aa, Mycobacterium
DQQREWILHMAKLSAAL

SEQ ID NO: 763101 - protein, 24 aa, Mycobacterium
DQRLAIADWVYWQHLAVIMNDAVN

SEQ ID NO: 763102 - protein, 22 aa, Mycobacterium
DQRLRRLLMFVARQEPRLNWAI

SEQ ID NO: 763103 - protein, 17 aa, Mycobacterium
DQRLRVIGVTWNDDAAA

SEQ ID NO: 763104 - protein, 19 aa, Mycobacterium
DQTMFRKLFESVIAGHVKV

SEQ ID NO: 763105 - protein, 17 aa, Mycobacterium
DQVRYFLLREVPFGQDG

SEQ ID NO: 763106 - protein, 17 aa, Mycobacterium
DRAALWYGRLHAPDSVV

SEQ ID NO: 763107 - protein, 23 aa, Mycobacterium
DRACSWLPIYHDMGLAFLLTAVL

SEQ ID NO: 763108 - protein, 19 aa, Mycobacterium
DRADLAFLPGQYVNITVPG

SEQ ID NO: 763109 - protein, 17 aa, Mycobacterium
DRAEAVDAWLAERQQAL

SEQ ID NO: 763110 - protein, 18 aa, Mycobacterium
DRALELGCGTGFFLLNLM

SEQ ID NO: 763111 - protein, 20 aa, Mycobacterium
DRARNGLSIVIAPEGTRLDT

SEQ ID NO: 763112 - protein, 23 aa, Mycobacterium
DRARPMWKLTLIEGLSDGRAAVL

SEQ ID NO: 763113 - protein, 17 aa, Mycobacterium
DRARWLYAKAIQHALVS

SEQ ID NO: 763114 - protein, 18 aa, Mycobacterium
DRCRDLAAEIGVDWTATV

SEQ ID NO: 763115 - protein, 22 aa, Mycobacterium
DREFAYGVLRAWLHTLRDRLPV

SEQ ID NO: 763116 - protein, 20 aa, Mycobacterium
DRELKAGGLHQLRGSRDSVE

SEQ ID NO: 763117 - protein, 22 aa, Mycobacterium
DRELWRWVPEHISLHLTRTPHV

SEQ ID NO: 763118 - protein, 19 aa, Mycobacterium
DRERCILCARCTRFSEQIA

SEQ ID NO: 763119 - protein, 24 aa, Mycobacterium
DRERCILCARCTRFSEQIAGDPFI

SEQ ID NO: 763120 - protein, 20 aa, Mycobacterium
DRERCILCARCTRFSNQIAG

SEQ ID NO: 763121 - protein, 17 aa, Mycobacterium
DRFAWSFAGAKHLKGIK

SEQ ID NO: 763122 - protein, 23 aa, Mycobacterium
DRFDAVVCSLVLCSVGDPDRAAA

SEQ ID NO: 763123 - protein, 28 aa, Mycobacterium
DRFLRSREPWVWGPRMLVGLDISASATL

SEQ ID NO: 763124 - protein, 24 aa, Mycobacterium
DRFNELVLRAGLTWQQVAVLRAYA

SEQ ID NO: 763125 - protein, 17 aa, Mycobacterium
DRFPDRFFDVGIAEQHA

SEQ ID NO: 763126 - protein, 22 aa, Mycobacterium
DRFPIDMVRLYFDDHLADESAS

SEQ ID NO: 763127 - protein, 22 aa, Mycobacterium
DRFPIDMVRLYFDGHLGDDAGK

SEQ ID NO: 763128 - protein, 25 aa, Mycobacterium
DRFPWSMKFARAMGSAGIDMNDPVT

SEQ ID NO: 763129 - protein, 24 aa, Mycobacterium
DRGEAIGYAVDWARTGDVVLIAGK

SEQ ID NO: 763130 - protein, 21 aa, Mycobacterium
DRGGTHLAFGFGMHRCLGAFL

SEQ ID NO: 763131 - protein, 18 aa, Mycobacterium
DRGLKFMSACGVVDSNLD

SEQ ID NO: 763132 - protein, 17 aa, Mycobacterium
DRGLRVIGLDAGGDTTL

SEQ ID NO: 763133 - protein, 19 aa, Mycobacterium
DRGLSWLPFFHDMGLITAL

SEQ ID NO: 763134 - protein, 18 aa, Mycobacterium
DRGPGRFFTMRLALSDIG

SEQ ID NO: 763135 - protein, 22 aa, Mycobacterium
DRGRTPVGLCAKVIRRDPRPHR

SEQ ID NO: 763136 - protein, 21 aa, Mycobacterium
DRGVSWLPFFHDMGLITVLLS

SEQ ID NO: 763137 - protein, 17 aa, Mycobacterium
DRGYPLFVENLVSLGAE

SEQ ID NO: 763138 - protein, 24 aa, Mycobacterium
DRHPELKIGWFEGGIAWVPTALQD

SEQ ID NO: 763139 - protein, 17 aa, Mycobacterium
DRHPGLRVGWFEGGIAW

SEQ ID NO: 763140 - protein, 19 aa, Mycobacterium
DRHRPRTLVLCAGAAPRMA

SEQ ID NO: 763141 - protein, 18 aa, Mycobacterium
DRHWPALCRVVGRPEWLA

SEQ ID NO: 763142 - protein, 18 aa, Mycobacterium
DRIFRWQLAAAVRPTLFV

SEQ ID NO: 763143 - protein, 19 aa, Mycobacterium
DRIGVAVEEMVRWASPVMT

SEQ ID NO: 763144 - protein, 20 aa, Mycobacterium
DRIKVSLPFHADHIVTAQQW

SEQ ID NO: 763145 - protein, 23 aa, Mycobacterium
DRILAGAVTLVWQGGQLRHLGAT

SEQ ID NO: 763146 - protein, 17 aa, Mycobacterium
DRILLRFGLHQALRLGK

SEQ ID NO: 763147 - protein, 24 aa, Mycobacterium
DRIRRAHLLLAMFNALQPGVFALS

SEQ ID NO: 763148 - protein, 19 aa, Mycobacterium
DRKIAERRVFPAVDVNPSG

SEQ ID NO: 763149 - protein, 19 aa, Mycobacterium
DRKSLTFALRFRAPDRTLT

SEQ ID NO: 763150 - protein, 17 aa, Mycobacterium
DRLDWARRVLAAARSER

SEQ ID NO: 763151 - protein, 19 aa, Mycobacterium
DRLGCVYTRGGGFLSGVAD

SEQ ID NO: 763152 - protein, 18 aa, Mycobacterium
DRLIRSGQPWSWDIGFML

SEQ ID NO: 763153 - protein, 21 aa, Mycobacterium
DRLNLPDGWRYRARTLDQTVR

SEQ ID NO: 763154 - protein, 23 aa, Mycobacterium
DRLPRPYMLIAMDLQGGMSEPDK

SEQ ID NO: 763155 - protein, 17 aa, Mycobacterium
DRLRLALDADLCGAVTG

SEQ ID NO: 763156 - protein, 17 aa, Mycobacterium
DRLRLALDSSLCGAVTG

SEQ ID NO: 763157 - protein, 19 aa, Mycobacterium
DRLRLALVLCAVRPDIGGV

SEQ ID NO: 763158 - protein, 20 aa, Mycobacterium
DRLRLPLVRSRSGEHVQVSW

SEQ ID NO: 763159 - protein, 17 aa, Mycobacterium
DRLRRIAVFDVLINNAD

SEQ ID NO: 763160 - protein, 17 aa, Mycobacterium
DRLRTRFEWGLITDVQP

SEQ ID NO: 763161 - protein, 27 aa, Mycobacterium
DRLSRGRLRICAGVGWMREEIEACGGD

SEQ ID NO: 763162 - protein, 17 aa, Mycobacterium
DRLVKRAATIVVGPTRD

SEQ ID NO: 763163 - protein, 24 aa, Mycobacterium
DRLVWQCASLLLSYPDDASLDAAA

SEQ ID NO: 763164 - protein, 23 aa, Mycobacterium
DRMAFRSAGYWDLGAELDAGKDN

SEQ ID NO: 763165 - protein, 17 aa, Mycobacterium
DRMGWDLPWVSSGRSTF

SEQ ID NO: 763166 - protein, 17 aa, Mycobacterium
DRMLIGLSVLGLLEEAA

SEQ ID NO: 763167 - protein, 20 aa, Mycobacterium
DRMNSWGGGLARAFYECIDR

SEQ ID NO: 763168 - protein, 17 aa, Mycobacterium
DRMPVLYCKTGVRSAEA

SEQ ID NO: 763169 - protein, 17 aa, Mycobacterium
DRMRPLRVEDHVVHQIW

SEQ ID NO: 763170 - protein, 17 aa, Mycobacterium
DRMWEFLDRLISIALPR

SEQ ID NO: 763171 - protein, 20 aa, Mycobacterium
DRPALEAALAILRDITAGAT

SEQ ID NO: 763172 - protein, 19 aa, Mycobacterium
DRPALEAALGILRDLTAAP

SEQ ID NO: 763173 - protein, 17 aa, Mycobacterium
DRPAMVIADGFFAFLTK

SEQ ID NO: 763174 - protein, 20 aa, Mycobacterium
DRPFLMPVEDVFTITGRGTV

SEQ ID NO: 763175 - protein, 23 aa, Mycobacterium
DRPIADVCPVEWARMADRSVLQW

SEQ ID NO: 763176 - protein, 23 aa, Mycobacterium
DRPIADVCPVEWARMANRSVLQW

SEQ ID NO: 763177 - protein, 21 aa, Mycobacterium
DRPLWECWIIEGLNDNRWAIL

SEQ ID NO: 763178 - protein, 18 aa, Mycobacterium
DRPRWQLTASVEFDDWAG

SEQ ID NO: 763179 - protein, 17 aa, Mycobacterium
DRPTLFTGVEWLGTASA

SEQ ID NO: 763180 - protein, 19 aa, Mycobacterium
DRPTLMIGEGLTMYLTEQD

SEQ ID NO: 763181 - protein, 20 aa, Mycobacterium
DRPWRPDVVHAHDWLVAHPA

SEQ ID NO: 763182 - protein, 21 aa, Mycobacterium
DRPWWEWAATYERAFSAAYDA

SEQ ID NO: 763183 - protein, 17 aa, Mycobacterium
DRQRLATRLGYSETVFV

SEQ ID NO: 763184 - protein, 24 aa, Mycobacterium
DRQRRGVVHIVDLSTAAVVGAIQI

SEQ ID NO: 763185 - protein, 19 aa, Mycobacterium
DRRAHWKNIQFVYQNPDSA

SEQ ID NO: 763186 - protein, 19 aa, Mycobacterium
DRRAKRLIVFDVDSTLIQG

SEQ ID NO: 763187 - protein, 18 aa, Mycobacterium
DRRLELMLVCAHPAIAAN

SEQ ID NO: 763188 - protein, 20 aa, Mycobacterium
DRRPELFDSLVLINPLSKNT

SEQ ID NO: 763189 - protein, 19 aa, Mycobacterium
DRRPMLWLEVMKPMASNAV

SEQ ID NO: 763190 - protein, 21 aa, Mycobacterium
DRSPRAWLFTVARNMIIDERR

SEQ ID NO: 763191 - protein, 19 aa, Mycobacterium
DRTRLRIFFEFTRGADESG

SEQ ID NO: 763192 - protein, 17 aa, Mycobacterium
DRTRPLWQGIWVDRYRD

SEQ ID NO: 763193 - protein, 23 aa, Mycobacterium
DRVARRFARCLLVSPGETAQLEA

SEQ ID NO: 763194 - protein, 18 aa, Mycobacterium
DRVGIAWLRHTCGACRYC

SEQ ID NO: 763195 - protein, 17 aa, Mycobacterium
DRVGIAWLRHTCGVCKY

SEQ ID NO: 763196 - protein, 18 aa, Mycobacterium
DRVGIAWLRHTCGVCKYC

SEQ ID NO: 763197 - protein, 19 aa, Mycobacterium
DRVILMLGNQVELWEAMLG

SEQ ID NO: 763198 - protein, 17 aa, Mycobacterium
DRVKCLHVLIAHSLAKG

SEQ ID NO: 763199 - protein, 17 aa, Mycobacterium
DRVKCLHVLIGHSLAVG

SEQ ID NO: 763200 - protein, 18 aa, Mycobacterium
DRVLLCLPDSPELVQLLL

SEQ ID NO: 763201 - protein, 23 aa, Mycobacterium
DRVNFRIALWAARNMGMREQGGE

SEQ ID NO: 763202 - protein, 23 aa, Mycobacterium
DRVYELFELVGFTDVERRYRQYP

SEQ ID NO: 763203 - protein, 17 aa, Mycobacterium
DRWLLRNRPHAVLDGLR

SEQ ID NO: 763204 - protein, 17 aa, Mycobacterium
DRWLRPVPPGVVGELYV

SEQ ID NO: 763205 - protein, 26 aa, Mycobacterium
DRWQIRWRLGWSFACLEHNVLLLDAC

SEQ ID NO: 763206 - protein, 17 aa, Mycobacterium
DRWYWHWDPQFISGTAA

SEQ ID NO: 763207 - protein, 18 aa, Mycobacterium
DRWYWHWDPQFISGTAAF

SEQ ID NO: 763208 - protein, 20 aa, Mycobacterium
DRYRLVVARACPWANRAIIV

SEQ ID NO: 763209 - protein, 19 aa, Mycobacterium
DRYSHTFSFSALQAALETT

SEQ ID NO: 763210 - protein, 28 aa, Mycobacterium
DSADGVWARLKFEGGVHRVQRVPVTESQ

SEQ ID NO: 763211 - protein, 28 aa, Mycobacterium
DSADGVWSRLKFEGGVHRVQRVPVTESQ

SEQ ID NO: 763212 - protein, 23 aa, Mycobacterium
DSAEIWRWLRGGGITHFSAAPTV

SEQ ID NO: 763213 - protein, 19 aa, Mycobacterium
DSAGFKWLAPYTGSAVAQH

SEQ ID NO: 763214 - protein, 17 aa, Mycobacterium
DSAWLLVSILRQFGLAA

SEQ ID NO: 763215 - protein, 20 aa, Mycobacterium
DSAYPTSDWDSAASDAYLSQ

SEQ ID NO: 763216 - protein, 24 aa, Mycobacterium
DSDAQRAAAAWALADIPLATFLTE

SEQ ID NO: 763217 - protein, 18 aa, Mycobacterium
DSDPRWPLLQAERSALLS

SEQ ID NO: 763218 - protein, 17 aa, Mycobacterium
DSDRRWVVLSADDVTLD

SEQ ID NO: 763219 - protein, 22 aa, Mycobacterium
DSDSRIAAQLAYWEDALAGMPE

SEQ ID NO: 763220 - protein, 22 aa, Mycobacterium
DSEWMGRVHRFLGLDVGVILSG

SEQ ID NO: 763221 - protein, 20 aa, Mycobacterium
DSFQLFPNFVILFWGQGWYL

SEQ ID NO: 763222 - protein, 19 aa, Mycobacterium
DSFRKGDGFEGLWDDVESI

SEQ ID NO: 763223 - protein, 17 aa, Mycobacterium
DSFWRYAKVLALLTDPA

SEQ ID NO: 763224 - protein, 18 aa, Mycobacterium
DSGAQAWLGPVPAETEGL

SEQ ID NO: 763225 - protein, 21 aa, Mycobacterium
DSGARFWGRFGAAGLLLRAPL

SEQ ID NO: 763226 - protein, 19 aa, Mycobacterium
DSGEPWLSLDFHTPAREQF

SEQ ID NO: 763227 - protein, 20 aa, Mycobacterium
DSGLLSGLFGTGGGHGGLGG

SEQ ID NO: 763228 - protein, 17 aa, Mycobacterium
DSIAFRLVFNTMRDSYV

SEQ ID NO: 763229 - protein, 17 aa, Mycobacterium
DSKSAAMGTGFVALAAA

SEQ ID NO: 763230 - protein, 20 aa, Mycobacterium
DSLDCFFVYLARHPDHRHQL

SEQ ID NO: 763231 - protein, 20 aa, Mycobacterium
DSLDCFFVYLARHPEHRRQL

SEQ ID NO: 763232 - protein, 24 aa, Mycobacterium
DSLGGRGGTSWVQAGYGPTTGGKA

SEQ ID NO: 763233 - protein, 25 aa, Mycobacterium
DSLPLEVFLPFAPFYILYDFGPVTV

SEQ ID NO: 763234 - protein, 22 aa, Mycobacterium
DSLRAVILGGDWVSSDLARRLA

SEQ ID NO: 763235 - protein, 18 aa, Mycobacterium
DSLWVYDHFHTVPVPTGE

SEQ ID NO: 763236 - protein, 18 aa, Mycobacterium
DSNVRWLQERGVTIWDEW

SEQ ID NO: 763237 - protein, 17 aa, Mycobacterium
DSPGADVLFAFTGTAAN

SEQ ID NO: 763238 - protein, 24 aa, Mycobacterium
DSPLAGTVRFEWNPLRWFEEDEPV

SEQ ID NO: 763239 - protein, 25 aa, Mycobacterium
DSPWLDITWRDRFEQMLKRAEARLH

SEQ ID NO: 763240 - protein, 21 aa, Mycobacterium
DSQRTIVCWAMGLTQHKHAVP

SEQ ID NO: 763241 - protein, 21 aa, Mycobacterium
DSRAAVCLRFANDVLAELDTR

SEQ ID NO: 763242 - protein, 25 aa, Mycobacterium
DSRAYRLKWPDGMAVYEIDQPKVLQ

SEQ ID NO: 763243 - protein, 22 aa, Mycobacterium
DSRAYRLPWPDGTVVYEIDQPR

SEQ ID NO: 763244 - protein, 21 aa, Mycobacterium
DSRFRPEFCTSMTAFITAEYA

SEQ ID NO: 763245 - protein, 18 aa, Mycobacterium
DSRGRFPGRYRVEVLANL

SEQ ID NO: 763246 - protein, 21 aa, Mycobacterium
DSSIWIGPRFVIPSLAMRARV

SEQ ID NO: 763247 - protein, 22 aa, Mycobacterium
DSSPRTAHEWAPSRDTPALLQY

SEQ ID NO: 763248 - protein, 24 aa, Mycobacterium
DSSRRFSVAVGHRLTPDSEPVLTK

SEQ ID NO: 763249 - protein, 20 aa, Mycobacterium
DSTTRRCCGGIGRHSRTCPT

SEQ ID NO: 763250 - protein, 21 aa, Mycobacterium
DSVFHCPFCHGWEARDRPLAV

SEQ ID NO: 763251 - protein, 24 aa, Mycobacterium
DSVGWLRDFLRAHTGGLIIISHNV

SEQ ID NO: 763252 - protein, 24 aa, Mycobacterium
DSVKYRLGRDVARMEAALSAPGMF

SEQ ID NO: 763253 - protein, 18 aa, Mycobacterium
DSVPRMRGVLALFEGVAT

SEQ ID NO: 763254 - protein, 18 aa, Mycobacterium
DSVSCPRSGELIMRDGNR

SEQ ID NO: 763255 - protein, 17 aa, Mycobacterium
DTAHYLWAWTDRAAGAL

SEQ ID NO: 763256 - protein, 22 aa, Mycobacterium
DTALYRYLWRSVLAFDGAARFR

SEQ ID NO: 763257 - protein, 24 aa, Mycobacterium
DTARRKAPCVLFFDEVDALGHRRS

SEQ ID NO: 763258 - protein, 21 aa, Mycobacterium
DTCPYFPGVTYRDWKLPDPAG

SEQ ID NO: 763259 - protein, 18 aa, Mycobacterium
DTDCRVFRVAGLRVVDAS

SEQ ID NO: 763260 - protein, 20 aa, Mycobacterium
DTDLRWRIVTALASAGEIDA

SEQ ID NO: 763261 - protein, 22 aa, Mycobacterium
DTDLRWRIVTALATAGDIDADG

SEQ ID NO: 763262 - protein, 22 aa, Mycobacterium
DTDLRWRIVTALATAGVIDSDG

SEQ ID NO: 763263 - protein, 24 aa, Mycobacterium
DTDLSWSRITYWRALLASALDQAP

SEQ ID NO: 763264 - protein, 19 aa, Mycobacterium
DTELLDFTALAKVFGYPTT

SEQ ID NO: 763265 - protein, 18 aa, Mycobacterium
DTFARAWFKLTHIDMGPI

SEQ ID NO: 763266 - protein, 17 aa, Mycobacterium
DTFSGPNMSGWWRSNVL

SEQ ID NO: 763267 - protein, 21 aa, Mycobacterium
DTGALLGFHWTKVHSESLGEV

SEQ ID NO: 763268 - protein, 24 aa, Mycobacterium
DTGSFRWASARAHRLAARLVEAGV

SEQ ID NO: 763269 - protein, 25 aa, Mycobacterium
DTGSFRWASARGYRLAARLVEIGVD

SEQ ID NO: 763270 - protein, 23 aa, Mycobacterium
DTGSFRWASPRGLRLAARLVDIG

SEQ ID NO: 763271 - protein, 20 aa, Mycobacterium
DTGSFRWATARAHRLAARLV

SEQ ID NO: 763272 - protein, 20 aa, Mycobacterium
DTHARVGILPTWGLTTLLPL

SEQ ID NO: 763273 - protein, 20 aa, Mycobacterium
DTHARVGLLPTWGLSVRLPQ

SEQ ID NO: 763274 - protein, 22 aa, Mycobacterium
DTHARVGLLPTWGLSVRLPQKV

SEQ ID NO: 763275 - protein, 22 aa, Mycobacterium
DTHARVGLMPTWGLSVRLPQKV

SEQ ID NO: 763276 - protein, 21 aa, Mycobacterium
DTHPFAWLPMLSRVLGSAELV

SEQ ID NO: 763277 - protein, 19 aa, Mycobacterium
DTIPAVAFSAGFSTSLRAL

SEQ ID NO: 763278 - protein, 24 aa, Mycobacterium
DTLIKEKWLTANAVIGFFPANAVG

SEQ ID NO: 763279 - protein, 17 aa, Mycobacterium
DTLLVMSVEPGFGGQSF

SEQ ID NO: 763280 - protein, 19 aa, Mycobacterium
DTLRLEAGMALYGHELSLE

SEQ ID NO: 763281 - protein, 18 aa, Mycobacterium
DTPKALAAIDGWAEDTLS

SEQ ID NO: 763282 - protein, 18 aa, Mycobacterium
DTPMPVRTPLPIQLPEPM

SEQ ID NO: 763283 - protein, 25 aa, Mycobacterium
DTPPQRYAMFMSFSLAAGAGRAELQ

SEQ ID NO: 763284 - protein, 18 aa, Mycobacterium
DTPWWAHDIWDLRADPRI

SEQ ID NO: 763285 - protein, 21 aa, Mycobacterium
DTRLPLTWIALLCGRIRASLA

SEQ ID NO: 763286 - protein, 18 aa, Mycobacterium
DTRLQWYVELGIDPENLR

SEQ ID NO: 763287 - protein, 19 aa, Mycobacterium
DTRLRPGAAVIGWPGEPMA

SEQ ID NO: 763288 - protein, 21 aa, Mycobacterium
DTRPTVIIAYTIKGFGLPTEG

SEQ ID NO: 763289 - protein, 23 aa, Mycobacterium
DTRRRFCDMYRRIVGGGEQHDVP

SEQ ID NO: 763290 - protein, 23 aa, Mycobacterium
DTTPRIAQMFGIQAVPTVVALAG

SEQ ID NO: 763291 - protein, 17 aa, Mycobacterium
DTVRRWINQGALEVSHD

SEQ ID NO: 763292 - protein, 21 aa, Mycobacterium
DTYAQEYQTFGAHMAAFHDQF

SEQ ID NO: 763293 - protein, 24 aa, Mycobacterium
DVAARLRLLIAWTGEHLAETEVND

SEQ ID NO: 763294 - protein, 17 aa, Mycobacterium
DVAARWPVPGPHDDKYT

SEQ ID NO: 763295 - protein, 19 aa, Mycobacterium
DVACGPGLYTRELAAQLGT

SEQ ID NO: 763296 - protein, 18 aa, Mycobacterium
DVAECITLTPGKRAPSVI

SEQ ID NO: 763297 - protein, 17 aa, Mycobacterium
DVAGVLAEYGWRETEQA

SEQ ID NO: 763298 - protein, 18 aa, Mycobacterium
DVALAGGVNVMFQPETFI

SEQ ID NO: 763299 - protein, 26 aa, Mycobacterium
DVALIVGVPMDFRLGFGAVFGQQTQL

SEQ ID NO: 763300 - protein, 26 aa, Mycobacterium
DVALIVGVPMDFRLGFGGVFGPQTQL

SEQ ID NO: 763301 - protein, 26 aa, Mycobacterium
DVALIVGVPMDFRLGFGGVFGSQTQL

SEQ ID NO: 763302 - protein, 17 aa, Mycobacterium
DVALLLRRLEHVPIATA

SEQ ID NO: 763303 - protein, 18 aa, Mycobacterium
DVAPRVAQIFGVDAVPTV

SEQ ID NO: 763304 - protein, 23 aa, Mycobacterium
DVARKSYRPAWCTVREIQPEIKA

SEQ ID NO: 763305 - protein, 22 aa, Mycobacterium
DVARLLAMARMRGAHGVVGELG

SEQ ID NO: 763306 - protein, 22 aa, Mycobacterium
DVARLLSMARMRGAQGVVGELG

SEQ ID NO: 763307 - protein, 17 aa, Mycobacterium
DVARLRAALGHWDITTN

SEQ ID NO: 763308 - protein, 22 aa, Mycobacterium
DVAVLKLSALRGLFSSVIEDQV

SEQ ID NO: 763309 - protein, 20 aa, Mycobacterium
DVAVVYRFIRDATWVSVRWF

SEQ ID NO: 763310 - protein, 19 aa, Mycobacterium
DVCFTWRFGDAPACRALFA

SEQ ID NO: 763311 - protein, 19 aa, Mycobacterium
DVCYGLTYADVRAVHQNGT

SEQ ID NO: 763312 - protein, 18 aa, Mycobacterium
DVDGAVFARVMQVSQLIG

SEQ ID NO: 763313 - protein, 22 aa, Mycobacterium
DVDGPYSWWSWRGKAFDNDAGW

SEQ ID NO: 763314 - protein, 18 aa, Mycobacterium
DVDLRWVILAARIGILRQ

SEQ ID NO: 763315 - protein, 18 aa, Mycobacterium
DVDPSLWGAAEWSVQAQL

SEQ ID NO: 763316 - protein, 23 aa, Mycobacterium
DVDRIVVHLAPWLEPEPICLAIK

SEQ ID NO: 763317 - protein, 19 aa, Mycobacterium
DVDYPYLWRNLTEVVGTVL

SEQ ID NO: 763318 - protein, 18 aa, Mycobacterium
DVEFAGAVAHRLNEAGGR

SEQ ID NO: 763319 - protein, 19 aa, Mycobacterium
DVEGIRWALTQANAAAAGP

SEQ ID NO: 763320 - protein, 19 aa, Mycobacterium
DVERVRWVGGYGRMDSASG

SEQ ID NO: 763321 - protein, 26 aa, Mycobacterium
DVFAPRLSFFWAIGMNFFMEVAKLRA

SEQ ID NO: 763322 - protein, 18 aa, Mycobacterium
DVFLTSFLPAHRKKFGID

SEQ ID NO: 763323 - protein, 18 aa, Mycobacterium
DVFLTSFLPAHRNKFGID

SEQ ID NO: 763324 - protein, 18 aa, Mycobacterium
DVFVDWLIAAGHDIRRIE

SEQ ID NO: 763325 - protein, 21 aa, Mycobacterium
DVGCGWGGAVVRALEKYDVNV

SEQ ID NO: 763326 - protein, 23 aa, Mycobacterium
DVGGKMVRFVVCRKGDRHVVAAR

SEQ ID NO: 763327 - protein, 24 aa, Mycobacterium
DVGRPDLLASIGFTREELAEKLYD

SEQ ID NO: 763328 - protein, 17 aa, Mycobacterium
DVHIGPSDHVGWLDDRK

SEQ ID NO: 763329 - protein, 17 aa, Mycobacterium
DVIDLIRTSQDWWPADY

SEQ ID NO: 763330 - protein, 21 aa, Mycobacterium
DVIGAYRFLQRVWRLVIDENT

SEQ ID NO: 763331 - protein, 19 aa, Mycobacterium
DVIRRLSALGLLVSVTVTS

SEQ ID NO: 763332 - protein, 20 aa, Mycobacterium
DVIRYLRWFTFLSADELGEL

SEQ ID NO: 763333 - protein, 19 aa, Mycobacterium
DVIRYLRWFTFLTADELGE

SEQ ID NO: 763334 - protein, 22 aa, Mycobacterium
DVIRYLRWFTFLVAEELTELEQ

SEQ ID NO: 763335 - protein, 23 aa, Mycobacterium
DVKSRGGQAWGIAAELTDRAAVA

SEQ ID NO: 763336 - protein, 19 aa, Mycobacterium
DVLICATGFKLWDTGAVPP

SEQ ID NO: 763337 - protein, 19 aa, Mycobacterium
DVLICATGFKLWEAGAVPP

SEQ ID NO: 763338 - protein, 18 aa, Mycobacterium
DVLLRAAALLPDVHVVIA

SEQ ID NO: 763339 - protein, 17 aa, Mycobacterium
DVLLWGRLIDKYKGTMT

SEQ ID NO: 763340 - protein, 19 aa, Mycobacterium
DVLPRTGVEVMISIDDGSD

SEQ ID NO: 763341 - protein, 19 aa, Mycobacterium
DVLPWLPVRGVFLLVERGS

SEQ ID NO: 763342 - protein, 17 aa, Mycobacterium
DVLQAQCTFSWPPQMDL

SEQ ID NO: 763343 - protein, 17 aa, Mycobacterium
DVLQGQCTFSWPPRIDL

SEQ ID NO: 763344 - protein, 24 aa, Mycobacterium
DVLQGQCTFSWPPRMDLPGYKPNT

SEQ ID NO: 763345 - protein, 18 aa, Mycobacterium
DVLRHRLVMSYDALADEV

SEQ ID NO: 763346 - protein, 17 aa, Mycobacterium
DVLRLGYNFKDWDLRTA

SEQ ID NO: 763347 - protein, 18 aa, Mycobacterium
DVMLRYNFPGGGLTDDAL

SEQ ID NO: 763348 - protein, 24 aa, Mycobacterium
DVMSGFPLDRGWDVAGLFDPDPDA

SEQ ID NO: 763349 - protein, 22 aa, Mycobacterium
DVNFKGVWLALAAEIAAIRATS

SEQ ID NO: 763350 - protein, 17 aa, Mycobacterium
DVNIFYGKFHAVQDVAL

SEQ ID NO: 763351 - protein, 23 aa, Mycobacterium
DVNRLKRFAVRFSKMVFPGDDLE

SEQ ID NO: 763352 - protein, 22 aa, Mycobacterium
DVPGIRPRPAFTPARPDEFTAL

SEQ ID NO: 763353 - protein, 18 aa, Mycobacterium
DVPHNWVGAPGYLDTVTW

SEQ ID NO: 763354 - protein, 22 aa, Mycobacterium
DVPLKRFDLMNGIQVRGTYAVS

SEQ ID NO: 763355 - protein, 21 aa, Mycobacterium
DVPPELAPLVGRDDDRGTETI

SEQ ID NO: 763356 - protein, 18 aa, Mycobacterium
DVPSLGWRSYRLADGAGG

SEQ ID NO: 763357 - protein, 20 aa, Mycobacterium
DVRAGWDWLVDTCGLPPKHI

SEQ ID NO: 763358 - protein, 19 aa, Mycobacterium
DVRASFLPAIYFEGVGMAG

SEQ ID NO: 763359 - protein, 23 aa, Mycobacterium
DVREGPCLSAAWEQHTIRIDDLT

SEQ ID NO: 763360 - protein, 18 aa, Mycobacterium
DVRGRWIINAAGLGADHL

SEQ ID NO: 763361 - protein, 18 aa, Mycobacterium
DVRMRWCGPEVEVEGIIS

SEQ ID NO: 763362 - protein, 20 aa, Mycobacterium
DVRPAFLLPGFVDAHIHFPQ

SEQ ID NO: 763363 - protein, 17 aa, Mycobacterium
DVRRRPRNILTFSHGAH

SEQ ID NO: 763364 - protein, 24 aa, Mycobacterium
DVRSAWRLLPELQVGIVHLRGRDS

SEQ ID NO: 763365 - protein, 19 aa, Mycobacterium
DVSRIQWRFERLFRHVDVA

SEQ ID NO: 763366 - protein, 18 aa, Mycobacterium
DVTARFVVVAAGPFPEPK

SEQ ID NO: 763367 - protein, 18 aa, Mycobacterium
DVTGEAPDSVFYSTGDAE

SEQ ID NO: 763368 - protein, 23 aa, Mycobacterium
DVTLRGAVSIARRLQDPLAELVK

SEQ ID NO: 763369 - protein, 20 aa, Mycobacterium
DVTLSPGFRERWFSWANPAE

SEQ ID NO: 763370 - protein, 17 aa, Mycobacterium
DVTSAWTRPLGADRRVV

SEQ ID NO: 763371 - protein, 21 aa, Mycobacterium
DVVAACGKWTMTAGRATARVH

SEQ ID NO: 763372 - protein, 22 aa, Mycobacterium
DVVGAYRFLQRVWRLVVDENTG

SEQ ID NO: 763373 - protein, 18 aa, Mycobacterium
DVVGPFFGRAAAAVKALT

SEQ ID NO: 763374 - protein, 17 aa, Mycobacterium
DVVIALFGNHAPKTVAN

SEQ ID NO: 763375 - protein, 23 aa, Mycobacterium
DVVKRWAPGRVMLNSYGPTETTI

SEQ ID NO: 763376 - protein, 21 aa, Mycobacterium
DVVLFPAWVRFSPLKPSHLDP

SEQ ID NO: 763377 - protein, 20 aa, Mycobacterium
DVVPYLRWFTFLTAEELAEL

SEQ ID NO: 763378 - protein, 18 aa, Mycobacterium
DVVRCWHRDDGFGRGAGE

SEQ ID NO: 763379 - protein, 17 aa, Mycobacterium
DVVRDWLLDNGIVCLMA

SEQ ID NO: 763380 - protein, 20 aa, Mycobacterium
DVVRYLRWFTFLSAEEIGEL

SEQ ID NO: 763381 - protein, 17 aa, Mycobacterium
DVWQGYYCFAAELISPT

SEQ ID NO: 763382 - protein, 17 aa, Mycobacterium
DVYIQDGLLRLGSETVE

SEQ ID NO: 763383 - protein, 24 aa, Mycobacterium
DWAEMLMRMYIRWAEAHKYPVEVF

SEQ ID NO: 763384 - protein, 24 aa, Mycobacterium
DWAEMLMRMYIRWAEKHDYPVEIF

SEQ ID NO: 763385 - protein, 24 aa, Mycobacterium
DWAEMLMRMYIRWAEQHDYPVEVF

SEQ ID NO: 763386 - protein, 24 aa, Mycobacterium
DWAEMLMRMYIRWAEQHKYPVELF

SEQ ID NO: 763387 - protein, 24 aa, Mycobacterium
DWAEMLMRMYIRWAEQHKYPVEVF

SEQ ID NO: 763388 - protein, 24 aa, Mycobacterium
DWAEMLMRMYLRWAEQHKYPVEVF

SEQ ID NO: 763389 - protein, 23 aa, Mycobacterium
DWAEMLMRMYVRWAEQHKYPVEV

SEQ ID NO: 763390 - protein, 17 aa, Mycobacterium
DWAETWPAQGLTYPKEL

SEQ ID NO: 763391 - protein, 17 aa, Mycobacterium
DWALIWPTLVERFTVIA

SEQ ID NO: 763392 - protein, 20 aa, Mycobacterium
DWAPGASWRHPWGPDSDVDD

SEQ ID NO: 763393 - protein, 17 aa, Mycobacterium
DWCGLPVSVFRCDMILA

SEQ ID NO: 763394 - protein, 23 aa, Mycobacterium
DWDDELLSFFAIPRAMLPRIGPS

SEQ ID NO: 763395 - protein, 23 aa, Mycobacterium
DWDDELLSFFGIPRRMLPEIKPS

SEQ ID NO: 763396 - protein, 20 aa, Mycobacterium
DWDIKPGDMARIWRGGCIIR

SEQ ID NO: 763397 - protein, 18 aa, Mycobacterium
DWDSAAVLEHWSKELFDQ

SEQ ID NO: 763398 - protein, 18 aa, Mycobacterium
DWDSAAVLERWSKELFDQ

SEQ ID NO: 763399 - protein, 20 aa, Mycobacterium
DWEHMMKIWEGVMPAAGDGQ

SEQ ID NO: 763400 - protein, 17 aa, Mycobacterium
DWETCWRDYRLGMPHTV

SEQ ID NO: 763401 - protein, 23 aa, Mycobacterium
DWIPRLATMDVIASYCLTEPDAG

SEQ ID NO: 763402 - protein, 24 aa, Mycobacterium
DWIYIPKACTWRQIPDPGPTGTTT

SEQ ID NO: 763403 - protein, 24 aa, Mycobacterium
DWLEPRPGAALGLGAREWPVNHYE

SEQ ID NO: 763404 - protein, 23 aa, Mycobacterium
DWLLGNGGLDWAVKRTADSSQRL

SEQ ID NO: 763405 - protein, 22 aa, Mycobacterium
DWLLGNGGLDWAVKRTADSSSR

SEQ ID NO: 763406 - protein, 22 aa, Mycobacterium
DWLLGNGGLEWAVKRTADSSQR

SEQ ID NO: 763407 - protein, 18 aa, Mycobacterium
DWLRRLLDAQAFIRAEGP

SEQ ID NO: 763408 - protein, 22 aa, Mycobacterium
DWMLGNGGLDWAVKRTADSSGR

SEQ ID NO: 763409 - protein, 20 aa, Mycobacterium
DWPAAIGALVDAPAVVANGF

SEQ ID NO: 763410 - protein, 19 aa, Mycobacterium
DWPESLFAERTWHIARPLP

SEQ ID NO: 763411 - protein, 22 aa, Mycobacterium
DWPEVIRFLLGHVLVRQRERNA

SEQ ID NO: 763412 - protein, 24 aa, Mycobacterium
DWPSFPLPLGDTWASCKGDLLTVE

SEQ ID NO: 763413 - protein, 21 aa, Mycobacterium
DWPVMPVDIVSFWLKPYGFFD

SEQ ID NO: 763414 - protein, 27 aa, Mycobacterium
DWQRFSLWADDVFKAFSFTADLTEVEP

SEQ ID NO: 763415 - protein, 23 aa, Mycobacterium
DWQRLLFDNGWLLPAQPPEFGGR

SEQ ID NO: 763416 - protein, 23 aa, Mycobacterium
DWREQRGSLAIARVDTAGTAPAP

SEQ ID NO: 763417 - protein, 18 aa, Mycobacterium
DWRFKGVPADWWGRTEAQ

SEQ ID NO: 763418 - protein, 25 aa, Mycobacterium
DWRPAWRVAAIPSYKAHRVVTDDPL

SEQ ID NO: 763419 - protein, 26 aa, Mycobacterium
DWRQWWRWVPGASWRHPFGPDSDVAD

SEQ ID NO: 763420 - protein, 20 aa, Mycobacterium
DWTAAAIERWYADTAEKQPL

SEQ ID NO: 763421 - protein, 19 aa, Mycobacterium
DWVELFGADALRFTLARGA

SEQ ID NO: 763422 - protein, 21 aa, Mycobacterium
DWVPRRLALLAAFPRNRECTA

SEQ ID NO: 763423 - protein, 24 aa, Mycobacterium
DWYDWLIERVRLWPDVKRRNDQLD

SEQ ID NO: 763424 - protein, 20 aa, Mycobacterium
DYAGKWVIFFSHPADFTPVC

SEQ ID NO: 763425 - protein, 18 aa, Mycobacterium
DYELMGVPFAKRGKRIDE

SEQ ID NO: 763426 - protein, 19 aa, Mycobacterium
DYELMGVPFAKRGKRMDEC

SEQ ID NO: 763427 - protein, 24 aa, Mycobacterium
DYFKLGYRGARFAFGYGACPDLED

SEQ ID NO: 763428 - protein, 20 aa, Mycobacterium
DYFKREAIELAWTLLTNGVS

SEQ ID NO: 763429 - protein, 20 aa, Mycobacterium
DYFKREAIRLAWTLLTNPVS

SEQ ID NO: 763430 - protein, 24 aa, Mycobacterium
DYGNYAGLFVRMSWHAAGTYRIFD

SEQ ID NO: 763431 - protein, 24 aa, Mycobacterium
DYGTYGGLFIRMSWHSAGTYRIHD

SEQ ID NO: 763432 - protein, 17 aa, Mycobacterium
DYHLPKPFLVMATQNPI

SEQ ID NO: 763433 - protein, 23 aa, Mycobacterium
DYILDWASPVPFFGDVDQAQVAT

SEQ ID NO: 763434 - protein, 24 aa, Mycobacterium
DYLDLLFLHVWDFATPVEEILRGM

SEQ ID NO: 763435 - protein, 18 aa, Mycobacterium
DYLPLFVAPQPVRFEDRY

SEQ ID NO: 763436 - protein, 22 aa, Mycobacterium
DYLQWLGIDCIWLPPFYDSPLR

SEQ ID NO: 763437 - protein, 24 aa, Mycobacterium
DYLWRWDTDWFWCSRAFGAQHPVI

SEQ ID NO: 763438 - protein, 25 aa, Mycobacterium
DYPALIGPRCRAVWLLTVGAEQVDR

SEQ ID NO: 763439 - protein, 21 aa, Mycobacterium
DYPFRCKRVLLGDDYYRALQR

SEQ ID NO: 763440 - protein, 17 aa, Mycobacterium
DYQEAFGLPDDGWVLDE

SEQ ID NO: 763441 - protein, 19 aa, Mycobacterium
DYQNLGARMTAFHDQFVAA

SEQ ID NO: 763442 - protein, 19 aa, Mycobacterium
DYRLPVILLTALGEEDDRI

SEQ ID NO: 763443 - protein, 23 aa, Mycobacterium
DYRREMGELFAPFTKVAAKNPFA

SEQ ID NO: 763444 - protein, 24 aa, Mycobacterium
DYTATVVIAGFSYDVPIMGTPIGG

SEQ ID NO: 763445 - protein, 25 aa, Mycobacterium
EAAAFQCGFCTAGLVVTASTFGDDE

SEQ ID NO: 763446 - protein, 24 aa, Mycobacterium
EAACPGRFLLGIGVGHREAHVEYR

SEQ ID NO: 763447 - protein, 17 aa, Mycobacterium
EAAFAHFGRRFDDLSTE

SEQ ID NO: 763448 - protein, 19 aa, Mycobacterium
EAAFLAGKCFLEYRRRQGQ

SEQ ID NO: 763449 - protein, 17 aa, Mycobacterium
EAAGAWQRLAVELENSV

SEQ ID NO: 763450 - protein, 19 aa, Mycobacterium
EAALRERFGYDAWVLVYDL

SEQ ID NO: 763451 - protein, 20 aa, Mycobacterium
EAANAAPFQGLLGAVNAPVQ

SEQ ID NO: 763452 - protein, 24 aa, Mycobacterium
EAAPYLAAHGWRLNSASIRDLFAA

SEQ ID NO: 763453 - protein, 17 aa, Mycobacterium
EAARFSSAFTFQYSKRP

SEQ ID NO: 763454 - protein, 23 aa, Mycobacterium
EAASAAALAQVWGATAGPTAVLS

SEQ ID NO: 763455 - protein, 22 aa, Mycobacterium
EAATLYDMFVRTLGVSAGTYAA

SEQ ID NO: 763456 - protein, 24 aa, Mycobacterium
EAAVCPRFRVGLLRPRTEIVVLDL

SEQ ID NO: 763457 - protein, 18 aa, Mycobacterium
EAAVSLYLAERGFTTVGL

SEQ ID NO: 763458 - protein, 21 aa, Mycobacterium
EACLWSSGLARPGVTRRASVL

SEQ ID NO: 763459 - protein, 17 aa, Mycobacterium
EADAAFDQARRRFEEAW

SEQ ID NO: 763460 - protein, 22 aa, Mycobacterium
EADEKFWLGVGLTRSEAYVFIA

SEQ ID NO: 763461 - protein, 23 aa, Mycobacterium
EADLRSDIWIKLMGNVAFNPLSA

SEQ ID NO: 763462 - protein, 18 aa, Mycobacterium
EADLSWFLMHRHVSTERA

SEQ ID NO: 763463 - protein, 18 aa, Mycobacterium
EAECAQWVAEQLAEVGYA

SEQ ID NO: 763464 - protein, 18 aa, Mycobacterium
EAECAQWVAEQLAQVGYL

SEQ ID NO: 763465 - protein, 18 aa, Mycobacterium
EAECARWVAEQLAEVGYQ

SEQ ID NO: 763466 - protein, 20 aa, Mycobacterium
EAEGVLFLAEYVPVTRRFSG

SEQ ID NO: 763467 - protein, 23 aa, Mycobacterium
EAEIACGRAAAVITELEALTAEH

SEQ ID NO: 763468 - protein, 24 aa, Mycobacterium
EAEYRRLAGLGVRFTQEPVEMGPV

SEQ ID NO: 763469 - protein, 19 aa, Mycobacterium
EAFDRWGLIPRMFVGAADR

SEQ ID NO: 763470 - protein, 19 aa, Mycobacterium
EAFDRWGLVPRMFVGAATR

SEQ ID NO: 763471 - protein, 26 aa, Mycobacterium
EAFHLHKACAVVWCYTGDPAAAEEVF

SEQ ID NO: 763472 - protein, 17 aa, Mycobacterium
EAFKAKGYEVLVLTDPV

SEQ ID NO: 763473 - protein, 18 aa, Mycobacterium
EAFSKWASLVIHAGAPGA

SEQ ID NO: 763474 - protein, 18 aa, Mycobacterium
EAGACWREQLEIAGFDSG

SEQ ID NO: 763475 - protein, 25 aa, Mycobacterium
EAGAWPWRPPHLVTTLGARGARYAG

SEQ ID NO: 763476 - protein, 22 aa, Mycobacterium
EAGEAAVALWARRTDVADRINA

SEQ ID NO: 763477 - protein, 18 aa, Mycobacterium
EAGHDFTYRFSVPDPGTY

SEQ ID NO: 763478 - protein, 17 aa, Mycobacterium
EAGLPPGLVNVLPAGPE

SEQ ID NO: 763479 - protein, 23 aa, Mycobacterium
EAGRRWSRTRILAALALGRLERS

SEQ ID NO: 763480 - protein, 18 aa, Mycobacterium
EAGVALSAITARFPDARL

SEQ ID NO: 763481 - protein, 18 aa, Mycobacterium
EAGVALSAVTARFPDARL

SEQ ID NO: 763482 - protein, 21 aa, Mycobacterium
EAHGFSHLWTFDSHLLWQEPY

SEQ ID NO: 763483 - protein, 22 aa, Mycobacterium
EAHLAVQLCWSFYQRLIAAYAH

SEQ ID NO: 763484 - protein, 19 aa, Mycobacterium
EAHRARRQLIEFLAESTRA

SEQ ID NO: 763485 - protein, 18 aa, Mycobacterium
EAHVRLVLRSGVTDIDEI

SEQ ID NO: 763486 - protein, 18 aa, Mycobacterium
EAHVRMVLRSGRRDVDEI

SEQ ID NO: 763487 - protein, 19 aa, Mycobacterium
EAIDRFGPIFAQYYGQSEA

SEQ ID NO: 763488 - protein, 17 aa, Mycobacterium
EAIGMQLQRSHSFFVGD

SEQ ID NO: 763489 - protein, 19 aa, Mycobacterium
EAIIIKWLVSVGDTVVIDQ

SEQ ID NO: 763490 - protein, 17 aa, Mycobacterium
EAIKTLKARYCRYLDTK

SEQ ID NO: 763491 - protein, 17 aa, Mycobacterium
EAIRAAQIAKVYCARAT

SEQ ID NO: 763492 - protein, 21 aa, Mycobacterium
EAIRGWLRREGTCLLLAPHHD

SEQ ID NO: 763493 - protein, 20 aa, Mycobacterium
EAIRRFGPIFAQYYGQSEAP

SEQ ID NO: 763494 - protein, 20 aa, Mycobacterium
EAITGWAAREPEVWWNTPEG

SEQ ID NO: 763495 - protein, 20 aa, Mycobacterium
EAITLAADWIWERSREEDLA

SEQ ID NO: 763496 - protein, 21 aa, Mycobacterium
EAITLAADWIWERSREEDLAP

SEQ ID NO: 763497 - protein, 21 aa, Mycobacterium
EAKAHRGPLCLGIDPHPELLR

SEQ ID NO: 763498 - protein, 17 aa, Mycobacterium
EAKLLGFHWTKIHHQPD

SEQ ID NO: 763499 - protein, 20 aa, Mycobacterium
EAKRRGIACVEMEAAALYAY

SEQ ID NO: 763500 - protein, 22 aa, Mycobacterium
EAKWAASISGYWRRGRTEETFR

SEQ ID NO: 763501 - protein, 22 aa, Mycobacterium
EAKWASSISGYWRRGRTEETFR

SEQ ID NO: 763502 - protein, 19 aa, Mycobacterium
EALCALPMVVNATADLVFS

SEQ ID NO: 763503 - protein, 20 aa, Mycobacterium
EALCALPMVVNATADLVFSA

SEQ ID NO: 763504 - protein, 20 aa, Mycobacterium
EALDGFRFWSVQGLQRSLPV

SEQ ID NO: 763505 - protein, 22 aa, Mycobacterium
EALELARGFGLRYELAHLSNSA

SEQ ID NO: 763506 - protein, 20 aa, Mycobacterium
EALERLGWLVVRVVATDSPA

SEQ ID NO: 763507 - protein, 17 aa, Mycobacterium
EALKGALVSPVITAHPT

SEQ ID NO: 763508 - protein, 20 aa, Mycobacterium
EALKPWYGYFCKRPCFHDEY

SEQ ID NO: 763509 - protein, 21 aa, Mycobacterium
EALKPWYGYFCKRPCFHDEYL

SEQ ID NO: 763510 - protein, 20 aa, Mycobacterium
EALLCREARDGVQKLHGNRL

SEQ ID NO: 763511 - protein, 20 aa, Mycobacterium
EALLGRPLIGDGANGSAPGQ

SEQ ID NO: 763512 - protein, 20 aa, Mycobacterium
EALLGRPLIGNGADGTAPGQ

SEQ ID NO: 763513 - protein, 18 aa, Mycobacterium
EALNSFNRAMCREMRDAW

SEQ ID NO: 763514 - protein, 22 aa, Mycobacterium
EALQIPVGVAFFFTNSAIGRTV

SEQ ID NO: 763515 - protein, 19 aa, Mycobacterium
EALQIPVGVVFFMRNSVLG

SEQ ID NO: 763516 - protein, 24 aa, Mycobacterium
EALRGCTWLPFFHDMGLITVMVPS

SEQ ID NO: 763517 - protein, 17 aa, Mycobacterium
EALRMMINMAYQDVDPL

SEQ ID NO: 763518 - protein, 19 aa, Mycobacterium
EALRNFNLRIARGETVALL

SEQ ID NO: 763519 - protein, 17 aa, Mycobacterium
EALRYVERIGIDRIAEY

SEQ ID NO: 763520 - protein, 19 aa, Mycobacterium
EALSAAAADTARIGSAINA

SEQ ID NO: 763521 - protein, 17 aa, Mycobacterium
EALWRLLCEQVGAAVLV

SEQ ID NO: 763522 - protein, 26 aa, Mycobacterium
EALYHFAWDEFCDWYLELAKVQLGQE

SEQ ID NO: 763523 - protein, 25 aa, Mycobacterium
EALYHFAWDEFCDWYVELAKTQLAD

SEQ ID NO: 763524 - protein, 25 aa, Mycobacterium
EALYHFAWDEFCDWYVELAKVQLGQ

SEQ ID NO: 763525 - protein, 29 aa, Mycobacterium
EAMASAAADIERIGALLTQGNAAAASPTI

SEQ ID NO: 763526 - protein, 17 aa, Mycobacterium
EAMLFGDYIRLMALVEY

SEQ ID NO: 763527 - protein, 17 aa, Mycobacterium
EAMLFGEYIRLMALVEY

SEQ ID NO: 763528 - protein, 19 aa, Mycobacterium
EAMNHWRADGGFGLHVFHK

SEQ ID NO: 763529 - protein, 18 aa, Mycobacterium
EAMPPFITGGSMIETVTM

SEQ ID NO: 763530 - protein, 17 aa, Mycobacterium
EAMVAAWIGGIDDELGE

SEQ ID NO: 763531 - protein, 19 aa, Mycobacterium
EANLARFPEDVARVVVRLI

SEQ ID NO: 763532 - protein, 19 aa, Mycobacterium
EANVIWKLRYTMRSQIFSR

SEQ ID NO: 763533 - protein, 19 aa, Mycobacterium
EAPAKAWEHGRFNAPYLRD

SEQ ID NO: 763534 - protein, 19 aa, Mycobacterium
EAPGGLPFSGGDADDPALQ

SEQ ID NO: 763535 - protein, 18 aa, Mycobacterium
EAPLVDWSDVDMGELLPT

SEQ ID NO: 763536 - protein, 25 aa, Mycobacterium
EAPSRDDALLAFPAMQAMPTPYVEA

SEQ ID NO: 763537 - protein, 19 aa, Mycobacterium
EAPSVFAPVPGFRGQQRFS

SEQ ID NO: 763538 - protein, 17 aa, Mycobacterium
EAPTLPAIERYTGVLYD

SEQ ID NO: 763539 - protein, 21 aa, Mycobacterium
EAQAGHILRCLRHARTADSNY

SEQ ID NO: 763540 - protein, 27 aa, Mycobacterium
EAQAWPVLRRHLALLAIEGHDPIAALH

SEQ ID NO: 763541 - protein, 25 aa, Mycobacterium
EAQLRGAPILAMGVWRWGLGEIAYE

SEQ ID NO: 763542 - protein, 19 aa, Mycobacterium
EAQRWPSVPGRYFTVRAGS

SEQ ID NO: 763543 - protein, 23 aa, Mycobacterium
EAQWASDTCYSWAVCEPTTGEML

SEQ ID NO: 763544 - protein, 21 aa, Mycobacterium
EARAKRLVACWGNNDGPELRR

SEQ ID NO: 763545 - protein, 19 aa, Mycobacterium
EARARLLYERSLGMLDSTV

SEQ ID NO: 763546 - protein, 20 aa, Mycobacterium
EARDLAGLLTKYADKLDEAT

SEQ ID NO: 763547 - protein, 21 aa, Mycobacterium
EARELLGILCDLYALSVIEDD

SEQ ID NO: 763548 - protein, 22 aa, Mycobacterium
EARKGGGAAPVYEAPKPEKKPE

SEQ ID NO: 763549 - protein, 18 aa, Mycobacterium
EARLEVLDGLGLDYTIMF

SEQ ID NO: 763550 - protein, 17 aa, Mycobacterium
EARLRGANLLVINATAG

SEQ ID NO: 763551 - protein, 18 aa, Mycobacterium
EARLSATLARGLKAEGFV

SEQ ID NO: 763552 - protein, 21 aa, Mycobacterium
EARLWRAARVFERYRPVFVSV

SEQ ID NO: 763553 - protein, 22 aa, Mycobacterium
EARQALTEAVLWPLQHPDTFAR

SEQ ID NO: 763554 - protein, 18 aa, Mycobacterium
EARRGLIDSVKGKAKEVV

SEQ ID NO: 763555 - protein, 17 aa, Mycobacterium
EARRIAPSMAWSVVANA

SEQ ID NO: 763556 - protein, 20 aa, Mycobacterium
EARSLFDLNVFGLINVTRAV

SEQ ID NO: 763557 - protein, 18 aa, Mycobacterium
EARWPQYAPAAAEIGVLS

SEQ ID NO: 763558 - protein, 19 aa, Mycobacterium
EASAGFMLMKPLVETATAA

SEQ ID NO: 763559 - protein, 18 aa, Mycobacterium
EASKLYLTQMVKHHEGAI

SEQ ID NO: 763560 - protein, 22 aa, Mycobacterium
EASLGITLPVALVWAYPTITDL

SEQ ID NO: 763561 - protein, 23 aa, Mycobacterium
EASRLRSRFGFLAIHGGGLEEMT

SEQ ID NO: 763562 - protein, 18 aa, Mycobacterium
EASVALAAVAARFPNARL

SEQ ID NO: 763563 - protein, 18 aa, Mycobacterium
EASVALSAIAARFPQARL

SEQ ID NO: 763564 - protein, 21 aa, Mycobacterium
EATCVPMRWTRRIQSTVTGAG

SEQ ID NO: 763565 - protein, 18 aa, Mycobacterium
EATLRWVVTTAVGDVLSA

SEQ ID NO: 763566 - protein, 24 aa, Mycobacterium
EATRARPEIIAWLSEAEIDELLDP

SEQ ID NO: 763567 - protein, 18 aa, Mycobacterium
EAVCGWASKQPQPWWHQS

SEQ ID NO: 763568 - protein, 17 aa, Mycobacterium
EAVGFFIRDIEAMLDQP

SEQ ID NO: 763569 - protein, 25 aa, Mycobacterium
EAVGIAAYHCGDWGQALAELRAARR

SEQ ID NO: 763570 - protein, 26 aa, Mycobacterium
EAVGIAAYQCGDWAQALAELRAARRM

SEQ ID NO: 763571 - protein, 18 aa, Mycobacterium
EAVLECREALAINVKPKF

SEQ ID NO: 763572 - protein, 18 aa, Mycobacterium
EAVLECREALAVNVKPKF

SEQ ID NO: 763573 - protein, 19 aa, Mycobacterium
EAVLRMALVGSHERLTAQR

SEQ ID NO: 763574 - protein, 22 aa, Mycobacterium
EAVLRMPWRPELATTADMVHGG

SEQ ID NO: 763575 - protein, 19 aa, Mycobacterium
EAVMLAGLAMKWRWRAKAG

SEQ ID NO: 763576 - protein, 19 aa, Mycobacterium
EAVMLAGLAMKWRWRDKFA

SEQ ID NO: 763577 - protein, 20 aa, Mycobacterium
EAVMLGGLAMKWRWRAKIGK

SEQ ID NO: 763578 - protein, 20 aa, Mycobacterium
EAVMLGGLAMKWRWRAKVGK

SEQ ID NO: 763579 - protein, 23 aa, Mycobacterium
EAVMLGGLAMKWRWRARTKDWKG

SEQ ID NO: 763580 - protein, 20 aa, Mycobacterium
EAVMLGGLAMKWRWRQKVGK

SEQ ID NO: 763581 - protein, 17 aa, Mycobacterium
EAVRRFHLADAREAVNL

SEQ ID NO: 763582 - protein, 23 aa, Mycobacterium
EAWCRSAEAVRLFRFDRIVDAQL

SEQ ID NO: 763583 - protein, 21 aa, Mycobacterium
EAWRFLKELRLERGPLTAEEA

SEQ ID NO: 763584 - protein, 17 aa, Mycobacterium
EAYKHLKPIGAYGAGVD

SEQ ID NO: 763585 - protein, 20 aa, Mycobacterium
EAYLKRFLRWVPHESDADAW

SEQ ID NO: 763586 - protein, 20 aa, Mycobacterium
EAYLRAAIAWHFGADTGSAF

SEQ ID NO: 763587 - protein, 17 aa, Mycobacterium
EAYPVLCGSAFKNKGVQ

SEQ ID NO: 763588 - protein, 17 aa, Mycobacterium
ECALRWMRDFHADGLRL

SEQ ID NO: 763589 - protein, 18 aa, Mycobacterium
ECAVPVIGCIHGYCVGLG

SEQ ID NO: 763590 - protein, 18 aa, Mycobacterium
ECDRRGWTVVGWHADEGV

SEQ ID NO: 763591 - protein, 19 aa, Mycobacterium
ECDSCGRGEYRRCSSNGLA

SEQ ID NO: 763592 - protein, 24 aa, Mycobacterium
ECHGLQCGFCTPGFVTSITALLRD

SEQ ID NO: 763593 - protein, 20 aa, Mycobacterium
ECIECPFHGWRWGPEGTNTY

SEQ ID NO: 763594 - protein, 17 aa, Mycobacterium
ECIRRIGDCLGIYTAIR

SEQ ID NO: 763595 - protein, 19 aa, Mycobacterium
ECLRPILAGERVDYAGRHV

SEQ ID NO: 763596 - protein, 23 aa, Mycobacterium
ECLRSGATAFGWSRRNPVPRSVR

SEQ ID NO: 763597 - protein, 19 aa, Mycobacterium
ECLTRGATRFGWNRRNPAP

SEQ ID NO: 763598 - protein, 17 aa, Mycobacterium
ECPPCLVYLQQMLDLKI

SEQ ID NO: 763599 - protein, 20 aa, Mycobacterium
ECPTEVPVGVGFLKRSGLVR

SEQ ID NO: 763600 - protein, 26 aa, Mycobacterium
ECRAKRRIGGYLSLRCVQIGSEPGKR

SEQ ID NO: 763601 - protein, 19 aa, Mycobacterium
ECSNRFDVVQSFTDDSLTT

SEQ ID NO: 763602 - protein, 20 aa, Mycobacterium
ECWMHLGIDLFWFALPPAQL

SEQ ID NO: 763603 - protein, 35 aa, Mycobacterium
ECYDYAGHVLFAWHLPELWRRFTITMRRTLRKELK

SEQ ID NO: 763604 - protein, 36 aa, Mycobacterium
ECYDYAGHVLFTWHLPELWRRFTITLRRALRKSLKA

SEQ ID NO: 763605 - protein, 24 aa, Mycobacterium
EDAEFGLACAIGIAPCMHAGQGCA

SEQ ID NO: 763606 - protein, 24 aa, Mycobacterium
EDAFPLLITHGWPGSIVEFHKVIE

SEQ ID NO: 763607 - protein, 19 aa, Mycobacterium
EDASPAFLGFNLFQHAIAR

SEQ ID NO: 763608 - protein, 22 aa, Mycobacterium
EDDIPGLVLIPAAADKIEIPMI

SEQ ID NO: 763609 - protein, 23 aa, Mycobacterium
EDEISTAIAALFSGHAQAYQAAS

SEQ ID NO: 763610 - protein, 22 aa, Mycobacterium
EDEVSAAIAAFFGAHAQSYQTL

SEQ ID NO: 763611 - protein, 22 aa, Mycobacterium
EDEVSAAIAAVFSGHAQAYQAA

SEQ ID NO: 763612 - protein, 20 aa, Mycobacterium
EDFAALLIYRLGRLPSDRSS

SEQ ID NO: 763613 - protein, 20 aa, Mycobacterium
EDFAALLLYRLGRLPSDRAS

SEQ ID NO: 763614 - protein, 27 aa, Mycobacterium
EDFARARGLGMLSMWSLNRDYPGNIGQ

SEQ ID NO: 763615 - protein, 18 aa, Mycobacterium
EDFLPRSAAGIFRSNLDG

SEQ ID NO: 763616 - protein, 24 aa, Mycobacterium
EDFTCWRIKLPHLDAAKFDAALAS

SEQ ID NO: 763617 - protein, 22 aa, Mycobacterium
EDFWLKVGIDPIRIMTGAGNLY

SEQ ID NO: 763618 - protein, 22 aa, Mycobacterium
EDFWLKVGIDPVRIMTGTGTFY

SEQ ID NO: 763619 - protein, 18 aa, Mycobacterium
EDFYLRYNCDTYVMGIAG

SEQ ID NO: 763620 - protein, 19 aa, Mycobacterium
EDGNLWFEWSRSLDNPAEY

SEQ ID NO: 763621 - protein, 17 aa, Mycobacterium
EDGRWTVQLAWKAGRSD

SEQ ID NO: 763622 - protein, 23 aa, Mycobacterium
EDGTRIPISIVYRGGIQLPAPAM

SEQ ID NO: 763623 - protein, 19 aa, Mycobacterium
EDHYGITMVTGWQEAVDVY

SEQ ID NO: 763624 - protein, 20 aa, Mycobacterium
EDHYGVTMVTGWEEAVSVYN

SEQ ID NO: 763625 - protein, 26 aa, Mycobacterium
EDIGPRSIASFVIPRQSVTVIGIDLL

SEQ ID NO: 763626 - protein, 22 aa, Mycobacterium
EDILRVGDWVLVHVGFAMAKID

SEQ ID NO: 763627 - protein, 19 aa, Mycobacterium
EDIPEVWRRLDTVGLTSIE

SEQ ID NO: 763628 - protein, 23 aa, Mycobacterium
EDKFWRRFCESLDRMDLYEPGRQ

SEQ ID NO: 763629 - protein, 20 aa, Mycobacterium
EDKPFWWAHFDRLNFPLEEW

SEQ ID NO: 763630 - protein, 20 aa, Mycobacterium
EDKPFWWAHFDRLNFPVDEW

SEQ ID NO: 763631 - protein, 19 aa, Mycobacterium
EDKPFWWSHFDRLNHPVEE

SEQ ID NO: 763632 - protein, 17 aa, Mycobacterium
EDLATSAHFVWPRETLR

SEQ ID NO: 763633 - protein, 21 aa, Mycobacterium
EDLIRLGLQVGDFVAFIASPE

SEQ ID NO: 763634 - protein, 18 aa, Mycobacterium
EDLKAALLEDAKKAYKAR

SEQ ID NO: 763635 - protein, 17 aa, Mycobacterium
EDLRLLGIHIFGSDATD

SEQ ID NO: 763636 - protein, 17 aa, Mycobacterium
EDMMKIHMGVAMISSSI

SEQ ID NO: 763637 - protein, 19 aa, Mycobacterium
EDPARFAGLLADRLTRMVG

SEQ ID NO: 763638 - protein, 17 aa, Mycobacterium
EDPDRWAPGYAEAGAYN

SEQ ID NO: 763639 - protein, 17 aa, Mycobacterium
EDPDRWAPPYAEAGAYN

SEQ ID NO: 763640 - protein, 24 aa, Mycobacterium
EDQEVWRYFASVAFPSEPLVRNVL

SEQ ID NO: 763641 - protein, 19 aa, Mycobacterium
EDQHLRAAKVLSLAQDTAD

SEQ ID NO: 763642 - protein, 19 aa, Mycobacterium
EDQRLRFLPPIVRNEEKWC

SEQ ID NO: 763643 - protein, 19 aa, Mycobacterium
EDREPRAAIAVGNPDTAEH

SEQ ID NO: 763644 - protein, 19 aa, Mycobacterium
EDRLRTRFEWGLITDVQPP

SEQ ID NO: 763645 - protein, 22 aa, Mycobacterium
EDRLTALFDFYGYRVLSVDAIN

SEQ ID NO: 763646 - protein, 19 aa, Mycobacterium
EDRRKLLWDNVWKPLASRS

SEQ ID NO: 763647 - protein, 24 aa, Mycobacterium
EDRVWKLTWYLGGHSASLSELLPM

SEQ ID NO: 763648 - protein, 22 aa, Mycobacterium
EDSRWTVQLAWKAGRSDNVAHF

SEQ ID NO: 763649 - protein, 17 aa, Mycobacterium
EDVLGMLAAQGIVTEVG

SEQ ID NO: 763650 - protein, 20 aa, Mycobacterium
EDVPEIWDRLASVGLTTTEA

SEQ ID NO: 763651 - protein, 24 aa, Mycobacterium
EDVTLARLCIRPEPAAPALTAVAL

SEQ ID NO: 763652 - protein, 17 aa, Mycobacterium
EDVVRVFGFSVDVAARQ

SEQ ID NO: 763653 - protein, 22 aa, Mycobacterium
EDWKAAISVNLWGVIYGCETFV

SEQ ID NO: 763654 - protein, 20 aa, Mycobacterium
EDWMARFILGFGAEVQVLAP

SEQ ID NO: 763655 - protein, 23 aa, Mycobacterium
EEAPRPPEFLAMLHRSEDAVIAA

SEQ ID NO: 763656 - protein, 20 aa, Mycobacterium
EEEWSHFAARDWDALADLVA

SEQ ID NO: 763657 - protein, 18 aa, Mycobacterium
EEFIRWASPVMTFRRTAA

SEQ ID NO: 763658 - protein, 17 aa, Mycobacterium
EEFTEPHIVRWEIADGF

SEQ ID NO: 763659 - protein, 21 aa, Mycobacterium
EEFVTLWADHRVKRCEADTYD

SEQ ID NO: 763660 - protein, 20 aa, Mycobacterium
EEGAICIKLPLPPGTLPTVW

SEQ ID NO: 763661 - protein, 19 aa, Mycobacterium
EEGNLWFEWSRSLDDPNEY

SEQ ID NO: 763662 - protein, 19 aa, Mycobacterium
EEGNLWFEWSRSLDNPAEY

SEQ ID NO: 763663 - protein, 23 aa, Mycobacterium
EEGPRLHANWTWAPSALDREQVT

SEQ ID NO: 763664 - protein, 21 aa, Mycobacterium
EEGRYAIPQVRFGVAPDALAH

SEQ ID NO: 763665 - protein, 19 aa, Mycobacterium
EEGVACYRLFIAGLLDITD

SEQ ID NO: 763666 - protein, 25 aa, Mycobacterium
EEHGRRCVWAFADVRDAAALTEAID

SEQ ID NO: 763667 - protein, 17 aa, Mycobacterium
EEIGGLITRLSIGGNGE

SEQ ID NO: 763668 - protein, 18 aa, Mycobacterium
EEIIRWTAPVKEFMRTAT

SEQ ID NO: 763669 - protein, 23 aa, Mycobacterium
EEILKRFPAWEVDWANAVPSETA

SEQ ID NO: 763670 - protein, 22 aa, Mycobacterium
EEIMLEKSLSWLTTRNAQRSID

SEQ ID NO: 763671 - protein, 21 aa, Mycobacterium
EELFSRFGAVRVVRPVEWARS

SEQ ID NO: 763672 - protein, 23 aa, Mycobacterium
EELLRWATPVMHFRRTVTRDVVI

SEQ ID NO: 763673 - protein, 19 aa, Mycobacterium
EELRKVWYRSWVFVGHESE

SEQ ID NO: 763674 - protein, 23 aa, Mycobacterium
EELRRTAARLADWVAERPEVAPG

SEQ ID NO: 763675 - protein, 24 aa, Mycobacterium
EELTRAGAAFAEIAGIYNAVDAAN

SEQ ID NO: 763676 - protein, 18 aa, Mycobacterium
EELVMWWNFVGRNHDEIV

SEQ ID NO: 763677 - protein, 18 aa, Mycobacterium
EELVMWWNFVGRSHDEIV

SEQ ID NO: 763678 - protein, 17 aa, Mycobacterium
EELVMWWNFVGRSHEDI

SEQ ID NO: 763679 - protein, 19 aa, Mycobacterium
EELWKRLGHEGSLAHGPFP

SEQ ID NO: 763680 - protein, 17 aa, Mycobacterium
EEMFGRHGLRLGGLDAQ

SEQ ID NO: 763681 - protein, 18 aa, Mycobacterium
EEMIRWVTPVKAFMRTAA

SEQ ID NO: 763682 - protein, 17 aa, Mycobacterium
EEMIRWVTPVKEFMRTA

SEQ ID NO: 763683 - protein, 17 aa, Mycobacterium
EEMIRWVTPVKQFMRTA

SEQ ID NO: 763684 - protein, 23 aa, Mycobacterium
EEMPVAVPWSLPAARPVHAGDPD

SEQ ID NO: 763685 - protein, 17 aa, Mycobacterium
EEMPVAVPWSLRDAHPV

SEQ ID NO: 763686 - protein, 17 aa, Mycobacterium
EEMPVAVPWSLSAARPV

SEQ ID NO: 763687 - protein, 17 aa, Mycobacterium
EEPEVLGTFVFAPSAPI

SEQ ID NO: 763688 - protein, 24 aa, Mycobacterium
EEPGRTGFRFAPCGSGGRSLDARI

SEQ ID NO: 763689 - protein, 19 aa, Mycobacterium
EEPKGTPVFAWKGETLEEY

SEQ ID NO: 763690 - protein, 20 aa, Mycobacterium
EEPKGVPVFAWKGESLEEYW

SEQ ID NO: 763691 - protein, 20 aa, Mycobacterium
EEPKGVPVYAWKGETLEEYW

SEQ ID NO: 763692 - protein, 19 aa, Mycobacterium
EEPPDHLIFVFATTEPEKV

SEQ ID NO: 763693 - protein, 23 aa, Mycobacterium
EEPRIATGPTVLTIRARPPGTTI

SEQ ID NO: 763694 - protein, 19 aa, Mycobacterium
EEPRKEWVLQFSIGAAPRS

SEQ ID NO: 763695 - protein, 23 aa, Mycobacterium
EEQFFWPAVRKALGDGLVDKAVE

SEQ ID NO: 763696 - protein, 19 aa, Mycobacterium
EERAMFGLPEVKRGLIAGA

SEQ ID NO: 763697 - protein, 17 aa, Mycobacterium
EESRPPFWQNLVELGWL

SEQ ID NO: 763698 - protein, 18 aa, Mycobacterium
EETLSLRFEQIFHQAPAS

SEQ ID NO: 763699 - protein, 23 aa, Mycobacterium
EETRELLGILCDLYALSVIEDDK

SEQ ID NO: 763700 - protein, 24 aa, Mycobacterium
EETRKRWDRYAAFAQKTFNVEIPA

SEQ ID NO: 763701 - protein, 18 aa, Mycobacterium
EETYRFVLTNHHIVLDGW

SEQ ID NO: 763702 - protein, 22 aa, Mycobacterium
EEVLKRWPDWEVDYANAQRAHT

SEQ ID NO: 763703 - protein, 18 aa, Mycobacterium
EEVPEVWAAVTSVFRDYG

SEQ ID NO: 763704 - protein, 21 aa, Mycobacterium
EEVRAAGLLPSWQETQAFIAG

SEQ ID NO: 763705 - protein, 25 aa, Mycobacterium
EEVVQRLTASFAHARSRLDEQWSQG

SEQ ID NO: 763706 - protein, 22 aa, Mycobacterium
EEYPRLFVYRGPRRKGVRYFGP

SEQ ID NO: 763707 - protein, 21 aa, Mycobacterium
EEYWWAAEQMLTWDGEPANMI

SEQ ID NO: 763708 - protein, 21 aa, Mycobacterium
EEYWWAAEQMLTWPGEPANMI

SEQ ID NO: 763709 - protein, 25 aa, Mycobacterium
EFAGAFKPPISWGMRTVGKGFLREY

SEQ ID NO: 763710 - protein, 18 aa, Mycobacterium
EFAHVFSAFGVRVTLVIR

SEQ ID NO: 763711 - protein, 23 aa, Mycobacterium
EFARRFGCRVVDSFGSSEFAVIV

SEQ ID NO: 763712 - protein, 25 aa, Mycobacterium
EFAVAWRLGREAILFVGERAAELTR

SEQ ID NO: 763713 - protein, 19 aa, Mycobacterium
EFCRQRHNVAGLKFVQGDA

SEQ ID NO: 763714 - protein, 20 aa, Mycobacterium
EFDGKLWISMDFVDGTDAAS

SEQ ID NO: 763715 - protein, 20 aa, Mycobacterium
EFDRTAGFGIYGTVKAALNR

SEQ ID NO: 763716 - protein, 25 aa, Mycobacterium
EFDSRAVGPGGLFLALPGARADGHD

SEQ ID NO: 763717 - protein, 18 aa, Mycobacterium
EFDYVDLFLIHWPLPTLY

SEQ ID NO: 763718 - protein, 20 aa, Mycobacterium
EFEDILAFWFDRGVDGFRID

SEQ ID NO: 763719 - protein, 24 aa, Mycobacterium
EFFGLLIRICLGIAAWLRGAFATA

SEQ ID NO: 763720 - protein, 17 aa, Mycobacterium
EFGRGMVDRGWGRVVNI

SEQ ID NO: 763721 - protein, 18 aa, Mycobacterium
EFIAEAIATLGARDGKGF

SEQ ID NO: 763722 - protein, 18 aa, Mycobacterium
EFILCLGYGADHIKNYFL

SEQ ID NO: 763723 - protein, 17 aa, Mycobacterium
EFIRARHGVALFSSDGS

SEQ ID NO: 763724 - protein, 18 aa, Mycobacterium
EFIYCPWHQWGFELATGT

SEQ ID NO: 763725 - protein, 28 aa, Mycobacterium
EFLERLSGWCEFVWKPGYADYYPELPGG

SEQ ID NO: 763726 - protein, 23 aa, Mycobacterium
EFLPRIAAGQCFFGIGMSEPDSG

SEQ ID NO: 763727 - protein, 18 aa, Mycobacterium
EFLRPIFRRHWSYVEPGV

SEQ ID NO: 763728 - protein, 19 aa, Mycobacterium
EFPDRLRVVHWLEAERGLP

SEQ ID NO: 763729 - protein, 24 aa, Mycobacterium
EFPELPRRLALRGAEVLALPVNWP

SEQ ID NO: 763730 - protein, 19 aa, Mycobacterium
EFPRVQWLAAARRALTAAP

SEQ ID NO: 763731 - protein, 18 aa, Mycobacterium
EFRSGFVCLVGRPNTGKS

SEQ ID NO: 763732 - protein, 20 aa, Mycobacterium
EFRTSIAALRSHDLVEGIRA

SEQ ID NO: 763733 - protein, 20 aa, Mycobacterium
EFSSALWLKFNLLAEAHTRD

SEQ ID NO: 763734 - protein, 18 aa, Mycobacterium
EFVDRLPAMLGLHDDATD

SEQ ID NO: 763735 - protein, 19 aa, Mycobacterium
EFWAFDILWLDGRSLLRAK

SEQ ID NO: 763736 - protein, 28 aa, Mycobacterium
EFWFDPLCPWCWITSRWILEVQKVRDIE

SEQ ID NO: 763737 - protein, 19 aa, Mycobacterium
EFYIRDVLLDWSRDDPNHL

SEQ ID NO: 763738 - protein, 22 aa, Mycobacterium
EGACNGCSMSAVTLRQLVETAL

SEQ ID NO: 763739 - protein, 19 aa, Mycobacterium
EGADALWLAERGWRVVAVD

SEQ ID NO: 763740 - protein, 18 aa, Mycobacterium
EGAFLLCGFMMALAEHQQ

SEQ ID NO: 763741 - protein, 17 aa, Mycobacterium
EGAFSRVPFGSASTGLV

SEQ ID NO: 763742 - protein, 23 aa, Mycobacterium
EGAGGNGGRGEVGGLPGNGGDGG

SEQ ID NO: 763743 - protein, 18 aa, Mycobacterium
EGAGRFAAGAGRHGAQAS

SEQ ID NO: 763744 - protein, 17 aa, Mycobacterium
EGALGRIGHGWDVLAHV

SEQ ID NO: 763745 - protein, 18 aa, Mycobacterium
EGALIMFAGGDPWKINST

SEQ ID NO: 763746 - protein, 23 aa, Mycobacterium
EGAPGVGVAPGWFSTSGNQIVDS

SEQ ID NO: 763747 - protein, 18 aa, Mycobacterium
EGAPRAAVEPLVLMLAPL

SEQ ID NO: 763748 - protein, 19 aa, Mycobacterium
EGCFWGAERGFWKLPGVYS

SEQ ID NO: 763749 - protein, 21 aa, Mycobacterium
EGCQLDWWLGFSSVASLLGSP

SEQ ID NO: 763750 - protein, 18 aa, Mycobacterium
EGDAEWGKTVADLMDAVD

SEQ ID NO: 763751 - protein, 18 aa, Mycobacterium
EGDEVWPGILGFDDTVLP

SEQ ID NO: 763752 - protein, 17 aa, Mycobacterium
EGDNVFVALSWSKHPAP

SEQ ID NO: 763753 - protein, 19 aa, Mycobacterium
EGDNVFVALSWSKHPAPQN

SEQ ID NO: 763754 - protein, 17 aa, Mycobacterium
EGDNVFVALSWSKHPVP

SEQ ID NO: 763755 - protein, 17 aa, Mycobacterium
EGDPKWVESVEQLMDAV

SEQ ID NO: 763756 - protein, 21 aa, Mycobacterium
EGEPAWAYSVIALRWAAKYYA

SEQ ID NO: 763757 - protein, 17 aa, Mycobacterium
EGERLWISWAMANRDPA

SEQ ID NO: 763758 - protein, 17 aa, Mycobacterium
EGERLWISWAMANRDPQ

SEQ ID NO: 763759 - protein, 18 aa, Mycobacterium
EGFGVWRLGDDDAMLDIV

SEQ ID NO: 763760 - protein, 18 aa, Mycobacterium
EGFLPTLLDWCRANDVVF

SEQ ID NO: 763761 - protein, 19 aa, Mycobacterium
EGFLPTLLEWCRRNDVVFI

SEQ ID NO: 763762 - protein, 22 aa, Mycobacterium
EGFLYPRITGYLAQRLQVEDWY

SEQ ID NO: 763763 - protein, 18 aa, Mycobacterium
EGFPEMRVAVIPRDQISF

SEQ ID NO: 763764 - protein, 17 aa, Mycobacterium
EGFPEMRVAVIPRSEIS

SEQ ID NO: 763765 - protein, 20 aa, Mycobacterium
EGGRAAALWRIRADGAGLAA

SEQ ID NO: 763766 - protein, 17 aa, Mycobacterium
EGGRFALYMKIHHALVD

SEQ ID NO: 763767 - protein, 19 aa, Mycobacterium
EGGRFRRNHCVPMPVVDSI

SEQ ID NO: 763768 - protein, 17 aa, Mycobacterium
EGGSPVWASDTSGHSAG

SEQ ID NO: 763769 - protein, 20 aa, Mycobacterium
EGGTVFCCRFGLGLHGGREE

SEQ ID NO: 763770 - protein, 23 aa, Mycobacterium
EGGWIRTWLDTVLDLPWNVRTED

SEQ ID NO: 763771 - protein, 24 aa, Mycobacterium
EGGWIRTWLDTVLDLPWNVRTEDS

SEQ ID NO: 763772 - protein, 18 aa, Mycobacterium
EGGWSLSGTKVWTSGAHL

SEQ ID NO: 763773 - protein, 20 aa, Mycobacterium
EGHCGACAATLRSGKVNMEV

SEQ ID NO: 763774 - protein, 19 aa, Mycobacterium
EGHCGACACTLKTGKVSME

SEQ ID NO: 763775 - protein, 19 aa, Mycobacterium
EGHHGVTMITGWDEACAVL

SEQ ID NO: 763776 - protein, 18 aa, Mycobacterium
EGHKWSMLTAYDYSTARV

SEQ ID NO: 763777 - protein, 20 aa, Mycobacterium
EGIAGIHLEGPWLSPQYAGA

SEQ ID NO: 763778 - protein, 17 aa, Mycobacterium
EGIDLSTRIDRMWADMR

SEQ ID NO: 763779 - protein, 20 aa, Mycobacterium
EGIELWAPCFGHQDVDPLDA

SEQ ID NO: 763780 - protein, 19 aa, Mycobacterium
EGIKHLKFIFYDWNRLGDG

SEQ ID NO: 763781 - protein, 18 aa, Mycobacterium
EGIKIKAQEFLPHRETSR

SEQ ID NO: 763782 - protein, 18 aa, Mycobacterium
EGILRYSRDLAFGAASAY

SEQ ID NO: 763783 - protein, 17 aa, Mycobacterium
EGISVNVTLIFSVERYR

SEQ ID NO: 763784 - protein, 22 aa, Mycobacterium
EGISVNVTLIFSVQRHKEVMDA

SEQ ID NO: 763785 - protein, 24 aa, Mycobacterium
EGKHAASAFAMWFPIEGGADYGQA

SEQ ID NO: 763786 - protein, 22 aa, Mycobacterium
EGKRIVPVCSMIGTVLKKHPEF

SEQ ID NO: 763787 - protein, 18 aa, Mycobacterium
EGLIAYRLVHLICTRTML

SEQ ID NO: 763788 - protein, 17 aa, Mycobacterium
EGLLEIGQKLGIPPLAT

SEQ ID NO: 763789 - protein, 18 aa, Mycobacterium
EGLLEIGRKLGIPPLATN

SEQ ID NO: 763790 - protein, 19 aa, Mycobacterium
EGLLGFEFWWELDAPDAGT

SEQ ID NO: 763791 - protein, 20 aa, Mycobacterium
EGLLNYLALLGWAIADDHDL

SEQ ID NO: 763792 - protein, 19 aa, Mycobacterium
EGLLNYLALLGWSIADDHD

SEQ ID NO: 763793 - protein, 19 aa, Mycobacterium
EGLLNYLALLGWSIADDRD

SEQ ID NO: 763794 - protein, 25 aa, Mycobacterium
EGLLRAAGLLLLWARGYVEPVLAPR

SEQ ID NO: 763795 - protein, 22 aa, Mycobacterium
EGLRGRFAHRFKFETYSAGELV

SEQ ID NO: 763796 - protein, 23 aa, Mycobacterium
EGLRRFAALSGRSVGAEKIWMGE

SEQ ID NO: 763797 - protein, 19 aa, Mycobacterium
EGLRRFHRNLGCGLLGRRI

SEQ ID NO: 763798 - protein, 24 aa, Mycobacterium
EGLRRFSRHLGRGWLGRRIERSPL

SEQ ID NO: 763799 - protein, 20 aa, Mycobacterium
EGLVRTCVFEVPKYLLTGGR

SEQ ID NO: 763800 - protein, 23 aa, Mycobacterium
EGMKLRPGLVIAIEPMLIADGTE

SEQ ID NO: 763801 - protein, 18 aa, Mycobacterium
EGMLALTGYYAWHKICVE

SEQ ID NO: 763802 - protein, 18 aa, Mycobacterium
EGNMPIAAMGRVGNADEV

SEQ ID NO: 763803 - protein, 19 aa, Mycobacterium
EGPARAWERGRFGAPYLRD

SEQ ID NO: 763804 - protein, 17 aa, Mycobacterium
EGPRTYLGLGVDGFPNL

SEQ ID NO: 763805 - protein, 21 aa, Mycobacterium
EGQPGRFLLVTNFEYATPQFM

SEQ ID NO: 763806 - protein, 25 aa, Mycobacterium
EGQTFAPECWLTWSGVAAAGSTFRL

SEQ ID NO: 763807 - protein, 17 aa, Mycobacterium
EGRAIALAQRWGTRKPI

SEQ ID NO: 763808 - protein, 17 aa, Mycobacterium
EGRFALYSVADAHEDAS

SEQ ID NO: 763809 - protein, 20 aa, Mycobacterium
EGRPRTGVVFQDALLMPWLT

SEQ ID NO: 763810 - protein, 19 aa, Mycobacterium
EGRRAIKYLGDFVKDVTPA

SEQ ID NO: 763811 - protein, 19 aa, Mycobacterium
EGSGRLFGLGGAGGAGGTG

SEQ ID NO: 763812 - protein, 18 aa, Mycobacterium
EGSLRLGDKVVFGKDNVV

SEQ ID NO: 763813 - protein, 18 aa, Mycobacterium
EGTNTWVLRGPRSDELVV

SEQ ID NO: 763814 - protein, 17 aa, Mycobacterium
EGTPFIAAHGMRRISLV

SEQ ID NO: 763815 - protein, 24 aa, Mycobacterium
EGTRRGGAVWARRGEVFAVHAAGN

SEQ ID NO: 763816 - protein, 19 aa, Mycobacterium
EGTSVFRWAAFEMGKVGQR

SEQ ID NO: 763817 - protein, 22 aa, Mycobacterium
EGVARYRLDGVVQPARRPRGGI

SEQ ID NO: 763818 - protein, 20 aa, Mycobacterium
EGVECYRLFISGLLDVTDNV

SEQ ID NO: 763819 - protein, 17 aa, Mycobacterium
EGVERGWAATMVLTEPD

SEQ ID NO: 763820 - protein, 23 aa, Mycobacterium
EGVKRALAAWVVFEPGAMFHYSD

SEQ ID NO: 763821 - protein, 19 aa, Mycobacterium
EGVNLTFLPFIARAVIDAL

SEQ ID NO: 763822 - protein, 26 aa, Mycobacterium
EGVPRWRKGSGLGWLTAEYAMLPAST

SEQ ID NO: 763823 - protein, 20 aa, Mycobacterium
EGVPRWRKGSGQGWLTAEYA

SEQ ID NO: 763824 - protein, 25 aa, Mycobacterium
EGVPRWRKGSGQGWLTAEYAMLPAA

SEQ ID NO: 763825 - protein, 26 aa, Mycobacterium
EGVPRWRKGSGVGWLTAEYAMLPSAT

SEQ ID NO: 763826 - protein, 18 aa, Mycobacterium
EGVPRYWFKDNDTLEQFI

SEQ ID NO: 763827 - protein, 17 aa, Mycobacterium
EGVVSLGLYGQIFHRNV

SEQ ID NO: 763828 - protein, 18 aa, Mycobacterium
EGVVSLGLYSKIFHNNIK

SEQ ID NO: 763829 - protein, 19 aa, Mycobacterium
EGVVSLGLYSKIFRNNILA

SEQ ID NO: 763830 - protein, 17 aa, Mycobacterium
EGVVSLGLYSRIFHNNI

SEQ ID NO: 763831 - protein, 19 aa, Mycobacterium
EGVVSLGLYSRIFRNNILA

SEQ ID NO: 763832 - protein, 18 aa, Mycobacterium
EGWMPFRKVFDVVASGRR

SEQ ID NO: 763833 - protein, 17 aa, Mycobacterium
EGYRLLKDWLDARPAEV

SEQ ID NO: 763834 - protein, 22 aa, Mycobacterium
EHARSAAYHAVWALADGSDDPA

SEQ ID NO: 763835 - protein, 21 aa, Mycobacterium
EHCGRRLIGFSAELGGKNAMI

SEQ ID NO: 763836 - protein, 24 aa, Mycobacterium
EHDILAFERQWWKFAGVKEDAIKE

SEQ ID NO: 763837 - protein, 22 aa, Mycobacterium
EHFNWLEALGFEFERTYYPGKV

SEQ ID NO: 763838 - protein, 24 aa, Mycobacterium
EHFNWLEALGFQFERSFYPEKAVI

SEQ ID NO: 763839 - protein, 22 aa, Mycobacterium
EHFNWLEALGFQFERSYYPGKV

SEQ ID NO: 763840 - protein, 23 aa, Mycobacterium
EHGLPFTICRPFNAYGPGELPDT

SEQ ID NO: 763841 - protein, 17 aa, Mycobacterium
EHHAVLDAVDWLVEHEG

SEQ ID NO: 763842 - protein, 17 aa, Mycobacterium
EHHAVLDTVDWLVEHEG

SEQ ID NO: 763843 - protein, 18 aa, Mycobacterium
EHHLLKTFWPGWSNVQFP

SEQ ID NO: 763844 - protein, 19 aa, Mycobacterium
EHIGAAIALLFENFTTVFV

SEQ ID NO: 763845 - protein, 19 aa, Mycobacterium
EHIKRIGVDLVDVSSGGSA

SEQ ID NO: 763846 - protein, 23 aa, Mycobacterium
EHIVCPWHGWQWRGDGTNALIPY

SEQ ID NO: 763847 - protein, 18 aa, Mycobacterium
EHLDALGFDEVWMGEHHS

SEQ ID NO: 763848 - protein, 25 aa, Mycobacterium
EHLGVPRWRLMGVFGDPDADAVSIA

SEQ ID NO: 763849 - protein, 17 aa, Mycobacterium
EHLKQRWARGAGGLLLI

SEQ ID NO: 763850 - protein, 19 aa, Mycobacterium
EHLPAHLLGGVLVGHSVGA

SEQ ID NO: 763851 - protein, 18 aa, Mycobacterium
EHLPRITVPTVFTHGTAD

SEQ ID NO: 763852 - protein, 22 aa, Mycobacterium
EHPLGHRWRWELAEVGPGATKV

SEQ ID NO: 763853 - protein, 20 aa, Mycobacterium
EHPLRPGTMYLLNGHERHRV

SEQ ID NO: 763854 - protein, 17 aa, Mycobacterium
EHQRLHHTYSFLGVETY

SEQ ID NO: 763855 - protein, 18 aa, Mycobacterium
EHSFPFTGRIHRIDASVS

SEQ ID NO: 763856 - protein, 19 aa, Mycobacterium
EHVKPRLLGHWGTTPALNL

SEQ ID NO: 763857 - protein, 22 aa, Mycobacterium
EHVVPILVRRGLFRAEYTGSTL

SEQ ID NO: 763858 - protein, 20 aa, Mycobacterium
EHYLRIPFALTKSAVPHMRG

SEQ ID NO: 763859 - protein, 18 aa, Mycobacterium
EIAEALNVVAGRLLNPRT

SEQ ID NO: 763860 - protein, 18 aa, Mycobacterium
EIAEALTVLTARLRNPRI

SEQ ID NO: 763861 - protein, 19 aa, Mycobacterium
EIAEGWQPIFFLPEKAATV

SEQ ID NO: 763862 - protein, 18 aa, Mycobacterium
EIAERAGARFVLASTSEV

SEQ ID NO: 763863 - protein, 21 aa, Mycobacterium
EIAHILVLRSKFDGGFTSEVR

SEQ ID NO: 763864 - protein, 18 aa, Mycobacterium
EIAILHRHAHGFDPRDLS

SEQ ID NO: 763865 - protein, 19 aa, Mycobacterium
EIAPRMALPEGMHFQTNRL

SEQ ID NO: 763866 - protein, 18 aa, Mycobacterium
EIARCIAEMVSLPVPTVS

SEQ ID NO: 763867 - protein, 20 aa, Mycobacterium
EIARLVPFIEWLRDAYPDHV

SEQ ID NO: 763868 - protein, 21 aa, Mycobacterium
EIASPRLGFRIQLDPLELESL

SEQ ID NO: 763869 - protein, 18 aa, Mycobacterium
EICARFIREPGYRFVELA

SEQ ID NO: 763870 - protein, 18 aa, Mycobacterium
EICARFIREPGYRFVELT

SEQ ID NO: 763871 - protein, 18 aa, Mycobacterium
EICDGWLPIFYSPRIAGM

SEQ ID NO: 763872 - protein, 19 aa, Mycobacterium
EICDGWLPIFYSPRMAGMY

SEQ ID NO: 763873 - protein, 19 aa, Mycobacterium
EIDARLRLLVGRRAGAVNV

SEQ ID NO: 763874 - protein, 20 aa, Mycobacterium
EIDARLRLLVGRRGGMANQE

SEQ ID NO: 763875 - protein, 19 aa, Mycobacterium
EIDARLRLLVGRRGGNANQ

SEQ ID NO: 763876 - protein, 23 aa, Mycobacterium
EIDRWPQQPGRYFTVRAGSLVAW

SEQ ID NO: 763877 - protein, 19 aa, Mycobacterium
EIDVAFPLGVLTSVTGVSG

SEQ ID NO: 763878 - protein, 23 aa, Mycobacterium
EIEMMRGWLALWGVGPAAAQQHH

SEQ ID NO: 763879 - protein, 18 aa, Mycobacterium
EIERARAAAELAVAAASE

SEQ ID NO: 763880 - protein, 19 aa, Mycobacterium
EIFPGGWLPTIPTVEEHAT

SEQ ID NO: 763881 - protein, 18 aa, Mycobacterium
EIFRGRWLVEPSPTGSRV

SEQ ID NO: 763882 - protein, 24 aa, Mycobacterium
EIGDIRFGEVFAHGAPLTHFTQIF

SEQ ID NO: 763883 - protein, 17 aa, Mycobacterium
EIGLLGFALITDALGGV

SEQ ID NO: 763884 - protein, 19 aa, Mycobacterium
EIGRLVPFVEWLRDAYPEQ

SEQ ID NO: 763885 - protein, 19 aa, Mycobacterium
EIHALLYRYARAVDTKDWD

SEQ ID NO: 763886 - protein, 19 aa, Mycobacterium
EIHAVAGAGHWPWLEQPDT

SEQ ID NO: 763887 - protein, 20 aa, Mycobacterium
EIIRCLKRFLAREIWASCIH

SEQ ID NO: 763888 - protein, 23 aa, Mycobacterium
EIKKLPTLRGRTVITMFYENSTR

SEQ ID NO: 763889 - protein, 20 aa, Mycobacterium
EIKPRYVVLAAAKVGGILAN

SEQ ID NO: 763890 - protein, 17 aa, Mycobacterium
EILARYDVTFSLGDGLR

SEQ ID NO: 763891 - protein, 19 aa, Mycobacterium
EILERLGWTVIRVLAGDRP

SEQ ID NO: 763892 - protein, 17 aa, Mycobacterium
EILKIALIKSGALFDVL

SEQ ID NO: 763893 - protein, 20 aa, Mycobacterium
EILKLSALRGLFSAVVDEQV

SEQ ID NO: 763894 - protein, 19 aa, Mycobacterium
EILPMPFLPAGVFDAWGLD

SEQ ID NO: 763895 - protein, 19 aa, Mycobacterium
EILPVPGLPEFRPGDDLVG

SEQ ID NO: 763896 - protein, 18 aa, Mycobacterium
EILRRYADELIFPAIEVY

SEQ ID NO: 763897 - protein, 18 aa, Mycobacterium
EIMAPILYRVQWLVRQIP

SEQ ID NO: 763898 - protein, 20 aa, Mycobacterium
EIMGLGPIEACKKALARAGM

SEQ ID NO: 763899 - protein, 19 aa, Mycobacterium
EIMGLGPIEACKKALQRAG

SEQ ID NO: 763900 - protein, 19 aa, Mycobacterium
EIMVRPLIRLSLGKRQPMR

SEQ ID NO: 763901 - protein, 20 aa, Mycobacterium
EINATFPLCHHGRYHVSPWV

SEQ ID NO: 763902 - protein, 18 aa, Mycobacterium
EINEAFAPVVLAWLKEIK

SEQ ID NO: 763903 - protein, 19 aa, Mycobacterium
EINSALMLAGAGSGPTLAA

SEQ ID NO: 763904 - protein, 19 aa, Mycobacterium
EINSLRLFSGAGSTSMLEA

SEQ ID NO: 763905 - protein, 18 aa, Mycobacterium
EIPARYGLNQSIGDTIGI

SEQ ID NO: 763906 - protein, 19 aa, Mycobacterium
EIPCDLALLAIGFEGVEHM

SEQ ID NO: 763907 - protein, 21 aa, Mycobacterium
EIPSPAAGVLTRIIAQEDDTV

SEQ ID NO: 763908 - protein, 20 aa, Mycobacterium
EIPVRVALTAARWAAEAGKQ

SEQ ID NO: 763909 - protein, 22 aa, Mycobacterium
EIQARLDAGLTFERKVFDELAA

SEQ ID NO: 763910 - protein, 22 aa, Mycobacterium
EIREDAGWVIGQWTAPPGVTAV

SEQ ID NO: 763911 - protein, 17 aa, Mycobacterium
EIREFLEGYVIGQDSAK

SEQ ID NO: 763912 - protein, 18 aa, Mycobacterium
EIRHWLMVFAQRFYSFSQ

SEQ ID NO: 763913 - protein, 23 aa, Mycobacterium
EIRPAHPALHRWFEDRARVDPDA

SEQ ID NO: 763914 - protein, 24 aa, Mycobacterium
EIRRLAIACLRELVTVAPAVFSDF

SEQ ID NO: 763915 - protein, 23 aa, Mycobacterium
EIRRLAIACLRQLADLAPSIFGD

SEQ ID NO: 763916 - protein, 17 aa, Mycobacterium
EIRSAGAVFGLLDVDDE

SEQ ID NO: 763917 - protein, 22 aa, Mycobacterium
EISAAVATLFACYGQTYQTLGI

SEQ ID NO: 763918 - protein, 22 aa, Mycobacterium
EISARLDLPLGVARVLVGDLVL

SEQ ID NO: 763919 - protein, 17 aa, Mycobacterium
EISARVLMKLKRDAEAY

SEQ ID NO: 763920 - protein, 27 aa, Mycobacterium
EISTAVAELFGAYARGYQIIGAQAAMF

SEQ ID NO: 763921 - protein, 23 aa, Mycobacterium
EITKPRVAIPIHYNDFSVFLSGL

SEQ ID NO: 763922 - protein, 24 aa, Mycobacterium
EITYAAEFFRHFAAEAVRIDGGYQ

SEQ ID NO: 763923 - protein, 22 aa, Mycobacterium
EIVAAAAADMDGIGSAITAANA

SEQ ID NO: 763924 - protein, 19 aa, Mycobacterium
EIVAGVALELQAINSAARA

SEQ ID NO: 763925 - protein, 19 aa, Mycobacterium
EIVDAYFPLGWPMACHVMG

SEQ ID NO: 763926 - protein, 19 aa, Mycobacterium
EIVDLRSLVPLDFATIAES

SEQ ID NO: 763927 - protein, 17 aa, Mycobacterium
EIVGAYFPLGWPIACHV

SEQ ID NO: 763928 - protein, 18 aa, Mycobacterium
EIVHGVSFDVHREQTVGI

SEQ ID NO: 763929 - protein, 17 aa, Mycobacterium
EIVKHPSFELVGVGVSN

SEQ ID NO: 763930 - protein, 18 aa, Mycobacterium
EIVRRSGVDPADIDDIIF

SEQ ID NO: 763931 - protein, 20 aa, Mycobacterium
EIVVHAATELRDIGSSVNTA

SEQ ID NO: 763932 - protein, 18 aa, Mycobacterium
EIWDEFTNRFEIPRVCEF

SEQ ID NO: 763933 - protein, 20 aa, Mycobacterium
EIWSSYILERYMAKNVFASL

SEQ ID NO: 763934 - protein, 17 aa, Mycobacterium
EIYRAPLSYPFRDAEFG

SEQ ID NO: 763935 - protein, 22 aa, Mycobacterium
EKAKAMGAIAMFGERYPDEVRV

SEQ ID NO: 763936 - protein, 17 aa, Mycobacterium
EKDRAALWYGRLHAPDS

SEQ ID NO: 763937 - protein, 21 aa, Mycobacterium
EKEAWLSMVMLEWGSCGQIAT

SEQ ID NO: 763938 - protein, 21 aa, Mycobacterium
EKEAWLSMVMLEWGSCGQVAV

SEQ ID NO: 763939 - protein, 18 aa, Mycobacterium
EKEAWTGLVSLILLMPGR

SEQ ID NO: 763940 - protein, 22 aa, Mycobacterium
EKEIDRRAALGIGLTSPELATL

SEQ ID NO: 763941 - protein, 22 aa, Mycobacterium
EKFRYGFAIAPELVRTVLRDQE

SEQ ID NO: 763942 - protein, 18 aa, Mycobacterium
EKFWDWADCDGHPENAVS

SEQ ID NO: 763943 - protein, 18 aa, Mycobacterium
EKGFCAVAAEADWPDAYR

SEQ ID NO: 763944 - protein, 24 aa, Mycobacterium
EKGNRYAAKFTRMMRRAYDKWWAA

SEQ ID NO: 763945 - protein, 21 aa, Mycobacterium
EKGPEVWRIRISKLTTTPLPR

SEQ ID NO: 763946 - protein, 17 aa, Mycobacterium
EKGQAFGAMYAYIQELV

SEQ ID NO: 763947 - protein, 23 aa, Mycobacterium
EKKLFCRMAEVFAGFLSYTDAQI

SEQ ID NO: 763948 - protein, 23 aa, Mycobacterium
EKKTFRIAAHWADHLNIVAALDE

SEQ ID NO: 763949 - protein, 17 aa, Mycobacterium
EKLAAWLLERQPKVVTG

SEQ ID NO: 763950 - protein, 18 aa, Mycobacterium
EKLCDLFVYSALEADLSW

SEQ ID NO: 763951 - protein, 20 aa, Mycobacterium
EKLDFCRDLGADITINYHDE

SEQ ID NO: 763952 - protein, 20 aa, Mycobacterium
EKLFPLICRYALAYHVVFIP

SEQ ID NO: 763953 - protein, 22 aa, Mycobacterium
EKLFPLICRYALAYHVVFIPSV

SEQ ID NO: 763954 - protein, 23 aa, Mycobacterium
EKMPRRFYCRARWHRSALDSETQ

SEQ ID NO: 763955 - protein, 23 aa, Mycobacterium
EKMPRRFYCRATWHEAPLDSETQ

SEQ ID NO: 763956 - protein, 21 aa, Mycobacterium
EKMPRYIAGVLARLQEVWMGR

SEQ ID NO: 763957 - protein, 17 aa, Mycobacterium
EKNRLPLAVGLKAPLSC

SEQ ID NO: 763958 - protein, 27 aa, Mycobacterium
EKPLDYLVERWEWWSRTAPDVGVQTRT

SEQ ID NO: 763959 - protein, 21 aa, Mycobacterium
EKRFSMPWSHPARRMREFVAA

SEQ ID NO: 763960 - protein, 18 aa, Mycobacterium
EKRGRVGIYSDEHIAIIN

SEQ ID NO: 763961 - protein, 19 aa, Mycobacterium
EKRRSWAVLGEMAELGEDA

SEQ ID NO: 763962 - protein, 17 aa, Mycobacterium
EKRRWLRDRGLKIFPLV

SEQ ID NO: 763963 - protein, 18 aa, Mycobacterium
EKTEMYWAIRAYEIAMEE

SEQ ID NO: 763964 - protein, 23 aa, Mycobacterium
EKTGEAWIDWQLYGGHTRGEFEY

SEQ ID NO: 763965 - protein, 20 aa, Mycobacterium
EKVEVLWRHVRCDGTEVEPL

SEQ ID NO: 763966 - protein, 21 aa, Mycobacterium
EKYARRGLVQFLGDDVGNPVA

SEQ ID NO: 763967 - protein, 22 aa, Mycobacterium
ELAAAFRIFGTFGFSEGVAGHI

SEQ ID NO: 763968 - protein, 17 aa, Mycobacterium
ELAEALTVLARRLTGPH

SEQ ID NO: 763969 - protein, 19 aa, Mycobacterium
ELAGLPGRFLFGLDDGRGD

SEQ ID NO: 763970 - protein, 25 aa, Mycobacterium
ELALPFCAACALPLELDQEVCDQCG

SEQ ID NO: 763971 - protein, 19 aa, Mycobacterium
ELARGLWRGALHGVPIGVK

SEQ ID NO: 763972 - protein, 23 aa, Mycobacterium
ELARSNGWAGLIINGAVRDSAAL

SEQ ID NO: 763973 - protein, 24 aa, Mycobacterium
ELARSNGWAGLVVHGAVRDSVTLR

SEQ ID NO: 763974 - protein, 23 aa, Mycobacterium
ELARSNGWAGLVVNGAVRDAAAL

SEQ ID NO: 763975 - protein, 17 aa, Mycobacterium
ELAWVLGCLTGYGEAAR

SEQ ID NO: 763976 - protein, 17 aa, Mycobacterium
ELCRRWYPRIYFGQPDK

SEQ ID NO: 763977 - protein, 18 aa, Mycobacterium
ELCRRWYPRIYFGQPEKG

SEQ ID NO: 763978 - protein, 19 aa, Mycobacterium
ELCVPHLQPLIANLVTEAI

SEQ ID NO: 763979 - protein, 20 aa, Mycobacterium
ELDAALARRIVKWMRFSKDK

SEQ ID NO: 763980 - protein, 18 aa, Mycobacterium
ELDGGPSWHEGPATNMWG

SEQ ID NO: 763981 - protein, 19 aa, Mycobacterium
ELDGGPSWHEGPPTNMFNG

SEQ ID NO: 763982 - protein, 23 aa, Mycobacterium
ELDGLRLITWRGAARAEQGLPFA

SEQ ID NO: 763983 - protein, 23 aa, Mycobacterium
ELDGLRLITWRGAARAEQGLPFI

SEQ ID NO: 763984 - protein, 23 aa, Mycobacterium
ELDGLRLITWRGAARAEQGLPFV

SEQ ID NO: 763985 - protein, 22 aa, Mycobacterium
ELDGLRLITWRGASRAEQGLPF

SEQ ID NO: 763986 - protein, 23 aa, Mycobacterium
ELDGLRLITWRGASRAEQGLPFA

SEQ ID NO: 763987 - protein, 22 aa, Mycobacterium
ELDGLRLITWRGASRAEQGLSF

SEQ ID NO: 763988 - protein, 21 aa, Mycobacterium
ELDLGWGRLIFGQTFADSAAL

SEQ ID NO: 763989 - protein, 19 aa, Mycobacterium
ELDLPLCVNTGIPGPPIPG

SEQ ID NO: 763990 - protein, 19 aa, Mycobacterium
ELDRFLVAVTFRIGRLGVP

SEQ ID NO: 763991 - protein, 23 aa, Mycobacterium
ELDVVWRNGLRLNKLVNTLLDFS

SEQ ID NO: 763992 - protein, 18 aa, Mycobacterium
ELDWWLGFSSTASLLGSP

SEQ ID NO: 763993 - protein, 18 aa, Mycobacterium
ELEAMPDLVARVLAMIEP

SEQ ID NO: 763994 - protein, 18 aa, Mycobacterium
ELEAWKRTLFRFVQQLYF

SEQ ID NO: 763995 - protein, 19 aa, Mycobacterium
ELEGARGLYQWGPPPPASF

SEQ ID NO: 763996 - protein, 19 aa, Mycobacterium
ELELGWGRLIFGQTFADAH

SEQ ID NO: 763997 - protein, 19 aa, Mycobacterium
ELELGWGRLIFGQTFADSQ

SEQ ID NO: 763998 - protein, 19 aa, Mycobacterium
ELELPLCINTGIPGPPIPG

SEQ ID NO: 763999 - protein, 19 aa, Mycobacterium
ELESALALADRLQELARRV

SEQ ID NO: 764000 - protein, 19 aa, Mycobacterium
ELESLFLGYGYRPITVAGD

SEQ ID NO: 764001 - protein, 18 aa, Mycobacterium
ELEWSLTRSVLWEAAAMP

SEQ ID NO: 764002 - protein, 19 aa, Mycobacterium
ELFEALTLVQTRKVTRFPI

SEQ ID NO: 764003 - protein, 17 aa, Mycobacterium
ELFGLRAGTPVAVGGAD

SEQ ID NO: 764004 - protein, 18 aa, Mycobacterium
ELFPGVTIQPLWEGDNGA

SEQ ID NO: 764005 - protein, 19 aa, Mycobacterium
ELFQARALHPLPIKTWDVR

SEQ ID NO: 764006 - protein, 19 aa, Mycobacterium
ELGCVAALKTLEITSRPEV

SEQ ID NO: 764007 - protein, 18 aa, Mycobacterium
ELGDTVVLLAHYGITSLM

SEQ ID NO: 764008 - protein, 17 aa, Mycobacterium
ELGELRWREGAAVTVVL

SEQ ID NO: 764009 - protein, 17 aa, Mycobacterium
ELGEVRAALAWLDGVEQ

SEQ ID NO: 764010 - protein, 17 aa, Mycobacterium
ELGRLCSPIGLDLGART

SEQ ID NO: 764011 - protein, 21 aa, Mycobacterium
ELGRSGGVLAVMSALENRNNY

SEQ ID NO: 764012 - protein, 20 aa, Mycobacterium
ELGTRWFADHARWVQDPAGL

SEQ ID NO: 764013 - protein, 18 aa, Mycobacterium
ELGWGRLIFGQTFADPEK

SEQ ID NO: 764014 - protein, 18 aa, Mycobacterium
ELGWRMEVEQGGEWHFFD

SEQ ID NO: 764015 - protein, 19 aa, Mycobacterium
ELIDRIGIDKVMWSSDYPH

SEQ ID NO: 764016 - protein, 19 aa, Mycobacterium
ELIDSAAMDLANIGTALNS

SEQ ID NO: 764017 - protein, 17 aa, Mycobacterium
ELIETHLLFGVDYDDID

SEQ ID NO: 764018 - protein, 19 aa, Mycobacterium
ELIETHLLFGVPYRQIGVV

SEQ ID NO: 764019 - protein, 17 aa, Mycobacterium
ELIFKRQIIAHARDRDI

SEQ ID NO: 764020 - protein, 18 aa, Mycobacterium
ELIGPALEDWAKWGQARH

SEQ ID NO: 764021 - protein, 21 aa, Mycobacterium
ELIGYRISTPIPRISYADAMR

SEQ ID NO: 764022 - protein, 18 aa, Mycobacterium
ELIKACAGRDFLDRRDEA

SEQ ID NO: 764023 - protein, 19 aa, Mycobacterium
ELILHLPLIVAIANTAHPL

SEQ ID NO: 764024 - protein, 17 aa, Mycobacterium
ELIPRLPGPMVRTGMSV

SEQ ID NO: 764025 - protein, 19 aa, Mycobacterium
ELIRRAVVVKAEVVAADEK

SEQ ID NO: 764026 - protein, 19 aa, Mycobacterium
ELLALHARGRFPIERLVTE

SEQ ID NO: 764027 - protein, 18 aa, Mycobacterium
ELLARLAPPAGYRDDVVV

SEQ ID NO: 764028 - protein, 34 aa, Mycobacterium
ELLDEAWWFPAICWPDGRLQFMLNERMMPSQFVV

SEQ ID NO: 764029 - protein, 20 aa, Mycobacterium
ELLEGLRLIARVSSLCAQMS

SEQ ID NO: 764030 - protein, 19 aa, Mycobacterium
ELLGCVSGALGLRKFFEDA

SEQ ID NO: 764031 - protein, 19 aa, Mycobacterium
ELLGLRIGYEMAEWAERLI

SEQ ID NO: 764032 - protein, 18 aa, Mycobacterium
ELLMLGWGSSYGPIGEAC

SEQ ID NO: 764033 - protein, 22 aa, Mycobacterium
ELLMSIMLEFGRKVGGAWSDIV

SEQ ID NO: 764034 - protein, 21 aa, Mycobacterium
ELLNRWPEWDVDYDSLKLAPT

SEQ ID NO: 764035 - protein, 22 aa, Mycobacterium
ELLNRWPEWGIDYETAQLASTS

SEQ ID NO: 764036 - protein, 22 aa, Mycobacterium
ELLPTVRGAFCLTFMDENTLYA

SEQ ID NO: 764037 - protein, 17 aa, Mycobacterium
ELLRAGVLVDLYPLVRK

SEQ ID NO: 764038 - protein, 19 aa, Mycobacterium
ELLRFCLEQGYQLRVIEQM

SEQ ID NO: 764039 - protein, 19 aa, Mycobacterium
ELLRLAEWVADPRATVVVG

SEQ ID NO: 764040 - protein, 22 aa, Mycobacterium
ELLRLQRRLGITSLYVTHDQEE

SEQ ID NO: 764041 - protein, 23 aa, Mycobacterium
ELLRRIKALPGFGAVKAQIFLAL

SEQ ID NO: 764042 - protein, 19 aa, Mycobacterium
ELLRRIKGLPGFGEVKAQI

SEQ ID NO: 764043 - protein, 18 aa, Mycobacterium
ELLRRLKGLPGFGEQKAR

SEQ ID NO: 764044 - protein, 19 aa, Mycobacterium
ELLRRLLTWQGWMDAPSSR

SEQ ID NO: 764045 - protein, 19 aa, Mycobacterium
ELLRTAVLAFLNYIDANRA

SEQ ID NO: 764046 - protein, 18 aa, Mycobacterium
ELLVGKGFTAGKVGNNES

SEQ ID NO: 764047 - protein, 21 aa, Mycobacterium
ELMPDVLHWLGIRKIHRLVSM

SEQ ID NO: 764048 - protein, 24 aa, Mycobacterium
ELMPDVLHWLGIRTIHRLVSMSNM

SEQ ID NO: 764049 - protein, 19 aa, Mycobacterium
ELMPLPIALAHRLARRLTE

SEQ ID NO: 764050 - protein, 20 aa, Mycobacterium
ELMPLPIALAHRLSRKLTEV

SEQ ID NO: 764051 - protein, 19 aa, Mycobacterium
ELMSRYSLHHAIRDHQRSD

SEQ ID NO: 764052 - protein, 25 aa, Mycobacterium
ELNFGCVWVNCHIPLVAEMPHGGFK

SEQ ID NO: 764053 - protein, 20 aa, Mycobacterium
ELNPYLGVRGIRLSLAHPDV

SEQ ID NO: 764054 - protein, 22 aa, Mycobacterium
ELPAAALWWRISGALSPTATLA

SEQ ID NO: 764055 - protein, 27 aa, Mycobacterium
ELPAAALWWRLAAELTPAAALDTPDAG

SEQ ID NO: 764056 - protein, 21 aa, Mycobacterium
ELPAVRVGRSFRVHAKAVHDM

SEQ ID NO: 764057 - protein, 18 aa, Mycobacterium
ELPAWYRQNPGLARDLAF

SEQ ID NO: 764058 - protein, 17 aa, Mycobacterium
ELPEPRPRFEIFVYSPR

SEQ ID NO: 764059 - protein, 19 aa, Mycobacterium
ELPGAPFVLAVQWHPEQSL

SEQ ID NO: 764060 - protein, 20 aa, Mycobacterium
ELPGPMGSVVPTGFRSQRST

SEQ ID NO: 764061 - protein, 24 aa, Mycobacterium
ELPGTELLDVFGLVPMVIDVHDER

SEQ ID NO: 764062 - protein, 19 aa, Mycobacterium
ELPPELAALTGRDEDRDVD

SEQ ID NO: 764063 - protein, 19 aa, Mycobacterium
ELPRLRVLIQIADDSGNGL

SEQ ID NO: 764064 - protein, 19 aa, Mycobacterium
ELPVYIVSIGRTFRTDELD

SEQ ID NO: 764065 - protein, 19 aa, Mycobacterium
ELPWRRPIASLNYLLSSHV

SEQ ID NO: 764066 - protein, 18 aa, Mycobacterium
ELPWTQRLSQVWRMHDPA

SEQ ID NO: 764067 - protein, 23 aa, Mycobacterium
ELQRQWRFACLFISHDLAVVDRL

SEQ ID NO: 764068 - protein, 24 aa, Mycobacterium
ELQRRGCSIARLILLDALLTVPNS

SEQ ID NO: 764069 - protein, 20 aa, Mycobacterium
ELRAECGMSLLTLDTLVQLS

SEQ ID NO: 764070 - protein, 23 aa, Mycobacterium
ELRARFAGALSQMYGTEVPAYNT

SEQ ID NO: 764071 - protein, 21 aa, Mycobacterium
ELRARIGAVTMGRVLTLIIAP

SEQ ID NO: 764072 - protein, 18 aa, Mycobacterium
ELRDGSCMNLALVLQKDR

SEQ ID NO: 764073 - protein, 18 aa, Mycobacterium
ELRGRWTRMLTHCRRARL

SEQ ID NO: 764074 - protein, 21 aa, Mycobacterium
ELRGTEIARHFDLVGFDPRGV

SEQ ID NO: 764075 - protein, 18 aa, Mycobacterium
ELRHAWLDLHESWLMAKA

SEQ ID NO: 764076 - protein, 18 aa, Mycobacterium
ELRIGLATADDIRNWSYG

SEQ ID NO: 764077 - protein, 19 aa, Mycobacterium
ELRKAWLELHESWLVAKAG

SEQ ID NO: 764078 - protein, 23 aa, Mycobacterium
ELRLKGPQCFLGYADAALDADAF

SEQ ID NO: 764079 - protein, 19 aa, Mycobacterium
ELRLRIGLNSGEVITGGIG

SEQ ID NO: 764080 - protein, 18 aa, Mycobacterium
ELRNRLKAATGLSLTPTL

SEQ ID NO: 764081 - protein, 22 aa, Mycobacterium
ELRPRIAEHFSRRGLPTTEDQI

SEQ ID NO: 764082 - protein, 19 aa, Mycobacterium
ELRPWVPVVSLVKGLEQGT

SEQ ID NO: 764083 - protein, 21 aa, Mycobacterium
ELRQRIGMVFQHFNLFPHRSV

SEQ ID NO: 764084 - protein, 22 aa, Mycobacterium
ELRRFLRRWLGSAILAQASPSR

SEQ ID NO: 764085 - protein, 22 aa, Mycobacterium
ELRRRGCEVGRLIVLDAAGEVD

SEQ ID NO: 764086 - protein, 23 aa, Mycobacterium
ELRRTAGRLAGWVRAHDDLALPD

SEQ ID NO: 764087 - protein, 19 aa, Mycobacterium
ELRSAAAWFEVLKLERRRQ

SEQ ID NO: 764088 - protein, 17 aa, Mycobacterium
ELRSSGAVFGLLDIDDE

SEQ ID NO: 764089 - protein, 18 aa, Mycobacterium
ELRSSGAVFGLLDIDDEF

SEQ ID NO: 764090 - protein, 19 aa, Mycobacterium
ELRTLFLFEHLTDAQLDTL

SEQ ID NO: 764091 - protein, 21 aa, Mycobacterium
ELRVAGLLPRVIAESQRRQRA

SEQ ID NO: 764092 - protein, 21 aa, Mycobacterium
ELRVLRLDTEYAWAEDPPSRI

SEQ ID NO: 764093 - protein, 18 aa, Mycobacterium
ELRVPRWVTADDRLLVTV

SEQ ID NO: 764094 - protein, 22 aa, Mycobacterium
ELRYPHLADWGIPTARAIVEVR

SEQ ID NO: 764095 - protein, 21 aa, Mycobacterium
ELSARAALFHDEFVRVLSAGA

SEQ ID NO: 764096 - protein, 24 aa, Mycobacterium
ELSELTENCDLIWVMHEGRNIAAF

SEQ ID NO: 764097 - protein, 17 aa, Mycobacterium
ELSGWPRSPGWTGAAAV

SEQ ID NO: 764098 - protein, 20 aa, Mycobacterium
ELSRRAGVVAGRSVCGVVGS

SEQ ID NO: 764099 - protein, 21 aa, Mycobacterium
ELSRRFGLPLWRFANSGTEAT

SEQ ID NO: 764100 - protein, 20 aa, Mycobacterium
ELTCSFLFACTGYYNYDEGY

SEQ ID NO: 764101 - protein, 17 aa, Mycobacterium
ELTEFDFEFELRGSEFQ

SEQ ID NO: 764102 - protein, 22 aa, Mycobacterium
ELTERPSLFPAWDSLSDSQKKL

SEQ ID NO: 764103 - protein, 19 aa, Mycobacterium
ELTHALWVGPASASMLSAV

SEQ ID NO: 764104 - protein, 25 aa, Mycobacterium
ELTRRSGGIFGRRVCAVVGSGDNGG

SEQ ID NO: 764105 - protein, 23 aa, Mycobacterium
ELTRYGLGVLRAWIRHGTIYGKA

SEQ ID NO: 764106 - protein, 19 aa, Mycobacterium
ELTVGQWVMRGLADLVPNM

SEQ ID NO: 764107 - protein, 25 aa, Mycobacterium
ELVDFWRFNVAFARQILAQQPISGP

SEQ ID NO: 764108 - protein, 18 aa, Mycobacterium
ELVDGFPRFDVDDVYLGN

SEQ ID NO: 764109 - protein, 24 aa, Mycobacterium
ELVDRYRITVTWAPNFAYQLVTAR

SEQ ID NO: 764110 - protein, 17 aa, Mycobacterium
ELVDVPGAHVLRLDITD

SEQ ID NO: 764111 - protein, 26 aa, Mycobacterium
ELVEVFLRLAHGVGRRQVLLAHAAER

SEQ ID NO: 764112 - protein, 18 aa, Mycobacterium
ELVGRMSVPQSWGVATAV

SEQ ID NO: 764113 - protein, 18 aa, Mycobacterium
ELVIPFLVPDGAHSYPDD

SEQ ID NO: 764114 - protein, 18 aa, Mycobacterium
ELVKRCYAEILPAARPGA

SEQ ID NO: 764115 - protein, 17 aa, Mycobacterium
ELVLAAFIEGMRAQLVR

SEQ ID NO: 764116 - protein, 24 aa, Mycobacterium
ELVLRTGATLKWYGVTAEGRIDLD

SEQ ID NO: 764117 - protein, 20 aa, Mycobacterium
ELVSLVLDWNRPVKLFIETK

SEQ ID NO: 764118 - protein, 19 aa, Mycobacterium
ELVVSLGYRCQIAKKAVNG

SEQ ID NO: 764119 - protein, 17 aa, Mycobacterium
ELWAARRPGQVFVVEQH

SEQ ID NO: 764120 - protein, 18 aa, Mycobacterium
ELWPELRAAFTPPDEQPS

SEQ ID NO: 764121 - protein, 24 aa, Mycobacterium
ELWWLKTPLPGVVWCNTPHMTGFD

SEQ ID NO: 764122 - protein, 20 aa, Mycobacterium
ELYDGFSFNCLSWIEALGFC

SEQ ID NO: 764123 - protein, 19 aa, Mycobacterium
ELYDGFTFNCLSWLEALGF

SEQ ID NO: 764124 - protein, 19 aa, Mycobacterium
ELYDGFTFNCLSWLEGLGF

SEQ ID NO: 764125 - protein, 17 aa, Mycobacterium
ELYEIRTLFGVLFQDGA

SEQ ID NO: 764126 - protein, 18 aa, Mycobacterium
ELYERWPFFRSVLSNMAQ

SEQ ID NO: 764127 - protein, 18 aa, Mycobacterium
ELYFPGSPVLSVSGTFAE

SEQ ID NO: 764128 - protein, 18 aa, Mycobacterium
ELYFPGSPVLSVTGTFAE

SEQ ID NO: 764129 - protein, 20 aa, Mycobacterium
ELYRRNGIQFLPFNTVYQLA

SEQ ID NO: 764130 - protein, 23 aa, Mycobacterium
ELYRRWTGLLSYRYIGRKHSSMD

SEQ ID NO: 764131 - protein, 23 aa, Mycobacterium
ELYRRWTGLLSYRYIGRKHSSMN

SEQ ID NO: 764132 - protein, 19 aa, Mycobacterium
EMARTGVALTDIARMYAQV

SEQ ID NO: 764133 - protein, 17 aa, Mycobacterium
EMGRCFAEFDWAAHPLG

SEQ ID NO: 764134 - protein, 24 aa, Mycobacterium
EMGRPRWKHAFGYLAGPNGPEPDP

SEQ ID NO: 764135 - protein, 18 aa, Mycobacterium
EMGVAGLEEFLERKTFAV

SEQ ID NO: 764136 - protein, 20 aa, Mycobacterium
EMGWRGACKRRRVRTTIADP

SEQ ID NO: 764137 - protein, 23 aa, Mycobacterium
EMGWRGACKRRRVRTTVADPAAT

SEQ ID NO: 764138 - protein, 19 aa, Mycobacterium
EMLASAALDLDNIGSTITA

SEQ ID NO: 764139 - protein, 20 aa, Mycobacterium
EMLPRNGFRLNIGLSEITDL

SEQ ID NO: 764140 - protein, 18 aa, Mycobacterium
EMLPTPWGLVRSGVAPDH

SEQ ID NO: 764141 - protein, 17 aa, Mycobacterium
EMLRLVETFGYGWSDLQ

SEQ ID NO: 764142 - protein, 19 aa, Mycobacterium
EMLSMAATDLASVGSAVSA

SEQ ID NO: 764143 - protein, 18 aa, Mycobacterium
EMMKHAWGPVRVAIAAEQ

SEQ ID NO: 764144 - protein, 20 aa, Mycobacterium
EMPHRVAGWCDYNSFFVSED

SEQ ID NO: 764145 - protein, 19 aa, Mycobacterium
EMQLHLACFAAFDDIGSVI

SEQ ID NO: 764146 - protein, 19 aa, Mycobacterium
EMQRLMALPVGMRPDPSDL

SEQ ID NO: 764147 - protein, 20 aa, Mycobacterium
EMRNRLKAATGLALSPTLIF

SEQ ID NO: 764148 - protein, 19 aa, Mycobacterium
EMSDRLVGHGALPIEVPTI

SEQ ID NO: 764149 - protein, 23 aa, Mycobacterium
EMVEKRLAATINERHRVVLGAVL

SEQ ID NO: 764150 - protein, 18 aa, Mycobacterium
EMYKYLVAVSRQPDHAKI

SEQ ID NO: 764151 - protein, 24 aa, Mycobacterium
EMYRECPRVYGVAVMGDLSRRRWW

SEQ ID NO: 764152 - protein, 22 aa, Mycobacterium
ENEKFRAGWCVPGVGQPNHDAV

SEQ ID NO: 764153 - protein, 23 aa, Mycobacterium
ENFARTWLDYRLKLLEATDRFGP

SEQ ID NO: 764154 - protein, 17 aa, Mycobacterium
ENFGVSRSEIWPRVDEA

SEQ ID NO: 764155 - protein, 18 aa, Mycobacterium
ENGRVAGAFGYYRETGKF

SEQ ID NO: 764156 - protein, 20 aa, Mycobacterium
ENIANCWQLAAVMKQRVGRL

SEQ ID NO: 764157 - protein, 24 aa, Mycobacterium
ENIVCPWHGWQWRGDGSNALIPYS

SEQ ID NO: 764158 - protein, 17 aa, Mycobacterium
ENKAALSNWAWGRQSID

SEQ ID NO: 764159 - protein, 17 aa, Mycobacterium
ENLSWSAPRLHLVDLQY

SEQ ID NO: 764160 - protein, 20 aa, Mycobacterium
ENLWTAAVQFDWDNARADAD

SEQ ID NO: 764161 - protein, 24 aa, Mycobacterium
ENLYRYCTEFGFPDPFSGMKKSIS

SEQ ID NO: 764162 - protein, 24 aa, Mycobacterium
ENMASGLALEWSRYGIRTLCVAPG

SEQ ID NO: 764163 - protein, 17 aa, Mycobacterium
ENMRRWGLLGSFGTVGD

SEQ ID NO: 764164 - protein, 17 aa, Mycobacterium
ENPDRWAPPYAEAGAHN

SEQ ID NO: 764165 - protein, 24 aa, Mycobacterium
ENRARPAPLAVEWGGQAFLDDATR

SEQ ID NO: 764166 - protein, 17 aa, Mycobacterium
ENRIVDLLMDFYPAAIA

SEQ ID NO: 764167 - protein, 25 aa, Mycobacterium
ENTFRWNWRLGDVAIWDNRATQHYG

SEQ ID NO: 764168 - protein, 17 aa, Mycobacterium
ENTRFWAPLSLTAEQKH

SEQ ID NO: 764169 - protein, 17 aa, Mycobacterium
ENTRFWAPLSLTPEQKH

SEQ ID NO: 764170 - protein, 19 aa, Mycobacterium
ENVKFFFTGIPWKTYPQTL

SEQ ID NO: 764171 - protein, 23 aa, Mycobacterium
ENYSGAVGLNWYLTDPTLRFTMA

SEQ ID NO: 764172 - protein, 18 aa, Mycobacterium
EPAHGVVMVSGYDEALAV

SEQ ID NO: 764173 - protein, 20 aa, Mycobacterium
EPARAAFEWCRTVQRADGSW

SEQ ID NO: 764174 - protein, 22 aa, Mycobacterium
EPDELRSLFLFEALTDEQLAVL

SEQ ID NO: 764175 - protein, 19 aa, Mycobacterium
EPDLKWERFITAVRLLAER

SEQ ID NO: 764176 - protein, 22 aa, Mycobacterium
EPDLPLRFAINIGSAVMTTPEG

SEQ ID NO: 764177 - protein, 20 aa, Mycobacterium
EPDLRWERFVTAIRLLAERL

SEQ ID NO: 764178 - protein, 23 aa, Mycobacterium
EPDYRGCAFINSFGELGGISPAV

SEQ ID NO: 764179 - protein, 22 aa, Mycobacterium
EPEKYIAAGLWRSADTLEELAV

SEQ ID NO: 764180 - protein, 23 aa, Mycobacterium
EPELRFELCLGVNGVHYPHETGR

SEQ ID NO: 764181 - protein, 22 aa, Mycobacterium
EPEMLRRAVLYAIERKRAELTS

SEQ ID NO: 764182 - protein, 23 aa, Mycobacterium
EPEPLRWIGVRGMYLAYKAADWH

SEQ ID NO: 764183 - protein, 26 aa, Mycobacterium
EPERTRWGLPVDRLRFAMSNYQRLTF

SEQ ID NO: 764184 - protein, 18 aa, Mycobacterium
EPESMTFTGLMVGTVPLT

SEQ ID NO: 764185 - protein, 20 aa, Mycobacterium
EPEVGLACRVNWRGDVVVSL

SEQ ID NO: 764186 - protein, 20 aa, Mycobacterium
EPEVGLACRVVWDGDTVVTL

SEQ ID NO: 764187 - protein, 23 aa, Mycobacterium
EPEVGVACQVVWNGDTVARLEPF

SEQ ID NO: 764188 - protein, 17 aa, Mycobacterium
EPFGAVGVIAPWNGSLV

SEQ ID NO: 764189 - protein, 27 aa, Mycobacterium
EPFLRVNLYGVLHCTRAVLPSMIDHTW

SEQ ID NO: 764190 - protein, 24 aa, Mycobacterium
EPFPGFVWEGCLNPVLGCPIQDHK

SEQ ID NO: 764191 - protein, 18 aa, Mycobacterium
EPFPRFSVVRTTNGRPTL

SEQ ID NO: 764192 - protein, 20 aa, Mycobacterium
EPFTRFPMRSVWPDMFSVYK

SEQ ID NO: 764193 - protein, 19 aa, Mycobacterium
EPFTTVGLCCYRDGSDSVA

SEQ ID NO: 764194 - protein, 18 aa, Mycobacterium
EPFWFPNWTRLVYAGNGL

SEQ ID NO: 764195 - protein, 22 aa, Mycobacterium
EPGIYFPGRWGARIEDIVVVTE

SEQ ID NO: 764196 - protein, 22 aa, Mycobacterium
EPGIYFPGRWGARIEDIVVVTK

SEQ ID NO: 764197 - protein, 23 aa, Mycobacterium
EPGRAATVALHWDKIAAQRLGVV

SEQ ID NO: 764198 - protein, 17 aa, Mycobacterium
EPGRLAGVIAFGDRVLR

SEQ ID NO: 764199 - protein, 21 aa, Mycobacterium
EPGRPCSLLGLLFADADGCAG

SEQ ID NO: 764200 - protein, 22 aa, Mycobacterium
EPGRPCWLVGLLFPGADGCAGH

SEQ ID NO: 764201 - protein, 21 aa, Mycobacterium
EPGRPCWLVGLLFPSADGCAG

SEQ ID NO: 764202 - protein, 19 aa, Mycobacterium
EPGRWSGWVRIDGERIGVD

SEQ ID NO: 764203 - protein, 18 aa, Mycobacterium
EPGRWSGWVTIDGERVSV

SEQ ID NO: 764204 - protein, 17 aa, Mycobacterium
EPGVYFPGQWGARIEDI

SEQ ID NO: 764205 - protein, 18 aa, Mycobacterium
EPGWTMFMVSHFHYDPVW

SEQ ID NO: 764206 - protein, 18 aa, Mycobacterium
EPGYRPSTALAEFVRFRD

SEQ ID NO: 764207 - protein, 18 aa, Mycobacterium
EPGYWPWPDVLANALVID

SEQ ID NO: 764208 - protein, 22 aa, Mycobacterium
EPIAARILEHFGLAEFFQVIAG

SEQ ID NO: 764209 - protein, 19 aa, Mycobacterium
EPIAVVGMACRYAGGVDSP

SEQ ID NO: 764210 - protein, 19 aa, Mycobacterium
EPIAVVGMGCRFPGGATDP

SEQ ID NO: 764211 - protein, 20 aa, Mycobacterium
EPIVLPGMVVPIELDDAGRA

SEQ ID NO: 764212 - protein, 19 aa, Mycobacterium
EPKKAVLFDDRWASAREDL

SEQ ID NO: 764213 - protein, 20 aa, Mycobacterium
EPKLALPTPAGWEYTAAMNS

SEQ ID NO: 764214 - protein, 21 aa, Mycobacterium
EPKTEKVRRLFAAADIHIPTQ

SEQ ID NO: 764215 - protein, 22 aa, Mycobacterium
EPLALSGGQSWWGGIDTERSHL

SEQ ID NO: 764216 - protein, 23 aa, Mycobacterium
EPLCRRLVMSVPFFKAVQRPNVS

SEQ ID NO: 764217 - protein, 20 aa, Mycobacterium
EPLFMAGLWTTWRPKPADTD

SEQ ID NO: 764218 - protein, 21 aa, Mycobacterium
EPLFMAGLWTTWRPPGAPKDH

SEQ ID NO: 764219 - protein, 19 aa, Mycobacterium
EPLGRLAFTFRYRGHRLRL

SEQ ID NO: 764220 - protein, 23 aa, Mycobacterium
EPLGVPGEFGWRVPSLSLADESI

SEQ ID NO: 764221 - protein, 21 aa, Mycobacterium
EPLIWRGFENLNIPLLDVHMS

SEQ ID NO: 764222 - protein, 18 aa, Mycobacterium
EPLKCLTENLWALHTNRH

SEQ ID NO: 764223 - protein, 18 aa, Mycobacterium
EPLKCLVENLWALHTNRY

SEQ ID NO: 764224 - protein, 17 aa, Mycobacterium
EPLPRIGLDSLPEQGAW

SEQ ID NO: 764225 - protein, 24 aa, Mycobacterium
EPLPRSLVWSAAWEMTREAELRAR

SEQ ID NO: 764226 - protein, 21 aa, Mycobacterium
EPLPRTLAWSAAWEMTRDAEL

SEQ ID NO: 764227 - protein, 21 aa, Mycobacterium
EPLPRTLAWSAAWEMTREAEL

SEQ ID NO: 764228 - protein, 17 aa, Mycobacterium
EPLRSTALAGRAPAKSA

SEQ ID NO: 764229 - protein, 18 aa, Mycobacterium
EPMLFEWTDRDTLLYALG

SEQ ID NO: 764230 - protein, 18 aa, Mycobacterium
EPMRIPLALVELVKRERS

SEQ ID NO: 764231 - protein, 22 aa, Mycobacterium
EPNLRVLVNLGYGDPAYGYDTG

SEQ ID NO: 764232 - protein, 19 aa, Mycobacterium
EPNMRWRTFCAELLAIADK

SEQ ID NO: 764233 - protein, 18 aa, Mycobacterium
EPNMRWRTFCAELLNIAD

SEQ ID NO: 764234 - protein, 18 aa, Mycobacterium
EPNMRWRTFCAELVAIAD

SEQ ID NO: 764235 - protein, 18 aa, Mycobacterium
EPPAALVQACLDRDLPLL

SEQ ID NO: 764236 - protein, 22 aa, Mycobacterium
EPPCAELAALVRRVGPLEAADR

SEQ ID NO: 764237 - protein, 25 aa, Mycobacterium
EPPQKWSASGKFGLVANEASEGESL

SEQ ID NO: 764238 - protein, 18 aa, Mycobacterium
EPPVARPAPEPPPRPAPE

SEQ ID NO: 764239 - protein, 22 aa, Mycobacterium
EPPVEGSWAWLPDEAAGSRVHW

SEQ ID NO: 764240 - protein, 22 aa, Mycobacterium
EPQIYLCGGAGFVDAVRGQLAA

SEQ ID NO: 764241 - protein, 22 aa, Mycobacterium
EPRFQILAVFDFLYEWFSQPDF

SEQ ID NO: 764242 - protein, 20 aa, Mycobacterium
EPRLFPWRDVRTNVGYGLTR

SEQ ID NO: 764243 - protein, 19 aa, Mycobacterium
EPRLFPWRDVRTNVSYGLT

SEQ ID NO: 764244 - protein, 20 aa, Mycobacterium
EPRLFPWRSVRDNVLYGLTR

SEQ ID NO: 764245 - protein, 17 aa, Mycobacterium
EPRTEWLDGVVVRDDHG

SEQ ID NO: 764246 - protein, 19 aa, Mycobacterium
EPRWPKYAPAAVEHGVLSS

SEQ ID NO: 764247 - protein, 24 aa, Mycobacterium
EPRYRPSRALQRFVHARDITCRFP

SEQ ID NO: 764248 - protein, 18 aa, Mycobacterium
EPVARWGAAVPWAAILEP

SEQ ID NO: 764249 - protein, 25 aa, Mycobacterium
EPVTDSWYLTSIQAGFEPWSGSVGA

SEQ ID NO: 764250 - protein, 17 aa, Mycobacterium
EPVWLQWFLILAKKMRF

SEQ ID NO: 764251 - protein, 19 aa, Mycobacterium
EPWQVPKFYWAVMADSAFE

SEQ ID NO: 764252 - protein, 19 aa, Mycobacterium
EPWRSKFFLDHKVGELIYY

SEQ ID NO: 764253 - protein, 19 aa, Mycobacterium
EPWRSKYFLNRNVGELIYY

SEQ ID NO: 764254 - protein, 19 aa, Mycobacterium
EPWRSKYFLSHRVGEQIYY

SEQ ID NO: 764255 - protein, 19 aa, Mycobacterium
EPWRSKYFLTRNVGEQIYY

SEQ ID NO: 764256 - protein, 21 aa, Mycobacterium
EPYFYIVEILSHFDLIAVQEV

SEQ ID NO: 764257 - protein, 20 aa, Mycobacterium
EPYGGAWLNSWLDRDLGVSG

SEQ ID NO: 764258 - protein, 17 aa, Mycobacterium
EPYLRPGQIEEHLVYPV

SEQ ID NO: 764259 - protein, 22 aa, Mycobacterium
EQARFAGAFTFQYSKRPGTPAA

SEQ ID NO: 764260 - protein, 23 aa, Mycobacterium
EQARKRFAAAWNHQDGGHPINDS

SEQ ID NO: 764261 - protein, 27 aa, Mycobacterium
EQEKLMAFCLAGALSFNLAAPESSDNR

SEQ ID NO: 764262 - protein, 27 aa, Mycobacterium
EQEKLMAFCLAGALSFNLANPETGDNR

SEQ ID NO: 764263 - protein, 27 aa, Mycobacterium
EQEKLMAFCLAGALSFNLASPESDNNK

SEQ ID NO: 764264 - protein, 27 aa, Mycobacterium
EQEKLMAFCLAGALSFNLASPGSADTR

SEQ ID NO: 764265 - protein, 19 aa, Mycobacterium
EQFQLPGIVHGLRWIADGD

SEQ ID NO: 764266 - protein, 20 aa, Mycobacterium
EQFRLAIYYRDVVGLRYREI

SEQ ID NO: 764267 - protein, 18 aa, Mycobacterium
EQGITIDVAYRFFSTESR

SEQ ID NO: 764268 - protein, 18 aa, Mycobacterium
EQIKRFRILPSLWEPGGD

SEQ ID NO: 764269 - protein, 24 aa, Mycobacterium
EQIYRGSQIVPWVNAVIPISKILP

SEQ ID NO: 764270 - protein, 20 aa, Mycobacterium
EQKHRWAVPILRAEITASLG

SEQ ID NO: 764271 - protein, 20 aa, Mycobacterium
EQKHRWAVPVLRGEKTASLG

SEQ ID NO: 764272 - protein, 21 aa, Mycobacterium
EQKQRWAVPILRADKTASLGM

SEQ ID NO: 764273 - protein, 21 aa, Mycobacterium
EQKRRWAVPILRAEITASLGM

SEQ ID NO: 764274 - protein, 17 aa, Mycobacterium
EQLFGWVAFEFGTYRFG

SEQ ID NO: 764275 - protein, 18 aa, Mycobacterium
EQLMPHWLLSLQADAARR

SEQ ID NO: 764276 - protein, 19 aa, Mycobacterium
EQLPAPGYVVWRAAANHFR

SEQ ID NO: 764277 - protein, 17 aa, Mycobacterium
EQLRFLAPVPLEPWEGV

SEQ ID NO: 764278 - protein, 21 aa, Mycobacterium
EQMKMFLTRLGFGSKMVITGD

SEQ ID NO: 764279 - protein, 22 aa, Mycobacterium
EQMKMFLTRLGFGSKMVVTGDI

SEQ ID NO: 764280 - protein, 17 aa, Mycobacterium
EQMPLDAGHQWRRGAAL

SEQ ID NO: 764281 - protein, 19 aa, Mycobacterium
EQPDIRPAPPIPQPVLGRP

SEQ ID NO: 764282 - protein, 17 aa, Mycobacterium
EQPFGFYARAWLDAQAV

SEQ ID NO: 764283 - protein, 19 aa, Mycobacterium
EQPRLLIKWVEACYGATSV

SEQ ID NO: 764284 - protein, 20 aa, Mycobacterium
EQPRRLGPVVAFPAQQTRRG

SEQ ID NO: 764285 - protein, 22 aa, Mycobacterium
EQQRLKVLVSIFGRETPVELNF

SEQ ID NO: 764286 - protein, 19 aa, Mycobacterium
EQRAKWWSNYDELAHTAVE

SEQ ID NO: 764287 - protein, 20 aa, Mycobacterium
EQRARPGARAALFGMTEAFG

SEQ ID NO: 764288 - protein, 20 aa, Mycobacterium
EQRSLTARPACTAADAAGAA

SEQ ID NO: 764289 - protein, 18 aa, Mycobacterium
EQRWPAYCRQALLETPIR

SEQ ID NO: 764290 - protein, 17 aa, Mycobacterium
EQVAALAHELFNMAREG

SEQ ID NO: 764291 - protein, 18 aa, Mycobacterium
EQVREILEPLGLSQEEPH

SEQ ID NO: 764292 - protein, 17 aa, Mycobacterium
EQYGSSLVTGWARLHGY

SEQ ID NO: 764293 - protein, 20 aa, Mycobacterium
EQYQRPGIVHGLRWIADGEY

SEQ ID NO: 764294 - protein, 18 aa, Mycobacterium
EQYRGSALYKLRTKGRAA

SEQ ID NO: 764295 - protein, 21 aa, Mycobacterium
ERAELIDWLFGQGITAAEIRT

SEQ ID NO: 764296 - protein, 22 aa, Mycobacterium
ERAGAAFQRWIARITARLCDDG

SEQ ID NO: 764297 - protein, 18 aa, Mycobacterium
ERALFLGQWGLRGQRGAD

SEQ ID NO: 764298 - protein, 21 aa, Mycobacterium
ERAMGFCLFNNISIGARHAQL

SEQ ID NO: 764299 - protein, 20 aa, Mycobacterium
ERARCLVVALAACAAAGTVR

SEQ ID NO: 764300 - protein, 23 aa, Mycobacterium
ERARLAYLRACNRLWALADPDGA

SEQ ID NO: 764301 - protein, 21 aa, Mycobacterium
ERARLGFGTVDARGWTEGRLR

SEQ ID NO: 764302 - protein, 17 aa, Mycobacterium
ERDRPLLDLAWDYATED

SEQ ID NO: 764303 - protein, 18 aa, Mycobacterium
EREILFPAGTKFYVIDKT

SEQ ID NO: 764304 - protein, 23 aa, Mycobacterium
EREIWSGKATFVFTRTTSGEIGI

SEQ ID NO: 764305 - protein, 23 aa, Mycobacterium
ERELWSGPATFVFTRTTAGEIGI

SEQ ID NO: 764306 - protein, 19 aa, Mycobacterium
ERERCLLFVACTRAREELL

SEQ ID NO: 764307 - protein, 20 aa, Mycobacterium
ERERTVLVLRFFDSMTQTQI

SEQ ID NO: 764308 - protein, 23 aa, Mycobacterium
ERFARRFGCVVIDGFGSTEGGVA

SEQ ID NO: 764309 - protein, 23 aa, Mycobacterium
ERFLAEGAERVFITGRRQTELDT

SEQ ID NO: 764310 - protein, 18 aa, Mycobacterium
ERFLQLWAEGSMTIAMPS

SEQ ID NO: 764311 - protein, 17 aa, Mycobacterium
ERFVQALAFGGSQYASA

SEQ ID NO: 764312 - protein, 17 aa, Mycobacterium
ERFWLGVGLTRSEAYVI

SEQ ID NO: 764313 - protein, 21 aa, Mycobacterium
ERGDMGLRPAMTVKCPVALVR

SEQ ID NO: 764314 - protein, 17 aa, Mycobacterium
ERGIPWDLIRGADSAEA

SEQ ID NO: 764315 - protein, 20 aa, Mycobacterium
ERGTLLAAVWLRPPAGESVL

SEQ ID NO: 764316 - protein, 24 aa, Mycobacterium
ERGWLAIRFDMPFRRNRPSGPPSA

SEQ ID NO: 764317 - protein, 18 aa, Mycobacterium
ERGWRFPDRLDRVYVNTR

SEQ ID NO: 764318 - protein, 26 aa, Mycobacterium
ERHYSFQLDREWPIRAAVLHTGDEHV

SEQ ID NO: 764319 - protein, 25 aa, Mycobacterium
ERIYWAFCTHLGYLVSNNSFGHRMV

SEQ ID NO: 764320 - protein, 25 aa, Mycobacterium
ERKVGGAEVVEWLRLRESLGHSAYQ

SEQ ID NO: 764321 - protein, 17 aa, Mycobacterium
ERLDQVQAWLADKPGTS

SEQ ID NO: 764322 - protein, 17 aa, Mycobacterium
ERLEQVRAWLAENPQTS

SEQ ID NO: 764323 - protein, 19 aa, Mycobacterium
ERLETLLALIEGWVQTVVT

SEQ ID NO: 764324 - protein, 19 aa, Mycobacterium
ERLETLLALVEGWVQTVVT

SEQ ID NO: 764325 - protein, 24 aa, Mycobacterium
ERLFPRTAAELFSWGKSWLETCQN

SEQ ID NO: 764326 - protein, 18 aa, Mycobacterium
ERLGAVIAGAVLKLSRDF

SEQ ID NO: 764327 - protein, 19 aa, Mycobacterium
ERLGGLPIRAIVRSPLLRC

SEQ ID NO: 764328 - protein, 24 aa, Mycobacterium
ERLIADQVRWIWLLLDDTLRAEGI

SEQ ID NO: 764329 - protein, 18 aa, Mycobacterium
ERLIEFFGGIPILDGIGS

SEQ ID NO: 764330 - protein, 17 aa, Mycobacterium
ERLPADHPLAVHFDVYQ

SEQ ID NO: 764331 - protein, 17 aa, Mycobacterium
ERLPCAHIPIAASTRES

SEQ ID NO: 764332 - protein, 18 aa, Mycobacterium
ERLPGLHLRRDISELTMR

SEQ ID NO: 764333 - protein, 24 aa, Mycobacterium
ERLPLLEPLRFIPVVGNPLADLLQ

SEQ ID NO: 764334 - protein, 24 aa, Mycobacterium
ERLPLRAALLWSRIGDQLSGQPRI

SEQ ID NO: 764335 - protein, 20 aa, Mycobacterium
ERLPRLKLITIVGMNLPNLD

SEQ ID NO: 764336 - protein, 18 aa, Mycobacterium
ERLQRLLTFVARQEPRLN

SEQ ID NO: 764337 - protein, 22 aa, Mycobacterium
ERLRIEPLLARSATWVTGESAG

SEQ ID NO: 764338 - protein, 22 aa, Mycobacterium
ERLRSGWLNGIKHWQVDYGGAP

SEQ ID NO: 764339 - protein, 22 aa, Mycobacterium
ERLRSGWLNGIKHWQVDYHSDS

SEQ ID NO: 764340 - protein, 23 aa, Mycobacterium
ERLRVCARRGVLLASGGFEQNAD

SEQ ID NO: 764341 - protein, 22 aa, Mycobacterium
ERLTGVMGYRWTKPVDAALSVA

SEQ ID NO: 764342 - protein, 17 aa, Mycobacterium
ERLVPDFLWISTEHTAQ

SEQ ID NO: 764343 - protein, 20 aa, Mycobacterium
ERLWISWAMANRDPAVFPDP

SEQ ID NO: 764344 - protein, 19 aa, Mycobacterium
ERLWISWAMANRDPQVFPD

SEQ ID NO: 764345 - protein, 22 aa, Mycobacterium
ERLYCIPATIDLAGAEIELVSM

SEQ ID NO: 764346 - protein, 22 aa, Mycobacterium
ERMRARIAAVMGYADRSAVDPA

SEQ ID NO: 764347 - protein, 25 aa, Mycobacterium
ERNRIGELIFRFYIGSLFQDNDFCG

SEQ ID NO: 764348 - protein, 21 aa, Mycobacterium
ERPARRPAWRPAASIRSHSVH

SEQ ID NO: 764349 - protein, 20 aa, Mycobacterium
ERPDLFPAWDSLSDTQKKLY

SEQ ID NO: 764350 - protein, 20 aa, Mycobacterium
ERPDYLPLFVAPQPVSFEPA

SEQ ID NO: 764351 - protein, 20 aa, Mycobacterium
ERPELLGAFLEEVLRYEPPF

SEQ ID NO: 764352 - protein, 24 aa, Mycobacterium
ERPEYPPGWARRVFWALMQAGYEA

SEQ ID NO: 764353 - protein, 18 aa, Mycobacterium
ERPLFPFLRGCLAGGAPI

SEQ ID NO: 764354 - protein, 19 aa, Mycobacterium
ERPQLGGLTIRTGVGQQPA

SEQ ID NO: 764355 - protein, 20 aa, Mycobacterium
ERPRTAAALGERGDEFLALK

SEQ ID NO: 764356 - protein, 20 aa, Mycobacterium
ERPYRLSASIGFVRAPVSDT

SEQ ID NO: 764357 - protein, 22 aa, Mycobacterium
ERQLKTLLPLIAVFGGAASGRI

SEQ ID NO: 764358 - protein, 17 aa, Mycobacterium
ERQYYWFGEPIDTTEFA

SEQ ID NO: 764359 - protein, 31 aa, Mycobacterium
ERRCWRLAMDILSCFAVRLGFDREFFARAHD

SEQ ID NO: 764360 - protein, 20 aa, Mycobacterium
ERRGDGLGALSTMVLPELRA

SEQ ID NO: 764361 - protein, 17 aa, Mycobacterium
ERRLPYPVEAVWAAITD

SEQ ID NO: 764362 - protein, 18 aa, Mycobacterium
ERRMCAIYSHLFGKERVG

SEQ ID NO: 764363 - protein, 21 aa, Mycobacterium
ERRPAPEPNWYGASSGNYGSP

SEQ ID NO: 764364 - protein, 17 aa, Mycobacterium
ERRPGWVGLPLAGVQTR

SEQ ID NO: 764365 - protein, 24 aa, Mycobacterium
ERRPLRAALLWGRIGDHLSGQARI

SEQ ID NO: 764366 - protein, 22 aa, Mycobacterium
ERRRFSMNYVFALYALPGPMTI

SEQ ID NO: 764367 - protein, 18 aa, Mycobacterium
ERRRGVVVNPVLETSEVP

SEQ ID NO: 764368 - protein, 24 aa, Mycobacterium
ERRTPPAFYAWRAFARYSPVLPAG

SEQ ID NO: 764369 - protein, 23 aa, Mycobacterium
ERRVAPRWWPPVMKKYVWPWLAA

SEQ ID NO: 764370 - protein, 21 aa, Mycobacterium
ERRVRLMMEMHVLAPLHLTQL

SEQ ID NO: 764371 - protein, 19 aa, Mycobacterium
ERSEFRFGQVMTGLSSTAD

SEQ ID NO: 764372 - protein, 21 aa, Mycobacterium
ERSPLPFGRHRWVAAPGPAAP

SEQ ID NO: 764373 - protein, 17 aa, Mycobacterium
ERSPSGKADYRWAREQA

SEQ ID NO: 764374 - protein, 23 aa, Mycobacterium
ERSRLMLDIANWRGRRRDELAAL

SEQ ID NO: 764375 - protein, 23 aa, Mycobacterium
ERSRLMLDIAQWRRRRRDELAAL

SEQ ID NO: 764376 - protein, 22 aa, Mycobacterium
ERSRLMLDIARWRRRRRDELAA

SEQ ID NO: 764377 - protein, 23 aa, Mycobacterium
ERSRPLWEMWFIEGLEGGRAATL

SEQ ID NO: 764378 - protein, 19 aa, Mycobacterium
ERTVLELRFFKGMTQSQIA

SEQ ID NO: 764379 - protein, 24 aa, Mycobacterium
ERVGWQWRLVWYKAVADLLTGDYD

SEQ ID NO: 764380 - protein, 19 aa, Mycobacterium
ERVGWQWRLVWYRAVSELL

SEQ ID NO: 764381 - protein, 23 aa, Mycobacterium
ERVKEIFRKAAIDLGRHEFFQGS

SEQ ID NO: 764382 - protein, 22 aa, Mycobacterium
ERWEWSDAVARMHGYRPGEVRP

SEQ ID NO: 764383 - protein, 19 aa, Mycobacterium
ERYGIPILVVYGATEFSGA

SEQ ID NO: 764384 - protein, 23 aa, Mycobacterium
ERYLAALMPMVWVACEREDFVVE

SEQ ID NO: 764385 - protein, 19 aa, Mycobacterium
ERYLRPLLEGELFSSYSMT

SEQ ID NO: 764386 - protein, 19 aa, Mycobacterium
ERYVREWLGGLVAAKVIEY

SEQ ID NO: 764387 - protein, 23 aa, Mycobacterium
ESAAGRFGVPMVWVPPLRERVSD

SEQ ID NO: 764388 - protein, 17 aa, Mycobacterium
ESADWTLRRGRIVLTDG

SEQ ID NO: 764389 - protein, 23 aa, Mycobacterium
ESARSVVYHGLWTAVHDVANLSV

SEQ ID NO: 764390 - protein, 17 aa, Mycobacterium
ESAWKLAKQYFKLTGKP

SEQ ID NO: 764391 - protein, 21 aa, Mycobacterium
ESCVEPLLARSAERFIEVLRR

SEQ ID NO: 764392 - protein, 23 aa, Mycobacterium
ESEFGVPILQAWGMTETSPLATV

SEQ ID NO: 764393 - protein, 17 aa, Mycobacterium
ESEGGFSPVRRRIFQLE

SEQ ID NO: 764394 - protein, 19 aa, Mycobacterium
ESEPMIIGRAFRVKVNAGI

SEQ ID NO: 764395 - protein, 20 aa, Mycobacterium
ESFAEAVSWVAKNLPTRPAV

SEQ ID NO: 764396 - protein, 19 aa, Mycobacterium
ESFAIPWLVIRALSDLAGA

SEQ ID NO: 764397 - protein, 21 aa, Mycobacterium
ESFGFKYGLPMDADMVVDVRF

SEQ ID NO: 764398 - protein, 18 aa, Mycobacterium
ESFHRWFSQALSAAAGSY

SEQ ID NO: 764399 - protein, 19 aa, Mycobacterium
ESFRLLGRVDVVFSNAGIV

SEQ ID NO: 764400 - protein, 20 aa, Mycobacterium
ESFTPLFVMSRITGWTAHIM

SEQ ID NO: 764401 - protein, 18 aa, Mycobacterium
ESFWKGKAFQSAYDQASN

SEQ ID NO: 764402 - protein, 21 aa, Mycobacterium
ESGKRGALLLALGSPGGSVII

SEQ ID NO: 764403 - protein, 18 aa, Mycobacterium
ESGLKVARKWGADVKGVP

SEQ ID NO: 764404 - protein, 17 aa, Mycobacterium
ESGSGWPSFTRPIDSGN

SEQ ID NO: 764405 - protein, 22 aa, Mycobacterium
ESGWIRTWLDTVLDLPWNARTE

SEQ ID NO: 764406 - protein, 23 aa, Mycobacterium
ESGWIRTWLDTVLDLPWNVKTED

SEQ ID NO: 764407 - protein, 20 aa, Mycobacterium
ESGWTFGFVDLAGFTALTDA

SEQ ID NO: 764408 - protein, 21 aa, Mycobacterium
ESGYDWLPRFVALLQGKLSTN

SEQ ID NO: 764409 - protein, 20 aa, Mycobacterium
ESIELWAPCFGERDVAEHES

SEQ ID NO: 764410 - protein, 17 aa, Mycobacterium
ESIKALAIILSKRLPPA

SEQ ID NO: 764411 - protein, 21 aa, Mycobacterium
ESIPEMVLRCALVDEAVLARV

SEQ ID NO: 764412 - protein, 17 aa, Mycobacterium
ESIRAGLRMEELDLEYL

SEQ ID NO: 764413 - protein, 21 aa, Mycobacterium
ESIRRFRILPVDFTVLTGELT

SEQ ID NO: 764414 - protein, 18 aa, Mycobacterium
ESKRFCWNCGKPVGRSSK

SEQ ID NO: 764415 - protein, 17 aa, Mycobacterium
ESLAGQGARVQVTEIDP

SEQ ID NO: 764416 - protein, 20 aa, Mycobacterium
ESLDCWPVNFALLGKGNTVS

SEQ ID NO: 764417 - protein, 18 aa, Mycobacterium
ESLDPWWPELSKPVIGAI

SEQ ID NO: 764418 - protein, 18 aa, Mycobacterium
ESLEEYWWCAEQMLTWPD

SEQ ID NO: 764419 - protein, 23 aa, Mycobacterium
ESLPDDFILYWGFLATAQVLTGR

SEQ ID NO: 764420 - protein, 20 aa, Mycobacterium
ESLRARFGTLTGVDRPVATG

SEQ ID NO: 764421 - protein, 23 aa, Mycobacterium
ESLRFGHRPRLRVFAMSPTADYD

SEQ ID NO: 764422 - protein, 17 aa, Mycobacterium
ESLRLLAEEVMPRLNAR

SEQ ID NO: 764423 - protein, 17 aa, Mycobacterium
ESLRLLLRRIFESAGGT

SEQ ID NO: 764424 - protein, 19 aa, Mycobacterium
ESLRRLRGLGARTVLPGHG

SEQ ID NO: 764425 - protein, 17 aa, Mycobacterium
ESLRRSLSFNGYSVDLA

SEQ ID NO: 764426 - protein, 17 aa, Mycobacterium
ESLVNWNALAAMSGTIV

SEQ ID NO: 764427 - protein, 17 aa, Mycobacterium
ESLWRLLCEQVGAAALV

SEQ ID NO: 764428 - protein, 25 aa, Mycobacterium
ESLYEYGSRAGLWRVLRVFEQRGIP

SEQ ID NO: 764429 - protein, 17 aa, Mycobacterium
ESMIERFERVLGAMTAD

SEQ ID NO: 764430 - protein, 20 aa, Mycobacterium
ESMKSFRPGGRVEIPTGVAS

SEQ ID NO: 764431 - protein, 20 aa, Mycobacterium
ESPEPPAFLLLGSDALSAYR

SEQ ID NO: 764432 - protein, 20 aa, Mycobacterium
ESRIGFVLSDAAPLAVVTTA

SEQ ID NO: 764433 - protein, 27 aa, Mycobacterium
ESRLTFLAVRRWFGWSAGRIINLDIGG

SEQ ID NO: 764434 - protein, 23 aa, Mycobacterium
ESRLTFLAVRRWYGWSAGRIINI

SEQ ID NO: 764435 - protein, 23 aa, Mycobacterium
ESRLTFLAVRRWYGWSAGRIINL

SEQ ID NO: 764436 - protein, 26 aa, Mycobacterium
ESRLTFLAVRRWYGWSAGRIINLDIG

SEQ ID NO: 764437 - protein, 27 aa, Mycobacterium
ESRLTFLAVRRWYGWSAGRIINLDIGG

SEQ ID NO: 764438 - protein, 27 aa, Mycobacterium
ESRLTFLAVRRWYGWSAGRIVNIDIGG

SEQ ID NO: 764439 - protein, 27 aa, Mycobacterium
ESRLTFLAVRRWYGWSAGRIVNLDIGG

SEQ ID NO: 764440 - protein, 20 aa, Mycobacterium
ESRPAALPFLSIKKITVHYR

SEQ ID NO: 764441 - protein, 17 aa, Mycobacterium
ESRRKPRMAAYVKQLYG

SEQ ID NO: 764442 - protein, 18 aa, Mycobacterium
ESTDRIAVIPAWRETAYF

SEQ ID NO: 764443 - protein, 20 aa, Mycobacterium
ESVAKPVQWYDIAQVLPELG

SEQ ID NO: 764444 - protein, 20 aa, Mycobacterium
ESVFHFWRYVGLLMGIHPEL

SEQ ID NO: 764445 - protein, 18 aa, Mycobacterium
ESVFSWPVLIEVPDNADD

SEQ ID NO: 764446 - protein, 20 aa, Mycobacterium
ESVGFIINRVWAAVKREALA

SEQ ID NO: 764447 - protein, 19 aa, Mycobacterium
ESVGTRVGRIIRIITRTVG

SEQ ID NO: 764448 - protein, 18 aa, Mycobacterium
ESVQRMALALGFDLDEME

SEQ ID NO: 764449 - protein, 18 aa, Mycobacterium
ESVRPGFSLAIDDGGDFR

SEQ ID NO: 764450 - protein, 24 aa, Mycobacterium
ESVSSSPDFLGWIDPTAAAASPHT

SEQ ID NO: 764451 - protein, 17 aa, Mycobacterium
ESVWWRCHRRLVADVAE

SEQ ID NO: 764452 - protein, 17 aa, Mycobacterium
ESWHAVVLVCPPRSADE

SEQ ID NO: 764453 - protein, 19 aa, Mycobacterium
ESWPSWAPVITKVTWTSPP

SEQ ID NO: 764454 - protein, 19 aa, Mycobacterium
ESWRLAPVLPKSVTVVNLL

SEQ ID NO: 764455 - protein, 23 aa, Mycobacterium
ESYAVAWTCLFRNLRLTAGQTLL

SEQ ID NO: 764456 - protein, 18 aa, Mycobacterium
ESYEKLQLLAIIGASSPP

SEQ ID NO: 764457 - protein, 17 aa, Mycobacterium
ESYRWSTDLGIASPMGI

SEQ ID NO: 764458 - protein, 22 aa, Mycobacterium
ETAFGCPVLEGYGLSESSPVAA

SEQ ID NO: 764459 - protein, 18 aa, Mycobacterium
ETALWLALTCAVPVPVVL

SEQ ID NO: 764460 - protein, 25 aa, Mycobacterium
ETALYRLAQSWGFQPDFVMGCSAGE

SEQ ID NO: 764461 - protein, 17 aa, Mycobacterium
ETARLWLSLGHHDRHGV

SEQ ID NO: 764462 - protein, 20 aa, Mycobacterium
ETEGCVREVLVLAAALTIHD

SEQ ID NO: 764463 - protein, 21 aa, Mycobacterium
ETELPRNCLLIFGQEGPGITP

SEQ ID NO: 764464 - protein, 18 aa, Mycobacterium
ETELRAWAVPRAANQFWM

SEQ ID NO: 764465 - protein, 21 aa, Mycobacterium
ETEQRLALIAAWEEAGDLFTE

SEQ ID NO: 764466 - protein, 23 aa, Mycobacterium
ETFHIAQLLPWVEANFRTYAEYD

SEQ ID NO: 764467 - protein, 17 aa, Mycobacterium
ETFKDGWLHTGDMARED

SEQ ID NO: 764468 - protein, 19 aa, Mycobacterium
ETFPGLRLLVLNDRLAESL

SEQ ID NO: 764469 - protein, 20 aa, Mycobacterium
ETFRAIGVDLMFTHIKQSLH

SEQ ID NO: 764470 - protein, 20 aa, Mycobacterium
ETFRAIGVNLMFDHIKESLH

SEQ ID NO: 764471 - protein, 17 aa, Mycobacterium
ETFRYSWGPAIAGLDTP

SEQ ID NO: 764472 - protein, 18 aa, Mycobacterium
ETGFWRFAPDPNDPDENQ

SEQ ID NO: 764473 - protein, 23 aa, Mycobacterium
ETGLAELCTLTWTVYSLPGAPIL

SEQ ID NO: 764474 - protein, 27 aa, Mycobacterium
ETGMPRLGWRAATLSGFRRDPDAALVF

SEQ ID NO: 764475 - protein, 18 aa, Mycobacterium
ETGRPWVEVHFANISAPP

SEQ ID NO: 764476 - protein, 18 aa, Mycobacterium
ETHPERWELIYGSAAVLP

SEQ ID NO: 764477 - protein, 19 aa, Mycobacterium
ETIAQRTTREWLDLFRELE

SEQ ID NO: 764478 - protein, 19 aa, Mycobacterium
ETIDGFGYSDCGGHPQWYE

SEQ ID NO: 764479 - protein, 17 aa, Mycobacterium
ETIDWGRTVLALGLDTI

SEQ ID NO: 764480 - protein, 24 aa, Mycobacterium
ETKRALTEAVLWPLQHPDTFSRLG

SEQ ID NO: 764481 - protein, 20 aa, Mycobacterium
ETKSRMALMAHLLKRGYRHL

SEQ ID NO: 764482 - protein, 17 aa, Mycobacterium
ETLELLLRPTGYSDDIT

SEQ ID NO: 764483 - protein, 29 aa, Mycobacterium
ETLGFFCGIGIPITEIWGMSELSCVATAS

SEQ ID NO: 764484 - protein, 20 aa, Mycobacterium
ETLGLGRYVIWLHDYGSQFG

SEQ ID NO: 764485 - protein, 17 aa, Mycobacterium
ETLKIALTLPFSADAIP

SEQ ID NO: 764486 - protein, 19 aa, Mycobacterium
ETLPDWFVREHDLMSEDEA

SEQ ID NO: 764487 - protein, 19 aa, Mycobacterium
ETLRLLIDLARTANLEQRR

SEQ ID NO: 764488 - protein, 18 aa, Mycobacterium
ETLRPCGVREVLLAGRRG

SEQ ID NO: 764489 - protein, 18 aa, Mycobacterium
ETLRRAGDRFGFAVESMS

SEQ ID NO: 764490 - protein, 22 aa, Mycobacterium
ETLRRAGERFGFAVESMSLLSE

SEQ ID NO: 764491 - protein, 22 aa, Mycobacterium
ETLRVGPQPEWRVEVDSDRVEV

SEQ ID NO: 764492 - protein, 19 aa, Mycobacterium
ETNVEFWAAVILDFAGVPA

SEQ ID NO: 764493 - protein, 23 aa, Mycobacterium
ETNVEFWAAVILDFAQVPANMMP

SEQ ID NO: 764494 - protein, 22 aa, Mycobacterium
ETNVEFWAAVILDFAQVPASMM

SEQ ID NO: 764495 - protein, 24 aa, Mycobacterium
ETNVEFWAAVILDFAQVPTRMMPA

SEQ ID NO: 764496 - protein, 23 aa, Mycobacterium
ETNVEFWAAVILDFARVPANMMP

SEQ ID NO: 764497 - protein, 24 aa, Mycobacterium
ETNVEFWAAVILDFARVPANMMPA

SEQ ID NO: 764498 - protein, 20 aa, Mycobacterium
ETPLPWPPPFWKSAADQGLT

SEQ ID NO: 764499 - protein, 19 aa, Mycobacterium
ETPWLPGQVQVFIHGEAQA

SEQ ID NO: 764500 - protein, 20 aa, Mycobacterium
ETRAAHWLLLLGADRVDAIE

SEQ ID NO: 764501 - protein, 19 aa, Mycobacterium
ETRGRFGTFVARADPADAA

SEQ ID NO: 764502 - protein, 20 aa, Mycobacterium
ETRGRFGTFVARADPADVAM

SEQ ID NO: 764503 - protein, 23 aa, Mycobacterium
ETRIARVFLDYCIDLHLAGQLDV

SEQ ID NO: 764504 - protein, 20 aa, Mycobacterium
ETRKSFGIAGARVVESIKLS

SEQ ID NO: 764505 - protein, 18 aa, Mycobacterium
ETRLQWYVDLGIERDNLR

SEQ ID NO: 764506 - protein, 22 aa, Mycobacterium
ETRWGLPVDRLRFAMSNYQRLT

SEQ ID NO: 764507 - protein, 21 aa, Mycobacterium
ETRWPEFTARAVAATPIRSML

SEQ ID NO: 764508 - protein, 21 aa, Mycobacterium
ETSVALGFGFRCGFLGLLHME

SEQ ID NO: 764509 - protein, 21 aa, Mycobacterium
ETTAQRILAHFGLDGHFEVIA

SEQ ID NO: 764510 - protein, 18 aa, Mycobacterium
ETTPEHWDTIIGVNVRGV

SEQ ID NO: 764511 - protein, 19 aa, Mycobacterium
ETVNGWFKRVYDLGLPLNI

SEQ ID NO: 764512 - protein, 24 aa, Mycobacterium
ETVPNPILTPGFHGLHIHSVGKCE

SEQ ID NO: 764513 - protein, 22 aa, Mycobacterium
ETVRHWLEVVGLQEFADHRPRQ

SEQ ID NO: 764514 - protein, 23 aa, Mycobacterium
ETWNGHFPFGWGVSAHPKVDSGT

SEQ ID NO: 764515 - protein, 18 aa, Mycobacterium
ETWPLLRNARWLPLVIAH

SEQ ID NO: 764516 - protein, 17 aa, Mycobacterium
EVAEGWQPIFYLPEKAH

SEQ ID NO: 764517 - protein, 20 aa, Mycobacterium
EVAGRLAARIGSGLLVDVVG

SEQ ID NO: 764518 - protein, 18 aa, Mycobacterium
EVAGRLAARLGSGLLTDV

SEQ ID NO: 764519 - protein, 21 aa, Mycobacterium
EVAHLRAFRAYAEHCQEIALH

SEQ ID NO: 764520 - protein, 19 aa, Mycobacterium
EVAIRLGVDPRKADQMVRG

SEQ ID NO: 764521 - protein, 18 aa, Mycobacterium
EVALEYAIAASLVHHGLG

SEQ ID NO: 764522 - protein, 23 aa, Mycobacterium
EVALFRLLESWGIHPDFVMGHSI

SEQ ID NO: 764523 - protein, 23 aa, Mycobacterium
EVALFRLLESWGIHPDLVLGHSI

SEQ ID NO: 764524 - protein, 24 aa, Mycobacterium
EVAPWLDLACKLGVLAAALSDEPP

SEQ ID NO: 764525 - protein, 24 aa, Mycobacterium
EVAPWLDLVRKLGLLVGALSAELP

SEQ ID NO: 764526 - protein, 22 aa, Mycobacterium
EVAPWLDLVRKLGVLAASLSDG

SEQ ID NO: 764527 - protein, 22 aa, Mycobacterium
EVAPWLDLVRKLGVLAATLSDG

SEQ ID NO: 764528 - protein, 25 aa, Mycobacterium
EVAPWLELVRKLGLLVGALADAPPV

SEQ ID NO: 764529 - protein, 23 aa, Mycobacterium
EVAPWLEVVRKLGVLIGAVSEQL

SEQ ID NO: 764530 - protein, 26 aa, Mycobacterium
EVARLLRPGGVFAFSAWVRDDRDGAE

SEQ ID NO: 764531 - protein, 18 aa, Mycobacterium
EVARRFESLAGRRPVVVF

SEQ ID NO: 764532 - protein, 17 aa, Mycobacterium
EVCAWIRMRPGRTALDA

SEQ ID NO: 764533 - protein, 19 aa, Mycobacterium
EVEEVFLPLARLLHLQVAA

SEQ ID NO: 764534 - protein, 23 aa, Mycobacterium
EVERPDLVIGWWAVPTILEHGSP

SEQ ID NO: 764535 - protein, 18 aa, Mycobacterium
EVFAGFGLDGRFPSSGLT

SEQ ID NO: 764536 - protein, 19 aa, Mycobacterium
EVFDLRPGAIIRDLDLLRP

SEQ ID NO: 764537 - protein, 22 aa, Mycobacterium
EVFEPPAYMGFHLANVWGESHD

SEQ ID NO: 764538 - protein, 18 aa, Mycobacterium
EVFFPGLRQEWRGTRPFV

SEQ ID NO: 764539 - protein, 19 aa, Mycobacterium
EVFRALLALILIVLRRDTG

SEQ ID NO: 764540 - protein, 22 aa, Mycobacterium
EVFWRKAHAAAMERAITLLLRQ

SEQ ID NO: 764541 - protein, 19 aa, Mycobacterium
EVGGLFGLFRMGLPTNFGL

SEQ ID NO: 764542 - protein, 20 aa, Mycobacterium
EVHCDVWAGFVFVNFDTTPR

SEQ ID NO: 764543 - protein, 22 aa, Mycobacterium
EVHEAVGVIVGWLAEADARART

SEQ ID NO: 764544 - protein, 17 aa, Mycobacterium
EVHRLRQPVLLIWGRED

SEQ ID NO: 764545 - protein, 19 aa, Mycobacterium
EVIAVGLVRIGEAAITQPG

SEQ ID NO: 764546 - protein, 22 aa, Mycobacterium
EVICELLAWAGVHPDYRSLPED

SEQ ID NO: 764547 - protein, 22 aa, Mycobacterium
EVIMVGGVLHFRQFRQANHGAS

SEQ ID NO: 764548 - protein, 18 aa, Mycobacterium
EVKKAAAEHGLWYPPDPS

SEQ ID NO: 764549 - protein, 18 aa, Mycobacterium
EVKKAVAEHGLWYPPDPS

SEQ ID NO: 764550 - protein, 20 aa, Mycobacterium
EVKPEFGWHTGMLIPGATMQ

SEQ ID NO: 764551 - protein, 18 aa, Mycobacterium
EVKQRYSVPVGGRGWIGP

SEQ ID NO: 764552 - protein, 18 aa, Mycobacterium
EVLGRAGLGVSLAGVGYA

SEQ ID NO: 764553 - protein, 17 aa, Mycobacterium
EVLGYRVERLLKMATIH

SEQ ID NO: 764554 - protein, 17 aa, Mycobacterium
EVLKLSALRGLFSAVVE

SEQ ID NO: 764555 - protein, 21 aa, Mycobacterium
EVLKRWPDWEVDYANAERAHT

SEQ ID NO: 764556 - protein, 21 aa, Mycobacterium
EVLLHLAAEGWQRWSNTVCGE

SEQ ID NO: 764557 - protein, 21 aa, Mycobacterium
EVLLHLAAEGWVRWSKTVCES

SEQ ID NO: 764558 - protein, 20 aa, Mycobacterium
EVLLHLSAEGWVRWSTTVSE

SEQ ID NO: 764559 - protein, 24 aa, Mycobacterium
EVLLRLSAEGWVRWSNTVSDKLAE

SEQ ID NO: 764560 - protein, 19 aa, Mycobacterium
EVLNAAAAEVSTIGSSLQT

SEQ ID NO: 764561 - protein, 23 aa, Mycobacterium
EVLPLRIPLLLAATGPKGAGVAK

SEQ ID NO: 764562 - protein, 20 aa, Mycobacterium
EVLRPGLLVLPVRGAARYFG

SEQ ID NO: 764563 - protein, 20 aa, Mycobacterium
EVLRRLKALPGFGEQKAKIF

SEQ ID NO: 764564 - protein, 17 aa, Mycobacterium
EVLTRVGYELANHGESL

SEQ ID NO: 764565 - protein, 26 aa, Mycobacterium
EVMAGFGRSGKWFSINHFDVVPDLLT

SEQ ID NO: 764566 - protein, 26 aa, Mycobacterium
EVMAGFGRSGKWFSINHFDVVPDLMT

SEQ ID NO: 764567 - protein, 25 aa, Mycobacterium
EVMAGFGRTGTWFAIDNFGVVPDLI

SEQ ID NO: 764568 - protein, 18 aa, Mycobacterium
EVMRRLTSELPLPVNAIA

SEQ ID NO: 764569 - protein, 21 aa, Mycobacterium
EVMVRPLIRLALGRRQSQRRI

SEQ ID NO: 764570 - protein, 18 aa, Mycobacterium
EVNAGLYAHPERIGTLIG

SEQ ID NO: 764571 - protein, 18 aa, Mycobacterium
EVNSVLLLDGPGPGPMLE

SEQ ID NO: 764572 - protein, 26 aa, Mycobacterium
EVPAPPFWGSRIVKGLAVADYTGMLD

SEQ ID NO: 764573 - protein, 18 aa, Mycobacterium
EVPARAWEHGRFGAPYLR

SEQ ID NO: 764574 - protein, 18 aa, Mycobacterium
EVPARLEALGALGGLDRA

SEQ ID NO: 764575 - protein, 18 aa, Mycobacterium
EVPDGWRVIGRVRASHAG

SEQ ID NO: 764576 - protein, 24 aa, Mycobacterium
EVPDLDTALAWARRCPAAEWGSVE

SEQ ID NO: 764577 - protein, 17 aa, Mycobacterium
EVPEFLAEYGWRLVEQA

SEQ ID NO: 764578 - protein, 17 aa, Mycobacterium
EVPGCFVALGALPPGAD

SEQ ID NO: 764579 - protein, 18 aa, Mycobacterium
EVPGDWEPLGAIAIGYGT

SEQ ID NO: 764580 - protein, 23 aa, Mycobacterium
EVPLKRFDLMNGIQIRGTYAVSQ

SEQ ID NO: 764581 - protein, 20 aa, Mycobacterium
EVPPDRWGLVPLLAGVAIVD

SEQ ID NO: 764582 - protein, 18 aa, Mycobacterium
EVPTMAALLIKESVNQSV

SEQ ID NO: 764583 - protein, 20 aa, Mycobacterium
EVPVDTFAGFIFLNPDPNAQ

SEQ ID NO: 764584 - protein, 24 aa, Mycobacterium
EVPWLSSQEVVQWAGAGYKAGFAY

SEQ ID NO: 764585 - protein, 19 aa, Mycobacterium
EVQEFIAGFWYHYDQGHFE

SEQ ID NO: 764586 - protein, 23 aa, Mycobacterium
EVQIGKFRLVFLTGPKQGEDGGS

SEQ ID NO: 764587 - protein, 18 aa, Mycobacterium
EVQRLPLNVTWVNLTTGR

SEQ ID NO: 764588 - protein, 20 aa, Mycobacterium
EVRDGAPLVVTWWDVVRAAS

SEQ ID NO: 764589 - protein, 22 aa, Mycobacterium
EVREILAALGMRTLREARGRSD

SEQ ID NO: 764590 - protein, 29 aa, Mycobacterium
EVRRAIDVLRFFGSAGWRPSGETLPSTMP

SEQ ID NO: 764591 - protein, 22 aa, Mycobacterium
EVSAAIAALFSVHGQTYQQLSA

SEQ ID NO: 764592 - protein, 21 aa, Mycobacterium
EVSAAIAAVFGEHGQAYQAFS

SEQ ID NO: 764593 - protein, 22 aa, Mycobacterium
EVSAAVAALFSSHARAYQALSV

SEQ ID NO: 764594 - protein, 19 aa, Mycobacterium
EVSADWEKLATGFSKALDD

SEQ ID NO: 764595 - protein, 21 aa, Mycobacterium
EVSALIAGLFDAHAQAYQALS

SEQ ID NO: 764596 - protein, 22 aa, Mycobacterium
EVSAQLAAVFGDYARQFQALSA

SEQ ID NO: 764597 - protein, 19 aa, Mycobacterium
EVSDIPVGVGLGVRSGEQA

SEQ ID NO: 764598 - protein, 19 aa, Mycobacterium
EVSGCLRVGKARNNSADTG

SEQ ID NO: 764599 - protein, 17 aa, Mycobacterium
EVSGWDSVYLLKLITAL

SEQ ID NO: 764600 - protein, 24 aa, Mycobacterium
EVSRLRSRFGFLAIHGGDLEKMTD

SEQ ID NO: 764601 - protein, 18 aa, Mycobacterium
EVTEILPLDGFNFDDLDW

SEQ ID NO: 764602 - protein, 19 aa, Mycobacterium
EVTESHWLPGWLAADNLLA

SEQ ID NO: 764603 - protein, 20 aa, Mycobacterium
EVTRRVIVPLGLRDTYWPAP

SEQ ID NO: 764604 - protein, 20 aa, Mycobacterium
EVTVPRWLAPFGTIEEVTPE

SEQ ID NO: 764605 - protein, 24 aa, Mycobacterium
EVTYGAEFFRWFAEEAVRIDGRYT

SEQ ID NO: 764606 - protein, 22 aa, Mycobacterium
EVVECGRLLALLASILSDLGHG

SEQ ID NO: 764607 - protein, 20 aa, Mycobacterium
EVVNAFGWTGPLGVTYPGVV

SEQ ID NO: 764608 - protein, 18 aa, Mycobacterium
EVVRALDMLFILHADHEQ

SEQ ID NO: 764609 - protein, 19 aa, Mycobacterium
EVVRALDMLFILHADHEQN

SEQ ID NO: 764610 - protein, 22 aa, Mycobacterium
EVVSGLVSDIGWHAKVGTLSGG

SEQ ID NO: 764611 - protein, 21 aa, Mycobacterium
EVVSRPILRSSFVAVLDGCAA

SEQ ID NO: 764612 - protein, 20 aa, Mycobacterium
EVWPGRAYPLGATYDGAGTN

SEQ ID NO: 764613 - protein, 28 aa, Mycobacterium
EVYERIKPAFKHWAAVVIHAGEPGAGTR

SEQ ID NO: 764614 - protein, 28 aa, Mycobacterium
EVYERIKPAFKHWAAVVIHAGGPGAGTR

SEQ ID NO: 764615 - protein, 20 aa, Mycobacterium
EVYHAGSLVQRGCAIGPVEE

SEQ ID NO: 764616 - protein, 20 aa, Mycobacterium
EVYHALKAVLKKAGLSTGLG

SEQ ID NO: 764617 - protein, 22 aa, Mycobacterium
EVYPHPATVVLFDLDRTLKYKR

SEQ ID NO: 764618 - protein, 21 aa, Mycobacterium
EVYRAPMAYPYRWPSGPENCA

SEQ ID NO: 764619 - protein, 22 aa, Mycobacterium
EVYRYLAGIFRRGLENEDLANR

SEQ ID NO: 764620 - protein, 20 aa, Mycobacterium
EWAKACGRQAETVYLRGGCI

SEQ ID NO: 764621 - protein, 19 aa, Mycobacterium
EWARRAGPQWSYTEVLGYF

SEQ ID NO: 764622 - protein, 22 aa, Mycobacterium
EWARRALGLLVHDHFGQTELGM

SEQ ID NO: 764623 - protein, 25 aa, Mycobacterium
EWCVISIRSDDEWRCAALVFDKPEL

SEQ ID NO: 764624 - protein, 19 aa, Mycobacterium
EWDVKRLVTSMAILGHDFG

SEQ ID NO: 764625 - protein, 24 aa, Mycobacterium
EWFSRLAPGLAEQVVEHWGPPPGE

SEQ ID NO: 764626 - protein, 24 aa, Mycobacterium
EWKPVGGFPVRFGWISAIRRGHAE

SEQ ID NO: 764627 - protein, 18 aa, Mycobacterium
EWKRMGIPLLMSRVRFIY

SEQ ID NO: 764628 - protein, 20 aa, Mycobacterium
EWLARGGIMLPIYQREAMWL

SEQ ID NO: 764629 - protein, 19 aa, Mycobacterium
EWLDRYGLRDPLNRGLKYG

SEQ ID NO: 764630 - protein, 20 aa, Mycobacterium
EWLVRGGVMLPVYQREAMWL

SEQ ID NO: 764631 - protein, 20 aa, Mycobacterium
EWMGRVHRFLGLDVGVILAQ

SEQ ID NO: 764632 - protein, 20 aa, Mycobacterium
EWMGRVHRFLGLDVGVILSQ

SEQ ID NO: 764633 - protein, 17 aa, Mycobacterium
EWMLPLLDLRNALDVAD

SEQ ID NO: 764634 - protein, 17 aa, Mycobacterium
EWMSGAIGREIHDPYAL

SEQ ID NO: 764635 - protein, 19 aa, Mycobacterium
EWNACLQAGLPVRWETTAD

SEQ ID NO: 764636 - protein, 18 aa, Mycobacterium
EWRQAGCSMCLGMNPDQL

SEQ ID NO: 764637 - protein, 19 aa, Mycobacterium
EWRRHLSGWIGLDSYDERN

SEQ ID NO: 764638 - protein, 17 aa, Mycobacterium
EWRRLGTAIADTRRTIG

SEQ ID NO: 764639 - protein, 19 aa, Mycobacterium
EWSDRFAGHFDDGWDALRE

SEQ ID NO: 764640 - protein, 20 aa, Mycobacterium
EWSDRFAGQFDEGWDALREQ

SEQ ID NO: 764641 - protein, 17 aa, Mycobacterium
EWSDTVGLCGANEEEML

SEQ ID NO: 764642 - protein, 18 aa, Mycobacterium
EWSPQCRWMHQFGPLRQG

SEQ ID NO: 764643 - protein, 19 aa, Mycobacterium
EWVGFSVTMPGKFAALQFA

SEQ ID NO: 764644 - protein, 18 aa, Mycobacterium
EWVSLRPTMFVSNLVGMW

SEQ ID NO: 764645 - protein, 17 aa, Mycobacterium
EWWAQRFGIEPDLAEAL

SEQ ID NO: 764646 - protein, 20 aa, Mycobacterium
EYAEMWARDTAAMFGYAGST

SEQ ID NO: 764647 - protein, 19 aa, Mycobacterium
EYARLLTYRVELLAHHAAT

SEQ ID NO: 764648 - protein, 20 aa, Mycobacterium
EYCKGRLGLDAALGSIDRSK

SEQ ID NO: 764649 - protein, 19 aa, Mycobacterium
EYEQMWALDVSTMATYHAG

SEQ ID NO: 764650 - protein, 20 aa, Mycobacterium
EYEVDCVIFASGFEISTEIH

SEQ ID NO: 764651 - protein, 17 aa, Mycobacterium
EYFANTEVVVWTPRRAT

SEQ ID NO: 764652 - protein, 19 aa, Mycobacterium
EYFCGKDVPILGWNSVTVP

SEQ ID NO: 764653 - protein, 22 aa, Mycobacterium
EYFTEPGFKGWLKKVFFGGSGQ

SEQ ID NO: 764654 - protein, 21 aa, Mycobacterium
EYGSRAGVWRVLRVCEQSGVP

SEQ ID NO: 764655 - protein, 23 aa, Mycobacterium
EYIISWLHRFARGEINTVEVSSE

SEQ ID NO: 764656 - protein, 24 aa, Mycobacterium
EYITRSGFDYTWFVLNAKIIEKEF

SEQ ID NO: 764657 - protein, 21 aa, Mycobacterium
EYIYRFAPLVGIYGGTLEVFR

SEQ ID NO: 764658 - protein, 19 aa, Mycobacterium
EYLLTRFIAWWVNQLEAHD

SEQ ID NO: 764659 - protein, 19 aa, Mycobacterium
EYLQRLGVDGIWINPVTVS

SEQ ID NO: 764660 - protein, 26 aa, Mycobacterium
EYLSGRWALKFGFPLMPVDGILVGTA

SEQ ID NO: 764661 - protein, 23 aa, Mycobacterium
EYPARRLGAAAADWLGDEQETIY

SEQ ID NO: 764662 - protein, 20 aa, Mycobacterium
EYQDRLEILGQRAQYVQQTV

SEQ ID NO: 764663 - protein, 18 aa, Mycobacterium
EYQGRLATFQADRRQRQH

SEQ ID NO: 764664 - protein, 18 aa, Mycobacterium
EYRRKLQLCLDVFETMLV

SEQ ID NO: 764665 - protein, 18 aa, Mycobacterium
EYRRKLQLCVDVVETMLA

SEQ ID NO: 764666 - protein, 20 aa, Mycobacterium
EYSDDGWTTWDWNTIVIEGS

SEQ ID NO: 764667 - protein, 24 aa, Mycobacterium
EYSHLTLSWVYDWMAQGVPVVAMH

SEQ ID NO: 764668 - protein, 19 aa, Mycobacterium
EYTSAVAMARCDDKRLTRR

SEQ ID NO: 764669 - protein, 18 aa, Mycobacterium
EYVDSFAGMFPRLGSAAS

SEQ ID NO: 764670 - protein, 20 aa, Mycobacterium
EYWRRLGVAAPDWTGKRVLD

SEQ ID NO: 764671 - protein, 18 aa, Mycobacterium
EYWWAAEQMLTWPDPDKP

SEQ ID NO: 764672 - protein, 17 aa, Mycobacterium
EYWWAAEQMLTWPNEPA

SEQ ID NO: 764673 - protein, 20 aa, Mycobacterium
FAAACPRVDFTLATGTTAEL

SEQ ID NO: 764674 - protein, 25 aa, Mycobacterium
FAAAFKPPLSWGMRMTGKKFLREYP

SEQ ID NO: 764675 - protein, 24 aa, Mycobacterium
FAAAFKPPMRWGVRMMGKKFLREY

SEQ ID NO: 764676 - protein, 18 aa, Mycobacterium
FAAAGARIRLCKGAYDEP

SEQ ID NO: 764677 - protein, 18 aa, Mycobacterium
FAAAGRYVLDRAIFDALR

SEQ ID NO: 764678 - protein, 17 aa, Mycobacterium
FAAALGRVGWPVELVEL

SEQ ID NO: 764679 - protein, 20 aa, Mycobacterium
FAAEAGFVFAMIGIDLSRLS

SEQ ID NO: 764680 - protein, 19 aa, Mycobacterium
FAAFPWRWVGGDGCIVRLV

SEQ ID NO: 764681 - protein, 18 aa, Mycobacterium
FAAGEVFEALSVLQSSEA

SEQ ID NO: 764682 - protein, 18 aa, Mycobacterium
FAAGFARLYNEWIADYCA

SEQ ID NO: 764683 - protein, 17 aa, Mycobacterium
FAAGLAFALRGSFDKVA

SEQ ID NO: 764684 - protein, 20 aa, Mycobacterium
FAAGRLSYFLGVRGPAVVSD

SEQ ID NO: 764685 - protein, 19 aa, Mycobacterium
FAAKIGIVLREEVARLTKS

SEQ ID NO: 764686 - protein, 17 aa, Mycobacterium
FAALAFKIATHPFFGKL

SEQ ID NO: 764687 - protein, 17 aa, Mycobacterium
FAALHFFPARALELGGF

SEQ ID NO: 764688 - protein, 17 aa, Mycobacterium
FAAPGWVVSPGVVKALP

SEQ ID NO: 764689 - protein, 24 aa, Mycobacterium
FAARAQCAFMGWPASLHEPLRQWV

SEQ ID NO: 764690 - protein, 19 aa, Mycobacterium
FAARCAHAFSKCTQPPPLE

SEQ ID NO: 764691 - protein, 18 aa, Mycobacterium
FAARGFRTLARWWEATAS

SEQ ID NO: 764692 - protein, 17 aa, Mycobacterium
FAATVGRRLARPGPPSS

SEQ ID NO: 764693 - protein, 25 aa, Mycobacterium
FADAFGADFFAPWGRLAEVRTPTIA

SEQ ID NO: 764694 - protein, 22 aa, Mycobacterium
FADAFPKFMWKPSREVARAGVD

SEQ ID NO: 764695 - protein, 21 aa, Mycobacterium
FADAFPKFMWMPSREVARAGV

SEQ ID NO: 764696 - protein, 23 aa, Mycobacterium
FADALAALWQWGLDIDWRPLYAE

SEQ ID NO: 764697 - protein, 17 aa, Mycobacterium
FADCARCVVDLLDGLGI

SEQ ID NO: 764698 - protein, 17 aa, Mycobacterium
FADLGGELRRAATQYAQ

SEQ ID NO: 764699 - protein, 19 aa, Mycobacterium
FADLIPWVKAHGDEHPELI

SEQ ID NO: 764700 - protein, 20 aa, Mycobacterium
FADLKFVWADGAADFLTPFI

SEQ ID NO: 764701 - protein, 18 aa, Mycobacterium
FAEFFYRRLHHFEDRADD

SEQ ID NO: 764702 - protein, 21 aa, Mycobacterium
FAEGYCLPTILSNALYMDRYP

SEQ ID NO: 764703 - protein, 17 aa, Mycobacterium
FAELLALGSLVAEGKLV

SEQ ID NO: 764704 - protein, 18 aa, Mycobacterium
FAEQLKIFGPVFMSNDAR

SEQ ID NO: 764705 - protein, 19 aa, Mycobacterium
FAERFAVRVVDGFGSSEGG

SEQ ID NO: 764706 - protein, 18 aa, Mycobacterium
FAETELRALLAHDAGAEP

SEQ ID NO: 764707 - protein, 18 aa, Mycobacterium
FAFAGGRLGYLVAAPAVI

SEQ ID NO: 764708 - protein, 19 aa, Mycobacterium
FAFAGGRLGYLVATPALVD

SEQ ID NO: 764709 - protein, 17 aa, Mycobacterium
FAFSHCRDVVAAVTNAG

SEQ ID NO: 764710 - protein, 18 aa, Mycobacterium
FAFSHCRDVVAAVTNAGG

SEQ ID NO: 764711 - protein, 18 aa, Mycobacterium
FAFTHCRDVVVAVSKAGG

SEQ ID NO: 764712 - protein, 17 aa, Mycobacterium
FAFTRYRVGGGAACVYV

SEQ ID NO: 764713 - protein, 25 aa, Mycobacterium
FAGAFKPPLRWGIRMTGHKFLREYP

SEQ ID NO: 764714 - protein, 25 aa, Mycobacterium
FAGAFKPPLRWGMRMTGKKFLREYP

SEQ ID NO: 764715 - protein, 24 aa, Mycobacterium
FAGFGGLGGEGGWVGNITLGPIGV

SEQ ID NO: 764716 - protein, 23 aa, Mycobacterium
FAGHPTVGLAWWLRERGTPVNTL

SEQ ID NO: 764717 - protein, 24 aa, Mycobacterium
FAGIGIPIAEVWGMSELSCVATVS

SEQ ID NO: 764718 - protein, 18 aa, Mycobacterium
FAGLPAFLQKKGRKVRFM

SEQ ID NO: 764719 - protein, 24 aa, Mycobacterium
FAGLRVVDMTTFWAGPSCTHLLAM

SEQ ID NO: 764720 - protein, 18 aa, Mycobacterium
FAGMFPRLGSAASTEPVR

SEQ ID NO: 764721 - protein, 19 aa, Mycobacterium
FAGNPWAAPTGWRVGGSAA

SEQ ID NO: 764722 - protein, 22 aa, Mycobacterium
FAGPLFRFALFRTRADQFHLFA

SEQ ID NO: 764723 - protein, 18 aa, Mycobacterium
FAGRIAAFIVRRRAVTPF

SEQ ID NO: 764724 - protein, 23 aa, Mycobacterium
FAGSGLRTSVQFVGPLSVVDNLL

SEQ ID NO: 764725 - protein, 21 aa, Mycobacterium
FAGSLWWRTVQEIAKKYPDVE

SEQ ID NO: 764726 - protein, 19 aa, Mycobacterium
FAGSLWWRTVQEIGEEYPD

SEQ ID NO: 764727 - protein, 18 aa, Mycobacterium
FAHPFIAMCPVSLRADDD

SEQ ID NO: 764728 - protein, 18 aa, Mycobacterium
FAIELGKAGGLGVINGEG

SEQ ID NO: 764729 - protein, 19 aa, Mycobacterium
FAIGAVLSMHFAKQAAKYF

SEQ ID NO: 764730 - protein, 19 aa, Mycobacterium
FAIGAVLSMHFAKQAAPFF

SEQ ID NO: 764731 - protein, 17 aa, Mycobacterium
FAIGMAEVMVATAAGDY

SEQ ID NO: 764732 - protein, 17 aa, Mycobacterium
FAIYIKMHHSLIDGYTG

SEQ ID NO: 764733 - protein, 20 aa, Mycobacterium
FAKACAESGVIFVGPSPEAI

SEQ ID NO: 764734 - protein, 17 aa, Mycobacterium
FAKEFGLPIIEVVTGGD

SEQ ID NO: 764735 - protein, 17 aa, Mycobacterium
FALCGSDGAGVREVLDA

SEQ ID NO: 764736 - protein, 17 aa, Mycobacterium
FALHCDIRIAAEDARFG

SEQ ID NO: 764737 - protein, 17 aa, Mycobacterium
FALKRFCGAEGIENVTT

SEQ ID NO: 764738 - protein, 20 aa, Mycobacterium
FALLARRRMDLFGATVEDFA

SEQ ID NO: 764739 - protein, 19 aa, Mycobacterium
FALLARRRMDLYGATLEDF

SEQ ID NO: 764740 - protein, 17 aa, Mycobacterium
FALLPLAELWVAATRIR

SEQ ID NO: 764741 - protein, 18 aa, Mycobacterium
FALLPLGELWVAAARNRQ

SEQ ID NO: 764742 - protein, 17 aa, Mycobacterium
FAMAFDMRFAALGTTVL

SEQ ID NO: 764743 - protein, 20 aa, Mycobacterium
FAMGLARGYSLAVVEGSTSL

SEQ ID NO: 764744 - protein, 19 aa, Mycobacterium
FANGFATLTLETVPNPILT

SEQ ID NO: 764745 - protein, 23 aa, Mycobacterium
FANGIEWITWWLAVSRIGAVAVP

SEQ ID NO: 764746 - protein, 17 aa, Mycobacterium
FANTEVVVWTPRRATGR

SEQ ID NO: 764747 - protein, 18 aa, Mycobacterium
FANTFGLPVQEVISGGDV

SEQ ID NO: 764748 - protein, 17 aa, Mycobacterium
FAPFPLEPARLIMERAG

SEQ ID NO: 764749 - protein, 20 aa, Mycobacterium
FAPGSAWRYSLALDVLGAVV

SEQ ID NO: 764750 - protein, 18 aa, Mycobacterium
FAPLNLKHRIFRKAAGSH

SEQ ID NO: 764751 - protein, 18 aa, Mycobacterium
FAPLRLPPDLDFAALFHG

SEQ ID NO: 764752 - protein, 19 aa, Mycobacterium
FAPLRLPPDLDFAALFHGV

SEQ ID NO: 764753 - protein, 18 aa, Mycobacterium
FAPNFKDIVIRYITFAPY

SEQ ID NO: 764754 - protein, 17 aa, Mycobacterium
FAPPLVVTSEEIDWAVD

SEQ ID NO: 764755 - protein, 24 aa, Mycobacterium
FAPQSRLAIRWALHNRSESECRKI

SEQ ID NO: 764756 - protein, 20 aa, Mycobacterium
FAPRCPLAIDECRLEEPELL

SEQ ID NO: 764757 - protein, 18 aa, Mycobacterium
FAPTRAAAWLSHHPHTRL

SEQ ID NO: 764758 - protein, 17 aa, Mycobacterium
FAPVRPGREQWLIELME

SEQ ID NO: 764759 - protein, 18 aa, Mycobacterium
FAQNRLWFIDQFQGPSPV

SEQ ID NO: 764760 - protein, 18 aa, Mycobacterium
FAQNRLWFIQQLQGPSPV

SEQ ID NO: 764761 - protein, 17 aa, Mycobacterium
FAQQMKILFPIFTSNDA

SEQ ID NO: 764762 - protein, 17 aa, Mycobacterium
FAQRAGVPMAQTVAVGD

SEQ ID NO: 764763 - protein, 18 aa, Mycobacterium
FAQSRLWFIDQLNGPSPV

SEQ ID NO: 764764 - protein, 20 aa, Mycobacterium
FAQSRLWFLDQLHGCSPVHN

SEQ ID NO: 764765 - protein, 18 aa, Mycobacterium
FAQSRLWFLDQLQGPSAV

SEQ ID NO: 764766 - protein, 18 aa, Mycobacterium
FAQSRLWFLDQLQGPSPV

SEQ ID NO: 764767 - protein, 20 aa, Mycobacterium
FAQSRLWFMGQLHGPSPVHN

SEQ ID NO: 764768 - protein, 18 aa, Mycobacterium
FAQSRLWFTGQLQGPSPV

SEQ ID NO: 764769 - protein, 20 aa, Mycobacterium
FAQYWAEICELPISLITDMI

SEQ ID NO: 764770 - protein, 23 aa, Mycobacterium
FAQYWAEICSIPISFIAESVRRA

SEQ ID NO: 764771 - protein, 23 aa, Mycobacterium
FARAFGLPVVEVIAGGDISQSAH

SEQ ID NO: 764772 - protein, 23 aa, Mycobacterium
FAREHPHLLPGYVTHTFGVDDVQ

SEQ ID NO: 764773 - protein, 17 aa, Mycobacterium
FARERSRWLFSNPDMIH

SEQ ID NO: 764774 - protein, 18 aa, Mycobacterium
FARERSRWLFSNPDMIHL

SEQ ID NO: 764775 - protein, 18 aa, Mycobacterium
FARERSRWLFSNPDMVHL

SEQ ID NO: 764776 - protein, 21 aa, Mycobacterium
FARPAEIAWATAFLLCDQATY

SEQ ID NO: 764777 - protein, 17 aa, Mycobacterium
FARQRIDAILTEVTAAD

SEQ ID NO: 764778 - protein, 19 aa, Mycobacterium
FARRCPRTGPPRLLYVGRL

SEQ ID NO: 764779 - protein, 19 aa, Mycobacterium
FARRFGCVVQDGFGSTEGG

SEQ ID NO: 764780 - protein, 17 aa, Mycobacterium
FARRLPLMAAKRVFSEP

SEQ ID NO: 764781 - protein, 23 aa, Mycobacterium
FARSFRLTGRMFRRRPEESGVVL

SEQ ID NO: 764782 - protein, 19 aa, Mycobacterium
FASAAMKWCRKAAELGTLT

SEQ ID NO: 764783 - protein, 17 aa, Mycobacterium
FASEPAWVVKDDGLAAG

SEQ ID NO: 764784 - protein, 20 aa, Mycobacterium
FASGELIGALAMTEPGAGSD

SEQ ID NO: 764785 - protein, 20 aa, Mycobacterium
FASLCSFAGIALARASEFSS

SEQ ID NO: 764786 - protein, 17 aa, Mycobacterium
FASLVFYSSWFKLHHPA

SEQ ID NO: 764787 - protein, 18 aa, Mycobacterium
FASSTGFGRRAIAYERLS

SEQ ID NO: 764788 - protein, 18 aa, Mycobacterium
FATEFGLPIVEVVAGGDV

SEQ ID NO: 764789 - protein, 17 aa, Mycobacterium
FATGNGFVGDFAAEPGP

SEQ ID NO: 764790 - protein, 17 aa, Mycobacterium
FATIPLWLDLGELRVVH

SEQ ID NO: 764791 - protein, 19 aa, Mycobacterium
FATLLSNAETVFWNGPMGV

SEQ ID NO: 764792 - protein, 18 aa, Mycobacterium
FATYPILAVQGWAAFHDL

SEQ ID NO: 764793 - protein, 21 aa, Mycobacterium
FAVELGEHFIRVNSVHPTNVN

SEQ ID NO: 764794 - protein, 18 aa, Mycobacterium
FAVGMAMGGFRPVVEMQF

SEQ ID NO: 764795 - protein, 17 aa, Mycobacterium
FAVGPFASMLDRARDLI

SEQ ID NO: 764796 - protein, 18 aa, Mycobacterium
FAVPRYQRSYAWGDEAVG

SEQ ID NO: 764797 - protein, 17 aa, Mycobacterium
FAVVEGGRHSVTHYDTL

SEQ ID NO: 764798 - protein, 17 aa, Mycobacterium
FAWRSCRAVKSNAIVIV

SEQ ID NO: 764799 - protein, 17 aa, Mycobacterium
FAYAGGWLRPGALTPPR

SEQ ID NO: 764800 - protein, 22 aa, Mycobacterium
FAYRFALPRAIAFAMRGVADES

SEQ ID NO: 764801 - protein, 17 aa, Mycobacterium
FCAAEFVPVIGDLIADM

SEQ ID NO: 764802 - protein, 25 aa, Mycobacterium
FCAGSPFPKNVCEWDMMGALLGRPV

SEQ ID NO: 764803 - protein, 17 aa, Mycobacterium
FCAHWGLAREGRVAYVN

SEQ ID NO: 764804 - protein, 17 aa, Mycobacterium
FCDVMGIAAAHFVGNSM

SEQ ID NO: 764805 - protein, 22 aa, Mycobacterium
FCESARALALLRGRNHVRPEDI

SEQ ID NO: 764806 - protein, 21 aa, Mycobacterium
FCGSCYFCARGLYSNCHNVNP

SEQ ID NO: 764807 - protein, 17 aa, Mycobacterium
FCGTGAMSAMLGRNSYR

SEQ ID NO: 764808 - protein, 24 aa, Mycobacterium
FCHKGCPLGNLIPEWNDMVYRGNW

SEQ ID NO: 764809 - protein, 17 aa, Mycobacterium
FCPLGPWIVTDLDPADL

SEQ ID NO: 764810 - protein, 17 aa, Mycobacterium
FCPLGPWIVTDLDPSDV

SEQ ID NO: 764811 - protein, 19 aa, Mycobacterium
FCRDRLAPFEVPTDFQQAA

SEQ ID NO: 764812 - protein, 21 aa, Mycobacterium
FCRRYPTTLIRWVIGTPTERV

SEQ ID NO: 764813 - protein, 17 aa, Mycobacterium
FCSGEMITAIGMTEPSG

SEQ ID NO: 764814 - protein, 18 aa, Mycobacterium
FCTLRSWLSQWSYDDANG

SEQ ID NO: 764815 - protein, 18 aa, Mycobacterium
FCTSHGYLFPGQVDGHIS

SEQ ID NO: 764816 - protein, 18 aa, Mycobacterium
FCVACLDPLVGGDRFDFV

SEQ ID NO: 764817 - protein, 17 aa, Mycobacterium
FCVGGGIGLVGNSDVIV

SEQ ID NO: 764818 - protein, 19 aa, Mycobacterium
FCVNYRLAPRYRFPTAADD

SEQ ID NO: 764819 - protein, 17 aa, Mycobacterium
FCVPATIDLAGAEIELV

SEQ ID NO: 764820 - protein, 17 aa, Mycobacterium
FCVRCLDPLVGRDSFDI

SEQ ID NO: 764821 - protein, 18 aa, Mycobacterium
FDAAALMARFTGVRTCTN

SEQ ID NO: 764822 - protein, 19 aa, Mycobacterium
FDALTGRPLIGNGTPGAAG

SEQ ID NO: 764823 - protein, 17 aa, Mycobacterium
FDARFSALCRHYVYRLS

SEQ ID NO: 764824 - protein, 23 aa, Mycobacterium
FDARKAVVFDDRWASAREDLVKL

SEQ ID NO: 764825 - protein, 18 aa, Mycobacterium
FDATVCWMADSSVLEPGR

SEQ ID NO: 764826 - protein, 21 aa, Mycobacterium
FDAVVCSLVLCSVTDQLGVLQ

SEQ ID NO: 764827 - protein, 17 aa, Mycobacterium
FDCAVAYHNRRRIDGSP

SEQ ID NO: 764828 - protein, 17 aa, Mycobacterium
FDCCSLHAGQACILHSR

SEQ ID NO: 764829 - protein, 25 aa, Mycobacterium
FDDAWRTQMSFVIAVPDFIGAAATE

SEQ ID NO: 764830 - protein, 23 aa, Mycobacterium
FDDCGFGWYFYDFGTAVSFIEHD

SEQ ID NO: 764831 - protein, 22 aa, Mycobacterium
FDDGVFCALALPPAVGENEALM

SEQ ID NO: 764832 - protein, 17 aa, Mycobacterium
FDDIRWRLDVWNASAQV

SEQ ID NO: 764833 - protein, 17 aa, Mycobacterium
FDDLLPYFMRSEASRGG

SEQ ID NO: 764834 - protein, 23 aa, Mycobacterium
FDEAACLPVAWTTAYRMLFTHAK

SEQ ID NO: 764835 - protein, 18 aa, Mycobacterium
FDEAFAALRGWEAQGRLH

SEQ ID NO: 764836 - protein, 19 aa, Mycobacterium
FDEALAWYGCIFGREPDLR

SEQ ID NO: 764837 - protein, 19 aa, Mycobacterium
FDEHLRPGGVIDLVEDVNR

SEQ ID NO: 764838 - protein, 18 aa, Mycobacterium
FDEWKLPVPALFGQMVLP

SEQ ID NO: 764839 - protein, 28 aa, Mycobacterium
FDFTIPRLKSGILLGTRWGEPGASMVPA

SEQ ID NO: 764840 - protein, 19 aa, Mycobacterium
FDGAIPFRTLHAVTEELPD

SEQ ID NO: 764841 - protein, 18 aa, Mycobacterium
FDGLRLAGRQVRRPDLTI

SEQ ID NO: 764842 - protein, 18 aa, Mycobacterium
FDGLRLAGRRVRRPDLTI

SEQ ID NO: 764843 - protein, 19 aa, Mycobacterium
FDGLTRWLTGMFDRDGWRP

SEQ ID NO: 764844 - protein, 18 aa, Mycobacterium
FDGRIITVPFSFKEIDED

SEQ ID NO: 764845 - protein, 18 aa, Mycobacterium
FDGRIITVPFSFKEIDGD

SEQ ID NO: 764846 - protein, 18 aa, Mycobacterium
FDGRIITVPFSFKEIDHE

SEQ ID NO: 764847 - protein, 18 aa, Mycobacterium
FDGRLITVPFSFKEIDDE

SEQ ID NO: 764848 - protein, 17 aa, Mycobacterium
FDIADLRSALTRLRSDN

SEQ ID NO: 764849 - protein, 18 aa, Mycobacterium
FDILRRWLIARGCDVAFI

SEQ ID NO: 764850 - protein, 19 aa, Mycobacterium
FDILRRWLMARGFDVAFIR

SEQ ID NO: 764851 - protein, 19 aa, Mycobacterium
FDIPNDFVVGYGLDYDERY

SEQ ID NO: 764852 - protein, 20 aa, Mycobacterium
FDISPRLAAALLDAAPQLRL

SEQ ID NO: 764853 - protein, 17 aa, Mycobacterium
FDLAAYWARGGIGDAYS

SEQ ID NO: 764854 - protein, 25 aa, Mycobacterium
FDLARLIEILLRWNLDDTTDGPRIK

SEQ ID NO: 764855 - protein, 19 aa, Mycobacterium
FDLCAMTGHVEWIDEDSPL

SEQ ID NO: 764856 - protein, 18 aa, Mycobacterium
FDLNAHWSRLWSGQKEIL

SEQ ID NO: 764857 - protein, 17 aa, Mycobacterium
FDLPGLFGNAGKPDDGA

SEQ ID NO: 764858 - protein, 18 aa, Mycobacterium
FDLPVGAWGARPTAQFGY

SEQ ID NO: 764859 - protein, 23 aa, Mycobacterium
FDLYSCFPFPVFVACEALGLAGD

SEQ ID NO: 764860 - protein, 19 aa, Mycobacterium
FDPIYCWPKPVTKPYPPLY

SEQ ID NO: 764861 - protein, 17 aa, Mycobacterium
FDPKFSRSPVLASPFTI

SEQ ID NO: 764862 - protein, 19 aa, Mycobacterium
FDPLIFFRPRVERLFDFHY

SEQ ID NO: 764863 - protein, 19 aa, Mycobacterium
FDPLIFFRPRVERLFEFHY

SEQ ID NO: 764864 - protein, 26 aa, Mycobacterium
FDPLIFFRPRVERLFGFHYRIEIYTP

SEQ ID NO: 764865 - protein, 20 aa, Mycobacterium
FDPLIFFRPRVERLFGGFHY

SEQ ID NO: 764866 - protein, 19 aa, Mycobacterium
FDPLIFFRPRVKRLFGFHY

SEQ ID NO: 764867 - protein, 19 aa, Mycobacterium
FDPPIAIAWLPGEDTDDGT

SEQ ID NO: 764868 - protein, 19 aa, Mycobacterium
FDPRTPYVVFWVIDPETGE

SEQ ID NO: 764869 - protein, 19 aa, Mycobacterium
FDPRTPYVVFWVVDPDTGE

SEQ ID NO: 764870 - protein, 19 aa, Mycobacterium
FDPTEHWPRYCYSTNQVKA

SEQ ID NO: 764871 - protein, 18 aa, Mycobacterium
FDPTRWQPVPGFEDLTDI

SEQ ID NO: 764872 - protein, 19 aa, Mycobacterium
FDRALELDPDFALARWGVA

SEQ ID NO: 764873 - protein, 17 aa, Mycobacterium
FDRFASVELVMFDEQVF

SEQ ID NO: 764874 - protein, 23 aa, Mycobacterium
FDRLRRGGIQWADMRGYAYDRRD

SEQ ID NO: 764875 - protein, 17 aa, Mycobacterium
FDRTAGFGIYGTAKAAL

SEQ ID NO: 764876 - protein, 18 aa, Mycobacterium
FDSGTGWPSFTRPLDDGY

SEQ ID NO: 764877 - protein, 23 aa, Mycobacterium
FDSRAVGPGGLFLALPGARSDGH

SEQ ID NO: 764878 - protein, 24 aa, Mycobacterium
FDSRKAVVLDDRWASAREDLVKIW

SEQ ID NO: 764879 - protein, 17 aa, Mycobacterium
FDTLLVMSVEPGFGGQK

SEQ ID NO: 764880 - protein, 18 aa, Mycobacterium
FDTVAWNMFAVIASSILN

SEQ ID NO: 764881 - protein, 18 aa, Mycobacterium
FDVFPWADGEPVQFGSLT

SEQ ID NO: 764882 - protein, 21 aa, Mycobacterium
FDVLPLLLAYGGDVDRRTLAS

SEQ ID NO: 764883 - protein, 19 aa, Mycobacterium
FDVLRRWLSARAYDVLFVR

SEQ ID NO: 764884 - protein, 18 aa, Mycobacterium
FDVLRRWLTAKGFDVAFI

SEQ ID NO: 764885 - protein, 18 aa, Mycobacterium
FDVLRRWLTANGYDVAFI

SEQ ID NO: 764886 - protein, 18 aa, Mycobacterium
FDVPACFIWRVEQGLITH

SEQ ID NO: 764887 - protein, 19 aa, Mycobacterium
FDWLTWRLSKKLEDAQRGE

SEQ ID NO: 764888 - protein, 20 aa, Mycobacterium
FEAAIGRDLIGNGAPGVAGV

SEQ ID NO: 764889 - protein, 18 aa, Mycobacterium
FEAGQLCLAISQSGETAD

SEQ ID NO: 764890 - protein, 19 aa, Mycobacterium
FECCLRLGGAEVRDDEVFE

SEQ ID NO: 764891 - protein, 23 aa, Mycobacterium
FEERFDFGLGLLVGGMRRLLEAV

SEQ ID NO: 764892 - protein, 18 aa, Mycobacterium
FEFRACDIRDDDAVKALV

SEQ ID NO: 764893 - protein, 21 aa, Mycobacterium
FEFRAGPVFTNLLLADEINRT

SEQ ID NO: 764894 - protein, 24 aa, Mycobacterium
FEFRCARCGIPYSEALPVMTEPAI

SEQ ID NO: 764895 - protein, 17 aa, Mycobacterium
FEGGFGGDGGDGGTGGT

SEQ ID NO: 764896 - protein, 19 aa, Mycobacterium
FEGLSIDHLEMFNAADRFW

SEQ ID NO: 764897 - protein, 22 aa, Mycobacterium
FEGRRLRDWAARCIPSPTGYLY

SEQ ID NO: 764898 - protein, 18 aa, Mycobacterium
FEHRQFWFSDNRAIDRDT

SEQ ID NO: 764899 - protein, 20 aa, Mycobacterium
FEIPACGGLFVGERTDEHSE

SEQ ID NO: 764900 - protein, 18 aa, Mycobacterium
FEIPISLETTICLIYVPF

SEQ ID NO: 764901 - protein, 21 aa, Mycobacterium
FEIPNEFVVGYGLDYGERYRD

SEQ ID NO: 764902 - protein, 19 aa, Mycobacterium
FELHEELILAVGLTREEAA

SEQ ID NO: 764903 - protein, 17 aa, Mycobacterium
FELPELLKRGSDVLLKT

SEQ ID NO: 764904 - protein, 19 aa, Mycobacterium
FEMDGCYPASIPIDGVALN

SEQ ID NO: 764905 - protein, 17 aa, Mycobacterium
FENLNIPLLDVHMSGDY

SEQ ID NO: 764906 - protein, 19 aa, Mycobacterium
FEPKIRWEAAVFEESPGID

SEQ ID NO: 764907 - protein, 18 aa, Mycobacterium
FEPLPPRYKTGVLAKYTK

SEQ ID NO: 764908 - protein, 17 aa, Mycobacterium
FEREMMDLYGISPVGHP

SEQ ID NO: 764909 - protein, 25 aa, Mycobacterium
FERLGRAWPALGWAAVQAHTAIDVL

SEQ ID NO: 764910 - protein, 17 aa, Mycobacterium
FERLRVIGCGTSLNAGT

SEQ ID NO: 764911 - protein, 22 aa, Mycobacterium
FERPRLRALSAIKQRAEERDMS

SEQ ID NO: 764912 - protein, 17 aa, Mycobacterium
FERRGRWNVPKKLTTFT

SEQ ID NO: 764913 - protein, 18 aa, Mycobacterium
FERVTLYGLPLVPRRRVG

SEQ ID NO: 764914 - protein, 21 aa, Mycobacterium
FESARLWPLLDELRRVGVRLV

SEQ ID NO: 764915 - protein, 17 aa, Mycobacterium
FESGVVRVYLAAPDLQA

SEQ ID NO: 764916 - protein, 18 aa, Mycobacterium
FESIRFDLNLVIAGDDGE

SEQ ID NO: 764917 - protein, 19 aa, Mycobacterium
FESLAGRRPVVVFASGSRA

SEQ ID NO: 764918 - protein, 20 aa, Mycobacterium
FEVNEAFAPVVLAWAADTGA

SEQ ID NO: 764919 - protein, 20 aa, Mycobacterium
FEVNEAFAPVVLAWAKDTGA

SEQ ID NO: 764920 - protein, 20 aa, Mycobacterium
FEVNEAFAPVVLAWAQDTGA

SEQ ID NO: 764921 - protein, 20 aa, Mycobacterium
FEVNEAFAPVVLSWAADVGG

SEQ ID NO: 764922 - protein, 19 aa, Mycobacterium
FEWNKPWAQRICGHLPLPR

SEQ ID NO: 764923 - protein, 21 aa, Mycobacterium
FEYVWPRIAALVVQPGVEFDH

SEQ ID NO: 764924 - protein, 17 aa, Mycobacterium
FFAESFVQLGLIPGDGG

SEQ ID NO: 764925 - protein, 18 aa, Mycobacterium
FFAGRGYRALALSFRGHG

SEQ ID NO: 764926 - protein, 19 aa, Mycobacterium
FFCLPEVNVGLPFTPGMSA

SEQ ID NO: 764927 - protein, 17 aa, Mycobacterium
FFDEPGWEPMGDQGLMY

SEQ ID NO: 764928 - protein, 24 aa, Mycobacterium
FFGRSGLRRNFRWDPLDSVYFAGY

SEQ ID NO: 764929 - protein, 17 aa, Mycobacterium
FFGSFVFGTPGFPLADV

SEQ ID NO: 764930 - protein, 18 aa, Mycobacterium
FFLCPGVPELSFRSHVGV

SEQ ID NO: 764931 - protein, 25 aa, Mycobacterium
FFLGIGVPIAEVWGMSELSCVAAVS

SEQ ID NO: 764932 - protein, 20 aa, Mycobacterium
FFLPLVCPRRVTFLAKSEYF

SEQ ID NO: 764933 - protein, 23 aa, Mycobacterium
FFLPRIAKGDLHFSIGYSEPGAG

SEQ ID NO: 764934 - protein, 22 aa, Mycobacterium
FFLPRILTGEVFFCQGYSEPES

SEQ ID NO: 764935 - protein, 17 aa, Mycobacterium
FFLRKGLQLGLGDRRLA

SEQ ID NO: 764936 - protein, 20 aa, Mycobacterium
FFLVELLDATSFWQSARAGI

SEQ ID NO: 764937 - protein, 17 aa, Mycobacterium
FFPLGGLTFDDSVAEGL

SEQ ID NO: 764938 - protein, 22 aa, Mycobacterium
FFPQRFRSPLSIAFPFVSTHNH

SEQ ID NO: 764939 - protein, 17 aa, Mycobacterium
FFPWGMVDQHFIKRGRF

SEQ ID NO: 764940 - protein, 17 aa, Mycobacterium
FFQRFIERVSVFARTVD

SEQ ID NO: 764941 - protein, 19 aa, Mycobacterium
FFQYHLPGVQAYHLDVVPD

SEQ ID NO: 764942 - protein, 21 aa, Mycobacterium
FFRPRVERLFGGFHYRIEIYV

SEQ ID NO: 764943 - protein, 21 aa, Mycobacterium
FFRPRVKRLFGFHYRIEIYTP

SEQ ID NO: 764944 - protein, 23 aa, Mycobacterium
FFSRNCRTWLGIALMMQGHLAEA

SEQ ID NO: 764945 - protein, 19 aa, Mycobacterium
FFTVRAGSLVAWRTVEDAS

SEQ ID NO: 764946 - protein, 17 aa, Mycobacterium
FFWVTGLTADGKIVVAN

SEQ ID NO: 764947 - protein, 17 aa, Mycobacterium
FGAAGYLEAEWKPESEG

SEQ ID NO: 764948 - protein, 17 aa, Mycobacterium
FGACGGVPLLLLTGRGG

SEQ ID NO: 764949 - protein, 17 aa, Mycobacterium
FGAELAVRVSAIRTDPW

SEQ ID NO: 764950 - protein, 24 aa, Mycobacterium
FGAGNRYNGNIGFGNIGNPATSPN

SEQ ID NO: 764951 - protein, 19 aa, Mycobacterium
FGAGRRADGHWVLPELSTE

SEQ ID NO: 764952 - protein, 18 aa, Mycobacterium
FGAHMAAFHDQFVQTLKT

SEQ ID NO: 764953 - protein, 17 aa, Mycobacterium
FGALIPRLVRQAINGKN

SEQ ID NO: 764954 - protein, 23 aa, Mycobacterium
FGALLPRYLATRVYAALLEAAAS

SEQ ID NO: 764955 - protein, 17 aa, Mycobacterium
FGAPRTMLNVKIGGARR

SEQ ID NO: 764956 - protein, 19 aa, Mycobacterium
FGARLCRLSLGWALLMRGE

SEQ ID NO: 764957 - protein, 18 aa, Mycobacterium
FGASRRGDGHWVLPELST

SEQ ID NO: 764958 - protein, 24 aa, Mycobacterium
FGCGGEVFAGLTLEPVVVLQRGAQ

SEQ ID NO: 764959 - protein, 23 aa, Mycobacterium
FGCKRPSFSNTYLKTFNRPNVAL

SEQ ID NO: 764960 - protein, 17 aa, Mycobacterium
FGCKRPTFSNSYYRTFT

SEQ ID NO: 764961 - protein, 23 aa, Mycobacterium
FGCKRPTFSNTYFRAFTKKNVSL

SEQ ID NO: 764962 - protein, 24 aa, Mycobacterium
FGCRMGICFACTAVKTSGCTRNLR

SEQ ID NO: 764963 - protein, 18 aa, Mycobacterium
FGCSPLDYMEELGWLGPD

SEQ ID NO: 764964 - protein, 17 aa, Mycobacterium
FGDAVAVFPSWETLPHE

SEQ ID NO: 764965 - protein, 17 aa, Mycobacterium
FGDFVARLDMGWPDHKV

SEQ ID NO: 764966 - protein, 17 aa, Mycobacterium
FGDLLYLDRYWREEQQV

SEQ ID NO: 764967 - protein, 17 aa, Mycobacterium
FGDQKARIFLALLGKQY

SEQ ID NO: 764968 - protein, 22 aa, Mycobacterium
FGDQPFAVWPWAAPKLGGARPV

SEQ ID NO: 764969 - protein, 17 aa, Mycobacterium
FGEDIWIPGREPSDRQL

SEQ ID NO: 764970 - protein, 20 aa, Mycobacterium
FGEELVMWWNFVGRSHDDIA

SEQ ID NO: 764971 - protein, 19 aa, Mycobacterium
FGEFAAFCYHQPFTKMAYK

SEQ ID NO: 764972 - protein, 17 aa, Mycobacterium
FGELLAFGTLVAEGKVV

SEQ ID NO: 764973 - protein, 17 aa, Mycobacterium
FGELRWAISGAAPIPKE

SEQ ID NO: 764974 - protein, 19 aa, Mycobacterium
FGEPNPRFGPVGDHDGLFI

SEQ ID NO: 764975 - protein, 24 aa, Mycobacterium
FGEPSLTEPWGWQMHGHHCVLNCQ

SEQ ID NO: 764976 - protein, 21 aa, Mycobacterium
FGEQIVMWWNFVGRDHDEIAA

SEQ ID NO: 764977 - protein, 17 aa, Mycobacterium
FGERGIRLSSAFAGLTA

SEQ ID NO: 764978 - protein, 19 aa, Mycobacterium
FGERPVRFWFRRQAQEVAV

SEQ ID NO: 764979 - protein, 17 aa, Mycobacterium
FGFDAAWQPLVALLDGH

SEQ ID NO: 764980 - protein, 20 aa, Mycobacterium
FGFGALQIWQAFTEKVSKQP

SEQ ID NO: 764981 - protein, 20 aa, Mycobacterium
FGFKRGGQWVYWDGTVAAES

SEQ ID NO: 764982 - protein, 17 aa, Mycobacterium
FGGCGQSGIGRELGIEG

SEQ ID NO: 764983 - protein, 18 aa, Mycobacterium
FGGFGGWGGQSGLIGSGG

SEQ ID NO: 764984 - protein, 17 aa, Mycobacterium
FGGGGLLGFLEKLGTQL

SEQ ID NO: 764985 - protein, 18 aa, Mycobacterium
FGGGLVWQLLAAGEPRLA

SEQ ID NO: 764986 - protein, 20 aa, Mycobacterium
FGGGNGGRAWLLGNGGAGGD

SEQ ID NO: 764987 - protein, 17 aa, Mycobacterium
FGGHGGDALLFGNGGNG

SEQ ID NO: 764988 - protein, 19 aa, Mycobacterium
FGGLCAWYSIIHTPADRLA

SEQ ID NO: 764989 - protein, 18 aa, Mycobacterium
FGGQWYGYFMRRLAERPA

SEQ ID NO: 764990 - protein, 24 aa, Mycobacterium
FGGRLPELAARLSAALSASLSGSL

SEQ ID NO: 764991 - protein, 19 aa, Mycobacterium
FGHCMGAVVAFEFARVAER

SEQ ID NO: 764992 - protein, 17 aa, Mycobacterium
FGHSMGGLLAFEVARRF

SEQ ID NO: 764993 - protein, 20 aa, Mycobacterium
FGIDAVEAFQLLTRVSQQSN

SEQ ID NO: 764994 - protein, 17 aa, Mycobacterium
FGIPFGFSVVAPVNVPL

SEQ ID NO: 764995 - protein, 20 aa, Mycobacterium
FGISWILPRLTTWGVALDLL

SEQ ID NO: 764996 - protein, 21 aa, Mycobacterium
FGLDGSHGWERTHIDSLEAAY

SEQ ID NO: 764997 - protein, 23 aa, Mycobacterium
FGLGDDRWAFFIGDVLGHGVDAA

SEQ ID NO: 764998 - protein, 22 aa, Mycobacterium
FGLPPFERLRVIACGTSLNAGC

SEQ ID NO: 764999 - protein, 17 aa, Mycobacterium
FGLRECVVVPGPDAPDV

SEQ ID NO: 765000 - protein, 17 aa, Mycobacterium
FGLRPAPEFNDWLERMG

SEQ ID NO: 765001 - protein, 17 aa, Mycobacterium
FGLSVIFPPNLPLPAKV

SEQ ID NO: 765002 - protein, 17 aa, Mycobacterium
FGMLAAGARLVIPKPGG

SEQ ID NO: 765003 - protein, 19 aa, Mycobacterium
FGMRMLKRFDVDWAAYGYD

SEQ ID NO: 765004 - protein, 17 aa, Mycobacterium
FGMSMRFIKSRAAFVDK

SEQ ID NO: 765005 - protein, 20 aa, Mycobacterium
FGNLKFVWADGAADFVTPFI

SEQ ID NO: 765006 - protein, 23 aa, Mycobacterium
FGNVLRFLPPLAISDDLLLEGLD

SEQ ID NO: 765007 - protein, 19 aa, Mycobacterium
FGPATSWPTPGFVPSADVV

SEQ ID NO: 765008 - protein, 20 aa, Mycobacterium
FGPAVARRVARWMVVFLQRP

SEQ ID NO: 765009 - protein, 20 aa, Mycobacterium
FGPHCFYCGTHLPANNPIDH

SEQ ID NO: 765010 - protein, 17 aa, Mycobacterium
FGPSWAWPKPVQPHIPI

SEQ ID NO: 765011 - protein, 17 aa, Mycobacterium
FGPSWAWPKPVQPHIPV

SEQ ID NO: 765012 - protein, 17 aa, Mycobacterium
FGPSWAWPKPVQSHIPV

SEQ ID NO: 765013 - protein, 17 aa, Mycobacterium
FGQAYAWGQNGQSAAAY

SEQ ID NO: 765014 - protein, 17 aa, Mycobacterium
FGRFTPRARNVIVVAHN

SEQ ID NO: 765015 - protein, 19 aa, Mycobacterium
FGRHGLRLGGLDAQLARLL

SEQ ID NO: 765016 - protein, 17 aa, Mycobacterium
FGRHRWVAAPGPAAPLD

SEQ ID NO: 765017 - protein, 17 aa, Mycobacterium
FGRRAGIAAANYARGHD

SEQ ID NO: 765018 - protein, 22 aa, Mycobacterium
FGRRRAVSTISEWIEASHYGIY

SEQ ID NO: 765019 - protein, 18 aa, Mycobacterium
FGRSGLRRNIRWDPLDSV

SEQ ID NO: 765020 - protein, 18 aa, Mycobacterium
FGSACARALPDPASFVRF

SEQ ID NO: 765021 - protein, 20 aa, Mycobacterium
FGSRGLRARLRHSARNVDEL

SEQ ID NO: 765022 - protein, 20 aa, Mycobacterium
FGSRSGLLTRAWLRAVHRLQ

SEQ ID NO: 765023 - protein, 22 aa, Mycobacterium
FGSRSRFSCRHRHRQHYHSRSE

SEQ ID NO: 765024 - protein, 18 aa, Mycobacterium
FGSSTAWNPLPRGWYPGP

SEQ ID NO: 765025 - protein, 19 aa, Mycobacterium
FGSVTAGLAGQAWQGAASR

SEQ ID NO: 765026 - protein, 18 aa, Mycobacterium
FGTHSGWLEACYDLGTAV

SEQ ID NO: 765027 - protein, 19 aa, Mycobacterium
FGTTGYCMGGRASLIVATR

SEQ ID NO: 765028 - protein, 17 aa, Mycobacterium
FGTWESIGDLGWLDDDG

SEQ ID NO: 765029 - protein, 19 aa, Mycobacterium
FGVATAFTFRLHPVPTVIC

SEQ ID NO: 765030 - protein, 18 aa, Mycobacterium
FGVFCRRWGVPLIDGGTV

SEQ ID NO: 765031 - protein, 19 aa, Mycobacterium
FGVFCRRWGVPLIDGGTVR

SEQ ID NO: 765032 - protein, 18 aa, Mycobacterium
FGVFRTRYDAVWCSGMRA

SEQ ID NO: 765033 - protein, 18 aa, Mycobacterium
FGVGAGWNIEELRDHGTD

SEQ ID NO: 765034 - protein, 17 aa, Mycobacterium
FGVGAGWNIEELRHHGT

SEQ ID NO: 765035 - protein, 17 aa, Mycobacterium
FGVGVSSGFFNTGYSEA

SEQ ID NO: 765036 - protein, 18 aa, Mycobacterium
FGVPPAGNANYAWIQHIL

SEQ ID NO: 765037 - protein, 17 aa, Mycobacterium
FGVRVSVVEPGFTKTSF

SEQ ID NO: 765038 - protein, 22 aa, Mycobacterium
FGWEIVDATAWSAGQLDEAIGD

SEQ ID NO: 765039 - protein, 18 aa, Mycobacterium
FGYDDCRGHPAWFEPTEW

SEQ ID NO: 765040 - protein, 17 aa, Mycobacterium
FGYKAGCIASLIRGATI

SEQ ID NO: 765041 - protein, 18 aa, Mycobacterium
FGYKAGCIASLIRGATIV

SEQ ID NO: 765042 - protein, 17 aa, Mycobacterium
FGYNVVRDFTGHGIGTT

SEQ ID NO: 765043 - protein, 18 aa, Mycobacterium
FGYNVVRDFTGHGIGTTF

SEQ ID NO: 765044 - protein, 18 aa, Mycobacterium
FHATRLTAVVSWSDLLPN

SEQ ID NO: 765045 - protein, 23 aa, Mycobacterium
FHCGDEVYGLIGFDRDGAAADFV

SEQ ID NO: 765046 - protein, 19 aa, Mycobacterium
FHEPARWSGWLLYTHESTQ

SEQ ID NO: 765047 - protein, 17 aa, Mycobacterium
FHFRLTITAGEHRMVIE

SEQ ID NO: 765048 - protein, 23 aa, Mycobacterium
FHGHSSLGASGWDAAPAGYTRQA

SEQ ID NO: 765049 - protein, 17 aa, Mycobacterium
FHGRLPWIRAQRNIPFG

SEQ ID NO: 765050 - protein, 19 aa, Mycobacterium
FHGWCWAIDGRNIYVARPE

SEQ ID NO: 765051 - protein, 17 aa, Mycobacterium
FHPSYRYASAVRREIGV

SEQ ID NO: 765052 - protein, 18 aa, Mycobacterium
FHQRAAVRAHLWPDAMTT

SEQ ID NO: 765053 - protein, 19 aa, Mycobacterium
FHRHNRWALSGNFYRRLDA

SEQ ID NO: 765054 - protein, 17 aa, Mycobacterium
FHRLCFGLAAGGVGNRF

SEQ ID NO: 765055 - protein, 17 aa, Mycobacterium
FHTGIRVSGAFNTGFQQ

SEQ ID NO: 765056 - protein, 17 aa, Mycobacterium
FHTRYEPLWALCAELDL

SEQ ID NO: 765057 - protein, 19 aa, Mycobacterium
FHVYARIAPQWSFSQVRLA

SEQ ID NO: 765058 - protein, 18 aa, Mycobacterium
FHVYARIAPRWPFSKVRL

SEQ ID NO: 765059 - protein, 18 aa, Mycobacterium
FHWWLVLATLRWGVICQY

SEQ ID NO: 765060 - protein, 19 aa, Mycobacterium
FIAGGAIEIGGRLPINTHG

SEQ ID NO: 765061 - protein, 17 aa, Mycobacterium
FIAPAGFDFGRWRFETA

SEQ ID NO: 765062 - protein, 18 aa, Mycobacterium
FIEACRWIKENLPGVHIS

SEQ ID NO: 765063 - protein, 18 aa, Mycobacterium
FIETTGIPFLPMSMAKGL

SEQ ID NO: 765064 - protein, 17 aa, Mycobacterium
FIGECREGGRLLEFDLA

SEQ ID NO: 765065 - protein, 17 aa, Mycobacterium
FIGQCLYQFANIYRSAL

SEQ ID NO: 765066 - protein, 24 aa, Mycobacterium
FIGWPRLPKMAGIAVLYTLRRALQ

SEQ ID NO: 765067 - protein, 18 aa, Mycobacterium
FIHATGFLGGQITLQTTW

SEQ ID NO: 765068 - protein, 17 aa, Mycobacterium
FIICYRMSMADYVEHGQ

SEQ ID NO: 765069 - protein, 18 aa, Mycobacterium
FILAEIFPGGWLPTPQTV

SEQ ID NO: 765070 - protein, 21 aa, Mycobacterium
FINRLDDVLIFDGLNPEELVQ

SEQ ID NO: 765071 - protein, 17 aa, Mycobacterium
FIPHSVWQQMGDTFLDT

SEQ ID NO: 765072 - protein, 18 aa, Mycobacterium
FIPLPWLGTNGFQEACWA

SEQ ID NO: 765073 - protein, 17 aa, Mycobacterium
FIPPIAVGRGLRPERVH

SEQ ID NO: 765074 - protein, 17 aa, Mycobacterium
FIQIYGLTETAPLITMN

SEQ ID NO: 765075 - protein, 20 aa, Mycobacterium
FIQPRFPGYLSNALHTPEQF

SEQ ID NO: 765076 - protein, 26 aa, Mycobacterium
FIRCRQIEALLCWDRYGGDLLNVVYA

SEQ ID NO: 765077 - protein, 20 aa, Mycobacterium
FIRDTTWVSVRWYKPGGALT

SEQ ID NO: 765078 - protein, 18 aa, Mycobacterium
FIREADVASALWHPNIVR

SEQ ID NO: 765079 - protein, 21 aa, Mycobacterium
FISNADWGDWFAVLARSGEEN

SEQ ID NO: 765080 - protein, 19 aa, Mycobacterium
FITATRTRAGWTFSGTISW

SEQ ID NO: 765081 - protein, 22 aa, Mycobacterium
FITRRMGVALARDEDVDTARRN

SEQ ID NO: 765082 - protein, 23 aa, Mycobacterium
FIVAQLLRLGKLGSFDFNSRFYA

SEQ ID NO: 765083 - protein, 24 aa, Mycobacterium
FIYFRLCTPRHGIRSLLMQKLQGG

SEQ ID NO: 765084 - protein, 19 aa, Mycobacterium
FKAAAPTGGMLSKADIEAA

SEQ ID NO: 765085 - protein, 17 aa, Mycobacterium
FKAKGYEVLVLTDPVDE

SEQ ID NO: 765086 - protein, 20 aa, Mycobacterium
FKAPKAFLFVERIERLGNGK

SEQ ID NO: 765087 - protein, 22 aa, Mycobacterium
FKCNWYKLSEMPVLWAYARDLF

SEQ ID NO: 765088 - protein, 17 aa, Mycobacterium
FKDAELLGMPWVVVVGR

SEQ ID NO: 765089 - protein, 20 aa, Mycobacterium
FKDAELLGVPWIVVIGRGWA

SEQ ID NO: 765090 - protein, 17 aa, Mycobacterium
FKDGWLHTGDMAREDED

SEQ ID NO: 765091 - protein, 17 aa, Mycobacterium
FKDRMGWDLPWVSSGRS

SEQ ID NO: 765092 - protein, 20 aa, Mycobacterium
FKEALWLRRWCSATSNRWCQ

SEQ ID NO: 765093 - protein, 18 aa, Mycobacterium
FKEFWSGLMQKWIAATAA

SEQ ID NO: 765094 - protein, 24 aa, Mycobacterium
FKEGDRLWLSWAMANRDPAVFPDP

SEQ ID NO: 765095 - protein, 19 aa, Mycobacterium
FKEVMKWPDYVEFLTNWAT

SEQ ID NO: 765096 - protein, 18 aa, Mycobacterium
FKEVMRWPDYVEFLTQWA

SEQ ID NO: 765097 - protein, 17 aa, Mycobacterium
FKFFWVTGLTADGKIVV

SEQ ID NO: 765098 - protein, 19 aa, Mycobacterium
FKGLCPYAGELIVVGEAKP

SEQ ID NO: 765099 - protein, 17 aa, Mycobacterium
FKGPWLALLLLSRGHQV

SEQ ID NO: 765100 - protein, 20 aa, Mycobacterium
FKGSRSFGLPEFDPFWQACV

SEQ ID NO: 765101 - protein, 18 aa, Mycobacterium
FKGVQSFKRWAAEHSGND

SEQ ID NO: 765102 - protein, 23 aa, Mycobacterium
FKGWSVEMSRHFDVVDVQDAKFL

SEQ ID NO: 765103 - protein, 22 aa, Mycobacterium
FKHGIQLFGAMGFTWENDLQFA

SEQ ID NO: 765104 - protein, 20 aa, Mycobacterium
FKLAAQTAVDWSRAWDDGRP

SEQ ID NO: 765105 - protein, 20 aa, Mycobacterium
FKLYGHRDVKLLDGGRKKWE

SEQ ID NO: 765106 - protein, 20 aa, Mycobacterium
FKNRILRAFFEGNRHRPRST

SEQ ID NO: 765107 - protein, 19 aa, Mycobacterium
FKPLSRFFDRVWRPEQLPA

SEQ ID NO: 765108 - protein, 21 aa, Mycobacterium
FKPPYLPFATLWNFVSELAAH

SEQ ID NO: 765109 - protein, 17 aa, Mycobacterium
FKRAAQTAVDWSRACDG

SEQ ID NO: 765110 - protein, 21 aa, Mycobacterium
FKRFGDLRLRLSVNGQERQNA

SEQ ID NO: 765111 - protein, 17 aa, Mycobacterium
FKSEPWARLGVNVDADF

SEQ ID NO: 765112 - protein, 23 aa, Mycobacterium
FKSEPWARLGVNVDQNFEPLYIV

SEQ ID NO: 765113 - protein, 17 aa, Mycobacterium
FKSKIARRSYYKGEQPT

SEQ ID NO: 765114 - protein, 21 aa, Mycobacterium
FKSPRPGTAPLRGCPFHNAAV

SEQ ID NO: 765115 - protein, 17 aa, Mycobacterium
FKSRGAFRVPVPPEFGP

SEQ ID NO: 765116 - protein, 20 aa, Mycobacterium
FKTAATWPPTWKAWRRIRRY

SEQ ID NO: 765117 - protein, 22 aa, Mycobacterium
FKTSIRNGMPWIADEHFTLGDR

SEQ ID NO: 765118 - protein, 19 aa, Mycobacterium
FKVALSIGIMKMVRSDLAS

SEQ ID NO: 765119 - protein, 18 aa, Mycobacterium
FKVSLSIGVMKMVRSDLA

SEQ ID NO: 765120 - protein, 17 aa, Mycobacterium
FKYGLPMDADMVMDVRF

SEQ ID NO: 765121 - protein, 18 aa, Mycobacterium
FKYPGIRSDSDMFTLGFR

SEQ ID NO: 765122 - protein, 23 aa, Mycobacterium
FLAERVVRWWLPDDVVFVDELPH

SEQ ID NO: 765123 - protein, 17 aa, Mycobacterium
FLAKLGCTFVVVGHSER

SEQ ID NO: 765124 - protein, 19 aa, Mycobacterium
FLAMLRRFYELGVKELNGH

SEQ ID NO: 765125 - protein, 18 aa, Mycobacterium
FLAMWRKIVIDSNFHAGC

SEQ ID NO: 765126 - protein, 18 aa, Mycobacterium
FLAPEDWNLPTGRFAGAT

SEQ ID NO: 765127 - protein, 17 aa, Mycobacterium
FLARNGLHYTWFRADDP

SEQ ID NO: 765128 - protein, 23 aa, Mycobacterium
FLAWEPFSRMAFRFNAASTRSIS

SEQ ID NO: 765129 - protein, 18 aa, Mycobacterium
FLAWHAWHDSELGTWPPG

SEQ ID NO: 765130 - protein, 17 aa, Mycobacterium
FLAWHAWHDVGAGDWPP

SEQ ID NO: 765131 - protein, 18 aa, Mycobacterium
FLAWHAWSDAERGNWPPG

SEQ ID NO: 765132 - protein, 17 aa, Mycobacterium
FLDAAACTLEYKTKDTA

SEQ ID NO: 765133 - protein, 19 aa, Mycobacterium
FLDDRVNAILGLAEDEQAL

SEQ ID NO: 765134 - protein, 19 aa, Mycobacterium
FLDGARAYVRFAIGHPGHY

SEQ ID NO: 765135 - protein, 23 aa, Mycobacterium
FLDKALEGFTMFALNQGEVCTCP

SEQ ID NO: 765136 - protein, 19 aa, Mycobacterium
FLDREGWDALTINALANQL

SEQ ID NO: 765137 - protein, 20 aa, Mycobacterium
FLDREGWDALTINALANQLG

SEQ ID NO: 765138 - protein, 18 aa, Mycobacterium
FLDREGWDSLTINALATQ

SEQ ID NO: 765139 - protein, 17 aa, Mycobacterium
FLDSSGFGRNMLFADEP

SEQ ID NO: 765140 - protein, 26 aa, Mycobacterium
FLEGLSPWLEFVWKPGYADYYPNLPG

SEQ ID NO: 765141 - protein, 17 aa, Mycobacterium
FLELCRKGYEQSKDKWT

SEQ ID NO: 765142 - protein, 25 aa, Mycobacterium
FLGARFDAGLAWVHFPVGFGGLDLP

SEQ ID NO: 765143 - protein, 17 aa, Mycobacterium
FLGIAVHGFPNYFFISG

SEQ ID NO: 765144 - protein, 19 aa, Mycobacterium
FLHKELYREYALRPPKGVL

SEQ ID NO: 765145 - protein, 18 aa, Mycobacterium
FLHKELYREYSLRPPKGV

SEQ ID NO: 765146 - protein, 23 aa, Mycobacterium
FLHPLPVRRLWGVGAKTAAKLQS

SEQ ID NO: 765147 - protein, 24 aa, Mycobacterium
FLHPLPVRRLWGVGAKTADKLHAH

SEQ ID NO: 765148 - protein, 24 aa, Mycobacterium
FLHPLPVRRLWGVGAKTADKLRAH

SEQ ID NO: 765149 - protein, 23 aa, Mycobacterium
FLHPLPVRRLWGVGAKTAEKLRA

SEQ ID NO: 765150 - protein, 23 aa, Mycobacterium
FLHPLPVRRLWGVGAVTADKLHA

SEQ ID NO: 765151 - protein, 20 aa, Mycobacterium
FLIRKGVRLIRCAGWSDYYP

SEQ ID NO: 765152 - protein, 21 aa, Mycobacterium
FLIRKGVRLIRCAGWSDYYPN

SEQ ID NO: 765153 - protein, 18 aa, Mycobacterium
FLKEDPWERLAVLREAAP

SEQ ID NO: 765154 - protein, 20 aa, Mycobacterium
FLKEGHMVYAFPGAIDTNLV

SEQ ID NO: 765155 - protein, 22 aa, Mycobacterium
FLKSRLRTGGLLLNHCITRHDN

SEQ ID NO: 765156 - protein, 18 aa, Mycobacterium
FLLALAVAYEVQCRFSAQ

SEQ ID NO: 765157 - protein, 17 aa, Mycobacterium
FLLEERRTWLLGGHATP

SEQ ID NO: 765158 - protein, 19 aa, Mycobacterium
FLLLDGWPDLDLTILNIVE

SEQ ID NO: 765159 - protein, 23 aa, Mycobacterium
FLLSRAPGGLGLHAALTGAPFSG

SEQ ID NO: 765160 - protein, 17 aa, Mycobacterium
FLMCTPLSHAGAAFFVP

SEQ ID NO: 765161 - protein, 19 aa, Mycobacterium
FLPDGTIEFLGRVDNQLKI

SEQ ID NO: 765162 - protein, 17 aa, Mycobacterium
FLPDSLKAVASRINSTP

SEQ ID NO: 765163 - protein, 18 aa, Mycobacterium
FLPELARRLLGEEPLLPT

SEQ ID NO: 765164 - protein, 17 aa, Mycobacterium
FLPEMAEHLLGETPLLP

SEQ ID NO: 765165 - protein, 20 aa, Mycobacterium
FLPKSIRIFQYWARVPGTDF

SEQ ID NO: 765166 - protein, 22 aa, Mycobacterium
FLPRGIAGLFFFDGEQIEALAD

SEQ ID NO: 765167 - protein, 26 aa, Mycobacterium
FLPSCGRCSYCARGMGNLCELGAALM

SEQ ID NO: 765168 - protein, 19 aa, Mycobacterium
FLPTPLRWLVAATRAAPLR

SEQ ID NO: 765169 - protein, 19 aa, Mycobacterium
FLPWFSHPRLSVAQLSPPT

SEQ ID NO: 765170 - protein, 19 aa, Mycobacterium
FLQGLGFSLSRQWTVAQVV

SEQ ID NO: 765171 - protein, 17 aa, Mycobacterium
FLQRVWRLVVDENTGET

SEQ ID NO: 765172 - protein, 22 aa, Mycobacterium
FLREVQDVWTWARPYFDDRATA

SEQ ID NO: 765173 - protein, 17 aa, Mycobacterium
FLRPELRTIQPYGVQVD

SEQ ID NO: 765174 - protein, 18 aa, Mycobacterium
FLRRFDFLVTPVTTAQAF

SEQ ID NO: 765175 - protein, 19 aa, Mycobacterium
FLRRFSLLDSLYMIPPPRI

SEQ ID NO: 765176 - protein, 20 aa, Mycobacterium
FLRRFSLLDSLYMVPPPRII

SEQ ID NO: 765177 - protein, 24 aa, Mycobacterium
FLRRPACWMQLLATSGRCFSAAPN

SEQ ID NO: 765178 - protein, 17 aa, Mycobacterium
FLRRWPRVQSWADIPLD

SEQ ID NO: 765179 - protein, 23 aa, Mycobacterium
FLSDGRASIRLVAFTDTDGGNHS

SEQ ID NO: 765180 - protein, 22 aa, Mycobacterium
FLSRAETLIPMYAHNPAQLFET

SEQ ID NO: 765181 - protein, 20 aa, Mycobacterium
FLTCDARLAVTLPPGLADDQ

SEQ ID NO: 765182 - protein, 18 aa, Mycobacterium
FLTDLSLIGGLIIAAADT

SEQ ID NO: 765183 - protein, 17 aa, Mycobacterium
FLTDWAGPEAMVKKLSI

SEQ ID NO: 765184 - protein, 17 aa, Mycobacterium
FLTDWAGPEAMVKNLSI

SEQ ID NO: 765185 - protein, 18 aa, Mycobacterium
FLTIEPRKGFSVTALSSE

SEQ ID NO: 765186 - protein, 21 aa, Mycobacterium
FLTTRLDRRWGGAFGTMPDGL

SEQ ID NO: 765187 - protein, 17 aa, Mycobacterium
FLVAVARSCCGHAASVV

SEQ ID NO: 765188 - protein, 18 aa, Mycobacterium
FLVMGAMNWTAEWWDPRR

SEQ ID NO: 765189 - protein, 18 aa, Mycobacterium
FLVPWTWRQHLWPTEKFE

SEQ ID NO: 765190 - protein, 18 aa, Mycobacterium
FLVSDGWWITGQTILING

SEQ ID NO: 765191 - protein, 17 aa, Mycobacterium
FLVVQAFDVYEFERMRV

SEQ ID NO: 765192 - protein, 17 aa, Mycobacterium
FLWAPRLGCYGIQRIHP

SEQ ID NO: 765193 - protein, 17 aa, Mycobacterium
FLWEVFGRIGIDRKDAV

SEQ ID NO: 765194 - protein, 18 aa, Mycobacterium
FLWMWPNARISVMGGEQA

SEQ ID NO: 765195 - protein, 17 aa, Mycobacterium
FMACCAFAVLADEAKRC

SEQ ID NO: 765196 - protein, 22 aa, Mycobacterium
FMACPFGAPGTRMYRTGDLVCW

SEQ ID NO: 765197 - protein, 18 aa, Mycobacterium
FMARYVLHNGFLESDKLA

SEQ ID NO: 765198 - protein, 18 aa, Mycobacterium
FMATPRYAEWLLNDADMI

SEQ ID NO: 765199 - protein, 17 aa, Mycobacterium
FMAVNEMLRSGGATYHN

SEQ ID NO: 765200 - protein, 18 aa, Mycobacterium
FMGGFALWVDEQRRLHHT

SEQ ID NO: 765201 - protein, 17 aa, Mycobacterium
FMLFGLVDHGGWITKAG

SEQ ID NO: 765202 - protein, 17 aa, Mycobacterium
FMMRAFCDLAERHPWQE

SEQ ID NO: 765203 - protein, 20 aa, Mycobacterium
FMPKSVVINPYFDWGNDRPP

SEQ ID NO: 765204 - protein, 17 aa, Mycobacterium
FMQRLNSVLPLWLQYGG

SEQ ID NO: 765205 - protein, 17 aa, Mycobacterium
FMRDRCLSIAGGTTQIL

SEQ ID NO: 765206 - protein, 23 aa, Mycobacterium
FMRECSRFPLSHVAIAGIDWGVL

SEQ ID NO: 765207 - protein, 31 aa, Mycobacterium
FMRRDEVEAAWAWAEPILRHWQDADRVPRTY

SEQ ID NO: 765208 - protein, 17 aa, Mycobacterium
FMRSCSIKHRMASVIFS

SEQ ID NO: 765209 - protein, 22 aa, Mycobacterium
FMSHPFCTPDYLAQVTRPALGR

SEQ ID NO: 765210 - protein, 19 aa, Mycobacterium
FMSIFAVMIQNHFFQNVDI

SEQ ID NO: 765211 - protein, 18 aa, Mycobacterium
FMVDEGWLPQSYLPDTYP

SEQ ID NO: 765212 - protein, 20 aa, Mycobacterium
FMWRLADECLDDFIDDGSCE

SEQ ID NO: 765213 - protein, 17 aa, Mycobacterium
FNAVFGVGGGSAIANGA

SEQ ID NO: 765214 - protein, 18 aa, Mycobacterium
FNCLSWIEALGFCGIGEA

SEQ ID NO: 765215 - protein, 26 aa, Mycobacterium
FNELVMRAGLRWQQVVLLRAYAKYLR

SEQ ID NO: 765216 - protein, 17 aa, Mycobacterium
FNFYACDVTLKVDGLQP

SEQ ID NO: 765217 - protein, 17 aa, Mycobacterium
FNGWKALSWMDANVWRH

SEQ ID NO: 765218 - protein, 17 aa, Mycobacterium
FNIPIVMFVDVPGFLPG

SEQ ID NO: 765219 - protein, 18 aa, Mycobacterium
FNKFNIPINIARVFHRDQ

SEQ ID NO: 765220 - protein, 17 aa, Mycobacterium
FNKPGTIPLQFQTEVRD

SEQ ID NO: 765221 - protein, 19 aa, Mycobacterium
FNLKGERLGAVIAGAVLKL

SEQ ID NO: 765222 - protein, 17 aa, Mycobacterium
FNLWLDEDWGFNRPDGR

SEQ ID NO: 765223 - protein, 23 aa, Mycobacterium
FNMKTRAAVLWGLEQKWEVEEVD

SEQ ID NO: 765224 - protein, 21 aa, Mycobacterium
FNPRAAYRWSVETSVYMARDR

SEQ ID NO: 765225 - protein, 18 aa, Mycobacterium
FNPSWGWAAGAMVSTLDD

SEQ ID NO: 765226 - protein, 24 aa, Mycobacterium
FNRCPDCGRIYWAGSHHARLVRQV

SEQ ID NO: 765227 - protein, 22 aa, Mycobacterium
FNRNTWGVAMIGNFDDVPPTPT

SEQ ID NO: 765228 - protein, 17 aa, Mycobacterium
FNVSRLAAWHMSKNDPV

SEQ ID NO: 765229 - protein, 24 aa, Mycobacterium
FNYNWQWECFRGEGLPREYAAARS

SEQ ID NO: 765230 - protein, 19 aa, Mycobacterium
FPAGIKWKTVLDCADALKF

SEQ ID NO: 765231 - protein, 20 aa, Mycobacterium
FPALPWPYRVVDLAAAVLRP

SEQ ID NO: 765232 - protein, 17 aa, Mycobacterium
FPAMQAMPTPYVEASDI

SEQ ID NO: 765233 - protein, 19 aa, Mycobacterium
FPAMVPLWFIPVALAAGNT

SEQ ID NO: 765234 - protein, 17 aa, Mycobacterium
FPAPAHWYFPTQADGSV

SEQ ID NO: 765235 - protein, 17 aa, Mycobacterium
FPAPVKYVAPIAFNVIP

SEQ ID NO: 765236 - protein, 17 aa, Mycobacterium
FPAPVPVGSRVRAQSSL

SEQ ID NO: 765237 - protein, 26 aa, Mycobacterium
FPASYWRRWSICASVVLRVELTGTGR

SEQ ID NO: 765238 - protein, 23 aa, Mycobacterium
FPASYWRRWSICSSVVLRVELTG

SEQ ID NO: 765239 - protein, 23 aa, Mycobacterium
FPASYWRRWSICTSVVLRVELIG

SEQ ID NO: 765240 - protein, 18 aa, Mycobacterium
FPAVKLLVRKAGARSSEM

SEQ ID NO: 765241 - protein, 25 aa, Mycobacterium
FPDKKGGPGWVEWGGCGMVNPNVLR

SEQ ID NO: 765242 - protein, 19 aa, Mycobacterium
FPDLFATHRVRAVDDYSSH

SEQ ID NO: 765243 - protein, 19 aa, Mycobacterium
FPDVPGVRIDAGFTSGSTV

SEQ ID NO: 765244 - protein, 23 aa, Mycobacterium
FPDYRPELPGGRPTGGRSLSAAP

SEQ ID NO: 765245 - protein, 25 aa, Mycobacterium
FPEAMVRPRWLWKFGKTLRPPDLRV

SEQ ID NO: 765246 - protein, 19 aa, Mycobacterium
FPEATMCRFGVPLGPVAQP

SEQ ID NO: 765247 - protein, 18 aa, Mycobacterium
FPEELGKMGFVFNFITYG

SEQ ID NO: 765248 - protein, 19 aa, Mycobacterium
FPEKYWLPIPVDVTAEAIV

SEQ ID NO: 765249 - protein, 20 aa, Mycobacterium
FPELCALSWTVYSLPGAPVL

SEQ ID NO: 765250 - protein, 17 aa, Mycobacterium
FPERWWWGQAHDFPAAD

SEQ ID NO: 765251 - protein, 18 aa, Mycobacterium
FPEYRFTEFDAEKATGGV

SEQ ID NO: 765252 - protein, 21 aa, Mycobacterium
FPFSLVFARLYAARGYHVVLQ

SEQ ID NO: 765253 - protein, 20 aa, Mycobacterium
FPFSRLYEKLGLPAAAQDND

SEQ ID NO: 765254 - protein, 17 aa, Mycobacterium
FPGCDAPAMAADIDHTR

SEQ ID NO: 765255 - protein, 18 aa, Mycobacterium
FPGLRGRIYRTLVIGTRG

SEQ ID NO: 765256 - protein, 17 aa, Mycobacterium
FPGLWYTWRHQLAALSA

SEQ ID NO: 765257 - protein, 17 aa, Mycobacterium
FPGRLTPQLSRALHRHA

SEQ ID NO: 765258 - protein, 18 aa, Mycobacterium
FPGVPTWFSKTPGRVRGF

SEQ ID NO: 765259 - protein, 18 aa, Mycobacterium
FPHAVKWQGVIYLEDGLH

SEQ ID NO: 765260 - protein, 18 aa, Mycobacterium
FPHAVKWRGVTYLEDGLH

SEQ ID NO: 765261 - protein, 19 aa, Mycobacterium
FPHAVRWKGVVYLEDGLHR

SEQ ID NO: 765262 - protein, 19 aa, Mycobacterium
FPHAVRWRGVIYLEDGLHR

SEQ ID NO: 765263 - protein, 25 aa, Mycobacterium
FPHGPFSVGFARFFEIWVDVEAHRF

SEQ ID NO: 765264 - protein, 20 aa, Mycobacterium
FPIEPHWLFPGMQWLPYEAR

SEQ ID NO: 765265 - protein, 17 aa, Mycobacterium
FPIGNLMPGFGHIGMGG

SEQ ID NO: 765266 - protein, 17 aa, Mycobacterium
FPILVAHDLACVLQCNG

SEQ ID NO: 765267 - protein, 20 aa, Mycobacterium
FPINLLGVWAQLATAQGVAS

SEQ ID NO: 765268 - protein, 21 aa, Mycobacterium
FPKAAVWSPMFMKPPDQDGPG

SEQ ID NO: 765269 - protein, 17 aa, Mycobacterium
FPKFPGTPGTEWHQVRN

SEQ ID NO: 765270 - protein, 20 aa, Mycobacterium
FPKFRVPGRLVWFAMTIWQF

SEQ ID NO: 765271 - protein, 21 aa, Mycobacterium
FPKWLGRSWIRSAMLRYGENP

SEQ ID NO: 765272 - protein, 18 aa, Mycobacterium
FPLAMAWAHLRTLRLADG

SEQ ID NO: 765273 - protein, 23 aa, Mycobacterium
FPLARLYAWHRAMRLFDGPDEVH

SEQ ID NO: 765274 - protein, 22 aa, Mycobacterium
FPLARLYSWHRAMRLFDGPDEV

SEQ ID NO: 765275 - protein, 17 aa, Mycobacterium
FPLELIHPFPTPTEADE

SEQ ID NO: 765276 - protein, 17 aa, Mycobacterium
FPLKQAWHVNVLGTSRV

SEQ ID NO: 765277 - protein, 17 aa, Mycobacterium
FPLLGGVIDFADYPRML

SEQ ID NO: 765278 - protein, 18 aa, Mycobacterium
FPLLGRRAAEEFGLRVVV

SEQ ID NO: 765279 - protein, 18 aa, Mycobacterium
FPLLRAGICAGPVVKRRG

SEQ ID NO: 765280 - protein, 23 aa, Mycobacterium
FPLSQWLKFAPPIAYGALPKDAL

SEQ ID NO: 765281 - protein, 19 aa, Mycobacterium
FPLYCCANGKALLASLPPE

SEQ ID NO: 765282 - protein, 17 aa, Mycobacterium
FPMRAVKHWNRWCEGAG

SEQ ID NO: 765283 - protein, 19 aa, Mycobacterium
FPNLFATHRVRAVDDYASH

SEQ ID NO: 765284 - protein, 19 aa, Mycobacterium
FPNLFATHRVRAVDDYPSH

SEQ ID NO: 765285 - protein, 20 aa, Mycobacterium
FPNMFSITGPYGFVLGSYLW

SEQ ID NO: 765286 - protein, 17 aa, Mycobacterium
FPPAPAHSASRTTASVG

SEQ ID NO: 765287 - protein, 17 aa, Mycobacterium
FPPAVRQVAAMFPGTTP

SEQ ID NO: 765288 - protein, 19 aa, Mycobacterium
FPPDRGWDIERLFDPDPDA

SEQ ID NO: 765289 - protein, 18 aa, Mycobacterium
FPPGYGLRHETDRGFANV

SEQ ID NO: 765290 - protein, 17 aa, Mycobacterium
FPPRIWDMLLERFGREV

SEQ ID NO: 765291 - protein, 20 aa, Mycobacterium
FPPVELFMQLPWRTEIIEGL

SEQ ID NO: 765292 - protein, 20 aa, Mycobacterium
FPPVELFMQMPWRTEIVDGL

SEQ ID NO: 765293 - protein, 17 aa, Mycobacterium
FPQLQIIVGHHFEALSW

SEQ ID NO: 765294 - protein, 21 aa, Mycobacterium
FPQSFGFSSLGGWLATRAGGH

SEQ ID NO: 765295 - protein, 17 aa, Mycobacterium
FPRCAEAIMAMLAVLKT

SEQ ID NO: 765296 - protein, 17 aa, Mycobacterium
FPRGLAAFIGLRDQRCR

SEQ ID NO: 765297 - protein, 20 aa, Mycobacterium
FPRIDPAIICLVHDGHDRAV

SEQ ID NO: 765298 - protein, 19 aa, Mycobacterium
FPRIDPAVICLVHDGGDRA

SEQ ID NO: 765299 - protein, 19 aa, Mycobacterium
FPRIDPAVICLVHDGHDRA

SEQ ID NO: 765300 - protein, 21 aa, Mycobacterium
FPRLRWGATECGAFWASDLLW

SEQ ID NO: 765301 - protein, 21 aa, Mycobacterium
FPRLRWGVTECGAFWANDLLW

SEQ ID NO: 765302 - protein, 21 aa, Mycobacterium
FPRVVPVGFYWTGERIVVSTA

SEQ ID NO: 765303 - protein, 21 aa, Mycobacterium
FPSRKGTWCALTLSRPDDVAA

SEQ ID NO: 765304 - protein, 19 aa, Mycobacterium
FPSTNWAPIEWRNIEDQEK

SEQ ID NO: 765305 - protein, 17 aa, Mycobacterium
FPTAALIAAGHRLRLTI

SEQ ID NO: 765306 - protein, 17 aa, Mycobacterium
FPTAGLIVGSQGIADAY

SEQ ID NO: 765307 - protein, 21 aa, Mycobacterium
FPTKESVLFFGEYDFIDAVSG

SEQ ID NO: 765308 - protein, 17 aa, Mycobacterium
FPTLCARAFTAHEAVER

SEQ ID NO: 765309 - protein, 24 aa, Mycobacterium
FPTPGWDVYVYFLKHDCDSLKNVQ

SEQ ID NO: 765310 - protein, 22 aa, Mycobacterium
FPTTARLTGRWMRGRIPVVSDF

SEQ ID NO: 765311 - protein, 21 aa, Mycobacterium
FPTTMRLTGRWLRGRLPNAYD

SEQ ID NO: 765312 - protein, 17 aa, Mycobacterium
FPVALGIRPNIPQDDLR

SEQ ID NO: 765313 - protein, 23 aa, Mycobacterium
FPVDARGGIELSLEGYGYRWLRL

SEQ ID NO: 765314 - protein, 20 aa, Mycobacterium
FPVKIHAASAGWTRAVAMID

SEQ ID NO: 765315 - protein, 19 aa, Mycobacterium
FPVQGWDSIGWVVGNAAQT

SEQ ID NO: 765316 - protein, 22 aa, Mycobacterium
FPVSQWLKFAPPIAYGALPKDA

SEQ ID NO: 765317 - protein, 18 aa, Mycobacterium
FPVWSGRCGFAVQEFARR

SEQ ID NO: 765318 - protein, 18 aa, Mycobacterium
FQAARWMWDYFIDLIASR

SEQ ID NO: 765319 - protein, 23 aa, Mycobacterium
FQAYAAACALHFAEKALAEIRAG

SEQ ID NO: 765320 - protein, 23 aa, Mycobacterium
FQAYAAACGLYFAEKALEEIRAG

SEQ ID NO: 765321 - protein, 25 aa, Mycobacterium
FQDHFGFDCVWEFPEKVQGGTQVGA

SEQ ID NO: 765322 - protein, 21 aa, Mycobacterium
FQEWARTAALPAPSARVGTIG

SEQ ID NO: 765323 - protein, 18 aa, Mycobacterium
FQFMPRRLLLPLLKSQHP

SEQ ID NO: 765324 - protein, 18 aa, Mycobacterium
FQFMPRRVLLPLLKNQHP

SEQ ID NO: 765325 - protein, 23 aa, Mycobacterium
FQIGFRGGHQWKGRDGLQVYLNQ

SEQ ID NO: 765326 - protein, 26 aa, Mycobacterium
FQISCGSCYMCGQQLYTQCETTQVRD

SEQ ID NO: 765327 - protein, 19 aa, Mycobacterium
FQLSGHWKIVTGIRSATWI

SEQ ID NO: 765328 - protein, 17 aa, Mycobacterium
FQPEIKGAPLLGEHTDE

SEQ ID NO: 765329 - protein, 18 aa, Mycobacterium
FQRGWQWATVEGRAELAG

SEQ ID NO: 765330 - protein, 18 aa, Mycobacterium
FQRLQIWYLRTIGHKKAA

SEQ ID NO: 765331 - protein, 19 aa, Mycobacterium
FQRRACAALECGHGVLVCA

SEQ ID NO: 765332 - protein, 18 aa, Mycobacterium
FQRRACAALEGGHGVLVC

SEQ ID NO: 765333 - protein, 21 aa, Mycobacterium
FQRRRFWPKSAGMAIDGRVGA

SEQ ID NO: 765334 - protein, 19 aa, Mycobacterium
FQRRRFWPKSSGTAIEGGG

SEQ ID NO: 765335 - protein, 17 aa, Mycobacterium
FQRRVWEALLTIPYGET

SEQ ID NO: 765336 - protein, 21 aa, Mycobacterium
FQSRFETVLARNPGEAEFHQA

SEQ ID NO: 765337 - protein, 17 aa, Mycobacterium
FQTRPAGLPGLRQKYGL

SEQ ID NO: 765338 - protein, 25 aa, Mycobacterium
FQWLTEMYPVWGRLDAELEFAAASA

SEQ ID NO: 765339 - protein, 17 aa, Mycobacterium
FQYHLPGVQAYHLDVTP

SEQ ID NO: 765340 - protein, 18 aa, Mycobacterium
FRAAMSMPLILLGGINRL

SEQ ID NO: 765341 - protein, 17 aa, Mycobacterium
FRAARVVIDIGVHCGLT

SEQ ID NO: 765342 - protein, 17 aa, Mycobacterium
FRAASPIARVHRNAPPF

SEQ ID NO: 765343 - protein, 17 aa, Mycobacterium
FRADNRFSDSGEQPAQP

SEQ ID NO: 765344 - protein, 23 aa, Mycobacterium
FRAELKLPLILLGGITNRDTMDQ

SEQ ID NO: 765345 - protein, 20 aa, Mycobacterium
FRAEPAAARRASTRAYRDSH

SEQ ID NO: 765346 - protein, 20 aa, Mycobacterium
FRAGGGLPYSEFPRFHQLMA

SEQ ID NO: 765347 - protein, 17 aa, Mycobacterium
FRAGGGVPYSDYPRFHT

SEQ ID NO: 765348 - protein, 17 aa, Mycobacterium
FRANGMWSDERGTNMLD

SEQ ID NO: 765349 - protein, 19 aa, Mycobacterium
FRAPLPLGIDPAAGDHTAA

SEQ ID NO: 765350 - protein, 19 aa, Mycobacterium
FRARLKAAYAEHPPVPLPG

SEQ ID NO: 765351 - protein, 19 aa, Mycobacterium
FRASVCVLGPLVGRCKRAK

SEQ ID NO: 765352 - protein, 19 aa, Mycobacterium
FRASVCVLGPLVGRCRRAK

SEQ ID NO: 765353 - protein, 18 aa, Mycobacterium
FRCARCAEPYSGALPHMP

SEQ ID NO: 765354 - protein, 22 aa, Mycobacterium
FRCSRLGSGLAEMFPGLTSVDV

SEQ ID NO: 765355 - protein, 19 aa, Mycobacterium
FRDRMGWDLPWVSSGATTF

SEQ ID NO: 765356 - protein, 18 aa, Mycobacterium
FREAVQWRIPVDELTVPD

SEQ ID NO: 765357 - protein, 20 aa, Mycobacterium
FRECAARALLLPRRHPGKRS

SEQ ID NO: 765358 - protein, 18 aa, Mycobacterium
FRECAARALLLPRRTPGR

SEQ ID NO: 765359 - protein, 17 aa, Mycobacterium
FREHASWALASDTLDFV

SEQ ID NO: 765360 - protein, 18 aa, Mycobacterium
FREHASWALTSDILEFVD

SEQ ID NO: 765361 - protein, 17 aa, Mycobacterium
FRESMRLILDGSVLAAA

SEQ ID NO: 765362 - protein, 17 aa, Mycobacterium
FRFHIGLAQLAGNALLD

SEQ ID NO: 765363 - protein, 17 aa, Mycobacterium
FRFLPALGQVLFRKDFP

SEQ ID NO: 765364 - protein, 17 aa, Mycobacterium
FRFPRIGTAVFDGIEIE

SEQ ID NO: 765365 - protein, 17 aa, Mycobacterium
FRFPRIGTAVFDGVELE

SEQ ID NO: 765366 - protein, 18 aa, Mycobacterium
FRFVEEMIRLGADARTDG

SEQ ID NO: 765367 - protein, 17 aa, Mycobacterium
FRFVEEMMRLGADARTD

SEQ ID NO: 765368 - protein, 20 aa, Mycobacterium
FRGNLSIVRTETWRRDGAGV

SEQ ID NO: 765369 - protein, 17 aa, Mycobacterium
FRGSAPILTGSTVTDQA

SEQ ID NO: 765370 - protein, 21 aa, Mycobacterium
FRHAVKFLRWRPDRDPQSCTF

SEQ ID NO: 765371 - protein, 21 aa, Mycobacterium
FRHFPTKEAVLFQDYENQLEW

SEQ ID NO: 765372 - protein, 23 aa, Mycobacterium
FRHGLQLFGAMGFTWENDLQFAL

SEQ ID NO: 765373 - protein, 25 aa, Mycobacterium
FRHGLQLFGAMGFTWENDVQFALKR

SEQ ID NO: 765374 - protein, 20 aa, Mycobacterium
FRHTFDWCVTSAFIMSQLAA

SEQ ID NO: 765375 - protein, 17 aa, Mycobacterium
FRIAREMVRVLGPGGRI

SEQ ID NO: 765376 - protein, 21 aa, Mycobacterium
FRIPEMIRWPGKISAGVVSNE

SEQ ID NO: 765377 - protein, 24 aa, Mycobacterium
FRKFKEWLADSAIGTFFSQTLPGF

SEQ ID NO: 765378 - protein, 19 aa, Mycobacterium
FRKHFWGCFIDDEHGLTNR

SEQ ID NO: 765379 - protein, 19 aa, Mycobacterium
FRKRLVAGFYAMRQKLAER

SEQ ID NO: 765380 - protein, 17 aa, Mycobacterium
FRLATSWMFGYVDAALN

SEQ ID NO: 765381 - protein, 21 aa, Mycobacterium
FRLLVLRTAWLIDKHHDYQKV

SEQ ID NO: 765382 - protein, 20 aa, Mycobacterium
FRLLVLRTAWLIDKHQDYLK

SEQ ID NO: 765383 - protein, 20 aa, Mycobacterium
FRLMSAWLMLAARPDLIGKR

SEQ ID NO: 765384 - protein, 19 aa, Mycobacterium
FRLPFGLTVTMDGRQGTGL

SEQ ID NO: 765385 - protein, 19 aa, Mycobacterium
FRLTYPFSPVLVSTLRNLS

SEQ ID NO: 765386 - protein, 17 aa, Mycobacterium
FRMGLPTNFGLSGYSGG

SEQ ID NO: 765387 - protein, 18 aa, Mycobacterium
FRNACRHRGFALVENAGC

SEQ ID NO: 765388 - protein, 25 aa, Mycobacterium
FRNRLWPGASLRWITANGHSAVLVV

SEQ ID NO: 765389 - protein, 18 aa, Mycobacterium
FRPATTLNVLAAAWLQFE

SEQ ID NO: 765390 - protein, 25 aa, Mycobacterium
FRPAVKWGGPIFEWARIPEVLRLAF

SEQ ID NO: 765391 - protein, 24 aa, Mycobacterium
FRPDLDVDLVYRFIRDTTWVSVRW

SEQ ID NO: 765392 - protein, 19 aa, Mycobacterium
FRPGAQFKAVISGAQKLPA

SEQ ID NO: 765393 - protein, 17 aa, Mycobacterium
FRPGCKRMLMTSDYYPA

SEQ ID NO: 765394 - protein, 19 aa, Mycobacterium
FRPGIPVPPVFTSRPQVHP

SEQ ID NO: 765395 - protein, 17 aa, Mycobacterium
FRPLERTQIRAMGLLKG

SEQ ID NO: 765396 - protein, 22 aa, Mycobacterium
FRPRVRTPFTRRSLSRDGSPTG

SEQ ID NO: 765397 - protein, 22 aa, Mycobacterium
FRPSKIAFLAWHAWSDAERGNW

SEQ ID NO: 765398 - protein, 21 aa, Mycobacterium
FRPSKIAFLAWHAWSDPEQGN

SEQ ID NO: 765399 - protein, 21 aa, Mycobacterium
FRPSKIAFLAWHAWSDSQRGN

SEQ ID NO: 765400 - protein, 20 aa, Mycobacterium
FRPSPYAVRCCERSLEILRA

SEQ ID NO: 765401 - protein, 18 aa, Mycobacterium
FRQACCTLGINLQPAHPD

SEQ ID NO: 765402 - protein, 19 aa, Mycobacterium
FRQAGGYRRQLTFTPKGVI

SEQ ID NO: 765403 - protein, 17 aa, Mycobacterium
FRRAFSWLPSQFASQSD

SEQ ID NO: 765404 - protein, 17 aa, Mycobacterium
FRREVLRSVDWGGDPHN

SEQ ID NO: 765405 - protein, 21 aa, Mycobacterium
FRRGHDGHFLWPGFGENSRVL

SEQ ID NO: 765406 - protein, 18 aa, Mycobacterium
FRRHPWQFVRTSLSGESL

SEQ ID NO: 765407 - protein, 17 aa, Mycobacterium
FRRKAVFIAVGGVYDPR

SEQ ID NO: 765408 - protein, 17 aa, Mycobacterium
FRRKAVIIAVGGIYDPR

SEQ ID NO: 765409 - protein, 17 aa, Mycobacterium
FRRLAAFAGDFDLDAAQ

SEQ ID NO: 765410 - protein, 19 aa, Mycobacterium
FRRNHCVPMPVVDSIDELN

SEQ ID NO: 765411 - protein, 18 aa, Mycobacterium
FRRRCCRAPDPAALRTQG

SEQ ID NO: 765412 - protein, 17 aa, Mycobacterium
FRRVDVASALVVPPQVL

SEQ ID NO: 765413 - protein, 17 aa, Mycobacterium
FRSKFDIFLAVYEDGMR

SEQ ID NO: 765414 - protein, 21 aa, Mycobacterium
FRSKHALACAIVEYHAAQARD

SEQ ID NO: 765415 - protein, 19 aa, Mycobacterium
FRSLPVVDVIQVRRLGAAM

SEQ ID NO: 765416 - protein, 18 aa, Mycobacterium
FRSRGAFRVPLPKEFGPV

SEQ ID NO: 765417 - protein, 19 aa, Mycobacterium
FRTAATWPASLRAWRRVRD

SEQ ID NO: 765418 - protein, 17 aa, Mycobacterium
FRTPLTLIIGPVAELRR

SEQ ID NO: 765419 - protein, 18 aa, Mycobacterium
FRTPLTLILDPVSELRRA

SEQ ID NO: 765420 - protein, 17 aa, Mycobacterium
FRTPLTLLLGPLDDALA

SEQ ID NO: 765421 - protein, 17 aa, Mycobacterium
FRTPLTLLLGPLDDARS

SEQ ID NO: 765422 - protein, 17 aa, Mycobacterium
FRTPLTLLLGPVEDALA

SEQ ID NO: 765423 - protein, 19 aa, Mycobacterium
FRTRAFRDGDDWVITGRKY

SEQ ID NO: 765424 - protein, 17 aa, Mycobacterium
FRVDPAWVPPEEEALAM

SEQ ID NO: 765425 - protein, 17 aa, Mycobacterium
FRVGLGWIIDALRRQAP

SEQ ID NO: 765426 - protein, 17 aa, Mycobacterium
FRVKRPIRVTGWPPKGT

SEQ ID NO: 765427 - protein, 17 aa, Mycobacterium
FRWLKPVLSTSVGERPI

SEQ ID NO: 765428 - protein, 17 aa, Mycobacterium
FRWRAMGSHGAFRSESL

SEQ ID NO: 765429 - protein, 17 aa, Mycobacterium
FRWRLAPVPLNLDHPYW

SEQ ID NO: 765430 - protein, 17 aa, Mycobacterium
FRYGAMFGVEIQFWVFE

SEQ ID NO: 765431 - protein, 24 aa, Mycobacterium
FRYLFPRLRPGGVYIVEDVCANYW

SEQ ID NO: 765432 - protein, 17 aa, Mycobacterium
FRYPGIRSDSDMFTLGF

SEQ ID NO: 765433 - protein, 19 aa, Mycobacterium
FRYVMMVLRHIPRPIFRKL

SEQ ID NO: 765434 - protein, 20 aa, Mycobacterium
FRYVMMVLRHIPRSIFRRLP

SEQ ID NO: 765435 - protein, 21 aa, Mycobacterium
FSAAAVWRVRRAAPLLPTVLL

SEQ ID NO: 765436 - protein, 20 aa, Mycobacterium
FSAAEAWDGLAAELRLAASS

SEQ ID NO: 765437 - protein, 17 aa, Mycobacterium
FSAAFTFQYSKRPGTPA

SEQ ID NO: 765438 - protein, 20 aa, Mycobacterium
FSAAPLRWADWLSASAATFT

SEQ ID NO: 765439 - protein, 18 aa, Mycobacterium
FSALCWGERIAFDNPDSL

SEQ ID NO: 765440 - protein, 18 aa, Mycobacterium
FSALSARAVALGFDTVAT

SEQ ID NO: 765441 - protein, 17 aa, Mycobacterium
FSALYAKALALGFDVVV

SEQ ID NO: 765442 - protein, 17 aa, Mycobacterium
FSASGFMMDVRRYGATY

SEQ ID NO: 765443 - protein, 17 aa, Mycobacterium
FSATAWLARLRTTYLEA

SEQ ID NO: 765444 - protein, 17 aa, Mycobacterium
FSATCYEWAILDLAILA

SEQ ID NO: 765445 - protein, 21 aa, Mycobacterium
FSDAWFLIRVVEPMSADELPE

SEQ ID NO: 765446 - protein, 25 aa, Mycobacterium
FSELCARAGLDLVLDCHPVLADVDP

SEQ ID NO: 765447 - protein, 18 aa, Mycobacterium
FSELFAAFPSFAGLRPAF

SEQ ID NO: 765448 - protein, 22 aa, Mycobacterium
FSFCSLCFRGGWRAIVQLRVGR

SEQ ID NO: 765449 - protein, 20 aa, Mycobacterium
FSFDLNAHWSRLWSGQPEIL

SEQ ID NO: 765450 - protein, 21 aa, Mycobacterium
FSFEKRPSWSRTYAPGIELKN

SEQ ID NO: 765451 - protein, 17 aa, Mycobacterium
FSFGIGVHRCVGSNVAR

SEQ ID NO: 765452 - protein, 18 aa, Mycobacterium
FSFSGLKTAVARYVEAHP

SEQ ID NO: 765453 - protein, 17 aa, Mycobacterium
FSFSSLPRVLDWREYGK

SEQ ID NO: 765454 - protein, 20 aa, Mycobacterium
FSFYLCDLLLKVNGKGGQPV

SEQ ID NO: 765455 - protein, 18 aa, Mycobacterium
FSGHALDYQNLGARMTAF

SEQ ID NO: 765456 - protein, 18 aa, Mycobacterium
FSGTGTWLPLLRSGPDGQ

SEQ ID NO: 765457 - protein, 19 aa, Mycobacterium
FSGTISWVSGWGLNTVLTV

SEQ ID NO: 765458 - protein, 21 aa, Mycobacterium
FSIERAERWGAWALGKLDDLN

SEQ ID NO: 765459 - protein, 17 aa, Mycobacterium
FSLHFPWSQQLPVHSLD

SEQ ID NO: 765460 - protein, 17 aa, Mycobacterium
FSPLRLPPDLDFTSLFH

SEQ ID NO: 765461 - protein, 19 aa, Mycobacterium
FSPPGGRVLLVWDAPNLDM

SEQ ID NO: 765462 - protein, 18 aa, Mycobacterium
FSPSGGRVLLVWDAPNLD

SEQ ID NO: 765463 - protein, 22 aa, Mycobacterium
FSQGATISGLWIRENAGEADAP

SEQ ID NO: 765464 - protein, 18 aa, Mycobacterium
FSQRPGEVLVLGQVVETR

SEQ ID NO: 765465 - protein, 20 aa, Mycobacterium
FSRFELLRLLAFSRSGALPI

SEQ ID NO: 765466 - protein, 20 aa, Mycobacterium
FSRFELLRLLAFSRTGALPI

SEQ ID NO: 765467 - protein, 17 aa, Mycobacterium
FSRPGVHYLSGFFGPLE

SEQ ID NO: 765468 - protein, 22 aa, Mycobacterium
FSRRFGCTVWDGFGSTETAVII

SEQ ID NO: 765469 - protein, 18 aa, Mycobacterium
FSRSPVLASPFTIVNAPF

SEQ ID NO: 765470 - protein, 17 aa, Mycobacterium
FSRWRFVAFATDQKAST

SEQ ID NO: 765471 - protein, 22 aa, Mycobacterium
FSSDFFAAWGKFAATRTPTIAA

SEQ ID NO: 765472 - protein, 17 aa, Mycobacterium
FSSLCWGERIAFDNPDN

SEQ ID NO: 765473 - protein, 18 aa, Mycobacterium
FSSLCWGERIAFDNPDNL

SEQ ID NO: 765474 - protein, 18 aa, Mycobacterium
FSSLCWGERIAFDNPESL

SEQ ID NO: 765475 - protein, 17 aa, Mycobacterium
FSSLGGWLATRAGGHFA

SEQ ID NO: 765476 - protein, 20 aa, Mycobacterium
FSTEEFVFYQGLPRHAYVSG

SEQ ID NO: 765477 - protein, 19 aa, Mycobacterium
FSTRLLAFALLGLFTGHPY

SEQ ID NO: 765478 - protein, 19 aa, Mycobacterium
FSVLPAWRGAAPVQAALAA

SEQ ID NO: 765479 - protein, 17 aa, Mycobacterium
FSVPVSGEALGFKSDAN

SEQ ID NO: 765480 - protein, 20 aa, Mycobacterium
FSVRMKHEFYSLVERHQDGT

SEQ ID NO: 765481 - protein, 18 aa, Mycobacterium
FSVWELWGPLLYGGCVVM

SEQ ID NO: 765482 - protein, 25 aa, Mycobacterium
FTAAFMVATAWEWELADRLRLASAC

SEQ ID NO: 765483 - protein, 19 aa, Mycobacterium
FTAGYNWPLLQASGLTTIT

SEQ ID NO: 765484 - protein, 17 aa, Mycobacterium
FTARFGVPLPRGLREEA

SEQ ID NO: 765485 - protein, 17 aa, Mycobacterium
FTASLGWYRAGAGTVAQ

SEQ ID NO: 765486 - protein, 18 aa, Mycobacterium
FTAYCGFDVLAHGSEPFV

SEQ ID NO: 765487 - protein, 17 aa, Mycobacterium
FTCFYLRAGELIAADCI

SEQ ID NO: 765488 - protein, 17 aa, Mycobacterium
FTCFYLRAGELLAADCI

SEQ ID NO: 765489 - protein, 23 aa, Mycobacterium
FTDPLRADWLWRVVGEQAHVAVV

SEQ ID NO: 765490 - protein, 17 aa, Mycobacterium
FTEGVGFDKGFLSAYFV

SEQ ID NO: 765491 - protein, 18 aa, Mycobacterium
FTEGVGFDKGFLSAYFVT

SEQ ID NO: 765492 - protein, 25 aa, Mycobacterium
FTELCARAGLDLALDCAPALADVDP

SEQ ID NO: 765493 - protein, 18 aa, Mycobacterium
FTELSRWVGRHISETGGF

SEQ ID NO: 765494 - protein, 22 aa, Mycobacterium
FTEPHIVRWEIADGFAHSADLP

SEQ ID NO: 765495 - protein, 19 aa, Mycobacterium
FTFGTGNIIAGVGGDGGTG

SEQ ID NO: 765496 - protein, 17 aa, Mycobacterium
FTGCHGLMLLSIRAGVT

SEQ ID NO: 765497 - protein, 19 aa, Mycobacterium
FTGDCLFPGGPGRTTRPED

SEQ ID NO: 765498 - protein, 20 aa, Mycobacterium
FTGDCLFPGGPGRTTRPEDF

SEQ ID NO: 765499 - protein, 21 aa, Mycobacterium
FTGDCLFPGGVGKTWKEGDFE

SEQ ID NO: 765500 - protein, 21 aa, Mycobacterium
FTGDCLFPGGVGKTWKPGDFE

SEQ ID NO: 765501 - protein, 17 aa, Mycobacterium
FTGTGLKGWINRWFYSV

SEQ ID NO: 765502 - protein, 26 aa, Mycobacterium
FTHAVSLAEAWRCCGVLPDITIGHSL

SEQ ID NO: 765503 - protein, 22 aa, Mycobacterium
FTIRRLRFADGVPLSVDLACFV

SEQ ID NO: 765504 - protein, 17 aa, Mycobacterium
FTLDGLGGWFIDGIDGD

SEQ ID NO: 765505 - protein, 20 aa, Mycobacterium
FTLELKQLWNDLGRPAMPKR

SEQ ID NO: 765506 - protein, 22 aa, Mycobacterium
FTLPPAKFGEKWRTVVYTGARQ

SEQ ID NO: 765507 - protein, 25 aa, Mycobacterium
FTLPSLFGVGLMPSFQLGTAPGANT

SEQ ID NO: 765508 - protein, 19 aa, Mycobacterium
FTLWVLRVSRVRWVGGYGR

SEQ ID NO: 765509 - protein, 17 aa, Mycobacterium
FTPALADLVRRGVVTGR

SEQ ID NO: 765510 - protein, 22 aa, Mycobacterium
FTPRMREVIILRVAHLQDSPYE

SEQ ID NO: 765511 - protein, 17 aa, Mycobacterium
FTPRPVPTVGLSHLHIP

SEQ ID NO: 765512 - protein, 19 aa, Mycobacterium
FTQDCPRQALVLPLSENPA

SEQ ID NO: 765513 - protein, 18 aa, Mycobacterium
FTQHYYRPVGFDDGGVLP

SEQ ID NO: 765514 - protein, 17 aa, Mycobacterium
FTQRFAVHVTRIPLVIV

SEQ ID NO: 765515 - protein, 18 aa, Mycobacterium
FTRFAGAPPRRWLAEEFR

SEQ ID NO: 765516 - protein, 17 aa, Mycobacterium
FTRSMAIEWARDNIQVN

SEQ ID NO: 765517 - protein, 17 aa, Mycobacterium
FTSAVAMSRCDDKRQTR

SEQ ID NO: 765518 - protein, 29 aa, Mycobacterium
FTTAAKIAVTWRLPVVFVVENIRGGPDAR

SEQ ID NO: 765519 - protein, 17 aa, Mycobacterium
FTTARSWLSQWGLDTAQ

SEQ ID NO: 765520 - protein, 18 aa, Mycobacterium
FTTIAWRLAHVIVGVLAM

SEQ ID NO: 765521 - protein, 18 aa, Mycobacterium
FTTPMEWQQRLWPTEEFE

SEQ ID NO: 765522 - protein, 17 aa, Mycobacterium
FTTTVAMPEVPRADSVP

SEQ ID NO: 765523 - protein, 17 aa, Mycobacterium
FTVLMDREWKYGVAAAV

SEQ ID NO: 765524 - protein, 20 aa, Mycobacterium
FTVPEFRRKAVIIAVGGIYD

SEQ ID NO: 765525 - protein, 20 aa, Mycobacterium
FTVPEFRRKAVIIAVGGVYD

SEQ ID NO: 765526 - protein, 26 aa, Mycobacterium
FTWNMPELWRRFTITLRRTLRRELRA

SEQ ID NO: 765527 - protein, 19 aa, Mycobacterium
FTWVVDWPMFESAAEATAS

SEQ ID NO: 765528 - protein, 18 aa, Mycobacterium
FTYRFSVPNAGTYWAHPH

SEQ ID NO: 765529 - protein, 18 aa, Mycobacterium
FTYRFSVPNSGTYWAHPH

SEQ ID NO: 765530 - protein, 24 aa, Mycobacterium
FTYRPEYRGALQLVPGAQTIALAP

SEQ ID NO: 765531 - protein, 19 aa, Mycobacterium
FVACPFGAAGLRMYRTGDL

SEQ ID NO: 765532 - protein, 22 aa, Mycobacterium
FVACPFGAPGTRMYRTGDLVSW

SEQ ID NO: 765533 - protein, 19 aa, Mycobacterium
FVALKGAAVLLTFQRVADH

SEQ ID NO: 765534 - protein, 17 aa, Mycobacterium
FVCPSIYEPLGIVNLEA

SEQ ID NO: 765535 - protein, 18 aa, Mycobacterium
FVCPSVYEPLGIVNLEAM

SEQ ID NO: 765536 - protein, 17 aa, Mycobacterium
FVDHAWHGVSGVLADFD

SEQ ID NO: 765537 - protein, 17 aa, Mycobacterium
FVDKCVDGLVANEDHLR

SEQ ID NO: 765538 - protein, 24 aa, Mycobacterium
FVDSMATSAWQWADRARQGVETLI

SEQ ID NO: 765539 - protein, 18 aa, Mycobacterium
FVEETGRTPMQWITDQRV

SEQ ID NO: 765540 - protein, 17 aa, Mycobacterium
FVEMWNRAAGVMESYAS

SEQ ID NO: 765541 - protein, 18 aa, Mycobacterium
FVEVAARVNTLLDIAQAN

SEQ ID NO: 765542 - protein, 19 aa, Mycobacterium
FVEVHWSRWGEAYVTPVEP

SEQ ID NO: 765543 - protein, 19 aa, Mycobacterium
FVFGEMWLRPNLGMKERRL

SEQ ID NO: 765544 - protein, 17 aa, Mycobacterium
FVFGVGAGWNIEELRDH

SEQ ID NO: 765545 - protein, 17 aa, Mycobacterium
FVGAITVPPTWQGSMPV

SEQ ID NO: 765546 - protein, 20 aa, Mycobacterium
FVGRLRLLWRGFDGGQDVRR

SEQ ID NO: 765547 - protein, 20 aa, Mycobacterium
FVGRLRLLWRGFDGGQEARE

SEQ ID NO: 765548 - protein, 20 aa, Mycobacterium
FVGRLRLLWRGFDGGQQARE

SEQ ID NO: 765549 - protein, 19 aa, Mycobacterium
FVGTEWQLGLLIRIDGPVD

SEQ ID NO: 765550 - protein, 25 aa, Mycobacterium
FVHSLTRAGAAYAAAEAVNASPLQT

SEQ ID NO: 765551 - protein, 18 aa, Mycobacterium
FVILNWRAVCGVCRACKR

SEQ ID NO: 765552 - protein, 18 aa, Mycobacterium
FVLLLVVHHICWDDDSWK

SEQ ID NO: 765553 - protein, 17 aa, Mycobacterium
FVLYWSFLAFALVRGGR

SEQ ID NO: 765554 - protein, 23 aa, Mycobacterium
FVNPRLPAGTAYVCQAGNVGTIG

SEQ ID NO: 765555 - protein, 23 aa, Mycobacterium
FVNRRMGVALAFADDVDTARRNA

SEQ ID NO: 765556 - protein, 17 aa, Mycobacterium
FVNRWKNILLAVAQYRL

SEQ ID NO: 765557 - protein, 17 aa, Mycobacterium
FVNSRPKPLAAYLFTKA

SEQ ID NO: 765558 - protein, 26 aa, Mycobacterium
FVQALSRAASRYAATEVANVEQNLLG

SEQ ID NO: 765559 - protein, 19 aa, Mycobacterium
FVRALDIGAGAYWATEVAN

SEQ ID NO: 765560 - protein, 20 aa, Mycobacterium
FVRQRHGLPRGDLDRVTRQQ

SEQ ID NO: 765561 - protein, 20 aa, Mycobacterium
FVRTRWELEECLALVDASPL

SEQ ID NO: 765562 - protein, 20 aa, Mycobacterium
FVRTRWELEECLSLVDASPL

SEQ ID NO: 765563 - protein, 18 aa, Mycobacterium
FVSGLSLNLAVMVRQPED

SEQ ID NO: 765564 - protein, 19 aa, Mycobacterium
FVSSPGYEHAWLNPDNTEV

SEQ ID NO: 765565 - protein, 17 aa, Mycobacterium
FVSTWKVFEEFARDGRA

SEQ ID NO: 765566 - protein, 18 aa, Mycobacterium
FVTMKLPSSMVFDGKDGS

SEQ ID NO: 765567 - protein, 20 aa, Mycobacterium
FVVKTVVGLLDWGLDPQQAV

SEQ ID NO: 765568 - protein, 18 aa, Mycobacterium
FVVLDGLAKPGRLAGPDP

SEQ ID NO: 765569 - protein, 18 aa, Mycobacterium
FVVLDGLGRPGRLVGPDP

SEQ ID NO: 765570 - protein, 17 aa, Mycobacterium
FVVPSRGLIGWRTDFLT

SEQ ID NO: 765571 - protein, 17 aa, Mycobacterium
FWAAVILDFAGVPANMM

SEQ ID NO: 765572 - protein, 17 aa, Mycobacterium
FWAFDLLFLDGRSLLRA

SEQ ID NO: 765573 - protein, 21 aa, Mycobacterium
FWAFRRGEFQLSYTTERADHH

SEQ ID NO: 765574 - protein, 23 aa, Mycobacterium
FWASWCGPCRAFAPTFQASSEAH

SEQ ID NO: 765575 - protein, 24 aa, Mycobacterium
FWASWCGPCRAFGPVYERSSEAHP

SEQ ID NO: 765576 - protein, 24 aa, Mycobacterium
FWASWCGPCRQFGPVFEASSEANP

SEQ ID NO: 765577 - protein, 24 aa, Mycobacterium
FWASWCGPCRSFAPTFQASSEKHP

SEQ ID NO: 765578 - protein, 24 aa, Mycobacterium
FWASYCRPCHAFAPTYERSAQAHP

SEQ ID NO: 765579 - protein, 21 aa, Mycobacterium
FWATWCGPCKMVAPVLEEIAK

SEQ ID NO: 765580 - protein, 18 aa, Mycobacterium
FWERVGIDPIRIMMTGET

SEQ ID NO: 765581 - protein, 24 aa, Mycobacterium
FWFDPLCPWAWITSRWILEVEKVR

SEQ ID NO: 765582 - protein, 24 aa, Mycobacterium
FWFDPLCPWAWITSRWVLEAEKVR

SEQ ID NO: 765583 - protein, 27 aa, Mycobacterium
FWFDPLCPWCWITSRWILEVEKVRDIE

SEQ ID NO: 765584 - protein, 19 aa, Mycobacterium
FWGGLRIGWIRAERSTLAT

SEQ ID NO: 765585 - protein, 17 aa, Mycobacterium
FWHLGAPCPPAIKQAWI

SEQ ID NO: 765586 - protein, 18 aa, Mycobacterium
FWPIPRVYSGLVRIDRHA

SEQ ID NO: 765587 - protein, 22 aa, Mycobacterium
FWPRRLRRSSFYWKLVAYDQRY

SEQ ID NO: 765588 - protein, 17 aa, Mycobacterium
FWPWLAYSGAILRGTKL

SEQ ID NO: 765589 - protein, 20 aa, Mycobacterium
FWQREFDILVCTTIVETGLD

SEQ ID NO: 765590 - protein, 26 aa, Mycobacterium
FWRADDRGQFGFDFGITMPGIPLNIG

SEQ ID NO: 765591 - protein, 19 aa, Mycobacterium
FWSEMPELFAALDADPEVR

SEQ ID NO: 765592 - protein, 22 aa, Mycobacterium
FYAELLKGLGLDGADLPAQNDI

SEQ ID NO: 765593 - protein, 18 aa, Mycobacterium
FYAPRLADMYNEWLDEGF

SEQ ID NO: 765594 - protein, 18 aa, Mycobacterium
FYCGTHLPANNPIDHVLP

SEQ ID NO: 765595 - protein, 20 aa, Mycobacterium
FYDGAVFHRVIRGFMIQGGD

SEQ ID NO: 765596 - protein, 17 aa, Mycobacterium
FYEAIGFTEAKRLTLPD

SEQ ID NO: 765597 - protein, 17 aa, Mycobacterium
FYGAGLINWWDPDGARR

SEQ ID NO: 765598 - protein, 17 aa, Mycobacterium
FYGHYWRQGSPKHRHDW

SEQ ID NO: 765599 - protein, 18 aa, Mycobacterium
FYIRDVLLDWGRDDPNHL

SEQ ID NO: 765600 - protein, 23 aa, Mycobacterium
FYLACAPALFGPICGALGAQGLV

SEQ ID NO: 765601 - protein, 18 aa, Mycobacterium
FYLMRAIDGWSPMDGGWP

SEQ ID NO: 765602 - protein, 19 aa, Mycobacterium
FYLPLVVRRRITFLAKAEY

SEQ ID NO: 765603 - protein, 23 aa, Mycobacterium
FYPDMPSRFAVIPRRGLSGDIRW

SEQ ID NO: 765604 - protein, 23 aa, Mycobacterium
FYPDMPSRFAVIPRRGSTADIRW

SEQ ID NO: 765605 - protein, 26 aa, Mycobacterium
FYRLAQTLLWQWMWDRITAAATDRAQ

SEQ ID NO: 765606 - protein, 17 aa, Mycobacterium
FYRRLRETAPVWPVGDS

SEQ ID NO: 765607 - protein, 17 aa, Mycobacterium
FYSGFYLPMYWSSRAKL

SEQ ID NO: 765608 - protein, 24 aa, Mycobacterium
GAAACARLALEPGLSPADAAGTWS

SEQ ID NO: 765609 - protein, 19 aa, Mycobacterium
GAAAGLWNPLAAAFPGGVL

SEQ ID NO: 765610 - protein, 18 aa, Mycobacterium
GAAALGFPGTAGKEAAGE

SEQ ID NO: 765611 - protein, 24 aa, Mycobacterium
GAADLPDRWWNFLALANAIAGGLF

SEQ ID NO: 765612 - protein, 24 aa, Mycobacterium
GAAESRPALMLSWIRDVPALGAAA

SEQ ID NO: 765613 - protein, 17 aa, Mycobacterium
GAAGCWRIEAGTYTVAV

SEQ ID NO: 765614 - protein, 18 aa, Mycobacterium
GAAGDLWSLCQIYSHQAT

SEQ ID NO: 765615 - protein, 18 aa, Mycobacterium
GAAGGWLLGDGGAGGSGA

SEQ ID NO: 765616 - protein, 18 aa, Mycobacterium
GAAGGWLLGNGGAGGSGA

SEQ ID NO: 765617 - protein, 19 aa, Mycobacterium
GAAGLFGRGGAGGAGGAGT

SEQ ID NO: 765618 - protein, 19 aa, Mycobacterium
GAAGSAWRSLAAVPTVATA

SEQ ID NO: 765619 - protein, 22 aa, Mycobacterium
GAAHPACAAVAKQPRTSTATPA

SEQ ID NO: 765620 - protein, 19 aa, Mycobacterium
GAAIKEMVCKGTLSILATA

SEQ ID NO: 765621 - protein, 21 aa, Mycobacterium
GAAIPACAAVAAGTDGLAASA

SEQ ID NO: 765622 - protein, 25 aa, Mycobacterium
GAAKWSLKIAREWSGERVQWGKPLG

SEQ ID NO: 765623 - protein, 20 aa, Mycobacterium
GAALIKVCVSGGVMSLTGEA

SEQ ID NO: 765624 - protein, 25 aa, Mycobacterium
GAALLAGPGRLVWTRVAGDVLDVAL

SEQ ID NO: 765625 - protein, 24 aa, Mycobacterium
GAALPDKFEQMWGYIYEQNIAPIY

SEQ ID NO: 765626 - protein, 18 aa, Mycobacterium
GAALPFKRRLFGQIVAAA

SEQ ID NO: 765627 - protein, 24 aa, Mycobacterium
GAALTWPAGWSVWPERVYGDTRLE

SEQ ID NO: 765628 - protein, 21 aa, Mycobacterium
GAANFKAGPLLAFSGGHLCYQ

SEQ ID NO: 765629 - protein, 19 aa, Mycobacterium
GAAPGGFDCSGLVMWAFQQ

SEQ ID NO: 765630 - protein, 23 aa, Mycobacterium
GAAPRLRAAAAWFTLLKQERRRR

SEQ ID NO: 765631 - protein, 17 aa, Mycobacterium
GAAPRYLGVPGEDTLLG

SEQ ID NO: 765632 - protein, 18 aa, Mycobacterium
GAARLPSRYVIGMLAVGR

SEQ ID NO: 765633 - protein, 18 aa, Mycobacterium
GAAYACFTPSPSLGIPAL

SEQ ID NO: 765634 - protein, 22 aa, Mycobacterium
GAAYPRPGLRGKFYDARARPLV

SEQ ID NO: 765635 - protein, 18 aa, Mycobacterium
GACAGCGETPYLKLLSQL

SEQ ID NO: 765636 - protein, 18 aa, Mycobacterium
GACAMGADSFAAVNDVTG

SEQ ID NO: 765637 - protein, 18 aa, Mycobacterium
GACRQCLVEVEGQRKPLA

SEQ ID NO: 765638 - protein, 19 aa, Mycobacterium
GACWRPELAAMFNQGAVTD

SEQ ID NO: 765639 - protein, 17 aa, Mycobacterium
GADALWLADRGWQVVAV

SEQ ID NO: 765640 - protein, 21 aa, Mycobacterium
GADCGRCRHTIRAILGARRGG

SEQ ID NO: 765641 - protein, 30 aa, Mycobacterium
GADEVSAVIAALFGTHALEYQAISTQLSVF

SEQ ID NO: 765642 - protein, 25 aa, Mycobacterium
GADEVSVGIAALFTDHAQQYDVVLR

SEQ ID NO: 765643 - protein, 18 aa, Mycobacterium
GADGEWPLFLDVWVEHVV

SEQ ID NO: 765644 - protein, 17 aa, Mycobacterium
GADGEWSRAAVLFRDAA

SEQ ID NO: 765645 - protein, 18 aa, Mycobacterium
GADGLGGAAFDGARGADG

SEQ ID NO: 765646 - protein, 22 aa, Mycobacterium
GADGTAGGWLLGDGGAGGSSTA

SEQ ID NO: 765647 - protein, 22 aa, Mycobacterium
GADGTAGGWLLGNGGAGGSGAD

SEQ ID NO: 765648 - protein, 18 aa, Mycobacterium
GADGWRLDAAYAVPDRFW

SEQ ID NO: 765649 - protein, 18 aa, Mycobacterium
GADIILFDICHDIETNEY

SEQ ID NO: 765650 - protein, 20 aa, Mycobacterium
GADLQQCWRQYVAGEVTEYP

SEQ ID NO: 765651 - protein, 24 aa, Mycobacterium
GADRCLRVAWTLADLAGRTSPTVE

SEQ ID NO: 765652 - protein, 17 aa, Mycobacterium
GADRTAAMLAEIQGLLR

SEQ ID NO: 765653 - protein, 24 aa, Mycobacterium
GADVLPWWPVLGVVLLLERETHRN

SEQ ID NO: 765654 - protein, 24 aa, Mycobacterium
GADWPRLVAPVFEPKKAVLFDDRW

SEQ ID NO: 765655 - protein, 23 aa, Mycobacterium
GAEAFATPGYRGWAAHARGAVLV

SEQ ID NO: 765656 - protein, 24 aa, Mycobacterium
GAEGWPVTVSYDFDAELPAADAVL

SEQ ID NO: 765657 - protein, 19 aa, Mycobacterium
GAEIRPCIACLQSCAGGLN

SEQ ID NO: 765658 - protein, 23 aa, Mycobacterium
GAELFPRMRIPQAWYDAGIAVRA

SEQ ID NO: 765659 - protein, 22 aa, Mycobacterium
GAEPRLTFEVIEVLRSGEPTVL

SEQ ID NO: 765660 - protein, 18 aa, Mycobacterium
GAERAVWVGHDWGAVVVW

SEQ ID NO: 765661 - protein, 18 aa, Mycobacterium
GAEYLRWLADNDYPLAPV

SEQ ID NO: 765662 - protein, 19 aa, Mycobacterium
GAFGDMWRSDLAAAFGREP

SEQ ID NO: 765663 - protein, 17 aa, Mycobacterium
GAFHVMRPAWRIMREQR

SEQ ID NO: 765664 - protein, 18 aa, Mycobacterium
GAFHVVRPAFGLMCDQLY

SEQ ID NO: 765665 - protein, 20 aa, Mycobacterium
GAFLRAGVVNRILVYVAPML

SEQ ID NO: 765666 - protein, 18 aa, Mycobacterium
GAGAIGFGGTAAKGNADA

SEQ ID NO: 765667 - protein, 19 aa, Mycobacterium
GAGALRFIRSCSAPLTAET

SEQ ID NO: 765668 - protein, 26 aa, Mycobacterium
GAGAPGIDGAALGEGGTNGYIGGNGG

SEQ ID NO: 765669 - protein, 22 aa, Mycobacterium
GAGCVPCSSMGRLFDAVASLLG

SEQ ID NO: 765670 - protein, 17 aa, Mycobacterium
GAGDWAMRELVVLHEVA

SEQ ID NO: 765671 - protein, 17 aa, Mycobacterium
GAGEHWALLGPNGAGKS

SEQ ID NO: 765672 - protein, 20 aa, Mycobacterium
GAGFPRRWWWGQAHDFGDAD

SEQ ID NO: 765673 - protein, 23 aa, Mycobacterium
GAGGAAGWWGRGGIGGQGGTGGE

SEQ ID NO: 765674 - protein, 21 aa, Mycobacterium
GAGGAARLWGTGGHGGSGGAG

SEQ ID NO: 765675 - protein, 18 aa, Mycobacterium
GAGGAGWDADAVGATGGN

SEQ ID NO: 765676 - protein, 19 aa, Mycobacterium
GAGGAGWDATAAGVLAATG

SEQ ID NO: 765677 - protein, 32 aa, Mycobacterium
GAGGDGGRGGWLLGIGGSGGFGGFGQGPSGGI

SEQ ID NO: 765678 - protein, 18 aa, Mycobacterium
GAGGEGFLTGGAGGKGGN

SEQ ID NO: 765679 - protein, 25 aa, Mycobacterium
GAGGMGGSGGWLLGNGGAGGAGGVG

SEQ ID NO: 765680 - protein, 23 aa, Mycobacterium
GAGGNGGDAYVFGNGQPGGSGGA

SEQ ID NO: 765681 - protein, 21 aa, Mycobacterium
GAGGPGLFGFNGGAGGAGGAG

SEQ ID NO: 765682 - protein, 20 aa, Mycobacterium
GAGGRAGLAIGGGGAGGAGG

SEQ ID NO: 765683 - protein, 18 aa, Mycobacterium
GAGGRGGLFYGAGGAGGD

SEQ ID NO: 765684 - protein, 20 aa, Mycobacterium
GAGGRGGWLVGGGGAGGSAG

SEQ ID NO: 765685 - protein, 22 aa, Mycobacterium
GAGGSAGLWGHGGNGGIGGAGG

SEQ ID NO: 765686 - protein, 21 aa, Mycobacterium
GAGLARYAHRLGMTVVLADVD

SEQ ID NO: 765687 - protein, 17 aa, Mycobacterium
GAGLDWKTSLQELTAAR

SEQ ID NO: 765688 - protein, 18 aa, Mycobacterium
GAGLDWKTSLQELTAARG

SEQ ID NO: 765689 - protein, 17 aa, Mycobacterium
GAGLDWKTSLQELTASR

SEQ ID NO: 765690 - protein, 19 aa, Mycobacterium
GAGNRGNGNFGFGNSQATG

SEQ ID NO: 765691 - protein, 23 aa, Mycobacterium
GAGNYTFPLGMETGWWATAPTLI

SEQ ID NO: 765692 - protein, 19 aa, Mycobacterium
GAGPLRLFGHRGVSNAHLR

SEQ ID NO: 765693 - protein, 22 aa, Mycobacterium
GAGPRPLISYAPGTQGQGNQCA

SEQ ID NO: 765694 - protein, 18 aa, Mycobacterium
GAGPRYGFRVTVMARPPF

SEQ ID NO: 765695 - protein, 20 aa, Mycobacterium
GAGRGFCSGAGIGADDVSGT

SEQ ID NO: 765696 - protein, 20 aa, Mycobacterium
GAGRWGTKLIRAFLAQGAAP

SEQ ID NO: 765697 - protein, 20 aa, Mycobacterium
GAGSFPWVLAITSPYTDAAH

SEQ ID NO: 765698 - protein, 19 aa, Mycobacterium
GAGSSPGFLSPAGNGGAGG

SEQ ID NO: 765699 - protein, 18 aa, Mycobacterium
GAGTLGFAGAEHSEGLVE

SEQ ID NO: 765700 - protein, 19 aa, Mycobacterium
GAGYCYRSYPQLFAAAADG

SEQ ID NO: 765701 - protein, 21 aa, Mycobacterium
GAHQARWALLVARSNPDVAKH

SEQ ID NO: 765702 - protein, 18 aa, Mycobacterium
GAHYECWTMLGAWAEQTS

SEQ ID NO: 765703 - protein, 18 aa, Mycobacterium
GAIAAAFEVARPGLDALQ

SEQ ID NO: 765704 - protein, 17 aa, Mycobacterium
GAIAARGPVMARLRAAS

SEQ ID NO: 765705 - protein, 18 aa, Mycobacterium
GAIAGEWQGQIRLIADAL

SEQ ID NO: 765706 - protein, 18 aa, Mycobacterium
GAIAGEWQGQIRLVADAL

SEQ ID NO: 765707 - protein, 19 aa, Mycobacterium
GAIANWRLFSILLRSLNIP

SEQ ID NO: 765708 - protein, 17 aa, Mycobacterium
GAIFAYWVANPSAYGVV

SEQ ID NO: 765709 - protein, 23 aa, Mycobacterium
GAIFRFGLPPFKWWQGLQGRKLL

SEQ ID NO: 765710 - protein, 22 aa, Mycobacterium
GAIGTPGGWLLGDGGAGGSGAP

SEQ ID NO: 765711 - protein, 17 aa, Mycobacterium
GAIILHPYIELYLGESF

SEQ ID NO: 765712 - protein, 18 aa, Mycobacterium
GAIPSMFEPGSPVLDRAG

SEQ ID NO: 765713 - protein, 17 aa, Mycobacterium
GAIRFVINGAVDPASPL

SEQ ID NO: 765714 - protein, 29 aa, Mycobacterium
GAIRYARKRGLPLLGLCLGLQCIVIEAAR

SEQ ID NO: 765715 - protein, 19 aa, Mycobacterium
GAIVKRPRIIIDEFGNESI

SEQ ID NO: 765716 - protein, 19 aa, Mycobacterium
GAIVKRPRVIVDEFGNESI

SEQ ID NO: 765717 - protein, 18 aa, Mycobacterium
GAIVKRPRVIVDEYGNES

SEQ ID NO: 765718 - protein, 23 aa, Mycobacterium
GAKMVTAVACARVPKLTIVIGGS

SEQ ID NO: 765719 - protein, 17 aa, Mycobacterium
GAKPAQVALAWLISYPG

SEQ ID NO: 765720 - protein, 17 aa, Mycobacterium
GALDIAVVYAFLQQSLP

SEQ ID NO: 765721 - protein, 20 aa, Mycobacterium
GALGVIPGVQGEYGGAANGI

SEQ ID NO: 765722 - protein, 19 aa, Mycobacterium
GALHSWCLAAARPDLVTAV

SEQ ID NO: 765723 - protein, 19 aa, Mycobacterium
GALICTRAATDTARTAGPA

SEQ ID NO: 765724 - protein, 18 aa, Mycobacterium
GALIGFLGPRVYELLYDE

SEQ ID NO: 765725 - protein, 23 aa, Mycobacterium
GALKNVFAIAVGMGYSLGIGENT

SEQ ID NO: 765726 - protein, 24 aa, Mycobacterium
GALKNVFAIAVGMGYSLGIGENTR

SEQ ID NO: 765727 - protein, 19 aa, Mycobacterium
GALLTRLVTDLGLTVHTSV

SEQ ID NO: 765728 - protein, 17 aa, Mycobacterium
GALNWTAAPVQLPDMPP

SEQ ID NO: 765729 - protein, 19 aa, Mycobacterium
GALQYRVLRAFNLAGPDAQ

SEQ ID NO: 765730 - protein, 17 aa, Mycobacterium
GALRLAIERALASDNQD

SEQ ID NO: 765731 - protein, 21 aa, Mycobacterium
GALRRSVKFPAFLDGIDAVRR

SEQ ID NO: 765732 - protein, 20 aa, Mycobacterium
GALSEWRATILVRETAYLAV

SEQ ID NO: 765733 - protein, 18 aa, Mycobacterium
GALSEWRATLIARESACL

SEQ ID NO: 765734 - protein, 24 aa, Mycobacterium
GALSEWRATLIVRESACLDVEDRR

SEQ ID NO: 765735 - protein, 20 aa, Mycobacterium
GALSEWRATLIVRESACLSV

SEQ ID NO: 765736 - protein, 19 aa, Mycobacterium
GALSRAVADFVLINVTGGI

SEQ ID NO: 765737 - protein, 20 aa, Mycobacterium
GALTPRIISLDVEYFGVMWP

SEQ ID NO: 765738 - protein, 19 aa, Mycobacterium
GALVGLAWVDARLVAAAVS

SEQ ID NO: 765739 - protein, 25 aa, Mycobacterium
GALWRFLPDRVRVLDFPTGFHYDFR

SEQ ID NO: 765740 - protein, 17 aa, Mycobacterium
GAMARLGVWSGDGPQLD

SEQ ID NO: 765741 - protein, 17 aa, Mycobacterium
GAMAVAIGGAWQAGWAP

SEQ ID NO: 765742 - protein, 19 aa, Mycobacterium
GAMEIDRLNVAIGLRERVN

SEQ ID NO: 765743 - protein, 17 aa, Mycobacterium
GAMGRLGVWSGDGPQLD

SEQ ID NO: 765744 - protein, 19 aa, Mycobacterium
GAMLPVLIFAAARAGVAFT

SEQ ID NO: 765745 - protein, 18 aa, Mycobacterium
GAMPLPFAGGSWVTWERG

SEQ ID NO: 765746 - protein, 17 aa, Mycobacterium
GAMRFARVEAYSKITGT

SEQ ID NO: 765747 - protein, 19 aa, Mycobacterium
GANIWQLLEQLGFPESGIA

SEQ ID NO: 765748 - protein, 22 aa, Mycobacterium
GANLRAAWLTMIAVASTHQGKG

SEQ ID NO: 765749 - protein, 19 aa, Mycobacterium
GANPLEWLDEKFIGYLEDR

SEQ ID NO: 765750 - protein, 20 aa, Mycobacterium
GANPWIMISAFHLKIDGCVG

SEQ ID NO: 765751 - protein, 21 aa, Mycobacterium
GAPAGWSWVAPYIGMIWPTGD

SEQ ID NO: 765752 - protein, 18 aa, Mycobacterium
GAPAMPSLGISAGSGGVG

SEQ ID NO: 765753 - protein, 23 aa, Mycobacterium
GAPAQFGSTGFAGGDGGAGGDGG

SEQ ID NO: 765754 - protein, 17 aa, Mycobacterium
GAPAWAVPETRLPNPQF

SEQ ID NO: 765755 - protein, 17 aa, Mycobacterium
GAPAWPYFEDVKIERLH

SEQ ID NO: 765756 - protein, 18 aa, Mycobacterium
GAPEELWDVLSLNDVPDD

SEQ ID NO: 765757 - protein, 18 aa, Mycobacterium
GAPGCWQPITRHLWPAPE

SEQ ID NO: 765758 - protein, 18 aa, Mycobacterium
GAPGGWLLGNGGAGGSGA

SEQ ID NO: 765759 - protein, 21 aa, Mycobacterium
GAPGTEVWTFTALNRGTTTIS

SEQ ID NO: 765760 - protein, 18 aa, Mycobacterium
GAPISRMWVRPFASDEAD

SEQ ID NO: 765761 - protein, 18 aa, Mycobacterium
GAPKLPAVIGFEVAGTIS

SEQ ID NO: 765762 - protein, 18 aa, Mycobacterium
GAPLARMEFRVVLEELFR

SEQ ID NO: 765763 - protein, 18 aa, Mycobacterium
GAPLCWQRRPTARDDAGL

SEQ ID NO: 765764 - protein, 25 aa, Mycobacterium
GAPLGYPSIYDGWHYGTGSPGTNLP

SEQ ID NO: 765765 - protein, 18 aa, Mycobacterium
GAPMPDWLAAALATAPPA

SEQ ID NO: 765766 - protein, 17 aa, Mycobacterium
GAPRGSVYYHFPDGRNQ

SEQ ID NO: 765767 - protein, 22 aa, Mycobacterium
GAPRLSGPMTFDITRLGRRPGA

SEQ ID NO: 765768 - protein, 17 aa, Mycobacterium
GAPRPVLRVAPLSVAGL

SEQ ID NO: 765769 - protein, 24 aa, Mycobacterium
GAPRRAAVCSYGYGGTIAHVLLEE

SEQ ID NO: 765770 - protein, 17 aa, Mycobacterium
GAPSWELDPLVWQRTLD

SEQ ID NO: 765771 - protein, 22 aa, Mycobacterium
GAPVWFVPEAFEFVLRAANDPE

SEQ ID NO: 765772 - protein, 27 aa, Mycobacterium
GAQAGRVGAPMPMGMPMGAAGAAAAGS

SEQ ID NO: 765773 - protein, 17 aa, Mycobacterium
GAQGAWTGSQWVMVEES

SEQ ID NO: 765774 - protein, 24 aa, Mycobacterium
GAQRFCPPRHWLEIGEFDDGTPTR

SEQ ID NO: 765775 - protein, 19 aa, Mycobacterium
GAQVPIIWLNWGTRSDRAN

SEQ ID NO: 765776 - protein, 19 aa, Mycobacterium
GAQVRFVWHEAGPITADSG

SEQ ID NO: 765777 - protein, 18 aa, Mycobacterium
GAQVRWASCNIFSTQDHA

SEQ ID NO: 765778 - protein, 23 aa, Mycobacterium
GARARFGDVLPFLVKVLAADEPL

SEQ ID NO: 765779 - protein, 23 aa, Mycobacterium
GARDWNWSTGRYWKIANPSRRNE

SEQ ID NO: 765780 - protein, 18 aa, Mycobacterium
GARFAFVCAVDMPGLTVD

SEQ ID NO: 765781 - protein, 17 aa, Mycobacterium
GARFRPVEMESLAHYPL

SEQ ID NO: 765782 - protein, 19 aa, Mycobacterium
GARFWYRIGTRYVAVDPGV

SEQ ID NO: 765783 - protein, 17 aa, Mycobacterium
GARGWAPQGFYFADPDG

SEQ ID NO: 765784 - protein, 24 aa, Mycobacterium
GARLSVVVSELWRAVALAEMMRDA

SEQ ID NO: 765785 - protein, 23 aa, Mycobacterium
GARMRWARCVSAPLLAGAFAVAK

SEQ ID NO: 765786 - protein, 24 aa, Mycobacterium
GARPWLAGVALDWVLDGAVRAGAA

SEQ ID NO: 765787 - protein, 19 aa, Mycobacterium
GARRARCSVSVRGRVLEII

SEQ ID NO: 765788 - protein, 25 aa, Mycobacterium
GARRPRIGIPMAVVYGFAYLADAIG

SEQ ID NO: 765789 - protein, 21 aa, Mycobacterium
GARSPRPATVWIAQDGSHRLV

SEQ ID NO: 765790 - protein, 18 aa, Mycobacterium
GARVPFRRVHLSTGDHFD

SEQ ID NO: 765791 - protein, 18 aa, Mycobacterium
GASGVGLGKAGGTGATGG

SEQ ID NO: 765792 - protein, 26 aa, Mycobacterium
GASGWCTAAPCLRPQPCIDLYEAVRA

SEQ ID NO: 765793 - protein, 24 aa, Mycobacterium
GASPRFLLDFSRRFPDATLVRLER

SEQ ID NO: 765794 - protein, 24 aa, Mycobacterium
GASPRFLLDFSRRFPDATVVRLER

SEQ ID NO: 765795 - protein, 23 aa, Mycobacterium
GASPRFLLDFSRRYPDATVVRLE

SEQ ID NO: 765796 - protein, 17 aa, Mycobacterium
GASPRWLALDGYQHSRR

SEQ ID NO: 765797 - protein, 24 aa, Mycobacterium
GASRFRLGRGIACTEAAMSTPDMY

SEQ ID NO: 765798 - protein, 19 aa, Mycobacterium
GASVATCPTGTTGTTVGTH

SEQ ID NO: 765799 - protein, 21 aa, Mycobacterium
GATAAQVALAWLLAKGPDIVP

SEQ ID NO: 765800 - protein, 17 aa, Mycobacterium
GATATLLQHRFWSAESG

SEQ ID NO: 765801 - protein, 18 aa, Mycobacterium
GATAWRAVVEYADTAGDR

SEQ ID NO: 765802 - protein, 20 aa, Mycobacterium
GATIAHGFLTLSLIPGVSKD

SEQ ID NO: 765803 - protein, 18 aa, Mycobacterium
GATLRFAPPLVITEGEID

SEQ ID NO: 765804 - protein, 17 aa, Mycobacterium
GATPSWECALAGLDQEC

SEQ ID NO: 765805 - protein, 18 aa, Mycobacterium
GATPSWECALGGLDQECG

SEQ ID NO: 765806 - protein, 18 aa, Mycobacterium
GATWSRWGQPLFPIGVLY

SEQ ID NO: 765807 - protein, 18 aa, Mycobacterium
GAVAFGYFEATGRWGDEP

SEQ ID NO: 765808 - protein, 18 aa, Mycobacterium
GAVAGIHLEGPWLSRARC

SEQ ID NO: 765809 - protein, 22 aa, Mycobacterium
GAVGGASGWLLGNGGAGGDGGA

SEQ ID NO: 765810 - protein, 18 aa, Mycobacterium
GAVGLNWYLTDPTLRSTV

SEQ ID NO: 765811 - protein, 24 aa, Mycobacterium
GAVKFPAERPELFDGDSDIQQDIE

SEQ ID NO: 765812 - protein, 18 aa, Mycobacterium
GAVRFIGVDGYRWMIRCV

SEQ ID NO: 765813 - protein, 17 aa, Mycobacterium
GAVTMPWLDRVSAVLES

SEQ ID NO: 765814 - protein, 17 aa, Mycobacterium
GAVWRVEGAYTFHALET

SEQ ID NO: 765815 - protein, 24 aa, Mycobacterium
GAWKNRPDTEFGYRAAELADDAPE

SEQ ID NO: 765816 - protein, 20 aa, Mycobacterium
GAWWVLRFNFGFPEHDMYTL

SEQ ID NO: 765817 - protein, 18 aa, Mycobacterium
GAYGSGLIPPARGGDGGN

SEQ ID NO: 765818 - protein, 20 aa, Mycobacterium
GAYLDWLFRYLVSALRTLPR

SEQ ID NO: 765819 - protein, 18 aa, Mycobacterium
GCADLHRSDRDAAWPAIC

SEQ ID NO: 765820 - protein, 19 aa, Mycobacterium
GCAGLRYNLFFDDRALDGD

SEQ ID NO: 765821 - protein, 19 aa, Mycobacterium
GCAGLRYNLFFDDRSLDGD

SEQ ID NO: 765822 - protein, 21 aa, Mycobacterium
GCAGLRYQLFFDDRTLDGDLT

SEQ ID NO: 765823 - protein, 18 aa, Mycobacterium
GCALHLVEPLGFDLSEPK

SEQ ID NO: 765824 - protein, 17 aa, Mycobacterium
GCAQLSAPIRYLGTDET

SEQ ID NO: 765825 - protein, 17 aa, Mycobacterium
GCARLSLQVTIQVRIPL

SEQ ID NO: 765826 - protein, 19 aa, Mycobacterium
GCDCPALACDIDHTIPYSA

SEQ ID NO: 765827 - protein, 17 aa, Mycobacterium
GCDHFRTNIAFLPDLQA

SEQ ID NO: 765828 - protein, 20 aa, Mycobacterium
GCDICKPTVASILASTSSDH

SEQ ID NO: 765829 - protein, 19 aa, Mycobacterium
GCGAVATGWCDACTDDLTV

SEQ ID NO: 765830 - protein, 18 aa, Mycobacterium
GCGGKVRPSIVWFGEMLP

SEQ ID NO: 765831 - protein, 20 aa, Mycobacterium
GCGMACPFCATGQGGLSRNL

SEQ ID NO: 765832 - protein, 17 aa, Mycobacterium
GCGTGFFLLNLIQAGVA

SEQ ID NO: 765833 - protein, 19 aa, Mycobacterium
GCGVSWNLLAGIGRIESGH

SEQ ID NO: 765834 - protein, 20 aa, Mycobacterium
GCIGCSLMADHIGNLAHLNA

SEQ ID NO: 765835 - protein, 18 aa, Mycobacterium
GCIQVCLNGGLTVAQAEA

SEQ ID NO: 765836 - protein, 18 aa, Mycobacterium
GCKRPGFHNGYLATFNRD

SEQ ID NO: 765837 - protein, 18 aa, Mycobacterium
GCMAAKFFTGLPMDGPDP

SEQ ID NO: 765838 - protein, 22 aa, Mycobacterium
GCPFAPRCPLAIDECTAAEPEL

SEQ ID NO: 765839 - protein, 21 aa, Mycobacterium
GCPYRCTFCGTGAMSAILGRN

SEQ ID NO: 765840 - protein, 21 aa, Mycobacterium
GCPYRCTFCGTGAMSAMLGRN

SEQ ID NO: 765841 - protein, 19 aa, Mycobacterium
GCQFPSKIVADYADRLTKV

SEQ ID NO: 765842 - protein, 18 aa, Mycobacterium
GCQTDIFAAIAPVAGALV

SEQ ID NO: 765843 - protein, 18 aa, Mycobacterium
GCRFAARCAHAFSKCTQP

SEQ ID NO: 765844 - protein, 23 aa, Mycobacterium
GCRGEVPLGMLIDLLAAHHGVDA

SEQ ID NO: 765845 - protein, 17 aa, Mycobacterium
GCRMGICHTCTRRKTAG

SEQ ID NO: 765846 - protein, 17 aa, Mycobacterium
GCRMGICHTCTRRKTSG

SEQ ID NO: 765847 - protein, 19 aa, Mycobacterium
GCRPSLAELDGFVRGLIAG

SEQ ID NO: 765848 - protein, 17 aa, Mycobacterium
GCTSLRLGIPILTANVA

SEQ ID NO: 765849 - protein, 18 aa, Mycobacterium
GDAAALWQAFDRHADGLD

SEQ ID NO: 765850 - protein, 18 aa, Mycobacterium
GDADSMGSAGATGGKGGN

SEQ ID NO: 765851 - protein, 21 aa, Mycobacterium
GDADWAQWVCRIHAKPDRIPQ

SEQ ID NO: 765852 - protein, 23 aa, Mycobacterium
GDAELPSWIGGTWNRSAVLRYGE

SEQ ID NO: 765853 - protein, 21 aa, Mycobacterium
GDAGGLLALNFAGNGGNAGQG

SEQ ID NO: 765854 - protein, 21 aa, Mycobacterium
GDANYAIPWGNSAYAGDGGYG

SEQ ID NO: 765855 - protein, 19 aa, Mycobacterium
GDAPLVWRAAARLGIGSDA

SEQ ID NO: 765856 - protein, 20 aa, Mycobacterium
GDARAGRLLAFEIDPTDSTS

SEQ ID NO: 765857 - protein, 20 aa, Mycobacterium
GDARGGAALSVREITGTPIL

SEQ ID NO: 765858 - protein, 20 aa, Mycobacterium
GDARGGAALSVREVTGQPIL

SEQ ID NO: 765859 - protein, 17 aa, Mycobacterium
GDARGGAALSVREVTGV

SEQ ID NO: 765860 - protein, 21 aa, Mycobacterium
GDARGGAALSVREVTGVPILF

SEQ ID NO: 765861 - protein, 22 aa, Mycobacterium
GDARLAALMRWRSELIDAGAVP

SEQ ID NO: 765862 - protein, 18 aa, Mycobacterium
GDAVGLPEARYVHLFVAR

SEQ ID NO: 765863 - protein, 19 aa, Mycobacterium
GDAVPDGFARISLGIEDTD

SEQ ID NO: 765864 - protein, 17 aa, Mycobacterium
GDAWRAGFLSARSAGLN

SEQ ID NO: 765865 - protein, 19 aa, Mycobacterium
GDCLFPGGVGKTWQPGDFT

SEQ ID NO: 765866 - protein, 17 aa, Mycobacterium
GDCSIYLAQHGWRVTAV

SEQ ID NO: 765867 - protein, 25 aa, Mycobacterium
GDDRVASLFLWHFVEEVEHRSSALI

SEQ ID NO: 765868 - protein, 25 aa, Mycobacterium
GDDRVASLFLWHFVEEVEHRSSALT

SEQ ID NO: 765869 - protein, 17 aa, Mycobacterium
GDEFVPFDAAADYRKYV

SEQ ID NO: 765870 - protein, 24 aa, Mycobacterium
GDEISAAVAACFEAQAEAYQTFGA

SEQ ID NO: 765871 - protein, 24 aa, Mycobacterium
GDEISAAVAALFGSYAQGYQSLSA

SEQ ID NO: 765872 - protein, 18 aa, Mycobacterium
GDELLAVCERLVKMTRKQ

SEQ ID NO: 765873 - protein, 24 aa, Mycobacterium
GDERVASLFLWHFVEEVEHRSSAL

SEQ ID NO: 765874 - protein, 25 aa, Mycobacterium
GDESRPAWPMIVFRTPKGWTGPDYI

SEQ ID NO: 765875 - protein, 28 aa, Mycobacterium
GDEVSAAIAALFSFHGQSYQTLGAQAEA

SEQ ID NO: 765876 - protein, 45 aa, Mycobacterium
GDEVSAAVTRMFGAYAQEFQTLSARMEQFHTDFVRALLTGAGAYS

SEQ ID NO: 765877 - protein, 17 aa, Mycobacterium
GDEVWNWTDELAQLPAL

SEQ ID NO: 765878 - protein, 23 aa, Mycobacterium
GDFDEACWLVFLATHFGFHRHNR

SEQ ID NO: 765879 - protein, 24 aa, Mycobacterium
GDFDRLREQFGFAGDDVLLGKCLT

SEQ ID NO: 765880 - protein, 17 aa, Mycobacterium
GDFGVKSGRGFYADYDG

SEQ ID NO: 765881 - protein, 21 aa, Mycobacterium
GDFNGGIAFARTFVDGIKDAG

SEQ ID NO: 765882 - protein, 26 aa, Mycobacterium
GDFPGGVVDLRFRFTLDGTYISRLTI

SEQ ID NO: 765883 - protein, 23 aa, Mycobacterium
GDFPSRWVYRTSPDFYEVKNFLV

SEQ ID NO: 765884 - protein, 18 aa, Mycobacterium
GDFPVLWPVLTRWADNDM

SEQ ID NO: 765885 - protein, 19 aa, Mycobacterium
GDFPVLWPVLTRWADNDMF

SEQ ID NO: 765886 - protein, 19 aa, Mycobacterium
GDFPWRPEPGYGRTSPVGS

SEQ ID NO: 765887 - protein, 20 aa, Mycobacterium
GDFYRDWARHGGIVSNGFLE

SEQ ID NO: 765888 - protein, 18 aa, Mycobacterium
GDGALLWGNGGAGGQGGT

SEQ ID NO: 765889 - protein, 21 aa, Mycobacterium
GDGGAGGFIIGTYGGNGGGAA

SEQ ID NO: 765890 - protein, 18 aa, Mycobacterium
GDGGHWGDGGGPGSGSRR

SEQ ID NO: 765891 - protein, 22 aa, Mycobacterium
GDGGLHLSSFVGPGGSGGDGGA

SEQ ID NO: 765892 - protein, 20 aa, Mycobacterium
GDGGRAGWLSGNAGAGGAGG

SEQ ID NO: 765893 - protein, 17 aa, Mycobacterium
GDGGRLGNGGTGGAGGA

SEQ ID NO: 765894 - protein, 18 aa, Mycobacterium
GDGGWLIGNGGNGGSGAP

SEQ ID NO: 765895 - protein, 18 aa, Mycobacterium
GDGMRWAMRHLPFYGRWY

SEQ ID NO: 765896 - protein, 18 aa, Mycobacterium
GDGNRGSNNFGFGNTNSG

SEQ ID NO: 765897 - protein, 21 aa, Mycobacterium
GDGRRWCDLFEQWLKIKDGLI

SEQ ID NO: 765898 - protein, 18 aa, Mycobacterium
GDGSFLWDSPPNTNVYIG

SEQ ID NO: 765899 - protein, 25 aa, Mycobacterium
GDGSRGDTPLGPFNVDGHSGGDGGR

SEQ ID NO: 765900 - protein, 22 aa, Mycobacterium
GDGTGCLRVRAGIPAGYYADHS

SEQ ID NO: 765901 - protein, 17 aa, Mycobacterium
GDGVVYWQVPKGSTLNS

SEQ ID NO: 765902 - protein, 17 aa, Mycobacterium
GDGWCPFAAPPGLAQTA

SEQ ID NO: 765903 - protein, 20 aa, Mycobacterium
GDGWRLAMDLLPYERSSCFW

SEQ ID NO: 765904 - protein, 18 aa, Mycobacterium
GDGWRLAMDLLPYERSTC

SEQ ID NO: 765905 - protein, 20 aa, Mycobacterium
GDGWRLAMDLLPYERSTCFW

SEQ ID NO: 765906 - protein, 21 aa, Mycobacterium
GDGWRLAMDLLPYERSTCFWQ

SEQ ID NO: 765907 - protein, 19 aa, Mycobacterium
GDIAFCFATGNGFVGDFAA

SEQ ID NO: 765908 - protein, 24 aa, Mycobacterium
GDIFFPRVFLRRGQFLPAGTVTLT

SEQ ID NO: 765909 - protein, 18 aa, Mycobacterium
GDIKIALFGNHAPKTVSN

SEQ ID NO: 765910 - protein, 19 aa, Mycobacterium
GDKGQPCWPDGVVGSLTHC

SEQ ID NO: 765911 - protein, 18 aa, Mycobacterium
GDKLAFAKGFMVRRDPDL

SEQ ID NO: 765912 - protein, 22 aa, Mycobacterium
GDKRGPLTVPIWYQYSPGGEPW

SEQ ID NO: 765913 - protein, 17 aa, Mycobacterium
GDLAVWDGHVAMIVGPN

SEQ ID NO: 765914 - protein, 21 aa, Mycobacterium
GDLDRAFAIACRMRTGNVTIN

SEQ ID NO: 765915 - protein, 23 aa, Mycobacterium
GDLFAGKVTEHFGRPVWTISQGP

SEQ ID NO: 765916 - protein, 17 aa, Mycobacterium
GDLGYRDTQGWIYLAGR

SEQ ID NO: 765917 - protein, 26 aa, Mycobacterium
GDLIKKLLPILAPIVLAYIGKQFSQQ

SEQ ID NO: 765918 - protein, 20 aa, Mycobacterium
GDLRAAFTWHMRAGTWLTNR

SEQ ID NO: 765919 - protein, 19 aa, Mycobacterium
GDLRLLFAFLADRGSALET

SEQ ID NO: 765920 - protein, 18 aa, Mycobacterium
GDLRSEAVIDRFDELLRP

SEQ ID NO: 765921 - protein, 17 aa, Mycobacterium
GDLTYYLDMGWEDCKVA

SEQ ID NO: 765922 - protein, 17 aa, Mycobacterium
GDLYKRLKWRQDGRTAT

SEQ ID NO: 765923 - protein, 23 aa, Mycobacterium
GDMAARIAHHLGYEVFAVDRIPE

SEQ ID NO: 765924 - protein, 18 aa, Mycobacterium
GDMARIWRGGCIIRAKFL

SEQ ID NO: 765925 - protein, 17 aa, Mycobacterium
GDMLMRWSDDLLPSNFH

SEQ ID NO: 765926 - protein, 20 aa, Mycobacterium
GDPACPLRCMVVAGAPVPRN

SEQ ID NO: 765927 - protein, 17 aa, Mycobacterium
GDPEVFAPLIANLSERD

SEQ ID NO: 765928 - protein, 21 aa, Mycobacterium
GDPGLLWRAAARLEIGAQAAT

SEQ ID NO: 765929 - protein, 17 aa, Mycobacterium
GDPLIALAWLARTTRKL

SEQ ID NO: 765930 - protein, 22 aa, Mycobacterium
GDPRLPEWRLMAARAVARRDEL

SEQ ID NO: 765931 - protein, 22 aa, Mycobacterium
GDPRLSAIRAWVALNVGLFDDA

SEQ ID NO: 765932 - protein, 20 aa, Mycobacterium
GDPRRARVTLRMLLTHTSGI

SEQ ID NO: 765933 - protein, 17 aa, Mycobacterium
GDPSMMWTRVRKLTPQI

SEQ ID NO: 765934 - protein, 17 aa, Mycobacterium
GDRCFKPTLARRMAQLF

SEQ ID NO: 765935 - protein, 21 aa, Mycobacterium
GDRGLSWLPFFHDMGLITALL

SEQ ID NO: 765936 - protein, 17 aa, Mycobacterium
GDRGRLALRRVAVRSGV

SEQ ID NO: 765937 - protein, 22 aa, Mycobacterium
GDRGVSWLPFFHDMGLITVLLT

SEQ ID NO: 765938 - protein, 23 aa, Mycobacterium
GDRLRLALDAALCAAVIGAPAPL

SEQ ID NO: 765939 - protein, 20 aa, Mycobacterium
GDRVAVGWFGFYCGSCYRCR

SEQ ID NO: 765940 - protein, 17 aa, Mycobacterium
GDRVQFGAGIRLHRRPG

SEQ ID NO: 765941 - protein, 24 aa, Mycobacterium
GDRWAYFCGCCWKRIRQMQDRAAE

SEQ ID NO: 765942 - protein, 19 aa, Mycobacterium
GDRWTLLIVRELLDGPQRY

SEQ ID NO: 765943 - protein, 20 aa, Mycobacterium
GDRWTLLVVRELLDGPRRYG

SEQ ID NO: 765944 - protein, 20 aa, Mycobacterium
GDRWYWHWDPRFISGTAAFP

SEQ ID NO: 765945 - protein, 19 aa, Mycobacterium
GDSRFPPAPAHSASRTTAS

SEQ ID NO: 765946 - protein, 22 aa, Mycobacterium
GDTCPYFPGVTYRDWKLPDPAG

SEQ ID NO: 765947 - protein, 18 aa, Mycobacterium
GDTFVGPRFGYLGRTQPV

SEQ ID NO: 765948 - protein, 17 aa, Mycobacterium
GDTGLDGLLGVPGSNGQ

SEQ ID NO: 765949 - protein, 19 aa, Mycobacterium
GDTRFVICLPLAAPAPTGP

SEQ ID NO: 765950 - protein, 17 aa, Mycobacterium
GDVARLLYTLGWHEVPA

SEQ ID NO: 765951 - protein, 19 aa, Mycobacterium
GDVDRVTLFRAWYSRRNFG

SEQ ID NO: 765952 - protein, 25 aa, Mycobacterium
GDVGRPDLLASIGFTREELAEKLYD

SEQ ID NO: 765953 - protein, 22 aa, Mycobacterium
GDVKRFRAFDNWEGDAATACEA

SEQ ID NO: 765954 - protein, 18 aa, Mycobacterium
GDVLLRYNFPAAGLTDDA

SEQ ID NO: 765955 - protein, 19 aa, Mycobacterium
GDVPPRIVAVARDFGAEQG

SEQ ID NO: 765956 - protein, 17 aa, Mycobacterium
GDWARHNWIPFSRFRGL

SEQ ID NO: 765957 - protein, 17 aa, Mycobacterium
GDWKIAVLRAYWDLPAM

SEQ ID NO: 765958 - protein, 25 aa, Mycobacterium
GDWPSFPLPLGDTWSSTRGDLLTVE

SEQ ID NO: 765959 - protein, 24 aa, Mycobacterium
GDYFKRGAIELAWALLTNSVADGG

SEQ ID NO: 765960 - protein, 24 aa, Mycobacterium
GDYFKRGAIELAWSLLTNGVAAGG

SEQ ID NO: 765961 - protein, 24 aa, Mycobacterium
GDYFKRGAIELAWTLLTNPVEEGG

SEQ ID NO: 765962 - protein, 23 aa, Mycobacterium
GDYFKRRAIELAWTLLTNSVEQG

SEQ ID NO: 765963 - protein, 19 aa, Mycobacterium
GEAAVSLFLAERGFTTVGL

SEQ ID NO: 765964 - protein, 17 aa, Mycobacterium
GEAEFLPLLRRLGRFLP

SEQ ID NO: 765965 - protein, 22 aa, Mycobacterium
GEAEGAFLFCSFVMALADHQQG

SEQ ID NO: 765966 - protein, 18 aa, Mycobacterium
GEAFRWWKHMVLSNPDSI

SEQ ID NO: 765967 - protein, 18 aa, Mycobacterium
GEAGFNIAGLFVGGPLSK

SEQ ID NO: 765968 - protein, 29 aa, Mycobacterium
GEAGPRISAALNRYADWAQEMARHADTVG

SEQ ID NO: 765969 - protein, 20 aa, Mycobacterium
GEAIGALLTRMGAQDTRLVW

SEQ ID NO: 765970 - protein, 19 aa, Mycobacterium
GEALFDYLRLMVLQCGAAD

SEQ ID NO: 765971 - protein, 17 aa, Mycobacterium
GEALLALYRHRGAVIDA

SEQ ID NO: 765972 - protein, 22 aa, Mycobacterium
GEARKSLTFALRFRAPDRTLTE

SEQ ID NO: 765973 - protein, 23 aa, Mycobacterium
GEARRFDVSPAWFAALGAGLTLP

SEQ ID NO: 765974 - protein, 17 aa, Mycobacterium
GEAVWNYNEIRAVVDPV

SEQ ID NO: 765975 - protein, 22 aa, Mycobacterium
GEAWRFLKELRLERGPLDTDEA

SEQ ID NO: 765976 - protein, 21 aa, Mycobacterium
GECSIEPWVFMNWRRASYYLY

SEQ ID NO: 765977 - protein, 19 aa, Mycobacterium
GEDFVRFAIAGSDGLDRTT

SEQ ID NO: 765978 - protein, 18 aa, Mycobacterium
GEEGRYLLAATFGNVHGV

SEQ ID NO: 765979 - protein, 17 aa, Mycobacterium
GEFKFYLDFYTKQSSHG

SEQ ID NO: 765980 - protein, 20 aa, Mycobacterium
GEFPDPGGGGGRGGSGGAAG

SEQ ID NO: 765981 - protein, 21 aa, Mycobacterium
GEFPDSAALFWEAISAESADQ

SEQ ID NO: 765982 - protein, 17 aa, Mycobacterium
GEFPILVAHDLACVLQC

SEQ ID NO: 765983 - protein, 17 aa, Mycobacterium
GEFSEPFIQLWDPSYTY

SEQ ID NO: 765984 - protein, 18 aa, Mycobacterium
GEFSEWQRLYLFSRSDTI

SEQ ID NO: 765985 - protein, 18 aa, Mycobacterium
GEGFRRWSPADIAEMNNR

SEQ ID NO: 765986 - protein, 18 aa, Mycobacterium
GEGGIRLHDVWRDGAYAY

SEQ ID NO: 765987 - protein, 17 aa, Mycobacterium
GEGPGVVLIPELPGLHP

SEQ ID NO: 765988 - protein, 23 aa, Mycobacterium
GEGPRFNGDWSLDDPRVNPIAGD

SEQ ID NO: 765989 - protein, 19 aa, Mycobacterium
GEGPRWFEGLLWFSDMLGE

SEQ ID NO: 765990 - protein, 17 aa, Mycobacterium
GEGQWALGYREPLNPNE

SEQ ID NO: 765991 - protein, 18 aa, Mycobacterium
GEHCQGWLPAKLGPDEIA

SEQ ID NO: 765992 - protein, 19 aa, Mycobacterium
GEHPSLCLLASWVSPGSPA

SEQ ID NO: 765993 - protein, 19 aa, Mycobacterium
GEIACSAWPAGAGALLSIS

SEQ ID NO: 765994 - protein, 20 aa, Mycobacterium
GEIFFDGKLCEFKDIRSSER

SEQ ID NO: 765995 - protein, 20 aa, Mycobacterium
GEIIYRFAVQAAQAINRFGT

SEQ ID NO: 765996 - protein, 21 aa, Mycobacterium
GEIPLGIFCRGSLARHMDAER

SEQ ID NO: 765997 - protein, 22 aa, Mycobacterium
GEIPRWGTPFAEQLALWEQAVN

SEQ ID NO: 765998 - protein, 22 aa, Mycobacterium
GEIRGGAMPRPERLRWYVYTDE

SEQ ID NO: 765999 - protein, 17 aa, Mycobacterium
GEITAEMAFIAAREGMP

SEQ ID NO: 766000 - protein, 17 aa, Mycobacterium
GEKALLLGNFVKRILDV

SEQ ID NO: 766001 - protein, 17 aa, Mycobacterium
GEKFVPFDAAADYRTYV

SEQ ID NO: 766002 - protein, 21 aa, Mycobacterium
GEKLGQPGLCWDEREQQHVDA

SEQ ID NO: 766003 - protein, 17 aa, Mycobacterium
GEKWVWAGAAVIYPEYT

SEQ ID NO: 766004 - protein, 19 aa, Mycobacterium
GELALAILVEQMRREGFEL

SEQ ID NO: 766005 - protein, 17 aa, Mycobacterium
GELCARGPYTIRGYFAA

SEQ ID NO: 766006 - protein, 20 aa, Mycobacterium
GELFAAMGMPGRWSVRPRDV

SEQ ID NO: 766007 - protein, 17 aa, Mycobacterium
GELGFTYDTGWYLQFRA

SEQ ID NO: 766008 - protein, 20 aa, Mycobacterium
GELICAAIVFAGPPQTPQTL

SEQ ID NO: 766009 - protein, 23 aa, Mycobacterium
GELIRLAGVLGCSLGRDRAEELA

SEQ ID NO: 766010 - protein, 17 aa, Mycobacterium
GELIVAVAMTEPGAGSD

SEQ ID NO: 766011 - protein, 19 aa, Mycobacterium
GELLPIMFGERVVGAFEQM

SEQ ID NO: 766012 - protein, 18 aa, Mycobacterium
GELLRLGSVLGIELGPDR

SEQ ID NO: 766013 - protein, 17 aa, Mycobacterium
GELMGGPVARWAEETDH

SEQ ID NO: 766014 - protein, 21 aa, Mycobacterium
GELPARAVISVAAYPPAADGT

SEQ ID NO: 766015 - protein, 21 aa, Mycobacterium
GELRAAVLEFMDSVRRAEDTI

SEQ ID NO: 766016 - protein, 24 aa, Mycobacterium
GELRLKGPQCFLGYVDATLDAHAF

SEQ ID NO: 766017 - protein, 22 aa, Mycobacterium
GELRRLKICAAPDCEAVLTDLS

SEQ ID NO: 766018 - protein, 22 aa, Mycobacterium
GELRRLKLCAAPDCEASLIDLS

SEQ ID NO: 766019 - protein, 24 aa, Mycobacterium
GELSVHFPFPIKDLVAIDDALKFG

SEQ ID NO: 766020 - protein, 19 aa, Mycobacterium
GELVSRLGAQRVIDTRTEA

SEQ ID NO: 766021 - protein, 17 aa, Mycobacterium
GELWIAASRLRQVDQVR

SEQ ID NO: 766022 - protein, 21 aa, Mycobacterium
GELYFPGSPILSVHGTFAECV

SEQ ID NO: 766023 - protein, 21 aa, Mycobacterium
GEMFAALGFGDLVRSARTGAT

SEQ ID NO: 766024 - protein, 17 aa, Mycobacterium
GEMLIAIAGRVARAVVA

SEQ ID NO: 766025 - protein, 17 aa, Mycobacterium
GEMVLAGYGFRTDPRSH

SEQ ID NO: 766026 - protein, 23 aa, Mycobacterium
GENWWRVVDLWQRIKAPLLDAML

SEQ ID NO: 766027 - protein, 18 aa, Mycobacterium
GENWWRVVKLWERIKAPL

SEQ ID NO: 766028 - protein, 24 aa, Mycobacterium
GEPFDAVVCSLVLCSVHDPGGVLR

SEQ ID NO: 766029 - protein, 24 aa, Mycobacterium
GEPFDAVVCSLVLCSVNDPVGVLR

SEQ ID NO: 766030 - protein, 20 aa, Mycobacterium
GEPFTTVGLCYYRDGSDSVA

SEQ ID NO: 766031 - protein, 18 aa, Mycobacterium
GEPFVLHPGEFVLGATLE

SEQ ID NO: 766032 - protein, 18 aa, Mycobacterium
GEPGRAFLRRSIDDAEQY

SEQ ID NO: 766033 - protein, 21 aa, Mycobacterium
GEPGWKLTGQKVWTSAAQNAH

SEQ ID NO: 766034 - protein, 18 aa, Mycobacterium
GEPILPLAPSRLAVIGPF

SEQ ID NO: 766035 - protein, 17 aa, Mycobacterium
GEPLRWPTVRRVRAARP

SEQ ID NO: 766036 - protein, 17 aa, Mycobacterium
GEPLSLATARRFAEILP

SEQ ID NO: 766037 - protein, 24 aa, Mycobacterium
GEPPRPAWDRPLPPPGGQWGYGPI

SEQ ID NO: 766038 - protein, 21 aa, Mycobacterium
GEPRLAAAAPFYGPLPDNPDF

SEQ ID NO: 766039 - protein, 22 aa, Mycobacterium
GEPRLRLLGFERVELEPGQSCA

SEQ ID NO: 766040 - protein, 18 aa, Mycobacterium
GEPRRLLLDAARELFARQ

SEQ ID NO: 766041 - protein, 17 aa, Mycobacterium
GEPRVSPLLYLREGNRV

SEQ ID NO: 766042 - protein, 17 aa, Mycobacterium
GEPRWPTFGIRLSARPG

SEQ ID NO: 766043 - protein, 19 aa, Mycobacterium
GEPTWWRCHRRMIADLAVR

SEQ ID NO: 766044 - protein, 18 aa, Mycobacterium
GEPWRNGYVESFNSRIRD

SEQ ID NO: 766045 - protein, 19 aa, Mycobacterium
GEQCAFGLALIAPRLPPFD

SEQ ID NO: 766046 - protein, 23 aa, Mycobacterium
GEQIRIGIRMSYWAATARKDLDV

SEQ ID NO: 766047 - protein, 21 aa, Mycobacterium
GEQRASNFLLWQAAYAEYVFQ

SEQ ID NO: 766048 - protein, 22 aa, Mycobacterium
GERLAVGVPKAFYQLDGQTLVE

SEQ ID NO: 766049 - protein, 18 aa, Mycobacterium
GERLRLIHKFGAGVNTIA

SEQ ID NO: 766050 - protein, 18 aa, Mycobacterium
GERLRLVKYLAYGWSSLR

SEQ ID NO: 766051 - protein, 18 aa, Mycobacterium
GERLRVSVELEFENAEQI

SEQ ID NO: 766052 - protein, 17 aa, Mycobacterium
GERPAVVPLSFAQQRLW

SEQ ID NO: 766053 - protein, 25 aa, Mycobacterium
GERPPRVPLSFAQSRLWFLEQLQGP

SEQ ID NO: 766054 - protein, 17 aa, Mycobacterium
GERVLLLGHFVKSFVGL

SEQ ID NO: 766055 - protein, 18 aa, Mycobacterium
GERWALLVVRELLLGPKR

SEQ ID NO: 766056 - protein, 19 aa, Mycobacterium
GERWTLLILRELVGGSRRY

SEQ ID NO: 766057 - protein, 19 aa, Mycobacterium
GESEGWCPACGSAYSFLPQ

SEQ ID NO: 766058 - protein, 19 aa, Mycobacterium
GESFLNLAHRWYGDEALAV

SEQ ID NO: 766059 - protein, 17 aa, Mycobacterium
GESLPVMPPWHVQENKW

SEQ ID NO: 766060 - protein, 20 aa, Mycobacterium
GESNVRWLQERGVTIWDEWA

SEQ ID NO: 766061 - protein, 18 aa, Mycobacterium
GESPHRIAPNPAEVSDGA

SEQ ID NO: 766062 - protein, 23 aa, Mycobacterium
GESPSARIERWWLGSTTFDELEL

SEQ ID NO: 766063 - protein, 23 aa, Mycobacterium
GESRASGMFEWRAPFGAMSAANW

SEQ ID NO: 766064 - protein, 20 aa, Mycobacterium
GESRFTTWVYKFVVFEVLNK

SEQ ID NO: 766065 - protein, 18 aa, Mycobacterium
GETPRWGKMVAPGMYGPN

SEQ ID NO: 766066 - protein, 19 aa, Mycobacterium
GETRIPIAGVRKHTAAAMV

SEQ ID NO: 766067 - protein, 19 aa, Mycobacterium
GETVVRGRIDAVFAEPDGT

SEQ ID NO: 766068 - protein, 18 aa, Mycobacterium
GETWWGFIRHGVVPDLVT

SEQ ID NO: 766069 - protein, 19 aa, Mycobacterium
GEVAEALEAFPQRSYVLPE

SEQ ID NO: 766070 - protein, 27 aa, Mycobacterium
GEVAYAAEFFRWFAGEAVRLDGSVMLA

SEQ ID NO: 766071 - protein, 24 aa, Mycobacterium
GEVAYGAEFFRWFSEEAVRIDGRY

SEQ ID NO: 766072 - protein, 24 aa, Mycobacterium
GEVAYGGEFLRWFSEEAVRINGRY

SEQ ID NO: 766073 - protein, 17 aa, Mycobacterium
GEVGLRVATAWEFDLYG

SEQ ID NO: 766074 - protein, 21 aa, Mycobacterium
GEVGYACSVVEKFGDSLVVTA

SEQ ID NO: 766075 - protein, 19 aa, Mycobacterium
GEVIIATGLVPRRIPTFPD

SEQ ID NO: 766076 - protein, 17 aa, Mycobacterium
GEVLEAFVVLREGTEGS

SEQ ID NO: 766077 - protein, 18 aa, Mycobacterium
GEVRLIAYFALRHFSDES

SEQ ID NO: 766078 - protein, 22 aa, Mycobacterium
GEVSSAFAVQWRALALVATTAD

SEQ ID NO: 766079 - protein, 23 aa, Mycobacterium
GEVWTQAGSLVFDITVWEIFGAL

SEQ ID NO: 766080 - protein, 18 aa, Mycobacterium
GEYEVFSSIVLIRSRYDE

SEQ ID NO: 766081 - protein, 21 aa, Mycobacterium
GFARACADAGLVFVGPPPDAI

SEQ ID NO: 766082 - protein, 23 aa, Mycobacterium
GFARSDFYLGAAFEGPPGHVHGG

SEQ ID NO: 766083 - protein, 17 aa, Mycobacterium
GFCRRMGLAELADDERF

SEQ ID NO: 766084 - protein, 17 aa, Mycobacterium
GFCTPGMMITARALLDR

SEQ ID NO: 766085 - protein, 18 aa, Mycobacterium
GFFPANAVGPGFEDIEVY

SEQ ID NO: 766086 - protein, 18 aa, Mycobacterium
GFGAARRARRGRAQRVPL

SEQ ID NO: 766087 - protein, 18 aa, Mycobacterium
GFGAWRLGDDDAMLDVVT

SEQ ID NO: 766088 - protein, 22 aa, Mycobacterium
GFGDGGYDIWAWIVDYGTDESD

SEQ ID NO: 766089 - protein, 18 aa, Mycobacterium
GFGKRWVTECLRASYPLG

SEQ ID NO: 766090 - protein, 26 aa, Mycobacterium
GFGPKPRLAGFWIRRQAHEHAVHHAD

SEQ ID NO: 766091 - protein, 17 aa, Mycobacterium
GFGRGTLYSAINPIAGM

SEQ ID NO: 766092 - protein, 17 aa, Mycobacterium
GFGRIAATTARQVMLQR

SEQ ID NO: 766093 - protein, 35 aa, Mycobacterium
GFGRLRLPREFGGFGVDLPTLFALLAEAGQADSNL

SEQ ID NO: 766094 - protein, 17 aa, Mycobacterium
GFGTRFLAQPTWRHGVM

SEQ ID NO: 766095 - protein, 17 aa, Mycobacterium
GFGVWRLGDDDAMLRIV

SEQ ID NO: 766096 - protein, 20 aa, Mycobacterium
GFGYIPRGVFLPRTARLLTA

SEQ ID NO: 766097 - protein, 20 aa, Mycobacterium
GFGYIPWGVFLPRTARLLAA

SEQ ID NO: 766098 - protein, 22 aa, Mycobacterium
GFIFKCEACLAVVKLGLEAIIV

SEQ ID NO: 766099 - protein, 18 aa, Mycobacterium
GFLGRYLALEWLERMDLV

SEQ ID NO: 766100 - protein, 18 aa, Mycobacterium
GFLGRYLALEWLERMSEV

SEQ ID NO: 766101 - protein, 17 aa, Mycobacterium
GFLGRYLVLQWLRELEQ

SEQ ID NO: 766102 - protein, 18 aa, Mycobacterium
GFLLRTAGKWTLKHPLRP

SEQ ID NO: 766103 - protein, 21 aa, Mycobacterium
GFLLTFLACFDVGDRVALASP

SEQ ID NO: 766104 - protein, 21 aa, Mycobacterium
GFLLTFLACFDVGDRVAMASP

SEQ ID NO: 766105 - protein, 17 aa, Mycobacterium
GFLPDIERILALAPSAD

SEQ ID NO: 766106 - protein, 23 aa, Mycobacterium
GFLVPEFRRKAVIIAVGGVYDIR

SEQ ID NO: 766107 - protein, 23 aa, Mycobacterium
GFNLPAVAFGHDWLTGTDKYRAT

SEQ ID NO: 766108 - protein, 23 aa, Mycobacterium
GFNLPGVAFGHDWITKADNYAGT

SEQ ID NO: 766109 - protein, 20 aa, Mycobacterium
GFPADGLYKFRVHGADGVVT

SEQ ID NO: 766110 - protein, 18 aa, Mycobacterium
GFPDGCFQTLLVPSSAVE

SEQ ID NO: 766111 - protein, 18 aa, Mycobacterium
GFPDGCFQTLLVSASAVE

SEQ ID NO: 766112 - protein, 18 aa, Mycobacterium
GFPEHWWWGQAHDFDNAD

SEQ ID NO: 766113 - protein, 23 aa, Mycobacterium
GFPEKGIAVALDWSVLHRSEWDQ

SEQ ID NO: 766114 - protein, 18 aa, Mycobacterium
GFPERWWWGQAHDFDGAD

SEQ ID NO: 766115 - protein, 22 aa, Mycobacterium
GFPNRWIIVGPYSWTGNGGWHG

SEQ ID NO: 766116 - protein, 24 aa, Mycobacterium
GFQARLTLAYALGWQGRGREAEDV

SEQ ID NO: 766117 - protein, 18 aa, Mycobacterium
GFQAWQLGGTYQKDGNTR

SEQ ID NO: 766118 - protein, 24 aa, Mycobacterium
GFQRLLWRLPITLFRAHLGFLVTK

SEQ ID NO: 766119 - protein, 21 aa, Mycobacterium
GFRGMPMPWGLVTWQTADHPE

SEQ ID NO: 766120 - protein, 18 aa, Mycobacterium
GFRKELFDLIDISFAQRR

SEQ ID NO: 766121 - protein, 20 aa, Mycobacterium
GFRMPSVWLADGHRKVAPVY

SEQ ID NO: 766122 - protein, 18 aa, Mycobacterium
GFRMPSVWLAEGHSRVAP

SEQ ID NO: 766123 - protein, 20 aa, Mycobacterium
GFRPDLSWIDAPIFDRKSRA

SEQ ID NO: 766124 - protein, 19 aa, Mycobacterium
GFRSRGAFRVPLPAEFGPI

SEQ ID NO: 766125 - protein, 18 aa, Mycobacterium
GFRVRRLAGRVVWMQPPD

SEQ ID NO: 766126 - protein, 18 aa, Mycobacterium
GFRVRRLAGRVVWMRPPD

SEQ ID NO: 766127 - protein, 21 aa, Mycobacterium
GFRWWTRCRALELGLIGYAAN

SEQ ID NO: 766128 - protein, 18 aa, Mycobacterium
GFSAELWLQPGVDQSEAL

SEQ ID NO: 766129 - protein, 19 aa, Mycobacterium
GFSFLGFNIRCYRHGRRPG

SEQ ID NO: 766130 - protein, 19 aa, Mycobacterium
GFSPLRLPPELDFAALFHG

SEQ ID NO: 766131 - protein, 18 aa, Mycobacterium
GFVPLRVKHVIPETRDAV

SEQ ID NO: 766132 - protein, 18 aa, Mycobacterium
GFVPRRFRLLLVAVGARK

SEQ ID NO: 766133 - protein, 19 aa, Mycobacterium
GFVSGRLIAAIGMTEPGAG

SEQ ID NO: 766134 - protein, 18 aa, Mycobacterium
GFWPARFEPSPVWDPNIP

SEQ ID NO: 766135 - protein, 20 aa, Mycobacterium
GGAAGKCQQVWCPLCALAAL

SEQ ID NO: 766136 - protein, 20 aa, Mycobacterium
GGAAGLWGVGGHGGDGAHGG

SEQ ID NO: 766137 - protein, 19 aa, Mycobacterium
GGAAGWLIGNGGSGGQGGL

SEQ ID NO: 766138 - protein, 19 aa, Mycobacterium
GGAAGWWGAGGAGGQGGTG

SEQ ID NO: 766139 - protein, 17 aa, Mycobacterium
GGAALPVQVLTEFETAF

SEQ ID NO: 766140 - protein, 17 aa, Mycobacterium
GGAAMTGILGGLPGQGG

SEQ ID NO: 766141 - protein, 18 aa, Mycobacterium
GGAARFFGDGGAAGTGGV

SEQ ID NO: 766142 - protein, 18 aa, Mycobacterium
GGAARWFGDGGTGGTGSQ

SEQ ID NO: 766143 - protein, 18 aa, Mycobacterium
GGADWLWKPISSNPALAA

SEQ ID NO: 766144 - protein, 19 aa, Mycobacterium
GGADWVEWGGCGMVHPNVL

SEQ ID NO: 766145 - protein, 23 aa, Mycobacterium
GGAGGAGGWLFGPGGVGGAGGSS

SEQ ID NO: 766146 - protein, 23 aa, Mycobacterium
GGAGGECDLGGFGDGGDGGDGGG

SEQ ID NO: 766147 - protein, 25 aa, Mycobacterium
GGAGGGGPVLFGHGGAGGLGGQGGT

SEQ ID NO: 766148 - protein, 20 aa, Mycobacterium
GGAGGILWGNGGAGATGAAG

SEQ ID NO: 766149 - protein, 19 aa, Mycobacterium
GGAGGLLWGNGGNGGSGAA

SEQ ID NO: 766150 - protein, 20 aa, Mycobacterium
GGAGGLWGGGGIGGTGGFGA

SEQ ID NO: 766151 - protein, 26 aa, Mycobacterium
GGAGGNGFLGAPAFSSNPGGNGGNGG

SEQ ID NO: 766152 - protein, 25 aa, Mycobacterium
GGAGGNGGFLFGHGGDGGTGGTGAS

SEQ ID NO: 766153 - protein, 22 aa, Mycobacterium
GGAGGNGGWLFGQGGAGGIGGS

SEQ ID NO: 766154 - protein, 21 aa, Mycobacterium
GGAGGQAGWLSGAGGTGGAGG

SEQ ID NO: 766155 - protein, 25 aa, Mycobacterium
GGAGGRAGLLAGLGGAGGDGGLGGN

SEQ ID NO: 766156 - protein, 22 aa, Mycobacterium
GGAGGRAGLLGYGGAGGAGGLG

SEQ ID NO: 766157 - protein, 24 aa, Mycobacterium
GGAGGRAGLVIGNGGAGGAGGESF

SEQ ID NO: 766158 - protein, 19 aa, Mycobacterium
GGAGGRGGDAGWLGDGGAG

SEQ ID NO: 766159 - protein, 24 aa, Mycobacterium
GGAGGRGGLLWGNAGISGPGLDGR

SEQ ID NO: 766160 - protein, 21 aa, Mycobacterium
GGAGGRGGLLYGSGGAGGSGG

SEQ ID NO: 766161 - protein, 25 aa, Mycobacterium
GGAGGRGGLVFGGGGAGGAGGDGGT

SEQ ID NO: 766162 - protein, 18 aa, Mycobacterium
GGAGGRGGSLLGDGGAGA

SEQ ID NO: 766163 - protein, 26 aa, Mycobacterium
GGAGGRGGWISFLSGQGAGGAGGDGG

SEQ ID NO: 766164 - protein, 22 aa, Mycobacterium
GGAGGRGGWLFGDAGAGGQGGL

SEQ ID NO: 766165 - protein, 22 aa, Mycobacterium
GGAGGRGGWLIGNGGAGGAGGA

SEQ ID NO: 766166 - protein, 19 aa, Mycobacterium
GGAGGRGGWLIGNGGTGGN

SEQ ID NO: 766167 - protein, 23 aa, Mycobacterium
GGAGGVGGWLFGAGGGGGAGGAG

SEQ ID NO: 766168 - protein, 22 aa, Mycobacterium
GGAGGWAGLIGAGGAGGVGGTG

SEQ ID NO: 766169 - protein, 19 aa, Mycobacterium
GGAGGWLFGNGGAGGTGGT

SEQ ID NO: 766170 - protein, 18 aa, Mycobacterium
GGAGGWLIGNGGAGGSGA

SEQ ID NO: 766171 - protein, 18 aa, Mycobacterium
GGAGGWLLGDGGGGGGGG

SEQ ID NO: 766172 - protein, 19 aa, Mycobacterium
GGAGGWLVGNGGTGGRGGL

SEQ ID NO: 766173 - protein, 17 aa, Mycobacterium
GGAGGWLYGNGGAGGAG

SEQ ID NO: 766174 - protein, 22 aa, Mycobacterium
GGAHALPFVVGFMSERQTAGAD

SEQ ID NO: 766175 - protein, 22 aa, Mycobacterium
GGAKFAAVFARRGLIAEFGISW

SEQ ID NO: 766176 - protein, 17 aa, Mycobacterium
GGALAYACAIGLKQSGA

SEQ ID NO: 766177 - protein, 18 aa, Mycobacterium
GGAMPARVLVVGRDRPGR

SEQ ID NO: 766178 - protein, 18 aa, Mycobacterium
GGAMVYGNFVGRVGALAA

SEQ ID NO: 766179 - protein, 19 aa, Mycobacterium
GGANNAWLGGAAGSGGTGG

SEQ ID NO: 766180 - protein, 17 aa, Mycobacterium
GGARGCPPATWCVQNAG

SEQ ID NO: 766181 - protein, 17 aa, Mycobacterium
GGARRCAAQSWSLDRFR

SEQ ID NO: 766182 - protein, 17 aa, Mycobacterium
GGASILMRAVLAAYGDE

SEQ ID NO: 766183 - protein, 17 aa, Mycobacterium
GGASILMRAVLAVYGDK

SEQ ID NO: 766184 - protein, 19 aa, Mycobacterium
GGATPRFPRVAGWGNAMRW

SEQ ID NO: 766185 - protein, 19 aa, Mycobacterium
GGAVGLNWYSTDPTLQFTM

SEQ ID NO: 766186 - protein, 20 aa, Mycobacterium
GGAWYWNRYPGARVDFESMQ

SEQ ID NO: 766187 - protein, 18 aa, Mycobacterium
GGCALDFEIPELIADALA

SEQ ID NO: 766188 - protein, 21 aa, Mycobacterium
GGCAPGLLGRWSHGWTARADV

SEQ ID NO: 766189 - protein, 19 aa, Mycobacterium
GGCEGCATGDPAMCRLGPQ

SEQ ID NO: 766190 - protein, 19 aa, Mycobacterium
GGCIIRAKFLNRIKEAFDA

SEQ ID NO: 766191 - protein, 17 aa, Mycobacterium
GGCIIRAQFLNRVKEAF

SEQ ID NO: 766192 - protein, 18 aa, Mycobacterium
GGDAGRFGNGGNGGNGGN

SEQ ID NO: 766193 - protein, 31 aa, Mycobacterium
GGDGGAFDDGFFLIFGDPGIDGDPGGPPDGG

SEQ ID NO: 766194 - protein, 23 aa, Mycobacterium
GGDGGAGGWLFGDAGAGGQGGTG

SEQ ID NO: 766195 - protein, 19 aa, Mycobacterium
GGDGGRAGLLFGSAGVGGQ

SEQ ID NO: 766196 - protein, 21 aa, Mycobacterium
GGDGGRAGWLSGNAGAGGGGG

SEQ ID NO: 766197 - protein, 19 aa, Mycobacterium
GGDGGRGGLLIGSGGNGGT

SEQ ID NO: 766198 - protein, 21 aa, Mycobacterium
GGDGGRSGWLSGNAGAGGAGG

SEQ ID NO: 766199 - protein, 18 aa, Mycobacterium
GGDGGWLLGDGGAGGSGA

SEQ ID NO: 766200 - protein, 22 aa, Mycobacterium
GGDGRPGGILMGKGGDGAPGGP

SEQ ID NO: 766201 - protein, 19 aa, Mycobacterium
GGEEPRWIYYSSGTTAAPK

SEQ ID NO: 766202 - protein, 22 aa, Mycobacterium
GGEGGFHLCAAWLVEAYLLIGA

SEQ ID NO: 766203 - protein, 21 aa, Mycobacterium
GGEPRLAVVTGDFSMSAGKLT

SEQ ID NO: 766204 - protein, 21 aa, Mycobacterium
GGEPRRSWAVLGEMAELGPDA

SEQ ID NO: 766205 - protein, 17 aa, Mycobacterium
GGFAYAGGWLRPGALTP

SEQ ID NO: 766206 - protein, 19 aa, Mycobacterium
GGFELAYRLLSFPKPVVMA

SEQ ID NO: 766207 - protein, 18 aa, Mycobacterium
GGFELAYRLLSYPKPVVM

SEQ ID NO: 766208 - protein, 18 aa, Mycobacterium
GGFELSYRLLSYPKPVVI

SEQ ID NO: 766209 - protein, 24 aa, Mycobacterium
GGFGGRGGNAWGFGNGGAGGAGGM

SEQ ID NO: 766210 - protein, 18 aa, Mycobacterium
GGFGLSVVGGHGGDGGNA

SEQ ID NO: 766211 - protein, 18 aa, Mycobacterium
GGFIGSRVAVLGAAFKPD

SEQ ID NO: 766212 - protein, 19 aa, Mycobacterium
GGFLCDRARAGWNVRVLVD

SEQ ID NO: 766213 - protein, 23 aa, Mycobacterium
GGFLLTFLACFDVGDRVAITSPG

SEQ ID NO: 766214 - protein, 19 aa, Mycobacterium
GGFPEGCFQTLLVPSSAVE

SEQ ID NO: 766215 - protein, 17 aa, Mycobacterium
GGFRADNRFSDSGEQPA

SEQ ID NO: 766216 - protein, 27 aa, Mycobacterium
GGFSNFPAWRIAGAAARADLLGMPRPI

SEQ ID NO: 766217 - protein, 17 aa, Mycobacterium
GGFTGMLLGSVSSRVAQ

SEQ ID NO: 766218 - protein, 18 aa, Mycobacterium
GGFTWAMPVMSRMDRIWE

SEQ ID NO: 766219 - protein, 17 aa, Mycobacterium
GGGAAFNVVATAQGGQG

SEQ ID NO: 766220 - protein, 18 aa, Mycobacterium
GGGACPVRFRCVGCDHFR

SEQ ID NO: 766221 - protein, 21 aa, Mycobacterium
GGGALRPAPVGAFPASASACG

SEQ ID NO: 766222 - protein, 23 aa, Mycobacterium
GGGDGGRGGWLYGNGGVGGTGGT

SEQ ID NO: 766223 - protein, 26 aa, Mycobacterium
GGGGGKSGWLGLAGALGGGGTGGSGG

SEQ ID NO: 766224 - protein, 17 aa, Mycobacterium
GGGGGWLSGSGGIGGGG

SEQ ID NO: 766225 - protein, 26 aa, Mycobacterium
GGGGGYGGTGFDAAGAMGGIGGTGGT

SEQ ID NO: 766226 - protein, 19 aa, Mycobacterium
GGGGIPLIAHFTLLGDTKA

SEQ ID NO: 766227 - protein, 17 aa, Mycobacterium
GGGIPWNVPEDLARFKE

SEQ ID NO: 766228 - protein, 18 aa, Mycobacterium
GGGIPWRKQDLFFNAPAN

SEQ ID NO: 766229 - protein, 19 aa, Mycobacterium
GGGLNWPLDLTVGADGAVY

SEQ ID NO: 766230 - protein, 21 aa, Mycobacterium
GGGRCWSEFVLGSAYEGPPKL

SEQ ID NO: 766231 - protein, 19 aa, Mycobacterium
GGGRSEAILSHFVAQIDAE

SEQ ID NO: 766232 - protein, 19 aa, Mycobacterium
GGGTFTPRTWVALATEYFL

SEQ ID NO: 766233 - protein, 21 aa, Mycobacterium
GGHEYLACGIDFTTEVIIFRN

SEQ ID NO: 766234 - protein, 22 aa, Mycobacterium
GGHGPFGEKIPAGGSGGDGGTG

SEQ ID NO: 766235 - protein, 17 aa, Mycobacterium
GGHLGRWYMAHVEARVA

SEQ ID NO: 766236 - protein, 17 aa, Mycobacterium
GGHLGRWYMSHVEGRVA

SEQ ID NO: 766237 - protein, 20 aa, Mycobacterium
GGHNVCYAAKAFLCSEIARW

SEQ ID NO: 766238 - protein, 17 aa, Mycobacterium
GGHSGWLYGNGGNGGNT

SEQ ID NO: 766239 - protein, 22 aa, Mycobacterium
GGHVPGGWFWRYDLAPNGHRTD

SEQ ID NO: 766240 - protein, 20 aa, Mycobacterium
GGIAFGWDRIVALLAGLDSI

SEQ ID NO: 766241 - protein, 18 aa, Mycobacterium
GGIAKLWDPANIDFSRDS

SEQ ID NO: 766242 - protein, 19 aa, Mycobacterium
GGIDVCRWAAADGVIGNSR

SEQ ID NO: 766243 - protein, 22 aa, Mycobacterium
GGIEIPSILAIIAYYAPKAAEF

SEQ ID NO: 766244 - protein, 20 aa, Mycobacterium
GGILERYTGLYIPFMDVSFD

SEQ ID NO: 766245 - protein, 22 aa, Mycobacterium
GGIPMPRALQWALIEHILGANP

SEQ ID NO: 766246 - protein, 18 aa, Mycobacterium
GGIRAGHQLKFWTPGGSS

SEQ ID NO: 766247 - protein, 22 aa, Mycobacterium
GGIRGPIGLGYRVPGIVISPFS

SEQ ID NO: 766248 - protein, 17 aa, Mycobacterium
GGIYTRADWILRHASDI

SEQ ID NO: 766249 - protein, 23 aa, Mycobacterium
GGKCPACGTYVFPPRENNCPNPG

SEQ ID NO: 766250 - protein, 23 aa, Mycobacterium
GGKCTGCGTLVFPPRTTNCPNPG

SEQ ID NO: 766251 - protein, 20 aa, Mycobacterium
GGKGGLLLGGGGRGGAGGLG

SEQ ID NO: 766252 - protein, 19 aa, Mycobacterium
GGKHLRPGDEIVITHLEHH

SEQ ID NO: 766253 - protein, 21 aa, Mycobacterium
GGLAFKEAFAAWLAADDEQDL

SEQ ID NO: 766254 - protein, 18 aa, Mycobacterium
GGLAKRPALFVASYFGEL

SEQ ID NO: 766255 - protein, 18 aa, Mycobacterium
GGLAMKWRWRAKIGKDWK

SEQ ID NO: 766256 - protein, 17 aa, Mycobacterium
GGLAMKWRWRAKVGKGW

SEQ ID NO: 766257 - protein, 19 aa, Mycobacterium
GGLFARFPGLSLPSMGLDF

SEQ ID NO: 766258 - protein, 17 aa, Mycobacterium
GGLFGVLTNVVWTNRGP

SEQ ID NO: 766259 - protein, 17 aa, Mycobacterium
GGLFYGAGGAGGDGGNG

SEQ ID NO: 766260 - protein, 29 aa, Mycobacterium
GGLGGDGGDARWLGRGGVGGVGGAGEGSG

SEQ ID NO: 766261 - protein, 19 aa, Mycobacterium
GGLGGMLFGTGGSGGAGGV

SEQ ID NO: 766262 - protein, 22 aa, Mycobacterium
GGLGGRGGFLFGDGGLGGQGGD

SEQ ID NO: 766263 - protein, 22 aa, Mycobacterium
GGLGIAYSPLVTGIGIGGAGGD

SEQ ID NO: 766264 - protein, 20 aa, Mycobacterium
GGLHPRIALMLDIESGGNPP

SEQ ID NO: 766265 - protein, 19 aa, Mycobacterium
GGLIIGEPVNVFNWLNPPS

SEQ ID NO: 766266 - protein, 19 aa, Mycobacterium
GGLIKAAWIDTWRLPAAPP

SEQ ID NO: 766267 - protein, 19 aa, Mycobacterium
GGLISFLGGHGTGGAGGEG

SEQ ID NO: 766268 - protein, 19 aa, Mycobacterium
GGLKPVLCLTKSDLAAPEA

SEQ ID NO: 766269 - protein, 17 aa, Mycobacterium
GGLKWLGAFSAHPKWDF

SEQ ID NO: 766270 - protein, 26 aa, Mycobacterium
GGLLARFPGFYIPFLDVSFNGATPAA

SEQ ID NO: 766271 - protein, 18 aa, Mycobacterium
GGLMTWAQLSAIYEPYNH

SEQ ID NO: 766272 - protein, 17 aa, Mycobacterium
GGLPLLYYSGRMHDWAA

SEQ ID NO: 766273 - protein, 19 aa, Mycobacterium
GGLRGGFEYARTGNPTRQS

SEQ ID NO: 766274 - protein, 20 aa, Mycobacterium
GGLRLSRRSPLAAAAQSVLS

SEQ ID NO: 766275 - protein, 19 aa, Mycobacterium
GGLRPGRRSALAAAARQVL

SEQ ID NO: 766276 - protein, 17 aa, Mycobacterium
GGLRSRRRWSLGGGGGV

SEQ ID NO: 766277 - protein, 19 aa, Mycobacterium
GGLRYAGRVGTGFTERELS

SEQ ID NO: 766278 - protein, 19 aa, Mycobacterium
GGLRYAQRADLATREEQIA

SEQ ID NO: 766279 - protein, 25 aa, Mycobacterium
GGLTAERFVACPFGPAGSRMYRSGD

SEQ ID NO: 766280 - protein, 17 aa, Mycobacterium
GGLVARWYISCEGGAEL

SEQ ID NO: 766281 - protein, 22 aa, Mycobacterium
GGLVPRYWCVAAAGRYTIRAVA

SEQ ID NO: 766282 - protein, 20 aa, Mycobacterium
GGLYLEPWDGILIDTLKMVA

SEQ ID NO: 766283 - protein, 21 aa, Mycobacterium
GGMAAARFKGVVDRWHAESTR

SEQ ID NO: 766284 - protein, 21 aa, Mycobacterium
GGMGGAAGWLGFGGAGGAGGF

SEQ ID NO: 766285 - protein, 24 aa, Mycobacterium
GGMKLDLLLSVPWDYYKKFMSVNQ

SEQ ID NO: 766286 - protein, 24 aa, Mycobacterium
GGMKLDLLLTVPWDYYRKFMSVNH

SEQ ID NO: 766287 - protein, 21 aa, Mycobacterium
GGMRQRVLIAIAFGLNPKLLV

SEQ ID NO: 766288 - protein, 17 aa, Mycobacterium
GGMSVWVRLPAPMSSAL

SEQ ID NO: 766289 - protein, 18 aa, Mycobacterium
GGNAAMLFGNGGAGGTGA

SEQ ID NO: 766290 - protein, 18 aa, Mycobacterium
GGNARYAGSLGTQVVKIF

SEQ ID NO: 766291 - protein, 18 aa, Mycobacterium
GGNFGQWSGLRKALRGNA

SEQ ID NO: 766292 - protein, 23 aa, Mycobacterium
GGNGGAGGWLFGDGGTGGTGGDA

SEQ ID NO: 766293 - protein, 22 aa, Mycobacterium
GGNGGAGGWLFGNGGNGGTGGD

SEQ ID NO: 766294 - protein, 23 aa, Mycobacterium
GGNGGAGGWLFGNGGTGGTGGDA

SEQ ID NO: 766295 - protein, 22 aa, Mycobacterium
GGNGGAGGWLFGQGGAGGNGGT

SEQ ID NO: 766296 - protein, 23 aa, Mycobacterium
GGNGGKGADGWVQAYDPAGPVGS

SEQ ID NO: 766297 - protein, 19 aa, Mycobacterium
GGNGGLWGAGGIGGNGGYG

SEQ ID NO: 766298 - protein, 24 aa, Mycobacterium
GGNGGNASAVFGFGGNGGASGTGG

SEQ ID NO: 766299 - protein, 25 aa, Mycobacterium
GGNGGRAALLIGFGGNGGNGGVGTA

SEQ ID NO: 766300 - protein, 22 aa, Mycobacterium
GGNGGVGWAGLDGGNGGSGGLL

SEQ ID NO: 766301 - protein, 18 aa, Mycobacterium
GGNGGWLYGSGGAGGAGG

SEQ ID NO: 766302 - protein, 22 aa, Mycobacterium
GGNGGYGGWGFNGGNGGNGGDG

SEQ ID NO: 766303 - protein, 20 aa, Mycobacterium
GGPADGCWVTVATAASAGLG

SEQ ID NO: 766304 - protein, 21 aa, Mycobacterium
GGPCWHWKGSVWGYTCTDCID

SEQ ID NO: 766305 - protein, 18 aa, Mycobacterium
GGPFLSFGQVYAYAQNAQ

SEQ ID NO: 766306 - protein, 19 aa, Mycobacterium
GGPFLSFGQVYAYVQNAQG

SEQ ID NO: 766307 - protein, 20 aa, Mycobacterium
GGPGRGFGGFGFGFDPGAGF

SEQ ID NO: 766308 - protein, 18 aa, Mycobacterium
GGPIFRFSEDDLRGKFAR

SEQ ID NO: 766309 - protein, 28 aa, Mycobacterium
GGPKPAGVPFLWRWQDVHAKLLKSCDVM

SEQ ID NO: 766310 - protein, 22 aa, Mycobacterium
GGPLTWPLHISLLLAKEYALTG

SEQ ID NO: 766311 - protein, 20 aa, Mycobacterium
GGPRPGWPTYFTKRPSGTAD

SEQ ID NO: 766312 - protein, 20 aa, Mycobacterium
GGPSTWRLGGAFNCGKAQPG

SEQ ID NO: 766313 - protein, 22 aa, Mycobacterium
GGPSTWRLGGAFNCGKAQPGQI

SEQ ID NO: 766314 - protein, 20 aa, Mycobacterium
GGPSTWRLGGAINCGKAQPG

SEQ ID NO: 766315 - protein, 18 aa, Mycobacterium
GGPVARWAEETDRNPPRL

SEQ ID NO: 766316 - protein, 18 aa, Mycobacterium
GGPVTRWAEETDRNPPQL

SEQ ID NO: 766317 - protein, 19 aa, Mycobacterium
GGQLLDWLSRCIFPAEVKL

SEQ ID NO: 766318 - protein, 17 aa, Mycobacterium
GGQTWLKDLGCAIYHEH

SEQ ID NO: 766319 - protein, 19 aa, Mycobacterium
GGQVSNLIHDVMKLRQQGY

SEQ ID NO: 766320 - protein, 17 aa, Mycobacterium
GGRAALVLGDWPDANDH

SEQ ID NO: 766321 - protein, 24 aa, Mycobacterium
GGRAPRPGELFTFPDHADTLEKIA

SEQ ID NO: 766322 - protein, 24 aa, Mycobacterium
GGRDELWRFTPLRRLRGLHDGTAV

SEQ ID NO: 766323 - protein, 21 aa, Mycobacterium
GGREALEWVFHPFLSTMILAR

SEQ ID NO: 766324 - protein, 18 aa, Mycobacterium
GGRFAVNVVSGWFKDEFT

SEQ ID NO: 766325 - protein, 19 aa, Mycobacterium
GGRLPAALANRLRITRGEA

SEQ ID NO: 766326 - protein, 23 aa, Mycobacterium
GGRLRLCVGVGWLKEELEACGAE

SEQ ID NO: 766327 - protein, 24 aa, Mycobacterium
GGRLRLCVGVGWLKEELQACGADF

SEQ ID NO: 766328 - protein, 18 aa, Mycobacterium
GGRSLRVANYLARNGYTP

SEQ ID NO: 766329 - protein, 17 aa, Mycobacterium
GGSAFLFGSGGHGGSGG

SEQ ID NO: 766330 - protein, 19 aa, Mycobacterium
GGSAGLWGAGGAGGAGGSA

SEQ ID NO: 766331 - protein, 18 aa, Mycobacterium
GGSCHFMPPEAFIERPMR

SEQ ID NO: 766332 - protein, 17 aa, Mycobacterium
GGSDLGFRIAFSEGHSY

SEQ ID NO: 766333 - protein, 24 aa, Mycobacterium
GGSELRRRISLVFQDPFSSLNPRA

SEQ ID NO: 766334 - protein, 22 aa, Mycobacterium
GGSGGHSGLLIGDGGSGGSGGN

SEQ ID NO: 766335 - protein, 24 aa, Mycobacterium
GGSGGRAALLYGVGGDGGAGGAGG

SEQ ID NO: 766336 - protein, 18 aa, Mycobacterium
GGSGGWLIGTGGTGGTGG

SEQ ID NO: 766337 - protein, 18 aa, Mycobacterium
GGSGIQWPCNADYPDGTE

SEQ ID NO: 766338 - protein, 20 aa, Mycobacterium
GGSGRARRGATAASAGTAGP

SEQ ID NO: 766339 - protein, 19 aa, Mycobacterium
GGSMGRYGGVWAHDETRKS

SEQ ID NO: 766340 - protein, 18 aa, Mycobacterium
GGSYGWLAAMPTLVVGPV

SEQ ID NO: 766341 - protein, 18 aa, Mycobacterium
GGTDIRWTGSFTEGVRGT

SEQ ID NO: 766342 - protein, 23 aa, Mycobacterium
GGTGGGLFGLLGHSGSTGAAGAA

SEQ ID NO: 766343 - protein, 22 aa, Mycobacterium
GGTGGRAGLLIGNAGAGGAGGE

SEQ ID NO: 766344 - protein, 18 aa, Mycobacterium
GGTGGWLIGHSGTNGIGG

SEQ ID NO: 766345 - protein, 18 aa, Mycobacterium
GGTLLRWLARKHASAVVL

SEQ ID NO: 766346 - protein, 17 aa, Mycobacterium
GGTNGYIGGNGGNGGAG

SEQ ID NO: 766347 - protein, 21 aa, Mycobacterium
GGTVGEMFGRKVARLMEWCAM

SEQ ID NO: 766348 - protein, 19 aa, Mycobacterium
GGVAMQFAYQFPQFVDRLI

SEQ ID NO: 766349 - protein, 17 aa, Mycobacterium
GGVAQVWVAAGRATALR

SEQ ID NO: 766350 - protein, 17 aa, Mycobacterium
GGVEAALRSCPVPVVVG

SEQ ID NO: 766351 - protein, 24 aa, Mycobacterium
GGVFRILLCLAEARPFVLLPKFEL

SEQ ID NO: 766352 - protein, 21 aa, Mycobacterium
GGVGGDGGWLIGDGGAGGQGG

SEQ ID NO: 766353 - protein, 22 aa, Mycobacterium
GGVGGGGGWLFGDGGVGGIGGN

SEQ ID NO: 766354 - protein, 23 aa, Mycobacterium
GGVGGRGGVLFGDGGIGGAGGGG

SEQ ID NO: 766355 - protein, 21 aa, Mycobacterium
GGVGGTGGWLYGNGGAGGIGG

SEQ ID NO: 766356 - protein, 17 aa, Mycobacterium
GGVGGWGVLAAAGGKGG

SEQ ID NO: 766357 - protein, 25 aa, Mycobacterium
GGVGQILCQWARYLGATVIGTVGSA

SEQ ID NO: 766358 - protein, 18 aa, Mycobacterium
GGVIFAEFEPGRSMLGTI

SEQ ID NO: 766359 - protein, 18 aa, Mycobacterium
GGVIGWAGSTGATGAGGT

SEQ ID NO: 766360 - protein, 17 aa, Mycobacterium
GGVMAWFCGPNHEVFAQ

SEQ ID NO: 766361 - protein, 17 aa, Mycobacterium
GGVPVAFEVARALHAPL

SEQ ID NO: 766362 - protein, 18 aa, Mycobacterium
GGVPVAFEVARALRAPLD

SEQ ID NO: 766363 - protein, 17 aa, Mycobacterium
GGVRAGHRLKFWTPGGS

SEQ ID NO: 766364 - protein, 19 aa, Mycobacterium
GGVRAGHRLKFWTPGGSST

SEQ ID NO: 766365 - protein, 18 aa, Mycobacterium
GGVRAIRAFTEIEGLPAP

SEQ ID NO: 766366 - protein, 21 aa, Mycobacterium
GGVRMPIRWVVKMAAMSGNPD

SEQ ID NO: 766367 - protein, 17 aa, Mycobacterium
GGVSLRLGEHPYAAELS

SEQ ID NO: 766368 - protein, 24 aa, Mycobacterium
GGVSPTIVVPGRWSSSDIEFQTRH

SEQ ID NO: 766369 - protein, 19 aa, Mycobacterium
GGWDVRFPFLMDLATYCAV

SEQ ID NO: 766370 - protein, 23 aa, Mycobacterium
GGWPFYHMEMMLAGIPIPVPPGE

SEQ ID NO: 766371 - protein, 23 aa, Mycobacterium
GGWSWENFCWLMARVGPLSTPQV

SEQ ID NO: 766372 - protein, 18 aa, Mycobacterium
GGWWPPLMLEPGWVGAHH

SEQ ID NO: 766373 - protein, 25 aa, Mycobacterium
GGWWRAPLRWTLRGSLAVRSRLMVR

SEQ ID NO: 766374 - protein, 20 aa, Mycobacterium
GGWYEHEWRAYGYGFPSAGI

SEQ ID NO: 766375 - protein, 20 aa, Mycobacterium
GGWYEHEWRAYGYGFPSAGV

SEQ ID NO: 766376 - protein, 23 aa, Mycobacterium
GGYAEFCTAPAFLSAKVPDGVSS

SEQ ID NO: 766377 - protein, 21 aa, Mycobacterium
GGYKITGRWQFGSGVWHSSWA

SEQ ID NO: 766378 - protein, 18 aa, Mycobacterium
GGYPTACFSSFDRHKALS

SEQ ID NO: 766379 - protein, 18 aa, Mycobacterium
GGYTCHWVRPEWILDPEA

SEQ ID NO: 766380 - protein, 22 aa, Mycobacterium
GHAEHIRYSFGLAHRSNDRGAL

SEQ ID NO: 766381 - protein, 21 aa, Mycobacterium
GHAFPALALCLKFAAAGDDPV

SEQ ID NO: 766382 - protein, 18 aa, Mycobacterium
GHAMVRAGLALGLKGSGD

SEQ ID NO: 766383 - protein, 20 aa, Mycobacterium
GHAPFNLGLGNIGFGNVGSA

SEQ ID NO: 766384 - protein, 20 aa, Mycobacterium
GHCGERWFIFNAGMGLDGEV

SEQ ID NO: 766385 - protein, 18 aa, Mycobacterium
GHCGWRYGLDGSLIAAPD

SEQ ID NO: 766386 - protein, 19 aa, Mycobacterium
GHCRRSSWQRAVRANAILN

SEQ ID NO: 766387 - protein, 19 aa, Mycobacterium
GHCVACATQGLTPCEPGSA

SEQ ID NO: 766388 - protein, 19 aa, Mycobacterium
GHDALRRWAASRQGTAELG

SEQ ID NO: 766389 - protein, 22 aa, Mycobacterium
GHDRLRLALVLSAVRPDIGGVL

SEQ ID NO: 766390 - protein, 19 aa, Mycobacterium
GHDTFCPLGPWIVTDLDPA

SEQ ID NO: 766391 - protein, 22 aa, Mycobacterium
GHDTFCPVGPWIVTDLDPLDPT

SEQ ID NO: 766392 - protein, 23 aa, Mycobacterium
GHDTFCPVGPWIVTDVDPADLEI

SEQ ID NO: 766393 - protein, 18 aa, Mycobacterium
GHDWKFAVVEGGRHSVTH

SEQ ID NO: 766394 - protein, 19 aa, Mycobacterium
GHERFRFYLNVEIGEHLSH

SEQ ID NO: 766395 - protein, 17 aa, Mycobacterium
GHFGDGCMHVRIDLPLD

SEQ ID NO: 766396 - protein, 19 aa, Mycobacterium
GHFPASLLYTAAKLYYTED

SEQ ID NO: 766397 - protein, 26 aa, Mycobacterium
GHFPKPWALGIHNVWLRIVPTTITGR

SEQ ID NO: 766398 - protein, 17 aa, Mycobacterium
GHFYGAGLINWWDPDGA

SEQ ID NO: 766399 - protein, 20 aa, Mycobacterium
GHFYGAGLINWWDPEGTRRT

SEQ ID NO: 766400 - protein, 20 aa, Mycobacterium
GHFYGAGLINWWDPQGARKT

SEQ ID NO: 766401 - protein, 21 aa, Mycobacterium
GHFYGAGLINWWDPRGTRKTL

SEQ ID NO: 766402 - protein, 27 aa, Mycobacterium
GHGAFILPVFRKARFLTLAMCEAEVAE

SEQ ID NO: 766403 - protein, 21 aa, Mycobacterium
GHGAFVVPFFRKAAFLTLAMC

SEQ ID NO: 766404 - protein, 25 aa, Mycobacterium
GHGGDSGFGWSGQVGSAGSGPNGVI

SEQ ID NO: 766405 - protein, 22 aa, Mycobacterium
GHGGGGGNAFLRANGAGSSASG

SEQ ID NO: 766406 - protein, 21 aa, Mycobacterium
GHGILTWHVPMLFRTPPGYNL

SEQ ID NO: 766407 - protein, 17 aa, Mycobacterium
GHHGVTMVTGWDEAVSV

SEQ ID NO: 766408 - protein, 17 aa, Mycobacterium
GHIAFGHGIHYCLGAPL

SEQ ID NO: 766409 - protein, 22 aa, Mycobacterium
GHIARACARAGAQLIHVSTDYV

SEQ ID NO: 766410 - protein, 17 aa, Mycobacterium
GHIARMFSLVYGDTPED

SEQ ID NO: 766411 - protein, 17 aa, Mycobacterium
GHIAVDVIMKWAEDHRH

SEQ ID NO: 766412 - protein, 26 aa, Mycobacterium
GHIELAAPVTHIWYFKGVPSRLGYLL

SEQ ID NO: 766413 - protein, 21 aa, Mycobacterium
GHIFWDELFIFPVLNLRVPTV

SEQ ID NO: 766414 - protein, 22 aa, Mycobacterium
GHIYRQGAGFTMETQHYPDSPN

SEQ ID NO: 766415 - protein, 25 aa, Mycobacterium
GHLHCPFNRMCEVVRRNDRRSAINA

SEQ ID NO: 766416 - protein, 18 aa, Mycobacterium
GHLPLPRLVWPADVVGTV

SEQ ID NO: 766417 - protein, 17 aa, Mycobacterium
GHLSFGLGLHFCLGSAL

SEQ ID NO: 766418 - protein, 24 aa, Mycobacterium
GHLVTRWLATYGFHRRALAVAGPR

SEQ ID NO: 766419 - protein, 20 aa, Mycobacterium
GHMLERARWAAAAYGEYDAA

SEQ ID NO: 766420 - protein, 17 aa, Mycobacterium
GHMLIEFMQNLPRAELF

SEQ ID NO: 766421 - protein, 17 aa, Mycobacterium
GHPARWADWGSLEYSVR

SEQ ID NO: 766422 - protein, 17 aa, Mycobacterium
GHPRFLVPHIVASAPKV

SEQ ID NO: 766423 - protein, 23 aa, Mycobacterium
GHRKGFLQFRWQRVSREMTAADG

SEQ ID NO: 766424 - protein, 22 aa, Mycobacterium
GHRRICGVFGPATLDTMVRRRH

SEQ ID NO: 766425 - protein, 23 aa, Mycobacterium
GHRVIRINPHLAIVPRIASELTV

SEQ ID NO: 766426 - protein, 22 aa, Mycobacterium
GHSMGALVAFEFVRLAEANGID

SEQ ID NO: 766427 - protein, 22 aa, Mycobacterium
GHSMIRAGFGLDGWRPDIVHAH

SEQ ID NO: 766428 - protein, 21 aa, Mycobacterium
GHSQGGLLIKNFVAQDKSDSV

SEQ ID NO: 766429 - protein, 20 aa, Mycobacterium
GHSRACAWAVRDGVIGSSTT

SEQ ID NO: 766430 - protein, 19 aa, Mycobacterium
GHSRVAPVYLYRFDYSTPL

SEQ ID NO: 766431 - protein, 20 aa, Mycobacterium
GHTPSGLGFRPDGSLLIASA

SEQ ID NO: 766432 - protein, 22 aa, Mycobacterium
GHVALDWLDRVDVIGHNKSSAR

SEQ ID NO: 766433 - protein, 18 aa, Mycobacterium
GHVARFGLLLARTDPDVP

SEQ ID NO: 766434 - protein, 23 aa, Mycobacterium
GHVHGGVCALVLDHVLGAAAHQP

SEQ ID NO: 766435 - protein, 30 aa, Mycobacterium
GHVLFTWHLPELWRRFTITLRRTLRRELRA

SEQ ID NO: 766436 - protein, 18 aa, Mycobacterium
GHVLHWWFPVYDPAFAQL

SEQ ID NO: 766437 - protein, 17 aa, Mycobacterium
GHYGVTMVTGWDEAVAV

SEQ ID NO: 766438 - protein, 24 aa, Mycobacterium
GIAAWRLGAGRSRPGEAVQHGAGV

SEQ ID NO: 766439 - protein, 24 aa, Mycobacterium
GIAGFCMGGGFALILSPRGFGASA

SEQ ID NO: 766440 - protein, 18 aa, Mycobacterium
GIAGMCLTMARDLGSVGI

SEQ ID NO: 766441 - protein, 20 aa, Mycobacterium
GIAHRLGMRPSWVLDLNNGG

SEQ ID NO: 766442 - protein, 17 aa, Mycobacterium
GIALLGMDSCRCRSGRA

SEQ ID NO: 766443 - protein, 17 aa, Mycobacterium
GIASRVIGKWARTRLSG

SEQ ID NO: 766444 - protein, 21 aa, Mycobacterium
GIAVLRWFDEPVISKETLVDE

SEQ ID NO: 766445 - protein, 24 aa, Mycobacterium
GIAVLSCREGLEFATSVASDAAPL

SEQ ID NO: 766446 - protein, 19 aa, Mycobacterium
GIDEFRAPLPLGIDPAAGD

SEQ ID NO: 766447 - protein, 24 aa, Mycobacterium
GIDGPADRPGGRGGQGGHGGDGGS

SEQ ID NO: 766448 - protein, 20 aa, Mycobacterium
GIDLRADWPTALKDAGFDTT

SEQ ID NO: 766449 - protein, 19 aa, Mycobacterium
GIDPEVYSGFAFGMGLERT

SEQ ID NO: 766450 - protein, 20 aa, Mycobacterium
GIDPEVYSGFAFGMGLERTL

SEQ ID NO: 766451 - protein, 18 aa, Mycobacterium
GIDRWLLYGGSWASTLIL

SEQ ID NO: 766452 - protein, 23 aa, Mycobacterium
GIDSFCPIGPWIVTADEIPNPHD

SEQ ID NO: 766453 - protein, 17 aa, Mycobacterium
GIDTCLWLLGQGIAPER

SEQ ID NO: 766454 - protein, 20 aa, Mycobacterium
GIDTPEVWLPDSFGYSAAMP

SEQ ID NO: 766455 - protein, 19 aa, Mycobacterium
GIDTVVVGWGYGRADFPDG

SEQ ID NO: 766456 - protein, 17 aa, Mycobacterium
GIDTVVVGWGYGRADTF

SEQ ID NO: 766457 - protein, 18 aa, Mycobacterium
GIDVLWRKLAELAAPTDT

SEQ ID NO: 766458 - protein, 19 aa, Mycobacterium
GIDWCKRHLEVLGAGYQLS

SEQ ID NO: 766459 - protein, 19 aa, Mycobacterium
GIEEAERLLGYEVSRTGEQ

SEQ ID NO: 766460 - protein, 19 aa, Mycobacterium
GIEEAERLLGYEVTRTGEQ

SEQ ID NO: 766461 - protein, 17 aa, Mycobacterium
GIEFCRQRHNVAGLKFV

SEQ ID NO: 766462 - protein, 18 aa, Mycobacterium
GIELGRGGYLTVDRVSRT

SEQ ID NO: 766463 - protein, 17 aa, Mycobacterium
GIESLGYGAAWIGGSPD

SEQ ID NO: 766464 - protein, 17 aa, Mycobacterium
GIFPWYVPGADGFLGQF

SEQ ID NO: 766465 - protein, 19 aa, Mycobacterium
GIGALCWLPDIRRWATVVA

SEQ ID NO: 766466 - protein, 21 aa, Mycobacterium
GIGETIAEVFARDGAAVVAID

SEQ ID NO: 766467 - protein, 17 aa, Mycobacterium
GIGFCFAPLFHPSYRHT

SEQ ID NO: 766468 - protein, 25 aa, Mycobacterium
GIGGQGGAGGWLYGNGGIGGQGGAG

SEQ ID NO: 766469 - protein, 17 aa, Mycobacterium
GIGKRGAERMVLELRDK

SEQ ID NO: 766470 - protein, 18 aa, Mycobacterium
GIGPLRWLPATPALLADD

SEQ ID NO: 766471 - protein, 19 aa, Mycobacterium
GIGPLRWLPATPTLLANDP

SEQ ID NO: 766472 - protein, 17 aa, Mycobacterium
GIHRLRFDTATYFAAQQ

SEQ ID NO: 766473 - protein, 21 aa, Mycobacterium
GIHVFLRIATDWDFIEVRRAG

SEQ ID NO: 766474 - protein, 21 aa, Mycobacterium
GIHVYLRIAARWDFIEVRRAG

SEQ ID NO: 766475 - protein, 21 aa, Mycobacterium
GIKDFRFIACLSESADGEVPG

SEQ ID NO: 766476 - protein, 21 aa, Mycobacterium
GIKKLSVRVGIVPPGKNSAPT

SEQ ID NO: 766477 - protein, 18 aa, Mycobacterium
GILFSHAGADGSTGAPGA

SEQ ID NO: 766478 - protein, 17 aa, Mycobacterium
GILPPLFSGLIRMPAKR

SEQ ID NO: 766479 - protein, 23 aa, Mycobacterium
GILTSRFGARWGTLHAGLDIANA

SEQ ID NO: 766480 - protein, 21 aa, Mycobacterium
GINFCRRRHNIAGLEFVQGDA

SEQ ID NO: 766481 - protein, 18 aa, Mycobacterium
GIPEQLRYAAMLDPEELL

SEQ ID NO: 766482 - protein, 20 aa, Mycobacterium
GIPGRLSWLVLRHLYAAALR

SEQ ID NO: 766483 - protein, 17 aa, Mycobacterium
GIRCTWLATSHAFHSEL

SEQ ID NO: 766484 - protein, 24 aa, Mycobacterium
GIRGFEVLEALPFDERRLRQALNA

SEQ ID NO: 766485 - protein, 17 aa, Mycobacterium
GIRSIPTIMAFRDGVLV

SEQ ID NO: 766486 - protein, 17 aa, Mycobacterium
GISLLAFNDHTHLIGDG

SEQ ID NO: 766487 - protein, 23 aa, Mycobacterium
GISRLRFRLRWRDFGVTVDANHS

SEQ ID NO: 766488 - protein, 24 aa, Mycobacterium
GISRLRFRLRWRDFRLTVDVNHSD

SEQ ID NO: 766489 - protein, 23 aa, Mycobacterium
GISRRGLLELAWPALPPDTFSTA

SEQ ID NO: 766490 - protein, 18 aa, Mycobacterium
GIVFFKYLLGMPVDDVPL

SEQ ID NO: 766491 - protein, 24 aa, Mycobacterium
GIVSRGGAVIADWCLLHNAESFLY

SEQ ID NO: 766492 - protein, 22 aa, Mycobacterium
GIYPPCSAFEAWFVSTALDDDA

SEQ ID NO: 766493 - protein, 20 aa, Mycobacterium
GIYQPGWKWSVHVGPTTGRA

SEQ ID NO: 766494 - protein, 21 aa, Mycobacterium
GKAALRRYWIAALERIPDLRF

SEQ ID NO: 766495 - protein, 17 aa, Mycobacterium
GKACGRKLAELGYDVVL

SEQ ID NO: 766496 - protein, 19 aa, Mycobacterium
GKADYRWAKEVSETEKVDL

SEQ ID NO: 766497 - protein, 21 aa, Mycobacterium
GKAEKCTLCYPRIEVGLPTVC

SEQ ID NO: 766498 - protein, 21 aa, Mycobacterium
GKAEKCTLCYPRIEVGMPTVC

SEQ ID NO: 766499 - protein, 21 aa, Mycobacterium
GKAEKCTLCYPRMEVGLPTIC

SEQ ID NO: 766500 - protein, 17 aa, Mycobacterium
GKAWTGGDFGRVLMQYD

SEQ ID NO: 766501 - protein, 19 aa, Mycobacterium
GKAWWVGNIVYLWDGEHYV

SEQ ID NO: 766502 - protein, 17 aa, Mycobacterium
GKCHGYMACLPRGRVRV

SEQ ID NO: 766503 - protein, 29 aa, Mycobacterium
GKCIAAGLMLCWPCDLIVAADNARFSDPV

SEQ ID NO: 766504 - protein, 24 aa, Mycobacterium
GKDTWRFVVDFPFDDQGHSVRDDD

SEQ ID NO: 766505 - protein, 30 aa, Mycobacterium
GKELIWAPGQWRFVMSVLRHVPRPLFRKLP

SEQ ID NO: 766506 - protein, 19 aa, Mycobacterium
GKFPGQWWGPASWRRKPHR

SEQ ID NO: 766507 - protein, 19 aa, Mycobacterium
GKGATGWFGASRATVYVDH

SEQ ID NO: 766508 - protein, 19 aa, Mycobacterium
GKGGDGFSPATSGQDGGSG

SEQ ID NO: 766509 - protein, 18 aa, Mycobacterium
GKGHGYMACLPRGRVRAV

SEQ ID NO: 766510 - protein, 18 aa, Mycobacterium
GKGKAGFVARAKELAAKY

SEQ ID NO: 766511 - protein, 21 aa, Mycobacterium
GKGTPGWRWLDVRALATRLVT

SEQ ID NO: 766512 - protein, 17 aa, Mycobacterium
GKIPRADVAAVLVAVLD

SEQ ID NO: 766513 - protein, 19 aa, Mycobacterium
GKIREAWNVPRDPNGAPAI

SEQ ID NO: 766514 - protein, 17 aa, Mycobacterium
GKIVFRAAFGARKLDGE

SEQ ID NO: 766515 - protein, 21 aa, Mycobacterium
GKLARSACRAEYLAGKYDPVA

SEQ ID NO: 766516 - protein, 17 aa, Mycobacterium
GKLDLRAAAAFKVTAAR

SEQ ID NO: 766517 - protein, 18 aa, Mycobacterium
GKLHPLHILQFLSNTDKH

SEQ ID NO: 766518 - protein, 19 aa, Mycobacterium
GKLLHRLGEIIAREADQLA

SEQ ID NO: 766519 - protein, 17 aa, Mycobacterium
GKLLPRDRVDALLDPGS

SEQ ID NO: 766520 - protein, 17 aa, Mycobacterium
GKLLPRDRVDGLLDPGS

SEQ ID NO: 766521 - protein, 18 aa, Mycobacterium
GKLLRYGAEFEALRDRSD

SEQ ID NO: 766522 - protein, 20 aa, Mycobacterium
GKLNRKALREWVISSPAAGV

SEQ ID NO: 766523 - protein, 20 aa, Mycobacterium
GKLPRLSKRLGVLTRTNSES

SEQ ID NO: 766524 - protein, 19 aa, Mycobacterium
GKLRKVLVCSPGLAHERLT

SEQ ID NO: 766525 - protein, 18 aa, Mycobacterium
GKLYLCAIKDVFSNRIVG

SEQ ID NO: 766526 - protein, 22 aa, Mycobacterium
GKMIRFVVCRKGGRHVVAARDN

SEQ ID NO: 766527 - protein, 19 aa, Mycobacterium
GKNEFGWIWSHCRHYLFDP

SEQ ID NO: 766528 - protein, 27 aa, Mycobacterium
GKPAKLVSKRGWRRWVHSITRINVGLS

SEQ ID NO: 766529 - protein, 19 aa, Mycobacterium
GKPDYRWAKDVTEERPADE

SEQ ID NO: 766530 - protein, 21 aa, Mycobacterium
GKPGAGLCPVRGHSNVQGDRT

SEQ ID NO: 766531 - protein, 19 aa, Mycobacterium
GKPKLRVVDTIDIGSAVRD

SEQ ID NO: 766532 - protein, 21 aa, Mycobacterium
GKPLAGPGWYYPPTVITDITK

SEQ ID NO: 766533 - protein, 18 aa, Mycobacterium
GKPSLAWRGRRAAHKVTA

SEQ ID NO: 766534 - protein, 23 aa, Mycobacterium
GKQEGRAGLSWVLDPIDGTVNFV

SEQ ID NO: 766535 - protein, 19 aa, Mycobacterium
GKRIVPVCSMIGTVLKKHP

SEQ ID NO: 766536 - protein, 24 aa, Mycobacterium
GKRLFAAGLWSVWKPAKGAVPLLS

SEQ ID NO: 766537 - protein, 21 aa, Mycobacterium
GKRLGSCIGVYAFYDFDGEPI

SEQ ID NO: 766538 - protein, 22 aa, Mycobacterium
GKRPPGHLWRWELRPLDDDRTQ

SEQ ID NO: 766539 - protein, 24 aa, Mycobacterium
GKRRLALDHLPRLATALSVTTDDL

SEQ ID NO: 766540 - protein, 18 aa, Mycobacterium
GKRRSWAVLGEMAELGDD

SEQ ID NO: 766541 - protein, 23 aa, Mycobacterium
GKSARPGGHFSLPALQLLISGLP

SEQ ID NO: 766542 - protein, 19 aa, Mycobacterium
GKSRRGRLAAGATLGALAL

SEQ ID NO: 766543 - protein, 17 aa, Mycobacterium
GKSVRSAHAVFCRAVIV

SEQ ID NO: 766544 - protein, 17 aa, Mycobacterium
GKSWFALACAAAELATG

SEQ ID NO: 766545 - protein, 18 aa, Mycobacterium
GKTARFAIESSYNPYSSE

SEQ ID NO: 766546 - protein, 20 aa, Mycobacterium
GKTFPLPSPFLVMATQNPIE

SEQ ID NO: 766547 - protein, 17 aa, Mycobacterium
GKTRFALRIATELLADG

SEQ ID NO: 766548 - protein, 25 aa, Mycobacterium
GKTRKGGACSCGWRTPPFDPVGDRA

SEQ ID NO: 766549 - protein, 17 aa, Mycobacterium
GKTTGWVHRASLKAKGV

SEQ ID NO: 766550 - protein, 17 aa, Mycobacterium
GKTTLLRLVAGFENPDA

SEQ ID NO: 766551 - protein, 22 aa, Mycobacterium
GKTVCARAAAATGAASTGVAPG

SEQ ID NO: 766552 - protein, 18 aa, Mycobacterium
GKVALLLGHILADRGDQV

SEQ ID NO: 766553 - protein, 18 aa, Mycobacterium
GKVIPGREGEAWYLDEFG

SEQ ID NO: 766554 - protein, 17 aa, Mycobacterium
GKVKWSAPLGFLAQTPP

SEQ ID NO: 766555 - protein, 23 aa, Mycobacterium
GKWPHIWRIVGEYANYSIFDVDS

SEQ ID NO: 766556 - protein, 23 aa, Mycobacterium
GKYNARCGRTFVLPTEQGAYDAC

SEQ ID NO: 766557 - protein, 18 aa, Mycobacterium
GLAAFRRAGGRIVESVSP

SEQ ID NO: 766558 - protein, 19 aa, Mycobacterium
GLAAFRRAGGRIVETVPPT

SEQ ID NO: 766559 - protein, 17 aa, Mycobacterium
GLAARIVADLGISADDM

SEQ ID NO: 766560 - protein, 19 aa, Mycobacterium
GLAAWRLGAGRSRPGDRVQ

SEQ ID NO: 766561 - protein, 19 aa, Mycobacterium
GLAGLRIGYAVADPDIVTA

SEQ ID NO: 766562 - protein, 24 aa, Mycobacterium
GLAGLRVGYGVGHPELITALDKVV

SEQ ID NO: 766563 - protein, 17 aa, Mycobacterium
GLAGQVWQGAAAAAMAA

SEQ ID NO: 766564 - protein, 26 aa, Mycobacterium
GLAGTVLRFLPPVAALRHAPTVFDGD

SEQ ID NO: 766565 - protein, 24 aa, Mycobacterium
GLAGTVLRFVPPIAALSAQTVTFD

SEQ ID NO: 766566 - protein, 25 aa, Mycobacterium
GLAGTVLRFVPPVAALSRSSVTFDG

SEQ ID NO: 766567 - protein, 17 aa, Mycobacterium
GLAKARWCIAGNYRSRL

SEQ ID NO: 766568 - protein, 17 aa, Mycobacterium
GLAMDWGICGVGVLPDD

SEQ ID NO: 766569 - protein, 20 aa, Mycobacterium
GLAPWFCWSESAVGTNGIGT

SEQ ID NO: 766570 - protein, 17 aa, Mycobacterium
GLARAIADIAARARSGN

SEQ ID NO: 766571 - protein, 22 aa, Mycobacterium
GLARFCSLRSWLSQWSYDDARG

SEQ ID NO: 766572 - protein, 17 aa, Mycobacterium
GLARFCTLRSWLSQWSY

SEQ ID NO: 766573 - protein, 26 aa, Mycobacterium
GLARHVLCFRTLWEATFGQLVKEGKM

SEQ ID NO: 766574 - protein, 25 aa, Mycobacterium
GLARHVLCFRTLWEATFNELMKQGR

SEQ ID NO: 766575 - protein, 25 aa, Mycobacterium
GLARHVLCFRTLWEATYNELMKRGK

SEQ ID NO: 766576 - protein, 22 aa, Mycobacterium
GLARTLCEGMLTWAHERGATRA

SEQ ID NO: 766577 - protein, 17 aa, Mycobacterium
GLASLGLDGVRLDDTPD

SEQ ID NO: 766578 - protein, 21 aa, Mycobacterium
GLASLPARIAVRWRHTHDFED

SEQ ID NO: 766579 - protein, 18 aa, Mycobacterium
GLASVRYLLAVGDLIIGW

SEQ ID NO: 766580 - protein, 17 aa, Mycobacterium
GLATGRWLVRRGARHLV

SEQ ID NO: 766581 - protein, 21 aa, Mycobacterium
GLAVLRAWNDWHLEVWAGAYP

SEQ ID NO: 766582 - protein, 17 aa, Mycobacterium
GLCFGRLDAITGERSYV

SEQ ID NO: 766583 - protein, 18 aa, Mycobacterium
GLCGKGTPGWRWLDVRAL

SEQ ID NO: 766584 - protein, 18 aa, Mycobacterium
GLCPLRPAILGALANRTR

SEQ ID NO: 766585 - protein, 18 aa, Mycobacterium
GLCRLLARRGVRVAPFKA

SEQ ID NO: 766586 - protein, 18 aa, Mycobacterium
GLDFKRFVNEVADGSARI

SEQ ID NO: 766587 - protein, 19 aa, Mycobacterium
GLDGWRPDIVHAHDWLVAH

SEQ ID NO: 766588 - protein, 19 aa, Mycobacterium
GLDHLRKVVGWARDRGVLV

SEQ ID NO: 766589 - protein, 18 aa, Mycobacterium
GLDLFKTKWEDVGDAIKN

SEQ ID NO: 766590 - protein, 22 aa, Mycobacterium
GLDLLPRLLLRGGDRGDELDVA

SEQ ID NO: 766591 - protein, 20 aa, Mycobacterium
GLDLRPASSLAECLQLAADH

SEQ ID NO: 766592 - protein, 18 aa, Mycobacterium
GLDNAFRRRWFGWINPAQ

SEQ ID NO: 766593 - protein, 19 aa, Mycobacterium
GLDRFVQKRVDGITLRQEH

SEQ ID NO: 766594 - protein, 23 aa, Mycobacterium
GLDTRAWRLPWLNDTVIFEVDRP

SEQ ID NO: 766595 - protein, 22 aa, Mycobacterium
GLEGDRRFHLGVAVAAHNPLLL

SEQ ID NO: 766596 - protein, 18 aa, Mycobacterium
GLEGGVAEFGRWHTRVRG

SEQ ID NO: 766597 - protein, 18 aa, Mycobacterium
GLEKLAKLGVTWVSVHLP

SEQ ID NO: 766598 - protein, 22 aa, Mycobacterium
GLELALACDFIWSAENVSMGLV

SEQ ID NO: 766599 - protein, 17 aa, Mycobacterium
GLELARALVKEWLGLEF

SEQ ID NO: 766600 - protein, 25 aa, Mycobacterium
GLELARRLAREWLGYEFDPTSKSAE

SEQ ID NO: 766601 - protein, 19 aa, Mycobacterium
GLELLAWGGRFVEIGKRDI

SEQ ID NO: 766602 - protein, 18 aa, Mycobacterium
GLELLGFPVGDPRPPLLP

SEQ ID NO: 766603 - protein, 17 aa, Mycobacterium
GLEMWKAIIDGIIEYAE

SEQ ID NO: 766604 - protein, 21 aa, Mycobacterium
GLEPPRFCAVCGRRMTVQVRP

SEQ ID NO: 766605 - protein, 18 aa, Mycobacterium
GLERIRWRLDVWNASAQV

SEQ ID NO: 766606 - protein, 18 aa, Mycobacterium
GLERVWRPLADKLDVHAY

SEQ ID NO: 766607 - protein, 17 aa, Mycobacterium
GLFDANLLASVLTVQVL

SEQ ID NO: 766608 - protein, 20 aa, Mycobacterium
GLFFRDARVLSRWQLHVDGG

SEQ ID NO: 766609 - protein, 21 aa, Mycobacterium
GLFKLCGRLDYRLPDTPIVSA

SEQ ID NO: 766610 - protein, 21 aa, Mycobacterium
GLGGAGGRGGYLIGSGGNGGA

SEQ ID NO: 766611 - protein, 21 aa, Mycobacterium
GLGGLGLVVARWLVDSGAGRV

SEQ ID NO: 766612 - protein, 18 aa, Mycobacterium
GLGGLVYGNGGGGGAGGV

SEQ ID NO: 766613 - protein, 18 aa, Mycobacterium
GLGKRYLIVLPFLTPAIA

SEQ ID NO: 766614 - protein, 22 aa, Mycobacterium
GLGLPQLLALNALGAPVNAGLA

SEQ ID NO: 766615 - protein, 17 aa, Mycobacterium
GLGSRFGGVDGLRKYCR

SEQ ID NO: 766616 - protein, 17 aa, Mycobacterium
GLGTGDRVLLCLPDSPE

SEQ ID NO: 766617 - protein, 31 aa, Mycobacterium
GLGTWRFHVERSGSISWFGLDGMEHPGGTAD

SEQ ID NO: 766618 - protein, 17 aa, Mycobacterium
GLGWRLVLATGRGELGG

SEQ ID NO: 766619 - protein, 18 aa, Mycobacterium
GLHTGLWAQYLLDQAATV

SEQ ID NO: 766620 - protein, 18 aa, Mycobacterium
GLIAEFGISWILPRLTTW

SEQ ID NO: 766621 - protein, 21 aa, Mycobacterium
GLIAPHWPRPWGVEATQLQLL

SEQ ID NO: 766622 - protein, 18 aa, Mycobacterium
GLIAPRFTMRQGRRILIP

SEQ ID NO: 766623 - protein, 17 aa, Mycobacterium
GLIESWTPIPGRFPSYL

SEQ ID NO: 766624 - protein, 27 aa, Mycobacterium
GLIIPWNFPLLLAMWKLAPALAAGNTV

SEQ ID NO: 766625 - protein, 17 aa, Mycobacterium
GLIKAAWIEDWRLPAAP

SEQ ID NO: 766626 - protein, 18 aa, Mycobacterium
GLIPRVRFEFDRSAVKGV

SEQ ID NO: 766627 - protein, 19 aa, Mycobacterium
GLIRMKFALACYGTRGDVE

SEQ ID NO: 766628 - protein, 20 aa, Mycobacterium
GLIRRVPWPLAEATYDLLVP

SEQ ID NO: 766629 - protein, 17 aa, Mycobacterium
GLISSWKAYAPAWAGKV

SEQ ID NO: 766630 - protein, 20 aa, Mycobacterium
GLIWEIAHNPGWRIDADGSV

SEQ ID NO: 766631 - protein, 24 aa, Mycobacterium
GLKDPRRPSGSFIFAGPSGVGKTE

SEQ ID NO: 766632 - protein, 18 aa, Mycobacterium
GLKGWFQRWFFTAVGQVP

SEQ ID NO: 766633 - protein, 19 aa, Mycobacterium
GLKPRKAFGPIRVGATGTT

SEQ ID NO: 766634 - protein, 19 aa, Mycobacterium
GLKVFGYHGVFEHERRDGQ

SEQ ID NO: 766635 - protein, 20 aa, Mycobacterium
GLKVGDIFAGYTIVRLLGAG

SEQ ID NO: 766636 - protein, 26 aa, Mycobacterium
GLKVSIPEEVAWRLGWIDDEQLARHA

SEQ ID NO: 766637 - protein, 20 aa, Mycobacterium
GLLAPHWPKPYGRNASPAEQ

SEQ ID NO: 766638 - protein, 17 aa, Mycobacterium
GLLEFGPNSLPPIVQLN

SEQ ID NO: 766639 - protein, 18 aa, Mycobacterium
GLLFCAACGRRMQGAARP

SEQ ID NO: 766640 - protein, 18 aa, Mycobacterium
GLLFCAACGRRMQGAARV

SEQ ID NO: 766641 - protein, 18 aa, Mycobacterium
GLLGCYRDFFGISHGAGL

SEQ ID NO: 766642 - protein, 18 aa, Mycobacterium
GLLGGFGVLHFDNGKFTV

SEQ ID NO: 766643 - protein, 17 aa, Mycobacterium
GLLGRPLIGDGADGAPG

SEQ ID NO: 766644 - protein, 18 aa, Mycobacterium
GLLLCLERAKLVVEPAGA

SEQ ID NO: 766645 - protein, 18 aa, Mycobacterium
GLLLPLGVRSLRIYGPTR

SEQ ID NO: 766646 - protein, 21 aa, Mycobacterium
GLLPGPWRLLRVVGHYYRPGF

SEQ ID NO: 766647 - protein, 18 aa, Mycobacterium
GLLRIWKSLIVLYPDGTP

SEQ ID NO: 766648 - protein, 25 aa, Mycobacterium
GLLRLPERIPYAIAMELALTGDNLP

SEQ ID NO: 766649 - protein, 25 aa, Mycobacterium
GLLRLPERIPYAIAMELALTGDNLS

SEQ ID NO: 766650 - protein, 22 aa, Mycobacterium
GLLSLPYPEEWGGGGQPYEVYL

SEQ ID NO: 766651 - protein, 23 aa, Mycobacterium
GLLSRPSVNNVLRVAPRQFKMPR

SEQ ID NO: 766652 - protein, 19 aa, Mycobacterium
GLLTRFAGYTGLPASGQTT

SEQ ID NO: 766653 - protein, 25 aa, Mycobacterium
GLLYLAGPMAWTFGLPIVPMLNPGS

SEQ ID NO: 766654 - protein, 22 aa, Mycobacterium
GLMAERWLSAGYCVLVIDPEGD

SEQ ID NO: 766655 - protein, 19 aa, Mycobacterium
GLMAVYWDRYILPRRAQAR

SEQ ID NO: 766656 - protein, 18 aa, Mycobacterium
GLMCAFSLPTAEERDHLV

SEQ ID NO: 766657 - protein, 18 aa, Mycobacterium
GLMHVRFGPYHVRDVKFV

SEQ ID NO: 766658 - protein, 22 aa, Mycobacterium
GLMKRLPWLSAVPAYFVGVGVL

SEQ ID NO: 766659 - protein, 18 aa, Mycobacterium
GLMLGLCAPVLGGWHTVL

SEQ ID NO: 766660 - protein, 17 aa, Mycobacterium
GLMLIEIHLMYAALVSG

SEQ ID NO: 766661 - protein, 18 aa, Mycobacterium
GLNHEFHRAINIAADSPK

SEQ ID NO: 766662 - protein, 18 aa, Mycobacterium
GLNNQIFGAKGTPNGAAG

SEQ ID NO: 766663 - protein, 25 aa, Mycobacterium
GLNVWREWWNGLPIFDEHVDQIVSW

SEQ ID NO: 766664 - protein, 21 aa, Mycobacterium
GLPAARIDFMLADAAPAAVLT

SEQ ID NO: 766665 - protein, 19 aa, Mycobacterium
GLPAPRFGTATTFEQAKQI

SEQ ID NO: 766666 - protein, 24 aa, Mycobacterium
GLPDLPLKVGDTWEEAGPDGDRIF

SEQ ID NO: 766667 - protein, 18 aa, Mycobacterium
GLPEVKRGLIAGAGGVFR

SEQ ID NO: 766668 - protein, 26 aa, Mycobacterium
GLPFPLSSAILPRFLYTKQIGQRLNS

SEQ ID NO: 766669 - protein, 24 aa, Mycobacterium
GLPLPIIAGNLFRFELLRTRHDLR

SEQ ID NO: 766670 - protein, 23 aa, Mycobacterium
GLPLTLWLARFLKFIQTEIFPGG

SEQ ID NO: 766671 - protein, 22 aa, Mycobacterium
GLPNRRRIAVVTVHGPIVSGRG

SEQ ID NO: 766672 - protein, 20 aa, Mycobacterium
GLPPALVVTAGFDPLRDEGN

SEQ ID NO: 766673 - protein, 18 aa, Mycobacterium
GLPPKRRYEVLKALDDDR

SEQ ID NO: 766674 - protein, 17 aa, Mycobacterium
GLPPNRVTLIWNAATDN

SEQ ID NO: 766675 - protein, 22 aa, Mycobacterium
GLPQPRRVAVLSVHTSPLAQPG

SEQ ID NO: 766676 - protein, 17 aa, Mycobacterium
GLPSCTGTASAAVAIQQ

SEQ ID NO: 766677 - protein, 18 aa, Mycobacterium
GLPSFAFRSQFRTWLYSL

SEQ ID NO: 766678 - protein, 24 aa, Mycobacterium
GLPTARIEFMLADAIPIAAVTTAG

SEQ ID NO: 766679 - protein, 22 aa, Mycobacterium
GLPVKVFRSGMIMVDTSYAGQV

SEQ ID NO: 766680 - protein, 18 aa, Mycobacterium
GLPVLGLCLGLQCIVIEA

SEQ ID NO: 766681 - protein, 22 aa, Mycobacterium
GLPYRWPHPWLLDKKSAAQQQQ

SEQ ID NO: 766682 - protein, 19 aa, Mycobacterium
GLPYRWPHPWLVDQQGARQ

SEQ ID NO: 766683 - protein, 20 aa, Mycobacterium
GLPYRWPHPWLVDTKTAAEQ

SEQ ID NO: 766684 - protein, 20 aa, Mycobacterium
GLQARFAPAIRRMRELVDAG

SEQ ID NO: 766685 - protein, 19 aa, Mycobacterium
GLQARFGLDAGKWTAEQMA

SEQ ID NO: 766686 - protein, 19 aa, Mycobacterium
GLQARFGLDSGKWTAEQMA

SEQ ID NO: 766687 - protein, 18 aa, Mycobacterium
GLQARIGLDTGKWNEEQM

SEQ ID NO: 766688 - protein, 18 aa, Mycobacterium
GLQARLGLDSGKWTHEQM

SEQ ID NO: 766689 - protein, 21 aa, Mycobacterium
GLQIRLDWDRGFELIAPTAAA

SEQ ID NO: 766690 - protein, 18 aa, Mycobacterium
GLQWSWSRYLAGAAVRAA

SEQ ID NO: 766691 - protein, 19 aa, Mycobacterium
GLRARWDALQASFVDNPKQ

SEQ ID NO: 766692 - protein, 17 aa, Mycobacterium
GLRGAPVLIGRSAVACD

SEQ ID NO: 766693 - protein, 18 aa, Mycobacterium
GLRISIAVLRAGVRDSVA

SEQ ID NO: 766694 - protein, 19 aa, Mycobacterium
GLRLRLPIIATTLGTYETA

SEQ ID NO: 766695 - protein, 19 aa, Mycobacterium
GLRLRLPIIGTDLGTFDTA

SEQ ID NO: 766696 - protein, 18 aa, Mycobacterium
GLRPDVRRVPLFGLGCVA

SEQ ID NO: 766697 - protein, 20 aa, Mycobacterium
GLRVGWFEGGIAWVPTALQD

SEQ ID NO: 766698 - protein, 18 aa, Mycobacterium
GLSALVRRGPGWIGGADP

SEQ ID NO: 766699 - protein, 17 aa, Mycobacterium
GLSFLPIAIVVDYELTV

SEQ ID NO: 766700 - protein, 24 aa, Mycobacterium
GLSFQLAEGIALLSKVDWRERGLA

SEQ ID NO: 766701 - protein, 22 aa, Mycobacterium
GLSSRAEWLPAWEDGLARAGKA

SEQ ID NO: 766702 - protein, 19 aa, Mycobacterium
GLSSRAEWLPAWQDGLQRA

SEQ ID NO: 766703 - protein, 24 aa, Mycobacterium
GLSWWGNFGEFGFLTKLRSEQLRD

SEQ ID NO: 766704 - protein, 18 aa, Mycobacterium
GLSYQLAEGIALLSKVDW

SEQ ID NO: 766705 - protein, 27 aa, Mycobacterium
GLTADEWRGPSALSMAAAAAPYVTWMR

SEQ ID NO: 766706 - protein, 17 aa, Mycobacterium
GLTGKFVRTIFESPRSG

SEQ ID NO: 766707 - protein, 24 aa, Mycobacterium
GLTGNSWRGPAAAVMSDVAASYVG

SEQ ID NO: 766708 - protein, 18 aa, Mycobacterium
GLTGRPLIGNGANGAAGT

SEQ ID NO: 766709 - protein, 18 aa, Mycobacterium
GLTLPEFVCLRMLSMFPG

SEQ ID NO: 766710 - protein, 18 aa, Mycobacterium
GLTRAVLRGGDYVGVHAI

SEQ ID NO: 766711 - protein, 19 aa, Mycobacterium
GLTRRLPTLTVRVIEDQTE

SEQ ID NO: 766712 - protein, 18 aa, Mycobacterium
GLTSMYWAGPASESMAAK

SEQ ID NO: 766713 - protein, 18 aa, Mycobacterium
GLVANLFAFDALRAARLE

SEQ ID NO: 766714 - protein, 18 aa, Mycobacterium
GLVGGMAVPPSWATATPA

SEQ ID NO: 766715 - protein, 18 aa, Mycobacterium
GLVGHGFGASAAVFAAAG

SEQ ID NO: 766716 - protein, 18 aa, Mycobacterium
GLVGRAWLRAGHRFLGAQ

SEQ ID NO: 766717 - protein, 23 aa, Mycobacterium
GLVKEIKINWVWVPPWGPDKITD

SEQ ID NO: 766718 - protein, 24 aa, Mycobacterium
GLVLPRRLQIEFAQSIQRITDGEG

SEQ ID NO: 766719 - protein, 19 aa, Mycobacterium
GLVRPSLNIAEWILPSVLA

SEQ ID NO: 766720 - protein, 20 aa, Mycobacterium
GLWMSLRVARRLEQRDIAVR

SEQ ID NO: 766721 - protein, 19 aa, Mycobacterium
GLWNKWGRYGLFNFHSHTN

SEQ ID NO: 766722 - protein, 24 aa, Mycobacterium
GLWNRAELFGGLSVITPAELHTLA

SEQ ID NO: 766723 - protein, 17 aa, Mycobacterium
GLWTTWRPPGAPKDHAP

SEQ ID NO: 766724 - protein, 25 aa, Mycobacterium
GLYHFAWDEFCDWYLELAKVQMVDR

SEQ ID NO: 766725 - protein, 22 aa, Mycobacterium
GLYPCPPFALLDGQDHWLLRPP

SEQ ID NO: 766726 - protein, 18 aa, Mycobacterium
GLYTTALQRIWSLLDDDP

SEQ ID NO: 766727 - protein, 26 aa, Mycobacterium
GMARHVLCFRTLWEATFNQLMKEGKA

SEQ ID NO: 766728 - protein, 20 aa, Mycobacterium
GMDGLWFAGSWCGHGFSTSV

SEQ ID NO: 766729 - protein, 23 aa, Mycobacterium
GMFTDRHALALGDGNAFLDGQMQ

SEQ ID NO: 766730 - protein, 25 aa, Mycobacterium
GMGGNGGSGSWLIGGGGAGGAGGIG

SEQ ID NO: 766731 - protein, 18 aa, Mycobacterium
GMGPRGGPGTVFAASFVA

SEQ ID NO: 766732 - protein, 18 aa, Mycobacterium
GMHPWGKWGRDFTEYGVV

SEQ ID NO: 766733 - protein, 18 aa, Mycobacterium
GMIGGGLARLWRDSGHDV

SEQ ID NO: 766734 - protein, 21 aa, Mycobacterium
GMIPLCYDWLCGMVVSTAGIP

SEQ ID NO: 766735 - protein, 22 aa, Mycobacterium
GMKDLQRLPGLVAIAYQHETSR

SEQ ID NO: 766736 - protein, 24 aa, Mycobacterium
GMKIRLSFLSGFVLDGLPGWRDTM

SEQ ID NO: 766737 - protein, 17 aa, Mycobacterium
GMLALTGYYAWHRICVD

SEQ ID NO: 766738 - protein, 19 aa, Mycobacterium
GMLLKLRFALDHHVNLRPG

SEQ ID NO: 766739 - protein, 18 aa, Mycobacterium
GMLRPAWEQVKAANFPYR

SEQ ID NO: 766740 - protein, 24 aa, Mycobacterium
GMLRRRLGLDTAWIASFRSGMQVF

SEQ ID NO: 766741 - protein, 18 aa, Mycobacterium
GMPAVAWAGPGGYGTGPR

SEQ ID NO: 766742 - protein, 21 aa, Mycobacterium
GMPISFTFARFIKFIVTEIFP

SEQ ID NO: 766743 - protein, 21 aa, Mycobacterium
GMPLSGLRVGDWVVDPRWWDG

SEQ ID NO: 766744 - protein, 18 aa, Mycobacterium
GMPVMPGSGVGRGMAAHF

SEQ ID NO: 766745 - protein, 20 aa, Mycobacterium
GMSAGLWPSVMQNNLPGSAG

SEQ ID NO: 766746 - protein, 20 aa, Mycobacterium
GMSYHLPRIVGAGVAADWML

SEQ ID NO: 766747 - protein, 20 aa, Mycobacterium
GMSYHLPRIVGTSVAADWML

SEQ ID NO: 766748 - protein, 19 aa, Mycobacterium
GMVPLKWISARNFGCDGEP

SEQ ID NO: 766749 - protein, 18 aa, Mycobacterium
GMVPPHLRDGHYSGAAAL

SEQ ID NO: 766750 - protein, 24 aa, Mycobacterium
GMVRCVRAALPLLRAAEWARIVNF

SEQ ID NO: 766751 - protein, 25 aa, Mycobacterium
GMVRCVRAALPLLRKAQWARIVNFS

SEQ ID NO: 766752 - protein, 23 aa, Mycobacterium
GMVWKYPDPFLIGREQIRQYAKA

SEQ ID NO: 766753 - protein, 17 aa, Mycobacterium
GMWLYRLSFAKAKWHSL

SEQ ID NO: 766754 - protein, 18 aa, Mycobacterium
GMYELEFPAPQLSSSDGR

SEQ ID NO: 766755 - protein, 18 aa, Mycobacterium
GMYELEFPAPQLSTSDGR

SEQ ID NO: 766756 - protein, 17 aa, Mycobacterium
GNAGFRWLVESAPVDDP

SEQ ID NO: 766757 - protein, 23 aa, Mycobacterium
GNAQPAGWFRFHFTDQRWEWSEQ

SEQ ID NO: 766758 - protein, 19 aa, Mycobacterium
GNARIAVQFVLNYEEGAEN

SEQ ID NO: 766759 - protein, 23 aa, Mycobacterium
GNAVCPPVMIAMMGALNGPDAAL

SEQ ID NO: 766760 - protein, 23 aa, Mycobacterium
GNAVLRYELQWPSPRAGFGACHD

SEQ ID NO: 766761 - protein, 19 aa, Mycobacterium
GNAVMFGNGGAGGMGGAGA

SEQ ID NO: 766762 - protein, 24 aa, Mycobacterium
GNCNRCIPCRRGSFMQCERMQVPS

SEQ ID NO: 766763 - protein, 19 aa, Mycobacterium
GNCPLWVVHEAFSNPGQFV

SEQ ID NO: 766764 - protein, 19 aa, Mycobacterium
GNCPLWVVHHAFSRPGQFL

SEQ ID NO: 766765 - protein, 17 aa, Mycobacterium
GNCPLWVVHQAFAQPGQ

SEQ ID NO: 766766 - protein, 17 aa, Mycobacterium
GNCRFCVNGQSYICDIG

SEQ ID NO: 766767 - protein, 18 aa, Mycobacterium
GNELPLVAGMAFSVEPGI

SEQ ID NO: 766768 - protein, 17 aa, Mycobacterium
GNFGVVVNFEFQAHPIP

SEQ ID NO: 766769 - protein, 17 aa, Mycobacterium
GNGCAQCVAGIKDRLQQ

SEQ ID NO: 766770 - protein, 18 aa, Mycobacterium
GNGFRIDAVWERVALTRK

SEQ ID NO: 766771 - protein, 22 aa, Mycobacterium
GNGGDATGFGMTGGDGAMGGAG

SEQ ID NO: 766772 - protein, 22 aa, Mycobacterium
GNGGFGGMALFIGSGGNGGAGG

SEQ ID NO: 766773 - protein, 18 aa, Mycobacterium
GNGGGLFNIGRGGDGGNG

SEQ ID NO: 766774 - protein, 17 aa, Mycobacterium
GNGGLGSAFGPGGTGGN

SEQ ID NO: 766775 - protein, 19 aa, Mycobacterium
GNGGLLFGHGGVGGLGGNG

SEQ ID NO: 766776 - protein, 25 aa, Mycobacterium
GNGGNAGAFALFGNGGNGGNGGVGV

SEQ ID NO: 766777 - protein, 23 aa, Mycobacterium
GNGGNGGLFGGNGGNGGNGLGGG

SEQ ID NO: 766778 - protein, 25 aa, Mycobacterium
GNGGNGGRGGLFGKGGNAGNGADGG

SEQ ID NO: 766779 - protein, 17 aa, Mycobacterium
GNGGRAGLFGGAGGAGG

SEQ ID NO: 766780 - protein, 29 aa, Mycobacterium
GNGLRPAIWDEFIERFGISRVCEFYAASE

SEQ ID NO: 766781 - protein, 18 aa, Mycobacterium
GNGNFGFGNSQATGGGNI

SEQ ID NO: 766782 - protein, 17 aa, Mycobacterium
GNGVWVFDAGVTRTADG

SEQ ID NO: 766783 - protein, 18 aa, Mycobacterium
GNGWFRFNGPVIAKGDSG

SEQ ID NO: 766784 - protein, 21 aa, Mycobacterium
GNGWLGRWLVLDWLERLAPNG

SEQ ID NO: 766785 - protein, 22 aa, Mycobacterium
GNHSPGGWFWRYDLQPDGDATA

SEQ ID NO: 766786 - protein, 17 aa, Mycobacterium
GNIGNSWFGKVASGFAG

SEQ ID NO: 766787 - protein, 18 aa, Mycobacterium
GNLAFRWFLADELPTRPE

SEQ ID NO: 766788 - protein, 17 aa, Mycobacterium
GNLARIGSSIGVANAAA

SEQ ID NO: 766789 - protein, 17 aa, Mycobacterium
GNLGRPGLAIVESDEDV

SEQ ID NO: 766790 - protein, 18 aa, Mycobacterium
GNLRARFNIALGIEASGF

SEQ ID NO: 766791 - protein, 18 aa, Mycobacterium
GNLRARFNIALGIGSSGF

SEQ ID NO: 766792 - protein, 21 aa, Mycobacterium
GNLRTAVLAWLFARSTGRRFL

SEQ ID NO: 766793 - protein, 22 aa, Mycobacterium
GNLRTAVLAWLFARSTGRRFLM

SEQ ID NO: 766794 - protein, 18 aa, Mycobacterium
GNPLLRWMVDNFAVAMDP

SEQ ID NO: 766795 - protein, 23 aa, Mycobacterium
GNPPGPCRAVGATDLTFAGGWKE

SEQ ID NO: 766796 - protein, 17 aa, Mycobacterium
GNPRPGVEIRLGPDGEI

SEQ ID NO: 766797 - protein, 20 aa, Mycobacterium
GNQPRPALLRVLDKTDPQIA

SEQ ID NO: 766798 - protein, 18 aa, Mycobacterium
GNRLLRTPLRGVGMALVE

SEQ ID NO: 766799 - protein, 17 aa, Mycobacterium
GNRRWARDAGYDDVSYG

SEQ ID NO: 766800 - protein, 20 aa, Mycobacterium
GNSWPMARLTLALSPATLPK

SEQ ID NO: 766801 - protein, 19 aa, Mycobacterium
GNTEWPKWEAVMAADPLDP

SEQ ID NO: 766802 - protein, 22 aa, Mycobacterium
GNTPLDYLSWLLGSTGNNTNPA

SEQ ID NO: 766803 - protein, 17 aa, Mycobacterium
GNVLRFLPPLSISDELL

SEQ ID NO: 766804 - protein, 18 aa, Mycobacterium
GNVLRFLPPLSMPDELLQ

SEQ ID NO: 766805 - protein, 24 aa, Mycobacterium
GNWAWRYDAIRAFPDFAVLWDDVD

SEQ ID NO: 766806 - protein, 17 aa, Mycobacterium
GNWTWRYDAIRKFPDFD

SEQ ID NO: 766807 - protein, 18 aa, Mycobacterium
GNYLTGWAVGVFRSPSGT

SEQ ID NO: 766808 - protein, 23 aa, Mycobacterium
GNYPFSIGPIYIWNDPSPIGTTV

SEQ ID NO: 766809 - protein, 17 aa, Mycobacterium
GPAADWLAPHGWQPFVG

SEQ ID NO: 766810 - protein, 20 aa, Mycobacterium
GPAAWWHAWAPADWDRLAGA

SEQ ID NO: 766811 - protein, 22 aa, Mycobacterium
GPAGLFGIGGTGGFGANIAGSG

SEQ ID NO: 766812 - protein, 18 aa, Mycobacterium
GPAGRVWVRITGHGTDGA

SEQ ID NO: 766813 - protein, 19 aa, Mycobacterium
GPAHLPGGFAVRYQPATRP

SEQ ID NO: 766814 - protein, 19 aa, Mycobacterium
GPAICKLEMFYDATIAHRQ

SEQ ID NO: 766815 - protein, 19 aa, Mycobacterium
GPAPARRAAVICLDRSANA

SEQ ID NO: 766816 - protein, 18 aa, Mycobacterium
GPAPPGLRRPRRLCRSKP

SEQ ID NO: 766817 - protein, 19 aa, Mycobacterium
GPAPWKPLLGMTGPTTLSI

SEQ ID NO: 766818 - protein, 17 aa, Mycobacterium
GPAPWKSVLGMTGPTTL

SEQ ID NO: 766819 - protein, 18 aa, Mycobacterium
GPARAFVGECRRRCASSP

SEQ ID NO: 766820 - protein, 17 aa, Mycobacterium
GPARAPMAVTVADTLIG

SEQ ID NO: 766821 - protein, 20 aa, Mycobacterium
GPARKALELTFRQALRLGHN

SEQ ID NO: 766822 - protein, 18 aa, Mycobacterium
GPCKMVAPVLEEIAAEKG

SEQ ID NO: 766823 - protein, 18 aa, Mycobacterium
GPCKMVAPVLEEIAKDHG

SEQ ID NO: 766824 - protein, 18 aa, Mycobacterium
GPCKMVAPVLEEIASEKA

SEQ ID NO: 766825 - protein, 19 aa, Mycobacterium
GPCLEGWMLLSALAQETSR

SEQ ID NO: 766826 - protein, 17 aa, Mycobacterium
GPCLEGWTTLTALAQAT

SEQ ID NO: 766827 - protein, 27 aa, Mycobacterium
GPDELRRWIPLLSRFRVVSVRGPRSAQ

SEQ ID NO: 766828 - protein, 21 aa, Mycobacterium
GPDFIICYRLSMADYVPDGQT

SEQ ID NO: 766829 - protein, 21 aa, Mycobacterium
GPDGWCSLSLHAGGTIGELRR

SEQ ID NO: 766830 - protein, 21 aa, Mycobacterium
GPDLPPLWEVFGARLRTDDRW

SEQ ID NO: 766831 - protein, 20 aa, Mycobacterium
GPDRSILRPASWDIDLPDQF

SEQ ID NO: 766832 - protein, 22 aa, Mycobacterium
GPDRSILRPASWDIDLPDQFTA

SEQ ID NO: 766833 - protein, 18 aa, Mycobacterium
GPDSVEWTAKYGSVVATG

SEQ ID NO: 766834 - protein, 17 aa, Mycobacterium
GPDWMCWDADQTFQQHG

SEQ ID NO: 766835 - protein, 19 aa, Mycobacterium
GPDWSHWPPRVLGHADPTT

SEQ ID NO: 766836 - protein, 18 aa, Mycobacterium
GPEAVWPDGWELMSRKYG

SEQ ID NO: 766837 - protein, 24 aa, Mycobacterium
GPEDLPALFLDFLENLPVIGTVVE

SEQ ID NO: 766838 - protein, 17 aa, Mycobacterium
GPEGLLTAAERVWSAAG

SEQ ID NO: 766839 - protein, 17 aa, Mycobacterium
GPEGLQFVGRVGTGFTE

SEQ ID NO: 766840 - protein, 22 aa, Mycobacterium
GPENTARYIARFNGANIIVSLL

SEQ ID NO: 766841 - protein, 18 aa, Mycobacterium
GPEPLSWQAASIAPESAC

SEQ ID NO: 766842 - protein, 18 aa, Mycobacterium
GPEPLSWQAVSIAPESAC

SEQ ID NO: 766843 - protein, 21 aa, Mycobacterium
GPEPYCPVGISPLFETIDDLH

SEQ ID NO: 766844 - protein, 21 aa, Mycobacterium
GPETFPTITIVGPTIDIGVGG

SEQ ID NO: 766845 - protein, 25 aa, Mycobacterium
GPEVARAALLFGMRFDAEAAVRHGL

SEQ ID NO: 766846 - protein, 19 aa, Mycobacterium
GPFGPRPGFGFGPGPAQRR

SEQ ID NO: 766847 - protein, 17 aa, Mycobacterium
GPFRLSALVGERMVAAG

SEQ ID NO: 766848 - protein, 17 aa, Mycobacterium
GPGAAVWIPKSTRHAFR

SEQ ID NO: 766849 - protein, 20 aa, Mycobacterium
GPGADDCAIWCSAIGGDGYG

SEQ ID NO: 766850 - protein, 24 aa, Mycobacterium
GPGDCVAVLFPRCADAIVSMLAVL

SEQ ID NO: 766851 - protein, 23 aa, Mycobacterium
GPGDLEKAWPLWEADGYLTRMSG

SEQ ID NO: 766852 - protein, 19 aa, Mycobacterium
GPGEIVWTWVVYEDDPTRG

SEQ ID NO: 766853 - protein, 20 aa, Mycobacterium
GPGGAPGCWQKISRDLWPAP

SEQ ID NO: 766854 - protein, 18 aa, Mycobacterium
GPGGERWEIYTVKADSET

SEQ ID NO: 766855 - protein, 17 aa, Mycobacterium
GPGGFRADNRFSDSGEQ

SEQ ID NO: 766856 - protein, 19 aa, Mycobacterium
GPGIKRIRRGRGFSYEKPD

SEQ ID NO: 766857 - protein, 20 aa, Mycobacterium
GPGLGTWWGSWRRFLPAGQD

SEQ ID NO: 766858 - protein, 21 aa, Mycobacterium
GPGLKELWVWPSGGIGQDQLF

SEQ ID NO: 766859 - protein, 18 aa, Mycobacterium
GPGQRVAVVIPRSAEAVI

SEQ ID NO: 766860 - protein, 23 aa, Mycobacterium
GPGQWCTLGLFAARDEPSLRKLL

SEQ ID NO: 766861 - protein, 18 aa, Mycobacterium
GPGRLVARLIQRGVPALG

SEQ ID NO: 766862 - protein, 23 aa, Mycobacterium
GPGRPRLAVVMSKFDVLRALNEV

SEQ ID NO: 766863 - protein, 21 aa, Mycobacterium
GPGRRAIVRQVSWAEQVEAVR

SEQ ID NO: 766864 - protein, 21 aa, Mycobacterium
GPGWWAAREAIEWTAEAQRQP

SEQ ID NO: 766865 - protein, 23 aa, Mycobacterium
GPIAEAWLPFHVPMSYHGAFTNR

SEQ ID NO: 766866 - protein, 17 aa, Mycobacterium
GPIAGTGAEMWVNVNPQ

SEQ ID NO: 766867 - protein, 18 aa, Mycobacterium
GPILTDWARPVLTSAGIA

SEQ ID NO: 766868 - protein, 17 aa, Mycobacterium
GPINWVIAKGMARAVNA

SEQ ID NO: 766869 - protein, 17 aa, Mycobacterium
GPIPLARLIPAGVDTRG

SEQ ID NO: 766870 - protein, 17 aa, Mycobacterium
GPIPRPVDWRWPWGEVL

SEQ ID NO: 766871 - protein, 18 aa, Mycobacterium
GPITWPLHISLLLAKEYA

SEQ ID NO: 766872 - protein, 24 aa, Mycobacterium
GPKAKLAAFGMKWGYKAQLDKLDK

SEQ ID NO: 766873 - protein, 17 aa, Mycobacterium
GPKLRWLLDNDRDLRAR

SEQ ID NO: 766874 - protein, 17 aa, Mycobacterium
GPKRARLLNPLALLASQ

SEQ ID NO: 766875 - protein, 22 aa, Mycobacterium
GPKTLRSAAAWADGLAGTTLDL

SEQ ID NO: 766876 - protein, 19 aa, Mycobacterium
GPKTLRSAAPWADGLAGTT

SEQ ID NO: 766877 - protein, 20 aa, Mycobacterium
GPLEGLRLGLMHGRLSGDEK

SEQ ID NO: 766878 - protein, 17 aa, Mycobacterium
GPLELLDMIGLDVQLHA

SEQ ID NO: 766879 - protein, 24 aa, Mycobacterium
GPLLKALGLTVGWITADSTADERR

SEQ ID NO: 766880 - protein, 24 aa, Mycobacterium
GPLMARLDLPRVWRLTRGAGQRVA

SEQ ID NO: 766881 - protein, 19 aa, Mycobacterium
GPLRYAGWSSCFRREAGSY

SEQ ID NO: 766882 - protein, 18 aa, Mycobacterium
GPLTVPIWYYYTAGGELW

SEQ ID NO: 766883 - protein, 23 aa, Mycobacterium
GPLTWPLHISLLLAKEFALTGTR

SEQ ID NO: 766884 - protein, 18 aa, Mycobacterium
GPMTWYWDLMFDRTPGGM

SEQ ID NO: 766885 - protein, 19 aa, Mycobacterium
GPNALSFVRQRHDLPRGDL

SEQ ID NO: 766886 - protein, 19 aa, Mycobacterium
GPNMSGWWRSNVLLISTDN

SEQ ID NO: 766887 - protein, 24 aa, Mycobacterium
GPNMTRWARRQGWQAPADADAKEL

SEQ ID NO: 766888 - protein, 18 aa, Mycobacterium
GPPDHWRRSSIRHHATTS

SEQ ID NO: 766889 - protein, 21 aa, Mycobacterium
GPPGLPRFTVVAFDLGIKTNT

SEQ ID NO: 766890 - protein, 18 aa, Mycobacterium
GPPPLWWAQRFGIQPDLA

SEQ ID NO: 766891 - protein, 29 aa, Mycobacterium
GPPRFADELAWWVYICWREGLCRIDPGDL

SEQ ID NO: 766892 - protein, 17 aa, Mycobacterium
GPPRFAHELAWWVYTCW

SEQ ID NO: 766893 - protein, 18 aa, Mycobacterium
GPPRIHLIGHSFGARLVS

SEQ ID NO: 766894 - protein, 19 aa, Mycobacterium
GPPTLPPFMLADGVASLNA

SEQ ID NO: 766895 - protein, 19 aa, Mycobacterium
GPQRWRIKANWKIGAENFA

SEQ ID NO: 766896 - protein, 23 aa, Mycobacterium
GPQSLRPRLIWFAYRRLKEGRPI

SEQ ID NO: 766897 - protein, 17 aa, Mycobacterium
GPQWSYTEVLGYFRRIE

SEQ ID NO: 766898 - protein, 17 aa, Mycobacterium
GPRDARHSFSFSGLKTA

SEQ ID NO: 766899 - protein, 25 aa, Mycobacterium
GPRGDCCWMCLPRWDSPAVFGSLLG

SEQ ID NO: 766900 - protein, 20 aa, Mycobacterium
GPRGDCCWMCSPRWDSPAVF

SEQ ID NO: 766901 - protein, 19 aa, Mycobacterium
GPRLPRWVQALLMLTHGSH

SEQ ID NO: 766902 - protein, 17 aa, Mycobacterium
GPRPAVVPLSFAQSRLW

SEQ ID NO: 766903 - protein, 22 aa, Mycobacterium
GPRPRLARPLSWGRAAPADTGS

SEQ ID NO: 766904 - protein, 20 aa, Mycobacterium
GPRRYAGWSSCFRREAGSYG

SEQ ID NO: 766905 - protein, 18 aa, Mycobacterium
GPRSFALPEFDPFWHRCV

SEQ ID NO: 766906 - protein, 18 aa, Mycobacterium
GPRSFALPEFDPFWQRCV

SEQ ID NO: 766907 - protein, 18 aa, Mycobacterium
GPRSSWRATDAVLYAMSG

SEQ ID NO: 766908 - protein, 28 aa, Mycobacterium
GPRSWQAPWFCRWMHGCSNGFGFMVANF

SEQ ID NO: 766909 - protein, 18 aa, Mycobacterium
GPSGLHFAGRVGTGFTQR

SEQ ID NO: 766910 - protein, 23 aa, Mycobacterium
GPSLRPSATLVRRTRPVVEARSE

SEQ ID NO: 766911 - protein, 19 aa, Mycobacterium
GPSMVRWARANGWSARPEA

SEQ ID NO: 766912 - protein, 18 aa, Mycobacterium
GPTAWLFGPEAHGLPAEV

SEQ ID NO: 766913 - protein, 18 aa, Mycobacterium
GPTGWVFTRREPVVVFSE

SEQ ID NO: 766914 - protein, 18 aa, Mycobacterium
GPTIAAAVIDWFTVDWHR

SEQ ID NO: 766915 - protein, 20 aa, Mycobacterium
GPTLYEWAQSLALLGDPSHS

SEQ ID NO: 766916 - protein, 18 aa, Mycobacterium
GPTRDWECYCGKYKRVRF

SEQ ID NO: 766917 - protein, 18 aa, Mycobacterium
GPVAATPIMRWLRDVAGP

SEQ ID NO: 766918 - protein, 18 aa, Mycobacterium
GPVAFVFLRQFGSAFAVR

SEQ ID NO: 766919 - protein, 17 aa, Mycobacterium
GPVAGTGAEMWVKVNPQ

SEQ ID NO: 766920 - protein, 19 aa, Mycobacterium
GPVLRPSTTLVRRSRVFAE

SEQ ID NO: 766921 - protein, 18 aa, Mycobacterium
GPVMARLRAASVIDTMLV

SEQ ID NO: 766922 - protein, 18 aa, Mycobacterium
GPVMTARAPWLRRAGLLG

SEQ ID NO: 766923 - protein, 18 aa, Mycobacterium
GPVPWWWRPSGALFDQFL

SEQ ID NO: 766924 - protein, 18 aa, Mycobacterium
GPVRLEVVQFLAGEGMST

SEQ ID NO: 766925 - protein, 19 aa, Mycobacterium
GPVRTARLVKQFAANARDW

SEQ ID NO: 766926 - protein, 21 aa, Mycobacterium
GQAAELFGWLGAYPDAVVGAA

SEQ ID NO: 766927 - protein, 23 aa, Mycobacterium
GQAAELFGWLGPYPDAVVGSSAA

SEQ ID NO: 766928 - protein, 17 aa, Mycobacterium
GQAAWRLGAGRSRPGER

SEQ ID NO: 766929 - protein, 20 aa, Mycobacterium
GQACALRILAEGGRVAAADI

SEQ ID NO: 766930 - protein, 19 aa, Mycobacterium
GQAGLFGAQGQQGAGGAGG

SEQ ID NO: 766931 - protein, 21 aa, Mycobacterium
GQAHAGGAFHDGDAGAGGLGG

SEQ ID NO: 766932 - protein, 19 aa, Mycobacterium
GQAIRVAREFARNAEESGG

SEQ ID NO: 766933 - protein, 19 aa, Mycobacterium
GQCGSCFNGTAAMAAAAGA

SEQ ID NO: 766934 - protein, 18 aa, Mycobacterium
GQCTFAWPPQFELPGYKP

SEQ ID NO: 766935 - protein, 18 aa, Mycobacterium
GQCTFSWPPKIDLPGYKP

SEQ ID NO: 766936 - protein, 25 aa, Mycobacterium
GQDSFEFFPNFTLLFWVPGWYLTYN

SEQ ID NO: 766937 - protein, 25 aa, Mycobacterium
GQDSFEFFPNFTLLLWVPGWYLTYN

SEQ ID NO: 766938 - protein, 18 aa, Mycobacterium
GQDWARWDRDAEIGVTVA

SEQ ID NO: 766939 - protein, 17 aa, Mycobacterium
GQEVVEFACGIPHLLKG

SEQ ID NO: 766940 - protein, 18 aa, Mycobacterium
GQFAGWAIAKIMAGAAAM

SEQ ID NO: 766941 - protein, 20 aa, Mycobacterium
GQFLAWAIARIMAGVVATQR

SEQ ID NO: 766942 - protein, 19 aa, Mycobacterium
GQGGEAWSVLQRWLEVDED

SEQ ID NO: 766943 - protein, 21 aa, Mycobacterium
GQGGFSEWPALLTFAEPGEQG

SEQ ID NO: 766944 - protein, 20 aa, Mycobacterium
GQGSLARLSAVWGGTASDAY

SEQ ID NO: 766945 - protein, 30 aa, Mycobacterium
GQGYQVLSARALEFHTRLAQALSAGAGAYS

SEQ ID NO: 766946 - protein, 18 aa, Mycobacterium
GQHLHSWMAPLMGGFFGY

SEQ ID NO: 766947 - protein, 17 aa, Mycobacterium
GQIKWLFDKLLGPRPHW

SEQ ID NO: 766948 - protein, 17 aa, Mycobacterium
GQLGTACAVAFGAAFEL

SEQ ID NO: 766949 - protein, 17 aa, Mycobacterium
GQLHGWALGGIVVNSQA

SEQ ID NO: 766950 - protein, 17 aa, Mycobacterium
GQLIRWSDDYAVSDSLR

SEQ ID NO: 766951 - protein, 17 aa, Mycobacterium
GQLPICWDTDREAAIKR

SEQ ID NO: 766952 - protein, 17 aa, Mycobacterium
GQLRPLYRPGLVHMYHA

SEQ ID NO: 766953 - protein, 20 aa, Mycobacterium
GQLSRWTRFSAHRVATMDPT

SEQ ID NO: 766954 - protein, 19 aa, Mycobacterium
GQLTAARASHDWAKGMRDQ

SEQ ID NO: 766955 - protein, 17 aa, Mycobacterium
GQPAAVVPWDFDDDGMP

SEQ ID NO: 766956 - protein, 19 aa, Mycobacterium
GQPEIKLGVLPGMGGSQRL

SEQ ID NO: 766957 - protein, 17 aa, Mycobacterium
GQPLAVMGNLTWIVDDE

SEQ ID NO: 766958 - protein, 17 aa, Mycobacterium
GQPRPGQTVAVVGLGGV

SEQ ID NO: 766959 - protein, 21 aa, Mycobacterium
GQRIPRKWLDSGVIIQAETLE

SEQ ID NO: 766960 - protein, 18 aa, Mycobacterium
GQRLVAFVVARPGSDIDV

SEQ ID NO: 766961 - protein, 19 aa, Mycobacterium
GQSISLRVCIVIRVGTDGR

SEQ ID NO: 766962 - protein, 19 aa, Mycobacterium
GQSLLRLTARASLTEADME

SEQ ID NO: 766963 - protein, 24 aa, Mycobacterium
GQSLRPVIFSTFLMWLLADLFTVL

SEQ ID NO: 766964 - protein, 18 aa, Mycobacterium
GQSTWRLGGAFNCGKAQP

SEQ ID NO: 766965 - protein, 18 aa, Mycobacterium
GQSWRGAAGIGEGHLGLP

SEQ ID NO: 766966 - protein, 17 aa, Mycobacterium
GQTAAGVALEWLRYRAG

SEQ ID NO: 766967 - protein, 23 aa, Mycobacterium
GQTGQAGGLLWGNGGAGGSGAPG

SEQ ID NO: 766968 - protein, 17 aa, Mycobacterium
GQTLDWLAARGMTTLLQ

SEQ ID NO: 766969 - protein, 24 aa, Mycobacterium
GQTMSLEMWVKWSGYAGTNSPIKL

SEQ ID NO: 766970 - protein, 22 aa, Mycobacterium
GQTRILAPRSRYDEVVEKVAAG

SEQ ID NO: 766971 - protein, 20 aa, Mycobacterium
GQTYLGLAIQHVRYWASTVQ

SEQ ID NO: 766972 - protein, 18 aa, Mycobacterium
GQVALAWVLSRGQDVVPI

SEQ ID NO: 766973 - protein, 18 aa, Mycobacterium
GQVDRLKVGVARPFSQTT

SEQ ID NO: 766974 - protein, 18 aa, Mycobacterium
GQVIAMRVCIVIKLDRDG

SEQ ID NO: 766975 - protein, 26 aa, Mycobacterium
GQVLKEVQFRLGFLLDVGLQYLSLSR

SEQ ID NO: 766976 - protein, 17 aa, Mycobacterium
GQVLPWVLADVDLGDNV

SEQ ID NO: 766977 - protein, 18 aa, Mycobacterium
GQVPPGFLPILQAYDYAG

SEQ ID NO: 766978 - protein, 23 aa, Mycobacterium
GQWRFRRRRCQFVTSRGLSDTPE

SEQ ID NO: 766979 - protein, 20 aa, Mycobacterium
GQWWGPASWRRKPHRSRGKG

SEQ ID NO: 766980 - protein, 19 aa, Mycobacterium
GQYPRPLPFIIGSEVCGTV

SEQ ID NO: 766981 - protein, 17 aa, Mycobacterium
GRAAFEVKIHRIAADGG

SEQ ID NO: 766982 - protein, 18 aa, Mycobacterium
GRAAIGFGAGRDYDFDVF

SEQ ID NO: 766983 - protein, 21 aa, Mycobacterium
GRAALPYGVHVGRWDELDGLV

SEQ ID NO: 766984 - protein, 18 aa, Mycobacterium
GRAARMGHRLTIAMTRWQ

SEQ ID NO: 766985 - protein, 19 aa, Mycobacterium
GRAAVLCCLHHALTDGVGA

SEQ ID NO: 766986 - protein, 17 aa, Mycobacterium
GRAAWNVVTSWDAFTGE

SEQ ID NO: 766987 - protein, 23 aa, Mycobacterium
GRADPGEIVWTWVVYEDDPSRGK

SEQ ID NO: 766988 - protein, 23 aa, Mycobacterium
GRADPGEIVWTWVVYEDDPTKGK

SEQ ID NO: 766989 - protein, 23 aa, Mycobacterium
GRADPGEIVWTWVVYEDDPTQGQ

SEQ ID NO: 766990 - protein, 22 aa, Mycobacterium
GRADPGEIVWTWVVYEDDPTRG

SEQ ID NO: 766991 - protein, 19 aa, Mycobacterium
GRAFLRKFLPGHWAYLQTL

SEQ ID NO: 766992 - protein, 17 aa, Mycobacterium
GRAGALLLDLAVDTVPR

SEQ ID NO: 766993 - protein, 18 aa, Mycobacterium
GRAIHEWSAQVFRDDEGT

SEQ ID NO: 766994 - protein, 18 aa, Mycobacterium
GRAKEAFGAATNNDDLKA

SEQ ID NO: 766995 - protein, 17 aa, Mycobacterium
GRAKYMWVSTFHSTCVR

SEQ ID NO: 766996 - protein, 21 aa, Mycobacterium
GRALACLPWISSAALGATALV

SEQ ID NO: 766997 - protein, 17 aa, Mycobacterium
GRALAGFGLTEPGAGSD

SEQ ID NO: 766998 - protein, 24 aa, Mycobacterium
GRALLPWMLGYQVPMWPERKLTRD

SEQ ID NO: 766999 - protein, 19 aa, Mycobacterium
GRANPGMFSRIVIDYYGAA

SEQ ID NO: 767000 - protein, 19 aa, Mycobacterium
GRANPGMFSRIVIDYYGAT

SEQ ID NO: 767001 - protein, 17 aa, Mycobacterium
GRAPGWADLPVQYVDYT

SEQ ID NO: 767002 - protein, 18 aa, Mycobacterium
GRAPGWAGLAVQYVDYTL

SEQ ID NO: 767003 - protein, 20 aa, Mycobacterium
GRAPTWRLARVQARRWLPRC

SEQ ID NO: 767004 - protein, 19 aa, Mycobacterium
GRASWYRNRWVRSLPVCAA

SEQ ID NO: 767005 - protein, 19 aa, Mycobacterium
GRASWYRNRWVRSMPVCAA

SEQ ID NO: 767006 - protein, 25 aa, Mycobacterium
GRATRWRLAGLGLRVIAHDPYNDDA

SEQ ID NO: 767007 - protein, 20 aa, Mycobacterium
GRAWPALDFVRPWDSLTDDE

SEQ ID NO: 767008 - protein, 20 aa, Mycobacterium
GRCQMSFVFAAPEALVAAAG

SEQ ID NO: 767009 - protein, 17 aa, Mycobacterium
GRDAYRLLSRAFLGTEA

SEQ ID NO: 767010 - protein, 21 aa, Mycobacterium
GRDCPKRMTFGPCGGVHPDGQ

SEQ ID NO: 767011 - protein, 17 aa, Mycobacterium
GRDDWAVHVALWQRTTN

SEQ ID NO: 767012 - protein, 23 aa, Mycobacterium
GRDEIWRFTPLRRLRGLHDGSAR

SEQ ID NO: 767013 - protein, 19 aa, Mycobacterium
GRDELWRFTPLKRLRGLHD

SEQ ID NO: 767014 - protein, 24 aa, Mycobacterium
GRDERLCWWAGPWPVDERWWDDRP

SEQ ID NO: 767015 - protein, 26 aa, Mycobacterium
GRDFPDYHALWAWSVEDVEEFWAALW

SEQ ID NO: 767016 - protein, 22 aa, Mycobacterium
GRDFTDPVGLNWSQDGTDVDFG

SEQ ID NO: 767017 - protein, 19 aa, Mycobacterium
GRDLSGWGRQWLKTTGLNT

SEQ ID NO: 767018 - protein, 31 aa, Mycobacterium
GRDMAEMFAWLRPTDLVWRYWVNNYVQGRKP

SEQ ID NO: 767019 - protein, 17 aa, Mycobacterium
GRDVAWWACAVEGGDAH

SEQ ID NO: 767020 - protein, 18 aa, Mycobacterium
GREGEAWYLDEFGGWGKI

SEQ ID NO: 767021 - protein, 18 aa, Mycobacterium
GREHALLFAKEGASVVVN

SEQ ID NO: 767022 - protein, 19 aa, Mycobacterium
GREHALLFAREGASVVVND

SEQ ID NO: 767023 - protein, 22 aa, Mycobacterium
GREIRDGFVVGAGYRELMTVDY

SEQ ID NO: 767024 - protein, 20 aa, Mycobacterium
GRERGGVCSTFLADRGSNAR

SEQ ID NO: 767025 - protein, 18 aa, Mycobacterium
GRFALYMKIHHALVDGYS

SEQ ID NO: 767026 - protein, 17 aa, Mycobacterium
GRFAMYAKMHHALIDGV

SEQ ID NO: 767027 - protein, 21 aa, Mycobacterium
GRFCRDLARLCGKGMVLPMNT

SEQ ID NO: 767028 - protein, 17 aa, Mycobacterium
GRFDYRWHDGARWTDQV

SEQ ID NO: 767029 - protein, 20 aa, Mycobacterium
GRFGALIPRLVRQAINGENL

SEQ ID NO: 767030 - protein, 22 aa, Mycobacterium
GRFGELRLRLRVNGELRQDMRV

SEQ ID NO: 767031 - protein, 20 aa, Mycobacterium
GRFIPCGILPLFDVAEAAKE

SEQ ID NO: 767032 - protein, 23 aa, Mycobacterium
GRFPAELYAALGMDDLIDKLPDE

SEQ ID NO: 767033 - protein, 25 aa, Mycobacterium
GRFRAGEIGVRFVVGAAQHLDAALR

SEQ ID NO: 767034 - protein, 19 aa, Mycobacterium
GRFTLAVGVGYLKREFAAL

SEQ ID NO: 767035 - protein, 21 aa, Mycobacterium
GRFTLGVGPSHHWIIDGQLGL

SEQ ID NO: 767036 - protein, 17 aa, Mycobacterium
GRFVFGVGAGWNIEELR

SEQ ID NO: 767037 - protein, 17 aa, Mycobacterium
GRFYYARVASVTDAGVQ

SEQ ID NO: 767038 - protein, 18 aa, Mycobacterium
GRGADGYGTGISGASGGA

SEQ ID NO: 767039 - protein, 19 aa, Mycobacterium
GRGAMIAMELVKAGTTEPD

SEQ ID NO: 767040 - protein, 19 aa, Mycobacterium
GRGAMIAMELVKSGTAEPD

SEQ ID NO: 767041 - protein, 19 aa, Mycobacterium
GRGEYRRCSSNGLATMFGF

SEQ ID NO: 767042 - protein, 24 aa, Mycobacterium
GRGFPFSLVFAGLYAARGYHVVLQ

SEQ ID NO: 767043 - protein, 20 aa, Mycobacterium
GRGGFPGMLLGSVGSAVAHS

SEQ ID NO: 767044 - protein, 18 aa, Mycobacterium
GRGGIRLNVEMTVSANDP

SEQ ID NO: 767045 - protein, 20 aa, Mycobacterium
GRGGLAGGLGGKGGDAGFFG

SEQ ID NO: 767046 - protein, 17 aa, Mycobacterium
GRGGLFYGAGGAGGDGG

SEQ ID NO: 767047 - protein, 17 aa, Mycobacterium
GRGGLIGAAGGTGSIGA

SEQ ID NO: 767048 - protein, 23 aa, Mycobacterium
GRGPKRYVCGGVMLSFDEMIGAL

SEQ ID NO: 767049 - protein, 18 aa, Mycobacterium
GRGPRRYVCGGQLLTFDE

SEQ ID NO: 767050 - protein, 24 aa, Mycobacterium
GRGRHPSLCLLASWVSPASPAGRR

SEQ ID NO: 767051 - protein, 19 aa, Mycobacterium
GRGSIKMRGVVEIEEDSRG

SEQ ID NO: 767052 - protein, 18 aa, Mycobacterium
GRGSIRMRGVVEIEEDAR

SEQ ID NO: 767053 - protein, 18 aa, Mycobacterium
GRGSIRMRGVVEIEEDSR

SEQ ID NO: 767054 - protein, 18 aa, Mycobacterium
GRGSIRMRGVVEVEEDSR

SEQ ID NO: 767055 - protein, 20 aa, Mycobacterium
GRGTPLWGGWITGPTWLGPE

SEQ ID NO: 767056 - protein, 18 aa, Mycobacterium
GRHAPGWSRRLLPPVMGT

SEQ ID NO: 767057 - protein, 23 aa, Mycobacterium
GRIAARVPQEWLLPYVHQRYDDA

SEQ ID NO: 767058 - protein, 23 aa, Mycobacterium
GRIAARVPQEWLLPYVHQRYDDV

SEQ ID NO: 767059 - protein, 17 aa, Mycobacterium
GRIAWSFRASGMTADTG

SEQ ID NO: 767060 - protein, 19 aa, Mycobacterium
GRICASLGLPERVLTQPLH

SEQ ID NO: 767061 - protein, 17 aa, Mycobacterium
GRICLCRVHDGRIEENF

SEQ ID NO: 767062 - protein, 19 aa, Mycobacterium
GRIDLGLGRTGHRIRDRLA

SEQ ID NO: 767063 - protein, 25 aa, Mycobacterium
GRIDRPRWVASLPWEQLEDEHHRLC

SEQ ID NO: 767064 - protein, 17 aa, Mycobacterium
GRIFAFDVHSIFIPVSR

SEQ ID NO: 767065 - protein, 19 aa, Mycobacterium
GRIGAKLLRFPAALITTTG

SEQ ID NO: 767066 - protein, 25 aa, Mycobacterium
GRIGLLVCWDIWFPETARIVAQQGA

SEQ ID NO: 767067 - protein, 21 aa, Mycobacterium
GRIGVPLSVPFPGVHDDRVTA

SEQ ID NO: 767068 - protein, 18 aa, Mycobacterium
GRIHDWFDFSARYWGVLF

SEQ ID NO: 767069 - protein, 19 aa, Mycobacterium
GRIKDLLIVYGRNHAPEDI

SEQ ID NO: 767070 - protein, 19 aa, Mycobacterium
GRIKDLLIVYGRNHSPDDI

SEQ ID NO: 767071 - protein, 19 aa, Mycobacterium
GRIKLAWFLLNAARYMPVL

SEQ ID NO: 767072 - protein, 26 aa, Mycobacterium
GRIKVAMDEFVRWTTPVMTFRRTATQ

SEQ ID NO: 767073 - protein, 18 aa, Mycobacterium
GRIPLQLKAMAEFADHMQ

SEQ ID NO: 767074 - protein, 19 aa, Mycobacterium
GRISYCLGLAGPAISVDTA

SEQ ID NO: 767075 - protein, 17 aa, Mycobacterium
GRIVLVAGFQGVSQDTR

SEQ ID NO: 767076 - protein, 18 aa, Mycobacterium
GRIVRGRIDAIFADGDGS

SEQ ID NO: 767077 - protein, 18 aa, Mycobacterium
GRIVSFDAAGGWNIEEEG

SEQ ID NO: 767078 - protein, 20 aa, Mycobacterium
GRIVSFDAAGGWNLEEEEGY

SEQ ID NO: 767079 - protein, 23 aa, Mycobacterium
GRIVSFDAAGGWNLEEEGYQSVG

SEQ ID NO: 767080 - protein, 17 aa, Mycobacterium
GRKAPGFFVKSADNRYL

SEQ ID NO: 767081 - protein, 25 aa, Mycobacterium
GRKKDEWSVYLSPSHWAVLELGGGA

SEQ ID NO: 767082 - protein, 25 aa, Mycobacterium
GRKLVEVPVGFKWFVDGLIGGTIGF

SEQ ID NO: 767083 - protein, 17 aa, Mycobacterium
GRLAGVIAFGDRVLRQY

SEQ ID NO: 767084 - protein, 24 aa, Mycobacterium
GRLALGVGPSHHWIIRDMLGLPYD

SEQ ID NO: 767085 - protein, 18 aa, Mycobacterium
GRLALLLKVHHAAVDGVS

SEQ ID NO: 767086 - protein, 18 aa, Mycobacterium
GRLALRRVAVRSGVPDYG

SEQ ID NO: 767087 - protein, 17 aa, Mycobacterium
GRLALVWNRIEPTVPTQ

SEQ ID NO: 767088 - protein, 24 aa, Mycobacterium
GRLDELIRFFGWLGQREITSLTAI

SEQ ID NO: 767089 - protein, 19 aa, Mycobacterium
GRLDLMFNNAGIVFGGETE

SEQ ID NO: 767090 - protein, 19 aa, Mycobacterium
GRLDLMFNNAGIVWGGDTE

SEQ ID NO: 767091 - protein, 17 aa, Mycobacterium
GRLGLLELRGFEMPPHH

SEQ ID NO: 767092 - protein, 22 aa, Mycobacterium
GRLGLLPLRWALACLLIDIESV

SEQ ID NO: 767093 - protein, 19 aa, Mycobacterium
GRLIAATSMHEFVSRAGAD

SEQ ID NO: 767094 - protein, 19 aa, Mycobacterium
GRLKLPVPTWQVLLDVPTE

SEQ ID NO: 767095 - protein, 19 aa, Mycobacterium
GRLLARERIELLLDRDAPF

SEQ ID NO: 767096 - protein, 18 aa, Mycobacterium
GRLLAWRLNRVVDAASQL

SEQ ID NO: 767097 - protein, 21 aa, Mycobacterium
GRLLGWRLGLDGVDPKGTVQL

SEQ ID NO: 767098 - protein, 19 aa, Mycobacterium
GRLLIIDCGVLFPGHNEPG

SEQ ID NO: 767099 - protein, 20 aa, Mycobacterium
GRLMVTFGVGWLAKEFELLG

SEQ ID NO: 767100 - protein, 23 aa, Mycobacterium
GRLPKARLSEMVRRILRSMFAVG

SEQ ID NO: 767101 - protein, 22 aa, Mycobacterium
GRLPWLAGVRVVYWGDIDTHGF

SEQ ID NO: 767102 - protein, 21 aa, Mycobacterium
GRLRLGVGVTEAIRRHPVLIA

SEQ ID NO: 767103 - protein, 20 aa, Mycobacterium
GRLRVGPRFAVDGVGDQNVG

SEQ ID NO: 767104 - protein, 18 aa, Mycobacterium
GRLSSRFWRLLGASTEKN

SEQ ID NO: 767105 - protein, 20 aa, Mycobacterium
GRLSVPPSWAGTTEVTDHVA

SEQ ID NO: 767106 - protein, 20 aa, Mycobacterium
GRLSVPPSWAVKAPAILPDA

SEQ ID NO: 767107 - protein, 21 aa, Mycobacterium
GRLTLAGAHLWNSRPYGAAGE

SEQ ID NO: 767108 - protein, 19 aa, Mycobacterium
GRLTLPAKFRDSLAGGLMV

SEQ ID NO: 767109 - protein, 17 aa, Mycobacterium
GRLVFAWRATGPMSPAA

SEQ ID NO: 767110 - protein, 19 aa, Mycobacterium
GRLVLGVGVGWFREEFEAL

SEQ ID NO: 767111 - protein, 20 aa, Mycobacterium
GRLWGLIACHHYAGPHLPPF

SEQ ID NO: 767112 - protein, 21 aa, Mycobacterium
GRLWGLIACHHYAGPHLPPFG

SEQ ID NO: 767113 - protein, 19 aa, Mycobacterium
GRLWLSRGGTYVLANIRGG

SEQ ID NO: 767114 - protein, 30 aa, Mycobacterium
GRLYSGNGIPDIFGRPLIGDGADGAPGTGQ

SEQ ID NO: 767115 - protein, 25 aa, Mycobacterium
GRMAEIIGALGLRSSDNVSLVTLRV

SEQ ID NO: 767116 - protein, 20 aa, Mycobacterium
GRMHGYWALHEGCLQLRGDA

SEQ ID NO: 767117 - protein, 20 aa, Mycobacterium
GRMHGYWALHEGCLQLRGEA

SEQ ID NO: 767118 - protein, 17 aa, Mycobacterium
GRMLWSLPKGHIELGET

SEQ ID NO: 767119 - protein, 18 aa, Mycobacterium
GRMLWSLPKGHIELGETA

SEQ ID NO: 767120 - protein, 18 aa, Mycobacterium
GRMLWSLPKGHIEMGETA

SEQ ID NO: 767121 - protein, 18 aa, Mycobacterium
GRMLWSLPKGHIEQGETA

SEQ ID NO: 767122 - protein, 23 aa, Mycobacterium
GRMPRPVFEQMGSLGILGVAIPE

SEQ ID NO: 767123 - protein, 19 aa, Mycobacterium
GRPALPMDRILGAAVELLD

SEQ ID NO: 767124 - protein, 19 aa, Mycobacterium
GRPAPLVAYWYGPDDENFR

SEQ ID NO: 767125 - protein, 17 aa, Mycobacterium
GRPDEWLQWLHAEHYPA

SEQ ID NO: 767126 - protein, 18 aa, Mycobacterium
GRPEFKAMFLDDLLNGSR

SEQ ID NO: 767127 - protein, 19 aa, Mycobacterium
GRPFAGFELRIDAETGSET

SEQ ID NO: 767128 - protein, 19 aa, Mycobacterium
GRPGWRPLPQLLAGSDIVS

SEQ ID NO: 767129 - protein, 18 aa, Mycobacterium
GRPHLVAMWYAILDGEIW

SEQ ID NO: 767130 - protein, 18 aa, Mycobacterium
GRPHLVAMWYAVVDGEIW

SEQ ID NO: 767131 - protein, 19 aa, Mycobacterium
GRPKPVPVWAALDGDHGDR

SEQ ID NO: 767132 - protein, 23 aa, Mycobacterium
GRPKRLRLGICVTDAGRRNPAVT

SEQ ID NO: 767133 - protein, 25 aa, Mycobacterium
GRPLRIAHAWSFTFDAAWQPLAALL

SEQ ID NO: 767134 - protein, 19 aa, Mycobacterium
GRPLWELYLIQGLSGGRVA

SEQ ID NO: 767135 - protein, 22 aa, Mycobacterium
GRPLWPMIIMRTPKGWTGPATV

SEQ ID NO: 767136 - protein, 19 aa, Mycobacterium
GRPRIAGVSSFGFAGTNAH

SEQ ID NO: 767137 - protein, 17 aa, Mycobacterium
GRPRLAPLVYLRIDGKM

SEQ ID NO: 767138 - protein, 21 aa, Mycobacterium
GRPRWDTAIVGLDCETAVLDQ

SEQ ID NO: 767139 - protein, 19 aa, Mycobacterium
GRPSSFIWYGPRWAQAATA

SEQ ID NO: 767140 - protein, 19 aa, Mycobacterium
GRPTSFIWYGPRWAQAATA

SEQ ID NO: 767141 - protein, 17 aa, Mycobacterium
GRPVAAWSLAADEAVVT

SEQ ID NO: 767142 - protein, 24 aa, Mycobacterium
GRPVFKAGKIFAMFGGNAKGATKG

SEQ ID NO: 767143 - protein, 18 aa, Mycobacterium
GRPVPFTAIEFAGPAPAS

SEQ ID NO: 767144 - protein, 19 aa, Mycobacterium
GRQRWCVRLFQGGGFGGPL

SEQ ID NO: 767145 - protein, 17 aa, Mycobacterium
GRRAIRYLGDFVKEVTD

SEQ ID NO: 767146 - protein, 18 aa, Mycobacterium
GRRALRYVGDFVKQTTGT

SEQ ID NO: 767147 - protein, 19 aa, Mycobacterium
GRRATGCPIAVSRWATSAG

SEQ ID NO: 767148 - protein, 18 aa, Mycobacterium
GRRCAGLTAAQWRARTRC

SEQ ID NO: 767149 - protein, 19 aa, Mycobacterium
GRRCLPIILDVRAPAQVSA

SEQ ID NO: 767150 - protein, 17 aa, Mycobacterium
GRRCTAVRWGLWPGAGI

SEQ ID NO: 767151 - protein, 21 aa, Mycobacterium
GRRLQVCFERGYPAAQIFAPP

SEQ ID NO: 767152 - protein, 17 aa, Mycobacterium
GRRLRLLGFERVELEPG

SEQ ID NO: 767153 - protein, 25 aa, Mycobacterium
GRRLVEVPVGFKWFVDGLINGTIGF

SEQ ID NO: 767154 - protein, 18 aa, Mycobacterium
GRRRARLTGVTWPSEWSR

SEQ ID NO: 767155 - protein, 19 aa, Mycobacterium
GRRSLALALRFRASDRTLT

SEQ ID NO: 767156 - protein, 18 aa, Mycobacterium
GRRTVWVPWALRPMFFAM

SEQ ID NO: 767157 - protein, 20 aa, Mycobacterium
GRRWAILVVWELRSGTKTLP

SEQ ID NO: 767158 - protein, 23 aa, Mycobacterium
GRRWDEVFTRAGLQVRLYPDGGA

SEQ ID NO: 767159 - protein, 22 aa, Mycobacterium
GRRWGMADGCAFDAAGNLWVTL

SEQ ID NO: 767160 - protein, 20 aa, Mycobacterium
GRRYLDMFSFFASSALGMNH

SEQ ID NO: 767161 - protein, 20 aa, Mycobacterium
GRRYLDMFTFFASSALGMNH

SEQ ID NO: 767162 - protein, 24 aa, Mycobacterium
GRRYRHPLCLSVHFPAGTLLDETG

SEQ ID NO: 767163 - protein, 24 aa, Mycobacterium
GRRYRLTVDLPRDFALNQPLSTFA

SEQ ID NO: 767164 - protein, 21 aa, Mycobacterium
GRSAAGWARRLVFVNGHGGNV

SEQ ID NO: 767165 - protein, 24 aa, Mycobacterium
GRSELLSTVWRFAFEDPLTGIANR

SEQ ID NO: 767166 - protein, 18 aa, Mycobacterium
GRSELRLAAEAVLDALDD

SEQ ID NO: 767167 - protein, 19 aa, Mycobacterium
GRSGFLLAPWTAEQIMCEL

SEQ ID NO: 767168 - protein, 19 aa, Mycobacterium
GRSGYRFGHIEGPMQVQHH

SEQ ID NO: 767169 - protein, 20 aa, Mycobacterium
GRSLGHPFLEQWRGREAELA

SEQ ID NO: 767170 - protein, 21 aa, Mycobacterium
GRSNAGIARRLWVTEGTVEKH

SEQ ID NO: 767171 - protein, 19 aa, Mycobacterium
GRSRPDWPSVPTFDDGVLV

SEQ ID NO: 767172 - protein, 17 aa, Mycobacterium
GRSWPAICDELLGHYAA

SEQ ID NO: 767173 - protein, 17 aa, Mycobacterium
GRSWSRWSFIGAGAPSA

SEQ ID NO: 767174 - protein, 19 aa, Mycobacterium
GRTAERWQRLASLAEENIV

SEQ ID NO: 767175 - protein, 19 aa, Mycobacterium
GRTAFPYSVHVGHWDELDG

SEQ ID NO: 767176 - protein, 17 aa, Mycobacterium
GRTELQILLARWSAAAA

SEQ ID NO: 767177 - protein, 18 aa, Mycobacterium
GRTFACDHWGVVPDVYLL

SEQ ID NO: 767178 - protein, 21 aa, Mycobacterium
GRTGEFLEWFLGNVPITPIWV

SEQ ID NO: 767179 - protein, 18 aa, Mycobacterium
GRTGVFWIREMLPIGELR

SEQ ID NO: 767180 - protein, 25 aa, Mycobacterium
GRTLIEVPVGFKWFVNGLIDGTIGF

SEQ ID NO: 767181 - protein, 18 aa, Mycobacterium
GRTLRFGIRLHVISRDTS

SEQ ID NO: 767182 - protein, 17 aa, Mycobacterium
GRTPAQVLVRWNLQLDN

SEQ ID NO: 767183 - protein, 21 aa, Mycobacterium
GRTRAALRFIRSCSAPLTPET

SEQ ID NO: 767184 - protein, 19 aa, Mycobacterium
GRTRFRPHFFPFTEPSAEV

SEQ ID NO: 767185 - protein, 19 aa, Mycobacterium
GRTRLEVISPTAAQQLSAV

SEQ ID NO: 767186 - protein, 20 aa, Mycobacterium
GRTSFDLIPAMSLTCAVSSV

SEQ ID NO: 767187 - protein, 23 aa, Mycobacterium
GRTTGYSCGVTWGPGKDPGTIVN

SEQ ID NO: 767188 - protein, 20 aa, Mycobacterium
GRVADGWLGTSFVPEGAEDA

SEQ ID NO: 767189 - protein, 19 aa, Mycobacterium
GRVADGWLGTSFVPEGAGD

SEQ ID NO: 767190 - protein, 18 aa, Mycobacterium
GRVAFTFGLEGPAVSVDT

SEQ ID NO: 767191 - protein, 21 aa, Mycobacterium
GRVALGWRLKLLVAAYPVLAM

SEQ ID NO: 767192 - protein, 17 aa, Mycobacterium
GRVAVCIEGLYSMDGDL

SEQ ID NO: 767193 - protein, 19 aa, Mycobacterium
GRVCKSCGATDRMGTIPVA

SEQ ID NO: 767194 - protein, 17 aa, Mycobacterium
GRVGEWILFQNQVNRSR

SEQ ID NO: 767195 - protein, 22 aa, Mycobacterium
GRVKAWKGIRYAAAPVGDLRFR

SEQ ID NO: 767196 - protein, 19 aa, Mycobacterium
GRVKLSWFLLHAARYLPPQ

SEQ ID NO: 767197 - protein, 18 aa, Mycobacterium
GRVKRPQLGIANWVVPSI

SEQ ID NO: 767198 - protein, 18 aa, Mycobacterium
GRVLLVWDAPNLDMGLGS

SEQ ID NO: 767199 - protein, 18 aa, Mycobacterium
GRVRCAARISGIRDGVLF

SEQ ID NO: 767200 - protein, 17 aa, Mycobacterium
GRVTVGVGYGWNTDELA

SEQ ID NO: 767201 - protein, 23 aa, Mycobacterium
GRWADSFGGLVFDATGITDPAGL

SEQ ID NO: 767202 - protein, 17 aa, Mycobacterium
GRWARKDKRSFTATHVV

SEQ ID NO: 767203 - protein, 19 aa, Mycobacterium
GRWDFKFLGMQIMIEGLAL

SEQ ID NO: 767204 - protein, 19 aa, Mycobacterium
GRWPFVGSLTMELPTDADD

SEQ ID NO: 767205 - protein, 17 aa, Mycobacterium
GRWPGRPLGSVSSGLLR

SEQ ID NO: 767206 - protein, 27 aa, Mycobacterium
GRWQLHWRLGWSFACLTHRCLLAHTCP

SEQ ID NO: 767207 - protein, 20 aa, Mycobacterium
GRWRRWRVDGAAARAAEAIE

SEQ ID NO: 767208 - protein, 19 aa, Mycobacterium
GRWSCVRWGTKTPPFCAEV

SEQ ID NO: 767209 - protein, 20 aa, Mycobacterium
GRWSCVRWGTLSPPFYPEAG

SEQ ID NO: 767210 - protein, 21 aa, Mycobacterium
GRWSCVRWGTLTPPFYPEAEA

SEQ ID NO: 767211 - protein, 17 aa, Mycobacterium
GRWVRQLTDLVAEKLPD

SEQ ID NO: 767212 - protein, 20 aa, Mycobacterium
GRYFARARVDVVARGGLLAG

SEQ ID NO: 767213 - protein, 24 aa, Mycobacterium
GRYRKVILSRCVDVPFELDFPSTY

SEQ ID NO: 767214 - protein, 19 aa, Mycobacterium
GRYRLKCVMAERIRVLEWL

SEQ ID NO: 767215 - protein, 17 aa, Mycobacterium
GRYRRVLTMAWEKQSES

SEQ ID NO: 767216 - protein, 18 aa, Mycobacterium
GSAARFGYQAGQFLTLLV

SEQ ID NO: 767217 - protein, 21 aa, Mycobacterium
GSAGLVFSDAGAGGFGGFGST

SEQ ID NO: 767218 - protein, 20 aa, Mycobacterium
GSALVPSWTAFAVIGLLEQH

SEQ ID NO: 767219 - protein, 17 aa, Mycobacterium
GSANLVWVSETSTNTVI

SEQ ID NO: 767220 - protein, 20 aa, Mycobacterium
GSAPDGPGFWFPPTVLTPSR

SEQ ID NO: 767221 - protein, 20 aa, Mycobacterium
GSAPQGPGFWFPPTVLTPAR

SEQ ID NO: 767222 - protein, 18 aa, Mycobacterium
GSAPRCWSMMELSWPSSG

SEQ ID NO: 767223 - protein, 24 aa, Mycobacterium
GSASMMAAAWAWNMLAAELDSAAT

SEQ ID NO: 767224 - protein, 26 aa, Mycobacterium
GSCCEACGFVHLPPGRVCKSCGATDR

SEQ ID NO: 767225 - protein, 20 aa, Mycobacterium
GSCPVSLFVPDTCEPVPGVV

SEQ ID NO: 767226 - protein, 18 aa, Mycobacterium
GSDEEWRCAAGVFDHHEW

SEQ ID NO: 767227 - protein, 24 aa, Mycobacterium
GSDLIVSGPIRWATNVFPDALMVL

SEQ ID NO: 767228 - protein, 18 aa, Mycobacterium
GSDLRPGNIWQTVEIPRL

SEQ ID NO: 767229 - protein, 20 aa, Mycobacterium
GSDPFGVAFAERYSEGIVPQ

SEQ ID NO: 767230 - protein, 19 aa, Mycobacterium
GSDVLPWLPARGVYLLVER

SEQ ID NO: 767231 - protein, 19 aa, Mycobacterium
GSEASLRLRFRGVDVVKAG

SEQ ID NO: 767232 - protein, 17 aa, Mycobacterium
GSEHFSRLVQPWNCTAV

SEQ ID NO: 767233 - protein, 17 aa, Mycobacterium
GSFFPVIPVCSTTGVGT

SEQ ID NO: 767234 - protein, 19 aa, Mycobacterium
GSFPYRNDGALGWVGTSPV

SEQ ID NO: 767235 - protein, 21 aa, Mycobacterium
GSFVVPFFRKVRFLTLAMCEA

SEQ ID NO: 767236 - protein, 17 aa, Mycobacterium
GSGCLMPGFVEAHGHPL

SEQ ID NO: 767237 - protein, 26 aa, Mycobacterium
GSGGDGGDGFGLWNPGEGGRGGSGGD

SEQ ID NO: 767238 - protein, 21 aa, Mycobacterium
GSGGFAFTFGTGNIIAGVGGD

SEQ ID NO: 767239 - protein, 18 aa, Mycobacterium
GSGHFLLGGFQRLLDRWH

SEQ ID NO: 767240 - protein, 18 aa, Mycobacterium
GSGLLPRMEPFVGELVGR

SEQ ID NO: 767241 - protein, 18 aa, Mycobacterium
GSGLPVFHPRGGVVRREL

SEQ ID NO: 767242 - protein, 18 aa, Mycobacterium
GSGNRGNGNFGFGNVVGD

SEQ ID NO: 767243 - protein, 18 aa, Mycobacterium
GSGNRGSRNFGAGNRGNG

SEQ ID NO: 767244 - protein, 17 aa, Mycobacterium
GSGPAWWQTLWNVWGPN

SEQ ID NO: 767245 - protein, 23 aa, Mycobacterium
GSGPMLAAALAWDGLSTELSSAA

SEQ ID NO: 767246 - protein, 20 aa, Mycobacterium
GSGPVIWLRADFDALPVQEQ

SEQ ID NO: 767247 - protein, 18 aa, Mycobacterium
GSGWIPWGSAFADLPAAI

SEQ ID NO: 767248 - protein, 18 aa, Mycobacterium
GSHIRTALTIAHEIAEHD

SEQ ID NO: 767249 - protein, 17 aa, Mycobacterium
GSIAVEWCRSAAGCTAV

SEQ ID NO: 767250 - protein, 17 aa, Mycobacterium
GSIGALSVPHSWGAAAP

SEQ ID NO: 767251 - protein, 18 aa, Mycobacterium
GSIPAGFMAPAENGIGGN

SEQ ID NO: 767252 - protein, 17 aa, Mycobacterium
GSIPFIAEFAAAFPDAT

SEQ ID NO: 767253 - protein, 17 aa, Mycobacterium
GSIPFIAEFAAAFPQAK

SEQ ID NO: 767254 - protein, 22 aa, Mycobacterium
GSKCPQCGTYVFPPRENNCPNP

SEQ ID NO: 767255 - protein, 18 aa, Mycobacterium
GSKVKVTIMFRGREQSRP

SEQ ID NO: 767256 - protein, 17 aa, Mycobacterium
GSLAIPVGLPLILGHEM

SEQ ID NO: 767257 - protein, 17 aa, Mycobacterium
GSLKGFVISGRWPDSTK

SEQ ID NO: 767258 - protein, 17 aa, Mycobacterium
GSLKGFVVSGRWPDSTK

SEQ ID NO: 767259 - protein, 17 aa, Mycobacterium
GSLKSSWYGDCLPERDF

SEQ ID NO: 767260 - protein, 19 aa, Mycobacterium
GSLLDEWSHKVVWAAQSLP

SEQ ID NO: 767261 - protein, 19 aa, Mycobacterium
GSLLSARWLRPPSGPGVLL

SEQ ID NO: 767262 - protein, 18 aa, Mycobacterium
GSLPEWLVPPGFSDGTGG

SEQ ID NO: 767263 - protein, 21 aa, Mycobacterium
GSLRFAVAFCYARFLRRGRKA

SEQ ID NO: 767264 - protein, 18 aa, Mycobacterium
GSLRRLDLAFSRDQAKRI

SEQ ID NO: 767265 - protein, 24 aa, Mycobacterium
GSLVAFGWFSWRSAIGTAGFDTTG

SEQ ID NO: 767266 - protein, 25 aa, Mycobacterium
GSLVTALACGGLAYFAASSDMSTLF

SEQ ID NO: 767267 - protein, 18 aa, Mycobacterium
GSNLFGFGGLNSGTNNTG

SEQ ID NO: 767268 - protein, 18 aa, Mycobacterium
GSNPLVFDTANPGAAGQD

SEQ ID NO: 767269 - protein, 23 aa, Mycobacterium
GSPAWNLPVVFGPIAVTYNISGV

SEQ ID NO: 767270 - protein, 23 aa, Mycobacterium
GSPKGEGLLAVFGYPQAHEDDAR

SEQ ID NO: 767271 - protein, 18 aa, Mycobacterium
GSPLAWLLTLAHRRAVDR

SEQ ID NO: 767272 - protein, 18 aa, Mycobacterium
GSPPACWRRAVGEPVGGS

SEQ ID NO: 767273 - protein, 20 aa, Mycobacterium
GSPWPSWRTHPLLFPFLHGH

SEQ ID NO: 767274 - protein, 18 aa, Mycobacterium
GSRAGLVGRAWLRAGHRF

SEQ ID NO: 767275 - protein, 23 aa, Mycobacterium
GSRARFGDVLPFLVKVLAADEPL

SEQ ID NO: 767276 - protein, 25 aa, Mycobacterium
GSRFPIGSCISGWAMLNRDAAVIPD

SEQ ID NO: 767277 - protein, 21 aa, Mycobacterium
GSRIDPVLARSWLLVNGAHGE

SEQ ID NO: 767278 - protein, 22 aa, Mycobacterium
GSRMRPDIVIKFMDRFGDVIYN

SEQ ID NO: 767279 - protein, 24 aa, Mycobacterium
GSRPARLWPFREVRGERHVAPATP

SEQ ID NO: 767280 - protein, 23 aa, Mycobacterium
GSRTRFGDVLPFLVKVLAADEPL

SEQ ID NO: 767281 - protein, 29 aa, Mycobacterium
GSRVAVLLPAHWQTAAVLFGIWWIGAEVV

SEQ ID NO: 767282 - protein, 18 aa, Mycobacterium
GSRVCLMVAELHADREGG

SEQ ID NO: 767283 - protein, 20 aa, Mycobacterium
GSSILLHFHATAFLNASGWS

SEQ ID NO: 767284 - protein, 25 aa, Mycobacterium
GSSKWALKIAREWSGERVQWGKPLA

SEQ ID NO: 767285 - protein, 20 aa, Mycobacterium
GSSLRLPYFGSFPETNVRLY

SEQ ID NO: 767286 - protein, 20 aa, Mycobacterium
GSSLVTGWARLWGYPVGILA

SEQ ID NO: 767287 - protein, 25 aa, Mycobacterium
GSSRYPGGVALRFARVLRYRDDKSP

SEQ ID NO: 767288 - protein, 20 aa, Mycobacterium
GSSWPMSRLTLALSPATLRK

SEQ ID NO: 767289 - protein, 18 aa, Mycobacterium
GSTAPCWPSATHRRPCSG

SEQ ID NO: 767290 - protein, 19 aa, Mycobacterium
GSTLRFAPPLVITAQEIDW

SEQ ID NO: 767291 - protein, 18 aa, Mycobacterium
GSTLRFAPPLVVTEQEID

SEQ ID NO: 767292 - protein, 18 aa, Mycobacterium
GSVALSWDGGALTYRQLD

SEQ ID NO: 767293 - protein, 21 aa, Mycobacterium
GSVANWWARHLRLRPGMAASL

SEQ ID NO: 767294 - protein, 18 aa, Mycobacterium
GSVAYRYTWHLPKNRTWT

SEQ ID NO: 767295 - protein, 25 aa, Mycobacterium
GSVFPRTYYLGGLFFLGPINLGAST

SEQ ID NO: 767296 - protein, 18 aa, Mycobacterium
GSVHRFRSADAFASYTGT

SEQ ID NO: 767297 - protein, 18 aa, Mycobacterium
GSVLEFLEVLGPLTDPRA

SEQ ID NO: 767298 - protein, 19 aa, Mycobacterium
GSVLELRADYGVGIVTALV

SEQ ID NO: 767299 - protein, 20 aa, Mycobacterium
GSVNCIRHLAAICAEADLDL

SEQ ID NO: 767300 - protein, 18 aa, Mycobacterium
GSVPMIVGALPFDVSEPA

SEQ ID NO: 767301 - protein, 23 aa, Mycobacterium
GSWRVNCLGPFLGIRTALPHLRR

SEQ ID NO: 767302 - protein, 24 aa, Mycobacterium
GTADHKASVLSFVLDGHDPVEVGK

SEQ ID NO: 767303 - protein, 18 aa, Mycobacterium
GTAEPRGSSILNVTSAQF

SEQ ID NO: 767304 - protein, 19 aa, Mycobacterium
GTAGRASAAAAVFEAAQAA

SEQ ID NO: 767305 - protein, 25 aa, Mycobacterium
GTAINYGAGDAFGGAAGKGGTGVVG

SEQ ID NO: 767306 - protein, 18 aa, Mycobacterium
GTALRPAPVGAYPAGASA

SEQ ID NO: 767307 - protein, 24 aa, Mycobacterium
GTANFRAGPALAFMSGNLCYQIEH

SEQ ID NO: 767308 - protein, 25 aa, Mycobacterium
GTCDELGRRCCWVLLDADGPVSLTL

SEQ ID NO: 767309 - protein, 19 aa, Mycobacterium
GTCVFEFPVALGTLPDAPK

SEQ ID NO: 767310 - protein, 18 aa, Mycobacterium
GTDEEWDRILAVNLRAHI

SEQ ID NO: 767311 - protein, 25 aa, Mycobacterium
GTDEQKLRWAVPILRAQITASLGMS

SEQ ID NO: 767312 - protein, 20 aa, Mycobacterium
GTDFRRPGCLCADQPQPCQW

SEQ ID NO: 767313 - protein, 25 aa, Mycobacterium
GTDGYGGWGGEGGWGGDAGTTRLSS

SEQ ID NO: 767314 - protein, 17 aa, Mycobacterium
GTDIALWVTTKEVPAVL

SEQ ID NO: 767315 - protein, 18 aa, Mycobacterium
GTDLRPYFTYSRDKLSFG

SEQ ID NO: 767316 - protein, 27 aa, Mycobacterium
GTDVLKRLRGMFAFALWDTVTRELFCA

SEQ ID NO: 767317 - protein, 21 aa, Mycobacterium
GTDVLYCPYCHGWEVRDQPIG

SEQ ID NO: 767318 - protein, 17 aa, Mycobacterium
GTDVSVIAYGRCVHDAL

SEQ ID NO: 767319 - protein, 18 aa, Mycobacterium
GTECLRYRLEVVATSAID

SEQ ID NO: 767320 - protein, 26 aa, Mycobacterium
GTEFLNKAVIKWAAQMEIFFTRSRPY

SEQ ID NO: 767321 - protein, 17 aa, Mycobacterium
GTELSRFGFDPGALSPS

SEQ ID NO: 767322 - protein, 17 aa, Mycobacterium
GTEPPGWEWLWELESQG

SEQ ID NO: 767323 - protein, 17 aa, Mycobacterium
GTESWVPVNKVHPSGGD

SEQ ID NO: 767324 - protein, 23 aa, Mycobacterium
GTFPGSNLLLGFFNSYPIQTFNS

SEQ ID NO: 767325 - protein, 17 aa, Mycobacterium
GTFPWFQVDSVIPFATL

SEQ ID NO: 767326 - protein, 30 aa, Mycobacterium
GTFVKFHWKPRLGVHSLIWDECQKIAGKDP

SEQ ID NO: 767327 - protein, 22 aa, Mycobacterium
GTGCVPCSSMGRLFDAVASLLG

SEQ ID NO: 767328 - protein, 19 aa, Mycobacterium
GTGDLVSPTAGYQGGQGGM

SEQ ID NO: 767329 - protein, 19 aa, Mycobacterium
GTGEVAAYCARKGTERLRS

SEQ ID NO: 767330 - protein, 22 aa, Mycobacterium
GTGGDGGRARGLLGDGGTGGDG

SEQ ID NO: 767331 - protein, 19 aa, Mycobacterium
GTGGFEWDPALTQAFLRGP

SEQ ID NO: 767332 - protein, 24 aa, Mycobacterium
GTGKRATSVIPRYGVRLTVMARPP

SEQ ID NO: 767333 - protein, 18 aa, Mycobacterium
GTGLPQWRDVSGADMLRH

SEQ ID NO: 767334 - protein, 17 aa, Mycobacterium
GTGPLGWLYSASEDSAS

SEQ ID NO: 767335 - protein, 21 aa, Mycobacterium
GTGQGGISFLAPGGQTGGDGS

SEQ ID NO: 767336 - protein, 22 aa, Mycobacterium
GTGQRLHTTWTWAPSALDEEQI

SEQ ID NO: 767337 - protein, 19 aa, Mycobacterium
GTGRGFCSGAGMSAEDVVR

SEQ ID NO: 767338 - protein, 20 aa, Mycobacterium
GTGTRVAWQWTLHPKSGVSA

SEQ ID NO: 767339 - protein, 17 aa, Mycobacterium
GTGWELFGRRAIRQGDW

SEQ ID NO: 767340 - protein, 20 aa, Mycobacterium
GTGWLPGWRLTFGGEDIGWE

SEQ ID NO: 767341 - protein, 24 aa, Mycobacterium
GTGWTTPMGHRWVFGGGYVAGLGD

SEQ ID NO: 767342 - protein, 18 aa, Mycobacterium
GTIAHGFMTLALLPRLQH

SEQ ID NO: 767343 - protein, 17 aa, Mycobacterium
GTIALAFAAVLIGAGEF

SEQ ID NO: 767344 - protein, 23 aa, Mycobacterium
GTIGWGGVYGHSWFVDAARGLSV

SEQ ID NO: 767345 - protein, 17 aa, Mycobacterium
GTIPLQFQTEVRDGCPS

SEQ ID NO: 767346 - protein, 17 aa, Mycobacterium
GTIPYQRFRGWEIAGLT

SEQ ID NO: 767347 - protein, 20 aa, Mycobacterium
GTLARLEWIKARGYAITDTV

SEQ ID NO: 767348 - protein, 19 aa, Mycobacterium
GTLDRLSCAFSRDRGPQGP

SEQ ID NO: 767349 - protein, 17 aa, Mycobacterium
GTLEHLASWGIVAAAPN

SEQ ID NO: 767350 - protein, 18 aa, Mycobacterium
GTLEKWDLGYDVLRERNP

SEQ ID NO: 767351 - protein, 18 aa, Mycobacterium
GTLFRRFGSRAGLMLVLL

SEQ ID NO: 767352 - protein, 19 aa, Mycobacterium
GTLFRRFGSRTGLLLALLD

SEQ ID NO: 767353 - protein, 18 aa, Mycobacterium
GTLICRWHGLALDGHSRE

SEQ ID NO: 767354 - protein, 19 aa, Mycobacterium
GTLLREFGLMLPVEPDTRL

SEQ ID NO: 767355 - protein, 18 aa, Mycobacterium
GTLPIVFSLGGLNAGSTG

SEQ ID NO: 767356 - protein, 17 aa, Mycobacterium
GTLRLARQIARSAELLV

SEQ ID NO: 767357 - protein, 22 aa, Mycobacterium
GTLTAGASWEWKPREDPGQEPG

SEQ ID NO: 767358 - protein, 19 aa, Mycobacterium
GTLYLATRGGYFVVDVATG

SEQ ID NO: 767359 - protein, 18 aa, Mycobacterium
GTMSYYLASAFREIWMQP

SEQ ID NO: 767360 - protein, 17 aa, Mycobacterium
GTNTGWFNAGIVNTGIG

SEQ ID NO: 767361 - protein, 20 aa, Mycobacterium
GTPFLPQWACEPEDVAAAVC

SEQ ID NO: 767362 - protein, 18 aa, Mycobacterium
GTPGDWWTVFALVPDALK

SEQ ID NO: 767363 - protein, 20 aa, Mycobacterium
GTPGGWLLGDGGAGGSGAAN

SEQ ID NO: 767364 - protein, 20 aa, Mycobacterium
GTPGGWLLGDGGAGGSGGTG

SEQ ID NO: 767365 - protein, 20 aa, Mycobacterium
GTPLGPLRCEAWVDGKEGRK

SEQ ID NO: 767366 - protein, 20 aa, Mycobacterium
GTPLGPLRCEAWVDRTEGVK

SEQ ID NO: 767367 - protein, 20 aa, Mycobacterium
GTPLRSYRVADFAALADAMQ

SEQ ID NO: 767368 - protein, 17 aa, Mycobacterium
GTPPAANANFAWIQHIL

SEQ ID NO: 767369 - protein, 19 aa, Mycobacterium
GTPPWWPMRQLVRALGADA

SEQ ID NO: 767370 - protein, 17 aa, Mycobacterium
GTPSYFAQLAFAVFHVV

SEQ ID NO: 767371 - protein, 17 aa, Mycobacterium
GTPWLLRFFDQINWYPV

SEQ ID NO: 767372 - protein, 24 aa, Mycobacterium
GTRLCHFYRGIGLTIYEGYGLTET

SEQ ID NO: 767373 - protein, 18 aa, Mycobacterium
GTRLKARVPIALAAALSE

SEQ ID NO: 767374 - protein, 17 aa, Mycobacterium
GTRLPVWLAQWGFARPV

SEQ ID NO: 767375 - protein, 17 aa, Mycobacterium
GTRLPVWLAQWGFQRPA

SEQ ID NO: 767376 - protein, 20 aa, Mycobacterium
GTSAGRYGGIWAIDETRKAA

SEQ ID NO: 767377 - protein, 18 aa, Mycobacterium
GTSCGSCIPMLKQILAAQ

SEQ ID NO: 767378 - protein, 19 aa, Mycobacterium
GTSFARWAAILSEHARSPA

SEQ ID NO: 767379 - protein, 20 aa, Mycobacterium
GTSFARWAALLAEHAHAPDV

SEQ ID NO: 767380 - protein, 19 aa, Mycobacterium
GTSFARWASLLAERAHVPA

SEQ ID NO: 767381 - protein, 19 aa, Mycobacterium
GTSFARWSALLAEHALSTD

SEQ ID NO: 767382 - protein, 19 aa, Mycobacterium
GTSFARWSSLLAEYAQTAE

SEQ ID NO: 767383 - protein, 25 aa, Mycobacterium
GTSGDGTQVAWGRGGDGGDGGQGGY

SEQ ID NO: 767384 - protein, 25 aa, Mycobacterium
GTSGGMGGTGGWLWGNGGAGGGGGV

SEQ ID NO: 767385 - protein, 18 aa, Mycobacterium
GTSIACSRWGMLSPEGQC

SEQ ID NO: 767386 - protein, 24 aa, Mycobacterium
GTSRFSVGHAVDWNLAATVGGKLA

SEQ ID NO: 767387 - protein, 19 aa, Mycobacterium
GTTIFPFRRVFVVAEVGGA

SEQ ID NO: 767388 - protein, 19 aa, Mycobacterium
GTTPIRWLIEQRIQASLAL

SEQ ID NO: 767389 - protein, 17 aa, Mycobacterium
GTVERIWAGISPEDAPG

SEQ ID NO: 767390 - protein, 17 aa, Mycobacterium
GTVSGLYVCEMVTARAL

SEQ ID NO: 767391 - protein, 18 aa, Mycobacterium
GTVSGLYVCEMVTARALV

SEQ ID NO: 767392 - protein, 17 aa, Mycobacterium
GTVSPVFGERLVSVTYS

SEQ ID NO: 767393 - protein, 18 aa, Mycobacterium
GTVVAELTAGPWAGPTSA

SEQ ID NO: 767394 - protein, 19 aa, Mycobacterium
GTVVYRFTWHLPKNRTWTY

SEQ ID NO: 767395 - protein, 17 aa, Mycobacterium
GTWCPPNPIAQVVDRNG

SEQ ID NO: 767396 - protein, 19 aa, Mycobacterium
GTWTAALIGAWWPAPSTAL

SEQ ID NO: 767397 - protein, 23 aa, Mycobacterium
GTYFKGHLYIAGRIKDLVIIDGR

SEQ ID NO: 767398 - protein, 21 aa, Mycobacterium
GTYLGALGWRIAGVSNTDLFA

SEQ ID NO: 767399 - protein, 28 aa, Mycobacterium
GTYRSAGGDSCYWERLRGVGGTLDEVIA

SEQ ID NO: 767400 - protein, 20 aa, Mycobacterium
GVAANWRAGGGWTDGRQRLG

SEQ ID NO: 767401 - protein, 17 aa, Mycobacterium
GVACPRFVDFVERGVTS

SEQ ID NO: 767402 - protein, 21 aa, Mycobacterium
GVACYPARFQLVLAANLCPCA

SEQ ID NO: 767403 - protein, 22 aa, Mycobacterium
GVACYPARFQLVLAANLCPCAP

SEQ ID NO: 767404 - protein, 22 aa, Mycobacterium
GVAESWAKFALGTADQMANPLG

SEQ ID NO: 767405 - protein, 19 aa, Mycobacterium
GVAIRAFELAVRYAQQRHT

SEQ ID NO: 767406 - protein, 21 aa, Mycobacterium
GVALRIGWRALTFAGLRGNER

SEQ ID NO: 767407 - protein, 17 aa, Mycobacterium
GVAMQFAYQFPQLVDRL

SEQ ID NO: 767408 - protein, 17 aa, Mycobacterium
GVARSGFYFYFDSKYAV

SEQ ID NO: 767409 - protein, 17 aa, Mycobacterium
GVCALVLDHVLGATAHH

SEQ ID NO: 767410 - protein, 18 aa, Mycobacterium
GVCALVLDHVLGATAHQP

SEQ ID NO: 767411 - protein, 17 aa, Mycobacterium
GVDAARYALIRSSVDTP

SEQ ID NO: 767412 - protein, 23 aa, Mycobacterium
GVDDAWAALQWVAANAAELGGDP

SEQ ID NO: 767413 - protein, 17 aa, Mycobacterium
GVDGYRWMIRCVLQGPA

SEQ ID NO: 767414 - protein, 17 aa, Mycobacterium
GVDGYRWMIRCVVNGPH

SEQ ID NO: 767415 - protein, 19 aa, Mycobacterium
GVDHLRKVVGWARDRGVLV

SEQ ID NO: 767416 - protein, 20 aa, Mycobacterium
GVDIAFNWDHFFPLYGDPDG

SEQ ID NO: 767417 - protein, 18 aa, Mycobacterium
GVDPRAANTMVHIFAEPS

SEQ ID NO: 767418 - protein, 23 aa, Mycobacterium
GVDPRWEWDIGLLNLRRRMEEDF

SEQ ID NO: 767419 - protein, 21 aa, Mycobacterium
GVDQLRYFLLREVPFGQDGSY

SEQ ID NO: 767420 - protein, 21 aa, Mycobacterium
GVDQLRYFLLREVSFGQDGSY

SEQ ID NO: 767421 - protein, 21 aa, Mycobacterium
GVEALLRWRVGGVEIPAGEIV

SEQ ID NO: 767422 - protein, 18 aa, Mycobacterium
GVECYRRFISGLLDITDN

SEQ ID NO: 767423 - protein, 17 aa, Mycobacterium
GVEDARTAWQLHTAAGG

SEQ ID NO: 767424 - protein, 18 aa, Mycobacterium
GVEWKDIQFGFGGSHEVS

SEQ ID NO: 767425 - protein, 18 aa, Mycobacterium
GVEWKDIQFGFGGSYEVS

SEQ ID NO: 767426 - protein, 17 aa, Mycobacterium
GVFCRRWGVPLIDGGTV

SEQ ID NO: 767427 - protein, 18 aa, Mycobacterium
GVFEAEFGDGSKLGLQIE

SEQ ID NO: 767428 - protein, 21 aa, Mycobacterium
GVFGFKCFLLHSGVDEFPHLD

SEQ ID NO: 767429 - protein, 19 aa, Mycobacterium
GVFLPPWGKVEQWLLSVQH

SEQ ID NO: 767430 - protein, 18 aa, Mycobacterium
GVFPRALPRVGLDSLPDE

SEQ ID NO: 767431 - protein, 23 aa, Mycobacterium
GVFREWLTDFARQWGNFLDTPES

SEQ ID NO: 767432 - protein, 21 aa, Mycobacterium
GVFVKFHWKPLLGVHSLLWDE

SEQ ID NO: 767433 - protein, 23 aa, Mycobacterium
GVGAWLVLCCRAIRAGAQEALTI

SEQ ID NO: 767434 - protein, 18 aa, Mycobacterium
GVGEAWLQEQLDIERRHC

SEQ ID NO: 767435 - protein, 23 aa, Mycobacterium
GVGFRWWTRCRALELGLTGYAAN

SEQ ID NO: 767436 - protein, 23 aa, Mycobacterium
GVGGKGIQGGQGLQGGKGGDGGA

SEQ ID NO: 767437 - protein, 18 aa, Mycobacterium
GVGGRLYSGNGIPDIFGR

SEQ ID NO: 767438 - protein, 23 aa, Mycobacterium
GVGGTGGDAGWLVGAGGSGGSGG

SEQ ID NO: 767439 - protein, 26 aa, Mycobacterium
GVGGVDRALIGWSGGAGGVGGSGGAG

SEQ ID NO: 767440 - protein, 24 aa, Mycobacterium
GVGGVGGRVVGLFGSGGGGGAGGD

SEQ ID NO: 767441 - protein, 19 aa, Mycobacterium
GVGIRAFELAVRYAQQRHT

SEQ ID NO: 767442 - protein, 18 aa, Mycobacterium
GVGKTWKPGDFETLLGDV

SEQ ID NO: 767443 - protein, 18 aa, Mycobacterium
GVGMLAVRRELMESLRPR

SEQ ID NO: 767444 - protein, 17 aa, Mycobacterium
GVGRAGLVGGLSVPQGW

SEQ ID NO: 767445 - protein, 17 aa, Mycobacterium
GVGRSGFYFYFDSKYSV

SEQ ID NO: 767446 - protein, 17 aa, Mycobacterium
GVHRVPLARAMRSVHRH

SEQ ID NO: 767447 - protein, 24 aa, Mycobacterium
GVHVFFRIATDWDFIQVRRAGIAL

SEQ ID NO: 767448 - protein, 23 aa, Mycobacterium
GVIGMIVADLWGGSVSNWLTAQR

SEQ ID NO: 767449 - protein, 21 aa, Mycobacterium
GVKDFLGATPFGGPDPTKGFQ

SEQ ID NO: 767450 - protein, 17 aa, Mycobacterium
GVKYCYNSSLAHCRIQV

SEQ ID NO: 767451 - protein, 25 aa, Mycobacterium
GVLARVSSLFSRRGFNIQSLAVGAT

SEQ ID NO: 767452 - protein, 18 aa, Mycobacterium
GVLDPRFDAYVGRTIADI

SEQ ID NO: 767453 - protein, 22 aa, Mycobacterium
GVLERFNGLYLPIVDVLFNGAT

SEQ ID NO: 767454 - protein, 24 aa, Mycobacterium
GVLGDCMSHWTLPHLVGGAVAADL

SEQ ID NO: 767455 - protein, 17 aa, Mycobacterium
GVLGFREHASWALTSDI

SEQ ID NO: 767456 - protein, 18 aa, Mycobacterium
GVLGRLWLARGGTYVLAN

SEQ ID NO: 767457 - protein, 17 aa, Mycobacterium
GVLPILERMGLWRHPNR

SEQ ID NO: 767458 - protein, 18 aa, Mycobacterium
GVLPLLERRGLWARPNGQ

SEQ ID NO: 767459 - protein, 18 aa, Mycobacterium
GVLPTVWDAWSARLAVDA

SEQ ID NO: 767460 - protein, 17 aa, Mycobacterium
GVLQYRVLRAFKKAGLN

SEQ ID NO: 767461 - protein, 20 aa, Mycobacterium
GVLTRLDLAFSRDGANGEPK

SEQ ID NO: 767462 - protein, 18 aa, Mycobacterium
GVLTRLWKRLGDIRYMDP

SEQ ID NO: 767463 - protein, 18 aa, Mycobacterium
GVLYGRRALLNALPPFLT

SEQ ID NO: 767464 - protein, 23 aa, Mycobacterium
GVLYGRRELLAAMPPFLTGGSMI

SEQ ID NO: 767465 - protein, 19 aa, Mycobacterium
GVLYGRRGLLDAMPPFITG

SEQ ID NO: 767466 - protein, 24 aa, Mycobacterium
GVMPRFPLPLGESGPHPERVEVRD

SEQ ID NO: 767467 - protein, 18 aa, Mycobacterium
GVMPWNFPVYQIARFAAP

SEQ ID NO: 767468 - protein, 20 aa, Mycobacterium
GVNLRGFFELTRAALGALPA

SEQ ID NO: 767469 - protein, 18 aa, Mycobacterium
GVNLTFLPFFAKAAVEAL

SEQ ID NO: 767470 - protein, 19 aa, Mycobacterium
GVNLTFLPFFARAVIDALK

SEQ ID NO: 767471 - protein, 20 aa, Mycobacterium
GVPAARFYIDYSDFSVWILD

SEQ ID NO: 767472 - protein, 17 aa, Mycobacterium
GVPAEWFLAGHVVIGRP

SEQ ID NO: 767473 - protein, 19 aa, Mycobacterium
GVPGIRVGNVLSPDDGEMA

SEQ ID NO: 767474 - protein, 19 aa, Mycobacterium
GVPIDIWWFRLPKHPDDPQ

SEQ ID NO: 767475 - protein, 23 aa, Mycobacterium
GVPLFDIAAAPGFGNTTTSYSSG

SEQ ID NO: 767476 - protein, 17 aa, Mycobacterium
GVPNWRSAPPVVLAVKD

SEQ ID NO: 767477 - protein, 23 aa, Mycobacterium
GVPPPFGSGDYLAGSGGNGGNAG

SEQ ID NO: 767478 - protein, 17 aa, Mycobacterium
GVPRAPVGMFAPHSPAG

SEQ ID NO: 767479 - protein, 17 aa, Mycobacterium
GVPVDWPAVFAGSGGRR

SEQ ID NO: 767480 - protein, 20 aa, Mycobacterium
GVPVLRNGRRAFKMPRPTFG

SEQ ID NO: 767481 - protein, 18 aa, Mycobacterium
GVQKRLFIDGKWVDATDG

SEQ ID NO: 767482 - protein, 24 aa, Mycobacterium
GVQSALCFPSFPGFGGGTFQRAED

SEQ ID NO: 767483 - protein, 20 aa, Mycobacterium
GVREAACFEIPDPEFGALVG

SEQ ID NO: 767484 - protein, 24 aa, Mycobacterium
GVRELCTRYGIVFIADEVMAGFGR

SEQ ID NO: 767485 - protein, 25 aa, Mycobacterium
GVRKLAGFWGHCWQSAVFGSGRAFG

SEQ ID NO: 767486 - protein, 23 aa, Mycobacterium
GVRRPVVVMAHGFGGTKDSGLEP

SEQ ID NO: 767487 - protein, 17 aa, Mycobacterium
GVRVWSLYVPNGRSIDS

SEQ ID NO: 767488 - protein, 20 aa, Mycobacterium
GVSLAEVWKTQAYAYLGITV

SEQ ID NO: 767489 - protein, 19 aa, Mycobacterium
GVSMDWPKAFAGLGARPVE

SEQ ID NO: 767490 - protein, 25 aa, Mycobacterium
GVSNSRIVVGGLWGNGGHGGTGGTG

SEQ ID NO: 767491 - protein, 18 aa, Mycobacterium
GVSPELVRRLIIKALPRL

SEQ ID NO: 767492 - protein, 17 aa, Mycobacterium
GVSRGWLYRHFPDKVSL

SEQ ID NO: 767493 - protein, 17 aa, Mycobacterium
GVSRPTLYRWFASKEEL

SEQ ID NO: 767494 - protein, 23 aa, Mycobacterium
GVSSRFKAPFAFTGGTIAQVTVD

SEQ ID NO: 767495 - protein, 18 aa, Mycobacterium
GVSTCATCDGFFFRDQDI

SEQ ID NO: 767496 - protein, 21 aa, Mycobacterium
GVTFALRLAFGLPVDADTEHI

SEQ ID NO: 767497 - protein, 19 aa, Mycobacterium
GVTKGRWLGVAGRAKADDI

SEQ ID NO: 767498 - protein, 24 aa, Mycobacterium
GVTLPLLLPIGLGFVVLDVPFDGI

SEQ ID NO: 767499 - protein, 23 aa, Mycobacterium
GVTPRMWDWWFGWHGTDTRRYKL

SEQ ID NO: 767500 - protein, 17 aa, Mycobacterium
GVTPWITLSCRDRNRVV

SEQ ID NO: 767501 - protein, 17 aa, Mycobacterium
GVTWGVIQYHFGDRNGL

SEQ ID NO: 767502 - protein, 20 aa, Mycobacterium
GVTWLPRWVSAHLNGQLRAV

SEQ ID NO: 767503 - protein, 17 aa, Mycobacterium
GVVCGRDLAVPALVIGN

SEQ ID NO: 767504 - protein, 18 aa, Mycobacterium
GVVFYPVIPLGSWVATTE

SEQ ID NO: 767505 - protein, 18 aa, Mycobacterium
GVVIGRGCLGRPWLFAEL

SEQ ID NO: 767506 - protein, 19 aa, Mycobacterium
GVVIGRGCLGRPWLFAELS

SEQ ID NO: 767507 - protein, 26 aa, Mycobacterium
GVVIGRGCLGRPWLFAELSAAFTDSP

SEQ ID NO: 767508 - protein, 27 aa, Mycobacterium
GVVIGRGCLGRPWLFAELSAVFNGQTI

SEQ ID NO: 767509 - protein, 19 aa, Mycobacterium
GVVLLMWAGILAYLDRYGY

SEQ ID NO: 767510 - protein, 17 aa, Mycobacterium
GVVPRIPAIPGIDHPRV

SEQ ID NO: 767511 - protein, 18 aa, Mycobacterium
GVVPRISVVNGRCFAGNA

SEQ ID NO: 767512 - protein, 18 aa, Mycobacterium
GVVPRYGLRMTVMSRPLS

SEQ ID NO: 767513 - protein, 18 aa, Mycobacterium
GVVRFIGVDGYRWMIRCV

SEQ ID NO: 767514 - protein, 25 aa, Mycobacterium
GVVSGLSAFPGGIGGAGGAGGQGGQ

SEQ ID NO: 767515 - protein, 17 aa, Mycobacterium
GVWRGGASILMRAVLAV

SEQ ID NO: 767516 - protein, 17 aa, Mycobacterium
GVYPRAVPAPALGDDTD

SEQ ID NO: 767517 - protein, 17 aa, Mycobacterium
GWAAPAWPVKYGGQPWS

SEQ ID NO: 767518 - protein, 22 aa, Mycobacterium
GWAGSLKRQGEWTVPTRLALVR

SEQ ID NO: 767519 - protein, 18 aa, Mycobacterium
GWARKPLWLPYFPPLEAT

SEQ ID NO: 767520 - protein, 22 aa, Mycobacterium
GWCPHCGSAYSFLPQLNPGDIV

SEQ ID NO: 767521 - protein, 17 aa, Mycobacterium
GWDEAWEITVATFGYTN

SEQ ID NO: 767522 - protein, 17 aa, Mycobacterium
GWDGALIGTGWGRPDTF

SEQ ID NO: 767523 - protein, 17 aa, Mycobacterium
GWDSPAADAARGRIGTA

SEQ ID NO: 767524 - protein, 21 aa, Mycobacterium
GWFGGCCYHCDQCRKGLFIHC

SEQ ID NO: 767525 - protein, 19 aa, Mycobacterium
GWFVESWLSPRLHRRNQYV

SEQ ID NO: 767526 - protein, 18 aa, Mycobacterium
GWGVPGLSWLPGEGPDPF

SEQ ID NO: 767527 - protein, 19 aa, Mycobacterium
GWGVPGLTWMPGEDPDPFG

SEQ ID NO: 767528 - protein, 19 aa, Mycobacterium
GWISGLLLELGITSLDALT

SEQ ID NO: 767529 - protein, 18 aa, Mycobacterium
GWLAFTFELCRQRIIDPT

SEQ ID NO: 767530 - protein, 19 aa, Mycobacterium
GWLALTFEICRQRIIDPTT

SEQ ID NO: 767531 - protein, 19 aa, Mycobacterium
GWLARTGFQMLDPIKTAQS

SEQ ID NO: 767532 - protein, 19 aa, Mycobacterium
GWLGRFLTLQWLERLAPVG

SEQ ID NO: 767533 - protein, 17 aa, Mycobacterium
GWLKDKFGLSWQVVSRE

SEQ ID NO: 767534 - protein, 17 aa, Mycobacterium
GWPSGVWIDEPRRTAPD

SEQ ID NO: 767535 - protein, 18 aa, Mycobacterium
GWPTLRGSTLIDEAGPWD

SEQ ID NO: 767536 - protein, 19 aa, Mycobacterium
GWREARWLMVVVNYRAARW

SEQ ID NO: 767537 - protein, 22 aa, Mycobacterium
GWREYGARVGIWRTIESLDRHG

SEQ ID NO: 767538 - protein, 19 aa, Mycobacterium
GWRLGWLLVPEKLRRAVDC

SEQ ID NO: 767539 - protein, 18 aa, Mycobacterium
GWRNLRSGYQVKTYGDDD

SEQ ID NO: 767540 - protein, 21 aa, Mycobacterium
GWRSPRAAAWTRRWRRCGRSR

SEQ ID NO: 767541 - protein, 19 aa, Mycobacterium
GWSAVRWRNLTGGIVALHA

SEQ ID NO: 767542 - protein, 20 aa, Mycobacterium
GWVNLHFSLLPAWRGAAPVQ

SEQ ID NO: 767543 - protein, 18 aa, Mycobacterium
GWYEHEWRAYGYGFPGAA

SEQ ID NO: 767544 - protein, 18 aa, Mycobacterium
GWYEHEWRAYGYGFPSAG

SEQ ID NO: 767545 - protein, 20 aa, Mycobacterium
GYAACHWCHVMAHESFEDAE

SEQ ID NO: 767546 - protein, 20 aa, Mycobacterium
GYAACHWCHVMAHESFEDDE

SEQ ID NO: 767547 - protein, 20 aa, Mycobacterium
GYAACHWCHVMAHESFSDDE

SEQ ID NO: 767548 - protein, 18 aa, Mycobacterium
GYAAQKWFLQHCGIAIND

SEQ ID NO: 767549 - protein, 21 aa, Mycobacterium
GYAGEIGMRVILDHHRSSKGA

SEQ ID NO: 767550 - protein, 17 aa, Mycobacterium
GYAGWRKAVQRTLDWVD

SEQ ID NO: 767551 - protein, 24 aa, Mycobacterium
GYAKIANCALGFPVVNIARSSAKL

SEQ ID NO: 767552 - protein, 20 aa, Mycobacterium
GYDPNLWRLLCEQVGAAALV

SEQ ID NO: 767553 - protein, 18 aa, Mycobacterium
GYEPRPEYIAARDFTPLT

SEQ ID NO: 767554 - protein, 18 aa, Mycobacterium
GYGAHGYRCYRLVATSDT

SEQ ID NO: 767555 - protein, 17 aa, Mycobacterium
GYGEMFAALGFGDLVRS

SEQ ID NO: 767556 - protein, 19 aa, Mycobacterium
GYGPAFRGLRAVWRRGAEV

SEQ ID NO: 767557 - protein, 22 aa, Mycobacterium
GYGSLIQMIWIYDRAVDVEGLR

SEQ ID NO: 767558 - protein, 18 aa, Mycobacterium
GYHGWTWDLTGELRRVPN

SEQ ID NO: 767559 - protein, 17 aa, Mycobacterium
GYHLGWWDVNGVPVDGS

SEQ ID NO: 767560 - protein, 22 aa, Mycobacterium
GYHWSRPEYWRDLGRTMERGLF

SEQ ID NO: 767561 - protein, 17 aa, Mycobacterium
GYKAGCIASLIRGATVL

SEQ ID NO: 767562 - protein, 18 aa, Mycobacterium
GYLCVPLAGEICDRLGLL

SEQ ID NO: 767563 - protein, 20 aa, Mycobacterium
GYLGRFLALEWLERLAETGG

SEQ ID NO: 767564 - protein, 20 aa, Mycobacterium
GYLGRFLALEWLERLDKTDG

SEQ ID NO: 767565 - protein, 23 aa, Mycobacterium
GYLGRFLCLDWLERLAPTGGTVI

SEQ ID NO: 767566 - protein, 17 aa, Mycobacterium
GYLKWNRTRGWRGQRAA

SEQ ID NO: 767567 - protein, 18 aa, Mycobacterium
GYLLVSFEDVLGRPLAQA

SEQ ID NO: 767568 - protein, 19 aa, Mycobacterium
GYLQPHWPAPYGRAADSVE

SEQ ID NO: 767569 - protein, 17 aa, Mycobacterium
GYLRAAVRPEWPQLVDA

SEQ ID NO: 767570 - protein, 18 aa, Mycobacterium
GYLVEWDLPADLDMETYL

SEQ ID NO: 767571 - protein, 20 aa, Mycobacterium
GYPTFCPTGPWLFTTGSDTT

SEQ ID NO: 767572 - protein, 18 aa, Mycobacterium
GYREMVGWGRGRTSGALR

SEQ ID NO: 767573 - protein, 21 aa, Mycobacterium
GYRGDMAFATLIVGGGGSEAA

SEQ ID NO: 767574 - protein, 18 aa, Mycobacterium
GYRLPWAAGTTVYELDLP

SEQ ID NO: 767575 - protein, 21 aa, Mycobacterium
GYRRYPNWTAMDMSAFTQDKT

SEQ ID NO: 767576 - protein, 21 aa, Mycobacterium
GYRYKRFHAALARHLQAVPEF

SEQ ID NO: 767577 - protein, 24 aa, Mycobacterium
GYSSDGGMSWALPRVVGKARAADI

SEQ ID NO: 767578 - protein, 19 aa, Mycobacterium
GYTRLSWAVLNWNADAITL

SEQ ID NO: 767579 - protein, 19 aa, Mycobacterium
GYWEPRKAIILNERILHRN

SEQ ID NO: 767580 - protein, 19 aa, Mycobacterium
GYWFRSIRQTVQFAEAVRA

SEQ ID NO: 767581 - protein, 18 aa, Mycobacterium
GYWKRPALTATRFVANPY

SEQ ID NO: 767582 - protein, 23 aa, Mycobacterium
GYWKRPGLTAARFVANPYAAEPG

SEQ ID NO: 767583 - protein, 23 aa, Mycobacterium
GYWPPRDTFDWMLEQKMTWHTMQ

SEQ ID NO: 767584 - protein, 23 aa, Mycobacterium
GYWRRAGLTAARFVACPFGGAGT

SEQ ID NO: 767585 - protein, 24 aa, Mycobacterium
GYWRRGALSAARFVACPFGAAGSR

SEQ ID NO: 767586 - protein, 23 aa, Mycobacterium
GYWRRGGFSAARFVACPFGAAGS

SEQ ID NO: 767587 - protein, 24 aa, Mycobacterium
GYWRRGGLSAARFVACPFGAAGSR

SEQ ID NO: 767588 - protein, 26 aa, Mycobacterium
GYWSFPHGHLCLWTWAANPQDRPLWD

SEQ ID NO: 767589 - protein, 24 aa, Mycobacterium
GYYGSRWRLAFGYPAARFDALSED

SEQ ID NO: 767590 - protein, 23 aa, Mycobacterium
GYYVPLGGALGVMFGVCANEYAA

SEQ ID NO: 767591 - protein, 19 aa, Mycobacterium
HAAARASIRRRFERIDRTF

SEQ ID NO: 767592 - protein, 19 aa, Mycobacterium
HAAAVPPMFADLVNAPARR

SEQ ID NO: 767593 - protein, 20 aa, Mycobacterium
HAAKGLEWDAVFLVGLADGT

SEQ ID NO: 767594 - protein, 18 aa, Mycobacterium
HAALTAWLHEGRPALATA

SEQ ID NO: 767595 - protein, 17 aa, Mycobacterium
HAARLALCLATRQVIAN

SEQ ID NO: 767596 - protein, 21 aa, Mycobacterium
HAATGHVIRTEPCTSVAAIAA

SEQ ID NO: 767597 - protein, 17 aa, Mycobacterium
HACLFDLDGVLTDTASV

SEQ ID NO: 767598 - protein, 23 aa, Mycobacterium
HAEFIRWRVEQLVATDALIGQQL

SEQ ID NO: 767599 - protein, 18 aa, Mycobacterium
HAEHFWTWSIDMLGHGYT

SEQ ID NO: 767600 - protein, 18 aa, Mycobacterium
HAELDWWTSPFVLTDGVP

SEQ ID NO: 767601 - protein, 18 aa, Mycobacterium
HAELTRYQLVIWTAGNVS

SEQ ID NO: 767602 - protein, 19 aa, Mycobacterium
HAERILKLFGHKELNKVVS

SEQ ID NO: 767603 - protein, 18 aa, Mycobacterium
HAFEVKWLCAVVEVARSS

SEQ ID NO: 767604 - protein, 20 aa, Mycobacterium
HAFPALALCLKFLAAGDQPT

SEQ ID NO: 767605 - protein, 21 aa, Mycobacterium
HAFPALELCRRFRAAGDAPTL

SEQ ID NO: 767606 - protein, 24 aa, Mycobacterium
HAGFSPPLVWRVMERFGVTNFTAA

SEQ ID NO: 767607 - protein, 17 aa, Mycobacterium
HAGHLIPLLTLRRFQQA

SEQ ID NO: 767608 - protein, 20 aa, Mycobacterium
HAGHYTFWFVPSLKPVNRRA

SEQ ID NO: 767609 - protein, 27 aa, Mycobacterium
HAGWLRAPLRWALRASLAVRSRLMVRS

SEQ ID NO: 767610 - protein, 23 aa, Mycobacterium
HAIRERWPRFTVDTEGLRRVTMS

SEQ ID NO: 767611 - protein, 24 aa, Mycobacterium
HALGCTIKLLSICERITDDDGQQR

SEQ ID NO: 767612 - protein, 20 aa, Mycobacterium
HALGPRWVLVKGGHLRSSDR

SEQ ID NO: 767613 - protein, 18 aa, Mycobacterium
HALLGTTFHEWVQRYFHA

SEQ ID NO: 767614 - protein, 17 aa, Mycobacterium
HALTWLFGELIAQRAED

SEQ ID NO: 767615 - protein, 22 aa, Mycobacterium
HALWEPKIPLGRMGRPEELTGL

SEQ ID NO: 767616 - protein, 20 aa, Mycobacterium
HAMAALVDRVCEVVGREPAL

SEQ ID NO: 767617 - protein, 22 aa, Mycobacterium
HAMFDPRFQKLGIHPGGGATWM

SEQ ID NO: 767618 - protein, 17 aa, Mycobacterium
HAMLGYRLWSVAQELMA

SEQ ID NO: 767619 - protein, 20 aa, Mycobacterium
HAMWRINELLNWQVAAAGED

SEQ ID NO: 767620 - protein, 17 aa, Mycobacterium
HAPLRVVTFAVRGRTML

SEQ ID NO: 767621 - protein, 19 aa, Mycobacterium
HAPRITLALLHFGEEPREL

SEQ ID NO: 767622 - protein, 22 aa, Mycobacterium
HAQRWRFDCVQTIGPDVLMSLV

SEQ ID NO: 767623 - protein, 20 aa, Mycobacterium
HARGAVLVRRGEFEAALDNL

SEQ ID NO: 767624 - protein, 22 aa, Mycobacterium
HARILCAMPFFWIGGLLAATGA

SEQ ID NO: 767625 - protein, 24 aa, Mycobacterium
HARLPGSAFTPVWKDPAAAALRNR

SEQ ID NO: 767626 - protein, 20 aa, Mycobacterium
HARRHGVALLWVMEAAPVDD

SEQ ID NO: 767627 - protein, 19 aa, Mycobacterium
HARRVWDSRGRPTIEAELL

SEQ ID NO: 767628 - protein, 18 aa, Mycobacterium
HATWCFAGGPVIKDGRPV

SEQ ID NO: 767629 - protein, 23 aa, Mycobacterium
HATWRINELLNWQVAAAGEDINV

SEQ ID NO: 767630 - protein, 22 aa, Mycobacterium
HATWRINELLNWQVAAAGENIN

SEQ ID NO: 767631 - protein, 23 aa, Mycobacterium
HAVHPTMWIRMWFSDGDKSHQRG

SEQ ID NO: 767632 - protein, 18 aa, Mycobacterium
HAWIEAWTGAWWSYDPTN

SEQ ID NO: 767633 - protein, 18 aa, Mycobacterium
HAWIQAWTGGWWHYDPTN

SEQ ID NO: 767634 - protein, 19 aa, Mycobacterium
HAWIQGWAGGWWDYDPTND

SEQ ID NO: 767635 - protein, 17 aa, Mycobacterium
HCADLHRADRDAAWPAL

SEQ ID NO: 767636 - protein, 25 aa, Mycobacterium
HCHRELWPVAGPVMGRIGWFVESWL

SEQ ID NO: 767637 - protein, 20 aa, Mycobacterium
HCKGVCLGGYLLQGGYGWNS

SEQ ID NO: 767638 - protein, 21 aa, Mycobacterium
HCKGVCLGGYLLQGGYGWNSR

SEQ ID NO: 767639 - protein, 22 aa, Mycobacterium
HCLDMPGLFVWRRYHPSRPKGK

SEQ ID NO: 767640 - protein, 20 aa, Mycobacterium
HCPFCMRGQKELGRDDFSKI

SEQ ID NO: 767641 - protein, 22 aa, Mycobacterium
HCPMCAAAHAWVGLGRIVYATS

SEQ ID NO: 767642 - protein, 23 aa, Mycobacterium
HCPMCAAAHAWVGLGRVVYAASS

SEQ ID NO: 767643 - protein, 22 aa, Mycobacterium
HCPMCSAAHAWVGLGRIVYASS

SEQ ID NO: 767644 - protein, 19 aa, Mycobacterium
HCPVCAGSLAGARLRETLL

SEQ ID NO: 767645 - protein, 23 aa, Mycobacterium
HCQRGRLSLQWGLVRLSVRDGTV

SEQ ID NO: 767646 - protein, 17 aa, Mycobacterium
HCRRIGKHYGLYDSAIF

SEQ ID NO: 767647 - protein, 19 aa, Mycobacterium
HCRSRLAGFKTPKQIFTVA

SEQ ID NO: 767648 - protein, 17 aa, Mycobacterium
HCSRGTFNFLLSAHEPA

SEQ ID NO: 767649 - protein, 17 aa, Mycobacterium
HCVAVLFAAMFEDTALR

SEQ ID NO: 767650 - protein, 22 aa, Mycobacterium
HCWTEARLGTLLDRALPRTELI

SEQ ID NO: 767651 - protein, 21 aa, Mycobacterium
HCYGVGLINWWDPRGARRTLT

SEQ ID NO: 767652 - protein, 19 aa, Mycobacterium
HCYPHFSRFLAEVVRVLRP

SEQ ID NO: 767653 - protein, 25 aa, Mycobacterium
HDADPRLAPLLAWRQQLVDSGAVAP

SEQ ID NO: 767654 - protein, 23 aa, Mycobacterium
HDDRLAAILSRYAVVEGDSARSA

SEQ ID NO: 767655 - protein, 18 aa, Mycobacterium
HDDWRWVVDIDLWGNIHA

SEQ ID NO: 767656 - protein, 23 aa, Mycobacterium
HDFRWWVCGYWRMQPCGPGNIER

SEQ ID NO: 767657 - protein, 18 aa, Mycobacterium
HDGLRRWGVDAEVRDRFL

SEQ ID NO: 767658 - protein, 24 aa, Mycobacterium
HDHQRIAPLVAEWADNLGRGIEVA

SEQ ID NO: 767659 - protein, 19 aa, Mycobacterium
HDIAWPKVHLFWGDERYVP

SEQ ID NO: 767660 - protein, 19 aa, Mycobacterium
HDIGYRIAHHADLDAPPPV

SEQ ID NO: 767661 - protein, 17 aa, Mycobacterium
HDIGYRIAHHADLNAPP

SEQ ID NO: 767662 - protein, 19 aa, Mycobacterium
HDLRPGGRVTYFMTGPDGE

SEQ ID NO: 767663 - protein, 19 aa, Mycobacterium
HDLRPGGRVTYFMTGPEGD

SEQ ID NO: 767664 - protein, 17 aa, Mycobacterium
HDLWDNRILPFAHNLSA

SEQ ID NO: 767665 - protein, 21 aa, Mycobacterium
HDPALCKAGLAFRSGPVDYDR

SEQ ID NO: 767666 - protein, 18 aa, Mycobacterium
HDPPWCRPLLGVRRGVTH

SEQ ID NO: 767667 - protein, 17 aa, Mycobacterium
HDPYCADARHGLAELLA

SEQ ID NO: 767668 - protein, 17 aa, Mycobacterium
HDQCDAWTGLAAAGDTS

SEQ ID NO: 767669 - protein, 23 aa, Mycobacterium
HDRGARVAHRWALDRPSEISALA

SEQ ID NO: 767670 - protein, 20 aa, Mycobacterium
HDRLRPGLISALIAAREAGQ

SEQ ID NO: 767671 - protein, 21 aa, Mycobacterium
HDSRLPVLLGIDGSPASEVAT

SEQ ID NO: 767672 - protein, 18 aa, Mycobacterium
HDTFCPLGPWIVTDLDPS

SEQ ID NO: 767673 - protein, 21 aa, Mycobacterium
HDTFCPVGPWIVTDIDPSDLE

SEQ ID NO: 767674 - protein, 21 aa, Mycobacterium
HDTFCPVGPWIVTDLKPLDPG

SEQ ID NO: 767675 - protein, 22 aa, Mycobacterium
HDTFCPVGPWIVTDVDPADLEL

SEQ ID NO: 767676 - protein, 21 aa, Mycobacterium
HDVKAGLFAPVELLVADEGDD

SEQ ID NO: 767677 - protein, 25 aa, Mycobacterium
HDVSRSWLYFGLIRFRVGALDEADE

SEQ ID NO: 767678 - protein, 19 aa, Mycobacterium
HDVSRSWLYFGLIRLGIGR

SEQ ID NO: 767679 - protein, 24 aa, Mycobacterium
HEAFRAEWLLSFLAADVRRDGPHD

SEQ ID NO: 767680 - protein, 23 aa, Mycobacterium
HEARWHPQRHLLTRALGIGPHIG

SEQ ID NO: 767681 - protein, 24 aa, Mycobacterium
HEGKWRVVFFWPKDFTFVCPTEIA

SEQ ID NO: 767682 - protein, 25 aa, Mycobacterium
HEGPGDAIGGIGGKGGIGYSGGGNG

SEQ ID NO: 767683 - protein, 18 aa, Mycobacterium
HEGSLRFGDKVVLGRDNV

SEQ ID NO: 767684 - protein, 23 aa, Mycobacterium
HEIIAGACFNTWLVWAQHAPTVG

SEQ ID NO: 767685 - protein, 18 aa, Mycobacterium
HELEFFFFVLAFAGSDTT

SEQ ID NO: 767686 - protein, 17 aa, Mycobacterium
HELELPAGHGLLLLTDG

SEQ ID NO: 767687 - protein, 21 aa, Mycobacterium
HELVFRLGFRRAVLSTVDTRG

SEQ ID NO: 767688 - protein, 17 aa, Mycobacterium
HEPAAWDGWLLYSHEST

SEQ ID NO: 767689 - protein, 23 aa, Mycobacterium
HEPEAWWWQKWVDPLGQHTEFSG

SEQ ID NO: 767690 - protein, 17 aa, Mycobacterium
HEPRLPYASLKAAVATF

SEQ ID NO: 767691 - protein, 22 aa, Mycobacterium
HERETYDFFGIIFDGHPSLTRI

SEQ ID NO: 767692 - protein, 17 aa, Mycobacterium
HEREWLRSDALRYGADP

SEQ ID NO: 767693 - protein, 17 aa, Mycobacterium
HERIAPLVADWADALGR

SEQ ID NO: 767694 - protein, 19 aa, Mycobacterium
HERVMLWLGYANLLGELTI

SEQ ID NO: 767695 - protein, 20 aa, Mycobacterium
HETFRAIGVDLMFTHIKESL

SEQ ID NO: 767696 - protein, 20 aa, Mycobacterium
HEYDRIPYLVAFQNNSGVRD

SEQ ID NO: 767697 - protein, 17 aa, Mycobacterium
HFDEIRDLLAFRNPASL

SEQ ID NO: 767698 - protein, 19 aa, Mycobacterium
HFELLWLLNKRDYYGHITD

SEQ ID NO: 767699 - protein, 20 aa, Mycobacterium
HFFVCSTHDWILFFTTKGRV

SEQ ID NO: 767700 - protein, 22 aa, Mycobacterium
HFGRLRYAHFFKMAYQALPADG

SEQ ID NO: 767701 - protein, 18 aa, Mycobacterium
HFLWLNWGPSPARQDMAY

SEQ ID NO: 767702 - protein, 20 aa, Mycobacterium
HFNLSVGVGDAFLRAVERGG

SEQ ID NO: 767703 - protein, 17 aa, Mycobacterium
HFPKDAWALGRFDGTAL

SEQ ID NO: 767704 - protein, 18 aa, Mycobacterium
HFRHAWRLPHADPLAYLD

SEQ ID NO: 767705 - protein, 21 aa, Mycobacterium
HFSLLPAWRGAAPVQASIAAG

SEQ ID NO: 767706 - protein, 17 aa, Mycobacterium
HFTWWRVVTWMRKRHHG

SEQ ID NO: 767707 - protein, 21 aa, Mycobacterium
HGADFTWAWAIDGTGPIRNAT

SEQ ID NO: 767708 - protein, 21 aa, Mycobacterium
HGAPLGAPCWIDLTTSDVDRA

SEQ ID NO: 767709 - protein, 19 aa, Mycobacterium
HGAPRMLGLLAEWLTGEVA

SEQ ID NO: 767710 - protein, 17 aa, Mycobacterium
HGARAGAVIALLLPRSD

SEQ ID NO: 767711 - protein, 23 aa, Mycobacterium
HGARPGECVALLLSRSAEAIVSI

SEQ ID NO: 767712 - protein, 19 aa, Mycobacterium
HGCYPCAAGSWISVAVADD

SEQ ID NO: 767713 - protein, 17 aa, Mycobacterium
HGDRFLLGIGVSHAPLI

SEQ ID NO: 767714 - protein, 18 aa, Mycobacterium
HGEHFWTWSIDMLGHGYT

SEQ ID NO: 767715 - protein, 24 aa, Mycobacterium
HGFGSFWWSWRHQLGALPGARVVA

SEQ ID NO: 767716 - protein, 21 aa, Mycobacterium
HGFGSFWWSWRHQLRGLAGAR

SEQ ID NO: 767717 - protein, 21 aa, Mycobacterium
HGFGSFWWSWRHQLRGLTSAR

SEQ ID NO: 767718 - protein, 21 aa, Mycobacterium
HGFGSFWWSWRHQLTGLRDAR

SEQ ID NO: 767719 - protein, 21 aa, Mycobacterium
HGFGSFWWSWRHQLTGLSGAR

SEQ ID NO: 767720 - protein, 19 aa, Mycobacterium
HGFPESWYSWRHQIPALAA

SEQ ID NO: 767721 - protein, 26 aa, Mycobacterium
HGGAGGAAGWFGHAGVGGDGGTGGAG

SEQ ID NO: 767722 - protein, 19 aa, Mycobacterium
HGGLDRWKKLTSISAHRSF

SEQ ID NO: 767723 - protein, 23 aa, Mycobacterium
HGGPALKFQLLWYPSTMWDATLP

SEQ ID NO: 767724 - protein, 17 aa, Mycobacterium
HGGVCALVLDHLLGEAA

SEQ ID NO: 767725 - protein, 24 aa, Mycobacterium
HGHPQWWIDIAAEWGRRDYWQQWR

SEQ ID NO: 767726 - protein, 19 aa, Mycobacterium
HGIDTVVVGWGYGGADFSG

SEQ ID NO: 767727 - protein, 20 aa, Mycobacterium
HGITCIAAIHALELMDASLS

SEQ ID NO: 767728 - protein, 25 aa, Mycobacterium
HGKTPAQVLIRWHIQLGNIVIPKSV

SEQ ID NO: 767729 - protein, 20 aa, Mycobacterium
HGLGPRWVLVKGGHLRSSTR

SEQ ID NO: 767730 - protein, 19 aa, Mycobacterium
HGLPSLGLNLCRIFTDGDQ

SEQ ID NO: 767731 - protein, 21 aa, Mycobacterium
HGLQCGFCTPGFVMSLTALLR

SEQ ID NO: 767732 - protein, 22 aa, Mycobacterium
HGLQCGFCTPGFVVSITALLRD

SEQ ID NO: 767733 - protein, 18 aa, Mycobacterium
HGLRLTGRSRPDWPSVPT

SEQ ID NO: 767734 - protein, 17 aa, Mycobacterium
HGLTWGPLIREIVSAAT

SEQ ID NO: 767735 - protein, 17 aa, Mycobacterium
HGMYWSGDLAYRDSDGW

SEQ ID NO: 767736 - protein, 24 aa, Mycobacterium
HGNPARIAQRWASAWVNPGKAGLM

SEQ ID NO: 767737 - protein, 17 aa, Mycobacterium
HGPEVLLRQTSFRALAE

SEQ ID NO: 767738 - protein, 17 aa, Mycobacterium
HGPRAEVMLSLRGPTPT

SEQ ID NO: 767739 - protein, 22 aa, Mycobacterium
HGPRFALAGSYALWAYGAPEPS

SEQ ID NO: 767740 - protein, 17 aa, Mycobacterium
HGPRTYLGLGVDGFPNL

SEQ ID NO: 767741 - protein, 22 aa, Mycobacterium
HGPVKFPGVPTWFSRTPGKVRG

SEQ ID NO: 767742 - protein, 17 aa, Mycobacterium
HGREFASRFGLGFSAED

SEQ ID NO: 767743 - protein, 23 aa, Mycobacterium
HGRGEFRPRVSFLSPGKKILHDD

SEQ ID NO: 767744 - protein, 24 aa, Mycobacterium
HGRKKHLLRFLDWILDNEDRLVGI

SEQ ID NO: 767745 - protein, 19 aa, Mycobacterium
HGRYLLPHFLIRDIADVAA

SEQ ID NO: 767746 - protein, 25 aa, Mycobacterium
HGSEASKMLVLWAVVVLRSPVGTHI

SEQ ID NO: 767747 - protein, 21 aa, Mycobacterium
HGSTLRFAPPLVITADEIDWA

SEQ ID NO: 767748 - protein, 21 aa, Mycobacterium
HGSTLRFAPPLVVTSEEIDWA

SEQ ID NO: 767749 - protein, 17 aa, Mycobacterium
HGTDWGWVCSAWELERR

SEQ ID NO: 767750 - protein, 19 aa, Mycobacterium
HGTIGFPMQSAFDAAHAAR

SEQ ID NO: 767751 - protein, 24 aa, Mycobacterium
HGTPPRVGVAFAAGPSSGALKNNP

SEQ ID NO: 767752 - protein, 18 aa, Mycobacterium
HGVARAGYLEVPRDPDLA

SEQ ID NO: 767753 - protein, 25 aa, Mycobacterium
HGVPRISIPIPNNWANVPDPNVPNA

SEQ ID NO: 767754 - protein, 21 aa, Mycobacterium
HGVWLRPFGKLIYAMPPFICT

SEQ ID NO: 767755 - protein, 22 aa, Mycobacterium
HGWQWCAGCGTDAAPYFRVFDP

SEQ ID NO: 767756 - protein, 22 aa, Mycobacterium
HGWQWCAGCGTDAAPYFRVFNP

SEQ ID NO: 767757 - protein, 23 aa, Mycobacterium
HGWQWCAGCGTDAAPYFRVFNPT

SEQ ID NO: 767758 - protein, 18 aa, Mycobacterium
HGYMACLPRGRVRAVRHD

SEQ ID NO: 767759 - protein, 19 aa, Mycobacterium
HGYMACLPRGRVRAVRHDL

SEQ ID NO: 767760 - protein, 17 aa, Mycobacterium
HGYPLTPFVRLAFAGDI

SEQ ID NO: 767761 - protein, 17 aa, Mycobacterium
HGYQDLASRACVAINHV

SEQ ID NO: 767762 - protein, 17 aa, Mycobacterium
HHGCLPTAIGVPAGDQR

SEQ ID NO: 767763 - protein, 18 aa, Mycobacterium
HHLLKTFWLGWSDRQLPD

SEQ ID NO: 767764 - protein, 17 aa, Mycobacterium
HHNAWRPAHIHFSLFGT

SEQ ID NO: 767765 - protein, 20 aa, Mycobacterium
HHPIRLAAFGPRALLPATVL

SEQ ID NO: 767766 - protein, 21 aa, Mycobacterium
HHPPTRIAFMLTDTTPIAVLT

SEQ ID NO: 767767 - protein, 17 aa, Mycobacterium
HHPSHPWGFVNSVISTE

SEQ ID NO: 767768 - protein, 24 aa, Mycobacterium
HHTPELLAELGFEYVLDWTNDDQP

SEQ ID NO: 767769 - protein, 26 aa, Mycobacterium
HHTPELLAELGFQYVLDWTNDDQPYP

SEQ ID NO: 767770 - protein, 17 aa, Mycobacterium
HHVKRSLVLDGLLGSSR

SEQ ID NO: 767771 - protein, 17 aa, Mycobacterium
HHWRFVLRRGVTFHNGE

SEQ ID NO: 767772 - protein, 23 aa, Mycobacterium
HIACPWHGWQWRGDGTNALIPYS

SEQ ID NO: 767773 - protein, 17 aa, Mycobacterium
HIARMYGQWCPRPWPDP

SEQ ID NO: 767774 - protein, 19 aa, Mycobacterium
HIASAVAIARQWLDCPDRG

SEQ ID NO: 767775 - protein, 17 aa, Mycobacterium
HIDKGLFALEWSPVTDT

SEQ ID NO: 767776 - protein, 17 aa, Mycobacterium
HIDKWKFTVPFVCGATN

SEQ ID NO: 767777 - protein, 24 aa, Mycobacterium
HIDKWKFTVPFVCGATNLGEALRR

SEQ ID NO: 767778 - protein, 19 aa, Mycobacterium
HIDRVRWDDIVSRIFGRID

SEQ ID NO: 767779 - protein, 19 aa, Mycobacterium
HIEALGFGAVWVGGSPAAE

SEQ ID NO: 767780 - protein, 24 aa, Mycobacterium
HIEKRFSMPWGRPVARMREFVQAL

SEQ ID NO: 767781 - protein, 22 aa, Mycobacterium
HIESRLAVTLSWIREFPSLGPI

SEQ ID NO: 767782 - protein, 19 aa, Mycobacterium
HIFWDELFIFPVLNLRLPA

SEQ ID NO: 767783 - protein, 19 aa, Mycobacterium
HIGGRWQLERLVGESLLAD

SEQ ID NO: 767784 - protein, 24 aa, Mycobacterium
HIIRPELRGGAGFDDPVDVPEDAG

SEQ ID NO: 767785 - protein, 20 aa, Mycobacterium
HILTCARELFALNGLDRTSV

SEQ ID NO: 767786 - protein, 22 aa, Mycobacterium
HIPDWTEFLALFDQAVQRRIKK

SEQ ID NO: 767787 - protein, 18 aa, Mycobacterium
HIPFTVAVASSFDETVRG

SEQ ID NO: 767788 - protein, 17 aa, Mycobacterium
HIRFGTEVEALWWDEER

SEQ ID NO: 767789 - protein, 17 aa, Mycobacterium
HIRRIGLVEARRHTRSQ

SEQ ID NO: 767790 - protein, 23 aa, Mycobacterium
HISSRLRPILNFRPKYDSWLTQA

SEQ ID NO: 767791 - protein, 17 aa, Mycobacterium
HITESGGRVFLELEERS

SEQ ID NO: 767792 - protein, 17 aa, Mycobacterium
HIYARIAPRWEFRQVRL

SEQ ID NO: 767793 - protein, 27 aa, Mycobacterium
HIYARIHPRWPFKQVRLAAEAVAREVE

SEQ ID NO: 767794 - protein, 19 aa, Mycobacterium
HIYRACIKLGVADRDELAR

SEQ ID NO: 767795 - protein, 21 aa, Mycobacterium
HKCADMLVDLEWARSASQAAL

SEQ ID NO: 767796 - protein, 17 aa, Mycobacterium
HKIHLYDAFGFTESRTV

SEQ ID NO: 767797 - protein, 18 aa, Mycobacterium
HKIRLNMVVPTWMYGPPI

SEQ ID NO: 767798 - protein, 17 aa, Mycobacterium
HKKGSALVPSWVAFAVI

SEQ ID NO: 767799 - protein, 22 aa, Mycobacterium
HKKIAGPGIEWYIMPGSDKPMR

SEQ ID NO: 767800 - protein, 20 aa, Mycobacterium
HKKSFVCGFHGWTYDRDGNC

SEQ ID NO: 767801 - protein, 19 aa, Mycobacterium
HKLTLGAWFKPALYALRTA

SEQ ID NO: 767802 - protein, 18 aa, Mycobacterium
HKRGPGIQQFACRVRNLE

SEQ ID NO: 767803 - protein, 17 aa, Mycobacterium
HKVPRGVGFFKRSGLVR

SEQ ID NO: 767804 - protein, 18 aa, Mycobacterium
HLAAAGWTCLGWPVEHGG

SEQ ID NO: 767805 - protein, 21 aa, Mycobacterium
HLAAELMGRFAFDRPGLAAIS

SEQ ID NO: 767806 - protein, 22 aa, Mycobacterium
HLAAELMGRFAFDRPGLAAISL

SEQ ID NO: 767807 - protein, 17 aa, Mycobacterium
HLAGRYPDLGWLIDAPT

SEQ ID NO: 767808 - protein, 18 aa, Mycobacterium
HLARASVMALSYVAQSAR

SEQ ID NO: 767809 - protein, 17 aa, Mycobacterium
HLDALGFDEVWLGEHHS

SEQ ID NO: 767810 - protein, 24 aa, Mycobacterium
HLDLDPLLPFPGWHEHAPAVEEPV

SEQ ID NO: 767811 - protein, 20 aa, Mycobacterium
HLDRGWCEHLAFLADIRESI

SEQ ID NO: 767812 - protein, 17 aa, Mycobacterium
HLDVPLYWQCWKLDSAV

SEQ ID NO: 767813 - protein, 17 aa, Mycobacterium
HLEGPWLSRARCGAHDR

SEQ ID NO: 767814 - protein, 18 aa, Mycobacterium
HLEGPWLSTLRCGAHQPV

SEQ ID NO: 767815 - protein, 25 aa, Mycobacterium
HLFRAAPRLGRWVIRKATISVLPKG

SEQ ID NO: 767816 - protein, 17 aa, Mycobacterium
HLFTVLMDREWKYGVAA

SEQ ID NO: 767817 - protein, 18 aa, Mycobacterium
HLGWVAKAGWNIRLASDG

SEQ ID NO: 767818 - protein, 22 aa, Mycobacterium
HLHLRRALVIAALFGGDGPARD

SEQ ID NO: 767819 - protein, 17 aa, Mycobacterium
HLHRILLQRSWIAIFWG

SEQ ID NO: 767820 - protein, 18 aa, Mycobacterium
HLILPMFVADGIDEPRPI

SEQ ID NO: 767821 - protein, 23 aa, Mycobacterium
HLISPWGTWEWLRPNIVGGALPA

SEQ ID NO: 767822 - protein, 20 aa, Mycobacterium
HLKALGWARREFGGDLIWGV

SEQ ID NO: 767823 - protein, 22 aa, Mycobacterium
HLKTYRPGTTFAVLEGRESIGG

SEQ ID NO: 767824 - protein, 18 aa, Mycobacterium
HLLGHDWGAIQGWTAVTD

SEQ ID NO: 767825 - protein, 19 aa, Mycobacterium
HLLLWRADAPWERLNVADT

SEQ ID NO: 767826 - protein, 23 aa, Mycobacterium
HLLPRTEWDRVIGINLTATFLVA

SEQ ID NO: 767827 - protein, 18 aa, Mycobacterium
HLMLTVFFDLGWPCRPID

SEQ ID NO: 767828 - protein, 23 aa, Mycobacterium
HLMPVKLKWGISLGALIMHLRES

SEQ ID NO: 767829 - protein, 18 aa, Mycobacterium
HLPADAWPPTSWYADWVS

SEQ ID NO: 767830 - protein, 23 aa, Mycobacterium
HLPEGGWPPTGWFEGWANGLDVF

SEQ ID NO: 767831 - protein, 19 aa, Mycobacterium
HLPEGLGVIGLLIDEPKPL

SEQ ID NO: 767832 - protein, 18 aa, Mycobacterium
HLRHCVRDAAAAGGPAAD

SEQ ID NO: 767833 - protein, 17 aa, Mycobacterium
HLRRAVVTTALFGGDAP

SEQ ID NO: 767834 - protein, 18 aa, Mycobacterium
HLRRHKWTRLGAYAQSKL

SEQ ID NO: 767835 - protein, 19 aa, Mycobacterium
HLRRNRWTPLGAYGRAKLA

SEQ ID NO: 767836 - protein, 19 aa, Mycobacterium
HLRSQLALRQEWEAQHVTV

SEQ ID NO: 767837 - protein, 19 aa, Mycobacterium
HLTALCWDGGAALPFNADD

SEQ ID NO: 767838 - protein, 17 aa, Mycobacterium
HLTEGRVAWNIVTSYLD

SEQ ID NO: 767839 - protein, 17 aa, Mycobacterium
HLVARGGGSLVNISSSA

SEQ ID NO: 767840 - protein, 25 aa, Mycobacterium
HLVSWLKAVIFGAAERWTDVIDEVK

SEQ ID NO: 767841 - protein, 20 aa, Mycobacterium
HLVTRWLATFAFFRAAMAAA

SEQ ID NO: 767842 - protein, 19 aa, Mycobacterium
HLYGRGVVVLGLPRGGVPV

SEQ ID NO: 767843 - protein, 17 aa, Mycobacterium
HMLADSGAQAWLGPVPA

SEQ ID NO: 767844 - protein, 22 aa, Mycobacterium
HMLKFLSSPLWRAYISTYVEGY

SEQ ID NO: 767845 - protein, 17 aa, Mycobacterium
HMLPGAFATVIAARVDL

SEQ ID NO: 767846 - protein, 24 aa, Mycobacterium
HMTFATGIANIWARPAVTAHGGAA

SEQ ID NO: 767847 - protein, 18 aa, Mycobacterium
HMWFGDLVTMQWWDDLWL

SEQ ID NO: 767848 - protein, 17 aa, Mycobacterium
HMWRFWYQVPMSLPVIG

SEQ ID NO: 767849 - protein, 20 aa, Mycobacterium
HNERLFCVPATIDLAGAEIE

SEQ ID NO: 767850 - protein, 22 aa, Mycobacterium
HNGCPLGNLIPEWNDLVRQGRW

SEQ ID NO: 767851 - protein, 23 aa, Mycobacterium
HNGCPLGNLIPEWNDLVRRDQWQ

SEQ ID NO: 767852 - protein, 22 aa, Mycobacterium
HNGCPLGNLIPEWNDLVRTGRW

SEQ ID NO: 767853 - protein, 21 aa, Mycobacterium
HNGGAGGLLWGNGGDGGAGAA

SEQ ID NO: 767854 - protein, 17 aa, Mycobacterium
HNGGVFLPPWGKVEQWL

SEQ ID NO: 767855 - protein, 17 aa, Mycobacterium
HNIPAQFAAPIASPFSP

SEQ ID NO: 767856 - protein, 25 aa, Mycobacterium
HNLARLAELLLLWRHGAPDHREVVY

SEQ ID NO: 767857 - protein, 17 aa, Mycobacterium
HNRPEWIAVAGLAREYE

SEQ ID NO: 767858 - protein, 17 aa, Mycobacterium
HPACLEVLFAAASIGAV

SEQ ID NO: 767859 - protein, 20 aa, Mycobacterium
HPADVLPLWVAEMDVNLAPT

SEQ ID NO: 767860 - protein, 23 aa, Mycobacterium
HPAIRPGYCAAFTLEVDGEERLG

SEQ ID NO: 767861 - protein, 17 aa, Mycobacterium
HPARLTAPVTMRLAHAL

SEQ ID NO: 767862 - protein, 17 aa, Mycobacterium
HPAVCAAVSRLSYDNRL

SEQ ID NO: 767863 - protein, 22 aa, Mycobacterium
HPAWDAVCYRLGLLTTPEAQAI

SEQ ID NO: 767864 - protein, 23 aa, Mycobacterium
HPDGVLWGHGWDESGWPDQTPPD

SEQ ID NO: 767865 - protein, 24 aa, Mycobacterium
HPEHLRLATWAQLERPAAGPAETS

SEQ ID NO: 767866 - protein, 20 aa, Mycobacterium
HPEIFRLASPIAQVHADAPP

SEQ ID NO: 767867 - protein, 24 aa, Mycobacterium
HPELRIAPPFTEWEFSGDMIRMPE

SEQ ID NO: 767868 - protein, 20 aa, Mycobacterium
HPEVRLPADYALQVPADYID

SEQ ID NO: 767869 - protein, 20 aa, Mycobacterium
HPFGGWAEAYGRELDLIGPR

SEQ ID NO: 767870 - protein, 19 aa, Mycobacterium
HPGAPAFWYQPSRNGAPPV

SEQ ID NO: 767871 - protein, 24 aa, Mycobacterium
HPGKWRVVFFWPKDFTFVCPTEIA

SEQ ID NO: 767872 - protein, 21 aa, Mycobacterium
HPGLPRLINMYGITETTVHAS

SEQ ID NO: 767873 - protein, 21 aa, Mycobacterium
HPGRFLLGIGVGHPEAHQQYR

SEQ ID NO: 767874 - protein, 20 aa, Mycobacterium
HPHARIAFMLTDTTPAAVLT

SEQ ID NO: 767875 - protein, 18 aa, Mycobacterium
HPHCAWTVIIDESYPEAQ

SEQ ID NO: 767876 - protein, 19 aa, Mycobacterium
HPHCCSVGYLLRDDGGRWR

SEQ ID NO: 767877 - protein, 18 aa, Mycobacterium
HPMTLWKWMRQADIDEGA

SEQ ID NO: 767878 - protein, 18 aa, Mycobacterium
HPPGFDFGPALLADVQIA

SEQ ID NO: 767879 - protein, 19 aa, Mycobacterium
HPRPDFKNRILAAFNDGMK

SEQ ID NO: 767880 - protein, 22 aa, Mycobacterium
HPRSARGGKVFGVEGDYSPEWA

SEQ ID NO: 767881 - protein, 22 aa, Mycobacterium
HPSLCLLASWVPPASPAGERLR

SEQ ID NO: 767882 - protein, 22 aa, Mycobacterium
HPSLKIGWFEGGIAWVPTALQD

SEQ ID NO: 767883 - protein, 25 aa, Mycobacterium
HPSVSLSIIKFLGFEQMFKNALTGL

SEQ ID NO: 767884 - protein, 17 aa, Mycobacterium
HPVPGRWLPNGCMATSG

SEQ ID NO: 767885 - protein, 20 aa, Mycobacterium
HPWLPGFEPPYVIAVVALDE

SEQ ID NO: 767886 - protein, 17 aa, Mycobacterium
HPWRLKQNYAYDIGMMR

SEQ ID NO: 767887 - protein, 23 aa, Mycobacterium
HPYASALVFWFGWPASEVPGMYL

SEQ ID NO: 767888 - protein, 22 aa, Mycobacterium
HQALCYFGYLAGYRLVHDAASD

SEQ ID NO: 767889 - protein, 17 aa, Mycobacterium
HQARINMMPGFTGTGFY

SEQ ID NO: 767890 - protein, 23 aa, Mycobacterium
HQCAPFCAVQAWPALSRQRLSLA

SEQ ID NO: 767891 - protein, 21 aa, Mycobacterium
HQDCLPAPLVDQARAADDDGE

SEQ ID NO: 767892 - protein, 18 aa, Mycobacterium
HQGLCYFGYLAGYRLVHE

SEQ ID NO: 767893 - protein, 21 aa, Mycobacterium
HQGLCYFGYLAGYRLVHEAAQ

SEQ ID NO: 767894 - protein, 26 aa, Mycobacterium
HQGPAYLDHISWKFIEDGSVRAAAVQ

SEQ ID NO: 767895 - protein, 25 aa, Mycobacterium
HQIPRAGNMFSVFFGGDPVTDFASA

SEQ ID NO: 767896 - protein, 24 aa, Mycobacterium
HQIPRAGNMLSVFFSDTPITDFGS

SEQ ID NO: 767897 - protein, 24 aa, Mycobacterium
HQIPRAGNMLSVFFSETPVTDFAA

SEQ ID NO: 767898 - protein, 24 aa, Mycobacterium
HQIPRAGNMLSVFFTDGPVTDFAS

SEQ ID NO: 767899 - protein, 17 aa, Mycobacterium
HQIVLWCMGEAHAAVVL

SEQ ID NO: 767900 - protein, 23 aa, Mycobacterium
HQIWQCPVVLLADVRSVGVQGDG

SEQ ID NO: 767901 - protein, 23 aa, Mycobacterium
HQLRACLAPRCVLYFVKEHPRRE

SEQ ID NO: 767902 - protein, 18 aa, Mycobacterium
HQLRCGVVVLGPPGSVSK

SEQ ID NO: 767903 - protein, 24 aa, Mycobacterium
HQLSRAGNMLSVFFSDPPVTDFAS

SEQ ID NO: 767904 - protein, 18 aa, Mycobacterium
HQRWLGTRLPFYANWIRL

SEQ ID NO: 767905 - protein, 24 aa, Mycobacterium
HQVQRAGNMLSVFFTDAPVHDFAA

SEQ ID NO: 767906 - protein, 18 aa, Mycobacterium
HRALAEFRVRGVSTNIPF

SEQ ID NO: 767907 - protein, 18 aa, Mycobacterium
HRALRPGGVFLMVDIKAS

SEQ ID NO: 767908 - protein, 20 aa, Mycobacterium
HRAPRWSASVSSAWKPLPAP

SEQ ID NO: 767909 - protein, 17 aa, Mycobacterium
HRCYGLWSGDGMVPPAH

SEQ ID NO: 767910 - protein, 18 aa, Mycobacterium
HRDLLAADVIVIADSDNW

SEQ ID NO: 767911 - protein, 21 aa, Mycobacterium
HREGFGLAALRDWLRTQRSER

SEQ ID NO: 767912 - protein, 17 aa, Mycobacterium
HRFPGSMAKRVQALAQA

SEQ ID NO: 767913 - protein, 17 aa, Mycobacterium
HRGLKLLLMAWARYEDE

SEQ ID NO: 767914 - protein, 22 aa, Mycobacterium
HRGQDFVYHWALGDRLPADAGL

SEQ ID NO: 767915 - protein, 17 aa, Mycobacterium
HRGRLGVQLDRQAPGAG

SEQ ID NO: 767916 - protein, 18 aa, Mycobacterium
HRIKLAWFLLNAARYMPA

SEQ ID NO: 767917 - protein, 20 aa, Mycobacterium
HRILRHRLILGFEAVAENVT

SEQ ID NO: 767918 - protein, 24 aa, Mycobacterium
HRLARSLFLYALCNGFIGENTTIV

SEQ ID NO: 767919 - protein, 24 aa, Mycobacterium
HRLARSLFLYALCNGWIDEGTTVI

SEQ ID NO: 767920 - protein, 24 aa, Mycobacterium
HRLARSLFLYALCNGWIDEGTTVV

SEQ ID NO: 767921 - protein, 24 aa, Mycobacterium
HRLARSLFLYALCNGWIGEGTTVV

SEQ ID NO: 767922 - protein, 24 aa, Mycobacterium
HRLARSLFLYALCNGWIGENTTVV

SEQ ID NO: 767923 - protein, 24 aa, Mycobacterium
HRLARSLFLYALCNGWINEGTTVV

SEQ ID NO: 767924 - protein, 24 aa, Mycobacterium
HRLARSLFLYGLCNGWICEGTTII

SEQ ID NO: 767925 - protein, 18 aa, Mycobacterium
HRLASVIFSLEMSKSEIV

SEQ ID NO: 767926 - protein, 18 aa, Mycobacterium
HRLDCAQLPAGMVDGLAD

SEQ ID NO: 767927 - protein, 18 aa, Mycobacterium
HRLGEVGRAFIVARPGFN

SEQ ID NO: 767928 - protein, 25 aa, Mycobacterium
HRLLRLSRHVPWDLWELDLLVRTTH

SEQ ID NO: 767929 - protein, 18 aa, Mycobacterium
HRLVRAGVPAVVLNAKND

SEQ ID NO: 767930 - protein, 20 aa, Mycobacterium
HRLWEPKIPLGRLGRPDELT

SEQ ID NO: 767931 - protein, 18 aa, Mycobacterium
HRPDCVLLDLNLPDAAGI

SEQ ID NO: 767932 - protein, 18 aa, Mycobacterium
HRPDLAILDVRMPPTFTD

SEQ ID NO: 767933 - protein, 19 aa, Mycobacterium
HRPHLAASVVERGHEVAHH

SEQ ID NO: 767934 - protein, 17 aa, Mycobacterium
HRPPPLFALVNFFDAQA

SEQ ID NO: 767935 - protein, 19 aa, Mycobacterium
HRQAIRWARSQFGVELVWA

SEQ ID NO: 767936 - protein, 20 aa, Mycobacterium
HRQLADFGFRVVEDLSGNEL

SEQ ID NO: 767937 - protein, 17 aa, Mycobacterium
HRRADILAVQWHPEDRH

SEQ ID NO: 767938 - protein, 21 aa, Mycobacterium
HRRARVGGGRWGHDERRRLVV

SEQ ID NO: 767939 - protein, 22 aa, Mycobacterium
HRRGEFRPRPSFLSPGKKILHD

SEQ ID NO: 767940 - protein, 18 aa, Mycobacterium
HRRGKPLILDEAWGAHLP

SEQ ID NO: 767941 - protein, 17 aa, Mycobacterium
HRRLKRIITQGILGCLE

SEQ ID NO: 767942 - protein, 24 aa, Mycobacterium
HRRRVGQLWARFNAVAVANPYAWI

SEQ ID NO: 767943 - protein, 20 aa, Mycobacterium
HRRVWFCVDGVYSMYGDLAP

SEQ ID NO: 767944 - protein, 20 aa, Mycobacterium
HRSIDLTLRWHRVGHDVLLV

SEQ ID NO: 767945 - protein, 20 aa, Mycobacterium
HRSRVGRLWAGFNAVAVDNP

SEQ ID NO: 767946 - protein, 17 aa, Mycobacterium
HRVELRNGVLVHYDLPE

SEQ ID NO: 767947 - protein, 23 aa, Mycobacterium
HRVRRRGGLVLSFRPMPGTYAEQ

SEQ ID NO: 767948 - protein, 20 aa, Mycobacterium
HRWAEILSIAGLVETPNMQT

SEQ ID NO: 767949 - protein, 20 aa, Mycobacterium
HRWLTKRAGAVVRINGADTD

SEQ ID NO: 767950 - protein, 21 aa, Mycobacterium
HRWTWELFDAHWWDGITNGHD

SEQ ID NO: 767951 - protein, 21 aa, Mycobacterium
HSALLGRWVALRAAAERVGDD

SEQ ID NO: 767952 - protein, 20 aa, Mycobacterium
HSALLVRFGEIFGHGLTTWL

SEQ ID NO: 767953 - protein, 17 aa, Mycobacterium
HSARPWLGDNAIHKLGA

SEQ ID NO: 767954 - protein, 20 aa, Mycobacterium
HSCFGPRFVLGLGRGDAGAF

SEQ ID NO: 767955 - protein, 20 aa, Mycobacterium
HSCVKGRFAFGYATHPDRVL

SEQ ID NO: 767956 - protein, 17 aa, Mycobacterium
HSELFWWTADFVATEGI

SEQ ID NO: 767957 - protein, 22 aa, Mycobacterium
HSGSWWIFWPTLLLTLVSDFNA

SEQ ID NO: 767958 - protein, 22 aa, Mycobacterium
HSIALFLRWCARSGRSWQAGVE

SEQ ID NO: 767959 - protein, 20 aa, Mycobacterium
HSIWLPDHMVSFWPDSIWTP

SEQ ID NO: 767960 - protein, 21 aa, Mycobacterium
HSIWLPDHMVSFWPDSIWTPE

SEQ ID NO: 767961 - protein, 23 aa, Mycobacterium
HSIWLPDHMVSFWPDSIWTPEFT

SEQ ID NO: 767962 - protein, 19 aa, Mycobacterium
HSLARLAIRDDIYSSLRAL

SEQ ID NO: 767963 - protein, 20 aa, Mycobacterium
HSLGAMVSFEFARLAEAQGI

SEQ ID NO: 767964 - protein, 21 aa, Mycobacterium
HSLTLPRTWLEAMVKAYIGDS

SEQ ID NO: 767965 - protein, 21 aa, Mycobacterium
HSMGAVVAFEFARIAESHDVA

SEQ ID NO: 767966 - protein, 21 aa, Mycobacterium
HSMGAVVSFEFARLAEAAGLD

SEQ ID NO: 767967 - protein, 18 aa, Mycobacterium
HSPARLRSELTWIEQQTG

SEQ ID NO: 767968 - protein, 18 aa, Mycobacterium
HSPKRLDSELTWIEEQTG

SEQ ID NO: 767969 - protein, 18 aa, Mycobacterium
HSPKRLESELTWIEEQTR

SEQ ID NO: 767970 - protein, 19 aa, Mycobacterium
HSQQWAQKGFVRMARDYGL

SEQ ID NO: 767971 - protein, 22 aa, Mycobacterium
HSSCFAMALALKLGENHTPPQR

SEQ ID NO: 767972 - protein, 23 aa, Mycobacterium
HSTLSRFRGIGVSTVFSHGATLR

SEQ ID NO: 767973 - protein, 21 aa, Mycobacterium
HSVCPFCAVGCAQKVYVKDEK

SEQ ID NO: 767974 - protein, 21 aa, Mycobacterium
HSVCPFCAVGCAQKVYVKDGK

SEQ ID NO: 767975 - protein, 22 aa, Mycobacterium
HSVCPFCAVGCAQKVYVKDGKV

SEQ ID NO: 767976 - protein, 19 aa, Mycobacterium
HSVKKAWPFEVLPRTAWAR

SEQ ID NO: 767977 - protein, 20 aa, Mycobacterium
HSVKVIPGRGAWLEFDVDKR

SEQ ID NO: 767978 - protein, 21 aa, Mycobacterium
HSVKVIPGRGAWLEFDVDKRD

SEQ ID NO: 767979 - protein, 17 aa, Mycobacterium
HSVLSWLGGAGAYGASK

SEQ ID NO: 767980 - protein, 22 aa, Mycobacterium
HSWAARDWWAMDWVWSAFHLED

SEQ ID NO: 767981 - protein, 24 aa, Mycobacterium
HSYPHCWRCRNPLIYRAVSSWFIK

SEQ ID NO: 767982 - protein, 24 aa, Mycobacterium
HSYPHCWRCRNPLIYRAVSSWFVK

SEQ ID NO: 767983 - protein, 24 aa, Mycobacterium
HSYPHCWRCRNPLIYRAVSSWFVR

SEQ ID NO: 767984 - protein, 19 aa, Mycobacterium
HTAAACYRSVIAGLTTGRW

SEQ ID NO: 767985 - protein, 18 aa, Mycobacterium
HTARLFRRSPWVGWSELF

SEQ ID NO: 767986 - protein, 19 aa, Mycobacterium
HTEFPYVFCDATFCKARIG

SEQ ID NO: 767987 - protein, 22 aa, Mycobacterium
HTEIARLIPFIEWLREAYPDQL

SEQ ID NO: 767988 - protein, 18 aa, Mycobacterium
HTEIPLGLYCRASLAKYM

SEQ ID NO: 767989 - protein, 22 aa, Mycobacterium
HTEPRWWLGKGFVGEYAGAVQK

SEQ ID NO: 767990 - protein, 26 aa, Mycobacterium
HTGEIRVPRMLGVFSIGRAINPRTLR

SEQ ID NO: 767991 - protein, 22 aa, Mycobacterium
HTGPALSPFNAWTLLKGLETMA

SEQ ID NO: 767992 - protein, 23 aa, Mycobacterium
HTGPALSPFNAWTLVKGLETLDL

SEQ ID NO: 767993 - protein, 17 aa, Mycobacterium
HTGWLFDHFYPIASPSQ

SEQ ID NO: 767994 - protein, 21 aa, Mycobacterium
HTGWLGFRLHHHRRYFPVRQG

SEQ ID NO: 767995 - protein, 17 aa, Mycobacterium
HTIEWYPAGHGFAVPDN

SEQ ID NO: 767996 - protein, 20 aa, Mycobacterium
HTIRATILIAEFPPRNADPD

SEQ ID NO: 767997 - protein, 22 aa, Mycobacterium
HTLRRAGERFGFAVEAMSLVSE

SEQ ID NO: 767998 - protein, 17 aa, Mycobacterium
HTMLRLPTGIFYAQGVK

SEQ ID NO: 767999 - protein, 20 aa, Mycobacterium
HTPLKMCWVPGYSDYYPEAP

SEQ ID NO: 768000 - protein, 18 aa, Mycobacterium
HTPLPLLAFTAWPEVRSQ

SEQ ID NO: 768001 - protein, 19 aa, Mycobacterium
HTRRVPGYHILKAHMSSSI

SEQ ID NO: 768002 - protein, 20 aa, Mycobacterium
HTYPMPCPRCGARVGRDDGQ

SEQ ID NO: 768003 - protein, 20 aa, Mycobacterium
HVADALPVLFGHIGEGNLHL

SEQ ID NO: 768004 - protein, 21 aa, Mycobacterium
HVAELFKFFTKCPDWVTYAEQ

SEQ ID NO: 768005 - protein, 24 aa, Mycobacterium
HVDEWRATFAVNVFGPVELTLALL

SEQ ID NO: 768006 - protein, 19 aa, Mycobacterium
HVDYRRIALIGAQLQVEAA

SEQ ID NO: 768007 - protein, 17 aa, Mycobacterium
HVFIPSFEPVTVMQAIA

SEQ ID NO: 768008 - protein, 22 aa, Mycobacterium
HVGLPMRCVFALTAMGFLPQSP

SEQ ID NO: 768009 - protein, 19 aa, Mycobacterium
HVGMGMGMYGVRPLRLAWR

SEQ ID NO: 768010 - protein, 17 aa, Mycobacterium
HVIALPASLSWIDAAAL

SEQ ID NO: 768011 - protein, 22 aa, Mycobacterium
HVIPELQRRGAYKTEYTEGTLR

SEQ ID NO: 768012 - protein, 17 aa, Mycobacterium
HVLFAWHLPELWRRFTI

SEQ ID NO: 768013 - protein, 19 aa, Mycobacterium
HVLPFISIRVWQPISENET

SEQ ID NO: 768014 - protein, 17 aa, Mycobacterium
HVLPGAPVMPVPDKIVE

SEQ ID NO: 768015 - protein, 22 aa, Mycobacterium
HVLREWFGQLVMHSMALTLSGN

SEQ ID NO: 768016 - protein, 17 aa, Mycobacterium
HVLWWQVYPLGFVGVHP

SEQ ID NO: 768017 - protein, 22 aa, Mycobacterium
HVPEAIPLLFGHIGEGNLHLNV

SEQ ID NO: 768018 - protein, 18 aa, Mycobacterium
HVPGLAAFIRKHAGGSWA

SEQ ID NO: 768019 - protein, 18 aa, Mycobacterium
HVPLRAGSDIAFLGGVIN

SEQ ID NO: 768020 - protein, 17 aa, Mycobacterium
HVPMMFSDYEAVTPEEN

SEQ ID NO: 768021 - protein, 20 aa, Mycobacterium
HVPRHMFIPFGMGKHKCIGD

SEQ ID NO: 768022 - protein, 17 aa, Mycobacterium
HVRAGSVSKVFVAAMIL

SEQ ID NO: 768023 - protein, 19 aa, Mycobacterium
HVRARGGGSLIAITTTGVD

SEQ ID NO: 768024 - protein, 25 aa, Mycobacterium
HVRIASPPVRWPCFYGIDFATPAEL

SEQ ID NO: 768025 - protein, 18 aa, Mycobacterium
HVRLPRRAAVFSMLAEAP

SEQ ID NO: 768026 - protein, 21 aa, Mycobacterium
HVRSGVAFDVLRRWLSARAYD

SEQ ID NO: 768027 - protein, 20 aa, Mycobacterium
HVRSGVAFDVLRRWLTAKGF

SEQ ID NO: 768028 - protein, 20 aa, Mycobacterium
HVRSGVAFDVLRRWLTANGY

SEQ ID NO: 768029 - protein, 22 aa, Mycobacterium
HVRSRIVPWFGPGAVITTPRHH

SEQ ID NO: 768030 - protein, 22 aa, Mycobacterium
HVSRRAGAFLGYMVDAEQQVVT

SEQ ID NO: 768031 - protein, 22 aa, Mycobacterium
HVTRLRADLCPDWPQPAQPGGS

SEQ ID NO: 768032 - protein, 25 aa, Mycobacterium
HVVALPITVPVQFFLGSAEGVPTVI

SEQ ID NO: 768033 - protein, 17 aa, Mycobacterium
HVVPRWGGDANFITVIG

SEQ ID NO: 768034 - protein, 18 aa, Mycobacterium
HVVYRWLGRRMHPAPPAA

SEQ ID NO: 768035 - protein, 17 aa, Mycobacterium
HVWALGDVAAWAGADGR

SEQ ID NO: 768036 - protein, 18 aa, Mycobacterium
HVYRACMKFGVPDRAALA

SEQ ID NO: 768037 - protein, 20 aa, Mycobacterium
HWAGRRWKYRRSLFDSYETL

SEQ ID NO: 768038 - protein, 19 aa, Mycobacterium
HWCGWLENPHRGFGLKDPW

SEQ ID NO: 768039 - protein, 22 aa, Mycobacterium
HWGIRPDFVLGHSVGELSAAHV

SEQ ID NO: 768040 - protein, 22 aa, Mycobacterium
HWIHRVFEGMGWRTAELLEAMW

SEQ ID NO: 768041 - protein, 18 aa, Mycobacterium
HWPWAQQWLTLWRNTIGY

SEQ ID NO: 768042 - protein, 17 aa, Mycobacterium
HWPWATHWLRLWRNTIG

SEQ ID NO: 768043 - protein, 19 aa, Mycobacterium
HWVAPAEAVWACRNLAATH

SEQ ID NO: 768044 - protein, 18 aa, Mycobacterium
HWVAPAEAVWACRSMAAT

SEQ ID NO: 768045 - protein, 21 aa, Mycobacterium
HWWQAPLRWSIRGALAARSAI

SEQ ID NO: 768046 - protein, 20 aa, Mycobacterium
HYGLPIARFDYHLSDNDKAN

SEQ ID NO: 768047 - protein, 18 aa, Mycobacterium
HYGVSVAVCPARRGNRKG

SEQ ID NO: 768048 - protein, 20 aa, Mycobacterium
HYHKIHLYDAFGFAESRTVA

SEQ ID NO: 768049 - protein, 17 aa, Mycobacterium
HYKGGAMSLLLDQVREL

SEQ ID NO: 768050 - protein, 17 aa, Mycobacterium
HYLAVAIDYLYTHRPDW

SEQ ID NO: 768051 - protein, 17 aa, Mycobacterium
HYLAVAIDYLYTHRPSW

SEQ ID NO: 768052 - protein, 24 aa, Mycobacterium
HYRLKDFRKGIAFGNPYRLINQCA

SEQ ID NO: 768053 - protein, 21 aa, Mycobacterium
IAAAEKFFFGYVVPTQAFTDL

SEQ ID NO: 768054 - protein, 23 aa, Mycobacterium
IAAARPCFRIAFGVNDYTLDIGV

SEQ ID NO: 768055 - protein, 26 aa, Mycobacterium
IAACAKRFPGGWMVFDTIPWLMSVYS

SEQ ID NO: 768056 - protein, 17 aa, Mycobacterium
IAACRLRRALAEAKEAF

SEQ ID NO: 768057 - protein, 20 aa, Mycobacterium
IAADGSFEWRVRPTSPGQLV

SEQ ID NO: 768058 - protein, 18 aa, Mycobacterium
IAAEIGYPVLVRPSYVLG

SEQ ID NO: 768059 - protein, 18 aa, Mycobacterium
IAAGKLHFSIGYSEPGAG

SEQ ID NO: 768060 - protein, 17 aa, Mycobacterium
IAALAARHDFHIIEDAT

SEQ ID NO: 768061 - protein, 22 aa, Mycobacterium
IAALRLPLIIGESGDLTTLVPA

SEQ ID NO: 768062 - protein, 17 aa, Mycobacterium
IAARGHQAGNLGIVSTA

SEQ ID NO: 768063 - protein, 19 aa, Mycobacterium
IAAVHGWCIGGGVDLISAV

SEQ ID NO: 768064 - protein, 17 aa, Mycobacterium
IACGAIRTPGLEADAAR

SEQ ID NO: 768065 - protein, 17 aa, Mycobacterium
IACLRANGLAACYVSGY

SEQ ID NO: 768066 - protein, 19 aa, Mycobacterium
IACPILFCVCEADSVAPAA

SEQ ID NO: 768067 - protein, 21 aa, Mycobacterium
IACTAEILANVALREGRDADI

SEQ ID NO: 768068 - protein, 18 aa, Mycobacterium
IADARWGRRVHAVVQVAA

SEQ ID NO: 768069 - protein, 21 aa, Mycobacterium
IADEGLRRWGVDAEVRDRFLG

SEQ ID NO: 768070 - protein, 17 aa, Mycobacterium
IADEIRAAIAVRHGVTI

SEQ ID NO: 768071 - protein, 17 aa, Mycobacterium
IADGCDRVLNLAAGLDT

SEQ ID NO: 768072 - protein, 22 aa, Mycobacterium
IADLERWGMAFARERDGRISQR

SEQ ID NO: 768073 - protein, 18 aa, Mycobacterium
IADLGGWSAADPQLFDKS

SEQ ID NO: 768074 - protein, 27 aa, Mycobacterium
IADLRAIPWVLAWSQSRVMLPGWYGTG

SEQ ID NO: 768075 - protein, 18 aa, Mycobacterium
IADPPAWFGVIRPAQLLA

SEQ ID NO: 768076 - protein, 25 aa, Mycobacterium
IADSGWLKLCFRYYSDWDLQTTSPD

SEQ ID NO: 768077 - protein, 18 aa, Mycobacterium
IADVLPLTPLQQGLLFHS

SEQ ID NO: 768078 - protein, 19 aa, Mycobacterium
IAEAAAWLLSDRASYVTGV

SEQ ID NO: 768079 - protein, 17 aa, Mycobacterium
IAEACTRGGSSMFGSGI

SEQ ID NO: 768080 - protein, 22 aa, Mycobacterium
IAEAGDWISCWTMGLNQSTHGT

SEQ ID NO: 768081 - protein, 25 aa, Mycobacterium
IAEARNALKLSWRYIEAFEAEAAAL

SEQ ID NO: 768082 - protein, 20 aa, Mycobacterium
IAEGCVRAGCALLGGETAEH

SEQ ID NO: 768083 - protein, 22 aa, Mycobacterium
IAEGLAAFGARVAIWERDPETC

SEQ ID NO: 768084 - protein, 18 aa, Mycobacterium
IAEGWQPIFFLPEKANDV

SEQ ID NO: 768085 - protein, 18 aa, Mycobacterium
IAEGWQPVFFYPAKAHGV

SEQ ID NO: 768086 - protein, 18 aa, Mycobacterium
IAEGWQPVFFYPEKADEV

SEQ ID NO: 768087 - protein, 18 aa, Mycobacterium
IAEIILLTGHYVMTALFL

SEQ ID NO: 768088 - protein, 18 aa, Mycobacterium
IAELRQAIAAQRRRLFGI

SEQ ID NO: 768089 - protein, 22 aa, Mycobacterium
IAERGWPVFLVSSVARVGLQPL

SEQ ID NO: 768090 - protein, 21 aa, Mycobacterium
IAERGWPVFLVSTVAREGLQP

SEQ ID NO: 768091 - protein, 22 aa, Mycobacterium
IAERVPQEWLLPYVHQRYDDPV

SEQ ID NO: 768092 - protein, 21 aa, Mycobacterium
IAETFARAGINVVITARTQDD

SEQ ID NO: 768093 - protein, 19 aa, Mycobacterium
IAETIDWGRTVLALGLDTI

SEQ ID NO: 768094 - protein, 20 aa, Mycobacterium
IAEVLRYCAHRSIAVVPFGG

SEQ ID NO: 768095 - protein, 17 aa, Mycobacterium
IAFDASKAGKSLMSTAT

SEQ ID NO: 768096 - protein, 20 aa, Mycobacterium
IAFMDCFRVTALRTAANTAL

SEQ ID NO: 768097 - protein, 18 aa, Mycobacterium
IAGALAIVAVDPVKFKRE

SEQ ID NO: 768098 - protein, 17 aa, Mycobacterium
IAGALAIVAVDPVNFKR

SEQ ID NO: 768099 - protein, 20 aa, Mycobacterium
IAGDQCDAWTGLAAAGDQSI

SEQ ID NO: 768100 - protein, 18 aa, Mycobacterium
IAGRLGLRDDVRRVPLFG

SEQ ID NO: 768101 - protein, 18 aa, Mycobacterium
IAGSPDWAANLPEALRSA

SEQ ID NO: 768102 - protein, 19 aa, Mycobacterium
IAGVPYLLGIQSYLLPQNV

SEQ ID NO: 768103 - protein, 18 aa, Mycobacterium
IAHNPGWRIDADGSVQLG

SEQ ID NO: 768104 - protein, 19 aa, Mycobacterium
IAHRLGMRPSWVLDLHNGG

SEQ ID NO: 768105 - protein, 17 aa, Mycobacterium
IAIGVAHVVVWPAEGNP

SEQ ID NO: 768106 - protein, 26 aa, Mycobacterium
IAIPAWKIAPALAYGNAVVWKPASTV

SEQ ID NO: 768107 - protein, 19 aa, Mycobacterium
IAIVVDYELTVSMPARLTA

SEQ ID NO: 768108 - protein, 17 aa, Mycobacterium
IAKATGKLGTWMPRAVA

SEQ ID NO: 768109 - protein, 17 aa, Mycobacterium
IAKELPMEYALELNRLI

SEQ ID NO: 768110 - protein, 22 aa, Mycobacterium
IAKGAAFKRLRMTINESDRVMT

SEQ ID NO: 768111 - protein, 19 aa, Mycobacterium
IAKHAWQPTWLKWSVSIIG

SEQ ID NO: 768112 - protein, 17 aa, Mycobacterium
IAKLLGIKHFVAAVNKI

SEQ ID NO: 768113 - protein, 17 aa, Mycobacterium
IAKRLAAQIGDQIVLNT

SEQ ID NO: 768114 - protein, 17 aa, Mycobacterium
IAKSLFAERGFDGTSIE

SEQ ID NO: 768115 - protein, 21 aa, Mycobacterium
IALADRWPAARILGVDDSGAA

SEQ ID NO: 768116 - protein, 17 aa, Mycobacterium
IALDLKLGHGVEGHTVT

SEQ ID NO: 768117 - protein, 21 aa, Mycobacterium
IALDLLHRAGIEWDPALPCVA

SEQ ID NO: 768118 - protein, 17 aa, Mycobacterium
IALGTALARLGMFAPAL

SEQ ID NO: 768119 - protein, 18 aa, Mycobacterium
IALHAALELARRGSGYAV

SEQ ID NO: 768120 - protein, 20 aa, Mycobacterium
IALPEWLRRDLGPWSPWGKI

SEQ ID NO: 768121 - protein, 19 aa, Mycobacterium
IALRFDDLQFTFGEFDAAA

SEQ ID NO: 768122 - protein, 20 aa, Mycobacterium
IALRLGWRLFEPMLRSATGL

SEQ ID NO: 768123 - protein, 24 aa, Mycobacterium
IALSIFGSLAWKSGEAAAEGVAGA

SEQ ID NO: 768124 - protein, 17 aa, Mycobacterium
IAMGFGVNFFGHQAPFI

SEQ ID NO: 768125 - protein, 24 aa, Mycobacterium
IAMPALRLDAAFAHLNLGDCHGNA

SEQ ID NO: 768126 - protein, 24 aa, Mycobacterium
IAMPALRLDAAFAHLNLGDCRGNA

SEQ ID NO: 768127 - protein, 23 aa, Mycobacterium
IAMPALRLDAAFVHLNLGDCRGN

SEQ ID NO: 768128 - protein, 23 aa, Mycobacterium
IAMPALRLDAAFVHLNLGDSRGN

SEQ ID NO: 768129 - protein, 23 aa, Mycobacterium
IAMTRWHATVSWAGSEPATVELV

SEQ ID NO: 768130 - protein, 17 aa, Mycobacterium
IANGCDRVLNLAAGLDT

SEQ ID NO: 768131 - protein, 17 aa, Mycobacterium
IANILKNLGINWDPSEG

SEQ ID NO: 768132 - protein, 17 aa, Mycobacterium
IANSLGFVTEPIAAEDW

SEQ ID NO: 768133 - protein, 17 aa, Mycobacterium
IAPALAHRERQIHSGGA

SEQ ID NO: 768134 - protein, 18 aa, Mycobacterium
IAPALVYGNTVVWKPAST

SEQ ID NO: 768135 - protein, 23 aa, Mycobacterium
IAPDARGVFYGRLSEMTSTDFQV

SEQ ID NO: 768136 - protein, 19 aa, Mycobacterium
IAPDEIKAAGYGGVVNYVS

SEQ ID NO: 768137 - protein, 19 aa, Mycobacterium
IAPDGTFHWQLRPTSPGQL

SEQ ID NO: 768138 - protein, 26 aa, Mycobacterium
IAPEEARSGLAYALSKSFVKWYSQSQ

SEQ ID NO: 768139 - protein, 24 aa, Mycobacterium
IAPEVASGLPWYAGQAVLEPTDLT

SEQ ID NO: 768140 - protein, 24 aa, Mycobacterium
IAPGERAMFWPDCLENSFICVSWD

SEQ ID NO: 768141 - protein, 18 aa, Mycobacterium
IAPPEWMLPFLARNHPAL

SEQ ID NO: 768142 - protein, 21 aa, Mycobacterium
IAPRLGGPIAPCYHAAVDTAT

SEQ ID NO: 768143 - protein, 24 aa, Mycobacterium
IAPRTMLCAIAWRVHEQVAGARFE

SEQ ID NO: 768144 - protein, 24 aa, Mycobacterium
IAPRTMLCGYAWRVHVNISDAHFA

SEQ ID NO: 768145 - protein, 18 aa, Mycobacterium
IAPWLRAAHRYGAKVKWA

SEQ ID NO: 768146 - protein, 25 aa, Mycobacterium
IAQARLGPGRIHHCMRAIGAAERAL

SEQ ID NO: 768147 - protein, 26 aa, Mycobacterium
IAQARLGPGRIHHCMRALGGAERALA

SEQ ID NO: 768148 - protein, 18 aa, Mycobacterium
IAQAVLFLASPRASFVTG

SEQ ID NO: 768149 - protein, 19 aa, Mycobacterium
IAQQLPRKVAMQLLLTGEP

SEQ ID NO: 768150 - protein, 18 aa, Mycobacterium
IARDLAGHLIRVMTIAPG

SEQ ID NO: 768151 - protein, 23 aa, Mycobacterium
IARELDRYLPFLATTKVLIAAVR

SEQ ID NO: 768152 - protein, 23 aa, Mycobacterium
IARELDRYLPFLATTKVLMAAVR

SEQ ID NO: 768153 - protein, 23 aa, Mycobacterium
IARELDRYLPFLATTRVLIAAVR

SEQ ID NO: 768154 - protein, 24 aa, Mycobacterium
IARFKRLDGFDVRFLTGTDVHGLK

SEQ ID NO: 768155 - protein, 22 aa, Mycobacterium
IARGGFPEGCFQTLLVSASAVE

SEQ ID NO: 768156 - protein, 23 aa, Mycobacterium
IARIDWARFLPLYQQAGKRGFLA

SEQ ID NO: 768157 - protein, 18 aa, Mycobacterium
IARMAGWCLGGGLEIAAC

SEQ ID NO: 768158 - protein, 21 aa, Mycobacterium
IARSRLAPFGTRFVGVHTRYD

SEQ ID NO: 768159 - protein, 18 aa, Mycobacterium
IARVVPFIEWVRGAHPDL

SEQ ID NO: 768160 - protein, 17 aa, Mycobacterium
IASAAGVLAEWMAGAGA

SEQ ID NO: 768161 - protein, 17 aa, Mycobacterium
IASGEFFSMLGPSGCGK

SEQ ID NO: 768162 - protein, 18 aa, Mycobacterium
IASGELHFSIGYSEPGAG

SEQ ID NO: 768163 - protein, 17 aa, Mycobacterium
IASLGWRLVRVSRDQLS

SEQ ID NO: 768164 - protein, 17 aa, Mycobacterium
IASLLTVGWPKGRHHPV

SEQ ID NO: 768165 - protein, 24 aa, Mycobacterium
IASPPVKWPCFYGIDFATPAELIA

SEQ ID NO: 768166 - protein, 19 aa, Mycobacterium
IASSGWRLSPAYRHFDAEH

SEQ ID NO: 768167 - protein, 22 aa, Mycobacterium
IATDHLMRFPGHFSEQLLPEHL

SEQ ID NO: 768168 - protein, 23 aa, Mycobacterium
IATDHLMRFPGRFSEQLLPEHLH

SEQ ID NO: 768169 - protein, 18 aa, Mycobacterium
IATESALTWAGRCQPGDG

SEQ ID NO: 768170 - protein, 17 aa, Mycobacterium
IATGALWRDFGLPPFER

SEQ ID NO: 768171 - protein, 18 aa, Mycobacterium
IATLKLHYVRIIPTEITG

SEQ ID NO: 768172 - protein, 17 aa, Mycobacterium
IATRTGIPDYGYAFWPG

SEQ ID NO: 768173 - protein, 17 aa, Mycobacterium
IATRYGRFVVASRTRDI

SEQ ID NO: 768174 - protein, 18 aa, Mycobacterium
IATVFARAGANVAVAGRS

SEQ ID NO: 768175 - protein, 18 aa, Mycobacterium
IAVAAGRRKVPVVNGALV

SEQ ID NO: 768176 - protein, 25 aa, Mycobacterium
IAVCGQCRWCATGMEYLCDTGYGTL

SEQ ID NO: 768177 - protein, 17 aa, Mycobacterium
IAVIGMGCRFPGGISEP

SEQ ID NO: 768178 - protein, 18 aa, Mycobacterium
IAVIPAWRETAYFTDEER

SEQ ID NO: 768179 - protein, 20 aa, Mycobacterium
IAVVARRAGSGPGVTACPAG

SEQ ID NO: 768180 - protein, 19 aa, Mycobacterium
IAVVKGRCFAGNAVIAGAS

SEQ ID NO: 768181 - protein, 21 aa, Mycobacterium
IAWHWELMFTRPLTGYDIAAQ

SEQ ID NO: 768182 - protein, 20 aa, Mycobacterium
IAWSHLWERLSIEFSNHTEE

SEQ ID NO: 768183 - protein, 17 aa, Mycobacterium
IAWTAWRGLGMGSTSGF

SEQ ID NO: 768184 - protein, 19 aa, Mycobacterium
ICAARTGLDVYSWTEKQVV

SEQ ID NO: 768185 - protein, 24 aa, Mycobacterium
ICAEPRLAGLGGRFWFSLDDGRGD

SEQ ID NO: 768186 - protein, 24 aa, Mycobacterium
ICAEPRLAGLGGRFWFSVDDGRAD

SEQ ID NO: 768187 - protein, 19 aa, Mycobacterium
ICAFGRIGSMFACEDFGYQ

SEQ ID NO: 768188 - protein, 19 aa, Mycobacterium
ICAFGRIGSMFACNDFGYV

SEQ ID NO: 768189 - protein, 19 aa, Mycobacterium
ICAFGRIGSMFACSSDLGD

SEQ ID NO: 768190 - protein, 19 aa, Mycobacterium
ICARAGLAVRVIEAQTTPG

SEQ ID NO: 768191 - protein, 18 aa, Mycobacterium
ICAVTGWSQADVVVSVPD

SEQ ID NO: 768192 - protein, 19 aa, Mycobacterium
ICAYGRIGSMFACEDFGYV

SEQ ID NO: 768193 - protein, 19 aa, Mycobacterium
ICAYGRIGSMFACNDFGYV

SEQ ID NO: 768194 - protein, 18 aa, Mycobacterium
ICDFPLFGVEIETMFRHL

SEQ ID NO: 768195 - protein, 19 aa, Mycobacterium
ICDGRGLAAVLAMGGAAAA

SEQ ID NO: 768196 - protein, 17 aa, Mycobacterium
ICDGWLPIFYTPRMADM

SEQ ID NO: 768197 - protein, 25 aa, Mycobacterium
ICDKGFPAYFLIVADLINYAKSVGI

SEQ ID NO: 768198 - protein, 19 aa, Mycobacterium
ICDRPACSQRAFPYLGRPV

SEQ ID NO: 768199 - protein, 19 aa, Mycobacterium
ICDRPSCPQRAFPYLGRPV

SEQ ID NO: 768200 - protein, 17 aa, Mycobacterium
ICDVFGLPVEAVFSRTA

SEQ ID NO: 768201 - protein, 24 aa, Mycobacterium
ICGDVIRPGVPWMLTRTHARLAGA

SEQ ID NO: 768202 - protein, 21 aa, Mycobacterium
ICGFAKFPPLGDRSFAGGRTS

SEQ ID NO: 768203 - protein, 25 aa, Mycobacterium
ICHVDEGFEFLGFRIQRQIKRGTTK

SEQ ID NO: 768204 - protein, 18 aa, Mycobacterium
ICLSEGGIGWVAGLLDRL

SEQ ID NO: 768205 - protein, 20 aa, Mycobacterium
ICLVNGWAAGGGHSLHVTCD

SEQ ID NO: 768206 - protein, 17 aa, Mycobacterium
ICNRLLWQADVLGFGAG

SEQ ID NO: 768207 - protein, 18 aa, Mycobacterium
ICRYRLPVVVVVLNNGGV

SEQ ID NO: 768208 - protein, 18 aa, Mycobacterium
ICSARTAAQFGIEPRVAM

SEQ ID NO: 768209 - protein, 17 aa, Mycobacterium
ICSCCYLVQHRSRLRSS

SEQ ID NO: 768210 - protein, 22 aa, Mycobacterium
ICSGGLRWASHLSYVPGLTNKA

SEQ ID NO: 768211 - protein, 22 aa, Mycobacterium
ICSGGTRWASHLGYVPTLTNQA

SEQ ID NO: 768212 - protein, 21 aa, Mycobacterium
ICVSGPLLAGGYWKLPDATAE

SEQ ID NO: 768213 - protein, 20 aa, Mycobacterium
ICVSGPLLAGGYWNLPDETA

SEQ ID NO: 768214 - protein, 17 aa, Mycobacterium
ICVSGPLLSGGYWNLPE

SEQ ID NO: 768215 - protein, 17 aa, Mycobacterium
IDAEIPLLVVITEGIPV

SEQ ID NO: 768216 - protein, 21 aa, Mycobacterium
IDAEIPLLVVITEGIPVQDTA

SEQ ID NO: 768217 - protein, 17 aa, Mycobacterium
IDAETALAWGLVDAISA

SEQ ID NO: 768218 - protein, 17 aa, Mycobacterium
IDAGFVLTCQSYPTTDS

SEQ ID NO: 768219 - protein, 18 aa, Mycobacterium
IDAILALPVVDGIFIGPS

SEQ ID NO: 768220 - protein, 18 aa, Mycobacterium
IDAKLGFPQRDPHGDPIP

SEQ ID NO: 768221 - protein, 17 aa, Mycobacterium
IDAKLGYPTRDPHGDPI

SEQ ID NO: 768222 - protein, 18 aa, Mycobacterium
IDAPAVWMMAHREIIRSG

SEQ ID NO: 768223 - protein, 19 aa, Mycobacterium
IDARHLVAVLGHDRERIAP

SEQ ID NO: 768224 - protein, 17 aa, Mycobacterium
IDARLRLVIGRRGGLAD

SEQ ID NO: 768225 - protein, 17 aa, Mycobacterium
IDARLRLVVGRRGGLAD

SEQ ID NO: 768226 - protein, 17 aa, Mycobacterium
IDASLPGLHSWVDERLA

SEQ ID NO: 768227 - protein, 17 aa, Mycobacterium
IDATHAWAAVWTPQDPG

SEQ ID NO: 768228 - protein, 18 aa, Mycobacterium
IDATHAWAAVWTPQEPGQ

SEQ ID NO: 768229 - protein, 18 aa, Mycobacterium
IDATHAWAAVWTPQQPGQ

SEQ ID NO: 768230 - protein, 17 aa, Mycobacterium
IDAVLPMFLEFARGAVL

SEQ ID NO: 768231 - protein, 17 aa, Mycobacterium
IDCFSRRLVGWSIADHM

SEQ ID NO: 768232 - protein, 18 aa, Mycobacterium
IDDARAFEVLKLSSQLAQ

SEQ ID NO: 768233 - protein, 18 aa, Mycobacterium
IDDCPPILVLTGRADDAW

SEQ ID NO: 768234 - protein, 25 aa, Mycobacterium
IDDIRWFDFYSCFPSAVEAAIDALD

SEQ ID NO: 768235 - protein, 19 aa, Mycobacterium
IDDVSAYEALLCRIASLGI

SEQ ID NO: 768236 - protein, 23 aa, Mycobacterium
IDEAFKLGDVVAVFAPGGRLQQC

SEQ ID NO: 768237 - protein, 18 aa, Mycobacterium
IDEGFVAAVYRWATTGDL

SEQ ID NO: 768238 - protein, 22 aa, Mycobacterium
IDEIRPSFILSNAINIADAPFE

SEQ ID NO: 768239 - protein, 20 aa, Mycobacterium
IDEKRMFGGLAFLVNGNMSV

SEQ ID NO: 768240 - protein, 24 aa, Mycobacterium
IDELCAAGYGFSCLVVDTIFSSDG

SEQ ID NO: 768241 - protein, 23 aa, Mycobacterium
IDERARAGLFLAMQYPVEVPGVS

SEQ ID NO: 768242 - protein, 24 aa, Mycobacterium
IDERARAGLFLAMQYPVEVPGVSM

SEQ ID NO: 768243 - protein, 18 aa, Mycobacterium
IDEYVDWLIEAGHPIERI

SEQ ID NO: 768244 - protein, 17 aa, Mycobacterium
IDEYVDWLIEAGYPIER

SEQ ID NO: 768245 - protein, 18 aa, Mycobacterium
IDEYVDWLIEAGYPIERI

SEQ ID NO: 768246 - protein, 18 aa, Mycobacterium
IDFDPHWLRHTAATRLLR

SEQ ID NO: 768247 - protein, 18 aa, Mycobacterium
IDFFVRWASGELRSEDVD

SEQ ID NO: 768248 - protein, 18 aa, Mycobacterium
IDFLHRWDPVHWLQPVSA

SEQ ID NO: 768249 - protein, 23 aa, Mycobacterium
IDFPSRIGVWWASDTWSMRDAQE

SEQ ID NO: 768250 - protein, 18 aa, Mycobacterium
IDGARLRPAVNAFDLPVI

SEQ ID NO: 768251 - protein, 23 aa, Mycobacterium
IDGHVRAGGFGLVGACDIVVAGP

SEQ ID NO: 768252 - protein, 24 aa, Mycobacterium
IDGMLPRPLLEVLFDIDRGAGGGA

SEQ ID NO: 768253 - protein, 18 aa, Mycobacterium
IDGSFEWDQALFSYNFGD

SEQ ID NO: 768254 - protein, 18 aa, Mycobacterium
IDHFRYFAGAIRAQEGSL

SEQ ID NO: 768255 - protein, 19 aa, Mycobacterium
IDHTLGLPMGWHRGYHSLT

SEQ ID NO: 768256 - protein, 17 aa, Mycobacterium
IDIPVYLGCDWDNVPLH

SEQ ID NO: 768257 - protein, 22 aa, Mycobacterium
IDKFPRMVDYVLPTGVRIADAD

SEQ ID NO: 768258 - protein, 17 aa, Mycobacterium
IDKRGKISLVLVEDDNS

SEQ ID NO: 768259 - protein, 19 aa, Mycobacterium
IDKRGKISLVLVEEDSAAP

SEQ ID NO: 768260 - protein, 19 aa, Mycobacterium
IDLGGPVVRTLAFGDSIPG

SEQ ID NO: 768261 - protein, 20 aa, Mycobacterium
IDLGGSWLLPKIVGLQQAKR

SEQ ID NO: 768262 - protein, 19 aa, Mycobacterium
IDLGGSWLLPKLVGLQQAK

SEQ ID NO: 768263 - protein, 22 aa, Mycobacterium
IDLKTCGVVAVGHRVVHGGNAF

SEQ ID NO: 768264 - protein, 24 aa, Mycobacterium
IDLMPPLRWRVREVPFGIDYPVLV

SEQ ID NO: 768265 - protein, 20 aa, Mycobacterium
IDLNVRWRKGQTLEPDWKIE

SEQ ID NO: 768266 - protein, 19 aa, Mycobacterium
IDLQLRGCFAMTETGHGSD

SEQ ID NO: 768267 - protein, 22 aa, Mycobacterium
IDLRACGLVAVGHRVVHGGNTF

SEQ ID NO: 768268 - protein, 23 aa, Mycobacterium
IDLRADWPAALRAAGFDPAAPTA

SEQ ID NO: 768269 - protein, 18 aa, Mycobacterium
IDLRFVLGYTPLEFRDTL

SEQ ID NO: 768270 - protein, 19 aa, Mycobacterium
IDLRFVLGYTPLEFRDTLH

SEQ ID NO: 768271 - protein, 18 aa, Mycobacterium
IDLRLDWPKALAQAGFDA

SEQ ID NO: 768272 - protein, 24 aa, Mycobacterium
IDLRQDWPAALVATGFDPARPTAW

SEQ ID NO: 768273 - protein, 20 aa, Mycobacterium
IDLRQDWPSALRAAGFDPSA

SEQ ID NO: 768274 - protein, 26 aa, Mycobacterium
IDLRRDWPAALCATGFDTTVPTAWLA

SEQ ID NO: 768275 - protein, 17 aa, Mycobacterium
IDLRYADALSMADNVMT

SEQ ID NO: 768276 - protein, 17 aa, Mycobacterium
IDLVMWGEWPLEASPLR

SEQ ID NO: 768277 - protein, 19 aa, Mycobacterium
IDLVPPVVIGWVMGVYTGL

SEQ ID NO: 768278 - protein, 18 aa, Mycobacterium
IDMMLDRRVDGLILGDAR

SEQ ID NO: 768279 - protein, 21 aa, Mycobacterium
IDNLRAAFAWSRENSDTNGAL

SEQ ID NO: 768280 - protein, 20 aa, Mycobacterium
IDNPDRWAPGYAEAGAHNVT

SEQ ID NO: 768281 - protein, 18 aa, Mycobacterium
IDNWRWAGVPIYLRTGKK

SEQ ID NO: 768282 - protein, 18 aa, Mycobacterium
IDNWRWAGVPIYLRTGKR

SEQ ID NO: 768283 - protein, 18 aa, Mycobacterium
IDNWRWAGVPVFLRAGKA

SEQ ID NO: 768284 - protein, 31 aa, Mycobacterium
IDPDVVELPGWYRPNPGLARDLAFIGFSTVS

SEQ ID NO: 768285 - protein, 24 aa, Mycobacterium
IDPGYRYVLIYGHRRRVAALEADR

SEQ ID NO: 768286 - protein, 21 aa, Mycobacterium
IDPRNCTVLVWGAVNAGVAAN

SEQ ID NO: 768287 - protein, 22 aa, Mycobacterium
IDPSWPAARVELVLSDCGPSMI

SEQ ID NO: 768288 - protein, 21 aa, Mycobacterium
IDPWAGSYYVEWLTHQLAQKA

SEQ ID NO: 768289 - protein, 19 aa, Mycobacterium
IDPWGGSYYVEWLTHQLAE

SEQ ID NO: 768290 - protein, 20 aa, Mycobacterium
IDPWGGSYYVEWLTHQLASR

SEQ ID NO: 768291 - protein, 20 aa, Mycobacterium
IDPWGGSYYVEWLTYQLAEK

SEQ ID NO: 768292 - protein, 24 aa, Mycobacterium
IDRGPQLFAYDVWWHRDFDTVITS

SEQ ID NO: 768293 - protein, 19 aa, Mycobacterium
IDRGYPLFVENLVSLGAEI

SEQ ID NO: 768294 - protein, 18 aa, Mycobacterium
IDRGYPLFVEYLGILGAE

SEQ ID NO: 768295 - protein, 18 aa, Mycobacterium
IDRLEFLAAPGWTIIRVS

SEQ ID NO: 768296 - protein, 18 aa, Mycobacterium
IDRTVFWLIRGYEASRRA

SEQ ID NO: 768297 - protein, 25 aa, Mycobacterium
IDRVFAGKVWGAWHLSEAAADLDLD

SEQ ID NO: 768298 - protein, 17 aa, Mycobacterium
IDRVRWDDIVSRVFGRI

SEQ ID NO: 768299 - protein, 17 aa, Mycobacterium
IDSAWLWPVRETVRKCA

SEQ ID NO: 768300 - protein, 20 aa, Mycobacterium
IDSELGWSRDVWKQLAEVGV

SEQ ID NO: 768301 - protein, 18 aa, Mycobacterium
IDSGEEWVVLDADQLEIE

SEQ ID NO: 768302 - protein, 18 aa, Mycobacterium
IDTCYRVGRKVLVRADAG

SEQ ID NO: 768303 - protein, 18 aa, Mycobacterium
IDTELGWAQFYGHNTARV

SEQ ID NO: 768304 - protein, 18 aa, Mycobacterium
IDTEVWFPAGPVGTASVL

SEQ ID NO: 768305 - protein, 18 aa, Mycobacterium
IDTIYGLVAETMKERSTA

SEQ ID NO: 768306 - protein, 17 aa, Mycobacterium
IDTVYGLVAETMKERST

SEQ ID NO: 768307 - protein, 19 aa, Mycobacterium
IDVAPGWELDRLTAPSRLF

SEQ ID NO: 768308 - protein, 18 aa, Mycobacterium
IDVAYRFFSTESRSYILA

SEQ ID NO: 768309 - protein, 17 aa, Mycobacterium
IDVEWTLLASMGRLGRP

SEQ ID NO: 768310 - protein, 17 aa, Mycobacterium
IDVPVLWVFTARTGAGG

SEQ ID NO: 768311 - protein, 25 aa, Mycobacterium
IDVPWDGVWWWSRPDGSLQLVPFSR

SEQ ID NO: 768312 - protein, 18 aa, Mycobacterium
IDVSFPLGVLTSVTGVSG

SEQ ID NO: 768313 - protein, 17 aa, Mycobacterium
IDVTAWPAVVVRAYTES

SEQ ID NO: 768314 - protein, 20 aa, Mycobacterium
IDWPARWSAWKARRYGDTRL

SEQ ID NO: 768315 - protein, 17 aa, Mycobacterium
IDYARGRFDAIVPDAVL

SEQ ID NO: 768316 - protein, 17 aa, Mycobacterium
IEAAICDGDWVVVRQQN

SEQ ID NO: 768317 - protein, 18 aa, Mycobacterium
IEAARLSAVFAEGAGARD

SEQ ID NO: 768318 - protein, 18 aa, Mycobacterium
IEACGDCPRGIHGSPLAG

SEQ ID NO: 768319 - protein, 17 aa, Mycobacterium
IEAELPPVVGLAHAAGV

SEQ ID NO: 768320 - protein, 18 aa, Mycobacterium
IEAFRLLTLQTAWKIDRH

SEQ ID NO: 768321 - protein, 21 aa, Mycobacterium
IEAFSGRSGRKRWGEIETVIL

SEQ ID NO: 768322 - protein, 20 aa, Mycobacterium
IEALGFGALWVNGGQLDRLE

SEQ ID NO: 768323 - protein, 21 aa, Mycobacterium
IEALLRILEPFGIREIVQSGV

SEQ ID NO: 768324 - protein, 20 aa, Mycobacterium
IEALLRVLEPFGIREIVQSG

SEQ ID NO: 768325 - protein, 18 aa, Mycobacterium
IEALRWALSIAEKGLAAG

SEQ ID NO: 768326 - protein, 18 aa, Mycobacterium
IEALWPMVIARAAVLLVS

SEQ ID NO: 768327 - protein, 19 aa, Mycobacterium
IECAKAGVELSTFETGGAG

SEQ ID NO: 768328 - protein, 17 aa, Mycobacterium
IECCLELYSAGLVVGIQ

SEQ ID NO: 768329 - protein, 17 aa, Mycobacterium
IEDFPYWEPCHNAILSN

SEQ ID NO: 768330 - protein, 23 aa, Mycobacterium
IEDPRVAGLIARVQIPPAAAGAV

SEQ ID NO: 768331 - protein, 18 aa, Mycobacterium
IEDVWLPLFRPRTDAQPR

SEQ ID NO: 768332 - protein, 19 aa, Mycobacterium
IEECLRLSVDYAKSRKLWG

SEQ ID NO: 768333 - protein, 19 aa, Mycobacterium
IEECLRLSVDYAKTRKLWG

SEQ ID NO: 768334 - protein, 20 aa, Mycobacterium
IEEGKPCWLLGLLFSDENGC

SEQ ID NO: 768335 - protein, 22 aa, Mycobacterium
IEEMLRFPLPVIAAVNGPAVGL

SEQ ID NO: 768336 - protein, 17 aa, Mycobacterium
IEERARAAAQFVLGGSV

SEQ ID NO: 768337 - protein, 23 aa, Mycobacterium
IEEWKWRGVPVWYHDGMICTGET

SEQ ID NO: 768338 - protein, 17 aa, Mycobacterium
IEFIVAQLLRLGKLGSF

SEQ ID NO: 768339 - protein, 23 aa, Mycobacterium
IEFPGVRLSERFLLADIHLDWAV

SEQ ID NO: 768340 - protein, 21 aa, Mycobacterium
IEFPLSALIKGWQDGIPGMKV

SEQ ID NO: 768341 - protein, 21 aa, Mycobacterium
IEFSGAYPWEWTARMMDEWSA

SEQ ID NO: 768342 - protein, 20 aa, Mycobacterium
IEFWAFDLLYLDGRSLLRAK

SEQ ID NO: 768343 - protein, 22 aa, Mycobacterium
IEGLRLPLLILHSPTDNTVGIE

SEQ ID NO: 768344 - protein, 18 aa, Mycobacterium
IEGTIPLAVPVTMTSTNT

SEQ ID NO: 768345 - protein, 25 aa, Mycobacterium
IEGVCLRLGPGLPVVLGGGLLVNQP

SEQ ID NO: 768346 - protein, 21 aa, Mycobacterium
IEHWTRLPVEIELASEFRYRD

SEQ ID NO: 768347 - protein, 21 aa, Mycobacterium
IEHWTRLPVEVELASEFRYRD

SEQ ID NO: 768348 - protein, 20 aa, Mycobacterium
IEIGDGFRLPALMESTGSRI

SEQ ID NO: 768349 - protein, 20 aa, Mycobacterium
IEIGQLFAYRLSRCSETEDW

SEQ ID NO: 768350 - protein, 17 aa, Mycobacterium
IEILGPVGLAGRSAATV

SEQ ID NO: 768351 - protein, 19 aa, Mycobacterium
IEIPERWRVVFGAASRADC

SEQ ID NO: 768352 - protein, 18 aa, Mycobacterium
IEIREFLEGYVIGQDTAK

SEQ ID NO: 768353 - protein, 25 aa, Mycobacterium
IEKAFPGRFLLGVGVGHPEHTQEYT

SEQ ID NO: 768354 - protein, 20 aa, Mycobacterium
IEKERPRFVVPLVEAASREA

SEQ ID NO: 768355 - protein, 20 aa, Mycobacterium
IEKMRVAGRIAAGALAEAGK

SEQ ID NO: 768356 - protein, 20 aa, Mycobacterium
IEKMRVAGRIAAGALVEAGK

SEQ ID NO: 768357 - protein, 17 aa, Mycobacterium
IELARSGAKLAISDVDT

SEQ ID NO: 768358 - protein, 19 aa, Mycobacterium
IELFTGVALLIQRDVIHTA

SEQ ID NO: 768359 - protein, 19 aa, Mycobacterium
IELGDWVRPVLLDGLAVLL

SEQ ID NO: 768360 - protein, 19 aa, Mycobacterium
IELGIKWLSLYAFSTENWK

SEQ ID NO: 768361 - protein, 17 aa, Mycobacterium
IELGRSGALVAISDVDT

SEQ ID NO: 768362 - protein, 18 aa, Mycobacterium
IELLAWQFASPVRWIETQ

SEQ ID NO: 768363 - protein, 20 aa, Mycobacterium
IELTGAWPGLRCDIDTAEDL

SEQ ID NO: 768364 - protein, 17 aa, Mycobacterium
IELWKIVDRPNLLIKIP

SEQ ID NO: 768365 - protein, 17 aa, Mycobacterium
IELYKDWGETRVGDQDL

SEQ ID NO: 768366 - protein, 17 aa, Mycobacterium
IEMGGDFGGVWYWNRYP

SEQ ID NO: 768367 - protein, 18 aa, Mycobacterium
IEMGIPWLTTYAFSTENW

SEQ ID NO: 768368 - protein, 21 aa, Mycobacterium
IEMIRLLTLKAAYLMDTVGNK

SEQ ID NO: 768369 - protein, 25 aa, Mycobacterium
IENESRLGYFAALYKRITVAVRTAV

SEQ ID NO: 768370 - protein, 22 aa, Mycobacterium
IEPDLSNALAFIAPALATGGTV

SEQ ID NO: 768371 - protein, 24 aa, Mycobacterium
IEPGIYVPGRWGARIEDIVVVTED

SEQ ID NO: 768372 - protein, 17 aa, Mycobacterium
IEPGNSVTVGFQAAQDG

SEQ ID NO: 768373 - protein, 22 aa, Mycobacterium
IEPRLSLQWFVRVESLAKAAGD

SEQ ID NO: 768374 - protein, 22 aa, Mycobacterium
IEPRPDQTFEFTVDVPGQVDIE

SEQ ID NO: 768375 - protein, 21 aa, Mycobacterium
IEQRIAPMLGRLSTREQQRLA

SEQ ID NO: 768376 - protein, 24 aa, Mycobacterium
IERFLEWYAPFANFFYDTLGLPFF

SEQ ID NO: 768377 - protein, 20 aa, Mycobacterium
IERFLQLWAEGSMTIAMPST

SEQ ID NO: 768378 - protein, 19 aa, Mycobacterium
IERFLQLWAEGSMTIAVPS

SEQ ID NO: 768379 - protein, 17 aa, Mycobacterium
IERGGAFGDMWRSDLAA

SEQ ID NO: 768380 - protein, 23 aa, Mycobacterium
IERMHRSCLILTFGGGTNEIQRD

SEQ ID NO: 768381 - protein, 18 aa, Mycobacterium
IERPGRRIALAVAEMEAR

SEQ ID NO: 768382 - protein, 17 aa, Mycobacterium
IERPHMYRLMFGSTSAH

SEQ ID NO: 768383 - protein, 18 aa, Mycobacterium
IERPHMYRLMFGSTSAHG

SEQ ID NO: 768384 - protein, 19 aa, Mycobacterium
IERPHMYRLMFGSTSAHGI

SEQ ID NO: 768385 - protein, 17 aa, Mycobacterium
IERRWQQTWADRGTFHV

SEQ ID NO: 768386 - protein, 17 aa, Mycobacterium
IERTCDFLEWFLDNVPI

SEQ ID NO: 768387 - protein, 18 aa, Mycobacterium
IESGEEWVLIDAAQLEIE

SEQ ID NO: 768388 - protein, 19 aa, Mycobacterium
IESGFTFPVLSDFWPHGKV

SEQ ID NO: 768389 - protein, 17 aa, Mycobacterium
IESPMFFTANTIDQPGK

SEQ ID NO: 768390 - protein, 21 aa, Mycobacterium
IESRIKMGLSQNIATVTASTT

SEQ ID NO: 768391 - protein, 17 aa, Mycobacterium
IEVAWRILRVTPVNATN

SEQ ID NO: 768392 - protein, 17 aa, Mycobacterium
IEVIKLVLGGGMVEFHG

SEQ ID NO: 768393 - protein, 17 aa, Mycobacterium
IEVLALRYAVNRGNLEW

SEQ ID NO: 768394 - protein, 21 aa, Mycobacterium
IEVLGDGGLRVSGRATLDRRD

SEQ ID NO: 768395 - protein, 17 aa, Mycobacterium
IEVPDRQLACVPVNSPE

SEQ ID NO: 768396 - protein, 20 aa, Mycobacterium
IEVPMEILPLLTIRDLVDTL

SEQ ID NO: 768397 - protein, 18 aa, Mycobacterium
IEYRRVGSGGGWPTTFHD

SEQ ID NO: 768398 - protein, 17 aa, Mycobacterium
IFADLELAWGPTWSGSL

SEQ ID NO: 768399 - protein, 22 aa, Mycobacterium
IFCATCYEWAILDLAILAVGGV

SEQ ID NO: 768400 - protein, 18 aa, Mycobacterium
IFCPRWVGLFRWLKPVLS

SEQ ID NO: 768401 - protein, 22 aa, Mycobacterium
IFDTRAGLIVSMRLYGDTRATA

SEQ ID NO: 768402 - protein, 18 aa, Mycobacterium
IFGDPTFNDTIFKRTTGL

SEQ ID NO: 768403 - protein, 18 aa, Mycobacterium
IFHRFPRGYTMSSLPQLT

SEQ ID NO: 768404 - protein, 23 aa, Mycobacterium
IFKRIRPAFRYDRSLAVITAARN

SEQ ID NO: 768405 - protein, 23 aa, Mycobacterium
IFKRIRPGFRYERSLAVITAARD

SEQ ID NO: 768406 - protein, 19 aa, Mycobacterium
IFLMCLPDRVLAYGDCAII

SEQ ID NO: 768407 - protein, 23 aa, Mycobacterium
IFLREVQDVWTWVRPYYDARAMA

SEQ ID NO: 768408 - protein, 21 aa, Mycobacterium
IFLYPENWIEPALRDDKSPFF

SEQ ID NO: 768409 - protein, 23 aa, Mycobacterium
IFMWEIFGPLVAGARLVFNPGEW

SEQ ID NO: 768410 - protein, 21 aa, Mycobacterium
IFSGVMPRWITPRWDADRHLS

SEQ ID NO: 768411 - protein, 18 aa, Mycobacterium
IFTKFSIPINIARVIHRD

SEQ ID NO: 768412 - protein, 18 aa, Mycobacterium
IFTKFSIPINIARVMHRD

SEQ ID NO: 768413 - protein, 19 aa, Mycobacterium
IFYNRELLSSLGLEVPKTL

SEQ ID NO: 768414 - protein, 19 aa, Mycobacterium
IFYPRVFLRRGAMSPAGTI

SEQ ID NO: 768415 - protein, 17 aa, Mycobacterium
IFYTAAVSDLFINPVDP

SEQ ID NO: 768416 - protein, 17 aa, Mycobacterium
IGAALADPATLPDAIDT

SEQ ID NO: 768417 - protein, 19 aa, Mycobacterium
IGAAVAVEWAVAHPGCALA

SEQ ID NO: 768418 - protein, 17 aa, Mycobacterium
IGAHYLGAFAMTSAKQG

SEQ ID NO: 768419 - protein, 17 aa, Mycobacterium
IGAKAVIVSAPFDAAAP

SEQ ID NO: 768420 - protein, 17 aa, Mycobacterium
IGALPRLEGTVHVNVAQ

SEQ ID NO: 768421 - protein, 27 aa, Mycobacterium
IGAPSFKEALRWGAEVYHSLKSVLKNQ

SEQ ID NO: 768422 - protein, 17 aa, Mycobacterium
IGAVLSMHFARQAAPFF

SEQ ID NO: 768423 - protein, 17 aa, Mycobacterium
IGCALRWMRDFHADGLR

SEQ ID NO: 768424 - protein, 21 aa, Mycobacterium
IGDSPLGAWVRSLGVDGDQVI

SEQ ID NO: 768425 - protein, 18 aa, Mycobacterium
IGDVASWRDTVGGQVRVE

SEQ ID NO: 768426 - protein, 24 aa, Mycobacterium
IGEGRKSLTLALRFRATDRTLTED

SEQ ID NO: 768427 - protein, 18 aa, Mycobacterium
IGELMGGPVTRWAEETDR

SEQ ID NO: 768428 - protein, 17 aa, Mycobacterium
IGELTVRAVGGKHAVIH

SEQ ID NO: 768429 - protein, 18 aa, Mycobacterium
IGERWEWSDEVARMHGYE

SEQ ID NO: 768430 - protein, 17 aa, Mycobacterium
IGFALLRYVWKIEPIAS

SEQ ID NO: 768431 - protein, 23 aa, Mycobacterium
IGFDIPNEFVVGYGLDYAERYRD

SEQ ID NO: 768432 - protein, 18 aa, Mycobacterium
IGFDLVWRTEFDRSSKIG

SEQ ID NO: 768433 - protein, 19 aa, Mycobacterium
IGFGLARPVWLDDVDFDIT

SEQ ID NO: 768434 - protein, 17 aa, Mycobacterium
IGFPPDWGERTVSLRRE

SEQ ID NO: 768435 - protein, 23 aa, Mycobacterium
IGGAFGRYGGVWAHDDTRKSFGI

SEQ ID NO: 768436 - protein, 20 aa, Mycobacterium
IGGARRCAAQSWSLERVKAV

SEQ ID NO: 768437 - protein, 19 aa, Mycobacterium
IGGAWFLTRIVGVAKAMEL

SEQ ID NO: 768438 - protein, 17 aa, Mycobacterium
IGGGLCLALAADVRVAA

SEQ ID NO: 768439 - protein, 24 aa, Mycobacterium
IGGGMCFTFLAAQGFSVGKSLLEE

SEQ ID NO: 768440 - protein, 25 aa, Mycobacterium
IGGGMCFTFLAAQGFSVGKSLLETE

SEQ ID NO: 768441 - protein, 25 aa, Mycobacterium
IGGGMCFTFLAAQGFSVGSSLLQEE

SEQ ID NO: 768442 - protein, 19 aa, Mycobacterium
IGGGMCFTFLAAQGLPVGK

SEQ ID NO: 768443 - protein, 19 aa, Mycobacterium
IGGGMCFTFLAAQGLSVGS

SEQ ID NO: 768444 - protein, 19 aa, Mycobacterium
IGGLSRWGHLQNRPVGPIF

SEQ ID NO: 768445 - protein, 20 aa, Mycobacterium
IGGMPAPAPLVWAVNEMIYC

SEQ ID NO: 768446 - protein, 17 aa, Mycobacterium
IGGPVEVLSSIGATTNF

SEQ ID NO: 768447 - protein, 25 aa, Mycobacterium
IGGRLVELCAPFGMEVLVFDPYLDE

SEQ ID NO: 768448 - protein, 17 aa, Mycobacterium
IGGRWVVDVASYKRHGR

SEQ ID NO: 768449 - protein, 18 aa, Mycobacterium
IGGTAWDFANPVRIPPGS

SEQ ID NO: 768450 - protein, 19 aa, Mycobacterium
IGGTGAWDPAFTQHYYRPV

SEQ ID NO: 768451 - protein, 18 aa, Mycobacterium
IGGTGGFGANIAGSGGAG

SEQ ID NO: 768452 - protein, 25 aa, Mycobacterium
IGGVGGRGGAAWAQSPTGTPNVTGG

SEQ ID NO: 768453 - protein, 18 aa, Mycobacterium
IGHIPGAVKIDWHTDLND

SEQ ID NO: 768454 - protein, 19 aa, Mycobacterium
IGHVLFTWNMPELWRRFTI

SEQ ID NO: 768455 - protein, 23 aa, Mycobacterium
IGHYFKRLTVIESEFGNRDFHTA

SEQ ID NO: 768456 - protein, 18 aa, Mycobacterium
IGKWANRMLDFFADTPSY

SEQ ID NO: 768457 - protein, 19 aa, Mycobacterium
IGLAAAKYWVCKRATPHAA

SEQ ID NO: 768458 - protein, 18 aa, Mycobacterium
IGLAAGKYWVCKRATPHA

SEQ ID NO: 768459 - protein, 17 aa, Mycobacterium
IGLDCLEELVLQAPLVP

SEQ ID NO: 768460 - protein, 17 aa, Mycobacterium
IGLDEYVDWVIEAGYPI

SEQ ID NO: 768461 - protein, 18 aa, Mycobacterium
IGLDRPAYVYPMFETAVR

SEQ ID NO: 768462 - protein, 17 aa, Mycobacterium
IGLFAIQWAKLHGADQV

SEQ ID NO: 768463 - protein, 23 aa, Mycobacterium
IGLGVDLFGAFIIDSAGSFGIDS

SEQ ID NO: 768464 - protein, 17 aa, Mycobacterium
IGLIAATGFGVWRPDET

SEQ ID NO: 768465 - protein, 19 aa, Mycobacterium
IGMVRCRIPVIAAVNGPAV

SEQ ID NO: 768466 - protein, 18 aa, Mycobacterium
IGNLMPGFGHIGMGGSVG

SEQ ID NO: 768467 - protein, 17 aa, Mycobacterium
IGPALEDWAKWGQARHD

SEQ ID NO: 768468 - protein, 20 aa, Mycobacterium
IGPAPWKSLLGMTGPTTLPI

SEQ ID NO: 768469 - protein, 17 aa, Mycobacterium
IGPAWAFLGWARPGSDW

SEQ ID NO: 768470 - protein, 17 aa, Mycobacterium
IGPGGLFLALPGAHVDG

SEQ ID NO: 768471 - protein, 18 aa, Mycobacterium
IGPITIPTIKGILPVIDI

SEQ ID NO: 768472 - protein, 22 aa, Mycobacterium
IGPRAARVVSIFLDGATLHAMI

SEQ ID NO: 768473 - protein, 17 aa, Mycobacterium
IGQAVFDTVAWNMFAVI

SEQ ID NO: 768474 - protein, 19 aa, Mycobacterium
IGQLCLLRLTSPAEHPYGS

SEQ ID NO: 768475 - protein, 17 aa, Mycobacterium
IGQLCLLRLTSPAENPY

SEQ ID NO: 768476 - protein, 20 aa, Mycobacterium
IGQLCLLRLTSPAQHPYGSS

SEQ ID NO: 768477 - protein, 17 aa, Mycobacterium
IGQLSMWQLPRDQTGDI

SEQ ID NO: 768478 - protein, 17 aa, Mycobacterium
IGRAHTPWFHWPTTAMV

SEQ ID NO: 768479 - protein, 26 aa, Mycobacterium
IGRGRHPSLCLFASWSAPDSPAGRRL

SEQ ID NO: 768480 - protein, 21 aa, Mycobacterium
IGRIKDLLIIYGRNHSPDDIE

SEQ ID NO: 768481 - protein, 26 aa, Mycobacterium
IGRKLIEVPVGFKWFVDGLIEGGIGF

SEQ ID NO: 768482 - protein, 24 aa, Mycobacterium
IGRKPRGSYQIAILGLKGGAGKTT

SEQ ID NO: 768483 - protein, 21 aa, Mycobacterium
IGSFRFWFIGQRWEWSDEVAR

SEQ ID NO: 768484 - protein, 24 aa, Mycobacterium
IGSGGYRLTALFSNVLNLPDSAKV

SEQ ID NO: 768485 - protein, 21 aa, Mycobacterium
IGSKELIAWLPTLLGLGPRDV

SEQ ID NO: 768486 - protein, 17 aa, Mycobacterium
IGSQGGILFSHAGADGS

SEQ ID NO: 768487 - protein, 17 aa, Mycobacterium
IGSQPGWRVDVADTTVT

SEQ ID NO: 768488 - protein, 23 aa, Mycobacterium
IGSRIDPVLARSWLLVNGTHPDR

SEQ ID NO: 768489 - protein, 18 aa, Mycobacterium
IGSSVLRWQEQRGLQHLA

SEQ ID NO: 768490 - protein, 17 aa, Mycobacterium
IGTAAAYLSAKRTGRGR

SEQ ID NO: 768491 - protein, 20 aa, Mycobacterium
IGTFSWPGAYGTWWQADPGA

SEQ ID NO: 768492 - protein, 17 aa, Mycobacterium
IGTLIGWQSTMHAAGVS

SEQ ID NO: 768493 - protein, 24 aa, Mycobacterium
IGVDGYRWMIRCVINGAHETMEAL

SEQ ID NO: 768494 - protein, 24 aa, Mycobacterium
IGVDGYRWMIRCVINGPHETMEAL

SEQ ID NO: 768495 - protein, 24 aa, Mycobacterium
IGVDGYRWMIRCVVNGPFERIAEL

SEQ ID NO: 768496 - protein, 19 aa, Mycobacterium
IGVDGYRWMVRCVVNGVPE

SEQ ID NO: 768497 - protein, 21 aa, Mycobacterium
IGVDIAFNWDHFFPLYGDPDG

SEQ ID NO: 768498 - protein, 18 aa, Mycobacterium
IGVNCLWPETYIATAAVT

SEQ ID NO: 768499 - protein, 18 aa, Mycobacterium
IGWSDSWAKAAPGANPYA

SEQ ID NO: 768500 - protein, 17 aa, Mycobacterium
IGWSDTWYKSTAGANPY

SEQ ID NO: 768501 - protein, 21 aa, Mycobacterium
IGYAACHWCHVMAHESFEDDE

SEQ ID NO: 768502 - protein, 23 aa, Mycobacterium
IGYHGLHAFRWVADDGSARFVRY

SEQ ID NO: 768503 - protein, 23 aa, Mycobacterium
IGYRIDPVLARSWLLVNGAHADR

SEQ ID NO: 768504 - protein, 17 aa, Mycobacterium
IHAGEAFGLPSIHEAIA

SEQ ID NO: 768505 - protein, 24 aa, Mycobacterium
IHAMWRINELLNWQVAAAGEDINV

SEQ ID NO: 768506 - protein, 18 aa, Mycobacterium
IHDFPALWYVPAAGAVYV

SEQ ID NO: 768507 - protein, 19 aa, Mycobacterium
IHDRMPLMLGADSWDSWLD

SEQ ID NO: 768508 - protein, 17 aa, Mycobacterium
IHFQEWWVRYRADVPTH

SEQ ID NO: 768509 - protein, 17 aa, Mycobacterium
IHFQEWWVRYRAKVPTH

SEQ ID NO: 768510 - protein, 17 aa, Mycobacterium
IHLALAAARDFPWTERR

SEQ ID NO: 768511 - protein, 18 aa, Mycobacterium
IHLTREWILRNSPVPVGT

SEQ ID NO: 768512 - protein, 18 aa, Mycobacterium
IHRFPGSMAKRVQVLAQE

SEQ ID NO: 768513 - protein, 20 aa, Mycobacterium
IHSLPLYHCAQLDNFLVTDV

SEQ ID NO: 768514 - protein, 19 aa, Mycobacterium
IIAAFPWEPEIEGVHSYVM

SEQ ID NO: 768515 - protein, 19 aa, Mycobacterium
IIACKDGHVRICILSKRQW

SEQ ID NO: 768516 - protein, 19 aa, Mycobacterium
IIAERRLWLAVLRAQAELG

SEQ ID NO: 768517 - protein, 18 aa, Mycobacterium
IIARMLAVMLRRRMAAAG

SEQ ID NO: 768518 - protein, 18 aa, Mycobacterium
IIEKLELPAGVNVKRVPQ

SEQ ID NO: 768519 - protein, 18 aa, Mycobacterium
IIEKLELPPGVNVKRVPQ

SEQ ID NO: 768520 - protein, 22 aa, Mycobacterium
IIEPGCLDLLFRGEIPEGVDPA

SEQ ID NO: 768521 - protein, 19 aa, Mycobacterium
IIEPGCLDLLFRGEVPEGV

SEQ ID NO: 768522 - protein, 18 aa, Mycobacterium
IIEQLRFPGYFLVVHDIT

SEQ ID NO: 768523 - protein, 19 aa, Mycobacterium
IIGCFRAGGGLPYSEFPRF

SEQ ID NO: 768524 - protein, 17 aa, Mycobacterium
IIGMFRLWWIPKGAAPT

SEQ ID NO: 768525 - protein, 25 aa, Mycobacterium
IIGNLLPPALKWKAFFKRQASNPKY

SEQ ID NO: 768526 - protein, 20 aa, Mycobacterium
IIPCQLPWLLDPDVGAQMIY

SEQ ID NO: 768527 - protein, 19 aa, Mycobacterium
IIPWNFPILMATWKLAPAL

SEQ ID NO: 768528 - protein, 18 aa, Mycobacterium
IIRALDMLLILHADHEQN

SEQ ID NO: 768529 - protein, 19 aa, Mycobacterium
IITRLTHRGALHLPEAQLK

SEQ ID NO: 768530 - protein, 22 aa, Mycobacterium
IIVPGCLDLLFRGEIPDGVDPA

SEQ ID NO: 768531 - protein, 21 aa, Mycobacterium
IIVVPRWWKALWYLERLSPAL

SEQ ID NO: 768532 - protein, 17 aa, Mycobacterium
IIWAPAIDGAFVLSTRG

SEQ ID NO: 768533 - protein, 17 aa, Mycobacterium
IKAGRVWTNCYHQYPAH

SEQ ID NO: 768534 - protein, 18 aa, Mycobacterium
IKAGRVWTNCYHQYPAHA

SEQ ID NO: 768535 - protein, 20 aa, Mycobacterium
IKAPRLIKAYGVRFRPNAPM

SEQ ID NO: 768536 - protein, 25 aa, Mycobacterium
IKDGPRIAVRLAWWRDHRPRGLDEL

SEQ ID NO: 768537 - protein, 23 aa, Mycobacterium
IKDGRAVTVLEHFTRLREDLAPN

SEQ ID NO: 768538 - protein, 21 aa, Mycobacterium
IKDLVIPPAWKNVWISPHANG

SEQ ID NO: 768539 - protein, 21 aa, Mycobacterium
IKDWKGKLKFLAKKIPFAGTL

SEQ ID NO: 768540 - protein, 23 aa, Mycobacterium
IKELCRRWYPRIYFGQPTKGLAH

SEQ ID NO: 768541 - protein, 24 aa, Mycobacterium
IKELCRRWYPRIYFGQPVKGLAHR

SEQ ID NO: 768542 - protein, 24 aa, Mycobacterium
IKEPFRRWASLVIHAGEPGAGTRM

SEQ ID NO: 768543 - protein, 17 aa, Mycobacterium
IKFSGCYHGHVDALLAD

SEQ ID NO: 768544 - protein, 17 aa, Mycobacterium
IKGAPLLGEHTDEVLAG

SEQ ID NO: 768545 - protein, 18 aa, Mycobacterium
IKGRIMAMAQPDAQGNRP

SEQ ID NO: 768546 - protein, 21 aa, Mycobacterium
IKKLPTLRGRTIVTMFYENST

SEQ ID NO: 768547 - protein, 21 aa, Mycobacterium
IKLDRPAYVYPIFEQALRIAN

SEQ ID NO: 768548 - protein, 18 aa, Mycobacterium
IKLDRPAYVYPLFEQALR

SEQ ID NO: 768549 - protein, 23 aa, Mycobacterium
IKMRPGAPWIPAQVVAAFAEKTF

SEQ ID NO: 768550 - protein, 22 aa, Mycobacterium
IKNLRLPLLILHSPTDNTVGIE

SEQ ID NO: 768551 - protein, 17 aa, Mycobacterium
IKPAAGFFNATTGPSSG

SEQ ID NO: 768552 - protein, 18 aa, Mycobacterium
IKPGWGFHFDYHPGQYVG

SEQ ID NO: 768553 - protein, 17 aa, Mycobacterium
IKRCNRCGYLHECNTPT

SEQ ID NO: 768554 - protein, 17 aa, Mycobacterium
IKRFVIVGTPWEPGGDE

SEQ ID NO: 768555 - protein, 18 aa, Mycobacterium
IKSIRVWRRLRADRAAQQ

SEQ ID NO: 768556 - protein, 22 aa, Mycobacterium
IKSLRLPLLILHSPTDNTVGIG

SEQ ID NO: 768557 - protein, 17 aa, Mycobacterium
IKSNWKFVSENFLGDTY

SEQ ID NO: 768558 - protein, 25 aa, Mycobacterium
IKTPCPRIDLIAAFADATRRVYLTA

SEQ ID NO: 768559 - protein, 19 aa, Mycobacterium
IKTRMGWQIPWYTMVPESS

SEQ ID NO: 768560 - protein, 19 aa, Mycobacterium
IKVKGFRNVIHWEVTQYDE

SEQ ID NO: 768561 - protein, 19 aa, Mycobacterium
IKVKGFRNVIHWRVTRYDE

SEQ ID NO: 768562 - protein, 19 aa, Mycobacterium
IKVKGFRNVVHWTVTEYDE

SEQ ID NO: 768563 - protein, 19 aa, Mycobacterium
IKVLAVREVMRLLDGQAAG

SEQ ID NO: 768564 - protein, 17 aa, Mycobacterium
IKVLLAMTVLDHLRPDS

SEQ ID NO: 768565 - protein, 17 aa, Mycobacterium
ILAALALGRLERSPLYH

SEQ ID NO: 768566 - protein, 22 aa, Mycobacterium
ILAEIFPGGWLPTIPTVEEHAT

SEQ ID NO: 768567 - protein, 21 aa, Mycobacterium
ILAFERQWWKFAGVKEEAIKE

SEQ ID NO: 768568 - protein, 24 aa, Mycobacterium
ILALPCPMCLGALYYCSPDEVVFL

SEQ ID NO: 768569 - protein, 22 aa, Mycobacterium
ILARFPGFYIPFLDVPFTGATP

SEQ ID NO: 768570 - protein, 25 aa, Mycobacterium
ILARRPGWFDARWLQVAINHRAQRW

SEQ ID NO: 768571 - protein, 24 aa, Mycobacterium
ILASICFPSFPGFAARLFATDDPD

SEQ ID NO: 768572 - protein, 24 aa, Mycobacterium
ILASICFPSFPGFAGRLFATEDPD

SEQ ID NO: 768573 - protein, 24 aa, Mycobacterium
ILASICFPSFPGFAGRRFATDDPD

SEQ ID NO: 768574 - protein, 24 aa, Mycobacterium
ILATEILDPLGFRWTNFGVAKGDV

SEQ ID NO: 768575 - protein, 25 aa, Mycobacterium
ILATEILDPLGFRWTNYGVAPEDVP

SEQ ID NO: 768576 - protein, 18 aa, Mycobacterium
ILAVQGWAQHHELQLRAV

SEQ ID NO: 768577 - protein, 18 aa, Mycobacterium
ILCARCTRFSNQIAGDPF

SEQ ID NO: 768578 - protein, 17 aa, Mycobacterium
ILCDLYALSVIEDDKAW

SEQ ID NO: 768579 - protein, 20 aa, Mycobacterium
ILDALRWLGLDWDEGPEVGG

SEQ ID NO: 768580 - protein, 17 aa, Mycobacterium
ILDCLRPVLDALGLDEN

SEQ ID NO: 768581 - protein, 18 aa, Mycobacterium
ILDGKRATTHWLAADLFR

SEQ ID NO: 768582 - protein, 19 aa, Mycobacterium
ILDGKRATTHWLAAELLTA

SEQ ID NO: 768583 - protein, 22 aa, Mycobacterium
ILDLRIARLTGRVAVIRVGGAT

SEQ ID NO: 768584 - protein, 18 aa, Mycobacterium
ILDYLRLAIAHVQRETDP

SEQ ID NO: 768585 - protein, 17 aa, Mycobacterium
ILEEARVPFLKDAFAAD

SEQ ID NO: 768586 - protein, 17 aa, Mycobacterium
ILENRLQLVTLIATNIF

SEQ ID NO: 768587 - protein, 18 aa, Mycobacterium
ILEPLGLSQEEPHGTQAR

SEQ ID NO: 768588 - protein, 18 aa, Mycobacterium
ILEYHWGPDWVVYDARGT

SEQ ID NO: 768589 - protein, 17 aa, Mycobacterium
ILFEVIRGGGLDPSSGV

SEQ ID NO: 768590 - protein, 18 aa, Mycobacterium
ILFLQGLMFVVGSTDEEA

SEQ ID NO: 768591 - protein, 17 aa, Mycobacterium
ILFRRLAAFAGDFDLDA

SEQ ID NO: 768592 - protein, 17 aa, Mycobacterium
ILGAAVFGVGGDEAIHC

SEQ ID NO: 768593 - protein, 21 aa, Mycobacterium
ILGAYRFSDFRSEKTAPKGPG

SEQ ID NO: 768594 - protein, 18 aa, Mycobacterium
ILGLLPHKQRVAIQTNNI

SEQ ID NO: 768595 - protein, 17 aa, Mycobacterium
ILGRPRAGLSYETLLAT

SEQ ID NO: 768596 - protein, 24 aa, Mycobacterium
ILGTEILDPLGFRWTNFGVAEKDV

SEQ ID NO: 768597 - protein, 22 aa, Mycobacterium
ILHDLYQRWPFFRSVLSNLAQV

SEQ ID NO: 768598 - protein, 18 aa, Mycobacterium
ILHERGWAAPAWPVEHGG

SEQ ID NO: 768599 - protein, 17 aa, Mycobacterium
ILHKHGLAVPNWPVEWG

SEQ ID NO: 768600 - protein, 19 aa, Mycobacterium
ILHMAKLSAALAKQAQYIA

SEQ ID NO: 768601 - protein, 18 aa, Mycobacterium
ILIPALVGHGGWERLQRF

SEQ ID NO: 768602 - protein, 20 aa, Mycobacterium
ILKFRGHRVLHRMITEEPGL

SEQ ID NO: 768603 - protein, 17 aa, Mycobacterium
ILKGWIDRVFVKGFAYG

SEQ ID NO: 768604 - protein, 17 aa, Mycobacterium
ILLEDLNIAWAQHRSGQ

SEQ ID NO: 768605 - protein, 19 aa, Mycobacterium
ILNNLCRYGLWDVSFESRV

SEQ ID NO: 768606 - protein, 21 aa, Mycobacterium
ILNRWPEWDIDYDTAQLASTS

SEQ ID NO: 768607 - protein, 21 aa, Mycobacterium
ILPAARPGALFIDSSTISVDD

SEQ ID NO: 768608 - protein, 18 aa, Mycobacterium
ILPALGYLHSLGLVYNDL

SEQ ID NO: 768609 - protein, 18 aa, Mycobacterium
ILPLMWRMDAIYAARKSR

SEQ ID NO: 768610 - protein, 18 aa, Mycobacterium
ILPLMWRMDAIYERRKSW

SEQ ID NO: 768611 - protein, 19 aa, Mycobacterium
ILPRLATYPRIRIWIAGCA

SEQ ID NO: 768612 - protein, 18 aa, Mycobacterium
ILQKAAFYWACRRWPQRM

SEQ ID NO: 768613 - protein, 19 aa, Mycobacterium
ILQRLVDWVAFTPLQNATG

SEQ ID NO: 768614 - protein, 23 aa, Mycobacterium
ILRAAAQHWIAWMTQKQELAQSL

SEQ ID NO: 768615 - protein, 24 aa, Mycobacterium
ILRAEGLRWIDWVAGETTYSPLPA

SEQ ID NO: 768616 - protein, 19 aa, Mycobacterium
ILRDGWRSVKRVPLAQALK

SEQ ID NO: 768617 - protein, 18 aa, Mycobacterium
ILRFSSRGPVGLRRQVRT

SEQ ID NO: 768618 - protein, 21 aa, Mycobacterium
ILRGPGPAPLRAAATAWATLS

SEQ ID NO: 768619 - protein, 17 aa, Mycobacterium
ILRKPRAGLSYETLLET

SEQ ID NO: 768620 - protein, 17 aa, Mycobacterium
ILRTALIRGAFDYQGQK

SEQ ID NO: 768621 - protein, 18 aa, Mycobacterium
ILRVAVWELLHAEDVPEP

SEQ ID NO: 768622 - protein, 17 aa, Mycobacterium
ILRVAVWELLYADDVPE

SEQ ID NO: 768623 - protein, 20 aa, Mycobacterium
ILRYASPVIHFRRTVTRDGV

SEQ ID NO: 768624 - protein, 18 aa, Mycobacterium
ILSESGWYSALFGMQHET

SEQ ID NO: 768625 - protein, 18 aa, Mycobacterium
ILSGSGWHTALFGMQHES

SEQ ID NO: 768626 - protein, 18 aa, Mycobacterium
ILSRCLEVPFRLDFPSTY

SEQ ID NO: 768627 - protein, 18 aa, Mycobacterium
ILTGAGWYSALFGMQHET

SEQ ID NO: 768628 - protein, 17 aa, Mycobacterium
ILVAKGAGVQGLQNGSI

SEQ ID NO: 768629 - protein, 19 aa, Mycobacterium
ILVELGLDWDRIIELKTAG

SEQ ID NO: 768630 - protein, 19 aa, Mycobacterium
ILWHIMKLYSHHGIRDFVV

SEQ ID NO: 768631 - protein, 17 aa, Mycobacterium
IMCRPDLAPVLLDAVAG

SEQ ID NO: 768632 - protein, 18 aa, Mycobacterium
IMGGTGFLGAHADEVYHL

SEQ ID NO: 768633 - protein, 18 aa, Mycobacterium
IMGLGPIEACKKALERAD

SEQ ID NO: 768634 - protein, 17 aa, Mycobacterium
IMIPARWAGYPPYHDRR

SEQ ID NO: 768635 - protein, 17 aa, Mycobacterium
IMRCIKRTSPARSTTPS

SEQ ID NO: 768636 - protein, 21 aa, Mycobacterium
IMRRIYPLIGRMFARQTAEIS

SEQ ID NO: 768637 - protein, 18 aa, Mycobacterium
IMRYRGYRSLTWALNGLL

SEQ ID NO: 768638 - protein, 18 aa, Mycobacterium
INAEAKAFGLLVGLPGAY

SEQ ID NO: 768639 - protein, 18 aa, Mycobacterium
INAFMGIRLVHNAYPVTA

SEQ ID NO: 768640 - protein, 23 aa, Mycobacterium
INDEFPFLLGHEAAGIVETVGEG

SEQ ID NO: 768641 - protein, 23 aa, Mycobacterium
INDEFPFLLGHEAAGIVETVGQG

SEQ ID NO: 768642 - protein, 22 aa, Mycobacterium
INDEFPFLLGHEAAGTVEAVGE

SEQ ID NO: 768643 - protein, 17 aa, Mycobacterium
INELLNWQVAAAGEDIN

SEQ ID NO: 768644 - protein, 23 aa, Mycobacterium
INEPRFPSFKGIMAAKKKEVAVL

SEQ ID NO: 768645 - protein, 23 aa, Mycobacterium
INEPRFPSFKGIMAAKKKEVTTL

SEQ ID NO: 768646 - protein, 18 aa, Mycobacterium
INERIGLRPTPLTWPVGI

SEQ ID NO: 768647 - protein, 17 aa, Mycobacterium
INERVAVHLGKRSTEEW

SEQ ID NO: 768648 - protein, 25 aa, Mycobacterium
INEVLKGAWAYRGWVMSDWGATPSW

SEQ ID NO: 768649 - protein, 25 aa, Mycobacterium
INEVLKGAWGYRGWVMSDWGGTPGW

SEQ ID NO: 768650 - protein, 25 aa, Mycobacterium
INFAWAEARYFLPPLPPLPGLALQT

SEQ ID NO: 768651 - protein, 18 aa, Mycobacterium
INGFLVMLNDDFPETCGG

SEQ ID NO: 768652 - protein, 23 aa, Mycobacterium
INGHVRAGGFGLVGACDIAVAGP

SEQ ID NO: 768653 - protein, 23 aa, Mycobacterium
INGHVRAGGFGLVGACDIVVAGP

SEQ ID NO: 768654 - protein, 23 aa, Mycobacterium
INGKELWGARAAFDFLDAGEDRE

SEQ ID NO: 768655 - protein, 21 aa, Mycobacterium
INGRRALSFLIYKNDPTACAI

SEQ ID NO: 768656 - protein, 17 aa, Mycobacterium
INISGPEPLSWRAASIA

SEQ ID NO: 768657 - protein, 19 aa, Mycobacterium
INPWALVGHQSYWDSIFFK

SEQ ID NO: 768658 - protein, 28 aa, Mycobacterium
INRGRYAPRSGWRKAVHRSTGGRVNPGD

SEQ ID NO: 768659 - protein, 17 aa, Mycobacterium
INRHVFESLAFNARIAL

SEQ ID NO: 768660 - protein, 21 aa, Mycobacterium
INRYPRVCGMTGTALAAGEQL

SEQ ID NO: 768661 - protein, 24 aa, Mycobacterium
INSARLTIGAGLGPMLEAANAWQG

SEQ ID NO: 768662 - protein, 21 aa, Mycobacterium
INSGFTRRRVALLEPKIREIV

SEQ ID NO: 768663 - protein, 17 aa, Mycobacterium
INSRPKPLAAYAFTESK

SEQ ID NO: 768664 - protein, 23 aa, Mycobacterium
INYLRCIGCGFCIEACPTRALTM

SEQ ID NO: 768665 - protein, 17 aa, Mycobacterium
IPAAPGFGNSTTNPSSG

SEQ ID NO: 768666 - protein, 17 aa, Mycobacterium
IPAAPGFGNTTAGPSSG

SEQ ID NO: 768667 - protein, 25 aa, Mycobacterium
IPACGKCPPCMRGYRSLCDRGAILL

SEQ ID NO: 768668 - protein, 18 aa, Mycobacterium
IPAGWSFAAAASIPVAFL

SEQ ID NO: 768669 - protein, 20 aa, Mycobacterium
IPALFRVLFRGGWRGTVAEV

SEQ ID NO: 768670 - protein, 17 aa, Mycobacterium
IPALKAFGAIPVADKRI

SEQ ID NO: 768671 - protein, 21 aa, Mycobacterium
IPAQFAAPIASPFSPQTQFAP

SEQ ID NO: 768672 - protein, 19 aa, Mycobacterium
IPARDRFQIITAHDAGDII

SEQ ID NO: 768673 - protein, 17 aa, Mycobacterium
IPARIAIERVDMAEPKP

SEQ ID NO: 768674 - protein, 24 aa, Mycobacterium
IPARVETWAGLVFVNLDLDAMPLI

SEQ ID NO: 768675 - protein, 19 aa, Mycobacterium
IPATVGDIAKRVFLGKPLI

SEQ ID NO: 768676 - protein, 18 aa, Mycobacterium
IPAWKIAPALVYGNAVLW

SEQ ID NO: 768677 - protein, 17 aa, Mycobacterium
IPCQLPWLLDPSAGAQL

SEQ ID NO: 768678 - protein, 22 aa, Mycobacterium
IPDAARYSVRFGKPLVLPATAG

SEQ ID NO: 768679 - protein, 21 aa, Mycobacterium
IPDAYCTTVFLAILDTKSGIL

SEQ ID NO: 768680 - protein, 25 aa, Mycobacterium
IPDEKFRYGFAIAPELVRTVLRDGE

SEQ ID NO: 768681 - protein, 21 aa, Mycobacterium
IPDIRRFGATYANYVGKPLSY

SEQ ID NO: 768682 - protein, 20 aa, Mycobacterium
IPDYPNFFLVLGPYGYVFGP

SEQ ID NO: 768683 - protein, 19 aa, Mycobacterium
IPEALPIVYTPTVGEACQR

SEQ ID NO: 768684 - protein, 18 aa, Mycobacterium
IPEDLAFAESRIRPSTIA

SEQ ID NO: 768685 - protein, 27 aa, Mycobacterium
IPEIPQWSSGEWTDWKWNTMLIEGSNC

SEQ ID NO: 768686 - protein, 20 aa, Mycobacterium
IPELQRRGLYRGGYESQSLR

SEQ ID NO: 768687 - protein, 18 aa, Mycobacterium
IPEPGQVIALGFNYPTHS

SEQ ID NO: 768688 - protein, 18 aa, Mycobacterium
IPERWAFIAEVPRTSVGK

SEQ ID NO: 768689 - protein, 23 aa, Mycobacterium
IPFFTDGVPPFFLTPGLDVERTE

SEQ ID NO: 768690 - protein, 20 aa, Mycobacterium
IPGLLTWRGLARVMSESPAR

SEQ ID NO: 768691 - protein, 19 aa, Mycobacterium
IPGMRAKLFDAARLAAEAI

SEQ ID NO: 768692 - protein, 20 aa, Mycobacterium
IPGPLKWDLTLGVATDTRES

SEQ ID NO: 768693 - protein, 21 aa, Mycobacterium
IPGPLKWDLTMGVATDTRESL

SEQ ID NO: 768694 - protein, 20 aa, Mycobacterium
IPGPRIYPAGGFISQSGGHG

SEQ ID NO: 768695 - protein, 22 aa, Mycobacterium
IPGRARISAALAHIDKAAFTRA

SEQ ID NO: 768696 - protein, 22 aa, Mycobacterium
IPGYKIAAVFGEVFGLTVRSRH

SEQ ID NO: 768697 - protein, 18 aa, Mycobacterium
IPHTFRIAVSATRPPFVL

SEQ ID NO: 768698 - protein, 18 aa, Mycobacterium
IPIAEIWGMSELSCVATA

SEQ ID NO: 768699 - protein, 18 aa, Mycobacterium
IPICEGYGMTECTCAGTI

SEQ ID NO: 768700 - protein, 18 aa, Mycobacterium
IPIIDIAAAPGFGNSTTT

SEQ ID NO: 768701 - protein, 20 aa, Mycobacterium
IPILCREALEAAAWDAYASK

SEQ ID NO: 768702 - protein, 18 aa, Mycobacterium
IPILDLPTAPGFGNATDS

SEQ ID NO: 768703 - protein, 19 aa, Mycobacterium
IPINLPLSVPLHIPVEGRT

SEQ ID NO: 768704 - protein, 20 aa, Mycobacterium
IPIQSPGPWRRSGAGQPAGT

SEQ ID NO: 768705 - protein, 22 aa, Mycobacterium
IPISRIPIVLSLGSDSTSLNTA

SEQ ID NO: 768706 - protein, 17 aa, Mycobacterium
IPIVMFVDVPGFLPGTD

SEQ ID NO: 768707 - protein, 17 aa, Mycobacterium
IPKAGGVEAILRLDEGP

SEQ ID NO: 768708 - protein, 19 aa, Mycobacterium
IPKAGGVEAIMRLDEGPRG

SEQ ID NO: 768709 - protein, 20 aa, Mycobacterium
IPLGIYCRASLAPYMDAERL

SEQ ID NO: 768710 - protein, 17 aa, Mycobacterium
IPLNLVLVKGVQILGFA

SEQ ID NO: 768711 - protein, 18 aa, Mycobacterium
IPLRVKAAAVGLAADEYH

SEQ ID NO: 768712 - protein, 19 aa, Mycobacterium
IPLRVKAGAVGLAADEYHA

SEQ ID NO: 768713 - protein, 19 aa, Mycobacterium
IPLRVKAGAVGLAADEYRA

SEQ ID NO: 768714 - protein, 21 aa, Mycobacterium
IPLRVKAGAVGLLADEYRAQD

SEQ ID NO: 768715 - protein, 17 aa, Mycobacterium
IPLSFAQNRLWFIDQFQ

SEQ ID NO: 768716 - protein, 18 aa, Mycobacterium
IPLSPAMFHAIGWVSDLL

SEQ ID NO: 768717 - protein, 17 aa, Mycobacterium
IPLWARLAAVAPNLLNT

SEQ ID NO: 768718 - protein, 21 aa, Mycobacterium
IPNAYCTTVFLAILDTETGLL

SEQ ID NO: 768719 - protein, 21 aa, Mycobacterium
IPNAYCTTVFLAVLDTESGVL

SEQ ID NO: 768720 - protein, 18 aa, Mycobacterium
IPNLLAMVISGLQGTNLD

SEQ ID NO: 768721 - protein, 17 aa, Mycobacterium
IPPELVALVGRDDDRGT

SEQ ID NO: 768722 - protein, 17 aa, Mycobacterium
IPPRSVVPIAWDTLRKL

SEQ ID NO: 768723 - protein, 18 aa, Mycobacterium
IPRAARWALKYIPGLQSL

SEQ ID NO: 768724 - protein, 19 aa, Mycobacterium
IPRELRLAVQESLLGLLSE

SEQ ID NO: 768725 - protein, 21 aa, Mycobacterium
IPRGMLRNVCFLASVCGVDPL

SEQ ID NO: 768726 - protein, 23 aa, Mycobacterium
IPRIGCTLPEVFDNARAGDRIFF

SEQ ID NO: 768727 - protein, 17 aa, Mycobacterium
IPRRSVRAFAWVGSHAP

SEQ ID NO: 768728 - protein, 19 aa, Mycobacterium
IPRVVGFKITGERRPGVTA

SEQ ID NO: 768729 - protein, 18 aa, Mycobacterium
IPRYPGDVTPQWLSAALS

SEQ ID NO: 768730 - protein, 20 aa, Mycobacterium
IPSFPDLPGIHVLRNFDESL

SEQ ID NO: 768731 - protein, 18 aa, Mycobacterium
IPSLFGIYPTTDWHERET

SEQ ID NO: 768732 - protein, 20 aa, Mycobacterium
IPSLMIRSGLAWANLADAHG

SEQ ID NO: 768733 - protein, 19 aa, Mycobacterium
IPSPAAGVLTKIVAKEDDT

SEQ ID NO: 768734 - protein, 18 aa, Mycobacterium
IPSPLEWGCFTFGVIQND

SEQ ID NO: 768735 - protein, 19 aa, Mycobacterium
IPSPVAGVLLSISANEDDT

SEQ ID NO: 768736 - protein, 19 aa, Mycobacterium
IPSPVAGVLLSITAEEDDV

SEQ ID NO: 768737 - protein, 21 aa, Mycobacterium
IPSWMARTGFQMMDPLKTAKA

SEQ ID NO: 768738 - protein, 19 aa, Mycobacterium
IPTLMAFKKGKLVFNQAGA

SEQ ID NO: 768739 - protein, 18 aa, Mycobacterium
IPTPLEWACFTFGVIQSE

SEQ ID NO: 768740 - protein, 23 aa, Mycobacterium
IPTPPRLGSVVVEVEHLDKGFNG

SEQ ID NO: 768741 - protein, 18 aa, Mycobacterium
IPTQISIVAEIPRTASGK

SEQ ID NO: 768742 - protein, 22 aa, Mycobacterium
IPVARLRPGFIVQRDAASGLMR

SEQ ID NO: 768743 - protein, 18 aa, Mycobacterium
IPVAYKLVPKDVVPVMVQ

SEQ ID NO: 768744 - protein, 19 aa, Mycobacterium
IPVGLPLILGHEMVGRIIA

SEQ ID NO: 768745 - protein, 17 aa, Mycobacterium
IPVGVAFFFTNSALGRT

SEQ ID NO: 768746 - protein, 18 aa, Mycobacterium
IPVMLRPLVLAKLMDGRT

SEQ ID NO: 768747 - protein, 19 aa, Mycobacterium
IPVPPQWGGYVIAPETVEF

SEQ ID NO: 768748 - protein, 20 aa, Mycobacterium
IPVRRVRAGHAFHTSAMDPM

SEQ ID NO: 768749 - protein, 20 aa, Mycobacterium
IPVYLGCDWDNVPLHLPSTF

SEQ ID NO: 768750 - protein, 20 aa, Mycobacterium
IPVYLGCDWQNVPLHLPSTF

SEQ ID NO: 768751 - protein, 17 aa, Mycobacterium
IPWNFPLLMATWKLAPA

SEQ ID NO: 768752 - protein, 20 aa, Mycobacterium
IPYALLPRRARTVYGSAMQK

SEQ ID NO: 768753 - protein, 19 aa, Mycobacterium
IPYYGRWLWAVARVLIEKH

SEQ ID NO: 768754 - protein, 18 aa, Mycobacterium
IQAIPIVGPIVWEAIDGI

SEQ ID NO: 768755 - protein, 20 aa, Mycobacterium
IQDWPLMRWRMREYRHGRWA

SEQ ID NO: 768756 - protein, 17 aa, Mycobacterium
IQEEWGISDEVMRDLVN

SEQ ID NO: 768757 - protein, 23 aa, Mycobacterium
IQEIRPGKPPSIGGLPAVNDGDV

SEQ ID NO: 768758 - protein, 18 aa, Mycobacterium
IQERPRFTTALQKLGTFG

SEQ ID NO: 768759 - protein, 17 aa, Mycobacterium
IQIPGAPAFSVGYVQDA

SEQ ID NO: 768760 - protein, 17 aa, Mycobacterium
IQKEWEWRVSRGESLKN

SEQ ID NO: 768761 - protein, 19 aa, Mycobacterium
IQLARLVWRAQGLKITVTG

SEQ ID NO: 768762 - protein, 19 aa, Mycobacterium
IQLARLVWRIQGLKFTVTG

SEQ ID NO: 768763 - protein, 17 aa, Mycobacterium
IQLYVKRVFIMGDCDQL

SEQ ID NO: 768764 - protein, 23 aa, Mycobacterium
IQLYYRRVRGWAMVFGEPAVALD

SEQ ID NO: 768765 - protein, 18 aa, Mycobacterium
IQMMWAMRGLGMWSDARG

SEQ ID NO: 768766 - protein, 18 aa, Mycobacterium
IQMPIAVDPEWDRPGRAV

SEQ ID NO: 768767 - protein, 17 aa, Mycobacterium
IQNMWLAARAEGLGMGW

SEQ ID NO: 768768 - protein, 24 aa, Mycobacterium
IQPDLRVLVDLGYGYGYADVPTPA

SEQ ID NO: 768769 - protein, 17 aa, Mycobacterium
IQRRPRMAGVRADYDKV

SEQ ID NO: 768770 - protein, 18 aa, Mycobacterium
IQSILLPTLLDWLADTPD

SEQ ID NO: 768771 - protein, 17 aa, Mycobacterium
IQTAPKLDIGWFVQGGC

SEQ ID NO: 768772 - protein, 26 aa, Mycobacterium
IQTGLGRLGQWWGVDRERVIPDILLS

SEQ ID NO: 768773 - protein, 18 aa, Mycobacterium
IQTRIGLKPTPLTWPVGI

SEQ ID NO: 768774 - protein, 18 aa, Mycobacterium
IRAAIAVRHGVTIRDLLL

SEQ ID NO: 768775 - protein, 20 aa, Mycobacterium
IRAALPLLRAADWARVVTLS

SEQ ID NO: 768776 - protein, 17 aa, Mycobacterium
IRAAVAAAENWGTYVTV

SEQ ID NO: 768777 - protein, 18 aa, Mycobacterium
IRAAWLWSGRRAIIAGRA

SEQ ID NO: 768778 - protein, 18 aa, Mycobacterium
IRACPRFAQRLRRYPFDL

SEQ ID NO: 768779 - protein, 23 aa, Mycobacterium
IRACPRFGQRLRLHPLDLGAPEW

SEQ ID NO: 768780 - protein, 18 aa, Mycobacterium
IRAFTEIEGLPAPEVFHM

SEQ ID NO: 768781 - protein, 19 aa, Mycobacterium
IRAGAGLVLAGLVADGETE

SEQ ID NO: 768782 - protein, 19 aa, Mycobacterium
IRAGALWVAANVDLTLPSE

SEQ ID NO: 768783 - protein, 20 aa, Mycobacterium
IRAGCVWINDHIPIISEMPH

SEQ ID NO: 768784 - protein, 17 aa, Mycobacterium
IRAGDPAGIGFYIDHHR

SEQ ID NO: 768785 - protein, 18 aa, Mycobacterium
IRAGETIALIALASGLEI

SEQ ID NO: 768786 - protein, 17 aa, Mycobacterium
IRAGRQLWCQLFSEPGA

SEQ ID NO: 768787 - protein, 19 aa, Mycobacterium
IRAGYRWPADVPERVLTDE

SEQ ID NO: 768788 - protein, 19 aa, Mycobacterium
IRALYLFKRTLWWPYSVAM

SEQ ID NO: 768789 - protein, 18 aa, Mycobacterium
IRAPWSLSKPKRRSSPSS

SEQ ID NO: 768790 - protein, 17 aa, Mycobacterium
IRARAPLRISFAGGGTD

SEQ ID NO: 768791 - protein, 18 aa, Mycobacterium
IRARSAGLLTAWVATGFD

SEQ ID NO: 768792 - protein, 21 aa, Mycobacterium
IRASLPLLRSADWARIVTLSA

SEQ ID NO: 768793 - protein, 17 aa, Mycobacterium
IRDAFVVGEGYAELMTA

SEQ ID NO: 768794 - protein, 21 aa, Mycobacterium
IRELLARLGYRFTPKQIPETV

SEQ ID NO: 768795 - protein, 22 aa, Mycobacterium
IRELRARLGLDSGYLSRLLRAL

SEQ ID NO: 768796 - protein, 17 aa, Mycobacterium
IREQLAWCYGRVEIMRC

SEQ ID NO: 768797 - protein, 23 aa, Mycobacterium
IRETGRASGFFAQFDMLILHTVG

SEQ ID NO: 768798 - protein, 22 aa, Mycobacterium
IREVCLRDGLQIEQPIPLSAKL

SEQ ID NO: 768799 - protein, 20 aa, Mycobacterium
IRFCDAFNIPLVFVVDTPGF

SEQ ID NO: 768800 - protein, 29 aa, Mycobacterium
IRFHVPRQWPPWRLVAGIPTTTIAQTIAD

SEQ ID NO: 768801 - protein, 17 aa, Mycobacterium
IRFLPALSKVLFRKDFP

SEQ ID NO: 768802 - protein, 18 aa, Mycobacterium
IRGLGVFWAIELVANPES

SEQ ID NO: 768803 - protein, 18 aa, Mycobacterium
IRGPGIVQHAARPHPPGQ

SEQ ID NO: 768804 - protein, 19 aa, Mycobacterium
IRGVEWLGVVHRWSRSPQA

SEQ ID NO: 768805 - protein, 17 aa, Mycobacterium
IRIAEGWAHGPEIDKGA

SEQ ID NO: 768806 - protein, 18 aa, Mycobacterium
IRIGAWFLENGHRALLAL

SEQ ID NO: 768807 - protein, 18 aa, Mycobacterium
IRIPAIWCGLFGVKPQRD

SEQ ID NO: 768808 - protein, 20 aa, Mycobacterium
IRIPATWCGVFGLKPQRDRV

SEQ ID NO: 768809 - protein, 21 aa, Mycobacterium
IRIPKPRFVLMPTPIWDQIFK

SEQ ID NO: 768810 - protein, 17 aa, Mycobacterium
IRIPLGLAHRPDPANVA

SEQ ID NO: 768811 - protein, 17 aa, Mycobacterium
IRIPWADGSLVALPGQP

SEQ ID NO: 768812 - protein, 17 aa, Mycobacterium
IRKELANVLALRELNRL

SEQ ID NO: 768813 - protein, 18 aa, Mycobacterium
IRKLFGVMFQDGALFGSM

SEQ ID NO: 768814 - protein, 17 aa, Mycobacterium
IRKRRRGILGFDDLLTR

SEQ ID NO: 768815 - protein, 20 aa, Mycobacterium
IRLAARPELIRLAGNGELKV

SEQ ID NO: 768816 - protein, 18 aa, Mycobacterium
IRLAGLVAHQEVLFGTLG

SEQ ID NO: 768817 - protein, 20 aa, Mycobacterium
IRLAGRRAFEIAGLGTDDVE

SEQ ID NO: 768818 - protein, 19 aa, Mycobacterium
IRLFLAVRGPLGFTTGFND

SEQ ID NO: 768819 - protein, 17 aa, Mycobacterium
IRLLLGLLPAMRESGRG

SEQ ID NO: 768820 - protein, 17 aa, Mycobacterium
IRLPIDVMLDANTVLTK

SEQ ID NO: 768821 - protein, 17 aa, Mycobacterium
IRLPVHLVEQVNKLARI

SEQ ID NO: 768822 - protein, 17 aa, Mycobacterium
IRLRPATELTRMTRYRG

SEQ ID NO: 768823 - protein, 22 aa, Mycobacterium
IRLSFLDIPAAPGFGNSTTNPS

SEQ ID NO: 768824 - protein, 17 aa, Mycobacterium
IRLWLPYDEVLPRRQPP

SEQ ID NO: 768825 - protein, 21 aa, Mycobacterium
IRMLIKYKNLRLMTSAWSPKR

SEQ ID NO: 768826 - protein, 24 aa, Mycobacterium
IRMPEDIIRCAFNRSYSITAVIDT

SEQ ID NO: 768827 - protein, 19 aa, Mycobacterium
IRNGWYWTGDLGYLDAAGF

SEQ ID NO: 768828 - protein, 30 aa, Mycobacterium
IRNLFNIPFNFMLAAGFEWGIALQHLELRK

SEQ ID NO: 768829 - protein, 17 aa, Mycobacterium
IRPAFTYQRSLDVLTAA

SEQ ID NO: 768830 - protein, 25 aa, Mycobacterium
IRPALRGRLALAWRLDGPVGPAARA

SEQ ID NO: 768831 - protein, 19 aa, Mycobacterium
IRPAPPIPQPVLGRPPSAP

SEQ ID NO: 768832 - protein, 18 aa, Mycobacterium
IRPAQAISIRPGDLLVMS

SEQ ID NO: 768833 - protein, 22 aa, Mycobacterium
IRPELVVPLVIFLASRACTFSH

SEQ ID NO: 768834 - protein, 19 aa, Mycobacterium
IRPGPDFPPFAVIWGDSNL

SEQ ID NO: 768835 - protein, 19 aa, Mycobacterium
IRQIFFRFGEVIVEVVGAP

SEQ ID NO: 768836 - protein, 25 aa, Mycobacterium
IRRCRRCDPCGWLLGPDHTPIDPAV

SEQ ID NO: 768837 - protein, 24 aa, Mycobacterium
IRRFEFPNLKALNFVVAGFLGDGV

SEQ ID NO: 768838 - protein, 17 aa, Mycobacterium
IRRGRGFSYEKPDGQAV

SEQ ID NO: 768839 - protein, 18 aa, Mycobacterium
IRRGVDGWVFFDCTDSPD

SEQ ID NO: 768840 - protein, 20 aa, Mycobacterium
IRRIITWLGIGDEFAAISRP

SEQ ID NO: 768841 - protein, 25 aa, Mycobacterium
IRRLAIECLRRLVAVAPQVFSDFEI

SEQ ID NO: 768842 - protein, 22 aa, Mycobacterium
IRRLERDLGIVIVQRGHRFEGF

SEQ ID NO: 768843 - protein, 19 aa, Mycobacterium
IRRLWPDFRAVERAYFEAT

SEQ ID NO: 768844 - protein, 18 aa, Mycobacterium
IRRRFSIDSIKGRDGVSL

SEQ ID NO: 768845 - protein, 17 aa, Mycobacterium
IRRRWLQGILHTRAQEL

SEQ ID NO: 768846 - protein, 21 aa, Mycobacterium
IRSATEWFARMLFSLFTTPSP

SEQ ID NO: 768847 - protein, 21 aa, Mycobacterium
IRSDAAWCFRRSREAIEVIRQ

SEQ ID NO: 768848 - protein, 18 aa, Mycobacterium
IRSELAWMSALRAETSVV

SEQ ID NO: 768849 - protein, 18 aa, Mycobacterium
IRSGDALIIRTGFMAARR

SEQ ID NO: 768850 - protein, 22 aa, Mycobacterium
IRSGQPWSWDIGFMLGTGLQGK

SEQ ID NO: 768851 - protein, 24 aa, Mycobacterium
IRSIGLRLGVPWYAYDTITFTGEV

SEQ ID NO: 768852 - protein, 20 aa, Mycobacterium
IRSITWCRRRTIQVGRIATR

SEQ ID NO: 768853 - protein, 22 aa, Mycobacterium
IRSLRLPLLILHSPTDNTVGIE

SEQ ID NO: 768854 - protein, 26 aa, Mycobacterium
IRSPATFAVRWLIPRFASFHRLHPDI

SEQ ID NO: 768855 - protein, 17 aa, Mycobacterium
IRSRAEWARLYQERQLA

SEQ ID NO: 768856 - protein, 21 aa, Mycobacterium
IRSVSWLPLYHDMGLIMIMFP

SEQ ID NO: 768857 - protein, 17 aa, Mycobacterium
IRTALTIAHEIAEHDPL

SEQ ID NO: 768858 - protein, 17 aa, Mycobacterium
IRTHYPLELEAEVGVIR

SEQ ID NO: 768859 - protein, 19 aa, Mycobacterium
IRTLFGVLFQDGALFGSMN

SEQ ID NO: 768860 - protein, 17 aa, Mycobacterium
IRVAIELRRATPGLPVV

SEQ ID NO: 768861 - protein, 18 aa, Mycobacterium
IRVGLAYGQVLSRFGDLY

SEQ ID NO: 768862 - protein, 18 aa, Mycobacterium
IRVKEMWESVKIVEQCLD

SEQ ID NO: 768863 - protein, 17 aa, Mycobacterium
IRVLRVALYPTKIVLDF

SEQ ID NO: 768864 - protein, 18 aa, Mycobacterium
IRVLRYGSAPGLDATLLD

SEQ ID NO: 768865 - protein, 18 aa, Mycobacterium
IRVNEMWESIKIVEQCLD

SEQ ID NO: 768866 - protein, 20 aa, Mycobacterium
IRWALDLLRKRFAKVIWIPG

SEQ ID NO: 768867 - protein, 20 aa, Mycobacterium
IRWALDLLRKRFAKVIWVPG

SEQ ID NO: 768868 - protein, 18 aa, Mycobacterium
IRWGHGLADMAPRPDGVT

SEQ ID NO: 768869 - protein, 19 aa, Mycobacterium
IRWSLDLLRRRFAKVIWVP

SEQ ID NO: 768870 - protein, 24 aa, Mycobacterium
IRYEAGDALGVWPRNSDRLVDEWL

SEQ ID NO: 768871 - protein, 26 aa, Mycobacterium
IRYFKLEKWMAWQRYLLRGGDMDIDT

SEQ ID NO: 768872 - protein, 17 aa, Mycobacterium
IRYLPALGKVVFRRDFP

SEQ ID NO: 768873 - protein, 17 aa, Mycobacterium
IRYSMWLGEDGWIVDRF

SEQ ID NO: 768874 - protein, 19 aa, Mycobacterium
ISAAVAALFTGHAQAYQWL

SEQ ID NO: 768875 - protein, 19 aa, Mycobacterium
ISAERAFDILVWRSQESNL

SEQ ID NO: 768876 - protein, 20 aa, Mycobacterium
ISAFNFPVAVWSWNTAIALV

SEQ ID NO: 768877 - protein, 18 aa, Mycobacterium
ISAPGVTVAHGWASELAE

SEQ ID NO: 768878 - protein, 20 aa, Mycobacterium
ISARSEWAPEFAIYDLPSAE

SEQ ID NO: 768879 - protein, 23 aa, Mycobacterium
ISARVAEFHAQFERVLAAGAQAY

SEQ ID NO: 768880 - protein, 18 aa, Mycobacterium
ISASLGIQWYRVTFDAEY

SEQ ID NO: 768881 - protein, 23 aa, Mycobacterium
ISAWAVQQGRAWYRHGSALTPAP

SEQ ID NO: 768882 - protein, 21 aa, Mycobacterium
ISCGHCFMCDMKLYTQCETTQ

SEQ ID NO: 768883 - protein, 21 aa, Mycobacterium
ISCGHCFMCDQKLYTQCETTQ

SEQ ID NO: 768884 - protein, 21 aa, Mycobacterium
ISCGPYRFVYRKRFHKRAETH

SEQ ID NO: 768885 - protein, 17 aa, Mycobacterium
ISELWLRLLEAYRDSFF

SEQ ID NO: 768886 - protein, 18 aa, Mycobacterium
ISEYRPGAAQSRVLTAAN

SEQ ID NO: 768887 - protein, 20 aa, Mycobacterium
ISFAGAEAFRDDANGSGKDA

SEQ ID NO: 768888 - protein, 24 aa, Mycobacterium
ISGDMGNGFAWRGDQQGQVSASYV

SEQ ID NO: 768889 - protein, 17 aa, Mycobacterium
ISGEIGLPVIDGVTAAV

SEQ ID NO: 768890 - protein, 17 aa, Mycobacterium
ISGELIVAVAMTEPGAG

SEQ ID NO: 768891 - protein, 18 aa, Mycobacterium
ISGLQMLLHQAFAQVEQF

SEQ ID NO: 768892 - protein, 21 aa, Mycobacterium
ISGPEPLSWRAASIAPESACT

SEQ ID NO: 768893 - protein, 18 aa, Mycobacterium
ISGPIRWASNVFPDALMV

SEQ ID NO: 768894 - protein, 17 aa, Mycobacterium
ISIGFPFGLSVIFPPNL

SEQ ID NO: 768895 - protein, 17 aa, Mycobacterium
ISINGPRAWDLDLAIDF

SEQ ID NO: 768896 - protein, 19 aa, Mycobacterium
ISKEMSVPAFVVFTDNTLI

SEQ ID NO: 768897 - protein, 17 aa, Mycobacterium
ISKRTVLPMDGSGPALD

SEQ ID NO: 768898 - protein, 17 aa, Mycobacterium
ISLDVEYFGVMWPNNSA

SEQ ID NO: 768899 - protein, 17 aa, Mycobacterium
ISLDVFVDWLIRAGHPI

SEQ ID NO: 768900 - protein, 18 aa, Mycobacterium
ISLLRHGRLWGLIACHHY

SEQ ID NO: 768901 - protein, 18 aa, Mycobacterium
ISLLRQGRLWGLIACHHY

SEQ ID NO: 768902 - protein, 17 aa, Mycobacterium
ISLPRWVEICSTTPARM

SEQ ID NO: 768903 - protein, 18 aa, Mycobacterium
ISMSWRRCGVFPPSSAAS

SEQ ID NO: 768904 - protein, 23 aa, Mycobacterium
ISPLQARCGWAIGWKKDAFFGRD

SEQ ID NO: 768905 - protein, 23 aa, Mycobacterium
ISPLQARCGWAIGWKKDAFFGRE

SEQ ID NO: 768906 - protein, 23 aa, Mycobacterium
ISPLQARCGWAIGWKKDAFWGRD

SEQ ID NO: 768907 - protein, 17 aa, Mycobacterium
ISPNLWAGYGLVRGGAG

SEQ ID NO: 768908 - protein, 19 aa, Mycobacterium
ISPWGTWEWLGPAVRAAVL

SEQ ID NO: 768909 - protein, 21 aa, Mycobacterium
ISPWGTWEWMAPAAAGAVLPA

SEQ ID NO: 768910 - protein, 18 aa, Mycobacterium
ISRIGRRTGIPGLELTME

SEQ ID NO: 768911 - protein, 17 aa, Mycobacterium
ISRIVTWLFVNAAGAET

SEQ ID NO: 768912 - protein, 23 aa, Mycobacterium
ISRLPVVPSMLEWLHVARTSVVM

SEQ ID NO: 768913 - protein, 21 aa, Mycobacterium
ISRQLWWGHRIPIWHGPDGET

SEQ ID NO: 768914 - protein, 20 aa, Mycobacterium
ISRQLWWGHRIPIWHGPGGE

SEQ ID NO: 768915 - protein, 20 aa, Mycobacterium
ISRQLWWGHRIPIWHGPNGE

SEQ ID NO: 768916 - protein, 25 aa, Mycobacterium
ISRQLWWGHRIPIWYGPDGEKVCVG

SEQ ID NO: 768917 - protein, 25 aa, Mycobacterium
ISRQLWWGHRIPIWYGPGGEQVCVG

SEQ ID NO: 768918 - protein, 25 aa, Mycobacterium
ISRQLWWGHRIPIWYGPNGEKVCVG

SEQ ID NO: 768919 - protein, 23 aa, Mycobacterium
ISRVPLMPAMLEWLHTARTSMVM

SEQ ID NO: 768920 - protein, 17 aa, Mycobacterium
ISRWAAYWPPGATEAAF

SEQ ID NO: 768921 - protein, 18 aa, Mycobacterium
ISSARTAAQFGIDPRVAM

SEQ ID NO: 768922 - protein, 20 aa, Mycobacterium
ISSARTAAQFGIEPRVAMLS

SEQ ID NO: 768923 - protein, 17 aa, Mycobacterium
ISSIKWAPNETGIIPTS

SEQ ID NO: 768924 - protein, 17 aa, Mycobacterium
ISSPADWRRWWPDLQLN

SEQ ID NO: 768925 - protein, 18 aa, Mycobacterium
ISSVGALGFRIGDLSNPK

SEQ ID NO: 768926 - protein, 20 aa, Mycobacterium
ISTAIAALFERHALAYREAY

SEQ ID NO: 768927 - protein, 20 aa, Mycobacterium
ISTGIAALFGAFGSDYQAIS

SEQ ID NO: 768928 - protein, 18 aa, Mycobacterium
ISTPRWTELRARIRDYLG

SEQ ID NO: 768929 - protein, 19 aa, Mycobacterium
ISTRFEAVIVEGQKAGTIR

SEQ ID NO: 768930 - protein, 23 aa, Mycobacterium
ISTTARMLIQFGFIERLAVAGDR

SEQ ID NO: 768931 - protein, 21 aa, Mycobacterium
ISVNVTLIFSVERYRLVMDAY

SEQ ID NO: 768932 - protein, 18 aa, Mycobacterium
ISVPFAIDVLHWDENVLV

SEQ ID NO: 768933 - protein, 17 aa, Mycobacterium
ISWGRPVFCAPKMFAIY

SEQ ID NO: 768934 - protein, 17 aa, Mycobacterium
ISWILPRLTSWAVALDL

SEQ ID NO: 768935 - protein, 18 aa, Mycobacterium
ISYPYLWRNLTEVVGTVL

SEQ ID NO: 768936 - protein, 24 aa, Mycobacterium
ITADFAAPVHRIWQVYADPRQLEK

SEQ ID NO: 768937 - protein, 20 aa, Mycobacterium
ITAKYADHWNFVLGTPEEFA

SEQ ID NO: 768938 - protein, 17 aa, Mycobacterium
ITARAGIRWLTAYGTTE

SEQ ID NO: 768939 - protein, 17 aa, Mycobacterium
ITARYAQHWNFVGGPPD

SEQ ID NO: 768940 - protein, 17 aa, Mycobacterium
ITATPAWDALRRHHEQI

SEQ ID NO: 768941 - protein, 17 aa, Mycobacterium
ITATPAWDALRRHHERI

SEQ ID NO: 768942 - protein, 17 aa, Mycobacterium
ITATPAWEALRKHHDQI

SEQ ID NO: 768943 - protein, 21 aa, Mycobacterium
ITATPIIRWLRGVESAGGPVD

SEQ ID NO: 768944 - protein, 17 aa, Mycobacterium
ITCDARLATTLPPGLTD

SEQ ID NO: 768945 - protein, 19 aa, Mycobacterium
ITCRPRYPHVMSEGYVSQE

SEQ ID NO: 768946 - protein, 17 aa, Mycobacterium
ITCVGEFHYLHHLPGGT

SEQ ID NO: 768947 - protein, 19 aa, Mycobacterium
ITDRGIIHWADPRAQHPGE

SEQ ID NO: 768948 - protein, 20 aa, Mycobacterium
ITEIIPLDGFDGFDELELAD

SEQ ID NO: 768949 - protein, 19 aa, Mycobacterium
ITEYFLRTVFQDVPHEEAD

SEQ ID NO: 768950 - protein, 20 aa, Mycobacterium
ITFEEWNRFLAVNLTGTFLC

SEQ ID NO: 768951 - protein, 17 aa, Mycobacterium
ITFPGFLKAYVESIDEL

SEQ ID NO: 768952 - protein, 17 aa, Mycobacterium
ITFPQFRTLVILFNEGP

SEQ ID NO: 768953 - protein, 20 aa, Mycobacterium
ITGIPAERVLVIIGNSPARF

SEQ ID NO: 768954 - protein, 17 aa, Mycobacterium
ITGPAVRRGWLRDGPGP

SEQ ID NO: 768955 - protein, 21 aa, Mycobacterium
ITGTFGLPVALTLDAAGSAVT

SEQ ID NO: 768956 - protein, 17 aa, Mycobacterium
ITKEVLNALGITVLAAP

SEQ ID NO: 768957 - protein, 17 aa, Mycobacterium
ITKEVLNALGITVLAEP

SEQ ID NO: 768958 - protein, 17 aa, Mycobacterium
ITKEVLQALGITVLAEE

SEQ ID NO: 768959 - protein, 24 aa, Mycobacterium
ITKPRWFLQWAKTMRPPELRVPNQ

SEQ ID NO: 768960 - protein, 18 aa, Mycobacterium
ITKVWKTPAFFLTHPLGV

SEQ ID NO: 768961 - protein, 17 aa, Mycobacterium
ITLALLHFGEEPRELTA

SEQ ID NO: 768962 - protein, 18 aa, Mycobacterium
ITLGGTMAKYDWTINGEP

SEQ ID NO: 768963 - protein, 18 aa, Mycobacterium
ITLHAALELARRGSGYAV

SEQ ID NO: 768964 - protein, 18 aa, Mycobacterium
ITLHAALELARRGSGYGV

SEQ ID NO: 768965 - protein, 17 aa, Mycobacterium
ITLLFGFSPRFPFPDSY

SEQ ID NO: 768966 - protein, 18 aa, Mycobacterium
ITLWKDYWDMAALAGKAP

SEQ ID NO: 768967 - protein, 17 aa, Mycobacterium
ITLWPGMKIGQLCILRL

SEQ ID NO: 768968 - protein, 18 aa, Mycobacterium
ITNWNEFWSVVTGVYSPQ

SEQ ID NO: 768969 - protein, 24 aa, Mycobacterium
ITPDWRIDVGDTWIGRDPIEFAAQ

SEQ ID NO: 768970 - protein, 19 aa, Mycobacterium
ITPELIKALGAVRRYHDKL

SEQ ID NO: 768971 - protein, 21 aa, Mycobacterium
ITPKSSWPWVRTLLHSVFDQP

SEQ ID NO: 768972 - protein, 23 aa, Mycobacterium
ITPRWLLHLLNWVPVEAGIYRVN

SEQ ID NO: 768973 - protein, 25 aa, Mycobacterium
ITPWNFPLGLAMWKIAPALLAGNTV

SEQ ID NO: 768974 - protein, 24 aa, Mycobacterium
ITQGRAGMQLSLFSRDVIAMSTAI

SEQ ID NO: 768975 - protein, 22 aa, Mycobacterium
ITRARVHLALSWALARAPGGRQ

SEQ ID NO: 768976 - protein, 23 aa, Mycobacterium
ITRYAWGSVWTRPGLDRRSRSMI

SEQ ID NO: 768977 - protein, 22 aa, Mycobacterium
ITSEFPVTLLLVGIGLENIGLF

SEQ ID NO: 768978 - protein, 25 aa, Mycobacterium
ITSGSVCARRCTVGGVGAIAAVAAE

SEQ ID NO: 768979 - protein, 20 aa, Mycobacterium
ITVGLSRGWPLPKSVRYGIA

SEQ ID NO: 768980 - protein, 17 aa, Mycobacterium
IVAAFAFELGKVEMPEI

SEQ ID NO: 768981 - protein, 18 aa, Mycobacterium
IVACLKLGPKDGRIPFVP

SEQ ID NO: 768982 - protein, 24 aa, Mycobacterium
IVADFAAPVERIWQIYADPRQLEK

SEQ ID NO: 768983 - protein, 19 aa, Mycobacterium
IVAERRLWLAVLRAQAELG

SEQ ID NO: 768984 - protein, 22 aa, Mycobacterium
IVAFRPRGRFGVAGVEPEEMES

SEQ ID NO: 768985 - protein, 19 aa, Mycobacterium
IVAGIPVCLCGSSEVEVAR

SEQ ID NO: 768986 - protein, 18 aa, Mycobacterium
IVAICPFVAAYVDKHDDY

SEQ ID NO: 768987 - protein, 23 aa, Mycobacterium
IVALKEAWKAAGRDGDPLIYVLA

SEQ ID NO: 768988 - protein, 24 aa, Mycobacterium
IVALRARAKAAFAEREGVNLTFLP

SEQ ID NO: 768989 - protein, 19 aa, Mycobacterium
IVARGWRSPLQLLFIDGGH

SEQ ID NO: 768990 - protein, 18 aa, Mycobacterium
IVAVCPYVAKYVSRHHDF

SEQ ID NO: 768991 - protein, 18 aa, Mycobacterium
IVCGLDLTRRVAMTPDIL

SEQ ID NO: 768992 - protein, 17 aa, Mycobacterium
IVDARFAIRDNYTELLI

SEQ ID NO: 768993 - protein, 18 aa, Mycobacterium
IVDCPSCGGMLKPDIVYF

SEQ ID NO: 768994 - protein, 26 aa, Mycobacterium
IVDEPFMLPAHIDFAALRVKFDNGTL

SEQ ID NO: 768995 - protein, 24 aa, Mycobacterium
IVDEPFMLPAHIDLAALRVKFDSG

SEQ ID NO: 768996 - protein, 17 aa, Mycobacterium
IVEGLPLHEQELVSRGL

SEQ ID NO: 768997 - protein, 18 aa, Mycobacterium
IVELPRPAGVVLALTPTT

SEQ ID NO: 768998 - protein, 19 aa, Mycobacterium
IVERLVPDFLWISTEHTAR

SEQ ID NO: 768999 - protein, 18 aa, Mycobacterium
IVGIGFKAVHVSAIKFPN

SEQ ID NO: 769000 - protein, 20 aa, Mycobacterium
IVGLRARAKSAFAEREGVNL

SEQ ID NO: 769001 - protein, 21 aa, Mycobacterium
IVGPSWRMARNPARVARGAPD

SEQ ID NO: 769002 - protein, 17 aa, Mycobacterium
IVGSLGIYTKIDFENKE

SEQ ID NO: 769003 - protein, 17 aa, Mycobacterium
IVGSLGIYTKIDFENRE

SEQ ID NO: 769004 - protein, 20 aa, Mycobacterium
IVGVPVVTTWAALTIPVGEP

SEQ ID NO: 769005 - protein, 20 aa, Mycobacterium
IVIAFPYRLVDFWRDHRAPA

SEQ ID NO: 769006 - protein, 19 aa, Mycobacterium
IVKGLRTGTDFEYELQMAQ

SEQ ID NO: 769007 - protein, 17 aa, Mycobacterium
IVKYLAYGWSSLRSRPA

SEQ ID NO: 769008 - protein, 18 aa, Mycobacterium
IVKYLAYGWSSLRSRPAL

SEQ ID NO: 769009 - protein, 18 aa, Mycobacterium
IVLAEGGIGWIPYLIERA

SEQ ID NO: 769010 - protein, 24 aa, Mycobacterium
IVLGALPFDVEWPAALLTPGAVRH

SEQ ID NO: 769011 - protein, 18 aa, Mycobacterium
IVLLDIPAAPGFGNSTSA

SEQ ID NO: 769012 - protein, 17 aa, Mycobacterium
IVLPGMVVPITLDDAAQ

SEQ ID NO: 769013 - protein, 18 aa, Mycobacterium
IVLVTGACRFLGGYLTAR

SEQ ID NO: 769014 - protein, 19 aa, Mycobacterium
IVNHVLWMRAHYAVGPKDV

SEQ ID NO: 769015 - protein, 20 aa, Mycobacterium
IVNNGAFTPALYGFGGNGGN

SEQ ID NO: 769016 - protein, 24 aa, Mycobacterium
IVNPLRLGYRYSSWVTIRVAGRTR

SEQ ID NO: 769017 - protein, 22 aa, Mycobacterium
IVNQLPRKLAMELLLTGEPITA

SEQ ID NO: 769018 - protein, 17 aa, Mycobacterium
IVPGCLDVLFRGEIPAG

SEQ ID NO: 769019 - protein, 18 aa, Mycobacterium
IVPHLNLADGREVIVNRD

SEQ ID NO: 769020 - protein, 17 aa, Mycobacterium
IVPIIPDEARTFGMDSW

SEQ ID NO: 769021 - protein, 17 aa, Mycobacterium
IVPRVIPLASMDIAKGG

SEQ ID NO: 769022 - protein, 24 aa, Mycobacterium
IVPRYRTMRGFKVERRFGWDTHGL

SEQ ID NO: 769023 - protein, 18 aa, Mycobacterium
IVPVCSMVVTVLDKHPEY

SEQ ID NO: 769024 - protein, 18 aa, Mycobacterium
IVRCKDGYVRICVLAKRQ

SEQ ID NO: 769025 - protein, 20 aa, Mycobacterium
IVRPRWLWKFGKTLRPPDLR

SEQ ID NO: 769026 - protein, 18 aa, Mycobacterium
IVRWPRQVLAEFGLILPE

SEQ ID NO: 769027 - protein, 18 aa, Mycobacterium
IVSAFSFELGKVSAEAGI

SEQ ID NO: 769028 - protein, 17 aa, Mycobacterium
IVSGELYGSFLPGTPQN

SEQ ID NO: 769029 - protein, 18 aa, Mycobacterium
IVSIEAFEHFGFERYDDF

SEQ ID NO: 769030 - protein, 18 aa, Mycobacterium
IVSIEAFEHFGHENYDDF

SEQ ID NO: 769031 - protein, 22 aa, Mycobacterium
IVSLRAGGKVIFFGNGGSAQDA

SEQ ID NO: 769032 - protein, 23 aa, Mycobacterium
IVSRGGSIMAAWMLAHHTESFLY

SEQ ID NO: 769033 - protein, 17 aa, Mycobacterium
IVSVGAWVEGASQVYSS

SEQ ID NO: 769034 - protein, 18 aa, Mycobacterium
IVSVGFNWIMGEHVTPPK

SEQ ID NO: 769035 - protein, 19 aa, Mycobacterium
IVTAFPFRLIDVWQSHRAP

SEQ ID NO: 769036 - protein, 24 aa, Mycobacterium
IVTAFPYRLLDVWRDHRAPVEDDF

SEQ ID NO: 769037 - protein, 21 aa, Mycobacterium
IVVGALPFDLSRPAALMRPQS

SEQ ID NO: 769038 - protein, 18 aa, Mycobacterium
IWAGTGFRAIGPGTVAEI

SEQ ID NO: 769039 - protein, 18 aa, Mycobacterium
IWAGTGFRRARTGSVADI

SEQ ID NO: 769040 - protein, 26 aa, Mycobacterium
IWAPGPFRFVMMVLRHIPRPIFRKLP

SEQ ID NO: 769041 - protein, 17 aa, Mycobacterium
IWCFPKFDFPLPAALRW

SEQ ID NO: 769042 - protein, 17 aa, Mycobacterium
IWCFPKFDVPLSRTARA

SEQ ID NO: 769043 - protein, 27 aa, Mycobacterium
IWFPGKKGGPGWVEWGGCGMVNPNVLR

SEQ ID NO: 769044 - protein, 18 aa, Mycobacterium
IWKLVLLQQFHDILPGSS

SEQ ID NO: 769045 - protein, 23 aa, Mycobacterium
IWMYLKELEFRQGFIDIPVNGVL

SEQ ID NO: 769046 - protein, 18 aa, Mycobacterium
IWQRPRWAVRLQPATVSD

SEQ ID NO: 769047 - protein, 18 aa, Mycobacterium
IWRDRWITRDGIIECREA

SEQ ID NO: 769048 - protein, 18 aa, Mycobacterium
IWRSRWVTTDGIVECREA

SEQ ID NO: 769049 - protein, 19 aa, Mycobacterium
IWSSLALKPERPWLELNSR

SEQ ID NO: 769050 - protein, 20 aa, Mycobacterium
IWVPRCLDAALALQPIWSAP

SEQ ID NO: 769051 - protein, 18 aa, Mycobacterium
IWVPWGYAVVRVDSRGAG

SEQ ID NO: 769052 - protein, 19 aa, Mycobacterium
IYADLGLRFDGERAAQISE

SEQ ID NO: 769053 - protein, 17 aa, Mycobacterium
IYARYQAFTSFTAHVRG

SEQ ID NO: 769054 - protein, 27 aa, Mycobacterium
IYEDLSWFCIRAWRFGAAESLGAGGLG

SEQ ID NO: 769055 - protein, 17 aa, Mycobacterium
IYFEGGYSFEYLNDPSK

SEQ ID NO: 769056 - protein, 24 aa, Mycobacterium
IYLREVQDVWTWVRPYFDDRATGT

SEQ ID NO: 769057 - protein, 24 aa, Mycobacterium
IYNLLLTLLFEWGVAVHDMDIDAI

SEQ ID NO: 769058 - protein, 24 aa, Mycobacterium
IYPDGRFSYQLTIYIFRYGEGTAM

SEQ ID NO: 769059 - protein, 24 aa, Mycobacterium
IYPDGRFSYQLTIYIFRYGQGTEM

SEQ ID NO: 769060 - protein, 24 aa, Mycobacterium
IYPDGRYSYQLTIYIFRYGEGTAM

SEQ ID NO: 769061 - protein, 17 aa, Mycobacterium
IYRGREVTGFTSSDDAV

SEQ ID NO: 769062 - protein, 24 aa, Mycobacterium
IYRRWPDIRWVIAEVLTVRISDVL

SEQ ID NO: 769063 - protein, 20 aa, Mycobacterium
IYRWWPTRPALVADVMLEDA

SEQ ID NO: 769064 - protein, 20 aa, Mycobacterium
IYWLSLPLDYGLSGTTAAGG

SEQ ID NO: 769065 - protein, 17 aa, Mycobacterium
IYYAGGYPFEYLNDQAK

SEQ ID NO: 769066 - protein, 18 aa, Mycobacterium
KAAGRPEDEFAFVVHGTM

SEQ ID NO: 769067 - protein, 20 aa, Mycobacterium
KAAQQIADWSTKGYLTPGAN

SEQ ID NO: 769068 - protein, 17 aa, Mycobacterium
KAARFVKRFADIGGELR

SEQ ID NO: 769069 - protein, 17 aa, Mycobacterium
KAARFVKRFADLGGELR

SEQ ID NO: 769070 - protein, 22 aa, Mycobacterium
KAARRLVAMLARRGYGQSMAYD

SEQ ID NO: 769071 - protein, 28 aa, Mycobacterium
KAATPWLAATVRFAWRTRLMSSAAVDAR

SEQ ID NO: 769072 - protein, 21 aa, Mycobacterium
KAAYEVLERVGLNPKVASRYP

SEQ ID NO: 769073 - protein, 18 aa, Mycobacterium
KACPAPGVMQGCLESTSG

SEQ ID NO: 769074 - protein, 19 aa, Mycobacterium
KACPAPGVMQGCLESTSGL

SEQ ID NO: 769075 - protein, 19 aa, Mycobacterium
KADCRAAALAEVAVAGLAG

SEQ ID NO: 769076 - protein, 22 aa, Mycobacterium
KADKTELGWRMEVDIDGDWRFF

SEQ ID NO: 769077 - protein, 18 aa, Mycobacterium
KAEKWLPLLENRTPVVAA

SEQ ID NO: 769078 - protein, 21 aa, Mycobacterium
KAFAFAGGRLGYLAAAPAVID

SEQ ID NO: 769079 - protein, 21 aa, Mycobacterium
KAFAFAGGRLGYLIATPAVID

SEQ ID NO: 769080 - protein, 21 aa, Mycobacterium
KAFAFAGGRLGYLVAAPAVID

SEQ ID NO: 769081 - protein, 17 aa, Mycobacterium
KAFGLLVGLPGAYVSNT

SEQ ID NO: 769082 - protein, 18 aa, Mycobacterium
KAFLCTEVARWIKDEGLG

SEQ ID NO: 769083 - protein, 18 aa, Mycobacterium
KAFPHVYCELDFTNPLEL

SEQ ID NO: 769084 - protein, 22 aa, Mycobacterium
KAFSAPPAWRVIKLAFGQPGPN

SEQ ID NO: 769085 - protein, 19 aa, Mycobacterium
KAFWPAPLPFSLLHVDTGH

SEQ ID NO: 769086 - protein, 19 aa, Mycobacterium
KAGAGQYVFLLYSTLQQVG

SEQ ID NO: 769087 - protein, 18 aa, Mycobacterium
KAGAVGLMITEPLDYSFS

SEQ ID NO: 769088 - protein, 17 aa, Mycobacterium
KAGAVGLVMAEPLTYFF

SEQ ID NO: 769089 - protein, 17 aa, Mycobacterium
KAGCSTYKWETFLTSEL

SEQ ID NO: 769090 - protein, 22 aa, Mycobacterium
KAGIDRKALRVILGNPLIAITM

SEQ ID NO: 769091 - protein, 18 aa, Mycobacterium
KAGMWLRDYLRALIDERR

SEQ ID NO: 769092 - protein, 23 aa, Mycobacterium
KAGPALACGNAFLLKPSERDPSV

SEQ ID NO: 769093 - protein, 20 aa, Mycobacterium
KAGRRFARLAPIVATYRKLE

SEQ ID NO: 769094 - protein, 20 aa, Mycobacterium
KAGVIGLTIAAARDLSSVGI

SEQ ID NO: 769095 - protein, 23 aa, Mycobacterium
KAGYEVLERVGLDVKLARRYPAQ

SEQ ID NO: 769096 - protein, 24 aa, Mycobacterium
KAHLARWGVCLARTDPDAPKHKGI

SEQ ID NO: 769097 - protein, 22 aa, Mycobacterium
KAHPGRFLLGIGAGHPELIAQY

SEQ ID NO: 769098 - protein, 20 aa, Mycobacterium
KAIAVGPDLSRTIARIEKVG

SEQ ID NO: 769099 - protein, 18 aa, Mycobacterium
KAIEASGRFCVNMLTEHQ

SEQ ID NO: 769100 - protein, 19 aa, Mycobacterium
KAIEASGRFCVNVLTEKQK

SEQ ID NO: 769101 - protein, 20 aa, Mycobacterium
KAITIDAAWILRKEDELGSI

SEQ ID NO: 769102 - protein, 20 aa, Mycobacterium
KAIWRINELLNWQVAASGET

SEQ ID NO: 769103 - protein, 17 aa, Mycobacterium
KAKAMGAMAMFGERYPD

SEQ ID NO: 769104 - protein, 17 aa, Mycobacterium
KAKEAVGAVAGRDDLTR

SEQ ID NO: 769105 - protein, 19 aa, Mycobacterium
KALARICALNALAAVDSLV

SEQ ID NO: 769106 - protein, 17 aa, Mycobacterium
KALAYYTFRHWDITESW

SEQ ID NO: 769107 - protein, 17 aa, Mycobacterium
KALCAAGVPAVYTGNTD

SEQ ID NO: 769108 - protein, 20 aa, Mycobacterium
KALEGFTMFAFNQGEVCTCP

SEQ ID NO: 769109 - protein, 17 aa, Mycobacterium
KALELIYRVPRSAGREL

SEQ ID NO: 769110 - protein, 22 aa, Mycobacterium
KALFCRMAEVFAGFLSYTDAQI

SEQ ID NO: 769111 - protein, 17 aa, Mycobacterium
KALKAALVPTVVTSRNP

SEQ ID NO: 769112 - protein, 22 aa, Mycobacterium
KALRARLGDIWARINDEEYVVR

SEQ ID NO: 769113 - protein, 23 aa, Mycobacterium
KAMERKVWLPSGGTLVIDRTEAM

SEQ ID NO: 769114 - protein, 19 aa, Mycobacterium
KAMGAMAMFGERYPDQVRV

SEQ ID NO: 769115 - protein, 21 aa, Mycobacterium
KANLFYRGLAFHRFPVIGDTL

SEQ ID NO: 769116 - protein, 18 aa, Mycobacterium
KANLGWGYGVHVCLGMHL

SEQ ID NO: 769117 - protein, 18 aa, Mycobacterium
KAPLPGFLVKKGAKGLMD

SEQ ID NO: 769118 - protein, 24 aa, Mycobacterium
KAPRTRFSYKLTRRRAPSDPTVST

SEQ ID NO: 769119 - protein, 23 aa, Mycobacterium
KAPRWPSMTSWKLATEVDRVVAK

SEQ ID NO: 769120 - protein, 20 aa, Mycobacterium
KAQELGLTWLVEIGAHGVAA

SEQ ID NO: 769121 - protein, 19 aa, Mycobacterium
KAQTRLADLVARSGILVFA

SEQ ID NO: 769122 - protein, 24 aa, Mycobacterium
KAREFPVKFDVWWFRLPHKEDTEY

SEQ ID NO: 769123 - protein, 24 aa, Mycobacterium
KARKALEYGKPVLCADDFFAWLAA

SEQ ID NO: 769124 - protein, 20 aa, Mycobacterium
KARSTMAWHRAVAADELHTA

SEQ ID NO: 769125 - protein, 18 aa, Mycobacterium
KARVVLCGVISSYLTGEH

SEQ ID NO: 769126 - protein, 22 aa, Mycobacterium
KASFLAGLIFRTALRKKYEDKA

SEQ ID NO: 769127 - protein, 19 aa, Mycobacterium
KASVLSFVLAGHEPLEVGK

SEQ ID NO: 769128 - protein, 17 aa, Mycobacterium
KAVAEHGLWYPPDPSSF

SEQ ID NO: 769129 - protein, 17 aa, Mycobacterium
KAVHAWSDLEVVDLPGL

SEQ ID NO: 769130 - protein, 17 aa, Mycobacterium
KAVKVEGGWRLTGQKIW

SEQ ID NO: 769131 - protein, 21 aa, Mycobacterium
KAVPSRLAWEAGVALADSLLA

SEQ ID NO: 769132 - protein, 21 aa, Mycobacterium
KAVPSRLAWEAGVALADSLLD

SEQ ID NO: 769133 - protein, 21 aa, Mycobacterium
KAVPSRLAWEAGVALADSLLT

SEQ ID NO: 769134 - protein, 22 aa, Mycobacterium
KAVPSRLAWETGVAMADSLLAR

SEQ ID NO: 769135 - protein, 23 aa, Mycobacterium
KAVPSRLAWETGVAMADSLLDRY

SEQ ID NO: 769136 - protein, 24 aa, Mycobacterium
KAVWPEIWTAIGPMLAGVVATGKA

SEQ ID NO: 769137 - protein, 20 aa, Mycobacterium
KAVWRLNELLNWQVASSGDD

SEQ ID NO: 769138 - protein, 20 aa, Mycobacterium
KAWESMPFESQWYARNELRR

SEQ ID NO: 769139 - protein, 19 aa, Mycobacterium
KAWSEAMVAAWIGGIDDEL

SEQ ID NO: 769140 - protein, 23 aa, Mycobacterium
KAYPGRFLLGIGVGHPEAHTEYR

SEQ ID NO: 769141 - protein, 24 aa, Mycobacterium
KAYPGRFLLGIGVGHPEHTEQYAK

SEQ ID NO: 769142 - protein, 21 aa, Mycobacterium
KCFALRIASVMARDEGWLAEH

SEQ ID NO: 769143 - protein, 23 aa, Mycobacterium
KCGTELLSVLAIDRIEAGGQWHC

SEQ ID NO: 769144 - protein, 20 aa, Mycobacterium
KCLRSTFMYLGWLCGAAPSR

SEQ ID NO: 769145 - protein, 20 aa, Mycobacterium
KCQHCGEVAATAPRTLTVPE

SEQ ID NO: 769146 - protein, 26 aa, Mycobacterium
KCQQVWCPLCALAALVNGEQHPLTTV

SEQ ID NO: 769147 - protein, 26 aa, Mycobacterium
KCQQVWCPVCALAAVVGGEQHPLLTV

SEQ ID NO: 769148 - protein, 17 aa, Mycobacterium
KCTPCREGTYWLAQIYA

SEQ ID NO: 769149 - protein, 17 aa, Mycobacterium
KCTPCREGTYWLAQIYE

SEQ ID NO: 769150 - protein, 19 aa, Mycobacterium
KCTPCREGTYWLVRILQRL

SEQ ID NO: 769151 - protein, 22 aa, Mycobacterium
KDADAWPKWNAWLEGIADVMGP

SEQ ID NO: 769152 - protein, 21 aa, Mycobacterium
KDAEAHFAEALGLTKPDPKSA

SEQ ID NO: 769153 - protein, 20 aa, Mycobacterium
KDAEWWRLGLAEEIGGMPAP

SEQ ID NO: 769154 - protein, 22 aa, Mycobacterium
KDCIQILGGIGFTWEHDAHLYL

SEQ ID NO: 769155 - protein, 20 aa, Mycobacterium
KDDFLDYWAFLAFASVRGGR

SEQ ID NO: 769156 - protein, 17 aa, Mycobacterium
KDDGLAWVPYGPKDPAF

SEQ ID NO: 769157 - protein, 18 aa, Mycobacterium
KDEGVEFVDVRFCDLPGT

SEQ ID NO: 769158 - protein, 18 aa, Mycobacterium
KDFRLMWDNAYAVHTLTD

SEQ ID NO: 769159 - protein, 17 aa, Mycobacterium
KDGEMRYTRTLTIQACW

SEQ ID NO: 769160 - protein, 20 aa, Mycobacterium
KDILQGQCTFSWPPKIDLPG

SEQ ID NO: 769161 - protein, 18 aa, Mycobacterium
KDISRFIALEGRVWSVAA

SEQ ID NO: 769162 - protein, 20 aa, Mycobacterium
KDKPTWLGRAWQRISEEVAA

SEQ ID NO: 769163 - protein, 21 aa, Mycobacterium
KDLLRLPGLVAIAYQHETSRA

SEQ ID NO: 769164 - protein, 17 aa, Mycobacterium
KDLRDAFTFNVSTAHAL

SEQ ID NO: 769165 - protein, 17 aa, Mycobacterium
KDLRTWHGTVLAAAAFA

SEQ ID NO: 769166 - protein, 17 aa, Mycobacterium
KDLRTWHGTVLAATAFA

SEQ ID NO: 769167 - protein, 20 aa, Mycobacterium
KDLVIPPAWKKVWISPHPNG

SEQ ID NO: 769168 - protein, 20 aa, Mycobacterium
KDLVIPPAWKNVWISPSPNG

SEQ ID NO: 769169 - protein, 20 aa, Mycobacterium
KDLVIPPAWQKVWIAPYPNG

SEQ ID NO: 769170 - protein, 18 aa, Mycobacterium
KDNYCVYGAHKLWKTARR

SEQ ID NO: 769171 - protein, 20 aa, Mycobacterium
KDPKRPSGSFIFAGPSGVGK

SEQ ID NO: 769172 - protein, 17 aa, Mycobacterium
KDPRLAGIHFTGSTATF

SEQ ID NO: 769173 - protein, 25 aa, Mycobacterium
KDPRWRFGVPPANNANYAWIQHILS

SEQ ID NO: 769174 - protein, 21 aa, Mycobacterium
KDPRYWIDVTKIIHVGEGEKA

SEQ ID NO: 769175 - protein, 19 aa, Mycobacterium
KDRLRPDLRIHVAAAEADF

SEQ ID NO: 769176 - protein, 21 aa, Mycobacterium
KDSRGGSSFAEFAANAKALSG

SEQ ID NO: 769177 - protein, 22 aa, Mycobacterium
KDSRLGYSIGIGFPPDWGERTV

SEQ ID NO: 769178 - protein, 20 aa, Mycobacterium
KDSVCTQCPFLGACDTSPIA

SEQ ID NO: 769179 - protein, 22 aa, Mycobacterium
KDTRAGSSFAEFAASAKELTGN

SEQ ID NO: 769180 - protein, 17 aa, Mycobacterium
KDVKRQLLLDALADELK

SEQ ID NO: 769181 - protein, 17 aa, Mycobacterium
KDWDWLVSINVMGVVHG

SEQ ID NO: 769182 - protein, 20 aa, Mycobacterium
KDYALWPALSLRRWRRTLKA

SEQ ID NO: 769183 - protein, 18 aa, Mycobacterium
KEAICKGTVWSIRHEAAK

SEQ ID NO: 769184 - protein, 25 aa, Mycobacterium
KEDWYRWQWRVHVGLWAAASASKLD

SEQ ID NO: 769185 - protein, 20 aa, Mycobacterium
KEELLRLAVDRALDALFAAT

SEQ ID NO: 769186 - protein, 22 aa, Mycobacterium
KEGDDVFVALSWTKHPAPQTYE

SEQ ID NO: 769187 - protein, 23 aa, Mycobacterium
KEGDDVFVALSWTKHPAPQTYEE

SEQ ID NO: 769188 - protein, 22 aa, Mycobacterium
KEGDDVFVALSWTKHPAPQTYQ

SEQ ID NO: 769189 - protein, 23 aa, Mycobacterium
KEGDDVFVALSWTKHPAPQTYQE

SEQ ID NO: 769190 - protein, 23 aa, Mycobacterium
KEGERLWISWAMANRDPAVFHDP

SEQ ID NO: 769191 - protein, 23 aa, Mycobacterium
KEGERLWISWAMANRDPAVFKDP

SEQ ID NO: 769192 - protein, 19 aa, Mycobacterium
KEGGRFACGGGRPADMDKG

SEQ ID NO: 769193 - protein, 20 aa, Mycobacterium
KEIAGRLAARIGSGILSDVV

SEQ ID NO: 769194 - protein, 20 aa, Mycobacterium
KEIAGRLAARIGSGLLVDVI

SEQ ID NO: 769195 - protein, 21 aa, Mycobacterium
KEIAGRLAARIGSGLLVDVVG

SEQ ID NO: 769196 - protein, 17 aa, Mycobacterium
KEIGLVWKLVEPADLQE

SEQ ID NO: 769197 - protein, 20 aa, Mycobacterium
KEIRAAAYWRWAKDNPEEAA

SEQ ID NO: 769198 - protein, 21 aa, Mycobacterium
KEIRRCLKRYLARQLYRTLER

SEQ ID NO: 769199 - protein, 23 aa, Mycobacterium
KELACIGSIRFARRSSNFEEAVR

SEQ ID NO: 769200 - protein, 21 aa, Mycobacterium
KELCRRWYPRIYFGQPEKGLA

SEQ ID NO: 769201 - protein, 21 aa, Mycobacterium
KELDIRFSLYYTLEEFAQTFA

SEQ ID NO: 769202 - protein, 19 aa, Mycobacterium
KELHLRLGAATAELSQRLG

SEQ ID NO: 769203 - protein, 20 aa, Mycobacterium
KELHLRLGAATAELSQRLGR

SEQ ID NO: 769204 - protein, 17 aa, Mycobacterium
KELPAPVKRDFIEDLLE

SEQ ID NO: 769205 - protein, 21 aa, Mycobacterium
KELPMEYALELNRLIELQMEG

SEQ ID NO: 769206 - protein, 21 aa, Mycobacterium
KELRRGATVSLVYLSADAKPG

SEQ ID NO: 769207 - protein, 20 aa, Mycobacterium
KELRRGSTVALVYLAPDAKP

SEQ ID NO: 769208 - protein, 24 aa, Mycobacterium
KENWSGNFPFDWGVSAHPKVDGKT

SEQ ID NO: 769209 - protein, 21 aa, Mycobacterium
KEPFGVVGLIFPWNGPIFNAS

SEQ ID NO: 769210 - protein, 21 aa, Mycobacterium
KEPYSVVGLIFPWNGPIFNAS

SEQ ID NO: 769211 - protein, 20 aa, Mycobacterium
KEQPLWRVLVALSIRHVGPT

SEQ ID NO: 769212 - protein, 19 aa, Mycobacterium
KERGFRLLALTPKGDARAL

SEQ ID NO: 769213 - protein, 20 aa, Mycobacterium
KERLRPDLRIHVASAEANFW

SEQ ID NO: 769214 - protein, 17 aa, Mycobacterium
KERLRRILITEVGCPVT

SEQ ID NO: 769215 - protein, 19 aa, Mycobacterium
KESLERLGLDYVDLYLIHW

SEQ ID NO: 769216 - protein, 18 aa, Mycobacterium
KESVCTQCAFLGACDTSP

SEQ ID NO: 769217 - protein, 19 aa, Mycobacterium
KETICKATLWAIRREAAKP

SEQ ID NO: 769218 - protein, 17 aa, Mycobacterium
KETWVRLLLIRAGLPRP

SEQ ID NO: 769219 - protein, 17 aa, Mycobacterium
KEVAALLRWLADGHFVL

SEQ ID NO: 769220 - protein, 22 aa, Mycobacterium
KEVAEAYLAFNVWVLKEDALFL

SEQ ID NO: 769221 - protein, 17 aa, Mycobacterium
KEVLNALGITVLAAPGF

SEQ ID NO: 769222 - protein, 20 aa, Mycobacterium
KEVLNALGITVLAEPGFEAD

SEQ ID NO: 769223 - protein, 18 aa, Mycobacterium
KEVLPEFIERDAKAVAEK

SEQ ID NO: 769224 - protein, 20 aa, Mycobacterium
KEVLQALGITVLAEEGFEAD

SEQ ID NO: 769225 - protein, 22 aa, Mycobacterium
KEWLKPTAYMMAKFGMTLCALG

SEQ ID NO: 769226 - protein, 17 aa, Mycobacterium
KEWRLRVSKEMKVPAYV

SEQ ID NO: 769227 - protein, 19 aa, Mycobacterium
KEWVPRLAGMDVIASYCLT

SEQ ID NO: 769228 - protein, 21 aa, Mycobacterium
KEYWRRFGVVPDWAGKRVLDV

SEQ ID NO: 769229 - protein, 19 aa, Mycobacterium
KFAAIIDRLFRNAANDPIP

SEQ ID NO: 769230 - protein, 17 aa, Mycobacterium
KFEWLDNKVVQWVPDRY

SEQ ID NO: 769231 - protein, 22 aa, Mycobacterium
KFFPPAMKRWWLYRRLADVAAL

SEQ ID NO: 769232 - protein, 18 aa, Mycobacterium
KFIPGMRERGFGHIINVS

SEQ ID NO: 769233 - protein, 17 aa, Mycobacterium
KFIPGMRERGYGHIVNV

SEQ ID NO: 769234 - protein, 23 aa, Mycobacterium
KFLFPRVEVEVGFILAADLPGED

SEQ ID NO: 769235 - protein, 18 aa, Mycobacterium
KFMGRWRSGAPLVLAPEC

SEQ ID NO: 769236 - protein, 18 aa, Mycobacterium
KFMGRWRSGAPLVLSPDV

SEQ ID NO: 769237 - protein, 19 aa, Mycobacterium
KFPGCAVVISHDRWFLDRT

SEQ ID NO: 769238 - protein, 18 aa, Mycobacterium
KFPYRNDGALGWVGTSPV

SEQ ID NO: 769239 - protein, 18 aa, Mycobacterium
KFTAALIGPWWSAPSTEL

SEQ ID NO: 769240 - protein, 18 aa, Mycobacterium
KFWWLAGPFCERALGDEI

SEQ ID NO: 769241 - protein, 22 aa, Mycobacterium
KFYGDIRGVLGFQRLAGTENCI

SEQ ID NO: 769242 - protein, 20 aa, Mycobacterium
KGAAPDSVFYSGYYSEAAPF

SEQ ID NO: 769243 - protein, 19 aa, Mycobacterium
KGACAQVNMDLGLLAPEKA

SEQ ID NO: 769244 - protein, 19 aa, Mycobacterium
KGALRVSGALEFRRRHQPH

SEQ ID NO: 769245 - protein, 20 aa, Mycobacterium
KGAMYPQWLVANLWQKKWLT

SEQ ID NO: 769246 - protein, 20 aa, Mycobacterium
KGCIAHGGLGWIYLAVDRNV

SEQ ID NO: 769247 - protein, 22 aa, Mycobacterium
KGCPKDTWCVINAGNYRGSMNV

SEQ ID NO: 769248 - protein, 18 aa, Mycobacterium
KGDGCIVRLVAITDPTGE

SEQ ID NO: 769249 - protein, 18 aa, Mycobacterium
KGEYGGGEVHIWDTGTYE

SEQ ID NO: 769250 - protein, 17 aa, Mycobacterium
KGFSLWGGVNVKRKRRK

SEQ ID NO: 769251 - protein, 20 aa, Mycobacterium
KGGADWVEWGGCGMVHPNVL

SEQ ID NO: 769252 - protein, 21 aa, Mycobacterium
KGGAMSLLLDQVRELGARIPD

SEQ ID NO: 769253 - protein, 19 aa, Mycobacterium
KGGGFAGPRYGFKPTVMPK

SEQ ID NO: 769254 - protein, 19 aa, Mycobacterium
KGGVCGTCRAKVTGGAVDM

SEQ ID NO: 769255 - protein, 24 aa, Mycobacterium
KGIFTSNFGYRWGVLHAGIDLANS

SEQ ID NO: 769256 - protein, 25 aa, Mycobacterium
KGIGCGIARRFAREGAKVVVAELDS

SEQ ID NO: 769257 - protein, 20 aa, Mycobacterium
KGKHVGFRWAADKQLRDTVC

SEQ ID NO: 769258 - protein, 25 aa, Mycobacterium
KGKLKSGFTALEWNSITRKFVLPGS

SEQ ID NO: 769259 - protein, 20 aa, Mycobacterium
KGLCLTLWQAAWRVSEDLPS

SEQ ID NO: 769260 - protein, 20 aa, Mycobacterium
KGLEFPAVFVTGWEDGMFPH

SEQ ID NO: 769261 - protein, 17 aa, Mycobacterium
KGLGRLAMWSANRDSQC

SEQ ID NO: 769262 - protein, 19 aa, Mycobacterium
KGLLDRFAEEAGFDKATRE

SEQ ID NO: 769263 - protein, 19 aa, Mycobacterium
KGLRSFRSEVEINFSELAL

SEQ ID NO: 769264 - protein, 17 aa, Mycobacterium
KGLRWGDTFVCDQHAGV

SEQ ID NO: 769265 - protein, 19 aa, Mycobacterium
KGMSSHFVWLNRGKRSVAL

SEQ ID NO: 769266 - protein, 18 aa, Mycobacterium
KGMYGSSLVTGWARLHGY

SEQ ID NO: 769267 - protein, 20 aa, Mycobacterium
KGNACLTCSVFVTDHTHHDV

SEQ ID NO: 769268 - protein, 17 aa, Mycobacterium
KGNNVLHALGFDSFGLP

SEQ ID NO: 769269 - protein, 22 aa, Mycobacterium
KGNPAWDLPLVFGPIALVYNLA

SEQ ID NO: 769270 - protein, 18 aa, Mycobacterium
KGPFRLSALIGERMVADG

SEQ ID NO: 769271 - protein, 20 aa, Mycobacterium
KGPFRLSALIGERMVADGGG

SEQ ID NO: 769272 - protein, 17 aa, Mycobacterium
KGRRILVEFDGRPSAST

SEQ ID NO: 769273 - protein, 20 aa, Mycobacterium
KGRRVGGLSIGYRINHSTKT

SEQ ID NO: 769274 - protein, 17 aa, Mycobacterium
KGRSWPRERTRLKLEEV

SEQ ID NO: 769275 - protein, 22 aa, Mycobacterium
KGSALVPSWVAFAVIGLLEQHF

SEQ ID NO: 769276 - protein, 20 aa, Mycobacterium
KGSALVPSWVAFAVTGLLEQ

SEQ ID NO: 769277 - protein, 22 aa, Mycobacterium
KGSALVPSWVAFAVVGLLEQHF

SEQ ID NO: 769278 - protein, 29 aa, Mycobacterium
KGSARKLAMEFARFLGLPPMQPRMNVTDI

SEQ ID NO: 769279 - protein, 18 aa, Mycobacterium
KGSGQGWLTAEYAMLPAA

SEQ ID NO: 769280 - protein, 24 aa, Mycobacterium
KGTFRLAFGIGDFRRDTGFGDDPA

SEQ ID NO: 769281 - protein, 24 aa, Mycobacterium
KGTFRLAFGIGDFRRDTGFGEDAT

SEQ ID NO: 769282 - protein, 24 aa, Mycobacterium
KGTFRLAFGIGDFRRDTGFGEDPG

SEQ ID NO: 769283 - protein, 24 aa, Mycobacterium
KGTFRLAFGIGDFRRDTGFGEDPT

SEQ ID NO: 769284 - protein, 24 aa, Mycobacterium
KGTFRLAFGIGDFRRDTGFGENPA

SEQ ID NO: 769285 - protein, 24 aa, Mycobacterium
KGTFRLAFGIGDFRRDTGFGGDAL

SEQ ID NO: 769286 - protein, 22 aa, Mycobacterium
KGTRVGLFFANGIEWITWWLAV

SEQ ID NO: 769287 - protein, 17 aa, Mycobacterium
KGVLWRQHDIFMTSFGG

SEQ ID NO: 769288 - protein, 21 aa, Mycobacterium
KGVPTPVAWTRMRAPRSLMGA

SEQ ID NO: 769289 - protein, 18 aa, Mycobacterium
KGVRAWRLPMGFTAWPPW

SEQ ID NO: 769290 - protein, 17 aa, Mycobacterium
KGWIDRVFVKGFAYGIA

SEQ ID NO: 769291 - protein, 25 aa, Mycobacterium
KGWVTECLRAAYPLGHGHGPVSALF

SEQ ID NO: 769292 - protein, 25 aa, Mycobacterium
KHAIADAIHGLKCVVDVLADELSRI

SEQ ID NO: 769293 - protein, 18 aa, Mycobacterium
KHARLSLAVNDMYLSTVG

SEQ ID NO: 769294 - protein, 19 aa, Mycobacterium
KHGRLAIGVNDIYLSTVGG

SEQ ID NO: 769295 - protein, 20 aa, Mycobacterium
KHIVAAYAFELGKVETPEIR

SEQ ID NO: 769296 - protein, 20 aa, Mycobacterium
KHMLDRAGAWDALHAELDDL

SEQ ID NO: 769297 - protein, 17 aa, Mycobacterium
KHPHSMAPWSPASRTHV

SEQ ID NO: 769298 - protein, 17 aa, Mycobacterium
KHVKGMLTGPVTILAWS

SEQ ID NO: 769299 - protein, 25 aa, Mycobacterium
KIAALRARAKAAFAEREGVNLTFLP

SEQ ID NO: 769300 - protein, 18 aa, Mycobacterium
KIAARIRKVFGRRVRIRD

SEQ ID NO: 769301 - protein, 21 aa, Mycobacterium
KIALRRCTIEWMISGDSSVLG

SEQ ID NO: 769302 - protein, 18 aa, Mycobacterium
KIARIGIRVADVLDEQVL

SEQ ID NO: 769303 - protein, 18 aa, Mycobacterium
KIARIGIRVADVLDREVL

SEQ ID NO: 769304 - protein, 20 aa, Mycobacterium
KICRMIMLYHLDRGWADHLA

SEQ ID NO: 769305 - protein, 23 aa, Mycobacterium
KICSDGRCPFLHAVRDVRAASGN

SEQ ID NO: 769306 - protein, 19 aa, Mycobacterium
KIDFEDYWAFLAFAVAKGG

SEQ ID NO: 769307 - protein, 22 aa, Mycobacterium
KIDMTEWWAYLDGVRSTYPLSY

SEQ ID NO: 769308 - protein, 20 aa, Mycobacterium
KIEPTFHAWSRIGAGAPVIF

SEQ ID NO: 769309 - protein, 17 aa, Mycobacterium
KIIPVSFGFPFGLSVVL

SEQ ID NO: 769310 - protein, 19 aa, Mycobacterium
KIKTGARVHVHWADETVGA

SEQ ID NO: 769311 - protein, 23 aa, Mycobacterium
KILGRPALPFGHWVAEHRDVFTN

SEQ ID NO: 769312 - protein, 17 aa, Mycobacterium
KILWCSPTRDQAERAVA

SEQ ID NO: 769313 - protein, 17 aa, Mycobacterium
KIMDRLGAVWVREDLGV

SEQ ID NO: 769314 - protein, 17 aa, Mycobacterium
KIPLVGMWAEMNFGTYG

SEQ ID NO: 769315 - protein, 18 aa, Mycobacterium
KIPRYVRIVDEFPMTVTG

SEQ ID NO: 769316 - protein, 18 aa, Mycobacterium
KIQIMPQVWAMRYTLERV

SEQ ID NO: 769317 - protein, 20 aa, Mycobacterium
KIQLPTFIPRIVFGAYPGLP

SEQ ID NO: 769318 - protein, 25 aa, Mycobacterium
KIRLPIGQGISGWVADHCEPVVISH

SEQ ID NO: 769319 - protein, 23 aa, Mycobacterium
KIRLPLGQGISGWVASHRQPVVI

SEQ ID NO: 769320 - protein, 24 aa, Mycobacterium
KISALRWGGAPPRIVFIHGGGQNA

SEQ ID NO: 769321 - protein, 18 aa, Mycobacterium
KITFRIKLEISFKMRPAK

SEQ ID NO: 769322 - protein, 18 aa, Mycobacterium
KITYRIKLEISFKMRPSQ

SEQ ID NO: 769323 - protein, 25 aa, Mycobacterium
KIVEYSPRFVLFVARGTSDHAALYG

SEQ ID NO: 769324 - protein, 17 aa, Mycobacterium
KIWSGEATFLFTRTTVG

SEQ ID NO: 769325 - protein, 17 aa, Mycobacterium
KIWSGKATFLFTRTTVG

SEQ ID NO: 769326 - protein, 17 aa, Mycobacterium
KIYCARAAMTVCETSIQ

SEQ ID NO: 769327 - protein, 17 aa, Mycobacterium
KKADAALGRPVVSNQVH

SEQ ID NO: 769328 - protein, 21 aa, Mycobacterium
KKARARRAVWFSAIGALSNGK

SEQ ID NO: 769329 - protein, 19 aa, Mycobacterium
KKAVAHPVARKAGQNATAK

SEQ ID NO: 769330 - protein, 18 aa, Mycobacterium
KKAVFDWSIGVGLKVSAS

SEQ ID NO: 769331 - protein, 20 aa, Mycobacterium
KKGPFRLAMAAGIPIVPIVI

SEQ ID NO: 769332 - protein, 18 aa, Mycobacterium
KKHMAFGVGMHRCLGSHY

SEQ ID NO: 769333 - protein, 24 aa, Mycobacterium
KKISRLSAVVVRWSRSRNRYERQG

SEQ ID NO: 769334 - protein, 22 aa, Mycobacterium
KKLFCRMAEVFAGFLSYTDAQI

SEQ ID NO: 769335 - protein, 24 aa, Mycobacterium
KKLLPRYRLVPFEVRRESVGFIFN

SEQ ID NO: 769336 - protein, 20 aa, Mycobacterium
KKLPTLRGRTVVTMFYENST

SEQ ID NO: 769337 - protein, 24 aa, Mycobacterium
KKMSRMSWRSMIRDGLAMRHGKEL

SEQ ID NO: 769338 - protein, 18 aa, Mycobacterium
KKNEPEWMLDIRLKALRT

SEQ ID NO: 769339 - protein, 19 aa, Mycobacterium
KKNGGGRFVFISSSAGIFG

SEQ ID NO: 769340 - protein, 17 aa, Mycobacterium
KKPPRWVVVADLVETSR

SEQ ID NO: 769341 - protein, 19 aa, Mycobacterium
KKPSLAWAETYPGTLSYYL

SEQ ID NO: 769342 - protein, 18 aa, Mycobacterium
KKPVLKRITESFKATPGK

SEQ ID NO: 769343 - protein, 18 aa, Mycobacterium
KKRFPFSLDANAMRATTL

SEQ ID NO: 769344 - protein, 18 aa, Mycobacterium
KKSEPEWMLDIRLKALRT

SEQ ID NO: 769345 - protein, 19 aa, Mycobacterium
KKSFVCGFHGWTYDQDGNC

SEQ ID NO: 769346 - protein, 17 aa, Mycobacterium
KKTIEFYLTAVFNVMRL

SEQ ID NO: 769347 - protein, 24 aa, Mycobacterium
KKTPRRLCLRITLGSGRNKVTATF

SEQ ID NO: 769348 - protein, 18 aa, Mycobacterium
KKWLAEVLPNFPVYAHML

SEQ ID NO: 769349 - protein, 24 aa, Mycobacterium
KLAERGDVFDLVFIDADKENNVAY

SEQ ID NO: 769350 - protein, 19 aa, Mycobacterium
KLAEWEAGAGLGNYTRARI

SEQ ID NO: 769351 - protein, 17 aa, Mycobacterium
KLAGFKIPQYWYSVTEL

SEQ ID NO: 769352 - protein, 17 aa, Mycobacterium
KLAGMGFRVIPSDANFV

SEQ ID NO: 769353 - protein, 19 aa, Mycobacterium
KLAKLKPVFGVKAGDATMT

SEQ ID NO: 769354 - protein, 18 aa, Mycobacterium
KLAKLKPVFGVRNGDATM

SEQ ID NO: 769355 - protein, 20 aa, Mycobacterium
KLAKLRPVFGVKAGDATMTA

SEQ ID NO: 769356 - protein, 19 aa, Mycobacterium
KLALSRAALELALDRGDLA

SEQ ID NO: 769357 - protein, 17 aa, Mycobacterium
KLAPLAFVRFRIDGKDW

SEQ ID NO: 769358 - protein, 18 aa, Mycobacterium
KLAPLPCRVAVDTSDAPL

SEQ ID NO: 769359 - protein, 17 aa, Mycobacterium
KLARPTSTWTYMVHDNP

SEQ ID NO: 769360 - protein, 17 aa, Mycobacterium
KLDLAWMVQSWPTGADS

SEQ ID NO: 769361 - protein, 17 aa, Mycobacterium
KLDPWLRHTFSDARQQL

SEQ ID NO: 769362 - protein, 19 aa, Mycobacterium
KLDTEFFAPVLLGVPYEVS

SEQ ID NO: 769363 - protein, 21 aa, Mycobacterium
KLEAIDGFRFLAVRELAKQRL

SEQ ID NO: 769364 - protein, 18 aa, Mycobacterium
KLEGVPLTFAGKVNRLAI

SEQ ID NO: 769365 - protein, 18 aa, Mycobacterium
KLEILRRVVAALRSRSGI

SEQ ID NO: 769366 - protein, 23 aa, Mycobacterium
KLFAESGFAWAPDGRHIAWVQAR

SEQ ID NO: 769367 - protein, 23 aa, Mycobacterium
KLGELRPLYPPGLVHIYHALTWG

SEQ ID NO: 769368 - protein, 18 aa, Mycobacterium
KLGFPVPIRHWLRAGELL

SEQ ID NO: 769369 - protein, 19 aa, Mycobacterium
KLGFPVPIRHWLRAGELLD

SEQ ID NO: 769370 - protein, 18 aa, Mycobacterium
KLGFPVPIRHWLRSGALL

SEQ ID NO: 769371 - protein, 18 aa, Mycobacterium
KLGFPVPIRHWLRTGELL

SEQ ID NO: 769372 - protein, 17 aa, Mycobacterium
KLHHPAAFCAALLRAQP

SEQ ID NO: 769373 - protein, 24 aa, Mycobacterium
KLHKRLQEELAWVRSGAKARQAKN

SEQ ID NO: 769374 - protein, 25 aa, Mycobacterium
KLHPNIRTFREWSPRIAGDKSVLDA

SEQ ID NO: 769375 - protein, 23 aa, Mycobacterium
KLHRIGRIAFVWSDRHSAVTAAA

SEQ ID NO: 769376 - protein, 17 aa, Mycobacterium
KLILGHKAMIVAGGANR

SEQ ID NO: 769377 - protein, 20 aa, Mycobacterium
KLISRPGCERICRYAFEYAR

SEQ ID NO: 769378 - protein, 17 aa, Mycobacterium
KLKCYIEVRCAVTGGLA

SEQ ID NO: 769379 - protein, 17 aa, Mycobacterium
KLKCYLEVRCAVAVDLA

SEQ ID NO: 769380 - protein, 18 aa, Mycobacterium
KLLNAVAVAAGWPDGDGG

SEQ ID NO: 769381 - protein, 19 aa, Mycobacterium
KLLPILAPIVLAYLGRKLS

SEQ ID NO: 769382 - protein, 23 aa, Mycobacterium
KLLRSDWLEPRWMVGIDPQSEGL

SEQ ID NO: 769383 - protein, 18 aa, Mycobacterium
KLLRSPRGGYCYEHVALF

SEQ ID NO: 769384 - protein, 24 aa, Mycobacterium
KLLSAFKVPTAWLLLDSDDDVPRG

SEQ ID NO: 769385 - protein, 17 aa, Mycobacterium
KLLSSWDESIFRPLAAK

SEQ ID NO: 769386 - protein, 21 aa, Mycobacterium
KLPFGEIPGQVFIGMRTSDVL

SEQ ID NO: 769387 - protein, 23 aa, Mycobacterium
KLPFGELPGQVFVGIRTSDVLTH

SEQ ID NO: 769388 - protein, 20 aa, Mycobacterium
KLPKAIVFRAGIQRSPSGKA

SEQ ID NO: 769389 - protein, 19 aa, Mycobacterium
KLPLPPGTLPTVWGDDQRY

SEQ ID NO: 769390 - protein, 24 aa, Mycobacterium
KLQKRLKEELAWVRSGAKARQAKN

SEQ ID NO: 769391 - protein, 24 aa, Mycobacterium
KLQKRLQDELAWVRSGAKARQAKS

SEQ ID NO: 769392 - protein, 23 aa, Mycobacterium
KLQKRLQEELAWVRSGAKARQAK

SEQ ID NO: 769393 - protein, 23 aa, Mycobacterium
KLQKRLTEELAWVRQGAKARQAK

SEQ ID NO: 769394 - protein, 23 aa, Mycobacterium
KLQKRLTEELAWVRSGAKARQAK

SEQ ID NO: 769395 - protein, 18 aa, Mycobacterium
KLQVANRVELARYAIEHG

SEQ ID NO: 769396 - protein, 17 aa, Mycobacterium
KLQVVSWHVMFMSRGKV

SEQ ID NO: 769397 - protein, 18 aa, Mycobacterium
KLRDWLLVRAFEHGITHL

SEQ ID NO: 769398 - protein, 21 aa, Mycobacterium
KLRSGQTLIGFLAPRNADNSI

SEQ ID NO: 769399 - protein, 22 aa, Mycobacterium
KLRWPENLWLGVSVEDRRHLDR

SEQ ID NO: 769400 - protein, 18 aa, Mycobacterium
KLSYAGPFFRYERPQAGR

SEQ ID NO: 769401 - protein, 20 aa, Mycobacterium
KLTFELARFVKFMITEIFPG

SEQ ID NO: 769402 - protein, 17 aa, Mycobacterium
KLVDDWRGFGQRATASG

SEQ ID NO: 769403 - protein, 19 aa, Mycobacterium
KLVGGTCVNYGCIPTKTLV

SEQ ID NO: 769404 - protein, 24 aa, Mycobacterium
KLVLGPWFRPVYRILVAARRLRGT

SEQ ID NO: 769405 - protein, 17 aa, Mycobacterium
KLVRCTRGAIAAVAVDV

SEQ ID NO: 769406 - protein, 21 aa, Mycobacterium
KLWAQACAWEPLAPKTLRLLQ

SEQ ID NO: 769407 - protein, 20 aa, Mycobacterium
KLWEGLRQLYPVGIDHRDLI

SEQ ID NO: 769408 - protein, 19 aa, Mycobacterium
KLWSALRRIPVRELRRTGL

SEQ ID NO: 769409 - protein, 17 aa, Mycobacterium
KLYLCAIKDAFSNRVVG

SEQ ID NO: 769410 - protein, 21 aa, Mycobacterium
KMASGELIGAIAMTEAGTGSD

SEQ ID NO: 769411 - protein, 19 aa, Mycobacterium
KMDGSWRVGERPVRVDHRA

SEQ ID NO: 769412 - protein, 19 aa, Mycobacterium
KMLEPGMLMYGWRRSSLRG

SEQ ID NO: 769413 - protein, 17 aa, Mycobacterium
KMLLERAYFLGVTAPQL

SEQ ID NO: 769414 - protein, 31 aa, Mycobacterium
KMPPRLRASVILAAWCGLRWGETSELRRKDV

SEQ ID NO: 769415 - protein, 20 aa, Mycobacterium
KMPRRFYCRARWHESPLDSE

SEQ ID NO: 769416 - protein, 18 aa, Mycobacterium
KMRVAGRIAAGALAEAGK

SEQ ID NO: 769417 - protein, 17 aa, Mycobacterium
KMSFPAAIRSNFRSLPV

SEQ ID NO: 769418 - protein, 24 aa, Mycobacterium
KMSKFEVLTAMAFAAFADAPIDVA

SEQ ID NO: 769419 - protein, 23 aa, Mycobacterium
KMSKFEVVTAMAFAAFADAPVDV

SEQ ID NO: 769420 - protein, 19 aa, Mycobacterium
KMVFGHRGINIPVIDHATG

SEQ ID NO: 769421 - protein, 19 aa, Mycobacterium
KMVFGHRGINIPVMDHATG

SEQ ID NO: 769422 - protein, 19 aa, Mycobacterium
KMVFGHRGINIPVMDHTTG

SEQ ID NO: 769423 - protein, 18 aa, Mycobacterium
KNALFPFVDFIRALSEEQ

SEQ ID NO: 769424 - protein, 23 aa, Mycobacterium
KNDGVCMVTFLPAFVSPAVARWH

SEQ ID NO: 769425 - protein, 19 aa, Mycobacterium
KNHRNAWRPAHIHFSLFGT

SEQ ID NO: 769426 - protein, 21 aa, Mycobacterium
KNKLRGGAVFAPVFDPVQVEV

SEQ ID NO: 769427 - protein, 22 aa, Mycobacterium
KNLRIPVLLIRGKLSDVVSPEG

SEQ ID NO: 769428 - protein, 17 aa, Mycobacterium
KNLYRPKVPIFIAVGEP

SEQ ID NO: 769429 - protein, 21 aa, Mycobacterium
KNPKEHFDFFPLTVDVEERMY

SEQ ID NO: 769430 - protein, 25 aa, Mycobacterium
KNPRFSLDGLRVFPFERAAERTVDH

SEQ ID NO: 769431 - protein, 21 aa, Mycobacterium
KNPRRVLGLHFFNPVPVLPLV

SEQ ID NO: 769432 - protein, 17 aa, Mycobacterium
KNQSRWQFGVLGPPGAL

SEQ ID NO: 769433 - protein, 17 aa, Mycobacterium
KNSRLGYRETINYATRI

SEQ ID NO: 769434 - protein, 25 aa, Mycobacterium
KNTWAEALWRFSLAPLQHACAFYTD

SEQ ID NO: 769435 - protein, 21 aa, Mycobacterium
KNYREAYGMFAVNGILFNHES

SEQ ID NO: 769436 - protein, 17 aa, Mycobacterium
KPAHLVVRMYSALTEAV

SEQ ID NO: 769437 - protein, 17 aa, Mycobacterium
KPAQVALAWLISLPGVV

SEQ ID NO: 769438 - protein, 17 aa, Mycobacterium
KPAQVALAWLISYPGVV

SEQ ID NO: 769439 - protein, 17 aa, Mycobacterium
KPARAGSSFGVSRVTAW

SEQ ID NO: 769440 - protein, 19 aa, Mycobacterium
KPAWLDRAWQRIIEEVAAG

SEQ ID NO: 769441 - protein, 18 aa, Mycobacterium
KPAWLDRAWQRIVEEVAA

SEQ ID NO: 769442 - protein, 17 aa, Mycobacterium
KPDLVIMDVKMPRRDGI

SEQ ID NO: 769443 - protein, 18 aa, Mycobacterium
KPEQLAWDELKAMWRADA

SEQ ID NO: 769444 - protein, 18 aa, Mycobacterium
KPEQLAWDELKTMWRADA

SEQ ID NO: 769445 - protein, 18 aa, Mycobacterium
KPESLSWAELREQWRGDG

SEQ ID NO: 769446 - protein, 18 aa, Mycobacterium
KPGMTLLDIGCGWGTTMR

SEQ ID NO: 769447 - protein, 17 aa, Mycobacterium
KPGRPLAWHSLGEALLN

SEQ ID NO: 769448 - protein, 17 aa, Mycobacterium
KPGTIPLQFQTEVRDGC

SEQ ID NO: 769449 - protein, 17 aa, Mycobacterium
KPGVSLPAPTGVFPKYQ

SEQ ID NO: 769450 - protein, 18 aa, Mycobacterium
KPIAESFGPVALPPTDPR

SEQ ID NO: 769451 - protein, 18 aa, Mycobacterium
KPIEWRYDNDPAWVLKAK

SEQ ID NO: 769452 - protein, 18 aa, Mycobacterium
KPIGGFPVTVGWIHAIRR

SEQ ID NO: 769453 - protein, 25 aa, Mycobacterium
KPLDHWDFYMALGYFKIAIIAAGIA

SEQ ID NO: 769454 - protein, 17 aa, Mycobacterium
KPLGMPLQYMVSGMAVR

SEQ ID NO: 769455 - protein, 19 aa, Mycobacterium
KPLIRRKLAEMIVDVESAQ

SEQ ID NO: 769456 - protein, 17 aa, Mycobacterium
KPLPFLFPLTNRWWERP

SEQ ID NO: 769457 - protein, 17 aa, Mycobacterium
KPLVHRWYGFSAMQKQV

SEQ ID NO: 769458 - protein, 19 aa, Mycobacterium
KPLVQRWYGFLAMQQQVAR

SEQ ID NO: 769459 - protein, 25 aa, Mycobacterium
KPLVRLRVPFTLSRYEIDNVERGAN

SEQ ID NO: 769460 - protein, 18 aa, Mycobacterium
KPLYGGSLVTGWATLHGY

SEQ ID NO: 769461 - protein, 17 aa, Mycobacterium
KPLYGSSLVTGWAQLHG

SEQ ID NO: 769462 - protein, 18 aa, Mycobacterium
KPLYGSSLVTGWARLHGY

SEQ ID NO: 769463 - protein, 18 aa, Mycobacterium
KPLYGSSLVTGWARLWGY

SEQ ID NO: 769464 - protein, 18 aa, Mycobacterium
KPLYGTSLVTGWASIHGY

SEQ ID NO: 769465 - protein, 27 aa, Mycobacterium
KPNKPVPQRGWRRWVYAVTRINFGLSP

SEQ ID NO: 769466 - protein, 17 aa, Mycobacterium
KPPAPWDYERILAAGPA

SEQ ID NO: 769467 - protein, 22 aa, Mycobacterium
KPPAVPAGLAWRRPVDAVADQC

SEQ ID NO: 769468 - protein, 21 aa, Mycobacterium
KPPDFWAWLIAAVKAIDPDVL

SEQ ID NO: 769469 - protein, 18 aa, Mycobacterium
KPPWRLSMNYYRDMWMAR

SEQ ID NO: 769470 - protein, 19 aa, Mycobacterium
KPQEMWGPDGGPGWQRNDP

SEQ ID NO: 769471 - protein, 19 aa, Mycobacterium
KPRFGHGVVAQFAPGVRLL

SEQ ID NO: 769472 - protein, 20 aa, Mycobacterium
KPRGPGYVCDIVYYCEDLPV

SEQ ID NO: 769473 - protein, 17 aa, Mycobacterium
KPRMAAYVKQLYGIYDR

SEQ ID NO: 769474 - protein, 21 aa, Mycobacterium
KPRRIPVWFMRQAGRSLPEYR

SEQ ID NO: 769475 - protein, 23 aa, Mycobacterium
KPRSCAALPRILRDNGYATGGFG

SEQ ID NO: 769476 - protein, 23 aa, Mycobacterium
KPRSCAALPRILRDNGYVTGAFG

SEQ ID NO: 769477 - protein, 20 aa, Mycobacterium
KPSRVPVWFMRQAGRSLPEY

SEQ ID NO: 769478 - protein, 21 aa, Mycobacterium
KPSRVPVWFMRQAGRSLPEYR

SEQ ID NO: 769479 - protein, 18 aa, Mycobacterium
KPSYGIAEATLFVATIAP

SEQ ID NO: 769480 - protein, 18 aa, Mycobacterium
KPTEAIAALLARYPDADT

SEQ ID NO: 769481 - protein, 19 aa, Mycobacterium
KPTELRRSIGYAIQQAGLF

SEQ ID NO: 769482 - protein, 18 aa, Mycobacterium
KPTLARRMAQLFPDASII

SEQ ID NO: 769483 - protein, 17 aa, Mycobacterium
KPTRVGYRIDDETGKKV

SEQ ID NO: 769484 - protein, 18 aa, Mycobacterium
KPTWGRVSVHGVFAMAPS

SEQ ID NO: 769485 - protein, 18 aa, Mycobacterium
KPTWSMYALGEMQPRFDN

SEQ ID NO: 769486 - protein, 20 aa, Mycobacterium
KPVAVPVLWLGAAERVSAIV

SEQ ID NO: 769487 - protein, 20 aa, Mycobacterium
KPVCCGLTWISTGQLSTAKK

SEQ ID NO: 769488 - protein, 18 aa, Mycobacterium
KPVICLVNGWAAGGGHSL

SEQ ID NO: 769489 - protein, 20 aa, Mycobacterium
KPVLWRLIATITRQWIDTTR

SEQ ID NO: 769490 - protein, 23 aa, Mycobacterium
KPVRCEIWEGFIFVNFDDDAMPL

SEQ ID NO: 769491 - protein, 23 aa, Mycobacterium
KPVRCEVWEGFIFVNFDDDAVSL

SEQ ID NO: 769492 - protein, 18 aa, Mycobacterium
KQALTESVLWPLQHPDTF

SEQ ID NO: 769493 - protein, 21 aa, Mycobacterium
KQCAHPQCVLFFYDTSKNGAR

SEQ ID NO: 769494 - protein, 22 aa, Mycobacterium
KQFKGANPWVMISNFHVKIDGC

SEQ ID NO: 769495 - protein, 21 aa, Mycobacterium
KQFPVELGKMGFVFNFITYGG

SEQ ID NO: 769496 - protein, 20 aa, Mycobacterium
KQFWPDVVGFKYKMSNIQAA

SEQ ID NO: 769497 - protein, 22 aa, Mycobacterium
KQGWKTEIWILVSPTMINKGVR

SEQ ID NO: 769498 - protein, 17 aa, Mycobacterium
KQHPDRVVAGWRVVALE

SEQ ID NO: 769499 - protein, 24 aa, Mycobacterium
KQKGFPAYFLVVGDLVSHAKEVGI

SEQ ID NO: 769500 - protein, 20 aa, Mycobacterium
KQLCCGLTWISTGQLDTARR

SEQ ID NO: 769501 - protein, 23 aa, Mycobacterium
KQPGRPTGATGLTSRSRAAGTAV

SEQ ID NO: 769502 - protein, 17 aa, Mycobacterium
KQRGHRGLAYVLIADDG

SEQ ID NO: 769503 - protein, 17 aa, Mycobacterium
KQRGHRGLAYVLVADDG

SEQ ID NO: 769504 - protein, 17 aa, Mycobacterium
KQRGHRGLAYVLVGEDG

SEQ ID NO: 769505 - protein, 17 aa, Mycobacterium
KQRSRLALWSRRLLGEA

SEQ ID NO: 769506 - protein, 17 aa, Mycobacterium
KQYARVRFDGVVVPRSA

SEQ ID NO: 769507 - protein, 18 aa, Mycobacterium
KQYERLWLSWAMANRDPA

SEQ ID NO: 769508 - protein, 18 aa, Mycobacterium
KQYERLWLSWAMANRDPS

SEQ ID NO: 769509 - protein, 22 aa, Mycobacterium
KRAHDEFRWFAGGWPVNADLPT

SEQ ID NO: 769510 - protein, 21 aa, Mycobacterium
KRARDSGIELVRIATHCTEAD

SEQ ID NO: 769511 - protein, 23 aa, Mycobacterium
KRATLRRLGVEYVYDSRTTDFAD

SEQ ID NO: 769512 - protein, 18 aa, Mycobacterium
KRATTHWLAAELLTATYP

SEQ ID NO: 769513 - protein, 20 aa, Mycobacterium
KRAYHALTFGWLLAGLARSV

SEQ ID NO: 769514 - protein, 22 aa, Mycobacterium
KRDFSEPVALNWSQHGTDVDFG

SEQ ID NO: 769515 - protein, 18 aa, Mycobacterium
KREIPHYYLADEIIMEKS

SEQ ID NO: 769516 - protein, 18 aa, Mycobacterium
KREIPHYYLADEILMEKS

SEQ ID NO: 769517 - protein, 17 aa, Mycobacterium
KRFEGVVAKKWDSTYQP

SEQ ID NO: 769518 - protein, 19 aa, Mycobacterium
KRFGADFERPVGRMRELIG

SEQ ID NO: 769519 - protein, 20 aa, Mycobacterium
KRFGRLRIATSMLLGRLERS

SEQ ID NO: 769520 - protein, 20 aa, Mycobacterium
KRFIAADGRIVWCDLTAVLV

SEQ ID NO: 769521 - protein, 19 aa, Mycobacterium
KRFLAGEFVGGGWTEANNG

SEQ ID NO: 769522 - protein, 19 aa, Mycobacterium
KRFLPGIINGSERWCQGFS

SEQ ID NO: 769523 - protein, 20 aa, Mycobacterium
KRFNLSWAIEGTRSRTGKML

SEQ ID NO: 769524 - protein, 17 aa, Mycobacterium
KRFPDRFFDVGIAEQHA

SEQ ID NO: 769525 - protein, 20 aa, Mycobacterium
KRFRILPSLWEPGGDEITLT

SEQ ID NO: 769526 - protein, 20 aa, Mycobacterium
KRFSMPWSHPVRRMREYIAA

SEQ ID NO: 769527 - protein, 20 aa, Mycobacterium
KRFSMSWSHPARRMREFVAA

SEQ ID NO: 769528 - protein, 19 aa, Mycobacterium
KRFVKGIATEAIFQKRAPE

SEQ ID NO: 769529 - protein, 19 aa, Mycobacterium
KRFVKGISEEAVFQKRAPA

SEQ ID NO: 769530 - protein, 19 aa, Mycobacterium
KRFVKGITEEAVFQKRAPA

SEQ ID NO: 769531 - protein, 19 aa, Mycobacterium
KRFVKGITQEAVFQKRAPK

SEQ ID NO: 769532 - protein, 23 aa, Mycobacterium
KRFVPSVRMFSRFTDRARRSVVG

SEQ ID NO: 769533 - protein, 21 aa, Mycobacterium
KRGAGIPVFCLHPAGGVSWPY

SEQ ID NO: 769534 - protein, 17 aa, Mycobacterium
KRGFLCQYHLWSYDLDG

SEQ ID NO: 769535 - protein, 20 aa, Mycobacterium
KRGLRCFAPTWPLGAHPRAL

SEQ ID NO: 769536 - protein, 17 aa, Mycobacterium
KRGPGIQQFACRVADLD

SEQ ID NO: 769537 - protein, 18 aa, Mycobacterium
KRHALEFATGQARFVDDI

SEQ ID NO: 769538 - protein, 17 aa, Mycobacterium
KRIDLYFPGERPLTAYH

SEQ ID NO: 769539 - protein, 19 aa, Mycobacterium
KRIGPAWVFQAGASGHMAG

SEQ ID NO: 769540 - protein, 20 aa, Mycobacterium
KRIQREIGITFIYVTHDQEE

SEQ ID NO: 769541 - protein, 19 aa, Mycobacterium
KRIQREVGITFIYVTHDQE

SEQ ID NO: 769542 - protein, 17 aa, Mycobacterium
KRIRLRVPLVSSAMDTV

SEQ ID NO: 769543 - protein, 18 aa, Mycobacterium
KRIWGTGVEPVFANSGMP

SEQ ID NO: 769544 - protein, 18 aa, Mycobacterium
KRLDPGFFYAPTLLTNVD

SEQ ID NO: 769545 - protein, 18 aa, Mycobacterium
KRLECLEVTLSEKSQTYP

SEQ ID NO: 769546 - protein, 19 aa, Mycobacterium
KRLFARMAEVFAGFLSYTD

SEQ ID NO: 769547 - protein, 21 aa, Mycobacterium
KRLGWAACRTFLAINAQWISA

SEQ ID NO: 769548 - protein, 17 aa, Mycobacterium
KRLKARYCRLLDTKDIE

SEQ ID NO: 769549 - protein, 19 aa, Mycobacterium
KRLLDWPGGLVVYDVRAEA

SEQ ID NO: 769550 - protein, 24 aa, Mycobacterium
KRLPRIAGPCGMVIFGVTGDLARK

SEQ ID NO: 769551 - protein, 17 aa, Mycobacterium
KRLRGAIAVARTVPAQL

SEQ ID NO: 769552 - protein, 20 aa, Mycobacterium
KRLSTALVITEWCQLPSGTT

SEQ ID NO: 769553 - protein, 21 aa, Mycobacterium
KRLTDFMVEFVFPAEAEYHAY

SEQ ID NO: 769554 - protein, 21 aa, Mycobacterium
KRMKPRGGGVIVNIASAAGKA

SEQ ID NO: 769555 - protein, 18 aa, Mycobacterium
KRMSEFTLGKGLDPSSTL

SEQ ID NO: 769556 - protein, 19 aa, Mycobacterium
KRPAPLPFLSIKKIEVHYR

SEQ ID NO: 769557 - protein, 19 aa, Mycobacterium
KRPEMLRFLPADAQCVLEL

SEQ ID NO: 769558 - protein, 19 aa, Mycobacterium
KRPPPAPNWYGASSNNYGS

SEQ ID NO: 769559 - protein, 20 aa, Mycobacterium
KRPQLGIANWVVPSIVAFGT

SEQ ID NO: 769560 - protein, 19 aa, Mycobacterium
KRPTFSNSYYRTFTKPHVH

SEQ ID NO: 769561 - protein, 17 aa, Mycobacterium
KRRCLHYHLGFPTPQRE

SEQ ID NO: 769562 - protein, 24 aa, Mycobacterium
KRREVVEPFLLCWKDIVGTLTSLA

SEQ ID NO: 769563 - protein, 23 aa, Mycobacterium
KRRGVALTRVIDWMAAKPAELAG

SEQ ID NO: 769564 - protein, 25 aa, Mycobacterium
KRRIHGVIFFPQWIRVHGERTVCYQ

SEQ ID NO: 769565 - protein, 19 aa, Mycobacterium
KRRRFPVEIVRRTRAAVGP

SEQ ID NO: 769566 - protein, 18 aa, Mycobacterium
KRRVPILGLCLGLQCMVI

SEQ ID NO: 769567 - protein, 17 aa, Mycobacterium
KRSALLPLLHLVQAEDS

SEQ ID NO: 769568 - protein, 18 aa, Mycobacterium
KRSALLPLLHLVQAQDSY

SEQ ID NO: 769569 - protein, 24 aa, Mycobacterium
KRSWLRARGLKLFPLVGWAERGGY

SEQ ID NO: 769570 - protein, 21 aa, Mycobacterium
KRTGESFCLKAWKSFGIAGVI

SEQ ID NO: 769571 - protein, 20 aa, Mycobacterium
KRTGLWPGLRDTFKSGTSAP

SEQ ID NO: 769572 - protein, 19 aa, Mycobacterium
KRTLDAWLRELTATISAAQ

SEQ ID NO: 769573 - protein, 20 aa, Mycobacterium
KRTLPEWSERFATLAGPWAP

SEQ ID NO: 769574 - protein, 17 aa, Mycobacterium
KRTRLGVGHFVETLETY

SEQ ID NO: 769575 - protein, 18 aa, Mycobacterium
KRTRLGVGHFVETLETYR

SEQ ID NO: 769576 - protein, 21 aa, Mycobacterium
KRTRLWPGLQETFKSGSAEIP

SEQ ID NO: 769577 - protein, 17 aa, Mycobacterium
KRVALVFSAYPTKHARI

SEQ ID NO: 769578 - protein, 20 aa, Mycobacterium
KRVCRDCGFFLPLAGALGAM

SEQ ID NO: 769579 - protein, 19 aa, Mycobacterium
KRVCRDCGFFLPLAGSLGA

SEQ ID NO: 769580 - protein, 18 aa, Mycobacterium
KRVEGIGFFAGLLGQHTV

SEQ ID NO: 769581 - protein, 21 aa, Mycobacterium
KRVEGRSGVWLAAGGGKPERK

SEQ ID NO: 769582 - protein, 20 aa, Mycobacterium
KRVGLWPGLADTFGSGKVDI

SEQ ID NO: 769583 - protein, 20 aa, Mycobacterium
KRVGLWPGLADTFGSGSGAV

SEQ ID NO: 769584 - protein, 20 aa, Mycobacterium
KRVLPGLGYRLTSRGVRVAT

SEQ ID NO: 769585 - protein, 20 aa, Mycobacterium
KRVLSWRGGERMMTDLAHLT

SEQ ID NO: 769586 - protein, 20 aa, Mycobacterium
KRWHAIAEIIGRSWDDVLGA

SEQ ID NO: 769587 - protein, 20 aa, Mycobacterium
KRWNAIGEIIGRGWDDVLGA

SEQ ID NO: 769588 - protein, 22 aa, Mycobacterium
KRWPRYRRYALEQTPIRSILSY

SEQ ID NO: 769589 - protein, 19 aa, Mycobacterium
KRWQLCLDVNTTGVFLVTK

SEQ ID NO: 769590 - protein, 25 aa, Mycobacterium
KRWVTECIRSAYPLGQGHGPVSALF

SEQ ID NO: 769591 - protein, 21 aa, Mycobacterium
KRWVTECLRAAYPLGAGHGPV

SEQ ID NO: 769592 - protein, 17 aa, Mycobacterium
KRYAAGFSRELEDEWQL

SEQ ID NO: 769593 - protein, 20 aa, Mycobacterium
KRYAAGFSRELEDEWQLPDA

SEQ ID NO: 769594 - protein, 20 aa, Mycobacterium
KRYALPHARILMHQPLGGIT

SEQ ID NO: 769595 - protein, 19 aa, Mycobacterium
KRYALPHARILMHQPLGGV

SEQ ID NO: 769596 - protein, 20 aa, Mycobacterium
KRYALPHARILMHQPLGGVT

SEQ ID NO: 769597 - protein, 21 aa, Mycobacterium
KRYPLGKAESFFHVRLENGTV

SEQ ID NO: 769598 - protein, 17 aa, Mycobacterium
KSAITLVGFDMAKLAAQ

SEQ ID NO: 769599 - protein, 19 aa, Mycobacterium
KSALPWGDFDAHLDHMRAL

SEQ ID NO: 769600 - protein, 21 aa, Mycobacterium
KSARPAAGYLVEWDLPADLDM

SEQ ID NO: 769601 - protein, 19 aa, Mycobacterium
KSDHCLLDLLWRNRRGELE

SEQ ID NO: 769602 - protein, 18 aa, Mycobacterium
KSDLRFASTFTWNTLPLP

SEQ ID NO: 769603 - protein, 19 aa, Mycobacterium
KSELFLAIFEQLADDVERR

SEQ ID NO: 769604 - protein, 19 aa, Mycobacterium
KSGVLSRVWHGIYGRGELT

SEQ ID NO: 769605 - protein, 17 aa, Mycobacterium
KSIPISLALPWGLNISD

SEQ ID NO: 769606 - protein, 23 aa, Mycobacterium
KSKKIAALPWFWSDQYDLKLQIA

SEQ ID NO: 769607 - protein, 17 aa, Mycobacterium
KSLPRVIVCGSDVIALG

SEQ ID NO: 769608 - protein, 22 aa, Mycobacterium
KSLRAGKIFLDWSQNNGSKTTI

SEQ ID NO: 769609 - protein, 17 aa, Mycobacterium
KSLRPGWQRERQRNFHS

SEQ ID NO: 769610 - protein, 22 aa, Mycobacterium
KSNEFFKLWLDPSMTYSCGYFD

SEQ ID NO: 769611 - protein, 24 aa, Mycobacterium
KSQLQRCASFTFSGPDQIQSTVTA

SEQ ID NO: 769612 - protein, 17 aa, Mycobacterium
KSRILAMAEPDAAGVRP

SEQ ID NO: 769613 - protein, 23 aa, Mycobacterium
KSRSEMAWCFPAVPMVVRAPAAK

SEQ ID NO: 769614 - protein, 22 aa, Mycobacterium
KSRTEMAWCFPAVPMVVRAPAA

SEQ ID NO: 769615 - protein, 26 aa, Mycobacterium
KSSRYPGGLALRFARVVRYRDDKGPA

SEQ ID NO: 769616 - protein, 25 aa, Mycobacterium
KSTLLLKVAHRWALSGRRALYISGE

SEQ ID NO: 769617 - protein, 24 aa, Mycobacterium
KSTLLLKVVHQWAASGGRALYISG

SEQ ID NO: 769618 - protein, 25 aa, Mycobacterium
KSTRYPGGVALRFARVLRYRDDKSP

SEQ ID NO: 769619 - protein, 21 aa, Mycobacterium
KSVLSEARWNIQYFGRTTYLG

SEQ ID NO: 769620 - protein, 21 aa, Mycobacterium
KSVVQRGLWFEEFEIGTTYLH

SEQ ID NO: 769621 - protein, 19 aa, Mycobacterium
KSYVRRLMREAGFTTVRTY

SEQ ID NO: 769622 - protein, 18 aa, Mycobacterium
KTAKEMKVPAFVVFTDNT

SEQ ID NO: 769623 - protein, 18 aa, Mycobacterium
KTALGTGFFLTWLTTYTD

SEQ ID NO: 769624 - protein, 20 aa, Mycobacterium
KTARWPFLFRLTTIKKPETR

SEQ ID NO: 769625 - protein, 18 aa, Mycobacterium
KTGAGWQPEIWRAFAEEL

SEQ ID NO: 769626 - protein, 18 aa, Mycobacterium
KTHCKTCLVVRREGSAIR

SEQ ID NO: 769627 - protein, 18 aa, Mycobacterium
KTHCKTCLVVRREGSTIR

SEQ ID NO: 769628 - protein, 17 aa, Mycobacterium
KTISFAGAEAFRDDANG

SEQ ID NO: 769629 - protein, 17 aa, Mycobacterium
KTLPLVQLLPFLKSQEA

SEQ ID NO: 769630 - protein, 24 aa, Mycobacterium
KTLRADEALPLFAISVGAALVRTD

SEQ ID NO: 769631 - protein, 17 aa, Mycobacterium
KTLRYVERFTFVGGDID

SEQ ID NO: 769632 - protein, 19 aa, Mycobacterium
KTMGIPILYPWANRLSSMG

SEQ ID NO: 769633 - protein, 20 aa, Mycobacterium
KTPKKVCHRITLGSGRNKVT

SEQ ID NO: 769634 - protein, 19 aa, Mycobacterium
KTQLAMRLGEWFGTDEHGR

SEQ ID NO: 769635 - protein, 21 aa, Mycobacterium
KTQRLLAERGFEIVTGQGGMD

SEQ ID NO: 769636 - protein, 21 aa, Mycobacterium
KTRGGAIFRPVFNQLSVEVGF

SEQ ID NO: 769637 - protein, 21 aa, Mycobacterium
KTRKCAFCTKKALNIDYKDTN

SEQ ID NO: 769638 - protein, 20 aa, Mycobacterium
KTRWSGCANRSLTVTSPGHA

SEQ ID NO: 769639 - protein, 22 aa, Mycobacterium
KTSEVSTVWTWPDKPGVAGCAA

SEQ ID NO: 769640 - protein, 20 aa, Mycobacterium
KTSFKAGALIGRGSGEALQV

SEQ ID NO: 769641 - protein, 19 aa, Mycobacterium
KTTCALALFSTGEQLNIPD

SEQ ID NO: 769642 - protein, 18 aa, Mycobacterium
KTVIGLNMLRLWDDRGTL

SEQ ID NO: 769643 - protein, 17 aa, Mycobacterium
KTWLQFPQWFYLDLPVN

SEQ ID NO: 769644 - protein, 19 aa, Mycobacterium
KTWLQFPQWFYLNIPVNTM

SEQ ID NO: 769645 - protein, 19 aa, Mycobacterium
KVAGWLNEHGWRATARNAG

SEQ ID NO: 769646 - protein, 19 aa, Mycobacterium
KVAKWWIPERWSFVSDIPR

SEQ ID NO: 769647 - protein, 20 aa, Mycobacterium
KVALPLVRKALELMPNVGFV

SEQ ID NO: 769648 - protein, 22 aa, Mycobacterium
KVARFLFGLARRYGPNWLAGAQ

SEQ ID NO: 769649 - protein, 18 aa, Mycobacterium
KVARWWLPERWAVAEEIP

SEQ ID NO: 769650 - protein, 17 aa, Mycobacterium
KVATGFAKPAGIFTLTD

SEQ ID NO: 769651 - protein, 18 aa, Mycobacterium
KVAWDFIHATGFLGGQIT

SEQ ID NO: 769652 - protein, 18 aa, Mycobacterium
KVDGGWRITGQKIWTTGA

SEQ ID NO: 769653 - protein, 19 aa, Mycobacterium
KVDGGWRITGQKIWTTGAQ

SEQ ID NO: 769654 - protein, 31 aa, Mycobacterium
KVEGLFRIAEAWPRRPGARMLVCSSVSGLWG

SEQ ID NO: 769655 - protein, 17 aa, Mycobacterium
KVFEGFETPTLVGPPGR

SEQ ID NO: 769656 - protein, 17 aa, Mycobacterium
KVFPLSIVQHFARIWLG

SEQ ID NO: 769657 - protein, 17 aa, Mycobacterium
KVGLPLVRRALELLPDV

SEQ ID NO: 769658 - protein, 22 aa, Mycobacterium
KVGRQVPMGALAPGDLVFSNFS

SEQ ID NO: 769659 - protein, 19 aa, Mycobacterium
KVHAITAVHDCGRVVEPVL

SEQ ID NO: 769660 - protein, 17 aa, Mycobacterium
KVHLDAFNLLPYLTGEV

SEQ ID NO: 769661 - protein, 24 aa, Mycobacterium
KVICRRSRLCTRLAGSGAMASVEL

SEQ ID NO: 769662 - protein, 17 aa, Mycobacterium
KVIKFSGCYHGHVDALL

SEQ ID NO: 769663 - protein, 24 aa, Mycobacterium
KVLAAKADAAWHLHQLTADADLDA

SEQ ID NO: 769664 - protein, 19 aa, Mycobacterium
KVLDWPTGHITRIRRGAAP

SEQ ID NO: 769665 - protein, 22 aa, Mycobacterium
KVLGRPAVPFAQWVAEHRDVFA

SEQ ID NO: 769666 - protein, 18 aa, Mycobacterium
KVLILKANGKGFCSGHAI

SEQ ID NO: 769667 - protein, 18 aa, Mycobacterium
KVLNPYFSPGRMKDLEPQ

SEQ ID NO: 769668 - protein, 17 aa, Mycobacterium
KVLPRKASHLTIRTYNA

SEQ ID NO: 769669 - protein, 17 aa, Mycobacterium
KVLRFLGTLPILEPLLP

SEQ ID NO: 769670 - protein, 18 aa, Mycobacterium
KVLRRFGKKPADTKTVLV

SEQ ID NO: 769671 - protein, 24 aa, Mycobacterium
KVLVHPRPRLSVMCVGGELVDVSR

SEQ ID NO: 769672 - protein, 18 aa, Mycobacterium
KVLVLKANGKGFCSGHAI

SEQ ID NO: 769673 - protein, 17 aa, Mycobacterium
KVPGARCALAWSLETAV

SEQ ID NO: 769674 - protein, 19 aa, Mycobacterium
KVPGARCALAWSTETATLA

SEQ ID NO: 769675 - protein, 23 aa, Mycobacterium
KVPGARCALAWSVETATLAREHN

SEQ ID NO: 769676 - protein, 17 aa, Mycobacterium
KVPRRLKELHLRLGTAT

SEQ ID NO: 769677 - protein, 17 aa, Mycobacterium
KVRGAGVPAEVMRLDRL

SEQ ID NO: 769678 - protein, 19 aa, Mycobacterium
KVRLRQGLPVGLLNSEERE

SEQ ID NO: 769679 - protein, 19 aa, Mycobacterium
KVRRLRRLAGLWLSEQDAR

SEQ ID NO: 769680 - protein, 22 aa, Mycobacterium
KVSCAGLVLGSWPAHPGLVESS

SEQ ID NO: 769681 - protein, 17 aa, Mycobacterium
KVSPLAVQMIMPNGAAA

SEQ ID NO: 769682 - protein, 17 aa, Mycobacterium
KVTATFFNPKWLKKTLV

SEQ ID NO: 769683 - protein, 18 aa, Mycobacterium
KVTCAIVSVGAWVEGASQ

SEQ ID NO: 769684 - protein, 19 aa, Mycobacterium
KVTGQRVVARFGGAVPGSD

SEQ ID NO: 769685 - protein, 22 aa, Mycobacterium
KVTKMMFDWAIGVGIKVSQARQ

SEQ ID NO: 769686 - protein, 24 aa, Mycobacterium
KVVELRASLDWDKGRTLRGILEQI

SEQ ID NO: 769687 - protein, 17 aa, Mycobacterium
KVVGWARERGSVVASDE

SEQ ID NO: 769688 - protein, 17 aa, Mycobacterium
KVVGWSRDRGVVVASDE

SEQ ID NO: 769689 - protein, 17 aa, Mycobacterium
KVVICLVNGWAAGGGHS

SEQ ID NO: 769690 - protein, 19 aa, Mycobacterium
KVVVFRPLYAVGGQELGYL

SEQ ID NO: 769691 - protein, 20 aa, Mycobacterium
KWASIVPHTWLWTSPLGPEV

SEQ ID NO: 769692 - protein, 21 aa, Mycobacterium
KWATYPILAVQGWAQHHELQL

SEQ ID NO: 769693 - protein, 18 aa, Mycobacterium
KWELCDALNKQIHNDNVA

SEQ ID NO: 769694 - protein, 24 aa, Mycobacterium
KWGPAVAALARWSGDLTVAEDAVQ

SEQ ID NO: 769695 - protein, 18 aa, Mycobacterium
KWHRARVIGGFEAEDYKQ

SEQ ID NO: 769696 - protein, 20 aa, Mycobacterium
KWKFTVPFVCGATNLGEALR

SEQ ID NO: 769697 - protein, 21 aa, Mycobacterium
KWLKPTAYMMAKFGMTLCALG

SEQ ID NO: 769698 - protein, 19 aa, Mycobacterium
KWPEPNFPVSNFFHGGAAP

SEQ ID NO: 769699 - protein, 21 aa, Mycobacterium
KWPNRPDPLLAARYPAIAGQN

SEQ ID NO: 769700 - protein, 20 aa, Mycobacterium
KWQRPGSETVWFEIHVNPLV

SEQ ID NO: 769701 - protein, 18 aa, Mycobacterium
KWQRTEPEFAYSDRERDG

SEQ ID NO: 769702 - protein, 20 aa, Mycobacterium
KWRKWLYFQCNWKVAMEAFN

SEQ ID NO: 769703 - protein, 18 aa, Mycobacterium
KWTAALIGPWWPASATIL

SEQ ID NO: 769704 - protein, 24 aa, Mycobacterium
KWVTECIRAAYPLGRGHGPVSPLF

SEQ ID NO: 769705 - protein, 19 aa, Mycobacterium
KWVTFPIAALQGWAESHHT

SEQ ID NO: 769706 - protein, 18 aa, Mycobacterium
KYAIEHWTRLPVEIELAS

SEQ ID NO: 769707 - protein, 17 aa, Mycobacterium
KYGGLGFANWAYEVAAQ

SEQ ID NO: 769708 - protein, 18 aa, Mycobacterium
KYGGTSFELFAKISEKNH

SEQ ID NO: 769709 - protein, 19 aa, Mycobacterium
KYGLRRYIEFGAHVDRAHW

SEQ ID NO: 769710 - protein, 19 aa, Mycobacterium
KYHAWRYALNGDLTFIQQE

SEQ ID NO: 769711 - protein, 19 aa, Mycobacterium
KYHAWRYGLDGELTFIQQE

SEQ ID NO: 769712 - protein, 19 aa, Mycobacterium
KYHGWRYGLDGELTFVQQP

SEQ ID NO: 769713 - protein, 24 aa, Mycobacterium
KYKSEPWARLGVNVDADFEPLYII

SEQ ID NO: 769714 - protein, 18 aa, Mycobacterium
KYPARLIDEYAWETDLGD

SEQ ID NO: 769715 - protein, 17 aa, Mycobacterium
KYRLVFEKLRLRPGDRL

SEQ ID NO: 769716 - protein, 20 aa, Mycobacterium
KYWPPVRRIDGVHGDRNLVC

SEQ ID NO: 769717 - protein, 20 aa, Mycobacterium
KYYAMTGWRLGWLLVPAELR

SEQ ID NO: 769718 - protein, 17 aa, Mycobacterium
KYYKWVRQWLDDLELKE

SEQ ID NO: 769719 - protein, 18 aa, Mycobacterium
LAAAAAWDVLANGLESAA

SEQ ID NO: 769720 - protein, 17 aa, Mycobacterium
LAAALGLSPVTNPVAGD

SEQ ID NO: 769721 - protein, 24 aa, Mycobacterium
LAAARPGVHWIREFLPTPKLREVL

SEQ ID NO: 769722 - protein, 19 aa, Mycobacterium
LAAAVHGWAPSGLLDTYHG

SEQ ID NO: 769723 - protein, 18 aa, Mycobacterium
LAAAVWRQAMPETEQLIV

SEQ ID NO: 769724 - protein, 17 aa, Mycobacterium
LAADCWLVLGERHVAEY

SEQ ID NO: 769725 - protein, 19 aa, Mycobacterium
LAADIRRADCQFVVTDAEH

SEQ ID NO: 769726 - protein, 17 aa, Mycobacterium
LAAELRAEFDIYLLDFP

SEQ ID NO: 769727 - protein, 23 aa, Mycobacterium
LAAELRLPLVLMIDTAGPALSAE

SEQ ID NO: 769728 - protein, 17 aa, Mycobacterium
LAAELRSAAAAFLAVTS

SEQ ID NO: 769729 - protein, 21 aa, Mycobacterium
LAAELRTCWNIEFDDAGAIGR

SEQ ID NO: 769730 - protein, 25 aa, Mycobacterium
LAAFVARIRPAFLLLQTAFCVGITR

SEQ ID NO: 769731 - protein, 20 aa, Mycobacterium
LAAGLARIWSELLGRRIGAE

SEQ ID NO: 769732 - protein, 18 aa, Mycobacterium
LAAHAAVFWIARGRTATR

SEQ ID NO: 769733 - protein, 17 aa, Mycobacterium
LAAHAGDGRRCGLTVVG

SEQ ID NO: 769734 - protein, 17 aa, Mycobacterium
LAAIATVAAAATDTADR

SEQ ID NO: 769735 - protein, 17 aa, Mycobacterium
LAAIRARGAHPYLVTPD

SEQ ID NO: 769736 - protein, 17 aa, Mycobacterium
LAAKGFAAKGGWGPGMH

SEQ ID NO: 769737 - protein, 23 aa, Mycobacterium
LAAKTWWRGVKWSADVATTTGTK

SEQ ID NO: 769738 - protein, 20 aa, Mycobacterium
LAALCGPVFGDLPLPPLGEY

SEQ ID NO: 769739 - protein, 18 aa, Mycobacterium
LAALGRWMSSSQMEAVEE

SEQ ID NO: 769740 - protein, 17 aa, Mycobacterium
LAALGWVRDNIAAFGGD

SEQ ID NO: 769741 - protein, 17 aa, Mycobacterium
LAALHRCCVALDGVGRA

SEQ ID NO: 769742 - protein, 17 aa, Mycobacterium
LAALHWVRENIAAFGGD

SEQ ID NO: 769743 - protein, 18 aa, Mycobacterium
LAALIAHAGFDCYSTDVM

SEQ ID NO: 769744 - protein, 18 aa, Mycobacterium
LAALPARTAVRWRHTHDF

SEQ ID NO: 769745 - protein, 17 aa, Mycobacterium
LAANVAERFGIPLAALH

SEQ ID NO: 769746 - protein, 18 aa, Mycobacterium
LAAQRFGEFNGFWRDDGF

SEQ ID NO: 769747 - protein, 17 aa, Mycobacterium
LAAQRYGEFNGFWRDDG

SEQ ID NO: 769748 - protein, 17 aa, Mycobacterium
LAARGEVLDSCLYTTPS

SEQ ID NO: 769749 - protein, 21 aa, Mycobacterium
LAARLKAAWAPTGLVQRSQGK

SEQ ID NO: 769750 - protein, 20 aa, Mycobacterium
LAARLSGYARYRKILAGANL

SEQ ID NO: 769751 - protein, 23 aa, Mycobacterium
LAARWLRPGGVFAVEHDDTTAAR

SEQ ID NO: 769752 - protein, 18 aa, Mycobacterium
LAATAVLISPAWKRDEVD

SEQ ID NO: 769753 - protein, 18 aa, Mycobacterium
LAAVEAFFGAGADRQLDV

SEQ ID NO: 769754 - protein, 18 aa, Mycobacterium
LAAVEAFFGAGAQRQLDV

SEQ ID NO: 769755 - protein, 21 aa, Mycobacterium
LAAVLRKGYKLGDRVLRTAMV

SEQ ID NO: 769756 - protein, 22 aa, Mycobacterium
LAAWLVLCCRAMEAGAQEALAI

SEQ ID NO: 769757 - protein, 19 aa, Mycobacterium
LACALVCRPDLLVLDEPTV

SEQ ID NO: 769758 - protein, 22 aa, Mycobacterium
LACARLGIMHSVVFAGFTAKAL

SEQ ID NO: 769759 - protein, 22 aa, Mycobacterium
LACARLGIMHSVVFGGFTANAL

SEQ ID NO: 769760 - protein, 22 aa, Mycobacterium
LACARLGLMHSVVFAGFSAAAL

SEQ ID NO: 769761 - protein, 18 aa, Mycobacterium
LADCRRLGITVLPPDVNE

SEQ ID NO: 769762 - protein, 19 aa, Mycobacterium
LADCRRLGITVLPPDVNES

SEQ ID NO: 769763 - protein, 18 aa, Mycobacterium
LADDAALPRCRQTVHRGV

SEQ ID NO: 769764 - protein, 17 aa, Mycobacterium
LADEGFLALAFDPRTVG

SEQ ID NO: 769765 - protein, 24 aa, Mycobacterium
LADEILTPLGFRWTNYGVAPEDVP

SEQ ID NO: 769766 - protein, 24 aa, Mycobacterium
LADFWRFNVQFARQILAEQPNSGG

SEQ ID NO: 769767 - protein, 17 aa, Mycobacterium
LADGIDIVGAWAEKVGL

SEQ ID NO: 769768 - protein, 18 aa, Mycobacterium
LADGLYRYSLLDIIEVAS

SEQ ID NO: 769769 - protein, 20 aa, Mycobacterium
LADGWLPLLHKWFDLAVASG

SEQ ID NO: 769770 - protein, 23 aa, Mycobacterium
LADHRIAGVMLFPGAGFVELAIR

SEQ ID NO: 769771 - protein, 17 aa, Mycobacterium
LADLAAIGVRWELPVVW

SEQ ID NO: 769772 - protein, 18 aa, Mycobacterium
LADLRVARLLAYRAVALR

SEQ ID NO: 769773 - protein, 24 aa, Mycobacterium
LADLSLPVLRSWLGAQARQGAARS

SEQ ID NO: 769774 - protein, 20 aa, Mycobacterium
LADLVFPTLPAPIAATGSDP

SEQ ID NO: 769775 - protein, 18 aa, Mycobacterium
LADMKARIDAARLLVWRA

SEQ ID NO: 769776 - protein, 18 aa, Mycobacterium
LADMKARIDAARLLVYRA

SEQ ID NO: 769777 - protein, 22 aa, Mycobacterium
LADYKGRRVIVYFYPAASTPGC

SEQ ID NO: 769778 - protein, 19 aa, Mycobacterium
LAEAAGWAAGPWAAAKTLS

SEQ ID NO: 769779 - protein, 21 aa, Mycobacterium
LAEAIARFGPIFAQYYGQSEA

SEQ ID NO: 769780 - protein, 24 aa, Mycobacterium
LAEALKRFGPIFAQYYGQSEAPMV

SEQ ID NO: 769781 - protein, 23 aa, Mycobacterium
LAEARTGVFWVREMLPQPKIDEI

SEQ ID NO: 769782 - protein, 21 aa, Mycobacterium
LAEARVGWRLMLAGPASVCLR

SEQ ID NO: 769783 - protein, 19 aa, Mycobacterium
LAEELGRPLSLIAESDLND

SEQ ID NO: 769784 - protein, 22 aa, Mycobacterium
LAEELWLRLGHAVSLAHGPFPE

SEQ ID NO: 769785 - protein, 21 aa, Mycobacterium
LAEELWLRLGHTTSLAHGPFP

SEQ ID NO: 769786 - protein, 20 aa, Mycobacterium
LAEHEMPGLMALRREYAEVL

SEQ ID NO: 769787 - protein, 20 aa, Mycobacterium
LAEHEMPGLMALRREYHDVQ

SEQ ID NO: 769788 - protein, 18 aa, Mycobacterium
LAEKLWKLRILDDERSAS

SEQ ID NO: 769789 - protein, 26 aa, Mycobacterium
LAELARVWKLLPFEADWFSSNELARH

SEQ ID NO: 769790 - protein, 20 aa, Mycobacterium
LAELCQRADLLPGIDGRTFV

SEQ ID NO: 769791 - protein, 18 aa, Mycobacterium
LAELCQRRDILLIVDDVQ

SEQ ID NO: 769792 - protein, 18 aa, Mycobacterium
LAELFAPLAKQLVENEDQ

SEQ ID NO: 769793 - protein, 18 aa, Mycobacterium
LAELGLDWDRIIELKTAG

SEQ ID NO: 769794 - protein, 18 aa, Mycobacterium
LAELPGRFLFSLDDGRGD

SEQ ID NO: 769795 - protein, 17 aa, Mycobacterium
LAELWVAATRIRQVDQL

SEQ ID NO: 769796 - protein, 23 aa, Mycobacterium
LAEPPVGCSYNFERVVEDRRDPK

SEQ ID NO: 769797 - protein, 19 aa, Mycobacterium
LAEQCRRLDALGIDYEIVP

SEQ ID NO: 769798 - protein, 19 aa, Mycobacterium
LAERDRFALLHGDYRLDNL

SEQ ID NO: 769799 - protein, 23 aa, Mycobacterium
LAERLCGWQERYPDVVTHKVVVS

SEQ ID NO: 769800 - protein, 19 aa, Mycobacterium
LAERTGWSVARVRRRLAAL

SEQ ID NO: 769801 - protein, 26 aa, Mycobacterium
LAERVGWRWRLIWYKAVAELLTGDYD

SEQ ID NO: 769802 - protein, 26 aa, Mycobacterium
LAERVGWRWRLVWFRAVSELLTADYD

SEQ ID NO: 769803 - protein, 18 aa, Mycobacterium
LAESILVRKVDWVDEITR

SEQ ID NO: 769804 - protein, 18 aa, Mycobacterium
LAEWGCSANERLIHVDGP

SEQ ID NO: 769805 - protein, 17 aa, Mycobacterium
LAFALHCDIRIAAEDAR

SEQ ID NO: 769806 - protein, 19 aa, Mycobacterium
LAFERQWWKFAGVKEDAIK

SEQ ID NO: 769807 - protein, 19 aa, Mycobacterium
LAFERQWWKYAGSKEDAIK

SEQ ID NO: 769808 - protein, 18 aa, Mycobacterium
LAFHAASLIMSRGPSSVA

SEQ ID NO: 769809 - protein, 21 aa, Mycobacterium
LAFPCVWIAPWTRADGLVPLR

SEQ ID NO: 769810 - protein, 17 aa, Mycobacterium
LAFRCVTPFDAWTMTYE

SEQ ID NO: 769811 - protein, 17 aa, Mycobacterium
LAFTGRRLFAVIVLTIR

SEQ ID NO: 769812 - protein, 17 aa, Mycobacterium
LAFVCAVDMPFLAVELI

SEQ ID NO: 769813 - protein, 20 aa, Mycobacterium
LAGAVTLVWHAGEVRQVNEL

SEQ ID NO: 769814 - protein, 22 aa, Mycobacterium
LAGEFDFRYLVGVLSVLADKDV

SEQ ID NO: 769815 - protein, 17 aa, Mycobacterium
LAGEIDRPVSFALIQVD

SEQ ID NO: 769816 - protein, 25 aa, Mycobacterium
LAGETRFGLPWVVGQVISEHTPDSY

SEQ ID NO: 769817 - protein, 26 aa, Mycobacterium
LAGHALKASIAWRTLRAHLLARGNDH

SEQ ID NO: 769818 - protein, 21 aa, Mycobacterium
LAGIRRQLGWWLRAADVSDER

SEQ ID NO: 769819 - protein, 24 aa, Mycobacterium
LAGLAWPDARLVAAAVSFDVCTAP

SEQ ID NO: 769820 - protein, 19 aa, Mycobacterium
LAGLGRLALSPVFREPRQV

SEQ ID NO: 769821 - protein, 18 aa, Mycobacterium
LAGLRLALMHGRLSADEK

SEQ ID NO: 769822 - protein, 23 aa, Mycobacterium
LAGLTEMRWRLSIFGDGPDRERL

SEQ ID NO: 769823 - protein, 18 aa, Mycobacterium
LAGPRPVVLHGFDPARAT

SEQ ID NO: 769824 - protein, 17 aa, Mycobacterium
LAGRWALLWPRDAPAPG

SEQ ID NO: 769825 - protein, 20 aa, Mycobacterium
LAGRWLRPGGLIGIEHDDTT

SEQ ID NO: 769826 - protein, 19 aa, Mycobacterium
LAGSHFRSDIGLRAAERKI

SEQ ID NO: 769827 - protein, 17 aa, Mycobacterium
LAGTGCRAVAFERDEAR

SEQ ID NO: 769828 - protein, 20 aa, Mycobacterium
LAGTVLRFVPPLAALSAAPI

SEQ ID NO: 769829 - protein, 20 aa, Mycobacterium
LAGTVLRFVPPLAALSAAVV

SEQ ID NO: 769830 - protein, 17 aa, Mycobacterium
LAGVIAFGDRVLRQYLL

SEQ ID NO: 769831 - protein, 17 aa, Mycobacterium
LAGVYAFSGITATSTDA

SEQ ID NO: 769832 - protein, 18 aa, Mycobacterium
LAGYAAWVTGLRRVDAPT

SEQ ID NO: 769833 - protein, 23 aa, Mycobacterium
LAHLPGYQGWQWAVVVAAHPGAD

SEQ ID NO: 769834 - protein, 24 aa, Mycobacterium
LAHLPGYQGWQWAVVVAAYAGADH

SEQ ID NO: 769835 - protein, 18 aa, Mycobacterium
LAHLRAFVLIPWLAVDPD

SEQ ID NO: 769836 - protein, 18 aa, Mycobacterium
LAHLRLGLMHGRLSGDEK

SEQ ID NO: 769837 - protein, 23 aa, Mycobacterium
LAHPCPMCLGSLYYCSPDEVIFL

SEQ ID NO: 769838 - protein, 23 aa, Mycobacterium
LAHPCPMCLGSLYYCSPDEVVFL

SEQ ID NO: 769839 - protein, 23 aa, Mycobacterium
LAHPCPMCLGSLYYCSPREVVFL

SEQ ID NO: 769840 - protein, 18 aa, Mycobacterium
LAHPFRFVAHNGEINTVR

SEQ ID NO: 769841 - protein, 23 aa, Mycobacterium
LAHRARWGLLLARTNPDVPKHKG

SEQ ID NO: 769842 - protein, 22 aa, Mycobacterium
LAIDHFRYFAGVLRAQEGSISE

SEQ ID NO: 769843 - protein, 23 aa, Mycobacterium
LAIDHFRYFAGVLRAQEGSLSQI

SEQ ID NO: 769844 - protein, 22 aa, Mycobacterium
LAIDHLRYFAGAIRAQEGGLSQ

SEQ ID NO: 769845 - protein, 24 aa, Mycobacterium
LAILRRPRAGLSYETLLATVEQRL

SEQ ID NO: 769846 - protein, 18 aa, Mycobacterium
LAIPELPDELFIESLCQL

SEQ ID NO: 769847 - protein, 17 aa, Mycobacterium
LAIPELPDELFIESLRQ

SEQ ID NO: 769848 - protein, 21 aa, Mycobacterium
LAISLRLGRGIAHQLKPHDPV

SEQ ID NO: 769849 - protein, 19 aa, Mycobacterium
LAKACARIMLGANISQLRT

SEQ ID NO: 769850 - protein, 20 aa, Mycobacterium
LAKACARIMLGASIAELREE

SEQ ID NO: 769851 - protein, 20 aa, Mycobacterium
LAKACARIMLGASISQLRAE

SEQ ID NO: 769852 - protein, 20 aa, Mycobacterium
LAKACARIMLGATIAGLREE

SEQ ID NO: 769853 - protein, 23 aa, Mycobacterium
LAKGFPKPMGWGVRLTGKKFFRS

SEQ ID NO: 769854 - protein, 19 aa, Mycobacterium
LAKISARVCAPVGVSVHGR

SEQ ID NO: 769855 - protein, 25 aa, Mycobacterium
LAKKIKADWGIEVPMEILPLLTIRD

SEQ ID NO: 769856 - protein, 17 aa, Mycobacterium
LAKLPRDRMPVLYCKTG

SEQ ID NO: 769857 - protein, 18 aa, Mycobacterium
LAKLRGATVLAHNYQLPA

SEQ ID NO: 769858 - protein, 18 aa, Mycobacterium
LAKLRGATVLAHNYQLPE

SEQ ID NO: 769859 - protein, 18 aa, Mycobacterium
LAKMAGYHLGWWDVNGVP

SEQ ID NO: 769860 - protein, 17 aa, Mycobacterium
LAKPFAWALIKLDGADT

SEQ ID NO: 769861 - protein, 17 aa, Mycobacterium
LAKRGGAELHYLRKVIE

SEQ ID NO: 769862 - protein, 25 aa, Mycobacterium
LAKRWARWRLSTGLGLEAGGGRPVV

SEQ ID NO: 769863 - protein, 20 aa, Mycobacterium
LALAEAWKPATLRIVSKAEP

SEQ ID NO: 769864 - protein, 17 aa, Mycobacterium
LALARFSIRMNAVHPTN

SEQ ID NO: 769865 - protein, 17 aa, Mycobacterium
LALDPGIAIALVPGDDP

SEQ ID NO: 769866 - protein, 19 aa, Mycobacterium
LALDVWLSYELRRAGFDSD

SEQ ID NO: 769867 - protein, 18 aa, Mycobacterium
LALDVWVAYELRRAGLEP

SEQ ID NO: 769868 - protein, 19 aa, Mycobacterium
LALELGYTGPFCCEHYGSD

SEQ ID NO: 769869 - protein, 17 aa, Mycobacterium
LALGGAVGDEWGSRAIA

SEQ ID NO: 769870 - protein, 19 aa, Mycobacterium
LALGMGRLRGNAIVAAFDA

SEQ ID NO: 769871 - protein, 17 aa, Mycobacterium
LALGRLSAGLTHQLNNP

SEQ ID NO: 769872 - protein, 17 aa, Mycobacterium
LALGSIVEWPVAKRNRT

SEQ ID NO: 769873 - protein, 19 aa, Mycobacterium
LALLAGMYAMFAGFFHGAA

SEQ ID NO: 769874 - protein, 17 aa, Mycobacterium
LALLYRWVEHAFGGREH

SEQ ID NO: 769875 - protein, 19 aa, Mycobacterium
LALMLRRRMHEAGMDTHGV

SEQ ID NO: 769876 - protein, 20 aa, Mycobacterium
LALNCEIAPWGRFARKNYFY

SEQ ID NO: 769877 - protein, 21 aa, Mycobacterium
LALNCEIAPWGRFARKNYFYP

SEQ ID NO: 769878 - protein, 17 aa, Mycobacterium
LALPNARVLIHQPALSG

SEQ ID NO: 769879 - protein, 24 aa, Mycobacterium
LALPRRLQIEFSRAIQEIAEGSAG

SEQ ID NO: 769880 - protein, 23 aa, Mycobacterium
LALQFGWRLFAPILRTATGLDEL

SEQ ID NO: 769881 - protein, 24 aa, Mycobacterium
LALQFGWRLFAPVLRSATGIEELT

SEQ ID NO: 769882 - protein, 18 aa, Mycobacterium
LALTELWRSYGVTPDAVI

SEQ ID NO: 769883 - protein, 19 aa, Mycobacterium
LAMGHAMIRTGLKVRDSAG

SEQ ID NO: 769884 - protein, 23 aa, Mycobacterium
LAMGHSMIRAGLSLKKRGSNRPW

SEQ ID NO: 769885 - protein, 17 aa, Mycobacterium
LAMIDPWPAGYYGAQDH

SEQ ID NO: 769886 - protein, 18 aa, Mycobacterium
LAMIDPWPAGYYGAQDHY

SEQ ID NO: 769887 - protein, 17 aa, Mycobacterium
LAMLRRFHELGVKELNG

SEQ ID NO: 769888 - protein, 23 aa, Mycobacterium
LAMPRLDMVTGLYFLTTEIEGDK

SEQ ID NO: 769889 - protein, 18 aa, Mycobacterium
LAMPRLDMVTGLYYLTTE

SEQ ID NO: 769890 - protein, 18 aa, Mycobacterium
LAMPRLDMVTGLYYLTTL

SEQ ID NO: 769891 - protein, 18 aa, Mycobacterium
LAMRGVRAIDEIPSDSAP

SEQ ID NO: 769892 - protein, 25 aa, Mycobacterium
LAMVCAARGYRCVLTMPDTMSTERR

SEQ ID NO: 769893 - protein, 25 aa, Mycobacterium
LANAKRWGVLHVIWRQKIYPGIGAP

SEQ ID NO: 769894 - protein, 25 aa, Mycobacterium
LANIFSVRLPWQWLGRPAGRRRFRG

SEQ ID NO: 769895 - protein, 18 aa, Mycobacterium
LANLPGYRTGGTIHIVVN

SEQ ID NO: 769896 - protein, 18 aa, Mycobacterium
LANLRLGLMHGRLSADEK

SEQ ID NO: 769897 - protein, 18 aa, Mycobacterium
LANLRLGLMHGRLSAEQK

SEQ ID NO: 769898 - protein, 17 aa, Mycobacterium
LANRPAIHVATYFGDPG

SEQ ID NO: 769899 - protein, 20 aa, Mycobacterium
LANSLGIKSIRVWRRLRADR

SEQ ID NO: 769900 - protein, 23 aa, Mycobacterium
LANSQRTIFCWAMGLTQHRHAVA

SEQ ID NO: 769901 - protein, 17 aa, Mycobacterium
LANVLALRELNRLNNAR

SEQ ID NO: 769902 - protein, 22 aa, Mycobacterium
LAPEFRAAVVLCDIEGLSYEEI

SEQ ID NO: 769903 - protein, 23 aa, Mycobacterium
LAPEPRLVVGMSLGGLTALRIAA

SEQ ID NO: 769904 - protein, 17 aa, Mycobacterium
LAPGPGLKRNRKELRII

SEQ ID NO: 769905 - protein, 22 aa, Mycobacterium
LAPGSILVPFSWQQVSLHAAGA

SEQ ID NO: 769906 - protein, 17 aa, Mycobacterium
LAPKPVLERQADQRSDE

SEQ ID NO: 769907 - protein, 21 aa, Mycobacterium
LAPRLGAGGGRAARVVAGARP

SEQ ID NO: 769908 - protein, 17 aa, Mycobacterium
LAPRLIAVVDRMEGIVT

SEQ ID NO: 769909 - protein, 17 aa, Mycobacterium
LAPRVSYKLNLRGPSIS

SEQ ID NO: 769910 - protein, 17 aa, Mycobacterium
LAPRYRFPTAADDVRAG

SEQ ID NO: 769911 - protein, 17 aa, Mycobacterium
LAPTLDWIEAALPQQNT

SEQ ID NO: 769912 - protein, 21 aa, Mycobacterium
LAPTLPLRIYWALLGWARGRT

SEQ ID NO: 769913 - protein, 17 aa, Mycobacterium
LAPVGGVDLGWWTGSRL

SEQ ID NO: 769914 - protein, 21 aa, Mycobacterium
LAQASGLRYIGFRHESDAGHA

SEQ ID NO: 769915 - protein, 22 aa, Mycobacterium
LAQDRIRTWSAWFENNTRSARY

SEQ ID NO: 769916 - protein, 18 aa, Mycobacterium
LAQELTPWPAVDGQRIGA

SEQ ID NO: 769917 - protein, 22 aa, Mycobacterium
LAQEWTYRFLAAAHDWALTEHA

SEQ ID NO: 769918 - protein, 23 aa, Mycobacterium
LAQFTWRTRHNWVSGTHSRATVD

SEQ ID NO: 769919 - protein, 18 aa, Mycobacterium
LAQFWGHAWQSAVFPSGK

SEQ ID NO: 769920 - protein, 18 aa, Mycobacterium
LAQGIAFVASRRWTTSRL

SEQ ID NO: 769921 - protein, 20 aa, Mycobacterium
LAQIKRLKIGSGRRLAATTK

SEQ ID NO: 769922 - protein, 20 aa, Mycobacterium
LAQIKRLKIGSGRRLASTTK

SEQ ID NO: 769923 - protein, 17 aa, Mycobacterium
LAQPTWRHGVMKLIFME

SEQ ID NO: 769924 - protein, 19 aa, Mycobacterium
LAQRSALAVGRLGGTGEQY

SEQ ID NO: 769925 - protein, 17 aa, Mycobacterium
LAQWGSALEVGRGSEND

SEQ ID NO: 769926 - protein, 17 aa, Mycobacterium
LARACARVGARLIHVST

SEQ ID NO: 769927 - protein, 19 aa, Mycobacterium
LARAGLRLSDIDLIELNEA

SEQ ID NO: 769928 - protein, 21 aa, Mycobacterium
LARDFLLTWFVHAAYEVDYTK

SEQ ID NO: 769929 - protein, 17 aa, Mycobacterium
LARDFPLYEGLEEWTLV

SEQ ID NO: 769930 - protein, 20 aa, Mycobacterium
LAREIACAFDLDFVDPADVA

SEQ ID NO: 769931 - protein, 17 aa, Mycobacterium
LARGELRLVGATTLDEY

SEQ ID NO: 769932 - protein, 24 aa, Mycobacterium
LARGRFSFVAGMGYRPEEYHAAGK

SEQ ID NO: 769933 - protein, 20 aa, Mycobacterium
LARLERRIADFLGFSTVLTS

SEQ ID NO: 769934 - protein, 18 aa, Mycobacterium
LARLGKRVLRPGGVELTT

SEQ ID NO: 769935 - protein, 17 aa, Mycobacterium
LARLRGATILAHNYQLP

SEQ ID NO: 769936 - protein, 17 aa, Mycobacterium
LARLRGATLLAHNYQLP

SEQ ID NO: 769937 - protein, 22 aa, Mycobacterium
LARLYSWHRAMRIFDGPDEVHL

SEQ ID NO: 769938 - protein, 22 aa, Mycobacterium
LARLYSWHRAMRIFDGPDEVHM

SEQ ID NO: 769939 - protein, 17 aa, Mycobacterium
LARNKMRVVPGLTSKAM

SEQ ID NO: 769940 - protein, 17 aa, Mycobacterium
LARQFRAAMSMPLILLG

SEQ ID NO: 769941 - protein, 17 aa, Mycobacterium
LARRAAAVIAERTEIDE

SEQ ID NO: 769942 - protein, 23 aa, Mycobacterium
LARRADVFLTSFLPGHREKFGID

SEQ ID NO: 769943 - protein, 23 aa, Mycobacterium
LARRADVFLTSFLPGHRQKFGID

SEQ ID NO: 769944 - protein, 23 aa, Mycobacterium
LARRELAEALAILTRRLSAPNRI

SEQ ID NO: 769945 - protein, 17 aa, Mycobacterium
LARRLGISAGDKVALIN

SEQ ID NO: 769946 - protein, 21 aa, Mycobacterium
LARRPAWLAACAEVGAGAAPG

SEQ ID NO: 769947 - protein, 25 aa, Mycobacterium
LARRRGWFEARWVRIAMYHRAARWS

SEQ ID NO: 769948 - protein, 21 aa, Mycobacterium
LARRVPLGLARTGTTGSHFSG

SEQ ID NO: 769949 - protein, 22 aa, Mycobacterium
LARSNGWAGLVVHGAVRDSAAL

SEQ ID NO: 769950 - protein, 17 aa, Mycobacterium
LARSRRALAEFNVEGLA

SEQ ID NO: 769951 - protein, 22 aa, Mycobacterium
LARTHLLYGEWLRRGRRRTEAR

SEQ ID NO: 769952 - protein, 22 aa, Mycobacterium
LARTRTGVFWVRDILPTGKLRE

SEQ ID NO: 769953 - protein, 18 aa, Mycobacterium
LARVQARRWLPRCCSRPR

SEQ ID NO: 769954 - protein, 23 aa, Mycobacterium
LARVSLPLLRSWLAEQSASGAAR

SEQ ID NO: 769955 - protein, 18 aa, Mycobacterium
LARWHRRRPLWVGVATGG

SEQ ID NO: 769956 - protein, 22 aa, Mycobacterium
LARWLHPGQRAFQLATQVALLT

SEQ ID NO: 769957 - protein, 19 aa, Mycobacterium
LASAWSWKLPAAVKHWGAQ

SEQ ID NO: 769958 - protein, 18 aa, Mycobacterium
LASELEILLALGAAHGAD

SEQ ID NO: 769959 - protein, 17 aa, Mycobacterium
LASFGLEGEQAFYAALE

SEQ ID NO: 769960 - protein, 18 aa, Mycobacterium
LASFPGVAGADEYGLPAD

SEQ ID NO: 769961 - protein, 17 aa, Mycobacterium
LASGDAIGCFGLTEPDF

SEQ ID NO: 769962 - protein, 18 aa, Mycobacterium
LASGRIAYALGVHGPALT

SEQ ID NO: 769963 - protein, 23 aa, Mycobacterium
LASILSWQNWEEMFAIARFIGVS

SEQ ID NO: 769964 - protein, 23 aa, Mycobacterium
LASMCFPSFPGFAGRLFATHPDK

SEQ ID NO: 769965 - protein, 21 aa, Mycobacterium
LASMPPFCWMTQDGTGWALIY

SEQ ID NO: 769966 - protein, 22 aa, Mycobacterium
LASTRSGVFWIRDILPVQKLRE

SEQ ID NO: 769967 - protein, 17 aa, Mycobacterium
LASVIAEHGVDWHVVSV

SEQ ID NO: 769968 - protein, 20 aa, Mycobacterium
LASWAVGWVPWIGILAPQIN

SEQ ID NO: 769969 - protein, 23 aa, Mycobacterium
LATEILDPLGFRWTNFGVAEEDL

SEQ ID NO: 769970 - protein, 23 aa, Mycobacterium
LATEILDPLGFRWTNFGVAKQDL

SEQ ID NO: 769971 - protein, 17 aa, Mycobacterium
LATLFGLLDAVAAALDG

SEQ ID NO: 769972 - protein, 18 aa, Mycobacterium
LATLPARMALRWRHTHEF

SEQ ID NO: 769973 - protein, 19 aa, Mycobacterium
LATLWSEFGPNANIWNTIA

SEQ ID NO: 769974 - protein, 18 aa, Mycobacterium
LATMDAIASYCLTEPGAG

SEQ ID NO: 769975 - protein, 18 aa, Mycobacterium
LATMLPLAPLVPFVHDGV

SEQ ID NO: 769976 - protein, 19 aa, Mycobacterium
LATMLPWAPLVPFVHDGVI

SEQ ID NO: 769977 - protein, 17 aa, Mycobacterium
LATPGVAVGDHFELLAM

SEQ ID NO: 769978 - protein, 19 aa, Mycobacterium
LATQLRAGLFGVLYVLDEP

SEQ ID NO: 769979 - protein, 17 aa, Mycobacterium
LATRIARPPHNWTPDVI

SEQ ID NO: 769980 - protein, 20 aa, Mycobacterium
LATRWKNVLLDWVVVELMTR

SEQ ID NO: 769981 - protein, 20 aa, Mycobacterium
LATVPLDLGHPWWVEGEVDL

SEQ ID NO: 769982 - protein, 18 aa, Mycobacterium
LATYRPGDFLGWTSDFTP

SEQ ID NO: 769983 - protein, 17 aa, Mycobacterium
LAVEAMTALVARHIDLS

SEQ ID NO: 769984 - protein, 17 aa, Mycobacterium
LAVEVFEAAFAMTVPPP

SEQ ID NO: 769985 - protein, 17 aa, Mycobacterium
LAVFPFPHALSMAVTLA

SEQ ID NO: 769986 - protein, 17 aa, Mycobacterium
LAVGFPGLSHVGLTLAT

SEQ ID NO: 769987 - protein, 17 aa, Mycobacterium
LAVGGVLMTINWWSASR

SEQ ID NO: 769988 - protein, 26 aa, Mycobacterium
LAVKLANMPFTWSTRGAERIAEAVRS

SEQ ID NO: 769989 - protein, 20 aa, Mycobacterium
LAVMLRRRMAAAGMDASGAE

SEQ ID NO: 769990 - protein, 17 aa, Mycobacterium
LAVSHAFHSASMEPMLA

SEQ ID NO: 769991 - protein, 25 aa, Mycobacterium
LAVTRARLSGMPVVFWLDTERPHEV

SEQ ID NO: 769992 - protein, 17 aa, Mycobacterium
LAWLHAPGMDFGPALAA

SEQ ID NO: 769993 - protein, 20 aa, Mycobacterium
LAWRARLGALVFGRTPTLEQ

SEQ ID NO: 769994 - protein, 22 aa, Mycobacterium
LAWRSEFGSVRYWDERLTDAAM

SEQ ID NO: 769995 - protein, 24 aa, Mycobacterium
LAWSVDPRPLFGLPALATDSTDAD

SEQ ID NO: 769996 - protein, 19 aa, Mycobacterium
LAYEGYRVLPYCWRDETPL

SEQ ID NO: 769997 - protein, 18 aa, Mycobacterium
LCAFVKWQGLRLLEDQLR

SEQ ID NO: 769998 - protein, 17 aa, Mycobacterium
LCALGLRFSEDPLVPAA

SEQ ID NO: 769999 - protein, 17 aa, Mycobacterium
LCARCTRFSEQIAGDPF

SEQ ID NO: 770000 - protein, 19 aa, Mycobacterium
LCEILARYDVTFSLGDGLR

SEQ ID NO: 770001 - protein, 20 aa, Mycobacterium
LCGALRRYHEAFGVPISTLP

SEQ ID NO: 770002 - protein, 22 aa, Mycobacterium
LCGALRRYHEALGMPISTLPMA

SEQ ID NO: 770003 - protein, 20 aa, Mycobacterium
LCGALRRYHEALGVPISTLP

SEQ ID NO: 770004 - protein, 17 aa, Mycobacterium
LCGIAFRIHIDVAGARF

SEQ ID NO: 770005 - protein, 17 aa, Mycobacterium
LCGLPVAVFRSDMILAH

SEQ ID NO: 770006 - protein, 20 aa, Mycobacterium
LCGPQRPIVLIPRRSETLVC

SEQ ID NO: 770007 - protein, 18 aa, Mycobacterium
LCHFYRGVGVTIYEGYGL

SEQ ID NO: 770008 - protein, 19 aa, Mycobacterium
LCHHFAPAMVRRGSGGIVL

SEQ ID NO: 770009 - protein, 17 aa, Mycobacterium
LCPDCGIALATAEPGHH

SEQ ID NO: 770010 - protein, 17 aa, Mycobacterium
LCPGSRNAPLAFALADA

SEQ ID NO: 770011 - protein, 26 aa, Mycobacterium
LCPVVPELFFRSGIGVKLVGAFERIG

SEQ ID NO: 770012 - protein, 20 aa, Mycobacterium
LCQRRHNLPGLDFVRGDAEN

SEQ ID NO: 770013 - protein, 22 aa, Mycobacterium
LCREKYCDQRSLTEALTEALTE

SEQ ID NO: 770014 - protein, 20 aa, Mycobacterium
LCRFPGCEAVADRADIDHTV

SEQ ID NO: 770015 - protein, 19 aa, Mycobacterium
LCRHVLCFRTVWESTHTAL

SEQ ID NO: 770016 - protein, 23 aa, Mycobacterium
LCRHVLCFRTVWESTYAALRLHG

SEQ ID NO: 770017 - protein, 23 aa, Mycobacterium
LCRRGVCGECRIPVSGSVITHRD

SEQ ID NO: 770018 - protein, 21 aa, Mycobacterium
LCTRGGAGLVPFSDRLAAEEW

SEQ ID NO: 770019 - protein, 17 aa, Mycobacterium
LDAAALLHRLSLKVPVR

SEQ ID NO: 770020 - protein, 21 aa, Mycobacterium
LDAACGPGLYAEELAKRGASL

SEQ ID NO: 770021 - protein, 23 aa, Mycobacterium
LDACRRCFASLFTDRAIHYRVDQ

SEQ ID NO: 770022 - protein, 18 aa, Mycobacterium
LDADAGRALRLRLNMESG

SEQ ID NO: 770023 - protein, 19 aa, Mycobacterium
LDAFTHWRQLQGLPATSIA

SEQ ID NO: 770024 - protein, 19 aa, Mycobacterium
LDAGCDWTEARSQLLALPG

SEQ ID NO: 770025 - protein, 18 aa, Mycobacterium
LDAGCDWTRTREQLLDIP

SEQ ID NO: 770026 - protein, 19 aa, Mycobacterium
LDAGHQWRRGAALSADDVL

SEQ ID NO: 770027 - protein, 18 aa, Mycobacterium
LDAGHSWSRARMVTADEI

SEQ ID NO: 770028 - protein, 17 aa, Mycobacterium
LDAGLLLGEMSFVPNPA

SEQ ID NO: 770029 - protein, 17 aa, Mycobacterium
LDAGMRATEIWLRDQGY

SEQ ID NO: 770030 - protein, 21 aa, Mycobacterium
LDALAYRRCRDHLPATSLAWG

SEQ ID NO: 770031 - protein, 18 aa, Mycobacterium
LDALFAWYSTMGSVTGVS

SEQ ID NO: 770032 - protein, 20 aa, Mycobacterium
LDALGYRGFWAGYFAARSAP

SEQ ID NO: 770033 - protein, 18 aa, Mycobacterium
LDALLAFADRLAKFTARA

SEQ ID NO: 770034 - protein, 19 aa, Mycobacterium
LDALRWLGLNWDEGPEVGG

SEQ ID NO: 770035 - protein, 20 aa, Mycobacterium
LDAQRWAREQARGVVEQKSV

SEQ ID NO: 770036 - protein, 23 aa, Mycobacterium
LDARGVFWLPPYHDFGLISVILS

SEQ ID NO: 770037 - protein, 18 aa, Mycobacterium
LDASHSWQRDNVIDADRI

SEQ ID NO: 770038 - protein, 21 aa, Mycobacterium
LDAWSQWKWMKNYRIWEANRK

SEQ ID NO: 770039 - protein, 17 aa, Mycobacterium
LDCALRWMRDFHADGLR

SEQ ID NO: 770040 - protein, 18 aa, Mycobacterium
LDCPINWKLAVDTFSENY

SEQ ID NO: 770041 - protein, 18 aa, Mycobacterium
LDDFATWCVLAEKHGADW

SEQ ID NO: 770042 - protein, 19 aa, Mycobacterium
LDDVVKFLLPQGAAKKPGK

SEQ ID NO: 770043 - protein, 19 aa, Mycobacterium
LDDVVKFLLPRGAAKKTAK

SEQ ID NO: 770044 - protein, 17 aa, Mycobacterium
LDEALRSWLAFGQEKVG

SEQ ID NO: 770045 - protein, 18 aa, Mycobacterium
LDEARRIANFEGLQPYSY

SEQ ID NO: 770046 - protein, 22 aa, Mycobacterium
LDEAWWFPAIQWPDGRMQFMLN

SEQ ID NO: 770047 - protein, 18 aa, Mycobacterium
LDEEFVWYGRIPRAKLAD

SEQ ID NO: 770048 - protein, 18 aa, Mycobacterium
LDEFARIVARLEPRTPQI

SEQ ID NO: 770049 - protein, 24 aa, Mycobacterium
LDEIPGTAVPLVFAMLGENGVHAP

SEQ ID NO: 770050 - protein, 17 aa, Mycobacterium
LDELAWWGAALRTAREH

SEQ ID NO: 770051 - protein, 23 aa, Mycobacterium
LDELRELAGILGIARDAEVLAER

SEQ ID NO: 770052 - protein, 17 aa, Mycobacterium
LDELRRNLCIETEFLSE

SEQ ID NO: 770053 - protein, 22 aa, Mycobacterium
LDELRSGLKFASTGLLAGAVSG

SEQ ID NO: 770054 - protein, 17 aa, Mycobacterium
LDELTRAAARWVPGAQE

SEQ ID NO: 770055 - protein, 24 aa, Mycobacterium
LDELVRMALDWNRPVKLFIETKHP

SEQ ID NO: 770056 - protein, 20 aa, Mycobacterium
LDERLHHLFARMPEAKVHLY

SEQ ID NO: 770057 - protein, 22 aa, Mycobacterium
LDERLRYVLVGGIRSTGLTSGM

SEQ ID NO: 770058 - protein, 18 aa, Mycobacterium
LDEVTAFLVVAATLLDLK

SEQ ID NO: 770059 - protein, 18 aa, Mycobacterium
LDEWRVLSAAALVGLVEE

SEQ ID NO: 770060 - protein, 18 aa, Mycobacterium
LDEYVDWLIEAGYPVHRV

SEQ ID NO: 770061 - protein, 18 aa, Mycobacterium
LDEYVDWVIEAGYPIERI

SEQ ID NO: 770062 - protein, 18 aa, Mycobacterium
LDEYVDWVIEAGYPIERV

SEQ ID NO: 770063 - protein, 20 aa, Mycobacterium
LDFARAAALIAHHIRQDVAG

SEQ ID NO: 770064 - protein, 21 aa, Mycobacterium
LDFKTVGALSKWYLGDTNPAT

SEQ ID NO: 770065 - protein, 24 aa, Mycobacterium
LDFLTVLRLDWLLAIPDEDWQPVA

SEQ ID NO: 770066 - protein, 19 aa, Mycobacterium
LDFYRCAMLPLSENGGDTG

SEQ ID NO: 770067 - protein, 17 aa, Mycobacterium
LDFYRCAMLPLSSDDVQ

SEQ ID NO: 770068 - protein, 17 aa, Mycobacterium
LDGEICDRLGLLPMYAV

SEQ ID NO: 770069 - protein, 19 aa, Mycobacterium
LDGIFGLLSNVVWTNFGPC

SEQ ID NO: 770070 - protein, 24 aa, Mycobacterium
LDGLDRLAKLGVTWVSVHLPGDSM

SEQ ID NO: 770071 - protein, 18 aa, Mycobacterium
LDGLGGWFIDGIDGDPSN

SEQ ID NO: 770072 - protein, 17 aa, Mycobacterium
LDGLLLLPGGGPELDDD

SEQ ID NO: 770073 - protein, 23 aa, Mycobacterium
LDGLSLPLLRSWLSAGAAAGAAR

SEQ ID NO: 770074 - protein, 17 aa, Mycobacterium
LDGLTGWIIGPHDNAGY

SEQ ID NO: 770075 - protein, 22 aa, Mycobacterium
LDGRKLLWWAMSRFTTLGNLPY

SEQ ID NO: 770076 - protein, 18 aa, Mycobacterium
LDGSHGWERTHLDSLQAA

SEQ ID NO: 770077 - protein, 18 aa, Mycobacterium
LDGTEVFDITGIAALNDG

SEQ ID NO: 770078 - protein, 18 aa, Mycobacterium
LDGTEVFDITGIEALNDG

SEQ ID NO: 770079 - protein, 18 aa, Mycobacterium
LDGYRVPNEFPIHTETMR

SEQ ID NO: 770080 - protein, 18 aa, Mycobacterium
LDHGHTWRQAELHPAPGT

SEQ ID NO: 770081 - protein, 19 aa, Mycobacterium
LDHLLTWGVLAAPLTLVPA

SEQ ID NO: 770082 - protein, 17 aa, Mycobacterium
LDHRAPGPALALLADPR

SEQ ID NO: 770083 - protein, 22 aa, Mycobacterium
LDHVAGRPYGLWVHGNNDTVGA

SEQ ID NO: 770084 - protein, 26 aa, Mycobacterium
LDIFKRLGVRPRIRHFVSGYETVRSY

SEQ ID NO: 770085 - protein, 23 aa, Mycobacterium
LDIFSIRIPKPWFVLMPTPIWDQ

SEQ ID NO: 770086 - protein, 18 aa, Mycobacterium
LDIGCGWGGALQRAVEKY

SEQ ID NO: 770087 - protein, 23 aa, Mycobacterium
LDIGCGWGGTLLRALEKYDVNVI

SEQ ID NO: 770088 - protein, 20 aa, Mycobacterium
LDIGCGWGSTIMRAVEKYDV

SEQ ID NO: 770089 - protein, 19 aa, Mycobacterium
LDIGCGWGSTIQRAVEKYD

SEQ ID NO: 770090 - protein, 18 aa, Mycobacterium
LDIGCGWGSVLKRAVEKY

SEQ ID NO: 770091 - protein, 18 aa, Mycobacterium
LDIGCGWGSVLQRAVEKY

SEQ ID NO: 770092 - protein, 19 aa, Mycobacterium
LDIGCGWGTTIVRALERYD

SEQ ID NO: 770093 - protein, 17 aa, Mycobacterium
LDIGIDWKTYRDAIDGL

SEQ ID NO: 770094 - protein, 19 aa, Mycobacterium
LDIGLPWRQYRSVQDGIAG

SEQ ID NO: 770095 - protein, 21 aa, Mycobacterium
LDIRALYLFKRTMWLPYSIAM

SEQ ID NO: 770096 - protein, 28 aa, Mycobacterium
LDIYRIGQYIAWRLWINIAFDLTSDPQE

SEQ ID NO: 770097 - protein, 19 aa, Mycobacterium
LDKSKCFYEALGFTEVRRL

SEQ ID NO: 770098 - protein, 21 aa, Mycobacterium
LDKVAKWWIPERWSFVSEIPR

SEQ ID NO: 770099 - protein, 19 aa, Mycobacterium
LDLAFRICAVFDLPVEAVF

SEQ ID NO: 770100 - protein, 19 aa, Mycobacterium
LDLAFRICDVFGLPVEAVF

SEQ ID NO: 770101 - protein, 20 aa, Mycobacterium
LDLAKSWARERETFGRPLTG

SEQ ID NO: 770102 - protein, 22 aa, Mycobacterium
LDLAQRLGVDWSMIYAGRHPDS

SEQ ID NO: 770103 - protein, 20 aa, Mycobacterium
LDLFAGLGLLQSVGEPVEVG

SEQ ID NO: 770104 - protein, 17 aa, Mycobacterium
LDLGALLPALSVRNSHG

SEQ ID NO: 770105 - protein, 17 aa, Mycobacterium
LDLGIAFAGPHPAGIDH

SEQ ID NO: 770106 - protein, 19 aa, Mycobacterium
LDLGVGVGWQRAEYDAAGL

SEQ ID NO: 770107 - protein, 19 aa, Mycobacterium
LDLGWIIFLHRFFQDLAEV

SEQ ID NO: 770108 - protein, 20 aa, Mycobacterium
LDLLAADGFEFRIRRGDNGQ

SEQ ID NO: 770109 - protein, 19 aa, Mycobacterium
LDLLRLGAYQILRTRVDDH

SEQ ID NO: 770110 - protein, 17 aa, Mycobacterium
LDLLRWHGAEEVEHRSL

SEQ ID NO: 770111 - protein, 17 aa, Mycobacterium
LDLPLCVNTGLPGPPIP

SEQ ID NO: 770112 - protein, 17 aa, Mycobacterium
LDLPRDSLIVFTGLSGS

SEQ ID NO: 770113 - protein, 17 aa, Mycobacterium
LDLPTAPGFGNATDSPS

SEQ ID NO: 770114 - protein, 23 aa, Mycobacterium
LDLRAVCDLEPYWEAVRKVYAPF

SEQ ID NO: 770115 - protein, 22 aa, Mycobacterium
LDLVRLQLLVAMGRPLPAEVSK

SEQ ID NO: 770116 - protein, 23 aa, Mycobacterium
LDLVVRAGREWKVREIPLAEVEK

SEQ ID NO: 770117 - protein, 18 aa, Mycobacterium
LDMFGEWNRAYGPAGFLQ

SEQ ID NO: 770118 - protein, 18 aa, Mycobacterium
LDMFGEWNRAYGSAGFLQ

SEQ ID NO: 770119 - protein, 19 aa, Mycobacterium
LDMGCGMGRVARPLTTFLD

SEQ ID NO: 770120 - protein, 17 aa, Mycobacterium
LDMLRWHGAEEVEHKAV

SEQ ID NO: 770121 - protein, 20 aa, Mycobacterium
LDMPGLFVWRRYHPTPPKGK

SEQ ID NO: 770122 - protein, 20 aa, Mycobacterium
LDMRSGVGFSENYDDPAAEI

SEQ ID NO: 770123 - protein, 23 aa, Mycobacterium
LDMSRRYGGDFGFTSYDPAWIDT

SEQ ID NO: 770124 - protein, 27 aa, Mycobacterium
LDMTTFWAGPCATHFLAMLGAEVIHVE

SEQ ID NO: 770125 - protein, 27 aa, Mycobacterium
LDMTTFWAGPCCTHFLAMLGAEVIHIE

SEQ ID NO: 770126 - protein, 18 aa, Mycobacterium
LDNFEWAYGYAKRFGLIH

SEQ ID NO: 770127 - protein, 22 aa, Mycobacterium
LDNLRSAFGWSLETRDFDSALE

SEQ ID NO: 770128 - protein, 17 aa, Mycobacterium
LDPALARWMSEHTTFPN

SEQ ID NO: 770129 - protein, 24 aa, Mycobacterium
LDPALRSWLAFGFEKVTEVVALAR

SEQ ID NO: 770130 - protein, 21 aa, Mycobacterium
LDPDFALARWGVAYAIGPNYN

SEQ ID NO: 770131 - protein, 24 aa, Mycobacterium
LDPQRVVAVLLAFGSPHAHNVILL

SEQ ID NO: 770132 - protein, 24 aa, Mycobacterium
LDPVRLRLGIGYVIQHAGLMPHLR

SEQ ID NO: 770133 - protein, 18 aa, Mycobacterium
LDQLIGFFINILVLRNDL

SEQ ID NO: 770134 - protein, 19 aa, Mycobacterium
LDQLLKLWVEQGALPARMS

SEQ ID NO: 770135 - protein, 19 aa, Mycobacterium
LDQPARWALLYGSPVPGYH

SEQ ID NO: 770136 - protein, 18 aa, Mycobacterium
LDQVRYFLLREVPFGQDG

SEQ ID NO: 770137 - protein, 21 aa, Mycobacterium
LDQYWFWNLRNTVRFDKAIAA

SEQ ID NO: 770138 - protein, 17 aa, Mycobacterium
LDRAGEVLGCYFLLEPG

SEQ ID NO: 770139 - protein, 18 aa, Mycobacterium
LDRCRELGAHTLINYREQ

SEQ ID NO: 770140 - protein, 18 aa, Mycobacterium
LDRCRRWFGALPLARRPR

SEQ ID NO: 770141 - protein, 24 aa, Mycobacterium
LDRERCVLCARCTRFSDQIAGDRF

SEQ ID NO: 770142 - protein, 22 aa, Mycobacterium
LDRERCVLCARCTRFSQQVAGD

SEQ ID NO: 770143 - protein, 25 aa, Mycobacterium
LDRERCVLCARCTRFSSQIAGDPFI

SEQ ID NO: 770144 - protein, 19 aa, Mycobacterium
LDRFPRPDVVLGQHVGPLP

SEQ ID NO: 770145 - protein, 17 aa, Mycobacterium
LDRGGLLHWARPIAPLI

SEQ ID NO: 770146 - protein, 29 aa, Mycobacterium
LDRHPRLRIGWFEGGIAWVPWALQDAEHL

SEQ ID NO: 770147 - protein, 17 aa, Mycobacterium
LDRKATLAFAFSHRSYL

SEQ ID NO: 770148 - protein, 21 aa, Mycobacterium
LDRKVWLPSGGTLVIDRTEAM

SEQ ID NO: 770149 - protein, 31 aa, Mycobacterium
LDRLAHTDIVSWARYPLGVVHEFVKRGNDIH

SEQ ID NO: 770150 - protein, 19 aa, Mycobacterium
LDRLLAGKLPEGWDADLPH

SEQ ID NO: 770151 - protein, 21 aa, Mycobacterium
LDRNGLRPGRWWRTLDDRLIL

SEQ ID NO: 770152 - protein, 20 aa, Mycobacterium
LDRNGLRPGRWWRTVDDRVI

SEQ ID NO: 770153 - protein, 20 aa, Mycobacterium
LDRRALEFGGRVYTAKDSRV

SEQ ID NO: 770154 - protein, 17 aa, Mycobacterium
LDRRFTLAAGLLELADR

SEQ ID NO: 770155 - protein, 23 aa, Mycobacterium
LDRSFKVGGCFAGPQNMKLRDVL

SEQ ID NO: 770156 - protein, 28 aa, Mycobacterium
LDRSTFRWWLTVATLRWGVICRHQAERH

SEQ ID NO: 770157 - protein, 17 aa, Mycobacterium
LDSELTWISEQTGGKPF

SEQ ID NO: 770158 - protein, 19 aa, Mycobacterium
LDSGFTFPVLSDFWPHGAV

SEQ ID NO: 770159 - protein, 17 aa, Mycobacterium
LDSKHSFSFGSHYDPDN

SEQ ID NO: 770160 - protein, 18 aa, Mycobacterium
LDSLLIRPVCGGKPIVGP

SEQ ID NO: 770161 - protein, 24 aa, Mycobacterium
LDSRAWRLAWPAGCVVYEIDQPKV

SEQ ID NO: 770162 - protein, 22 aa, Mycobacterium
LDSRAWRLPWPDGTTVYELDQP

SEQ ID NO: 770163 - protein, 23 aa, Mycobacterium
LDSRAWRLPWPDGTVVYELDQPR

SEQ ID NO: 770164 - protein, 17 aa, Mycobacterium
LDSWPVNIALLGKGNTV

SEQ ID NO: 770165 - protein, 17 aa, Mycobacterium
LDTACLVGFPRRDLSAE

SEQ ID NO: 770166 - protein, 18 aa, Mycobacterium
LDTESWRGQPLKDFLTKM

SEQ ID NO: 770167 - protein, 17 aa, Mycobacterium
LDTEYAWAEDPPSRIRH

SEQ ID NO: 770168 - protein, 19 aa, Mycobacterium
LDVAFSIVVKRGCRAADVR

SEQ ID NO: 770169 - protein, 17 aa, Mycobacterium
LDVAGAFHTSAMDTAIS

SEQ ID NO: 770170 - protein, 19 aa, Mycobacterium
LDVAHCLYAGLTTDTGSFR

SEQ ID NO: 770171 - protein, 19 aa, Mycobacterium
LDVCPPILVLTGRPDDAWL

SEQ ID NO: 770172 - protein, 20 aa, Mycobacterium
LDVFVDWLIRAGHPIDRVDD

SEQ ID NO: 770173 - protein, 18 aa, Mycobacterium
LDVGCGLGALSIEMAQAG

SEQ ID NO: 770174 - protein, 21 aa, Mycobacterium
LDVGCGWGATARRAIEKYDVN

SEQ ID NO: 770175 - protein, 20 aa, Mycobacterium
LDVGCGWGATMLRALERYDV

SEQ ID NO: 770176 - protein, 23 aa, Mycobacterium
LDVGCGWGATMMRAVEKYDVNVV

SEQ ID NO: 770177 - protein, 19 aa, Mycobacterium
LDVGCGWGGMVRYAARHGV

SEQ ID NO: 770178 - protein, 20 aa, Mycobacterium
LDVGCGWGGMVRYAARHGVK

SEQ ID NO: 770179 - protein, 20 aa, Mycobacterium
LDVGCGWGGMVRYAARHGVR

SEQ ID NO: 770180 - protein, 20 aa, Mycobacterium
LDVGCGWGGMVRYAARRGVH

SEQ ID NO: 770181 - protein, 20 aa, Mycobacterium
LDVGCGWGGMVRYAARRGVR

SEQ ID NO: 770182 - protein, 19 aa, Mycobacterium
LDVGCGWGSMVRYAARRGV

SEQ ID NO: 770183 - protein, 19 aa, Mycobacterium
LDVGCGWGTTIVRALERYD

SEQ ID NO: 770184 - protein, 24 aa, Mycobacterium
LDVLRFWLDLGIDGFRLDAVPYLF

SEQ ID NO: 770185 - protein, 17 aa, Mycobacterium
LDVTAGWLASRIDGPVT

SEQ ID NO: 770186 - protein, 18 aa, Mycobacterium
LDWAGARVRPTMIGHRDV

SEQ ID NO: 770187 - protein, 17 aa, Mycobacterium
LDWCRKNDVVFIADEVQ

SEQ ID NO: 770188 - protein, 19 aa, Mycobacterium
LDWFCSFSSIAALVGSPGQ

SEQ ID NO: 770189 - protein, 22 aa, Mycobacterium
LDWFLRPAVKLDFRHLDDGYVA

SEQ ID NO: 770190 - protein, 17 aa, Mycobacterium
LDWLRKHGYQDLASRAC

SEQ ID NO: 770191 - protein, 22 aa, Mycobacterium
LDWQSVWDRGWTLAAAAEDKPV

SEQ ID NO: 770192 - protein, 22 aa, Mycobacterium
LDWQSVWDRGWTLAAAAEEKPV

SEQ ID NO: 770193 - protein, 24 aa, Mycobacterium
LDYIKWLGVDCLWLPPFYDSPLRD

SEQ ID NO: 770194 - protein, 20 aa, Mycobacterium
LEAAAAWGSLADELQVAASS

SEQ ID NO: 770195 - protein, 24 aa, Mycobacterium
LEAALPAGVTVCWREPGDSRILDD

SEQ ID NO: 770196 - protein, 18 aa, Mycobacterium
LEAARWAPTWGGRQPVRF

SEQ ID NO: 770197 - protein, 19 aa, Mycobacterium
LEAEMLWPRMWQMACRLEE

SEQ ID NO: 770198 - protein, 18 aa, Mycobacterium
LEAEWRLVSEHVRTIVAL

SEQ ID NO: 770199 - protein, 18 aa, Mycobacterium
LEAFVAVADLHGWGHSCD

SEQ ID NO: 770200 - protein, 19 aa, Mycobacterium
LEAGLPPGLVNILPAAAEG

SEQ ID NO: 770201 - protein, 27 aa, Mycobacterium
LEAHLGQRLQLRFADVVGEGRGKRPVR

SEQ ID NO: 770202 - protein, 20 aa, Mycobacterium
LEALKAITINAAYQYSEEQS

SEQ ID NO: 770203 - protein, 20 aa, Mycobacterium
LEALLRVLEPFGIREIAQSG

SEQ ID NO: 770204 - protein, 21 aa, Mycobacterium
LEALLRVLEPFGIREIAQSGM

SEQ ID NO: 770205 - protein, 21 aa, Mycobacterium
LEALLRVLEPYGIREIAQSGV

SEQ ID NO: 770206 - protein, 19 aa, Mycobacterium
LEAVLARGAERAREVSGQT

SEQ ID NO: 770207 - protein, 25 aa, Mycobacterium
LEAWCRGSEGVRLFRFDRIEQAEVL

SEQ ID NO: 770208 - protein, 30 aa, Mycobacterium
LEDLAARVGWRWRLVWFKAVSEMLSADYDS

SEQ ID NO: 770209 - protein, 19 aa, Mycobacterium
LEDLRLRACEAIAKGARTL

SEQ ID NO: 770210 - protein, 19 aa, Mycobacterium
LEDMPTFRAIIAMAFKDMD

SEQ ID NO: 770211 - protein, 21 aa, Mycobacterium
LEEFRSGFDLERVVQRLTEPG

SEQ ID NO: 770212 - protein, 22 aa, Mycobacterium
LEELAGAFLLVWTTTPWTLPSN

SEQ ID NO: 770213 - protein, 22 aa, Mycobacterium
LEELKGLWFYYAGVYKGLPLDD

SEQ ID NO: 770214 - protein, 18 aa, Mycobacterium
LEERRTWLLGGHATPIER

SEQ ID NO: 770215 - protein, 20 aa, Mycobacterium
LEEYWWAAEQMLTWPDEPAN

SEQ ID NO: 770216 - protein, 20 aa, Mycobacterium
LEFATHFWGTLSMTRAFAPI

SEQ ID NO: 770217 - protein, 19 aa, Mycobacterium
LEFCDHFAHRGARRITLVS

SEQ ID NO: 770218 - protein, 18 aa, Mycobacterium
LEFCRELGAEITINYRDE

SEQ ID NO: 770219 - protein, 20 aa, Mycobacterium
LEFLAAPGWTIIRVSHEHLR

SEQ ID NO: 770220 - protein, 17 aa, Mycobacterium
LEFLAERVVRWWLPDDV

SEQ ID NO: 770221 - protein, 19 aa, Mycobacterium
LEFLFDRLGGPEVFEAAYE

SEQ ID NO: 770222 - protein, 19 aa, Mycobacterium
LEFVKRGSLATVLPDAIAH

SEQ ID NO: 770223 - protein, 20 aa, Mycobacterium
LEGDPKWVKSVEELMEAVDA

SEQ ID NO: 770224 - protein, 20 aa, Mycobacterium
LEGLRLPALSTRAGGQGRPA

SEQ ID NO: 770225 - protein, 25 aa, Mycobacterium
LEGLSAWLEFVWKPGYADYYPELPG

SEQ ID NO: 770226 - protein, 17 aa, Mycobacterium
LEGMVSCDCCAAPICKR

SEQ ID NO: 770227 - protein, 19 aa, Mycobacterium
LEGSAVFRWAAFEMGKVGR

SEQ ID NO: 770228 - protein, 20 aa, Mycobacterium
LEGTNTWVLRAPRSDEIVVV

SEQ ID NO: 770229 - protein, 20 aa, Mycobacterium
LEGVGLGTVWGRQVATSMLA

SEQ ID NO: 770230 - protein, 20 aa, Mycobacterium
LEGYPAFAITPDWGIAAWNT

SEQ ID NO: 770231 - protein, 17 aa, Mycobacterium
LEHELGYAITHRIPMQM

SEQ ID NO: 770232 - protein, 23 aa, Mycobacterium
LEHLAFFVLDGWLRKVPVGVVGE

SEQ ID NO: 770233 - protein, 23 aa, Mycobacterium
LEHPKMPLVPLIDGWETVPEMEA

SEQ ID NO: 770234 - protein, 20 aa, Mycobacterium
LEHRMRFALEVTEAVRAAWP

SEQ ID NO: 770235 - protein, 24 aa, Mycobacterium
LEIARAHTPWYHWGTTSVVARLVR

SEQ ID NO: 770236 - protein, 18 aa, Mycobacterium
LEIAWKGAKAVYLSFDID

SEQ ID NO: 770237 - protein, 17 aa, Mycobacterium
LEIFTKFSIPINIARVI

SEQ ID NO: 770238 - protein, 19 aa, Mycobacterium
LEIGRAHTPWFHWGTTAMA

SEQ ID NO: 770239 - protein, 17 aa, Mycobacterium
LEIGYSFRTAEQARSEV

SEQ ID NO: 770240 - protein, 19 aa, Mycobacterium
LEIIPWADFIGRWTAEENL

SEQ ID NO: 770241 - protein, 19 aa, Mycobacterium
LEILERFYGLVLTDCGTGL

SEQ ID NO: 770242 - protein, 25 aa, Mycobacterium
LEKAIAWYSMIARVVVDAKLAVNDN

SEQ ID NO: 770243 - protein, 17 aa, Mycobacterium
LEKDAWCNPHLSPQRSG

SEQ ID NO: 770244 - protein, 19 aa, Mycobacterium
LEKICRLIMLYHLDRGWAD

SEQ ID NO: 770245 - protein, 18 aa, Mycobacterium
LEKICRLIMLYHLDRGWC

SEQ ID NO: 770246 - protein, 24 aa, Mycobacterium
LEKTLRFWLDRGVDGFRIDVAHGM

SEQ ID NO: 770247 - protein, 19 aa, Mycobacterium
LELAAGLYDMAAWQLDVFL

SEQ ID NO: 770248 - protein, 17 aa, Mycobacterium
LELARKFLPEALPRRFG

SEQ ID NO: 770249 - protein, 17 aa, Mycobacterium
LELARRGSGYGVAALCG

SEQ ID NO: 770250 - protein, 17 aa, Mycobacterium
LELGMDWDRIDQLKRSG

SEQ ID NO: 770251 - protein, 22 aa, Mycobacterium
LELGPWLINWVPFGYLISDQIL

SEQ ID NO: 770252 - protein, 18 aa, Mycobacterium
LELGRSGASLAISDVDSD

SEQ ID NO: 770253 - protein, 17 aa, Mycobacterium
LELHGWGDLQTELHRLS

SEQ ID NO: 770254 - protein, 17 aa, Mycobacterium
LELIHPFPTPTEADETR

SEQ ID NO: 770255 - protein, 18 aa, Mycobacterium
LELKLMLGKILQRLPDMR

SEQ ID NO: 770256 - protein, 18 aa, Mycobacterium
LELLAAIAATGVREVEAT

SEQ ID NO: 770257 - protein, 18 aa, Mycobacterium
LELLDMIGLDVQLHATEA

SEQ ID NO: 770258 - protein, 21 aa, Mycobacterium
LELLKVRGFAAVSLREVAKSA

SEQ ID NO: 770259 - protein, 20 aa, Mycobacterium
LELLPLIPLVPKRALQGLGG

SEQ ID NO: 770260 - protein, 17 aa, Mycobacterium
LELLTMWSAGFPEPRTF

SEQ ID NO: 770261 - protein, 17 aa, Mycobacterium
LELPEGMGLVLLTDGLF

SEQ ID NO: 770262 - protein, 17 aa, Mycobacterium
LELPFAVDFPATYRVGR

SEQ ID NO: 770263 - protein, 18 aa, Mycobacterium
LELPPLVIGMAWHPRFDA

SEQ ID NO: 770264 - protein, 18 aa, Mycobacterium
LELRTSWRNPPEVLHLAN

SEQ ID NO: 770265 - protein, 19 aa, Mycobacterium
LELRTSWRNPPRTLALANA

SEQ ID NO: 770266 - protein, 20 aa, Mycobacterium
LELSEWWAYLEGVRKTYPLS

SEQ ID NO: 770267 - protein, 17 aa, Mycobacterium
LELSRLSNTAGWGITSN

SEQ ID NO: 770268 - protein, 17 aa, Mycobacterium
LELTGRILLAASKKRSA

SEQ ID NO: 770269 - protein, 22 aa, Mycobacterium
LELYKRLPGDLSILTPSPASDT

SEQ ID NO: 770270 - protein, 20 aa, Mycobacterium
LEMAEGLTARGIKVTQIEAL

SEQ ID NO: 770271 - protein, 20 aa, Mycobacterium
LEMLRLVEAFGYGWSDLERF

SEQ ID NO: 770272 - protein, 17 aa, Mycobacterium
LENAAPMGRGMRGVSYV

SEQ ID NO: 770273 - protein, 25 aa, Mycobacterium
LENLSPWLEFVWKPGYADYYPELPG

SEQ ID NO: 770274 - protein, 20 aa, Mycobacterium
LENPTRWRLILTVPDSAPRE

SEQ ID NO: 770275 - protein, 19 aa, Mycobacterium
LENQWPIRVAVLSIPGEHA

SEQ ID NO: 770276 - protein, 18 aa, Mycobacterium
LENTRFWAPLSLTAEQKH

SEQ ID NO: 770277 - protein, 19 aa, Mycobacterium
LENWKRLVDPVAEQISGMW

SEQ ID NO: 770278 - protein, 17 aa, Mycobacterium
LEPAGKALIQWRSPSWF

SEQ ID NO: 770279 - protein, 18 aa, Mycobacterium
LEPARAAFDWSRRTQRSD

SEQ ID NO: 770280 - protein, 20 aa, Mycobacterium
LEPDLKWERFITAVRLLAER

SEQ ID NO: 770281 - protein, 21 aa, Mycobacterium
LEPDLKWERFVNAIRLLAEQL

SEQ ID NO: 770282 - protein, 21 aa, Mycobacterium
LEPDLRWERFITAVRLLAEQL

SEQ ID NO: 770283 - protein, 33 aa, Mycobacterium
LEPFTFRPALTVGWRLWMDIGFKLASDPDELRE

SEQ ID NO: 770284 - protein, 18 aa, Mycobacterium
LEPFWEALRKVYAPFESG

SEQ ID NO: 770285 - protein, 17 aa, Mycobacterium
LEPMAGKIIHCGAAGAG

SEQ ID NO: 770286 - protein, 17 aa, Mycobacterium
LEPPRFCAACGRRMVVQ

SEQ ID NO: 770287 - protein, 18 aa, Mycobacterium
LEPWGVVTDRGRWYVVGH

SEQ ID NO: 770288 - protein, 21 aa, Mycobacterium
LEPYGGAWLNSWLDRDLGISG

SEQ ID NO: 770289 - protein, 18 aa, Mycobacterium
LEQQAIFRRTWLHVGRVE

SEQ ID NO: 770290 - protein, 17 aa, Mycobacterium
LERDVLGLVNAPTQALL

SEQ ID NO: 770291 - protein, 18 aa, Mycobacterium
LERFGWRTGRPLEDAVHW

SEQ ID NO: 770292 - protein, 22 aa, Mycobacterium
LERKAVFRRAWLNVGRVEQVPR

SEQ ID NO: 770293 - protein, 23 aa, Mycobacterium
LERLRRLGLPFLFYVDAAQGRAS

SEQ ID NO: 770294 - protein, 25 aa, Mycobacterium
LERLSGWFEFVWKPGYADYYPELPG

SEQ ID NO: 770295 - protein, 24 aa, Mycobacterium
LERRAAEIAQRWGVNTYPVQADMS

SEQ ID NO: 770296 - protein, 18 aa, Mycobacterium
LERRDVLRAFSMLRNQYS

SEQ ID NO: 770297 - protein, 22 aa, Mycobacterium
LERRISAAWLWSGRAATIAGAA

SEQ ID NO: 770298 - protein, 20 aa, Mycobacterium
LERRLRLVLLERGPTGSRLT

SEQ ID NO: 770299 - protein, 19 aa, Mycobacterium
LERTRISGVLINLQPDRSA

SEQ ID NO: 770300 - protein, 30 aa, Mycobacterium
LESFFRGAGWNVIKVVWGREWDVLLHADRD

SEQ ID NO: 770301 - protein, 19 aa, Mycobacterium
LESGFTFPVLSDFWPHGEV

SEQ ID NO: 770302 - protein, 26 aa, Mycobacterium
LESILSWQGWEELFDLARFVGVSRPG

SEQ ID NO: 770303 - protein, 22 aa, Mycobacterium
LESRSARLLACWGNNDGPALRA

SEQ ID NO: 770304 - protein, 20 aa, Mycobacterium
LESRWCGGDLLLQICADDPL

SEQ ID NO: 770305 - protein, 22 aa, Mycobacterium
LESVAEHYLHFGGVSPINGINR

SEQ ID NO: 770306 - protein, 19 aa, Mycobacterium
LESWIPLLALFAHAGAHDW

SEQ ID NO: 770307 - protein, 21 aa, Mycobacterium
LESWIPLLALFAHDPGRDWSA

SEQ ID NO: 770308 - protein, 20 aa, Mycobacterium
LESWIRLVALTAHRPGTDWT

SEQ ID NO: 770309 - protein, 19 aa, Mycobacterium
LETATCAAGAPVTPSAGDH

SEQ ID NO: 770310 - protein, 18 aa, Mycobacterium
LETCPPLVVLTGRPDDAW

SEQ ID NO: 770311 - protein, 18 aa, Mycobacterium
LETFRFLRQFSVDPALIR

SEQ ID NO: 770312 - protein, 21 aa, Mycobacterium
LETGNPVAMPWRDRVNAIVQA

SEQ ID NO: 770313 - protein, 24 aa, Mycobacterium
LETRGVFWLPPYHDFGLISVILST

SEQ ID NO: 770314 - protein, 18 aa, Mycobacterium
LETSILLAAHPDYLRDGW

SEQ ID NO: 770315 - protein, 18 aa, Mycobacterium
LETTICLIYVPFVGCVLH

SEQ ID NO: 770316 - protein, 17 aa, Mycobacterium
LETWRAALGDLRRREKA

SEQ ID NO: 770317 - protein, 18 aa, Mycobacterium
LEVAVLLAEWLRRVPEYA

SEQ ID NO: 770318 - protein, 17 aa, Mycobacterium
LEVAWPRLFERIPDLRL

SEQ ID NO: 770319 - protein, 24 aa, Mycobacterium
LEVDSRAGLLFVDWERGSTLHLTG

SEQ ID NO: 770320 - protein, 21 aa, Mycobacterium
LEVEEVYLPLARLIHLQVAAR

SEQ ID NO: 770321 - protein, 17 aa, Mycobacterium
LEVELVWHRERESPGLL

SEQ ID NO: 770322 - protein, 23 aa, Mycobacterium
LEVIDLRSLIPLDFETIAASIRR

SEQ ID NO: 770323 - protein, 20 aa, Mycobacterium
LEVIDLRSLVPLDFDTVAAS

SEQ ID NO: 770324 - protein, 21 aa, Mycobacterium
LEVIDLRSLVPLDFDTVAASI

SEQ ID NO: 770325 - protein, 22 aa, Mycobacterium
LEVLEAAGLVTVQWEGRQKLHH

SEQ ID NO: 770326 - protein, 21 aa, Mycobacterium
LEVLEALGFTREDDMFGRRKW

SEQ ID NO: 770327 - protein, 17 aa, Mycobacterium
LEVLERVGLDPKLATRY

SEQ ID NO: 770328 - protein, 20 aa, Mycobacterium
LEVLRRWPELRADMDATVEA

SEQ ID NO: 770329 - protein, 19 aa, Mycobacterium
LEVVIAYRLLFGIYSGIVP

SEQ ID NO: 770330 - protein, 25 aa, Mycobacterium
LEVVRRARFSSAFTFQYSIRPGTPA

SEQ ID NO: 770331 - protein, 19 aa, Mycobacterium
LEYHWGPDWMCWDADQTFQ

SEQ ID NO: 770332 - protein, 18 aa, Mycobacterium
LEYHWGPDWMVWDAHKTA

SEQ ID NO: 770333 - protein, 17 aa, Mycobacterium
LEYHWGPDWVCWDADQT

SEQ ID NO: 770334 - protein, 18 aa, Mycobacterium
LEYLFPRSWLFVGHASQV

SEQ ID NO: 770335 - protein, 18 aa, Mycobacterium
LFAAFGMFAVGFYDLRSA

SEQ ID NO: 770336 - protein, 18 aa, Mycobacterium
LFAAKCIDGLIANDQHIR

SEQ ID NO: 770337 - protein, 18 aa, Mycobacterium
LFAAPGWVVSPGVVKALP

SEQ ID NO: 770338 - protein, 18 aa, Mycobacterium
LFAEAGLPPGVFQVVHGD

SEQ ID NO: 770339 - protein, 23 aa, Mycobacterium
LFAECVELAMPFCTQVGHTGPLR

SEQ ID NO: 770340 - protein, 17 aa, Mycobacterium
LFAELMWEYRFGDRHTA

SEQ ID NO: 770341 - protein, 19 aa, Mycobacterium
LFAERCIDGLVANEERLRE

SEQ ID NO: 770342 - protein, 18 aa, Mycobacterium
LFAERCIVGLVANVDHLR

SEQ ID NO: 770343 - protein, 23 aa, Mycobacterium
LFALGRLPGWIAHWREMHGEPNK

SEQ ID NO: 770344 - protein, 23 aa, Mycobacterium
LFALGRLPGWIAHWREMHSEPGK

SEQ ID NO: 770345 - protein, 23 aa, Mycobacterium
LFALGRLPGWIAHWREMHSEPNK

SEQ ID NO: 770346 - protein, 18 aa, Mycobacterium
LFALLAYGEVAAFYRLAE

SEQ ID NO: 770347 - protein, 18 aa, Mycobacterium
LFAQIGMRPGMRGGEFAM

SEQ ID NO: 770348 - protein, 18 aa, Mycobacterium
LFAWCFARRGWAERSATL

SEQ ID NO: 770349 - protein, 27 aa, Mycobacterium
LFAWHLPELWRRFTIALRRAITTHLKA

SEQ ID NO: 770350 - protein, 18 aa, Mycobacterium
LFCPPGIRCEKAAFESHV

SEQ ID NO: 770351 - protein, 17 aa, Mycobacterium
LFDAATLRRLYPGGSTE

SEQ ID NO: 770352 - protein, 19 aa, Mycobacterium
LFDKELIPIAGLSTDEFIR

SEQ ID NO: 770353 - protein, 24 aa, Mycobacterium
LFDLPPRWFSLFTRLGMRTSIRYK

SEQ ID NO: 770354 - protein, 25 aa, Mycobacterium
LFDLPPRWFTLFSRLGIRTSLRYKI

SEQ ID NO: 770355 - protein, 19 aa, Mycobacterium
LFDPRFQKLGIHPGGGATW

SEQ ID NO: 770356 - protein, 17 aa, Mycobacterium
LFDPRLKRSIPFLPNTI

SEQ ID NO: 770357 - protein, 17 aa, Mycobacterium
LFETLGFTYIGPTDGHD

SEQ ID NO: 770358 - protein, 21 aa, Mycobacterium
LFGETCPRQALVLPLAETSNA

SEQ ID NO: 770359 - protein, 20 aa, Mycobacterium
LFGFSPRFPFPDSYQEFCRA

SEQ ID NO: 770360 - protein, 17 aa, Mycobacterium
LFGGYALEYQSVIGHVT

SEQ ID NO: 770361 - protein, 18 aa, Mycobacterium
LFGLFRMGLPTNFGLSGY

SEQ ID NO: 770362 - protein, 17 aa, Mycobacterium
LFHFIRTAEEFSWRASE

SEQ ID NO: 770363 - protein, 29 aa, Mycobacterium
LFHVLRFGFRPSKIAFLAWHAWHDSELGT

SEQ ID NO: 770364 - protein, 18 aa, Mycobacterium
LFIEAGLPPGVFQVVQGD

SEQ ID NO: 770365 - protein, 17 aa, Mycobacterium
LFIGAGMPAGLWKRVVD

SEQ ID NO: 770366 - protein, 18 aa, Mycobacterium
LFIRHALVQGEWQTRHHF

SEQ ID NO: 770367 - protein, 17 aa, Mycobacterium
LFIRRALVEGDWHTRHH

SEQ ID NO: 770368 - protein, 19 aa, Mycobacterium
LFLDIPNPLASIALPPPAS

SEQ ID NO: 770369 - protein, 18 aa, Mycobacterium
LFLEVAWEALENAGIPPQ

SEQ ID NO: 770370 - protein, 17 aa, Mycobacterium
LFLGAEIRQIWARTHQT

SEQ ID NO: 770371 - protein, 20 aa, Mycobacterium
LFLPGWKWTLRWDTGKRKWD

SEQ ID NO: 770372 - protein, 18 aa, Mycobacterium
LFLRDLVMALRWVKDNIS

SEQ ID NO: 770373 - protein, 17 aa, Mycobacterium
LFLSLPGVNEWRTLQRV

SEQ ID NO: 770374 - protein, 17 aa, Mycobacterium
LFMAGLWSVWKPAKEGS

SEQ ID NO: 770375 - protein, 18 aa, Mycobacterium
LFMPDGRVVPVCKVQVDP

SEQ ID NO: 770376 - protein, 18 aa, Mycobacterium
LFPAEFAKRARSLGESVG

SEQ ID NO: 770377 - protein, 21 aa, Mycobacterium
LFPEATMCRFGVPLGPVAQPL

SEQ ID NO: 770378 - protein, 19 aa, Mycobacterium
LFPFCAVLQELARRGHDIH

SEQ ID NO: 770379 - protein, 19 aa, Mycobacterium
LFPGALLWLPRRSRRQFTA

SEQ ID NO: 770380 - protein, 18 aa, Mycobacterium
LFPITAIPAQIQQNLVNI

SEQ ID NO: 770381 - protein, 21 aa, Mycobacterium
LFPSLCRPTAPVAVDAGVRAP

SEQ ID NO: 770382 - protein, 24 aa, Mycobacterium
LFPSLRFALTFSYARFLRRGRKAP

SEQ ID NO: 770383 - protein, 19 aa, Mycobacterium
LFPVHCWFEGDGWGMRVYP

SEQ ID NO: 770384 - protein, 29 aa, Mycobacterium
LFQVLRFGFRPSKVAFLAWHAWHDVGAGD

SEQ ID NO: 770385 - protein, 17 aa, Mycobacterium
LFRELRILPPFTQKTTR

SEQ ID NO: 770386 - protein, 19 aa, Mycobacterium
LFRESLRLILDPGVLIEAL

SEQ ID NO: 770387 - protein, 25 aa, Mycobacterium
LFRSTPIPVCLWFFDTDKGTRSGQV

SEQ ID NO: 770388 - protein, 24 aa, Mycobacterium
LFSALELLHAWALIHDDVIDASST

SEQ ID NO: 770389 - protein, 23 aa, Mycobacterium
LFSEWRALLMLGDFERADTFAAE

SEQ ID NO: 770390 - protein, 25 aa, Mycobacterium
LFSGWTDDILKAFSWDAAAQQPAIL

SEQ ID NO: 770391 - protein, 20 aa, Mycobacterium
LFSQHAKTYQLLAAELAAIP

SEQ ID NO: 770392 - protein, 21 aa, Mycobacterium
LFSQWAEDVVRVFGFSVDVAA

SEQ ID NO: 770393 - protein, 18 aa, Mycobacterium
LFSSHARAYQALSVQAGQ

SEQ ID NO: 770394 - protein, 19 aa, Mycobacterium
LFTEHAFYFGDTHVRLRGK

SEQ ID NO: 770395 - protein, 19 aa, Mycobacterium
LFTEHAFYFGDTHVRLRGR

SEQ ID NO: 770396 - protein, 17 aa, Mycobacterium
LFVPPALFPDYLRTARR

SEQ ID NO: 770397 - protein, 18 aa, Mycobacterium
LFWQCWKLDSPLVQAITD

SEQ ID NO: 770398 - protein, 20 aa, Mycobacterium
LFYSGFYLPMYWSSRAKLTN

SEQ ID NO: 770399 - protein, 17 aa, Mycobacterium
LGAALWRRGIHRVLHGF

SEQ ID NO: 770400 - protein, 20 aa, Mycobacterium
LGAALWRTGIHRVLREFVLD

SEQ ID NO: 770401 - protein, 17 aa, Mycobacterium
LGAAMTMLQQPTSQADL

SEQ ID NO: 770402 - protein, 22 aa, Mycobacterium
LGADLVRFLPWFSHPRLSVAQL

SEQ ID NO: 770403 - protein, 24 aa, Mycobacterium
LGAEGRLPISYSRKVFIPVTHLCR

SEQ ID NO: 770404 - protein, 19 aa, Mycobacterium
LGAELGWAGLLIAEQYDGL

SEQ ID NO: 770405 - protein, 19 aa, Mycobacterium
LGAGLDWKSSLQELTAARG

SEQ ID NO: 770406 - protein, 19 aa, Mycobacterium
LGAGLDWKSSLQELTASLA

SEQ ID NO: 770407 - protein, 19 aa, Mycobacterium
LGAIARRLETPWGHLLAAL

SEQ ID NO: 770408 - protein, 23 aa, Mycobacterium
LGALGMTGLTAWIGIRDIGKPQP

SEQ ID NO: 770409 - protein, 18 aa, Mycobacterium
LGALGMTGLTAWIGIRDV

SEQ ID NO: 770410 - protein, 23 aa, Mycobacterium
LGALGMTGLTAWIGMREIAKPRP

SEQ ID NO: 770411 - protein, 18 aa, Mycobacterium
LGALRWVRDNIAAFGGDP

SEQ ID NO: 770412 - protein, 17 aa, Mycobacterium
LGALVLTSCDAFEHFPP

SEQ ID NO: 770413 - protein, 19 aa, Mycobacterium
LGAPCWIDLTTSDVARAQD

SEQ ID NO: 770414 - protein, 17 aa, Mycobacterium
LGAQCWLVDDARLAMLI

SEQ ID NO: 770415 - protein, 24 aa, Mycobacterium
LGARFDAGLAWVHFPVGFGGLDLP

SEQ ID NO: 770416 - protein, 20 aa, Mycobacterium
LGARIGVPVSAFFETMTRFN

SEQ ID NO: 770417 - protein, 20 aa, Mycobacterium
LGARRWIRMPAVRFGPDTCT

SEQ ID NO: 770418 - protein, 18 aa, Mycobacterium
LGASPVWHVFAIDQTGIV

SEQ ID NO: 770419 - protein, 17 aa, Mycobacterium
LGASWRPGCPVEPGQLR

SEQ ID NO: 770420 - protein, 21 aa, Mycobacterium
LGATCVSLWSGYSVDYSDPET

SEQ ID NO: 770421 - protein, 18 aa, Mycobacterium
LGAVPVPLNTRWAAPEKL

SEQ ID NO: 770422 - protein, 18 aa, Mycobacterium
LGAYAARVWLPMLRAEGA

SEQ ID NO: 770423 - protein, 20 aa, Mycobacterium
LGCFGMKIPTEYGGLNMSQV

SEQ ID NO: 770424 - protein, 18 aa, Mycobacterium
LGCVAAIKTLEICTRPEV

SEQ ID NO: 770425 - protein, 17 aa, Mycobacterium
LGCYGVHVLRRFGVPSI

SEQ ID NO: 770426 - protein, 17 aa, Mycobacterium
LGDDCWFNLRSSNTEPL

SEQ ID NO: 770427 - protein, 20 aa, Mycobacterium
LGDLEKCWSLLLTGILQPDR

SEQ ID NO: 770428 - protein, 17 aa, Mycobacterium
LGDLRLCGGQRLSTFRT

SEQ ID NO: 770429 - protein, 19 aa, Mycobacterium
LGDRVAALAAAWRSGLPGG

SEQ ID NO: 770430 - protein, 18 aa, Mycobacterium
LGDVAAWAGADGRPNRVE

SEQ ID NO: 770431 - protein, 17 aa, Mycobacterium
LGEEGGRAFIRSMEGVE

SEQ ID NO: 770432 - protein, 26 aa, Mycobacterium
LGELKRPFGIGVIDWVIRKEPELLTT

SEQ ID NO: 770433 - protein, 22 aa, Mycobacterium
LGELRPLYRPGLFHMYHALTWG

SEQ ID NO: 770434 - protein, 23 aa, Mycobacterium
LGELRPLYRPGLIHMYHALTWGP

SEQ ID NO: 770435 - protein, 22 aa, Mycobacterium
LGELRPLYRPGLVHMYHALTWG

SEQ ID NO: 770436 - protein, 24 aa, Mycobacterium
LGEMPGVAVPLVFRLLGETGVHAP

SEQ ID NO: 770437 - protein, 25 aa, Mycobacterium
LGEPFMLPAHIDFAALRVKFDGGTL

SEQ ID NO: 770438 - protein, 20 aa, Mycobacterium
LGEQCAFGLALIAPRLPPFD

SEQ ID NO: 770439 - protein, 18 aa, Mycobacterium
LGESLGLIDMERGAKVSG

SEQ ID NO: 770440 - protein, 18 aa, Mycobacterium
LGEVVAVFAPGGRLQQCD

SEQ ID NO: 770441 - protein, 18 aa, Mycobacterium
LGFHEAWVGEHHSAGFEI

SEQ ID NO: 770442 - protein, 25 aa, Mycobacterium
LGFPLRSGFEFFLRKGLQLGLGDRR

SEQ ID NO: 770443 - protein, 17 aa, Mycobacterium
LGFPLSIHLEATYGVSA

SEQ ID NO: 770444 - protein, 17 aa, Mycobacterium
LGFPLSVHFEATYGVNT

SEQ ID NO: 770445 - protein, 17 aa, Mycobacterium
LGFREHASWALTSDILE

SEQ ID NO: 770446 - protein, 18 aa, Mycobacterium
LGFRRGWLSERFDLKDSG

SEQ ID NO: 770447 - protein, 20 aa, Mycobacterium
LGFTYDTGWYLQFRATEPDD

SEQ ID NO: 770448 - protein, 18 aa, Mycobacterium
LGGAFNCGKAQPGQIAAV

SEQ ID NO: 770449 - protein, 18 aa, Mycobacterium
LGGAFNCGKAQPGQIAPV

SEQ ID NO: 770450 - protein, 18 aa, Mycobacterium
LGGAFNCGKAQPGQVAAV

SEQ ID NO: 770451 - protein, 17 aa, Mycobacterium
LGGAPVRIGSFLADDHA

SEQ ID NO: 770452 - protein, 19 aa, Mycobacterium
LGGAYAVGPVFWAAELLGI

SEQ ID NO: 770453 - protein, 22 aa, Mycobacterium
LGGFRYGLPIKRWLLDHEAAAV

SEQ ID NO: 770454 - protein, 20 aa, Mycobacterium
LGGGHGWYSAQLCRRYPTLA

SEQ ID NO: 770455 - protein, 27 aa, Mycobacterium
LGGGKRLRPAFAYWGWRAVATDEPDEQ

SEQ ID NO: 770456 - protein, 24 aa, Mycobacterium
LGGKARSGPEFDKGYWIEPTIYLD

SEQ ID NO: 770457 - protein, 25 aa, Mycobacterium
LGGKWRVGAAFPWGIPVLLLTTTGR

SEQ ID NO: 770458 - protein, 20 aa, Mycobacterium
LGGLCERVALLPGADTQAFV

SEQ ID NO: 770459 - protein, 24 aa, Mycobacterium
LGGLTLPMLRSWLAAHAAAGTARS

SEQ ID NO: 770460 - protein, 19 aa, Mycobacterium
LGGNCPVIVLGDVDVEAVA

SEQ ID NO: 770461 - protein, 25 aa, Mycobacterium
LGHARLTRFLIRYSRGAWREAQATL

SEQ ID NO: 770462 - protein, 17 aa, Mycobacterium
LGHERVMLWLGYANLLG

SEQ ID NO: 770463 - protein, 19 aa, Mycobacterium
LGHFDAWAAQFVRYEVLIE

SEQ ID NO: 770464 - protein, 17 aa, Mycobacterium
LGHQWVLFHGHGQQRIR

SEQ ID NO: 770465 - protein, 24 aa, Mycobacterium
LGHRIRAAIHFDDLQWERGYDRIA

SEQ ID NO: 770466 - protein, 23 aa, Mycobacterium
LGHRIRAAIHFDDLQWERSYNRV

SEQ ID NO: 770467 - protein, 23 aa, Mycobacterium
LGHRLRAAIHFDDLQWEHRYDRI

SEQ ID NO: 770468 - protein, 19 aa, Mycobacterium
LGIAAARFHDEFVGNLRAA

SEQ ID NO: 770469 - protein, 18 aa, Mycobacterium
LGICGGFQMLGRVIRDPH

SEQ ID NO: 770470 - protein, 21 aa, Mycobacterium
LGIDWPLPVTMVSPRDAGAGS

SEQ ID NO: 770471 - protein, 20 aa, Mycobacterium
LGIRARPTWSGPPEFAYADF

SEQ ID NO: 770472 - protein, 18 aa, Mycobacterium
LGIRGCSVSMPFKEDVLA

SEQ ID NO: 770473 - protein, 18 aa, Mycobacterium
LGIRGCSVSMPFKQDVMA

SEQ ID NO: 770474 - protein, 18 aa, Mycobacterium
LGIVASTWHGKICEALLQ

SEQ ID NO: 770475 - protein, 19 aa, Mycobacterium
LGKLGSFDFNSRFYADDDL

SEQ ID NO: 770476 - protein, 23 aa, Mycobacterium
LGLARLWQSWGFEPDVVLGHSVG

SEQ ID NO: 770477 - protein, 24 aa, Mycobacterium
LGLARLWQSWGFEPDVVVGHSVGQ

SEQ ID NO: 770478 - protein, 24 aa, Mycobacterium
LGLDGDGLGTCWGREVATTMLADA

SEQ ID NO: 770479 - protein, 17 aa, Mycobacterium
LGLDYVDLYLIHWPAPA

SEQ ID NO: 770480 - protein, 20 aa, Mycobacterium
LGLEGAGLGTMWGRQLAESM

SEQ ID NO: 770481 - protein, 18 aa, Mycobacterium
LGLEIFDWLEVVDFGDAY

SEQ ID NO: 770482 - protein, 17 aa, Mycobacterium
LGLKVGMMICYDVEFPE

SEQ ID NO: 770483 - protein, 22 aa, Mycobacterium
LGLLRRFAKGWIVRANQVGVDE

SEQ ID NO: 770484 - protein, 17 aa, Mycobacterium
LGLLSWMYHRPLEGTEQ

SEQ ID NO: 770485 - protein, 17 aa, Mycobacterium
LGLLYRWVEQAFGGREH

SEQ ID NO: 770486 - protein, 26 aa, Mycobacterium
LGLMLRAPFRLARDVIPHMGPGSAII

SEQ ID NO: 770487 - protein, 26 aa, Mycobacterium
LGLMLRAPFRLARDVLPHMGPGSAII

SEQ ID NO: 770488 - protein, 18 aa, Mycobacterium
LGLPRGGVPVAFEVARAL

SEQ ID NO: 770489 - protein, 17 aa, Mycobacterium
LGLQDVIMTRDRDGQLH

SEQ ID NO: 770490 - protein, 24 aa, Mycobacterium
LGLRDVIFALQWVRDNIAAFGGDP

SEQ ID NO: 770491 - protein, 17 aa, Mycobacterium
LGLRPAPEFETWLRKVG

SEQ ID NO: 770492 - protein, 21 aa, Mycobacterium
LGLRVRLPWHTTRTPVTAAAD

SEQ ID NO: 770493 - protein, 25 aa, Mycobacterium
LGLTLPEFVCLRILSAQPRQSNAEL

SEQ ID NO: 770494 - protein, 22 aa, Mycobacterium
LGLVPMRAGNRWDISAPRNTYQ

SEQ ID NO: 770495 - protein, 17 aa, Mycobacterium
LGMPVNWGIGTPDLPIP

SEQ ID NO: 770496 - protein, 19 aa, Mycobacterium
LGMPWIVVVGRGWADGVVE

SEQ ID NO: 770497 - protein, 17 aa, Mycobacterium
LGMRPSWVLDLNNGGCA

SEQ ID NO: 770498 - protein, 20 aa, Mycobacterium
LGMTGLTAWIGIRDVGRPRA

SEQ ID NO: 770499 - protein, 20 aa, Mycobacterium
LGNAGFRWLVDACSPVDDPV

SEQ ID NO: 770500 - protein, 17 aa, Mycobacterium
LGNLIPEWNDLVRRGRW

SEQ ID NO: 770501 - protein, 21 aa, Mycobacterium
LGNLRARFNLALGIGSAGFSG

SEQ ID NO: 770502 - protein, 17 aa, Mycobacterium
LGNWTGIPVFKLTEAET

SEQ ID NO: 770503 - protein, 17 aa, Mycobacterium
LGPDGKRQPAHFDGLPV

SEQ ID NO: 770504 - protein, 17 aa, Mycobacterium
LGPQDALPRCRQTVHRG

SEQ ID NO: 770505 - protein, 20 aa, Mycobacterium
LGPRGRHVVLAKSFGGPQVT

SEQ ID NO: 770506 - protein, 19 aa, Mycobacterium
LGPRGRHVVLAKSFGGPTI

SEQ ID NO: 770507 - protein, 19 aa, Mycobacterium
LGPRGRHVVLAKSFGGPTV

SEQ ID NO: 770508 - protein, 20 aa, Mycobacterium
LGPRGRHVVLAKSWGGPTVT

SEQ ID NO: 770509 - protein, 17 aa, Mycobacterium
LGPRPASWWLRRWVHEV

SEQ ID NO: 770510 - protein, 17 aa, Mycobacterium
LGPTAWPSGNPAMLRLT

SEQ ID NO: 770511 - protein, 24 aa, Mycobacterium
LGPVADLFPILALPGQDVQGFSNL

SEQ ID NO: 770512 - protein, 18 aa, Mycobacterium
LGQLRAGDTVRFIRIEAS

SEQ ID NO: 770513 - protein, 23 aa, Mycobacterium
LGQLWWNKEFCRIVVIDGQHRAM

SEQ ID NO: 770514 - protein, 17 aa, Mycobacterium
LGRAAMRAFDWVSWRLN

SEQ ID NO: 770515 - protein, 17 aa, Mycobacterium
LGRCIGVGLARRGDDVA

SEQ ID NO: 770516 - protein, 17 aa, Mycobacterium
LGRGIKAGRVWTNCYHQ

SEQ ID NO: 770517 - protein, 23 aa, Mycobacterium
LGRHEFPLVLSPAVEEFLTAVAE

SEQ ID NO: 770518 - protein, 18 aa, Mycobacterium
LGRLCVYLSTRDCYATNA

SEQ ID NO: 770519 - protein, 20 aa, Mycobacterium
LGRLRFTTSLADMADRQLVI

SEQ ID NO: 770520 - protein, 26 aa, Mycobacterium
LGRPLRIAHAWSFAFDAAWQPLVALL

SEQ ID NO: 770521 - protein, 27 aa, Mycobacterium
LGRPLRIAHAWSFGFDAAWQPLVALLD

SEQ ID NO: 770522 - protein, 23 aa, Mycobacterium
LGRRSNVYVVEWQNVHGLTPSGL

SEQ ID NO: 770523 - protein, 20 aa, Mycobacterium
LGRSGLRVSPLCLGAMTFGE

SEQ ID NO: 770524 - protein, 21 aa, Mycobacterium
LGRSNGWSGLIINGAVRDAST

SEQ ID NO: 770525 - protein, 24 aa, Mycobacterium
LGRYGVCANAICPRARTAMTADVF

SEQ ID NO: 770526 - protein, 26 aa, Mycobacterium
LGSGWKGGAGSAYSEQWDKWHNGAGQ

SEQ ID NO: 770527 - protein, 19 aa, Mycobacterium
LGSIALTWDGGELTYRQLD

SEQ ID NO: 770528 - protein, 18 aa, Mycobacterium
LGSILRWFVAGTLGVGPV

SEQ ID NO: 770529 - protein, 21 aa, Mycobacterium
LGSILSWQNWEDMFSMAKFVG

SEQ ID NO: 770530 - protein, 24 aa, Mycobacterium
LGSKMSRFFLRNALVARLLSEASW

SEQ ID NO: 770531 - protein, 17 aa, Mycobacterium
LGSLGIRVTAIAPSLFA

SEQ ID NO: 770532 - protein, 21 aa, Mycobacterium
LGSLRVGNRFVHTGKPTAAGY

SEQ ID NO: 770533 - protein, 18 aa, Mycobacterium
LGSLRVGNRFVHTVKPTP

SEQ ID NO: 770534 - protein, 18 aa, Mycobacterium
LGSSTLRLARSALLEQQM

SEQ ID NO: 770535 - protein, 24 aa, Mycobacterium
LGTAAVCWRLRRRYGLPVHDIAPM

SEQ ID NO: 770536 - protein, 20 aa, Mycobacterium
LGTACAVAFGAAFELTSRRA

SEQ ID NO: 770537 - protein, 20 aa, Mycobacterium
LGTAWRLRSPWHGVRAQLDL

SEQ ID NO: 770538 - protein, 19 aa, Mycobacterium
LGTCKVCLYAGSIMPDDLL

SEQ ID NO: 770539 - protein, 25 aa, Mycobacterium
LGTFFIGQCLYRFANVYNKALRAEI

SEQ ID NO: 770540 - protein, 20 aa, Mycobacterium
LGTFLYWMLWKRPGLDIYLL

SEQ ID NO: 770541 - protein, 20 aa, Mycobacterium
LGTFSWPGAYGTWWQADPGA

SEQ ID NO: 770542 - protein, 23 aa, Mycobacterium
LGTVAVTPIMHWLRDVDGPIVEF

SEQ ID NO: 770543 - protein, 18 aa, Mycobacterium
LGTVPAIVDWYERRGVTP

SEQ ID NO: 770544 - protein, 21 aa, Mycobacterium
LGVALRIAWRALTFAGLHGSD

SEQ ID NO: 770545 - protein, 19 aa, Mycobacterium
LGVDEVWAIGGAQAVALLA

SEQ ID NO: 770546 - protein, 19 aa, Mycobacterium
LGVFCRRWGVPLIDGGTIR

SEQ ID NO: 770547 - protein, 18 aa, Mycobacterium
LGVFGGFELGDLAGDFSD

SEQ ID NO: 770548 - protein, 19 aa, Mycobacterium
LGVGIGRRFVECTPDSLLA

SEQ ID NO: 770549 - protein, 23 aa, Mycobacterium
LGVGWPKEFGGLGFGPIEQQIFV

SEQ ID NO: 770550 - protein, 24 aa, Mycobacterium
LGVGWPKEFGGLGFGPIEQSIFVN

SEQ ID NO: 770551 - protein, 25 aa, Mycobacterium
LGVMLRAPFRLARDVIVHMQPGSAI

SEQ ID NO: 770552 - protein, 17 aa, Mycobacterium
LGVPCAWPDDAVTVCSF

SEQ ID NO: 770553 - protein, 23 aa, Mycobacterium
LGVPGRLVLVGGLHRIEAALAQP

SEQ ID NO: 770554 - protein, 21 aa, Mycobacterium
LGVPMDFRLGFGAVFGPQTRL

SEQ ID NO: 770555 - protein, 19 aa, Mycobacterium
LGVPRLVVHPGELVNGQAA

SEQ ID NO: 770556 - protein, 18 aa, Mycobacterium
LGVQYARQGIRVNALCPG

SEQ ID NO: 770557 - protein, 17 aa, Mycobacterium
LGVRPAGLWAFEALRVA

SEQ ID NO: 770558 - protein, 20 aa, Mycobacterium
LGVRVALDWDRGVELISPIP

SEQ ID NO: 770559 - protein, 19 aa, Mycobacterium
LGVSAATCFAWADRDTDAA

SEQ ID NO: 770560 - protein, 20 aa, Mycobacterium
LGWARPGSDWERRFSAADGP

SEQ ID NO: 770561 - protein, 20 aa, Mycobacterium
LGWLCVWAVLEAVAEPGSAA

SEQ ID NO: 770562 - protein, 21 aa, Mycobacterium
LGYGDPRYGYSTAPANIETPF

SEQ ID NO: 770563 - protein, 21 aa, Mycobacterium
LGYGDPRYGYSTAPANVPTPF

SEQ ID NO: 770564 - protein, 30 aa, Mycobacterium
LGYNFKDWDLRTAFTWKFLRAATAEQITAS

SEQ ID NO: 770565 - protein, 26 aa, Mycobacterium
LGYQVGFPWSLGVGINFSYTTPNILI

SEQ ID NO: 770566 - protein, 23 aa, Mycobacterium
LGYRVRRLAGRVVWLAPPDAPTP

SEQ ID NO: 770567 - protein, 21 aa, Mycobacterium
LHAAAGCWRGLAAALGGAEQG

SEQ ID NO: 770568 - protein, 18 aa, Mycobacterium
LHAEWTWASSVFDRGALV

SEQ ID NO: 770569 - protein, 18 aa, Mycobacterium
LHAGFPPERITFHGNNKS

SEQ ID NO: 770570 - protein, 19 aa, Mycobacterium
LHALGPRWALVKGGHLRSS

SEQ ID NO: 770571 - protein, 17 aa, Mycobacterium
LHANWRWATSALTDEQV

SEQ ID NO: 770572 - protein, 17 aa, Mycobacterium
LHARLALEATEQGVPMN

SEQ ID NO: 770573 - protein, 17 aa, Mycobacterium
LHATWTWAPSALDREQV

SEQ ID NO: 770574 - protein, 18 aa, Mycobacterium
LHCGDAFYHVGTLDGQSK

SEQ ID NO: 770575 - protein, 17 aa, Mycobacterium
LHDIAWRAMQVHGALGV

SEQ ID NO: 770576 - protein, 18 aa, Mycobacterium
LHDPARWKYVHLGNHTLH

SEQ ID NO: 770577 - protein, 19 aa, Mycobacterium
LHDRMALEWSIVVLGPDTA

SEQ ID NO: 770578 - protein, 18 aa, Mycobacterium
LHDVLREAWGFKGFVVSD

SEQ ID NO: 770579 - protein, 17 aa, Mycobacterium
LHEGHAIEAARRVLDQP

SEQ ID NO: 770580 - protein, 18 aa, Mycobacterium
LHEIPWDLVASIGVTLRL

SEQ ID NO: 770581 - protein, 21 aa, Mycobacterium
LHFFPAAALELGWLQSQVTSA

SEQ ID NO: 770582 - protein, 23 aa, Mycobacterium
LHFFPARLWASGGMSPLITAAVD

SEQ ID NO: 770583 - protein, 22 aa, Mycobacterium
LHFGKPLVVLPLFWDQYENAQR

SEQ ID NO: 770584 - protein, 18 aa, Mycobacterium
LHGLAGWVDVKGPVVATA

SEQ ID NO: 770585 - protein, 18 aa, Mycobacterium
LHGLPVRKLWGIGPVAED

SEQ ID NO: 770586 - protein, 17 aa, Mycobacterium
LHHAVLMMIPEAWERHE

SEQ ID NO: 770587 - protein, 18 aa, Mycobacterium
LHHFPTRRMCNLASVTSF

SEQ ID NO: 770588 - protein, 17 aa, Mycobacterium
LHHLKAAGFGIDVATVS

SEQ ID NO: 770589 - protein, 19 aa, Mycobacterium
LHHTYSFLGIETYRQVSTE

SEQ ID NO: 770590 - protein, 18 aa, Mycobacterium
LHHTYSFLGVETYRQVST

SEQ ID NO: 770591 - protein, 18 aa, Mycobacterium
LHKHWGFGGGPHRCLGSH

SEQ ID NO: 770592 - protein, 18 aa, Mycobacterium
LHLKASNVIPGYFKHPEL

SEQ ID NO: 770593 - protein, 17 aa, Mycobacterium
LHLRAAAAALRSLRVGP

SEQ ID NO: 770594 - protein, 19 aa, Mycobacterium
LHLRMPEVWGIRLEGELPQ

SEQ ID NO: 770595 - protein, 23 aa, Mycobacterium
LHLYRCREVCAAVDVARADILLV

SEQ ID NO: 770596 - protein, 19 aa, Mycobacterium
LHPAWPMAMAVAGRAEFAD

SEQ ID NO: 770597 - protein, 25 aa, Mycobacterium
LHPDLKWDFRLPRVVSINVSGHKYG

SEQ ID NO: 770598 - protein, 25 aa, Mycobacterium
LHPDLQWDFRLPRVVSINVSGHKYG

SEQ ID NO: 770599 - protein, 23 aa, Mycobacterium
LHPEAIAALGIREWDAISLTGSR

SEQ ID NO: 770600 - protein, 23 aa, Mycobacterium
LHPEAIAALGIREWDAVSLTGAR

SEQ ID NO: 770601 - protein, 18 aa, Mycobacterium
LHPGEFVLGATLERCTLP

SEQ ID NO: 770602 - protein, 24 aa, Mycobacterium
LHPMSAPMSMEWLSARFRGEPLPT

SEQ ID NO: 770603 - protein, 19 aa, Mycobacterium
LHPTQWVRLWFSDGGKLHQ

SEQ ID NO: 770604 - protein, 19 aa, Mycobacterium
LHRGCAGLAEVARPAPHSV

SEQ ID NO: 770605 - protein, 18 aa, Mycobacterium
LHRHFGWLTRWYAFSSAD

SEQ ID NO: 770606 - protein, 24 aa, Mycobacterium
LHRLRGMFAFAIWDTVERELFCAR

SEQ ID NO: 770607 - protein, 23 aa, Mycobacterium
LHRLRGMFAFALWDTVEQELFCA

SEQ ID NO: 770608 - protein, 23 aa, Mycobacterium
LHRLRLPWWHVWRVAEAAGAATP

SEQ ID NO: 770609 - protein, 17 aa, Mycobacterium
LHRRGCVVQRLILLDPP

SEQ ID NO: 770610 - protein, 26 aa, Mycobacterium
LHRRRGWTWSGFRIMNVLWVFGTVEQ

SEQ ID NO: 770611 - protein, 22 aa, Mycobacterium
LHSGDKVMLCFGAANRDDEVFP

SEQ ID NO: 770612 - protein, 20 aa, Mycobacterium
LHSTPRWCIWIPDDDLPADV

SEQ ID NO: 770613 - protein, 22 aa, Mycobacterium
LHSVKVIPGRGAWLEFDVDKRD

SEQ ID NO: 770614 - protein, 17 aa, Mycobacterium
LHWECLNPVPPATTDTL

SEQ ID NO: 770615 - protein, 22 aa, Mycobacterium
LIAARWGFSRAQLDEFAATSHE

SEQ ID NO: 770616 - protein, 18 aa, Mycobacterium
LIAARWGLSRTQLDEFSA

SEQ ID NO: 770617 - protein, 17 aa, Mycobacterium
LIAEFGISWILPRLTSW

SEQ ID NO: 770618 - protein, 21 aa, Mycobacterium
LIAGAAYRWLRSWPTAPADPW

SEQ ID NO: 770619 - protein, 23 aa, Mycobacterium
LIAKRRLRFPVGHSVDADKVAAT

SEQ ID NO: 770620 - protein, 24 aa, Mycobacterium
LIALARRRINVIWAMLRDHTHYHE

SEQ ID NO: 770621 - protein, 17 aa, Mycobacterium
LIAPHWPAPWGVDAGPL

SEQ ID NO: 770622 - protein, 20 aa, Mycobacterium
LICIGGNPMAAWPDQRKTKR

SEQ ID NO: 770623 - protein, 18 aa, Mycobacterium
LIDARFPIQYVIRPQGGA

SEQ ID NO: 770624 - protein, 24 aa, Mycobacterium
LIDFWRFNVAFARQILAQQPISSP

SEQ ID NO: 770625 - protein, 20 aa, Mycobacterium
LIDGRWVRWDADRAAGAYAH

SEQ ID NO: 770626 - protein, 23 aa, Mycobacterium
LIDIPWRLHHPMWLQDCPVDLDY

SEQ ID NO: 770627 - protein, 17 aa, Mycobacterium
LIDLALRLRQRIADLDQ

SEQ ID NO: 770628 - protein, 21 aa, Mycobacterium
LIDPALLRPGRMERLVFVEPP

SEQ ID NO: 770629 - protein, 18 aa, Mycobacterium
LIDRIGVGKVMWSSDYPH

SEQ ID NO: 770630 - protein, 17 aa, Mycobacterium
LIEAMGLTVGWITAEST

SEQ ID NO: 770631 - protein, 17 aa, Mycobacterium
LIECCLELYAAHLVVGI

SEQ ID NO: 770632 - protein, 26 aa, Mycobacterium
LIEPDLRYLVNWGYGDPAYGWSTSPP

SEQ ID NO: 770633 - protein, 19 aa, Mycobacterium
LIEVRFPDGWSVAPRRLPF

SEQ ID NO: 770634 - protein, 18 aa, Mycobacterium
LIFNLGIGNVGTFNLGSG

SEQ ID NO: 770635 - protein, 19 aa, Mycobacterium
LIGAMLYRIFNRAKTVDET

SEQ ID NO: 770636 - protein, 17 aa, Mycobacterium
LIGAWCFIDHYGPVAAR

SEQ ID NO: 770637 - protein, 18 aa, Mycobacterium
LIGGTCVNNGCIPTKTLV

SEQ ID NO: 770638 - protein, 18 aa, Mycobacterium
LIGIARLDFLPAPVSALF

SEQ ID NO: 770639 - protein, 18 aa, Mycobacterium
LIGLWPMGFRRLGMRDVD

SEQ ID NO: 770640 - protein, 24 aa, Mycobacterium
LIGWRRGICGYRRFFSITSLAALR

SEQ ID NO: 770641 - protein, 17 aa, Mycobacterium
LIHCGRLSVEKHVDRSI

SEQ ID NO: 770642 - protein, 25 aa, Mycobacterium
LIKSIGLRLGVPWYAYDTVIFSGEV

SEQ ID NO: 770643 - protein, 24 aa, Mycobacterium
LIKSIGLRLGVPWYAYDTVTFAGE

SEQ ID NO: 770644 - protein, 17 aa, Mycobacterium
LIKVLRKRGRILQSAPD

SEQ ID NO: 770645 - protein, 17 aa, Mycobacterium
LIKVLRKRGRILQSAPN

SEQ ID NO: 770646 - protein, 18 aa, Mycobacterium
LILADAIVRACEDNPDYL

SEQ ID NO: 770647 - protein, 24 aa, Mycobacterium
LILKEALRLLAPVPLVMRKTVRDV

SEQ ID NO: 770648 - protein, 17 aa, Mycobacterium
LILLMGLRADVDRFNNA

SEQ ID NO: 770649 - protein, 20 aa, Mycobacterium
LILRRCHVVLGRGRFFPPLF

SEQ ID NO: 770650 - protein, 19 aa, Mycobacterium
LIMTGPLAWLAGRTAGSRV

SEQ ID NO: 770651 - protein, 19 aa, Mycobacterium
LINACAHRGAMICRRKTDN

SEQ ID NO: 770652 - protein, 18 aa, Mycobacterium
LINALPFLIGKRAGAPQG

SEQ ID NO: 770653 - protein, 18 aa, Mycobacterium
LINAPALALFGRPWIGNG

SEQ ID NO: 770654 - protein, 23 aa, Mycobacterium
LINCAGVGWPGRTIGKDGQYASA

SEQ ID NO: 770655 - protein, 17 aa, Mycobacterium
LINMYGITETTVHASFR

SEQ ID NO: 770656 - protein, 26 aa, Mycobacterium
LINRVLKGAWGFRGWVMSDWGATPSW

SEQ ID NO: 770657 - protein, 17 aa, Mycobacterium
LIPDFLWIDTEYTAKLS

SEQ ID NO: 770658 - protein, 17 aa, Mycobacterium
LIPGGFGIRGIEGKVGA

SEQ ID NO: 770659 - protein, 18 aa, Mycobacterium
LIPKLILPVNDIFITIIM

SEQ ID NO: 770660 - protein, 17 aa, Mycobacterium
LIPSLFTEHAFYFGDTH

SEQ ID NO: 770661 - protein, 18 aa, Mycobacterium
LIRERGYLAFGLKLFTQT

SEQ ID NO: 770662 - protein, 19 aa, Mycobacterium
LIRKGVRFVRCPGWSDYYP

SEQ ID NO: 770663 - protein, 20 aa, Mycobacterium
LIRLGCPRAKVSVLSAGVEV

SEQ ID NO: 770664 - protein, 23 aa, Mycobacterium
LIRLHHSRFPQARFELHQRSGQG

SEQ ID NO: 770665 - protein, 18 aa, Mycobacterium
LIRRAVVVKAEVVAADEK

SEQ ID NO: 770666 - protein, 20 aa, Mycobacterium
LISRLPGWDSPAADAARGRI

SEQ ID NO: 770667 - protein, 18 aa, Mycobacterium
LITCGLCRACRSGDDVHC

SEQ ID NO: 770668 - protein, 24 aa, Mycobacterium
LITPEMYRLIGINAGRHAKGATPS

SEQ ID NO: 770669 - protein, 23 aa, Mycobacterium
LIWPPRSPSGFSLIVDGQARAGA

SEQ ID NO: 770670 - protein, 23 aa, Mycobacterium
LIYKCPRPPSGIVARNDRIDPDE

SEQ ID NO: 770671 - protein, 17 aa, Mycobacterium
LIYREWVETGAYPRLRD

SEQ ID NO: 770672 - protein, 28 aa, Mycobacterium
LKAAGFRWFRTLGVWGIAGSRDRQPNRY

SEQ ID NO: 770673 - protein, 17 aa, Mycobacterium
LKAANTWHATRAIQEAR

SEQ ID NO: 770674 - protein, 19 aa, Mycobacterium
LKAAYWKSARDGLDGRTID

SEQ ID NO: 770675 - protein, 18 aa, Mycobacterium
LKAFFVLMGVASNDTTRH

SEQ ID NO: 770676 - protein, 23 aa, Mycobacterium
LKAFSFDIGYRIAHHDDLTTPPP

SEQ ID NO: 770677 - protein, 17 aa, Mycobacterium
LKAGMILEGVVTNVAAF

SEQ ID NO: 770678 - protein, 17 aa, Mycobacterium
LKAGMVLEGVVTNVAAF

SEQ ID NO: 770679 - protein, 19 aa, Mycobacterium
LKAIFPLAVTSDLYEGANH

SEQ ID NO: 770680 - protein, 23 aa, Mycobacterium
LKAKARAAGLWNLFLPDPELGGG

SEQ ID NO: 770681 - protein, 17 aa, Mycobacterium
LKALDWARRRFGSDLVW

SEQ ID NO: 770682 - protein, 18 aa, Mycobacterium
LKAMTSWHAQHAITVCRE

SEQ ID NO: 770683 - protein, 18 aa, Mycobacterium
LKARIAALEASRTSYEEI

SEQ ID NO: 770684 - protein, 19 aa, Mycobacterium
LKATFDWHIDGCTPLNDEC

SEQ ID NO: 770685 - protein, 22 aa, Mycobacterium
LKDFRFIPCLSQQAPDPVPNGR

SEQ ID NO: 770686 - protein, 21 aa, Mycobacterium
LKDLLERGGLRAGRTERDVRN

SEQ ID NO: 770687 - protein, 18 aa, Mycobacterium
LKDPEWLEVVLRLLDEAD

SEQ ID NO: 770688 - protein, 21 aa, Mycobacterium
LKELHLRLGAATAELSQRLGR

SEQ ID NO: 770689 - protein, 17 aa, Mycobacterium
LKELIIRGGENIAPAEI

SEQ ID NO: 770690 - protein, 21 aa, Mycobacterium
LKERMDWKMPWYTITDGFDAD

SEQ ID NO: 770691 - protein, 17 aa, Mycobacterium
LKFKIRFLRVNRRHHSV

SEQ ID NO: 770692 - protein, 19 aa, Mycobacterium
LKFLADEGVDLIITSGGLG

SEQ ID NO: 770693 - protein, 19 aa, Mycobacterium
LKFPGRLVVGLAVSRLGTS

SEQ ID NO: 770694 - protein, 21 aa, Mycobacterium
LKFTYVVGWPHLWRAYKKFSD

SEQ ID NO: 770695 - protein, 17 aa, Mycobacterium
LKGAEALQDAWRQADID

SEQ ID NO: 770696 - protein, 17 aa, Mycobacterium
LKGAEAMRQAWRNDGVD

SEQ ID NO: 770697 - protein, 17 aa, Mycobacterium
LKGANLWNEVKDRLDKP

SEQ ID NO: 770698 - protein, 20 aa, Mycobacterium
LKGEVKDVLLLDVTPLSLGI

SEQ ID NO: 770699 - protein, 20 aa, Mycobacterium
LKGGVLLAAYGVRRPTKDAD

SEQ ID NO: 770700 - protein, 23 aa, Mycobacterium
LKGIRKWVWERLGGTLYAQKAAD

SEQ ID NO: 770701 - protein, 19 aa, Mycobacterium
LKGMFAFAIVERDSGRVLL

SEQ ID NO: 770702 - protein, 18 aa, Mycobacterium
LKGPVLWVAALIGEEIFD

SEQ ID NO: 770703 - protein, 19 aa, Mycobacterium
LKGWVWKFDPAIFGGHLAE

SEQ ID NO: 770704 - protein, 18 aa, Mycobacterium
LKHTPIRSVLSFKLFRGS

SEQ ID NO: 770705 - protein, 19 aa, Mycobacterium
LKHWHFGPLYTRDEYIRLQ

SEQ ID NO: 770706 - protein, 20 aa, Mycobacterium
LKIALIKSGALFDVLETSGR

SEQ ID NO: 770707 - protein, 17 aa, Mycobacterium
LKICLSEGGIGWVAGLL

SEQ ID NO: 770708 - protein, 17 aa, Mycobacterium
LKIGSGRRLAATTKETL

SEQ ID NO: 770709 - protein, 18 aa, Mycobacterium
LKILWPGYSISWAYGATA

SEQ ID NO: 770710 - protein, 19 aa, Mycobacterium
LKIPILLIRGKLSDVVSPE

SEQ ID NO: 770711 - protein, 20 aa, Mycobacterium
LKIPRLRDAYLKRFPDYSKG

SEQ ID NO: 770712 - protein, 22 aa, Mycobacterium
LKIRLRQGLPMSRLDSAERERA

SEQ ID NO: 770713 - protein, 17 aa, Mycobacterium
LKITEKLLQPWGIVHGG

SEQ ID NO: 770714 - protein, 18 aa, Mycobacterium
LKKLWGLPGTQLGVVAWP

SEQ ID NO: 770715 - protein, 19 aa, Mycobacterium
LKLGFAGSDFGYAMDLGLP

SEQ ID NO: 770716 - protein, 19 aa, Mycobacterium
LKLGGPRLKDVAGLSLTKL

SEQ ID NO: 770717 - protein, 17 aa, Mycobacterium
LKLGLYPSREDWAEART

SEQ ID NO: 770718 - protein, 18 aa, Mycobacterium
LKLGSKWTDSGYVVVDEF

SEQ ID NO: 770719 - protein, 17 aa, Mycobacterium
LKLLIVFNASTAEGKDD

SEQ ID NO: 770720 - protein, 19 aa, Mycobacterium
LKLRHAMQFELKRIQREVG

SEQ ID NO: 770721 - protein, 21 aa, Mycobacterium
LKLRHVMQFELKRIQREIGIT

SEQ ID NO: 770722 - protein, 17 aa, Mycobacterium
LKLSLAAVMVLRERYLL

SEQ ID NO: 770723 - protein, 20 aa, Mycobacterium
LKLSMFVLNAAFYKPALLSR

SEQ ID NO: 770724 - protein, 25 aa, Mycobacterium
LKLVKPLVIAEGFALLSVPTPFVQN

SEQ ID NO: 770725 - protein, 19 aa, Mycobacterium
LKLVRPLVITEGFALLSVP

SEQ ID NO: 770726 - protein, 17 aa, Mycobacterium
LKMDGAWVIGRVRVPTY

SEQ ID NO: 770727 - protein, 19 aa, Mycobacterium
LKMFFAVFLGAGFVTTTHL

SEQ ID NO: 770728 - protein, 17 aa, Mycobacterium
LKMGLEHLAGYENHTGV

SEQ ID NO: 770729 - protein, 25 aa, Mycobacterium
LKMLFSREMLEGVTADNVFPRALAG

SEQ ID NO: 770730 - protein, 18 aa, Mycobacterium
LKNAIDWLSRPFGSSVFK

SEQ ID NO: 770731 - protein, 17 aa, Mycobacterium
LKNAIDWLSRPYGDSAL

SEQ ID NO: 770732 - protein, 17 aa, Mycobacterium
LKNVFAISAGMGYSLGI

SEQ ID NO: 770733 - protein, 21 aa, Mycobacterium
LKNVYAISVGMGYSLGIGENT

SEQ ID NO: 770734 - protein, 23 aa, Mycobacterium
LKPALGRFGVWTGEPATPDQAVE

SEQ ID NO: 770735 - protein, 17 aa, Mycobacterium
LKPEFIKDISIGSLIYD

SEQ ID NO: 770736 - protein, 17 aa, Mycobacterium
LKPEYKGKVSISNPVTS

SEQ ID NO: 770737 - protein, 17 aa, Mycobacterium
LKPGIIMCREKQDSTSA

SEQ ID NO: 770738 - protein, 19 aa, Mycobacterium
LKPLIFCDGYGSTRRIYGR

SEQ ID NO: 770739 - protein, 20 aa, Mycobacterium
LKPRRVAVLAVHTSPLAQPG

SEQ ID NO: 770740 - protein, 17 aa, Mycobacterium
LKQLTGRDVARPRDIAE

SEQ ID NO: 770741 - protein, 18 aa, Mycobacterium
LKQNEFVSLWSQYASPTQ

SEQ ID NO: 770742 - protein, 17 aa, Mycobacterium
LKQNYAYDIGMMRRSRV

SEQ ID NO: 770743 - protein, 18 aa, Mycobacterium
LKQNYLFDMRTIRRGKVA

SEQ ID NO: 770744 - protein, 19 aa, Mycobacterium
LKRFPTWEVDWPNAVPSQT

SEQ ID NO: 770745 - protein, 22 aa, Mycobacterium
LKRHRFSPFFIDYFITPLVAAV

SEQ ID NO: 770746 - protein, 17 aa, Mycobacterium
LKRLSFEGLVEYDRRAV

SEQ ID NO: 770747 - protein, 17 aa, Mycobacterium
LKRPIPFLPDTIGLITG

SEQ ID NO: 770748 - protein, 18 aa, Mycobacterium
LKRPIPFLPNMIGLITGR

SEQ ID NO: 770749 - protein, 19 aa, Mycobacterium
LKRPIPFLPNMIGLITGRA

SEQ ID NO: 770750 - protein, 20 aa, Mycobacterium
LKRPIPFLPNMVGLITGRAS

SEQ ID NO: 770751 - protein, 24 aa, Mycobacterium
LKRPVPFLPARIGLITGRASAAEH

SEQ ID NO: 770752 - protein, 19 aa, Mycobacterium
LKRPWFPIIPTQDWNALIN

SEQ ID NO: 770753 - protein, 17 aa, Mycobacterium
LKRRCLFLHIDFPDAEL

SEQ ID NO: 770754 - protein, 21 aa, Mycobacterium
LKRVRDLGCEYAILYFPEAAY

SEQ ID NO: 770755 - protein, 18 aa, Mycobacterium
LKRVWRWDFGDLSTVTVH

SEQ ID NO: 770756 - protein, 23 aa, Mycobacterium
LKRWPEWDIDMSGARRSRTSTVR

SEQ ID NO: 770757 - protein, 20 aa, Mycobacterium
LKSEPHWYPYVPRMSRLQKR

SEQ ID NO: 770758 - protein, 21 aa, Mycobacterium
LKSKLRPGGLLLNHCITRNNN

SEQ ID NO: 770759 - protein, 20 aa, Mycobacterium
LKSKLRTGGLLLNHCITRPD

SEQ ID NO: 770760 - protein, 17 aa, Mycobacterium
LKSSVAMELVRKQRGLA

SEQ ID NO: 770761 - protein, 17 aa, Mycobacterium
LKSSVAMELVRKQRGLT

SEQ ID NO: 770762 - protein, 19 aa, Mycobacterium
LKSYLPRLAVTYGAAMATG

SEQ ID NO: 770763 - protein, 22 aa, Mycobacterium
LKTELRLRYGVGVYSESRSVSR

SEQ ID NO: 770764 - protein, 21 aa, Mycobacterium
LKTEPAELEWTLARTDHPDAG

SEQ ID NO: 770765 - protein, 19 aa, Mycobacterium
LKTHCKTCLVVRREGSAIR

SEQ ID NO: 770766 - protein, 20 aa, Mycobacterium
LKTHCKTCLVVRREGSAIRR

SEQ ID NO: 770767 - protein, 18 aa, Mycobacterium
LKTLMSRTAGLSLHYVGG

SEQ ID NO: 770768 - protein, 20 aa, Mycobacterium
LKTLWTIASTNPWLSVTPVS

SEQ ID NO: 770769 - protein, 21 aa, Mycobacterium
LKTSFKAGALIGRGSGEAVQV

SEQ ID NO: 770770 - protein, 18 aa, Mycobacterium
LKTSYAWAQARRDGDDPA

SEQ ID NO: 770771 - protein, 18 aa, Mycobacterium
LKTSYAWAQARRDRDDPE

SEQ ID NO: 770772 - protein, 21 aa, Mycobacterium
LKTWWRPGLLCIGDAAHAMSP

SEQ ID NO: 770773 - protein, 18 aa, Mycobacterium
LKVAFDWKSRFNEARGLD

SEQ ID NO: 770774 - protein, 22 aa, Mycobacterium
LKVFRGAACVVHLAWGFQPTRN

SEQ ID NO: 770775 - protein, 17 aa, Mycobacterium
LKVGAARSFAATTQESL

SEQ ID NO: 770776 - protein, 23 aa, Mycobacterium
LKVGDKVGNAWLWSACGSCEQCR

SEQ ID NO: 770777 - protein, 17 aa, Mycobacterium
LKVGTARRFSASTERTL

SEQ ID NO: 770778 - protein, 20 aa, Mycobacterium
LKVLGLCHSVYWTMVGLCEL

SEQ ID NO: 770779 - protein, 17 aa, Mycobacterium
LKVLPGIRIYLGDTDEQ

SEQ ID NO: 770780 - protein, 18 aa, Mycobacterium
LKVPRRLKELNVRLNAAR

SEQ ID NO: 770781 - protein, 18 aa, Mycobacterium
LKWWTSEVQWEIIDRCLQ

SEQ ID NO: 770782 - protein, 20 aa, Mycobacterium
LKYGVKHGFSAAGAATRQFK

SEQ ID NO: 770783 - protein, 22 aa, Mycobacterium
LKYNCPGFVFSTGLPGPLAAAA

SEQ ID NO: 770784 - protein, 21 aa, Mycobacterium
LKYPHMFAAAGLVILNKIDLL

SEQ ID NO: 770785 - protein, 19 aa, Mycobacterium
LLAAMPPFLTGGSMIETVT

SEQ ID NO: 770786 - protein, 19 aa, Mycobacterium
LLAARCLRGLLTMSSQQPD

SEQ ID NO: 770787 - protein, 19 aa, Mycobacterium
LLAARCVRGLLSMSSGEPD

SEQ ID NO: 770788 - protein, 22 aa, Mycobacterium
LLADPRRAAAMGVAGRHWALDN

SEQ ID NO: 770789 - protein, 17 aa, Mycobacterium
LLAEGIEGRCRIVGVVD

SEQ ID NO: 770790 - protein, 31 aa, Mycobacterium
LLAESFNSLFLRNCINYGLPILAVPGISSAV

SEQ ID NO: 770791 - protein, 17 aa, Mycobacterium
LLAGLLRAGRQVKDLVV

SEQ ID NO: 770792 - protein, 18 aa, Mycobacterium
LLAHDWGSIQGWAAVTAD

SEQ ID NO: 770793 - protein, 20 aa, Mycobacterium
LLALFGRLGYRFAPERIPET

SEQ ID NO: 770794 - protein, 18 aa, Mycobacterium
LLALGIPICEGYGMTECT

SEQ ID NO: 770795 - protein, 17 aa, Mycobacterium
LLAPEWVPWEHRVRPGD

SEQ ID NO: 770796 - protein, 17 aa, Mycobacterium
LLAPHWPAPYGRGASPA

SEQ ID NO: 770797 - protein, 18 aa, Mycobacterium
LLAPHWPKPYGRAAGPAE

SEQ ID NO: 770798 - protein, 18 aa, Mycobacterium
LLAPHWPPPYGRGASAAE

SEQ ID NO: 770799 - protein, 19 aa, Mycobacterium
LLAPRTMRPLLERICAEEN

SEQ ID NO: 770800 - protein, 17 aa, Mycobacterium
LLAPVAVPLVYRASIAA

SEQ ID NO: 770801 - protein, 20 aa, Mycobacterium
LLARGWRIFFAHRTFAWSSD

SEQ ID NO: 770802 - protein, 19 aa, Mycobacterium
LLARLGKRVLRPGGVELTR

SEQ ID NO: 770803 - protein, 22 aa, Mycobacterium
LLARRLVDVTGWLAAQPDTTAL

SEQ ID NO: 770804 - protein, 23 aa, Mycobacterium
LLARRLVDVTGWLAGQPDTASLP

SEQ ID NO: 770805 - protein, 23 aa, Mycobacterium
LLASDFRAGCPIAAVAVEAGEGP

SEQ ID NO: 770806 - protein, 19 aa, Mycobacterium
LLASFPYPHLLTVTARLAD

SEQ ID NO: 770807 - protein, 19 aa, Mycobacterium
LLASMAFCIDKIVSYGVDI

SEQ ID NO: 770808 - protein, 17 aa, Mycobacterium
LLATEWALPRLDAETTV

SEQ ID NO: 770809 - protein, 27 aa, Mycobacterium
LLAVPRLGWVNLHFSLLPAWRGAAPVQ

SEQ ID NO: 770810 - protein, 17 aa, Mycobacterium
LLCAEEVDRACAPWGLL

SEQ ID NO: 770811 - protein, 18 aa, Mycobacterium
LLDAFGIPTAGAAGFEAD

SEQ ID NO: 770812 - protein, 22 aa, Mycobacterium
LLDALRWLGLDWDEGPEVDGPY

SEQ ID NO: 770813 - protein, 23 aa, Mycobacterium
LLDDRVRFIPGWFKDTLQDAPIE

SEQ ID NO: 770814 - protein, 33 aa, Mycobacterium
LLDEAWWFPAICWPDGRLQFMLNERMMPAQFIV

SEQ ID NO: 770815 - protein, 17 aa, Mycobacterium
LLDEAWWLPSVFIANGG

SEQ ID NO: 770816 - protein, 20 aa, Mycobacterium
LLDEFSKVWDYRGRARASAT

SEQ ID NO: 770817 - protein, 19 aa, Mycobacterium
LLDGFPRAAAIVVDPGMTV

SEQ ID NO: 770818 - protein, 19 aa, Mycobacterium
LLDGQRVTTHWAFAERLAS

SEQ ID NO: 770819 - protein, 17 aa, Mycobacterium
LLDGRRATTHWAAADLF

SEQ ID NO: 770820 - protein, 19 aa, Mycobacterium
LLDGRRATTHWAFADRLAR

SEQ ID NO: 770821 - protein, 19 aa, Mycobacterium
LLDGRRATTHWAHCQTLAR

SEQ ID NO: 770822 - protein, 18 aa, Mycobacterium
LLDGRRVTTHWAFADRLA

SEQ ID NO: 770823 - protein, 24 aa, Mycobacterium
LLDGYGLACVGGFVPVVLFSDDHD

SEQ ID NO: 770824 - protein, 18 aa, Mycobacterium
LLDHIPEALPIVYTPTVG

SEQ ID NO: 770825 - protein, 18 aa, Mycobacterium
LLDICFLFLIAGLDTVTD

SEQ ID NO: 770826 - protein, 21 aa, Mycobacterium
LLDIGCGWGATLRRALSRYDV

SEQ ID NO: 770827 - protein, 19 aa, Mycobacterium
LLDIGMTWSAYRDATQALI

SEQ ID NO: 770828 - protein, 17 aa, Mycobacterium
LLDLGWLLVCWPDGPNP

SEQ ID NO: 770829 - protein, 24 aa, Mycobacterium
LLDLRPAVVSFTFGLPSAEERRRL

SEQ ID NO: 770830 - protein, 24 aa, Mycobacterium
LLDPFRPGVCERIGIGPEECAKRN

SEQ ID NO: 770831 - protein, 17 aa, Mycobacterium
LLDRARYLKALAVAAEL

SEQ ID NO: 770832 - protein, 24 aa, Mycobacterium
LLDRLPPLLGTWAFGFATRLSRRS

SEQ ID NO: 770833 - protein, 19 aa, Mycobacterium
LLDRPTLVVGHSFGGALAL

SEQ ID NO: 770834 - protein, 17 aa, Mycobacterium
LLDRWAPGRIMLNAYGP

SEQ ID NO: 770835 - protein, 19 aa, Mycobacterium
LLDRWSAVMMNNYGTPPLA

SEQ ID NO: 770836 - protein, 26 aa, Mycobacterium
LLDVGCGWGGMARYAARRGVRVIGAT

SEQ ID NO: 770837 - protein, 18 aa, Mycobacterium
LLDWCRKNDVVFIADEVQ

SEQ ID NO: 770838 - protein, 25 aa, Mycobacterium
LLEAGRWAASWGKRFPVRYIVGRRG

SEQ ID NO: 770839 - protein, 19 aa, Mycobacterium
LLEALNLYADEMINPLANS

SEQ ID NO: 770840 - protein, 17 aa, Mycobacterium
LLEDLNVAWAQRRSGLD

SEQ ID NO: 770841 - protein, 26 aa, Mycobacterium
LLEGYRAASHWAFREFLSAYGAIPDD

SEQ ID NO: 770842 - protein, 22 aa, Mycobacterium
LLEIARFWAGLALFSRERGRYV

SEQ ID NO: 770843 - protein, 17 aa, Mycobacterium
LLELSWEALERSGIDPT

SEQ ID NO: 770844 - protein, 20 aa, Mycobacterium
LLEMSQLPGRGWVEYEPYGT

SEQ ID NO: 770845 - protein, 17 aa, Mycobacterium
LLEQFGLMHAAKRRVST

SEQ ID NO: 770846 - protein, 21 aa, Mycobacterium
LLERCPVCLYAGSIMPKDLLA

SEQ ID NO: 770847 - protein, 18 aa, Mycobacterium
LLERELPVYIVSIGRTFR

SEQ ID NO: 770848 - protein, 18 aa, Mycobacterium
LLERRLGLTTADIERLAK

SEQ ID NO: 770849 - protein, 17 aa, Mycobacterium
LLESFLFYSGFYLPMYW

SEQ ID NO: 770850 - protein, 23 aa, Mycobacterium
LLEVGCGWGLTLQRAMEKYDVNV

SEQ ID NO: 770851 - protein, 19 aa, Mycobacterium
LLEYHWGPDWMVWDAEKTA

SEQ ID NO: 770852 - protein, 19 aa, Mycobacterium
LLEYHWGPDWMVWDAHKTA

SEQ ID NO: 770853 - protein, 19 aa, Mycobacterium
LLEYHWGPDWMVWDAQRTV

SEQ ID NO: 770854 - protein, 18 aa, Mycobacterium
LLFARLLQYRAFKHVAEM

SEQ ID NO: 770855 - protein, 18 aa, Mycobacterium
LLFARLLQYRAFKHVAQM

SEQ ID NO: 770856 - protein, 17 aa, Mycobacterium
LLFCAACGRRMQGAARA

SEQ ID NO: 770857 - protein, 17 aa, Mycobacterium
LLFCAACGRRMQGAARP

SEQ ID NO: 770858 - protein, 18 aa, Mycobacterium
LLFDSGWLLPGNPPEFGG

SEQ ID NO: 770859 - protein, 19 aa, Mycobacterium
LLFDSGWLLPGNPPEFGGR

SEQ ID NO: 770860 - protein, 19 aa, Mycobacterium
LLFGIPYDRIDVVVHPQSI

SEQ ID NO: 770861 - protein, 19 aa, Mycobacterium
LLFGIPYDRIEVVVHPQSV

SEQ ID NO: 770862 - protein, 19 aa, Mycobacterium
LLFGIPYERIEVVVHPQSI

SEQ ID NO: 770863 - protein, 19 aa, Mycobacterium
LLFGLPYDRIEVVVHPQSI

SEQ ID NO: 770864 - protein, 23 aa, Mycobacterium
LLFPFAAGVPTWWRTMEAKVAKL

SEQ ID NO: 770865 - protein, 17 aa, Mycobacterium
LLGAIAWLAEQKPGIYD

SEQ ID NO: 770866 - protein, 17 aa, Mycobacterium
LLGCGFITGWGSSVYAA

SEQ ID NO: 770867 - protein, 18 aa, Mycobacterium
LLGCPRCGTQFDVVHAGA

SEQ ID NO: 770868 - protein, 23 aa, Mycobacterium
LLGFSIKRAVTWSEEAGNTRPRY

SEQ ID NO: 770869 - protein, 18 aa, Mycobacterium
LLGGLAVMFGVLPPLPTT

SEQ ID NO: 770870 - protein, 23 aa, Mycobacterium
LLGGLPVRRLWGIGPVAEEKLHR

SEQ ID NO: 770871 - protein, 18 aa, Mycobacterium
LLGGMPLAGVGGGSTGAG

SEQ ID NO: 770872 - protein, 18 aa, Mycobacterium
LLGHDWGSIQAWAAVTDD

SEQ ID NO: 770873 - protein, 19 aa, Mycobacterium
LLGHLWSIESWVRQILRTR

SEQ ID NO: 770874 - protein, 24 aa, Mycobacterium
LLGIPDAFAWCWAKGGYWRSHIRS

SEQ ID NO: 770875 - protein, 19 aa, Mycobacterium
LLGIWWAGAELVFGDASTD

SEQ ID NO: 770876 - protein, 23 aa, Mycobacterium
LLGKSAYHALTFGWLMSGLARAV

SEQ ID NO: 770877 - protein, 17 aa, Mycobacterium
LLGLECVIYMGAVDTER

SEQ ID NO: 770878 - protein, 18 aa, Mycobacterium
LLGLRFGAAAVRALDEGH

SEQ ID NO: 770879 - protein, 17 aa, Mycobacterium
LLGMLGLIIGGGFDTTT

SEQ ID NO: 770880 - protein, 18 aa, Mycobacterium
LLGPAYRLFYERPVHLVR

SEQ ID NO: 770881 - protein, 17 aa, Mycobacterium
LLGPEYKSPQLIKPEVL

SEQ ID NO: 770882 - protein, 25 aa, Mycobacterium
LLGREWLKPTAYMMAKFGMTLCALG

SEQ ID NO: 770883 - protein, 17 aa, Mycobacterium
LLGRPLIGNGADGTAPG

SEQ ID NO: 770884 - protein, 17 aa, Mycobacterium
LLGSEAMQRACEDALGA

SEQ ID NO: 770885 - protein, 23 aa, Mycobacterium
LLGSLRIGNRFVHTGKPKPEAYA

SEQ ID NO: 770886 - protein, 23 aa, Mycobacterium
LLGSLRVGNRFVHTGKPTPAGYA

SEQ ID NO: 770887 - protein, 17 aa, Mycobacterium
LLGVPFSAPYSFDTPFG

SEQ ID NO: 770888 - protein, 19 aa, Mycobacterium
LLGVPWIVVIGRGWADGTI

SEQ ID NO: 770889 - protein, 18 aa, Mycobacterium
LLHALSLWRKAADDFAPP

SEQ ID NO: 770890 - protein, 19 aa, Mycobacterium
LLHCPRCGTGFDVVGAGAG

SEQ ID NO: 770891 - protein, 19 aa, Mycobacterium
LLHGLPVRRLWGIGPVAEE

SEQ ID NO: 770892 - protein, 18 aa, Mycobacterium
LLHGWPQTWYAWRKVIPL

SEQ ID NO: 770893 - protein, 19 aa, Mycobacterium
LLHHVPRPPALQVGTCTAL

SEQ ID NO: 770894 - protein, 23 aa, Mycobacterium
LLHLVDFPLALGIRPNIPYEEQR

SEQ ID NO: 770895 - protein, 17 aa, Mycobacterium
LLHWARPIAPLILNASS

SEQ ID NO: 770896 - protein, 18 aa, Mycobacterium
LLIARPGFVVGRMTQGMD

SEQ ID NO: 770897 - protein, 19 aa, Mycobacterium
LLIELDIHFRIEDDLYYPA

SEQ ID NO: 770898 - protein, 20 aa, Mycobacterium
LLIPDWRTGSTLQLTGTARL

SEQ ID NO: 770899 - protein, 18 aa, Mycobacterium
LLIRRAGARSSDMAAELA

SEQ ID NO: 770900 - protein, 18 aa, Mycobacterium
LLIRRSGARSADMAAELA

SEQ ID NO: 770901 - protein, 18 aa, Mycobacterium
LLKCGPWHRGGWDPIPER

SEQ ID NO: 770902 - protein, 18 aa, Mycobacterium
LLLAEGIEGRCRIIGPID

SEQ ID NO: 770903 - protein, 17 aa, Mycobacterium
LLLAHGYDHNWVINRAD

SEQ ID NO: 770904 - protein, 18 aa, Mycobacterium
LLLETAWRAIEHSGTAPS

SEQ ID NO: 770905 - protein, 18 aa, Mycobacterium
LLLEVAWEALEDAGQVPE

SEQ ID NO: 770906 - protein, 18 aa, Mycobacterium
LLLEVAWEALEHAGIPPT

SEQ ID NO: 770907 - protein, 18 aa, Mycobacterium
LLLEVAWEALENAGINPR

SEQ ID NO: 770908 - protein, 21 aa, Mycobacterium
LLLEVICARLLLPSASDAESA

SEQ ID NO: 770909 - protein, 22 aa, Mycobacterium
LLLEVMCARLLLPSAADTESAL

SEQ ID NO: 770910 - protein, 21 aa, Mycobacterium
LLLEVVCARLLLPSASDAESA

SEQ ID NO: 770911 - protein, 22 aa, Mycobacterium
LLLEVVCARLLLPSASDTEAAL

SEQ ID NO: 770912 - protein, 22 aa, Mycobacterium
LLLEVVCARLLLPSATDAESAV

SEQ ID NO: 770913 - protein, 21 aa, Mycobacterium
LLLEVVCSRLLLPSASDTESA

SEQ ID NO: 770914 - protein, 17 aa, Mycobacterium
LLLGYQRCRVHERLVSG

SEQ ID NO: 770915 - protein, 18 aa, Mycobacterium
LLLLGALCHDIGKGRGGD

SEQ ID NO: 770916 - protein, 20 aa, Mycobacterium
LLLLTCGAWGQVVRFIPALV

SEQ ID NO: 770917 - protein, 17 aa, Mycobacterium
LLLPLGLRRLRVYASTR

SEQ ID NO: 770918 - protein, 17 aa, Mycobacterium
LLLPLGVRSLRAYGPTR

SEQ ID NO: 770919 - protein, 17 aa, Mycobacterium
LLLRDVFIAAGGTHDDW

SEQ ID NO: 770920 - protein, 26 aa, Mycobacterium
LLLSRFSFRVRYLWFRAWVNSPAGAR

SEQ ID NO: 770921 - protein, 22 aa, Mycobacterium
LLMARHMFTLWAPKRAGVTDGV

SEQ ID NO: 770922 - protein, 18 aa, Mycobacterium
LLMEVFRPLLSSDSGRIP

SEQ ID NO: 770923 - protein, 17 aa, Mycobacterium
LLMPNCLEFIPIQQAIW

SEQ ID NO: 770924 - protein, 21 aa, Mycobacterium
LLMRRCPRRSFTIVGDLAQRR

SEQ ID NO: 770925 - protein, 17 aa, Mycobacterium
LLMSAWLDLPGRPSLVG

SEQ ID NO: 770926 - protein, 23 aa, Mycobacterium
LLNAKTRRPSVCNAAETLLVDRA

SEQ ID NO: 770927 - protein, 17 aa, Mycobacterium
LLNAWGLTVDAEGLRAF

SEQ ID NO: 770928 - protein, 17 aa, Mycobacterium
LLNGFKWFASNCAGEAF

SEQ ID NO: 770929 - protein, 19 aa, Mycobacterium
LLNGRRATTHWAHCQTLAR

SEQ ID NO: 770930 - protein, 17 aa, Mycobacterium
LLNPLALLASQGVPLAF

SEQ ID NO: 770931 - protein, 18 aa, Mycobacterium
LLNRLWKLVSLRCNFFTP

SEQ ID NO: 770932 - protein, 20 aa, Mycobacterium
LLNRWPQWDIDYDSLQLAPT

SEQ ID NO: 770933 - protein, 23 aa, Mycobacterium
LLNSKTRRPSVCNAAETLLIDRA

SEQ ID NO: 770934 - protein, 17 aa, Mycobacterium
LLPEARHALRLSGAFLA

SEQ ID NO: 770935 - protein, 18 aa, Mycobacterium
LLPEWAIPPREEFDFGYP

SEQ ID NO: 770936 - protein, 17 aa, Mycobacterium
LLPGCKAPSSSGGSPSP

SEQ ID NO: 770937 - protein, 17 aa, Mycobacterium
LLPGYLIFRSIIPGRPP

SEQ ID NO: 770938 - protein, 20 aa, Mycobacterium
LLPILTPIVLAFVAKKLTGG

SEQ ID NO: 770939 - protein, 21 aa, Mycobacterium
LLPNLVTVLGWRSCDHTGPVH

SEQ ID NO: 770940 - protein, 22 aa, Mycobacterium
LLPPALKWRLFFASQGKNPKYL

SEQ ID NO: 770941 - protein, 20 aa, Mycobacterium
LLPRMAAAGFGRVVAVSSVY

SEQ ID NO: 770942 - protein, 22 aa, Mycobacterium
LLPSCWRRINAYGIRVNNRSYD

SEQ ID NO: 770943 - protein, 20 aa, Mycobacterium
LLPTVRGAFCLTFMDENTLY

SEQ ID NO: 770944 - protein, 19 aa, Mycobacterium
LLPVHCWFDGDGWGFEVFP

SEQ ID NO: 770945 - protein, 22 aa, Mycobacterium
LLQHWDWLSSMAELSIKIAKQA

SEQ ID NO: 770946 - protein, 23 aa, Mycobacterium
LLQLRRPALLVGRTDPTGLTAGT

SEQ ID NO: 770947 - protein, 18 aa, Mycobacterium
LLQPEQWGGLQADPTVFY

SEQ ID NO: 770948 - protein, 19 aa, Mycobacterium
LLQPLALAPRGIWLGPKEL

SEQ ID NO: 770949 - protein, 18 aa, Mycobacterium
LLQPMGIVHGGVYCSMIE

SEQ ID NO: 770950 - protein, 19 aa, Mycobacterium
LLQRAGCFRTGYRDGETLR

SEQ ID NO: 770951 - protein, 23 aa, Mycobacterium
LLQRMLFESCLLHAGQACILHSR

SEQ ID NO: 770952 - protein, 20 aa, Mycobacterium
LLQRPRCLYFRDVSAACNRR

SEQ ID NO: 770953 - protein, 19 aa, Mycobacterium
LLQRPRCPYFRDVSAACNR

SEQ ID NO: 770954 - protein, 23 aa, Mycobacterium
LLQRSWIAIFWSRFAEAVELIAE

SEQ ID NO: 770955 - protein, 17 aa, Mycobacterium
LLQVRWLCLEGSGDRVD

SEQ ID NO: 770956 - protein, 21 aa, Mycobacterium
LLRACGGIDGLERVRFTSPHP

SEQ ID NO: 770957 - protein, 21 aa, Mycobacterium
LLRAGAIAKRVRRAMDHLPLG

SEQ ID NO: 770958 - protein, 20 aa, Mycobacterium
LLRDRFRLVAIDNRGAGKSS

SEQ ID NO: 770959 - protein, 21 aa, Mycobacterium
LLREAHDWCGLPVSVFRCDMI

SEQ ID NO: 770960 - protein, 22 aa, Mycobacterium
LLREFADVFGIEGETKMRYDAA

SEQ ID NO: 770961 - protein, 23 aa, Mycobacterium
LLREFLDWLFARYLEIVDGEPNP

SEQ ID NO: 770962 - protein, 17 aa, Mycobacterium
LLREFPILVPTGVGFMK

SEQ ID NO: 770963 - protein, 17 aa, Mycobacterium
LLREVNAEFGVTIVVIT

SEQ ID NO: 770964 - protein, 19 aa, Mycobacterium
LLRFFFKSWFRVEVSGVEN

SEQ ID NO: 770965 - protein, 18 aa, Mycobacterium
LLRFFFRSWFRVEVSGIE

SEQ ID NO: 770966 - protein, 18 aa, Mycobacterium
LLRFFFRSWFRVEVSGVE

SEQ ID NO: 770967 - protein, 24 aa, Mycobacterium
LLRGKLWHDTRCEWWYRQNVLVYA

SEQ ID NO: 770968 - protein, 20 aa, Mycobacterium
LLRGLAQWDRLVIVETFAPE

SEQ ID NO: 770969 - protein, 19 aa, Mycobacterium
LLRGRARMAAVFVTGGHFL

SEQ ID NO: 770970 - protein, 24 aa, Mycobacterium
LLRGVPIGPFGRRTAAAGYSHKYG

SEQ ID NO: 770971 - protein, 25 aa, Mycobacterium
LLRHWGIRPDFVLGHSVGEIAAAYA

SEQ ID NO: 770972 - protein, 20 aa, Mycobacterium
LLRKRPDPMAGMDDAPQSIE

SEQ ID NO: 770973 - protein, 22 aa, Mycobacterium
LLRKSGKAVLDWADVVAEESAE

SEQ ID NO: 770974 - protein, 20 aa, Mycobacterium
LLRLKAWRLDVAKEQKVPAY

SEQ ID NO: 770975 - protein, 17 aa, Mycobacterium
LLRPALRGSDAVLSAVG

SEQ ID NO: 770976 - protein, 23 aa, Mycobacterium
LLRREIACVPLLHGGGHERDIRS

SEQ ID NO: 770977 - protein, 19 aa, Mycobacterium
LLRRGGECLAEFDTDITGV

SEQ ID NO: 770978 - protein, 17 aa, Mycobacterium
LLRRPDLLVSLLTYWQH

SEQ ID NO: 770979 - protein, 22 aa, Mycobacterium
LLRRRIKPLVKRRTKALVAAEL

SEQ ID NO: 770980 - protein, 19 aa, Mycobacterium
LLRSCTGWPSGVWIDEPRR

SEQ ID NO: 770981 - protein, 27 aa, Mycobacterium
LLRWLPRLWPSWRIEFWEDRYEEQFRQ

SEQ ID NO: 770982 - protein, 17 aa, Mycobacterium
LLSAEWQAGVSHHVVLS

SEQ ID NO: 770983 - protein, 18 aa, Mycobacterium
LLSDIALDFKPVVQTRYE

SEQ ID NO: 770984 - protein, 18 aa, Mycobacterium
LLSDYALVCIDEFELDDP

SEQ ID NO: 770985 - protein, 17 aa, Mycobacterium
LLSEWRATLIVRESACL

SEQ ID NO: 770986 - protein, 21 aa, Mycobacterium
LLSKLRAGKVLSLSGIMDDLI

SEQ ID NO: 770987 - protein, 26 aa, Mycobacterium
LLSPILRPALRAVLMVQRRLEGRGPY

SEQ ID NO: 770988 - protein, 21 aa, Mycobacterium
LLSRFGAVQVVRPVEWARSNR

SEQ ID NO: 770989 - protein, 21 aa, Mycobacterium
LLSRLREWGVQQVFGYPGDGI

SEQ ID NO: 770990 - protein, 24 aa, Mycobacterium
LLSSRFPMWMAWGPDLTFFCNDAY

SEQ ID NO: 770991 - protein, 17 aa, Mycobacterium
LLTAAGIAAEWCNEPNL

SEQ ID NO: 770992 - protein, 18 aa, Mycobacterium
LLTARGYLLVSFEDVLGR

SEQ ID NO: 770993 - protein, 25 aa, Mycobacterium
LLTCAIRPSGIWGRGDQTMFRKLFE

SEQ ID NO: 770994 - protein, 25 aa, Mycobacterium
LLTCSIRPSGIWGRGDQTMFRKVFE

SEQ ID NO: 770995 - protein, 17 aa, Mycobacterium
LLTEMGYRPSEIVIAGD

SEQ ID NO: 770996 - protein, 21 aa, Mycobacterium
LLTEWFARWVGFLVPTHRPMD

SEQ ID NO: 770997 - protein, 19 aa, Mycobacterium
LLTGWRDAWELGRTARDNA

SEQ ID NO: 770998 - protein, 17 aa, Mycobacterium
LLTILAIALHEVDTIEV

SEQ ID NO: 770999 - protein, 21 aa, Mycobacterium
LLTPRELGGWAAPLPTALSVY

SEQ ID NO: 771000 - protein, 22 aa, Mycobacterium
LLTRATPYIGHFQIRNRGTLGG

SEQ ID NO: 771001 - protein, 17 aa, Mycobacterium
LLTRNGLTLQDFDYYEI

SEQ ID NO: 771002 - protein, 18 aa, Mycobacterium
LLTRVWADEFGRSGVRVN

SEQ ID NO: 771003 - protein, 17 aa, Mycobacterium
LLTRWRPALAVAQNAKV

SEQ ID NO: 771004 - protein, 17 aa, Mycobacterium
LLVALLYSGRIDLKNDA

SEQ ID NO: 771005 - protein, 24 aa, Mycobacterium
LLVDAMGALVFWRLIALFRPVTSE

SEQ ID NO: 771006 - protein, 17 aa, Mycobacterium
LLVEAAWHHKPRYHVGA

SEQ ID NO: 771007 - protein, 22 aa, Mycobacterium
LLVFGRRAGLGAADYVRALPDR

SEQ ID NO: 771008 - protein, 19 aa, Mycobacterium
LLVGKCCGHGSDIVLDFPV

SEQ ID NO: 771009 - protein, 21 aa, Mycobacterium
LLVHRWCGGGSWVMVLLPVVR

SEQ ID NO: 771010 - protein, 17 aa, Mycobacterium
LLVIFGITGDLARKMTF

SEQ ID NO: 771011 - protein, 19 aa, Mycobacterium
LLVLRINFLGMRQFTESLL

SEQ ID NO: 771012 - protein, 17 aa, Mycobacterium
LLVPRAFVPVAALPVTP

SEQ ID NO: 771013 - protein, 26 aa, Mycobacterium
LLVQPAHTLSQAWITSPLGQVVDPVI

SEQ ID NO: 771014 - protein, 19 aa, Mycobacterium
LLVRGGVVFNGYWGNEEET

SEQ ID NO: 771015 - protein, 18 aa, Mycobacterium
LLVRGGVVFSGYWRNEQA

SEQ ID NO: 771016 - protein, 17 aa, Mycobacterium
LLWRRWSPGYRADEDLR

SEQ ID NO: 771017 - protein, 17 aa, Mycobacterium
LLWSFAPPARPRPADMS

SEQ ID NO: 771018 - protein, 17 aa, Mycobacterium
LLWSFAPSDRMTRPRPA

SEQ ID NO: 771019 - protein, 17 aa, Mycobacterium
LLWSHPGAPAFWYQPSR

SEQ ID NO: 771020 - protein, 19 aa, Mycobacterium
LMAAARLDLASVFFYNGSI

SEQ ID NO: 771021 - protein, 18 aa, Mycobacterium
LMAAARLDLASVFLYNGS

SEQ ID NO: 771022 - protein, 18 aa, Mycobacterium
LMAELGFRTVNEAVGQVG

SEQ ID NO: 771023 - protein, 19 aa, Mycobacterium
LMAELGFRTVNEMVGQVGA

SEQ ID NO: 771024 - protein, 18 aa, Mycobacterium
LMAGLPALRRQRLHAQVA

SEQ ID NO: 771025 - protein, 17 aa, Mycobacterium
LMAPHWPAPWGVDADPL

SEQ ID NO: 771026 - protein, 19 aa, Mycobacterium
LMAQLGFRTVNEMVGQVGA

SEQ ID NO: 771027 - protein, 19 aa, Mycobacterium
LMARLWLRSIARYQDGVLT

SEQ ID NO: 771028 - protein, 20 aa, Mycobacterium
LMAYEVLRDIPLHDVEIETP

SEQ ID NO: 771029 - protein, 18 aa, Mycobacterium
LMCGAGYGRIVLTSSIGG

SEQ ID NO: 771030 - protein, 22 aa, Mycobacterium
LMEMMWSFRANGMWSDERGTNM

SEQ ID NO: 771031 - protein, 17 aa, Mycobacterium
LMENLNISRIVQIDPDT

SEQ ID NO: 771032 - protein, 25 aa, Mycobacterium
LMGHARLTVEFTWYGPDGDSITSVA

SEQ ID NO: 771033 - protein, 22 aa, Mycobacterium
LMGTVWMCRAAWPHMRDAGYGR

SEQ ID NO: 771034 - protein, 18 aa, Mycobacterium
LMHGAAQWSVMTAITTGQ

SEQ ID NO: 771035 - protein, 20 aa, Mycobacterium
LMHLMRIASTFGFVPIGGWA

SEQ ID NO: 771036 - protein, 20 aa, Mycobacterium
LMKFYQCIQNVVIPTQPGAG

SEQ ID NO: 771037 - protein, 18 aa, Mycobacterium
LMLARRLPTASAFLHQPG

SEQ ID NO: 771038 - protein, 18 aa, Mycobacterium
LMLEIAWEGLERAGYSPA

SEQ ID NO: 771039 - protein, 18 aa, Mycobacterium
LMLIWACDLIVAADNAKF

SEQ ID NO: 771040 - protein, 18 aa, Mycobacterium
LMLIWACDLIVAADNARF

SEQ ID NO: 771041 - protein, 18 aa, Mycobacterium
LMLIWACDLIVGSEEVRF

SEQ ID NO: 771042 - protein, 22 aa, Mycobacterium
LMLRAPFRLTREVLPHLRPGSA

SEQ ID NO: 771043 - protein, 23 aa, Mycobacterium
LMLRAPFRLTREVLPHMPAGSGI

SEQ ID NO: 771044 - protein, 23 aa, Mycobacterium
LMLRECPRLPAVGCETGDWSHVD

SEQ ID NO: 771045 - protein, 17 aa, Mycobacterium
LMMCLRDALSAVHDEMA

SEQ ID NO: 771046 - protein, 19 aa, Mycobacterium
LMPCFARLYEELGITKADI

SEQ ID NO: 771047 - protein, 22 aa, Mycobacterium
LMRAALPLGLWVPVLPGTRQVT

SEQ ID NO: 771048 - protein, 25 aa, Mycobacterium
LMREYPDLAAFEWAIRAGNIVSSDW

SEQ ID NO: 771049 - protein, 23 aa, Mycobacterium
LMREYPDLAAFEWVIRAEGAAGP

SEQ ID NO: 771050 - protein, 17 aa, Mycobacterium
LMRLTGYGSKWSVEQGD

SEQ ID NO: 771051 - protein, 23 aa, Mycobacterium
LMRNRIDLLIGHGRFVDPHTIEV

SEQ ID NO: 771052 - protein, 23 aa, Mycobacterium
LMRNRIDLLLGHGRFVDPHTIEV

SEQ ID NO: 771053 - protein, 19 aa, Mycobacterium
LMRRCPSRSFTIVGDLAQR

SEQ ID NO: 771054 - protein, 24 aa, Mycobacterium
LMRSCTGWPSGTWIDPPRRTAPDG

SEQ ID NO: 771055 - protein, 20 aa, Mycobacterium
LMRSCTGWPSGVWIDEPRRT

SEQ ID NO: 771056 - protein, 24 aa, Mycobacterium
LMRSCTGWPSGVWIDEPRRTAPDG

SEQ ID NO: 771057 - protein, 18 aa, Mycobacterium
LMRWGLVPPWVKAGEDGG

SEQ ID NO: 771058 - protein, 17 aa, Mycobacterium
LMSAFALGLRLPADYFV

SEQ ID NO: 771059 - protein, 19 aa, Mycobacterium
LMSGYLGSIGFGFPAAMGA

SEQ ID NO: 771060 - protein, 18 aa, Mycobacterium
LMTAAATPYVEWLTTAAA

SEQ ID NO: 771061 - protein, 18 aa, Mycobacterium
LMTAAVTPYVAWLQAGAA

SEQ ID NO: 771062 - protein, 18 aa, Mycobacterium
LMTAMSWLALGRDLEGLP

SEQ ID NO: 771063 - protein, 23 aa, Mycobacterium
LMVKAGVQWGLFGGAVENLGTER

SEQ ID NO: 771064 - protein, 24 aa, Mycobacterium
LMVKAGVQWGLFGGAVENLGTERH

SEQ ID NO: 771065 - protein, 17 aa, Mycobacterium
LMYMGGDGFYWRHTFHP

SEQ ID NO: 771066 - protein, 18 aa, Mycobacterium
LNAARAPFSLSFSTHHVQ

SEQ ID NO: 771067 - protein, 18 aa, Mycobacterium
LNAGANWYAGVESANSST

SEQ ID NO: 771068 - protein, 18 aa, Mycobacterium
LNALIPTAGLDWRQVAVL

SEQ ID NO: 771069 - protein, 17 aa, Mycobacterium
LNAMWRRGDEVFAEVAL

SEQ ID NO: 771070 - protein, 17 aa, Mycobacterium
LNAVMGIVYVHPTYLDL

SEQ ID NO: 771071 - protein, 20 aa, Mycobacterium
LNDCPLRWLAERHGGTNPRA

SEQ ID NO: 771072 - protein, 23 aa, Mycobacterium
LNDPAVGVVCEWACAMFQQPGET

SEQ ID NO: 771073 - protein, 25 aa, Mycobacterium
LNDVLKAAWGYRGWVMSDWGGTPGW

SEQ ID NO: 771074 - protein, 24 aa, Mycobacterium
LNELERVGGRYGLQTMCEGGGTAN

SEQ ID NO: 771075 - protein, 24 aa, Mycobacterium
LNELRTWFGFGVAGNFAGHLEQAG

SEQ ID NO: 771076 - protein, 25 aa, Mycobacterium
LNEPRLRPNIPIMIGGSGEKKTFGL

SEQ ID NO: 771077 - protein, 17 aa, Mycobacterium
LNFISDLNAVMGIVYVH

SEQ ID NO: 771078 - protein, 27 aa, Mycobacterium
LNFVFGEMWLRPGLGMKERRLITVACV

SEQ ID NO: 771079 - protein, 17 aa, Mycobacterium
LNGPRYWLMNAIEKEAQ

SEQ ID NO: 771080 - protein, 17 aa, Mycobacterium
LNGPRYWLMNAIEKQRQ

SEQ ID NO: 771081 - protein, 17 aa, Mycobacterium
LNGRSGYRFGHIEGPMQ

SEQ ID NO: 771082 - protein, 17 aa, Mycobacterium
LNITLLFGFSPRFPFPD

SEQ ID NO: 771083 - protein, 22 aa, Mycobacterium
LNLALEIGCLFSIDTDAHAPGQ

SEQ ID NO: 771084 - protein, 17 aa, Mycobacterium
LNLALEIGCVFSIDTDA

SEQ ID NO: 771085 - protein, 17 aa, Mycobacterium
LNLALEIGCVFSIDTDS

SEQ ID NO: 771086 - protein, 20 aa, Mycobacterium
LNLKEWKAEWGVADPQEARG

SEQ ID NO: 771087 - protein, 21 aa, Mycobacterium
LNLPFPQYVCMRVLSKNPGWS

SEQ ID NO: 771088 - protein, 24 aa, Mycobacterium
LNLPGVAFGHDWLTGAARYAGLLE

SEQ ID NO: 771089 - protein, 23 aa, Mycobacterium
LNLPGVAFGHEWLAGAARYSNLL

SEQ ID NO: 771090 - protein, 17 aa, Mycobacterium
LNLPSGWSYQPNRLTDE

SEQ ID NO: 771091 - protein, 25 aa, Mycobacterium
LNLSFPISLPISIDIGKIVIESFTL

SEQ ID NO: 771092 - protein, 19 aa, Mycobacterium
LNMAIPWIAAERGFIDAVI

SEQ ID NO: 771093 - protein, 19 aa, Mycobacterium
LNMAIPWIAAERGFIDAVV

SEQ ID NO: 771094 - protein, 17 aa, Mycobacterium
LNMATPWIAAERGYIDA

SEQ ID NO: 771095 - protein, 18 aa, Mycobacterium
LNMLIEFGDAFDYTGADF

SEQ ID NO: 771096 - protein, 17 aa, Mycobacterium
LNMMAHLLSTIDYRPVE

SEQ ID NO: 771097 - protein, 19 aa, Mycobacterium
LNMNPRWLGAHPAYTLSKY

SEQ ID NO: 771098 - protein, 19 aa, Mycobacterium
LNPAAGVLVSAAWAQSTGQ

SEQ ID NO: 771099 - protein, 19 aa, Mycobacterium
LNPAAGVMLRAVWAEPTGR

SEQ ID NO: 771100 - protein, 18 aa, Mycobacterium
LNPAAGVMLSALWVAPTG

SEQ ID NO: 771101 - protein, 18 aa, Mycobacterium
LNPEVPWEAMRFAVTTRP

SEQ ID NO: 771102 - protein, 17 aa, Mycobacterium
LNPEVWTWVAVSGLNLL

SEQ ID NO: 771103 - protein, 25 aa, Mycobacterium
LNPIDWKIVAGFMRELMPVDLPAGV

SEQ ID NO: 771104 - protein, 23 aa, Mycobacterium
LNPKSVVVPGHLIDIVVVQEDQW

SEQ ID NO: 771105 - protein, 18 aa, Mycobacterium
LNPQVWPRYCERFHDILG

SEQ ID NO: 771106 - protein, 21 aa, Mycobacterium
LNPRRAAVVAPGFTEPEAVLA

SEQ ID NO: 771107 - protein, 26 aa, Mycobacterium
LNQLWMCGLPGYFPGDLIDFEFSGDT

SEQ ID NO: 771108 - protein, 25 aa, Mycobacterium
LNQLWMCGLPGYFPGDLIDFQFSGD

SEQ ID NO: 771109 - protein, 17 aa, Mycobacterium
LNRAHIGAVIWSDEPDG

SEQ ID NO: 771110 - protein, 21 aa, Mycobacterium
LNRFPEWDIDYSTARLAPTST

SEQ ID NO: 771111 - protein, 24 aa, Mycobacterium
LNRLRRWYCDGALCIGDAAHAMSP

SEQ ID NO: 771112 - protein, 18 aa, Mycobacterium
LNRTRFTAVPGQGLFYRS

SEQ ID NO: 771113 - protein, 17 aa, Mycobacterium
LNSALMFSGAGSGPLLD

SEQ ID NO: 771114 - protein, 22 aa, Mycobacterium
LNSKTRRPSVCNAAETLLVDAA

SEQ ID NO: 771115 - protein, 22 aa, Mycobacterium
LNSKTRRPSVCNAAETLLVDAT

SEQ ID NO: 771116 - protein, 22 aa, Mycobacterium
LNVADAGLCFGRLDGVDGEHLY

SEQ ID NO: 771117 - protein, 25 aa, Mycobacterium
LNVELPFPCVWVAPWSPDAAIEPLR

SEQ ID NO: 771118 - protein, 17 aa, Mycobacterium
LNVLPVYGGSSYAIQLA

SEQ ID NO: 771119 - protein, 23 aa, Mycobacterium
LNWKSRPYLAWPAYGQSKLANLL

SEQ ID NO: 771120 - protein, 17 aa, Mycobacterium
LNWLLGHGEPPQFSRDV

SEQ ID NO: 771121 - protein, 26 aa, Mycobacterium
LNWWESRALYGWTVLVPRTKDQAGEM

SEQ ID NO: 771122 - protein, 17 aa, Mycobacterium
LNYWYPWQVTVLGLGPV

SEQ ID NO: 771123 - protein, 17 aa, Mycobacterium
LPAAAALLALHDLGLGN

SEQ ID NO: 771124 - protein, 20 aa, Mycobacterium
LPAARIAFMLSDSAPVAVLT

SEQ ID NO: 771125 - protein, 21 aa, Mycobacterium
LPAARRRLGIELDDVRKINPD

SEQ ID NO: 771126 - protein, 18 aa, Mycobacterium
LPADFGLPECPRWKVIDR

SEQ ID NO: 771127 - protein, 17 aa, Mycobacterium
LPADFRVVIIGAGIAGI

SEQ ID NO: 771128 - protein, 29 aa, Mycobacterium
LPAEMPAAALWWRLAGTLAPPSLEGTDTK

SEQ ID NO: 771129 - protein, 17 aa, Mycobacterium
LPAGHGLNAATLSYGDL

SEQ ID NO: 771130 - protein, 17 aa, Mycobacterium
LPAGHGLNAATLTYGDL

SEQ ID NO: 771131 - protein, 17 aa, Mycobacterium
LPAGWSYQPRVLTEELR

SEQ ID NO: 771132 - protein, 17 aa, Mycobacterium
LPAHCWFEPHERWGVRI

SEQ ID NO: 771133 - protein, 17 aa, Mycobacterium
LPAHLWAQYGLAGVLEH

SEQ ID NO: 771134 - protein, 20 aa, Mycobacterium
LPAILRKTLTWDRGKEMANH

SEQ ID NO: 771135 - protein, 24 aa, Mycobacterium
LPAKAADSLTEWMLGYVRFHRTYR

SEQ ID NO: 771136 - protein, 25 aa, Mycobacterium
LPAKGSRFIVCSQIQVVYPGVNLTT

SEQ ID NO: 771137 - protein, 17 aa, Mycobacterium
LPALKAFGAIPVADERI

SEQ ID NO: 771138 - protein, 17 aa, Mycobacterium
LPALLAALAERSTACTF

SEQ ID NO: 771139 - protein, 18 aa, Mycobacterium
LPAMRVLVAPDCYGESLS

SEQ ID NO: 771140 - protein, 17 aa, Mycobacterium
LPAMVCYWSELARDAAL

SEQ ID NO: 771141 - protein, 18 aa, Mycobacterium
LPAMVCYWSELAREIVLP

SEQ ID NO: 771142 - protein, 17 aa, Mycobacterium
LPANQVYRRLNWNLAAS

SEQ ID NO: 771143 - protein, 18 aa, Mycobacterium
LPAPLTFVCVFGYTAQTA

SEQ ID NO: 771144 - protein, 19 aa, Mycobacterium
LPAPRWTRVGVHIAESGMR

SEQ ID NO: 771145 - protein, 18 aa, Mycobacterium
LPAPRYGTATTFAQARRI

SEQ ID NO: 771146 - protein, 18 aa, Mycobacterium
LPAQWPVLLCNGAVGIAE

SEQ ID NO: 771147 - protein, 18 aa, Mycobacterium
LPARLVLSALIGRVRIPD

SEQ ID NO: 771148 - protein, 24 aa, Mycobacterium
LPARPELRLLWKVIGLAATVEGAL

SEQ ID NO: 771149 - protein, 18 aa, Mycobacterium
LPASLAYPIVKWKNQMVS

SEQ ID NO: 771150 - protein, 17 aa, Mycobacterium
LPATALAWREGFLDGQH

SEQ ID NO: 771151 - protein, 21 aa, Mycobacterium
LPATFALYLERAWPRHRRLSS

SEQ ID NO: 771152 - protein, 20 aa, Mycobacterium
LPAVRVGRSFRVHAKAVHDM

SEQ ID NO: 771153 - protein, 19 aa, Mycobacterium
LPCRTTVFVGLPHEVMLVE

SEQ ID NO: 771154 - protein, 18 aa, Mycobacterium
LPDALRIAVEALRASSAD

SEQ ID NO: 771155 - protein, 24 aa, Mycobacterium
LPDARPTVWLGVPRVWHKIKVGIE

SEQ ID NO: 771156 - protein, 19 aa, Mycobacterium
LPDCLRAVLTAALCAPVPV

SEQ ID NO: 771157 - protein, 30 aa, Mycobacterium
LPDELPAAALWWRLAAELTPAATVDAPHTG

SEQ ID NO: 771158 - protein, 22 aa, Mycobacterium
LPDERICLCGNTFGPLFGHIPN

SEQ ID NO: 771159 - protein, 23 aa, Mycobacterium
LPDERICLCGNTFGPVFGHVPNL

SEQ ID NO: 771160 - protein, 21 aa, Mycobacterium
LPDGEMAWWLLEDSARSTRLA

SEQ ID NO: 771161 - protein, 17 aa, Mycobacterium
LPDGWVITSSGRISGVT

SEQ ID NO: 771162 - protein, 19 aa, Mycobacterium
LPDIRRWATVVAQLLRPGG

SEQ ID NO: 771163 - protein, 20 aa, Mycobacterium
LPDIRRYGATYMNYVGKPLA

SEQ ID NO: 771164 - protein, 18 aa, Mycobacterium
LPDLKVFICGGASVPPSL

SEQ ID NO: 771165 - protein, 18 aa, Mycobacterium
LPDLKVFICGGASVPPTL

SEQ ID NO: 771166 - protein, 18 aa, Mycobacterium
LPDLKVFICGGASVSPSL

SEQ ID NO: 771167 - protein, 21 aa, Mycobacterium
LPDLLAVLSVRLGRIDRVLYH

SEQ ID NO: 771168 - protein, 18 aa, Mycobacterium
LPDLRICFLHGGGCAPGL

SEQ ID NO: 771169 - protein, 17 aa, Mycobacterium
LPDLVRRSPWGEMFQSA

SEQ ID NO: 771170 - protein, 22 aa, Mycobacterium
LPDPRTGLALKMIADYRNLVAH

SEQ ID NO: 771171 - protein, 24 aa, Mycobacterium
LPDREFDALFTPDRPVIFAYHGYP

SEQ ID NO: 771172 - protein, 17 aa, Mycobacterium
LPDSLLHYMRTRGKNKV

SEQ ID NO: 771173 - protein, 17 aa, Mycobacterium
LPDYFPRPLRERFTSEI

SEQ ID NO: 771174 - protein, 17 aa, Mycobacterium
LPEARYVHLFVARGRVT

SEQ ID NO: 771175 - protein, 20 aa, Mycobacterium
LPEEFRMAVYYADVEGFPYK

SEQ ID NO: 771176 - protein, 21 aa, Mycobacterium
LPEERICLCGNTFGPLFGHIP

SEQ ID NO: 771177 - protein, 20 aa, Mycobacterium
LPEFVCLRILSMYPGMSSAE

SEQ ID NO: 771178 - protein, 19 aa, Mycobacterium
LPEGMGLVLLTDGLFEGHI

SEQ ID NO: 771179 - protein, 20 aa, Mycobacterium
LPEGSGFEFLDKVVGGAVPR

SEQ ID NO: 771180 - protein, 24 aa, Mycobacterium
LPEGSMLVPFSWQRISLHAAGATA

SEQ ID NO: 771181 - protein, 18 aa, Mycobacterium
LPEHLHKVSLSFLVDDLV

SEQ ID NO: 771182 - protein, 18 aa, Mycobacterium
LPEHLVIVGGGFVAAEFA

SEQ ID NO: 771183 - protein, 21 aa, Mycobacterium
LPEIARAGTPLVLIDRGADIE

SEQ ID NO: 771184 - protein, 20 aa, Mycobacterium
LPELDFADAGTWLLVSTTDV

SEQ ID NO: 771185 - protein, 18 aa, Mycobacterium
LPELLGLCDRIYTLSAGR

SEQ ID NO: 771186 - protein, 23 aa, Mycobacterium
LPELPLRVGDTWEEAGPEGNRVF

SEQ ID NO: 771187 - protein, 24 aa, Mycobacterium
LPELPQLRWRVVGAPLGLDRPYFV

SEQ ID NO: 771188 - protein, 20 aa, Mycobacterium
LPELRCLMLTSFTSDEAMLE

SEQ ID NO: 771189 - protein, 20 aa, Mycobacterium
LPENLAYFAVRWKNVLRQAA

SEQ ID NO: 771190 - protein, 24 aa, Mycobacterium
LPERDFPTLISLYLQGRFPLDKFV

SEQ ID NO: 771191 - protein, 23 aa, Mycobacterium
LPERDFPTLISLYLQGRLPLEKF

SEQ ID NO: 771192 - protein, 19 aa, Mycobacterium
LPESIIIAGCGAIGMEFGY

SEQ ID NO: 771193 - protein, 24 aa, Mycobacterium
LPETFAVAWTCLFRNLDLKAGQTL

SEQ ID NO: 771194 - protein, 21 aa, Mycobacterium
LPETFGLYLERAWPRHRRLSG

SEQ ID NO: 771195 - protein, 22 aa, Mycobacterium
LPEWLRRWDVRGGQACEEAIEL

SEQ ID NO: 771196 - protein, 18 aa, Mycobacterium
LPEWLSADVAILGEPTSG

SEQ ID NO: 771197 - protein, 19 aa, Mycobacterium
LPFAGGSWVIWSRGDQAGS

SEQ ID NO: 771198 - protein, 17 aa, Mycobacterium
LPFALALVIRSVLQRFR

SEQ ID NO: 771199 - protein, 24 aa, Mycobacterium
LPFEEGWCRLAFSTGLDRLGVEPT

SEQ ID NO: 771200 - protein, 20 aa, Mycobacterium
LPFIDFPPGYGLRHETDRGF

SEQ ID NO: 771201 - protein, 20 aa, Mycobacterium
LPFPLSSAMLPRFLYTKEIG

SEQ ID NO: 771202 - protein, 24 aa, Mycobacterium
LPFSRIRILLRLSRGSMTVKEVAH

SEQ ID NO: 771203 - protein, 21 aa, Mycobacterium
LPFTVADLFEFLSIRELSRHL

SEQ ID NO: 771204 - protein, 18 aa, Mycobacterium
LPFWCVNHGPTLSMYYRD

SEQ ID NO: 771205 - protein, 17 aa, Mycobacterium
LPGALLVPAIHLVRAAH

SEQ ID NO: 771206 - protein, 23 aa, Mycobacterium
LPGFRPGKAPIRLLEARFGREAM

SEQ ID NO: 771207 - protein, 18 aa, Mycobacterium
LPGFVAGLGDEWVGLSVT

SEQ ID NO: 771208 - protein, 18 aa, Mycobacterium
LPGGLNWPLDLTVSDGRL

SEQ ID NO: 771209 - protein, 24 aa, Mycobacterium
LPGGLPIELGMSIRLARDKNYDLL

SEQ ID NO: 771210 - protein, 25 aa, Mycobacterium
LPGGLRPGDFVGVLGFTSIDYVVHY

SEQ ID NO: 771211 - protein, 23 aa, Mycobacterium
LPGHSPCGLGFRPDGTLLIASAH

SEQ ID NO: 771212 - protein, 22 aa, Mycobacterium
LPGHSPSGLGFRPDGSLLIAST

SEQ ID NO: 771213 - protein, 17 aa, Mycobacterium
LPGHTPSGLGFRPDGSL

SEQ ID NO: 771214 - protein, 17 aa, Mycobacterium
LPGIPGIKDFGGHIFHS

SEQ ID NO: 771215 - protein, 19 aa, Mycobacterium
LPGIWYAGSHGFELTAPDG

SEQ ID NO: 771216 - protein, 18 aa, Mycobacterium
LPGLGGWRRPQAELDESS

SEQ ID NO: 771217 - protein, 18 aa, Mycobacterium
LPGLGSWRRPQAELDESS

SEQ ID NO: 771218 - protein, 20 aa, Mycobacterium
LPGLHKAFYFGMGLVLQDER

SEQ ID NO: 771219 - protein, 17 aa, Mycobacterium
LPGLHSWVDERLAGREQ

SEQ ID NO: 771220 - protein, 20 aa, Mycobacterium
LPGMFAGVVPLVLNTSPTAS

SEQ ID NO: 771221 - protein, 23 aa, Mycobacterium
LPGQRIPLSFGRWPTRDQMVEYF

SEQ ID NO: 771222 - protein, 17 aa, Mycobacterium
LPGRAFLGYCTAKGALA

SEQ ID NO: 771223 - protein, 23 aa, Mycobacterium
LPGRETFSGISLHSARWDPNLDL

SEQ ID NO: 771224 - protein, 19 aa, Mycobacterium
LPGRFLFGFDDGRGDISGL

SEQ ID NO: 771225 - protein, 17 aa, Mycobacterium
LPGRIGAVAAELRRLGV

SEQ ID NO: 771226 - protein, 21 aa, Mycobacterium
LPGRWSFQVVEDYDDGYYRCF

SEQ ID NO: 771227 - protein, 17 aa, Mycobacterium
LPGSHFRSDIGLAAAEG

SEQ ID NO: 771228 - protein, 17 aa, Mycobacterium
LPGTALFVLDRWLRQLP

SEQ ID NO: 771229 - protein, 18 aa, Mycobacterium
LPGVWLIDVERVQREPSA

SEQ ID NO: 771230 - protein, 17 aa, Mycobacterium
LPGWARKPLWLPYFPPL

SEQ ID NO: 771231 - protein, 17 aa, Mycobacterium
LPGWLAYRDALAGAGAD

SEQ ID NO: 771232 - protein, 17 aa, Mycobacterium
LPGYAHRALITSHLQRA

SEQ ID NO: 771233 - protein, 21 aa, Mycobacterium
LPGYEEFAPWLLVEKTGNVHV

SEQ ID NO: 771234 - protein, 17 aa, Mycobacterium
LPGYIWGGTLESYFSHQ

SEQ ID NO: 771235 - protein, 20 aa, Mycobacterium
LPGYQGWQWAAVVASYVGAD

SEQ ID NO: 771236 - protein, 17 aa, Mycobacterium
LPHAVLMMIPEAWENAT

SEQ ID NO: 771237 - protein, 17 aa, Mycobacterium
LPHAVLMMIPEAWENST

SEQ ID NO: 771238 - protein, 18 aa, Mycobacterium
LPHGLPFTELLALHGVPA

SEQ ID NO: 771239 - protein, 17 aa, Mycobacterium
LPHGVEVIGYWGEAVTT

SEQ ID NO: 771240 - protein, 19 aa, Mycobacterium
LPHLQRLAVYTGDALAELE

SEQ ID NO: 771241 - protein, 18 aa, Mycobacterium
LPHVRRSPSEYVREHVRF

SEQ ID NO: 771242 - protein, 22 aa, Mycobacterium
LPHWAGVVPLALRAGTPEPAAD

SEQ ID NO: 771243 - protein, 17 aa, Mycobacterium
LPHWAGVVPLRVTAGAP

SEQ ID NO: 771244 - protein, 18 aa, Mycobacterium
LPHWAGVVPLTLTAGTPV

SEQ ID NO: 771245 - protein, 19 aa, Mycobacterium
LPIMFPLEVRFGAPDDAFL

SEQ ID NO: 771246 - protein, 23 aa, Mycobacterium
LPIPAEAATPFGIMSDALKDSIV

SEQ ID NO: 771247 - protein, 17 aa, Mycobacterium
LPISIDIIRFVKFIVTE

SEQ ID NO: 771248 - protein, 24 aa, Mycobacterium
LPITARYAQHWNFAGGPPEEFARK

SEQ ID NO: 771249 - protein, 17 aa, Mycobacterium
LPITLWPGMKIGQLCIL

SEQ ID NO: 771250 - protein, 17 aa, Mycobacterium
LPITLWPGMKIGQLCLL

SEQ ID NO: 771251 - protein, 18 aa, Mycobacterium
LPITYSRKVFIPVTHLCR

SEQ ID NO: 771252 - protein, 17 aa, Mycobacterium
LPIVEVIAGGDISEAAY

SEQ ID NO: 771253 - protein, 18 aa, Mycobacterium
LPKAIVFRAAIERSPSGK

SEQ ID NO: 771254 - protein, 24 aa, Mycobacterium
LPKAIVFRPVIERSPSGKADYRWA

SEQ ID NO: 771255 - protein, 23 aa, Mycobacterium
LPKFCSGELITAIAMTEPGTGSD

SEQ ID NO: 771256 - protein, 21 aa, Mycobacterium
LPKFCTGEFITAIAMTEPGTG

SEQ ID NO: 771257 - protein, 21 aa, Mycobacterium
LPKFCTGEIITAIAMTEPGTG

SEQ ID NO: 771258 - protein, 19 aa, Mycobacterium
LPKGVMVWDRSRLIEAQRV

SEQ ID NO: 771259 - protein, 25 aa, Mycobacterium
LPKLLKRLVIMGGSFDYPGNTTPVA

SEQ ID NO: 771260 - protein, 17 aa, Mycobacterium
LPKPARPVPPWPTVQRE

SEQ ID NO: 771261 - protein, 17 aa, Mycobacterium
LPLAVPVGASFGETARG

SEQ ID NO: 771262 - protein, 17 aa, Mycobacterium
LPLDALVYINGTPIPIF

SEQ ID NO: 771263 - protein, 17 aa, Mycobacterium
LPLEHPRVYTALIDEDA

SEQ ID NO: 771264 - protein, 18 aa, Mycobacterium
LPLGHGFNALTGEYGDMF

SEQ ID NO: 771265 - protein, 17 aa, Mycobacterium
LPLIVLHGGPGMAHNYV

SEQ ID NO: 771266 - protein, 17 aa, Mycobacterium
LPLKPSQYWARQCYAGA

SEQ ID NO: 771267 - protein, 22 aa, Mycobacterium
LPLLEPFRIISRLVSLIPGVHI

SEQ ID NO: 771268 - protein, 17 aa, Mycobacterium
LPLLGGLAVMFGVLPPL

SEQ ID NO: 771269 - protein, 18 aa, Mycobacterium
LPLLLLDEGHCLRDQALD

SEQ ID NO: 771270 - protein, 20 aa, Mycobacterium
LPLLRPRQVIMLGRPTLHRP

SEQ ID NO: 771271 - protein, 19 aa, Mycobacterium
LPLNCAIGAPVLFGRANVV

SEQ ID NO: 771272 - protein, 17 aa, Mycobacterium
LPLNVTWVNLTTGRSGS

SEQ ID NO: 771273 - protein, 17 aa, Mycobacterium
LPLPAWVADAMWSRASL

SEQ ID NO: 771274 - protein, 18 aa, Mycobacterium
LPLPEWAPALSVAQRLQL

SEQ ID NO: 771275 - protein, 21 aa, Mycobacterium
LPLPFAGGSWVLWERRDESDA

SEQ ID NO: 771276 - protein, 18 aa, Mycobacterium
LPLPGHAVAAAFDGGTHQ

SEQ ID NO: 771277 - protein, 21 aa, Mycobacterium
LPLPYAGNAWVVWDRGGASEA

SEQ ID NO: 771278 - protein, 17 aa, Mycobacterium
LPLRLVYVIPAADVPGG

SEQ ID NO: 771279 - protein, 18 aa, Mycobacterium
LPLRRWAVRQHADTSITV

SEQ ID NO: 771280 - protein, 17 aa, Mycobacterium
LPLSLAIVFEPEDPEQV

SEQ ID NO: 771281 - protein, 22 aa, Mycobacterium
LPLTLWLARFLKFIQTEIFPGG

SEQ ID NO: 771282 - protein, 19 aa, Mycobacterium
LPLTQRLVAIFGDRLNKLD

SEQ ID NO: 771283 - protein, 18 aa, Mycobacterium
LPLVAGMAFSVEPGIYFP

SEQ ID NO: 771284 - protein, 17 aa, Mycobacterium
LPLVLVVHGGPWHRDSW

SEQ ID NO: 771285 - protein, 17 aa, Mycobacterium
LPLVQLLPFLKSQEASL

SEQ ID NO: 771286 - protein, 19 aa, Mycobacterium
LPMMVVCKLLGLPDDDVDK

SEQ ID NO: 771287 - protein, 20 aa, Mycobacterium
LPMVESFAAYGLFSHQRDAC

SEQ ID NO: 771288 - protein, 18 aa, Mycobacterium
LPNGRWLYEYGEPRRLAQ

SEQ ID NO: 771289 - protein, 24 aa, Mycobacterium
LPNPSRVAGLHFFNPAPLQRTVEV

SEQ ID NO: 771290 - protein, 17 aa, Mycobacterium
LPPALIVVAGFDPLRDE

SEQ ID NO: 771291 - protein, 17 aa, Mycobacterium
LPPALVVTAGFDPLRDE

SEQ ID NO: 771292 - protein, 18 aa, Mycobacterium
LPPDIAWPYLQRVGEVVL

SEQ ID NO: 771293 - protein, 17 aa, Mycobacterium
LPPDLDFAALFHGVDER

SEQ ID NO: 771294 - protein, 17 aa, Mycobacterium
LPPEFRAAVVLCDIEGL

SEQ ID NO: 771295 - protein, 19 aa, Mycobacterium
LPPEIAWPYLKRVGEVVLP

SEQ ID NO: 771296 - protein, 23 aa, Mycobacterium
LPPEINSALMFAGPGAGPLLAAA

SEQ ID NO: 771297 - protein, 17 aa, Mycobacterium
LPPERRGSFGIPLPGVV

SEQ ID NO: 771298 - protein, 17 aa, Mycobacterium
LPPGAWPPTSWYADWVS

SEQ ID NO: 771299 - protein, 17 aa, Mycobacterium
LPPGGGISWAYRNLSPY

SEQ ID NO: 771300 - protein, 20 aa, Mycobacterium
LPPHPSHFLWLNWGPSPARQ

SEQ ID NO: 771301 - protein, 18 aa, Mycobacterium
LPPKGRRAMNKALGLDTV

SEQ ID NO: 771302 - protein, 18 aa, Mycobacterium
LPPKGRRWLNKKLGLDNV

SEQ ID NO: 771303 - protein, 17 aa, Mycobacterium
LPPLLAAPPVKTRYVTT

SEQ ID NO: 771304 - protein, 18 aa, Mycobacterium
LPPRTMRGLIGRICEQEG

SEQ ID NO: 771305 - protein, 20 aa, Mycobacterium
LPPVVRRWAGVYSQCTDPDQ

SEQ ID NO: 771306 - protein, 19 aa, Mycobacterium
LPPWNEVLQNLGFSNTTTA

SEQ ID NO: 771307 - protein, 17 aa, Mycobacterium
LPQAGAVAPGFYGGMPP

SEQ ID NO: 771308 - protein, 22 aa, Mycobacterium
LPQCIPNVWLGTVGVNPNPYTG

SEQ ID NO: 771309 - protein, 19 aa, Mycobacterium
LPQDILDWPLNVVVVRSGD

SEQ ID NO: 771310 - protein, 21 aa, Mycobacterium
LPQEWLRFGWFFLVTRHDPKG

SEQ ID NO: 771311 - protein, 21 aa, Mycobacterium
LPQEWLRFGWFFLVTRRDPGG

SEQ ID NO: 771312 - protein, 25 aa, Mycobacterium
LPQFLKGCIQLGAWPLLETTWEMAP

SEQ ID NO: 771313 - protein, 19 aa, Mycobacterium
LPQKLAYALVRWKNALLGI

SEQ ID NO: 771314 - protein, 17 aa, Mycobacterium
LPQLVGAAMARRLSMTG

SEQ ID NO: 771315 - protein, 18 aa, Mycobacterium
LPQPECFESFLNHHWAFD

SEQ ID NO: 771316 - protein, 24 aa, Mycobacterium
LPQTRPLLRRIISISQAHVWSPYL

SEQ ID NO: 771317 - protein, 18 aa, Mycobacterium
LPQVFFVNWFRRGEDHRF

SEQ ID NO: 771318 - protein, 17 aa, Mycobacterium
LPQVFRWARAVDPSQPL

SEQ ID NO: 771319 - protein, 21 aa, Mycobacterium
LPQVVGAAMARRLSMTGEVVD

SEQ ID NO: 771320 - protein, 22 aa, Mycobacterium
LPRADPGLPWPGRLPEPSPAVL

SEQ ID NO: 771321 - protein, 18 aa, Mycobacterium
LPRDAELVVGGRNVVQDV

SEQ ID NO: 771322 - protein, 18 aa, Mycobacterium
LPREEWPTHLRRLIAEQV

SEQ ID NO: 771323 - protein, 17 aa, Mycobacterium
LPRFSRPDCSAPTFCTP

SEQ ID NO: 771324 - protein, 22 aa, Mycobacterium
LPRIECRGGLAARRTAPDTVHL

SEQ ID NO: 771325 - protein, 21 aa, Mycobacterium
LPRIVRGECFFGIGMSEPDSG

SEQ ID NO: 771326 - protein, 19 aa, Mycobacterium
LPRLIAMLFSVLSTMDSDS

SEQ ID NO: 771327 - protein, 18 aa, Mycobacterium
LPRLRPRVFYDLVVEVAL

SEQ ID NO: 771328 - protein, 18 aa, Mycobacterium
LPRMRRVLLVDGQLVADP

SEQ ID NO: 771329 - protein, 17 aa, Mycobacterium
LPRRAEILAGREIAAPG

SEQ ID NO: 771330 - protein, 24 aa, Mycobacterium
LPRRLADGLPIVFGTKVDSIVHKD

SEQ ID NO: 771331 - protein, 17 aa, Mycobacterium
LPRRLQIEFSQAIQKIT

SEQ ID NO: 771332 - protein, 18 aa, Mycobacterium
LPRTVTFKVLKRQLAAQG

SEQ ID NO: 771333 - protein, 19 aa, Mycobacterium
LPRYIGGVLARLQEVWMGR

SEQ ID NO: 771334 - protein, 17 aa, Mycobacterium
LPSAIYHRFARVHTYAP

SEQ ID NO: 771335 - protein, 17 aa, Mycobacterium
LPSFERLRVIGCGTSLN

SEQ ID NO: 771336 - protein, 18 aa, Mycobacterium
LPSHAWPDRVLRITAIDV

SEQ ID NO: 771337 - protein, 29 aa, Mycobacterium
LPSKRIPPTRGWRKVLYRGTFKLINPGQS

SEQ ID NO: 771338 - protein, 21 aa, Mycobacterium
LPSLFTVGVAPSFQVGTAPNQ

SEQ ID NO: 771339 - protein, 17 aa, Mycobacterium
LPSLMVLTGVSSARDAV

SEQ ID NO: 771340 - protein, 17 aa, Mycobacterium
LPSRPVQVIGFTSVPGA

SEQ ID NO: 771341 - protein, 18 aa, Mycobacterium
LPSRRFVSMIAVGRDADP

SEQ ID NO: 771342 - protein, 22 aa, Mycobacterium
LPSRWCSEVDVALYLKDETTHI

SEQ ID NO: 771343 - protein, 18 aa, Mycobacterium
LPSVISWALQEHILGANP

SEQ ID NO: 771344 - protein, 29 aa, Mycobacterium
LPTAFAPAAFRWLGLRDMPNKLMNVAVSS

SEQ ID NO: 771345 - protein, 18 aa, Mycobacterium
LPTALLLRRDRLGSATAR

SEQ ID NO: 771346 - protein, 17 aa, Mycobacterium
LPTGFAFIPGHEIIGVI

SEQ ID NO: 771347 - protein, 19 aa, Mycobacterium
LPTHCWFEPKGWGFQVYPA

SEQ ID NO: 771348 - protein, 18 aa, Mycobacterium
LPTHLVIVGGSYIALEFA

SEQ ID NO: 771349 - protein, 18 aa, Mycobacterium
LPTLMAFKKGKLVFKQAG

SEQ ID NO: 771350 - protein, 20 aa, Mycobacterium
LPTLWLNQAFFSLVAGAGRS

SEQ ID NO: 771351 - protein, 20 aa, Mycobacterium
LPTLYGGDFVSTWKVFEEFA

SEQ ID NO: 771352 - protein, 18 aa, Mycobacterium
LPTPLRWLVGATRFAPVR

SEQ ID NO: 771353 - protein, 17 aa, Mycobacterium
LPTRVLLISAHDESAIV

SEQ ID NO: 771354 - protein, 17 aa, Mycobacterium
LPTRVLLLSAHDDAAIV

SEQ ID NO: 771355 - protein, 17 aa, Mycobacterium
LPTVRGAFCLVFADENT

SEQ ID NO: 771356 - protein, 19 aa, Mycobacterium
LPTVWPGTPYPLGATYDGA

SEQ ID NO: 771357 - protein, 18 aa, Mycobacterium
LPVADFAATVARFNGFAR

SEQ ID NO: 771358 - protein, 17 aa, Mycobacterium
LPVALVWAYPTITDLAT

SEQ ID NO: 771359 - protein, 18 aa, Mycobacterium
LPVARRAGVDVVHCLVQR

SEQ ID NO: 771360 - protein, 17 aa, Mycobacterium
LPVATGDDIVWADAVIF

SEQ ID NO: 771361 - protein, 25 aa, Mycobacterium
LPVDKLRFPVFSWQRITLQEMLHMR

SEQ ID NO: 771362 - protein, 17 aa, Mycobacterium
LPVDNWPVLGGMGNASW

SEQ ID NO: 771363 - protein, 17 aa, Mycobacterium
LPVFAAEMIALYGAGGD

SEQ ID NO: 771364 - protein, 19 aa, Mycobacterium
LPVIFSHGFADSAVIRNPD

SEQ ID NO: 771365 - protein, 24 aa, Mycobacterium
LPVIGSKELIAWLPTLLGLGPADV

SEQ ID NO: 771366 - protein, 25 aa, Mycobacterium
LPVIGTKELIAWLPTLLGLGAADTV

SEQ ID NO: 771367 - protein, 24 aa, Mycobacterium
LPVIGTKELIAWLPTLLGLGSDDV

SEQ ID NO: 771368 - protein, 23 aa, Mycobacterium
LPVIPMPFGFGIWTSHTTPIYLG

SEQ ID NO: 771369 - protein, 20 aa, Mycobacterium
LPVIVLRTSRFFPEQDDNDR

SEQ ID NO: 771370 - protein, 23 aa, Mycobacterium
LPVKCFYLPTAVRGFEREGIDPR

SEQ ID NO: 771371 - protein, 22 aa, Mycobacterium
LPVKLCYSGPFFRYERPQAGRY

SEQ ID NO: 771372 - protein, 23 aa, Mycobacterium
LPVKLCYSGPFFRYERPQAGRYR

SEQ ID NO: 771373 - protein, 18 aa, Mycobacterium
LPVLIAGWLRSRAEADEA

SEQ ID NO: 771374 - protein, 17 aa, Mycobacterium
LPVPDWQVLLAVPADLA

SEQ ID NO: 771375 - protein, 21 aa, Mycobacterium
LPVPEFYGGAVYFAADDVADV

SEQ ID NO: 771376 - protein, 19 aa, Mycobacterium
LPVPEWFPMLGGHEGSGVV

SEQ ID NO: 771377 - protein, 19 aa, Mycobacterium
LPVPLKPYFEADWRFHQTI

SEQ ID NO: 771378 - protein, 17 aa, Mycobacterium
LPVPPGFVLLRDCYRDS

SEQ ID NO: 771379 - protein, 19 aa, Mycobacterium
LPVPPGWQLTQDSGTSYGG

SEQ ID NO: 771380 - protein, 24 aa, Mycobacterium
LPVSAWRIHRCIGMDGTTLVRTLS

SEQ ID NO: 771381 - protein, 23 aa, Mycobacterium
LPVTECWDLLAGVTLGRLVTSVG

SEQ ID NO: 771382 - protein, 17 aa, Mycobacterium
LPVYIISIGRTFRTDEL

SEQ ID NO: 771383 - protein, 18 aa, Mycobacterium
LPVYIVSIGRTFRTDELD

SEQ ID NO: 771384 - protein, 24 aa, Mycobacterium
LPVYRPPLDMARLFGESRLGAGPG

SEQ ID NO: 771385 - protein, 18 aa, Mycobacterium
LPVYVISLGRAFRTDEID

SEQ ID NO: 771386 - protein, 17 aa, Mycobacterium
LPWDYRRVYGVDPDEQS

SEQ ID NO: 771387 - protein, 18 aa, Mycobacterium
LPWIPGLPPGMATWTPDQ

SEQ ID NO: 771388 - protein, 21 aa, Mycobacterium
LPWLRRLGVVYTYDAPWHRGR

SEQ ID NO: 771389 - protein, 18 aa, Mycobacterium
LPWRRPIASLNYLLSSHV

SEQ ID NO: 771390 - protein, 20 aa, Mycobacterium
LPWRTARKNIEFGLEAKGLP

SEQ ID NO: 771391 - protein, 19 aa, Mycobacterium
LPWYYRSGYDVVMYTLPFH

SEQ ID NO: 771392 - protein, 25 aa, Mycobacterium
LPYAGRWVGHEGVERWLRAFGDTWS

SEQ ID NO: 771393 - protein, 17 aa, Mycobacterium
LPYEVFPELGAKSNKRT

SEQ ID NO: 771394 - protein, 17 aa, Mycobacterium
LPYEVLERISTRITNEV

SEQ ID NO: 771395 - protein, 18 aa, Mycobacterium
LPYFSIGMANNFIQMSKT

SEQ ID NO: 771396 - protein, 21 aa, Mycobacterium
LPYPLMHPWWPLKGSDAEANR

SEQ ID NO: 771397 - protein, 19 aa, Mycobacterium
LPYRRSVVCGSAKQAVSLL

SEQ ID NO: 771398 - protein, 19 aa, Mycobacterium
LPYRWPHPWLVDRKSAAQQ

SEQ ID NO: 771399 - protein, 24 aa, Mycobacterium
LQAFARDFFLLWAPYPNSYKRFRD

SEQ ID NO: 771400 - protein, 17 aa, Mycobacterium
LQAGLPVRWETTADTPF

SEQ ID NO: 771401 - protein, 17 aa, Mycobacterium
LQAGTQWLSVRGYRQAE

SEQ ID NO: 771402 - protein, 25 aa, Mycobacterium
LQALRGGAIYDHWLAIGGVKSVLGA

SEQ ID NO: 771403 - protein, 17 aa, Mycobacterium
LQAQCTFSWPPQMDLPG

SEQ ID NO: 771404 - protein, 21 aa, Mycobacterium
LQARFKLSYLFVSHDLSVVKH

SEQ ID NO: 771405 - protein, 20 aa, Mycobacterium
LQDHFNRIDAVLCSTATRTR

SEQ ID NO: 771406 - protein, 19 aa, Mycobacterium
LQEGRSVILDGTWRDPQSR

SEQ ID NO: 771407 - protein, 22 aa, Mycobacterium
LQFARRLAALGARRIVLLSRNG

SEQ ID NO: 771408 - protein, 18 aa, Mycobacterium
LQFDHGWLLPGNPPEFGG

SEQ ID NO: 771409 - protein, 17 aa, Mycobacterium
LQFGLNWFPWILRGVYP

SEQ ID NO: 771410 - protein, 22 aa, Mycobacterium
LQFPIVYVPFLFNRNVRREDIM

SEQ ID NO: 771411 - protein, 17 aa, Mycobacterium
LQFSPLHSWVTDEDFDF

SEQ ID NO: 771412 - protein, 22 aa, Mycobacterium
LQGGRLHFCYNFLGEYEQTLAA

SEQ ID NO: 771413 - protein, 18 aa, Mycobacterium
LQGLSRRFWFAHLRSDPD

SEQ ID NO: 771414 - protein, 20 aa, Mycobacterium
LQGLSRRFWFGHLSDPVEEL

SEQ ID NO: 771415 - protein, 21 aa, Mycobacterium
LQGQCTFSWPPRIDLPGYKPT

SEQ ID NO: 771416 - protein, 21 aa, Mycobacterium
LQGQCTFSWPPRMDLPGYKPN

SEQ ID NO: 771417 - protein, 17 aa, Mycobacterium
LQGWLLRAGNGVNVAVP

SEQ ID NO: 771418 - protein, 19 aa, Mycobacterium
LQHALPITFGYRVACWTAP

SEQ ID NO: 771419 - protein, 18 aa, Mycobacterium
LQHPDTFQRLGVDPPRGV

SEQ ID NO: 771420 - protein, 19 aa, Mycobacterium
LQHPDTFSRLGIDPPRGVL

SEQ ID NO: 771421 - protein, 20 aa, Mycobacterium
LQHPRIARPAVIISAEAIED

SEQ ID NO: 771422 - protein, 20 aa, Mycobacterium
LQHWVPRAGAEFGAHAQNWI

SEQ ID NO: 771423 - protein, 20 aa, Mycobacterium
LQIEAAWVWPEQHQWLKQFG

SEQ ID NO: 771424 - protein, 25 aa, Mycobacterium
LQIIGMCNWVAWWFHKDDATSAEIV

SEQ ID NO: 771425 - protein, 17 aa, Mycobacterium
LQKRFGTLTGVERPAEN

SEQ ID NO: 771426 - protein, 22 aa, Mycobacterium
LQKWVAACLFRYYLDQYTLLYG

SEQ ID NO: 771427 - protein, 18 aa, Mycobacterium
LQLCDAFGLPVLSLVDCP

SEQ ID NO: 771428 - protein, 17 aa, Mycobacterium
LQLCDAFGLPVVSLIDC

SEQ ID NO: 771429 - protein, 18 aa, Mycobacterium
LQLGWRLFGPFLRAATGL

SEQ ID NO: 771430 - protein, 17 aa, Mycobacterium
LQLTLAWTNVLLQRLAP

SEQ ID NO: 771431 - protein, 20 aa, Mycobacterium
LQLWGSLQWMWVWFDPADSR

SEQ ID NO: 771432 - protein, 18 aa, Mycobacterium
LQMRGCGQIHALSSGYAA

SEQ ID NO: 771433 - protein, 17 aa, Mycobacterium
LQMSWKVAPALAAGCTM

SEQ ID NO: 771434 - protein, 19 aa, Mycobacterium
LQMVGLFSEPVVREGDNVT

SEQ ID NO: 771435 - protein, 17 aa, Mycobacterium
LQPEIRLAAPLLAKGLP

SEQ ID NO: 771436 - protein, 19 aa, Mycobacterium
LQPGGAVIGAFLGSRRDTP

SEQ ID NO: 771437 - protein, 18 aa, Mycobacterium
LQPQLGWEANEPDELAQV

SEQ ID NO: 771438 - protein, 17 aa, Mycobacterium
LQQLLRLLPGCKAPSSS

SEQ ID NO: 771439 - protein, 24 aa, Mycobacterium
LQQLSGRHDLMWAMVSDMPAVGSA

SEQ ID NO: 771440 - protein, 20 aa, Mycobacterium
LQQRFPFDLVIFALDCGGEF

SEQ ID NO: 771441 - protein, 19 aa, Mycobacterium
LQQRLKVANAMREDAAQSP

SEQ ID NO: 771442 - protein, 22 aa, Mycobacterium
LQQWRKARALLMNRPLQNIVAR

SEQ ID NO: 771443 - protein, 23 aa, Mycobacterium
LQRACAWAACGRSAFNAGDIPEL

SEQ ID NO: 771444 - protein, 19 aa, Mycobacterium
LQRFVDRFAHFNFRDSMMR

SEQ ID NO: 771445 - protein, 18 aa, Mycobacterium
LQRGCAWSGDGWDVQQTV

SEQ ID NO: 771446 - protein, 24 aa, Mycobacterium
LQRLRLPWWHVWRAADAVGAATPK

SEQ ID NO: 771447 - protein, 22 aa, Mycobacterium
LQRMSTVIGRRVWENAGSPEVD

SEQ ID NO: 771448 - protein, 18 aa, Mycobacterium
LQRPARWMQLLGRHRGQI

SEQ ID NO: 771449 - protein, 20 aa, Mycobacterium
LQRREAWEIIDYVNRLSDPS

SEQ ID NO: 771450 - protein, 22 aa, Mycobacterium
LQRRGCEIGRLILLDAQPGLDG

SEQ ID NO: 771451 - protein, 18 aa, Mycobacterium
LQRRKLLWWTLSRFTTLS

SEQ ID NO: 771452 - protein, 18 aa, Mycobacterium
LQRTRIAVELARTHLRYG

SEQ ID NO: 771453 - protein, 17 aa, Mycobacterium
LQSRLKTGGLLLNHCIT

SEQ ID NO: 771454 - protein, 20 aa, Mycobacterium
LQTGVRWKDLGLVIVDEEQR

SEQ ID NO: 771455 - protein, 17 aa, Mycobacterium
LQTLSECPLRWLTERHG

SEQ ID NO: 771456 - protein, 24 aa, Mycobacterium
LQTRLAAGPVRFYFRVQIAGPGDS

SEQ ID NO: 771457 - protein, 17 aa, Mycobacterium
LQTRLKALRIFDRKPMP

SEQ ID NO: 771458 - protein, 18 aa, Mycobacterium
LQVAEAFGRYGAHMPKLN

SEQ ID NO: 771459 - protein, 18 aa, Mycobacterium
LQVAEAFGRYGAQLRVNV

SEQ ID NO: 771460 - protein, 18 aa, Mycobacterium
LQVAEAFSRYGAHLPKIN

SEQ ID NO: 771461 - protein, 18 aa, Mycobacterium
LQVAEAFSRYGAHLPKVN

SEQ ID NO: 771462 - protein, 18 aa, Mycobacterium
LQVAEAFSRYGAYLPKLN

SEQ ID NO: 771463 - protein, 17 aa, Mycobacterium
LQVANRVELARYAIEHG

SEQ ID NO: 771464 - protein, 18 aa, Mycobacterium
LQVLGIWPILPEEFTLLD

SEQ ID NO: 771465 - protein, 18 aa, Mycobacterium
LQVMISFDKVGREALDAW

SEQ ID NO: 771466 - protein, 17 aa, Mycobacterium
LQWDCFRFGIIQRTDHF

SEQ ID NO: 771467 - protein, 21 aa, Mycobacterium
LQWDLRFGMDVVDALGPHVTD

SEQ ID NO: 771468 - protein, 23 aa, Mycobacterium
LQWRYYLAWWLWNGHEFDPAAAR

SEQ ID NO: 771469 - protein, 19 aa, Mycobacterium
LQYDLWKAKGLRAVPPTAI

SEQ ID NO: 771470 - protein, 21 aa, Mycobacterium
LQYFWPRLVGDTGWELLDSKF

SEQ ID NO: 771471 - protein, 18 aa, Mycobacterium
LRAAAAFKVTAARLGEEV

SEQ ID NO: 771472 - protein, 21 aa, Mycobacterium
LRAAAALGFRTAFVARPLEFG

SEQ ID NO: 771473 - protein, 19 aa, Mycobacterium
LRAAEAFARMWDMGVAESI

SEQ ID NO: 771474 - protein, 18 aa, Mycobacterium
LRAAFWDRDVPKPVQIVP

SEQ ID NO: 771475 - protein, 19 aa, Mycobacterium
LRAAGIPILGKTNMDEFAM

SEQ ID NO: 771476 - protein, 19 aa, Mycobacterium
LRAAGLSYLCWSRHAVDDA

SEQ ID NO: 771477 - protein, 17 aa, Mycobacterium
LRAAGWRRGDAVVLAAA

SEQ ID NO: 771478 - protein, 18 aa, Mycobacterium
LRAAIPVMRQQRFGRIVA

SEQ ID NO: 771479 - protein, 18 aa, Mycobacterium
LRAALPLVDPGAASPKET

SEQ ID NO: 771480 - protein, 17 aa, Mycobacterium
LRAANALDFDDLIGETV

SEQ ID NO: 771481 - protein, 18 aa, Mycobacterium
LRAAVLDFSDNVRRAERA

SEQ ID NO: 771482 - protein, 18 aa, Mycobacterium
LRAAVRIHPIAAVQSEWS

SEQ ID NO: 771483 - protein, 19 aa, Mycobacterium
LRAAWKDIPEVVGAATVTG

SEQ ID NO: 771484 - protein, 17 aa, Mycobacterium
LRAAWLTMIAVASTHQG

SEQ ID NO: 771485 - protein, 22 aa, Mycobacterium
LRACPGPGCVLYFLTDGRREWC

SEQ ID NO: 771486 - protein, 21 aa, Mycobacterium
LRADELHLGFNFRLVKADYDA

SEQ ID NO: 771487 - protein, 20 aa, Mycobacterium
LRAEAAFLWSGRKAVVSGVS

SEQ ID NO: 771488 - protein, 18 aa, Mycobacterium
LRAEFPPERIALHGNNKS

SEQ ID NO: 771489 - protein, 22 aa, Mycobacterium
LRAELIAAPVLDADLLRRGKHN

SEQ ID NO: 771490 - protein, 20 aa, Mycobacterium
LRAFLLDKVAKWWIPERWSF

SEQ ID NO: 771491 - protein, 19 aa, Mycobacterium
LRAGAAVSRPGPRHVRRLD

SEQ ID NO: 771492 - protein, 19 aa, Mycobacterium
LRAGLFGVLYVLDEPSAGL

SEQ ID NO: 771493 - protein, 22 aa, Mycobacterium
LRAGSQWPALAARVLTETPVHG

SEQ ID NO: 771494 - protein, 18 aa, Mycobacterium
LRAGVVNRILAYVAPILL

SEQ ID NO: 771495 - protein, 17 aa, Mycobacterium
LRAKAKAGFAEREGVNL

SEQ ID NO: 771496 - protein, 19 aa, Mycobacterium
LRAKAWRQIRGGSVGLIPQ

SEQ ID NO: 771497 - protein, 17 aa, Mycobacterium
LRAKFGFVFQDPATALN

SEQ ID NO: 771498 - protein, 23 aa, Mycobacterium
LRALKRLKVVAAFQNSTNSPGGM

SEQ ID NO: 771499 - protein, 24 aa, Mycobacterium
LRALKRLKVVAAFQTNRNSPMGMV

SEQ ID NO: 771500 - protein, 20 aa, Mycobacterium
LRALLVRRNELWAPHHVEPH

SEQ ID NO: 771501 - protein, 17 aa, Mycobacterium
LRAMGVRAGGLVVRCRN

SEQ ID NO: 771502 - protein, 18 aa, Mycobacterium
LRAPLDVFLVRKLGVPQW

SEQ ID NO: 771503 - protein, 19 aa, Mycobacterium
LRAPLTWEVDEPCPVPQPA

SEQ ID NO: 771504 - protein, 20 aa, Mycobacterium
LRAQFAAGLSRMYGAEVPAY

SEQ ID NO: 771505 - protein, 21 aa, Mycobacterium
LRAQLRLAGAGLRNTRIDECV

SEQ ID NO: 771506 - protein, 19 aa, Mycobacterium
LRAQWGWRLVAAASTLPTP

SEQ ID NO: 771507 - protein, 23 aa, Mycobacterium
LRARGDGRVVIWAATQFDVLACR

SEQ ID NO: 771508 - protein, 18 aa, Mycobacterium
LRARLDWLGENNLARSIL

SEQ ID NO: 771509 - protein, 17 aa, Mycobacterium
LRARLRLAVGRRRGTAD

SEQ ID NO: 771510 - protein, 17 aa, Mycobacterium
LRARLRLAVTRRRRARK

SEQ ID NO: 771511 - protein, 19 aa, Mycobacterium
LRARLVLLAVADDGMSTVE

SEQ ID NO: 771512 - protein, 23 aa, Mycobacterium
LRARSAGLLTAWVATSFDVLASR

SEQ ID NO: 771513 - protein, 17 aa, Mycobacterium
LRARVAQWFPPRRYLPR

SEQ ID NO: 771514 - protein, 17 aa, Mycobacterium
LRASREWDLPHEVLDAP

SEQ ID NO: 771515 - protein, 19 aa, Mycobacterium
LRATYLRLGHRVEVIEPVR

SEQ ID NO: 771516 - protein, 18 aa, Mycobacterium
LRAVLPPGVTVPLHSHND

SEQ ID NO: 771517 - protein, 18 aa, Mycobacterium
LRAVLTAALCAPVPVTVV

SEQ ID NO: 771518 - protein, 17 aa, Mycobacterium
LRAVTGLALSRTIIFDY

SEQ ID NO: 771519 - protein, 18 aa, Mycobacterium
LRAYELWAGLAADSGRDV

SEQ ID NO: 771520 - protein, 17 aa, Mycobacterium
LRCGSMFEPVAGERFDL

SEQ ID NO: 771521 - protein, 17 aa, Mycobacterium
LRCSPGYQDQRRALRRH

SEQ ID NO: 771522 - protein, 22 aa, Mycobacterium
LRCSVVGPRAWLSKLPDQIRKR

SEQ ID NO: 771523 - protein, 18 aa, Mycobacterium
LRDAFTFNVSTAHALTSA

SEQ ID NO: 771524 - protein, 19 aa, Mycobacterium
LRDAVPCPLVLHGSSGVPD

SEQ ID NO: 771525 - protein, 19 aa, Mycobacterium
LRDAWFWAHEVMAVGMVWN

SEQ ID NO: 771526 - protein, 20 aa, Mycobacterium
LRDAWFWAHEVMAVGMVWNT

SEQ ID NO: 771527 - protein, 18 aa, Mycobacterium
LRDDLCPEWPQPAQEGGS

SEQ ID NO: 771528 - protein, 19 aa, Mycobacterium
LRDEFRPATTLNVLAAAWL

SEQ ID NO: 771529 - protein, 21 aa, Mycobacterium
LRDFLDWLFGRYQQILDTATS

SEQ ID NO: 771530 - protein, 17 aa, Mycobacterium
LRDIEWRIAPGERTGIL

SEQ ID NO: 771531 - protein, 17 aa, Mycobacterium
LRDIYCATLGYPVDATN

SEQ ID NO: 771532 - protein, 23 aa, Mycobacterium
LRDKLRLGTSITRAEFDERNSLW

SEQ ID NO: 771533 - protein, 18 aa, Mycobacterium
LRDLLKFDFYFADSAAFH

SEQ ID NO: 771534 - protein, 19 aa, Mycobacterium
LRDLLKFDFYFADSATFRD

SEQ ID NO: 771535 - protein, 21 aa, Mycobacterium
LRDLTEWAGIRWGDDTPDEGI

SEQ ID NO: 771536 - protein, 18 aa, Mycobacterium
LRDLWLAIAERFISAGAA

SEQ ID NO: 771537 - protein, 23 aa, Mycobacterium
LRDRLPNVSLWNFYGQTEIAPLA

SEQ ID NO: 771538 - protein, 23 aa, Mycobacterium
LRDRLSEVLPAYMVPAAFIEIDQ

SEQ ID NO: 771539 - protein, 23 aa, Mycobacterium
LRDRLSEVLPAYMVPAAFVVIGE

SEQ ID NO: 771540 - protein, 24 aa, Mycobacterium
LRDRLSEVLPPYMVPAAFIEIDQL

SEQ ID NO: 771541 - protein, 25 aa, Mycobacterium
LRDRLSEVLPPYMVPAAFMLIDQLP

SEQ ID NO: 771542 - protein, 23 aa, Mycobacterium
LRDRLSEVLPPYMVPAAFVVIDE

SEQ ID NO: 771543 - protein, 17 aa, Mycobacterium
LRDVEWRIAPGERTGIV

SEQ ID NO: 771544 - protein, 19 aa, Mycobacterium
LRDWAWSGLCLPAVRLGSF

SEQ ID NO: 771545 - protein, 17 aa, Mycobacterium
LREAFGYEAWVLVYDLG

SEQ ID NO: 771546 - protein, 26 aa, Mycobacterium
LREAPILALGIWRWGLGEIPYRQLEH

SEQ ID NO: 771547 - protein, 17 aa, Mycobacterium
LREAVGIVTEWLQRHDF

SEQ ID NO: 771548 - protein, 26 aa, Mycobacterium
LREFLADKVVRWWLPERWAFVDQVPR

SEQ ID NO: 771549 - protein, 17 aa, Mycobacterium
LREGLGRTVDWFQLSLG

SEQ ID NO: 771550 - protein, 24 aa, Mycobacterium
LREGQRLWLSWAMANRDPAVFTDP

SEQ ID NO: 771551 - protein, 18 aa, Mycobacterium
LREGYKVVRMLVDAYDDK

SEQ ID NO: 771552 - protein, 28 aa, Mycobacterium
LRELAKRWCRWRMSCGVGLGQLRSDRLA

SEQ ID NO: 771553 - protein, 18 aa, Mycobacterium
LRELCKMDGAVVLSTDCS

SEQ ID NO: 771554 - protein, 19 aa, Mycobacterium
LRELCKMDGAVVLSTDGSR

SEQ ID NO: 771555 - protein, 25 aa, Mycobacterium
LRELKCGYHGWTWDLAGALKRVPNR

SEQ ID NO: 771556 - protein, 25 aa, Mycobacterium
LRELKCGYHGWTWDLAGTLKRVPNR

SEQ ID NO: 771557 - protein, 20 aa, Mycobacterium
LRELKCGYHGWTWDLTGELR

SEQ ID NO: 771558 - protein, 20 aa, Mycobacterium
LREMFPGTLIMYGAHERHLL

SEQ ID NO: 771559 - protein, 20 aa, Mycobacterium
LREMIKVRGFQVAPAEVEAV

SEQ ID NO: 771560 - protein, 23 aa, Mycobacterium
LRERLGFGDLRWAVSGAAPIPKE

SEQ ID NO: 771561 - protein, 19 aa, Mycobacterium
LRESPAWITGFEHRIESPS

SEQ ID NO: 771562 - protein, 17 aa, Mycobacterium
LRESPCSVTELSAAVGM

SEQ ID NO: 771563 - protein, 18 aa, Mycobacterium
LRETGFWRFVNDPNDPGE

SEQ ID NO: 771564 - protein, 17 aa, Mycobacterium
LREVYEWEQTRSQGLLI

SEQ ID NO: 771565 - protein, 18 aa, Mycobacterium
LREYFGLRPEDLNIDLGP

SEQ ID NO: 771566 - protein, 18 aa, Mycobacterium
LRFARAGAHTVLTRRRHR

SEQ ID NO: 771567 - protein, 19 aa, Mycobacterium
LRFASTFTWNTLPLPAVPT

SEQ ID NO: 771568 - protein, 17 aa, Mycobacterium
LRFASWRDIHQTAVRVA

SEQ ID NO: 771569 - protein, 21 aa, Mycobacterium
LRFAVTVGGLYIDYSKHRVTA

SEQ ID NO: 771570 - protein, 17 aa, Mycobacterium
LRFFDRISWYPVSAEEL

SEQ ID NO: 771571 - protein, 21 aa, Mycobacterium
LRFGELCLEAGLPPGLVNVLP

SEQ ID NO: 771572 - protein, 17 aa, Mycobacterium
LRFGIELVECTEYFKDT

SEQ ID NO: 771573 - protein, 19 aa, Mycobacterium
LRFGLELVECAEFFKDTTF

SEQ ID NO: 771574 - protein, 19 aa, Mycobacterium
LRFGLELVECTDYFSETSF

SEQ ID NO: 771575 - protein, 17 aa, Mycobacterium
LRFLPPIVRNEEKWCQL

SEQ ID NO: 771576 - protein, 17 aa, Mycobacterium
LRFLPPLSMPDELLQEA

SEQ ID NO: 771577 - protein, 18 aa, Mycobacterium
LRFLPPLSMPDHLLDEGL

SEQ ID NO: 771578 - protein, 20 aa, Mycobacterium
LRFLSSPLWRAYTSTYIEGY

SEQ ID NO: 771579 - protein, 20 aa, Mycobacterium
LRFLVHWSAEVFSDFDELKK

SEQ ID NO: 771580 - protein, 18 aa, Mycobacterium
LRFPGYFLVVHDITQFCR

SEQ ID NO: 771581 - protein, 17 aa, Mycobacterium
LRFQIGRWAYRDLIREQ

SEQ ID NO: 771582 - protein, 18 aa, Mycobacterium
LRFQLLWYPSTTFDTSLP

SEQ ID NO: 771583 - protein, 17 aa, Mycobacterium
LRFTSPVTHMARRATED

SEQ ID NO: 771584 - protein, 20 aa, Mycobacterium
LRFVVLDGLAKPGRLEGPDP

SEQ ID NO: 771585 - protein, 18 aa, Mycobacterium
LRFWPRRVTPAIVSFLVE

SEQ ID NO: 771586 - protein, 18 aa, Mycobacterium
LRGAAWVHGYVTSKWAVR

SEQ ID NO: 771587 - protein, 19 aa, Mycobacterium
LRGAFNVVRPAFPLMCGAG

SEQ ID NO: 771588 - protein, 17 aa, Mycobacterium
LRGAIAVARTVPAQLHR

SEQ ID NO: 771589 - protein, 18 aa, Mycobacterium
LRGANLWDEVKDRLDKPG

SEQ ID NO: 771590 - protein, 18 aa, Mycobacterium
LRGANLWDEVKDRMDRPG

SEQ ID NO: 771591 - protein, 28 aa, Mycobacterium
LRGFERFPAWMWRNTVVRDFVAWLRACN

SEQ ID NO: 771592 - protein, 27 aa, Mycobacterium
LRGFERFPAWMWRNTVVRDFVDWLRER

SEQ ID NO: 771593 - protein, 19 aa, Mycobacterium
LRGGAYFFLPGIKALRYLA

SEQ ID NO: 771594 - protein, 26 aa, Mycobacterium
LRGGKRLRPVFAYWGWHAVTTEEPGP

SEQ ID NO: 771595 - protein, 27 aa, Mycobacterium
LRGGKRVRPAFAYWGWRSVIEPADAVA

SEQ ID NO: 771596 - protein, 20 aa, Mycobacterium
LRGGVHFNLLALSGVTPVEA

SEQ ID NO: 771597 - protein, 17 aa, Mycobacterium
LRGGYALTRIREGSEEA

SEQ ID NO: 771598 - protein, 18 aa, Mycobacterium
LRGILGKEIGFVFQDPQS

SEQ ID NO: 771599 - protein, 17 aa, Mycobacterium
LRGKLVRVLRDRDLGTA

SEQ ID NO: 771600 - protein, 19 aa, Mycobacterium
LRGLFRWWGLYTQREQGYD

SEQ ID NO: 771601 - protein, 19 aa, Mycobacterium
LRGLLGAFMFSGPQLEQPA

SEQ ID NO: 771602 - protein, 19 aa, Mycobacterium
LRGLLGAFMFTGPQLDQPA

SEQ ID NO: 771603 - protein, 25 aa, Mycobacterium
LRGMPAGALGRRGAAAGYVNKYGFR

SEQ ID NO: 771604 - protein, 25 aa, Mycobacterium
LRGMPAGALGRRGAAGGYVNKYGFR

SEQ ID NO: 771605 - protein, 20 aa, Mycobacterium
LRGPFWRWYPGLYAGSKLMH

SEQ ID NO: 771606 - protein, 17 aa, Mycobacterium
LRGPRGGMVLATEEYAP

SEQ ID NO: 771607 - protein, 22 aa, Mycobacterium
LRGRGGTHLVAMAVTADSPYGR

SEQ ID NO: 771608 - protein, 19 aa, Mycobacterium
LRGTCFGITAGDEIGYAIA

SEQ ID NO: 771609 - protein, 17 aa, Mycobacterium
LRGTFLLTKACVPHLQK

SEQ ID NO: 771610 - protein, 18 aa, Mycobacterium
LRHAEILVALALSPQGRS

SEQ ID NO: 771611 - protein, 17 aa, Mycobacterium
LRHCVRDAAAAGGPAAD

SEQ ID NO: 771612 - protein, 17 aa, Mycobacterium
LRHGWPKALSDTGFDRS

SEQ ID NO: 771613 - protein, 19 aa, Mycobacterium
LRHPCCGDLVYGADPKLAK

SEQ ID NO: 771614 - protein, 19 aa, Mycobacterium
LRHRLRLGVLAALDQRIAV

SEQ ID NO: 771615 - protein, 24 aa, Mycobacterium
LRHTCGVCKYCLRGDENLCPKSRY

SEQ ID NO: 771616 - protein, 17 aa, Mycobacterium
LRHTVRFAAAVQAALKD

SEQ ID NO: 771617 - protein, 18 aa, Mycobacterium
LRHTVRFGAAVQAALEDG

SEQ ID NO: 771618 - protein, 21 aa, Mycobacterium
LRIAPELFLKKALVGGFDKIF

SEQ ID NO: 771619 - protein, 24 aa, Mycobacterium
LRIAPELFLKRCVVGGFDRVFELN

SEQ ID NO: 771620 - protein, 17 aa, Mycobacterium
LRIFFEFTRGADESGPA

SEQ ID NO: 771621 - protein, 17 aa, Mycobacterium
LRIGASLVHLGHAARLW

SEQ ID NO: 771622 - protein, 17 aa, Mycobacterium
LRIGELTVRAVGGKHAV

SEQ ID NO: 771623 - protein, 19 aa, Mycobacterium
LRIGESYSRIAGVEHRVEN

SEQ ID NO: 771624 - protein, 19 aa, Mycobacterium
LRIGHLVLCDAFRHPAVLA

SEQ ID NO: 771625 - protein, 17 aa, Mycobacterium
LRIGLATADDIRNWSFG

SEQ ID NO: 771626 - protein, 23 aa, Mycobacterium
LRIGWFEGGIAWVPWALQDAEHL

SEQ ID NO: 771627 - protein, 18 aa, Mycobacterium
LRIPNRVGYWYAQGSMVT

SEQ ID NO: 771628 - protein, 18 aa, Mycobacterium
LRIYWALLGWARGRTNRN

SEQ ID NO: 771629 - protein, 26 aa, Mycobacterium
LRKFLADRVVRWWLPERWAFADQVPR

SEQ ID NO: 771630 - protein, 26 aa, Mycobacterium
LRKFLAEKVVRWWLPERWAFVEEIPR

SEQ ID NO: 771631 - protein, 20 aa, Mycobacterium
LRKGMPTAWLIARLSDTALA

SEQ ID NO: 771632 - protein, 17 aa, Mycobacterium
LRKHFNWVRSWYDFAVP

SEQ ID NO: 771633 - protein, 20 aa, Mycobacterium
LRKLFHAVGVVFKGSGFYRT

SEQ ID NO: 771634 - protein, 20 aa, Mycobacterium
LRKLFNSVGIVFKGSGFYRT

SEQ ID NO: 771635 - protein, 24 aa, Mycobacterium
LRKRAIELLELVGLGHRINHQPTR

SEQ ID NO: 771636 - protein, 18 aa, Mycobacterium
LRKRLRRATGRSVPLAAM

SEQ ID NO: 771637 - protein, 20 aa, Mycobacterium
LRKSEPIHWVDVPGGTGGFG

SEQ ID NO: 771638 - protein, 18 aa, Mycobacterium
LRKSRSEMAWAFPAVPMV

SEQ ID NO: 771639 - protein, 24 aa, Mycobacterium
LRKSRSEMAWAFPAVPMVVRAPAA

SEQ ID NO: 771640 - protein, 18 aa, Mycobacterium
LRKTDWLFPQYREIGAFL

SEQ ID NO: 771641 - protein, 21 aa, Mycobacterium
LRKVANCWTLRPSGPAGAATV

SEQ ID NO: 771642 - protein, 21 aa, Mycobacterium
LRKVVGWARDRGCLVASDECY

SEQ ID NO: 771643 - protein, 20 aa, Mycobacterium
LRKVVGWARDRGVLVASDEC

SEQ ID NO: 771644 - protein, 21 aa, Mycobacterium
LRKVVGWARDRGVLVASDECY

SEQ ID NO: 771645 - protein, 21 aa, Mycobacterium
LRKVVTWARERGVLVASDECY

SEQ ID NO: 771646 - protein, 20 aa, Mycobacterium
LRKYRSGGVGTHYYNTVRAA

SEQ ID NO: 771647 - protein, 19 aa, Mycobacterium
LRLADYTGRILEWINVGQP

SEQ ID NO: 771648 - protein, 21 aa, Mycobacterium
LRLALDADLCGAVTGLPAPLA

SEQ ID NO: 771649 - protein, 17 aa, Mycobacterium
LRLALVLCAVRPEIGGV

SEQ ID NO: 771650 - protein, 21 aa, Mycobacterium
LRLAPTPPWHTTRWQVTRIGD

SEQ ID NO: 771651 - protein, 18 aa, Mycobacterium
LRLAQAMHRRAHRCRVMA

SEQ ID NO: 771652 - protein, 19 aa, Mycobacterium
LRLARCVVEDGWPLRRAAE

SEQ ID NO: 771653 - protein, 17 aa, Mycobacterium
LRLATLVIVAGTAKAVT

SEQ ID NO: 771654 - protein, 17 aa, Mycobacterium
LRLAVLAQREYGTAFDL

SEQ ID NO: 771655 - protein, 19 aa, Mycobacterium
LRLDRHFAISVIDCGSTMD

SEQ ID NO: 771656 - protein, 19 aa, Mycobacterium
LRLEGFRDWADIDVDEAQS

SEQ ID NO: 771657 - protein, 17 aa, Mycobacterium
LRLERVVLVGVWTDGSA

SEQ ID NO: 771658 - protein, 19 aa, Mycobacterium
LRLFAGGIAKLWDPANIDF

SEQ ID NO: 771659 - protein, 17 aa, Mycobacterium
LRLFAGLVGAAGVYATQ

SEQ ID NO: 771660 - protein, 19 aa, Mycobacterium
LRLFAGVLREGSWNQARID

SEQ ID NO: 771661 - protein, 18 aa, Mycobacterium
LRLGATVIQAHIAKGQLE

SEQ ID NO: 771662 - protein, 20 aa, Mycobacterium
LRLGDAWVWDMYRPARFVKQ

SEQ ID NO: 771663 - protein, 20 aa, Mycobacterium
LRLGFLAGHLHWKVDQHDDT

SEQ ID NO: 771664 - protein, 18 aa, Mycobacterium
LRLGRPVRYEFSRSDEFT

SEQ ID NO: 771665 - protein, 17 aa, Mycobacterium
LRLGRPVRYEFTRVDEF

SEQ ID NO: 771666 - protein, 17 aa, Mycobacterium
LRLGVAVLVASQHDPLQ

SEQ ID NO: 771667 - protein, 17 aa, Mycobacterium
LRLGWLVLPDRLVDAVL

SEQ ID NO: 771668 - protein, 18 aa, Mycobacterium
LRLITSMLDRGYTIAHVR

SEQ ID NO: 771669 - protein, 19 aa, Mycobacterium
LRLKAWRLDVAKEQKVPAY

SEQ ID NO: 771670 - protein, 18 aa, Mycobacterium
LRLLFKDEVRAVGRELGL

SEQ ID NO: 771671 - protein, 19 aa, Mycobacterium
LRLLFKDEVRAVGRELGLP

SEQ ID NO: 771672 - protein, 19 aa, Mycobacterium
LRLLFPVEWERFRAGAPER

SEQ ID NO: 771673 - protein, 17 aa, Mycobacterium
LRLLGIHIFGSDATDLV

SEQ ID NO: 771674 - protein, 19 aa, Mycobacterium
LRLLLRRIFESAGGTHDDW

SEQ ID NO: 771675 - protein, 19 aa, Mycobacterium
LRLLPALDGFWFGVTPVAL

SEQ ID NO: 771676 - protein, 20 aa, Mycobacterium
LRLLPFRLVLDGTREIDADI

SEQ ID NO: 771677 - protein, 19 aa, Mycobacterium
LRLPATFGIGTYGVSADFV

SEQ ID NO: 771678 - protein, 18 aa, Mycobacterium
LRLPAVVLEVEFALDASG

SEQ ID NO: 771679 - protein, 18 aa, Mycobacterium
LRLPEWQLAVPQVGGPGQ

SEQ ID NO: 771680 - protein, 17 aa, Mycobacterium
LRLPFGRLWGYDVSVSD

SEQ ID NO: 771681 - protein, 17 aa, Mycobacterium
LRLPGFPFQFFCYKRIA

SEQ ID NO: 771682 - protein, 17 aa, Mycobacterium
LRLPMRVRTAIRQTRDV

SEQ ID NO: 771683 - protein, 20 aa, Mycobacterium
LRLPPELDFAALFHGVDERV

SEQ ID NO: 771684 - protein, 25 aa, Mycobacterium
LRLPQRIPSAIAMELALTGDNLPAE

SEQ ID NO: 771685 - protein, 25 aa, Mycobacterium
LRLPQRIPSAIAMELALTGENLSAE

SEQ ID NO: 771686 - protein, 22 aa, Mycobacterium
LRLPTAFCSPNFAYLMASDALD

SEQ ID NO: 771687 - protein, 18 aa, Mycobacterium
LRLPVDIVVADKFAADAT

SEQ ID NO: 771688 - protein, 22 aa, Mycobacterium
LRLRDVGGIVVIDFIDMVLESN

SEQ ID NO: 771689 - protein, 18 aa, Mycobacterium
LRLRGMSAMLTRIKRRLR

SEQ ID NO: 771690 - protein, 19 aa, Mycobacterium
LRLSARMVFEHPVVHDLAV

SEQ ID NO: 771691 - protein, 25 aa, Mycobacterium
LRLSPGLKRGALIGGIRYYDTVVDD

SEQ ID NO: 771692 - protein, 17 aa, Mycobacterium
LRLSRPLPLRVGDIGLL

SEQ ID NO: 771693 - protein, 17 aa, Mycobacterium
LRLTYVIVVEGNLLSRV

SEQ ID NO: 771694 - protein, 17 aa, Mycobacterium
LRLVHKFGAGVNTIDVA

SEQ ID NO: 771695 - protein, 21 aa, Mycobacterium
LRLYERRGLLAPSRTDGGTRR

SEQ ID NO: 771696 - protein, 18 aa, Mycobacterium
LRMADLQARVDLLRHGLL

SEQ ID NO: 771697 - protein, 20 aa, Mycobacterium
LRMDEFPARLIIVPGENDRL

SEQ ID NO: 771698 - protein, 22 aa, Mycobacterium
LRMDEFPARLVIVPGEHDRLQV

SEQ ID NO: 771699 - protein, 21 aa, Mycobacterium
LRMKMLECLLVLHTLPDEADL

SEQ ID NO: 771700 - protein, 24 aa, Mycobacterium
LRMLRPDLTIGFFLHIPFPPVELF

SEQ ID NO: 771701 - protein, 24 aa, Mycobacterium
LRMLRPDVTIGFFLHIPFPPVELF

SEQ ID NO: 771702 - protein, 19 aa, Mycobacterium
LRMMPAFLLAMGLKVGRGM

SEQ ID NO: 771703 - protein, 18 aa, Mycobacterium
LRMPAGRGKVLRWAAPLL

SEQ ID NO: 771704 - protein, 17 aa, Mycobacterium
LRMPVLMCVGDHDQQAS

SEQ ID NO: 771705 - protein, 19 aa, Mycobacterium
LRMRFKWMGLYTQREEGYD

SEQ ID NO: 771706 - protein, 20 aa, Mycobacterium
LRNDIAFSFVFSEPVDGRQL

SEQ ID NO: 771707 - protein, 18 aa, Mycobacterium
LRNEGLNWVTWVDGETTY

SEQ ID NO: 771708 - protein, 20 aa, Mycobacterium
LRNLLARCFERGVDPWDLER

SEQ ID NO: 771709 - protein, 22 aa, Mycobacterium
LRNLLLAVIFEWGIALHGIHSE

SEQ ID NO: 771710 - protein, 19 aa, Mycobacterium
LRNVWRFWYQIPISLPVIG

SEQ ID NO: 771711 - protein, 18 aa, Mycobacterium
LRPAALAELALRAPARPA

SEQ ID NO: 771712 - protein, 19 aa, Mycobacterium
LRPAHHPSHPWGFVNSVIS

SEQ ID NO: 771713 - protein, 17 aa, Mycobacterium
LRPALFPLWLAIRPIAG

SEQ ID NO: 771714 - protein, 27 aa, Mycobacterium
LRPAPEFEAWLSGLGMVGADGRVLPVD

SEQ ID NO: 771715 - protein, 23 aa, Mycobacterium
LRPAPEFEAWLTGLGMADANGRI

SEQ ID NO: 771716 - protein, 21 aa, Mycobacterium
LRPAPEFNDWLERMGMLERDG

SEQ ID NO: 771717 - protein, 20 aa, Mycobacterium
LRPARAAVVAPSFTEPADAL

SEQ ID NO: 771718 - protein, 26 aa, Mycobacterium
LRPASHYSLGWLPRWAKLGSAVPRLA

SEQ ID NO: 771719 - protein, 19 aa, Mycobacterium
LRPAWITDLHNVFGSAAAE

SEQ ID NO: 771720 - protein, 21 aa, Mycobacterium
LRPDELHLGFNFRLTKIDFDA

SEQ ID NO: 771721 - protein, 21 aa, Mycobacterium
LRPDFATGLAPLRWGTGFMLG

SEQ ID NO: 771722 - protein, 21 aa, Mycobacterium
LRPDLDWDKGKTLRWVIDHLH

SEQ ID NO: 771723 - protein, 19 aa, Mycobacterium
LRPDLRPDWAQPAAGGGSY

SEQ ID NO: 771724 - protein, 23 aa, Mycobacterium
LRPEIWGEFTKRFDIDRVCEFYA

SEQ ID NO: 771725 - protein, 25 aa, Mycobacterium
LRPEPRLPAPAGWPFGEDFPRTCGT

SEQ ID NO: 771726 - protein, 25 aa, Mycobacterium
LRPEPRLPVPSGWPFGEDFPRTCGA

SEQ ID NO: 771727 - protein, 19 aa, Mycobacterium
LRPEVVSFTFGLPDDDEVK

SEQ ID NO: 771728 - protein, 19 aa, Mycobacterium
LRPFMGMMGVAFTQDREIT

SEQ ID NO: 771729 - protein, 19 aa, Mycobacterium
LRPGDLLAVAATGAYCYSL

SEQ ID NO: 771730 - protein, 17 aa, Mycobacterium
LRPGGLIGIEHDDTTSR

SEQ ID NO: 771731 - protein, 21 aa, Mycobacterium
LRPGGQAIIEWVPPSMLASRQ

SEQ ID NO: 771732 - protein, 24 aa, Mycobacterium
LRPGGRLGLVWNVRDERLGWVKDL

SEQ ID NO: 771733 - protein, 24 aa, Mycobacterium
LRPGGRLGLVWNVRDERLGWVSDL

SEQ ID NO: 771734 - protein, 20 aa, Mycobacterium
LRPGGWMVIEDYDWTAFGFE

SEQ ID NO: 771735 - protein, 20 aa, Mycobacterium
LRPGGYFAYADLRPSNEIPD

SEQ ID NO: 771736 - protein, 20 aa, Mycobacterium
LRPHFEWRGLGFISQSALKI

SEQ ID NO: 771737 - protein, 18 aa, Mycobacterium
LRPLLIDTVVGFIGPEYL

SEQ ID NO: 771738 - protein, 19 aa, Mycobacterium
LRPLLPDNLAYVIYTSGST

SEQ ID NO: 771739 - protein, 19 aa, Mycobacterium
LRPLYRPGLVHMYHALTWG

SEQ ID NO: 771740 - protein, 17 aa, Mycobacterium
LRPPPPVRYRLADGAAA

SEQ ID NO: 771741 - protein, 19 aa, Mycobacterium
LRPQLLDRFGFAVDIHASR

SEQ ID NO: 771742 - protein, 18 aa, Mycobacterium
LRPRIAFEATSPAELAEL

SEQ ID NO: 771743 - protein, 20 aa, Mycobacterium
LRPRLRWEMLRLAADHADAG

SEQ ID NO: 771744 - protein, 24 aa, Mycobacterium
LRPTRAGAVPTIWNDVMHYLEKNP

SEQ ID NO: 771745 - protein, 17 aa, Mycobacterium
LRPWVPVVSLVKGLEQG

SEQ ID NO: 771746 - protein, 21 aa, Mycobacterium
LRQALEVFGPIFIQTYAGTEP

SEQ ID NO: 771747 - protein, 19 aa, Mycobacterium
LRQALLMARNRLGPTAITA

SEQ ID NO: 771748 - protein, 17 aa, Mycobacterium
LRQAPVLVLGDRREGDA

SEQ ID NO: 771749 - protein, 17 aa, Mycobacterium
LRQARPALQNTIHQADR

SEQ ID NO: 771750 - protein, 17 aa, Mycobacterium
LRQAWLDLHESWLTAKA

SEQ ID NO: 771751 - protein, 17 aa, Mycobacterium
LRQAYPVPRAPYGLAGS

SEQ ID NO: 771752 - protein, 17 aa, Mycobacterium
LRQKCPVAWNENYGGFW

SEQ ID NO: 771753 - protein, 18 aa, Mycobacterium
LRQLAGAAPAVFADFEIS

SEQ ID NO: 771754 - protein, 20 aa, Mycobacterium
LRQLKNAFLVSSRRQGKLVM

SEQ ID NO: 771755 - protein, 19 aa, Mycobacterium
LRQLPGLAVQRLMADGFGF

SEQ ID NO: 771756 - protein, 17 aa, Mycobacterium
LRQMGIDEPVEWSPLPQ

SEQ ID NO: 771757 - protein, 20 aa, Mycobacterium
LRQRIGMVFQHFNLFPHRTV

SEQ ID NO: 771758 - protein, 19 aa, Mycobacterium
LRQTARELAEWVGSRADSA

SEQ ID NO: 771759 - protein, 20 aa, Mycobacterium
LRQTFDYCVTSAFIMSQLAV

SEQ ID NO: 771760 - protein, 19 aa, Mycobacterium
LRQTYPFGMFAVPQSQISR

SEQ ID NO: 771761 - protein, 18 aa, Mycobacterium
LRQVCGLARPTTVDTAMA

SEQ ID NO: 771762 - protein, 19 aa, Mycobacterium
LRQVIGCVFQDFRLLQQKT

SEQ ID NO: 771763 - protein, 19 aa, Mycobacterium
LRRAPRLGFEIDIDDAKIS

SEQ ID NO: 771764 - protein, 19 aa, Mycobacterium
LRRAPRLGFEIDIDDAKLS

SEQ ID NO: 771765 - protein, 17 aa, Mycobacterium
LRRAVGWYRSHDRLHTG

SEQ ID NO: 771766 - protein, 19 aa, Mycobacterium
LRRAVRLLAQMTRQVAVVQ

SEQ ID NO: 771767 - protein, 18 aa, Mycobacterium
LRRDCFRVLLELPGGVAG

SEQ ID NO: 771768 - protein, 18 aa, Mycobacterium
LRRECPRLQAGATVVAAH

SEQ ID NO: 771769 - protein, 23 aa, Mycobacterium
LRRFGELRLRLSVNGDERQNSLV

SEQ ID NO: 771770 - protein, 19 aa, Mycobacterium
LRRFIPFDVDAGVLRSAGA

SEQ ID NO: 771771 - protein, 20 aa, Mycobacterium
LRRFIRRWLGGALLAQPRAT

SEQ ID NO: 771772 - protein, 17 aa, Mycobacterium
LRRFPKIELVGAVDRMR

SEQ ID NO: 771773 - protein, 18 aa, Mycobacterium
LRRFSLLDSLYMIPPPRI

SEQ ID NO: 771774 - protein, 17 aa, Mycobacterium
LRRHFDWVRSWYDFAVP

SEQ ID NO: 771775 - protein, 18 aa, Mycobacterium
LRRLRGLGHLTVLPGHGP

SEQ ID NO: 771776 - protein, 17 aa, Mycobacterium
LRRLWAMPGTQLGVVAW

SEQ ID NO: 771777 - protein, 20 aa, Mycobacterium
LRRMEFAIAVAKTLANQTAE

SEQ ID NO: 771778 - protein, 20 aa, Mycobacterium
LRRMGELFAPFTKIAAGNPF

SEQ ID NO: 771779 - protein, 18 aa, Mycobacterium
LRRNIRWDPLDSVYFAGY

SEQ ID NO: 771780 - protein, 19 aa, Mycobacterium
LRRRGRLAYTYAMGQCIVA

SEQ ID NO: 771781 - protein, 18 aa, Mycobacterium
LRRSIGYAIQQAGLFPHM

SEQ ID NO: 771782 - protein, 17 aa, Mycobacterium
LRRSPAWEVLRPLAQPM

SEQ ID NO: 771783 - protein, 21 aa, Mycobacterium
LRRWLAPAIREWAARPVTASV

SEQ ID NO: 771784 - protein, 23 aa, Mycobacterium
LRRYRAQSGFVFQAHNLFPHMTV

SEQ ID NO: 771785 - protein, 18 aa, Mycobacterium
LRRYWPWTAVGRRMAETD

SEQ ID NO: 771786 - protein, 18 aa, Mycobacterium
LRSAAALRWAISPWAQSQ

SEQ ID NO: 771787 - protein, 18 aa, Mycobacterium
LRSAAPWADGLAGTTLDL

SEQ ID NO: 771788 - protein, 19 aa, Mycobacterium
LRSALALGAARVFAVDPVV

SEQ ID NO: 771789 - protein, 20 aa, Mycobacterium
LRSALAWLCNAVSRFGRNPS

SEQ ID NO: 771790 - protein, 18 aa, Mycobacterium
LRSARGFGGPVIVHVVTR

SEQ ID NO: 771791 - protein, 19 aa, Mycobacterium
LRSATPLGDVFVSIRPPAG

SEQ ID NO: 771792 - protein, 21 aa, Mycobacterium
LRSEINLGFQPFTLEHAIAAH

SEQ ID NO: 771793 - protein, 23 aa, Mycobacterium
LRSELKGDELLGVEVFASALSSP

SEQ ID NO: 771794 - protein, 23 aa, Mycobacterium
LRSELKMLPALPVAELRAQADEL

SEQ ID NO: 771795 - protein, 18 aa, Mycobacterium
LRSGAAIINLCTLGTRDR

SEQ ID NO: 771796 - protein, 17 aa, Mycobacterium
LRSGALLDWAHQTVSGS

SEQ ID NO: 771797 - protein, 19 aa, Mycobacterium
LRSGLKLNFSCTVGGCAAC

SEQ ID NO: 771798 - protein, 20 aa, Mycobacterium
LRSGMTIGIAGWGSRRKPMA

SEQ ID NO: 771799 - protein, 20 aa, Mycobacterium
LRSGWLNGIKHWQVDYRGDA

SEQ ID NO: 771800 - protein, 27 aa, Mycobacterium
LRSIPTLFWREWSFRLTVGRGTLSVIR

SEQ ID NO: 771801 - protein, 19 aa, Mycobacterium
LRSKGFCWIASRDDIAAIW

SEQ ID NO: 771802 - protein, 19 aa, Mycobacterium
LRSKGFCWIASRPSVAAIW

SEQ ID NO: 771803 - protein, 17 aa, Mycobacterium
LRSLLRFVLDLLSDYGL

SEQ ID NO: 771804 - protein, 19 aa, Mycobacterium
LRSRFGFLAIHGGGLEEMT

SEQ ID NO: 771805 - protein, 19 aa, Mycobacterium
LRSRFGFLAIHGGGLERMT

SEQ ID NO: 771806 - protein, 19 aa, Mycobacterium
LRSRFGFLAIHGGSLEKMT

SEQ ID NO: 771807 - protein, 17 aa, Mycobacterium
LRSRFPGGFTSEVRGIF

SEQ ID NO: 771808 - protein, 18 aa, Mycobacterium
LRSSAILGVCKNVLRAQE

SEQ ID NO: 771809 - protein, 19 aa, Mycobacterium
LRSSPDWYRVIGGRGGNGA

SEQ ID NO: 771810 - protein, 21 aa, Mycobacterium
LRSYLRRWVGAAVKPAQASVQ

SEQ ID NO: 771811 - protein, 17 aa, Mycobacterium
LRTALRMQVWAGHTIVE

SEQ ID NO: 771812 - protein, 19 aa, Mycobacterium
LRTATPLGDVFVALKPPSA

SEQ ID NO: 771813 - protein, 18 aa, Mycobacterium
LRTAVLEFMDTVREVEAA

SEQ ID NO: 771814 - protein, 21 aa, Mycobacterium
LRTCPLCEAMCGLEIQVDDGR

SEQ ID NO: 771815 - protein, 18 aa, Mycobacterium
LRTDRDWIADIVRFVTSR

SEQ ID NO: 771816 - protein, 19 aa, Mycobacterium
LRTDRDWIADVMRFVANRR

SEQ ID NO: 771817 - protein, 18 aa, Mycobacterium
LRTDRDWISDIVRFVSQQ

SEQ ID NO: 771818 - protein, 18 aa, Mycobacterium
LRTDWPARLVGAGFEPAK

SEQ ID NO: 771819 - protein, 19 aa, Mycobacterium
LRTEPWLGPASLSMAAAAQ

SEQ ID NO: 771820 - protein, 23 aa, Mycobacterium
LRTEWWQSCLLPVNWKLATAAFM

SEQ ID NO: 771821 - protein, 18 aa, Mycobacterium
LRTGTDFEYELQMAQMNK

SEQ ID NO: 771822 - protein, 17 aa, Mycobacterium
LRTGWSVTVVGHAEPIT

SEQ ID NO: 771823 - protein, 19 aa, Mycobacterium
LRTLVGIYFDVICDLQPVN

SEQ ID NO: 771824 - protein, 17 aa, Mycobacterium
LRTRCAGAWLWSGRRGI

SEQ ID NO: 771825 - protein, 19 aa, Mycobacterium
LRTRGLKIFPLVGWAERGG

SEQ ID NO: 771826 - protein, 17 aa, Mycobacterium
LRTRLDALIGHGVTEVR

SEQ ID NO: 771827 - protein, 17 aa, Mycobacterium
LRTSHRFGKSIGTLADA

SEQ ID NO: 771828 - protein, 19 aa, Mycobacterium
LRTVCLDFKLYAGGMASTV

SEQ ID NO: 771829 - protein, 22 aa, Mycobacterium
LRVALYPTKIVLDFADDRIAQI

SEQ ID NO: 771830 - protein, 18 aa, Mycobacterium
LRVARLLAYRAVSLQDDP

SEQ ID NO: 771831 - protein, 18 aa, Mycobacterium
LRVATAWEFDLYGGTVLL

SEQ ID NO: 771832 - protein, 18 aa, Mycobacterium
LRVAVCRLVARHPALRTG

SEQ ID NO: 771833 - protein, 19 aa, Mycobacterium
LRVEHRVHLGIATATERGL

SEQ ID NO: 771834 - protein, 17 aa, Mycobacterium
LRVGLPMAPNTVFIAFG

SEQ ID NO: 771835 - protein, 17 aa, Mycobacterium
LRVGNRFIHTGKPTPEG

SEQ ID NO: 771836 - protein, 17 aa, Mycobacterium
LRVGNRFVHTVKPTPEA

SEQ ID NO: 771837 - protein, 17 aa, Mycobacterium
LRVGSFFPSLLERRRRI

SEQ ID NO: 771838 - protein, 19 aa, Mycobacterium
LRVGWFEGGIAWVPPALQD

SEQ ID NO: 771839 - protein, 23 aa, Mycobacterium
LRVGWFEGGIAWVPWALQDAEHL

SEQ ID NO: 771840 - protein, 18 aa, Mycobacterium
LRVIFPPGFAERIGADAV

SEQ ID NO: 771841 - protein, 21 aa, Mycobacterium
LRVLDMTTFWAGPSCTHILGM

SEQ ID NO: 771842 - protein, 18 aa, Mycobacterium
LRVLIDWTGAHLAEVEVN

SEQ ID NO: 771843 - protein, 25 aa, Mycobacterium
LRVLQDLYARWPFFRTVLSNMAQVL

SEQ ID NO: 771844 - protein, 20 aa, Mycobacterium
LRVLRLFLGAAYRPVAVHLP

SEQ ID NO: 771845 - protein, 20 aa, Mycobacterium
LRVPRFLWEVGFAAFEIARR

SEQ ID NO: 771846 - protein, 18 aa, Mycobacterium
LRVPTFIRYDLRADGDDL

SEQ ID NO: 771847 - protein, 21 aa, Mycobacterium
LRVRRRARDWYQRLLTDDPGR

SEQ ID NO: 771848 - protein, 22 aa, Mycobacterium
LRVSRVRWVGGYGRMDSATGEA

SEQ ID NO: 771849 - protein, 17 aa, Mycobacterium
LRVSVRMSGPLDVVPAS

SEQ ID NO: 771850 - protein, 17 aa, Mycobacterium
LRVVDTIDIGSAVRDVA

SEQ ID NO: 771851 - protein, 24 aa, Mycobacterium
LRVVKFWVSHGVKVFRVDNPHTKP

SEQ ID NO: 771852 - protein, 17 aa, Mycobacterium
LRVVTVFGGVSQHKQVA

SEQ ID NO: 771853 - protein, 17 aa, Mycobacterium
LRWALPVAYRLPGLGRL

SEQ ID NO: 771854 - protein, 20 aa, Mycobacterium
LRWERFAVVTDIEWIKQTVK

SEQ ID NO: 771855 - protein, 19 aa, Mycobacterium
LRWLASANCLLEIGEDVTE

SEQ ID NO: 771856 - protein, 19 aa, Mycobacterium
LRWLASANCLLELDEDTAE

SEQ ID NO: 771857 - protein, 20 aa, Mycobacterium
LRWPQPNFPVSNFFHGGAAP

SEQ ID NO: 771858 - protein, 18 aa, Mycobacterium
LRWSVWRMAVGNRNITTT

SEQ ID NO: 771859 - protein, 18 aa, Mycobacterium
LRWWEVLRCIASVRSGLV

SEQ ID NO: 771860 - protein, 17 aa, Mycobacterium
LRYADALSMADNVMTFR

SEQ ID NO: 771861 - protein, 20 aa, Mycobacterium
LRYDIRWKVACGRALTQTSF

SEQ ID NO: 771862 - protein, 24 aa, Mycobacterium
LRYFWPRVVGDIGWQLLDSKFAVV

SEQ ID NO: 771863 - protein, 24 aa, Mycobacterium
LRYFWPRVVGDIGWQLLDTKFAVV

SEQ ID NO: 771864 - protein, 20 aa, Mycobacterium
LRYIMPLGEIIFDFFDSLKS

SEQ ID NO: 771865 - protein, 21 aa, Mycobacterium
LRYLAPIAIRGELVWIDLQES

SEQ ID NO: 771866 - protein, 17 aa, Mycobacterium
LRYLLTLYVYRFGVTTV

SEQ ID NO: 771867 - protein, 20 aa, Mycobacterium
LRYPLPAAWCDDVDVALYLK

SEQ ID NO: 771868 - protein, 19 aa, Mycobacterium
LRYPYARGVLIEMYREAKA

SEQ ID NO: 771869 - protein, 20 aa, Mycobacterium
LRYRIGASLPRAVDTSMPRE

SEQ ID NO: 771870 - protein, 25 aa, Mycobacterium
LRYTCGRCAYCLRGRENLCPESRYT

SEQ ID NO: 771871 - protein, 17 aa, Mycobacterium
LRYTEAEWARMLAKQAE

SEQ ID NO: 771872 - protein, 20 aa, Mycobacterium
LRYTMPLGEIIFDFFDALKS

SEQ ID NO: 771873 - protein, 18 aa, Mycobacterium
LSAAAAWDGLAGELESAA

SEQ ID NO: 771874 - protein, 17 aa, Mycobacterium
LSAAGISWKLYRNKTLG

SEQ ID NO: 771875 - protein, 21 aa, Mycobacterium
LSADLNYVWPTARIAVIGAEG

SEQ ID NO: 771876 - protein, 24 aa, Mycobacterium
LSAEAGAILGRWCAALTRAFTHDG

SEQ ID NO: 771877 - protein, 17 aa, Mycobacterium
LSAGFPLLTTKKVHLKS

SEQ ID NO: 771878 - protein, 17 aa, Mycobacterium
LSAGFVIEEGFPIAELR

SEQ ID NO: 771879 - protein, 20 aa, Mycobacterium
LSAKIAFFFTRRKLAQMTGL

SEQ ID NO: 771880 - protein, 24 aa, Mycobacterium
LSALSFKCDVLWSMLDAIDQAYGN

SEQ ID NO: 771881 - protein, 18 aa, Mycobacterium
LSAMPPFLTGGSMIENVA

SEQ ID NO: 771882 - protein, 17 aa, Mycobacterium
LSAPLVRRDGVLREATW

SEQ ID NO: 771883 - protein, 21 aa, Mycobacterium
LSAPMTLRWLTDRFAGLPLTE

SEQ ID NO: 771884 - protein, 20 aa, Mycobacterium
LSAPMTLRWLTDRFAGRPLS

SEQ ID NO: 771885 - protein, 28 aa, Mycobacterium
LSAQMAAFHDRFMNALAGASGSYASAEA

SEQ ID NO: 771886 - protein, 17 aa, Mycobacterium
LSARLGLTARVAHVEGD

SEQ ID NO: 771887 - protein, 21 aa, Mycobacterium
LSASQLRSWFAYRLDGPSPVN

SEQ ID NO: 771888 - protein, 22 aa, Mycobacterium
LSASQLRSWFAYRVDGPSWVNN

SEQ ID NO: 771889 - protein, 23 aa, Mycobacterium
LSATECWDLLKSVALGRIVTTVD

SEQ ID NO: 771890 - protein, 17 aa, Mycobacterium
LSATLARGLKAEGFVVV

SEQ ID NO: 771891 - protein, 23 aa, Mycobacterium
LSAWTIRLLSRFPQRAVVALATN

SEQ ID NO: 771892 - protein, 20 aa, Mycobacterium
LSAYGVRYLFGVPGAKIDSV

SEQ ID NO: 771893 - protein, 17 aa, Mycobacterium
LSCAGLVIGAWPAEPGV

SEQ ID NO: 771894 - protein, 23 aa, Mycobacterium
LSCPADYQLLLALRAYADVVLVG

SEQ ID NO: 771895 - protein, 18 aa, Mycobacterium
LSDAVTWLAAAGRLSDPR

SEQ ID NO: 771896 - protein, 18 aa, Mycobacterium
LSDELLIEVAEAYIGEAA

SEQ ID NO: 771897 - protein, 20 aa, Mycobacterium
LSDIALKWVIEGAAEHGLLL

SEQ ID NO: 771898 - protein, 18 aa, Mycobacterium
LSDLAALARRTGAADDPF

SEQ ID NO: 771899 - protein, 20 aa, Mycobacterium
LSDLQPGDVITFYNDASHSG

SEQ ID NO: 771900 - protein, 20 aa, Mycobacterium
LSDLQPGDVLTFYSDASHAG

SEQ ID NO: 771901 - protein, 23 aa, Mycobacterium
LSDPRLRRIFTFQSLYAGVAPRD

SEQ ID NO: 771902 - protein, 17 aa, Mycobacterium
LSDRADLVWRSTAATAL

SEQ ID NO: 771903 - protein, 24 aa, Mycobacterium
LSDRGKYQLGIGVSRLARARSGHS

SEQ ID NO: 771904 - protein, 17 aa, Mycobacterium
LSDVLGYAAEYAERGIE

SEQ ID NO: 771905 - protein, 17 aa, Mycobacterium
LSDYLGWSAAIPASECA

SEQ ID NO: 771906 - protein, 21 aa, Mycobacterium
LSEHIRLLAAFDHRHIFIDPT

SEQ ID NO: 771907 - protein, 20 aa, Mycobacterium
LSEIRHWLQVFVERFYSFSQ

SEQ ID NO: 771908 - protein, 21 aa, Mycobacterium
LSELPPFLTGGSMIETVTMES

SEQ ID NO: 771909 - protein, 22 aa, Mycobacterium
LSFAELRAAWRADERGVRLDDA

SEQ ID NO: 771910 - protein, 19 aa, Mycobacterium
LSFLDFRKIPLNGLWAETK

SEQ ID NO: 771911 - protein, 20 aa, Mycobacterium
LSFSSLSGWADRGKRDRFID

SEQ ID NO: 771912 - protein, 20 aa, Mycobacterium
LSGADFPAGWQKLNGPQALS

SEQ ID NO: 771913 - protein, 20 aa, Mycobacterium
LSGAGLWPLLALLASAADDP

SEQ ID NO: 771914 - protein, 28 aa, Mycobacterium
LSGFERFPAWMWRNTVVRDFVEWLRTRN

SEQ ID NO: 771915 - protein, 18 aa, Mycobacterium
LSGGHLFSLYDGCRDEGV

SEQ ID NO: 771916 - protein, 25 aa, Mycobacterium
LSGQVGWLARDRWAVPLVHTAHTLA

SEQ ID NO: 771917 - protein, 20 aa, Mycobacterium
LSGRHFVRWLTAWNETVDAM

SEQ ID NO: 771918 - protein, 17 aa, Mycobacterium
LSGSLGAMFGVCGNELS

SEQ ID NO: 771919 - protein, 17 aa, Mycobacterium
LSGTKVWTSGAHLAHAF

SEQ ID NO: 771920 - protein, 18 aa, Mycobacterium
LSGTKVWTSGAHLAHAFI

SEQ ID NO: 771921 - protein, 18 aa, Mycobacterium
LSGVRLGLMHGRLSGDEK

SEQ ID NO: 771922 - protein, 20 aa, Mycobacterium
LSGYEIPTQISIVAEIPRTA

SEQ ID NO: 771923 - protein, 23 aa, Mycobacterium
LSHDTMEVWSWFLVEKDADEEFK

SEQ ID NO: 771924 - protein, 23 aa, Mycobacterium
LSHNCWQYAALVFATARVGVVLV

SEQ ID NO: 771925 - protein, 18 aa, Mycobacterium
LSIKRPNWITAFDRGGVW

SEQ ID NO: 771926 - protein, 17 aa, Mycobacterium
LSIRLGVPCFPDDPLRF

SEQ ID NO: 771927 - protein, 21 aa, Mycobacterium
LSIWPDWVRRWPTASATAAAT

SEQ ID NO: 771928 - protein, 21 aa, Mycobacterium
LSIWPDWVRRWPTASATATAT

SEQ ID NO: 771929 - protein, 21 aa, Mycobacterium
LSKHIRLLAAFDHRHIFLDPD

SEQ ID NO: 771930 - protein, 19 aa, Mycobacterium
LSKLARPTSTWTYMVNDNP

SEQ ID NO: 771931 - protein, 19 aa, Mycobacterium
LSKPFTFKRVEALRPTIQQ

SEQ ID NO: 771932 - protein, 21 aa, Mycobacterium
LSKPFTFRRVEALRPVIQEVT

SEQ ID NO: 771933 - protein, 20 aa, Mycobacterium
LSKPFTFRRVEGLRPAIQKI

SEQ ID NO: 771934 - protein, 20 aa, Mycobacterium
LSKPFTFRRVEGLRPTIQQI

SEQ ID NO: 771935 - protein, 17 aa, Mycobacterium
LSKRGGGVALLLSNIRE

SEQ ID NO: 771936 - protein, 17 aa, Mycobacterium
LSLEGGKVTGERETDEG

SEQ ID NO: 771937 - protein, 17 aa, Mycobacterium
LSLGYPFDAEWYACGQS

SEQ ID NO: 771938 - protein, 18 aa, Mycobacterium
LSLHLGRRHRIGGLPGYV

SEQ ID NO: 771939 - protein, 19 aa, Mycobacterium
LSLRLAVRTPFAFEGLFGH

SEQ ID NO: 771940 - protein, 26 aa, Mycobacterium
LSLRPETQLALGKWGMLSPHGKCYAF

SEQ ID NO: 771941 - protein, 20 aa, Mycobacterium
LSLTGRPLIGNGANGAPGTG

SEQ ID NO: 771942 - protein, 17 aa, Mycobacterium
LSLWARLRRFTVADLDT

SEQ ID NO: 771943 - protein, 24 aa, Mycobacterium
LSMASAFWPYVTWTSMVATQAGEA

SEQ ID NO: 771944 - protein, 24 aa, Mycobacterium
LSMASALGPYVAWTAGVAARAAET

SEQ ID NO: 771945 - protein, 21 aa, Mycobacterium
LSMFERFLPRHLEIIYEINRR

SEQ ID NO: 771946 - protein, 17 aa, Mycobacterium
LSMMWRNDCESPHLQPL

SEQ ID NO: 771947 - protein, 25 aa, Mycobacterium
LSNIKLLGPVGDLLPILRIPGDTAF

SEQ ID NO: 771948 - protein, 17 aa, Mycobacterium
LSNLDGWGRISDAGGFI

SEQ ID NO: 771949 - protein, 17 aa, Mycobacterium
LSPAWVYSKAMRRRAPW

SEQ ID NO: 771950 - protein, 20 aa, Mycobacterium
LSPGLKRSSLIGGIRYYDTV

SEQ ID NO: 771951 - protein, 25 aa, Mycobacterium
LSPHWPEYLGALGFPIHYRGNHLHL

SEQ ID NO: 771952 - protein, 18 aa, Mycobacterium
LSPISGRAGIAVRAALSR

SEQ ID NO: 771953 - protein, 19 aa, Mycobacterium
LSPWLAMDYFEIWRTQPSV

SEQ ID NO: 771954 - protein, 25 aa, Mycobacterium
LSQGRFRFGVGVGWLREEIANHGVD

SEQ ID NO: 771955 - protein, 25 aa, Mycobacterium
LSQGRFRFGVGVGWLREEVANHRVD

SEQ ID NO: 771956 - protein, 22 aa, Mycobacterium
LSQLRLLPFRLVLDGTTEIDAD

SEQ ID NO: 771957 - protein, 17 aa, Mycobacterium
LSQLWFEALAGICAHVQ

SEQ ID NO: 771958 - protein, 23 aa, Mycobacterium
LSRDLTIRLGREVTRISHDATGV

SEQ ID NO: 771959 - protein, 19 aa, Mycobacterium
LSRFADLCVTAFAGFAVVK

SEQ ID NO: 771960 - protein, 24 aa, Mycobacterium
LSRNAYRYEFGWRSTAVDGLLGAA

SEQ ID NO: 771961 - protein, 20 aa, Mycobacterium
LSRPELKAAVGQIVNADGGQ

SEQ ID NO: 771962 - protein, 17 aa, Mycobacterium
LSSALARRGHDVVVYTR

SEQ ID NO: 771963 - protein, 17 aa, Mycobacterium
LSSLFLLASTAALFSTS

SEQ ID NO: 771964 - protein, 17 aa, Mycobacterium
LSSLMAWPTEHLTNAAD

SEQ ID NO: 771965 - protein, 18 aa, Mycobacterium
LSSLPGCWLLVGADEMRR

SEQ ID NO: 771966 - protein, 17 aa, Mycobacterium
LSSPRIVGWIMRTDSAD

SEQ ID NO: 771967 - protein, 17 aa, Mycobacterium
LSSPRIVGWIMRTDSSD

SEQ ID NO: 771968 - protein, 17 aa, Mycobacterium
LSSSHFVRWLTVWNDTV

SEQ ID NO: 771969 - protein, 18 aa, Mycobacterium
LSTCPPILVLTGRPDDSW

SEQ ID NO: 771970 - protein, 24 aa, Mycobacterium
LSTEAGAILGRWCTALTRAFVNDG

SEQ ID NO: 771971 - protein, 17 aa, Mycobacterium
LSTLTWRAATNVTKLPG

SEQ ID NO: 771972 - protein, 25 aa, Mycobacterium
LSTRPAATCLIDWGTADRHAHREGV

SEQ ID NO: 771973 - protein, 18 aa, Mycobacterium
LSTWWADMGAECGRLAQE

SEQ ID NO: 771974 - protein, 22 aa, Mycobacterium
LSTYRFPTGWFIVAFGSDLAAG

SEQ ID NO: 771975 - protein, 22 aa, Mycobacterium
LSTYRFPTGWFIVAFGSDLAPG

SEQ ID NO: 771976 - protein, 17 aa, Mycobacterium
LSVANGWGAQVTEGKKV

SEQ ID NO: 771977 - protein, 21 aa, Mycobacterium
LSVDACRAFKPSPAVYRYVCD

SEQ ID NO: 771978 - protein, 17 aa, Mycobacterium
LSVDGFRALLVLNHEHH

SEQ ID NO: 771979 - protein, 19 aa, Mycobacterium
LSVDVLDLWDNVRAHLDEN

SEQ ID NO: 771980 - protein, 17 aa, Mycobacterium
LSVPPSWAGPATPVVGT

SEQ ID NO: 771981 - protein, 19 aa, Mycobacterium
LSVPPSWAGSTPVVGSSAA

SEQ ID NO: 771982 - protein, 33 aa, Mycobacterium
LSVPRFASAWLWRLRWPLPLLGMGADIPDGQLC

SEQ ID NO: 771983 - protein, 19 aa, Mycobacterium
LSVRWRHGDTWAIVEGPPA

SEQ ID NO: 771984 - protein, 17 aa, Mycobacterium
LSVSFGDDWAWVRRAHD

SEQ ID NO: 771985 - protein, 19 aa, Mycobacterium
LSVTCPRDLVLNAPVKLAE

SEQ ID NO: 771986 - protein, 20 aa, Mycobacterium
LSVVVGESWRAEALAEMMRE

SEQ ID NO: 771987 - protein, 17 aa, Mycobacterium
LSWAAGLRDDGSTTLLV

SEQ ID NO: 771988 - protein, 17 aa, Mycobacterium
LSWGFDRIFAVTMNHSV

SEQ ID NO: 771989 - protein, 17 aa, Mycobacterium
LSYGSGCVAELFAGTVT

SEQ ID NO: 771990 - protein, 18 aa, Mycobacterium
LSYSLDEACLLIFPRREL

SEQ ID NO: 771991 - protein, 18 aa, Mycobacterium
LTAAGIRCDLHLWDGQIH

SEQ ID NO: 771992 - protein, 17 aa, Mycobacterium
LTAAGRRSVLCGNIGDP

SEQ ID NO: 771993 - protein, 17 aa, Mycobacterium
LTAAGRRSVLCGNIGSP

SEQ ID NO: 771994 - protein, 23 aa, Mycobacterium
LTAARAARLKWWTTDLQVRTADR

SEQ ID NO: 771995 - protein, 18 aa, Mycobacterium
LTAARFSQHGQLFQEISA

SEQ ID NO: 771996 - protein, 18 aa, Mycobacterium
LTAASLLKSMPAAVNAPA

SEQ ID NO: 771997 - protein, 20 aa, Mycobacterium
LTADCVPVLFADAAAGVVAG

SEQ ID NO: 771998 - protein, 26 aa, Mycobacterium
LTADRSRAGGGVCAIAAITGASTGPT

SEQ ID NO: 771999 - protein, 20 aa, Mycobacterium
LTAGCWPAWWLSNEDRGEID

SEQ ID NO: 772000 - protein, 19 aa, Mycobacterium
LTAGSWQGPAAMAMAAAVA

SEQ ID NO: 772001 - protein, 18 aa, Mycobacterium
LTAGYALYGTTGWDDVTV

SEQ ID NO: 772002 - protein, 19 aa, Mycobacterium
LTARGWRVAAHPARELYAQ

SEQ ID NO: 772003 - protein, 21 aa, Mycobacterium
LTARLKKVWAPQGLVQRSQGK

SEQ ID NO: 772004 - protein, 19 aa, Mycobacterium
LTARRLACVAALLRRRSGA

SEQ ID NO: 772005 - protein, 18 aa, Mycobacterium
LTATDAYDWGLISAVYPA

SEQ ID NO: 772006 - protein, 24 aa, Mycobacterium
LTCAIRPSGIWGRGDQTMFRKLFE

SEQ ID NO: 772007 - protein, 17 aa, Mycobacterium
LTCPAGIRCGVSQSIVA

SEQ ID NO: 772008 - protein, 17 aa, Mycobacterium
LTCPMFVTTPEFLPQHH

SEQ ID NO: 772009 - protein, 18 aa, Mycobacterium
LTDAGAFRMFVPRQYGGE

SEQ ID NO: 772010 - protein, 21 aa, Mycobacterium
LTDCPLRWLLERHGGDDGRDV

SEQ ID NO: 772011 - protein, 22 aa, Mycobacterium
LTDFPPSMGIRLNIPQPDLRKV

SEQ ID NO: 772012 - protein, 24 aa, Mycobacterium
LTDGWGLAGARGWQGVGHTRMATE

SEQ ID NO: 772013 - protein, 17 aa, Mycobacterium
LTDHSWNRPSWTVADLE

SEQ ID NO: 772014 - protein, 18 aa, Mycobacterium
LTDLLWRMGIRTIGQFAA

SEQ ID NO: 772015 - protein, 19 aa, Mycobacterium
LTDLLWRMGIRTIGQFAAL

SEQ ID NO: 772016 - protein, 18 aa, Mycobacterium
LTDLSWRGPASESMAASA

SEQ ID NO: 772017 - protein, 25 aa, Mycobacterium
LTDLVFAWRACRAVKSNAIVIAGGG

SEQ ID NO: 772018 - protein, 18 aa, Mycobacterium
LTDPNFRLPFGLTVTMDG

SEQ ID NO: 772019 - protein, 21 aa, Mycobacterium
LTDRLRRSFGRMPWTTTQKRL

SEQ ID NO: 772020 - protein, 18 aa, Mycobacterium
LTDWADRGLRVIGLDAGG

SEQ ID NO: 772021 - protein, 17 aa, Mycobacterium
LTDYAEAAHGMFASLST

SEQ ID NO: 772022 - protein, 18 aa, Mycobacterium
LTEAFLWSEFRVVTKTAT

SEQ ID NO: 772023 - protein, 19 aa, Mycobacterium
LTEAILVRRVDWVEEISSV

SEQ ID NO: 772024 - protein, 17 aa, Mycobacterium
LTEALARDRTRHQVSEV

SEQ ID NO: 772025 - protein, 17 aa, Mycobacterium
LTEGGSPVWASDTSGHS

SEQ ID NO: 772026 - protein, 18 aa, Mycobacterium
LTEIPVLWAYARDLYQTP

SEQ ID NO: 772027 - protein, 22 aa, Mycobacterium
LTELCGVISHLLPEAHRDPGRE

SEQ ID NO: 772028 - protein, 25 aa, Mycobacterium
LTELFSRPGVHFISGFYGPLERALR

SEQ ID NO: 772029 - protein, 20 aa, Mycobacterium
LTEVHLFWAAVLFRNVTAED

SEQ ID NO: 772030 - protein, 19 aa, Mycobacterium
LTFEIARFIKFIVTEIFPG

SEQ ID NO: 772031 - protein, 19 aa, Mycobacterium
LTFELARFIKFMVTEIFPG

SEQ ID NO: 772032 - protein, 19 aa, Mycobacterium
LTGACSMAAFTVAMHAGQG

SEQ ID NO: 772033 - protein, 17 aa, Mycobacterium
LTGEGWLGPASASMAAA

SEQ ID NO: 772034 - protein, 19 aa, Mycobacterium
LTGLRLATKLHEWEPKHGV

SEQ ID NO: 772035 - protein, 19 aa, Mycobacterium
LTGLRLATTLHEWQPRDGV

SEQ ID NO: 772036 - protein, 24 aa, Mycobacterium
LTGRPAISVPLHWTDEGLPLGVQF

SEQ ID NO: 772037 - protein, 24 aa, Mycobacterium
LTGRPAISVPLHWTPAGLPLGVQF

SEQ ID NO: 772038 - protein, 24 aa, Mycobacterium
LTGRPAISVPLHWTQNGLPLGVQF

SEQ ID NO: 772039 - protein, 17 aa, Mycobacterium
LTGRPLIGNGADGINGT

SEQ ID NO: 772040 - protein, 17 aa, Mycobacterium
LTGTKVWTSGAHLAHAF

SEQ ID NO: 772041 - protein, 18 aa, Mycobacterium
LTGWRDAWEIGRTVRDNS

SEQ ID NO: 772042 - protein, 18 aa, Mycobacterium
LTGYGLGRIEGWPDDQTI

SEQ ID NO: 772043 - protein, 18 aa, Mycobacterium
LTHEIVHFSQFILTEIFP

SEQ ID NO: 772044 - protein, 17 aa, Mycobacterium
LTIPALKAFGAIPVADK

SEQ ID NO: 772045 - protein, 25 aa, Mycobacterium
LTIPRLKRSLMLGTRWEQEGAQLVP

SEQ ID NO: 772046 - protein, 17 aa, Mycobacterium
LTIRIPFGGGIGAVEHH

SEQ ID NO: 772047 - protein, 24 aa, Mycobacterium
LTKPRWLWQWGKTMRPPNLRVPNQ

SEQ ID NO: 772048 - protein, 21 aa, Mycobacterium
LTKPVRWDLCTATLRDRFQNA

SEQ ID NO: 772049 - protein, 24 aa, Mycobacterium
LTKYAANCFLALKLSYANAMAELA

SEQ ID NO: 772050 - protein, 25 aa, Mycobacterium
LTLAVDFLGFGLFHGGAGGDGGAAT

SEQ ID NO: 772051 - protein, 18 aa, Mycobacterium
LTLCESFRLPVISLCDTP

SEQ ID NO: 772052 - protein, 22 aa, Mycobacterium
LTLGDGRVVIWGTTDRTDEKAE

SEQ ID NO: 772053 - protein, 18 aa, Mycobacterium
LTLHPGVMTGYSHGELAD

SEQ ID NO: 772054 - protein, 18 aa, Mycobacterium
LTLIAFEAMNHWRADGGF

SEQ ID NO: 772055 - protein, 23 aa, Mycobacterium
LTLPATFSLYVERAWPRHRRLSL

SEQ ID NO: 772056 - protein, 18 aa, Mycobacterium
LTLPSGVGIRLFRPPAST

SEQ ID NO: 772057 - protein, 17 aa, Mycobacterium
LTLRLLTVALRRHVVLN

SEQ ID NO: 772058 - protein, 19 aa, Mycobacterium
LTLRYRRGTVLGRPLRAEG

SEQ ID NO: 772059 - protein, 20 aa, Mycobacterium
LTLWSARAVKSFALDAFNTG

SEQ ID NO: 772060 - protein, 24 aa, Mycobacterium
LTMASAFAPYMAWTAGAAARAAEA

SEQ ID NO: 772061 - protein, 17 aa, Mycobacterium
LTMGFAEEVERILADTP

SEQ ID NO: 772062 - protein, 17 aa, Mycobacterium
LTMLGAIGFTWEHDLHL

SEQ ID NO: 772063 - protein, 22 aa, Mycobacterium
LTMLPTRAWSGLVILDPGEDST

SEQ ID NO: 772064 - protein, 21 aa, Mycobacterium
LTNRSTIRWALHQMVASGVVR

SEQ ID NO: 772065 - protein, 17 aa, Mycobacterium
LTPFIWRMDCFGRPHLE

SEQ ID NO: 772066 - protein, 17 aa, Mycobacterium
LTPGPWRLIRVVGDYYK

SEQ ID NO: 772067 - protein, 19 aa, Mycobacterium
LTPIVCIGEALDIREAGDH

SEQ ID NO: 772068 - protein, 19 aa, Mycobacterium
LTPMHAGLVWASLFSHPGL

SEQ ID NO: 772069 - protein, 18 aa, Mycobacterium
LTRAAARWVPGAQEAGIT

SEQ ID NO: 772070 - protein, 17 aa, Mycobacterium
LTRAVLRGGAYVGVHTM

SEQ ID NO: 772071 - protein, 17 aa, Mycobacterium
LTRELPLRISLIRTGAD

SEQ ID NO: 772072 - protein, 20 aa, Mycobacterium
LTRFPRLRIASVENGSSWIF

SEQ ID NO: 772073 - protein, 23 aa, Mycobacterium
LTRLGLPVPPGFVIADASGTSLG

SEQ ID NO: 772074 - protein, 18 aa, Mycobacterium
LTRLLGMVRDCFALAPDA

SEQ ID NO: 772075 - protein, 21 aa, Mycobacterium
LTRRRMLAIAMIRSSNSASLA

SEQ ID NO: 772076 - protein, 22 aa, Mycobacterium
LTRSCKRWFGIGPAAYRAKTRV

SEQ ID NO: 772077 - protein, 21 aa, Mycobacterium
LTRTAGFQWARHNICVNAIAP

SEQ ID NO: 772078 - protein, 22 aa, Mycobacterium
LTRYGLGVLRAWIRHGTIYGKA

SEQ ID NO: 772079 - protein, 18 aa, Mycobacterium
LTSELPLPVNAIAVPDVD

SEQ ID NO: 772080 - protein, 18 aa, Mycobacterium
LTSEQAWSMLGVTPLIGI

SEQ ID NO: 772081 - protein, 23 aa, Mycobacterium
LTSQWPNWGKIFFNNKGVVAKGT

SEQ ID NO: 772082 - protein, 17 aa, Mycobacterium
LTSRHSFSFGDHYDPDN

SEQ ID NO: 772083 - protein, 25 aa, Mycobacterium
LTSRPCPTCRGVGVVIPDPCHQCMG

SEQ ID NO: 772084 - protein, 19 aa, Mycobacterium
LTSRYEIPCTVAGTVTVDG

SEQ ID NO: 772085 - protein, 17 aa, Mycobacterium
LTSSAALTWRRPIASLN

SEQ ID NO: 772086 - protein, 18 aa, Mycobacterium
LTSSQWLGPASMAMVATI

SEQ ID NO: 772087 - protein, 18 aa, Mycobacterium
LTSTFGRWVHSIRSGHGA

SEQ ID NO: 772088 - protein, 17 aa, Mycobacterium
LTTALALAEWIEEHEPV

SEQ ID NO: 772089 - protein, 18 aa, Mycobacterium
LTTALALAEWIEQHAHAC

SEQ ID NO: 772090 - protein, 19 aa, Mycobacterium
LTTALARHGIVLSLQFETD

SEQ ID NO: 772091 - protein, 18 aa, Mycobacterium
LTTCPKCSGRLRKLFGSV

SEQ ID NO: 772092 - protein, 19 aa, Mycobacterium
LTTCPPILVLTGRPDDAWL

SEQ ID NO: 772093 - protein, 27 aa, Mycobacterium
LTTYRESIRWGKWHMPALFTPETYVSA

SEQ ID NO: 772094 - protein, 17 aa, Mycobacterium
LTVAFLLMLARRLPTAS

SEQ ID NO: 772095 - protein, 22 aa, Mycobacterium
LTVAGTRAWLNRQLRPIGKALD

SEQ ID NO: 772096 - protein, 17 aa, Mycobacterium
LTVGLGIGGREEDYRAV

SEQ ID NO: 772097 - protein, 22 aa, Mycobacterium
LTVRSGEHWALLGPNGAGKSTL

SEQ ID NO: 772098 - protein, 20 aa, Mycobacterium
LTWLIAHGRLEIKLAVVSNK

SEQ ID NO: 772099 - protein, 17 aa, Mycobacterium
LTYRVDFTNVVYNRKTN

SEQ ID NO: 772100 - protein, 17 aa, Mycobacterium
LVACGGSAVPLSLMRAF

SEQ ID NO: 772101 - protein, 25 aa, Mycobacterium
LVADTRGGALLAFGLADSLILRQRY

SEQ ID NO: 772102 - protein, 18 aa, Mycobacterium
LVAFWAILATRVEAPELA

SEQ ID NO: 772103 - protein, 18 aa, Mycobacterium
LVAPLTFLAIAGRRVQLE

SEQ ID NO: 772104 - protein, 17 aa, Mycobacterium
LVARAWLDPDFAELART

SEQ ID NO: 772105 - protein, 25 aa, Mycobacterium
LVARAWRAPLQFLFIDGGHSEDAAN

SEQ ID NO: 772106 - protein, 23 aa, Mycobacterium
LVASTRPPVEWLRIPPGGTVLDI

SEQ ID NO: 772107 - protein, 19 aa, Mycobacterium
LVCNPRWTLGQIIAEPALI

SEQ ID NO: 772108 - protein, 20 aa, Mycobacterium
LVCRACPYRAHQHAGAGVQP

SEQ ID NO: 772109 - protein, 23 aa, Mycobacterium
LVDDLRINWVWNPPWGPDKITED

SEQ ID NO: 772110 - protein, 20 aa, Mycobacterium
LVDIPFKFHHPMWRENCDVD

SEQ ID NO: 772111 - protein, 17 aa, Mycobacterium
LVDLRVARLLAYRAVSL

SEQ ID NO: 772112 - protein, 17 aa, Mycobacterium
LVDPVAEQISGMWAANL

SEQ ID NO: 772113 - protein, 22 aa, Mycobacterium
LVEFTLRIMLSFFVAPNEATRS

SEQ ID NO: 772114 - protein, 19 aa, Mycobacterium
LVEHMGLLLGRPVVTISCH

SEQ ID NO: 772115 - protein, 17 aa, Mycobacterium
LVEKLRTALGLEIPGLA

SEQ ID NO: 772116 - protein, 18 aa, Mycobacterium
LVELDGLLLLPGGGPELD

SEQ ID NO: 772117 - protein, 24 aa, Mycobacterium
LVELRLVDWHGWLFVDPSGQDADF

SEQ ID NO: 772118 - protein, 17 aa, Mycobacterium
LVERLVPDFLWISTEHT

SEQ ID NO: 772119 - protein, 23 aa, Mycobacterium
LVFAWRACRAVKSNAIVVARDGA

SEQ ID NO: 772120 - protein, 24 aa, Mycobacterium
LVFCAAVIRAVHKFAGLLRVSVAS

SEQ ID NO: 772121 - protein, 22 aa, Mycobacterium
LVFCAAVIRAVHKYAGLLRVSV

SEQ ID NO: 772122 - protein, 17 aa, Mycobacterium
LVFDGLFLQLPIGSVDA

SEQ ID NO: 772123 - protein, 19 aa, Mycobacterium
LVFGRRAGLGAADYVKSLT

SEQ ID NO: 772124 - protein, 19 aa, Mycobacterium
LVFGRRAGLGASDYVRSLD

SEQ ID NO: 772125 - protein, 18 aa, Mycobacterium
LVFKELRIFGSLGVDYPA

SEQ ID NO: 772126 - protein, 22 aa, Mycobacterium
LVFKELRVLGSLGVDYPAYQSA

SEQ ID NO: 772127 - protein, 21 aa, Mycobacterium
LVGARARYMWVSTFHSTCVRI

SEQ ID NO: 772128 - protein, 17 aa, Mycobacterium
LVGHGRASAMLLTAEKL

SEQ ID NO: 772129 - protein, 24 aa, Mycobacterium
LVGPNLLAGWGFRTDRRAHDEIAA

SEQ ID NO: 772130 - protein, 18 aa, Mycobacterium
LVGPRAFHRLRLDRNRNL

SEQ ID NO: 772131 - protein, 18 aa, Mycobacterium
LVGRPAYHAFTFGWLLSG

SEQ ID NO: 772132 - protein, 25 aa, Mycobacterium
LVHGGPWARDCWYYQPEVQLLANRG

SEQ ID NO: 772133 - protein, 17 aa, Mycobacterium
LVHRYCRAVDRGDVEAL

SEQ ID NO: 772134 - protein, 17 aa, Mycobacterium
LVIDGRLPLGVRIPSER

SEQ ID NO: 772135 - protein, 24 aa, Mycobacterium
LVIKEALRLLAPVPLVMRKTVRDV

SEQ ID NO: 772136 - protein, 23 aa, Mycobacterium
LVIKESLRLVAPVPLVMRKTVTD

SEQ ID NO: 772137 - protein, 17 aa, Mycobacterium
LVKAGKVSKDWNTDATK

SEQ ID NO: 772138 - protein, 18 aa, Mycobacterium
LVKGGVVFNGYWKNEDET

SEQ ID NO: 772139 - protein, 18 aa, Mycobacterium
LVKICRLIMLYHLDRAWA

SEQ ID NO: 772140 - protein, 18 aa, Mycobacterium
LVKPEIMGGTGFLGAHAD

SEQ ID NO: 772141 - protein, 17 aa, Mycobacterium
LVLADAIVRACEDNPDY

SEQ ID NO: 772142 - protein, 17 aa, Mycobacterium
LVLCGAYARGRAVRALS

SEQ ID NO: 772143 - protein, 17 aa, Mycobacterium
LVLELNSIYGLRDPGAY

SEQ ID NO: 772144 - protein, 19 aa, Mycobacterium
LVLGVGPSHHWIIDDMLGL

SEQ ID NO: 772145 - protein, 17 aa, Mycobacterium
LVLGVGPSHHWIVDDML

SEQ ID NO: 772146 - protein, 25 aa, Mycobacterium
LVLHDWGGALGFDWANRHRDRVAGI

SEQ ID NO: 772147 - protein, 17 aa, Mycobacterium
LVLLLVVHHICWDDDSW

SEQ ID NO: 772148 - protein, 19 aa, Mycobacterium
LVLPRRLQIEFSQVIQKIS

SEQ ID NO: 772149 - protein, 22 aa, Mycobacterium
LVLPRRLQIEFSQVIQQITDGE

SEQ ID NO: 772150 - protein, 19 aa, Mycobacterium
LVLRLLYRHGLLRDDPEQD

SEQ ID NO: 772151 - protein, 17 aa, Mycobacterium
LVLTEGGSPVWASDTSG

SEQ ID NO: 772152 - protein, 19 aa, Mycobacterium
LVLTHGWPGSVLEFLEVLG

SEQ ID NO: 772153 - protein, 20 aa, Mycobacterium
LVLYWWPRADLSGVENAILA

SEQ ID NO: 772154 - protein, 19 aa, Mycobacterium
LVMALRWVRDNVAAFGGDP

SEQ ID NO: 772155 - protein, 20 aa, Mycobacterium
LVMLGLPFLFFIHADYGCAG

SEQ ID NO: 772156 - protein, 20 aa, Mycobacterium
LVMRARLTWQQVVLLRAYAK

SEQ ID NO: 772157 - protein, 18 aa, Mycobacterium
LVMSSGFYRAIQRDDVEL

SEQ ID NO: 772158 - protein, 24 aa, Mycobacterium
LVNAWSAAFARYGRTVGQVLLTAH

SEQ ID NO: 772159 - protein, 18 aa, Mycobacterium
LVNFPLSQWLKFAPPIAY

SEQ ID NO: 772160 - protein, 24 aa, Mycobacterium
LVNIPAQIWIRLTGVTGNKIIPPV

SEQ ID NO: 772161 - protein, 23 aa, Mycobacterium
LVNVHSVFSWLGGTGAYGASKAA

SEQ ID NO: 772162 - protein, 17 aa, Mycobacterium
LVPGAAIPSMFDPSSPV

SEQ ID NO: 772163 - protein, 18 aa, Mycobacterium
LVPGCGFGQHRYRLCYTH

SEQ ID NO: 772164 - protein, 20 aa, Mycobacterium
LVPGDIIWAPAIDGAFVLTT

SEQ ID NO: 772165 - protein, 19 aa, Mycobacterium
LVPHPDWHGDWSAARGYEI

SEQ ID NO: 772166 - protein, 17 aa, Mycobacterium
LVPMLAMRLTHFDNLID

SEQ ID NO: 772167 - protein, 18 aa, Mycobacterium
LVPMLSMRLAFFDHLIDI

SEQ ID NO: 772168 - protein, 18 aa, Mycobacterium
LVPPCWRRESTLARNCFG

SEQ ID NO: 772169 - protein, 17 aa, Mycobacterium
LVPRVCDMFFLRYRKEL

SEQ ID NO: 772170 - protein, 18 aa, Mycobacterium
LVQEGAYVFITGRDRTRA

SEQ ID NO: 772171 - protein, 25 aa, Mycobacterium
LVRAGLRPAGIWAYEAHRVAALRPR

SEQ ID NO: 772172 - protein, 17 aa, Mycobacterium
LVRESFADAVSWVAKNL

SEQ ID NO: 772173 - protein, 25 aa, Mycobacterium
LVRHPRLAKGFLRFNFHLLYGSSLP

SEQ ID NO: 772174 - protein, 20 aa, Mycobacterium
LVRKALELMPNVGFVNAYGL

SEQ ID NO: 772175 - protein, 20 aa, Mycobacterium
LVRLRPAPSLGLPAPLSELA

SEQ ID NO: 772176 - protein, 18 aa, Mycobacterium
LVRRALDLLPQVGFVNAY

SEQ ID NO: 772177 - protein, 18 aa, Mycobacterium
LVRRALELLPDVGFVNAY

SEQ ID NO: 772178 - protein, 19 aa, Mycobacterium
LVRRALELLPDVGFVNAYG

SEQ ID NO: 772179 - protein, 24 aa, Mycobacterium
LVRRGCPFSGLLYAGLAITAKGPA

SEQ ID NO: 772180 - protein, 18 aa, Mycobacterium
LVRWPRQVLAEFGLYLPD

SEQ ID NO: 772181 - protein, 17 aa, Mycobacterium
LVRYGLDMCDVWCRQGR

SEQ ID NO: 772182 - protein, 17 aa, Mycobacterium
LVSDLSVAGWAQILEQG

SEQ ID NO: 772183 - protein, 25 aa, Mycobacterium
LVSDWQVGSTFAWRDGDLSITSPEQ

SEQ ID NO: 772184 - protein, 24 aa, Mycobacterium
LVSFEVFIRPALRTAMGLPDPERP

SEQ ID NO: 772185 - protein, 19 aa, Mycobacterium
LVTALAIAILRGFPVVVLV

SEQ ID NO: 772186 - protein, 17 aa, Mycobacterium
LVTCIDIAPYTSGDAAL

SEQ ID NO: 772187 - protein, 23 aa, Mycobacterium
LVTGEILWAPAIDGAFVLTCRGG

SEQ ID NO: 772188 - protein, 17 aa, Mycobacterium
LVTPLPFNIRSTVRDTD

SEQ ID NO: 772189 - protein, 20 aa, Mycobacterium
LVTPSKLWPLTGLDSLSLDK

SEQ ID NO: 772190 - protein, 17 aa, Mycobacterium
LVTVLGWESCDHTGPVH

SEQ ID NO: 772191 - protein, 24 aa, Mycobacterium
LVVFKELRILGALGVDATAYRAAL

SEQ ID NO: 772192 - protein, 19 aa, Mycobacterium
LVVIRLARHLRFRRADSPV

SEQ ID NO: 772193 - protein, 22 aa, Mycobacterium
LVVKCAPGLDFADLREQTGFDG

SEQ ID NO: 772194 - protein, 19 aa, Mycobacterium
LVVLWRRATGFGRGGAPAV

SEQ ID NO: 772195 - protein, 17 aa, Mycobacterium
LVVRLDFHLDRLVMAVY

SEQ ID NO: 772196 - protein, 18 aa, Mycobacterium
LVVSLAKRYTGRGMAFLD

SEQ ID NO: 772197 - protein, 17 aa, Mycobacterium
LVWSWYGSWTLKGWENR

SEQ ID NO: 772198 - protein, 21 aa, Mycobacterium
LVYKKDCGRFGRLRNFRNQAF

SEQ ID NO: 772199 - protein, 17 aa, Mycobacterium
LWALTFLRRRGVSASAV

SEQ ID NO: 772200 - protein, 19 aa, Mycobacterium
LWALWRFGTDPAFTRISME

SEQ ID NO: 772201 - protein, 19 aa, Mycobacterium
LWALWRFGTDPGFTRISME

SEQ ID NO: 772202 - protein, 18 aa, Mycobacterium
LWAPIARYWPDTSTTLLS

SEQ ID NO: 772203 - protein, 23 aa, Mycobacterium
LWAQEIYADLGLRFDGEQAQAIG

SEQ ID NO: 772204 - protein, 18 aa, Mycobacterium
LWARSGYLQPHWPAPYGR

SEQ ID NO: 772205 - protein, 18 aa, Mycobacterium
LWDAAEWSVQAQLDYLQR

SEQ ID NO: 772206 - protein, 17 aa, Mycobacterium
LWECGVIMLGCGTDSVR

SEQ ID NO: 772207 - protein, 22 aa, Mycobacterium
LWEHWDRCAFHWFPGNHLLHVS

SEQ ID NO: 772208 - protein, 22 aa, Mycobacterium
LWEHWDRCALHWFPGNHILHVN

SEQ ID NO: 772209 - protein, 22 aa, Mycobacterium
LWEPARAAFEWSRTTQRADGTW

SEQ ID NO: 772210 - protein, 18 aa, Mycobacterium
LWGAAEWSVQAQLDYLRT

SEQ ID NO: 772211 - protein, 18 aa, Mycobacterium
LWGGGGIGGTGGFGALNG

SEQ ID NO: 772212 - protein, 25 aa, Mycobacterium
LWHVLFRFSAMYARKVPYRYEMDLV

SEQ ID NO: 772213 - protein, 17 aa, Mycobacterium
LWINIAFDLTSDPQELR

SEQ ID NO: 772214 - protein, 22 aa, Mycobacterium
LWLDPVCPFSWNTARWLRAVAE

SEQ ID NO: 772215 - protein, 18 aa, Mycobacterium
LWLLRGGDLARPSMLSPA

SEQ ID NO: 772216 - protein, 20 aa, Mycobacterium
LWLPHYERTEVVGLRTDAPV

SEQ ID NO: 772217 - protein, 17 aa, Mycobacterium
LWMGVAFGLTSDPDELR

SEQ ID NO: 772218 - protein, 21 aa, Mycobacterium
LWPKARCALMGVGAPPLLRSD

SEQ ID NO: 772219 - protein, 18 aa, Mycobacterium
LWQLAFRLVCDFDGDLDT

SEQ ID NO: 772220 - protein, 17 aa, Mycobacterium
LWQSWGIVPDVVLGHSV

SEQ ID NO: 772221 - protein, 18 aa, Mycobacterium
LWRARRVLAVTFPAYGSS

SEQ ID NO: 772222 - protein, 18 aa, Mycobacterium
LWRARRVLAVTFPTRSEA

SEQ ID NO: 772223 - protein, 18 aa, Mycobacterium
LWRMGIRTIGQFAALSRS

SEQ ID NO: 772224 - protein, 18 aa, Mycobacterium
LWRMGIRTIGQFAALSRT

SEQ ID NO: 772225 - protein, 18 aa, Mycobacterium
LWRMGIRTLGQFAALSRT

SEQ ID NO: 772226 - protein, 22 aa, Mycobacterium
LWRWDTDWFWCSRAFGAQNPGI

SEQ ID NO: 772227 - protein, 17 aa, Mycobacterium
LWSGWLGTDLSRFDLDD

SEQ ID NO: 772228 - protein, 18 aa, Mycobacterium
LWSIESWVRQILRTRELA

SEQ ID NO: 772229 - protein, 18 aa, Mycobacterium
LWSLLSITAPGLFPNPAK

SEQ ID NO: 772230 - protein, 21 aa, Mycobacterium
LWSRLRVAITLVQGGDDLTGA

SEQ ID NO: 772231 - protein, 21 aa, Mycobacterium
LWSTRVARWLRRHTRPSASRP

SEQ ID NO: 772232 - protein, 18 aa, Mycobacterium
LWVPDDFAFVRYLAVGLA

SEQ ID NO: 772233 - protein, 20 aa, Mycobacterium
LWWAEVCQIASKLMAQMPSG

SEQ ID NO: 772234 - protein, 18 aa, Mycobacterium
LWYTWRHQLAALSAAGYR

SEQ ID NO: 772235 - protein, 18 aa, Mycobacterium
LYADWPVIAADAVAGFRM

SEQ ID NO: 772236 - protein, 21 aa, Mycobacterium
LYAPMIHPWSGTGMLEDDNGD

SEQ ID NO: 772237 - protein, 19 aa, Mycobacterium
LYARILAGAGVEWGLLGPR

SEQ ID NO: 772238 - protein, 17 aa, Mycobacterium
LYCKTGVRSAEALAALK

SEQ ID NO: 772239 - protein, 21 aa, Mycobacterium
LYCRNRIEIVIAMLGIIKAGA

SEQ ID NO: 772240 - protein, 23 aa, Mycobacterium
LYCRNRIEIVIAMLGIVKAGAIL

SEQ ID NO: 772241 - protein, 19 aa, Mycobacterium
LYERFGFKVVEEIKPTTHG

SEQ ID NO: 772242 - protein, 17 aa, Mycobacterium
LYFPGSPVLSVHGSFAE

SEQ ID NO: 772243 - protein, 17 aa, Mycobacterium
LYFPGSPVLTLRGSFAE

SEQ ID NO: 772244 - protein, 17 aa, Mycobacterium
LYGDRLCRAFDRDRSGM

SEQ ID NO: 772245 - protein, 20 aa, Mycobacterium
LYGPRWAMVRAFNAANDLDR

SEQ ID NO: 772246 - protein, 17 aa, Mycobacterium
LYGRDVLDLLALADLGA

SEQ ID NO: 772247 - protein, 21 aa, Mycobacterium
LYGRWTFQVVEEFDDNYWSPF

SEQ ID NO: 772248 - protein, 18 aa, Mycobacterium
LYGYKWPTLDGMFTPHAS

SEQ ID NO: 772249 - protein, 18 aa, Mycobacterium
LYGYRIPLVYLVQSTSAG

SEQ ID NO: 772250 - protein, 18 aa, Mycobacterium
LYHREWWDRYVVVNRRFA

SEQ ID NO: 772251 - protein, 17 aa, Mycobacterium
LYIALGISGAIQHRAGM

SEQ ID NO: 772252 - protein, 18 aa, Mycobacterium
LYIPYSWYEPMWMENIGL

SEQ ID NO: 772253 - protein, 26 aa, Mycobacterium
LYKLLRSEWLEPRWMIGIDPESEGLA

SEQ ID NO: 772254 - protein, 20 aa, Mycobacterium
LYLERAWPRHRRLSGTVDAA

SEQ ID NO: 772255 - protein, 19 aa, Mycobacterium
LYLERAWPRHRRLSSADDA

SEQ ID NO: 772256 - protein, 17 aa, Mycobacterium
LYLFFSLLFSAGAETTR

SEQ ID NO: 772257 - protein, 21 aa, Mycobacterium
LYLKRAHVFRHLFGEPTDVLA

SEQ ID NO: 772258 - protein, 25 aa, Mycobacterium
LYLRIAPELFLKRCVVGGFDRVFEL

SEQ ID NO: 772259 - protein, 17 aa, Mycobacterium
LYLWEFPKPTISAIHGY

SEQ ID NO: 772260 - protein, 22 aa, Mycobacterium
LYPDSLHAMGWDIGTKGFEIVL

SEQ ID NO: 772261 - protein, 19 aa, Mycobacterium
LYPECPRAYGVAVMSDVGR

SEQ ID NO: 772262 - protein, 23 aa, Mycobacterium
LYPECPRVYGVAVMGDLSRRRWW

SEQ ID NO: 772263 - protein, 20 aa, Mycobacterium
LYPLFNLWGPAYHDKYSNVT

SEQ ID NO: 772264 - protein, 20 aa, Mycobacterium
LYPRVEVEVGFILAADLPGA

SEQ ID NO: 772265 - protein, 21 aa, Mycobacterium
LYPRVEVEVGFILADDLPGAG

SEQ ID NO: 772266 - protein, 21 aa, Mycobacterium
LYPRVEVEVGFILNADLPGAG

SEQ ID NO: 772267 - protein, 23 aa, Mycobacterium
LYPSLSSDQAWAMLGVTPMIGVN

SEQ ID NO: 772268 - protein, 17 aa, Mycobacterium
LYREGFFGLSWPREYGG

SEQ ID NO: 772269 - protein, 19 aa, Mycobacterium
LYREGITSMHFVPSLLGLF

SEQ ID NO: 772270 - protein, 19 aa, Mycobacterium
LYREYALRPPKGVLLYGPP

SEQ ID NO: 772271 - protein, 19 aa, Mycobacterium
LYREYSLRPPKGVLLYGPP

SEQ ID NO: 772272 - protein, 18 aa, Mycobacterium
LYRHFPDKVSLLGAAIVR

SEQ ID NO: 772273 - protein, 17 aa, Mycobacterium
LYRLCGDRNPLHSDPTF

SEQ ID NO: 772274 - protein, 19 aa, Mycobacterium
LYRTLRAGEFIKIVQSGCN

SEQ ID NO: 772275 - protein, 17 aa, Mycobacterium
LYSCFPVPVFNFCDGTG

SEQ ID NO: 772276 - protein, 18 aa, Mycobacterium
LYSCFPVPVFNFCDGTQL

SEQ ID NO: 772277 - protein, 19 aa, Mycobacterium
LYSRFWHKVLYDLGYVSSR

SEQ ID NO: 772278 - protein, 18 aa, Mycobacterium
LYSRTAAFATEFADALSI

SEQ ID NO: 772279 - protein, 21 aa, Mycobacterium
LYTDFRLPFGIDAWETALADA

SEQ ID NO: 772280 - protein, 19 aa, Mycobacterium
LYVERAWPRHRRLSLAIED

SEQ ID NO: 772281 - protein, 22 aa, Mycobacterium
LYVRPAAWGMWTFYELSEEDKR

SEQ ID NO: 772282 - protein, 17 aa, Mycobacterium
LYVSPALVRTDLLHRTD

SEQ ID NO: 772283 - protein, 20 aa, Mycobacterium
LYYLEMPPALFAPIVENLAK

SEQ ID NO: 772284 - protein, 23 aa, Mycobacterium
LYYLEMPPSLFAPIVENLAKADL

SEQ ID NO: 772285 - protein, 19 aa, Mycobacterium
MAAAAAPYVVWLRATAELC

SEQ ID NO: 772286 - protein, 19 aa, Mycobacterium
MAAANVWEGLQLGIRRFDA

SEQ ID NO: 772287 - protein, 18 aa, Mycobacterium
MAAGALQRFGADTAVAIT

SEQ ID NO: 772288 - protein, 19 aa, Mycobacterium
MAAGALRRFGADTAVAITG

SEQ ID NO: 772289 - protein, 18 aa, Mycobacterium
MAAKNGWAAMPFDERAGV

SEQ ID NO: 772290 - protein, 20 aa, Mycobacterium
MAAKRVWAAMPFDERAAVFL

SEQ ID NO: 772291 - protein, 18 aa, Mycobacterium
MAAKVAPYVSWLYTTATQ

SEQ ID NO: 772292 - protein, 17 aa, Mycobacterium
MAALRLNIPAVFVSGGP

SEQ ID NO: 772293 - protein, 20 aa, Mycobacterium
MAALRPGGRVAVMAYQSLED

SEQ ID NO: 772294 - protein, 17 aa, Mycobacterium
MAAMLLDLCDVEHKVAA

SEQ ID NO: 772295 - protein, 17 aa, Mycobacterium
MAAPAWVAVAIPEPTTP

SEQ ID NO: 772296 - protein, 17 aa, Mycobacterium
MAARIAHHLGHRVIGVD

SEQ ID NO: 772297 - protein, 17 aa, Mycobacterium
MACAIGIAPCMHAGQGC

SEQ ID NO: 772298 - protein, 21 aa, Mycobacterium
MADCHPILFLRMADRLKAGAR

SEQ ID NO: 772299 - protein, 20 aa, Mycobacterium
MADCHPILFLRMADRLSSGA

SEQ ID NO: 772300 - protein, 19 aa, Mycobacterium
MADECLRVIGVEVSSQGVG

SEQ ID NO: 772301 - protein, 18 aa, Mycobacterium
MADIIAALRQLMAGTLWK

SEQ ID NO: 772302 - protein, 18 aa, Mycobacterium
MADRVAVMKRVWAGEKLT

SEQ ID NO: 772303 - protein, 21 aa, Mycobacterium
MAEELWLRLGHTTSLAHGPFP

SEQ ID NO: 772304 - protein, 24 aa, Mycobacterium
MAEGSFKMAFAITEPDAGSNSHNI

SEQ ID NO: 772305 - protein, 24 aa, Mycobacterium
MAERRLGGLSGRTAVLVGAGAMGA

SEQ ID NO: 772306 - protein, 23 aa, Mycobacterium
MAEVPVSVPMKWLPDSLALAGVF

SEQ ID NO: 772307 - protein, 17 aa, Mycobacterium
MAFDMRFAALGTTVLGH

SEQ ID NO: 772308 - protein, 20 aa, Mycobacterium
MAGAITPYVAWALTTAAQAE

SEQ ID NO: 772309 - protein, 17 aa, Mycobacterium
MAGDFGGVWYWNRFPGI

SEQ ID NO: 772310 - protein, 17 aa, Mycobacterium
MAGTGFLGAHAEEVYRL

SEQ ID NO: 772311 - protein, 17 aa, Mycobacterium
MAHCLYAGLVTDSGSFR

SEQ ID NO: 772312 - protein, 17 aa, Mycobacterium
MAHFFYIHFGLPTYFKN

SEQ ID NO: 772313 - protein, 23 aa, Mycobacterium
MAHPCPMCLGSLYYCSPKEVIFL

SEQ ID NO: 772314 - protein, 20 aa, Mycobacterium
MAIFYLRLPATFGIGTYGVS

SEQ ID NO: 772315 - protein, 18 aa, Mycobacterium
MAILALHVDVLWKTVDDF

SEQ ID NO: 772316 - protein, 18 aa, Mycobacterium
MAINYGFNKARFITPVAV

SEQ ID NO: 772317 - protein, 18 aa, Mycobacterium
MAIPELPEELFIESLTQL

SEQ ID NO: 772318 - protein, 23 aa, Mycobacterium
MAKKCIAEGWILSLSGTVSFKNA

SEQ ID NO: 772319 - protein, 20 aa, Mycobacterium
MALCRPLWRCYGKILECDLR

SEQ ID NO: 772320 - protein, 18 aa, Mycobacterium
MALELTWEALEHARIPAS

SEQ ID NO: 772321 - protein, 18 aa, Mycobacterium
MALHYEGWVVDIAHNGRE

SEQ ID NO: 772322 - protein, 19 aa, Mycobacterium
MALSQLWLAHIDWTPDLAP

SEQ ID NO: 772323 - protein, 19 aa, Mycobacterium
MAMLGRPLIGNGADGAPGQ

SEQ ID NO: 772324 - protein, 24 aa, Mycobacterium
MAMPMLRLGGAVARATFGRASMAR

SEQ ID NO: 772325 - protein, 18 aa, Mycobacterium
MANGVFWRADSMGQLSAH

SEQ ID NO: 772326 - protein, 17 aa, Mycobacterium
MAPICQMFHTLPIPWVE

SEQ ID NO: 772327 - protein, 17 aa, Mycobacterium
MAQAAGVPVVFLTAYYG

SEQ ID NO: 772328 - protein, 17 aa, Mycobacterium
MAQAVAPYVAWMRTTAA

SEQ ID NO: 772329 - protein, 21 aa, Mycobacterium
MARAAAPYIAWLRTMAEQAEQ

SEQ ID NO: 772330 - protein, 21 aa, Mycobacterium
MARGIEIGHIFQLGQKYTDAF

SEQ ID NO: 772331 - protein, 22 aa, Mycobacterium
MARGIEIGHIFQLGRKYTDAFT

SEQ ID NO: 772332 - protein, 17 aa, Mycobacterium
MARICALNALAAVDSLV

SEQ ID NO: 772333 - protein, 17 aa, Mycobacterium
MARRFLTFNGWLLQRGE

SEQ ID NO: 772334 - protein, 18 aa, Mycobacterium
MASALARRHGIAVDIVDG

SEQ ID NO: 772335 - protein, 19 aa, Mycobacterium
MASAYAPYMAWMAGAGARA

SEQ ID NO: 772336 - protein, 18 aa, Mycobacterium
MASGDMRATMALTEPGGG

SEQ ID NO: 772337 - protein, 18 aa, Mycobacterium
MASGETKVVFAITEPDAG

SEQ ID NO: 772338 - protein, 19 aa, Mycobacterium
MASGRISYALGLRGPAVSL

SEQ ID NO: 772339 - protein, 19 aa, Mycobacterium
MASGRVSYALGLRGPAMTV

SEQ ID NO: 772340 - protein, 18 aa, Mycobacterium
MASMAAFTWLSTRGGGGV

SEQ ID NO: 772341 - protein, 22 aa, Mycobacterium
MASQRTIICWAMGLTQHSHAVA

SEQ ID NO: 772342 - protein, 18 aa, Mycobacterium
MATGECRGAFSMSEPELG

SEQ ID NO: 772343 - protein, 18 aa, Mycobacterium
MATGEVIGCFGLTEPDFG

SEQ ID NO: 772344 - protein, 18 aa, Mycobacterium
MAVICLIGAMLIEDGHSD

SEQ ID NO: 772345 - protein, 18 aa, Mycobacterium
MAVICLIGAMLVEDGHSD

SEQ ID NO: 772346 - protein, 24 aa, Mycobacterium
MAVLGRPLIGDGVDAAAGSGHNGG

SEQ ID NO: 772347 - protein, 17 aa, Mycobacterium
MAWRILKFRPREDSGAT

SEQ ID NO: 772348 - protein, 17 aa, Mycobacterium
MAYEGRIDWAFAELLAL

SEQ ID NO: 772349 - protein, 17 aa, Mycobacterium
MCFPTFTGFSARHLNMH

SEQ ID NO: 772350 - protein, 17 aa, Mycobacterium
MCFPTFTGFSARHLNMT

SEQ ID NO: 772351 - protein, 17 aa, Mycobacterium
MDAWRQGEEFVVEFDLP

SEQ ID NO: 772352 - protein, 23 aa, Mycobacterium
MDEKRWDAVIAVNLLAPQRLTEG

SEQ ID NO: 772353 - protein, 20 aa, Mycobacterium
MDFRPGLPIRLMPRQQAQRS

SEQ ID NO: 772354 - protein, 17 aa, Mycobacterium
MDGAWVIGRVRVPTYKI

SEQ ID NO: 772355 - protein, 17 aa, Mycobacterium
MDGIGSAITAANAAAAI

SEQ ID NO: 772356 - protein, 18 aa, Mycobacterium
MDGWYEWKGTKGAKTPYY

SEQ ID NO: 772357 - protein, 19 aa, Mycobacterium
MDGWYEWRANPDVLSGAGS

SEQ ID NO: 772358 - protein, 23 aa, Mycobacterium
MDIAKGGLLGGVYAYLDNNNQLV

SEQ ID NO: 772359 - protein, 19 aa, Mycobacterium
MDIESVHRWDAYTEAKEAM

SEQ ID NO: 772360 - protein, 17 aa, Mycobacterium
MDLELTGPMAARLWVRL

SEQ ID NO: 772361 - protein, 17 aa, Mycobacterium
MDLTFSLADRWTEAGRH

SEQ ID NO: 772362 - protein, 17 aa, Mycobacterium
MDLTFSLAERWTEGNEP

SEQ ID NO: 772363 - protein, 18 aa, Mycobacterium
MDNLKFLIENGIHAVVGT

SEQ ID NO: 772364 - protein, 23 aa, Mycobacterium
MDNLKFLIGKGIHAVVGTTGFTD

SEQ ID NO: 772365 - protein, 22 aa, Mycobacterium
MDNLRSAFTWSMENSDLEQALR

SEQ ID NO: 772366 - protein, 24 aa, Mycobacterium
MDPPDWLDFIFVTAVPLILSSVSS

SEQ ID NO: 772367 - protein, 25 aa, Mycobacterium
MDPRQRLALELAWELFEDARIVAES

SEQ ID NO: 772368 - protein, 27 aa, Mycobacterium
MDPRQRLALELAWELLEDAFIVPETVR

SEQ ID NO: 772369 - protein, 26 aa, Mycobacterium
MDPRQRLALELTWELFENAFIVPDTL

SEQ ID NO: 772370 - protein, 19 aa, Mycobacterium
MDRFVDWLVDAGCAIHRID

SEQ ID NO: 772371 - protein, 21 aa, Mycobacterium
MDSHPFVWLPILSRVLGTAEL

SEQ ID NO: 772372 - protein, 21 aa, Mycobacterium
MDSRGRFAMGMARPPERFTDG

SEQ ID NO: 772373 - protein, 17 aa, Mycobacterium
MDTEVLSGLGLIANPVS

SEQ ID NO: 772374 - protein, 24 aa, Mycobacterium
MDTHPFEWLPMLSRVLGSAQLVPG

SEQ ID NO: 772375 - protein, 24 aa, Mycobacterium
MDTHPFMWLPMLSRVLGSAQLLPE

SEQ ID NO: 772376 - protein, 18 aa, Mycobacterium
MEAMWTRFQPAIVAAKDL

SEQ ID NO: 772377 - protein, 19 aa, Mycobacterium
MEFCAAESCGKCTPCRVGS

SEQ ID NO: 772378 - protein, 17 aa, Mycobacterium
MEGRAAFEVKIHRIAAD

SEQ ID NO: 772379 - protein, 19 aa, Mycobacterium
MEGRLGFEVKVHRIAADGA

SEQ ID NO: 772380 - protein, 21 aa, Mycobacterium
MEKRTRFGLAAAQQALEDGGV

SEQ ID NO: 772381 - protein, 18 aa, Mycobacterium
MELFCAGTHPFARWSAQQ

SEQ ID NO: 772382 - protein, 20 aa, Mycobacterium
MELGCDAVLLASAVTRAADP

SEQ ID NO: 772383 - protein, 17 aa, Mycobacterium
MELRIAPSEGRRSGERE

SEQ ID NO: 772384 - protein, 17 aa, Mycobacterium
MEMKVLLWAVQRLIAGL

SEQ ID NO: 772385 - protein, 17 aa, Mycobacterium
MEMKVLLWAVQRLIGGL

SEQ ID NO: 772386 - protein, 17 aa, Mycobacterium
MEMKVLLWAVQRLISGL

SEQ ID NO: 772387 - protein, 20 aa, Mycobacterium
MEPDLKWERFITAVRLLAER

SEQ ID NO: 772388 - protein, 21 aa, Mycobacterium
MEPDLKWERFITAVRLLAERL

SEQ ID NO: 772389 - protein, 22 aa, Mycobacterium
MERFSINAAEAFTVIRTLSQDF

SEQ ID NO: 772390 - protein, 22 aa, Mycobacterium
MERYRIDAGQAFEVLKKLSQGA

SEQ ID NO: 772391 - protein, 27 aa, Mycobacterium
MESLYEYGSRAGLWRVLRVFERRGLPL

SEQ ID NO: 772392 - protein, 17 aa, Mycobacterium
MESRFSAAWALLSAGDE

SEQ ID NO: 772393 - protein, 17 aa, Mycobacterium
METGWWATAPTLIVDGG

SEQ ID NO: 772394 - protein, 18 aa, Mycobacterium
MEVCRKWDVLATVIGEVT

SEQ ID NO: 772395 - protein, 17 aa, Mycobacterium
MEVPAFALALMRRSLSG

SEQ ID NO: 772396 - protein, 20 aa, Mycobacterium
MFALGLVSWMYGRPIQTSET

SEQ ID NO: 772397 - protein, 17 aa, Mycobacterium
MFDGRFLGFADFLVRDG

SEQ ID NO: 772398 - protein, 18 aa, Mycobacterium
MFDYYPLRVRTEFPDGSC

SEQ ID NO: 772399 - protein, 18 aa, Mycobacterium
MFELGQWRGHGGSWRGYE

SEQ ID NO: 772400 - protein, 22 aa, Mycobacterium
MFGSDFFSAWGKLGAVRTPTIA

SEQ ID NO: 772401 - protein, 20 aa, Mycobacterium
MFHCNGWCFTWAVGAAGGTH

SEQ ID NO: 772402 - protein, 24 aa, Mycobacterium
MFKIKPERTADCVVAGYRVHKSGD

SEQ ID NO: 772403 - protein, 24 aa, Mycobacterium
MFLDELVLWLAFRVRDAEFFGREA

SEQ ID NO: 772404 - protein, 19 aa, Mycobacterium
MFLELSWEALERAGIEPGG

SEQ ID NO: 772405 - protein, 19 aa, Mycobacterium
MFPRAEWLRALRRVLEATP

SEQ ID NO: 772406 - protein, 18 aa, Mycobacterium
MFRQWSPRITLFLNGAVD

SEQ ID NO: 772407 - protein, 17 aa, Mycobacterium
MFTKLGGLMAERVTDLR

SEQ ID NO: 772408 - protein, 17 aa, Mycobacterium
MFTPALANWGYDDRGTS

SEQ ID NO: 772409 - protein, 17 aa, Mycobacterium
MFYNLPVEGLDIPKSAL

SEQ ID NO: 772410 - protein, 17 aa, Mycobacterium
MGAGWSWSRKVGSDDDH

SEQ ID NO: 772411 - protein, 18 aa, Mycobacterium
MGAMKLILLMGLRADVDR

SEQ ID NO: 772412 - protein, 18 aa, Mycobacterium
MGAQGAWSGSQWLMVEEA

SEQ ID NO: 772413 - protein, 18 aa, Mycobacterium
MGAVLAFEVARRFESLAG

SEQ ID NO: 772414 - protein, 23 aa, Mycobacterium
MGAWAKRTGAIFIRRQTKDIPVY

SEQ ID NO: 772415 - protein, 20 aa, Mycobacterium
MGDDAWLWKLDCEFRLFNYV

SEQ ID NO: 772416 - protein, 17 aa, Mycobacterium
MGEGLAHLHLCDGSGAS

SEQ ID NO: 772417 - protein, 25 aa, Mycobacterium
MGFGLGVVQWGSWLGWIGNLGGYKC

SEQ ID NO: 772418 - protein, 21 aa, Mycobacterium
MGGAVPRYGFRPMVVPRPPAA

SEQ ID NO: 772419 - protein, 19 aa, Mycobacterium
MGGDFGGVWYWNRYPGIQC

SEQ ID NO: 772420 - protein, 17 aa, Mycobacterium
MGGFRPVVEMQFDAFAY

SEQ ID NO: 772421 - protein, 17 aa, Mycobacterium
MGGITIAAWSARYRHMV

SEQ ID NO: 772422 - protein, 17 aa, Mycobacterium
MGGITIAAWSERYRHKV

SEQ ID NO: 772423 - protein, 17 aa, Mycobacterium
MGGITISAWSERYRHKV

SEQ ID NO: 772424 - protein, 19 aa, Mycobacterium
MGGPVELTAGIGLSGGFGT

SEQ ID NO: 772425 - protein, 17 aa, Mycobacterium
MGGRASLIVATRVPDRV

SEQ ID NO: 772426 - protein, 20 aa, Mycobacterium
MGGVPPSVWGGTAAARFKDV

SEQ ID NO: 772427 - protein, 17 aa, Mycobacterium
MGHRLTIVMDAWTISVD

SEQ ID NO: 772428 - protein, 19 aa, Mycobacterium
MGIDHVDIFYSHRIDPVTP

SEQ ID NO: 772429 - protein, 22 aa, Mycobacterium
MGKDGWLTLNWPKEYGGQDRSP

SEQ ID NO: 772430 - protein, 20 aa, Mycobacterium
MGLAELLAGLGIPYDSERGV

SEQ ID NO: 772431 - protein, 22 aa, Mycobacterium
MGLARLWQSWAIEPDVVLGHSV

SEQ ID NO: 772432 - protein, 20 aa, Mycobacterium
MGLARLWQSWGIQPDVVLGH

SEQ ID NO: 772433 - protein, 20 aa, Mycobacterium
MGLARLWQSWGIVPDVVLGH

SEQ ID NO: 772434 - protein, 17 aa, Mycobacterium
MGLPTNFGLSGYSGGLT

SEQ ID NO: 772435 - protein, 20 aa, Mycobacterium
MGMPCGKYLVVMVGLWLPLL

SEQ ID NO: 772436 - protein, 18 aa, Mycobacterium
MGQLSAHYAITVNRIPAF

SEQ ID NO: 772437 - protein, 17 aa, Mycobacterium
MGRPEFPTPVGNYTVLS

SEQ ID NO: 772438 - protein, 17 aa, Mycobacterium
MGRPRFGSWLRNSTRGA

SEQ ID NO: 772439 - protein, 17 aa, Mycobacterium
MGSCALDLCAVAAGRLD

SEQ ID NO: 772440 - protein, 17 aa, Mycobacterium
MGSEAFRADVTMNKGVD

SEQ ID NO: 772441 - protein, 21 aa, Mycobacterium
MGTGIGLCLLRQGAKLRVIAN

SEQ ID NO: 772442 - protein, 19 aa, Mycobacterium
MGTQFCGSALWKHAPSRSR

SEQ ID NO: 772443 - protein, 25 aa, Mycobacterium
MGTVAYRFTWHLPKNRTWSYDGQLK

SEQ ID NO: 772444 - protein, 18 aa, Mycobacterium
MGWIPLWARLAAVAPNLL

SEQ ID NO: 772445 - protein, 17 aa, Mycobacterium
MGWPEWKVGVQYDGIQH

SEQ ID NO: 772446 - protein, 24 aa, Mycobacterium
MGYSFGAGIGMTFHRAARPGPHGQ

SEQ ID NO: 772447 - protein, 23 aa, Mycobacterium
MHFYFPRFCALCMAENATHNLHN

SEQ ID NO: 772448 - protein, 17 aa, Mycobacterium
MHIGWVFTRTERNNAHT

SEQ ID NO: 772449 - protein, 18 aa, Mycobacterium
MHLGPFRPAWGFGGYRTP

SEQ ID NO: 772450 - protein, 24 aa, Mycobacterium
MHPGNWAGAYACWGTENREAAVRF

SEQ ID NO: 772451 - protein, 17 aa, Mycobacterium
MHSRSGLIDEVRASAVD

SEQ ID NO: 772452 - protein, 17 aa, Mycobacterium
MHSRSGLIDEVRASTVD

SEQ ID NO: 772453 - protein, 21 aa, Mycobacterium
MHYPSWRLSYRGIMTPETLDL

SEQ ID NO: 772454 - protein, 18 aa, Mycobacterium
MIANRISYAFGLQGPSMT

SEQ ID NO: 772455 - protein, 20 aa, Mycobacterium
MIANRVSYAFALHGPSMTVD

SEQ ID NO: 772456 - protein, 20 aa, Mycobacterium
MIANRVSYGFALHGPSMTVD

SEQ ID NO: 772457 - protein, 25 aa, Mycobacterium
MIDVIRFWLGLGIDGFRLDAVPYLF

SEQ ID NO: 772458 - protein, 24 aa, Mycobacterium
MIDVMRFWLGLGIDGFRLDAVPYL

SEQ ID NO: 772459 - protein, 18 aa, Mycobacterium
MIEWRWFELEAFIYGDAL

SEQ ID NO: 772460 - protein, 19 aa, Mycobacterium
MIFYRDPMRLMTHLGEKHG

SEQ ID NO: 772461 - protein, 19 aa, Mycobacterium
MIGEIKPGIKGVGVVVPGT

SEQ ID NO: 772462 - protein, 21 aa, Mycobacterium
MIGGSAFRKGTIFERLYRDSA

SEQ ID NO: 772463 - protein, 23 aa, Mycobacterium
MILRRPRAGLSYEALLATVEQRL

SEQ ID NO: 772464 - protein, 20 aa, Mycobacterium
MIPLFYDWLFGMMVSTAGTP

SEQ ID NO: 772465 - protein, 22 aa, Mycobacterium
MIPLFYDWLFGMVVSTADIRPT

SEQ ID NO: 772466 - protein, 21 aa, Mycobacterium
MIPRRIAMELVLTGAPISAAR

SEQ ID NO: 772467 - protein, 17 aa, Mycobacterium
MIRACPVTWPWNLLGWP

SEQ ID NO: 772468 - protein, 22 aa, Mycobacterium
MIRFCAPAQWFARTVRKPFTLH

SEQ ID NO: 772469 - protein, 22 aa, Mycobacterium
MIRYCAPAQWFARTARKPFDIH

SEQ ID NO: 772470 - protein, 22 aa, Mycobacterium
MIRYCAPAQWFARTARKPFTIG

SEQ ID NO: 772471 - protein, 22 aa, Mycobacterium
MIRYCAPAQWFARTARKPFTIH

SEQ ID NO: 772472 - protein, 23 aa, Mycobacterium
MIRYCAPAQWFARTLRRPFTLHG

SEQ ID NO: 772473 - protein, 17 aa, Mycobacterium
MKAYPLWLARGCMPGKL

SEQ ID NO: 772474 - protein, 18 aa, Mycobacterium
MKAYRAALVASWNTFLEN

SEQ ID NO: 772475 - protein, 17 aa, Mycobacterium
MKFEGGVHRVQRVPVTE

SEQ ID NO: 772476 - protein, 21 aa, Mycobacterium
MKHFGGLVSFELADAAAVNAL

SEQ ID NO: 772477 - protein, 22 aa, Mycobacterium
MKHHFAELLGFRYGRSDQQQAV

SEQ ID NO: 772478 - protein, 19 aa, Mycobacterium
MKIPTEYGGLGMSQVAYNR

SEQ ID NO: 772479 - protein, 21 aa, Mycobacterium
MKLARLNGCRRFISMTGGYHG

SEQ ID NO: 772480 - protein, 20 aa, Mycobacterium
MKLDFLITVDWDYYKKFMSV

SEQ ID NO: 772481 - protein, 20 aa, Mycobacterium
MKLDFLLTVDWDYYKKFMSV

SEQ ID NO: 772482 - protein, 20 aa, Mycobacterium
MKLDLLLTVPLDYYKKFMSV

SEQ ID NO: 772483 - protein, 19 aa, Mycobacterium
MKLFSERAVDYFRTASADD

SEQ ID NO: 772484 - protein, 17 aa, Mycobacterium
MKLHLACYQAFDDIGSV

SEQ ID NO: 772485 - protein, 19 aa, Mycobacterium
MKLTEVWQGAGSLAASGEA

SEQ ID NO: 772486 - protein, 18 aa, Mycobacterium
MKNPEFAAAILPTLRGLK

SEQ ID NO: 772487 - protein, 22 aa, Mycobacterium
MKPEVCWQLPIRRTQAWVDRPD

SEQ ID NO: 772488 - protein, 23 aa, Mycobacterium
MKRMGIGGIYLGGWATSAKGSIS

SEQ ID NO: 772489 - protein, 19 aa, Mycobacterium
MKSGWTWRTPLLGRFGSGY

SEQ ID NO: 772490 - protein, 19 aa, Mycobacterium
MKTLFAALRKGYKATDANN

SEQ ID NO: 772491 - protein, 21 aa, Mycobacterium
MKWRWRAKIGKDWKGRTPNLV

SEQ ID NO: 772492 - protein, 24 aa, Mycobacterium
MKWRWRAKVGKGWEGRRPNLVMGS

SEQ ID NO: 772493 - protein, 18 aa, Mycobacterium
MLAAAAAEVSHLGSSLCA

SEQ ID NO: 772494 - protein, 19 aa, Mycobacterium
MLAAFADQAAQAWQLASTQ

SEQ ID NO: 772495 - protein, 23 aa, Mycobacterium
MLACARLGIMHSVVFAGFTAKAL

SEQ ID NO: 772496 - protein, 17 aa, Mycobacterium
MLAGVVPLVLRLSPELT

SEQ ID NO: 772497 - protein, 18 aa, Mycobacterium
MLAMGFAEDVERILSDTP

SEQ ID NO: 772498 - protein, 18 aa, Mycobacterium
MLANWLTYCGWARNDTLV

SEQ ID NO: 772499 - protein, 21 aa, Mycobacterium
MLDLKILLSHVFDGERLTEDH

SEQ ID NO: 772500 - protein, 19 aa, Mycobacterium
MLEAAVAWDSLAAELGSAA

SEQ ID NO: 772501 - protein, 18 aa, Mycobacterium
MLERFRAMEPWLVGGRVH

SEQ ID NO: 772502 - protein, 24 aa, Mycobacterium
MLETWKVAPALAWGNTVVLKPAED

SEQ ID NO: 772503 - protein, 17 aa, Mycobacterium
MLEVSWEALEHAGIDPL

SEQ ID NO: 772504 - protein, 20 aa, Mycobacterium
MLHRGCRAIRELGAIDLVRS

SEQ ID NO: 772505 - protein, 17 aa, Mycobacterium
MLIAIAGRVARAVVAES

SEQ ID NO: 772506 - protein, 17 aa, Mycobacterium
MLISAPIFHAWGLGCLQ

SEQ ID NO: 772507 - protein, 25 aa, Mycobacterium
MLLDWRRLGIDGARLRPAVNATDLA

SEQ ID NO: 772508 - protein, 19 aa, Mycobacterium
MLLELSWEALERAGIDPSG

SEQ ID NO: 772509 - protein, 18 aa, Mycobacterium
MLLPRSRYDEGVAILKSI

SEQ ID NO: 772510 - protein, 18 aa, Mycobacterium
MLLPRSRYDEGVEILKSI

SEQ ID NO: 772511 - protein, 21 aa, Mycobacterium
MLLQRRCVWMVEQGDIPVAEG

SEQ ID NO: 772512 - protein, 19 aa, Mycobacterium
MLLRGMGIPAHYVSGYLHP

SEQ ID NO: 772513 - protein, 20 aa, Mycobacterium
MLLRRNGFRAAHPVVEKDAG

SEQ ID NO: 772514 - protein, 20 aa, Mycobacterium
MLMAAARLDLASVFFYNGSI

SEQ ID NO: 772515 - protein, 18 aa, Mycobacterium
MLNRVRWTLVHYKPPQAL

SEQ ID NO: 772516 - protein, 18 aa, Mycobacterium
MLPHNAVEYFVSYYDYYQ

SEQ ID NO: 772517 - protein, 21 aa, Mycobacterium
MLPPRFQPRASWNANLSILNT

SEQ ID NO: 772518 - protein, 20 aa, Mycobacterium
MLQARGGGQWATFSELVADC

SEQ ID NO: 772519 - protein, 19 aa, Mycobacterium
MLQARLKALRIFERKPMPT

SEQ ID NO: 772520 - protein, 21 aa, Mycobacterium
MLQAVQPYLIWLRETAQQAQQ

SEQ ID NO: 772521 - protein, 26 aa, Mycobacterium
MLQLYALRSAHSWGIGDLGDLRAFVD

SEQ ID NO: 772522 - protein, 25 aa, Mycobacterium
MLQLYGLRSSRSWGVGDLGDLREFV

SEQ ID NO: 772523 - protein, 19 aa, Mycobacterium
MLRAAEWARIVTLSAHSIQ

SEQ ID NO: 772524 - protein, 19 aa, Mycobacterium
MLRDNRFRLPPGITLAAQG

SEQ ID NO: 772525 - protein, 25 aa, Mycobacterium
MLRELRPDLTIGFFLHIPFPPVELF

SEQ ID NO: 772526 - protein, 24 aa, Mycobacterium
MLREMRPDLTIGFFLHIPFPPVEL

SEQ ID NO: 772527 - protein, 21 aa, Mycobacterium
MLRFLSSPLWRAYTSTYVEGY

SEQ ID NO: 772528 - protein, 20 aa, Mycobacterium
MLRLAIATRYGRFVVASRTR

SEQ ID NO: 772529 - protein, 25 aa, Mycobacterium
MLRMLRPDLTIGFFLHIPFPPVELF

SEQ ID NO: 772530 - protein, 21 aa, Mycobacterium
MLRNRPEFHLADTAAMHLGAI

SEQ ID NO: 772531 - protein, 17 aa, Mycobacterium
MLRQWWGPEKTLVPECR

SEQ ID NO: 772532 - protein, 19 aa, Mycobacterium
MLRWKCVESPLGLNHPYWV

SEQ ID NO: 772533 - protein, 21 aa, Mycobacterium
MLSNLKGLFPAAAAAGAQIAT

SEQ ID NO: 772534 - protein, 25 aa, Mycobacterium
MLTCAIRPSGIWGRGDQTMFRKLFE

SEQ ID NO: 772535 - protein, 25 aa, Mycobacterium
MLTCSIRPSGIWGRGDQTMFRKVFE

SEQ ID NO: 772536 - protein, 20 aa, Mycobacterium
MLTWQMALCRPLWRCYGKIL

SEQ ID NO: 772537 - protein, 19 aa, Mycobacterium
MLVPDPKHPGVMRVGTLEE

SEQ ID NO: 772538 - protein, 20 aa, Mycobacterium
MLYKRFRVRSQVWMFGLTPG

SEQ ID NO: 772539 - protein, 23 aa, Mycobacterium
MLYLEIRCILVAKGAGVQGLQNG

SEQ ID NO: 772540 - protein, 19 aa, Mycobacterium
MMARLCRELGLPLVVDAAQ

SEQ ID NO: 772541 - protein, 19 aa, Mycobacterium
MMFDRCVEFLPALRSAAPD

SEQ ID NO: 772542 - protein, 18 aa, Mycobacterium
MMFGEYWDLTALAEDCAA

SEQ ID NO: 772543 - protein, 21 aa, Mycobacterium
MMFPDRWIPNLADQVRAAALA

SEQ ID NO: 772544 - protein, 17 aa, Mycobacterium
MMGCPYRPLNRLWGNQF

SEQ ID NO: 772545 - protein, 17 aa, Mycobacterium
MMHRLLIVIDEAANVAP

SEQ ID NO: 772546 - protein, 17 aa, Mycobacterium
MMIVRYLIDRRVSVEIP

SEQ ID NO: 772547 - protein, 20 aa, Mycobacterium
MMLEAITPYVTWMRSTAVQA

SEQ ID NO: 772548 - protein, 18 aa, Mycobacterium
MMLVRYLLDRDVHAEIPA

SEQ ID NO: 772549 - protein, 17 aa, Mycobacterium
MMMRAFCDLAERHTWTE

SEQ ID NO: 772550 - protein, 21 aa, Mycobacterium
MMTSNFTFRRCESMRPHIQEM

SEQ ID NO: 772551 - protein, 17 aa, Mycobacterium
MMVTFGVGWLKGEFDAL

SEQ ID NO: 772552 - protein, 17 aa, Mycobacterium
MNFDIVYLPPIHPIGKV

SEQ ID NO: 772553 - protein, 19 aa, Mycobacterium
MNKRVCVRIVAQRARSWDH

SEQ ID NO: 772554 - protein, 24 aa, Mycobacterium
MNLPAVAFGHDWLTGVARYSGLLE

SEQ ID NO: 772555 - protein, 18 aa, Mycobacterium
MNLSRRWANDGIRVNAIA

SEQ ID NO: 772556 - protein, 17 aa, Mycobacterium
MNPHWLGAHPSYTLSKY

SEQ ID NO: 772557 - protein, 23 aa, Mycobacterium
MNSRGRFAMKMARPPERFTDGLL

SEQ ID NO: 772558 - protein, 17 aa, Mycobacterium
MNWASCFEMDFTFIHEG

SEQ ID NO: 772559 - protein, 19 aa, Mycobacterium
MPAGLWKRVVDVFAPANVV

SEQ ID NO: 772560 - protein, 20 aa, Mycobacterium
MPAKSAAVAAIFPTVTAPPP

SEQ ID NO: 772561 - protein, 19 aa, Mycobacterium
MPALKFVWADGAADLLTPF

SEQ ID NO: 772562 - protein, 19 aa, Mycobacterium
MPAMPLIKFIDGYETVEEM

SEQ ID NO: 772563 - protein, 18 aa, Mycobacterium
MPAMPLIRFLDGYETIAE

SEQ ID NO: 772564 - protein, 17 aa, Mycobacterium
MPAPGVYGHSFGSGPRY

SEQ ID NO: 772565 - protein, 17 aa, Mycobacterium
MPARAKEAFGIQKRQRQ

SEQ ID NO: 772566 - protein, 20 aa, Mycobacterium
MPARLLRFWFGLRNQAAYSL

SEQ ID NO: 772567 - protein, 17 aa, Mycobacterium
MPARYVIHAATMELGGP

SEQ ID NO: 772568 - protein, 20 aa, Mycobacterium
MPDAEFEAILGLKRRALVVG

SEQ ID NO: 772569 - protein, 18 aa, Mycobacterium
MPDELKPVLARQMEIYAG

SEQ ID NO: 772570 - protein, 18 aa, Mycobacterium
MPDLKFVWADGAADLLTP

SEQ ID NO: 772571 - protein, 19 aa, Mycobacterium
MPDLRCLMLTSFTSDEAML

SEQ ID NO: 772572 - protein, 17 aa, Mycobacterium
MPDLVARVISGVKPVAD

SEQ ID NO: 772573 - protein, 21 aa, Mycobacterium
MPDTRVAFMLTDAAPIVALTT

SEQ ID NO: 772574 - protein, 22 aa, Mycobacterium
MPDTRVGTTFGHEFIGVVEKVG

SEQ ID NO: 772575 - protein, 20 aa, Mycobacterium
MPDYYRWLLYKADHGPAYRY

SEQ ID NO: 772576 - protein, 19 aa, Mycobacterium
MPELYRYLSPNPGETDVLG

SEQ ID NO: 772577 - protein, 18 aa, Mycobacterium
MPERAIACSFNLEYLLVG

SEQ ID NO: 772578 - protein, 17 aa, Mycobacterium
MPFYLMRAIDGWSPMDG

SEQ ID NO: 772579 - protein, 20 aa, Mycobacterium
MPFYVMRAIDGWSPMDGGWQ

SEQ ID NO: 772580 - protein, 20 aa, Mycobacterium
MPGAEWFPGATLNYATEIFR

SEQ ID NO: 772581 - protein, 17 aa, Mycobacterium
MPGFGLVMFGAIREAGA

SEQ ID NO: 772582 - protein, 19 aa, Mycobacterium
MPGGIYAPMMHPWSTGKDV

SEQ ID NO: 772583 - protein, 25 aa, Mycobacterium
MPGLESPRAFGLMEVLRWAPIGDQD

SEQ ID NO: 772584 - protein, 21 aa, Mycobacterium
MPGYEEFTLYPGPDMDKAKQL

SEQ ID NO: 772585 - protein, 20 aa, Mycobacterium
MPIGELWYRKSGTYRNKVQN

SEQ ID NO: 772586 - protein, 21 aa, Mycobacterium
MPIKVPWSLPAARPAHTGDPA

SEQ ID NO: 772587 - protein, 21 aa, Mycobacterium
MPISIGFPFGLSVVAPVNMPL

SEQ ID NO: 772588 - protein, 25 aa, Mycobacterium
MPKAKCFNEALGYWCVARAERYAYE

SEQ ID NO: 772589 - protein, 17 aa, Mycobacterium
MPKVPSFMWLEVDDVVS

SEQ ID NO: 772590 - protein, 18 aa, Mycobacterium
MPLARALQTVHRYDYLDA

SEQ ID NO: 772591 - protein, 21 aa, Mycobacterium
MPLDAGHQWRRGAALSADDVL

SEQ ID NO: 772592 - protein, 26 aa, Mycobacterium
MPLDALRAGLDWGWASFGDWLDRLEG

SEQ ID NO: 772593 - protein, 19 aa, Mycobacterium
MPLMLAESDWDAWLNPDAP

SEQ ID NO: 772594 - protein, 19 aa, Mycobacterium
MPLMLSEGDWDAWLNPDAP

SEQ ID NO: 772595 - protein, 20 aa, Mycobacterium
MPLPLLHRALATWPDTKFVQ

SEQ ID NO: 772596 - protein, 21 aa, Mycobacterium
MPLPLLHRALSTWPDTRFVQV

SEQ ID NO: 772597 - protein, 20 aa, Mycobacterium
MPMRVIGMLLGIPEDRQRAI

SEQ ID NO: 772598 - protein, 19 aa, Mycobacterium
MPMRVIGMLLGIPEEDQRR

SEQ ID NO: 772599 - protein, 19 aa, Mycobacterium
MPMRVIGMLLGLPEDRQRQ

SEQ ID NO: 772600 - protein, 18 aa, Mycobacterium
MPPALFAPIVENLAAADL

SEQ ID NO: 772601 - protein, 24 aa, Mycobacterium
MPPQMLHMILPRKDYEIVEDSWDV

SEQ ID NO: 772602 - protein, 24 aa, Mycobacterium
MPPQMLHMILPRKDYEIVEDSWNV

SEQ ID NO: 772603 - protein, 22 aa, Mycobacterium
MPPQMLHMILPRKDYQIVDDSW

SEQ ID NO: 772604 - protein, 17 aa, Mycobacterium
MPQIRVGLAYGQVLSRF

SEQ ID NO: 772605 - protein, 17 aa, Mycobacterium
MPQMSGIEFLEAAMDIF

SEQ ID NO: 772606 - protein, 17 aa, Mycobacterium
MPQMSGIEFLERAMDLY

SEQ ID NO: 772607 - protein, 20 aa, Mycobacterium
MPRRFYCRARWRTGGVDSET

SEQ ID NO: 772608 - protein, 22 aa, Mycobacterium
MPSLPWPAADDWLAAVRASPLA

SEQ ID NO: 772609 - protein, 19 aa, Mycobacterium
MPSRAYVSAFGFKGPDQQK

SEQ ID NO: 772610 - protein, 17 aa, Mycobacterium
MPSRFAILPRRGGTHDI

SEQ ID NO: 772611 - protein, 17 aa, Mycobacterium
MPTLAGVTWVGRWEMNL

SEQ ID NO: 772612 - protein, 18 aa, Mycobacterium
MPTPFLAVGESFWDFRQV

SEQ ID NO: 772613 - protein, 20 aa, Mycobacterium
MPTTCPECGTVLAPEKEGDA

SEQ ID NO: 772614 - protein, 21 aa, Mycobacterium
MPVAVPWSLSAARPVHSGADA

SEQ ID NO: 772615 - protein, 18 aa, Mycobacterium
MPVGRRVAIVGGDLVALE

SEQ ID NO: 772616 - protein, 18 aa, Mycobacterium
MPVVWAMFEWGRKHLDDT

SEQ ID NO: 772617 - protein, 19 aa, Mycobacterium
MPYKHGFGPFAPEIYRAPM

SEQ ID NO: 772618 - protein, 24 aa, Mycobacterium
MQEGQRLWLSWAMANRDPRLFDQP

SEQ ID NO: 772619 - protein, 17 aa, Mycobacterium
MQREFPMAVHLLEGHMV

SEQ ID NO: 772620 - protein, 17 aa, Mycobacterium
MQRPRCLYFRDVTAACN

SEQ ID NO: 772621 - protein, 19 aa, Mycobacterium
MQRRWSIVMVDEFQDTDPV

SEQ ID NO: 772622 - protein, 22 aa, Mycobacterium
MRACGICGSDAFYIAIGGIPPR

SEQ ID NO: 772623 - protein, 22 aa, Mycobacterium
MRACGICGSDAFYITIGGLPPR

SEQ ID NO: 772624 - protein, 18 aa, Mycobacterium
MRAEERFGPERVITATTL

SEQ ID NO: 772625 - protein, 19 aa, Mycobacterium
MRALIGIGVFRRGSDGRYA

SEQ ID NO: 772626 - protein, 18 aa, Mycobacterium
MRARFLFHCREFEVIEES

SEQ ID NO: 772627 - protein, 18 aa, Mycobacterium
MRDDLALLIKELEQACDK

SEQ ID NO: 772628 - protein, 17 aa, Mycobacterium
MREWARLDPVAAENIRA

SEQ ID NO: 772629 - protein, 17 aa, Mycobacterium
MRFKWRKWLDFDCNWKV

SEQ ID NO: 772630 - protein, 19 aa, Mycobacterium
MRHGMFWSGDLAYRDADGW

SEQ ID NO: 772631 - protein, 19 aa, Mycobacterium
MRHWLGRGADGWRLDAAYA

SEQ ID NO: 772632 - protein, 18 aa, Mycobacterium
MRIKPGTVLTLWTEDAYG

SEQ ID NO: 772633 - protein, 18 aa, Mycobacterium
MRISHCRPPGADRDIVLM

SEQ ID NO: 772634 - protein, 18 aa, Mycobacterium
MRLDMPLLDFFSHGGALK

SEQ ID NO: 772635 - protein, 18 aa, Mycobacterium
MRLDMPLVDFFSRGGALK

SEQ ID NO: 772636 - protein, 18 aa, Mycobacterium
MRLGALFVPLNWRLHTTE

SEQ ID NO: 772637 - protein, 17 aa, Mycobacterium
MRLHWGPIEFRTLAEQA

SEQ ID NO: 772638 - protein, 22 aa, Mycobacterium
MRLIAIPLWHSYMFAIRKDWGY

SEQ ID NO: 772639 - protein, 18 aa, Mycobacterium
MRLQPGRMFLVDTAQGRI

SEQ ID NO: 772640 - protein, 18 aa, Mycobacterium
MRLWAQERVRGWTNDRVR

SEQ ID NO: 772641 - protein, 17 aa, Mycobacterium
MRPDCFDWDAGLKRYLS

SEQ ID NO: 772642 - protein, 17 aa, Mycobacterium
MRRCPSRSFTVVGDLAQ

SEQ ID NO: 772643 - protein, 18 aa, Mycobacterium
MRRIKQSFDPAGILNPGI

SEQ ID NO: 772644 - protein, 18 aa, Mycobacterium
MRRIKRSFDPAGILNPDV

SEQ ID NO: 772645 - protein, 17 aa, Mycobacterium
MRRMLALQSGRRGVVNI

SEQ ID NO: 772646 - protein, 23 aa, Mycobacterium
MRSCTGWPSGTWIDPPRRTAPDG

SEQ ID NO: 772647 - protein, 18 aa, Mycobacterium
MRSLLRMQHRILGGTRRV

SEQ ID NO: 772648 - protein, 22 aa, Mycobacterium
MRSRAAILYEYGHPWTVEEFEL

SEQ ID NO: 772649 - protein, 18 aa, Mycobacterium
MRTFAVELGEHFIRVNSV

SEQ ID NO: 772650 - protein, 17 aa, Mycobacterium
MRTVMCIINGQLRPVLV

SEQ ID NO: 772651 - protein, 18 aa, Mycobacterium
MRTVMCIINGQLRPVLVR

SEQ ID NO: 772652 - protein, 17 aa, Mycobacterium
MRTVMCILNGQLRPVLV

SEQ ID NO: 772653 - protein, 17 aa, Mycobacterium
MRTVMCIMNGQLRPVLV

SEQ ID NO: 772654 - protein, 20 aa, Mycobacterium
MRTWFGFGVAGNFAGHLEQA

SEQ ID NO: 772655 - protein, 19 aa, Mycobacterium
MRTYRIGAILLDLQDPTRI

SEQ ID NO: 772656 - protein, 18 aa, Mycobacterium
MRVVRELSALPAEVEAAR

SEQ ID NO: 772657 - protein, 17 aa, Mycobacterium
MRVVRELSSLAGEVEAA

SEQ ID NO: 772658 - protein, 17 aa, Mycobacterium
MRWKGPSGHSCWFANAP

SEQ ID NO: 772659 - protein, 25 aa, Mycobacterium
MRWPHGRLRYYLAMLAELSQLRLLP

SEQ ID NO: 772660 - protein, 17 aa, Mycobacterium
MRYKWRKWLYFDCNWKV

SEQ ID NO: 772661 - protein, 20 aa, Mycobacterium
MRYTRTLTIQACWEAGKQPP

SEQ ID NO: 772662 - protein, 23 aa, Mycobacterium
MSAALCKRLLWDSAIHHYTPRQV

SEQ ID NO: 772663 - protein, 17 aa, Mycobacterium
MSAHPALLFSLGQSAGD

SEQ ID NO: 772664 - protein, 21 aa, Mycobacterium
MSARLMERWSSRRAAIKARTA

SEQ ID NO: 772665 - protein, 23 aa, Mycobacterium
MSAYRAGGQFLWDALSQAIDAAG

SEQ ID NO: 772666 - protein, 18 aa, Mycobacterium
MSCGWFFCASGYYRYDAG

SEQ ID NO: 772667 - protein, 26 aa, Mycobacterium
MSCPNCLRGDIGNCLRIQLMAFAYDG

SEQ ID NO: 772668 - protein, 18 aa, Mycobacterium
MSECYRIRLNYAQADGGP

SEQ ID NO: 772669 - protein, 17 aa, Mycobacterium
MSEERVRLISPFVGGAF

SEQ ID NO: 772670 - protein, 20 aa, Mycobacterium
MSEVLPLLYLHGLSTSDFGP

SEQ ID NO: 772671 - protein, 28 aa, Mycobacterium
MSFIAVCGQCRWCASGMEYLCDAGIGTL

SEQ ID NO: 772672 - protein, 21 aa, Mycobacterium
MSFPAYVRWARLIRTIEVART

SEQ ID NO: 772673 - protein, 19 aa, Mycobacterium
MSFQPDLCAQVPIVGLVGE

SEQ ID NO: 772674 - protein, 28 aa, Mycobacterium
MSFVAVCGQCRWCASGIEYLCDQGIGTM

SEQ ID NO: 772675 - protein, 17 aa, Mycobacterium
MSFVFAVPEFLTTAAQD

SEQ ID NO: 772676 - protein, 18 aa, Mycobacterium
MSGARIALHAALELARRG

SEQ ID NO: 772677 - protein, 17 aa, Mycobacterium
MSGLRWLQDRGFDGERV

SEQ ID NO: 772678 - protein, 17 aa, Mycobacterium
MSGTGFLGAHAEEVYHL

SEQ ID NO: 772679 - protein, 23 aa, Mycobacterium
MSGWQRLHFRFGIPEPLLEPLAV

SEQ ID NO: 772680 - protein, 17 aa, Mycobacterium
MSISLLRHGRLWGLIAC

SEQ ID NO: 772681 - protein, 26 aa, Mycobacterium
MSISVAFHEPVRWDGWLLYTHESTQV

SEQ ID NO: 772682 - protein, 21 aa, Mycobacterium
MSLSGRWRRQGIDVGFAALAA

SEQ ID NO: 772683 - protein, 18 aa, Mycobacterium
MSPETWAALSTHLNRAQL

SEQ ID NO: 772684 - protein, 22 aa, Mycobacterium
MSQLRTALRLQIAAGRSIGEAL

SEQ ID NO: 772685 - protein, 21 aa, Mycobacterium
MSQLRTALRMQIVAGYPVAEA

SEQ ID NO: 772686 - protein, 17 aa, Mycobacterium
MSRRYHADFSFASYDPA

SEQ ID NO: 772687 - protein, 17 aa, Mycobacterium
MSTELMAAWSSRRLAIE

SEQ ID NO: 772688 - protein, 20 aa, Mycobacterium
MSVGDLIIGWLLQRQAAVAV

SEQ ID NO: 772689 - protein, 23 aa, Mycobacterium
MSVGDLLIGWLLQRQAAVAIEAL

SEQ ID NO: 772690 - protein, 19 aa, Mycobacterium
MSVGDLVIGWLLQRQAAVA

SEQ ID NO: 772691 - protein, 19 aa, Mycobacterium
MSYHLPRIVGTSVAADWML

SEQ ID NO: 772692 - protein, 19 aa, Mycobacterium
MSYYEMKNRAGVVGERGLG

SEQ ID NO: 772693 - protein, 18 aa, Mycobacterium
MTAEDRWLQFSSVSFDAS

SEQ ID NO: 772694 - protein, 18 aa, Mycobacterium
MTCACVLKDGKVRMLVND

SEQ ID NO: 772695 - protein, 17 aa, Mycobacterium
MTCPSLPAGFDFTDPDI

SEQ ID NO: 772696 - protein, 18 aa, Mycobacterium
MTDGRWDPGKDFAMVSAR

SEQ ID NO: 772697 - protein, 18 aa, Mycobacterium
MTEVPAPVVRKIPKEWLD

SEQ ID NO: 772698 - protein, 24 aa, Mycobacterium
MTFAKPYAEWRGMFAGNGMLLPRS

SEQ ID NO: 772699 - protein, 19 aa, Mycobacterium
MTFTQDWFRFERLMVAARC

SEQ ID NO: 772700 - protein, 23 aa, Mycobacterium
MTGWQRLHFRFGIPAPLLEPLAV

SEQ ID NO: 772701 - protein, 19 aa, Mycobacterium
MTHHRWLRALAVFGGMGLR

SEQ ID NO: 772702 - protein, 23 aa, Mycobacterium
MTHWAGKEWDHFLHGTPVGRALN

SEQ ID NO: 772703 - protein, 26 aa, Mycobacterium
MTISVAFHEPVRWDGWLLYTHESTQV

SEQ ID NO: 772704 - protein, 25 aa, Mycobacterium
MTKSLRAGKVFLDWSQNNAAKTTIA

SEQ ID NO: 772705 - protein, 25 aa, Mycobacterium
MTKSLRAGKVFLDWSQNNGSKTTIA

SEQ ID NO: 772706 - protein, 19 aa, Mycobacterium
MTLAGRWRRQGIAVDFATL

SEQ ID NO: 772707 - protein, 17 aa, Mycobacterium
MTLEGTNTWVLRAPRSD

SEQ ID NO: 772708 - protein, 18 aa, Mycobacterium
MTLKSHRWISGTFGPDLS

SEQ ID NO: 772709 - protein, 23 aa, Mycobacterium
MTLTCPFHGWTFRNDGALLKVKD

SEQ ID NO: 772710 - protein, 25 aa, Mycobacterium
MTLVPRARPALRFVEIVAADPSVAA

SEQ ID NO: 772711 - protein, 18 aa, Mycobacterium
MTPAAFVRRPGRWIRAMA

SEQ ID NO: 772712 - protein, 20 aa, Mycobacterium
MTPHWGRGTLVGKLTVPPSW

SEQ ID NO: 772713 - protein, 22 aa, Mycobacterium
MTPSGFEWELGWNPIVVDENTW

SEQ ID NO: 772714 - protein, 24 aa, Mycobacterium
MTSPVRWDLCTEYFKTANDTPAAT

SEQ ID NO: 772715 - protein, 24 aa, Mycobacterium
MTSRPCPTCRGVGTVIPDPCHQCM

SEQ ID NO: 772716 - protein, 25 aa, Mycobacterium
MTSRPCPTCRGVGVVIPDPCHQCMG

SEQ ID NO: 772717 - protein, 17 aa, Mycobacterium
MTVALLLTVTRHVLTAD

SEQ ID NO: 772718 - protein, 17 aa, Mycobacterium
MTVDLEWPGSLVQSVEG

SEQ ID NO: 772719 - protein, 26 aa, Mycobacterium
MTVSVSFHEPVTWGGWLLYTHESTQV

SEQ ID NO: 772720 - protein, 26 aa, Mycobacterium
MTWPHGRLRYYIAMLVELSQLRPLPF

SEQ ID NO: 772721 - protein, 20 aa, Mycobacterium
MTYLQWLRRYVELAIGDGNS

SEQ ID NO: 772722 - protein, 20 aa, Mycobacterium
MTYLQWLRRYVELTIGEGNS

SEQ ID NO: 772723 - protein, 24 aa, Mycobacterium
MVARGCPFSGLLYAGLAITANGPA

SEQ ID NO: 772724 - protein, 17 aa, Mycobacterium
MVCQAWLGPRYQVTSQV

SEQ ID NO: 772725 - protein, 19 aa, Mycobacterium
MVDVLPLTPLQHGLLFHTG

SEQ ID NO: 772726 - protein, 19 aa, Mycobacterium
MVEMFRGGIDWVLNMYQER

SEQ ID NO: 772727 - protein, 18 aa, Mycobacterium
MVFVGGLLPVPGHSFVEH

SEQ ID NO: 772728 - protein, 17 aa, Mycobacterium
MVGAVSVPPTWEGSMPT

SEQ ID NO: 772729 - protein, 17 aa, Mycobacterium
MVIADGFFAFLTKEQII

SEQ ID NO: 772730 - protein, 17 aa, Mycobacterium
MVIRGGENIYPREIEEF

SEQ ID NO: 772731 - protein, 22 aa, Mycobacterium
MVKAGVQWGLFGGAVENLGTQR

SEQ ID NO: 772732 - protein, 22 aa, Mycobacterium
MVKKLSIRLGVPCFPDDPLHFT

SEQ ID NO: 772733 - protein, 22 aa, Mycobacterium
MVKKLSIRLGVPCFPDDPLRFT

SEQ ID NO: 772734 - protein, 23 aa, Mycobacterium
MVLAAKADTAWHLHRLTADINLD

SEQ ID NO: 772735 - protein, 17 aa, Mycobacterium
MVLAITGYVWRQGVGAV

SEQ ID NO: 772736 - protein, 18 aa, Mycobacterium
MVLLQSFIGRNGWHRRIV

SEQ ID NO: 772737 - protein, 20 aa, Mycobacterium
MVLRAMGIPAHYVSGYLHPK

SEQ ID NO: 772738 - protein, 18 aa, Mycobacterium
MVLRGMGIPSRYVSGYLH

SEQ ID NO: 772739 - protein, 17 aa, Mycobacterium
MVPYRGVNIAMMICYDV

SEQ ID NO: 772740 - protein, 19 aa, Mycobacterium
MVQGIAFADAERGPRVSRA

SEQ ID NO: 772741 - protein, 17 aa, Mycobacterium
MVRCVRTALPLLRKAQW

SEQ ID NO: 772742 - protein, 19 aa, Mycobacterium
MVRDFQRIIGLEARAQIQA

SEQ ID NO: 772743 - protein, 19 aa, Mycobacterium
MVRDFQRIIGLEARVQIQA

SEQ ID NO: 772744 - protein, 24 aa, Mycobacterium
MVSCDCCAAPICKRCANKPKVDLW

SEQ ID NO: 772745 - protein, 19 aa, Mycobacterium
MVSFLDFRKIPLVGMWAEM

SEQ ID NO: 772746 - protein, 17 aa, Mycobacterium
MVTEIFPGGRLPSIEKV

SEQ ID NO: 772747 - protein, 17 aa, Mycobacterium
MVTLASWCALRFGETVE

SEQ ID NO: 772748 - protein, 23 aa, Mycobacterium
MWAQDVAAMFGYRSGAESIAAAL

SEQ ID NO: 772749 - protein, 25 aa, Mycobacterium
MWDLSWRTPALLAERGFLYDSSLMD

SEQ ID NO: 772750 - protein, 22 aa, Mycobacterium
MWKTSECWRQWINVGDFPDHPW

SEQ ID NO: 772751 - protein, 17 aa, Mycobacterium
MWLYRLSLAKVKWHSLT

SEQ ID NO: 772752 - protein, 20 aa, Mycobacterium
MWPLDMLQEFLVGQRMAVPA

SEQ ID NO: 772753 - protein, 21 aa, Mycobacterium
MWVQLRAAGLLDHGVSVLALG

SEQ ID NO: 772754 - protein, 21 aa, Mycobacterium
MWWVPVWLLRALEVIVYGPDR

SEQ ID NO: 772755 - protein, 23 aa, Mycobacterium
MYESEIYRRLSLSVLVRLPAGID

SEQ ID NO: 772756 - protein, 23 aa, Mycobacterium
MYFCPGCGHAPHHVFKDWADRYR

SEQ ID NO: 772757 - protein, 17 aa, Mycobacterium
MYGWGLRINELCRLDLA

SEQ ID NO: 772758 - protein, 23 aa, Mycobacterium
MYTDGACQLAFWRDDGYLVCEAR

SEQ ID NO: 772759 - protein, 23 aa, Mycobacterium
MYTMAGEGFAHWLGLDDEDVLLT

SEQ ID NO: 772760 - protein, 23 aa, Mycobacterium
NAADEADLLWALRGGGANFGVVT

SEQ ID NO: 772761 - protein, 17 aa, Mycobacterium
NAAECLIVLTNRHGATA

SEQ ID NO: 772762 - protein, 22 aa, Mycobacterium
NAAFRKALRELTLVLVYEATRA

SEQ ID NO: 772763 - protein, 18 aa, Mycobacterium
NAALYWIALCQIKHGAPG

SEQ ID NO: 772764 - protein, 24 aa, Mycobacterium
NAAYLRWWACLERVVLEAGLRGVL

SEQ ID NO: 772765 - protein, 21 aa, Mycobacterium
NACNGRDGGLIWGNGGAGANG

SEQ ID NO: 772766 - protein, 17 aa, Mycobacterium
NADAAFDVLKWRSQENN

SEQ ID NO: 772767 - protein, 25 aa, Mycobacterium
NADEWLRERGFLPGAGGPGDFRVGF

SEQ ID NO: 772768 - protein, 19 aa, Mycobacterium
NADSIAGNGVWVFDAGVTR

SEQ ID NO: 772769 - protein, 17 aa, Mycobacterium
NAEELAGVLGLDADVLE

SEQ ID NO: 772770 - protein, 20 aa, Mycobacterium
NAELKHGCEFNWDSDGPEYS

SEQ ID NO: 772771 - protein, 20 aa, Mycobacterium
NAERIARWFLPITGDLRAGG

SEQ ID NO: 772772 - protein, 18 aa, Mycobacterium
NAETVFWNGPMGVFEFPA

SEQ ID NO: 772773 - protein, 19 aa, Mycobacterium
NAFHQQFWRSLSGAAASYS

SEQ ID NO: 772774 - protein, 18 aa, Mycobacterium
NAICPGFIATPLAEGVFG

SEQ ID NO: 772775 - protein, 17 aa, Mycobacterium
NAIKVLAVREVMRLLDG

SEQ ID NO: 772776 - protein, 20 aa, Mycobacterium
NAIRECLAWADGWLPGDAAL

SEQ ID NO: 772777 - protein, 20 aa, Mycobacterium
NAIWPDLFIVGGGISRKADK

SEQ ID NO: 772778 - protein, 18 aa, Mycobacterium
NALARLELRVALEEILKR

SEQ ID NO: 772779 - protein, 18 aa, Mycobacterium
NALATAWWMYWRMTKEAE

SEQ ID NO: 772780 - protein, 19 aa, Mycobacterium
NALCAAAVALECGADVDQV

SEQ ID NO: 772781 - protein, 19 aa, Mycobacterium
NALCAGAVALECGASVSQV

SEQ ID NO: 772782 - protein, 24 aa, Mycobacterium
NALDVIREFPIRAAIEEWQQVLIR

SEQ ID NO: 772783 - protein, 24 aa, Mycobacterium
NALKAVPAERLWVNPDCGLKTRKT

SEQ ID NO: 772784 - protein, 20 aa, Mycobacterium
NALKVAFDWKSRHNQARGID

SEQ ID NO: 772785 - protein, 18 aa, Mycobacterium
NALLDWAYGRQFRYTESM

SEQ ID NO: 772786 - protein, 17 aa, Mycobacterium
NALLDWAYGTRMRYREA

SEQ ID NO: 772787 - protein, 21 aa, Mycobacterium
NALLGRPLIGNGTDGLAGTGA

SEQ ID NO: 772788 - protein, 22 aa, Mycobacterium
NALRPQLLAARHTPEGYKTVQA

SEQ ID NO: 772789 - protein, 18 aa, Mycobacterium
NALRSWSVLRFEVTEDPS

SEQ ID NO: 772790 - protein, 24 aa, Mycobacterium
NALWRFLPDRVRVLDFPTNFHYDF

SEQ ID NO: 772791 - protein, 18 aa, Mycobacterium
NAMGRPGLTLGLGPSHEP

SEQ ID NO: 772792 - protein, 20 aa, Mycobacterium
NAMGRPGLTLGLGPSHEPIV

SEQ ID NO: 772793 - protein, 26 aa, Mycobacterium
NAPFLQFTGRPLVGPGTDGAPGTGQA

SEQ ID NO: 772794 - protein, 24 aa, Mycobacterium
NAPTQVLFGRGLIGDGANGTAPGQ

SEQ ID NO: 772795 - protein, 18 aa, Mycobacterium
NARFCYTRVTACGHDAEA

SEQ ID NO: 772796 - protein, 18 aa, Mycobacterium
NARGVPFIFVRTDSAGNI

SEQ ID NO: 772797 - protein, 19 aa, Mycobacterium
NARGVPFIFVRTDSAGNIS

SEQ ID NO: 772798 - protein, 17 aa, Mycobacterium
NARSGLRAAMDILGNIE

SEQ ID NO: 772799 - protein, 22 aa, Mycobacterium
NASAATEFVDWAAMNRQQTVAE

SEQ ID NO: 772800 - protein, 20 aa, Mycobacterium
NASPLEFLLDAVNAPTQTLF

SEQ ID NO: 772801 - protein, 17 aa, Mycobacterium
NATGWKIGWACGAPELI

SEQ ID NO: 772802 - protein, 22 aa, Mycobacterium
NAVELARAWKPATLRATSKTKS

SEQ ID NO: 772803 - protein, 20 aa, Mycobacterium
NAVGGWRGAPRPVLARELLP

SEQ ID NO: 772804 - protein, 17 aa, Mycobacterium
NAVIFCGHFPDGAEKFT

SEQ ID NO: 772805 - protein, 18 aa, Mycobacterium
NAVIFCGHFPDGAEKFTK

SEQ ID NO: 772806 - protein, 20 aa, Mycobacterium
NAVSRWLFRRVLTKFVGAKG

SEQ ID NO: 772807 - protein, 17 aa, Mycobacterium
NAYRFGTVGWPFPATEA

SEQ ID NO: 772808 - protein, 20 aa, Mycobacterium
NCAAFKRWGLYPRMGIAPEE

SEQ ID NO: 772809 - protein, 19 aa, Mycobacterium
NCGTPCPAFAGGSTVTAVA

SEQ ID NO: 772810 - protein, 18 aa, Mycobacterium
NCLVALAILDAVGVSPEQ

SEQ ID NO: 772811 - protein, 18 aa, Mycobacterium
NCNGRIPFDTALLSEVLS

SEQ ID NO: 772812 - protein, 19 aa, Mycobacterium
NCSGRIPFETALLPEVLAE

SEQ ID NO: 772813 - protein, 21 aa, Mycobacterium
NDALLRFACSWIAAEDGTPRT

SEQ ID NO: 772814 - protein, 22 aa, Mycobacterium
NDAMWLRFCAAIDLPDLASDPD

SEQ ID NO: 772815 - protein, 19 aa, Mycobacterium
NDFPPKLVGRMVLNRNVDN

SEQ ID NO: 772816 - protein, 17 aa, Mycobacterium
NDGALGWFGTSPVGTFP

SEQ ID NO: 772817 - protein, 18 aa, Mycobacterium
NDGALGWHGTSPVGTFPA

SEQ ID NO: 772818 - protein, 18 aa, Mycobacterium
NDGALGWKGTSPVGTFPP

SEQ ID NO: 772819 - protein, 18 aa, Mycobacterium
NDGALGWTGTSPVGTFPP

SEQ ID NO: 772820 - protein, 17 aa, Mycobacterium
NDGALGWVGTSPVGTFP

SEQ ID NO: 772821 - protein, 17 aa, Mycobacterium
NDIIEMVTDLTLGHDPA

SEQ ID NO: 772822 - protein, 20 aa, Mycobacterium
NDMYPRLVVAVVRAVGDAAM

SEQ ID NO: 772823 - protein, 19 aa, Mycobacterium
NDPARLAGWWAEQFGGATR

SEQ ID NO: 772824 - protein, 18 aa, Mycobacterium
NDTTLRWLAPGIRVVWGS

SEQ ID NO: 772825 - protein, 17 aa, Mycobacterium
NDWPMARLTLALSPATL

SEQ ID NO: 772826 - protein, 17 aa, Mycobacterium
NEAAFCYQLLVRSFGTN

SEQ ID NO: 772827 - protein, 17 aa, Mycobacterium
NEAAFCYQLLVRSLGTN

SEQ ID NO: 772828 - protein, 17 aa, Mycobacterium
NEAFAPVVMAWLKEIKA

SEQ ID NO: 772829 - protein, 21 aa, Mycobacterium
NEAWWFPAIQWPDGRMQFMLN

SEQ ID NO: 772830 - protein, 17 aa, Mycobacterium
NEDFPRLMVYRGPRRKG

SEQ ID NO: 772831 - protein, 24 aa, Mycobacterium
NEDNRWTVQLAWKVGRSDNLAHFC

SEQ ID NO: 772832 - protein, 20 aa, Mycobacterium
NEDSRWTVQLAWKAGLSDNV

SEQ ID NO: 772833 - protein, 24 aa, Mycobacterium
NEDSRWTVQLAWKAGRSDNIAHFC

SEQ ID NO: 772834 - protein, 21 aa, Mycobacterium
NEDWYQWQWRVHVGLWAAASA

SEQ ID NO: 772835 - protein, 17 aa, Mycobacterium
NEFQYFVEMWNRAAGVM

SEQ ID NO: 772836 - protein, 19 aa, Mycobacterium
NEGLCAIGLRFSEDKTAPR

SEQ ID NO: 772837 - protein, 21 aa, Mycobacterium
NEIKINWVWNPPWGPDKITED

SEQ ID NO: 772838 - protein, 18 aa, Mycobacterium
NELAQYWIRVNTIHPTGV

SEQ ID NO: 772839 - protein, 23 aa, Mycobacterium
NELDRVGGRYGLQTMCEGGGTAN

SEQ ID NO: 772840 - protein, 23 aa, Mycobacterium
NELERVGGRYGLQTMCEGGGTAN

SEQ ID NO: 772841 - protein, 19 aa, Mycobacterium
NELGHPWTVLRATESTDYL

SEQ ID NO: 772842 - protein, 18 aa, Mycobacterium
NELGHPWTVLRATESTKF

SEQ ID NO: 772843 - protein, 18 aa, Mycobacterium
NELGHPWTVLRATPETDF

SEQ ID NO: 772844 - protein, 19 aa, Mycobacterium
NELGHPWTVLRATRGTDYL

SEQ ID NO: 772845 - protein, 25 aa, Mycobacterium
NELGHPWTVLRATRRTDYLVLEMSA

SEQ ID NO: 772846 - protein, 20 aa, Mycobacterium
NELPLRITVIRTRADELVLL

SEQ ID NO: 772847 - protein, 22 aa, Mycobacterium
NELRQRIGMVFQHFNLFPHLSV

SEQ ID NO: 772848 - protein, 23 aa, Mycobacterium
NEPICPPCGSFIRSNAGDIDTAV

SEQ ID NO: 772849 - protein, 23 aa, Mycobacterium
NEPICPPCGTFIRSNGADIDAAV

SEQ ID NO: 772850 - protein, 22 aa, Mycobacterium
NERLYCIPATIDLAGAEIELVS

SEQ ID NO: 772851 - protein, 23 aa, Mycobacterium
NERRTNWLNAFYFGGDHGVEGSV

SEQ ID NO: 772852 - protein, 21 aa, Mycobacterium
NERRWRTGLSLAEGAPVEDIH

SEQ ID NO: 772853 - protein, 20 aa, Mycobacterium
NERSEFRFGQVMTGLTTNAD

SEQ ID NO: 772854 - protein, 23 aa, Mycobacterium
NEVCARTALEIGFNRATGFARRL

SEQ ID NO: 772855 - protein, 21 aa, Mycobacterium
NEVMRSLGLPTMFPTIGGHEG

SEQ ID NO: 772856 - protein, 20 aa, Mycobacterium
NEWGWTWPLNRRVLYNRASA

SEQ ID NO: 772857 - protein, 23 aa, Mycobacterium
NFARRLPMLRGWVADLLDRDARD

SEQ ID NO: 772858 - protein, 19 aa, Mycobacterium
NFEGGPLLRFMSGNLSQQI

SEQ ID NO: 772859 - protein, 17 aa, Mycobacterium
NFELRQGHTLGIVGESG

SEQ ID NO: 772860 - protein, 19 aa, Mycobacterium
NFFPMGAWAKRTGAIFIRR

SEQ ID NO: 772861 - protein, 28 aa, Mycobacterium
NFFPMGAWAKRTGAIFIRRQTKDIPVYR

SEQ ID NO: 772862 - protein, 20 aa, Mycobacterium
NFTGRSWPLADVRLLAPILA

SEQ ID NO: 772863 - protein, 24 aa, Mycobacterium
NFTNVCYTGCRFCAFAQRKGDADA

SEQ ID NO: 772864 - protein, 25 aa, Mycobacterium
NFVFGEMWLRPGLGMKERRLITLAC

SEQ ID NO: 772865 - protein, 25 aa, Mycobacterium
NFVFGEMWLRPGLGMKERRLITVAC

SEQ ID NO: 772866 - protein, 18 aa, Mycobacterium
NFVSDLNAIMGIYYVHTQ

SEQ ID NO: 772867 - protein, 24 aa, Mycobacterium
NGAALRPVHDWVAAFERAWNERLD

SEQ ID NO: 772868 - protein, 25 aa, Mycobacterium
NGAEGAIGAQFVPASSLPTPSGGAG

SEQ ID NO: 772869 - protein, 17 aa, Mycobacterium
NGAGLVCGGVHTANATV

SEQ ID NO: 772870 - protein, 24 aa, Mycobacterium
NGDGKGFVDYVLWGEDGLPLAIVE

SEQ ID NO: 772871 - protein, 24 aa, Mycobacterium
NGDRALCIKAMIEKVVDRMYAEID

SEQ ID NO: 772872 - protein, 24 aa, Mycobacterium
NGDSAPPGWGWVAPYIGMIWPNGD

SEQ ID NO: 772873 - protein, 18 aa, Mycobacterium
NGDTYRVLFGVATTQGVN

SEQ ID NO: 772874 - protein, 18 aa, Mycobacterium
NGFFYKEMPPFCLATEAH

SEQ ID NO: 772875 - protein, 18 aa, Mycobacterium
NGFLWRGDNQGLIFGEPG

SEQ ID NO: 772876 - protein, 18 aa, Mycobacterium
NGFRDIICPPLFLQYAVL

SEQ ID NO: 772877 - protein, 19 aa, Mycobacterium
NGGAAGWWGTGGAGGAGGE

SEQ ID NO: 772878 - protein, 25 aa, Mycobacterium
NGGAGGSAGLWGRGGNGGAGGTGVA

SEQ ID NO: 772879 - protein, 22 aa, Mycobacterium
NGGAGGSAWLIGDGGNGGNGGI

SEQ ID NO: 772880 - protein, 19 aa, Mycobacterium
NGGAGGWIYGHGGDGGIGG

SEQ ID NO: 772881 - protein, 24 aa, Mycobacterium
NGGDGGAGGWLFGDAGAGGQGGTG

SEQ ID NO: 772882 - protein, 19 aa, Mycobacterium
NGGDGGWLLGDGGIGGSGT

SEQ ID NO: 772883 - protein, 18 aa, Mycobacterium
NGGFLERFHGLYIPILDL

SEQ ID NO: 772884 - protein, 26 aa, Mycobacterium
NGGKRLRPAFAYWGWRAVATGEPDSE

SEQ ID NO: 772885 - protein, 18 aa, Mycobacterium
NGGNANWFGSGGAGGQGG

SEQ ID NO: 772886 - protein, 25 aa, Mycobacterium
NGGNGGRLLGLGGAGGDAGNGGVGG

SEQ ID NO: 772887 - protein, 19 aa, Mycobacterium
NGGNGGWLIGSGGAGGVSG

SEQ ID NO: 772888 - protein, 23 aa, Mycobacterium
NGGNGGWLYGLGGQGGMGGNGSS

SEQ ID NO: 772889 - protein, 21 aa, Mycobacterium
NGGSGGLLFGGGGIGGTGGTG

SEQ ID NO: 772890 - protein, 23 aa, Mycobacterium
NGGSWAHRLLDVFDRVYRKRPYD

SEQ ID NO: 772891 - protein, 17 aa, Mycobacterium
NGGVRFSGNAGAGGAGG

SEQ ID NO: 772892 - protein, 24 aa, Mycobacterium
NGGWPFYHMEMMLAGIPIPVPPGE

SEQ ID NO: 772893 - protein, 24 aa, Mycobacterium
NGHKFRAAIHFDDLQWERGYSRVG

SEQ ID NO: 772894 - protein, 23 aa, Mycobacterium
NGIGGDGGDAFLIGNGGNGGAGA

SEQ ID NO: 772895 - protein, 20 aa, Mycobacterium
NGILHPLERITAIAPNPLTG

SEQ ID NO: 772896 - protein, 24 aa, Mycobacterium
NGKPEFVENFFLFIAEEVRELMAE

SEQ ID NO: 772897 - protein, 22 aa, Mycobacterium
NGLDFVRAWLGLILCGAVTVSI

SEQ ID NO: 772898 - protein, 28 aa, Mycobacterium
NGLFWQDDYRLLGIDLKINFGGTSGDYA

SEQ ID NO: 772899 - protein, 21 aa, Mycobacterium
NGLLWRGDYQGNLGAFNYTVT

SEQ ID NO: 772900 - protein, 23 aa, Mycobacterium
NGLNCMSVRWGLWQGTTIAGADD

SEQ ID NO: 772901 - protein, 33 aa, Mycobacterium
NGLRPELWGEFTARFGIKRVCEFYSASESNTAF

SEQ ID NO: 772902 - protein, 21 aa, Mycobacterium
NGMAVSWPRGITCAGEQRSQF

SEQ ID NO: 772903 - protein, 25 aa, Mycobacterium
NGNWTWRYDAIRSFPDFASLWDDVD

SEQ ID NO: 772904 - protein, 22 aa, Mycobacterium
NGPDGRSALFAFTSNAEIARVH

SEQ ID NO: 772905 - protein, 18 aa, Mycobacterium
NGPLALAVGRRLRERYGL

SEQ ID NO: 772906 - protein, 20 aa, Mycobacterium
NGPQALSFVRQRHGLPRGDL

SEQ ID NO: 772907 - protein, 23 aa, Mycobacterium
NGPRFALAGSYALWAYGAPEPTH

SEQ ID NO: 772908 - protein, 26 aa, Mycobacterium
NGPTQAWLGRPLIGNGTDGAAGTGQA

SEQ ID NO: 772909 - protein, 17 aa, Mycobacterium
NGQGVGSLFSWTGDPAV

SEQ ID NO: 772910 - protein, 20 aa, Mycobacterium
NGRFAVNVVSGWFKDEFIHL

SEQ ID NO: 772911 - protein, 24 aa, Mycobacterium
NGRFVFGVGAGWNLEEMRNHGTDP

SEQ ID NO: 772912 - protein, 19 aa, Mycobacterium
NGRIGRLLIVLQFMIDDLL

SEQ ID NO: 772913 - protein, 26 aa, Mycobacterium
NGRWQLSWRLPWIFTCQVHSCLLVDV

SEQ ID NO: 772914 - protein, 20 aa, Mycobacterium
NGRWYWHWDPAFLTKPSEDP

SEQ ID NO: 772915 - protein, 24 aa, Mycobacterium
NGTFTSGFGYRWGALHGGIDIANS

SEQ ID NO: 772916 - protein, 21 aa, Mycobacterium
NGTQMPLMWTQLIPATLEGKA

SEQ ID NO: 772917 - protein, 20 aa, Mycobacterium
NGVHSWGYWDAQLSAMKPDM

SEQ ID NO: 772918 - protein, 20 aa, Mycobacterium
NGVRRWLALDGQPLHRVTVA

SEQ ID NO: 772919 - protein, 17 aa, Mycobacterium
NGVWQFRGPTVIPSGLA

SEQ ID NO: 772920 - protein, 17 aa, Mycobacterium
NGWAMPLPEELRDDLKS

SEQ ID NO: 772921 - protein, 17 aa, Mycobacterium
NGYAIRFFMPEKWTMET

SEQ ID NO: 772922 - protein, 23 aa, Mycobacterium
NGYLGRFLCLEWLERLAETGGRL

SEQ ID NO: 772923 - protein, 23 aa, Mycobacterium
NHCFHVFGAYPWTRFLGRGMDEH

SEQ ID NO: 772924 - protein, 20 aa, Mycobacterium
NHFLAVAIDYLFAHRPEWAA

SEQ ID NO: 772925 - protein, 17 aa, Mycobacterium
NHGLTLWDLDRVFKVDG

SEQ ID NO: 772926 - protein, 17 aa, Mycobacterium
NHGLTLWDLDRVFKVNG

SEQ ID NO: 772927 - protein, 17 aa, Mycobacterium
NHSFKFVLLESLNADVL

SEQ ID NO: 772928 - protein, 22 aa, Mycobacterium
NHTQLPLGFMVEWEATGATVEA

SEQ ID NO: 772929 - protein, 24 aa, Mycobacterium
NHVADRPKLAWFLLQAVRYTPHQL

SEQ ID NO: 772930 - protein, 19 aa, Mycobacterium
NHYLAVAIDYLFSHRGGWA

SEQ ID NO: 772931 - protein, 17 aa, Mycobacterium
NIAKLLGKRARVIGTTL

SEQ ID NO: 772932 - protein, 19 aa, Mycobacterium
NIAPWLRAAHRYGAKVKWA

SEQ ID NO: 772933 - protein, 18 aa, Mycobacterium
NIAPYFKRIEAVEGATES

SEQ ID NO: 772934 - protein, 18 aa, Mycobacterium
NICGRPRITAEINDGKPA

SEQ ID NO: 772935 - protein, 19 aa, Mycobacterium
NIGKLLAKRARVIGTTLRG

SEQ ID NO: 772936 - protein, 18 aa, Mycobacterium
NIGWRIVPIIPDEARTFG

SEQ ID NO: 772937 - protein, 18 aa, Mycobacterium
NIKCLCRFHHLIKTFWAG

SEQ ID NO: 772938 - protein, 17 aa, Mycobacterium
NILPVTFGIPFGFSVVA

SEQ ID NO: 772939 - protein, 22 aa, Mycobacterium
NILWLLKQAFYFSLTSVNEAVS

SEQ ID NO: 772940 - protein, 33 aa, Mycobacterium
NINGWKPVKDVIYSAASALAWPSLSQQTVGSRF

SEQ ID NO: 772941 - protein, 17 aa, Mycobacterium
NIPAWLIFDQQYRDRYI

SEQ ID NO: 772942 - protein, 23 aa, Mycobacterium
NIRSIPTLMAFKQGQLVFNQAGA

SEQ ID NO: 772943 - protein, 20 aa, Mycobacterium
NISHEFRTPLTLIIGPVAEL

SEQ ID NO: 772944 - protein, 19 aa, Mycobacterium
NISHEFRTPLTLILDPVSE

SEQ ID NO: 772945 - protein, 17 aa, Mycobacterium
NITAYWKGYSEYHRDGV

SEQ ID NO: 772946 - protein, 17 aa, Mycobacterium
NITAYWKGYTEYHHDGV

SEQ ID NO: 772947 - protein, 17 aa, Mycobacterium
NITAYWKGYTEYHHEGL

SEQ ID NO: 772948 - protein, 18 aa, Mycobacterium
NIVCPWHGWRWRGDGTNA

SEQ ID NO: 772949 - protein, 17 aa, Mycobacterium
NIYRVVTNLGVFDFNGP

SEQ ID NO: 772950 - protein, 23 aa, Mycobacterium
NIYYRRALMLAACFGRHTTYPQR

SEQ ID NO: 772951 - protein, 25 aa, Mycobacterium
NKAIARFIVRFNDAFRKYGTSDNVL

SEQ ID NO: 772952 - protein, 20 aa, Mycobacterium
NKALRPGYVAAFSVPANQLP

SEQ ID NO: 772953 - protein, 23 aa, Mycobacterium
NKKGGAGWVEWGGCGMVNPNVLR

SEQ ID NO: 772954 - protein, 18 aa, Mycobacterium
NKLSCPIYTFIGSKDWIA

SEQ ID NO: 772955 - protein, 17 aa, Mycobacterium
NKRVCVRIVARRARSWD

SEQ ID NO: 772956 - protein, 19 aa, Mycobacterium
NKTRLAALRVKDFGKRDVM

SEQ ID NO: 772957 - protein, 23 aa, Mycobacterium
NKVMRRLVGMLARRGYHQSMALD

SEQ ID NO: 772958 - protein, 24 aa, Mycobacterium
NKVPGARCALAWSEQTASLAREHN

SEQ ID NO: 772959 - protein, 23 aa, Mycobacterium
NLAREFMELFALGHGNGYTEDDV

SEQ ID NO: 772960 - protein, 25 aa, Mycobacterium
NLASIPGALRWTWDTMKPLYANGAV

SEQ ID NO: 772961 - protein, 17 aa, Mycobacterium
NLAVKWAGKGIRVNAVA

SEQ ID NO: 772962 - protein, 17 aa, Mycobacterium
NLAVKWAPMGIRVNAVA

SEQ ID NO: 772963 - protein, 21 aa, Mycobacterium
NLAYRPPLYRVRTHDGLALCG

SEQ ID NO: 772964 - protein, 21 aa, Mycobacterium
NLDPAVLLAGWPVVESEVRRI

SEQ ID NO: 772965 - protein, 17 aa, Mycobacterium
NLDSCFVVTSAVLPRMK

SEQ ID NO: 772966 - protein, 17 aa, Mycobacterium
NLFTVFGPYGYVGSSYF

SEQ ID NO: 772967 - protein, 19 aa, Mycobacterium
NLGGLICWENWMPQARHAL

SEQ ID NO: 772968 - protein, 18 aa, Mycobacterium
NLGKLLTKRARVIGTTLR

SEQ ID NO: 772969 - protein, 21 aa, Mycobacterium
NLGLPELLGLNALGAPVNAAM

SEQ ID NO: 772970 - protein, 18 aa, Mycobacterium
NLGPKVRRLHYLSVPPKA

SEQ ID NO: 772971 - protein, 17 aa, Mycobacterium
NLHGWPFLLEARKNNGA

SEQ ID NO: 772972 - protein, 23 aa, Mycobacterium
NLIWQCPVVLLADVRSVGVQGDN

SEQ ID NO: 772973 - protein, 18 aa, Mycobacterium
NLLCGNIGSPVLDVLDQP

SEQ ID NO: 772974 - protein, 23 aa, Mycobacterium
NLLRLKAFFARQWRQMPAAHFMA

SEQ ID NO: 772975 - protein, 20 aa, Mycobacterium
NLNMAIPWTAAERGFIDAVI

SEQ ID NO: 772976 - protein, 20 aa, Mycobacterium
NLNMAIPWTAAERGFIDAVV

SEQ ID NO: 772977 - protein, 19 aa, Mycobacterium
NLNPVWRVGFQVREALRAN

SEQ ID NO: 772978 - protein, 23 aa, Mycobacterium
NLPLRPESVFAFGTIAELAAEYG

SEQ ID NO: 772979 - protein, 18 aa, Mycobacterium
NLPPLPGRCGPASRLHRR

SEQ ID NO: 772980 - protein, 17 aa, Mycobacterium
NLQAVGVPGGWLYALGD

SEQ ID NO: 772981 - protein, 26 aa, Mycobacterium
NLRHKGGRWYWHWDPRFIDGTAPHPP

SEQ ID NO: 772982 - protein, 18 aa, Mycobacterium
NLRLWNFYGQTEMAPLAS

SEQ ID NO: 772983 - protein, 19 aa, Mycobacterium
NLSIRLGVPCFPDDPLRFT

SEQ ID NO: 772984 - protein, 17 aa, Mycobacterium
NLVEYGFRLPSACDNRP

SEQ ID NO: 772985 - protein, 20 aa, Mycobacterium
NLVLASRGTPLWATATNGQQ

SEQ ID NO: 772986 - protein, 19 aa, Mycobacterium
NLYLAFGMLSWHLNDRELR

SEQ ID NO: 772987 - protein, 23 aa, Mycobacterium
NLYVYFWRWGTWKVFDANADQPN

SEQ ID NO: 772988 - protein, 22 aa, Mycobacterium
NMFALGLLSWMYGRELEASEAF

SEQ ID NO: 772989 - protein, 22 aa, Mycobacterium
NMFALGLLSWMYGRELEHSEAF

SEQ ID NO: 772990 - protein, 22 aa, Mycobacterium
NMFALGLLSWMYGRPIETSEKF

SEQ ID NO: 772991 - protein, 23 aa, Mycobacterium
NMFALGLLSWMYGRPIETSEKFI

SEQ ID NO: 772992 - protein, 23 aa, Mycobacterium
NMFALGLLSWMYGRPIRTSENFI

SEQ ID NO: 772993 - protein, 17 aa, Mycobacterium
NMFSITGPYGFVLGSYL

SEQ ID NO: 772994 - protein, 20 aa, Mycobacterium
NMILELLDAFGIPTAGAAGF

SEQ ID NO: 772995 - protein, 20 aa, Mycobacterium
NMPEIWKRLDAVGLQTTEAC

SEQ ID NO: 772996 - protein, 21 aa, Mycobacterium
NMPGYRGWQWAVVVAAYPGAD

SEQ ID NO: 772997 - protein, 21 aa, Mycobacterium
NNAEIRWRLDVWNASAQVVGD

SEQ ID NO: 772998 - protein, 17 aa, Mycobacterium
NNARWCSMAICGNRMKA

SEQ ID NO: 772999 - protein, 18 aa, Mycobacterium
NNAVRFAFWTAEEDGLAG

SEQ ID NO: 773000 - protein, 19 aa, Mycobacterium
NNEFIRRWLADLVAETGSG

SEQ ID NO: 773001 - protein, 25 aa, Mycobacterium
NNELGHPWTVLRAGRDTDYLILEMS

SEQ ID NO: 773002 - protein, 21 aa, Mycobacterium
NNELGHPWTVLRATRDTDFLV

SEQ ID NO: 773003 - protein, 17 aa, Mycobacterium
NNFEGWTALASWGEITT

SEQ ID NO: 773004 - protein, 18 aa, Mycobacterium
NNHLAFGFGTHFCLGNQL

SEQ ID NO: 773005 - protein, 21 aa, Mycobacterium
NNIEFLRFLLADERVQAGDLD

SEQ ID NO: 773006 - protein, 24 aa, Mycobacterium
NNPFGGPVGRIFAAAGFRRSRKNP

SEQ ID NO: 773007 - protein, 25 aa, Mycobacterium
NNRGRLSIDVLQRWGTDLLTALVAL

SEQ ID NO: 773008 - protein, 20 aa, Mycobacterium
NNTEVRWKLSLRVTPDAEPP

SEQ ID NO: 773009 - protein, 18 aa, Mycobacterium
NNVMELWSLLSITAPGLF

SEQ ID NO: 773010 - protein, 22 aa, Mycobacterium
NNWPSVFGGPAWTRVTEADGTP

SEQ ID NO: 773011 - protein, 19 aa, Mycobacterium
NPAGTEWQAAAVARATSAV

SEQ ID NO: 773012 - protein, 26 aa, Mycobacterium
NPALPIMTTTMLFFVRDMCSQSFCVR

SEQ ID NO: 773013 - protein, 18 aa, Mycobacterium
NPAVRVRVGGTWRNGTAH

SEQ ID NO: 773014 - protein, 23 aa, Mycobacterium
NPCGVCESCTALAPNAPGSIDVV

SEQ ID NO: 773015 - protein, 23 aa, Mycobacterium
NPDYGLRLSWDFLARSTAGLWEW

SEQ ID NO: 773016 - protein, 19 aa, Mycobacterium
NPEAWRWYREVIGAGRTPV

SEQ ID NO: 773017 - protein, 19 aa, Mycobacterium
NPEAWRWYREVIGGNRTPI

SEQ ID NO: 773018 - protein, 23 aa, Mycobacterium
NPEAWRWYRMAFGKDKTPIVDTW

SEQ ID NO: 773019 - protein, 19 aa, Mycobacterium
NPEIKGCWILARYNDGRPS

SEQ ID NO: 773020 - protein, 21 aa, Mycobacterium
NPEIRPAHLLMALLTQNDGIA

SEQ ID NO: 773021 - protein, 21 aa, Mycobacterium
NPEIRPAHLLVALLGQTDGIA

SEQ ID NO: 773022 - protein, 25 aa, Mycobacterium
NPERVWGWYLWRHYLVADVQPNTGH

SEQ ID NO: 773023 - protein, 25 aa, Mycobacterium
NPERVWGWYLWRHYLVATVEPNEGH

SEQ ID NO: 773024 - protein, 24 aa, Mycobacterium
NPEVIRFLAYTGLRWGEMAALRVC

SEQ ID NO: 773025 - protein, 19 aa, Mycobacterium
NPINIRWSPPEIAYALRDS

SEQ ID NO: 773026 - protein, 17 aa, Mycobacterium
NPKMKRFIFTDRNGIYI

SEQ ID NO: 773027 - protein, 21 aa, Mycobacterium
NPLPLLGIPVRLAQGGTTLYQ

SEQ ID NO: 773028 - protein, 20 aa, Mycobacterium
NPLRFLRAGLKWCRKAAELG

SEQ ID NO: 773029 - protein, 17 aa, Mycobacterium
NPLRFVSAAVKWCRKAE

SEQ ID NO: 773030 - protein, 18 aa, Mycobacterium
NPMARRRLEWQIEQSEDS

SEQ ID NO: 773031 - protein, 25 aa, Mycobacterium
NPMIGFRGCYRYVKEPELFALELEA

SEQ ID NO: 773032 - protein, 23 aa, Mycobacterium
NPNGGLLSRFVGLNVPSLGLDFY

SEQ ID NO: 773033 - protein, 24 aa, Mycobacterium
NPPDRPWNLPAWVNSLFGAAYYHN

SEQ ID NO: 773034 - protein, 20 aa, Mycobacterium
NPRITALMCTADVLALSAMD

SEQ ID NO: 773035 - protein, 23 aa, Mycobacterium
NPRRLAVTCVFRLHDGVNRAALE

SEQ ID NO: 773036 - protein, 24 aa, Mycobacterium
NPRTRSGIMALELLDATPDWDRFR

SEQ ID NO: 773037 - protein, 23 aa, Mycobacterium
NPRTRSGIMALELLDTTPDWDKF

SEQ ID NO: 773038 - protein, 23 aa, Mycobacterium
NPRTRSGIMALELLDTTPDWERF

SEQ ID NO: 773039 - protein, 23 aa, Mycobacterium
NPRTRSGIMALELLDTTPDWQQF

SEQ ID NO: 773040 - protein, 21 aa, Mycobacterium
NPRWCQLCFEKAPGGGVTLPI

SEQ ID NO: 773041 - protein, 19 aa, Mycobacterium
NPVKLRLGIGYVIQNAGLM

SEQ ID NO: 773042 - protein, 17 aa, Mycobacterium
NPVLEWITGTALVPVRE

SEQ ID NO: 773043 - protein, 21 aa, Mycobacterium
NPYQLSWWINRFTEIFQTIAR

SEQ ID NO: 773044 - protein, 18 aa, Mycobacterium
NPYRWGAGLIGRLMPTAV

SEQ ID NO: 773045 - protein, 17 aa, Mycobacterium
NQGAFGFSEPCADCRGT

SEQ ID NO: 773046 - protein, 18 aa, Mycobacterium
NQGDAVGGVGGRGGAGFA

SEQ ID NO: 773047 - protein, 23 aa, Mycobacterium
NQIWQCPVVLLADVRSVGVQGDG

SEQ ID NO: 773048 - protein, 23 aa, Mycobacterium
NQIWQCPVVLLADVRSVGVQGDN

SEQ ID NO: 773049 - protein, 23 aa, Mycobacterium
NQLRRMLADFGIDIDRYGLDDEI

SEQ ID NO: 773050 - protein, 17 aa, Mycobacterium
NQLVVWWLLDPPTGARS

SEQ ID NO: 773051 - protein, 22 aa, Mycobacterium
NQLWMCGLPGYGPGDLIDFEFS

SEQ ID NO: 773052 - protein, 24 aa, Mycobacterium
NQLWMCGLPGYYPGDLIDFEFSGD

SEQ ID NO: 773053 - protein, 24 aa, Mycobacterium
NQLWMCGLPGYYPGDLIDFQFAGD

SEQ ID NO: 773054 - protein, 17 aa, Mycobacterium
NQPAAAITAGMAMVPED

SEQ ID NO: 773055 - protein, 18 aa, Mycobacterium
NQQFALLFVDWLNADADV

SEQ ID NO: 773056 - protein, 18 aa, Mycobacterium
NQQFALLFVDWLRANPGA

SEQ ID NO: 773057 - protein, 23 aa, Mycobacterium
NQVKRLKVGTARRFSRTTEKSLV

SEQ ID NO: 773058 - protein, 17 aa, Mycobacterium
NRAAGRVKLSWFLLHAA

SEQ ID NO: 773059 - protein, 19 aa, Mycobacterium
NRAKLNWWESRALYGWTVL

SEQ ID NO: 773060 - protein, 30 aa, Mycobacterium
NRAKLNWWESRALYGWTVLVPRTKDQAGEM

SEQ ID NO: 773061 - protein, 24 aa, Mycobacterium
NRALRFDRAVTFGMRLDIPSGTAV

SEQ ID NO: 773062 - protein, 22 aa, Mycobacterium
NRARLAILVATNFFGQNTPAIA

SEQ ID NO: 773063 - protein, 25 aa, Mycobacterium
NREVRWRPEHFWKSGTAIDVAVNTY

SEQ ID NO: 773064 - protein, 17 aa, Mycobacterium
NRFTEIFQTIARDLEEF

SEQ ID NO: 773065 - protein, 20 aa, Mycobacterium
NRGSNNFGFGNTNSGNVGFG

SEQ ID NO: 773066 - protein, 20 aa, Mycobacterium
NRGVGAWGEILGDTTVAAAM

SEQ ID NO: 773067 - protein, 21 aa, Mycobacterium
NRHGWRAEHCDHFVIHQTSKA

SEQ ID NO: 773068 - protein, 23 aa, Mycobacterium
NRHRELHNAIALNSSYPSPGSAA

SEQ ID NO: 773069 - protein, 17 aa, Mycobacterium
NRIDLISGIGRFADEHT

SEQ ID NO: 773070 - protein, 17 aa, Mycobacterium
NRIKLLLVDDAQHLDPQ

SEQ ID NO: 773071 - protein, 17 aa, Mycobacterium
NRIRLLALIATNFFGQN

SEQ ID NO: 773072 - protein, 20 aa, Mycobacterium
NRISGGLAVRFARPGETVVT

SEQ ID NO: 773073 - protein, 20 aa, Mycobacterium
NRKSLTFALRFRAPDRTLTE

SEQ ID NO: 773074 - protein, 25 aa, Mycobacterium
NRKSRFPHRWWWVVLTEEPFPRFSV

SEQ ID NO: 773075 - protein, 22 aa, Mycobacterium
NRKVLPGYILVRMDLTDDSWAA

SEQ ID NO: 773076 - protein, 18 aa, Mycobacterium
NRLARWFIGQGFGPEDII

SEQ ID NO: 773077 - protein, 21 aa, Mycobacterium
NRLLPCLPTLLALSASSPFWA

SEQ ID NO: 773078 - protein, 19 aa, Mycobacterium
NRLRCYVVGVSRGAREPLI

SEQ ID NO: 773079 - protein, 18 aa, Mycobacterium
NRLRCYVVGVSRGSREPL

SEQ ID NO: 773080 - protein, 18 aa, Mycobacterium
NRLRPGVLRGECADPPKT

SEQ ID NO: 773081 - protein, 17 aa, Mycobacterium
NRLRPGVVRGEHTHHPT

SEQ ID NO: 773082 - protein, 21 aa, Mycobacterium
NRLYRGRCDLVVLSVALNLLD

SEQ ID NO: 773083 - protein, 20 aa, Mycobacterium
NRLYWMSAWIDPDGTNGGPI

SEQ ID NO: 773084 - protein, 17 aa, Mycobacterium
NRMFQLLGESDCTEQES

SEQ ID NO: 773085 - protein, 20 aa, Mycobacterium
NRPALEVLLLGGKPIREPVF

SEQ ID NO: 773086 - protein, 17 aa, Mycobacterium
NRPDLVGALVLFAGLQP

SEQ ID NO: 773087 - protein, 21 aa, Mycobacterium
NRPEFLDYFAAHHVQVPLRRG

SEQ ID NO: 773088 - protein, 20 aa, Mycobacterium
NRPGACLHLGLHLPAQAVGV

SEQ ID NO: 773089 - protein, 19 aa, Mycobacterium
NRPGDCLVKLGGAGDILAA

SEQ ID NO: 773090 - protein, 19 aa, Mycobacterium
NRPKIGWRRLEAQAVMSRL

SEQ ID NO: 773091 - protein, 23 aa, Mycobacterium
NRPKLPRLINMYGITETTVHASF

SEQ ID NO: 773092 - protein, 17 aa, Mycobacterium
NRPLLRPYLRGCLLESV

SEQ ID NO: 773093 - protein, 21 aa, Mycobacterium
NRPLRGCYRIALLSLKGGVGK

SEQ ID NO: 773094 - protein, 22 aa, Mycobacterium
NRPMRGCYRIALVSLKGGVGKT

SEQ ID NO: 773095 - protein, 17 aa, Mycobacterium
NRPNRRIVIMPTDDAAK

SEQ ID NO: 773096 - protein, 17 aa, Mycobacterium
NRPRWKIDELVEAKAGR

SEQ ID NO: 773097 - protein, 24 aa, Mycobacterium
NRRSRFPHRWWWVTLTDEAFPRLS

SEQ ID NO: 773098 - protein, 18 aa, Mycobacterium
NRSEYRPLDGFVYAITPF

SEQ ID NO: 773099 - protein, 19 aa, Mycobacterium
NRTMLSWLVATNALGQNIT

SEQ ID NO: 773100 - protein, 19 aa, Mycobacterium
NRTPIEWDGYTPPVPAMGA

SEQ ID NO: 773101 - protein, 19 aa, Mycobacterium
NRTPIEWDGYTPPVPAQGL

SEQ ID NO: 773102 - protein, 19 aa, Mycobacterium
NRTPIEWDGYTPPVPAQGV

SEQ ID NO: 773103 - protein, 21 aa, Mycobacterium
NRTVEVWGRLDVAFNNGATIQ

SEQ ID NO: 773104 - protein, 19 aa, Mycobacterium
NRVADAWIKAQAYRLQTFG

SEQ ID NO: 773105 - protein, 19 aa, Mycobacterium
NRVSYFFDLRGPSVTIDTA

SEQ ID NO: 773106 - protein, 19 aa, Mycobacterium
NRVVADLGATGWRLDDGEL

SEQ ID NO: 773107 - protein, 17 aa, Mycobacterium
NRYPRQWMTGTASSAVG

SEQ ID NO: 773108 - protein, 19 aa, Mycobacterium
NRYPRVCGMTGTALAAGEQ

SEQ ID NO: 773109 - protein, 23 aa, Mycobacterium
NSAALARTTGLLAAAEDEVSTAI

SEQ ID NO: 773110 - protein, 19 aa, Mycobacterium
NSCPLPDLLTYVGESAGLG

SEQ ID NO: 773111 - protein, 22 aa, Mycobacterium
NSDVAQAFHWVRHALRRPLAPG

SEQ ID NO: 773112 - protein, 22 aa, Mycobacterium
NSEAPCIGRWAALHAGLPISVP

SEQ ID NO: 773113 - protein, 22 aa, Mycobacterium
NSFRCPYHGWTFGNTGALQGVP

SEQ ID NO: 773114 - protein, 18 aa, Mycobacterium
NSIPWRLPEDLARFKEMT

SEQ ID NO: 773115 - protein, 24 aa, Mycobacterium
NSLITSWRALGWIGPAASEISETS

SEQ ID NO: 773116 - protein, 17 aa, Mycobacterium
NSMLYKRFRVRSQVWMF

SEQ ID NO: 773117 - protein, 18 aa, Mycobacterium
NSSYAYLLWCTDFPSTSA

SEQ ID NO: 773118 - protein, 17 aa, Mycobacterium
NSVEVISAVTNYLKSSQ

SEQ ID NO: 773119 - protein, 17 aa, Mycobacterium
NSVGLHWTSVGTGDFYT

SEQ ID NO: 773120 - protein, 17 aa, Mycobacterium
NTEVVVWTPRRATGRPL

SEQ ID NO: 773121 - protein, 23 aa, Mycobacterium
NTKELRPLIGVALQEVALDLWMS

SEQ ID NO: 773122 - protein, 20 aa, Mycobacterium
NTKSYCRLHHLIKTFRPGWT

SEQ ID NO: 773123 - protein, 17 aa, Mycobacterium
NTLRRWLREQNITNTAA

SEQ ID NO: 773124 - protein, 18 aa, Mycobacterium
NTMETWKRLCDPVAEQVS

SEQ ID NO: 773125 - protein, 29 aa, Mycobacterium
NTPGYSGVMGRLWLARGGTYVLANIRGGG

SEQ ID NO: 773126 - protein, 17 aa, Mycobacterium
NTRALDLLTRWGDALAA

SEQ ID NO: 773127 - protein, 22 aa, Mycobacterium
NTSYRLPLMRKLMFTENEDTDT

SEQ ID NO: 773128 - protein, 18 aa, Mycobacterium
NTVSLGWSSWAIQWLSRI

SEQ ID NO: 773129 - protein, 25 aa, Mycobacterium
NVAFRLSGIAGRAGRAPVMVTDVVH

SEQ ID NO: 773130 - protein, 18 aa, Mycobacterium
NVAISRAKFQAVIVRSPA

SEQ ID NO: 773131 - protein, 25 aa, Mycobacterium
NVATRLWPFWALCRIVYVVDEPNRR

SEQ ID NO: 773132 - protein, 19 aa, Mycobacterium
NVDLVYRFIRDTTWVSVRW

SEQ ID NO: 773133 - protein, 18 aa, Mycobacterium
NVDYSAFNEVHWVAPAEA

SEQ ID NO: 773134 - protein, 19 aa, Mycobacterium
NVEDFKFFWVTGLTADGKI

SEQ ID NO: 773135 - protein, 26 aa, Mycobacterium
NVEFRLRAGLIHDWFTFPFLPDAHED

SEQ ID NO: 773136 - protein, 20 aa, Mycobacterium
NVFGRRAGIAAADFADVHDF

SEQ ID NO: 773137 - protein, 24 aa, Mycobacterium
NVFGRRAGIAAARYARGHDFVDMP

SEQ ID NO: 773138 - protein, 17 aa, Mycobacterium
NVGCLPTKMFVYAADVA

SEQ ID NO: 773139 - protein, 17 aa, Mycobacterium
NVGCLPTKMFVYAAEVA

SEQ ID NO: 773140 - protein, 18 aa, Mycobacterium
NVKKAGFLPQERQWLTEV

SEQ ID NO: 773141 - protein, 17 aa, Mycobacterium
NVKKSGFLPEERAWVSG

SEQ ID NO: 773142 - protein, 26 aa, Mycobacterium
NVKMPSQRGWRHWLYVMTRINLGLSP

SEQ ID NO: 773143 - protein, 17 aa, Mycobacterium
NVKRIGPAWVFQAGASG

SEQ ID NO: 773144 - protein, 17 aa, Mycobacterium
NVLGFRFWWELDPPDGP

SEQ ID NO: 773145 - protein, 25 aa, Mycobacterium
NVLKIRPPLVFSMADVDWFCTEFAG

SEQ ID NO: 773146 - protein, 24 aa, Mycobacterium
NVLKIRPPLVFSRSDVDWFCTELD

SEQ ID NO: 773147 - protein, 20 aa, Mycobacterium
NVPEVFVVYWAALRSGLYIT

SEQ ID NO: 773148 - protein, 19 aa, Mycobacterium
NVPGFPNLFLLAGPGSGTN

SEQ ID NO: 773149 - protein, 21 aa, Mycobacterium
NVRARVALCGLISGYNSADPP

SEQ ID NO: 773150 - protein, 19 aa, Mycobacterium
NVSHEFRTPLTLLLGPLDD

SEQ ID NO: 773151 - protein, 19 aa, Mycobacterium
NVSHEFRTPLTLLLGPVED

SEQ ID NO: 773152 - protein, 23 aa, Mycobacterium
NVSLPVFVARAFGGIIEDVDGNR

SEQ ID NO: 773153 - protein, 17 aa, Mycobacterium
NVSTCLRGDFSGAHLTG

SEQ ID NO: 773154 - protein, 18 aa, Mycobacterium
NVTYRLGVFGGFELGDLA

SEQ ID NO: 773155 - protein, 22 aa, Mycobacterium
NVVCSVGLWARYRKLAVTARAL

SEQ ID NO: 773156 - protein, 17 aa, Mycobacterium
NVWAYAVIVCGHFADGA

SEQ ID NO: 773157 - protein, 24 aa, Mycobacterium
NVWPREVPELAPLVEEYTAQMRRV

SEQ ID NO: 773158 - protein, 17 aa, Mycobacterium
NVYRVVTNLGVFDFNGP

SEQ ID NO: 773159 - protein, 18 aa, Mycobacterium
NWDCPKLRVGAGSFITPV

SEQ ID NO: 773160 - protein, 22 aa, Mycobacterium
NWDYRYCWLRDASMTASALVAL

SEQ ID NO: 773161 - protein, 19 aa, Mycobacterium
NWFAAYAYWYFKLYGHRDV

SEQ ID NO: 773162 - protein, 19 aa, Mycobacterium
NWFWIKVPVGYLFTIANPR

SEQ ID NO: 773163 - protein, 18 aa, Mycobacterium
NWGGYRIAPEVVEFWQGR

SEQ ID NO: 773164 - protein, 20 aa, Mycobacterium
NWMEFVWKPGYADYYPELPG

SEQ ID NO: 773165 - protein, 18 aa, Mycobacterium
NWPWRRWALSWTANTYAR

SEQ ID NO: 773166 - protein, 19 aa, Mycobacterium
NWPWRRWALSWTANTYARL

SEQ ID NO: 773167 - protein, 25 aa, Mycobacterium
NWSALPLEWPLRGWINGALGVIRPR

SEQ ID NO: 773168 - protein, 19 aa, Mycobacterium
NWWEWRELIGPLAADGYRV

SEQ ID NO: 773169 - protein, 19 aa, Mycobacterium
NWYRCFDRNWELTAETPAP

SEQ ID NO: 773170 - protein, 19 aa, Mycobacterium
NWYTEFARIVPLMEKDTHY

SEQ ID NO: 773171 - protein, 20 aa, Mycobacterium
NWYTEFARLAPLMEKDTHYE

SEQ ID NO: 773172 - protein, 20 aa, Mycobacterium
NWYTEFARLAPLMEKDVHYE

SEQ ID NO: 773173 - protein, 19 aa, Mycobacterium
NYAKSLRMFAVLPTIVATD

SEQ ID NO: 773174 - protein, 18 aa, Mycobacterium
NYEAVVAFSERLAGLLPD

SEQ ID NO: 773175 - protein, 17 aa, Mycobacterium
NYGTLYHALGWTITPTS

SEQ ID NO: 773176 - protein, 18 aa, Mycobacterium
NYVAVPWFWTHQYSAKLQ

SEQ ID NO: 773177 - protein, 21 aa, Mycobacterium
NYWGVRGCDDFLTGMTHVVSP

SEQ ID NO: 773178 - protein, 17 aa, Mycobacterium
PAAAPYRSFVSWLAARD

SEQ ID NO: 773179 - protein, 18 aa, Mycobacterium
PAAAYAFSKLAIALFTRE

SEQ ID NO: 773180 - protein, 18 aa, Mycobacterium
PAAIFALPVCRRPAGDTV

SEQ ID NO: 773181 - protein, 22 aa, Mycobacterium
PAAIRLLGAIGYRVVLLETVGV

SEQ ID NO: 773182 - protein, 17 aa, Mycobacterium
PAAMPGFGWPTAVLSGG

SEQ ID NO: 773183 - protein, 19 aa, Mycobacterium
PAAPSWRKGPRHIAGRGPR

SEQ ID NO: 773184 - protein, 20 aa, Mycobacterium
PAAPSWRKGPRHIAGRGPRD

SEQ ID NO: 773185 - protein, 21 aa, Mycobacterium
PAAPSYRSFVSWLDRQDRSAA

SEQ ID NO: 773186 - protein, 18 aa, Mycobacterium
PAAPSYRSFVTWLSEQDR

SEQ ID NO: 773187 - protein, 18 aa, Mycobacterium
PAAPSYRSFVTWLTNQDR

SEQ ID NO: 773188 - protein, 17 aa, Mycobacterium
PAAPYAKAVREWEQLER

SEQ ID NO: 773189 - protein, 25 aa, Mycobacterium
PAARDLACRWAREWVDRLSALNRPQ

SEQ ID NO: 773190 - protein, 24 aa, Mycobacterium
PAARPRIRLAYRLTPTRVLGEQRV

SEQ ID NO: 773191 - protein, 20 aa, Mycobacterium
PAAVCPHVEWALSSTLGAKA

SEQ ID NO: 773192 - protein, 20 aa, Mycobacterium
PAAVCPHVEWALSSTLGSKA

SEQ ID NO: 773193 - protein, 20 aa, Mycobacterium
PAAVCPHVEWALSSTLHAKA

SEQ ID NO: 773194 - protein, 17 aa, Mycobacterium
PAAVLLHLGPGLGNGLA

SEQ ID NO: 773195 - protein, 20 aa, Mycobacterium
PAAVVPWDFDDDGMPISIQL

SEQ ID NO: 773196 - protein, 18 aa, Mycobacterium
PAAWWHAWAPADWDRLAG

SEQ ID NO: 773197 - protein, 20 aa, Mycobacterium
PACGAGRAALTPGAPSADVS

SEQ ID NO: 773198 - protein, 20 aa, Mycobacterium
PACIKAMIEKVVDRMYAEID

SEQ ID NO: 773199 - protein, 18 aa, Mycobacterium
PACKCKHVYFAHPNEGPC

SEQ ID NO: 773200 - protein, 23 aa, Mycobacterium
PACQAGDYSLCWSFTDGVLSPGI

SEQ ID NO: 773201 - protein, 18 aa, Mycobacterium
PADCLRPLQVHALVSEVL

SEQ ID NO: 773202 - protein, 19 aa, Mycobacterium
PADDVYLVFTTNEEIGGVG

SEQ ID NO: 773203 - protein, 19 aa, Mycobacterium
PADFRLWVCLHEVTHRVQF

SEQ ID NO: 773204 - protein, 21 aa, Mycobacterium
PADLRVCPAHHELSAAARAFK

SEQ ID NO: 773205 - protein, 22 aa, Mycobacterium
PADRLAGLFAEFSRVLADPGWL

SEQ ID NO: 773206 - protein, 19 aa, Mycobacterium
PADVLPLWVAEMDVHLPPT

SEQ ID NO: 773207 - protein, 19 aa, Mycobacterium
PADWEPLGAIAIGYAAEPA

SEQ ID NO: 773208 - protein, 19 aa, Mycobacterium
PAEAIAALLQRYPDAESVK

SEQ ID NO: 773209 - protein, 18 aa, Mycobacterium
PAEAIVVGPLHFEPTDQL

SEQ ID NO: 773210 - protein, 18 aa, Mycobacterium
PAEAVWACRSMAATHYAS

SEQ ID NO: 773211 - protein, 18 aa, Mycobacterium
PAECPGRNLVLFTTSTLA

SEQ ID NO: 773212 - protein, 17 aa, Mycobacterium
PAELALRLIPGYVVTPT

SEQ ID NO: 773213 - protein, 20 aa, Mycobacterium
PAELKANWLPESQYVNVIQY

SEQ ID NO: 773214 - protein, 20 aa, Mycobacterium
PAELRPALQRAFASGLPSVV

SEQ ID NO: 773215 - protein, 19 aa, Mycobacterium
PAENGVVMKTRWEGHTKDG

SEQ ID NO: 773216 - protein, 23 aa, Mycobacterium
PAERAARLWYRRFFADSGAAEGR

SEQ ID NO: 773217 - protein, 19 aa, Mycobacterium
PAGAVWRIGDDVTHRELGH

SEQ ID NO: 773218 - protein, 17 aa, Mycobacterium
PAGELLPLMSLPAQMQQ

SEQ ID NO: 773219 - protein, 18 aa, Mycobacterium
PAGEQRLVVELARGSGAR

SEQ ID NO: 773220 - protein, 18 aa, Mycobacterium
PAGGLSWGQVVAGEDALG

SEQ ID NO: 773221 - protein, 18 aa, Mycobacterium
PAGLGVFVGVPTFGDGGG

SEQ ID NO: 773222 - protein, 19 aa, Mycobacterium
PAGLLSFFLSNPVYALSLV

SEQ ID NO: 773223 - protein, 18 aa, Mycobacterium
PAGRIGALAAEFTLDLNP

SEQ ID NO: 773224 - protein, 18 aa, Mycobacterium
PAGRLWANPDCGLKTRNV

SEQ ID NO: 773225 - protein, 20 aa, Mycobacterium
PAGSAIAVVARRAGSGPGVT

SEQ ID NO: 773226 - protein, 18 aa, Mycobacterium
PAGSMPVGLAPMLPTTGS

SEQ ID NO: 773227 - protein, 17 aa, Mycobacterium
PAGSVLIEFGHTKVMCT

SEQ ID NO: 773228 - protein, 18 aa, Mycobacterium
PAHDAARYDQVWKEHVLP

SEQ ID NO: 773229 - protein, 20 aa, Mycobacterium
PAISAFNAWVLLKGLETLAV

SEQ ID NO: 773230 - protein, 18 aa, Mycobacterium
PAISLPLHWTADGLPLGV

SEQ ID NO: 773231 - protein, 18 aa, Mycobacterium
PAKRAGTATALWHLSERL

SEQ ID NO: 773232 - protein, 17 aa, Mycobacterium
PAKRKKPVLKRITESFK

SEQ ID NO: 773233 - protein, 24 aa, Mycobacterium
PALAALCDIFYPRVYLRRGAIVPA

SEQ ID NO: 773234 - protein, 19 aa, Mycobacterium
PALCRAVGRPEWRDDPRFA

SEQ ID NO: 773235 - protein, 17 aa, Mycobacterium
PALESALAILRDITSGP

SEQ ID NO: 773236 - protein, 17 aa, Mycobacterium
PALFEAISLSYLGPLGL

SEQ ID NO: 773237 - protein, 21 aa, Mycobacterium
PALKEIDGWLGLSLLVDRQSG

SEQ ID NO: 773238 - protein, 19 aa, Mycobacterium
PALLRKQLKGAPMPAPKAI

SEQ ID NO: 773239 - protein, 22 aa, Mycobacterium
PALPAARIEFMLSDTAPVAALT

SEQ ID NO: 773240 - protein, 22 aa, Mycobacterium
PALPAARIEFMLSDTAPVAAVS

SEQ ID NO: 773241 - protein, 18 aa, Mycobacterium
PALPAARMEFMLTDAAPI

SEQ ID NO: 773242 - protein, 27 aa, Mycobacterium
PALPLGWADVWMGCQFPSKIVADYADR

SEQ ID NO: 773243 - protein, 24 aa, Mycobacterium
PALPRLMRRLVIMGGAFDYKGNTT

SEQ ID NO: 773244 - protein, 22 aa, Mycobacterium
PALRFELCLGVSGVHYPDDTGR

SEQ ID NO: 773245 - protein, 19 aa, Mycobacterium
PALRRAHGQVVFINSGSGR

SEQ ID NO: 773246 - protein, 18 aa, Mycobacterium
PALRRARGQVIFINSGAG

SEQ ID NO: 773247 - protein, 17 aa, Mycobacterium
PALVAWKLGCSSANAHT

SEQ ID NO: 773248 - protein, 17 aa, Mycobacterium
PALVAWKLGCSSGNAHT

SEQ ID NO: 773249 - protein, 17 aa, Mycobacterium
PALVCLLRSLTLRMTTA

SEQ ID NO: 773250 - protein, 21 aa, Mycobacterium
PALVGHGGWERLQRFAVITQF

SEQ ID NO: 773251 - protein, 17 aa, Mycobacterium
PALVGMPKWYAENGQYL

SEQ ID NO: 773252 - protein, 19 aa, Mycobacterium
PAMAQRTLWAPYWQLLMNA

SEQ ID NO: 773253 - protein, 17 aa, Mycobacterium
PAMAWRYLQLDADDTDP

SEQ ID NO: 773254 - protein, 18 aa, Mycobacterium
PAMIDWLLDQHLRFRRAI

SEQ ID NO: 773255 - protein, 18 aa, Mycobacterium
PAMIRAGGKMWGADGRQK

SEQ ID NO: 773256 - protein, 20 aa, Mycobacterium
PAMSAFNAWVLLKGLETLAV

SEQ ID NO: 773257 - protein, 21 aa, Mycobacterium
PAMSAFNAWVLLKGLETMAIR

SEQ ID NO: 773258 - protein, 18 aa, Mycobacterium
PANIDFAKSLGFKPEVGI

SEQ ID NO: 773259 - protein, 19 aa, Mycobacterium
PANIGLAVADAVNFPAELQ

SEQ ID NO: 773260 - protein, 25 aa, Mycobacterium
PANWLLAARCARGFLSMSSEKPDPA

SEQ ID NO: 773261 - protein, 25 aa, Mycobacterium
PANWWLAARCVRGFLSMSSGKPDPA

SEQ ID NO: 773262 - protein, 18 aa, Mycobacterium
PAPEFETWLRKVGMVDDA

SEQ ID NO: 773263 - protein, 17 aa, Mycobacterium
PAPFFAQRKIFITGANG

SEQ ID NO: 773264 - protein, 17 aa, Mycobacterium
PAPHCRTPIDAYSLTVE

SEQ ID NO: 773265 - protein, 18 aa, Mycobacterium
PAPIRLSPPIGIKGVTYA

SEQ ID NO: 773266 - protein, 19 aa, Mycobacterium
PAPLLRWGINQFDLDQRPT

SEQ ID NO: 773267 - protein, 19 aa, Mycobacterium
PAPPGLRANMIFSADGAAA

SEQ ID NO: 773268 - protein, 19 aa, Mycobacterium
PAPSAGWRKTVYRASFGTI

SEQ ID NO: 773269 - protein, 19 aa, Mycobacterium
PAPTLPMLLPLKDIGVPQP

SEQ ID NO: 773270 - protein, 18 aa, Mycobacterium
PAPVAYRRFVTWLSGQDN

SEQ ID NO: 773271 - protein, 19 aa, Mycobacterium
PAPVPGFRGTRSFGTEEFD

SEQ ID NO: 773272 - protein, 21 aa, Mycobacterium
PAPVPGYRGSRSFGFEEFDPF

SEQ ID NO: 773273 - protein, 21 aa, Mycobacterium
PAPVPGYRGSRSFGLEEFDPF

SEQ ID NO: 773274 - protein, 19 aa, Mycobacterium
PAQLIPTFQWERMLDQDAK

SEQ ID NO: 773275 - protein, 17 aa, Mycobacterium
PAQMAAFLGVLLSGATV

SEQ ID NO: 773276 - protein, 20 aa, Mycobacterium
PAQQRPLLHPSLEDEDAHYE

SEQ ID NO: 773277 - protein, 18 aa, Mycobacterium
PAQRWGVATGHERILLCG

SEQ ID NO: 773278 - protein, 26 aa, Mycobacterium
PAQSRASGVLPRYGVRLTVMAHPPAA

SEQ ID NO: 773279 - protein, 24 aa, Mycobacterium
PARLLVPHLYFWKSAKWVRSIELC

SEQ ID NO: 773280 - protein, 19 aa, Mycobacterium
PARWARWAAPCPIGDAEIR

SEQ ID NO: 773281 - protein, 19 aa, Mycobacterium
PASALLFFLASSRILNRRK

SEQ ID NO: 773282 - protein, 22 aa, Mycobacterium
PASARGSLRLSLGHTSTEADIE

SEQ ID NO: 773283 - protein, 20 aa, Mycobacterium
PASARGSLRLSLGHTSVDAD

SEQ ID NO: 773284 - protein, 20 aa, Mycobacterium
PASARGSLRLSLGHTTVEAD

SEQ ID NO: 773285 - protein, 18 aa, Mycobacterium
PASGRGPVASAISAGSSA

SEQ ID NO: 773286 - protein, 20 aa, Mycobacterium
PASNAAVCWAARDAALRHVP

SEQ ID NO: 773287 - protein, 20 aa, Mycobacterium
PASNAAVCWAARDAAMRNVQ

SEQ ID NO: 773288 - protein, 24 aa, Mycobacterium
PASRPRIRLAYRLTPRRVLGPQRA

SEQ ID NO: 773289 - protein, 20 aa, Mycobacterium
PASYWRRWSICKSVVLRVEL

SEQ ID NO: 773290 - protein, 20 aa, Mycobacterium
PATARLTGRWMRGRLPTVSD

SEQ ID NO: 773291 - protein, 22 aa, Mycobacterium
PATFGFNWQQSPGFFNSSDTPS

SEQ ID NO: 773292 - protein, 18 aa, Mycobacterium
PATGSFSGTGTWLPLLRS

SEQ ID NO: 773293 - protein, 18 aa, Mycobacterium
PATPIIRWLEGVDGPVEE

SEQ ID NO: 773294 - protein, 30 aa, Mycobacterium
PATPWLATTVRLAWRAKLMISASVDARIRL

SEQ ID NO: 773295 - protein, 19 aa, Mycobacterium
PATVVDWGLWKSWADAQPQ

SEQ ID NO: 773296 - protein, 20 aa, Mycobacterium
PATVVEFGMSFGISAVHLAA

SEQ ID NO: 773297 - protein, 18 aa, Mycobacterium
PATYFAGGKIQWILENVP

SEQ ID NO: 773298 - protein, 26 aa, Mycobacterium
PAVMTAYRIGFRFIWEQTLAAARASG

SEQ ID NO: 773299 - protein, 17 aa, Mycobacterium
PAVPCARAARRPHPVHR

SEQ ID NO: 773300 - protein, 20 aa, Mycobacterium
PAVRFVCSWATTDQEVDDVL

SEQ ID NO: 773301 - protein, 17 aa, Mycobacterium
PAVRMGWVSSELAMFRG

SEQ ID NO: 773302 - protein, 17 aa, Mycobacterium
PAVRVGRSFRVHAKAVH

SEQ ID NO: 773303 - protein, 18 aa, Mycobacterium
PAVVYCHAGGFALGNLDT

SEQ ID NO: 773304 - protein, 22 aa, Mycobacterium
PAWDAVCFRLGLLSTLEARAVL

SEQ ID NO: 773305 - protein, 21 aa, Mycobacterium
PAYRWPLVPALALVAAMPALG

SEQ ID NO: 773306 - protein, 20 aa, Mycobacterium
PCALLSCAIPTGYGSAANRA

SEQ ID NO: 773307 - protein, 18 aa, Mycobacterium
PCAWSAEGLLRYLPATAQ

SEQ ID NO: 773308 - protein, 17 aa, Mycobacterium
PCFRELYSELGLEQTDI

SEQ ID NO: 773309 - protein, 19 aa, Mycobacterium
PCGISAFGVLEQFVEQLLA

SEQ ID NO: 773310 - protein, 18 aa, Mycobacterium
PCGNCDRCRDDSRPTSSG

SEQ ID NO: 773311 - protein, 22 aa, Mycobacterium
PCGVCDSCQALAPNAPGSIDVV

SEQ ID NO: 773312 - protein, 18 aa, Mycobacterium
PCLAAAWEHHIMQITDLS

SEQ ID NO: 773313 - protein, 20 aa, Mycobacterium
PCLECKLCVAVCPVGAIGKN

SEQ ID NO: 773314 - protein, 18 aa, Mycobacterium
PCLPCGVHMYLGGGKTLD

SEQ ID NO: 773315 - protein, 17 aa, Mycobacterium
PCLPCGVHMYLGKGKTL

SEQ ID NO: 773316 - protein, 18 aa, Mycobacterium
PCLPCGVHMYLGKGKTLE

SEQ ID NO: 773317 - protein, 22 aa, Mycobacterium
PCLQSRIAAAWLWSRGSATVGG

SEQ ID NO: 773318 - protein, 22 aa, Mycobacterium
PCSMKPRSDLVLQIAGTSDIAK

SEQ ID NO: 773319 - protein, 17 aa, Mycobacterium
PCWKVHLDTGLASDDTP

SEQ ID NO: 773320 - protein, 17 aa, Mycobacterium
PDAAPGILIPFFASHTQ

SEQ ID NO: 773321 - protein, 22 aa, Mycobacterium
PDADRAAAFYGHVLGWTYDPAT

SEQ ID NO: 773322 - protein, 17 aa, Mycobacterium
PDAGLVLREVGLEVLGS

SEQ ID NO: 773323 - protein, 18 aa, Mycobacterium
PDAGLVLREVGLEVMGSA

SEQ ID NO: 773324 - protein, 18 aa, Mycobacterium
PDAIPVLFGHIGEGNLHL

SEQ ID NO: 773325 - protein, 18 aa, Mycobacterium
PDAISLVLSHRAPHRVVV

SEQ ID NO: 773326 - protein, 17 aa, Mycobacterium
PDALARFPITRLVSSPQ

SEQ ID NO: 773327 - protein, 20 aa, Mycobacterium
PDALDVWPAYALKIAPTPTL

SEQ ID NO: 773328 - protein, 18 aa, Mycobacterium
PDALIGFLGPRVYEHLYG

SEQ ID NO: 773329 - protein, 22 aa, Mycobacterium
PDARGLGVLVCFAGTVRAPLGL

SEQ ID NO: 773330 - protein, 20 aa, Mycobacterium
PDAYCTTVFLAILDTESGIL

SEQ ID NO: 773331 - protein, 17 aa, Mycobacterium
PDCARGRLCSGCGRGRI

SEQ ID NO: 773332 - protein, 19 aa, Mycobacterium
PDCCAVVAYGALLREELLA

SEQ ID NO: 773333 - protein, 17 aa, Mycobacterium
PDCGVALEDAEPGHHHE

SEQ ID NO: 773334 - protein, 18 aa, Mycobacterium
PDCTRVVNEWVIERNRNY

SEQ ID NO: 773335 - protein, 17 aa, Mycobacterium
PDDAWLASWSRAEAAVP

SEQ ID NO: 773336 - protein, 18 aa, Mycobacterium
PDDEFAFVVHGTMADPRW

SEQ ID NO: 773337 - protein, 18 aa, Mycobacterium
PDEAWLRRELDAERRHCF

SEQ ID NO: 773338 - protein, 22 aa, Mycobacterium
PDEEKLAWARRVLVAARTERGV

SEQ ID NO: 773339 - protein, 20 aa, Mycobacterium
PDEFRIQLAWLRQSPPDSAN

SEQ ID NO: 773340 - protein, 21 aa, Mycobacterium
PDEIASAIAFLLSDEASFVTA

SEQ ID NO: 773341 - protein, 20 aa, Mycobacterium
PDELRRHIGYVIQGAGLFPH

SEQ ID NO: 773342 - protein, 18 aa, Mycobacterium
PDELRRHIGYVVQGAGLF

SEQ ID NO: 773343 - protein, 26 aa, Mycobacterium
PDELRRWIPLLSRFRVVSVRGPRSAQ

SEQ ID NO: 773344 - protein, 21 aa, Mycobacterium
PDELRTLFLFEALTEAQLAVL

SEQ ID NO: 773345 - protein, 23 aa, Mycobacterium
PDEPRPGFDPCGALADRYKAKAE

SEQ ID NO: 773346 - protein, 21 aa, Mycobacterium
PDEPWMICELDLHQMLHVTAG

SEQ ID NO: 773347 - protein, 19 aa, Mycobacterium
PDERGMRTVMCILNGQLRP

SEQ ID NO: 773348 - protein, 19 aa, Mycobacterium
PDEVPGVLLARGLAEESGK

SEQ ID NO: 773349 - protein, 18 aa, Mycobacterium
PDEVRRHMGLTGQVATVD

SEQ ID NO: 773350 - protein, 17 aa, Mycobacterium
PDFAVGLQPARWGTGFI

SEQ ID NO: 773351 - protein, 20 aa, Mycobacterium
PDFIRLGLMLALERRPAEPR

SEQ ID NO: 773352 - protein, 20 aa, Mycobacterium
PDFIRLGLMLALERRPTEPR

SEQ ID NO: 773353 - protein, 22 aa, Mycobacterium
PDFLSIEIFRPLDLAMVVDPIS

SEQ ID NO: 773354 - protein, 19 aa, Mycobacterium
PDFRVLRKLLAVPLYLDAP

SEQ ID NO: 773355 - protein, 18 aa, Mycobacterium
PDFSELLAGFPSFAGPRV

SEQ ID NO: 773356 - protein, 24 aa, Mycobacterium
PDFVKLAEALGCVGLRCERAEDVE

SEQ ID NO: 773357 - protein, 24 aa, Mycobacterium
PDFVKLAEALGCVGLRCEREEDVA

SEQ ID NO: 773358 - protein, 19 aa, Mycobacterium
PDFVPRVTAILGDLRQLEA

SEQ ID NO: 773359 - protein, 18 aa, Mycobacterium
PDFWQWLIGEVKAADPDV

SEQ ID NO: 773360 - protein, 17 aa, Mycobacterium
PDFWSWLIGQVKTIHPD

SEQ ID NO: 773361 - protein, 19 aa, Mycobacterium
PDGEVWVHCASGYRSSIAA

SEQ ID NO: 773362 - protein, 24 aa, Mycobacterium
PDGISCLRFRLRWKGFRVTVQANH

SEQ ID NO: 773363 - protein, 18 aa, Mycobacterium
PDGKVRWFLGIPYAAPPV

SEQ ID NO: 773364 - protein, 17 aa, Mycobacterium
PDGLPVWIYQFKISTHP

SEQ ID NO: 773365 - protein, 17 aa, Mycobacterium
PDGLPVWIYQFKVSPHR

SEQ ID NO: 773366 - protein, 17 aa, Mycobacterium
PDGPGWRITGQKVWTSY

SEQ ID NO: 773367 - protein, 25 aa, Mycobacterium
PDGRDCPDWVPGELWVGGRGIARGY

SEQ ID NO: 773368 - protein, 17 aa, Mycobacterium
PDGRMIRLDMGWREQQV

SEQ ID NO: 773369 - protein, 21 aa, Mycobacterium
PDGVLRWLALDGQPVHQFTVA

SEQ ID NO: 773370 - protein, 24 aa, Mycobacterium
PDGVLRWLALDGRPIHQFTVAASE

SEQ ID NO: 773371 - protein, 23 aa, Mycobacterium
PDGVPRWLALDGTPLHHATVAAS

SEQ ID NO: 773372 - protein, 18 aa, Mycobacterium
PDGWWKDRGRAMVVLVDR

SEQ ID NO: 773373 - protein, 17 aa, Mycobacterium
PDHGITIGFVFRALTGE

SEQ ID NO: 773374 - protein, 21 aa, Mycobacterium
PDHLRPGSVGQRLPYQQVKIA

SEQ ID NO: 773375 - protein, 17 aa, Mycobacterium
PDHPWAREHRNWFTQLP

SEQ ID NO: 773376 - protein, 25 aa, Mycobacterium
PDIARLKARMGWRMPWFTLTDDFDA

SEQ ID NO: 773377 - protein, 17 aa, Mycobacterium
PDIDLRRTVGWFTTYYP

SEQ ID NO: 773378 - protein, 19 aa, Mycobacterium
PDIDWDKGAALAWIRSLIF

SEQ ID NO: 773379 - protein, 17 aa, Mycobacterium
PDIDWDKGKTLRWVIDH

SEQ ID NO: 773380 - protein, 17 aa, Mycobacterium
PDIPGYAAKVFRAIADA

SEQ ID NO: 773381 - protein, 18 aa, Mycobacterium
PDIRCCILTGAGGYFCAG

SEQ ID NO: 773382 - protein, 23 aa, Mycobacterium
PDKFWAGFCRRMGLAELVADERF

SEQ ID NO: 773383 - protein, 22 aa, Mycobacterium
PDKPWKGGRWVVRTETGSRLPL

SEQ ID NO: 773384 - protein, 24 aa, Mycobacterium
PDKRGLLPFRVWQFYDAMVGFAKS

SEQ ID NO: 773385 - protein, 19 aa, Mycobacterium
PDKYLRIVAAMARENMSVT

SEQ ID NO: 773386 - protein, 17 aa, Mycobacterium
PDLAAGCGFENPTLYRC

SEQ ID NO: 773387 - protein, 18 aa, Mycobacterium
PDLATGLQPMRWGTGYML

SEQ ID NO: 773388 - protein, 22 aa, Mycobacterium
PDLDAATWLHRWHVDHTPVAIE

SEQ ID NO: 773389 - protein, 17 aa, Mycobacterium
PDLDLDRVLTPAGREAA

SEQ ID NO: 773390 - protein, 20 aa, Mycobacterium
PDLDVDLVYRFIRDTTWVSV

SEQ ID NO: 773391 - protein, 22 aa, Mycobacterium
PDLDVDLVYRFIRDTTWVSVRW

SEQ ID NO: 773392 - protein, 18 aa, Mycobacterium
PDLEVCVYAAPTQTVIGG

SEQ ID NO: 773393 - protein, 17 aa, Mycobacterium
PDLFPAWDSLSEAQQKL

SEQ ID NO: 773394 - protein, 19 aa, Mycobacterium
PDLFREWMEAAGIDQLAFD

SEQ ID NO: 773395 - protein, 25 aa, Mycobacterium
PDLGFKRRSCCLFYRVPGGGTCGDC

SEQ ID NO: 773396 - protein, 18 aa, Mycobacterium
PDLGRFGSFGWGVTPQQA

SEQ ID NO: 773397 - protein, 21 aa, Mycobacterium
PDLGRFGVWLGSRSITPGLAR

SEQ ID NO: 773398 - protein, 18 aa, Mycobacterium
PDLIPVFIEEALRTQSPT

SEQ ID NO: 773399 - protein, 17 aa, Mycobacterium
PDLPGLHTGLWAQYLLD

SEQ ID NO: 773400 - protein, 21 aa, Mycobacterium
PDLPLLCAEEVDRACAPWGLM

SEQ ID NO: 773401 - protein, 22 aa, Mycobacterium
PDLPLRFALNLSVFVGVTAEGT

SEQ ID NO: 773402 - protein, 17 aa, Mycobacterium
PDLPPLWQAFGAGRRAD

SEQ ID NO: 773403 - protein, 18 aa, Mycobacterium
PDLPRWALTLGFGSQCVP

SEQ ID NO: 773404 - protein, 18 aa, Mycobacterium
PDLPSWRSAIDVATREWV

SEQ ID NO: 773405 - protein, 19 aa, Mycobacterium
PDLRGRFAVVTGANSGLGF

SEQ ID NO: 773406 - protein, 17 aa, Mycobacterium
PDLRVLVDLGYGNIGVG

SEQ ID NO: 773407 - protein, 20 aa, Mycobacterium
PDLSCPLLGLFGLDDRFPAP

SEQ ID NO: 773408 - protein, 17 aa, Mycobacterium
PDLSVRWLIGVARHKLA

SEQ ID NO: 773409 - protein, 22 aa, Mycobacterium
PDLTSGAFARYLADYIHEQGWQ

SEQ ID NO: 773410 - protein, 17 aa, Mycobacterium
PDLVGALVLFAGLQPSP

SEQ ID NO: 773411 - protein, 17 aa, Mycobacterium
PDLWAAVVLVDITPRME

SEQ ID NO: 773412 - protein, 17 aa, Mycobacterium
PDMATGGMPMRWGTGYM

SEQ ID NO: 773413 - protein, 20 aa, Mycobacterium
PDMFTRLLLSLLITGVAPRS

SEQ ID NO: 773414 - protein, 23 aa, Mycobacterium
PDMKLPIALALGWPDRIAGAAAA

SEQ ID NO: 773415 - protein, 18 aa, Mycobacterium
PDMLSRAAALNWDTNAPA

SEQ ID NO: 773416 - protein, 20 aa, Mycobacterium
PDMTEWWAYLDSVQATYPLS

SEQ ID NO: 773417 - protein, 18 aa, Mycobacterium
PDMWSVLEYGCHVRDVHR

SEQ ID NO: 773418 - protein, 19 aa, Mycobacterium
PDNPWRGSFAQLYLAAVQA

SEQ ID NO: 773419 - protein, 18 aa, Mycobacterium
PDPELVPFVTWTYDDNTT

SEQ ID NO: 773420 - protein, 18 aa, Mycobacterium
PDPFCALEAGWLSHIDHD

SEQ ID NO: 773421 - protein, 22 aa, Mycobacterium
PDPRLDLVRAFSRYFNVDPSYF

SEQ ID NO: 773422 - protein, 20 aa, Mycobacterium
PDPRLTELARMFGSEKIVPA

SEQ ID NO: 773423 - protein, 17 aa, Mycobacterium
PDPVALLRCCGGADLAA

SEQ ID NO: 773424 - protein, 17 aa, Mycobacterium
PDPWPMYRALRDQDPVH

SEQ ID NO: 773425 - protein, 19 aa, Mycobacterium
PDQAAVWGFVRSARAEAPG

SEQ ID NO: 773426 - protein, 19 aa, Mycobacterium
PDQTCLWGFGRAASLEHPQ

SEQ ID NO: 773427 - protein, 17 aa, Mycobacterium
PDQWPALTAPPATAAPA

SEQ ID NO: 773428 - protein, 17 aa, Mycobacterium
PDRAAAIAARLRVGTVN

SEQ ID NO: 773429 - protein, 20 aa, Mycobacterium
PDRACWALQHLLSRRYISKH

SEQ ID NO: 773430 - protein, 17 aa, Mycobacterium
PDRCVAVLAALPAWTGE

SEQ ID NO: 773431 - protein, 19 aa, Mycobacterium
PDRHPHCAWTVVIDESHPA

SEQ ID NO: 773432 - protein, 27 aa, Mycobacterium
PDRITRLIFWSAFVPRPGRSITEEVEQ

SEQ ID NO: 773433 - protein, 23 aa, Mycobacterium
PDRLRSGWLNGIKHWQVDYSGRG

SEQ ID NO: 773434 - protein, 20 aa, Mycobacterium
PDRSGGVLPGYGGSKAALEH

SEQ ID NO: 773435 - protein, 18 aa, Mycobacterium
PDSAAIWPGILGFDDTVL

SEQ ID NO: 773436 - protein, 17 aa, Mycobacterium
PDTALGIRHVAWVKERG

SEQ ID NO: 773437 - protein, 21 aa, Mycobacterium
PDTGSGWVCHAEGTLSTGSVE

SEQ ID NO: 773438 - protein, 18 aa, Mycobacterium
PDTVKLVLLTGRHTIRRH

SEQ ID NO: 773439 - protein, 23 aa, Mycobacterium
PDVAGPYAWWSWRGKAFDNDAGW

SEQ ID NO: 773440 - protein, 18 aa, Mycobacterium
PDVLFVWQVAVARSAQGT

SEQ ID NO: 773441 - protein, 18 aa, Mycobacterium
PDVPKLGSFEVMNRTIDI

SEQ ID NO: 773442 - protein, 29 aa, Mycobacterium
PDVPLLCAEEVDRACAPWGLLAEDHQAAL

SEQ ID NO: 773443 - protein, 21 aa, Mycobacterium
PDVVARLTADWVDRVVAGTGD

SEQ ID NO: 773444 - protein, 19 aa, Mycobacterium
PDVVARLTAEWVDRTVAGA

SEQ ID NO: 773445 - protein, 21 aa, Mycobacterium
PDVVHAYGWLGGLAAQLAARR

SEQ ID NO: 773446 - protein, 19 aa, Mycobacterium
PDVVKAWDLIVKKQAEFEE

SEQ ID NO: 773447 - protein, 22 aa, Mycobacterium
PDVYSNDALICFNSHAFMDDPD

SEQ ID NO: 773448 - protein, 19 aa, Mycobacterium
PDWHGDWSAARGYEIGEKI

SEQ ID NO: 773449 - protein, 20 aa, Mycobacterium
PDWLRWNYATVVWGLATAHE

SEQ ID NO: 773450 - protein, 18 aa, Mycobacterium
PDWVPGEYWVSGRGIARG

SEQ ID NO: 773451 - protein, 17 aa, Mycobacterium
PDWWWPALAFTAVAALD

SEQ ID NO: 773452 - protein, 18 aa, Mycobacterium
PDYHASWDYGGMPVPKDG

SEQ ID NO: 773453 - protein, 22 aa, Mycobacterium
PDYLPGTLLPPGIRATADAAEA

SEQ ID NO: 773454 - protein, 24 aa, Mycobacterium
PDYRGCSSWVRLPVDPRWGEPVHS

SEQ ID NO: 773455 - protein, 25 aa, Mycobacterium
PDYRPAPLPSWPTRLGWAVRDWPET

SEQ ID NO: 773456 - protein, 19 aa, Mycobacterium
PEAAEQWRALALVTTTADL

SEQ ID NO: 773457 - protein, 18 aa, Mycobacterium
PEAFKWIQRAAMDRRTTM

SEQ ID NO: 773458 - protein, 20 aa, Mycobacterium
PEAFTALAARFLGPTLDGVR

SEQ ID NO: 773459 - protein, 22 aa, Mycobacterium
PEAGLKIARRFAHLTYRGETEL

SEQ ID NO: 773460 - protein, 18 aa, Mycobacterium
PEAGPWLRRAEARAEANG

SEQ ID NO: 773461 - protein, 18 aa, Mycobacterium
PEAIAITCGERSWSYGEL

SEQ ID NO: 773462 - protein, 24 aa, Mycobacterium
PEAITAWIVFCCQALTAGAAEATS

SEQ ID NO: 773463 - protein, 20 aa, Mycobacterium
PEAKRFCWNCGKPVGRSSKG

SEQ ID NO: 773464 - protein, 17 aa, Mycobacterium
PEALAPRYVEAMGGIDR

SEQ ID NO: 773465 - protein, 21 aa, Mycobacterium
PEALSRFPITRVISSPQRRAV

SEQ ID NO: 773466 - protein, 20 aa, Mycobacterium
PEALTGVLYRLADVNVPGAE

SEQ ID NO: 773467 - protein, 18 aa, Mycobacterium
PEAPMALCLHGFPDTAYG

SEQ ID NO: 773468 - protein, 23 aa, Mycobacterium
PEAPWVRPPLRSMKWMETFLDTL

SEQ ID NO: 773469 - protein, 19 aa, Mycobacterium
PEARFLTKVRHSAFYATSL

SEQ ID NO: 773470 - protein, 21 aa, Mycobacterium
PEAYLRAAIAWHFGQDTGSPF

SEQ ID NO: 773471 - protein, 20 aa, Mycobacterium
PECDRRIAGINSFGFGGTNA

SEQ ID NO: 773472 - protein, 20 aa, Mycobacterium
PECVEGWGAPALEKERVKPK

SEQ ID NO: 773473 - protein, 17 aa, Mycobacterium
PEDADRAAIAASIHDVV

SEQ ID NO: 773474 - protein, 24 aa, Mycobacterium
PEDDRGWCFTGWFDTSGSQALLGY

SEQ ID NO: 773475 - protein, 18 aa, Mycobacterium
PEDEFAFVVHGTMADPRW

SEQ ID NO: 773476 - protein, 19 aa, Mycobacterium
PEDLRFLIRLARQQGERLG

SEQ ID NO: 773477 - protein, 18 aa, Mycobacterium
PEDLRPGDLLGVAATGAY

SEQ ID NO: 773478 - protein, 21 aa, Mycobacterium
PEDPEWLLAHLADFGTARCEN

SEQ ID NO: 773479 - protein, 21 aa, Mycobacterium
PEDPEWLLAHLADFGTVRCEN

SEQ ID NO: 773480 - protein, 21 aa, Mycobacterium
PEDRLRPVIVHDAKELVYQTP

SEQ ID NO: 773481 - protein, 20 aa, Mycobacterium
PEDVSAFVLFLASDESSYAT

SEQ ID NO: 773482 - protein, 23 aa, Mycobacterium
PEEAGWRVGDDVVHRELGHGWVQ

SEQ ID NO: 773483 - protein, 19 aa, Mycobacterium
PEEEWGLGIDNIDYFRPTG

SEQ ID NO: 773484 - protein, 17 aa, Mycobacterium
PEEFDWLATRLEIARKL

SEQ ID NO: 773485 - protein, 20 aa, Mycobacterium
PEEFRMAVYYADVEGFPYKE

SEQ ID NO: 773486 - protein, 20 aa, Mycobacterium
PEEIAWRAGFIDDDQLATRA

SEQ ID NO: 773487 - protein, 24 aa, Mycobacterium
PEELRPNDEWVLFGYDPLFQAFRD

SEQ ID NO: 773488 - protein, 17 aa, Mycobacterium
PEEVAARRGLPIEDVAP

SEQ ID NO: 773489 - protein, 17 aa, Mycobacterium
PEFARWLQERGRVRMPD

SEQ ID NO: 773490 - protein, 21 aa, Mycobacterium
PEFIGRLPIVASVTNLDRESL

SEQ ID NO: 773491 - protein, 20 aa, Mycobacterium
PEFIGRLPVVASVTNLDKAS

SEQ ID NO: 773492 - protein, 20 aa, Mycobacterium
PEFIGRLPVVASVTNLDKES

SEQ ID NO: 773493 - protein, 19 aa, Mycobacterium
PEFLERIGIGAPEVEQDMI

SEQ ID NO: 773494 - protein, 17 aa, Mycobacterium
PEFLKISPLGTVGDDGT

SEQ ID NO: 773495 - protein, 17 aa, Mycobacterium
PEFLTAAANDLSGIGDA

SEQ ID NO: 773496 - protein, 21 aa, Mycobacterium
PEFPDTFWVNPFGMNFRHITV

SEQ ID NO: 773497 - protein, 23 aa, Mycobacterium
PEFRKLEWSRLAAGVTRRTVVDS

SEQ ID NO: 773498 - protein, 19 aa, Mycobacterium
PEFRLCDYFDLIGGTSTGS

SEQ ID NO: 773499 - protein, 18 aa, Mycobacterium
PEGFSWLYRFIKAQGERN

SEQ ID NO: 773500 - protein, 22 aa, Mycobacterium
PEGKICHWGGWGGSWETMNPDK

SEQ ID NO: 773501 - protein, 21 aa, Mycobacterium
PEGLLNYLALLGWGIADDHDV

SEQ ID NO: 773502 - protein, 21 aa, Mycobacterium
PEGLLNYLALLGWSIADDRDL

SEQ ID NO: 773503 - protein, 20 aa, Mycobacterium
PEGLMSFRWFLSDDLPERPV

SEQ ID NO: 773504 - protein, 20 aa, Mycobacterium
PEGLSGLIWLNTDDASADRA

SEQ ID NO: 773505 - protein, 19 aa, Mycobacterium
PEGQPALGIGEVDGPYHQA

SEQ ID NO: 773506 - protein, 18 aa, Mycobacterium
PEGSRLAVEQALDSSPMK

SEQ ID NO: 773507 - protein, 19 aa, Mycobacterium
PEGSVLVPFAWQGVTLHAA

SEQ ID NO: 773508 - protein, 17 aa, Mycobacterium
PEGWKLLSECVTSPRAV

SEQ ID NO: 773509 - protein, 18 aa, Mycobacterium
PEGWRFDDLLPYFMRSEA

SEQ ID NO: 773510 - protein, 17 aa, Mycobacterium
PEGYAWDALNGKDLLDR

SEQ ID NO: 773511 - protein, 17 aa, Mycobacterium
PEHLHKVSLSFLVDDLV

SEQ ID NO: 773512 - protein, 18 aa, Mycobacterium
PEHPRFLMCTPLSHAGAA

SEQ ID NO: 773513 - protein, 20 aa, Mycobacterium
PEHYYRALALAVRDRMQDRR

SEQ ID NO: 773514 - protein, 21 aa, Mycobacterium
PEIAQFQWRTKVYWVNGTHSR

SEQ ID NO: 773515 - protein, 22 aa, Mycobacterium
PEIARTLALSGVDLFVVSSANM

SEQ ID NO: 773516 - protein, 18 aa, Mycobacterium
PEIGWAARIGRIPMGYFN

SEQ ID NO: 773517 - protein, 17 aa, Mycobacterium
PEIKLGVLPGMGGSQRL

SEQ ID NO: 773518 - protein, 21 aa, Mycobacterium
PEIPAHIEGTIPLAVPVTMTS

SEQ ID NO: 773519 - protein, 17 aa, Mycobacterium
PEIPINLPLSVPLHIPV

SEQ ID NO: 773520 - protein, 17 aa, Mycobacterium
PEIRAPWSLSKPKRRSS

SEQ ID NO: 773521 - protein, 19 aa, Mycobacterium
PEIVIPFLVPDGAHDYPDD

SEQ ID NO: 773522 - protein, 20 aa, Mycobacterium
PEIWAGVAAPVMIWSIAHAA

SEQ ID NO: 773523 - protein, 25 aa, Mycobacterium
PEIWDEFTERFGIARVCEFYAASEG

SEQ ID NO: 773524 - protein, 26 aa, Mycobacterium
PEIWDEFTKRFGIARVCEFYASSEGN

SEQ ID NO: 773525 - protein, 22 aa, Mycobacterium
PEIYRAPLSYPYRDGLLDKELA

SEQ ID NO: 773526 - protein, 17 aa, Mycobacterium
PEKRTRLGVGHFVETLE

SEQ ID NO: 773527 - protein, 18 aa, Mycobacterium
PELACDAPLLAAVLNGAA

SEQ ID NO: 773528 - protein, 17 aa, Mycobacterium
PELAEWGIPTAEALVEV

SEQ ID NO: 773529 - protein, 17 aa, Mycobacterium
PELEILGNLGLVIGGGF

SEQ ID NO: 773530 - protein, 20 aa, Mycobacterium
PELGGFRWLTVGPPGQEDVS

SEQ ID NO: 773531 - protein, 20 aa, Mycobacterium
PELGRFGVWLGSRSITPELA

SEQ ID NO: 773532 - protein, 21 aa, Mycobacterium
PELGRPSWLTAYGLCEQPKLA

SEQ ID NO: 773533 - protein, 18 aa, Mycobacterium
PELIPKLMSAGVIEVAPL

SEQ ID NO: 773534 - protein, 20 aa, Mycobacterium
PELKGKLDGYALRVPIPTGS

SEQ ID NO: 773535 - protein, 19 aa, Mycobacterium
PELLAAFAAMGTEIFETMF

SEQ ID NO: 773536 - protein, 22 aa, Mycobacterium
PELLKRLKALPGFGEQKAKIFL

SEQ ID NO: 773537 - protein, 19 aa, Mycobacterium
PELLLGGPVMSRLQQVVHR

SEQ ID NO: 773538 - protein, 20 aa, Mycobacterium
PELLRWIPFTKGDYWVLKID

SEQ ID NO: 773539 - protein, 20 aa, Mycobacterium
PELLSGPVVTRFELQVSPER

SEQ ID NO: 773540 - protein, 18 aa, Mycobacterium
PELLSRAAALNWDTTEPA

SEQ ID NO: 773541 - protein, 18 aa, Mycobacterium
PELLVSMFGDIDNFTMVK

SEQ ID NO: 773542 - protein, 20 aa, Mycobacterium
PELNILCGLAIGYSDPEFPA

SEQ ID NO: 773543 - protein, 20 aa, Mycobacterium
PELPGVVVRPLLPLTERRLG

SEQ ID NO: 773544 - protein, 21 aa, Mycobacterium
PELPLRFAVNLSVFVATTPEG

SEQ ID NO: 773545 - protein, 18 aa, Mycobacterium
PELPSILCATDLAPADTA

SEQ ID NO: 773546 - protein, 21 aa, Mycobacterium
PELPTDLVIIGGGFVSAEFAH

SEQ ID NO: 773547 - protein, 21 aa, Mycobacterium
PELRAPLTWEVDEPCPVPQPE

SEQ ID NO: 773548 - protein, 19 aa, Mycobacterium
PELRCLMLTSFTSDEAMLE

SEQ ID NO: 773549 - protein, 17 aa, Mycobacterium
PELRGRLVFAWRATGPM

SEQ ID NO: 773550 - protein, 20 aa, Mycobacterium
PELRLPAAVKQILAGYADRP

SEQ ID NO: 773551 - protein, 18 aa, Mycobacterium
PELRRLRTAVVARATEAG

SEQ ID NO: 773552 - protein, 17 aa, Mycobacterium
PELRRPITDLGMVKSID

SEQ ID NO: 773553 - protein, 17 aa, Mycobacterium
PELRRPITELGMVKGID

SEQ ID NO: 773554 - protein, 17 aa, Mycobacterium
PELRRPITELGMVKSVE

SEQ ID NO: 773555 - protein, 17 aa, Mycobacterium
PELRRPITEVGMVKNVT

SEQ ID NO: 773556 - protein, 17 aa, Mycobacterium
PELRSSAILGVCKNVLR

SEQ ID NO: 773557 - protein, 19 aa, Mycobacterium
PELTGKWLGAFFMGPVNTR

SEQ ID NO: 773558 - protein, 17 aa, Mycobacterium
PELVALLAGRRIAVLTG

SEQ ID NO: 773559 - protein, 22 aa, Mycobacterium
PELVRRLCWDWAPVAAAEITST

SEQ ID NO: 773560 - protein, 17 aa, Mycobacterium
PELWCALVAVVGADPPH

SEQ ID NO: 773561 - protein, 23 aa, Mycobacterium
PEMARAFLTFNGFLLRRGELSPR

SEQ ID NO: 773562 - protein, 19 aa, Mycobacterium
PEMARRALAELGEVEGLTV

SEQ ID NO: 773563 - protein, 21 aa, Mycobacterium
PEMLRRAMLYAIERKRAELIA

SEQ ID NO: 773564 - protein, 17 aa, Mycobacterium
PEMLSFVLANSPLKLDW

SEQ ID NO: 773565 - protein, 24 aa, Mycobacterium
PEMPIGAVLLSWLPLFHDMGLILG

SEQ ID NO: 773566 - protein, 23 aa, Mycobacterium
PEMRDCMRRILKGFVERITHDEA

SEQ ID NO: 773567 - protein, 18 aa, Mycobacterium
PEMTARYAATLAATAEAE

SEQ ID NO: 773568 - protein, 19 aa, Mycobacterium
PENKGPLLINARAEKVTTS

SEQ ID NO: 773569 - protein, 20 aa, Mycobacterium
PENKRALADWSWGRQSIDLL

SEQ ID NO: 773570 - protein, 25 aa, Mycobacterium
PENNIACSRWGMLAPDGLCKTFDAD

SEQ ID NO: 773571 - protein, 20 aa, Mycobacterium
PENPRMAALEGVDLLAVPTA

SEQ ID NO: 773572 - protein, 21 aa, Mycobacterium
PEPAPFVPMVAPWASVPEPVR

SEQ ID NO: 773573 - protein, 18 aa, Mycobacterium
PEPDLAIVGMGRRDVSFD

SEQ ID NO: 773574 - protein, 24 aa, Mycobacterium
PEPEWQAASPLPGWDVKALVAHMI

SEQ ID NO: 773575 - protein, 19 aa, Mycobacterium
PEPHQRWVLEQIVTMADSV

SEQ ID NO: 773576 - protein, 18 aa, Mycobacterium
PEPKGCVFEYVYLARPDS

SEQ ID NO: 773577 - protein, 21 aa, Mycobacterium
PEPKLPVPSGWPFGEEFPRTC

SEQ ID NO: 773578 - protein, 19 aa, Mycobacterium
PEPLRSAALAGRAPAKPVG

SEQ ID NO: 773579 - protein, 24 aa, Mycobacterium
PEPLRWLGVRGLYIAYKLADRHEA

SEQ ID NO: 773580 - protein, 18 aa, Mycobacterium
PEPPRGVFEVGYEIGCGI

SEQ ID NO: 773581 - protein, 23 aa, Mycobacterium
PEPRARLIFNFPKPATLARILRD

SEQ ID NO: 773582 - protein, 22 aa, Mycobacterium
PEPRASAAFTRTLRAVVDWRGQ

SEQ ID NO: 773583 - protein, 20 aa, Mycobacterium
PEPRPGPALGGRSVDEVLAD

SEQ ID NO: 773584 - protein, 20 aa, Mycobacterium
PEPSRWGLPVDRLRYPVFSW

SEQ ID NO: 773585 - protein, 21 aa, Mycobacterium
PEPTFRGAVLVGDEPESRLIL

SEQ ID NO: 773586 - protein, 22 aa, Mycobacterium
PEQKQRWAVPILRAEITASLGM

SEQ ID NO: 773587 - protein, 20 aa, Mycobacterium
PEQLKRLVAQISEKPESVQH

SEQ ID NO: 773588 - protein, 20 aa, Mycobacterium
PEQLKRLVAQISEQPETVQH

SEQ ID NO: 773589 - protein, 22 aa, Mycobacterium
PEQPGLYAARGWSMFPTIDRVY

SEQ ID NO: 773590 - protein, 17 aa, Mycobacterium
PEQQLALLAVRLEMAAV

SEQ ID NO: 773591 - protein, 21 aa, Mycobacterium
PEQRLAFVLHDAFAVPFDQIA

SEQ ID NO: 773592 - protein, 17 aa, Mycobacterium
PEQWSGFGALGEAAPES

SEQ ID NO: 773593 - protein, 17 aa, Mycobacterium
PERAIAALIARYPDAET

SEQ ID NO: 773594 - protein, 19 aa, Mycobacterium
PERASSFIGHMLDLEMLLM

SEQ ID NO: 773595 - protein, 23 aa, Mycobacterium
PEREGRAAFLPPYLISGQGLAVD

SEQ ID NO: 773596 - protein, 21 aa, Mycobacterium
PERGALVAAVWLRPPAGPSVL

SEQ ID NO: 773597 - protein, 19 aa, Mycobacterium
PERGCRGCSMMADHVGNLA

SEQ ID NO: 773598 - protein, 19 aa, Mycobacterium
PERGDMGLIPAMTVKCPVA

SEQ ID NO: 773599 - protein, 18 aa, Mycobacterium
PERGEMGLVPAMTVKCAV

SEQ ID NO: 773600 - protein, 19 aa, Mycobacterium
PERHPARHWRGRFREADVA

SEQ ID NO: 773601 - protein, 21 aa, Mycobacterium
PERIIPCQLPWLLDPDLGARM

SEQ ID NO: 773602 - protein, 19 aa, Mycobacterium
PERIIPCQLPWLLDPSAGA

SEQ ID NO: 773603 - protein, 18 aa, Mycobacterium
PERLEIRAELPLTNIHKV

SEQ ID NO: 773604 - protein, 23 aa, Mycobacterium
PERLRSGWLNGIKHWQVDYHSTA

SEQ ID NO: 773605 - protein, 23 aa, Mycobacterium
PERLRSGWLNGIKHWQVDYSGAT

SEQ ID NO: 773606 - protein, 18 aa, Mycobacterium
PERMSARRFWVRYAAEAS

SEQ ID NO: 773607 - protein, 18 aa, Mycobacterium
PERPRLSVLGGDRPRWQT

SEQ ID NO: 773608 - protein, 20 aa, Mycobacterium
PERPTLVMAHGWPDSHVLWD

SEQ ID NO: 773609 - protein, 17 aa, Mycobacterium
PERRGSFGIPLPGVVQH

SEQ ID NO: 773610 - protein, 17 aa, Mycobacterium
PERTGCIGCAACMTGCK

SEQ ID NO: 773611 - protein, 20 aa, Mycobacterium
PERVRPCFRLLRSLRDQARD

SEQ ID NO: 773612 - protein, 24 aa, Mycobacterium
PERVWGWYLWRHYLVADVAPNPGH

SEQ ID NO: 773613 - protein, 22 aa, Mycobacterium
PERYRFSVTLPRTMPAPGAGIV

SEQ ID NO: 773614 - protein, 22 aa, Mycobacterium
PESFTGLVIRWHAPVIIDGADP

SEQ ID NO: 773615 - protein, 20 aa, Mycobacterium
PESHGRGAVNAGLAITTVTA

SEQ ID NO: 773616 - protein, 22 aa, Mycobacterium
PESMKPFLPRTVREVPLDTSAL

SEQ ID NO: 773617 - protein, 23 aa, Mycobacterium
PESPRELGAWGLTEREARMHESL

SEQ ID NO: 773618 - protein, 18 aa, Mycobacterium
PESVRAAFHYVRSGQTVI

SEQ ID NO: 773619 - protein, 18 aa, Mycobacterium
PESWRLAPVRPRAVTTVN

SEQ ID NO: 773620 - protein, 25 aa, Mycobacterium
PETAFPHWFARNWRRQAILRYGENP

SEQ ID NO: 773621 - protein, 17 aa, Mycobacterium
PETDELWVLGDICSGGV

SEQ ID NO: 773622 - protein, 20 aa, Mycobacterium
PETDFPRWFGRNWRRQAMLR

SEQ ID NO: 773623 - protein, 28 aa, Mycobacterium
PETLADLAFAWRVCRAVKSNAIVIAAGG

SEQ ID NO: 773624 - protein, 17 aa, Mycobacterium
PETLRALGLPAMSPTIG

SEQ ID NO: 773625 - protein, 18 aa, Mycobacterium
PETQIAISAWGLLSPEGR

SEQ ID NO: 773626 - protein, 20 aa, Mycobacterium
PEVADHLAALGFTAAAGDVV

SEQ ID NO: 773627 - protein, 17 aa, Mycobacterium
PEVAFAMVQLGLAFDDM

SEQ ID NO: 773628 - protein, 20 aa, Mycobacterium
PEVARCYSLGGAEIVVYPTA

SEQ ID NO: 773629 - protein, 20 aa, Mycobacterium
PEVFDLRPGAIIRDLDLLRP

SEQ ID NO: 773630 - protein, 20 aa, Mycobacterium
PEVIRRSGVDPADIDDIIFA

SEQ ID NO: 773631 - protein, 22 aa, Mycobacterium
PEVKARFGDRFRLEDSINTYYF

SEQ ID NO: 773632 - protein, 19 aa, Mycobacterium
PEVLAVAGRDLASIGSAIS

SEQ ID NO: 773633 - protein, 20 aa, Mycobacterium
PEVLGTFVFAPSAPIQAVRD

SEQ ID NO: 773634 - protein, 17 aa, Mycobacterium
PEVLRGPLLGALGRSRS

SEQ ID NO: 773635 - protein, 17 aa, Mycobacterium
PEVLRLAFREMHNGRPG

SEQ ID NO: 773636 - protein, 19 aa, Mycobacterium
PEVLRRLKRLPGFGDQKAR

SEQ ID NO: 773637 - protein, 24 aa, Mycobacterium
PEVTELKAAVLALIEGVAPHAVLA

SEQ ID NO: 773638 - protein, 22 aa, Mycobacterium
PEVYRAPLSYPYRDGLIDKELA

SEQ ID NO: 773639 - protein, 20 aa, Mycobacterium
PEWLRWNYATVVWGIATAHE

SEQ ID NO: 773640 - protein, 20 aa, Mycobacterium
PEWLRWNYATVVWGLATAHE

SEQ ID NO: 773641 - protein, 19 aa, Mycobacterium
PEYGATCAIFPIDDITLDY

SEQ ID NO: 773642 - protein, 25 aa, Mycobacterium
PEYSHLTLSWVYDWMAQGVPVVAMH

SEQ ID NO: 773643 - protein, 18 aa, Mycobacterium
PEYWGAVEELGFGQIALL

SEQ ID NO: 773644 - protein, 21 aa, Mycobacterium
PFAEPEILTFGYALEQNTDTV

SEQ ID NO: 773645 - protein, 19 aa, Mycobacterium
PFAKLRVAPTASWMFEYYP

SEQ ID NO: 773646 - protein, 21 aa, Mycobacterium
PFAPRCPLVIDECRSAEPELI

SEQ ID NO: 773647 - protein, 21 aa, Mycobacterium
PFAPRCPLVIDECRSDEPELI

SEQ ID NO: 773648 - protein, 21 aa, Mycobacterium
PFAVLRLQYQVARLPLQLIED

SEQ ID NO: 773649 - protein, 17 aa, Mycobacterium
PFAWPPRTTNTAGLASH

SEQ ID NO: 773650 - protein, 22 aa, Mycobacterium
PFDAVVCSLVLCSVRDPGAVLR

SEQ ID NO: 773651 - protein, 23 aa, Mycobacterium
PFDNWPLGWGFDHYWGFLSGAAG

SEQ ID NO: 773652 - protein, 24 aa, Mycobacterium
PFEHARIRLAYGMRLRRLRRYRNA

SEQ ID NO: 773653 - protein, 19 aa, Mycobacterium
PFERERLWMSPPRSVLDKP

SEQ ID NO: 773654 - protein, 18 aa, Mycobacterium
PFFARAVIDALKIHPNIN

SEQ ID NO: 773655 - protein, 18 aa, Mycobacterium
PFFHDMGLMFGIIMPLLE

SEQ ID NO: 773656 - protein, 24 aa, Mycobacterium
PFFMWYDWMAGGWGGRSTKDGSTA

SEQ ID NO: 773657 - protein, 18 aa, Mycobacterium
PFFNWRAGGLRSDVVHPQ

SEQ ID NO: 773658 - protein, 20 aa, Mycobacterium
PFFPRFCGQMFAHLGDRDLA

SEQ ID NO: 773659 - protein, 21 aa, Mycobacterium
PFGGATIRFPRTAGWGNAMRW

SEQ ID NO: 773660 - protein, 22 aa, Mycobacterium
PFGGRPGFGFGFGSGPVDRRAL

SEQ ID NO: 773661 - protein, 17 aa, Mycobacterium
PFHRFRRIDGAAIDSLL

SEQ ID NO: 773662 - protein, 20 aa, Mycobacterium
PFHWECFSFGIIQNEDHFTF

SEQ ID NO: 773663 - protein, 17 aa, Mycobacterium
PFIGFPIPPMIHGATQA

SEQ ID NO: 773664 - protein, 17 aa, Mycobacterium
PFKAEFFSEPGWEPMGD

SEQ ID NO: 773665 - protein, 19 aa, Mycobacterium
PFKPEMRDLLAGRSDRDHI

SEQ ID NO: 773666 - protein, 17 aa, Mycobacterium
PFLDYAFGFRRGQNAGQ

SEQ ID NO: 773667 - protein, 17 aa, Mycobacterium
PFLERMGLTVGWITEES

SEQ ID NO: 773668 - protein, 27 aa, Mycobacterium
PFLHPELHWDFRLPRVVSINVSGHKYG

SEQ ID NO: 773669 - protein, 17 aa, Mycobacterium
PFLRGCLAGGAPITPEL

SEQ ID NO: 773670 - protein, 26 aa, Mycobacterium
PFLRVNLYGVLHCTRAVLPAMITNTW

SEQ ID NO: 773671 - protein, 24 aa, Mycobacterium
PFNFPAMVPMWFFPIAIAAGNTVV

SEQ ID NO: 773672 - protein, 23 aa, Mycobacterium
PFNFPAMVPMWFFPVAIAAGNTV

SEQ ID NO: 773673 - protein, 24 aa, Mycobacterium
PFNVLRPAWKAMVDQGYGRILNIS

SEQ ID NO: 773674 - protein, 23 aa, Mycobacterium
PFPPEPLASIGIQATRWSLDRAD

SEQ ID NO: 773675 - protein, 23 aa, Mycobacterium
PFPPVELFLQMPWRTEIIEGLLG

SEQ ID NO: 773676 - protein, 18 aa, Mycobacterium
PFRLRVCTRDQFRVRPDR

SEQ ID NO: 773677 - protein, 19 aa, Mycobacterium
PFSEQRGATLIAKEPIGVC

SEQ ID NO: 773678 - protein, 20 aa, Mycobacterium
PFSRIRVLRRLARRPMSVKE

SEQ ID NO: 773679 - protein, 21 aa, Mycobacterium
PFSRRGMFRFGHSRRRESALR

SEQ ID NO: 773680 - protein, 26 aa, Mycobacterium
PFTFRIAQTVGWRLWMGVAFGLTSDP

SEQ ID NO: 773681 - protein, 18 aa, Mycobacterium
PFTHMAFRFNECSTKSVA

SEQ ID NO: 773682 - protein, 17 aa, Mycobacterium
PFTTVGLCCYRDGSDSV

SEQ ID NO: 773683 - protein, 25 aa, Mycobacterium
PFYNFLLTVLFEWGVAVHDTDVESL

SEQ ID NO: 773684 - protein, 20 aa, Mycobacterium
PGAEAFRSWRLLVTRYGTPA

SEQ ID NO: 773685 - protein, 17 aa, Mycobacterium
PGAEAWRAWRYLINNVG

SEQ ID NO: 773686 - protein, 17 aa, Mycobacterium
PGAEGRLKVKPAKPSKL

SEQ ID NO: 773687 - protein, 17 aa, Mycobacterium
PGAHEVRPGLQIVAAPW

SEQ ID NO: 773688 - protein, 18 aa, Mycobacterium
PGAIRRLCCDAGVLTDTE

SEQ ID NO: 773689 - protein, 18 aa, Mycobacterium
PGALHRLGFDYAALAAHN

SEQ ID NO: 773690 - protein, 18 aa, Mycobacterium
PGALIGFLGPRVYEHLYG

SEQ ID NO: 773691 - protein, 22 aa, Mycobacterium
PGAMARLGVWPGVGPQLDLHQP

SEQ ID NO: 773692 - protein, 20 aa, Mycobacterium
PGAMGRLGVWSGQGPQLDLH

SEQ ID NO: 773693 - protein, 18 aa, Mycobacterium
PGAMIGFLGPRVYQALYD

SEQ ID NO: 773694 - protein, 17 aa, Mycobacterium
PGAPAFSVGYVQDAHGL

SEQ ID NO: 773695 - protein, 23 aa, Mycobacterium
PGAPALVCVHGFPTAGVDYHALT

SEQ ID NO: 773696 - protein, 17 aa, Mycobacterium
PGARIWAHGNIAAAQAM

SEQ ID NO: 773697 - protein, 19 aa, Mycobacterium
PGARLAWREDATWAPHGGE

SEQ ID NO: 773698 - protein, 18 aa, Mycobacterium
PGARLAWRENAEWAPHGG

SEQ ID NO: 773699 - protein, 17 aa, Mycobacterium
PGATILLRLDRDVPGDV

SEQ ID NO: 773700 - protein, 17 aa, Mycobacterium
PGAVWKNAGLEWDYYDM

SEQ ID NO: 773701 - protein, 17 aa, Mycobacterium
PGAVWSFSIGWGCDKLI

SEQ ID NO: 773702 - protein, 19 aa, Mycobacterium
PGCGTGWHAIEYARAGCSV

SEQ ID NO: 773703 - protein, 18 aa, Mycobacterium
PGCKVCVRESCAQRAFPY

SEQ ID NO: 773704 - protein, 24 aa, Mycobacterium
PGCPFAPRCPLVIDECRAQEPELL

SEQ ID NO: 773705 - protein, 19 aa, Mycobacterium
PGDEISIADVLRCIDGPLA

SEQ ID NO: 773706 - protein, 18 aa, Mycobacterium
PGDFRVGFNASHMQATLP

SEQ ID NO: 773707 - protein, 20 aa, Mycobacterium
PGDGADECWILVPITAAADG

SEQ ID NO: 773708 - protein, 18 aa, Mycobacterium
PGDGTFRVGVDIKAGTYR

SEQ ID NO: 773709 - protein, 18 aa, Mycobacterium
PGDLLAVACTGAYHHSMA

SEQ ID NO: 773710 - protein, 24 aa, Mycobacterium
PGDWREVMEALLLGAFISDGFVSE

SEQ ID NO: 773711 - protein, 22 aa, Mycobacterium
PGEPLPRWQIALYRRTDGRPLW

SEQ ID NO: 773712 - protein, 22 aa, Mycobacterium
PGEPLPRWQIALYWRTDGLPLW

SEQ ID NO: 773713 - protein, 22 aa, Mycobacterium
PGEPLPRWQIALYWRTDGRPLW

SEQ ID NO: 773714 - protein, 17 aa, Mycobacterium
PGERVALLFPRSAQAIV

SEQ ID NO: 773715 - protein, 19 aa, Mycobacterium
PGERVALLLPRTGEAIAAI

SEQ ID NO: 773716 - protein, 20 aa, Mycobacterium
PGESRFYLSLQDELMRRFNG

SEQ ID NO: 773717 - protein, 18 aa, Mycobacterium
PGEVWSQWHSLVFDVSVW

SEQ ID NO: 773718 - protein, 23 aa, Mycobacterium
PGEWGHVELAWWRQVLAGLPGDI

SEQ ID NO: 773719 - protein, 17 aa, Mycobacterium
PGFRELRTTIGRERGWP

SEQ ID NO: 773720 - protein, 18 aa, Mycobacterium
PGFRGCLTLELVNLGKMP

SEQ ID NO: 773721 - protein, 19 aa, Mycobacterium
PGGEPIPGVSFVFVSNSSP

SEQ ID NO: 773722 - protein, 24 aa, Mycobacterium
PGGERRLNVAVTRARREVVLYASF

SEQ ID NO: 773723 - protein, 23 aa, Mycobacterium
PGGFRYGPAFGVELQFWVFDETV

SEQ ID NO: 773724 - protein, 24 aa, Mycobacterium
PGGGRPRVRLAYRLTPNRVLGEQR

SEQ ID NO: 773725 - protein, 19 aa, Mycobacterium
PGGGWGRPPTPLWPDAVGE

SEQ ID NO: 773726 - protein, 26 aa, Mycobacterium
PGGGYKPEGAWAFAVVQAVVKTIAEW

SEQ ID NO: 773727 - protein, 18 aa, Mycobacterium
PGGIYAPMIHPWSSGRDL

SEQ ID NO: 773728 - protein, 18 aa, Mycobacterium
PGGLFGKAAATLFGESPD

SEQ ID NO: 773729 - protein, 24 aa, Mycobacterium
PGGLGGRGGLLWGDGGKGGDGGAP

SEQ ID NO: 773730 - protein, 20 aa, Mycobacterium
PGGPFLAFGQVYAFSQNMVG

SEQ ID NO: 773731 - protein, 22 aa, Mycobacterium
PGGPFLSFGQAYAWGQNGQGAA

SEQ ID NO: 773732 - protein, 22 aa, Mycobacterium
PGGPFLSFGQAYAWGQNGQSAA

SEQ ID NO: 773733 - protein, 17 aa, Mycobacterium
PGGRLAATVARFNGFAA

SEQ ID NO: 773734 - protein, 19 aa, Mycobacterium
PGGRLGLVWNTRDERLGWV

SEQ ID NO: 773735 - protein, 20 aa, Mycobacterium
PGGSGWRWLASALWAEILLS

SEQ ID NO: 773736 - protein, 17 aa, Mycobacterium
PGGTLGLISWTPEGFIG

SEQ ID NO: 773737 - protein, 24 aa, Mycobacterium
PGGYSFPIVREWLASRVAQIPTYT

SEQ ID NO: 773738 - protein, 24 aa, Mycobacterium
PGHGGNGGNAFLFGDGGTGGQGGT

SEQ ID NO: 773739 - protein, 18 aa, Mycobacterium
PGHLWRWELTPISGTRTL

SEQ ID NO: 773740 - protein, 17 aa, Mycobacterium
PGHPEFRHTAGVEITTG

SEQ ID NO: 773741 - protein, 18 aa, Mycobacterium
PGHPEFRHTPGVEITTGP

SEQ ID NO: 773742 - protein, 17 aa, Mycobacterium
PGHPMLRVDRLYADDEG

SEQ ID NO: 773743 - protein, 24 aa, Mycobacterium
PGHYTLRASVDWQQHKPGASHVVN

SEQ ID NO: 773744 - protein, 20 aa, Mycobacterium
PGIAGPAGWCVYLDNDDRSR

SEQ ID NO: 773745 - protein, 22 aa, Mycobacterium
PGIDLRPFWTLGVAALMRDLAA

SEQ ID NO: 773746 - protein, 17 aa, Mycobacterium
PGIGRAGVVGRLSVPPG

SEQ ID NO: 773747 - protein, 18 aa, Mycobacterium
PGILRTPWYTVISGTGDT

SEQ ID NO: 773748 - protein, 19 aa, Mycobacterium
PGITEAWPWTNRQATEASS

SEQ ID NO: 773749 - protein, 17 aa, Mycobacterium
PGIVDALARLRIDGEPA

SEQ ID NO: 773750 - protein, 18 aa, Mycobacterium
PGIWYAGSHGFDLMAPDG

SEQ ID NO: 773751 - protein, 17 aa, Mycobacterium
PGKGRRILVEFDGRPSA

SEQ ID NO: 773752 - protein, 23 aa, Mycobacterium
PGKHAASAFALWFPIEGGADYGD

SEQ ID NO: 773753 - protein, 24 aa, Mycobacterium
PGKHAASAFAMWFPIEGEQDSHEY

SEQ ID NO: 773754 - protein, 25 aa, Mycobacterium
PGKHAVSAFSLWFPLSEEISGYGAL

SEQ ID NO: 773755 - protein, 18 aa, Mycobacterium
PGKRFWRTGAVSFWVLPP

SEQ ID NO: 773756 - protein, 25 aa, Mycobacterium
PGKRIRAGLGLACFRLQPSAATVSP

SEQ ID NO: 773757 - protein, 23 aa, Mycobacterium
PGKWRVIFFWPKDFTFVCPTEIA

SEQ ID NO: 773758 - protein, 18 aa, Mycobacterium
PGLALRSGPAYTTITATT

SEQ ID NO: 773759 - protein, 22 aa, Mycobacterium
PGLCPDCGIPLATAEPGHGHEK

SEQ ID NO: 773760 - protein, 19 aa, Mycobacterium
PGLDNAFRRRWFGWINPAQ

SEQ ID NO: 773761 - protein, 17 aa, Mycobacterium
PGLHKFRLMELVDVLMA

SEQ ID NO: 773762 - protein, 18 aa, Mycobacterium
PGLLRFTLGLGQTLALIM

SEQ ID NO: 773763 - protein, 22 aa, Mycobacterium
PGLPAGRVEFMLADAAPAAVIV

SEQ ID NO: 773764 - protein, 17 aa, Mycobacterium
PGLPRMINMYGITETTV

SEQ ID NO: 773765 - protein, 24 aa, Mycobacterium
PGLRSRFPFQLEFTSCDTDDLVRI

SEQ ID NO: 773766 - protein, 17 aa, Mycobacterium
PGLTASRFVANPFGGPG

SEQ ID NO: 773767 - protein, 17 aa, Mycobacterium
PGLTLGLGPSHEPIVRN

SEQ ID NO: 773768 - protein, 17 aa, Mycobacterium
PGLTVPWVLSARSERAL

SEQ ID NO: 773769 - protein, 17 aa, Mycobacterium
PGLVRWTSLYDMRFVEG

SEQ ID NO: 773770 - protein, 19 aa, Mycobacterium
PGLWLLASLYFRADVRGLD

SEQ ID NO: 773771 - protein, 20 aa, Mycobacterium
PGMGLSGIWLGAVVADASGQ

SEQ ID NO: 773772 - protein, 17 aa, Mycobacterium
PGMPRMINMYGITETTV

SEQ ID NO: 773773 - protein, 21 aa, Mycobacterium
PGMRPVLCLFEGVATGAADGY

SEQ ID NO: 773774 - protein, 18 aa, Mycobacterium
PGMTLLEVGCGWGLTLQR

SEQ ID NO: 773775 - protein, 18 aa, Mycobacterium
PGMTVAWQLPSHVNAAVV

SEQ ID NO: 773776 - protein, 19 aa, Mycobacterium
PGMVLTVRFDDAGDTETFL

SEQ ID NO: 773777 - protein, 19 aa, Mycobacterium
PGNSVTVGFQAAQDGAYSP

SEQ ID NO: 773778 - protein, 17 aa, Mycobacterium
PGNVWQTIEIPRLIGNL

SEQ ID NO: 773779 - protein, 17 aa, Mycobacterium
PGPCAFPDIVPWPTQAA

SEQ ID NO: 773780 - protein, 23 aa, Mycobacterium
PGPEMIAGILLEFNDRLMERHTL

SEQ ID NO: 773781 - protein, 24 aa, Mycobacterium
PGPGARPSAILAYPLVAACPTITQ

SEQ ID NO: 773782 - protein, 23 aa, Mycobacterium
PGPGESWLRPTVDLVKGEAMTPL

SEQ ID NO: 773783 - protein, 19 aa, Mycobacterium
PGPGGVRWVGVSAGGDDES

SEQ ID NO: 773784 - protein, 18 aa, Mycobacterium
PGPHGSVVPGTWRAQRTT

SEQ ID NO: 773785 - protein, 22 aa, Mycobacterium
PGPIGERADWWWYDPFQPQPPP

SEQ ID NO: 773786 - protein, 18 aa, Mycobacterium
PGPWFQWHFDRWTVPPGA

SEQ ID NO: 773787 - protein, 23 aa, Mycobacterium
PGQDGRDGGLLIGNGGNGAAGDF

SEQ ID NO: 773788 - protein, 20 aa, Mycobacterium
PGQGGNGGNANWFGSGGAGG

SEQ ID NO: 773789 - protein, 18 aa, Mycobacterium
PGQILLPGFVDLHTHLRE

SEQ ID NO: 773790 - protein, 18 aa, Mycobacterium
PGQTCWRTARADKFAPIV

SEQ ID NO: 773791 - protein, 17 aa, Mycobacterium
PGQTLCSTWDLTDWRGK

SEQ ID NO: 773792 - protein, 19 aa, Mycobacterium
PGRADWAVHIALWRRDAGT

SEQ ID NO: 773793 - protein, 19 aa, Mycobacterium
PGREPITGVSFAFVSNSSP

SEQ ID NO: 773794 - protein, 18 aa, Mycobacterium
PGRFAVRTPMQWTSGTNG

SEQ ID NO: 773795 - protein, 20 aa, Mycobacterium
PGRFRLGIGAGHPESAKRYD

SEQ ID NO: 773796 - protein, 18 aa, Mycobacterium
PGRLRAAGFTDIDTDVKR

SEQ ID NO: 773797 - protein, 20 aa, Mycobacterium
PGRLSSKFWKLLGASTERNQ

SEQ ID NO: 773798 - protein, 21 aa, Mycobacterium
PGRLSSRFWKLLGASTEKDRS

SEQ ID NO: 773799 - protein, 20 aa, Mycobacterium
PGRLSSRFWRLLGASTEKNR

SEQ ID NO: 773800 - protein, 21 aa, Mycobacterium
PGRMPSKWGAYIDDMAGFDAE

SEQ ID NO: 773801 - protein, 18 aa, Mycobacterium
PGRMSARRFWVRYAAESA

SEQ ID NO: 773802 - protein, 18 aa, Mycobacterium
PGRQLWWSYYMRLLIYVT

SEQ ID NO: 773803 - protein, 23 aa, Mycobacterium
PGRREGWDYPAMVKEAGTKALED

SEQ ID NO: 773804 - protein, 20 aa, Mycobacterium
PGRRPVFALARFVSGRDIPD

SEQ ID NO: 773805 - protein, 20 aa, Mycobacterium
PGRTVCKWGSFLDNVGDFDP

SEQ ID NO: 773806 - protein, 30 aa, Mycobacterium
PGSAMARATWRMCRDCGYYVPLGGALGVMF

SEQ ID NO: 773807 - protein, 17 aa, Mycobacterium
PGSHFRGDIALLAAEGR

SEQ ID NO: 773808 - protein, 26 aa, Mycobacterium
PGSIFPLPALPPWLATDIDNWNIIMA

SEQ ID NO: 773809 - protein, 20 aa, Mycobacterium
PGSLIWKYWGRLDVSFFGNA

SEQ ID NO: 773810 - protein, 19 aa, Mycobacterium
PGSRLGLLSRNCWQYAVLA

SEQ ID NO: 773811 - protein, 19 aa, Mycobacterium
PGTALWLYAHPLRGSLNDH

SEQ ID NO: 773812 - protein, 18 aa, Mycobacterium
PGTDISIADVLRCIDGPL

SEQ ID NO: 773813 - protein, 21 aa, Mycobacterium
PGTDRCGPWIIERAIRDVRGG

SEQ ID NO: 773814 - protein, 21 aa, Mycobacterium
PGTGGTIGIAGVPGSLPSGST

SEQ ID NO: 773815 - protein, 21 aa, Mycobacterium
PGTLEKWDLGYDVLRQHNKGV

SEQ ID NO: 773816 - protein, 20 aa, Mycobacterium
PGTLEKWNLGYDVLRERNRG

SEQ ID NO: 773817 - protein, 18 aa, Mycobacterium
PGTLERWGLGYDVLAQRN

SEQ ID NO: 773818 - protein, 17 aa, Mycobacterium
PGTRHGYHAITLGWYES

SEQ ID NO: 773819 - protein, 17 aa, Mycobacterium
PGTRLIVAGVCMQPDTV

SEQ ID NO: 773820 - protein, 17 aa, Mycobacterium
PGTRWRFEYSPESYTGT

SEQ ID NO: 773821 - protein, 18 aa, Mycobacterium
PGTSFGRWSRLLDQHART

SEQ ID NO: 773822 - protein, 17 aa, Mycobacterium
PGTSVALLFSRSAQAIV

SEQ ID NO: 773823 - protein, 20 aa, Mycobacterium
PGTVVEFGMSFGISAIHLAA

SEQ ID NO: 773824 - protein, 24 aa, Mycobacterium
PGTWGGAIAPDFRVRFGTAYDIEF

SEQ ID NO: 773825 - protein, 17 aa, Mycobacterium
PGVFVIDMDRILREPTA

SEQ ID NO: 773826 - protein, 29 aa, Mycobacterium
PGVGKVNVKLYWDLKISPITFSDITISGP

SEQ ID NO: 773827 - protein, 18 aa, Mycobacterium
PGVHGFRLLPPRTLRHQM

SEQ ID NO: 773828 - protein, 26 aa, Mycobacterium
PGVLARVAALFSRRGFNIASLAVGPT

SEQ ID NO: 773829 - protein, 25 aa, Mycobacterium
PGVLARVASLFSRRGYNIQSLAVGA

SEQ ID NO: 773830 - protein, 19 aa, Mycobacterium
PGVRGIPFIFVRTDSAGNI

SEQ ID NO: 773831 - protein, 17 aa, Mycobacterium
PGVRLWLYTNFHCNLSC

SEQ ID NO: 773832 - protein, 19 aa, Mycobacterium
PGVVLRLGAAVGDAVTAGT

SEQ ID NO: 773833 - protein, 17 aa, Mycobacterium
PGWACYHTEMWVVEVDG

SEQ ID NO: 773834 - protein, 28 aa, Mycobacterium
PGWAKHAWSCFFAPWIAEATIFVYNYRR

SEQ ID NO: 773835 - protein, 20 aa, Mycobacterium
PGWHWRTWHLYPRNAFGSGG

SEQ ID NO: 773836 - protein, 17 aa, Mycobacterium
PGWTMYMISHFHYDPVW

SEQ ID NO: 773837 - protein, 18 aa, Mycobacterium
PGYQGWQWAVVVAAHAGA

SEQ ID NO: 773838 - protein, 19 aa, Mycobacterium
PGYRGWQWAVVVAACPGAG

SEQ ID NO: 773839 - protein, 17 aa, Mycobacterium
PGYVAAFSVPANQLPQV

SEQ ID NO: 773840 - protein, 17 aa, Mycobacterium
PGYVTALLGDRVGEITT

SEQ ID NO: 773841 - protein, 18 aa, Mycobacterium
PHAKGGGAFGQFEVTHDV

SEQ ID NO: 773842 - protein, 20 aa, Mycobacterium
PHAKGGGAHGHFEVTHDVSK

SEQ ID NO: 773843 - protein, 22 aa, Mycobacterium
PHAKGSGAFGHFEVTGDVSRYT

SEQ ID NO: 773844 - protein, 17 aa, Mycobacterium
PHALKYGVTYNHILGVE

SEQ ID NO: 773845 - protein, 23 aa, Mycobacterium
PHCPRSPVIPGIVWYSAETQPDG

SEQ ID NO: 773846 - protein, 24 aa, Mycobacterium
PHGCYPCAGGAWLAVAVADDSQWR

SEQ ID NO: 773847 - protein, 17 aa, Mycobacterium
PHGLAVMWGMDLINFLG

SEQ ID NO: 773848 - protein, 17 aa, Mycobacterium
PHGLPFTELLALHGVSP

SEQ ID NO: 773849 - protein, 24 aa, Mycobacterium
PHIWRSRGGGFVFFAGARGDASFA

SEQ ID NO: 773850 - protein, 19 aa, Mycobacterium
PHKLVLCARLGPLGAARIT

SEQ ID NO: 773851 - protein, 17 aa, Mycobacterium
PHLAAAWEYDWPAPRWE

SEQ ID NO: 773852 - protein, 18 aa, Mycobacterium
PHLFEFGSLIQALNSERV

SEQ ID NO: 773853 - protein, 20 aa, Mycobacterium
PHLQEFLANWFVSVDHVRTD

SEQ ID NO: 773854 - protein, 26 aa, Mycobacterium
PHNDRLFCIPATIDLAGAEIELVSMV

SEQ ID NO: 773855 - protein, 17 aa, Mycobacterium
PHPAALLSRIGHKHASL

SEQ ID NO: 773856 - protein, 18 aa, Mycobacterium
PHPEEFEALAGRCPVFRF

SEQ ID NO: 773857 - protein, 25 aa, Mycobacterium
PHPRAEVFESLRFVLNGEQIRPLEV

SEQ ID NO: 773858 - protein, 18 aa, Mycobacterium
PHQCYRLGEQLGYTTAVT

SEQ ID NO: 773859 - protein, 19 aa, Mycobacterium
PHRGVDTGGVWVWRDAQAV

SEQ ID NO: 773860 - protein, 18 aa, Mycobacterium
PHRPRVINMYGITETTVH

SEQ ID NO: 773861 - protein, 18 aa, Mycobacterium
PHRYSLPLAEVLAGTLAG

SEQ ID NO: 773862 - protein, 23 aa, Mycobacterium
PHTRASALVAEWPARTDAADPDP

SEQ ID NO: 773863 - protein, 17 aa, Mycobacterium
PHTTLGAAIAWAPAPPD

SEQ ID NO: 773864 - protein, 18 aa, Mycobacterium
PHVWAIGDVASWRDHVGG

SEQ ID NO: 773865 - protein, 18 aa, Mycobacterium
PHVWAIGDVASWRDTVGG

SEQ ID NO: 773866 - protein, 18 aa, Mycobacterium
PHWLFPGMQFMPVAARTQ

SEQ ID NO: 773867 - protein, 20 aa, Mycobacterium
PHYKDLRSFYAYDKDKAGKL

SEQ ID NO: 773868 - protein, 22 aa, Mycobacterium
PIAFTRPVWRVDLFGSTESPPG

SEQ ID NO: 773869 - protein, 18 aa, Mycobacterium
PIAIVGMSCRFPGGVDSP

SEQ ID NO: 773870 - protein, 19 aa, Mycobacterium
PIAIVGMSCRFPGGVDSPE

SEQ ID NO: 773871 - protein, 18 aa, Mycobacterium
PIAVIGIGCRFPGADGPA

SEQ ID NO: 773872 - protein, 18 aa, Mycobacterium
PIAVVGMGCRFPGAVDNP

SEQ ID NO: 773873 - protein, 18 aa, Mycobacterium
PIAVVGMGCRFPGGVDNP

SEQ ID NO: 773874 - protein, 20 aa, Mycobacterium
PICAPDLLLAQALLRTKQIK

SEQ ID NO: 773875 - protein, 19 aa, Mycobacterium
PICCPGCGPTLRYRDRAGR

SEQ ID NO: 773876 - protein, 18 aa, Mycobacterium
PICEFVRATGEIHLNSTW

SEQ ID NO: 773877 - protein, 19 aa, Mycobacterium
PICQMFHTLPIPWVEAEDI

SEQ ID NO: 773878 - protein, 19 aa, Mycobacterium
PIEAFIAVANKYGWEHGCE

SEQ ID NO: 773879 - protein, 17 aa, Mycobacterium
PIEEGWKMSAMLTLGYP

SEQ ID NO: 773880 - protein, 25 aa, Mycobacterium
PIERFLEWWAPFANFLYDTAGLPFF

SEQ ID NO: 773881 - protein, 24 aa, Mycobacterium
PIERTVEFLQWFLGTIPIEPIWLC

SEQ ID NO: 773882 - protein, 17 aa, Mycobacterium
PIEWRYTNDPSWVMRDK

SEQ ID NO: 773883 - protein, 18 aa, Mycobacterium
PIEWRYTNDPSWVMREKG

SEQ ID NO: 773884 - protein, 17 aa, Mycobacterium
PIFAEWEADFGRTFVLS

SEQ ID NO: 773885 - protein, 27 aa, Mycobacterium
PIGAPSFKEALRWGAEVYHSLKSVLKK

SEQ ID NO: 773886 - protein, 26 aa, Mycobacterium
PIGAPSFKESLRWGTEVYHSLKSVLK

SEQ ID NO: 773887 - protein, 19 aa, Mycobacterium
PIGIGDLSYRVVITGDPDL

SEQ ID NO: 773888 - protein, 19 aa, Mycobacterium
PIKLMGIDSVLALYSSLDD

SEQ ID NO: 773889 - protein, 19 aa, Mycobacterium
PIKLMGIDSVLALYSSLDG

SEQ ID NO: 773890 - protein, 17 aa, Mycobacterium
PILDPFDPVTVWGYDEC

SEQ ID NO: 773891 - protein, 24 aa, Mycobacterium
PILGLEFFSSAPFRHGDHVAKYRF

SEQ ID NO: 773892 - protein, 18 aa, Mycobacterium
PILKPGSWIGGDRDGNPN

SEQ ID NO: 773893 - protein, 22 aa, Mycobacterium
PIPGDVCFFGFEPWEIGNPAYG

SEQ ID NO: 773894 - protein, 22 aa, Mycobacterium
PIPRYRLEETLSRYPDDAQYIW

SEQ ID NO: 773895 - protein, 20 aa, Mycobacterium
PIRHWLRSGALLDWAHQTVS

SEQ ID NO: 773896 - protein, 18 aa, Mycobacterium
PIRLPRRIVEPMWAVAEW

SEQ ID NO: 773897 - protein, 24 aa, Mycobacterium
PIRVDWRAGCAFTTPPGMWHAHYN

SEQ ID NO: 773898 - protein, 17 aa, Mycobacterium
PITDLGMVKSIDTEPDG

SEQ ID NO: 773899 - protein, 17 aa, Mycobacterium
PITELGMVKGIDISPQG

SEQ ID NO: 773900 - protein, 19 aa, Mycobacterium
PITFGYRVACWTAPLLRHL

SEQ ID NO: 773901 - protein, 19 aa, Mycobacterium
PIVGVSWWLRERGMPIKTL

SEQ ID NO: 773902 - protein, 21 aa, Mycobacterium
PIWEWDGTDLFGWIATVPTPL

SEQ ID NO: 773903 - protein, 18 aa, Mycobacterium
PKAALLLITRVTFDQTGT

SEQ ID NO: 773904 - protein, 30 aa, Mycobacterium
PKASVMTHLRWLKALAAFGGIGLRLKASDT

SEQ ID NO: 773905 - protein, 29 aa, Mycobacterium
PKASVMTHLRWLKALAAFGGIGLRLKSSD

SEQ ID NO: 773906 - protein, 19 aa, Mycobacterium
PKATWAHKSTEDFEPLTAT
